United States Patent 7,691,997 (FUNCTIONAL AND HYPERFUNCTIONAL SIRNA) - sequence listing, part 13

SEQ ID NO: 500954 - RNA, 19 nt, Homo sapiens
caucaagauuuccaacauu

SEQ ID NO: 500955 - RNA, 19 nt, Homo sapiens
gaaguacaccugccucaug

SEQ ID NO: 500956 - RNA, 19 nt, Homo sapiens
gaagaugcgucaacaagcu

SEQ ID NO: 500957 - RNA, 19 nt, Homo sapiens
ggacgaugcuaauggaaag

SEQ ID NO: 500958 - RNA, 19 nt, Homo sapiens
gaacaucgaggcuacuugu

SEQ ID NO: 500959 - RNA, 19 nt, Homo sapiens
ccagcuacuuuaacuauga

SEQ ID NO: 500960 - RNA, 19 nt, Homo sapiens
ggagacggacccagcauuu

SEQ ID NO: 500961 - RNA, 19 nt, Homo sapiens
uuggauggcuauucuauuu

SEQ ID NO: 500962 - RNA, 19 nt, Homo sapiens
ggauuugccagaucauaua

SEQ ID NO: 500963 - RNA, 19 nt, Homo sapiens
gaugagguguaugaucuaa

SEQ ID NO: 500964 - RNA, 19 nt, Homo sapiens
gaaggcauaccgaggauga

SEQ ID NO: 500965 - RNA, 19 nt, Homo sapiens
ggcagaacuuguaaagaaa

SEQ ID NO: 500966 - RNA, 19 nt, Homo sapiens
caauggugcuuauuucugu

SEQ ID NO: 500967 - RNA, 19 nt, Homo sapiens
ggugcuacuuaacaacuua

SEQ ID NO: 500968 - RNA, 19 nt, Homo sapiens
gugaucagcagaauauuaa

SEQ ID NO: 500969 - RNA, 19 nt, Homo sapiens
aaacaucucucaccugcau

SEQ ID NO: 500970 - RNA, 19 nt, Homo sapiens
gaagagggcaaaugugcaa

SEQ ID NO: 500971 - RNA, 19 nt, Homo sapiens
ggaagaugcugcuuauagc

SEQ ID NO: 500972 - RNA, 19 nt, Homo sapiens
gggaagaugcugcuuauag

SEQ ID NO: 500973 - RNA, 19 nt, Homo sapiens
gagcuagagucaacaccaa

SEQ ID NO: 500974 - RNA, 19 nt, Homo sapiens
gccauggacuugaucuuga

SEQ ID NO: 500975 - RNA, 19 nt, Homo sapiens
acccagauccuacaauuua

SEQ ID NO: 500976 - RNA, 19 nt, Homo sapiens
gcaaaugugcaaaggagaa

SEQ ID NO: 500977 - RNA, 19 nt, Homo sapiens
aaagugaucagcagaauau

SEQ ID NO: 500978 - RNA, 19 nt, Homo sapiens
gucuaaaucuccugccuaa

SEQ ID NO: 500979 - RNA, 19 nt, Homo sapiens
uaacuuugcugucaucaac

SEQ ID NO: 500980 - RNA, 19 nt, Homo sapiens
aagaagaugcagugauuua

SEQ ID NO: 500981 - RNA, 19 nt, Homo sapiens
uaaacaagacguacuagga

SEQ ID NO: 500982 - RNA, 19 nt, Homo sapiens
ccaaaggaugugauauaua

SEQ ID NO: 500983 - RNA, 19 nt, Homo sapiens
ugagguguaugaucuaaug

SEQ ID NO: 500984 - RNA, 19 nt, Homo sapiens
ggagauuguuagcuuagga

SEQ ID NO: 500985 - RNA, 19 nt, Homo sapiens
gucaagagguguacgugaa

SEQ ID NO: 500986 - RNA, 19 nt, Homo sapiens
gcuggccgcuaccuacuaa

SEQ ID NO: 500987 - RNA, 19 nt, Homo sapiens
ggaugcaagucuuaugugu

SEQ ID NO: 500988 - RNA, 19 nt, Homo sapiens
gggccagauuguaagcuua

SEQ ID NO: 500989 - RNA, 19 nt, Homo sapiens
gccaucauuugcccagaua

SEQ ID NO: 500990 - RNA, 19 nt, Homo sapiens
caaccaauauuuccaagcu

SEQ ID NO: 500991 - RNA, 19 nt, Homo sapiens
acaaacccguuaaucacua

SEQ ID NO: 500992 - RNA, 19 nt, Homo sapiens
ccaugaagauacuggagaa

SEQ ID NO: 500993 - RNA, 19 nt, Homo sapiens
ugaauaccacgcuuuauga

SEQ ID NO: 500994 - RNA, 19 nt, Homo sapiens
ggacccagcauuugccauu

SEQ ID NO: 500995 - RNA, 19 nt, Homo sapiens
ggaauggagugaagaucuc

SEQ ID NO: 500996 - RNA, 19 nt, Homo sapiens
ggaaaagcccuucaacauu

SEQ ID NO: 500997 - RNA, 19 nt, Homo sapiens
gaaugcaaccaucucugua

SEQ ID NO: 500998 - RNA, 19 nt, Homo sapiens
auaccacgcuuuaugagaa

SEQ ID NO: 500999 - RNA, 19 nt, Homo sapiens
gcgaaagaccuacgugaau

SEQ ID NO: 501000 - RNA, 19 nt, Homo sapiens
gguguaugaucuaaugaga

SEQ ID NO: 501001 - RNA, 19 nt, Homo sapiens
uaugggagauuguuagcuu

SEQ ID NO: 501002 - RNA, 19 nt, Homo sapiens
gauaguggauuugccagau

SEQ ID NO: 501003 - RNA, 19 nt, Homo sapiens
ggcaugaaguaccugauau

SEQ ID NO: 501004 - RNA, 19 nt, Homo sapiens
gaagaugcagugauuuaca

SEQ ID NO: 501005 - RNA, 19 nt, Homo sapiens
ggacuuugaagccuuaaug

SEQ ID NO: 501006 - RNA, 19 nt, Homo sapiens
cugguaauauugacuugua

SEQ ID NO: 501007 - RNA, 19 nt, Homo sapiens
ggaccaaucaaauccaaga

SEQ ID NO: 501008 - RNA, 19 nt, Homo sapiens
gaagaagaugcagugauuu

SEQ ID NO: 501009 - RNA, 19 nt, Homo sapiens
caagggagauaacgugaac

SEQ ID NO: 501010 - RNA, 19 nt, Homo sapiens
ugaccacucugucuugugu

SEQ ID NO: 501011 - RNA, 19 nt, Homo sapiens
cgggaugacuugugcagaa

SEQ ID NO: 501012 - RNA, 19 nt, Homo sapiens
gaaugaagaccagcacguu

SEQ ID NO: 501013 - RNA, 19 nt, Homo sapiens
ccauacggaucauuucuca

SEQ ID NO: 501014 - RNA, 19 nt, Homo sapiens
aaacaugccucugccaaag

SEQ ID NO: 501015 - RNA, 19 nt, Homo sapiens
ggauggcuauucuauuucu

SEQ ID NO: 501016 - RNA, 19 nt, Homo sapiens
gagaaggcauaccgaggau

SEQ ID NO: 501017 - RNA, 19 nt, Homo sapiens
gcaugaaguaccugauauu

SEQ ID NO: 501018 - RNA, 19 nt, Homo sapiens
gugaauaccacgcuuuaug

SEQ ID NO: 501019 - RNA, 19 nt, Homo sapiens
agauauugguguccuuaaa

SEQ ID NO: 501020 - RNA, 19 nt, Homo sapiens
ggacagagauguuaagcua

SEQ ID NO: 501021 - RNA, 19 nt, Homo sapiens
ggaaauaccugcugucucu

SEQ ID NO: 501022 - RNA, 19 nt, Homo sapiens
gcaauugccugcucucuga

SEQ ID NO: 501023 - RNA, 19 nt, Homo sapiens
gagaggagcuggcccugua

SEQ ID NO: 501024 - RNA, 19 nt, Homo sapiens
gaugauacacucuuucuua

SEQ ID NO: 501025 - RNA, 19 nt, Homo sapiens
gaaauaugauggugagaug

SEQ ID NO: 501026 - RNA, 19 nt, Homo sapiens
acacuacgauggcuuaaua

SEQ ID NO: 501027 - RNA, 19 nt, Homo sapiens
gauggucccugaauacuuu

SEQ ID NO: 501028 - RNA, 19 nt, Homo sapiens
gaagagaggcugaacuuug

SEQ ID NO: 501029 - RNA, 19 nt, Homo sapiens
ggaagcagaugacacaugu

SEQ ID NO: 501030 - RNA, 19 nt, Homo sapiens
cuacagauaucucacauga

SEQ ID NO: 501031 - RNA, 19 nt, Homo sapiens
gaaacccugucucuacuaa

SEQ ID NO: 501032 - RNA, 19 nt, Homo sapiens
uaaugugugucucuucuua

SEQ ID NO: 501033 - RNA, 19 nt, Homo sapiens
gaacugaagagcuaccuaa

SEQ ID NO: 501034 - RNA, 19 nt, Homo sapiens
gaagaaggcauccugaaga

SEQ ID NO: 501035 - RNA, 19 nt, Homo sapiens
gaugggaccuugaaagugu

SEQ ID NO: 501036 - RNA, 19 nt, Homo sapiens
ugaagacacugguagcuuu

SEQ ID NO: 501037 - RNA, 19 nt, Homo sapiens
gcaugcggguugccaguua

SEQ ID NO: 501038 - RNA, 19 nt, Homo sapiens
ccaaaugccuucuuauagu

SEQ ID NO: 501039 - RNA, 19 nt, Homo sapiens
gaacuuggcaggaggagaa

SEQ ID NO: 501040 - RNA, 19 nt, Homo sapiens
gagaauggaccacagguaa

SEQ ID NO: 501041 - RNA, 19 nt, Homo sapiens
gauggauggucccugaaua

SEQ ID NO: 501042 - RNA, 19 nt, Homo sapiens
caacauuaauccuuacuag

SEQ ID NO: 501043 - RNA, 19 nt, Homo sapiens
caggauguauggaauauga

SEQ ID NO: 501044 - RNA, 19 nt, Homo sapiens
gagaagagcagagaaaguu

SEQ ID NO: 501045 - RNA, 19 nt, Homo sapiens
gauauccucuccuugaaga

SEQ ID NO: 501046 - RNA, 19 nt, Homo sapiens
gaccaaagauaaccuacug

SEQ ID NO: 501047 - RNA, 19 nt, Homo sapiens
guacauaggguuucucaga

SEQ ID NO: 501048 - RNA, 19 nt, Homo sapiens
aagagaggcugaacuuuga

SEQ ID NO: 501049 - RNA, 19 nt, Homo sapiens
ccugugagcugcuguaguu

SEQ ID NO: 501050 - RNA, 19 nt, Homo sapiens
ggccauugcugcuuucuug

SEQ ID NO: 501051 - RNA, 19 nt, Homo sapiens
gcauguaucuacccacuca

SEQ ID NO: 501052 - RNA, 19 nt, Homo sapiens
gcagggcaauguguacuuu

SEQ ID NO: 501053 - RNA, 19 nt, Homo sapiens
gauggaaucucugcuuguu

SEQ ID NO: 501054 - RNA, 19 nt, Homo sapiens
gaagacaugugacgcugau

SEQ ID NO: 501055 - RNA, 19 nt, Homo sapiens
ugaaaucugucgugaacuu

SEQ ID NO: 501056 - RNA, 19 nt, Homo sapiens
gcauauacaagcugaguuu

SEQ ID NO: 501057 - RNA, 19 nt, Homo sapiens
aggcugaacuuugauauaa

SEQ ID NO: 501058 - RNA, 19 nt, Homo sapiens
ggaguucuuucuuucuuga

SEQ ID NO: 501059 - RNA, 19 nt, Homo sapiens
gaugacacauguauaccaa

SEQ ID NO: 501060 - RNA, 19 nt, Homo sapiens
ccaagucccugaacugugu

SEQ ID NO: 501061 - RNA, 19 nt, Homo sapiens
gauacacucuuucuuacug

SEQ ID NO: 501062 - RNA, 19 nt, Homo sapiens
gugagaugcugaacaggua

SEQ ID NO: 501063 - RNA, 19 nt, Homo sapiens
ggcaguaucuggaaaucaa

SEQ ID NO: 501064 - RNA, 19 nt, Homo sapiens
agacccaaaugccuucuua

SEQ ID NO: 501065 - RNA, 19 nt, Homo sapiens
gaacaggaggauauucuau

SEQ ID NO: 501066 - RNA, 19 nt, Homo sapiens
caaagauaaccuacugaua

SEQ ID NO: 501067 - RNA, 19 nt, Homo sapiens
acacaaggcagaagacuuu

SEQ ID NO: 501068 - RNA, 19 nt, Homo sapiens
ugacagagauggaggugau

SEQ ID NO: 501069 - RNA, 19 nt, Homo sapiens
ggagaacgcacagcuguuu

SEQ ID NO: 501070 - RNA, 19 nt, Homo sapiens
gcaaugaggauaccugugu

SEQ ID NO: 501071 - RNA, 19 nt, Homo sapiens
gggcucagcauuucucuaa

SEQ ID NO: 501072 - RNA, 19 nt, Homo sapiens
uauggaaccuggccaaaug

SEQ ID NO: 501073 - RNA, 19 nt, Homo sapiens
cauggaugauggaaugaua

SEQ ID NO: 501074 - RNA, 19 nt, Homo sapiens
ucaagaccauccuggcuaa

SEQ ID NO: 501075 - RNA, 19 nt, Homo sapiens
gaugauggaaugauaaaug

SEQ ID NO: 501076 - RNA, 19 nt, Homo sapiens
gagccaacaccacaucuaa

SEQ ID NO: 501077 - RNA, 19 nt, Homo sapiens
acucagaaaucaagcauug

SEQ ID NO: 501078 - RNA, 19 nt, Homo sapiens
uggaagaccuuucaguuca

SEQ ID NO: 501079 - RNA, 19 nt, Homo sapiens
gaggauauucuauguguau

SEQ ID NO: 501080 - RNA, 19 nt, Homo sapiens
ucagauauccucuccuuga

SEQ ID NO: 501081 - RNA, 19 nt, Homo sapiens
aaaggaaucaggagaguuu

SEQ ID NO: 501082 - RNA, 19 nt, Homo sapiens
ggagaagucuguggugagu

SEQ ID NO: 501083 - RNA, 19 nt, Homo sapiens
ggccuugacugcccuagaa

SEQ ID NO: 501084 - RNA, 19 nt, Homo sapiens
gaacagacaacuggaagug

SEQ ID NO: 501085 - RNA, 19 nt, Homo sapiens
gcccaaggauccuggaguu

SEQ ID NO: 501086 - RNA, 19 nt, Homo sapiens
agacuaaggcucaccagua

SEQ ID NO: 501087 - RNA, 19 nt, Homo sapiens
gaacaugugggccaaaugg

SEQ ID NO: 501088 - RNA, 19 nt, Homo sapiens
gggaggaacucauugaaaa

SEQ ID NO: 501089 - RNA, 19 nt, Homo sapiens
gagcagagaaaguuugaga

SEQ ID NO: 501090 - RNA, 19 nt, Homo sapiens
gaagagcagagaaaguuug

SEQ ID NO: 501091 - RNA, 19 nt, Homo sapiens
caaaugccuucuuauaguc

SEQ ID NO: 501092 - RNA, 19 nt, Homo sapiens
gcagaugacacauguauac

SEQ ID NO: 501093 - RNA, 19 nt, Homo sapiens
uggaaucucugcuuguuug

SEQ ID NO: 501094 - RNA, 19 nt, Homo sapiens
cuggaaaucugacuuuguu

SEQ ID NO: 501095 - RNA, 19 nt, Homo sapiens
ugauaaauguggccaaaca

SEQ ID NO: 501096 - RNA, 19 nt, Homo sapiens
aagcauggaugauggaaug

SEQ ID NO: 501097 - RNA, 19 nt, Homo sapiens
ccucgaggcucaacucaga

SEQ ID NO: 501098 - RNA, 19 nt, Homo sapiens
gcaguuuccauucagauuu

SEQ ID NO: 501099 - RNA, 19 nt, Homo sapiens
gacgcaagcugauuuguac

SEQ ID NO: 501100 - RNA, 19 nt, Homo sapiens
ggaggauauucuaugugua

SEQ ID NO: 501101 - RNA, 19 nt, Homo sapiens
ggcaauguguacuuucuga

SEQ ID NO: 501102 - RNA, 19 nt, Homo sapiens
acagagauguuaagcuaug

SEQ ID NO: 501103 - RNA, 19 nt, Homo sapiens
gcucagcucuggaagacau

SEQ ID NO: 501104 - RNA, 19 nt, Homo sapiens
cagacuggaucccaaagaa

SEQ ID NO: 501105 - RNA, 19 nt, Homo sapiens
ggaauaugauccagaagcu

SEQ ID NO: 501106 - RNA, 19 nt, Homo sapiens
gaacuaugcacugcuguug

SEQ ID NO: 501107 - RNA, 19 nt, Homo sapiens
gcugugaaccucucuguga

SEQ ID NO: 501108 - RNA, 19 nt, Homo sapiens
aguaccagcuggcuaagua

SEQ ID NO: 501109 - RNA, 19 nt, Homo sapiens
guuccagagucuacagaua

SEQ ID NO: 501110 - RNA, 19 nt, Homo sapiens
uggagcagcuauacagaaa

SEQ ID NO: 501111 - RNA, 19 nt, Homo sapiens
gaaaucuggagcagcuaua

SEQ ID NO: 501112 - RNA, 19 nt, Homo sapiens
ccacauuggugcucugauc

SEQ ID NO: 501113 - RNA, 19 nt, Homo sapiens
ggacaugagggcccuguga

SEQ ID NO: 501114 - RNA, 19 nt, Homo sapiens
gcaccuggguucccuuucu

SEQ ID NO: 501115 - RNA, 19 nt, Homo sapiens
ggaauugggucuggucucu

SEQ ID NO: 501116 - RNA, 19 nt, Homo sapiens
aaucugacuuuguuucuga

SEQ ID NO: 501117 - RNA, 19 nt, Homo sapiens
gggagaagcugagaguaca

SEQ ID NO: 501118 - RNA, 19 nt, Homo sapiens
aauaacaucuuggccauug

SEQ ID NO: 501119 - RNA, 19 nt, Homo sapiens
ggauugggcuccugauggu

SEQ ID NO: 501120 - RNA, 19 nt, Homo sapiens
gauagaagauaaugacuug

SEQ ID NO: 501121 - RNA, 19 nt, Homo sapiens
uaacaaaccugcccaugug

SEQ ID NO: 501122 - RNA, 19 nt, Homo sapiens
gaaagcagaauaccuguuu

SEQ ID NO: 501123 - RNA, 19 nt, Homo sapiens
ugaauuaugugcuaaguga

SEQ ID NO: 501124 - RNA, 19 nt, Homo sapiens
guaaugauguugaaaugga

SEQ ID NO: 501125 - RNA, 19 nt, Homo sapiens
caagauaaaccuaguggua

SEQ ID NO: 501126 - RNA, 19 nt, Homo sapiens
cagaauaccuguuucaaag

SEQ ID NO: 501127 - RNA, 19 nt, Homo sapiens
gaaaggacaguuaaguauu

SEQ ID NO: 501128 - RNA, 19 nt, Homo sapiens
gaucuggcgugaggaaaua

SEQ ID NO: 501129 - RNA, 19 nt, Homo sapiens
gaagacugauuguguuugu

SEQ ID NO: 501130 - RNA, 19 nt, Homo sapiens
gaagaagacaagaauuuga

SEQ ID NO: 501131 - RNA, 19 nt, Homo sapiens
gggaagaagacaagaauuu

SEQ ID NO: 501132 - RNA, 19 nt, Homo sapiens
guugaacccugccacauuu

SEQ ID NO: 501133 - RNA, 19 nt, Homo sapiens
gaacaauaacuucucaaga

SEQ ID NO: 501134 - RNA, 19 nt, Homo sapiens
ucuaacagcuugccaguug

SEQ ID NO: 501135 - RNA, 19 nt, Homo sapiens
uaaacaaggucauacauac

SEQ ID NO: 501136 - RNA, 19 nt, Homo sapiens
ccucaacccuguaacguaa

SEQ ID NO: 501137 - RNA, 19 nt, Homo sapiens
gcagaauaccuguuucaaa

SEQ ID NO: 501138 - RNA, 19 nt, Homo sapiens
ggagugcaguggcgcaauu

SEQ ID NO: 501139 - RNA, 19 nt, Homo sapiens
caaauucucauaugccuuu

SEQ ID NO: 501140 - RNA, 19 nt, Homo sapiens
aaaggaacaugacaaacuu

SEQ ID NO: 501141 - RNA, 19 nt, Homo sapiens
caaauccuguuccaaugaa

SEQ ID NO: 501142 - RNA, 19 nt, Homo sapiens
gagggaaacuggucuaaaa

SEQ ID NO: 501143 - RNA, 19 nt, Homo sapiens
gaagauaaugacuugguuu

SEQ ID NO: 501144 - RNA, 19 nt, Homo sapiens
ggaagaagacaagaauuug

SEQ ID NO: 501145 - RNA, 19 nt, Homo sapiens
ggcuauagcuguuuguaug

SEQ ID NO: 501146 - RNA, 19 nt, Homo sapiens
gcgcagaggcuauuauuca

SEQ ID NO: 501147 - RNA, 19 nt, Homo sapiens
uuuauaaccugaugccuaa

SEQ ID NO: 501148 - RNA, 19 nt, Homo sapiens
gaaagaaagaagaguagga

SEQ ID NO: 501149 - RNA, 19 nt, Homo sapiens
uaaagaagcagaagaaguc

SEQ ID NO: 501150 - RNA, 19 nt, Homo sapiens
ccuguaacguaacccauua

SEQ ID NO: 501151 - RNA, 19 nt, Homo sapiens
aaacuugugucauugaugu

SEQ ID NO: 501152 - RNA, 19 nt, Homo sapiens
gaagcuaauuuggauacaa

SEQ ID NO: 501153 - RNA, 19 nt, Homo sapiens
ggaaauauggagagggaaa

SEQ ID NO: 501154 - RNA, 19 nt, Homo sapiens
ggacaagaacaauaacuuc

SEQ ID NO: 501155 - RNA, 19 nt, Homo sapiens
gaauaccuguuucaaagag

SEQ ID NO: 501156 - RNA, 19 nt, Homo sapiens
guuccaguguuuaaacuuu

SEQ ID NO: 501157 - RNA, 19 nt, Homo sapiens
caucaaccuuucuaaugaa

SEQ ID NO: 501158 - RNA, 19 nt, Homo sapiens
gguauuaacuaugaucauc

SEQ ID NO: 501159 - RNA, 19 nt, Homo sapiens
ccaaagugcugagauuaca

SEQ ID NO: 501160 - RNA, 19 nt, Homo sapiens
cuaccagaguuaaagcaua

SEQ ID NO: 501161 - RNA, 19 nt, Homo sapiens
ugaaaggacaguuaaguau

SEQ ID NO: 501162 - RNA, 19 nt, Homo sapiens
gacaagaauuugagaucug

SEQ ID NO: 501163 - RNA, 19 nt, Homo sapiens
guugagaacgauauacaua

SEQ ID NO: 501164 - RNA, 19 nt, Homo sapiens
guaguaguccuuugauaga

SEQ ID NO: 501165 - RNA, 19 nt, Homo sapiens
ggaggaccaugaagaaacu

SEQ ID NO: 501166 - RNA, 19 nt, Homo sapiens
ggaaacugaagcuaauuug

SEQ ID NO: 501167 - RNA, 19 nt, Homo sapiens
ggccuuaauauacuacuua

SEQ ID NO: 501168 - RNA, 19 nt, Homo sapiens
uaacaguaguaguccuuug

SEQ ID NO: 501169 - RNA, 19 nt, Homo sapiens
uaccagaguuaaagcauau

SEQ ID NO: 501170 - RNA, 19 nt, Homo sapiens
gaauuacacccuuggaauc

SEQ ID NO: 501171 - RNA, 19 nt, Homo sapiens
gaaacgacgaggagcaguu

SEQ ID NO: 501172 - RNA, 19 nt, Homo sapiens
gaaggcagcggcaaaagua

SEQ ID NO: 501173 - RNA, 19 nt, Homo sapiens
gauccaaauucucauaugc

SEQ ID NO: 501174 - RNA, 19 nt, Homo sapiens
gcccauguguuuccugaau

SEQ ID NO: 501175 - RNA, 19 nt, Homo sapiens
caguaguaguccuuugaua

SEQ ID NO: 501176 - RNA, 19 nt, Homo sapiens
gaaauggaaacugaagcua

SEQ ID NO: 501177 - RNA, 19 nt, Homo sapiens
caacagcgcagaggcuauu

SEQ ID NO: 501178 - RNA, 19 nt, Homo sapiens
ucaaagagucagccgguaa

SEQ ID NO: 501179 - RNA, 19 nt, Homo sapiens
cagcaacaagaccuuaaua

SEQ ID NO: 501180 - RNA, 19 nt, Homo sapiens
ggugacaggaucauacgua

SEQ ID NO: 501181 - RNA, 19 nt, Homo sapiens
ccaaauccuguuccaauga

SEQ ID NO: 501182 - RNA, 19 nt, Homo sapiens
aaacugaagcuaauuugga

SEQ ID NO: 501183 - RNA, 19 nt, Homo sapiens
cguauucuguaaagcuuaa

SEQ ID NO: 501184 - RNA, 19 nt, Homo sapiens
aauggaaacugaagcuaau

SEQ ID NO: 501185 - RNA, 19 nt, Homo sapiens
gaaaauggcaacuuuaaag

SEQ ID NO: 501186 - RNA, 19 nt, Homo sapiens
cuauaagcaugacauacuu

SEQ ID NO: 501187 - RNA, 19 nt, Homo sapiens
cagcgaagacugauugugu

SEQ ID NO: 501188 - RNA, 19 nt, Homo sapiens
guccuuugauagaagauaa

SEQ ID NO: 501189 - RNA, 19 nt, Homo sapiens
agauaaaccuagugguaau

SEQ ID NO: 501190 - RNA, 19 nt, Homo sapiens
gcaguucgaaugccaggaa

SEQ ID NO: 501191 - RNA, 19 nt, Homo sapiens
auaaccugaugccuaaaua

SEQ ID NO: 501192 - RNA, 19 nt, Homo sapiens
gcgaagacugauuguguuu

SEQ ID NO: 501193 - RNA, 19 nt, Homo sapiens
gaacuccucaaaguacaaa

SEQ ID NO: 501194 - RNA, 19 nt, Homo sapiens
aaauggaaacugaagcuaa

SEQ ID NO: 501195 - RNA, 19 nt, Homo sapiens
caaaaggacaagaacaaua

SEQ ID NO: 501196 - RNA, 19 nt, Homo sapiens
uguacagaguaaccuauaa

SEQ ID NO: 501197 - RNA, 19 nt, Homo sapiens
agaagauaaugacuugguu

SEQ ID NO: 501198 - RNA, 19 nt, Homo sapiens
guaguccuuugauagaaga

SEQ ID NO: 501199 - RNA, 19 nt, Homo sapiens
ccucccaggucaagugauu

SEQ ID NO: 501200 - RNA, 19 nt, Homo sapiens
uuaaugaggguuugugcua

SEQ ID NO: 501201 - RNA, 19 nt, Homo sapiens
agacugauuguguuuguaa

SEQ ID NO: 501202 - RNA, 19 nt, Homo sapiens
gaagacaagaauuugagau

SEQ ID NO: 501203 - RNA, 19 nt, Homo sapiens
cgaauuacacccuuggaau

SEQ ID NO: 501204 - RNA, 19 nt, Homo sapiens
cuguaaagcuuaaauuggu

SEQ ID NO: 501205 - RNA, 19 nt, Homo sapiens
ccuaaaacguauucuguaa

SEQ ID NO: 501206 - RNA, 19 nt, Homo sapiens
agacagcgaagacugauug

SEQ ID NO: 501207 - RNA, 19 nt, Homo sapiens
gcagaagagccacugaaag

SEQ ID NO: 501208 - RNA, 19 nt, Homo sapiens
guuuauggccuuaauauac

SEQ ID NO: 501209 - RNA, 19 nt, Homo sapiens
gguuuauggccuuaauaua

SEQ ID NO: 501210 - RNA, 19 nt, Homo sapiens
ggaaacuggucuaaaauac

SEQ ID NO: 501211 - RNA, 19 nt, Homo sapiens
aaagaaagaagaguaggaa

SEQ ID NO: 501212 - RNA, 19 nt, Homo sapiens
gaaacugaagcuaauuugg

SEQ ID NO: 501213 - RNA, 19 nt, Homo sapiens
aagauaaaccuagugguaa

SEQ ID NO: 501214 - RNA, 19 nt, Homo sapiens
ggugauccaaauucucaua

SEQ ID NO: 501215 - RNA, 19 nt, Homo sapiens
ucaguaguuucauguaaag

SEQ ID NO: 501216 - RNA, 19 nt, Homo sapiens
cagaguaaccuauaagcau

SEQ ID NO: 501217 - RNA, 19 nt, Homo sapiens
gcagaggcuauuauucaug

SEQ ID NO: 501218 - RNA, 19 nt, Homo sapiens
uuucugugaccaucaauua

SEQ ID NO: 501219 - RNA, 19 nt, Homo sapiens
aggcauggcuuugggaaga

SEQ ID NO: 501220 - RNA, 19 nt, Homo sapiens
gauagaagauaaugacuug

SEQ ID NO: 501221 - RNA, 19 nt, Homo sapiens
uaacaaaccugcccaugug

SEQ ID NO: 501222 - RNA, 19 nt, Homo sapiens
gaaagcagaauaccuguuu

SEQ ID NO: 501223 - RNA, 19 nt, Homo sapiens
ugaauuaugugcuaaguga

SEQ ID NO: 501224 - RNA, 19 nt, Homo sapiens
guaaugauguugaaaugga

SEQ ID NO: 501225 - RNA, 19 nt, Homo sapiens
caagauaaaccuaguggua

SEQ ID NO: 501226 - RNA, 19 nt, Homo sapiens
cagaauaccuguuucaaag

SEQ ID NO: 501227 - RNA, 19 nt, Homo sapiens
gaaaggacaguuaaguauu

SEQ ID NO: 501228 - RNA, 19 nt, Homo sapiens
gaucuggcgugaggaaaua

SEQ ID NO: 501229 - RNA, 19 nt, Homo sapiens
gaagacugauuguguuugu

SEQ ID NO: 501230 - RNA, 19 nt, Homo sapiens
gaagaagacaagaauuuga

SEQ ID NO: 501231 - RNA, 19 nt, Homo sapiens
gggaagaagacaagaauuu

SEQ ID NO: 501232 - RNA, 19 nt, Homo sapiens
guugaacccugccacauuu

SEQ ID NO: 501233 - RNA, 19 nt, Homo sapiens
gaacaauaacuucucaaga

SEQ ID NO: 501234 - RNA, 19 nt, Homo sapiens
ucuaacagcuugccaguug

SEQ ID NO: 501235 - RNA, 19 nt, Homo sapiens
uaaacaaggucauacauac

SEQ ID NO: 501236 - RNA, 19 nt, Homo sapiens
ccucaacccuguaacguaa

SEQ ID NO: 501237 - RNA, 19 nt, Homo sapiens
gcagaauaccuguuucaaa

SEQ ID NO: 501238 - RNA, 19 nt, Homo sapiens
ggagugcaguggcgcaauu

SEQ ID NO: 501239 - RNA, 19 nt, Homo sapiens
caaauucucauaugccuuu

SEQ ID NO: 501240 - RNA, 19 nt, Homo sapiens
aaaggaacaugacaaacuu

SEQ ID NO: 501241 - RNA, 19 nt, Homo sapiens
caaauccuguuccaaugaa

SEQ ID NO: 501242 - RNA, 19 nt, Homo sapiens
gagggaaacuggucuaaaa

SEQ ID NO: 501243 - RNA, 19 nt, Homo sapiens
gaagauaaugacuugguuu

SEQ ID NO: 501244 - RNA, 19 nt, Homo sapiens
ggaagaagacaagaauuug

SEQ ID NO: 501245 - RNA, 19 nt, Homo sapiens
ggcuauagcuguuuguaug

SEQ ID NO: 501246 - RNA, 19 nt, Homo sapiens
gcgcagaggcuauuauuca

SEQ ID NO: 501247 - RNA, 19 nt, Homo sapiens
uuuauaaccugaugccuaa

SEQ ID NO: 501248 - RNA, 19 nt, Homo sapiens
gaaagaaagaagaguagga

SEQ ID NO: 501249 - RNA, 19 nt, Homo sapiens
uaaagaagcagaagaaguc

SEQ ID NO: 501250 - RNA, 19 nt, Homo sapiens
ccuguaacguaacccauua

SEQ ID NO: 501251 - RNA, 19 nt, Homo sapiens
aaacuugugucauugaugu

SEQ ID NO: 501252 - RNA, 19 nt, Homo sapiens
gaagcuaauuuggauacaa

SEQ ID NO: 501253 - RNA, 19 nt, Homo sapiens
ggaaauauggagagggaaa

SEQ ID NO: 501254 - RNA, 19 nt, Homo sapiens
gguacaguauccuuauuga

SEQ ID NO: 501255 - RNA, 19 nt, Homo sapiens
ggacaagaacaauaacuuc

SEQ ID NO: 501256 - RNA, 19 nt, Homo sapiens
gaauaccuguuucaaagag

SEQ ID NO: 501257 - RNA, 19 nt, Homo sapiens
guuccaguguuuaaacuuu

SEQ ID NO: 501258 - RNA, 19 nt, Homo sapiens
caucaaccuuucuaaugaa

SEQ ID NO: 501259 - RNA, 19 nt, Homo sapiens
gacaaacagucugcgguaa

SEQ ID NO: 501260 - RNA, 19 nt, Homo sapiens
gguauuaacuaugaucauc

SEQ ID NO: 501261 - RNA, 19 nt, Homo sapiens
ccaaagugcugagauuaca

SEQ ID NO: 501262 - RNA, 19 nt, Homo sapiens
cuaccagaguuaaagcaua

SEQ ID NO: 501263 - RNA, 19 nt, Homo sapiens
ugaaaggacaguuaaguau

SEQ ID NO: 501264 - RNA, 19 nt, Homo sapiens
gacaagaauuugagaucug

SEQ ID NO: 501265 - RNA, 19 nt, Homo sapiens
guugagaacgauauacaua

SEQ ID NO: 501266 - RNA, 19 nt, Homo sapiens
guaguaguccuuugauaga

SEQ ID NO: 501267 - RNA, 19 nt, Homo sapiens
ggaggaccaugaagaaacu

SEQ ID NO: 501268 - RNA, 19 nt, Homo sapiens
ggaaacugaagcuaauuug

SEQ ID NO: 501269 - RNA, 19 nt, Homo sapiens
ggccuuaauauacuacuua

SEQ ID NO: 501270 - RNA, 19 nt, Homo sapiens
uaacaguaguaguccuuug

SEQ ID NO: 501271 - RNA, 19 nt, Homo sapiens
uaccagaguuaaagcauau

SEQ ID NO: 501272 - RNA, 19 nt, Homo sapiens
gaauuacacccuuggaauc

SEQ ID NO: 501273 - RNA, 19 nt, Homo sapiens
gaaacgacgaggagcaguu

SEQ ID NO: 501274 - RNA, 19 nt, Homo sapiens
gaaggcagcggcaaaagua

SEQ ID NO: 501275 - RNA, 19 nt, Homo sapiens
gauccaaauucucauaugc

SEQ ID NO: 501276 - RNA, 19 nt, Homo sapiens
gcccauguguuuccugaau

SEQ ID NO: 501277 - RNA, 19 nt, Homo sapiens
caguaguaguccuuugaua

SEQ ID NO: 501278 - RNA, 19 nt, Homo sapiens
gaaauggaaacugaagcua

SEQ ID NO: 501279 - RNA, 19 nt, Homo sapiens
caacagcgcagaggcuauu

SEQ ID NO: 501280 - RNA, 19 nt, Homo sapiens
ucaaagagucagccgguaa

SEQ ID NO: 501281 - RNA, 19 nt, Homo sapiens
cagcaacaagaccuuaaua

SEQ ID NO: 501282 - RNA, 19 nt, Homo sapiens
ggugacaggaucauacgua

SEQ ID NO: 501283 - RNA, 19 nt, Homo sapiens
ccaaauccuguuccaauga

SEQ ID NO: 501284 - RNA, 19 nt, Homo sapiens
aaacugaagcuaauuugga

SEQ ID NO: 501285 - RNA, 19 nt, Homo sapiens
cguauucuguaaagcuuaa

SEQ ID NO: 501286 - RNA, 19 nt, Homo sapiens
aauggaaacugaagcuaau

SEQ ID NO: 501287 - RNA, 19 nt, Homo sapiens
gaaaauggcaacuuuaaag

SEQ ID NO: 501288 - RNA, 19 nt, Homo sapiens
cuauaagcaugacauacuu

SEQ ID NO: 501289 - RNA, 19 nt, Homo sapiens
cagcgaagacugauugugu

SEQ ID NO: 501290 - RNA, 19 nt, Homo sapiens
guccuuugauagaagauaa

SEQ ID NO: 501291 - RNA, 19 nt, Homo sapiens
agauaaaccuagugguaau

SEQ ID NO: 501292 - RNA, 19 nt, Homo sapiens
gcaguucgaaugccaggaa

SEQ ID NO: 501293 - RNA, 19 nt, Homo sapiens
auaaccugaugccuaaaua

SEQ ID NO: 501294 - RNA, 19 nt, Homo sapiens
gcgaagacugauuguguuu

SEQ ID NO: 501295 - RNA, 19 nt, Homo sapiens
gaacuccucaaaguacaaa

SEQ ID NO: 501296 - RNA, 19 nt, Homo sapiens
aaauggaaacugaagcuaa

SEQ ID NO: 501297 - RNA, 19 nt, Homo sapiens
caaaaggacaagaacaaua

SEQ ID NO: 501298 - RNA, 19 nt, Homo sapiens
uguacagaguaaccuauaa

SEQ ID NO: 501299 - RNA, 19 nt, Homo sapiens
agaagauaaugacuugguu

SEQ ID NO: 501300 - RNA, 19 nt, Homo sapiens
guaguccuuugauagaaga

SEQ ID NO: 501301 - RNA, 19 nt, Homo sapiens
ccucccaggucaagugauu

SEQ ID NO: 501302 - RNA, 19 nt, Homo sapiens
uuaaugaggguuugugcua

SEQ ID NO: 501303 - RNA, 19 nt, Homo sapiens
agacugauuguguuuguaa

SEQ ID NO: 501304 - RNA, 19 nt, Homo sapiens
gaagacaagaauuugagau

SEQ ID NO: 501305 - RNA, 19 nt, Homo sapiens
cgaauuacacccuuggaau

SEQ ID NO: 501306 - RNA, 19 nt, Homo sapiens
cuguaaagcuuaaauuggu

SEQ ID NO: 501307 - RNA, 19 nt, Homo sapiens
ccuaaaacguauucuguaa

SEQ ID NO: 501308 - RNA, 19 nt, Homo sapiens
agacagcgaagacugauug

SEQ ID NO: 501309 - RNA, 19 nt, Homo sapiens
gcagaagagccacugaaag

SEQ ID NO: 501310 - RNA, 19 nt, Homo sapiens
guuuauggccuuaauauac

SEQ ID NO: 501311 - RNA, 19 nt, Homo sapiens
gguuuauggccuuaauaua

SEQ ID NO: 501312 - RNA, 19 nt, Homo sapiens
ggaaacuggucuaaaauac

SEQ ID NO: 501313 - RNA, 19 nt, Homo sapiens
aaagaaagaagaguaggaa

SEQ ID NO: 501314 - RNA, 19 nt, Homo sapiens
caaacagucugcgguaacu

SEQ ID NO: 501315 - RNA, 19 nt, Homo sapiens
gaaacugaagcuaauuugg

SEQ ID NO: 501316 - RNA, 19 nt, Homo sapiens
aagauaaaccuagugguaa

SEQ ID NO: 501317 - RNA, 19 nt, Homo sapiens
ggugauccaaauucucaua

SEQ ID NO: 501318 - RNA, 19 nt, Homo sapiens
ucaguaguuucauguaaag

SEQ ID NO: 501319 - RNA, 19 nt, Homo sapiens
cagaguaaccuauaagcau

SEQ ID NO: 501320 - RNA, 19 nt, Homo sapiens
gaaaugaucuccugaauau

SEQ ID NO: 501321 - RNA, 19 nt, Homo sapiens
gaacagcugugaugauuaa

SEQ ID NO: 501322 - RNA, 19 nt, Homo sapiens
ggaagaggaugaacuguuu

SEQ ID NO: 501323 - RNA, 19 nt, Homo sapiens
gaaguggacuguagaagaa

SEQ ID NO: 501324 - RNA, 19 nt, Homo sapiens
caaggaagcugcugucauu

SEQ ID NO: 501325 - RNA, 19 nt, Homo sapiens
gaaauggugaagucuauua

SEQ ID NO: 501326 - RNA, 19 nt, Homo sapiens
gaacuuagucuguuaugaa

SEQ ID NO: 501327 - RNA, 19 nt, Homo sapiens
ggaagcugcugucauuauu

SEQ ID NO: 501328 - RNA, 19 nt, Homo sapiens
ggaaucagcuaucaaugug

SEQ ID NO: 501329 - RNA, 19 nt, Homo sapiens
gaccaguccuuguggaaua

SEQ ID NO: 501330 - RNA, 19 nt, Homo sapiens
gaagacaguacaaccaaua

SEQ ID NO: 501331 - RNA, 19 nt, Homo sapiens
ggagcaugguuccuaauaa

SEQ ID NO: 501332 - RNA, 19 nt, Homo sapiens
caaaggaacuuagucuguu

SEQ ID NO: 501333 - RNA, 19 nt, Homo sapiens
gagcaugguuccuaauaau

SEQ ID NO: 501334 - RNA, 19 nt, Homo sapiens
gaacuuggcccauccuguu

SEQ ID NO: 501335 - RNA, 19 nt, Homo sapiens
aaaggaacuuagucuguua

SEQ ID NO: 501336 - RNA, 19 nt, Homo sapiens
agagaagaaucccaaagua

SEQ ID NO: 501337 - RNA, 19 nt, Homo sapiens
guacagggaaggaagauaa

SEQ ID NO: 501338 - RNA, 19 nt, Homo sapiens
gaacaagcgcaugacaaua

SEQ ID NO: 501339 - RNA, 19 nt, Homo sapiens
cagaauaucauuagcguuu

SEQ ID NO: 501340 - RNA, 19 nt, Homo sapiens
caacauucccuucuccuuu

SEQ ID NO: 501341 - RNA, 19 nt, Homo sapiens
gacaguacaaccaauauaa

SEQ ID NO: 501342 - RNA, 19 nt, Homo sapiens
gauagucugcucuuucuuu

SEQ ID NO: 501343 - RNA, 19 nt, Homo sapiens
gcaaaggaacuuagucugu

SEQ ID NO: 501344 - RNA, 19 nt, Homo sapiens
ccgaacagcugugaugauu

SEQ ID NO: 501345 - RNA, 19 nt, Homo sapiens
aaacugggcugccauuucu

SEQ ID NO: 501346 - RNA, 19 nt, Homo sapiens
ccaauucccuuccuuaugc

SEQ ID NO: 501347 - RNA, 19 nt, Homo sapiens
gcaaaugcaaaggaacuua

SEQ ID NO: 501348 - RNA, 19 nt, Homo sapiens
gcaaugugaguauuauuug

SEQ ID NO: 501349 - RNA, 19 nt, Homo sapiens
gugacuccaugaccuguua

SEQ ID NO: 501350 - RNA, 19 nt, Homo sapiens
ggaacuuagucuguuauga

SEQ ID NO: 501351 - RNA, 19 nt, Homo sapiens
guagaaaacuggucaagga

SEQ ID NO: 501352 - RNA, 19 nt, Homo sapiens
gcugggugcucaaguucua

SEQ ID NO: 501353 - RNA, 19 nt, Homo sapiens
cagaaaagaugaaaacgaa

SEQ ID NO: 501354 - RNA, 19 nt, Homo sapiens
gcaaguggaacagcucuaa

SEQ ID NO: 501355 - RNA, 19 nt, Homo sapiens
gagagaagaaucccaaagu

SEQ ID NO: 501356 - RNA, 19 nt, Homo sapiens
gaagcugcugucauuauuu

SEQ ID NO: 501357 - RNA, 19 nt, Homo sapiens
uuaaaucccugguaaucug

SEQ ID NO: 501358 - RNA, 19 nt, Homo sapiens
ccaaagugcugggauuaca

SEQ ID NO: 501359 - RNA, 19 nt, Homo sapiens
gaggaggacagccagagua

SEQ ID NO: 501360 - RNA, 19 nt, Homo sapiens
aacaagcgcaugacaauaa

SEQ ID NO: 501361 - RNA, 19 nt, Homo sapiens
gaacugcagcccaagaaca

SEQ ID NO: 501362 - RNA, 19 nt, Homo sapiens
agaaaugaucuccugaaua

SEQ ID NO: 501363 - RNA, 19 nt, Homo sapiens
ucaaugugcuggagaugau

SEQ ID NO: 501364 - RNA, 19 nt, Homo sapiens
aggcuggagugcagaaaua

SEQ ID NO: 501365 - RNA, 19 nt, Homo sapiens
aagcagaaguggacuguag

SEQ ID NO: 501366 - RNA, 19 nt, Homo sapiens
gaauuuacacugacagaag

SEQ ID NO: 501367 - RNA, 19 nt, Homo sapiens
ggacacccuuaaagacugu

SEQ ID NO: 501368 - RNA, 19 nt, Homo sapiens
ggagugcaguggcgugauc

SEQ ID NO: 501369 - RNA, 19 nt, Homo sapiens
cagcugugaugauuaagga

SEQ ID NO: 501370 - RNA, 19 nt, Homo sapiens
ccacuggaaucagcuauca

SEQ ID NO: 501371 - RNA, 19 nt, Homo sapiens
gcguuucccuucuuuagug

SEQ ID NO: 501372 - RNA, 19 nt, Homo sapiens
cggcuaauguuuuguauuu

SEQ ID NO: 501373 - RNA, 19 nt, Homo sapiens
ggaaugaugacucugaaag

SEQ ID NO: 501374 - RNA, 19 nt, Homo sapiens
caacucggccucccaaagu

SEQ ID NO: 501375 - RNA, 19 nt, Homo sapiens
aagcugcugucauuauuug

SEQ ID NO: 501376 - RNA, 19 nt, Homo sapiens
gcaguggucgaauccagua

SEQ ID NO: 501377 - RNA, 19 nt, Homo sapiens
uaagauuaguucccugauc

SEQ ID NO: 501378 - RNA, 19 nt, Homo sapiens
gcagguuaauccuccacuu

SEQ ID NO: 501379 - RNA, 19 nt, Homo sapiens
ggcauuugcugucaacauc

SEQ ID NO: 501380 - RNA, 19 nt, Homo sapiens
gaaaagacuuggcaugaac

SEQ ID NO: 501381 - RNA, 19 nt, Homo sapiens
gagaagaaucccaaaguac

SEQ ID NO: 501382 - RNA, 19 nt, Homo sapiens
cagaagcaguggucgaauc

SEQ ID NO: 501383 - RNA, 19 nt, Homo sapiens
ugaagaaggggaaaauuua

SEQ ID NO: 501384 - RNA, 19 nt, Homo sapiens
gacuuggcaugaacugaaa

SEQ ID NO: 501385 - RNA, 19 nt, Homo sapiens
ccagcaaugugaguauuau

SEQ ID NO: 501386 - RNA, 19 nt, Homo sapiens
gcaugguuccuaauaauag

SEQ ID NO: 501387 - RNA, 19 nt, Homo sapiens
uuagacuguuccuuugaua

SEQ ID NO: 501388 - RNA, 19 nt, Homo sapiens
uaaauuuguuccacgucaa

SEQ ID NO: 501389 - RNA, 19 nt, Homo sapiens
ccuaggaaauggugaaguc

SEQ ID NO: 501390 - RNA, 19 nt, Homo sapiens
gcagaaguggacuguagaa

SEQ ID NO: 501391 - RNA, 19 nt, Homo sapiens
aaaggagacuuggguggaa

SEQ ID NO: 501392 - RNA, 19 nt, Homo sapiens
gcaugacaauaagcagauu

SEQ ID NO: 501393 - RNA, 19 nt, Homo sapiens
ugacagaccaguccuugug

SEQ ID NO: 501394 - RNA, 19 nt, Homo sapiens
gaggucccauuuccacuuc

SEQ ID NO: 501395 - RNA, 19 nt, Homo sapiens
uaaccgaacagcugugaug

SEQ ID NO: 501396 - RNA, 19 nt, Homo sapiens
aggaaauggugaagucuau

SEQ ID NO: 501397 - RNA, 19 nt, Homo sapiens
cuucaucacuguuggagau

SEQ ID NO: 501398 - RNA, 19 nt, Homo sapiens
gaggacagccagaguacug

SEQ ID NO: 501399 - RNA, 19 nt, Homo sapiens
gcaaggcagcuacggaauc

SEQ ID NO: 501400 - RNA, 19 nt, Homo sapiens
guaaaauggugauuguaga

SEQ ID NO: 501401 - RNA, 19 nt, Homo sapiens
gcagaaauauggggaagga

SEQ ID NO: 501402 - RNA, 19 nt, Homo sapiens
cgaacagcugugaugauua

SEQ ID NO: 501403 - RNA, 19 nt, Homo sapiens
agaaguggacuguagaaga

SEQ ID NO: 501404 - RNA, 19 nt, Homo sapiens
agacaguacaaccaauaua

SEQ ID NO: 501405 - RNA, 19 nt, Homo sapiens
cuaaugggguugaagaaaa

SEQ ID NO: 501406 - RNA, 19 nt, Homo sapiens
gacagaagcaguggucgaa

SEQ ID NO: 501407 - RNA, 19 nt, Homo sapiens
cuugugcagugccagaaua

SEQ ID NO: 501408 - RNA, 19 nt, Homo sapiens
ggaggucccauuuccacuu

SEQ ID NO: 501409 - RNA, 19 nt, Homo sapiens
uggcaucugcuguuucuuu

SEQ ID NO: 501410 - RNA, 19 nt, Homo sapiens
guucuggccuucugaugca

SEQ ID NO: 501411 - RNA, 19 nt, Homo sapiens
gugaguauuauuuggagua

SEQ ID NO: 501412 - RNA, 19 nt, Homo sapiens
caaugugaguauuauuugg

SEQ ID NO: 501413 - RNA, 19 nt, Homo sapiens
gggacaucaugcaggcuuu

SEQ ID NO: 501414 - RNA, 19 nt, Homo sapiens
gcagugccagaauaucauu

SEQ ID NO: 501415 - RNA, 19 nt, Homo sapiens
aauuuagacuguuccuuug

SEQ ID NO: 501416 - RNA, 19 nt, Homo sapiens
agacagauccgggacauca

SEQ ID NO: 501417 - RNA, 19 nt, Homo sapiens
ggaaacugggcugccauuu

SEQ ID NO: 501418 - RNA, 19 nt, Homo sapiens
ugaagacaguacaaccaau

SEQ ID NO: 501419 - RNA, 19 nt, Homo sapiens
agaacaagcgcaugacaau

SEQ ID NO: 501420 - RNA, 19 nt, Homo sapiens
gaacgggccuggaaccaua

SEQ ID NO: 501421 - RNA, 19 nt, Homo sapiens
gagcugacguggaagauga

SEQ ID NO: 501422 - RNA, 19 nt, Homo sapiens
gcaaagcauuggaaucaga

SEQ ID NO: 501423 - RNA, 19 nt, Homo sapiens
ggaagacaguggugaacuu

SEQ ID NO: 501424 - RNA, 19 nt, Homo sapiens
cagcacaccugccgucuuc

SEQ ID NO: 501425 - RNA, 19 nt, Homo sapiens
guacagguuucacgcaugu

SEQ ID NO: 501426 - RNA, 19 nt, Homo sapiens
gcacugcccucagacuuca

SEQ ID NO: 501427 - RNA, 19 nt, Homo sapiens
guggugaacuugcggaaga

SEQ ID NO: 501428 - RNA, 19 nt, Homo sapiens
gcagagcuccucccugaau

SEQ ID NO: 501429 - RNA, 19 nt, Homo sapiens
gagccagucucaccuucaa

SEQ ID NO: 501430 - RNA, 19 nt, Homo sapiens
gguggaugauuucuuguug

SEQ ID NO: 501431 - RNA, 19 nt, Homo sapiens
ggaaucagacagcacuuga

SEQ ID NO: 501432 - RNA, 19 nt, Homo sapiens
cgccugagcuguacuuugu

SEQ ID NO: 501433 - RNA, 19 nt, Homo sapiens
gcucaggucuuucuuuuau

SEQ ID NO: 501434 - RNA, 19 nt, Homo sapiens
gggaggugcugugggagua

SEQ ID NO: 501435 - RNA, 19 nt, Homo sapiens
guggugaacuucccuguag

SEQ ID NO: 501436 - RNA, 19 nt, Homo sapiens
ccaaaggugugcccuguac

SEQ ID NO: 501437 - RNA, 19 nt, Homo sapiens
gguaugccgugguccagaa

SEQ ID NO: 501438 - RNA, 19 nt, Homo sapiens
ggaagagugucuggagcaa

SEQ ID NO: 501439 - RNA, 19 nt, Homo sapiens
ccugggagcucugggaauu

SEQ ID NO: 501440 - RNA, 19 nt, Homo sapiens
ccacgucucuaccuugaca

SEQ ID NO: 501441 - RNA, 19 nt, Homo sapiens
ugcaggagcugacguggaa

SEQ ID NO: 501442 - RNA, 19 nt, Homo sapiens
ucacggagaccacguuuca

SEQ ID NO: 501443 - RNA, 19 nt, Homo sapiens
ucaggaacaccaagaaguu

SEQ ID NO: 501444 - RNA, 19 nt, Homo sapiens
guggagacccugagaagga

SEQ ID NO: 501445 - RNA, 19 nt, Homo sapiens
ggucaucgccagcaucauc

SEQ ID NO: 501446 - RNA, 19 nt, Homo sapiens
gagugaccgugguuucugu

SEQ ID NO: 501447 - RNA, 19 nt, Homo sapiens
ccagaacguuccgcagaga

SEQ ID NO: 501448 - RNA, 19 nt, Homo sapiens
gaaucagacagcacuugaa

SEQ ID NO: 501449 - RNA, 19 nt, Homo sapiens
gaggugcugugggaguaaa

SEQ ID NO: 501450 - RNA, 19 nt, Homo sapiens
gcgacgacgugcugguuca

SEQ ID NO: 501451 - RNA, 19 nt, Homo sapiens
gagcgacuacuccagcuau

SEQ ID NO: 501452 - RNA, 19 nt, Homo sapiens
gcucguggagaccaucuuu

SEQ ID NO: 501453 - RNA, 19 nt, Homo sapiens
uuugguggaugauuucuug

SEQ ID NO: 501454 - RNA, 19 nt, Homo sapiens
aagagugucuggagcaagu

SEQ ID NO: 501455 - RNA, 19 nt, Homo sapiens
ggugaacuucccuguagaa

SEQ ID NO: 501456 - RNA, 19 nt, Homo sapiens
agaccaagcacuuccucua

SEQ ID NO: 501457 - RNA, 19 nt, Homo sapiens
ugggagcucugggaauuug

SEQ ID NO: 501458 - RNA, 19 nt, Homo sapiens
ccacauaggaauaguccau

SEQ ID NO: 501459 - RNA, 19 nt, Homo sapiens
caucagcaaguuuggaaga

SEQ ID NO: 501460 - RNA, 19 nt, Homo sapiens
gugcugggccuggacgaua

SEQ ID NO: 501461 - RNA, 19 nt, Homo sapiens
ucagacagcacuugaagag

SEQ ID NO: 501462 - RNA, 19 nt, Homo sapiens
gagaccacguuucaaaaga

SEQ ID NO: 501463 - RNA, 19 nt, Homo sapiens
ccaagcacuuccucuacuc

SEQ ID NO: 501464 - RNA, 19 nt, Homo sapiens
caccugccgucuucacuuc

SEQ ID NO: 501465 - RNA, 19 nt, Homo sapiens
ccucagacuucaagaccau

SEQ ID NO: 501466 - RNA, 19 nt, Homo sapiens
gaggucaucgccagcauca

SEQ ID NO: 501467 - RNA, 19 nt, Homo sapiens
ucagcgugcucaacuacga

SEQ ID NO: 501468 - RNA, 19 nt, Homo sapiens
gaugcgaacgggccuggaa

SEQ ID NO: 501469 - RNA, 19 nt, Homo sapiens
gcugcaggcguacagguuu

SEQ ID NO: 501470 - RNA, 19 nt, Homo sapiens
ccucuucgacgucuuccua

SEQ ID NO: 501471 - RNA, 19 nt, Homo sapiens
cagagcuccucccugaaug

SEQ ID NO: 501472 - RNA, 19 nt, Homo sapiens
ggagauccuggccaaguuc

SEQ ID NO: 501473 - RNA, 19 nt, Homo sapiens
gcucccauuucaucagcaa

SEQ ID NO: 501474 - RNA, 19 nt, Homo sapiens
ccugagcuguacuuuguca

SEQ ID NO: 501475 - RNA, 19 nt, Homo sapiens
gaccaagcacuuccucuac

SEQ ID NO: 501476 - RNA, 19 nt, Homo sapiens
uugcaaagcauuggaauca

SEQ ID NO: 501477 - RNA, 19 nt, Homo sapiens
uggaagaaccccacauuuu

SEQ ID NO: 501478 - RNA, 19 nt, Homo sapiens
uccgaggugucccugagua

SEQ ID NO: 501479 - RNA, 19 nt, Homo sapiens
ucaccucacccacgcgaaa

SEQ ID NO: 501480 - RNA, 19 nt, Homo sapiens
ugcguuugguggaugauuu

SEQ ID NO: 501481 - RNA, 19 nt, Homo sapiens
uuccugcacuggcugauga

SEQ ID NO: 501482 - RNA, 19 nt, Homo sapiens
ggaccgagugaccgugguu

SEQ ID NO: 501483 - RNA, 19 nt, Homo sapiens
acggagaccacguuucaaa

SEQ ID NO: 501484 - RNA, 19 nt, Homo sapiens
gaggugucccugaguaugg

SEQ ID NO: 501485 - RNA, 19 nt, Homo sapiens
guacugcgugcgucgguau

SEQ ID NO: 501486 - RNA, 19 nt, Homo sapiens
gcuacuccauccugaaagc

SEQ ID NO: 501487 - RNA, 19 nt, Homo sapiens
gccaagaacgcagggaugu

SEQ ID NO: 501488 - RNA, 19 nt, Homo sapiens
gcacggcuuuuguucagau

SEQ ID NO: 501489 - RNA, 19 nt, Homo sapiens
agccacgucucuaccuuga

SEQ ID NO: 501490 - RNA, 19 nt, Homo sapiens
ggccgauugugaacaugga

SEQ ID NO: 501491 - RNA, 19 nt, Homo sapiens
ggaggugcugugggaguaa

SEQ ID NO: 501492 - RNA, 19 nt, Homo sapiens
ccgaggaggaggacacaga

SEQ ID NO: 501493 - RNA, 19 nt, Homo sapiens
uggaugauuucuuguuggu

SEQ ID NO: 501494 - RNA, 19 nt, Homo sapiens
gcugcucaggucuuucuuu

SEQ ID NO: 501495 - RNA, 19 nt, Homo sapiens
gcugugccaccaagcauuc

SEQ ID NO: 501496 - RNA, 19 nt, Homo sapiens
agucugccguugcccaaga

SEQ ID NO: 501497 - RNA, 19 nt, Homo sapiens
gagggugaaggcacuguuc

SEQ ID NO: 501498 - RNA, 19 nt, Homo sapiens
agaacguuccgcagagaaa

SEQ ID NO: 501499 - RNA, 19 nt, Homo sapiens
ugagaaggcugaugucuuu

SEQ ID NO: 501500 - RNA, 19 nt, Homo sapiens
ggaccgcccugacacacaa

SEQ ID NO: 501501 - RNA, 19 nt, Homo sapiens
agacuaacacgugcaauua

SEQ ID NO: 501502 - RNA, 19 nt, Homo sapiens
gcacuccaaagguguauuu

SEQ ID NO: 501503 - RNA, 19 nt, Homo sapiens
ggacagcugcacgcucuua

SEQ ID NO: 501504 - RNA, 19 nt, Homo sapiens
gagacuaacacgugcaauu

SEQ ID NO: 501505 - RNA, 19 nt, Homo sapiens
ugaacaagcuccccaguaa

SEQ ID NO: 501506 - RNA, 19 nt, Homo sapiens
ccacucagcugcccuuggu

SEQ ID NO: 501507 - RNA, 19 nt, Homo sapiens
ucagggcucuguugcaaga

SEQ ID NO: 501508 - RNA, 19 nt, Homo sapiens
ggggugagcuguaugauga

SEQ ID NO: 501509 - RNA, 19 nt, Homo sapiens
acuaacacgugcaauuauu

SEQ ID NO: 501510 - RNA, 19 nt, Homo sapiens
ucucaggccuccaacuuug

SEQ ID NO: 501511 - RNA, 19 nt, Homo sapiens
gaaaagauuccuguguaua

SEQ ID NO: 501512 - RNA, 19 nt, Homo sapiens
ccgaaaagauuccugugua

SEQ ID NO: 501513 - RNA, 19 nt, Homo sapiens
aaucagggcucuguugcaa

SEQ ID NO: 501514 - RNA, 19 nt, Homo sapiens
gacccguccucaauaacaa

SEQ ID NO: 501515 - RNA, 19 nt, Homo sapiens
ucucugaggucuacaaggu

SEQ ID NO: 501516 - RNA, 19 nt, Homo sapiens
uaagaacagagcacacuug

SEQ ID NO: 501517 - RNA, 19 nt, Homo sapiens
gggaagugcagcugaugaa

SEQ ID NO: 501518 - RNA, 19 nt, Homo sapiens
cuaacacgugcaauuauuu

SEQ ID NO: 501519 - RNA, 19 nt, Homo sapiens
ggucucaggccuccaacuu

SEQ ID NO: 501520 - RNA, 19 nt, Homo sapiens
gaucaagcucuuagacaca

SEQ ID NO: 501521 - RNA, 19 nt, Homo sapiens
gccuggaugugccugcuuu

SEQ ID NO: 501522 - RNA, 19 nt, Homo sapiens
gggcaaggaaggagccauu

SEQ ID NO: 501523 - RNA, 19 nt, Homo sapiens
gcaacacacuacgggaagu

SEQ ID NO: 501524 - RNA, 19 nt, Homo sapiens
cgaaaagauuccuguguau

SEQ ID NO: 501525 - RNA, 19 nt, Homo sapiens
uuacagaguauaugaaugg

SEQ ID NO: 501526 - RNA, 19 nt, Homo sapiens
gacuaacacgugcaauuau

SEQ ID NO: 501527 - RNA, 19 nt, Homo sapiens
ugcagacccugacuaccua

SEQ ID NO: 501528 - RNA, 19 nt, Homo sapiens
cggcggaucuuccauucuc

SEQ ID NO: 501529 - RNA, 19 nt, Homo sapiens
gaccucacauccaagaacu

SEQ ID NO: 501530 - RNA, 19 nt, Homo sapiens
ggugagcuguaugaugaga

SEQ ID NO: 501531 - RNA, 19 nt, Homo sapiens
ccaccuggcccuggacauu

SEQ ID NO: 501532 - RNA, 19 nt, Homo sapiens
caagucauggugcugaaga

SEQ ID NO: 501533 - RNA, 19 nt, Homo sapiens
ggcaagucauggugcugaa

SEQ ID NO: 501534 - RNA, 19 nt, Homo sapiens
guaagaacagagcacacuu

SEQ ID NO: 501535 - RNA, 19 nt, Homo sapiens
uggcgcguguggacgauuu

SEQ ID NO: 501536 - RNA, 19 nt, Homo sapiens
gcaaggaaggagccauugg

SEQ ID NO: 501537 - RNA, 19 nt, Homo sapiens
gcucaucgcccgaguaccu

SEQ ID NO: 501538 - RNA, 19 nt, Homo sapiens
gcauugcugacacaugaga

SEQ ID NO: 501539 - RNA, 19 nt, Homo sapiens
ugaaccagacacagcauug

SEQ ID NO: 501540 - RNA, 19 nt, Homo sapiens
gagcucaucgcccgaguac

SEQ ID NO: 501541 - RNA, 19 nt, Homo sapiens
aaagauuccuguguauagg

SEQ ID NO: 501542 - RNA, 19 nt, Homo sapiens
ugagcuguaugaugagaag

SEQ ID NO: 501543 - RNA, 19 nt, Homo sapiens
accgcaaccugaacuguga

SEQ ID NO: 501544 - RNA, 19 nt, Homo sapiens
cagcugugguggugaacuc

SEQ ID NO: 501545 - RNA, 19 nt, Homo sapiens
ccacagacaacuucaucag

SEQ ID NO: 501546 - RNA, 19 nt, Homo sapiens
ccacugcugcaaccuggaa

SEQ ID NO: 501547 - RNA, 19 nt, Homo sapiens
ggacuuuggccuggaugug

SEQ ID NO: 501548 - RNA, 19 nt, Homo sapiens
ggauggcuccagagguguu

SEQ ID NO: 501549 - RNA, 19 nt, Homo sapiens
ugcgguaccugcacuccaa

SEQ ID NO: 501550 - RNA, 19 nt, Homo sapiens
gacagugccaguuccagau

SEQ ID NO: 501551 - RNA, 19 nt, Homo sapiens
ggccacagacaacuucauc

SEQ ID NO: 501552 - RNA, 19 nt, Homo sapiens
cacaaucagggcucuguug

SEQ ID NO: 501553 - RNA, 19 nt, Homo sapiens
gauggcuccagagguguua

SEQ ID NO: 501554 - RNA, 19 nt, Homo sapiens
gaucacugaaccagacaca

SEQ ID NO: 501555 - RNA, 19 nt, Homo sapiens
ugucuuugccuucgggauu

SEQ ID NO: 501556 - RNA, 19 nt, Homo sapiens
ucacauccaagaacugucu

SEQ ID NO: 501557 - RNA, 19 nt, Homo sapiens
cccaacauccuaagguuca

SEQ ID NO: 501558 - RNA, 19 nt, Homo sapiens
ggaaggaccugcuguuuaa

SEQ ID NO: 501559 - RNA, 19 nt, Homo sapiens
gauaguggcuuccagauga

SEQ ID NO: 501560 - RNA, 19 nt, Homo sapiens
guucagagaugacacagua

SEQ ID NO: 501561 - RNA, 19 nt, Homo sapiens
gaagaaagccuccuaccuu

SEQ ID NO: 501562 - RNA, 19 nt, Homo sapiens
ggaagccgguagaugaaua

SEQ ID NO: 501563 - RNA, 19 nt, Homo sapiens
gagcuuggauggaggguuu

SEQ ID NO: 501564 - RNA, 19 nt, Homo sapiens
agaaagcaguggccaauuu

SEQ ID NO: 501565 - RNA, 19 nt, Homo sapiens
gcuccacccuuaaccaaua

SEQ ID NO: 501566 - RNA, 19 nt, Homo sapiens
ccacagacuuucuauuaug

SEQ ID NO: 501567 - RNA, 19 nt, Homo sapiens
gcagaaaacuacaauaaga

SEQ ID NO: 501568 - RNA, 19 nt, Homo sapiens
gggaaggaccugcuguuua

SEQ ID NO: 501569 - RNA, 19 nt, Homo sapiens
gaucaaccacugcagauuu

SEQ ID NO: 501570 - RNA, 19 nt, Homo sapiens
cugcagauuugaugaauuu

SEQ ID NO: 501571 - RNA, 19 nt, Homo sapiens
gaaaauagaguguguauca

SEQ ID NO: 501572 - RNA, 19 nt, Homo sapiens
gucaagcacucgacuauau

SEQ ID NO: 501573 - RNA, 19 nt, Homo sapiens
gagaugacacaguauguuu

SEQ ID NO: 501574 - RNA, 19 nt, Homo sapiens
gggcuaagaaucugaauga

SEQ ID NO: 501575 - RNA, 19 nt, Homo sapiens
gacagaaacacauaugaaa

SEQ ID NO: 501576 - RNA, 19 nt, Homo sapiens
gcuaagaaucugaaugaaa

SEQ ID NO: 501577 - RNA, 19 nt, Homo sapiens
gaacauccccauaggcuua

SEQ ID NO: 501578 - RNA, 19 nt, Homo sapiens
guaaaccucuugagaaagc

SEQ ID NO: 501579 - RNA, 19 nt, Homo sapiens
ggauggaugccaagaugua

SEQ ID NO: 501580 - RNA, 19 nt, Homo sapiens
gcccaggucccuucucaua

SEQ ID NO: 501581 - RNA, 19 nt, Homo sapiens
ggccaaacuucaugacaga

SEQ ID NO: 501582 - RNA, 19 nt, Homo sapiens
ucaggugucugguugagaa

SEQ ID NO: 501583 - RNA, 19 nt, Homo sapiens
gaucaugaauggagaagcu

SEQ ID NO: 501584 - RNA, 19 nt, Homo sapiens
caggauggaugccaagaug

SEQ ID NO: 501585 - RNA, 19 nt, Homo sapiens
ggccugcucuacaauaaga

SEQ ID NO: 501586 - RNA, 19 nt, Homo sapiens
ggaugcagguuugguguau

SEQ ID NO: 501587 - RNA, 19 nt, Homo sapiens
cuacauagcgggcaagugu

SEQ ID NO: 501588 - RNA, 19 nt, Homo sapiens
acgagaggcucaaguguga

SEQ ID NO: 501589 - RNA, 19 nt, Homo sapiens
gaaagccuccuaccuugau

SEQ ID NO: 501590 - RNA, 19 nt, Homo sapiens
caacagcagcaccuauuug

SEQ ID NO: 501591 - RNA, 19 nt, Homo sapiens
ggagauguggccuuuguga

SEQ ID NO: 501592 - RNA, 19 nt, Homo sapiens
cagcagagaccaccgaaga

SEQ ID NO: 501593 - RNA, 19 nt, Homo sapiens
acguaaaccucuugagaaa

SEQ ID NO: 501594 - RNA, 19 nt, Homo sapiens
ggacucugcccacggguuu

SEQ ID NO: 501595 - RNA, 19 nt, Homo sapiens
gcacucgacuauauuugag

SEQ ID NO: 501596 - RNA, 19 nt, Homo sapiens
ccacguaaaccucuugaga

SEQ ID NO: 501597 - RNA, 19 nt, Homo sapiens
gcacuuuccguagaccuua

SEQ ID NO: 501598 - RNA, 19 nt, Homo sapiens
ugacagaaacacauaugaa

SEQ ID NO: 501599 - RNA, 19 nt, Homo sapiens
cagcagcaccuauuuggaa

SEQ ID NO: 501600 - RNA, 19 nt, Homo sapiens
cuauucagcucuccucaug

SEQ ID NO: 501601 - RNA, 19 nt, Homo sapiens
gacacuggaugcagguuug

SEQ ID NO: 501602 - RNA, 19 nt, Homo sapiens
uagcaguggugaagaaauc

SEQ ID NO: 501603 - RNA, 19 nt, Homo sapiens
agauguaccugggcuauga

SEQ ID NO: 501604 - RNA, 19 nt, Homo sapiens
caagcacucgacuauauuu

SEQ ID NO: 501605 - RNA, 19 nt, Homo sapiens
gccgguagaugaauacaag

SEQ ID NO: 501606 - RNA, 19 nt, Homo sapiens
gacuauauuugagaacuug

SEQ ID NO: 501607 - RNA, 19 nt, Homo sapiens
ugacugcucgggcaacuuu

SEQ ID NO: 501608 - RNA, 19 nt, Homo sapiens
cacaagauauuacgucaac

SEQ ID NO: 501609 - RNA, 19 nt, Homo sapiens
ccaugggccugcucuacaa

SEQ ID NO: 501610 - RNA, 19 nt, Homo sapiens
guaccugggcuaugaguau

SEQ ID NO: 501611 - RNA, 19 nt, Homo sapiens
cgacuauauuugagaacuu

SEQ ID NO: 501612 - RNA, 19 nt, Homo sapiens
uguaugggcucaggccuaa

SEQ ID NO: 501613 - RNA, 19 nt, Homo sapiens
gagcgauaauugugaggau

SEQ ID NO: 501614 - RNA, 19 nt, Homo sapiens
uggaggguuugucuacaua

SEQ ID NO: 501615 - RNA, 19 nt, Homo sapiens
ggauguggccuuugucaag

SEQ ID NO: 501616 - RNA, 19 nt, Homo sapiens
auccacagacuuucuauua

SEQ ID NO: 501617 - RNA, 19 nt, Homo sapiens
aagaggauccacagacuuu

SEQ ID NO: 501618 - RNA, 19 nt, Homo sapiens
cgaagcggaugcugugaca

SEQ ID NO: 501619 - RNA, 19 nt, Homo sapiens
gaguugcugugccuugaug

SEQ ID NO: 501620 - RNA, 19 nt, Homo sapiens
gaugaaugcaagccuguga

SEQ ID NO: 501621 - RNA, 19 nt, Homo sapiens
gaauaugucaaggcuguug

SEQ ID NO: 501622 - RNA, 19 nt, Homo sapiens
ccaaacuucaugacagaaa

SEQ ID NO: 501623 - RNA, 19 nt, Homo sapiens
ucgccaagaucaugaaugg

SEQ ID NO: 501624 - RNA, 19 nt, Homo sapiens
gcaaagacaaaucaaaaga

SEQ ID NO: 501625 - RNA, 19 nt, Homo sapiens
ggaccaguaugagcugcuu

SEQ ID NO: 501626 - RNA, 19 nt, Homo sapiens
ggaagcaacguaacugacu

SEQ ID NO: 501627 - RNA, 19 nt, Homo sapiens
agauguggccuuugugaaa

SEQ ID NO: 501628 - RNA, 19 nt, Homo sapiens
caccagaggcaggguauuu

SEQ ID NO: 501629 - RNA, 19 nt, Homo sapiens
aauaagagcgauaauugug

SEQ ID NO: 501630 - RNA, 19 nt, Homo sapiens
ggauaguggcuuccagaug

SEQ ID NO: 501631 - RNA, 19 nt, Homo sapiens
gcucuguguugccaugugu

SEQ ID NO: 501632 - RNA, 19 nt, Homo sapiens
ugucaaggcuguugguaac

SEQ ID NO: 501633 - RNA, 19 nt, Homo sapiens
gcaagaaguccugccauac

SEQ ID NO: 501634 - RNA, 19 nt, Homo sapiens
gaccucaccugggacaauc

SEQ ID NO: 501635 - RNA, 19 nt, Homo sapiens
gagcaugaggccacuaagu

SEQ ID NO: 501636 - RNA, 19 nt, Homo sapiens
ucugggagcuucucaacca

SEQ ID NO: 501637 - RNA, 19 nt, Homo sapiens
gacuuucuauuaugcuguu

SEQ ID NO: 501638 - RNA, 19 nt, Homo sapiens
ucaacagcagcaccuauuu

SEQ ID NO: 501639 - RNA, 19 nt, Homo sapiens
gagaaagcaguggccaauu

SEQ ID NO: 501640 - RNA, 19 nt, Homo sapiens
cacguaaaccucuugagaa

SEQ ID NO: 501641 - RNA, 19 nt, Homo sapiens
uaggcuuacuuuacuguga

SEQ ID NO: 501642 - RNA, 19 nt, Homo sapiens
gauguggccuuugugaaac

SEQ ID NO: 501643 - RNA, 19 nt, Homo sapiens
gagauguggccuuugugaa

SEQ ID NO: 501644 - RNA, 19 nt, Homo sapiens
gauggaggguuugucuaca

SEQ ID NO: 501645 - RNA, 19 nt, Homo sapiens
gaagacugcaucgccaaga

SEQ ID NO: 501646 - RNA, 19 nt, Homo sapiens
uccacagacuuucuauuau

SEQ ID NO: 501647 - RNA, 19 nt, Homo sapiens
gcagaguucuaugggucaa

SEQ ID NO: 501648 - RNA, 19 nt, Homo sapiens
gcuaaccacgucugucuuc

SEQ ID NO: 501649 - RNA, 19 nt, Homo sapiens
ccaagugguuugugcuaac

SEQ ID NO: 501650 - RNA, 19 nt, Homo sapiens
guggucacacggaaagaua

SEQ ID NO: 501651 - RNA, 19 nt, Homo sapiens
ccaacaacaaagagggaua

SEQ ID NO: 501652 - RNA, 19 nt, Homo sapiens
ccuccuaccuugauugcau

SEQ ID NO: 501653 - RNA, 19 nt, Homo sapiens
ggauggaggguuugucuac

SEQ ID NO: 501654 - RNA, 19 nt, Homo sapiens
ucaagcacucgacuauauu

SEQ ID NO: 501655 - RNA, 19 nt, Homo sapiens
ccagcugugucaacugugu

SEQ ID NO: 501656 - RNA, 19 nt, Homo sapiens
caaacuucaugacagaaac

SEQ ID NO: 501657 - RNA, 19 nt, Homo sapiens
gucaacagcagcaccuauu

SEQ ID NO: 501658 - RNA, 19 nt, Homo sapiens
gaacaacuacccauauuua

SEQ ID NO: 501659 - RNA, 19 nt, Homo sapiens
gaagagauaagcagauuua

SEQ ID NO: 501660 - RNA, 19 nt, Homo sapiens
gaacucaucuagguaaauu

SEQ ID NO: 501661 - RNA, 19 nt, Homo sapiens
caagucagauuaugucuuu

SEQ ID NO: 501662 - RNA, 19 nt, Homo sapiens
caaagaaaccuguaaguuc

SEQ ID NO: 501663 - RNA, 19 nt, Homo sapiens
gaacaaaugauugaaguug

SEQ ID NO: 501664 - RNA, 19 nt, Homo sapiens
gaaaggauaaaguugguaa

SEQ ID NO: 501665 - RNA, 19 nt, Homo sapiens
gcugaagacuguaaaggaa

SEQ ID NO: 501666 - RNA, 19 nt, Homo sapiens
gagauaagcagauuuaaag

SEQ ID NO: 501667 - RNA, 19 nt, Homo sapiens
guugaugguuguacauaua

SEQ ID NO: 501668 - RNA, 19 nt, Homo sapiens
cagauuaugucuuuggaaa

SEQ ID NO: 501669 - RNA, 19 nt, Homo sapiens
gcuaggaauuguguuuaua

SEQ ID NO: 501670 - RNA, 19 nt, Homo sapiens
gcagaacucaucuagguaa

SEQ ID NO: 501671 - RNA, 19 nt, Homo sapiens
cauaauacuugcuuuggaa

SEQ ID NO: 501672 - RNA, 19 nt, Homo sapiens
gcugaaagauuccaagaag

SEQ ID NO: 501673 - RNA, 19 nt, Homo sapiens
guauauugauccagaaaga

SEQ ID NO: 501674 - RNA, 19 nt, Homo sapiens
guacucuuguuuccuuaua

SEQ ID NO: 501675 - RNA, 19 nt, Homo sapiens
cuacagaacuaauuagaag

SEQ ID NO: 501676 - RNA, 19 nt, Homo sapiens
agauaaagguucaugcaaa

SEQ ID NO: 501677 - RNA, 19 nt, Homo sapiens
gaugaugacuauggaaaga

SEQ ID NO: 501678 - RNA, 19 nt, Homo sapiens
uauaagugauugcugguuu

SEQ ID NO: 501679 - RNA, 19 nt, Homo sapiens
gcauaauacuugcuuugga

SEQ ID NO: 501680 - RNA, 19 nt, Homo sapiens
uuauguagcugaaagauuc

SEQ ID NO: 501681 - RNA, 19 nt, Homo sapiens
gcagguauauaaagaagag

SEQ ID NO: 501682 - RNA, 19 nt, Homo sapiens
gauaaagguucaugcaaac

SEQ ID NO: 501683 - RNA, 19 nt, Homo sapiens
gggaagaacaaaugauuga

SEQ ID NO: 501684 - RNA, 19 nt, Homo sapiens
gaaaucauggacaaacauu

SEQ ID NO: 501685 - RNA, 19 nt, Homo sapiens
aagaacaacuacccauauu

SEQ ID NO: 501686 - RNA, 19 nt, Homo sapiens
ggaaaccaguuaggucuca

SEQ ID NO: 501687 - RNA, 19 nt, Homo sapiens
aaauuacaguuccuaggua

SEQ ID NO: 501688 - RNA, 19 nt, Homo sapiens
ccaaagaaaccuguaaguu

SEQ ID NO: 501689 - RNA, 19 nt, Homo sapiens
gaacagcuaacuccaaguc

SEQ ID NO: 501690 - RNA, 19 nt, Homo sapiens
caacuacccauauuuaaag

SEQ ID NO: 501691 - RNA, 19 nt, Homo sapiens
gagcuaggaauuguguuua

SEQ ID NO: 501692 - RNA, 19 nt, Homo sapiens
ggauaaaguugguaaaccu

SEQ ID NO: 501693 - RNA, 19 nt, Homo sapiens
gcacgcggguuccaguugu

SEQ ID NO: 501694 - RNA, 19 nt, Homo sapiens
aagaagagauaagcagauu

SEQ ID NO: 501695 - RNA, 19 nt, Homo sapiens
uauacaggaugaugacuau

SEQ ID NO: 501696 - RNA, 19 nt, Homo sapiens
gaagaacaaaugauugaag

SEQ ID NO: 501697 - RNA, 19 nt, Homo sapiens
aaaggaaagcuaugacaaa

SEQ ID NO: 501698 - RNA, 19 nt, Homo sapiens
cggaguggcagguauauaa

SEQ ID NO: 501699 - RNA, 19 nt, Homo sapiens
gaaacacuuugcauaacgu

SEQ ID NO: 501700 - RNA, 19 nt, Homo sapiens
cacauuguauucagaguug

SEQ ID NO: 501701 - RNA, 19 nt, Homo sapiens
ggcaaguuguccaaagaaa

SEQ ID NO: 501702 - RNA, 19 nt, Homo sapiens
ggaggcaggaguuucguuu

SEQ ID NO: 501703 - RNA, 19 nt, Homo sapiens
uaacguuuauguagcugaa

SEQ ID NO: 501704 - RNA, 19 nt, Homo sapiens
gguguucugugauauaagu

SEQ ID NO: 501705 - RNA, 19 nt, Homo sapiens
gccacgguguucugugaua

SEQ ID NO: 501706 - RNA, 19 nt, Homo sapiens
cuacgucgcacaauaaaga

SEQ ID NO: 501707 - RNA, 19 nt, Homo sapiens
aaaagggacugagaaauuu

SEQ ID NO: 501708 - RNA, 19 nt, Homo sapiens
uaaaagggacugagaaauu

SEQ ID NO: 501709 - RNA, 19 nt, Homo sapiens
gauugaaguuggacgaaag

SEQ ID NO: 501710 - RNA, 19 nt, Homo sapiens
aaagaccucguucagcuua

SEQ ID NO: 501711 - RNA, 19 nt, Homo sapiens
gaacuuccugauucaaaga

SEQ ID NO: 501712 - RNA, 19 nt, Homo sapiens
acaaaugauugaaguugga

SEQ ID NO: 501713 - RNA, 19 nt, Homo sapiens
ccaagaagcuaagggugau

SEQ ID NO: 501714 - RNA, 19 nt, Homo sapiens
gaaagauuccaagaagcua

SEQ ID NO: 501715 - RNA, 19 nt, Homo sapiens
ggaguggcagguauauaaa

SEQ ID NO: 501716 - RNA, 19 nt, Homo sapiens
aggcagaacucaucuaggu

SEQ ID NO: 501717 - RNA, 19 nt, Homo sapiens
gaguacucuuguuuccuua

SEQ ID NO: 501718 - RNA, 19 nt, Homo sapiens
ucagaguaauccaagcaaa

SEQ ID NO: 501719 - RNA, 19 nt, Homo sapiens
aaagaacaacuacccauau

SEQ ID NO: 501720 - RNA, 19 nt, Homo sapiens
aguagaagauugagaugug

SEQ ID NO: 501721 - RNA, 19 nt, Homo sapiens
acacuuugcauaacguaua

SEQ ID NO: 501722 - RNA, 19 nt, Homo sapiens
uuacaguuccuagguauaa

SEQ ID NO: 501723 - RNA, 19 nt, Homo sapiens
aaagguaaaucagacuaug

SEQ ID NO: 501724 - RNA, 19 nt, Homo sapiens
guagaagauugagaugugu

SEQ ID NO: 501725 - RNA, 19 nt, Homo sapiens
gcucagaacccagaugcaa

SEQ ID NO: 501726 - RNA, 19 nt, Homo sapiens
ugugccagauuuaugcaua

SEQ ID NO: 501727 - RNA, 19 nt, Homo sapiens
aaagggacugagaaauuua

SEQ ID NO: 501728 - RNA, 19 nt, Homo sapiens
uaaauuacaguuccuaggu

SEQ ID NO: 501729 - RNA, 19 nt, Homo sapiens
guaaaucagacuaugaagu

SEQ ID NO: 501730 - RNA, 19 nt, Homo sapiens
uuauucagcucauggacuu

SEQ ID NO: 501731 - RNA, 19 nt, Homo sapiens
gaaaagcugaagacuguaa

SEQ ID NO: 501732 - RNA, 19 nt, Homo sapiens
guucagcuuauaacguuua

SEQ ID NO: 501733 - RNA, 19 nt, Homo sapiens
cagaacucaucuagguaaa

SEQ ID NO: 501734 - RNA, 19 nt, Homo sapiens
gcaggcagaacucaucuag

SEQ ID NO: 501735 - RNA, 19 nt, Homo sapiens
ggaagaacaaaugauugaa

SEQ ID NO: 501736 - RNA, 19 nt, Homo sapiens
agaccucguucagcuuaua

SEQ ID NO: 501737 - RNA, 19 nt, Homo sapiens
gaguuaacacugcuuggaa

SEQ ID NO: 501738 - RNA, 19 nt, Homo sapiens
cacuuugcauaacguauaa

SEQ ID NO: 501739 - RNA, 19 nt, Homo sapiens
aagccacgguguucuguga

SEQ ID NO: 501740 - RNA, 19 nt, Homo sapiens
guaauccaagcaaauguga

SEQ ID NO: 501741 - RNA, 19 nt, Homo sapiens
cuaacuccaagucagauua

SEQ ID NO: 501742 - RNA, 19 nt, Homo sapiens
gggcggaguggcagguaua

SEQ ID NO: 501743 - RNA, 19 nt, Homo sapiens
uaagagacagccaacuaug

SEQ ID NO: 501744 - RNA, 19 nt, Homo sapiens
cgaaaagucuccaaagucu

SEQ ID NO: 501745 - RNA, 19 nt, Homo sapiens
uugcuggaguuguguauug

SEQ ID NO: 501746 - RNA, 19 nt, Homo sapiens
caaagguaaaucagacuau

SEQ ID NO: 501747 - RNA, 19 nt, Homo sapiens
gaucagaguaauccaagca

SEQ ID NO: 501748 - RNA, 19 nt, Homo sapiens
uaaagguucaugcaaacuu

SEQ ID NO: 501749 - RNA, 19 nt, Homo sapiens
gaucuucuacgucgcacaa

SEQ ID NO: 501750 - RNA, 19 nt, Homo sapiens
aagaaaucauggacaaaca

SEQ ID NO: 501751 - RNA, 19 nt, Homo sapiens
ugaaacacuuugcauaacg

SEQ ID NO: 501752 - RNA, 19 nt, Homo sapiens
gaguugaugguuguacaua

SEQ ID NO: 501753 - RNA, 19 nt, Homo sapiens
cuagguauaauucacauug

SEQ ID NO: 501754 - RNA, 19 nt, Homo sapiens
gauaaaguugguaaaccuu

SEQ ID NO: 501755 - RNA, 19 nt, Homo sapiens
cucaauaccugaagcuauc

SEQ ID NO: 501756 - RNA, 19 nt, Homo sapiens
gaaaccaguuaggucucaa

SEQ ID NO: 501757 - RNA, 19 nt, Homo sapiens
uuuaagagacagccaacua

SEQ ID NO: 501758 - RNA, 19 nt, Homo sapiens
gcguuucuccgaagcaugu

SEQ ID NO: 501759 - RNA, 19 nt, Homo sapiens
gggagaagcuguccaccua

SEQ ID NO: 501760 - RNA, 19 nt, Homo sapiens
ggaaauugacggauaauau

SEQ ID NO: 501761 - RNA, 19 nt, Homo sapiens
ggacugcccucucgacugu

SEQ ID NO: 501762 - RNA, 19 nt, Homo sapiens
aaacagauaugcaaagagu

SEQ ID NO: 501763 - RNA, 19 nt, Homo sapiens
guagaagacccggguauua

SEQ ID NO: 501764 - RNA, 19 nt, Homo sapiens
ccaaagcaguagcugaauu

SEQ ID NO: 501765 - RNA, 19 nt, Homo sapiens
caaagcaguagcugaauuu

SEQ ID NO: 501766 - RNA, 19 nt, Homo sapiens
guauuaacaucccagauca

SEQ ID NO: 501767 - RNA, 19 nt, Homo sapiens
gaaaaugcuuuggaaauug

SEQ ID NO: 501768 - RNA, 19 nt, Homo sapiens
ccagaucaaacuguaauua

SEQ ID NO: 501769 - RNA, 19 nt, Homo sapiens
caucccagaucaaacugua

SEQ ID NO: 501770 - RNA, 19 nt, Homo sapiens
uagaagacccggguauuaa

SEQ ID NO: 501771 - RNA, 19 nt, Homo sapiens
ggagaagcacagaaaguga

SEQ ID NO: 501772 - RNA, 19 nt, Homo sapiens
ggugacagcuccgggauca

SEQ ID NO: 501773 - RNA, 19 nt, Homo sapiens
uaacaaggacaaccucuuc

SEQ ID NO: 501774 - RNA, 19 nt, Homo sapiens
ggaggucccgcauguagaa

SEQ ID NO: 501775 - RNA, 19 nt, Homo sapiens
cgaauuuccugccaaagca

SEQ ID NO: 501776 - RNA, 19 nt, Homo sapiens
aaauguaccucagcaacaa

SEQ ID NO: 501777 - RNA, 19 nt, Homo sapiens
caaaacagauaugcaaaga

SEQ ID NO: 501778 - RNA, 19 nt, Homo sapiens
gguauuaacaucccagauc

SEQ ID NO: 501779 - RNA, 19 nt, Homo sapiens
uaacaucccagaucaaacu

SEQ ID NO: 501780 - RNA, 19 nt, Homo sapiens
gaggaggucccgcauguag

SEQ ID NO: 501781 - RNA, 19 nt, Homo sapiens
ccaccuagccagggacuuu

SEQ ID NO: 501782 - RNA, 19 nt, Homo sapiens
aaauggaggaagaucuuua

SEQ ID NO: 501783 - RNA, 19 nt, Homo sapiens
gaagacccggguauuaaca

SEQ ID NO: 501784 - RNA, 19 nt, Homo sapiens
gaggagaagcacagaaagu

SEQ ID NO: 501785 - RNA, 19 nt, Homo sapiens
ccaaugagcaagugacaag

SEQ ID NO: 501786 - RNA, 19 nt, Homo sapiens
ucgaggaggucccgcaugu

SEQ ID NO: 501787 - RNA, 19 nt, Homo sapiens
gcugggcacuguaggucaa

SEQ ID NO: 501788 - RNA, 19 nt, Homo sapiens
gcagugacaaagaggagaa

SEQ ID NO: 501789 - RNA, 19 nt, Homo sapiens
cuuuggaaauugacggaua

SEQ ID NO: 501790 - RNA, 19 nt, Homo sapiens
uuuggaaauugacggauaa

SEQ ID NO: 501791 - RNA, 19 nt, Homo sapiens
caaaagcagugacaaagag

SEQ ID NO: 501792 - RNA, 19 nt, Homo sapiens
aagaggagaagcacagaaa

SEQ ID NO: 501793 - RNA, 19 nt, Homo sapiens
gcucacaucacuaguagag

SEQ ID NO: 501794 - RNA, 19 nt, Homo sapiens
ucuccgccaucccuauuaa

SEQ ID NO: 501795 - RNA, 19 nt, Homo sapiens
acagauaugcaaagaguuc

SEQ ID NO: 501796 - RNA, 19 nt, Homo sapiens
aaccgaauuuccugccaaa

SEQ ID NO: 501797 - RNA, 19 nt, Homo sapiens
cguaaagcugccaacguua

SEQ ID NO: 501798 - RNA, 19 nt, Homo sapiens
aauggaggaagaucuuuaa

SEQ ID NO: 501799 - RNA, 19 nt, Homo sapiens
ccucaaggccauggacaaa

SEQ ID NO: 501800 - RNA, 19 nt, Homo sapiens
augagcaagugacaagaaa

SEQ ID NO: 501801 - RNA, 19 nt, Homo sapiens
cgccaucccuauuaacaag

SEQ ID NO: 501802 - RNA, 19 nt, Homo sapiens
ucagcuccaccucgaagua

SEQ ID NO: 501803 - RNA, 19 nt, Homo sapiens
cccagucgcaagauccuua

SEQ ID NO: 501804 - RNA, 19 nt, Homo sapiens
ccaugaaaaugcuuuggaa

SEQ ID NO: 501805 - RNA, 19 nt, Homo sapiens
ugccaaagcaguagcugaa

SEQ ID NO: 501806 - RNA, 19 nt, Homo sapiens
ucacgccgauccaugaaaa

SEQ ID NO: 501807 - RNA, 19 nt, Homo sapiens
ucaaggccauggacaaaau

SEQ ID NO: 501808 - RNA, 19 nt, Homo sapiens
cugcucacaucacuaguag

SEQ ID NO: 501809 - RNA, 19 nt, Homo sapiens
gcucucaccacccgagugu

SEQ ID NO: 501810 - RNA, 19 nt, Homo sapiens
caaagaggagaagcacaga

SEQ ID NO: 501811 - RNA, 19 nt, Homo sapiens
ccaucccuauuaacaagga

SEQ ID NO: 501812 - RNA, 19 nt, Homo sapiens
acaugcuccuggcuacaaa

SEQ ID NO: 501813 - RNA, 19 nt, Homo sapiens
cgugugcgaaaccgaauuu

SEQ ID NO: 501814 - RNA, 19 nt, Homo sapiens
ccugcucacaucacuagua

SEQ ID NO: 501815 - RNA, 19 nt, Homo sapiens
aggagaagcuguucacuua

SEQ ID NO: 501816 - RNA, 19 nt, Homo sapiens
ggaccagucugucauuaaa

SEQ ID NO: 501817 - RNA, 19 nt, Homo sapiens
caaaguaacugugggagaa

SEQ ID NO: 501818 - RNA, 19 nt, Homo sapiens
ccaaagccgucucugagua

SEQ ID NO: 501819 - RNA, 19 nt, Homo sapiens
ucacggcccugcagaacua

SEQ ID NO: 501820 - RNA, 19 nt, Homo sapiens
gcaaaugucacguuacuca

SEQ ID NO: 501821 - RNA, 19 nt, Homo sapiens
gaccugcacucccgaaaga

SEQ ID NO: 501822 - RNA, 19 nt, Homo sapiens
ccaaaucggugacuucucu

SEQ ID NO: 501823 - RNA, 19 nt, Homo sapiens
cagaagagccaaaucgaaa

SEQ ID NO: 501824 - RNA, 19 nt, Homo sapiens
ugacuucucuaaugaugaa

SEQ ID NO: 501825 - RNA, 19 nt, Homo sapiens
gagaaacacaggaaaugaa

SEQ ID NO: 501826 - RNA, 19 nt, Homo sapiens
guacgaagauaucuaugag

SEQ ID NO: 501827 - RNA, 19 nt, Homo sapiens
ucaaaggcauggacaagau

SEQ ID NO: 501828 - RNA, 19 nt, Homo sapiens
ggagaaacacaggaaauga

SEQ ID NO: 501829 - RNA, 19 nt, Homo sapiens
ccaccaagcaacuuuguaa

SEQ ID NO: 501830 - RNA, 19 nt, Homo sapiens
gaagacguccagucaguug

SEQ ID NO: 501831 - RNA, 19 nt, Homo sapiens
ucuggaagcuuguggagaa

SEQ ID NO: 501832 - RNA, 19 nt, Homo sapiens
ggaagcuuguggagaaugu

SEQ ID NO: 501833 - RNA, 19 nt, Homo sapiens
ggaaggcccagguaguaaa

SEQ ID NO: 501834 - RNA, 19 nt, Homo sapiens
caaguacgaagauaucuau

SEQ ID NO: 501835 - RNA, 19 nt, Homo sapiens
ugaacaacaccaccacuaa

SEQ ID NO: 501836 - RNA, 19 nt, Homo sapiens
cagcaaaugucacguuacu

SEQ ID NO: 501837 - RNA, 19 nt, Homo sapiens
agaccaggcugccaucaug

SEQ ID NO: 501838 - RNA, 19 nt, Homo sapiens
gcgcaaagcagcaaauguc

SEQ ID NO: 501839 - RNA, 19 nt, Homo sapiens
gaacaacaccaccacuaac

SEQ ID NO: 501840 - RNA, 19 nt, Homo sapiens
gagaagcuguucacuuagc

SEQ ID NO: 501841 - RNA, 19 nt, Homo sapiens
ggugacuucucuaaugaug

SEQ ID NO: 501842 - RNA, 19 nt, Homo sapiens
ucacuuagcuagggauuuu

SEQ ID NO: 501843 - RNA, 19 nt, Homo sapiens
gaggagaaacacaggaaau

SEQ ID NO: 501844 - RNA, 19 nt, Homo sapiens
ucggugacuucucuaauga

SEQ ID NO: 501845 - RNA, 19 nt, Homo sapiens
agaaacacaggaaaugaaa

SEQ ID NO: 501846 - RNA, 19 nt, Homo sapiens
gggagaucuuugcgagaaa

SEQ ID NO: 501847 - RNA, 19 nt, Homo sapiens
uggagaaugucaaguacga

SEQ ID NO: 501848 - RNA, 19 nt, Homo sapiens
caaagccgucucugaguau

SEQ ID NO: 501849 - RNA, 19 nt, Homo sapiens
ggaggcaugucugucaaca

SEQ ID NO: 501850 - RNA, 19 nt, Homo sapiens
gggaaggcccagguaguaa

SEQ ID NO: 501851 - RNA, 19 nt, Homo sapiens
uaacagcggcaugaaucua

SEQ ID NO: 501852 - RNA, 19 nt, Homo sapiens
ggaggagaaacacaggaaa

SEQ ID NO: 501853 - RNA, 19 nt, Homo sapiens
gaaugucaaguacgaagau

SEQ ID NO: 501854 - RNA, 19 nt, Homo sapiens
agcagcaaaugucacguua

SEQ ID NO: 501855 - RNA, 19 nt, Homo sapiens
caguugaagaugccaauaa

SEQ ID NO: 501856 - RNA, 19 nt, Homo sapiens
guuugucucugcucaguuc

SEQ ID NO: 501857 - RNA, 19 nt, Homo sapiens
gccaauaacagcggcauga

SEQ ID NO: 501858 - RNA, 19 nt, Homo sapiens
ggaagacguccagucaguu

SEQ ID NO: 501859 - RNA, 19 nt, Homo sapiens
ucagaagagccaaaucgaa

SEQ ID NO: 501860 - RNA, 19 nt, Homo sapiens
caauaacagcggcaugaau

SEQ ID NO: 501861 - RNA, 19 nt, Homo sapiens
ucaaguacgaagauaucua

SEQ ID NO: 501862 - RNA, 19 nt, Homo sapiens
ccgaaagaauaugcuguug

SEQ ID NO: 501863 - RNA, 19 nt, Homo sapiens
ggacaccgauagggaacag

SEQ ID NO: 501864 - RNA, 19 nt, Homo sapiens
cgaaguacaaaguaacugu

SEQ ID NO: 501865 - RNA, 19 nt, Homo sapiens
aauaacagcggcaugaauc

SEQ ID NO: 501866 - RNA, 19 nt, Homo sapiens
gcgacaaggaggagaaaca

SEQ ID NO: 501867 - RNA, 19 nt, Homo sapiens
caaaggcauggacaagaug

SEQ ID NO: 501868 - RNA, 19 nt, Homo sapiens
gcaggaccggacaccgaua

SEQ ID NO: 501869 - RNA, 19 nt, Homo sapiens
ggaaggagaagcuguucac

SEQ ID NO: 501870 - RNA, 19 nt, Homo sapiens
ggggagaucuuugcgagaa

SEQ ID NO: 501871 - RNA, 19 nt, Homo sapiens
cggacgugcugcugcauuc

SEQ ID NO: 501872 - RNA, 19 nt, Homo sapiens
aaugucaaguacgaagaua

SEQ ID NO: 501873 - RNA, 19 nt, Homo sapiens
acagcggcaugaaucuauu

SEQ ID NO: 501874 - RNA, 19 nt, Homo sapiens
caacggcagcggcaagaag

SEQ ID NO: 501875 - RNA, 19 nt, Homo sapiens
gguggaaggagaagcuguu

SEQ ID NO: 501876 - RNA, 19 nt, Homo sapiens
ggagaagcuguucacuuag

SEQ ID NO: 501877 - RNA, 19 nt, Homo sapiens
ccaauaacagcggcaugaa

SEQ ID NO: 501878 - RNA, 19 nt, Homo sapiens
gcucaaaggcauggacaag

SEQ ID NO: 501879 - RNA, 19 nt, Homo sapiens
agagcugccucacgcacuu

SEQ ID NO: 501880 - RNA, 19 nt, Homo sapiens
uuggaccagucugucauua

SEQ ID NO: 501881 - RNA, 19 nt, Homo sapiens
caccaagcaacuuuguaaa

SEQ ID NO: 501882 - RNA, 19 nt, Homo sapiens
cugcacucccgaaagaaua

SEQ ID NO: 501883 - RNA, 19 nt, Homo sapiens
aaagccgucucugaguauu

SEQ ID NO: 501884 - RNA, 19 nt, Homo sapiens
cggcggaguccucagaaga

SEQ ID NO: 501885 - RNA, 19 nt, Homo sapiens
ucaccgaggcgcucaaagg

SEQ ID NO: 501886 - RNA, 19 nt, Homo sapiens
ggagaaugucaaguacgaa

SEQ ID NO: 501887 - RNA, 19 nt, Homo sapiens
aaggagaagcuguucacuu

SEQ ID NO: 501888 - RNA, 19 nt, Homo sapiens
aguacgaagauaucuauga

SEQ ID NO: 501889 - RNA, 19 nt, Homo sapiens
gaaaugacauguucccuua

SEQ ID NO: 501890 - RNA, 19 nt, Homo sapiens
caacagacccacacacuua

SEQ ID NO: 501891 - RNA, 19 nt, Homo sapiens
gcaauaacuuugucucguu

SEQ ID NO: 501892 - RNA, 19 nt, Homo sapiens
gacaaguacuggcucuuua

SEQ ID NO: 501893 - RNA, 19 nt, Homo sapiens
gcgcugagcuaucuccuaa

SEQ ID NO: 501894 - RNA, 19 nt, Homo sapiens
gggaagaguuuguuaccua

SEQ ID NO: 501895 - RNA, 19 nt, Homo sapiens
guaaaccaguggcagaaua

SEQ ID NO: 501896 - RNA, 19 nt, Homo sapiens
guuaauaagugguaucuga

SEQ ID NO: 501897 - RNA, 19 nt, Homo sapiens
caaagguucuaucugcuua

SEQ ID NO: 501898 - RNA, 19 nt, Homo sapiens
gaagccugcugauugauuu

SEQ ID NO: 501899 - RNA, 19 nt, Homo sapiens
gagaucaaguccucuggua

SEQ ID NO: 501900 - RNA, 19 nt, Homo sapiens
ccaaauaauuguugugugu

SEQ ID NO: 501901 - RNA, 19 nt, Homo sapiens
ggauuuaacuggcgacugu

SEQ ID NO: 501902 - RNA, 19 nt, Homo sapiens
ugagcuaucuccuaacuuu

SEQ ID NO: 501903 - RNA, 19 nt, Homo sapiens
uaaagagccuucacugguu

SEQ ID NO: 501904 - RNA, 19 nt, Homo sapiens
gaagccgaauuuccuagua

SEQ ID NO: 501905 - RNA, 19 nt, Homo sapiens
aaacgaagccugcugauug

SEQ ID NO: 501906 - RNA, 19 nt, Homo sapiens
cgacaugccucaccagaug

SEQ ID NO: 501907 - RNA, 19 nt, Homo sapiens
gggagacucuuugaaauga

SEQ ID NO: 501908 - RNA, 19 nt, Homo sapiens
gagaaacacaggaaauaaa

SEQ ID NO: 501909 - RNA, 19 nt, Homo sapiens
gaaagccgcucaugugacu

SEQ ID NO: 501910 - RNA, 19 nt, Homo sapiens
gaaaguggugcuauaaguu

SEQ ID NO: 501911 - RNA, 19 nt, Homo sapiens
ggagaaacacaggaaauaa

SEQ ID NO: 501912 - RNA, 19 nt, Homo sapiens
uuaagguacugaagcuuua

SEQ ID NO: 501913 - RNA, 19 nt, Homo sapiens
gcaacuguguaaagaauuc

SEQ ID NO: 501914 - RNA, 19 nt, Homo sapiens
uuucagauguuucgaguaa

SEQ ID NO: 501915 - RNA, 19 nt, Homo sapiens
cagaacugcuugucucauu

SEQ ID NO: 501916 - RNA, 19 nt, Homo sapiens
gguaaucuauaacacauca

SEQ ID NO: 501917 - RNA, 19 nt, Homo sapiens
gacaugggauccaauuuua

SEQ ID NO: 501918 - RNA, 19 nt, Homo sapiens
guaaagaauucacagaacu

SEQ ID NO: 501919 - RNA, 19 nt, Homo sapiens
gggagaaguuggacaagau

SEQ ID NO: 501920 - RNA, 19 nt, Homo sapiens
cagaagagccaaaucgaaa

SEQ ID NO: 501921 - RNA, 19 nt, Homo sapiens
ccguggagguucuguauuu

SEQ ID NO: 501922 - RNA, 19 nt, Homo sapiens
ggacuuugccuaugucugu

SEQ ID NO: 501923 - RNA, 19 nt, Homo sapiens
acacuggagucgccgaaua

SEQ ID NO: 501924 - RNA, 19 nt, Homo sapiens
ugaaaguggugcuauaagu

SEQ ID NO: 501925 - RNA, 19 nt, Homo sapiens
cagcaacuguguaaagaau

SEQ ID NO: 501926 - RNA, 19 nt, Homo sapiens
gugcacuucuuacgacuuu

SEQ ID NO: 501927 - RNA, 19 nt, Homo sapiens
gaaggaacaggacugcaaa

SEQ ID NO: 501928 - RNA, 19 nt, Homo sapiens
ggaaggaacaggacugcaa

SEQ ID NO: 501929 - RNA, 19 nt, Homo sapiens
gcagaacuacaucaaagaa

SEQ ID NO: 501930 - RNA, 19 nt, Homo sapiens
ccaccugaaugcuuaaaug

SEQ ID NO: 501931 - RNA, 19 nt, Homo sapiens
uaaccgauaaugucaagua

SEQ ID NO: 501932 - RNA, 19 nt, Homo sapiens
ggaaacuuguagaaacgaa

SEQ ID NO: 501933 - RNA, 19 nt, Homo sapiens
gaaaauaaccgauaauguc

SEQ ID NO: 501934 - RNA, 19 nt, Homo sapiens
gcaaaggucccauuuccau

SEQ ID NO: 501935 - RNA, 19 nt, Homo sapiens
ugaacucucugccuguaaa

SEQ ID NO: 501936 - RNA, 19 nt, Homo sapiens
uaucagaaggugacaagua

SEQ ID NO: 501937 - RNA, 19 nt, Homo sapiens
gaaacgaagccugcugauu

SEQ ID NO: 501938 - RNA, 19 nt, Homo sapiens
ccacacacuuagccauuga

SEQ ID NO: 501939 - RNA, 19 nt, Homo sapiens
gacaguggcugaaguacag

SEQ ID NO: 501940 - RNA, 19 nt, Homo sapiens
gcuuggaagauucuauuua

SEQ ID NO: 501941 - RNA, 19 nt, Homo sapiens
auagacaaauccuacauga

SEQ ID NO: 501942 - RNA, 19 nt, Homo sapiens
augcuuaaaugccucguua

SEQ ID NO: 501943 - RNA, 19 nt, Homo sapiens
ccauuuccaugaccaagaa

SEQ ID NO: 501944 - RNA, 19 nt, Homo sapiens
gaaacagugcguugagugu

SEQ ID NO: 501945 - RNA, 19 nt, Homo sapiens
gcaaagguucuaucugcuu

SEQ ID NO: 501946 - RNA, 19 nt, Homo sapiens
caaagaagcccugauuguc

SEQ ID NO: 501947 - RNA, 19 nt, Homo sapiens
ucaaagaagcccugauugu

SEQ ID NO: 501948 - RNA, 19 nt, Homo sapiens
gaugugcccuagaucaaca

SEQ ID NO: 501949 - RNA, 19 nt, Homo sapiens
aaaguggugcuauaaguuu

SEQ ID NO: 501950 - RNA, 19 nt, Homo sapiens
aaccagaccucaucuugga

SEQ ID NO: 501951 - RNA, 19 nt, Homo sapiens
gacaagaucggguugaauc

SEQ ID NO: 501952 - RNA, 19 nt, Homo sapiens
gacauguucccuuaaggua

SEQ ID NO: 501953 - RNA, 19 nt, Homo sapiens
aaauugaugugcccuagau

SEQ ID NO: 501954 - RNA, 19 nt, Homo sapiens
aaagaagcccugauuguca

SEQ ID NO: 501955 - RNA, 19 nt, Homo sapiens
gaacugcuugucucauuuc

SEQ ID NO: 501956 - RNA, 19 nt, Homo sapiens
ccgauaaugucaaguacga

SEQ ID NO: 501957 - RNA, 19 nt, Homo sapiens
aagccgaauuuccuaguaa

SEQ ID NO: 501958 - RNA, 19 nt, Homo sapiens
uuaggaaacuuguagaaac

SEQ ID NO: 501959 - RNA, 19 nt, Homo sapiens
cuucuuaguuguuucucua

SEQ ID NO: 501960 - RNA, 19 nt, Homo sapiens
agaacugcuugucucauuu

SEQ ID NO: 501961 - RNA, 19 nt, Homo sapiens
ucauuuggcuagggacuuu

SEQ ID NO: 501962 - RNA, 19 nt, Homo sapiens
gccgaugcguguccaguga

SEQ ID NO: 501963 - RNA, 19 nt, Homo sapiens
gcuuagcaacuaguuaaua

SEQ ID NO: 501964 - RNA, 19 nt, Homo sapiens
uuaagguaaugguugguuu

SEQ ID NO: 501965 - RNA, 19 nt, Homo sapiens
agacaaauccuacaugaac

SEQ ID NO: 501966 - RNA, 19 nt, Homo sapiens
guucagaaagcaauaacuu

SEQ ID NO: 501967 - RNA, 19 nt, Homo sapiens
aacgaagccugcugauuga

SEQ ID NO: 501968 - RNA, 19 nt, Homo sapiens
ucagcucuacgucuaaaua

SEQ ID NO: 501969 - RNA, 19 nt, Homo sapiens
guacugaagcuuuauuugc

SEQ ID NO: 501970 - RNA, 19 nt, Homo sapiens
gagacucuuugaaaugaca

SEQ ID NO: 501971 - RNA, 19 nt, Homo sapiens
ugacaaguacuggcucuuu

SEQ ID NO: 501972 - RNA, 19 nt, Homo sapiens
gcugagcuaucuccuaacu

SEQ ID NO: 501973 - RNA, 19 nt, Homo sapiens
acaaaacccuggagaaaau

SEQ ID NO: 501974 - RNA, 19 nt, Homo sapiens
uggacgaggugcagaaugu

SEQ ID NO: 501975 - RNA, 19 nt, Homo sapiens
aguagaaggugaagcuguu

SEQ ID NO: 501976 - RNA, 19 nt, Homo sapiens
ccugacauccuuaguagaa

SEQ ID NO: 501977 - RNA, 19 nt, Homo sapiens
gcucuacgucuaaauacaa

SEQ ID NO: 501978 - RNA, 19 nt, Homo sapiens
guaaauguuccccaaauaa

SEQ ID NO: 501979 - RNA, 19 nt, Homo sapiens
uaauugaaacucucuguuc

SEQ ID NO: 501980 - RNA, 19 nt, Homo sapiens
uggagaaacacaggaaaua

SEQ ID NO: 501981 - RNA, 19 nt, Homo sapiens
gaccagaguccagcugauu

SEQ ID NO: 501982 - RNA, 19 nt, Homo sapiens
cugcagaacuacaucaaag

SEQ ID NO: 501983 - RNA, 19 nt, Homo sapiens
agacgaacauacagaacug

SEQ ID NO: 501984 - RNA, 19 nt, Homo sapiens
aaugggagacucuuugaaa

SEQ ID NO: 501985 - RNA, 19 nt, Homo sapiens
guguguaucuagcuucuuc

SEQ ID NO: 501986 - RNA, 19 nt, Homo sapiens
gugaugggguaaucuauaa

SEQ ID NO: 501987 - RNA, 19 nt, Homo sapiens
uguaaauacuggugcacuu

SEQ ID NO: 501988 - RNA, 19 nt, Homo sapiens
uaucuagcuucuucagaga

SEQ ID NO: 501989 - RNA, 19 nt, Homo sapiens
ggacaaggacgaaggcaua

SEQ ID NO: 501990 - RNA, 19 nt, Homo sapiens
gcgaaugagugagaaauuu

SEQ ID NO: 501991 - RNA, 19 nt, Homo sapiens
ucaaggagaagcuauuaua

SEQ ID NO: 501992 - RNA, 19 nt, Homo sapiens
ggagagacaugggcgaaug

SEQ ID NO: 501993 - RNA, 19 nt, Homo sapiens
ggauuuccaucuugcauuc

SEQ ID NO: 501994 - RNA, 19 nt, Homo sapiens
gaaggugcccucuuugcaa

SEQ ID NO: 501995 - RNA, 19 nt, Homo sapiens
cgaucgcuauggaguauuu

SEQ ID NO: 501996 - RNA, 19 nt, Homo sapiens
caaggagaagcuauuauau

SEQ ID NO: 501997 - RNA, 19 nt, Homo sapiens
cucagaaggugcccucuuu

SEQ ID NO: 501998 - RNA, 19 nt, Homo sapiens
gcagacagccgaguacauc

SEQ ID NO: 501999 - RNA, 19 nt, Homo sapiens
guucaaggagaagcuauua

SEQ ID NO: 502000 - RNA, 19 nt, Homo sapiens
gcaaacacacacacacaca

SEQ ID NO: 502001 - RNA, 19 nt, Homo sapiens
acacacacacacacacaua

SEQ ID NO: 502002 - RNA, 19 nt, Homo sapiens
ggauuccagucccucaaga

SEQ ID NO: 502003 - RNA, 19 nt, Homo sapiens
uaaaucgaccuuugaacga

SEQ ID NO: 502004 - RNA, 19 nt, Homo sapiens
gacaugggcgaaugaguga

SEQ ID NO: 502005 - RNA, 19 nt, Homo sapiens
gccgaucgcuauggaguau

SEQ ID NO: 502006 - RNA, 19 nt, Homo sapiens
ccacacagacggagagaag

SEQ ID NO: 502007 - RNA, 19 nt, Homo sapiens
aaaucgaccuuugaacgaa

SEQ ID NO: 502008 - RNA, 19 nt, Homo sapiens
gagagacaugggcgaauga

SEQ ID NO: 502009 - RNA, 19 nt, Homo sapiens
gcccacauguacccggaaa

SEQ ID NO: 502010 - RNA, 19 nt, Homo sapiens
gaacagggaaaauuaaaca

SEQ ID NO: 502011 - RNA, 19 nt, Homo sapiens
ucaacucuguuuccacauc

SEQ ID NO: 502012 - RNA, 19 nt, Homo sapiens
gaaaacagagaaagaagug

SEQ ID NO: 502013 - RNA, 19 nt, Homo sapiens
caucucggcacuagaauuc

SEQ ID NO: 502014 - RNA, 19 nt, Homo sapiens
gauucggauuuccaucuug

SEQ ID NO: 502015 - RNA, 19 nt, Homo sapiens
aaacagagaaagaagugau

SEQ ID NO: 502016 - RNA, 19 nt, Homo sapiens
ggcgagcugucaucgugaa

SEQ ID NO: 502017 - RNA, 19 nt, Homo sapiens
gagcaucaacgcgggauuc

SEQ ID NO: 502018 - RNA, 19 nt, Homo sapiens
cggaaaagcucaaggugau

SEQ ID NO: 502019 - RNA, 19 nt, Homo sapiens
ggcgaaugagugagaaauu

SEQ ID NO: 502020 - RNA, 19 nt, Homo sapiens
gcucagcaaggcagccauu

SEQ ID NO: 502021 - RNA, 19 nt, Homo sapiens
ugauucggauuuccaucuu

SEQ ID NO: 502022 - RNA, 19 nt, Homo sapiens
uacuguaaaucgaccuuug

SEQ ID NO: 502023 - RNA, 19 nt, Homo sapiens
gcuggaggcccacauguac

SEQ ID NO: 502024 - RNA, 19 nt, Homo sapiens
gcagaacacacagcucaag

SEQ ID NO: 502025 - RNA, 19 nt, Homo sapiens
agagaaagaagugauagga

SEQ ID NO: 502026 - RNA, 19 nt, Homo sapiens
gaaaagcucaaggugauug

SEQ ID NO: 502027 - RNA, 19 nt, Homo sapiens
aaacacacacacacacaca

SEQ ID NO: 502028 - RNA, 19 nt, Homo sapiens
aaaugucugucucucucuu

SEQ ID NO: 502029 - RNA, 19 nt, Homo sapiens
ggcaaaaucuggacaccau

SEQ ID NO: 502030 - RNA, 19 nt, Homo sapiens
gugauaggagggcucugua

SEQ ID NO: 502031 - RNA, 19 nt, Homo sapiens
gcccuuugauucggauuuc

SEQ ID NO: 502032 - RNA, 19 nt, Homo sapiens
ucuguagccuugccaacau

SEQ ID NO: 502033 - RNA, 19 nt, Homo sapiens
ucauuugggucucuuuuau

SEQ ID NO: 502034 - RNA, 19 nt, Homo sapiens
aacagagaaagaagugaua

SEQ ID NO: 502035 - RNA, 19 nt, Homo sapiens
cgaaugagugagaaauuuu

SEQ ID NO: 502036 - RNA, 19 nt, Homo sapiens
ccucggucaucaacucugu

SEQ ID NO: 502037 - RNA, 19 nt, Homo sapiens
gacagccgaguacaucuuc

SEQ ID NO: 502038 - RNA, 19 nt, Homo sapiens
ggaauugugugauguuuaa

SEQ ID NO: 502039 - RNA, 19 nt, Homo sapiens
ggaauauacugagcacuua

SEQ ID NO: 502040 - RNA, 19 nt, Homo sapiens
gaaccgaccuggagacaga

SEQ ID NO: 502041 - RNA, 19 nt, Homo sapiens
gcaaauuggugaagaguau

SEQ ID NO: 502042 - RNA, 19 nt, Homo sapiens
ggacaucuguguuuauuca

SEQ ID NO: 502043 - RNA, 19 nt, Homo sapiens
gauggagacucaaauggua

SEQ ID NO: 502044 - RNA, 19 nt, Homo sapiens
agacagaauucuugacaua

SEQ ID NO: 502045 - RNA, 19 nt, Homo sapiens
gauaaccucuuaccaacaa

SEQ ID NO: 502046 - RNA, 19 nt, Homo sapiens
ggauaugaauggagauuug

SEQ ID NO: 502047 - RNA, 19 nt, Homo sapiens
gagaugaugugauccaaau

SEQ ID NO: 502048 - RNA, 19 nt, Homo sapiens
gaggaaacaugguggagaa

SEQ ID NO: 502049 - RNA, 19 nt, Homo sapiens
gcacagaguucacuaugag

SEQ ID NO: 502050 - RNA, 19 nt, Homo sapiens
gaggacaucuguguuuauu

SEQ ID NO: 502051 - RNA, 19 nt, Homo sapiens
caaggacagucuuaugaaa

SEQ ID NO: 502052 - RNA, 19 nt, Homo sapiens
gugaugagaugauacagaa

SEQ ID NO: 502053 - RNA, 19 nt, Homo sapiens
gauggugcguccaagguua

SEQ ID NO: 502054 - RNA, 19 nt, Homo sapiens
gcagauggaaucagacuuu

SEQ ID NO: 502055 - RNA, 19 nt, Homo sapiens
gcaaagaggacaucugugu

SEQ ID NO: 502056 - RNA, 19 nt, Homo sapiens
gaaacgaacaccucaugaa

SEQ ID NO: 502057 - RNA, 19 nt, Homo sapiens
gcccaaaggugcagacaga

SEQ ID NO: 502058 - RNA, 19 nt, Homo sapiens
ggagaacuuccagaaauua

SEQ ID NO: 502059 - RNA, 19 nt, Homo sapiens
gaagaagcauguuuuauuc

SEQ ID NO: 502060 - RNA, 19 nt, Homo sapiens
caacucaacuaaauacagu

SEQ ID NO: 502061 - RNA, 19 nt, Homo sapiens
cguccaagguuaaccauuu

SEQ ID NO: 502062 - RNA, 19 nt, Homo sapiens
agucacagauaaccucuua

SEQ ID NO: 502063 - RNA, 19 nt, Homo sapiens
ggaccuuguuguuguuaaa

SEQ ID NO: 502064 - RNA, 19 nt, Homo sapiens
gagauuaguugugcacaga

SEQ ID NO: 502065 - RNA, 19 nt, Homo sapiens
ucacaaggcuuuucacaaa

SEQ ID NO: 502066 - RNA, 19 nt, Homo sapiens
gagaucacguaugucaaua

SEQ ID NO: 502067 - RNA, 19 nt, Homo sapiens
cagugaaacuccaugauga

SEQ ID NO: 502068 - RNA, 19 nt, Homo sapiens
guccaagguuaaccauuua

SEQ ID NO: 502069 - RNA, 19 nt, Homo sapiens
ucaccuggcuucaacaguu

SEQ ID NO: 502070 - RNA, 19 nt, Homo sapiens
acaaauagauaccuucaag

SEQ ID NO: 502071 - RNA, 19 nt, Homo sapiens
gaaccugacucgucugacu

SEQ ID NO: 502072 - RNA, 19 nt, Homo sapiens
gaaauucgaaugcuagaca

SEQ ID NO: 502073 - RNA, 19 nt, Homo sapiens
gauauggagcccuguaauu

SEQ ID NO: 502074 - RNA, 19 nt, Homo sapiens
acagauuacugcccaauau

SEQ ID NO: 502075 - RNA, 19 nt, Homo sapiens
ggaagaagcauguuuuauu

SEQ ID NO: 502076 - RNA, 19 nt, Homo sapiens
gaacuuccagaaauuaaug

SEQ ID NO: 502077 - RNA, 19 nt, Homo sapiens
gcuaucauaucauacugaa

SEQ ID NO: 502078 - RNA, 19 nt, Homo sapiens
aaacgaacaccucaugaaa

SEQ ID NO: 502079 - RNA, 19 nt, Homo sapiens
gcauaaugaugaugggaau

SEQ ID NO: 502080 - RNA, 19 nt, Homo sapiens
aauaucagccuuccuauga

SEQ ID NO: 502081 - RNA, 19 nt, Homo sapiens
agaaauaucagccuuccua

SEQ ID NO: 502082 - RNA, 19 nt, Homo sapiens
gcagugaaacuccaugaug

SEQ ID NO: 502083 - RNA, 19 nt, Homo sapiens
ugagugauguccuugcauu

SEQ ID NO: 502084 - RNA, 19 nt, Homo sapiens
aaagaggacaucuguguuu

SEQ ID NO: 502085 - RNA, 19 nt, Homo sapiens
gcuaauccaacucaacuaa

SEQ ID NO: 502086 - RNA, 19 nt, Homo sapiens
gcaaagggguccucacguu

SEQ ID NO: 502087 - RNA, 19 nt, Homo sapiens
gguuaaccauuuauguuug

SEQ ID NO: 502088 - RNA, 19 nt, Homo sapiens
aagaggacaucuguguuua

SEQ ID NO: 502089 - RNA, 19 nt, Homo sapiens
gaugaaacccuaacguauc

SEQ ID NO: 502090 - RNA, 19 nt, Homo sapiens
gaguuugccuccugauaau

SEQ ID NO: 502091 - RNA, 19 nt, Homo sapiens
ucacguaugucaauaacuc

SEQ ID NO: 502092 - RNA, 19 nt, Homo sapiens
acagaauucuugacauaga

SEQ ID NO: 502093 - RNA, 19 nt, Homo sapiens
gagaacuuccagaaauuaa

SEQ ID NO: 502094 - RNA, 19 nt, Homo sapiens
cgaguuugccuccugauaa

SEQ ID NO: 502095 - RNA, 19 nt, Homo sapiens
gcuggugccuauagcauga

SEQ ID NO: 502096 - RNA, 19 nt, Homo sapiens
gugcaggacuuugaugcua

SEQ ID NO: 502097 - RNA, 19 nt, Homo sapiens
gagaaacgaacaccucaug

SEQ ID NO: 502098 - RNA, 19 nt, Homo sapiens
cagcagugguugcaucgaa

SEQ ID NO: 502099 - RNA, 19 nt, Homo sapiens
ggcccgagaucacguaugu

SEQ ID NO: 502100 - RNA, 19 nt, Homo sapiens
gcaagaagagucgaguuug

SEQ ID NO: 502101 - RNA, 19 nt, Homo sapiens
gcagaagcaugaggaugga

SEQ ID NO: 502102 - RNA, 19 nt, Homo sapiens
ugggaagucugcaguaguu

SEQ ID NO: 502103 - RNA, 19 nt, Homo sapiens
gggaauauacugagcacuu

SEQ ID NO: 502104 - RNA, 19 nt, Homo sapiens
agaaaccaaugauagcuau

SEQ ID NO: 502105 - RNA, 19 nt, Homo sapiens
gaucacguaugucaauaac

SEQ ID NO: 502106 - RNA, 19 nt, Homo sapiens
ggagacagaauucuugaca

SEQ ID NO: 502107 - RNA, 19 nt, Homo sapiens
aggacagucuuaugaaauu

SEQ ID NO: 502108 - RNA, 19 nt, Homo sapiens
caagaagagucgaguuugc

SEQ ID NO: 502109 - RNA, 19 nt, Homo sapiens
ggacagucuuaugaaauuc

SEQ ID NO: 502110 - RNA, 19 nt, Homo sapiens
gaaacuccaugaugaaacc

SEQ ID NO: 502111 - RNA, 19 nt, Homo sapiens
gggaauugugugauguuua

SEQ ID NO: 502112 - RNA, 19 nt, Homo sapiens
gaaagcagaaaccaaugau

SEQ ID NO: 502113 - RNA, 19 nt, Homo sapiens
acagauaaccucuuaccaa

SEQ ID NO: 502114 - RNA, 19 nt, Homo sapiens
agacaaccauacucacaga

SEQ ID NO: 502115 - RNA, 19 nt, Homo sapiens
uaggaaacuuggagaacuu

SEQ ID NO: 502116 - RNA, 19 nt, Homo sapiens
guccuugcauugcccauuu

SEQ ID NO: 502117 - RNA, 19 nt, Homo sapiens
uuaaauuucuggaccuugu

SEQ ID NO: 502118 - RNA, 19 nt, Homo sapiens
ccaaggguacgggagauua

SEQ ID NO: 502119 - RNA, 19 nt, Homo sapiens
gaugaugggaauuguguga

SEQ ID NO: 502120 - RNA, 19 nt, Homo sapiens
gaaauaucagccuuccuau

SEQ ID NO: 502121 - RNA, 19 nt, Homo sapiens
gaguacaaauagauaccuu

SEQ ID NO: 502122 - RNA, 19 nt, Homo sapiens
ggaagucugcaguaguuga

SEQ ID NO: 502123 - RNA, 19 nt, Homo sapiens
uagcaugagugauguccuu

SEQ ID NO: 502124 - RNA, 19 nt, Homo sapiens
aaugguacuuucuucguuu

SEQ ID NO: 502125 - RNA, 19 nt, Homo sapiens
agacucaaaugguacuuuc

SEQ ID NO: 502126 - RNA, 19 nt, Homo sapiens
uaucagccuuccuaugaga

SEQ ID NO: 502127 - RNA, 19 nt, Homo sapiens
ccaaaggugcagacagaaa

SEQ ID NO: 502128 - RNA, 19 nt, Homo sapiens
guacaaauagauaccuuca

SEQ ID NO: 502129 - RNA, 19 nt, Homo sapiens
gggaaaaggugcaaaagca

SEQ ID NO: 502130 - RNA, 19 nt, Homo sapiens
ucaaucaaggacagucuua

SEQ ID NO: 502131 - RNA, 19 nt, Homo sapiens
gagaugauacagaacuuuc

SEQ ID NO: 502132 - RNA, 19 nt, Homo sapiens
aaaugguacuuucuucguu

SEQ ID NO: 502133 - RNA, 19 nt, Homo sapiens
gccauuccgaguacaaaua

SEQ ID NO: 502134 - RNA, 19 nt, Homo sapiens
caggugcacuguauuagca

SEQ ID NO: 502135 - RNA, 19 nt, Homo sapiens
gaugggaauugugugaugu

SEQ ID NO: 502136 - RNA, 19 nt, Homo sapiens
gaauucaugugcucaucag

SEQ ID NO: 502137 - RNA, 19 nt, Homo sapiens
caaagaggacaucuguguu

SEQ ID NO: 502138 - RNA, 19 nt, Homo sapiens
gaaacucucauccgcgaua

SEQ ID NO: 502139 - RNA, 19 nt, Homo sapiens
ccaaagauauggcaauggu

SEQ ID NO: 502140 - RNA, 19 nt, Homo sapiens
gaguacagcugccucaaag

SEQ ID NO: 502141 - RNA, 19 nt, Homo sapiens
ucaaagccaucgugcuguu

SEQ ID NO: 502142 - RNA, 19 nt, Homo sapiens
guuagcagcuggcgagauc

SEQ ID NO: 502143 - RNA, 19 nt, Homo sapiens
gauauggcaaugguaguua

SEQ ID NO: 502144 - RNA, 19 nt, Homo sapiens
ucucauccgcgauauguua

SEQ ID NO: 502145 - RNA, 19 nt, Homo sapiens
gcccaaagauauggcaaug

SEQ ID NO: 502146 - RNA, 19 nt, Homo sapiens
aaaagaaccuugugucugu

SEQ ID NO: 502147 - RNA, 19 nt, Homo sapiens
caagaagugccucaaagug

SEQ ID NO: 502148 - RNA, 19 nt, Homo sapiens
agaaauacaauccgagcua

SEQ ID NO: 502149 - RNA, 19 nt, Homo sapiens
cgcaggaacuuaacuuaca

SEQ ID NO: 502150 - RNA, 19 nt, Homo sapiens
gcaugcagcccaacaacau

SEQ ID NO: 502151 - RNA, 19 nt, Homo sapiens
ccacccagcagaaauacaa

SEQ ID NO: 502152 - RNA, 19 nt, Homo sapiens
ucgagagccugcaggagaa

SEQ ID NO: 502153 - RNA, 19 nt, Homo sapiens
ggaacuuaacuuacacaug

SEQ ID NO: 502154 - RNA, 19 nt, Homo sapiens
gagcguccgcaggaacuua

SEQ ID NO: 502155 - RNA, 19 nt, Homo sapiens
ucagaucugugagcacguu

SEQ ID NO: 502156 - RNA, 19 nt, Homo sapiens
cgaguacagcugccucaaa

SEQ ID NO: 502157 - RNA, 19 nt, Homo sapiens
caaagauauggcaauggua

SEQ ID NO: 502158 - RNA, 19 nt, Homo sapiens
gcaggaacuuaacuuacac

SEQ ID NO: 502159 - RNA, 19 nt, Homo sapiens
ccaaccagcccagccguuu

SEQ ID NO: 502160 - RNA, 19 nt, Homo sapiens
ucaagaagugccucaaagu

SEQ ID NO: 502161 - RNA, 19 nt, Homo sapiens
caauacugccgccucaaga

SEQ ID NO: 502162 - RNA, 19 nt, Homo sapiens
caagcacuacggccaauuc

SEQ ID NO: 502163 - RNA, 19 nt, Homo sapiens
aauccgagcuacaaagcau

SEQ ID NO: 502164 - RNA, 19 nt, Homo sapiens
ggccuuacauguccaucca

SEQ ID NO: 502165 - RNA, 19 nt, Homo sapiens
ggaccacauccgcaucuuc

SEQ ID NO: 502166 - RNA, 19 nt, Homo sapiens
ugagcacguuggcgaggaa

SEQ ID NO: 502167 - RNA, 19 nt, Homo sapiens
ucaacuggccuuacauguc

SEQ ID NO: 502168 - RNA, 19 nt, Homo sapiens
ccucaagaagugccucaaa

SEQ ID NO: 502169 - RNA, 19 nt, Homo sapiens
cucaagaagugccucaaag

SEQ ID NO: 502170 - RNA, 19 nt, Homo sapiens
gcaagcacuacggccaauu

SEQ ID NO: 502171 - RNA, 19 nt, Homo sapiens
gcucuucuucguccguuug

SEQ ID NO: 502172 - RNA, 19 nt, Homo sapiens
ggcaagcacuacggccaau

SEQ ID NO: 502173 - RNA, 19 nt, Homo sapiens
augcagcccaacaacauua

SEQ ID NO: 502174 - RNA, 19 nt, Homo sapiens
aaacucucauccgcgauau

SEQ ID NO: 502175 - RNA, 19 nt, Homo sapiens
ccaauacugccgccucaag

SEQ ID NO: 502176 - RNA, 19 nt, Homo sapiens
guggaaagcuugcaggaaa

SEQ ID NO: 502177 - RNA, 19 nt, Homo sapiens
ggagcgagcuguuuguguu

SEQ ID NO: 502178 - RNA, 19 nt, Homo sapiens
gaagagaggggaagaauuu

SEQ ID NO: 502179 - RNA, 19 nt, Homo sapiens
agacugguuuguuugcuua

SEQ ID NO: 502180 - RNA, 19 nt, Homo sapiens
ccaacaacaucauggguau

SEQ ID NO: 502181 - RNA, 19 nt, Homo sapiens
ggagugaaacagagaaaga

SEQ ID NO: 502182 - RNA, 19 nt, Homo sapiens
acucguaccuguccggaua

SEQ ID NO: 502183 - RNA, 19 nt, Homo sapiens
gauguuacaaguuugcuaa

SEQ ID NO: 502184 - RNA, 19 nt, Homo sapiens
ggccguauauggcaauuca

SEQ ID NO: 502185 - RNA, 19 nt, Homo sapiens
guaccuguccggauauauu

SEQ ID NO: 502186 - RNA, 19 nt, Homo sapiens
agaauuuaauggacuguga

SEQ ID NO: 502187 - RNA, 19 nt, Homo sapiens
agucauagagcaauuguuu

SEQ ID NO: 502188 - RNA, 19 nt, Homo sapiens
ccaaccagccgacgagauu

SEQ ID NO: 502189 - RNA, 19 nt, Homo sapiens
ucagugugcuuuggaagaa

SEQ ID NO: 502190 - RNA, 19 nt, Homo sapiens
cagacaagccaucgacaaa

SEQ ID NO: 502191 - RNA, 19 nt, Homo sapiens
uuaauggacugugaauuuc

SEQ ID NO: 502192 - RNA, 19 nt, Homo sapiens
ugauguagcccauguggaa

SEQ ID NO: 502193 - RNA, 19 nt, Homo sapiens
cgagaacauuugcgaacug

SEQ ID NO: 502194 - RNA, 19 nt, Homo sapiens
gcaugcagcccaacaacau

SEQ ID NO: 502195 - RNA, 19 nt, Homo sapiens
ggaggaaccugagcuacac

SEQ ID NO: 502196 - RNA, 19 nt, Homo sapiens
gaauuuaauggacugugaa

SEQ ID NO: 502197 - RNA, 19 nt, Homo sapiens
gcuuaauuuccuucuguua

SEQ ID NO: 502198 - RNA, 19 nt, Homo sapiens
caucauggguaucgagaac

SEQ ID NO: 502199 - RNA, 19 nt, Homo sapiens
gagugaaacagagaaagaa

SEQ ID NO: 502200 - RNA, 19 nt, Homo sapiens
ccuguggucucucugaugu

SEQ ID NO: 502201 - RNA, 19 nt, Homo sapiens
caaguuugcuaaaagaaga

SEQ ID NO: 502202 - RNA, 19 nt, Homo sapiens
gccgagagaaacaaacaaa

SEQ ID NO: 502203 - RNA, 19 nt, Homo sapiens
cgucuccuccucagucaua

SEQ ID NO: 502204 - RNA, 19 nt, Homo sapiens
ccucagucauagagcaauu

SEQ ID NO: 502205 - RNA, 19 nt, Homo sapiens
cguauauggcaauucaaua

SEQ ID NO: 502206 - RNA, 19 nt, Homo sapiens
ucaaggccauaguccuguu

SEQ ID NO: 502207 - RNA, 19 nt, Homo sapiens
agugugcuuuggaagaaua

SEQ ID NO: 502208 - RNA, 19 nt, Homo sapiens
ucagaugccuguggucucu

SEQ ID NO: 502209 - RNA, 19 nt, Homo sapiens
gcucaaggcgcugcacguu

SEQ ID NO: 502210 - RNA, 19 nt, Homo sapiens
ccacauacggaucuuccaa

SEQ ID NO: 502211 - RNA, 19 nt, Homo sapiens
gcgagcuguuuguguugaa

SEQ ID NO: 502212 - RNA, 19 nt, Homo sapiens
gagccgagagaaacaaaca

SEQ ID NO: 502213 - RNA, 19 nt, Homo sapiens
aaaggauguuacaaguuug

SEQ ID NO: 502214 - RNA, 19 nt, Homo sapiens
ccaguacugccgccucaaa

SEQ ID NO: 502215 - RNA, 19 nt, Homo sapiens
gagcgagcuguuuguguug

SEQ ID NO: 502216 - RNA, 19 nt, Homo sapiens
cugguuuguuugcuuaauu

SEQ ID NO: 502217 - RNA, 19 nt, Homo sapiens
ccagacaagccaucgacaa

SEQ ID NO: 502218 - RNA, 19 nt, Homo sapiens
ucucugauguagcccaugu

SEQ ID NO: 502219 - RNA, 19 nt, Homo sapiens
uugcuuaauuuccuucugu

SEQ ID NO: 502220 - RNA, 19 nt, Homo sapiens
gacgagauucggaaagcuu

SEQ ID NO: 502221 - RNA, 19 nt, Homo sapiens
uaccuguccggauauauuu

SEQ ID NO: 502222 - RNA, 19 nt, Homo sapiens
ggauguuacaaguuugcua

SEQ ID NO: 502223 - RNA, 19 nt, Homo sapiens
ucauggguaucgagaacau

SEQ ID NO: 502224 - RNA, 19 nt, Homo sapiens
aagacugguuuguuugcuu

SEQ ID NO: 502225 - RNA, 19 nt, Homo sapiens
gcuuuggaagaauacguua

SEQ ID NO: 502226 - RNA, 19 nt, Homo sapiens
uagcccauguggaaagcuu

SEQ ID NO: 502227 - RNA, 19 nt, Homo sapiens
gauguagcccauguggaaa

SEQ ID NO: 502228 - RNA, 19 nt, Homo sapiens
gauauggcaaugguaguca

SEQ ID NO: 502229 - RNA, 19 nt, Homo sapiens
aaagcugagccgagagaaa

SEQ ID NO: 502230 - RNA, 19 nt, Homo sapiens
gaaagaaaaggcaaaagac

SEQ ID NO: 502231 - RNA, 19 nt, Homo sapiens
caagcacuacggccaguuc

SEQ ID NO: 502232 - RNA, 19 nt, Homo sapiens
acaaagcugagccgagaga

SEQ ID NO: 502233 - RNA, 19 nt, Homo sapiens
gagagaaacaaacaaaaca

SEQ ID NO: 502234 - RNA, 19 nt, Homo sapiens
gauauauuucccugcuguu

SEQ ID NO: 502235 - RNA, 19 nt, Homo sapiens
ggaagcagcucuugccaaa

SEQ ID NO: 502236 - RNA, 19 nt, Homo sapiens
gaggagacuugaaagaaua

SEQ ID NO: 502237 - RNA, 19 nt, Homo sapiens
gaaugcaacuuucuaaaca

SEQ ID NO: 502238 - RNA, 19 nt, Homo sapiens
gaaacagucucaacuucaa

SEQ ID NO: 502239 - RNA, 19 nt, Homo sapiens
gaacuuauucuacagcaaa

SEQ ID NO: 502240 - RNA, 19 nt, Homo sapiens
ugaguuugcugaagaaauu

SEQ ID NO: 502241 - RNA, 19 nt, Homo sapiens
gaacuuagagguggaaaga

SEQ ID NO: 502242 - RNA, 19 nt, Homo sapiens
ucaggaaugucagaacuua

SEQ ID NO: 502243 - RNA, 19 nt, Homo sapiens
gcgagaaggugcagaggaa

SEQ ID NO: 502244 - RNA, 19 nt, Homo sapiens
uggaaugguuuauugcuua

SEQ ID NO: 502245 - RNA, 19 nt, Homo sapiens
gcaagggccuacggcauuu

SEQ ID NO: 502246 - RNA, 19 nt, Homo sapiens
caucuccaaugacaaauuu

SEQ ID NO: 502247 - RNA, 19 nt, Homo sapiens
gaacauuuguagcauugau

SEQ ID NO: 502248 - RNA, 19 nt, Homo sapiens
ugaaauccacgaugacaua

SEQ ID NO: 502249 - RNA, 19 nt, Homo sapiens
caacucggcucaggaaugu

SEQ ID NO: 502250 - RNA, 19 nt, Homo sapiens
gaaagacagaggagacuug

SEQ ID NO: 502251 - RNA, 19 nt, Homo sapiens
gcacucacuuugccucuca

SEQ ID NO: 502252 - RNA, 19 nt, Homo sapiens
ggaaugguuuauugcuuau

SEQ ID NO: 502253 - RNA, 19 nt, Homo sapiens
gcaaacagcagaauucaac

SEQ ID NO: 502254 - RNA, 19 nt, Homo sapiens
cagaaacagucucaacuuc

SEQ ID NO: 502255 - RNA, 19 nt, Homo sapiens
gacauguacugaaacaaau

SEQ ID NO: 502256 - RNA, 19 nt, Homo sapiens
gcaagaagacggucaucga

SEQ ID NO: 502257 - RNA, 19 nt, Homo sapiens
agaaggagaucaaguggau

SEQ ID NO: 502258 - RNA, 19 nt, Homo sapiens
gaaccuuagucccgggaaa

SEQ ID NO: 502259 - RNA, 19 nt, Homo sapiens
gaagugcuuuuguuuguuu

SEQ ID NO: 502260 - RNA, 19 nt, Homo sapiens
gugaacauuuguagcauug

SEQ ID NO: 502261 - RNA, 19 nt, Homo sapiens
uaaacaccaucaaccuuau

SEQ ID NO: 502262 - RNA, 19 nt, Homo sapiens
ggaggacgaugacuucaac

SEQ ID NO: 502263 - RNA, 19 nt, Homo sapiens
agacagaggagacuugaaa

SEQ ID NO: 502264 - RNA, 19 nt, Homo sapiens
caaacgagucagcuuauga

SEQ ID NO: 502265 - RNA, 19 nt, Homo sapiens
gaacucaaggucuucauag

SEQ ID NO: 502266 - RNA, 19 nt, Homo sapiens
gcaucuuccuguaaucuau

SEQ ID NO: 502267 - RNA, 19 nt, Homo sapiens
aaagaugccggucuaauug

SEQ ID NO: 502268 - RNA, 19 nt, Homo sapiens
auaaacaccaucaaccuua

SEQ ID NO: 502269 - RNA, 19 nt, Homo sapiens
ggugaacauuuguagcauu

SEQ ID NO: 502270 - RNA, 19 nt, Homo sapiens
ucauaagcaucuuccugua

SEQ ID NO: 502271 - RNA, 19 nt, Homo sapiens
ccacauccaugaaaauaaa

SEQ ID NO: 502272 - RNA, 19 nt, Homo sapiens
agacauguacugaaacaaa

SEQ ID NO: 502273 - RNA, 19 nt, Homo sapiens
aaagacauguacugaaaca

SEQ ID NO: 502274 - RNA, 19 nt, Homo sapiens
caagcaaacagcagaauuc

SEQ ID NO: 502275 - RNA, 19 nt, Homo sapiens
ggaaaacguuuagcgaaaa

SEQ ID NO: 502276 - RNA, 19 nt, Homo sapiens
gaaugacgaggacgacuga

SEQ ID NO: 502277 - RNA, 19 nt, Homo sapiens
ccaaugacaaauuugagua

SEQ ID NO: 502278 - RNA, 19 nt, Homo sapiens
agaggagacuugaaagaau

SEQ ID NO: 502279 - RNA, 19 nt, Homo sapiens
ggaaaggagagaagaaugg

SEQ ID NO: 502280 - RNA, 19 nt, Homo sapiens
cauaagcaucuuccuguaa

SEQ ID NO: 502281 - RNA, 19 nt, Homo sapiens
cagcaucuccaaugacaaa

SEQ ID NO: 502282 - RNA, 19 nt, Homo sapiens
gcgcgucuacgaugccuua

SEQ ID NO: 502283 - RNA, 19 nt, Homo sapiens
gauaugcaccucugauaag

SEQ ID NO: 502284 - RNA, 19 nt, Homo sapiens
aauccacgaugacauagaa

SEQ ID NO: 502285 - RNA, 19 nt, Homo sapiens
ugacuuuauugucccuuaa

SEQ ID NO: 502286 - RNA, 19 nt, Homo sapiens
cugggaaggugaacauuug

SEQ ID NO: 502287 - RNA, 19 nt, Homo sapiens
cuacggcauuucuccauga

SEQ ID NO: 502288 - RNA, 19 nt, Homo sapiens
ggcaagggccuacggcauu

SEQ ID NO: 502289 - RNA, 19 nt, Homo sapiens
gcauugauuucccggaucu

SEQ ID NO: 502290 - RNA, 19 nt, Homo sapiens
ggaaggcuuggaaugguuu

SEQ ID NO: 502291 - RNA, 19 nt, Homo sapiens
uagauaugcaccucugaua

SEQ ID NO: 502292 - RNA, 19 nt, Homo sapiens
caacuucaagaacuuauuc

SEQ ID NO: 502293 - RNA, 19 nt, Homo sapiens
cagaggagacuugaaagaa

SEQ ID NO: 502294 - RNA, 19 nt, Homo sapiens
gcucaggaaugucagaacu

SEQ ID NO: 502295 - RNA, 19 nt, Homo sapiens
auaagcaucuuccuguaau

SEQ ID NO: 502296 - RNA, 19 nt, Homo sapiens
ggcuuggaaugguuuauug

SEQ ID NO: 502297 - RNA, 19 nt, Homo sapiens
gguacgguguccaagcaaa

SEQ ID NO: 502298 - RNA, 19 nt, Homo sapiens
gauaagcaaggauuguuuc

SEQ ID NO: 502299 - RNA, 19 nt, Homo sapiens
ccaugaaggucugcgagaa

SEQ ID NO: 502300 - RNA, 19 nt, Homo sapiens
cagcaagugguaauuggua

SEQ ID NO: 502301 - RNA, 19 nt, Homo sapiens
uaauguggguuuucuguuu

SEQ ID NO: 502302 - RNA, 19 nt, Homo sapiens
uaccaaacgagucagcuua

SEQ ID NO: 502303 - RNA, 19 nt, Homo sapiens
acaaccacaucuuaccaaa

SEQ ID NO: 502304 - RNA, 19 nt, Homo sapiens
ggaaggugaacauuuguag

SEQ ID NO: 502305 - RNA, 19 nt, Homo sapiens
ucccggaucugguaacaug

SEQ ID NO: 502306 - RNA, 19 nt, Homo sapiens
gcggauagcaagacucugu

SEQ ID NO: 502307 - RNA, 19 nt, Homo sapiens
ugacaaauuugaguaucug

SEQ ID NO: 502308 - RNA, 19 nt, Homo sapiens
ccaaacgagucagcuuaug

SEQ ID NO: 502309 - RNA, 19 nt, Homo sapiens
gcgaagugcuuuuguuugu

SEQ ID NO: 502310 - RNA, 19 nt, Homo sapiens
agaaauggcucagggaacu

SEQ ID NO: 502311 - RNA, 19 nt, Homo sapiens
cagauucggcuucaggaaa

SEQ ID NO: 502312 - RNA, 19 nt, Homo sapiens
gaucugguaacauggcaaa

SEQ ID NO: 502313 - RNA, 19 nt, Homo sapiens
agaagaaggagaucaagug

SEQ ID NO: 502314 - RNA, 19 nt, Homo sapiens
ccaaggagaagaaggagau

SEQ ID NO: 502315 - RNA, 19 nt, Homo sapiens
ccaagcaaacagcagaauu

SEQ ID NO: 502316 - RNA, 19 nt, Homo sapiens
gggaaggugaacauuugua

SEQ ID NO: 502317 - RNA, 19 nt, Homo sapiens
cgucuacgaugccuuaaac

SEQ ID NO: 502318 - RNA, 19 nt, Homo sapiens
guggauguguguuuugaua

SEQ ID NO: 502319 - RNA, 19 nt, Homo sapiens
gagaagaaggagaucaagu

SEQ ID NO: 502320 - RNA, 19 nt, Homo sapiens
guucagugcugccgacaac

SEQ ID NO: 502321 - RNA, 19 nt, Homo sapiens
uugcugaguuugcugaaga

SEQ ID NO: 502322 - RNA, 19 nt, Homo sapiens
agauaugcaccucugauaa

SEQ ID NO: 502323 - RNA, 19 nt, Homo sapiens
gcuccaaugggucucagua

SEQ ID NO: 502324 - RNA, 19 nt, Homo sapiens
caacaggaaaggagagaag

SEQ ID NO: 502325 - RNA, 19 nt, Homo sapiens
gugcggcuauggagacugu

SEQ ID NO: 502326 - RNA, 19 nt, Homo sapiens
uggaguuuguucaguggua

SEQ ID NO: 502327 - RNA, 19 nt, Homo sapiens
ugauaagcaaggauuguuu

SEQ ID NO: 502328 - RNA, 19 nt, Homo sapiens
gcaucuccaaugacaaauu

SEQ ID NO: 502329 - RNA, 19 nt, Homo sapiens
guaauugguacgccucaga

SEQ ID NO: 502330 - RNA, 19 nt, Homo sapiens
gaaggcuuggaaugguuua

SEQ ID NO: 502331 - RNA, 19 nt, Homo sapiens
cgaggaggacgaugacuuc

SEQ ID NO: 502332 - RNA, 19 nt, Homo sapiens
agccauacgugacagaaau

SEQ ID NO: 502333 - RNA, 19 nt, Homo sapiens
acggagaacucaaggucuu

SEQ ID NO: 502334 - RNA, 19 nt, Homo sapiens
acagaaacagucucaacuu

SEQ ID NO: 502335 - RNA, 19 nt, Homo sapiens
gaaggaaacuguaucuuua

SEQ ID NO: 502336 - RNA, 19 nt, Homo sapiens
gauaaucccugaagaguug

SEQ ID NO: 502337 - RNA, 19 nt, Homo sapiens
gaaacuguaucuuuagguu

SEQ ID NO: 502338 - RNA, 19 nt, Homo sapiens
gaaagugugugagaaaguu

SEQ ID NO: 502339 - RNA, 19 nt, Homo sapiens
caacucaccuacaaagauu

SEQ ID NO: 502340 - RNA, 19 nt, Homo sapiens
guacuuaagugacauuuag

SEQ ID NO: 502341 - RNA, 19 nt, Homo sapiens
cacaggaccuucuugguua

SEQ ID NO: 502342 - RNA, 19 nt, Homo sapiens
gaacuucuccuacagcaaa

SEQ ID NO: 502343 - RNA, 19 nt, Homo sapiens
gcucugaacucuaccauuc

SEQ ID NO: 502344 - RNA, 19 nt, Homo sapiens
gcaaagaaacaaauuccua

SEQ ID NO: 502345 - RNA, 19 nt, Homo sapiens
cgaaaucccuggugccaaa

SEQ ID NO: 502346 - RNA, 19 nt, Homo sapiens
ugagauccaugaugacaua

SEQ ID NO: 502347 - RNA, 19 nt, Homo sapiens
gaugaaaguuaacauagug

SEQ ID NO: 502348 - RNA, 19 nt, Homo sapiens
ugagaggcaugcuuccuua

SEQ ID NO: 502349 - RNA, 19 nt, Homo sapiens
caacagagcaguagaugau

SEQ ID NO: 502350 - RNA, 19 nt, Homo sapiens
ggaaaugaaccaaauguca

SEQ ID NO: 502351 - RNA, 19 nt, Homo sapiens
acaaugaagucgcugauga

SEQ ID NO: 502352 - RNA, 19 nt, Homo sapiens
ccacagagacuaaccaguu

SEQ ID NO: 502353 - RNA, 19 nt, Homo sapiens
aaugauugcuucagucuuu

SEQ ID NO: 502354 - RNA, 19 nt, Homo sapiens
agauugaacugcugaacua

SEQ ID NO: 502355 - RNA, 19 nt, Homo sapiens
guacagagaaaucgacaaa

SEQ ID NO: 502356 - RNA, 19 nt, Homo sapiens
acaguucccugcaguaauu

SEQ ID NO: 502357 - RNA, 19 nt, Homo sapiens
caugaaggcugagaugauu

SEQ ID NO: 502358 - RNA, 19 nt, Homo sapiens
gauccaugaugacauagaa

SEQ ID NO: 502359 - RNA, 19 nt, Homo sapiens
gugagaaaguucaacgaaa

SEQ ID NO: 502360 - RNA, 19 nt, Homo sapiens
gggaaaggcuugagacacu

SEQ ID NO: 502361 - RNA, 19 nt, Homo sapiens
gcauuuccaugugcauuaa

SEQ ID NO: 502362 - RNA, 19 nt, Homo sapiens
gaaguggccuuagcaacug

SEQ ID NO: 502363 - RNA, 19 nt, Homo sapiens
ugucagaguucaccaauuc

SEQ ID NO: 502364 - RNA, 19 nt, Homo sapiens
caagagaaagccuacguuu

SEQ ID NO: 502365 - RNA, 19 nt, Homo sapiens
agaaggaaacuguaucuuu

SEQ ID NO: 502366 - RNA, 19 nt, Homo sapiens
gaaaguaaacgaagcaaaa

SEQ ID NO: 502367 - RNA, 19 nt, Homo sapiens
ccaaauugcuugccuacag

SEQ ID NO: 502368 - RNA, 19 nt, Homo sapiens
uagaauagcauuuccaugu

SEQ ID NO: 502369 - RNA, 19 nt, Homo sapiens
gaaaguuaacauaguguga

SEQ ID NO: 502370 - RNA, 19 nt, Homo sapiens
cagcugccauucauaauca

SEQ ID NO: 502371 - RNA, 19 nt, Homo sapiens
gcucaggaaugucagaauc

SEQ ID NO: 502372 - RNA, 19 nt, Homo sapiens
uaaaugugcuaauggcaau

SEQ ID NO: 502373 - RNA, 19 nt, Homo sapiens
gaaacacaauaagcaaauc

SEQ ID NO: 502374 - RNA, 19 nt, Homo sapiens
ccacaggaccuucuugguu

SEQ ID NO: 502375 - RNA, 19 nt, Homo sapiens
ugacauagaaguacuaaag

SEQ ID NO: 502376 - RNA, 19 nt, Homo sapiens
gagaaacacaauaagcaaa

SEQ ID NO: 502377 - RNA, 19 nt, Homo sapiens
caucuccagugacaaguuu

SEQ ID NO: 502378 - RNA, 19 nt, Homo sapiens
gcuaauggcaaugaacaua

SEQ ID NO: 502379 - RNA, 19 nt, Homo sapiens
cauccuaaaucuggaguuu

SEQ ID NO: 502380 - RNA, 19 nt, Homo sapiens
ccucaccacccauguaaua

SEQ ID NO: 502381 - RNA, 19 nt, Homo sapiens
caacucauuuaucuucugu

SEQ ID NO: 502382 - RNA, 19 nt, Homo sapiens
caaaugcucucuggaggau

SEQ ID NO: 502383 - RNA, 19 nt, Homo sapiens
gaacauuaggcgaagaguu

SEQ ID NO: 502384 - RNA, 19 nt, Homo sapiens
gagaugaaaguuaacauag

SEQ ID NO: 502385 - RNA, 19 nt, Homo sapiens
ccuuugagauccaugauga

SEQ ID NO: 502386 - RNA, 19 nt, Homo sapiens
ggauagaacggauaaagca

SEQ ID NO: 502387 - RNA, 19 nt, Homo sapiens
gaagaacauuaggcgaaga

SEQ ID NO: 502388 - RNA, 19 nt, Homo sapiens
gcauuggugcauagaauuu

SEQ ID NO: 502389 - RNA, 19 nt, Homo sapiens
ugaacuaguuggaggucua

SEQ ID NO: 502390 - RNA, 19 nt, Homo sapiens
aggcagaaaugaacaugaa

SEQ ID NO: 502391 - RNA, 19 nt, Homo sapiens
gcauuuccaguuuccaaua

SEQ ID NO: 502392 - RNA, 19 nt, Homo sapiens
caaugaaagugugugagaa

SEQ ID NO: 502393 - RNA, 19 nt, Homo sapiens
ggaaaggcuugagacacuu

SEQ ID NO: 502394 - RNA, 19 nt, Homo sapiens
aaaacgggcuagaaaauuu

SEQ ID NO: 502395 - RNA, 19 nt, Homo sapiens
caaauugcuugccuacagu

SEQ ID NO: 502396 - RNA, 19 nt, Homo sapiens
gaucguguuucugacguuu

SEQ ID NO: 502397 - RNA, 19 nt, Homo sapiens
gcgaagaguuuaugaugcu

SEQ ID NO: 502398 - RNA, 19 nt, Homo sapiens
gaguucaccaauucaaaua

SEQ ID NO: 502399 - RNA, 19 nt, Homo sapiens
gaaaugauugcuucagucu

SEQ ID NO: 502400 - RNA, 19 nt, Homo sapiens
gcucauguguguuuguagu

SEQ ID NO: 502401 - RNA, 19 nt, Homo sapiens
ccaugugcauuaaauacuu

SEQ ID NO: 502402 - RNA, 19 nt, Homo sapiens
guuaacauagugugaauga

SEQ ID NO: 502403 - RNA, 19 nt, Homo sapiens
gaagaguuuaugaugcuuu

SEQ ID NO: 502404 - RNA, 19 nt, Homo sapiens
ccaauaaaugugaauguug

SEQ ID NO: 502405 - RNA, 19 nt, Homo sapiens
ccagucaaguguaaaccaa

SEQ ID NO: 502406 - RNA, 19 nt, Homo sapiens
ugacaacaccuuugagauc

SEQ ID NO: 502407 - RNA, 19 nt, Homo sapiens
gaaaagguacaacaucgua

SEQ ID NO: 502408 - RNA, 19 nt, Homo sapiens
ugagaaaguucaacgaaaa

SEQ ID NO: 502409 - RNA, 19 nt, Homo sapiens
gaaaugaacaugaaaaguc

SEQ ID NO: 502410 - RNA, 19 nt, Homo sapiens
acaauaagcaaaucacaug

SEQ ID NO: 502411 - RNA, 19 nt, Homo sapiens
gaauaaagacaagagaaag

SEQ ID NO: 502412 - RNA, 19 nt, Homo sapiens
ggaagaugaugaggaggau

SEQ ID NO: 502413 - RNA, 19 nt, Homo sapiens
ccagugacaaguuugagua

SEQ ID NO: 502414 - RNA, 19 nt, Homo sapiens
caccacccauguaauauuc

SEQ ID NO: 502415 - RNA, 19 nt, Homo sapiens
ggacuacuucugaacucua

SEQ ID NO: 502416 - RNA, 19 nt, Homo sapiens
uagaacggauaaagcagaa

SEQ ID NO: 502417 - RNA, 19 nt, Homo sapiens
agaauagcauuuccaugug

SEQ ID NO: 502418 - RNA, 19 nt, Homo sapiens
acagagcaguagaugauau

SEQ ID NO: 502419 - RNA, 19 nt, Homo sapiens
ugagaugauugagaugaaa

SEQ ID NO: 502420 - RNA, 19 nt, Homo sapiens
ggaccuucuugguuaaauc

SEQ ID NO: 502421 - RNA, 19 nt, Homo sapiens
gugacaaguuugaguaucu

SEQ ID NO: 502422 - RNA, 19 nt, Homo sapiens
aacauuaggcgaagaguuu

SEQ ID NO: 502423 - RNA, 19 nt, Homo sapiens
gaggggagcuguguaguga

SEQ ID NO: 502424 - RNA, 19 nt, Homo sapiens
agcaguagaugauauaaca

SEQ ID NO: 502425 - RNA, 19 nt, Homo sapiens
gugaugcucauguguguuu

SEQ ID NO: 502426 - RNA, 19 nt, Homo sapiens
ccuguucguucaaugauga

SEQ ID NO: 502427 - RNA, 19 nt, Homo sapiens
cuucugaacucuacccaau

SEQ ID NO: 502428 - RNA, 19 nt, Homo sapiens
gaaaacgggcuagaaaauu

SEQ ID NO: 502429 - RNA, 19 nt, Homo sapiens
gaccaggcaacauuucauu

SEQ ID NO: 502430 - RNA, 19 nt, Homo sapiens
caaggcaaagaaacaaauu

SEQ ID NO: 502431 - RNA, 19 nt, Homo sapiens
cagagcaguagaugauaua

SEQ ID NO: 502432 - RNA, 19 nt, Homo sapiens
caggcaacauuucauuugu

SEQ ID NO: 502433 - RNA, 19 nt, Homo sapiens
agacuaaccaguucaggaa

SEQ ID NO: 502434 - RNA, 19 nt, Homo sapiens
ucugaacucuacccaauca

SEQ ID NO: 502435 - RNA, 19 nt, Homo sapiens
gaaagacaaucacaaccua

SEQ ID NO: 502436 - RNA, 19 nt, Homo sapiens
gaagaggagucaaguaaug

SEQ ID NO: 502437 - RNA, 19 nt, Homo sapiens
ggagaaggcuggagaagga

SEQ ID NO: 502438 - RNA, 19 nt, Homo sapiens
ggaaucugcuugaugugua

SEQ ID NO: 502439 - RNA, 19 nt, Homo sapiens
gaacagcccagcacaggua

SEQ ID NO: 502440 - RNA, 19 nt, Homo sapiens
cagagcagcuggacauuga

SEQ ID NO: 502441 - RNA, 19 nt, Homo sapiens
gaacucuccuggccuucua

SEQ ID NO: 502442 - RNA, 19 nt, Homo sapiens
gaacagaagugaggaugag

SEQ ID NO: 502443 - RNA, 19 nt, Homo sapiens
agaaggagauugaugaugu

SEQ ID NO: 502444 - RNA, 19 nt, Homo sapiens
gauuguugcugacauagaa

SEQ ID NO: 502445 - RNA, 19 nt, Homo sapiens
cagaagaggagucaaguaa

SEQ ID NO: 502446 - RNA, 19 nt, Homo sapiens
cgcaggcgauucaacauua

SEQ ID NO: 502447 - RNA, 19 nt, Homo sapiens
gcucaagccucccaauauc

SEQ ID NO: 502448 - RNA, 19 nt, Homo sapiens
gucuauagguuugugauua

SEQ ID NO: 502449 - RNA, 19 nt, Homo sapiens
ggacagauuaugaaauuuc

SEQ ID NO: 502450 - RNA, 19 nt, Homo sapiens
gaaggccucuguggauuau

SEQ ID NO: 502451 - RNA, 19 nt, Homo sapiens
gcaggcgauucaacauuaa

SEQ ID NO: 502452 - RNA, 19 nt, Homo sapiens
ggcagcaggugaaacagua

SEQ ID NO: 502453 - RNA, 19 nt, Homo sapiens
gcucagagaaggagauuga

SEQ ID NO: 502454 - RNA, 19 nt, Homo sapiens
ucagcaacaucccaucuaa

SEQ ID NO: 502455 - RNA, 19 nt, Homo sapiens
gaagaaagacaaucacaac

SEQ ID NO: 502456 - RNA, 19 nt, Homo sapiens
gcaaggaggaggagucaga

SEQ ID NO: 502457 - RNA, 19 nt, Homo sapiens
gcagcaacguuccauguag

SEQ ID NO: 502458 - RNA, 19 nt, Homo sapiens
cagggaaucugcuugaugu

SEQ ID NO: 502459 - RNA, 19 nt, Homo sapiens
ccacccaguucuucauuug

SEQ ID NO: 502460 - RNA, 19 nt, Homo sapiens
gaaccaguaccucaguauu

SEQ ID NO: 502461 - RNA, 19 nt, Homo sapiens
gaaggagauugaugauguc

SEQ ID NO: 502462 - RNA, 19 nt, Homo sapiens
ggaaggugauggguauuag

SEQ ID NO: 502463 - RNA, 19 nt, Homo sapiens
ggggacagauuaugaaauu

SEQ ID NO: 502464 - RNA, 19 nt, Homo sapiens
ggaccaaccugaccuaacc

SEQ ID NO: 502465 - RNA, 19 nt, Homo sapiens
ugaaggaacggcagaagaa

SEQ ID NO: 502466 - RNA, 19 nt, Homo sapiens
gggaaggugauggguauua

SEQ ID NO: 502467 - RNA, 19 nt, Homo sapiens
gcacagaagaggagucaag

SEQ ID NO: 502468 - RNA, 19 nt, Homo sapiens
cagagaaggagauugauga

SEQ ID NO: 502469 - RNA, 19 nt, Homo sapiens
ccagggaggugcucaaggu

SEQ ID NO: 502470 - RNA, 19 nt, Homo sapiens
gaaggaacggcagaagaaa

SEQ ID NO: 502471 - RNA, 19 nt, Homo sapiens
cagaaccaguaccucagua

SEQ ID NO: 502472 - RNA, 19 nt, Homo sapiens
ugaaggccucuguggauua

SEQ ID NO: 502473 - RNA, 19 nt, Homo sapiens
ggaguccaguuacaaugau

SEQ ID NO: 502474 - RNA, 19 nt, Homo sapiens
cgggauuguugcugacaua

SEQ ID NO: 502475 - RNA, 19 nt, Homo sapiens
caguuacaaugaugaaaug

SEQ ID NO: 502476 - RNA, 19 nt, Homo sapiens
ggaacagaagugaggauga

SEQ ID NO: 502477 - RNA, 19 nt, Homo sapiens
gaaggagaaggcuggagaa

SEQ ID NO: 502478 - RNA, 19 nt, Homo sapiens
gggaagaggagaugugauc

SEQ ID NO: 502479 - RNA, 19 nt, Homo sapiens
caacaucccaucuaagcau

SEQ ID NO: 502480 - RNA, 19 nt, Homo sapiens
gaaagggagaugucaggau

SEQ ID NO: 502481 - RNA, 19 nt, Homo sapiens
ucaaggaacugggcacucu

SEQ ID NO: 502482 - RNA, 19 nt, Homo sapiens
gaugaaaugcucagcuauc

SEQ ID NO: 502483 - RNA, 19 nt, Homo sapiens
gaaccgcccagugcaggua

SEQ ID NO: 502484 - RNA, 19 nt, Homo sapiens
gcuccgaauucaggaacua

SEQ ID NO: 502485 - RNA, 19 nt, Homo sapiens
gcucaaaagccaacccuua

SEQ ID NO: 502486 - RNA, 19 nt, Homo sapiens
gcacucucaucccuaaguc

SEQ ID NO: 502487 - RNA, 19 nt, Homo sapiens
uuucagaguuaucaagaga

SEQ ID NO: 502488 - RNA, 19 nt, Homo sapiens
gggacagauuaugaaauuu

SEQ ID NO: 502489 - RNA, 19 nt, Homo sapiens
ggaggaccagucaggauga

SEQ ID NO: 502490 - RNA, 19 nt, Homo sapiens
ggagaaggacaugagauca

SEQ ID NO: 502491 - RNA, 19 nt, Homo sapiens
ucaaacgggagaucucuga

SEQ ID NO: 502492 - RNA, 19 nt, Homo sapiens
cacccaagguugucagcuu

SEQ ID NO: 502493 - RNA, 19 nt, Homo sapiens
ucagaguuaucaagagaca

SEQ ID NO: 502494 - RNA, 19 nt, Homo sapiens
ggaaggggacagauuauga

SEQ ID NO: 502495 - RNA, 19 nt, Homo sapiens
uggaggacauucugaugga

SEQ ID NO: 502496 - RNA, 19 nt, Homo sapiens
gaaucugcuugauguguac

SEQ ID NO: 502497 - RNA, 19 nt, Homo sapiens
ccaguuacaaugaugaaau

SEQ ID NO: 502498 - RNA, 19 nt, Homo sapiens
ggaaucaccccauuucaga

SEQ ID NO: 502499 - RNA, 19 nt, Homo sapiens
augaugaaaugcucagcua

SEQ ID NO: 502500 - RNA, 19 nt, Homo sapiens
gcagggaggagugguacuu

SEQ ID NO: 502501 - RNA, 19 nt, Homo sapiens
acagguauuucagguguga

SEQ ID NO: 502502 - RNA, 19 nt, Homo sapiens
gcgcagcaacguuccaugu

SEQ ID NO: 502503 - RNA, 19 nt, Homo sapiens
gaacggcagaagaaagaca

SEQ ID NO: 502504 - RNA, 19 nt, Homo sapiens
uugaugcgcuuuuaacuuu

SEQ ID NO: 502505 - RNA, 19 nt, Homo sapiens
agggaggagugguacuuaa

SEQ ID NO: 502506 - RNA, 19 nt, Homo sapiens
caucuaagcauuccacacu

SEQ ID NO: 502507 - RNA, 19 nt, Homo sapiens
ggccaccgcuagugcuugu

SEQ ID NO: 502508 - RNA, 19 nt, Homo sapiens
gcugacauagaauuagaaa

SEQ ID NO: 502509 - RNA, 19 nt, Homo sapiens
cuccagggcugcuuuccuu

SEQ ID NO: 502510 - RNA, 19 nt, Homo sapiens
ggcagaagaaagacaauca

SEQ ID NO: 502511 - RNA, 19 nt, Homo sapiens
cagugcagguauuucagaa

SEQ ID NO: 502512 - RNA, 19 nt, Homo sapiens
agacaaucacaaccuaauu

SEQ ID NO: 502513 - RNA, 19 nt, Homo sapiens
acccaagguugucagcuuu

SEQ ID NO: 502514 - RNA, 19 nt, Homo sapiens
accuauaucuggagugaga

SEQ ID NO: 502515 - RNA, 19 nt, Homo sapiens
cagcccagcacagguauuu

SEQ ID NO: 502516 - RNA, 19 nt, Homo sapiens
aaagacaaucacaaccuaa

SEQ ID NO: 502517 - RNA, 19 nt, Homo sapiens
gagaaggagauugaugaug

SEQ ID NO: 502518 - RNA, 19 nt, Homo sapiens
uaaccuaggagggcucuga

SEQ ID NO: 502519 - RNA, 19 nt, Homo sapiens
gaggagugguacuuaagcu

SEQ ID NO: 502520 - RNA, 19 nt, Homo sapiens
ugugaaagaaucaguagga

SEQ ID NO: 502521 - RNA, 19 nt, Homo sapiens
gcccagcacagguauuuca

SEQ ID NO: 502522 - RNA, 19 nt, Homo sapiens
gugcuagcuccauggcuua

SEQ ID NO: 502523 - RNA, 19 nt, Homo sapiens
cugaaggccucuguggauu

SEQ ID NO: 502524 - RNA, 19 nt, Homo sapiens
ugggcacucucaucccuaa

SEQ ID NO: 502525 - RNA, 19 nt, Homo sapiens
uugcugacauagaauuaga

SEQ ID NO: 502526 - RNA, 19 nt, Homo sapiens
caguaccucaguauucuuu

SEQ ID NO: 502527 - RNA, 19 nt, Homo sapiens
uugggaaggugauggguau

SEQ ID NO: 502528 - RNA, 19 nt, Homo sapiens
gagaaggacaugagaucag

SEQ ID NO: 502529 - RNA, 19 nt, Homo sapiens
ggaagaggagaugugauca

SEQ ID NO: 502530 - RNA, 19 nt, Homo sapiens
uccgcaagcugcagaagga

SEQ ID NO: 502531 - RNA, 19 nt, Homo sapiens
ggaacugggcacucucauc

SEQ ID NO: 502532 - RNA, 19 nt, Homo sapiens
agaagaaagacaaucacaa

SEQ ID NO: 502533 - RNA, 19 nt, Homo sapiens
gaaggugauggguauuagu

SEQ ID NO: 502534 - RNA, 19 nt, Homo sapiens
gaaggggacagauuaugaa

SEQ ID NO: 502535 - RNA, 19 nt, Homo sapiens
caaauaagggcugcuguuu

SEQ ID NO: 502536 - RNA, 19 nt, Homo sapiens
gcaaauaagggcugcuguu

SEQ ID NO: 502537 - RNA, 19 nt, Homo sapiens
gaagaggagugugaauuuu

SEQ ID NO: 502538 - RNA, 19 nt, Homo sapiens
agaagaggagugugaauuu

SEQ ID NO: 502539 - RNA, 19 nt, Homo sapiens
cgacgucccuccagaagag

SEQ ID NO: 502540 - RNA, 19 nt, Homo sapiens
gaaagacagaauugugguu

SEQ ID NO: 502541 - RNA, 19 nt, Homo sapiens
aauaagggcugcuguuucg

SEQ ID NO: 502542 - RNA, 19 nt, Homo sapiens
gagcagagaggaggcaaug

SEQ ID NO: 502543 - RNA, 19 nt, Homo sapiens
gcucugacuuugacuacuc

SEQ ID NO: 502544 - RNA, 19 nt, Homo sapiens
gauugacugcucugacuuu

SEQ ID NO: 502545 - RNA, 19 nt, Homo sapiens
cagaagaggagugugaauu

SEQ ID NO: 502546 - RNA, 19 nt, Homo sapiens
ugacugcucugacuuugac

SEQ ID NO: 502547 - RNA, 19 nt, Homo sapiens
aaagacagaauugugguuu

SEQ ID NO: 502548 - RNA, 19 nt, Homo sapiens
ccuggugcuucuauccuaa

SEQ ID NO: 502549 - RNA, 19 nt, Homo sapiens
aaauaagggcugcuguuuc

SEQ ID NO: 502550 - RNA, 19 nt, Homo sapiens
agacagagacguguacagu

SEQ ID NO: 502551 - RNA, 19 nt, Homo sapiens
acucaaaauuggccuaaaa

SEQ ID NO: 502552 - RNA, 19 nt, Homo sapiens
cgugaaagacagaauugug

SEQ ID NO: 502553 - RNA, 19 nt, Homo sapiens
gcccagacagagacgugua

SEQ ID NO: 502554 - RNA, 19 nt, Homo sapiens
caucgacgucccuccagaa

SEQ ID NO: 502555 - RNA, 19 nt, Homo sapiens
uggugcuucuauccuaaua

SEQ ID NO: 502556 - RNA, 19 nt, Homo sapiens
ccucccagugugcaaauaa

SEQ ID NO: 502557 - RNA, 19 nt, Homo sapiens
ggaagacugccauuacuaa

SEQ ID NO: 502558 - RNA, 19 nt, Homo sapiens
gacaauggaugcuguuucg

SEQ ID NO: 502559 - RNA, 19 nt, Homo sapiens
gaaugcgccucucggaagu

SEQ ID NO: 502560 - RNA, 19 nt, Homo sapiens
ucuccaacuucaucuuuga

SEQ ID NO: 502561 - RNA, 19 nt, Homo sapiens
caaagcaagagucggauca

SEQ ID NO: 502562 - RNA, 19 nt, Homo sapiens
guggaagacugccauuacu

SEQ ID NO: 502563 - RNA, 19 nt, Homo sapiens
uggaagacugccauuacua

SEQ ID NO: 502564 - RNA, 19 nt, Homo sapiens
ugacaauggaugcuguuuc

SEQ ID NO: 502565 - RNA, 19 nt, Homo sapiens
ccugaugucuuaacgaaua

SEQ ID NO: 502566 - RNA, 19 nt, Homo sapiens
ucuggagccugaugucuua

SEQ ID NO: 502567 - RNA, 19 nt, Homo sapiens
ggagugccuugguguuuca

SEQ ID NO: 502568 - RNA, 19 nt, Homo sapiens
ugacuaggaagacagaaug

SEQ ID NO: 502569 - RNA, 19 nt, Homo sapiens
agccugaugucuuaacgaa

SEQ ID NO: 502570 - RNA, 19 nt, Homo sapiens
cggcaagcuuucugcugaa

SEQ ID NO: 502571 - RNA, 19 nt, Homo sapiens
cugaugucuuaacgaauaa

SEQ ID NO: 502572 - RNA, 19 nt, Homo sapiens
ggaagaagauccuggaaua

SEQ ID NO: 502573 - RNA, 19 nt, Homo sapiens
gcaaacaggauuauaaaga

SEQ ID NO: 502574 - RNA, 19 nt, Homo sapiens
gaagaacacacaauuauca

SEQ ID NO: 502575 - RNA, 19 nt, Homo sapiens
gaacagauucuacuacaau

SEQ ID NO: 502576 - RNA, 19 nt, Homo sapiens
gcaagaacauuugugaaga

SEQ ID NO: 502577 - RNA, 19 nt, Homo sapiens
gaugaagaacacacaauua

SEQ ID NO: 502578 - RNA, 19 nt, Homo sapiens
gcgaagaauuuauauaugg

SEQ ID NO: 502579 - RNA, 19 nt, Homo sapiens
gaaagaagcagagagugaa

SEQ ID NO: 502580 - RNA, 19 nt, Homo sapiens
gaacauuugugaagauggu

SEQ ID NO: 502581 - RNA, 19 nt, Homo sapiens
cuacuacaauucagucauu

SEQ ID NO: 502582 - RNA, 19 nt, Homo sapiens
gaagaugguccgaaugguu

SEQ ID NO: 502583 - RNA, 19 nt, Homo sapiens
caagaacauuugugaagau

SEQ ID NO: 502584 - RNA, 19 nt, Homo sapiens
caaacaggauuauaaagac

SEQ ID NO: 502585 - RNA, 19 nt, Homo sapiens
ccacugaaacuuaugcauu

SEQ ID NO: 502586 - RNA, 19 nt, Homo sapiens
gaagaagauccuggaauau

SEQ ID NO: 502587 - RNA, 19 nt, Homo sapiens
ugggcaauaugaacaauuu

SEQ ID NO: 502588 - RNA, 19 nt, Homo sapiens
uggaauaugucgagguuau

SEQ ID NO: 502589 - RNA, 19 nt, Homo sapiens
agaagauccuggaauaugu

SEQ ID NO: 502590 - RNA, 19 nt, Homo sapiens
guacaagagauaaugcaaa

SEQ ID NO: 502591 - RNA, 19 nt, Homo sapiens
ggaguugccaccacugaaa

SEQ ID NO: 502592 - RNA, 19 nt, Homo sapiens
agacaacauugcaacaaga

SEQ ID NO: 502593 - RNA, 19 nt, Homo sapiens
ggaauaugucgagguuaua

SEQ ID NO: 502594 - RNA, 19 nt, Homo sapiens
cagaaucgauuugaaaguc

SEQ ID NO: 502595 - RNA, 19 nt, Homo sapiens
cgacagugcgaagaauuua

SEQ ID NO: 502596 - RNA, 19 nt, Homo sapiens
ucaaaaggaggccuaauua

SEQ ID NO: 502597 - RNA, 19 nt, Homo sapiens
cacugaaacuuaugcauuc

SEQ ID NO: 502598 - RNA, 19 nt, Homo sapiens
gcacuuugggcuucuguau

SEQ ID NO: 502599 - RNA, 19 nt, Homo sapiens
ccagguggauaauuaugga

SEQ ID NO: 502600 - RNA, 19 nt, Homo sapiens
agaaagaagcagagaguga

SEQ ID NO: 502601 - RNA, 19 nt, Homo sapiens
guaaagcaaucaugaaaag

SEQ ID NO: 502602 - RNA, 19 nt, Homo sapiens
gaagaugaagaacacacaa

SEQ ID NO: 502603 - RNA, 19 nt, Homo sapiens
ucaaugcugugaauaacuc

SEQ ID NO: 502604 - RNA, 19 nt, Homo sapiens
acagugcgaagaauuuaua

SEQ ID NO: 502605 - RNA, 19 nt, Homo sapiens
gcucaaugcugugaauaac

SEQ ID NO: 502606 - RNA, 19 nt, Homo sapiens
ccuggaauaugucgagguu

SEQ ID NO: 502607 - RNA, 19 nt, Homo sapiens
gaaggaaaucagaaucgau

SEQ ID NO: 502608 - RNA, 19 nt, Homo sapiens
ugaggaagaugaagaacac

SEQ ID NO: 502609 - RNA, 19 nt, Homo sapiens
aaagaaagaagcagagagu

SEQ ID NO: 502610 - RNA, 19 nt, Homo sapiens
gagauaaugcaaacaggau

SEQ ID NO: 502611 - RNA, 19 nt, Homo sapiens
uacaagagauaaugcaaac

SEQ ID NO: 502612 - RNA, 19 nt, Homo sapiens
ugaaggaaaucagaaucga

SEQ ID NO: 502613 - RNA, 19 nt, Homo sapiens
gagugaaaauagcauauga

SEQ ID NO: 502614 - RNA, 19 nt, Homo sapiens
aaaggaggccuaauuaaaa

SEQ ID NO: 502615 - RNA, 19 nt, Homo sapiens
aaaaggaggccuaauuaaa

SEQ ID NO: 502616 - RNA, 19 nt, Homo sapiens
gacaacauugcaacaagaa

SEQ ID NO: 502617 - RNA, 19 nt, Homo sapiens
gguuucauccaaagaauau

SEQ ID NO: 502618 - RNA, 19 nt, Homo sapiens
ggaagaugaagaacacaca

SEQ ID NO: 502619 - RNA, 19 nt, Homo sapiens
aagaugguccgaaugguuu

SEQ ID NO: 502620 - RNA, 19 nt, Homo sapiens
cuguaugccugcugcuuaa

SEQ ID NO: 502621 - RNA, 19 nt, Homo sapiens
caagagauaaugcaaacag

SEQ ID NO: 502622 - RNA, 19 nt, Homo sapiens
caaaaggaggccuaauuaa

SEQ ID NO: 502623 - RNA, 19 nt, Homo sapiens
ccauuuaaguacaguggau

SEQ ID NO: 502624 - RNA, 19 nt, Homo sapiens
cagauucuacuacaauuca

SEQ ID NO: 502625 - RNA, 19 nt, Homo sapiens
uugagacacuggaagaaug

SEQ ID NO: 502626 - RNA, 19 nt, Homo sapiens
aagaagauccuggaauaug

SEQ ID NO: 502627 - RNA, 19 nt, Homo sapiens
uaaugcugauucugaggaa

SEQ ID NO: 502628 - RNA, 19 nt, Homo sapiens
gauuugaaagucuggaaga

SEQ ID NO: 502629 - RNA, 19 nt, Homo sapiens
gaugugaaggaaaucagaa

SEQ ID NO: 502630 - RNA, 19 nt, Homo sapiens
gaagauccuggaauauguc

SEQ ID NO: 502631 - RNA, 19 nt, Homo sapiens
ugaagaacacacaauuauc

SEQ ID NO: 502632 - RNA, 19 nt, Homo sapiens
acacacaauuaucacagau

SEQ ID NO: 502633 - RNA, 19 nt, Homo sapiens
agaugaagaacacacaauu

SEQ ID NO: 502634 - RNA, 19 nt, Homo sapiens
aaagguuucauccaaagaa

SEQ ID NO: 502635 - RNA, 19 nt, Homo sapiens
ggaugugaaggaaaucaga

SEQ ID NO: 502636 - RNA, 19 nt, Homo sapiens
ucuguaugccugcugcuua

SEQ ID NO: 502637 - RNA, 19 nt, Homo sapiens
ugccaccacugaaacuuau

SEQ ID NO: 502638 - RNA, 19 nt, Homo sapiens
gaaugucugagggcaugua

SEQ ID NO: 502639 - RNA, 19 nt, Homo sapiens
aagacaacauugcaacaag

SEQ ID NO: 502640 - RNA, 19 nt, Homo sapiens
aaagacaacauugcaacaa

SEQ ID NO: 502641 - RNA, 19 nt, Homo sapiens
uaaagacaacauugcaaca

SEQ ID NO: 502642 - RNA, 19 nt, Homo sapiens
caacauugcaacaagaaaa

SEQ ID NO: 502643 - RNA, 19 nt, Homo sapiens
aaagaagcagagagugaaa

SEQ ID NO: 502644 - RNA, 19 nt, Homo sapiens
gugaagaugguccgaaugg

SEQ ID NO: 502645 - RNA, 19 nt, Homo sapiens
aagaacauuugugaagaug

SEQ ID NO: 502646 - RNA, 19 nt, Homo sapiens
ucgacagugcgaagaauuu

SEQ ID NO: 502647 - RNA, 19 nt, Homo sapiens
gugccaaugagaacagauu

SEQ ID NO: 502648 - RNA, 19 nt, Homo sapiens
uauggaacccagcucaaug

SEQ ID NO: 502649 - RNA, 19 nt, Homo sapiens
aacacacaauuaucacaga

SEQ ID NO: 502650 - RNA, 19 nt, Homo sapiens
cuggaagaaugcaagaaca

SEQ ID NO: 502651 - RNA, 19 nt, Homo sapiens
gaauuucacggucccucau

SEQ ID NO: 502652 - RNA, 19 nt, Homo sapiens
agaaucgauuugaaagucu

SEQ ID NO: 502653 - RNA, 19 nt, Homo sapiens
gacagugcgaagaauuuau

SEQ ID NO: 502654 - RNA, 19 nt, Homo sapiens
gcauucauuuugugcauuc

SEQ ID NO: 502655 - RNA, 19 nt, Homo sapiens
gcugaucaauuucucauua

SEQ ID NO: 502656 - RNA, 19 nt, Homo sapiens
gaacauugauaacaacuuc

SEQ ID NO: 502657 - RNA, 19 nt, Homo sapiens
caaaggaggacacuuauga

SEQ ID NO: 502658 - RNA, 19 nt, Homo sapiens
gcuccucgcuugaaugauu

SEQ ID NO: 502659 - RNA, 19 nt, Homo sapiens
acacaaaggaggacacuua

SEQ ID NO: 502660 - RNA, 19 nt, Homo sapiens
gugaggaugucaacuauga

SEQ ID NO: 502661 - RNA, 19 nt, Homo sapiens
ggaggacacuuaugagaac

SEQ ID NO: 502662 - RNA, 19 nt, Homo sapiens
ggacgguggugacuuugga

SEQ ID NO: 502663 - RNA, 19 nt, Homo sapiens
ggaggacccugacgucuac

SEQ ID NO: 502664 - RNA, 19 nt, Homo sapiens
gaccaaugcucaggacuuc

SEQ ID NO: 502665 - RNA, 19 nt, Homo sapiens
guacaacgugcgcauaaug

SEQ ID NO: 502666 - RNA, 19 nt, Homo sapiens
ggacagcagugccuauucc

SEQ ID NO: 502667 - RNA, 19 nt, Homo sapiens
ggcagacucucuaugaaca

SEQ ID NO: 502668 - RNA, 19 nt, Homo sapiens
gcucaaggagugcucauau

SEQ ID NO: 502669 - RNA, 19 nt, Homo sapiens
ugacggcccugcugaucuu

SEQ ID NO: 502670 - RNA, 19 nt, Homo sapiens
ccagagagcgcaacaacug

SEQ ID NO: 502671 - RNA, 19 nt, Homo sapiens
ucagugaggaugucaacua

SEQ ID NO: 502672 - RNA, 19 nt, Homo sapiens
ccucaaagccguaguguac

SEQ ID NO: 502673 - RNA, 19 nt, Homo sapiens
cucaaggagugcucauaua

SEQ ID NO: 502674 - RNA, 19 nt, Homo sapiens
cagugaggaugucaacuau

SEQ ID NO: 502675 - RNA, 19 nt, Homo sapiens
gugcggagacucuguguug

SEQ ID NO: 502676 - RNA, 19 nt, Homo sapiens
ucuggaacauugauaacaa

SEQ ID NO: 502677 - RNA, 19 nt, Homo sapiens
gcagguggaguucuacuuc

SEQ ID NO: 502678 - RNA, 19 nt, Homo sapiens
ccagaucacuacguuguca

SEQ ID NO: 502679 - RNA, 19 nt, Homo sapiens
gaggacaccaucaggcaaa

SEQ ID NO: 502680 - RNA, 19 nt, Homo sapiens
guggaguucuacuuccuuu

SEQ ID NO: 502681 - RNA, 19 nt, Homo sapiens
ucgggaaccucaacgaguu

SEQ ID NO: 502682 - RNA, 19 nt, Homo sapiens
gccgucgaguucuccuuua

SEQ ID NO: 502683 - RNA, 19 nt, Homo sapiens
cgaccaggccuacccauuc

SEQ ID NO: 502684 - RNA, 19 nt, Homo sapiens
uggcuucccuuccuucaau

SEQ ID NO: 502685 - RNA, 19 nt, Homo sapiens
caacaacuguccccaagau

SEQ ID NO: 502686 - RNA, 19 nt, Homo sapiens
gagagagacgagcgacuga

SEQ ID NO: 502687 - RNA, 19 nt, Homo sapiens
gugggcagacucucuauga

SEQ ID NO: 502688 - RNA, 19 nt, Homo sapiens
cugggacgguggugacuuu

SEQ ID NO: 502689 - RNA, 19 nt, Homo sapiens
ggcuaguggucaacaauca

SEQ ID NO: 502690 - RNA, 19 nt, Homo sapiens
agagccagaucacuacguu

SEQ ID NO: 502691 - RNA, 19 nt, Homo sapiens
cugcgcagguggaguucua

SEQ ID NO: 502692 - RNA, 19 nt, Homo sapiens
ggcaguguauggacaugug

SEQ ID NO: 502693 - RNA, 19 nt, Homo sapiens
ucaaggagugcucauauac

SEQ ID NO: 502694 - RNA, 19 nt, Homo sapiens
cccagaaggugaccaaugc

SEQ ID NO: 502695 - RNA, 19 nt, Homo sapiens
ugacacgcauguacaacgu

SEQ ID NO: 502696 - RNA, 19 nt, Homo sapiens
ggaacauugauaacaacuu

SEQ ID NO: 502697 - RNA, 19 nt, Homo sapiens
cgacugacacgcauguaca

SEQ ID NO: 502698 - RNA, 19 nt, Homo sapiens
gagagacgagcgacugaca

SEQ ID NO: 502699 - RNA, 19 nt, Homo sapiens
acccauuccugcacacaaa

SEQ ID NO: 502700 - RNA, 19 nt, Homo sapiens
ggagacauuggcccacuuc

SEQ ID NO: 502701 - RNA, 19 nt, Homo sapiens
gcacaucgggaaccucaac

SEQ ID NO: 502702 - RNA, 19 nt, Homo sapiens
gucgaguucuccuuuaugg

SEQ ID NO: 502703 - RNA, 19 nt, Homo sapiens
gcccagaaggugaccaaug

SEQ ID NO: 502704 - RNA, 19 nt, Homo sapiens
gcaccucaaagccguagug

SEQ ID NO: 502705 - RNA, 19 nt, Homo sapiens
ggaccgacacgcacuacgu

SEQ ID NO: 502706 - RNA, 19 nt, Homo sapiens
cacaaaggaggacacuuau

SEQ ID NO: 502707 - RNA, 19 nt, Homo sapiens
gaccaggccuacccauucc

SEQ ID NO: 502708 - RNA, 19 nt, Homo sapiens
ccagccagcaggcagugua

SEQ ID NO: 502709 - RNA, 19 nt, Homo sapiens
cuaugagccugaccuggau

SEQ ID NO: 502710 - RNA, 19 nt, Homo sapiens
gagcgacugacacgcaugu

SEQ ID NO: 502711 - RNA, 19 nt, Homo sapiens
ugggcagacucucuaugaa

SEQ ID NO: 502712 - RNA, 19 nt, Homo sapiens
uggaggacccugacgucua

SEQ ID NO: 502713 - RNA, 19 nt, Homo sapiens
ggauggccgcucugacuca

SEQ ID NO: 502714 - RNA, 19 nt, Homo sapiens
gggcagacucucuaugaac

SEQ ID NO: 502715 - RNA, 19 nt, Homo sapiens
ugaccaaugcucaggacuu

SEQ ID NO: 502716 - RNA, 19 nt, Homo sapiens
ccgucgaguucuccuuuau

SEQ ID NO: 502717 - RNA, 19 nt, Homo sapiens
acagugggcagacucucua

SEQ ID NO: 502718 - RNA, 19 nt, Homo sapiens
aggaggacacuuaugagaa

SEQ ID NO: 502719 - RNA, 19 nt, Homo sapiens
aaggaggacacuuaugaga

SEQ ID NO: 502720 - RNA, 19 nt, Homo sapiens
ucauugagaguguccugaa

SEQ ID NO: 502721 - RNA, 19 nt, Homo sapiens
ggagaaccauugucauaua

SEQ ID NO: 502722 - RNA, 19 nt, Homo sapiens
gaucuaagccuuuccauaa

SEQ ID NO: 502723 - RNA, 19 nt, Homo sapiens
ggacacagauuauccuuau

SEQ ID NO: 502724 - RNA, 19 nt, Homo sapiens
gcacagcucuccuauugaa

SEQ ID NO: 502725 - RNA, 19 nt, Homo sapiens
gcagugccuuccauaauua

SEQ ID NO: 502726 - RNA, 19 nt, Homo sapiens
ugaaagaccucuccaaaug

SEQ ID NO: 502727 - RNA, 19 nt, Homo sapiens
gaauggaucuauagugauu

SEQ ID NO: 502728 - RNA, 19 nt, Homo sapiens
gaauugaccuuuugacuua

SEQ ID NO: 502729 - RNA, 19 nt, Homo sapiens
gcacugagauauuuauugu

SEQ ID NO: 502730 - RNA, 19 nt, Homo sapiens
gaaacucacuuuagacaau

SEQ ID NO: 502731 - RNA, 19 nt, Homo sapiens
gcugaaagcuuaaaugcaa

SEQ ID NO: 502732 - RNA, 19 nt, Homo sapiens
gaaacuugcuguagaugaa

SEQ ID NO: 502733 - RNA, 19 nt, Homo sapiens
ggucaacacuuaaggguuu

SEQ ID NO: 502734 - RNA, 19 nt, Homo sapiens
ugacagaguucacuauaaa

SEQ ID NO: 502735 - RNA, 19 nt, Homo sapiens
ugagggaucugaaccaaua

SEQ ID NO: 502736 - RNA, 19 nt, Homo sapiens
gggaugaccugaagagaaa

SEQ ID NO: 502737 - RNA, 19 nt, Homo sapiens
ucacaauccuaacacauua

SEQ ID NO: 502738 - RNA, 19 nt, Homo sapiens
gcccagauguucucagaua

SEQ ID NO: 502739 - RNA, 19 nt, Homo sapiens
uaaaugcagugaauuguga

SEQ ID NO: 502740 - RNA, 19 nt, Homo sapiens
gugaauggaucuauaguga

SEQ ID NO: 502741 - RNA, 19 nt, Homo sapiens
gauaagaacgguagacuug

SEQ ID NO: 502742 - RNA, 19 nt, Homo sapiens
caacuucauuugaugcuaa

SEQ ID NO: 502743 - RNA, 19 nt, Homo sapiens
ggaaaugggccugaguuua

SEQ ID NO: 502744 - RNA, 19 nt, Homo sapiens
gcaaugugcugaaagagau

SEQ ID NO: 502745 - RNA, 19 nt, Homo sapiens
ccaucaagcugcugaauga

SEQ ID NO: 502746 - RNA, 19 nt, Homo sapiens
gcaaguagauggcgauaac

SEQ ID NO: 502747 - RNA, 19 nt, Homo sapiens
gaauaaaguugaagcuaag

SEQ ID NO: 502748 - RNA, 19 nt, Homo sapiens
caaagcacauugaaagaga

SEQ ID NO: 502749 - RNA, 19 nt, Homo sapiens
gagcagacauaaaggaaau

SEQ ID NO: 502750 - RNA, 19 nt, Homo sapiens
caauugguguguugauaua

SEQ ID NO: 502751 - RNA, 19 nt, Homo sapiens
ugaaugaucucucugaauc

SEQ ID NO: 502752 - RNA, 19 nt, Homo sapiens
gaaaugggccugaguuuac

SEQ ID NO: 502753 - RNA, 19 nt, Homo sapiens
caacugcuuucauuuguga

SEQ ID NO: 502754 - RNA, 19 nt, Homo sapiens
gaaagaccucuccaaauga

SEQ ID NO: 502755 - RNA, 19 nt, Homo sapiens
ugaaauaucagacuaguga

SEQ ID NO: 502756 - RNA, 19 nt, Homo sapiens
gaauacagggcaugcauuu

SEQ ID NO: 502757 - RNA, 19 nt, Homo sapiens
gcaaugacaucuucaaagc

SEQ ID NO: 502758 - RNA, 19 nt, Homo sapiens
ggagcagugucuuccauaa

SEQ ID NO: 502759 - RNA, 19 nt, Homo sapiens
acaguuaacuuucagaaga

SEQ ID NO: 502760 - RNA, 19 nt, Homo sapiens
gaaaagcuguuugggaaua

SEQ ID NO: 502761 - RNA, 19 nt, Homo sapiens
guaaacugguccaugcuaa

SEQ ID NO: 502762 - RNA, 19 nt, Homo sapiens
gaucagcauucucuaacuu

SEQ ID NO: 502763 - RNA, 19 nt, Homo sapiens
gaauugugaccaaguuaua

SEQ ID NO: 502764 - RNA, 19 nt, Homo sapiens
ggccaaaguguuaaucuua

SEQ ID NO: 502765 - RNA, 19 nt, Homo sapiens
ucucagauauggucuuaaa

SEQ ID NO: 502766 - RNA, 19 nt, Homo sapiens
gaugaaacuugcuguagau

SEQ ID NO: 502767 - RNA, 19 nt, Homo sapiens
gcuugaagaucguuaguau

SEQ ID NO: 502768 - RNA, 19 nt, Homo sapiens
gcacugaccagauaagaau

SEQ ID NO: 502769 - RNA, 19 nt, Homo sapiens
agaauaauaugcugccaaa

SEQ ID NO: 502770 - RNA, 19 nt, Homo sapiens
aggcacagcucuccuauug

SEQ ID NO: 502771 - RNA, 19 nt, Homo sapiens
ugagugaaccaucauauaa

SEQ ID NO: 502772 - RNA, 19 nt, Homo sapiens
gaaccaguuucagguguuu

SEQ ID NO: 502773 - RNA, 19 nt, Homo sapiens
gccaaagacuuaguauauu

SEQ ID NO: 502774 - RNA, 19 nt, Homo sapiens
uagauaaccuguacuucaa

SEQ ID NO: 502775 - RNA, 19 nt, Homo sapiens
uaucuuggacugacauuua

SEQ ID NO: 502776 - RNA, 19 nt, Homo sapiens
uaucccaacuccuauaauu

SEQ ID NO: 502777 - RNA, 19 nt, Homo sapiens
acagugaucuccauauguu

SEQ ID NO: 502778 - RNA, 19 nt, Homo sapiens
cuuaaaggcugugguagua

SEQ ID NO: 502779 - RNA, 19 nt, Homo sapiens
ggagacuucuuccgugcua

SEQ ID NO: 502780 - RNA, 19 nt, Homo sapiens
uguauacgcuuauugagaa

SEQ ID NO: 502781 - RNA, 19 nt, Homo sapiens
ugcaaaugcugaaagcuua

SEQ ID NO: 502782 - RNA, 19 nt, Homo sapiens
uaagaacgguagacuuguu

SEQ ID NO: 502783 - RNA, 19 nt, Homo sapiens
gcuaacaggcucaauauuc

SEQ ID NO: 502784 - RNA, 19 nt, Homo sapiens
ucacuuaccuagauuuaca

SEQ ID NO: 502785 - RNA, 19 nt, Homo sapiens
cuaaggguguaaguaauua

SEQ ID NO: 502786 - RNA, 19 nt, Homo sapiens
guagauaaccuguacuuca

SEQ ID NO: 502787 - RNA, 19 nt, Homo sapiens
caucaggauugccuaauau

SEQ ID NO: 502788 - RNA, 19 nt, Homo sapiens
ggugaucaauuaaauguag

SEQ ID NO: 502789 - RNA, 19 nt, Homo sapiens
ugauuaaacuaacccauga

SEQ ID NO: 502790 - RNA, 19 nt, Homo sapiens
ucaucaggauugccuaaua

SEQ ID NO: 502791 - RNA, 19 nt, Homo sapiens
cagacuaaauuucccauug

SEQ ID NO: 502792 - RNA, 19 nt, Homo sapiens
cauuuauggucaacacuua

SEQ ID NO: 502793 - RNA, 19 nt, Homo sapiens
uaaccucagugucauuuau

SEQ ID NO: 502794 - RNA, 19 nt, Homo sapiens
ccaaugaggucugaaaugg

SEQ ID NO: 502795 - RNA, 19 nt, Homo sapiens
cagaagagaugggcuuguu

SEQ ID NO: 502796 - RNA, 19 nt, Homo sapiens
cauagggucucuucagguu

SEQ ID NO: 502797 - RNA, 19 nt, Homo sapiens
uaaacuaacccaugauguu

SEQ ID NO: 502798 - RNA, 19 nt, Homo sapiens
gcagaagcauuaucuuugc

SEQ ID NO: 502799 - RNA, 19 nt, Homo sapiens
guucucagauauggucuua

SEQ ID NO: 502800 - RNA, 19 nt, Homo sapiens
agagaaaguugucggagaa

SEQ ID NO: 502801 - RNA, 19 nt, Homo sapiens
gcacacguacuuaaaugaa

SEQ ID NO: 502802 - RNA, 19 nt, Homo sapiens
ucagaaaccaguuauguga

SEQ ID NO: 502803 - RNA, 19 nt, Homo sapiens
aauugaaccuggacuauga

SEQ ID NO: 502804 - RNA, 19 nt, Homo sapiens
gauaaagcgguucuuggua

SEQ ID NO: 502805 - RNA, 19 nt, Homo sapiens
cugaauggcuagagggaua

SEQ ID NO: 502806 - RNA, 19 nt, Homo sapiens
gaaaaucaccuuugcagaa

SEQ ID NO: 502807 - RNA, 19 nt, Homo sapiens
gcagugagucucuucagaa

SEQ ID NO: 502808 - RNA, 19 nt, Homo sapiens
uaacuuguuugguggagaa

SEQ ID NO: 502809 - RNA, 19 nt, Homo sapiens
ggagagcuuucuguccuuu

SEQ ID NO: 502810 - RNA, 19 nt, Homo sapiens
ggaggacgcgcuaguguga

SEQ ID NO: 502811 - RNA, 19 nt, Homo sapiens
gcuggucaguucgugauua

SEQ ID NO: 502812 - RNA, 19 nt, Homo sapiens
ccacuguuguauacgcuua

SEQ ID NO: 502813 - RNA, 19 nt, Homo sapiens
ucagaaagcaagaauguga

SEQ ID NO: 502814 - RNA, 19 nt, Homo sapiens
guacagcuguuugucauag

SEQ ID NO: 502815 - RNA, 19 nt, Homo sapiens
cauguuaccuccuauaaac

SEQ ID NO: 502816 - RNA, 19 nt, Homo sapiens
ggagauaccagguugaaag

SEQ ID NO: 502817 - RNA, 19 nt, Homo sapiens
guggagaaccauugucaua

SEQ ID NO: 502818 - RNA, 19 nt, Homo sapiens
acccauagcuuccaugaga

SEQ ID NO: 502819 - RNA, 19 nt, Homo sapiens
cagcagaagcauuaucuuu

SEQ ID NO: 502820 - RNA, 19 nt, Homo sapiens
cacagucucuuuaaucuuc

SEQ ID NO: 502821 - RNA, 19 nt, Homo sapiens
ccaaggagcugugaaauaa

SEQ ID NO: 502822 - RNA, 19 nt, Homo sapiens
gaaauuaaccuacaagaga

SEQ ID NO: 502823 - RNA, 19 nt, Homo sapiens
gaagaaaguuauacuggaa

SEQ ID NO: 502824 - RNA, 19 nt, Homo sapiens
caagacaccuuuaccaauu

SEQ ID NO: 502825 - RNA, 19 nt, Homo sapiens
gcaaagggcucgcaugcaa

SEQ ID NO: 502826 - RNA, 19 nt, Homo sapiens
gaggaaacgucuucaugua

SEQ ID NO: 502827 - RNA, 19 nt, Homo sapiens
acucaaagcugcacacaua

SEQ ID NO: 502828 - RNA, 19 nt, Homo sapiens
ggagagugcugguguguga

SEQ ID NO: 502829 - RNA, 19 nt, Homo sapiens
ccacuuaccuucaauaaag

SEQ ID NO: 502830 - RNA, 19 nt, Homo sapiens
ggaggagccuggcgcauuu

SEQ ID NO: 502831 - RNA, 19 nt, Homo sapiens
gaaauaaagugcccauguc

SEQ ID NO: 502832 - RNA, 19 nt, Homo sapiens
gcaaaccuauggugccuuu

SEQ ID NO: 502833 - RNA, 19 nt, Homo sapiens
ggaugaggcuggccaagaa

SEQ ID NO: 502834 - RNA, 19 nt, Homo sapiens
caaaggcugugaagcaauu

SEQ ID NO: 502835 - RNA, 19 nt, Homo sapiens
ccaaagcgauguccaagga

SEQ ID NO: 502836 - RNA, 19 nt, Homo sapiens
caauggaaaucaaucacua

SEQ ID NO: 502837 - RNA, 19 nt, Homo sapiens
ggaagcaaguggaccaguu

SEQ ID NO: 502838 - RNA, 19 nt, Homo sapiens
gggauuagauucaaauucu

SEQ ID NO: 502839 - RNA, 19 nt, Homo sapiens
gcacaagaggcacauuuaa

SEQ ID NO: 502840 - RNA, 19 nt, Homo sapiens
gaauucagaugugcaguga

SEQ ID NO: 502841 - RNA, 19 nt, Homo sapiens
gaaucucucugcucagcua

SEQ ID NO: 502842 - RNA, 19 nt, Homo sapiens
ccagagauuuccugugauu

SEQ ID NO: 502843 - RNA, 19 nt, Homo sapiens
ugacaugucucacucugaa

SEQ ID NO: 502844 - RNA, 19 nt, Homo sapiens
gaggagaggugacaugucu

SEQ ID NO: 502845 - RNA, 19 nt, Homo sapiens
gcacuccuuuggcacauuu

SEQ ID NO: 502846 - RNA, 19 nt, Homo sapiens
cagaagauguggcaagaga

SEQ ID NO: 502847 - RNA, 19 nt, Homo sapiens
uaagaaggaugguacuaug

SEQ ID NO: 502848 - RNA, 19 nt, Homo sapiens
ccaaagagacuccagcaaa

SEQ ID NO: 502849 - RNA, 19 nt, Homo sapiens
gauccaaaguuccugauuc

SEQ ID NO: 502850 - RNA, 19 nt, Homo sapiens
ggaacaauccugugugaga

SEQ ID NO: 502851 - RNA, 19 nt, Homo sapiens
ggaaaucaaucacuaucca

SEQ ID NO: 502852 - RNA, 19 nt, Homo sapiens
aaacaugcuuucuggauug

SEQ ID NO: 502853 - RNA, 19 nt, Homo sapiens
ggaaacuucagucucuuua

SEQ ID NO: 502854 - RNA, 19 nt, Homo sapiens
gaaaucccaacuacccuua

SEQ ID NO: 502855 - RNA, 19 nt, Homo sapiens
gccaagaacuggaaggaau

SEQ ID NO: 502856 - RNA, 19 nt, Homo sapiens
ccacagacaugaugauuuu

SEQ ID NO: 502857 - RNA, 19 nt, Homo sapiens
ccaguguccugcuuuguaa

SEQ ID NO: 502858 - RNA, 19 nt, Homo sapiens
gaagauguggcaagagauu

SEQ ID NO: 502859 - RNA, 19 nt, Homo sapiens
cuaaauguuucccaguuaa

SEQ ID NO: 502860 - RNA, 19 nt, Homo sapiens
ucuaaauguuucccaguua

SEQ ID NO: 502861 - RNA, 19 nt, Homo sapiens
gaccaggaguucaucaaga

SEQ ID NO: 502862 - RNA, 19 nt, Homo sapiens
gaaggaugguacuaugaau

SEQ ID NO: 502863 - RNA, 19 nt, Homo sapiens
gaaaguacccacauuugca

SEQ ID NO: 502864 - RNA, 19 nt, Homo sapiens
cagugaagauuguuuguau

SEQ ID NO: 502865 - RNA, 19 nt, Homo sapiens
gcucaccucuucugucuuc

SEQ ID NO: 502866 - RNA, 19 nt, Homo sapiens
ggacugggaugcguuaagu

SEQ ID NO: 502867 - RNA, 19 nt, Homo sapiens
gaaccaaaaugcccucaaa

SEQ ID NO: 502868 - RNA, 19 nt, Homo sapiens
gaucugggcuaagagaaga

SEQ ID NO: 502869 - RNA, 19 nt, Homo sapiens
gagcaaaggcugugaagca

SEQ ID NO: 502870 - RNA, 19 nt, Homo sapiens
ucaaggaggugccaucauc

SEQ ID NO: 502871 - RNA, 19 nt, Homo sapiens
gaauccggcugaggaauga

SEQ ID NO: 502872 - RNA, 19 nt, Homo sapiens
gaagccauccgagcaauuu

SEQ ID NO: 502873 - RNA, 19 nt, Homo sapiens
ugagaagguuccagaauca

SEQ ID NO: 502874 - RNA, 19 nt, Homo sapiens
gggauauccauuagaaaua

SEQ ID NO: 502875 - RNA, 19 nt, Homo sapiens
ccacaacacuucagaaacg

SEQ ID NO: 502876 - RNA, 19 nt, Homo sapiens
ggcaagagauuuaggugau

SEQ ID NO: 502877 - RNA, 19 nt, Homo sapiens
ggacagagccaacaguuuu

SEQ ID NO: 502878 - RNA, 19 nt, Homo sapiens
gcagguuuaucucuggaaa

SEQ ID NO: 502879 - RNA, 19 nt, Homo sapiens
caggugauauugcgucuug

SEQ ID NO: 502880 - RNA, 19 nt, Homo sapiens
ccaaaguuccugauucuga

SEQ ID NO: 502881 - RNA, 19 nt, Homo sapiens
caaagagacuccagcaaaa

SEQ ID NO: 502882 - RNA, 19 nt, Homo sapiens
ccaaguacaucucgucucu

SEQ ID NO: 502883 - RNA, 19 nt, Homo sapiens
gaucaggaaaucccaacua

SEQ ID NO: 502884 - RNA, 19 nt, Homo sapiens
gcuggcggauguucaguuu

SEQ ID NO: 502885 - RNA, 19 nt, Homo sapiens
gccaccaacucccaacuuu

SEQ ID NO: 502886 - RNA, 19 nt, Homo sapiens
gaggagccauggucaagau

SEQ ID NO: 502887 - RNA, 19 nt, Homo sapiens
gcugucagauccaaaguuc

SEQ ID NO: 502888 - RNA, 19 nt, Homo sapiens
gaagcuauucccaagauga

SEQ ID NO: 502889 - RNA, 19 nt, Homo sapiens
caggcuagaucccaagaaa

SEQ ID NO: 502890 - RNA, 19 nt, Homo sapiens
gaucaugagcuacagagaa

SEQ ID NO: 502891 - RNA, 19 nt, Homo sapiens
ucagagugcuacuguguug

SEQ ID NO: 502892 - RNA, 19 nt, Homo sapiens
ggugaauguuggccaguuu

SEQ ID NO: 502893 - RNA, 19 nt, Homo sapiens
ucuaauggguucuuugaau

SEQ ID NO: 502894 - RNA, 19 nt, Homo sapiens
uaacagagagugcauccuu

SEQ ID NO: 502895 - RNA, 19 nt, Homo sapiens
gaagauaaagugaagaacu

SEQ ID NO: 502896 - RNA, 19 nt, Homo sapiens
gccagcaucuccaacagaa

SEQ ID NO: 502897 - RNA, 19 nt, Homo sapiens
gaagagauuguuucagcuu

SEQ ID NO: 502898 - RNA, 19 nt, Homo sapiens
cuaauggguucuuugaaug

SEQ ID NO: 502899 - RNA, 19 nt, Homo sapiens
gcagaaguuugagaagguu

SEQ ID NO: 502900 - RNA, 19 nt, Homo sapiens
gaaggauucuaccaagucu

SEQ ID NO: 502901 - RNA, 19 nt, Homo sapiens
uuacugaguggcuacauua

SEQ ID NO: 502902 - RNA, 19 nt, Homo sapiens
acaauacccuucucugcaa

SEQ ID NO: 502903 - RNA, 19 nt, Homo sapiens
gcaagagauuuaggugaug

SEQ ID NO: 502904 - RNA, 19 nt, Homo sapiens
ugagacagguuuggaguug

SEQ ID NO: 502905 - RNA, 19 nt, Homo sapiens
gaagcaauuugaggaaagu

SEQ ID NO: 502906 - RNA, 19 nt, Homo sapiens
agccagagauuuccuguga

SEQ ID NO: 502907 - RNA, 19 nt, Homo sapiens
cgacggagccagagauuuc

SEQ ID NO: 502908 - RNA, 19 nt, Homo sapiens
guggaacaauccuguguga

SEQ ID NO: 502909 - RNA, 19 nt, Homo sapiens
uagugaagaucaugagcua

SEQ ID NO: 502910 - RNA, 19 nt, Homo sapiens
gaugggaggcucagaacaa

SEQ ID NO: 502911 - RNA, 19 nt, Homo sapiens
agauuuaggugaugugaug

SEQ ID NO: 502912 - RNA, 19 nt, Homo sapiens
ucaaauuccuugcuucucu

SEQ ID NO: 502913 - RNA, 19 nt, Homo sapiens
cggccaauaucuucgagua

SEQ ID NO: 502914 - RNA, 19 nt, Homo sapiens
cuggaaagauucugacaug

SEQ ID NO: 502915 - RNA, 19 nt, Homo sapiens
ggaggugguugguggaaca

SEQ ID NO: 502916 - RNA, 19 nt, Homo sapiens
gggcagcuuuggcuuugaa

SEQ ID NO: 502917 - RNA, 19 nt, Homo sapiens
uacaacagguuuccagaug

SEQ ID NO: 502918 - RNA, 19 nt, Homo sapiens
ggccaaggauccaccacaa

SEQ ID NO: 502919 - RNA, 19 nt, Homo sapiens
gauccagaguggcucauuc

SEQ ID NO: 502920 - RNA, 19 nt, Homo sapiens
ugacuuacaugacauugag

SEQ ID NO: 502921 - RNA, 19 nt, Homo sapiens
gcacaugggucaccaguug

SEQ ID NO: 502922 - RNA, 19 nt, Homo sapiens
ccacagaccuuccuacuug

SEQ ID NO: 502923 - RNA, 19 nt, Homo sapiens
gcaccuagcuuauuacauc

SEQ ID NO: 502924 - RNA, 19 nt, Homo sapiens
guaaaugccucaauacguu

SEQ ID NO: 502925 - RNA, 19 nt, Homo sapiens
gaaguaagacaaacaugua

SEQ ID NO: 502926 - RNA, 19 nt, Homo sapiens
caggagauuucuauaguua

SEQ ID NO: 502927 - RNA, 19 nt, Homo sapiens
gagcaucgcuguuuccaau

SEQ ID NO: 502928 - RNA, 19 nt, Homo sapiens
gaaugaggcuggacagaug

SEQ ID NO: 502929 - RNA, 19 nt, Homo sapiens
gagaagcuguauccucuaa

SEQ ID NO: 502930 - RNA, 19 nt, Homo sapiens
gaaacagaguaaugaagaa

SEQ ID NO: 502931 - RNA, 19 nt, Homo sapiens
gacccuagcuuuaagagaa

SEQ ID NO: 502932 - RNA, 19 nt, Homo sapiens
ggacagcacugccagagau

SEQ ID NO: 502933 - RNA, 19 nt, Homo sapiens
gaggaaaugcuacuaauau

SEQ ID NO: 502934 - RNA, 19 nt, Homo sapiens
caagucaccuccacuaugu

SEQ ID NO: 502935 - RNA, 19 nt, Homo sapiens
uaacacacaugcagugaga

SEQ ID NO: 502936 - RNA, 19 nt, Homo sapiens
gaaaccagcaggucugaaa

SEQ ID NO: 502937 - RNA, 19 nt, Homo sapiens
ggaaacagaguaaugaaga

SEQ ID NO: 502938 - RNA, 19 nt, Homo sapiens
ggagaugaugucuuauuua

SEQ ID NO: 502939 - RNA, 19 nt, Homo sapiens
cauaagaccuguucucucu

SEQ ID NO: 502940 - RNA, 19 nt, Homo sapiens
ccuuggagaugaugucuua

SEQ ID NO: 502941 - RNA, 19 nt, Homo sapiens
ggauaaacccaauacauau

SEQ ID NO: 502942 - RNA, 19 nt, Homo sapiens
ucaaauacauaguggauag

SEQ ID NO: 502943 - RNA, 19 nt, Homo sapiens
gaaggaggaaugacucaaa

SEQ ID NO: 502944 - RNA, 19 nt, Homo sapiens
cgugaaagguacauuuaaa

SEQ ID NO: 502945 - RNA, 19 nt, Homo sapiens
gccgguaaaugccucaaua

SEQ ID NO: 502946 - RNA, 19 nt, Homo sapiens
ccacaaagccgguaaaugc

SEQ ID NO: 502947 - RNA, 19 nt, Homo sapiens
agaaaugucuggccucuuc

SEQ ID NO: 502948 - RNA, 19 nt, Homo sapiens
caacacaggagauuucuau

SEQ ID NO: 502949 - RNA, 19 nt, Homo sapiens
ugcgaagacuugagauuua

SEQ ID NO: 502950 - RNA, 19 nt, Homo sapiens
cagcaguggugucccauuu

SEQ ID NO: 502951 - RNA, 19 nt, Homo sapiens
gcauuguuauugaguugua

SEQ ID NO: 502952 - RNA, 19 nt, Homo sapiens
ucaaaugacugauaagcau

SEQ ID NO: 502953 - RNA, 19 nt, Homo sapiens
caggaugccggcuuuauua

SEQ ID NO: 502954 - RNA, 19 nt, Homo sapiens
gaaaucagcggaccacgau

SEQ ID NO: 502955 - RNA, 19 nt, Homo sapiens
caaugguagucuuugguua

SEQ ID NO: 502956 - RNA, 19 nt, Homo sapiens
guaguuagcauccaagaga

SEQ ID NO: 502957 - RNA, 19 nt, Homo sapiens
gcacucuuauuuaacaaug

SEQ ID NO: 502958 - RNA, 19 nt, Homo sapiens
cuucagacuucuacauuaa

SEQ ID NO: 502959 - RNA, 19 nt, Homo sapiens
caugaagacccuagcuuua

SEQ ID NO: 502960 - RNA, 19 nt, Homo sapiens
gaacacauugcagaaguaa

SEQ ID NO: 502961 - RNA, 19 nt, Homo sapiens
gcagaucaauaaagaaagg

SEQ ID NO: 502962 - RNA, 19 nt, Homo sapiens
uaaagaguagugagcaaua

SEQ ID NO: 502963 - RNA, 19 nt, Homo sapiens
caacuccucuucuuagucu

SEQ ID NO: 502964 - RNA, 19 nt, Homo sapiens
ucugaaagaucuagugguu

SEQ ID NO: 502965 - RNA, 19 nt, Homo sapiens
gcaguggugucccauuuua

SEQ ID NO: 502966 - RNA, 19 nt, Homo sapiens
uggagaugaugucuuauuu

SEQ ID NO: 502967 - RNA, 19 nt, Homo sapiens
ggacuguggcagaucaaua

SEQ ID NO: 502968 - RNA, 19 nt, Homo sapiens
guuauugaguuguacugua

SEQ ID NO: 502969 - RNA, 19 nt, Homo sapiens
gaaaugcuacuaauaucug

SEQ ID NO: 502970 - RNA, 19 nt, Homo sapiens
uaacaagucaccuccacua

SEQ ID NO: 502971 - RNA, 19 nt, Homo sapiens
ggacacaugacauugaaga

SEQ ID NO: 502972 - RNA, 19 nt, Homo sapiens
gaauggcccuagaguucuu

SEQ ID NO: 502973 - RNA, 19 nt, Homo sapiens
cauauacgccucccuagaa

SEQ ID NO: 502974 - RNA, 19 nt, Homo sapiens
gaugccggcuuuauuaaca

SEQ ID NO: 502975 - RNA, 19 nt, Homo sapiens
ggaagagugugugugucua

SEQ ID NO: 502976 - RNA, 19 nt, Homo sapiens
ugacacagcuccagguuuu

SEQ ID NO: 502977 - RNA, 19 nt, Homo sapiens
aggauaaacccaauacaua

SEQ ID NO: 502978 - RNA, 19 nt, Homo sapiens
ggagaaaacuuagcaaauc

SEQ ID NO: 502979 - RNA, 19 nt, Homo sapiens
ugaagaccaucccaagcua

SEQ ID NO: 502980 - RNA, 19 nt, Homo sapiens
cagaauggcccuagaguuc

SEQ ID NO: 502981 - RNA, 19 nt, Homo sapiens
ccagugcccucauccuuau

SEQ ID NO: 502982 - RNA, 19 nt, Homo sapiens
aagugcaccuagcuuauua

SEQ ID NO: 502983 - RNA, 19 nt, Homo sapiens
gaaaagcuauacugauuag

SEQ ID NO: 502984 - RNA, 19 nt, Homo sapiens
aaacuuagcaaauccauca

SEQ ID NO: 502985 - RNA, 19 nt, Homo sapiens
ccuucagacuucuacauua

SEQ ID NO: 502986 - RNA, 19 nt, Homo sapiens
uuuaaugacugcccagauu

SEQ ID NO: 502987 - RNA, 19 nt, Homo sapiens
gauuccaggcuauauauuu

SEQ ID NO: 502988 - RNA, 19 nt, Homo sapiens
ggaccacgauuucaagacu

SEQ ID NO: 502989 - RNA, 19 nt, Homo sapiens
ucugaugucuguauauguu

SEQ ID NO: 502990 - RNA, 19 nt, Homo sapiens
agaccucuaucaaucagua

SEQ ID NO: 502991 - RNA, 19 nt, Homo sapiens
cacaggagauuucuauagu

SEQ ID NO: 502992 - RNA, 19 nt, Homo sapiens
gagauuuagugucugugaa

SEQ ID NO: 502993 - RNA, 19 nt, Homo sapiens
gguugaggcuugacuguag

SEQ ID NO: 502994 - RNA, 19 nt, Homo sapiens
gacuguggcagaucaauaa

SEQ ID NO: 502995 - RNA, 19 nt, Homo sapiens
gcaugugucugccauucug

SEQ ID NO: 502996 - RNA, 19 nt, Homo sapiens
uaagaccuguucucucuag

SEQ ID NO: 502997 - RNA, 19 nt, Homo sapiens
agaacacauugcagaagua

SEQ ID NO: 502998 - RNA, 19 nt, Homo sapiens
gcaaugguagucuuugguu

SEQ ID NO: 502999 - RNA, 19 nt, Homo sapiens
gccagugcccucauccuua

SEQ ID NO: 503000 - RNA, 19 nt, Homo sapiens
gcgaagacuugagauuuag

SEQ ID NO: 503001 - RNA, 19 nt, Homo sapiens
ugaggaaaugcuacuaaua

SEQ ID NO: 503002 - RNA, 19 nt, Homo sapiens
gugaggaaaugcuacuaau

SEQ ID NO: 503003 - RNA, 19 nt, Homo sapiens
gcagaauggcccuagaguu

SEQ ID NO: 503004 - RNA, 19 nt, Homo sapiens
gacuugagauuuagugucu

SEQ ID NO: 503005 - RNA, 19 nt, Homo sapiens
cgugagcccucgguaagua

SEQ ID NO: 503006 - RNA, 19 nt, Homo sapiens
ggagagaggaagagugugu

SEQ ID NO: 503007 - RNA, 19 nt, Homo sapiens
aaagcaacuccucuucuua

SEQ ID NO: 503008 - RNA, 19 nt, Homo sapiens
ggagagaugggcagaaugg

SEQ ID NO: 503009 - RNA, 19 nt, Homo sapiens
cuagaaaucaaaugacuga

SEQ ID NO: 503010 - RNA, 19 nt, Homo sapiens
ggccagauauguggguuga

SEQ ID NO: 503011 - RNA, 19 nt, Homo sapiens
ggaaaugcuacuaauaucu

SEQ ID NO: 503012 - RNA, 19 nt, Homo sapiens
uguggcagaucaauaaaga

SEQ ID NO: 503013 - RNA, 19 nt, Homo sapiens
uuacucugaugucuguaua

SEQ ID NO: 503014 - RNA, 19 nt, Homo sapiens
uuagaacuccuuacucuga

SEQ ID NO: 503015 - RNA, 19 nt, Homo sapiens
acacauugcagaaguaaga

SEQ ID NO: 503016 - RNA, 19 nt, Homo sapiens
gggcuuugaucucuuccaa

SEQ ID NO: 503017 - RNA, 19 nt, Homo sapiens
caggagagaugggcagaau

SEQ ID NO: 503018 - RNA, 19 nt, Homo sapiens
aaaagaggcugcaucaaug

SEQ ID NO: 503019 - RNA, 19 nt, Homo sapiens
ggaaugaggcuggacagau

SEQ ID NO: 503020 - RNA, 19 nt, Homo sapiens
cgguaaguauguuuagaaa

SEQ ID NO: 503021 - RNA, 19 nt, Homo sapiens
gagcagcuguccaacauga

SEQ ID NO: 503022 - RNA, 19 nt, Homo sapiens
gcaaggaccucggcuggaa

SEQ ID NO: 503023 - RNA, 19 nt, Homo sapiens
cgaaaucuaugacaaguuc

SEQ ID NO: 503024 - RNA, 19 nt, Homo sapiens
gaaccggccuuuccugcuu

SEQ ID NO: 503025 - RNA, 19 nt, Homo sapiens
gcaagguccuggcccugua

SEQ ID NO: 503026 - RNA, 19 nt, Homo sapiens
gcaagacuaucgacaugga

SEQ ID NO: 503027 - RNA, 19 nt, Homo sapiens
gaagugccuuacauuaaug

SEQ ID NO: 503028 - RNA, 19 nt, Homo sapiens
ugaagugccuuacauuaau

SEQ ID NO: 503029 - RNA, 19 nt, Homo sapiens
gcucacgccuguaauccua

SEQ ID NO: 503030 - RNA, 19 nt, Homo sapiens
cagcuacucuggaggcuaa

SEQ ID NO: 503031 - RNA, 19 nt, Homo sapiens
guacacacagcauauauau

SEQ ID NO: 503032 - RNA, 19 nt, Homo sapiens
gcggaucucugugucauug

SEQ ID NO: 503033 - RNA, 19 nt, Homo sapiens
guugaagugccuuacauua

SEQ ID NO: 503034 - RNA, 19 nt, Homo sapiens
gcagaguacacacagcaua

SEQ ID NO: 503035 - RNA, 19 nt, Homo sapiens
auugagggcuuucgccuua

SEQ ID NO: 503036 - RNA, 19 nt, Homo sapiens
agaaauacagcaacaauuc

SEQ ID NO: 503037 - RNA, 19 nt, Homo sapiens
gcgcccaucuagguuauuu

SEQ ID NO: 503038 - RNA, 19 nt, Homo sapiens
gggcuaccaugccaacuuc

SEQ ID NO: 503039 - RNA, 19 nt, Homo sapiens
aggcagagaugggaggaua

SEQ ID NO: 503040 - RNA, 19 nt, Homo sapiens
acaacgaaaucuaugacaa

SEQ ID NO: 503041 - RNA, 19 nt, Homo sapiens
gagaugggaggauacuuga

SEQ ID NO: 503042 - RNA, 19 nt, Homo sapiens
caccauagcaacacucuga

SEQ ID NO: 503043 - RNA, 19 nt, Homo sapiens
gaugggaggauacuugaau

SEQ ID NO: 503044 - RNA, 19 nt, Homo sapiens
ggacugcggaucucugugu

SEQ ID NO: 503045 - RNA, 19 nt, Homo sapiens
caacgaaaucuaugacaag

SEQ ID NO: 503046 - RNA, 19 nt, Homo sapiens
aaacaagcccagagagguu

SEQ ID NO: 503047 - RNA, 19 nt, Homo sapiens
gaggaaacaagcccagaga

SEQ ID NO: 503048 - RNA, 19 nt, Homo sapiens
gcaacaauuccuggcgaua

SEQ ID NO: 503049 - RNA, 19 nt, Homo sapiens
cagaaauacagcaacaauu

SEQ ID NO: 503050 - RNA, 19 nt, Homo sapiens
ggacuauccaccugcaaga

SEQ ID NO: 503051 - RNA, 19 nt, Homo sapiens
gauggcagggacucugaua

SEQ ID NO: 503052 - RNA, 19 nt, Homo sapiens
uugaagugccuuacauuaa

SEQ ID NO: 503053 - RNA, 19 nt, Homo sapiens
gacaucaacggguucacua

SEQ ID NO: 503054 - RNA, 19 nt, Homo sapiens
ccagaaauacagcaacaau

SEQ ID NO: 503055 - RNA, 19 nt, Homo sapiens
ggaaacccacaacgaaauc

SEQ ID NO: 503056 - RNA, 19 nt, Homo sapiens
auacuugaauccaggcauu

SEQ ID NO: 503057 - RNA, 19 nt, Homo sapiens
ugcggcagcuguacauuga

SEQ ID NO: 503058 - RNA, 19 nt, Homo sapiens
gacaccaacuauugcuuca

SEQ ID NO: 503059 - RNA, 19 nt, Homo sapiens
gaguacacacagcauauau

SEQ ID NO: 503060 - RNA, 19 nt, Homo sapiens
gauagugaagaagacaaua

SEQ ID NO: 503061 - RNA, 19 nt, Homo sapiens
gagauggcagggacucuga

SEQ ID NO: 503062 - RNA, 19 nt, Homo sapiens
cugcaagacuaucgacaug

SEQ ID NO: 503063 - RNA, 19 nt, Homo sapiens
ggcagggacucugauaaca

SEQ ID NO: 503064 - RNA, 19 nt, Homo sapiens
ugucugcacuauuccuuug

SEQ ID NO: 503065 - RNA, 19 nt, Homo sapiens
uaccagaaauacagcaaca

SEQ ID NO: 503066 - RNA, 19 nt, Homo sapiens
acguggagcuguaccagaa

SEQ ID NO: 503067 - RNA, 19 nt, Homo sapiens
ccuguaauccuagcacuuu

SEQ ID NO: 503068 - RNA, 19 nt, Homo sapiens
gacaaguucaagcagagua

SEQ ID NO: 503069 - RNA, 19 nt, Homo sapiens
gagagaggacugcggaucu

SEQ ID NO: 503070 - RNA, 19 nt, Homo sapiens
cagaguacacacagcauau

SEQ ID NO: 503071 - RNA, 19 nt, Homo sapiens
cagccuggguaacauagug

SEQ ID NO: 503072 - RNA, 19 nt, Homo sapiens
ggauagugaagaagacaau

SEQ ID NO: 503073 - RNA, 19 nt, Homo sapiens
cuauccaccugcaagacua

SEQ ID NO: 503074 - RNA, 19 nt, Homo sapiens
gcccacugcuccugugaca

SEQ ID NO: 503075 - RNA, 19 nt, Homo sapiens
ccagagugguuaucuuuug

SEQ ID NO: 503076 - RNA, 19 nt, Homo sapiens
cgccagagugguuaucuuu

SEQ ID NO: 503077 - RNA, 19 nt, Homo sapiens
agagaugggaggauacuug

SEQ ID NO: 503078 - RNA, 19 nt, Homo sapiens
cugccugucugcacuauuc

SEQ ID NO: 503079 - RNA, 19 nt, Homo sapiens
gaaauacagcaacaauucc

SEQ ID NO: 503080 - RNA, 19 nt, Homo sapiens
gaggucacccgcgugcuaa

SEQ ID NO: 503081 - RNA, 19 nt, Homo sapiens
ccacagauccccuauucaa

SEQ ID NO: 503082 - RNA, 19 nt, Homo sapiens
ccgagaagcgguaccugaa

SEQ ID NO: 503083 - RNA, 19 nt, Homo sapiens
gcggccagauccuguccaa

SEQ ID NO: 503084 - RNA, 19 nt, Homo sapiens
gaccuggccaccauucaug

SEQ ID NO: 503085 - RNA, 19 nt, Homo sapiens
caacaauuccuggcgauac

SEQ ID NO: 503086 - RNA, 19 nt, Homo sapiens
guggagcuguaccagaaau

SEQ ID NO: 503087 - RNA, 19 nt, Homo sapiens
gaacucauucagucaccau

SEQ ID NO: 503088 - RNA, 19 nt, Homo sapiens
caagaccacccaccuucug

SEQ ID NO: 503089 - RNA, 19 nt, Homo sapiens
gauaacacccauuuuaaag

SEQ ID NO: 503090 - RNA, 19 nt, Homo sapiens
ucugauaacacccauuuua

SEQ ID NO: 503091 - RNA, 19 nt, Homo sapiens
acucugauaacacccauuu

SEQ ID NO: 503092 - RNA, 19 nt, Homo sapiens
gcaccuugggcacuguuga

SEQ ID NO: 503093 - RNA, 19 nt, Homo sapiens
gagcuggucgggagaagag

SEQ ID NO: 503094 - RNA, 19 nt, Homo sapiens
ucuccgaccugccacagau

SEQ ID NO: 503095 - RNA, 19 nt, Homo sapiens
agaguacacacagcauaua

SEQ ID NO: 503096 - RNA, 19 nt, Homo sapiens
gcagcuguccaacaugauc

SEQ ID NO: 503097 - RNA, 19 nt, Homo sapiens
gacccuaucucuacaaaac

SEQ ID NO: 503098 - RNA, 19 nt, Homo sapiens
uaacacccauuuuaaaggu

SEQ ID NO: 503099 - RNA, 19 nt, Homo sapiens
gcagcuguacauugacuuc

SEQ ID NO: 503100 - RNA, 19 nt, Homo sapiens
gugcggcagcuguacauug

SEQ ID NO: 503101 - RNA, 19 nt, Homo sapiens
ggacaucaacggguucacu

SEQ ID NO: 503102 - RNA, 19 nt, Homo sapiens
gggauaacacacugcaagu

SEQ ID NO: 503103 - RNA, 19 nt, Homo sapiens
uaaggugggaggaucacuu

SEQ ID NO: 503104 - RNA, 19 nt, Homo sapiens
gaggacugcggaucucugu

SEQ ID NO: 503105 - RNA, 19 nt, Homo sapiens
aguacacacagcauauaua

SEQ ID NO: 503106 - RNA, 19 nt, Homo sapiens
aaacccacaacgaaaucua

SEQ ID NO: 503107 - RNA, 19 nt, Homo sapiens
cauagcaacacucugagau

SEQ ID NO: 503108 - RNA, 19 nt, Homo sapiens
gcccuggacaccaacuauu

SEQ ID NO: 503109 - RNA, 19 nt, Homo sapiens
ugacagcagggauaacaca

SEQ ID NO: 503110 - RNA, 19 nt, Homo sapiens
uuuaaagguugaggaaaca

SEQ ID NO: 503111 - RNA, 19 nt, Homo sapiens
ugccuuacauuaaugaacu

SEQ ID NO: 503112 - RNA, 19 nt, Homo sapiens
uggaaacccacaacgaaau

SEQ ID NO: 503113 - RNA, 19 nt, Homo sapiens
ggaccagucugaagauaag

SEQ ID NO: 503114 - RNA, 19 nt, Homo sapiens
gaggaccagucugaagaua

SEQ ID NO: 503115 - RNA, 19 nt, Homo sapiens
ggacaaggaccaccuguac

SEQ ID NO: 503116 - RNA, 19 nt, Homo sapiens
ucacuguucugugcacuuu

SEQ ID NO: 503117 - RNA, 19 nt, Homo sapiens
ggagcuggauagacugaug

SEQ ID NO: 503118 - RNA, 19 nt, Homo sapiens
gaacuuaaugccacucagu

SEQ ID NO: 503119 - RNA, 19 nt, Homo sapiens
cuacauaaacacacgcauu

SEQ ID NO: 503120 - RNA, 19 nt, Homo sapiens
gagcgcuucucgccaagau

SEQ ID NO: 503121 - RNA, 19 nt, Homo sapiens
agaaggaggaccagucuga

SEQ ID NO: 503122 - RNA, 19 nt, Homo sapiens
aaaguggauugcacacaga

SEQ ID NO: 503123 - RNA, 19 nt, Homo sapiens
gaaggaggaccagucugaa

SEQ ID NO: 503124 - RNA, 19 nt, Homo sapiens
gcagaaggaggaccagucu

SEQ ID NO: 503125 - RNA, 19 nt, Homo sapiens
ucaggaggcuggguuugug

SEQ ID NO: 503126 - RNA, 19 nt, Homo sapiens
cucuguggcuccugcaaua

SEQ ID NO: 503127 - RNA, 19 nt, Homo sapiens
gccacucaguucaacauca

SEQ ID NO: 503128 - RNA, 19 nt, Homo sapiens
gggacaaggaccaccugua

SEQ ID NO: 503129 - RNA, 19 nt, Homo sapiens
gggaggguccuugcaauuc

SEQ ID NO: 503130 - RNA, 19 nt, Homo sapiens
caagauguggcuucugcaa

SEQ ID NO: 503131 - RNA, 19 nt, Homo sapiens
ggaggguccuugcaauucc

SEQ ID NO: 503132 - RNA, 19 nt, Homo sapiens
gggacuuccugcagcuguu

SEQ ID NO: 503133 - RNA, 19 nt, Homo sapiens
ggaggaccagucugaagau

SEQ ID NO: 503134 - RNA, 19 nt, Homo sapiens
ugagcuagaucgguugcuu

SEQ ID NO: 503135 - RNA, 19 nt, Homo sapiens
uacauaaacacacgcauuc

SEQ ID NO: 503136 - RNA, 19 nt, Homo sapiens
gcgcuucucgccaagaugu

SEQ ID NO: 503137 - RNA, 19 nt, Homo sapiens
ugucucaguucccaucuag

SEQ ID NO: 503138 - RNA, 19 nt, Homo sapiens
ugaaaucaugucucaguuc

SEQ ID NO: 503139 - RNA, 19 nt, Homo sapiens
aaacccacacgcccacaaa

SEQ ID NO: 503140 - RNA, 19 nt, Homo sapiens
ggcaagggcagccuagaca

SEQ ID NO: 503141 - RNA, 19 nt, Homo sapiens
ccacucaguucaacaucac

SEQ ID NO: 503142 - RNA, 19 nt, Homo sapiens
gauugcacacagacaagaa

SEQ ID NO: 503143 - RNA, 19 nt, Homo sapiens
ggauugcacacagacaaga

SEQ ID NO: 503144 - RNA, 19 nt, Homo sapiens
gacaaggaccaccuguaca

SEQ ID NO: 503145 - RNA, 19 nt, Homo sapiens
cagcccauccgacacaaga

SEQ ID NO: 503146 - RNA, 19 nt, Homo sapiens
ucuggcacccggacuguuu

SEQ ID NO: 503147 - RNA, 19 nt, Homo sapiens
cuucggagaugaggguuuc

SEQ ID NO: 503148 - RNA, 19 nt, Homo sapiens
uggccucacucucugacuu

SEQ ID NO: 503149 - RNA, 19 nt, Homo sapiens
ccgaggccuugcucucaga

SEQ ID NO: 503150 - RNA, 19 nt, Homo sapiens
gcauuucugcugcgucagu

SEQ ID NO: 503151 - RNA, 19 nt, Homo sapiens
ccagucugaagauaagaaa

SEQ ID NO: 503152 - RNA, 19 nt, Homo sapiens
gaacagcuuucuaauauga

SEQ ID NO: 503153 - RNA, 19 nt, Homo sapiens
guccugagcuuauauaaua

SEQ ID NO: 503154 - RNA, 19 nt, Homo sapiens
gauggcaccuccacauaua

SEQ ID NO: 503155 - RNA, 19 nt, Homo sapiens
ggaaguuuguguucuguuu

SEQ ID NO: 503156 - RNA, 19 nt, Homo sapiens
gaaaugugcaggauaauug

SEQ ID NO: 503157 - RNA, 19 nt, Homo sapiens
uuagaaaugugcaggauaa

SEQ ID NO: 503158 - RNA, 19 nt, Homo sapiens
ggauugagcuauaucagau

SEQ ID NO: 503159 - RNA, 19 nt, Homo sapiens
caacucuccuugaucuaua

SEQ ID NO: 503160 - RNA, 19 nt, Homo sapiens
ccaaacaacucuccuugau

SEQ ID NO: 503161 - RNA, 19 nt, Homo sapiens
gaucuaggguggaaaugga

SEQ ID NO: 503162 - RNA, 19 nt, Homo sapiens
gaacuagaagcaagauuug

SEQ ID NO: 503163 - RNA, 19 nt, Homo sapiens
aaacaacucuccuugaucu

SEQ ID NO: 503164 - RNA, 19 nt, Homo sapiens
ggcauugacuagauuguuu

SEQ ID NO: 503165 - RNA, 19 nt, Homo sapiens
uaacugaugcuguucauga

SEQ ID NO: 503166 - RNA, 19 nt, Homo sapiens
gaugcggccuauugcuuua

SEQ ID NO: 503167 - RNA, 19 nt, Homo sapiens
gagcaugcccguauuuaug

SEQ ID NO: 503168 - RNA, 19 nt, Homo sapiens
cuucagaauuguucgauuu

SEQ ID NO: 503169 - RNA, 19 nt, Homo sapiens
caaggagguuuacaaaaua

SEQ ID NO: 503170 - RNA, 19 nt, Homo sapiens
cuacagacccuacuucaga

SEQ ID NO: 503171 - RNA, 19 nt, Homo sapiens
cgauguaacugaugcuguu

SEQ ID NO: 503172 - RNA, 19 nt, Homo sapiens
gcagcacacucgauaugga

SEQ ID NO: 503173 - RNA, 19 nt, Homo sapiens
gaacaacggauugagcuau

SEQ ID NO: 503174 - RNA, 19 nt, Homo sapiens
gccuauugcuuuagaaaug

SEQ ID NO: 503175 - RNA, 19 nt, Homo sapiens
ucucaaguccaaagauuua

SEQ ID NO: 503176 - RNA, 19 nt, Homo sapiens
gcaaaaguuucgcaucaaa

SEQ ID NO: 503177 - RNA, 19 nt, Homo sapiens
ccaaggagguuuacaaaau

SEQ ID NO: 503178 - RNA, 19 nt, Homo sapiens
cauuucaccuacuuuguaa

SEQ ID NO: 503179 - RNA, 19 nt, Homo sapiens
gcaaaacacccaagauuga

SEQ ID NO: 503180 - RNA, 19 nt, Homo sapiens
ugacuagauuguuugcaaa

SEQ ID NO: 503181 - RNA, 19 nt, Homo sapiens
uauaucagauucucaaguc

SEQ ID NO: 503182 - RNA, 19 nt, Homo sapiens
ggaugcggccuauugcuuu

SEQ ID NO: 503183 - RNA, 19 nt, Homo sapiens
guacaaugccaacuucugu

SEQ ID NO: 503184 - RNA, 19 nt, Homo sapiens
uguaaagucuugcaaaugc

SEQ ID NO: 503185 - RNA, 19 nt, Homo sapiens
agaacuagaagcaagauuu

SEQ ID NO: 503186 - RNA, 19 nt, Homo sapiens
cgacagcaaaguugugaaa

SEQ ID NO: 503187 - RNA, 19 nt, Homo sapiens
aacaacggauugagcuaua

SEQ ID NO: 503188 - RNA, 19 nt, Homo sapiens
gauuugacgucucagcaau

SEQ ID NO: 503189 - RNA, 19 nt, Homo sapiens
uaccauaaauccagaagca

SEQ ID NO: 503190 - RNA, 19 nt, Homo sapiens
uaagugagagagacaagaa

SEQ ID NO: 503191 - RNA, 19 nt, Homo sapiens
uaaccauucucuacuacau

SEQ ID NO: 503192 - RNA, 19 nt, Homo sapiens
ggagcaugcccguauuuau

SEQ ID NO: 503193 - RNA, 19 nt, Homo sapiens
guucagagucuuucguuug

SEQ ID NO: 503194 - RNA, 19 nt, Homo sapiens
ggaggugauuuccaucuac

SEQ ID NO: 503195 - RNA, 19 nt, Homo sapiens
cugcgugucccaagauuua

SEQ ID NO: 503196 - RNA, 19 nt, Homo sapiens
acuauaaaguccacuagga

SEQ ID NO: 503197 - RNA, 19 nt, Homo sapiens
cuacaucgacagcaaaguu

SEQ ID NO: 503198 - RNA, 19 nt, Homo sapiens
gaggugauuuccaucuaca

SEQ ID NO: 503199 - RNA, 19 nt, Homo sapiens
guacuaguucagacacuuu

SEQ ID NO: 503200 - RNA, 19 nt, Homo sapiens
agauugaacagcuuucuaa

SEQ ID NO: 503201 - RNA, 19 nt, Homo sapiens
caacagcaccagggacuug

SEQ ID NO: 503202 - RNA, 19 nt, Homo sapiens
caacgaugaugcuuguaac

SEQ ID NO: 503203 - RNA, 19 nt, Homo sapiens
ucuccuugaucuauacuuu

SEQ ID NO: 503204 - RNA, 19 nt, Homo sapiens
uaagagagccuugguucau

SEQ ID NO: 503205 - RNA, 19 nt, Homo sapiens
uauaaaguccacuaggaaa

SEQ ID NO: 503206 - RNA, 19 nt, Homo sapiens
gcacuuuuguaccaucuaa

SEQ ID NO: 503207 - RNA, 19 nt, Homo sapiens
ucagaauuguucgauuuga

SEQ ID NO: 503208 - RNA, 19 nt, Homo sapiens
gcgggcagauccugagcaa

SEQ ID NO: 503209 - RNA, 19 nt, Homo sapiens
gagagagacaagaagcaaa

SEQ ID NO: 503210 - RNA, 19 nt, Homo sapiens
gaaguuuguguucuguuug

SEQ ID NO: 503211 - RNA, 19 nt, Homo sapiens
ugaacagcuuucuaauaug

SEQ ID NO: 503212 - RNA, 19 nt, Homo sapiens
gcuggagcaugcccguauu

SEQ ID NO: 503213 - RNA, 19 nt, Homo sapiens
agacccuacuucagaauug

SEQ ID NO: 503214 - RNA, 19 nt, Homo sapiens
cggaggugauuuccaucua

SEQ ID NO: 503215 - RNA, 19 nt, Homo sapiens
acauuucaccuacuuugua

SEQ ID NO: 503216 - RNA, 19 nt, Homo sapiens
gaaggccuuauucuacauu

SEQ ID NO: 503217 - RNA, 19 nt, Homo sapiens
guugaaggccuuauucuac

SEQ ID NO: 503218 - RNA, 19 nt, Homo sapiens
cagcuaaaauucuuggaaa

SEQ ID NO: 503219 - RNA, 19 nt, Homo sapiens
gauuguaaagucuugcaaa

SEQ ID NO: 503220 - RNA, 19 nt, Homo sapiens
cuacguccacuuuacauug

SEQ ID NO: 503221 - RNA, 19 nt, Homo sapiens
gguacuaguucagacacuu

SEQ ID NO: 503222 - RNA, 19 nt, Homo sapiens
uacguccacuuuacauuga

SEQ ID NO: 503223 - RNA, 19 nt, Homo sapiens
guuauugcccuccuacaga

SEQ ID NO: 503224 - RNA, 19 nt, Homo sapiens
gaggagcgacgaagaguac

SEQ ID NO: 503225 - RNA, 19 nt, Homo sapiens
aaacuggcaucugacacaa

SEQ ID NO: 503226 - RNA, 19 nt, Homo sapiens
gcaaaugcagcuaaaauuc

SEQ ID NO: 503227 - RNA, 19 nt, Homo sapiens
guugggcauugacuagauu

SEQ ID NO: 503228 - RNA, 19 nt, Homo sapiens
uacagacccuacuucagaa

SEQ ID NO: 503229 - RNA, 19 nt, Homo sapiens
guacuacgccaaggagguu

SEQ ID NO: 503230 - RNA, 19 nt, Homo sapiens
gagacaagaagcaaauuuu

SEQ ID NO: 503231 - RNA, 19 nt, Homo sapiens
agagacaagaagcaaauuu

SEQ ID NO: 503232 - RNA, 19 nt, Homo sapiens
agagagccuugguucauca

SEQ ID NO: 503233 - RNA, 19 nt, Homo sapiens
gcugagcgcuuuucugauc

SEQ ID NO: 503234 - RNA, 19 nt, Homo sapiens
cuauaaaguccacuaggaa

SEQ ID NO: 503235 - RNA, 19 nt, Homo sapiens
gaaccucuaaccauucucu

SEQ ID NO: 503236 - RNA, 19 nt, Homo sapiens
caaacaacucuccuugauc

SEQ ID NO: 503237 - RNA, 19 nt, Homo sapiens
uugacuagauuguuugcaa

SEQ ID NO: 503238 - RNA, 19 nt, Homo sapiens
gcauugacuagauuguuug

SEQ ID NO: 503239 - RNA, 19 nt, Homo sapiens
ggagcgacgaagaguacua

SEQ ID NO: 503240 - RNA, 19 nt, Homo sapiens
uccuugaucuauacuuuga

SEQ ID NO: 503241 - RNA, 19 nt, Homo sapiens
cuacauuucaccuacuuug

SEQ ID NO: 503242 - RNA, 19 nt, Homo sapiens
uugaaggccuuauucuaca

SEQ ID NO: 503243 - RNA, 19 nt, Homo sapiens
gaaaaggcgguacuaguuc

SEQ ID NO: 503244 - RNA, 19 nt, Homo sapiens
agagggaucuaggguggaa

SEQ ID NO: 503245 - RNA, 19 nt, Homo sapiens
gaagaacuagaagcaagau

SEQ ID NO: 503246 - RNA, 19 nt, Homo sapiens
cugaugcuguucaugaaug

SEQ ID NO: 503247 - RNA, 19 nt, Homo sapiens
ggccuuauucuacauuuca

SEQ ID NO: 503248 - RNA, 19 nt, Homo sapiens
guuuguguucuguuuguua

SEQ ID NO: 503249 - RNA, 19 nt, Homo sapiens
ugaaaaggcgguacuaguu

SEQ ID NO: 503250 - RNA, 19 nt, Homo sapiens
accauucucuacuacauug

SEQ ID NO: 503251 - RNA, 19 nt, Homo sapiens
agaaaugugcaggauaauu

SEQ ID NO: 503252 - RNA, 19 nt, Homo sapiens
ggaaagggaugguaaguug

SEQ ID NO: 503253 - RNA, 19 nt, Homo sapiens
caacuuaggucuagaaauc

SEQ ID NO: 503254 - RNA, 19 nt, Homo sapiens
gagaagagaguccaacuua

SEQ ID NO: 503255 - RNA, 19 nt, Homo sapiens
ggaauacuaugccaaagaa

SEQ ID NO: 503256 - RNA, 19 nt, Homo sapiens
gauuucaucuucuggaaua

SEQ ID NO: 503257 - RNA, 19 nt, Homo sapiens
ccacaacccucaucuaauc

SEQ ID NO: 503258 - RNA, 19 nt, Homo sapiens
gaaaguguggguuugguua

SEQ ID NO: 503259 - RNA, 19 nt, Homo sapiens
ggugaagucuuguaaaugu

SEQ ID NO: 503260 - RNA, 19 nt, Homo sapiens
ucaaaggcguggacaauga

SEQ ID NO: 503261 - RNA, 19 nt, Homo sapiens
gaugguaaguugagauguu

SEQ ID NO: 503262 - RNA, 19 nt, Homo sapiens
guaaagaaaguguggguuu

SEQ ID NO: 503263 - RNA, 19 nt, Homo sapiens
gcagaaggaucaccacaac

SEQ ID NO: 503264 - RNA, 19 nt, Homo sapiens
ggaucgagcucuuccagau

SEQ ID NO: 503265 - RNA, 19 nt, Homo sapiens
ccaagacccuguguucauu

SEQ ID NO: 503266 - RNA, 19 nt, Homo sapiens
uaaagaaaguguggguuug

SEQ ID NO: 503267 - RNA, 19 nt, Homo sapiens
caauggagauauccuggaa

SEQ ID NO: 503268 - RNA, 19 nt, Homo sapiens
ccgaguggcuguccuuuga

SEQ ID NO: 503269 - RNA, 19 nt, Homo sapiens
gguauaaagacaaguauga

SEQ ID NO: 503270 - RNA, 19 nt, Homo sapiens
agacaaagucccagaauug

SEQ ID NO: 503271 - RNA, 19 nt, Homo sapiens
gggcaaaucuauuacuuuu

SEQ ID NO: 503272 - RNA, 19 nt, Homo sapiens
gagguuggauuugcucauu

SEQ ID NO: 503273 - RNA, 19 nt, Homo sapiens
ggaugcacauuucuggauu

SEQ ID NO: 503274 - RNA, 19 nt, Homo sapiens
caaagucccagaauuguau

SEQ ID NO: 503275 - RNA, 19 nt, Homo sapiens
gaaacacacaagcaacaaa

SEQ ID NO: 503276 - RNA, 19 nt, Homo sapiens
gcacacaguccgcuucuuc

SEQ ID NO: 503277 - RNA, 19 nt, Homo sapiens
gacaggaucugggcuggaa

SEQ ID NO: 503278 - RNA, 19 nt, Homo sapiens
ucaagaagcagaaggauca

SEQ ID NO: 503279 - RNA, 19 nt, Homo sapiens
gaagagaguccaacuuagg

SEQ ID NO: 503280 - RNA, 19 nt, Homo sapiens
cuaaaggaauuaccuccaa

SEQ ID NO: 503281 - RNA, 19 nt, Homo sapiens
gcucauugcuguaccacau

SEQ ID NO: 503282 - RNA, 19 nt, Homo sapiens
guggugaagucuuguaaau

SEQ ID NO: 503283 - RNA, 19 nt, Homo sapiens
ggaauauuguuucuagaac

SEQ ID NO: 503284 - RNA, 19 nt, Homo sapiens
agacugagguauaaagaca

SEQ ID NO: 503285 - RNA, 19 nt, Homo sapiens
gggcuacuaugccaacuuc

SEQ ID NO: 503286 - RNA, 19 nt, Homo sapiens
caccacaacccucaucuaa

SEQ ID NO: 503287 - RNA, 19 nt, Homo sapiens
aaacuguccucuacaucaa

SEQ ID NO: 503288 - RNA, 19 nt, Homo sapiens
gaucugagguuggauuugc

SEQ ID NO: 503289 - RNA, 19 nt, Homo sapiens
gauuugggcuacccuaaag

SEQ ID NO: 503290 - RNA, 19 nt, Homo sapiens
gugaguggcuguugagaag

SEQ ID NO: 503291 - RNA, 19 nt, Homo sapiens
gaagaggguggaagccauu

SEQ ID NO: 503292 - RNA, 19 nt, Homo sapiens
cgcauagacugagguauaa

SEQ ID NO: 503293 - RNA, 19 nt, Homo sapiens
caaacuguccucuacauca

SEQ ID NO: 503294 - RNA, 19 nt, Homo sapiens
gugaagucuuguaaaugua

SEQ ID NO: 503295 - RNA, 19 nt, Homo sapiens
gaaagggaugguaaguuga

SEQ ID NO: 503296 - RNA, 19 nt, Homo sapiens
acgcauagacugagguaua

SEQ ID NO: 503297 - RNA, 19 nt, Homo sapiens
gaaggaagggcagagaaug

SEQ ID NO: 503298 - RNA, 19 nt, Homo sapiens
gcagugcagugaguucaug

SEQ ID NO: 503299 - RNA, 19 nt, Homo sapiens
gcucacacaugaagaugca

SEQ ID NO: 503300 - RNA, 19 nt, Homo sapiens
aagacaaagucccagaauu

SEQ ID NO: 503301 - RNA, 19 nt, Homo sapiens
gaaccuaagggcuacuaug

SEQ ID NO: 503302 - RNA, 19 nt, Homo sapiens
ggacuucggccacaucaag

SEQ ID NO: 503303 - RNA, 19 nt, Homo sapiens
gaugcacauuucuggauug

SEQ ID NO: 503304 - RNA, 19 nt, Homo sapiens
ugaccauccuguacuaugu

SEQ ID NO: 503305 - RNA, 19 nt, Homo sapiens
uuagacacauggacaacaa

SEQ ID NO: 503306 - RNA, 19 nt, Homo sapiens
ggauuugggcuacccuaaa

SEQ ID NO: 503307 - RNA, 19 nt, Homo sapiens
cuauaucgguggcaagaau

SEQ ID NO: 503308 - RNA, 19 nt, Homo sapiens
ggaaugagcagaggaucga

SEQ ID NO: 503309 - RNA, 19 nt, Homo sapiens
cuucccagcucacacauga

SEQ ID NO: 503310 - RNA, 19 nt, Homo sapiens
ugagauggagguuuccuuu

SEQ ID NO: 503311 - RNA, 19 nt, Homo sapiens
gcucaggcccuugcccaua

SEQ ID NO: 503312 - RNA, 19 nt, Homo sapiens
ugucugcccuaaaggaauu

SEQ ID NO: 503313 - RNA, 19 nt, Homo sapiens
aaucaacccucuccugucu

SEQ ID NO: 503314 - RNA, 19 nt, Homo sapiens
gagaaggaagggcagagaa

SEQ ID NO: 503315 - RNA, 19 nt, Homo sapiens
uggcugagauggagguuuc

SEQ ID NO: 503316 - RNA, 19 nt, Homo sapiens
ggacuguacaacacucuga

SEQ ID NO: 503317 - RNA, 19 nt, Homo sapiens
gaguggcuguccuuugaug

SEQ ID NO: 503318 - RNA, 19 nt, Homo sapiens
ucuggaauauuguuucuag

SEQ ID NO: 503319 - RNA, 19 nt, Homo sapiens
ugagguauaaagacaagua

SEQ ID NO: 503320 - RNA, 19 nt, Homo sapiens
ggaaacacacaagcaacaa

SEQ ID NO: 503321 - RNA, 19 nt, Homo sapiens
gagcagaauuccgggucuu

SEQ ID NO: 503322 - RNA, 19 nt, Homo sapiens
cuacaucaauuaacaucgu

SEQ ID NO: 503323 - RNA, 19 nt, Homo sapiens
gaucauauuuccccuugga

SEQ ID NO: 503324 - RNA, 19 nt, Homo sapiens
gugcgugaguggcuguuga

SEQ ID NO: 503325 - RNA, 19 nt, Homo sapiens
caaccuauuccgagcagaa

SEQ ID NO: 503326 - RNA, 19 nt, Homo sapiens
gggaaacacacaagcaaca

SEQ ID NO: 503327 - RNA, 19 nt, Homo sapiens
agaagagaguccaacuuag

SEQ ID NO: 503328 - RNA, 19 nt, Homo sapiens
gaaggcugcacccaggaaa

SEQ ID NO: 503329 - RNA, 19 nt, Homo sapiens
ucaacuguauugggccuuu

SEQ ID NO: 503330 - RNA, 19 nt, Homo sapiens
aaauccaggucaugcaguu

SEQ ID NO: 503331 - RNA, 19 nt, Homo sapiens
gagauguuguguggcaaug

SEQ ID NO: 503332 - RNA, 19 nt, Homo sapiens
gaacucuucagaacacaca

SEQ ID NO: 503333 - RNA, 19 nt, Homo sapiens
caagacccuguguucauuu

SEQ ID NO: 503334 - RNA, 19 nt, Homo sapiens
uugccaagccucagucuuu

SEQ ID NO: 503335 - RNA, 19 nt, Homo sapiens
gccaaagaaauccauaaau

SEQ ID NO: 503336 - RNA, 19 nt, Homo sapiens
ggaaggcugcacccaggaa

SEQ ID NO: 503337 - RNA, 19 nt, Homo sapiens
aagggcaaaucuauuacuu

SEQ ID NO: 503338 - RNA, 19 nt, Homo sapiens
ggagaaggaagggcagaga

SEQ ID NO: 503339 - RNA, 19 nt, Homo sapiens
uagaggaaagggaugguaa

SEQ ID NO: 503340 - RNA, 19 nt, Homo sapiens
ccaacaugguggugaaguc

SEQ ID NO: 503341 - RNA, 19 nt, Homo sapiens
caggucaggaugcacauuu

SEQ ID NO: 503342 - RNA, 19 nt, Homo sapiens
ggacaaugaggaugaccau

SEQ ID NO: 503343 - RNA, 19 nt, Homo sapiens
gggagcugcuggaggagau

SEQ ID NO: 503344 - RNA, 19 nt, Homo sapiens
gcaaacuguccucuacauc

SEQ ID NO: 503345 - RNA, 19 nt, Homo sapiens
ucugaacccugaagcaucu

SEQ ID NO: 503346 - RNA, 19 nt, Homo sapiens
gaccauggccguggagauc

SEQ ID NO: 503347 - RNA, 19 nt, Homo sapiens
ggagauauccuggaaaaca

SEQ ID NO: 503348 - RNA, 19 nt, Homo sapiens
gaguggcuguugagaagag

SEQ ID NO: 503349 - RNA, 19 nt, Homo sapiens
acaugguggugaagucuug

SEQ ID NO: 503350 - RNA, 19 nt, Homo sapiens
cggaauacuaugccaaaga

SEQ ID NO: 503351 - RNA, 19 nt, Homo sapiens
uaacaucgugggucacuac

SEQ ID NO: 503352 - RNA, 19 nt, Homo sapiens
gaacugaauugcuguguua

SEQ ID NO: 503353 - RNA, 19 nt, Homo sapiens
gaacaauaauacccuauga

SEQ ID NO: 503354 - RNA, 19 nt, Homo sapiens
gaauugcuguguuauauga

SEQ ID NO: 503355 - RNA, 19 nt, Homo sapiens
gcauagagguggucuuaau

SEQ ID NO: 503356 - RNA, 19 nt, Homo sapiens
ccagaaaccacauguauuu

SEQ ID NO: 503357 - RNA, 19 nt, Homo sapiens
gccaggagauguacauuga

SEQ ID NO: 503358 - RNA, 19 nt, Homo sapiens
gaauguagauacucagaag

SEQ ID NO: 503359 - RNA, 19 nt, Homo sapiens
gcaugcugauuacaagaua

SEQ ID NO: 503360 - RNA, 19 nt, Homo sapiens
guuacuccaucccaauuua

SEQ ID NO: 503361 - RNA, 19 nt, Homo sapiens
gcaauugaauguagauacu

SEQ ID NO: 503362 - RNA, 19 nt, Homo sapiens
gaaaccacauguauuugca

SEQ ID NO: 503363 - RNA, 19 nt, Homo sapiens
gcuaggaucucuaacaaac

SEQ ID NO: 503364 - RNA, 19 nt, Homo sapiens
cuaaagcaauugaauguag

SEQ ID NO: 503365 - RNA, 19 nt, Homo sapiens
gagaacuugucaccagaaa

SEQ ID NO: 503366 - RNA, 19 nt, Homo sapiens
gcugagcucuaguaggaaa

SEQ ID NO: 503367 - RNA, 19 nt, Homo sapiens
gcucgucauuuccucuuaa

SEQ ID NO: 503368 - RNA, 19 nt, Homo sapiens
uagagguggucuuaaugua

SEQ ID NO: 503369 - RNA, 19 nt, Homo sapiens
gugcauagagguggucuua

SEQ ID NO: 503370 - RNA, 19 nt, Homo sapiens
uaacugaacgugugcauag

SEQ ID NO: 503371 - RNA, 19 nt, Homo sapiens
gugcauauuuaggucauuu

SEQ ID NO: 503372 - RNA, 19 nt, Homo sapiens
cacugagucuggaacaaua

SEQ ID NO: 503373 - RNA, 19 nt, Homo sapiens
aagcuaggaucucuaacaa

SEQ ID NO: 503374 - RNA, 19 nt, Homo sapiens
cugaauugcuguguuauau

SEQ ID NO: 503375 - RNA, 19 nt, Homo sapiens
augcugagcucuaguagga

SEQ ID NO: 503376 - RNA, 19 nt, Homo sapiens
gggaugaagugggccaaga

SEQ ID NO: 503377 - RNA, 19 nt, Homo sapiens
ggcaaauucuucacugagu

SEQ ID NO: 503378 - RNA, 19 nt, Homo sapiens
ucuguucucuggcaaauuc

SEQ ID NO: 503379 - RNA, 19 nt, Homo sapiens
ggucuuaauguaggucuua

SEQ ID NO: 503380 - RNA, 19 nt, Homo sapiens
gugcuaagaggaaggauga

SEQ ID NO: 503381 - RNA, 19 nt, Homo sapiens
ggaacaauaauacccuaug

SEQ ID NO: 503382 - RNA, 19 nt, Homo sapiens
gagcucagggcgacuguga

SEQ ID NO: 503383 - RNA, 19 nt, Homo sapiens
caccagaaaccacauguau

SEQ ID NO: 503384 - RNA, 19 nt, Homo sapiens
ggcuuuggcucgucauuuc

SEQ ID NO: 503385 - RNA, 19 nt, Homo sapiens
gagagggugcuaagaggaa

SEQ ID NO: 503386 - RNA, 19 nt, Homo sapiens
ggaugaagugggccaagaa

SEQ ID NO: 503387 - RNA, 19 nt, Homo sapiens
gggaaacagaacugaauug

SEQ ID NO: 503388 - RNA, 19 nt, Homo sapiens
ccauugagcccucuaacug

SEQ ID NO: 503389 - RNA, 19 nt, Homo sapiens
gcuaaagcaauugaaugua

SEQ ID NO: 503390 - RNA, 19 nt, Homo sapiens
caagcuaggaucucuaaca

SEQ ID NO: 503391 - RNA, 19 nt, Homo sapiens
gggcgacugugacccugaa

SEQ ID NO: 503392 - RNA, 19 nt, Homo sapiens
guagauacucagaagaaau

SEQ ID NO: 503393 - RNA, 19 nt, Homo sapiens
gagccuugcccgugcauau

SEQ ID NO: 503394 - RNA, 19 nt, Homo sapiens
uaaauaaugcagcucagau

SEQ ID NO: 503395 - RNA, 19 nt, Homo sapiens
gaacuugucaccagaaacc

SEQ ID NO: 503396 - RNA, 19 nt, Homo sapiens
cccaaauacugacccauuc

SEQ ID NO: 503397 - RNA, 19 nt, Homo sapiens
cagaugcugagcucuagua

SEQ ID NO: 503398 - RNA, 19 nt, Homo sapiens
guaaauaaugcagcucaga

SEQ ID NO: 503399 - RNA, 19 nt, Homo sapiens
cacaagcuaggaucucuaa

SEQ ID NO: 503400 - RNA, 19 nt, Homo sapiens
ccuugcccgugcauauuua

SEQ ID NO: 503401 - RNA, 19 nt, Homo sapiens
aacaaacgcagaaggcuuu

SEQ ID NO: 503402 - RNA, 19 nt, Homo sapiens
ggacagggaauugggauac

SEQ ID NO: 503403 - RNA, 19 nt, Homo sapiens
uguagauacucagaagaaa

SEQ ID NO: 503404 - RNA, 19 nt, Homo sapiens
ugaccgaggccgugaacuu

SEQ ID NO: 503405 - RNA, 19 nt, Homo sapiens
agaacugaauugcuguguu

SEQ ID NO: 503406 - RNA, 19 nt, Homo sapiens
ggaaacagaacugaauugc

SEQ ID NO: 503407 - RNA, 19 nt, Homo sapiens
gcugggaguuucuguucuc

SEQ ID NO: 503408 - RNA, 19 nt, Homo sapiens
caaguuacuccaucccaau

SEQ ID NO: 503409 - RNA, 19 nt, Homo sapiens
gccauaggcgccuggugua

SEQ ID NO: 503410 - RNA, 19 nt, Homo sapiens
acaugagggugcagaagug

SEQ ID NO: 503411 - RNA, 19 nt, Homo sapiens
cuuccuggcuuacgagugu

SEQ ID NO: 503412 - RNA, 19 nt, Homo sapiens
gcucuaagaacuucauugc

SEQ ID NO: 503413 - RNA, 19 nt, Homo sapiens
gaaacagaacugaauugcu

SEQ ID NO: 503414 - RNA, 19 nt, Homo sapiens
caaccgcaccucccucauc

SEQ ID NO: 503415 - RNA, 19 nt, Homo sapiens
uagcuaaagcaauugaaug

SEQ ID NO: 503416 - RNA, 19 nt, Homo sapiens
gaccgaggccgugaacuuc

SEQ ID NO: 503417 - RNA, 19 nt, Homo sapiens
gauuagaacuggggaaaca

SEQ ID NO: 503418 - RNA, 19 nt, Homo sapiens
cgugagggcccaguaugua

SEQ ID NO: 503419 - RNA, 19 nt, Homo sapiens
agauacagcugagcaaugc

SEQ ID NO: 503420 - RNA, 19 nt, Homo sapiens
caauuuagugcuccugugu

SEQ ID NO: 503421 - RNA, 19 nt, Homo sapiens
ugaagugggccaagaacug

SEQ ID NO: 503422 - RNA, 19 nt, Homo sapiens
cauagagguggucuuaaug

SEQ ID NO: 503423 - RNA, 19 nt, Homo sapiens
cauugagcccucuaacuga

SEQ ID NO: 503424 - RNA, 19 nt, Homo sapiens
ggcucgucauuuccucuua

SEQ ID NO: 503425 - RNA, 19 nt, Homo sapiens
aaauaaugcagcucagaug

SEQ ID NO: 503426 - RNA, 19 nt, Homo sapiens
ggcuucagcucuaagaacu

SEQ ID NO: 503427 - RNA, 19 nt, Homo sapiens
caagauacagcugagcaau

SEQ ID NO: 503428 - RNA, 19 nt, Homo sapiens
gcuggcaugcugauuacaa

SEQ ID NO: 503429 - RNA, 19 nt, Homo sapiens
gacccugaagcaccaauga

SEQ ID NO: 503430 - RNA, 19 nt, Homo sapiens
gccuugcccgugcauauuu

SEQ ID NO: 503431 - RNA, 19 nt, Homo sapiens
cuucagcucuaagaacuuc

SEQ ID NO: 503432 - RNA, 19 nt, Homo sapiens
caaauacugacccauucug

SEQ ID NO: 503433 - RNA, 19 nt, Homo sapiens
ucacugagucuggaacaau

SEQ ID NO: 503434 - RNA, 19 nt, Homo sapiens
cagcugggaguuucuguuc

SEQ ID NO: 503435 - RNA, 19 nt, Homo sapiens
gggccgacauggagaagcu

SEQ ID NO: 503436 - RNA, 19 nt, Homo sapiens
ucaccagaaaccacaugua

SEQ ID NO: 503437 - RNA, 19 nt, Homo sapiens
ccacaagcuaggaucucua

SEQ ID NO: 503438 - RNA, 19 nt, Homo sapiens
gccacaagcuaggaucucu

SEQ ID NO: 503439 - RNA, 19 nt, Homo sapiens
ucacccauccuaagcacuu

SEQ ID NO: 503440 - RNA, 19 nt, Homo sapiens
cagaaaccacauguauuug

SEQ ID NO: 503441 - RNA, 19 nt, Homo sapiens
auuuagugcuccuguguga

SEQ ID NO: 503442 - RNA, 19 nt, Homo sapiens
ccacgugagggcccaguau

SEQ ID NO: 503443 - RNA, 19 nt, Homo sapiens
ugagucuggaacaauaaua

SEQ ID NO: 503444 - RNA, 19 nt, Homo sapiens
ggaccucagggacuaugga

SEQ ID NO: 503445 - RNA, 19 nt, Homo sapiens
gcccuguguccuuccauuu

SEQ ID NO: 503446 - RNA, 19 nt, Homo sapiens
auugagcccucuaacugaa

SEQ ID NO: 503447 - RNA, 19 nt, Homo sapiens
cgccugguguauccauuga

SEQ ID NO: 503448 - RNA, 19 nt, Homo sapiens
ugaauugcuguguuauaug

SEQ ID NO: 503449 - RNA, 19 nt, Homo sapiens
cuggcaaauucuucacuga

SEQ ID NO: 503450 - RNA, 19 nt, Homo sapiens
cgacugugacccugaagca

SEQ ID NO: 503451 - RNA, 19 nt, Homo sapiens
caaauucuucacugagucu

SEQ ID NO: 503452 - RNA, 19 nt, Homo sapiens
gaaauguucugucaaaugu

SEQ ID NO: 503453 - RNA, 19 nt, Homo sapiens
caacagaccucaggaaaga

SEQ ID NO: 503454 - RNA, 19 nt, Homo sapiens
gagcuuagauuucccuauu

SEQ ID NO: 503455 - RNA, 19 nt, Homo sapiens
gaaaugguauguagagcuu

SEQ ID NO: 503456 - RNA, 19 nt, Homo sapiens
uagagaggaugaagcauua

SEQ ID NO: 503457 - RNA, 19 nt, Homo sapiens
gaaaagaaaugguauguag

SEQ ID NO: 503458 - RNA, 19 nt, Homo sapiens
ccaagacacuauuugaauu

SEQ ID NO: 503459 - RNA, 19 nt, Homo sapiens
gagaagaucccuagugaga

SEQ ID NO: 503460 - RNA, 19 nt, Homo sapiens
ggaaggcgaucaucuccaa

SEQ ID NO: 503461 - RNA, 19 nt, Homo sapiens
aaaaggagcuucaguauug

SEQ ID NO: 503462 - RNA, 19 nt, Homo sapiens
ugagagaccugcugaacaa

SEQ ID NO: 503463 - RNA, 19 nt, Homo sapiens
gcuaugaguugaaauguuc

SEQ ID NO: 503464 - RNA, 19 nt, Homo sapiens
gccaauuucucucagauuu

SEQ ID NO: 503465 - RNA, 19 nt, Homo sapiens
gaagggagacaaucgcuuu

SEQ ID NO: 503466 - RNA, 19 nt, Homo sapiens
gaaaaucuguggcaaauca

SEQ ID NO: 503467 - RNA, 19 nt, Homo sapiens
ggaaccacauaauuaaaga

SEQ ID NO: 503468 - RNA, 19 nt, Homo sapiens
gcaugacccucaccucuau

SEQ ID NO: 503469 - RNA, 19 nt, Homo sapiens
ccacauuggugaugaaauc

SEQ ID NO: 503470 - RNA, 19 nt, Homo sapiens
gcgaucaucuccaauaaag

SEQ ID NO: 503471 - RNA, 19 nt, Homo sapiens
gcuaaagucucuccaaggu

SEQ ID NO: 503472 - RNA, 19 nt, Homo sapiens
acacgaugcuugaagguaa

SEQ ID NO: 503473 - RNA, 19 nt, Homo sapiens
aaacaugaaucaagcaauc

SEQ ID NO: 503474 - RNA, 19 nt, Homo sapiens
gaagaucccuagugagacu

SEQ ID NO: 503475 - RNA, 19 nt, Homo sapiens
caucagggcucaacacgau

SEQ ID NO: 503476 - RNA, 19 nt, Homo sapiens
gaaggagucuacacagucu

SEQ ID NO: 503477 - RNA, 19 nt, Homo sapiens
gcacuaauaggaaguacuu

SEQ ID NO: 503478 - RNA, 19 nt, Homo sapiens
gaguugaaauguucuguca

SEQ ID NO: 503479 - RNA, 19 nt, Homo sapiens
ucgagaagaucccuaguga

SEQ ID NO: 503480 - RNA, 19 nt, Homo sapiens
ugaauuggcugcagagucu

SEQ ID NO: 503481 - RNA, 19 nt, Homo sapiens
cuaaugggauuguaacugu

SEQ ID NO: 503482 - RNA, 19 nt, Homo sapiens
acagagccaugguguguuu

SEQ ID NO: 503483 - RNA, 19 nt, Homo sapiens
guauguagagcuuagauuu

SEQ ID NO: 503484 - RNA, 19 nt, Homo sapiens
cuaccacucucaaaccuuu

SEQ ID NO: 503485 - RNA, 19 nt, Homo sapiens
cuucggaaccacauaauua

SEQ ID NO: 503486 - RNA, 19 nt, Homo sapiens
uugcacagcuggagaaaug

SEQ ID NO: 503487 - RNA, 19 nt, Homo sapiens
gggaaguccuggcacaguu

SEQ ID NO: 503488 - RNA, 19 nt, Homo sapiens
aagaccagcuggccucuaa

SEQ ID NO: 503489 - RNA, 19 nt, Homo sapiens
ccacuacauugaugagcua

SEQ ID NO: 503490 - RNA, 19 nt, Homo sapiens
ccaaugaggccuucgagaa

SEQ ID NO: 503491 - RNA, 19 nt, Homo sapiens
caugguguguuuguaauaa

SEQ ID NO: 503492 - RNA, 19 nt, Homo sapiens
gauuguaacugugaacugu

SEQ ID NO: 503493 - RNA, 19 nt, Homo sapiens
gaacaaccacaucuugaag

SEQ ID NO: 503494 - RNA, 19 nt, Homo sapiens
aaucaacagucaucagcua

SEQ ID NO: 503495 - RNA, 19 nt, Homo sapiens
ggaauuugcuucggaacca

SEQ ID NO: 503496 - RNA, 19 nt, Homo sapiens
uugccaacauccugaaaua

SEQ ID NO: 503497 - RNA, 19 nt, Homo sapiens
caagacacuauuugaauug

SEQ ID NO: 503498 - RNA, 19 nt, Homo sapiens
gggaaggagucuacacagu

SEQ ID NO: 503499 - RNA, 19 nt, Homo sapiens
cgagugcuguccuggauau

SEQ ID NO: 503500 - RNA, 19 nt, Homo sapiens
gacagacccuggaaacucu

SEQ ID NO: 503501 - RNA, 19 nt, Homo sapiens
ggacagacccuggaaacuc

SEQ ID NO: 503502 - RNA, 19 nt, Homo sapiens
gaagguaacggccaguaca

SEQ ID NO: 503503 - RNA, 19 nt, Homo sapiens
gcuuagauuucccuauugu

SEQ ID NO: 503504 - RNA, 19 nt, Homo sapiens
gcaccauaaugagauguga

SEQ ID NO: 503505 - RNA, 19 nt, Homo sapiens
ggugaugaaauccugguua

SEQ ID NO: 503506 - RNA, 19 nt, Homo sapiens
ccaacaacauccagcagau

SEQ ID NO: 503507 - RNA, 19 nt, Homo sapiens
guaccagaauuccaacauc

SEQ ID NO: 503508 - RNA, 19 nt, Homo sapiens
ggaaguccuggcacaguuu

SEQ ID NO: 503509 - RNA, 19 nt, Homo sapiens
gaagguuauuggcacuaau

SEQ ID NO: 503510 - RNA, 19 nt, Homo sapiens
gugaugaaauccugguuag

SEQ ID NO: 503511 - RNA, 19 nt, Homo sapiens
gcagugguaccaaaggaaa

SEQ ID NO: 503512 - RNA, 19 nt, Homo sapiens
gagccaugguguguuugua

SEQ ID NO: 503513 - RNA, 19 nt, Homo sapiens
ugaaauguucugucaaaug

SEQ ID NO: 503514 - RNA, 19 nt, Homo sapiens
ucucucagauuuccacaga

SEQ ID NO: 503515 - RNA, 19 nt, Homo sapiens
gccaagacacuauuugaau

SEQ ID NO: 503516 - RNA, 19 nt, Homo sapiens
gggacaugcucacuaucaa

SEQ ID NO: 503517 - RNA, 19 nt, Homo sapiens
cauuauaagcuaugaguug

SEQ ID NO: 503518 - RNA, 19 nt, Homo sapiens
gaaaaggagcuucaguauu

SEQ ID NO: 503519 - RNA, 19 nt, Homo sapiens
agagacuguuugaauguuu

SEQ ID NO: 503520 - RNA, 19 nt, Homo sapiens
ucaccucuauguaccagaa

SEQ ID NO: 503521 - RNA, 19 nt, Homo sapiens
guaucacacuuuaauguac

SEQ ID NO: 503522 - RNA, 19 nt, Homo sapiens
ggaugaacuugcagacucu

SEQ ID NO: 503523 - RNA, 19 nt, Homo sapiens
gugcuguccuggauaugaa

SEQ ID NO: 503524 - RNA, 19 nt, Homo sapiens
aaucaucucucuggaagug

SEQ ID NO: 503525 - RNA, 19 nt, Homo sapiens
gcugaacaaccacaucuug

SEQ ID NO: 503526 - RNA, 19 nt, Homo sapiens
gaggagggagagagaugua

SEQ ID NO: 503527 - RNA, 19 nt, Homo sapiens
cggcagcucuccgccaauu

SEQ ID NO: 503528 - RNA, 19 nt, Homo sapiens
ggaaagaggggaugaacuu

SEQ ID NO: 503529 - RNA, 19 nt, Homo sapiens
cagcuggccucuaaguauc

SEQ ID NO: 503530 - RNA, 19 nt, Homo sapiens
ccacagccauugaccuuuu

SEQ ID NO: 503531 - RNA, 19 nt, Homo sapiens
caacagucaucagcuacga

SEQ ID NO: 503532 - RNA, 19 nt, Homo sapiens
gaucaucuccaauaaagac

SEQ ID NO: 503533 - RNA, 19 nt, Homo sapiens
caacauccagcagaucauu

SEQ ID NO: 503534 - RNA, 19 nt, Homo sapiens
gccaacagaccucaggaaa

SEQ ID NO: 503535 - RNA, 19 nt, Homo sapiens
ccagcuggccucuaaguau

SEQ ID NO: 503536 - RNA, 19 nt, Homo sapiens
ugacagagccauggugugu

SEQ ID NO: 503537 - RNA, 19 nt, Homo sapiens
gcagcucuccgccaauuuc

SEQ ID NO: 503538 - RNA, 19 nt, Homo sapiens
gaucuucaaacaagcauca

SEQ ID NO: 503539 - RNA, 19 nt, Homo sapiens
ugucauggauguccugaag

SEQ ID NO: 503540 - RNA, 19 nt, Homo sapiens
ugaacaaccacaucuugaa

SEQ ID NO: 503541 - RNA, 19 nt, Homo sapiens
ugagaucgaggacaccuuu

SEQ ID NO: 503542 - RNA, 19 nt, Homo sapiens
uggugcaccucaucgauaa

SEQ ID NO: 503543 - RNA, 19 nt, Homo sapiens
gaaagccgaccaccaugca

SEQ ID NO: 503544 - RNA, 19 nt, Homo sapiens
agaagguuauuggcacuaa

SEQ ID NO: 503545 - RNA, 19 nt, Homo sapiens
ggaaaaggagcuucaguau

SEQ ID NO: 503546 - RNA, 19 nt, Homo sapiens
cagagacuguuugaauguu

SEQ ID NO: 503547 - RNA, 19 nt, Homo sapiens
acucugcgcuugagaucuu

SEQ ID NO: 503548 - RNA, 19 nt, Homo sapiens
uaagcuaugaguugaaaug

SEQ ID NO: 503549 - RNA, 19 nt, Homo sapiens
cagccaagacacuauuuga

SEQ ID NO: 503550 - RNA, 19 nt, Homo sapiens
gugauccacuacauugaug

SEQ ID NO: 503551 - RNA, 19 nt, Homo sapiens
aggcgaucaucuccaauaa

SEQ ID NO: 503552 - RNA, 19 nt, Homo sapiens
gagaagaaguugcuguuaa

SEQ ID NO: 503553 - RNA, 19 nt, Homo sapiens
gaauggaacuugcuguauu

SEQ ID NO: 503554 - RNA, 19 nt, Homo sapiens
ggaaauugcucgacgaugu

SEQ ID NO: 503555 - RNA, 19 nt, Homo sapiens
ggaguuggauugcugaauu

SEQ ID NO: 503556 - RNA, 19 nt, Homo sapiens
agaaguugcuguuaagaua

SEQ ID NO: 503557 - RNA, 19 nt, Homo sapiens
gcugaaagucucuauguua

SEQ ID NO: 503558 - RNA, 19 nt, Homo sapiens
gaacuuccaacuacuguaa

SEQ ID NO: 503559 - RNA, 19 nt, Homo sapiens
gaguuggauugcugaauua

SEQ ID NO: 503560 - RNA, 19 nt, Homo sapiens
caaacgugcugacaucuau

SEQ ID NO: 503561 - RNA, 19 nt, Homo sapiens
gcaaugggcuuaguauucu

SEQ ID NO: 503562 - RNA, 19 nt, Homo sapiens
cagcuaggcuuacagcauu

SEQ ID NO: 503563 - RNA, 19 nt, Homo sapiens
gcucgacgauguuccauug

SEQ ID NO: 503564 - RNA, 19 nt, Homo sapiens
guuaagauauucuccucua

SEQ ID NO: 503565 - RNA, 19 nt, Homo sapiens
ccacagauaccauugauau

SEQ ID NO: 503566 - RNA, 19 nt, Homo sapiens
gagaagaacguucgugguu

SEQ ID NO: 503567 - RNA, 19 nt, Homo sapiens
ggagaaguuuggagaggaa

SEQ ID NO: 503568 - RNA, 19 nt, Homo sapiens
cugaaagucucuauguuaa

SEQ ID NO: 503569 - RNA, 19 nt, Homo sapiens
ccacuucugugucuuucua

SEQ ID NO: 503570 - RNA, 19 nt, Homo sapiens
gcaacucagucaacaggaa

SEQ ID NO: 503571 - RNA, 19 nt, Homo sapiens
ccaaauaucccaaacagau

SEQ ID NO: 503572 - RNA, 19 nt, Homo sapiens
ugcgagaacuauuguguua

SEQ ID NO: 503573 - RNA, 19 nt, Homo sapiens
gcagagauuuaucaaacug

SEQ ID NO: 503574 - RNA, 19 nt, Homo sapiens
aaauagaacuuccaacuac

SEQ ID NO: 503575 - RNA, 19 nt, Homo sapiens
gaccacagacaaaguuaua

SEQ ID NO: 503576 - RNA, 19 nt, Homo sapiens
ugaauguacuguucuauag

SEQ ID NO: 503577 - RNA, 19 nt, Homo sapiens
gaacagaaggauauugcuu

SEQ ID NO: 503578 - RNA, 19 nt, Homo sapiens
ugugaagccuugagaguaa

SEQ ID NO: 503579 - RNA, 19 nt, Homo sapiens
guacuacguugaaagacuu

SEQ ID NO: 503580 - RNA, 19 nt, Homo sapiens
cgagauaggccguuuguau

SEQ ID NO: 503581 - RNA, 19 nt, Homo sapiens
gaacauuacaugccuucaa

SEQ ID NO: 503582 - RNA, 19 nt, Homo sapiens
ggagaagaaguugcuguua

SEQ ID NO: 503583 - RNA, 19 nt, Homo sapiens
gggcaaaggaguuggauug

SEQ ID NO: 503584 - RNA, 19 nt, Homo sapiens
ggucuuaacuuuagguaac

SEQ ID NO: 503585 - RNA, 19 nt, Homo sapiens
gcacuaugaacgcuucuuu

SEQ ID NO: 503586 - RNA, 19 nt, Homo sapiens
cgacggcguuacaguguuu

SEQ ID NO: 503587 - RNA, 19 nt, Homo sapiens
ggaacuggcagcugucauu

SEQ ID NO: 503588 - RNA, 19 nt, Homo sapiens
ccauugauauugcuccaaa

SEQ ID NO: 503589 - RNA, 19 nt, Homo sapiens
gagauaggccguuuguaug

SEQ ID NO: 503590 - RNA, 19 nt, Homo sapiens
gaguagaauugcugaaagu

SEQ ID NO: 503591 - RNA, 19 nt, Homo sapiens
gaugauugcuggucuuaac

SEQ ID NO: 503592 - RNA, 19 nt, Homo sapiens
auuaccaacugccuuauua

SEQ ID NO: 503593 - RNA, 19 nt, Homo sapiens
ggacucagcucugguuggu

SEQ ID NO: 503594 - RNA, 19 nt, Homo sapiens
gaaauugcucgacgauguu

SEQ ID NO: 503595 - RNA, 19 nt, Homo sapiens
cgagaacuauuguguuaca

SEQ ID NO: 503596 - RNA, 19 nt, Homo sapiens
caacuacuguaaagucauc

SEQ ID NO: 503597 - RNA, 19 nt, Homo sapiens
ucaggaccauugcaauaaa

SEQ ID NO: 503598 - RNA, 19 nt, Homo sapiens
gaaguuaaggccaaauauc

SEQ ID NO: 503599 - RNA, 19 nt, Homo sapiens
gagaaaaguuguuugugaa

SEQ ID NO: 503600 - RNA, 19 nt, Homo sapiens
ccaacugccuuauuaugau

SEQ ID NO: 503601 - RNA, 19 nt, Homo sapiens
gacaauaaagacaauggua

SEQ ID NO: 503602 - RNA, 19 nt, Homo sapiens
ucacagagaccacagacaa

SEQ ID NO: 503603 - RNA, 19 nt, Homo sapiens
gaacaauugcgagaacuau

SEQ ID NO: 503604 - RNA, 19 nt, Homo sapiens
ggucugugacuacaacaua

SEQ ID NO: 503605 - RNA, 19 nt, Homo sapiens
uaaagaagaauggaacuug

SEQ ID NO: 503606 - RNA, 19 nt, Homo sapiens
ggaaaugaguagaauugcu

SEQ ID NO: 503607 - RNA, 19 nt, Homo sapiens
aacauuacaugccuucaaa

SEQ ID NO: 503608 - RNA, 19 nt, Homo sapiens
gauugcuggucuuaacuuu

SEQ ID NO: 503609 - RNA, 19 nt, Homo sapiens
gaugggcucugcuuugucu

SEQ ID NO: 503610 - RNA, 19 nt, Homo sapiens
ucaugaagauuaccaacug

SEQ ID NO: 503611 - RNA, 19 nt, Homo sapiens
cagacaaaguuauacacaa

SEQ ID NO: 503612 - RNA, 19 nt, Homo sapiens
ggaacauaauucaugcaau

SEQ ID NO: 503613 - RNA, 19 nt, Homo sapiens
cacuagaguuuccuugauu

SEQ ID NO: 503614 - RNA, 19 nt, Homo sapiens
ccacuagaguuuccuugau

SEQ ID NO: 503615 - RNA, 19 nt, Homo sapiens
cagaucugcuccuggguuu

SEQ ID NO: 503616 - RNA, 19 nt, Homo sapiens
agaagaaguugcuguuaag

SEQ ID NO: 503617 - RNA, 19 nt, Homo sapiens
gaagaaaugagaaaaguug

SEQ ID NO: 503618 - RNA, 19 nt, Homo sapiens
gaaguugcuguuaagauau

SEQ ID NO: 503619 - RNA, 19 nt, Homo sapiens
uggcucagguuuaccauug

SEQ ID NO: 503620 - RNA, 19 nt, Homo sapiens
gcaguguaauaaagucaau

SEQ ID NO: 503621 - RNA, 19 nt, Homo sapiens
ugagaaaaguuguuuguga

SEQ ID NO: 503622 - RNA, 19 nt, Homo sapiens
guggaauucaugaagauua

SEQ ID NO: 503623 - RNA, 19 nt, Homo sapiens
uauagcagcagacaauaaa

SEQ ID NO: 503624 - RNA, 19 nt, Homo sapiens
ugacuuaauuccucgagau

SEQ ID NO: 503625 - RNA, 19 nt, Homo sapiens
ucauguugauggucuauau

SEQ ID NO: 503626 - RNA, 19 nt, Homo sapiens
gcaucucacucauguugau

SEQ ID NO: 503627 - RNA, 19 nt, Homo sapiens
aaucaggaccauugcaaua

SEQ ID NO: 503628 - RNA, 19 nt, Homo sapiens
guagugaggaacauaauuc

SEQ ID NO: 503629 - RNA, 19 nt, Homo sapiens
cagcauugcggauuaagaa

SEQ ID NO: 503630 - RNA, 19 nt, Homo sapiens
gugcugacaucuaugcaau

SEQ ID NO: 503631 - RNA, 19 nt, Homo sapiens
aauggaacuugcuguauug

SEQ ID NO: 503632 - RNA, 19 nt, Homo sapiens
caagaaagcauuggcaaag

SEQ ID NO: 503633 - RNA, 19 nt, Homo sapiens
agaggacccuucauuagau

SEQ ID NO: 503634 - RNA, 19 nt, Homo sapiens
gcauguguauagcugaaau

SEQ ID NO: 503635 - RNA, 19 nt, Homo sapiens
guguauagcugaaauugac

SEQ ID NO: 503636 - RNA, 19 nt, Homo sapiens
cuuacagcauugcggauua

SEQ ID NO: 503637 - RNA, 19 nt, Homo sapiens
ggccaaauaucccaaacag

SEQ ID NO: 503638 - RNA, 19 nt, Homo sapiens
caacugccuuauuaugauc

SEQ ID NO: 503639 - RNA, 19 nt, Homo sapiens
acagauaccauugauauug

SEQ ID NO: 503640 - RNA, 19 nt, Homo sapiens
gaucaucuuuaagggcaaa

SEQ ID NO: 503641 - RNA, 19 nt, Homo sapiens
gagagggaacagaaggaua

SEQ ID NO: 503642 - RNA, 19 nt, Homo sapiens
cagaaguuaaggccaaaua

SEQ ID NO: 503643 - RNA, 19 nt, Homo sapiens
agacaaaguuauacacaac

SEQ ID NO: 503644 - RNA, 19 nt, Homo sapiens
ucacugagagggaacagaa

SEQ ID NO: 503645 - RNA, 19 nt, Homo sapiens
uuacagcauugcggauuaa

SEQ ID NO: 503646 - RNA, 19 nt, Homo sapiens
guacauggccccugaaguu

SEQ ID NO: 503647 - RNA, 19 nt, Homo sapiens
uaagauauucuccucuaga

SEQ ID NO: 503648 - RNA, 19 nt, Homo sapiens
gaagaaguugcuguuaaga

SEQ ID NO: 503649 - RNA, 19 nt, Homo sapiens
gaacuggcagcugucauug

SEQ ID NO: 503650 - RNA, 19 nt, Homo sapiens
gugaggaacauaauucaug

SEQ ID NO: 503651 - RNA, 19 nt, Homo sapiens
agaguuuccuugauucaga

SEQ ID NO: 503652 - RNA, 19 nt, Homo sapiens
gugcuuagcuuucagauua

SEQ ID NO: 503653 - RNA, 19 nt, Homo sapiens
ggagagauaucaccuauga

SEQ ID NO: 503654 - RNA, 19 nt, Homo sapiens
uaucagagguuucaucauu

SEQ ID NO: 503655 - RNA, 19 nt, Homo sapiens
gauccaaggucaaguauca

SEQ ID NO: 503656 - RNA, 19 nt, Homo sapiens
caaauccucuucccuuauu

SEQ ID NO: 503657 - RNA, 19 nt, Homo sapiens
caaguuaaguuccaaacaa

SEQ ID NO: 503658 - RNA, 19 nt, Homo sapiens
gaaugagaauggcaagaaa

SEQ ID NO: 503659 - RNA, 19 nt, Homo sapiens
cuacuugucugcaauugua

SEQ ID NO: 503660 - RNA, 19 nt, Homo sapiens
ggugugaacucuuucuuug

SEQ ID NO: 503661 - RNA, 19 nt, Homo sapiens
gcauuucccugcugacuga

SEQ ID NO: 503662 - RNA, 19 nt, Homo sapiens
caagacaggcggagagaua

SEQ ID NO: 503663 - RNA, 19 nt, Homo sapiens
gaagugcauucuccuccua

SEQ ID NO: 503664 - RNA, 19 nt, Homo sapiens
gaaaccacauccuuaaguc

SEQ ID NO: 503665 - RNA, 19 nt, Homo sapiens
gaagaccgcugcccuacag

SEQ ID NO: 503666 - RNA, 19 nt, Homo sapiens
aagaguacauccucaauga

SEQ ID NO: 503667 - RNA, 19 nt, Homo sapiens
aaucauggccucugaagua

SEQ ID NO: 503668 - RNA, 19 nt, Homo sapiens
ggccugaacucaccauaga

SEQ ID NO: 503669 - RNA, 19 nt, Homo sapiens
aaacuggacccaagaaauu

SEQ ID NO: 503670 - RNA, 19 nt, Homo sapiens
caacuggagugcucucuca

SEQ ID NO: 503671 - RNA, 19 nt, Homo sapiens
gauuaaugcucagaagauu

SEQ ID NO: 503672 - RNA, 19 nt, Homo sapiens
ccaaacaagugaaagagau

SEQ ID NO: 503673 - RNA, 19 nt, Homo sapiens
gcagauccaaggucaagua

SEQ ID NO: 503674 - RNA, 19 nt, Homo sapiens
gcaagaaaaucaccaguau

SEQ ID NO: 503675 - RNA, 19 nt, Homo sapiens
gcggagagauaucaccuau

SEQ ID NO: 503676 - RNA, 19 nt, Homo sapiens
gcuuucagauuauggauga

SEQ ID NO: 503677 - RNA, 19 nt, Homo sapiens
ggucaaguaucagaaguga

SEQ ID NO: 503678 - RNA, 19 nt, Homo sapiens
gaccauccaaucccaaaua

SEQ ID NO: 503679 - RNA, 19 nt, Homo sapiens
caaaagagcugcaaguucu

SEQ ID NO: 503680 - RNA, 19 nt, Homo sapiens
ccagaaguaucaaaugcaa

SEQ ID NO: 503681 - RNA, 19 nt, Homo sapiens
ccucuucccuuauucuaaa

SEQ ID NO: 503682 - RNA, 19 nt, Homo sapiens
caagaaauuuaucgucaag

SEQ ID NO: 503683 - RNA, 19 nt, Homo sapiens
ccacgacucugucuggaau

SEQ ID NO: 503684 - RNA, 19 nt, Homo sapiens
ccaagaaauuuaucgucaa

SEQ ID NO: 503685 - RNA, 19 nt, Homo sapiens
gcaggaggaguuacacgua

SEQ ID NO: 503686 - RNA, 19 nt, Homo sapiens
ccacuauccuggcaacuca

SEQ ID NO: 503687 - RNA, 19 nt, Homo sapiens
ggaugggccugauagaagu

SEQ ID NO: 503688 - RNA, 19 nt, Homo sapiens
cggaaauuguggagucuaa

SEQ ID NO: 503689 - RNA, 19 nt, Homo sapiens
gcugcaaguucuccacauu

SEQ ID NO: 503690 - RNA, 19 nt, Homo sapiens
gcaaagaguacauccucaa

SEQ ID NO: 503691 - RNA, 19 nt, Homo sapiens
ggaaaccacauccuuaagu

SEQ ID NO: 503692 - RNA, 19 nt, Homo sapiens
gcaaauccucuucccuuau

SEQ ID NO: 503693 - RNA, 19 nt, Homo sapiens
gcaagaagauggcaaaacu

SEQ ID NO: 503694 - RNA, 19 nt, Homo sapiens
acaccuaugugaaugagaa

SEQ ID NO: 503695 - RNA, 19 nt, Homo sapiens
caaacgagcaguccugugu

SEQ ID NO: 503696 - RNA, 19 nt, Homo sapiens
uaguugagauuucagcauu

SEQ ID NO: 503697 - RNA, 19 nt, Homo sapiens
ucacaugucgguacaauca

SEQ ID NO: 503698 - RNA, 19 nt, Homo sapiens
gugacaggcucaucugguu

SEQ ID NO: 503699 - RNA, 19 nt, Homo sapiens
ggccaugugugcuaugaug

SEQ ID NO: 503700 - RNA, 19 nt, Homo sapiens
uugagaagcugccauaucu

SEQ ID NO: 503701 - RNA, 19 nt, Homo sapiens
gagauaucaccuaugagua

SEQ ID NO: 503702 - RNA, 19 nt, Homo sapiens
cgauucagcucacgacaca

SEQ ID NO: 503703 - RNA, 19 nt, Homo sapiens
acucaaggcugcuucuguu

SEQ ID NO: 503704 - RNA, 19 nt, Homo sapiens
gucaaguucucuuuggaaa

SEQ ID NO: 503705 - RNA, 19 nt, Homo sapiens
cacauugacuucuugaauc

SEQ ID NO: 503706 - RNA, 19 nt, Homo sapiens
cacagaaucccaucccuuu

SEQ ID NO: 503707 - RNA, 19 nt, Homo sapiens
cauggccucugaaguauuc

SEQ ID NO: 503708 - RNA, 19 nt, Homo sapiens
ccagauucgucuucucaga

SEQ ID NO: 503709 - RNA, 19 nt, Homo sapiens
caagugaaagagauuaaug

SEQ ID NO: 503710 - RNA, 19 nt, Homo sapiens
ccacauugacuucuugaau

SEQ ID NO: 503711 - RNA, 19 nt, Homo sapiens
cugggaaacucuguuaauu

SEQ ID NO: 503712 - RNA, 19 nt, Homo sapiens
ucaccuaugaguacaagua

SEQ ID NO: 503713 - RNA, 19 nt, Homo sapiens
agcaaauccucuucccuua

SEQ ID NO: 503714 - RNA, 19 nt, Homo sapiens
caacaucuugggcuccuuu

SEQ ID NO: 503715 - RNA, 19 nt, Homo sapiens
cugaugcuguggagccuua

SEQ ID NO: 503716 - RNA, 19 nt, Homo sapiens
gagauuaaugcucagaaga

SEQ ID NO: 503717 - RNA, 19 nt, Homo sapiens
caaacaagugaaagagauu

SEQ ID NO: 503718 - RNA, 19 nt, Homo sapiens
gaaaucauggccucugaag

SEQ ID NO: 503719 - RNA, 19 nt, Homo sapiens
ucaauaagaccucgcagau

SEQ ID NO: 503720 - RNA, 19 nt, Homo sapiens
ggacggaugccuggaugaa

SEQ ID NO: 503721 - RNA, 19 nt, Homo sapiens
gagccuuaguugagauuuc

SEQ ID NO: 503722 - RNA, 19 nt, Homo sapiens
agaauuggccagcuacuug

SEQ ID NO: 503723 - RNA, 19 nt, Homo sapiens
ugggaaacucuguuaauuu

SEQ ID NO: 503724 - RNA, 19 nt, Homo sapiens
gaaugggcaggaggaguua

SEQ ID NO: 503725 - RNA, 19 nt, Homo sapiens
guaaagaggacaugguuuu

SEQ ID NO: 503726 - RNA, 19 nt, Homo sapiens
ucaaggcugcuucuguuaa

SEQ ID NO: 503727 - RNA, 19 nt, Homo sapiens
gcacugggaugggccugau

SEQ ID NO: 503728 - RNA, 19 nt, Homo sapiens
agaggcaggucauggauca

SEQ ID NO: 503729 - RNA, 19 nt, Homo sapiens
aaggugacaucuuuauugu

SEQ ID NO: 503730 - RNA, 19 nt, Homo sapiens
gcagggccaugugugcuau

SEQ ID NO: 503731 - RNA, 19 nt, Homo sapiens
acauugacuucuugaauca

SEQ ID NO: 503732 - RNA, 19 nt, Homo sapiens
gcaaguaccaacuaaacgu

SEQ ID NO: 503733 - RNA, 19 nt, Homo sapiens
gauaucaccuaugaguaca

SEQ ID NO: 503734 - RNA, 19 nt, Homo sapiens
ugaaugagaauggcaagaa

SEQ ID NO: 503735 - RNA, 19 nt, Homo sapiens
gcuaugaugagcuuugaga

SEQ ID NO: 503736 - RNA, 19 nt, Homo sapiens
gggaugggccugauagaag

SEQ ID NO: 503737 - RNA, 19 nt, Homo sapiens
ugacgacccuugagaagcu

SEQ ID NO: 503738 - RNA, 19 nt, Homo sapiens
ugaaugggcaggaggaguu

SEQ ID NO: 503739 - RNA, 19 nt, Homo sapiens
ugcaaguucuccacauuga

SEQ ID NO: 503740 - RNA, 19 nt, Homo sapiens
ggacaccuaugugaaugag

SEQ ID NO: 503741 - RNA, 19 nt, Homo sapiens
gaguacauccucaaugaca

SEQ ID NO: 503742 - RNA, 19 nt, Homo sapiens
gaacucuuucuuugguauu

SEQ ID NO: 503743 - RNA, 19 nt, Homo sapiens
ugucugcaauuguaucuuc

SEQ ID NO: 503744 - RNA, 19 nt, Homo sapiens
ggaaaucauggccucugaa

SEQ ID NO: 503745 - RNA, 19 nt, Homo sapiens
caaagaguacauccucaau

SEQ ID NO: 503746 - RNA, 19 nt, Homo sapiens
aaaugagucuggcaaagag

SEQ ID NO: 503747 - RNA, 19 nt, Homo sapiens
caaggcugcuucuguuaac

SEQ ID NO: 503748 - RNA, 19 nt, Homo sapiens
ugaacucuuucuuugguau

SEQ ID NO: 503749 - RNA, 19 nt, Homo sapiens
gugaacucuuucuuuggua

SEQ ID NO: 503750 - RNA, 19 nt, Homo sapiens
caucuugggcuccuuugaa

SEQ ID NO: 503751 - RNA, 19 nt, Homo sapiens
ccgcugcccuacagaaugu

SEQ ID NO: 503752 - RNA, 19 nt, Homo sapiens
gaaaugacaucucgcugua

SEQ ID NO: 503753 - RNA, 19 nt, Homo sapiens
gaagacggcucccuaaaca

SEQ ID NO: 503754 - RNA, 19 nt, Homo sapiens
gaacauaacacuagagaca

SEQ ID NO: 503755 - RNA, 19 nt, Homo sapiens
guucagaagucgguuaaua

SEQ ID NO: 503756 - RNA, 19 nt, Homo sapiens
caaagugcauuaugaagga

SEQ ID NO: 503757 - RNA, 19 nt, Homo sapiens
caacaacggugcagucaag

SEQ ID NO: 503758 - RNA, 19 nt, Homo sapiens
ggagaaagaaugacgagaa

SEQ ID NO: 503759 - RNA, 19 nt, Homo sapiens
ccaauauccucgugaagaa

SEQ ID NO: 503760 - RNA, 19 nt, Homo sapiens
aaacaauacuggcugauca

SEQ ID NO: 503761 - RNA, 19 nt, Homo sapiens
gaccagaaauucccagcuu

SEQ ID NO: 503762 - RNA, 19 nt, Homo sapiens
gaauauaacaccagcaauc

SEQ ID NO: 503763 - RNA, 19 nt, Homo sapiens
gaagaugaccgcucugaca

SEQ ID NO: 503764 - RNA, 19 nt, Homo sapiens
cagcaauccugacuuguug

SEQ ID NO: 503765 - RNA, 19 nt, Homo sapiens
ggaagucuguguggcugua

SEQ ID NO: 503766 - RNA, 19 nt, Homo sapiens
gucaagaucuuucccuaug

SEQ ID NO: 503767 - RNA, 19 nt, Homo sapiens
caacggugcagucaaguuu

SEQ ID NO: 503768 - RNA, 19 nt, Homo sapiens
ccuaaacacuaccaaauag

SEQ ID NO: 503769 - RNA, 19 nt, Homo sapiens
ucagugagcuggagcaucu

SEQ ID NO: 503770 - RNA, 19 nt, Homo sapiens
gaaagaaugacgagaacau

SEQ ID NO: 503771 - RNA, 19 nt, Homo sapiens
gagaaagaaugacgagaac

SEQ ID NO: 503772 - RNA, 19 nt, Homo sapiens
cuagucauauuucaaguga

SEQ ID NO: 503773 - RNA, 19 nt, Homo sapiens
ggugagacuuucuucaugu

SEQ ID NO: 503774 - RNA, 19 nt, Homo sapiens
auacauggcuccagaaguc

SEQ ID NO: 503775 - RNA, 19 nt, Homo sapiens
ccaacaacaucaaccacaa

SEQ ID NO: 503776 - RNA, 19 nt, Homo sapiens
gaucgagggcgaccagaaa

SEQ ID NO: 503777 - RNA, 19 nt, Homo sapiens
aaccagaaauccugcauga

SEQ ID NO: 503778 - RNA, 19 nt, Homo sapiens
ucuccaaagugcauuauga

SEQ ID NO: 503779 - RNA, 19 nt, Homo sapiens
acaucaaucugaagcauga

SEQ ID NO: 503780 - RNA, 19 nt, Homo sapiens
gaacacuucagagcaguuu

SEQ ID NO: 503781 - RNA, 19 nt, Homo sapiens
gagacuuucuucauguguu

SEQ ID NO: 503782 - RNA, 19 nt, Homo sapiens
ucaagaucuuucccuauga

SEQ ID NO: 503783 - RNA, 19 nt, Homo sapiens
caacaucaaccacaacaca

SEQ ID NO: 503784 - RNA, 19 nt, Homo sapiens
caccagcaauccugacuug

SEQ ID NO: 503785 - RNA, 19 nt, Homo sapiens
gagaacauaacacuagaga

SEQ ID NO: 503786 - RNA, 19 nt, Homo sapiens
ggaugaauuuggagaaugc

SEQ ID NO: 503787 - RNA, 19 nt, Homo sapiens
gcuccaauauccucgugaa

SEQ ID NO: 503788 - RNA, 19 nt, Homo sapiens
gaguugaaguugagugagu

SEQ ID NO: 503789 - RNA, 19 nt, Homo sapiens
ugccauaucugucaucauc

SEQ ID NO: 503790 - RNA, 19 nt, Homo sapiens
gcagucaaguuuccacaac

SEQ ID NO: 503791 - RNA, 19 nt, Homo sapiens
ggagaagauuccugaagac

SEQ ID NO: 503792 - RNA, 19 nt, Homo sapiens
cagagcugcugcccauuga

SEQ ID NO: 503793 - RNA, 19 nt, Homo sapiens
ggaguugccauaucuguca

SEQ ID NO: 503794 - RNA, 19 nt, Homo sapiens
ggacaucuucucagacauc

SEQ ID NO: 503795 - RNA, 19 nt, Homo sapiens
cgcggaagcucauggaguu

SEQ ID NO: 503796 - RNA, 19 nt, Homo sapiens
gacgagaacauaacacuag

SEQ ID NO: 503797 - RNA, 19 nt, Homo sapiens
aggccaagcugaagcagaa

SEQ ID NO: 503798 - RNA, 19 nt, Homo sapiens
gcgcugaguugaaguugag

SEQ ID NO: 503799 - RNA, 19 nt, Homo sapiens
gaaacaauacuggcugauc

SEQ ID NO: 503800 - RNA, 19 nt, Homo sapiens
gauuaugagccuccauuug

SEQ ID NO: 503801 - RNA, 19 nt, Homo sapiens
caagaucuuucccuaugag

SEQ ID NO: 503802 - RNA, 19 nt, Homo sapiens
aaagaaugacgagaacaua

SEQ ID NO: 503803 - RNA, 19 nt, Homo sapiens
gaccucaagagcuccaaua

SEQ ID NO: 503804 - RNA, 19 nt, Homo sapiens
ucugaagcaugagaacaua

SEQ ID NO: 503805 - RNA, 19 nt, Homo sapiens
cagcaucaccuccaucugu

SEQ ID NO: 503806 - RNA, 19 nt, Homo sapiens
aaugacaucucgcuguaau

SEQ ID NO: 503807 - RNA, 19 nt, Homo sapiens
aaggacaucuucucagaca

SEQ ID NO: 503808 - RNA, 19 nt, Homo sapiens
ccagcaauccugacuuguu

SEQ ID NO: 503809 - RNA, 19 nt, Homo sapiens
cccuaaacacuaccaaaua

SEQ ID NO: 503810 - RNA, 19 nt, Homo sapiens
uggcagaacgcuucaguga

SEQ ID NO: 503811 - RNA, 19 nt, Homo sapiens
aagaaugacgagaacauaa

SEQ ID NO: 503812 - RNA, 19 nt, Homo sapiens
gcaugaaggacaacguguu

SEQ ID NO: 503813 - RNA, 19 nt, Homo sapiens
agacagagaaggacaucuu

SEQ ID NO: 503814 - RNA, 19 nt, Homo sapiens
ugagugcaaugacaacauc

SEQ ID NO: 503815 - RNA, 19 nt, Homo sapiens
gaaugacgagaacauaaca

SEQ ID NO: 503816 - RNA, 19 nt, Homo sapiens
ucgaaagcaugaaggacaa

SEQ ID NO: 503817 - RNA, 19 nt, Homo sapiens
guaaugcagugggagaagu

SEQ ID NO: 503818 - RNA, 19 nt, Homo sapiens
cucaagagcuccaauaucc

SEQ ID NO: 503819 - RNA, 19 nt, Homo sapiens
cagagcaguuugagacagu

SEQ ID NO: 503820 - RNA, 19 nt, Homo sapiens
uagagacaguuugccauga

SEQ ID NO: 503821 - RNA, 19 nt, Homo sapiens
gcucugaugagugcaauga

SEQ ID NO: 503822 - RNA, 19 nt, Homo sapiens
ugggagaaguaaaagauua

SEQ ID NO: 503823 - RNA, 19 nt, Homo sapiens
caggaugaauuuggagaau

SEQ ID NO: 503824 - RNA, 19 nt, Homo sapiens
gcaagacgcggaagcucau

SEQ ID NO: 503825 - RNA, 19 nt, Homo sapiens
ccauaucugucaucaucau

SEQ ID NO: 503826 - RNA, 19 nt, Homo sapiens
ccgcagcgcugaguugaag

SEQ ID NO: 503827 - RNA, 19 nt, Homo sapiens
gacaguggcagucaagauc

SEQ ID NO: 503828 - RNA, 19 nt, Homo sapiens
uaaugcagugggagaagua

SEQ ID NO: 503829 - RNA, 19 nt, Homo sapiens
uggaugaccuggcuaacag

SEQ ID NO: 503830 - RNA, 19 nt, Homo sapiens
ugugagacguugacugagu

SEQ ID NO: 503831 - RNA, 19 nt, Homo sapiens
ugugugagacguugacuga

SEQ ID NO: 503832 - RNA, 19 nt, Homo sapiens
caucuucucagacaucaau

SEQ ID NO: 503833 - RNA, 19 nt, Homo sapiens
guggcuguauggagaaaga

SEQ ID NO: 503834 - RNA, 19 nt, Homo sapiens
uucagaagucgguuaauaa

SEQ ID NO: 503835 - RNA, 19 nt, Homo sapiens
gugagaagccacaggaagu

SEQ ID NO: 503836 - RNA, 19 nt, Homo sapiens
gaagacagagaaggacauc

SEQ ID NO: 503837 - RNA, 19 nt, Homo sapiens
gcuuugcugaggucuauaa

SEQ ID NO: 503838 - RNA, 19 nt, Homo sapiens
gaugcugcuucuccaaagu

SEQ ID NO: 503839 - RNA, 19 nt, Homo sapiens
acauaacacuagagacagu

SEQ ID NO: 503840 - RNA, 19 nt, Homo sapiens
ugacgagaacauaacacua

SEQ ID NO: 503841 - RNA, 19 nt, Homo sapiens
gcucuggugcucugggaaa

SEQ ID NO: 503842 - RNA, 19 nt, Homo sapiens
gugagacuuucuucaugug

SEQ ID NO: 503843 - RNA, 19 nt, Homo sapiens
cuccagaaguccuagaauc

SEQ ID NO: 503844 - RNA, 19 nt, Homo sapiens
gacaucuucucagacauca

SEQ ID NO: 503845 - RNA, 19 nt, Homo sapiens
ucuauaaggccaagcugaa

SEQ ID NO: 503846 - RNA, 19 nt, Homo sapiens
ucgcuuugcugaggucuau

SEQ ID NO: 503847 - RNA, 19 nt, Homo sapiens
gcagcgcugaguugaaguu

SEQ ID NO: 503848 - RNA, 19 nt, Homo sapiens
uaucugucaucaucaucuu

SEQ ID NO: 503849 - RNA, 19 nt, Homo sapiens
acaacaucaucuucucaga

SEQ ID NO: 503850 - RNA, 19 nt, Homo sapiens
agacuuucuucauguguuc

SEQ ID NO: 503851 - RNA, 19 nt, Homo sapiens
cuggugcucugggaaauga

SEQ ID NO: 503852 - RNA, 19 nt, Homo sapiens
ucaauuaccuugcugagua

SEQ ID NO: 503853 - RNA, 19 nt, Homo sapiens
ggacgaauuugcacaguga

SEQ ID NO: 503854 - RNA, 19 nt, Homo sapiens
gugagaacauccauaauuu

SEQ ID NO: 503855 - RNA, 19 nt, Homo sapiens
gcacagugauauauuucua

SEQ ID NO: 503856 - RNA, 19 nt, Homo sapiens
gaagcagaaucuaaagaaa

SEQ ID NO: 503857 - RNA, 19 nt, Homo sapiens
gcaaaugcauggcaaaucu

SEQ ID NO: 503858 - RNA, 19 nt, Homo sapiens
gagaauauuuguccuaaag

SEQ ID NO: 503859 - RNA, 19 nt, Homo sapiens
gaagugggcuuuggacaau

SEQ ID NO: 503860 - RNA, 19 nt, Homo sapiens
guacgaagauggagaagca

SEQ ID NO: 503861 - RNA, 19 nt, Homo sapiens
caagauagcaagaaacauu

SEQ ID NO: 503862 - RNA, 19 nt, Homo sapiens
auacaacacugaccucuuu

SEQ ID NO: 503863 - RNA, 19 nt, Homo sapiens
guaaagacagagugaauuu

SEQ ID NO: 503864 - RNA, 19 nt, Homo sapiens
gauaggaugucucauuaca

SEQ ID NO: 503865 - RNA, 19 nt, Homo sapiens
gacaaugaccaaaucaaua

SEQ ID NO: 503866 - RNA, 19 nt, Homo sapiens
guacaucuauucucacaca

SEQ ID NO: 503867 - RNA, 19 nt, Homo sapiens
gaaggaaccaaauccaauu

SEQ ID NO: 503868 - RNA, 19 nt, Homo sapiens
cugauaggaugucucauua

SEQ ID NO: 503869 - RNA, 19 nt, Homo sapiens
ggagucaggugauaaugga

SEQ ID NO: 503870 - RNA, 19 nt, Homo sapiens
gacaauggcuauaguccaa

SEQ ID NO: 503871 - RNA, 19 nt, Homo sapiens
gaaaauguccuuaugcuuu

SEQ ID NO: 503872 - RNA, 19 nt, Homo sapiens
uuacaggccuacagaaauu

SEQ ID NO: 503873 - RNA, 19 nt, Homo sapiens
uuacuucucuugccuuaaa

SEQ ID NO: 503874 - RNA, 19 nt, Homo sapiens
ggugagaacauccauaauu

SEQ ID NO: 503875 - RNA, 19 nt, Homo sapiens
gaucuggagucaggugaua

SEQ ID NO: 503876 - RNA, 19 nt, Homo sapiens
uauaagaccuucucaagag

SEQ ID NO: 503877 - RNA, 19 nt, Homo sapiens
gaacaagaacugggauuug

SEQ ID NO: 503878 - RNA, 19 nt, Homo sapiens
gaaaucgugguguuuaauu

SEQ ID NO: 503879 - RNA, 19 nt, Homo sapiens
ugaaagaucuaugacaaug

SEQ ID NO: 503880 - RNA, 19 nt, Homo sapiens
gaucaaguguucccuccaa

SEQ ID NO: 503881 - RNA, 19 nt, Homo sapiens
ccaagacagugcugagauu

SEQ ID NO: 503882 - RNA, 19 nt, Homo sapiens
ccaguugguuaucugaaua

SEQ ID NO: 503883 - RNA, 19 nt, Homo sapiens
uaagacuacuucugauuug

SEQ ID NO: 503884 - RNA, 19 nt, Homo sapiens
gggccaugaugcagaauaa

SEQ ID NO: 503885 - RNA, 19 nt, Homo sapiens
ccaauaacuucauacacaa

SEQ ID NO: 503886 - RNA, 19 nt, Homo sapiens
gcagaagggugugugaugu

SEQ ID NO: 503887 - RNA, 19 nt, Homo sapiens
auggagagcuucacuguuu

SEQ ID NO: 503888 - RNA, 19 nt, Homo sapiens
gagacgcacuguuggagaa

SEQ ID NO: 503889 - RNA, 19 nt, Homo sapiens
gcaaggagggacuuuaaga

SEQ ID NO: 503890 - RNA, 19 nt, Homo sapiens
caauggcuauaguccaaua

SEQ ID NO: 503891 - RNA, 19 nt, Homo sapiens
ccagguggauauaacaauu

SEQ ID NO: 503892 - RNA, 19 nt, Homo sapiens
ggaaagggcacucauuugg

SEQ ID NO: 503893 - RNA, 19 nt, Homo sapiens
uaaagucaaggacgaauuu

SEQ ID NO: 503894 - RNA, 19 nt, Homo sapiens
gaauuugcacagugauaua

SEQ ID NO: 503895 - RNA, 19 nt, Homo sapiens
gaauggacacguuuauguu

SEQ ID NO: 503896 - RNA, 19 nt, Homo sapiens
aaacaucaccuucaacaug

SEQ ID NO: 503897 - RNA, 19 nt, Homo sapiens
ggaaacaucaccuucaaca

SEQ ID NO: 503898 - RNA, 19 nt, Homo sapiens
uacuauaacuccauuguga

SEQ ID NO: 503899 - RNA, 19 nt, Homo sapiens
gagaugacauuccuucaac

SEQ ID NO: 503900 - RNA, 19 nt, Homo sapiens
ccaaaucaauaagagauga

SEQ ID NO: 503901 - RNA, 19 nt, Homo sapiens
gauauaagaccuucucaag

SEQ ID NO: 503902 - RNA, 19 nt, Homo sapiens
aagcugacauggauaagaa

SEQ ID NO: 503903 - RNA, 19 nt, Homo sapiens
ucagcaaacuucuccuuga

SEQ ID NO: 503904 - RNA, 19 nt, Homo sapiens
ggaggugcauguccugaau

SEQ ID NO: 503905 - RNA, 19 nt, Homo sapiens
cugaugagcuucuguuuag

SEQ ID NO: 503906 - RNA, 19 nt, Homo sapiens
agaaaugcuuugaggcuuu

SEQ ID NO: 503907 - RNA, 19 nt, Homo sapiens
gaaagggcacucauuugga

SEQ ID NO: 503908 - RNA, 19 nt, Homo sapiens
guuaauagccagauaguag

SEQ ID NO: 503909 - RNA, 19 nt, Homo sapiens
gaccugaaaucgugguguu

SEQ ID NO: 503910 - RNA, 19 nt, Homo sapiens
agagagaggucacacuuca

SEQ ID NO: 503911 - RNA, 19 nt, Homo sapiens
ggagggacuuuaagacuac

SEQ ID NO: 503912 - RNA, 19 nt, Homo sapiens
gaggagaugcggccaaaga

SEQ ID NO: 503913 - RNA, 19 nt, Homo sapiens
gcaaggacacaacaucaga

SEQ ID NO: 503914 - RNA, 19 nt, Homo sapiens
gaaagaucuaugacaauga

SEQ ID NO: 503915 - RNA, 19 nt, Homo sapiens
gagagugaaagaucuauga

SEQ ID NO: 503916 - RNA, 19 nt, Homo sapiens
gauccaccaugaagcagaa

SEQ ID NO: 503917 - RNA, 19 nt, Homo sapiens
uacuaaggcugaacaagaa

SEQ ID NO: 503918 - RNA, 19 nt, Homo sapiens
gauauugcccugucuguca

SEQ ID NO: 503919 - RNA, 19 nt, Homo sapiens
gaaugaagagggagaagau

SEQ ID NO: 503920 - RNA, 19 nt, Homo sapiens
guaugcaaguacaaguaua

SEQ ID NO: 503921 - RNA, 19 nt, Homo sapiens
ggagaugcuucccuguuca

SEQ ID NO: 503922 - RNA, 19 nt, Homo sapiens
uccaauaacuucauacaca

SEQ ID NO: 503923 - RNA, 19 nt, Homo sapiens
ggauggacgucacccuguu

SEQ ID NO: 503924 - RNA, 19 nt, Homo sapiens
gcagagaauccuugugugu

SEQ ID NO: 503925 - RNA, 19 nt, Homo sapiens
ggagaugggagaugaggaa

SEQ ID NO: 503926 - RNA, 19 nt, Homo sapiens
ucaacugggugaucaaauc

SEQ ID NO: 503927 - RNA, 19 nt, Homo sapiens
gaacucaagauagcaagaa

SEQ ID NO: 503928 - RNA, 19 nt, Homo sapiens
ggucuacuauaacuccauu

SEQ ID NO: 503929 - RNA, 19 nt, Homo sapiens
gaggaaguccacacuauuc

SEQ ID NO: 503930 - RNA, 19 nt, Homo sapiens
aaauaggcccuuucauaaa

SEQ ID NO: 503931 - RNA, 19 nt, Homo sapiens
cuuuauaucugaaccaaga

SEQ ID NO: 503932 - RNA, 19 nt, Homo sapiens
gagaugcggccaaagauuc

SEQ ID NO: 503933 - RNA, 19 nt, Homo sapiens
gaugggagaugaggaaguc

SEQ ID NO: 503934 - RNA, 19 nt, Homo sapiens
gaaaagagagugaaagauc

SEQ ID NO: 503935 - RNA, 19 nt, Homo sapiens
guacacaucaucgagcuaa

SEQ ID NO: 503936 - RNA, 19 nt, Homo sapiens
aaagggcacucauuuggau

SEQ ID NO: 503937 - RNA, 19 nt, Homo sapiens
ucaccuggcacauucauuu

SEQ ID NO: 503938 - RNA, 19 nt, Homo sapiens
gcgauccuccugucuaauu

SEQ ID NO: 503939 - RNA, 19 nt, Homo sapiens
ggagaugcggccaaagauu

SEQ ID NO: 503940 - RNA, 19 nt, Homo sapiens
gagaacauccauaauuugg

SEQ ID NO: 503941 - RNA, 19 nt, Homo sapiens
agugaaagaucuaugacaa

SEQ ID NO: 503942 - RNA, 19 nt, Homo sapiens
gcaacauagggaagaauuu

SEQ ID NO: 503943 - RNA, 19 nt, Homo sapiens
aagcgauccuccugucuaa

SEQ ID NO: 503944 - RNA, 19 nt, Homo sapiens
caggugagaacauccauaa

SEQ ID NO: 503945 - RNA, 19 nt, Homo sapiens
ugaagcagaaucuaaagaa

SEQ ID NO: 503946 - RNA, 19 nt, Homo sapiens
ccaugaagcagaaucuaaa

SEQ ID NO: 503947 - RNA, 19 nt, Homo sapiens
ucgauaaucugggccauga

SEQ ID NO: 503948 - RNA, 19 nt, Homo sapiens
gaauggcacacacuuuguu

SEQ ID NO: 503949 - RNA, 19 nt, Homo sapiens
aagggaaucuggugaagug

SEQ ID NO: 503950 - RNA, 19 nt, Homo sapiens
aaaauaggcccuuucauaa

SEQ ID NO: 503951 - RNA, 19 nt, Homo sapiens
uuacuaaggcugaacaaga

SEQ ID NO: 503952 - RNA, 19 nt, Homo sapiens
gaucagagcguccuguuua

SEQ ID NO: 503953 - RNA, 19 nt, Homo sapiens
ggaacaggaugcccacaua

SEQ ID NO: 503954 - RNA, 19 nt, Homo sapiens
gcaaagauccaaaucaguu

SEQ ID NO: 503955 - RNA, 19 nt, Homo sapiens
gagaaaggauggcaaagau

SEQ ID NO: 503956 - RNA, 19 nt, Homo sapiens
gagcacguccuacaaguua

SEQ ID NO: 503957 - RNA, 19 nt, Homo sapiens
caagagaugaauugcauua

SEQ ID NO: 503958 - RNA, 19 nt, Homo sapiens
caaacgggcugcagagaug

SEQ ID NO: 503959 - RNA, 19 nt, Homo sapiens
ugagaugucuucaauggaa

SEQ ID NO: 503960 - RNA, 19 nt, Homo sapiens
ugaaggagacguucgcuua

SEQ ID NO: 503961 - RNA, 19 nt, Homo sapiens
ggaggaagcccaaguguca

SEQ ID NO: 503962 - RNA, 19 nt, Homo sapiens
ucucagaaaugucaugauu

SEQ ID NO: 503963 - RNA, 19 nt, Homo sapiens
caagaaagguauuguugca

SEQ ID NO: 503964 - RNA, 19 nt, Homo sapiens
uuacugagaugucuucaau

SEQ ID NO: 503965 - RNA, 19 nt, Homo sapiens
ccacauacugucuaauuaa

SEQ ID NO: 503966 - RNA, 19 nt, Homo sapiens
gaaggcaagagaugaauug

SEQ ID NO: 503967 - RNA, 19 nt, Homo sapiens
agauggagcuucaggcaaa

SEQ ID NO: 503968 - RNA, 19 nt, Homo sapiens
gacauucccuuggaccuuu

SEQ ID NO: 503969 - RNA, 19 nt, Homo sapiens
gcauggacauucccuugga

SEQ ID NO: 503970 - RNA, 19 nt, Homo sapiens
cccacauacugucuaauua

SEQ ID NO: 503971 - RNA, 19 nt, Homo sapiens
gaggggagauccagaauga

SEQ ID NO: 503972 - RNA, 19 nt, Homo sapiens
gagaaccuauagcaucuuc

SEQ ID NO: 503973 - RNA, 19 nt, Homo sapiens
gugagaugguucccaauau

SEQ ID NO: 503974 - RNA, 19 nt, Homo sapiens
acagacaccucucucaugu

SEQ ID NO: 503975 - RNA, 19 nt, Homo sapiens
gaaggagacguucgcuuau

SEQ ID NO: 503976 - RNA, 19 nt, Homo sapiens
ccuauagcaucuucucauu

SEQ ID NO: 503977 - RNA, 19 nt, Homo sapiens
ucagaaaugucaugauugc

SEQ ID NO: 503978 - RNA, 19 nt, Homo sapiens
aggcaaaacuuacagcuua

SEQ ID NO: 503979 - RNA, 19 nt, Homo sapiens
cuaguugguugaugccuuu

SEQ ID NO: 503980 - RNA, 19 nt, Homo sapiens
gcccacauacugucuaauu

SEQ ID NO: 503981 - RNA, 19 nt, Homo sapiens
ggacuucaguggauuucag

SEQ ID NO: 503982 - RNA, 19 nt, Homo sapiens
acacagauauacagcagau

SEQ ID NO: 503983 - RNA, 19 nt, Homo sapiens
ucagugaucugccauacca

SEQ ID NO: 503984 - RNA, 19 nt, Homo sapiens
gaaaggcaagaaagguauu

SEQ ID NO: 503985 - RNA, 19 nt, Homo sapiens
gagagucggcugugaagga

SEQ ID NO: 503986 - RNA, 19 nt, Homo sapiens
uagagaaccuauagcaucu

SEQ ID NO: 503987 - RNA, 19 nt, Homo sapiens
ugagaugguucccaauauc

SEQ ID NO: 503988 - RNA, 19 nt, Homo sapiens
ggcaagaaagguauuguug

SEQ ID NO: 503989 - RNA, 19 nt, Homo sapiens
cugcagagauggagcuuca

SEQ ID NO: 503990 - RNA, 19 nt, Homo sapiens
ugacugcauugaaagaugu

SEQ ID NO: 503991 - RNA, 19 nt, Homo sapiens
caaacaaguaugaaucuag

SEQ ID NO: 503992 - RNA, 19 nt, Homo sapiens
agacaccucucucauguac

SEQ ID NO: 503993 - RNA, 19 nt, Homo sapiens
gagaugguucccaauauca

SEQ ID NO: 503994 - RNA, 19 nt, Homo sapiens
acuuacagcuuaacccauu

SEQ ID NO: 503995 - RNA, 19 nt, Homo sapiens
cacugugacugcauugaaa

SEQ ID NO: 503996 - RNA, 19 nt, Homo sapiens
cagaaugaaaggcaagaaa

SEQ ID NO: 503997 - RNA, 19 nt, Homo sapiens
gaacaggaugcccacauac

SEQ ID NO: 503998 - RNA, 19 nt, Homo sapiens
ucccugacaugcugagaaa

SEQ ID NO: 503999 - RNA, 19 nt, Homo sapiens
ggagcacguccuacaaguu

SEQ ID NO: 504000 - RNA, 19 nt, Homo sapiens
uggcaaagauccaaaucag

SEQ ID NO: 504001 - RNA, 19 nt, Homo sapiens
gcugagaaaggauggcaaa

SEQ ID NO: 504002 - RNA, 19 nt, Homo sapiens
gucuguaacugguucauca

SEQ ID NO: 504003 - RNA, 19 nt, Homo sapiens
gaaugaaaggcaagaaagg

SEQ ID NO: 504004 - RNA, 19 nt, Homo sapiens
gagaugucuucaauggaau

SEQ ID NO: 504005 - RNA, 19 nt, Homo sapiens
ugagaaaggauggcaaaga

SEQ ID NO: 504006 - RNA, 19 nt, Homo sapiens
gaggacagcauggacauuc

SEQ ID NO: 504007 - RNA, 19 nt, Homo sapiens
acugagaugucuucaaugg

SEQ ID NO: 504008 - RNA, 19 nt, Homo sapiens
ggugaaggcaagagaugaa

SEQ ID NO: 504009 - RNA, 19 nt, Homo sapiens
gugacugcauugaaagaug

SEQ ID NO: 504010 - RNA, 19 nt, Homo sapiens
ggacauucccuuggaccuu

SEQ ID NO: 504011 - RNA, 19 nt, Homo sapiens
gaaccuauagcaucuucuc

SEQ ID NO: 504012 - RNA, 19 nt, Homo sapiens
ugugagaugguucccaaua

SEQ ID NO: 504013 - RNA, 19 nt, Homo sapiens
ggaucagagcguccuguuu

SEQ ID NO: 504014 - RNA, 19 nt, Homo sapiens
ccacugugacugcauugaa

SEQ ID NO: 504015 - RNA, 19 nt, Homo sapiens
uaugagcaccguuacaaug

SEQ ID NO: 504016 - RNA, 19 nt, Homo sapiens
ccuuggaccuuucuucauc

SEQ ID NO: 504017 - RNA, 19 nt, Homo sapiens
gucauuccaagaacuauaa

SEQ ID NO: 504018 - RNA, 19 nt, Homo sapiens
uuacaaugccuauccuuca

SEQ ID NO: 504019 - RNA, 19 nt, Homo sapiens
gcacaugggauugcuaaaa

SEQ ID NO: 504020 - RNA, 19 nt, Homo sapiens
aaccaggacuucaguggau

SEQ ID NO: 504021 - RNA, 19 nt, Homo sapiens
cagcaaacacaccugucua

SEQ ID NO: 504022 - RNA, 19 nt, Homo sapiens
gugcagauucuucgggauu

SEQ ID NO: 504023 - RNA, 19 nt, Homo sapiens
ugaaaggcaagaaagguau

SEQ ID NO: 504024 - RNA, 19 nt, Homo sapiens
acaaguaugaaucuaguug

SEQ ID NO: 504025 - RNA, 19 nt, Homo sapiens
gagcuucaggcaaaacuua

SEQ ID NO: 504026 - RNA, 19 nt, Homo sapiens
caaagauccaaaucaguuc

SEQ ID NO: 504027 - RNA, 19 nt, Homo sapiens
uauagcaucuucucauucc

SEQ ID NO: 504028 - RNA, 19 nt, Homo sapiens
gcaauacuuagagaaccua

SEQ ID NO: 504029 - RNA, 19 nt, Homo sapiens
ucagacugugcaauacuua

SEQ ID NO: 504030 - RNA, 19 nt, Homo sapiens
ggacaaaacacagauauac

SEQ ID NO: 504031 - RNA, 19 nt, Homo sapiens
caucuucucauucccaugu

SEQ ID NO: 504032 - RNA, 19 nt, Homo sapiens
acagauauacagcagauag

SEQ ID NO: 504033 - RNA, 19 nt, Homo sapiens
auacuuagagaaccuauag

SEQ ID NO: 504034 - RNA, 19 nt, Homo sapiens
gaugguucccaauaucaug

SEQ ID NO: 504035 - RNA, 19 nt, Homo sapiens
ggcaaaacuuacagcuuaa

SEQ ID NO: 504036 - RNA, 19 nt, Homo sapiens
cacagacaccucucucaug

SEQ ID NO: 504037 - RNA, 19 nt, Homo sapiens
auaccacugugacugcauu

SEQ ID NO: 504038 - RNA, 19 nt, Homo sapiens
ugaaggcaagagaugaauu

SEQ ID NO: 504039 - RNA, 19 nt, Homo sapiens
ucaaacgggcugcagagau

SEQ ID NO: 504040 - RNA, 19 nt, Homo sapiens
guaaaucuggaccaaguac

SEQ ID NO: 504041 - RNA, 19 nt, Homo sapiens
ucacagacaccucucucau

SEQ ID NO: 504042 - RNA, 19 nt, Homo sapiens
ggagauccagaaugaaagg

SEQ ID NO: 504043 - RNA, 19 nt, Homo sapiens
acagucauuccaagaacua

SEQ ID NO: 504044 - RNA, 19 nt, Homo sapiens
ccaggacuucaguggauuu

SEQ ID NO: 504045 - RNA, 19 nt, Homo sapiens
gauccaaaucaguucacaa

SEQ ID NO: 504046 - RNA, 19 nt, Homo sapiens
gcagauucuucgggauugg

SEQ ID NO: 504047 - RNA, 19 nt, Homo sapiens
caggaugcccacauacugu

SEQ ID NO: 504048 - RNA, 19 nt, Homo sapiens
agaaugaaaggcaagaaag

SEQ ID NO: 504049 - RNA, 19 nt, Homo sapiens
aauacagucauuccaagaa

SEQ ID NO: 504050 - RNA, 19 nt, Homo sapiens
aauauuugcacaugggauu

SEQ ID NO: 504051 - RNA, 19 nt, Homo sapiens
gggaucagagcguccuguu

SEQ ID NO: 504052 - RNA, 19 nt, Homo sapiens
ggaacaggaugcccacaua

SEQ ID NO: 504053 - RNA, 19 nt, Homo sapiens
gcaaagauccaaaucaguu

SEQ ID NO: 504054 - RNA, 19 nt, Homo sapiens
gagaaaggauggcaaagau

SEQ ID NO: 504055 - RNA, 19 nt, Homo sapiens
caagagaugaauugcauua

SEQ ID NO: 504056 - RNA, 19 nt, Homo sapiens
caaacgggcugcagagaug

SEQ ID NO: 504057 - RNA, 19 nt, Homo sapiens
ugagaugucuucaauggaa

SEQ ID NO: 504058 - RNA, 19 nt, Homo sapiens
ucucagaaaugucaugauu

SEQ ID NO: 504059 - RNA, 19 nt, Homo sapiens
uuacugagaugucuucaau

SEQ ID NO: 504060 - RNA, 19 nt, Homo sapiens
ccacauacugucuaauuaa

SEQ ID NO: 504061 - RNA, 19 nt, Homo sapiens
gaaggcaagagaugaauug

SEQ ID NO: 504062 - RNA, 19 nt, Homo sapiens
cagcgagagugaaauuaaa

SEQ ID NO: 504063 - RNA, 19 nt, Homo sapiens
agauggagcuucaggcaaa

SEQ ID NO: 504064 - RNA, 19 nt, Homo sapiens
gacauucccuuggaccuuu

SEQ ID NO: 504065 - RNA, 19 nt, Homo sapiens
gcauggacauucccuugga

SEQ ID NO: 504066 - RNA, 19 nt, Homo sapiens
cccacauacugucuaauua

SEQ ID NO: 504067 - RNA, 19 nt, Homo sapiens
ggaauuggcccugggagaa

SEQ ID NO: 504068 - RNA, 19 nt, Homo sapiens
gagaaccuauagcaucuuc

SEQ ID NO: 504069 - RNA, 19 nt, Homo sapiens
ggacugacaggucuagaga

SEQ ID NO: 504070 - RNA, 19 nt, Homo sapiens
gugagaugguucccaauau

SEQ ID NO: 504071 - RNA, 19 nt, Homo sapiens
acagacaccucucucaugu

SEQ ID NO: 504072 - RNA, 19 nt, Homo sapiens
ccuauagcaucuucucauu

SEQ ID NO: 504073 - RNA, 19 nt, Homo sapiens
gagagugaaauuaaacuug

SEQ ID NO: 504074 - RNA, 19 nt, Homo sapiens
ucagaaaugucaugauugc

SEQ ID NO: 504075 - RNA, 19 nt, Homo sapiens
aggcaaaacuuacagcuua

SEQ ID NO: 504076 - RNA, 19 nt, Homo sapiens
cuaguugguugaugccuuu

SEQ ID NO: 504077 - RNA, 19 nt, Homo sapiens
gcccacauacugucuaauu

SEQ ID NO: 504078 - RNA, 19 nt, Homo sapiens
ggacuucaguggauuucag

SEQ ID NO: 504079 - RNA, 19 nt, Homo sapiens
acacagauauacagcagau

SEQ ID NO: 504080 - RNA, 19 nt, Homo sapiens
ucagugaucugccauacca

SEQ ID NO: 504081 - RNA, 19 nt, Homo sapiens
ccagcgagagugaaauuaa

SEQ ID NO: 504082 - RNA, 19 nt, Homo sapiens
uggaaacaaugaaagguau

SEQ ID NO: 504083 - RNA, 19 nt, Homo sapiens
uagagaaccuauagcaucu

SEQ ID NO: 504084 - RNA, 19 nt, Homo sapiens
ugagaugguucccaauauc

SEQ ID NO: 504085 - RNA, 19 nt, Homo sapiens
cugcagagauggagcuuca

SEQ ID NO: 504086 - RNA, 19 nt, Homo sapiens
ugacugcauugaaagaugu

SEQ ID NO: 504087 - RNA, 19 nt, Homo sapiens
gaauuggcccugggagaaa

SEQ ID NO: 504088 - RNA, 19 nt, Homo sapiens
caaacaaguaugaaucuag

SEQ ID NO: 504089 - RNA, 19 nt, Homo sapiens
agacaccucucucauguac

SEQ ID NO: 504090 - RNA, 19 nt, Homo sapiens
gagaugguucccaauauca

SEQ ID NO: 504091 - RNA, 19 nt, Homo sapiens
acuuacagcuuaacccauu

SEQ ID NO: 504092 - RNA, 19 nt, Homo sapiens
ggaaacaaugaaagguauu

SEQ ID NO: 504093 - RNA, 19 nt, Homo sapiens
cacugugacugcauugaaa

SEQ ID NO: 504094 - RNA, 19 nt, Homo sapiens
gaacaggaugcccacauac

SEQ ID NO: 504095 - RNA, 19 nt, Homo sapiens
ucccugacaugcugagaaa

SEQ ID NO: 504096 - RNA, 19 nt, Homo sapiens
uggcaaagauccaaaucag

SEQ ID NO: 504097 - RNA, 19 nt, Homo sapiens
gcugagaaaggauggcaaa

SEQ ID NO: 504098 - RNA, 19 nt, Homo sapiens
gucuguaacugguucauca

SEQ ID NO: 504099 - RNA, 19 nt, Homo sapiens
gagaugucuucaauggaau

SEQ ID NO: 504100 - RNA, 19 nt, Homo sapiens
ugagaaaggauggcaaaga

SEQ ID NO: 504101 - RNA, 19 nt, Homo sapiens
gaggacagcauggacauuc

SEQ ID NO: 504102 - RNA, 19 nt, Homo sapiens
aaugaaagguauuguugca

SEQ ID NO: 504103 - RNA, 19 nt, Homo sapiens
acugagaugucuucaaugg

SEQ ID NO: 504104 - RNA, 19 nt, Homo sapiens
ggugaaggcaagagaugaa

SEQ ID NO: 504105 - RNA, 19 nt, Homo sapiens
gugacugcauugaaagaug

SEQ ID NO: 504106 - RNA, 19 nt, Homo sapiens
ggacauucccuuggaccuu

SEQ ID NO: 504107 - RNA, 19 nt, Homo sapiens
gaaccuauagcaucuucuc

SEQ ID NO: 504108 - RNA, 19 nt, Homo sapiens
ugugagaugguucccaaua

SEQ ID NO: 504109 - RNA, 19 nt, Homo sapiens
ggcagucguuguugguaga

SEQ ID NO: 504110 - RNA, 19 nt, Homo sapiens
ccacugugacugcauugaa

SEQ ID NO: 504111 - RNA, 19 nt, Homo sapiens
uaugagcaccguuacaaug

SEQ ID NO: 504112 - RNA, 19 nt, Homo sapiens
ccuuggaccuuucuucauc

SEQ ID NO: 504113 - RNA, 19 nt, Homo sapiens
gucauuccaagaacuauaa

SEQ ID NO: 504114 - RNA, 19 nt, Homo sapiens
uuacaaugccuauccuuca

SEQ ID NO: 504115 - RNA, 19 nt, Homo sapiens
gcacaugggauugcuaaaa

SEQ ID NO: 504116 - RNA, 19 nt, Homo sapiens
aaccaggacuucaguggau

SEQ ID NO: 504117 - RNA, 19 nt, Homo sapiens
cagcaaacacaccugucua

SEQ ID NO: 504118 - RNA, 19 nt, Homo sapiens
gugcagauucuucgggauu

SEQ ID NO: 504119 - RNA, 19 nt, Homo sapiens
ccgcaucggugggaacuuc

SEQ ID NO: 504120 - RNA, 19 nt, Homo sapiens
acaaguaugaaucuaguug

SEQ ID NO: 504121 - RNA, 19 nt, Homo sapiens
gagcuucaggcaaaacuua

SEQ ID NO: 504122 - RNA, 19 nt, Homo sapiens
caaagauccaaaucaguuc

SEQ ID NO: 504123 - RNA, 19 nt, Homo sapiens
uauagcaucuucucauucc

SEQ ID NO: 504124 - RNA, 19 nt, Homo sapiens
gcaauacuuagagaaccua

SEQ ID NO: 504125 - RNA, 19 nt, Homo sapiens
ucagacugugcaauacuua

SEQ ID NO: 504126 - RNA, 19 nt, Homo sapiens
ggacaaaacacagauauac

SEQ ID NO: 504127 - RNA, 19 nt, Homo sapiens
caucuucucauucccaugu

SEQ ID NO: 504128 - RNA, 19 nt, Homo sapiens
aaacuugaaacucggauca

SEQ ID NO: 504129 - RNA, 19 nt, Homo sapiens
ggacucgggacagggaauu

SEQ ID NO: 504130 - RNA, 19 nt, Homo sapiens
acagauauacagcagauag

SEQ ID NO: 504131 - RNA, 19 nt, Homo sapiens
auacuuagagaaccuauag

SEQ ID NO: 504132 - RNA, 19 nt, Homo sapiens
gaugguucccaauaucaug

SEQ ID NO: 504133 - RNA, 19 nt, Homo sapiens
cuggaaacaaugaaaggua

SEQ ID NO: 504134 - RNA, 19 nt, Homo sapiens
ggcaaaacuuacagcuuaa

SEQ ID NO: 504135 - RNA, 19 nt, Homo sapiens
cacagacaccucucucaug

SEQ ID NO: 504136 - RNA, 19 nt, Homo sapiens
auaccacugugacugcauu

SEQ ID NO: 504137 - RNA, 19 nt, Homo sapiens
gccgacuccuggaaacaau

SEQ ID NO: 504138 - RNA, 19 nt, Homo sapiens
ugaaggcaagagaugaauu

SEQ ID NO: 504139 - RNA, 19 nt, Homo sapiens
ucaaacgggcugcagagau

SEQ ID NO: 504140 - RNA, 19 nt, Homo sapiens
guaaaucuggaccaaguac

SEQ ID NO: 504141 - RNA, 19 nt, Homo sapiens
ucacagacaccucucucau

SEQ ID NO: 504142 - RNA, 19 nt, Homo sapiens
acagucauuccaagaacua

SEQ ID NO: 504143 - RNA, 19 nt, Homo sapiens
cgacuccuggaaacaauga

SEQ ID NO: 504144 - RNA, 19 nt, Homo sapiens
ccaggacuucaguggauuu

SEQ ID NO: 504145 - RNA, 19 nt, Homo sapiens
cgagagugaaauuaaacuu

SEQ ID NO: 504146 - RNA, 19 nt, Homo sapiens
gauccaaaucaguucacaa

SEQ ID NO: 504147 - RNA, 19 nt, Homo sapiens
gcagauucuucgggauugg

SEQ ID NO: 504148 - RNA, 19 nt, Homo sapiens
caggaugcccacauacugu

SEQ ID NO: 504149 - RNA, 19 nt, Homo sapiens
aauacagucauuccaagaa

SEQ ID NO: 504150 - RNA, 19 nt, Homo sapiens
aauauuugcacaugggauu

SEQ ID NO: 504151 - RNA, 19 nt, Homo sapiens
ggaccucaaccaggacuuc

SEQ ID NO: 504152 - RNA, 19 nt, Homo sapiens
ggaacaggaugcccacaua

SEQ ID NO: 504153 - RNA, 19 nt, Homo sapiens
gcaaagauccaaaucaguu

SEQ ID NO: 504154 - RNA, 19 nt, Homo sapiens
gagaaaggauggcaaagau

SEQ ID NO: 504155 - RNA, 19 nt, Homo sapiens
gaucaagccugacuucuag

SEQ ID NO: 504156 - RNA, 19 nt, Homo sapiens
caagagaugaauugcauua

SEQ ID NO: 504157 - RNA, 19 nt, Homo sapiens
caaacgggcugcagagaug

SEQ ID NO: 504158 - RNA, 19 nt, Homo sapiens
ugagaugucuucaauggaa

SEQ ID NO: 504159 - RNA, 19 nt, Homo sapiens
ucucagaaaugucaugauu

SEQ ID NO: 504160 - RNA, 19 nt, Homo sapiens
uuacugagaugucuucaau

SEQ ID NO: 504161 - RNA, 19 nt, Homo sapiens
ccacauacugucuaauuaa

SEQ ID NO: 504162 - RNA, 19 nt, Homo sapiens
gaaggcaagagaugaauug

SEQ ID NO: 504163 - RNA, 19 nt, Homo sapiens
agauggagcuucaggcaaa

SEQ ID NO: 504164 - RNA, 19 nt, Homo sapiens
uaacaaccguuuggauaug

SEQ ID NO: 504165 - RNA, 19 nt, Homo sapiens
gacauucccuuggaccuuu

SEQ ID NO: 504166 - RNA, 19 nt, Homo sapiens
gcauggacauucccuugga

SEQ ID NO: 504167 - RNA, 19 nt, Homo sapiens
cccacauacugucuaauua

SEQ ID NO: 504168 - RNA, 19 nt, Homo sapiens
gagaaccuauagcaucuuc

SEQ ID NO: 504169 - RNA, 19 nt, Homo sapiens
gugagaugguucccaauau

SEQ ID NO: 504170 - RNA, 19 nt, Homo sapiens
acagacaccucucucaugu

SEQ ID NO: 504171 - RNA, 19 nt, Homo sapiens
ccuauagcaucuucucauu

SEQ ID NO: 504172 - RNA, 19 nt, Homo sapiens
ucagaaaugucaugauugc

SEQ ID NO: 504173 - RNA, 19 nt, Homo sapiens
aggcaaaacuuacagcuua

SEQ ID NO: 504174 - RNA, 19 nt, Homo sapiens
gggcaaaaguugugcauug

SEQ ID NO: 504175 - RNA, 19 nt, Homo sapiens
cuaguugguugaugccuuu

SEQ ID NO: 504176 - RNA, 19 nt, Homo sapiens
gcccacauacugucuaauu

SEQ ID NO: 504177 - RNA, 19 nt, Homo sapiens
ggacuucaguggauuucag

SEQ ID NO: 504178 - RNA, 19 nt, Homo sapiens
acacagauauacagcagau

SEQ ID NO: 504179 - RNA, 19 nt, Homo sapiens
ucagugaucugccauacca

SEQ ID NO: 504180 - RNA, 19 nt, Homo sapiens
uagagaaccuauagcaucu

SEQ ID NO: 504181 - RNA, 19 nt, Homo sapiens
ugagaugguucccaauauc

SEQ ID NO: 504182 - RNA, 19 nt, Homo sapiens
cgguugggcuguaagcuuu

SEQ ID NO: 504183 - RNA, 19 nt, Homo sapiens
cugcagagauggagcuuca

SEQ ID NO: 504184 - RNA, 19 nt, Homo sapiens
ugacugcauugaaagaugu

SEQ ID NO: 504185 - RNA, 19 nt, Homo sapiens
caaacaaguaugaaucuag

SEQ ID NO: 504186 - RNA, 19 nt, Homo sapiens
agacaccucucucauguac

SEQ ID NO: 504187 - RNA, 19 nt, Homo sapiens
cgaucaagccugacuucua

SEQ ID NO: 504188 - RNA, 19 nt, Homo sapiens
gagaugguucccaauauca

SEQ ID NO: 504189 - RNA, 19 nt, Homo sapiens
acuuacagcuuaacccauu

SEQ ID NO: 504190 - RNA, 19 nt, Homo sapiens
uuuaacaaccguuuggaua

SEQ ID NO: 504191 - RNA, 19 nt, Homo sapiens
cacugugacugcauugaaa

SEQ ID NO: 504192 - RNA, 19 nt, Homo sapiens
gaacaggaugcccacauac

SEQ ID NO: 504193 - RNA, 19 nt, Homo sapiens
ucccugacaugcugagaaa

SEQ ID NO: 504194 - RNA, 19 nt, Homo sapiens
uggcaaagauccaaaucag

SEQ ID NO: 504195 - RNA, 19 nt, Homo sapiens
gcugagaaaggauggcaaa

SEQ ID NO: 504196 - RNA, 19 nt, Homo sapiens
gucuguaacugguucauca

SEQ ID NO: 504197 - RNA, 19 nt, Homo sapiens
gagaugucuucaauggaau

SEQ ID NO: 504198 - RNA, 19 nt, Homo sapiens
ugagaaaggauggcaaaga

SEQ ID NO: 504199 - RNA, 19 nt, Homo sapiens
gaggacagcauggacauuc

SEQ ID NO: 504200 - RNA, 19 nt, Homo sapiens
acugagaugucuucaaugg

SEQ ID NO: 504201 - RNA, 19 nt, Homo sapiens
ggugaaggcaagagaugaa

SEQ ID NO: 504202 - RNA, 19 nt, Homo sapiens
gugacugcauugaaagaug

SEQ ID NO: 504203 - RNA, 19 nt, Homo sapiens
ggacauucccuuggaccuu

SEQ ID NO: 504204 - RNA, 19 nt, Homo sapiens
gggagcgguugggcuguaa

SEQ ID NO: 504205 - RNA, 19 nt, Homo sapiens
gaaccuauagcaucuucuc

SEQ ID NO: 504206 - RNA, 19 nt, Homo sapiens
ugugagaugguucccaaua

SEQ ID NO: 504207 - RNA, 19 nt, Homo sapiens
ccacugugacugcauugaa

SEQ ID NO: 504208 - RNA, 19 nt, Homo sapiens
uuaacaaccguuuggauau

SEQ ID NO: 504209 - RNA, 19 nt, Homo sapiens
uaugagcaccguuacaaug

SEQ ID NO: 504210 - RNA, 19 nt, Homo sapiens
ccuuggaccuuucuucauc

SEQ ID NO: 504211 - RNA, 19 nt, Homo sapiens
ggagugccucgccagcuuu

SEQ ID NO: 504212 - RNA, 19 nt, Homo sapiens
gucauuccaagaacuauaa

SEQ ID NO: 504213 - RNA, 19 nt, Homo sapiens
uuacaaugccuauccuuca

SEQ ID NO: 504214 - RNA, 19 nt, Homo sapiens
gcacaugggauugcuaaaa

SEQ ID NO: 504215 - RNA, 19 nt, Homo sapiens
gugccaguguuucucuuug

SEQ ID NO: 504216 - RNA, 19 nt, Homo sapiens
aaccaggacuucaguggau

SEQ ID NO: 504217 - RNA, 19 nt, Homo sapiens
cagcaaacacaccugucua

SEQ ID NO: 504218 - RNA, 19 nt, Homo sapiens
gugcagauucuucgggauu

SEQ ID NO: 504219 - RNA, 19 nt, Homo sapiens
acaaguaugaaucuaguug

SEQ ID NO: 504220 - RNA, 19 nt, Homo sapiens
gagcuucaggcaaaacuua

SEQ ID NO: 504221 - RNA, 19 nt, Homo sapiens
cagaauugugccaguguuu

SEQ ID NO: 504222 - RNA, 19 nt, Homo sapiens
caaagauccaaaucaguuc

SEQ ID NO: 504223 - RNA, 19 nt, Homo sapiens
uauagcaucuucucauucc

SEQ ID NO: 504224 - RNA, 19 nt, Homo sapiens
gcaauacuuagagaaccua

SEQ ID NO: 504225 - RNA, 19 nt, Homo sapiens
ucagacugugcaauacuua

SEQ ID NO: 504226 - RNA, 19 nt, Homo sapiens
gaauugugccaguguuucu

SEQ ID NO: 504227 - RNA, 19 nt, Homo sapiens
ggacaaaacacagauauac

SEQ ID NO: 504228 - RNA, 19 nt, Homo sapiens
caucuucucauucccaugu

SEQ ID NO: 504229 - RNA, 19 nt, Homo sapiens
gagugccucgccagcuuua

SEQ ID NO: 504230 - RNA, 19 nt, Homo sapiens
gccaguguuucucuuugga

SEQ ID NO: 504231 - RNA, 19 nt, Homo sapiens
acagaauugugccaguguu

SEQ ID NO: 504232 - RNA, 19 nt, Homo sapiens
acagauauacagcagauag

SEQ ID NO: 504233 - RNA, 19 nt, Homo sapiens
aacaaccguuuggauauga

SEQ ID NO: 504234 - RNA, 19 nt, Homo sapiens
uggagugccucgccagcuu

SEQ ID NO: 504235 - RNA, 19 nt, Homo sapiens
auacuuagagaaccuauag

SEQ ID NO: 504236 - RNA, 19 nt, Homo sapiens
uagccaagguauuguugca

SEQ ID NO: 504237 - RNA, 19 nt, Homo sapiens
gaugguucccaauaucaug

SEQ ID NO: 504238 - RNA, 19 nt, Homo sapiens
ggcaaaacuuacagcuuaa

SEQ ID NO: 504239 - RNA, 19 nt, Homo sapiens
cacagacaccucucucaug

SEQ ID NO: 504240 - RNA, 19 nt, Homo sapiens
auaccacugugacugcauu

SEQ ID NO: 504241 - RNA, 19 nt, Homo sapiens
ugaaggcaagagaugaauu

SEQ ID NO: 504242 - RNA, 19 nt, Homo sapiens
ucaaacgggcugcagagau

SEQ ID NO: 504243 - RNA, 19 nt, Homo sapiens
guaaaucuggaccaaguac

SEQ ID NO: 504244 - RNA, 19 nt, Homo sapiens
ucacagacaccucucucau

SEQ ID NO: 504245 - RNA, 19 nt, Homo sapiens
acagucauuccaagaacua

SEQ ID NO: 504246 - RNA, 19 nt, Homo sapiens
ccaggacuucaguggauuu

SEQ ID NO: 504247 - RNA, 19 nt, Homo sapiens
gauccaaaucaguucacaa

SEQ ID NO: 504248 - RNA, 19 nt, Homo sapiens
gcagauucuucgggauugg

SEQ ID NO: 504249 - RNA, 19 nt, Homo sapiens
caggaugcccacauacugu

SEQ ID NO: 504250 - RNA, 19 nt, Homo sapiens
aauacagucauuccaagaa

SEQ ID NO: 504251 - RNA, 19 nt, Homo sapiens
aauauuugcacaugggauu

SEQ ID NO: 504252 - RNA, 19 nt, Homo sapiens
gaucagagcguccuguuua

SEQ ID NO: 504253 - RNA, 19 nt, Homo sapiens
ggaacaggaugcccacaua

SEQ ID NO: 504254 - RNA, 19 nt, Homo sapiens
gcaaagauccaaaucaguu

SEQ ID NO: 504255 - RNA, 19 nt, Homo sapiens
gagaaaggauggcaaagau

SEQ ID NO: 504256 - RNA, 19 nt, Homo sapiens
gagcacguccuacaaguua

SEQ ID NO: 504257 - RNA, 19 nt, Homo sapiens
caagagaugaauugcauua

SEQ ID NO: 504258 - RNA, 19 nt, Homo sapiens
caaacgggcugcagagaug

SEQ ID NO: 504259 - RNA, 19 nt, Homo sapiens
ugagaugucuucaauggaa

SEQ ID NO: 504260 - RNA, 19 nt, Homo sapiens
ugaaggagacguucgcuua

SEQ ID NO: 504261 - RNA, 19 nt, Homo sapiens
ucucagaaaugucaugauu

SEQ ID NO: 504262 - RNA, 19 nt, Homo sapiens
caagaaagguauuguugca

SEQ ID NO: 504263 - RNA, 19 nt, Homo sapiens
uuacugagaugucuucaau

SEQ ID NO: 504264 - RNA, 19 nt, Homo sapiens
ccacauacugucuaauuaa

SEQ ID NO: 504265 - RNA, 19 nt, Homo sapiens
gaaggcaagagaugaauug

SEQ ID NO: 504266 - RNA, 19 nt, Homo sapiens
agauggagcuucaggcaaa

SEQ ID NO: 504267 - RNA, 19 nt, Homo sapiens
gacauucccuuggaccuuu

SEQ ID NO: 504268 - RNA, 19 nt, Homo sapiens
gcauggacauucccuugga

SEQ ID NO: 504269 - RNA, 19 nt, Homo sapiens
cccacauacugucuaauua

SEQ ID NO: 504270 - RNA, 19 nt, Homo sapiens
gaggggagauccagaauga

SEQ ID NO: 504271 - RNA, 19 nt, Homo sapiens
gagaaccuauagcaucuuc

SEQ ID NO: 504272 - RNA, 19 nt, Homo sapiens
gugagaugguucccaauau

SEQ ID NO: 504273 - RNA, 19 nt, Homo sapiens
acagacaccucucucaugu

SEQ ID NO: 504274 - RNA, 19 nt, Homo sapiens
gaaggagacguucgcuuau

SEQ ID NO: 504275 - RNA, 19 nt, Homo sapiens
ccuauagcaucuucucauu

SEQ ID NO: 504276 - RNA, 19 nt, Homo sapiens
ucagaaaugucaugauugc

SEQ ID NO: 504277 - RNA, 19 nt, Homo sapiens
aggcaaaacuuacagcuua

SEQ ID NO: 504278 - RNA, 19 nt, Homo sapiens
cuaguugguugaugccuuu

SEQ ID NO: 504279 - RNA, 19 nt, Homo sapiens
gcccacauacugucuaauu

SEQ ID NO: 504280 - RNA, 19 nt, Homo sapiens
ggacuucaguggauuucag

SEQ ID NO: 504281 - RNA, 19 nt, Homo sapiens
acacagauauacagcagau

SEQ ID NO: 504282 - RNA, 19 nt, Homo sapiens
ucagugaucugccauacca

SEQ ID NO: 504283 - RNA, 19 nt, Homo sapiens
gaaaggcaagaaagguauu

SEQ ID NO: 504284 - RNA, 19 nt, Homo sapiens
gagagucggcugugaagga

SEQ ID NO: 504285 - RNA, 19 nt, Homo sapiens
uagagaaccuauagcaucu

SEQ ID NO: 504286 - RNA, 19 nt, Homo sapiens
ugagaugguucccaauauc

SEQ ID NO: 504287 - RNA, 19 nt, Homo sapiens
ggcaagaaagguauuguug

SEQ ID NO: 504288 - RNA, 19 nt, Homo sapiens
cugcagagauggagcuuca

SEQ ID NO: 504289 - RNA, 19 nt, Homo sapiens
ugacugcauugaaagaugu

SEQ ID NO: 504290 - RNA, 19 nt, Homo sapiens
caaacaaguaugaaucuag

SEQ ID NO: 504291 - RNA, 19 nt, Homo sapiens
agacaccucucucauguac

SEQ ID NO: 504292 - RNA, 19 nt, Homo sapiens
gagaugguucccaauauca

SEQ ID NO: 504293 - RNA, 19 nt, Homo sapiens
acuuacagcuuaacccauu

SEQ ID NO: 504294 - RNA, 19 nt, Homo sapiens
cacugugacugcauugaaa

SEQ ID NO: 504295 - RNA, 19 nt, Homo sapiens
cagaaugaaaggcaagaaa

SEQ ID NO: 504296 - RNA, 19 nt, Homo sapiens
gaacaggaugcccacauac

SEQ ID NO: 504297 - RNA, 19 nt, Homo sapiens
ucccugacaugcugagaaa

SEQ ID NO: 504298 - RNA, 19 nt, Homo sapiens
ggagcacguccuacaaguu

SEQ ID NO: 504299 - RNA, 19 nt, Homo sapiens
gaaugaaaggcaagaaagg

SEQ ID NO: 504300 - RNA, 19 nt, Homo sapiens
uggcaaagauccaaaucag

SEQ ID NO: 504301 - RNA, 19 nt, Homo sapiens
gcugagaaaggauggcaaa

SEQ ID NO: 504302 - RNA, 19 nt, Homo sapiens
gucuguaacugguucauca

SEQ ID NO: 504303 - RNA, 19 nt, Homo sapiens
gagaugucuucaauggaau

SEQ ID NO: 504304 - RNA, 19 nt, Homo sapiens
ugagaaaggauggcaaaga

SEQ ID NO: 504305 - RNA, 19 nt, Homo sapiens
gaggacagcauggacauuc

SEQ ID NO: 504306 - RNA, 19 nt, Homo sapiens
acugagaugucuucaaugg

SEQ ID NO: 504307 - RNA, 19 nt, Homo sapiens
ggugaaggcaagagaugaa

SEQ ID NO: 504308 - RNA, 19 nt, Homo sapiens
gugacugcauugaaagaug

SEQ ID NO: 504309 - RNA, 19 nt, Homo sapiens
ggacauucccuuggaccuu

SEQ ID NO: 504310 - RNA, 19 nt, Homo sapiens
ggaucagagcguccuguuu

SEQ ID NO: 504311 - RNA, 19 nt, Homo sapiens
gaaccuauagcaucuucuc

SEQ ID NO: 504312 - RNA, 19 nt, Homo sapiens
ugugagaugguucccaaua

SEQ ID NO: 504313 - RNA, 19 nt, Homo sapiens
ccacugugacugcauugaa

SEQ ID NO: 504314 - RNA, 19 nt, Homo sapiens
uaugagcaccguuacaaug

SEQ ID NO: 504315 - RNA, 19 nt, Homo sapiens
ccuuggaccuuucuucauc

SEQ ID NO: 504316 - RNA, 19 nt, Homo sapiens
gucauuccaagaacuauaa

SEQ ID NO: 504317 - RNA, 19 nt, Homo sapiens
uuacaaugccuauccuuca

SEQ ID NO: 504318 - RNA, 19 nt, Homo sapiens
ugaaaggcaagaaagguau

SEQ ID NO: 504319 - RNA, 19 nt, Homo sapiens
gcacaugggauugcuaaaa

SEQ ID NO: 504320 - RNA, 19 nt, Homo sapiens
aaccaggacuucaguggau

SEQ ID NO: 504321 - RNA, 19 nt, Homo sapiens
cagcaaacacaccugucua

SEQ ID NO: 504322 - RNA, 19 nt, Homo sapiens
gugcagauucuucgggauu

SEQ ID NO: 504323 - RNA, 19 nt, Homo sapiens
acaaguaugaaucuaguug

SEQ ID NO: 504324 - RNA, 19 nt, Homo sapiens
gagcuucaggcaaaacuua

SEQ ID NO: 504325 - RNA, 19 nt, Homo sapiens
caaagauccaaaucaguuc

SEQ ID NO: 504326 - RNA, 19 nt, Homo sapiens
uauagcaucuucucauucc

SEQ ID NO: 504327 - RNA, 19 nt, Homo sapiens
gcaauacuuagagaaccua

SEQ ID NO: 504328 - RNA, 19 nt, Homo sapiens
ucagacugugcaauacuua

SEQ ID NO: 504329 - RNA, 19 nt, Homo sapiens
ggacaaaacacagauauac

SEQ ID NO: 504330 - RNA, 19 nt, Homo sapiens
caucuucucauucccaugu

SEQ ID NO: 504331 - RNA, 19 nt, Homo sapiens
acagauauacagcagauag

SEQ ID NO: 504332 - RNA, 19 nt, Homo sapiens
auacuuagagaaccuauag

SEQ ID NO: 504333 - RNA, 19 nt, Homo sapiens
gaugguucccaauaucaug

SEQ ID NO: 504334 - RNA, 19 nt, Homo sapiens
ggcaaaacuuacagcuuaa

SEQ ID NO: 504335 - RNA, 19 nt, Homo sapiens
cacagacaccucucucaug

SEQ ID NO: 504336 - RNA, 19 nt, Homo sapiens
auaccacugugacugcauu

SEQ ID NO: 504337 - RNA, 19 nt, Homo sapiens
ugaaggcaagagaugaauu

SEQ ID NO: 504338 - RNA, 19 nt, Homo sapiens
ucaaacgggcugcagagau

SEQ ID NO: 504339 - RNA, 19 nt, Homo sapiens
guaaaucuggaccaaguac

SEQ ID NO: 504340 - RNA, 19 nt, Homo sapiens
ggagauccagaaugaaagg

SEQ ID NO: 504341 - RNA, 19 nt, Homo sapiens
ucacagacaccucucucau

SEQ ID NO: 504342 - RNA, 19 nt, Homo sapiens
acagucauuccaagaacua

SEQ ID NO: 504343 - RNA, 19 nt, Homo sapiens
gcagauucuucgggauugg

SEQ ID NO: 504344 - RNA, 19 nt, Homo sapiens
ccaggacuucaguggauuu

SEQ ID NO: 504345 - RNA, 19 nt, Homo sapiens
gauccaaaucaguucacaa

SEQ ID NO: 504346 - RNA, 19 nt, Homo sapiens
caggaugcccacauacugu

SEQ ID NO: 504347 - RNA, 19 nt, Homo sapiens
aauacagucauuccaagaa

SEQ ID NO: 504348 - RNA, 19 nt, Homo sapiens
aauauuugcacaugggauu

SEQ ID NO: 504349 - RNA, 19 nt, Homo sapiens
ggcuguaugagcaccguua

SEQ ID NO: 504350 - RNA, 19 nt, Homo sapiens
ggaccucaaccaggacuuc

SEQ ID NO: 504351 - RNA, 19 nt, Homo sapiens
guaugagcaccguuacaau

SEQ ID NO: 504352 - RNA, 19 nt, Homo sapiens
ggaacaggaugcccacaua

SEQ ID NO: 504353 - RNA, 19 nt, Homo sapiens
gcaaagauccaaaucaguu

SEQ ID NO: 504354 - RNA, 19 nt, Homo sapiens
gagaaaggauggcaaagau

SEQ ID NO: 504355 - RNA, 19 nt, Homo sapiens
caagagaugaauugcauua

SEQ ID NO: 504356 - RNA, 19 nt, Homo sapiens
caaacgggcugcagagaug

SEQ ID NO: 504357 - RNA, 19 nt, Homo sapiens
ugagaugucuucaauggaa

SEQ ID NO: 504358 - RNA, 19 nt, Homo sapiens
ucucagaaaugucaugauu

SEQ ID NO: 504359 - RNA, 19 nt, Homo sapiens
uuacugagaugucuucaau

SEQ ID NO: 504360 - RNA, 19 nt, Homo sapiens
ccacauacugucuaauuaa

SEQ ID NO: 504361 - RNA, 19 nt, Homo sapiens
gaaggcaagagaugaauug

SEQ ID NO: 504362 - RNA, 19 nt, Homo sapiens
agauggagcuucaggcaaa

SEQ ID NO: 504363 - RNA, 19 nt, Homo sapiens
gacauucccuuggaccuuu

SEQ ID NO: 504364 - RNA, 19 nt, Homo sapiens
gcauggacauucccuugga

SEQ ID NO: 504365 - RNA, 19 nt, Homo sapiens
cccacauacugucuaauua

SEQ ID NO: 504366 - RNA, 19 nt, Homo sapiens
gagaaccuauagcaucuuc

SEQ ID NO: 504367 - RNA, 19 nt, Homo sapiens
gugagaugguucccaauau

SEQ ID NO: 504368 - RNA, 19 nt, Homo sapiens
acagacaccucucucaugu

SEQ ID NO: 504369 - RNA, 19 nt, Homo sapiens
ccuauagcaucuucucauu

SEQ ID NO: 504370 - RNA, 19 nt, Homo sapiens
ucagaaaugucaugauugc

SEQ ID NO: 504371 - RNA, 19 nt, Homo sapiens
aggcaaaacuuacagcuua

SEQ ID NO: 504372 - RNA, 19 nt, Homo sapiens
cuaguugguugaugccuuu

SEQ ID NO: 504373 - RNA, 19 nt, Homo sapiens
gcccacauacugucuaauu

SEQ ID NO: 504374 - RNA, 19 nt, Homo sapiens
ggacuucaguggauuucag

SEQ ID NO: 504375 - RNA, 19 nt, Homo sapiens
acacagauauacagcagau

SEQ ID NO: 504376 - RNA, 19 nt, Homo sapiens
ucagugaucugccauacca

SEQ ID NO: 504377 - RNA, 19 nt, Homo sapiens
uagagaaccuauagcaucu

SEQ ID NO: 504378 - RNA, 19 nt, Homo sapiens
ugagaugguucccaauauc

SEQ ID NO: 504379 - RNA, 19 nt, Homo sapiens
cugcagagauggagcuuca

SEQ ID NO: 504380 - RNA, 19 nt, Homo sapiens
ugacugcauugaaagaugu

SEQ ID NO: 504381 - RNA, 19 nt, Homo sapiens
caaacaaguaugaaucuag

SEQ ID NO: 504382 - RNA, 19 nt, Homo sapiens
agacaccucucucauguac

SEQ ID NO: 504383 - RNA, 19 nt, Homo sapiens
gagaugguucccaauauca

SEQ ID NO: 504384 - RNA, 19 nt, Homo sapiens
acuuacagcuuaacccauu

SEQ ID NO: 504385 - RNA, 19 nt, Homo sapiens
gcuggaagguauuguugca

SEQ ID NO: 504386 - RNA, 19 nt, Homo sapiens
cacugugacugcauugaaa

SEQ ID NO: 504387 - RNA, 19 nt, Homo sapiens
gaacaggaugcccacauac

SEQ ID NO: 504388 - RNA, 19 nt, Homo sapiens
ucccugacaugcugagaaa

SEQ ID NO: 504389 - RNA, 19 nt, Homo sapiens
uggcaaagauccaaaucag

SEQ ID NO: 504390 - RNA, 19 nt, Homo sapiens
gcugagaaaggauggcaaa

SEQ ID NO: 504391 - RNA, 19 nt, Homo sapiens
gucuguaacugguucauca

SEQ ID NO: 504392 - RNA, 19 nt, Homo sapiens
gaggacagcauggacauuc

SEQ ID NO: 504393 - RNA, 19 nt, Homo sapiens
gagaugucuucaauggaau

SEQ ID NO: 504394 - RNA, 19 nt, Homo sapiens
ugagaaaggauggcaaaga

SEQ ID NO: 504395 - RNA, 19 nt, Homo sapiens
acugagaugucuucaaugg

SEQ ID NO: 504396 - RNA, 19 nt, Homo sapiens
ggugaaggcaagagaugaa

SEQ ID NO: 504397 - RNA, 19 nt, Homo sapiens
ggacauucccuuggaccuu

SEQ ID NO: 504398 - RNA, 19 nt, Homo sapiens
gugacugcauugaaagaug

SEQ ID NO: 504399 - RNA, 19 nt, Homo sapiens
gaaccuauagcaucuucuc

SEQ ID NO: 504400 - RNA, 19 nt, Homo sapiens
ccuuggaccuuucuucauc

SEQ ID NO: 504401 - RNA, 19 nt, Homo sapiens
ugugagaugguucccaaua

SEQ ID NO: 504402 - RNA, 19 nt, Homo sapiens
ccacugugacugcauugaa

SEQ ID NO: 504403 - RNA, 19 nt, Homo sapiens
uaugagcaccguuacaaug

SEQ ID NO: 504404 - RNA, 19 nt, Homo sapiens
gucauuccaagaacuauaa

SEQ ID NO: 504405 - RNA, 19 nt, Homo sapiens
uuacaaugccuauccuuca

SEQ ID NO: 504406 - RNA, 19 nt, Homo sapiens
gcacaugggauugcuaaaa

SEQ ID NO: 504407 - RNA, 19 nt, Homo sapiens
aaccaggacuucaguggau

SEQ ID NO: 504408 - RNA, 19 nt, Homo sapiens
gugcagauucuucgggauu

SEQ ID NO: 504409 - RNA, 19 nt, Homo sapiens
cagcaaacacaccugucua

SEQ ID NO: 504410 - RNA, 19 nt, Homo sapiens
acaaguaugaaucuaguug

SEQ ID NO: 504411 - RNA, 19 nt, Homo sapiens
gagcuucaggcaaaacuua

SEQ ID NO: 504412 - RNA, 19 nt, Homo sapiens
caaagauccaaaucaguuc

SEQ ID NO: 504413 - RNA, 19 nt, Homo sapiens
uauagcaucuucucauucc

SEQ ID NO: 504414 - RNA, 19 nt, Homo sapiens
gcaauacuuagagaaccua

SEQ ID NO: 504415 - RNA, 19 nt, Homo sapiens
ucagacugugcaauacuua

SEQ ID NO: 504416 - RNA, 19 nt, Homo sapiens
ggacaaaacacagauauac

SEQ ID NO: 504417 - RNA, 19 nt, Homo sapiens
caucuucucauucccaugu

SEQ ID NO: 504418 - RNA, 19 nt, Homo sapiens
acagauauacagcagauag

SEQ ID NO: 504419 - RNA, 19 nt, Homo sapiens
auacuuagagaaccuauag

SEQ ID NO: 504420 - RNA, 19 nt, Homo sapiens
gaugguucccaauaucaug

SEQ ID NO: 504421 - RNA, 19 nt, Homo sapiens
ggcaaaacuuacagcuuaa

SEQ ID NO: 504422 - RNA, 19 nt, Homo sapiens
cacagacaccucucucaug

SEQ ID NO: 504423 - RNA, 19 nt, Homo sapiens
auaccacugugacugcauu

SEQ ID NO: 504424 - RNA, 19 nt, Homo sapiens
ugaaggcaagagaugaauu

SEQ ID NO: 504425 - RNA, 19 nt, Homo sapiens
ucaaacgggcugcagagau

SEQ ID NO: 504426 - RNA, 19 nt, Homo sapiens
guaaaucuggaccaaguac

SEQ ID NO: 504427 - RNA, 19 nt, Homo sapiens
ucacagacaccucucucau

SEQ ID NO: 504428 - RNA, 19 nt, Homo sapiens
acagucauuccaagaacua

SEQ ID NO: 504429 - RNA, 19 nt, Homo sapiens
gcagauucuucgggauugg

SEQ ID NO: 504430 - RNA, 19 nt, Homo sapiens
ccaggacuucaguggauuu

SEQ ID NO: 504431 - RNA, 19 nt, Homo sapiens
gauccaaaucaguucacaa

SEQ ID NO: 504432 - RNA, 19 nt, Homo sapiens
caggaugcccacauacugu

SEQ ID NO: 504433 - RNA, 19 nt, Homo sapiens
ggcuguaugagcaccguua

SEQ ID NO: 504434 - RNA, 19 nt, Homo sapiens
guaugagcaccguuacaau

SEQ ID NO: 504435 - RNA, 19 nt, Homo sapiens
aauacagucauuccaagaa

SEQ ID NO: 504436 - RNA, 19 nt, Homo sapiens
aauauuugcacaugggauu

SEQ ID NO: 504437 - RNA, 19 nt, Homo sapiens
ggaccucaaccaggacuuc

SEQ ID NO: 504438 - RNA, 19 nt, Homo sapiens
gaugucccuuucucucucu

SEQ ID NO: 504439 - RNA, 19 nt, Homo sapiens
caguggauuucagcuucua

SEQ ID NO: 504440 - RNA, 19 nt, Homo sapiens
ugucuucaauggaauacag

SEQ ID NO: 504441 - RNA, 19 nt, Homo sapiens
ggaacaggaugcccacaua

SEQ ID NO: 504442 - RNA, 19 nt, Homo sapiens
gcaaagauccaaaucaguu

SEQ ID NO: 504443 - RNA, 19 nt, Homo sapiens
gagaaaggauggcaaagau

SEQ ID NO: 504444 - RNA, 19 nt, Homo sapiens
caagagaugaauugcauua

SEQ ID NO: 504445 - RNA, 19 nt, Homo sapiens
caaacgggcugcagagaug

SEQ ID NO: 504446 - RNA, 19 nt, Homo sapiens
ugagaugucuucaauggaa

SEQ ID NO: 504447 - RNA, 19 nt, Homo sapiens
ucucagaaaugucaugauu

SEQ ID NO: 504448 - RNA, 19 nt, Homo sapiens
uuacugagaugucuucaau

SEQ ID NO: 504449 - RNA, 19 nt, Homo sapiens
ccacauacugucuaauuaa

SEQ ID NO: 504450 - RNA, 19 nt, Homo sapiens
gaaggcaagagaugaauug

SEQ ID NO: 504451 - RNA, 19 nt, Homo sapiens
cagcgagagugaaauuaaa

SEQ ID NO: 504452 - RNA, 19 nt, Homo sapiens
agauggagcuucaggcaaa

SEQ ID NO: 504453 - RNA, 19 nt, Homo sapiens
gacauucccuuggaccuuu

SEQ ID NO: 504454 - RNA, 19 nt, Homo sapiens
gcauggacauucccuugga

SEQ ID NO: 504455 - RNA, 19 nt, Homo sapiens
cccacauacugucuaauua

SEQ ID NO: 504456 - RNA, 19 nt, Homo sapiens
gagaaccuauagcaucuuc

SEQ ID NO: 504457 - RNA, 19 nt, Homo sapiens
gugagaugguucccaauau

SEQ ID NO: 504458 - RNA, 19 nt, Homo sapiens
acagacaccucucucaugu

SEQ ID NO: 504459 - RNA, 19 nt, Homo sapiens
ccuauagcaucuucucauu

SEQ ID NO: 504460 - RNA, 19 nt, Homo sapiens
gagagugaaauuaaacuug

SEQ ID NO: 504461 - RNA, 19 nt, Homo sapiens
ucagaaaugucaugauugc

SEQ ID NO: 504462 - RNA, 19 nt, Homo sapiens
aggcaaaacuuacagcuua

SEQ ID NO: 504463 - RNA, 19 nt, Homo sapiens
cuaguugguugaugccuuu

SEQ ID NO: 504464 - RNA, 19 nt, Homo sapiens
gcccacauacugucuaauu

SEQ ID NO: 504465 - RNA, 19 nt, Homo sapiens
ggacuucaguggauuucag

SEQ ID NO: 504466 - RNA, 19 nt, Homo sapiens
acacagauauacagcagau

SEQ ID NO: 504467 - RNA, 19 nt, Homo sapiens
ucagugaucugccauacca

SEQ ID NO: 504468 - RNA, 19 nt, Homo sapiens
ccagcgagagugaaauuaa

SEQ ID NO: 504469 - RNA, 19 nt, Homo sapiens
uagagaaccuauagcaucu

SEQ ID NO: 504470 - RNA, 19 nt, Homo sapiens
ugagaugguucccaauauc

SEQ ID NO: 504471 - RNA, 19 nt, Homo sapiens
cugcagagauggagcuuca

SEQ ID NO: 504472 - RNA, 19 nt, Homo sapiens
ugacugcauugaaagaugu

SEQ ID NO: 504473 - RNA, 19 nt, Homo sapiens
caaacaaguaugaaucuag

SEQ ID NO: 504474 - RNA, 19 nt, Homo sapiens
ggcagucguuguugguauu

SEQ ID NO: 504475 - RNA, 19 nt, Homo sapiens
agacaccucucucauguac

SEQ ID NO: 504476 - RNA, 19 nt, Homo sapiens
gagaugguucccaauauca

SEQ ID NO: 504477 - RNA, 19 nt, Homo sapiens
acuuacagcuuaacccauu

SEQ ID NO: 504478 - RNA, 19 nt, Homo sapiens
cacugugacugcauugaaa

SEQ ID NO: 504479 - RNA, 19 nt, Homo sapiens
gaacaggaugcccacauac

SEQ ID NO: 504480 - RNA, 19 nt, Homo sapiens
ucccugacaugcugagaaa

SEQ ID NO: 504481 - RNA, 19 nt, Homo sapiens
uggcaaagauccaaaucag

SEQ ID NO: 504482 - RNA, 19 nt, Homo sapiens
gcugagaaaggauggcaaa

SEQ ID NO: 504483 - RNA, 19 nt, Homo sapiens
gucuguaacugguucauca

SEQ ID NO: 504484 - RNA, 19 nt, Homo sapiens
gagaugucuucaauggaau

SEQ ID NO: 504485 - RNA, 19 nt, Homo sapiens
gaggacagcauggacauuc

SEQ ID NO: 504486 - RNA, 19 nt, Homo sapiens
ugagaaaggauggcaaaga

SEQ ID NO: 504487 - RNA, 19 nt, Homo sapiens
ggacauucccuuggaccuu

SEQ ID NO: 504488 - RNA, 19 nt, Homo sapiens
acugagaugucuucaaugg

SEQ ID NO: 504489 - RNA, 19 nt, Homo sapiens
ggugaaggcaagagaugaa

SEQ ID NO: 504490 - RNA, 19 nt, Homo sapiens
gugacugcauugaaagaug

SEQ ID NO: 504491 - RNA, 19 nt, Homo sapiens
gaaccuauagcaucuucuc

SEQ ID NO: 504492 - RNA, 19 nt, Homo sapiens
ugugagaugguucccaaua

SEQ ID NO: 504493 - RNA, 19 nt, Homo sapiens
ccuuggaccuuucuucauc

SEQ ID NO: 504494 - RNA, 19 nt, Homo sapiens
ccacugugacugcauugaa

SEQ ID NO: 504495 - RNA, 19 nt, Homo sapiens
uaugagcaccguuacaaug

SEQ ID NO: 504496 - RNA, 19 nt, Homo sapiens
gucauuccaagaacuauaa

SEQ ID NO: 504497 - RNA, 19 nt, Homo sapiens
uuacaaugccuauccuuca

SEQ ID NO: 504498 - RNA, 19 nt, Homo sapiens
gcacaugggauugcuaaaa

SEQ ID NO: 504499 - RNA, 19 nt, Homo sapiens
aaccaggacuucaguggau

SEQ ID NO: 504500 - RNA, 19 nt, Homo sapiens
cagcaaacacaccugucua

SEQ ID NO: 504501 - RNA, 19 nt, Homo sapiens
gugcagauucuucgggauu

SEQ ID NO: 504502 - RNA, 19 nt, Homo sapiens
acaaguaugaaucuaguug

SEQ ID NO: 504503 - RNA, 19 nt, Homo sapiens
gagcuucaggcaaaacuua

SEQ ID NO: 504504 - RNA, 19 nt, Homo sapiens
caaagauccaaaucaguuc

SEQ ID NO: 504505 - RNA, 19 nt, Homo sapiens
uauagcaucuucucauucc

SEQ ID NO: 504506 - RNA, 19 nt, Homo sapiens
gcaauacuuagagaaccua

SEQ ID NO: 504507 - RNA, 19 nt, Homo sapiens
ucagacugugcaauacuua

SEQ ID NO: 504508 - RNA, 19 nt, Homo sapiens
ggacaaaacacagauauac

SEQ ID NO: 504509 - RNA, 19 nt, Homo sapiens
caucuucucauucccaugu

SEQ ID NO: 504510 - RNA, 19 nt, Homo sapiens
aaacuugaaacucggauca

SEQ ID NO: 504511 - RNA, 19 nt, Homo sapiens
acagauauacagcagauag

SEQ ID NO: 504512 - RNA, 19 nt, Homo sapiens
auacuuagagaaccuauag

SEQ ID NO: 504513 - RNA, 19 nt, Homo sapiens
gaugguucccaauaucaug

SEQ ID NO: 504514 - RNA, 19 nt, Homo sapiens
ggcaaaacuuacagcuuaa

SEQ ID NO: 504515 - RNA, 19 nt, Homo sapiens
cacagacaccucucucaug

SEQ ID NO: 504516 - RNA, 19 nt, Homo sapiens
auaccacugugacugcauu

SEQ ID NO: 504517 - RNA, 19 nt, Homo sapiens
uggcagucguuguugguau

SEQ ID NO: 504518 - RNA, 19 nt, Homo sapiens
ugaaggcaagagaugaauu

SEQ ID NO: 504519 - RNA, 19 nt, Homo sapiens
ucaaacgggcugcagagau

SEQ ID NO: 504520 - RNA, 19 nt, Homo sapiens
guaaaucuggaccaaguac

SEQ ID NO: 504521 - RNA, 19 nt, Homo sapiens
ucacagacaccucucucau

SEQ ID NO: 504522 - RNA, 19 nt, Homo sapiens
gcagauucuucgggauugg

SEQ ID NO: 504523 - RNA, 19 nt, Homo sapiens
acagucauuccaagaacua

SEQ ID NO: 504524 - RNA, 19 nt, Homo sapiens
cgagagugaaauuaaacuu

SEQ ID NO: 504525 - RNA, 19 nt, Homo sapiens
ccaggacuucaguggauuu

SEQ ID NO: 504526 - RNA, 19 nt, Homo sapiens
gauccaaaucaguucacaa

SEQ ID NO: 504527 - RNA, 19 nt, Homo sapiens
caggaugcccacauacugu

SEQ ID NO: 504528 - RNA, 19 nt, Homo sapiens
ggcuguaugagcaccguua

SEQ ID NO: 504529 - RNA, 19 nt, Homo sapiens
aauacagucauuccaagaa

SEQ ID NO: 504530 - RNA, 19 nt, Homo sapiens
aauauuugcacaugggauu

SEQ ID NO: 504531 - RNA, 19 nt, Homo sapiens
ggaccucaaccaggacuuc

SEQ ID NO: 504532 - RNA, 19 nt, Homo sapiens
guaugagcaccguuacaau

SEQ ID NO: 504533 - RNA, 19 nt, Homo sapiens
gaugucccuuucucucucu

SEQ ID NO: 504534 - RNA, 19 nt, Homo sapiens
caguggauuucagcuucua

SEQ ID NO: 504535 - RNA, 19 nt, Homo sapiens
ugucuucaauggaauacag

SEQ ID NO: 504536 - RNA, 19 nt, Homo sapiens
ggaacaggaugcccacaua

SEQ ID NO: 504537 - RNA, 19 nt, Homo sapiens
gaaagaagcuugugauccu

SEQ ID NO: 504538 - RNA, 19 nt, Homo sapiens
gcaaagauccaaaucaguu

SEQ ID NO: 504539 - RNA, 19 nt, Homo sapiens
gagaaaggauggcaaagau

SEQ ID NO: 504540 - RNA, 19 nt, Homo sapiens
caagagaugaauugcauua

SEQ ID NO: 504541 - RNA, 19 nt, Homo sapiens
caaacgggcugcagagaug

SEQ ID NO: 504542 - RNA, 19 nt, Homo sapiens
ugagaugucuucaauggaa

SEQ ID NO: 504543 - RNA, 19 nt, Homo sapiens
ucucagaaaugucaugauu

SEQ ID NO: 504544 - RNA, 19 nt, Homo sapiens
uuacugagaugucuucaau

SEQ ID NO: 504545 - RNA, 19 nt, Homo sapiens
ccacauacugucuaauuaa

SEQ ID NO: 504546 - RNA, 19 nt, Homo sapiens
gaaggcaagagaugaauug

SEQ ID NO: 504547 - RNA, 19 nt, Homo sapiens
agauggagcuucaggcaaa

SEQ ID NO: 504548 - RNA, 19 nt, Homo sapiens
gacauucccuuggaccuuu

SEQ ID NO: 504549 - RNA, 19 nt, Homo sapiens
gcauggacauucccuugga

SEQ ID NO: 504550 - RNA, 19 nt, Homo sapiens
cccacauacugucuaauua

SEQ ID NO: 504551 - RNA, 19 nt, Homo sapiens
gagaaccuauagcaucuuc

SEQ ID NO: 504552 - RNA, 19 nt, Homo sapiens
gugagaugguucccaauau

SEQ ID NO: 504553 - RNA, 19 nt, Homo sapiens
guauguggauagcgugaaa

SEQ ID NO: 504554 - RNA, 19 nt, Homo sapiens
acagacaccucucucaugu

SEQ ID NO: 504555 - RNA, 19 nt, Homo sapiens
ccuauagcaucuucucauu

SEQ ID NO: 504556 - RNA, 19 nt, Homo sapiens
ucagaaaugucaugauugc

SEQ ID NO: 504557 - RNA, 19 nt, Homo sapiens
aggcaaaacuuacagcuua

SEQ ID NO: 504558 - RNA, 19 nt, Homo sapiens
cuaguugguugaugccuuu

SEQ ID NO: 504559 - RNA, 19 nt, Homo sapiens
gcccacauacugucuaauu

SEQ ID NO: 504560 - RNA, 19 nt, Homo sapiens
ggacuucaguggauuucag

SEQ ID NO: 504561 - RNA, 19 nt, Homo sapiens
acacagauauacagcagau

SEQ ID NO: 504562 - RNA, 19 nt, Homo sapiens
ucagugaucugccauacca

SEQ ID NO: 504563 - RNA, 19 nt, Homo sapiens
uagagaaccuauagcaucu

SEQ ID NO: 504564 - RNA, 19 nt, Homo sapiens
ugagaugguucccaauauc

SEQ ID NO: 504565 - RNA, 19 nt, Homo sapiens
cugcagagauggagcuuca

SEQ ID NO: 504566 - RNA, 19 nt, Homo sapiens
ugacugcauugaaagaugu

SEQ ID NO: 504567 - RNA, 19 nt, Homo sapiens
caaacaaguaugaaucuag

SEQ ID NO: 504568 - RNA, 19 nt, Homo sapiens
agacaccucucucauguac

SEQ ID NO: 504569 - RNA, 19 nt, Homo sapiens
gagaugguucccaauauca

SEQ ID NO: 504570 - RNA, 19 nt, Homo sapiens
acuuacagcuuaacccauu

SEQ ID NO: 504571 - RNA, 19 nt, Homo sapiens
cacugugacugcauugaaa

SEQ ID NO: 504572 - RNA, 19 nt, Homo sapiens
gaacaggaugcccacauac

SEQ ID NO: 504573 - RNA, 19 nt, Homo sapiens
ucccugacaugcugagaaa

SEQ ID NO: 504574 - RNA, 19 nt, Homo sapiens
uggcaaagauccaaaucag

SEQ ID NO: 504575 - RNA, 19 nt, Homo sapiens
gcugagaaaggauggcaaa

SEQ ID NO: 504576 - RNA, 19 nt, Homo sapiens
gucuguaacugguucauca

SEQ ID NO: 504577 - RNA, 19 nt, Homo sapiens
gagaugucuucaauggaau

SEQ ID NO: 504578 - RNA, 19 nt, Homo sapiens
gaggacagcauggacauuc

SEQ ID NO: 504579 - RNA, 19 nt, Homo sapiens
ugagaaaggauggcaaaga

SEQ ID NO: 504580 - RNA, 19 nt, Homo sapiens
guggauagcgugaaagaag

SEQ ID NO: 504581 - RNA, 19 nt, Homo sapiens
ggacauucccuuggaccuu

SEQ ID NO: 504582 - RNA, 19 nt, Homo sapiens
acugagaugucuucaaugg

SEQ ID NO: 504583 - RNA, 19 nt, Homo sapiens
ggugaaggcaagagaugaa

SEQ ID NO: 504584 - RNA, 19 nt, Homo sapiens
gugacugcauugaaagaug

SEQ ID NO: 504585 - RNA, 19 nt, Homo sapiens
gaaccuauagcaucuucuc

SEQ ID NO: 504586 - RNA, 19 nt, Homo sapiens
ugugagaugguucccaaua

SEQ ID NO: 504587 - RNA, 19 nt, Homo sapiens
ccuuggaccuuucuucauc

SEQ ID NO: 504588 - RNA, 19 nt, Homo sapiens
ccacugugacugcauugaa

SEQ ID NO: 504589 - RNA, 19 nt, Homo sapiens
uaugagcaccguuacaaug

SEQ ID NO: 504590 - RNA, 19 nt, Homo sapiens
gucauuccaagaacuauaa

SEQ ID NO: 504591 - RNA, 19 nt, Homo sapiens
uuacaaugccuauccuuca

SEQ ID NO: 504592 - RNA, 19 nt, Homo sapiens
gugcagauucuucgggauu

SEQ ID NO: 504593 - RNA, 19 nt, Homo sapiens
gcacaugggauugcuaaaa

SEQ ID NO: 504594 - RNA, 19 nt, Homo sapiens
aaccaggacuucaguggau

SEQ ID NO: 504595 - RNA, 19 nt, Homo sapiens
cagcaaacacaccugucua

SEQ ID NO: 504596 - RNA, 19 nt, Homo sapiens
acaaguaugaaucuaguug

SEQ ID NO: 504597 - RNA, 19 nt, Homo sapiens
gagcuucaggcaaaacuua

SEQ ID NO: 504598 - RNA, 19 nt, Homo sapiens
caaagauccaaaucaguuc

SEQ ID NO: 504599 - RNA, 19 nt, Homo sapiens
uauagcaucuucucauucc

SEQ ID NO: 504600 - RNA, 19 nt, Homo sapiens
gcaauacuuagagaaccua

SEQ ID NO: 504601 - RNA, 19 nt, Homo sapiens
ucagacugugcaauacuua

SEQ ID NO: 504602 - RNA, 19 nt, Homo sapiens
ggacaaaacacagauauac

SEQ ID NO: 504603 - RNA, 19 nt, Homo sapiens
caucuucucauucccaugu

SEQ ID NO: 504604 - RNA, 19 nt, Homo sapiens
acagauauacagcagauag

SEQ ID NO: 504605 - RNA, 19 nt, Homo sapiens
auacuuagagaaccuauag

SEQ ID NO: 504606 - RNA, 19 nt, Homo sapiens
gaugguucccaauaucaug

SEQ ID NO: 504607 - RNA, 19 nt, Homo sapiens
ggcaaaacuuacagcuuaa

SEQ ID NO: 504608 - RNA, 19 nt, Homo sapiens
cacagacaccucucucaug

SEQ ID NO: 504609 - RNA, 19 nt, Homo sapiens
auaccacugugacugcauu

SEQ ID NO: 504610 - RNA, 19 nt, Homo sapiens
ugaaggcaagagaugaauu

SEQ ID NO: 504611 - RNA, 19 nt, Homo sapiens
ucaaacgggcugcagagau

SEQ ID NO: 504612 - RNA, 19 nt, Homo sapiens
guaaaucuggaccaaguac

SEQ ID NO: 504613 - RNA, 19 nt, Homo sapiens
ucacagacaccucucucau

SEQ ID NO: 504614 - RNA, 19 nt, Homo sapiens
gcagauucuucgggauugg

SEQ ID NO: 504615 - RNA, 19 nt, Homo sapiens
acagucauuccaagaacua

SEQ ID NO: 504616 - RNA, 19 nt, Homo sapiens
ccaggacuucaguggauuu

SEQ ID NO: 504617 - RNA, 19 nt, Homo sapiens
gauccaaaucaguucacaa

SEQ ID NO: 504618 - RNA, 19 nt, Homo sapiens
caggaugcccacauacugu

SEQ ID NO: 504619 - RNA, 19 nt, Homo sapiens
guaugagcaccguuacaau

SEQ ID NO: 504620 - RNA, 19 nt, Homo sapiens
aauacagucauuccaagaa

SEQ ID NO: 504621 - RNA, 19 nt, Homo sapiens
aauauuugcacaugggauu

SEQ ID NO: 504622 - RNA, 19 nt, Homo sapiens
ggaccucaaccaggacuuc

SEQ ID NO: 504623 - RNA, 19 nt, Homo sapiens
gaugucccuuucucucucu

SEQ ID NO: 504624 - RNA, 19 nt, Homo sapiens
ggcuguaugagcaccguua

SEQ ID NO: 504625 - RNA, 19 nt, Homo sapiens
caguggauuucagcuucua

SEQ ID NO: 504626 - RNA, 19 nt, Homo sapiens
ugucuucaauggaauacag

SEQ ID NO: 504627 - RNA, 19 nt, Homo sapiens
ggaacaggaugcccacaua

SEQ ID NO: 504628 - RNA, 19 nt, Homo sapiens
gcaaagauccaaaucaguu

SEQ ID NO: 504629 - RNA, 19 nt, Homo sapiens
gagaaaggauggcaaagau

SEQ ID NO: 504630 - RNA, 19 nt, Homo sapiens
caagagaugaauugcauua

SEQ ID NO: 504631 - RNA, 19 nt, Homo sapiens
caaacgggcugcagagaug

SEQ ID NO: 504632 - RNA, 19 nt, Homo sapiens
ugagaugucuucaauggaa

SEQ ID NO: 504633 - RNA, 19 nt, Homo sapiens
ucucagaaaugucaugauu

SEQ ID NO: 504634 - RNA, 19 nt, Homo sapiens
uuacugagaugucuucaau

SEQ ID NO: 504635 - RNA, 19 nt, Homo sapiens
ccacauacugucuaauuaa

SEQ ID NO: 504636 - RNA, 19 nt, Homo sapiens
gaaggcaagagaugaauug

SEQ ID NO: 504637 - RNA, 19 nt, Homo sapiens
agauggagcuucaggcaaa

SEQ ID NO: 504638 - RNA, 19 nt, Homo sapiens
gaaaguccaagguauuguu

SEQ ID NO: 504639 - RNA, 19 nt, Homo sapiens
gacauucccuuggaccuuu

SEQ ID NO: 504640 - RNA, 19 nt, Homo sapiens
gcauggacauucccuugga

SEQ ID NO: 504641 - RNA, 19 nt, Homo sapiens
gguagaagcuggcuaaccu

SEQ ID NO: 504642 - RNA, 19 nt, Homo sapiens
cccacauacugucuaauua

SEQ ID NO: 504643 - RNA, 19 nt, Homo sapiens
gagaaccuauagcaucuuc

SEQ ID NO: 504644 - RNA, 19 nt, Homo sapiens
gugagaugguucccaauau

SEQ ID NO: 504645 - RNA, 19 nt, Homo sapiens
acagacaccucucucaugu

SEQ ID NO: 504646 - RNA, 19 nt, Homo sapiens
ccuauagcaucuucucauu

SEQ ID NO: 504647 - RNA, 19 nt, Homo sapiens
caagggaaaguccaaggua

SEQ ID NO: 504648 - RNA, 19 nt, Homo sapiens
ucagaaaugucaugauugc

SEQ ID NO: 504649 - RNA, 19 nt, Homo sapiens
aggcaaaacuuacagcuua

SEQ ID NO: 504650 - RNA, 19 nt, Homo sapiens
cuaguugguugaugccuuu

SEQ ID NO: 504651 - RNA, 19 nt, Homo sapiens
gcccacauacugucuaauu

SEQ ID NO: 504652 - RNA, 19 nt, Homo sapiens
ggacuucaguggauuucag

SEQ ID NO: 504653 - RNA, 19 nt, Homo sapiens
acacagauauacagcagau

SEQ ID NO: 504654 - RNA, 19 nt, Homo sapiens
ucagugaucugccauacca

SEQ ID NO: 504655 - RNA, 19 nt, Homo sapiens
uagagaaccuauagcaucu

SEQ ID NO: 504656 - RNA, 19 nt, Homo sapiens
ugagaugguucccaauauc

SEQ ID NO: 504657 - RNA, 19 nt, Homo sapiens
cugcagagauggagcuuca

SEQ ID NO: 504658 - RNA, 19 nt, Homo sapiens
ugacugcauugaaagaugu

SEQ ID NO: 504659 - RNA, 19 nt, Homo sapiens
caaacaaguaugaaucuag

SEQ ID NO: 504660 - RNA, 19 nt, Homo sapiens
agacaccucucucauguac

SEQ ID NO: 504661 - RNA, 19 nt, Homo sapiens
gggaaaguccaagguauug

SEQ ID NO: 504662 - RNA, 19 nt, Homo sapiens
gagaugguucccaauauca

SEQ ID NO: 504663 - RNA, 19 nt, Homo sapiens
acuuacagcuuaacccauu

SEQ ID NO: 504664 - RNA, 19 nt, Homo sapiens
cacugugacugcauugaaa

SEQ ID NO: 504665 - RNA, 19 nt, Homo sapiens
gaacaggaugcccacauac

SEQ ID NO: 504666 - RNA, 19 nt, Homo sapiens
ucccugacaugcugagaaa

SEQ ID NO: 504667 - RNA, 19 nt, Homo sapiens
uaaccuccacuuccacauu

SEQ ID NO: 504668 - RNA, 19 nt, Homo sapiens
uggcaaagauccaaaucag

SEQ ID NO: 504669 - RNA, 19 nt, Homo sapiens
gcugagaaaggauggcaaa

SEQ ID NO: 504670 - RNA, 19 nt, Homo sapiens
gucuguaacugguucauca

SEQ ID NO: 504671 - RNA, 19 nt, Homo sapiens
gagaugucuucaauggaau

SEQ ID NO: 504672 - RNA, 19 nt, Homo sapiens
ugagaaaggauggcaaaga

SEQ ID NO: 504673 - RNA, 19 nt, Homo sapiens
gaggacagcauggacauuc

SEQ ID NO: 504674 - RNA, 19 nt, Homo sapiens
aagggaaaguccaagguau

SEQ ID NO: 504675 - RNA, 19 nt, Homo sapiens
acugagaugucuucaaugg

SEQ ID NO: 504676 - RNA, 19 nt, Homo sapiens
ggugaaggcaagagaugaa

SEQ ID NO: 504677 - RNA, 19 nt, Homo sapiens
ggacauucccuuggaccuu

SEQ ID NO: 504678 - RNA, 19 nt, Homo sapiens
gugacugcauugaaagaug

SEQ ID NO: 504679 - RNA, 19 nt, Homo sapiens
gaaccuauagcaucuucuc

SEQ ID NO: 504680 - RNA, 19 nt, Homo sapiens
ugugagaugguucccaaua

SEQ ID NO: 504681 - RNA, 19 nt, Homo sapiens
ccacugugacugcauugaa

SEQ ID NO: 504682 - RNA, 19 nt, Homo sapiens
uaugagcaccguuacaaug

SEQ ID NO: 504683 - RNA, 19 nt, Homo sapiens
ccuuggaccuuucuucauc

SEQ ID NO: 504684 - RNA, 19 nt, Homo sapiens
gucauuccaagaacuauaa

SEQ ID NO: 504685 - RNA, 19 nt, Homo sapiens
uuacaaugccuauccuuca

SEQ ID NO: 504686 - RNA, 19 nt, Homo sapiens
gcacaugggauugcuaaaa

SEQ ID NO: 504687 - RNA, 19 nt, Homo sapiens
aaccaggacuucaguggau

SEQ ID NO: 504688 - RNA, 19 nt, Homo sapiens
cagcaaacacaccugucua

SEQ ID NO: 504689 - RNA, 19 nt, Homo sapiens
gugcagauucuucgggauu

SEQ ID NO: 504690 - RNA, 19 nt, Homo sapiens
acaaguaugaaucuaguug

SEQ ID NO: 504691 - RNA, 19 nt, Homo sapiens
gagcuucaggcaaaacuua

SEQ ID NO: 504692 - RNA, 19 nt, Homo sapiens
caaagauccaaaucaguuc

SEQ ID NO: 504693 - RNA, 19 nt, Homo sapiens
uauagcaucuucucauucc

SEQ ID NO: 504694 - RNA, 19 nt, Homo sapiens
gcaauacuuagagaaccua

SEQ ID NO: 504695 - RNA, 19 nt, Homo sapiens
ucagacugugcaauacuua

SEQ ID NO: 504696 - RNA, 19 nt, Homo sapiens
ggacaaaacacagauauac

SEQ ID NO: 504697 - RNA, 19 nt, Homo sapiens
caucuucucauucccaugu

SEQ ID NO: 504698 - RNA, 19 nt, Homo sapiens
uggcuaaccuccacuucca

SEQ ID NO: 504699 - RNA, 19 nt, Homo sapiens
acagauauacagcagauag

SEQ ID NO: 504700 - RNA, 19 nt, Homo sapiens
auacuuagagaaccuauag

SEQ ID NO: 504701 - RNA, 19 nt, Homo sapiens
gaugguucccaauaucaug

SEQ ID NO: 504702 - RNA, 19 nt, Homo sapiens
cgugguagaagcuggcuaa

SEQ ID NO: 504703 - RNA, 19 nt, Homo sapiens
ggaaaguccaagguauugu

SEQ ID NO: 504704 - RNA, 19 nt, Homo sapiens
ggcaaaacuuacagcuuaa

SEQ ID NO: 504705 - RNA, 19 nt, Homo sapiens
cacagacaccucucucaug

SEQ ID NO: 504706 - RNA, 19 nt, Homo sapiens
auaccacugugacugcauu

SEQ ID NO: 504707 - RNA, 19 nt, Homo sapiens
ugaaggcaagagaugaauu

SEQ ID NO: 504708 - RNA, 19 nt, Homo sapiens
aaccuccacuuccacauuc

SEQ ID NO: 504709 - RNA, 19 nt, Homo sapiens
ucaaacgggcugcagagau

SEQ ID NO: 504710 - RNA, 19 nt, Homo sapiens
guaaaucuggaccaaguac

SEQ ID NO: 504711 - RNA, 19 nt, Homo sapiens
ucacagacaccucucucau

SEQ ID NO: 504712 - RNA, 19 nt, Homo sapiens
acagucauuccaagaacua

SEQ ID NO: 504713 - RNA, 19 nt, Homo sapiens
ccaggacuucaguggauuu

SEQ ID NO: 504714 - RNA, 19 nt, Homo sapiens
gcagauucuucgggauugg

SEQ ID NO: 504715 - RNA, 19 nt, Homo sapiens
gauccaaaucaguucacaa

SEQ ID NO: 504716 - RNA, 19 nt, Homo sapiens
caggaugcccacauacugu

SEQ ID NO: 504717 - RNA, 19 nt, Homo sapiens
aauacagucauuccaagaa

SEQ ID NO: 504718 - RNA, 19 nt, Homo sapiens
aauauuugcacaugggauu

SEQ ID NO: 504719 - RNA, 19 nt, Homo sapiens
guaugagcaccguuacaau

SEQ ID NO: 504720 - RNA, 19 nt, Homo sapiens
ggaccucaaccaggacuuc

SEQ ID NO: 504721 - RNA, 19 nt, Homo sapiens
ggcuguaugagcaccguua

SEQ ID NO: 504722 - RNA, 19 nt, Homo sapiens
gaugucccuuucucucucu

SEQ ID NO: 504723 - RNA, 19 nt, Homo sapiens
caguggauuucagcuucua

SEQ ID NO: 504724 - RNA, 19 nt, Homo sapiens
ugucuucaauggaauacag

SEQ ID NO: 504725 - RNA, 19 nt, Homo sapiens
gggaacagaugcuaauaaa

SEQ ID NO: 504726 - RNA, 19 nt, Homo sapiens
gauggcagcuucaagauug

SEQ ID NO: 504727 - RNA, 19 nt, Homo sapiens
gaacuggucuggugauuac

SEQ ID NO: 504728 - RNA, 19 nt, Homo sapiens
gaacagaugcuaauaaacu

SEQ ID NO: 504729 - RNA, 19 nt, Homo sapiens
ggacaucaccuaccucuau

SEQ ID NO: 504730 - RNA, 19 nt, Homo sapiens
gcucgaaggcucuggguua

SEQ ID NO: 504731 - RNA, 19 nt, Homo sapiens
gacaucaccuaccucuaua

SEQ ID NO: 504732 - RNA, 19 nt, Homo sapiens
gcaggaguauguucuuaau

SEQ ID NO: 504733 - RNA, 19 nt, Homo sapiens
gcaaugagaucuacauccu

SEQ ID NO: 504734 - RNA, 19 nt, Homo sapiens
gcagcaaacccaaugugua

SEQ ID NO: 504735 - RNA, 19 nt, Homo sapiens
aggaguauguucuuaauga

SEQ ID NO: 504736 - RNA, 19 nt, Homo sapiens
gggagucagucuucacuug

SEQ ID NO: 504737 - RNA, 19 nt, Homo sapiens
ggagucagaugagcaagga

SEQ ID NO: 504738 - RNA, 19 nt, Homo sapiens
gcuucaagauuguuuaugu

SEQ ID NO: 504739 - RNA, 19 nt, Homo sapiens
acacaucccuuaccaugga

SEQ ID NO: 504740 - RNA, 19 nt, Homo sapiens
ggugcuggaugccugcuua

SEQ ID NO: 504741 - RNA, 19 nt, Homo sapiens
ucaccuaccucuauaagca

SEQ ID NO: 504742 - RNA, 19 nt, Homo sapiens
ucgcaucacccuugaguua

SEQ ID NO: 504743 - RNA, 19 nt, Homo sapiens
gaugauggcagcuucaaga

SEQ ID NO: 504744 - RNA, 19 nt, Homo sapiens
gaucugauggucucuguga

SEQ ID NO: 504745 - RNA, 19 nt, Homo sapiens
cagcaaacccaauguguau

SEQ ID NO: 504746 - RNA, 19 nt, Homo sapiens
ggaacuggucuggugauua

SEQ ID NO: 504747 - RNA, 19 nt, Homo sapiens
ucaaggagaccaagaagga

SEQ ID NO: 504748 - RNA, 19 nt, Homo sapiens
uugcugaggugaauaguga

SEQ ID NO: 504749 - RNA, 19 nt, Homo sapiens
guacgacacgccuuucauu

SEQ ID NO: 504750 - RNA, 19 nt, Homo sapiens
gggccaugcugcucaaugu

SEQ ID NO: 504751 - RNA, 19 nt, Homo sapiens
uaaugagucugggagaauu

SEQ ID NO: 504752 - RNA, 19 nt, Homo sapiens
ggagagggagucagucuuc

SEQ ID NO: 504753 - RNA, 19 nt, Homo sapiens
uggagcaccugaaccauga

SEQ ID NO: 504754 - RNA, 19 nt, Homo sapiens
cggcaggaguauguucuua

SEQ ID NO: 504755 - RNA, 19 nt, Homo sapiens
uggaacgacugcuggauga

SEQ ID NO: 504756 - RNA, 19 nt, Homo sapiens
ugaacucccuggaugacaa

SEQ ID NO: 504757 - RNA, 19 nt, Homo sapiens
agaauggccuggucuacau

SEQ ID NO: 504758 - RNA, 19 nt, Homo sapiens
gcccagaggacauugugua

SEQ ID NO: 504759 - RNA, 19 nt, Homo sapiens
ggaaagcccagguggucaa

SEQ ID NO: 504760 - RNA, 19 nt, Homo sapiens
gcgggcagccuuuccauau

SEQ ID NO: 504761 - RNA, 19 nt, Homo sapiens
gacacagacacaucccuua

SEQ ID NO: 504762 - RNA, 19 nt, Homo sapiens
ggagugugaaguacagauu

SEQ ID NO: 504763 - RNA, 19 nt, Homo sapiens
caaaggccaucagcuccaa

SEQ ID NO: 504764 - RNA, 19 nt, Homo sapiens
ggaccuaugaauccucuga

SEQ ID NO: 504765 - RNA, 19 nt, Homo sapiens
gagagggcaugcuaguagu

SEQ ID NO: 504766 - RNA, 19 nt, Homo sapiens
agaccucucccucacguua

SEQ ID NO: 504767 - RNA, 19 nt, Homo sapiens
ggaguauguucuuaaugag

SEQ ID NO: 504768 - RNA, 19 nt, Homo sapiens
cagaggacauuguguacgu

SEQ ID NO: 504769 - RNA, 19 nt, Homo sapiens
cgagagggcaugcuaguag

SEQ ID NO: 504770 - RNA, 19 nt, Homo sapiens
ugaaguacgacacgccuuu

SEQ ID NO: 504771 - RNA, 19 nt, Homo sapiens
gacuagcaguggcaucuuc

SEQ ID NO: 504772 - RNA, 19 nt, Homo sapiens
caacuccgcccacgacaca

SEQ ID NO: 504773 - RNA, 19 nt, Homo sapiens
gcguggagauccugcuuag

SEQ ID NO: 504774 - RNA, 19 nt, Homo sapiens
gggaacuggucuggugauu

SEQ ID NO: 504775 - RNA, 19 nt, Homo sapiens
guacguggaccaugaggau

SEQ ID NO: 504776 - RNA, 19 nt, Homo sapiens
gagagggagucagucuuca

SEQ ID NO: 504777 - RNA, 19 nt, Homo sapiens
ccaguggccuacaaggaau

SEQ ID NO: 504778 - RNA, 19 nt, Homo sapiens
gcagcuucaagauuguuua

SEQ ID NO: 504779 - RNA, 19 nt, Homo sapiens
gauccugcuuagcuaccua

SEQ ID NO: 504780 - RNA, 19 nt, Homo sapiens
gggcagccuuuccauaugc

SEQ ID NO: 504781 - RNA, 19 nt, Homo sapiens
gugguaccaucuucaagga

SEQ ID NO: 504782 - RNA, 19 nt, Homo sapiens
ccauggacaucuacuucga

SEQ ID NO: 504783 - RNA, 19 nt, Homo sapiens
ugacaauggaguccugauu

SEQ ID NO: 504784 - RNA, 19 nt, Homo sapiens
ggcaggaguauguucuuaa

SEQ ID NO: 504785 - RNA, 19 nt, Homo sapiens
gcaaguuucaguucacagu

SEQ ID NO: 504786 - RNA, 19 nt, Homo sapiens
aaguacagauugucuucaa

SEQ ID NO: 504787 - RNA, 19 nt, Homo sapiens
uggagauccugcuuagcua

SEQ ID NO: 504788 - RNA, 19 nt, Homo sapiens
ugaguacgacgagcugaua

SEQ ID NO: 504789 - RNA, 19 nt, Homo sapiens
guggagacccagucaaugu

SEQ ID NO: 504790 - RNA, 19 nt, Homo sapiens
gcaucacccuugaguuacu

SEQ ID NO: 504791 - RNA, 19 nt, Homo sapiens
ccucaccaaugucgucuuc

SEQ ID NO: 504792 - RNA, 19 nt, Homo sapiens
gaacgacugcuggaugaag

SEQ ID NO: 504793 - RNA, 19 nt, Homo sapiens
ggacauugccccaagauag

SEQ ID NO: 504794 - RNA, 19 nt, Homo sapiens
cauccauccugaccuguuc

SEQ ID NO: 504795 - RNA, 19 nt, Homo sapiens
cagaugagcaaggacauug

SEQ ID NO: 504796 - RNA, 19 nt, Homo sapiens
gaucgcaucacccuugagu

SEQ ID NO: 504797 - RNA, 19 nt, Homo sapiens
gcaaacccaauguguaugc

SEQ ID NO: 504798 - RNA, 19 nt, Homo sapiens
gcggaaggcaguagagaca

SEQ ID NO: 504799 - RNA, 19 nt, Homo sapiens
gggaggacaucaccuaccu

SEQ ID NO: 504800 - RNA, 19 nt, Homo sapiens
ggccaucggcacacucauu

SEQ ID NO: 504801 - RNA, 19 nt, Homo sapiens
ugaauagugacaaggugua

SEQ ID NO: 504802 - RNA, 19 nt, Homo sapiens
ggccuggucuacaugaagu

SEQ ID NO: 504803 - RNA, 19 nt, Homo sapiens
cgaaggcucuggguuacag

SEQ ID NO: 504804 - RNA, 19 nt, Homo sapiens
gaguuccaguugcccuuug

SEQ ID NO: 504805 - RNA, 19 nt, Homo sapiens
gagucagucuucacuugca

SEQ ID NO: 504806 - RNA, 19 nt, Homo sapiens
ggcccaagauccucaacgu

SEQ ID NO: 504807 - RNA, 19 nt, Homo sapiens
ucaagaauggccuggucua

SEQ ID NO: 504808 - RNA, 19 nt, Homo sapiens
gcaccugaaccaugauucu

SEQ ID NO: 504809 - RNA, 19 nt, Homo sapiens
gaacucccuggaugacaau

SEQ ID NO: 504810 - RNA, 19 nt, Homo sapiens
cuggaugccugcuuauaca

SEQ ID NO: 504811 - RNA, 19 nt, Homo sapiens
ccaggagugugaaguacag

SEQ ID NO: 504812 - RNA, 19 nt, Homo sapiens
cuucaagauuguuuaugug

SEQ ID NO: 504813 - RNA, 19 nt, Homo sapiens
acagacacaucccuuacca

SEQ ID NO: 504814 - RNA, 19 nt, Homo sapiens
gaaguacgacacgccuuuc

SEQ ID NO: 504815 - RNA, 19 nt, Homo sapiens
ggaugaagaggccggaucu

SEQ ID NO: 504816 - RNA, 19 nt, Homo sapiens
gagcaccugaaccaugauu

SEQ ID NO: 504817 - RNA, 19 nt, Homo sapiens
gcuggaugccugcuuauac

SEQ ID NO: 504818 - RNA, 19 nt, Homo sapiens
gagugugaaguacagauug

SEQ ID NO: 504819 - RNA, 19 nt, Homo sapiens
ugucagugguaccaucuuc

SEQ ID NO: 504820 - RNA, 19 nt, Homo sapiens
ggccaucagcuccaacaug

SEQ ID NO: 504821 - RNA, 19 nt, Homo sapiens
gccaucggcacacucauug

SEQ ID NO: 504822 - RNA, 19 nt, Homo sapiens
uacgacacgccuuucauuu

SEQ ID NO: 504823 - RNA, 19 nt, Homo sapiens
cauccgagagggcaugcua

SEQ ID NO: 504824 - RNA, 19 nt, Homo sapiens
ggaccgaagcacagauugg

SEQ ID NO: 504825 - RNA, 19 nt, Homo sapiens
gaacauaccuuggaauuuu

SEQ ID NO: 504826 - RNA, 19 nt, Homo sapiens
gaacaugggcagugacuuu

SEQ ID NO: 504827 - RNA, 19 nt, Homo sapiens
gaaccuccuuaaagcauaa

SEQ ID NO: 504828 - RNA, 19 nt, Homo sapiens
ccgaggagcuggucuuaga

SEQ ID NO: 504829 - RNA, 19 nt, Homo sapiens
ugaacaaacuggccgagaa

SEQ ID NO: 504830 - RNA, 19 nt, Homo sapiens
gcaaccuucucaucgagua

SEQ ID NO: 504831 - RNA, 19 nt, Homo sapiens
gaacagcaaccuucucauc

SEQ ID NO: 504832 - RNA, 19 nt, Homo sapiens
guccacugcuccauuuaua

SEQ ID NO: 504833 - RNA, 19 nt, Homo sapiens
ugaguccacugcuccauuu

SEQ ID NO: 504834 - RNA, 19 nt, Homo sapiens
ggucaaugccgacguggua

SEQ ID NO: 504835 - RNA, 19 nt, Homo sapiens
gaaguuaaggugagaaugg

SEQ ID NO: 504836 - RNA, 19 nt, Homo sapiens
gggcgcugcuuccaggaua

SEQ ID NO: 504837 - RNA, 19 nt, Homo sapiens
caacaccgcugaggaguac

SEQ ID NO: 504838 - RNA, 19 nt, Homo sapiens
gagacgagcgggaggauau

SEQ ID NO: 504839 - RNA, 19 nt, Homo sapiens
cagcagcccaagcuuaaua

SEQ ID NO: 504840 - RNA, 19 nt, Homo sapiens
ggaggaaguuaaggugaga

SEQ ID NO: 504841 - RNA, 19 nt, Homo sapiens
gcagugacuuugacgucuu

SEQ ID NO: 504842 - RNA, 19 nt, Homo sapiens
caaaauagaaccuccuuaa

SEQ ID NO: 504843 - RNA, 19 nt, Homo sapiens
gcaaggcuggguaauguga

SEQ ID NO: 504844 - RNA, 19 nt, Homo sapiens
ccaguggccucgugguuau

SEQ ID NO: 504845 - RNA, 19 nt, Homo sapiens
gaauccagcucccuagacu

SEQ ID NO: 504846 - RNA, 19 nt, Homo sapiens
ccaaguaccugcucaaccu

SEQ ID NO: 504847 - RNA, 19 nt, Homo sapiens
gaacaaacuggccgagaag

SEQ ID NO: 504848 - RNA, 19 nt, Homo sapiens
aaauagaaccuccuuaaag

SEQ ID NO: 504849 - RNA, 19 nt, Homo sapiens
guacuuccgcaaugaguuu

SEQ ID NO: 504850 - RNA, 19 nt, Homo sapiens
ucacccacaccuacaaaua

SEQ ID NO: 504851 - RNA, 19 nt, Homo sapiens
cggccaaguucaucaagaa

SEQ ID NO: 504852 - RNA, 19 nt, Homo sapiens
agacugaggcuuagagaga

SEQ ID NO: 504853 - RNA, 19 nt, Homo sapiens
cgaaccaccugaacaaacu

SEQ ID NO: 504854 - RNA, 19 nt, Homo sapiens
gauugaaccugcucaucuc

SEQ ID NO: 504855 - RNA, 19 nt, Homo sapiens
gagaggaaagaccuacauu

SEQ ID NO: 504856 - RNA, 19 nt, Homo sapiens
aauagaaccuccuuaaagc

SEQ ID NO: 504857 - RNA, 19 nt, Homo sapiens
gugcugggccacuucauuu

SEQ ID NO: 504858 - RNA, 19 nt, Homo sapiens
uaccagggauccagcuuug

SEQ ID NO: 504859 - RNA, 19 nt, Homo sapiens
guaguggcauggucaacug

SEQ ID NO: 504860 - RNA, 19 nt, Homo sapiens
aagaggagcggcaggagua

SEQ ID NO: 504861 - RNA, 19 nt, Homo sapiens
gggcgaaccaccugaacaa

SEQ ID NO: 504862 - RNA, 19 nt, Homo sapiens
ccauugaccacccaccaua

SEQ ID NO: 504863 - RNA, 19 nt, Homo sapiens
gagaauccagaaaucaaga

SEQ ID NO: 504864 - RNA, 19 nt, Homo sapiens
cagcuacaaugggaucuug

SEQ ID NO: 504865 - RNA, 19 nt, Homo sapiens
agaaccuccuuaaagcaua

SEQ ID NO: 504866 - RNA, 19 nt, Homo sapiens
cgaugggucugugcacaaa

SEQ ID NO: 504867 - RNA, 19 nt, Homo sapiens
ggucagaggagugauugaa

SEQ ID NO: 504868 - RNA, 19 nt, Homo sapiens
ggccuuuguuuccuuguug

SEQ ID NO: 504869 - RNA, 19 nt, Homo sapiens
ccuuaaagcauaaaucuca

SEQ ID NO: 504870 - RNA, 19 nt, Homo sapiens
gaacuucgagagcgacaag

SEQ ID NO: 504871 - RNA, 19 nt, Homo sapiens
gcccagaugcccuuuggaa

SEQ ID NO: 504872 - RNA, 19 nt, Homo sapiens
ggcugacccugcacuuuga

SEQ ID NO: 504873 - RNA, 19 nt, Homo sapiens
aagaacauaccuuggaauu

SEQ ID NO: 504874 - RNA, 19 nt, Homo sapiens
ccucuccacuccauguuug

SEQ ID NO: 504875 - RNA, 19 nt, Homo sapiens
ggagagggaggccuucaca

SEQ ID NO: 504876 - RNA, 19 nt, Homo sapiens
gugaagcaccuacuaugug

SEQ ID NO: 504877 - RNA, 19 nt, Homo sapiens
ccacaugggccuccacaag

SEQ ID NO: 504878 - RNA, 19 nt, Homo sapiens
ggagaauccagaaaucaag

SEQ ID NO: 504879 - RNA, 19 nt, Homo sapiens
cagugacuuugacgucuuu

SEQ ID NO: 504880 - RNA, 19 nt, Homo sapiens
caaaguacaccaaaauaga

SEQ ID NO: 504881 - RNA, 19 nt, Homo sapiens
acagcaaccuucucaucga

SEQ ID NO: 504882 - RNA, 19 nt, Homo sapiens
ucgaguacuuccgcaauga

SEQ ID NO: 504883 - RNA, 19 nt, Homo sapiens
gaggagcuggucuuagaga

SEQ ID NO: 504884 - RNA, 19 nt, Homo sapiens
ugaaccugcucaucuccaa

SEQ ID NO: 504885 - RNA, 19 nt, Homo sapiens
ccacuccauguuugcaaua

SEQ ID NO: 504886 - RNA, 19 nt, Homo sapiens
gggccuuuguuuccuuguu

SEQ ID NO: 504887 - RNA, 19 nt, Homo sapiens
guaaugugaaggcccaaga

SEQ ID NO: 504888 - RNA, 19 nt, Homo sapiens
cccagcagcccaagcuuaa

SEQ ID NO: 504889 - RNA, 19 nt, Homo sapiens
uguuugaucuacuucauag

SEQ ID NO: 504890 - RNA, 19 nt, Homo sapiens
caccauauuguuugaucua

SEQ ID NO: 504891 - RNA, 19 nt, Homo sapiens
ugacgucuuugcccacauc

SEQ ID NO: 504892 - RNA, 19 nt, Homo sapiens
cgacugccuucuccucucu

SEQ ID NO: 504893 - RNA, 19 nt, Homo sapiens
ggagacugaggcuuagaga

SEQ ID NO: 504894 - RNA, 19 nt, Homo sapiens
ccacccaccauauuguuug

SEQ ID NO: 504895 - RNA, 19 nt, Homo sapiens
gaccacccaccauauuguu

SEQ ID NO: 504896 - RNA, 19 nt, Homo sapiens
acaagcugguggugaacuu

SEQ ID NO: 504897 - RNA, 19 nt, Homo sapiens
ccuccaacccauuuaauca

SEQ ID NO: 504898 - RNA, 19 nt, Homo sapiens
gcagaagacgguggagauc

SEQ ID NO: 504899 - RNA, 19 nt, Homo sapiens
gauaucacccacaccuaca

SEQ ID NO: 504900 - RNA, 19 nt, Homo sapiens
gagaagagcgaaggaacgu

SEQ ID NO: 504901 - RNA, 19 nt, Homo sapiens
aagaugggauccuagacau

SEQ ID NO: 504902 - RNA, 19 nt, Homo sapiens
gauccucuccacuccaugu

SEQ ID NO: 504903 - RNA, 19 nt, Homo sapiens
ccagggauccagcuuugug

SEQ ID NO: 504904 - RNA, 19 nt, Homo sapiens
gcaccaaguaccugcucaa

SEQ ID NO: 504905 - RNA, 19 nt, Homo sapiens
uggcugacccugcacuuug

SEQ ID NO: 504906 - RNA, 19 nt, Homo sapiens
gcaaugaguuuggggagau

SEQ ID NO: 504907 - RNA, 19 nt, Homo sapiens
agaacauaccuuggaauuu

SEQ ID NO: 504908 - RNA, 19 nt, Homo sapiens
cacccaccauauuguuuga

SEQ ID NO: 504909 - RNA, 19 nt, Homo sapiens
uaugagaaauaccgugacu

SEQ ID NO: 504910 - RNA, 19 nt, Homo sapiens
ggccgaggagcuggucuua

SEQ ID NO: 504911 - RNA, 19 nt, Homo sapiens
gggccuccaacccauuuaa

SEQ ID NO: 504912 - RNA, 19 nt, Homo sapiens
caagggcgaaccaccugaa

SEQ ID NO: 504913 - RNA, 19 nt, Homo sapiens
uggguggagucguggauga

SEQ ID NO: 504914 - RNA, 19 nt, Homo sapiens
ugauugaaccugcucaucu

SEQ ID NO: 504915 - RNA, 19 nt, Homo sapiens
ggcgcugcuuccaggauaa

SEQ ID NO: 504916 - RNA, 19 nt, Homo sapiens
caacccauuuaaucaccau

SEQ ID NO: 504917 - RNA, 19 nt, Homo sapiens
cauccucuaugagaaauac

SEQ ID NO: 504918 - RNA, 19 nt, Homo sapiens
uaccagggcucggccaagu

SEQ ID NO: 504919 - RNA, 19 nt, Homo sapiens
caaguaccugcucaaccua

SEQ ID NO: 504920 - RNA, 19 nt, Homo sapiens
ccacugcuccauuuauaac

SEQ ID NO: 504921 - RNA, 19 nt, Homo sapiens
cccuggagccuuucucuga

SEQ ID NO: 504922 - RNA, 19 nt, Homo sapiens
gcccacaucaccaacaaca

SEQ ID NO: 504923 - RNA, 19 nt, Homo sapiens
gcgaaccaccugaacaaac

SEQ ID NO: 504924 - RNA, 19 nt, Homo sapiens
ugccugauccuucuagaug

SEQ ID NO: 504925 - RNA, 19 nt, Homo sapiens
aaacauggcugcucuagga

SEQ ID NO: 504926 - RNA, 19 nt, Homo sapiens
gaaggacucugccacaaug

SEQ ID NO: 504927 - RNA, 19 nt, Homo sapiens
caacucagcucaugacaca

SEQ ID NO: 504928 - RNA, 19 nt, Homo sapiens
gaauguggauagcgucuuu

SEQ ID NO: 504929 - RNA, 19 nt, Homo sapiens
gagagaagcuggucuagac

SEQ ID NO: 504930 - RNA, 19 nt, Homo sapiens
gaacaucccauaaagaucu

SEQ ID NO: 504931 - RNA, 19 nt, Homo sapiens
aaugaaggcugguuuguga

SEQ ID NO: 504932 - RNA, 19 nt, Homo sapiens
acacagcgcugcggucuuu

SEQ ID NO: 504933 - RNA, 19 nt, Homo sapiens
gguccacccuguccuauga

SEQ ID NO: 504934 - RNA, 19 nt, Homo sapiens
acaaaggccuuggcucuaa

SEQ ID NO: 504935 - RNA, 19 nt, Homo sapiens
gcaacaaguucccugcaau

SEQ ID NO: 504936 - RNA, 19 nt, Homo sapiens
gaacaggagcccagcauca

SEQ ID NO: 504937 - RNA, 19 nt, Homo sapiens
gcaaacaguggaagaauuc

SEQ ID NO: 504938 - RNA, 19 nt, Homo sapiens
ggccuuggcucuaacgaaa

SEQ ID NO: 504939 - RNA, 19 nt, Homo sapiens
ggcaaacaguggaagaauu

SEQ ID NO: 504940 - RNA, 19 nt, Homo sapiens
ggaauuggagcggcacuua

SEQ ID NO: 504941 - RNA, 19 nt, Homo sapiens
gaaagacaaguguuccaaa

SEQ ID NO: 504942 - RNA, 19 nt, Homo sapiens
caauagcaaugaugacaau

SEQ ID NO: 504943 - RNA, 19 nt, Homo sapiens
ccuaugacuugaucacuuu

SEQ ID NO: 504944 - RNA, 19 nt, Homo sapiens
caaguucccugcaaucaag

SEQ ID NO: 504945 - RNA, 19 nt, Homo sapiens
cgacaugcccuuuaucuuc

SEQ ID NO: 504946 - RNA, 19 nt, Homo sapiens
aaaccgaauuggcaugauu

SEQ ID NO: 504947 - RNA, 19 nt, Homo sapiens
gcagaacaucccauaaaga

SEQ ID NO: 504948 - RNA, 19 nt, Homo sapiens
caacaccacuggcaaacag

SEQ ID NO: 504949 - RNA, 19 nt, Homo sapiens
agaaggcucugaccaggaa

SEQ ID NO: 504950 - RNA, 19 nt, Homo sapiens
gaacuucgacaugcccuuu

SEQ ID NO: 504951 - RNA, 19 nt, Homo sapiens
gaaagacuggaguucauug

SEQ ID NO: 504952 - RNA, 19 nt, Homo sapiens
ucacggacaaguacaagua

SEQ ID NO: 504953 - RNA, 19 nt, Homo sapiens
gcauggacgucacggacaa

SEQ ID NO: 504954 - RNA, 19 nt, Homo sapiens
ggacaaggguagugauagc

SEQ ID NO: 504955 - RNA, 19 nt, Homo sapiens
aagcuggucuagacuguuu

SEQ ID NO: 504956 - RNA, 19 nt, Homo sapiens
cagaugcucuucuccaauc

SEQ ID NO: 504957 - RNA, 19 nt, Homo sapiens
cgaagacagugacagugaa

SEQ ID NO: 504958 - RNA, 19 nt, Homo sapiens
gcagguacaucagcaccaa

SEQ ID NO: 504959 - RNA, 19 nt, Homo sapiens
ucaccuggcuguacgacaa

SEQ ID NO: 504960 - RNA, 19 nt, Homo sapiens
aagaguauguucaggaaga

SEQ ID NO: 504961 - RNA, 19 nt, Homo sapiens
agaagaguauguucaggaa

SEQ ID NO: 504962 - RNA, 19 nt, Homo sapiens
ggcagaacaucccauaaag

SEQ ID NO: 504963 - RNA, 19 nt, Homo sapiens
gacaagcgcaucacacaga

SEQ ID NO: 504964 - RNA, 19 nt, Homo sapiens
gcagaaaugaccccaaaua

SEQ ID NO: 504965 - RNA, 19 nt, Homo sapiens
ggauaggagucugaauuuc

SEQ ID NO: 504966 - RNA, 19 nt, Homo sapiens
gcacucacacccuaacuca

SEQ ID NO: 504967 - RNA, 19 nt, Homo sapiens
guacaaacuuggacaacac

SEQ ID NO: 504968 - RNA, 19 nt, Homo sapiens
cagaacaucccauaaagau

SEQ ID NO: 504969 - RNA, 19 nt, Homo sapiens
gaagucagacaacaugauc

SEQ ID NO: 504970 - RNA, 19 nt, Homo sapiens
ugagugccaugaucaauag

SEQ ID NO: 504971 - RNA, 19 nt, Homo sapiens
ggaaggacucugccacaau

SEQ ID NO: 504972 - RNA, 19 nt, Homo sapiens
gcaucugccucucaaucuu

SEQ ID NO: 504973 - RNA, 19 nt, Homo sapiens
ggaagcacaaaccgaauug

SEQ ID NO: 504974 - RNA, 19 nt, Homo sapiens
caauggcccuccagaucuu

SEQ ID NO: 504975 - RNA, 19 nt, Homo sapiens
gggaaacccucuccaucuc

SEQ ID NO: 504976 - RNA, 19 nt, Homo sapiens
agaauuccgugaacaguca

SEQ ID NO: 504977 - RNA, 19 nt, Homo sapiens
uaaccaugcugagagagaa

SEQ ID NO: 504978 - RNA, 19 nt, Homo sapiens
ggcggcaucuccucuguga

SEQ ID NO: 504979 - RNA, 19 nt, Homo sapiens
cgacaacaccacuggcaaa

SEQ ID NO: 504980 - RNA, 19 nt, Homo sapiens
uuaaauaagugcgaucaca

SEQ ID NO: 504981 - RNA, 19 nt, Homo sapiens
agggagagcucaccaugga

SEQ ID NO: 504982 - RNA, 19 nt, Homo sapiens
gagcagggauacgaagaca

SEQ ID NO: 504983 - RNA, 19 nt, Homo sapiens
gugauagcguauggaauuu

SEQ ID NO: 504984 - RNA, 19 nt, Homo sapiens
gaucaccaacuucaacuca

SEQ ID NO: 504985 - RNA, 19 nt, Homo sapiens
gaagacauucucagcaucu

SEQ ID NO: 504986 - RNA, 19 nt, Homo sapiens
guggauagcgucuuuaugg

SEQ ID NO: 504987 - RNA, 19 nt, Homo sapiens
cggcaucuccucugugaaa

SEQ ID NO: 504988 - RNA, 19 nt, Homo sapiens
ggagagcucaccauggaau

SEQ ID NO: 504989 - RNA, 19 nt, Homo sapiens
gcagggauacgaagacagu

SEQ ID NO: 504990 - RNA, 19 nt, Homo sapiens
ggguaaccaugcugagaga

SEQ ID NO: 504991 - RNA, 19 nt, Homo sapiens
ggcaauacucugacuauca

SEQ ID NO: 504992 - RNA, 19 nt, Homo sapiens
ccacagcccugcucauucc

SEQ ID NO: 504993 - RNA, 19 nt, Homo sapiens
gaaugaaggcugguuugug

SEQ ID NO: 504994 - RNA, 19 nt, Homo sapiens
agugauagcguauggaauu

SEQ ID NO: 504995 - RNA, 19 nt, Homo sapiens
gggaagcacaaaccgaauu

SEQ ID NO: 504996 - RNA, 19 nt, Homo sapiens
ggagagaagcuggucuaga

SEQ ID NO: 504997 - RNA, 19 nt, Homo sapiens
ggacgucacggacaaguac

SEQ ID NO: 504998 - RNA, 19 nt, Homo sapiens
guagugauagcguauggaa

SEQ ID NO: 504999 - RNA, 19 nt, Homo sapiens
gauguggccagcagaaaug

SEQ ID NO: 505000 - RNA, 19 nt, Homo sapiens
gaagaauuccgugaacagu

SEQ ID NO: 505001 - RNA, 19 nt, Homo sapiens
uggauaggagucugaauuu

SEQ ID NO: 505002 - RNA, 19 nt, Homo sapiens
caacaaguucccugcaauc

SEQ ID NO: 505003 - RNA, 19 nt, Homo sapiens
ugugcaaggucccagauga

SEQ ID NO: 505004 - RNA, 19 nt, Homo sapiens
aaagacaaguguuccaaaa

SEQ ID NO: 505005 - RNA, 19 nt, Homo sapiens
uagaggagccugagaagag

SEQ ID NO: 505006 - RNA, 19 nt, Homo sapiens
gaaaugaccccaaauacgu

SEQ ID NO: 505007 - RNA, 19 nt, Homo sapiens
augauuggcuggaacuuug

SEQ ID NO: 505008 - RNA, 19 nt, Homo sapiens
ucucguacgcucaguauga

SEQ ID NO: 505009 - RNA, 19 nt, Homo sapiens
gcagaggaagggcgaaaca

SEQ ID NO: 505010 - RNA, 19 nt, Homo sapiens
ggaaugaaggcugguuugu

SEQ ID NO: 505011 - RNA, 19 nt, Homo sapiens
aaacuuccaggucuuaaug

SEQ ID NO: 505012 - RNA, 19 nt, Homo sapiens
acucacacccuaacucaaa

SEQ ID NO: 505013 - RNA, 19 nt, Homo sapiens
cgacuucuccugcaacaag

SEQ ID NO: 505014 - RNA, 19 nt, Homo sapiens
gaucucguacgcucaguau

SEQ ID NO: 505015 - RNA, 19 nt, Homo sapiens
aggcagaacaucccauaaa

SEQ ID NO: 505016 - RNA, 19 nt, Homo sapiens
gcucugaccaggaaagaca

SEQ ID NO: 505017 - RNA, 19 nt, Homo sapiens
cagcagaaaugaccccaaa

SEQ ID NO: 505018 - RNA, 19 nt, Homo sapiens
gaaacuugggacguucaua

SEQ ID NO: 505019 - RNA, 19 nt, Homo sapiens
caucuccucugugaaacuu

SEQ ID NO: 505020 - RNA, 19 nt, Homo sapiens
gcaaucaaggccauguugu

SEQ ID NO: 505021 - RNA, 19 nt, Homo sapiens
caacggcacgcuuguacau

SEQ ID NO: 505022 - RNA, 19 nt, Homo sapiens
uuccaggucuuaaugauca

SEQ ID NO: 505023 - RNA, 19 nt, Homo sapiens
gcagaugcucuucuccaau

SEQ ID NO: 505024 - RNA, 19 nt, Homo sapiens
cgaaagacuggaguucauu

SEQ ID NO: 505025 - RNA, 19 nt, Homo sapiens
ccaaucaccgucacaauaa

SEQ ID NO: 505026 - RNA, 19 nt, Homo sapiens
gaagguguuugagacguuu

SEQ ID NO: 505027 - RNA, 19 nt, Homo sapiens
caaucaccgucacaauaaa

SEQ ID NO: 505028 - RNA, 19 nt, Homo sapiens
ggaagcugauugcugagau

SEQ ID NO: 505029 - RNA, 19 nt, Homo sapiens
cccaaucaccgucacaaua

SEQ ID NO: 505030 - RNA, 19 nt, Homo sapiens
guacaccgccgaggagauu

SEQ ID NO: 505031 - RNA, 19 nt, Homo sapiens
gaagcugauugcugagauc

SEQ ID NO: 505032 - RNA, 19 nt, Homo sapiens
gagaucgccuuccaguaca

SEQ ID NO: 505033 - RNA, 19 nt, Homo sapiens
ugaagguguuugagacguu

SEQ ID NO: 505034 - RNA, 19 nt, Homo sapiens
uguccacgcugucaugguu

SEQ ID NO: 505035 - RNA, 19 nt, Homo sapiens
ugagaucgccuuccaguac

SEQ ID NO: 505036 - RNA, 19 nt, Homo sapiens
gagcugugaagguguuuga

SEQ ID NO: 505037 - RNA, 19 nt, Homo sapiens
gcaguucucgcaggacauu

SEQ ID NO: 505038 - RNA, 19 nt, Homo sapiens
gcaggcagaggccaucaug

SEQ ID NO: 505039 - RNA, 19 nt, Homo sapiens
guaccagucagucuacuuc

SEQ ID NO: 505040 - RNA, 19 nt, Homo sapiens
gcugugaagguguuugaga

SEQ ID NO: 505041 - RNA, 19 nt, Homo sapiens
cagucuacuucgugucuga

SEQ ID NO: 505042 - RNA, 19 nt, Homo sapiens
cguacacgcuggccaucga

SEQ ID NO: 505043 - RNA, 19 nt, Homo sapiens
ccuggaggccuuugcuuug

SEQ ID NO: 505044 - RNA, 19 nt, Homo sapiens
acccugaccuggacuugga

SEQ ID NO: 505045 - RNA, 19 nt, Homo sapiens
ucagugacgccaaggacaa

SEQ ID NO: 505046 - RNA, 19 nt, Homo sapiens
cggaugaggaaauugagaa

SEQ ID NO: 505047 - RNA, 19 nt, Homo sapiens
aaaagaaacuguggucucu

SEQ ID NO: 505048 - RNA, 19 nt, Homo sapiens
gaagcuguccacgcuguca

SEQ ID NO: 505049 - RNA, 19 nt, Homo sapiens
ggacguggaugacugcaua

SEQ ID NO: 505050 - RNA, 19 nt, Homo sapiens
ggaaguggcuguaacaugu

SEQ ID NO: 505051 - RNA, 19 nt, Homo sapiens
caccagauuugcuaauuua

SEQ ID NO: 505052 - RNA, 19 nt, Homo sapiens
caugggagcugguuagaaa

SEQ ID NO: 505053 - RNA, 19 nt, Homo sapiens
guacacagcucuagacacu

SEQ ID NO: 505054 - RNA, 19 nt, Homo sapiens
ccuggaggaugcccaauua

SEQ ID NO: 505055 - RNA, 19 nt, Homo sapiens
cuacuggucuuguggaauu

SEQ ID NO: 505056 - RNA, 19 nt, Homo sapiens
gaaaggaggaccaagagau

SEQ ID NO: 505057 - RNA, 19 nt, Homo sapiens
gggccaagauggaguacaa

SEQ ID NO: 505058 - RNA, 19 nt, Homo sapiens
gaacccagcaauccgagua

SEQ ID NO: 505059 - RNA, 19 nt, Homo sapiens
ucaccagauuugcuaauuu

SEQ ID NO: 505060 - RNA, 19 nt, Homo sapiens
ggacagucgucuuguuaca

SEQ ID NO: 505061 - RNA, 19 nt, Homo sapiens
gaaauccugcuucagugua

SEQ ID NO: 505062 - RNA, 19 nt, Homo sapiens
gggugugucugcucaguaa

SEQ ID NO: 505063 - RNA, 19 nt, Homo sapiens
acaaaggguugagauguaa

SEQ ID NO: 505064 - RNA, 19 nt, Homo sapiens
gagcagcagugcgaaguga

SEQ ID NO: 505065 - RNA, 19 nt, Homo sapiens
aacaaaggguugagaugua

SEQ ID NO: 505066 - RNA, 19 nt, Homo sapiens
gcacagcucuccggucucu

SEQ ID NO: 505067 - RNA, 19 nt, Homo sapiens
gacaacaacaccagcuaua

SEQ ID NO: 505068 - RNA, 19 nt, Homo sapiens
ugacaucacuuguacaaaa

SEQ ID NO: 505069 - RNA, 19 nt, Homo sapiens
ggagacaguucaagaaagc

SEQ ID NO: 505070 - RNA, 19 nt, Homo sapiens
aaacagugagccugaauuu

SEQ ID NO: 505071 - RNA, 19 nt, Homo sapiens
gaauuucuaccauuucaga

SEQ ID NO: 505072 - RNA, 19 nt, Homo sapiens
uuaaucagguccucagaga

SEQ ID NO: 505073 - RNA, 19 nt, Homo sapiens
gguaauuguugcuaaucuu

SEQ ID NO: 505074 - RNA, 19 nt, Homo sapiens
gcuucaaacugcaugauuc

SEQ ID NO: 505075 - RNA, 19 nt, Homo sapiens
ccaagucaggcccuuauuu

SEQ ID NO: 505076 - RNA, 19 nt, Homo sapiens
gaaguggcuguaacaugua

SEQ ID NO: 505077 - RNA, 19 nt, Homo sapiens
ucagaagguugcucuagau

SEQ ID NO: 505078 - RNA, 19 nt, Homo sapiens
gcaggagggugagcguuau

SEQ ID NO: 505079 - RNA, 19 nt, Homo sapiens
cauagaaauuacacccaaa

SEQ ID NO: 505080 - RNA, 19 nt, Homo sapiens
gaagcaagccccacuuauu

SEQ ID NO: 505081 - RNA, 19 nt, Homo sapiens
agacacagacugcgauuug

SEQ ID NO: 505082 - RNA, 19 nt, Homo sapiens
aaagaaaggaggaccaaga

SEQ ID NO: 505083 - RNA, 19 nt, Homo sapiens
ggacugucauagaaauuac

SEQ ID NO: 505084 - RNA, 19 nt, Homo sapiens
gcuggacugucauagaaau

SEQ ID NO: 505085 - RNA, 19 nt, Homo sapiens
gggcaaugauggcaauuuu

SEQ ID NO: 505086 - RNA, 19 nt, Homo sapiens
ccaggcacuuccuuccuuu

SEQ ID NO: 505087 - RNA, 19 nt, Homo sapiens
gcuuaugacaucacuugua

SEQ ID NO: 505088 - RNA, 19 nt, Homo sapiens
gcuuugcucuuugguagaa

SEQ ID NO: 505089 - RNA, 19 nt, Homo sapiens
gaagacacagacugcgauu

SEQ ID NO: 505090 - RNA, 19 nt, Homo sapiens
gucauuuccuugcuacuga

SEQ ID NO: 505091 - RNA, 19 nt, Homo sapiens
gcuguaacauguaugaaaa

SEQ ID NO: 505092 - RNA, 19 nt, Homo sapiens
uugcuggacugucauagaa

SEQ ID NO: 505093 - RNA, 19 nt, Homo sapiens
aaacaaaggguugagaugu

SEQ ID NO: 505094 - RNA, 19 nt, Homo sapiens
ccagacugcuuccaauuuu

SEQ ID NO: 505095 - RNA, 19 nt, Homo sapiens
ucaagaaagcuucaaacug

SEQ ID NO: 505096 - RNA, 19 nt, Homo sapiens
caggagacaguucaagaaa

SEQ ID NO: 505097 - RNA, 19 nt, Homo sapiens
ccaggagacaguucaagaa

SEQ ID NO: 505098 - RNA, 19 nt, Homo sapiens
ugauguugcuggacuguca

SEQ ID NO: 505099 - RNA, 19 nt, Homo sapiens
gaaugagccucggccucuu

SEQ ID NO: 505100 - RNA, 19 nt, Homo sapiens
uuguguagcuuugcucuuu

SEQ ID NO: 505101 - RNA, 19 nt, Homo sapiens
gguuagaaaugcagaaucc

SEQ ID NO: 505102 - RNA, 19 nt, Homo sapiens
caaacucccacuugucaug

SEQ ID NO: 505103 - RNA, 19 nt, Homo sapiens
gagacaacaacaccagcua

SEQ ID NO: 505104 - RNA, 19 nt, Homo sapiens
gcuaagcuaggaaugaaau

SEQ ID NO: 505105 - RNA, 19 nt, Homo sapiens
uaaacaaaggguugagaug

SEQ ID NO: 505106 - RNA, 19 nt, Homo sapiens
ugccugacccuacuucuuu

SEQ ID NO: 505107 - RNA, 19 nt, Homo sapiens
gcacggcucgaccucaaug

SEQ ID NO: 505108 - RNA, 19 nt, Homo sapiens
cgaugucauuuccuugcua

SEQ ID NO: 505109 - RNA, 19 nt, Homo sapiens
uugcuaaucuucuuaugca

SEQ ID NO: 505110 - RNA, 19 nt, Homo sapiens
uccuagcccucucacauuu

SEQ ID NO: 505111 - RNA, 19 nt, Homo sapiens
ccgcagcgcugugucaaca

SEQ ID NO: 505112 - RNA, 19 nt, Homo sapiens
gacugucacuguuccuugu

SEQ ID NO: 505113 - RNA, 19 nt, Homo sapiens
gaauuuuguugcuguuuug

SEQ ID NO: 505114 - RNA, 19 nt, Homo sapiens
cagauuugcuaauuuaucc

SEQ ID NO: 505115 - RNA, 19 nt, Homo sapiens
gacacagacugcgauuugu

SEQ ID NO: 505116 - RNA, 19 nt, Homo sapiens
cuuaugacaucacuuguac

SEQ ID NO: 505117 - RNA, 19 nt, Homo sapiens
gaacacaggcaaaauccuu

SEQ ID NO: 505118 - RNA, 19 nt, Homo sapiens
ggucuuugguucagcuaag

SEQ ID NO: 505119 - RNA, 19 nt, Homo sapiens
gaauugggagcuugggaau

SEQ ID NO: 505120 - RNA, 19 nt, Homo sapiens
guaauuguugcuaaucuuc

SEQ ID NO: 505121 - RNA, 19 nt, Homo sapiens
aaaggaggaccaagagaug

SEQ ID NO: 505122 - RNA, 19 nt, Homo sapiens
cuagcccucucacauuuau

SEQ ID NO: 505123 - RNA, 19 nt, Homo sapiens
gcauucgggcuugcucaua

SEQ ID NO: 505124 - RNA, 19 nt, Homo sapiens
gacaaagguuuuccucuuc

SEQ ID NO: 505125 - RNA, 19 nt, Homo sapiens
agacaaagguuuuccucuu

SEQ ID NO: 505126 - RNA, 19 nt, Homo sapiens
ugugucugcucaguaauuu

SEQ ID NO: 505127 - RNA, 19 nt, Homo sapiens
uuagaaaugcagaauccua

SEQ ID NO: 505128 - RNA, 19 nt, Homo sapiens
aaucagguccucagagaau

SEQ ID NO: 505129 - RNA, 19 nt, Homo sapiens
gcuaaucuucuuaugcaau

SEQ ID NO: 505130 - RNA, 19 nt, Homo sapiens
ugacagguaaacuaucuug

SEQ ID NO: 505131 - RNA, 19 nt, Homo sapiens
cauucgggcuugcucauag

SEQ ID NO: 505132 - RNA, 19 nt, Homo sapiens
uaugacaucacuuguacaa

SEQ ID NO: 505133 - RNA, 19 nt, Homo sapiens
cugcuucaguguauggaaa

SEQ ID NO: 505134 - RNA, 19 nt, Homo sapiens
ggcuguaacauguaugaaa

SEQ ID NO: 505135 - RNA, 19 nt, Homo sapiens
caagucaggcccuuauuuu

SEQ ID NO: 505136 - RNA, 19 nt, Homo sapiens
uaaacagugagccugaauu

SEQ ID NO: 505137 - RNA, 19 nt, Homo sapiens
agacagaaccccuacauga

SEQ ID NO: 505138 - RNA, 19 nt, Homo sapiens
aauccuugcuuaugacauc

SEQ ID NO: 505139 - RNA, 19 nt, Homo sapiens
gcuucaguguauggaaaua

SEQ ID NO: 505140 - RNA, 19 nt, Homo sapiens
aaauccugcuucaguguau

SEQ ID NO: 505141 - RNA, 19 nt, Homo sapiens
caaaauaaaaccagcucua

SEQ ID NO: 505142 - RNA, 19 nt, Homo sapiens
ugugacagguaaacuaucu

SEQ ID NO: 505143 - RNA, 19 nt, Homo sapiens
caugugacagguaaacuau

SEQ ID NO: 505144 - RNA, 19 nt, Homo sapiens
ucaugugacagguaaacua

SEQ ID NO: 505145 - RNA, 19 nt, Homo sapiens
caacaacaccagcuauagc

SEQ ID NO: 505146 - RNA, 19 nt, Homo sapiens
gaauguggccccugaacaa

SEQ ID NO: 505147 - RNA, 19 nt, Homo sapiens
uggacugucauagaaauua

SEQ ID NO: 505148 - RNA, 19 nt, Homo sapiens
gcgccuggguaacaugcuu

SEQ ID NO: 505149 - RNA, 19 nt, Homo sapiens
gcaaguaguugacauuuau

SEQ ID NO: 505150 - RNA, 19 nt, Homo sapiens
gaaagacuauugcuggauu

SEQ ID NO: 505151 - RNA, 19 nt, Homo sapiens
ggaaagaguuuaagugucu

SEQ ID NO: 505152 - RNA, 19 nt, Homo sapiens
ggaguucaguacagaaaua

SEQ ID NO: 505153 - RNA, 19 nt, Homo sapiens
ggaagaagcguaaagacua

SEQ ID NO: 505154 - RNA, 19 nt, Homo sapiens
ggaggacucacuagaauua

SEQ ID NO: 505155 - RNA, 19 nt, Homo sapiens
guacaaggaacaacaauaa

SEQ ID NO: 505156 - RNA, 19 nt, Homo sapiens
gaagaagcguaaagacuau

SEQ ID NO: 505157 - RNA, 19 nt, Homo sapiens
ggacugcguuggugaugua

SEQ ID NO: 505158 - RNA, 19 nt, Homo sapiens
acaaagaguuggccaauga

SEQ ID NO: 505159 - RNA, 19 nt, Homo sapiens
gaccaaagccugcaagaaa

SEQ ID NO: 505160 - RNA, 19 nt, Homo sapiens
guacagaaauaacgaggaa

SEQ ID NO: 505161 - RNA, 19 nt, Homo sapiens
ccaaagacggguuucauua

SEQ ID NO: 505162 - RNA, 19 nt, Homo sapiens
ggagauaccugugacaaca

SEQ ID NO: 505163 - RNA, 19 nt, Homo sapiens
ccaagcauauaaacaauug

SEQ ID NO: 505164 - RNA, 19 nt, Homo sapiens
gguauaccauugcuuuauu

SEQ ID NO: 505165 - RNA, 19 nt, Homo sapiens
ggagaucagugugacaauu

SEQ ID NO: 505166 - RNA, 19 nt, Homo sapiens
gcaacuaccugggccacua

SEQ ID NO: 505167 - RNA, 19 nt, Homo sapiens
ggaauuaguugguuaucca

SEQ ID NO: 505168 - RNA, 19 nt, Homo sapiens
cacauaggcuggaaagauu

SEQ ID NO: 505169 - RNA, 19 nt, Homo sapiens
gagagacacugauauggau

SEQ ID NO: 505170 - RNA, 19 nt, Homo sapiens
gagacgguauccucaauga

SEQ ID NO: 505171 - RNA, 19 nt, Homo sapiens
aauacugccuguagaguua

SEQ ID NO: 505172 - RNA, 19 nt, Homo sapiens
gcagagaaguauucccaau

SEQ ID NO: 505173 - RNA, 19 nt, Homo sapiens
ggaaaguguuugagagcaa

SEQ ID NO: 505174 - RNA, 19 nt, Homo sapiens
ggaagacuaugacaaggau

SEQ ID NO: 505175 - RNA, 19 nt, Homo sapiens
gaguggaccuccuguucua

SEQ ID NO: 505176 - RNA, 19 nt, Homo sapiens
gggcagccgugcuuauauu

SEQ ID NO: 505177 - RNA, 19 nt, Homo sapiens
guucuucucugaccugaaa

SEQ ID NO: 505178 - RNA, 19 nt, Homo sapiens
gauggcagcuggaaaugug

SEQ ID NO: 505179 - RNA, 19 nt, Homo sapiens
gaguuuaagugucuaacaa

SEQ ID NO: 505180 - RNA, 19 nt, Homo sapiens
agaucuggcugaaggauua

SEQ ID NO: 505181 - RNA, 19 nt, Homo sapiens
guugauagcugcacugagu

SEQ ID NO: 505182 - RNA, 19 nt, Homo sapiens
ggugaugccugcaaagaug

SEQ ID NO: 505183 - RNA, 19 nt, Homo sapiens
caacggaguucaguacaga

SEQ ID NO: 505184 - RNA, 19 nt, Homo sapiens
caaagugacugaagagaac

SEQ ID NO: 505185 - RNA, 19 nt, Homo sapiens
gcaaagugacugaagagaa

SEQ ID NO: 505186 - RNA, 19 nt, Homo sapiens
ggaagagcaucacccuguu

SEQ ID NO: 505187 - RNA, 19 nt, Homo sapiens
ggugaaacuuacauacaaa

SEQ ID NO: 505188 - RNA, 19 nt, Homo sapiens
gacuauccaugucaucuuu

SEQ ID NO: 505189 - RNA, 19 nt, Homo sapiens
gauggagaaugcugaguug

SEQ ID NO: 505190 - RNA, 19 nt, Homo sapiens
gaacuaugggcuugagaaa

SEQ ID NO: 505191 - RNA, 19 nt, Homo sapiens
gaaauacgaauguagagau

SEQ ID NO: 505192 - RNA, 19 nt, Homo sapiens
gaagauggccaccagaaca

SEQ ID NO: 505193 - RNA, 19 nt, Homo sapiens
gccaugaggucuucaauac

SEQ ID NO: 505194 - RNA, 19 nt, Homo sapiens
guagagaucccuaaucauc

SEQ ID NO: 505195 - RNA, 19 nt, Homo sapiens
gaccagagagacacugaua

SEQ ID NO: 505196 - RNA, 19 nt, Homo sapiens
acacggaccugccacauuc

SEQ ID NO: 505197 - RNA, 19 nt, Homo sapiens
ggaauggacuguugauagc

SEQ ID NO: 505198 - RNA, 19 nt, Homo sapiens
gaacaaagaguuggccaau

SEQ ID NO: 505199 - RNA, 19 nt, Homo sapiens
gccauugccuggucacauu

SEQ ID NO: 505200 - RNA, 19 nt, Homo sapiens
cgaaagggacgaugacuau

SEQ ID NO: 505201 - RNA, 19 nt, Homo sapiens
ugacaacaaucaggauauu

SEQ ID NO: 505202 - RNA, 19 nt, Homo sapiens
gaguggauguuaugggauu

SEQ ID NO: 505203 - RNA, 19 nt, Homo sapiens
aaauauggaggaacuguua

SEQ ID NO: 505204 - RNA, 19 nt, Homo sapiens
aaagacggguuucauuaga

SEQ ID NO: 505205 - RNA, 19 nt, Homo sapiens
gccaguacgucuacaaugu

SEQ ID NO: 505206 - RNA, 19 nt, Homo sapiens
uauaauguuugcacacuga

SEQ ID NO: 505207 - RNA, 19 nt, Homo sapiens
gcaagaacagcacaaggaa

SEQ ID NO: 505208 - RNA, 19 nt, Homo sapiens
gaaauugguggcuucauuc

SEQ ID NO: 505209 - RNA, 19 nt, Homo sapiens
uuagaguggugauguauga

SEQ ID NO: 505210 - RNA, 19 nt, Homo sapiens
ggagagcaccggugugaga

SEQ ID NO: 505211 - RNA, 19 nt, Homo sapiens
ccauguaaauaggcacuua

SEQ ID NO: 505212 - RNA, 19 nt, Homo sapiens
cgaugacuaugcuggauuu

SEQ ID NO: 505213 - RNA, 19 nt, Homo sapiens
gaagagcaucacccuguuu

SEQ ID NO: 505214 - RNA, 19 nt, Homo sapiens
caugaggucuucaauacug

SEQ ID NO: 505215 - RNA, 19 nt, Homo sapiens
gaagggaggacucacuaga

SEQ ID NO: 505216 - RNA, 19 nt, Homo sapiens
gaccugaaauacgaaugua

SEQ ID NO: 505217 - RNA, 19 nt, Homo sapiens
caggacccaucuaugauaa

SEQ ID NO: 505218 - RNA, 19 nt, Homo sapiens
cagcguguuugacaucuuu

SEQ ID NO: 505219 - RNA, 19 nt, Homo sapiens
gcaggaagacuaugacaag

SEQ ID NO: 505220 - RNA, 19 nt, Homo sapiens
gaaugugagguuugucuuu

SEQ ID NO: 505221 - RNA, 19 nt, Homo sapiens
gaaagaguuuaagugucua

SEQ ID NO: 505222 - RNA, 19 nt, Homo sapiens
uggaggaacuguuacaugu

SEQ ID NO: 505223 - RNA, 19 nt, Homo sapiens
gagaagggaggacucacua

SEQ ID NO: 505224 - RNA, 19 nt, Homo sapiens
ugacaaggauggaauuggu

SEQ ID NO: 505225 - RNA, 19 nt, Homo sapiens
gugcagauguagcaggaaa

SEQ ID NO: 505226 - RNA, 19 nt, Homo sapiens
gugacugaguaaagaauuu

SEQ ID NO: 505227 - RNA, 19 nt, Homo sapiens
ggaacaggaagaagcguaa

SEQ ID NO: 505228 - RNA, 19 nt, Homo sapiens
cuccuuggcuuccuucuuu

SEQ ID NO: 505229 - RNA, 19 nt, Homo sapiens
gaucccuaaucaucaaauu

SEQ ID NO: 505230 - RNA, 19 nt, Homo sapiens
agaacaaucuggacaacug

SEQ ID NO: 505231 - RNA, 19 nt, Homo sapiens
gagaucagugugacaauug

SEQ ID NO: 505232 - RNA, 19 nt, Homo sapiens
uaaagcaguguaaguugua

SEQ ID NO: 505233 - RNA, 19 nt, Homo sapiens
cuaaagcaguguaaguugu

SEQ ID NO: 505234 - RNA, 19 nt, Homo sapiens
gauguuaugggauuccuuu

SEQ ID NO: 505235 - RNA, 19 nt, Homo sapiens
gaaaaucagucuaauaagc

SEQ ID NO: 505236 - RNA, 19 nt, Homo sapiens
ucucugaccugaaauacga

SEQ ID NO: 505237 - RNA, 19 nt, Homo sapiens
gcaacaagaacgccaagug

SEQ ID NO: 505238 - RNA, 19 nt, Homo sapiens
gaucaagcggaaagaguuu

SEQ ID NO: 505239 - RNA, 19 nt, Homo sapiens
caaguggaauuaguugguu

SEQ ID NO: 505240 - RNA, 19 nt, Homo sapiens
cuucgugacuguaagauug

SEQ ID NO: 505241 - RNA, 19 nt, Homo sapiens
agauguagcuugugcagau

SEQ ID NO: 505242 - RNA, 19 nt, Homo sapiens
ccacgagggcucagggaua

SEQ ID NO: 505243 - RNA, 19 nt, Homo sapiens
gacagcauccgcaaaguga

SEQ ID NO: 505244 - RNA, 19 nt, Homo sapiens
gagcaaguaguugacauuu

SEQ ID NO: 505245 - RNA, 19 nt, Homo sapiens
gacuggcguuagcugauua

SEQ ID NO: 505246 - RNA, 19 nt, Homo sapiens
gcaucuacuugcuucaguu

SEQ ID NO: 505247 - RNA, 19 nt, Homo sapiens
ucauuagaguggugaugua

SEQ ID NO: 505248 - RNA, 19 nt, Homo sapiens
gaacucguccagacuguca

SEQ ID NO: 505249 - RNA, 19 nt, Homo sapiens
gaacaaacauccuugcaaa

SEQ ID NO: 505250 - RNA, 19 nt, Homo sapiens
gacauaagcuaccgauuaa

SEQ ID NO: 505251 - RNA, 19 nt, Homo sapiens
aaacaagggucaauucaaa

SEQ ID NO: 505252 - RNA, 19 nt, Homo sapiens
gcagagauauuuaaacaag

SEQ ID NO: 505253 - RNA, 19 nt, Homo sapiens
caacaggcauagcaaauga

SEQ ID NO: 505254 - RNA, 19 nt, Homo sapiens
uaaacgaacucuccucuug

SEQ ID NO: 505255 - RNA, 19 nt, Homo sapiens
ugacauaagcuaccgauua

SEQ ID NO: 505256 - RNA, 19 nt, Homo sapiens
gccaaagacuguaaauauu

SEQ ID NO: 505257 - RNA, 19 nt, Homo sapiens
gcaacuccauuuaccagua

SEQ ID NO: 505258 - RNA, 19 nt, Homo sapiens
ggugauauaugagacuuua

SEQ ID NO: 505259 - RNA, 19 nt, Homo sapiens
gcacaacccugcccagauc

SEQ ID NO: 505260 - RNA, 19 nt, Homo sapiens
gaacguccaccuaguguuu

SEQ ID NO: 505261 - RNA, 19 nt, Homo sapiens
gaacucuccucuuguccua

SEQ ID NO: 505262 - RNA, 19 nt, Homo sapiens
gaugauguguguccugaaa

SEQ ID NO: 505263 - RNA, 19 nt, Homo sapiens
gaagauauucuaagcaaga

SEQ ID NO: 505264 - RNA, 19 nt, Homo sapiens
uaacuaaucggaacaugua

SEQ ID NO: 505265 - RNA, 19 nt, Homo sapiens
gaucucaccuacuggauug

SEQ ID NO: 505266 - RNA, 19 nt, Homo sapiens
ggacuucaguggcacauuc

SEQ ID NO: 505267 - RNA, 19 nt, Homo sapiens
gggacgaugucuucaauga

SEQ ID NO: 505268 - RNA, 19 nt, Homo sapiens
ucaagagagugucgaauga

SEQ ID NO: 505269 - RNA, 19 nt, Homo sapiens
gaaaacgaaucagcauuua

SEQ ID NO: 505270 - RNA, 19 nt, Homo sapiens
gaaaauaugaggcuugaua

SEQ ID NO: 505271 - RNA, 19 nt, Homo sapiens
ccaguuuggugauauauga

SEQ ID NO: 505272 - RNA, 19 nt, Homo sapiens
gaaucagcauuuagucuug

SEQ ID NO: 505273 - RNA, 19 nt, Homo sapiens
ggugauauuuguaaagaug

SEQ ID NO: 505274 - RNA, 19 nt, Homo sapiens
ggaccuaucuaugaccaaa

SEQ ID NO: 505275 - RNA, 19 nt, Homo sapiens
gcguugggauacuucauua

SEQ ID NO: 505276 - RNA, 19 nt, Homo sapiens
cauuaagguuccaguuaua

SEQ ID NO: 505277 - RNA, 19 nt, Homo sapiens
gcuuaaaguugucacuauu

SEQ ID NO: 505278 - RNA, 19 nt, Homo sapiens
gaccuuaacucugaugguu

SEQ ID NO: 505279 - RNA, 19 nt, Homo sapiens
gcgagaaccucaagagagu

SEQ ID NO: 505280 - RNA, 19 nt, Homo sapiens
gcagaugaccucagcaaga

SEQ ID NO: 505281 - RNA, 19 nt, Homo sapiens
aaacaagauuugcugcauu

SEQ ID NO: 505282 - RNA, 19 nt, Homo sapiens
caaagggaccacccaaauu

SEQ ID NO: 505283 - RNA, 19 nt, Homo sapiens
uaacgcguaucuaggcuuu

SEQ ID NO: 505284 - RNA, 19 nt, Homo sapiens
caggagaagcggcauauaa

SEQ ID NO: 505285 - RNA, 19 nt, Homo sapiens
cgucagaugugcaacaaga

SEQ ID NO: 505286 - RNA, 19 nt, Homo sapiens
caguagagaugcaguuuca

SEQ ID NO: 505287 - RNA, 19 nt, Homo sapiens
gacuuuauguggagugaaa

SEQ ID NO: 505288 - RNA, 19 nt, Homo sapiens
aagagagugucgaaugaua

SEQ ID NO: 505289 - RNA, 19 nt, Homo sapiens
ucauuaagguuccaguuau

SEQ ID NO: 505290 - RNA, 19 nt, Homo sapiens
gaagacaacaggcauagca

SEQ ID NO: 505291 - RNA, 19 nt, Homo sapiens
ccaagugccuucagaggau

SEQ ID NO: 505292 - RNA, 19 nt, Homo sapiens
aacaagauuugcugcauuu

SEQ ID NO: 505293 - RNA, 19 nt, Homo sapiens
ucucagaccucaaguacga

SEQ ID NO: 505294 - RNA, 19 nt, Homo sapiens
agaccgacguggacaauga

SEQ ID NO: 505295 - RNA, 19 nt, Homo sapiens
gcaauggcacccacuguga

SEQ ID NO: 505296 - RNA, 19 nt, Homo sapiens
caaacauccuugcaaaugg

SEQ ID NO: 505297 - RNA, 19 nt, Homo sapiens
gacaacaucccagauauug

SEQ ID NO: 505298 - RNA, 19 nt, Homo sapiens
caacaacgaggacauagau

SEQ ID NO: 505299 - RNA, 19 nt, Homo sapiens
gcaggaagacuuugacaag

SEQ ID NO: 505300 - RNA, 19 nt, Homo sapiens
ccaauaaucagucaugugu

SEQ ID NO: 505301 - RNA, 19 nt, Homo sapiens
gacacgaccuucgaccuuu

SEQ ID NO: 505302 - RNA, 19 nt, Homo sapiens
guacgaaugcagagauauu

SEQ ID NO: 505303 - RNA, 19 nt, Homo sapiens
gcgaggagcugggaaacau

SEQ ID NO: 505304 - RNA, 19 nt, Homo sapiens
uggaagauauucuaagcaa

SEQ ID NO: 505305 - RNA, 19 nt, Homo sapiens
aauauuagguugucacgau

SEQ ID NO: 505306 - RNA, 19 nt, Homo sapiens
cuagacaccucaguucauu

SEQ ID NO: 505307 - RNA, 19 nt, Homo sapiens
guaacagaauacauagaga

SEQ ID NO: 505308 - RNA, 19 nt, Homo sapiens
gcucuacaaugacacacaa

SEQ ID NO: 505309 - RNA, 19 nt, Homo sapiens
gaacuacuuuuggugcuua

SEQ ID NO: 505310 - RNA, 19 nt, Homo sapiens
cgaaugcagagauauuuaa

SEQ ID NO: 505311 - RNA, 19 nt, Homo sapiens
caacaucccagauauugau

SEQ ID NO: 505312 - RNA, 19 nt, Homo sapiens
gcaguuucaucaaagaaca

SEQ ID NO: 505313 - RNA, 19 nt, Homo sapiens
guaaggagagauuagaaga

SEQ ID NO: 505314 - RNA, 19 nt, Homo sapiens
aaagggaccacccaaauug

SEQ ID NO: 505315 - RNA, 19 nt, Homo sapiens
ggacuuggacggugaugga

SEQ ID NO: 505316 - RNA, 19 nt, Homo sapiens
ucagcaagaucaccaagau

SEQ ID NO: 505317 - RNA, 19 nt, Homo sapiens
cagaugaccucagcaagau

SEQ ID NO: 505318 - RNA, 19 nt, Homo sapiens
aggcauagcaaaugacaua

SEQ ID NO: 505319 - RNA, 19 nt, Homo sapiens
ugccaaagacuguaaauau

SEQ ID NO: 505320 - RNA, 19 nt, Homo sapiens
guugaucguuguguuguuu

SEQ ID NO: 505321 - RNA, 19 nt, Homo sapiens
ccaaagggaccacccaaau

SEQ ID NO: 505322 - RNA, 19 nt, Homo sapiens
gcaaggacaagacacacaa

SEQ ID NO: 505323 - RNA, 19 nt, Homo sapiens
ggauguacguggccaaagg

SEQ ID NO: 505324 - RNA, 19 nt, Homo sapiens
uaagcuaccgauuaacuaa

SEQ ID NO: 505325 - RNA, 19 nt, Homo sapiens
gcacaggagaagcggcaua

SEQ ID NO: 505326 - RNA, 19 nt, Homo sapiens
uaaguugcaugaucuuucu

SEQ ID NO: 505327 - RNA, 19 nt, Homo sapiens
gagaauaaugaggaguuua

SEQ ID NO: 505328 - RNA, 19 nt, Homo sapiens
ggcaaaaccucauuuaagu

SEQ ID NO: 505329 - RNA, 19 nt, Homo sapiens
gaagggaauacugugcaua

SEQ ID NO: 505330 - RNA, 19 nt, Homo sapiens
caagugccuucagaggaua

SEQ ID NO: 505331 - RNA, 19 nt, Homo sapiens
uaaacaagauuugcugcau

SEQ ID NO: 505332 - RNA, 19 nt, Homo sapiens
caaccaggcugaccaugac

SEQ ID NO: 505333 - RNA, 19 nt, Homo sapiens
ugacaacaacgaggacaua

SEQ ID NO: 505334 - RNA, 19 nt, Homo sapiens
guaccugcaagaaauuuaa

SEQ ID NO: 505335 - RNA, 19 nt, Homo sapiens
aaauaugccuaguaacaca

SEQ ID NO: 505336 - RNA, 19 nt, Homo sapiens
gagacagacuucaggaacu

SEQ ID NO: 505337 - RNA, 19 nt, Homo sapiens
gaucgacacagacaacaau

SEQ ID NO: 505338 - RNA, 19 nt, Homo sapiens
ugaaccagcucagcgagaa

SEQ ID NO: 505339 - RNA, 19 nt, Homo sapiens
aaacgaaucagcauuuagu

SEQ ID NO: 505340 - RNA, 19 nt, Homo sapiens
ucaaagaacaaacauccuu

SEQ ID NO: 505341 - RNA, 19 nt, Homo sapiens
aaaguugucacuauucuug

SEQ ID NO: 505342 - RNA, 19 nt, Homo sapiens
aaacccaagugccuucaga

SEQ ID NO: 505343 - RNA, 19 nt, Homo sapiens
uaacucugaugguucuuca

SEQ ID NO: 505344 - RNA, 19 nt, Homo sapiens
acucaggaccuaucuauga

SEQ ID NO: 505345 - RNA, 19 nt, Homo sapiens
ucccagauauugaugaugu

SEQ ID NO: 505346 - RNA, 19 nt, Homo sapiens
acaaacauccuugcaaaug

SEQ ID NO: 505347 - RNA, 19 nt, Homo sapiens
uaaacaagggucaauucaa

SEQ ID NO: 505348 - RNA, 19 nt, Homo sapiens
ggaccagugugacaacaac

SEQ ID NO: 505349 - RNA, 19 nt, Homo sapiens
gcaaacaggucugcaauga

SEQ ID NO: 505350 - RNA, 19 nt, Homo sapiens
gcaaugacaucgaugaaug

SEQ ID NO: 505351 - RNA, 19 nt, Homo sapiens
gaacucagauacagauuca

SEQ ID NO: 505352 - RNA, 19 nt, Homo sapiens
gcaggaagaugcugauaau

SEQ ID NO: 505353 - RNA, 19 nt, Homo sapiens
gcacugcacuccauucuag

SEQ ID NO: 505354 - RNA, 19 nt, Homo sapiens
ggaagaugcugauaaugau

SEQ ID NO: 505355 - RNA, 19 nt, Homo sapiens
gcauggaaguguacgagua

SEQ ID NO: 505356 - RNA, 19 nt, Homo sapiens
ggacagaaggcguauuuga

SEQ ID NO: 505357 - RNA, 19 nt, Homo sapiens
gcccacagcugccaaauag

SEQ ID NO: 505358 - RNA, 19 nt, Homo sapiens
gcagggugguguccucuuu

SEQ ID NO: 505359 - RNA, 19 nt, Homo sapiens
gggaugggaucaagaaugu

SEQ ID NO: 505360 - RNA, 19 nt, Homo sapiens
aaacaggucugcaaugaca

SEQ ID NO: 505361 - RNA, 19 nt, Homo sapiens
acaaaguacuggugcgaua

SEQ ID NO: 505362 - RNA, 19 nt, Homo sapiens
gcucccagcuggacucuga

SEQ ID NO: 505363 - RNA, 19 nt, Homo sapiens
gaggaugacuuugacaaug

SEQ ID NO: 505364 - RNA, 19 nt, Homo sapiens
gacagcacauugccauaaa

SEQ ID NO: 505365 - RNA, 19 nt, Homo sapiens
uaauugaccugcugacugu

SEQ ID NO: 505366 - RNA, 19 nt, Homo sapiens
ccacauccaugcucacugu

SEQ ID NO: 505367 - RNA, 19 nt, Homo sapiens
ggacagacccacgaaaugu

SEQ ID NO: 505368 - RNA, 19 nt, Homo sapiens
ggugaugccugugacaauu

SEQ ID NO: 505369 - RNA, 19 nt, Homo sapiens
uaaaggaaaugucccugau

SEQ ID NO: 505370 - RNA, 19 nt, Homo sapiens
caggcuuucucuucaguua

SEQ ID NO: 505371 - RNA, 19 nt, Homo sapiens
gauuaggacuggacagaag

SEQ ID NO: 505372 - RNA, 19 nt, Homo sapiens
caaacugggugaccaacau

SEQ ID NO: 505373 - RNA, 19 nt, Homo sapiens
gcaauggcguuggugaugu

SEQ ID NO: 505374 - RNA, 19 nt, Homo sapiens
caacaacaaacacugcaaa

SEQ ID NO: 505375 - RNA, 19 nt, Homo sapiens
caaacuggguugugcucaa

SEQ ID NO: 505376 - RNA, 19 nt, Homo sapiens
ggaccagugugaugaugau

SEQ ID NO: 505377 - RNA, 19 nt, Homo sapiens
gcuggaggccucuguugua

SEQ ID NO: 505378 - RNA, 19 nt, Homo sapiens
gguccaaucuccaguaucg

SEQ ID NO: 505379 - RNA, 19 nt, Homo sapiens
ggauguguguccugaaagu

SEQ ID NO: 505380 - RNA, 19 nt, Homo sapiens
caacaaacacugcaaacag

SEQ ID NO: 505381 - RNA, 19 nt, Homo sapiens
gagaccagguaaaggaaau

SEQ ID NO: 505382 - RNA, 19 nt, Homo sapiens
ggaugucugugauacuaau

SEQ ID NO: 505383 - RNA, 19 nt, Homo sapiens
aaaugucccugauccgaaa

SEQ ID NO: 505384 - RNA, 19 nt, Homo sapiens
gagcaauccuacccagaca

SEQ ID NO: 505385 - RNA, 19 nt, Homo sapiens
gcagaacucagauacagau

SEQ ID NO: 505386 - RNA, 19 nt, Homo sapiens
aggaugacuuugacaauga

SEQ ID NO: 505387 - RNA, 19 nt, Homo sapiens
gcuggacucugauaacgau

SEQ ID NO: 505388 - RNA, 19 nt, Homo sapiens
gaugggaucaagaauguug

SEQ ID NO: 505389 - RNA, 19 nt, Homo sapiens
ggaggaggccaccagauuc

SEQ ID NO: 505390 - RNA, 19 nt, Homo sapiens
gacccuggcuuggcaguug

SEQ ID NO: 505391 - RNA, 19 nt, Homo sapiens
ugauaacgauggacuugga

SEQ ID NO: 505392 - RNA, 19 nt, Homo sapiens
cgacagcugcccugaaaug

SEQ ID NO: 505393 - RNA, 19 nt, Homo sapiens
gaaggacucagauggcaau

SEQ ID NO: 505394 - RNA, 19 nt, Homo sapiens
gaaggacacagauggcaau

SEQ ID NO: 505395 - RNA, 19 nt, Homo sapiens
cagcagaacucagauacag

SEQ ID NO: 505396 - RNA, 19 nt, Homo sapiens
aggaagaugcugauaauga

SEQ ID NO: 505397 - RNA, 19 nt, Homo sapiens
gauauacgagaccagguaa

SEQ ID NO: 505398 - RNA, 19 nt, Homo sapiens
ucgaugggcuggagauuag

SEQ ID NO: 505399 - RNA, 19 nt, Homo sapiens
ugacagcacauugccauaa

SEQ ID NO: 505400 - RNA, 19 nt, Homo sapiens
cacagugccugaggacuuu

SEQ ID NO: 505401 - RNA, 19 nt, Homo sapiens
ggucugcaaugacaucgau

SEQ ID NO: 505402 - RNA, 19 nt, Homo sapiens
gucaggaucugcagguaau

SEQ ID NO: 505403 - RNA, 19 nt, Homo sapiens
gaaaucguucagaccauga

SEQ ID NO: 505404 - RNA, 19 nt, Homo sapiens
ggacucugauaacgaugga

SEQ ID NO: 505405 - RNA, 19 nt, Homo sapiens
ugcgacagcugcccugaaa

SEQ ID NO: 505406 - RNA, 19 nt, Homo sapiens
aaacaggacaacugccuuu

SEQ ID NO: 505407 - RNA, 19 nt, Homo sapiens
ccaacacugugggcucuuu

SEQ ID NO: 505408 - RNA, 19 nt, Homo sapiens
uaggcaagaucaacaaagu

SEQ ID NO: 505409 - RNA, 19 nt, Homo sapiens
ggacaucuaccucuuaucc

SEQ ID NO: 505410 - RNA, 19 nt, Homo sapiens
ggacaauugcccuaaaguc

SEQ ID NO: 505411 - RNA, 19 nt, Homo sapiens
caacaaagaccagcagaac

SEQ ID NO: 505412 - RNA, 19 nt, Homo sapiens
caguaucgaugcaaugaca

SEQ ID NO: 505413 - RNA, 19 nt, Homo sapiens
gcaauccuacccagacaga

SEQ ID NO: 505414 - RNA, 19 nt, Homo sapiens
ccaacguucccaacaauga

SEQ ID NO: 505415 - RNA, 19 nt, Homo sapiens
ucaaggcagugacaucagu

SEQ ID NO: 505416 - RNA, 19 nt, Homo sapiens
ggaugacuuugacaaugau

SEQ ID NO: 505417 - RNA, 19 nt, Homo sapiens
gaagaugcugauaaugaug

SEQ ID NO: 505418 - RNA, 19 nt, Homo sapiens
ggcaggaagaugcugauaa

SEQ ID NO: 505419 - RNA, 19 nt, Homo sapiens
caugcucacugucucuuug

SEQ ID NO: 505420 - RNA, 19 nt, Homo sapiens
ggagcugcgggaugauaua

SEQ ID NO: 505421 - RNA, 19 nt, Homo sapiens
gagauuaggacuggacaga

SEQ ID NO: 505422 - RNA, 19 nt, Homo sapiens
ccaaucagaaggacucaga

SEQ ID NO: 505423 - RNA, 19 nt, Homo sapiens
gaccagcagaacucagaua

SEQ ID NO: 505424 - RNA, 19 nt, Homo sapiens
gcaacgauggcaacaaugg

SEQ ID NO: 505425 - RNA, 19 nt, Homo sapiens
gcgggaggauggcaaaguc

SEQ ID NO: 505426 - RNA, 19 nt, Homo sapiens
ucagauacagauucauuug

SEQ ID NO: 505427 - RNA, 19 nt, Homo sapiens
ggacaacugccggcuguuc

SEQ ID NO: 505428 - RNA, 19 nt, Homo sapiens
gagugaguguccauuccaa

SEQ ID NO: 505429 - RNA, 19 nt, Homo sapiens
gaggaggccaccagauuca

SEQ ID NO: 505430 - RNA, 19 nt, Homo sapiens
caauggcguuggugaugug

SEQ ID NO: 505431 - RNA, 19 nt, Homo sapiens
gcauggacaacaacaaaca

SEQ ID NO: 505432 - RNA, 19 nt, Homo sapiens
ggacugacacagacaucga

SEQ ID NO: 505433 - RNA, 19 nt, Homo sapiens
gcucaaggcagugacauca

SEQ ID NO: 505434 - RNA, 19 nt, Homo sapiens
gauacacggccuucaaugg

SEQ ID NO: 505435 - RNA, 19 nt, Homo sapiens
ccaacccacuacagacaga

SEQ ID NO: 505436 - RNA, 19 nt, Homo sapiens
gggaaggagaugccuguga

SEQ ID NO: 505437 - RNA, 19 nt, Homo sapiens
gcaacaaugguggcuguga

SEQ ID NO: 505438 - RNA, 19 nt, Homo sapiens
ugauauacgagaccaggua

SEQ ID NO: 505439 - RNA, 19 nt, Homo sapiens
gcugcgggaugauauacga

SEQ ID NO: 505440 - RNA, 19 nt, Homo sapiens
gcccugcccuacaucucua

SEQ ID NO: 505441 - RNA, 19 nt, Homo sapiens
cuucaaugguguggacuuu

SEQ ID NO: 505442 - RNA, 19 nt, Homo sapiens
cuggauguguguccugaaa

SEQ ID NO: 505443 - RNA, 19 nt, Homo sapiens
agauacagauucauuuggu

SEQ ID NO: 505444 - RNA, 19 nt, Homo sapiens
caggacaacugccuuuuga

SEQ ID NO: 505445 - RNA, 19 nt, Homo sapiens
caagaucaacaaaguacug

SEQ ID NO: 505446 - RNA, 19 nt, Homo sapiens
caaacuccaucugcaccaa

SEQ ID NO: 505447 - RNA, 19 nt, Homo sapiens
gauccgaaacaccauuaug

SEQ ID NO: 505448 - RNA, 19 nt, Homo sapiens
gacagaaggcguauuugag

SEQ ID NO: 505449 - RNA, 19 nt, Homo sapiens
gcaaauaugugccaaauuc

SEQ ID NO: 505450 - RNA, 19 nt, Homo sapiens
gagaugggauccugaauga

SEQ ID NO: 505451 - RNA, 19 nt, Homo sapiens
gaaacgggaucaccuguau

SEQ ID NO: 505452 - RNA, 19 nt, Homo sapiens
gaaagaaacugcagaaacc

SEQ ID NO: 505453 - RNA, 19 nt, Homo sapiens
ccaagaagaugcagacaga

SEQ ID NO: 505454 - RNA, 19 nt, Homo sapiens
gcaaauaccaucccugcua

SEQ ID NO: 505455 - RNA, 19 nt, Homo sapiens
ccagacagaugaugacuau

SEQ ID NO: 505456 - RNA, 19 nt, Homo sapiens
ggauaacuguguccugauu

SEQ ID NO: 505457 - RNA, 19 nt, Homo sapiens
ggacaaggauggugauggu

SEQ ID NO: 505458 - RNA, 19 nt, Homo sapiens
ucaaggcugugaagucuaa

SEQ ID NO: 505459 - RNA, 19 nt, Homo sapiens
gaugcaaaguggaaagaaa

SEQ ID NO: 505460 - RNA, 19 nt, Homo sapiens
ggagaugccugugaugaug

SEQ ID NO: 505461 - RNA, 19 nt, Homo sapiens
ccagaaaccugagaccauu

SEQ ID NO: 505462 - RNA, 19 nt, Homo sapiens
gaaacaccauagcugaaug

SEQ ID NO: 505463 - RNA, 19 nt, Homo sapiens
ugaaugaucucuaugugau

SEQ ID NO: 505464 - RNA, 19 nt, Homo sapiens
ggauggagauggaauaaaa

SEQ ID NO: 505465 - RNA, 19 nt, Homo sapiens
ugacauggauggagaugga

SEQ ID NO: 505466 - RNA, 19 nt, Homo sapiens
guauacuggugaucagaua

SEQ ID NO: 505467 - RNA, 19 nt, Homo sapiens
agacggagcagacauauug

SEQ ID NO: 505468 - RNA, 19 nt, Homo sapiens
guacacagcuuuuaaugga

SEQ ID NO: 505469 - RNA, 19 nt, Homo sapiens
gaucugcguuaauacuuug

SEQ ID NO: 505470 - RNA, 19 nt, Homo sapiens
gaaggugcauuuggugguu

SEQ ID NO: 505471 - RNA, 19 nt, Homo sapiens
uaauggaguugacuucgaa

SEQ ID NO: 505472 - RNA, 19 nt, Homo sapiens
gaagaggagaugccuguga

SEQ ID NO: 505473 - RNA, 19 nt, Homo sapiens
ggaaagaaacugcagaaac

SEQ ID NO: 505474 - RNA, 19 nt, Homo sapiens
agucugauguggauaauga

SEQ ID NO: 505475 - RNA, 19 nt, Homo sapiens
uaaauaacgaccagaaaga

SEQ ID NO: 505476 - RNA, 19 nt, Homo sapiens
ccaaggaagcaaucuguaa

SEQ ID NO: 505477 - RNA, 19 nt, Homo sapiens
gcagaaacccagagcugaa

SEQ ID NO: 505478 - RNA, 19 nt, Homo sapiens
ccuucaagcugcagacuaa

SEQ ID NO: 505479 - RNA, 19 nt, Homo sapiens
ggucugcacugacauugau

SEQ ID NO: 505480 - RNA, 19 nt, Homo sapiens
gcucaaggcugugaagucu

SEQ ID NO: 505481 - RNA, 19 nt, Homo sapiens
ggacaacugcccaaaauuu

SEQ ID NO: 505482 - RNA, 19 nt, Homo sapiens
uaaccagucugauguggau

SEQ ID NO: 505483 - RNA, 19 nt, Homo sapiens
gccugagugucuuaaauaa

SEQ ID NO: 505484 - RNA, 19 nt, Homo sapiens
gaccaaaggaacagcgaua

SEQ ID NO: 505485 - RNA, 19 nt, Homo sapiens
ggaaacgggaucaccugua

SEQ ID NO: 505486 - RNA, 19 nt, Homo sapiens
uaaaggagaagagaucauu

SEQ ID NO: 505487 - RNA, 19 nt, Homo sapiens
gguccaaccucaaguaucg

SEQ ID NO: 505488 - RNA, 19 nt, Homo sapiens
ggagaugggauccugaaug

SEQ ID NO: 505489 - RNA, 19 nt, Homo sapiens
aaggacaacugcaaauaug

SEQ ID NO: 505490 - RNA, 19 nt, Homo sapiens
ggacuccugugacaccaau

SEQ ID NO: 505491 - RNA, 19 nt, Homo sapiens
ccaacucgaucugcguuaa

SEQ ID NO: 505492 - RNA, 19 nt, Homo sapiens
ggucuuuacucuucaacug

SEQ ID NO: 505493 - RNA, 19 nt, Homo sapiens
uaugcaggcuuuaucuuug

SEQ ID NO: 505494 - RNA, 19 nt, Homo sapiens
ugaaugagcaggauaacug

SEQ ID NO: 505495 - RNA, 19 nt, Homo sapiens
cgaucugcguuaauacuuu

SEQ ID NO: 505496 - RNA, 19 nt, Homo sapiens
ucaaguaucgcugcaauga

SEQ ID NO: 505497 - RNA, 19 nt, Homo sapiens
ggacaacugcaaauaugug

SEQ ID NO: 505498 - RNA, 19 nt, Homo sapiens
ucaccuguauugauguuga

SEQ ID NO: 505499 - RNA, 19 nt, Homo sapiens
caucuucggucuuuacucu

SEQ ID NO: 505500 - RNA, 19 nt, Homo sapiens
ggacaccgauaaggaugga

SEQ ID NO: 505501 - RNA, 19 nt, Homo sapiens
caauaaaggagaagagauc

SEQ ID NO: 505502 - RNA, 19 nt, Homo sapiens
ccaaaggaacagcgauaaa

SEQ ID NO: 505503 - RNA, 19 nt, Homo sapiens
ccauugaauugaggacuuu

SEQ ID NO: 505504 - RNA, 19 nt, Homo sapiens
ugaauacccagacagauga

SEQ ID NO: 505505 - RNA, 19 nt, Homo sapiens
gagauuguacagaccauga

SEQ ID NO: 505506 - RNA, 19 nt, Homo sapiens
ccaacugggugguccugaa

SEQ ID NO: 505507 - RNA, 19 nt, Homo sapiens
gaggagaugccugugauga

SEQ ID NO: 505508 - RNA, 19 nt, Homo sapiens
gacagcagguuaaggaaac

SEQ ID NO: 505509 - RNA, 19 nt, Homo sapiens
cuacaucaggguacgauuu

SEQ ID NO: 505510 - RNA, 19 nt, Homo sapiens
gugaauacccagacagaug

SEQ ID NO: 505511 - RNA, 19 nt, Homo sapiens
ggaacagcgauaaagauau

SEQ ID NO: 505512 - RNA, 19 nt, Homo sapiens
caaaggaacagcgauaaag

SEQ ID NO: 505513 - RNA, 19 nt, Homo sapiens
gaagaugcagacagagaug

SEQ ID NO: 505514 - RNA, 19 nt, Homo sapiens
aaaggacaacugcaaauau

SEQ ID NO: 505515 - RNA, 19 nt, Homo sapiens
ugagacagcagguuaagga

SEQ ID NO: 505516 - RNA, 19 nt, Homo sapiens
ugaugacuaugcaggcuuu

SEQ ID NO: 505517 - RNA, 19 nt, Homo sapiens
ugaccgacuucagggcuua

SEQ ID NO: 505518 - RNA, 19 nt, Homo sapiens
ugacgagugugaugaugau

SEQ ID NO: 505519 - RNA, 19 nt, Homo sapiens
gaauuggugacgaguguga

SEQ ID NO: 505520 - RNA, 19 nt, Homo sapiens
cgauaaggauggaauuggu

SEQ ID NO: 505521 - RNA, 19 nt, Homo sapiens
gcgguccucucaaguuuca

SEQ ID NO: 505522 - RNA, 19 nt, Homo sapiens
gcaauaaaggagaagagau

SEQ ID NO: 505523 - RNA, 19 nt, Homo sapiens
uacagaccaugaacaguga

SEQ ID NO: 505524 - RNA, 19 nt, Homo sapiens
cagcaacccuaaccagucu

SEQ ID NO: 505525 - RNA, 19 nt, Homo sapiens
cgaggaugcugacggagau

SEQ ID NO: 505526 - RNA, 19 nt, Homo sapiens
gccaccaucuucggucuuu

SEQ ID NO: 505527 - RNA, 19 nt, Homo sapiens
ggaaggacuccaggaaugu

SEQ ID NO: 505528 - RNA, 19 nt, Homo sapiens
aggaacagcgauaaagaua

SEQ ID NO: 505529 - RNA, 19 nt, Homo sapiens
aaaggaacagcgauaaaga

SEQ ID NO: 505530 - RNA, 19 nt, Homo sapiens
aaguaucgcugcaaugaca

SEQ ID NO: 505531 - RNA, 19 nt, Homo sapiens
gaaccagggcauggagauu

SEQ ID NO: 505532 - RNA, 19 nt, Homo sapiens
uaacugccugagugucuua

SEQ ID NO: 505533 - RNA, 19 nt, Homo sapiens
guuaauacuuugggaucuu

SEQ ID NO: 505534 - RNA, 19 nt, Homo sapiens
gagcgugcguucccaacuc

SEQ ID NO: 505535 - RNA, 19 nt, Homo sapiens
gaugaugacaaugauggua

SEQ ID NO: 505536 - RNA, 19 nt, Homo sapiens
cgagugugaugaugaugau

SEQ ID NO: 505537 - RNA, 19 nt, Homo sapiens
gcucugccaggaacuguaa

SEQ ID NO: 505538 - RNA, 19 nt, Homo sapiens
gcgaaacaccauagcugaa

SEQ ID NO: 505539 - RNA, 19 nt, Homo sapiens
ccugaggacuuccaagagu

SEQ ID NO: 505540 - RNA, 19 nt, Homo sapiens
ccucaaguaucgcugcaau

SEQ ID NO: 505541 - RNA, 19 nt, Homo sapiens
cuaugcaggcuuuaucuuu

SEQ ID NO: 505542 - RNA, 19 nt, Homo sapiens
gacagaugaugacuaugca

SEQ ID NO: 505543 - RNA, 19 nt, Homo sapiens
gaaugaucucuaugugauu

SEQ ID NO: 505544 - RNA, 19 nt, Homo sapiens
gauaacugccugagugucu

SEQ ID NO: 505545 - RNA, 19 nt, Homo sapiens
acuguguccugauucauaa

SEQ ID NO: 505546 - RNA, 19 nt, Homo sapiens
gguuaaggaaacaucauuu

SEQ ID NO: 505547 - RNA, 19 nt, Homo sapiens
caccaucccugaggacuuc

SEQ ID NO: 505548 - RNA, 19 nt, Homo sapiens
aagaggagaugccugugau

SEQ ID NO: 505549 - RNA, 19 nt, Homo sapiens
gaaggaagcugcucagaau

SEQ ID NO: 505550 - RNA, 19 nt, Homo sapiens
gaaccuaaauugaucauug

SEQ ID NO: 505551 - RNA, 19 nt, Homo sapiens
ggaaaacucucugauauua

SEQ ID NO: 505552 - RNA, 19 nt, Homo sapiens
guaauaggaugauuugaga

SEQ ID NO: 505553 - RNA, 19 nt, Homo sapiens
aaacucaacuccacuuaaa

SEQ ID NO: 505554 - RNA, 19 nt, Homo sapiens
uaagugauguugccaauau

SEQ ID NO: 505555 - RNA, 19 nt, Homo sapiens
gcagaaacgucgccaggaa

SEQ ID NO: 505556 - RNA, 19 nt, Homo sapiens
ugaaauaauuggacuguga

SEQ ID NO: 505557 - RNA, 19 nt, Homo sapiens
uaacaagguuuacugcaaa

SEQ ID NO: 505558 - RNA, 19 nt, Homo sapiens
caaaguggcucaagcuugu

SEQ ID NO: 505559 - RNA, 19 nt, Homo sapiens
cacauaaucucaugaagaa

SEQ ID NO: 505560 - RNA, 19 nt, Homo sapiens
gaacagcugcgccaagaaa

SEQ ID NO: 505561 - RNA, 19 nt, Homo sapiens
caacgaauuccuccuauuu

SEQ ID NO: 505562 - RNA, 19 nt, Homo sapiens
gcaaaggucacgaaacuga

SEQ ID NO: 505563 - RNA, 19 nt, Homo sapiens
aagaauagguuuagcuuug

SEQ ID NO: 505564 - RNA, 19 nt, Homo sapiens
aaacagcauuucauccuuu

SEQ ID NO: 505565 - RNA, 19 nt, Homo sapiens
gaacagcugcuccaggaaa

SEQ ID NO: 505566 - RNA, 19 nt, Homo sapiens
gaacagcugcuccaggaaa

SEQ ID NO: 505567 - RNA, 19 nt, Homo sapiens
gaacagcugcuccaggaaa

SEQ ID NO: 505568 - RNA, 19 nt, Homo sapiens
gaagagaaggcgccaagaa

SEQ ID NO: 505569 - RNA, 19 nt, Homo sapiens
guaaugggcgugucgauuu

SEQ ID NO: 505570 - RNA, 19 nt, Homo sapiens
aaacaucugucuuacucua

SEQ ID NO: 505571 - RNA, 19 nt, Homo sapiens
gauguggugugcauuuaaa

SEQ ID NO: 505572 - RNA, 19 nt, Homo sapiens
gaagagucgucgugaggaa

SEQ ID NO: 505573 - RNA, 19 nt, Homo sapiens
gcagagagaaugaacaguu

SEQ ID NO: 505574 - RNA, 19 nt, Homo sapiens
ugaagaaccuccuugaaag

SEQ ID NO: 505575 - RNA, 19 nt, Homo sapiens
gagcagcauuaacuaagaa

SEQ ID NO: 505576 - RNA, 19 nt, Homo sapiens
ggagcagcauuaacuaaga

SEQ ID NO: 505577 - RNA, 19 nt, Homo sapiens
ugaagaaccuccuugaaag

SEQ ID NO: 505578 - RNA, 19 nt, Homo sapiens
gagcagcauuaacuaagaa

SEQ ID NO: 505579 - RNA, 19 nt, Homo sapiens
ggagcagcauuaacuaaga

SEQ ID NO: 505580 - RNA, 19 nt, Homo sapiens
gaaaggagagccuguuaca

SEQ ID NO: 505581 - RNA, 19 nt, Homo sapiens
uagcacaaauuccagguaa

SEQ ID NO: 505582 - RNA, 19 nt, Homo sapiens
gagaaacacuggguaccaa

SEQ ID NO: 505583 - RNA, 19 nt, Homo sapiens
gaaaguaucgcugggaaga

SEQ ID NO: 505584 - RNA, 19 nt, Homo sapiens
ggaaagagaagagaagaga

SEQ ID NO: 505585 - RNA, 19 nt, Homo sapiens
aauaagagaucacauagag

SEQ ID NO: 505586 - RNA, 19 nt, Homo sapiens
gaauagguuuagcuuugaa

SEQ ID NO: 505587 - RNA, 19 nt, Homo sapiens
caguaugucucucaugauu

SEQ ID NO: 505588 - RNA, 19 nt, Homo sapiens
caguaugucucucaugauu

SEQ ID NO: 505589 - RNA, 19 nt, Homo sapiens
gccaagagcgugacagaaa

SEQ ID NO: 505590 - RNA, 19 nt, Homo sapiens
gccaagagcgugacagaaa

SEQ ID NO: 505591 - RNA, 19 nt, Homo sapiens
gccaagagcgugacagaaa

SEQ ID NO: 505592 - RNA, 19 nt, Homo sapiens
gccaagagcgugacagaaa

SEQ ID NO: 505593 - RNA, 19 nt, Homo sapiens
gccaagagcgugacagaaa

SEQ ID NO: 505594 - RNA, 19 nt, Homo sapiens
gccaagagcgugacagaaa

SEQ ID NO: 505595 - RNA, 19 nt, Homo sapiens
gccaagagcgugacagaaa

SEQ ID NO: 505596 - RNA, 19 nt, Homo sapiens
gaaggaagaagagaaguug

SEQ ID NO: 505597 - RNA, 19 nt, Homo sapiens
acagacaacuggaagaaga

SEQ ID NO: 505598 - RNA, 19 nt, Homo sapiens
gcagauguggugugcauuu

SEQ ID NO: 505599 - RNA, 19 nt, Homo sapiens
caagaacuauggcaagaag

SEQ ID NO: 505600 - RNA, 19 nt, Homo sapiens
aagagcagcugcagaguug

SEQ ID NO: 505601 - RNA, 19 nt, Homo sapiens
gaagagcagcugcagaguu

SEQ ID NO: 505602 - RNA, 19 nt, Homo sapiens
gaaauaauuggacugugaa

SEQ ID NO: 505603 - RNA, 19 nt, Homo sapiens
gccaauaagagaucacaua

SEQ ID NO: 505604 - RNA, 19 nt, Homo sapiens
gcaagaagaggagcagaaa

SEQ ID NO: 505605 - RNA, 19 nt, Homo sapiens
agagagagaucgugagcaa

SEQ ID NO: 505606 - RNA, 19 nt, Homo sapiens
gcaaaggcagagagaauga

SEQ ID NO: 505607 - RNA, 19 nt, Homo sapiens
cagauguggugugcauuua

SEQ ID NO: 505608 - RNA, 19 nt, Homo sapiens
gagcagagaucucaauacc

SEQ ID NO: 505609 - RNA, 19 nt, Homo sapiens
guaugucucucaugauugu

SEQ ID NO: 505610 - RNA, 19 nt, Homo sapiens
guaugucucucaugauugu

SEQ ID NO: 505611 - RNA, 19 nt, Homo sapiens
caacuccacuuaaacacau

SEQ ID NO: 505612 - RNA, 19 nt, Homo sapiens
agugauaacucagauguuu

SEQ ID NO: 505613 - RNA, 19 nt, Homo sapiens
ggacagacaacuggaagaa

SEQ ID NO: 505614 - RNA, 19 nt, Homo sapiens
gaagaagaccaaaggagau

SEQ ID NO: 505615 - RNA, 19 nt, Homo sapiens
caaacagcauuucauccuu

SEQ ID NO: 505616 - RNA, 19 nt, Homo sapiens
caauaccgcccuuaaguga

SEQ ID NO: 505617 - RNA, 19 nt, Homo sapiens
aagaggaacugcuccauca

SEQ ID NO: 505618 - RNA, 19 nt, Homo sapiens
gaaaaugcaguucgugaua

SEQ ID NO: 505619 - RNA, 19 nt, Homo sapiens
gaggagcuguggcggcaaa

SEQ ID NO: 505620 - RNA, 19 nt, Homo sapiens
gccaagaacgcuacagaaa

SEQ ID NO: 505621 - RNA, 19 nt, Homo sapiens
ggaaggaagaagagaaguu

SEQ ID NO: 505622 - RNA, 19 nt, Homo sapiens
ggagcaaagugagaaacaa

SEQ ID NO: 505623 - RNA, 19 nt, Homo sapiens
cauuugaggccuauugaua

SEQ ID NO: 505624 - RNA, 19 nt, Homo sapiens
gaacauaggggcaaauuuc

SEQ ID NO: 505625 - RNA, 19 nt, Homo sapiens
cccauaaacaucugucuua

SEQ ID NO: 505626 - RNA, 19 nt, Homo sapiens
gcagauacuuuuaauguuc

SEQ ID NO: 505627 - RNA, 19 nt, Homo sapiens
gaaguaacaagaguaauag

SEQ ID NO: 505628 - RNA, 19 nt, Homo sapiens
ggaacgggaaaggaaauua

SEQ ID NO: 505629 - RNA, 19 nt, Homo sapiens
gacaauaccgcgaggaaga

SEQ ID NO: 505630 - RNA, 19 nt, Homo sapiens
caacgacgcaggcagaaga

SEQ ID NO: 505631 - RNA, 19 nt, Homo sapiens
ggcucaagcuuguuacuau

SEQ ID NO: 505632 - RNA, 19 nt, Homo sapiens
caaugggucgguuuguuua

SEQ ID NO: 505633 - RNA, 19 nt, Homo sapiens
gaggagcgagcaacaacua

SEQ ID NO: 505634 - RNA, 19 nt, Homo sapiens
gcccauuacuggaagaaau

SEQ ID NO: 505635 - RNA, 19 nt, Homo sapiens
aaauggagguggcaacuag

SEQ ID NO: 505636 - RNA, 19 nt, Homo sapiens
agaaagaccugaagaaccu

SEQ ID NO: 505637 - RNA, 19 nt, Homo sapiens
ggagaccacaugacccuaa

SEQ ID NO: 505638 - RNA, 19 nt, Homo sapiens
agaaagaccugaagaaccu

SEQ ID NO: 505639 - RNA, 19 nt, Homo sapiens
gguuuagcuuugaagauuu

SEQ ID NO: 505640 - RNA, 19 nt, Homo sapiens
uuauaacccuugaauagug

SEQ ID NO: 505641 - RNA, 19 nt, Homo sapiens
gcgaggaacgggagagaaa

SEQ ID NO: 505642 - RNA, 19 nt, Homo sapiens
agaaagagcugcaguuccu

SEQ ID NO: 505643 - RNA, 19 nt, Homo sapiens
gaagagcagcagcagcaaa

SEQ ID NO: 505644 - RNA, 19 nt, Homo sapiens
gcucaagcuuguuacuaug

SEQ ID NO: 505645 - RNA, 19 nt, Homo sapiens
ccagcccucucuaugagua

SEQ ID NO: 505646 - RNA, 19 nt, Homo sapiens
gccaggagcgucacagaaa

SEQ ID NO: 505647 - RNA, 19 nt, Homo sapiens
cugaagaaccuccuugaaa

SEQ ID NO: 505648 - RNA, 19 nt, Homo sapiens
gagaggaaccggagaagag

SEQ ID NO: 505649 - RNA, 19 nt, Homo sapiens
ggagacggcucuucuuuga

SEQ ID NO: 505650 - RNA, 19 nt, Homo sapiens
gcacagaggccgacaagaa

SEQ ID NO: 505651 - RNA, 19 nt, Homo sapiens
gaacugcgcuauccucaag

SEQ ID NO: 505652 - RNA, 19 nt, Homo sapiens
acaagaagcucucugaguu

SEQ ID NO: 505653 - RNA, 19 nt, Homo sapiens
uagaugagcuggcgcagaa

SEQ ID NO: 505654 - RNA, 19 nt, Homo sapiens
agacggcucuucuuugaaa

SEQ ID NO: 505655 - RNA, 19 nt, Homo sapiens
ucaaacgcaucaagaagaa

SEQ ID NO: 505656 - RNA, 19 nt, Homo sapiens
ucaaggcgcuggccgaugu

SEQ ID NO: 505657 - RNA, 19 nt, Homo sapiens
gcaagguuggcauggauua

SEQ ID NO: 505658 - RNA, 19 nt, Homo sapiens
gcaucgacuucaacaagaa

SEQ ID NO: 505659 - RNA, 19 nt, Homo sapiens
ggagcgagguguauuccau

SEQ ID NO: 505660 - RNA, 19 nt, Homo sapiens
ugucuugccucuugucauu

SEQ ID NO: 505661 - RNA, 19 nt, Homo sapiens
gaaggucacccucaaguac

SEQ ID NO: 505662 - RNA, 19 nt, Homo sapiens
gcgcguguaugaccagguu

SEQ ID NO: 505663 - RNA, 19 nt, Homo sapiens
agaccaagcgcguguauga

SEQ ID NO: 505664 - RNA, 19 nt, Homo sapiens
gcaggagcgugcggugauu

SEQ ID NO: 505665 - RNA, 19 nt, Homo sapiens
gcggcugucuugccucuug

SEQ ID NO: 505666 - RNA, 19 nt, Homo sapiens
gauggaggacggcaaguug

SEQ ID NO: 505667 - RNA, 19 nt, Homo sapiens
gaggagaacugcgcuaucc

SEQ ID NO: 505668 - RNA, 19 nt, Homo sapiens
caacacaggccucuucaac

SEQ ID NO: 505669 - RNA, 19 nt, Homo sapiens
cgucgcagaugcuggagaa

SEQ ID NO: 505670 - RNA, 19 nt, Homo sapiens
agaaccugcucaaggagua

SEQ ID NO: 505671 - RNA, 19 nt, Homo sapiens
cagcaagguuggcauggau

SEQ ID NO: 505672 - RNA, 19 nt, Homo sapiens
gagaugaacauggccaaga

SEQ ID NO: 505673 - RNA, 19 nt, Homo sapiens
gacaagaagcucucugagu

SEQ ID NO: 505674 - RNA, 19 nt, Homo sapiens
caggagacggcucuucuuu

SEQ ID NO: 505675 - RNA, 19 nt, Homo sapiens
gaccuacuuccaugaguuu

SEQ ID NO: 505676 - RNA, 19 nt, Homo sapiens
aggagaaaguucagaagga

SEQ ID NO: 505677 - RNA, 19 nt, Homo sapiens
gcuacgacgcccaguacua

SEQ ID NO: 505678 - RNA, 19 nt, Homo sapiens
gcuacugcguggaccagaa

SEQ ID NO: 505679 - RNA, 19 nt, Homo sapiens
agaccuacuuccaugaguu

SEQ ID NO: 505680 - RNA, 19 nt, Homo sapiens
gaccguggccaccuuccua

SEQ ID NO: 505681 - RNA, 19 nt, Homo sapiens
caagaagcucucugaguuc

SEQ ID NO: 505682 - RNA, 19 nt, Homo sapiens
ggaaccaacaugccugcaa

SEQ ID NO: 505683 - RNA, 19 nt, Homo sapiens
ggagguggucggcaaguuc

SEQ ID NO: 505684 - RNA, 19 nt, Homo sapiens
ugaaggucacccucaagua

SEQ ID NO: 505685 - RNA, 19 nt, Homo sapiens
gaaaacaucaaacgcauca

SEQ ID NO: 505686 - RNA, 19 nt, Homo sapiens
accagaaccugcucaagga

SEQ ID NO: 505687 - RNA, 19 nt, Homo sapiens
acacaggccucuucaaccu

SEQ ID NO: 505688 - RNA, 19 nt, Homo sapiens
gggagguggucggcaaguu

SEQ ID NO: 505689 - RNA, 19 nt, Homo sapiens
ccagagagacucaggaaaa

SEQ ID NO: 505690 - RNA, 19 nt, Homo sapiens
uggcugagcggcugucuug

SEQ ID NO: 505691 - RNA, 19 nt, Homo sapiens
cuacacaguucagaggaau

SEQ ID NO: 505692 - RNA, 19 nt, Homo sapiens
gcaugagggaggacgugua

SEQ ID NO: 505693 - RNA, 19 nt, Homo sapiens
gcagaccaagcgcguguau

SEQ ID NO: 505694 - RNA, 19 nt, Homo sapiens
cggcucuucuuugaaauga

SEQ ID NO: 505695 - RNA, 19 nt, Homo sapiens
gagaccuacuuccaugagu

SEQ ID NO: 505696 - RNA, 19 nt, Homo sapiens
ccugggacaugcgcuacua

SEQ ID NO: 505697 - RNA, 19 nt, Homo sapiens
gugcaucgacuucaacaag

SEQ ID NO: 505698 - RNA, 19 nt, Homo sapiens
guggccaccuuccuagaug

SEQ ID NO: 505699 - RNA, 19 nt, Homo sapiens
ccacacgcacgccgacuau

SEQ ID NO: 505700 - RNA, 19 nt, Homo sapiens
ccuacacaguucagaggaa

SEQ ID NO: 505701 - RNA, 19 nt, Homo sapiens
ccacguggagcgggacuuu

SEQ ID NO: 505702 - RNA, 19 nt, Homo sapiens
caucaaacgcaucaagaag

SEQ ID NO: 505703 - RNA, 19 nt, Homo sapiens
acuauguccuggagaugaa

SEQ ID NO: 505704 - RNA, 19 nt, Homo sapiens
gacuauguccuggagauga

SEQ ID NO: 505705 - RNA, 19 nt, Homo sapiens
ucaacaagaaccugaacga

SEQ ID NO: 505706 - RNA, 19 nt, Homo sapiens
aaacaucaaacgcaucaag

SEQ ID NO: 505707 - RNA, 19 nt, Homo sapiens
ugcaucgacuucaacaaga

SEQ ID NO: 505708 - RNA, 19 nt, Homo sapiens
ccuggucuuuguugcacua

SEQ ID NO: 505709 - RNA, 19 nt, Homo sapiens
ccaacaugccugcaaccuu

SEQ ID NO: 505710 - RNA, 19 nt, Homo sapiens
ccgacuauguccuggagau

SEQ ID NO: 505711 - RNA, 19 nt, Homo sapiens
ccugagugcccagcagaua

SEQ ID NO: 505712 - RNA, 19 nt, Homo sapiens
ccgacaagaagcucucuga

SEQ ID NO: 505713 - RNA, 19 nt, Homo sapiens
ggaggagaacugcgcuauc

SEQ ID NO: 505714 - RNA, 19 nt, Homo sapiens
gagacggcucuucuuugaa

SEQ ID NO: 505715 - RNA, 19 nt, Homo sapiens
cagaagcugcauccugaga

SEQ ID NO: 505716 - RNA, 19 nt, Homo sapiens
cgcagaugcuggagaacug

SEQ ID NO: 505717 - RNA, 19 nt, Homo sapiens
acacaguucagaggaauau

SEQ ID NO: 505718 - RNA, 19 nt, Homo sapiens
ggagaccuacuuccaugag

SEQ ID NO: 505719 - RNA, 19 nt, Homo sapiens
aguucuaccuggaccugua

SEQ ID NO: 505720 - RNA, 19 nt, Homo sapiens
ccgaggacuuucugaacuc

SEQ ID NO: 505721 - RNA, 19 nt, Homo sapiens
acaucaaacgcaucaagaa

SEQ ID NO: 505722 - RNA, 19 nt, Homo sapiens
acuaacacgucuccucucu

SEQ ID NO: 505723 - RNA, 19 nt, Homo sapiens
acagcaagguuggcaugga

SEQ ID NO: 505724 - RNA, 19 nt, Homo sapiens
cacagaggccgacaagaag

SEQ ID NO: 505725 - RNA, 19 nt, Homo sapiens
acacgcacgccgacuaugu

SEQ ID NO: 505726 - RNA, 19 nt, Homo sapiens
ugagugcccagcagauaga

SEQ ID NO: 505727 - RNA, 19 nt, Homo sapiens
ucuccgugcucugugguaa

SEQ ID NO: 505728 - RNA, 19 nt, Homo sapiens
gacguggagaugagcauga

SEQ ID NO: 505729 - RNA, 19 nt, Homo sapiens
ggacgcguacgagguggaa

SEQ ID NO: 505730 - RNA, 19 nt, Homo sapiens
gcaccagggagcucaucga

SEQ ID NO: 505731 - RNA, 19 nt, Homo sapiens
gguuggcacccaggaguuu

SEQ ID NO: 505732 - RNA, 19 nt, Homo sapiens
ugaacgaggacacgaccuu

SEQ ID NO: 505733 - RNA, 19 nt, Homo sapiens
uaacagaucuuuacucuug

SEQ ID NO: 505734 - RNA, 19 nt, Homo sapiens
gaauggagcugacugaauu

SEQ ID NO: 505735 - RNA, 19 nt, Homo sapiens
ggacaagauuuccuacuuu

SEQ ID NO: 505736 - RNA, 19 nt, Homo sapiens
gaacagagggagagacuaa

SEQ ID NO: 505737 - RNA, 19 nt, Homo sapiens
aaacaggacuucuggauug

SEQ ID NO: 505738 - RNA, 19 nt, Homo sapiens
ggagacaacuggacaagau

SEQ ID NO: 505739 - RNA, 19 nt, Homo sapiens
gaucuuuacucuugagaaa

SEQ ID NO: 505740 - RNA, 19 nt, Homo sapiens
gcaacucacugauucucua

SEQ ID NO: 505741 - RNA, 19 nt, Homo sapiens
gcccagagguucacccuuu

SEQ ID NO: 505742 - RNA, 19 nt, Homo sapiens
gaauaagcuuucucucaga

SEQ ID NO: 505743 - RNA, 19 nt, Homo sapiens
gaccacagcucacaaggau

SEQ ID NO: 505744 - RNA, 19 nt, Homo sapiens
ggacucugaucccauauuc

SEQ ID NO: 505745 - RNA, 19 nt, Homo sapiens
gaaauuugcaacucacuga

SEQ ID NO: 505746 - RNA, 19 nt, Homo sapiens
gacaagauuuccuacuuuc

SEQ ID NO: 505747 - RNA, 19 nt, Homo sapiens
cacgaacucuugaauggaa

SEQ ID NO: 505748 - RNA, 19 nt, Homo sapiens
ugaacgagcucccaaacag

SEQ ID NO: 505749 - RNA, 19 nt, Homo sapiens
gacuuuagcuugggagaau

SEQ ID NO: 505750 - RNA, 19 nt, Homo sapiens
guaauuuccuuugcuucaa

SEQ ID NO: 505751 - RNA, 19 nt, Homo sapiens
aaacagagaaaggguaauu

SEQ ID NO: 505752 - RNA, 19 nt, Homo sapiens
caaacaggacuucuggauu

SEQ ID NO: 505753 - RNA, 19 nt, Homo sapiens
cagcagaaccucucuaguc

SEQ ID NO: 505754 - RNA, 19 nt, Homo sapiens
uggacaagauuuccuacuu

SEQ ID NO: 505755 - RNA, 19 nt, Homo sapiens
caggauacacgaacucuug

SEQ ID NO: 505756 - RNA, 19 nt, Homo sapiens
gaaaacagagaaaggguaa

SEQ ID NO: 505757 - RNA, 19 nt, Homo sapiens
cuagcucuuuggucuauuu

SEQ ID NO: 505758 - RNA, 19 nt, Homo sapiens
gggauacacaggacugaaa

SEQ ID NO: 505759 - RNA, 19 nt, Homo sapiens
aaaggugcguuuccugaug

SEQ ID NO: 505760 - RNA, 19 nt, Homo sapiens
caggacuucuggauuguug

SEQ ID NO: 505761 - RNA, 19 nt, Homo sapiens
cuuaacagaucuuuacucu

SEQ ID NO: 505762 - RNA, 19 nt, Homo sapiens
cugcagagccuccuuggaa

SEQ ID NO: 505763 - RNA, 19 nt, Homo sapiens
gaucccauauucuuaacag

SEQ ID NO: 505764 - RNA, 19 nt, Homo sapiens
ccuaccagcccucuucuaa

SEQ ID NO: 505765 - RNA, 19 nt, Homo sapiens
uauacgcucuucccucuuc

SEQ ID NO: 505766 - RNA, 19 nt, Homo sapiens
uacacgaacucuugaaugg

SEQ ID NO: 505767 - RNA, 19 nt, Homo sapiens
gaccaaggcacaggacauu

SEQ ID NO: 505768 - RNA, 19 nt, Homo sapiens
ucuuuacucuugagaaaug

SEQ ID NO: 505769 - RNA, 19 nt, Homo sapiens
gguaauuuccuuugcuuca

SEQ ID NO: 505770 - RNA, 19 nt, Homo sapiens
gaaacccaaagcccuggua

SEQ ID NO: 505771 - RNA, 19 nt, Homo sapiens
ugaaguggcagcagggauu

SEQ ID NO: 505772 - RNA, 19 nt, Homo sapiens
caacaccugcuccgaggaa

SEQ ID NO: 505773 - RNA, 19 nt, Homo sapiens
uaccagcccucuucuaaac

SEQ ID NO: 505774 - RNA, 19 nt, Homo sapiens
ggaccacagcucacaagga

SEQ ID NO: 505775 - RNA, 19 nt, Homo sapiens
gaacaggauacacgaacuc

SEQ ID NO: 505776 - RNA, 19 nt, Homo sapiens
ggauucagagccaagauuc

SEQ ID NO: 505777 - RNA, 19 nt, Homo sapiens
ccaaacaggacuucuggau

SEQ ID NO: 505778 - RNA, 19 nt, Homo sapiens
caaauucaaggccuuccaa

SEQ ID NO: 505779 - RNA, 19 nt, Homo sapiens
gggagagacuaaccuugag

SEQ ID NO: 505780 - RNA, 19 nt, Homo sapiens
gagacaacuggacaagauu

SEQ ID NO: 505781 - RNA, 19 nt, Homo sapiens
gauacacgaacucuugaau

SEQ ID NO: 505782 - RNA, 19 nt, Homo sapiens
gggacccacuugccucuca

SEQ ID NO: 505783 - RNA, 19 nt, Homo sapiens
agacaacuggacaagauuu

SEQ ID NO: 505784 - RNA, 19 nt, Homo sapiens
gaaggguaagguucucaga

SEQ ID NO: 505785 - RNA, 19 nt, Homo sapiens
ccaaagcccugguaaaagg

SEQ ID NO: 505786 - RNA, 19 nt, Homo sapiens
cagaagugcaagagccuaa

SEQ ID NO: 505787 - RNA, 19 nt, Homo sapiens
ugugauaacucugcaaagg

SEQ ID NO: 505788 - RNA, 19 nt, Homo sapiens
gcuaucagcaauacucauc

SEQ ID NO: 505789 - RNA, 19 nt, Homo sapiens
gggauucagagccaagauu

SEQ ID NO: 505790 - RNA, 19 nt, Homo sapiens
ucucuaguccucacacuga

SEQ ID NO: 505791 - RNA, 19 nt, Homo sapiens
ucugaucccauauucuuaa

SEQ ID NO: 505792 - RNA, 19 nt, Homo sapiens
uggaacucguggacucuuu

SEQ ID NO: 505793 - RNA, 19 nt, Homo sapiens
ccagaauggagcugacuga

SEQ ID NO: 505794 - RNA, 19 nt, Homo sapiens
ggaucccaaugccaucuuc

SEQ ID NO: 505795 - RNA, 19 nt, Homo sapiens
caagauuuccuacuuucuc

SEQ ID NO: 505796 - RNA, 19 nt, Homo sapiens
aggguaagguucucagaca

SEQ ID NO: 505797 - RNA, 19 nt, Homo sapiens
cagccuggauauucuccuu

SEQ ID NO: 505798 - RNA, 19 nt, Homo sapiens
ggacuucuggauuguugga

SEQ ID NO: 505799 - RNA, 19 nt, Homo sapiens
gaccuccgaguccucagua

SEQ ID NO: 505800 - RNA, 19 nt, Homo sapiens
cuugagaaaugaauaagcu

SEQ ID NO: 505801 - RNA, 19 nt, Homo sapiens
gcccuucuccacccggaua

SEQ ID NO: 505802 - RNA, 19 nt, Homo sapiens
ggacuuuagcuugggagaa

SEQ ID NO: 505803 - RNA, 19 nt, Homo sapiens
cuaccagcccucuucuaaa

SEQ ID NO: 505804 - RNA, 19 nt, Homo sapiens
cccauauucuuaacagauc

SEQ ID NO: 505805 - RNA, 19 nt, Homo sapiens
agggagagacuaaccuuga

SEQ ID NO: 505806 - RNA, 19 nt, Homo sapiens
gcugccugcuguggacuuu

SEQ ID NO: 505807 - RNA, 19 nt, Homo sapiens
ggauacacgaacucuugaa

SEQ ID NO: 505808 - RNA, 19 nt, Homo sapiens
acucugaucccauauucuu

SEQ ID NO: 505809 - RNA, 19 nt, Homo sapiens
ggagagacuaaccuugagu

SEQ ID NO: 505810 - RNA, 19 nt, Homo sapiens
uaagcuaucagcaauacuc

SEQ ID NO: 505811 - RNA, 19 nt, Homo sapiens
ggaacucguggacucuuuc

SEQ ID NO: 505812 - RNA, 19 nt, Homo sapiens
uagcuugggagaauggaaa

SEQ ID NO: 505813 - RNA, 19 nt, Homo sapiens
gaaguggcagcagggauuc

SEQ ID NO: 505814 - RNA, 19 nt, Homo sapiens
agaauggagcugacugaau

SEQ ID NO: 505815 - RNA, 19 nt, Homo sapiens
gagccagugcccagagguu

SEQ ID NO: 505816 - RNA, 19 nt, Homo sapiens
ccaaggcacaggacauucu

SEQ ID NO: 505817 - RNA, 19 nt, Homo sapiens
aaacccaaagcccugguaa

SEQ ID NO: 505818 - RNA, 19 nt, Homo sapiens
ugaacaggauacacgaacu

SEQ ID NO: 505819 - RNA, 19 nt, Homo sapiens
cccagagguucacccuuug

SEQ ID NO: 505820 - RNA, 19 nt, Homo sapiens
gcaggaccacagcucacaa

SEQ ID NO: 505821 - RNA, 19 nt, Homo sapiens
acagguccgucuccuccuu

SEQ ID NO: 505822 - RNA, 19 nt, Homo sapiens
ggacccacuugccucucau

SEQ ID NO: 505823 - RNA, 19 nt, Homo sapiens
augaauaagcuuucucuca

SEQ ID NO: 505824 - RNA, 19 nt, Homo sapiens
gcucacaaggaucccaaug

SEQ ID NO: 505825 - RNA, 19 nt, Homo sapiens
gacaacuggacaagauuuc

SEQ ID NO: 505826 - RNA, 19 nt, Homo sapiens
ggacaagacuccgaagcua

SEQ ID NO: 505827 - RNA, 19 nt, Homo sapiens
cuaguuaccuggacaaaga

SEQ ID NO: 505828 - RNA, 19 nt, Homo sapiens
gaaccuccaucccaccuau

SEQ ID NO: 505829 - RNA, 19 nt, Homo sapiens
caucuuacuuguccuuuga

SEQ ID NO: 505830 - RNA, 19 nt, Homo sapiens
ggaaacagaggcggaaauu

SEQ ID NO: 505831 - RNA, 19 nt, Homo sapiens
ggacaaagacgagcagugu

SEQ ID NO: 505832 - RNA, 19 nt, Homo sapiens
gacagcagcuucucggaau

SEQ ID NO: 505833 - RNA, 19 nt, Homo sapiens
uaaaagguguguugaauug

SEQ ID NO: 505834 - RNA, 19 nt, Homo sapiens
ggcccaagcugcugaugaa

SEQ ID NO: 505835 - RNA, 19 nt, Homo sapiens
ggacaaggcaacugguuau

SEQ ID NO: 505836 - RNA, 19 nt, Homo sapiens
ugaagugaauggaacagaa

SEQ ID NO: 505837 - RNA, 19 nt, Homo sapiens
ggauggaauugaagugaau

SEQ ID NO: 505838 - RNA, 19 nt, Homo sapiens
agagagaagugcagaguuc

SEQ ID NO: 505839 - RNA, 19 nt, Homo sapiens
aaagguguguugaauugaa

SEQ ID NO: 505840 - RNA, 19 nt, Homo sapiens
guucaugcuucuacuguga

SEQ ID NO: 505841 - RNA, 19 nt, Homo sapiens
ccaagcugcugaugaagga

SEQ ID NO: 505842 - RNA, 19 nt, Homo sapiens
guaagcugauugagcagaa

SEQ ID NO: 505843 - RNA, 19 nt, Homo sapiens
ggaauugaagugaauggaa

SEQ ID NO: 505844 - RNA, 19 nt, Homo sapiens
agaguucgauucuguacaa

SEQ ID NO: 505845 - RNA, 19 nt, Homo sapiens
acacuuaucucacuguuuu

SEQ ID NO: 505846 - RNA, 19 nt, Homo sapiens
gguuaucacuaccgcugua

SEQ ID NO: 505847 - RNA, 19 nt, Homo sapiens
gggacaaggcaacugguua

SEQ ID NO: 505848 - RNA, 19 nt, Homo sapiens
ggacuugguucuagaugac

SEQ ID NO: 505849 - RNA, 19 nt, Homo sapiens
agaaagaacggccaauguu

SEQ ID NO: 505850 - RNA, 19 nt, Homo sapiens
gaacugggcaagucacucu

SEQ ID NO: 505851 - RNA, 19 nt, Homo sapiens
gacugugucugaaucaugu

SEQ ID NO: 505852 - RNA, 19 nt, Homo sapiens
gaagugcagaguucgauuc

SEQ ID NO: 505853 - RNA, 19 nt, Homo sapiens
gaaauaguugucugugcuu

SEQ ID NO: 505854 - RNA, 19 nt, Homo sapiens
gacaagaucacccgcaauc

SEQ ID NO: 505855 - RNA, 19 nt, Homo sapiens
cggccaauguucccugaaa

SEQ ID NO: 505856 - RNA, 19 nt, Homo sapiens
gagaaggagugccauaccu

SEQ ID NO: 505857 - RNA, 19 nt, Homo sapiens
ucagcgaguuuaccaagau

SEQ ID NO: 505858 - RNA, 19 nt, Homo sapiens
ugucugugcuuccuugguu

SEQ ID NO: 505859 - RNA, 19 nt, Homo sapiens
gaagugaauggaacagaag

SEQ ID NO: 505860 - RNA, 19 nt, Homo sapiens
caaggcaacugguuaucac

SEQ ID NO: 505861 - RNA, 19 nt, Homo sapiens
uauaauuagucgggcauga

SEQ ID NO: 505862 - RNA, 19 nt, Homo sapiens
ggagagagaagugcagagu

SEQ ID NO: 505863 - RNA, 19 nt, Homo sapiens
caagucacucucugccuuu

SEQ ID NO: 505864 - RNA, 19 nt, Homo sapiens
cauaaaagguguguugaau

SEQ ID NO: 505865 - RNA, 19 nt, Homo sapiens
ugacacuuaucucacuguu

SEQ ID NO: 505866 - RNA, 19 nt, Homo sapiens
caacaucuuacuuguccuu

SEQ ID NO: 505867 - RNA, 19 nt, Homo sapiens
ggccagacucccuugcuuu

SEQ ID NO: 505868 - RNA, 19 nt, Homo sapiens
gagagagaagugcagaguu

SEQ ID NO: 505869 - RNA, 19 nt, Homo sapiens
gaaacagaggcggaaauuc

SEQ ID NO: 505870 - RNA, 19 nt, Homo sapiens
gcccaucgcagcaccaaug

SEQ ID NO: 505871 - RNA, 19 nt, Homo sapiens
gccauggacuugguucuag

SEQ ID NO: 505872 - RNA, 19 nt, Homo sapiens
gaugaaggagagagaagug

SEQ ID NO: 505873 - RNA, 19 nt, Homo sapiens
ccauggacuugguucuaga

SEQ ID NO: 505874 - RNA, 19 nt, Homo sapiens
gggcugcaagggcuucuuu

SEQ ID NO: 505875 - RNA, 19 nt, Homo sapiens
gggaagacgacagcaguga

SEQ ID NO: 505876 - RNA, 19 nt, Homo sapiens
gaguuuaccaagaucauca

SEQ ID NO: 505877 - RNA, 19 nt, Homo sapiens
uggauggaauugaagugaa

SEQ ID NO: 505878 - RNA, 19 nt, Homo sapiens
aaagaaagaacggccaaug

SEQ ID NO: 505879 - RNA, 19 nt, Homo sapiens
uggacaagaucgagaagag

SEQ ID NO: 505880 - RNA, 19 nt, Homo sapiens
ggccaagcguaagcugauu

SEQ ID NO: 505881 - RNA, 19 nt, Homo sapiens
cagcugugccgcuucaaga

SEQ ID NO: 505882 - RNA, 19 nt, Homo sapiens
acaaagacgagcagugugu

SEQ ID NO: 505883 - RNA, 19 nt, Homo sapiens
aagguguguugaauugaaa

SEQ ID NO: 505884 - RNA, 19 nt, Homo sapiens
cuucuacugugacacuuau

SEQ ID NO: 505885 - RNA, 19 nt, Homo sapiens
ccugaagagugggaucuga

SEQ ID NO: 505886 - RNA, 19 nt, Homo sapiens
uggacuugguucuagauga

SEQ ID NO: 505887 - RNA, 19 nt, Homo sapiens
caagaucacccgcaaucag

SEQ ID NO: 505888 - RNA, 19 nt, Homo sapiens
gccgcacaauccagaagaa

SEQ ID NO: 505889 - RNA, 19 nt, Homo sapiens
cgcagggcauggugugaaa

SEQ ID NO: 505890 - RNA, 19 nt, Homo sapiens
cacuaccgcuguaucacuu

SEQ ID NO: 505891 - RNA, 19 nt, Homo sapiens
cgagcagugugucgugugu

SEQ ID NO: 505892 - RNA, 19 nt, Homo sapiens
gagucuguuucccaagcua

SEQ ID NO: 505893 - RNA, 19 nt, Homo sapiens
ccaggucaccagauggaaa

SEQ ID NO: 505894 - RNA, 19 nt, Homo sapiens
acacaacauuccgcacuuc

SEQ ID NO: 505895 - RNA, 19 nt, Homo sapiens
aagaaagaacggccaaugu

SEQ ID NO: 505896 - RNA, 19 nt, Homo sapiens
ggcaacugguuaucacuac

SEQ ID NO: 505897 - RNA, 19 nt, Homo sapiens
caccucccaucccguaaga

SEQ ID NO: 505898 - RNA, 19 nt, Homo sapiens
ggacaagaucgagaagagu

SEQ ID NO: 505899 - RNA, 19 nt, Homo sapiens
ggccauggacuugguucua

SEQ ID NO: 505900 - RNA, 19 nt, Homo sapiens
gcuucuacugugacacuua

SEQ ID NO: 505901 - RNA, 19 nt, Homo sapiens
acucaagugucaccuccuu

SEQ ID NO: 505902 - RNA, 19 nt, Homo sapiens
gagaagugcagaguucgau

SEQ ID NO: 505903 - RNA, 19 nt, Homo sapiens
ccaagcguaagcugauuga

SEQ ID NO: 505904 - RNA, 19 nt, Homo sapiens
uaucacuaccgcuguauca

SEQ ID NO: 505905 - RNA, 19 nt, Homo sapiens
ccaccgcaaacacaacauu

SEQ ID NO: 505906 - RNA, 19 nt, Homo sapiens
cuacgucaaccaccgcaaa

SEQ ID NO: 505907 - RNA, 19 nt, Homo sapiens
gcgcagggcauggugugaa

SEQ ID NO: 505908 - RNA, 19 nt, Homo sapiens
gggcagccauuggaaacag

SEQ ID NO: 505909 - RNA, 19 nt, Homo sapiens
ccagggcagccauuggaaa

SEQ ID NO: 505910 - RNA, 19 nt, Homo sapiens
gcacaauccagaagaaccu

SEQ ID NO: 505911 - RNA, 19 nt, Homo sapiens
cggaaugcauguuguucag

SEQ ID NO: 505912 - RNA, 19 nt, Homo sapiens
aagucacucucugccuuua

SEQ ID NO: 505913 - RNA, 19 nt, Homo sapiens
ggcagccauuggaaacaga

SEQ ID NO: 505914 - RNA, 19 nt, Homo sapiens
ugauccacauugccacaga

SEQ ID NO: 505915 - RNA, 19 nt, Homo sapiens
gacacuuaucucacuguuu

SEQ ID NO: 505916 - RNA, 19 nt, Homo sapiens
acaucuuacuuguccuuug

SEQ ID NO: 505917 - RNA, 19 nt, Homo sapiens
ccuggcaacaucuuacuug

SEQ ID NO: 505918 - RNA, 19 nt, Homo sapiens
gagcagcagcuuggugaag

SEQ ID NO: 505919 - RNA, 19 nt, Homo sapiens
cagcgaguuuaccaagauc

SEQ ID NO: 505920 - RNA, 19 nt, Homo sapiens
ccagagcccacuccugaag

SEQ ID NO: 505921 - RNA, 19 nt, Homo sapiens
ucccaccuauuccugcaaa

SEQ ID NO: 505922 - RNA, 19 nt, Homo sapiens
gaaugucgcuuuaagaaau

SEQ ID NO: 505923 - RNA, 19 nt, Homo sapiens
gaucaacuuugcaugaaua

SEQ ID NO: 505924 - RNA, 19 nt, Homo sapiens
gcaugucucugucuucuuu

SEQ ID NO: 505925 - RNA, 19 nt, Homo sapiens
gggaagagcugcagaaguc

SEQ ID NO: 505926 - RNA, 19 nt, Homo sapiens
gauccagaaugauuacuaa

SEQ ID NO: 505927 - RNA, 19 nt, Homo sapiens
gcaagaggcuggccaagag

SEQ ID NO: 505928 - RNA, 19 nt, Homo sapiens
ggauuagacugacuggauu

SEQ ID NO: 505929 - RNA, 19 nt, Homo sapiens
gaacagucgucgccacauc

SEQ ID NO: 505930 - RNA, 19 nt, Homo sapiens
gcuaugacccggaaaguga

SEQ ID NO: 505931 - RNA, 19 nt, Homo sapiens
ggaaugggagcucaucaaa

SEQ ID NO: 505932 - RNA, 19 nt, Homo sapiens
ggacaagcaccaauaguca

SEQ ID NO: 505933 - RNA, 19 nt, Homo sapiens
caacuuugcaugaauaaug

SEQ ID NO: 505934 - RNA, 19 nt, Homo sapiens
ucugaagccugccuacaua

SEQ ID NO: 505935 - RNA, 19 nt, Homo sapiens
agaaggagaugucagugaa

SEQ ID NO: 505936 - RNA, 19 nt, Homo sapiens
caaccuggaugacacugaa

SEQ ID NO: 505937 - RNA, 19 nt, Homo sapiens
gaucugcgauuuccuucug

SEQ ID NO: 505938 - RNA, 19 nt, Homo sapiens
guggaaagguugacuugga

SEQ ID NO: 505939 - RNA, 19 nt, Homo sapiens
uagaagaaccauucagaaa

SEQ ID NO: 505940 - RNA, 19 nt, Homo sapiens
uggaaguguucgaggauua

SEQ ID NO: 505941 - RNA, 19 nt, Homo sapiens
cgaaaucagugccaggaau

SEQ ID NO: 505942 - RNA, 19 nt, Homo sapiens
gaaaauggccuuacagcuu

SEQ ID NO: 505943 - RNA, 19 nt, Homo sapiens
ugacagaucugcggaugau

SEQ ID NO: 505944 - RNA, 19 nt, Homo sapiens
gggaucaacuuugcaugaa

SEQ ID NO: 505945 - RNA, 19 nt, Homo sapiens
ggaaugucgcuuuaagaaa

SEQ ID NO: 505946 - RNA, 19 nt, Homo sapiens
gaaaucagugccaggaaug

SEQ ID NO: 505947 - RNA, 19 nt, Homo sapiens
ugacaaagccaccggguau

SEQ ID NO: 505948 - RNA, 19 nt, Homo sapiens
cagauuuggugcuggauga

SEQ ID NO: 505949 - RNA, 19 nt, Homo sapiens
aaacggaggagaagaaaug

SEQ ID NO: 505950 - RNA, 19 nt, Homo sapiens
uuugugagcugccauguga

SEQ ID NO: 505951 - RNA, 19 nt, Homo sapiens
ggaagcugauagaggagaa

SEQ ID NO: 505952 - RNA, 19 nt, Homo sapiens
cagaaugauuacuaaccua

SEQ ID NO: 505953 - RNA, 19 nt, Homo sapiens
ccaggaaugucgcuuuaag

SEQ ID NO: 505954 - RNA, 19 nt, Homo sapiens
cugcaaggguuucuuuaga

SEQ ID NO: 505955 - RNA, 19 nt, Homo sapiens
guacauccccaguuacuua

SEQ ID NO: 505956 - RNA, 19 nt, Homo sapiens
aaagggauccagaaugauu

SEQ ID NO: 505957 - RNA, 19 nt, Homo sapiens
ggaucaacuuugcaugaau

SEQ ID NO: 505958 - RNA, 19 nt, Homo sapiens
ugccaggaaugucgcuuua

SEQ ID NO: 505959 - RNA, 19 nt, Homo sapiens
cggaggagaagaaauguaa

SEQ ID NO: 505960 - RNA, 19 nt, Homo sapiens
caaguuccacacaugauuu

SEQ ID NO: 505961 - RNA, 19 nt, Homo sapiens
gggcuugccuguguugaga

SEQ ID NO: 505962 - RNA, 19 nt, Homo sapiens
ggugucagacgccaucuuu

SEQ ID NO: 505963 - RNA, 19 nt, Homo sapiens
gagaggcgcagcacguuga

SEQ ID NO: 505964 - RNA, 19 nt, Homo sapiens
gaaggagaugucagugaaa

SEQ ID NO: 505965 - RNA, 19 nt, Homo sapiens
ccacacaugauuuaaugaa

SEQ ID NO: 505966 - RNA, 19 nt, Homo sapiens
cccagaagguggaaagguu

SEQ ID NO: 505967 - RNA, 19 nt, Homo sapiens
uggauuccuuccuauaauu

SEQ ID NO: 505968 - RNA, 19 nt, Homo sapiens
uggaaagguugacuuggaa

SEQ ID NO: 505969 - RNA, 19 nt, Homo sapiens
uagacaaagucacgcgaaa

SEQ ID NO: 505970 - RNA, 19 nt, Homo sapiens
ccaguuacuuagacaagga

SEQ ID NO: 505971 - RNA, 19 nt, Homo sapiens
ggacaaaccgaagcacugu

SEQ ID NO: 505972 - RNA, 19 nt, Homo sapiens
ggccaaaacuccugaugaa

SEQ ID NO: 505973 - RNA, 19 nt, Homo sapiens
gacgagcucuguguagugu

SEQ ID NO: 505974 - RNA, 19 nt, Homo sapiens
ugaugaaggugacagaucu

SEQ ID NO: 505975 - RNA, 19 nt, Homo sapiens
gacaaagucacgcgaaauc

SEQ ID NO: 505976 - RNA, 19 nt, Homo sapiens
uguaguguguggugacaaa

SEQ ID NO: 505977 - RNA, 19 nt, Homo sapiens
ggaccaugaugaugugaac

SEQ ID NO: 505978 - RNA, 19 nt, Homo sapiens
ccuuacagcuugggacaaa

SEQ ID NO: 505979 - RNA, 19 nt, Homo sapiens
ugacuggauuccuuccuau

SEQ ID NO: 505980 - RNA, 19 nt, Homo sapiens
gaaggaaaaugugucauag

SEQ ID NO: 505981 - RNA, 19 nt, Homo sapiens
ggauccagaaugauuacua

SEQ ID NO: 505982 - RNA, 19 nt, Homo sapiens
ggcagccacuggaagcaaa

SEQ ID NO: 505983 - RNA, 19 nt, Homo sapiens
caaggacgagcucugugua

SEQ ID NO: 505984 - RNA, 19 nt, Homo sapiens
gugccaaguuccacacaug

SEQ ID NO: 505985 - RNA, 19 nt, Homo sapiens
gaccagagugucucaagug

SEQ ID NO: 505986 - RNA, 19 nt, Homo sapiens
cacuuggacuagcucaaua

SEQ ID NO: 505987 - RNA, 19 nt, Homo sapiens
gaacgaccagagugucuca

SEQ ID NO: 505988 - RNA, 19 nt, Homo sapiens
gaccuaggcaugucucugu

SEQ ID NO: 505989 - RNA, 19 nt, Homo sapiens
ugucagacgccaucuuuga

SEQ ID NO: 505990 - RNA, 19 nt, Homo sapiens
ccaagaggaagcugauaga

SEQ ID NO: 505991 - RNA, 19 nt, Homo sapiens
aagaaaugcaucuauguug

SEQ ID NO: 505992 - RNA, 19 nt, Homo sapiens
ggacgagcucuguguagug

SEQ ID NO: 505993 - RNA, 19 nt, Homo sapiens
cuacauaggaagagccauu

SEQ ID NO: 505994 - RNA, 19 nt, Homo sapiens
gcacuguccagaccgagaa

SEQ ID NO: 505995 - RNA, 19 nt, Homo sapiens
uagacugacuggauuccuu

SEQ ID NO: 505996 - RNA, 19 nt, Homo sapiens
aaucaucacaccagcaauu

SEQ ID NO: 505997 - RNA, 19 nt, Homo sapiens
ccaaguuccacacaugauu

SEQ ID NO: 505998 - RNA, 19 nt, Homo sapiens
ccagaucauccuccucaaa

SEQ ID NO: 505999 - RNA, 19 nt, Homo sapiens
gaggagaagaaauguaaag

SEQ ID NO: 506000 - RNA, 19 nt, Homo sapiens
aggaagagccauucagaga

SEQ ID NO: 506001 - RNA, 19 nt, Homo sapiens
caccagcaauuaccagagu

SEQ ID NO: 506002 - RNA, 19 nt, Homo sapiens
gaagcuaguaggaaugucu

SEQ ID NO: 506003 - RNA, 19 nt, Homo sapiens
agugagacuuuaaccuuga

SEQ ID NO: 506004 - RNA, 19 nt, Homo sapiens
gaauaagaaggagauguca

SEQ ID NO: 506005 - RNA, 19 nt, Homo sapiens
ccagaaugauuacuaaccu

SEQ ID NO: 506006 - RNA, 19 nt, Homo sapiens
cgaccagagugucucaagu

SEQ ID NO: 506007 - RNA, 19 nt, Homo sapiens
uuccacacaugauuuaaug

SEQ ID NO: 506008 - RNA, 19 nt, Homo sapiens
gaaaacaccacgugacaca

SEQ ID NO: 506009 - RNA, 19 nt, Homo sapiens
ugaauaagaaggagauguc

SEQ ID NO: 506010 - RNA, 19 nt, Homo sapiens
cauccauccuauuccugua

SEQ ID NO: 506011 - RNA, 19 nt, Homo sapiens
cgagcucuguguagugugu

SEQ ID NO: 506012 - RNA, 19 nt, Homo sapiens
ggaggagaagaaauguaaa

SEQ ID NO: 506013 - RNA, 19 nt, Homo sapiens
gaauagaaaaguaccaaga

SEQ ID NO: 506014 - RNA, 19 nt, Homo sapiens
gacaagcaccaauagucaa

SEQ ID NO: 506015 - RNA, 19 nt, Homo sapiens
cugacuggauuccuuccua

SEQ ID NO: 506016 - RNA, 19 nt, Homo sapiens
aggaaugucgcuuuaagaa

SEQ ID NO: 506017 - RNA, 19 nt, Homo sapiens
acuggaagcuaguaggaau

SEQ ID NO: 506018 - RNA, 19 nt, Homo sapiens
gcuggccuuugaacacuau

SEQ ID NO: 506019 - RNA, 19 nt, Homo sapiens
ccaacaguaugacagaaaa

SEQ ID NO: 506020 - RNA, 19 nt, Homo sapiens
gugagacuuuaaccuugaa

SEQ ID NO: 506021 - RNA, 19 nt, Homo sapiens
agaagacauuggacaagca

SEQ ID NO: 506022 - RNA, 19 nt, Homo sapiens
gaaaugacgggacaaguuu

SEQ ID NO: 506023 - RNA, 19 nt, Homo sapiens
ggaaaugacgggacaaguu

SEQ ID NO: 506024 - RNA, 19 nt, Homo sapiens
gaauggaaccgcagagaca

SEQ ID NO: 506025 - RNA, 19 nt, Homo sapiens
ggaaauaccaggaaaugac

SEQ ID NO: 506026 - RNA, 19 nt, Homo sapiens
acaaggaaauaccaggaaa

SEQ ID NO: 506027 - RNA, 19 nt, Homo sapiens
cccaggaggugacaaggaa

SEQ ID NO: 506028 - RNA, 19 nt, Homo sapiens
ucaugcaccucaccgagaa

SEQ ID NO: 506029 - RNA, 19 nt, Homo sapiens
cagccgaggugcacaacau

SEQ ID NO: 506030 - RNA, 19 nt, Homo sapiens
ggaagucgaggacgagagu

SEQ ID NO: 506031 - RNA, 19 nt, Homo sapiens
gacaaggaaauaccaggaa

SEQ ID NO: 506032 - RNA, 19 nt, Homo sapiens
gagaauggaaccgcagaga

SEQ ID NO: 506033 - RNA, 19 nt, Homo sapiens
ugacgggacaaguuuggua

SEQ ID NO: 506034 - RNA, 19 nt, Homo sapiens
caaggaaauaccaggaaau

SEQ ID NO: 506035 - RNA, 19 nt, Homo sapiens
gcacuucuccagccuccau

SEQ ID NO: 506036 - RNA, 19 nt, Homo sapiens
gcaggcagcgaagagaaug

SEQ ID NO: 506037 - RNA, 19 nt, Homo sapiens
uggagcagguggugaugau

SEQ ID NO: 506038 - RNA, 19 nt, Homo sapiens
aaggaaauaccaggaaaug

SEQ ID NO: 506039 - RNA, 19 nt, Homo sapiens
ccgcagagacagaggaagu

SEQ ID NO: 506040 - RNA, 19 nt, Homo sapiens
ccccugaucucuacaccua

SEQ ID NO: 506041 - RNA, 19 nt, Homo sapiens
gagacaaacuggucaagug

SEQ ID NO: 506042 - RNA, 19 nt, Homo sapiens
ccaagccucuggaaucuaa

SEQ ID NO: 506043 - RNA, 19 nt, Homo sapiens
gaaccaacuucaccagcaa

SEQ ID NO: 506044 - RNA, 19 nt, Homo sapiens
gcaguucacccauccagua

SEQ ID NO: 506045 - RNA, 19 nt, Homo sapiens
gcuucugucugguuuauuu

SEQ ID NO: 506046 - RNA, 19 nt, Homo sapiens
ggacacuucucaggaaaug

SEQ ID NO: 506047 - RNA, 19 nt, Homo sapiens
gcacaccucuggcugucuu

SEQ ID NO: 506048 - RNA, 19 nt, Homo sapiens
gaagagggaagccaggauu

SEQ ID NO: 506049 - RNA, 19 nt, Homo sapiens
gcaaauacaacaugaaggu

SEQ ID NO: 506050 - RNA, 19 nt, Homo sapiens
caugaagguccucuacuua

SEQ ID NO: 506051 - RNA, 19 nt, Homo sapiens
caaagaaaacugcacaaua

SEQ ID NO: 506052 - RNA, 19 nt, Homo sapiens
gagaaggagguaaggauga

SEQ ID NO: 506053 - RNA, 19 nt, Homo sapiens
gugcagagauccuacuucu

SEQ ID NO: 506054 - RNA, 19 nt, Homo sapiens
acaaacuggucaaguguga

SEQ ID NO: 506055 - RNA, 19 nt, Homo sapiens
cagugaagaugcagguuug

SEQ ID NO: 506056 - RNA, 19 nt, Homo sapiens
ggcaagccauggagugaga

SEQ ID NO: 506057 - RNA, 19 nt, Homo sapiens
gaacgucacagugcucaga

SEQ ID NO: 506058 - RNA, 19 nt, Homo sapiens
acaugaagguccucuacuu

SEQ ID NO: 506059 - RNA, 19 nt, Homo sapiens
aaaccaagccucuggaauc

SEQ ID NO: 506060 - RNA, 19 nt, Homo sapiens
gcuuauggcaucucauuga

SEQ ID NO: 506061 - RNA, 19 nt, Homo sapiens
ucacagugcucagagacaa

SEQ ID NO: 506062 - RNA, 19 nt, Homo sapiens
caacuucaccagcaaauac

SEQ ID NO: 506063 - RNA, 19 nt, Homo sapiens
ugaagguccucuacuuauc

SEQ ID NO: 506064 - RNA, 19 nt, Homo sapiens
ggacugccgccaugagaau

SEQ ID NO: 506065 - RNA, 19 nt, Homo sapiens
gccggacacuucucaggaa

SEQ ID NO: 506066 - RNA, 19 nt, Homo sapiens
ugagaucccagaaccauga

SEQ ID NO: 506067 - RNA, 19 nt, Homo sapiens
gagggcaccaccaagaauu

SEQ ID NO: 506068 - RNA, 19 nt, Homo sapiens
gacaggaagccucaaguuc

SEQ ID NO: 506069 - RNA, 19 nt, Homo sapiens
cagcuuauggcaucucauu

SEQ ID NO: 506070 - RNA, 19 nt, Homo sapiens
guggaggguuggagaagga

SEQ ID NO: 506071 - RNA, 19 nt, Homo sapiens
ccagugaagaugcagguuu

SEQ ID NO: 506072 - RNA, 19 nt, Homo sapiens
ggagagugagagcauguga

SEQ ID NO: 506073 - RNA, 19 nt, Homo sapiens
cugagcaucuccagcauuc

SEQ ID NO: 506074 - RNA, 19 nt, Homo sapiens
caacaugaagguccucuac

SEQ ID NO: 506075 - RNA, 19 nt, Homo sapiens
ccuguucugugacugugua

SEQ ID NO: 506076 - RNA, 19 nt, Homo sapiens
gggcaugacccagugaaga

SEQ ID NO: 506077 - RNA, 19 nt, Homo sapiens
gcaaggacgagggcaccua

SEQ ID NO: 506078 - RNA, 19 nt, Homo sapiens
gaugugagggcaccaccaa

SEQ ID NO: 506079 - RNA, 19 nt, Homo sapiens
gguucuuccuguucuguga

SEQ ID NO: 506080 - RNA, 19 nt, Homo sapiens
gaggcaagccauggaguga

SEQ ID NO: 506081 - RNA, 19 nt, Homo sapiens
gggaccugauggagaguga

SEQ ID NO: 506082 - RNA, 19 nt, Homo sapiens
cagaaggugaccagccuaa

SEQ ID NO: 506083 - RNA, 19 nt, Homo sapiens
cagcaaauacaacaugaag

SEQ ID NO: 506084 - RNA, 19 nt, Homo sapiens
guucacccauccaguacga

SEQ ID NO: 506085 - RNA, 19 nt, Homo sapiens
gagaauaccagcaguucac

SEQ ID NO: 506086 - RNA, 19 nt, Homo sapiens
gagcugcuucugucugguu

SEQ ID NO: 506087 - RNA, 19 nt, Homo sapiens
agacaggaagccucaaguu

SEQ ID NO: 506088 - RNA, 19 nt, Homo sapiens
ccaugaaccuggccaucag

SEQ ID NO: 506089 - RNA, 19 nt, Homo sapiens
gaaggugaccagccuaacg

SEQ ID NO: 506090 - RNA, 19 nt, Homo sapiens
ccagagcugcacaggguuu

SEQ ID NO: 506091 - RNA, 19 nt, Homo sapiens
caggaaagcagcgcuagug

SEQ ID NO: 506092 - RNA, 19 nt, Homo sapiens
ccuaacggccugccuagug

SEQ ID NO: 506093 - RNA, 19 nt, Homo sapiens
ggcaugacccagugaagau

SEQ ID NO: 506094 - RNA, 19 nt, Homo sapiens
cuacuuauccgccuucacu

SEQ ID NO: 506095 - RNA, 19 nt, Homo sapiens
ccggacacuucucaggaaa

SEQ ID NO: 506096 - RNA, 19 nt, Homo sapiens
cuacaaaggaggacaagac

SEQ ID NO: 506097 - RNA, 19 nt, Homo sapiens
gagcaucuccagcauucuc

SEQ ID NO: 506098 - RNA, 19 nt, Homo sapiens
ccaacuucaccagcaaaua

SEQ ID NO: 506099 - RNA, 19 nt, Homo sapiens
guucugugacuguguauag

SEQ ID NO: 506100 - RNA, 19 nt, Homo sapiens
gcaccaccaagaauuugug

SEQ ID NO: 506101 - RNA, 19 nt, Homo sapiens
ccagugcugcaugcgauua

SEQ ID NO: 506102 - RNA, 19 nt, Homo sapiens
ggagacaggaagccucaag

SEQ ID NO: 506103 - RNA, 19 nt, Homo sapiens
gaaaacugcacaauaaaac

SEQ ID NO: 506104 - RNA, 19 nt, Homo sapiens
ggauuucaugucccuguga

SEQ ID NO: 506105 - RNA, 19 nt, Homo sapiens
agacaaacuggucaagugu

SEQ ID NO: 506106 - RNA, 19 nt, Homo sapiens
caguggagagggcuacaaa

SEQ ID NO: 506107 - RNA, 19 nt, Homo sapiens
gugagggcaccaccaagaa

SEQ ID NO: 506108 - RNA, 19 nt, Homo sapiens
gcaucgcucuccugcuaac

SEQ ID NO: 506109 - RNA, 19 nt, Homo sapiens
gaagguccucuacuuaucc

SEQ ID NO: 506110 - RNA, 19 nt, Homo sapiens
gaaaccugggagagacuug

SEQ ID NO: 506111 - RNA, 19 nt, Homo sapiens
uuugagaguucgugaagag

SEQ ID NO: 506112 - RNA, 19 nt, Homo sapiens
aaccaagccucuggaaucu

SEQ ID NO: 506113 - RNA, 19 nt, Homo sapiens
gggcaccaccaagaauuug

SEQ ID NO: 506114 - RNA, 19 nt, Homo sapiens
caugagaauaccagcaguu

SEQ ID NO: 506115 - RNA, 19 nt, Homo sapiens
gaccugauggagagugaga

SEQ ID NO: 506116 - RNA, 19 nt, Homo sapiens
acauaccgcucccgaacca

SEQ ID NO: 506117 - RNA, 19 nt, Homo sapiens
ccaccacucuggccauucc

SEQ ID NO: 506118 - RNA, 19 nt, Homo sapiens
agaaggagguaaggaugag

SEQ ID NO: 506119 - RNA, 19 nt, Homo sapiens
uuuguggccuaccuuguga

SEQ ID NO: 506120 - RNA, 19 nt, Homo sapiens
ugucugguuuauuuagguu

SEQ ID NO: 506121 - RNA, 19 nt, Homo sapiens
cauggcuggugccugaaga

SEQ ID NO: 506122 - RNA, 19 nt, Homo sapiens
caaaggcgcugucauguuu

SEQ ID NO: 506123 - RNA, 19 nt, Homo sapiens
gaacaaaacugcagagaaa

SEQ ID NO: 506124 - RNA, 19 nt, Homo sapiens
gaagggauauuaagaaucu

SEQ ID NO: 506125 - RNA, 19 nt, Homo sapiens
cacuauaucuucccauuua

SEQ ID NO: 506126 - RNA, 19 nt, Homo sapiens
gaacgacuguauauugcua

SEQ ID NO: 506127 - RNA, 19 nt, Homo sapiens
gcacugguuucaagaauau

SEQ ID NO: 506128 - RNA, 19 nt, Homo sapiens
guagauuucugacaucaaa

SEQ ID NO: 506129 - RNA, 19 nt, Homo sapiens
gaacccaccuaaauguuga

SEQ ID NO: 506130 - RNA, 19 nt, Homo sapiens
caccagaccugcccaauga

SEQ ID NO: 506131 - RNA, 19 nt, Homo sapiens
ucaaugagcugcaguugga

SEQ ID NO: 506132 - RNA, 19 nt, Homo sapiens
gaagugagcaagcuaaaug

SEQ ID NO: 506133 - RNA, 19 nt, Homo sapiens
ggaaggaaauaaacauuac

SEQ ID NO: 506134 - RNA, 19 nt, Homo sapiens
ccaagaagcuaccaaacug

SEQ ID NO: 506135 - RNA, 19 nt, Homo sapiens
gauaaggagucacaucugu

SEQ ID NO: 506136 - RNA, 19 nt, Homo sapiens
ccaaacagauccaaaugug

SEQ ID NO: 506137 - RNA, 19 nt, Homo sapiens
ggaauugaacgacuguaua

SEQ ID NO: 506138 - RNA, 19 nt, Homo sapiens
gaagaacccaccuaaaugu

SEQ ID NO: 506139 - RNA, 19 nt, Homo sapiens
ggaaagaauggaaaugauu

SEQ ID NO: 506140 - RNA, 19 nt, Homo sapiens
uaagagggcccaaagaauu

SEQ ID NO: 506141 - RNA, 19 nt, Homo sapiens
ggagguaguuggguagaaa

SEQ ID NO: 506142 - RNA, 19 nt, Homo sapiens
gaaacacaguggcagaugu

SEQ ID NO: 506143 - RNA, 19 nt, Homo sapiens
gaauugaacgacuguauau

SEQ ID NO: 506144 - RNA, 19 nt, Homo sapiens
gaaucugugugcauauuug

SEQ ID NO: 506145 - RNA, 19 nt, Homo sapiens
gaagaagaacccaccuaaa

SEQ ID NO: 506146 - RNA, 19 nt, Homo sapiens
uagaagcacuuaugucaau

SEQ ID NO: 506147 - RNA, 19 nt, Homo sapiens
ggauauaaugugugcuuua

SEQ ID NO: 506148 - RNA, 19 nt, Homo sapiens
uggcuuaugucaucaguaa

SEQ ID NO: 506149 - RNA, 19 nt, Homo sapiens
caacacagguagcacagau

SEQ ID NO: 506150 - RNA, 19 nt, Homo sapiens
gcaguuggaagucugauuu

SEQ ID NO: 506151 - RNA, 19 nt, Homo sapiens
gaaauacguugaaaacaga

SEQ ID NO: 506152 - RNA, 19 nt, Homo sapiens
gaggaaagaauggaaauga

SEQ ID NO: 506153 - RNA, 19 nt, Homo sapiens
gcuaagagggcccaaagaa

SEQ ID NO: 506154 - RNA, 19 nt, Homo sapiens
cuaaagcacugguuucaag

SEQ ID NO: 506155 - RNA, 19 nt, Homo sapiens
uauauuggguguagauuuc

SEQ ID NO: 506156 - RNA, 19 nt, Homo sapiens
caaauguuguccuguuaau

SEQ ID NO: 506157 - RNA, 19 nt, Homo sapiens
guaucuaggcauuucauua

SEQ ID NO: 506158 - RNA, 19 nt, Homo sapiens
uaagauacacugcacuuug

SEQ ID NO: 506159 - RNA, 19 nt, Homo sapiens
aggcagguuucauuucuua

SEQ ID NO: 506160 - RNA, 19 nt, Homo sapiens
ccacacgggugagaagaaa

SEQ ID NO: 506161 - RNA, 19 nt, Homo sapiens
uggcagauguugaugagaa

SEQ ID NO: 506162 - RNA, 19 nt, Homo sapiens
ucaagucacucucagauac

SEQ ID NO: 506163 - RNA, 19 nt, Homo sapiens
ucucaagugucaaaucuga

SEQ ID NO: 506164 - RNA, 19 nt, Homo sapiens
uauggaggcuggaaggaaa

SEQ ID NO: 506165 - RNA, 19 nt, Homo sapiens
caugaggagugaccauuug

SEQ ID NO: 506166 - RNA, 19 nt, Homo sapiens
aagaagaacccaccuaaau

SEQ ID NO: 506167 - RNA, 19 nt, Homo sapiens
ugaagcauagcuacaauuu

SEQ ID NO: 506168 - RNA, 19 nt, Homo sapiens
ggagugaccauuugaccaa

SEQ ID NO: 506169 - RNA, 19 nt, Homo sapiens
guaaagaagggauauuaag

SEQ ID NO: 506170 - RNA, 19 nt, Homo sapiens
caaaagagaguauguauuc

SEQ ID NO: 506171 - RNA, 19 nt, Homo sapiens
uaagagagaugagaaagcu

SEQ ID NO: 506172 - RNA, 19 nt, Homo sapiens
uuacaccaguaucugauuu

SEQ ID NO: 506173 - RNA, 19 nt, Homo sapiens
gggagccaguggugaugua

SEQ ID NO: 506174 - RNA, 19 nt, Homo sapiens
ucaacuaucagaacaauuc

SEQ ID NO: 506175 - RNA, 19 nt, Homo sapiens
acacugcacuuuguuuaga

SEQ ID NO: 506176 - RNA, 19 nt, Homo sapiens
aagauacacugcacuuugu

SEQ ID NO: 506177 - RNA, 19 nt, Homo sapiens
aaacuuggacccuuggaaa

SEQ ID NO: 506178 - RNA, 19 nt, Homo sapiens
gaugaggucaacacaggua

SEQ ID NO: 506179 - RNA, 19 nt, Homo sapiens
aaaggcagguuucauuucu

SEQ ID NO: 506180 - RNA, 19 nt, Homo sapiens
agaacuaacuuuggucuca

SEQ ID NO: 506181 - RNA, 19 nt, Homo sapiens
ugacagaccggaaagugaa

SEQ ID NO: 506182 - RNA, 19 nt, Homo sapiens
agaagaagaacccaccuaa

SEQ ID NO: 506183 - RNA, 19 nt, Homo sapiens
aaaagucacuccucagauu

SEQ ID NO: 506184 - RNA, 19 nt, Homo sapiens
agaagaacccaccuaaaug

SEQ ID NO: 506185 - RNA, 19 nt, Homo sapiens
gaagcacuuaugucaauga

SEQ ID NO: 506186 - RNA, 19 nt, Homo sapiens
ggcaagacauacuuuaaaa

SEQ ID NO: 506187 - RNA, 19 nt, Homo sapiens
cagccagcauccucaacua

SEQ ID NO: 506188 - RNA, 19 nt, Homo sapiens
guauauuggguguagauuu

SEQ ID NO: 506189 - RNA, 19 nt, Homo sapiens
gaggauauaaugugugcuu

SEQ ID NO: 506190 - RNA, 19 nt, Homo sapiens
gaagcauagcuacaauuug

SEQ ID NO: 506191 - RNA, 19 nt, Homo sapiens
caaugugauucuucuaaag

SEQ ID NO: 506192 - RNA, 19 nt, Homo sapiens
ccagcauccucaacuauca

SEQ ID NO: 506193 - RNA, 19 nt, Homo sapiens
gauacacugcacuuuguuu

SEQ ID NO: 506194 - RNA, 19 nt, Homo sapiens
gagaccaacuuuucaaugu

SEQ ID NO: 506195 - RNA, 19 nt, Homo sapiens
caucaaggauaaggaguca

SEQ ID NO: 506196 - RNA, 19 nt, Homo sapiens
ccaaaggcgcugucauguu

SEQ ID NO: 506197 - RNA, 19 nt, Homo sapiens
ggcagauguugaugagaaa

SEQ ID NO: 506198 - RNA, 19 nt, Homo sapiens
accaguaucugauuuguca

SEQ ID NO: 506199 - RNA, 19 nt, Homo sapiens
ggguguagauuucugacau

SEQ ID NO: 506200 - RNA, 19 nt, Homo sapiens
ucuguuauauaguggauga

SEQ ID NO: 506201 - RNA, 19 nt, Homo sapiens
auucacagguggacaaaug

SEQ ID NO: 506202 - RNA, 19 nt, Homo sapiens
gcaguuucuuguguagauu

SEQ ID NO: 506203 - RNA, 19 nt, Homo sapiens
acacagguagcacagauuu

SEQ ID NO: 506204 - RNA, 19 nt, Homo sapiens
cagguuucauuucuuauca

SEQ ID NO: 506205 - RNA, 19 nt, Homo sapiens
ugagcaagcuaaaugacau

SEQ ID NO: 506206 - RNA, 19 nt, Homo sapiens
caaacagauccaaauguga

SEQ ID NO: 506207 - RNA, 19 nt, Homo sapiens
gaaaagagcccaguaucug

SEQ ID NO: 506208 - RNA, 19 nt, Homo sapiens
gacuguauauugcuaagag

SEQ ID NO: 506209 - RNA, 19 nt, Homo sapiens
ugaacccucucaaguguca

SEQ ID NO: 506210 - RNA, 19 nt, Homo sapiens
gucacuauaucuucccauu

SEQ ID NO: 506211 - RNA, 19 nt, Homo sapiens
agagagaugagaaagcuuu

SEQ ID NO: 506212 - RNA, 19 nt, Homo sapiens
uguagaagcacuuauguca

SEQ ID NO: 506213 - RNA, 19 nt, Homo sapiens
ggaaagugaagagucagaa

SEQ ID NO: 506214 - RNA, 19 nt, Homo sapiens
gauccaaaugugagagaaa

SEQ ID NO: 506215 - RNA, 19 nt, Homo sapiens
acaagugugauucgucaua

SEQ ID NO: 506216 - RNA, 19 nt, Homo sapiens
gcucaggcaacaaguguga

SEQ ID NO: 506217 - RNA, 19 nt, Homo sapiens
gaagcuguagaagcacuua

SEQ ID NO: 506218 - RNA, 19 nt, Homo sapiens
uggcaagacauacuuuaaa

SEQ ID NO: 506219 - RNA, 19 nt, Homo sapiens
gaagaaaagagcccaguau

SEQ ID NO: 506220 - RNA, 19 nt, Homo sapiens
auacacugcacuuuguuua

SEQ ID NO: 506221 - RNA, 19 nt, Homo sapiens
ucugugugcauauuuguua

SEQ ID NO: 506222 - RNA, 19 nt, Homo sapiens
gaaggugccucaagaauuu

SEQ ID NO: 506223 - RNA, 19 nt, Homo sapiens
gaaaugaucccuauuguuu

SEQ ID NO: 506224 - RNA, 19 nt, Homo sapiens
gaucucagcccacaaauua

SEQ ID NO: 506225 - RNA, 19 nt, Homo sapiens
ccaaacagcuaucauauga

SEQ ID NO: 506226 - RNA, 19 nt, Homo sapiens
gaaacaagaugcuggaugu

SEQ ID NO: 506227 - RNA, 19 nt, Homo sapiens
gaagacaaaucagaacuaa

SEQ ID NO: 506228 - RNA, 19 nt, Homo sapiens
ucagauggauugauaauug

SEQ ID NO: 506229 - RNA, 19 nt, Homo sapiens
gaaguagugugcaguucua

SEQ ID NO: 506230 - RNA, 19 nt, Homo sapiens
ccaagcaacuguacuguau

SEQ ID NO: 506231 - RNA, 19 nt, Homo sapiens
ggauacagcuggaaaugau

SEQ ID NO: 506232 - RNA, 19 nt, Homo sapiens
guaaggaagucaaagugaa

SEQ ID NO: 506233 - RNA, 19 nt, Homo sapiens
cauaaccgcuuaaacgauu

SEQ ID NO: 506234 - RNA, 19 nt, Homo sapiens
gacaugagauuuauaaggu

SEQ ID NO: 506235 - RNA, 19 nt, Homo sapiens
ggaaaugcacaacaaauug

SEQ ID NO: 506236 - RNA, 19 nt, Homo sapiens
gcaaaugucagauacaaug

SEQ ID NO: 506237 - RNA, 19 nt, Homo sapiens
guaaaucagucuaguccaa

SEQ ID NO: 506238 - RNA, 19 nt, Homo sapiens
gcauucaucuuguguuuua

SEQ ID NO: 506239 - RNA, 19 nt, Homo sapiens
caacuguacuguauacugu

SEQ ID NO: 506240 - RNA, 19 nt, Homo sapiens
ccacuauccuguagccaua

SEQ ID NO: 506241 - RNA, 19 nt, Homo sapiens
gauaauugcauucaucuug

SEQ ID NO: 506242 - RNA, 19 nt, Homo sapiens
aaacacaaaugcagggauu

SEQ ID NO: 506243 - RNA, 19 nt, Homo sapiens
agaauuuccuguuggauuu

SEQ ID NO: 506244 - RNA, 19 nt, Homo sapiens
gcaaguuccugcauaugga

SEQ ID NO: 506245 - RNA, 19 nt, Homo sapiens
gaaacccagugaauaagga

SEQ ID NO: 506246 - RNA, 19 nt, Homo sapiens
gcaauuguuucuguuaaug

SEQ ID NO: 506247 - RNA, 19 nt, Homo sapiens
gaacaacuaaugcgucaga

SEQ ID NO: 506248 - RNA, 19 nt, Homo sapiens
gacggaagauaauggguaa

SEQ ID NO: 506249 - RNA, 19 nt, Homo sapiens
caacaaauuggccaguaua

SEQ ID NO: 506250 - RNA, 19 nt, Homo sapiens
ggacaaauaauggaaauuc

SEQ ID NO: 506251 - RNA, 19 nt, Homo sapiens
gcccacaaauuacaacuga

SEQ ID NO: 506252 - RNA, 19 nt, Homo sapiens
uaugaaacccagugaauaa

SEQ ID NO: 506253 - RNA, 19 nt, Homo sapiens
gaagauaauggguaaggaa

SEQ ID NO: 506254 - RNA, 19 nt, Homo sapiens
ggaagacaaaucagaacua

SEQ ID NO: 506255 - RNA, 19 nt, Homo sapiens
guauggaaaugcacaacaa

SEQ ID NO: 506256 - RNA, 19 nt, Homo sapiens
ugugucaacuucaacauuu

SEQ ID NO: 506257 - RNA, 19 nt, Homo sapiens
gauaaacuuugcuguguac

SEQ ID NO: 506258 - RNA, 19 nt, Homo sapiens
ccucaagaauuuccuguug

SEQ ID NO: 506259 - RNA, 19 nt, Homo sapiens
ugucccaucuccacuguua

SEQ ID NO: 506260 - RNA, 19 nt, Homo sapiens
gaaagccucccgcuccaaa

SEQ ID NO: 506261 - RNA, 19 nt, Homo sapiens
ggaaaugaucccuauuguu

SEQ ID NO: 506262 - RNA, 19 nt, Homo sapiens
uuucucagauggauugaua

SEQ ID NO: 506263 - RNA, 19 nt, Homo sapiens
gaauaaggacuccagaauc

SEQ ID NO: 506264 - RNA, 19 nt, Homo sapiens
guacauaugagucaaauac

SEQ ID NO: 506265 - RNA, 19 nt, Homo sapiens
gcuaacagaacaacuaaug

SEQ ID NO: 506266 - RNA, 19 nt, Homo sapiens
gcaaucauuuccaugucuu

SEQ ID NO: 506267 - RNA, 19 nt, Homo sapiens
ugauaaacuuugcugugua

SEQ ID NO: 506268 - RNA, 19 nt, Homo sapiens
guaugaaacccagugaaua

SEQ ID NO: 506269 - RNA, 19 nt, Homo sapiens
caacagcagaaucaaauug

SEQ ID NO: 506270 - RNA, 19 nt, Homo sapiens
gugauaaacuuugcugugu

SEQ ID NO: 506271 - RNA, 19 nt, Homo sapiens
gugcaaaugucagauacaa

SEQ ID NO: 506272 - RNA, 19 nt, Homo sapiens
aauaaggacuccagaaucu

SEQ ID NO: 506273 - RNA, 19 nt, Homo sapiens
caacaaaugggaugcugaa

SEQ ID NO: 506274 - RNA, 19 nt, Homo sapiens
ugauaaaguuucucagauc

SEQ ID NO: 506275 - RNA, 19 nt, Homo sapiens
uaaggacuccagaaucuaa

SEQ ID NO: 506276 - RNA, 19 nt, Homo sapiens
caacuaaugcgucagacuu

SEQ ID NO: 506277 - RNA, 19 nt, Homo sapiens
caggaaagucuaagggaua

SEQ ID NO: 506278 - RNA, 19 nt, Homo sapiens
gcaacucuuuagccagauu

SEQ ID NO: 506279 - RNA, 19 nt, Homo sapiens
gaguugacaugagauuuau

SEQ ID NO: 506280 - RNA, 19 nt, Homo sapiens
agaguugacaugagauuua

SEQ ID NO: 506281 - RNA, 19 nt, Homo sapiens
ucugaaaugugauaaguuc

SEQ ID NO: 506282 - RNA, 19 nt, Homo sapiens
ucaagaauuuccuguugga

SEQ ID NO: 506283 - RNA, 19 nt, Homo sapiens
ucaaaucagucagugcaaa

SEQ ID NO: 506284 - RNA, 19 nt, Homo sapiens
gccaguauaugccuaaugg

SEQ ID NO: 506285 - RNA, 19 nt, Homo sapiens
ugaaggucauguugugaaa

SEQ ID NO: 506286 - RNA, 19 nt, Homo sapiens
gauaauggguaaggaaguc

SEQ ID NO: 506287 - RNA, 19 nt, Homo sapiens
uaugauaaaucccgugcaa

SEQ ID NO: 506288 - RNA, 19 nt, Homo sapiens
ggaagauaauggguaagga

SEQ ID NO: 506289 - RNA, 19 nt, Homo sapiens
caaauuggccaguauaugc

SEQ ID NO: 506290 - RNA, 19 nt, Homo sapiens
gaaaugcacaacaaauugg

SEQ ID NO: 506291 - RNA, 19 nt, Homo sapiens
auucgagucuuuccagaua

SEQ ID NO: 506292 - RNA, 19 nt, Homo sapiens
aauggaaauucgagucuuu

SEQ ID NO: 506293 - RNA, 19 nt, Homo sapiens
gauauggcuuugucuccuu

SEQ ID NO: 506294 - RNA, 19 nt, Homo sapiens
uaagggauauggcuuuguc

SEQ ID NO: 506295 - RNA, 19 nt, Homo sapiens
gugucaacuucaacauuua

SEQ ID NO: 506296 - RNA, 19 nt, Homo sapiens
ugucuugccuuauuaaagu

SEQ ID NO: 506297 - RNA, 19 nt, Homo sapiens
gcauuccugauaugauuua

SEQ ID NO: 506298 - RNA, 19 nt, Homo sapiens
uuacuuaucauccacauug

SEQ ID NO: 506299 - RNA, 19 nt, Homo sapiens
gagaaggugccucaagaau

SEQ ID NO: 506300 - RNA, 19 nt, Homo sapiens
ccuaaugguuggcaaguuc

SEQ ID NO: 506301 - RNA, 19 nt, Homo sapiens
ucaaauaccaaacagcuau

SEQ ID NO: 506302 - RNA, 19 nt, Homo sapiens
ucgguaaccuuuccagaga

SEQ ID NO: 506303 - RNA, 19 nt, Homo sapiens
guuggcaaguuccugcaua

SEQ ID NO: 506304 - RNA, 19 nt, Homo sapiens
caaagugaauugggcaaca

SEQ ID NO: 506305 - RNA, 19 nt, Homo sapiens
gguaaggaagucaaaguga

SEQ ID NO: 506306 - RNA, 19 nt, Homo sapiens
gcaaaaugauuauggauac

SEQ ID NO: 506307 - RNA, 19 nt, Homo sapiens
caacuucaacauuuacaug

SEQ ID NO: 506308 - RNA, 19 nt, Homo sapiens
gcacaauucuguuuuaggu

SEQ ID NO: 506309 - RNA, 19 nt, Homo sapiens
uaaaguuucucagauccuu

SEQ ID NO: 506310 - RNA, 19 nt, Homo sapiens
caaucagccuucuggguau

SEQ ID NO: 506311 - RNA, 19 nt, Homo sapiens
cacaacaaauuggccagua

SEQ ID NO: 506312 - RNA, 19 nt, Homo sapiens
uaaguuguuugcaugugaa

SEQ ID NO: 506313 - RNA, 19 nt, Homo sapiens
uuaaguuguuugcauguga

SEQ ID NO: 506314 - RNA, 19 nt, Homo sapiens
gguaugaaacccagugaau

SEQ ID NO: 506315 - RNA, 19 nt, Homo sapiens
gcagcauguugcccaauca

SEQ ID NO: 506316 - RNA, 19 nt, Homo sapiens
acaacaaauuggccaguau

SEQ ID NO: 506317 - RNA, 19 nt, Homo sapiens
cauugaaggucauguugug

SEQ ID NO: 506318 - RNA, 19 nt, Homo sapiens
gggcuaacagaacaacuaa

SEQ ID NO: 506319 - RNA, 19 nt, Homo sapiens
uugcauuccugauaugauu

SEQ ID NO: 506320 - RNA, 19 nt, Homo sapiens
ugaauaaggacuccagaau

SEQ ID NO: 506321 - RNA, 19 nt, Homo sapiens
cuaauucugcaacucuuua

SEQ ID NO: 506322 - RNA, 19 nt, Homo sapiens
gaaggugccucaagaauuu

SEQ ID NO: 506323 - RNA, 19 nt, Homo sapiens
gaaaugaucccuauuguuu

SEQ ID NO: 506324 - RNA, 19 nt, Homo sapiens
gaucucagcccacaaauua

SEQ ID NO: 506325 - RNA, 19 nt, Homo sapiens
ccaaacagcuaucauauga

SEQ ID NO: 506326 - RNA, 19 nt, Homo sapiens
gaaacaagaugcuggaugu

SEQ ID NO: 506327 - RNA, 19 nt, Homo sapiens
gaagacaaaucagaacuaa

SEQ ID NO: 506328 - RNA, 19 nt, Homo sapiens
ucagauggauugauaauug

SEQ ID NO: 506329 - RNA, 19 nt, Homo sapiens
gaaguagugugcaguucua

SEQ ID NO: 506330 - RNA, 19 nt, Homo sapiens
ccaagcaacuguacuguau

SEQ ID NO: 506331 - RNA, 19 nt, Homo sapiens
ggauacagcuggaaaugau

SEQ ID NO: 506332 - RNA, 19 nt, Homo sapiens
gcacacagcguucacaaga

SEQ ID NO: 506333 - RNA, 19 nt, Homo sapiens
guaaggaagucaaagugaa

SEQ ID NO: 506334 - RNA, 19 nt, Homo sapiens
cauaaccgcuuaaacgauu

SEQ ID NO: 506335 - RNA, 19 nt, Homo sapiens
gacaugagauuuauaaggu

SEQ ID NO: 506336 - RNA, 19 nt, Homo sapiens
ggaaaugcacaacaaauug

SEQ ID NO: 506337 - RNA, 19 nt, Homo sapiens
gcaaaugucagauacaaug

SEQ ID NO: 506338 - RNA, 19 nt, Homo sapiens
guaaaucagucuaguccaa

SEQ ID NO: 506339 - RNA, 19 nt, Homo sapiens
gcauucaucuuguguuuua

SEQ ID NO: 506340 - RNA, 19 nt, Homo sapiens
ccacuauccuguagccaua

SEQ ID NO: 506341 - RNA, 19 nt, Homo sapiens
caacuguacuguauacugu

SEQ ID NO: 506342 - RNA, 19 nt, Homo sapiens
gauaauugcauucaucuug

SEQ ID NO: 506343 - RNA, 19 nt, Homo sapiens
aaacacaaaugcagggauu

SEQ ID NO: 506344 - RNA, 19 nt, Homo sapiens
agaauuuccuguuggauuu

SEQ ID NO: 506345 - RNA, 19 nt, Homo sapiens
gcaaguuccugcauaugga

SEQ ID NO: 506346 - RNA, 19 nt, Homo sapiens
gaaacccagugaauaagga

SEQ ID NO: 506347 - RNA, 19 nt, Homo sapiens
gcaauuguuucuguuaaug

SEQ ID NO: 506348 - RNA, 19 nt, Homo sapiens
gaacaacuaaugcgucaga

SEQ ID NO: 506349 - RNA, 19 nt, Homo sapiens
gacggaagauaauggguaa

SEQ ID NO: 506350 - RNA, 19 nt, Homo sapiens
caacaaauuggccaguaua

SEQ ID NO: 506351 - RNA, 19 nt, Homo sapiens
ggacaaauaauggaaauuc

SEQ ID NO: 506352 - RNA, 19 nt, Homo sapiens
gcccacaaauuacaacuga

SEQ ID NO: 506353 - RNA, 19 nt, Homo sapiens
uaugaaacccagugaauaa

SEQ ID NO: 506354 - RNA, 19 nt, Homo sapiens
gaagauaauggguaaggaa

SEQ ID NO: 506355 - RNA, 19 nt, Homo sapiens
ggaagacaaaucagaacua

SEQ ID NO: 506356 - RNA, 19 nt, Homo sapiens
aaagauacaagcaguagua

SEQ ID NO: 506357 - RNA, 19 nt, Homo sapiens
guauggaaaugcacaacaa

SEQ ID NO: 506358 - RNA, 19 nt, Homo sapiens
ugugucaacuucaacauuu

SEQ ID NO: 506359 - RNA, 19 nt, Homo sapiens
gauaaacuuugcuguguac

SEQ ID NO: 506360 - RNA, 19 nt, Homo sapiens
ccucaagaauuuccuguug

SEQ ID NO: 506361 - RNA, 19 nt, Homo sapiens
ugucccaucuccacuguua

SEQ ID NO: 506362 - RNA, 19 nt, Homo sapiens
gaaagccucccgcuccaaa

SEQ ID NO: 506363 - RNA, 19 nt, Homo sapiens
ggaaaugaucccuauuguu

SEQ ID NO: 506364 - RNA, 19 nt, Homo sapiens
uuucucagauggauugaua

SEQ ID NO: 506365 - RNA, 19 nt, Homo sapiens
gaauaaggacuccagaauc

SEQ ID NO: 506366 - RNA, 19 nt, Homo sapiens
guacauaugagucaaauac

SEQ ID NO: 506367 - RNA, 19 nt, Homo sapiens
gcuaacagaacaacuaaug

SEQ ID NO: 506368 - RNA, 19 nt, Homo sapiens
ugauaaacuuugcugugua

SEQ ID NO: 506369 - RNA, 19 nt, Homo sapiens
guaugaaacccagugaaua

SEQ ID NO: 506370 - RNA, 19 nt, Homo sapiens
caacagcagaaucaaauug

SEQ ID NO: 506371 - RNA, 19 nt, Homo sapiens
gugauaaacuuugcugugu

SEQ ID NO: 506372 - RNA, 19 nt, Homo sapiens
gugcaaaugucagauacaa

SEQ ID NO: 506373 - RNA, 19 nt, Homo sapiens
aauaaggacuccagaaucu

SEQ ID NO: 506374 - RNA, 19 nt, Homo sapiens
caacaaaugggaugcugaa

SEQ ID NO: 506375 - RNA, 19 nt, Homo sapiens
ugauaaaguuucucagauc

SEQ ID NO: 506376 - RNA, 19 nt, Homo sapiens
uaaggacuccagaaucuaa

SEQ ID NO: 506377 - RNA, 19 nt, Homo sapiens
caacuaaugcgucagacuu

SEQ ID NO: 506378 - RNA, 19 nt, Homo sapiens
caggaaagucuaagggaua

SEQ ID NO: 506379 - RNA, 19 nt, Homo sapiens
gcaacucuuuagccagauu

SEQ ID NO: 506380 - RNA, 19 nt, Homo sapiens
gaguugacaugagauuuau

SEQ ID NO: 506381 - RNA, 19 nt, Homo sapiens
agaguugacaugagauuua

SEQ ID NO: 506382 - RNA, 19 nt, Homo sapiens
ucugaaaugugauaaguuc

SEQ ID NO: 506383 - RNA, 19 nt, Homo sapiens
ucaagaauuuccuguugga

SEQ ID NO: 506384 - RNA, 19 nt, Homo sapiens
ucaaaucagucagugcaaa

SEQ ID NO: 506385 - RNA, 19 nt, Homo sapiens
gccaguauaugccuaaugg

SEQ ID NO: 506386 - RNA, 19 nt, Homo sapiens
ugaaggucauguugugaaa

SEQ ID NO: 506387 - RNA, 19 nt, Homo sapiens
gauaauggguaaggaaguc

SEQ ID NO: 506388 - RNA, 19 nt, Homo sapiens
uaugauaaaucccgugcaa

SEQ ID NO: 506389 - RNA, 19 nt, Homo sapiens
caagaucauuuccaugucu

SEQ ID NO: 506390 - RNA, 19 nt, Homo sapiens
ggaagauaauggguaagga

SEQ ID NO: 506391 - RNA, 19 nt, Homo sapiens
caaauuggccaguauaugc

SEQ ID NO: 506392 - RNA, 19 nt, Homo sapiens
gaaaugcacaacaaauugg

SEQ ID NO: 506393 - RNA, 19 nt, Homo sapiens
auucgagucuuuccagaua

SEQ ID NO: 506394 - RNA, 19 nt, Homo sapiens
aauggaaauucgagucuuu

SEQ ID NO: 506395 - RNA, 19 nt, Homo sapiens
gauauggcuuugucuccuu

SEQ ID NO: 506396 - RNA, 19 nt, Homo sapiens
uaagggauauggcuuuguc

SEQ ID NO: 506397 - RNA, 19 nt, Homo sapiens
gugucaacuucaacauuua

SEQ ID NO: 506398 - RNA, 19 nt, Homo sapiens
ugucuugccuuauuaaagu

SEQ ID NO: 506399 - RNA, 19 nt, Homo sapiens
gcauuccugauaugauuua

SEQ ID NO: 506400 - RNA, 19 nt, Homo sapiens
uuacuuaucauccacauug

SEQ ID NO: 506401 - RNA, 19 nt, Homo sapiens
gagaaggugccucaagaau

SEQ ID NO: 506402 - RNA, 19 nt, Homo sapiens
ccuaaugguuggcaaguuc

SEQ ID NO: 506403 - RNA, 19 nt, Homo sapiens
ucaaauaccaaacagcuau

SEQ ID NO: 506404 - RNA, 19 nt, Homo sapiens
ucgguaaccuuuccagaga

SEQ ID NO: 506405 - RNA, 19 nt, Homo sapiens
guuggcaaguuccugcaua

SEQ ID NO: 506406 - RNA, 19 nt, Homo sapiens
caaagugaauugggcaaca

SEQ ID NO: 506407 - RNA, 19 nt, Homo sapiens
gguaaggaagucaaaguga

SEQ ID NO: 506408 - RNA, 19 nt, Homo sapiens
gcaaaaugauuauggauac

SEQ ID NO: 506409 - RNA, 19 nt, Homo sapiens
caacuucaacauuuacaug

SEQ ID NO: 506410 - RNA, 19 nt, Homo sapiens
gcacaauucuguuuuaggu

SEQ ID NO: 506411 - RNA, 19 nt, Homo sapiens
uaaaguuucucagauccuu

SEQ ID NO: 506412 - RNA, 19 nt, Homo sapiens
caaucagccuucuggguau

SEQ ID NO: 506413 - RNA, 19 nt, Homo sapiens
cacaacaaauuggccagua

SEQ ID NO: 506414 - RNA, 19 nt, Homo sapiens
acacagcguucacaagauc

SEQ ID NO: 506415 - RNA, 19 nt, Homo sapiens
uaaguuguuugcaugugaa

SEQ ID NO: 506416 - RNA, 19 nt, Homo sapiens
uuaaguuguuugcauguga

SEQ ID NO: 506417 - RNA, 19 nt, Homo sapiens
gguaugaaacccagugaau

SEQ ID NO: 506418 - RNA, 19 nt, Homo sapiens
gcagcauguugcccaauca

SEQ ID NO: 506419 - RNA, 19 nt, Homo sapiens
acaacaaauuggccaguau

SEQ ID NO: 506420 - RNA, 19 nt, Homo sapiens
cauugaaggucauguugug

SEQ ID NO: 506421 - RNA, 19 nt, Homo sapiens
gggcuaacagaacaacuaa

SEQ ID NO: 506422 - RNA, 19 nt, Homo sapiens
gaaaggaggucaaaguaaa

SEQ ID NO: 506423 - RNA, 19 nt, Homo sapiens
gauaugguauggcaaguua

SEQ ID NO: 506424 - RNA, 19 nt, Homo sapiens
uaaagaaucuccugauaug

SEQ ID NO: 506425 - RNA, 19 nt, Homo sapiens
gguaaagaaucuccugaua

SEQ ID NO: 506426 - RNA, 19 nt, Homo sapiens
gaaaagggcuauucauuug

SEQ ID NO: 506427 - RNA, 19 nt, Homo sapiens
gcaaauggguggcaaguac

SEQ ID NO: 506428 - RNA, 19 nt, Homo sapiens
ggaaaggaggucaaaguaa

SEQ ID NO: 506429 - RNA, 19 nt, Homo sapiens
caacaaggauuuggaguag

SEQ ID NO: 506430 - RNA, 19 nt, Homo sapiens
uaacagagcauacaagcaa

SEQ ID NO: 506431 - RNA, 19 nt, Homo sapiens
ugaaauguuuggaaccuuu

SEQ ID NO: 506432 - RNA, 19 nt, Homo sapiens
ggaauugcgucuggguuaa

SEQ ID NO: 506433 - RNA, 19 nt, Homo sapiens
guaaagaaucuccugauau

SEQ ID NO: 506434 - RNA, 19 nt, Homo sapiens
guugagauuugaagaugua

SEQ ID NO: 506435 - RNA, 19 nt, Homo sapiens
caacagaagauaucaaauc

SEQ ID NO: 506436 - RNA, 19 nt, Homo sapiens
gacaguauauggcaaaugg

SEQ ID NO: 506437 - RNA, 19 nt, Homo sapiens
cagaucagcuuaugagaca

SEQ ID NO: 506438 - RNA, 19 nt, Homo sapiens
uaaaccaccugcaccuaaa

SEQ ID NO: 506439 - RNA, 19 nt, Homo sapiens
gggaaaggaggucaaagua

SEQ ID NO: 506440 - RNA, 19 nt, Homo sapiens
gcuauucauuugucagauu

SEQ ID NO: 506441 - RNA, 19 nt, Homo sapiens
gacaugugguuaaaugcua

SEQ ID NO: 506442 - RNA, 19 nt, Homo sapiens
guaaaccaccugcaccuaa

SEQ ID NO: 506443 - RNA, 19 nt, Homo sapiens
gaaauguuuggaaccuuua

SEQ ID NO: 506444 - RNA, 19 nt, Homo sapiens
ugaaggacaugugguuaaa

SEQ ID NO: 506445 - RNA, 19 nt, Homo sapiens
gaacgguacuacgauugaa

SEQ ID NO: 506446 - RNA, 19 nt, Homo sapiens
acacuaagcaguugagauu

SEQ ID NO: 506447 - RNA, 19 nt, Homo sapiens
cgucaaauccgaaccaauu

SEQ ID NO: 506448 - RNA, 19 nt, Homo sapiens
guccagaaauuacaacaga

SEQ ID NO: 506449 - RNA, 19 nt, Homo sapiens
uaaagacaauucugacuac

SEQ ID NO: 506450 - RNA, 19 nt, Homo sapiens
gcaaguaccgccuuaugga

SEQ ID NO: 506451 - RNA, 19 nt, Homo sapiens
gagauuugaagauguagua

SEQ ID NO: 506452 - RNA, 19 nt, Homo sapiens
ccagagaugugacagaagu

SEQ ID NO: 506453 - RNA, 19 nt, Homo sapiens
guaaaccagucaaguccaa

SEQ ID NO: 506454 - RNA, 19 nt, Homo sapiens
ggagccaaguguauggaaa

SEQ ID NO: 506455 - RNA, 19 nt, Homo sapiens
gaagauaucaaaucagcau

SEQ ID NO: 506456 - RNA, 19 nt, Homo sapiens
ugacagaaguccuuauacu

SEQ ID NO: 506457 - RNA, 19 nt, Homo sapiens
gaaaguagacaucggaaaa

SEQ ID NO: 506458 - RNA, 19 nt, Homo sapiens
ggugaacgguacuacgauu

SEQ ID NO: 506459 - RNA, 19 nt, Homo sapiens
cauauugcuuuguggaauu

SEQ ID NO: 506460 - RNA, 19 nt, Homo sapiens
ccaauugggccacucguaa

SEQ ID NO: 506461 - RNA, 19 nt, Homo sapiens
guuaacagaucagcuuaug

SEQ ID NO: 506462 - RNA, 19 nt, Homo sapiens
gaaccuuuagcacagauuu

SEQ ID NO: 506463 - RNA, 19 nt, Homo sapiens
guagaucaaucaccuucug

SEQ ID NO: 506464 - RNA, 19 nt, Homo sapiens
caugauaggcuucgauuuc

SEQ ID NO: 506465 - RNA, 19 nt, Homo sapiens
ucaacaaggauuuggagua

SEQ ID NO: 506466 - RNA, 19 nt, Homo sapiens
gguggcaaguaccgccuua

SEQ ID NO: 506467 - RNA, 19 nt, Homo sapiens
agacagacauucucaccau

SEQ ID NO: 506468 - RNA, 19 nt, Homo sapiens
uaacagaucagcuuaugag

SEQ ID NO: 506469 - RNA, 19 nt, Homo sapiens
acaaggauuuggaguagau

SEQ ID NO: 506470 - RNA, 19 nt, Homo sapiens
uaacaaacuggaugcagaa

SEQ ID NO: 506471 - RNA, 19 nt, Homo sapiens
uacaagcaaugacccauau

SEQ ID NO: 506472 - RNA, 19 nt, Homo sapiens
cugaagacaugaaaguaga

SEQ ID NO: 506473 - RNA, 19 nt, Homo sapiens
aaggacaugugguuaaaug

SEQ ID NO: 506474 - RNA, 19 nt, Homo sapiens
gacagacauucucaccauu

SEQ ID NO: 506475 - RNA, 19 nt, Homo sapiens
acuaagcaguugagauuug

SEQ ID NO: 506476 - RNA, 19 nt, Homo sapiens
cagacauucucaccauuug

SEQ ID NO: 506477 - RNA, 19 nt, Homo sapiens
cuaagcaguugagauuuga

SEQ ID NO: 506478 - RNA, 19 nt, Homo sapiens
gugacacucugaagacaug

SEQ ID NO: 506479 - RNA, 19 nt, Homo sapiens
ccaaucacuuccauguguu

SEQ ID NO: 506480 - RNA, 19 nt, Homo sapiens
gguaaccuuuccagagaug

SEQ ID NO: 506481 - RNA, 19 nt, Homo sapiens
aggcuucgauuuccuguga

SEQ ID NO: 506482 - RNA, 19 nt, Homo sapiens
acaacaguauggacaguau

SEQ ID NO: 506483 - RNA, 19 nt, Homo sapiens
aaagauacuuccaaucacu

SEQ ID NO: 506484 - RNA, 19 nt, Homo sapiens
gggcaaccauggaaucaac

SEQ ID NO: 506485 - RNA, 19 nt, Homo sapiens
caaacuggaugcagaaaau

SEQ ID NO: 506486 - RNA, 19 nt, Homo sapiens
caacaguauggacaguaua

SEQ ID NO: 506487 - RNA, 19 nt, Homo sapiens
ccaauggagccaaguguau

SEQ ID NO: 506488 - RNA, 19 nt, Homo sapiens
guaguaaaccagucaaguc

SEQ ID NO: 506489 - RNA, 19 nt, Homo sapiens
ucacuuccauguguuuguu

SEQ ID NO: 506490 - RNA, 19 nt, Homo sapiens
uccaaucacuuccaugugu

SEQ ID NO: 506491 - RNA, 19 nt, Homo sapiens
ugauggauaugaacaugau

SEQ ID NO: 506492 - RNA, 19 nt, Homo sapiens
uguaauaccuccuccuaac

SEQ ID NO: 506493 - RNA, 19 nt, Homo sapiens
caguugagauuugaagaug

SEQ ID NO: 506494 - RNA, 19 nt, Homo sapiens
ggaauuuuaugaacacaga

SEQ ID NO: 506495 - RNA, 19 nt, Homo sapiens
acacgugucuucuaguucu

SEQ ID NO: 506496 - RNA, 19 nt, Homo sapiens
gauuugcuuuggugaagga

SEQ ID NO: 506497 - RNA, 19 nt, Homo sapiens
aaaguaaacugggcaacca

SEQ ID NO: 506498 - RNA, 19 nt, Homo sapiens
gauugaaggacaugugguu

SEQ ID NO: 506499 - RNA, 19 nt, Homo sapiens
gcaguugagauuugaagau

SEQ ID NO: 506500 - RNA, 19 nt, Homo sapiens
caauugggccacucguaaa

SEQ ID NO: 506501 - RNA, 19 nt, Homo sapiens
gaucagcuuaugagacaga

SEQ ID NO: 506502 - RNA, 19 nt, Homo sapiens
gcuaugguuuuguaucuuu

SEQ ID NO: 506503 - RNA, 19 nt, Homo sapiens
ccauauugcuuuguggaau

SEQ ID NO: 506504 - RNA, 19 nt, Homo sapiens
uauggcaaguuaccaaaca

SEQ ID NO: 506505 - RNA, 19 nt, Homo sapiens
aaagggcuauucauuuguc

SEQ ID NO: 506506 - RNA, 19 nt, Homo sapiens
ugacccauauugcuuugug

SEQ ID NO: 506507 - RNA, 19 nt, Homo sapiens
ugugacagaaguccuuaua

SEQ ID NO: 506508 - RNA, 19 nt, Homo sapiens
gcaaguuaccaaacacagu

SEQ ID NO: 506509 - RNA, 19 nt, Homo sapiens
gccaauggagccaagugua

SEQ ID NO: 506510 - RNA, 19 nt, Homo sapiens
acagacauucucaccauuu

SEQ ID NO: 506511 - RNA, 19 nt, Homo sapiens
cagauuugcuuuggugaag

SEQ ID NO: 506512 - RNA, 19 nt, Homo sapiens
ggaaacccacaacaguaug

SEQ ID NO: 506513 - RNA, 19 nt, Homo sapiens
gaugugacagaaguccuua

SEQ ID NO: 506514 - RNA, 19 nt, Homo sapiens
agaaaagggcuauucauuu

SEQ ID NO: 506515 - RNA, 19 nt, Homo sapiens
aggaauugcgucuggguua

SEQ ID NO: 506516 - RNA, 19 nt, Homo sapiens
uguguacuguggaggaauu

SEQ ID NO: 506517 - RNA, 19 nt, Homo sapiens
aauaagaguuuucccagaa

SEQ ID NO: 506518 - RNA, 19 nt, Homo sapiens
gacauucucaccauuugga

SEQ ID NO: 506519 - RNA, 19 nt, Homo sapiens
ccacaacaguauggacagu

SEQ ID NO: 506520 - RNA, 19 nt, Homo sapiens
ugaacgguacuacgauuga

SEQ ID NO: 506521 - RNA, 19 nt, Homo sapiens
ccggguaguuaaagacaug

SEQ ID NO: 506522 - RNA, 19 nt, Homo sapiens
gaaaggaggucaaaguaaa

SEQ ID NO: 506523 - RNA, 19 nt, Homo sapiens
gauaugguauggcaaguua

SEQ ID NO: 506524 - RNA, 19 nt, Homo sapiens
uaaagaaucuccugauaug

SEQ ID NO: 506525 - RNA, 19 nt, Homo sapiens
gguaaagaaucuccugaua

SEQ ID NO: 506526 - RNA, 19 nt, Homo sapiens
gaaaagggcuauucauuug

SEQ ID NO: 506527 - RNA, 19 nt, Homo sapiens
gcauauagcuacuuucagu

SEQ ID NO: 506528 - RNA, 19 nt, Homo sapiens
gcaaauggguggcaaguac

SEQ ID NO: 506529 - RNA, 19 nt, Homo sapiens
ggaaaggaggucaaaguaa

SEQ ID NO: 506530 - RNA, 19 nt, Homo sapiens
caacaaggauuuggaguag

SEQ ID NO: 506531 - RNA, 19 nt, Homo sapiens
uaacagagcauacaagcaa

SEQ ID NO: 506532 - RNA, 19 nt, Homo sapiens
ugaaauguuuggaaccuuu

SEQ ID NO: 506533 - RNA, 19 nt, Homo sapiens
ggaauugcgucuggguuaa

SEQ ID NO: 506534 - RNA, 19 nt, Homo sapiens
guaaagaaucuccugauau

SEQ ID NO: 506535 - RNA, 19 nt, Homo sapiens
guugagauuugaagaugua

SEQ ID NO: 506536 - RNA, 19 nt, Homo sapiens
caacagaagauaucaaauc

SEQ ID NO: 506537 - RNA, 19 nt, Homo sapiens
gacaguauauggcaaaugg

SEQ ID NO: 506538 - RNA, 19 nt, Homo sapiens
cagaucagcuuaugagaca

SEQ ID NO: 506539 - RNA, 19 nt, Homo sapiens
uaaaccaccugcaccuaaa

SEQ ID NO: 506540 - RNA, 19 nt, Homo sapiens
cauauacgguguuucuuau

SEQ ID NO: 506541 - RNA, 19 nt, Homo sapiens
gggaaaggaggucaaagua

SEQ ID NO: 506542 - RNA, 19 nt, Homo sapiens
gcuauucauuugucagauu

SEQ ID NO: 506543 - RNA, 19 nt, Homo sapiens
gacaugugguuaaaugcua

SEQ ID NO: 506544 - RNA, 19 nt, Homo sapiens
guaaaccaccugcaccuaa

SEQ ID NO: 506545 - RNA, 19 nt, Homo sapiens
gaaauguuuggaaccuuua

SEQ ID NO: 506546 - RNA, 19 nt, Homo sapiens
ugaaggacaugugguuaaa

SEQ ID NO: 506547 - RNA, 19 nt, Homo sapiens
gaacgguacuacgauugaa

SEQ ID NO: 506548 - RNA, 19 nt, Homo sapiens
acacuaagcaguugagauu

SEQ ID NO: 506549 - RNA, 19 nt, Homo sapiens
cgucaaauccgaaccaauu

SEQ ID NO: 506550 - RNA, 19 nt, Homo sapiens
guccagaaauuacaacaga

SEQ ID NO: 506551 - RNA, 19 nt, Homo sapiens
uaaagacaauucugacuac

SEQ ID NO: 506552 - RNA, 19 nt, Homo sapiens
gcaaguaccgccuuaugga

SEQ ID NO: 506553 - RNA, 19 nt, Homo sapiens
gcuaagacauaugguucua

SEQ ID NO: 506554 - RNA, 19 nt, Homo sapiens
gagauuugaagauguagua

SEQ ID NO: 506555 - RNA, 19 nt, Homo sapiens
ccagagaugugacagaagu

SEQ ID NO: 506556 - RNA, 19 nt, Homo sapiens
ucauauacgguguuucuua

SEQ ID NO: 506557 - RNA, 19 nt, Homo sapiens
acagaguccuauucacaua

SEQ ID NO: 506558 - RNA, 19 nt, Homo sapiens
guaaaccagucaaguccaa

SEQ ID NO: 506559 - RNA, 19 nt, Homo sapiens
acacacaagcuaagacaua

SEQ ID NO: 506560 - RNA, 19 nt, Homo sapiens
ggagccaaguguauggaaa

SEQ ID NO: 506561 - RNA, 19 nt, Homo sapiens
uaacagaguccuauucaca

SEQ ID NO: 506562 - RNA, 19 nt, Homo sapiens
gacauaugguucuaucuuc

SEQ ID NO: 506563 - RNA, 19 nt, Homo sapiens
gaagauaucaaaucagcau

SEQ ID NO: 506564 - RNA, 19 nt, Homo sapiens
ugacagaaguccuuauacu

SEQ ID NO: 506565 - RNA, 19 nt, Homo sapiens
gaaaguagacaucggaaaa

SEQ ID NO: 506566 - RNA, 19 nt, Homo sapiens
uaagacauaugguucuauc

SEQ ID NO: 506567 - RNA, 19 nt, Homo sapiens
ggugaacgguacuacgauu

SEQ ID NO: 506568 - RNA, 19 nt, Homo sapiens
cauauugcuuuguggaauu

SEQ ID NO: 506569 - RNA, 19 nt, Homo sapiens
ccaauugggccacucguaa

SEQ ID NO: 506570 - RNA, 19 nt, Homo sapiens
guuaacagaucagcuuaug

SEQ ID NO: 506571 - RNA, 19 nt, Homo sapiens
gaaccuuuagcacagauuu

SEQ ID NO: 506572 - RNA, 19 nt, Homo sapiens
guagaucaaucaccuucug

SEQ ID NO: 506573 - RNA, 19 nt, Homo sapiens
caugauaggcuucgauuuc

SEQ ID NO: 506574 - RNA, 19 nt, Homo sapiens
ucaacaaggauuuggagua

SEQ ID NO: 506575 - RNA, 19 nt, Homo sapiens
gguggcaaguaccgccuua

SEQ ID NO: 506576 - RNA, 19 nt, Homo sapiens
uuucuuauguguucccuaa

SEQ ID NO: 506577 - RNA, 19 nt, Homo sapiens
agacagacauucucaccau

SEQ ID NO: 506578 - RNA, 19 nt, Homo sapiens
uaacagaucagcuuaugag

SEQ ID NO: 506579 - RNA, 19 nt, Homo sapiens
acaaggauuuggaguagau

SEQ ID NO: 506580 - RNA, 19 nt, Homo sapiens
uaacaaacuggaugcagaa

SEQ ID NO: 506581 - RNA, 19 nt, Homo sapiens
uacaagcaaugacccauau

SEQ ID NO: 506582 - RNA, 19 nt, Homo sapiens
cugaagacaugaaaguaga

SEQ ID NO: 506583 - RNA, 19 nt, Homo sapiens
aaggacaugugguuaaaug

SEQ ID NO: 506584 - RNA, 19 nt, Homo sapiens
gacagacauucucaccauu

SEQ ID NO: 506585 - RNA, 19 nt, Homo sapiens
acuaagcaguugagauuug

SEQ ID NO: 506586 - RNA, 19 nt, Homo sapiens
uggguaaccuuuccagaga

SEQ ID NO: 506587 - RNA, 19 nt, Homo sapiens
cagacauucucaccauuug

SEQ ID NO: 506588 - RNA, 19 nt, Homo sapiens
cuaagcaguugagauuuga

SEQ ID NO: 506589 - RNA, 19 nt, Homo sapiens
gugacacucugaagacaug

SEQ ID NO: 506590 - RNA, 19 nt, Homo sapiens
uggaaacucuguaaaauga

SEQ ID NO: 506591 - RNA, 19 nt, Homo sapiens
ccaaucacuuccauguguu

SEQ ID NO: 506592 - RNA, 19 nt, Homo sapiens
aggcuucgauuuccuguga

SEQ ID NO: 506593 - RNA, 19 nt, Homo sapiens
acaacaguauggacaguau

SEQ ID NO: 506594 - RNA, 19 nt, Homo sapiens
gguaaccuuuccagagaug

SEQ ID NO: 506595 - RNA, 19 nt, Homo sapiens
aaagauacuuccaaucacu

SEQ ID NO: 506596 - RNA, 19 nt, Homo sapiens
cacacaagcuaagacauau

SEQ ID NO: 506597 - RNA, 19 nt, Homo sapiens
gggcaaccauggaaucaac

SEQ ID NO: 506598 - RNA, 19 nt, Homo sapiens
uauacgguguuucuuaugu

SEQ ID NO: 506599 - RNA, 19 nt, Homo sapiens
gauaaauaacagaguccua

SEQ ID NO: 506600 - RNA, 19 nt, Homo sapiens
caaacuggaugcagaaaau

SEQ ID NO: 506601 - RNA, 19 nt, Homo sapiens
caacaguauggacaguaua

SEQ ID NO: 506602 - RNA, 19 nt, Homo sapiens
ccaauggagccaaguguau

SEQ ID NO: 506603 - RNA, 19 nt, Homo sapiens
guaguaaaccagucaaguc

SEQ ID NO: 506604 - RNA, 19 nt, Homo sapiens
ucacuuccauguguuuguu

SEQ ID NO: 506605 - RNA, 19 nt, Homo sapiens
uccaaucacuuccaugugu

SEQ ID NO: 506606 - RNA, 19 nt, Homo sapiens
ugauggauaugaacaugau

SEQ ID NO: 506607 - RNA, 19 nt, Homo sapiens
uguaauaccuccuccuaac

SEQ ID NO: 506608 - RNA, 19 nt, Homo sapiens
caguugagauuugaagaug

SEQ ID NO: 506609 - RNA, 19 nt, Homo sapiens
ggaauuuuaugaacacaga

SEQ ID NO: 506610 - RNA, 19 nt, Homo sapiens
acacgugucuucuaguucu

SEQ ID NO: 506611 - RNA, 19 nt, Homo sapiens
gauuugcuuuggugaagga

SEQ ID NO: 506612 - RNA, 19 nt, Homo sapiens
uuuccuagguugacuauag

SEQ ID NO: 506613 - RNA, 19 nt, Homo sapiens
cucccacucuuucuucaua

SEQ ID NO: 506614 - RNA, 19 nt, Homo sapiens
uauagcuacuuucaguuga

SEQ ID NO: 506615 - RNA, 19 nt, Homo sapiens
aaaguaaacugggcaacca

SEQ ID NO: 506616 - RNA, 19 nt, Homo sapiens
uauuugcgguauuaacuga

SEQ ID NO: 506617 - RNA, 19 nt, Homo sapiens
gauugaaggacaugugguu

SEQ ID NO: 506618 - RNA, 19 nt, Homo sapiens
gcaguugagauuugaagau

SEQ ID NO: 506619 - RNA, 19 nt, Homo sapiens
caauugggccacucguaaa

SEQ ID NO: 506620 - RNA, 19 nt, Homo sapiens
cauaaaagcuuuggaaacu

SEQ ID NO: 506621 - RNA, 19 nt, Homo sapiens
gaucagcuuaugagacaga

SEQ ID NO: 506622 - RNA, 19 nt, Homo sapiens
gacaaagccucuucuguuu

SEQ ID NO: 506623 - RNA, 19 nt, Homo sapiens
gcaccuacgugaaggauuu

SEQ ID NO: 506624 - RNA, 19 nt, Homo sapiens
gcucaaagauuuccucuca

SEQ ID NO: 506625 - RNA, 19 nt, Homo sapiens
ggaagaagaugguauucga

SEQ ID NO: 506626 - RNA, 19 nt, Homo sapiens
guauaaagaugguuccaaa

SEQ ID NO: 506627 - RNA, 19 nt, Homo sapiens
gaaaauccaugaagaguuu

SEQ ID NO: 506628 - RNA, 19 nt, Homo sapiens
ccaggaaacugaacacuga

SEQ ID NO: 506629 - RNA, 19 nt, Homo sapiens
ugagaagguugaucaauuu

SEQ ID NO: 506630 - RNA, 19 nt, Homo sapiens
gggaauauuugaugacauu

SEQ ID NO: 506631 - RNA, 19 nt, Homo sapiens
ggaauuuggugucugauau

SEQ ID NO: 506632 - RNA, 19 nt, Homo sapiens
gagaugagauucuugagau

SEQ ID NO: 506633 - RNA, 19 nt, Homo sapiens
gaagaaacuuguaggaucu

SEQ ID NO: 506634 - RNA, 19 nt, Homo sapiens
uaacggaaaugguagaguu

SEQ ID NO: 506635 - RNA, 19 nt, Homo sapiens
gaucacagcagcaagagua

SEQ ID NO: 506636 - RNA, 19 nt, Homo sapiens
ggaugacgcuacauauuug

SEQ ID NO: 506637 - RNA, 19 nt, Homo sapiens
gcaaaugccgugugugaaa

SEQ ID NO: 506638 - RNA, 19 nt, Homo sapiens
gauuuaaacugucuuaugg

SEQ ID NO: 506639 - RNA, 19 nt, Homo sapiens
gaaccgaagcuguaaagaa

SEQ ID NO: 506640 - RNA, 19 nt, Homo sapiens
agacagacauccucaguga

SEQ ID NO: 506641 - RNA, 19 nt, Homo sapiens
gaaagcaggagaugagauu

SEQ ID NO: 506642 - RNA, 19 nt, Homo sapiens
gaaaggaugcacgcuauuu

SEQ ID NO: 506643 - RNA, 19 nt, Homo sapiens
aaauggaccuguuucguuu

SEQ ID NO: 506644 - RNA, 19 nt, Homo sapiens
gaagaaacgcuccaaaucu

SEQ ID NO: 506645 - RNA, 19 nt, Homo sapiens
gaucagaaucccaaauaaa

SEQ ID NO: 506646 - RNA, 19 nt, Homo sapiens
gaagguugaucaauuuaag

SEQ ID NO: 506647 - RNA, 19 nt, Homo sapiens
aaccgaagcuguaaagaaa

SEQ ID NO: 506648 - RNA, 19 nt, Homo sapiens
gggaugacgcuacauauuu

SEQ ID NO: 506649 - RNA, 19 nt, Homo sapiens
ggaaggugauccacaggaa

SEQ ID NO: 506650 - RNA, 19 nt, Homo sapiens
gaggaagucauuuggguua

SEQ ID NO: 506651 - RNA, 19 nt, Homo sapiens
cagaaagaauugaucagaa

SEQ ID NO: 506652 - RNA, 19 nt, Homo sapiens
ccagagagccgaaaggauu

SEQ ID NO: 506653 - RNA, 19 nt, Homo sapiens
gaucauuccuguauuaugc

SEQ ID NO: 506654 - RNA, 19 nt, Homo sapiens
ucuaugagcugcuguacaa

SEQ ID NO: 506655 - RNA, 19 nt, Homo sapiens
ugacaaagccucuucuguu

SEQ ID NO: 506656 - RNA, 19 nt, Homo sapiens
gaaguggucuuaccuaacg

SEQ ID NO: 506657 - RNA, 19 nt, Homo sapiens
caaauuagccauagcaaca

SEQ ID NO: 506658 - RNA, 19 nt, Homo sapiens
gagagggucuuucacuugu

SEQ ID NO: 506659 - RNA, 19 nt, Homo sapiens
ugacuuguaugcucagaaa

SEQ ID NO: 506660 - RNA, 19 nt, Homo sapiens
uagagaauguguguagaua

SEQ ID NO: 506661 - RNA, 19 nt, Homo sapiens
gagcugcuguacaaagaaa

SEQ ID NO: 506662 - RNA, 19 nt, Homo sapiens
ugaacagacuggugagaaa

SEQ ID NO: 506663 - RNA, 19 nt, Homo sapiens
cgguuuagcuuccaagaaa

SEQ ID NO: 506664 - RNA, 19 nt, Homo sapiens
ccacccaacuuugucauuu

SEQ ID NO: 506665 - RNA, 19 nt, Homo sapiens
ggaaaacccuggauaguca

SEQ ID NO: 506666 - RNA, 19 nt, Homo sapiens
uaaaggcugugcauucaau

SEQ ID NO: 506667 - RNA, 19 nt, Homo sapiens
caaauggaccuguuucguu

SEQ ID NO: 506668 - RNA, 19 nt, Homo sapiens
caaccucaauaucuaaaug

SEQ ID NO: 506669 - RNA, 19 nt, Homo sapiens
ggacugagacccaccuuuc

SEQ ID NO: 506670 - RNA, 19 nt, Homo sapiens
gaagacagcuccucaaaac

SEQ ID NO: 506671 - RNA, 19 nt, Homo sapiens
gaagaagaaacuuguagga

SEQ ID NO: 506672 - RNA, 19 nt, Homo sapiens
aaagaugguuccaaacaga

SEQ ID NO: 506673 - RNA, 19 nt, Homo sapiens
gaauguguguagauacuuc

SEQ ID NO: 506674 - RNA, 19 nt, Homo sapiens
ugaacaagguugccaguca

SEQ ID NO: 506675 - RNA, 19 nt, Homo sapiens
gguagaguuucaaguagaa

SEQ ID NO: 506676 - RNA, 19 nt, Homo sapiens
cagaacagguggccgcauu

SEQ ID NO: 506677 - RNA, 19 nt, Homo sapiens
gaguggagcugcuggaaag

SEQ ID NO: 506678 - RNA, 19 nt, Homo sapiens
cuucuaugcucaaagauuu

SEQ ID NO: 506679 - RNA, 19 nt, Homo sapiens
gaacucuucuaugcucaaa

SEQ ID NO: 506680 - RNA, 19 nt, Homo sapiens
caagacacaucaacuggau

SEQ ID NO: 506681 - RNA, 19 nt, Homo sapiens
gaucugagccaagaacauu

SEQ ID NO: 506682 - RNA, 19 nt, Homo sapiens
gguuaggcgugaagacuuu

SEQ ID NO: 506683 - RNA, 19 nt, Homo sapiens
ggagagggucuuucacuug

SEQ ID NO: 506684 - RNA, 19 nt, Homo sapiens
ucacaggcuuuccauuuau

SEQ ID NO: 506685 - RNA, 19 nt, Homo sapiens
ucaaagauuuccucucaca

SEQ ID NO: 506686 - RNA, 19 nt, Homo sapiens
gguucugucugcccaauaa

SEQ ID NO: 506687 - RNA, 19 nt, Homo sapiens
caagaacauuuaacaagca

SEQ ID NO: 506688 - RNA, 19 nt, Homo sapiens
gcagcugacuugguucuga

SEQ ID NO: 506689 - RNA, 19 nt, Homo sapiens
gagaauguguguagauacu

SEQ ID NO: 506690 - RNA, 19 nt, Homo sapiens
gagaagguugaucaauuua

SEQ ID NO: 506691 - RNA, 19 nt, Homo sapiens
uagaaucacuguggacuga

SEQ ID NO: 506692 - RNA, 19 nt, Homo sapiens
gccaccaacccacaaauua

SEQ ID NO: 506693 - RNA, 19 nt, Homo sapiens
gcaggcuacugucggaauu

SEQ ID NO: 506694 - RNA, 19 nt, Homo sapiens
gaugaugaguucugugagu

SEQ ID NO: 506695 - RNA, 19 nt, Homo sapiens
gaggagcaguuugaucuug

SEQ ID NO: 506696 - RNA, 19 nt, Homo sapiens
ucuagaagauggagugaga

SEQ ID NO: 506697 - RNA, 19 nt, Homo sapiens
gaaauugaaaucuguccaa

SEQ ID NO: 506698 - RNA, 19 nt, Homo sapiens
ggaccacuguugccuuuua

SEQ ID NO: 506699 - RNA, 19 nt, Homo sapiens
gauguaaacagcuucagaa

SEQ ID NO: 506700 - RNA, 19 nt, Homo sapiens
cucacaggcuuuccauuua

SEQ ID NO: 506701 - RNA, 19 nt, Homo sapiens
ggauuuaaacugucuuaug

SEQ ID NO: 506702 - RNA, 19 nt, Homo sapiens
gagaugagcaccaccaaca

SEQ ID NO: 506703 - RNA, 19 nt, Homo sapiens
gaaucacuguggacugaga

SEQ ID NO: 506704 - RNA, 19 nt, Homo sapiens
gcagaaagucaacauguag

SEQ ID NO: 506705 - RNA, 19 nt, Homo sapiens
ucaacaacaucagaaagaa

SEQ ID NO: 506706 - RNA, 19 nt, Homo sapiens
gcccugaacucuucuaugc

SEQ ID NO: 506707 - RNA, 19 nt, Homo sapiens
cgcagaaagucaacaugua

SEQ ID NO: 506708 - RNA, 19 nt, Homo sapiens
ugaucagaaucccaaauaa

SEQ ID NO: 506709 - RNA, 19 nt, Homo sapiens
ccuaaaggcugugcauuca

SEQ ID NO: 506710 - RNA, 19 nt, Homo sapiens
cgugaaggauuuaaacugu

SEQ ID NO: 506711 - RNA, 19 nt, Homo sapiens
gaagaagaugguauucgaa

SEQ ID NO: 506712 - RNA, 19 nt, Homo sapiens
cacaucaacuggaucauuc

SEQ ID NO: 506713 - RNA, 19 nt, Homo sapiens
aagaaacgcuccaaaucug

SEQ ID NO: 506714 - RNA, 19 nt, Homo sapiens
ccaagaugguacccuagaa

SEQ ID NO: 506715 - RNA, 19 nt, Homo sapiens
gguuuaccauugauucuga

SEQ ID NO: 506716 - RNA, 19 nt, Homo sapiens
caaaugccgugugugaaau

SEQ ID NO: 506717 - RNA, 19 nt, Homo sapiens
ucaaugagaugcagaaaau

SEQ ID NO: 506718 - RNA, 19 nt, Homo sapiens
cgaaggcuguacgugaaua

SEQ ID NO: 506719 - RNA, 19 nt, Homo sapiens
uggcacagcucaagaagca

SEQ ID NO: 506720 - RNA, 19 nt, Homo sapiens
gcaagucgaccaacgaaag

SEQ ID NO: 506721 - RNA, 19 nt, Homo sapiens
gaauuuggugucugauauu

SEQ ID NO: 506722 - RNA, 19 nt, Homo sapiens
gaaccuagccuccaagauu

SEQ ID NO: 506723 - RNA, 19 nt, Homo sapiens
ucagggaccuugacacuua

SEQ ID NO: 506724 - RNA, 19 nt, Homo sapiens
gagaggagguuuaugugaa

SEQ ID NO: 506725 - RNA, 19 nt, Homo sapiens
gggaggacaucaccuuuga

SEQ ID NO: 506726 - RNA, 19 nt, Homo sapiens
gggacagccucuacccuua

SEQ ID NO: 506727 - RNA, 19 nt, Homo sapiens
gaaguucugugcaaauugg

SEQ ID NO: 506728 - RNA, 19 nt, Homo sapiens
guaggugucucauagcuau

SEQ ID NO: 506729 - RNA, 19 nt, Homo sapiens
gagagaaccuagccuccaa

SEQ ID NO: 506730 - RNA, 19 nt, Homo sapiens
caacauggccucagaacug

SEQ ID NO: 506731 - RNA, 19 nt, Homo sapiens
uaagcugccucaaggaauu

SEQ ID NO: 506732 - RNA, 19 nt, Homo sapiens
ggacaggccugaggagaca

SEQ ID NO: 506733 - RNA, 19 nt, Homo sapiens
ggaucuggcuggagaggaa

SEQ ID NO: 506734 - RNA, 19 nt, Homo sapiens
caacggauccuacuucuac

SEQ ID NO: 506735 - RNA, 19 nt, Homo sapiens
ggagcagccucgaaacugu

SEQ ID NO: 506736 - RNA, 19 nt, Homo sapiens
ucaaaaugcugaaagagua

SEQ ID NO: 506737 - RNA, 19 nt, Homo sapiens
ugacaccgcuguacuuucu

SEQ ID NO: 506738 - RNA, 19 nt, Homo sapiens
ccuuacagccucugacuua

SEQ ID NO: 506739 - RNA, 19 nt, Homo sapiens
ggagaggagguuuauguga

SEQ ID NO: 506740 - RNA, 19 nt, Homo sapiens
aaaugaccaucgugacuuu

SEQ ID NO: 506741 - RNA, 19 nt, Homo sapiens
acgggaaccugcuagauuu

SEQ ID NO: 506742 - RNA, 19 nt, Homo sapiens
gcauggagcagccucgaaa

SEQ ID NO: 506743 - RNA, 19 nt, Homo sapiens
uaaugaaccugaggccaaa

SEQ ID NO: 506744 - RNA, 19 nt, Homo sapiens
acaugucgcuguuugagaa

SEQ ID NO: 506745 - RNA, 19 nt, Homo sapiens
gaacuacagugucuauacc

SEQ ID NO: 506746 - RNA, 19 nt, Homo sapiens
gaagaccacagcugaguuc

SEQ ID NO: 506747 - RNA, 19 nt, Homo sapiens
ggagugcacugugagaagu

SEQ ID NO: 506748 - RNA, 19 nt, Homo sapiens
gagcaacggauccuacuuc

SEQ ID NO: 506749 - RNA, 19 nt, Homo sapiens
gaacgcagccaucaaaaug

SEQ ID NO: 506750 - RNA, 19 nt, Homo sapiens
caaggucaaugugaaagug

SEQ ID NO: 506751 - RNA, 19 nt, Homo sapiens
ggcauggagugcacuguga

SEQ ID NO: 506752 - RNA, 19 nt, Homo sapiens
ggaagccagugccaagaag

SEQ ID NO: 506753 - RNA, 19 nt, Homo sapiens
ucgaaacugugacgaugaa

SEQ ID NO: 506754 - RNA, 19 nt, Homo sapiens
uggaaguucugugcaaauu

SEQ ID NO: 506755 - RNA, 19 nt, Homo sapiens
gaacuucggccaggucauc

SEQ ID NO: 506756 - RNA, 19 nt, Homo sapiens
gagcaacacaguagaagag

SEQ ID NO: 506757 - RNA, 19 nt, Homo sapiens
gcacucacaccacuaacau

SEQ ID NO: 506758 - RNA, 19 nt, Homo sapiens
aaccuagccuccaagauug

SEQ ID NO: 506759 - RNA, 19 nt, Homo sapiens
ggagaaggacgaccguauc

SEQ ID NO: 506760 - RNA, 19 nt, Homo sapiens
cuucuuggcuucucaugug

SEQ ID NO: 506761 - RNA, 19 nt, Homo sapiens
ccuccaagauugcagacuu

SEQ ID NO: 506762 - RNA, 19 nt, Homo sapiens
ggagacgcaccuucaccua

SEQ ID NO: 506763 - RNA, 19 nt, Homo sapiens
ccaggaaggccuaugugaa

SEQ ID NO: 506764 - RNA, 19 nt, Homo sapiens
gugccgagcucuaugaaaa

SEQ ID NO: 506765 - RNA, 19 nt, Homo sapiens
ccauugagucccugaacua

SEQ ID NO: 506766 - RNA, 19 nt, Homo sapiens
ggaaguucugugcaaauug

SEQ ID NO: 506767 - RNA, 19 nt, Homo sapiens
gaggagacaagcaccauca

SEQ ID NO: 506768 - RNA, 19 nt, Homo sapiens
ccagauugcgcuacagcua

SEQ ID NO: 506769 - RNA, 19 nt, Homo sapiens
cgagguuacuuguauaucg

SEQ ID NO: 506770 - RNA, 19 nt, Homo sapiens
gggccaugaucaagaagga

SEQ ID NO: 506771 - RNA, 19 nt, Homo sapiens
uguuugagaacuucacuua

SEQ ID NO: 506772 - RNA, 19 nt, Homo sapiens
agugaugucugguccuuug

SEQ ID NO: 506773 - RNA, 19 nt, Homo sapiens
ucagaaugguggcacuugu

SEQ ID NO: 506774 - RNA, 19 nt, Homo sapiens
gcaacggauccuacuucua

SEQ ID NO: 506775 - RNA, 19 nt, Homo sapiens
gcauccuucuuucuaguuc

SEQ ID NO: 506776 - RNA, 19 nt, Homo sapiens
acaaggagaagcagacaga

SEQ ID NO: 506777 - RNA, 19 nt, Homo sapiens
gggcauccuucuuucuagu

SEQ ID NO: 506778 - RNA, 19 nt, Homo sapiens
ggagauagugagccuugga

SEQ ID NO: 506779 - RNA, 19 nt, Homo sapiens
ggacagccucuacccuuag

SEQ ID NO: 506780 - RNA, 19 nt, Homo sapiens
gcacgcgcgucaucuacgu

SEQ ID NO: 506781 - RNA, 19 nt, Homo sapiens
ggagcaacacaguagaaga

SEQ ID NO: 506782 - RNA, 19 nt, Homo sapiens
gagaagaccacagcugagu

SEQ ID NO: 506783 - RNA, 19 nt, Homo sapiens
gaagcagacagacgugauc

SEQ ID NO: 506784 - RNA, 19 nt, Homo sapiens
gaaacugugacgaugaagu

SEQ ID NO: 506785 - RNA, 19 nt, Homo sapiens
acuuguauaucgcuauuga

SEQ ID NO: 506786 - RNA, 19 nt, Homo sapiens
gaaggacgggcugaagaug

SEQ ID NO: 506787 - RNA, 19 nt, Homo sapiens
ccagcacucacaccacuaa

SEQ ID NO: 506788 - RNA, 19 nt, Homo sapiens
aaacugugacgaugaagug

SEQ ID NO: 506789 - RNA, 19 nt, Homo sapiens
auagugagccuuggaggua

SEQ ID NO: 506790 - RNA, 19 nt, Homo sapiens
gaggagguuuaugugaaga

SEQ ID NO: 506791 - RNA, 19 nt, Homo sapiens
aggacgggcugaagaugaa

SEQ ID NO: 506792 - RNA, 19 nt, Homo sapiens
gagaccauccugcaguuca

SEQ ID NO: 506793 - RNA, 19 nt, Homo sapiens
caucggagacgcaccuuca

SEQ ID NO: 506794 - RNA, 19 nt, Homo sapiens
ggagacaagcaccaucauc

SEQ ID NO: 506795 - RNA, 19 nt, Homo sapiens
gccaauauccaaguacguu

SEQ ID NO: 506796 - RNA, 19 nt, Homo sapiens
cagacuguccugagccuuu

SEQ ID NO: 506797 - RNA, 19 nt, Homo sapiens
caucauccguggccucaac

SEQ ID NO: 506798 - RNA, 19 nt, Homo sapiens
aaagacaggauacaguguu

SEQ ID NO: 506799 - RNA, 19 nt, Homo sapiens
gaaccugaggccaaagaca

SEQ ID NO: 506800 - RNA, 19 nt, Homo sapiens
caccucggcuccugaccaa

SEQ ID NO: 506801 - RNA, 19 nt, Homo sapiens
ugacuuaagcugccucaag

SEQ ID NO: 506802 - RNA, 19 nt, Homo sapiens
ugaccagucugacccuuac

SEQ ID NO: 506803 - RNA, 19 nt, Homo sapiens
ggagguuuaugugaagaag

SEQ ID NO: 506804 - RNA, 19 nt, Homo sapiens
gagaaccuagccuccaaga

SEQ ID NO: 506805 - RNA, 19 nt, Homo sapiens
gcaugcaguaccugaguga

SEQ ID NO: 506806 - RNA, 19 nt, Homo sapiens
ggaagagcaacggauccua

SEQ ID NO: 506807 - RNA, 19 nt, Homo sapiens
ugcaguaccugagugagaa

SEQ ID NO: 506808 - RNA, 19 nt, Homo sapiens
uacgggaaccugcuagauu

SEQ ID NO: 506809 - RNA, 19 nt, Homo sapiens
ccaugacggcgaaugugua

SEQ ID NO: 506810 - RNA, 19 nt, Homo sapiens
cuuuguaggugucucauag

SEQ ID NO: 506811 - RNA, 19 nt, Homo sapiens
gugaccagucugacccuua

SEQ ID NO: 506812 - RNA, 19 nt, Homo sapiens
gccaggaaggccuauguga

SEQ ID NO: 506813 - RNA, 19 nt, Homo sapiens
agaggagguuuaugugaag

SEQ ID NO: 506814 - RNA, 19 nt, Homo sapiens
ggagggcuggcauguggaa

SEQ ID NO: 506815 - RNA, 19 nt, Homo sapiens
uaaccugugaccagucuga

SEQ ID NO: 506816 - RNA, 19 nt, Homo sapiens
caggaaggccuaugugaac

SEQ ID NO: 506817 - RNA, 19 nt, Homo sapiens
ccaauggcaugcaguaccu

SEQ ID NO: 506818 - RNA, 19 nt, Homo sapiens
ccagugaugcggccaaugg

SEQ ID NO: 506819 - RNA, 19 nt, Homo sapiens
gagcaugggacagccucua

SEQ ID NO: 506820 - RNA, 19 nt, Homo sapiens
gaguaugccucugaaaaug

SEQ ID NO: 506821 - RNA, 19 nt, Homo sapiens
caaagacaggauacagugu

SEQ ID NO: 506822 - RNA, 19 nt, Homo sapiens
ugaccaagauguauaaagg

SEQ ID NO: 506823 - RNA, 19 nt, Homo sapiens
ucaaccagaccaccuuaua

SEQ ID NO: 506824 - RNA, 19 nt, Homo sapiens
ccagagagacaccagagaa

SEQ ID NO: 506825 - RNA, 19 nt, Homo sapiens
gcgaggaguuucucauugc

SEQ ID NO: 506826 - RNA, 19 nt, Homo sapiens
ucaagaugaccaagaugua

SEQ ID NO: 506827 - RNA, 19 nt, Homo sapiens
guuaugagaucaagaugac

SEQ ID NO: 506828 - RNA, 19 nt, Homo sapiens
accaagaccuacacuguug

SEQ ID NO: 506829 - RNA, 19 nt, Homo sapiens
caagaugaccaagauguau

SEQ ID NO: 506830 - RNA, 19 nt, Homo sapiens
ugaggaaugcacaguguuu

SEQ ID NO: 506831 - RNA, 19 nt, Homo sapiens
ggacaaugaaauaaagagu

SEQ ID NO: 506832 - RNA, 19 nt, Homo sapiens
gagaucaagaugaccaaga

SEQ ID NO: 506833 - RNA, 19 nt, Homo sapiens
ucaccaagaccuacacugu

SEQ ID NO: 506834 - RNA, 19 nt, Homo sapiens
agaucaagaugaccaagau

SEQ ID NO: 506835 - RNA, 19 nt, Homo sapiens
ggucccagauagccugaau

SEQ ID NO: 506836 - RNA, 19 nt, Homo sapiens
gagagugucugcggauacu

SEQ ID NO: 506837 - RNA, 19 nt, Homo sapiens
aagaugaccaagauguaua

SEQ ID NO: 506838 - RNA, 19 nt, Homo sapiens
cagcgaggaguuucucauu

SEQ ID NO: 506839 - RNA, 19 nt, Homo sapiens
caaccagaccaccuuauac

SEQ ID NO: 506840 - RNA, 19 nt, Homo sapiens
caccaagaccuacacuguu

SEQ ID NO: 506841 - RNA, 19 nt, Homo sapiens
ggaacagccugagcuuagc

SEQ ID NO: 506842 - RNA, 19 nt, Homo sapiens
caaccgcagcgaggaguuu

SEQ ID NO: 506843 - RNA, 19 nt, Homo sapiens
uggaacagccugagcuuag

SEQ ID NO: 506844 - RNA, 19 nt, Homo sapiens
cuucuggcauccuguuguu

SEQ ID NO: 506845 - RNA, 19 nt, Homo sapiens
agaugaccaagauguauaa

SEQ ID NO: 506846 - RNA, 19 nt, Homo sapiens
gaucaagaugaccaagaug

SEQ ID NO: 506847 - RNA, 19 nt, Homo sapiens
uggagagugucugcggaua

SEQ ID NO: 506848 - RNA, 19 nt, Homo sapiens
ggacucuugcacaucacua

SEQ ID NO: 506849 - RNA, 19 nt, Homo sapiens
ggagagugucugcggauac

SEQ ID NO: 506850 - RNA, 19 nt, Homo sapiens
gagauccagcgcccagaga

SEQ ID NO: 506851 - RNA, 19 nt, Homo sapiens
ccuuauaccagcguuauga

SEQ ID NO: 506852 - RNA, 19 nt, Homo sapiens
gauccagcgcccagagaga

SEQ ID NO: 506853 - RNA, 19 nt, Homo sapiens
agacggccuucugcaauuc

SEQ ID NO: 506854 - RNA, 19 nt, Homo sapiens
agcgaggaguuucucauug

SEQ ID NO: 506855 - RNA, 19 nt, Homo sapiens
ccaucuuucuuccggacaa

SEQ ID NO: 506856 - RNA, 19 nt, Homo sapiens
gagugucugcggauacuuc

SEQ ID NO: 506857 - RNA, 19 nt, Homo sapiens
gaggaaugcacaguguuuc

SEQ ID NO: 506858 - RNA, 19 nt, Homo sapiens
acugcaggauggacucuug

SEQ ID NO: 506859 - RNA, 19 nt, Homo sapiens
ucaagaggauccaguauga

SEQ ID NO: 506860 - RNA, 19 nt, Homo sapiens
gaaggaauaucucauugca

SEQ ID NO: 506861 - RNA, 19 nt, Homo sapiens
ugagaaggauauagaguuu

SEQ ID NO: 506862 - RNA, 19 nt, Homo sapiens
ggaaacagcaugaauaaaa

SEQ ID NO: 506863 - RNA, 19 nt, Homo sapiens
cgacaucgaggacccauaa

SEQ ID NO: 506864 - RNA, 19 nt, Homo sapiens
ggaaagaaggaauaucuca

SEQ ID NO: 506865 - RNA, 19 nt, Homo sapiens
ccaaagcggucagugagaa

SEQ ID NO: 506866 - RNA, 19 nt, Homo sapiens
ucaaagggccugagaagga

SEQ ID NO: 506867 - RNA, 19 nt, Homo sapiens
ucaagcagauaaagauguu

SEQ ID NO: 506868 - RNA, 19 nt, Homo sapiens
gcaaacacauccguagaag

SEQ ID NO: 506869 - RNA, 19 nt, Homo sapiens
caaagaggagagaaaguuu

SEQ ID NO: 506870 - RNA, 19 nt, Homo sapiens
gaggaaagaaggaauaucu

SEQ ID NO: 506871 - RNA, 19 nt, Homo sapiens
agauaaagauguucaaagg

SEQ ID NO: 506872 - RNA, 19 nt, Homo sapiens
caaugcagauguagugauc

SEQ ID NO: 506873 - RNA, 19 nt, Homo sapiens
caaagggccugagaaggau

SEQ ID NO: 506874 - RNA, 19 nt, Homo sapiens
ucacagagaagaacaucaa

SEQ ID NO: 506875 - RNA, 19 nt, Homo sapiens
aagaaggaauaucucauug

SEQ ID NO: 506876 - RNA, 19 nt, Homo sapiens
gcagauaaagauguucaaa

SEQ ID NO: 506877 - RNA, 19 nt, Homo sapiens
gaaguggacucuggaaacg

SEQ ID NO: 506878 - RNA, 19 nt, Homo sapiens
gaauaucucauugcaggaa

SEQ ID NO: 506879 - RNA, 19 nt, Homo sapiens
gaaagaaggaauaucucau

SEQ ID NO: 506880 - RNA, 19 nt, Homo sapiens
gagaucaagcagauaaaga

SEQ ID NO: 506881 - RNA, 19 nt, Homo sapiens
uaugagaucaagcagauaa

SEQ ID NO: 506882 - RNA, 19 nt, Homo sapiens
gcaggaguuucucgacauc

SEQ ID NO: 506883 - RNA, 19 nt, Homo sapiens
gagaaggauauagaguuua

SEQ ID NO: 506884 - RNA, 19 nt, Homo sapiens
ccuggaaacagcaugaaua

SEQ ID NO: 506885 - RNA, 19 nt, Homo sapiens
gagacaaagaggagagaaa

SEQ ID NO: 506886 - RNA, 19 nt, Homo sapiens
caacaggcguuuugcaaug

SEQ ID NO: 506887 - RNA, 19 nt, Homo sapiens
gcaacccuaucaagaggau

SEQ ID NO: 506888 - RNA, 19 nt, Homo sapiens
ggaaguggacucuggaaac

SEQ ID NO: 506889 - RNA, 19 nt, Homo sapiens
acaaagaggagagaaaguu

SEQ ID NO: 506890 - RNA, 19 nt, Homo sapiens
aguaugagaucaagcagau

SEQ ID NO: 506891 - RNA, 19 nt, Homo sapiens
gaaccacagguaccagaug

SEQ ID NO: 506892 - RNA, 19 nt, Homo sapiens
gaucaagcagauaaagaug

SEQ ID NO: 506893 - RNA, 19 nt, Homo sapiens
gaaacagcaugaauaaaac

SEQ ID NO: 506894 - RNA, 19 nt, Homo sapiens
cuggaaacagcaugaauaa

SEQ ID NO: 506895 - RNA, 19 nt, Homo sapiens
ggccugagaaggauauaga

SEQ ID NO: 506896 - RNA, 19 nt, Homo sapiens
gggccaaagcggucaguga

SEQ ID NO: 506897 - RNA, 19 nt, Homo sapiens
gcaccaggccaaguucuuc

SEQ ID NO: 506898 - RNA, 19 nt, Homo sapiens
guucuucgccugcaucaag

SEQ ID NO: 506899 - RNA, 19 nt, Homo sapiens
aaagaggagagaaaguuug

SEQ ID NO: 506900 - RNA, 19 nt, Homo sapiens
guucaaagggccugagaag

SEQ ID NO: 506901 - RNA, 19 nt, Homo sapiens
gcaaugcagauguagugau

SEQ ID NO: 506902 - RNA, 19 nt, Homo sapiens
aagaggauccaguaugaga

SEQ ID NO: 506903 - RNA, 19 nt, Homo sapiens
cagcaaacacauccguaga

SEQ ID NO: 506904 - RNA, 19 nt, Homo sapiens
uggacugggucacagagaa

SEQ ID NO: 506905 - RNA, 19 nt, Homo sapiens
gcaccacccagaagaagag

SEQ ID NO: 506906 - RNA, 19 nt, Homo sapiens
ggacguuggaggaaagaag

SEQ ID NO: 506907 - RNA, 19 nt, Homo sapiens
cagauaaagauguucaaag

SEQ ID NO: 506908 - RNA, 19 nt, Homo sapiens
uauggcaacccuaucaaga

SEQ ID NO: 506909 - RNA, 19 nt, Homo sapiens
ggacugggucacagagaag

SEQ ID NO: 506910 - RNA, 19 nt, Homo sapiens
ggacucuggaaacgacauu

SEQ ID NO: 506911 - RNA, 19 nt, Homo sapiens
acucuggaaacgacauuua

SEQ ID NO: 506912 - RNA, 19 nt, Homo sapiens
caucgaggacccauaagca

SEQ ID NO: 506913 - RNA, 19 nt, Homo sapiens
cugagaaggauauagaguu

SEQ ID NO: 506914 - RNA, 19 nt, Homo sapiens
cuaucaagaggauccagua

SEQ ID NO: 506915 - RNA, 19 nt, Homo sapiens
agacaaagaggagagaaag

SEQ ID NO: 506916 - RNA, 19 nt, Homo sapiens
ggauggacugggucacaga

SEQ ID NO: 506917 - RNA, 19 nt, Homo sapiens
agaucaagcagauaaagau

SEQ ID NO: 506918 - RNA, 19 nt, Homo sapiens
gagcaccacccagaagaag

SEQ ID NO: 506919 - RNA, 19 nt, Homo sapiens
aauaucucauugcaggaaa

SEQ ID NO: 506920 - RNA, 19 nt, Homo sapiens
gacaaagaggagagaaagu

SEQ ID NO: 506921 - RNA, 19 nt, Homo sapiens
caugaucccgugcuacauc

SEQ ID NO: 506922 - RNA, 19 nt, Homo sapiens
agaagaagagccugaacca

SEQ ID NO: 506923 - RNA, 19 nt, Homo sapiens
uaacagagcuuucuuaguu

SEQ ID NO: 506924 - RNA, 19 nt, Homo sapiens
ggaagaagcugguaaagga

SEQ ID NO: 506925 - RNA, 19 nt, Homo sapiens
gagaguaggugauaaugua

SEQ ID NO: 506926 - RNA, 19 nt, Homo sapiens
gacaacaacuuccaaauug

SEQ ID NO: 506927 - RNA, 19 nt, Homo sapiens
ccacagauauagccaagua

SEQ ID NO: 506928 - RNA, 19 nt, Homo sapiens
gguagaggcuucuuagauu

SEQ ID NO: 506929 - RNA, 19 nt, Homo sapiens
gaaauagaaggaacuagua

SEQ ID NO: 506930 - RNA, 19 nt, Homo sapiens
gaacaugauugcucucugu

SEQ ID NO: 506931 - RNA, 19 nt, Homo sapiens
gaauaacagagcuuucuua

SEQ ID NO: 506932 - RNA, 19 nt, Homo sapiens
ucaagcagaugaagaugua

SEQ ID NO: 506933 - RNA, 19 nt, Homo sapiens
cagcuagacuggugaauug

SEQ ID NO: 506934 - RNA, 19 nt, Homo sapiens
agaaggaacuaguaacuga

SEQ ID NO: 506935 - RNA, 19 nt, Homo sapiens
gagauacaauuccaaguuc

SEQ ID NO: 506936 - RNA, 19 nt, Homo sapiens
uaacugccuuccuggcuua

SEQ ID NO: 506937 - RNA, 19 nt, Homo sapiens
gcugaaaggccaaccauuu

SEQ ID NO: 506938 - RNA, 19 nt, Homo sapiens
ggagauacaauuccaaguu

SEQ ID NO: 506939 - RNA, 19 nt, Homo sapiens
gguaucaccuggguuguaa

SEQ ID NO: 506940 - RNA, 19 nt, Homo sapiens
cugagacacuucuguauuu

SEQ ID NO: 506941 - RNA, 19 nt, Homo sapiens
cagaagugauggagagaaa

SEQ ID NO: 506942 - RNA, 19 nt, Homo sapiens
gcaguggaauggagaggaa

SEQ ID NO: 506943 - RNA, 19 nt, Homo sapiens
uaacaugucacuagaguau

SEQ ID NO: 506944 - RNA, 19 nt, Homo sapiens
gcaggauggugacauugaa

SEQ ID NO: 506945 - RNA, 19 nt, Homo sapiens
gauaaauacacacaccaua

SEQ ID NO: 506946 - RNA, 19 nt, Homo sapiens
gaaagacugagaugaaugu

SEQ ID NO: 506947 - RNA, 19 nt, Homo sapiens
gcaagcagauagacucaag

SEQ ID NO: 506948 - RNA, 19 nt, Homo sapiens
gaaccguguuuguugaaug

SEQ ID NO: 506949 - RNA, 19 nt, Homo sapiens
ugacaacaacuuccaaauu

SEQ ID NO: 506950 - RNA, 19 nt, Homo sapiens
ggaaauagaaggaacuagu

SEQ ID NO: 506951 - RNA, 19 nt, Homo sapiens
ugaccaaccuacacaaguu

SEQ ID NO: 506952 - RNA, 19 nt, Homo sapiens
gagcuucccuuggacacua

SEQ ID NO: 506953 - RNA, 19 nt, Homo sapiens
ggaccgacaugcucuccaa

SEQ ID NO: 506954 - RNA, 19 nt, Homo sapiens
gcugacaggucgcgucuau

SEQ ID NO: 506955 - RNA, 19 nt, Homo sapiens
ggugaagacuuaaacaucu

SEQ ID NO: 506956 - RNA, 19 nt, Homo sapiens
gguuguaacugcaagauca

SEQ ID NO: 506957 - RNA, 19 nt, Homo sapiens
gagagaaaccaacaagaga

SEQ ID NO: 506958 - RNA, 19 nt, Homo sapiens
gggagaacuuggagaauag

SEQ ID NO: 506959 - RNA, 19 nt, Homo sapiens
gcuguuaaauaugccaaua

SEQ ID NO: 506960 - RNA, 19 nt, Homo sapiens
uagcucagauggcagauga

SEQ ID NO: 506961 - RNA, 19 nt, Homo sapiens
gccaauaguuuaaucucuu

SEQ ID NO: 506962 - RNA, 19 nt, Homo sapiens
gauauagccaaguagauuu

SEQ ID NO: 506963 - RNA, 19 nt, Homo sapiens
ggugaaagacugagaugaa

SEQ ID NO: 506964 - RNA, 19 nt, Homo sapiens
gaaggaaggaacuacaaga

SEQ ID NO: 506965 - RNA, 19 nt, Homo sapiens
caaggugugugaaagaugu

SEQ ID NO: 506966 - RNA, 19 nt, Homo sapiens
aaagugagaugcugagagu

SEQ ID NO: 506967 - RNA, 19 nt, Homo sapiens
ccgacaugcucuccaauuu

SEQ ID NO: 506968 - RNA, 19 nt, Homo sapiens
agagagaguuugggucuuu

SEQ ID NO: 506969 - RNA, 19 nt, Homo sapiens
guagaggcuucuuagauuc

SEQ ID NO: 506970 - RNA, 19 nt, Homo sapiens
acaugucacuagaguauuu

SEQ ID NO: 506971 - RNA, 19 nt, Homo sapiens
caaguucccucccacaagu

SEQ ID NO: 506972 - RNA, 19 nt, Homo sapiens
ggaaaacgcuuugguagau

SEQ ID NO: 506973 - RNA, 19 nt, Homo sapiens
cuuaguuggugaagacuua

SEQ ID NO: 506974 - RNA, 19 nt, Homo sapiens
gcuacuaccugccuugcuu

SEQ ID NO: 506975 - RNA, 19 nt, Homo sapiens
ggauauguuuguauacaca

SEQ ID NO: 506976 - RNA, 19 nt, Homo sapiens
gaaccuguauuccucuucu

SEQ ID NO: 506977 - RNA, 19 nt, Homo sapiens
ccgcugagcuucccuugga

SEQ ID NO: 506978 - RNA, 19 nt, Homo sapiens
ggagagaaaccaacaagag

SEQ ID NO: 506979 - RNA, 19 nt, Homo sapiens
uguguaggcuguaauaugu

SEQ ID NO: 506980 - RNA, 19 nt, Homo sapiens
gauggcagaugagagugua

SEQ ID NO: 506981 - RNA, 19 nt, Homo sapiens
ugacaggucgcgucuauga

SEQ ID NO: 506982 - RNA, 19 nt, Homo sapiens
uaucauagccagcugcaaa

SEQ ID NO: 506983 - RNA, 19 nt, Homo sapiens
gggcaagggcuuuguguug

SEQ ID NO: 506984 - RNA, 19 nt, Homo sapiens
uaaauuagcagaaccacau

SEQ ID NO: 506985 - RNA, 19 nt, Homo sapiens
cugcggagucgauaaauua

SEQ ID NO: 506986 - RNA, 19 nt, Homo sapiens
guauuuguaucuucaguuc

SEQ ID NO: 506987 - RNA, 19 nt, Homo sapiens
gaucaaguccugcuacuac

SEQ ID NO: 506988 - RNA, 19 nt, Homo sapiens
caagauggcacccaagugu

SEQ ID NO: 506989 - RNA, 19 nt, Homo sapiens
ucaauuucauuaccgugua

SEQ ID NO: 506990 - RNA, 19 nt, Homo sapiens
gauaaaagcaucaucaaug

SEQ ID NO: 506991 - RNA, 19 nt, Homo sapiens
uaggguuucuguuguguuu

SEQ ID NO: 506992 - RNA, 19 nt, Homo sapiens
ccucaccucuuggaauuaa

SEQ ID NO: 506993 - RNA, 19 nt, Homo sapiens
gugaaagacugagaugaau

SEQ ID NO: 506994 - RNA, 19 nt, Homo sapiens
gagcugauccuugucuuug

SEQ ID NO: 506995 - RNA, 19 nt, Homo sapiens
gcagacaacacacuguaga

SEQ ID NO: 506996 - RNA, 19 nt, Homo sapiens
ucaaugcuguuaaauaugc

SEQ ID NO: 506997 - RNA, 19 nt, Homo sapiens
gccaggagcuuucuuuuau

SEQ ID NO: 506998 - RNA, 19 nt, Homo sapiens
ggggagaacuuggagaaua

SEQ ID NO: 506999 - RNA, 19 nt, Homo sapiens
ggagguggaugugacaaca

SEQ ID NO: 507000 - RNA, 19 nt, Homo sapiens
caauuugccugccuuguac

SEQ ID NO: 507001 - RNA, 19 nt, Homo sapiens
gggcugaacuaucgguauc

SEQ ID NO: 507002 - RNA, 19 nt, Homo sapiens
uaccgaggcuucaccaaga

SEQ ID NO: 507003 - RNA, 19 nt, Homo sapiens
guuaacaugucacuagagu

SEQ ID NO: 507004 - RNA, 19 nt, Homo sapiens
gcugagacacuucuguauu

SEQ ID NO: 507005 - RNA, 19 nt, Homo sapiens
agggagagcugcagagugu

SEQ ID NO: 507006 - RNA, 19 nt, Homo sapiens
ccaauaguuuaaucucuuc

SEQ ID NO: 507007 - RNA, 19 nt, Homo sapiens
gcagcuagacuggugaauu

SEQ ID NO: 507008 - RNA, 19 nt, Homo sapiens
gggaugagcccagacuuga

SEQ ID NO: 507009 - RNA, 19 nt, Homo sapiens
ccguguaccuuucccauug

SEQ ID NO: 507010 - RNA, 19 nt, Homo sapiens
ggagcuuucuuuuauguaa

SEQ ID NO: 507011 - RNA, 19 nt, Homo sapiens
cuucauagcccuagcauca

SEQ ID NO: 507012 - RNA, 19 nt, Homo sapiens
ccagagagagagagaaaga

SEQ ID NO: 507013 - RNA, 19 nt, Homo sapiens
cguguuuguugaaugaaua

SEQ ID NO: 507014 - RNA, 19 nt, Homo sapiens
cccguucacuuacuguaua

SEQ ID NO: 507015 - RNA, 19 nt, Homo sapiens
caagagagucggagaugau

SEQ ID NO: 507016 - RNA, 19 nt, Homo sapiens
ggacacagacaaggaacuu

SEQ ID NO: 507017 - RNA, 19 nt, Homo sapiens
agagaaagagagagaguuu

SEQ ID NO: 507018 - RNA, 19 nt, Homo sapiens
uauuucacccguucacuua

SEQ ID NO: 507019 - RNA, 19 nt, Homo sapiens
gcuuauggguauuuaucuu

SEQ ID NO: 507020 - RNA, 19 nt, Homo sapiens
gacaugcucuccaauuucg

SEQ ID NO: 507021 - RNA, 19 nt, Homo sapiens
gcaaggggcugaacuaucg

SEQ ID NO: 507022 - RNA, 19 nt, Homo sapiens
agacacuucuguauuucaa

SEQ ID NO: 507023 - RNA, 19 nt, Homo sapiens
aacgaaagcucuaugguua

SEQ ID NO: 507024 - RNA, 19 nt, Homo sapiens
ucaaggauguucaguauau

SEQ ID NO: 507025 - RNA, 19 nt, Homo sapiens
gggaaagucugaaucauca

SEQ ID NO: 507026 - RNA, 19 nt, Homo sapiens
gaacgaaagcucuaugguu

SEQ ID NO: 507027 - RNA, 19 nt, Homo sapiens
ggaaggaguuuguugacau

SEQ ID NO: 507028 - RNA, 19 nt, Homo sapiens
gguauauccuugcgaugua

SEQ ID NO: 507029 - RNA, 19 nt, Homo sapiens
gguaugaaaucaaacagau

SEQ ID NO: 507030 - RNA, 19 nt, Homo sapiens
caagaguccugaagaucaa

SEQ ID NO: 507031 - RNA, 19 nt, Homo sapiens
gaaggaguuuguugacauc

SEQ ID NO: 507032 - RNA, 19 nt, Homo sapiens
agaaauggcgaaugucaua

SEQ ID NO: 507033 - RNA, 19 nt, Homo sapiens
aaucaucacuaccaucuga

SEQ ID NO: 507034 - RNA, 19 nt, Homo sapiens
gaaggugguuugacagcau

SEQ ID NO: 507035 - RNA, 19 nt, Homo sapiens
ggaguuuguugacaucguu

SEQ ID NO: 507036 - RNA, 19 nt, Homo sapiens
ggagaaauggcgaauguca

SEQ ID NO: 507037 - RNA, 19 nt, Homo sapiens
gcuccgguaugaaaucaaa

SEQ ID NO: 507038 - RNA, 19 nt, Homo sapiens
ccauuagucuagccuugua

SEQ ID NO: 507039 - RNA, 19 nt, Homo sapiens
agucaaggauguucaguau

SEQ ID NO: 507040 - RNA, 19 nt, Homo sapiens
agauaaagauguucaaagg

SEQ ID NO: 507041 - RNA, 19 nt, Homo sapiens
gaauauguguuuuccuuug

SEQ ID NO: 507042 - RNA, 19 nt, Homo sapiens
gcagagcuuuggccauuac

SEQ ID NO: 507043 - RNA, 19 nt, Homo sapiens
cugcagagcuuuggccauu

SEQ ID NO: 507044 - RNA, 19 nt, Homo sapiens
cagaagcaguaucucuuga

SEQ ID NO: 507045 - RNA, 19 nt, Homo sapiens
ggucagguccucagugaug

SEQ ID NO: 507046 - RNA, 19 nt, Homo sapiens
guuaccaggcucagcauua

SEQ ID NO: 507047 - RNA, 19 nt, Homo sapiens
gaucaagccaguucuccuu

SEQ ID NO: 507048 - RNA, 19 nt, Homo sapiens
ucgcggaucugcaguguca

SEQ ID NO: 507049 - RNA, 19 nt, Homo sapiens
gaagcaguaucucuugacu

SEQ ID NO: 507050 - RNA, 19 nt, Homo sapiens
ucaagaguccugaagauca

SEQ ID NO: 507051 - RNA, 19 nt, Homo sapiens
ccacucggcacuugugauu

SEQ ID NO: 507052 - RNA, 19 nt, Homo sapiens
cacaugagaugguauaucc

SEQ ID NO: 507053 - RNA, 19 nt, Homo sapiens
uuaccaggcucagcauuau

SEQ ID NO: 507054 - RNA, 19 nt, Homo sapiens
aaguguuucuucuggcuua

SEQ ID NO: 507055 - RNA, 19 nt, Homo sapiens
ccaacagccagaagcagua

SEQ ID NO: 507056 - RNA, 19 nt, Homo sapiens
caucacaucccuucaagag

SEQ ID NO: 507057 - RNA, 19 nt, Homo sapiens
ucaggaaggaguuuguuga

SEQ ID NO: 507058 - RNA, 19 nt, Homo sapiens
ccagaagcaguaucucuug

SEQ ID NO: 507059 - RNA, 19 nt, Homo sapiens
gcuguuacugcaaguguuu

SEQ ID NO: 507060 - RNA, 19 nt, Homo sapiens
gaccaucacaucccuucaa

SEQ ID NO: 507061 - RNA, 19 nt, Homo sapiens
gcucagcauuaugucugua

SEQ ID NO: 507062 - RNA, 19 nt, Homo sapiens
ucacuaccaucugaacugu

SEQ ID NO: 507063 - RNA, 19 nt, Homo sapiens
gagggaaagucugaaucau

SEQ ID NO: 507064 - RNA, 19 nt, Homo sapiens
ggggagaaauggcgaaugu

SEQ ID NO: 507065 - RNA, 19 nt, Homo sapiens
caaaucaccaccugcuaca

SEQ ID NO: 507066 - RNA, 19 nt, Homo sapiens
agccaggacuauucccuuu

SEQ ID NO: 507067 - RNA, 19 nt, Homo sapiens
ucuaaagccaggacuauuc

SEQ ID NO: 507068 - RNA, 19 nt, Homo sapiens
gagaaagucaaggauguuc

SEQ ID NO: 507069 - RNA, 19 nt, Homo sapiens
gaagaucaagccaguucuc

SEQ ID NO: 507070 - RNA, 19 nt, Homo sapiens
gaaagucaaggauguucag

SEQ ID NO: 507071 - RNA, 19 nt, Homo sapiens
ucauccaucugugcaacua

SEQ ID NO: 507072 - RNA, 19 nt, Homo sapiens
gccagaagcaguaucucuu

SEQ ID NO: 507073 - RNA, 19 nt, Homo sapiens
ccucuguggugugaaacua

SEQ ID NO: 507074 - RNA, 19 nt, Homo sapiens
gguuugacagcaucauaaa

SEQ ID NO: 507075 - RNA, 19 nt, Homo sapiens
ugucuuaaucgaucuggua

SEQ ID NO: 507076 - RNA, 19 nt, Homo sapiens
gaaaagucuucauccaucu

SEQ ID NO: 507077 - RNA, 19 nt, Homo sapiens
cuggucagguccucaguga

SEQ ID NO: 507078 - RNA, 19 nt, Homo sapiens
aaagauguucaaaggguuu

SEQ ID NO: 507079 - RNA, 19 nt, Homo sapiens
gcgauguacagaaucagaa

SEQ ID NO: 507080 - RNA, 19 nt, Homo sapiens
caugagaugguauauccuu

SEQ ID NO: 507081 - RNA, 19 nt, Homo sapiens
caaggauguucaguauauc

SEQ ID NO: 507082 - RNA, 19 nt, Homo sapiens
gggaaggggccaugacuuu

SEQ ID NO: 507083 - RNA, 19 nt, Homo sapiens
gaaagucugaaucaucacu

SEQ ID NO: 507084 - RNA, 19 nt, Homo sapiens
gggccaaaaucuccaguga

SEQ ID NO: 507085 - RNA, 19 nt, Homo sapiens
agaaucagaaggugguuug

SEQ ID NO: 507086 - RNA, 19 nt, Homo sapiens
ggaacgaaagcucuauggu

SEQ ID NO: 507087 - RNA, 19 nt, Homo sapiens
cagauaaagauguucaaag

SEQ ID NO: 507088 - RNA, 19 nt, Homo sapiens
gagaaauggcgaaugucau

SEQ ID NO: 507089 - RNA, 19 nt, Homo sapiens
ggauguucaguauaucuau

SEQ ID NO: 507090 - RNA, 19 nt, Homo sapiens
aaaaugcuccgguaugaaa

SEQ ID NO: 507091 - RNA, 19 nt, Homo sapiens
uaauaagaagugccaagug

SEQ ID NO: 507092 - RNA, 19 nt, Homo sapiens
cagcauuaugucuguauga

SEQ ID NO: 507093 - RNA, 19 nt, Homo sapiens
ugaaucaucacuaccaucu

SEQ ID NO: 507094 - RNA, 19 nt, Homo sapiens
agagggaaagucugaauca

SEQ ID NO: 507095 - RNA, 19 nt, Homo sapiens
cuucuggcuuagucuguuu

SEQ ID NO: 507096 - RNA, 19 nt, Homo sapiens
caacagccagaagcaguau

SEQ ID NO: 507097 - RNA, 19 nt, Homo sapiens
caggcugacuggcaggaau

SEQ ID NO: 507098 - RNA, 19 nt, Homo sapiens
caagcugggugcuguugcu

SEQ ID NO: 507099 - RNA, 19 nt, Homo sapiens
caccaccugcuacacagua

SEQ ID NO: 507100 - RNA, 19 nt, Homo sapiens
gugguuugacagcaucaua

SEQ ID NO: 507101 - RNA, 19 nt, Homo sapiens
auuaccaccugaccucuug

SEQ ID NO: 507102 - RNA, 19 nt, Homo sapiens
ugcagagcuuuggccauua

SEQ ID NO: 507103 - RNA, 19 nt, Homo sapiens
agacccugcugacacugaa

SEQ ID NO: 507104 - RNA, 19 nt, Homo sapiens
ugagaaagucaaggauguu

SEQ ID NO: 507105 - RNA, 19 nt, Homo sapiens
ggaaggggccaugacuuuu

SEQ ID NO: 507106 - RNA, 19 nt, Homo sapiens
gccaaaucaccaccugcua

SEQ ID NO: 507107 - RNA, 19 nt, Homo sapiens
gaaucagaaggugguuuga

SEQ ID NO: 507108 - RNA, 19 nt, Homo sapiens
guauauccuugcgauguac

SEQ ID NO: 507109 - RNA, 19 nt, Homo sapiens
gaaauggcgaaugucauac

SEQ ID NO: 507110 - RNA, 19 nt, Homo sapiens
gucaaggauguucaguaua

SEQ ID NO: 507111 - RNA, 19 nt, Homo sapiens
agcauuaugucuguaugaa

SEQ ID NO: 507112 - RNA, 19 nt, Homo sapiens
ucuguggugugaaacuaga

SEQ ID NO: 507113 - RNA, 19 nt, Homo sapiens
gguccucagugauggaaaa

SEQ ID NO: 507114 - RNA, 19 nt, Homo sapiens
aaagaggacucgcuuguaa

SEQ ID NO: 507115 - RNA, 19 nt, Homo sapiens
caacauaacccacuuguca

SEQ ID NO: 507116 - RNA, 19 nt, Homo sapiens
gaggaaagcuacaagaaag

SEQ ID NO: 507117 - RNA, 19 nt, Homo sapiens
caagaucggcguuaaggua

SEQ ID NO: 507118 - RNA, 19 nt, Homo sapiens
ggaggaaagcuacaagaaa

SEQ ID NO: 507119 - RNA, 19 nt, Homo sapiens
gauguaggcuucuauuguc

SEQ ID NO: 507120 - RNA, 19 nt, Homo sapiens
guaaaacgcugucaaaagu

SEQ ID NO: 507121 - RNA, 19 nt, Homo sapiens
uaagguaacaccagaauau

SEQ ID NO: 507122 - RNA, 19 nt, Homo sapiens
gcacacgacuccguucuca

SEQ ID NO: 507123 - RNA, 19 nt, Homo sapiens
ccaacaagaucggcguuaa

SEQ ID NO: 507124 - RNA, 19 nt, Homo sapiens
ucuauugucuuguugcuuu

SEQ ID NO: 507125 - RNA, 19 nt, Homo sapiens
gcaaagaggacucgcuugu

SEQ ID NO: 507126 - RNA, 19 nt, Homo sapiens
gguaacaccagaauauuug

SEQ ID NO: 507127 - RNA, 19 nt, Homo sapiens
cuaauuaucucgggcaaga

SEQ ID NO: 507128 - RNA, 19 nt, Homo sapiens
cauccaaucucaaggaauc

SEQ ID NO: 507129 - RNA, 19 nt, Homo sapiens
caaagaggacucgcuugua

SEQ ID NO: 507130 - RNA, 19 nt, Homo sapiens
acauggcucuggacucuaa

SEQ ID NO: 507131 - RNA, 19 nt, Homo sapiens
gggacacucugccagcaaa

SEQ ID NO: 507132 - RNA, 19 nt, Homo sapiens
ugacauggcucuggacucu

SEQ ID NO: 507133 - RNA, 19 nt, Homo sapiens
gcauguaagcuaauuaucu

SEQ ID NO: 507134 - RNA, 19 nt, Homo sapiens
caaccaagcgcauccaauc

SEQ ID NO: 507135 - RNA, 19 nt, Homo sapiens
cauguaagcuaauuaucuc

SEQ ID NO: 507136 - RNA, 19 nt, Homo sapiens
ccaaacugcuggacgucuu

SEQ ID NO: 507137 - RNA, 19 nt, Homo sapiens
ccacgcaggucaagaucug

SEQ ID NO: 507138 - RNA, 19 nt, Homo sapiens
ccaagcgcauccaaucuca

SEQ ID NO: 507139 - RNA, 19 nt, Homo sapiens
caagauguaggcuucuauu

SEQ ID NO: 507140 - RNA, 19 nt, Homo sapiens
gcuuguaaauaccaggauu

SEQ ID NO: 507141 - RNA, 19 nt, Homo sapiens
ccagaaccaccgcuacaaa

SEQ ID NO: 507142 - RNA, 19 nt, Homo sapiens
guaggcuucuauugucuug

SEQ ID NO: 507143 - RNA, 19 nt, Homo sapiens
ggcaagauguaggcuucua

SEQ ID NO: 507144 - RNA, 19 nt, Homo sapiens
ggaaagcuacaagaaagug

SEQ ID NO: 507145 - RNA, 19 nt, Homo sapiens
gcaagauguaggcuucuau

SEQ ID NO: 507146 - RNA, 19 nt, Homo sapiens
cagcauguaagcuaauuau

SEQ ID NO: 507147 - RNA, 19 nt, Homo sapiens
gcaccuggccagcaugauc

SEQ ID NO: 507148 - RNA, 19 nt, Homo sapiens
gcauugacaaaucugugua

SEQ ID NO: 507149 - RNA, 19 nt, Homo sapiens
ucaucagcauguaagcuaa

SEQ ID NO: 507150 - RNA, 19 nt, Homo sapiens
caaucucaaggaaucuuua

SEQ ID NO: 507151 - RNA, 19 nt, Homo sapiens
auaacccacuugucacuga

SEQ ID NO: 507152 - RNA, 19 nt, Homo sapiens
aggacucgcuuguaaauac

SEQ ID NO: 507153 - RNA, 19 nt, Homo sapiens
acaagaaagugggcaugga

SEQ ID NO: 507154 - RNA, 19 nt, Homo sapiens
caacaagaucggcguuaag

SEQ ID NO: 507155 - RNA, 19 nt, Homo sapiens
cuauugucuuguugcuuua

SEQ ID NO: 507156 - RNA, 19 nt, Homo sapiens
gaggacucgcuuguaaaua

SEQ ID NO: 507157 - RNA, 19 nt, Homo sapiens
gucaaaaguuggacuaaau

SEQ ID NO: 507158 - RNA, 19 nt, Homo sapiens
gcgcauccaaucucaagga

SEQ ID NO: 507159 - RNA, 19 nt, Homo sapiens
caaacugcuggacgucuuu

SEQ ID NO: 507160 - RNA, 19 nt, Homo sapiens
gagcaccuggccagcauga

SEQ ID NO: 507161 - RNA, 19 nt, Homo sapiens
gucaucagcauguaagcua

SEQ ID NO: 507162 - RNA, 19 nt, Homo sapiens
ccuccacucaagccaauua

SEQ ID NO: 507163 - RNA, 19 nt, Homo sapiens
aggcuucuauugucuuguu

SEQ ID NO: 507164 - RNA, 19 nt, Homo sapiens
ccgcgaaaauaguuuguuu

SEQ ID NO: 507165 - RNA, 19 nt, Homo sapiens
aagcagagaagggcauaaa

SEQ ID NO: 507166 - RNA, 19 nt, Homo sapiens
agauguaggcuucuauugu

SEQ ID NO: 507167 - RNA, 19 nt, Homo sapiens
ccacucaagccaauuaagg

SEQ ID NO: 507168 - RNA, 19 nt, Homo sapiens
gcguuuagaccaaggaaca

SEQ ID NO: 507169 - RNA, 19 nt, Homo sapiens
aagaucggcguuaagguaa

SEQ ID NO: 507170 - RNA, 19 nt, Homo sapiens
ccccagcccuucacauuuu

SEQ ID NO: 507171 - RNA, 19 nt, Homo sapiens
ccacacagaccaccaucca

SEQ ID NO: 507172 - RNA, 19 nt, Homo sapiens
gaaccaccgcuacaaaaug

SEQ ID NO: 507173 - RNA, 19 nt, Homo sapiens
uuaugggcauugacaaauc

SEQ ID NO: 507174 - RNA, 19 nt, Homo sapiens
ccaaucucaaggaaucuuu

SEQ ID NO: 507175 - RNA, 19 nt, Homo sapiens
ggacgugagcaagaacaug

SEQ ID NO: 507176 - RNA, 19 nt, Homo sapiens
agguaacaccagaauauuu

SEQ ID NO: 507177 - RNA, 19 nt, Homo sapiens
aaaacgcugucaaaaguug

SEQ ID NO: 507178 - RNA, 19 nt, Homo sapiens
gugaacuuguagcuguaaa

SEQ ID NO: 507179 - RNA, 19 nt, Homo sapiens
guguuuaccuugucaucag

SEQ ID NO: 507180 - RNA, 19 nt, Homo sapiens
agaggacucgcuuguaaau

SEQ ID NO: 507181 - RNA, 19 nt, Homo sapiens
cugcuggacgucuuucuuu

SEQ ID NO: 507182 - RNA, 19 nt, Homo sapiens
uggaggaaagcuacaagaa

SEQ ID NO: 507183 - RNA, 19 nt, Homo sapiens
ucacugacacaaaggaagu

SEQ ID NO: 507184 - RNA, 19 nt, Homo sapiens
cuaaagaccaaacuucacu

SEQ ID NO: 507185 - RNA, 19 nt, Homo sapiens
cucaaggaaucuuuaagca

SEQ ID NO: 507186 - RNA, 19 nt, Homo sapiens
gcgcuucgacuuuucuuaa

SEQ ID NO: 507187 - RNA, 19 nt, Homo sapiens
uuaagguaacaccagaaua

SEQ ID NO: 507188 - RNA, 19 nt, Homo sapiens
uaugggcauugacaaaucu

SEQ ID NO: 507189 - RNA, 19 nt, Homo sapiens
acacgacuccguucucagu

SEQ ID NO: 507190 - RNA, 19 nt, Homo sapiens
ucuggacucuaaagaccaa

SEQ ID NO: 507191 - RNA, 19 nt, Homo sapiens
ugccgguccuggugaaaga

SEQ ID NO: 507192 - RNA, 19 nt, Homo sapiens
acguguacauccaacaaga

SEQ ID NO: 507193 - RNA, 19 nt, Homo sapiens
ucagcauguaagcuaauua

SEQ ID NO: 507194 - RNA, 19 nt, Homo sapiens
gcuccacgcgcuucgacuu

SEQ ID NO: 507195 - RNA, 19 nt, Homo sapiens
gcacagaguuguuacauuu

SEQ ID NO: 507196 - RNA, 19 nt, Homo sapiens
caacaaagguguauagaaa

SEQ ID NO: 507197 - RNA, 19 nt, Homo sapiens
gcaaagacauugauagaaa

SEQ ID NO: 507198 - RNA, 19 nt, Homo sapiens
caacguagcucuggcauua

SEQ ID NO: 507199 - RNA, 19 nt, Homo sapiens
gaaguaauaugcacacauu

SEQ ID NO: 507200 - RNA, 19 nt, Homo sapiens
ggaaauacaugauccaaga

SEQ ID NO: 507201 - RNA, 19 nt, Homo sapiens
gagaagaaccagauauuua

SEQ ID NO: 507202 - RNA, 19 nt, Homo sapiens
gaagaacaguggucauauu

SEQ ID NO: 507203 - RNA, 19 nt, Homo sapiens
gagaagaagugaccauauu

SEQ ID NO: 507204 - RNA, 19 nt, Homo sapiens
caaaagaucugcauccuua

SEQ ID NO: 507205 - RNA, 19 nt, Homo sapiens
gcaaggagauuuacaacug

SEQ ID NO: 507206 - RNA, 19 nt, Homo sapiens
ucaagaaggugauguugua

SEQ ID NO: 507207 - RNA, 19 nt, Homo sapiens
ggaagaggaugaagaugaa

SEQ ID NO: 507208 - RNA, 19 nt, Homo sapiens
gaagaaaguucaaauacca

SEQ ID NO: 507209 - RNA, 19 nt, Homo sapiens
gaaaacagcugucauacuu

SEQ ID NO: 507210 - RNA, 19 nt, Homo sapiens
gcaaccagauguggauuua

SEQ ID NO: 507211 - RNA, 19 nt, Homo sapiens
uaaggaugcuuguacauaa

SEQ ID NO: 507212 - RNA, 19 nt, Homo sapiens
gaagccaccugaagauauu

SEQ ID NO: 507213 - RNA, 19 nt, Homo sapiens
gaaccacucuaucaaguau

SEQ ID NO: 507214 - RNA, 19 nt, Homo sapiens
uaacagaaauguacagcaa

SEQ ID NO: 507215 - RNA, 19 nt, Homo sapiens
ggaagaaguuacaguugaa

SEQ ID NO: 507216 - RNA, 19 nt, Homo sapiens
gauaauacaccacuacauu

SEQ ID NO: 507217 - RNA, 19 nt, Homo sapiens
gaguagagaugaagagaga

SEQ ID NO: 507218 - RNA, 19 nt, Homo sapiens
ggcuagagguucaaagaua

SEQ ID NO: 507219 - RNA, 19 nt, Homo sapiens
ggagagguguuccguguug

SEQ ID NO: 507220 - RNA, 19 nt, Homo sapiens
agaggaaggugaucaaauu

SEQ ID NO: 507221 - RNA, 19 nt, Homo sapiens
caaaguacacuguuucaaa

SEQ ID NO: 507222 - RNA, 19 nt, Homo sapiens
gaaacugguguuaguauaa

SEQ ID NO: 507223 - RNA, 19 nt, Homo sapiens
uaaagcagcguuucuauga

SEQ ID NO: 507224 - RNA, 19 nt, Homo sapiens
gcauuuguuugaacugaua

SEQ ID NO: 507225 - RNA, 19 nt, Homo sapiens
gaaguagcaucuaaaccuu

SEQ ID NO: 507226 - RNA, 19 nt, Homo sapiens
gagaaaagcuggcaagaga

SEQ ID NO: 507227 - RNA, 19 nt, Homo sapiens
gaagaaggauguuuaucgu

SEQ ID NO: 507228 - RNA, 19 nt, Homo sapiens
cagagaagccuaaauauca

SEQ ID NO: 507229 - RNA, 19 nt, Homo sapiens
gcuaagagaucaagaacca

SEQ ID NO: 507230 - RNA, 19 nt, Homo sapiens
ggauagaagugcaaguaga

SEQ ID NO: 507231 - RNA, 19 nt, Homo sapiens
gaauauauaaccaguguug

SEQ ID NO: 507232 - RNA, 19 nt, Homo sapiens
caagugaaacugcacauaa

SEQ ID NO: 507233 - RNA, 19 nt, Homo sapiens
ccaagaaggauguaaauga

SEQ ID NO: 507234 - RNA, 19 nt, Homo sapiens
ggauuuggauuuggaauug

SEQ ID NO: 507235 - RNA, 19 nt, Homo sapiens
uaaccaguguuguggauuu

SEQ ID NO: 507236 - RNA, 19 nt, Homo sapiens
gaacuagaugaaacucuua

SEQ ID NO: 507237 - RNA, 19 nt, Homo sapiens
guggauaccuuguacaaug

SEQ ID NO: 507238 - RNA, 19 nt, Homo sapiens
gggcuacgcuauugaaugu

SEQ ID NO: 507239 - RNA, 19 nt, Homo sapiens
aaacagcugucauacuuug

SEQ ID NO: 507240 - RNA, 19 nt, Homo sapiens
gcauguagauccaacaaag

SEQ ID NO: 507241 - RNA, 19 nt, Homo sapiens
gaaucucccuauggacuua

SEQ ID NO: 507242 - RNA, 19 nt, Homo sapiens
gaucaaauucucaggguaa

SEQ ID NO: 507243 - RNA, 19 nt, Homo sapiens
ucagaauucucuaguuuga

SEQ ID NO: 507244 - RNA, 19 nt, Homo sapiens
ucagcacgauuucuguuua

SEQ ID NO: 507245 - RNA, 19 nt, Homo sapiens
agaauaagccagcaacuuu

SEQ ID NO: 507246 - RNA, 19 nt, Homo sapiens
ccaccuccaucucagaaua

SEQ ID NO: 507247 - RNA, 19 nt, Homo sapiens
gaagaagaaggauguuuau

SEQ ID NO: 507248 - RNA, 19 nt, Homo sapiens
uaacggaguuucaauggau

SEQ ID NO: 507249 - RNA, 19 nt, Homo sapiens
aaaugcaccuggaauauau

SEQ ID NO: 507250 - RNA, 19 nt, Homo sapiens
cugcuuaacuucacauauu

SEQ ID NO: 507251 - RNA, 19 nt, Homo sapiens
gcuagagguucaaagauau

SEQ ID NO: 507252 - RNA, 19 nt, Homo sapiens
cagcauccuuccaccuuua

SEQ ID NO: 507253 - RNA, 19 nt, Homo sapiens
cauagaaacugguguuagu

SEQ ID NO: 507254 - RNA, 19 nt, Homo sapiens
gugcugaguuccauagaaa

SEQ ID NO: 507255 - RNA, 19 nt, Homo sapiens
guaggagauucuuucuaua

SEQ ID NO: 507256 - RNA, 19 nt, Homo sapiens
uguaggagauucuuucuau

SEQ ID NO: 507257 - RNA, 19 nt, Homo sapiens
uggaaaugauguuggaaua

SEQ ID NO: 507258 - RNA, 19 nt, Homo sapiens
gaaugucccugaucuuucu

SEQ ID NO: 507259 - RNA, 19 nt, Homo sapiens
cacgauuucuguuuagaua

SEQ ID NO: 507260 - RNA, 19 nt, Homo sapiens
gacaaugacuuacuguaca

SEQ ID NO: 507261 - RNA, 19 nt, Homo sapiens
gaacgcaaguuugaaaguc

SEQ ID NO: 507262 - RNA, 19 nt, Homo sapiens
gaggguacuuuccacguuu

SEQ ID NO: 507263 - RNA, 19 nt, Homo sapiens
ggccuacacugaucaagaa

SEQ ID NO: 507264 - RNA, 19 nt, Homo sapiens
cgagcgaucucauaaacuu

SEQ ID NO: 507265 - RNA, 19 nt, Homo sapiens
aaaggaaucucccuaugga

SEQ ID NO: 507266 - RNA, 19 nt, Homo sapiens
gaaaggaggaccagcugaa

SEQ ID NO: 507267 - RNA, 19 nt, Homo sapiens
gaaaugccuuacccucaug

SEQ ID NO: 507268 - RNA, 19 nt, Homo sapiens
uaaaugcaccuggaauaua

SEQ ID NO: 507269 - RNA, 19 nt, Homo sapiens
guaauucagugucauugga

SEQ ID NO: 507270 - RNA, 19 nt, Homo sapiens
gagguuauguccagaaucu

SEQ ID NO: 507271 - RNA, 19 nt, Homo sapiens
agaagaagaaggauguuua

SEQ ID NO: 507272 - RNA, 19 nt, Homo sapiens
gaugguguccuaccuaauu

SEQ ID NO: 507273 - RNA, 19 nt, Homo sapiens
gaaggaagaagaaaguuca

SEQ ID NO: 507274 - RNA, 19 nt, Homo sapiens
gacaaagacugaguacguu

SEQ ID NO: 507275 - RNA, 19 nt, Homo sapiens
ugacgggacuguugguauu

SEQ ID NO: 507276 - RNA, 19 nt, Homo sapiens
gcacagcaauggaggaaac

SEQ ID NO: 507277 - RNA, 19 nt, Homo sapiens
agaaaggucuaaaggcaaa

SEQ ID NO: 507278 - RNA, 19 nt, Homo sapiens
agaaggugauguuguauug

SEQ ID NO: 507279 - RNA, 19 nt, Homo sapiens
ggaugaagaugaagauggu

SEQ ID NO: 507280 - RNA, 19 nt, Homo sapiens
cagcgcgucucuccacaua

SEQ ID NO: 507281 - RNA, 19 nt, Homo sapiens
accacaagcugauucuuua

SEQ ID NO: 507282 - RNA, 19 nt, Homo sapiens
ccucugcuguuaaucauaa

SEQ ID NO: 507283 - RNA, 19 nt, Homo sapiens
agaaacugguguuaguaua

SEQ ID NO: 507284 - RNA, 19 nt, Homo sapiens
gcagagaagccuaaauauc

SEQ ID NO: 507285 - RNA, 19 nt, Homo sapiens
caauagugauuucagaugu

SEQ ID NO: 507286 - RNA, 19 nt, Homo sapiens
caaggaaggcuuagaggaa

SEQ ID NO: 507287 - RNA, 19 nt, Homo sapiens
caagauaguuuggcagcaa

SEQ ID NO: 507288 - RNA, 19 nt, Homo sapiens
gcaagccauauauuuguua

SEQ ID NO: 507289 - RNA, 19 nt, Homo sapiens
ggaagaagaaaguucaaau

SEQ ID NO: 507290 - RNA, 19 nt, Homo sapiens
acucagaauucucuaguuu

SEQ ID NO: 507291 - RNA, 19 nt, Homo sapiens
gagcugcgcuuaccacacu

SEQ ID NO: 507292 - RNA, 19 nt, Homo sapiens
cuacacugaucaagaacua

SEQ ID NO: 507293 - RNA, 19 nt, Homo sapiens
aaacaaacaccuucucuuc

SEQ ID NO: 507294 - RNA, 19 nt, Homo sapiens
gaaguuacaguugaaagaa

SEQ ID NO: 507295 - RNA, 19 nt, Homo sapiens
gcacagaguuguuacauuu

SEQ ID NO: 507296 - RNA, 19 nt, Homo sapiens
gcaaagacauugauagaaa

SEQ ID NO: 507297 - RNA, 19 nt, Homo sapiens
caacguagcucuggcauua

SEQ ID NO: 507298 - RNA, 19 nt, Homo sapiens
gaaguaauaugcacacauu

SEQ ID NO: 507299 - RNA, 19 nt, Homo sapiens
ggaaauacaugauccaaga

SEQ ID NO: 507300 - RNA, 19 nt, Homo sapiens
gagaagaaccagauauuua

SEQ ID NO: 507301 - RNA, 19 nt, Homo sapiens
gaagaacaguggucauauu

SEQ ID NO: 507302 - RNA, 19 nt, Homo sapiens
gagaagaagugaccauauu

SEQ ID NO: 507303 - RNA, 19 nt, Homo sapiens
caaaagaucugcauccuua

SEQ ID NO: 507304 - RNA, 19 nt, Homo sapiens
gcaaggagauuuacaacug

SEQ ID NO: 507305 - RNA, 19 nt, Homo sapiens
ucaagaaggugauguugua

SEQ ID NO: 507306 - RNA, 19 nt, Homo sapiens
ggaagaggaugaagaugaa

SEQ ID NO: 507307 - RNA, 19 nt, Homo sapiens
gaagaaaguucaaauacca

SEQ ID NO: 507308 - RNA, 19 nt, Homo sapiens
gaaaacagcugucauacuu

SEQ ID NO: 507309 - RNA, 19 nt, Homo sapiens
gcaaccagauguggauuua

SEQ ID NO: 507310 - RNA, 19 nt, Homo sapiens
uaaggaugcuuguacauaa

SEQ ID NO: 507311 - RNA, 19 nt, Homo sapiens
gaagccaccugaagauauu

SEQ ID NO: 507312 - RNA, 19 nt, Homo sapiens
gaaccacucuaucaaguau

SEQ ID NO: 507313 - RNA, 19 nt, Homo sapiens
uaacagaaauguacagcaa

SEQ ID NO: 507314 - RNA, 19 nt, Homo sapiens
ggaagaaguuacaguugaa

SEQ ID NO: 507315 - RNA, 19 nt, Homo sapiens
gauaauacaccacuacauu

SEQ ID NO: 507316 - RNA, 19 nt, Homo sapiens
gaguagagaugaagagaga

SEQ ID NO: 507317 - RNA, 19 nt, Homo sapiens
ggcuagagguucaaagaua

SEQ ID NO: 507318 - RNA, 19 nt, Homo sapiens
ggagagguguuccguguug

SEQ ID NO: 507319 - RNA, 19 nt, Homo sapiens
agaggaaggugaucaaauu

SEQ ID NO: 507320 - RNA, 19 nt, Homo sapiens
caaaguacacuguuucaaa

SEQ ID NO: 507321 - RNA, 19 nt, Homo sapiens
gaaacugguguuaguauaa

SEQ ID NO: 507322 - RNA, 19 nt, Homo sapiens
uaaagcagcguuucuauga

SEQ ID NO: 507323 - RNA, 19 nt, Homo sapiens
gcauuuguuugaacugaua

SEQ ID NO: 507324 - RNA, 19 nt, Homo sapiens
gaaguagcaucuaaaccuu

SEQ ID NO: 507325 - RNA, 19 nt, Homo sapiens
gagaaaagcuggcaagaga

SEQ ID NO: 507326 - RNA, 19 nt, Homo sapiens
gaagaaggauguuuaucgu

SEQ ID NO: 507327 - RNA, 19 nt, Homo sapiens
cagagaagccuaaauauca

SEQ ID NO: 507328 - RNA, 19 nt, Homo sapiens
ggauagaagugcaaguaga

SEQ ID NO: 507329 - RNA, 19 nt, Homo sapiens
gaauauauaaccaguguug

SEQ ID NO: 507330 - RNA, 19 nt, Homo sapiens
caagugaaacugcacauaa

SEQ ID NO: 507331 - RNA, 19 nt, Homo sapiens
ccaagaaggauguaaauga

SEQ ID NO: 507332 - RNA, 19 nt, Homo sapiens
ggauuuggauuuggaauug

SEQ ID NO: 507333 - RNA, 19 nt, Homo sapiens
uaaccaguguuguggauuu

SEQ ID NO: 507334 - RNA, 19 nt, Homo sapiens
gaacuagaugaaacucuua

SEQ ID NO: 507335 - RNA, 19 nt, Homo sapiens
guggauaccuuguacaaug

SEQ ID NO: 507336 - RNA, 19 nt, Homo sapiens
gggcuacgcuauugaaugu

SEQ ID NO: 507337 - RNA, 19 nt, Homo sapiens
aaacagcugucauacuuug

SEQ ID NO: 507338 - RNA, 19 nt, Homo sapiens
gaaucucccuauggacuua

SEQ ID NO: 507339 - RNA, 19 nt, Homo sapiens
gaucaaauucucaggguaa

SEQ ID NO: 507340 - RNA, 19 nt, Homo sapiens
ucagaauucucuaguuuga

SEQ ID NO: 507341 - RNA, 19 nt, Homo sapiens
ucagcacgauuucuguuua

SEQ ID NO: 507342 - RNA, 19 nt, Homo sapiens
agaauaagccagcaacuuu

SEQ ID NO: 507343 - RNA, 19 nt, Homo sapiens
ccaccuccaucucagaaua

SEQ ID NO: 507344 - RNA, 19 nt, Homo sapiens
gaagaagaaggauguuuau

SEQ ID NO: 507345 - RNA, 19 nt, Homo sapiens
uaacggaguuucaauggau

SEQ ID NO: 507346 - RNA, 19 nt, Homo sapiens
aaaugcaccuggaauauau

SEQ ID NO: 507347 - RNA, 19 nt, Homo sapiens
cugcuuaacuucacauauu

SEQ ID NO: 507348 - RNA, 19 nt, Homo sapiens
gcuagagguucaaagauau

SEQ ID NO: 507349 - RNA, 19 nt, Homo sapiens
cagcauccuuccaccuuua

SEQ ID NO: 507350 - RNA, 19 nt, Homo sapiens
cauagaaacugguguuagu

SEQ ID NO: 507351 - RNA, 19 nt, Homo sapiens
gugcugaguuccauagaaa

SEQ ID NO: 507352 - RNA, 19 nt, Homo sapiens
guaggagauucuuucuaua

SEQ ID NO: 507353 - RNA, 19 nt, Homo sapiens
uguaggagauucuuucuau

SEQ ID NO: 507354 - RNA, 19 nt, Homo sapiens
uggaaaugauguuggaaua

SEQ ID NO: 507355 - RNA, 19 nt, Homo sapiens
gaaugucccugaucuuucu

SEQ ID NO: 507356 - RNA, 19 nt, Homo sapiens
cacgauuucuguuuagaua

SEQ ID NO: 507357 - RNA, 19 nt, Homo sapiens
gacaaugacuuacuguaca

SEQ ID NO: 507358 - RNA, 19 nt, Homo sapiens
gaacgcaaguuugaaaguc

SEQ ID NO: 507359 - RNA, 19 nt, Homo sapiens
gaggguacuuuccacguuu

SEQ ID NO: 507360 - RNA, 19 nt, Homo sapiens
ggccuacacugaucaagaa

SEQ ID NO: 507361 - RNA, 19 nt, Homo sapiens
cgagcgaucucauaaacuu

SEQ ID NO: 507362 - RNA, 19 nt, Homo sapiens
aaaggaaucucccuaugga

SEQ ID NO: 507363 - RNA, 19 nt, Homo sapiens
gaaaggaggaccagcugaa

SEQ ID NO: 507364 - RNA, 19 nt, Homo sapiens
gaaaugccuuacccucaug

SEQ ID NO: 507365 - RNA, 19 nt, Homo sapiens
uaaaugcaccuggaauaua

SEQ ID NO: 507366 - RNA, 19 nt, Homo sapiens
guaauucagugucauugga

SEQ ID NO: 507367 - RNA, 19 nt, Homo sapiens
gagguuauguccagaaucu

SEQ ID NO: 507368 - RNA, 19 nt, Homo sapiens
agaagaagaaggauguuua

SEQ ID NO: 507369 - RNA, 19 nt, Homo sapiens
gaugguguccuaccuaauu

SEQ ID NO: 507370 - RNA, 19 nt, Homo sapiens
gaaggaagaagaaaguuca

SEQ ID NO: 507371 - RNA, 19 nt, Homo sapiens
gcacagcaauggaggaaac

SEQ ID NO: 507372 - RNA, 19 nt, Homo sapiens
gacaaagacugaguacguu

SEQ ID NO: 507373 - RNA, 19 nt, Homo sapiens
ugacgggacuguugguauu

SEQ ID NO: 507374 - RNA, 19 nt, Homo sapiens
agaaaggucuaaaggcaaa

SEQ ID NO: 507375 - RNA, 19 nt, Homo sapiens
agaaggugauguuguauug

SEQ ID NO: 507376 - RNA, 19 nt, Homo sapiens
ggaugaagaugaagauggu

SEQ ID NO: 507377 - RNA, 19 nt, Homo sapiens
cagcgcgucucuccacaua

SEQ ID NO: 507378 - RNA, 19 nt, Homo sapiens
agaaacugguguuaguaua

SEQ ID NO: 507379 - RNA, 19 nt, Homo sapiens
gcagagaagccuaaauauc

SEQ ID NO: 507380 - RNA, 19 nt, Homo sapiens
caaggaaggcuuagaggaa

SEQ ID NO: 507381 - RNA, 19 nt, Homo sapiens
caagauaguuuggcagcaa

SEQ ID NO: 507382 - RNA, 19 nt, Homo sapiens
gcaagccauauauuuguua

SEQ ID NO: 507383 - RNA, 19 nt, Homo sapiens
ggaagaagaaaguucaaau

SEQ ID NO: 507384 - RNA, 19 nt, Homo sapiens
caauagugauuucagaugu

SEQ ID NO: 507385 - RNA, 19 nt, Homo sapiens
acucagaauucucuaguuu

SEQ ID NO: 507386 - RNA, 19 nt, Homo sapiens
gagcugcgcuuaccacacu

SEQ ID NO: 507387 - RNA, 19 nt, Homo sapiens
cuacacugaucaagaacua

SEQ ID NO: 507388 - RNA, 19 nt, Homo sapiens
aaacaaacaccuucucuuc

SEQ ID NO: 507389 - RNA, 19 nt, Homo sapiens
gaaguuacaguugaaagaa

SEQ ID NO: 507390 - RNA, 19 nt, Homo sapiens
uggaagaaguuacaguuga

SEQ ID NO: 507391 - RNA, 19 nt, Homo sapiens
uaucgucacugcuuaacuu

SEQ ID NO: 507392 - RNA, 19 nt, Homo sapiens
gguauuggcuagagguuca

SEQ ID NO: 507393 - RNA, 19 nt, Homo sapiens
caagaaggauguaaaugac

SEQ ID NO: 507394 - RNA, 19 nt, Homo sapiens
caacagguguauagaaagg

SEQ ID NO: 507395 - RNA, 19 nt, Homo sapiens
gggcuuaucucuucaagug

SEQ ID NO: 507396 - RNA, 19 nt, Homo sapiens
gcauuaaccugcccacugu

SEQ ID NO: 507397 - RNA, 19 nt, Homo sapiens
gaucaaguaugccaaagac

SEQ ID NO: 507398 - RNA, 19 nt, Homo sapiens
ugcuguagcuuaugaaauu

SEQ ID NO: 507399 - RNA, 19 nt, Homo sapiens
ccaagaggcucggcacaga

SEQ ID NO: 507400 - RNA, 19 nt, Homo sapiens
guccgucgcuuccagauug

SEQ ID NO: 507401 - RNA, 19 nt, Homo sapiens
gcuguagcuuaugaaauua

SEQ ID NO: 507402 - RNA, 19 nt, Homo sapiens
gaagccgccuauaccaaga

SEQ ID NO: 507403 - RNA, 19 nt, Homo sapiens
ggcuuucacugcugaguuu

SEQ ID NO: 507404 - RNA, 19 nt, Homo sapiens
gacaucagccugcuucuuc

SEQ ID NO: 507405 - RNA, 19 nt, Homo sapiens
gggccgauguucucaggaa

SEQ ID NO: 507406 - RNA, 19 nt, Homo sapiens
gauucacgcccucuuguuu

SEQ ID NO: 507407 - RNA, 19 nt, Homo sapiens
acaagugccuggugaucaa

SEQ ID NO: 507408 - RNA, 19 nt, Homo sapiens
ggaacaacagcaucuuuca

SEQ ID NO: 507409 - RNA, 19 nt, Homo sapiens
gcuuccagauugcucagua

SEQ ID NO: 507410 - RNA, 19 nt, Homo sapiens
ggacggccuuggagaguac

SEQ ID NO: 507411 - RNA, 19 nt, Homo sapiens
ccucugcuguagcuuauga

SEQ ID NO: 507412 - RNA, 19 nt, Homo sapiens
gggacggccuuggagagua

SEQ ID NO: 507413 - RNA, 19 nt, Homo sapiens
agaaggaggucgaggugau

SEQ ID NO: 507414 - RNA, 19 nt, Homo sapiens
caacagcaucuuucaccaa

SEQ ID NO: 507415 - RNA, 19 nt, Homo sapiens
gaaggaggucgaggugauu

SEQ ID NO: 507416 - RNA, 19 nt, Homo sapiens
ucugggaacucuccuuugu

SEQ ID NO: 507417 - RNA, 19 nt, Homo sapiens
ccagauugcucaguacaag

SEQ ID NO: 507418 - RNA, 19 nt, Homo sapiens
gguccacgccucugcugua

SEQ ID NO: 507419 - RNA, 19 nt, Homo sapiens
ugggaacucuccuuugugu

SEQ ID NO: 507420 - RNA, 19 nt, Homo sapiens
caugcucccuccucuccua

SEQ ID NO: 507421 - RNA, 19 nt, Homo sapiens
gggcagauccaggugauuc

SEQ ID NO: 507422 - RNA, 19 nt, Homo sapiens
caggaacaacagcaucuuu

SEQ ID NO: 507423 - RNA, 19 nt, Homo sapiens
gaccacaccuuggccuucu

SEQ ID NO: 507424 - RNA, 19 nt, Homo sapiens
ugucggcucugcuacuuca

SEQ ID NO: 507425 - RNA, 19 nt, Homo sapiens
caaguaccacuccgugugu

SEQ ID NO: 507426 - RNA, 19 nt, Homo sapiens
gaacaacagcaucuuucac

SEQ ID NO: 507427 - RNA, 19 nt, Homo sapiens
ggauucacgcccucuuguu

SEQ ID NO: 507428 - RNA, 19 nt, Homo sapiens
gggaagccgccuauaccaa

SEQ ID NO: 507429 - RNA, 19 nt, Homo sapiens
ggugaucaaguaugccaaa

SEQ ID NO: 507430 - RNA, 19 nt, Homo sapiens
ccacgccucugcuguagcu

SEQ ID NO: 507431 - RNA, 19 nt, Homo sapiens
ggccgauguucucaggaaa

SEQ ID NO: 507432 - RNA, 19 nt, Homo sapiens
ugacggcggugugcaugga

SEQ ID NO: 507433 - RNA, 19 nt, Homo sapiens
gagccuuggcccacacuga

SEQ ID NO: 507434 - RNA, 19 nt, Homo sapiens
ggagaguacucggguucgu

SEQ ID NO: 507435 - RNA, 19 nt, Homo sapiens
guacaagugccuggugauc

SEQ ID NO: 507436 - RNA, 19 nt, Homo sapiens
aauuguggcugcacuggau

SEQ ID NO: 507437 - RNA, 19 nt, Homo sapiens
cggcucugcuacuucaaga

SEQ ID NO: 507438 - RNA, 19 nt, Homo sapiens
ggccggacaacaaagagaa

SEQ ID NO: 507439 - RNA, 19 nt, Homo sapiens
ccgggaagaccguaauugu

SEQ ID NO: 507440 - RNA, 19 nt, Homo sapiens
cuuccuaccucuggugaug

SEQ ID NO: 507441 - RNA, 19 nt, Homo sapiens
ccaaagacacucgcuacag

SEQ ID NO: 507442 - RNA, 19 nt, Homo sapiens
cgggaagaccguaauugug

SEQ ID NO: 507443 - RNA, 19 nt, Homo sapiens
ggaaaugccucgagccaua

SEQ ID NO: 507444 - RNA, 19 nt, Homo sapiens
ggacgugucuguugauuug

SEQ ID NO: 507445 - RNA, 19 nt, Homo sapiens
caaguggccuuaagucuuu

SEQ ID NO: 507446 - RNA, 19 nt, Homo sapiens
gugcggagcugauaacauu

SEQ ID NO: 507447 - RNA, 19 nt, Homo sapiens
uaaaggcucuggaagcauu

SEQ ID NO: 507448 - RNA, 19 nt, Homo sapiens
gggauagucuggaaaguug

SEQ ID NO: 507449 - RNA, 19 nt, Homo sapiens
aaaucgggaucgaauauua

SEQ ID NO: 507450 - RNA, 19 nt, Homo sapiens
ggucucaucuccuuugcua

SEQ ID NO: 507451 - RNA, 19 nt, Homo sapiens
ggaccaauccugagacuug

SEQ ID NO: 507452 - RNA, 19 nt, Homo sapiens
cgacaugccuggaauucuu

SEQ ID NO: 507453 - RNA, 19 nt, Homo sapiens
gcaaauaaaggcucuggaa

SEQ ID NO: 507454 - RNA, 19 nt, Homo sapiens
uaccagagguuaaagaaga

SEQ ID NO: 507455 - RNA, 19 nt, Homo sapiens
gaaagucuguggcccuaag

SEQ ID NO: 507456 - RNA, 19 nt, Homo sapiens
uaacggagccuguguccaa

SEQ ID NO: 507457 - RNA, 19 nt, Homo sapiens
ugauuaagguccugcuuga

SEQ ID NO: 507458 - RNA, 19 nt, Homo sapiens
cauagagccugaaaucauc

SEQ ID NO: 507459 - RNA, 19 nt, Homo sapiens
ggaauuugaagcucagaaa

SEQ ID NO: 507460 - RNA, 19 nt, Homo sapiens
gauguuagaacucuuugaa

SEQ ID NO: 507461 - RNA, 19 nt, Homo sapiens
uggaauaccuggaagcaau

SEQ ID NO: 507462 - RNA, 19 nt, Homo sapiens
ccaaggacagucagcauuu

SEQ ID NO: 507463 - RNA, 19 nt, Homo sapiens
caguggagcuggcaccauu

SEQ ID NO: 507464 - RNA, 19 nt, Homo sapiens
cuaauggucucaucuccuu

SEQ ID NO: 507465 - RNA, 19 nt, Homo sapiens
cgagguaggagucuuauau

SEQ ID NO: 507466 - RNA, 19 nt, Homo sapiens
gucuauggcucaugucuga

SEQ ID NO: 507467 - RNA, 19 nt, Homo sapiens
gaagacgacaugccuggaa

SEQ ID NO: 507468 - RNA, 19 nt, Homo sapiens
ucacucagcuggacugcau

SEQ ID NO: 507469 - RNA, 19 nt, Homo sapiens
guauagaagugggaagaug

SEQ ID NO: 507470 - RNA, 19 nt, Homo sapiens
gaauauuaacuccagagaa

SEQ ID NO: 507471 - RNA, 19 nt, Homo sapiens
guagaaaaccuguauagaa

SEQ ID NO: 507472 - RNA, 19 nt, Homo sapiens
ucacagcgcaagauacauu

SEQ ID NO: 507473 - RNA, 19 nt, Homo sapiens
gcucuuggaauuacugaaa

SEQ ID NO: 507474 - RNA, 19 nt, Homo sapiens
cagagaaucggaagcauug

SEQ ID NO: 507475 - RNA, 19 nt, Homo sapiens
gaaaguugggauuugcaaa

SEQ ID NO: 507476 - RNA, 19 nt, Homo sapiens
uaucccaggugaggaauuu

SEQ ID NO: 507477 - RNA, 19 nt, Homo sapiens
gacuggaucuugaggaaca

SEQ ID NO: 507478 - RNA, 19 nt, Homo sapiens
ccaauccugagacuuguua

SEQ ID NO: 507479 - RNA, 19 nt, Homo sapiens
cagcuggacugcauugaag

SEQ ID NO: 507480 - RNA, 19 nt, Homo sapiens
ccugaaaucaucuuuguug

SEQ ID NO: 507481 - RNA, 19 nt, Homo sapiens
ggaauaccuggaagcaauu

SEQ ID NO: 507482 - RNA, 19 nt, Homo sapiens
ucagucuccuuggugauua

SEQ ID NO: 507483 - RNA, 19 nt, Homo sapiens
aaaggucuauggcucaugu

SEQ ID NO: 507484 - RNA, 19 nt, Homo sapiens
gaggauguuagaacucuuu

SEQ ID NO: 507485 - RNA, 19 nt, Homo sapiens
gaaaaccuguauagaagug

SEQ ID NO: 507486 - RNA, 19 nt, Homo sapiens
aauaaaggcucuggaagca

SEQ ID NO: 507487 - RNA, 19 nt, Homo sapiens
ccauagagccugaaaucau

SEQ ID NO: 507488 - RNA, 19 nt, Homo sapiens
uaagagagagacacaagug

SEQ ID NO: 507489 - RNA, 19 nt, Homo sapiens
ggacauugagauucacaug

SEQ ID NO: 507490 - RNA, 19 nt, Homo sapiens
gccaagcccuuugcuguuc

SEQ ID NO: 507491 - RNA, 19 nt, Homo sapiens
ugccagaaguggacuaugu

SEQ ID NO: 507492 - RNA, 19 nt, Homo sapiens
caaggacagucagcauuuc

SEQ ID NO: 507493 - RNA, 19 nt, Homo sapiens
gcagugugcggagcugaua

SEQ ID NO: 507494 - RNA, 19 nt, Homo sapiens
gccugcugcugccaaguua

SEQ ID NO: 507495 - RNA, 19 nt, Homo sapiens
ggaagcaauucaccaucuc

SEQ ID NO: 507496 - RNA, 19 nt, Homo sapiens
agacacaaguggccuuaag

SEQ ID NO: 507497 - RNA, 19 nt, Homo sapiens
gaacugcugccaacuccau

SEQ ID NO: 507498 - RNA, 19 nt, Homo sapiens
ggagcuggcaccauucaga

SEQ ID NO: 507499 - RNA, 19 nt, Homo sapiens
caauucaccaucuccauga

SEQ ID NO: 507500 - RNA, 19 nt, Homo sapiens
gugggaagaugccagaagu

SEQ ID NO: 507501 - RNA, 19 nt, Homo sapiens
gaaaauaccuuagcuucac

SEQ ID NO: 507502 - RNA, 19 nt, Homo sapiens
gacagacgucgagguguua

SEQ ID NO: 507503 - RNA, 19 nt, Homo sapiens
gaggcucucaugucucuuu

SEQ ID NO: 507504 - RNA, 19 nt, Homo sapiens
guuggaggcucucaugucu

SEQ ID NO: 507505 - RNA, 19 nt, Homo sapiens
caucuuuguuggcucagaa

SEQ ID NO: 507506 - RNA, 19 nt, Homo sapiens
ggaauuacugaaagucugu

SEQ ID NO: 507507 - RNA, 19 nt, Homo sapiens
ccagagaaucggaagcauu

SEQ ID NO: 507508 - RNA, 19 nt, Homo sapiens
ggaaaguugggauuugcaa

SEQ ID NO: 507509 - RNA, 19 nt, Homo sapiens
gcagaaaacaagagaaaga

SEQ ID NO: 507510 - RNA, 19 nt, Homo sapiens
ggacagucagcauuucuag

SEQ ID NO: 507511 - RNA, 19 nt, Homo sapiens
guucgcagcccucacauuc

SEQ ID NO: 507512 - RNA, 19 nt, Homo sapiens
uagaaaaccuguauagaag

SEQ ID NO: 507513 - RNA, 19 nt, Homo sapiens
acauggacgugucuguuga

SEQ ID NO: 507514 - RNA, 19 nt, Homo sapiens
cggaaugguuugacuggau

SEQ ID NO: 507515 - RNA, 19 nt, Homo sapiens
gccagaaguggacuaugua

SEQ ID NO: 507516 - RNA, 19 nt, Homo sapiens
ggaagaggagaaggucauu

SEQ ID NO: 507517 - RNA, 19 nt, Homo sapiens
guccucaggugucaucugu

SEQ ID NO: 507518 - RNA, 19 nt, Homo sapiens
ugacaaacgggaccaaugg

SEQ ID NO: 507519 - RNA, 19 nt, Homo sapiens
gcugccaaguuagcuauug

SEQ ID NO: 507520 - RNA, 19 nt, Homo sapiens
gaccaauccugagacuugu

SEQ ID NO: 507521 - RNA, 19 nt, Homo sapiens
acaaguggccuuaagucuu

SEQ ID NO: 507522 - RNA, 19 nt, Homo sapiens
ggccgagguaggagucuua

SEQ ID NO: 507523 - RNA, 19 nt, Homo sapiens
ggaagcauugcccauagga

SEQ ID NO: 507524 - RNA, 19 nt, Homo sapiens
guuagaacucuuugaacaa

SEQ ID NO: 507525 - RNA, 19 nt, Homo sapiens
gaagagaugcagggaagag

SEQ ID NO: 507526 - RNA, 19 nt, Homo sapiens
ccucaggugucaucuguac

SEQ ID NO: 507527 - RNA, 19 nt, Homo sapiens
ccaaucgucucagccuuca

SEQ ID NO: 507528 - RNA, 19 nt, Homo sapiens
aggaguggcucaucaaagg

SEQ ID NO: 507529 - RNA, 19 nt, Homo sapiens
gaaaugccucgagccauag

SEQ ID NO: 507530 - RNA, 19 nt, Homo sapiens
ccucguggguaaaugacaa

SEQ ID NO: 507531 - RNA, 19 nt, Homo sapiens
cuccuuugcuagugucuuu

SEQ ID NO: 507532 - RNA, 19 nt, Homo sapiens
cgugucuguugauuugaua

SEQ ID NO: 507533 - RNA, 19 nt, Homo sapiens
gaauuugaagcucagaaag

SEQ ID NO: 507534 - RNA, 19 nt, Homo sapiens
gagguaggagucuuauauc

SEQ ID NO: 507535 - RNA, 19 nt, Homo sapiens
uggaagcaauucaccaucu

SEQ ID NO: 507536 - RNA, 19 nt, Homo sapiens
aaauguccguggccacaau

SEQ ID NO: 507537 - RNA, 19 nt, Homo sapiens
caaaaucgggaucgaauau

SEQ ID NO: 507538 - RNA, 19 nt, Homo sapiens
gaacaaaaucgggaucgaa

SEQ ID NO: 507539 - RNA, 19 nt, Homo sapiens
gcagggaagaggagaaggu

SEQ ID NO: 507540 - RNA, 19 nt, Homo sapiens
ucuggaaaguugggauuug

SEQ ID NO: 507541 - RNA, 19 nt, Homo sapiens
gaaaacaagagaaagaaag

SEQ ID NO: 507542 - RNA, 19 nt, Homo sapiens
gaaauguccguggccacaa

SEQ ID NO: 507543 - RNA, 19 nt, Homo sapiens
gaucauggcuguccucuuu

SEQ ID NO: 507544 - RNA, 19 nt, Homo sapiens
gaaaggugcucaaagaugu

SEQ ID NO: 507545 - RNA, 19 nt, Homo sapiens
uagaagaucuggcuauguu

SEQ ID NO: 507546 - RNA, 19 nt, Homo sapiens
ggaggaccauuauuaugaa

SEQ ID NO: 507547 - RNA, 19 nt, Homo sapiens
gaagaucagcuccgacuug

SEQ ID NO: 507548 - RNA, 19 nt, Homo sapiens
gaacuagccgccaauacaa

SEQ ID NO: 507549 - RNA, 19 nt, Homo sapiens
ggaaaggugcucaaagaug

SEQ ID NO: 507550 - RNA, 19 nt, Homo sapiens
ggaacuagccgccaauaca

SEQ ID NO: 507551 - RNA, 19 nt, Homo sapiens
gaaaaugccaucaucuaua

SEQ ID NO: 507552 - RNA, 19 nt, Homo sapiens
aaacauggcugagcagauc

SEQ ID NO: 507553 - RNA, 19 nt, Homo sapiens
ugggaaaggugcucaaaga

SEQ ID NO: 507554 - RNA, 19 nt, Homo sapiens
uaacaacaaugaggacuuc

SEQ ID NO: 507555 - RNA, 19 nt, Homo sapiens
ucacccaccuggcaguuaa

SEQ ID NO: 507556 - RNA, 19 nt, Homo sapiens
gaacugcugaagaaagaaa

SEQ ID NO: 507557 - RNA, 19 nt, Homo sapiens
cgacagggaugccauugca

SEQ ID NO: 507558 - RNA, 19 nt, Homo sapiens
ccgaacugcugaagaaaga

SEQ ID NO: 507559 - RNA, 19 nt, Homo sapiens
ccagauggcccuagaagau

SEQ ID NO: 507560 - RNA, 19 nt, Homo sapiens
gaagaucuggcuauguuuc

SEQ ID NO: 507561 - RNA, 19 nt, Homo sapiens
ggaccauuauuaugaaggu

SEQ ID NO: 507562 - RNA, 19 nt, Homo sapiens
uggaggaccauuauuauga

SEQ ID NO: 507563 - RNA, 19 nt, Homo sapiens
ccacaucaacugucuuuua

SEQ ID NO: 507564 - RNA, 19 nt, Homo sapiens
gcaguuaaccggguaccaa

SEQ ID NO: 507565 - RNA, 19 nt, Homo sapiens
cugccgaacugcugaagaa

SEQ ID NO: 507566 - RNA, 19 nt, Homo sapiens
gccaucaucuauaacaaca

SEQ ID NO: 507567 - RNA, 19 nt, Homo sapiens
ccguggaggaccauuauua

SEQ ID NO: 507568 - RNA, 19 nt, Homo sapiens
gccaaccgccuacguauca

SEQ ID NO: 507569 - RNA, 19 nt, Homo sapiens
gugauggcguugcuacaga

SEQ ID NO: 507570 - RNA, 19 nt, Homo sapiens
gaugaccaggugaccguua

SEQ ID NO: 507571 - RNA, 19 nt, Homo sapiens
gguagaagauaaggagucu

SEQ ID NO: 507572 - RNA, 19 nt, Homo sapiens
ucuauaagcuggacaaccu

SEQ ID NO: 507573 - RNA, 19 nt, Homo sapiens
ucuauacauuccugagauu

SEQ ID NO: 507574 - RNA, 19 nt, Homo sapiens
ccaaggugguccugaagag

SEQ ID NO: 507575 - RNA, 19 nt, Homo sapiens
gagccuggcaucacuguca

SEQ ID NO: 507576 - RNA, 19 nt, Homo sapiens
ccuagaagaucuggcuaug

SEQ ID NO: 507577 - RNA, 19 nt, Homo sapiens
caaaggguaucugcuucau

SEQ ID NO: 507578 - RNA, 19 nt, Homo sapiens
aagccaaggugguccugaa

SEQ ID NO: 507579 - RNA, 19 nt, Homo sapiens
ggacuuccaggucggacaa

SEQ ID NO: 507580 - RNA, 19 nt, Homo sapiens
ccagcuaccgagucuauug

SEQ ID NO: 507581 - RNA, 19 nt, Homo sapiens
agagaaggcaguggaacua

SEQ ID NO: 507582 - RNA, 19 nt, Homo sapiens
cugcccagcuacaaaguug

SEQ ID NO: 507583 - RNA, 19 nt, Homo sapiens
ggacaaccucguggccauu

SEQ ID NO: 507584 - RNA, 19 nt, Homo sapiens
ggccuucgccagcaucuau

SEQ ID NO: 507585 - RNA, 19 nt, Homo sapiens
gggaaaggugcucaaagau

SEQ ID NO: 507586 - RNA, 19 nt, Homo sapiens
guuaaccggguaccaagaa

SEQ ID NO: 507587 - RNA, 19 nt, Homo sapiens
ucaccguggaggaccauua

SEQ ID NO: 507588 - RNA, 19 nt, Homo sapiens
ggccagcuaccgagucuau

SEQ ID NO: 507589 - RNA, 19 nt, Homo sapiens
gucuauacauuccugagau

SEQ ID NO: 507590 - RNA, 19 nt, Homo sapiens
ggucuauacauuccugaga

SEQ ID NO: 507591 - RNA, 19 nt, Homo sapiens
gcugagcugcugaagaugu

SEQ ID NO: 507592 - RNA, 19 nt, Homo sapiens
gaggaccauuauuaugaag

SEQ ID NO: 507593 - RNA, 19 nt, Homo sapiens
cugcugaaccugaggaaga

SEQ ID NO: 507594 - RNA, 19 nt, Homo sapiens
caguggacauugccaacau

SEQ ID NO: 507595 - RNA, 19 nt, Homo sapiens
caaccucguggccauucua

SEQ ID NO: 507596 - RNA, 19 nt, Homo sapiens
cggcaaauacuucgacaag

SEQ ID NO: 507597 - RNA, 19 nt, Homo sapiens
guggaggaccauuauuaug

SEQ ID NO: 507598 - RNA, 19 nt, Homo sapiens
cuucaucgagugcuacauu

SEQ ID NO: 507599 - RNA, 19 nt, Homo sapiens
gcuaccgagucuauugcuu

SEQ ID NO: 507600 - RNA, 19 nt, Homo sapiens
ugcugaagauguuugguau

SEQ ID NO: 507601 - RNA, 19 nt, Homo sapiens
uuaugaagguggcauuggu

SEQ ID NO: 507602 - RNA, 19 nt, Homo sapiens
cguggaggaccauuauuau

SEQ ID NO: 507603 - RNA, 19 nt, Homo sapiens
ggccuacaccggcaaauac

SEQ ID NO: 507604 - RNA, 19 nt, Homo sapiens
acagccagauccagagcaa

SEQ ID NO: 507605 - RNA, 19 nt, Homo sapiens
cugagcugcugaagauguu

SEQ ID NO: 507606 - RNA, 19 nt, Homo sapiens
ucaagccccuggacagaaa

SEQ ID NO: 507607 - RNA, 19 nt, Homo sapiens
gaaagaaaagaucaacauc

SEQ ID NO: 507608 - RNA, 19 nt, Homo sapiens
cagaaaaugccaucaucua

SEQ ID NO: 507609 - RNA, 19 nt, Homo sapiens
caaaguuggggacaagaua

SEQ ID NO: 507610 - RNA, 19 nt, Homo sapiens
ccagccaacagccaucauu

SEQ ID NO: 507611 - RNA, 19 nt, Homo sapiens
cugcugaagauguuuggua

SEQ ID NO: 507612 - RNA, 19 nt, Homo sapiens
gagcugcugaagauguuug

SEQ ID NO: 507613 - RNA, 19 nt, Homo sapiens
cuacaccggcaaauacuuc

SEQ ID NO: 507614 - RNA, 19 nt, Homo sapiens
cagccaacagccaucauug

SEQ ID NO: 507615 - RNA, 19 nt, Homo sapiens
ggaagaucagcuccgacuu

SEQ ID NO: 507616 - RNA, 19 nt, Homo sapiens
cugaagauguuugguaucg

SEQ ID NO: 507617 - RNA, 19 nt, Homo sapiens
gagaaggcaguggaacuag

SEQ ID NO: 507618 - RNA, 19 nt, Homo sapiens
ccucccagauggcccuaga

SEQ ID NO: 507619 - RNA, 19 nt, Homo sapiens
gcaucuauaagcuggacaa

SEQ ID NO: 507620 - RNA, 19 nt, Homo sapiens
aaaggugcucaaagaugua

SEQ ID NO: 507621 - RNA, 19 nt, Homo sapiens
acaggacggugcccuucug

SEQ ID NO: 507622 - RNA, 19 nt, Homo sapiens
aggcggagcugcugaaccu

SEQ ID NO: 507623 - RNA, 19 nt, Homo sapiens
ggaggaaacuucacguuga

SEQ ID NO: 507624 - RNA, 19 nt, Homo sapiens
gggcuuauuuauugcuuua

SEQ ID NO: 507625 - RNA, 19 nt, Homo sapiens
gggagacccugaucaagaa

SEQ ID NO: 507626 - RNA, 19 nt, Homo sapiens
ggacugggacuguuugaaa

SEQ ID NO: 507627 - RNA, 19 nt, Homo sapiens
gggagaacgugaccaucua

SEQ ID NO: 507628 - RNA, 19 nt, Homo sapiens
gaaucuaccugcccaaguc

SEQ ID NO: 507629 - RNA, 19 nt, Homo sapiens
gcaagaagggcgaguacaa

SEQ ID NO: 507630 - RNA, 19 nt, Homo sapiens
ccagagagcuccgaaccuu

SEQ ID NO: 507631 - RNA, 19 nt, Homo sapiens
gaacaggagcgcagagcuu

SEQ ID NO: 507632 - RNA, 19 nt, Homo sapiens
gggcagauggugacaguaa

SEQ ID NO: 507633 - RNA, 19 nt, Homo sapiens
gcacggacugggacuguuu

SEQ ID NO: 507634 - RNA, 19 nt, Homo sapiens
gcccagaacgcauuacuug

SEQ ID NO: 507635 - RNA, 19 nt, Homo sapiens
ggaggaccauggagccaau

SEQ ID NO: 507636 - RNA, 19 nt, Homo sapiens
ucccagagcucccagaauc

SEQ ID NO: 507637 - RNA, 19 nt, Homo sapiens
caccggagauggaugaauc

SEQ ID NO: 507638 - RNA, 19 nt, Homo sapiens
cgacagacgcagcuucuuc

SEQ ID NO: 507639 - RNA, 19 nt, Homo sapiens
gaggaaacuucacguugac

SEQ ID NO: 507640 - RNA, 19 nt, Homo sapiens
gaauauggccccagguuug

SEQ ID NO: 507641 - RNA, 19 nt, Homo sapiens
gaaucugaguccugauguc

SEQ ID NO: 507642 - RNA, 19 nt, Homo sapiens
gggagcaugcgggcacuua

SEQ ID NO: 507643 - RNA, 19 nt, Homo sapiens
ucacugugggcguggaaua

SEQ ID NO: 507644 - RNA, 19 nt, Homo sapiens
gucaaggacguaacgcuaa

SEQ ID NO: 507645 - RNA, 19 nt, Homo sapiens
uaaaugccaccgagaacga

SEQ ID NO: 507646 - RNA, 19 nt, Homo sapiens
agaccucgcugcgccgaaa

SEQ ID NO: 507647 - RNA, 19 nt, Homo sapiens
gaccauggagccaauuucu

SEQ ID NO: 507648 - RNA, 19 nt, Homo sapiens
uaacgcuaacgguggagua

SEQ ID NO: 507649 - RNA, 19 nt, Homo sapiens
ggaccauggagccaauuuc

SEQ ID NO: 507650 - RNA, 19 nt, Homo sapiens
ucaaggacguaacgcuaac

SEQ ID NO: 507651 - RNA, 19 nt, Homo sapiens
gacugggacuguuugaaaa

SEQ ID NO: 507652 - RNA, 19 nt, Homo sapiens
ggaauauggccccagguuu

SEQ ID NO: 507653 - RNA, 19 nt, Homo sapiens
gcagagcuucguguccuau

SEQ ID NO: 507654 - RNA, 19 nt, Homo sapiens
cagcuucgccggugaacca

SEQ ID NO: 507655 - RNA, 19 nt, Homo sapiens
cccaagcucuggucacacu

SEQ ID NO: 507656 - RNA, 19 nt, Homo sapiens
gcucacagccacgguacug

SEQ ID NO: 507657 - RNA, 19 nt, Homo sapiens
gacagacgcagcuucuucu

SEQ ID NO: 507658 - RNA, 19 nt, Homo sapiens
ggagaacgugaccaucuac

SEQ ID NO: 507659 - RNA, 19 nt, Homo sapiens
caagaagggcgaguacaac

SEQ ID NO: 507660 - RNA, 19 nt, Homo sapiens
aagccucgcugagcugugu

SEQ ID NO: 507661 - RNA, 19 nt, Homo sapiens
ggggagacccugaucaaga

SEQ ID NO: 507662 - RNA, 19 nt, Homo sapiens
gcuaaaugccaccgagaac

SEQ ID NO: 507663 - RNA, 19 nt, Homo sapiens
gaaaugagcuugcaugaaa

SEQ ID NO: 507664 - RNA, 19 nt, Homo sapiens
gaacaagccugacaaguac

SEQ ID NO: 507665 - RNA, 19 nt, Homo sapiens
aaaggaagguggaugauaa

SEQ ID NO: 507666 - RNA, 19 nt, Homo sapiens
caaaagcgaugacaacuua

SEQ ID NO: 507667 - RNA, 19 nt, Homo sapiens
caagaaggcuacagucuau

SEQ ID NO: 507668 - RNA, 19 nt, Homo sapiens
ggcacuaugugauguauua

SEQ ID NO: 507669 - RNA, 19 nt, Homo sapiens
gaacagagacaauuauauc

SEQ ID NO: 507670 - RNA, 19 nt, Homo sapiens
aaagucaccugucuacaua

SEQ ID NO: 507671 - RNA, 19 nt, Homo sapiens
gcaguggugucuccaauga

SEQ ID NO: 507672 - RNA, 19 nt, Homo sapiens
ggauuaaaguuggaaauug

SEQ ID NO: 507673 - RNA, 19 nt, Homo sapiens
ugaacaagccugacaagua

SEQ ID NO: 507674 - RNA, 19 nt, Homo sapiens
gaugauaaguacauaguca

SEQ ID NO: 507675 - RNA, 19 nt, Homo sapiens
gcauacuccuuccacguua

SEQ ID NO: 507676 - RNA, 19 nt, Homo sapiens
gccaagagauugaauacga

SEQ ID NO: 507677 - RNA, 19 nt, Homo sapiens
guaaaugguuugugaguac

SEQ ID NO: 507678 - RNA, 19 nt, Homo sapiens
ugacagugauggugacaaa

SEQ ID NO: 507679 - RNA, 19 nt, Homo sapiens
gaaagucaccugucuacau

SEQ ID NO: 507680 - RNA, 19 nt, Homo sapiens
ggagccagcuguauugaca

SEQ ID NO: 507681 - RNA, 19 nt, Homo sapiens
gguuuaacguuuauaguug

SEQ ID NO: 507682 - RNA, 19 nt, Homo sapiens
gguaaaugguuugugagua

SEQ ID NO: 507683 - RNA, 19 nt, Homo sapiens
gcacaagucaucccauuuc

SEQ ID NO: 507684 - RNA, 19 nt, Homo sapiens
gccaguacuuuguccauuu

SEQ ID NO: 507685 - RNA, 19 nt, Homo sapiens
aaagauaaccuccucaaug

SEQ ID NO: 507686 - RNA, 19 nt, Homo sapiens
cggcaagccuccagccaua

SEQ ID NO: 507687 - RNA, 19 nt, Homo sapiens
cagcacgccuguucugaaa

SEQ ID NO: 507688 - RNA, 19 nt, Homo sapiens
gacagcccauucuuucuuu

SEQ ID NO: 507689 - RNA, 19 nt, Homo sapiens
ggccauggguuguaggauu

SEQ ID NO: 507690 - RNA, 19 nt, Homo sapiens
gcccauauccugcuccuuu

SEQ ID NO: 507691 - RNA, 19 nt, Homo sapiens
gcacgccuguucugaaauc

SEQ ID NO: 507692 - RNA, 19 nt, Homo sapiens
gcacaaacagacugaaauc

SEQ ID NO: 507693 - RNA, 19 nt, Homo sapiens
gagcaguggugucuccaau

SEQ ID NO: 507694 - RNA, 19 nt, Homo sapiens
gcagaaauggaccugaauu

SEQ ID NO: 507695 - RNA, 19 nt, Homo sapiens
gaggagaagagcaaagaaa

SEQ ID NO: 507696 - RNA, 19 nt, Homo sapiens
gaacuuguuuccugguuuu

SEQ ID NO: 507697 - RNA, 19 nt, Homo sapiens
uuccaaaccuugacagaaa

SEQ ID NO: 507698 - RNA, 19 nt, Homo sapiens
gugcacaagucaucccauu

SEQ ID NO: 507699 - RNA, 19 nt, Homo sapiens
gcagaaagucaccugucua

SEQ ID NO: 507700 - RNA, 19 nt, Homo sapiens
gcagaggcacuaugugaug

SEQ ID NO: 507701 - RNA, 19 nt, Homo sapiens
ccaguacuuuguccauuug

SEQ ID NO: 507702 - RNA, 19 nt, Homo sapiens
ccaaagaaaugagcuugca

SEQ ID NO: 507703 - RNA, 19 nt, Homo sapiens
caagucaucccauuucugu

SEQ ID NO: 507704 - RNA, 19 nt, Homo sapiens
ggccagcccuucaaguuca

SEQ ID NO: 507705 - RNA, 19 nt, Homo sapiens
guugaagguuaaacauuug

SEQ ID NO: 507706 - RNA, 19 nt, Homo sapiens
gccauggguuguaggauug

SEQ ID NO: 507707 - RNA, 19 nt, Homo sapiens
gauaaccuccucaaugcuu

SEQ ID NO: 507708 - RNA, 19 nt, Homo sapiens
aagauaaccuccucaaugc

SEQ ID NO: 507709 - RNA, 19 nt, Homo sapiens
ugugguaaaugguuuguga

SEQ ID NO: 507710 - RNA, 19 nt, Homo sapiens
ccacuucuuugaaauccaa

SEQ ID NO: 507711 - RNA, 19 nt, Homo sapiens
gcacagauaaacgcagaaa

SEQ ID NO: 507712 - RNA, 19 nt, Homo sapiens
ggacuucagccuccuggaa

SEQ ID NO: 507713 - RNA, 19 nt, Homo sapiens
gugcuuagcugugacaucu

SEQ ID NO: 507714 - RNA, 19 nt, Homo sapiens
acagauaaacgcagaaaug

SEQ ID NO: 507715 - RNA, 19 nt, Homo sapiens
cgucagugcuuagcuguga

SEQ ID NO: 507716 - RNA, 19 nt, Homo sapiens
ucacagccuuaaauuggaa

SEQ ID NO: 507717 - RNA, 19 nt, Homo sapiens
gaaaugcagaggcacuaug

SEQ ID NO: 507718 - RNA, 19 nt, Homo sapiens
uaucacagccuuaaauugg

SEQ ID NO: 507719 - RNA, 19 nt, Homo sapiens
uaaagaggaauuccaguuc

SEQ ID NO: 507720 - RNA, 19 nt, Homo sapiens
acaagaaggcuacagucua

SEQ ID NO: 507721 - RNA, 19 nt, Homo sapiens
ccaagagauugaauacgau

SEQ ID NO: 507722 - RNA, 19 nt, Homo sapiens
agacugaaaucgccaagag

SEQ ID NO: 507723 - RNA, 19 nt, Homo sapiens
gggauuaaaguuggaaauu

SEQ ID NO: 507724 - RNA, 19 nt, Homo sapiens
ggaccggauuaaagaggaa

SEQ ID NO: 507725 - RNA, 19 nt, Homo sapiens
ccaaagaguccucgucagu

SEQ ID NO: 507726 - RNA, 19 nt, Homo sapiens
gcauauuccaguccaaaga

SEQ ID NO: 507727 - RNA, 19 nt, Homo sapiens
ccugaaauuugcuuacugu

SEQ ID NO: 507728 - RNA, 19 nt, Homo sapiens
gaccugaauuuuccaauga

SEQ ID NO: 507729 - RNA, 19 nt, Homo sapiens
gagauugaauacgauuugu

SEQ ID NO: 507730 - RNA, 19 nt, Homo sapiens
ggaagguggaugauaagga

SEQ ID NO: 507731 - RNA, 19 nt, Homo sapiens
ucuaagaggcacagauaaa

SEQ ID NO: 507732 - RNA, 19 nt, Homo sapiens
ugaacuuguuuccugguuu

SEQ ID NO: 507733 - RNA, 19 nt, Homo sapiens
caugacagcccauucuuuc

SEQ ID NO: 507734 - RNA, 19 nt, Homo sapiens
ccagcuguauugacauuuc

SEQ ID NO: 507735 - RNA, 19 nt, Homo sapiens
agacggagccagcuguauu

SEQ ID NO: 507736 - RNA, 19 nt, Homo sapiens
uauauccguuccuguaaau

SEQ ID NO: 507737 - RNA, 19 nt, Homo sapiens
gaaaauggaaucgacaaaa

SEQ ID NO: 507738 - RNA, 19 nt, Homo sapiens
gccuuaaauuggaauguga

SEQ ID NO: 507739 - RNA, 19 nt, Homo sapiens
acaaguccaucagcagaaa

SEQ ID NO: 507740 - RNA, 19 nt, Homo sapiens
gcacaaccagacacuagug

SEQ ID NO: 507741 - RNA, 19 nt, Homo sapiens
gagaguaccuaccauuccu

SEQ ID NO: 507742 - RNA, 19 nt, Homo sapiens
gcagagcaccacagagaca

SEQ ID NO: 507743 - RNA, 19 nt, Homo sapiens
gaaaacuacuuugagucua

SEQ ID NO: 507744 - RNA, 19 nt, Homo sapiens
cccgauggcugcacucuca

SEQ ID NO: 507745 - RNA, 19 nt, Homo sapiens
aauuauauccguuccugua

SEQ ID NO: 507746 - RNA, 19 nt, Homo sapiens
gagguggugugcgcuguga

SEQ ID NO: 507747 - RNA, 19 nt, Homo sapiens
ccaaugacaucaagaaaag

SEQ ID NO: 507748 - RNA, 19 nt, Homo sapiens
cagucucacuuggcaauaa

SEQ ID NO: 507749 - RNA, 19 nt, Homo sapiens
gaagucaucuacugaaaac

SEQ ID NO: 507750 - RNA, 19 nt, Homo sapiens
uuauauccguuccuguaaa

SEQ ID NO: 507751 - RNA, 19 nt, Homo sapiens
guaccuaccauuccuccaa

SEQ ID NO: 507752 - RNA, 19 nt, Homo sapiens
gcaagccuccagccauaga

SEQ ID NO: 507753 - RNA, 19 nt, Homo sapiens
acgcagaaauggaccugaa

SEQ ID NO: 507754 - RNA, 19 nt, Homo sapiens
agucuaagaggcacagaua

SEQ ID NO: 507755 - RNA, 19 nt, Homo sapiens
ucaggaacaucaacaacag

SEQ ID NO: 507756 - RNA, 19 nt, Homo sapiens
caagagauugaauacgauu

SEQ ID NO: 507757 - RNA, 19 nt, Homo sapiens
cuaaugaggacccuucuuc

SEQ ID NO: 507758 - RNA, 19 nt, Homo sapiens
uuaaagaggaauuccaguu

SEQ ID NO: 507759 - RNA, 19 nt, Homo sapiens
ugagauuaccuuucuguuc

SEQ ID NO: 507760 - RNA, 19 nt, Homo sapiens
ugacagcccauucuuucuu

SEQ ID NO: 507761 - RNA, 19 nt, Homo sapiens
gaaggcuacagucuaugaa

SEQ ID NO: 507762 - RNA, 19 nt, Homo sapiens
cgacuucaccucccagauc

SEQ ID NO: 507763 - RNA, 19 nt, Homo sapiens
gcauugauauuuccgauua

SEQ ID NO: 507764 - RNA, 19 nt, Homo sapiens
caaagaagaauuccaguuu

SEQ ID NO: 507765 - RNA, 19 nt, Homo sapiens
ggaccucgguggaaauaaa

SEQ ID NO: 507766 - RNA, 19 nt, Homo sapiens
ugugacaucuccagaaaua

SEQ ID NO: 507767 - RNA, 19 nt, Homo sapiens
gaaccgagacaacuacauu

SEQ ID NO: 507768 - RNA, 19 nt, Homo sapiens
gacuucagcucccagauuu

SEQ ID NO: 507769 - RNA, 19 nt, Homo sapiens
gccagcaccuuguccauuu

SEQ ID NO: 507770 - RNA, 19 nt, Homo sapiens
cgagacaacuacauucguu

SEQ ID NO: 507771 - RNA, 19 nt, Homo sapiens
gcagagagcagaugagaag

SEQ ID NO: 507772 - RNA, 19 nt, Homo sapiens
ggcgccagcugcauugaua

SEQ ID NO: 507773 - RNA, 19 nt, Homo sapiens
agacaagagugauuacaau

SEQ ID NO: 507774 - RNA, 19 nt, Homo sapiens
caagaaggccaccguguau

SEQ ID NO: 507775 - RNA, 19 nt, Homo sapiens
guugugacaucuccagaaa

SEQ ID NO: 507776 - RNA, 19 nt, Homo sapiens
aaagaagaauuccaguuuc

SEQ ID NO: 507777 - RNA, 19 nt, Homo sapiens
gccaacggcuucacaccuu

SEQ ID NO: 507778 - RNA, 19 nt, Homo sapiens
ggaagcagagagcagauga

SEQ ID NO: 507779 - RNA, 19 nt, Homo sapiens
cugcagcgauggcaacauu

SEQ ID NO: 507780 - RNA, 19 nt, Homo sapiens
acaagaaggccaccgugua

SEQ ID NO: 507781 - RNA, 19 nt, Homo sapiens
uguaugagguggucuacug

SEQ ID NO: 507782 - RNA, 19 nt, Homo sapiens
gccucaagcuagaauguga

SEQ ID NO: 507783 - RNA, 19 nt, Homo sapiens
gaaagguacccaucugcau

SEQ ID NO: 507784 - RNA, 19 nt, Homo sapiens
gcggaaagguacccaucug

SEQ ID NO: 507785 - RNA, 19 nt, Homo sapiens
ccagcugcauugauauuuc

SEQ ID NO: 507786 - RNA, 19 nt, Homo sapiens
caucaggaccuuaugaaag

SEQ ID NO: 507787 - RNA, 19 nt, Homo sapiens
cagcacuccugccuccaaa

SEQ ID NO: 507788 - RNA, 19 nt, Homo sapiens
aaagguacccaucugcauu

SEQ ID NO: 507789 - RNA, 19 nt, Homo sapiens
ucaaagaagaauuccaguu

SEQ ID NO: 507790 - RNA, 19 nt, Homo sapiens
ggaaggacaaccugcucaa

SEQ ID NO: 507791 - RNA, 19 nt, Homo sapiens
ugaaagcgacgaagacaag

SEQ ID NO: 507792 - RNA, 19 nt, Homo sapiens
ggccagcccuucaaguucu

SEQ ID NO: 507793 - RNA, 19 nt, Homo sapiens
ugacuucagcucccagauu

SEQ ID NO: 507794 - RNA, 19 nt, Homo sapiens
agaaggccaccguguauga

SEQ ID NO: 507795 - RNA, 19 nt, Homo sapiens
cagcagcucugugguguac

SEQ ID NO: 507796 - RNA, 19 nt, Homo sapiens
gcacuccugccuccaaauc

SEQ ID NO: 507797 - RNA, 19 nt, Homo sapiens
gcgagaagacggaaaugca

SEQ ID NO: 507798 - RNA, 19 nt, Homo sapiens
gaagacaagagugauuaca

SEQ ID NO: 507799 - RNA, 19 nt, Homo sapiens
gacgaagacaagagugauu

SEQ ID NO: 507800 - RNA, 19 nt, Homo sapiens
uguauuaugagaugucgua

SEQ ID NO: 507801 - RNA, 19 nt, Homo sapiens
ucccagcccugccuaggaa

SEQ ID NO: 507802 - RNA, 19 nt, Homo sapiens
ccagcaccuuguccauuug

SEQ ID NO: 507803 - RNA, 19 nt, Homo sapiens
gcgaccgcaucaaagaaga

SEQ ID NO: 507804 - RNA, 19 nt, Homo sapiens
acgaagacaagagugauua

SEQ ID NO: 507805 - RNA, 19 nt, Homo sapiens
gagauugugaagcgucuga

SEQ ID NO: 507806 - RNA, 19 nt, Homo sapiens
cuccagaaauaacaaauac

SEQ ID NO: 507807 - RNA, 19 nt, Homo sapiens
gcgacgaagacaagaguga

SEQ ID NO: 507808 - RNA, 19 nt, Homo sapiens
gaaagcgacgaagacaaga

SEQ ID NO: 507809 - RNA, 19 nt, Homo sapiens
ugaagcgucugagcgguau

SEQ ID NO: 507810 - RNA, 19 nt, Homo sapiens
caagcuagaaugugagaag

SEQ ID NO: 507811 - RNA, 19 nt, Homo sapiens
gcucucuccucccucuuuc

SEQ ID NO: 507812 - RNA, 19 nt, Homo sapiens
gcagcgauggcaacauugu

SEQ ID NO: 507813 - RNA, 19 nt, Homo sapiens
ggagccaucaggaccuuau

SEQ ID NO: 507814 - RNA, 19 nt, Homo sapiens
gcugcgugcugucccugaa

SEQ ID NO: 507815 - RNA, 19 nt, Homo sapiens
ccaucaggaccuuaugaaa

SEQ ID NO: 507816 - RNA, 19 nt, Homo sapiens
ugacaucuccagaaauaac

SEQ ID NO: 507817 - RNA, 19 nt, Homo sapiens
ccgcaucaaagaagaauuc

SEQ ID NO: 507818 - RNA, 19 nt, Homo sapiens
agacuauggucaggcaguu

SEQ ID NO: 507819 - RNA, 19 nt, Homo sapiens
ugcggacggugguuuguga

SEQ ID NO: 507820 - RNA, 19 nt, Homo sapiens
gcaagccggagaaauacca

SEQ ID NO: 507821 - RNA, 19 nt, Homo sapiens
aagacaagagugauuacaa

SEQ ID NO: 507822 - RNA, 19 nt, Homo sapiens
gccaucaggaccuuaugaa

SEQ ID NO: 507823 - RNA, 19 nt, Homo sapiens
guaugagguggucuacuga

SEQ ID NO: 507824 - RNA, 19 nt, Homo sapiens
ggccagcaccuuguccauu

SEQ ID NO: 507825 - RNA, 19 nt, Homo sapiens
gcauaagcaggcggagauu

SEQ ID NO: 507826 - RNA, 19 nt, Homo sapiens
gaauggagaguagcaacgu

SEQ ID NO: 507827 - RNA, 19 nt, Homo sapiens
ccagcgagaagacggaaau

SEQ ID NO: 507828 - RNA, 19 nt, Homo sapiens
uacauucguuccugcaagu

SEQ ID NO: 507829 - RNA, 19 nt, Homo sapiens
gccagcugcauugauauuu

SEQ ID NO: 507830 - RNA, 19 nt, Homo sapiens
aagcagagagcagaugaga

SEQ ID NO: 507831 - RNA, 19 nt, Homo sapiens
gcauagacaucucccauga

SEQ ID NO: 507832 - RNA, 19 nt, Homo sapiens
gaucaugccuuuccuguca

SEQ ID NO: 507833 - RNA, 19 nt, Homo sapiens
gaacagggacaauuacaug

SEQ ID NO: 507834 - RNA, 19 nt, Homo sapiens
gccauuaugugauguacua

SEQ ID NO: 507835 - RNA, 19 nt, Homo sapiens
uagcacagaucaugccuuu

SEQ ID NO: 507836 - RNA, 19 nt, Homo sapiens
cgaagagacugaacacaau

SEQ ID NO: 507837 - RNA, 19 nt, Homo sapiens
gagaauccagugcgaauaa

SEQ ID NO: 507838 - RNA, 19 nt, Homo sapiens
acaagaaggccacaguuua

SEQ ID NO: 507839 - RNA, 19 nt, Homo sapiens
gaggucaucuacuaaacaa

SEQ ID NO: 507840 - RNA, 19 nt, Homo sapiens
caagaaggccacaguuuau

SEQ ID NO: 507841 - RNA, 19 nt, Homo sapiens
agacagagauugcgaagag

SEQ ID NO: 507842 - RNA, 19 nt, Homo sapiens
gaaccaccaugaacucgau

SEQ ID NO: 507843 - RNA, 19 nt, Homo sapiens
gugaagaucugggacauca

SEQ ID NO: 507844 - RNA, 19 nt, Homo sapiens
gacaagaaggccacaguuu

SEQ ID NO: 507845 - RNA, 19 nt, Homo sapiens
gaagagacugaacacaauu

SEQ ID NO: 507846 - RNA, 19 nt, Homo sapiens
gcgaagagacugaacacaa

SEQ ID NO: 507847 - RNA, 19 nt, Homo sapiens
gcauaucccagucuaaaga

SEQ ID NO: 507848 - RNA, 19 nt, Homo sapiens
ggaaagauaaccuucucaa

SEQ ID NO: 507849 - RNA, 19 nt, Homo sapiens
ugacuucacuucccagauc

SEQ ID NO: 507850 - RNA, 19 nt, Homo sapiens
ucaggucgaugccggguaa

SEQ ID NO: 507851 - RNA, 19 nt, Homo sapiens
gcagcacgcucaccaucug

SEQ ID NO: 507852 - RNA, 19 nt, Homo sapiens
gcagcgccauuaugugaug

SEQ ID NO: 507853 - RNA, 19 nt, Homo sapiens
ggucaucuacuaaacaaga

SEQ ID NO: 507854 - RNA, 19 nt, Homo sapiens
ggcaagggcugcgugaaga

SEQ ID NO: 507855 - RNA, 19 nt, Homo sapiens
gcauggacccgauagguau

SEQ ID NO: 507856 - RNA, 19 nt, Homo sapiens
cgacagugauggagacaag

SEQ ID NO: 507857 - RNA, 19 nt, Homo sapiens
gcacaagcagacagagauu

SEQ ID NO: 507858 - RNA, 19 nt, Homo sapiens
caaagacgaauuccaguuc

SEQ ID NO: 507859 - RNA, 19 nt, Homo sapiens
guuaugcccuggccauuag

SEQ ID NO: 507860 - RNA, 19 nt, Homo sapiens
gaagaaccaccaugaacuc

SEQ ID NO: 507861 - RNA, 19 nt, Homo sapiens
cagccgggauuuaaauuca

SEQ ID NO: 507862 - RNA, 19 nt, Homo sapiens
guaacaggcucuggugaca

SEQ ID NO: 507863 - RNA, 19 nt, Homo sapiens
cagcauaucccagucuaaa

SEQ ID NO: 507864 - RNA, 19 nt, Homo sapiens
cauuagcccugacgccaaa

SEQ ID NO: 507865 - RNA, 19 nt, Homo sapiens
gagaagaaccaccaugaac

SEQ ID NO: 507866 - RNA, 19 nt, Homo sapiens
acuaugagauguccuaugg

SEQ ID NO: 507867 - RNA, 19 nt, Homo sapiens
cagcuggacugccugaaca

SEQ ID NO: 507868 - RNA, 19 nt, Homo sapiens
gagagaauccagugcgaau

SEQ ID NO: 507869 - RNA, 19 nt, Homo sapiens
gcacagaucaugccuuucc

SEQ ID NO: 507870 - RNA, 19 nt, Homo sapiens
ggagaugcagcgccauuau

SEQ ID NO: 507871 - RNA, 19 nt, Homo sapiens
ccucgucugucuugaguug

SEQ ID NO: 507872 - RNA, 19 nt, Homo sapiens
aaagaauccucgucugucu

SEQ ID NO: 507873 - RNA, 19 nt, Homo sapiens
gaucgccaauggugagcuu

SEQ ID NO: 507874 - RNA, 19 nt, Homo sapiens
uccuauggcuugaacauug

SEQ ID NO: 507875 - RNA, 19 nt, Homo sapiens
uaugugauguacuaugaga

SEQ ID NO: 507876 - RNA, 19 nt, Homo sapiens
ggcauggacccgauaggua

SEQ ID NO: 507877 - RNA, 19 nt, Homo sapiens
agacaagagugaugaucug

SEQ ID NO: 507878 - RNA, 19 nt, Homo sapiens
gaucacagagagagagaau

SEQ ID NO: 507879 - RNA, 19 nt, Homo sapiens
gaugagccaccaugagaug

SEQ ID NO: 507880 - RNA, 19 nt, Homo sapiens
ucgguggccucuuccagua

SEQ ID NO: 507881 - RNA, 19 nt, Homo sapiens
ccuauggcuugaacauuga

SEQ ID NO: 507882 - RNA, 19 nt, Homo sapiens
uuucagcggaugacaaaua

SEQ ID NO: 507883 - RNA, 19 nt, Homo sapiens
gagaugcagcgccauuaug

SEQ ID NO: 507884 - RNA, 19 nt, Homo sapiens
gccagcauaucccagucua

SEQ ID NO: 507885 - RNA, 19 nt, Homo sapiens
gaaagauaaccuucucaac

SEQ ID NO: 507886 - RNA, 19 nt, Homo sapiens
gaaaaccagcguacucauu

SEQ ID NO: 507887 - RNA, 19 nt, Homo sapiens
gagauguccuauggcuuga

SEQ ID NO: 507888 - RNA, 19 nt, Homo sapiens
gcggaugacaaauacauug

SEQ ID NO: 507889 - RNA, 19 nt, Homo sapiens
acgacaagcuggcaaacga

SEQ ID NO: 507890 - RNA, 19 nt, Homo sapiens
caaaguggaguacgacaag

SEQ ID NO: 507891 - RNA, 19 nt, Homo sapiens
cuaaagaauccucgucugu

SEQ ID NO: 507892 - RNA, 19 nt, Homo sapiens
caugauggcaccaaacugu

SEQ ID NO: 507893 - RNA, 19 nt, Homo sapiens
ucaaagacgaauuccaguu

SEQ ID NO: 507894 - RNA, 19 nt, Homo sapiens
caaacgagaagacggagau

SEQ ID NO: 507895 - RNA, 19 nt, Homo sapiens
gagacaagagugaugaucu

SEQ ID NO: 507896 - RNA, 19 nt, Homo sapiens
cugcagcgaugggaacauu

SEQ ID NO: 507897 - RNA, 19 nt, Homo sapiens
gaucuggugguggauguuu

SEQ ID NO: 507898 - RNA, 19 nt, Homo sapiens
gggcagccgggauuuaaau

SEQ ID NO: 507899 - RNA, 19 nt, Homo sapiens
ugagaagaaccaccaugaa

SEQ ID NO: 507900 - RNA, 19 nt, Homo sapiens
gaggagaaggacagcuuga

SEQ ID NO: 507901 - RNA, 19 nt, Homo sapiens
gaacucgaucacagagaga

SEQ ID NO: 507902 - RNA, 19 nt, Homo sapiens
agaaggccacaguuuauga

SEQ ID NO: 507903 - RNA, 19 nt, Homo sapiens
cauuucagcggaugacaaa

SEQ ID NO: 507904 - RNA, 19 nt, Homo sapiens
ccucaagccuggccuccau

SEQ ID NO: 507905 - RNA, 19 nt, Homo sapiens
ggugaaggaugagaagaac

SEQ ID NO: 507906 - RNA, 19 nt, Homo sapiens
gagauugcgaagagacuga

SEQ ID NO: 507907 - RNA, 19 nt, Homo sapiens
gcagccgggauuuaaauuc

SEQ ID NO: 507908 - RNA, 19 nt, Homo sapiens
ugacaagaaggccacaguu

SEQ ID NO: 507909 - RNA, 19 nt, Homo sapiens
gucuugaguugugacauuu

SEQ ID NO: 507910 - RNA, 19 nt, Homo sapiens
gcguacucauuccauguga

SEQ ID NO: 507911 - RNA, 19 nt, Homo sapiens
gacagagauugcgaagaga

SEQ ID NO: 507912 - RNA, 19 nt, Homo sapiens
cgugagcacugggaaagau

SEQ ID NO: 507913 - RNA, 19 nt, Homo sapiens
ucacgguggcugagucuug

SEQ ID NO: 507914 - RNA, 19 nt, Homo sapiens
gucaucuacuaaacaagaa

SEQ ID NO: 507915 - RNA, 19 nt, Homo sapiens
gaaggccacaguuuaugag

SEQ ID NO: 507916 - RNA, 19 nt, Homo sapiens
caggaucaaagacgaauuc

SEQ ID NO: 507917 - RNA, 19 nt, Homo sapiens
gauggagacaagagugaug

SEQ ID NO: 507918 - RNA, 19 nt, Homo sapiens
ccagugcgaauaacucugu

SEQ ID NO: 507919 - RNA, 19 nt, Homo sapiens
gccaagcaggucaccauga

SEQ ID NO: 507920 - RNA, 19 nt, Homo sapiens
gauguccuauggcuugaac

SEQ ID NO: 507921 - RNA, 19 nt, Homo sapiens
gcaagggcugcgugaagau

SEQ ID NO: 507922 - RNA, 19 nt, Homo sapiens
cggcagaucaacacacuca

SEQ ID NO: 507923 - RNA, 19 nt, Homo sapiens
guagcacaccuuccuccaa

SEQ ID NO: 507924 - RNA, 19 nt, Homo sapiens
agaauccucgucugucuug

SEQ ID NO: 507925 - RNA, 19 nt, Homo sapiens
guaaaccuccgggcaugga

SEQ ID NO: 507926 - RNA, 19 nt, Homo sapiens
gagacugaacacaauuuua

SEQ ID NO: 507927 - RNA, 19 nt, Homo sapiens
ugacaggaucaaagacgaa

SEQ ID NO: 507928 - RNA, 19 nt, Homo sapiens
ucaaaguggaguacgacaa

SEQ ID NO: 507929 - RNA, 19 nt, Homo sapiens
cgaauuccaguuccugcaa

SEQ ID NO: 507930 - RNA, 19 nt, Homo sapiens
gugagcacugggaaagaua

SEQ ID NO: 507931 - RNA, 19 nt, Homo sapiens
ugacaaaccugaagacaua

SEQ ID NO: 507932 - RNA, 19 nt, Homo sapiens
caagaaagcuguauagaug

SEQ ID NO: 507933 - RNA, 19 nt, Homo sapiens
ggaaauguauugcucuaua

SEQ ID NO: 507934 - RNA, 19 nt, Homo sapiens
gauaauugcugacuuugua

SEQ ID NO: 507935 - RNA, 19 nt, Homo sapiens
gaaucaaucucgaccuaua

SEQ ID NO: 507936 - RNA, 19 nt, Homo sapiens
gaagggauuucauauaaga

SEQ ID NO: 507937 - RNA, 19 nt, Homo sapiens
gaugaaugcucuaaggaua

SEQ ID NO: 507938 - RNA, 19 nt, Homo sapiens
gaaagggcaucauauacuu

SEQ ID NO: 507939 - RNA, 19 nt, Homo sapiens
ugaaauagcaccuuccuua

SEQ ID NO: 507940 - RNA, 19 nt, Homo sapiens
ggaagacucuacaagcuuu

SEQ ID NO: 507941 - RNA, 19 nt, Homo sapiens
gaaagaauguguguggaaa

SEQ ID NO: 507942 - RNA, 19 nt, Homo sapiens
ugaauugggucaugugaua

SEQ ID NO: 507943 - RNA, 19 nt, Homo sapiens
caagagaucuguacucaca

SEQ ID NO: 507944 - RNA, 19 nt, Homo sapiens
ccacguaacuaucauaaga

SEQ ID NO: 507945 - RNA, 19 nt, Homo sapiens
gaauguagaugugugauug

SEQ ID NO: 507946 - RNA, 19 nt, Homo sapiens
ggaguggucuuuccucuga

SEQ ID NO: 507947 - RNA, 19 nt, Homo sapiens
caaauuagccuuuagugaa

SEQ ID NO: 507948 - RNA, 19 nt, Homo sapiens
gauggagccuggagaagua

SEQ ID NO: 507949 - RNA, 19 nt, Homo sapiens
gagcauacaacauugaaua

SEQ ID NO: 507950 - RNA, 19 nt, Homo sapiens
gaauuucugugaaguuuga

SEQ ID NO: 507951 - RNA, 19 nt, Homo sapiens
ggaugaaguuuguuucuga

SEQ ID NO: 507952 - RNA, 19 nt, Homo sapiens
ugaaauagaugccucacaa

SEQ ID NO: 507953 - RNA, 19 nt, Homo sapiens
guacucacaugcucaguuu

SEQ ID NO: 507954 - RNA, 19 nt, Homo sapiens
ucucaauggugucuaauua

SEQ ID NO: 507955 - RNA, 19 nt, Homo sapiens
gauauuggcacaaauguuu

SEQ ID NO: 507956 - RNA, 19 nt, Homo sapiens
uaguagagcugauuuauuc

SEQ ID NO: 507957 - RNA, 19 nt, Homo sapiens
acaauuggguguauucuuu

SEQ ID NO: 507958 - RNA, 19 nt, Homo sapiens
uuacaacgauggaucuaua

SEQ ID NO: 507959 - RNA, 19 nt, Homo sapiens
gauaugauuucgacaguau

SEQ ID NO: 507960 - RNA, 19 nt, Homo sapiens
guauauugguugugcuuua

SEQ ID NO: 507961 - RNA, 19 nt, Homo sapiens
acagacagcuucauuguug

SEQ ID NO: 507962 - RNA, 19 nt, Homo sapiens
uaauaaagcuggugaaagg

SEQ ID NO: 507963 - RNA, 19 nt, Homo sapiens
caaauugccugaaguucuu

SEQ ID NO: 507964 - RNA, 19 nt, Homo sapiens
gaagugaugaagagaguua

SEQ ID NO: 507965 - RNA, 19 nt, Homo sapiens
ucaaacagauccuccuaaa

SEQ ID NO: 507966 - RNA, 19 nt, Homo sapiens
ugaaagacaugacaauugu

SEQ ID NO: 507967 - RNA, 19 nt, Homo sapiens
gcgcuggccucgauuauga

SEQ ID NO: 507968 - RNA, 19 nt, Homo sapiens
gaaaauagcccuuugauag

SEQ ID NO: 507969 - RNA, 19 nt, Homo sapiens
caauugaccuuacgcagaa

SEQ ID NO: 507970 - RNA, 19 nt, Homo sapiens
caagaagggauuucauaua

SEQ ID NO: 507971 - RNA, 19 nt, Homo sapiens
gagcugauuuauuccagua

SEQ ID NO: 507972 - RNA, 19 nt, Homo sapiens
gaccagaauuaucuuugua

SEQ ID NO: 507973 - RNA, 19 nt, Homo sapiens
gagaaacucuacaagaauc

SEQ ID NO: 507974 - RNA, 19 nt, Homo sapiens
cugcacaacugagaaauua

SEQ ID NO: 507975 - RNA, 19 nt, Homo sapiens
uaacagcucuaugaagaaa

SEQ ID NO: 507976 - RNA, 19 nt, Homo sapiens
cauauaaggugaaugugaa

SEQ ID NO: 507977 - RNA, 19 nt, Homo sapiens
cgaaucaaauuagccuuua

SEQ ID NO: 507978 - RNA, 19 nt, Homo sapiens
ccaauuauccugaugacua

SEQ ID NO: 507979 - RNA, 19 nt, Homo sapiens
gaacaacuacuuauaaugc

SEQ ID NO: 507980 - RNA, 19 nt, Homo sapiens
gaacggggcucucgacuug

SEQ ID NO: 507981 - RNA, 19 nt, Homo sapiens
gcaaggaagcugaguguga

SEQ ID NO: 507982 - RNA, 19 nt, Homo sapiens
gagcagcgaugucugaaca

SEQ ID NO: 507983 - RNA, 19 nt, Homo sapiens
gaaggcauauagagauguu

SEQ ID NO: 507984 - RNA, 19 nt, Homo sapiens
gcuauugucuuuccuuugu

SEQ ID NO: 507985 - RNA, 19 nt, Homo sapiens
caaggaagcugagugugaa

SEQ ID NO: 507986 - RNA, 19 nt, Homo sapiens
ugacggaacugugaacaaa

SEQ ID NO: 507987 - RNA, 19 nt, Homo sapiens
gcaagaacugugauaaauu

SEQ ID NO: 507988 - RNA, 19 nt, Homo sapiens
ggcaagaacugugauaaau

SEQ ID NO: 507989 - RNA, 19 nt, Homo sapiens
gaauaccaaugauagcuau

SEQ ID NO: 507990 - RNA, 19 nt, Homo sapiens
caaaugagccucugcuugu

SEQ ID NO: 507991 - RNA, 19 nt, Homo sapiens
gcaguuaaauucuagacau

SEQ ID NO: 507992 - RNA, 19 nt, Homo sapiens
ggauauuucagcuucauua

SEQ ID NO: 507993 - RNA, 19 nt, Homo sapiens
gaagauauuggcacaaaug

SEQ ID NO: 507994 - RNA, 19 nt, Homo sapiens
aaacuuaacggcaccauaa

SEQ ID NO: 507995 - RNA, 19 nt, Homo sapiens
uggagaaacucuacaagaa

SEQ ID NO: 507996 - RNA, 19 nt, Homo sapiens
guguaaagccgcuguauuu

SEQ ID NO: 507997 - RNA, 19 nt, Homo sapiens
gguagcauuugaagacuaa

SEQ ID NO: 507998 - RNA, 19 nt, Homo sapiens
ggugaaagggcaucauaua

SEQ ID NO: 507999 - RNA, 19 nt, Homo sapiens
ggacuucuuaccaaacuua

SEQ ID NO: 508000 - RNA, 19 nt, Homo sapiens
gcaagaaagcuguauagau

SEQ ID NO: 508001 - RNA, 19 nt, Homo sapiens
gauauugccuuagaugaug

SEQ ID NO: 508002 - RNA, 19 nt, Homo sapiens
gagucacaguguaaaguua

SEQ ID NO: 508003 - RNA, 19 nt, Homo sapiens
gagauaaccacguaacuau

SEQ ID NO: 508004 - RNA, 19 nt, Homo sapiens
acacacagauguagcuuau

SEQ ID NO: 508005 - RNA, 19 nt, Homo sapiens
gaaguagcuuugugucugu

SEQ ID NO: 508006 - RNA, 19 nt, Homo sapiens
guacuuacauuuagaugag

SEQ ID NO: 508007 - RNA, 19 nt, Homo sapiens
uaggauaauugcugacuuu

SEQ ID NO: 508008 - RNA, 19 nt, Homo sapiens
ggacaaauugccugaaguu

SEQ ID NO: 508009 - RNA, 19 nt, Homo sapiens
cuacuagaauuccauuuga

SEQ ID NO: 508010 - RNA, 19 nt, Homo sapiens
aaagagaaguuuccagcaa

SEQ ID NO: 508011 - RNA, 19 nt, Homo sapiens
cauaagaucuaccuccaau

SEQ ID NO: 508012 - RNA, 19 nt, Homo sapiens
gaaauggaccucaggcaau

SEQ ID NO: 508013 - RNA, 19 nt, Homo sapiens
agaagccugugaugucuua

SEQ ID NO: 508014 - RNA, 19 nt, Homo sapiens
ugaacacucugggcaguua

SEQ ID NO: 508015 - RNA, 19 nt, Homo sapiens
gaauguguguggaaaauaa

SEQ ID NO: 508016 - RNA, 19 nt, Homo sapiens
guauagauguccagcaugu

SEQ ID NO: 508017 - RNA, 19 nt, Homo sapiens
uaaauuccaugcuacacuu

SEQ ID NO: 508018 - RNA, 19 nt, Homo sapiens
uccaguaacuucuuccaua

SEQ ID NO: 508019 - RNA, 19 nt, Homo sapiens
caaauaaugggaacuucua

SEQ ID NO: 508020 - RNA, 19 nt, Homo sapiens
gaaguaggccuugugagaa

SEQ ID NO: 508021 - RNA, 19 nt, Homo sapiens
guaaaccagauccauauaa

SEQ ID NO: 508022 - RNA, 19 nt, Homo sapiens
uaaacugcauggcaaauuc

SEQ ID NO: 508023 - RNA, 19 nt, Homo sapiens
gaagauggagccuggagaa

SEQ ID NO: 508024 - RNA, 19 nt, Homo sapiens
ccaguaacuucuuccauau

SEQ ID NO: 508025 - RNA, 19 nt, Homo sapiens
ucaaugccguaauggauuu

SEQ ID NO: 508026 - RNA, 19 nt, Homo sapiens
caaauucuguggcgcugaa

SEQ ID NO: 508027 - RNA, 19 nt, Homo sapiens
uagaaucaaucucgaccua

SEQ ID NO: 508028 - RNA, 19 nt, Homo sapiens
caauuauccugaugacuau

SEQ ID NO: 508029 - RNA, 19 nt, Homo sapiens
gggagaagauuguuuuaaa

SEQ ID NO: 508030 - RNA, 19 nt, Homo sapiens
agaaagaagugaugaagag

SEQ ID NO: 508031 - RNA, 19 nt, Homo sapiens
gaggaaagcuuuauuguau

SEQ ID NO: 508032 - RNA, 19 nt, Homo sapiens
gaaugugucuggaggauua

SEQ ID NO: 508033 - RNA, 19 nt, Homo sapiens
guugaagacugguuaauua

SEQ ID NO: 508034 - RNA, 19 nt, Homo sapiens
uaacauaugucucuaccua

SEQ ID NO: 508035 - RNA, 19 nt, Homo sapiens
gcaaugacgucuguaagua

SEQ ID NO: 508036 - RNA, 19 nt, Homo sapiens
ggacuuaccuuccaagcuu

SEQ ID NO: 508037 - RNA, 19 nt, Homo sapiens
acacacagcuucaacaauu

SEQ ID NO: 508038 - RNA, 19 nt, Homo sapiens
gaacggaugguuucauuaa

SEQ ID NO: 508039 - RNA, 19 nt, Homo sapiens
gagaggaccuaacauaugu

SEQ ID NO: 508040 - RNA, 19 nt, Homo sapiens
gcuaaggcauccauuauga

SEQ ID NO: 508041 - RNA, 19 nt, Homo sapiens
gaauauggcccgacacaaa

SEQ ID NO: 508042 - RNA, 19 nt, Homo sapiens
gaaugaaagucuuguaagu

SEQ ID NO: 508043 - RNA, 19 nt, Homo sapiens
ggacacaacgggaaacuuu

SEQ ID NO: 508044 - RNA, 19 nt, Homo sapiens
caaggaagcuggaaaggau

SEQ ID NO: 508045 - RNA, 19 nt, Homo sapiens
ggaaagcuuuauuguauuc

SEQ ID NO: 508046 - RNA, 19 nt, Homo sapiens
gaauugcucagcugauuua

SEQ ID NO: 508047 - RNA, 19 nt, Homo sapiens
gaauacagcagaacauuug

SEQ ID NO: 508048 - RNA, 19 nt, Homo sapiens
uaagauggguguuaugguu

SEQ ID NO: 508049 - RNA, 19 nt, Homo sapiens
gaaguuaggagaccacaaa

SEQ ID NO: 508050 - RNA, 19 nt, Homo sapiens
ccaacaagguggagagaaa

SEQ ID NO: 508051 - RNA, 19 nt, Homo sapiens
caacuggccugacaaauac

SEQ ID NO: 508052 - RNA, 19 nt, Homo sapiens
ugacacagguucuugcaaa

SEQ ID NO: 508053 - RNA, 19 nt, Homo sapiens
caaugggacucuuaugaaa

SEQ ID NO: 508054 - RNA, 19 nt, Homo sapiens
agacagaaacugagaauuu

SEQ ID NO: 508055 - RNA, 19 nt, Homo sapiens
ccaacuggccugacaaaua

SEQ ID NO: 508056 - RNA, 19 nt, Homo sapiens
cgacugugcugguaugauu

SEQ ID NO: 508057 - RNA, 19 nt, Homo sapiens
gcuguaaaguuucauauca

SEQ ID NO: 508058 - RNA, 19 nt, Homo sapiens
cagcagagguagaagauau

SEQ ID NO: 508059 - RNA, 19 nt, Homo sapiens
gcaggacggugaaacaaug

SEQ ID NO: 508060 - RNA, 19 nt, Homo sapiens
acagugaguugcaagaaua

SEQ ID NO: 508061 - RNA, 19 nt, Homo sapiens
uaaaagcugugguauguua

SEQ ID NO: 508062 - RNA, 19 nt, Homo sapiens
gcaaacagaauucauaaca

SEQ ID NO: 508063 - RNA, 19 nt, Homo sapiens
gagggaguuucgaguauaa

SEQ ID NO: 508064 - RNA, 19 nt, Homo sapiens
uuugauagcuuucagauug

SEQ ID NO: 508065 - RNA, 19 nt, Homo sapiens
gaagcaaacagcagaggua

SEQ ID NO: 508066 - RNA, 19 nt, Homo sapiens
caacaauugucaccauaug

SEQ ID NO: 508067 - RNA, 19 nt, Homo sapiens
gaagaaauagugcugaugu

SEQ ID NO: 508068 - RNA, 19 nt, Homo sapiens
ggaaggcaaugacgucugu

SEQ ID NO: 508069 - RNA, 19 nt, Homo sapiens
gggaaaagaucguauuaaa

SEQ ID NO: 508070 - RNA, 19 nt, Homo sapiens
gcaaacagcagagguagaa

SEQ ID NO: 508071 - RNA, 19 nt, Homo sapiens
gagcaucgcugugugaaca

SEQ ID NO: 508072 - RNA, 19 nt, Homo sapiens
gcaccugguuucccaaaug

SEQ ID NO: 508073 - RNA, 19 nt, Homo sapiens
aagagaggcuguucauuga

SEQ ID NO: 508074 - RNA, 19 nt, Homo sapiens
ggauggaugucaggacuaa

SEQ ID NO: 508075 - RNA, 19 nt, Homo sapiens
caagaaaccugaaaauaug

SEQ ID NO: 508076 - RNA, 19 nt, Homo sapiens
gcuucugucugcaauguua

SEQ ID NO: 508077 - RNA, 19 nt, Homo sapiens
gaauccagccuuagaggua

SEQ ID NO: 508078 - RNA, 19 nt, Homo sapiens
ggagaggaccuaacauaug

SEQ ID NO: 508079 - RNA, 19 nt, Homo sapiens
gcucagcugauuuaaauaa

SEQ ID NO: 508080 - RNA, 19 nt, Homo sapiens
gagaguccauucagcagaa

SEQ ID NO: 508081 - RNA, 19 nt, Homo sapiens
agaggacugugucucauua

SEQ ID NO: 508082 - RNA, 19 nt, Homo sapiens
ggacaugucaaccaagaaa

SEQ ID NO: 508083 - RNA, 19 nt, Homo sapiens
gaaugggcaugacugcaaa

SEQ ID NO: 508084 - RNA, 19 nt, Homo sapiens
aaagagaggcuguucauug

SEQ ID NO: 508085 - RNA, 19 nt, Homo sapiens
ccaguggaauuucuucaaa

SEQ ID NO: 508086 - RNA, 19 nt, Homo sapiens
uaggguagauuccauuuau

SEQ ID NO: 508087 - RNA, 19 nt, Homo sapiens
aaagaaaggucagagaaau

SEQ ID NO: 508088 - RNA, 19 nt, Homo sapiens
ggaucucccuucaguuuga

SEQ ID NO: 508089 - RNA, 19 nt, Homo sapiens
uccgauggcucuaucaaua

SEQ ID NO: 508090 - RNA, 19 nt, Homo sapiens
gaugucaguuucaaagaga

SEQ ID NO: 508091 - RNA, 19 nt, Homo sapiens
caauuucucucuaaagcaa

SEQ ID NO: 508092 - RNA, 19 nt, Homo sapiens
caaagaaaggucagagaaa

SEQ ID NO: 508093 - RNA, 19 nt, Homo sapiens
guucauugauccacuauuc

SEQ ID NO: 508094 - RNA, 19 nt, Homo sapiens
caaagaugccggucagauu

SEQ ID NO: 508095 - RNA, 19 nt, Homo sapiens
uagaacggaugguuucauu

SEQ ID NO: 508096 - RNA, 19 nt, Homo sapiens
gcuacuggcuccacgagaa

SEQ ID NO: 508097 - RNA, 19 nt, Homo sapiens
ggaagagagugcccugauc

SEQ ID NO: 508098 - RNA, 19 nt, Homo sapiens
gggaagaacugugacaagu

SEQ ID NO: 508099 - RNA, 19 nt, Homo sapiens
gauaauucuucuuccaaug

SEQ ID NO: 508100 - RNA, 19 nt, Homo sapiens
gauccacuauucccucuau

SEQ ID NO: 508101 - RNA, 19 nt, Homo sapiens
ucagagaauugucuuagga

SEQ ID NO: 508102 - RNA, 19 nt, Homo sapiens
gucaaagccuuaaucaaug

SEQ ID NO: 508103 - RNA, 19 nt, Homo sapiens
gcccacuucuucucagaua

SEQ ID NO: 508104 - RNA, 19 nt, Homo sapiens
ggagagacauacgacuuug

SEQ ID NO: 508105 - RNA, 19 nt, Homo sapiens
caacaugucaccaucauca

SEQ ID NO: 508106 - RNA, 19 nt, Homo sapiens
ugugugaccuucauagaaa

SEQ ID NO: 508107 - RNA, 19 nt, Homo sapiens
ugucaaagccuuaaucaau

SEQ ID NO: 508108 - RNA, 19 nt, Homo sapiens
uguaaaaggugaaagguua

SEQ ID NO: 508109 - RNA, 19 nt, Homo sapiens
gcugugguauguuagcuuu

SEQ ID NO: 508110 - RNA, 19 nt, Homo sapiens
caaauguucccuuggcuuu

SEQ ID NO: 508111 - RNA, 19 nt, Homo sapiens
gagaggcuguucauugauc

SEQ ID NO: 508112 - RNA, 19 nt, Homo sapiens
gcaguauguuucucagguu

SEQ ID NO: 508113 - RNA, 19 nt, Homo sapiens
gaaggaguaucccacaaac

SEQ ID NO: 508114 - RNA, 19 nt, Homo sapiens
gaagaguaauaccaaaugc

SEQ ID NO: 508115 - RNA, 19 nt, Homo sapiens
gcaaauucacauugagauu

SEQ ID NO: 508116 - RNA, 19 nt, Homo sapiens
gcuaaaagcugugguaugu

SEQ ID NO: 508117 - RNA, 19 nt, Homo sapiens
ggaacaagucaaucaguga

SEQ ID NO: 508118 - RNA, 19 nt, Homo sapiens
cccggaagcuguacaaaug

SEQ ID NO: 508119 - RNA, 19 nt, Homo sapiens
guugguaacuuugcucuga

SEQ ID NO: 508120 - RNA, 19 nt, Homo sapiens
caauucaggucccuuaugg

SEQ ID NO: 508121 - RNA, 19 nt, Homo sapiens
ccuuagagguauauauuug

SEQ ID NO: 508122 - RNA, 19 nt, Homo sapiens
gaguguaccuggaacaucu

SEQ ID NO: 508123 - RNA, 19 nt, Homo sapiens
ccaacuauccggaugacua

SEQ ID NO: 508124 - RNA, 19 nt, Homo sapiens
gaugaggaaagcuuuauug

SEQ ID NO: 508125 - RNA, 19 nt, Homo sapiens
uugcucagcugauuuaaau

SEQ ID NO: 508126 - RNA, 19 nt, Homo sapiens
agaaaugcaugggaauauu

SEQ ID NO: 508127 - RNA, 19 nt, Homo sapiens
ggaauuccuuugggaugaa

SEQ ID NO: 508128 - RNA, 19 nt, Homo sapiens
agagugcguugguaacuuu

SEQ ID NO: 508129 - RNA, 19 nt, Homo sapiens
cgauggcucuaucaauaaa

SEQ ID NO: 508130 - RNA, 19 nt, Homo sapiens
gaaaucgagcuccaacaga

SEQ ID NO: 508131 - RNA, 19 nt, Homo sapiens
gcacacagaugaugaguug

SEQ ID NO: 508132 - RNA, 19 nt, Homo sapiens
ggaaagcuuuggacuacua

SEQ ID NO: 508133 - RNA, 19 nt, Homo sapiens
ggaaauaacagggaccuua

SEQ ID NO: 508134 - RNA, 19 nt, Homo sapiens
ucaaucagcucaucacuau

SEQ ID NO: 508135 - RNA, 19 nt, Homo sapiens
gaagaugguuggcggcauu

SEQ ID NO: 508136 - RNA, 19 nt, Homo sapiens
gaagagauagguucccaua

SEQ ID NO: 508137 - RNA, 19 nt, Homo sapiens
gaaauaacagggaccuuaa

SEQ ID NO: 508138 - RNA, 19 nt, Homo sapiens
ugacaaggccugugaguuu

SEQ ID NO: 508139 - RNA, 19 nt, Homo sapiens
agagaaagaucuacaggaa

SEQ ID NO: 508140 - RNA, 19 nt, Homo sapiens
caagauggaugaaucaaag

SEQ ID NO: 508141 - RNA, 19 nt, Homo sapiens
ucaagaagcuaauuacaag

SEQ ID NO: 508142 - RNA, 19 nt, Homo sapiens
ggaagcauguggaccuuug

SEQ ID NO: 508143 - RNA, 19 nt, Homo sapiens
uaacagggaccuuaagaaa

SEQ ID NO: 508144 - RNA, 19 nt, Homo sapiens
ugaagacgaugcaguuuga

SEQ ID NO: 508145 - RNA, 19 nt, Homo sapiens
gaagcgagccucagauaau

SEQ ID NO: 508146 - RNA, 19 nt, Homo sapiens
uauuaacgcuccaagagua

SEQ ID NO: 508147 - RNA, 19 nt, Homo sapiens
ucaaugacauguccuacuu

SEQ ID NO: 508148 - RNA, 19 nt, Homo sapiens
gaugaguccuugaacuuug

SEQ ID NO: 508149 - RNA, 19 nt, Homo sapiens
uaagaaaggacaagacauu

SEQ ID NO: 508150 - RNA, 19 nt, Homo sapiens
ggacacaugccuccucuga

SEQ ID NO: 508151 - RNA, 19 nt, Homo sapiens
ggaaggagaugaggagucu

SEQ ID NO: 508152 - RNA, 19 nt, Homo sapiens
gaaccucaccaacaucaaa

SEQ ID NO: 508153 - RNA, 19 nt, Homo sapiens
cuaaccagcugaccaguga

SEQ ID NO: 508154 - RNA, 19 nt, Homo sapiens
ggaggaggcugugcagaug

SEQ ID NO: 508155 - RNA, 19 nt, Homo sapiens
gcagaaugccaucaagaaa

SEQ ID NO: 508156 - RNA, 19 nt, Homo sapiens
gauaucauccugaagaaga

SEQ ID NO: 508157 - RNA, 19 nt, Homo sapiens
gaaacuaaagcagaaauug

SEQ ID NO: 508158 - RNA, 19 nt, Homo sapiens
cuucagagcuucgagauga

SEQ ID NO: 508159 - RNA, 19 nt, Homo sapiens
gaucaucgcagcacaggaa

SEQ ID NO: 508160 - RNA, 19 nt, Homo sapiens
gcagugggcugugcaguca

SEQ ID NO: 508161 - RNA, 19 nt, Homo sapiens
gcacucacuggaaccauua

SEQ ID NO: 508162 - RNA, 19 nt, Homo sapiens
caucauugcuuaagacagu

SEQ ID NO: 508163 - RNA, 19 nt, Homo sapiens
agaaagaucuacaggaagu

SEQ ID NO: 508164 - RNA, 19 nt, Homo sapiens
ggaauguggugaagacgau

SEQ ID NO: 508165 - RNA, 19 nt, Homo sapiens
gagaugaggagucuacuau

SEQ ID NO: 508166 - RNA, 19 nt, Homo sapiens
cauaggggcugcagaguua

SEQ ID NO: 508167 - RNA, 19 nt, Homo sapiens
gcuccaagaguauuauuaa

SEQ ID NO: 508168 - RNA, 19 nt, Homo sapiens
gagcugggcccucuugcua

SEQ ID NO: 508169 - RNA, 19 nt, Homo sapiens
cagggcagcuggaguguga

SEQ ID NO: 508170 - RNA, 19 nt, Homo sapiens
gagaugagcacuaaagaag

SEQ ID NO: 508171 - RNA, 19 nt, Homo sapiens
ggaccgagcccaaguugug

SEQ ID NO: 508172 - RNA, 19 nt, Homo sapiens
uacagaaucuagagaaaga

SEQ ID NO: 508173 - RNA, 19 nt, Homo sapiens
gguacagaaucuagagaaa

SEQ ID NO: 508174 - RNA, 19 nt, Homo sapiens
agacagugguggugaaaga

SEQ ID NO: 508175 - RNA, 19 nt, Homo sapiens
gaacuuugaggagcagaua

SEQ ID NO: 508176 - RNA, 19 nt, Homo sapiens
cccguucucucaagacuua

SEQ ID NO: 508177 - RNA, 19 nt, Homo sapiens
ccacagucauugcugagaa

SEQ ID NO: 508178 - RNA, 19 nt, Homo sapiens
aaacacaccucugcacugu

SEQ ID NO: 508179 - RNA, 19 nt, Homo sapiens
aaagugaucuggagaacuc

SEQ ID NO: 508180 - RNA, 19 nt, Homo sapiens
gaagggagagcguaagauc

SEQ ID NO: 508181 - RNA, 19 nt, Homo sapiens
gacaaggccugugaguuug

SEQ ID NO: 508182 - RNA, 19 nt, Homo sapiens
gaagauggagaaacuaaag

SEQ ID NO: 508183 - RNA, 19 nt, Homo sapiens
agacauugcugcgagauga

SEQ ID NO: 508184 - RNA, 19 nt, Homo sapiens
gaccaucugugcccgcauu

SEQ ID NO: 508185 - RNA, 19 nt, Homo sapiens
gaaggugggugccauucca

SEQ ID NO: 508186 - RNA, 19 nt, Homo sapiens
gcagaugaguccuugaacu

SEQ ID NO: 508187 - RNA, 19 nt, Homo sapiens
guagaggaccugacaacaa

SEQ ID NO: 508188 - RNA, 19 nt, Homo sapiens
gcacugggacauuucaaga

SEQ ID NO: 508189 - RNA, 19 nt, Homo sapiens
agugaaagauguagccaaa

SEQ ID NO: 508190 - RNA, 19 nt, Homo sapiens
uaacugacagcaucaauca

SEQ ID NO: 508191 - RNA, 19 nt, Homo sapiens
acaaucagcucaccugucu

SEQ ID NO: 508192 - RNA, 19 nt, Homo sapiens
gaugaggagucuacuaugc

SEQ ID NO: 508193 - RNA, 19 nt, Homo sapiens
cagcacagcuaaucuuguc

SEQ ID NO: 508194 - RNA, 19 nt, Homo sapiens
caacagcacagcuaaucuu

SEQ ID NO: 508195 - RNA, 19 nt, Homo sapiens
gggagacaauggagaagug

SEQ ID NO: 508196 - RNA, 19 nt, Homo sapiens
ucagcucucuucaccguuu

SEQ ID NO: 508197 - RNA, 19 nt, Homo sapiens
ccaaggagguggccaacag

SEQ ID NO: 508198 - RNA, 19 nt, Homo sapiens
ccuauccacuucccaacua

SEQ ID NO: 508199 - RNA, 19 nt, Homo sapiens
ccucugguccugagaauuu

SEQ ID NO: 508200 - RNA, 19 nt, Homo sapiens
gaaagggaagaacaagcua

SEQ ID NO: 508201 - RNA, 19 nt, Homo sapiens
uggagaaacuaaagcagaa

SEQ ID NO: 508202 - RNA, 19 nt, Homo sapiens
gagagcugauggaagagaa

SEQ ID NO: 508203 - RNA, 19 nt, Homo sapiens
gcucugaaccgcuguguca

SEQ ID NO: 508204 - RNA, 19 nt, Homo sapiens
ccagaaggcucaggaagca

SEQ ID NO: 508205 - RNA, 19 nt, Homo sapiens
uugaagagcaggagaauga

SEQ ID NO: 508206 - RNA, 19 nt, Homo sapiens
ggacucggaggcaaugaaa

SEQ ID NO: 508207 - RNA, 19 nt, Homo sapiens
ccaagaaggagcucauaga

SEQ ID NO: 508208 - RNA, 19 nt, Homo sapiens
gaaggcagcagcucgagau

SEQ ID NO: 508209 - RNA, 19 nt, Homo sapiens
gaacucccgcaagcucuua

SEQ ID NO: 508210 - RNA, 19 nt, Homo sapiens
gugaagcgagccucagaua

SEQ ID NO: 508211 - RNA, 19 nt, Homo sapiens
uaaaagccguggaagauga

SEQ ID NO: 508212 - RNA, 19 nt, Homo sapiens
caaggaggcuggugguaac

SEQ ID NO: 508213 - RNA, 19 nt, Homo sapiens
uugcagcucugaacaguug

SEQ ID NO: 508214 - RNA, 19 nt, Homo sapiens
gagauggauucugcacuga

SEQ ID NO: 508215 - RNA, 19 nt, Homo sapiens
gagaagaccaaggaaguga

SEQ ID NO: 508216 - RNA, 19 nt, Homo sapiens
ggcugcagcuggcaaaguu

SEQ ID NO: 508217 - RNA, 19 nt, Homo sapiens
ccagauggcgcaguacuuu

SEQ ID NO: 508218 - RNA, 19 nt, Homo sapiens
gaugcucacugcaguccaa

SEQ ID NO: 508219 - RNA, 19 nt, Homo sapiens
ugagaauuaugcagguauu

SEQ ID NO: 508220 - RNA, 19 nt, Homo sapiens
caaugcagcugcgcagaau

SEQ ID NO: 508221 - RNA, 19 nt, Homo sapiens
ggaaagugaucuggagaac

SEQ ID NO: 508222 - RNA, 19 nt, Homo sapiens
gaaauugcacacagaugau

SEQ ID NO: 508223 - RNA, 19 nt, Homo sapiens
agaaauugcacacagauga

SEQ ID NO: 508224 - RNA, 19 nt, Homo sapiens
uaacgcuccaagaguauua

SEQ ID NO: 508225 - RNA, 19 nt, Homo sapiens
gcuucgagaugagcacuaa

SEQ ID NO: 508226 - RNA, 19 nt, Homo sapiens
gcaguugacaggacauuca

SEQ ID NO: 508227 - RNA, 19 nt, Homo sapiens
ccaaggaggcuggugguaa

SEQ ID NO: 508228 - RNA, 19 nt, Homo sapiens
gauccacucucagguagau

SEQ ID NO: 508229 - RNA, 19 nt, Homo sapiens
ggagaugaggagucuacua

SEQ ID NO: 508230 - RNA, 19 nt, Homo sapiens
gaagagcaggagaaugaga

SEQ ID NO: 508231 - RNA, 19 nt, Homo sapiens
caaagaaacuccaacauuu

SEQ ID NO: 508232 - RNA, 19 nt, Homo sapiens
gaaaugagguguauguaug

SEQ ID NO: 508233 - RNA, 19 nt, Homo sapiens
gaaacaagccaacuaguaa

SEQ ID NO: 508234 - RNA, 19 nt, Homo sapiens
cagcaacacuucugguuua

SEQ ID NO: 508235 - RNA, 19 nt, Homo sapiens
guacacacaugaauacaaa

SEQ ID NO: 508236 - RNA, 19 nt, Homo sapiens
ggaaacaagccaacuagua

SEQ ID NO: 508237 - RNA, 19 nt, Homo sapiens
caacaaaguccaccaauau

SEQ ID NO: 508238 - RNA, 19 nt, Homo sapiens
gaaaugagaguagguguuu

SEQ ID NO: 508239 - RNA, 19 nt, Homo sapiens
ccaacaaaguccaccaaua

SEQ ID NO: 508240 - RNA, 19 nt, Homo sapiens
gaaauggaaguuugaguaa

SEQ ID NO: 508241 - RNA, 19 nt, Homo sapiens
gagaguagguguuuauuac

SEQ ID NO: 508242 - RNA, 19 nt, Homo sapiens
gauguacuuuccacaguua

SEQ ID NO: 508243 - RNA, 19 nt, Homo sapiens
gcauugcugugaaagauaa

SEQ ID NO: 508244 - RNA, 19 nt, Homo sapiens
ggagaggaagcuuuauuua

SEQ ID NO: 508245 - RNA, 19 nt, Homo sapiens
gagaaaggccgcacccuaa

SEQ ID NO: 508246 - RNA, 19 nt, Homo sapiens
uauauucgguccuucauuu

SEQ ID NO: 508247 - RNA, 19 nt, Homo sapiens
gaaaguaggaccaggaaau

SEQ ID NO: 508248 - RNA, 19 nt, Homo sapiens
gggauuaauucuugugauu

SEQ ID NO: 508249 - RNA, 19 nt, Homo sapiens
guaaguaggucucauucau

SEQ ID NO: 508250 - RNA, 19 nt, Homo sapiens
gagaaacaccuaaaucuuc

SEQ ID NO: 508251 - RNA, 19 nt, Homo sapiens
ugagaagucugaaaccaaa

SEQ ID NO: 508252 - RNA, 19 nt, Homo sapiens
gaacaaagaaacuccaaca

SEQ ID NO: 508253 - RNA, 19 nt, Homo sapiens
gggacugaaugaauaagua

SEQ ID NO: 508254 - RNA, 19 nt, Homo sapiens
agaggaagcuuuauuuaca

SEQ ID NO: 508255 - RNA, 19 nt, Homo sapiens
ggaaugucaugaaauauac

SEQ ID NO: 508256 - RNA, 19 nt, Homo sapiens
ccaaguaucuucgauucaa

SEQ ID NO: 508257 - RNA, 19 nt, Homo sapiens
gcacaguaguggaaaugga

SEQ ID NO: 508258 - RNA, 19 nt, Homo sapiens
ggaaaugagguguauguau

SEQ ID NO: 508259 - RNA, 19 nt, Homo sapiens
gaggaagcuuuauuuacaa

SEQ ID NO: 508260 - RNA, 19 nt, Homo sapiens
gaacacauggcauuuguag

SEQ ID NO: 508261 - RNA, 19 nt, Homo sapiens
ggagaaacaccuaaaucuu

SEQ ID NO: 508262 - RNA, 19 nt, Homo sapiens
gagaacuauuggacucuaa

SEQ ID NO: 508263 - RNA, 19 nt, Homo sapiens
acuccaacauuucacauua

SEQ ID NO: 508264 - RNA, 19 nt, Homo sapiens
gaacgcaggagacacaaga

SEQ ID NO: 508265 - RNA, 19 nt, Homo sapiens
uuagagaaauggaaguuug

SEQ ID NO: 508266 - RNA, 19 nt, Homo sapiens
acaaagaaacuccaacauu

SEQ ID NO: 508267 - RNA, 19 nt, Homo sapiens
agaaggcuguggccaagua

SEQ ID NO: 508268 - RNA, 19 nt, Homo sapiens
aaguaggucucauucauuu

SEQ ID NO: 508269 - RNA, 19 nt, Homo sapiens
aaacauuugucaugggauu

SEQ ID NO: 508270 - RNA, 19 nt, Homo sapiens
ggagagaaggcaccgcuaa

SEQ ID NO: 508271 - RNA, 19 nt, Homo sapiens
ggacucuaauugcuuugaa

SEQ ID NO: 508272 - RNA, 19 nt, Homo sapiens
gcaguuauauucgguccuu

SEQ ID NO: 508273 - RNA, 19 nt, Homo sapiens
ggauggaaaugagguguau

SEQ ID NO: 508274 - RNA, 19 nt, Homo sapiens
uaaaggaugagaagacaaa

SEQ ID NO: 508275 - RNA, 19 nt, Homo sapiens
gaugugggcuucauugacu

SEQ ID NO: 508276 - RNA, 19 nt, Homo sapiens
gucaugggauuaauucuug

SEQ ID NO: 508277 - RNA, 19 nt, Homo sapiens
guaaacucauuguccuuga

SEQ ID NO: 508278 - RNA, 19 nt, Homo sapiens
agaaacaccuaaaucuuca

SEQ ID NO: 508279 - RNA, 19 nt, Homo sapiens
aaagaaagaugagaagucu

SEQ ID NO: 508280 - RNA, 19 nt, Homo sapiens
agaaauggaaguuugagua

SEQ ID NO: 508281 - RNA, 19 nt, Homo sapiens
gaaagugaacagcauuugu

SEQ ID NO: 508282 - RNA, 19 nt, Homo sapiens
uguaggaaauccacacuga

SEQ ID NO: 508283 - RNA, 19 nt, Homo sapiens
ucauuguccuugauaguuu

SEQ ID NO: 508284 - RNA, 19 nt, Homo sapiens
gcauuuguagcauucuuua

SEQ ID NO: 508285 - RNA, 19 nt, Homo sapiens
cgauucaacuguccaacaa

SEQ ID NO: 508286 - RNA, 19 nt, Homo sapiens
gaacuauuggacucuaauu

SEQ ID NO: 508287 - RNA, 19 nt, Homo sapiens
gcagcaacacuucugguuu

SEQ ID NO: 508288 - RNA, 19 nt, Homo sapiens
ggaacugccucagguaaag

SEQ ID NO: 508289 - RNA, 19 nt, Homo sapiens
ugacccaguucacuuuaaa

SEQ ID NO: 508290 - RNA, 19 nt, Homo sapiens
ggccaaguaucuucgauuc

SEQ ID NO: 508291 - RNA, 19 nt, Homo sapiens
gagaaagugaacagcauuu

SEQ ID NO: 508292 - RNA, 19 nt, Homo sapiens
ggaaaaugauggagaaaca

SEQ ID NO: 508293 - RNA, 19 nt, Homo sapiens
caagccaacuaguaacaau

SEQ ID NO: 508294 - RNA, 19 nt, Homo sapiens
acaccuaaaucuucacaug

SEQ ID NO: 508295 - RNA, 19 nt, Homo sapiens
ugagaguagguguuuauua

SEQ ID NO: 508296 - RNA, 19 nt, Homo sapiens
gaaaggccgcacccuaaau

SEQ ID NO: 508297 - RNA, 19 nt, Homo sapiens
aagcagacuuaaagaaaga

SEQ ID NO: 508298 - RNA, 19 nt, Homo sapiens
ccauuucacaguuucuuua

SEQ ID NO: 508299 - RNA, 19 nt, Homo sapiens
agaaagaugagaagucuga

SEQ ID NO: 508300 - RNA, 19 nt, Homo sapiens
gagaggaagcuuuauuuac

SEQ ID NO: 508301 - RNA, 19 nt, Homo sapiens
ggugaaccaucuaaagaag

SEQ ID NO: 508302 - RNA, 19 nt, Homo sapiens
caacacuucugguuuagcu

SEQ ID NO: 508303 - RNA, 19 nt, Homo sapiens
uaaguaggucucauucauu

SEQ ID NO: 508304 - RNA, 19 nt, Homo sapiens
gaugagaagucugaaacca

SEQ ID NO: 508305 - RNA, 19 nt, Homo sapiens
gggcaaaggccaagaaagg

SEQ ID NO: 508306 - RNA, 19 nt, Homo sapiens
gagaaggcaccgcuaagga

SEQ ID NO: 508307 - RNA, 19 nt, Homo sapiens
ucagaaaugagauacugua

SEQ ID NO: 508308 - RNA, 19 nt, Homo sapiens
uaacaaugcagcaacacuu

SEQ ID NO: 508309 - RNA, 19 nt, Homo sapiens
aaagcagacuuaaagaaag

SEQ ID NO: 508310 - RNA, 19 nt, Homo sapiens
uauaaaggaugagaagaca

SEQ ID NO: 508311 - RNA, 19 nt, Homo sapiens
gaagcuuuauuuacaacca

SEQ ID NO: 508312 - RNA, 19 nt, Homo sapiens
gucaccggguugauuauuu

SEQ ID NO: 508313 - RNA, 19 nt, Homo sapiens
cagagaaagugaacagcau

SEQ ID NO: 508314 - RNA, 19 nt, Homo sapiens
ugaguuagcagaguucaaa

SEQ ID NO: 508315 - RNA, 19 nt, Homo sapiens
ugacauucaagcaguuaua

SEQ ID NO: 508316 - RNA, 19 nt, Homo sapiens
gaaugaauaaguacaagag

SEQ ID NO: 508317 - RNA, 19 nt, Homo sapiens
gugaagaggaugaggaaga

SEQ ID NO: 508318 - RNA, 19 nt, Homo sapiens
gauuaauucuugugauugc

SEQ ID NO: 508319 - RNA, 19 nt, Homo sapiens
gaaauauacaguacauugc

SEQ ID NO: 508320 - RNA, 19 nt, Homo sapiens
acaaaguccaccaauauga

SEQ ID NO: 508321 - RNA, 19 nt, Homo sapiens
ugagaaaccaggacucuuc

SEQ ID NO: 508322 - RNA, 19 nt, Homo sapiens
ugauucagaugcucaguca

SEQ ID NO: 508323 - RNA, 19 nt, Homo sapiens
caucuuaguuacaagucuu

SEQ ID NO: 508324 - RNA, 19 nt, Homo sapiens
gacuuuacgucuuauacau

SEQ ID NO: 508325 - RNA, 19 nt, Homo sapiens
aguuugacuuuacgucuua

SEQ ID NO: 508326 - RNA, 19 nt, Homo sapiens
ggcguaacguaaaguguau

SEQ ID NO: 508327 - RNA, 19 nt, Homo sapiens
aaacucauuguccuugaua

SEQ ID NO: 508328 - RNA, 19 nt, Homo sapiens
gcacuauuauugguacagu

SEQ ID NO: 508329 - RNA, 19 nt, Homo sapiens
uuucuauguuggcugauua

SEQ ID NO: 508330 - RNA, 19 nt, Homo sapiens
gagguuggauuuucuaugu

SEQ ID NO: 508331 - RNA, 19 nt, Homo sapiens
gaacauacccuuagaagaa

SEQ ID NO: 508332 - RNA, 19 nt, Homo sapiens
ccaaagaaaucuccaguuu

SEQ ID NO: 508333 - RNA, 19 nt, Homo sapiens
ugaaggaucuaauagcuua

SEQ ID NO: 508334 - RNA, 19 nt, Homo sapiens
ccaauaaucucuuaacaga

SEQ ID NO: 508335 - RNA, 19 nt, Homo sapiens
gaaagaagguaugcagauu

SEQ ID NO: 508336 - RNA, 19 nt, Homo sapiens
ccaaaguuaucaagucuua

SEQ ID NO: 508337 - RNA, 19 nt, Homo sapiens
ggcaauaugucucaacuaa

SEQ ID NO: 508338 - RNA, 19 nt, Homo sapiens
gaagaaaucaggauaacaa

SEQ ID NO: 508339 - RNA, 19 nt, Homo sapiens
gccauuaucuucauguuaa

SEQ ID NO: 508340 - RNA, 19 nt, Homo sapiens
ugaauuauccugcaacaua

SEQ ID NO: 508341 - RNA, 19 nt, Homo sapiens
aaaggaaucuguaucugua

SEQ ID NO: 508342 - RNA, 19 nt, Homo sapiens
ggucgcaguucaccauuua

SEQ ID NO: 508343 - RNA, 19 nt, Homo sapiens
caaauguucuuacuuccua

SEQ ID NO: 508344 - RNA, 19 nt, Homo sapiens
caacauaacucugcugauc

SEQ ID NO: 508345 - RNA, 19 nt, Homo sapiens
gcuagaagauaacaaaugu

SEQ ID NO: 508346 - RNA, 19 nt, Homo sapiens
ugaagucucugcaacaauu

SEQ ID NO: 508347 - RNA, 19 nt, Homo sapiens
cagcauagauguaaacaca

SEQ ID NO: 508348 - RNA, 19 nt, Homo sapiens
gaaacaacuuggaauucuu

SEQ ID NO: 508349 - RNA, 19 nt, Homo sapiens
guuaucaagucuuaccuua

SEQ ID NO: 508350 - RNA, 19 nt, Homo sapiens
gaucugcccugguaucuca

SEQ ID NO: 508351 - RNA, 19 nt, Homo sapiens
cuaaagaccuaucccagaa

SEQ ID NO: 508352 - RNA, 19 nt, Homo sapiens
ugacuagcaucuuccauuu

SEQ ID NO: 508353 - RNA, 19 nt, Homo sapiens
gauuacacaucaagugaaa

SEQ ID NO: 508354 - RNA, 19 nt, Homo sapiens
gcauagauguaaacacaau

SEQ ID NO: 508355 - RNA, 19 nt, Homo sapiens
gaaaugacuacacagauga

SEQ ID NO: 508356 - RNA, 19 nt, Homo sapiens
uggcgaaacuucaaacaaa

SEQ ID NO: 508357 - RNA, 19 nt, Homo sapiens
gcaaagaaauagauuacac

SEQ ID NO: 508358 - RNA, 19 nt, Homo sapiens
ugaaaugacuacacagaug

SEQ ID NO: 508359 - RNA, 19 nt, Homo sapiens
ucaaaugugugcuagaaga

SEQ ID NO: 508360 - RNA, 19 nt, Homo sapiens
gaggaacccuacuaaagga

SEQ ID NO: 508361 - RNA, 19 nt, Homo sapiens
cagcuggacuucagagauu

SEQ ID NO: 508362 - RNA, 19 nt, Homo sapiens
cagaagaugaggucaauaa

SEQ ID NO: 508363 - RNA, 19 nt, Homo sapiens
caggaggacuuauuuggaa

SEQ ID NO: 508364 - RNA, 19 nt, Homo sapiens
uuagagggcuggccugauu

SEQ ID NO: 508365 - RNA, 19 nt, Homo sapiens
gaugaagucucugcaacaa

SEQ ID NO: 508366 - RNA, 19 nt, Homo sapiens
ggaauucuuucauuaggau

SEQ ID NO: 508367 - RNA, 19 nt, Homo sapiens
gccaauugcucauuugaau

SEQ ID NO: 508368 - RNA, 19 nt, Homo sapiens
cagguugucuuguguuaaa

SEQ ID NO: 508369 - RNA, 19 nt, Homo sapiens
cugcaacaauuggauauua

SEQ ID NO: 508370 - RNA, 19 nt, Homo sapiens
uagcaaaucuggaacuauc

SEQ ID NO: 508371 - RNA, 19 nt, Homo sapiens
gaauuggaauacuuggauu

SEQ ID NO: 508372 - RNA, 19 nt, Homo sapiens
ugacagagcaagcaaagaa

SEQ ID NO: 508373 - RNA, 19 nt, Homo sapiens
uaucaaaugugugcuagaa

SEQ ID NO: 508374 - RNA, 19 nt, Homo sapiens
aguaucaagugaaguguua

SEQ ID NO: 508375 - RNA, 19 nt, Homo sapiens
uaucugagcuuuggacuuc

SEQ ID NO: 508376 - RNA, 19 nt, Homo sapiens
gaacagcuucuaccuuuag

SEQ ID NO: 508377 - RNA, 19 nt, Homo sapiens
gggcuggccugauucuuau

SEQ ID NO: 508378 - RNA, 19 nt, Homo sapiens
gaaaucaggauaacaaagg

SEQ ID NO: 508379 - RNA, 19 nt, Homo sapiens
ucacaugucugaauuaucc

SEQ ID NO: 508380 - RNA, 19 nt, Homo sapiens
ggauaacaaagguauauug

SEQ ID NO: 508381 - RNA, 19 nt, Homo sapiens
uagcagccuuucuguauug

SEQ ID NO: 508382 - RNA, 19 nt, Homo sapiens
aagaagguaugcagauuug

SEQ ID NO: 508383 - RNA, 19 nt, Homo sapiens
ggagacuguucuuggacua

SEQ ID NO: 508384 - RNA, 19 nt, Homo sapiens
cuacacagaugaagucucu

SEQ ID NO: 508385 - RNA, 19 nt, Homo sapiens
gaccaaguaucaagugaag

SEQ ID NO: 508386 - RNA, 19 nt, Homo sapiens
cacaaucucuuucaugaag

SEQ ID NO: 508387 - RNA, 19 nt, Homo sapiens
gcaagagcauuguggaaaa

SEQ ID NO: 508388 - RNA, 19 nt, Homo sapiens
aaaggagacuguucuugga

SEQ ID NO: 508389 - RNA, 19 nt, Homo sapiens
gcaaaucuggaacuaucua

SEQ ID NO: 508390 - RNA, 19 nt, Homo sapiens
gcaguucaccauuuauaug

SEQ ID NO: 508391 - RNA, 19 nt, Homo sapiens
ccaguuucaugcauuuauu

SEQ ID NO: 508392 - RNA, 19 nt, Homo sapiens
caauguugcuuucaauucu

SEQ ID NO: 508393 - RNA, 19 nt, Homo sapiens
ugaaacaacuuggaauucu

SEQ ID NO: 508394 - RNA, 19 nt, Homo sapiens
caggcccucuuccuuguua

SEQ ID NO: 508395 - RNA, 19 nt, Homo sapiens
gcaagcaaagaaauagauu

SEQ ID NO: 508396 - RNA, 19 nt, Homo sapiens
gagcaccacacacuuagaa

SEQ ID NO: 508397 - RNA, 19 nt, Homo sapiens
gcaauaugucucaacuaaa

SEQ ID NO: 508398 - RNA, 19 nt, Homo sapiens
caaaaugacuagcaucuuc

SEQ ID NO: 508399 - RNA, 19 nt, Homo sapiens
gcuucuaccuuuaggaaug

SEQ ID NO: 508400 - RNA, 19 nt, Homo sapiens
ccaggaacauacccuuaga

SEQ ID NO: 508401 - RNA, 19 nt, Homo sapiens
ucagcgauguguucgguuu

SEQ ID NO: 508402 - RNA, 19 nt, Homo sapiens
guugagcaccacacacuua

SEQ ID NO: 508403 - RNA, 19 nt, Homo sapiens
ggaauuggaauacuuggau

SEQ ID NO: 508404 - RNA, 19 nt, Homo sapiens
uagcugaaaugacuacaca

SEQ ID NO: 508405 - RNA, 19 nt, Homo sapiens
agucuuaccuuaaacaaca

SEQ ID NO: 508406 - RNA, 19 nt, Homo sapiens
acuuggaccugucauuuaa

SEQ ID NO: 508407 - RNA, 19 nt, Homo sapiens
guuaauacuucagaucaga

SEQ ID NO: 508408 - RNA, 19 nt, Homo sapiens
cagagcaagcaaagaaaua

SEQ ID NO: 508409 - RNA, 19 nt, Homo sapiens
gcaguuaucacaagcucaa

SEQ ID NO: 508410 - RNA, 19 nt, Homo sapiens
ccgcaguacuccauuccua

SEQ ID NO: 508411 - RNA, 19 nt, Homo sapiens
gcgcagggccaggaacaua

SEQ ID NO: 508412 - RNA, 19 nt, Homo sapiens
uuccagagcugccagaaga

SEQ ID NO: 508413 - RNA, 19 nt, Homo sapiens
ggcgaaacuucaaacaaau

SEQ ID NO: 508414 - RNA, 19 nt, Homo sapiens
aaugugugcuagaagauaa

SEQ ID NO: 508415 - RNA, 19 nt, Homo sapiens
uuaggaaugucuaguguuc

SEQ ID NO: 508416 - RNA, 19 nt, Homo sapiens
cuguucagcucuuguguuu

SEQ ID NO: 508417 - RNA, 19 nt, Homo sapiens
uaagggcagccauuaauau

SEQ ID NO: 508418 - RNA, 19 nt, Homo sapiens
aaagaagguaugcagauuu

SEQ ID NO: 508419 - RNA, 19 nt, Homo sapiens
ggaacauacccuuagaaga

SEQ ID NO: 508420 - RNA, 19 nt, Homo sapiens
ucuguaagcuaugaugaaa

SEQ ID NO: 508421 - RNA, 19 nt, Homo sapiens
ugagggccuucaagacuuu

SEQ ID NO: 508422 - RNA, 19 nt, Homo sapiens
acaaguuggugaagauuuc

SEQ ID NO: 508423 - RNA, 19 nt, Homo sapiens
ucugacaucuuaucacugu

SEQ ID NO: 508424 - RNA, 19 nt, Homo sapiens
gaacccuacuaaaggacuu

SEQ ID NO: 508425 - RNA, 19 nt, Homo sapiens
gaagaugaggucaauaaaa

SEQ ID NO: 508426 - RNA, 19 nt, Homo sapiens
gccagaagaugaggucaau

SEQ ID NO: 508427 - RNA, 19 nt, Homo sapiens
ccaauugcucauuugaaua

SEQ ID NO: 508428 - RNA, 19 nt, Homo sapiens
uaacuuaagggcagccauu

SEQ ID NO: 508429 - RNA, 19 nt, Homo sapiens
gccagggucuucaugaaca

SEQ ID NO: 508430 - RNA, 19 nt, Homo sapiens
guuagaagaaaucaggaua

SEQ ID NO: 508431 - RNA, 19 nt, Homo sapiens
gaacuggacuucucccauu

SEQ ID NO: 508432 - RNA, 19 nt, Homo sapiens
gaaauaaguugaugacucu

SEQ ID NO: 508433 - RNA, 19 nt, Homo sapiens
gcaaguggaucauugacaa

SEQ ID NO: 508434 - RNA, 19 nt, Homo sapiens
gaucugagcacuuuauauu

SEQ ID NO: 508435 - RNA, 19 nt, Homo sapiens
caaaggagaccuauaguga

SEQ ID NO: 508436 - RNA, 19 nt, Homo sapiens
ggacaaugccacauacuuu

SEQ ID NO: 508437 - RNA, 19 nt, Homo sapiens
caacuugacucauuucaca

SEQ ID NO: 508438 - RNA, 19 nt, Homo sapiens
gcaacaacaaucucaauuu

SEQ ID NO: 508439 - RNA, 19 nt, Homo sapiens
ggagcaacuugacucauuu

SEQ ID NO: 508440 - RNA, 19 nt, Homo sapiens
caucugauccuucauauga

SEQ ID NO: 508441 - RNA, 19 nt, Homo sapiens
ggaaugcaauaacuacguu

SEQ ID NO: 508442 - RNA, 19 nt, Homo sapiens
gggcagucuugaacauuua

SEQ ID NO: 508443 - RNA, 19 nt, Homo sapiens
ccaauggaauuaacacaau

SEQ ID NO: 508444 - RNA, 19 nt, Homo sapiens
gaacugcgagauacugauu

SEQ ID NO: 508445 - RNA, 19 nt, Homo sapiens
gauugaugcuucagaucua

SEQ ID NO: 508446 - RNA, 19 nt, Homo sapiens
uaagucaucugauccuuca

SEQ ID NO: 508447 - RNA, 19 nt, Homo sapiens
ccaagacacuggaaauuuu

SEQ ID NO: 508448 - RNA, 19 nt, Homo sapiens
ucacuuacagaaagaguua

SEQ ID NO: 508449 - RNA, 19 nt, Homo sapiens
uuugaugacuguacccuua

SEQ ID NO: 508450 - RNA, 19 nt, Homo sapiens
auacugauuuggacacuuu

SEQ ID NO: 508451 - RNA, 19 nt, Homo sapiens
guccuagguucccauauuu

SEQ ID NO: 508452 - RNA, 19 nt, Homo sapiens
gaaaagagccacaaaacug

SEQ ID NO: 508453 - RNA, 19 nt, Homo sapiens
uugaggaacuugagauuga

SEQ ID NO: 508454 - RNA, 19 nt, Homo sapiens
ucacugcuuucaacuggua

SEQ ID NO: 508455 - RNA, 19 nt, Homo sapiens
cuucagaucuacagagcua

SEQ ID NO: 508456 - RNA, 19 nt, Homo sapiens
ggaaagcucccagcaggaa

SEQ ID NO: 508457 - RNA, 19 nt, Homo sapiens
caaguugugucuucauaag

SEQ ID NO: 508458 - RNA, 19 nt, Homo sapiens
cagguaaaguggaaacguu

SEQ ID NO: 508459 - RNA, 19 nt, Homo sapiens
gaaaaucaccgaugaaagu

SEQ ID NO: 508460 - RNA, 19 nt, Homo sapiens
gcaagcaggauccaaagga

SEQ ID NO: 508461 - RNA, 19 nt, Homo sapiens
ucugagcacuuuauauuca

SEQ ID NO: 508462 - RNA, 19 nt, Homo sapiens
uuuaugaucugagcacuuu

SEQ ID NO: 508463 - RNA, 19 nt, Homo sapiens
ggaagaauccuccaaucag

SEQ ID NO: 508464 - RNA, 19 nt, Homo sapiens
gcacuggugucuggcaugu

SEQ ID NO: 508465 - RNA, 19 nt, Homo sapiens
gaccagucuuugucuaguu

SEQ ID NO: 508466 - RNA, 19 nt, Homo sapiens
ggcccucucuacaaacuuu

SEQ ID NO: 508467 - RNA, 19 nt, Homo sapiens
ggaaauauggacaccuuca

SEQ ID NO: 508468 - RNA, 19 nt, Homo sapiens
guugaugacucuaccagau

SEQ ID NO: 508469 - RNA, 19 nt, Homo sapiens
aaucaccgaugaaaguuug

SEQ ID NO: 508470 - RNA, 19 nt, Homo sapiens
gaacuauccacuggugaaa

SEQ ID NO: 508471 - RNA, 19 nt, Homo sapiens
aacaggaucaccuacauua

SEQ ID NO: 508472 - RNA, 19 nt, Homo sapiens
aggagcaacuugacucauu

SEQ ID NO: 508473 - RNA, 19 nt, Homo sapiens
gacaaugccacauacuuug

SEQ ID NO: 508474 - RNA, 19 nt, Homo sapiens
ccagaugccucccucuuac

SEQ ID NO: 508475 - RNA, 19 nt, Homo sapiens
ugacuaacauugauaucag

SEQ ID NO: 508476 - RNA, 19 nt, Homo sapiens
aggcuucucugucuuguga

SEQ ID NO: 508477 - RNA, 19 nt, Homo sapiens
caaucaggcuucucugucu

SEQ ID NO: 508478 - RNA, 19 nt, Homo sapiens
gccagcagguucaggaugu

SEQ ID NO: 508479 - RNA, 19 nt, Homo sapiens
gcaaauuaccugugugacu

SEQ ID NO: 508480 - RNA, 19 nt, Homo sapiens
aguuauagauccagguaaa

SEQ ID NO: 508481 - RNA, 19 nt, Homo sapiens
caacaggaucaccuacauu

SEQ ID NO: 508482 - RNA, 19 nt, Homo sapiens
gccuugaccuguccaacaa

SEQ ID NO: 508483 - RNA, 19 nt, Homo sapiens
aguccuagguucccauauu

SEQ ID NO: 508484 - RNA, 19 nt, Homo sapiens
cauggccugugguauauga

SEQ ID NO: 508485 - RNA, 19 nt, Homo sapiens
gguugaagaauacuugaaa

SEQ ID NO: 508486 - RNA, 19 nt, Homo sapiens
ugagauugaugcuucagau

SEQ ID NO: 508487 - RNA, 19 nt, Homo sapiens
auacuuggaucucagugaa

SEQ ID NO: 508488 - RNA, 19 nt, Homo sapiens
ugacagaguuauagaucca

SEQ ID NO: 508489 - RNA, 19 nt, Homo sapiens
uaaugaacaccaagaccua

SEQ ID NO: 508490 - RNA, 19 nt, Homo sapiens
gccagcaaauuaccugugu

SEQ ID NO: 508491 - RNA, 19 nt, Homo sapiens
uuacccauguuacuaguau

SEQ ID NO: 508492 - RNA, 19 nt, Homo sapiens
ggacaccuucacuaagauu

SEQ ID NO: 508493 - RNA, 19 nt, Homo sapiens
acugggaaauccuuacaaa

SEQ ID NO: 508494 - RNA, 19 nt, Homo sapiens
ugggcagucuugaacauuu

SEQ ID NO: 508495 - RNA, 19 nt, Homo sapiens
cagcaaauuaccuguguga

SEQ ID NO: 508496 - RNA, 19 nt, Homo sapiens
ccuagguucccauauuuaa

SEQ ID NO: 508497 - RNA, 19 nt, Homo sapiens
ggaagcugguggcaauaac

SEQ ID NO: 508498 - RNA, 19 nt, Homo sapiens
uaacuacguuuucuaagga

SEQ ID NO: 508499 - RNA, 19 nt, Homo sapiens
gauccaaaggagaccuaua

SEQ ID NO: 508500 - RNA, 19 nt, Homo sapiens
gccuggcccucucuacaaa

SEQ ID NO: 508501 - RNA, 19 nt, Homo sapiens
gguaaaguggaaacguuaa

SEQ ID NO: 508502 - RNA, 19 nt, Homo sapiens
gaauuagaguuugaugacu

SEQ ID NO: 508503 - RNA, 19 nt, Homo sapiens
ugggaaauauggacaccuu

SEQ ID NO: 508504 - RNA, 19 nt, Homo sapiens
gcagcaagcacuggccaaa

SEQ ID NO: 508505 - RNA, 19 nt, Homo sapiens
ccauguuacuaguauugaa

SEQ ID NO: 508506 - RNA, 19 nt, Homo sapiens
guggaaacguuaacaaucc

SEQ ID NO: 508507 - RNA, 19 nt, Homo sapiens
ccaaaggagaccuauagug

SEQ ID NO: 508508 - RNA, 19 nt, Homo sapiens
gaacuugagauugaugcuu

SEQ ID NO: 508509 - RNA, 19 nt, Homo sapiens
ucaagccccuuucuucuuu

SEQ ID NO: 508510 - RNA, 19 nt, Homo sapiens
caugugcugugcucuguuc

SEQ ID NO: 508511 - RNA, 19 nt, Homo sapiens
cccaagacacuggaaauuu

SEQ ID NO: 508512 - RNA, 19 nt, Homo sapiens
cauuuggcaucauuggaaa

SEQ ID NO: 508513 - RNA, 19 nt, Homo sapiens
gaugguugaagaauacuug

SEQ ID NO: 508514 - RNA, 19 nt, Homo sapiens
auggacaccuucacuaaga

SEQ ID NO: 508515 - RNA, 19 nt, Homo sapiens
gcucuuagugaccaaguga

SEQ ID NO: 508516 - RNA, 19 nt, Homo sapiens
uaucauugacuccauugaa

SEQ ID NO: 508517 - RNA, 19 nt, Homo sapiens
ccuggcaaguggaucauug

SEQ ID NO: 508518 - RNA, 19 nt, Homo sapiens
acaacaggaucaccuacau

SEQ ID NO: 508519 - RNA, 19 nt, Homo sapiens
ucaaguugugucuucauaa

SEQ ID NO: 508520 - RNA, 19 nt, Homo sapiens
gcuaugaugcauuuguuuc

SEQ ID NO: 508521 - RNA, 19 nt, Homo sapiens
uuagagcaucugauaauga

SEQ ID NO: 508522 - RNA, 19 nt, Homo sapiens
ccaacaacaggaucaccua

SEQ ID NO: 508523 - RNA, 19 nt, Homo sapiens
uucaaguugugucuucaua

SEQ ID NO: 508524 - RNA, 19 nt, Homo sapiens
uuuggaagcugguggcaau

SEQ ID NO: 508525 - RNA, 19 nt, Homo sapiens
ggccagaaaagaugaaaua

SEQ ID NO: 508526 - RNA, 19 nt, Homo sapiens
uagagcaucugauaaugac

SEQ ID NO: 508527 - RNA, 19 nt, Homo sapiens
aucauugacuccauugaaa

SEQ ID NO: 508528 - RNA, 19 nt, Homo sapiens
gacuaacauugauaucagu

SEQ ID NO: 508529 - RNA, 19 nt, Homo sapiens
gugaaaauuugaugguuga

SEQ ID NO: 508530 - RNA, 19 nt, Homo sapiens
uuagaauacuuggaucuca

SEQ ID NO: 508531 - RNA, 19 nt, Homo sapiens
gaagcuauguuuggaauua

SEQ ID NO: 508532 - RNA, 19 nt, Homo sapiens
gaucaucgauuuaggauug

SEQ ID NO: 508533 - RNA, 19 nt, Homo sapiens
caacauaaaugaugacaug

SEQ ID NO: 508534 - RNA, 19 nt, Homo sapiens
gaagaggaauguuuaaauc

SEQ ID NO: 508535 - RNA, 19 nt, Homo sapiens
gaacuagaagcaauuguua

SEQ ID NO: 508536 - RNA, 19 nt, Homo sapiens
caacauagccaacauaaau

SEQ ID NO: 508537 - RNA, 19 nt, Homo sapiens
ccagaaacuucccauguua

SEQ ID NO: 508538 - RNA, 19 nt, Homo sapiens
cagcaucugucuuuaauaa

SEQ ID NO: 508539 - RNA, 19 nt, Homo sapiens
ggacuaaaguggacaaauc

SEQ ID NO: 508540 - RNA, 19 nt, Homo sapiens
cauaauggcuugucaucua

SEQ ID NO: 508541 - RNA, 19 nt, Homo sapiens
agaccaaucucucaaauuu

SEQ ID NO: 508542 - RNA, 19 nt, Homo sapiens
cauuagaucugucucauaa

SEQ ID NO: 508543 - RNA, 19 nt, Homo sapiens
uaacauccguugagaagaa

SEQ ID NO: 508544 - RNA, 19 nt, Homo sapiens
ggacaaaucucacuaugcu

SEQ ID NO: 508545 - RNA, 19 nt, Homo sapiens
gcagaagaauuuaaucaca

SEQ ID NO: 508546 - RNA, 19 nt, Homo sapiens
gaaaaugugucuccuuauu

SEQ ID NO: 508547 - RNA, 19 nt, Homo sapiens
gaagaccaaucucucaaau

SEQ ID NO: 508548 - RNA, 19 nt, Homo sapiens
agacagaacaguuugaaua

SEQ ID NO: 508549 - RNA, 19 nt, Homo sapiens
gaacuaaagaucaucgauu

SEQ ID NO: 508550 - RNA, 19 nt, Homo sapiens
ucacgcaauuggaagauua

SEQ ID NO: 508551 - RNA, 19 nt, Homo sapiens
uugaggagauuccagauua

SEQ ID NO: 508552 - RNA, 19 nt, Homo sapiens
caagguacaucaugcaguu

SEQ ID NO: 508553 - RNA, 19 nt, Homo sapiens
ugagguaccugaauuugaa

SEQ ID NO: 508554 - RNA, 19 nt, Homo sapiens
gagcuucuauuaucaaaca

SEQ ID NO: 508555 - RNA, 19 nt, Homo sapiens
uuacaucucuucuaggaaa

SEQ ID NO: 508556 - RNA, 19 nt, Homo sapiens
cauaaaugaugacauguug

SEQ ID NO: 508557 - RNA, 19 nt, Homo sapiens
gcaauuggaagauuauuug

SEQ ID NO: 508558 - RNA, 19 nt, Homo sapiens
uagcuuggauguaggauuu

SEQ ID NO: 508559 - RNA, 19 nt, Homo sapiens
aguauugccugguuuguua

SEQ ID NO: 508560 - RNA, 19 nt, Homo sapiens
agaagaaucucauaacauc

SEQ ID NO: 508561 - RNA, 19 nt, Homo sapiens
caacaucccugagcuguca

SEQ ID NO: 508562 - RNA, 19 nt, Homo sapiens
gaaccugacugaguuagau

SEQ ID NO: 508563 - RNA, 19 nt, Homo sapiens
gcaauauguucacaggauu

SEQ ID NO: 508564 - RNA, 19 nt, Homo sapiens
gagaagcuauguuuggaau

SEQ ID NO: 508565 - RNA, 19 nt, Homo sapiens
agacagacuuugccuugua

SEQ ID NO: 508566 - RNA, 19 nt, Homo sapiens
gaucuacccacaaacauaa

SEQ ID NO: 508567 - RNA, 19 nt, Homo sapiens
acacuucccugaugaaaug

SEQ ID NO: 508568 - RNA, 19 nt, Homo sapiens
gaauggagaggucuagaaa

SEQ ID NO: 508569 - RNA, 19 nt, Homo sapiens
gccagaaacuucccauguu

SEQ ID NO: 508570 - RNA, 19 nt, Homo sapiens
gcaucugucuuuaauaauc

SEQ ID NO: 508571 - RNA, 19 nt, Homo sapiens
gaauuugacugaacuccau

SEQ ID NO: 508572 - RNA, 19 nt, Homo sapiens
ccacacacuucccugauga

SEQ ID NO: 508573 - RNA, 19 nt, Homo sapiens
acaauuacaucucuucuag

SEQ ID NO: 508574 - RNA, 19 nt, Homo sapiens
cgucauaaauugcaaguag

SEQ ID NO: 508575 - RNA, 19 nt, Homo sapiens
gaccugggccuuaaugaaa

SEQ ID NO: 508576 - RNA, 19 nt, Homo sapiens
uuacagagaagcuauguuu

SEQ ID NO: 508577 - RNA, 19 nt, Homo sapiens
ucaaagaaauagacagaca

SEQ ID NO: 508578 - RNA, 19 nt, Homo sapiens
caacaacauagccaacaua

SEQ ID NO: 508579 - RNA, 19 nt, Homo sapiens
ccaagagcuucuauuauca

SEQ ID NO: 508580 - RNA, 19 nt, Homo sapiens
gaggaauguuuaaaucuca

SEQ ID NO: 508581 - RNA, 19 nt, Homo sapiens
ggagauuccagauuauaaa

SEQ ID NO: 508582 - RNA, 19 nt, Homo sapiens
ggagaggucuagaaaauau

SEQ ID NO: 508583 - RNA, 19 nt, Homo sapiens
cggaaucugucucugagua

SEQ ID NO: 508584 - RNA, 19 nt, Homo sapiens
uccaagagcuucuauuauc

SEQ ID NO: 508585 - RNA, 19 nt, Homo sapiens
gaaaguauugccugguuug

SEQ ID NO: 508586 - RNA, 19 nt, Homo sapiens
ucagaagaaucucauaaca

SEQ ID NO: 508587 - RNA, 19 nt, Homo sapiens
ggauaucuuugccaauuca

SEQ ID NO: 508588 - RNA, 19 nt, Homo sapiens
gcacgaauuugacugaacu

SEQ ID NO: 508589 - RNA, 19 nt, Homo sapiens
ccgaugaucuacccacaaa

SEQ ID NO: 508590 - RNA, 19 nt, Homo sapiens
gggaacauuucucuucaau

SEQ ID NO: 508591 - RNA, 19 nt, Homo sapiens
ucaggugucucuaaaguca

SEQ ID NO: 508592 - RNA, 19 nt, Homo sapiens
ggucuucaaggauuuauuu

SEQ ID NO: 508593 - RNA, 19 nt, Homo sapiens
uguugaaccuuacccauaa

SEQ ID NO: 508594 - RNA, 19 nt, Homo sapiens
ggaagaccaaucucucaaa

SEQ ID NO: 508595 - RNA, 19 nt, Homo sapiens
guacaucgaguucuugguu

SEQ ID NO: 508596 - RNA, 19 nt, Homo sapiens
gugaaaguauugccugguu

SEQ ID NO: 508597 - RNA, 19 nt, Homo sapiens
guacuugaccugggccuua

SEQ ID NO: 508598 - RNA, 19 nt, Homo sapiens
ucacuaugcucgaucuuuc

SEQ ID NO: 508599 - RNA, 19 nt, Homo sapiens
uuagaucugucucauaaug

SEQ ID NO: 508600 - RNA, 19 nt, Homo sapiens
ugacucagguacccgauga

SEQ ID NO: 508601 - RNA, 19 nt, Homo sapiens
gacagaacaguuugaauau

SEQ ID NO: 508602 - RNA, 19 nt, Homo sapiens
gaggagauuccagauuaua

SEQ ID NO: 508603 - RNA, 19 nt, Homo sapiens
gaucuaagcaacaacaaca

SEQ ID NO: 508604 - RNA, 19 nt, Homo sapiens
cuucguaacuugaccauuc

SEQ ID NO: 508605 - RNA, 19 nt, Homo sapiens
cuaacuagcuuggauguag

SEQ ID NO: 508606 - RNA, 19 nt, Homo sapiens
cagaacaguuugaauaugc

SEQ ID NO: 508607 - RNA, 19 nt, Homo sapiens
auaaucaggugucucuaaa

SEQ ID NO: 508608 - RNA, 19 nt, Homo sapiens
guuggagggucuugagaaa

SEQ ID NO: 508609 - RNA, 19 nt, Homo sapiens
ggaauggagaggucuagaa

SEQ ID NO: 508610 - RNA, 19 nt, Homo sapiens
gauuuaacaccaucucaaa

SEQ ID NO: 508611 - RNA, 19 nt, Homo sapiens
gaaccaugcacucuguuug

SEQ ID NO: 508612 - RNA, 19 nt, Homo sapiens
ugaaaguauugccugguuu

SEQ ID NO: 508613 - RNA, 19 nt, Homo sapiens
gauugcacgugugaaagua

SEQ ID NO: 508614 - RNA, 19 nt, Homo sapiens
ugaguuagauaugcgcuuu

SEQ ID NO: 508615 - RNA, 19 nt, Homo sapiens
aaauagagagugaugcuuu

SEQ ID NO: 508616 - RNA, 19 nt, Homo sapiens
cagagaagcuauguuugga

SEQ ID NO: 508617 - RNA, 19 nt, Homo sapiens
ucuccaagagcuucuauua

SEQ ID NO: 508618 - RNA, 19 nt, Homo sapiens
ugacugaacuccaucucau

SEQ ID NO: 508619 - RNA, 19 nt, Homo sapiens
cgaagaggaauguuuaaau

SEQ ID NO: 508620 - RNA, 19 nt, Homo sapiens
cgagagugccgucuauuug

SEQ ID NO: 508621 - RNA, 19 nt, Homo sapiens
gacagacuuugccuuguau

SEQ ID NO: 508622 - RNA, 19 nt, Homo sapiens
gaaccuuacccauaaucaa

SEQ ID NO: 508623 - RNA, 19 nt, Homo sapiens
gaaauugggcaagaacuca

SEQ ID NO: 508624 - RNA, 19 nt, Homo sapiens
caaccuaaccaagaauaaa

SEQ ID NO: 508625 - RNA, 19 nt, Homo sapiens
ggaaucugucucugaguaa

SEQ ID NO: 508626 - RNA, 19 nt, Homo sapiens
gauugggucugggaacauu

SEQ ID NO: 508627 - RNA, 19 nt, Homo sapiens
guacuucucauccacuuug

SEQ ID NO: 508628 - RNA, 19 nt, Homo sapiens
uagccaacauaaaugauga

SEQ ID NO: 508629 - RNA, 19 nt, Homo sapiens
ucagguacccgaugaucua

SEQ ID NO: 508630 - RNA, 19 nt, Homo sapiens
aaugugagguaccugaauu

SEQ ID NO: 508631 - RNA, 19 nt, Homo sapiens
gaaaugaguugcagcagaa

SEQ ID NO: 508632 - RNA, 19 nt, Homo sapiens
cagaagagcuggcaugaaa

SEQ ID NO: 508633 - RNA, 19 nt, Homo sapiens
gcauggagcugaauuucua

SEQ ID NO: 508634 - RNA, 19 nt, Homo sapiens
gaaagcagcauugaaauaa

SEQ ID NO: 508635 - RNA, 19 nt, Homo sapiens
gggaauaaaugcuagacua

SEQ ID NO: 508636 - RNA, 19 nt, Homo sapiens
ucacagagcugagaaacuu

SEQ ID NO: 508637 - RNA, 19 nt, Homo sapiens
ucacggaggugguuccuaa

SEQ ID NO: 508638 - RNA, 19 nt, Homo sapiens
uagcaguucuggucuauaa

SEQ ID NO: 508639 - RNA, 19 nt, Homo sapiens
gagcuucaaugguguuauu

SEQ ID NO: 508640 - RNA, 19 nt, Homo sapiens
uuacagagguuaaagucua

SEQ ID NO: 508641 - RNA, 19 nt, Homo sapiens
gaagcaacaucuaucugaa

SEQ ID NO: 508642 - RNA, 19 nt, Homo sapiens
ugacaaaucugcucuagag

SEQ ID NO: 508643 - RNA, 19 nt, Homo sapiens
ggaggugguuccuaauauu

SEQ ID NO: 508644 - RNA, 19 nt, Homo sapiens
gcucagaccuggcaguuuc

SEQ ID NO: 508645 - RNA, 19 nt, Homo sapiens
ccaugaagguuuccauaaa

SEQ ID NO: 508646 - RNA, 19 nt, Homo sapiens
ccaaaguuauugccuacua

SEQ ID NO: 508647 - RNA, 19 nt, Homo sapiens
gcccagaacugcuuugaau

SEQ ID NO: 508648 - RNA, 19 nt, Homo sapiens
ggaauaaaugcuagacuaa

SEQ ID NO: 508649 - RNA, 19 nt, Homo sapiens
gcugguguaucuuugaaua

SEQ ID NO: 508650 - RNA, 19 nt, Homo sapiens
guaauuccauggugcacua

SEQ ID NO: 508651 - RNA, 19 nt, Homo sapiens
gguaaggaaugagcuagua

SEQ ID NO: 508652 - RNA, 19 nt, Homo sapiens
cagaaugacuuugcuugua

SEQ ID NO: 508653 - RNA, 19 nt, Homo sapiens
gaaaauggcuggcaauucu

SEQ ID NO: 508654 - RNA, 19 nt, Homo sapiens
caaaguuauugccuacuaa

SEQ ID NO: 508655 - RNA, 19 nt, Homo sapiens
ggagcugaauuucuacaaa

SEQ ID NO: 508656 - RNA, 19 nt, Homo sapiens
ggaagcaacaucuaucuga

SEQ ID NO: 508657 - RNA, 19 nt, Homo sapiens
gaauaucaccugucagaug

SEQ ID NO: 508658 - RNA, 19 nt, Homo sapiens
aaagguugcuguucucaaa

SEQ ID NO: 508659 - RNA, 19 nt, Homo sapiens
ccaaccaggugcauuuaaa

SEQ ID NO: 508660 - RNA, 19 nt, Homo sapiens
gugcugaguuugaauauca

SEQ ID NO: 508661 - RNA, 19 nt, Homo sapiens
gcuauagcuucuucaguuu

SEQ ID NO: 508662 - RNA, 19 nt, Homo sapiens
gaaaccugauuaacacaug

SEQ ID NO: 508663 - RNA, 19 nt, Homo sapiens
gaugguaaaucauggaauc

SEQ ID NO: 508664 - RNA, 19 nt, Homo sapiens
guagaaauggcuugaguuu

SEQ ID NO: 508665 - RNA, 19 nt, Homo sapiens
ggagacaaaucuagcaucu

SEQ ID NO: 508666 - RNA, 19 nt, Homo sapiens
caugaaagcagcauugaaa

SEQ ID NO: 508667 - RNA, 19 nt, Homo sapiens
ucaaggaacccaugacaaa

SEQ ID NO: 508668 - RNA, 19 nt, Homo sapiens
ccaggugcauuuaaagaaa

SEQ ID NO: 508669 - RNA, 19 nt, Homo sapiens
gaggugguuccuaauauua

SEQ ID NO: 508670 - RNA, 19 nt, Homo sapiens
agaaacauaugggcugaua

SEQ ID NO: 508671 - RNA, 19 nt, Homo sapiens
ugaaagcagcauugaaaua

SEQ ID NO: 508672 - RNA, 19 nt, Homo sapiens
uggauacguuuccuuauaa

SEQ ID NO: 508673 - RNA, 19 nt, Homo sapiens
ucauuuaccuugacauuuc

SEQ ID NO: 508674 - RNA, 19 nt, Homo sapiens
cgaugucauuccaaaguua

SEQ ID NO: 508675 - RNA, 19 nt, Homo sapiens
gcagagggaauaaaugcua

SEQ ID NO: 508676 - RNA, 19 nt, Homo sapiens
gugcaacaccuucagauaa

SEQ ID NO: 508677 - RNA, 19 nt, Homo sapiens
uaaggaaaccugauuaaca

SEQ ID NO: 508678 - RNA, 19 nt, Homo sapiens
acucuuaccucaucaaguu

SEQ ID NO: 508679 - RNA, 19 nt, Homo sapiens
aauaucaccugucagauga

SEQ ID NO: 508680 - RNA, 19 nt, Homo sapiens
aaacauaugggcugauaaa

SEQ ID NO: 508681 - RNA, 19 nt, Homo sapiens
gaaacucaaaucucucaaa

SEQ ID NO: 508682 - RNA, 19 nt, Homo sapiens
uagcauacuuagacuacua

SEQ ID NO: 508683 - RNA, 19 nt, Homo sapiens
caaguugaauaaagacaga

SEQ ID NO: 508684 - RNA, 19 nt, Homo sapiens
gaugaggacuggguaagga

SEQ ID NO: 508685 - RNA, 19 nt, Homo sapiens
agacaaaucuagcaucucu

SEQ ID NO: 508686 - RNA, 19 nt, Homo sapiens
gguggaaguugaacgaaug

SEQ ID NO: 508687 - RNA, 19 nt, Homo sapiens
caaguagucuagcuuucuu

SEQ ID NO: 508688 - RNA, 19 nt, Homo sapiens
uuggauacguuuccuuaua

SEQ ID NO: 508689 - RNA, 19 nt, Homo sapiens
uagagggccugugcaauuu

SEQ ID NO: 508690 - RNA, 19 nt, Homo sapiens
guuuagaaguccaucguuu

SEQ ID NO: 508691 - RNA, 19 nt, Homo sapiens
gaaaccucauuuaccuuga

SEQ ID NO: 508692 - RNA, 19 nt, Homo sapiens
gggcuuagaacaacuagaa

SEQ ID NO: 508693 - RNA, 19 nt, Homo sapiens
ggugugaaauccagacaau

SEQ ID NO: 508694 - RNA, 19 nt, Homo sapiens
gcaugccugugcugaguuu

SEQ ID NO: 508695 - RNA, 19 nt, Homo sapiens
ugacuuugcuuguacuugu

SEQ ID NO: 508696 - RNA, 19 nt, Homo sapiens
aacaggaacuacagcauuu

SEQ ID NO: 508697 - RNA, 19 nt, Homo sapiens
caccagaguugcuuucaau

SEQ ID NO: 508698 - RNA, 19 nt, Homo sapiens
gccgaaaggugauuguugu

SEQ ID NO: 508699 - RNA, 19 nt, Homo sapiens
ugaaacaaaugagugaguu

SEQ ID NO: 508700 - RNA, 19 nt, Homo sapiens
cauugaagaauuccgauua

SEQ ID NO: 508701 - RNA, 19 nt, Homo sapiens
gaaaugaaggaaacuugga

SEQ ID NO: 508702 - RNA, 19 nt, Homo sapiens
caacaaaggugggaaugcu

SEQ ID NO: 508703 - RNA, 19 nt, Homo sapiens
gauggcaacauuuagaauu

SEQ ID NO: 508704 - RNA, 19 nt, Homo sapiens
ccuacucaaucucucuuua

SEQ ID NO: 508705 - RNA, 19 nt, Homo sapiens
cgucuugccuauaagcuaa

SEQ ID NO: 508706 - RNA, 19 nt, Homo sapiens
uguaguaucuguuguagca

SEQ ID NO: 508707 - RNA, 19 nt, Homo sapiens
caacagcauuuaacucacu

SEQ ID NO: 508708 - RNA, 19 nt, Homo sapiens
gaaaacuuccuuccagaua

SEQ ID NO: 508709 - RNA, 19 nt, Homo sapiens
ucagaaaccucauuuaccu

SEQ ID NO: 508710 - RNA, 19 nt, Homo sapiens
gaacgaauggaaugugcaa

SEQ ID NO: 508711 - RNA, 19 nt, Homo sapiens
ucaauggcaucuucaaugg

SEQ ID NO: 508712 - RNA, 19 nt, Homo sapiens
cuagagggccugugcaauu

SEQ ID NO: 508713 - RNA, 19 nt, Homo sapiens
cuagagcacuuggaccuuu

SEQ ID NO: 508714 - RNA, 19 nt, Homo sapiens
gaacugcaggugcuggauu

SEQ ID NO: 508715 - RNA, 19 nt, Homo sapiens
gaaccuggaccugagcuuu

SEQ ID NO: 508716 - RNA, 19 nt, Homo sapiens
gcugguaucaucuucauug

SEQ ID NO: 508717 - RNA, 19 nt, Homo sapiens
ucaccugucagaugaauaa

SEQ ID NO: 508718 - RNA, 19 nt, Homo sapiens
gaaguugaacgaauggaau

SEQ ID NO: 508719 - RNA, 19 nt, Homo sapiens
ucaaucacauaaugacuuc

SEQ ID NO: 508720 - RNA, 19 nt, Homo sapiens
gaagaauuccgauuagcau

SEQ ID NO: 508721 - RNA, 19 nt, Homo sapiens
gcaugaaacccagagcuuu

SEQ ID NO: 508722 - RNA, 19 nt, Homo sapiens
cuucauaagcugacuuuaa

SEQ ID NO: 508723 - RNA, 19 nt, Homo sapiens
gagcugaauuucuacaaaa

SEQ ID NO: 508724 - RNA, 19 nt, Homo sapiens
gguguaucuuugaauauga

SEQ ID NO: 508725 - RNA, 19 nt, Homo sapiens
gagggccugugcaauuuga

SEQ ID NO: 508726 - RNA, 19 nt, Homo sapiens
uaagacgugcuucaaauau

SEQ ID NO: 508727 - RNA, 19 nt, Homo sapiens
ggccauugcugccaacauc

SEQ ID NO: 508728 - RNA, 19 nt, Homo sapiens
aaacaggaacuacagcauu

SEQ ID NO: 508729 - RNA, 19 nt, Homo sapiens
ggacaguuucccacauuga

SEQ ID NO: 508730 - RNA, 19 nt, Homo sapiens
agaaguccaucguuugguu

SEQ ID NO: 508731 - RNA, 19 nt, Homo sapiens
gaaaugaguugcagcagaa

SEQ ID NO: 508732 - RNA, 19 nt, Homo sapiens
gcauggagcugaauuucua

SEQ ID NO: 508733 - RNA, 19 nt, Homo sapiens
gaaagcagcauugaaauaa

SEQ ID NO: 508734 - RNA, 19 nt, Homo sapiens
gggaauaaaugcuagacua

SEQ ID NO: 508735 - RNA, 19 nt, Homo sapiens
ucacagagcugagaaacuu

SEQ ID NO: 508736 - RNA, 19 nt, Homo sapiens
uagcaguucuggucuauaa

SEQ ID NO: 508737 - RNA, 19 nt, Homo sapiens
gagcuucaaugguguuauu

SEQ ID NO: 508738 - RNA, 19 nt, Homo sapiens
uuacagagguuaaagucua

SEQ ID NO: 508739 - RNA, 19 nt, Homo sapiens
gaagcaacaucuaucugaa

SEQ ID NO: 508740 - RNA, 19 nt, Homo sapiens
ugacaaaucugcucuagag

SEQ ID NO: 508741 - RNA, 19 nt, Homo sapiens
ggaggugguuccuaauauu

SEQ ID NO: 508742 - RNA, 19 nt, Homo sapiens
gcucagaccuggcaguuuc

SEQ ID NO: 508743 - RNA, 19 nt, Homo sapiens
ccaugaagguuuccauaaa

SEQ ID NO: 508744 - RNA, 19 nt, Homo sapiens
ccaaaguuauugccuacua

SEQ ID NO: 508745 - RNA, 19 nt, Homo sapiens
ggaauaaaugcuagacuaa

SEQ ID NO: 508746 - RNA, 19 nt, Homo sapiens
gcugguguaucuuugaaua

SEQ ID NO: 508747 - RNA, 19 nt, Homo sapiens
gcccagaacugcuuugaau

SEQ ID NO: 508748 - RNA, 19 nt, Homo sapiens
guaauuccauggugcacua

SEQ ID NO: 508749 - RNA, 19 nt, Homo sapiens
gguaaggaaugagcuagua

SEQ ID NO: 508750 - RNA, 19 nt, Homo sapiens
cagaaugacuuugcuugua

SEQ ID NO: 508751 - RNA, 19 nt, Homo sapiens
gaaaauggcuggcaauucu

SEQ ID NO: 508752 - RNA, 19 nt, Homo sapiens
caaaguuauugccuacuaa

SEQ ID NO: 508753 - RNA, 19 nt, Homo sapiens
ggagcugaauuucuacaaa

SEQ ID NO: 508754 - RNA, 19 nt, Homo sapiens
ggaagcaacaucuaucuga

SEQ ID NO: 508755 - RNA, 19 nt, Homo sapiens
gaauaucaccugucagaug

SEQ ID NO: 508756 - RNA, 19 nt, Homo sapiens
aaagguugcuguucucaaa

SEQ ID NO: 508757 - RNA, 19 nt, Homo sapiens
ccaaccaggugcauuuaaa

SEQ ID NO: 508758 - RNA, 19 nt, Homo sapiens
gugcugaguuugaauauca

SEQ ID NO: 508759 - RNA, 19 nt, Homo sapiens
gcuauagcuucuucaguuu

SEQ ID NO: 508760 - RNA, 19 nt, Homo sapiens
gaaaccugauuaacacaug

SEQ ID NO: 508761 - RNA, 19 nt, Homo sapiens
gaugguaaaucauggaauc

SEQ ID NO: 508762 - RNA, 19 nt, Homo sapiens
guagaaauggcuugaguuu

SEQ ID NO: 508763 - RNA, 19 nt, Homo sapiens
ggagacaaaucuagcaucu

SEQ ID NO: 508764 - RNA, 19 nt, Homo sapiens
caugaaagcagcauugaaa

SEQ ID NO: 508765 - RNA, 19 nt, Homo sapiens
ucaaggaacccaugacaaa

SEQ ID NO: 508766 - RNA, 19 nt, Homo sapiens
ccaggugcauuuaaagaaa

SEQ ID NO: 508767 - RNA, 19 nt, Homo sapiens
gaggugguuccuaauauua

SEQ ID NO: 508768 - RNA, 19 nt, Homo sapiens
agaaacauaugggcugaua

SEQ ID NO: 508769 - RNA, 19 nt, Homo sapiens
ugaaagcagcauugaaaua

SEQ ID NO: 508770 - RNA, 19 nt, Homo sapiens
uggauacguuuccuuauaa

SEQ ID NO: 508771 - RNA, 19 nt, Homo sapiens
ucauuuaccuugacauuuc

SEQ ID NO: 508772 - RNA, 19 nt, Homo sapiens
cgaugucauuccaaaguua

SEQ ID NO: 508773 - RNA, 19 nt, Homo sapiens
gcagagggaauaaaugcua

SEQ ID NO: 508774 - RNA, 19 nt, Homo sapiens
gugcaacaccuucagauaa

SEQ ID NO: 508775 - RNA, 19 nt, Homo sapiens
uaaggaaaccugauuaaca

SEQ ID NO: 508776 - RNA, 19 nt, Homo sapiens
acucuuaccucaucaaguu

SEQ ID NO: 508777 - RNA, 19 nt, Homo sapiens
aauaucaccugucagauga

SEQ ID NO: 508778 - RNA, 19 nt, Homo sapiens
aaacauaugggcugauaaa

SEQ ID NO: 508779 - RNA, 19 nt, Homo sapiens
gaaacucaaaucucucaaa

SEQ ID NO: 508780 - RNA, 19 nt, Homo sapiens
uagcauacuuagacuacua

SEQ ID NO: 508781 - RNA, 19 nt, Homo sapiens
caaguugaauaaagacaga

SEQ ID NO: 508782 - RNA, 19 nt, Homo sapiens
gaugaggacuggguaagga

SEQ ID NO: 508783 - RNA, 19 nt, Homo sapiens
agacaaaucuagcaucucu

SEQ ID NO: 508784 - RNA, 19 nt, Homo sapiens
gcguggaggugguuccuaa

SEQ ID NO: 508785 - RNA, 19 nt, Homo sapiens
gguggaaguugaacgaaug

SEQ ID NO: 508786 - RNA, 19 nt, Homo sapiens
caaguagucuagcuuucuu

SEQ ID NO: 508787 - RNA, 19 nt, Homo sapiens
uuggauacguuuccuuaua

SEQ ID NO: 508788 - RNA, 19 nt, Homo sapiens
uagagggccugugcaauuu

SEQ ID NO: 508789 - RNA, 19 nt, Homo sapiens
guuuagaaguccaucguuu

SEQ ID NO: 508790 - RNA, 19 nt, Homo sapiens
gaaaccucauuuaccuuga

SEQ ID NO: 508791 - RNA, 19 nt, Homo sapiens
gggcuuagaacaacuagaa

SEQ ID NO: 508792 - RNA, 19 nt, Homo sapiens
ggugugaaauccagacaau

SEQ ID NO: 508793 - RNA, 19 nt, Homo sapiens
gcaugccugugcugaguuu

SEQ ID NO: 508794 - RNA, 19 nt, Homo sapiens
ugacuuugcuuguacuugu

SEQ ID NO: 508795 - RNA, 19 nt, Homo sapiens
aacaggaacuacagcauuu

SEQ ID NO: 508796 - RNA, 19 nt, Homo sapiens
caccagaguugcuuucaau

SEQ ID NO: 508797 - RNA, 19 nt, Homo sapiens
gccgaaaggugauuguugu

SEQ ID NO: 508798 - RNA, 19 nt, Homo sapiens
ugaaacaaaugagugaguu

SEQ ID NO: 508799 - RNA, 19 nt, Homo sapiens
cauugaagaauuccgauua

SEQ ID NO: 508800 - RNA, 19 nt, Homo sapiens
gaaaugaaggaaacuugga

SEQ ID NO: 508801 - RNA, 19 nt, Homo sapiens
caacaaaggugggaaugcu

SEQ ID NO: 508802 - RNA, 19 nt, Homo sapiens
gauggcaacauuuagaauu

SEQ ID NO: 508803 - RNA, 19 nt, Homo sapiens
ccuacucaaucucucuuua

SEQ ID NO: 508804 - RNA, 19 nt, Homo sapiens
cgucuugccuauaagcuaa

SEQ ID NO: 508805 - RNA, 19 nt, Homo sapiens
uguaguaucuguuguagca

SEQ ID NO: 508806 - RNA, 19 nt, Homo sapiens
caacagcauuuaacucacu

SEQ ID NO: 508807 - RNA, 19 nt, Homo sapiens
gaaaacuuccuuccagaua

SEQ ID NO: 508808 - RNA, 19 nt, Homo sapiens
ucagaaaccucauuuaccu

SEQ ID NO: 508809 - RNA, 19 nt, Homo sapiens
gaacgaauggaaugugcaa

SEQ ID NO: 508810 - RNA, 19 nt, Homo sapiens
ucaauggcaucuucaaugg

SEQ ID NO: 508811 - RNA, 19 nt, Homo sapiens
cuagagggccugugcaauu

SEQ ID NO: 508812 - RNA, 19 nt, Homo sapiens
cuagagcacuuggaccuuu

SEQ ID NO: 508813 - RNA, 19 nt, Homo sapiens
gaacugcaggugcuggauu

SEQ ID NO: 508814 - RNA, 19 nt, Homo sapiens
gaaccuggaccugagcuuu

SEQ ID NO: 508815 - RNA, 19 nt, Homo sapiens
gcugguaucaucuucauug

SEQ ID NO: 508816 - RNA, 19 nt, Homo sapiens
ucaccugucagaugaauaa

SEQ ID NO: 508817 - RNA, 19 nt, Homo sapiens
gagcugaauuucuacaaaa

SEQ ID NO: 508818 - RNA, 19 nt, Homo sapiens
gaaguugaacgaauggaau

SEQ ID NO: 508819 - RNA, 19 nt, Homo sapiens
ucaaucacauaaugacuuc

SEQ ID NO: 508820 - RNA, 19 nt, Homo sapiens
gaagaauuccgauuagcau

SEQ ID NO: 508821 - RNA, 19 nt, Homo sapiens
cuucauaagcugacuuuaa

SEQ ID NO: 508822 - RNA, 19 nt, Homo sapiens
gguguaucuuugaauauga

SEQ ID NO: 508823 - RNA, 19 nt, Homo sapiens
gagggccugugcaauuuga

SEQ ID NO: 508824 - RNA, 19 nt, Homo sapiens
uaagacgugcuucaaauau

SEQ ID NO: 508825 - RNA, 19 nt, Homo sapiens
ggccauugcugccaacauc

SEQ ID NO: 508826 - RNA, 19 nt, Homo sapiens
aaacaggaacuacagcauu

SEQ ID NO: 508827 - RNA, 19 nt, Homo sapiens
ggacaguuucccacauuga

SEQ ID NO: 508828 - RNA, 19 nt, Homo sapiens
agaaguccaucguuugguu

SEQ ID NO: 508829 - RNA, 19 nt, Homo sapiens
ugaccaaucuagagcacuu

SEQ ID NO: 508830 - RNA, 19 nt, Homo sapiens
ugaauaagaccaucauugg

SEQ ID NO: 508831 - RNA, 19 nt, Homo sapiens
gaaaugaguugcagcagaa

SEQ ID NO: 508832 - RNA, 19 nt, Homo sapiens
cagaagagcuggcaugaaa

SEQ ID NO: 508833 - RNA, 19 nt, Homo sapiens
gaaagcagcauugaaauaa

SEQ ID NO: 508834 - RNA, 19 nt, Homo sapiens
gggaauaaaugcuagacua

SEQ ID NO: 508835 - RNA, 19 nt, Homo sapiens
ucacagagcugagaaacuu

SEQ ID NO: 508836 - RNA, 19 nt, Homo sapiens
uagcaguucuggucuauaa

SEQ ID NO: 508837 - RNA, 19 nt, Homo sapiens
gagcuucaaugguguuauu

SEQ ID NO: 508838 - RNA, 19 nt, Homo sapiens
uuacagagguuaaagucua

SEQ ID NO: 508839 - RNA, 19 nt, Homo sapiens
gaagcaacaucuaucugaa

SEQ ID NO: 508840 - RNA, 19 nt, Homo sapiens
ugacaaaucugcucuagag

SEQ ID NO: 508841 - RNA, 19 nt, Homo sapiens
gcucagaccuggcaguuuc

SEQ ID NO: 508842 - RNA, 19 nt, Homo sapiens
ccaugaagguuuccauaaa

SEQ ID NO: 508843 - RNA, 19 nt, Homo sapiens
ccaaaguuauugccuacua

SEQ ID NO: 508844 - RNA, 19 nt, Homo sapiens
ggaauaaaugcuagacuaa

SEQ ID NO: 508845 - RNA, 19 nt, Homo sapiens
gcugguguaucuuugaaua

SEQ ID NO: 508846 - RNA, 19 nt, Homo sapiens
gcccagaacugcuuugaau

SEQ ID NO: 508847 - RNA, 19 nt, Homo sapiens
guaauuccauggugcacua

SEQ ID NO: 508848 - RNA, 19 nt, Homo sapiens
gguaaggaaugagcuagua

SEQ ID NO: 508849 - RNA, 19 nt, Homo sapiens
cagaaugacuuugcuugua

SEQ ID NO: 508850 - RNA, 19 nt, Homo sapiens
gaaaauggcuggcaauucu

SEQ ID NO: 508851 - RNA, 19 nt, Homo sapiens
caaaguuauugccuacuaa

SEQ ID NO: 508852 - RNA, 19 nt, Homo sapiens
ggaagcaacaucuaucuga

SEQ ID NO: 508853 - RNA, 19 nt, Homo sapiens
gaauaucaccugucagaug

SEQ ID NO: 508854 - RNA, 19 nt, Homo sapiens
aaagguugcuguucucaaa

SEQ ID NO: 508855 - RNA, 19 nt, Homo sapiens
ccaaccaggugcauuuaaa

SEQ ID NO: 508856 - RNA, 19 nt, Homo sapiens
gugcugaguuugaauauca

SEQ ID NO: 508857 - RNA, 19 nt, Homo sapiens
gaaaccugauuaacacaug

SEQ ID NO: 508858 - RNA, 19 nt, Homo sapiens
gaugguaaaucauggaauc

SEQ ID NO: 508859 - RNA, 19 nt, Homo sapiens
guagaaauggcuugaguuu

SEQ ID NO: 508860 - RNA, 19 nt, Homo sapiens
ggagacaaaucuagcaucu

SEQ ID NO: 508861 - RNA, 19 nt, Homo sapiens
caugaaagcagcauugaaa

SEQ ID NO: 508862 - RNA, 19 nt, Homo sapiens
ucaaggaacccaugacaaa

SEQ ID NO: 508863 - RNA, 19 nt, Homo sapiens
ccaggugcauuuaaagaaa

SEQ ID NO: 508864 - RNA, 19 nt, Homo sapiens
agaaacauaugggcugaua

SEQ ID NO: 508865 - RNA, 19 nt, Homo sapiens
ugaaagcagcauugaaaua

SEQ ID NO: 508866 - RNA, 19 nt, Homo sapiens
uggauacguuuccuuauaa

SEQ ID NO: 508867 - RNA, 19 nt, Homo sapiens
ucauuuaccuugacauuuc

SEQ ID NO: 508868 - RNA, 19 nt, Homo sapiens
cgaugucauuccaaaguua

SEQ ID NO: 508869 - RNA, 19 nt, Homo sapiens
gcagagggaauaaaugcua

SEQ ID NO: 508870 - RNA, 19 nt, Homo sapiens
gugcaacaccuucagauaa

SEQ ID NO: 508871 - RNA, 19 nt, Homo sapiens
uaaggaaaccugauuaaca

SEQ ID NO: 508872 - RNA, 19 nt, Homo sapiens
acucuuaccucaucaaguu

SEQ ID NO: 508873 - RNA, 19 nt, Homo sapiens
aauaucaccugucagauga

SEQ ID NO: 508874 - RNA, 19 nt, Homo sapiens
aaacauaugggcugauaaa

SEQ ID NO: 508875 - RNA, 19 nt, Homo sapiens
gaaacucaaaucucucaaa

SEQ ID NO: 508876 - RNA, 19 nt, Homo sapiens
uagcauacuuagacuacua

SEQ ID NO: 508877 - RNA, 19 nt, Homo sapiens
caaguugaauaaagacaga

SEQ ID NO: 508878 - RNA, 19 nt, Homo sapiens
gaugaggacuggguaagga

SEQ ID NO: 508879 - RNA, 19 nt, Homo sapiens
agacaaaucuagcaucucu

SEQ ID NO: 508880 - RNA, 19 nt, Homo sapiens
gguggaaguugaacgaaug

SEQ ID NO: 508881 - RNA, 19 nt, Homo sapiens
caaguagucuagcuuucuu

SEQ ID NO: 508882 - RNA, 19 nt, Homo sapiens
uuggauacguuuccuuaua

SEQ ID NO: 508883 - RNA, 19 nt, Homo sapiens
uagagggccugugcaauuu

SEQ ID NO: 508884 - RNA, 19 nt, Homo sapiens
guuuagaaguccaucguuu

SEQ ID NO: 508885 - RNA, 19 nt, Homo sapiens
gaaaccucauuuaccuuga

SEQ ID NO: 508886 - RNA, 19 nt, Homo sapiens
gggcuuagaacaacuagaa

SEQ ID NO: 508887 - RNA, 19 nt, Homo sapiens
ggugugaaauccagacaau

SEQ ID NO: 508888 - RNA, 19 nt, Homo sapiens
gcaugccugugcugaguuu

SEQ ID NO: 508889 - RNA, 19 nt, Homo sapiens
ugacuuugcuuguacuugu

SEQ ID NO: 508890 - RNA, 19 nt, Homo sapiens
aacaggaacuacagcauuu

SEQ ID NO: 508891 - RNA, 19 nt, Homo sapiens
caccagaguugcuuucaau

SEQ ID NO: 508892 - RNA, 19 nt, Homo sapiens
gccgaaaggugauuguugu

SEQ ID NO: 508893 - RNA, 19 nt, Homo sapiens
ugaaacaaaugagugaguu

SEQ ID NO: 508894 - RNA, 19 nt, Homo sapiens
cauugaagaauuccgauua

SEQ ID NO: 508895 - RNA, 19 nt, Homo sapiens
gaaaugaaggaaacuugga

SEQ ID NO: 508896 - RNA, 19 nt, Homo sapiens
caacaaaggugggaaugcu

SEQ ID NO: 508897 - RNA, 19 nt, Homo sapiens
gauggcaacauuuagaauu

SEQ ID NO: 508898 - RNA, 19 nt, Homo sapiens
ccuacucaaucucucuuua

SEQ ID NO: 508899 - RNA, 19 nt, Homo sapiens
cgucuugccuauaagcuaa

SEQ ID NO: 508900 - RNA, 19 nt, Homo sapiens
uguaguaucuguuguagca

SEQ ID NO: 508901 - RNA, 19 nt, Homo sapiens
caacagcauuuaacucacu

SEQ ID NO: 508902 - RNA, 19 nt, Homo sapiens
gaaaacuuccuuccagaua

SEQ ID NO: 508903 - RNA, 19 nt, Homo sapiens
ucagaaaccucauuuaccu

SEQ ID NO: 508904 - RNA, 19 nt, Homo sapiens
gaacgaauggaaugugcaa

SEQ ID NO: 508905 - RNA, 19 nt, Homo sapiens
ucaauggcaucuucaaugg

SEQ ID NO: 508906 - RNA, 19 nt, Homo sapiens
cuagagggccugugcaauu

SEQ ID NO: 508907 - RNA, 19 nt, Homo sapiens
cuagagcacuuggaccuuu

SEQ ID NO: 508908 - RNA, 19 nt, Homo sapiens
gcugguaucaucuucauug

SEQ ID NO: 508909 - RNA, 19 nt, Homo sapiens
ucaccugucagaugaauaa

SEQ ID NO: 508910 - RNA, 19 nt, Homo sapiens
gaaguugaacgaauggaau

SEQ ID NO: 508911 - RNA, 19 nt, Homo sapiens
ucaaucacauaaugacuuc

SEQ ID NO: 508912 - RNA, 19 nt, Homo sapiens
gaagaauuccgauuagcau

SEQ ID NO: 508913 - RNA, 19 nt, Homo sapiens
gcaugaaacccagagcuuu

SEQ ID NO: 508914 - RNA, 19 nt, Homo sapiens
cuucauaagcugacuuuaa

SEQ ID NO: 508915 - RNA, 19 nt, Homo sapiens
gguguaucuuugaauauga

SEQ ID NO: 508916 - RNA, 19 nt, Homo sapiens
gagggccugugcaauuuga

SEQ ID NO: 508917 - RNA, 19 nt, Homo sapiens
uaagacgugcuucaaauau

SEQ ID NO: 508918 - RNA, 19 nt, Homo sapiens
ggccauugcugccaacauc

SEQ ID NO: 508919 - RNA, 19 nt, Homo sapiens
aaacaggaacuacagcauu

SEQ ID NO: 508920 - RNA, 19 nt, Homo sapiens
ggacaguuucccacauuga

SEQ ID NO: 508921 - RNA, 19 nt, Homo sapiens
agaaguccaucguuugguu

SEQ ID NO: 508922 - RNA, 19 nt, Homo sapiens
ugaccaaucuagagcacuu

SEQ ID NO: 508923 - RNA, 19 nt, Homo sapiens
ugaauaagaccaucauugg

SEQ ID NO: 508924 - RNA, 19 nt, Homo sapiens
uagaacaacuagaacaucu

SEQ ID NO: 508925 - RNA, 19 nt, Homo sapiens
ccgauuccauugcuucuug

SEQ ID NO: 508926 - RNA, 19 nt, Homo sapiens
ggucuuaucauggacaauu

SEQ ID NO: 508927 - RNA, 19 nt, Homo sapiens
cagagccgcugguguaucu

SEQ ID NO: 508928 - RNA, 19 nt, Homo sapiens
guaaggaaugagcuaguaa

SEQ ID NO: 508929 - RNA, 19 nt, Homo sapiens
ggaaguugaacgaauggaa

SEQ ID NO: 508930 - RNA, 19 nt, Homo sapiens
caccagaguuuccugcaau

SEQ ID NO: 508931 - RNA, 19 nt, Homo sapiens
gggaauaaaugcuagacua

SEQ ID NO: 508932 - RNA, 19 nt, Homo sapiens
ucacagagcugagaaacuu

SEQ ID NO: 508933 - RNA, 19 nt, Homo sapiens
uagcaguucuggucuauaa

SEQ ID NO: 508934 - RNA, 19 nt, Homo sapiens
gagcuucaaugguguuauu

SEQ ID NO: 508935 - RNA, 19 nt, Homo sapiens
gaagcaacaucuaucugaa

SEQ ID NO: 508936 - RNA, 19 nt, Homo sapiens
ugacaaaucugcucuagag

SEQ ID NO: 508937 - RNA, 19 nt, Homo sapiens
gcucagaccuggcaguuuc

SEQ ID NO: 508938 - RNA, 19 nt, Homo sapiens
ccaugaagguuuccauaaa

SEQ ID NO: 508939 - RNA, 19 nt, Homo sapiens
ggaauaaaugcuagacuaa

SEQ ID NO: 508940 - RNA, 19 nt, Homo sapiens
gcugguguaucuuugaaua

SEQ ID NO: 508941 - RNA, 19 nt, Homo sapiens
gcccagaacugcuuugaau

SEQ ID NO: 508942 - RNA, 19 nt, Homo sapiens
guaauuccauggugcacua

SEQ ID NO: 508943 - RNA, 19 nt, Homo sapiens
gguaaggaaugagcuagua

SEQ ID NO: 508944 - RNA, 19 nt, Homo sapiens
cagaaugacuuugcuugua

SEQ ID NO: 508945 - RNA, 19 nt, Homo sapiens
gaaaauggcuggcaauucu

SEQ ID NO: 508946 - RNA, 19 nt, Homo sapiens
ggaagcaacaucuaucuga

SEQ ID NO: 508947 - RNA, 19 nt, Homo sapiens
gaauaucaccugucagaug

SEQ ID NO: 508948 - RNA, 19 nt, Homo sapiens
aaagguugcuguucucaaa

SEQ ID NO: 508949 - RNA, 19 nt, Homo sapiens
ccaaccaggugcauuuaaa

SEQ ID NO: 508950 - RNA, 19 nt, Homo sapiens
gugcugaguuugaauauca

SEQ ID NO: 508951 - RNA, 19 nt, Homo sapiens
gaugguaaaucauggaauc

SEQ ID NO: 508952 - RNA, 19 nt, Homo sapiens
guagaaauggcuugaguuu

SEQ ID NO: 508953 - RNA, 19 nt, Homo sapiens
ggagacaaaucuagcaucu

SEQ ID NO: 508954 - RNA, 19 nt, Homo sapiens
ucaaggaacccaugacaaa

SEQ ID NO: 508955 - RNA, 19 nt, Homo sapiens
ccaggugcauuuaaagaaa

SEQ ID NO: 508956 - RNA, 19 nt, Homo sapiens
uggauacguuuccuuauaa

SEQ ID NO: 508957 - RNA, 19 nt, Homo sapiens
ucauuuaccuugacauuuc

SEQ ID NO: 508958 - RNA, 19 nt, Homo sapiens
gcagagggaauaaaugcua

SEQ ID NO: 508959 - RNA, 19 nt, Homo sapiens
gugcaacaccuucagauaa

SEQ ID NO: 508960 - RNA, 19 nt, Homo sapiens
acucuuaccucaucaaguu

SEQ ID NO: 508961 - RNA, 19 nt, Homo sapiens
aauaucaccugucagauga

SEQ ID NO: 508962 - RNA, 19 nt, Homo sapiens
gaaacucaaaucucucaaa

SEQ ID NO: 508963 - RNA, 19 nt, Homo sapiens
uagcauacuuagacuacua

SEQ ID NO: 508964 - RNA, 19 nt, Homo sapiens
caaguugaauaaagacaga

SEQ ID NO: 508965 - RNA, 19 nt, Homo sapiens
gaugaggacuggguaagga

SEQ ID NO: 508966 - RNA, 19 nt, Homo sapiens
agacaaaucuagcaucucu

SEQ ID NO: 508967 - RNA, 19 nt, Homo sapiens
gguggaaguugaacgaaug

SEQ ID NO: 508968 - RNA, 19 nt, Homo sapiens
caaguagucuagcuuucuu

SEQ ID NO: 508969 - RNA, 19 nt, Homo sapiens
uuggauacguuuccuuaua

SEQ ID NO: 508970 - RNA, 19 nt, Homo sapiens
uagagggccugugcaauuu

SEQ ID NO: 508971 - RNA, 19 nt, Homo sapiens
guuuagaaguccaucguuu

SEQ ID NO: 508972 - RNA, 19 nt, Homo sapiens
gaaaccucauuuaccuuga

SEQ ID NO: 508973 - RNA, 19 nt, Homo sapiens
gggcuuagaacaacuagaa

SEQ ID NO: 508974 - RNA, 19 nt, Homo sapiens
ggugugaaauccagacaau

SEQ ID NO: 508975 - RNA, 19 nt, Homo sapiens
gcaugccugugcugaguuu

SEQ ID NO: 508976 - RNA, 19 nt, Homo sapiens
ugacuuugcuuguacuugu

SEQ ID NO: 508977 - RNA, 19 nt, Homo sapiens
aacaggaacuacagcauuu

SEQ ID NO: 508978 - RNA, 19 nt, Homo sapiens
caccagaguugcuuucaau

SEQ ID NO: 508979 - RNA, 19 nt, Homo sapiens
gccgaaaggugauuguugu

SEQ ID NO: 508980 - RNA, 19 nt, Homo sapiens
ugaaacaaaugagugaguu

SEQ ID NO: 508981 - RNA, 19 nt, Homo sapiens
cauugaagaauuccgauua

SEQ ID NO: 508982 - RNA, 19 nt, Homo sapiens
gaaaugaaggaaacuugga

SEQ ID NO: 508983 - RNA, 19 nt, Homo sapiens
caacaaaggugggaaugcu

SEQ ID NO: 508984 - RNA, 19 nt, Homo sapiens
gauggcaacauuuagaauu

SEQ ID NO: 508985 - RNA, 19 nt, Homo sapiens
ccuacucaaucucucuuua

SEQ ID NO: 508986 - RNA, 19 nt, Homo sapiens
uguaguaucuguuguagca

SEQ ID NO: 508987 - RNA, 19 nt, Homo sapiens
caacagcauuuaacucacu

SEQ ID NO: 508988 - RNA, 19 nt, Homo sapiens
gaaaacuuccuuccagaua

SEQ ID NO: 508989 - RNA, 19 nt, Homo sapiens
ucagaaaccucauuuaccu

SEQ ID NO: 508990 - RNA, 19 nt, Homo sapiens
gaacgaauggaaugugcaa

SEQ ID NO: 508991 - RNA, 19 nt, Homo sapiens
ucaauggcaucuucaaugg

SEQ ID NO: 508992 - RNA, 19 nt, Homo sapiens
cuagagggccugugcaauu

SEQ ID NO: 508993 - RNA, 19 nt, Homo sapiens
cuagagcacuuggaccuuu

SEQ ID NO: 508994 - RNA, 19 nt, Homo sapiens
gcugguaucaucuucauug

SEQ ID NO: 508995 - RNA, 19 nt, Homo sapiens
ucaccugucagaugaauaa

SEQ ID NO: 508996 - RNA, 19 nt, Homo sapiens
gaaguugaacgaauggaau

SEQ ID NO: 508997 - RNA, 19 nt, Homo sapiens
ucaaucacauaaugacuuc

SEQ ID NO: 508998 - RNA, 19 nt, Homo sapiens
gaagaauuccgauuagcau

SEQ ID NO: 508999 - RNA, 19 nt, Homo sapiens
cuucauaagcugacuuuaa

SEQ ID NO: 509000 - RNA, 19 nt, Homo sapiens
gguguaucuuugaauauga

SEQ ID NO: 509001 - RNA, 19 nt, Homo sapiens
gagggccugugcaauuuga

SEQ ID NO: 509002 - RNA, 19 nt, Homo sapiens
ggccauugcugccaacauc

SEQ ID NO: 509003 - RNA, 19 nt, Homo sapiens
aaacaggaacuacagcauu

SEQ ID NO: 509004 - RNA, 19 nt, Homo sapiens
ggacaguuucccacauuga

SEQ ID NO: 509005 - RNA, 19 nt, Homo sapiens
agaaguccaucguuugguu

SEQ ID NO: 509006 - RNA, 19 nt, Homo sapiens
ugaccaaucuagagcacuu

SEQ ID NO: 509007 - RNA, 19 nt, Homo sapiens
ugaauaagaccaucauugg

SEQ ID NO: 509008 - RNA, 19 nt, Homo sapiens
uagaacaacuagaacaucu

SEQ ID NO: 509009 - RNA, 19 nt, Homo sapiens
cagagccgcugguguaucu

SEQ ID NO: 509010 - RNA, 19 nt, Homo sapiens
guaaggaaugagcuaguaa

SEQ ID NO: 509011 - RNA, 19 nt, Homo sapiens
ggaaguugaacgaauggaa

SEQ ID NO: 509012 - RNA, 19 nt, Homo sapiens
caccagaguuuccugcaau

SEQ ID NO: 509013 - RNA, 19 nt, Homo sapiens
uuucuaaucugaccaaucu

SEQ ID NO: 509014 - RNA, 19 nt, Homo sapiens
ccacaugucaggccuuaug

SEQ ID NO: 509015 - RNA, 19 nt, Homo sapiens
acaucuaucugaagaggaa

SEQ ID NO: 509016 - RNA, 19 nt, Homo sapiens
cauuggauacguuuccuua

SEQ ID NO: 509017 - RNA, 19 nt, Homo sapiens
uuucuggacuaucaaguuu

SEQ ID NO: 509018 - RNA, 19 nt, Homo sapiens
ugugaaauccagacaauug

SEQ ID NO: 509019 - RNA, 19 nt, Homo sapiens
ggaccucucucagugucaa

SEQ ID NO: 509020 - RNA, 19 nt, Homo sapiens
cauaagcugacuuuaagaa

SEQ ID NO: 509021 - RNA, 19 nt, Homo sapiens
gcuucuugcuggcugcaua

SEQ ID NO: 509022 - RNA, 19 nt, Homo sapiens
ggccacugcugcucacaga

SEQ ID NO: 509023 - RNA, 19 nt, Homo sapiens
caacuagaacaucuggauu

SEQ ID NO: 509024 - RNA, 19 nt, Homo sapiens
gaugaugccaggaugaugu

SEQ ID NO: 509025 - RNA, 19 nt, Homo sapiens
ccugaacccuaugaacuuu

SEQ ID NO: 509026 - RNA, 19 nt, Homo sapiens
gcacagacuugcggguucu

SEQ ID NO: 509027 - RNA, 19 nt, Homo sapiens
uaaaugcugccacauguca

SEQ ID NO: 509028 - RNA, 19 nt, Homo sapiens
agaaugacuuugcuuguac

SEQ ID NO: 509029 - RNA, 19 nt, Homo sapiens
aaacuuccuuccagauauc

SEQ ID NO: 509030 - RNA, 19 nt, Homo sapiens
cuagaucucaguagaaaug

SEQ ID NO: 509031 - RNA, 19 nt, Homo sapiens
gcaauaaacuagugacuuu

SEQ ID NO: 509032 - RNA, 19 nt, Homo sapiens
gaacugaagucuuuaaaca

SEQ ID NO: 509033 - RNA, 19 nt, Homo sapiens
gcacagaaccugauaugua

SEQ ID NO: 509034 - RNA, 19 nt, Homo sapiens
uaaacucucucaacagaua

SEQ ID NO: 509035 - RNA, 19 nt, Homo sapiens
ggacaucacaggaaacuuu

SEQ ID NO: 509036 - RNA, 19 nt, Homo sapiens
uaacagugcucucaucaug

SEQ ID NO: 509037 - RNA, 19 nt, Homo sapiens
gaaguugaauuccuuaaag

SEQ ID NO: 509038 - RNA, 19 nt, Homo sapiens
gaacuuagacuguauuucu

SEQ ID NO: 509039 - RNA, 19 nt, Homo sapiens
gauguuggcugguuucuuc

SEQ ID NO: 509040 - RNA, 19 nt, Homo sapiens
guagaaagaucguuugucu

SEQ ID NO: 509041 - RNA, 19 nt, Homo sapiens
cauaaacucucucaacaga

SEQ ID NO: 509042 - RNA, 19 nt, Homo sapiens
gauugcagaugaagcauuu

SEQ ID NO: 509043 - RNA, 19 nt, Homo sapiens
cugcugagcuucaacuaua

SEQ ID NO: 509044 - RNA, 19 nt, Homo sapiens
gcaaccaucuccuaaucaa

SEQ ID NO: 509045 - RNA, 19 nt, Homo sapiens
ucaaacaccuggacacuca

SEQ ID NO: 509046 - RNA, 19 nt, Homo sapiens
gaacuuagcacuuuuauca

SEQ ID NO: 509047 - RNA, 19 nt, Homo sapiens
gcagacauauauugugugu

SEQ ID NO: 509048 - RNA, 19 nt, Homo sapiens
caucaugggugccggguuu

SEQ ID NO: 509049 - RNA, 19 nt, Homo sapiens
gcagacacuuccuuagaga

SEQ ID NO: 509050 - RNA, 19 nt, Homo sapiens
ucaaagauccugaccagaa

SEQ ID NO: 509051 - RNA, 19 nt, Homo sapiens
ccaaguagcugggauuaca

SEQ ID NO: 509052 - RNA, 19 nt, Homo sapiens
caacagauacuaaagaaag

SEQ ID NO: 509053 - RNA, 19 nt, Homo sapiens
acaggaaacuuuagcaaug

SEQ ID NO: 509054 - RNA, 19 nt, Homo sapiens
ggacuucccuacucucauc

SEQ ID NO: 509055 - RNA, 19 nt, Homo sapiens
ggacugcagugacacaauc

SEQ ID NO: 509056 - RNA, 19 nt, Homo sapiens
gauuacagauugauguuca

SEQ ID NO: 509057 - RNA, 19 nt, Homo sapiens
gagcagacacuuccuuaga

SEQ ID NO: 509058 - RNA, 19 nt, Homo sapiens
agacauauauuguguguac

SEQ ID NO: 509059 - RNA, 19 nt, Homo sapiens
ggccagaaguucagugaga

SEQ ID NO: 509060 - RNA, 19 nt, Homo sapiens
ccaaauauuccuuguaugu

SEQ ID NO: 509061 - RNA, 19 nt, Homo sapiens
uagcugggauuacagauug

SEQ ID NO: 509062 - RNA, 19 nt, Homo sapiens
cagcgaaccucauccacuu

SEQ ID NO: 509063 - RNA, 19 nt, Homo sapiens
ggagcaauuuccaacuuau

SEQ ID NO: 509064 - RNA, 19 nt, Homo sapiens
ugacaguucuuucucacaa

SEQ ID NO: 509065 - RNA, 19 nt, Homo sapiens
gaaacauggugcuggagau

SEQ ID NO: 509066 - RNA, 19 nt, Homo sapiens
guacagaaacagcaguauu

SEQ ID NO: 509067 - RNA, 19 nt, Homo sapiens
aaugugaacuuagcacuuu

SEQ ID NO: 509068 - RNA, 19 nt, Homo sapiens
ucacaugggugcagaaugc

SEQ ID NO: 509069 - RNA, 19 nt, Homo sapiens
cuuagugucuuggauauaa

SEQ ID NO: 509070 - RNA, 19 nt, Homo sapiens
ugagacaccuggaucuuuc

SEQ ID NO: 509071 - RNA, 19 nt, Homo sapiens
ggguuuggcuuccauaaca

SEQ ID NO: 509072 - RNA, 19 nt, Homo sapiens
cagcuuuccuggcaauuga

SEQ ID NO: 509073 - RNA, 19 nt, Homo sapiens
acaaugauuuaccugcuaa

SEQ ID NO: 509074 - RNA, 19 nt, Homo sapiens
uacagaaacagcaguauuu

SEQ ID NO: 509075 - RNA, 19 nt, Homo sapiens
cacagaaccugauauguac

SEQ ID NO: 509076 - RNA, 19 nt, Homo sapiens
ccugggaaguaguaagaua

SEQ ID NO: 509077 - RNA, 19 nt, Homo sapiens
uagcaaccaucuccuaauc

SEQ ID NO: 509078 - RNA, 19 nt, Homo sapiens
ggaagguugugaugaagag

SEQ ID NO: 509079 - RNA, 19 nt, Homo sapiens
gaaccucauccacuuauca

SEQ ID NO: 509080 - RNA, 19 nt, Homo sapiens
gaccaaacauucaaauucc

SEQ ID NO: 509081 - RNA, 19 nt, Homo sapiens
gaugcuguauugaaagaug

SEQ ID NO: 509082 - RNA, 19 nt, Homo sapiens
caauugacuuugcccauca

SEQ ID NO: 509083 - RNA, 19 nt, Homo sapiens
gugcuuaucugaccuuaac

SEQ ID NO: 509084 - RNA, 19 nt, Homo sapiens
caaguucuguauuugaauc

SEQ ID NO: 509085 - RNA, 19 nt, Homo sapiens
acagauugauguucauguu

SEQ ID NO: 509086 - RNA, 19 nt, Homo sapiens
gagccucagauguuaauuu

SEQ ID NO: 509087 - RNA, 19 nt, Homo sapiens
cagaggcuuuguacagaaa

SEQ ID NO: 509088 - RNA, 19 nt, Homo sapiens
cacggaagguugugaugaa

SEQ ID NO: 509089 - RNA, 19 nt, Homo sapiens
gcucuuacaaccauucauu

SEQ ID NO: 509090 - RNA, 19 nt, Homo sapiens
ccuccaaguucucaauuug

SEQ ID NO: 509091 - RNA, 19 nt, Homo sapiens
gacaucacaggaaacuuua

SEQ ID NO: 509092 - RNA, 19 nt, Homo sapiens
aggagcaauuuccaacuua

SEQ ID NO: 509093 - RNA, 19 nt, Homo sapiens
gacuaagccucaacuccaa

SEQ ID NO: 509094 - RNA, 19 nt, Homo sapiens
aagcauacccgauaucuuc

SEQ ID NO: 509095 - RNA, 19 nt, Homo sapiens
caaagauccugaccagaac

SEQ ID NO: 509096 - RNA, 19 nt, Homo sapiens
caaccaaauauuccuugua

SEQ ID NO: 509097 - RNA, 19 nt, Homo sapiens
gaauagccuuuuaucguuu

SEQ ID NO: 509098 - RNA, 19 nt, Homo sapiens
caaccugugcuuugaagaa

SEQ ID NO: 509099 - RNA, 19 nt, Homo sapiens
cacaaugauuuaccugcua

SEQ ID NO: 509100 - RNA, 19 nt, Homo sapiens
ucagaggcuuuguacagaa

SEQ ID NO: 509101 - RNA, 19 nt, Homo sapiens
ccaacaggcugacaguucu

SEQ ID NO: 509102 - RNA, 19 nt, Homo sapiens
gagggacuuucucaucuuc

SEQ ID NO: 509103 - RNA, 19 nt, Homo sapiens
cauggccgguccuguguuu

SEQ ID NO: 509104 - RNA, 19 nt, Homo sapiens
gcaccaaguuaucauuuug

SEQ ID NO: 509105 - RNA, 19 nt, Homo sapiens
uaaagucccuaaaguucuc

SEQ ID NO: 509106 - RNA, 19 nt, Homo sapiens
acaaugcucuuacaaccau

SEQ ID NO: 509107 - RNA, 19 nt, Homo sapiens
uuaacucgcuuggaucuau

SEQ ID NO: 509108 - RNA, 19 nt, Homo sapiens
cgaauagccuuuuaucguu

SEQ ID NO: 509109 - RNA, 19 nt, Homo sapiens
caucaauacacaggauuua

SEQ ID NO: 509110 - RNA, 19 nt, Homo sapiens
cugaggaucuccaggaugu

SEQ ID NO: 509111 - RNA, 19 nt, Homo sapiens
gaucaaaccccuucagaga

SEQ ID NO: 509112 - RNA, 19 nt, Homo sapiens
gucggagccucagauguua

SEQ ID NO: 509113 - RNA, 19 nt, Homo sapiens
guuggcugguuucuucaua

SEQ ID NO: 509114 - RNA, 19 nt, Homo sapiens
gaaugugaacuuagcacuu

SEQ ID NO: 509115 - RNA, 19 nt, Homo sapiens
agaccaaacauucaaauuc

SEQ ID NO: 509116 - RNA, 19 nt, Homo sapiens
gaauuucuauggacuaccu

SEQ ID NO: 509117 - RNA, 19 nt, Homo sapiens
ccuuaaaguccauagauuu

SEQ ID NO: 509118 - RNA, 19 nt, Homo sapiens
ggacuguuccaucuguuug

SEQ ID NO: 509119 - RNA, 19 nt, Homo sapiens
ucagaaaccugcccaaccu

SEQ ID NO: 509120 - RNA, 19 nt, Homo sapiens
cucaacagauacuaaagaa

SEQ ID NO: 509121 - RNA, 19 nt, Homo sapiens
gugagcagacacuuccuua

SEQ ID NO: 509122 - RNA, 19 nt, Homo sapiens
agaaaccugcccaaccuua

SEQ ID NO: 509123 - RNA, 19 nt, Homo sapiens
cuucuugaguggcaauaaa

SEQ ID NO: 509124 - RNA, 19 nt, Homo sapiens
gcaauaauucaagaccaaa

SEQ ID NO: 509125 - RNA, 19 nt, Homo sapiens
caguggacaucacaggaaa

SEQ ID NO: 509126 - RNA, 19 nt, Homo sapiens
gaccugggaaguaguaaga

SEQ ID NO: 509127 - RNA, 19 nt, Homo sapiens
gcccaaccuuagaaucuug

SEQ ID NO: 509128 - RNA, 19 nt, Homo sapiens
aaggagcaauuuccaacuu

SEQ ID NO: 509129 - RNA, 19 nt, Homo sapiens
cagaaacagcaguauuuga

SEQ ID NO: 509130 - RNA, 19 nt, Homo sapiens
gggcacagaaccugauaug

SEQ ID NO: 509131 - RNA, 19 nt, Homo sapiens
gaacaagccucaacuaaca

SEQ ID NO: 509132 - RNA, 19 nt, Homo sapiens
guagauugcugucccguua

SEQ ID NO: 509133 - RNA, 19 nt, Homo sapiens
ggagaugaaugaaugcuaa

SEQ ID NO: 509134 - RNA, 19 nt, Homo sapiens
uuaaauagcugcuguacuu

SEQ ID NO: 509135 - RNA, 19 nt, Homo sapiens
gaucauaucugaaauacag

SEQ ID NO: 509136 - RNA, 19 nt, Homo sapiens
caaauccagugauaucuaa

SEQ ID NO: 509137 - RNA, 19 nt, Homo sapiens
ucaaggagaugaaugaaug

SEQ ID NO: 509138 - RNA, 19 nt, Homo sapiens
ggacguaauugcagaagga

SEQ ID NO: 509139 - RNA, 19 nt, Homo sapiens
caagacugcuuucagauau

SEQ ID NO: 509140 - RNA, 19 nt, Homo sapiens
caacacagauucccagaag

SEQ ID NO: 509141 - RNA, 19 nt, Homo sapiens
guuagaugcuacugaauuu

SEQ ID NO: 509142 - RNA, 19 nt, Homo sapiens
gagaacaagccucaacuaa

SEQ ID NO: 509143 - RNA, 19 nt, Homo sapiens
ggaagaugcuuggagagaa

SEQ ID NO: 509144 - RNA, 19 nt, Homo sapiens
caauguaucucuaugaagu

SEQ ID NO: 509145 - RNA, 19 nt, Homo sapiens
caaaggaauugauggacaa

SEQ ID NO: 509146 - RNA, 19 nt, Homo sapiens
uuacaagacugcuuucaga

SEQ ID NO: 509147 - RNA, 19 nt, Homo sapiens
guucuugacugauccauug

SEQ ID NO: 509148 - RNA, 19 nt, Homo sapiens
caaauaaaguggagaugag

SEQ ID NO: 509149 - RNA, 19 nt, Homo sapiens
ggugguggcucgauuuaga

SEQ ID NO: 509150 - RNA, 19 nt, Homo sapiens
ugaaucagcugccagacuu

SEQ ID NO: 509151 - RNA, 19 nt, Homo sapiens
gcaagcaaguggcccucua

SEQ ID NO: 509152 - RNA, 19 nt, Homo sapiens
aaacauaaguagugcuuuc

SEQ ID NO: 509153 - RNA, 19 nt, Homo sapiens
gaagaaguguuuggaaguc

SEQ ID NO: 509154 - RNA, 19 nt, Homo sapiens
aaacgaauauggacguaau

SEQ ID NO: 509155 - RNA, 19 nt, Homo sapiens
ggaaacgaauauggacgua

SEQ ID NO: 509156 - RNA, 19 nt, Homo sapiens
guacaaauccagugauauc

SEQ ID NO: 509157 - RNA, 19 nt, Homo sapiens
ucuauuagcccaucaacua

SEQ ID NO: 509158 - RNA, 19 nt, Homo sapiens
guaaagccuugaaugaaca

SEQ ID NO: 509159 - RNA, 19 nt, Homo sapiens
ccaaauauagcucugugua

SEQ ID NO: 509160 - RNA, 19 nt, Homo sapiens
uaaaaugcaucgucacuuu

SEQ ID NO: 509161 - RNA, 19 nt, Homo sapiens
gcuuaaauuuccacuguug

SEQ ID NO: 509162 - RNA, 19 nt, Homo sapiens
ggauuucgcuccguaggaa

SEQ ID NO: 509163 - RNA, 19 nt, Homo sapiens
gaucaaaagcugaaacaua

SEQ ID NO: 509164 - RNA, 19 nt, Homo sapiens
ggaccuaugucugcaaauc

SEQ ID NO: 509165 - RNA, 19 nt, Homo sapiens
uaucugaaauacaggcuuu

SEQ ID NO: 509166 - RNA, 19 nt, Homo sapiens
ggagaacaagccucaacua

SEQ ID NO: 509167 - RNA, 19 nt, Homo sapiens
cccagaagcugaacaagau

SEQ ID NO: 509168 - RNA, 19 nt, Homo sapiens
uaaguggccuucagaacug

SEQ ID NO: 509169 - RNA, 19 nt, Homo sapiens
acacaaagcauuccaguag

SEQ ID NO: 509170 - RNA, 19 nt, Homo sapiens
caacuccgguuagaugcua

SEQ ID NO: 509171 - RNA, 19 nt, Homo sapiens
gaagaugcuuggagagaac

SEQ ID NO: 509172 - RNA, 19 nt, Homo sapiens
gaucgaagacugagugaca

SEQ ID NO: 509173 - RNA, 19 nt, Homo sapiens
cuacauccauaccagauau

SEQ ID NO: 509174 - RNA, 19 nt, Homo sapiens
ccaauuacaagacugcuuu

SEQ ID NO: 509175 - RNA, 19 nt, Homo sapiens
ggaaaacuccuguugcuuu

SEQ ID NO: 509176 - RNA, 19 nt, Homo sapiens
uuaagcugcuccuuuggua

SEQ ID NO: 509177 - RNA, 19 nt, Homo sapiens
gaacacacacacacacaca

SEQ ID NO: 509178 - RNA, 19 nt, Homo sapiens
gaauauggacguaauugca

SEQ ID NO: 509179 - RNA, 19 nt, Homo sapiens
gaagucaacaugaacaaag

SEQ ID NO: 509180 - RNA, 19 nt, Homo sapiens
ggaaauguagaaacaaaca

SEQ ID NO: 509181 - RNA, 19 nt, Homo sapiens
uaaaaggguucuugacuga

SEQ ID NO: 509182 - RNA, 19 nt, Homo sapiens
gacaguaucagaugaacuu

SEQ ID NO: 509183 - RNA, 19 nt, Homo sapiens
cucaacagcuacauccaua

SEQ ID NO: 509184 - RNA, 19 nt, Homo sapiens
ucaaagccguuccuacaca

SEQ ID NO: 509185 - RNA, 19 nt, Homo sapiens
ugaaauacaggcuuuacaa

SEQ ID NO: 509186 - RNA, 19 nt, Homo sapiens
cuaguaaagccuugaauga

SEQ ID NO: 509187 - RNA, 19 nt, Homo sapiens
acauagugcugaaaccaaa

SEQ ID NO: 509188 - RNA, 19 nt, Homo sapiens
aagagaagagcuuuacuaa

SEQ ID NO: 509189 - RNA, 19 nt, Homo sapiens
gaaauacaggcuuuacaag

SEQ ID NO: 509190 - RNA, 19 nt, Homo sapiens
gcuaacagccugagacucu

SEQ ID NO: 509191 - RNA, 19 nt, Homo sapiens
ccaaauaaaguggagauga

SEQ ID NO: 509192 - RNA, 19 nt, Homo sapiens
acaagacugcuuucagaua

SEQ ID NO: 509193 - RNA, 19 nt, Homo sapiens
uugcagcccuucaagauga

SEQ ID NO: 509194 - RNA, 19 nt, Homo sapiens
caugaacggugacaacaca

SEQ ID NO: 509195 - RNA, 19 nt, Homo sapiens
gguuagaugcuacugaauu

SEQ ID NO: 509196 - RNA, 19 nt, Homo sapiens
gaggugguggcucgauuua

SEQ ID NO: 509197 - RNA, 19 nt, Homo sapiens
gagaugagugauugaguga

SEQ ID NO: 509198 - RNA, 19 nt, Homo sapiens
gucaagggaggaugaauaa

SEQ ID NO: 509199 - RNA, 19 nt, Homo sapiens
caaauauagcucuguguau

SEQ ID NO: 509200 - RNA, 19 nt, Homo sapiens
ccaauugacacaaagcauu

SEQ ID NO: 509201 - RNA, 19 nt, Homo sapiens
ccauuccgguugaugcuaa

SEQ ID NO: 509202 - RNA, 19 nt, Homo sapiens
guacaaagugaauuaacug

SEQ ID NO: 509203 - RNA, 19 nt, Homo sapiens
gcaaugugccaauuacaag

SEQ ID NO: 509204 - RNA, 19 nt, Homo sapiens
caucaacuauagaagaagu

SEQ ID NO: 509205 - RNA, 19 nt, Homo sapiens
ccagcuuuacguucuauua

SEQ ID NO: 509206 - RNA, 19 nt, Homo sapiens
ccgguuagaugcuacugaa

SEQ ID NO: 509207 - RNA, 19 nt, Homo sapiens
agacaacuccgguuagaug

SEQ ID NO: 509208 - RNA, 19 nt, Homo sapiens
ggacaagacgcacagaaac

SEQ ID NO: 509209 - RNA, 19 nt, Homo sapiens
gaaacgaauauggacguaa

SEQ ID NO: 509210 - RNA, 19 nt, Homo sapiens
uagcuuaugccaugugauu

SEQ ID NO: 509211 - RNA, 19 nt, Homo sapiens
cccaucaacuauagaagaa

SEQ ID NO: 509212 - RNA, 19 nt, Homo sapiens
caagaccagcugaugcuuu

SEQ ID NO: 509213 - RNA, 19 nt, Homo sapiens
cccaauguaucucuaugaa

SEQ ID NO: 509214 - RNA, 19 nt, Homo sapiens
gagcaagccagccggauca

SEQ ID NO: 509215 - RNA, 19 nt, Homo sapiens
cuaacaaacccuucaggaa

SEQ ID NO: 509216 - RNA, 19 nt, Homo sapiens
acucaacccugucgcuuug

SEQ ID NO: 509217 - RNA, 19 nt, Homo sapiens
aaauacaggcuuuacaaga

SEQ ID NO: 509218 - RNA, 19 nt, Homo sapiens
gaagcugaacaagaucaua

SEQ ID NO: 509219 - RNA, 19 nt, Homo sapiens
ggaagucaacaugaacaaa

SEQ ID NO: 509220 - RNA, 19 nt, Homo sapiens
acuuuaagcugcuccuuug

SEQ ID NO: 509221 - RNA, 19 nt, Homo sapiens
gaagacugagugacaggaa

SEQ ID NO: 509222 - RNA, 19 nt, Homo sapiens
guuuggaagucaacaugaa

SEQ ID NO: 509223 - RNA, 19 nt, Homo sapiens
ggacagccagcaugagcaa

SEQ ID NO: 509224 - RNA, 19 nt, Homo sapiens
gacaggaaacgaauaugga

SEQ ID NO: 509225 - RNA, 19 nt, Homo sapiens
ccagacaggaaacgaauau

SEQ ID NO: 509226 - RNA, 19 nt, Homo sapiens
cagguuggauaacauguca

SEQ ID NO: 509227 - RNA, 19 nt, Homo sapiens
guagugcuuucucuuccuu

SEQ ID NO: 509228 - RNA, 19 nt, Homo sapiens
aaaugccaauugacacaaa

SEQ ID NO: 509229 - RNA, 19 nt, Homo sapiens
aauacaggcuuuacaagag

SEQ ID NO: 509230 - RNA, 19 nt, Homo sapiens
gagccgggaagaaacuuaa

SEQ ID NO: 509231 - RNA, 19 nt, Homo sapiens
caacaagaaugcauugaua

SEQ ID NO: 509232 - RNA, 19 nt, Homo sapiens
gaacgaaacugauuguaau

SEQ ID NO: 509233 - RNA, 19 nt, Homo sapiens
caucaucggugacugguua

SEQ ID NO: 509234 - RNA, 19 nt, Homo sapiens
gaaggaaacugaacuugag

SEQ ID NO: 509235 - RNA, 19 nt, Homo sapiens
gcucguagcuggcauuuca

SEQ ID NO: 509236 - RNA, 19 nt, Homo sapiens
ccacacaccuuuaaguaga

SEQ ID NO: 509237 - RNA, 19 nt, Homo sapiens
gauaagcagacgauaguua

SEQ ID NO: 509238 - RNA, 19 nt, Homo sapiens
gcaccuauaucucccuuau

SEQ ID NO: 509239 - RNA, 19 nt, Homo sapiens
gccgagaacuccacaaaug

SEQ ID NO: 509240 - RNA, 19 nt, Homo sapiens
ccuaagacauguaacgaaa

SEQ ID NO: 509241 - RNA, 19 nt, Homo sapiens
gacuuaaucucauuugguu

SEQ ID NO: 509242 - RNA, 19 nt, Homo sapiens
ugaaagacuuccaaagaau

SEQ ID NO: 509243 - RNA, 19 nt, Homo sapiens
ggaacuggcaccacuauug

SEQ ID NO: 509244 - RNA, 19 nt, Homo sapiens
gcauugauauugugaacau

SEQ ID NO: 509245 - RNA, 19 nt, Homo sapiens
guaaaugccacacaccuuu

SEQ ID NO: 509246 - RNA, 19 nt, Homo sapiens
gaacugcagcaaucuuuga

SEQ ID NO: 509247 - RNA, 19 nt, Homo sapiens
ccaccaaaguuaaccagaa

SEQ ID NO: 509248 - RNA, 19 nt, Homo sapiens
gaccucauccaaacaauuu

SEQ ID NO: 509249 - RNA, 19 nt, Homo sapiens
ccacaaaugcucccuaugu

SEQ ID NO: 509250 - RNA, 19 nt, Homo sapiens
guaacgaaacacuucaaua

SEQ ID NO: 509251 - RNA, 19 nt, Homo sapiens
gaaagacuuccaaagaaug

SEQ ID NO: 509252 - RNA, 19 nt, Homo sapiens
ccagaaggguuguuaugau

SEQ ID NO: 509253 - RNA, 19 nt, Homo sapiens
ccuccuugcuuguuacaua

SEQ ID NO: 509254 - RNA, 19 nt, Homo sapiens
ggacuuacacggacgcuau

SEQ ID NO: 509255 - RNA, 19 nt, Homo sapiens
gaacuggcaccacuauugu

SEQ ID NO: 509256 - RNA, 19 nt, Homo sapiens
gcauugacauuauagacau

SEQ ID NO: 509257 - RNA, 19 nt, Homo sapiens
uugaaagacuuccaaagaa

SEQ ID NO: 509258 - RNA, 19 nt, Homo sapiens
caagaaugacggaauaaga

SEQ ID NO: 509259 - RNA, 19 nt, Homo sapiens
gcaguuuagugcaucuuug

SEQ ID NO: 509260 - RNA, 19 nt, Homo sapiens
uaagacauguaacgaaaca

SEQ ID NO: 509261 - RNA, 19 nt, Homo sapiens
ccuguuagcuccucacugu

SEQ ID NO: 509262 - RNA, 19 nt, Homo sapiens
uuucaagaaugacggaaua

SEQ ID NO: 509263 - RNA, 19 nt, Homo sapiens
ugaacgaaacugauuguaa

SEQ ID NO: 509264 - RNA, 19 nt, Homo sapiens
cauggaugcugaaacugua

SEQ ID NO: 509265 - RNA, 19 nt, Homo sapiens
caagaaugcauugauauug

SEQ ID NO: 509266 - RNA, 19 nt, Homo sapiens
gguguaaggagaagucuuu

SEQ ID NO: 509267 - RNA, 19 nt, Homo sapiens
gcuguggugugcagaacua

SEQ ID NO: 509268 - RNA, 19 nt, Homo sapiens
guaaggagaagucuuucaa

SEQ ID NO: 509269 - RNA, 19 nt, Homo sapiens
cagaaggguuguuaugauc

SEQ ID NO: 509270 - RNA, 19 nt, Homo sapiens
ggagaccaaaccugugaua

SEQ ID NO: 509271 - RNA, 19 nt, Homo sapiens
gcaccacuauuguugucuu

SEQ ID NO: 509272 - RNA, 19 nt, Homo sapiens
cggacgcuaugcagacuua

SEQ ID NO: 509273 - RNA, 19 nt, Homo sapiens
gaaggguuguuaugaucug

SEQ ID NO: 509274 - RNA, 19 nt, Homo sapiens
ugaaggaaacugaacuuga

SEQ ID NO: 509275 - RNA, 19 nt, Homo sapiens
gugauaaccugucucaaaa

SEQ ID NO: 509276 - RNA, 19 nt, Homo sapiens
ugugauaaccugucucaaa

SEQ ID NO: 509277 - RNA, 19 nt, Homo sapiens
accuauaucucccuuauug

SEQ ID NO: 509278 - RNA, 19 nt, Homo sapiens
uagagcacaguacauaaua

SEQ ID NO: 509279 - RNA, 19 nt, Homo sapiens
cggaauaagagaccuguuu

SEQ ID NO: 509280 - RNA, 19 nt, Homo sapiens
gcccauggaugcugaaacu

SEQ ID NO: 509281 - RNA, 19 nt, Homo sapiens
gaauaagagaccuguuuua

SEQ ID NO: 509282 - RNA, 19 nt, Homo sapiens
guuccuggcugagcucgua

SEQ ID NO: 509283 - RNA, 19 nt, Homo sapiens
ggaccucauccaaacaauu

SEQ ID NO: 509284 - RNA, 19 nt, Homo sapiens
gcuccucacugugguaaau

SEQ ID NO: 509285 - RNA, 19 nt, Homo sapiens
gugcagaacuacaccaacu

SEQ ID NO: 509286 - RNA, 19 nt, Homo sapiens
cgccggagcucuguaguau

SEQ ID NO: 509287 - RNA, 19 nt, Homo sapiens
guagauaagcagacgauag

SEQ ID NO: 509288 - RNA, 19 nt, Homo sapiens
gcuguguuguugcuucuug

SEQ ID NO: 509289 - RNA, 19 nt, Homo sapiens
gaccaaaccugugauaacc

SEQ ID NO: 509290 - RNA, 19 nt, Homo sapiens
ccggagcucuguaguaugg

SEQ ID NO: 509291 - RNA, 19 nt, Homo sapiens
ucugguaacuaguuucaug

SEQ ID NO: 509292 - RNA, 19 nt, Homo sapiens
cgaggagaauggagaccaa

SEQ ID NO: 509293 - RNA, 19 nt, Homo sapiens
ucacguguaguguccauuu

SEQ ID NO: 509294 - RNA, 19 nt, Homo sapiens
cacaguacauaauacacuu

SEQ ID NO: 509295 - RNA, 19 nt, Homo sapiens
gagcacaguacauaauaca

SEQ ID NO: 509296 - RNA, 19 nt, Homo sapiens
agacuuccaaagaauguua

SEQ ID NO: 509297 - RNA, 19 nt, Homo sapiens
aaaaggaacugcagcaauc

SEQ ID NO: 509298 - RNA, 19 nt, Homo sapiens
gagacuaacaugggaauca

SEQ ID NO: 509299 - RNA, 19 nt, Homo sapiens
caucuacuccuucgucuuc

SEQ ID NO: 509300 - RNA, 19 nt, Homo sapiens
gcacaguacauaauacacu

SEQ ID NO: 509301 - RNA, 19 nt, Homo sapiens
aguaugagaugguguaagg

SEQ ID NO: 509302 - RNA, 19 nt, Homo sapiens
gaucugguaacuaguuuca

SEQ ID NO: 509303 - RNA, 19 nt, Homo sapiens
ggguuguuaugaucuggua

SEQ ID NO: 509304 - RNA, 19 nt, Homo sapiens
caccaaaguuaaccagaag

SEQ ID NO: 509305 - RNA, 19 nt, Homo sapiens
ccacuauuguugucuuugg

SEQ ID NO: 509306 - RNA, 19 nt, Homo sapiens
agaaugcauugauauugug

SEQ ID NO: 509307 - RNA, 19 nt, Homo sapiens
aaacccuccucaucaucua

SEQ ID NO: 509308 - RNA, 19 nt, Homo sapiens
uagauaagcagacgauagu

SEQ ID NO: 509309 - RNA, 19 nt, Homo sapiens
auagagcaauuacaagcaa

SEQ ID NO: 509310 - RNA, 19 nt, Homo sapiens
gagaccaaaccugugauaa

SEQ ID NO: 509311 - RNA, 19 nt, Homo sapiens
ggaauaagagaccuguuuu

SEQ ID NO: 509312 - RNA, 19 nt, Homo sapiens
gcaugaacgaaacugauug

SEQ ID NO: 509313 - RNA, 19 nt, Homo sapiens
ggguuuguguuucgucaug

SEQ ID NO: 509314 - RNA, 19 nt, Homo sapiens
guggccuccuugcuuguua

SEQ ID NO: 509315 - RNA, 19 nt, Homo sapiens
acacaccuuuaaguagaua

SEQ ID NO: 509316 - RNA, 19 nt, Homo sapiens
ggaacugcagcaaucuuug

SEQ ID NO: 509317 - RNA, 19 nt, Homo sapiens
cuacuucucucuguauuuu

SEQ ID NO: 509318 - RNA, 19 nt, Homo sapiens
ugugaaggccaugauauuu

SEQ ID NO: 509319 - RNA, 19 nt, Homo sapiens
gguauguguaggcaguuua

SEQ ID NO: 509320 - RNA, 19 nt, Homo sapiens
gguaaaugccacacaccuu

SEQ ID NO: 509321 - RNA, 19 nt, Homo sapiens
guuagagcacaguacauaa

SEQ ID NO: 509322 - RNA, 19 nt, Homo sapiens
cccaggaucuacacaaucu

SEQ ID NO: 509323 - RNA, 19 nt, Homo sapiens
gaaugcauugauauuguga

SEQ ID NO: 509324 - RNA, 19 nt, Homo sapiens
ccaacaagaaugcauugau

SEQ ID NO: 509325 - RNA, 19 nt, Homo sapiens
ggguauguguaggcaguuu

SEQ ID NO: 509326 - RNA, 19 nt, Homo sapiens
uguuagagcacaguacaua

SEQ ID NO: 509327 - RNA, 19 nt, Homo sapiens
aaucgcauucucccaguua

SEQ ID NO: 509328 - RNA, 19 nt, Homo sapiens
caccacuauuguugucuuu

SEQ ID NO: 509329 - RNA, 19 nt, Homo sapiens
ugaaggccaugauauuuug

SEQ ID NO: 509330 - RNA, 19 nt, Homo sapiens
ggaguggcguuuggaaucg

SEQ ID NO: 509331 - RNA, 19 nt, Homo sapiens
ggagauagccuuugcgaua

SEQ ID NO: 509332 - RNA, 19 nt, Homo sapiens
gaaugaaacucucuaugaa

SEQ ID NO: 509333 - RNA, 19 nt, Homo sapiens
ggacaagccuguaacgaau

SEQ ID NO: 509334 - RNA, 19 nt, Homo sapiens
ucaacacuauccugaauua

SEQ ID NO: 509335 - RNA, 19 nt, Homo sapiens
gauccuagcauuagcaaua

SEQ ID NO: 509336 - RNA, 19 nt, Homo sapiens
caaugacucucaagcaauu

SEQ ID NO: 509337 - RNA, 19 nt, Homo sapiens
gagauagccuuugcgauau

SEQ ID NO: 509338 - RNA, 19 nt, Homo sapiens
ugaaugaaacucucuauga

SEQ ID NO: 509339 - RNA, 19 nt, Homo sapiens
gauacuggguuugguguuu

SEQ ID NO: 509340 - RNA, 19 nt, Homo sapiens
ugaauuaugugccugucua

SEQ ID NO: 509341 - RNA, 19 nt, Homo sapiens
ccacagauaucuucuagac

SEQ ID NO: 509342 - RNA, 19 nt, Homo sapiens
gaccacagauaucuucuag

SEQ ID NO: 509343 - RNA, 19 nt, Homo sapiens
caaccuaucgucagucaaa

SEQ ID NO: 509344 - RNA, 19 nt, Homo sapiens
gcaauauggguacgaguaa

SEQ ID NO: 509345 - RNA, 19 nt, Homo sapiens
acagauaucuucuagacau

SEQ ID NO: 509346 - RNA, 19 nt, Homo sapiens
gaccuguauuucuuucaua

SEQ ID NO: 509347 - RNA, 19 nt, Homo sapiens
ugccaaagcuauaauggaa

SEQ ID NO: 509348 - RNA, 19 nt, Homo sapiens
cuacguugcuguggacaua

SEQ ID NO: 509349 - RNA, 19 nt, Homo sapiens
gcuuuggcuuuguaaauuu

SEQ ID NO: 509350 - RNA, 19 nt, Homo sapiens
uuaugugccugucuagaua

SEQ ID NO: 509351 - RNA, 19 nt, Homo sapiens
acacuauccugaauuaugu

SEQ ID NO: 509352 - RNA, 19 nt, Homo sapiens
ggacauauugauugcugua

SEQ ID NO: 509353 - RNA, 19 nt, Homo sapiens
gauagccuuugcgauauuu

SEQ ID NO: 509354 - RNA, 19 nt, Homo sapiens
cagauaucuucuagacaua

SEQ ID NO: 509355 - RNA, 19 nt, Homo sapiens
caaagagaccuguauuucu

SEQ ID NO: 509356 - RNA, 19 nt, Homo sapiens
ccuaggagcuguuuucaaa

SEQ ID NO: 509357 - RNA, 19 nt, Homo sapiens
ggugugagugccuguauaa

SEQ ID NO: 509358 - RNA, 19 nt, Homo sapiens
caagaagaguuuaaaugcu

SEQ ID NO: 509359 - RNA, 19 nt, Homo sapiens
gcaaugacucucaagcaau

SEQ ID NO: 509360 - RNA, 19 nt, Homo sapiens
uuauugagauacuggguuu

SEQ ID NO: 509361 - RNA, 19 nt, Homo sapiens
gucaggagcagcugucuuu

SEQ ID NO: 509362 - RNA, 19 nt, Homo sapiens
gcaucaaccuaucgucagu

SEQ ID NO: 509363 - RNA, 19 nt, Homo sapiens
ccauaauuguguuucaaga

SEQ ID NO: 509364 - RNA, 19 nt, Homo sapiens
uaucuugauccuagcauua

SEQ ID NO: 509365 - RNA, 19 nt, Homo sapiens
cgaaauggcaggugugagu

SEQ ID NO: 509366 - RNA, 19 nt, Homo sapiens
gacaagccuguaacgaaua

SEQ ID NO: 509367 - RNA, 19 nt, Homo sapiens
ccagaucgggaacaaauga

SEQ ID NO: 509368 - RNA, 19 nt, Homo sapiens
acaaagagaccuguauuuc

SEQ ID NO: 509369 - RNA, 19 nt, Homo sapiens
aagcagagaccaugccaaa

SEQ ID NO: 509370 - RNA, 19 nt, Homo sapiens
ccaggaagccauaauugug

SEQ ID NO: 509371 - RNA, 19 nt, Homo sapiens
gcugcaugcuucuguuguu

SEQ ID NO: 509372 - RNA, 19 nt, Homo sapiens
gaccaugccaaagcuauaa

SEQ ID NO: 509373 - RNA, 19 nt, Homo sapiens
gcagagaccaugccaaagc

SEQ ID NO: 509374 - RNA, 19 nt, Homo sapiens
uucauaggcuugcuucuga

SEQ ID NO: 509375 - RNA, 19 nt, Homo sapiens
ucaaaccccuuuaaaaugu

SEQ ID NO: 509376 - RNA, 19 nt, Homo sapiens
ccaaagcuauaauggaaaa

SEQ ID NO: 509377 - RNA, 19 nt, Homo sapiens
ucaagaagaguuuaaaugc

SEQ ID NO: 509378 - RNA, 19 nt, Homo sapiens
caggagcuaugacaagcaa

SEQ ID NO: 509379 - RNA, 19 nt, Homo sapiens
cacggcaucuggauuccua

SEQ ID NO: 509380 - RNA, 19 nt, Homo sapiens
uguaagugcuauauaaguc

SEQ ID NO: 509381 - RNA, 19 nt, Homo sapiens
gcuaugacaagcaaaggaa

SEQ ID NO: 509382 - RNA, 19 nt, Homo sapiens
gggaugcugcggugcuaua

SEQ ID NO: 509383 - RNA, 19 nt, Homo sapiens
gcuguggacauauugauug

SEQ ID NO: 509384 - RNA, 19 nt, Homo sapiens
cuagacauauugaacacau

SEQ ID NO: 509385 - RNA, 19 nt, Homo sapiens
aaauguccguggauacaga

SEQ ID NO: 509386 - RNA, 19 nt, Homo sapiens
ggcgacagguauccuagga

SEQ ID NO: 509387 - RNA, 19 nt, Homo sapiens
uuucuaugguccuguauug

SEQ ID NO: 509388 - RNA, 19 nt, Homo sapiens
gcuaugugguaucuugauc

SEQ ID NO: 509389 - RNA, 19 nt, Homo sapiens
aagcaaaggaacauacuug

SEQ ID NO: 509390 - RNA, 19 nt, Homo sapiens
guaucuugauccuagcauu

SEQ ID NO: 509391 - RNA, 19 nt, Homo sapiens
agauagccuuugcgauauu

SEQ ID NO: 509392 - RNA, 19 nt, Homo sapiens
ccuuugcgauauuuaaaug

SEQ ID NO: 509393 - RNA, 19 nt, Homo sapiens
cuagcuagaccacagauau

SEQ ID NO: 509394 - RNA, 19 nt, Homo sapiens
aaauguugcuuuggcuuug

SEQ ID NO: 509395 - RNA, 19 nt, Homo sapiens
gguccuguauugccagauc

SEQ ID NO: 509396 - RNA, 19 nt, Homo sapiens
ggaagccauaauuguguuu

SEQ ID NO: 509397 - RNA, 19 nt, Homo sapiens
gaaacucucuaugaaaaca

SEQ ID NO: 509398 - RNA, 19 nt, Homo sapiens
gagcuguuuucaaaucuaa

SEQ ID NO: 509399 - RNA, 19 nt, Homo sapiens
cauauugauugcuguaggu

SEQ ID NO: 509400 - RNA, 19 nt, Homo sapiens
gaagauguaggcucuagcu

SEQ ID NO: 509401 - RNA, 19 nt, Homo sapiens
uaagucugaucgcauugug

SEQ ID NO: 509402 - RNA, 19 nt, Homo sapiens
guaagugcuauauaaguca

SEQ ID NO: 509403 - RNA, 19 nt, Homo sapiens
aaaugaaucuguggaugca

SEQ ID NO: 509404 - RNA, 19 nt, Homo sapiens
agcaaugacucucaagcaa

SEQ ID NO: 509405 - RNA, 19 nt, Homo sapiens
gugagugccuguauaaaau

SEQ ID NO: 509406 - RNA, 19 nt, Homo sapiens
ugcuuuggcuuuguaaauu

SEQ ID NO: 509407 - RNA, 19 nt, Homo sapiens
guccguggauacagaaauc

SEQ ID NO: 509408 - RNA, 19 nt, Homo sapiens
gagaccaugccaaagcuau

SEQ ID NO: 509409 - RNA, 19 nt, Homo sapiens
acaagccuguaacgaauag

SEQ ID NO: 509410 - RNA, 19 nt, Homo sapiens
caggaagccauaauugugu

SEQ ID NO: 509411 - RNA, 19 nt, Homo sapiens
ugacaagcaaaggaacaua

SEQ ID NO: 509412 - RNA, 19 nt, Homo sapiens
guggaugcaucaaccuauc

SEQ ID NO: 509413 - RNA, 19 nt, Homo sapiens
gaucgggaacaaaugaauc

SEQ ID NO: 509414 - RNA, 19 nt, Homo sapiens
cugcaugcuucuguuguuu

SEQ ID NO: 509415 - RNA, 19 nt, Homo sapiens
ggaugcugcggugcuauaa

SEQ ID NO: 509416 - RNA, 19 nt, Homo sapiens
aggacaagccuguaacgaa

SEQ ID NO: 509417 - RNA, 19 nt, Homo sapiens
guuuaaaugcugcgguuug

SEQ ID NO: 509418 - RNA, 19 nt, Homo sapiens
aguaagcaaugacucucaa

SEQ ID NO: 509419 - RNA, 19 nt, Homo sapiens
cuggcuaugugguaucuug

SEQ ID NO: 509420 - RNA, 19 nt, Homo sapiens
gggaaaaugauaugaaugu

SEQ ID NO: 509421 - RNA, 19 nt, Homo sapiens
agaccaugccaaagcuaua

SEQ ID NO: 509422 - RNA, 19 nt, Homo sapiens
gugccugucuagauaagca

SEQ ID NO: 509423 - RNA, 19 nt, Homo sapiens
ggagcuaugacaagcaaag

SEQ ID NO: 509424 - RNA, 19 nt, Homo sapiens
caauauggguacgaguaag

SEQ ID NO: 509425 - RNA, 19 nt, Homo sapiens
ggaaaaugauaugaaugug

SEQ ID NO: 509426 - RNA, 19 nt, Homo sapiens
caagcaaaggaacauacuu

SEQ ID NO: 509427 - RNA, 19 nt, Homo sapiens
agaccuguauuucuuucau

SEQ ID NO: 509428 - RNA, 19 nt, Homo sapiens
cagagaccaugccaaagcu

SEQ ID NO: 509429 - RNA, 19 nt, Homo sapiens
gacaagcaaaggaacauac

SEQ ID NO: 509430 - RNA, 19 nt, Homo sapiens
aacacuauccugaauuaug

SEQ ID NO: 509431 - RNA, 19 nt, Homo sapiens
gggauuaucucaaugauga

SEQ ID NO: 509432 - RNA, 19 nt, Homo sapiens
ggacacaguucacagaaau

SEQ ID NO: 509433 - RNA, 19 nt, Homo sapiens
caacaaggguccuaaaugc

SEQ ID NO: 509434 - RNA, 19 nt, Homo sapiens
gagaaacuaagaccaauuu

SEQ ID NO: 509435 - RNA, 19 nt, Homo sapiens
ggagcuggauacucguuua

SEQ ID NO: 509436 - RNA, 19 nt, Homo sapiens
ggaagaaagcacauuuaaa

SEQ ID NO: 509437 - RNA, 19 nt, Homo sapiens
gaugaggccuuauggaaca

SEQ ID NO: 509438 - RNA, 19 nt, Homo sapiens
ccaacagguucaaagcaua

SEQ ID NO: 509439 - RNA, 19 nt, Homo sapiens
ggucagggagaauguauaa

SEQ ID NO: 509440 - RNA, 19 nt, Homo sapiens
gauguucaccuccacgaua

SEQ ID NO: 509441 - RNA, 19 nt, Homo sapiens
ugauguauccuaaguauug

SEQ ID NO: 509442 - RNA, 19 nt, Homo sapiens
gaggaaaagugauagauga

SEQ ID NO: 509443 - RNA, 19 nt, Homo sapiens
cagcuuugcucgaguuaga

SEQ ID NO: 509444 - RNA, 19 nt, Homo sapiens
caucgagguucugcuauuu

SEQ ID NO: 509445 - RNA, 19 nt, Homo sapiens
ggagauggacccguuuaaa

SEQ ID NO: 509446 - RNA, 19 nt, Homo sapiens
gauauuugcugugguugga

SEQ ID NO: 509447 - RNA, 19 nt, Homo sapiens
ggaagcgauuugcgauguu

SEQ ID NO: 509448 - RNA, 19 nt, Homo sapiens
caaggacucucuggccaaa

SEQ ID NO: 509449 - RNA, 19 nt, Homo sapiens
guuuaaaccuccgagauga

SEQ ID NO: 509450 - RNA, 19 nt, Homo sapiens
cagggagaauguauaaaug

SEQ ID NO: 509451 - RNA, 19 nt, Homo sapiens
gggaagcgauuugcgaugu

SEQ ID NO: 509452 - RNA, 19 nt, Homo sapiens
gaagcggugucuugaugau

SEQ ID NO: 509453 - RNA, 19 nt, Homo sapiens
cacauguacugccauacua

SEQ ID NO: 509454 - RNA, 19 nt, Homo sapiens
gaagcgauuugcgauguuc

SEQ ID NO: 509455 - RNA, 19 nt, Homo sapiens
gaaaagugauagaugacaa

SEQ ID NO: 509456 - RNA, 19 nt, Homo sapiens
aaacuaagaccaauuucug

SEQ ID NO: 509457 - RNA, 19 nt, Homo sapiens
aaaggaagaaagcacauuu

SEQ ID NO: 509458 - RNA, 19 nt, Homo sapiens
ccaucgagguucugcuauu

SEQ ID NO: 509459 - RNA, 19 nt, Homo sapiens
gggagaauguauaaauguc

SEQ ID NO: 509460 - RNA, 19 nt, Homo sapiens
aaaauaguuuggccacuua

SEQ ID NO: 509461 - RNA, 19 nt, Homo sapiens
gcaugacgacuacaauuuc

SEQ ID NO: 509462 - RNA, 19 nt, Homo sapiens
ucagggagaauguauaaau

SEQ ID NO: 509463 - RNA, 19 nt, Homo sapiens
caucauggcuaggguucuu

SEQ ID NO: 509464 - RNA, 19 nt, Homo sapiens
gaauuuaccaacagguuca

SEQ ID NO: 509465 - RNA, 19 nt, Homo sapiens
ugacgacuacaauuucuuu

SEQ ID NO: 509466 - RNA, 19 nt, Homo sapiens
gagauggacccguuuaaac

SEQ ID NO: 509467 - RNA, 19 nt, Homo sapiens
gaugacaacgaccaccuuu

SEQ ID NO: 509468 - RNA, 19 nt, Homo sapiens
gccauacuacuucuuugua

SEQ ID NO: 509469 - RNA, 19 nt, Homo sapiens
uguauaaagucacauguac

SEQ ID NO: 509470 - RNA, 19 nt, Homo sapiens
aggcaguuauuccuucuuu

SEQ ID NO: 509471 - RNA, 19 nt, Homo sapiens
caaggacacaguucacaga

SEQ ID NO: 509472 - RNA, 19 nt, Homo sapiens
ucaacaaggguccuaaaug

SEQ ID NO: 509473 - RNA, 19 nt, Homo sapiens
cacgauauuugcugugguu

SEQ ID NO: 509474 - RNA, 19 nt, Homo sapiens
uugaguugcuugugacuga

SEQ ID NO: 509475 - RNA, 19 nt, Homo sapiens
cuaagaccaauuucuguuu

SEQ ID NO: 509476 - RNA, 19 nt, Homo sapiens
uuuaucaucucagccauuu

SEQ ID NO: 509477 - RNA, 19 nt, Homo sapiens
ggaagcggugucuugauga

SEQ ID NO: 509478 - RNA, 19 nt, Homo sapiens
aggaagcggugucuugaug

SEQ ID NO: 509479 - RNA, 19 nt, Homo sapiens
aggaagaaagcacauuuaa

SEQ ID NO: 509480 - RNA, 19 nt, Homo sapiens
ucucagccauuucaaucaa

SEQ ID NO: 509481 - RNA, 19 nt, Homo sapiens
gaccaccuuucccaagaga

SEQ ID NO: 509482 - RNA, 19 nt, Homo sapiens
aaggaagaaagcacauuua

SEQ ID NO: 509483 - RNA, 19 nt, Homo sapiens
agucacauguacugccaua

SEQ ID NO: 509484 - RNA, 19 nt, Homo sapiens
cagcaugacgacuacaauu

SEQ ID NO: 509485 - RNA, 19 nt, Homo sapiens
acacaguucacagaaauuu

SEQ ID NO: 509486 - RNA, 19 nt, Homo sapiens
ugauugauguauccuaagu

SEQ ID NO: 509487 - RNA, 19 nt, Homo sapiens
gaaugauugauguauccua

SEQ ID NO: 509488 - RNA, 19 nt, Homo sapiens
caaaggaagaaagcacauu

SEQ ID NO: 509489 - RNA, 19 nt, Homo sapiens
guacugccauacuacuucu

SEQ ID NO: 509490 - RNA, 19 nt, Homo sapiens
cuucuucucuucuuggaau

SEQ ID NO: 509491 - RNA, 19 nt, Homo sapiens
cauaaaacuucuucucuuc

SEQ ID NO: 509492 - RNA, 19 nt, Homo sapiens
uugagaagcugaagcaacu

SEQ ID NO: 509493 - RNA, 19 nt, Homo sapiens
ccuggaaucugacccucuu

SEQ ID NO: 509494 - RNA, 19 nt, Homo sapiens
uaucaucucagccauuuca

SEQ ID NO: 509495 - RNA, 19 nt, Homo sapiens
gauguauccuaaguauugu

SEQ ID NO: 509496 - RNA, 19 nt, Homo sapiens
cgacuacaauuucuuuuca

SEQ ID NO: 509497 - RNA, 19 nt, Homo sapiens
ucaaugaugaggccuuaug

SEQ ID NO: 509498 - RNA, 19 nt, Homo sapiens
caucucagccauuucaauc

SEQ ID NO: 509499 - RNA, 19 nt, Homo sapiens
uauaaagucacauguacug

SEQ ID NO: 509500 - RNA, 19 nt, Homo sapiens
gggagauggacccguuuaa

SEQ ID NO: 509501 - RNA, 19 nt, Homo sapiens
uugcuugaguugcuuguga

SEQ ID NO: 509502 - RNA, 19 nt, Homo sapiens
cgacggggauuaucucaau

SEQ ID NO: 509503 - RNA, 19 nt, Homo sapiens
caugacgacuacaauuucu

SEQ ID NO: 509504 - RNA, 19 nt, Homo sapiens
guucaccuccacgauauuu

SEQ ID NO: 509505 - RNA, 19 nt, Homo sapiens
gauugauguauccuaagua

SEQ ID NO: 509506 - RNA, 19 nt, Homo sapiens
gagcuggauacucguuuau

SEQ ID NO: 509507 - RNA, 19 nt, Homo sapiens
uuugauugcugaccugugu

SEQ ID NO: 509508 - RNA, 19 nt, Homo sapiens
gaagcugaagcaacuccaa

SEQ ID NO: 509509 - RNA, 19 nt, Homo sapiens
ugagaaacuaagaccaauu

SEQ ID NO: 509510 - RNA, 19 nt, Homo sapiens
aaugagaaacuaagaccaa

SEQ ID NO: 509511 - RNA, 19 nt, Homo sapiens
caacagguucaaagcauac

SEQ ID NO: 509512 - RNA, 19 nt, Homo sapiens
uauuugcugugguuggauu

SEQ ID NO: 509513 - RNA, 19 nt, Homo sapiens
ucccugcgcugguguucuu

SEQ ID NO: 509514 - RNA, 19 nt, Homo sapiens
cucagacucuacagcauga

SEQ ID NO: 509515 - RNA, 19 nt, Homo sapiens
gcuugugacugaucuuuug

SEQ ID NO: 509516 - RNA, 19 nt, Homo sapiens
uagaauuuaccaacagguu

SEQ ID NO: 509517 - RNA, 19 nt, Homo sapiens
aggacacaguucacagaaa

SEQ ID NO: 509518 - RNA, 19 nt, Homo sapiens
gugaggagcuuuugauugc

SEQ ID NO: 509519 - RNA, 19 nt, Homo sapiens
ugauaaagcuuagaaaagg

SEQ ID NO: 509520 - RNA, 19 nt, Homo sapiens
acgaccaccuuucccaaga

SEQ ID NO: 509521 - RNA, 19 nt, Homo sapiens
gcugaagcaacuccaagga

SEQ ID NO: 509522 - RNA, 19 nt, Homo sapiens
aagaaugauugauguaucc

SEQ ID NO: 509523 - RNA, 19 nt, Homo sapiens
uaaaucaaaggaagaaagc

SEQ ID NO: 509524 - RNA, 19 nt, Homo sapiens
aaccagcuuugcucgaguu

SEQ ID NO: 509525 - RNA, 19 nt, Homo sapiens
gcaguuauuccuucuuucc

SEQ ID NO: 509526 - RNA, 19 nt, Homo sapiens
gcugauaaagcuuagaaaa

SEQ ID NO: 509527 - RNA, 19 nt, Homo sapiens
agcaugacgacuacaauuu

SEQ ID NO: 509528 - RNA, 19 nt, Homo sapiens
cguuuaaaccuccgagaug

SEQ ID NO: 509529 - RNA, 19 nt, Homo sapiens
uaggaggaauccagauggu

SEQ ID NO: 509530 - RNA, 19 nt, Homo sapiens
ccucauggccaauaguaca

SEQ ID NO: 509531 - RNA, 19 nt, Homo sapiens
gcuguaaacuugaagauug

SEQ ID NO: 509532 - RNA, 19 nt, Homo sapiens
cuacugauguucugugaua

SEQ ID NO: 509533 - RNA, 19 nt, Homo sapiens
uggaagagcuaguaaauug

SEQ ID NO: 509534 - RNA, 19 nt, Homo sapiens
ggaaggcacugugaauuug

SEQ ID NO: 509535 - RNA, 19 nt, Homo sapiens
ggaauucaguggaacuuau

SEQ ID NO: 509536 - RNA, 19 nt, Homo sapiens
acagagagaugcagacaaa

SEQ ID NO: 509537 - RNA, 19 nt, Homo sapiens
ggaagggacuacugauguu

SEQ ID NO: 509538 - RNA, 19 nt, Homo sapiens
gaagagcuaguaaauugua

SEQ ID NO: 509539 - RNA, 19 nt, Homo sapiens
caagauguauguuugcuau

SEQ ID NO: 509540 - RNA, 19 nt, Homo sapiens
gcuaagcccuacauuucua

SEQ ID NO: 509541 - RNA, 19 nt, Homo sapiens
ugacuuugcuauugaugua

SEQ ID NO: 509542 - RNA, 19 nt, Homo sapiens
uaaaggugaugaccauuau

SEQ ID NO: 509543 - RNA, 19 nt, Homo sapiens
caaucaagauguauguuug

SEQ ID NO: 509544 - RNA, 19 nt, Homo sapiens
aaauacugcuuuccucuaa

SEQ ID NO: 509545 - RNA, 19 nt, Homo sapiens
guucauacuuucccucuug

SEQ ID NO: 509546 - RNA, 19 nt, Homo sapiens
aagguuaucugguuugauu

SEQ ID NO: 509547 - RNA, 19 nt, Homo sapiens
gagagaugcagacaaagua

SEQ ID NO: 509548 - RNA, 19 nt, Homo sapiens
gagauuggacagauacuaa

SEQ ID NO: 509549 - RNA, 19 nt, Homo sapiens
ugucggaauuguuguauuu

SEQ ID NO: 509550 - RNA, 19 nt, Homo sapiens
caaaauacguugcauuguu

SEQ ID NO: 509551 - RNA, 19 nt, Homo sapiens
cagacaaaguaaacaauga

SEQ ID NO: 509552 - RNA, 19 nt, Homo sapiens
gagauuaagaacagcuuua

SEQ ID NO: 509553 - RNA, 19 nt, Homo sapiens
gacaugagauuaagaacag

SEQ ID NO: 509554 - RNA, 19 nt, Homo sapiens
caaucaagauguauguaga

SEQ ID NO: 509555 - RNA, 19 nt, Homo sapiens
caaauaaccaguaugagau

SEQ ID NO: 509556 - RNA, 19 nt, Homo sapiens
gggagucguugcaggaauu

SEQ ID NO: 509557 - RNA, 19 nt, Homo sapiens
cuaaaccagucauuacuug

SEQ ID NO: 509558 - RNA, 19 nt, Homo sapiens
uauagagauuggacagaua

SEQ ID NO: 509559 - RNA, 19 nt, Homo sapiens
gagauaguguaacccaaug

SEQ ID NO: 509560 - RNA, 19 nt, Homo sapiens
cuauugauguagugugaua

SEQ ID NO: 509561 - RNA, 19 nt, Homo sapiens
acaaauaaccaguaugaga

SEQ ID NO: 509562 - RNA, 19 nt, Homo sapiens
guguuccucuugacuguua

SEQ ID NO: 509563 - RNA, 19 nt, Homo sapiens
guaauacuguguuccucuu

SEQ ID NO: 509564 - RNA, 19 nt, Homo sapiens
cuauuccucucuaccuuua

SEQ ID NO: 509565 - RNA, 19 nt, Homo sapiens
uguaaggccuugggucuaa

SEQ ID NO: 509566 - RNA, 19 nt, Homo sapiens
gcagacaaaguaaacaaug

SEQ ID NO: 509567 - RNA, 19 nt, Homo sapiens
ccucugacuuugcuauuga

SEQ ID NO: 509568 - RNA, 19 nt, Homo sapiens
caagagcguucugcuaauc

SEQ ID NO: 509569 - RNA, 19 nt, Homo sapiens
gauguauguuugcuauguu

SEQ ID NO: 509570 - RNA, 19 nt, Homo sapiens
gauaguguaacccaaugua

SEQ ID NO: 509571 - RNA, 19 nt, Homo sapiens
ccuaagaguugcuguaaac

SEQ ID NO: 509572 - RNA, 19 nt, Homo sapiens
aggugagccuggagaauua

SEQ ID NO: 509573 - RNA, 19 nt, Homo sapiens
guauaacucuacaggagau

SEQ ID NO: 509574 - RNA, 19 nt, Homo sapiens
aagcuaagcccuacauuuc

SEQ ID NO: 509575 - RNA, 19 nt, Homo sapiens
cauguuagaucguugaaac

SEQ ID NO: 509576 - RNA, 19 nt, Homo sapiens
uaaauggugucggaauugu

SEQ ID NO: 509577 - RNA, 19 nt, Homo sapiens
gcacugugaauuugcuauu

SEQ ID NO: 509578 - RNA, 19 nt, Homo sapiens
auaaaggugaugaccauua

SEQ ID NO: 509579 - RNA, 19 nt, Homo sapiens
uaaaugagaaggccaccaa

SEQ ID NO: 509580 - RNA, 19 nt, Homo sapiens
uagaaaaucugcuggaaug

SEQ ID NO: 509581 - RNA, 19 nt, Homo sapiens
uaaauacugcuuuccucua

SEQ ID NO: 509582 - RNA, 19 nt, Homo sapiens
caaaguaaacaaugaaggu

SEQ ID NO: 509583 - RNA, 19 nt, Homo sapiens
aaagcuaagcccuacauuu

SEQ ID NO: 509584 - RNA, 19 nt, Homo sapiens
guuacaagauggaaaauug

SEQ ID NO: 509585 - RNA, 19 nt, Homo sapiens
ucucgugccauaacaaaua

SEQ ID NO: 509586 - RNA, 19 nt, Homo sapiens
gaaucuuucucgccuacug

SEQ ID NO: 509587 - RNA, 19 nt, Homo sapiens
gaagauuguacuccacaga

SEQ ID NO: 509588 - RNA, 19 nt, Homo sapiens
uguauaauuugcaccaaga

SEQ ID NO: 509589 - RNA, 19 nt, Homo sapiens
uggaaggcacugugaauuu

SEQ ID NO: 509590 - RNA, 19 nt, Homo sapiens
gaagcaguauaacucuaca

SEQ ID NO: 509591 - RNA, 19 nt, Homo sapiens
acuggucgcugccaucgua

SEQ ID NO: 509592 - RNA, 19 nt, Homo sapiens
cuacauuucuauucagagu

SEQ ID NO: 509593 - RNA, 19 nt, Homo sapiens
aaccagucauuacuuguuu

SEQ ID NO: 509594 - RNA, 19 nt, Homo sapiens
ucaagagcguucugcuaau

SEQ ID NO: 509595 - RNA, 19 nt, Homo sapiens
cagucaagguuaucugguu

SEQ ID NO: 509596 - RNA, 19 nt, Homo sapiens
cugcuaaucuacacuuuua

SEQ ID NO: 509597 - RNA, 19 nt, Homo sapiens
gcaguagacaagauccaaa

SEQ ID NO: 509598 - RNA, 19 nt, Homo sapiens
gaaagcuaagcccuacauu

SEQ ID NO: 509599 - RNA, 19 nt, Homo sapiens
gacuacugauguucuguga

SEQ ID NO: 509600 - RNA, 19 nt, Homo sapiens
gauguagugugauagaaaa

SEQ ID NO: 509601 - RNA, 19 nt, Homo sapiens
guucuaaguccaccuucua

SEQ ID NO: 509602 - RNA, 19 nt, Homo sapiens
gagccuggagaauuacuuu

SEQ ID NO: 509603 - RNA, 19 nt, Homo sapiens
uaaccaguaugagauagug

SEQ ID NO: 509604 - RNA, 19 nt, Homo sapiens
uuauaaaggugaugaccau

SEQ ID NO: 509605 - RNA, 19 nt, Homo sapiens
gagaugcagacaaaguaaa

SEQ ID NO: 509606 - RNA, 19 nt, Homo sapiens
guggaacuuaucuucauua

SEQ ID NO: 509607 - RNA, 19 nt, Homo sapiens
ccauaacaaauaaccagua

SEQ ID NO: 509608 - RNA, 19 nt, Homo sapiens
caguggaacuuaucuucau

SEQ ID NO: 509609 - RNA, 19 nt, Homo sapiens
gauuggacagauacuaauu

SEQ ID NO: 509610 - RNA, 19 nt, Homo sapiens
aaaauacguugcauuguug

SEQ ID NO: 509611 - RNA, 19 nt, Homo sapiens
ucagacaugagauuaagaa

SEQ ID NO: 509612 - RNA, 19 nt, Homo sapiens
agucaagguuaucugguuu

SEQ ID NO: 509613 - RNA, 19 nt, Homo sapiens
ggaagagcuaguaaauugu

SEQ ID NO: 509614 - RNA, 19 nt, Homo sapiens
gcaaggugagccuggagaa

SEQ ID NO: 509615 - RNA, 19 nt, Homo sapiens
uuauagaagccaugcagua

SEQ ID NO: 509616 - RNA, 19 nt, Homo sapiens
uacuuucccucuuguuuga

SEQ ID NO: 509617 - RNA, 19 nt, Homo sapiens
cauacuuucccucuuguuu

SEQ ID NO: 509618 - RNA, 19 nt, Homo sapiens
uaauuugcaccaagaaguu

SEQ ID NO: 509619 - RNA, 19 nt, Homo sapiens
gguaccgucauuauucuuu

SEQ ID NO: 509620 - RNA, 19 nt, Homo sapiens
guaccagguugauaugacu

SEQ ID NO: 509621 - RNA, 19 nt, Homo sapiens
auuaaauggugucggaauu

SEQ ID NO: 509622 - RNA, 19 nt, Homo sapiens
gcaccaagaaguuaaaaug

SEQ ID NO: 509623 - RNA, 19 nt, Homo sapiens
guuaucugguuugauugua

SEQ ID NO: 509624 - RNA, 19 nt, Homo sapiens
ccugugaauuagaaaguug

SEQ ID NO: 509625 - RNA, 19 nt, Homo sapiens
ugucaccgauuauagagau

SEQ ID NO: 509626 - RNA, 19 nt, Homo sapiens
guagacaagauccaaaaua

SEQ ID NO: 509627 - RNA, 19 nt, Homo sapiens
agauguauguuugcuaugu

SEQ ID NO: 509628 - RNA, 19 nt, Homo sapiens
cugccucucucgugccaua

SEQ ID NO: 509629 - RNA, 19 nt, Homo sapiens
guauaccuauguaacaaac

SEQ ID NO: 509630 - RNA, 19 nt, Homo sapiens
gaauucaguggaacuuauc

SEQ ID NO: 509631 - RNA, 19 nt, Homo sapiens
ggacaagauugacagguau

SEQ ID NO: 509632 - RNA, 19 nt, Homo sapiens
cggacaagauugacaggua

SEQ ID NO: 509633 - RNA, 19 nt, Homo sapiens
ucaccuacauuccauagug

SEQ ID NO: 509634 - RNA, 19 nt, Homo sapiens
ggccugaccuucgccauga

SEQ ID NO: 509635 - RNA, 19 nt, Homo sapiens
gcuguggcgucuccaacua

SEQ ID NO: 509636 - RNA, 19 nt, Homo sapiens
ugacagguaugcccagcaa

SEQ ID NO: 509637 - RNA, 19 nt, Homo sapiens
agaaaggcuugcaccugua

SEQ ID NO: 509638 - RNA, 19 nt, Homo sapiens
ccuggugcaucuuaauaaa

SEQ ID NO: 509639 - RNA, 19 nt, Homo sapiens
gcaucuuaauaaaguguga

SEQ ID NO: 509640 - RNA, 19 nt, Homo sapiens
gaccauguacugccaagug

SEQ ID NO: 509641 - RNA, 19 nt, Homo sapiens
ccaacuacacugacugguu

SEQ ID NO: 509642 - RNA, 19 nt, Homo sapiens
cagcaagaccugaagaaag

SEQ ID NO: 509643 - RNA, 19 nt, Homo sapiens
gggcuccuggugcaucuua

SEQ ID NO: 509644 - RNA, 19 nt, Homo sapiens
agcaagaccugaagaaagg

SEQ ID NO: 509645 - RNA, 19 nt, Homo sapiens
ucgccacgcuguccucuuc

SEQ ID NO: 509646 - RNA, 19 nt, Homo sapiens
ccagcaagaccugaagaaa

SEQ ID NO: 509647 - RNA, 19 nt, Homo sapiens
gaaaggcuugcaccuguac

SEQ ID NO: 509648 - RNA, 19 nt, Homo sapiens
uggugcaucuuaauaaagu

SEQ ID NO: 509649 - RNA, 19 nt, Homo sapiens
caccaucgccauccucuuc

SEQ ID NO: 509650 - RNA, 19 nt, Homo sapiens
aauaaagugugagcagcaa

SEQ ID NO: 509651 - RNA, 19 nt, Homo sapiens
gcuacgagacggugaaggu

SEQ ID NO: 509652 - RNA, 19 nt, Homo sapiens
cgucaaguaccucauguuc

SEQ ID NO: 509653 - RNA, 19 nt, Homo sapiens
agguguggcuucaggagaa

SEQ ID NO: 509654 - RNA, 19 nt, Homo sapiens
acagguaugcccagcaaga

SEQ ID NO: 509655 - RNA, 19 nt, Homo sapiens
gagcaccgccuggucucuu

SEQ ID NO: 509656 - RNA, 19 nt, Homo sapiens
ugggugccaucaaggagaa

SEQ ID NO: 509657 - RNA, 19 nt, Homo sapiens
gcugccaaccugcucauca

SEQ ID NO: 509658 - RNA, 19 nt, Homo sapiens
ccacaaaucuuaccucuuu

SEQ ID NO: 509659 - RNA, 19 nt, Homo sapiens
caaggaaucucuuaaguuu

SEQ ID NO: 509660 - RNA, 19 nt, Homo sapiens
gcaauaauguagacugaua

SEQ ID NO: 509661 - RNA, 19 nt, Homo sapiens
ggagugguguuauuuguuu

SEQ ID NO: 509662 - RNA, 19 nt, Homo sapiens
gcaaucauguuguaguuug

SEQ ID NO: 509663 - RNA, 19 nt, Homo sapiens
ugacaacccucgaagauau

SEQ ID NO: 509664 - RNA, 19 nt, Homo sapiens
ucccagaucuuauuucuuu

SEQ ID NO: 509665 - RNA, 19 nt, Homo sapiens
ggacuaaaguauuccacaa

SEQ ID NO: 509666 - RNA, 19 nt, Homo sapiens
uagcugacuuauccuauua

SEQ ID NO: 509667 - RNA, 19 nt, Homo sapiens
ggaauaagcaauaauguag

SEQ ID NO: 509668 - RNA, 19 nt, Homo sapiens
uagcaucaguuaacaguuu

SEQ ID NO: 509669 - RNA, 19 nt, Homo sapiens
gggagaugcuggauacgua

SEQ ID NO: 509670 - RNA, 19 nt, Homo sapiens
gauuaugacugguacaaug

SEQ ID NO: 509671 - RNA, 19 nt, Homo sapiens
gcacagacuuuuaugcaua

SEQ ID NO: 509672 - RNA, 19 nt, Homo sapiens
gaauguuacugcaaucaug

SEQ ID NO: 509673 - RNA, 19 nt, Homo sapiens
gaccuugccuggaacauug

SEQ ID NO: 509674 - RNA, 19 nt, Homo sapiens
uguaaggucuuuagagauu

SEQ ID NO: 509675 - RNA, 19 nt, Homo sapiens
guuuauuucuuccgaguua

SEQ ID NO: 509676 - RNA, 19 nt, Homo sapiens
guagacugauaaacccuua

SEQ ID NO: 509677 - RNA, 19 nt, Homo sapiens
gaagauaugacagugauga

SEQ ID NO: 509678 - RNA, 19 nt, Homo sapiens
uauuaaaccuccucugcua

SEQ ID NO: 509679 - RNA, 19 nt, Homo sapiens
gagggagccuugcuauuuc

SEQ ID NO: 509680 - RNA, 19 nt, Homo sapiens
ccaccuuagucguuuauuu

SEQ ID NO: 509681 - RNA, 19 nt, Homo sapiens
guagcugacuuauccuauu

SEQ ID NO: 509682 - RNA, 19 nt, Homo sapiens
guagggcgcuaauguauac

SEQ ID NO: 509683 - RNA, 19 nt, Homo sapiens
gauaugacagugaugauga

SEQ ID NO: 509684 - RNA, 19 nt, Homo sapiens
uuacugcaaucauguugua

SEQ ID NO: 509685 - RNA, 19 nt, Homo sapiens
acucuuaccuaccaccuua

SEQ ID NO: 509686 - RNA, 19 nt, Homo sapiens
guaaagcagcagacuguaa

SEQ ID NO: 509687 - RNA, 19 nt, Homo sapiens
uaucagaccaggcagauuu

SEQ ID NO: 509688 - RNA, 19 nt, Homo sapiens
ggaagguuaucgucucugu

SEQ ID NO: 509689 - RNA, 19 nt, Homo sapiens
ccacauugguagacuccua

SEQ ID NO: 509690 - RNA, 19 nt, Homo sapiens
acuccaguguugauaauua

SEQ ID NO: 509691 - RNA, 19 nt, Homo sapiens
cauagugacagcugaauuu

SEQ ID NO: 509692 - RNA, 19 nt, Homo sapiens
caagagcguccauuccuuu

SEQ ID NO: 509693 - RNA, 19 nt, Homo sapiens
agagggagccuugcuauuu

SEQ ID NO: 509694 - RNA, 19 nt, Homo sapiens
ccauaggaauaagcaauaa

SEQ ID NO: 509695 - RNA, 19 nt, Homo sapiens
ggacgauuccucagaugaa

SEQ ID NO: 509696 - RNA, 19 nt, Homo sapiens
aaauguagcugacuuaucc

SEQ ID NO: 509697 - RNA, 19 nt, Homo sapiens
ugacagugaugaugaccuu

SEQ ID NO: 509698 - RNA, 19 nt, Homo sapiens
gagcguccauuccuuugau

SEQ ID NO: 509699 - RNA, 19 nt, Homo sapiens
ucacgcugaugaacuugua

SEQ ID NO: 509700 - RNA, 19 nt, Homo sapiens
gcugggagaugcuggauac

SEQ ID NO: 509701 - RNA, 19 nt, Homo sapiens
cuccagaauuacucaaaua

SEQ ID NO: 509702 - RNA, 19 nt, Homo sapiens
guaaggucuuuagagauuu

SEQ ID NO: 509703 - RNA, 19 nt, Homo sapiens
gcugacuuauccuauuaaa

SEQ ID NO: 509704 - RNA, 19 nt, Homo sapiens
ucaaggaaucucuuaaguu

SEQ ID NO: 509705 - RNA, 19 nt, Homo sapiens
aagcaauaauguagacuga

SEQ ID NO: 509706 - RNA, 19 nt, Homo sapiens
gacgauuccucagaugaaa

SEQ ID NO: 509707 - RNA, 19 nt, Homo sapiens
gcaggaacuuugcaagacu

SEQ ID NO: 509708 - RNA, 19 nt, Homo sapiens
acuguaaggucuuuagaga

SEQ ID NO: 509709 - RNA, 19 nt, Homo sapiens
uaaagagggagccuugcua

SEQ ID NO: 509710 - RNA, 19 nt, Homo sapiens
ccaggcagauuugaagaau

SEQ ID NO: 509711 - RNA, 19 nt, Homo sapiens
ucaguagggcgcuaaugua

SEQ ID NO: 509712 - RNA, 19 nt, Homo sapiens
gauucugagugccacauug

SEQ ID NO: 509713 - RNA, 19 nt, Homo sapiens
cuaaaguauuccacaaauc

SEQ ID NO: 509714 - RNA, 19 nt, Homo sapiens
cacaaaucuuaccucuuua

SEQ ID NO: 509715 - RNA, 19 nt, Homo sapiens
gacuaaaguauuccacaaa

SEQ ID NO: 509716 - RNA, 19 nt, Homo sapiens
gacaacaaacuaacagcuu

SEQ ID NO: 509717 - RNA, 19 nt, Homo sapiens
gaacaagagcguccauucc

SEQ ID NO: 509718 - RNA, 19 nt, Homo sapiens
gaggaagguuaucgucucu

SEQ ID NO: 509719 - RNA, 19 nt, Homo sapiens
gcauagugacagcugaauu

SEQ ID NO: 509720 - RNA, 19 nt, Homo sapiens
ucgaagauaugacagugau

SEQ ID NO: 509721 - RNA, 19 nt, Homo sapiens
gauucagucccagaucuua

SEQ ID NO: 509722 - RNA, 19 nt, Homo sapiens
gcaagacucaacuuuggau

SEQ ID NO: 509723 - RNA, 19 nt, Homo sapiens
gcgcugcucuucguguuca

SEQ ID NO: 509724 - RNA, 19 nt, Homo sapiens
gcuccagauuacuaugauu

SEQ ID NO: 509725 - RNA, 19 nt, Homo sapiens
augaugaccuugccuggaa

SEQ ID NO: 509726 - RNA, 19 nt, Homo sapiens
cuuagucguuuauuucuuc

SEQ ID NO: 509727 - RNA, 19 nt, Homo sapiens
cuaccaccuuagucguuua

SEQ ID NO: 509728 - RNA, 19 nt, Homo sapiens
gaugcuggauacguauuau

SEQ ID NO: 509729 - RNA, 19 nt, Homo sapiens
acaagagcguccauuccuu

SEQ ID NO: 509730 - RNA, 19 nt, Homo sapiens
caagggcuccuccgugugu

SEQ ID NO: 509731 - RNA, 19 nt, Homo sapiens
gaaauugggagaggaaggu

SEQ ID NO: 509732 - RNA, 19 nt, Homo sapiens
uaaagcagcagacuguaag

SEQ ID NO: 509733 - RNA, 19 nt, Homo sapiens
cuccaguguugauaauuaa

SEQ ID NO: 509734 - RNA, 19 nt, Homo sapiens
cugcaaucauguuguaguu

SEQ ID NO: 509735 - RNA, 19 nt, Homo sapiens
gaacuuugcaagacucaac

SEQ ID NO: 509736 - RNA, 19 nt, Homo sapiens
ccagaucuuauuucuuuga

SEQ ID NO: 509737 - RNA, 19 nt, Homo sapiens
cgaguuagaaauccuacaa

SEQ ID NO: 509738 - RNA, 19 nt, Homo sapiens
uauuuggagugguguuauu

SEQ ID NO: 509739 - RNA, 19 nt, Homo sapiens
uccauuccuuugauuauga

SEQ ID NO: 509740 - RNA, 19 nt, Homo sapiens
cuccaucugucucuacaaa

SEQ ID NO: 509741 - RNA, 19 nt, Homo sapiens
gguaaagacgggaaauugg

SEQ ID NO: 509742 - RNA, 19 nt, Homo sapiens
ugacuuauccuauuaaacc

SEQ ID NO: 509743 - RNA, 19 nt, Homo sapiens
gcccaaagacugguacuuc

SEQ ID NO: 509744 - RNA, 19 nt, Homo sapiens
caaagacugguacuuccuu

SEQ ID NO: 509745 - RNA, 19 nt, Homo sapiens
gauggucacuccgauucug

SEQ ID NO: 509746 - RNA, 19 nt, Homo sapiens
uauggacgauuccucagau

SEQ ID NO: 509747 - RNA, 19 nt, Homo sapiens
caguagggcgcuaauguau

SEQ ID NO: 509748 - RNA, 19 nt, Homo sapiens
cccauaggaauaagcaaua

SEQ ID NO: 509749 - RNA, 19 nt, Homo sapiens
uugcaagacucaacuuugg

SEQ ID NO: 509750 - RNA, 19 nt, Homo sapiens
gcacaagcaggaacuuugc

SEQ ID NO: 509751 - RNA, 19 nt, Homo sapiens
ggcacaagcaggaacuuug

SEQ ID NO: 509752 - RNA, 19 nt, Homo sapiens
gaccuuaccaacccuggaa

SEQ ID NO: 509753 - RNA, 19 nt, Homo sapiens
caccuuagucguuuauuuc

SEQ ID NO: 509754 - RNA, 19 nt, Homo sapiens
ccuaccaccuuagucguuu

SEQ ID NO: 509755 - RNA, 19 nt, Homo sapiens
ggagaugcuggauacguau

SEQ ID NO: 509756 - RNA, 19 nt, Homo sapiens
ucaaagccaagucaaaaua

SEQ ID NO: 509757 - RNA, 19 nt, Homo sapiens
gccacaagcggcucagcua

SEQ ID NO: 509758 - RNA, 19 nt, Homo sapiens
gagaagaggugguuuagag

SEQ ID NO: 509759 - RNA, 19 nt, Homo sapiens
gcucaacccucguaucugu

SEQ ID NO: 509760 - RNA, 19 nt, Homo sapiens
cgccugcgcuauccuauua

SEQ ID NO: 509761 - RNA, 19 nt, Homo sapiens
cggagugccugcagaagua

SEQ ID NO: 509762 - RNA, 19 nt, Homo sapiens
uaucacacaugacggguuu

SEQ ID NO: 509763 - RNA, 19 nt, Homo sapiens
ccucaccgcuuucaucuuc

SEQ ID NO: 509764 - RNA, 19 nt, Homo sapiens
ucagagaagaggugguuua

SEQ ID NO: 509765 - RNA, 19 nt, Homo sapiens
ugaacaaccucagagaaga

SEQ ID NO: 509766 - RNA, 19 nt, Homo sapiens
ggacaguguuuccuugacu

SEQ ID NO: 509767 - RNA, 19 nt, Homo sapiens
gaugaacaaccucagagaa

SEQ ID NO: 509768 - RNA, 19 nt, Homo sapiens
gagcucaacccucguaucu

SEQ ID NO: 509769 - RNA, 19 nt, Homo sapiens
ggucaauggcuuccaguug

SEQ ID NO: 509770 - RNA, 19 nt, Homo sapiens
gaguccaucuccugggaaa

SEQ ID NO: 509771 - RNA, 19 nt, Homo sapiens
gguccgccaucccaacuau

SEQ ID NO: 509772 - RNA, 19 nt, Homo sapiens
gaacaaccucagagaagag

SEQ ID NO: 509773 - RNA, 19 nt, Homo sapiens
ggcaggaauugaaggacaa

SEQ ID NO: 509774 - RNA, 19 nt, Homo sapiens
ggcgagaucugaggaugga

SEQ ID NO: 509775 - RNA, 19 nt, Homo sapiens
ugacggguuuggcuucaug

SEQ ID NO: 509776 - RNA, 19 nt, Homo sapiens
ggaauugaaggacaagagu

SEQ ID NO: 509777 - RNA, 19 nt, Homo sapiens
ggaugaacaaccucagaga

SEQ ID NO: 509778 - RNA, 19 nt, Homo sapiens
caucaugcccuacaucuac

SEQ ID NO: 509779 - RNA, 19 nt, Homo sapiens
gagcggagugccugcagaa

SEQ ID NO: 509780 - RNA, 19 nt, Homo sapiens
gcccauggccucugucauc

SEQ ID NO: 509781 - RNA, 19 nt, Homo sapiens
cgacuucaaauauuucugu

SEQ ID NO: 509782 - RNA, 19 nt, Homo sapiens
uggagcgggugaacuaaga

SEQ ID NO: 509783 - RNA, 19 nt, Homo sapiens
ucugucaucugccucauca

SEQ ID NO: 509784 - RNA, 19 nt, Homo sapiens
gaugaaggaggcagagcuu

SEQ ID NO: 509785 - RNA, 19 nt, Homo sapiens
ucaucaaccuggcccuguu

SEQ ID NO: 509786 - RNA, 19 nt, Homo sapiens
ccaggagccucgacacacu

SEQ ID NO: 509787 - RNA, 19 nt, Homo sapiens
gaggcgcacucugggaaug

SEQ ID NO: 509788 - RNA, 19 nt, Homo sapiens
gcaaaggcuaagcgaagga

SEQ ID NO: 509789 - RNA, 19 nt, Homo sapiens
ucgccacccucaccgcuuu

SEQ ID NO: 509790 - RNA, 19 nt, Homo sapiens
caccauggauaucacacau

SEQ ID NO: 509791 - RNA, 19 nt, Homo sapiens
ucaacccucguaucuguuu

SEQ ID NO: 509792 - RNA, 19 nt, Homo sapiens
uggcugggcuugagaccau

SEQ ID NO: 509793 - RNA, 19 nt, Homo sapiens
aagaggugguuuagagcaa

SEQ ID NO: 509794 - RNA, 19 nt, Homo sapiens
cagccucuuucucuacaug

SEQ ID NO: 509795 - RNA, 19 nt, Homo sapiens
cagaguggcugggcuugag

SEQ ID NO: 509796 - RNA, 19 nt, Homo sapiens
caaauauuucugugaacug

SEQ ID NO: 509797 - RNA, 19 nt, Homo sapiens
aaaugaaaccagugaccaa

SEQ ID NO: 509798 - RNA, 19 nt, Homo sapiens
cgacacacuugggacucaa

SEQ ID NO: 509799 - RNA, 19 nt, Homo sapiens
gcggacaguguuuccuuga

SEQ ID NO: 509800 - RNA, 19 nt, Homo sapiens
uuccuugacugacuauugu

SEQ ID NO: 509801 - RNA, 19 nt, Homo sapiens
gaccaggagccucgacaca

SEQ ID NO: 509802 - RNA, 19 nt, Homo sapiens
gggcggacaguguuuccuu

SEQ ID NO: 509803 - RNA, 19 nt, Homo sapiens
gcggagugccugcagaagu

SEQ ID NO: 509804 - RNA, 19 nt, Homo sapiens
guccucaccaccauggaua

SEQ ID NO: 509805 - RNA, 19 nt, Homo sapiens
gcaggaggagggucuucga

SEQ ID NO: 509806 - RNA, 19 nt, Homo sapiens
guguuuccuugacugacua

SEQ ID NO: 509807 - RNA, 19 nt, Homo sapiens
ucaucugccucaucaaugc

SEQ ID NO: 509808 - RNA, 19 nt, Homo sapiens
guaucuguuucuucgacuu

SEQ ID NO: 509809 - RNA, 19 nt, Homo sapiens
guccaucuccugggaaaug

SEQ ID NO: 509810 - RNA, 19 nt, Homo sapiens
cagagaagaggugguuuag

SEQ ID NO: 509811 - RNA, 19 nt, Homo sapiens
acuucuaccuccucuacuu

SEQ ID NO: 509812 - RNA, 19 nt, Homo sapiens
caugacggguuuggcuuca

SEQ ID NO: 509813 - RNA, 19 nt, Homo sapiens
aaccuggcccuguugauga

SEQ ID NO: 509814 - RNA, 19 nt, Homo sapiens
cuacaugaaggcgcaggua

SEQ ID NO: 509815 - RNA, 19 nt, Homo sapiens
cgacaaagcuuauguauga

SEQ ID NO: 509816 - RNA, 19 nt, Homo sapiens
ggaaauauguucaaguuug

SEQ ID NO: 509817 - RNA, 19 nt, Homo sapiens
gaaaggaccuaacucagaa

SEQ ID NO: 509818 - RNA, 19 nt, Homo sapiens
gagagaagcccaucugaua

SEQ ID NO: 509819 - RNA, 19 nt, Homo sapiens
ucacacagcugcccaguuu

SEQ ID NO: 509820 - RNA, 19 nt, Homo sapiens
ggaguuguaugaaauguuu

SEQ ID NO: 509821 - RNA, 19 nt, Homo sapiens
ggagacagccugcagcuua

SEQ ID NO: 509822 - RNA, 19 nt, Homo sapiens
agucacagcuuguaaauaa

SEQ ID NO: 509823 - RNA, 19 nt, Homo sapiens
ggaagucaguguaacauga

SEQ ID NO: 509824 - RNA, 19 nt, Homo sapiens
ggaagcagcuggccgaaug

SEQ ID NO: 509825 - RNA, 19 nt, Homo sapiens
gaaguucucucuuuaccuu

SEQ ID NO: 509826 - RNA, 19 nt, Homo sapiens
gauaucccauacagaauua

SEQ ID NO: 509827 - RNA, 19 nt, Homo sapiens
aaacugggcugauguaaau

SEQ ID NO: 509828 - RNA, 19 nt, Homo sapiens
gcagaaaucuaucuucaag

SEQ ID NO: 509829 - RNA, 19 nt, Homo sapiens
aaauaaagguggugugauu

SEQ ID NO: 509830 - RNA, 19 nt, Homo sapiens
gcacugggaguuaaauaua

SEQ ID NO: 509831 - RNA, 19 nt, Homo sapiens
caaggaaccuggaacguau

SEQ ID NO: 509832 - RNA, 19 nt, Homo sapiens
gaaacugaaagaagcauua

SEQ ID NO: 509833 - RNA, 19 nt, Homo sapiens
gggcacagaucgacucaaa

SEQ ID NO: 509834 - RNA, 19 nt, Homo sapiens
gauucgaucugcuaaguuu

SEQ ID NO: 509835 - RNA, 19 nt, Homo sapiens
gcgagaagccacccuguua

SEQ ID NO: 509836 - RNA, 19 nt, Homo sapiens
caaaugugcuuggaauuga

SEQ ID NO: 509837 - RNA, 19 nt, Homo sapiens
gaaugcuucugccucuuua

SEQ ID NO: 509838 - RNA, 19 nt, Homo sapiens
cagacuaacugauguaaug

SEQ ID NO: 509839 - RNA, 19 nt, Homo sapiens
ccuuaaagccguauacuua

SEQ ID NO: 509840 - RNA, 19 nt, Homo sapiens
gaacucaaguggacagaag

SEQ ID NO: 509841 - RNA, 19 nt, Homo sapiens
gaucgaauuugaacuggaa

SEQ ID NO: 509842 - RNA, 19 nt, Homo sapiens
gaaagucacagcuuguaaa

SEQ ID NO: 509843 - RNA, 19 nt, Homo sapiens
auaaagagaugggagauuu

SEQ ID NO: 509844 - RNA, 19 nt, Homo sapiens
gaacacgacugggauuauc

SEQ ID NO: 509845 - RNA, 19 nt, Homo sapiens
ggagguggauaaagaugaa

SEQ ID NO: 509846 - RNA, 19 nt, Homo sapiens
ggaauggaguauugcagaa

SEQ ID NO: 509847 - RNA, 19 nt, Homo sapiens
aaaguaagguguauguguu

SEQ ID NO: 509848 - RNA, 19 nt, Homo sapiens
uaauguagcuuucucucuu

SEQ ID NO: 509849 - RNA, 19 nt, Homo sapiens
gaacuucagaaucuaauga

SEQ ID NO: 509850 - RNA, 19 nt, Homo sapiens
gaaagguacugaagaaagc

SEQ ID NO: 509851 - RNA, 19 nt, Homo sapiens
ucagaguccuuauaagaaa

SEQ ID NO: 509852 - RNA, 19 nt, Homo sapiens
gaacugaagcucuuagaag

SEQ ID NO: 509853 - RNA, 19 nt, Homo sapiens
gaagaugauucaccuagag

SEQ ID NO: 509854 - RNA, 19 nt, Homo sapiens
ccagauaucccauacagaa

SEQ ID NO: 509855 - RNA, 19 nt, Homo sapiens
gaaaaugacuuuaccuaca

SEQ ID NO: 509856 - RNA, 19 nt, Homo sapiens
gagauuugauuccgucaga

SEQ ID NO: 509857 - RNA, 19 nt, Homo sapiens
uaacaaacuuggucaaacu

SEQ ID NO: 509858 - RNA, 19 nt, Homo sapiens
gcaaaugugcuuggaauug

SEQ ID NO: 509859 - RNA, 19 nt, Homo sapiens
gccguauacuuaugaauuu

SEQ ID NO: 509860 - RNA, 19 nt, Homo sapiens
cagcccaggucauaagaua

SEQ ID NO: 509861 - RNA, 19 nt, Homo sapiens
gcucagaguccuuauaaga

SEQ ID NO: 509862 - RNA, 19 nt, Homo sapiens
acaaagcucugcucacguu

SEQ ID NO: 509863 - RNA, 19 nt, Homo sapiens
gggcaaaugugcuuggaau

SEQ ID NO: 509864 - RNA, 19 nt, Homo sapiens
ccacuggucuacugaguug

SEQ ID NO: 509865 - RNA, 19 nt, Homo sapiens
agaaaucuaucuucaagga

SEQ ID NO: 509866 - RNA, 19 nt, Homo sapiens
ggaccuaacucagaagauc

SEQ ID NO: 509867 - RNA, 19 nt, Homo sapiens
gcacagaucgacucaaaca

SEQ ID NO: 509868 - RNA, 19 nt, Homo sapiens
guagauaccggugauagua

SEQ ID NO: 509869 - RNA, 19 nt, Homo sapiens
gcgcuggaguuguaugaaa

SEQ ID NO: 509870 - RNA, 19 nt, Homo sapiens
gaccgcaccuuucccugua

SEQ ID NO: 509871 - RNA, 19 nt, Homo sapiens
caaguccugugaauaaaga

SEQ ID NO: 509872 - RNA, 19 nt, Homo sapiens
aagauuagcucaagcagau

SEQ ID NO: 509873 - RNA, 19 nt, Homo sapiens
caagagaaccaauggaaug

SEQ ID NO: 509874 - RNA, 19 nt, Homo sapiens
uuaauugccuggaaaugaa

SEQ ID NO: 509875 - RNA, 19 nt, Homo sapiens
caugggauguccuaugauu

SEQ ID NO: 509876 - RNA, 19 nt, Homo sapiens
gaacauguaaauacuguca

SEQ ID NO: 509877 - RNA, 19 nt, Homo sapiens
aagaguaacuguaauugga

SEQ ID NO: 509878 - RNA, 19 nt, Homo sapiens
gcuuucgguuguaaauuua

SEQ ID NO: 509879 - RNA, 19 nt, Homo sapiens
cgugaaagguacugaagaa

SEQ ID NO: 509880 - RNA, 19 nt, Homo sapiens
cgugaaggcugagaucuuu

SEQ ID NO: 509881 - RNA, 19 nt, Homo sapiens
gcguugagauaaccaugua

SEQ ID NO: 509882 - RNA, 19 nt, Homo sapiens
cagaucgacucaaacauug

SEQ ID NO: 509883 - RNA, 19 nt, Homo sapiens
acaaauaucuguggaacau

SEQ ID NO: 509884 - RNA, 19 nt, Homo sapiens
acacaggcuucuauucaaa

SEQ ID NO: 509885 - RNA, 19 nt, Homo sapiens
gcgcuuaauugccuggaaa

SEQ ID NO: 509886 - RNA, 19 nt, Homo sapiens
uaccaaguccugugaauaa

SEQ ID NO: 509887 - RNA, 19 nt, Homo sapiens
gggauuaucugcagaaacg

SEQ ID NO: 509888 - RNA, 19 nt, Homo sapiens
uguuagaucugcgcaguua

SEQ ID NO: 509889 - RNA, 19 nt, Homo sapiens
ugaccaaacucaggacauu

SEQ ID NO: 509890 - RNA, 19 nt, Homo sapiens
gauauuccaucgugaggau

SEQ ID NO: 509891 - RNA, 19 nt, Homo sapiens
gcugaguucuguuguuguu

SEQ ID NO: 509892 - RNA, 19 nt, Homo sapiens
ccgguucucuguuggauuu

SEQ ID NO: 509893 - RNA, 19 nt, Homo sapiens
cucaggacauugcuucuua

SEQ ID NO: 509894 - RNA, 19 nt, Homo sapiens
aagaugaccucaccaagug

SEQ ID NO: 509895 - RNA, 19 nt, Homo sapiens
ccaauggauuauuugcuuu

SEQ ID NO: 509896 - RNA, 19 nt, Homo sapiens
cauaugcacugggaguuaa

SEQ ID NO: 509897 - RNA, 19 nt, Homo sapiens
gaaggccauuugucuuuca

SEQ ID NO: 509898 - RNA, 19 nt, Homo sapiens
gaagccagauaugcaaugu

SEQ ID NO: 509899 - RNA, 19 nt, Homo sapiens
gcccaaagaaggaaacaaa

SEQ ID NO: 509900 - RNA, 19 nt, Homo sapiens
cgauugcccugcauuucua

SEQ ID NO: 509901 - RNA, 19 nt, Homo sapiens
gcacacaaguccuggucau

SEQ ID NO: 509902 - RNA, 19 nt, Homo sapiens
gcauaaggaccaacagaga

SEQ ID NO: 509903 - RNA, 19 nt, Homo sapiens
ccaaggaaccuggaacgua

SEQ ID NO: 509904 - RNA, 19 nt, Homo sapiens
gcagaaacguccacaugcu

SEQ ID NO: 509905 - RNA, 19 nt, Homo sapiens
gcacuucugccaggagaua

SEQ ID NO: 509906 - RNA, 19 nt, Homo sapiens
guaccgaccugcaacuagu

SEQ ID NO: 509907 - RNA, 19 nt, Homo sapiens
cagcucagaguccuuauaa

SEQ ID NO: 509908 - RNA, 19 nt, Homo sapiens
gacuuuaccuacaacaguu

SEQ ID NO: 509909 - RNA, 19 nt, Homo sapiens
ggagacguguaaagaagau

SEQ ID NO: 509910 - RNA, 19 nt, Homo sapiens
gugaggugguuuagggaua

SEQ ID NO: 509911 - RNA, 19 nt, Homo sapiens
ggaaggccauuugucuuuc

SEQ ID NO: 509912 - RNA, 19 nt, Homo sapiens
acggaaauauguucaaguu

SEQ ID NO: 509913 - RNA, 19 nt, Homo sapiens
acuggaaguucucucuuua

SEQ ID NO: 509914 - RNA, 19 nt, Homo sapiens
ucugauaacuccuugaaca

SEQ ID NO: 509915 - RNA, 19 nt, Homo sapiens
gaaaguaucugaaagugua

SEQ ID NO: 509916 - RNA, 19 nt, Homo sapiens
gaagaaagcaguagcauuu

SEQ ID NO: 509917 - RNA, 19 nt, Homo sapiens
gaacucagcuaagagauuu

SEQ ID NO: 509918 - RNA, 19 nt, Homo sapiens
gaucaaagguacaacacua

SEQ ID NO: 509919 - RNA, 19 nt, Homo sapiens
cagaagaacuccuugcuaa

SEQ ID NO: 509920 - RNA, 19 nt, Homo sapiens
gcucaguuauuaucucuua

SEQ ID NO: 509921 - RNA, 19 nt, Homo sapiens
gaaugaaaguugaacaaga

SEQ ID NO: 509922 - RNA, 19 nt, Homo sapiens
gaacuugccacuagauuaa

SEQ ID NO: 509923 - RNA, 19 nt, Homo sapiens
aauaauggcugaagaacua

SEQ ID NO: 509924 - RNA, 19 nt, Homo sapiens
gaacugagucaaaguguuu

SEQ ID NO: 509925 - RNA, 19 nt, Homo sapiens
gaagaggaguugcagcauu

SEQ ID NO: 509926 - RNA, 19 nt, Homo sapiens
caacuagccugcaaagaga

SEQ ID NO: 509927 - RNA, 19 nt, Homo sapiens
gaagacaggcagagcaaua

SEQ ID NO: 509928 - RNA, 19 nt, Homo sapiens
ccagaaaggaggauuauuu

SEQ ID NO: 509929 - RNA, 19 nt, Homo sapiens
gaagagacgaggaaagaaa

SEQ ID NO: 509930 - RNA, 19 nt, Homo sapiens
gaaaagaaccgaaguauuc

SEQ ID NO: 509931 - RNA, 19 nt, Homo sapiens
ggaagaaaguggacgaagu

SEQ ID NO: 509932 - RNA, 19 nt, Homo sapiens
ugaaacaacugaaucacaa

SEQ ID NO: 509933 - RNA, 19 nt, Homo sapiens
gcaagaaacauuagccauu

SEQ ID NO: 509934 - RNA, 19 nt, Homo sapiens
acaaagaacuuacugaucu

SEQ ID NO: 509935 - RNA, 19 nt, Homo sapiens
caaagaagagguugagaaa

SEQ ID NO: 509936 - RNA, 19 nt, Homo sapiens
caagggauaugcuuuagug

SEQ ID NO: 509937 - RNA, 19 nt, Homo sapiens
ggacauagcuuuggaaccu

SEQ ID NO: 509938 - RNA, 19 nt, Homo sapiens
ccaaauggaagcaucuuua

SEQ ID NO: 509939 - RNA, 19 nt, Homo sapiens
cagaaaggaggauuauuua

SEQ ID NO: 509940 - RNA, 19 nt, Homo sapiens
gcacaauucuaacaucauc

SEQ ID NO: 509941 - RNA, 19 nt, Homo sapiens
ggagauacccaaacuuaga

SEQ ID NO: 509942 - RNA, 19 nt, Homo sapiens
caagaaacauuagccauuc

SEQ ID NO: 509943 - RNA, 19 nt, Homo sapiens
agacauggaugaacuugaa

SEQ ID NO: 509944 - RNA, 19 nt, Homo sapiens
uuagauagccggaguguaa

SEQ ID NO: 509945 - RNA, 19 nt, Homo sapiens
gcuaagagauuuggaucaa

SEQ ID NO: 509946 - RNA, 19 nt, Homo sapiens
ggagcaggaucaagcauau

SEQ ID NO: 509947 - RNA, 19 nt, Homo sapiens
gcaaagaagagguugagaa

SEQ ID NO: 509948 - RNA, 19 nt, Homo sapiens
agagagagaugcugcuaaa

SEQ ID NO: 509949 - RNA, 19 nt, Homo sapiens
caacuccuguuaacuguga

SEQ ID NO: 509950 - RNA, 19 nt, Homo sapiens
ggaggacuguggucgauga

SEQ ID NO: 509951 - RNA, 19 nt, Homo sapiens
gaucaauaauggcugaaga

SEQ ID NO: 509952 - RNA, 19 nt, Homo sapiens
aagaagagguugagaaaca

SEQ ID NO: 509953 - RNA, 19 nt, Homo sapiens
aagggaggcucaguuauua

SEQ ID NO: 509954 - RNA, 19 nt, Homo sapiens
gcaagacaguugaauuucu

SEQ ID NO: 509955 - RNA, 19 nt, Homo sapiens
ccugaaagaugaaauguuc

SEQ ID NO: 509956 - RNA, 19 nt, Homo sapiens
gaaaguggacgaagugcaa

SEQ ID NO: 509957 - RNA, 19 nt, Homo sapiens
agaauagacucauuuagug

SEQ ID NO: 509958 - RNA, 19 nt, Homo sapiens
ccaauagccucuccuaaag

SEQ ID NO: 509959 - RNA, 19 nt, Homo sapiens
aagaagaacuugccacuag

SEQ ID NO: 509960 - RNA, 19 nt, Homo sapiens
gaagugcaacuccuguuaa

SEQ ID NO: 509961 - RNA, 19 nt, Homo sapiens
gaagaaaguggacgaagug

SEQ ID NO: 509962 - RNA, 19 nt, Homo sapiens
gacaagagacuacagauuc

SEQ ID NO: 509963 - RNA, 19 nt, Homo sapiens
gucaagaacuccugaaaca

SEQ ID NO: 509964 - RNA, 19 nt, Homo sapiens
gaaaugaaagcuaaagaag

SEQ ID NO: 509965 - RNA, 19 nt, Homo sapiens
gagcagauccgaggguuaa

SEQ ID NO: 509966 - RNA, 19 nt, Homo sapiens
gaaaguguaauaagugaga

SEQ ID NO: 509967 - RNA, 19 nt, Homo sapiens
ugaacagccugauaucuug

SEQ ID NO: 509968 - RNA, 19 nt, Homo sapiens
ucagaagaguccaguggua

SEQ ID NO: 509969 - RNA, 19 nt, Homo sapiens
aagaggaguugcagcauuu

SEQ ID NO: 509970 - RNA, 19 nt, Homo sapiens
gcaguagcauuucuuccuu

SEQ ID NO: 509971 - RNA, 19 nt, Homo sapiens
acacuauucugcagaugua

SEQ ID NO: 509972 - RNA, 19 nt, Homo sapiens
gaagaacuccuugcuaaca

SEQ ID NO: 509973 - RNA, 19 nt, Homo sapiens
uugauaaccugaaagauga

SEQ ID NO: 509974 - RNA, 19 nt, Homo sapiens
gaguguaagugaaaucaau

SEQ ID NO: 509975 - RNA, 19 nt, Homo sapiens
ggacuguggucgaugaauc

SEQ ID NO: 509976 - RNA, 19 nt, Homo sapiens
gaauauguaagaacacuug

SEQ ID NO: 509977 - RNA, 19 nt, Homo sapiens
gggagaaauuagagaagaa

SEQ ID NO: 509978 - RNA, 19 nt, Homo sapiens
ggaacugagucaaaguguu

SEQ ID NO: 509979 - RNA, 19 nt, Homo sapiens
gaaaggaagaaagccauuu

SEQ ID NO: 509980 - RNA, 19 nt, Homo sapiens
gccgugaaaugaaagcuaa

SEQ ID NO: 509981 - RNA, 19 nt, Homo sapiens
gagaaacaacauagagaaa

SEQ ID NO: 509982 - RNA, 19 nt, Homo sapiens
ucaaagaauugcagaagca

SEQ ID NO: 509983 - RNA, 19 nt, Homo sapiens
caagacaguugaauuucug

SEQ ID NO: 509984 - RNA, 19 nt, Homo sapiens
acaacugaaucacaaguaa

SEQ ID NO: 509985 - RNA, 19 nt, Homo sapiens
gaacaagaaaggaagaaag

SEQ ID NO: 509986 - RNA, 19 nt, Homo sapiens
uguguaaacuggaggauga

SEQ ID NO: 509987 - RNA, 19 nt, Homo sapiens
cuaaagacaaggagaauga

SEQ ID NO: 509988 - RNA, 19 nt, Homo sapiens
gagaguugcuguucaucug

SEQ ID NO: 509989 - RNA, 19 nt, Homo sapiens
caugaauccuugcacauug

SEQ ID NO: 509990 - RNA, 19 nt, Homo sapiens
aaggagauacccaaacuua

SEQ ID NO: 509991 - RNA, 19 nt, Homo sapiens
guaccagguugaauuggaa

SEQ ID NO: 509992 - RNA, 19 nt, Homo sapiens
ggauagugcauacaaagaa

SEQ ID NO: 509993 - RNA, 19 nt, Homo sapiens
ggaagauguuugcaagaca

SEQ ID NO: 509994 - RNA, 19 nt, Homo sapiens
gaaaguguaauugauguga

SEQ ID NO: 509995 - RNA, 19 nt, Homo sapiens
gagagaacgugcagcuaca

SEQ ID NO: 509996 - RNA, 19 nt, Homo sapiens
gcccagaagucuauugaca

SEQ ID NO: 509997 - RNA, 19 nt, Homo sapiens
gaaauuaagagcuaaagac

SEQ ID NO: 509998 - RNA, 19 nt, Homo sapiens
caagguggcugagcagugu

SEQ ID NO: 509999 - RNA, 19 nt, Homo sapiens
gcacgaagaaacuguuaau

SEQ ID NO: 510000 - RNA, 19 nt, Homo sapiens
ggaaagaaugaaaguugaa

SEQ ID NO: 510001 - RNA, 19 nt, Homo sapiens
cagcagcaguugagagaga

SEQ ID NO: 510002 - RNA, 19 nt, Homo sapiens
gaccauugcuucgacaaau

SEQ ID NO: 510003 - RNA, 19 nt, Homo sapiens
caguugaauuucugaauga

SEQ ID NO: 510004 - RNA, 19 nt, Homo sapiens
cgaagugcaacuccuguua

SEQ ID NO: 510005 - RNA, 19 nt, Homo sapiens
gaacaauagguaccagguu

SEQ ID NO: 510006 - RNA, 19 nt, Homo sapiens
agagaaggcccaagaagaa

SEQ ID NO: 510007 - RNA, 19 nt, Homo sapiens
gguagaacgccaagagaaa

SEQ ID NO: 510008 - RNA, 19 nt, Homo sapiens
aaagggaggcucaguuauu

SEQ ID NO: 510009 - RNA, 19 nt, Homo sapiens
gaaauggaaagaaugaaag

SEQ ID NO: 510010 - RNA, 19 nt, Homo sapiens
gaaaggaggauuauuuacg

SEQ ID NO: 510011 - RNA, 19 nt, Homo sapiens
aggaaaaucugaagaagua

SEQ ID NO: 510012 - RNA, 19 nt, Homo sapiens
uaaagaaucggauaugaag

SEQ ID NO: 510013 - RNA, 19 nt, Homo sapiens
uggaaagaaugaaaguuga

SEQ ID NO: 510014 - RNA, 19 nt, Homo sapiens
guacuucuaccaccaguga

SEQ ID NO: 510015 - RNA, 19 nt, Homo sapiens
caacauggcuaugguauuu

SEQ ID NO: 510016 - RNA, 19 nt, Homo sapiens
gacgagaacuagagaaaua

SEQ ID NO: 510017 - RNA, 19 nt, Homo sapiens
cagcaaaucucaugauaaa

SEQ ID NO: 510018 - RNA, 19 nt, Homo sapiens
gauuaaaguugccaaauug

SEQ ID NO: 510019 - RNA, 19 nt, Homo sapiens
guaagacacuagagggaua

SEQ ID NO: 510020 - RNA, 19 nt, Homo sapiens
gcugaaaacugcaauauaa

SEQ ID NO: 510021 - RNA, 19 nt, Homo sapiens
gaacagauagacagacuga

SEQ ID NO: 510022 - RNA, 19 nt, Homo sapiens
gaaguugaaucugguuauu

SEQ ID NO: 510023 - RNA, 19 nt, Homo sapiens
caaauucggcuaccacuuu

SEQ ID NO: 510024 - RNA, 19 nt, Homo sapiens
gcagaagcccugaaagaaa

SEQ ID NO: 510025 - RNA, 19 nt, Homo sapiens
cgauuaaaguugccaaauu

SEQ ID NO: 510026 - RNA, 19 nt, Homo sapiens
gaaauaccgugaccuggau

SEQ ID NO: 510027 - RNA, 19 nt, Homo sapiens
ccauuuggcuucuccuuaa

SEQ ID NO: 510028 - RNA, 19 nt, Homo sapiens
ugaagaaacuccagauauc

SEQ ID NO: 510029 - RNA, 19 nt, Homo sapiens
gcuaugguauuuaguaaug

SEQ ID NO: 510030 - RNA, 19 nt, Homo sapiens
gcaacaaaguggaaaugga

SEQ ID NO: 510031 - RNA, 19 nt, Homo sapiens
gaaaaucuacggccaaaua

SEQ ID NO: 510032 - RNA, 19 nt, Homo sapiens
ggacaauggugaagaaacu

SEQ ID NO: 510033 - RNA, 19 nt, Homo sapiens
ggauaaauuuccagaucaa

SEQ ID NO: 510034 - RNA, 19 nt, Homo sapiens
cagagaggcuggugaugaa

SEQ ID NO: 510035 - RNA, 19 nt, Homo sapiens
gcucuuggaucacuuggaa

SEQ ID NO: 510036 - RNA, 19 nt, Homo sapiens
acgcaacacuucucaaauu

SEQ ID NO: 510037 - RNA, 19 nt, Homo sapiens
caagaugauuacacugaaa

SEQ ID NO: 510038 - RNA, 19 nt, Homo sapiens
gaggaagccuuggcaaaug

SEQ ID NO: 510039 - RNA, 19 nt, Homo sapiens
gcagagaggcuggugauga

SEQ ID NO: 510040 - RNA, 19 nt, Homo sapiens
gggauaaauuuccagauca

SEQ ID NO: 510041 - RNA, 19 nt, Homo sapiens
ugauuaaacccacacaaua

SEQ ID NO: 510042 - RNA, 19 nt, Homo sapiens
gcaaaucucaugauaaagg

SEQ ID NO: 510043 - RNA, 19 nt, Homo sapiens
gaagaaacuccagauauca

SEQ ID NO: 510044 - RNA, 19 nt, Homo sapiens
uagaagcccucccauacaa

SEQ ID NO: 510045 - RNA, 19 nt, Homo sapiens
acucauaugugaagaaguu

SEQ ID NO: 510046 - RNA, 19 nt, Homo sapiens
gaagaaguuaaccucaaua

SEQ ID NO: 510047 - RNA, 19 nt, Homo sapiens
ggaguggugucuagugugu

SEQ ID NO: 510048 - RNA, 19 nt, Homo sapiens
aaauucggcuaccacuuua

SEQ ID NO: 510049 - RNA, 19 nt, Homo sapiens
acaaauugcugcugaccuu

SEQ ID NO: 510050 - RNA, 19 nt, Homo sapiens
caacagacguagaggaaac

SEQ ID NO: 510051 - RNA, 19 nt, Homo sapiens
gaauccaacuucauuucug

SEQ ID NO: 510052 - RNA, 19 nt, Homo sapiens
ugaagaaguuaaccucaau

SEQ ID NO: 510053 - RNA, 19 nt, Homo sapiens
ccaagaugauuacacugaa

SEQ ID NO: 510054 - RNA, 19 nt, Homo sapiens
gaucucaucacuuauuaga

SEQ ID NO: 510055 - RNA, 19 nt, Homo sapiens
acacuucucugguggaaau

SEQ ID NO: 510056 - RNA, 19 nt, Homo sapiens
gcagcuccaucaugaacaa

SEQ ID NO: 510057 - RNA, 19 nt, Homo sapiens
ggaggaagccuuggcaaau

SEQ ID NO: 510058 - RNA, 19 nt, Homo sapiens
ggacaaccauccccauuug

SEQ ID NO: 510059 - RNA, 19 nt, Homo sapiens
uaaaggacaaggucaagaa

SEQ ID NO: 510060 - RNA, 19 nt, Homo sapiens
caaaucucaugauaaagga

SEQ ID NO: 510061 - RNA, 19 nt, Homo sapiens
gggcaaauggcuuauguga

SEQ ID NO: 510062 - RNA, 19 nt, Homo sapiens
ucucaucacuuauuagaca

SEQ ID NO: 510063 - RNA, 19 nt, Homo sapiens
gacacuagagggauaaauu

SEQ ID NO: 510064 - RNA, 19 nt, Homo sapiens
ugaccuggaugaagaugaa

SEQ ID NO: 510065 - RNA, 19 nt, Homo sapiens
gugaagaaacuccagauau

SEQ ID NO: 510066 - RNA, 19 nt, Homo sapiens
gcaaugaugaacaacaaug

SEQ ID NO: 510067 - RNA, 19 nt, Homo sapiens
ccaacgcaaugaugaacaa

SEQ ID NO: 510068 - RNA, 19 nt, Homo sapiens
gaacaacgacccaaaacuu

SEQ ID NO: 510069 - RNA, 19 nt, Homo sapiens
ccagagcacugagcagaga

SEQ ID NO: 510070 - RNA, 19 nt, Homo sapiens
ccuuacgccuguauauuaa

SEQ ID NO: 510071 - RNA, 19 nt, Homo sapiens
caacacuucucugguggaa

SEQ ID NO: 510072 - RNA, 19 nt, Homo sapiens
gguagaagcccucccauac

SEQ ID NO: 510073 - RNA, 19 nt, Homo sapiens
cgacgaagaaccaaauuca

SEQ ID NO: 510074 - RNA, 19 nt, Homo sapiens
gagcugaggacccuggaaa

SEQ ID NO: 510075 - RNA, 19 nt, Homo sapiens
cuccagauaucaaggaauu

SEQ ID NO: 510076 - RNA, 19 nt, Homo sapiens
gaucaacauggcuauggua

SEQ ID NO: 510077 - RNA, 19 nt, Homo sapiens
aaacgcaacacuucucaaa

SEQ ID NO: 510078 - RNA, 19 nt, Homo sapiens
gugaaggccugcgcacuga

SEQ ID NO: 510079 - RNA, 19 nt, Homo sapiens
uaaagaacaacgacccaaa

SEQ ID NO: 510080 - RNA, 19 nt, Homo sapiens
gaaacgcuggaacggauaa

SEQ ID NO: 510081 - RNA, 19 nt, Homo sapiens
ggugaagaaacuccagaua

SEQ ID NO: 510082 - RNA, 19 nt, Homo sapiens
cagaagcccugaaagaaaa

SEQ ID NO: 510083 - RNA, 19 nt, Homo sapiens
gauuaaacccacacaauac

SEQ ID NO: 510084 - RNA, 19 nt, Homo sapiens
ugcacacgcucaugaguaa

SEQ ID NO: 510085 - RNA, 19 nt, Homo sapiens
acacuagagggauaaauuu

SEQ ID NO: 510086 - RNA, 19 nt, Homo sapiens
ggcaaaugcuucagaugca

SEQ ID NO: 510087 - RNA, 19 nt, Homo sapiens
cauuagugauuucagcaaa

SEQ ID NO: 510088 - RNA, 19 nt, Homo sapiens
ggaguuauuuucauuagug

SEQ ID NO: 510089 - RNA, 19 nt, Homo sapiens
gggcucaacagcgugauua

SEQ ID NO: 510090 - RNA, 19 nt, Homo sapiens
ccugcgcacugaacuguaa

SEQ ID NO: 510091 - RNA, 19 nt, Homo sapiens
gagcuggacccugauaaug

SEQ ID NO: 510092 - RNA, 19 nt, Homo sapiens
gaaagaaaacucauaugug

SEQ ID NO: 510093 - RNA, 19 nt, Homo sapiens
uggcuaugguauuuaguaa

SEQ ID NO: 510094 - RNA, 19 nt, Homo sapiens
aaauggagauugugagcau

SEQ ID NO: 510095 - RNA, 19 nt, Homo sapiens
ggaaacgcuggaacggaua

SEQ ID NO: 510096 - RNA, 19 nt, Homo sapiens
gcaggaugccggacaaugg

SEQ ID NO: 510097 - RNA, 19 nt, Homo sapiens
guacagacgagaacuagag

SEQ ID NO: 510098 - RNA, 19 nt, Homo sapiens
guagaagcccucccauaca

SEQ ID NO: 510099 - RNA, 19 nt, Homo sapiens
agcagcagcuccaucauga

SEQ ID NO: 510100 - RNA, 19 nt, Homo sapiens
gccggacaauggugaagaa

SEQ ID NO: 510101 - RNA, 19 nt, Homo sapiens
ggauguguucuauugauga

SEQ ID NO: 510102 - RNA, 19 nt, Homo sapiens
ccucaaggcauaugcagaa

SEQ ID NO: 510103 - RNA, 19 nt, Homo sapiens
aagcaaaggaguuuaagga

SEQ ID NO: 510104 - RNA, 19 nt, Homo sapiens
gaaaggucuggguuccuaa

SEQ ID NO: 510105 - RNA, 19 nt, Homo sapiens
gagcagagaggcuggugau

SEQ ID NO: 510106 - RNA, 19 nt, Homo sapiens
gaugagcuggacccugaua

SEQ ID NO: 510107 - RNA, 19 nt, Homo sapiens
gcuggacccugauaaugca

SEQ ID NO: 510108 - RNA, 19 nt, Homo sapiens
gucccugaguguucuuuaa

SEQ ID NO: 510109 - RNA, 19 nt, Homo sapiens
caaugaugaacaacaauga

SEQ ID NO: 510110 - RNA, 19 nt, Homo sapiens
cagacgagaacuagagaaa

SEQ ID NO: 510111 - RNA, 19 nt, Homo sapiens
gugggcaaauggcuuaugu

SEQ ID NO: 510112 - RNA, 19 nt, Homo sapiens
cagaacagauagacagacu

SEQ ID NO: 510113 - RNA, 19 nt, Homo sapiens
ccuuugaacuggauguguu

SEQ ID NO: 510114 - RNA, 19 nt, Homo sapiens
gaagacacugaauguggaa

SEQ ID NO: 510115 - RNA, 19 nt, Homo sapiens
uaacagagcucacuaauga

SEQ ID NO: 510116 - RNA, 19 nt, Homo sapiens
ggagaaguaugcaaaguaa

SEQ ID NO: 510117 - RNA, 19 nt, Homo sapiens
gaagaaagaacacaagaaa

SEQ ID NO: 510118 - RNA, 19 nt, Homo sapiens
uggaucagcuugugaaaua

SEQ ID NO: 510119 - RNA, 19 nt, Homo sapiens
gaugcagccucauauauuu

SEQ ID NO: 510120 - RNA, 19 nt, Homo sapiens
gcaaauauccaguuucuuc

SEQ ID NO: 510121 - RNA, 19 nt, Homo sapiens
ccugagaggucccauauuu

SEQ ID NO: 510122 - RNA, 19 nt, Homo sapiens
gaagagaauugaucagucu

SEQ ID NO: 510123 - RNA, 19 nt, Homo sapiens
gaacaaccaggaagcuaua

SEQ ID NO: 510124 - RNA, 19 nt, Homo sapiens
gaugaaauccuaggguuua

SEQ ID NO: 510125 - RNA, 19 nt, Homo sapiens
gauccgaacugaugucuuc

SEQ ID NO: 510126 - RNA, 19 nt, Homo sapiens
caugauagguguuuagaga

SEQ ID NO: 510127 - RNA, 19 nt, Homo sapiens
gaaguuagccucugaaagg

SEQ ID NO: 510128 - RNA, 19 nt, Homo sapiens
ccaggaagcuauaugagaa

SEQ ID NO: 510129 - RNA, 19 nt, Homo sapiens
gaacugaugucuucuuuug

SEQ ID NO: 510130 - RNA, 19 nt, Homo sapiens
cuuuaaagguggaacauua

SEQ ID NO: 510131 - RNA, 19 nt, Homo sapiens
gaauugaucagucuaaguu

SEQ ID NO: 510132 - RNA, 19 nt, Homo sapiens
ggacuuagcacucuguaga

SEQ ID NO: 510133 - RNA, 19 nt, Homo sapiens
cuaaagauuugcguagaua

SEQ ID NO: 510134 - RNA, 19 nt, Homo sapiens
ggaggcaacacagauauua

SEQ ID NO: 510135 - RNA, 19 nt, Homo sapiens
uaaaauagaugccucagaa

SEQ ID NO: 510136 - RNA, 19 nt, Homo sapiens
guagguaguuugccuggaa

SEQ ID NO: 510137 - RNA, 19 nt, Homo sapiens
gaaagaagaaagaacacaa

SEQ ID NO: 510138 - RNA, 19 nt, Homo sapiens
gcaugcaaauauccaguuu

SEQ ID NO: 510139 - RNA, 19 nt, Homo sapiens
gaaucaagaucuucuacuc

SEQ ID NO: 510140 - RNA, 19 nt, Homo sapiens
cuagggauauuguuccuuu

SEQ ID NO: 510141 - RNA, 19 nt, Homo sapiens
agauagggcuaauuacaaa

SEQ ID NO: 510142 - RNA, 19 nt, Homo sapiens
ggaacagaaucaagaucuu

SEQ ID NO: 510143 - RNA, 19 nt, Homo sapiens
gacaagaagauaaagauga

SEQ ID NO: 510144 - RNA, 19 nt, Homo sapiens
gcaaucagcaguuggacuu

SEQ ID NO: 510145 - RNA, 19 nt, Homo sapiens
gaaguccacuagggauauu

SEQ ID NO: 510146 - RNA, 19 nt, Homo sapiens
ggauucagguuccuuugug

SEQ ID NO: 510147 - RNA, 19 nt, Homo sapiens
ugauagguguuuagagaaa

SEQ ID NO: 510148 - RNA, 19 nt, Homo sapiens
gaagaauggcagcaaguug

SEQ ID NO: 510149 - RNA, 19 nt, Homo sapiens
gcuucuacccaucaaauua

SEQ ID NO: 510150 - RNA, 19 nt, Homo sapiens
gaacaaggaacagaaucaa

SEQ ID NO: 510151 - RNA, 19 nt, Homo sapiens
caugggaaaugccacugua

SEQ ID NO: 510152 - RNA, 19 nt, Homo sapiens
aaaguggaauucaaccauu

SEQ ID NO: 510153 - RNA, 19 nt, Homo sapiens
gaaagaacacaagaaagug

SEQ ID NO: 510154 - RNA, 19 nt, Homo sapiens
cagauacagugacaaugaa

SEQ ID NO: 510155 - RNA, 19 nt, Homo sapiens
caaccaggaagcuauauga

SEQ ID NO: 510156 - RNA, 19 nt, Homo sapiens
acaggcagcuaagaaagua

SEQ ID NO: 510157 - RNA, 19 nt, Homo sapiens
gaacagaaucaagaucuuc

SEQ ID NO: 510158 - RNA, 19 nt, Homo sapiens
ggaacaaccaggaagcuau

SEQ ID NO: 510159 - RNA, 19 nt, Homo sapiens
ggacuucuccagugacgaa

SEQ ID NO: 510160 - RNA, 19 nt, Homo sapiens
gcugaaggauugcaaaauu

SEQ ID NO: 510161 - RNA, 19 nt, Homo sapiens
uagucaagcugcacagauu

SEQ ID NO: 510162 - RNA, 19 nt, Homo sapiens
gcaucagcauugcagauug

SEQ ID NO: 510163 - RNA, 19 nt, Homo sapiens
cagaauggaaguaaugauu

SEQ ID NO: 510164 - RNA, 19 nt, Homo sapiens
ggaacaaggaacagaauca

SEQ ID NO: 510165 - RNA, 19 nt, Homo sapiens
ccgaacugaugucuucuuu

SEQ ID NO: 510166 - RNA, 19 nt, Homo sapiens
aaguggaauucaaccauua

SEQ ID NO: 510167 - RNA, 19 nt, Homo sapiens
agaaagaacacaagaaagu

SEQ ID NO: 510168 - RNA, 19 nt, Homo sapiens
ugaagccacuccacuagga

SEQ ID NO: 510169 - RNA, 19 nt, Homo sapiens
aaucgccucucuccaguaa

SEQ ID NO: 510170 - RNA, 19 nt, Homo sapiens
cccaucaaauuacaguaua

SEQ ID NO: 510171 - RNA, 19 nt, Homo sapiens
aagacaaguugaagaguga

SEQ ID NO: 510172 - RNA, 19 nt, Homo sapiens
agaaguggcuaagcaauca

SEQ ID NO: 510173 - RNA, 19 nt, Homo sapiens
gaggagaaguaugcaaagu

SEQ ID NO: 510174 - RNA, 19 nt, Homo sapiens
auaugaagcugcagcauca

SEQ ID NO: 510175 - RNA, 19 nt, Homo sapiens
caaccauuauguccugaga

SEQ ID NO: 510176 - RNA, 19 nt, Homo sapiens
gaagaaggaaagaagaaag

SEQ ID NO: 510177 - RNA, 19 nt, Homo sapiens
acagauacagugacaauga

SEQ ID NO: 510178 - RNA, 19 nt, Homo sapiens
gauaaacccagacaagaag

SEQ ID NO: 510179 - RNA, 19 nt, Homo sapiens
acacugccuuuguagcuaa

SEQ ID NO: 510180 - RNA, 19 nt, Homo sapiens
aaacuguugucucucauuc

SEQ ID NO: 510181 - RNA, 19 nt, Homo sapiens
gaauuccugucuccuccaa

SEQ ID NO: 510182 - RNA, 19 nt, Homo sapiens
ggucccauauuucagauca

SEQ ID NO: 510183 - RNA, 19 nt, Homo sapiens
gaacuacaggcagcuaaga

SEQ ID NO: 510184 - RNA, 19 nt, Homo sapiens
gaaaauacaaggcagaaug

SEQ ID NO: 510185 - RNA, 19 nt, Homo sapiens
caagcugcacagauucuua

SEQ ID NO: 510186 - RNA, 19 nt, Homo sapiens
ucacuggcaugcaaauauc

SEQ ID NO: 510187 - RNA, 19 nt, Homo sapiens
ugauaaacccagacaagaa

SEQ ID NO: 510188 - RNA, 19 nt, Homo sapiens
ggaauucaaccauuauguc

SEQ ID NO: 510189 - RNA, 19 nt, Homo sapiens
guaauugccuguguagaac

SEQ ID NO: 510190 - RNA, 19 nt, Homo sapiens
gguacuuuaugccaacauu

SEQ ID NO: 510191 - RNA, 19 nt, Homo sapiens
ugaugcagccucauauauu

SEQ ID NO: 510192 - RNA, 19 nt, Homo sapiens
gaggaaagggauucagguu

SEQ ID NO: 510193 - RNA, 19 nt, Homo sapiens
gcuucuccuucacugauua

SEQ ID NO: 510194 - RNA, 19 nt, Homo sapiens
acaaggaacagaaucaaga

SEQ ID NO: 510195 - RNA, 19 nt, Homo sapiens
gaaacugagggaacaagga

SEQ ID NO: 510196 - RNA, 19 nt, Homo sapiens
cagauagggcuaauuacaa

SEQ ID NO: 510197 - RNA, 19 nt, Homo sapiens
ccagauagggcuaauuaca

SEQ ID NO: 510198 - RNA, 19 nt, Homo sapiens
ugagaggucccauauuuca

SEQ ID NO: 510199 - RNA, 19 nt, Homo sapiens
cuacuccucugccaacaau

SEQ ID NO: 510200 - RNA, 19 nt, Homo sapiens
caacucacacugccuuugu

SEQ ID NO: 510201 - RNA, 19 nt, Homo sapiens
caagcagccuccacugagu

SEQ ID NO: 510202 - RNA, 19 nt, Homo sapiens
gagaauugaucagucuaag

SEQ ID NO: 510203 - RNA, 19 nt, Homo sapiens
cuccuucacugauuaaaga

SEQ ID NO: 510204 - RNA, 19 nt, Homo sapiens
gcaagucuagccaugauag

SEQ ID NO: 510205 - RNA, 19 nt, Homo sapiens
aaagaacacaagaaaguga

SEQ ID NO: 510206 - RNA, 19 nt, Homo sapiens
guggaaauaaacacuagua

SEQ ID NO: 510207 - RNA, 19 nt, Homo sapiens
gaagcugcauuugaugaag

SEQ ID NO: 510208 - RNA, 19 nt, Homo sapiens
auucuuagcucagauccua

SEQ ID NO: 510209 - RNA, 19 nt, Homo sapiens
guaacagagcucacuaaug

SEQ ID NO: 510210 - RNA, 19 nt, Homo sapiens
gaaaauauuugcgguagag

SEQ ID NO: 510211 - RNA, 19 nt, Homo sapiens
ugacagauacagugacaau

SEQ ID NO: 510212 - RNA, 19 nt, Homo sapiens
caaggcagaauggaaguaa

SEQ ID NO: 510213 - RNA, 19 nt, Homo sapiens
gccaacaauuucuucuuca

SEQ ID NO: 510214 - RNA, 19 nt, Homo sapiens
aaagguggaacauuauuug

SEQ ID NO: 510215 - RNA, 19 nt, Homo sapiens
gacaugggcuauaagaaua

SEQ ID NO: 510216 - RNA, 19 nt, Homo sapiens
gagacaaucuuucauguuc

SEQ ID NO: 510217 - RNA, 19 nt, Homo sapiens
gaaaacgucuuccuucuuu

SEQ ID NO: 510218 - RNA, 19 nt, Homo sapiens
uaagagugguggccuauuu

SEQ ID NO: 510219 - RNA, 19 nt, Homo sapiens
guacacuguuuccauguua

SEQ ID NO: 510220 - RNA, 19 nt, Homo sapiens
gcagggacaugggcuauaa

SEQ ID NO: 510221 - RNA, 19 nt, Homo sapiens
gcuagucacuggaaauuga

SEQ ID NO: 510222 - RNA, 19 nt, Homo sapiens
gaacacaagugccggcaau

SEQ ID NO: 510223 - RNA, 19 nt, Homo sapiens
gcacuacucuaccaugguu

SEQ ID NO: 510224 - RNA, 19 nt, Homo sapiens
caagauggcuuugaacuca

SEQ ID NO: 510225 - RNA, 19 nt, Homo sapiens
ccaaggugcuucucauuga

SEQ ID NO: 510226 - RNA, 19 nt, Homo sapiens
aaucaaggaugcucaguuu

SEQ ID NO: 510227 - RNA, 19 nt, Homo sapiens
ggacaugggcuauaagaau

SEQ ID NO: 510228 - RNA, 19 nt, Homo sapiens
gcaagaaugaaaugaauga

SEQ ID NO: 510229 - RNA, 19 nt, Homo sapiens
gacaaucuuucauguucua

SEQ ID NO: 510230 - RNA, 19 nt, Homo sapiens
gaacauuccagauaccuau

SEQ ID NO: 510231 - RNA, 19 nt, Homo sapiens
gcaaugucgauaucuauaa

SEQ ID NO: 510232 - RNA, 19 nt, Homo sapiens
ggacuuaaccuugaaaugg

SEQ ID NO: 510233 - RNA, 19 nt, Homo sapiens
ucaaggaugcucaguuuaa

SEQ ID NO: 510234 - RNA, 19 nt, Homo sapiens
ggacuggauuuaucgacaa

SEQ ID NO: 510235 - RNA, 19 nt, Homo sapiens
caagcaggcugguuugcaa

SEQ ID NO: 510236 - RNA, 19 nt, Homo sapiens
guacgggaaugugauggua

SEQ ID NO: 510237 - RNA, 19 nt, Homo sapiens
gaaacuguaucaccuuugc

SEQ ID NO: 510238 - RNA, 19 nt, Homo sapiens
gaccaaacuucauccuuca

SEQ ID NO: 510239 - RNA, 19 nt, Homo sapiens
gacuuaaccuugaaaugga

SEQ ID NO: 510240 - RNA, 19 nt, Homo sapiens
guaguccaccuucauuuaa

SEQ ID NO: 510241 - RNA, 19 nt, Homo sapiens
gaugguggccagaaauaaa

SEQ ID NO: 510242 - RNA, 19 nt, Homo sapiens
auucagaggucacuucauu

SEQ ID NO: 510243 - RNA, 19 nt, Homo sapiens
caacagcagauaugucuau

SEQ ID NO: 510244 - RNA, 19 nt, Homo sapiens
gaaauggaaagucuugcaa

SEQ ID NO: 510245 - RNA, 19 nt, Homo sapiens
gaagcaaagugcccauggu

SEQ ID NO: 510246 - RNA, 19 nt, Homo sapiens
gcagacggcuaauccacau

SEQ ID NO: 510247 - RNA, 19 nt, Homo sapiens
uauuggaccuuacuaugaa

SEQ ID NO: 510248 - RNA, 19 nt, Homo sapiens
caccuucauuuaacucuuu

SEQ ID NO: 510249 - RNA, 19 nt, Homo sapiens
cauguuauguuucuacaca

SEQ ID NO: 510250 - RNA, 19 nt, Homo sapiens
gccaaggaauaguggauga

SEQ ID NO: 510251 - RNA, 19 nt, Homo sapiens
augacuggcuccugacuua

SEQ ID NO: 510252 - RNA, 19 nt, Homo sapiens
uaucaccuuugccaaguaa

SEQ ID NO: 510253 - RNA, 19 nt, Homo sapiens
caccagcuauuggaccuua

SEQ ID NO: 510254 - RNA, 19 nt, Homo sapiens
ccuaaaagguguuguaaug

SEQ ID NO: 510255 - RNA, 19 nt, Homo sapiens
gcuaggacuuaaccuugaa

SEQ ID NO: 510256 - RNA, 19 nt, Homo sapiens
ccaagugccauaaccauga

SEQ ID NO: 510257 - RNA, 19 nt, Homo sapiens
caaguaguccaccuucauu

SEQ ID NO: 510258 - RNA, 19 nt, Homo sapiens
acagcaagauggcuuugaa

SEQ ID NO: 510259 - RNA, 19 nt, Homo sapiens
cgugcaugauuuacucuua

SEQ ID NO: 510260 - RNA, 19 nt, Homo sapiens
aaagugauuucucauccaa

SEQ ID NO: 510261 - RNA, 19 nt, Homo sapiens
ggacgagaaucgguguguu

SEQ ID NO: 510262 - RNA, 19 nt, Homo sapiens
aaacuuagcuuuugauguc

SEQ ID NO: 510263 - RNA, 19 nt, Homo sapiens
gguacacuguuuccauguu

SEQ ID NO: 510264 - RNA, 19 nt, Homo sapiens
ccaagaccaagaacaauga

SEQ ID NO: 510265 - RNA, 19 nt, Homo sapiens
cuguaaaguucaauuguga

SEQ ID NO: 510266 - RNA, 19 nt, Homo sapiens
caggucauauugaacauuc

SEQ ID NO: 510267 - RNA, 19 nt, Homo sapiens
ggacagugugcaccucaaa

SEQ ID NO: 510268 - RNA, 19 nt, Homo sapiens
gcgaagaagagaaagaugu

SEQ ID NO: 510269 - RNA, 19 nt, Homo sapiens
guaucaccuuugccaagua

SEQ ID NO: 510270 - RNA, 19 nt, Homo sapiens
gcaccauguuggccucuuc

SEQ ID NO: 510271 - RNA, 19 nt, Homo sapiens
cagcagauaugucuaugac

SEQ ID NO: 510272 - RNA, 19 nt, Homo sapiens
gaaagggaagaccucagaa

SEQ ID NO: 510273 - RNA, 19 nt, Homo sapiens
ggccuacucuggaaguuca

SEQ ID NO: 510274 - RNA, 19 nt, Homo sapiens
gcaccucaaagacuaagaa

SEQ ID NO: 510275 - RNA, 19 nt, Homo sapiens
caaggaugcucaguuuaag

SEQ ID NO: 510276 - RNA, 19 nt, Homo sapiens
gcugcuggaugacuugaga

SEQ ID NO: 510277 - RNA, 19 nt, Homo sapiens
cagugcuccuggaaacuua

SEQ ID NO: 510278 - RNA, 19 nt, Homo sapiens
cagccuaccucuccacaag

SEQ ID NO: 510279 - RNA, 19 nt, Homo sapiens
cuggaugacuugagaugaa

SEQ ID NO: 510280 - RNA, 19 nt, Homo sapiens
ggcaaugucgauaucuaua

SEQ ID NO: 510281 - RNA, 19 nt, Homo sapiens
gcaggcugguuugcaagaa

SEQ ID NO: 510282 - RNA, 19 nt, Homo sapiens
gccauaaccaugagcacua

SEQ ID NO: 510283 - RNA, 19 nt, Homo sapiens
cauggguggugacguggua

SEQ ID NO: 510284 - RNA, 19 nt, Homo sapiens
ggaguguacgggaauguga

SEQ ID NO: 510285 - RNA, 19 nt, Homo sapiens
agaagccucugacuuucaa

SEQ ID NO: 510286 - RNA, 19 nt, Homo sapiens
uuaugaaacugaacacaag

SEQ ID NO: 510287 - RNA, 19 nt, Homo sapiens
ggauccaccagcuuuauga

SEQ ID NO: 510288 - RNA, 19 nt, Homo sapiens
uauuucagcugcuuugaca

SEQ ID NO: 510289 - RNA, 19 nt, Homo sapiens
ggaagcaauugaaaaggaa

SEQ ID NO: 510290 - RNA, 19 nt, Homo sapiens
gcuauuggaccuuacuaug

SEQ ID NO: 510291 - RNA, 19 nt, Homo sapiens
cuauuggaccuuacuauga

SEQ ID NO: 510292 - RNA, 19 nt, Homo sapiens
cagcggauccaccagcuuu

SEQ ID NO: 510293 - RNA, 19 nt, Homo sapiens
gugugcaccucaaagacua

SEQ ID NO: 510294 - RNA, 19 nt, Homo sapiens
aguuuaagguacacuguuu

SEQ ID NO: 510295 - RNA, 19 nt, Homo sapiens
gagaugcaacagcagauau

SEQ ID NO: 510296 - RNA, 19 nt, Homo sapiens
caaacuucauccuucagau

SEQ ID NO: 510297 - RNA, 19 nt, Homo sapiens
agaagagaaagauguguuu

SEQ ID NO: 510298 - RNA, 19 nt, Homo sapiens
ggaugguggccagaaauaa

SEQ ID NO: 510299 - RNA, 19 nt, Homo sapiens
gugcaugauuuacucuuag

SEQ ID NO: 510300 - RNA, 19 nt, Homo sapiens
gacuggauuuaucgacaaa

SEQ ID NO: 510301 - RNA, 19 nt, Homo sapiens
gguauucacggacuggauu

SEQ ID NO: 510302 - RNA, 19 nt, Homo sapiens
ggucuccaccugcacauug

SEQ ID NO: 510303 - RNA, 19 nt, Homo sapiens
gccaaggugcuucucauug

SEQ ID NO: 510304 - RNA, 19 nt, Homo sapiens
ggaaguucaugggcagcaa

SEQ ID NO: 510305 - RNA, 19 nt, Homo sapiens
gcaagauggcuuugaacuc

SEQ ID NO: 510306 - RNA, 19 nt, Homo sapiens
gcuccugacuuaacguucu

SEQ ID NO: 510307 - RNA, 19 nt, Homo sapiens
aguaguccaccuucauuua

SEQ ID NO: 510308 - RNA, 19 nt, Homo sapiens
gggaagcaauugaaaagga

SEQ ID NO: 510309 - RNA, 19 nt, Homo sapiens
ccacauggucuucguccuu

SEQ ID NO: 510310 - RNA, 19 nt, Homo sapiens
caaauuaugacuccaagac

SEQ ID NO: 510311 - RNA, 19 nt, Homo sapiens
aaacgucuuccuucuuuau

SEQ ID NO: 510312 - RNA, 19 nt, Homo sapiens
aauggaaagucuugcaauc

SEQ ID NO: 510313 - RNA, 19 nt, Homo sapiens
cgaagaagagaaagaugug

SEQ ID NO: 510314 - RNA, 19 nt, Homo sapiens
uugaaacuguaucaccuuu

SEQ ID NO: 510315 - RNA, 19 nt, Homo sapiens
ggaaagaacuugcauguug

SEQ ID NO: 510316 - RNA, 19 nt, Homo sapiens
gagguuggaucaaguuuaa

SEQ ID NO: 510317 - RNA, 19 nt, Homo sapiens
gaacuugcauguuggugaa

SEQ ID NO: 510318 - RNA, 19 nt, Homo sapiens
gcaaagagguuggaucaag

SEQ ID NO: 510319 - RNA, 19 nt, Homo sapiens
guaaugcaguuuaaucaga

SEQ ID NO: 510320 - RNA, 19 nt, Homo sapiens
gcaagcaggcgaaucguaa

SEQ ID NO: 510321 - RNA, 19 nt, Homo sapiens
uggcugagaucgagaaauu

SEQ ID NO: 510322 - RNA, 19 nt, Homo sapiens
cacaagcauugccuucuua

SEQ ID NO: 510323 - RNA, 19 nt, Homo sapiens
aagcauugccuucuuauuu

SEQ ID NO: 510324 - RNA, 19 nt, Homo sapiens
ucaaagaacuacugacaac

SEQ ID NO: 510325 - RNA, 19 nt, Homo sapiens
caaagagguuggaucaagu

SEQ ID NO: 510326 - RNA, 19 nt, Homo sapiens
ccacaagcauugccuucuu

SEQ ID NO: 510327 - RNA, 19 nt, Homo sapiens
ccacugccuuccaaagaaa

SEQ ID NO: 510328 - RNA, 19 nt, Homo sapiens
ccaaagaaacgauugaaca

SEQ ID NO: 510329 - RNA, 19 nt, Homo sapiens
agacagagacgcaagagaa

SEQ ID NO: 510330 - RNA, 19 nt, Homo sapiens
guacauuccacaagcauug

SEQ ID NO: 510331 - RNA, 19 nt, Homo sapiens
gcauugccuucuuauuuua

SEQ ID NO: 510332 - RNA, 19 nt, Homo sapiens
gaagcaagcaggcgaaucg

SEQ ID NO: 510333 - RNA, 19 nt, Homo sapiens
caucaaagaacuacugaca

SEQ ID NO: 510334 - RNA, 19 nt, Homo sapiens
ggaucaaguuuaaaugacu

SEQ ID NO: 510335 - RNA, 19 nt, Homo sapiens
gacagagacgcaagagaaa

SEQ ID NO: 510336 - RNA, 19 nt, Homo sapiens
caauaugcacuguacauuc

SEQ ID NO: 510337 - RNA, 19 nt, Homo sapiens
agaccagacuucgcucgua

SEQ ID NO: 510338 - RNA, 19 nt, Homo sapiens
aagaacuacugacaacgaa

SEQ ID NO: 510339 - RNA, 19 nt, Homo sapiens
caaagaaacgauugaacag

SEQ ID NO: 510340 - RNA, 19 nt, Homo sapiens
gcagggaaggaaagaacuu

SEQ ID NO: 510341 - RNA, 19 nt, Homo sapiens
ccaauaugcacuguacauu

SEQ ID NO: 510342 - RNA, 19 nt, Homo sapiens
gcaggcgaaucguaaugag

SEQ ID NO: 510343 - RNA, 19 nt, Homo sapiens
aggcuguaaugcaguuuaa

SEQ ID NO: 510344 - RNA, 19 nt, Homo sapiens
aaagaacuacugacaacga

SEQ ID NO: 510345 - RNA, 19 nt, Homo sapiens
gcacuguacauuccacaag

SEQ ID NO: 510346 - RNA, 19 nt, Homo sapiens
agucgaaacugaagaagac

SEQ ID NO: 510347 - RNA, 19 nt, Homo sapiens
gcuguaaugcaguuuaauc

SEQ ID NO: 510348 - RNA, 19 nt, Homo sapiens
ggaaggaaagaacuugcau

SEQ ID NO: 510349 - RNA, 19 nt, Homo sapiens
uuucccaucugucuaucua

SEQ ID NO: 510350 - RNA, 19 nt, Homo sapiens
gcuguuuaacuuuguaaga

SEQ ID NO: 510351 - RNA, 19 nt, Homo sapiens
aaacugaagaagacagaga

SEQ ID NO: 510352 - RNA, 19 nt, Homo sapiens
gguuggaucaaguuuaaau

SEQ ID NO: 510353 - RNA, 19 nt, Homo sapiens
uccacugccuuccaaagaa

SEQ ID NO: 510354 - RNA, 19 nt, Homo sapiens
ucacaucaaagaacuacug

SEQ ID NO: 510355 - RNA, 19 nt, Homo sapiens
aaggaaagaacuugcaugu

SEQ ID NO: 510356 - RNA, 19 nt, Homo sapiens
cgaaacugaagaagacaga

SEQ ID NO: 510357 - RNA, 19 nt, Homo sapiens
agagguuggaucaaguuua

SEQ ID NO: 510358 - RNA, 19 nt, Homo sapiens
aaagagguuggaucaaguu

SEQ ID NO: 510359 - RNA, 19 nt, Homo sapiens
gauaagucgaaacugaaga

SEQ ID NO: 510360 - RNA, 19 nt, Homo sapiens
uguaagaugcaaagagguu

SEQ ID NO: 510361 - RNA, 19 nt, Homo sapiens
caagcauugccuucuuauu

SEQ ID NO: 510362 - RNA, 19 nt, Homo sapiens
ccgccaauaugcacuguac

SEQ ID NO: 510363 - RNA, 19 nt, Homo sapiens
gaagacagagacgcaagag

SEQ ID NO: 510364 - RNA, 19 nt, Homo sapiens
aauaugcacuguacauucc

SEQ ID NO: 510365 - RNA, 19 nt, Homo sapiens
gccaauaugcacuguacau

SEQ ID NO: 510366 - RNA, 19 nt, Homo sapiens
cgauugaacaggagaagca

SEQ ID NO: 510367 - RNA, 19 nt, Homo sapiens
gcgcugccuuucccaucug

SEQ ID NO: 510368 - RNA, 19 nt, Homo sapiens
caggcuguaaugcaguuua

SEQ ID NO: 510369 - RNA, 19 nt, Homo sapiens
ccacugcgcagaccagacu

SEQ ID NO: 510370 - RNA, 19 nt, Homo sapiens
ggucuuggcugcugccuua

SEQ ID NO: 510371 - RNA, 19 nt, Homo sapiens
uaaaugguuugaacucuca

SEQ ID NO: 510372 - RNA, 19 nt, Homo sapiens
caagaagaacuacgucuga

SEQ ID NO: 510373 - RNA, 19 nt, Homo sapiens
uaacagacggaaugaaguu

SEQ ID NO: 510374 - RNA, 19 nt, Homo sapiens
ggagugggaaggcuaagaa

SEQ ID NO: 510375 - RNA, 19 nt, Homo sapiens
agaaucugcuuaguaaaug

SEQ ID NO: 510376 - RNA, 19 nt, Homo sapiens
gaggcgugcucuaccuguu

SEQ ID NO: 510377 - RNA, 19 nt, Homo sapiens
gaaugaaguuuccuuuucu

SEQ ID NO: 510378 - RNA, 19 nt, Homo sapiens
gaaucugcuuaguaaaugg

SEQ ID NO: 510379 - RNA, 19 nt, Homo sapiens
gaccuucuccugccacuag

SEQ ID NO: 510380 - RNA, 19 nt, Homo sapiens
gcccuuaacagacggaaug

SEQ ID NO: 510381 - RNA, 19 nt, Homo sapiens
gcgacuacgacaagaagaa

SEQ ID NO: 510382 - RNA, 19 nt, Homo sapiens
cuuaguaaaugguuugaac

SEQ ID NO: 510383 - RNA, 19 nt, Homo sapiens
gugggaaggcuaagaaucu

SEQ ID NO: 510384 - RNA, 19 nt, Homo sapiens
aggcagagcgggugucaga

SEQ ID NO: 510385 - RNA, 19 nt, Homo sapiens
ccugcgaggcguuggauaa

SEQ ID NO: 510386 - RNA, 19 nt, Homo sapiens
cagaggcuccugcugacuu

SEQ ID NO: 510387 - RNA, 19 nt, Homo sapiens
gcagagcgggugucagacu

SEQ ID NO: 510388 - RNA, 19 nt, Homo sapiens
ggaccaaggugcacaugaa

SEQ ID NO: 510389 - RNA, 19 nt, Homo sapiens
caagaaagauguugugaac

SEQ ID NO: 510390 - RNA, 19 nt, Homo sapiens
ccaagaagauuguaaaugc

SEQ ID NO: 510391 - RNA, 19 nt, Homo sapiens
gauuguaaaugccaagaaa

SEQ ID NO: 510392 - RNA, 19 nt, Homo sapiens
gaacugcgcgguccuguca

SEQ ID NO: 510393 - RNA, 19 nt, Homo sapiens
ggagaacgacgcccuguau

SEQ ID NO: 510394 - RNA, 19 nt, Homo sapiens
gcgaucagcugcccuacau

SEQ ID NO: 510395 - RNA, 19 nt, Homo sapiens
guaaaugccaagaaagaug

SEQ ID NO: 510396 - RNA, 19 nt, Homo sapiens
gaacgacgcccuguaugag

SEQ ID NO: 510397 - RNA, 19 nt, Homo sapiens
ccaaggugcacaugaaaug

SEQ ID NO: 510398 - RNA, 19 nt, Homo sapiens
gaacugggagacugagauc

SEQ ID NO: 510399 - RNA, 19 nt, Homo sapiens
caacccagaagcccaagaa

SEQ ID NO: 510400 - RNA, 19 nt, Homo sapiens
gaccaaggugcacaugaaa

SEQ ID NO: 510401 - RNA, 19 nt, Homo sapiens
gcaacgaggccgagaucug

SEQ ID NO: 510402 - RNA, 19 nt, Homo sapiens
ccaagaaagauguugugaa

SEQ ID NO: 510403 - RNA, 19 nt, Homo sapiens
agaacgacgcccuguauga

SEQ ID NO: 510404 - RNA, 19 nt, Homo sapiens
uaaaugccaagaaagaugu

SEQ ID NO: 510405 - RNA, 19 nt, Homo sapiens
cagaagcccaagaagauug

SEQ ID NO: 510406 - RNA, 19 nt, Homo sapiens
acgacgcccuguaugagua

SEQ ID NO: 510407 - RNA, 19 nt, Homo sapiens
gcacguucgcggagaggaa

SEQ ID NO: 510408 - RNA, 19 nt, Homo sapiens
cccagaagcccaagaagau

SEQ ID NO: 510409 - RNA, 19 nt, Homo sapiens
gagaacgacgcccuguaug

SEQ ID NO: 510410 - RNA, 19 nt, Homo sapiens
ccagaagcccaagaagauu

SEQ ID NO: 510411 - RNA, 19 nt, Homo sapiens
acaagaacugggagacuga

SEQ ID NO: 510412 - RNA, 19 nt, Homo sapiens
ccgcaucgccuacaagaac

SEQ ID NO: 510413 - RNA, 19 nt, Homo sapiens
gcccaagaagauuguaaau

SEQ ID NO: 510414 - RNA, 19 nt, Homo sapiens
gccaagaaagauguuguga

SEQ ID NO: 510415 - RNA, 19 nt, Homo sapiens
gagaagaccucaccuagaa

SEQ ID NO: 510416 - RNA, 19 nt, Homo sapiens
aaacggagcugaacaauag

SEQ ID NO: 510417 - RNA, 19 nt, Homo sapiens
gaccaacugucacucauug

SEQ ID NO: 510418 - RNA, 19 nt, Homo sapiens
gaccucaccuagaaauuga

SEQ ID NO: 510419 - RNA, 19 nt, Homo sapiens
gcguggagcugagagauaa

SEQ ID NO: 510420 - RNA, 19 nt, Homo sapiens
gcaacaagaccaccacuuc

SEQ ID NO: 510421 - RNA, 19 nt, Homo sapiens
gguaugagcccaucuaucu

SEQ ID NO: 510422 - RNA, 19 nt, Homo sapiens
ccagggaccucucucuaau

SEQ ID NO: 510423 - RNA, 19 nt, Homo sapiens
ucuaaacaaugcugauuug

SEQ ID NO: 510424 - RNA, 19 nt, Homo sapiens
ccagaaugcugcaggacuu

SEQ ID NO: 510425 - RNA, 19 nt, Homo sapiens
gcccgacuaucucgacuuu

SEQ ID NO: 510426 - RNA, 19 nt, Homo sapiens
ggagagaagcaacuacaga

SEQ ID NO: 510427 - RNA, 19 nt, Homo sapiens
gaacccaagcuuagaacuu

SEQ ID NO: 510428 - RNA, 19 nt, Homo sapiens
gaagaccucaccuagaaau

SEQ ID NO: 510429 - RNA, 19 nt, Homo sapiens
uguaaucgcccuacuauuc

SEQ ID NO: 510430 - RNA, 19 nt, Homo sapiens
ccagcucccucuauuuaug

SEQ ID NO: 510431 - RNA, 19 nt, Homo sapiens
aacccaagcuuagaacuuu

SEQ ID NO: 510432 - RNA, 19 nt, Homo sapiens
ccagauguuuccagacuuc

SEQ ID NO: 510433 - RNA, 19 nt, Homo sapiens
ugacacaaguggaccuuag

SEQ ID NO: 510434 - RNA, 19 nt, Homo sapiens
aauaggcuguucccaugua

SEQ ID NO: 510435 - RNA, 19 nt, Homo sapiens
ccacuaagaauucaaacug

SEQ ID NO: 510436 - RNA, 19 nt, Homo sapiens
guaaucgcccuacuauuca

SEQ ID NO: 510437 - RNA, 19 nt, Homo sapiens
gccuguagcccauguugua

SEQ ID NO: 510438 - RNA, 19 nt, Homo sapiens
caaccacuaagaauucaaa

SEQ ID NO: 510439 - RNA, 19 nt, Homo sapiens
ggucggaacccaagcuuag

SEQ ID NO: 510440 - RNA, 19 nt, Homo sapiens
ggucuacuuugggaucauu

SEQ ID NO: 510441 - RNA, 19 nt, Homo sapiens
agccagcucccucuauuua

SEQ ID NO: 510442 - RNA, 19 nt, Homo sapiens
ggaguugugucuguaaucg

SEQ ID NO: 510443 - RNA, 19 nt, Homo sapiens
caagaccaccacuucgaaa

SEQ ID NO: 510444 - RNA, 19 nt, Homo sapiens
gcagaggaccagcuaagag

SEQ ID NO: 510445 - RNA, 19 nt, Homo sapiens
acuauucaguggcgagaaa

SEQ ID NO: 510446 - RNA, 19 nt, Homo sapiens
cugauuaaguugucuaaac

SEQ ID NO: 510447 - RNA, 19 nt, Homo sapiens
ccuagaaauugacacaagu

SEQ ID NO: 510448 - RNA, 19 nt, Homo sapiens
cauccaaccuucccaaacg

SEQ ID NO: 510449 - RNA, 19 nt, Homo sapiens
ccagggagccuuugguucu

SEQ ID NO: 510450 - RNA, 19 nt, Homo sapiens
uagcccauguuguagcaaa

SEQ ID NO: 510451 - RNA, 19 nt, Homo sapiens
gcuaagagggagagaagca

SEQ ID NO: 510452 - RNA, 19 nt, Homo sapiens
guucucuuccucucacaua

SEQ ID NO: 510453 - RNA, 19 nt, Homo sapiens
uggccucugugccuucuuu

SEQ ID NO: 510454 - RNA, 19 nt, Homo sapiens
gacagcagaggaccagcua

SEQ ID NO: 510455 - RNA, 19 nt, Homo sapiens
agggaccucucucuaauca

SEQ ID NO: 510456 - RNA, 19 nt, Homo sapiens
cgagaaauaaaguuugcuu

SEQ ID NO: 510457 - RNA, 19 nt, Homo sapiens
uaaacaaugcugauuuggu

SEQ ID NO: 510458 - RNA, 19 nt, Homo sapiens
ggcgagaaauaaaguuugc

SEQ ID NO: 510459 - RNA, 19 nt, Homo sapiens
ggcaaccacuaagaauuca

SEQ ID NO: 510460 - RNA, 19 nt, Homo sapiens
uggcaaccacuaagaauuc

SEQ ID NO: 510461 - RNA, 19 nt, Homo sapiens
gaacuuuaagcaacaagac

SEQ ID NO: 510462 - RNA, 19 nt, Homo sapiens
ccgacuaucucgacuuugc

SEQ ID NO: 510463 - RNA, 19 nt, Homo sapiens
gccuguaccucaucuacuc

SEQ ID NO: 510464 - RNA, 19 nt, Homo sapiens
cccagggaccucucucuaa

SEQ ID NO: 510465 - RNA, 19 nt, Homo sapiens
cuuccucucuccagauguu

SEQ ID NO: 510466 - RNA, 19 nt, Homo sapiens
agaccucaccuagaaauug

SEQ ID NO: 510467 - RNA, 19 nt, Homo sapiens
acccaagcuuagaacuuua

SEQ ID NO: 510468 - RNA, 19 nt, Homo sapiens
ugggaucauugcccuguga

SEQ ID NO: 510469 - RNA, 19 nt, Homo sapiens
ggcguggagcugagagaua

SEQ ID NO: 510470 - RNA, 19 nt, Homo sapiens
gucuaaacaaugcugauuu

SEQ ID NO: 510471 - RNA, 19 nt, Homo sapiens
cugcaggacuugagaagac

SEQ ID NO: 510472 - RNA, 19 nt, Homo sapiens
cagcuuugaucccugacau

SEQ ID NO: 510473 - RNA, 19 nt, Homo sapiens
gaggaggacgaacauccaa

SEQ ID NO: 510474 - RNA, 19 nt, Homo sapiens
uuuccagacuuccuugaga

SEQ ID NO: 510475 - RNA, 19 nt, Homo sapiens
acaagaccaccacuucgaa

SEQ ID NO: 510476 - RNA, 19 nt, Homo sapiens
gagaagggugaccgacuca

SEQ ID NO: 510477 - RNA, 19 nt, Homo sapiens
cagcuaagagggagagaag

SEQ ID NO: 510478 - RNA, 19 nt, Homo sapiens
guggcgagaaauaaaguuu

SEQ ID NO: 510479 - RNA, 19 nt, Homo sapiens
ucuguaaucgcccuacuau

SEQ ID NO: 510480 - RNA, 19 nt, Homo sapiens
gcuggcaaccacuaagaau

SEQ ID NO: 510481 - RNA, 19 nt, Homo sapiens
ccuccucucugccaucaag

SEQ ID NO: 510482 - RNA, 19 nt, Homo sapiens
cagcagaggaccagcuaag

SEQ ID NO: 510483 - RNA, 19 nt, Homo sapiens
ugccuuggcucagacaugu

SEQ ID NO: 510484 - RNA, 19 nt, Homo sapiens
gacaccaugagcacugaaa

SEQ ID NO: 510485 - RNA, 19 nt, Homo sapiens
ccucuucuccuuccugauc

SEQ ID NO: 510486 - RNA, 19 nt, Homo sapiens
gauguuuccagacuuccuu

SEQ ID NO: 510487 - RNA, 19 nt, Homo sapiens
gccuuccucucuccagaug

SEQ ID NO: 510488 - RNA, 19 nt, Homo sapiens
aggccaagcccugguauga

SEQ ID NO: 510489 - RNA, 19 nt, Homo sapiens
gaucgaaucucugaugaaa

SEQ ID NO: 510490 - RNA, 19 nt, Homo sapiens
ucgaaucucugaugaaaga

SEQ ID NO: 510491 - RNA, 19 nt, Homo sapiens
gaugaucgcugaguucaag

SEQ ID NO: 510492 - RNA, 19 nt, Homo sapiens
gcauugacuucgacgaguu

SEQ ID NO: 510493 - RNA, 19 nt, Homo sapiens
gaugaaagaggacgcgaaa

SEQ ID NO: 510494 - RNA, 19 nt, Homo sapiens
caaaggaggcgaccugcaa

SEQ ID NO: 510495 - RNA, 19 nt, Homo sapiens
gaaagacggcgacaagaac

SEQ ID NO: 510496 - RNA, 19 nt, Homo sapiens
cggaggagcuggcugagau

SEQ ID NO: 510497 - RNA, 19 nt, Homo sapiens
gaugaaagacggcgacaag

SEQ ID NO: 510498 - RNA, 19 nt, Homo sapiens
ugaaagacggcgacaagaa

SEQ ID NO: 510499 - RNA, 19 nt, Homo sapiens
gguccuaccucagcgaaga

SEQ ID NO: 510500 - RNA, 19 nt, Homo sapiens
gaaugcagacggcuacauc

SEQ ID NO: 510501 - RNA, 19 nt, Homo sapiens
gacgaguuccugaagauga

SEQ ID NO: 510502 - RNA, 19 nt, Homo sapiens
gauggagggcgugcaguaa

SEQ ID NO: 510503 - RNA, 19 nt, Homo sapiens
ggaggcgaccugcaacaga

SEQ ID NO: 510504 - RNA, 19 nt, Homo sapiens
ugacauguuugaugcugau

SEQ ID NO: 510505 - RNA, 19 nt, Homo sapiens
gaagagaugaucgcugagu

SEQ ID NO: 510506 - RNA, 19 nt, Homo sapiens
ggacagucgccucuaccaa

SEQ ID NO: 510507 - RNA, 19 nt, Homo sapiens
ugaaagaggacgcgaaagg

SEQ ID NO: 510508 - RNA, 19 nt, Homo sapiens
acagucgccucuaccaaga

SEQ ID NO: 510509 - RNA, 19 nt, Homo sapiens
ggaauaaaagcaaauguuc

SEQ ID NO: 510510 - RNA, 19 nt, Homo sapiens
gagaugaucgcugaguuca

SEQ ID NO: 510511 - RNA, 19 nt, Homo sapiens
aagagaugaucgcugaguu

SEQ ID NO: 510512 - RNA, 19 nt, Homo sapiens
gaggagcuggcugagauuu

SEQ ID NO: 510513 - RNA, 19 nt, Homo sapiens
gccgagugcuuccgcaucu

SEQ ID NO: 510514 - RNA, 19 nt, Homo sapiens
ugauggagggcgugcagua

SEQ ID NO: 510515 - RNA, 19 nt, Homo sapiens
cgacuucgaggaguucuug

SEQ ID NO: 510516 - RNA, 19 nt, Homo sapiens
gcaguaaggaguggacagu

SEQ ID NO: 510517 - RNA, 19 nt, Homo sapiens
ucgacgaguuccugaagau

SEQ ID NO: 510518 - RNA, 19 nt, Homo sapiens
ggaggagcuggcugagauu

SEQ ID NO: 510519 - RNA, 19 nt, Homo sapiens
ggagcuggacgccaucauc

SEQ ID NO: 510520 - RNA, 19 nt, Homo sapiens
gccagacacccaccaagga

SEQ ID NO: 510521 - RNA, 19 nt, Homo sapiens
ggagcuggcugagauuuuc

SEQ ID NO: 510522 - RNA, 19 nt, Homo sapiens
gaguugggcacggugauga

SEQ ID NO: 510523 - RNA, 19 nt, Homo sapiens
ggugguggagugcaaagga

SEQ ID NO: 510524 - RNA, 19 nt, Homo sapiens
gcacggugaugaggaugcu

SEQ ID NO: 510525 - RNA, 19 nt, Homo sapiens
cauguuugaugcugauggu

SEQ ID NO: 510526 - RNA, 19 nt, Homo sapiens
ggaguugggcacggugaug

SEQ ID NO: 510527 - RNA, 19 nt, Homo sapiens
gaacacagguuaucaaguu

SEQ ID NO: 510528 - RNA, 19 nt, Homo sapiens
gaucuuagcuucuuuaauc

SEQ ID NO: 510529 - RNA, 19 nt, Homo sapiens
gcacaggcuugauaaguuu

SEQ ID NO: 510530 - RNA, 19 nt, Homo sapiens
ggauaaagaggaagcaaua

SEQ ID NO: 510531 - RNA, 19 nt, Homo sapiens
aaucagacuuugugacuua

SEQ ID NO: 510532 - RNA, 19 nt, Homo sapiens
ggcaagaaaucaaggaauu

SEQ ID NO: 510533 - RNA, 19 nt, Homo sapiens
ccacugagguguugugaug

SEQ ID NO: 510534 - RNA, 19 nt, Homo sapiens
ccacuucccugcagaauca

SEQ ID NO: 510535 - RNA, 19 nt, Homo sapiens
ugugggaucuguuucuuua

SEQ ID NO: 510536 - RNA, 19 nt, Homo sapiens
gccaagacccuacauauga

SEQ ID NO: 510537 - RNA, 19 nt, Homo sapiens
ugaauuaccuccgagauga

SEQ ID NO: 510538 - RNA, 19 nt, Homo sapiens
ggacugggcauuuaucuuc

SEQ ID NO: 510539 - RNA, 19 nt, Homo sapiens
gcauuuaucuucucugacu

SEQ ID NO: 510540 - RNA, 19 nt, Homo sapiens
gggcauuuaucuucucuga

SEQ ID NO: 510541 - RNA, 19 nt, Homo sapiens
caaaccagaauucagcuua

SEQ ID NO: 510542 - RNA, 19 nt, Homo sapiens
cauaagugauggaagcaaa

SEQ ID NO: 510543 - RNA, 19 nt, Homo sapiens
guaaacaaaguauggauga

SEQ ID NO: 510544 - RNA, 19 nt, Homo sapiens
gccaugcuguccucacaua

SEQ ID NO: 510545 - RNA, 19 nt, Homo sapiens
gcacgacugcucuuuguga

SEQ ID NO: 510546 - RNA, 19 nt, Homo sapiens
gacaugaucuuagcuucuu

SEQ ID NO: 510547 - RNA, 19 nt, Homo sapiens
acaaggaccugaagugaca

SEQ ID NO: 510548 - RNA, 19 nt, Homo sapiens
gcacaugcuuggccacaca

SEQ ID NO: 510549 - RNA, 19 nt, Homo sapiens
ucacagucuugaauguaua

SEQ ID NO: 510550 - RNA, 19 nt, Homo sapiens
gaagcaacaacaaguauuc

SEQ ID NO: 510551 - RNA, 19 nt, Homo sapiens
guucaucucucuugacuac

SEQ ID NO: 510552 - RNA, 19 nt, Homo sapiens
cgacugcucuuugugauuc

SEQ ID NO: 510553 - RNA, 19 nt, Homo sapiens
gcaacaacaaguauuccua

SEQ ID NO: 510554 - RNA, 19 nt, Homo sapiens
ccucagaaccggcaagaaa

SEQ ID NO: 510555 - RNA, 19 nt, Homo sapiens
guaccuuggugaucagcua

SEQ ID NO: 510556 - RNA, 19 nt, Homo sapiens
gaagcaaacacuaauuucu

SEQ ID NO: 510557 - RNA, 19 nt, Homo sapiens
gagacugcguccuguccua

SEQ ID NO: 510558 - RNA, 19 nt, Homo sapiens
uggcugaagcaaaguauua

SEQ ID NO: 510559 - RNA, 19 nt, Homo sapiens
gcaagaaaucaaggaauug

SEQ ID NO: 510560 - RNA, 19 nt, Homo sapiens
ggaagcaaacacuaauuuc

SEQ ID NO: 510561 - RNA, 19 nt, Homo sapiens
guaaguaaacaaaguaugg

SEQ ID NO: 510562 - RNA, 19 nt, Homo sapiens
ucagguaccuuggugauca

SEQ ID NO: 510563 - RNA, 19 nt, Homo sapiens
gauaaagaggaagcaauaa

SEQ ID NO: 510564 - RNA, 19 nt, Homo sapiens
ugaacucacugacaugauc

SEQ ID NO: 510565 - RNA, 19 nt, Homo sapiens
gaauguauaaacagcacua

SEQ ID NO: 510566 - RNA, 19 nt, Homo sapiens
aaaccagaauucagcuuau

SEQ ID NO: 510567 - RNA, 19 nt, Homo sapiens
ugggaucuguuucuuuaaa

SEQ ID NO: 510568 - RNA, 19 nt, Homo sapiens
caacagaagcaacaacaag

SEQ ID NO: 510569 - RNA, 19 nt, Homo sapiens
uagaggcccuggugcagaa

SEQ ID NO: 510570 - RNA, 19 nt, Homo sapiens
ucaacguccuacucuauga

SEQ ID NO: 510571 - RNA, 19 nt, Homo sapiens
uuucucagcugcccucuug

SEQ ID NO: 510572 - RNA, 19 nt, Homo sapiens
gcagaggagggaccacauu

SEQ ID NO: 510573 - RNA, 19 nt, Homo sapiens
acaaguauguccagcucaa

SEQ ID NO: 510574 - RNA, 19 nt, Homo sapiens
uggugaagcugcuguacaa

SEQ ID NO: 510575 - RNA, 19 nt, Homo sapiens
gucacagucuugaauguau

SEQ ID NO: 510576 - RNA, 19 nt, Homo sapiens
ggagagaacacagguuauc

SEQ ID NO: 510577 - RNA, 19 nt, Homo sapiens
gaagaugaggagaccuuug

SEQ ID NO: 510578 - RNA, 19 nt, Homo sapiens
acaucgagcuguuugacaa

SEQ ID NO: 510579 - RNA, 19 nt, Homo sapiens
gauggaagcaaacacuaau

SEQ ID NO: 510580 - RNA, 19 nt, Homo sapiens
uguauaaacagcacuaaga

SEQ ID NO: 510581 - RNA, 19 nt, Homo sapiens
cuacagcacuuacgaugac

SEQ ID NO: 510582 - RNA, 19 nt, Homo sapiens
gucaagcgcuacagcacuu

SEQ ID NO: 510583 - RNA, 19 nt, Homo sapiens
uggaagcaaacacuaauuu

SEQ ID NO: 510584 - RNA, 19 nt, Homo sapiens
ggacgcacugagauuauga

SEQ ID NO: 510585 - RNA, 19 nt, Homo sapiens
gaucagcuacuaguucuuc

SEQ ID NO: 510586 - RNA, 19 nt, Homo sapiens
cacauacgguaaagccaaa

SEQ ID NO: 510587 - RNA, 19 nt, Homo sapiens
ucacugacaugaucuuagc

SEQ ID NO: 510588 - RNA, 19 nt, Homo sapiens
aaacugagcauuucuuuug

SEQ ID NO: 510589 - RNA, 19 nt, Homo sapiens
acagaagcaacaacaagua

SEQ ID NO: 510590 - RNA, 19 nt, Homo sapiens
cagauuuucuugucaguuu

SEQ ID NO: 510591 - RNA, 19 nt, Homo sapiens
guaccuccaucguguaugc

SEQ ID NO: 510592 - RNA, 19 nt, Homo sapiens
cauagaccguuguggaaag

SEQ ID NO: 510593 - RNA, 19 nt, Homo sapiens
uaucuucucugacugaaaa

SEQ ID NO: 510594 - RNA, 19 nt, Homo sapiens
aaauucaggcuuuggcuuu

SEQ ID NO: 510595 - RNA, 19 nt, Homo sapiens
gugaucagcuacuaguucu

SEQ ID NO: 510596 - RNA, 19 nt, Homo sapiens
gagagaacacagguuauca

SEQ ID NO: 510597 - RNA, 19 nt, Homo sapiens
gggacgcacugagauuaug

SEQ ID NO: 510598 - RNA, 19 nt, Homo sapiens
caucaucacaucccuaaag

SEQ ID NO: 510599 - RNA, 19 nt, Homo sapiens
aagcaacucuuggcugugu

SEQ ID NO: 510600 - RNA, 19 nt, Homo sapiens
caugaucuuagcuucuuua

SEQ ID NO: 510601 - RNA, 19 nt, Homo sapiens
acauugaacucacugacau

SEQ ID NO: 510602 - RNA, 19 nt, Homo sapiens
acacaaggaccugaaguga

SEQ ID NO: 510603 - RNA, 19 nt, Homo sapiens
gagaacacagguuaucaag

SEQ ID NO: 510604 - RNA, 19 nt, Homo sapiens
gugccaagacccuacauau

SEQ ID NO: 510605 - RNA, 19 nt, Homo sapiens
ccagaggcccgaaucuaug

SEQ ID NO: 510606 - RNA, 19 nt, Homo sapiens
agaagaagcagaccaaggu

SEQ ID NO: 510607 - RNA, 19 nt, Homo sapiens
aauucaggcuuuggcuuua

SEQ ID NO: 510608 - RNA, 19 nt, Homo sapiens
ccaucacccucccucagaa

SEQ ID NO: 510609 - RNA, 19 nt, Homo sapiens
ggugaucagcuacuaguuc

SEQ ID NO: 510610 - RNA, 19 nt, Homo sapiens
uaacucagccauggagaug

SEQ ID NO: 510611 - RNA, 19 nt, Homo sapiens
agcacaggcuugauaaguu

SEQ ID NO: 510612 - RNA, 19 nt, Homo sapiens
aagaugaggagaccuuuga

SEQ ID NO: 510613 - RNA, 19 nt, Homo sapiens
ggagacacucaacguccua

SEQ ID NO: 510614 - RNA, 19 nt, Homo sapiens
cagaagcaacaacaaguau

SEQ ID NO: 510615 - RNA, 19 nt, Homo sapiens
agagugcccugcaggacaa

SEQ ID NO: 510616 - RNA, 19 nt, Homo sapiens
caaggucggccuaaaggau

SEQ ID NO: 510617 - RNA, 19 nt, Homo sapiens
gggaucuguuucuuuaaag

SEQ ID NO: 510618 - RNA, 19 nt, Homo sapiens
ccaagacccuacauaugac

SEQ ID NO: 510619 - RNA, 19 nt, Homo sapiens
cuaguaaugaggaaacuga

SEQ ID NO: 510620 - RNA, 19 nt, Homo sapiens
aggcaguucuggugcugua

SEQ ID NO: 510621 - RNA, 19 nt, Homo sapiens
ugauggaagcaaacacuaa

SEQ ID NO: 510622 - RNA, 19 nt, Homo sapiens
cgagaaagcacaguagucu

SEQ ID NO: 510623 - RNA, 19 nt, Homo sapiens
uuggagagaacacagguua

SEQ ID NO: 510624 - RNA, 19 nt, Homo sapiens
ccacguauaguacccacuu

SEQ ID NO: 510625 - RNA, 19 nt, Homo sapiens
gcuacagcacuuacgauga

SEQ ID NO: 510626 - RNA, 19 nt, Homo sapiens
gaucugcugcugguccuuu

SEQ ID NO: 510627 - RNA, 19 nt, Homo sapiens
gcaagcagcugacgaauua

SEQ ID NO: 510628 - RNA, 19 nt, Homo sapiens
ggacagaccuugguuuguu

SEQ ID NO: 510629 - RNA, 19 nt, Homo sapiens
agacagaacuggaagagaa

SEQ ID NO: 510630 - RNA, 19 nt, Homo sapiens
ggacuugggcucacagaua

SEQ ID NO: 510631 - RNA, 19 nt, Homo sapiens
cuaaagugcugggauuaua

SEQ ID NO: 510632 - RNA, 19 nt, Homo sapiens
agauugagguggccacuua

SEQ ID NO: 510633 - RNA, 19 nt, Homo sapiens
ccacauuccuguccaguga

SEQ ID NO: 510634 - RNA, 19 nt, Homo sapiens
gacuugggcucacagauaa

SEQ ID NO: 510635 - RNA, 19 nt, Homo sapiens
ggaaguggccgguauaaag

SEQ ID NO: 510636 - RNA, 19 nt, Homo sapiens
gaacccaggucgucuuucu

SEQ ID NO: 510637 - RNA, 19 nt, Homo sapiens
ggacgcuuaugaucacauu

SEQ ID NO: 510638 - RNA, 19 nt, Homo sapiens
gacagaccuugguuuguuu

SEQ ID NO: 510639 - RNA, 19 nt, Homo sapiens
gaccguaauucuugacuuc

SEQ ID NO: 510640 - RNA, 19 nt, Homo sapiens
ccaaagggaagaagaagaa

SEQ ID NO: 510641 - RNA, 19 nt, Homo sapiens
cgugacagguuuccacaaa

SEQ ID NO: 510642 - RNA, 19 nt, Homo sapiens
cagcaaugguggaauggaa

SEQ ID NO: 510643 - RNA, 19 nt, Homo sapiens
ccaggucgucuuucuauuu

SEQ ID NO: 510644 - RNA, 19 nt, Homo sapiens
gaauucauuucuggccuuu

SEQ ID NO: 510645 - RNA, 19 nt, Homo sapiens
caccaaggacucuuuguaa

SEQ ID NO: 510646 - RNA, 19 nt, Homo sapiens
ggauguccauggagcagaa

SEQ ID NO: 510647 - RNA, 19 nt, Homo sapiens
cgaagaagaagaaggagaa

SEQ ID NO: 510648 - RNA, 19 nt, Homo sapiens
gaugaugaccuucuuccaa

SEQ ID NO: 510649 - RNA, 19 nt, Homo sapiens
uauaaaggaugcccaaggu

SEQ ID NO: 510650 - RNA, 19 nt, Homo sapiens
uauaaagguugguuagcuu

SEQ ID NO: 510651 - RNA, 19 nt, Homo sapiens
ccacuuaugccaccugcua

SEQ ID NO: 510652 - RNA, 19 nt, Homo sapiens
uuacagggccaauguuauu

SEQ ID NO: 510653 - RNA, 19 nt, Homo sapiens
ggagcagaauuggcaggua

SEQ ID NO: 510654 - RNA, 19 nt, Homo sapiens
agaaggagaagaagaagaa

SEQ ID NO: 510655 - RNA, 19 nt, Homo sapiens
agaagaaggagaagaagaa

SEQ ID NO: 510656 - RNA, 19 nt, Homo sapiens
agaagaagaaggagaagaa

SEQ ID NO: 510657 - RNA, 19 nt, Homo sapiens
gauacagggucucauucug

SEQ ID NO: 510658 - RNA, 19 nt, Homo sapiens
gcaacaccaaggacucuuu

SEQ ID NO: 510659 - RNA, 19 nt, Homo sapiens
gaccuugguuuguuuacau

SEQ ID NO: 510660 - RNA, 19 nt, Homo sapiens
gggcaagcuugaccucuca

SEQ ID NO: 510661 - RNA, 19 nt, Homo sapiens
gagcaccgccagcauuaga

SEQ ID NO: 510662 - RNA, 19 nt, Homo sapiens
gugagcaccgccagcauua

SEQ ID NO: 510663 - RNA, 19 nt, Homo sapiens
ugggugagcugcaggguau

SEQ ID NO: 510664 - RNA, 19 nt, Homo sapiens
caucagaggcagagucaga

SEQ ID NO: 510665 - RNA, 19 nt, Homo sapiens
gaaguggccgguauaaagg

SEQ ID NO: 510666 - RNA, 19 nt, Homo sapiens
gagaacccaggucgucuuu

SEQ ID NO: 510667 - RNA, 19 nt, Homo sapiens
gaacuggacagaccuuggu

SEQ ID NO: 510668 - RNA, 19 nt, Homo sapiens
cgaauuacagggccaaugu

SEQ ID NO: 510669 - RNA, 19 nt, Homo sapiens
gagcgucuuucugcacuug

SEQ ID NO: 510670 - RNA, 19 nt, Homo sapiens
accaaggacucuuuguaaa

SEQ ID NO: 510671 - RNA, 19 nt, Homo sapiens
gaggcaagcagcugacgaa

SEQ ID NO: 510672 - RNA, 19 nt, Homo sapiens
gagcaucacgcuggacuug

SEQ ID NO: 510673 - RNA, 19 nt, Homo sapiens
ugccuaggcuugucuggaa

SEQ ID NO: 510674 - RNA, 19 nt, Homo sapiens
gcgcuauccuggccaucaa

SEQ ID NO: 510675 - RNA, 19 nt, Homo sapiens
gaaggaguacaucauccaa

SEQ ID NO: 510676 - RNA, 19 nt, Homo sapiens
aaacaucaucgccacugua

SEQ ID NO: 510677 - RNA, 19 nt, Homo sapiens
cugauuagccaccuuaguu

SEQ ID NO: 510678 - RNA, 19 nt, Homo sapiens
cagcugauuagccaccuua

SEQ ID NO: 510679 - RNA, 19 nt, Homo sapiens
ugagcgggauucagcaaug

SEQ ID NO: 510680 - RNA, 19 nt, Homo sapiens
caaggacucuuuguaaacg

SEQ ID NO: 510681 - RNA, 19 nt, Homo sapiens
acaccaaggacucuuugua

SEQ ID NO: 510682 - RNA, 19 nt, Homo sapiens
ggucuccugugcucugaug

SEQ ID NO: 510683 - RNA, 19 nt, Homo sapiens
gaagacagaacuggaagag

SEQ ID NO: 510684 - RNA, 19 nt, Homo sapiens
gaauuacagggccaauguu

SEQ ID NO: 510685 - RNA, 19 nt, Homo sapiens
uaaugaauuucuggagaga

SEQ ID NO: 510686 - RNA, 19 nt, Homo sapiens
ccaggaaguggccgguaua

SEQ ID NO: 510687 - RNA, 19 nt, Homo sapiens
gaacuggaagagaaagaag

SEQ ID NO: 510688 - RNA, 19 nt, Homo sapiens
gacagaacuggaagagaaa

SEQ ID NO: 510689 - RNA, 19 nt, Homo sapiens
gcaaugguggaauggaaga

SEQ ID NO: 510690 - RNA, 19 nt, Homo sapiens
caacaccaaggacucuuug

SEQ ID NO: 510691 - RNA, 19 nt, Homo sapiens
gcaagguggaggcgcugua

SEQ ID NO: 510692 - RNA, 19 nt, Homo sapiens
guuaagagcagcgcugguu

SEQ ID NO: 510693 - RNA, 19 nt, Homo sapiens
aauuacagggccaauguua

SEQ ID NO: 510694 - RNA, 19 nt, Homo sapiens
ggcaagcagcugacgaauu

SEQ ID NO: 510695 - RNA, 19 nt, Homo sapiens
gaagaagaagaaguccaaa

SEQ ID NO: 510696 - RNA, 19 nt, Homo sapiens
gccugaaaguuccuucuca

SEQ ID NO: 510697 - RNA, 19 nt, Homo sapiens
cuauugccgugacagguuu

SEQ ID NO: 510698 - RNA, 19 nt, Homo sapiens
ggaagacagaacuggaaga

SEQ ID NO: 510699 - RNA, 19 nt, Homo sapiens
agaagaagaagaaguccaa

SEQ ID NO: 510700 - RNA, 19 nt, Homo sapiens
uguguaaccuaacauaguc

SEQ ID NO: 510701 - RNA, 19 nt, Homo sapiens
gugauccucuugucucagu

SEQ ID NO: 510702 - RNA, 19 nt, Homo sapiens
aaaacgaggucuuccaguu

SEQ ID NO: 510703 - RNA, 19 nt, Homo sapiens
uuuagaggcugaccguaau

SEQ ID NO: 510704 - RNA, 19 nt, Homo sapiens
aaacgaggucuuccaguuc

SEQ ID NO: 510705 - RNA, 19 nt, Homo sapiens
ccugagcccucccucuuca

SEQ ID NO: 510706 - RNA, 19 nt, Homo sapiens
gggugaugcugaagaugau

SEQ ID NO: 510707 - RNA, 19 nt, Homo sapiens
ucaccaaagggaagaagaa

SEQ ID NO: 510708 - RNA, 19 nt, Homo sapiens
ccucugcagugcugaguca

SEQ ID NO: 510709 - RNA, 19 nt, Homo sapiens
guggauacagggucucauu

SEQ ID NO: 510710 - RNA, 19 nt, Homo sapiens
cccaaggccucaacuagag

SEQ ID NO: 510711 - RNA, 19 nt, Homo sapiens
gaagaagaaggagaagaag

SEQ ID NO: 510712 - RNA, 19 nt, Homo sapiens
gaagaaggagaagaagaag

SEQ ID NO: 510713 - RNA, 19 nt, Homo sapiens
uaaagugcugggauuauag

SEQ ID NO: 510714 - RNA, 19 nt, Homo sapiens
ggauacagggucucauucu

SEQ ID NO: 510715 - RNA, 19 nt, Homo sapiens
uguggguaguugaaucuuu

SEQ ID NO: 510716 - RNA, 19 nt, Homo sapiens
cccuuuggccucuguauuu

SEQ ID NO: 510717 - RNA, 19 nt, Homo sapiens
ggacucuuuguaaacgaua

SEQ ID NO: 510718 - RNA, 19 nt, Homo sapiens
ccaaggacucuuuguaaac

SEQ ID NO: 510719 - RNA, 19 nt, Homo sapiens
ccagguacugccuuacaaa

SEQ ID NO: 510720 - RNA, 19 nt, Homo sapiens
gccuggaccuccugguuca

SEQ ID NO: 510721 - RNA, 19 nt, Homo sapiens
cuugaccucucacuguuga

SEQ ID NO: 510722 - RNA, 19 nt, Homo sapiens
gagcgggauucagcaaugg

SEQ ID NO: 510723 - RNA, 19 nt, Homo sapiens
cauauagggaggaggaaga

SEQ ID NO: 510724 - RNA, 19 nt, Homo sapiens
ggugaaggaguacaucauc

SEQ ID NO: 510725 - RNA, 19 nt, Homo sapiens
ggaccugaagccacuguuc

SEQ ID NO: 510726 - RNA, 19 nt, Homo sapiens
ccaucgacaucauccagau

SEQ ID NO: 510727 - RNA, 19 nt, Homo sapiens
gggaagauuugaagacuua

SEQ ID NO: 510728 - RNA, 19 nt, Homo sapiens
gcggaaagcugugaagaua

SEQ ID NO: 510729 - RNA, 19 nt, Homo sapiens
uaaauuggccucuuugaua

SEQ ID NO: 510730 - RNA, 19 nt, Homo sapiens
ggaguaaauuggccucuuu

SEQ ID NO: 510731 - RNA, 19 nt, Homo sapiens
gaaaguggguggaauuuac

SEQ ID NO: 510732 - RNA, 19 nt, Homo sapiens
ucacaagagucaacauuaa

SEQ ID NO: 510733 - RNA, 19 nt, Homo sapiens
gaacuggaaugaugaaugg

SEQ ID NO: 510734 - RNA, 19 nt, Homo sapiens
ggaauugcauccaagguau

SEQ ID NO: 510735 - RNA, 19 nt, Homo sapiens
cauauuugcucuagaagaa

SEQ ID NO: 510736 - RNA, 19 nt, Homo sapiens
ggcaugagcuuguguauac

SEQ ID NO: 510737 - RNA, 19 nt, Homo sapiens
gauaaaggcugccauuuug

SEQ ID NO: 510738 - RNA, 19 nt, Homo sapiens
caacucaucucaucaaugc

SEQ ID NO: 510739 - RNA, 19 nt, Homo sapiens
gcuaagaaguuuggaauca

SEQ ID NO: 510740 - RNA, 19 nt, Homo sapiens
gaacuucuuuggacuugga

SEQ ID NO: 510741 - RNA, 19 nt, Homo sapiens
gauacacacuggaaauguu

SEQ ID NO: 510742 - RNA, 19 nt, Homo sapiens
gaccaggacuugggacuuu

SEQ ID NO: 510743 - RNA, 19 nt, Homo sapiens
ucugguagaugauuacuuu

SEQ ID NO: 510744 - RNA, 19 nt, Homo sapiens
gcaccauguuugaaggaua

SEQ ID NO: 510745 - RNA, 19 nt, Homo sapiens
uauacucuguguucuguua

SEQ ID NO: 510746 - RNA, 19 nt, Homo sapiens
gaugauuacuuugaacuug

SEQ ID NO: 510747 - RNA, 19 nt, Homo sapiens
ggaugaagcuaacuuacca

SEQ ID NO: 510748 - RNA, 19 nt, Homo sapiens
gaaggauacugccagaagu

SEQ ID NO: 510749 - RNA, 19 nt, Homo sapiens
uguauacacugcuugcaua

SEQ ID NO: 510750 - RNA, 19 nt, Homo sapiens
gguagaugauuacuuugaa

SEQ ID NO: 510751 - RNA, 19 nt, Homo sapiens
ccaguaaccaugaguauga

SEQ ID NO: 510752 - RNA, 19 nt, Homo sapiens
ggcaagggaugaugucaga

SEQ ID NO: 510753 - RNA, 19 nt, Homo sapiens
gagcaggagaggaaagaua

SEQ ID NO: 510754 - RNA, 19 nt, Homo sapiens
caacgaaugcuuucaguuc

SEQ ID NO: 510755 - RNA, 19 nt, Homo sapiens
gcacaacucaucucaucaa

SEQ ID NO: 510756 - RNA, 19 nt, Homo sapiens
ccaaauaaacuucaguguu

SEQ ID NO: 510757 - RNA, 19 nt, Homo sapiens
gagaugagauagggaagga

SEQ ID NO: 510758 - RNA, 19 nt, Homo sapiens
caacucacuggaagaaaua

SEQ ID NO: 510759 - RNA, 19 nt, Homo sapiens
cacaauggcugaacaaguc

SEQ ID NO: 510760 - RNA, 19 nt, Homo sapiens
ugucauauuugcucuagaa

SEQ ID NO: 510761 - RNA, 19 nt, Homo sapiens
ugugguugcugucauauuu

SEQ ID NO: 510762 - RNA, 19 nt, Homo sapiens
caauaggaaggcuaaauaa

SEQ ID NO: 510763 - RNA, 19 nt, Homo sapiens
acaauaggaaggcuaaaua

SEQ ID NO: 510764 - RNA, 19 nt, Homo sapiens
caagguuccuccucuccua

SEQ ID NO: 510765 - RNA, 19 nt, Homo sapiens
ggaaggagcagggaugaga

SEQ ID NO: 510766 - RNA, 19 nt, Homo sapiens
aaacuccagcuauguaaua

SEQ ID NO: 510767 - RNA, 19 nt, Homo sapiens
gaaaauggacguauucaga

SEQ ID NO: 510768 - RNA, 19 nt, Homo sapiens
gcgaggagcucugcaugga

SEQ ID NO: 510769 - RNA, 19 nt, Homo sapiens
uacaagaaauggcaggaaa

SEQ ID NO: 510770 - RNA, 19 nt, Homo sapiens
gaagcuaacuuaccaaaag

SEQ ID NO: 510771 - RNA, 19 nt, Homo sapiens
caacuggugucgagaaguc

SEQ ID NO: 510772 - RNA, 19 nt, Homo sapiens
ccaaagauaccaaauaaac

SEQ ID NO: 510773 - RNA, 19 nt, Homo sapiens
uacacagccuuuacucaua

SEQ ID NO: 510774 - RNA, 19 nt, Homo sapiens
ggaaagcugugaagauacg

SEQ ID NO: 510775 - RNA, 19 nt, Homo sapiens
ucccaaagcugaacuccaa

SEQ ID NO: 510776 - RNA, 19 nt, Homo sapiens
aaaacaagcugcucuuuau

SEQ ID NO: 510777 - RNA, 19 nt, Homo sapiens
ugaaggagaagcucuuaaa

SEQ ID NO: 510778 - RNA, 19 nt, Homo sapiens
ccuauucuuuguuggauuu

SEQ ID NO: 510779 - RNA, 19 nt, Homo sapiens
gaugaaugggacaaucuua

SEQ ID NO: 510780 - RNA, 19 nt, Homo sapiens
ccagacgaaucuuuauaau

SEQ ID NO: 510781 - RNA, 19 nt, Homo sapiens
gaaaugcugcccuagaagu

SEQ ID NO: 510782 - RNA, 19 nt, Homo sapiens
caagcugcucuuuauaaua

SEQ ID NO: 510783 - RNA, 19 nt, Homo sapiens
gauacugccagaaguguuu

SEQ ID NO: 510784 - RNA, 19 nt, Homo sapiens
caucaaugccgcaaaguug

SEQ ID NO: 510785 - RNA, 19 nt, Homo sapiens
aaaaugagaugaaggagaa

SEQ ID NO: 510786 - RNA, 19 nt, Homo sapiens
gaauugcauccaagguaua

SEQ ID NO: 510787 - RNA, 19 nt, Homo sapiens
uaaagaaguuagcuugaac

SEQ ID NO: 510788 - RNA, 19 nt, Homo sapiens
caaggaagcucagggaaaa

SEQ ID NO: 510789 - RNA, 19 nt, Homo sapiens
ugccagaaguguuucauug

SEQ ID NO: 510790 - RNA, 19 nt, Homo sapiens
ugacagauccugaaaauga

SEQ ID NO: 510791 - RNA, 19 nt, Homo sapiens
aaacaagcugcucuuuaua

SEQ ID NO: 510792 - RNA, 19 nt, Homo sapiens
aaugggaucugcaguacuu

SEQ ID NO: 510793 - RNA, 19 nt, Homo sapiens
caagggaugaugucagauu

SEQ ID NO: 510794 - RNA, 19 nt, Homo sapiens
ccucaggcuuuguauuuga

SEQ ID NO: 510795 - RNA, 19 nt, Homo sapiens
gcacaauggcugaacaagu

SEQ ID NO: 510796 - RNA, 19 nt, Homo sapiens
gaagagcaacugagaucga

SEQ ID NO: 510797 - RNA, 19 nt, Homo sapiens
caaaguuggaugaagcuaa

SEQ ID NO: 510798 - RNA, 19 nt, Homo sapiens
guacaacucacuggaagaa

SEQ ID NO: 510799 - RNA, 19 nt, Homo sapiens
gagauaaaggcugccauuu

SEQ ID NO: 510800 - RNA, 19 nt, Homo sapiens
uugaaaugcugcccuagaa

SEQ ID NO: 510801 - RNA, 19 nt, Homo sapiens
cagcaugaguacaagaaau

SEQ ID NO: 510802 - RNA, 19 nt, Homo sapiens
gaugaaggagaagcucuua

SEQ ID NO: 510803 - RNA, 19 nt, Homo sapiens
aauccgagcuguuccacuu

SEQ ID NO: 510804 - RNA, 19 nt, Homo sapiens
acaacucacuggaagaaau

SEQ ID NO: 510805 - RNA, 19 nt, Homo sapiens
acucggaacuggaaugaug

SEQ ID NO: 510806 - RNA, 19 nt, Homo sapiens
gacacagacuugguacuga

SEQ ID NO: 510807 - RNA, 19 nt, Homo sapiens
acaagcugcucuuuauaau

SEQ ID NO: 510808 - RNA, 19 nt, Homo sapiens
gaaggacagugggccugaa

SEQ ID NO: 510809 - RNA, 19 nt, Homo sapiens
gggacaaucuuaucaaaau

SEQ ID NO: 510810 - RNA, 19 nt, Homo sapiens
gaaugggacaaucuuauca

SEQ ID NO: 510811 - RNA, 19 nt, Homo sapiens
ggaacuggaaugaugaaug

SEQ ID NO: 510812 - RNA, 19 nt, Homo sapiens
ggacacagacuugguacug

SEQ ID NO: 510813 - RNA, 19 nt, Homo sapiens
ggaugagacuggcaauggu

SEQ ID NO: 510814 - RNA, 19 nt, Homo sapiens
gaccacagggaguaaauug

SEQ ID NO: 510815 - RNA, 19 nt, Homo sapiens
cauuauguaugagggauuu

SEQ ID NO: 510816 - RNA, 19 nt, Homo sapiens
ucagagaguguuuguaguu

SEQ ID NO: 510817 - RNA, 19 nt, Homo sapiens
gacagaagagcaacugaga

SEQ ID NO: 510818 - RNA, 19 nt, Homo sapiens
ggaagcaccauguuugaag

SEQ ID NO: 510819 - RNA, 19 nt, Homo sapiens
cugcaguacuugcuucaaa

SEQ ID NO: 510820 - RNA, 19 nt, Homo sapiens
acagacacacgcaacuuua

SEQ ID NO: 510821 - RNA, 19 nt, Homo sapiens
gaguaaaaguguguacaua

SEQ ID NO: 510822 - RNA, 19 nt, Homo sapiens
gaacugaggaguaaaagug

SEQ ID NO: 510823 - RNA, 19 nt, Homo sapiens
caacggcuacugcaacgaa

SEQ ID NO: 510824 - RNA, 19 nt, Homo sapiens
uggcacaacucaucucauc

SEQ ID NO: 510825 - RNA, 19 nt, Homo sapiens
ugacagccaucauuuugua

SEQ ID NO: 510826 - RNA, 19 nt, Homo sapiens
ggacagugggccugaaauc

SEQ ID NO: 510827 - RNA, 19 nt, Homo sapiens
gagaugagcuuccagauga

SEQ ID NO: 510828 - RNA, 19 nt, Homo sapiens
guacgaagauaaccaaauc

SEQ ID NO: 510829 - RNA, 19 nt, Homo sapiens
gaaaugucaugaccuugaa

SEQ ID NO: 510830 - RNA, 19 nt, Homo sapiens
ucaaauauguugcaaugga

SEQ ID NO: 510831 - RNA, 19 nt, Homo sapiens
caaaugaguacgaagauaa

SEQ ID NO: 510832 - RNA, 19 nt, Homo sapiens
gcaaauacaagcucaccua

SEQ ID NO: 510833 - RNA, 19 nt, Homo sapiens
ggagugugguggcgucuuu

SEQ ID NO: 510834 - RNA, 19 nt, Homo sapiens
ggaaaugucaugaccuuga

SEQ ID NO: 510835 - RNA, 19 nt, Homo sapiens
gaagauuuagccacuuaua

SEQ ID NO: 510836 - RNA, 19 nt, Homo sapiens
gcggccaucucgcaacuua

SEQ ID NO: 510837 - RNA, 19 nt, Homo sapiens
ccaaaugaguacgaagaua

SEQ ID NO: 510838 - RNA, 19 nt, Homo sapiens
uggaagauuuagccacuua

SEQ ID NO: 510839 - RNA, 19 nt, Homo sapiens
ccacugcucugagaauuug

SEQ ID NO: 510840 - RNA, 19 nt, Homo sapiens
ggaagauacuguggagaug

SEQ ID NO: 510841 - RNA, 19 nt, Homo sapiens
uauggaauccgucucaaua

SEQ ID NO: 510842 - RNA, 19 nt, Homo sapiens
guaccuauauguauuugca

SEQ ID NO: 510843 - RNA, 19 nt, Homo sapiens
cagguugcuuggcugauua

SEQ ID NO: 510844 - RNA, 19 nt, Homo sapiens
caggaaaugucaugaccuu

SEQ ID NO: 510845 - RNA, 19 nt, Homo sapiens
caaauauguugcaauggau

SEQ ID NO: 510846 - RNA, 19 nt, Homo sapiens
gaagauacuguggagauga

SEQ ID NO: 510847 - RNA, 19 nt, Homo sapiens
gucaugaccuugaaguuuc

SEQ ID NO: 510848 - RNA, 19 nt, Homo sapiens
ggagaugagcuuccagaug

SEQ ID NO: 510849 - RNA, 19 nt, Homo sapiens
gaagcacggucuggcaaau

SEQ ID NO: 510850 - RNA, 19 nt, Homo sapiens
gacgauaugaucaucuuaa

SEQ ID NO: 510851 - RNA, 19 nt, Homo sapiens
gcacauuagacucaaguau

SEQ ID NO: 510852 - RNA, 19 nt, Homo sapiens
gaugggaugccuauugcua

SEQ ID NO: 510853 - RNA, 19 nt, Homo sapiens
aaagaugggaugccuauug

SEQ ID NO: 510854 - RNA, 19 nt, Homo sapiens
gagguuuccaaaucaaaua

SEQ ID NO: 510855 - RNA, 19 nt, Homo sapiens
caucaucaguacaggaaau

SEQ ID NO: 510856 - RNA, 19 nt, Homo sapiens
cuaaggcggugugugaauu

SEQ ID NO: 510857 - RNA, 19 nt, Homo sapiens
ggcugauuauguugaaaua

SEQ ID NO: 510858 - RNA, 19 nt, Homo sapiens
uugcuuggcugauuauguu

SEQ ID NO: 510859 - RNA, 19 nt, Homo sapiens
ccagguugcuuggcugauu

SEQ ID NO: 510860 - RNA, 19 nt, Homo sapiens
aagccugucucuauuguug

SEQ ID NO: 510861 - RNA, 19 nt, Homo sapiens
uauuuaagccugucucuau

SEQ ID NO: 510862 - RNA, 19 nt, Homo sapiens
gaacuccuuugaucucacu

SEQ ID NO: 510863 - RNA, 19 nt, Homo sapiens
ccuugaaguuucuaaguga

SEQ ID NO: 510864 - RNA, 19 nt, Homo sapiens
ucuccaggcuucccaaaug

SEQ ID NO: 510865 - RNA, 19 nt, Homo sapiens
uaaucccacugcauagaaa

SEQ ID NO: 510866 - RNA, 19 nt, Homo sapiens
ccuuugaucucacuguuau

SEQ ID NO: 510867 - RNA, 19 nt, Homo sapiens
uuacagauccaaagcaaau

SEQ ID NO: 510868 - RNA, 19 nt, Homo sapiens
ggaauccgucucaauagga

SEQ ID NO: 510869 - RNA, 19 nt, Homo sapiens
caacuuacaagcagcuaga

SEQ ID NO: 510870 - RNA, 19 nt, Homo sapiens
gggaagauacuguggagau

SEQ ID NO: 510871 - RNA, 19 nt, Homo sapiens
cuacuucuacuggaaauaa

SEQ ID NO: 510872 - RNA, 19 nt, Homo sapiens
ccaaauccagucaaggaaa

SEQ ID NO: 510873 - RNA, 19 nt, Homo sapiens
caaguauggucagcguauu

SEQ ID NO: 510874 - RNA, 19 nt, Homo sapiens
ugaaagaugggaugccuau

SEQ ID NO: 510875 - RNA, 19 nt, Homo sapiens
gggcccaacuguggauuug

SEQ ID NO: 510876 - RNA, 19 nt, Homo sapiens
guacuacuucuacuggaaa

SEQ ID NO: 510877 - RNA, 19 nt, Homo sapiens
ucacuacaacugacgauau

SEQ ID NO: 510878 - RNA, 19 nt, Homo sapiens
cacuacaacugacgauaug

SEQ ID NO: 510879 - RNA, 19 nt, Homo sapiens
uauaugacaguuacgauga

SEQ ID NO: 510880 - RNA, 19 nt, Homo sapiens
acauuagacucaaguaugg

SEQ ID NO: 510881 - RNA, 19 nt, Homo sapiens
gacaucaucaguacaggaa

SEQ ID NO: 510882 - RNA, 19 nt, Homo sapiens
aagcuaaggcgguguguga

SEQ ID NO: 510883 - RNA, 19 nt, Homo sapiens
gaauccugcucuauguaca

SEQ ID NO: 510884 - RNA, 19 nt, Homo sapiens
caaauccagucaaggaaaa

SEQ ID NO: 510885 - RNA, 19 nt, Homo sapiens
ucaauaggagugaaagaug

SEQ ID NO: 510886 - RNA, 19 nt, Homo sapiens
gcaauaaauauccuugaac

SEQ ID NO: 510887 - RNA, 19 nt, Homo sapiens
ccugcucuauguacaguuu

SEQ ID NO: 510888 - RNA, 19 nt, Homo sapiens
ugucaugaccuugaaguuu

SEQ ID NO: 510889 - RNA, 19 nt, Homo sapiens
gguggcgucuuuacagauc

SEQ ID NO: 510890 - RNA, 19 nt, Homo sapiens
caagcucaccuacgcagaa

SEQ ID NO: 510891 - RNA, 19 nt, Homo sapiens
ggagguuuccaaaucaaau

SEQ ID NO: 510892 - RNA, 19 nt, Homo sapiens
agugacagcuggagguuuc

SEQ ID NO: 510893 - RNA, 19 nt, Homo sapiens
cacauuagacucaaguaug

SEQ ID NO: 510894 - RNA, 19 nt, Homo sapiens
ggcggugugugaauuugaa

SEQ ID NO: 510895 - RNA, 19 nt, Homo sapiens
caacugacgauaugaucau

SEQ ID NO: 510896 - RNA, 19 nt, Homo sapiens
uaaggcggugugugaauuu

SEQ ID NO: 510897 - RNA, 19 nt, Homo sapiens
guuggaauuucaggucauu

SEQ ID NO: 510898 - RNA, 19 nt, Homo sapiens
cucauaaucccacugcaua

SEQ ID NO: 510899 - RNA, 19 nt, Homo sapiens
acagauccaaagcaaauuu

SEQ ID NO: 510900 - RNA, 19 nt, Homo sapiens
gcuacaacccacacgcaaa

SEQ ID NO: 510901 - RNA, 19 nt, Homo sapiens
ggaauccugcucuauguac

SEQ ID NO: 510902 - RNA, 19 nt, Homo sapiens
gauccuguauccaaaucca

SEQ ID NO: 510903 - RNA, 19 nt, Homo sapiens
ucaaguauggucagcguau

SEQ ID NO: 510904 - RNA, 19 nt, Homo sapiens
gugguggcgucuuuacaga

SEQ ID NO: 510905 - RNA, 19 nt, Homo sapiens
gcuguuacuucacuacaac

SEQ ID NO: 510906 - RNA, 19 nt, Homo sapiens
gaagccagggcccaacugu

SEQ ID NO: 510907 - RNA, 19 nt, Homo sapiens
uuaagccugucucuauugu

SEQ ID NO: 510908 - RNA, 19 nt, Homo sapiens
ccaaaucaaauauguugca

SEQ ID NO: 510909 - RNA, 19 nt, Homo sapiens
gaugauguccauggcuuug

SEQ ID NO: 510910 - RNA, 19 nt, Homo sapiens
ucaccuacgcagaagcuaa

SEQ ID NO: 510911 - RNA, 19 nt, Homo sapiens
gaagaugacccagguugcu

SEQ ID NO: 510912 - RNA, 19 nt, Homo sapiens
ggcuguuacuucacuacaa

SEQ ID NO: 510913 - RNA, 19 nt, Homo sapiens
gcuaaggcggugugugaau

SEQ ID NO: 510914 - RNA, 19 nt, Homo sapiens
cuccaggcuucccaaauga

SEQ ID NO: 510915 - RNA, 19 nt, Homo sapiens
gaaagaugggaugccuauu

SEQ ID NO: 510916 - RNA, 19 nt, Homo sapiens
cauaaucccacugcauaga

SEQ ID NO: 510917 - RNA, 19 nt, Homo sapiens
ggaaacuuuaaacgagaaa

SEQ ID NO: 510918 - RNA, 19 nt, Homo sapiens
gaccuugaaguuucuaagu

SEQ ID NO: 510919 - RNA, 19 nt, Homo sapiens
gaacgagcagccggugugu

SEQ ID NO: 510920 - RNA, 19 nt, Homo sapiens
ggaugccuauugcuacaac

SEQ ID NO: 510921 - RNA, 19 nt, Homo sapiens
gcuaagggcagaguuggau

SEQ ID NO: 510922 - RNA, 19 nt, Homo sapiens
uuggaauccugcucuaugu

SEQ ID NO: 510923 - RNA, 19 nt, Homo sapiens
guauccaaauccagucaag

SEQ ID NO: 510924 - RNA, 19 nt, Homo sapiens
cugacgauaugaucaucuu

SEQ ID NO: 510925 - RNA, 19 nt, Homo sapiens
aagaugggaugccuauugc

SEQ ID NO: 510926 - RNA, 19 nt, Homo sapiens
aggaaacuuuaaacgagaa

SEQ ID NO: 510927 - RNA, 19 nt, Homo sapiens
gaaccuacuuguacaauga

SEQ ID NO: 510928 - RNA, 19 nt, Homo sapiens
gaagagagauagugugugu

SEQ ID NO: 510929 - RNA, 19 nt, Homo sapiens
gagugugucuccuguagua

SEQ ID NO: 510930 - RNA, 19 nt, Homo sapiens
caaaggaaccuacuuguac

SEQ ID NO: 510931 - RNA, 19 nt, Homo sapiens
uuaaagcucugcucuugga

SEQ ID NO: 510932 - RNA, 19 nt, Homo sapiens
ccuccucucugcuuuaauu

SEQ ID NO: 510933 - RNA, 19 nt, Homo sapiens
ccaugcagguuucuuucua

SEQ ID NO: 510934 - RNA, 19 nt, Homo sapiens
ggaaccuacuuguacaaug

SEQ ID NO: 510935 - RNA, 19 nt, Homo sapiens
gcacauagcaagcugaacu

SEQ ID NO: 510936 - RNA, 19 nt, Homo sapiens
gcuagcagccgccuacuug

SEQ ID NO: 510937 - RNA, 19 nt, Homo sapiens
ccacaaaggaaccuacuug

SEQ ID NO: 510938 - RNA, 19 nt, Homo sapiens
gagaagagagauagugugu

SEQ ID NO: 510939 - RNA, 19 nt, Homo sapiens
ugaaggaacuacuacuaag

SEQ ID NO: 510940 - RNA, 19 nt, Homo sapiens
aaauauauccacccucaaa

SEQ ID NO: 510941 - RNA, 19 nt, Homo sapiens
ucucaacccucaacuguca

SEQ ID NO: 510942 - RNA, 19 nt, Homo sapiens
caugcagguuucuuucuaa

SEQ ID NO: 510943 - RNA, 19 nt, Homo sapiens
guggagaucucuucuugca

SEQ ID NO: 510944 - RNA, 19 nt, Homo sapiens
caacacugccucacucuuc

SEQ ID NO: 510945 - RNA, 19 nt, Homo sapiens
gagcuugaaggaacuacua

SEQ ID NO: 510946 - RNA, 19 nt, Homo sapiens
aaaggaaccuacuuguaca

SEQ ID NO: 510947 - RNA, 19 nt, Homo sapiens
aagcugaacuguccuaagg

SEQ ID NO: 510948 - RNA, 19 nt, Homo sapiens
cacagagccuagacacuga

SEQ ID NO: 510949 - RNA, 19 nt, Homo sapiens
aguuaaagcucugcucuug

SEQ ID NO: 510950 - RNA, 19 nt, Homo sapiens
aagcucuacuccauuguuu

SEQ ID NO: 510951 - RNA, 19 nt, Homo sapiens
ggaaaucgacaccugaaaa

SEQ ID NO: 510952 - RNA, 19 nt, Homo sapiens
guguguggcugcaggaaga

SEQ ID NO: 510953 - RNA, 19 nt, Homo sapiens
gagccugagugggugguuu

SEQ ID NO: 510954 - RNA, 19 nt, Homo sapiens
gaaccaguaccggcauuau

SEQ ID NO: 510955 - RNA, 19 nt, Homo sapiens
uccaagcucuacuccauug

SEQ ID NO: 510956 - RNA, 19 nt, Homo sapiens
ccaaaugccgaaaggaaau

SEQ ID NO: 510957 - RNA, 19 nt, Homo sapiens
gcccagucuucucagauga

SEQ ID NO: 510958 - RNA, 19 nt, Homo sapiens
cggcauuauuggagugaaa

SEQ ID NO: 510959 - RNA, 19 nt, Homo sapiens
acacugcccugagcccaaa

SEQ ID NO: 510960 - RNA, 19 nt, Homo sapiens
gcucuacuccauuguuugu

SEQ ID NO: 510961 - RNA, 19 nt, Homo sapiens
gaccaggccgugaucucua

SEQ ID NO: 510962 - RNA, 19 nt, Homo sapiens
ugccucagcugcuccaaau

SEQ ID NO: 510963 - RNA, 19 nt, Homo sapiens
agguggagaucucuucuug

SEQ ID NO: 510964 - RNA, 19 nt, Homo sapiens
uugaaggaacuacuacuaa

SEQ ID NO: 510965 - RNA, 19 nt, Homo sapiens
ucgauuugcuguaccaagu

SEQ ID NO: 510966 - RNA, 19 nt, Homo sapiens
gggagaagagagauagugu

SEQ ID NO: 510967 - RNA, 19 nt, Homo sapiens
uuuaauguaucgcuaccaa

SEQ ID NO: 510968 - RNA, 19 nt, Homo sapiens
gaaggaacuacuacuaagc

SEQ ID NO: 510969 - RNA, 19 nt, Homo sapiens
gacagggagaagagagaua

SEQ ID NO: 510970 - RNA, 19 nt, Homo sapiens
ggagugagaggccauagcu

SEQ ID NO: 510971 - RNA, 19 nt, Homo sapiens
caagcucuacuccauuguu

SEQ ID NO: 510972 - RNA, 19 nt, Homo sapiens
gggaaaucgacaccugaaa

SEQ ID NO: 510973 - RNA, 19 nt, Homo sapiens
aguccaagcucuacuccau

SEQ ID NO: 510974 - RNA, 19 nt, Homo sapiens
gcugagcgaccacgagauc

SEQ ID NO: 510975 - RNA, 19 nt, Homo sapiens
ggaccaggccgugaucucu

SEQ ID NO: 510976 - RNA, 19 nt, Homo sapiens
ggaaguccaagcucuacuc

SEQ ID NO: 510977 - RNA, 19 nt, Homo sapiens
auaauucgauuugcuguac

SEQ ID NO: 510978 - RNA, 19 nt, Homo sapiens
gggcgagcacggaacaaug

SEQ ID NO: 510979 - RNA, 19 nt, Homo sapiens
gcaacacugccucacucuu

SEQ ID NO: 510980 - RNA, 19 nt, Homo sapiens
gcaagcugaacuguccuaa

SEQ ID NO: 510981 - RNA, 19 nt, Homo sapiens
ccguugcgcuggaaggaau

SEQ ID NO: 510982 - RNA, 19 nt, Homo sapiens
cuugaaggaacuacuacua

SEQ ID NO: 510983 - RNA, 19 nt, Homo sapiens
gcugcaggaagaaccagua

SEQ ID NO: 510984 - RNA, 19 nt, Homo sapiens
ggacagggagaagagagau

SEQ ID NO: 510985 - RNA, 19 nt, Homo sapiens
cgcccagucuucucagaug

SEQ ID NO: 510986 - RNA, 19 nt, Homo sapiens
uauauccacccucaaaaua

SEQ ID NO: 510987 - RNA, 19 nt, Homo sapiens
ucagucccgugcccaguuc

SEQ ID NO: 510988 - RNA, 19 nt, Homo sapiens
ucccuccucuucauugguu

SEQ ID NO: 510989 - RNA, 19 nt, Homo sapiens
accaguaccggcauuauug

SEQ ID NO: 510990 - RNA, 19 nt, Homo sapiens
uccaaaugccgaaaggaaa

SEQ ID NO: 510991 - RNA, 19 nt, Homo sapiens
gaggaugagggacgcuaug

SEQ ID NO: 510992 - RNA, 19 nt, Homo sapiens
gugcuaaccccucgaugua

SEQ ID NO: 510993 - RNA, 19 nt, Homo sapiens
aagaaccaguaccggcauu

SEQ ID NO: 510994 - RNA, 19 nt, Homo sapiens
caaaugccgaaaggaaaug

SEQ ID NO: 510995 - RNA, 19 nt, Homo sapiens
gaaaaccaccucagacacu

SEQ ID NO: 510996 - RNA, 19 nt, Homo sapiens
guaccaagugccacaaagg

SEQ ID NO: 510997 - RNA, 19 nt, Homo sapiens
caagauaacgcacuucuaa

SEQ ID NO: 510998 - RNA, 19 nt, Homo sapiens
cgacuucgcucuuccaguu

SEQ ID NO: 510999 - RNA, 19 nt, Homo sapiens
gcagugacgugcaccugua

SEQ ID NO: 511000 - RNA, 19 nt, Homo sapiens
gggaagcgaugaauuugga

SEQ ID NO: 511001 - RNA, 19 nt, Homo sapiens
ccaagacaaugaaaguuug

SEQ ID NO: 511002 - RNA, 19 nt, Homo sapiens
uaaaggagaaggcaugaaa

SEQ ID NO: 511003 - RNA, 19 nt, Homo sapiens
gcagggugauaaauuguug

SEQ ID NO: 511004 - RNA, 19 nt, Homo sapiens
caagccagcuccacaaugg

SEQ ID NO: 511005 - RNA, 19 nt, Homo sapiens
aaugaaaguuugcacugua

SEQ ID NO: 511006 - RNA, 19 nt, Homo sapiens
gauaacgcacuucuaacua

SEQ ID NO: 511007 - RNA, 19 nt, Homo sapiens
ggacggcauuccugcuuau

SEQ ID NO: 511008 - RNA, 19 nt, Homo sapiens
gcacaugccggcucagaga

SEQ ID NO: 511009 - RNA, 19 nt, Homo sapiens
caucagacguggugugcaa

SEQ ID NO: 511010 - RNA, 19 nt, Homo sapiens
ccaacaagccaacgacaaa

SEQ ID NO: 511011 - RNA, 19 nt, Homo sapiens
ggugaacugugucaucaug

SEQ ID NO: 511012 - RNA, 19 nt, Homo sapiens
cuuggcagcugaacuauug

SEQ ID NO: 511013 - RNA, 19 nt, Homo sapiens
ccagguuucugcccacauu

SEQ ID NO: 511014 - RNA, 19 nt, Homo sapiens
agccuugggucuacuaaua

SEQ ID NO: 511015 - RNA, 19 nt, Homo sapiens
guacauggccagugugauc

SEQ ID NO: 511016 - RNA, 19 nt, Homo sapiens
gcaaaagucuucuguacca

SEQ ID NO: 511017 - RNA, 19 nt, Homo sapiens
gcauuccugcuuaucaaua

SEQ ID NO: 511018 - RNA, 19 nt, Homo sapiens
ugaauggccugccuugaag

SEQ ID NO: 511019 - RNA, 19 nt, Homo sapiens
gggccaaguuccucuagug

SEQ ID NO: 511020 - RNA, 19 nt, Homo sapiens
gcaagauaacgcacuucua

SEQ ID NO: 511021 - RNA, 19 nt, Homo sapiens
ucacuugccugccgauaag

SEQ ID NO: 511022 - RNA, 19 nt, Homo sapiens
caaugaaaguuugcacugu

SEQ ID NO: 511023 - RNA, 19 nt, Homo sapiens
gcaccuauagucccagcua

SEQ ID NO: 511024 - RNA, 19 nt, Homo sapiens
gaacuagagaugacugagu

SEQ ID NO: 511025 - RNA, 19 nt, Homo sapiens
uaauaggaguggugaacug

SEQ ID NO: 511026 - RNA, 19 nt, Homo sapiens
gccgggaagcgaugaauuu

SEQ ID NO: 511027 - RNA, 19 nt, Homo sapiens
agaauacuaugaccagaca

SEQ ID NO: 511028 - RNA, 19 nt, Homo sapiens
caaggucgguaaguugaau

SEQ ID NO: 511029 - RNA, 19 nt, Homo sapiens
uagccaaggucgguaaguu

SEQ ID NO: 511030 - RNA, 19 nt, Homo sapiens
guggugaacugugucauca

SEQ ID NO: 511031 - RNA, 19 nt, Homo sapiens
ccuaugaucccagcacuuu

SEQ ID NO: 511032 - RNA, 19 nt, Homo sapiens
caucaugacccaggugaaa

SEQ ID NO: 511033 - RNA, 19 nt, Homo sapiens
cggcauuccugcuuaucaa

SEQ ID NO: 511034 - RNA, 19 nt, Homo sapiens
caugccggcucagagaaua

SEQ ID NO: 511035 - RNA, 19 nt, Homo sapiens
ccacauuggacccacauga

SEQ ID NO: 511036 - RNA, 19 nt, Homo sapiens
gauaaaggagaaggcauga

SEQ ID NO: 511037 - RNA, 19 nt, Homo sapiens
agccaucucucuacuccua

SEQ ID NO: 511038 - RNA, 19 nt, Homo sapiens
cagggaauuucaggaacua

SEQ ID NO: 511039 - RNA, 19 nt, Homo sapiens
gcugggaaaucguuugaac

SEQ ID NO: 511040 - RNA, 19 nt, Homo sapiens
accaggaacugaaacauca

SEQ ID NO: 511041 - RNA, 19 nt, Homo sapiens
cccaagacaaugaaaguuu

SEQ ID NO: 511042 - RNA, 19 nt, Homo sapiens
ccaggcaggccaccauauu

SEQ ID NO: 511043 - RNA, 19 nt, Homo sapiens
gaaaaccccagcauccuuu

SEQ ID NO: 511044 - RNA, 19 nt, Homo sapiens
gaccagacagcucagaugu

SEQ ID NO: 511045 - RNA, 19 nt, Homo sapiens
uggacggcauuccugcuua

SEQ ID NO: 511046 - RNA, 19 nt, Homo sapiens
auaacgcacuucuaacuag

SEQ ID NO: 511047 - RNA, 19 nt, Homo sapiens
cagcggagccuggagagaa

SEQ ID NO: 511048 - RNA, 19 nt, Homo sapiens
ggccuugguucccuugugu

SEQ ID NO: 511049 - RNA, 19 nt, Homo sapiens
aaggagaaggcaugaaauu

SEQ ID NO: 511050 - RNA, 19 nt, Homo sapiens
gaucccaagugccagucuu

SEQ ID NO: 511051 - RNA, 19 nt, Homo sapiens
gcaccgggagcucagauuc

SEQ ID NO: 511052 - RNA, 19 nt, Homo sapiens
gccaaggucgguaaguuga

SEQ ID NO: 511053 - RNA, 19 nt, Homo sapiens
ccucguagccaucucucua

SEQ ID NO: 511054 - RNA, 19 nt, Homo sapiens
gaacgggguccuucaaguu

SEQ ID NO: 511055 - RNA, 19 nt, Homo sapiens
uaggaguggugaacugugu

SEQ ID NO: 511056 - RNA, 19 nt, Homo sapiens
gaccaggaacugaaacauc

SEQ ID NO: 511057 - RNA, 19 nt, Homo sapiens
guugaucccaagacaauga

SEQ ID NO: 511058 - RNA, 19 nt, Homo sapiens
gagaaccucaggcuuccuu

SEQ ID NO: 511059 - RNA, 19 nt, Homo sapiens
ggccagaccaggaacugaa

SEQ ID NO: 511060 - RNA, 19 nt, Homo sapiens
cagccuggccaacauggua

SEQ ID NO: 511061 - RNA, 19 nt, Homo sapiens
ugcaguggcucacgccuau

SEQ ID NO: 511062 - RNA, 19 nt, Homo sapiens
ccagugcguuggacagaag

SEQ ID NO: 511063 - RNA, 19 nt, Homo sapiens
aagccaaggugccucacuu

SEQ ID NO: 511064 - RNA, 19 nt, Homo sapiens
gaaaguuugcacuguaugc

SEQ ID NO: 511065 - RNA, 19 nt, Homo sapiens
gcuaugaucgcgccacuac

SEQ ID NO: 511066 - RNA, 19 nt, Homo sapiens
gcucagagaauacuaugac

SEQ ID NO: 511067 - RNA, 19 nt, Homo sapiens
gaauuucaggaacuagaga

SEQ ID NO: 511068 - RNA, 19 nt, Homo sapiens
cgaugaauuuggagacucu

SEQ ID NO: 511069 - RNA, 19 nt, Homo sapiens
guaccacucaggccaacaa

SEQ ID NO: 511070 - RNA, 19 nt, Homo sapiens
uugaauggccugccuugaa

SEQ ID NO: 511071 - RNA, 19 nt, Homo sapiens
gggaauuucaggaacuaga

SEQ ID NO: 511072 - RNA, 19 nt, Homo sapiens
gcuguggccugggcaagau

SEQ ID NO: 511073 - RNA, 19 nt, Homo sapiens
gccuugggucuacuaauaa

SEQ ID NO: 511074 - RNA, 19 nt, Homo sapiens
gccacaccaucuccuuuca

SEQ ID NO: 511075 - RNA, 19 nt, Homo sapiens
uaacuagaaaucugccaau

SEQ ID NO: 511076 - RNA, 19 nt, Homo sapiens
gaugaagcccaguuaacca

SEQ ID NO: 511077 - RNA, 19 nt, Homo sapiens
ggaaucaagaugucagacu

SEQ ID NO: 511078 - RNA, 19 nt, Homo sapiens
gagucugucucaaaagaaa

SEQ ID NO: 511079 - RNA, 19 nt, Homo sapiens
agggagcacuggcgacuuc

SEQ ID NO: 511080 - RNA, 19 nt, Homo sapiens
ucagggaauuucaggaacu

SEQ ID NO: 511081 - RNA, 19 nt, Homo sapiens
ccuugugccugcagagaga

SEQ ID NO: 511082 - RNA, 19 nt, Homo sapiens
augaaaguuugcacuguau

SEQ ID NO: 511083 - RNA, 19 nt, Homo sapiens
guguugaucccaagacaau

SEQ ID NO: 511084 - RNA, 19 nt, Homo sapiens
ggaauuucaggaacuagag

SEQ ID NO: 511085 - RNA, 19 nt, Homo sapiens
gggccuugguucccuugug

SEQ ID NO: 511086 - RNA, 19 nt, Homo sapiens
ggggcagggugauaaauug

SEQ ID NO: 511087 - RNA, 19 nt, Homo sapiens
aacuagaaaucugccaauu

SEQ ID NO: 511088 - RNA, 19 nt, Homo sapiens
uaaaaccccaucucuacua

SEQ ID NO: 511089 - RNA, 19 nt, Homo sapiens
ggaacgggguccuucaagu

SEQ ID NO: 511090 - RNA, 19 nt, Homo sapiens
acaaugggagacacagauu

SEQ ID NO: 511091 - RNA, 19 nt, Homo sapiens
gccagugcguuggacagaa

SEQ ID NO: 511092 - RNA, 19 nt, Homo sapiens
gcucugaccagguggaaac

SEQ ID NO: 511093 - RNA, 19 nt, Homo sapiens
gcauggggauaaaggagaa

SEQ ID NO: 511094 - RNA, 19 nt, Homo sapiens
cuggaaaggcucagucuca

SEQ ID NO: 511095 - RNA, 19 nt, Homo sapiens
gccaacaagccaacgacaa

SEQ ID NO: 511096 - RNA, 19 nt, Homo sapiens
caacacacgcagccaacuc

SEQ ID NO: 511097 - RNA, 19 nt, Homo sapiens
uggaugagcugaagauaau

SEQ ID NO: 511098 - RNA, 19 nt, Homo sapiens
uagagcagcugacagaaga

SEQ ID NO: 511099 - RNA, 19 nt, Homo sapiens
ucgaggagcucaugaagga

SEQ ID NO: 511100 - RNA, 19 nt, Homo sapiens
ggagcugucugaccucuuc

SEQ ID NO: 511101 - RNA, 19 nt, Homo sapiens
ccaaggagcugggcaaggu

SEQ ID NO: 511102 - RNA, 19 nt, Homo sapiens
ugcaggagaugaucgauga

SEQ ID NO: 511103 - RNA, 19 nt, Homo sapiens
ugaaggguguggaguagau

SEQ ID NO: 511104 - RNA, 19 nt, Homo sapiens
gcacgguggacuuugauga

SEQ ID NO: 511105 - RNA, 19 nt, Homo sapiens
uggaguagaugcugaccuu

SEQ ID NO: 511106 - RNA, 19 nt, Homo sapiens
gcggcacgguggacuuuga

SEQ ID NO: 511107 - RNA, 19 nt, Homo sapiens
cugaggagcugcaggagau

SEQ ID NO: 511108 - RNA, 19 nt, Homo sapiens
ggacgacagcaaagggaaa

SEQ ID NO: 511109 - RNA, 19 nt, Homo sapiens
caugaaggacgacagcaaa

SEQ ID NO: 511110 - RNA, 19 nt, Homo sapiens
gaccugagccuggccaugu

SEQ ID NO: 511111 - RNA, 19 nt, Homo sapiens
gguggacuuugaugaguuc

SEQ ID NO: 511112 - RNA, 19 nt, Homo sapiens
caugaaggguguggaguag

SEQ ID NO: 511113 - RNA, 19 nt, Homo sapiens
gcaugaaggacgacagcaa

SEQ ID NO: 511114 - RNA, 19 nt, Homo sapiens
gaguagaugcugaccuuca

SEQ ID NO: 511115 - RNA, 19 nt, Homo sapiens
ucaugaaggguguggagua

SEQ ID NO: 511116 - RNA, 19 nt, Homo sapiens
gaaggacggagacaagaac

SEQ ID NO: 511117 - RNA, 19 nt, Homo sapiens
gagcugggcaaggugauga

SEQ ID NO: 511118 - RNA, 19 nt, Homo sapiens
ugaaggacggagacaagaa

SEQ ID NO: 511119 - RNA, 19 nt, Homo sapiens
guagagcagcugacagaag

SEQ ID NO: 511120 - RNA, 19 nt, Homo sapiens
augaugaguuccuggaguu

SEQ ID NO: 511121 - RNA, 19 nt, Homo sapiens
ggacggagacaagaacaac

SEQ ID NO: 511122 - RNA, 19 nt, Homo sapiens
gcugacagaagagcagaaa

SEQ ID NO: 511123 - RNA, 19 nt, Homo sapiens
cgacaucgaggagcucaug

SEQ ID NO: 511124 - RNA, 19 nt, Homo sapiens
ucugaccucuuccgcaugu

SEQ ID NO: 511125 - RNA, 19 nt, Homo sapiens
cgguagagcagcugacaga

SEQ ID NO: 511126 - RNA, 19 nt, Homo sapiens
cuggaugagcugaagauaa

SEQ ID NO: 511127 - RNA, 19 nt, Homo sapiens
cgaccuggaugagcugaag

SEQ ID NO: 511128 - RNA, 19 nt, Homo sapiens
gcaaggugaugaggaugcu

SEQ ID NO: 511129 - RNA, 19 nt, Homo sapiens
ugaccucuuccgcauguuu

SEQ ID NO: 511130 - RNA, 19 nt, Homo sapiens
caugaaggacggagacaag

SEQ ID NO: 511131 - RNA, 19 nt, Homo sapiens
gagccgccagcauggauga

SEQ ID NO: 511132 - RNA, 19 nt, Homo sapiens
ucacggaggacgacaucga

SEQ ID NO: 511133 - RNA, 19 nt, Homo sapiens
cgguggacuuugaugaguu

SEQ ID NO: 511134 - RNA, 19 nt, Homo sapiens
gaggagcugcaggagauga

SEQ ID NO: 511135 - RNA, 19 nt, Homo sapiens
cagcggcacgguggacuuu

SEQ ID NO: 511136 - RNA, 19 nt, Homo sapiens
cugaggaggagcugucuga

SEQ ID NO: 511137 - RNA, 19 nt, Homo sapiens
caauagagguaccuagaga

SEQ ID NO: 511138 - RNA, 19 nt, Homo sapiens
gggcaugucauuucuguuu

SEQ ID NO: 511139 - RNA, 19 nt, Homo sapiens
ugaacaaggugcugucuca

SEQ ID NO: 511140 - RNA, 19 nt, Homo sapiens
gcaccgaugagacugauuu

SEQ ID NO: 511141 - RNA, 19 nt, Homo sapiens
uuaaggaccugaagcugaa

SEQ ID NO: 511142 - RNA, 19 nt, Homo sapiens
gcacaugagaguuugagaa

SEQ ID NO: 511143 - RNA, 19 nt, Homo sapiens
gggccaaccucaagucugu

SEQ ID NO: 511144 - RNA, 19 nt, Homo sapiens
ucaagucugugaagaagga

SEQ ID NO: 511145 - RNA, 19 nt, Homo sapiens
ccacuaaauuggaaacucu

SEQ ID NO: 511146 - RNA, 19 nt, Homo sapiens
gaaggaagacacagagaag

SEQ ID NO: 511147 - RNA, 19 nt, Homo sapiens
gaggagcgauacgacauug

SEQ ID NO: 511148 - RNA, 19 nt, Homo sapiens
ccaaaugccuccacaacac

SEQ ID NO: 511149 - RNA, 19 nt, Homo sapiens
gcacggaugcacggacuaa

SEQ ID NO: 511150 - RNA, 19 nt, Homo sapiens
gcaggcggguuguacuuag

SEQ ID NO: 511151 - RNA, 19 nt, Homo sapiens
caucagagucuagaggaua

SEQ ID NO: 511152 - RNA, 19 nt, Homo sapiens
caugagaguuugagaacca

SEQ ID NO: 511153 - RNA, 19 nt, Homo sapiens
gaacguggaggccaugucu

SEQ ID NO: 511154 - RNA, 19 nt, Homo sapiens
gaucacugccucccgcaaa

SEQ ID NO: 511155 - RNA, 19 nt, Homo sapiens
cgaugagacugauuugagu

SEQ ID NO: 511156 - RNA, 19 nt, Homo sapiens
ucuccgaccucacaauaga

SEQ ID NO: 511157 - RNA, 19 nt, Homo sapiens
gugggugacuggaggaaga

SEQ ID NO: 511158 - RNA, 19 nt, Homo sapiens
ggcacaagguguccaugga

SEQ ID NO: 511159 - RNA, 19 nt, Homo sapiens
gggaucccuucaucucuga

SEQ ID NO: 511160 - RNA, 19 nt, Homo sapiens
gcacaagguguccauggau

SEQ ID NO: 511161 - RNA, 19 nt, Homo sapiens
ggacuaaggcaccgaugag

SEQ ID NO: 511162 - RNA, 19 nt, Homo sapiens
ggaccuccgugggaaguuc

SEQ ID NO: 511163 - RNA, 19 nt, Homo sapiens
gcaugucauuucuguuugg

SEQ ID NO: 511164 - RNA, 19 nt, Homo sapiens
cacaacaccagggagauua

SEQ ID NO: 511165 - RNA, 19 nt, Homo sapiens
ugccggaagucgagagaaa

SEQ ID NO: 511166 - RNA, 19 nt, Homo sapiens
ccacaacaccagggagauu

SEQ ID NO: 511167 - RNA, 19 nt, Homo sapiens
caccugggaugcaaaugau

SEQ ID NO: 511168 - RNA, 19 nt, Homo sapiens
ucaccugggaugcaaauga

SEQ ID NO: 511169 - RNA, 19 nt, Homo sapiens
caaaucagugguucuccaa

SEQ ID NO: 511170 - RNA, 19 nt, Homo sapiens
ggcaugucauuucuguuug

SEQ ID NO: 511171 - RNA, 19 nt, Homo sapiens
ccaagucuccgaccucaca

SEQ ID NO: 511172 - RNA, 19 nt, Homo sapiens
ugaagaaggaagacacaga

SEQ ID NO: 511173 - RNA, 19 nt, Homo sapiens
cacgaggacugaacaaggu

SEQ ID NO: 511174 - RNA, 19 nt, Homo sapiens
cacaauagagguaccuaga

SEQ ID NO: 511175 - RNA, 19 nt, Homo sapiens
gccggaagaagauguuuga

SEQ ID NO: 511176 - RNA, 19 nt, Homo sapiens
ccucaagucugugaagaag

SEQ ID NO: 511177 - RNA, 19 nt, Homo sapiens
aaucagugguucuccaagu

SEQ ID NO: 511178 - RNA, 19 nt, Homo sapiens
cggaagaagauguuugaug

SEQ ID NO: 511179 - RNA, 19 nt, Homo sapiens
gauacuugggcaugucauu

SEQ ID NO: 511180 - RNA, 19 nt, Homo sapiens
ggcaggcggguuguacuua

SEQ ID NO: 511181 - RNA, 19 nt, Homo sapiens
agaaggaagacacagagaa

SEQ ID NO: 511182 - RNA, 19 nt, Homo sapiens
gccaaaugccuccacaaca

SEQ ID NO: 511183 - RNA, 19 nt, Homo sapiens
gagaguuugagaaccacua

SEQ ID NO: 511184 - RNA, 19 nt, Homo sapiens
agguggaggugguggauga

SEQ ID NO: 511185 - RNA, 19 nt, Homo sapiens
gaccagcagcgucuacauc

SEQ ID NO: 511186 - RNA, 19 nt, Homo sapiens
cugaugcacaugagaguuu

SEQ ID NO: 511187 - RNA, 19 nt, Homo sapiens
gaaggccggaagaagaugu

SEQ ID NO: 511188 - RNA, 19 nt, Homo sapiens
gugauucugaugcacauga

SEQ ID NO: 511189 - RNA, 19 nt, Homo sapiens
aucagagucuagaggauaa

SEQ ID NO: 511190 - RNA, 19 nt, Homo sapiens
gagagaaaacccaagauca

SEQ ID NO: 511191 - RNA, 19 nt, Homo sapiens
ggagcgauacgacauugag

SEQ ID NO: 511192 - RNA, 19 nt, Homo sapiens
gggcaggcggguuguacuu

SEQ ID NO: 511193 - RNA, 19 nt, Homo sapiens
gcauggaaggccggaagaa

SEQ ID NO: 511194 - RNA, 19 nt, Homo sapiens
agucuccgaccucacaaua

SEQ ID NO: 511195 - RNA, 19 nt, Homo sapiens
acaacaccagggagauuaa

SEQ ID NO: 511196 - RNA, 19 nt, Homo sapiens
ggagauuaaggaccugaag

SEQ ID NO: 511197 - RNA, 19 nt, Homo sapiens
ccgaugagacugauuugag

SEQ ID NO: 511198 - RNA, 19 nt, Homo sapiens
ugaugcacaugagaguuug

SEQ ID NO: 511199 - RNA, 19 nt, Homo sapiens
ggaagaacaucgaggagaa

SEQ ID NO: 511200 - RNA, 19 nt, Homo sapiens
gcaaggagcuggaggacau

SEQ ID NO: 511201 - RNA, 19 nt, Homo sapiens
ccacggagcuggagaagga

SEQ ID NO: 511202 - RNA, 19 nt, Homo sapiens
ugaagcaggucaagaagga

SEQ ID NO: 511203 - RNA, 19 nt, Homo sapiens
ggacaugaaccagaagcua

SEQ ID NO: 511204 - RNA, 19 nt, Homo sapiens
caagaucgaugcggcugaa

SEQ ID NO: 511205 - RNA, 19 nt, Homo sapiens
caccgucaauaaaggauuu

SEQ ID NO: 511206 - RNA, 19 nt, Homo sapiens
gaugggagaugaggagaag

SEQ ID NO: 511207 - RNA, 19 nt, Homo sapiens
gaacaucgaggagaagucu

SEQ ID NO: 511208 - RNA, 19 nt, Homo sapiens
gacaugaaccagaagcuau

SEQ ID NO: 511209 - RNA, 19 nt, Homo sapiens
uggaggacaugaaccagaa

SEQ ID NO: 511210 - RNA, 19 nt, Homo sapiens
ucaagaaggaggacacaga

SEQ ID NO: 511211 - RNA, 19 nt, Homo sapiens
ucaccaccaccgucaauaa

SEQ ID NO: 511212 - RNA, 19 nt, Homo sapiens
gugggugacuggaggaaga

SEQ ID NO: 511213 - RNA, 19 nt, Homo sapiens
gaggugagggugcagaaga

SEQ ID NO: 511214 - RNA, 19 nt, Homo sapiens
gaaggaggacacagagaag

SEQ ID NO: 511215 - RNA, 19 nt, Homo sapiens
gaaccagaagcuauuugau

SEQ ID NO: 511216 - RNA, 19 nt, Homo sapiens
agaaggaggacacagagaa

SEQ ID NO: 511217 - RNA, 19 nt, Homo sapiens
aggcagagaagcagaacua

SEQ ID NO: 511218 - RNA, 19 nt, Homo sapiens
cggcugaagaggagaagua

SEQ ID NO: 511219 - RNA, 19 nt, Homo sapiens
ccaccaccgucaauaaagg

SEQ ID NO: 511220 - RNA, 19 nt, Homo sapiens
gccggaagaagauguuuga

SEQ ID NO: 511221 - RNA, 19 nt, Homo sapiens
ugaaccagaagcuauuuga

SEQ ID NO: 511222 - RNA, 19 nt, Homo sapiens
caccaccaccgucaauaaa

SEQ ID NO: 511223 - RNA, 19 nt, Homo sapiens
accagaagcuauuugaucu

SEQ ID NO: 511224 - RNA, 19 nt, Homo sapiens
gaagaacaucgaggagaag

SEQ ID NO: 511225 - RNA, 19 nt, Homo sapiens
gaucgaugcggcugaagag

SEQ ID NO: 511226 - RNA, 19 nt, Homo sapiens
acaugaaccagaagcuauu

SEQ ID NO: 511227 - RNA, 19 nt, Homo sapiens
ggaugggagaugaggagaa

SEQ ID NO: 511228 - RNA, 19 nt, Homo sapiens
cagagaagcagaacuaccu

SEQ ID NO: 511229 - RNA, 19 nt, Homo sapiens
cggaagaagauguuugagu

SEQ ID NO: 511230 - RNA, 19 nt, Homo sapiens
aaccagaagcuauuugauc

SEQ ID NO: 511231 - RNA, 19 nt, Homo sapiens
caugaaccagaagcuauuu

SEQ ID NO: 511232 - RNA, 19 nt, Homo sapiens
cugaagaggagaaguacga

SEQ ID NO: 511233 - RNA, 19 nt, Homo sapiens
gaauaaagcuucucucuga

SEQ ID NO: 511234 - RNA, 19 nt, Homo sapiens
gaacaucgaugcacugagu

SEQ ID NO: 511235 - RNA, 19 nt, Homo sapiens
gaagagagauacgacauag

SEQ ID NO: 511236 - RNA, 19 nt, Homo sapiens
caagguggaugaagagaga

SEQ ID NO: 511237 - RNA, 19 nt, Homo sapiens
ucaagcaggugaagaagga

SEQ ID NO: 511238 - RNA, 19 nt, Homo sapiens
gagggccacugaggaauaa

SEQ ID NO: 511239 - RNA, 19 nt, Homo sapiens
ccaagaacaucacggagau

SEQ ID NO: 511240 - RNA, 19 nt, Homo sapiens
ggagggccacugaggaaua

SEQ ID NO: 511241 - RNA, 19 nt, Homo sapiens
gauacgacauagaggcaaa

SEQ ID NO: 511242 - RNA, 19 nt, Homo sapiens
gaccuucgaggcaaguuua

SEQ ID NO: 511243 - RNA, 19 nt, Homo sapiens
ucgcggagcugcaggacuu

SEQ ID NO: 511244 - RNA, 19 nt, Homo sapiens
gaggagggccacugaggaa

SEQ ID NO: 511245 - RNA, 19 nt, Homo sapiens
ugaagagagauacgacaua

SEQ ID NO: 511246 - RNA, 19 nt, Homo sapiens
ugacucagaagaucuuuga

SEQ ID NO: 511247 - RNA, 19 nt, Homo sapiens
gaacaucacggagauugca

SEQ ID NO: 511248 - RNA, 19 nt, Homo sapiens
uggacaagguggaugaaga

SEQ ID NO: 511249 - RNA, 19 nt, Homo sapiens
ggacaagguggaugaagag

SEQ ID NO: 511250 - RNA, 19 nt, Homo sapiens
gugggagacuggcggaaga

SEQ ID NO: 511251 - RNA, 19 nt, Homo sapiens
ggaggacaccgagaaggaa

SEQ ID NO: 511252 - RNA, 19 nt, Homo sapiens
gaaggaggacaccgagaag

SEQ ID NO: 511253 - RNA, 19 nt, Homo sapiens
ccacugaggaauaaagcuu

SEQ ID NO: 511254 - RNA, 19 nt, Homo sapiens
gaggacaccgagaaggaaa

SEQ ID NO: 511255 - RNA, 19 nt, Homo sapiens
agaaggaggacaccgagaa

SEQ ID NO: 511256 - RNA, 19 nt, Homo sapiens
gagacuggcggaagaacau

SEQ ID NO: 511257 - RNA, 19 nt, Homo sapiens
gcaaaagucaccaagaaca

SEQ ID NO: 511258 - RNA, 19 nt, Homo sapiens
agagagauacgacauagag

SEQ ID NO: 511259 - RNA, 19 nt, Homo sapiens
aauugcagcugaagacucu

SEQ ID NO: 511260 - RNA, 19 nt, Homo sapiens
ggagacuggcggaagaaca

SEQ ID NO: 511261 - RNA, 19 nt, Homo sapiens
agacgccgcuccuccaacu

SEQ ID NO: 511262 - RNA, 19 nt, Homo sapiens
cgagaaaauugcagcugaa

SEQ ID NO: 511263 - RNA, 19 nt, Homo sapiens
ccaacuaccgcgcuuaugc

SEQ ID NO: 511264 - RNA, 19 nt, Homo sapiens
gaaaauugcagcugaagac

SEQ ID NO: 511265 - RNA, 19 nt, Homo sapiens
aggcaaaagucaccaagaa

SEQ ID NO: 511266 - RNA, 19 nt, Homo sapiens
ggagccgcacgccaagaaa

SEQ ID NO: 511267 - RNA, 19 nt, Homo sapiens
caagaacaucacggagauu

SEQ ID NO: 511268 - RNA, 19 nt, Homo sapiens
aaagucaccaagaacauca

SEQ ID NO: 511269 - RNA, 19 nt, Homo sapiens
ucagaagaucuuugaccuu

SEQ ID NO: 511270 - RNA, 19 nt, Homo sapiens
aagaacaucacggagauug

SEQ ID NO: 511271 - RNA, 19 nt, Homo sapiens
caacagcgcuucagaacug

SEQ ID NO: 511272 - RNA, 19 nt, Homo sapiens
ugaaacagcagaaauauga

SEQ ID NO: 511273 - RNA, 19 nt, Homo sapiens
gcaagcgcauggagaaaga

SEQ ID NO: 511274 - RNA, 19 nt, Homo sapiens
uaagaagccucuggacauu

SEQ ID NO: 511275 - RNA, 19 nt, Homo sapiens
gcagaaauaugagaucaac

SEQ ID NO: 511276 - RNA, 19 nt, Homo sapiens
guaagaagccucuggacau

SEQ ID NO: 511277 - RNA, 19 nt, Homo sapiens
agaagccucuggacauuga

SEQ ID NO: 511278 - RNA, 19 nt, Homo sapiens
ccgaggagcaggaauauga

SEQ ID NO: 511279 - RNA, 19 nt, Homo sapiens
ccauggacuugucauaaga

SEQ ID NO: 511280 - RNA, 19 nt, Homo sapiens
gagcaacagcgcuucagaa

SEQ ID NO: 511281 - RNA, 19 nt, Homo sapiens
acucaucgauguacauuuc

SEQ ID NO: 511282 - RNA, 19 nt, Homo sapiens
cagcagaaauaugagauca

SEQ ID NO: 511283 - RNA, 19 nt, Homo sapiens
gaacagaagcgugguaagc

SEQ ID NO: 511284 - RNA, 19 nt, Homo sapiens
cagccuagguucccaugga

SEQ ID NO: 511285 - RNA, 19 nt, Homo sapiens
gcagacacucaucgaugua

SEQ ID NO: 511286 - RNA, 19 nt, Homo sapiens
agaggaugaugccaagaaa

SEQ ID NO: 511287 - RNA, 19 nt, Homo sapiens
ggaggaggaagaagaggaa

SEQ ID NO: 511288 - RNA, 19 nt, Homo sapiens
aucgguagcuugaaauaaa

SEQ ID NO: 511289 - RNA, 19 nt, Homo sapiens
gcagaacagaagcguggua

SEQ ID NO: 511290 - RNA, 19 nt, Homo sapiens
ggucaaggcagaacagaag

SEQ ID NO: 511291 - RNA, 19 nt, Homo sapiens
agaaggugcuguccaacau

SEQ ID NO: 511292 - RNA, 19 nt, Homo sapiens
gcuggagucugagaaguuc

SEQ ID NO: 511293 - RNA, 19 nt, Homo sapiens
acaccgaggagcaggaaua

SEQ ID NO: 511294 - RNA, 19 nt, Homo sapiens
aaaagaaggugcuguccaa

SEQ ID NO: 511295 - RNA, 19 nt, Homo sapiens
ggagcugguugccuugaag

SEQ ID NO: 511296 - RNA, 19 nt, Homo sapiens
ggagcgcguugacuucgau

SEQ ID NO: 511297 - RNA, 19 nt, Homo sapiens
ucccaucgguagcuugaaa

SEQ ID NO: 511298 - RNA, 19 nt, Homo sapiens
cagaggaugaugccaagaa

SEQ ID NO: 511299 - RNA, 19 nt, Homo sapiens
gaugaggaaggaagaggaa

SEQ ID NO: 511300 - RNA, 19 nt, Homo sapiens
ggaggaagaggagcugguu

SEQ ID NO: 511301 - RNA, 19 nt, Homo sapiens
gggaagccugggaguguuu

SEQ ID NO: 511302 - RNA, 19 nt, Homo sapiens
gaaggugcuguccaacaug

SEQ ID NO: 511303 - RNA, 19 nt, Homo sapiens
ggaggaggaggaggaagaa

SEQ ID NO: 511304 - RNA, 19 nt, Homo sapiens
aaacagcagaaauaugaga

SEQ ID NO: 511305 - RNA, 19 nt, Homo sapiens
aggagaagaugaggaagga

SEQ ID NO: 511306 - RNA, 19 nt, Homo sapiens
gagaucaacgugcuguaca

SEQ ID NO: 511307 - RNA, 19 nt, Homo sapiens
ggaggaggaggaagaagag

SEQ ID NO: 511308 - RNA, 19 nt, Homo sapiens
cagaacagaagcgugguaa

SEQ ID NO: 511309 - RNA, 19 nt, Homo sapiens
ggacaccgaggagcaggaa

SEQ ID NO: 511310 - RNA, 19 nt, Homo sapiens
ugcagacacucaucgaugu

SEQ ID NO: 511311 - RNA, 19 nt, Homo sapiens
agaucaacgugcuguacaa

SEQ ID NO: 511312 - RNA, 19 nt, Homo sapiens
cccauggacuugucauaag

SEQ ID NO: 511313 - RNA, 19 nt, Homo sapiens
cguggugccuccuuugauc

SEQ ID NO: 511314 - RNA, 19 nt, Homo sapiens
caucgguagcuugaaauaa

SEQ ID NO: 511315 - RNA, 19 nt, Homo sapiens
ccaucgguagcuugaaaua

SEQ ID NO: 511316 - RNA, 19 nt, Homo sapiens
cggaggagaagaugaggaa

SEQ ID NO: 511317 - RNA, 19 nt, Homo sapiens
caaggccgcaccaggaugu

SEQ ID NO: 511318 - RNA, 19 nt, Homo sapiens
gaagaggaagaggccaaga

SEQ ID NO: 511319 - RNA, 19 nt, Homo sapiens
agaaauaugagaucaacgu

SEQ ID NO: 511320 - RNA, 19 nt, Homo sapiens
ugaggaaggaagaggaaga

SEQ ID NO: 511321 - RNA, 19 nt, Homo sapiens
ucccauggacuugucauaa

SEQ ID NO: 511322 - RNA, 19 nt, Homo sapiens
gaagcgggcagaggaugau

SEQ ID NO: 511323 - RNA, 19 nt, Homo sapiens
aagaggaagaggccaagaa

SEQ ID NO: 511324 - RNA, 19 nt, Homo sapiens
gaaacagcagaaauaugag

SEQ ID NO: 511325 - RNA, 19 nt, Homo sapiens
ugagaaguucgaccugaug

SEQ ID NO: 511326 - RNA, 19 nt, Homo sapiens
cggaggaggaggaggaaga

SEQ ID NO: 511327 - RNA, 19 nt, Homo sapiens
caagaagcgggcagaggau

SEQ ID NO: 511328 - RNA, 19 nt, Homo sapiens
gggagcgcguugacuucga

SEQ ID NO: 511329 - RNA, 19 nt, Homo sapiens
cugagaaguucgaccugau

SEQ ID NO: 511330 - RNA, 19 nt, Homo sapiens
gcaacagcgcuucagaacu

SEQ ID NO: 511331 - RNA, 19 nt, Homo sapiens
gaggaacgccccaaaccaa

SEQ ID NO: 511332 - RNA, 19 nt, Homo sapiens
gaaacaggaucaacgauaa

SEQ ID NO: 511333 - RNA, 19 nt, Homo sapiens
gaucaacgauaaccagaaa

SEQ ID NO: 511334 - RNA, 19 nt, Homo sapiens
ggaaggugcuggccauuga

SEQ ID NO: 511335 - RNA, 19 nt, Homo sapiens
agaagaagaugaagaagaa

SEQ ID NO: 511336 - RNA, 19 nt, Homo sapiens
ggaagaagcagcuguugaa

SEQ ID NO: 511337 - RNA, 19 nt, Homo sapiens
gcagaaauaugagaucaau

SEQ ID NO: 511338 - RNA, 19 nt, Homo sapiens
ggaaugagcgggagaagga

SEQ ID NO: 511339 - RNA, 19 nt, Homo sapiens
gagagagaguggacuuuga

SEQ ID NO: 511340 - RNA, 19 nt, Homo sapiens
agaaggaccugaaugaguu

SEQ ID NO: 511341 - RNA, 19 nt, Homo sapiens
uagaagaggugguggaaga

SEQ ID NO: 511342 - RNA, 19 nt, Homo sapiens
ggaggaaggcugaggauga

SEQ ID NO: 511343 - RNA, 19 nt, Homo sapiens
ucaagcagcagaaauauga

SEQ ID NO: 511344 - RNA, 19 nt, Homo sapiens
ggagcucguuucucucaaa

SEQ ID NO: 511345 - RNA, 19 nt, Homo sapiens
cgaaacaggaucaacgaua

SEQ ID NO: 511346 - RNA, 19 nt, Homo sapiens
ggaagcgcauggagaagga

SEQ ID NO: 511347 - RNA, 19 nt, Homo sapiens
ggaaaccugcacugacuuu

SEQ ID NO: 511348 - RNA, 19 nt, Homo sapiens
gcagagcaucuauaacuug

SEQ ID NO: 511349 - RNA, 19 nt, Homo sapiens
agaagcagcuguugaagag

SEQ ID NO: 511350 - RNA, 19 nt, Homo sapiens
ccacuccacaccaguaaua

SEQ ID NO: 511351 - RNA, 19 nt, Homo sapiens
gagaaggaccugaaugagu

SEQ ID NO: 511352 - RNA, 19 nt, Homo sapiens
uguccaacaugaugcauuu

SEQ ID NO: 511353 - RNA, 19 nt, Homo sapiens
ggaagaagaaggcuuuguc

SEQ ID NO: 511354 - RNA, 19 nt, Homo sapiens
ggagagagaguggacuuug

SEQ ID NO: 511355 - RNA, 19 nt, Homo sapiens
cagcagaaauaugagauca

SEQ ID NO: 511356 - RNA, 19 nt, Homo sapiens
ggcagagcaucuauaacuu

SEQ ID NO: 511357 - RNA, 19 nt, Homo sapiens
gcaggaagaagcagcuguu

SEQ ID NO: 511358 - RNA, 19 nt, Homo sapiens
gaggaaggcugaggaugag

SEQ ID NO: 511359 - RNA, 19 nt, Homo sapiens
ggcagaagaagaugaagaa

SEQ ID NO: 511360 - RNA, 19 nt, Homo sapiens
gaccagggcagaagaagau

SEQ ID NO: 511361 - RNA, 19 nt, Homo sapiens
gaucaauguucuccgaaac

SEQ ID NO: 511362 - RNA, 19 nt, Homo sapiens
cagaagaagaugaagaaga

SEQ ID NO: 511363 - RNA, 19 nt, Homo sapiens
aagaggugguggaagagua

SEQ ID NO: 511364 - RNA, 19 nt, Homo sapiens
gaggagcucguuucucuca

SEQ ID NO: 511365 - RNA, 19 nt, Homo sapiens
gaaguucaagcagcagaaa

SEQ ID NO: 511366 - RNA, 19 nt, Homo sapiens
aagaucagcugagggagaa

SEQ ID NO: 511367 - RNA, 19 nt, Homo sapiens
agaagaaggcuuuguccaa

SEQ ID NO: 511368 - RNA, 19 nt, Homo sapiens
aggaggagcucguuucucu

SEQ ID NO: 511369 - RNA, 19 nt, Homo sapiens
gaaaagaagaagaagauuc

SEQ ID NO: 511370 - RNA, 19 nt, Homo sapiens
ggcugaagauggcccaaug

SEQ ID NO: 511371 - RNA, 19 nt, Homo sapiens
ggaggcagcggaagaggau

SEQ ID NO: 511372 - RNA, 19 nt, Homo sapiens
gacgagaggaggaggagaa

SEQ ID NO: 511373 - RNA, 19 nt, Homo sapiens
cagcagcgcauccggaaug

SEQ ID NO: 511374 - RNA, 19 nt, Homo sapiens
ggucguucaugcccaacuu

SEQ ID NO: 511375 - RNA, 19 nt, Homo sapiens
uggagaaggaccugaauga

SEQ ID NO: 511376 - RNA, 19 nt, Homo sapiens
ggagaccagggcagaagaa

SEQ ID NO: 511377 - RNA, 19 nt, Homo sapiens
gcucguuucucucaaagac

SEQ ID NO: 511378 - RNA, 19 nt, Homo sapiens
gcauggagaaggaccugaa

SEQ ID NO: 511379 - RNA, 19 nt, Homo sapiens
gcaaaggaggcugaagaug

SEQ ID NO: 511380 - RNA, 19 nt, Homo sapiens
aauagagccuggccuccuu

SEQ ID NO: 511381 - RNA, 19 nt, Homo sapiens
gggcagaagaagaugaaga

SEQ ID NO: 511382 - RNA, 19 nt, Homo sapiens
ccaaagcccaggucguuca

SEQ ID NO: 511383 - RNA, 19 nt, Homo sapiens
aagcaaaggaggcugaaga

SEQ ID NO: 511384 - RNA, 19 nt, Homo sapiens
ggaggaggagcaggaagaa

SEQ ID NO: 511385 - RNA, 19 nt, Homo sapiens
agaucaauguucuccgaaa

SEQ ID NO: 511386 - RNA, 19 nt, Homo sapiens
gagcucguuucucucaaag

SEQ ID NO: 511387 - RNA, 19 nt, Homo sapiens
gaaggaccugaaugaguug

SEQ ID NO: 511388 - RNA, 19 nt, Homo sapiens
ggaggaguccaaaccaaag

SEQ ID NO: 511389 - RNA, 19 nt, Homo sapiens
uggcagagcaucuauaacu

SEQ ID NO: 511390 - RNA, 19 nt, Homo sapiens
ggcagcuccuguuuggaaa

SEQ ID NO: 511391 - RNA, 19 nt, Homo sapiens
aagaagaagaggaagcaaa

SEQ ID NO: 511392 - RNA, 19 nt, Homo sapiens
gaguggacuuugaugacau

SEQ ID NO: 511393 - RNA, 19 nt, Homo sapiens
ggaucaacgauaaccagaa

SEQ ID NO: 511394 - RNA, 19 nt, Homo sapiens
uaacuuggaggcagagaag

SEQ ID NO: 511395 - RNA, 19 nt, Homo sapiens
gagaggaggaggagaacag

SEQ ID NO: 511396 - RNA, 19 nt, Homo sapiens
agaaccgccuggcugaaga

SEQ ID NO: 511397 - RNA, 19 nt, Homo sapiens
cagcuccuguuuggaaaug

SEQ ID NO: 511398 - RNA, 19 nt, Homo sapiens
aguucaagcagcagaaaua

SEQ ID NO: 511399 - RNA, 19 nt, Homo sapiens
uguggcagagcaucuauaa

SEQ ID NO: 511400 - RNA, 19 nt, Homo sapiens
gugggaagaggcagacuga

SEQ ID NO: 511401 - RNA, 19 nt, Homo sapiens
agaagcaggcccagacaga

SEQ ID NO: 511402 - RNA, 19 nt, Homo sapiens
caaagacaggaucgagaga

SEQ ID NO: 511403 - RNA, 19 nt, Homo sapiens
agaagaagaggaagcaaag

SEQ ID NO: 511404 - RNA, 19 nt, Homo sapiens
gaagaagcagcuguugaag

SEQ ID NO: 511405 - RNA, 19 nt, Homo sapiens
ugagggagaaggccaagga

SEQ ID NO: 511406 - RNA, 19 nt, Homo sapiens
aagaaggcuuuguccaaca

SEQ ID NO: 511407 - RNA, 19 nt, Homo sapiens
ggagaaggaccugaaugag

SEQ ID NO: 511408 - RNA, 19 nt, Homo sapiens
agaguggacuuugaugaca

SEQ ID NO: 511409 - RNA, 19 nt, Homo sapiens
gagaguggacuuugaugac

SEQ ID NO: 511410 - RNA, 19 nt, Homo sapiens
aagaagcagcuguugaaga

SEQ ID NO: 511411 - RNA, 19 nt, Homo sapiens
aagaagaggaagcaaagga

SEQ ID NO: 511412 - RNA, 19 nt, Homo sapiens
agaaggcuuuguccaacau

SEQ ID NO: 511413 - RNA, 19 nt, Homo sapiens
ggaggaggagcucguuucu

SEQ ID NO: 511414 - RNA, 19 nt, Homo sapiens
gaagaagaagaggaagcaa

SEQ ID NO: 511415 - RNA, 19 nt, Homo sapiens
gaagaggugguggaagagu

SEQ ID NO: 511416 - RNA, 19 nt, Homo sapiens
uugaccaccugaaugaaga

SEQ ID NO: 511417 - RNA, 19 nt, Homo sapiens
aaccaaagcccaggucguu

SEQ ID NO: 511418 - RNA, 19 nt, Homo sapiens
cauagaagaggugguggaa

SEQ ID NO: 511419 - RNA, 19 nt, Homo sapiens
gaggaggaggagcucguuu

SEQ ID NO: 511420 - RNA, 19 nt, Homo sapiens
guucaagcagcagaaauau

SEQ ID NO: 511421 - RNA, 19 nt, Homo sapiens
gagagaguggacuuugaug

SEQ ID NO: 511422 - RNA, 19 nt, Homo sapiens
gggaaaagaagaagaagau

SEQ ID NO: 511423 - RNA, 19 nt, Homo sapiens
aggcagcuccuguuuggaa

SEQ ID NO: 511424 - RNA, 19 nt, Homo sapiens
aagaagaugaagaagaaga

SEQ ID NO: 511425 - RNA, 19 nt, Homo sapiens
ucaacgauaaccagaaagu

SEQ ID NO: 511426 - RNA, 19 nt, Homo sapiens
ggagagcagagaccauguc

SEQ ID NO: 511427 - RNA, 19 nt, Homo sapiens
agacugagcgggaaaagaa

SEQ ID NO: 511428 - RNA, 19 nt, Homo sapiens
agagaguggacuuugauga

SEQ ID NO: 511429 - RNA, 19 nt, Homo sapiens
agaugaagaagaagaggaa

SEQ ID NO: 511430 - RNA, 19 nt, Homo sapiens
gcagaaccgccuggcugaa

SEQ ID NO: 511431 - RNA, 19 nt, Homo sapiens
ggaggagcaggaagaagca

SEQ ID NO: 511432 - RNA, 19 nt, Homo sapiens
gaagaagcgucagaacaaa

SEQ ID NO: 511433 - RNA, 19 nt, Homo sapiens
caacaucgaucaccuuggu

SEQ ID NO: 511434 - RNA, 19 nt, Homo sapiens
gcaagccgcucaacaucga

SEQ ID NO: 511435 - RNA, 19 nt, Homo sapiens
ggaagaggaaguucaagaa

SEQ ID NO: 511436 - RNA, 19 nt, Homo sapiens
guacgaagaagaagaggaa

SEQ ID NO: 511437 - RNA, 19 nt, Homo sapiens
gaagcgccgugcagagaga

SEQ ID NO: 511438 - RNA, 19 nt, Homo sapiens
caccaugucugacgaggaa

SEQ ID NO: 511439 - RNA, 19 nt, Homo sapiens
ggagaaaccgagacccaaa

SEQ ID NO: 511440 - RNA, 19 nt, Homo sapiens
ggccaaggcugaccagaag

SEQ ID NO: 511441 - RNA, 19 nt, Homo sapiens
agaaagcgcuguccuccau

SEQ ID NO: 511442 - RNA, 19 nt, Homo sapiens
gaaguagagaggccagaaa

SEQ ID NO: 511443 - RNA, 19 nt, Homo sapiens
ugaaacgccagaaauauga

SEQ ID NO: 511444 - RNA, 19 nt, Homo sapiens
aagaggaaguucaagaaga

SEQ ID NO: 511445 - RNA, 19 nt, Homo sapiens
agaagaagcgucagaacaa

SEQ ID NO: 511446 - RNA, 19 nt, Homo sapiens
gagaagcgccgugcagaga

SEQ ID NO: 511447 - RNA, 19 nt, Homo sapiens
caaacucacugcuccuaag

SEQ ID NO: 511448 - RNA, 19 nt, Homo sapiens
ggaggaagaggaaguucaa

SEQ ID NO: 511449 - RNA, 19 nt, Homo sapiens
ucaaagagagaaucgagaa

SEQ ID NO: 511450 - RNA, 19 nt, Homo sapiens
gaagaggaaguucaagaag

SEQ ID NO: 511451 - RNA, 19 nt, Homo sapiens
gagcggagcagcagaggau

SEQ ID NO: 511452 - RNA, 19 nt, Homo sapiens
aggacgaccugaagaagaa

SEQ ID NO: 511453 - RNA, 19 nt, Homo sapiens
gcugaaacgccagaaauau

SEQ ID NO: 511454 - RNA, 19 nt, Homo sapiens
gaacagacuggcggaggaa

SEQ ID NO: 511455 - RNA, 19 nt, Homo sapiens
gaggacgaccugaagaaga

SEQ ID NO: 511456 - RNA, 19 nt, Homo sapiens
ggagcaguacgaagaagaa

SEQ ID NO: 511457 - RNA, 19 nt, Homo sapiens
gaagcugaaacgccagaaa

SEQ ID NO: 511458 - RNA, 19 nt, Homo sapiens
gcagaggacgaccugaaga

SEQ ID NO: 511459 - RNA, 19 nt, Homo sapiens
ggaggagcaguacgaagaa

SEQ ID NO: 511460 - RNA, 19 nt, Homo sapiens
aaaccgagacccaaacuca

SEQ ID NO: 511461 - RNA, 19 nt, Homo sapiens
ggaaguagagaggccagaa

SEQ ID NO: 511462 - RNA, 19 nt, Homo sapiens
gggcagaggacgaccugaa

SEQ ID NO: 511463 - RNA, 19 nt, Homo sapiens
cagaagaagcgucagaaca

SEQ ID NO: 511464 - RNA, 19 nt, Homo sapiens
gcuggagauugacaaguuc

SEQ ID NO: 511465 - RNA, 19 nt, Homo sapiens
gaggauucgugcagagaag

SEQ ID NO: 511466 - RNA, 19 nt, Homo sapiens
ccucaucgacagccacuuu

SEQ ID NO: 511467 - RNA, 19 nt, Homo sapiens
gauugacaaguucgaguuu

SEQ ID NO: 511468 - RNA, 19 nt, Homo sapiens
ugcaccagcuggagauuga

SEQ ID NO: 511469 - RNA, 19 nt, Homo sapiens
gcaguacgaagaagaagag

SEQ ID NO: 511470 - RNA, 19 nt, Homo sapiens
ucagaacaaagaccuaaug

SEQ ID NO: 511471 - RNA, 19 nt, Homo sapiens
gaagauucuggcugagaga

SEQ ID NO: 511472 - RNA, 19 nt, Homo sapiens
cagaggacgaccugaagaa

SEQ ID NO: 511473 - RNA, 19 nt, Homo sapiens
agaggaaguucaagaagac

SEQ ID NO: 511474 - RNA, 19 nt, Homo sapiens
uggaggagcaguacgaaga

SEQ ID NO: 511475 - RNA, 19 nt, Homo sapiens
ccaaacucacugcuccuaa

SEQ ID NO: 511476 - RNA, 19 nt, Homo sapiens
ggacgcggaagaggagaaa

SEQ ID NO: 511477 - RNA, 19 nt, Homo sapiens
cagaggaggacgcggaaga

SEQ ID NO: 511478 - RNA, 19 nt, Homo sapiens
cugaaacgccagaaauaug

SEQ ID NO: 511479 - RNA, 19 nt, Homo sapiens
aagacaaacugagggacaa

SEQ ID NO: 511480 - RNA, 19 nt, Homo sapiens
gacgcaagccgcucaacau

SEQ ID NO: 511481 - RNA, 19 nt, Homo sapiens
agaggaagcccaggaggaa

SEQ ID NO: 511482 - RNA, 19 nt, Homo sapiens
caucgacagccacuuugaa

SEQ ID NO: 511483 - RNA, 19 nt, Homo sapiens
gcucaacaucgaucaccuu

SEQ ID NO: 511484 - RNA, 19 nt, Homo sapiens
cgucagaacaaagaccuaa

SEQ ID NO: 511485 - RNA, 19 nt, Homo sapiens
agaagcgucagaacaaaga

SEQ ID NO: 511486 - RNA, 19 nt, Homo sapiens
agcuggagauugacaaguu

SEQ ID NO: 511487 - RNA, 19 nt, Homo sapiens
gaccagaagagaggcaaga

SEQ ID NO: 511488 - RNA, 19 nt, Homo sapiens
gagagggagcgccagaaca

SEQ ID NO: 511489 - RNA, 19 nt, Homo sapiens
aaacucacugcuccuaaga

SEQ ID NO: 511490 - RNA, 19 nt, Homo sapiens
cgccagaaauaugacauca

SEQ ID NO: 511491 - RNA, 19 nt, Homo sapiens
acucacugcuccuaagauc

SEQ ID NO: 511492 - RNA, 19 nt, Homo sapiens
gaggagcaguacgaagaag

SEQ ID NO: 511493 - RNA, 19 nt, Homo sapiens
aagcugaaacgccagaaau

SEQ ID NO: 511494 - RNA, 19 nt, Homo sapiens
gagaaaccgagacccaaac

SEQ ID NO: 511495 - RNA, 19 nt, Homo sapiens
caagagagguggcagcaaa

SEQ ID NO: 511496 - RNA, 19 nt, Homo sapiens
caagagagguggcagcaaa

SEQ ID NO: 511497 - RNA, 19 nt, Homo sapiens
gagaggagccuauggaaug

SEQ ID NO: 511498 - RNA, 19 nt, Homo sapiens
ccaaggagaccugauguua

SEQ ID NO: 511499 - RNA, 19 nt, Homo sapiens
gcaccaagcagcaacaaga

SEQ ID NO: 511500 - RNA, 19 nt, Homo sapiens
gaucaaaugccaguuguga

SEQ ID NO: 511501 - RNA, 19 nt, Homo sapiens
aaggagaccugauguuaga

SEQ ID NO: 511502 - RNA, 19 nt, Homo sapiens
gagccgaucuccucacaag

SEQ ID NO: 511503 - RNA, 19 nt, Homo sapiens
gagccgaucuccucacaag

SEQ ID NO: 511504 - RNA, 19 nt, Homo sapiens
gcaauuaccgcucccacuu

SEQ ID NO: 511505 - RNA, 19 nt, Homo sapiens
gaaaugaggaauguauaug

SEQ ID NO: 511506 - RNA, 19 nt, Homo sapiens
uauggaauguggaucaaau

SEQ ID NO: 511507 - RNA, 19 nt, Homo sapiens
cgaaaugaggaauguauau

SEQ ID NO: 511508 - RNA, 19 nt, Homo sapiens
gacgaaaugaggaauguau

SEQ ID NO: 511509 - RNA, 19 nt, Homo sapiens
ucacaagggagucaagaga

SEQ ID NO: 511510 - RNA, 19 nt, Homo sapiens
ucacaagggagucaagaga

SEQ ID NO: 511511 - RNA, 19 nt, Homo sapiens
caaggagaccugauguuag

SEQ ID NO: 511512 - RNA, 19 nt, Homo sapiens
cgaccagccgcaaauuaaa

SEQ ID NO: 511513 - RNA, 19 nt, Homo sapiens
ccagagaggagccuaugga

SEQ ID NO: 511514 - RNA, 19 nt, Homo sapiens
ucgaccagccgcaaauuaa

SEQ ID NO: 511515 - RNA, 19 nt, Homo sapiens
gugacgaaaugaggaaugu

SEQ ID NO: 511516 - RNA, 19 nt, Homo sapiens
caauuaccgcucccacuug

SEQ ID NO: 511517 - RNA, 19 nt, Homo sapiens
ccaagcagcaacaagaaca

SEQ ID NO: 511518 - RNA, 19 nt, Homo sapiens
gaugacgccaaucgcaauu

SEQ ID NO: 511519 - RNA, 19 nt, Homo sapiens
gucgaccagccgcaaauua

SEQ ID NO: 511520 - RNA, 19 nt, Homo sapiens
ggcaugaggaggagcaaga

SEQ ID NO: 511521 - RNA, 19 nt, Homo sapiens
gcaacaagaacagcagaag

SEQ ID NO: 511522 - RNA, 19 nt, Homo sapiens
ugacgccaaucgcaauuac

SEQ ID NO: 511523 - RNA, 19 nt, Homo sapiens
gcaaaagaaaauaccguaa

SEQ ID NO: 511524 - RNA, 19 nt, Homo sapiens
aaaugccaguugugacgaa

SEQ ID NO: 511525 - RNA, 19 nt, Homo sapiens
gaccagccgcaaauuaaag

SEQ ID NO: 511526 - RNA, 19 nt, Homo sapiens
cagagaggagccuauggaa

SEQ ID NO: 511527 - RNA, 19 nt, Homo sapiens
ggagaccugauguuagauc

SEQ ID NO: 511528 - RNA, 19 nt, Homo sapiens
agaggagccuauggaaugu

SEQ ID NO: 511529 - RNA, 19 nt, Homo sapiens
uuaccgcucccacuuguga

SEQ ID NO: 511530 - RNA, 19 nt, Homo sapiens
uggaucaaaugccaguugu

SEQ ID NO: 511531 - RNA, 19 nt, Homo sapiens
caccaagcagcaacaagaa

SEQ ID NO: 511532 - RNA, 19 nt, Homo sapiens
ugccaguugugacgaaaug

SEQ ID NO: 511533 - RNA, 19 nt, Homo sapiens
aauuaccgcucccacuugu

SEQ ID NO: 511534 - RNA, 19 nt, Homo sapiens
auguauauguuggcuguuu

SEQ ID NO: 511535 - RNA, 19 nt, Homo sapiens
acgaaaugaggaauguaua

SEQ ID NO: 511536 - RNA, 19 nt, Homo sapiens
guggaucaaaugccaguug

SEQ ID NO: 511537 - RNA, 19 nt, Homo sapiens
aagagccgaucuccucaca

SEQ ID NO: 511538 - RNA, 19 nt, Homo sapiens
aagagccgaucuccucaca

SEQ ID NO: 511539 - RNA, 19 nt, Homo sapiens
ccuauggaauguggaucaa

SEQ ID NO: 511540 - RNA, 19 nt, Homo sapiens
aaaagaaaauaccguaagg

SEQ ID NO: 511541 - RNA, 19 nt, Homo sapiens
gaaauuggauggguugauu

SEQ ID NO: 511542 - RNA, 19 nt, Homo sapiens
ggaagacuaucccugagua

SEQ ID NO: 511543 - RNA, 19 nt, Homo sapiens
gagcucagguacccuuuaa

SEQ ID NO: 511544 - RNA, 19 nt, Homo sapiens
uuagguagaugaucaguuu

SEQ ID NO: 511545 - RNA, 19 nt, Homo sapiens
gcaguuggcuagcugaaug

SEQ ID NO: 511546 - RNA, 19 nt, Homo sapiens
gcaggaacauguuacuaug

SEQ ID NO: 511547 - RNA, 19 nt, Homo sapiens
ccauaucaaucacaaauga

SEQ ID NO: 511548 - RNA, 19 nt, Homo sapiens
gaacagaaagaacuuggaa

SEQ ID NO: 511549 - RNA, 19 nt, Homo sapiens
gaagugcucagcuauuaaa

SEQ ID NO: 511550 - RNA, 19 nt, Homo sapiens
cuaguuauuugguugguua

SEQ ID NO: 511551 - RNA, 19 nt, Homo sapiens
ggaaugagugaacuaauga

SEQ ID NO: 511552 - RNA, 19 nt, Homo sapiens
caaaugaguaguuguaaga

SEQ ID NO: 511553 - RNA, 19 nt, Homo sapiens
gaugaucaguuugaagauu

SEQ ID NO: 511554 - RNA, 19 nt, Homo sapiens
cagauaagcuagaugaaag

SEQ ID NO: 511555 - RNA, 19 nt, Homo sapiens
gaaaggauaguuggaagaa

SEQ ID NO: 511556 - RNA, 19 nt, Homo sapiens
gcagauaagcuagaugaaa

SEQ ID NO: 511557 - RNA, 19 nt, Homo sapiens
gcuuguaccuggaagacua

SEQ ID NO: 511558 - RNA, 19 nt, Homo sapiens
acagagagaagaauagaua

SEQ ID NO: 511559 - RNA, 19 nt, Homo sapiens
gggaaagaaauguugaaua

SEQ ID NO: 511560 - RNA, 19 nt, Homo sapiens
ggaagagggagaagagaaa

SEQ ID NO: 511561 - RNA, 19 nt, Homo sapiens
ggaaauccaacuaaugaga

SEQ ID NO: 511562 - RNA, 19 nt, Homo sapiens
gaauaaacagagagaagaa

SEQ ID NO: 511563 - RNA, 19 nt, Homo sapiens
gcagccaggucacaaagga

SEQ ID NO: 511564 - RNA, 19 nt, Homo sapiens
acacucagcuccauagcaa

SEQ ID NO: 511565 - RNA, 19 nt, Homo sapiens
auggaaagauggacagaua

SEQ ID NO: 511566 - RNA, 19 nt, Homo sapiens
uaugauacguugacggaaa

SEQ ID NO: 511567 - RNA, 19 nt, Homo sapiens
ugagugaacuaaugaaugg

SEQ ID NO: 511568 - RNA, 19 nt, Homo sapiens
ccucaaacguggccuccua

SEQ ID NO: 511569 - RNA, 19 nt, Homo sapiens
augaagugcucagcuauua

SEQ ID NO: 511570 - RNA, 19 nt, Homo sapiens
agggauaaauggauggaua

SEQ ID NO: 511571 - RNA, 19 nt, Homo sapiens
ugcacuggcuggcuaguua

SEQ ID NO: 511572 - RNA, 19 nt, Homo sapiens
ggaaguuuggauacgauua

SEQ ID NO: 511573 - RNA, 19 nt, Homo sapiens
ugaauggaguugagagguu

SEQ ID NO: 511574 - RNA, 19 nt, Homo sapiens
uggaaugagugaacuaaug

SEQ ID NO: 511575 - RNA, 19 nt, Homo sapiens
gauugugguugguggauga

SEQ ID NO: 511576 - RNA, 19 nt, Homo sapiens
gaaggaagagggagaagag

SEQ ID NO: 511577 - RNA, 19 nt, Homo sapiens
caaauggaagggauaaaug

SEQ ID NO: 511578 - RNA, 19 nt, Homo sapiens
gauagaaugggaaagaaau

SEQ ID NO: 511579 - RNA, 19 nt, Homo sapiens
gggauagaaugggaaagaa

SEQ ID NO: 511580 - RNA, 19 nt, Homo sapiens
aaggauaguuggaagaaug

SEQ ID NO: 511581 - RNA, 19 nt, Homo sapiens
agucuaaacucuaucuaug

SEQ ID NO: 511582 - RNA, 19 nt, Homo sapiens
ggauagaaugggaaagaaa

SEQ ID NO: 511583 - RNA, 19 nt, Homo sapiens
uggaugaauugguuagaaa

SEQ ID NO: 511584 - RNA, 19 nt, Homo sapiens
ggguugguuugauugguua

SEQ ID NO: 511585 - RNA, 19 nt, Homo sapiens
gaaugggaaagaaauguug

SEQ ID NO: 511586 - RNA, 19 nt, Homo sapiens
guugguggaugaauugguu

SEQ ID NO: 511587 - RNA, 19 nt, Homo sapiens
gugcucagcuauuaaaggu

SEQ ID NO: 511588 - RNA, 19 nt, Homo sapiens
cuggauggauggauaaaug

SEQ ID NO: 511589 - RNA, 19 nt, Homo sapiens
gcugaaugauaggaaguuu

SEQ ID NO: 511590 - RNA, 19 nt, Homo sapiens
cuacgcaacacuaauuaaa

SEQ ID NO: 511591 - RNA, 19 nt, Homo sapiens
aaucacaaaugaguaguug

SEQ ID NO: 511592 - RNA, 19 nt, Homo sapiens
uuagcuggauggauggaua

SEQ ID NO: 511593 - RNA, 19 nt, Homo sapiens
aaacguggccuccuaugga

SEQ ID NO: 511594 - RNA, 19 nt, Homo sapiens
uagaugaucaguuugaaga

SEQ ID NO: 511595 - RNA, 19 nt, Homo sapiens
gguagaugaucaguuugaa

SEQ ID NO: 511596 - RNA, 19 nt, Homo sapiens
gaaguuuggauacgauuag

SEQ ID NO: 511597 - RNA, 19 nt, Homo sapiens
gaagaaugcauuggcugaa

SEQ ID NO: 511598 - RNA, 19 nt, Homo sapiens
uuaggaggauggaaagaug

SEQ ID NO: 511599 - RNA, 19 nt, Homo sapiens
ggacacugacgguagucua

SEQ ID NO: 511600 - RNA, 19 nt, Homo sapiens
gaauggaaugagugaacua

SEQ ID NO: 511601 - RNA, 19 nt, Homo sapiens
gagagaagaauagauaucu

SEQ ID NO: 511602 - RNA, 19 nt, Homo sapiens
guggaugaauugguuagaa

SEQ ID NO: 511603 - RNA, 19 nt, Homo sapiens
cuggguggguaaacaauaa

SEQ ID NO: 511604 - RNA, 19 nt, Homo sapiens
cagggccucuguaaagcua

SEQ ID NO: 511605 - RNA, 19 nt, Homo sapiens
uuauuugguugguuaggua

SEQ ID NO: 511606 - RNA, 19 nt, Homo sapiens
gaaccacaggcaagaagga

SEQ ID NO: 511607 - RNA, 19 nt, Homo sapiens
ggagcucagguacccuuua

SEQ ID NO: 511608 - RNA, 19 nt, Homo sapiens
gacacugacgguagucuaa

SEQ ID NO: 511609 - RNA, 19 nt, Homo sapiens
acucacagccuuccuauca

SEQ ID NO: 511610 - RNA, 19 nt, Homo sapiens
ugaauaaacagagagaaga

SEQ ID NO: 511611 - RNA, 19 nt, Homo sapiens
aaaggacacugacgguagu

SEQ ID NO: 511612 - RNA, 19 nt, Homo sapiens
ggccugggcaucauaauca

SEQ ID NO: 511613 - RNA, 19 nt, Homo sapiens
gguggguaaacaauaaaua

SEQ ID NO: 511614 - RNA, 19 nt, Homo sapiens
gaaagcaugaauggaguug

SEQ ID NO: 511615 - RNA, 19 nt, Homo sapiens
ugacaaauggaagggauaa

SEQ ID NO: 511616 - RNA, 19 nt, Homo sapiens
aaacagagagaagaauaga

SEQ ID NO: 511617 - RNA, 19 nt, Homo sapiens
cuccuacccugaaccagua

SEQ ID NO: 511618 - RNA, 19 nt, Homo sapiens
gcaacacuaauuaaagcuu

SEQ ID NO: 511619 - RNA, 19 nt, Homo sapiens
ccacucuuaucccuuagga

SEQ ID NO: 511620 - RNA, 19 nt, Homo sapiens
ucuaaacucuaucuauguc

SEQ ID NO: 511621 - RNA, 19 nt, Homo sapiens
gcuagcugaauguaugaua

SEQ ID NO: 511622 - RNA, 19 nt, Homo sapiens
uuacuauggugauuucuac

SEQ ID NO: 511623 - RNA, 19 nt, Homo sapiens
gacgguagucuaaacucua

SEQ ID NO: 511624 - RNA, 19 nt, Homo sapiens
ggauaccuggauucacaua

SEQ ID NO: 511625 - RNA, 19 nt, Homo sapiens
gauaggaaguuuggauacg

SEQ ID NO: 511626 - RNA, 19 nt, Homo sapiens
ccacaggcaagaaggaaga

SEQ ID NO: 511627 - RNA, 19 nt, Homo sapiens
ccaagaacagaaagaacuu

SEQ ID NO: 511628 - RNA, 19 nt, Homo sapiens
auggauaaauggaugaaug

SEQ ID NO: 511629 - RNA, 19 nt, Homo sapiens
auggacagauagcagauaa

SEQ ID NO: 511630 - RNA, 19 nt, Homo sapiens
uuggauggguugauuagga

SEQ ID NO: 511631 - RNA, 19 nt, Homo sapiens
uucccacucuuaucccuua

SEQ ID NO: 511632 - RNA, 19 nt, Homo sapiens
ugaauggguggaugacaaa

SEQ ID NO: 511633 - RNA, 19 nt, Homo sapiens
gaaugagugaacuaaugaa

SEQ ID NO: 511634 - RNA, 19 nt, Homo sapiens
agacuaaugggauagaaug

SEQ ID NO: 511635 - RNA, 19 nt, Homo sapiens
uugauggguugguuugauu

SEQ ID NO: 511636 - RNA, 19 nt, Homo sapiens
ggaugaauugguuagaaau

SEQ ID NO: 511637 - RNA, 19 nt, Homo sapiens
gggagaagagaaacaaugg

SEQ ID NO: 511638 - RNA, 19 nt, Homo sapiens
caagaaggaagagggagaa

SEQ ID NO: 511639 - RNA, 19 nt, Homo sapiens
ggauccagcagguguacaa

SEQ ID NO: 511640 - RNA, 19 nt, Homo sapiens
uaaacagagagaagaauag

SEQ ID NO: 511641 - RNA, 19 nt, Homo sapiens
gaaaucagcuucauuccaa

SEQ ID NO: 511642 - RNA, 19 nt, Homo sapiens
gcagacagacucauucuua

SEQ ID NO: 511643 - RNA, 19 nt, Homo sapiens
gggcagagauugaaaauua

SEQ ID NO: 511644 - RNA, 19 nt, Homo sapiens
cggaauaugugaucucuua

SEQ ID NO: 511645 - RNA, 19 nt, Homo sapiens
gcagaaaccuguacaaacu

SEQ ID NO: 511646 - RNA, 19 nt, Homo sapiens
gaucaagccuucagagugu

SEQ ID NO: 511647 - RNA, 19 nt, Homo sapiens
gagcgcaucuguacucuug

SEQ ID NO: 511648 - RNA, 19 nt, Homo sapiens
caaagucgauuucauucuu

SEQ ID NO: 511649 - RNA, 19 nt, Homo sapiens
caauaucacuccaacagaa

SEQ ID NO: 511650 - RNA, 19 nt, Homo sapiens
gaacccagcuaccgaauac

SEQ ID NO: 511651 - RNA, 19 nt, Homo sapiens
gaaaagagccucagcaaga

SEQ ID NO: 511652 - RNA, 19 nt, Homo sapiens
caggacaacuggacuauau

SEQ ID NO: 511653 - RNA, 19 nt, Homo sapiens
ggagagaccauccuuguug

SEQ ID NO: 511654 - RNA, 19 nt, Homo sapiens
ggaaacagaucaacuacac

SEQ ID NO: 511655 - RNA, 19 nt, Homo sapiens
ggaauccgcuggcuaacau

SEQ ID NO: 511656 - RNA, 19 nt, Homo sapiens
gcaggaauccgcuggcuaa

SEQ ID NO: 511657 - RNA, 19 nt, Homo sapiens
gaggagaaguaggaaguuu

SEQ ID NO: 511658 - RNA, 19 nt, Homo sapiens
gagagaccauccuuguuga

SEQ ID NO: 511659 - RNA, 19 nt, Homo sapiens
ccucaagggcuacaauuua

SEQ ID NO: 511660 - RNA, 19 nt, Homo sapiens
caaguguacugugauauga

SEQ ID NO: 511661 - RNA, 19 nt, Homo sapiens
cagacagacucauucuuaa

SEQ ID NO: 511662 - RNA, 19 nt, Homo sapiens
ggacaggaccucauacaca

SEQ ID NO: 511663 - RNA, 19 nt, Homo sapiens
uggaauaucugccgucaug

SEQ ID NO: 511664 - RNA, 19 nt, Homo sapiens
uaacaucugcucuugguuu

SEQ ID NO: 511665 - RNA, 19 nt, Homo sapiens
ugagcaauaucaugaggua

SEQ ID NO: 511666 - RNA, 19 nt, Homo sapiens
gcagggaugucgcaggaau

SEQ ID NO: 511667 - RNA, 19 nt, Homo sapiens
ggagcauggugguauaaga

SEQ ID NO: 511668 - RNA, 19 nt, Homo sapiens
caaaagacaucacaauuag

SEQ ID NO: 511669 - RNA, 19 nt, Homo sapiens
gucaugaacucacagcaaa

SEQ ID NO: 511670 - RNA, 19 nt, Homo sapiens
ccacucaguucacaacaga

SEQ ID NO: 511671 - RNA, 19 nt, Homo sapiens
ggauagagacaaugauguu

SEQ ID NO: 511672 - RNA, 19 nt, Homo sapiens
ggacaacccuguggaucug

SEQ ID NO: 511673 - RNA, 19 nt, Homo sapiens
ccaaaagacaucacaauua

SEQ ID NO: 511674 - RNA, 19 nt, Homo sapiens
aaaggaaacagaucaacua

SEQ ID NO: 511675 - RNA, 19 nt, Homo sapiens
gaaguaggaaguuuucuua

SEQ ID NO: 511676 - RNA, 19 nt, Homo sapiens
gggaaacagugguucugaa

SEQ ID NO: 511677 - RNA, 19 nt, Homo sapiens
gcuaacaucugcucuuggu

SEQ ID NO: 511678 - RNA, 19 nt, Homo sapiens
ggcaucaacugguaccauu

SEQ ID NO: 511679 - RNA, 19 nt, Homo sapiens
cagaauggccaaacugauu

SEQ ID NO: 511680 - RNA, 19 nt, Homo sapiens
gaagucaccagacaaagug

SEQ ID NO: 511681 - RNA, 19 nt, Homo sapiens
ggagaacuacgucauuguu

SEQ ID NO: 511682 - RNA, 19 nt, Homo sapiens
cucaagggcuacaauuuaa

SEQ ID NO: 511683 - RNA, 19 nt, Homo sapiens
ccaaggacaggaccucaua

SEQ ID NO: 511684 - RNA, 19 nt, Homo sapiens
gaauaucugccgucaugaa

SEQ ID NO: 511685 - RNA, 19 nt, Homo sapiens
ggucucaccuacaacauca

SEQ ID NO: 511686 - RNA, 19 nt, Homo sapiens
gccaacugcugccaagaaa

SEQ ID NO: 511687 - RNA, 19 nt, Homo sapiens
gagcauggugguauaagaa

SEQ ID NO: 511688 - RNA, 19 nt, Homo sapiens
ggaaagcgagcgcaucugu

SEQ ID NO: 511689 - RNA, 19 nt, Homo sapiens
gcaaccagccacagaguau

SEQ ID NO: 511690 - RNA, 19 nt, Homo sapiens
ugaagaacaugcucauugg

SEQ ID NO: 511691 - RNA, 19 nt, Homo sapiens
guauggaguuggaauaucu

SEQ ID NO: 511692 - RNA, 19 nt, Homo sapiens
cagaaaggguccagagaca

SEQ ID NO: 511693 - RNA, 19 nt, Homo sapiens
cgauggcagugacggaaua

SEQ ID NO: 511694 - RNA, 19 nt, Homo sapiens
gaacuccggugcccaacag

SEQ ID NO: 511695 - RNA, 19 nt, Homo sapiens
ccaccaaggaggagaagua

SEQ ID NO: 511696 - RNA, 19 nt, Homo sapiens
guacaaacuccgcauagga

SEQ ID NO: 511697 - RNA, 19 nt, Homo sapiens
gagcugagccagaaauuac

SEQ ID NO: 511698 - RNA, 19 nt, Homo sapiens
gcagaagacaccuggauuc

SEQ ID NO: 511699 - RNA, 19 nt, Homo sapiens
gaaagcgagcgcaucugua

SEQ ID NO: 511700 - RNA, 19 nt, Homo sapiens
ggagcugagccagaaauua

SEQ ID NO: 511701 - RNA, 19 nt, Homo sapiens
caacugguaccauuggaaa

SEQ ID NO: 511702 - RNA, 19 nt, Homo sapiens
ugggugagguggagaacua

SEQ ID NO: 511703 - RNA, 19 nt, Homo sapiens
gaaaggguccagagacagu

SEQ ID NO: 511704 - RNA, 19 nt, Homo sapiens
ccucagcuaucaucaagga

SEQ ID NO: 511705 - RNA, 19 nt, Homo sapiens
gaggauagagacaaugaug

SEQ ID NO: 511706 - RNA, 19 nt, Homo sapiens
guggagaacuacgucauug

SEQ ID NO: 511707 - RNA, 19 nt, Homo sapiens
gaccaaggacucagugaug

SEQ ID NO: 511708 - RNA, 19 nt, Homo sapiens
gggauugccucagaaguca

SEQ ID NO: 511709 - RNA, 19 nt, Homo sapiens
gagccaaagucgauuucau

SEQ ID NO: 511710 - RNA, 19 nt, Homo sapiens
gaaacagugguucugaaga

SEQ ID NO: 511711 - RNA, 19 nt, Homo sapiens
ccaaggaggagaaguagga

SEQ ID NO: 511712 - RNA, 19 nt, Homo sapiens
gcugcaagccaaccaauau

SEQ ID NO: 511713 - RNA, 19 nt, Homo sapiens
gacaauauacacaggauca

SEQ ID NO: 511714 - RNA, 19 nt, Homo sapiens
gaggcaugcuguccugaug

SEQ ID NO: 511715 - RNA, 19 nt, Homo sapiens
ugccaacgguaccuguuua

SEQ ID NO: 511716 - RNA, 19 nt, Homo sapiens
gaauggagacacuuugagu

SEQ ID NO: 511717 - RNA, 19 nt, Homo sapiens
aagccgaaguucaggagua

SEQ ID NO: 511718 - RNA, 19 nt, Homo sapiens
gcagugacggaauauguga

SEQ ID NO: 511719 - RNA, 19 nt, Homo sapiens
ccacggcaacuuuagcuuu

SEQ ID NO: 511720 - RNA, 19 nt, Homo sapiens
cuucugggcuccaugauca

SEQ ID NO: 511721 - RNA, 19 nt, Homo sapiens
cggagucagugaggaauuu

SEQ ID NO: 511722 - RNA, 19 nt, Homo sapiens
gcccuccuguugcaucuuu

SEQ ID NO: 511723 - RNA, 19 nt, Homo sapiens
guacaucauuuccgucacu

SEQ ID NO: 511724 - RNA, 19 nt, Homo sapiens
uaacagugaagccgaaguu

SEQ ID NO: 511725 - RNA, 19 nt, Homo sapiens
caaccaauauuuucuguca

SEQ ID NO: 511726 - RNA, 19 nt, Homo sapiens
ggaaacagugguucugaag

SEQ ID NO: 511727 - RNA, 19 nt, Homo sapiens
gggcagaguacaucauuuc

SEQ ID NO: 511728 - RNA, 19 nt, Homo sapiens
gaaggcugguuuggcaaga

SEQ ID NO: 511729 - RNA, 19 nt, Homo sapiens
cuuccucccuuccuucuuu

SEQ ID NO: 511730 - RNA, 19 nt, Homo sapiens
aaacggcaguccuuacagu

SEQ ID NO: 511731 - RNA, 19 nt, Homo sapiens
aaccacguguacaacauua

SEQ ID NO: 511732 - RNA, 19 nt, Homo sapiens
cagcagaaaccuguacaaa

SEQ ID NO: 511733 - RNA, 19 nt, Homo sapiens
gcgcaucuguacucuugug

SEQ ID NO: 511734 - RNA, 19 nt, Homo sapiens
auugaccacuaccgaauua

SEQ ID NO: 511735 - RNA, 19 nt, Homo sapiens
gcaauaucaugagguacug

SEQ ID NO: 511736 - RNA, 19 nt, Homo sapiens
caacugcugccaagaaagu

SEQ ID NO: 511737 - RNA, 19 nt, Homo sapiens
cgagugggauaacagugaa

SEQ ID NO: 511738 - RNA, 19 nt, Homo sapiens
gcacagcaaccagccuuga

SEQ ID NO: 511739 - RNA, 19 nt, Homo sapiens
gucagggcaucaacuggua

SEQ ID NO: 511740 - RNA, 19 nt, Homo sapiens
acagacucauucuuaacua

SEQ ID NO: 511741 - RNA, 19 nt, Homo sapiens
gaagauggauguccucaaa

SEQ ID NO: 511742 - RNA, 19 nt, Homo sapiens
gaagguacgugcauuacuu

SEQ ID NO: 511743 - RNA, 19 nt, Homo sapiens
caccaggacuccauucuua

SEQ ID NO: 511744 - RNA, 19 nt, Homo sapiens
gaaagaaaguggaugaaaa

SEQ ID NO: 511745 - RNA, 19 nt, Homo sapiens
gcaaugugcucuucaucaa

SEQ ID NO: 511746 - RNA, 19 nt, Homo sapiens
gcaacuaccugcuguucaa

SEQ ID NO: 511747 - RNA, 19 nt, Homo sapiens
gagaggcauuguacugaua

SEQ ID NO: 511748 - RNA, 19 nt, Homo sapiens
ggagacaucuugcugaagu

SEQ ID NO: 511749 - RNA, 19 nt, Homo sapiens
ggaccagccuuaucucaga

SEQ ID NO: 511750 - RNA, 19 nt, Homo sapiens
acagaugaaucgaaagaua

SEQ ID NO: 511751 - RNA, 19 nt, Homo sapiens
guacacaucuggcaucuac

SEQ ID NO: 511752 - RNA, 19 nt, Homo sapiens
gaagcuccaugccaaggua

SEQ ID NO: 511753 - RNA, 19 nt, Homo sapiens
uaacucaacugcuuugcaa

SEQ ID NO: 511754 - RNA, 19 nt, Homo sapiens
gaacuuguuugcuugaaag

SEQ ID NO: 511755 - RNA, 19 nt, Homo sapiens
agagaaagauggaggagaa

SEQ ID NO: 511756 - RNA, 19 nt, Homo sapiens
caaugaagcgguucuauga

SEQ ID NO: 511757 - RNA, 19 nt, Homo sapiens
gaaaguggaugaaaacaga

SEQ ID NO: 511758 - RNA, 19 nt, Homo sapiens
gaugggagccuguaugcua

SEQ ID NO: 511759 - RNA, 19 nt, Homo sapiens
caaagaauguaguggacaa

SEQ ID NO: 511760 - RNA, 19 nt, Homo sapiens
gaugaucgauuuccagagu

SEQ ID NO: 511761 - RNA, 19 nt, Homo sapiens
ccacaucgccuaccuacaa

SEQ ID NO: 511762 - RNA, 19 nt, Homo sapiens
gcccagcccuguucuauuc

SEQ ID NO: 511763 - RNA, 19 nt, Homo sapiens
gggcuaaagugaaguuugu

SEQ ID NO: 511764 - RNA, 19 nt, Homo sapiens
caaagaagguacgugcauu

SEQ ID NO: 511765 - RNA, 19 nt, Homo sapiens
ggacaaacaaccaagcuau

SEQ ID NO: 511766 - RNA, 19 nt, Homo sapiens
ggaaagaaaguggaugaaa

SEQ ID NO: 511767 - RNA, 19 nt, Homo sapiens
uuacucaccuuaugacuau

SEQ ID NO: 511768 - RNA, 19 nt, Homo sapiens
gaggagccauugaauuuag

SEQ ID NO: 511769 - RNA, 19 nt, Homo sapiens
uaaccaggauuuccauuca

SEQ ID NO: 511770 - RNA, 19 nt, Homo sapiens
uggaagaacuuguuugcuu

SEQ ID NO: 511771 - RNA, 19 nt, Homo sapiens
gaaucacucugacugacaa

SEQ ID NO: 511772 - RNA, 19 nt, Homo sapiens
gcaagcuggucauuccaaa

SEQ ID NO: 511773 - RNA, 19 nt, Homo sapiens
gaaagauggaggagaagaa

SEQ ID NO: 511774 - RNA, 19 nt, Homo sapiens
ggcacuggcuuccauggua

SEQ ID NO: 511775 - RNA, 19 nt, Homo sapiens
ggaggagccauugaauuua

SEQ ID NO: 511776 - RNA, 19 nt, Homo sapiens
gagcgugucuguggacuau

SEQ ID NO: 511777 - RNA, 19 nt, Homo sapiens
ggagcuauguggagucugu

SEQ ID NO: 511778 - RNA, 19 nt, Homo sapiens
gcgugucuguggacuauaa

SEQ ID NO: 511779 - RNA, 19 nt, Homo sapiens
gcaaugaagcgguucuaug

SEQ ID NO: 511780 - RNA, 19 nt, Homo sapiens
gccagacccuucucuucua

SEQ ID NO: 511781 - RNA, 19 nt, Homo sapiens
caccaucguucacuucaaa

SEQ ID NO: 511782 - RNA, 19 nt, Homo sapiens
gagaaugcaccaaagaaug

SEQ ID NO: 511783 - RNA, 19 nt, Homo sapiens
guacgugcauuacuucagu

SEQ ID NO: 511784 - RNA, 19 nt, Homo sapiens
aaagaagguacgugcauua

SEQ ID NO: 511785 - RNA, 19 nt, Homo sapiens
gauaagauugugcccauug

SEQ ID NO: 511786 - RNA, 19 nt, Homo sapiens
ggagguagagauaugugua

SEQ ID NO: 511787 - RNA, 19 nt, Homo sapiens
gaucggagacccacacugu

SEQ ID NO: 511788 - RNA, 19 nt, Homo sapiens
ggccagccaucccaaagaa

SEQ ID NO: 511789 - RNA, 19 nt, Homo sapiens
gaaaacaccugaccaccau

SEQ ID NO: 511790 - RNA, 19 nt, Homo sapiens
agacacacaugcauacugu

SEQ ID NO: 511791 - RNA, 19 nt, Homo sapiens
caucaacucuguggacaug

SEQ ID NO: 511792 - RNA, 19 nt, Homo sapiens
ccacaggaguuaccagaag

SEQ ID NO: 511793 - RNA, 19 nt, Homo sapiens
ggaccuugaugaugcuuuc

SEQ ID NO: 511794 - RNA, 19 nt, Homo sapiens
ggaaaagccucgaggacaa

SEQ ID NO: 511795 - RNA, 19 nt, Homo sapiens
caugagacauacugacaga

SEQ ID NO: 511796 - RNA, 19 nt, Homo sapiens
ccaccucucagccuuguua

SEQ ID NO: 511797 - RNA, 19 nt, Homo sapiens
gcauacuguccaaagauua

SEQ ID NO: 511798 - RNA, 19 nt, Homo sapiens
gaagaacuuguuugcuuga

SEQ ID NO: 511799 - RNA, 19 nt, Homo sapiens
guuccgcucucaauccuuu

SEQ ID NO: 511800 - RNA, 19 nt, Homo sapiens
gcauggagcaccuggagaa

SEQ ID NO: 511801 - RNA, 19 nt, Homo sapiens
ggcauuguacugauauaua

SEQ ID NO: 511802 - RNA, 19 nt, Homo sapiens
gcacagccaaugaggagaa

SEQ ID NO: 511803 - RNA, 19 nt, Homo sapiens
gaaacuaccagagcucuuc

SEQ ID NO: 511804 - RNA, 19 nt, Homo sapiens
ggccagugauggacaguau

SEQ ID NO: 511805 - RNA, 19 nt, Homo sapiens
ccacugagaaugcaccaaa

SEQ ID NO: 511806 - RNA, 19 nt, Homo sapiens
aggaggagccauugaauuu

SEQ ID NO: 511807 - RNA, 19 nt, Homo sapiens
gaggaggagccauugaauu

SEQ ID NO: 511808 - RNA, 19 nt, Homo sapiens
gagagaggcauuguacuga

SEQ ID NO: 511809 - RNA, 19 nt, Homo sapiens
gcauguggcucagcagcaa

SEQ ID NO: 511810 - RNA, 19 nt, Homo sapiens
gcacccacauccucacaca

SEQ ID NO: 511811 - RNA, 19 nt, Homo sapiens
gagacauacugacagaauc

SEQ ID NO: 511812 - RNA, 19 nt, Homo sapiens
ccacagaugaaucgaaaga

SEQ ID NO: 511813 - RNA, 19 nt, Homo sapiens
gcaggaaagagcccacuug

SEQ ID NO: 511814 - RNA, 19 nt, Homo sapiens
gcugaguggcuuuggcuua

SEQ ID NO: 511815 - RNA, 19 nt, Homo sapiens
augcuaaggugaagaagaa

SEQ ID NO: 511816 - RNA, 19 nt, Homo sapiens
gaguugucaucgcggcuua

SEQ ID NO: 511817 - RNA, 19 nt, Homo sapiens
gccuggagcuuugguuuga

SEQ ID NO: 511818 - RNA, 19 nt, Homo sapiens
gaaaucaagcugggagaau

SEQ ID NO: 511819 - RNA, 19 nt, Homo sapiens
ccacuacccucucaacacu

SEQ ID NO: 511820 - RNA, 19 nt, Homo sapiens
acuacucacuucagcauuu

SEQ ID NO: 511821 - RNA, 19 nt, Homo sapiens
gaagcaaggcgccauguac

SEQ ID NO: 511822 - RNA, 19 nt, Homo sapiens
caaagaugaucgauuucca

SEQ ID NO: 511823 - RNA, 19 nt, Homo sapiens
caucgaaacacucaauaug

SEQ ID NO: 511824 - RNA, 19 nt, Homo sapiens
ccaacggucuggacaaguc

SEQ ID NO: 511825 - RNA, 19 nt, Homo sapiens
gaggcauuguacugauaua

SEQ ID NO: 511826 - RNA, 19 nt, Homo sapiens
ccucacacauugaucuaga

SEQ ID NO: 511827 - RNA, 19 nt, Homo sapiens
gaaaagagagagagagaga

SEQ ID NO: 511828 - RNA, 19 nt, Homo sapiens
caaccaucaugcagcagaa

SEQ ID NO: 511829 - RNA, 19 nt, Homo sapiens
caacgccugccaccucuuu

SEQ ID NO: 511830 - RNA, 19 nt, Homo sapiens
caacuaugccaccaucaau

SEQ ID NO: 511831 - RNA, 19 nt, Homo sapiens
ggucuuacucaccuuauga

SEQ ID NO: 511832 - RNA, 19 nt, Homo sapiens
gggccucucuggagucugu

SEQ ID NO: 511833 - RNA, 19 nt, Homo sapiens
gaagugcuaccacaagaag

SEQ ID NO: 511834 - RNA, 19 nt, Homo sapiens
ggaaaccgaggcaggauag

SEQ ID NO: 511835 - RNA, 19 nt, Homo sapiens
ugacugacaaccagagaaa

SEQ ID NO: 511836 - RNA, 19 nt, Homo sapiens
ccagagaagcgaaggaugu

SEQ ID NO: 511837 - RNA, 19 nt, Homo sapiens
ggauaagauugugcccauu

SEQ ID NO: 511838 - RNA, 19 nt, Homo sapiens
acacccaccugacuuagug

SEQ ID NO: 511839 - RNA, 19 nt, Homo sapiens
uaaggacucuaagccagaa

SEQ ID NO: 511840 - RNA, 19 nt, Homo sapiens
cagacacccaccugacuua

SEQ ID NO: 511841 - RNA, 19 nt, Homo sapiens
gaaaggaaaugacuaauga

SEQ ID NO: 511842 - RNA, 19 nt, Homo sapiens
gaagaaggcuguucagaga

SEQ ID NO: 511843 - RNA, 19 nt, Homo sapiens
ggaaguagcuacguucuuu

SEQ ID NO: 511844 - RNA, 19 nt, Homo sapiens
gaacagaaguggaaauggu

SEQ ID NO: 511845 - RNA, 19 nt, Homo sapiens
ggacauaaguggaaagaag

SEQ ID NO: 511846 - RNA, 19 nt, Homo sapiens
ggaaagaaguccggcauga

SEQ ID NO: 511847 - RNA, 19 nt, Homo sapiens
acauaaagguccaguauuu

SEQ ID NO: 511848 - RNA, 19 nt, Homo sapiens
gaacauaaagguccaguau

SEQ ID NO: 511849 - RNA, 19 nt, Homo sapiens
gagaaggacuggcagaaau

SEQ ID NO: 511850 - RNA, 19 nt, Homo sapiens
ggaaaugacuaaugaagag

SEQ ID NO: 511851 - RNA, 19 nt, Homo sapiens
gaagagcgcuauccugaag

SEQ ID NO: 511852 - RNA, 19 nt, Homo sapiens
ggaugaugcugauuauaaa

SEQ ID NO: 511853 - RNA, 19 nt, Homo sapiens
ccacaucuuuccucaagua

SEQ ID NO: 511854 - RNA, 19 nt, Homo sapiens
caaucgagcuguugcaauu

SEQ ID NO: 511855 - RNA, 19 nt, Homo sapiens
ggaaacagaugagcaagga

SEQ ID NO: 511856 - RNA, 19 nt, Homo sapiens
ccucaaguaucuucuauuu

SEQ ID NO: 511857 - RNA, 19 nt, Homo sapiens
caaggucccuguugagaaa

SEQ ID NO: 511858 - RNA, 19 nt, Homo sapiens
gaacuuaggcuguuacaca

SEQ ID NO: 511859 - RNA, 19 nt, Homo sapiens
gaaaauggcuucucuaguc

SEQ ID NO: 511860 - RNA, 19 nt, Homo sapiens
gcaaguggaugggaauuug

SEQ ID NO: 511861 - RNA, 19 nt, Homo sapiens
ggagaaaggaaaugacuaa

SEQ ID NO: 511862 - RNA, 19 nt, Homo sapiens
agaagaggaugguaaauug

SEQ ID NO: 511863 - RNA, 19 nt, Homo sapiens
ggaaggacuccaucagaua

SEQ ID NO: 511864 - RNA, 19 nt, Homo sapiens
uagcaaagaugccaagguu

SEQ ID NO: 511865 - RNA, 19 nt, Homo sapiens
ucacugaaauguuuggauu

SEQ ID NO: 511866 - RNA, 19 nt, Homo sapiens
agauaaaccuggagauauu

SEQ ID NO: 511867 - RNA, 19 nt, Homo sapiens
gcgagugaaucuaaggaua

SEQ ID NO: 511868 - RNA, 19 nt, Homo sapiens
gaagggcgagugaaucuaa

SEQ ID NO: 511869 - RNA, 19 nt, Homo sapiens
gaaccuccaaacucaauua

SEQ ID NO: 511870 - RNA, 19 nt, Homo sapiens
cauccaagguuccauuaaa

SEQ ID NO: 511871 - RNA, 19 nt, Homo sapiens
ggaaagauggauaaacuga

SEQ ID NO: 511872 - RNA, 19 nt, Homo sapiens
ccaaggaaauauuuaggaa

SEQ ID NO: 511873 - RNA, 19 nt, Homo sapiens
gcuguacccuuuaagauau

SEQ ID NO: 511874 - RNA, 19 nt, Homo sapiens
gaauaagcaucuucaggau

SEQ ID NO: 511875 - RNA, 19 nt, Homo sapiens
ccaggcaaauucacuguuu

SEQ ID NO: 511876 - RNA, 19 nt, Homo sapiens
gaaagaagaggaacagaag

SEQ ID NO: 511877 - RNA, 19 nt, Homo sapiens
ucacaggucaauaaacuua

SEQ ID NO: 511878 - RNA, 19 nt, Homo sapiens
ccacaacgauucccagauc

SEQ ID NO: 511879 - RNA, 19 nt, Homo sapiens
aaagaaguccggcaugaua

SEQ ID NO: 511880 - RNA, 19 nt, Homo sapiens
ggagaagaccaaacacaaa

SEQ ID NO: 511881 - RNA, 19 nt, Homo sapiens
gcacaaagaacacaagaag

SEQ ID NO: 511882 - RNA, 19 nt, Homo sapiens
gauagagccuccuggacuu

SEQ ID NO: 511883 - RNA, 19 nt, Homo sapiens
uagcaacagugaacauaaa

SEQ ID NO: 511884 - RNA, 19 nt, Homo sapiens
caccacaaauuaaagauga

SEQ ID NO: 511885 - RNA, 19 nt, Homo sapiens
agacaaacauaaagacaga

SEQ ID NO: 511886 - RNA, 19 nt, Homo sapiens
gcaaaguccgauuauauug

SEQ ID NO: 511887 - RNA, 19 nt, Homo sapiens
ugacauggcugaugaagac

SEQ ID NO: 511888 - RNA, 19 nt, Homo sapiens
guaguagagucaaagaaga

SEQ ID NO: 511889 - RNA, 19 nt, Homo sapiens
gaaccuacaacuauuuaug

SEQ ID NO: 511890 - RNA, 19 nt, Homo sapiens
gggaaggacuccaucagau

SEQ ID NO: 511891 - RNA, 19 nt, Homo sapiens
gauaaaccuggagauauua

SEQ ID NO: 511892 - RNA, 19 nt, Homo sapiens
cagagaaugucaaguuuua

SEQ ID NO: 511893 - RNA, 19 nt, Homo sapiens
gauuuccgauugaaugauu

SEQ ID NO: 511894 - RNA, 19 nt, Homo sapiens
acaaagagaggauugcuaa

SEQ ID NO: 511895 - RNA, 19 nt, Homo sapiens
aaacagaagauaccaagaa

SEQ ID NO: 511896 - RNA, 19 nt, Homo sapiens
gagaacaccggcacaaaga

SEQ ID NO: 511897 - RNA, 19 nt, Homo sapiens
uuaaagaucguguagauug

SEQ ID NO: 511898 - RNA, 19 nt, Homo sapiens
gaacuugcaaacuaagauu

SEQ ID NO: 511899 - RNA, 19 nt, Homo sapiens
gaagaggaugguaaauuga

SEQ ID NO: 511900 - RNA, 19 nt, Homo sapiens
ugaugaacuugcaaacuaa

SEQ ID NO: 511901 - RNA, 19 nt, Homo sapiens
aaagagaccucgagaugag

SEQ ID NO: 511902 - RNA, 19 nt, Homo sapiens
gaggauauaaagccauuaa

SEQ ID NO: 511903 - RNA, 19 nt, Homo sapiens
aaagauaaaccuggagaua

SEQ ID NO: 511904 - RNA, 19 nt, Homo sapiens
augaugaacuugcaaacua

SEQ ID NO: 511905 - RNA, 19 nt, Homo sapiens
gaagagaaacugaaaauca

SEQ ID NO: 511906 - RNA, 19 nt, Homo sapiens
ggcagcaagucuuaacaaa

SEQ ID NO: 511907 - RNA, 19 nt, Homo sapiens
ugaugaagacuaugaguuu

SEQ ID NO: 511908 - RNA, 19 nt, Homo sapiens
gaagaagguaguagaguca

SEQ ID NO: 511909 - RNA, 19 nt, Homo sapiens
cgacaagcuugcucugaga

SEQ ID NO: 511910 - RNA, 19 nt, Homo sapiens
ggaaauggugggaagaaga

SEQ ID NO: 511911 - RNA, 19 nt, Homo sapiens
gaaccaguaucgagaagac

SEQ ID NO: 511912 - RNA, 19 nt, Homo sapiens
gaggauugcuaacuucaag

SEQ ID NO: 511913 - RNA, 19 nt, Homo sapiens
gaauauacuaccaaggaaa

SEQ ID NO: 511914 - RNA, 19 nt, Homo sapiens
gauagacucaauacuggua

SEQ ID NO: 511915 - RNA, 19 nt, Homo sapiens
ggaauaugugguagaguuu

SEQ ID NO: 511916 - RNA, 19 nt, Homo sapiens
caaggaagagaaacugaaa

SEQ ID NO: 511917 - RNA, 19 nt, Homo sapiens
acaaagaacacaagaagga

SEQ ID NO: 511918 - RNA, 19 nt, Homo sapiens
cgagugaaucuaaggauaa

SEQ ID NO: 511919 - RNA, 19 nt, Homo sapiens
gaagaggaacagugugguu

SEQ ID NO: 511920 - RNA, 19 nt, Homo sapiens
caaagaagaaggcuguuca

SEQ ID NO: 511921 - RNA, 19 nt, Homo sapiens
uaagauugaugccaagaag

SEQ ID NO: 511922 - RNA, 19 nt, Homo sapiens
gcaaggaagagaaacugaa

SEQ ID NO: 511923 - RNA, 19 nt, Homo sapiens
cuagcuguaugauuuguuu

SEQ ID NO: 511924 - RNA, 19 nt, Homo sapiens
ccuccaaacucaauuaucu

SEQ ID NO: 511925 - RNA, 19 nt, Homo sapiens
aggaauaugugguagaguu

SEQ ID NO: 511926 - RNA, 19 nt, Homo sapiens
guagcuacguucuuugcaa

SEQ ID NO: 511927 - RNA, 19 nt, Homo sapiens
cagaagauaccaagaagga

SEQ ID NO: 511928 - RNA, 19 nt, Homo sapiens
acacaaagaucgagaacac

SEQ ID NO: 511929 - RNA, 19 nt, Homo sapiens
uuaaagagaccucgagaug

SEQ ID NO: 511930 - RNA, 19 nt, Homo sapiens
ggauauaaagccauuaaag

SEQ ID NO: 511931 - RNA, 19 nt, Homo sapiens
aagaugaaccugaagauga

SEQ ID NO: 511932 - RNA, 19 nt, Homo sapiens
guucugagcauucgcugua

SEQ ID NO: 511933 - RNA, 19 nt, Homo sapiens
cagaugagccaguauuuca

SEQ ID NO: 511934 - RNA, 19 nt, Homo sapiens
gaaaagaaacacaaagaga

SEQ ID NO: 511935 - RNA, 19 nt, Homo sapiens
ugaauauacuaccaaggaa

SEQ ID NO: 511936 - RNA, 19 nt, Homo sapiens
ucuaguccaccacaaauua

SEQ ID NO: 511937 - RNA, 19 nt, Homo sapiens
uuugagaagucuaugauga

SEQ ID NO: 511938 - RNA, 19 nt, Homo sapiens
aagagaggauugcuaacuu

SEQ ID NO: 511939 - RNA, 19 nt, Homo sapiens
gaugagccaguauuucaaa

SEQ ID NO: 511940 - RNA, 19 nt, Homo sapiens
gaugauggcuauuuuguuc

SEQ ID NO: 511941 - RNA, 19 nt, Homo sapiens
gaagacaccuccucucaua

SEQ ID NO: 511942 - RNA, 19 nt, Homo sapiens
gaacauggacccagacaua

SEQ ID NO: 511943 - RNA, 19 nt, Homo sapiens
aaacagacauggauggaua

SEQ ID NO: 511944 - RNA, 19 nt, Homo sapiens
gggaagagcuggugagaug

SEQ ID NO: 511945 - RNA, 19 nt, Homo sapiens
caaacuacauuggcauuua

SEQ ID NO: 511946 - RNA, 19 nt, Homo sapiens
gaaguguguuuaacuauga

SEQ ID NO: 511947 - RNA, 19 nt, Homo sapiens
caaaggaagcuaaagaaua

SEQ ID NO: 511948 - RNA, 19 nt, Homo sapiens
gaaagaguccaucagauuu

SEQ ID NO: 511949 - RNA, 19 nt, Homo sapiens
gaugaacucugcaggcuaa

SEQ ID NO: 511950 - RNA, 19 nt, Homo sapiens
cgaaaggaaugguuaacua

SEQ ID NO: 511951 - RNA, 19 nt, Homo sapiens
agaaauagcuaucugauca

SEQ ID NO: 511952 - RNA, 19 nt, Homo sapiens
agacauggauggauaauau

SEQ ID NO: 511953 - RNA, 19 nt, Homo sapiens
gcaauaaucuaaaccucuu

SEQ ID NO: 511954 - RNA, 19 nt, Homo sapiens
gaaaggaaugguuaacuaa

SEQ ID NO: 511955 - RNA, 19 nt, Homo sapiens
ugacuaaacuuguugaugu

SEQ ID NO: 511956 - RNA, 19 nt, Homo sapiens
gcaaagaaaccuauaaagu

SEQ ID NO: 511957 - RNA, 19 nt, Homo sapiens
ggacagcuccuaacuucua

SEQ ID NO: 511958 - RNA, 19 nt, Homo sapiens
ucaagaagaugguguggaa

SEQ ID NO: 511959 - RNA, 19 nt, Homo sapiens
uggcugaaaugucuucuua

SEQ ID NO: 511960 - RNA, 19 nt, Homo sapiens
caagaaguguucagcugua

SEQ ID NO: 511961 - RNA, 19 nt, Homo sapiens
ggagaagauuauacaugua

SEQ ID NO: 511962 - RNA, 19 nt, Homo sapiens
ggaaacagccaguagagaa

SEQ ID NO: 511963 - RNA, 19 nt, Homo sapiens
aacaagagcuggacacauu

SEQ ID NO: 511964 - RNA, 19 nt, Homo sapiens
gauaaauggugcugaagga

SEQ ID NO: 511965 - RNA, 19 nt, Homo sapiens
ggaaguguguuuaacuaug

SEQ ID NO: 511966 - RNA, 19 nt, Homo sapiens
gguaacuccuugaaaguaa

SEQ ID NO: 511967 - RNA, 19 nt, Homo sapiens
gaaggaagcccucaagaag

SEQ ID NO: 511968 - RNA, 19 nt, Homo sapiens
uaaauaacaucaggcguuu

SEQ ID NO: 511969 - RNA, 19 nt, Homo sapiens
aguaaagguugcccaauua

SEQ ID NO: 511970 - RNA, 19 nt, Homo sapiens
ggaccaaccuucaacuauc

SEQ ID NO: 511971 - RNA, 19 nt, Homo sapiens
aaaggaagcuaaagaauac

SEQ ID NO: 511972 - RNA, 19 nt, Homo sapiens
gaugaagauuucucagauu

SEQ ID NO: 511973 - RNA, 19 nt, Homo sapiens
agacuuggcuacauuuauu

SEQ ID NO: 511974 - RNA, 19 nt, Homo sapiens
gaauuuaucacucccauug

SEQ ID NO: 511975 - RNA, 19 nt, Homo sapiens
ucaaaggcuugcugauuaa

SEQ ID NO: 511976 - RNA, 19 nt, Homo sapiens
guacaagacaucaaaguga

SEQ ID NO: 511977 - RNA, 19 nt, Homo sapiens
guacaaagacaaagaaaca

SEQ ID NO: 511978 - RNA, 19 nt, Homo sapiens
gauagaugaucgaaaggaa

SEQ ID NO: 511979 - RNA, 19 nt, Homo sapiens
uuauguagcugaucagauu

SEQ ID NO: 511980 - RNA, 19 nt, Homo sapiens
ccucuuaugugccaaguuu

SEQ ID NO: 511981 - RNA, 19 nt, Homo sapiens
ugccaaugcuuccaaguua

SEQ ID NO: 511982 - RNA, 19 nt, Homo sapiens
gagaagaaccuuugccaau

SEQ ID NO: 511983 - RNA, 19 nt, Homo sapiens
gauguuggcauuaacuaua

SEQ ID NO: 511984 - RNA, 19 nt, Homo sapiens
caaauauucugguccugaa

SEQ ID NO: 511985 - RNA, 19 nt, Homo sapiens
ugucccagcucucauauuu

SEQ ID NO: 511986 - RNA, 19 nt, Homo sapiens
cugcuaaacugaauaauca

SEQ ID NO: 511987 - RNA, 19 nt, Homo sapiens
aaacuagucucacaugcaa

SEQ ID NO: 511988 - RNA, 19 nt, Homo sapiens
gaaauuuguugugaagaug

SEQ ID NO: 511989 - RNA, 19 nt, Homo sapiens
uagaagacaacgaaaguua

SEQ ID NO: 511990 - RNA, 19 nt, Homo sapiens
gcacaucaaaggaagcuaa

SEQ ID NO: 511991 - RNA, 19 nt, Homo sapiens
uuacagccuuccugaauuu

SEQ ID NO: 511992 - RNA, 19 nt, Homo sapiens
guaaaaggauuucguaguu

SEQ ID NO: 511993 - RNA, 19 nt, Homo sapiens
gcugaaaugucuucuuauc

SEQ ID NO: 511994 - RNA, 19 nt, Homo sapiens
caaacuaccacauaucuga

SEQ ID NO: 511995 - RNA, 19 nt, Homo sapiens
ugagggagauucagccaaa

SEQ ID NO: 511996 - RNA, 19 nt, Homo sapiens
caagggugguguugcagua

SEQ ID NO: 511997 - RNA, 19 nt, Homo sapiens
gaccaaaacuuccccaaaa

SEQ ID NO: 511998 - RNA, 19 nt, Homo sapiens
gaagaaccuuugccaaugc

SEQ ID NO: 511999 - RNA, 19 nt, Homo sapiens
gcugauaaauggugcugaa

SEQ ID NO: 512000 - RNA, 19 nt, Homo sapiens
gaaaugucuucuuaucauc

SEQ ID NO: 512001 - RNA, 19 nt, Homo sapiens
gaacucaagcccuucaaug

SEQ ID NO: 512002 - RNA, 19 nt, Homo sapiens
cgaugaagauguuggcauu

SEQ ID NO: 512003 - RNA, 19 nt, Homo sapiens
gaagacuuggcuacauuua

SEQ ID NO: 512004 - RNA, 19 nt, Homo sapiens
uuacaaugcucagcucuuu

SEQ ID NO: 512005 - RNA, 19 nt, Homo sapiens
caccaaagaugucaaaguc

SEQ ID NO: 512006 - RNA, 19 nt, Homo sapiens
ccaaagagagaaaccaauu

SEQ ID NO: 512007 - RNA, 19 nt, Homo sapiens
gaaguaaagcccaaguguu

SEQ ID NO: 512008 - RNA, 19 nt, Homo sapiens
cgaaagcagucacaagcaa

SEQ ID NO: 512009 - RNA, 19 nt, Homo sapiens
cgaauaaccauagaaauga

SEQ ID NO: 512010 - RNA, 19 nt, Homo sapiens
cacguaggcuguuuaaaga

SEQ ID NO: 512011 - RNA, 19 nt, Homo sapiens
caaggguacuauugaagaa

SEQ ID NO: 512012 - RNA, 19 nt, Homo sapiens
acagauagaugaucgaaag

SEQ ID NO: 512013 - RNA, 19 nt, Homo sapiens
guagaaagcauacuaaacu

SEQ ID NO: 512014 - RNA, 19 nt, Homo sapiens
guauuagagucacaauuga

SEQ ID NO: 512015 - RNA, 19 nt, Homo sapiens
gacaacauuugauccaaga

SEQ ID NO: 512016 - RNA, 19 nt, Homo sapiens
gaaauuacaaacccaguuc

SEQ ID NO: 512017 - RNA, 19 nt, Homo sapiens
gguguuggauauucuaaga

SEQ ID NO: 512018 - RNA, 19 nt, Homo sapiens
gaacuucaaggguacuauu

SEQ ID NO: 512019 - RNA, 19 nt, Homo sapiens
uggcagacauguugauuau

SEQ ID NO: 512020 - RNA, 19 nt, Homo sapiens
ccagacaccuacauugguu

SEQ ID NO: 512021 - RNA, 19 nt, Homo sapiens
aaaguuaccugaagcucuu

SEQ ID NO: 512022 - RNA, 19 nt, Homo sapiens
gaacucugcaggcuaagaa

SEQ ID NO: 512023 - RNA, 19 nt, Homo sapiens
gaagagagugacaacgaaa

SEQ ID NO: 512024 - RNA, 19 nt, Homo sapiens
ggugaaguagcuauucuua

SEQ ID NO: 512025 - RNA, 19 nt, Homo sapiens
gaggauagaagacaacgaa

SEQ ID NO: 512026 - RNA, 19 nt, Homo sapiens
caaacucgaugaugccaau

SEQ ID NO: 512027 - RNA, 19 nt, Homo sapiens
caacaugccaauugaguga

SEQ ID NO: 512028 - RNA, 19 nt, Homo sapiens
aaauguggguuuacgauga

SEQ ID NO: 512029 - RNA, 19 nt, Homo sapiens
cugaucagauugugacuaa

SEQ ID NO: 512030 - RNA, 19 nt, Homo sapiens
caaagauauuguugcacua

SEQ ID NO: 512031 - RNA, 19 nt, Homo sapiens
uggagaagauuauacaugu

SEQ ID NO: 512032 - RNA, 19 nt, Homo sapiens
caaauuuacuguggaaaca

SEQ ID NO: 512033 - RNA, 19 nt, Homo sapiens
cuacacauuucccagauga

SEQ ID NO: 512034 - RNA, 19 nt, Homo sapiens
aaacacaaauggcugaagu

SEQ ID NO: 512035 - RNA, 19 nt, Homo sapiens
caaagagagaaaccaauuu

SEQ ID NO: 512036 - RNA, 19 nt, Homo sapiens
gggcaaagaaaccuauaaa

SEQ ID NO: 512037 - RNA, 19 nt, Homo sapiens
caauggauuuggauucaga

SEQ ID NO: 512038 - RNA, 19 nt, Homo sapiens
cuacauugguucuguggaa

SEQ ID NO: 512039 - RNA, 19 nt, Homo sapiens
aagaagacuuggcuacauu

SEQ ID NO: 512040 - RNA, 19 nt, Homo sapiens
caucagauuuguggaaaga

SEQ ID NO: 512041 - RNA, 19 nt, Homo sapiens
gaacaaagcugguguauca

SEQ ID NO: 512042 - RNA, 19 nt, Homo sapiens
ggaaagaaauugccuguaa

SEQ ID NO: 512043 - RNA, 19 nt, Homo sapiens
gaacaagcauugaugauga

SEQ ID NO: 512044 - RNA, 19 nt, Homo sapiens
cuacaaagcuuaacaauca

SEQ ID NO: 512045 - RNA, 19 nt, Homo sapiens
gaacuuuccuucuacagua

SEQ ID NO: 512046 - RNA, 19 nt, Homo sapiens
ggacacagguauauaaaga

SEQ ID NO: 512047 - RNA, 19 nt, Homo sapiens
gcacguggauuauguggua

SEQ ID NO: 512048 - RNA, 19 nt, Homo sapiens
gaaauugccuguaaaugga

SEQ ID NO: 512049 - RNA, 19 nt, Homo sapiens
gaaaggcauuccaguagua

SEQ ID NO: 512050 - RNA, 19 nt, Homo sapiens
gcaguuauguagaucuuua

SEQ ID NO: 512051 - RNA, 19 nt, Homo sapiens
gaaagaaauugccuguaaa

SEQ ID NO: 512052 - RNA, 19 nt, Homo sapiens
gaauuuggcucagaacuuu

SEQ ID NO: 512053 - RNA, 19 nt, Homo sapiens
gaaguugucuguugagaga

SEQ ID NO: 512054 - RNA, 19 nt, Homo sapiens
ccaaagagcacaaacauuu

SEQ ID NO: 512055 - RNA, 19 nt, Homo sapiens
ccagaucuguccaaauuua

SEQ ID NO: 512056 - RNA, 19 nt, Homo sapiens
gaaagcaucuggcucugaa

SEQ ID NO: 512057 - RNA, 19 nt, Homo sapiens
gagaauaggucaaagaaag

SEQ ID NO: 512058 - RNA, 19 nt, Homo sapiens
gaaaaugacugaagagaaa

SEQ ID NO: 512059 - RNA, 19 nt, Homo sapiens
caagaugguucucacauaa

SEQ ID NO: 512060 - RNA, 19 nt, Homo sapiens
agaaacagcuugcaaagaa

SEQ ID NO: 512061 - RNA, 19 nt, Homo sapiens
gauccugaaucuaacauua

SEQ ID NO: 512062 - RNA, 19 nt, Homo sapiens
ggaaaggcaucgcaucuug

SEQ ID NO: 512063 - RNA, 19 nt, Homo sapiens
caaagaaguugucuguuga

SEQ ID NO: 512064 - RNA, 19 nt, Homo sapiens
guacaaaguuuacaguaga

SEQ ID NO: 512065 - RNA, 19 nt, Homo sapiens
gauaagaacaugacuugua

SEQ ID NO: 512066 - RNA, 19 nt, Homo sapiens
ucaaagaaguugucuguug

SEQ ID NO: 512067 - RNA, 19 nt, Homo sapiens
cagauaaaguuccaaguaa

SEQ ID NO: 512068 - RNA, 19 nt, Homo sapiens
gaagaagauugaugacaga

SEQ ID NO: 512069 - RNA, 19 nt, Homo sapiens
uaagaaguguucaucagua

SEQ ID NO: 512070 - RNA, 19 nt, Homo sapiens
agacucagcugaauaagaa

SEQ ID NO: 512071 - RNA, 19 nt, Homo sapiens
gaaacuagcacaagcagaa

SEQ ID NO: 512072 - RNA, 19 nt, Homo sapiens
gaugauaguuccuccgauu

SEQ ID NO: 512073 - RNA, 19 nt, Homo sapiens
aagcagacauggaugaaua

SEQ ID NO: 512074 - RNA, 19 nt, Homo sapiens
cgaaagaccuaaauacaca

SEQ ID NO: 512075 - RNA, 19 nt, Homo sapiens
gaagauuacacaugcauaa

SEQ ID NO: 512076 - RNA, 19 nt, Homo sapiens
uaaagcaucucccauaaca

SEQ ID NO: 512077 - RNA, 19 nt, Homo sapiens
gaaagugauuuggaagaaa

SEQ ID NO: 512078 - RNA, 19 nt, Homo sapiens
ccagagagguuaugaaucu

SEQ ID NO: 512079 - RNA, 19 nt, Homo sapiens
gaacuuggacacagguaua

SEQ ID NO: 512080 - RNA, 19 nt, Homo sapiens
ugggaugucugaagaaaua

SEQ ID NO: 512081 - RNA, 19 nt, Homo sapiens
cagcuaaauuugacaguaa

SEQ ID NO: 512082 - RNA, 19 nt, Homo sapiens
guuaaagcaucucccauaa

SEQ ID NO: 512083 - RNA, 19 nt, Homo sapiens
gcaauuaaagguaaaguug

SEQ ID NO: 512084 - RNA, 19 nt, Homo sapiens
ggacagaaacacaguagaa

SEQ ID NO: 512085 - RNA, 19 nt, Homo sapiens
ugaacugggugaaauuuaa

SEQ ID NO: 512086 - RNA, 19 nt, Homo sapiens
aaccagaucuguccaaauu

SEQ ID NO: 512087 - RNA, 19 nt, Homo sapiens
ggaaaaccgucuucagaua

SEQ ID NO: 512088 - RNA, 19 nt, Homo sapiens
uuacagagcuuccaguuag

SEQ ID NO: 512089 - RNA, 19 nt, Homo sapiens
ucaagaugguucucacaua

SEQ ID NO: 512090 - RNA, 19 nt, Homo sapiens
gaagaagacacaacuugaa

SEQ ID NO: 512091 - RNA, 19 nt, Homo sapiens
guaagaagaagauugauga

SEQ ID NO: 512092 - RNA, 19 nt, Homo sapiens
guucauuacuccuauugua

SEQ ID NO: 512093 - RNA, 19 nt, Homo sapiens
uaaaaggccugcuuauuaa

SEQ ID NO: 512094 - RNA, 19 nt, Homo sapiens
gaaacagacagauaaaguu

SEQ ID NO: 512095 - RNA, 19 nt, Homo sapiens
gaagaugauucagcuaaau

SEQ ID NO: 512096 - RNA, 19 nt, Homo sapiens
gaagaugaauuuguuccuu

SEQ ID NO: 512097 - RNA, 19 nt, Homo sapiens
gaaccuaugcuaaauggaa

SEQ ID NO: 512098 - RNA, 19 nt, Homo sapiens
gaugaugacuauugugaau

SEQ ID NO: 512099 - RNA, 19 nt, Homo sapiens
gaagauguaggaaugaauu

SEQ ID NO: 512100 - RNA, 19 nt, Homo sapiens
gggagacucugccaaauca

SEQ ID NO: 512101 - RNA, 19 nt, Homo sapiens
uuaauuaagugcccaaaga

SEQ ID NO: 512102 - RNA, 19 nt, Homo sapiens
uggaugggcuuguaaacua

SEQ ID NO: 512103 - RNA, 19 nt, Homo sapiens
gcacugaccugggugaaca

SEQ ID NO: 512104 - RNA, 19 nt, Homo sapiens
gucagaaacugccaacaaa

SEQ ID NO: 512105 - RNA, 19 nt, Homo sapiens
gaucauaugggaugucuga

SEQ ID NO: 512106 - RNA, 19 nt, Homo sapiens
gaagaggcauugacuccau

SEQ ID NO: 512107 - RNA, 19 nt, Homo sapiens
gaagauugaugacagaaaa

SEQ ID NO: 512108 - RNA, 19 nt, Homo sapiens
gaaacagcuugcaaagaau

SEQ ID NO: 512109 - RNA, 19 nt, Homo sapiens
caaagaaagugaagaaacg

SEQ ID NO: 512110 - RNA, 19 nt, Homo sapiens
gaagaacugauuaaacaga

SEQ ID NO: 512111 - RNA, 19 nt, Homo sapiens
uauaaaggauuggguacua

SEQ ID NO: 512112 - RNA, 19 nt, Homo sapiens
cagaaagccuggaaaauaa

SEQ ID NO: 512113 - RNA, 19 nt, Homo sapiens
uaacauccaguaacuauga

SEQ ID NO: 512114 - RNA, 19 nt, Homo sapiens
agaagaagaugauguugau

SEQ ID NO: 512115 - RNA, 19 nt, Homo sapiens
cuaaagaagcaaaggaaua

SEQ ID NO: 512116 - RNA, 19 nt, Homo sapiens
aaucaaagguauucccaaa

SEQ ID NO: 512117 - RNA, 19 nt, Homo sapiens
uaaagcagccucuaauugu

SEQ ID NO: 512118 - RNA, 19 nt, Homo sapiens
aaugaaagaugggauguuu

SEQ ID NO: 512119 - RNA, 19 nt, Homo sapiens
gaaaguuauucaugagcuu

SEQ ID NO: 512120 - RNA, 19 nt, Homo sapiens
gggucaaggucauguuuaa

SEQ ID NO: 512121 - RNA, 19 nt, Homo sapiens
cugauuggcuuguagaauu

SEQ ID NO: 512122 - RNA, 19 nt, Homo sapiens
cauaugggaugucugaaga

SEQ ID NO: 512123 - RNA, 19 nt, Homo sapiens
gcugcaagcccucguuaua

SEQ ID NO: 512124 - RNA, 19 nt, Homo sapiens
gcacagauuuuaauuguca

SEQ ID NO: 512125 - RNA, 19 nt, Homo sapiens
agacaaugcccucaccuua

SEQ ID NO: 512126 - RNA, 19 nt, Homo sapiens
ggauuuagcggcauuuguu

SEQ ID NO: 512127 - RNA, 19 nt, Homo sapiens
cagaaacacaguagaaauu

SEQ ID NO: 512128 - RNA, 19 nt, Homo sapiens
agucaguggugaaauauuu

SEQ ID NO: 512129 - RNA, 19 nt, Homo sapiens
guaaacuacccaacuauga

SEQ ID NO: 512130 - RNA, 19 nt, Homo sapiens
caaacuggaugaugcuaau

SEQ ID NO: 512131 - RNA, 19 nt, Homo sapiens
gguguaugaugaagaugua

SEQ ID NO: 512132 - RNA, 19 nt, Homo sapiens
acaccuacaucaucuggua

SEQ ID NO: 512133 - RNA, 19 nt, Homo sapiens
gaaacacaguagaaauuac

SEQ ID NO: 512134 - RNA, 19 nt, Homo sapiens
gagccugagugguauauuc

SEQ ID NO: 512135 - RNA, 19 nt, Homo sapiens
uugcugagaugucggcuua

SEQ ID NO: 512136 - RNA, 19 nt, Homo sapiens
gacaauaaacagagggaua

SEQ ID NO: 512137 - RNA, 19 nt, Homo sapiens
gcaagaaaccgaagaagac

SEQ ID NO: 512138 - RNA, 19 nt, Homo sapiens
gaagucagaagaugauuca

SEQ ID NO: 512139 - RNA, 19 nt, Homo sapiens
uuggaaaucucuucucauu

SEQ ID NO: 512140 - RNA, 19 nt, Homo sapiens
ugaugaagauguaggaaug

SEQ ID NO: 512141 - RNA, 19 nt, Homo sapiens
gaaacuaucuggaugugua

SEQ ID NO: 512142 - RNA, 19 nt, Homo sapiens
ccacaaagaugguaucgua

SEQ ID NO: 512143 - RNA, 19 nt, Homo sapiens
ggaaauggcugugguaaca

SEQ ID NO: 512144 - RNA, 19 nt, Homo sapiens
ccagaaaucuuccacagaa

SEQ ID NO: 512145 - RNA, 19 nt, Homo sapiens
caaauacaccaacaacuua

SEQ ID NO: 512146 - RNA, 19 nt, Homo sapiens
gaacaagucugaccaagcu

SEQ ID NO: 512147 - RNA, 19 nt, Homo sapiens
gaaaucuuccacagaauua

SEQ ID NO: 512148 - RNA, 19 nt, Homo sapiens
gaagcuucauucccucuua

SEQ ID NO: 512149 - RNA, 19 nt, Homo sapiens
gaaggacgguguaaugcaa

SEQ ID NO: 512150 - RNA, 19 nt, Homo sapiens
ccacacggcuugccuaguu

SEQ ID NO: 512151 - RNA, 19 nt, Homo sapiens
ggagguagcugcaacuucu

SEQ ID NO: 512152 - RNA, 19 nt, Homo sapiens
gagaaggacuuucaaaauu

SEQ ID NO: 512153 - RNA, 19 nt, Homo sapiens
gaaguuccacgccaagaua

SEQ ID NO: 512154 - RNA, 19 nt, Homo sapiens
gagcaaggaucccacuuuc

SEQ ID NO: 512155 - RNA, 19 nt, Homo sapiens
gaccaugccucuggaguuu

SEQ ID NO: 512156 - RNA, 19 nt, Homo sapiens
ggcagcaagugcagaaaua

SEQ ID NO: 512157 - RNA, 19 nt, Homo sapiens
gaucuaagcccaagagcaa

SEQ ID NO: 512158 - RNA, 19 nt, Homo sapiens
gcaauucugugaccugcaa

SEQ ID NO: 512159 - RNA, 19 nt, Homo sapiens
gguaaugacuucaguuucu

SEQ ID NO: 512160 - RNA, 19 nt, Homo sapiens
caaagaugguaucguagaa

SEQ ID NO: 512161 - RNA, 19 nt, Homo sapiens
gacauuuacuggcucauga

SEQ ID NO: 512162 - RNA, 19 nt, Homo sapiens
ccaaauacaccaacaacuu

SEQ ID NO: 512163 - RNA, 19 nt, Homo sapiens
gcaaugggaacaagucuga

SEQ ID NO: 512164 - RNA, 19 nt, Homo sapiens
gagaagcucuacacucaag

SEQ ID NO: 512165 - RNA, 19 nt, Homo sapiens
gcacaucgagaccaucaaa

SEQ ID NO: 512166 - RNA, 19 nt, Homo sapiens
aaagaaaccaugaggauug

SEQ ID NO: 512167 - RNA, 19 nt, Homo sapiens
gaaaaguacugcccagaga

SEQ ID NO: 512168 - RNA, 19 nt, Homo sapiens
ggugaaagcaauucuguga

SEQ ID NO: 512169 - RNA, 19 nt, Homo sapiens
gaucuggacugacugugau

SEQ ID NO: 512170 - RNA, 19 nt, Homo sapiens
gcugaucugugauggcaaa

SEQ ID NO: 512171 - RNA, 19 nt, Homo sapiens
gagcuggaccugaggauug

SEQ ID NO: 512172 - RNA, 19 nt, Homo sapiens
ggagagaaggacuuucaaa

SEQ ID NO: 512173 - RNA, 19 nt, Homo sapiens
gauuggagcugccuuuacu

SEQ ID NO: 512174 - RNA, 19 nt, Homo sapiens
gagcugccuuuacuagguu

SEQ ID NO: 512175 - RNA, 19 nt, Homo sapiens
gaccauagccacugcugaa

SEQ ID NO: 512176 - RNA, 19 nt, Homo sapiens
ggacaguguuggccuuugg

SEQ ID NO: 512177 - RNA, 19 nt, Homo sapiens
ggagaagcauggcauuggu

SEQ ID NO: 512178 - RNA, 19 nt, Homo sapiens
ccacagaauuaaaguaacu

SEQ ID NO: 512179 - RNA, 19 nt, Homo sapiens
ggagcugccuuuacuaggu

SEQ ID NO: 512180 - RNA, 19 nt, Homo sapiens
caacuuacagggagaugaa

SEQ ID NO: 512181 - RNA, 19 nt, Homo sapiens
ccaaggaugguugcuguua

SEQ ID NO: 512182 - RNA, 19 nt, Homo sapiens
ccaugaggauugcugagaa

SEQ ID NO: 512183 - RNA, 19 nt, Homo sapiens
aagaugguaucguagaauu

SEQ ID NO: 512184 - RNA, 19 nt, Homo sapiens
gaacuggaagcugaucuga

SEQ ID NO: 512185 - RNA, 19 nt, Homo sapiens
gcaaggaucccacuuucag

SEQ ID NO: 512186 - RNA, 19 nt, Homo sapiens
ggugagcgaugcuguggau

SEQ ID NO: 512187 - RNA, 19 nt, Homo sapiens
gagauuauccacgugugua

SEQ ID NO: 512188 - RNA, 19 nt, Homo sapiens
ggacugacugugauagaga

SEQ ID NO: 512189 - RNA, 19 nt, Homo sapiens
ugagaaggacgguguaaug

SEQ ID NO: 512190 - RNA, 19 nt, Homo sapiens
gcaacccucuuguccucuu

SEQ ID NO: 512191 - RNA, 19 nt, Homo sapiens
ccaaguggccauuuagugu

SEQ ID NO: 512192 - RNA, 19 nt, Homo sapiens
ggguagagaacgccacuuu

SEQ ID NO: 512193 - RNA, 19 nt, Homo sapiens
gagaagcauggcauuggua

SEQ ID NO: 512194 - RNA, 19 nt, Homo sapiens
uaaagaaaccaugaggauu

SEQ ID NO: 512195 - RNA, 19 nt, Homo sapiens
caaggaugguugcuguuag

SEQ ID NO: 512196 - RNA, 19 nt, Homo sapiens
ucgccgaccugcugucaaa

SEQ ID NO: 512197 - RNA, 19 nt, Homo sapiens
ucauugcccucauggagaa

SEQ ID NO: 512198 - RNA, 19 nt, Homo sapiens
gauccucccugucuaugag

SEQ ID NO: 512199 - RNA, 19 nt, Homo sapiens
uaacucaugaccacaaaga

SEQ ID NO: 512200 - RNA, 19 nt, Homo sapiens
gagcgaugcuguggaugug

SEQ ID NO: 512201 - RNA, 19 nt, Homo sapiens
caaggaaauggcuguggua

SEQ ID NO: 512202 - RNA, 19 nt, Homo sapiens
ggaagugcccacagugcaa

SEQ ID NO: 512203 - RNA, 19 nt, Homo sapiens
gcagaaauacaagcagguu

SEQ ID NO: 512204 - RNA, 19 nt, Homo sapiens
gcccgaagaccgugccuuu

SEQ ID NO: 512205 - RNA, 19 nt, Homo sapiens
caagaaaacuuuggaacga

SEQ ID NO: 512206 - RNA, 19 nt, Homo sapiens
uucaguuucuggacauuua

SEQ ID NO: 512207 - RNA, 19 nt, Homo sapiens
gcuaaccagucccugaaca

SEQ ID NO: 512208 - RNA, 19 nt, Homo sapiens
gauccuggaccugagauuu

SEQ ID NO: 512209 - RNA, 19 nt, Homo sapiens
gagugucgcucagcugugu

SEQ ID NO: 512210 - RNA, 19 nt, Homo sapiens
ccuccgggcugaacuggaa

SEQ ID NO: 512211 - RNA, 19 nt, Homo sapiens
cgaacagaaacaaacauuu

SEQ ID NO: 512212 - RNA, 19 nt, Homo sapiens
cuaaagaaaccaugaggau

SEQ ID NO: 512213 - RNA, 19 nt, Homo sapiens
ucauagacguccugagaag

SEQ ID NO: 512214 - RNA, 19 nt, Homo sapiens
gaaggacuuucaaaauuca

SEQ ID NO: 512215 - RNA, 19 nt, Homo sapiens
gacaggagacagaggaaga

SEQ ID NO: 512216 - RNA, 19 nt, Homo sapiens
guaaugacuucaguuucug

SEQ ID NO: 512217 - RNA, 19 nt, Homo sapiens
gagcacaucgagaccauca

SEQ ID NO: 512218 - RNA, 19 nt, Homo sapiens
caagauccucccugucuau

SEQ ID NO: 512219 - RNA, 19 nt, Homo sapiens
acaagauccucccugucua

SEQ ID NO: 512220 - RNA, 19 nt, Homo sapiens
cagcgacuguacgaguuua

SEQ ID NO: 512221 - RNA, 19 nt, Homo sapiens
cgaaaguugagaauaaaug

SEQ ID NO: 512222 - RNA, 19 nt, Homo sapiens
gcggagagaaggacuuuca

SEQ ID NO: 512223 - RNA, 19 nt, Homo sapiens
aggaccaaguggccauuua

SEQ ID NO: 512224 - RNA, 19 nt, Homo sapiens
gaaaguugagaauaaaugc

SEQ ID NO: 512225 - RNA, 19 nt, Homo sapiens
gcuggcuucucgaaaguug

SEQ ID NO: 512226 - RNA, 19 nt, Homo sapiens
agaaaucuuccacagaauu

SEQ ID NO: 512227 - RNA, 19 nt, Homo sapiens
aacaucggguuugagauua

SEQ ID NO: 512228 - RNA, 19 nt, Homo sapiens
aagcuucauucccucuuaa

SEQ ID NO: 512229 - RNA, 19 nt, Homo sapiens
ggaccaaguggccauuuag

SEQ ID NO: 512230 - RNA, 19 nt, Homo sapiens
acuggaagcugaucugaag

SEQ ID NO: 512231 - RNA, 19 nt, Homo sapiens
gggcaugggacuuguggaa

SEQ ID NO: 512232 - RNA, 19 nt, Homo sapiens
gauucuggcccgaaacuau

SEQ ID NO: 512233 - RNA, 19 nt, Homo sapiens
ggucugaggaugaucuuuc

SEQ ID NO: 512234 - RNA, 19 nt, Homo sapiens
gaugguaucguagaauuca

SEQ ID NO: 512235 - RNA, 19 nt, Homo sapiens
gacugacugugauagagaa

SEQ ID NO: 512236 - RNA, 19 nt, Homo sapiens
gucgggccuucuuguguua

SEQ ID NO: 512237 - RNA, 19 nt, Homo sapiens
gcaaagaaaccccggaaau

SEQ ID NO: 512238 - RNA, 19 nt, Homo sapiens
gccagaauguuaccauggu

SEQ ID NO: 512239 - RNA, 19 nt, Homo sapiens
caacccucuuguccucuuu

SEQ ID NO: 512240 - RNA, 19 nt, Homo sapiens
gagagaaggacuuucaaaa

SEQ ID NO: 512241 - RNA, 19 nt, Homo sapiens
gaaauguucuugcaguuaa

SEQ ID NO: 512242 - RNA, 19 nt, Homo sapiens
ggacauaccagcuuagauu

SEQ ID NO: 512243 - RNA, 19 nt, Homo sapiens
gaaauuugcguguggagua

SEQ ID NO: 512244 - RNA, 19 nt, Homo sapiens
gcaguuaaggguuaguuua

SEQ ID NO: 512245 - RNA, 19 nt, Homo sapiens
gcucaagacuggcgcuaaa

SEQ ID NO: 512246 - RNA, 19 nt, Homo sapiens
gagaauauuucacccuuca

SEQ ID NO: 512247 - RNA, 19 nt, Homo sapiens
gagguuggcucugacugua

SEQ ID NO: 512248 - RNA, 19 nt, Homo sapiens
gaagcugucccucauguug

SEQ ID NO: 512249 - RNA, 19 nt, Homo sapiens
gggcuccacugaacaaguu

SEQ ID NO: 512250 - RNA, 19 nt, Homo sapiens
gaggguuaaugaaauaaug

SEQ ID NO: 512251 - RNA, 19 nt, Homo sapiens
ggacuuccauuugcuuugu

SEQ ID NO: 512252 - RNA, 19 nt, Homo sapiens
cgucugggcuucuugcauu

SEQ ID NO: 512253 - RNA, 19 nt, Homo sapiens
agaugaagcucccagaaug

SEQ ID NO: 512254 - RNA, 19 nt, Homo sapiens
gcacagaggaagagaaucu

SEQ ID NO: 512255 - RNA, 19 nt, Homo sapiens
ugugaggguuaaugaaaua

SEQ ID NO: 512256 - RNA, 19 nt, Homo sapiens
gcacccaggacuuccauuu

SEQ ID NO: 512257 - RNA, 19 nt, Homo sapiens
gaagaaaccacuggaugga

SEQ ID NO: 512258 - RNA, 19 nt, Homo sapiens
cccaagcaauggaugauuu

SEQ ID NO: 512259 - RNA, 19 nt, Homo sapiens
gugcugggauuacaauugu

SEQ ID NO: 512260 - RNA, 19 nt, Homo sapiens
gaaaccaccuuuuauuaca

SEQ ID NO: 512261 - RNA, 19 nt, Homo sapiens
guaccaccauccacuacaa

SEQ ID NO: 512262 - RNA, 19 nt, Homo sapiens
guuaaggguuaguuuacaa

SEQ ID NO: 512263 - RNA, 19 nt, Homo sapiens
ggagauguaagaaauguuc

SEQ ID NO: 512264 - RNA, 19 nt, Homo sapiens
agacugacauucuccacuu

SEQ ID NO: 512265 - RNA, 19 nt, Homo sapiens
gcucagggucaauuucuuu

SEQ ID NO: 512266 - RNA, 19 nt, Homo sapiens
gaggauuucaucucuugua

SEQ ID NO: 512267 - RNA, 19 nt, Homo sapiens
gcccauaucugugaaaugc

SEQ ID NO: 512268 - RNA, 19 nt, Homo sapiens
ggaguggaguggcgugauc

SEQ ID NO: 512269 - RNA, 19 nt, Homo sapiens
gaauauuucacccuucaga

SEQ ID NO: 512270 - RNA, 19 nt, Homo sapiens
aguaggacauaccagcuua

SEQ ID NO: 512271 - RNA, 19 nt, Homo sapiens
ggauuucaucucuuguaua

SEQ ID NO: 512272 - RNA, 19 nt, Homo sapiens
cauaccagcuuagauuuua

SEQ ID NO: 512273 - RNA, 19 nt, Homo sapiens
cagucuaccucccgccaua

SEQ ID NO: 512274 - RNA, 19 nt, Homo sapiens
gacauaccagcuuagauuu

SEQ ID NO: 512275 - RNA, 19 nt, Homo sapiens
gcaagcacaucugcauuuu

SEQ ID NO: 512276 - RNA, 19 nt, Homo sapiens
uggaggauuucaucucuug

SEQ ID NO: 512277 - RNA, 19 nt, Homo sapiens
gcaauaggugugcgucaga

SEQ ID NO: 512278 - RNA, 19 nt, Homo sapiens
ggaagacuccagugguaau

SEQ ID NO: 512279 - RNA, 19 nt, Homo sapiens
caauaggugugcgucagaa

SEQ ID NO: 512280 - RNA, 19 nt, Homo sapiens
gacugggucucgcuuuguu

SEQ ID NO: 512281 - RNA, 19 nt, Homo sapiens
uugggcagcugguuaggua

SEQ ID NO: 512282 - RNA, 19 nt, Homo sapiens
ucaaggcccauaucuguga

SEQ ID NO: 512283 - RNA, 19 nt, Homo sapiens
guauuuggaugacagaaac

SEQ ID NO: 512284 - RNA, 19 nt, Homo sapiens
agacuccagugguaaucua

SEQ ID NO: 512285 - RNA, 19 nt, Homo sapiens
gugcagcuguggguugauu

SEQ ID NO: 512286 - RNA, 19 nt, Homo sapiens
agcaauggaugauuugaug

SEQ ID NO: 512287 - RNA, 19 nt, Homo sapiens
ccagccaccugaaguccaa

SEQ ID NO: 512288 - RNA, 19 nt, Homo sapiens
gcuuugaggugcguguuug

SEQ ID NO: 512289 - RNA, 19 nt, Homo sapiens
ccacuacaacuacaugugu

SEQ ID NO: 512290 - RNA, 19 nt, Homo sapiens
guggcgugaucuuggcuua

SEQ ID NO: 512291 - RNA, 19 nt, Homo sapiens
cccacacccuggaggauuu

SEQ ID NO: 512292 - RNA, 19 nt, Homo sapiens
uuugggagauguaagaaau

SEQ ID NO: 512293 - RNA, 19 nt, Homo sapiens
gugacacgcuucccuggau

SEQ ID NO: 512294 - RNA, 19 nt, Homo sapiens
gacagaagggccugacuca

SEQ ID NO: 512295 - RNA, 19 nt, Homo sapiens
gcgcacagaggaagagaau

SEQ ID NO: 512296 - RNA, 19 nt, Homo sapiens
cgugagcgcuucgagaugu

SEQ ID NO: 512297 - RNA, 19 nt, Homo sapiens
gagccgcagucagauccua

SEQ ID NO: 512298 - RNA, 19 nt, Homo sapiens
ugacacgcuucccuggauu

SEQ ID NO: 512299 - RNA, 19 nt, Homo sapiens
gaaacuacuuccugaaaac

SEQ ID NO: 512300 - RNA, 19 nt, Homo sapiens
acaaucagccacauucuag

SEQ ID NO: 512301 - RNA, 19 nt, Homo sapiens
gcacugguguuuuguugug

SEQ ID NO: 512302 - RNA, 19 nt, Homo sapiens
gaaaccacuggauggagaa

SEQ ID NO: 512303 - RNA, 19 nt, Homo sapiens
uggaggagccgcagucaga

SEQ ID NO: 512304 - RNA, 19 nt, Homo sapiens
agagggaguugucaagucu

SEQ ID NO: 512305 - RNA, 19 nt, Homo sapiens
cuucaaggcccauaucugu

SEQ ID NO: 512306 - RNA, 19 nt, Homo sapiens
cagaugaagcucccagaau

SEQ ID NO: 512307 - RNA, 19 nt, Homo sapiens
uagagggaguugucaaguc

SEQ ID NO: 512308 - RNA, 19 nt, Homo sapiens
ucagaccuauggaaacuac

SEQ ID NO: 512309 - RNA, 19 nt, Homo sapiens
cgccugagguuggcucuga

SEQ ID NO: 512310 - RNA, 19 nt, Homo sapiens
gaaugaggccuuggaacuc

SEQ ID NO: 512311 - RNA, 19 nt, Homo sapiens
gucaacaucuuuuacauuc

SEQ ID NO: 512312 - RNA, 19 nt, Homo sapiens
gaagggucaacaucuuuua

SEQ ID NO: 512313 - RNA, 19 nt, Homo sapiens
acaguugggcagcugguua

SEQ ID NO: 512314 - RNA, 19 nt, Homo sapiens
caaggcccauaucugugaa

SEQ ID NO: 512315 - RNA, 19 nt, Homo sapiens
ugaaugaggccuuggaacu

SEQ ID NO: 512316 - RNA, 19 nt, Homo sapiens
gcugggauuacaauuguga

SEQ ID NO: 512317 - RNA, 19 nt, Homo sapiens
ccaagcaauggaugauuug

SEQ ID NO: 512318 - RNA, 19 nt, Homo sapiens
gugugguggugcccuauga

SEQ ID NO: 512319 - RNA, 19 nt, Homo sapiens
caacaucuuuuacauucug

SEQ ID NO: 512320 - RNA, 19 nt, Homo sapiens
cuggaagggucaacaucuu

SEQ ID NO: 512321 - RNA, 19 nt, Homo sapiens
aaauuugcguguggaguau

SEQ ID NO: 512322 - RNA, 19 nt, Homo sapiens
ccagaugaagcucccagaa

SEQ ID NO: 512323 - RNA, 19 nt, Homo sapiens
uguauaugaugaucuggau

SEQ ID NO: 512324 - RNA, 19 nt, Homo sapiens
ccuggaggauuucaucucu

SEQ ID NO: 512325 - RNA, 19 nt, Homo sapiens
uacaaucagccacauucua

SEQ ID NO: 512326 - RNA, 19 nt, Homo sapiens
aaggguuaguuuacaauca

SEQ ID NO: 512327 - RNA, 19 nt, Homo sapiens
ugagggauguuugggagau

SEQ ID NO: 512328 - RNA, 19 nt, Homo sapiens
gaguaggacauaccagcuu

SEQ ID NO: 512329 - RNA, 19 nt, Homo sapiens
ugacauucuccacuucuug

SEQ ID NO: 512330 - RNA, 19 nt, Homo sapiens
ccaccauccacuacaacua

SEQ ID NO: 512331 - RNA, 19 nt, Homo sapiens
ccauggccaucuacaagca

SEQ ID NO: 512332 - RNA, 19 nt, Homo sapiens
aagcacaucugcauuuuca

SEQ ID NO: 512333 - RNA, 19 nt, Homo sapiens
uggaagggucaacaucuuu

SEQ ID NO: 512334 - RNA, 19 nt, Homo sapiens
ggaagcugucccucauguu

SEQ ID NO: 512335 - RNA, 19 nt, Homo sapiens
cauggcgacuguccagcuu

SEQ ID NO: 512336 - RNA, 19 nt, Homo sapiens
ugggagauguaagaaaugu

SEQ ID NO: 512337 - RNA, 19 nt, Homo sapiens
gacauucuccacuucuugu

SEQ ID NO: 512338 - RNA, 19 nt, Homo sapiens
accacuggauggagaauau

SEQ ID NO: 512339 - RNA, 19 nt, Homo sapiens
aggauuucaucucuuguau

SEQ ID NO: 512340 - RNA, 19 nt, Homo sapiens
gagugcauugugaggguua

SEQ ID NO: 512341 - RNA, 19 nt, Homo sapiens
gaacagaaguagaaagaaa

SEQ ID NO: 512342 - RNA, 19 nt, Homo sapiens
gaagaaagauggagauaug

SEQ ID NO: 512343 - RNA, 19 nt, Homo sapiens
gcaaagacauucuguuaug

SEQ ID NO: 512344 - RNA, 19 nt, Homo sapiens
ggacagaacccgcagauuu

SEQ ID NO: 512345 - RNA, 19 nt, Homo sapiens
agacguggaugauaaauua

SEQ ID NO: 512346 - RNA, 19 nt, Homo sapiens
gagagcagaugauccuuua

SEQ ID NO: 512347 - RNA, 19 nt, Homo sapiens
ggacaagucucucagcuau

SEQ ID NO: 512348 - RNA, 19 nt, Homo sapiens
gagaggaacucaaagaaga

SEQ ID NO: 512349 - RNA, 19 nt, Homo sapiens
ggaggaagcuauggaaauu

SEQ ID NO: 512350 - RNA, 19 nt, Homo sapiens
gcauggaucuuguauauag

SEQ ID NO: 512351 - RNA, 19 nt, Homo sapiens
gagaagaguuggaacagaa

SEQ ID NO: 512352 - RNA, 19 nt, Homo sapiens
gauaucagcuuagacaauu

SEQ ID NO: 512353 - RNA, 19 nt, Homo sapiens
acaaacagcuggagaagaa

SEQ ID NO: 512354 - RNA, 19 nt, Homo sapiens
guacgaaugugauguguug

SEQ ID NO: 512355 - RNA, 19 nt, Homo sapiens
gggcaaagacauucuguua

SEQ ID NO: 512356 - RNA, 19 nt, Homo sapiens
gaaggacggaguacuaaua

SEQ ID NO: 512357 - RNA, 19 nt, Homo sapiens
uaaagaaggugauaucauc

SEQ ID NO: 512358 - RNA, 19 nt, Homo sapiens
gaagucaguuggauucaga

SEQ ID NO: 512359 - RNA, 19 nt, Homo sapiens
gcuauauccuugaagauuu

SEQ ID NO: 512360 - RNA, 19 nt, Homo sapiens
ggucagaggucccuuguuc

SEQ ID NO: 512361 - RNA, 19 nt, Homo sapiens
ccaaccagcuccagaacua

SEQ ID NO: 512362 - RNA, 19 nt, Homo sapiens
gaagauguuuguauugauc

SEQ ID NO: 512363 - RNA, 19 nt, Homo sapiens
ugacagaugugcuagaaga

SEQ ID NO: 512364 - RNA, 19 nt, Homo sapiens
ggagacccaugaucccaua

SEQ ID NO: 512365 - RNA, 19 nt, Homo sapiens
gaaaguggacugcagauuc

SEQ ID NO: 512366 - RNA, 19 nt, Homo sapiens
cauaugaaguggacaaaga

SEQ ID NO: 512367 - RNA, 19 nt, Homo sapiens
ggucugagguggaagaaau

SEQ ID NO: 512368 - RNA, 19 nt, Homo sapiens
aaaugugucuuguguguaa

SEQ ID NO: 512369 - RNA, 19 nt, Homo sapiens
gaguugauguuucuuguga

SEQ ID NO: 512370 - RNA, 19 nt, Homo sapiens
ggacuccaguguugucauu

SEQ ID NO: 512371 - RNA, 19 nt, Homo sapiens
gaagguggguguucuuugg

SEQ ID NO: 512372 - RNA, 19 nt, Homo sapiens
gcacaagaacuuauggaaa

SEQ ID NO: 512373 - RNA, 19 nt, Homo sapiens
ccagugaugucaugucuga

SEQ ID NO: 512374 - RNA, 19 nt, Homo sapiens
cagaagauguuuguauuga

SEQ ID NO: 512375 - RNA, 19 nt, Homo sapiens
ccacaagccucaacaccaa

SEQ ID NO: 512376 - RNA, 19 nt, Homo sapiens
gaugauccuuuaagacuug

SEQ ID NO: 512377 - RNA, 19 nt, Homo sapiens
ugaaggagaucugaaauca

SEQ ID NO: 512378 - RNA, 19 nt, Homo sapiens
gaaaccagugugauuagua

SEQ ID NO: 512379 - RNA, 19 nt, Homo sapiens
caagaagggagacaagaua

SEQ ID NO: 512380 - RNA, 19 nt, Homo sapiens
ucagaggacuccaguguug

SEQ ID NO: 512381 - RNA, 19 nt, Homo sapiens
gaacagaaggagaaagaga

SEQ ID NO: 512382 - RNA, 19 nt, Homo sapiens
caaagaaagugguauaagc

SEQ ID NO: 512383 - RNA, 19 nt, Homo sapiens
uagaggacauuucaccuaa

SEQ ID NO: 512384 - RNA, 19 nt, Homo sapiens
gagaagaagaguuugauau

SEQ ID NO: 512385 - RNA, 19 nt, Homo sapiens
gauaucaucccaccauuga

SEQ ID NO: 512386 - RNA, 19 nt, Homo sapiens
ucacagaauugaugaagau

SEQ ID NO: 512387 - RNA, 19 nt, Homo sapiens
gauacagagucgcuccaua

SEQ ID NO: 512388 - RNA, 19 nt, Homo sapiens
gaacuaccguaauuaucug

SEQ ID NO: 512389 - RNA, 19 nt, Homo sapiens
gaagaagaguuugauaugc

SEQ ID NO: 512390 - RNA, 19 nt, Homo sapiens
gcaguuccgucaccagcua

SEQ ID NO: 512391 - RNA, 19 nt, Homo sapiens
gcaaguugaugcuuucuac

SEQ ID NO: 512392 - RNA, 19 nt, Homo sapiens
gaucuugggcuaucuuuga

SEQ ID NO: 512393 - RNA, 19 nt, Homo sapiens
cacaagaacuuauggaaag

SEQ ID NO: 512394 - RNA, 19 nt, Homo sapiens
ggcagcagauaucagcuua

SEQ ID NO: 512395 - RNA, 19 nt, Homo sapiens
gaagcaguaacaccucuua

SEQ ID NO: 512396 - RNA, 19 nt, Homo sapiens
gagcugggaaguauaaauu

SEQ ID NO: 512397 - RNA, 19 nt, Homo sapiens
ggacauuucaccuaacuug

SEQ ID NO: 512398 - RNA, 19 nt, Homo sapiens
caaaugaugggaagaaaga

SEQ ID NO: 512399 - RNA, 19 nt, Homo sapiens
gaacgaggagacgguaaua

SEQ ID NO: 512400 - RNA, 19 nt, Homo sapiens
gcagauaucagcuuagaca

SEQ ID NO: 512401 - RNA, 19 nt, Homo sapiens
gagaggcaauggugacaga

SEQ ID NO: 512402 - RNA, 19 nt, Homo sapiens
ugagacaccuugugaaagu

SEQ ID NO: 512403 - RNA, 19 nt, Homo sapiens
gauacuccuugccugauaa

SEQ ID NO: 512404 - RNA, 19 nt, Homo sapiens
ggaaggcugcgcaguauug

SEQ ID NO: 512405 - RNA, 19 nt, Homo sapiens
guggagaagugcucagauu

SEQ ID NO: 512406 - RNA, 19 nt, Homo sapiens
acaggaagcuugggaagaa

SEQ ID NO: 512407 - RNA, 19 nt, Homo sapiens
cagaagcuauggaaguuga

SEQ ID NO: 512408 - RNA, 19 nt, Homo sapiens
gagccaggauguugaggaa

SEQ ID NO: 512409 - RNA, 19 nt, Homo sapiens
ggagaagaguuggaacaga

SEQ ID NO: 512410 - RNA, 19 nt, Homo sapiens
ucaaugaagcccaguguaa

SEQ ID NO: 512411 - RNA, 19 nt, Homo sapiens
ggagaagaagaguuugaua

SEQ ID NO: 512412 - RNA, 19 nt, Homo sapiens
aguaaggccuugauugaaa

SEQ ID NO: 512413 - RNA, 19 nt, Homo sapiens
ugugaaaguucuagugaaa

SEQ ID NO: 512414 - RNA, 19 nt, Homo sapiens
gagauugaaccaaagaauu

SEQ ID NO: 512415 - RNA, 19 nt, Homo sapiens
caacgaagauauccccaua

SEQ ID NO: 512416 - RNA, 19 nt, Homo sapiens
gagcagcuacaaucaguaa

SEQ ID NO: 512417 - RNA, 19 nt, Homo sapiens
ggacaaagagcagcuacaa

SEQ ID NO: 512418 - RNA, 19 nt, Homo sapiens
caaagaaaauccuguguug

SEQ ID NO: 512419 - RNA, 19 nt, Homo sapiens
cguagugacucuccagaaa

SEQ ID NO: 512420 - RNA, 19 nt, Homo sapiens
ggauggaacagaaguagaa

SEQ ID NO: 512421 - RNA, 19 nt, Homo sapiens
ggucagaggacaugccuuu

SEQ ID NO: 512422 - RNA, 19 nt, Homo sapiens
guaaggauguacauguugu

SEQ ID NO: 512423 - RNA, 19 nt, Homo sapiens
uugcauggaucuuguauau

SEQ ID NO: 512424 - RNA, 19 nt, Homo sapiens
aaagcaagaugccacaguu

SEQ ID NO: 512425 - RNA, 19 nt, Homo sapiens
gaaaggcccagccaaaaua

SEQ ID NO: 512426 - RNA, 19 nt, Homo sapiens
ggugacagaugugcuagaa

SEQ ID NO: 512427 - RNA, 19 nt, Homo sapiens
ucaguuggauucagauuuc

SEQ ID NO: 512428 - RNA, 19 nt, Homo sapiens
aaagaaugcucagaagcua

SEQ ID NO: 512429 - RNA, 19 nt, Homo sapiens
aggaagcuauggaaauuaa

SEQ ID NO: 512430 - RNA, 19 nt, Homo sapiens
aaaguggacugcagauuca

SEQ ID NO: 512431 - RNA, 19 nt, Homo sapiens
aaagaaggacggaguacua

SEQ ID NO: 512432 - RNA, 19 nt, Homo sapiens
gaaguugaaaccaguguga

SEQ ID NO: 512433 - RNA, 19 nt, Homo sapiens
caaggguugugucuucaaa

SEQ ID NO: 512434 - RNA, 19 nt, Homo sapiens
gcagaagauguuuguauug

SEQ ID NO: 512435 - RNA, 19 nt, Homo sapiens
gaugguugcucuacuccuu

SEQ ID NO: 512436 - RNA, 19 nt, Homo sapiens
gaacaguccaacgaagaua

SEQ ID NO: 512437 - RNA, 19 nt, Homo sapiens
gaaagagaaggaagaagau

SEQ ID NO: 512438 - RNA, 19 nt, Homo sapiens
cagcagauaucagcuuaga

SEQ ID NO: 512439 - RNA, 19 nt, Homo sapiens
gcaaggaaacagacugaga

SEQ ID NO: 512440 - RNA, 19 nt, Homo sapiens
aaaccagugugauuaguau

SEQ ID NO: 512441 - RNA, 19 nt, Homo sapiens
gaucauagcugacuuuaaa

SEQ ID NO: 512442 - RNA, 19 nt, Homo sapiens
gaaacuugcuacagacuua

SEQ ID NO: 512443 - RNA, 19 nt, Homo sapiens
gcccaaaucuccagaauaa

SEQ ID NO: 512444 - RNA, 19 nt, Homo sapiens
gaacagcgcuuaaaguuuu

SEQ ID NO: 512445 - RNA, 19 nt, Homo sapiens
ggacuguacccaagaauua

SEQ ID NO: 512446 - RNA, 19 nt, Homo sapiens
caagaauccugucuaguaa

SEQ ID NO: 512447 - RNA, 19 nt, Homo sapiens
gaaggcagcucuacagcaa

SEQ ID NO: 512448 - RNA, 19 nt, Homo sapiens
gcagcaaguucaauauauu

SEQ ID NO: 512449 - RNA, 19 nt, Homo sapiens
gaaggagacugcaugacaa

SEQ ID NO: 512450 - RNA, 19 nt, Homo sapiens
acacagaaaucguuaaguu

SEQ ID NO: 512451 - RNA, 19 nt, Homo sapiens
ugaaagcgaugaagaaugu

SEQ ID NO: 512452 - RNA, 19 nt, Homo sapiens
ggaaugcucuggaucaagu

SEQ ID NO: 512453 - RNA, 19 nt, Homo sapiens
ggagaacgguguuaauagu

SEQ ID NO: 512454 - RNA, 19 nt, Homo sapiens
caaaggagcuuggccugaa

SEQ ID NO: 512455 - RNA, 19 nt, Homo sapiens
caacuaaauuacugccuuu

SEQ ID NO: 512456 - RNA, 19 nt, Homo sapiens
gcaaaggugucccguguag

SEQ ID NO: 512457 - RNA, 19 nt, Homo sapiens
agacgaagaugaaaucgaa

SEQ ID NO: 512458 - RNA, 19 nt, Homo sapiens
gagaagaugggcauaauga

SEQ ID NO: 512459 - RNA, 19 nt, Homo sapiens
acaagaauccugucuagua

SEQ ID NO: 512460 - RNA, 19 nt, Homo sapiens
gcagauaagugcgaggaaa

SEQ ID NO: 512461 - RNA, 19 nt, Homo sapiens
ccaaggcucugcuucugua

SEQ ID NO: 512462 - RNA, 19 nt, Homo sapiens
gggagaauuugaccuugua

SEQ ID NO: 512463 - RNA, 19 nt, Homo sapiens
ggaggaaauugaacagaug

SEQ ID NO: 512464 - RNA, 19 nt, Homo sapiens
gagauagaguuucaucaug

SEQ ID NO: 512465 - RNA, 19 nt, Homo sapiens
gaccaucucugucccauca

SEQ ID NO: 512466 - RNA, 19 nt, Homo sapiens
cuagaagccuuacgaaaga

SEQ ID NO: 512467 - RNA, 19 nt, Homo sapiens
cagagggaguguuugaaua

SEQ ID NO: 512468 - RNA, 19 nt, Homo sapiens
gaaaggagaacgguguuaa

SEQ ID NO: 512469 - RNA, 19 nt, Homo sapiens
gcaccaaggccucuaaaga

SEQ ID NO: 512470 - RNA, 19 nt, Homo sapiens
gcacugcacaccuuguaua

SEQ ID NO: 512471 - RNA, 19 nt, Homo sapiens
gaacagaagagacuaagca

SEQ ID NO: 512472 - RNA, 19 nt, Homo sapiens
gcagagacgugguggaucu

SEQ ID NO: 512473 - RNA, 19 nt, Homo sapiens
aaacuaagcuacaguacca

SEQ ID NO: 512474 - RNA, 19 nt, Homo sapiens
cugcacaccuuguauauug

SEQ ID NO: 512475 - RNA, 19 nt, Homo sapiens
gaugaagaaugucucuaga

SEQ ID NO: 512476 - RNA, 19 nt, Homo sapiens
gaagaugggcauaaugaau

SEQ ID NO: 512477 - RNA, 19 nt, Homo sapiens
gaaagugcguccguucuca

SEQ ID NO: 512478 - RNA, 19 nt, Homo sapiens
ucacaucgcugucucugau

SEQ ID NO: 512479 - RNA, 19 nt, Homo sapiens
caucacggcucuucacaau

SEQ ID NO: 512480 - RNA, 19 nt, Homo sapiens
gcguaucgcucauggaaug

SEQ ID NO: 512481 - RNA, 19 nt, Homo sapiens
gagcgaauguuugauguuc

SEQ ID NO: 512482 - RNA, 19 nt, Homo sapiens
gauagaguuucaucauguu

SEQ ID NO: 512483 - RNA, 19 nt, Homo sapiens
gagcuuggccugaaacuuc

SEQ ID NO: 512484 - RNA, 19 nt, Homo sapiens
ccacucagcccaacuaaau

SEQ ID NO: 512485 - RNA, 19 nt, Homo sapiens
cagagaacauuuauuccaa

SEQ ID NO: 512486 - RNA, 19 nt, Homo sapiens
cgagagugauugccauuug

SEQ ID NO: 512487 - RNA, 19 nt, Homo sapiens
gaggaaggcuacacucagu

SEQ ID NO: 512488 - RNA, 19 nt, Homo sapiens
gaccuuguacagagaauua

SEQ ID NO: 512489 - RNA, 19 nt, Homo sapiens
gagugaugcugaccuagaa

SEQ ID NO: 512490 - RNA, 19 nt, Homo sapiens
ggcagcaaguucaauauau

SEQ ID NO: 512491 - RNA, 19 nt, Homo sapiens
ggaacagcgcuuaaaguuu

SEQ ID NO: 512492 - RNA, 19 nt, Homo sapiens
gaaacguaguucuauuaca

SEQ ID NO: 512493 - RNA, 19 nt, Homo sapiens
cagaagagacuaagcaaug

SEQ ID NO: 512494 - RNA, 19 nt, Homo sapiens
agaagagaaugaaggauug

SEQ ID NO: 512495 - RNA, 19 nt, Homo sapiens
uuuaugcgcuuugggauua

SEQ ID NO: 512496 - RNA, 19 nt, Homo sapiens
ucagaaagcccaguagaaa

SEQ ID NO: 512497 - RNA, 19 nt, Homo sapiens
ggaaacuuguggaggaaau

SEQ ID NO: 512498 - RNA, 19 nt, Homo sapiens
gauaaugagcgaauguuug

SEQ ID NO: 512499 - RNA, 19 nt, Homo sapiens
gaacguuaguugguuguca

SEQ ID NO: 512500 - RNA, 19 nt, Homo sapiens
gaagaaugucucuagaaga

SEQ ID NO: 512501 - RNA, 19 nt, Homo sapiens
ugaagaaugucucuagaag

SEQ ID NO: 512502 - RNA, 19 nt, Homo sapiens
ggaagaaccagagcaguga

SEQ ID NO: 512503 - RNA, 19 nt, Homo sapiens
gaaguggcagucauggaua

SEQ ID NO: 512504 - RNA, 19 nt, Homo sapiens
ccaaagugcuggauuacag

SEQ ID NO: 512505 - RNA, 19 nt, Homo sapiens
ggaagacgaagaugaaauc

SEQ ID NO: 512506 - RNA, 19 nt, Homo sapiens
ccagagugaugcugaccua

SEQ ID NO: 512507 - RNA, 19 nt, Homo sapiens
uggauaagcguguuaauga

SEQ ID NO: 512508 - RNA, 19 nt, Homo sapiens
cuacaagaauccugucuag

SEQ ID NO: 512509 - RNA, 19 nt, Homo sapiens
gcacucagauaaguauaca

SEQ ID NO: 512510 - RNA, 19 nt, Homo sapiens
gaauccauauuuacaugug

SEQ ID NO: 512511 - RNA, 19 nt, Homo sapiens
cagaauccauauuuacaug

SEQ ID NO: 512512 - RNA, 19 nt, Homo sapiens
aaacguaguucuauuacag

SEQ ID NO: 512513 - RNA, 19 nt, Homo sapiens
cuaaauuacugccuuucuu

SEQ ID NO: 512514 - RNA, 19 nt, Homo sapiens
ucacagaaguuccaguuac

SEQ ID NO: 512515 - RNA, 19 nt, Homo sapiens
gaaacuuccacacagaauu

SEQ ID NO: 512516 - RNA, 19 nt, Homo sapiens
uaaaugcugcugauaguga

SEQ ID NO: 512517 - RNA, 19 nt, Homo sapiens
ccaaauauucagaagcuuu

SEQ ID NO: 512518 - RNA, 19 nt, Homo sapiens
caccaaggccucuaaagaa

SEQ ID NO: 512519 - RNA, 19 nt, Homo sapiens
ccaagaugaugccgauguu

SEQ ID NO: 512520 - RNA, 19 nt, Homo sapiens
cgaucagccucuaguguuu

SEQ ID NO: 512521 - RNA, 19 nt, Homo sapiens
ugaagaacguuaguugguu

SEQ ID NO: 512522 - RNA, 19 nt, Homo sapiens
aagaugggcauaaugaaua

SEQ ID NO: 512523 - RNA, 19 nt, Homo sapiens
acaguuugguguaaaugua

SEQ ID NO: 512524 - RNA, 19 nt, Homo sapiens
uaucuaauccuuaccgaaa

SEQ ID NO: 512525 - RNA, 19 nt, Homo sapiens
gaagaaggcagcucuacag

SEQ ID NO: 512526 - RNA, 19 nt, Homo sapiens
guuaguugguugucaguga

SEQ ID NO: 512527 - RNA, 19 nt, Homo sapiens
aaacuuccacacagaauuu

SEQ ID NO: 512528 - RNA, 19 nt, Homo sapiens
gucaggagccgcuguguuu

SEQ ID NO: 512529 - RNA, 19 nt, Homo sapiens
cuccaggccuugauuauga

SEQ ID NO: 512530 - RNA, 19 nt, Homo sapiens
gcgaauguuugauguucuu

SEQ ID NO: 512531 - RNA, 19 nt, Homo sapiens
ggauaaugagcgaauguuu

SEQ ID NO: 512532 - RNA, 19 nt, Homo sapiens
cguaauauuugucaagauc

SEQ ID NO: 512533 - RNA, 19 nt, Homo sapiens
gaucauuuauugggcaguu

SEQ ID NO: 512534 - RNA, 19 nt, Homo sapiens
gagaaugaaggauugaaga

SEQ ID NO: 512535 - RNA, 19 nt, Homo sapiens
uaaugacaauguagcuuga

SEQ ID NO: 512536 - RNA, 19 nt, Homo sapiens
agauagaguuucaucaugu

SEQ ID NO: 512537 - RNA, 19 nt, Homo sapiens
augcucagguugcaaauaa

SEQ ID NO: 512538 - RNA, 19 nt, Homo sapiens
gaagaagaaggcagcucua

SEQ ID NO: 512539 - RNA, 19 nt, Homo sapiens
guaacuugcugggacugua

SEQ ID NO: 512540 - RNA, 19 nt, Homo sapiens
ucagccaccuucagacauu

SEQ ID NO: 512541 - RNA, 19 nt, Homo sapiens
gcaauaaucucucgcagua

SEQ ID NO: 512542 - RNA, 19 nt, Homo sapiens
caaacugcaucgaguauuu

SEQ ID NO: 512543 - RNA, 19 nt, Homo sapiens
gcaagcagcccaucaagga

SEQ ID NO: 512544 - RNA, 19 nt, Homo sapiens
ggacggaauucaccaccau

SEQ ID NO: 512545 - RNA, 19 nt, Homo sapiens
aauaaucucucgcaguaug

SEQ ID NO: 512546 - RNA, 19 nt, Homo sapiens
ugcagaaccugaccauuga

SEQ ID NO: 512547 - RNA, 19 nt, Homo sapiens
gccuggagcugauggaguu

SEQ ID NO: 512548 - RNA, 19 nt, Homo sapiens
gagacgaggacacguacua

SEQ ID NO: 512549 - RNA, 19 nt, Homo sapiens
ggccaugccuguuuacaag

SEQ ID NO: 512550 - RNA, 19 nt, Homo sapiens
gcauuuaccaccugcagaa

SEQ ID NO: 512551 - RNA, 19 nt, Homo sapiens
ccaccauccuguacaacuu

SEQ ID NO: 512552 - RNA, 19 nt, Homo sapiens
gaaacucuacugccagauc

SEQ ID NO: 512553 - RNA, 19 nt, Homo sapiens
gaacuuugagauccugaug

SEQ ID NO: 512554 - RNA, 19 nt, Homo sapiens
cugcagaaccugaccauug

SEQ ID NO: 512555 - RNA, 19 nt, Homo sapiens
ucaccaccauccuguacaa

SEQ ID NO: 512556 - RNA, 19 nt, Homo sapiens
cagcaagcgugccuucaag

SEQ ID NO: 512557 - RNA, 19 nt, Homo sapiens
ccaugccuguuuacaagaa

SEQ ID NO: 512558 - RNA, 19 nt, Homo sapiens
gcagcaccauggaccagau

SEQ ID NO: 512559 - RNA, 19 nt, Homo sapiens
aacgagagcuccgccaaga

SEQ ID NO: 512560 - RNA, 19 nt, Homo sapiens
gaagcagggccacgacuac

SEQ ID NO: 512561 - RNA, 19 nt, Homo sapiens
acuuugagauccugaugaa

SEQ ID NO: 512562 - RNA, 19 nt, Homo sapiens
caaggguuacagagcauuu

SEQ ID NO: 512563 - RNA, 19 nt, Homo sapiens
caucugucauggcccaguu

SEQ ID NO: 512564 - RNA, 19 nt, Homo sapiens
gcacaguucggcagcuaca

SEQ ID NO: 512565 - RNA, 19 nt, Homo sapiens
cagcagcagcuccuacaga

SEQ ID NO: 512566 - RNA, 19 nt, Homo sapiens
ugaagcagggccacgacua

SEQ ID NO: 512567 - RNA, 19 nt, Homo sapiens
gggccaugccuguuuacaa

SEQ ID NO: 512568 - RNA, 19 nt, Homo sapiens
uuucaccucccaaggguua

SEQ ID NO: 512569 - RNA, 19 nt, Homo sapiens
gcaagcgugccuucaagca

SEQ ID NO: 512570 - RNA, 19 nt, Homo sapiens
ccagcaagcgugccuucaa

SEQ ID NO: 512571 - RNA, 19 nt, Homo sapiens
ccgcacaguucggcagcua

SEQ ID NO: 512572 - RNA, 19 nt, Homo sapiens
gcgucguggugcccuauga

SEQ ID NO: 512573 - RNA, 19 nt, Homo sapiens
guccaaacugcaucgagua

SEQ ID NO: 512574 - RNA, 19 nt, Homo sapiens
ggaggccgagauccacuga

SEQ ID NO: 512575 - RNA, 19 nt, Homo sapiens
aagagagccuggagcugau

SEQ ID NO: 512576 - RNA, 19 nt, Homo sapiens
ugaccgacgucgugaaacg

SEQ ID NO: 512577 - RNA, 19 nt, Homo sapiens
ggacacguacuaccuucag

SEQ ID NO: 512578 - RNA, 19 nt, Homo sapiens
gaaccagacagcaccuacu

SEQ ID NO: 512579 - RNA, 19 nt, Homo sapiens
cgggagggacuucaacgaa

SEQ ID NO: 512580 - RNA, 19 nt, Homo sapiens
ccacucgcccuacgcacaa

SEQ ID NO: 512581 - RNA, 19 nt, Homo sapiens
ugucauggcccaguucaau

SEQ ID NO: 512582 - RNA, 19 nt, Homo sapiens
ccaaacugcaucgaguauu

SEQ ID NO: 512583 - RNA, 19 nt, Homo sapiens
cugaugaagcugaaagaga

SEQ ID NO: 512584 - RNA, 19 nt, Homo sapiens
cgaggacacguacuaccuu

SEQ ID NO: 512585 - RNA, 19 nt, Homo sapiens
cgagagcuccgccaagaac

SEQ ID NO: 512586 - RNA, 19 nt, Homo sapiens
uggagggcaugacuacauc

SEQ ID NO: 512587 - RNA, 19 nt, Homo sapiens
gggagaacuuugagauccu

SEQ ID NO: 512588 - RNA, 19 nt, Homo sapiens
uaacaaaccucaguucuaa

SEQ ID NO: 512589 - RNA, 19 nt, Homo sapiens
gauguagacuuaagcuuua

SEQ ID NO: 512590 - RNA, 19 nt, Homo sapiens
gggauuugcuuccuuguua

SEQ ID NO: 512591 - RNA, 19 nt, Homo sapiens
gcaaaccucuuaugucuuc

SEQ ID NO: 512592 - RNA, 19 nt, Homo sapiens
ggacaacucugcaugagau

SEQ ID NO: 512593 - RNA, 19 nt, Homo sapiens
guaagacgaugaacaguug

SEQ ID NO: 512594 - RNA, 19 nt, Homo sapiens
gaacaguuguguauagugu

SEQ ID NO: 512595 - RNA, 19 nt, Homo sapiens
caccuggacuuaaguaaua

SEQ ID NO: 512596 - RNA, 19 nt, Homo sapiens
ggaaggguaucauuacaga

SEQ ID NO: 512597 - RNA, 19 nt, Homo sapiens
ccaaccgacugaauuguua

SEQ ID NO: 512598 - RNA, 19 nt, Homo sapiens
gaugaacaguuguguauag

SEQ ID NO: 512599 - RNA, 19 nt, Homo sapiens
ugcaugagauguagacuua

SEQ ID NO: 512600 - RNA, 19 nt, Homo sapiens
ccaagagcaugcuuacauu

SEQ ID NO: 512601 - RNA, 19 nt, Homo sapiens
gugcugaccuggacuguga

SEQ ID NO: 512602 - RNA, 19 nt, Homo sapiens
guaccuaaguuguggagaa

SEQ ID NO: 512603 - RNA, 19 nt, Homo sapiens
ggaugucugagaaauauua

SEQ ID NO: 512604 - RNA, 19 nt, Homo sapiens
caacacguauggagggauu

SEQ ID NO: 512605 - RNA, 19 nt, Homo sapiens
gcaacuucauaacuucuuu

SEQ ID NO: 512606 - RNA, 19 nt, Homo sapiens
acagauagcauucaacaaa

SEQ ID NO: 512607 - RNA, 19 nt, Homo sapiens
ggacuuaaguaauaauucg

SEQ ID NO: 512608 - RNA, 19 nt, Homo sapiens
gguguguucuguuaaugua

SEQ ID NO: 512609 - RNA, 19 nt, Homo sapiens
uaacucggaugucugagaa

SEQ ID NO: 512610 - RNA, 19 nt, Homo sapiens
ccacacagauagcauucaa

SEQ ID NO: 512611 - RNA, 19 nt, Homo sapiens
ggaaucggguccucuugga

SEQ ID NO: 512612 - RNA, 19 nt, Homo sapiens
cuucauaacuucuuugaca

SEQ ID NO: 512613 - RNA, 19 nt, Homo sapiens
caacggacuuugacuaaaa

SEQ ID NO: 512614 - RNA, 19 nt, Homo sapiens
gugcgcaaccucuuccuua

SEQ ID NO: 512615 - RNA, 19 nt, Homo sapiens
gauccaaccgacugaauug

SEQ ID NO: 512616 - RNA, 19 nt, Homo sapiens
ccacuuucauccuccacua

SEQ ID NO: 512617 - RNA, 19 nt, Homo sapiens
ccagcaaccacuuccuuua

SEQ ID NO: 512618 - RNA, 19 nt, Homo sapiens
caagagcaugcuuacauuu

SEQ ID NO: 512619 - RNA, 19 nt, Homo sapiens
acaguuguguauaguguuu

SEQ ID NO: 512620 - RNA, 19 nt, Homo sapiens
caacucugcaugagaugua

SEQ ID NO: 512621 - RNA, 19 nt, Homo sapiens
cugcaaaccucuuaugucu

SEQ ID NO: 512622 - RNA, 19 nt, Homo sapiens
caaccugacacaucuagaa

SEQ ID NO: 512623 - RNA, 19 nt, Homo sapiens
ggauuugcuuccuuguuau

SEQ ID NO: 512624 - RNA, 19 nt, Homo sapiens
caaggacaacucugcauga

SEQ ID NO: 512625 - RNA, 19 nt, Homo sapiens
ucggaugucugagaaauau

SEQ ID NO: 512626 - RNA, 19 nt, Homo sapiens
gcucaaggaaacagaggua

SEQ ID NO: 512627 - RNA, 19 nt, Homo sapiens
gcaccuggacuuaaguaau

SEQ ID NO: 512628 - RNA, 19 nt, Homo sapiens
gaggacagaccaaggacaa

SEQ ID NO: 512629 - RNA, 19 nt, Homo sapiens
uuaacaaaccucaguucua

SEQ ID NO: 512630 - RNA, 19 nt, Homo sapiens
cugcagggaucacauggaa

SEQ ID NO: 512631 - RNA, 19 nt, Homo sapiens
uaaaguuucucgguguguu

SEQ ID NO: 512632 - RNA, 19 nt, Homo sapiens
agauguagacuuaagcuuu

SEQ ID NO: 512633 - RNA, 19 nt, Homo sapiens
caugagauguagacuuaag

SEQ ID NO: 512634 - RNA, 19 nt, Homo sapiens
uggaacuccucaacacgua

SEQ ID NO: 512635 - RNA, 19 nt, Homo sapiens
ugaccuggcucaaggaaac

SEQ ID NO: 512636 - RNA, 19 nt, Homo sapiens
uaccuaaguuguggagaaa

SEQ ID NO: 512637 - RNA, 19 nt, Homo sapiens
acauggaaggguaucauua

SEQ ID NO: 512638 - RNA, 19 nt, Homo sapiens
uacaacggacuuugacuaa

SEQ ID NO: 512639 - RNA, 19 nt, Homo sapiens
gucugucucucucucagua

SEQ ID NO: 512640 - RNA, 19 nt, Homo sapiens
acaacggacuuugacuaaa

SEQ ID NO: 512641 - RNA, 19 nt, Homo sapiens
uuacuguucugcauauuac

SEQ ID NO: 512642 - RNA, 19 nt, Homo sapiens
agagcaugcuuacauuuua

SEQ ID NO: 512643 - RNA, 19 nt, Homo sapiens
gaacuccucaacacguaug

SEQ ID NO: 512644 - RNA, 19 nt, Homo sapiens
caaggaaacagagguagug

SEQ ID NO: 512645 - RNA, 19 nt, Homo sapiens
gacguuagcaggcucuuca

SEQ ID NO: 512646 - RNA, 19 nt, Homo sapiens
uugcuuccuuguuauguaa

SEQ ID NO: 512647 - RNA, 19 nt, Homo sapiens
ggucugcgacugccacaug

SEQ ID NO: 512648 - RNA, 19 nt, Homo sapiens
uagauacaacggacuuuga

SEQ ID NO: 512649 - RNA, 19 nt, Homo sapiens
gggaugugcuggcccaacu

SEQ ID NO: 512650 - RNA, 19 nt, Homo sapiens
cagauagcauucaacaaaa

SEQ ID NO: 512651 - RNA, 19 nt, Homo sapiens
acacagauagcauucaaca

SEQ ID NO: 512652 - RNA, 19 nt, Homo sapiens
caaccgacugaauuguuaa

SEQ ID NO: 512653 - RNA, 19 nt, Homo sapiens
guuaauguaagacgaugaa

SEQ ID NO: 512654 - RNA, 19 nt, Homo sapiens
auacaacggacuuugacua

SEQ ID NO: 512655 - RNA, 19 nt, Homo sapiens
caaggucuaccccacauua

SEQ ID NO: 512656 - RNA, 19 nt, Homo sapiens
uaagcuuuaucccuacuag

SEQ ID NO: 512657 - RNA, 19 nt, Homo sapiens
gaaucggguccucuuggaa

SEQ ID NO: 512658 - RNA, 19 nt, Homo sapiens
gccagcaaccacuuccuuu

SEQ ID NO: 512659 - RNA, 19 nt, Homo sapiens
gacgaugaacaguugugua

SEQ ID NO: 512660 - RNA, 19 nt, Homo sapiens
gauuaacaaaccucaguuc

SEQ ID NO: 512661 - RNA, 19 nt, Homo sapiens
gagauccaaccgacugaau

SEQ ID NO: 512662 - RNA, 19 nt, Homo sapiens
uaaacugcaucgagaucca

SEQ ID NO: 512663 - RNA, 19 nt, Homo sapiens
aaaaguggaugcauaacau

SEQ ID NO: 512664 - RNA, 19 nt, Homo sapiens
acgaugaacaguuguguau

SEQ ID NO: 512665 - RNA, 19 nt, Homo sapiens
uguaagacgaugaacaguu

SEQ ID NO: 512666 - RNA, 19 nt, Homo sapiens
uaggcuugcuccacuuuca

SEQ ID NO: 512667 - RNA, 19 nt, Homo sapiens
caacuucauaacuucuuug

SEQ ID NO: 512668 - RNA, 19 nt, Homo sapiens
acuugcaacuucauaacuu

SEQ ID NO: 512669 - RNA, 19 nt, Homo sapiens
gcaaccacuuccuuuaccu

SEQ ID NO: 512670 - RNA, 19 nt, Homo sapiens
ggacagaccaaggacaacu

SEQ ID NO: 512671 - RNA, 19 nt, Homo sapiens
cagauuaacaaaccucagu

SEQ ID NO: 512672 - RNA, 19 nt, Homo sapiens
cagcaaccacuuccuuuac

SEQ ID NO: 512673 - RNA, 19 nt, Homo sapiens
ggacugugacccgauucuu

SEQ ID NO: 512674 - RNA, 19 nt, Homo sapiens
ccuggacugugacccgauu

SEQ ID NO: 512675 - RNA, 19 nt, Homo sapiens
uccaagagcaugcuuacau

SEQ ID NO: 512676 - RNA, 19 nt, Homo sapiens
cgaugaacaguuguguaua

SEQ ID NO: 512677 - RNA, 19 nt, Homo sapiens
agcaggcucuucaaaauaa

SEQ ID NO: 512678 - RNA, 19 nt, Homo sapiens
uaauguaagacgaugaaca

SEQ ID NO: 512679 - RNA, 19 nt, Homo sapiens
uuagaggacagaccaagga

SEQ ID NO: 512680 - RNA, 19 nt, Homo sapiens
cauggaaggguaucauuac

SEQ ID NO: 512681 - RNA, 19 nt, Homo sapiens
gacugugacccgauucuuc

SEQ ID NO: 512682 - RNA, 19 nt, Homo sapiens
ccugacacaucuagaaagc

SEQ ID NO: 512683 - RNA, 19 nt, Homo sapiens
cggcucaccugugcauauc

SEQ ID NO: 512684 - RNA, 19 nt, Homo sapiens
uaauaaacugcaucgagau

SEQ ID NO: 512685 - RNA, 19 nt, Homo sapiens
uaacuugcaacuucauaac

SEQ ID NO: 512686 - RNA, 19 nt, Homo sapiens
ggaacuccucaacacguau

SEQ ID NO: 512687 - RNA, 19 nt, Homo sapiens
uuugcuuccuuguuaugua

SEQ ID NO: 512688 - RNA, 19 nt, Homo sapiens
gaagacaucugaaaccuua

SEQ ID NO: 512689 - RNA, 19 nt, Homo sapiens
gaacuagucuacuucuuaa

SEQ ID NO: 512690 - RNA, 19 nt, Homo sapiens
gaagagaacuugcaaaggu

SEQ ID NO: 512691 - RNA, 19 nt, Homo sapiens
ggagugaccuaaagcauuu

SEQ ID NO: 512692 - RNA, 19 nt, Homo sapiens
caacuggagucuaugcuua

SEQ ID NO: 512693 - RNA, 19 nt, Homo sapiens
gaaaauaucuucaccucua

SEQ ID NO: 512694 - RNA, 19 nt, Homo sapiens
ggacucaaguguagaagaa

SEQ ID NO: 512695 - RNA, 19 nt, Homo sapiens
gaaauacccucaagucucu

SEQ ID NO: 512696 - RNA, 19 nt, Homo sapiens
ggaaauagggcaagaauuc

SEQ ID NO: 512697 - RNA, 19 nt, Homo sapiens
gaaccugucuccuacuuug

SEQ ID NO: 512698 - RNA, 19 nt, Homo sapiens
ggaguaaaguggcaauuuc

SEQ ID NO: 512699 - RNA, 19 nt, Homo sapiens
gaaauauugugcuuacuca

SEQ ID NO: 512700 - RNA, 19 nt, Homo sapiens
gcaagagugugaaaucuca

SEQ ID NO: 512701 - RNA, 19 nt, Homo sapiens
cgaaucaacuggagucuau

SEQ ID NO: 512702 - RNA, 19 nt, Homo sapiens
uguggcagauucaauauua

SEQ ID NO: 512703 - RNA, 19 nt, Homo sapiens
ggaaccuccuauaucauua

SEQ ID NO: 512704 - RNA, 19 nt, Homo sapiens
ucuaauaacugcuuacuca

SEQ ID NO: 512705 - RNA, 19 nt, Homo sapiens
ggugauaacucuugaggau

SEQ ID NO: 512706 - RNA, 19 nt, Homo sapiens
cuaagaagcuacagauugu

SEQ ID NO: 512707 - RNA, 19 nt, Homo sapiens
caacaucugcuuacaagaa

SEQ ID NO: 512708 - RNA, 19 nt, Homo sapiens
agacaucuaccuauacuua

SEQ ID NO: 512709 - RNA, 19 nt, Homo sapiens
ucaaaagccugaaaguuua

SEQ ID NO: 512710 - RNA, 19 nt, Homo sapiens
gcucaaaacuggauuauca

SEQ ID NO: 512711 - RNA, 19 nt, Homo sapiens
gaaaauagcaagaguguga

SEQ ID NO: 512712 - RNA, 19 nt, Homo sapiens
ugaacuagucuacuucuua

SEQ ID NO: 512713 - RNA, 19 nt, Homo sapiens
gcauugccaugaauuucua

SEQ ID NO: 512714 - RNA, 19 nt, Homo sapiens
ucaguagguugaacuauga

SEQ ID NO: 512715 - RNA, 19 nt, Homo sapiens
gacucugucucaaguguua

SEQ ID NO: 512716 - RNA, 19 nt, Homo sapiens
gccaagguauucuauucua

SEQ ID NO: 512717 - RNA, 19 nt, Homo sapiens
gcauagaggccaagguauu

SEQ ID NO: 512718 - RNA, 19 nt, Homo sapiens
ccauuucaguguauuguuu

SEQ ID NO: 512719 - RNA, 19 nt, Homo sapiens
aaacuggauuaucaccuua

SEQ ID NO: 512720 - RNA, 19 nt, Homo sapiens
ccaagguauucuauucuaa

SEQ ID NO: 512721 - RNA, 19 nt, Homo sapiens
gaagagaguagagcucaaa

SEQ ID NO: 512722 - RNA, 19 nt, Homo sapiens
gaguggaucuguagaaguc

SEQ ID NO: 512723 - RNA, 19 nt, Homo sapiens
gauuauggccuacaauguu

SEQ ID NO: 512724 - RNA, 19 nt, Homo sapiens
gaagcuacagauugucaua

SEQ ID NO: 512725 - RNA, 19 nt, Homo sapiens
gcaggaagagcuaagaaga

SEQ ID NO: 512726 - RNA, 19 nt, Homo sapiens
ccauuguugucuucacuua

SEQ ID NO: 512727 - RNA, 19 nt, Homo sapiens
ugaccuuugucuucuauaa

SEQ ID NO: 512728 - RNA, 19 nt, Homo sapiens
gagugaggauggauuuaga

SEQ ID NO: 512729 - RNA, 19 nt, Homo sapiens
guuaagauaugcacagucu

SEQ ID NO: 512730 - RNA, 19 nt, Homo sapiens
ugauaacucuugaggaugu

SEQ ID NO: 512731 - RNA, 19 nt, Homo sapiens
gcggaaacuuggaaucaau

SEQ ID NO: 512732 - RNA, 19 nt, Homo sapiens
caagcacacuguauguuca

SEQ ID NO: 512733 - RNA, 19 nt, Homo sapiens
gagaguggaaccuccuaua

SEQ ID NO: 512734 - RNA, 19 nt, Homo sapiens
cagcugugcauccaauuua

SEQ ID NO: 512735 - RNA, 19 nt, Homo sapiens
aaacagcugugcauccaau

SEQ ID NO: 512736 - RNA, 19 nt, Homo sapiens
guaaacagcugugcaucca

SEQ ID NO: 512737 - RNA, 19 nt, Homo sapiens
gaagacaccagacugaagu

SEQ ID NO: 512738 - RNA, 19 nt, Homo sapiens
ucugaauccugguaauuaa

SEQ ID NO: 512739 - RNA, 19 nt, Homo sapiens
guacuuuggaugcaauuaa

SEQ ID NO: 512740 - RNA, 19 nt, Homo sapiens
aagagaacuugcaaaggua

SEQ ID NO: 512741 - RNA, 19 nt, Homo sapiens
ugucuucacuuaauccauu

SEQ ID NO: 512742 - RNA, 19 nt, Homo sapiens
uaagauaugcacagucuau

SEQ ID NO: 512743 - RNA, 19 nt, Homo sapiens
uguaaggacucaaguguag

SEQ ID NO: 512744 - RNA, 19 nt, Homo sapiens
ucuaugaacuagucuacuu

SEQ ID NO: 512745 - RNA, 19 nt, Homo sapiens
gaaguaaacagcugugcau

SEQ ID NO: 512746 - RNA, 19 nt, Homo sapiens
aaucaauucucuacaggaa

SEQ ID NO: 512747 - RNA, 19 nt, Homo sapiens
gaaucaagcacacuguaug

SEQ ID NO: 512748 - RNA, 19 nt, Homo sapiens
ggaagagaguagagcucaa

SEQ ID NO: 512749 - RNA, 19 nt, Homo sapiens
gaaaauauccccuucuuac

SEQ ID NO: 512750 - RNA, 19 nt, Homo sapiens
gagcuaagaagagaacuug

SEQ ID NO: 512751 - RNA, 19 nt, Homo sapiens
guuggaaacuguaaaauga

SEQ ID NO: 512752 - RNA, 19 nt, Homo sapiens
cuuaauccauuuagcacua

SEQ ID NO: 512753 - RNA, 19 nt, Homo sapiens
ugaacacugucaucaaugu

SEQ ID NO: 512754 - RNA, 19 nt, Homo sapiens
gaaugccaguuugaccuuu

SEQ ID NO: 512755 - RNA, 19 nt, Homo sapiens
aagcacaucuugucaacau

SEQ ID NO: 512756 - RNA, 19 nt, Homo sapiens
gaaaaggucgaaaacuuaa

SEQ ID NO: 512757 - RNA, 19 nt, Homo sapiens
acaccaaguuauaugacua

SEQ ID NO: 512758 - RNA, 19 nt, Homo sapiens
caauaucaaucacauuagg

SEQ ID NO: 512759 - RNA, 19 nt, Homo sapiens
caguaaccauuucagugua

SEQ ID NO: 512760 - RNA, 19 nt, Homo sapiens
aguggaaccuccuauauca

SEQ ID NO: 512761 - RNA, 19 nt, Homo sapiens
gcuacagauugucauaguu

SEQ ID NO: 512762 - RNA, 19 nt, Homo sapiens
gaacuaaaacagaacauug

SEQ ID NO: 512763 - RNA, 19 nt, Homo sapiens
ucacagauguaaggacuca

SEQ ID NO: 512764 - RNA, 19 nt, Homo sapiens
gaaaugccagaaacaguuc

SEQ ID NO: 512765 - RNA, 19 nt, Homo sapiens
ggaugaagguggguauugg

SEQ ID NO: 512766 - RNA, 19 nt, Homo sapiens
aauguuaacugccaagcuu

SEQ ID NO: 512767 - RNA, 19 nt, Homo sapiens
aaauaagcacaccaaguua

SEQ ID NO: 512768 - RNA, 19 nt, Homo sapiens
ugucaucaauguucaguuc

SEQ ID NO: 512769 - RNA, 19 nt, Homo sapiens
guugaacuaugaacacugu

SEQ ID NO: 512770 - RNA, 19 nt, Homo sapiens
aagaagaaauccagacucu

SEQ ID NO: 512771 - RNA, 19 nt, Homo sapiens
gaauucggcugcaaaugcu

SEQ ID NO: 512772 - RNA, 19 nt, Homo sapiens
gauguaaggacucaagugu

SEQ ID NO: 512773 - RNA, 19 nt, Homo sapiens
acucaacacuaccaccuuu

SEQ ID NO: 512774 - RNA, 19 nt, Homo sapiens
gccugaaaguuuagaucua

SEQ ID NO: 512775 - RNA, 19 nt, Homo sapiens
caucaauguucaguucaaa

SEQ ID NO: 512776 - RNA, 19 nt, Homo sapiens
uugcaaagguagaagaaga

SEQ ID NO: 512777 - RNA, 19 nt, Homo sapiens
gcuacuaacuuuucaacaa

SEQ ID NO: 512778 - RNA, 19 nt, Homo sapiens
aggaagagcuaagaagaga

SEQ ID NO: 512779 - RNA, 19 nt, Homo sapiens
gaaccuccuauaucauuau

SEQ ID NO: 512780 - RNA, 19 nt, Homo sapiens
gaaagaacuacuagcuaca

SEQ ID NO: 512781 - RNA, 19 nt, Homo sapiens
ucuaagaagcuacagauug

SEQ ID NO: 512782 - RNA, 19 nt, Homo sapiens
ugagauuccuaccuuuguu

SEQ ID NO: 512783 - RNA, 19 nt, Homo sapiens
ccugguuccucuuguguuu

SEQ ID NO: 512784 - RNA, 19 nt, Homo sapiens
ugugcuuacucaaguguua

SEQ ID NO: 512785 - RNA, 19 nt, Homo sapiens
gucuagacauauuugcaua

SEQ ID NO: 512786 - RNA, 19 nt, Homo sapiens
aaagguagaagaagaaauc

SEQ ID NO: 512787 - RNA, 19 nt, Homo sapiens
gggaaccauuguugucuuc

SEQ ID NO: 512788 - RNA, 19 nt, Homo sapiens
gcaauaggaugauuuacua

SEQ ID NO: 512789 - RNA, 19 nt, Homo sapiens
gcaugaaccugaugaauga

SEQ ID NO: 512790 - RNA, 19 nt, Homo sapiens
guacacaacuggucauaau

SEQ ID NO: 512791 - RNA, 19 nt, Homo sapiens
gaaagaaaggcaucuaguu

SEQ ID NO: 512792 - RNA, 19 nt, Homo sapiens
ucacaagccucaagacgaa

SEQ ID NO: 512793 - RNA, 19 nt, Homo sapiens
gaacggccaucagcaagaa

SEQ ID NO: 512794 - RNA, 19 nt, Homo sapiens
aaacagaacuucagcaaaa

SEQ ID NO: 512795 - RNA, 19 nt, Homo sapiens
cauaauuccugucugugua

SEQ ID NO: 512796 - RNA, 19 nt, Homo sapiens
ggucauaauuccugucugu

SEQ ID NO: 512797 - RNA, 19 nt, Homo sapiens
ggaauucuccuacuuucaa

SEQ ID NO: 512798 - RNA, 19 nt, Homo sapiens
gaaccugaugaaugaauua

SEQ ID NO: 512799 - RNA, 19 nt, Homo sapiens
gcaaggaacagacgaagau

SEQ ID NO: 512800 - RNA, 19 nt, Homo sapiens
gcuauuguuugcuuugauu

SEQ ID NO: 512801 - RNA, 19 nt, Homo sapiens
ggauggagcucuucaugac

SEQ ID NO: 512802 - RNA, 19 nt, Homo sapiens
ccaaacauguagcuauugu

SEQ ID NO: 512803 - RNA, 19 nt, Homo sapiens
gaauucuccuacuuucaaa

SEQ ID NO: 512804 - RNA, 19 nt, Homo sapiens
ccacuugaccaucacauuu

SEQ ID NO: 512805 - RNA, 19 nt, Homo sapiens
aaagaaaggcaucuaguug

SEQ ID NO: 512806 - RNA, 19 nt, Homo sapiens
aggaggagcugcagugcua

SEQ ID NO: 512807 - RNA, 19 nt, Homo sapiens
gaccaucacauuucaguau

SEQ ID NO: 512808 - RNA, 19 nt, Homo sapiens
ccagcaauaggaugauuua

SEQ ID NO: 512809 - RNA, 19 nt, Homo sapiens
gcaagaaguucggagacau

SEQ ID NO: 512810 - RNA, 19 nt, Homo sapiens
gcuagaagacgaaauuaca

SEQ ID NO: 512811 - RNA, 19 nt, Homo sapiens
agacgaaauuacaacacua

SEQ ID NO: 512812 - RNA, 19 nt, Homo sapiens
ggcaugaaccugaugaaug

SEQ ID NO: 512813 - RNA, 19 nt, Homo sapiens
ucucucaccuacaucaauu

SEQ ID NO: 512814 - RNA, 19 nt, Homo sapiens
agaguuaguucagcuagaa

SEQ ID NO: 512815 - RNA, 19 nt, Homo sapiens
ggaggaaaaggaagaguua

SEQ ID NO: 512816 - RNA, 19 nt, Homo sapiens
cuugaaggcugaaugaaca

SEQ ID NO: 512817 - RNA, 19 nt, Homo sapiens
gaaguucggagacaugagu

SEQ ID NO: 512818 - RNA, 19 nt, Homo sapiens
ugaaccugaugaaugaauu

SEQ ID NO: 512819 - RNA, 19 nt, Homo sapiens
gaaaggcaucuaguugaga

SEQ ID NO: 512820 - RNA, 19 nt, Homo sapiens
aagaaaggcaucuaguuga

SEQ ID NO: 512821 - RNA, 19 nt, Homo sapiens
ucagcuagaagacgaaauu

SEQ ID NO: 512822 - RNA, 19 nt, Homo sapiens
gccuugacauuguuauuca

SEQ ID NO: 512823 - RNA, 19 nt, Homo sapiens
ggaacggccaucagcaaga

SEQ ID NO: 512824 - RNA, 19 nt, Homo sapiens
ucucuagcaugcucucuga

SEQ ID NO: 512825 - RNA, 19 nt, Homo sapiens
caacugcagcuuucagcaa

SEQ ID NO: 512826 - RNA, 19 nt, Homo sapiens
ugaaugaacagucccuuuc

SEQ ID NO: 512827 - RNA, 19 nt, Homo sapiens
caucacauuucaguauuca

SEQ ID NO: 512828 - RNA, 19 nt, Homo sapiens
ggaaaaggaagaguuaaaa

SEQ ID NO: 512829 - RNA, 19 nt, Homo sapiens
aaacccaggccuugacauu

SEQ ID NO: 512830 - RNA, 19 nt, Homo sapiens
agaaaggcaucuaguugag

SEQ ID NO: 512831 - RNA, 19 nt, Homo sapiens
uuccaaacauguagcuauu

SEQ ID NO: 512832 - RNA, 19 nt, Homo sapiens
acacaacuggucauaauuc

SEQ ID NO: 512833 - RNA, 19 nt, Homo sapiens
caagaaguucggagacaug

SEQ ID NO: 512834 - RNA, 19 nt, Homo sapiens
augacugucuccagcaaua

SEQ ID NO: 512835 - RNA, 19 nt, Homo sapiens
ucaacaggauggagcucuu

SEQ ID NO: 512836 - RNA, 19 nt, Homo sapiens
ugaugugcauguccuugaa

SEQ ID NO: 512837 - RNA, 19 nt, Homo sapiens
acauguagcuauuguuugc

SEQ ID NO: 512838 - RNA, 19 nt, Homo sapiens
ccauuuguauuuguguuga

SEQ ID NO: 512839 - RNA, 19 nt, Homo sapiens
cgaaagaaaggcaucuagu

SEQ ID NO: 512840 - RNA, 19 nt, Homo sapiens
acaacacuacgacaaguuu

SEQ ID NO: 512841 - RNA, 19 nt, Homo sapiens
ccaucacauuucaguauuc

SEQ ID NO: 512842 - RNA, 19 nt, Homo sapiens
cagcuagaagacgaaauua

SEQ ID NO: 512843 - RNA, 19 nt, Homo sapiens
cagaguuaguucagcuaga

SEQ ID NO: 512844 - RNA, 19 nt, Homo sapiens
caaauggccccuccagaaa

SEQ ID NO: 512845 - RNA, 19 nt, Homo sapiens
gaggagaggguugagacaa

SEQ ID NO: 512846 - RNA, 19 nt, Homo sapiens
gcgaaagaaaggcaucuag

SEQ ID NO: 512847 - RNA, 19 nt, Homo sapiens
aacagucccuuucaguuca

SEQ ID NO: 512848 - RNA, 19 nt, Homo sapiens
uagcuauuguuugcuuuga

SEQ ID NO: 512849 - RNA, 19 nt, Homo sapiens
cuguguaauucgauguaua

SEQ ID NO: 512850 - RNA, 19 nt, Homo sapiens
auaaguaugccugcuauga

SEQ ID NO: 512851 - RNA, 19 nt, Homo sapiens
uccauucgccauuccauaa

SEQ ID NO: 512852 - RNA, 19 nt, Homo sapiens
gacuaccacugccuacaag

SEQ ID NO: 512853 - RNA, 19 nt, Homo sapiens
uuacaacacuacgacaagu

SEQ ID NO: 512854 - RNA, 19 nt, Homo sapiens
ugcuuggccuccuuuauga

SEQ ID NO: 512855 - RNA, 19 nt, Homo sapiens
cuagaagacgaaauuacaa

SEQ ID NO: 512856 - RNA, 19 nt, Homo sapiens
gguacacaacuggucauaa

SEQ ID NO: 512857 - RNA, 19 nt, Homo sapiens
acccaggccuugacauugu

SEQ ID NO: 512858 - RNA, 19 nt, Homo sapiens
acugaaccguugcaaggaa

SEQ ID NO: 512859 - RNA, 19 nt, Homo sapiens
ucaaauggccccuccagaa

SEQ ID NO: 512860 - RNA, 19 nt, Homo sapiens
cacaugaaacccugaguca

SEQ ID NO: 512861 - RNA, 19 nt, Homo sapiens
uaccacugccuacaagaaa

SEQ ID NO: 512862 - RNA, 19 nt, Homo sapiens
ucaugacugucuccagcaa

SEQ ID NO: 512863 - RNA, 19 nt, Homo sapiens
caggauggagcucuucaug

SEQ ID NO: 512864 - RNA, 19 nt, Homo sapiens
cgaagucagccaccaugga

SEQ ID NO: 512865 - RNA, 19 nt, Homo sapiens
gaaaaggaagaguuaaaag

SEQ ID NO: 512866 - RNA, 19 nt, Homo sapiens
cgaaauuacaacacuacga

SEQ ID NO: 512867 - RNA, 19 nt, Homo sapiens
ugaucucucucaccuacau

SEQ ID NO: 512868 - RNA, 19 nt, Homo sapiens
ccaacuacuugugaucucu

SEQ ID NO: 512869 - RNA, 19 nt, Homo sapiens
aagguuuguuggagacuga

SEQ ID NO: 512870 - RNA, 19 nt, Homo sapiens
uuuaaaauguucccacuug

SEQ ID NO: 512871 - RNA, 19 nt, Homo sapiens
uaaguaugccugcuaugag

SEQ ID NO: 512872 - RNA, 19 nt, Homo sapiens
agacuaccacugccuacaa

SEQ ID NO: 512873 - RNA, 19 nt, Homo sapiens
gaagacgaaauuacaacac

SEQ ID NO: 512874 - RNA, 19 nt, Homo sapiens
aagacgaaauuacaacacu

SEQ ID NO: 512875 - RNA, 19 nt, Homo sapiens
guuaaaagcagaguuaguu

SEQ ID NO: 512876 - RNA, 19 nt, Homo sapiens
accaucacauuucaguauu

SEQ ID NO: 512877 - RNA, 19 nt, Homo sapiens
cuccuacuuucaaaucauu

SEQ ID NO: 512878 - RNA, 19 nt, Homo sapiens
caugcucucugaggaggaa

SEQ ID NO: 512879 - RNA, 19 nt, Homo sapiens
cuaccacugccuacaagaa

SEQ ID NO: 512880 - RNA, 19 nt, Homo sapiens
guagcuauuguuugcuuug

SEQ ID NO: 512881 - RNA, 19 nt, Homo sapiens
ucauaauuccugucugugu

SEQ ID NO: 512882 - RNA, 19 nt, Homo sapiens
ggccuugacauuguuauuc

SEQ ID NO: 512883 - RNA, 19 nt, Homo sapiens
caucucugccugugcuuau

SEQ ID NO: 512884 - RNA, 19 nt, Homo sapiens
gcagcugcauccagaaacc

SEQ ID NO: 512885 - RNA, 19 nt, Homo sapiens
uugcuuggccuccuuuaug

SEQ ID NO: 512886 - RNA, 19 nt, Homo sapiens
gacgaaauuacaacacuac

SEQ ID NO: 512887 - RNA, 19 nt, Homo sapiens
ccuccagaaaguuuaauga

SEQ ID NO: 512888 - RNA, 19 nt, Homo sapiens
gaaagaauauugagccaaa

SEQ ID NO: 512889 - RNA, 19 nt, Homo sapiens
cagcaaguccuaccuguua

SEQ ID NO: 512890 - RNA, 19 nt, Homo sapiens
acaaaggucugcugucuga

SEQ ID NO: 512891 - RNA, 19 nt, Homo sapiens
gcuuuagccucauagaaua

SEQ ID NO: 512892 - RNA, 19 nt, Homo sapiens
gaagaguucuaagcauaaa

SEQ ID NO: 512893 - RNA, 19 nt, Homo sapiens
gaaauacaagccuuacauu

SEQ ID NO: 512894 - RNA, 19 nt, Homo sapiens
gggcugagcuuaccaaggu

SEQ ID NO: 512895 - RNA, 19 nt, Homo sapiens
uacauugccuuaugcuuua

SEQ ID NO: 512896 - RNA, 19 nt, Homo sapiens
agucagaccucuacaagaa

SEQ ID NO: 512897 - RNA, 19 nt, Homo sapiens
caagauaucaaccugaauu

SEQ ID NO: 512898 - RNA, 19 nt, Homo sapiens
ggaccgaguugggaccaua

SEQ ID NO: 512899 - RNA, 19 nt, Homo sapiens
uaacaaaggucugcugucu

SEQ ID NO: 512900 - RNA, 19 nt, Homo sapiens
gacucaagcugaaauacaa

SEQ ID NO: 512901 - RNA, 19 nt, Homo sapiens
gcaggaagcuuggagacau

SEQ ID NO: 512902 - RNA, 19 nt, Homo sapiens
gaugaggguuccuuaaugg

SEQ ID NO: 512903 - RNA, 19 nt, Homo sapiens
gccaagauaucaaccugaa

SEQ ID NO: 512904 - RNA, 19 nt, Homo sapiens
uugaagaguucuaagcaua

SEQ ID NO: 512905 - RNA, 19 nt, Homo sapiens
guugaaggauugaagaguu

SEQ ID NO: 512906 - RNA, 19 nt, Homo sapiens
gaacacaggcuuguacaca

SEQ ID NO: 512907 - RNA, 19 nt, Homo sapiens
gcaggucucuagcgccuau

SEQ ID NO: 512908 - RNA, 19 nt, Homo sapiens
uaacggaagcaaauucauu

SEQ ID NO: 512909 - RNA, 19 nt, Homo sapiens
gaucucuuccuguuacuaa

SEQ ID NO: 512910 - RNA, 19 nt, Homo sapiens
uuacauugccuuaugcuuu

SEQ ID NO: 512911 - RNA, 19 nt, Homo sapiens
uuacgcgaaucuagcuuua

SEQ ID NO: 512912 - RNA, 19 nt, Homo sapiens
caagaagacucaggaaacu

SEQ ID NO: 512913 - RNA, 19 nt, Homo sapiens
ccugaauucuccuaacaaa

SEQ ID NO: 512914 - RNA, 19 nt, Homo sapiens
ucagaauguugaaggauug

SEQ ID NO: 512915 - RNA, 19 nt, Homo sapiens
cggaggguuugaaagaaua

SEQ ID NO: 512916 - RNA, 19 nt, Homo sapiens
gcggaggguuugaaagaau

SEQ ID NO: 512917 - RNA, 19 nt, Homo sapiens
gaaggaaaacccugucuuu

SEQ ID NO: 512918 - RNA, 19 nt, Homo sapiens
cauguuagcccaucagaau

SEQ ID NO: 512919 - RNA, 19 nt, Homo sapiens
caacccagccucagcauca

SEQ ID NO: 512920 - RNA, 19 nt, Homo sapiens
gaccauaaagucuaagguu

SEQ ID NO: 512921 - RNA, 19 nt, Homo sapiens
gcucuuggcaggacacuga

SEQ ID NO: 512922 - RNA, 19 nt, Homo sapiens
ggagcucugugccuuagug

SEQ ID NO: 512923 - RNA, 19 nt, Homo sapiens
ggacucaagcugaaauaca

SEQ ID NO: 512924 - RNA, 19 nt, Homo sapiens
gggcggaggguuugaaaga

SEQ ID NO: 512925 - RNA, 19 nt, Homo sapiens
agauguggcugccgcguuu

SEQ ID NO: 512926 - RNA, 19 nt, Homo sapiens
cgauguaucuuuuccuuaa

SEQ ID NO: 512927 - RNA, 19 nt, Homo sapiens
gcagcugccugauuguuac

SEQ ID NO: 512928 - RNA, 19 nt, Homo sapiens
ugaagaguucuaagcauaa

SEQ ID NO: 512929 - RNA, 19 nt, Homo sapiens
ucagaccucuacaagaaga

SEQ ID NO: 512930 - RNA, 19 nt, Homo sapiens
agaugaggguuccuuaaug

SEQ ID NO: 512931 - RNA, 19 nt, Homo sapiens
acacaggcuuguacacaga

SEQ ID NO: 512932 - RNA, 19 nt, Homo sapiens
gguaauuugucaauaaagc

SEQ ID NO: 512933 - RNA, 19 nt, Homo sapiens
ggauguuccugucgacaca

SEQ ID NO: 512934 - RNA, 19 nt, Homo sapiens
gagaguggaaugagaaagu

SEQ ID NO: 512935 - RNA, 19 nt, Homo sapiens
aacggaagcaaauucauua

SEQ ID NO: 512936 - RNA, 19 nt, Homo sapiens
cauaaagucuaagguugug

SEQ ID NO: 512937 - RNA, 19 nt, Homo sapiens
gcacuccacacacgacaga

SEQ ID NO: 512938 - RNA, 19 nt, Homo sapiens
gauugccguuacagucuuu

SEQ ID NO: 512939 - RNA, 19 nt, Homo sapiens
ggauugccguuacagucuu

SEQ ID NO: 512940 - RNA, 19 nt, Homo sapiens
ccuaugcccugcccuaaag

SEQ ID NO: 512941 - RNA, 19 nt, Homo sapiens
ggcagccucuuccaguuga

SEQ ID NO: 512942 - RNA, 19 nt, Homo sapiens
aaauacaagccuuacauug

SEQ ID NO: 512943 - RNA, 19 nt, Homo sapiens
caagguggaagaggaaauu

SEQ ID NO: 512944 - RNA, 19 nt, Homo sapiens
gauaucaaccugaauucuc

SEQ ID NO: 512945 - RNA, 19 nt, Homo sapiens
ugaauucuccuaacaaagg

SEQ ID NO: 512946 - RNA, 19 nt, Homo sapiens
ugaaauacaagccuuacau

SEQ ID NO: 512947 - RNA, 19 nt, Homo sapiens
ggaaaacccugucuuuagc

SEQ ID NO: 512948 - RNA, 19 nt, Homo sapiens
gaauucuccuaacaaaggu

SEQ ID NO: 512949 - RNA, 19 nt, Homo sapiens
ggaucccgcaccuuucuaa

SEQ ID NO: 512950 - RNA, 19 nt, Homo sapiens
aaaccugcuucucuucuca

SEQ ID NO: 512951 - RNA, 19 nt, Homo sapiens
gccuuaugcuuuauuucuu

SEQ ID NO: 512952 - RNA, 19 nt, Homo sapiens
ggcggaggguuugaaagaa

SEQ ID NO: 512953 - RNA, 19 nt, Homo sapiens
ugucggaucccgcaccuuu

SEQ ID NO: 512954 - RNA, 19 nt, Homo sapiens
caggaagcuuggagacaug

SEQ ID NO: 512955 - RNA, 19 nt, Homo sapiens
acagugggcucugccauca

SEQ ID NO: 512956 - RNA, 19 nt, Homo sapiens
uauagaugaggguuccuua

SEQ ID NO: 512957 - RNA, 19 nt, Homo sapiens
caaccugaauucuccuaac

SEQ ID NO: 512958 - RNA, 19 nt, Homo sapiens
gauugaagaguucuaagca

SEQ ID NO: 512959 - RNA, 19 nt, Homo sapiens
ccauaaagucuaagguugu

SEQ ID NO: 512960 - RNA, 19 nt, Homo sapiens
uagaugaggguuccuuaau

SEQ ID NO: 512961 - RNA, 19 nt, Homo sapiens
uaaaugcaguggacuuuuc

SEQ ID NO: 512962 - RNA, 19 nt, Homo sapiens
cggaagcaaauucauuauu

SEQ ID NO: 512963 - RNA, 19 nt, Homo sapiens
ccaucagaauguugaagga

SEQ ID NO: 512964 - RNA, 19 nt, Homo sapiens
acacucacguuuguagaug

SEQ ID NO: 512965 - RNA, 19 nt, Homo sapiens
ggaacucugcgaccuucaa

SEQ ID NO: 512966 - RNA, 19 nt, Homo sapiens
gguguugaccgauguaucu

SEQ ID NO: 512967 - RNA, 19 nt, Homo sapiens
guacaaaaccugcuucucu

SEQ ID NO: 512968 - RNA, 19 nt, Homo sapiens
gaaucauguuagcccauca

SEQ ID NO: 512969 - RNA, 19 nt, Homo sapiens
cucaggagcuacaaagauc

SEQ ID NO: 512970 - RNA, 19 nt, Homo sapiens
ugagcauuguguggaauuu

SEQ ID NO: 512971 - RNA, 19 nt, Homo sapiens
gaaggauugaagaguucua

SEQ ID NO: 512972 - RNA, 19 nt, Homo sapiens
ucucagugcugccuuugca

SEQ ID NO: 512973 - RNA, 19 nt, Homo sapiens
guggcagccucuuccaguu

SEQ ID NO: 512974 - RNA, 19 nt, Homo sapiens
guacacagauguuuuacac

SEQ ID NO: 512975 - RNA, 19 nt, Homo sapiens
acaagaagacucaggaaac

SEQ ID NO: 512976 - RNA, 19 nt, Homo sapiens
aaccugaauucuccuaaca

SEQ ID NO: 512977 - RNA, 19 nt, Homo sapiens
ucacaggcaggacagaaga

SEQ ID NO: 512978 - RNA, 19 nt, Homo sapiens
agccuuacauugccuuaug

SEQ ID NO: 512979 - RNA, 19 nt, Homo sapiens
guugggaccauaaagucua

SEQ ID NO: 512980 - RNA, 19 nt, Homo sapiens
gaacucugcgaccuucaag

SEQ ID NO: 512981 - RNA, 19 nt, Homo sapiens
ggaagaggaaauugucacu

SEQ ID NO: 512982 - RNA, 19 nt, Homo sapiens
uacaagaagacucaggaaa

SEQ ID NO: 512983 - RNA, 19 nt, Homo sapiens
caguugagguguuuuaugu

SEQ ID NO: 512984 - RNA, 19 nt, Homo sapiens
caaaaugccgaacgagaaa

SEQ ID NO: 512985 - RNA, 19 nt, Homo sapiens
ucacagaaggaaugcaauc

SEQ ID NO: 512986 - RNA, 19 nt, Homo sapiens
gaauguugaaggauugaag

SEQ ID NO: 512987 - RNA, 19 nt, Homo sapiens
agagagaacggcagugaca

SEQ ID NO: 512988 - RNA, 19 nt, Homo sapiens
gaacaaagaccauuccuua

SEQ ID NO: 512989 - RNA, 19 nt, Homo sapiens
gaaggaagaugguauggaa

SEQ ID NO: 512990 - RNA, 19 nt, Homo sapiens
ugaaugagcugcagcauga

SEQ ID NO: 512991 - RNA, 19 nt, Homo sapiens
caagaugucuacuuuguau

SEQ ID NO: 512992 - RNA, 19 nt, Homo sapiens
caaagaccauuccuuagaa

SEQ ID NO: 512993 - RNA, 19 nt, Homo sapiens
uaaacaagauggacagcua

SEQ ID NO: 512994 - RNA, 19 nt, Homo sapiens
aaacaggaaugucuuauca

SEQ ID NO: 512995 - RNA, 19 nt, Homo sapiens
gcuaugaacuauaaacaug

SEQ ID NO: 512996 - RNA, 19 nt, Homo sapiens
ggacuuggcuaugaacuau

SEQ ID NO: 512997 - RNA, 19 nt, Homo sapiens
gaagaugucuccaacuuuu

SEQ ID NO: 512998 - RNA, 19 nt, Homo sapiens
gagaagaugagagaauuua

SEQ ID NO: 512999 - RNA, 19 nt, Homo sapiens
caacagagaacaauugaau

SEQ ID NO: 513000 - RNA, 19 nt, Homo sapiens
gaagaaacucagaauuuga

SEQ ID NO: 513001 - RNA, 19 nt, Homo sapiens
ggaguuuggucuauguaaa

SEQ ID NO: 513002 - RNA, 19 nt, Homo sapiens
agaagaaacucagaauuug

SEQ ID NO: 513003 - RNA, 19 nt, Homo sapiens
gaaauuggcuuggcuucuc

SEQ ID NO: 513004 - RNA, 19 nt, Homo sapiens
gaugagagaauuuaccaaa

SEQ ID NO: 513005 - RNA, 19 nt, Homo sapiens
gguuuagccuuucgaguuu

SEQ ID NO: 513006 - RNA, 19 nt, Homo sapiens
gaaagacaccaagagcaua

SEQ ID NO: 513007 - RNA, 19 nt, Homo sapiens
gcaggaagccgaguaucua

SEQ ID NO: 513008 - RNA, 19 nt, Homo sapiens
guaaacgucgaaaguauuu

SEQ ID NO: 513009 - RNA, 19 nt, Homo sapiens
caaaggagaagaugagaga

SEQ ID NO: 513010 - RNA, 19 nt, Homo sapiens
ggaagagcaagucucauuu

SEQ ID NO: 513011 - RNA, 19 nt, Homo sapiens
gggaagagcaagucucauu

SEQ ID NO: 513012 - RNA, 19 nt, Homo sapiens
cauuuggagugaaguauaa

SEQ ID NO: 513013 - RNA, 19 nt, Homo sapiens
ccagauaccugccaugaac

SEQ ID NO: 513014 - RNA, 19 nt, Homo sapiens
gcugaagucucauaccaau

SEQ ID NO: 513015 - RNA, 19 nt, Homo sapiens
uaccugccaugaacucuua

SEQ ID NO: 513016 - RNA, 19 nt, Homo sapiens
ucacugcacucaauaugug

SEQ ID NO: 513017 - RNA, 19 nt, Homo sapiens
ggaagaugucuccaacuuu

SEQ ID NO: 513018 - RNA, 19 nt, Homo sapiens
gaacucaaacaugcacuuu

SEQ ID NO: 513019 - RNA, 19 nt, Homo sapiens
aaacuuaccuuugcuuucu

SEQ ID NO: 513020 - RNA, 19 nt, Homo sapiens
ggagugaaguauaauccau

SEQ ID NO: 513021 - RNA, 19 nt, Homo sapiens
ccaauguucucucugugaa

SEQ ID NO: 513022 - RNA, 19 nt, Homo sapiens
guucagaucccuucuauac

SEQ ID NO: 513023 - RNA, 19 nt, Homo sapiens
agagauuucuuaucagguu

SEQ ID NO: 513024 - RNA, 19 nt, Homo sapiens
uaaaagagcguacagguuu

SEQ ID NO: 513025 - RNA, 19 nt, Homo sapiens
acaaagaccauuccuuaga

SEQ ID NO: 513026 - RNA, 19 nt, Homo sapiens
ggagaagaugagagaauuu

SEQ ID NO: 513027 - RNA, 19 nt, Homo sapiens
acaauaaggagaacaaaga

SEQ ID NO: 513028 - RNA, 19 nt, Homo sapiens
ucacugaagaggagauuaa

SEQ ID NO: 513029 - RNA, 19 nt, Homo sapiens
gcagcaugaucucgauguu

SEQ ID NO: 513030 - RNA, 19 nt, Homo sapiens
cuuaucagguuuagccuuu

SEQ ID NO: 513031 - RNA, 19 nt, Homo sapiens
uccaagagcucaacaaacu

SEQ ID NO: 513032 - RNA, 19 nt, Homo sapiens
acagagaacaauugaauga

SEQ ID NO: 513033 - RNA, 19 nt, Homo sapiens
aaagaccauuccuuagaaa

SEQ ID NO: 513034 - RNA, 19 nt, Homo sapiens
cauccuggcuucaaagaca

SEQ ID NO: 513035 - RNA, 19 nt, Homo sapiens
uuucugaccuggaccauug

SEQ ID NO: 513036 - RNA, 19 nt, Homo sapiens
uaaaagcccugaaaaucuu

SEQ ID NO: 513037 - RNA, 19 nt, Homo sapiens
ggugcuggcuuacuuucuu

SEQ ID NO: 513038 - RNA, 19 nt, Homo sapiens
uccuguggcugguuacuua

SEQ ID NO: 513039 - RNA, 19 nt, Homo sapiens
ggaccauugugccaacaga

SEQ ID NO: 513040 - RNA, 19 nt, Homo sapiens
acaauuaagcguccauuug

SEQ ID NO: 513041 - RNA, 19 nt, Homo sapiens
gcccuuugaucccaagauu

SEQ ID NO: 513042 - RNA, 19 nt, Homo sapiens
gagauuucuuaucagguuu

SEQ ID NO: 513043 - RNA, 19 nt, Homo sapiens
uaaccagugccaugaauga

SEQ ID NO: 513044 - RNA, 19 nt, Homo sapiens
gagugaaguauaauccaua

SEQ ID NO: 513045 - RNA, 19 nt, Homo sapiens
caucaacagagaacaauug

SEQ ID NO: 513046 - RNA, 19 nt, Homo sapiens
gugaaucuguuacauaucg

SEQ ID NO: 513047 - RNA, 19 nt, Homo sapiens
aaagacaccaagagcauaa

SEQ ID NO: 513048 - RNA, 19 nt, Homo sapiens
ccguaaacgucgaaaguau

SEQ ID NO: 513049 - RNA, 19 nt, Homo sapiens
ugaacuagaugcagaccau

SEQ ID NO: 513050 - RNA, 19 nt, Homo sapiens
gaagucucauaccaauguu

SEQ ID NO: 513051 - RNA, 19 nt, Homo sapiens
cauaaccagugccaugaau

SEQ ID NO: 513052 - RNA, 19 nt, Homo sapiens
acaggaaugucuuaucaca

SEQ ID NO: 513053 - RNA, 19 nt, Homo sapiens
ggagaagcaugugaaucug

SEQ ID NO: 513054 - RNA, 19 nt, Homo sapiens
caguucagaucccuucuau

SEQ ID NO: 513055 - RNA, 19 nt, Homo sapiens
caauuaagcguccauuugg

SEQ ID NO: 513056 - RNA, 19 nt, Homo sapiens
aggagaagaugagagaauu

SEQ ID NO: 513057 - RNA, 19 nt, Homo sapiens
agaagcaugugaaucuguu

SEQ ID NO: 513058 - RNA, 19 nt, Homo sapiens
gaagcaugugaaucuguua

SEQ ID NO: 513059 - RNA, 19 nt, Homo sapiens
ugaagucucauaccaaugu

SEQ ID NO: 513060 - RNA, 19 nt, Homo sapiens
ucagugaugcccuugcuaa

SEQ ID NO: 513061 - RNA, 19 nt, Homo sapiens
agucuuuggugcuggcuua

SEQ ID NO: 513062 - RNA, 19 nt, Homo sapiens
gaagagcaagucucauuuu

SEQ ID NO: 513063 - RNA, 19 nt, Homo sapiens
uaauaucccacaauuggaa

SEQ ID NO: 513064 - RNA, 19 nt, Homo sapiens
agaccauccuggcuucaaa

SEQ ID NO: 513065 - RNA, 19 nt, Homo sapiens
gcaaacaggaaugucuuau

SEQ ID NO: 513066 - RNA, 19 nt, Homo sapiens
cuuaaagaaugaaguugga

SEQ ID NO: 513067 - RNA, 19 nt, Homo sapiens
gauguauggaucugaacua

SEQ ID NO: 513068 - RNA, 19 nt, Homo sapiens
ucaagaugucuacuuugua

SEQ ID NO: 513069 - RNA, 19 nt, Homo sapiens
aaacaagauggacagcuaa

SEQ ID NO: 513070 - RNA, 19 nt, Homo sapiens
ccauuuggagugaaguaua

SEQ ID NO: 513071 - RNA, 19 nt, Homo sapiens
acucaaacaugcacuuucu

SEQ ID NO: 513072 - RNA, 19 nt, Homo sapiens
acuuggcuaugaacuauaa

SEQ ID NO: 513073 - RNA, 19 nt, Homo sapiens
aagaugguauggaaacugu

SEQ ID NO: 513074 - RNA, 19 nt, Homo sapiens
auaccaauguucucucugu

SEQ ID NO: 513075 - RNA, 19 nt, Homo sapiens
caggaagccgaguaucuaa

SEQ ID NO: 513076 - RNA, 19 nt, Homo sapiens
ugacaucaacagagaacaa

SEQ ID NO: 513077 - RNA, 19 nt, Homo sapiens
gcauaaccagugccaugaa

SEQ ID NO: 513078 - RNA, 19 nt, Homo sapiens
ugaaagacaccaagagcau

SEQ ID NO: 513079 - RNA, 19 nt, Homo sapiens
caagauggacagcuaagag

SEQ ID NO: 513080 - RNA, 19 nt, Homo sapiens
ggaagaugguauggaaacu

SEQ ID NO: 513081 - RNA, 19 nt, Homo sapiens
uucaagaugucuacuuugu

SEQ ID NO: 513082 - RNA, 19 nt, Homo sapiens
aggaaugucuuaucacaac

SEQ ID NO: 513083 - RNA, 19 nt, Homo sapiens
caaacaggaaugucuuauc

SEQ ID NO: 513084 - RNA, 19 nt, Homo sapiens
gagaagcaugugaaucugu

SEQ ID NO: 513085 - RNA, 19 nt, Homo sapiens
gaagaugguauggaaacug

SEQ ID NO: 513086 - RNA, 19 nt, Homo sapiens
gaaugucuuaucacaacuu

SEQ ID NO: 513087 - RNA, 19 nt, Homo sapiens
cguaaacgucgaaaguauu

SEQ ID NO: 513088 - RNA, 19 nt, Homo sapiens
gaagcuagaucccaagauu

SEQ ID NO: 513089 - RNA, 19 nt, Homo sapiens
caaacuguaucuuccuuua

SEQ ID NO: 513090 - RNA, 19 nt, Homo sapiens
gaggauggcugaaguccaa

SEQ ID NO: 513091 - RNA, 19 nt, Homo sapiens
caaaggucaucgcagauaa

SEQ ID NO: 513092 - RNA, 19 nt, Homo sapiens
gggagaagcuagaugaaag

SEQ ID NO: 513093 - RNA, 19 nt, Homo sapiens
ccaaucccuucuccacuua

SEQ ID NO: 513094 - RNA, 19 nt, Homo sapiens
ggaguaaucgccugcauug

SEQ ID NO: 513095 - RNA, 19 nt, Homo sapiens
caucaucaaugccaaacaa

SEQ ID NO: 513096 - RNA, 19 nt, Homo sapiens
gagcacccguaucauuuau

SEQ ID NO: 513097 - RNA, 19 nt, Homo sapiens
guaucuuccuuuacuguuu

SEQ ID NO: 513098 - RNA, 19 nt, Homo sapiens
caucaaugccaaacaauga

SEQ ID NO: 513099 - RNA, 19 nt, Homo sapiens
gcuacaaagugacuaaugg

SEQ ID NO: 513100 - RNA, 19 nt, Homo sapiens
cagaacugcuacaaaguga

SEQ ID NO: 513101 - RNA, 19 nt, Homo sapiens
gccaaucccuucuccacuu

SEQ ID NO: 513102 - RNA, 19 nt, Homo sapiens
cagagcacccguaucauuu

SEQ ID NO: 513103 - RNA, 19 nt, Homo sapiens
gaagcuggcaucacugaga

SEQ ID NO: 513104 - RNA, 19 nt, Homo sapiens
gagaucagcccuggcauga

SEQ ID NO: 513105 - RNA, 19 nt, Homo sapiens
gcacccguaucauuuaugg

SEQ ID NO: 513106 - RNA, 19 nt, Homo sapiens
gagcucaucggcacucuga

SEQ ID NO: 513107 - RNA, 19 nt, Homo sapiens
ucagagcacccguaucauu

SEQ ID NO: 513108 - RNA, 19 nt, Homo sapiens
gcccuggcaugaucaaaga

SEQ ID NO: 513109 - RNA, 19 nt, Homo sapiens
ccacccaugugagggaaua

SEQ ID NO: 513110 - RNA, 19 nt, Homo sapiens
ggacaucaucaaugccaaa

SEQ ID NO: 513111 - RNA, 19 nt, Homo sapiens
ccaacaggcccaggaagua

SEQ ID NO: 513112 - RNA, 19 nt, Homo sapiens
agagagaaggcaugucuuu

SEQ ID NO: 513113 - RNA, 19 nt, Homo sapiens
cuauaaugguuggaacuaa

SEQ ID NO: 513114 - RNA, 19 nt, Homo sapiens
acaaaggucaucgcagaua

SEQ ID NO: 513115 - RNA, 19 nt, Homo sapiens
ggaaggcguggugggauuu

SEQ ID NO: 513116 - RNA, 19 nt, Homo sapiens
gagagaaggcaugucuuug

SEQ ID NO: 513117 - RNA, 19 nt, Homo sapiens
uggcaucacugagaagguu

SEQ ID NO: 513118 - RNA, 19 nt, Homo sapiens
gggaagcuggcaucacuga

SEQ ID NO: 513119 - RNA, 19 nt, Homo sapiens
agagcacccguaucauuua

SEQ ID NO: 513120 - RNA, 19 nt, Homo sapiens
gagccugugugggccauug

SEQ ID NO: 513121 - RNA, 19 nt, Homo sapiens
caucgcagauaacgugaag

SEQ ID NO: 513122 - RNA, 19 nt, Homo sapiens
gaacugcuacaaagugacu

SEQ ID NO: 513123 - RNA, 19 nt, Homo sapiens
aagcuggcaucacugagaa

SEQ ID NO: 513124 - RNA, 19 nt, Homo sapiens
gaaagggaagcuggcauca

SEQ ID NO: 513125 - RNA, 19 nt, Homo sapiens
ugauguggauggcuuccuu

SEQ ID NO: 513126 - RNA, 19 nt, Homo sapiens
aagggaagcuggcaucacu

SEQ ID NO: 513127 - RNA, 19 nt, Homo sapiens
gugccucugugcuguguau

SEQ ID NO: 513128 - RNA, 19 nt, Homo sapiens
cuucuccacuuacuauaau

SEQ ID NO: 513129 - RNA, 19 nt, Homo sapiens
cagccagccugauguggau

SEQ ID NO: 513130 - RNA, 19 nt, Homo sapiens
ugaaguccaacgucucuga

SEQ ID NO: 513131 - RNA, 19 nt, Homo sapiens
ggccucauccaaacuguau

SEQ ID NO: 513132 - RNA, 19 nt, Homo sapiens
ucagagagaaggcaugucu

SEQ ID NO: 513133 - RNA, 19 nt, Homo sapiens
ccaaacuguaucuuccuuu

SEQ ID NO: 513134 - RNA, 19 nt, Homo sapiens
cccaggaaguacacgagaa

SEQ ID NO: 513135 - RNA, 19 nt, Homo sapiens
cagcccagaagcccaguaa

SEQ ID NO: 513136 - RNA, 19 nt, Homo sapiens
gaaguccaacgucucugau

SEQ ID NO: 513137 - RNA, 19 nt, Homo sapiens
agagaaggcaugucuuugg

SEQ ID NO: 513138 - RNA, 19 nt, Homo sapiens
agugagggcagaagagaaa

SEQ ID NO: 513139 - RNA, 19 nt, Homo sapiens
ggguggugcuucccucaag

SEQ ID NO: 513140 - RNA, 19 nt, Homo sapiens
caacaggcccaggaaguac

SEQ ID NO: 513141 - RNA, 19 nt, Homo sapiens
ggagaagcuagaugaaagg

SEQ ID NO: 513142 - RNA, 19 nt, Homo sapiens
gcccagaagcccaguaacu

SEQ ID NO: 513143 - RNA, 19 nt, Homo sapiens
ccucugugcuguguaugug

SEQ ID NO: 513144 - RNA, 19 nt, Homo sapiens
cgaauucguggacaucauc

SEQ ID NO: 513145 - RNA, 19 nt, Homo sapiens
ucgcagauaacgugaagga

SEQ ID NO: 513146 - RNA, 19 nt, Homo sapiens
ucacugagaagguuguuuu

SEQ ID NO: 513147 - RNA, 19 nt, Homo sapiens
gcagaaaguggcccaugcu

SEQ ID NO: 513148 - RNA, 19 nt, Homo sapiens
gagcugauugggcagaaag

SEQ ID NO: 513149 - RNA, 19 nt, Homo sapiens
guaugugaaccacccaugu

SEQ ID NO: 513150 - RNA, 19 nt, Homo sapiens
ucugugcuguguaugugaa

SEQ ID NO: 513151 - RNA, 19 nt, Homo sapiens
gaaggcguggugggauuug

SEQ ID NO: 513152 - RNA, 19 nt, Homo sapiens
gcugaaguccaacgucucu

SEQ ID NO: 513153 - RNA, 19 nt, Homo sapiens
gacaaaggucaucgcagau

SEQ ID NO: 513154 - RNA, 19 nt, Homo sapiens
gcaagcagcuggaagauga

SEQ ID NO: 513155 - RNA, 19 nt, Homo sapiens
aagaugaacuggacaaaua

SEQ ID NO: 513156 - RNA, 19 nt, Homo sapiens
gaaaagcauugaugacuua

SEQ ID NO: 513157 - RNA, 19 nt, Homo sapiens
cgauaugacuuccauguaa

SEQ ID NO: 513158 - RNA, 19 nt, Homo sapiens
gaucagaccuugaaagcau

SEQ ID NO: 513159 - RNA, 19 nt, Homo sapiens
gauaugacuuccauguaaa

SEQ ID NO: 513160 - RNA, 19 nt, Homo sapiens
cgacguagcuucucugaac

SEQ ID NO: 513161 - RNA, 19 nt, Homo sapiens
ggaccacgcucucaacgau

SEQ ID NO: 513162 - RNA, 19 nt, Homo sapiens
gcggagaggucaguaacua

SEQ ID NO: 513163 - RNA, 19 nt, Homo sapiens
cauccacucugccugcuua

SEQ ID NO: 513164 - RNA, 19 nt, Homo sapiens
gagcuggugucacugcaaa

SEQ ID NO: 513165 - RNA, 19 nt, Homo sapiens
gcagaaggaagacagauau

SEQ ID NO: 513166 - RNA, 19 nt, Homo sapiens
ggagaggucaguaacuaaa

SEQ ID NO: 513167 - RNA, 19 nt, Homo sapiens
guaagcuggucaucauuga

SEQ ID NO: 513168 - RNA, 19 nt, Homo sapiens
gaaagaggcaaagcacauu

SEQ ID NO: 513169 - RNA, 19 nt, Homo sapiens
ugacuuccauguaaacguu

SEQ ID NO: 513170 - RNA, 19 nt, Homo sapiens
aagcauugaugacuuagaa

SEQ ID NO: 513171 - RNA, 19 nt, Homo sapiens
gcucugcauuugucuauuc

SEQ ID NO: 513172 - RNA, 19 nt, Homo sapiens
ucucugagcucugcauuug

SEQ ID NO: 513173 - RNA, 19 nt, Homo sapiens
gcucuucguuucaguguca

SEQ ID NO: 513174 - RNA, 19 nt, Homo sapiens
gagagaggcaugaaaguca

SEQ ID NO: 513175 - RNA, 19 nt, Homo sapiens
gaaggcagcagaugagagu

SEQ ID NO: 513176 - RNA, 19 nt, Homo sapiens
ggagcaagcagcuggaaga

SEQ ID NO: 513177 - RNA, 19 nt, Homo sapiens
gcuggaagaacaauuaaga

SEQ ID NO: 513178 - RNA, 19 nt, Homo sapiens
ucaaagaugcccaggagaa

SEQ ID NO: 513179 - RNA, 19 nt, Homo sapiens
gaagaugaacuggacaaau

SEQ ID NO: 513180 - RNA, 19 nt, Homo sapiens
ggaagacagauaugaggaa

SEQ ID NO: 513181 - RNA, 19 nt, Homo sapiens
gaaggaagacagauaugag

SEQ ID NO: 513182 - RNA, 19 nt, Homo sapiens
agaggucaguaacuaaauu

SEQ ID NO: 513183 - RNA, 19 nt, Homo sapiens
augaagagguggcccguaa

SEQ ID NO: 513184 - RNA, 19 nt, Homo sapiens
gaagaugccgaccgcaaau

SEQ ID NO: 513185 - RNA, 19 nt, Homo sapiens
caagggcaccgaagaugaa

SEQ ID NO: 513186 - RNA, 19 nt, Homo sapiens
gaacuggacaaauauucug

SEQ ID NO: 513187 - RNA, 19 nt, Homo sapiens
aagaugagcuggugucacu

SEQ ID NO: 513188 - RNA, 19 nt, Homo sapiens
ucguuucagugucaaauaa

SEQ ID NO: 513189 - RNA, 19 nt, Homo sapiens
gcauugaugacuuagaaga

SEQ ID NO: 513190 - RNA, 19 nt, Homo sapiens
acagcuggaagaacaauua

SEQ ID NO: 513191 - RNA, 19 nt, Homo sapiens
aaauggaaauucaggagau

SEQ ID NO: 513192 - RNA, 19 nt, Homo sapiens
gcuguacgcucagaaacug

SEQ ID NO: 513193 - RNA, 19 nt, Homo sapiens
gauaugaggaagagaucaa

SEQ ID NO: 513194 - RNA, 19 nt, Homo sapiens
agacagauaugaggaagag

SEQ ID NO: 513195 - RNA, 19 nt, Homo sapiens
ggagaacgccuuggaucga

SEQ ID NO: 513196 - RNA, 19 nt, Homo sapiens
agaagaagaugcagaugcu

SEQ ID NO: 513197 - RNA, 19 nt, Homo sapiens
ggaugucccaccucucuga

SEQ ID NO: 513198 - RNA, 19 nt, Homo sapiens
ucaacgauaugacuuccau

SEQ ID NO: 513199 - RNA, 19 nt, Homo sapiens
uaauggaucagaccuugaa

SEQ ID NO: 513200 - RNA, 19 nt, Homo sapiens
gaugaacuggacaaauauu

SEQ ID NO: 513201 - RNA, 19 nt, Homo sapiens
gagcucugcauuugucuau

SEQ ID NO: 513202 - RNA, 19 nt, Homo sapiens
gaauaauggaucagaccuu

SEQ ID NO: 513203 - RNA, 19 nt, Homo sapiens
ucaagaagaagaugcagau

SEQ ID NO: 513204 - RNA, 19 nt, Homo sapiens
ugaagaugccgaccgcaaa

SEQ ID NO: 513205 - RNA, 19 nt, Homo sapiens
auuaauggcugcagaggau

SEQ ID NO: 513206 - RNA, 19 nt, Homo sapiens
ucaagggcaccgaagauga

SEQ ID NO: 513207 - RNA, 19 nt, Homo sapiens
gaccuugaaagcauuaaug

SEQ ID NO: 513208 - RNA, 19 nt, Homo sapiens
gaggucaguaacuaaauug

SEQ ID NO: 513209 - RNA, 19 nt, Homo sapiens
ugaaagaggcaaagcacau

SEQ ID NO: 513210 - RNA, 19 nt, Homo sapiens
agaaggaagacagauauga

SEQ ID NO: 513211 - RNA, 19 nt, Homo sapiens
ugcugaagcucgacaagga

SEQ ID NO: 513212 - RNA, 19 nt, Homo sapiens
ggucaguaacuaaauugga

SEQ ID NO: 513213 - RNA, 19 nt, Homo sapiens
gagaggucaguaacuaaau

SEQ ID NO: 513214 - RNA, 19 nt, Homo sapiens
uccgacagcuggaagaaca

SEQ ID NO: 513215 - RNA, 19 nt, Homo sapiens
gaccacgcucucaacgaua

SEQ ID NO: 513216 - RNA, 19 nt, Homo sapiens
cccguaagcuggucaucau

SEQ ID NO: 513217 - RNA, 19 nt, Homo sapiens
ucugagcucugcauuuguc

SEQ ID NO: 513218 - RNA, 19 nt, Homo sapiens
uggacgccaucaagaagaa

SEQ ID NO: 513219 - RNA, 19 nt, Homo sapiens
cagcuggaagaacaauuaa

SEQ ID NO: 513220 - RNA, 19 nt, Homo sapiens
caggagauccaacugaaag

SEQ ID NO: 513221 - RNA, 19 nt, Homo sapiens
uaauggcugcagaggauaa

SEQ ID NO: 513222 - RNA, 19 nt, Homo sapiens
cgcagaaggaagacagaua

SEQ ID NO: 513223 - RNA, 19 nt, Homo sapiens
caaagaugcccaggagaag

SEQ ID NO: 513224 - RNA, 19 nt, Homo sapiens
cguaagcuggucaucauug

SEQ ID NO: 513225 - RNA, 19 nt, Homo sapiens
gaagagguggcccguaagc

SEQ ID NO: 513226 - RNA, 19 nt, Homo sapiens
gagaaggcagcagaugaga

SEQ ID NO: 513227 - RNA, 19 nt, Homo sapiens
gacguagcuucucugaaca

SEQ ID NO: 513228 - RNA, 19 nt, Homo sapiens
gacccugguucucucucuu

SEQ ID NO: 513229 - RNA, 19 nt, Homo sapiens
gagagugagagaggcauga

SEQ ID NO: 513230 - RNA, 19 nt, Homo sapiens
ggaagaugagcugguguca

SEQ ID NO: 513231 - RNA, 19 nt, Homo sapiens
gcucucaacgauaugacuu

SEQ ID NO: 513232 - RNA, 19 nt, Homo sapiens
agaaaagcauugaugacuu

SEQ ID NO: 513233 - RNA, 19 nt, Homo sapiens
cggagaggucaguaacuaa

SEQ ID NO: 513234 - RNA, 19 nt, Homo sapiens
uaaguacucgcagaaggaa

SEQ ID NO: 513235 - RNA, 19 nt, Homo sapiens
ucagaccuugaaagcauua

SEQ ID NO: 513236 - RNA, 19 nt, Homo sapiens
aaagaggcaaagcacauug

SEQ ID NO: 513237 - RNA, 19 nt, Homo sapiens
aggcggaggccgacaagaa

SEQ ID NO: 513238 - RNA, 19 nt, Homo sapiens
ggaaauucaggagauccaa

SEQ ID NO: 513239 - RNA, 19 nt, Homo sapiens
cugguucucucucuuagca

SEQ ID NO: 513240 - RNA, 19 nt, Homo sapiens
cuuacacccugcccucaug

SEQ ID NO: 513241 - RNA, 19 nt, Homo sapiens
gagugagagaggcaugaaa

SEQ ID NO: 513242 - RNA, 19 nt, Homo sapiens
cugagaaggcagcagauga

SEQ ID NO: 513243 - RNA, 19 nt, Homo sapiens
acagauaugaggaagagau

SEQ ID NO: 513244 - RNA, 19 nt, Homo sapiens
gcucucagaaggccaaguc

SEQ ID NO: 513245 - RNA, 19 nt, Homo sapiens
gagcaagcagcuggaagau

SEQ ID NO: 513246 - RNA, 19 nt, Homo sapiens
gaugccgaccgcaaauaug

SEQ ID NO: 513247 - RNA, 19 nt, Homo sapiens
cgaagaugaacuggacaaa

SEQ ID NO: 513248 - RNA, 19 nt, Homo sapiens
gagcgucuggcaacagcuu

SEQ ID NO: 513249 - RNA, 19 nt, Homo sapiens
ugagaaggcagcagaugag

SEQ ID NO: 513250 - RNA, 19 nt, Homo sapiens
cacccugcccucaugcuaa

SEQ ID NO: 513251 - RNA, 19 nt, Homo sapiens
agaagaugcagaugcugaa

SEQ ID NO: 513252 - RNA, 19 nt, Homo sapiens
uggcugcagaggauaagua

SEQ ID NO: 513253 - RNA, 19 nt, Homo sapiens
aagcuggucaucauugaga

SEQ ID NO: 513254 - RNA, 19 nt, Homo sapiens
gcacaucgcugaggauuca

SEQ ID NO: 513255 - RNA, 19 nt, Homo sapiens
gaaggaggcccaggagaaa

SEQ ID NO: 513256 - RNA, 19 nt, Homo sapiens
ggauucagaccgcaaauau

SEQ ID NO: 513257 - RNA, 19 nt, Homo sapiens
gaugagagcgagagaggaa

SEQ ID NO: 513258 - RNA, 19 nt, Homo sapiens
aagaggagaucaaacuguu

SEQ ID NO: 513259 - RNA, 19 nt, Homo sapiens
gaagaggagaucaaacugu

SEQ ID NO: 513260 - RNA, 19 nt, Homo sapiens
aaccaucgaugaccuagaa

SEQ ID NO: 513261 - RNA, 19 nt, Homo sapiens
ccaccaaagaagauaaaua

SEQ ID NO: 513262 - RNA, 19 nt, Homo sapiens
gagaagaaggccacugaug

SEQ ID NO: 513263 - RNA, 19 nt, Homo sapiens
ggaggagaacgucgagauu

SEQ ID NO: 513264 - RNA, 19 nt, Homo sapiens
ugaaggaggcccaggagaa

SEQ ID NO: 513265 - RNA, 19 nt, Homo sapiens
gacagaggaugagguggaa

SEQ ID NO: 513266 - RNA, 19 nt, Homo sapiens
agaggucuguggcaaaguu

SEQ ID NO: 513267 - RNA, 19 nt, Homo sapiens
gaagaaggccacugaugcu

SEQ ID NO: 513268 - RNA, 19 nt, Homo sapiens
ggaacucaacaaccuguga

SEQ ID NO: 513269 - RNA, 19 nt, Homo sapiens
agaagaagaugcagaugcu

SEQ ID NO: 513270 - RNA, 19 nt, Homo sapiens
ucaaacuguuggaggagaa

SEQ ID NO: 513271 - RNA, 19 nt, Homo sapiens
augaagagguggccaggaa

SEQ ID NO: 513272 - RNA, 19 nt, Homo sapiens
cuacagcccugcagaagcu

SEQ ID NO: 513273 - RNA, 19 nt, Homo sapiens
gaggagaacgucgagauuc

SEQ ID NO: 513274 - RNA, 19 nt, Homo sapiens
cagcaggcccuccagaaga

SEQ ID NO: 513275 - RNA, 19 nt, Homo sapiens
cgagaggucuguggcaaag

SEQ ID NO: 513276 - RNA, 19 nt, Homo sapiens
ccgagaaggcggcugauga

SEQ ID NO: 513277 - RNA, 19 nt, Homo sapiens
ucaagaagaagaugcagau

SEQ ID NO: 513278 - RNA, 19 nt, Homo sapiens
auucagaccgcaaauauga

SEQ ID NO: 513279 - RNA, 19 nt, Homo sapiens
agauggaacugcaggagau

SEQ ID NO: 513280 - RNA, 19 nt, Homo sapiens
ggccgaagccgacaagaag

SEQ ID NO: 513281 - RNA, 19 nt, Homo sapiens
gaaggaggccaagcacauc

SEQ ID NO: 513282 - RNA, 19 nt, Homo sapiens
aggaugagguggaaaagua

SEQ ID NO: 513283 - RNA, 19 nt, Homo sapiens
aggagaacgucgagauuca

SEQ ID NO: 513284 - RNA, 19 nt, Homo sapiens
ugcugaagcuggacaagga

SEQ ID NO: 513285 - RNA, 19 nt, Homo sapiens
caugaaggaugaggagaag

SEQ ID NO: 513286 - RNA, 19 nt, Homo sapiens
ccgagaagaaggccacuga

SEQ ID NO: 513287 - RNA, 19 nt, Homo sapiens
ugaaggaugaggagaagau

SEQ ID NO: 513288 - RNA, 19 nt, Homo sapiens
ccaugaaggaugaggagaa

SEQ ID NO: 513289 - RNA, 19 nt, Homo sapiens
ugaaggaggccaagcacau

SEQ ID NO: 513290 - RNA, 19 nt, Homo sapiens
uggacgccaucaagaagaa

SEQ ID NO: 513291 - RNA, 19 nt, Homo sapiens
gauucagaccgcaaauaug

SEQ ID NO: 513292 - RNA, 19 nt, Homo sapiens
agcaggcccuccagaagaa

SEQ ID NO: 513293 - RNA, 19 nt, Homo sapiens
gaaggaugaggagaagaug

SEQ ID NO: 513294 - RNA, 19 nt, Homo sapiens
gaaaaccaucgaugaccua

SEQ ID NO: 513295 - RNA, 19 nt, Homo sapiens
gagaaggcggcugaugaga

SEQ ID NO: 513296 - RNA, 19 nt, Homo sapiens
cgagaaggcggcugaugag

SEQ ID NO: 513297 - RNA, 19 nt, Homo sapiens
gcugagacccgagcagagu

SEQ ID NO: 513298 - RNA, 19 nt, Homo sapiens
gaagcuggugauccuggaa

SEQ ID NO: 513299 - RNA, 19 nt, Homo sapiens
uggagcaggccgagaagaa

SEQ ID NO: 513300 - RNA, 19 nt, Homo sapiens
ugagacccgagcagaguuu

SEQ ID NO: 513301 - RNA, 19 nt, Homo sapiens
ggagcaggccgagaagaag

SEQ ID NO: 513302 - RNA, 19 nt, Homo sapiens
agaagaugcagaugcugaa

SEQ ID NO: 513303 - RNA, 19 nt, Homo sapiens
gagcgagagaggaaugaag

SEQ ID NO: 513304 - RNA, 19 nt, Homo sapiens
gagagcgagagaggaauga

SEQ ID NO: 513305 - RNA, 19 nt, Homo sapiens
guaaacagcuggaggauga

SEQ ID NO: 513306 - RNA, 19 nt, Homo sapiens
caaagaagcuaagcacauu

SEQ ID NO: 513307 - RNA, 19 nt, Homo sapiens
ugacaugaccucuauauaa

SEQ ID NO: 513308 - RNA, 19 nt, Homo sapiens
gacaugaccucuauauaau

SEQ ID NO: 513309 - RNA, 19 nt, Homo sapiens
guaaguuggugaucauuga

SEQ ID NO: 513310 - RNA, 19 nt, Homo sapiens
ucaaugacaugaccucuau

SEQ ID NO: 513311 - RNA, 19 nt, Homo sapiens
ggaaauccaacucaaagaa

SEQ ID NO: 513312 - RNA, 19 nt, Homo sapiens
gacaauugaugaccuggaa

SEQ ID NO: 513313 - RNA, 19 nt, Homo sapiens
gaagcaggcagaagaaaga

SEQ ID NO: 513314 - RNA, 19 nt, Homo sapiens
agagguggcucguaaguug

SEQ ID NO: 513315 - RNA, 19 nt, Homo sapiens
caacagccacugcucauga

SEQ ID NO: 513316 - RNA, 19 nt, Homo sapiens
gagagagguaugaagguua

SEQ ID NO: 513317 - RNA, 19 nt, Homo sapiens
cccagaaacugaaguacaa

SEQ ID NO: 513318 - RNA, 19 nt, Homo sapiens
uugaugaccuggaagauga

SEQ ID NO: 513319 - RNA, 19 nt, Homo sapiens
gguaugaagguuauugaaa

SEQ ID NO: 513320 - RNA, 19 nt, Homo sapiens
cuaccagagugauggauuu

SEQ ID NO: 513321 - RNA, 19 nt, Homo sapiens
augaagagguggcucguaa

SEQ ID NO: 513322 - RNA, 19 nt, Homo sapiens
cuaagcacauugcagaaga

SEQ ID NO: 513323 - RNA, 19 nt, Homo sapiens
gaaguuagacaaggagaau

SEQ ID NO: 513324 - RNA, 19 nt, Homo sapiens
gcucguaaguuggugauca

SEQ ID NO: 513325 - RNA, 19 nt, Homo sapiens
gcagaagcaggcagaagaa

SEQ ID NO: 513326 - RNA, 19 nt, Homo sapiens
ugagagagguaugaagguu

SEQ ID NO: 513327 - RNA, 19 nt, Homo sapiens
gaaauccaacucaaagaag

SEQ ID NO: 513328 - RNA, 19 nt, Homo sapiens
caaggagaaugcucuggau

SEQ ID NO: 513329 - RNA, 19 nt, Homo sapiens
guacagguuacucaggaua

SEQ ID NO: 513330 - RNA, 19 nt, Homo sapiens
ccagagugauggauuuagu

SEQ ID NO: 513331 - RNA, 19 nt, Homo sapiens
gaagagguggcucguaagu

SEQ ID NO: 513332 - RNA, 19 nt, Homo sapiens
agagagguaugaagguuau

SEQ ID NO: 513333 - RNA, 19 nt, Homo sapiens
gaugagagugagagaggua

SEQ ID NO: 513334 - RNA, 19 nt, Homo sapiens
ugaaagggacagaggauga

SEQ ID NO: 513335 - RNA, 19 nt, Homo sapiens
agaugcagaugcugaaguu

SEQ ID NO: 513336 - RNA, 19 nt, Homo sapiens
ugacuuauguaaucaaagc

SEQ ID NO: 513337 - RNA, 19 nt, Homo sapiens
ccaggaaauccaacucaaa

SEQ ID NO: 513338 - RNA, 19 nt, Homo sapiens
ugagcucuaugcccagaaa

SEQ ID NO: 513339 - RNA, 19 nt, Homo sapiens
ccuggaagaugagcucuau

SEQ ID NO: 513340 - RNA, 19 nt, Homo sapiens
gcagaagaaagaaguaaac

SEQ ID NO: 513341 - RNA, 19 nt, Homo sapiens
ucaaagaagcuaagcacau

SEQ ID NO: 513342 - RNA, 19 nt, Homo sapiens
gagguaugaagguuauuga

SEQ ID NO: 513343 - RNA, 19 nt, Homo sapiens
cauuuaaacucagcugauc

SEQ ID NO: 513344 - RNA, 19 nt, Homo sapiens
gcaggcagaagaaagaagu

SEQ ID NO: 513345 - RNA, 19 nt, Homo sapiens
cagagugauggauuuagua

SEQ ID NO: 513346 - RNA, 19 nt, Homo sapiens
gagagugagagagguauga

SEQ ID NO: 513347 - RNA, 19 nt, Homo sapiens
caccguuucugcucuguuc

SEQ ID NO: 513348 - RNA, 19 nt, Homo sapiens
caauugaugaccuggaaga

SEQ ID NO: 513349 - RNA, 19 nt, Homo sapiens
ugcagaugcugaaguuaga

SEQ ID NO: 513350 - RNA, 19 nt, Homo sapiens
gcugaacaagauuaaauuc

SEQ ID NO: 513351 - RNA, 19 nt, Homo sapiens
caggaaauccaacucaaag

SEQ ID NO: 513352 - RNA, 19 nt, Homo sapiens
ucaagcugaacaagauuaa

SEQ ID NO: 513353 - RNA, 19 nt, Homo sapiens
ugaaguacaaggccauuag

SEQ ID NO: 513354 - RNA, 19 nt, Homo sapiens
uggcagagucuaaguguuc

SEQ ID NO: 513355 - RNA, 19 nt, Homo sapiens
ggcagaagaaagaaguaaa

SEQ ID NO: 513356 - RNA, 19 nt, Homo sapiens
ggaccacgcccucaaugac

SEQ ID NO: 513357 - RNA, 19 nt, Homo sapiens
ggaacuccaggaaauccaa

SEQ ID NO: 513358 - RNA, 19 nt, Homo sapiens
gaaagggacagaggaugag

SEQ ID NO: 513359 - RNA, 19 nt, Homo sapiens
gaccacgcccucaaugaca

SEQ ID NO: 513360 - RNA, 19 nt, Homo sapiens
gcccagaaacugaaguaca

SEQ ID NO: 513361 - RNA, 19 nt, Homo sapiens
ccucugacuuauguaauca

SEQ ID NO: 513362 - RNA, 19 nt, Homo sapiens
caggugagccuaccaacag

SEQ ID NO: 513363 - RNA, 19 nt, Homo sapiens
uaccagagugauggauuua

SEQ ID NO: 513364 - RNA, 19 nt, Homo sapiens
uuucugcucuguucuggau

SEQ ID NO: 513365 - RNA, 19 nt, Homo sapiens
agugauggauuuaguacag

SEQ ID NO: 513366 - RNA, 19 nt, Homo sapiens
aaugacaugaccucuauau

SEQ ID NO: 513367 - RNA, 19 nt, Homo sapiens
uaagcacauugcagaagag

SEQ ID NO: 513368 - RNA, 19 nt, Homo sapiens
uccucaagcugaacaagau

SEQ ID NO: 513369 - RNA, 19 nt, Homo sapiens
gcugaaagggacagaggau

SEQ ID NO: 513370 - RNA, 19 nt, Homo sapiens
gcuggcagagucuaagugu

SEQ ID NO: 513371 - RNA, 19 nt, Homo sapiens
uaaguuggugaucauugaa

SEQ ID NO: 513372 - RNA, 19 nt, Homo sapiens
uccaggaaauccaacucaa

SEQ ID NO: 513373 - RNA, 19 nt, Homo sapiens
cuccaguucuccaguguuc

SEQ ID NO: 513374 - RNA, 19 nt, Homo sapiens
gaaguacaaggccauuagc

SEQ ID NO: 513375 - RNA, 19 nt, Homo sapiens
gagcagaagcaggcagaag

SEQ ID NO: 513376 - RNA, 19 nt, Homo sapiens
cagaagaaagaaguaaaca

SEQ ID NO: 513377 - RNA, 19 nt, Homo sapiens
gcuaagcacauugcagaag

SEQ ID NO: 513378 - RNA, 19 nt, Homo sapiens
cagaagcaggcagaagaaa

SEQ ID NO: 513379 - RNA, 19 nt, Homo sapiens
gaugcagaugcugaaguua

SEQ ID NO: 513380 - RNA, 19 nt, Homo sapiens
caaagaagcuaagcacauu

SEQ ID NO: 513381 - RNA, 19 nt, Homo sapiens
ggagaaagagaaaucaaua

SEQ ID NO: 513382 - RNA, 19 nt, Homo sapiens
ggagaaaucuugaauagcu

SEQ ID NO: 513383 - RNA, 19 nt, Homo sapiens
gaagugccaucucaauugu

SEQ ID NO: 513384 - RNA, 19 nt, Homo sapiens
guaaguuggugaucauuga

SEQ ID NO: 513385 - RNA, 19 nt, Homo sapiens
ggaguuagccaaacaacaa

SEQ ID NO: 513386 - RNA, 19 nt, Homo sapiens
gaagaaaaguacucucaaa

SEQ ID NO: 513387 - RNA, 19 nt, Homo sapiens
gaagauaaacugaaaugca

SEQ ID NO: 513388 - RNA, 19 nt, Homo sapiens
ggaaauccaacucaaagaa

SEQ ID NO: 513389 - RNA, 19 nt, Homo sapiens
uugaugaccuggaagauaa

SEQ ID NO: 513390 - RNA, 19 nt, Homo sapiens
ggauccagcugguugaaga

SEQ ID NO: 513391 - RNA, 19 nt, Homo sapiens
gaaagagaaaucaauagug

SEQ ID NO: 513392 - RNA, 19 nt, Homo sapiens
gacaauugaugaccuggaa

SEQ ID NO: 513393 - RNA, 19 nt, Homo sapiens
agagguggcucguaaguug

SEQ ID NO: 513394 - RNA, 19 nt, Homo sapiens
ccucacaacugcuuacaga

SEQ ID NO: 513395 - RNA, 19 nt, Homo sapiens
gaaaccucauuguucugua

SEQ ID NO: 513396 - RNA, 19 nt, Homo sapiens
aaacugaaaugcaccaaag

SEQ ID NO: 513397 - RNA, 19 nt, Homo sapiens
gaaagaaagaagacugugu

SEQ ID NO: 513398 - RNA, 19 nt, Homo sapiens
gagagagguaugaagguua

SEQ ID NO: 513399 - RNA, 19 nt, Homo sapiens
gcaguuuguugaucuuuua

SEQ ID NO: 513400 - RNA, 19 nt, Homo sapiens
ccuggaagauaaacugaaa

SEQ ID NO: 513401 - RNA, 19 nt, Homo sapiens
gguaugaagguuauugaaa

SEQ ID NO: 513402 - RNA, 19 nt, Homo sapiens
gagaaaucuugaauagcuu

SEQ ID NO: 513403 - RNA, 19 nt, Homo sapiens
ggugaccacuuaauugcuu

SEQ ID NO: 513404 - RNA, 19 nt, Homo sapiens
augaagagguggcucguaa

SEQ ID NO: 513405 - RNA, 19 nt, Homo sapiens
cuaagcacauugcagaaga

SEQ ID NO: 513406 - RNA, 19 nt, Homo sapiens
uaagaccucugagaccaaa

SEQ ID NO: 513407 - RNA, 19 nt, Homo sapiens
gcucguaaguuggugauca

SEQ ID NO: 513408 - RNA, 19 nt, Homo sapiens
gcgagaaguugagggagaa

SEQ ID NO: 513409 - RNA, 19 nt, Homo sapiens
ugagagagguaugaagguu

SEQ ID NO: 513410 - RNA, 19 nt, Homo sapiens
cuggagaaaucuugaauag

SEQ ID NO: 513411 - RNA, 19 nt, Homo sapiens
gaaauccaacucaaagaag

SEQ ID NO: 513412 - RNA, 19 nt, Homo sapiens
cacaacugcuuacagaaug

SEQ ID NO: 513413 - RNA, 19 nt, Homo sapiens
gaagagguggcucguaagu

SEQ ID NO: 513414 - RNA, 19 nt, Homo sapiens
agagagguaugaagguuau

SEQ ID NO: 513415 - RNA, 19 nt, Homo sapiens
gaugagagugagagaggua

SEQ ID NO: 513416 - RNA, 19 nt, Homo sapiens
ucaauugugcuuuguauca

SEQ ID NO: 513417 - RNA, 19 nt, Homo sapiens
aaagaaagaagacuguguu

SEQ ID NO: 513418 - RNA, 19 nt, Homo sapiens
aaaaugugcuguucaaguu

SEQ ID NO: 513419 - RNA, 19 nt, Homo sapiens
gagaaagagaaaucaauag

SEQ ID NO: 513420 - RNA, 19 nt, Homo sapiens
gcugcugucucuagaagug

SEQ ID NO: 513421 - RNA, 19 nt, Homo sapiens
guguacauccugcagcuua

SEQ ID NO: 513422 - RNA, 19 nt, Homo sapiens
agaagugccaucucaauug

SEQ ID NO: 513423 - RNA, 19 nt, Homo sapiens
guuugaagcugcugucucu

SEQ ID NO: 513424 - RNA, 19 nt, Homo sapiens
auguugaggugaccacuua

SEQ ID NO: 513425 - RNA, 19 nt, Homo sapiens
aguacuagcuaaaccagaa

SEQ ID NO: 513426 - RNA, 19 nt, Homo sapiens
ugaagcugcugucucuaga

SEQ ID NO: 513427 - RNA, 19 nt, Homo sapiens
gauacugaauauugacaag

SEQ ID NO: 513428 - RNA, 19 nt, Homo sapiens
gcuggagaaaucuugaaua

SEQ ID NO: 513429 - RNA, 19 nt, Homo sapiens
agucagugcuggagaaauc

SEQ ID NO: 513430 - RNA, 19 nt, Homo sapiens
ccacugauuuagccaugug

SEQ ID NO: 513431 - RNA, 19 nt, Homo sapiens
ucacaacugcuuacagaau

SEQ ID NO: 513432 - RNA, 19 nt, Homo sapiens
aaaagcauguugugaugua

SEQ ID NO: 513433 - RNA, 19 nt, Homo sapiens
ccaggaaauccaacucaaa

SEQ ID NO: 513434 - RNA, 19 nt, Homo sapiens
ucucaauugugcuuuguau

SEQ ID NO: 513435 - RNA, 19 nt, Homo sapiens
ugaggugaccacuuaauug

SEQ ID NO: 513436 - RNA, 19 nt, Homo sapiens
uagaagugccaucucaauu

SEQ ID NO: 513437 - RNA, 19 nt, Homo sapiens
ggaaaccucauuguucugu

SEQ ID NO: 513438 - RNA, 19 nt, Homo sapiens
gggagaaagagaaaucaau

SEQ ID NO: 513439 - RNA, 19 nt, Homo sapiens
guucaaguuuucagcuuua

SEQ ID NO: 513440 - RNA, 19 nt, Homo sapiens
caaacugucucugccucuu

SEQ ID NO: 513441 - RNA, 19 nt, Homo sapiens
ucaaagaagcuaagcacau

SEQ ID NO: 513442 - RNA, 19 nt, Homo sapiens
gcaacuguuuugauacuga

SEQ ID NO: 513443 - RNA, 19 nt, Homo sapiens
ggaggucuguuagguguac

SEQ ID NO: 513444 - RNA, 19 nt, Homo sapiens
ugugaaacucaucucauua

SEQ ID NO: 513445 - RNA, 19 nt, Homo sapiens
gaugguaagaccucugaga

SEQ ID NO: 513446 - RNA, 19 nt, Homo sapiens
ugggaaaccucauuguucu

SEQ ID NO: 513447 - RNA, 19 nt, Homo sapiens
gugggaaaccucauuguuc

SEQ ID NO: 513448 - RNA, 19 nt, Homo sapiens
gagguaugaagguuauuga

SEQ ID NO: 513449 - RNA, 19 nt, Homo sapiens
gcuggcaguuuguugaucu

SEQ ID NO: 513450 - RNA, 19 nt, Homo sapiens
gagagugagagagguauga

SEQ ID NO: 513451 - RNA, 19 nt, Homo sapiens
aagaaccagucccuccaaa

SEQ ID NO: 513452 - RNA, 19 nt, Homo sapiens
guuucuaggaggucuguua

SEQ ID NO: 513453 - RNA, 19 nt, Homo sapiens
gaagcugcugucucuagaa

SEQ ID NO: 513454 - RNA, 19 nt, Homo sapiens
augugaaacucaucucauu

SEQ ID NO: 513455 - RNA, 19 nt, Homo sapiens
caauugaugaccuggaaga

SEQ ID NO: 513456 - RNA, 19 nt, Homo sapiens
gaaccugaagugucugagu

SEQ ID NO: 513457 - RNA, 19 nt, Homo sapiens
aaucaauagugcaacuguu

SEQ ID NO: 513458 - RNA, 19 nt, Homo sapiens
agaaaucaauagugcaacu

SEQ ID NO: 513459 - RNA, 19 nt, Homo sapiens
caggaaauccaacucaaag

SEQ ID NO: 513460 - RNA, 19 nt, Homo sapiens
ccaucucaauugugcuuug

SEQ ID NO: 513461 - RNA, 19 nt, Homo sapiens
uacugaauauugacaagug

SEQ ID NO: 513462 - RNA, 19 nt, Homo sapiens
agagaaaucaauagugcaa

SEQ ID NO: 513463 - RNA, 19 nt, Homo sapiens
acucaucucauuacccuuu

SEQ ID NO: 513464 - RNA, 19 nt, Homo sapiens
gaggugaccacuuaauugc

SEQ ID NO: 513465 - RNA, 19 nt, Homo sapiens
uaaacugaaaugcaccaaa

SEQ ID NO: 513466 - RNA, 19 nt, Homo sapiens
uagugcaacuguuuugaua

SEQ ID NO: 513467 - RNA, 19 nt, Homo sapiens
ggaacuccaggaaauccaa

SEQ ID NO: 513468 - RNA, 19 nt, Homo sapiens
gugaaacucaucucauuac

SEQ ID NO: 513469 - RNA, 19 nt, Homo sapiens
ccaggaggaguuagccaaa

SEQ ID NO: 513470 - RNA, 19 nt, Homo sapiens
aaccggagcgcgagcagua

SEQ ID NO: 513471 - RNA, 19 nt, Homo sapiens
caaaguacuagcuaaacca

SEQ ID NO: 513472 - RNA, 19 nt, Homo sapiens
aaaccucauuguucuguac

SEQ ID NO: 513473 - RNA, 19 nt, Homo sapiens
gaaaucaauagugcaacug

SEQ ID NO: 513474 - RNA, 19 nt, Homo sapiens
gaaagaaagaaagaagacu

SEQ ID NO: 513475 - RNA, 19 nt, Homo sapiens
guagcaaccauuuguaaaa

SEQ ID NO: 513476 - RNA, 19 nt, Homo sapiens
guacauccugcagcuuauu

SEQ ID NO: 513477 - RNA, 19 nt, Homo sapiens
ucuaggaggucuguuaggu

SEQ ID NO: 513478 - RNA, 19 nt, Homo sapiens
aagaaagaagacuguguuu

SEQ ID NO: 513479 - RNA, 19 nt, Homo sapiens
gugaccacuuaauugcuuu

SEQ ID NO: 513480 - RNA, 19 nt, Homo sapiens
ggacaaauaugaagaagaa

SEQ ID NO: 513481 - RNA, 19 nt, Homo sapiens
ggaaaugucaagcaaauua

SEQ ID NO: 513482 - RNA, 19 nt, Homo sapiens
gaaaccaugucucuacuaa

SEQ ID NO: 513483 - RNA, 19 nt, Homo sapiens
ggaagaggcugaccgcaaa

SEQ ID NO: 513484 - RNA, 19 nt, Homo sapiens
gaagaacucaagaauguua

SEQ ID NO: 513485 - RNA, 19 nt, Homo sapiens
guagaaugcuugggaaaua

SEQ ID NO: 513486 - RNA, 19 nt, Homo sapiens
ggacaaacaucuucucaag

SEQ ID NO: 513487 - RNA, 19 nt, Homo sapiens
gaccacaagucauuacuaa

SEQ ID NO: 513488 - RNA, 19 nt, Homo sapiens
aagaagaacucaagaaugu

SEQ ID NO: 513489 - RNA, 19 nt, Homo sapiens
gcaggaauaugguggaguu

SEQ ID NO: 513490 - RNA, 19 nt, Homo sapiens
ggacagggcucaggaacga

SEQ ID NO: 513491 - RNA, 19 nt, Homo sapiens
cgagaaagcugaaggugau

SEQ ID NO: 513492 - RNA, 19 nt, Homo sapiens
ggaaugaaggugauagaaa

SEQ ID NO: 513493 - RNA, 19 nt, Homo sapiens
gaagaagaacucaagaaug

SEQ ID NO: 513494 - RNA, 19 nt, Homo sapiens
gaaugaaggugauagaaaa

SEQ ID NO: 513495 - RNA, 19 nt, Homo sapiens
ggaagaagaacucaagaau

SEQ ID NO: 513496 - RNA, 19 nt, Homo sapiens
caacuucauuuccauacuu

SEQ ID NO: 513497 - RNA, 19 nt, Homo sapiens
gagcaccaguuaaaucuca

SEQ ID NO: 513498 - RNA, 19 nt, Homo sapiens
acaaacaucuucucaagca

SEQ ID NO: 513499 - RNA, 19 nt, Homo sapiens
ggcaggguauuuccuagua

SEQ ID NO: 513500 - RNA, 19 nt, Homo sapiens
gacaauugaugaccuggaa

SEQ ID NO: 513501 - RNA, 19 nt, Homo sapiens
ggaggugucugaacuaaaa

SEQ ID NO: 513502 - RNA, 19 nt, Homo sapiens
gcaggguauuuccuaguaa

SEQ ID NO: 513503 - RNA, 19 nt, Homo sapiens
uaaaguuguucucugaaga

SEQ ID NO: 513504 - RNA, 19 nt, Homo sapiens
gcauauuuccuucauucua

SEQ ID NO: 513505 - RNA, 19 nt, Homo sapiens
caucuucgcuuugcuggaa

SEQ ID NO: 513506 - RNA, 19 nt, Homo sapiens
cuaacaaucugaaaucucu

SEQ ID NO: 513507 - RNA, 19 nt, Homo sapiens
guggugaccuggaagaaga

SEQ ID NO: 513508 - RNA, 19 nt, Homo sapiens
gaacagcaaauugaggauu

SEQ ID NO: 513509 - RNA, 19 nt, Homo sapiens
acagauagaucaaccuaag

SEQ ID NO: 513510 - RNA, 19 nt, Homo sapiens
agucauaauuacccacaua

SEQ ID NO: 513511 - RNA, 19 nt, Homo sapiens
gcggaggugucugaacuaa

SEQ ID NO: 513512 - RNA, 19 nt, Homo sapiens
ccacaagucauuacuaagu

SEQ ID NO: 513513 - RNA, 19 nt, Homo sapiens
gcaggaggaucgcuugaac

SEQ ID NO: 513514 - RNA, 19 nt, Homo sapiens
ccuguaaucccaacacuuu

SEQ ID NO: 513515 - RNA, 19 nt, Homo sapiens
guaagaaguuccuuuuguu

SEQ ID NO: 513516 - RNA, 19 nt, Homo sapiens
ggaggacaaauaugaagaa

SEQ ID NO: 513517 - RNA, 19 nt, Homo sapiens
cacaagucauuacuaaguu

SEQ ID NO: 513518 - RNA, 19 nt, Homo sapiens
caaaagaccacaagucauu

SEQ ID NO: 513519 - RNA, 19 nt, Homo sapiens
caauucaggucagccauau

SEQ ID NO: 513520 - RNA, 19 nt, Homo sapiens
gggaaauagucauaauuac

SEQ ID NO: 513521 - RNA, 19 nt, Homo sapiens
uaagguaggcaggguauuu

SEQ ID NO: 513522 - RNA, 19 nt, Homo sapiens
cauaauuacccacauauag

SEQ ID NO: 513523 - RNA, 19 nt, Homo sapiens
gcuauugugggaagucaua

SEQ ID NO: 513524 - RNA, 19 nt, Homo sapiens
gcuuugagcaccaguuaaa

SEQ ID NO: 513525 - RNA, 19 nt, Homo sapiens
gaacucaagaauguuacua

SEQ ID NO: 513526 - RNA, 19 nt, Homo sapiens
gcugaagaccauaaccuuu

SEQ ID NO: 513527 - RNA, 19 nt, Homo sapiens
uugaugaccuggaagagaa

SEQ ID NO: 513528 - RNA, 19 nt, Homo sapiens
aggagaagauggagauuca

SEQ ID NO: 513529 - RNA, 19 nt, Homo sapiens
ucagggaacagcaaauuga

SEQ ID NO: 513530 - RNA, 19 nt, Homo sapiens
ggaauaugguggaguucag

SEQ ID NO: 513531 - RNA, 19 nt, Homo sapiens
uaauugauccuugauguga

SEQ ID NO: 513532 - RNA, 19 nt, Homo sapiens
ccacagauagaucaaccua

SEQ ID NO: 513533 - RNA, 19 nt, Homo sapiens
gaccagggaccaucacaug

SEQ ID NO: 513534 - RNA, 19 nt, Homo sapiens
aaacuggcccaacuucauu

SEQ ID NO: 513535 - RNA, 19 nt, Homo sapiens
ccacucagcaggaauaugg

SEQ ID NO: 513536 - RNA, 19 nt, Homo sapiens
gaacgugggcuuacaucag

SEQ ID NO: 513537 - RNA, 19 nt, Homo sapiens
gaaacuugcccaggccaaa

SEQ ID NO: 513538 - RNA, 19 nt, Homo sapiens
gucuuucucuucucuugua

SEQ ID NO: 513539 - RNA, 19 nt, Homo sapiens
acaagucauuacuaaguug

SEQ ID NO: 513540 - RNA, 19 nt, Homo sapiens
ccaauucaggucagccaua

SEQ ID NO: 513541 - RNA, 19 nt, Homo sapiens
agacggaggccauuugguu

SEQ ID NO: 513542 - RNA, 19 nt, Homo sapiens
gaaguuccuuuuguuauug

SEQ ID NO: 513543 - RNA, 19 nt, Homo sapiens
ucaaagaggccaagcacau

SEQ ID NO: 513544 - RNA, 19 nt, Homo sapiens
gacacuggaucagacacua

SEQ ID NO: 513545 - RNA, 19 nt, Homo sapiens
ggaguucaguccaauucag

SEQ ID NO: 513546 - RNA, 19 nt, Homo sapiens
cuggaaaugucaagcaaau

SEQ ID NO: 513547 - RNA, 19 nt, Homo sapiens
gaagagaacgugggcuuac

SEQ ID NO: 513548 - RNA, 19 nt, Homo sapiens
gcagagagaacgguugcaa

SEQ ID NO: 513549 - RNA, 19 nt, Homo sapiens
gacccacucagcaggaaua

SEQ ID NO: 513550 - RNA, 19 nt, Homo sapiens
uugcauauuuccuucauuc

SEQ ID NO: 513551 - RNA, 19 nt, Homo sapiens
agacugcagugagccgaua

SEQ ID NO: 513552 - RNA, 19 nt, Homo sapiens
gauccuugaugugauguuc

SEQ ID NO: 513553 - RNA, 19 nt, Homo sapiens
agauggagauucaggagau

SEQ ID NO: 513554 - RNA, 19 nt, Homo sapiens
ggaaauagucauaauuacc

SEQ ID NO: 513555 - RNA, 19 nt, Homo sapiens
gaagucauaacccacagau

SEQ ID NO: 513556 - RNA, 19 nt, Homo sapiens
aacgugggcuuacaucaga

SEQ ID NO: 513557 - RNA, 19 nt, Homo sapiens
gugcggaggugucugaacu

SEQ ID NO: 513558 - RNA, 19 nt, Homo sapiens
gcgaaaccaugucucuacu

SEQ ID NO: 513559 - RNA, 19 nt, Homo sapiens
ggccaggacagaucacuug

SEQ ID NO: 513560 - RNA, 19 nt, Homo sapiens
agucauaacccacagauag

SEQ ID NO: 513561 - RNA, 19 nt, Homo sapiens
aaaaggaggacaaauauga

SEQ ID NO: 513562 - RNA, 19 nt, Homo sapiens
gaugagagugagagaggaa

SEQ ID NO: 513563 - RNA, 19 nt, Homo sapiens
aggauuuacuuaucuagga

SEQ ID NO: 513564 - RNA, 19 nt, Homo sapiens
gaaguggagacugcaguga

SEQ ID NO: 513565 - RNA, 19 nt, Homo sapiens
aaccaugucucuacuaaaa

SEQ ID NO: 513566 - RNA, 19 nt, Homo sapiens
aagcauacuuucuuaagac

SEQ ID NO: 513567 - RNA, 19 nt, Homo sapiens
uagcauuuauuccuaaggu

SEQ ID NO: 513568 - RNA, 19 nt, Homo sapiens
ucuggaggcugcaucugaa

SEQ ID NO: 513569 - RNA, 19 nt, Homo sapiens
gaccagcccagccaacaug

SEQ ID NO: 513570 - RNA, 19 nt, Homo sapiens
uagaaugcuugggaaauag

SEQ ID NO: 513571 - RNA, 19 nt, Homo sapiens
gagagugagagaggaauga

SEQ ID NO: 513572 - RNA, 19 nt, Homo sapiens
uuauugccaucuucgcuuu

SEQ ID NO: 513573 - RNA, 19 nt, Homo sapiens
gaggacaaauaugaagaag

SEQ ID NO: 513574 - RNA, 19 nt, Homo sapiens
gaggaaugaaggugauaga

SEQ ID NO: 513575 - RNA, 19 nt, Homo sapiens
agauagaucaaccuaagaa

SEQ ID NO: 513576 - RNA, 19 nt, Homo sapiens
caucagacacuggaucaga

SEQ ID NO: 513577 - RNA, 19 nt, Homo sapiens
caauugaugaccuggaaga

SEQ ID NO: 513578 - RNA, 19 nt, Homo sapiens
aaaggaggacaaauaugaa

SEQ ID NO: 513579 - RNA, 19 nt, Homo sapiens
ggagaugcagcucaaagag

SEQ ID NO: 513580 - RNA, 19 nt, Homo sapiens
gaacaaacauucccaaauu

SEQ ID NO: 513581 - RNA, 19 nt, Homo sapiens
gaacuucacuugacauuga

SEQ ID NO: 513582 - RNA, 19 nt, Homo sapiens
ggacaaauauuggcaaauu

SEQ ID NO: 513583 - RNA, 19 nt, Homo sapiens
uguguuaccuguacaauua

SEQ ID NO: 513584 - RNA, 19 nt, Homo sapiens
gacaucagcuauuaaagaa

SEQ ID NO: 513585 - RNA, 19 nt, Homo sapiens
gagaggagauuaugaugug

SEQ ID NO: 513586 - RNA, 19 nt, Homo sapiens
acaaggacaucagcuauua

SEQ ID NO: 513587 - RNA, 19 nt, Homo sapiens
ggacaucagcuauuaaaga

SEQ ID NO: 513588 - RNA, 19 nt, Homo sapiens
ggaugguuguguauuauaa

SEQ ID NO: 513589 - RNA, 19 nt, Homo sapiens
gaucuucccaggacaaaua

SEQ ID NO: 513590 - RNA, 19 nt, Homo sapiens
gaaaagcgguugagaugaa

SEQ ID NO: 513591 - RNA, 19 nt, Homo sapiens
ccagagauaugucuuguca

SEQ ID NO: 513592 - RNA, 19 nt, Homo sapiens
gaaccaaaguauuuaagag

SEQ ID NO: 513593 - RNA, 19 nt, Homo sapiens
gaacaaggacaucagcuau

SEQ ID NO: 513594 - RNA, 19 nt, Homo sapiens
gaaagauuaugccuaugug

SEQ ID NO: 513595 - RNA, 19 nt, Homo sapiens
gcauuuagauacuuuccuu

SEQ ID NO: 513596 - RNA, 19 nt, Homo sapiens
gacagggucucacuuuguu

SEQ ID NO: 513597 - RNA, 19 nt, Homo sapiens
caaaugcuaugcagauaca

SEQ ID NO: 513598 - RNA, 19 nt, Homo sapiens
auaggaugguuguguauua

SEQ ID NO: 513599 - RNA, 19 nt, Homo sapiens
uuaauaggaugguugugua

SEQ ID NO: 513600 - RNA, 19 nt, Homo sapiens
gaaauugaaagguuguuug

SEQ ID NO: 513601 - RNA, 19 nt, Homo sapiens
guacucggauacugaggua

SEQ ID NO: 513602 - RNA, 19 nt, Homo sapiens
gaagcucucugccaucgau

SEQ ID NO: 513603 - RNA, 19 nt, Homo sapiens
gagauuaugaugugaaaga

SEQ ID NO: 513604 - RNA, 19 nt, Homo sapiens
ugccaucgauguauucuaa

SEQ ID NO: 513605 - RNA, 19 nt, Homo sapiens
gcuaaagccugaaaaugua

SEQ ID NO: 513606 - RNA, 19 nt, Homo sapiens
guaacagaaucaagaaaca

SEQ ID NO: 513607 - RNA, 19 nt, Homo sapiens
gaaccaaucaccgaaauuc

SEQ ID NO: 513608 - RNA, 19 nt, Homo sapiens
gagauggaguuucguucuu

SEQ ID NO: 513609 - RNA, 19 nt, Homo sapiens
ugugaaagauuaugccuau

SEQ ID NO: 513610 - RNA, 19 nt, Homo sapiens
aaaucacacugacauguuu

SEQ ID NO: 513611 - RNA, 19 nt, Homo sapiens
aaaggugucucugaaacua

SEQ ID NO: 513612 - RNA, 19 nt, Homo sapiens
ggaacaaggacaucagcua

SEQ ID NO: 513613 - RNA, 19 nt, Homo sapiens
uggcaaauuugacaugauu

SEQ ID NO: 513614 - RNA, 19 nt, Homo sapiens
gaagaaccaaucaccgaaa

SEQ ID NO: 513615 - RNA, 19 nt, Homo sapiens
gacauaugcuugugagaca

SEQ ID NO: 513616 - RNA, 19 nt, Homo sapiens
aagguuagauuucucaguu

SEQ ID NO: 513617 - RNA, 19 nt, Homo sapiens
caauauacguugucuugag

SEQ ID NO: 513618 - RNA, 19 nt, Homo sapiens
auugaaagguuguuuggua

SEQ ID NO: 513619 - RNA, 19 nt, Homo sapiens
uugagaagguugaugcuuu

SEQ ID NO: 513620 - RNA, 19 nt, Homo sapiens
ccaaaguauuuaagaguuc

SEQ ID NO: 513621 - RNA, 19 nt, Homo sapiens
gugcuaggauuacagguau

SEQ ID NO: 513622 - RNA, 19 nt, Homo sapiens
cccaacaacuaaaugguuu

SEQ ID NO: 513623 - RNA, 19 nt, Homo sapiens
gauucauggcuguuuauua

SEQ ID NO: 513624 - RNA, 19 nt, Homo sapiens
gaacauuucauuguacugu

SEQ ID NO: 513625 - RNA, 19 nt, Homo sapiens
ggaaccaaaguauuuaaga

SEQ ID NO: 513626 - RNA, 19 nt, Homo sapiens
gagcuggaccaacacaauu

SEQ ID NO: 513627 - RNA, 19 nt, Homo sapiens
acuauaaacccuugucuuu

SEQ ID NO: 513628 - RNA, 19 nt, Homo sapiens
ccaaagugcugggauuaca

SEQ ID NO: 513629 - RNA, 19 nt, Homo sapiens
acuuagagcuggauucaug

SEQ ID NO: 513630 - RNA, 19 nt, Homo sapiens
cuaugugucuugcagauug

SEQ ID NO: 513631 - RNA, 19 nt, Homo sapiens
cuaugcagauacaauguuu

SEQ ID NO: 513632 - RNA, 19 nt, Homo sapiens
gcgaggcacggaagacaua

SEQ ID NO: 513633 - RNA, 19 nt, Homo sapiens
ugaaagugcagaaggauug

SEQ ID NO: 513634 - RNA, 19 nt, Homo sapiens
uuacagagcagaaucuuuc

SEQ ID NO: 513635 - RNA, 19 nt, Homo sapiens
uaucagacaguccucuaua

SEQ ID NO: 513636 - RNA, 19 nt, Homo sapiens
caaacauucccaaauucua

SEQ ID NO: 513637 - RNA, 19 nt, Homo sapiens
gcacggaagacauaugcuu

SEQ ID NO: 513638 - RNA, 19 nt, Homo sapiens
ccagagacuuuugauuuua

SEQ ID NO: 513639 - RNA, 19 nt, Homo sapiens
cacuugacauugaagagua

SEQ ID NO: 513640 - RNA, 19 nt, Homo sapiens
gaaagguuguuugguaaaa

SEQ ID NO: 513641 - RNA, 19 nt, Homo sapiens
uugaaagguuguuugguaa

SEQ ID NO: 513642 - RNA, 19 nt, Homo sapiens
uguguguucuuucuuauga

SEQ ID NO: 513643 - RNA, 19 nt, Homo sapiens
ggaagacauaugcuuguga

SEQ ID NO: 513644 - RNA, 19 nt, Homo sapiens
aagcaguccuccugucuug

SEQ ID NO: 513645 - RNA, 19 nt, Homo sapiens
cagcauguguuaccuguac

SEQ ID NO: 513646 - RNA, 19 nt, Homo sapiens
gaagaacgacauaaaaguu

SEQ ID NO: 513647 - RNA, 19 nt, Homo sapiens
ggaagaauggcaagacaag

SEQ ID NO: 513648 - RNA, 19 nt, Homo sapiens
gaagguugaugcuuuugaa

SEQ ID NO: 513649 - RNA, 19 nt, Homo sapiens
ucucugaguuuggcaauug

SEQ ID NO: 513650 - RNA, 19 nt, Homo sapiens
gcaccuggccugacauucu

SEQ ID NO: 513651 - RNA, 19 nt, Homo sapiens
ggagaggagauuaugaugu

SEQ ID NO: 513652 - RNA, 19 nt, Homo sapiens
aauauacguugucuugaga

SEQ ID NO: 513653 - RNA, 19 nt, Homo sapiens
caggacaaauauuggcaaa

SEQ ID NO: 513654 - RNA, 19 nt, Homo sapiens
uuacagguaugagccauug

SEQ ID NO: 513655 - RNA, 19 nt, Homo sapiens
ccaaagugcuaggauuaca

SEQ ID NO: 513656 - RNA, 19 nt, Homo sapiens
ccacgcugauguugaacuu

SEQ ID NO: 513657 - RNA, 19 nt, Homo sapiens
ggugaaagcuacgguacuc

SEQ ID NO: 513658 - RNA, 19 nt, Homo sapiens
gguucaagguggucccaaa

SEQ ID NO: 513659 - RNA, 19 nt, Homo sapiens
ugaaagauuaugccuaugu

SEQ ID NO: 513660 - RNA, 19 nt, Homo sapiens
uaauccaggugaucgcaaa

SEQ ID NO: 513661 - RNA, 19 nt, Homo sapiens
ucagugaacuugggauaca

SEQ ID NO: 513662 - RNA, 19 nt, Homo sapiens
cgguugagaugaaaugguu

SEQ ID NO: 513663 - RNA, 19 nt, Homo sapiens
cacaugugcuggcuuaaag

SEQ ID NO: 513664 - RNA, 19 nt, Homo sapiens
ccauguauauaacagaauc

SEQ ID NO: 513665 - RNA, 19 nt, Homo sapiens
cgcaaaugcuaugcagaua

SEQ ID NO: 513666 - RNA, 19 nt, Homo sapiens
ugacaugauuugggauaga

SEQ ID NO: 513667 - RNA, 19 nt, Homo sapiens
acgcugauguugaacuuga

SEQ ID NO: 513668 - RNA, 19 nt, Homo sapiens
guacuacccaacaacuaaa

SEQ ID NO: 513669 - RNA, 19 nt, Homo sapiens
agacaguccucuauaacuc

SEQ ID NO: 513670 - RNA, 19 nt, Homo sapiens
guacuuagagcuggauuca

SEQ ID NO: 513671 - RNA, 19 nt, Homo sapiens
cauaaaaguuggggaauug

SEQ ID NO: 513672 - RNA, 19 nt, Homo sapiens
caguguaguugguguggaa

SEQ ID NO: 513673 - RNA, 19 nt, Homo sapiens
uagcucauguuaauaggau

SEQ ID NO: 513674 - RNA, 19 nt, Homo sapiens
guucuucuuuaaccacauu

SEQ ID NO: 513675 - RNA, 19 nt, Homo sapiens
caaucuauauggaacaaac

SEQ ID NO: 513676 - RNA, 19 nt, Homo sapiens
gauuguuuagcucauguua

SEQ ID NO: 513677 - RNA, 19 nt, Homo sapiens
caaggacaucagcuauuaa

SEQ ID NO: 513678 - RNA, 19 nt, Homo sapiens
aacaaacauucccaaauuc

SEQ ID NO: 513679 - RNA, 19 nt, Homo sapiens
gauggaguuucguucuugu

SEQ ID NO: 513680 - RNA, 19 nt, Homo sapiens
caaaugagguugucacaga

SEQ ID NO: 513681 - RNA, 19 nt, Homo sapiens
gcagagaaaccucaagaaa

SEQ ID NO: 513682 - RNA, 19 nt, Homo sapiens
guacgugggucccuaugaa

SEQ ID NO: 513683 - RNA, 19 nt, Homo sapiens
gagcaucauugcaaacaug

SEQ ID NO: 513684 - RNA, 19 nt, Homo sapiens
ggagagugcugggauggaa

SEQ ID NO: 513685 - RNA, 19 nt, Homo sapiens
caagacaugucauucaagu

SEQ ID NO: 513686 - RNA, 19 nt, Homo sapiens
ucucaggcauggaugaaua

SEQ ID NO: 513687 - RNA, 19 nt, Homo sapiens
caacggaugcuuuaucaga

SEQ ID NO: 513688 - RNA, 19 nt, Homo sapiens
agacaugucauucaaguuu

SEQ ID NO: 513689 - RNA, 19 nt, Homo sapiens
aggcauggaugaauaaaug

SEQ ID NO: 513690 - RNA, 19 nt, Homo sapiens
uguaaacauugccugauuu

SEQ ID NO: 513691 - RNA, 19 nt, Homo sapiens
guacaagcauccugacaac

SEQ ID NO: 513692 - RNA, 19 nt, Homo sapiens
acacuugccuggcgaacaa

SEQ ID NO: 513693 - RNA, 19 nt, Homo sapiens
ccagaugacuugugagaac

SEQ ID NO: 513694 - RNA, 19 nt, Homo sapiens
ccacagagcaccagcaaag

SEQ ID NO: 513695 - RNA, 19 nt, Homo sapiens
gacacgcacuggcacuaaa

SEQ ID NO: 513696 - RNA, 19 nt, Homo sapiens
gcccauuucagaagaguua

SEQ ID NO: 513697 - RNA, 19 nt, Homo sapiens
cagcagagauaauggaaac

SEQ ID NO: 513698 - RNA, 19 nt, Homo sapiens
ggcgugagcuggagaagca

SEQ ID NO: 513699 - RNA, 19 nt, Homo sapiens
caacacggguaaaucuagu

SEQ ID NO: 513700 - RNA, 19 nt, Homo sapiens
cuaguaccaugucguaguu

SEQ ID NO: 513701 - RNA, 19 nt, Homo sapiens
ggagaacagccacgucuuc

SEQ ID NO: 513702 - RNA, 19 nt, Homo sapiens
gagcguggccgacaagauc

SEQ ID NO: 513703 - RNA, 19 nt, Homo sapiens
cacaggagcuugcaacaac

SEQ ID NO: 513704 - RNA, 19 nt, Homo sapiens
caaaggcggcuuccagugu

SEQ ID NO: 513705 - RNA, 19 nt, Homo sapiens
gcacggguaugagcuccaa

SEQ ID NO: 513706 - RNA, 19 nt, Homo sapiens
cagcaucacuggcaugaac

SEQ ID NO: 513707 - RNA, 19 nt, Homo sapiens
guaaacauugccugauuug

SEQ ID NO: 513708 - RNA, 19 nt, Homo sapiens
ggacacgcacuggcacuaa

SEQ ID NO: 513709 - RNA, 19 nt, Homo sapiens
gcagugcaguuggcugaga

SEQ ID NO: 513710 - RNA, 19 nt, Homo sapiens
uguuauagcugcauuuguc

SEQ ID NO: 513711 - RNA, 19 nt, Homo sapiens
gagcugagaugcggaaagc

SEQ ID NO: 513712 - RNA, 19 nt, Homo sapiens
caaauuccccgaagacuuu

SEQ ID NO: 513713 - RNA, 19 nt, Homo sapiens
gguuauggccugcacagaa

SEQ ID NO: 513714 - RNA, 19 nt, Homo sapiens
ccugaaaacucaacaauca

SEQ ID NO: 513715 - RNA, 19 nt, Homo sapiens
gggaaagccugaggagucu

SEQ ID NO: 513716 - RNA, 19 nt, Homo sapiens
guuauggccugcacagaag

SEQ ID NO: 513717 - RNA, 19 nt, Homo sapiens
ggacacugcagaacagcuu

SEQ ID NO: 513718 - RNA, 19 nt, Homo sapiens
ccagagagcguggagaaug

SEQ ID NO: 513719 - RNA, 19 nt, Homo sapiens
acgaggagcugacggaaag

SEQ ID NO: 513720 - RNA, 19 nt, Homo sapiens
gaugaugaccgcuauucug

SEQ ID NO: 513721 - RNA, 19 nt, Homo sapiens
ccaacaagcggagugauug

SEQ ID NO: 513722 - RNA, 19 nt, Homo sapiens
caagcauccugacaacauc

SEQ ID NO: 513723 - RNA, 19 nt, Homo sapiens
gacaugucauucaaguuuc

SEQ ID NO: 513724 - RNA, 19 nt, Homo sapiens
cagagagcguggagaaugg

SEQ ID NO: 513725 - RNA, 19 nt, Homo sapiens
ccgacaagauccuggacuu

SEQ ID NO: 513726 - RNA, 19 nt, Homo sapiens
ugaggagucucgugucucu

SEQ ID NO: 513727 - RNA, 19 nt, Homo sapiens
gggacuuugugcacuguga

SEQ ID NO: 513728 - RNA, 19 nt, Homo sapiens
uccaacggaugcuuuauca

SEQ ID NO: 513729 - RNA, 19 nt, Homo sapiens
gagauaauggaaacaucaa

SEQ ID NO: 513730 - RNA, 19 nt, Homo sapiens
agagaaaccucaagaaaag

SEQ ID NO: 513731 - RNA, 19 nt, Homo sapiens
uuguaaacauugccugauu

SEQ ID NO: 513732 - RNA, 19 nt, Homo sapiens
gaacucccgagcugagaug

SEQ ID NO: 513733 - RNA, 19 nt, Homo sapiens
gggagaaccugcguagacu

SEQ ID NO: 513734 - RNA, 19 nt, Homo sapiens
ugucucgggucaucuguga

SEQ ID NO: 513735 - RNA, 19 nt, Homo sapiens
gagaacagccacgucuuca

SEQ ID NO: 513736 - RNA, 19 nt, Homo sapiens
gagcagcagagauaaugga

SEQ ID NO: 513737 - RNA, 19 nt, Homo sapiens
gccaacaagcggagugauu

SEQ ID NO: 513738 - RNA, 19 nt, Homo sapiens
accacgggcugccagguua

SEQ ID NO: 513739 - RNA, 19 nt, Homo sapiens
cuaauacgaggccuucuug

SEQ ID NO: 513740 - RNA, 19 nt, Homo sapiens
gagcuugcaacaacagaga

SEQ ID NO: 513741 - RNA, 19 nt, Homo sapiens
caaaaugcccaaacacuug

SEQ ID NO: 513742 - RNA, 19 nt, Homo sapiens
aaagaaaagucaaccugaa

SEQ ID NO: 513743 - RNA, 19 nt, Homo sapiens
gcagagauaauggaaacau

SEQ ID NO: 513744 - RNA, 19 nt, Homo sapiens
gcauuugucuggccuuuuc

SEQ ID NO: 513745 - RNA, 19 nt, Homo sapiens
gcauggaugaauaaauguu

SEQ ID NO: 513746 - RNA, 19 nt, Homo sapiens
guaaaucuaguaccauguc

SEQ ID NO: 513747 - RNA, 19 nt, Homo sapiens
ggagacaggcggaggaacu

SEQ ID NO: 513748 - RNA, 19 nt, Homo sapiens
aaguguggcuucccagaga

SEQ ID NO: 513749 - RNA, 19 nt, Homo sapiens
gcugggaggcuuagcugaa

SEQ ID NO: 513750 - RNA, 19 nt, Homo sapiens
ccgccugucugcccuucua

SEQ ID NO: 513751 - RNA, 19 nt, Homo sapiens
cagagauaauggaaacauc

SEQ ID NO: 513752 - RNA, 19 nt, Homo sapiens
gaagaguuacagccgugaa

SEQ ID NO: 513753 - RNA, 19 nt, Homo sapiens
uacaagcgaugaaaagaaa

SEQ ID NO: 513754 - RNA, 19 nt, Homo sapiens
aaucuaguaccaugucgua

SEQ ID NO: 513755 - RNA, 19 nt, Homo sapiens
ccgaggccuuccagcagua

SEQ ID NO: 513756 - RNA, 19 nt, Homo sapiens
caaacuuccugagccaaca

SEQ ID NO: 513757 - RNA, 19 nt, Homo sapiens
cagagaaaccucaagaaaa

SEQ ID NO: 513758 - RNA, 19 nt, Homo sapiens
ggcgcgugcugguguauuc

SEQ ID NO: 513759 - RNA, 19 nt, Homo sapiens
cuggaggccuggagggaaa

SEQ ID NO: 513760 - RNA, 19 nt, Homo sapiens
ucuuugugcuguccaauuc

SEQ ID NO: 513761 - RNA, 19 nt, Homo sapiens
cacagaugaugaccgcuau

SEQ ID NO: 513762 - RNA, 19 nt, Homo sapiens
aacggaugcuuuaucagaa

SEQ ID NO: 513763 - RNA, 19 nt, Homo sapiens
acaggcaaaucggaaauca

SEQ ID NO: 513764 - RNA, 19 nt, Homo sapiens
cugggaggcuuagcugaaa

SEQ ID NO: 513765 - RNA, 19 nt, Homo sapiens
ugguuuggacccacuaaua

SEQ ID NO: 513766 - RNA, 19 nt, Homo sapiens
aaaugagguugucacagau

SEQ ID NO: 513767 - RNA, 19 nt, Homo sapiens
caaauacaggcccaucaca

SEQ ID NO: 513768 - RNA, 19 nt, Homo sapiens
gcagcagagauaauggaaa

SEQ ID NO: 513769 - RNA, 19 nt, Homo sapiens
acgccacgaugcagagaaa

SEQ ID NO: 513770 - RNA, 19 nt, Homo sapiens
aggcuuagcugaaaacuuc

SEQ ID NO: 513771 - RNA, 19 nt, Homo sapiens
cuucagcccauggacauua

SEQ ID NO: 513772 - RNA, 19 nt, Homo sapiens
caacaaucacagcauccaa

SEQ ID NO: 513773 - RNA, 19 nt, Homo sapiens
guacgacucuuuuccaaac

SEQ ID NO: 513774 - RNA, 19 nt, Homo sapiens
cuguuugccugucucauug

SEQ ID NO: 513775 - RNA, 19 nt, Homo sapiens
acaagcauccugacaacau

SEQ ID NO: 513776 - RNA, 19 nt, Homo sapiens
auacgaggccuucuugcaa

SEQ ID NO: 513777 - RNA, 19 nt, Homo sapiens
gcaguacgugggucccuau

SEQ ID NO: 513778 - RNA, 19 nt, Homo sapiens
cagugcaguuggcugagaa

SEQ ID NO: 513779 - RNA, 19 nt, Homo sapiens
gagagggaaagaacuccuu

SEQ ID NO: 513780 - RNA, 19 nt, Homo sapiens
caaaugagguugucacaga

SEQ ID NO: 513781 - RNA, 19 nt, Homo sapiens
gcagagaaaccucaagaaa

SEQ ID NO: 513782 - RNA, 19 nt, Homo sapiens
guacgugggucccuaugaa

SEQ ID NO: 513783 - RNA, 19 nt, Homo sapiens
gagcaucauugcaaacaug

SEQ ID NO: 513784 - RNA, 19 nt, Homo sapiens
ggagagugcugggauggaa

SEQ ID NO: 513785 - RNA, 19 nt, Homo sapiens
caagacaugucauucaagu

SEQ ID NO: 513786 - RNA, 19 nt, Homo sapiens
ucucaggcauggaugaaua

SEQ ID NO: 513787 - RNA, 19 nt, Homo sapiens
caacggaugcuuuaucaga

SEQ ID NO: 513788 - RNA, 19 nt, Homo sapiens
agacaugucauucaaguuu

SEQ ID NO: 513789 - RNA, 19 nt, Homo sapiens
aggcauggaugaauaaaug

SEQ ID NO: 513790 - RNA, 19 nt, Homo sapiens
uguaaacauugccugauuu

SEQ ID NO: 513791 - RNA, 19 nt, Homo sapiens
guacaagcauccugacaac

SEQ ID NO: 513792 - RNA, 19 nt, Homo sapiens
acacuugccuggcgaacaa

SEQ ID NO: 513793 - RNA, 19 nt, Homo sapiens
ccagaugacuugugagaac

SEQ ID NO: 513794 - RNA, 19 nt, Homo sapiens
ccacagagcaccagcaaag

SEQ ID NO: 513795 - RNA, 19 nt, Homo sapiens
gacacgcacuggcacuaaa

SEQ ID NO: 513796 - RNA, 19 nt, Homo sapiens
gcccauuucagaagaguua

SEQ ID NO: 513797 - RNA, 19 nt, Homo sapiens
cagcagagauaauggaaac

SEQ ID NO: 513798 - RNA, 19 nt, Homo sapiens
ggcgugagcuggagaagca

SEQ ID NO: 513799 - RNA, 19 nt, Homo sapiens
caacacggguaaaucuagu

SEQ ID NO: 513800 - RNA, 19 nt, Homo sapiens
cuaguaccaugucguaguu

SEQ ID NO: 513801 - RNA, 19 nt, Homo sapiens
ggagaacagccacgucuuc

SEQ ID NO: 513802 - RNA, 19 nt, Homo sapiens
gagcguggccgacaagauc

SEQ ID NO: 513803 - RNA, 19 nt, Homo sapiens
cacaggagcuugcaacaac

SEQ ID NO: 513804 - RNA, 19 nt, Homo sapiens
caaaggcggcuuccagugu

SEQ ID NO: 513805 - RNA, 19 nt, Homo sapiens
gcacggguaugagcuccaa

SEQ ID NO: 513806 - RNA, 19 nt, Homo sapiens
cagcaucacuggcaugaac

SEQ ID NO: 513807 - RNA, 19 nt, Homo sapiens
guaaacauugccugauuug

SEQ ID NO: 513808 - RNA, 19 nt, Homo sapiens
ggacacgcacuggcacuaa

SEQ ID NO: 513809 - RNA, 19 nt, Homo sapiens
gcagugcaguuggcugaga

SEQ ID NO: 513810 - RNA, 19 nt, Homo sapiens
uguuauagcugcauuuguc

SEQ ID NO: 513811 - RNA, 19 nt, Homo sapiens
gagcugagaugcggaaagc

SEQ ID NO: 513812 - RNA, 19 nt, Homo sapiens
caaauuccccgaagacuuu

SEQ ID NO: 513813 - RNA, 19 nt, Homo sapiens
gguuauggccugcacagaa

SEQ ID NO: 513814 - RNA, 19 nt, Homo sapiens
ccugaaaacucaacaauca

SEQ ID NO: 513815 - RNA, 19 nt, Homo sapiens
gggaaagccugaggagucu

SEQ ID NO: 513816 - RNA, 19 nt, Homo sapiens
guuauggccugcacagaag

SEQ ID NO: 513817 - RNA, 19 nt, Homo sapiens
ggacacugcagaacagcuu

SEQ ID NO: 513818 - RNA, 19 nt, Homo sapiens
ccagagagcguggagaaug

SEQ ID NO: 513819 - RNA, 19 nt, Homo sapiens
gaugaugaccgcuauucug

SEQ ID NO: 513820 - RNA, 19 nt, Homo sapiens
ccaacaagcggagugauug

SEQ ID NO: 513821 - RNA, 19 nt, Homo sapiens
caagcauccugacaacauc

SEQ ID NO: 513822 - RNA, 19 nt, Homo sapiens
gacaugucauucaaguuuc

SEQ ID NO: 513823 - RNA, 19 nt, Homo sapiens
cagagagcguggagaaugg

SEQ ID NO: 513824 - RNA, 19 nt, Homo sapiens
ccgacaagauccuggacuu

SEQ ID NO: 513825 - RNA, 19 nt, Homo sapiens
ugaggagucucgugucucu

SEQ ID NO: 513826 - RNA, 19 nt, Homo sapiens
gggacuuugugcacuguga

SEQ ID NO: 513827 - RNA, 19 nt, Homo sapiens
uccaacggaugcuuuauca

SEQ ID NO: 513828 - RNA, 19 nt, Homo sapiens
gagauaauggaaacaucaa

SEQ ID NO: 513829 - RNA, 19 nt, Homo sapiens
agagaaaccucaagaaaag

SEQ ID NO: 513830 - RNA, 19 nt, Homo sapiens
uuguaaacauugccugauu

SEQ ID NO: 513831 - RNA, 19 nt, Homo sapiens
gaacucccgagcugagaug

SEQ ID NO: 513832 - RNA, 19 nt, Homo sapiens
gggagaaccugcguagacu

SEQ ID NO: 513833 - RNA, 19 nt, Homo sapiens
ugucucgggucaucuguga

SEQ ID NO: 513834 - RNA, 19 nt, Homo sapiens
gagaacagccacgucuuca

SEQ ID NO: 513835 - RNA, 19 nt, Homo sapiens
gagcagcagagauaaugga

SEQ ID NO: 513836 - RNA, 19 nt, Homo sapiens
gccaacaagcggagugauu

SEQ ID NO: 513837 - RNA, 19 nt, Homo sapiens
gagcuugcaacaacagaga

SEQ ID NO: 513838 - RNA, 19 nt, Homo sapiens
caaaaugcccaaacacuug

SEQ ID NO: 513839 - RNA, 19 nt, Homo sapiens
aaagaaaagucaaccugaa

SEQ ID NO: 513840 - RNA, 19 nt, Homo sapiens
gcagagauaauggaaacau

SEQ ID NO: 513841 - RNA, 19 nt, Homo sapiens
gcauuugucuggccuuuuc

SEQ ID NO: 513842 - RNA, 19 nt, Homo sapiens
gcauggaugaauaaauguu

SEQ ID NO: 513843 - RNA, 19 nt, Homo sapiens
guaaaucuaguaccauguc

SEQ ID NO: 513844 - RNA, 19 nt, Homo sapiens
ggagacaggcggaggaacu

SEQ ID NO: 513845 - RNA, 19 nt, Homo sapiens
aaguguggcuucccagaga

SEQ ID NO: 513846 - RNA, 19 nt, Homo sapiens
gcugggaggcuuagcugaa

SEQ ID NO: 513847 - RNA, 19 nt, Homo sapiens
ccgccugucugcccuucua

SEQ ID NO: 513848 - RNA, 19 nt, Homo sapiens
cagagauaauggaaacauc

SEQ ID NO: 513849 - RNA, 19 nt, Homo sapiens
gaagaguuacagccgugaa

SEQ ID NO: 513850 - RNA, 19 nt, Homo sapiens
uacaagcgaugaaaagaaa

SEQ ID NO: 513851 - RNA, 19 nt, Homo sapiens
aaucuaguaccaugucgua

SEQ ID NO: 513852 - RNA, 19 nt, Homo sapiens
ccgaggccuuccagcagua

SEQ ID NO: 513853 - RNA, 19 nt, Homo sapiens
caaacuuccugagccaaca

SEQ ID NO: 513854 - RNA, 19 nt, Homo sapiens
cagagaaaccucaagaaaa

SEQ ID NO: 513855 - RNA, 19 nt, Homo sapiens
ggcgcgugcugguguauuc

SEQ ID NO: 513856 - RNA, 19 nt, Homo sapiens
cuggaggccuggagggaaa

SEQ ID NO: 513857 - RNA, 19 nt, Homo sapiens
cacagaugaugaccgcuau

SEQ ID NO: 513858 - RNA, 19 nt, Homo sapiens
aacggaugcuuuaucagaa

SEQ ID NO: 513859 - RNA, 19 nt, Homo sapiens
acaggcaaaucggaaauca

SEQ ID NO: 513860 - RNA, 19 nt, Homo sapiens
cugggaggcuuagcugaaa

SEQ ID NO: 513861 - RNA, 19 nt, Homo sapiens
aaaugagguugucacagau

SEQ ID NO: 513862 - RNA, 19 nt, Homo sapiens
caaauacaggcccaucaca

SEQ ID NO: 513863 - RNA, 19 nt, Homo sapiens
gcagcagagauaauggaaa

SEQ ID NO: 513864 - RNA, 19 nt, Homo sapiens
aggcuuagcugaaaacuuc

SEQ ID NO: 513865 - RNA, 19 nt, Homo sapiens
cuucagcccauggacauua

SEQ ID NO: 513866 - RNA, 19 nt, Homo sapiens
acgccacgaugcagagaaa

SEQ ID NO: 513867 - RNA, 19 nt, Homo sapiens
caacaaucacagcauccaa

SEQ ID NO: 513868 - RNA, 19 nt, Homo sapiens
guacgacucuuuuccaaac

SEQ ID NO: 513869 - RNA, 19 nt, Homo sapiens
cuguuugccugucucauug

SEQ ID NO: 513870 - RNA, 19 nt, Homo sapiens
acaagcauccugacaacau

SEQ ID NO: 513871 - RNA, 19 nt, Homo sapiens
gcaguacgugggucccuau

SEQ ID NO: 513872 - RNA, 19 nt, Homo sapiens
cagugcaguuggcugagaa

SEQ ID NO: 513873 - RNA, 19 nt, Homo sapiens
gagagggaaagaacuccuu

SEQ ID NO: 513874 - RNA, 19 nt, Homo sapiens
ugucuggccuuuucuugua

SEQ ID NO: 513875 - RNA, 19 nt, Homo sapiens
ccaacacggguaaaucuag

SEQ ID NO: 513876 - RNA, 19 nt, Homo sapiens
cugcagaacagcuucaugu

SEQ ID NO: 513877 - RNA, 19 nt, Homo sapiens
gacagcaucacuggcauga

SEQ ID NO: 513878 - RNA, 19 nt, Homo sapiens
ccuguuugccugucucauu

SEQ ID NO: 513879 - RNA, 19 nt, Homo sapiens
agaggcagcugcggaacug

SEQ ID NO: 513880 - RNA, 19 nt, Homo sapiens
caaaugagguugucacaga

SEQ ID NO: 513881 - RNA, 19 nt, Homo sapiens
gcagagaaaccucaagaaa

SEQ ID NO: 513882 - RNA, 19 nt, Homo sapiens
guacgugggucccuaugaa

SEQ ID NO: 513883 - RNA, 19 nt, Homo sapiens
gagcaucauugcaaacaug

SEQ ID NO: 513884 - RNA, 19 nt, Homo sapiens
ggagagugcugggauggaa

SEQ ID NO: 513885 - RNA, 19 nt, Homo sapiens
caagacaugucauucaagu

SEQ ID NO: 513886 - RNA, 19 nt, Homo sapiens
ucucaggcauggaugaaua

SEQ ID NO: 513887 - RNA, 19 nt, Homo sapiens
caacggaugcuuuaucaga

SEQ ID NO: 513888 - RNA, 19 nt, Homo sapiens
agacaugucauucaaguuu

SEQ ID NO: 513889 - RNA, 19 nt, Homo sapiens
aggcauggaugaauaaaug

SEQ ID NO: 513890 - RNA, 19 nt, Homo sapiens
uguaaacauugccugauuu

SEQ ID NO: 513891 - RNA, 19 nt, Homo sapiens
guacaagcauccugacaac

SEQ ID NO: 513892 - RNA, 19 nt, Homo sapiens
acacuugccuggcgaacaa

SEQ ID NO: 513893 - RNA, 19 nt, Homo sapiens
ccagaugacuugugagaac

SEQ ID NO: 513894 - RNA, 19 nt, Homo sapiens
ccacagagcaccagcaaag

SEQ ID NO: 513895 - RNA, 19 nt, Homo sapiens
gcccauuucagaagaguua

SEQ ID NO: 513896 - RNA, 19 nt, Homo sapiens
cagcagagauaauggaaac

SEQ ID NO: 513897 - RNA, 19 nt, Homo sapiens
ggcgugagcuggagaagca

SEQ ID NO: 513898 - RNA, 19 nt, Homo sapiens
caacacggguaaaucuagu

SEQ ID NO: 513899 - RNA, 19 nt, Homo sapiens
cuaguaccaugucguaguu

SEQ ID NO: 513900 - RNA, 19 nt, Homo sapiens
ggagaacagccacgucuuc

SEQ ID NO: 513901 - RNA, 19 nt, Homo sapiens
gagcguggccgacaagauc

SEQ ID NO: 513902 - RNA, 19 nt, Homo sapiens
cacaggagcuugcaacaac

SEQ ID NO: 513903 - RNA, 19 nt, Homo sapiens
caaaggcggcuuccagugu

SEQ ID NO: 513904 - RNA, 19 nt, Homo sapiens
gcacggguaugagcuccaa

SEQ ID NO: 513905 - RNA, 19 nt, Homo sapiens
cagcaucacuggcaugaac

SEQ ID NO: 513906 - RNA, 19 nt, Homo sapiens
guaaacauugccugauuug

SEQ ID NO: 513907 - RNA, 19 nt, Homo sapiens
gcagugcaguuggcugaga

SEQ ID NO: 513908 - RNA, 19 nt, Homo sapiens
uguuauagcugcauuuguc

SEQ ID NO: 513909 - RNA, 19 nt, Homo sapiens
caaauuccccgaagacuuu

SEQ ID NO: 513910 - RNA, 19 nt, Homo sapiens
gguuauggccugcacagaa

SEQ ID NO: 513911 - RNA, 19 nt, Homo sapiens
ccugaaaacucaacaauca

SEQ ID NO: 513912 - RNA, 19 nt, Homo sapiens
gggaaagccugaggagucu

SEQ ID NO: 513913 - RNA, 19 nt, Homo sapiens
guuauggccugcacagaag

SEQ ID NO: 513914 - RNA, 19 nt, Homo sapiens
ggacacugcagaacagcuu

SEQ ID NO: 513915 - RNA, 19 nt, Homo sapiens
ccagagagcguggagaaug

SEQ ID NO: 513916 - RNA, 19 nt, Homo sapiens
acgaggagcugacggaaag

SEQ ID NO: 513917 - RNA, 19 nt, Homo sapiens
gaugaugaccgcuauucug

SEQ ID NO: 513918 - RNA, 19 nt, Homo sapiens
ccaacaagcggagugauug

SEQ ID NO: 513919 - RNA, 19 nt, Homo sapiens
caagcauccugacaacauc

SEQ ID NO: 513920 - RNA, 19 nt, Homo sapiens
gacaugucauucaaguuuc

SEQ ID NO: 513921 - RNA, 19 nt, Homo sapiens
cagagagcguggagaaugg

SEQ ID NO: 513922 - RNA, 19 nt, Homo sapiens
ccgacaagauccuggacuu

SEQ ID NO: 513923 - RNA, 19 nt, Homo sapiens
ugaggagucucgugucucu

SEQ ID NO: 513924 - RNA, 19 nt, Homo sapiens
gggacuuugugcacuguga

SEQ ID NO: 513925 - RNA, 19 nt, Homo sapiens
uccaacggaugcuuuauca

SEQ ID NO: 513926 - RNA, 19 nt, Homo sapiens
gagauaauggaaacaucaa

SEQ ID NO: 513927 - RNA, 19 nt, Homo sapiens
agagaaaccucaagaaaag

SEQ ID NO: 513928 - RNA, 19 nt, Homo sapiens
uuguaaacauugccugauu

SEQ ID NO: 513929 - RNA, 19 nt, Homo sapiens
gggagaaccugcguagacu

SEQ ID NO: 513930 - RNA, 19 nt, Homo sapiens
ugucucgggucaucuguga

SEQ ID NO: 513931 - RNA, 19 nt, Homo sapiens
gagaacagccacgucuuca

SEQ ID NO: 513932 - RNA, 19 nt, Homo sapiens
gagcagcagagauaaugga

SEQ ID NO: 513933 - RNA, 19 nt, Homo sapiens
gccaacaagcggagugauu

SEQ ID NO: 513934 - RNA, 19 nt, Homo sapiens
accacgggcugccagguua

SEQ ID NO: 513935 - RNA, 19 nt, Homo sapiens
cuaauacgaggccuucuug

SEQ ID NO: 513936 - RNA, 19 nt, Homo sapiens
gagcuugcaacaacagaga

SEQ ID NO: 513937 - RNA, 19 nt, Homo sapiens
caaaaugcccaaacacuug

SEQ ID NO: 513938 - RNA, 19 nt, Homo sapiens
aaagaaaagucaaccugaa

SEQ ID NO: 513939 - RNA, 19 nt, Homo sapiens
gcagagauaauggaaacau

SEQ ID NO: 513940 - RNA, 19 nt, Homo sapiens
gcauuugucuggccuuuuc

SEQ ID NO: 513941 - RNA, 19 nt, Homo sapiens
gcauggaugaauaaauguu

SEQ ID NO: 513942 - RNA, 19 nt, Homo sapiens
guaaaucuaguaccauguc

SEQ ID NO: 513943 - RNA, 19 nt, Homo sapiens
aaguguggcuucccagaga

SEQ ID NO: 513944 - RNA, 19 nt, Homo sapiens
gcugggaggcuuagcugaa

SEQ ID NO: 513945 - RNA, 19 nt, Homo sapiens
ccgccugucugcccuucua

SEQ ID NO: 513946 - RNA, 19 nt, Homo sapiens
cagagauaauggaaacauc

SEQ ID NO: 513947 - RNA, 19 nt, Homo sapiens
gaagaguuacagccgugaa

SEQ ID NO: 513948 - RNA, 19 nt, Homo sapiens
uacaagcgaugaaaagaaa

SEQ ID NO: 513949 - RNA, 19 nt, Homo sapiens
aaucuaguaccaugucgua

SEQ ID NO: 513950 - RNA, 19 nt, Homo sapiens
ccgaggccuuccagcagua

SEQ ID NO: 513951 - RNA, 19 nt, Homo sapiens
caaacuuccugagccaaca

SEQ ID NO: 513952 - RNA, 19 nt, Homo sapiens
cagagaaaccucaagaaaa

SEQ ID NO: 513953 - RNA, 19 nt, Homo sapiens
ggcgcgugcugguguauuc

SEQ ID NO: 513954 - RNA, 19 nt, Homo sapiens
cuggaggccuggagggaaa

SEQ ID NO: 513955 - RNA, 19 nt, Homo sapiens
ucuuugugcuguccaauuc

SEQ ID NO: 513956 - RNA, 19 nt, Homo sapiens
cacagaugaugaccgcuau

SEQ ID NO: 513957 - RNA, 19 nt, Homo sapiens
aacggaugcuuuaucagaa

SEQ ID NO: 513958 - RNA, 19 nt, Homo sapiens
acaggcaaaucggaaauca

SEQ ID NO: 513959 - RNA, 19 nt, Homo sapiens
cugggaggcuuagcugaaa

SEQ ID NO: 513960 - RNA, 19 nt, Homo sapiens
ugguuuggacccacuaaua

SEQ ID NO: 513961 - RNA, 19 nt, Homo sapiens
aaaugagguugucacagau

SEQ ID NO: 513962 - RNA, 19 nt, Homo sapiens
caaauacaggcccaucaca

SEQ ID NO: 513963 - RNA, 19 nt, Homo sapiens
gcagcagagauaauggaaa

SEQ ID NO: 513964 - RNA, 19 nt, Homo sapiens
acgccacgaugcagagaaa

SEQ ID NO: 513965 - RNA, 19 nt, Homo sapiens
aggcuuagcugaaaacuuc

SEQ ID NO: 513966 - RNA, 19 nt, Homo sapiens
cuucagcccauggacauua

SEQ ID NO: 513967 - RNA, 19 nt, Homo sapiens
caacaaucacagcauccaa

SEQ ID NO: 513968 - RNA, 19 nt, Homo sapiens
guacgacucuuuuccaaac

SEQ ID NO: 513969 - RNA, 19 nt, Homo sapiens
cuguuugccugucucauug

SEQ ID NO: 513970 - RNA, 19 nt, Homo sapiens
acaagcauccugacaacau

SEQ ID NO: 513971 - RNA, 19 nt, Homo sapiens
auacgaggccuucuugcaa

SEQ ID NO: 513972 - RNA, 19 nt, Homo sapiens
gcaguacgugggucccuau

SEQ ID NO: 513973 - RNA, 19 nt, Homo sapiens
cagugcaguuggcugagaa

SEQ ID NO: 513974 - RNA, 19 nt, Homo sapiens
gagagggaaagaacuccuu

SEQ ID NO: 513975 - RNA, 19 nt, Homo sapiens
ugucuggccuuuucuugua

SEQ ID NO: 513976 - RNA, 19 nt, Homo sapiens
ccaacacggguaaaucuag

SEQ ID NO: 513977 - RNA, 19 nt, Homo sapiens
cugcagaacagcuucaugu

SEQ ID NO: 513978 - RNA, 19 nt, Homo sapiens
gacagcaucacuggcauga

SEQ ID NO: 513979 - RNA, 19 nt, Homo sapiens
ccuguuugccugucucauu

SEQ ID NO: 513980 - RNA, 19 nt, Homo sapiens
caaaugagguugucacaga

SEQ ID NO: 513981 - RNA, 19 nt, Homo sapiens
gcagagaaaccucaagaaa

SEQ ID NO: 513982 - RNA, 19 nt, Homo sapiens
guacgugggucccuaugaa

SEQ ID NO: 513983 - RNA, 19 nt, Homo sapiens
gagcaucauugcaaacaug

SEQ ID NO: 513984 - RNA, 19 nt, Homo sapiens
ggagagugcugggauggaa

SEQ ID NO: 513985 - RNA, 19 nt, Homo sapiens
caagacaugucauucaagu

SEQ ID NO: 513986 - RNA, 19 nt, Homo sapiens
ucucaggcauggaugaaua

SEQ ID NO: 513987 - RNA, 19 nt, Homo sapiens
caacggaugcuuuaucaga

SEQ ID NO: 513988 - RNA, 19 nt, Homo sapiens
agacaugucauucaaguuu

SEQ ID NO: 513989 - RNA, 19 nt, Homo sapiens
aggcauggaugaauaaaug

SEQ ID NO: 513990 - RNA, 19 nt, Homo sapiens
uguaaacauugccugauuu

SEQ ID NO: 513991 - RNA, 19 nt, Homo sapiens
guacaagcauccugacaac

SEQ ID NO: 513992 - RNA, 19 nt, Homo sapiens
acacuugccuggcgaacaa

SEQ ID NO: 513993 - RNA, 19 nt, Homo sapiens
ccagaugacuugugagaac

SEQ ID NO: 513994 - RNA, 19 nt, Homo sapiens
ccacagagcaccagcaaag

SEQ ID NO: 513995 - RNA, 19 nt, Homo sapiens
gacacgcacuggcacuaaa

SEQ ID NO: 513996 - RNA, 19 nt, Homo sapiens
gcccauuucagaagaguua

SEQ ID NO: 513997 - RNA, 19 nt, Homo sapiens
cagcagagauaauggaaac

SEQ ID NO: 513998 - RNA, 19 nt, Homo sapiens
ggcgugagcuggagaagca

SEQ ID NO: 513999 - RNA, 19 nt, Homo sapiens
caacacggguaaaucuagu

SEQ ID NO: 514000 - RNA, 19 nt, Homo sapiens
cuaguaccaugucguaguu

SEQ ID NO: 514001 - RNA, 19 nt, Homo sapiens
ggagaacagccacgucuuc

SEQ ID NO: 514002 - RNA, 19 nt, Homo sapiens
gagcguggccgacaagauc

SEQ ID NO: 514003 - RNA, 19 nt, Homo sapiens
cacaggagcuugcaacaac

SEQ ID NO: 514004 - RNA, 19 nt, Homo sapiens
gcacggguaugagcuccaa

SEQ ID NO: 514005 - RNA, 19 nt, Homo sapiens
cagcaucacuggcaugaac

SEQ ID NO: 514006 - RNA, 19 nt, Homo sapiens
guaaacauugccugauuug

SEQ ID NO: 514007 - RNA, 19 nt, Homo sapiens
ggacacgcacuggcacuaa

SEQ ID NO: 514008 - RNA, 19 nt, Homo sapiens
gcagugcaguuggcugaga

SEQ ID NO: 514009 - RNA, 19 nt, Homo sapiens
uguuauagcugcauuuguc

SEQ ID NO: 514010 - RNA, 19 nt, Homo sapiens
gagcugagaugcggaaagc

SEQ ID NO: 514011 - RNA, 19 nt, Homo sapiens
caaauuccccgaagacuuu

SEQ ID NO: 514012 - RNA, 19 nt, Homo sapiens
gguuauggccugcacagaa

SEQ ID NO: 514013 - RNA, 19 nt, Homo sapiens
ccugaaaacucaacaauca

SEQ ID NO: 514014 - RNA, 19 nt, Homo sapiens
gggaaagccugaggagucu

SEQ ID NO: 514015 - RNA, 19 nt, Homo sapiens
guuauggccugcacagaag

SEQ ID NO: 514016 - RNA, 19 nt, Homo sapiens
ggacacugcagaacagcuu

SEQ ID NO: 514017 - RNA, 19 nt, Homo sapiens
ccagagagcguggagaaug

SEQ ID NO: 514018 - RNA, 19 nt, Homo sapiens
acgaggagcugacggaaag

SEQ ID NO: 514019 - RNA, 19 nt, Homo sapiens
gaugaugaccgcuauucug

SEQ ID NO: 514020 - RNA, 19 nt, Homo sapiens
ccaacaagcggagugauug

SEQ ID NO: 514021 - RNA, 19 nt, Homo sapiens
caagcauccugacaacauc

SEQ ID NO: 514022 - RNA, 19 nt, Homo sapiens
gacaugucauucaaguuuc

SEQ ID NO: 514023 - RNA, 19 nt, Homo sapiens
cagagagcguggagaaugg

SEQ ID NO: 514024 - RNA, 19 nt, Homo sapiens
ccgacaagauccuggacuu

SEQ ID NO: 514025 - RNA, 19 nt, Homo sapiens
ugaggagucucgugucucu

SEQ ID NO: 514026 - RNA, 19 nt, Homo sapiens
gggacuuugugcacuguga

SEQ ID NO: 514027 - RNA, 19 nt, Homo sapiens
uccaacggaugcuuuauca

SEQ ID NO: 514028 - RNA, 19 nt, Homo sapiens
gagauaauggaaacaucaa

SEQ ID NO: 514029 - RNA, 19 nt, Homo sapiens
agagaaaccucaagaaaag

SEQ ID NO: 514030 - RNA, 19 nt, Homo sapiens
uuguaaacauugccugauu

SEQ ID NO: 514031 - RNA, 19 nt, Homo sapiens
gaacucccgagcugagaug

SEQ ID NO: 514032 - RNA, 19 nt, Homo sapiens
ugucucgggucaucuguga

SEQ ID NO: 514033 - RNA, 19 nt, Homo sapiens
gagaacagccacgucuuca

SEQ ID NO: 514034 - RNA, 19 nt, Homo sapiens
gagcagcagagauaaugga

SEQ ID NO: 514035 - RNA, 19 nt, Homo sapiens
gccaacaagcggagugauu

SEQ ID NO: 514036 - RNA, 19 nt, Homo sapiens
accacgggcugccagguua

SEQ ID NO: 514037 - RNA, 19 nt, Homo sapiens
cuaauacgaggccuucuug

SEQ ID NO: 514038 - RNA, 19 nt, Homo sapiens
gagcuugcaacaacagaga

SEQ ID NO: 514039 - RNA, 19 nt, Homo sapiens
caaaaugcccaaacacuug

SEQ ID NO: 514040 - RNA, 19 nt, Homo sapiens
aaagaaaagucaaccugaa

SEQ ID NO: 514041 - RNA, 19 nt, Homo sapiens
gcagagauaauggaaacau

SEQ ID NO: 514042 - RNA, 19 nt, Homo sapiens
gcauuugucuggccuuuuc

SEQ ID NO: 514043 - RNA, 19 nt, Homo sapiens
gcauggaugaauaaauguu

SEQ ID NO: 514044 - RNA, 19 nt, Homo sapiens
guaaaucuaguaccauguc

SEQ ID NO: 514045 - RNA, 19 nt, Homo sapiens
ggagacaggcggaggaacu

SEQ ID NO: 514046 - RNA, 19 nt, Homo sapiens
aaguguggcuucccagaga

SEQ ID NO: 514047 - RNA, 19 nt, Homo sapiens
gcugggaggcuuagcugaa

SEQ ID NO: 514048 - RNA, 19 nt, Homo sapiens
ccgccugucugcccuucua

SEQ ID NO: 514049 - RNA, 19 nt, Homo sapiens
cagagauaauggaaacauc

SEQ ID NO: 514050 - RNA, 19 nt, Homo sapiens
gaagaguuacagccgugaa

SEQ ID NO: 514051 - RNA, 19 nt, Homo sapiens
uacaagcgaugaaaagaaa

SEQ ID NO: 514052 - RNA, 19 nt, Homo sapiens
aaucuaguaccaugucgua

SEQ ID NO: 514053 - RNA, 19 nt, Homo sapiens
ccgaggccuuccagcagua

SEQ ID NO: 514054 - RNA, 19 nt, Homo sapiens
caaacuuccugagccaaca

SEQ ID NO: 514055 - RNA, 19 nt, Homo sapiens
cagagaaaccucaagaaaa

SEQ ID NO: 514056 - RNA, 19 nt, Homo sapiens
ggcgcgugcugguguauuc

SEQ ID NO: 514057 - RNA, 19 nt, Homo sapiens
cuggaggccuggagggaaa

SEQ ID NO: 514058 - RNA, 19 nt, Homo sapiens
ucuuugugcuguccaauuc

SEQ ID NO: 514059 - RNA, 19 nt, Homo sapiens
cacagaugaugaccgcuau

SEQ ID NO: 514060 - RNA, 19 nt, Homo sapiens
aacggaugcuuuaucagaa

SEQ ID NO: 514061 - RNA, 19 nt, Homo sapiens
acaggcaaaucggaaauca

SEQ ID NO: 514062 - RNA, 19 nt, Homo sapiens
cugggaggcuuagcugaaa

SEQ ID NO: 514063 - RNA, 19 nt, Homo sapiens
ugguuuggacccacuaaua

SEQ ID NO: 514064 - RNA, 19 nt, Homo sapiens
aaaugagguugucacagau

SEQ ID NO: 514065 - RNA, 19 nt, Homo sapiens
caaauacaggcccaucaca

SEQ ID NO: 514066 - RNA, 19 nt, Homo sapiens
gcagcagagauaauggaaa

SEQ ID NO: 514067 - RNA, 19 nt, Homo sapiens
aggcuuagcugaaaacuuc

SEQ ID NO: 514068 - RNA, 19 nt, Homo sapiens
acgccacgaugcagagaaa

SEQ ID NO: 514069 - RNA, 19 nt, Homo sapiens
cuucagcccauggacauua

SEQ ID NO: 514070 - RNA, 19 nt, Homo sapiens
caacaaucacagcauccaa

SEQ ID NO: 514071 - RNA, 19 nt, Homo sapiens
guacgacucuuuuccaaac

SEQ ID NO: 514072 - RNA, 19 nt, Homo sapiens
cuguuugccugucucauug

SEQ ID NO: 514073 - RNA, 19 nt, Homo sapiens
acaagcauccugacaacau

SEQ ID NO: 514074 - RNA, 19 nt, Homo sapiens
auacgaggccuucuugcaa

SEQ ID NO: 514075 - RNA, 19 nt, Homo sapiens
gcaguacgugggucccuau

SEQ ID NO: 514076 - RNA, 19 nt, Homo sapiens
cagugcaguuggcugagaa

SEQ ID NO: 514077 - RNA, 19 nt, Homo sapiens
gagagggaaagaacuccuu

SEQ ID NO: 514078 - RNA, 19 nt, Homo sapiens
ugucuggccuuuucuugua

SEQ ID NO: 514079 - RNA, 19 nt, Homo sapiens
ccaacacggguaaaucuag

SEQ ID NO: 514080 - RNA, 19 nt, Homo sapiens
caaaugagguugucacaga

SEQ ID NO: 514081 - RNA, 19 nt, Homo sapiens
gcagagaaaccucaagaaa

SEQ ID NO: 514082 - RNA, 19 nt, Homo sapiens
guacgugggucccuaugaa

SEQ ID NO: 514083 - RNA, 19 nt, Homo sapiens
gagcaucauugcaaacaug

SEQ ID NO: 514084 - RNA, 19 nt, Homo sapiens
ggagagugcugggauggaa

SEQ ID NO: 514085 - RNA, 19 nt, Homo sapiens
caagacaugucauucaagu

SEQ ID NO: 514086 - RNA, 19 nt, Homo sapiens
ucucaggcauggaugaaua

SEQ ID NO: 514087 - RNA, 19 nt, Homo sapiens
caacggaugcuuuaucaga

SEQ ID NO: 514088 - RNA, 19 nt, Homo sapiens
agacaugucauucaaguuu

SEQ ID NO: 514089 - RNA, 19 nt, Homo sapiens
aggcauggaugaauaaaug

SEQ ID NO: 514090 - RNA, 19 nt, Homo sapiens
uguaaacauugccugauuu

SEQ ID NO: 514091 - RNA, 19 nt, Homo sapiens
guacaagcauccugacaac

SEQ ID NO: 514092 - RNA, 19 nt, Homo sapiens
acacuugccuggcgaacaa

SEQ ID NO: 514093 - RNA, 19 nt, Homo sapiens
ccagaugacuugugagaac

SEQ ID NO: 514094 - RNA, 19 nt, Homo sapiens
ccacagagcaccagcaaag

SEQ ID NO: 514095 - RNA, 19 nt, Homo sapiens
gacacgcacuggcacuaaa

SEQ ID NO: 514096 - RNA, 19 nt, Homo sapiens
gcccauuucagaagaguua

SEQ ID NO: 514097 - RNA, 19 nt, Homo sapiens
cagcagagauaauggaaac

SEQ ID NO: 514098 - RNA, 19 nt, Homo sapiens
ggcgugagcuggagaagca

SEQ ID NO: 514099 - RNA, 19 nt, Homo sapiens
caacacggguaaaucuagu

SEQ ID NO: 514100 - RNA, 19 nt, Homo sapiens
cuaguaccaugucguaguu

SEQ ID NO: 514101 - RNA, 19 nt, Homo sapiens
ggagaacagccacgucuuc

SEQ ID NO: 514102 - RNA, 19 nt, Homo sapiens
gagcguggccgacaagauc

SEQ ID NO: 514103 - RNA, 19 nt, Homo sapiens
cacaggagcuugcaacaac

SEQ ID NO: 514104 - RNA, 19 nt, Homo sapiens
caaaggcggcuuccagugu

SEQ ID NO: 514105 - RNA, 19 nt, Homo sapiens
gcacggguaugagcuccaa

SEQ ID NO: 514106 - RNA, 19 nt, Homo sapiens
cagcaucacuggcaugaac

SEQ ID NO: 514107 - RNA, 19 nt, Homo sapiens
guaaacauugccugauuug

SEQ ID NO: 514108 - RNA, 19 nt, Homo sapiens
ggacacgcacuggcacuaa

SEQ ID NO: 514109 - RNA, 19 nt, Homo sapiens
gcagugcaguuggcugaga

SEQ ID NO: 514110 - RNA, 19 nt, Homo sapiens
uguuauagcugcauuuguc

SEQ ID NO: 514111 - RNA, 19 nt, Homo sapiens
gagcugagaugcggaaagc

SEQ ID NO: 514112 - RNA, 19 nt, Homo sapiens
caaauuccccgaagacuuu

SEQ ID NO: 514113 - RNA, 19 nt, Homo sapiens
gguuauggccugcacagaa

SEQ ID NO: 514114 - RNA, 19 nt, Homo sapiens
ccugaaaacucaacaauca

SEQ ID NO: 514115 - RNA, 19 nt, Homo sapiens
gggaaagccugaggagucu

SEQ ID NO: 514116 - RNA, 19 nt, Homo sapiens
guuauggccugcacagaag

SEQ ID NO: 514117 - RNA, 19 nt, Homo sapiens
ggacacugcagaacagcuu

SEQ ID NO: 514118 - RNA, 19 nt, Homo sapiens
ccagagagcguggagaaug

SEQ ID NO: 514119 - RNA, 19 nt, Homo sapiens
acgaggagcugacggaaag

SEQ ID NO: 514120 - RNA, 19 nt, Homo sapiens
gaugaugaccgcuauucug

SEQ ID NO: 514121 - RNA, 19 nt, Homo sapiens
ccaacaagcggagugauug

SEQ ID NO: 514122 - RNA, 19 nt, Homo sapiens
caagcauccugacaacauc

SEQ ID NO: 514123 - RNA, 19 nt, Homo sapiens
gacaugucauucaaguuuc

SEQ ID NO: 514124 - RNA, 19 nt, Homo sapiens
cagagagcguggagaaugg

SEQ ID NO: 514125 - RNA, 19 nt, Homo sapiens
ccgacaagauccuggacuu

SEQ ID NO: 514126 - RNA, 19 nt, Homo sapiens
ugaggagucucgugucucu

SEQ ID NO: 514127 - RNA, 19 nt, Homo sapiens
gggacuuugugcacuguga

SEQ ID NO: 514128 - RNA, 19 nt, Homo sapiens
uccaacggaugcuuuauca

SEQ ID NO: 514129 - RNA, 19 nt, Homo sapiens
gagauaauggaaacaucaa

SEQ ID NO: 514130 - RNA, 19 nt, Homo sapiens
agagaaaccucaagaaaag

SEQ ID NO: 514131 - RNA, 19 nt, Homo sapiens
uuguaaacauugccugauu

SEQ ID NO: 514132 - RNA, 19 nt, Homo sapiens
gaacucccgagcugagaug

SEQ ID NO: 514133 - RNA, 19 nt, Homo sapiens
gggagaaccugcguagacu

SEQ ID NO: 514134 - RNA, 19 nt, Homo sapiens
ugucucgggucaucuguga

SEQ ID NO: 514135 - RNA, 19 nt, Homo sapiens
gagaacagccacgucuuca

SEQ ID NO: 514136 - RNA, 19 nt, Homo sapiens
gagcagcagagauaaugga

SEQ ID NO: 514137 - RNA, 19 nt, Homo sapiens
gccaacaagcggagugauu

SEQ ID NO: 514138 - RNA, 19 nt, Homo sapiens
accacgggcugccagguua

SEQ ID NO: 514139 - RNA, 19 nt, Homo sapiens
cuaauacgaggccuucuug

SEQ ID NO: 514140 - RNA, 19 nt, Homo sapiens
gagcuugcaacaacagaga

SEQ ID NO: 514141 - RNA, 19 nt, Homo sapiens
caaaaugcccaaacacuug

SEQ ID NO: 514142 - RNA, 19 nt, Homo sapiens
aaagaaaagucaaccugaa

SEQ ID NO: 514143 - RNA, 19 nt, Homo sapiens
gcagagauaauggaaacau

SEQ ID NO: 514144 - RNA, 19 nt, Homo sapiens
gcauuugucuggccuuuuc

SEQ ID NO: 514145 - RNA, 19 nt, Homo sapiens
gcauggaugaauaaauguu

SEQ ID NO: 514146 - RNA, 19 nt, Homo sapiens
guaaaucuaguaccauguc

SEQ ID NO: 514147 - RNA, 19 nt, Homo sapiens
ggagacaggcggaggaacu

SEQ ID NO: 514148 - RNA, 19 nt, Homo sapiens
aaguguggcuucccagaga

SEQ ID NO: 514149 - RNA, 19 nt, Homo sapiens
gcugggaggcuuagcugaa

SEQ ID NO: 514150 - RNA, 19 nt, Homo sapiens
cagagauaauggaaacauc

SEQ ID NO: 514151 - RNA, 19 nt, Homo sapiens
gaagaguuacagccgugaa

SEQ ID NO: 514152 - RNA, 19 nt, Homo sapiens
uacaagcgaugaaaagaaa

SEQ ID NO: 514153 - RNA, 19 nt, Homo sapiens
aaucuaguaccaugucgua

SEQ ID NO: 514154 - RNA, 19 nt, Homo sapiens
ccgaggccuuccagcagua

SEQ ID NO: 514155 - RNA, 19 nt, Homo sapiens
caaacuuccugagccaaca

SEQ ID NO: 514156 - RNA, 19 nt, Homo sapiens
cagagaaaccucaagaaaa

SEQ ID NO: 514157 - RNA, 19 nt, Homo sapiens
ggcgcgugcugguguauuc

SEQ ID NO: 514158 - RNA, 19 nt, Homo sapiens
cuggaggccuggagggaaa

SEQ ID NO: 514159 - RNA, 19 nt, Homo sapiens
ucuuugugcuguccaauuc

SEQ ID NO: 514160 - RNA, 19 nt, Homo sapiens
cacagaugaugaccgcuau

SEQ ID NO: 514161 - RNA, 19 nt, Homo sapiens
aacggaugcuuuaucagaa

SEQ ID NO: 514162 - RNA, 19 nt, Homo sapiens
acaggcaaaucggaaauca

SEQ ID NO: 514163 - RNA, 19 nt, Homo sapiens
cugggaggcuuagcugaaa

SEQ ID NO: 514164 - RNA, 19 nt, Homo sapiens
ugguuuggacccacuaaua

SEQ ID NO: 514165 - RNA, 19 nt, Homo sapiens
aaaugagguugucacagau

SEQ ID NO: 514166 - RNA, 19 nt, Homo sapiens
caaauacaggcccaucaca

SEQ ID NO: 514167 - RNA, 19 nt, Homo sapiens
gcagcagagauaauggaaa

SEQ ID NO: 514168 - RNA, 19 nt, Homo sapiens
acgccacgaugcagagaaa

SEQ ID NO: 514169 - RNA, 19 nt, Homo sapiens
aggcuuagcugaaaacuuc

SEQ ID NO: 514170 - RNA, 19 nt, Homo sapiens
cuucagcccauggacauua

SEQ ID NO: 514171 - RNA, 19 nt, Homo sapiens
caacaaucacagcauccaa

SEQ ID NO: 514172 - RNA, 19 nt, Homo sapiens
guacgacucuuuuccaaac

SEQ ID NO: 514173 - RNA, 19 nt, Homo sapiens
cuguuugccugucucauug

SEQ ID NO: 514174 - RNA, 19 nt, Homo sapiens
acaagcauccugacaacau

SEQ ID NO: 514175 - RNA, 19 nt, Homo sapiens
auacgaggccuucuugcaa

SEQ ID NO: 514176 - RNA, 19 nt, Homo sapiens
gcaguacgugggucccuau

SEQ ID NO: 514177 - RNA, 19 nt, Homo sapiens
cagugcaguuggcugagaa

SEQ ID NO: 514178 - RNA, 19 nt, Homo sapiens
gagagggaaagaacuccuu

SEQ ID NO: 514179 - RNA, 19 nt, Homo sapiens
ugucuggccuuuucuugua

SEQ ID NO: 514180 - RNA, 19 nt, Homo sapiens
gaaauuaccugcaaaucaa

SEQ ID NO: 514181 - RNA, 19 nt, Homo sapiens
cagcugagauguugaauua

SEQ ID NO: 514182 - RNA, 19 nt, Homo sapiens
ccagacagcugaaucuuua

SEQ ID NO: 514183 - RNA, 19 nt, Homo sapiens
caacuaaacuuguggaaga

SEQ ID NO: 514184 - RNA, 19 nt, Homo sapiens
uaaauggacugaucucuuu

SEQ ID NO: 514185 - RNA, 19 nt, Homo sapiens
caaagaagcccaagaauau

SEQ ID NO: 514186 - RNA, 19 nt, Homo sapiens
ggacugaucucuuugacaa

SEQ ID NO: 514187 - RNA, 19 nt, Homo sapiens
aaagaaagcugauguaauc

SEQ ID NO: 514188 - RNA, 19 nt, Homo sapiens
ugacaaagcuggauucuag

SEQ ID NO: 514189 - RNA, 19 nt, Homo sapiens
ccaaauaaccgucaacuuu

SEQ ID NO: 514190 - RNA, 19 nt, Homo sapiens
caaauaaccgucaacuuua

SEQ ID NO: 514191 - RNA, 19 nt, Homo sapiens
gcaacucacuggccaaauu

SEQ ID NO: 514192 - RNA, 19 nt, Homo sapiens
ggacgcagcugaugaaugg

SEQ ID NO: 514193 - RNA, 19 nt, Homo sapiens
ggaacuacaucaaguguga

SEQ ID NO: 514194 - RNA, 19 nt, Homo sapiens
cuaauuaucuuccucugua

SEQ ID NO: 514195 - RNA, 19 nt, Homo sapiens
gagcuuagauauucaugaa

SEQ ID NO: 514196 - RNA, 19 nt, Homo sapiens
gcaaaccuauaaaguacua

SEQ ID NO: 514197 - RNA, 19 nt, Homo sapiens
agagaaggauugcauuaua

SEQ ID NO: 514198 - RNA, 19 nt, Homo sapiens
cagaauacaucauuugcua

SEQ ID NO: 514199 - RNA, 19 nt, Homo sapiens
caacaaagacuaagaaugg

SEQ ID NO: 514200 - RNA, 19 nt, Homo sapiens
ggacacauguagcuaguau

SEQ ID NO: 514201 - RNA, 19 nt, Homo sapiens
ggaccuggaugcuaucuug

SEQ ID NO: 514202 - RNA, 19 nt, Homo sapiens
uaacagaacuucauuucca

SEQ ID NO: 514203 - RNA, 19 nt, Homo sapiens
gaccuuccauuuauuguuu

SEQ ID NO: 514204 - RNA, 19 nt, Homo sapiens
ucaaggacaugguauuauu

SEQ ID NO: 514205 - RNA, 19 nt, Homo sapiens
cgaguuggguugcagcuua

SEQ ID NO: 514206 - RNA, 19 nt, Homo sapiens
gagaugguccugacauaua

SEQ ID NO: 514207 - RNA, 19 nt, Homo sapiens
gaguaaaucuaccguguug

SEQ ID NO: 514208 - RNA, 19 nt, Homo sapiens
gcaugcagguuacaacuga

SEQ ID NO: 514209 - RNA, 19 nt, Homo sapiens
ugacaugcaugauagguuu

SEQ ID NO: 514210 - RNA, 19 nt, Homo sapiens
guucagagcaucagaauga

SEQ ID NO: 514211 - RNA, 19 nt, Homo sapiens
gaaagaaagcugauguaau

SEQ ID NO: 514212 - RNA, 19 nt, Homo sapiens
ggaaagaaagcugauguaa

SEQ ID NO: 514213 - RNA, 19 nt, Homo sapiens
caagauuggugauacaaga

SEQ ID NO: 514214 - RNA, 19 nt, Homo sapiens
gagccugcauugauucuaa

SEQ ID NO: 514215 - RNA, 19 nt, Homo sapiens
gcuaugacuucuauccuaa

SEQ ID NO: 514216 - RNA, 19 nt, Homo sapiens
agaguuuacugaagcauua

SEQ ID NO: 514217 - RNA, 19 nt, Homo sapiens
ccacaucaguauucuuuga

SEQ ID NO: 514218 - RNA, 19 nt, Homo sapiens
agugaaggcugacaauaua

SEQ ID NO: 514219 - RNA, 19 nt, Homo sapiens
caauauacuuggucuucua

SEQ ID NO: 514220 - RNA, 19 nt, Homo sapiens
gccaaaggauggugagauu

SEQ ID NO: 514221 - RNA, 19 nt, Homo sapiens
ggagaggccuuaaauuugc

SEQ ID NO: 514222 - RNA, 19 nt, Homo sapiens
gaacacugacugaagcuuu

SEQ ID NO: 514223 - RNA, 19 nt, Homo sapiens
gaaauaaccguggcaucua

SEQ ID NO: 514224 - RNA, 19 nt, Homo sapiens
acaaagaagcccaagaaua

SEQ ID NO: 514225 - RNA, 19 nt, Homo sapiens
guauaugacugcuugguau

SEQ ID NO: 514226 - RNA, 19 nt, Homo sapiens
caacggcucuucucaagca

SEQ ID NO: 514227 - RNA, 19 nt, Homo sapiens
gaagagugcuuaagauucc

SEQ ID NO: 514228 - RNA, 19 nt, Homo sapiens
gcacucugguaccuuaauu

SEQ ID NO: 514229 - RNA, 19 nt, Homo sapiens
uaagagaaggauugcauua

SEQ ID NO: 514230 - RNA, 19 nt, Homo sapiens
gaaaccugcucuccauugu

SEQ ID NO: 514231 - RNA, 19 nt, Homo sapiens
gagaaggauugcauuauac

SEQ ID NO: 514232 - RNA, 19 nt, Homo sapiens
gcaggauccuuaacauugu

SEQ ID NO: 514233 - RNA, 19 nt, Homo sapiens
aaccagccauucuuuguua

SEQ ID NO: 514234 - RNA, 19 nt, Homo sapiens
guuccuaacuggacacuga

SEQ ID NO: 514235 - RNA, 19 nt, Homo sapiens
gcaaaucaauauacuuggu

SEQ ID NO: 514236 - RNA, 19 nt, Homo sapiens
ucauguauccucccgauua

SEQ ID NO: 514237 - RNA, 19 nt, Homo sapiens
gggagaggccuuaaauuug

SEQ ID NO: 514238 - RNA, 19 nt, Homo sapiens
gaacucaugaaucaaugua

SEQ ID NO: 514239 - RNA, 19 nt, Homo sapiens
gcucaaggacaugguauua

SEQ ID NO: 514240 - RNA, 19 nt, Homo sapiens
gggagaauuugugaaguaa

SEQ ID NO: 514241 - RNA, 19 nt, Homo sapiens
gacauuaccacccaaauau

SEQ ID NO: 514242 - RNA, 19 nt, Homo sapiens
ggagaaaggagauuauaca

SEQ ID NO: 514243 - RNA, 19 nt, Homo sapiens
gccaugaauucuauaaguu

SEQ ID NO: 514244 - RNA, 19 nt, Homo sapiens
cuuuaaaccuggucaaauu

SEQ ID NO: 514245 - RNA, 19 nt, Homo sapiens
gagagaaauuaccugcaaa

SEQ ID NO: 514246 - RNA, 19 nt, Homo sapiens
gcagaaacauuuugggaaa

SEQ ID NO: 514247 - RNA, 19 nt, Homo sapiens
ucaaacagcccuagcaguu

SEQ ID NO: 514248 - RNA, 19 nt, Homo sapiens
gcuguuauuucucauauag

SEQ ID NO: 514249 - RNA, 19 nt, Homo sapiens
gcauaacugcuucaauaaa

SEQ ID NO: 514250 - RNA, 19 nt, Homo sapiens
ggaaguggcgaugugaaua

SEQ ID NO: 514251 - RNA, 19 nt, Homo sapiens
gcuuauguuucuccugaua

SEQ ID NO: 514252 - RNA, 19 nt, Homo sapiens
agaagaaccugaacggaau

SEQ ID NO: 514253 - RNA, 19 nt, Homo sapiens
aagaauggcagcaaagaua

SEQ ID NO: 514254 - RNA, 19 nt, Homo sapiens
ugacauuaccacccaaaua

SEQ ID NO: 514255 - RNA, 19 nt, Homo sapiens
gguugcagcuuaugacaug

SEQ ID NO: 514256 - RNA, 19 nt, Homo sapiens
ggccuuaaauuugcaacua

SEQ ID NO: 514257 - RNA, 19 nt, Homo sapiens
gucaaagacugaacuagga

SEQ ID NO: 514258 - RNA, 19 nt, Homo sapiens
gaaaggaacacugacugaa

SEQ ID NO: 514259 - RNA, 19 nt, Homo sapiens
ggaaauaaccguggcaucu

SEQ ID NO: 514260 - RNA, 19 nt, Homo sapiens
gaggagccauugcuucugu

SEQ ID NO: 514261 - RNA, 19 nt, Homo sapiens
ggaagagugcuuaagauuc

SEQ ID NO: 514262 - RNA, 19 nt, Homo sapiens
ugggagaauuugugaagua

SEQ ID NO: 514263 - RNA, 19 nt, Homo sapiens
gaacgaaugaaaagacuua

SEQ ID NO: 514264 - RNA, 19 nt, Homo sapiens
gaaaaggaacgaaugaaaa

SEQ ID NO: 514265 - RNA, 19 nt, Homo sapiens
gauguucaguccuccuuga

SEQ ID NO: 514266 - RNA, 19 nt, Homo sapiens
gaaggaaucaaccgcuuug

SEQ ID NO: 514267 - RNA, 19 nt, Homo sapiens
gcauugcccugauccuuuc

SEQ ID NO: 514268 - RNA, 19 nt, Homo sapiens
agugugaucuugucaacua

SEQ ID NO: 514269 - RNA, 19 nt, Homo sapiens
cuacaaagaagcccaagaa

SEQ ID NO: 514270 - RNA, 19 nt, Homo sapiens
uaugcacucugguaccuua

SEQ ID NO: 514271 - RNA, 19 nt, Homo sapiens
ugggagaggccuuaaauuu

SEQ ID NO: 514272 - RNA, 19 nt, Homo sapiens
guagaugcccuuuguagga

SEQ ID NO: 514273 - RNA, 19 nt, Homo sapiens
gauguaaucccuguucauu

SEQ ID NO: 514274 - RNA, 19 nt, Homo sapiens
agacugaacuaggaaagaa

SEQ ID NO: 514275 - RNA, 19 nt, Homo sapiens
gguauguggcuaugauaua

SEQ ID NO: 514276 - RNA, 19 nt, Homo sapiens
agagagaaauuaccugcaa

SEQ ID NO: 514277 - RNA, 19 nt, Homo sapiens
uauagcugcuggacacuuu

SEQ ID NO: 514278 - RNA, 19 nt, Homo sapiens
gcaucagaaugaacucuau

SEQ ID NO: 514279 - RNA, 19 nt, Homo sapiens
ucacugacguguggcuuaa

SEQ ID NO: 514280 - RNA, 19 nt, Homo sapiens
gaacaaaggcauacacuua

SEQ ID NO: 514281 - RNA, 19 nt, Homo sapiens
gaaguaagcucugcugaua

SEQ ID NO: 514282 - RNA, 19 nt, Homo sapiens
gaaauaacaucacuucaug

SEQ ID NO: 514283 - RNA, 19 nt, Homo sapiens
gaagagaaauuccacaaug

SEQ ID NO: 514284 - RNA, 19 nt, Homo sapiens
gaacaacaguuaucugaau

SEQ ID NO: 514285 - RNA, 19 nt, Homo sapiens
ggaaagagagagaauguua

SEQ ID NO: 514286 - RNA, 19 nt, Homo sapiens
ggacuuagaugccaaaaua

SEQ ID NO: 514287 - RNA, 19 nt, Homo sapiens
gaagcuagcugucgcagaa

SEQ ID NO: 514288 - RNA, 19 nt, Homo sapiens
guacaagacucaauaugaa

SEQ ID NO: 514289 - RNA, 19 nt, Homo sapiens
gagcuuaaauguaaucuug

SEQ ID NO: 514290 - RNA, 19 nt, Homo sapiens
cagaauacauggcugaaua

SEQ ID NO: 514291 - RNA, 19 nt, Homo sapiens
gcagaaagaugaauuggau

SEQ ID NO: 514292 - RNA, 19 nt, Homo sapiens
gaagaaauugguagacuua

SEQ ID NO: 514293 - RNA, 19 nt, Homo sapiens
guagcaaguuuaucuguua

SEQ ID NO: 514294 - RNA, 19 nt, Homo sapiens
gaaacuaacugagcucuau

SEQ ID NO: 514295 - RNA, 19 nt, Homo sapiens
ugaauuaaaugcccacaua

SEQ ID NO: 514296 - RNA, 19 nt, Homo sapiens
gaacaugccucucaaucug

SEQ ID NO: 514297 - RNA, 19 nt, Homo sapiens
gaagaagugcguaagaaua

SEQ ID NO: 514298 - RNA, 19 nt, Homo sapiens
uaacugagcucuauaaugc

SEQ ID NO: 514299 - RNA, 19 nt, Homo sapiens
gaaaaggaauugcuacaua

SEQ ID NO: 514300 - RNA, 19 nt, Homo sapiens
ggaauaaacagaggaaaua

SEQ ID NO: 514301 - RNA, 19 nt, Homo sapiens
gaauguaucucucagugaa

SEQ ID NO: 514302 - RNA, 19 nt, Homo sapiens
ggaagaggauagcaccaua

SEQ ID NO: 514303 - RNA, 19 nt, Homo sapiens
caagaaaucuccaggaaca

SEQ ID NO: 514304 - RNA, 19 nt, Homo sapiens
gaaggaagguguacaaggu

SEQ ID NO: 514305 - RNA, 19 nt, Homo sapiens
aaacagcaccucaguaaua

SEQ ID NO: 514306 - RNA, 19 nt, Homo sapiens
gaagaaaacugaaacaaug

SEQ ID NO: 514307 - RNA, 19 nt, Homo sapiens
ugauggagaugaaguauuu

SEQ ID NO: 514308 - RNA, 19 nt, Homo sapiens
gagcauggaacaacaguua

SEQ ID NO: 514309 - RNA, 19 nt, Homo sapiens
ggaacaauaucaagcaaug

SEQ ID NO: 514310 - RNA, 19 nt, Homo sapiens
gcaaagagcaaugaacuaa

SEQ ID NO: 514311 - RNA, 19 nt, Homo sapiens
gaacaaaggaagaauuaga

SEQ ID NO: 514312 - RNA, 19 nt, Homo sapiens
gaagauaugccacaaacaa

SEQ ID NO: 514313 - RNA, 19 nt, Homo sapiens
gaccaagucucugaugaua

SEQ ID NO: 514314 - RNA, 19 nt, Homo sapiens
guaccuagaugaaauagug

SEQ ID NO: 514315 - RNA, 19 nt, Homo sapiens
ucacagagcugcugauucu

SEQ ID NO: 514316 - RNA, 19 nt, Homo sapiens
uagagaaacucaacaauca

SEQ ID NO: 514317 - RNA, 19 nt, Homo sapiens
guuccuagcucaugaagaa

SEQ ID NO: 514318 - RNA, 19 nt, Homo sapiens
ucaguugacuccaggaaua

SEQ ID NO: 514319 - RNA, 19 nt, Homo sapiens
gugaagaucuggagaaaca

SEQ ID NO: 514320 - RNA, 19 nt, Homo sapiens
ggaugaaguuuccaaaugu

SEQ ID NO: 514321 - RNA, 19 nt, Homo sapiens
agaaacaacuucauccaaa

SEQ ID NO: 514322 - RNA, 19 nt, Homo sapiens
ucaaggagguuuaggaaug

SEQ ID NO: 514323 - RNA, 19 nt, Homo sapiens
gaaagcagaaucacaguug

SEQ ID NO: 514324 - RNA, 19 nt, Homo sapiens
cagaagagcaggugaauga

SEQ ID NO: 514325 - RNA, 19 nt, Homo sapiens
caacaaagcaauacaagau

SEQ ID NO: 514326 - RNA, 19 nt, Homo sapiens
caacagaaagauccagaua

SEQ ID NO: 514327 - RNA, 19 nt, Homo sapiens
gagagagaauguuaaagga

SEQ ID NO: 514328 - RNA, 19 nt, Homo sapiens
gcaaucaucuguacuugag

SEQ ID NO: 514329 - RNA, 19 nt, Homo sapiens
ggacguggccuucaguuga

SEQ ID NO: 514330 - RNA, 19 nt, Homo sapiens
ugacagugaugaugaagaa

SEQ ID NO: 514331 - RNA, 19 nt, Homo sapiens
guucagaguucaccaguug

SEQ ID NO: 514332 - RNA, 19 nt, Homo sapiens
caaccaagcugaaacaaaa

SEQ ID NO: 514333 - RNA, 19 nt, Homo sapiens
gaaagagagagaauguuaa

SEQ ID NO: 514334 - RNA, 19 nt, Homo sapiens
ggaagaaacaacacagaaa

SEQ ID NO: 514335 - RNA, 19 nt, Homo sapiens
ggcauacacuuacuagaaa

SEQ ID NO: 514336 - RNA, 19 nt, Homo sapiens
cacagcaucuaguaucuua

SEQ ID NO: 514337 - RNA, 19 nt, Homo sapiens
auacauggcugaauacaga

SEQ ID NO: 514338 - RNA, 19 nt, Homo sapiens
caauaugaaggucgaauua

SEQ ID NO: 514339 - RNA, 19 nt, Homo sapiens
gaaauugcaagaucaaaug

SEQ ID NO: 514340 - RNA, 19 nt, Homo sapiens
gcacagcuuuaaguaauga

SEQ ID NO: 514341 - RNA, 19 nt, Homo sapiens
aacaagaacuucaggauga

SEQ ID NO: 514342 - RNA, 19 nt, Homo sapiens
ugaaacagcaccucaguaa

SEQ ID NO: 514343 - RNA, 19 nt, Homo sapiens
gagacaaaucuucaucuua

SEQ ID NO: 514344 - RNA, 19 nt, Homo sapiens
gcaagauaauguugaagga

SEQ ID NO: 514345 - RNA, 19 nt, Homo sapiens
aguaagcucugcugauaua

SEQ ID NO: 514346 - RNA, 19 nt, Homo sapiens
gaaagaaguggaagccaaa

SEQ ID NO: 514347 - RNA, 19 nt, Homo sapiens
cgaaggagcagguuucaaa

SEQ ID NO: 514348 - RNA, 19 nt, Homo sapiens
gaauaaguaugagagagaa

SEQ ID NO: 514349 - RNA, 19 nt, Homo sapiens
ucaauacgaugacucaaga

SEQ ID NO: 514350 - RNA, 19 nt, Homo sapiens
ugagagagauaaucgaaga

SEQ ID NO: 514351 - RNA, 19 nt, Homo sapiens
ugaauuggauguucgcauu

SEQ ID NO: 514352 - RNA, 19 nt, Homo sapiens
caaagaagauguggaugau

SEQ ID NO: 514353 - RNA, 19 nt, Homo sapiens
gaaaccaaacaaaggcuua

SEQ ID NO: 514354 - RNA, 19 nt, Homo sapiens
acaaagaacuugaaauugc

SEQ ID NO: 514355 - RNA, 19 nt, Homo sapiens
ggaagaugaugaugaugau

SEQ ID NO: 514356 - RNA, 19 nt, Homo sapiens
gcacaacaggauaagguua

SEQ ID NO: 514357 - RNA, 19 nt, Homo sapiens
gguacaagacucaauauga

SEQ ID NO: 514358 - RNA, 19 nt, Homo sapiens
gaacaggaucuacagcaaa

SEQ ID NO: 514359 - RNA, 19 nt, Homo sapiens
gggcaaaacuuacugcuaa

SEQ ID NO: 514360 - RNA, 19 nt, Homo sapiens
gaacagauuaucaauacga

SEQ ID NO: 514361 - RNA, 19 nt, Homo sapiens
ugaaggauaucgucgagaa

SEQ ID NO: 514362 - RNA, 19 nt, Homo sapiens
cgugauauguaccguauuu

SEQ ID NO: 514363 - RNA, 19 nt, Homo sapiens
caaccaggauucucaagau

SEQ ID NO: 514364 - RNA, 19 nt, Homo sapiens
gcgcuaaagucccaauaug

SEQ ID NO: 514365 - RNA, 19 nt, Homo sapiens
ggaaaugcaggaacucaaa

SEQ ID NO: 514366 - RNA, 19 nt, Homo sapiens
aaccagaacuuaauucaga

SEQ ID NO: 514367 - RNA, 19 nt, Homo sapiens
aaagagagcugcaggaacu

SEQ ID NO: 514368 - RNA, 19 nt, Homo sapiens
caacaguuaucugaauuga

SEQ ID NO: 514369 - RNA, 19 nt, Homo sapiens
gcaggugaaugacuuaaag

SEQ ID NO: 514370 - RNA, 19 nt, Homo sapiens
gaagcaggccuagaaauug

SEQ ID NO: 514371 - RNA, 19 nt, Homo sapiens
ggaagaaguuauggcagaa

SEQ ID NO: 514372 - RNA, 19 nt, Homo sapiens
ccaagucucugaugauaca

SEQ ID NO: 514373 - RNA, 19 nt, Homo sapiens
ggagagacuugugaaugaa

SEQ ID NO: 514374 - RNA, 19 nt, Homo sapiens
gaaacucacugccacaacu

SEQ ID NO: 514375 - RNA, 19 nt, Homo sapiens
gagaaggaauuagagaaug

SEQ ID NO: 514376 - RNA, 19 nt, Homo sapiens
gaacaaaugaauggcuuaa

SEQ ID NO: 514377 - RNA, 19 nt, Homo sapiens
gaacuugaauacuuaacag

SEQ ID NO: 514378 - RNA, 19 nt, Homo sapiens
gaaugaaacccgagagugu

SEQ ID NO: 514379 - RNA, 19 nt, Homo sapiens
caaaacagauuacuucaug

SEQ ID NO: 514380 - RNA, 19 nt, Homo sapiens
ucauuaaagugcauggaaa

SEQ ID NO: 514381 - RNA, 19 nt, Homo sapiens
gggagcagcaccucuacua

SEQ ID NO: 514382 - RNA, 19 nt, Homo sapiens
caaccggccuggcaucuac

SEQ ID NO: 514383 - RNA, 19 nt, Homo sapiens
gauacuggaugcacuucug

SEQ ID NO: 514384 - RNA, 19 nt, Homo sapiens
ggacuggauccaccacuau

SEQ ID NO: 514385 - RNA, 19 nt, Homo sapiens
gaccggacgucaaggaucu

SEQ ID NO: 514386 - RNA, 19 nt, Homo sapiens
gugcuggaccucauuaaag

SEQ ID NO: 514387 - RNA, 19 nt, Homo sapiens
ggaccucauuaaagugcau

SEQ ID NO: 514388 - RNA, 19 nt, Homo sapiens
gaggagcccgugaacaucu

SEQ ID NO: 514389 - RNA, 19 nt, Homo sapiens
ugagaguccgcgaccgaua

SEQ ID NO: 514390 - RNA, 19 nt, Homo sapiens
ggaggagcccgugaacauc

SEQ ID NO: 514391 - RNA, 19 nt, Homo sapiens
uggaggagcccgugaacau

SEQ ID NO: 514392 - RNA, 19 nt, Homo sapiens
cacccacaguucuacauca

SEQ ID NO: 514393 - RNA, 19 nt, Homo sapiens
cauuaaagugcauggaaau

SEQ ID NO: 514394 - RNA, 19 nt, Homo sapiens
gcacccacaguucuacauc

SEQ ID NO: 514395 - RNA, 19 nt, Homo sapiens
ugcuggaccucauuaaagu

SEQ ID NO: 514396 - RNA, 19 nt, Homo sapiens
gagaguccgcgaccgauac

SEQ ID NO: 514397 - RNA, 19 nt, Homo sapiens
caucgugcacccacaguuc

SEQ ID NO: 514398 - RNA, 19 nt, Homo sapiens
ucauuaaagugcauggaaa

SEQ ID NO: 514399 - RNA, 19 nt, Homo sapiens
gggagcagcaccucuacua

SEQ ID NO: 514400 - RNA, 19 nt, Homo sapiens
caaccggccuggcaucuac

SEQ ID NO: 514401 - RNA, 19 nt, Homo sapiens
ggacuggauccaccacuau

SEQ ID NO: 514402 - RNA, 19 nt, Homo sapiens
gaccggacgucaaggaucu

SEQ ID NO: 514403 - RNA, 19 nt, Homo sapiens
cauacuggaugcacuucug

SEQ ID NO: 514404 - RNA, 19 nt, Homo sapiens
gugcuggaccucauuaaag

SEQ ID NO: 514405 - RNA, 19 nt, Homo sapiens
ggaccucauuaaagugcau

SEQ ID NO: 514406 - RNA, 19 nt, Homo sapiens
ugaggacccuucccuaucc

SEQ ID NO: 514407 - RNA, 19 nt, Homo sapiens
cggccaggaugcugaaucu

SEQ ID NO: 514408 - RNA, 19 nt, Homo sapiens
cauuaaagugcauggaaau

SEQ ID NO: 514409 - RNA, 19 nt, Homo sapiens
ugcuggaccucauuaaagu

SEQ ID NO: 514410 - RNA, 19 nt, Homo sapiens
ccugaggacccuucccuau

SEQ ID NO: 514411 - RNA, 19 nt, Homo sapiens
gcacauccuugcuaauuuc

SEQ ID NO: 514412 - RNA, 19 nt, Homo sapiens
ggacagaagguaacauuga

SEQ ID NO: 514413 - RNA, 19 nt, Homo sapiens
ucuaucaccugucaucaua

SEQ ID NO: 514414 - RNA, 19 nt, Homo sapiens
gaacagagaccagaaagag

SEQ ID NO: 514415 - RNA, 19 nt, Homo sapiens
gaagaacagagaccagaaa

SEQ ID NO: 514416 - RNA, 19 nt, Homo sapiens
gaauccagauggcaugguu

SEQ ID NO: 514417 - RNA, 19 nt, Homo sapiens
ggaaaugccuccgcugaag

SEQ ID NO: 514418 - RNA, 19 nt, Homo sapiens
gacagaagguaacauugau

SEQ ID NO: 514419 - RNA, 19 nt, Homo sapiens
cuugagcucuucauuuauu

SEQ ID NO: 514420 - RNA, 19 nt, Homo sapiens
uggcaugguugcucuauug

SEQ ID NO: 514421 - RNA, 19 nt, Homo sapiens
guuaacaaauguggcaauu

SEQ ID NO: 514422 - RNA, 19 nt, Homo sapiens
gaaaucaaucaaagggaaa

SEQ ID NO: 514423 - RNA, 19 nt, Homo sapiens
cauccuugcuaauuucaaa

SEQ ID NO: 514424 - RNA, 19 nt, Homo sapiens
acagagaccagaaagagua

SEQ ID NO: 514425 - RNA, 19 nt, Homo sapiens
ugacugugauuuauuugga

SEQ ID NO: 514426 - RNA, 19 nt, Homo sapiens
caaagggaaacuugaagaa

SEQ ID NO: 514427 - RNA, 19 nt, Homo sapiens
guacaucaaagauuacaug

SEQ ID NO: 514428 - RNA, 19 nt, Homo sapiens
aucuugagcucuucauuua

SEQ ID NO: 514429 - RNA, 19 nt, Homo sapiens
aaagaagccuacaagaagu

SEQ ID NO: 514430 - RNA, 19 nt, Homo sapiens
ucacuggugucgauauugu

SEQ ID NO: 514431 - RNA, 19 nt, Homo sapiens
caucuugagcucuucauuu

SEQ ID NO: 514432 - RNA, 19 nt, Homo sapiens
caaaagaagccuacaagaa

SEQ ID NO: 514433 - RNA, 19 nt, Homo sapiens
gaaacuugaagaacagaga

SEQ ID NO: 514434 - RNA, 19 nt, Homo sapiens
aagggaaacuugaagaaca

SEQ ID NO: 514435 - RNA, 19 nt, Homo sapiens
cagaacaaaucaagcacau

SEQ ID NO: 514436 - RNA, 19 nt, Homo sapiens
ucauguagguugucuaaaa

SEQ ID NO: 514437 - RNA, 19 nt, Homo sapiens
cuacaagaaguacaucaaa

SEQ ID NO: 514438 - RNA, 19 nt, Homo sapiens
gggaagauggucaguagga

SEQ ID NO: 514439 - RNA, 19 nt, Homo sapiens
ucagucgccaucaugauua

SEQ ID NO: 514440 - RNA, 19 nt, Homo sapiens
acaagaaguacaucaaaga

SEQ ID NO: 514441 - RNA, 19 nt, Homo sapiens
caagaaguacaucaaagau

SEQ ID NO: 514442 - RNA, 19 nt, Homo sapiens
cagaagguaacauugauga

SEQ ID NO: 514443 - RNA, 19 nt, Homo sapiens
aaucacuggugucgauauu

SEQ ID NO: 514444 - RNA, 19 nt, Homo sapiens
aguaaucacuggugucgau

SEQ ID NO: 514445 - RNA, 19 nt, Homo sapiens
gaagguaacauugaugacu

SEQ ID NO: 514446 - RNA, 19 nt, Homo sapiens
uacaagaaguacaucaaag

SEQ ID NO: 514447 - RNA, 19 nt, Homo sapiens
gggcgaagguaccgaaagc

SEQ ID NO: 514448 - RNA, 19 nt, Homo sapiens
auaacuggcuucugcuugu

SEQ ID NO: 514449 - RNA, 19 nt, Homo sapiens
gacaggggcugcagaacaa

SEQ ID NO: 514450 - RNA, 19 nt, Homo sapiens
ucaaucaaagggaaacuug

SEQ ID NO: 514451 - RNA, 19 nt, Homo sapiens
ggacuaccgugaggauggu

SEQ ID NO: 514452 - RNA, 19 nt, Homo sapiens
caaaugggacugaugucau

SEQ ID NO: 514453 - RNA, 19 nt, Homo sapiens
ugucauguagguugucuaa

SEQ ID NO: 514454 - RNA, 19 nt, Homo sapiens
uaggacagaagguaacauu

SEQ ID NO: 514455 - RNA, 19 nt, Homo sapiens
ucaguaggacagaagguaa

SEQ ID NO: 514456 - RNA, 19 nt, Homo sapiens
ggugugaccccauauauga

SEQ ID NO: 514457 - RNA, 19 nt, Homo sapiens
gaaguacaucaaagauuac

SEQ ID NO: 514458 - RNA, 19 nt, Homo sapiens
cgaaagcacaguaaucacu

SEQ ID NO: 514459 - RNA, 19 nt, Homo sapiens
gauggucaguaggacagaa

SEQ ID NO: 514460 - RNA, 19 nt, Homo sapiens
gugucgauauugucaugaa

SEQ ID NO: 514461 - RNA, 19 nt, Homo sapiens
ggaucuaucaccugucauc

SEQ ID NO: 514462 - RNA, 19 nt, Homo sapiens
ccaguucuuuauuggugaa

SEQ ID NO: 514463 - RNA, 19 nt, Homo sapiens
cagccacgaugagauguuc

SEQ ID NO: 514464 - RNA, 19 nt, Homo sapiens
aaaagaagccuacaagaag

SEQ ID NO: 514465 - RNA, 19 nt, Homo sapiens
aagaagccuacaagaagua

SEQ ID NO: 514466 - RNA, 19 nt, Homo sapiens
uggaguggaggcauuguuu

SEQ ID NO: 514467 - RNA, 19 nt, Homo sapiens
cagagaccagaaagaguaa

SEQ ID NO: 514468 - RNA, 19 nt, Homo sapiens
ugaagaacagagaccagaa

SEQ ID NO: 514469 - RNA, 19 nt, Homo sapiens
uaucaccugucaucauaac

SEQ ID NO: 514470 - RNA, 19 nt, Homo sapiens
gaaaacaugaauccagaug

SEQ ID NO: 514471 - RNA, 19 nt, Homo sapiens
guaccgaaagcacaguaau

SEQ ID NO: 514472 - RNA, 19 nt, Homo sapiens
uauuuggaguggaggcauu

SEQ ID NO: 514473 - RNA, 19 nt, Homo sapiens
aaccaucaccugcaggaaa

SEQ ID NO: 514474 - RNA, 19 nt, Homo sapiens
guaaucacuggugucgaua

SEQ ID NO: 514475 - RNA, 19 nt, Homo sapiens
acaaaucaagcacauccuu

SEQ ID NO: 514476 - RNA, 19 nt, Homo sapiens
cagucgccaucaugauuau

SEQ ID NO: 514477 - RNA, 19 nt, Homo sapiens
uuggaucuaucaccuguca

SEQ ID NO: 514478 - RNA, 19 nt, Homo sapiens
gaaccaucaccugcaggaa

SEQ ID NO: 514479 - RNA, 19 nt, Homo sapiens
ugguugcucuauuggacua

SEQ ID NO: 514480 - RNA, 19 nt, Homo sapiens
uaacuggcuucugcuuguc

SEQ ID NO: 514481 - RNA, 19 nt, Homo sapiens
gucaguaggacagaaggua

SEQ ID NO: 514482 - RNA, 19 nt, Homo sapiens
ucaggcucgugcuaagcua

SEQ ID NO: 514483 - RNA, 19 nt, Homo sapiens
ggagaaaggcgaacagaua

SEQ ID NO: 514484 - RNA, 19 nt, Homo sapiens
ccuaagcacuuccauaaua

SEQ ID NO: 514485 - RNA, 19 nt, Homo sapiens
ggaaggcagucuuucuaua

SEQ ID NO: 514486 - RNA, 19 nt, Homo sapiens
caaaggaaagccuguauua

SEQ ID NO: 514487 - RNA, 19 nt, Homo sapiens
gaagcagucugguguauag

SEQ ID NO: 514488 - RNA, 19 nt, Homo sapiens
cgacuucuacgacuuauua

SEQ ID NO: 514489 - RNA, 19 nt, Homo sapiens
aggaaagccuguauuauuu

SEQ ID NO: 514490 - RNA, 19 nt, Homo sapiens
gaacaggaacuaugguuug

SEQ ID NO: 514491 - RNA, 19 nt, Homo sapiens
gaaaggagacagcaguauu

SEQ ID NO: 514492 - RNA, 19 nt, Homo sapiens
gaaauauguucaacugcaa

SEQ ID NO: 514493 - RNA, 19 nt, Homo sapiens
gcacacaucuuuuauugaa

SEQ ID NO: 514494 - RNA, 19 nt, Homo sapiens
gagaaaggcgaacagauaa

SEQ ID NO: 514495 - RNA, 19 nt, Homo sapiens
gcugcuaccugaacaguuu

SEQ ID NO: 514496 - RNA, 19 nt, Homo sapiens
ugaaacaucucuacaacug

SEQ ID NO: 514497 - RNA, 19 nt, Homo sapiens
gaaauccaaucaaggaagu

SEQ ID NO: 514498 - RNA, 19 nt, Homo sapiens
uaaauguucccuugaagua

SEQ ID NO: 514499 - RNA, 19 nt, Homo sapiens
agacggauacucuuuauaa

SEQ ID NO: 514500 - RNA, 19 nt, Homo sapiens
guugugcgguuucuagaua

SEQ ID NO: 514501 - RNA, 19 nt, Homo sapiens
gaaagaaagcccacacaca

SEQ ID NO: 514502 - RNA, 19 nt, Homo sapiens
auucgaaucuuccuacaua

SEQ ID NO: 514503 - RNA, 19 nt, Homo sapiens
ggaggcaccugcgaaagaa

SEQ ID NO: 514504 - RNA, 19 nt, Homo sapiens
ccacagacaagugaauuua

SEQ ID NO: 514505 - RNA, 19 nt, Homo sapiens
caaggaaguugugcgguuu

SEQ ID NO: 514506 - RNA, 19 nt, Homo sapiens
aaagaaagcccacacacaa

SEQ ID NO: 514507 - RNA, 19 nt, Homo sapiens
ugacaacuaugaccacaau

SEQ ID NO: 514508 - RNA, 19 nt, Homo sapiens
aaggaaagccuguauuauu

SEQ ID NO: 514509 - RNA, 19 nt, Homo sapiens
gaaggcagucuuucuauag

SEQ ID NO: 514510 - RNA, 19 nt, Homo sapiens
ucaauuguaucauccuuug

SEQ ID NO: 514511 - RNA, 19 nt, Homo sapiens
uguaugcucuugacaacua

SEQ ID NO: 514512 - RNA, 19 nt, Homo sapiens
gaaaaugacuuccagugau

SEQ ID NO: 514513 - RNA, 19 nt, Homo sapiens
gacggauacucuuuauaaa

SEQ ID NO: 514514 - RNA, 19 nt, Homo sapiens
ugaaagagcuuacgauccu

SEQ ID NO: 514515 - RNA, 19 nt, Homo sapiens
gagaauuuauccaucagau

SEQ ID NO: 514516 - RNA, 19 nt, Homo sapiens
uuuauucgauuccucguua

SEQ ID NO: 514517 - RNA, 19 nt, Homo sapiens
ucacugacagcaaacuuua

SEQ ID NO: 514518 - RNA, 19 nt, Homo sapiens
ucauaugacagcaagauua

SEQ ID NO: 514519 - RNA, 19 nt, Homo sapiens
guggauggcucaagaucuu

SEQ ID NO: 514520 - RNA, 19 nt, Homo sapiens
gcaaaggaaagccuguauu

SEQ ID NO: 514521 - RNA, 19 nt, Homo sapiens
gaaagagcuuacgauccua

SEQ ID NO: 514522 - RNA, 19 nt, Homo sapiens
uacaaucuaugcagugaaa

SEQ ID NO: 514523 - RNA, 19 nt, Homo sapiens
gaaucuuccuacauacuau

SEQ ID NO: 514524 - RNA, 19 nt, Homo sapiens
uaucgagucuacaaucuau

SEQ ID NO: 514525 - RNA, 19 nt, Homo sapiens
guuugugccuuccuuauug

SEQ ID NO: 514526 - RNA, 19 nt, Homo sapiens
uaagaaggcggguuucaga

SEQ ID NO: 514527 - RNA, 19 nt, Homo sapiens
aaaggagacagcaguauuu

SEQ ID NO: 514528 - RNA, 19 nt, Homo sapiens
cauaugacagcaagauuaa

SEQ ID NO: 514529 - RNA, 19 nt, Homo sapiens
ccacacacaagugaauuua

SEQ ID NO: 514530 - RNA, 19 nt, Homo sapiens
uaaaggaggcacagauaga

SEQ ID NO: 514531 - RNA, 19 nt, Homo sapiens
gaacguauuauugcuaugu

SEQ ID NO: 514532 - RNA, 19 nt, Homo sapiens
cagaacguauuauugcuau

SEQ ID NO: 514533 - RNA, 19 nt, Homo sapiens
guccaccucuguaugauga

SEQ ID NO: 514534 - RNA, 19 nt, Homo sapiens
gaaguugugcgguuucuag

SEQ ID NO: 514535 - RNA, 19 nt, Homo sapiens
gcacggagaauuuauccau

SEQ ID NO: 514536 - RNA, 19 nt, Homo sapiens
gauacugccauuauuguga

SEQ ID NO: 514537 - RNA, 19 nt, Homo sapiens
ggaagcagucugguguaua

SEQ ID NO: 514538 - RNA, 19 nt, Homo sapiens
uaacaggcuuuaucuacca

SEQ ID NO: 514539 - RNA, 19 nt, Homo sapiens
aauguucgguacuugauaa

SEQ ID NO: 514540 - RNA, 19 nt, Homo sapiens
ccaaauagaaauggagaaa

SEQ ID NO: 514541 - RNA, 19 nt, Homo sapiens
ucguagcgauucacuguaa

SEQ ID NO: 514542 - RNA, 19 nt, Homo sapiens
gacagcaaacuuuauauuc

SEQ ID NO: 514543 - RNA, 19 nt, Homo sapiens
auaauagggucguuagaau

SEQ ID NO: 514544 - RNA, 19 nt, Homo sapiens
gauccuaagcacuuccaua

SEQ ID NO: 514545 - RNA, 19 nt, Homo sapiens
ggauguucuucuucgagua

SEQ ID NO: 514546 - RNA, 19 nt, Homo sapiens
ucucauggauguucuucuu

SEQ ID NO: 514547 - RNA, 19 nt, Homo sapiens
cauaauagggucguuagaa

SEQ ID NO: 514548 - RNA, 19 nt, Homo sapiens
cuaagcacuuccauaauag

SEQ ID NO: 514549 - RNA, 19 nt, Homo sapiens
agucugguguauagaguua

SEQ ID NO: 514550 - RNA, 19 nt, Homo sapiens
uguaucauccuuugcauuu

SEQ ID NO: 514551 - RNA, 19 nt, Homo sapiens
aauguucccuugaaguauu

SEQ ID NO: 514552 - RNA, 19 nt, Homo sapiens
gaaagccuguauuauuuug

SEQ ID NO: 514553 - RNA, 19 nt, Homo sapiens
cuauagaaauccaaucaag

SEQ ID NO: 514554 - RNA, 19 nt, Homo sapiens
ggaguaucguucuauuucu

SEQ ID NO: 514555 - RNA, 19 nt, Homo sapiens
cagaggcacguaugaauga

SEQ ID NO: 514556 - RNA, 19 nt, Homo sapiens
cgaaaccacuaucgagucu

SEQ ID NO: 514557 - RNA, 19 nt, Homo sapiens
guauagaguuauggauuca

SEQ ID NO: 514558 - RNA, 19 nt, Homo sapiens
cgaaucuuccuacauacua

SEQ ID NO: 514559 - RNA, 19 nt, Homo sapiens
ccucagacuuguguuauuc

SEQ ID NO: 514560 - RNA, 19 nt, Homo sapiens
uguaaaggaggcacagaua

SEQ ID NO: 514561 - RNA, 19 nt, Homo sapiens
gcagucugguguauagagu

SEQ ID NO: 514562 - RNA, 19 nt, Homo sapiens
ucaccaaggaaguaaauga

SEQ ID NO: 514563 - RNA, 19 nt, Homo sapiens
uguauagaguuauggauuc

SEQ ID NO: 514564 - RNA, 19 nt, Homo sapiens
ccugccacauguucauaua

SEQ ID NO: 514565 - RNA, 19 nt, Homo sapiens
uggauccgauuaaguauag

SEQ ID NO: 514566 - RNA, 19 nt, Homo sapiens
gcuaugucauuuccaucuu

SEQ ID NO: 514567 - RNA, 19 nt, Homo sapiens
cuagaccucacuuacguua

SEQ ID NO: 514568 - RNA, 19 nt, Homo sapiens
ucagacuuguguuauucua

SEQ ID NO: 514569 - RNA, 19 nt, Homo sapiens
uaucagugaaaguguguua

SEQ ID NO: 514570 - RNA, 19 nt, Homo sapiens
cagaagagauauguugcau

SEQ ID NO: 514571 - RNA, 19 nt, Homo sapiens
guaaaggaggcacagauag

SEQ ID NO: 514572 - RNA, 19 nt, Homo sapiens
agaccucacuuacguuaca

SEQ ID NO: 514573 - RNA, 19 nt, Homo sapiens
gggauggauuugaccuaga

SEQ ID NO: 514574 - RNA, 19 nt, Homo sapiens
acauuuacuucgacuucua

SEQ ID NO: 514575 - RNA, 19 nt, Homo sapiens
gacaagugaauuuaaagga

SEQ ID NO: 514576 - RNA, 19 nt, Homo sapiens
caaugacaguccacagaca

SEQ ID NO: 514577 - RNA, 19 nt, Homo sapiens
gaacccagaggcacguaug

SEQ ID NO: 514578 - RNA, 19 nt, Homo sapiens
gaaacaccgaaaccacuau

SEQ ID NO: 514579 - RNA, 19 nt, Homo sapiens
ggauggauuugaccuagac

SEQ ID NO: 514580 - RNA, 19 nt, Homo sapiens
cauccuugccgaccuaauu

SEQ ID NO: 514581 - RNA, 19 nt, Homo sapiens
uaugacagcaagauuaaga

SEQ ID NO: 514582 - RNA, 19 nt, Homo sapiens
gaaagcccacacacaagug

SEQ ID NO: 514583 - RNA, 19 nt, Homo sapiens
gauaagggcugcaucauuu

SEQ ID NO: 514584 - RNA, 19 nt, Homo sapiens
gcacaguacuucaccauua

SEQ ID NO: 514585 - RNA, 19 nt, Homo sapiens
gaagaagacuguaacauca

SEQ ID NO: 514586 - RNA, 19 nt, Homo sapiens
gaaacaugcuaaagaagaa

SEQ ID NO: 514587 - RNA, 19 nt, Homo sapiens
gcagagagguaacaacgaa

SEQ ID NO: 514588 - RNA, 19 nt, Homo sapiens
auacucagcuuguuuggua

SEQ ID NO: 514589 - RNA, 19 nt, Homo sapiens
ugacaacugugaacucuga

SEQ ID NO: 514590 - RNA, 19 nt, Homo sapiens
gagccaggguaaaugguua

SEQ ID NO: 514591 - RNA, 19 nt, Homo sapiens
aaaggacuaugcaccaaua

SEQ ID NO: 514592 - RNA, 19 nt, Homo sapiens
caggguaaaugguuauaaa

SEQ ID NO: 514593 - RNA, 19 nt, Homo sapiens
ccugaaacaugcuaaagaa

SEQ ID NO: 514594 - RNA, 19 nt, Homo sapiens
ccaguaacaugcuaaagau

SEQ ID NO: 514595 - RNA, 19 nt, Homo sapiens
gcaaagggagauuguaaau

SEQ ID NO: 514596 - RNA, 19 nt, Homo sapiens
ggauaagggcugcaucauu

SEQ ID NO: 514597 - RNA, 19 nt, Homo sapiens
gaauggagcagagagguaa

SEQ ID NO: 514598 - RNA, 19 nt, Homo sapiens
aucaagaucuccuaaguaa

SEQ ID NO: 514599 - RNA, 19 nt, Homo sapiens
cacaguacuucaccauuaa

SEQ ID NO: 514600 - RNA, 19 nt, Homo sapiens
cauaguagaugaugacaac

SEQ ID NO: 514601 - RNA, 19 nt, Homo sapiens
cagguaggcuguggaauug

SEQ ID NO: 514602 - RNA, 19 nt, Homo sapiens
caaagggagauuguaaaua

SEQ ID NO: 514603 - RNA, 19 nt, Homo sapiens
uaaagacacucuaggaaaa

SEQ ID NO: 514604 - RNA, 19 nt, Homo sapiens
ugugaacucugacauaaau

SEQ ID NO: 514605 - RNA, 19 nt, Homo sapiens
guaucaagaucuccuaagu

SEQ ID NO: 514606 - RNA, 19 nt, Homo sapiens
cuaaagacacucuaggaaa

SEQ ID NO: 514607 - RNA, 19 nt, Homo sapiens
cuacuauguuugccaauau

SEQ ID NO: 514608 - RNA, 19 nt, Homo sapiens
ccagguaggcuguggaauu

SEQ ID NO: 514609 - RNA, 19 nt, Homo sapiens
aaaccaacauuuccagcaa

SEQ ID NO: 514610 - RNA, 19 nt, Homo sapiens
aaaguagcauaguagauga

SEQ ID NO: 514611 - RNA, 19 nt, Homo sapiens
uaacugugauuccuugaag

SEQ ID NO: 514612 - RNA, 19 nt, Homo sapiens
ggaauggagcagagaggua

SEQ ID NO: 514613 - RNA, 19 nt, Homo sapiens
gaugacaacugugaacucu

SEQ ID NO: 514614 - RNA, 19 nt, Homo sapiens
caagaucuccuaaguaacu

SEQ ID NO: 514615 - RNA, 19 nt, Homo sapiens
gcaguuguuggacauuaua

SEQ ID NO: 514616 - RNA, 19 nt, Homo sapiens
uacaagauguggugagaau

SEQ ID NO: 514617 - RNA, 19 nt, Homo sapiens
gugcaaagggagauuguaa

SEQ ID NO: 514618 - RNA, 19 nt, Homo sapiens
agaagacuguaacaucauu

SEQ ID NO: 514619 - RNA, 19 nt, Homo sapiens
cuaaagaagaagacuguaa

SEQ ID NO: 514620 - RNA, 19 nt, Homo sapiens
ugaaacaugcuaaagaaga

SEQ ID NO: 514621 - RNA, 19 nt, Homo sapiens
guaacaugcuaaagaugga

SEQ ID NO: 514622 - RNA, 19 nt, Homo sapiens
auucaaagcuuuacaucug

SEQ ID NO: 514623 - RNA, 19 nt, Homo sapiens
uuacugauuuaccuaguga

SEQ ID NO: 514624 - RNA, 19 nt, Homo sapiens
gccaguaacaugcuaaaga

SEQ ID NO: 514625 - RNA, 19 nt, Homo sapiens
uaaacacaaugaacuaagg

SEQ ID NO: 514626 - RNA, 19 nt, Homo sapiens
uaucaagaucuccuaagua

SEQ ID NO: 514627 - RNA, 19 nt, Homo sapiens
gaaagagcacaguacuuca

SEQ ID NO: 514628 - RNA, 19 nt, Homo sapiens
acugugaacucugacauaa

SEQ ID NO: 514629 - RNA, 19 nt, Homo sapiens
caugucauccugaucuuaa

SEQ ID NO: 514630 - RNA, 19 nt, Homo sapiens
gcaagaaagagcacaguac

SEQ ID NO: 514631 - RNA, 19 nt, Homo sapiens
agaagaagacuguaacauc

SEQ ID NO: 514632 - RNA, 19 nt, Homo sapiens
augacgagauccuagauuu

SEQ ID NO: 514633 - RNA, 19 nt, Homo sapiens
agaaagagcacaguacuuc

SEQ ID NO: 514634 - RNA, 19 nt, Homo sapiens
uaaaacaccugcaagaaag

SEQ ID NO: 514635 - RNA, 19 nt, Homo sapiens
ucacuaggacuuuggauca

SEQ ID NO: 514636 - RNA, 19 nt, Homo sapiens
guauguauguuagugacaa

SEQ ID NO: 514637 - RNA, 19 nt, Homo sapiens
gcaccaauaguugccagua

SEQ ID NO: 514638 - RNA, 19 nt, Homo sapiens
gaucaucacagaaaucacu

SEQ ID NO: 514639 - RNA, 19 nt, Homo sapiens
uaagggcugcaucauuuaa

SEQ ID NO: 514640 - RNA, 19 nt, Homo sapiens
aauauuguccugcugguaa

SEQ ID NO: 514641 - RNA, 19 nt, Homo sapiens
uaacaacgaaugcccaaag

SEQ ID NO: 514642 - RNA, 19 nt, Homo sapiens
caccaauaguugccaguau

SEQ ID NO: 514643 - RNA, 19 nt, Homo sapiens
gacauuauacucagcuugu

SEQ ID NO: 514644 - RNA, 19 nt, Homo sapiens
gaccaaagagucccaaugc

SEQ ID NO: 514645 - RNA, 19 nt, Homo sapiens
gggagauuguaaauaaaca

SEQ ID NO: 514646 - RNA, 19 nt, Homo sapiens
acuacuauguuugccaaua

SEQ ID NO: 514647 - RNA, 19 nt, Homo sapiens
gaacuaaggaaagcagucu

SEQ ID NO: 514648 - RNA, 19 nt, Homo sapiens
cuacuugccuaugugagaa

SEQ ID NO: 514649 - RNA, 19 nt, Homo sapiens
ccgguguuguuucugguua

SEQ ID NO: 514650 - RNA, 19 nt, Homo sapiens
uagaugaugacaacuguga

SEQ ID NO: 514651 - RNA, 19 nt, Homo sapiens
acaaaggacuaugcaccaa

SEQ ID NO: 514652 - RNA, 19 nt, Homo sapiens
ugaugacugugacaaagga

SEQ ID NO: 514653 - RNA, 19 nt, Homo sapiens
gcuguggaauugccuacug

SEQ ID NO: 514654 - RNA, 19 nt, Homo sapiens
caccauggcccuccuaaag

SEQ ID NO: 514655 - RNA, 19 nt, Homo sapiens
guagcauaguagaugauga

SEQ ID NO: 514656 - RNA, 19 nt, Homo sapiens
uaaagaagaagacuguaac

SEQ ID NO: 514657 - RNA, 19 nt, Homo sapiens
cauaggauuuaggucacua

SEQ ID NO: 514658 - RNA, 19 nt, Homo sapiens
caagaaagagcacaguacu

SEQ ID NO: 514659 - RNA, 19 nt, Homo sapiens
gcuacuugccuaugugaga

SEQ ID NO: 514660 - RNA, 19 nt, Homo sapiens
gaagacuguaacaucauug

SEQ ID NO: 514661 - RNA, 19 nt, Homo sapiens
gcucagaaaaccaacauuu

SEQ ID NO: 514662 - RNA, 19 nt, Homo sapiens
ggagccaggguaaaugguu

SEQ ID NO: 514663 - RNA, 19 nt, Homo sapiens
caaugcaguuguuggacau

SEQ ID NO: 514664 - RNA, 19 nt, Homo sapiens
guauaaccauaggauuuag

SEQ ID NO: 514665 - RNA, 19 nt, Homo sapiens
cuguauaaccauaggauuu

SEQ ID NO: 514666 - RNA, 19 nt, Homo sapiens
gggcugcaucauuuaauug

SEQ ID NO: 514667 - RNA, 19 nt, Homo sapiens
ugauuuaccuagugagcau

SEQ ID NO: 514668 - RNA, 19 nt, Homo sapiens
caaaggacuaugcaccaau

SEQ ID NO: 514669 - RNA, 19 nt, Homo sapiens
cauuauacucagcuuguuu

SEQ ID NO: 514670 - RNA, 19 nt, Homo sapiens
acacaaugaacuaaggaaa

SEQ ID NO: 514671 - RNA, 19 nt, Homo sapiens
uaacaucauugccauuccu

SEQ ID NO: 514672 - RNA, 19 nt, Homo sapiens
caguacuucaccauuaaua

SEQ ID NO: 514673 - RNA, 19 nt, Homo sapiens
gguaugacgagauccuaga

SEQ ID NO: 514674 - RNA, 19 nt, Homo sapiens
acaaugaacuaaggaaagc

SEQ ID NO: 514675 - RNA, 19 nt, Homo sapiens
guaacugugauuccuugaa

SEQ ID NO: 514676 - RNA, 19 nt, Homo sapiens
ccaauaguugccaguauca

SEQ ID NO: 514677 - RNA, 19 nt, Homo sapiens
uggcugugaacaugaguua

SEQ ID NO: 514678 - RNA, 19 nt, Homo sapiens
cagaucaucacagaaauca

SEQ ID NO: 514679 - RNA, 19 nt, Homo sapiens
augcaguuguuggacauua

SEQ ID NO: 514680 - RNA, 19 nt, Homo sapiens
ccauggcccuccuaaagac

SEQ ID NO: 514681 - RNA, 19 nt, Homo sapiens
aagcugguaugacgagauc

SEQ ID NO: 514682 - RNA, 19 nt, Homo sapiens
gcaauccaaagcugguaug

SEQ ID NO: 514683 - RNA, 19 nt, Homo sapiens
ugacagcacuugaucauaa

SEQ ID NO: 514684 - RNA, 19 nt, Homo sapiens
ggaaggaaguguacaccua

SEQ ID NO: 514685 - RNA, 19 nt, Homo sapiens
gcaagacucuguccaaugu

SEQ ID NO: 514686 - RNA, 19 nt, Homo sapiens
uagcuucccuuaagaauuu

SEQ ID NO: 514687 - RNA, 19 nt, Homo sapiens
gaacacaagacaccaaauu

SEQ ID NO: 514688 - RNA, 19 nt, Homo sapiens
ucaggaauguucaugaaua

SEQ ID NO: 514689 - RNA, 19 nt, Homo sapiens
ggugaaagcuuacuggaau

SEQ ID NO: 514690 - RNA, 19 nt, Homo sapiens
ggaaaaggcuuauguggaa

SEQ ID NO: 514691 - RNA, 19 nt, Homo sapiens
gagcacaucuucaaacuac

SEQ ID NO: 514692 - RNA, 19 nt, Homo sapiens
gcuguaaacuuaacuguuc

SEQ ID NO: 514693 - RNA, 19 nt, Homo sapiens
gcaaugaugauaccucuuu

SEQ ID NO: 514694 - RNA, 19 nt, Homo sapiens
aaauggagccugcagauua

SEQ ID NO: 514695 - RNA, 19 nt, Homo sapiens
aaauugaacucacugcuuu

SEQ ID NO: 514696 - RNA, 19 nt, Homo sapiens
cugcagugcuguaaacuua

SEQ ID NO: 514697 - RNA, 19 nt, Homo sapiens
gaagaaauugcacaucaaa

SEQ ID NO: 514698 - RNA, 19 nt, Homo sapiens
uaccaucacugaagaauug

SEQ ID NO: 514699 - RNA, 19 nt, Homo sapiens
guuaaacucugcauugaug

SEQ ID NO: 514700 - RNA, 19 nt, Homo sapiens
gaccaacggugauguuuca

SEQ ID NO: 514701 - RNA, 19 nt, Homo sapiens
gaaggaaguguacaccuaa

SEQ ID NO: 514702 - RNA, 19 nt, Homo sapiens
uagaagaaauugcacauca

SEQ ID NO: 514703 - RNA, 19 nt, Homo sapiens
gcaggcagcagaaauuaaa

SEQ ID NO: 514704 - RNA, 19 nt, Homo sapiens
aaacuuaacuguucuuugc

SEQ ID NO: 514705 - RNA, 19 nt, Homo sapiens
gcagcaaacugggcagaaa

SEQ ID NO: 514706 - RNA, 19 nt, Homo sapiens
aaacuaagcgcucauucua

SEQ ID NO: 514707 - RNA, 19 nt, Homo sapiens
gcugucaccucuugauuau

SEQ ID NO: 514708 - RNA, 19 nt, Homo sapiens
ucucagcgauucacaugua

SEQ ID NO: 514709 - RNA, 19 nt, Homo sapiens
uagcaacauuugucaauug

SEQ ID NO: 514710 - RNA, 19 nt, Homo sapiens
gcacugggcacuuucgauu

SEQ ID NO: 514711 - RNA, 19 nt, Homo sapiens
ggaccuucguagcccauua

SEQ ID NO: 514712 - RNA, 19 nt, Homo sapiens
ucaaugcacugggcacuuu

SEQ ID NO: 514713 - RNA, 19 nt, Homo sapiens
ggcaagcaguucauucuga

SEQ ID NO: 514714 - RNA, 19 nt, Homo sapiens
acuaagcgcucauucuauu

SEQ ID NO: 514715 - RNA, 19 nt, Homo sapiens
cguaguauguggagacaaa

SEQ ID NO: 514716 - RNA, 19 nt, Homo sapiens
caacauuugucaauugucu

SEQ ID NO: 514717 - RNA, 19 nt, Homo sapiens
uaacugcaacuccaacuuu

SEQ ID NO: 514718 - RNA, 19 nt, Homo sapiens
agauaaggcugaaucaugu

SEQ ID NO: 514719 - RNA, 19 nt, Homo sapiens
acagagauguauugcguuu

SEQ ID NO: 514720 - RNA, 19 nt, Homo sapiens
gcaacuauauuagcaacau

SEQ ID NO: 514721 - RNA, 19 nt, Homo sapiens
gaagcaagacucuguccaa

SEQ ID NO: 514722 - RNA, 19 nt, Homo sapiens
ggaucaaaggauuguauua

SEQ ID NO: 514723 - RNA, 19 nt, Homo sapiens
ugggagagauuguuacaga

SEQ ID NO: 514724 - RNA, 19 nt, Homo sapiens
ucacaauagucuucaacaa

SEQ ID NO: 514725 - RNA, 19 nt, Homo sapiens
cgaaaccgcugucaauacu

SEQ ID NO: 514726 - RNA, 19 nt, Homo sapiens
gaaugaagcaagacucugu

SEQ ID NO: 514727 - RNA, 19 nt, Homo sapiens
ggagauucaagcauaaauu

SEQ ID NO: 514728 - RNA, 19 nt, Homo sapiens
caggaauguucaugaauau

SEQ ID NO: 514729 - RNA, 19 nt, Homo sapiens
gaucauccaagccuagaaa

SEQ ID NO: 514730 - RNA, 19 nt, Homo sapiens
cacuggagauucaagcaua

SEQ ID NO: 514731 - RNA, 19 nt, Homo sapiens
ucagggagauuuaaguaca

SEQ ID NO: 514732 - RNA, 19 nt, Homo sapiens
cagcaggugucaaccaguu

SEQ ID NO: 514733 - RNA, 19 nt, Homo sapiens
uaaccagaauccaagguau

SEQ ID NO: 514734 - RNA, 19 nt, Homo sapiens
ggaaguguacaccuaauca

SEQ ID NO: 514735 - RNA, 19 nt, Homo sapiens
gcauugauggauacgaaua

SEQ ID NO: 514736 - RNA, 19 nt, Homo sapiens
cagauaaggcugaaucaug

SEQ ID NO: 514737 - RNA, 19 nt, Homo sapiens
caacagaugggagagauug

SEQ ID NO: 514738 - RNA, 19 nt, Homo sapiens
gcuggcaagugaugaaugu

SEQ ID NO: 514739 - RNA, 19 nt, Homo sapiens
gggcaggcagcagaaauua

SEQ ID NO: 514740 - RNA, 19 nt, Homo sapiens
acacaagacaccaaauuga

SEQ ID NO: 514741 - RNA, 19 nt, Homo sapiens
aauaauuggucacagcauu

SEQ ID NO: 514742 - RNA, 19 nt, Homo sapiens
aguguuaucccacauauuu

SEQ ID NO: 514743 - RNA, 19 nt, Homo sapiens
cuacucagauugccagcuu

SEQ ID NO: 514744 - RNA, 19 nt, Homo sapiens
gaaaguacaaggucaacag

SEQ ID NO: 514745 - RNA, 19 nt, Homo sapiens
uaacagauagugaaaguac

SEQ ID NO: 514746 - RNA, 19 nt, Homo sapiens
uuaauaagcaccaccgaaa

SEQ ID NO: 514747 - RNA, 19 nt, Homo sapiens
ccugauuccuuuaaaugaa

SEQ ID NO: 514748 - RNA, 19 nt, Homo sapiens
gaacaacagaugggagaga

SEQ ID NO: 514749 - RNA, 19 nt, Homo sapiens
cacuuucgauuccuucuuu

SEQ ID NO: 514750 - RNA, 19 nt, Homo sapiens
ccagacugcuguucuuauc

SEQ ID NO: 514751 - RNA, 19 nt, Homo sapiens
gcgauucacauguagcuuu

SEQ ID NO: 514752 - RNA, 19 nt, Homo sapiens
agaagaaauugcacaucaa

SEQ ID NO: 514753 - RNA, 19 nt, Homo sapiens
guaaccagaauccaaggua

SEQ ID NO: 514754 - RNA, 19 nt, Homo sapiens
cagaugggagagauuguua

SEQ ID NO: 514755 - RNA, 19 nt, Homo sapiens
caccaugccuucuccuaug

SEQ ID NO: 514756 - RNA, 19 nt, Homo sapiens
caaauugaacucacugcuu

SEQ ID NO: 514757 - RNA, 19 nt, Homo sapiens
ccagacuacuacucagauu

SEQ ID NO: 514758 - RNA, 19 nt, Homo sapiens
cugcagcuccuaacagaua

SEQ ID NO: 514759 - RNA, 19 nt, Homo sapiens
cagguuauccagacuacua

SEQ ID NO: 514760 - RNA, 19 nt, Homo sapiens
gauagagaaauuucaggaa

SEQ ID NO: 514761 - RNA, 19 nt, Homo sapiens
ugaugaauguagcaacuau

SEQ ID NO: 514762 - RNA, 19 nt, Homo sapiens
gggcauggaaggaagugua

SEQ ID NO: 514763 - RNA, 19 nt, Homo sapiens
gacagcacuugaucauaau

SEQ ID NO: 514764 - RNA, 19 nt, Homo sapiens
uguaacagauagugaaagu

SEQ ID NO: 514765 - RNA, 19 nt, Homo sapiens
ugucgaggaucaaaggauu

SEQ ID NO: 514766 - RNA, 19 nt, Homo sapiens
gcaguucauucugacaaau

SEQ ID NO: 514767 - RNA, 19 nt, Homo sapiens
agacugcuguucuuaucaa

SEQ ID NO: 514768 - RNA, 19 nt, Homo sapiens
caacugugccgcuucaaca

SEQ ID NO: 514769 - RNA, 19 nt, Homo sapiens
gaggaucaaaggauuguau

SEQ ID NO: 514770 - RNA, 19 nt, Homo sapiens
ccaaggaccaaauaagguu

SEQ ID NO: 514771 - RNA, 19 nt, Homo sapiens
ccagaccaaggaccaaaua

SEQ ID NO: 514772 - RNA, 19 nt, Homo sapiens
cacaagacaccaaauugaa

SEQ ID NO: 514773 - RNA, 19 nt, Homo sapiens
aauggagccugcagauuau

SEQ ID NO: 514774 - RNA, 19 nt, Homo sapiens
ugaaugcuaccaucacuga

SEQ ID NO: 514775 - RNA, 19 nt, Homo sapiens
gcuuuaagacugaugaaug

SEQ ID NO: 514776 - RNA, 19 nt, Homo sapiens
ugugaaggcugcaaaggau

SEQ ID NO: 514777 - RNA, 19 nt, Homo sapiens
ugucaccucuugauuaucu

SEQ ID NO: 514778 - RNA, 19 nt, Homo sapiens
ugaggcaucuggaaauuuu

SEQ ID NO: 514779 - RNA, 19 nt, Homo sapiens
gaugaauguagcaacuaua

SEQ ID NO: 514780 - RNA, 19 nt, Homo sapiens
gucuaugauugaaagcuua

SEQ ID NO: 514781 - RNA, 19 nt, Homo sapiens
cugaagcugucaccucuug

SEQ ID NO: 514782 - RNA, 19 nt, Homo sapiens
cagauugccagcuuuaaga

SEQ ID NO: 514783 - RNA, 19 nt, Homo sapiens
gaacaacggugacacuuca

SEQ ID NO: 514784 - RNA, 19 nt, Homo sapiens
cugaugagcuccaacauaa

SEQ ID NO: 514785 - RNA, 19 nt, Homo sapiens
agacaaagauggagcaaga

SEQ ID NO: 514786 - RNA, 19 nt, Homo sapiens
caacauaacagaagaacuu

SEQ ID NO: 514787 - RNA, 19 nt, Homo sapiens
ugagauaacucgggcauuu

SEQ ID NO: 514788 - RNA, 19 nt, Homo sapiens
acacacacgucacauuuaa

SEQ ID NO: 514789 - RNA, 19 nt, Homo sapiens
caaccuaagugaaucuuug

SEQ ID NO: 514790 - RNA, 19 nt, Homo sapiens
gaagacaccuaccgauugg

SEQ ID NO: 514791 - RNA, 19 nt, Homo sapiens
uugcaaagguuucuucaaa

SEQ ID NO: 514792 - RNA, 19 nt, Homo sapiens
aagagaagauugucacaga

SEQ ID NO: 514793 - RNA, 19 nt, Homo sapiens
gaaaaucuauauccggaaa

SEQ ID NO: 514794 - RNA, 19 nt, Homo sapiens
caagacugcaucaucaaua

SEQ ID NO: 514795 - RNA, 19 nt, Homo sapiens
acaaacaggucuucuugau

SEQ ID NO: 514796 - RNA, 19 nt, Homo sapiens
gguuucuccuuaucuguua

SEQ ID NO: 514797 - RNA, 19 nt, Homo sapiens
ggagaaaccaagcaauugu

SEQ ID NO: 514798 - RNA, 19 nt, Homo sapiens
aagacugcaucaucaauaa

SEQ ID NO: 514799 - RNA, 19 nt, Homo sapiens
gcugaugagcuccaacaua

SEQ ID NO: 514800 - RNA, 19 nt, Homo sapiens
gacacacacgucacauuua

SEQ ID NO: 514801 - RNA, 19 nt, Homo sapiens
ucuggaagcugcaggaguu

SEQ ID NO: 514802 - RNA, 19 nt, Homo sapiens
ggauaaagcaagucaugga

SEQ ID NO: 514803 - RNA, 19 nt, Homo sapiens
ccaggaagauaaacuuucu

SEQ ID NO: 514804 - RNA, 19 nt, Homo sapiens
gccauuuccugucugguuu

SEQ ID NO: 514805 - RNA, 19 nt, Homo sapiens
augcauaccuuaaagcuau

SEQ ID NO: 514806 - RNA, 19 nt, Homo sapiens
agacacacacgucacauuu

SEQ ID NO: 514807 - RNA, 19 nt, Homo sapiens
uaccuuagcuaaagcacuu

SEQ ID NO: 514808 - RNA, 19 nt, Homo sapiens
gcuuagagaugggcaugaa

SEQ ID NO: 514809 - RNA, 19 nt, Homo sapiens
ggagacagcagaguauaau

SEQ ID NO: 514810 - RNA, 19 nt, Homo sapiens
gcuccaacauaacagaaga

SEQ ID NO: 514811 - RNA, 19 nt, Homo sapiens
ccaguccaaugccagagua

SEQ ID NO: 514812 - RNA, 19 nt, Homo sapiens
cuaagugaaucuuugaaca

SEQ ID NO: 514813 - RNA, 19 nt, Homo sapiens
aaagauggagcaagacaaa

SEQ ID NO: 514814 - RNA, 19 nt, Homo sapiens
cagaagacaccuaccgauu

SEQ ID NO: 514815 - RNA, 19 nt, Homo sapiens
gagguaacacguacacaga

SEQ ID NO: 514816 - RNA, 19 nt, Homo sapiens
gaugagcuccaacauaaca

SEQ ID NO: 514817 - RNA, 19 nt, Homo sapiens
gggagaaaccaagcaauug

SEQ ID NO: 514818 - RNA, 19 nt, Homo sapiens
gaacauccagcagccuuug

SEQ ID NO: 514819 - RNA, 19 nt, Homo sapiens
agaagacaccuaccgauug

SEQ ID NO: 514820 - RNA, 19 nt, Homo sapiens
gcacaagccagauugaaaa

SEQ ID NO: 514821 - RNA, 19 nt, Homo sapiens
caacgugcacuacaucugu

SEQ ID NO: 514822 - RNA, 19 nt, Homo sapiens
cacgucacauuuaagcuaa

SEQ ID NO: 514823 - RNA, 19 nt, Homo sapiens
gcaaagguuucuucaaaag

SEQ ID NO: 514824 - RNA, 19 nt, Homo sapiens
gaacagcauccaggaagau

SEQ ID NO: 514825 - RNA, 19 nt, Homo sapiens
ccacagacagcuccucuuc

SEQ ID NO: 514826 - RNA, 19 nt, Homo sapiens
gcagaacagcauccaggaa

SEQ ID NO: 514827 - RNA, 19 nt, Homo sapiens
gcgccaagcaacucauauu

SEQ ID NO: 514828 - RNA, 19 nt, Homo sapiens
gauggagacagcagaguau

SEQ ID NO: 514829 - RNA, 19 nt, Homo sapiens
uggcgcaaauccugaggua

SEQ ID NO: 514830 - RNA, 19 nt, Homo sapiens
gauaaucuccaccgacucu

SEQ ID NO: 514831 - RNA, 19 nt, Homo sapiens
acagacagcuccucuucuc

SEQ ID NO: 514832 - RNA, 19 nt, Homo sapiens
gcacuuaauaccacagaca

SEQ ID NO: 514833 - RNA, 19 nt, Homo sapiens
ccaagcaacucauauucac

SEQ ID NO: 514834 - RNA, 19 nt, Homo sapiens
caauugugcugcuucaacu

SEQ ID NO: 514835 - RNA, 19 nt, Homo sapiens
cccagacaauagcaauuaa

SEQ ID NO: 514836 - RNA, 19 nt, Homo sapiens
ggcaauguuucgauagaca

SEQ ID NO: 514837 - RNA, 19 nt, Homo sapiens
gagaaaccaagcaauugug

SEQ ID NO: 514838 - RNA, 19 nt, Homo sapiens
uuccauauguuagccauuu

SEQ ID NO: 514839 - RNA, 19 nt, Homo sapiens
caggaccguucacauacaa

SEQ ID NO: 514840 - RNA, 19 nt, Homo sapiens
ccaggaccguucacauaca

SEQ ID NO: 514841 - RNA, 19 nt, Homo sapiens
gcgcaaauccugagguaac

SEQ ID NO: 514842 - RNA, 19 nt, Homo sapiens
cagcauccaggaagauaaa

SEQ ID NO: 514843 - RNA, 19 nt, Homo sapiens
acacgucacauuuaagcua

SEQ ID NO: 514844 - RNA, 19 nt, Homo sapiens
aagcuuggcagaugggaua

SEQ ID NO: 514845 - RNA, 19 nt, Homo sapiens
cauuugauaccuuagcuaa

SEQ ID NO: 514846 - RNA, 19 nt, Homo sapiens
gacaaacaggucuucuuga

SEQ ID NO: 514847 - RNA, 19 nt, Homo sapiens
gcaugaaaauggaaucugu

SEQ ID NO: 514848 - RNA, 19 nt, Homo sapiens
ccugucugguuucuccuua

SEQ ID NO: 514849 - RNA, 19 nt, Homo sapiens
gaccagcacaagccagauu

SEQ ID NO: 514850 - RNA, 19 nt, Homo sapiens
ucgggcauuugauaccuua

SEQ ID NO: 514851 - RNA, 19 nt, Homo sapiens
gagauaacucgggcauuug

SEQ ID NO: 514852 - RNA, 19 nt, Homo sapiens
cagggaugcuugugaacau

SEQ ID NO: 514853 - RNA, 19 nt, Homo sapiens
aaaucuauauccggaaaga

SEQ ID NO: 514854 - RNA, 19 nt, Homo sapiens
gcaauugugcugcuucaac

SEQ ID NO: 514855 - RNA, 19 nt, Homo sapiens
cgggagaaaccaagcaauu

SEQ ID NO: 514856 - RNA, 19 nt, Homo sapiens
ccagacaauagcaauuaaa

SEQ ID NO: 514857 - RNA, 19 nt, Homo sapiens
ucauggagcacaucuggaa

SEQ ID NO: 514858 - RNA, 19 nt, Homo sapiens
agaacagcauccaggaaga

SEQ ID NO: 514859 - RNA, 19 nt, Homo sapiens
ugugaagguugcaaagguu

SEQ ID NO: 514860 - RNA, 19 nt, Homo sapiens
ucccagacaauagcaauua

SEQ ID NO: 514861 - RNA, 19 nt, Homo sapiens
ccuuaaagcuauaguucuc

SEQ ID NO: 514862 - RNA, 19 nt, Homo sapiens
cugcaggaguucuguaaca

SEQ ID NO: 514863 - RNA, 19 nt, Homo sapiens
uaacaaugcccaguccaau

SEQ ID NO: 514864 - RNA, 19 nt, Homo sapiens
gcuaaagcacuuaauacca

SEQ ID NO: 514865 - RNA, 19 nt, Homo sapiens
caacggugacacuucagaa

SEQ ID NO: 514866 - RNA, 19 nt, Homo sapiens
agccaagacugcaucauca

SEQ ID NO: 514867 - RNA, 19 nt, Homo sapiens
gccaagcaacucauauuca

SEQ ID NO: 514868 - RNA, 19 nt, Homo sapiens
uuugauaccuuagcuaaag

SEQ ID NO: 514869 - RNA, 19 nt, Homo sapiens
gggcacacuggcaaaugua

SEQ ID NO: 514870 - RNA, 19 nt, Homo sapiens
ccugagaaguccccugaua

SEQ ID NO: 514871 - RNA, 19 nt, Homo sapiens
caaaaggagugugaggaaa

SEQ ID NO: 514872 - RNA, 19 nt, Homo sapiens
ggacagaaaauccagauag

SEQ ID NO: 514873 - RNA, 19 nt, Homo sapiens
gcacuacaucugugagucu

SEQ ID NO: 514874 - RNA, 19 nt, Homo sapiens
gacagcuccucuucuccaa

SEQ ID NO: 514875 - RNA, 19 nt, Homo sapiens
ggcaggauccagauuguca

SEQ ID NO: 514876 - RNA, 19 nt, Homo sapiens
gaggaccagucugcaagug

SEQ ID NO: 514877 - RNA, 19 nt, Homo sapiens
caaacaggucuucuugauc

SEQ ID NO: 514878 - RNA, 19 nt, Homo sapiens
gcugucaguugugaagguu

SEQ ID NO: 514879 - RNA, 19 nt, Homo sapiens
ucaaccaccugcagaacag

SEQ ID NO: 514880 - RNA, 19 nt, Homo sapiens
cggugacacuucagaaauc

SEQ ID NO: 514881 - RNA, 19 nt, Homo sapiens
gaccucccuugccaaccua

SEQ ID NO: 514882 - RNA, 19 nt, Homo sapiens
caaagauggagcaagacaa

SEQ ID NO: 514883 - RNA, 19 nt, Homo sapiens
ggaagaagcuuguucguaa

SEQ ID NO: 514884 - RNA, 19 nt, Homo sapiens
gaagauugcugaugauaaa

SEQ ID NO: 514885 - RNA, 19 nt, Homo sapiens
ggaagaagcuauucaguug

SEQ ID NO: 514886 - RNA, 19 nt, Homo sapiens
gcaaggacaucucuacaaa

SEQ ID NO: 514887 - RNA, 19 nt, Homo sapiens
ugagagaacugauuucaaa

SEQ ID NO: 514888 - RNA, 19 nt, Homo sapiens
ucaagaagauugcugauga

SEQ ID NO: 514889 - RNA, 19 nt, Homo sapiens
gaaguuaacagaaugauga

SEQ ID NO: 514890 - RNA, 19 nt, Homo sapiens
gggaacagaugaagaagaa

SEQ ID NO: 514891 - RNA, 19 nt, Homo sapiens
gaacacgucuugcuaaacu

SEQ ID NO: 514892 - RNA, 19 nt, Homo sapiens
gaagaagcuuguucguaaa

SEQ ID NO: 514893 - RNA, 19 nt, Homo sapiens
ggacaucucuacaaauuac

SEQ ID NO: 514894 - RNA, 19 nt, Homo sapiens
ccagucaacuucugaauug

SEQ ID NO: 514895 - RNA, 19 nt, Homo sapiens
agacgaagaugaagaaaug

SEQ ID NO: 514896 - RNA, 19 nt, Homo sapiens
agaagaaucugaugaugaa

SEQ ID NO: 514897 - RNA, 19 nt, Homo sapiens
gagagggaaugugaaauuu

SEQ ID NO: 514898 - RNA, 19 nt, Homo sapiens
caauuacccuugucuuaaa

SEQ ID NO: 514899 - RNA, 19 nt, Homo sapiens
gaagaugaauacaaagcuu

SEQ ID NO: 514900 - RNA, 19 nt, Homo sapiens
ggagugaaguucgaugaaa

SEQ ID NO: 514901 - RNA, 19 nt, Homo sapiens
gaagauggccagucaacuu

SEQ ID NO: 514902 - RNA, 19 nt, Homo sapiens
ugacgaauauggaucuaaa

SEQ ID NO: 514903 - RNA, 19 nt, Homo sapiens
gaaagaagaaucugaugau

SEQ ID NO: 514904 - RNA, 19 nt, Homo sapiens
ggagagggaaugugaaauu

SEQ ID NO: 514905 - RNA, 19 nt, Homo sapiens
ggaagaagagcccgaagaa

SEQ ID NO: 514906 - RNA, 19 nt, Homo sapiens
gaacagaugaagaagaaga

SEQ ID NO: 514907 - RNA, 19 nt, Homo sapiens
uaaagcauauggagauaga

SEQ ID NO: 514908 - RNA, 19 nt, Homo sapiens
uaaggaagaugaagaugau

SEQ ID NO: 514909 - RNA, 19 nt, Homo sapiens
gcgauuacauuaagcucua

SEQ ID NO: 514910 - RNA, 19 nt, Homo sapiens
aaggacaucucuacaaauu

SEQ ID NO: 514911 - RNA, 19 nt, Homo sapiens
gauuaugggucacaggaaa

SEQ ID NO: 514912 - RNA, 19 nt, Homo sapiens
ggagauagaauagaaagaa

SEQ ID NO: 514913 - RNA, 19 nt, Homo sapiens
cagaaccuguggaugaaua

SEQ ID NO: 514914 - RNA, 19 nt, Homo sapiens
acagacgacuuccaugaua

SEQ ID NO: 514915 - RNA, 19 nt, Homo sapiens
ggaagaagaagcagccaaa

SEQ ID NO: 514916 - RNA, 19 nt, Homo sapiens
gcaagacgaagaugaagaa

SEQ ID NO: 514917 - RNA, 19 nt, Homo sapiens
ggcugaaucuucuccauuu

SEQ ID NO: 514918 - RNA, 19 nt, Homo sapiens
caaagaagagaaagaagaa

SEQ ID NO: 514919 - RNA, 19 nt, Homo sapiens
ccucaugaauguaaauuug

SEQ ID NO: 514920 - RNA, 19 nt, Homo sapiens
cagcaagacugaaacuguu

SEQ ID NO: 514921 - RNA, 19 nt, Homo sapiens
agaagaaccugcugcaugu

SEQ ID NO: 514922 - RNA, 19 nt, Homo sapiens
ucaguuggauggauuaaau

SEQ ID NO: 514923 - RNA, 19 nt, Homo sapiens
gugaagcaguugagaaaga

SEQ ID NO: 514924 - RNA, 19 nt, Homo sapiens
gacggaugaugaaguagua

SEQ ID NO: 514925 - RNA, 19 nt, Homo sapiens
agaagaaccugaagagaca

SEQ ID NO: 514926 - RNA, 19 nt, Homo sapiens
caacauaaacugcuuaagg

SEQ ID NO: 514927 - RNA, 19 nt, Homo sapiens
cgacuuccaugauaugaug

SEQ ID NO: 514928 - RNA, 19 nt, Homo sapiens
ugaauugauuggccaguuu

SEQ ID NO: 514929 - RNA, 19 nt, Homo sapiens
gagggaaugugaaauuuac

SEQ ID NO: 514930 - RNA, 19 nt, Homo sapiens
gaagaaacagcaaaggaau

SEQ ID NO: 514931 - RNA, 19 nt, Homo sapiens
aaagagcgauuacauuaag

SEQ ID NO: 514932 - RNA, 19 nt, Homo sapiens
acugggaacuuaugaauga

SEQ ID NO: 514933 - RNA, 19 nt, Homo sapiens
aaagggcuaugaaguuauu

SEQ ID NO: 514934 - RNA, 19 nt, Homo sapiens
ggagagucgugaagcaguu

SEQ ID NO: 514935 - RNA, 19 nt, Homo sapiens
gaaaugaggaacuaacagu

SEQ ID NO: 514936 - RNA, 19 nt, Homo sapiens
ggaagaugaagaugauaaa

SEQ ID NO: 514937 - RNA, 19 nt, Homo sapiens
agaagaagcagccaaagaa

SEQ ID NO: 514938 - RNA, 19 nt, Homo sapiens
aagaagaagcaucugauua

SEQ ID NO: 514939 - RNA, 19 nt, Homo sapiens
ugauguggaugguacagua

SEQ ID NO: 514940 - RNA, 19 nt, Homo sapiens
aaaggaaucuacagcugaa

SEQ ID NO: 514941 - RNA, 19 nt, Homo sapiens
aagaagagcccgaagaaga

SEQ ID NO: 514942 - RNA, 19 nt, Homo sapiens
gcgagacucuucagcaaca

SEQ ID NO: 514943 - RNA, 19 nt, Homo sapiens
ccaaagaagagaaagaaga

SEQ ID NO: 514944 - RNA, 19 nt, Homo sapiens
agaagcaucugauuaccuu

SEQ ID NO: 514945 - RNA, 19 nt, Homo sapiens
gaauuaaggaagaugaaga

SEQ ID NO: 514946 - RNA, 19 nt, Homo sapiens
caaaagaaguagaagaaga

SEQ ID NO: 514947 - RNA, 19 nt, Homo sapiens
aaggacggaugaugaagua

SEQ ID NO: 514948 - RNA, 19 nt, Homo sapiens
auaaagcccuuaaggacaa

SEQ ID NO: 514949 - RNA, 19 nt, Homo sapiens
gggaacuuaugaaugauau

SEQ ID NO: 514950 - RNA, 19 nt, Homo sapiens
ggacugggaacuuaugaau

SEQ ID NO: 514951 - RNA, 19 nt, Homo sapiens
ugaugaagcugcaguagag

SEQ ID NO: 514952 - RNA, 19 nt, Homo sapiens
gaagaagaaccugaagaga

SEQ ID NO: 514953 - RNA, 19 nt, Homo sapiens
gaacauugacccugaugca

SEQ ID NO: 514954 - RNA, 19 nt, Homo sapiens
caagaagauugcugaugau

SEQ ID NO: 514955 - RNA, 19 nt, Homo sapiens
guaaaacgcuggacaugau

SEQ ID NO: 514956 - RNA, 19 nt, Homo sapiens
acaaagcuuucuacaaauc

SEQ ID NO: 514957 - RNA, 19 nt, Homo sapiens
gcagcaagacugaaacugu

SEQ ID NO: 514958 - RNA, 19 nt, Homo sapiens
acaggaagauggccaguca

SEQ ID NO: 514959 - RNA, 19 nt, Homo sapiens
uagaagaggaucuggguaa

SEQ ID NO: 514960 - RNA, 19 nt, Homo sapiens
ggacggggaacgacaauua

SEQ ID NO: 514961 - RNA, 19 nt, Homo sapiens
caaaugcuucugaugcuuu

SEQ ID NO: 514962 - RNA, 19 nt, Homo sapiens
ugaagcaguugagaaagaa

SEQ ID NO: 514963 - RNA, 19 nt, Homo sapiens
gaucuccccuugaauguuu

SEQ ID NO: 514964 - RNA, 19 nt, Homo sapiens
cugauuaccuugaauugga

SEQ ID NO: 514965 - RNA, 19 nt, Homo sapiens
ccagagaagaguugguuaa

SEQ ID NO: 514966 - RNA, 19 nt, Homo sapiens
aaaugcuucugaugcuuua

SEQ ID NO: 514967 - RNA, 19 nt, Homo sapiens
gacaugaucaagaagauug

SEQ ID NO: 514968 - RNA, 19 nt, Homo sapiens
ucacagacgacuuccauga

SEQ ID NO: 514969 - RNA, 19 nt, Homo sapiens
gacacccgcugaucagaga

SEQ ID NO: 514970 - RNA, 19 nt, Homo sapiens
gagugaaguucgaugaaag

SEQ ID NO: 514971 - RNA, 19 nt, Homo sapiens
gcuaugaaguuauuuaccu

SEQ ID NO: 514972 - RNA, 19 nt, Homo sapiens
ugaaucuucuccauuuguu

SEQ ID NO: 514973 - RNA, 19 nt, Homo sapiens
aaagaagaaucugaugaug

SEQ ID NO: 514974 - RNA, 19 nt, Homo sapiens
augcaaagguggaagaaga

SEQ ID NO: 514975 - RNA, 19 nt, Homo sapiens
uaccagacacuaaagcaua

SEQ ID NO: 514976 - RNA, 19 nt, Homo sapiens
ugaaagauaaagcccuuaa

SEQ ID NO: 514977 - RNA, 19 nt, Homo sapiens
ccagaauguugccaaggaa

SEQ ID NO: 514978 - RNA, 19 nt, Homo sapiens
uccaugauaugaugccuaa

SEQ ID NO: 514979 - RNA, 19 nt, Homo sapiens
ggaacuaacagucaaaauu

SEQ ID NO: 514980 - RNA, 19 nt, Homo sapiens
acacagagcaagacgaaga

SEQ ID NO: 514981 - RNA, 19 nt, Homo sapiens
gcagaagacacaacagaag

SEQ ID NO: 514982 - RNA, 19 nt, Homo sapiens
gagagaggaagaagcuauu

SEQ ID NO: 514983 - RNA, 19 nt, Homo sapiens
uagaaucucuuucgaaguu

SEQ ID NO: 514984 - RNA, 19 nt, Homo sapiens
acacaggccugcucucuuu

SEQ ID NO: 514985 - RNA, 19 nt, Homo sapiens
gagaaugaguuucccuuug

SEQ ID NO: 514986 - RNA, 19 nt, Homo sapiens
ccagagggcuccacuagga

SEQ ID NO: 514987 - RNA, 19 nt, Homo sapiens
ggcauaaacuuuccucuuc

SEQ ID NO: 514988 - RNA, 19 nt, Homo sapiens
ggaaagagaacccaucugu

SEQ ID NO: 514989 - RNA, 19 nt, Homo sapiens
gaacccaucugucgcucuu

SEQ ID NO: 514990 - RNA, 19 nt, Homo sapiens
ccacuaggacuucaaauug

SEQ ID NO: 514991 - RNA, 19 nt, Homo sapiens
ggugaaggcuggcaugauc

SEQ ID NO: 514992 - RNA, 19 nt, Homo sapiens
gguuggauuugaagacuuu

SEQ ID NO: 514993 - RNA, 19 nt, Homo sapiens
ggcaaaggguccagaagga

SEQ ID NO: 514994 - RNA, 19 nt, Homo sapiens
cguaacaccugauuaacug

SEQ ID NO: 514995 - RNA, 19 nt, Homo sapiens
ggagauggcacuggaaaga

SEQ ID NO: 514996 - RNA, 19 nt, Homo sapiens
ucccagaccucccaccuaa

SEQ ID NO: 514997 - RNA, 19 nt, Homo sapiens
gaaggacgacacaauguuc

SEQ ID NO: 514998 - RNA, 19 nt, Homo sapiens
ccaaguauggcuacaaguu

SEQ ID NO: 514999 - RNA, 19 nt, Homo sapiens
uguggaagaucaccaaugu

SEQ ID NO: 515000 - RNA, 19 nt, Homo sapiens
uaacugaggcauccacuuc

SEQ ID NO: 515001 - RNA, 19 nt, Homo sapiens
agaaugaguuucccuuugg

SEQ ID NO: 515002 - RNA, 19 nt, Homo sapiens
ggaagcugcguguguuuga

SEQ ID NO: 515003 - RNA, 19 nt, Homo sapiens
gaagaggggcauaaacuuu

SEQ ID NO: 515004 - RNA, 19 nt, Homo sapiens
gacacaauguuccucaagu

SEQ ID NO: 515005 - RNA, 19 nt, Homo sapiens
caaguauggcuacaaguug

SEQ ID NO: 515006 - RNA, 19 nt, Homo sapiens
cuucuacacugccaaguau

SEQ ID NO: 515007 - RNA, 19 nt, Homo sapiens
ggaauugggugccccuuug

SEQ ID NO: 515008 - RNA, 19 nt, Homo sapiens
ccaagccacugagcaaugu

SEQ ID NO: 515009 - RNA, 19 nt, Homo sapiens
acacaauguuccucaagug

SEQ ID NO: 515010 - RNA, 19 nt, Homo sapiens
gggcauaaacuuuccucuu

SEQ ID NO: 515011 - RNA, 19 nt, Homo sapiens
ccauggcccuggagcagaa

SEQ ID NO: 515012 - RNA, 19 nt, Homo sapiens
gcccagaaagucucucauu

SEQ ID NO: 515013 - RNA, 19 nt, Homo sapiens
gaaacaggaccggguggaa

SEQ ID NO: 515014 - RNA, 19 nt, Homo sapiens
gaagcucucgggcuaggaa

SEQ ID NO: 515015 - RNA, 19 nt, Homo sapiens
cauuggaggugaacaagca

SEQ ID NO: 515016 - RNA, 19 nt, Homo sapiens
ccucccagcuccucacuca

SEQ ID NO: 515017 - RNA, 19 nt, Homo sapiens
cccagaaagucucucauuc

SEQ ID NO: 515018 - RNA, 19 nt, Homo sapiens
ggugucggcugcuccuuca

SEQ ID NO: 515019 - RNA, 19 nt, Homo sapiens
agauggcacuggaaagaga

SEQ ID NO: 515020 - RNA, 19 nt, Homo sapiens
cuaaacaccacgucacuuc

SEQ ID NO: 515021 - RNA, 19 nt, Homo sapiens
gcacggaccaugcgacacu

SEQ ID NO: 515022 - RNA, 19 nt, Homo sapiens
gcucgucauuggaggugaa

SEQ ID NO: 515023 - RNA, 19 nt, Homo sapiens
guauaaccccaaagaaaua

SEQ ID NO: 515024 - RNA, 19 nt, Homo sapiens
ucacucaccuucaguaacc

SEQ ID NO: 515025 - RNA, 19 nt, Homo sapiens
ggacacaggccugcucucu

SEQ ID NO: 515026 - RNA, 19 nt, Homo sapiens
uggaagaucaccaauguca

SEQ ID NO: 515027 - RNA, 19 nt, Homo sapiens
ugaaggacgacacaauguu

SEQ ID NO: 515028 - RNA, 19 nt, Homo sapiens
ugagaaugaguuucccuuu

SEQ ID NO: 515029 - RNA, 19 nt, Homo sapiens
caauguuccucaagugcau

SEQ ID NO: 515030 - RNA, 19 nt, Homo sapiens
ucccguaacaccugauuaa

SEQ ID NO: 515031 - RNA, 19 nt, Homo sapiens
caggugaguccuagagcua

SEQ ID NO: 515032 - RNA, 19 nt, Homo sapiens
cacuaggacuucaaauugg

SEQ ID NO: 515033 - RNA, 19 nt, Homo sapiens
ggaauggcgaggaucagau

SEQ ID NO: 515034 - RNA, 19 nt, Homo sapiens
ucugagaacccgaggaaug

SEQ ID NO: 515035 - RNA, 19 nt, Homo sapiens
caagggaagcccacagucu

SEQ ID NO: 515036 - RNA, 19 nt, Homo sapiens
caguuugaaugcagucugu

SEQ ID NO: 515037 - RNA, 19 nt, Homo sapiens
caaaugagaagaaaaugga

SEQ ID NO: 515038 - RNA, 19 nt, Homo sapiens
gaaucucuuucgaaguuuu

SEQ ID NO: 515039 - RNA, 19 nt, Homo sapiens
gccacugagcaauguauaa

SEQ ID NO: 515040 - RNA, 19 nt, Homo sapiens
caagaccucagggcacaaa

SEQ ID NO: 515041 - RNA, 19 nt, Homo sapiens
gugaaggacgacacaaugu

SEQ ID NO: 515042 - RNA, 19 nt, Homo sapiens
gaagcugcguguguuugag

SEQ ID NO: 515043 - RNA, 19 nt, Homo sapiens
ccaccuaaaccugcuguug

SEQ ID NO: 515044 - RNA, 19 nt, Homo sapiens
gaccucagggcacaaagau

SEQ ID NO: 515045 - RNA, 19 nt, Homo sapiens
gcaggaccgucagccucuu

SEQ ID NO: 515046 - RNA, 19 nt, Homo sapiens
gcagagcuugcgccucaug

SEQ ID NO: 515047 - RNA, 19 nt, Homo sapiens
uguccaggcucgucauugg

SEQ ID NO: 515048 - RNA, 19 nt, Homo sapiens
cgugaaggacgacacaaug

SEQ ID NO: 515049 - RNA, 19 nt, Homo sapiens
gcuccucacucaccuucag

SEQ ID NO: 515050 - RNA, 19 nt, Homo sapiens
ggugaguccuagagcuaca

SEQ ID NO: 515051 - RNA, 19 nt, Homo sapiens
cgaggaauggcgaggauca

SEQ ID NO: 515052 - RNA, 19 nt, Homo sapiens
uaaacaccacgucacuuca

SEQ ID NO: 515053 - RNA, 19 nt, Homo sapiens
gcuccacuaggacuucaaa

SEQ ID NO: 515054 - RNA, 19 nt, Homo sapiens
gggauggggugccaguuug

SEQ ID NO: 515055 - RNA, 19 nt, Homo sapiens
guaggacccaagcagagaa

SEQ ID NO: 515056 - RNA, 19 nt, Homo sapiens
gcuaaacaccacgucacuu

SEQ ID NO: 515057 - RNA, 19 nt, Homo sapiens
ggguuggauuugaagacuu

SEQ ID NO: 515058 - RNA, 19 nt, Homo sapiens
gacacaggccugcucucuu

SEQ ID NO: 515059 - RNA, 19 nt, Homo sapiens
gggaagcugcguguguuug

SEQ ID NO: 515060 - RNA, 19 nt, Homo sapiens
ccagaccucccaccuaaac

SEQ ID NO: 515061 - RNA, 19 nt, Homo sapiens
gagcuagccagaggacugu

SEQ ID NO: 515062 - RNA, 19 nt, Homo sapiens
agaaucucuuucgaaguuu

SEQ ID NO: 515063 - RNA, 19 nt, Homo sapiens
uccacuaggacuucaaauu

SEQ ID NO: 515064 - RNA, 19 nt, Homo sapiens
cgggcuggccaucugguua

SEQ ID NO: 515065 - RNA, 19 nt, Homo sapiens
gagggagcuccaacucaga

SEQ ID NO: 515066 - RNA, 19 nt, Homo sapiens
gccugcggcuguaccugaa

SEQ ID NO: 515067 - RNA, 19 nt, Homo sapiens
gaacacaccugucccucuu

SEQ ID NO: 515068 - RNA, 19 nt, Homo sapiens
gaacugugcugccuguguu

SEQ ID NO: 515069 - RNA, 19 nt, Homo sapiens
gcgagagccuggagaagaa

SEQ ID NO: 515070 - RNA, 19 nt, Homo sapiens
gaagacagaguuauuaaac

SEQ ID NO: 515071 - RNA, 19 nt, Homo sapiens
agaagaagacggccacuuu

SEQ ID NO: 515072 - RNA, 19 nt, Homo sapiens
cagcacagccugcggguaa

SEQ ID NO: 515073 - RNA, 19 nt, Homo sapiens
gcucggugcuggaggcaaa

SEQ ID NO: 515074 - RNA, 19 nt, Homo sapiens
ucacgaagacagaguuauu

SEQ ID NO: 515075 - RNA, 19 nt, Homo sapiens
caagggcugugguggcauu

SEQ ID NO: 515076 - RNA, 19 nt, Homo sapiens
gcagccaaguucacuguca

SEQ ID NO: 515077 - RNA, 19 nt, Homo sapiens
gggccagggucucacugua

SEQ ID NO: 515078 - RNA, 19 nt, Homo sapiens
agacagaguuauuaaacca

SEQ ID NO: 515079 - RNA, 19 nt, Homo sapiens
caagauggaggcaaagaau

SEQ ID NO: 515080 - RNA, 19 nt, Homo sapiens
guucggccuucccagauaa

SEQ ID NO: 515081 - RNA, 19 nt, Homo sapiens
cgaagacagaguuauuaaa

SEQ ID NO: 515082 - RNA, 19 nt, Homo sapiens
cacgaagacagaguuauua

SEQ ID NO: 515083 - RNA, 19 nt, Homo sapiens
ggaccaagacaagauugaa

SEQ ID NO: 515084 - RNA, 19 nt, Homo sapiens
gcagguacggcuacaagau

SEQ ID NO: 515085 - RNA, 19 nt, Homo sapiens
ccgcauacccgccaucuuc

SEQ ID NO: 515086 - RNA, 19 nt, Homo sapiens
gaagaagacggccacuuuu

SEQ ID NO: 515087 - RNA, 19 nt, Homo sapiens
gacgguagagggugagaaa

SEQ ID NO: 515088 - RNA, 19 nt, Homo sapiens
ucgagucccuugcagauuc

SEQ ID NO: 515089 - RNA, 19 nt, Homo sapiens
gcucacgaagacagaguua

SEQ ID NO: 515090 - RNA, 19 nt, Homo sapiens
uaaugcugcucgaccagaa

SEQ ID NO: 515091 - RNA, 19 nt, Homo sapiens
acaccugucccucuucuuu

SEQ ID NO: 515092 - RNA, 19 nt, Homo sapiens
ucucagacuucgccaggaa

SEQ ID NO: 515093 - RNA, 19 nt, Homo sapiens
gaaggcauuucuauuuuag

SEQ ID NO: 515094 - RNA, 19 nt, Homo sapiens
ugugagagcuugccaucca

SEQ ID NO: 515095 - RNA, 19 nt, Homo sapiens
caagaugugucugcguauc

SEQ ID NO: 515096 - RNA, 19 nt, Homo sapiens
agccugagcugccggcauu

SEQ ID NO: 515097 - RNA, 19 nt, Homo sapiens
gcagaaggucuuggagaug

SEQ ID NO: 515098 - RNA, 19 nt, Homo sapiens
ucccagcagugcccaugua

SEQ ID NO: 515099 - RNA, 19 nt, Homo sapiens
gccagggucucacuguaca

SEQ ID NO: 515100 - RNA, 19 nt, Homo sapiens
ccaagauggaggcaaagaa

SEQ ID NO: 515101 - RNA, 19 nt, Homo sapiens
uaaccgggagcacgugauu

SEQ ID NO: 515102 - RNA, 19 nt, Homo sapiens
ucacgagggcauauaugaa

SEQ ID NO: 515103 - RNA, 19 nt, Homo sapiens
gacgugacuucauccucuu

SEQ ID NO: 515104 - RNA, 19 nt, Homo sapiens
uggcugacuuggagcagaa

SEQ ID NO: 515105 - RNA, 19 nt, Homo sapiens
cagcagugcccauguagca

SEQ ID NO: 515106 - RNA, 19 nt, Homo sapiens
ccagccaguccucagauuu

SEQ ID NO: 515107 - RNA, 19 nt, Homo sapiens
ggaggcauccaccuacgau

SEQ ID NO: 515108 - RNA, 19 nt, Homo sapiens
gaaugucccgcgugcaaag

SEQ ID NO: 515109 - RNA, 19 nt, Homo sapiens
acgaagacagaguuauuaa

SEQ ID NO: 515110 - RNA, 19 nt, Homo sapiens
gguagagggugagaaacag

SEQ ID NO: 515111 - RNA, 19 nt, Homo sapiens
ggcccgacgugacuucauc

SEQ ID NO: 515112 - RNA, 19 nt, Homo sapiens
gagaagaagacggccacuu

SEQ ID NO: 515113 - RNA, 19 nt, Homo sapiens
ccauccagcucacgaagac

SEQ ID NO: 515114 - RNA, 19 nt, Homo sapiens
cagguacggcuacaagaug

SEQ ID NO: 515115 - RNA, 19 nt, Homo sapiens
gaccaagacaagauugaag

SEQ ID NO: 515116 - RNA, 19 nt, Homo sapiens
cagaguuauuaaaccauuc

SEQ ID NO: 515117 - RNA, 19 nt, Homo sapiens
cagccaguccucagauuuc

SEQ ID NO: 515118 - RNA, 19 nt, Homo sapiens
agauggaggcaaagaauuc

SEQ ID NO: 515119 - RNA, 19 nt, Homo sapiens
cauauaugaagaaggcauu

SEQ ID NO: 515120 - RNA, 19 nt, Homo sapiens
agcagaaggucuuggagau

SEQ ID NO: 515121 - RNA, 19 nt, Homo sapiens
caagauugaagcccugagu

SEQ ID NO: 515122 - RNA, 19 nt, Homo sapiens
gcuggaccaagacaagauu

SEQ ID NO: 515123 - RNA, 19 nt, Homo sapiens
ccgaaugucccgcgugcaa

SEQ ID NO: 515124 - RNA, 19 nt, Homo sapiens
ccaguccucagauuucaga

SEQ ID NO: 515125 - RNA, 19 nt, Homo sapiens
gagggcauauaugaagaag

SEQ ID NO: 515126 - RNA, 19 nt, Homo sapiens
aguucggccuucccagaua

SEQ ID NO: 515127 - RNA, 19 nt, Homo sapiens
gcaccuggccaugcuacug

SEQ ID NO: 515128 - RNA, 19 nt, Homo sapiens
gggcaugacaggcagaaac

SEQ ID NO: 515129 - RNA, 19 nt, Homo sapiens
cgagggcauauaugaagaa

SEQ ID NO: 515130 - RNA, 19 nt, Homo sapiens
ccaccagccaguccucaga

SEQ ID NO: 515131 - RNA, 19 nt, Homo sapiens
gguggcccuucaaccagaa

SEQ ID NO: 515132 - RNA, 19 nt, Homo sapiens
caccuggccaugcuacuga

SEQ ID NO: 515133 - RNA, 19 nt, Homo sapiens
aagauugaagcccugagua

SEQ ID NO: 515134 - RNA, 19 nt, Homo sapiens
gaacacaccugucccucuu

SEQ ID NO: 515135 - RNA, 19 nt, Homo sapiens
gaacugugcugccuguguu

SEQ ID NO: 515136 - RNA, 19 nt, Homo sapiens
gaagacagaguuauuaaac

SEQ ID NO: 515137 - RNA, 19 nt, Homo sapiens
gcugaagccugucugaugu

SEQ ID NO: 515138 - RNA, 19 nt, Homo sapiens
gaaagaauacgagguaaag

SEQ ID NO: 515139 - RNA, 19 nt, Homo sapiens
cagcacagccugcggguaa

SEQ ID NO: 515140 - RNA, 19 nt, Homo sapiens
ucacgaagacagaguuauu

SEQ ID NO: 515141 - RNA, 19 nt, Homo sapiens
caagggcugugguggcauu

SEQ ID NO: 515142 - RNA, 19 nt, Homo sapiens
gcagccaaguucacuguca

SEQ ID NO: 515143 - RNA, 19 nt, Homo sapiens
gggccagggucucacugua

SEQ ID NO: 515144 - RNA, 19 nt, Homo sapiens
agacagaguuauuaaacca

SEQ ID NO: 515145 - RNA, 19 nt, Homo sapiens
caagauggaggcaaagaau

SEQ ID NO: 515146 - RNA, 19 nt, Homo sapiens
guucggccuucccagauaa

SEQ ID NO: 515147 - RNA, 19 nt, Homo sapiens
cgaagacagaguuauuaaa

SEQ ID NO: 515148 - RNA, 19 nt, Homo sapiens
ccugaaagaauacgaggua

SEQ ID NO: 515149 - RNA, 19 nt, Homo sapiens
ggagaaguuucaggaccaa

SEQ ID NO: 515150 - RNA, 19 nt, Homo sapiens
cacgaagacagaguuauua

SEQ ID NO: 515151 - RNA, 19 nt, Homo sapiens
ggaccaagacaagauugaa

SEQ ID NO: 515152 - RNA, 19 nt, Homo sapiens
gcagguacggcuacaagau

SEQ ID NO: 515153 - RNA, 19 nt, Homo sapiens
ccgcauacccgccaucuuc

SEQ ID NO: 515154 - RNA, 19 nt, Homo sapiens
ugaaagaauacgagguaaa

SEQ ID NO: 515155 - RNA, 19 nt, Homo sapiens
gcucacgaagacagaguua

SEQ ID NO: 515156 - RNA, 19 nt, Homo sapiens
uaaugcugcucgaccagaa

SEQ ID NO: 515157 - RNA, 19 nt, Homo sapiens
acaccugucccucuucuuu

SEQ ID NO: 515158 - RNA, 19 nt, Homo sapiens
ucucagacuucgccaggaa

SEQ ID NO: 515159 - RNA, 19 nt, Homo sapiens
gaaggcauuucuauuuuag

SEQ ID NO: 515160 - RNA, 19 nt, Homo sapiens
ugugagagcuugccaucca

SEQ ID NO: 515161 - RNA, 19 nt, Homo sapiens
caagaugugucugcguauc

SEQ ID NO: 515162 - RNA, 19 nt, Homo sapiens
agccugagcugccggcauu

SEQ ID NO: 515163 - RNA, 19 nt, Homo sapiens
gcagaaggucuuggagaug

SEQ ID NO: 515164 - RNA, 19 nt, Homo sapiens
ucccagcagugcccaugua

SEQ ID NO: 515165 - RNA, 19 nt, Homo sapiens
gccagggucucacuguaca

SEQ ID NO: 515166 - RNA, 19 nt, Homo sapiens
ccaagauggaggcaaagaa

SEQ ID NO: 515167 - RNA, 19 nt, Homo sapiens
uaaccgggagcacgugauu

SEQ ID NO: 515168 - RNA, 19 nt, Homo sapiens
ugaugucuguggaggaaga

SEQ ID NO: 515169 - RNA, 19 nt, Homo sapiens
ucacgagggcauauaugaa

SEQ ID NO: 515170 - RNA, 19 nt, Homo sapiens
aagccugucugaugucugu

SEQ ID NO: 515171 - RNA, 19 nt, Homo sapiens
agaauacgagguaaagaug

SEQ ID NO: 515172 - RNA, 19 nt, Homo sapiens
gacgugacuucauccucuu

SEQ ID NO: 515173 - RNA, 19 nt, Homo sapiens
uggcugacuuggagcagaa

SEQ ID NO: 515174 - RNA, 19 nt, Homo sapiens
cagcagugcccauguagca

SEQ ID NO: 515175 - RNA, 19 nt, Homo sapiens
ccagccaguccucagauuu

SEQ ID NO: 515176 - RNA, 19 nt, Homo sapiens
ggaggcauccaccuacgau

SEQ ID NO: 515177 - RNA, 19 nt, Homo sapiens
gaaugucccgcgugcaaag

SEQ ID NO: 515178 - RNA, 19 nt, Homo sapiens
ucugaugucuguggaggaa

SEQ ID NO: 515179 - RNA, 19 nt, Homo sapiens
cccaagcaguuaugaccuu

SEQ ID NO: 515180 - RNA, 19 nt, Homo sapiens
acgaagacagaguuauuaa

SEQ ID NO: 515181 - RNA, 19 nt, Homo sapiens
aagaauacgagguaaagau

SEQ ID NO: 515182 - RNA, 19 nt, Homo sapiens
ggcccgacgugacuucauc

SEQ ID NO: 515183 - RNA, 19 nt, Homo sapiens
ccauccagcucacgaagac

SEQ ID NO: 515184 - RNA, 19 nt, Homo sapiens
cagguacggcuacaagaug

SEQ ID NO: 515185 - RNA, 19 nt, Homo sapiens
gaccaagacaagauugaag

SEQ ID NO: 515186 - RNA, 19 nt, Homo sapiens
cguguggcauggugacaga

SEQ ID NO: 515187 - RNA, 19 nt, Homo sapiens
cugaaagaauacgagguaa

SEQ ID NO: 515188 - RNA, 19 nt, Homo sapiens
cagaguuauuaaaccauuc

SEQ ID NO: 515189 - RNA, 19 nt, Homo sapiens
cauauaugaagaaggcauu

SEQ ID NO: 515190 - RNA, 19 nt, Homo sapiens
cagccaguccucagauuuc

SEQ ID NO: 515191 - RNA, 19 nt, Homo sapiens
agauggaggcaaagaauuc

SEQ ID NO: 515192 - RNA, 19 nt, Homo sapiens
agcagaaggucuuggagau

SEQ ID NO: 515193 - RNA, 19 nt, Homo sapiens
caagauugaagcccugagu

SEQ ID NO: 515194 - RNA, 19 nt, Homo sapiens
ccgaaugucccgcgugcaa

SEQ ID NO: 515195 - RNA, 19 nt, Homo sapiens
ccaguccucagauuucaga

SEQ ID NO: 515196 - RNA, 19 nt, Homo sapiens
gagggcauauaugaagaag

SEQ ID NO: 515197 - RNA, 19 nt, Homo sapiens
ucaggaccaagacaagauu

SEQ ID NO: 515198 - RNA, 19 nt, Homo sapiens
aguucggccuucccagaua

SEQ ID NO: 515199 - RNA, 19 nt, Homo sapiens
gggcaugacaggcagaaac

SEQ ID NO: 515200 - RNA, 19 nt, Homo sapiens
ccaccagccaguccucaga

SEQ ID NO: 515201 - RNA, 19 nt, Homo sapiens
cgagggcauauaugaagaa

SEQ ID NO: 515202 - RNA, 19 nt, Homo sapiens
gguggcccuucaaccagaa

SEQ ID NO: 515203 - RNA, 19 nt, Homo sapiens
aagauugaagcccugagua

SEQ ID NO: 515204 - RNA, 19 nt, Homo sapiens
gauaagguguuuaaggaua

SEQ ID NO: 515205 - RNA, 19 nt, Homo sapiens
gagcacaccugacacguuu

SEQ ID NO: 515206 - RNA, 19 nt, Homo sapiens
ggaaaugcuucgaaauaau

SEQ ID NO: 515207 - RNA, 19 nt, Homo sapiens
ggagguggauuuagcagaa

SEQ ID NO: 515208 - RNA, 19 nt, Homo sapiens
gaacuccucuuuccuaaaa

SEQ ID NO: 515209 - RNA, 19 nt, Homo sapiens
gagaacuccucuuuccuaa

SEQ ID NO: 515210 - RNA, 19 nt, Homo sapiens
gagagcaucguuaaagaua

SEQ ID NO: 515211 - RNA, 19 nt, Homo sapiens
caucaugcguggagaauau

SEQ ID NO: 515212 - RNA, 19 nt, Homo sapiens
gaaaugcuucgaaauaaug

SEQ ID NO: 515213 - RNA, 19 nt, Homo sapiens
acaaggagguuacaaggaa

SEQ ID NO: 515214 - RNA, 19 nt, Homo sapiens
ggacaaaccagcagaucaa

SEQ ID NO: 515215 - RNA, 19 nt, Homo sapiens
gcaaguggcucggaacaca

SEQ ID NO: 515216 - RNA, 19 nt, Homo sapiens
gacaucugcuggugcauuu

SEQ ID NO: 515217 - RNA, 19 nt, Homo sapiens
aagauaagguguuuaagga

SEQ ID NO: 515218 - RNA, 19 nt, Homo sapiens
guaaugcaauucugauauc

SEQ ID NO: 515219 - RNA, 19 nt, Homo sapiens
ggcccaaacuguucuagaa

SEQ ID NO: 515220 - RNA, 19 nt, Homo sapiens
gaaaaggucuugaggaaag

SEQ ID NO: 515221 - RNA, 19 nt, Homo sapiens
aaucagauauguagcuuug

SEQ ID NO: 515222 - RNA, 19 nt, Homo sapiens
ggagaaggcguguaaauac

SEQ ID NO: 515223 - RNA, 19 nt, Homo sapiens
aaauauugcugucagagaa

SEQ ID NO: 515224 - RNA, 19 nt, Homo sapiens
gauaaauauugcugucaga

SEQ ID NO: 515225 - RNA, 19 nt, Homo sapiens
gaaccggucugucuucacu

SEQ ID NO: 515226 - RNA, 19 nt, Homo sapiens
ucagauauguagcuuugaa

SEQ ID NO: 515227 - RNA, 19 nt, Homo sapiens
gcaacucgcucgaaaagaa

SEQ ID NO: 515228 - RNA, 19 nt, Homo sapiens
cagagaagguuuucauuuu

SEQ ID NO: 515229 - RNA, 19 nt, Homo sapiens
gaagcccacuggagagaug

SEQ ID NO: 515230 - RNA, 19 nt, Homo sapiens
aggaaaugcuucgaaauaa

SEQ ID NO: 515231 - RNA, 19 nt, Homo sapiens
aaggaaaugcuucgaaaua

SEQ ID NO: 515232 - RNA, 19 nt, Homo sapiens
acaagagcauacaaaguuu

SEQ ID NO: 515233 - RNA, 19 nt, Homo sapiens
gagcaucguuaaagauaag

SEQ ID NO: 515234 - RNA, 19 nt, Homo sapiens
uuucuacacugguuacuuu

SEQ ID NO: 515235 - RNA, 19 nt, Homo sapiens
cgcuaaagcugcacacuga

SEQ ID NO: 515236 - RNA, 19 nt, Homo sapiens
cgagaacuccucuuuccua

SEQ ID NO: 515237 - RNA, 19 nt, Homo sapiens
caagagagcaucguuaaag

SEQ ID NO: 515238 - RNA, 19 nt, Homo sapiens
caaggagguuacaaggaaa

SEQ ID NO: 515239 - RNA, 19 nt, Homo sapiens
ggacgcacuugucgcuguu

SEQ ID NO: 515240 - RNA, 19 nt, Homo sapiens
uagccacacuucacucuga

SEQ ID NO: 515241 - RNA, 19 nt, Homo sapiens
aacaagagcauacaaaguu

SEQ ID NO: 515242 - RNA, 19 nt, Homo sapiens
cugcugagcucuucaaguc

SEQ ID NO: 515243 - RNA, 19 nt, Homo sapiens
cguccugacugcaaagaaa

SEQ ID NO: 515244 - RNA, 19 nt, Homo sapiens
aagagagcaucguuaaaga

SEQ ID NO: 515245 - RNA, 19 nt, Homo sapiens
gaagcagacagcaugaaga

SEQ ID NO: 515246 - RNA, 19 nt, Homo sapiens
ucagaucuauugucggaau

SEQ ID NO: 515247 - RNA, 19 nt, Homo sapiens
cguuaaagauaagguguuu

SEQ ID NO: 515248 - RNA, 19 nt, Homo sapiens
gcaauucugauaucuucuu

SEQ ID NO: 515249 - RNA, 19 nt, Homo sapiens
ggagugcucaucuggaaga

SEQ ID NO: 515250 - RNA, 19 nt, Homo sapiens
gaugaucgcgcugcagaaa

SEQ ID NO: 515251 - RNA, 19 nt, Homo sapiens
ggaagauucgcgacuacaa

SEQ ID NO: 515252 - RNA, 19 nt, Homo sapiens
gcagaaugaaaguguagaa

SEQ ID NO: 515253 - RNA, 19 nt, Homo sapiens
uggagaaggcguguaaaua

SEQ ID NO: 515254 - RNA, 19 nt, Homo sapiens
aaaauggagucgaguaaaa

SEQ ID NO: 515255 - RNA, 19 nt, Homo sapiens
ggacaucugcuggugcauu

SEQ ID NO: 515256 - RNA, 19 nt, Homo sapiens
ggagaccgccagcuacaau

SEQ ID NO: 515257 - RNA, 19 nt, Homo sapiens
gagccggcaugaccagaug

SEQ ID NO: 515258 - RNA, 19 nt, Homo sapiens
gucaagagagcaucguuaa

SEQ ID NO: 515259 - RNA, 19 nt, Homo sapiens
aaaaggaaaugcuucgaaa

SEQ ID NO: 515260 - RNA, 19 nt, Homo sapiens
gaucuauugucggaaugaa

SEQ ID NO: 515261 - RNA, 19 nt, Homo sapiens
ccugacacguuuuauaaua

SEQ ID NO: 515262 - RNA, 19 nt, Homo sapiens
ccacuggagagaugaauau

SEQ ID NO: 515263 - RNA, 19 nt, Homo sapiens
ugaagaccguggaggacaa

SEQ ID NO: 515264 - RNA, 19 nt, Homo sapiens
gaagauucgcgacuacaag

SEQ ID NO: 515265 - RNA, 19 nt, Homo sapiens
ggaagcagacagcaugaag

SEQ ID NO: 515266 - RNA, 19 nt, Homo sapiens
gagaagguuuucauuuuca

SEQ ID NO: 515267 - RNA, 19 nt, Homo sapiens
gcccgaucccugauaagua

SEQ ID NO: 515268 - RNA, 19 nt, Homo sapiens
ucauuuacagcgagugaua

SEQ ID NO: 515269 - RNA, 19 nt, Homo sapiens
uaaauauugcugucagaga

SEQ ID NO: 515270 - RNA, 19 nt, Homo sapiens
agaauaugaugcccugcuu

SEQ ID NO: 515271 - RNA, 19 nt, Homo sapiens
ugaucgcgcugcagaaaca

SEQ ID NO: 515272 - RNA, 19 nt, Homo sapiens
gagaaggcguguaaauacc

SEQ ID NO: 515273 - RNA, 19 nt, Homo sapiens
agagcaucguuaaagauaa

SEQ ID NO: 515274 - RNA, 19 nt, Homo sapiens
gcccaaacuguucuagaaa

SEQ ID NO: 515275 - RNA, 19 nt, Homo sapiens
aaacaagagcauacaaagu

SEQ ID NO: 515276 - RNA, 19 nt, Homo sapiens
caucugcuggugcauuuaa

SEQ ID NO: 515277 - RNA, 19 nt, Homo sapiens
gaaugaaagcagagguugu

SEQ ID NO: 515278 - RNA, 19 nt, Homo sapiens
gcacaccugacacguuuua

SEQ ID NO: 515279 - RNA, 19 nt, Homo sapiens
gaagcaggaggccgucaug

SEQ ID NO: 515280 - RNA, 19 nt, Homo sapiens
guugcagaaugaaagugua

SEQ ID NO: 515281 - RNA, 19 nt, Homo sapiens
ggggauagcuggacauguc

SEQ ID NO: 515282 - RNA, 19 nt, Homo sapiens
gauuugaaccggucugucu

SEQ ID NO: 515283 - RNA, 19 nt, Homo sapiens
cccgaucccugauaaguag

SEQ ID NO: 515284 - RNA, 19 nt, Homo sapiens
ggaggacaaguacaagugu

SEQ ID NO: 515285 - RNA, 19 nt, Homo sapiens
agagucagguuccgaugau

SEQ ID NO: 515286 - RNA, 19 nt, Homo sapiens
aaagauaagguguuuaagg

SEQ ID NO: 515287 - RNA, 19 nt, Homo sapiens
cugcuuccuuggccguuua

SEQ ID NO: 515288 - RNA, 19 nt, Homo sapiens
cugguuacuuuggcuauaa

SEQ ID NO: 515289 - RNA, 19 nt, Homo sapiens
ucaagagagcaucguuaaa

SEQ ID NO: 515290 - RNA, 19 nt, Homo sapiens
ucuggaagauucgcgacua

SEQ ID NO: 515291 - RNA, 19 nt, Homo sapiens
cccagcaccuguaguuuua

SEQ ID NO: 515292 - RNA, 19 nt, Homo sapiens
ugucaagagagcaucguua

SEQ ID NO: 515293 - RNA, 19 nt, Homo sapiens
gggacaaaccagcagauca

SEQ ID NO: 515294 - RNA, 19 nt, Homo sapiens
augcaauucugauaucuuc

SEQ ID NO: 515295 - RNA, 19 nt, Homo sapiens
caacagcagcagcuucaag

SEQ ID NO: 515296 - RNA, 19 nt, Homo sapiens
cgacgucauuugggagaug

SEQ ID NO: 515297 - RNA, 19 nt, Homo sapiens
agacagccaagcagagaaa

SEQ ID NO: 515298 - RNA, 19 nt, Homo sapiens
acaaucagauauguagcuu

SEQ ID NO: 515299 - RNA, 19 nt, Homo sapiens
ccuuaaacuugaacaccaa

SEQ ID NO: 515300 - RNA, 19 nt, Homo sapiens
ugacacucaugcugaugga

SEQ ID NO: 515301 - RNA, 19 nt, Homo sapiens
acaauggagugcucaucug

SEQ ID NO: 515302 - RNA, 19 nt, Homo sapiens
gaggaagcagacagcauga

SEQ ID NO: 515303 - RNA, 19 nt, Homo sapiens
cagaaugaaaguguagaaa

SEQ ID NO: 515304 - RNA, 19 nt, Homo sapiens
gauaagguguuuaaggaua

SEQ ID NO: 515305 - RNA, 19 nt, Homo sapiens
gagcacaccugacacguuu

SEQ ID NO: 515306 - RNA, 19 nt, Homo sapiens
ggaaaugcuucgaaauaau

SEQ ID NO: 515307 - RNA, 19 nt, Homo sapiens
ggagguggauuuagcagaa

SEQ ID NO: 515308 - RNA, 19 nt, Homo sapiens
gaacuccucuuuccuaaaa

SEQ ID NO: 515309 - RNA, 19 nt, Homo sapiens
gagaacuccucuuuccuaa

SEQ ID NO: 515310 - RNA, 19 nt, Homo sapiens
gagagcaucguuaaagaua

SEQ ID NO: 515311 - RNA, 19 nt, Homo sapiens
caucaugcguggagaauau

SEQ ID NO: 515312 - RNA, 19 nt, Homo sapiens
gaaaugcuucgaaauaaug

SEQ ID NO: 515313 - RNA, 19 nt, Homo sapiens
acaaggagguuacaaggaa

SEQ ID NO: 515314 - RNA, 19 nt, Homo sapiens
ggacaaaccagcagaucaa

SEQ ID NO: 515315 - RNA, 19 nt, Homo sapiens
gcaaguggcucggaacaca

SEQ ID NO: 515316 - RNA, 19 nt, Homo sapiens
gacaucugcuggugcauuu

SEQ ID NO: 515317 - RNA, 19 nt, Homo sapiens
aagauaagguguuuaagga

SEQ ID NO: 515318 - RNA, 19 nt, Homo sapiens
guaaugcaauucugauauc

SEQ ID NO: 515319 - RNA, 19 nt, Homo sapiens
ggcccaaacuguucuagaa

SEQ ID NO: 515320 - RNA, 19 nt, Homo sapiens
gaaaaggucuugaggaaag

SEQ ID NO: 515321 - RNA, 19 nt, Homo sapiens
aaucagauauguagcuuug

SEQ ID NO: 515322 - RNA, 19 nt, Homo sapiens
ggagaaggcguguaaauac

SEQ ID NO: 515323 - RNA, 19 nt, Homo sapiens
aaauauugcugucagagaa

SEQ ID NO: 515324 - RNA, 19 nt, Homo sapiens
gauaaauauugcugucaga

SEQ ID NO: 515325 - RNA, 19 nt, Homo sapiens
gaaccggucugucuucacu

SEQ ID NO: 515326 - RNA, 19 nt, Homo sapiens
ucagauauguagcuuugaa

SEQ ID NO: 515327 - RNA, 19 nt, Homo sapiens
gcaacucgcucgaaaagaa

SEQ ID NO: 515328 - RNA, 19 nt, Homo sapiens
cagagaagguuuucauuuu

SEQ ID NO: 515329 - RNA, 19 nt, Homo sapiens
gaagcccacuggagagaug

SEQ ID NO: 515330 - RNA, 19 nt, Homo sapiens
aggaaaugcuucgaaauaa

SEQ ID NO: 515331 - RNA, 19 nt, Homo sapiens
aaggaaaugcuucgaaaua

SEQ ID NO: 515332 - RNA, 19 nt, Homo sapiens
acaagagcauacaaaguuu

SEQ ID NO: 515333 - RNA, 19 nt, Homo sapiens
gagcaucguuaaagauaag

SEQ ID NO: 515334 - RNA, 19 nt, Homo sapiens
uuucuacacugguuacuuu

SEQ ID NO: 515335 - RNA, 19 nt, Homo sapiens
cgcuaaagcugcacacuga

SEQ ID NO: 515336 - RNA, 19 nt, Homo sapiens
caagagagcaucguuaaag

SEQ ID NO: 515337 - RNA, 19 nt, Homo sapiens
caaggagguuacaaggaaa

SEQ ID NO: 515338 - RNA, 19 nt, Homo sapiens
ggacgcacuugucgcuguu

SEQ ID NO: 515339 - RNA, 19 nt, Homo sapiens
uagccacacuucacucuga

SEQ ID NO: 515340 - RNA, 19 nt, Homo sapiens
aacaagagcauacaaaguu

SEQ ID NO: 515341 - RNA, 19 nt, Homo sapiens
cugcugagcucuucaaguc

SEQ ID NO: 515342 - RNA, 19 nt, Homo sapiens
cguccugacugcaaagaaa

SEQ ID NO: 515343 - RNA, 19 nt, Homo sapiens
aagagagcaucguuaaaga

SEQ ID NO: 515344 - RNA, 19 nt, Homo sapiens
gaagcagacagcaugaaga

SEQ ID NO: 515345 - RNA, 19 nt, Homo sapiens
ucagaucuauugucggaau

SEQ ID NO: 515346 - RNA, 19 nt, Homo sapiens
cguuaaagauaagguguuu

SEQ ID NO: 515347 - RNA, 19 nt, Homo sapiens
gcaauucugauaucuucuu

SEQ ID NO: 515348 - RNA, 19 nt, Homo sapiens
ggagugcucaucuggaaga

SEQ ID NO: 515349 - RNA, 19 nt, Homo sapiens
gaugaucgcgcugcagaaa

SEQ ID NO: 515350 - RNA, 19 nt, Homo sapiens
ggaagauucgcgacuacaa

SEQ ID NO: 515351 - RNA, 19 nt, Homo sapiens
gcagaaugaaaguguagaa

SEQ ID NO: 515352 - RNA, 19 nt, Homo sapiens
uggagaaggcguguaaaua

SEQ ID NO: 515353 - RNA, 19 nt, Homo sapiens
ggacaucugcuggugcauu

SEQ ID NO: 515354 - RNA, 19 nt, Homo sapiens
aaaauggagucgaguaaaa

SEQ ID NO: 515355 - RNA, 19 nt, Homo sapiens
ggagaccgccagcuacaau

SEQ ID NO: 515356 - RNA, 19 nt, Homo sapiens
gagccggcaugaccagaug

SEQ ID NO: 515357 - RNA, 19 nt, Homo sapiens
gcuccuggcucccuacucu

SEQ ID NO: 515358 - RNA, 19 nt, Homo sapiens
gucaagagagcaucguuaa

SEQ ID NO: 515359 - RNA, 19 nt, Homo sapiens
aaucagaccuaggaucaga

SEQ ID NO: 515360 - RNA, 19 nt, Homo sapiens
aaaaggaaaugcuucgaaa

SEQ ID NO: 515361 - RNA, 19 nt, Homo sapiens
gaucuauugucggaaugaa

SEQ ID NO: 515362 - RNA, 19 nt, Homo sapiens
ccugacacguuuuauaaua

SEQ ID NO: 515363 - RNA, 19 nt, Homo sapiens
ccacuggagagaugaauau

SEQ ID NO: 515364 - RNA, 19 nt, Homo sapiens
gaaaaugaggcccaaagaa

SEQ ID NO: 515365 - RNA, 19 nt, Homo sapiens
ugaagaccguggaggacaa

SEQ ID NO: 515366 - RNA, 19 nt, Homo sapiens
gaagauucgcgacuacaag

SEQ ID NO: 515367 - RNA, 19 nt, Homo sapiens
ggaagcagacagcaugaag

SEQ ID NO: 515368 - RNA, 19 nt, Homo sapiens
gagaagguuuucauuuuca

SEQ ID NO: 515369 - RNA, 19 nt, Homo sapiens
gcccgaucccugauaagua

SEQ ID NO: 515370 - RNA, 19 nt, Homo sapiens
ucauuuacagcgagugaua

SEQ ID NO: 515371 - RNA, 19 nt, Homo sapiens
uaaauauugcugucagaga

SEQ ID NO: 515372 - RNA, 19 nt, Homo sapiens
agaauaugaugcccugcuu

SEQ ID NO: 515373 - RNA, 19 nt, Homo sapiens
ugaucgcgcugcagaaaca

SEQ ID NO: 515374 - RNA, 19 nt, Homo sapiens
gagaaggcguguaaauacc

SEQ ID NO: 515375 - RNA, 19 nt, Homo sapiens
agagcaucguuaaagauaa

SEQ ID NO: 515376 - RNA, 19 nt, Homo sapiens
gcccaaacuguucuagaaa

SEQ ID NO: 515377 - RNA, 19 nt, Homo sapiens
aaacaagagcauacaaagu

SEQ ID NO: 515378 - RNA, 19 nt, Homo sapiens
caucugcuggugcauuuaa

SEQ ID NO: 515379 - RNA, 19 nt, Homo sapiens
gaaugaaagcagagguugu

SEQ ID NO: 515380 - RNA, 19 nt, Homo sapiens
agaaucagaccuaggauca

SEQ ID NO: 515381 - RNA, 19 nt, Homo sapiens
gcacaccugacacguuuua

SEQ ID NO: 515382 - RNA, 19 nt, Homo sapiens
gaagcaggaggccgucaug

SEQ ID NO: 515383 - RNA, 19 nt, Homo sapiens
guugcagaaugaaagugua

SEQ ID NO: 515384 - RNA, 19 nt, Homo sapiens
ggggauagcuggacauguc

SEQ ID NO: 515385 - RNA, 19 nt, Homo sapiens
gauuugaaccggucugucu

SEQ ID NO: 515386 - RNA, 19 nt, Homo sapiens
cccgaucccugauaaguag

SEQ ID NO: 515387 - RNA, 19 nt, Homo sapiens
agagucagguuccgaugau

SEQ ID NO: 515388 - RNA, 19 nt, Homo sapiens
aaagauaagguguuuaagg

SEQ ID NO: 515389 - RNA, 19 nt, Homo sapiens
ggaggacaaguacaagugu

SEQ ID NO: 515390 - RNA, 19 nt, Homo sapiens
cugcuuccuuggccguuua

SEQ ID NO: 515391 - RNA, 19 nt, Homo sapiens
cugguuacuuuggcuauaa

SEQ ID NO: 515392 - RNA, 19 nt, Homo sapiens
ucuggaagauucgcgacua

SEQ ID NO: 515393 - RNA, 19 nt, Homo sapiens
cccagcaccuguaguuuua

SEQ ID NO: 515394 - RNA, 19 nt, Homo sapiens
ucaagagagcaucguuaaa

SEQ ID NO: 515395 - RNA, 19 nt, Homo sapiens
ugucaagagagcaucguua

SEQ ID NO: 515396 - RNA, 19 nt, Homo sapiens
ccagagcaggucagaauca

SEQ ID NO: 515397 - RNA, 19 nt, Homo sapiens
gggacaaaccagcagauca

SEQ ID NO: 515398 - RNA, 19 nt, Homo sapiens
augcaauucugauaucuuc

SEQ ID NO: 515399 - RNA, 19 nt, Homo sapiens
caacagcagcagcuucaag

SEQ ID NO: 515400 - RNA, 19 nt, Homo sapiens
cgacgucauuugggagaug

SEQ ID NO: 515401 - RNA, 19 nt, Homo sapiens
agacagccaagcagagaaa

SEQ ID NO: 515402 - RNA, 19 nt, Homo sapiens
acaaucagauauguagcuu

SEQ ID NO: 515403 - RNA, 19 nt, Homo sapiens
ccuuaaacuugaacaccaa

SEQ ID NO: 515404 - RNA, 19 nt, Homo sapiens
gauaagguguuuaaggaua

SEQ ID NO: 515405 - RNA, 19 nt, Homo sapiens
gagcacaccugacacguuu

SEQ ID NO: 515406 - RNA, 19 nt, Homo sapiens
ggaaaugcuucgaaauaau

SEQ ID NO: 515407 - RNA, 19 nt, Homo sapiens
ggagguggauuuagcagaa

SEQ ID NO: 515408 - RNA, 19 nt, Homo sapiens
gaacuccucuuuccuaaaa

SEQ ID NO: 515409 - RNA, 19 nt, Homo sapiens
gagaacuccucuuuccuaa

SEQ ID NO: 515410 - RNA, 19 nt, Homo sapiens
gagagcaucguuaaagaua

SEQ ID NO: 515411 - RNA, 19 nt, Homo sapiens
caucaugcguggagaauau

SEQ ID NO: 515412 - RNA, 19 nt, Homo sapiens
gaaaugcuucgaaauaaug

SEQ ID NO: 515413 - RNA, 19 nt, Homo sapiens
acaaggagguuacaaggaa

SEQ ID NO: 515414 - RNA, 19 nt, Homo sapiens
ggacaaaccagcagaucaa

SEQ ID NO: 515415 - RNA, 19 nt, Homo sapiens
gcaaguggcucggaacaca

SEQ ID NO: 515416 - RNA, 19 nt, Homo sapiens
gacaucugcuggugcauuu

SEQ ID NO: 515417 - RNA, 19 nt, Homo sapiens
aagauaagguguuuaagga

SEQ ID NO: 515418 - RNA, 19 nt, Homo sapiens
guaaugcaauucugauauc

SEQ ID NO: 515419 - RNA, 19 nt, Homo sapiens
ggcccaaacuguucuagaa

SEQ ID NO: 515420 - RNA, 19 nt, Homo sapiens
gaaaaggucuugaggaaag

SEQ ID NO: 515421 - RNA, 19 nt, Homo sapiens
aaucagauauguagcuuug

SEQ ID NO: 515422 - RNA, 19 nt, Homo sapiens
ggagaaggcguguaaauac

SEQ ID NO: 515423 - RNA, 19 nt, Homo sapiens
aaauauugcugucagagaa

SEQ ID NO: 515424 - RNA, 19 nt, Homo sapiens
gauaaauauugcugucaga

SEQ ID NO: 515425 - RNA, 19 nt, Homo sapiens
gaaccggucugucuucacu

SEQ ID NO: 515426 - RNA, 19 nt, Homo sapiens
ucagauauguagcuuugaa

SEQ ID NO: 515427 - RNA, 19 nt, Homo sapiens
gcaacucgcucgaaaagaa

SEQ ID NO: 515428 - RNA, 19 nt, Homo sapiens
cagagaagguuuucauuuu

SEQ ID NO: 515429 - RNA, 19 nt, Homo sapiens
gaagcccacuggagagaug

SEQ ID NO: 515430 - RNA, 19 nt, Homo sapiens
aggaaaugcuucgaaauaa

SEQ ID NO: 515431 - RNA, 19 nt, Homo sapiens
aaggaaaugcuucgaaaua

SEQ ID NO: 515432 - RNA, 19 nt, Homo sapiens
acaagagcauacaaaguuu

SEQ ID NO: 515433 - RNA, 19 nt, Homo sapiens
gagcaucguuaaagauaag

SEQ ID NO: 515434 - RNA, 19 nt, Homo sapiens
uuucuacacugguuacuuu

SEQ ID NO: 515435 - RNA, 19 nt, Homo sapiens
cgcuaaagcugcacacuga

SEQ ID NO: 515436 - RNA, 19 nt, Homo sapiens
caagagagcaucguuaaag

SEQ ID NO: 515437 - RNA, 19 nt, Homo sapiens
caaggagguuacaaggaaa

SEQ ID NO: 515438 - RNA, 19 nt, Homo sapiens
ggacgcacuugucgcuguu

SEQ ID NO: 515439 - RNA, 19 nt, Homo sapiens
uagccacacuucacucuga

SEQ ID NO: 515440 - RNA, 19 nt, Homo sapiens
aacaagagcauacaaaguu

SEQ ID NO: 515441 - RNA, 19 nt, Homo sapiens
cugcugagcucuucaaguc

SEQ ID NO: 515442 - RNA, 19 nt, Homo sapiens
cguccugacugcaaagaaa

SEQ ID NO: 515443 - RNA, 19 nt, Homo sapiens
aagagagcaucguuaaaga

SEQ ID NO: 515444 - RNA, 19 nt, Homo sapiens
gaagcagacagcaugaaga

SEQ ID NO: 515445 - RNA, 19 nt, Homo sapiens
ucagaucuauugucggaau

SEQ ID NO: 515446 - RNA, 19 nt, Homo sapiens
cguuaaagauaagguguuu

SEQ ID NO: 515447 - RNA, 19 nt, Homo sapiens
gcaauucugauaucuucuu

SEQ ID NO: 515448 - RNA, 19 nt, Homo sapiens
ggagugcucaucuggaaga

SEQ ID NO: 515449 - RNA, 19 nt, Homo sapiens
gaugaucgcgcugcagaaa

SEQ ID NO: 515450 - RNA, 19 nt, Homo sapiens
ggaagauucgcgacuacaa

SEQ ID NO: 515451 - RNA, 19 nt, Homo sapiens
gcagaaugaaaguguagaa

SEQ ID NO: 515452 - RNA, 19 nt, Homo sapiens
uggagaaggcguguaaaua

SEQ ID NO: 515453 - RNA, 19 nt, Homo sapiens
ggacaucugcuggugcauu

SEQ ID NO: 515454 - RNA, 19 nt, Homo sapiens
aaaauggagucgaguaaaa

SEQ ID NO: 515455 - RNA, 19 nt, Homo sapiens
ggagaccgccagcuacaau

SEQ ID NO: 515456 - RNA, 19 nt, Homo sapiens
gagccggcaugaccagaug

SEQ ID NO: 515457 - RNA, 19 nt, Homo sapiens
gcuccuggcucccuacucu

SEQ ID NO: 515458 - RNA, 19 nt, Homo sapiens
gucaagagagcaucguuaa

SEQ ID NO: 515459 - RNA, 19 nt, Homo sapiens
aaucagaccuaggaucaga

SEQ ID NO: 515460 - RNA, 19 nt, Homo sapiens
aaaaggaaaugcuucgaaa

SEQ ID NO: 515461 - RNA, 19 nt, Homo sapiens
gaucuauugucggaaugaa

SEQ ID NO: 515462 - RNA, 19 nt, Homo sapiens
ccugacacguuuuauaaua

SEQ ID NO: 515463 - RNA, 19 nt, Homo sapiens
ccacuggagagaugaauau

SEQ ID NO: 515464 - RNA, 19 nt, Homo sapiens
gaaaaugaggcccaaagaa

SEQ ID NO: 515465 - RNA, 19 nt, Homo sapiens
ugaagaccguggaggacaa

SEQ ID NO: 515466 - RNA, 19 nt, Homo sapiens
gaagauucgcgacuacaag

SEQ ID NO: 515467 - RNA, 19 nt, Homo sapiens
ggaagcagacagcaugaag

SEQ ID NO: 515468 - RNA, 19 nt, Homo sapiens
gagaagguuuucauuuuca

SEQ ID NO: 515469 - RNA, 19 nt, Homo sapiens
gcccgaucccugauaagua

SEQ ID NO: 515470 - RNA, 19 nt, Homo sapiens
ucauuuacagcgagugaua

SEQ ID NO: 515471 - RNA, 19 nt, Homo sapiens
uaaauauugcugucagaga

SEQ ID NO: 515472 - RNA, 19 nt, Homo sapiens
agaauaugaugcccugcuu

SEQ ID NO: 515473 - RNA, 19 nt, Homo sapiens
ugaucgcgcugcagaaaca

SEQ ID NO: 515474 - RNA, 19 nt, Homo sapiens
gagaaggcguguaaauacc

SEQ ID NO: 515475 - RNA, 19 nt, Homo sapiens
agagcaucguuaaagauaa

SEQ ID NO: 515476 - RNA, 19 nt, Homo sapiens
gcccaaacuguucuagaaa

SEQ ID NO: 515477 - RNA, 19 nt, Homo sapiens
aaacaagagcauacaaagu

SEQ ID NO: 515478 - RNA, 19 nt, Homo sapiens
caucugcuggugcauuuaa

SEQ ID NO: 515479 - RNA, 19 nt, Homo sapiens
gaaugaaagcagagguugu

SEQ ID NO: 515480 - RNA, 19 nt, Homo sapiens
agaaucagaccuaggauca

SEQ ID NO: 515481 - RNA, 19 nt, Homo sapiens
gcacaccugacacguuuua

SEQ ID NO: 515482 - RNA, 19 nt, Homo sapiens
gaagcaggaggccgucaug

SEQ ID NO: 515483 - RNA, 19 nt, Homo sapiens
guugcagaaugaaagugua

SEQ ID NO: 515484 - RNA, 19 nt, Homo sapiens
ggggauagcuggacauguc

SEQ ID NO: 515485 - RNA, 19 nt, Homo sapiens
gauuugaaccggucugucu

SEQ ID NO: 515486 - RNA, 19 nt, Homo sapiens
cccgaucccugauaaguag

SEQ ID NO: 515487 - RNA, 19 nt, Homo sapiens
agagucagguuccgaugau

SEQ ID NO: 515488 - RNA, 19 nt, Homo sapiens
aaagauaagguguuuaagg

SEQ ID NO: 515489 - RNA, 19 nt, Homo sapiens
ggaggacaaguacaagugu

SEQ ID NO: 515490 - RNA, 19 nt, Homo sapiens
cugcuuccuuggccguuua

SEQ ID NO: 515491 - RNA, 19 nt, Homo sapiens
cugguuacuuuggcuauaa

SEQ ID NO: 515492 - RNA, 19 nt, Homo sapiens
ucuggaagauucgcgacua

SEQ ID NO: 515493 - RNA, 19 nt, Homo sapiens
ucaagagagcaucguuaaa

SEQ ID NO: 515494 - RNA, 19 nt, Homo sapiens
ugucaagagagcaucguua

SEQ ID NO: 515495 - RNA, 19 nt, Homo sapiens
ccagagcaggucagaauca

SEQ ID NO: 515496 - RNA, 19 nt, Homo sapiens
gggacaaaccagcagauca

SEQ ID NO: 515497 - RNA, 19 nt, Homo sapiens
augcaauucugauaucuuc

SEQ ID NO: 515498 - RNA, 19 nt, Homo sapiens
caacagcagcagcuucaag

SEQ ID NO: 515499 - RNA, 19 nt, Homo sapiens
cgacgucauuugggagaug

SEQ ID NO: 515500 - RNA, 19 nt, Homo sapiens
agacagccaagcagagaaa

SEQ ID NO: 515501 - RNA, 19 nt, Homo sapiens
acaaucagauauguagcuu

SEQ ID NO: 515502 - RNA, 19 nt, Homo sapiens
ccuuaaacuugaacaccaa

SEQ ID NO: 515503 - RNA, 19 nt, Homo sapiens
ugacacucaugcugaugga

SEQ ID NO: 515504 - RNA, 19 nt, Homo sapiens
ggaauauacugaagaacua

SEQ ID NO: 515505 - RNA, 19 nt, Homo sapiens
gaucaaagauuagccguuu

SEQ ID NO: 515506 - RNA, 19 nt, Homo sapiens
gaucucagcucacugcaaa

SEQ ID NO: 515507 - RNA, 19 nt, Homo sapiens
gaagagcgcuacaaaugug

SEQ ID NO: 515508 - RNA, 19 nt, Homo sapiens
aaacugagaugaguccuua

SEQ ID NO: 515509 - RNA, 19 nt, Homo sapiens
ggucacaccugucccuaua

SEQ ID NO: 515510 - RNA, 19 nt, Homo sapiens
caagaacgccuacauuaaa

SEQ ID NO: 515511 - RNA, 19 nt, Homo sapiens
gagcaagacuguccuuuua

SEQ ID NO: 515512 - RNA, 19 nt, Homo sapiens
cauaagaacuggugaaugg

SEQ ID NO: 515513 - RNA, 19 nt, Homo sapiens
gaggagagcacauuugauu

SEQ ID NO: 515514 - RNA, 19 nt, Homo sapiens
cacaauggcuuauucagaa

SEQ ID NO: 515515 - RNA, 19 nt, Homo sapiens
caugauacccacauuaaua

SEQ ID NO: 515516 - RNA, 19 nt, Homo sapiens
ggaggaaccugcagcaaca

SEQ ID NO: 515517 - RNA, 19 nt, Homo sapiens
gugcgaagauuauucuaaa

SEQ ID NO: 515518 - RNA, 19 nt, Homo sapiens
gccaagaacgccuacauua

SEQ ID NO: 515519 - RNA, 19 nt, Homo sapiens
cuugaaagaugguaaguuu

SEQ ID NO: 515520 - RNA, 19 nt, Homo sapiens
gcagcuagcagaaacuaua

SEQ ID NO: 515521 - RNA, 19 nt, Homo sapiens
auaaagaggucaucaaauc

SEQ ID NO: 515522 - RNA, 19 nt, Homo sapiens
uaacugaccuggaggaucu

SEQ ID NO: 515523 - RNA, 19 nt, Homo sapiens
gcuagaagcucaagugcau

SEQ ID NO: 515524 - RNA, 19 nt, Homo sapiens
ggugacagauuacaagaug

SEQ ID NO: 515525 - RNA, 19 nt, Homo sapiens
gaacaaggaauacuagagu

SEQ ID NO: 515526 - RNA, 19 nt, Homo sapiens
acacauacauauacaccua

SEQ ID NO: 515527 - RNA, 19 nt, Homo sapiens
gaaauucaccagcaguuug

SEQ ID NO: 515528 - RNA, 19 nt, Homo sapiens
caucaaaucucaggagguu

SEQ ID NO: 515529 - RNA, 19 nt, Homo sapiens
acaaacaguucgaauguau

SEQ ID NO: 515530 - RNA, 19 nt, Homo sapiens
ccaagaacgccuacauuaa

SEQ ID NO: 515531 - RNA, 19 nt, Homo sapiens
gaggguacuugcuauaaug

SEQ ID NO: 515532 - RNA, 19 nt, Homo sapiens
gcaaugcuccuggauguaa

SEQ ID NO: 515533 - RNA, 19 nt, Homo sapiens
guucagaguuccuucauca

SEQ ID NO: 515534 - RNA, 19 nt, Homo sapiens
gaggauggauagaauuuag

SEQ ID NO: 515535 - RNA, 19 nt, Homo sapiens
ggagagcacauuugauuau

SEQ ID NO: 515536 - RNA, 19 nt, Homo sapiens
ccaauuagaagaacagauu

SEQ ID NO: 515537 - RNA, 19 nt, Homo sapiens
uuuggaaggugacagauua

SEQ ID NO: 515538 - RNA, 19 nt, Homo sapiens
gcacaugcguuugguuuua

SEQ ID NO: 515539 - RNA, 19 nt, Homo sapiens
gguaggcuguuccaguuaa

SEQ ID NO: 515540 - RNA, 19 nt, Homo sapiens
ggaggguacuugcuauaau

SEQ ID NO: 515541 - RNA, 19 nt, Homo sapiens
ggaagaucauauugcugua

SEQ ID NO: 515542 - RNA, 19 nt, Homo sapiens
agaaauagguucacaacag

SEQ ID NO: 515543 - RNA, 19 nt, Homo sapiens
ggacacagagguagcagaa

SEQ ID NO: 515544 - RNA, 19 nt, Homo sapiens
gaugguaaguuucuugaag

SEQ ID NO: 515545 - RNA, 19 nt, Homo sapiens
cagaagagcauaaagguau

SEQ ID NO: 515546 - RNA, 19 nt, Homo sapiens
gaggaucucuagucacugu

SEQ ID NO: 515547 - RNA, 19 nt, Homo sapiens
uuaaguaguugauguggaa

SEQ ID NO: 515548 - RNA, 19 nt, Homo sapiens
caacaggaauauacugaag

SEQ ID NO: 515549 - RNA, 19 nt, Homo sapiens
uggccaagcugaucucaaa

SEQ ID NO: 515550 - RNA, 19 nt, Homo sapiens
ggagaaaaccuuuacaauu

SEQ ID NO: 515551 - RNA, 19 nt, Homo sapiens
aaacugagguagaugaaca

SEQ ID NO: 515552 - RNA, 19 nt, Homo sapiens
caacaauugugcgaagauu

SEQ ID NO: 515553 - RNA, 19 nt, Homo sapiens
guaugggucugaaggugua

SEQ ID NO: 515554 - RNA, 19 nt, Homo sapiens
gagcacaugcguuugguuu

SEQ ID NO: 515555 - RNA, 19 nt, Homo sapiens
agaggaaccuucuuaaucu

SEQ ID NO: 515556 - RNA, 19 nt, Homo sapiens
ucaagccucugacaacuau

SEQ ID NO: 515557 - RNA, 19 nt, Homo sapiens
gauaauaugcucaguuugg

SEQ ID NO: 515558 - RNA, 19 nt, Homo sapiens
gagaaaaugucauaaaugg

SEQ ID NO: 515559 - RNA, 19 nt, Homo sapiens
cccaauagcagcagcuuua

SEQ ID NO: 515560 - RNA, 19 nt, Homo sapiens
aaacaugauacccacauua

SEQ ID NO: 515561 - RNA, 19 nt, Homo sapiens
guccucaacuuauauguau

SEQ ID NO: 515562 - RNA, 19 nt, Homo sapiens
ggaagagcgcuacaaaugu

SEQ ID NO: 515563 - RNA, 19 nt, Homo sapiens
cgaaauagugauuaaguga

SEQ ID NO: 515564 - RNA, 19 nt, Homo sapiens
gaacaguuaacccuauaga

SEQ ID NO: 515565 - RNA, 19 nt, Homo sapiens
gugaugaccaugcaccuua

SEQ ID NO: 515566 - RNA, 19 nt, Homo sapiens
uugauaagccugaguuuaa

SEQ ID NO: 515567 - RNA, 19 nt, Homo sapiens
ggaguacaguggcaugauc

SEQ ID NO: 515568 - RNA, 19 nt, Homo sapiens
acacagagguagcagaauc

SEQ ID NO: 515569 - RNA, 19 nt, Homo sapiens
caaacaugauacccacauu

SEQ ID NO: 515570 - RNA, 19 nt, Homo sapiens
aaacuuguguccugaauac

SEQ ID NO: 515571 - RNA, 19 nt, Homo sapiens
gaucccagaacaaggaaua

SEQ ID NO: 515572 - RNA, 19 nt, Homo sapiens
ccaaagugcugagauuaca

SEQ ID NO: 515573 - RNA, 19 nt, Homo sapiens
ggauggauagaauuuagua

SEQ ID NO: 515574 - RNA, 19 nt, Homo sapiens
ucaagcaguuugcacaguu

SEQ ID NO: 515575 - RNA, 19 nt, Homo sapiens
gaagaucauauugcuguaa

SEQ ID NO: 515576 - RNA, 19 nt, Homo sapiens
acaggaauauacugaagaa

SEQ ID NO: 515577 - RNA, 19 nt, Homo sapiens
ccaugcaccuuacaauuuc

SEQ ID NO: 515578 - RNA, 19 nt, Homo sapiens
ggacuuugagcccaguaua

SEQ ID NO: 515579 - RNA, 19 nt, Homo sapiens
auggaaagcucauuuggaa

SEQ ID NO: 515580 - RNA, 19 nt, Homo sapiens
ugaccuggauuuagacuca

SEQ ID NO: 515581 - RNA, 19 nt, Homo sapiens
caggugcucuguauguuug

SEQ ID NO: 515582 - RNA, 19 nt, Homo sapiens
gaccaugcaccuuacaauu

SEQ ID NO: 515583 - RNA, 19 nt, Homo sapiens
gauggaagcaguugauaca

SEQ ID NO: 515584 - RNA, 19 nt, Homo sapiens
gaagcuuccucccaaacau

SEQ ID NO: 515585 - RNA, 19 nt, Homo sapiens
gaauguccaauuagaagaa

SEQ ID NO: 515586 - RNA, 19 nt, Homo sapiens
gcugugcuguaacggauaa

SEQ ID NO: 515587 - RNA, 19 nt, Homo sapiens
cugaagaacuagaguguca

SEQ ID NO: 515588 - RNA, 19 nt, Homo sapiens
uggaagagcgcuacaaaug

SEQ ID NO: 515589 - RNA, 19 nt, Homo sapiens
gaaguacucucagcgaaaa

SEQ ID NO: 515590 - RNA, 19 nt, Homo sapiens
gaaguaaagcagaaaguac

SEQ ID NO: 515591 - RNA, 19 nt, Homo sapiens
gguacuugcuauaauggaa

SEQ ID NO: 515592 - RNA, 19 nt, Homo sapiens
acaagagccuagaacagaa

SEQ ID NO: 515593 - RNA, 19 nt, Homo sapiens
ggauguaaugccaagguua

SEQ ID NO: 515594 - RNA, 19 nt, Homo sapiens
gagcccuucugcguuguua

SEQ ID NO: 515595 - RNA, 19 nt, Homo sapiens
caguauagaguaccaguuu

SEQ ID NO: 515596 - RNA, 19 nt, Homo sapiens
acacacacacauacauaua

SEQ ID NO: 515597 - RNA, 19 nt, Homo sapiens
gaaggugacagauuacaag

SEQ ID NO: 515598 - RNA, 19 nt, Homo sapiens
gcagcaacaugagcauuca

SEQ ID NO: 515599 - RNA, 19 nt, Homo sapiens
gauaaagaggucaucaaau

SEQ ID NO: 515600 - RNA, 19 nt, Homo sapiens
ccacaauggcuuauucaga

SEQ ID NO: 515601 - RNA, 19 nt, Homo sapiens
ccugagaccuuugauggaa

SEQ ID NO: 515602 - RNA, 19 nt, Homo sapiens
acaugagcauucagccuua

SEQ ID NO: 515603 - RNA, 19 nt, Homo sapiens
cacuauggcugugcuguaa

SEQ ID NO: 515604 - RNA, 19 nt, Homo sapiens
ggaauauacugaagaacua

SEQ ID NO: 515605 - RNA, 19 nt, Homo sapiens
gaucaaagauuagccguuu

SEQ ID NO: 515606 - RNA, 19 nt, Homo sapiens
gaucucagcucacugcaaa

SEQ ID NO: 515607 - RNA, 19 nt, Homo sapiens
gaagagcgcuacaaaugug

SEQ ID NO: 515608 - RNA, 19 nt, Homo sapiens
aaacugagaugaguccuua

SEQ ID NO: 515609 - RNA, 19 nt, Homo sapiens
ggucacaccugucccuaua

SEQ ID NO: 515610 - RNA, 19 nt, Homo sapiens
caagaacgccuacauuaaa

SEQ ID NO: 515611 - RNA, 19 nt, Homo sapiens
gagcaagacuguccuuuua

SEQ ID NO: 515612 - RNA, 19 nt, Homo sapiens
cauaagaacuggugaaugg

SEQ ID NO: 515613 - RNA, 19 nt, Homo sapiens
gaggagagcacauuugauu

SEQ ID NO: 515614 - RNA, 19 nt, Homo sapiens
caugauacccacauuaaua

SEQ ID NO: 515615 - RNA, 19 nt, Homo sapiens
ggaggaaccugcagcaaca

SEQ ID NO: 515616 - RNA, 19 nt, Homo sapiens
gugcgaagauuauucuaaa

SEQ ID NO: 515617 - RNA, 19 nt, Homo sapiens
gccaagaacgccuacauua

SEQ ID NO: 515618 - RNA, 19 nt, Homo sapiens
cuugaaagaugguaaguuu

SEQ ID NO: 515619 - RNA, 19 nt, Homo sapiens
gcagcuagcagaaacuaua

SEQ ID NO: 515620 - RNA, 19 nt, Homo sapiens
auaaagaggucaucaaauc

SEQ ID NO: 515621 - RNA, 19 nt, Homo sapiens
uaacugaccuggaggaucu

SEQ ID NO: 515622 - RNA, 19 nt, Homo sapiens
gcuagaagcucaagugcau

SEQ ID NO: 515623 - RNA, 19 nt, Homo sapiens
ggugacagauuacaagaug

SEQ ID NO: 515624 - RNA, 19 nt, Homo sapiens
gaacaaggaauacuagagu

SEQ ID NO: 515625 - RNA, 19 nt, Homo sapiens
acacauacauauacaccua

SEQ ID NO: 515626 - RNA, 19 nt, Homo sapiens
gaaauucaccagcaguuug

SEQ ID NO: 515627 - RNA, 19 nt, Homo sapiens
caucaaaucucaggagguu

SEQ ID NO: 515628 - RNA, 19 nt, Homo sapiens
acaaacaguucgaauguau

SEQ ID NO: 515629 - RNA, 19 nt, Homo sapiens
ccaagaacgccuacauuaa

SEQ ID NO: 515630 - RNA, 19 nt, Homo sapiens
gaggguacuugcuauaaug

SEQ ID NO: 515631 - RNA, 19 nt, Homo sapiens
gcaaugcuccuggauguaa

SEQ ID NO: 515632 - RNA, 19 nt, Homo sapiens
guucagaguuccuucauca

SEQ ID NO: 515633 - RNA, 19 nt, Homo sapiens
gaggauggauagaauuuag

SEQ ID NO: 515634 - RNA, 19 nt, Homo sapiens
ggagagcacauuugauuau

SEQ ID NO: 515635 - RNA, 19 nt, Homo sapiens
ccaauuagaagaacagauu

SEQ ID NO: 515636 - RNA, 19 nt, Homo sapiens
uuuggaaggugacagauua

SEQ ID NO: 515637 - RNA, 19 nt, Homo sapiens
gcacaugcguuugguuuua

SEQ ID NO: 515638 - RNA, 19 nt, Homo sapiens
gguaggcuguuccaguuaa

SEQ ID NO: 515639 - RNA, 19 nt, Homo sapiens
ggaggguacuugcuauaau

SEQ ID NO: 515640 - RNA, 19 nt, Homo sapiens
ggaagaucauauugcugua

SEQ ID NO: 515641 - RNA, 19 nt, Homo sapiens
agaaauagguucacaacag

SEQ ID NO: 515642 - RNA, 19 nt, Homo sapiens
ggacacagagguagcagaa

SEQ ID NO: 515643 - RNA, 19 nt, Homo sapiens
gaugguaaguuucuugaag

SEQ ID NO: 515644 - RNA, 19 nt, Homo sapiens
gaggaucucuagucacugu

SEQ ID NO: 515645 - RNA, 19 nt, Homo sapiens
cagaagagcauaaagguau

SEQ ID NO: 515646 - RNA, 19 nt, Homo sapiens
uuaaguaguugauguggaa

SEQ ID NO: 515647 - RNA, 19 nt, Homo sapiens
caacaggaauauacugaag

SEQ ID NO: 515648 - RNA, 19 nt, Homo sapiens
uggccaagcugaucucaaa

SEQ ID NO: 515649 - RNA, 19 nt, Homo sapiens
ggagaaaaccuuuacaauu

SEQ ID NO: 515650 - RNA, 19 nt, Homo sapiens
aaacugagguagaugaaca

SEQ ID NO: 515651 - RNA, 19 nt, Homo sapiens
caacaauugugcgaagauu

SEQ ID NO: 515652 - RNA, 19 nt, Homo sapiens
guaugggucugaaggugua

SEQ ID NO: 515653 - RNA, 19 nt, Homo sapiens
gagcacaugcguuugguuu

SEQ ID NO: 515654 - RNA, 19 nt, Homo sapiens
agaggaaccuucuuaaucu

SEQ ID NO: 515655 - RNA, 19 nt, Homo sapiens
ucaagccucugacaacuau

SEQ ID NO: 515656 - RNA, 19 nt, Homo sapiens
gauaauaugcucaguuugg

SEQ ID NO: 515657 - RNA, 19 nt, Homo sapiens
gagaaaaugucauaaaugg

SEQ ID NO: 515658 - RNA, 19 nt, Homo sapiens
cccaauagcagcagcuuua

SEQ ID NO: 515659 - RNA, 19 nt, Homo sapiens
aaacaugauacccacauua

SEQ ID NO: 515660 - RNA, 19 nt, Homo sapiens
guccucaacuuauauguau

SEQ ID NO: 515661 - RNA, 19 nt, Homo sapiens
ggaagagcgcuacaaaugu

SEQ ID NO: 515662 - RNA, 19 nt, Homo sapiens
cgaaauagugauuaaguga

SEQ ID NO: 515663 - RNA, 19 nt, Homo sapiens
gaacaguuaacccuauaga

SEQ ID NO: 515664 - RNA, 19 nt, Homo sapiens
gugaugaccaugcaccuua

SEQ ID NO: 515665 - RNA, 19 nt, Homo sapiens
uugauaagccugaguuuaa

SEQ ID NO: 515666 - RNA, 19 nt, Homo sapiens
ggaguacaguggcaugauc

SEQ ID NO: 515667 - RNA, 19 nt, Homo sapiens
acacagagguagcagaauc

SEQ ID NO: 515668 - RNA, 19 nt, Homo sapiens
caaacaugauacccacauu

SEQ ID NO: 515669 - RNA, 19 nt, Homo sapiens
aaacuuguguccugaauac

SEQ ID NO: 515670 - RNA, 19 nt, Homo sapiens
gaucccagaacaaggaaua

SEQ ID NO: 515671 - RNA, 19 nt, Homo sapiens
ccaaagugcugagauuaca

SEQ ID NO: 515672 - RNA, 19 nt, Homo sapiens
ggauggauagaauuuagua

SEQ ID NO: 515673 - RNA, 19 nt, Homo sapiens
ucaagcaguuugcacaguu

SEQ ID NO: 515674 - RNA, 19 nt, Homo sapiens
ggacuuugagcccaguaua

SEQ ID NO: 515675 - RNA, 19 nt, Homo sapiens
gaagaucauauugcuguaa

SEQ ID NO: 515676 - RNA, 19 nt, Homo sapiens
acaggaauauacugaagaa

SEQ ID NO: 515677 - RNA, 19 nt, Homo sapiens
ccaugcaccuuacaauuuc

SEQ ID NO: 515678 - RNA, 19 nt, Homo sapiens
auggaaagcucauuuggaa

SEQ ID NO: 515679 - RNA, 19 nt, Homo sapiens
gcagggaugugcagaugag

SEQ ID NO: 515680 - RNA, 19 nt, Homo sapiens
ugaccuggauuuagacuca

SEQ ID NO: 515681 - RNA, 19 nt, Homo sapiens
caggugcucuguauguuug

SEQ ID NO: 515682 - RNA, 19 nt, Homo sapiens
gaccaugcaccuuacaauu

SEQ ID NO: 515683 - RNA, 19 nt, Homo sapiens
gauggaagcaguugauaca

SEQ ID NO: 515684 - RNA, 19 nt, Homo sapiens
gaagcuuccucccaaacau

SEQ ID NO: 515685 - RNA, 19 nt, Homo sapiens
gaauguccaauuagaagaa

SEQ ID NO: 515686 - RNA, 19 nt, Homo sapiens
gcugugcuguaacggauaa

SEQ ID NO: 515687 - RNA, 19 nt, Homo sapiens
cugaagaacuagaguguca

SEQ ID NO: 515688 - RNA, 19 nt, Homo sapiens
gaaguacucucagcgaaaa

SEQ ID NO: 515689 - RNA, 19 nt, Homo sapiens
gaaguaaagcagaaaguac

SEQ ID NO: 515690 - RNA, 19 nt, Homo sapiens
uggaagagcgcuacaaaug

SEQ ID NO: 515691 - RNA, 19 nt, Homo sapiens
gguacuugcuauaauggaa

SEQ ID NO: 515692 - RNA, 19 nt, Homo sapiens
acaagagccuagaacagaa

SEQ ID NO: 515693 - RNA, 19 nt, Homo sapiens
ggauguaaugccaagguua

SEQ ID NO: 515694 - RNA, 19 nt, Homo sapiens
gagcccuucugcguuguua

SEQ ID NO: 515695 - RNA, 19 nt, Homo sapiens
caguauagaguaccaguuu

SEQ ID NO: 515696 - RNA, 19 nt, Homo sapiens
acacacacacauacauaua

SEQ ID NO: 515697 - RNA, 19 nt, Homo sapiens
gaaggugacagauuacaag

SEQ ID NO: 515698 - RNA, 19 nt, Homo sapiens
gcagcaacaugagcauuca

SEQ ID NO: 515699 - RNA, 19 nt, Homo sapiens
gauaaagaggucaucaaau

SEQ ID NO: 515700 - RNA, 19 nt, Homo sapiens
ccugagaccuuugauggaa

SEQ ID NO: 515701 - RNA, 19 nt, Homo sapiens
acaugagcauucagccuua

SEQ ID NO: 515702 - RNA, 19 nt, Homo sapiens
cacuauggcugugcuguaa

SEQ ID NO: 515703 - RNA, 19 nt, Homo sapiens
ucaucaaucuacagaauca

SEQ ID NO: 515704 - RNA, 19 nt, Homo sapiens
ggagaaaccuguugugauu

SEQ ID NO: 515705 - RNA, 19 nt, Homo sapiens
ggacaaaguugcugaaauc

SEQ ID NO: 515706 - RNA, 19 nt, Homo sapiens
gaacagaugccuaaucauu

SEQ ID NO: 515707 - RNA, 19 nt, Homo sapiens
ggagacagguuucuuguga

SEQ ID NO: 515708 - RNA, 19 nt, Homo sapiens
gagaacagaugccuaauca

SEQ ID NO: 515709 - RNA, 19 nt, Homo sapiens
guucauaguuugagcguua

SEQ ID NO: 515710 - RNA, 19 nt, Homo sapiens
caaaguugcugaaaucgaa

SEQ ID NO: 515711 - RNA, 19 nt, Homo sapiens
cauuaaggaugacacauua

SEQ ID NO: 515712 - RNA, 19 nt, Homo sapiens
gauaugauguagaguuuga

SEQ ID NO: 515713 - RNA, 19 nt, Homo sapiens
caaaugaucugaggcaguu

SEQ ID NO: 515714 - RNA, 19 nt, Homo sapiens
uuagagaggucacuuacua

SEQ ID NO: 515715 - RNA, 19 nt, Homo sapiens
caacugugcugcaucaaug

SEQ ID NO: 515716 - RNA, 19 nt, Homo sapiens
gcagugcaauggaauuuau

SEQ ID NO: 515717 - RNA, 19 nt, Homo sapiens
ggugaaauguccaaaugaa

SEQ ID NO: 515718 - RNA, 19 nt, Homo sapiens
gggauaugauguagaguuu

SEQ ID NO: 515719 - RNA, 19 nt, Homo sapiens
aaccagagcugcuugcuuu

SEQ ID NO: 515720 - RNA, 19 nt, Homo sapiens
ggucacaaauguccaguug

SEQ ID NO: 515721 - RNA, 19 nt, Homo sapiens
cagaggauuugaaccauaa

SEQ ID NO: 515722 - RNA, 19 nt, Homo sapiens
gaccagaacuguccuuugg

SEQ ID NO: 515723 - RNA, 19 nt, Homo sapiens
gauaauggaugccaaacca

SEQ ID NO: 515724 - RNA, 19 nt, Homo sapiens
ggaugcaggucacaaaugu

SEQ ID NO: 515725 - RNA, 19 nt, Homo sapiens
gaaccauaauccuuggaaa

SEQ ID NO: 515726 - RNA, 19 nt, Homo sapiens
caaaugucaucugugaaua

SEQ ID NO: 515727 - RNA, 19 nt, Homo sapiens
gcaaaugucaucugugaau

SEQ ID NO: 515728 - RNA, 19 nt, Homo sapiens
gaaccucuccagcucauuu

SEQ ID NO: 515729 - RNA, 19 nt, Homo sapiens
ucucagagguccggaauuu

SEQ ID NO: 515730 - RNA, 19 nt, Homo sapiens
ugagacaucuugaggauca

SEQ ID NO: 515731 - RNA, 19 nt, Homo sapiens
uggcaaaugucaucuguga

SEQ ID NO: 515732 - RNA, 19 nt, Homo sapiens
guuagagggucgccuugua

SEQ ID NO: 515733 - RNA, 19 nt, Homo sapiens
ucagaggauuugaaccaua

SEQ ID NO: 515734 - RNA, 19 nt, Homo sapiens
ccaauuccaugcacauuca

SEQ ID NO: 515735 - RNA, 19 nt, Homo sapiens
ggccauagguucugcaaag

SEQ ID NO: 515736 - RNA, 19 nt, Homo sapiens
acaauacgccuuacaauuc

SEQ ID NO: 515737 - RNA, 19 nt, Homo sapiens
ugacaacugugcugcauca

SEQ ID NO: 515738 - RNA, 19 nt, Homo sapiens
gagaggucacuuacuauuu

SEQ ID NO: 515739 - RNA, 19 nt, Homo sapiens
gcgcuugcaccuucaguua

SEQ ID NO: 515740 - RNA, 19 nt, Homo sapiens
gauauucagggaugaguuu

SEQ ID NO: 515741 - RNA, 19 nt, Homo sapiens
ucagagaacagaugccuaa

SEQ ID NO: 515742 - RNA, 19 nt, Homo sapiens
gaucuagacugcccuacag

SEQ ID NO: 515743 - RNA, 19 nt, Homo sapiens
gcaaagccugcaucauaaa

SEQ ID NO: 515744 - RNA, 19 nt, Homo sapiens
gcagcuauuuugccaguua

SEQ ID NO: 515745 - RNA, 19 nt, Homo sapiens
agaggucacuuacuauuuc

SEQ ID NO: 515746 - RNA, 19 nt, Homo sapiens
guauguaagugagcucaaa

SEQ ID NO: 515747 - RNA, 19 nt, Homo sapiens
gcaaaaccacgaagagaua

SEQ ID NO: 515748 - RNA, 19 nt, Homo sapiens
uaguauaccucuuuguugu

SEQ ID NO: 515749 - RNA, 19 nt, Homo sapiens
ccaguuaguauaccucuuu

SEQ ID NO: 515750 - RNA, 19 nt, Homo sapiens
ugugaauacugcaauacua

SEQ ID NO: 515751 - RNA, 19 nt, Homo sapiens
ggaugaguuuaaacccuaa

SEQ ID NO: 515752 - RNA, 19 nt, Homo sapiens
caauacgccuuacaauucu

SEQ ID NO: 515753 - RNA, 19 nt, Homo sapiens
gcucagcgcugugcaaacu

SEQ ID NO: 515754 - RNA, 19 nt, Homo sapiens
gaagaggagaaaccuguug

SEQ ID NO: 515755 - RNA, 19 nt, Homo sapiens
gcacgccaccuacaagaga

SEQ ID NO: 515756 - RNA, 19 nt, Homo sapiens
ccagggauaugauguagag

SEQ ID NO: 515757 - RNA, 19 nt, Homo sapiens
cuagaacgagcaagugaua

SEQ ID NO: 515758 - RNA, 19 nt, Homo sapiens
gaacacccagucacacaug

SEQ ID NO: 515759 - RNA, 19 nt, Homo sapiens
gaggagaaaccuguuguga

SEQ ID NO: 515760 - RNA, 19 nt, Homo sapiens
ucacaaauguccaguugac

SEQ ID NO: 515761 - RNA, 19 nt, Homo sapiens
agaaaccuguugugauuca

SEQ ID NO: 515762 - RNA, 19 nt, Homo sapiens
guaagugagcucaaacgaa

SEQ ID NO: 515763 - RNA, 19 nt, Homo sapiens
uccgggagcugacugcuaa

SEQ ID NO: 515764 - RNA, 19 nt, Homo sapiens
ugaguuugcucuuauggau

SEQ ID NO: 515765 - RNA, 19 nt, Homo sapiens
ucaacuauuuccagacaau

SEQ ID NO: 515766 - RNA, 19 nt, Homo sapiens
caaacgccaugcggccaua

SEQ ID NO: 515767 - RNA, 19 nt, Homo sapiens
ggaaagcaaguaugaaugc

SEQ ID NO: 515768 - RNA, 19 nt, Homo sapiens
gaagauuggcaacuuugga

SEQ ID NO: 515769 - RNA, 19 nt, Homo sapiens
cauugugaguuugcucuua

SEQ ID NO: 515770 - RNA, 19 nt, Homo sapiens
gcacaagauggaacugaga

SEQ ID NO: 515771 - RNA, 19 nt, Homo sapiens
uacaauacgccuuacaauu

SEQ ID NO: 515772 - RNA, 19 nt, Homo sapiens
gcaauacuauacucaucag

SEQ ID NO: 515773 - RNA, 19 nt, Homo sapiens
ggaugacacauuauuagug

SEQ ID NO: 515774 - RNA, 19 nt, Homo sapiens
guacaauacgccuuacaau

SEQ ID NO: 515775 - RNA, 19 nt, Homo sapiens
gcgcugugcaaacuauaua

SEQ ID NO: 515776 - RNA, 19 nt, Homo sapiens
gagcucaaacgaaccauuc

SEQ ID NO: 515777 - RNA, 19 nt, Homo sapiens
gcucauuuauggaggagau

SEQ ID NO: 515778 - RNA, 19 nt, Homo sapiens
aaucaacuauuuccagaca

SEQ ID NO: 515779 - RNA, 19 nt, Homo sapiens
gaaaacagcuguggaucca

SEQ ID NO: 515780 - RNA, 19 nt, Homo sapiens
ccuuaaaacuucagucuuu

SEQ ID NO: 515781 - RNA, 19 nt, Homo sapiens
guuaguauaccucuuuguu

SEQ ID NO: 515782 - RNA, 19 nt, Homo sapiens
cccaggcuguucauaguuu

SEQ ID NO: 515783 - RNA, 19 nt, Homo sapiens
auacuauacucaucagaga

SEQ ID NO: 515784 - RNA, 19 nt, Homo sapiens
ucauagcccuggauucuac

SEQ ID NO: 515785 - RNA, 19 nt, Homo sapiens
ggagcugacugcuaaaaug

SEQ ID NO: 515786 - RNA, 19 nt, Homo sapiens
gagaacacccagucacaca

SEQ ID NO: 515787 - RNA, 19 nt, Homo sapiens
ccaugcacauucaguacuu

SEQ ID NO: 515788 - RNA, 19 nt, Homo sapiens
ugagucugcuaaacuguga

SEQ ID NO: 515789 - RNA, 19 nt, Homo sapiens
aaacaacuaccuggagaaa

SEQ ID NO: 515790 - RNA, 19 nt, Homo sapiens
gaacgagcaagugauaauc

SEQ ID NO: 515791 - RNA, 19 nt, Homo sapiens
caggguacaauacgccuua

SEQ ID NO: 515792 - RNA, 19 nt, Homo sapiens
cagaguauguauguaagug

SEQ ID NO: 515793 - RNA, 19 nt, Homo sapiens
ggauccagccagucugaaa

SEQ ID NO: 515794 - RNA, 19 nt, Homo sapiens
uuauugcucuagaaaguug

SEQ ID NO: 515795 - RNA, 19 nt, Homo sapiens
gguacaauacgccuuacaa

SEQ ID NO: 515796 - RNA, 19 nt, Homo sapiens
agacagguuucuugugaca

SEQ ID NO: 515797 - RNA, 19 nt, Homo sapiens
gcaaacuauauaucccuuu

SEQ ID NO: 515798 - RNA, 19 nt, Homo sapiens
guaagacaagaccaucaaa

SEQ ID NO: 515799 - RNA, 19 nt, Homo sapiens
ggcccaggcuguucauagu

SEQ ID NO: 515800 - RNA, 19 nt, Homo sapiens
gugaauacugcaauacuau

SEQ ID NO: 515801 - RNA, 19 nt, Homo sapiens
gaaauguccaaaugaaggu

SEQ ID NO: 515802 - RNA, 19 nt, Homo sapiens
gcccuaagacaaagaacuu

SEQ ID NO: 515803 - RNA, 19 nt, Homo sapiens
ucagcgcugugcaaacuau

SEQ ID NO: 515804 - RNA, 19 nt, Homo sapiens
ggagaaaccuguugugauu

SEQ ID NO: 515805 - RNA, 19 nt, Homo sapiens
ggacaaaguugcugaaauc

SEQ ID NO: 515806 - RNA, 19 nt, Homo sapiens
gaacagaugccuaaucauu

SEQ ID NO: 515807 - RNA, 19 nt, Homo sapiens
ggagacagguuucuuguga

SEQ ID NO: 515808 - RNA, 19 nt, Homo sapiens
gagaacagaugccuaauca

SEQ ID NO: 515809 - RNA, 19 nt, Homo sapiens
guucauaguuugagcguua

SEQ ID NO: 515810 - RNA, 19 nt, Homo sapiens
caaaguugcugaaaucgaa

SEQ ID NO: 515811 - RNA, 19 nt, Homo sapiens
cauuaaggaugacacauua

SEQ ID NO: 515812 - RNA, 19 nt, Homo sapiens
gauaugauguagaguuuga

SEQ ID NO: 515813 - RNA, 19 nt, Homo sapiens
caaaugaucugaggcaguu

SEQ ID NO: 515814 - RNA, 19 nt, Homo sapiens
uuagagaggucacuuacua

SEQ ID NO: 515815 - RNA, 19 nt, Homo sapiens
caacugugcugcaucaaug

SEQ ID NO: 515816 - RNA, 19 nt, Homo sapiens
gcagugcaauggaauuuau

SEQ ID NO: 515817 - RNA, 19 nt, Homo sapiens
ggacccagcuuucuuugug

SEQ ID NO: 515818 - RNA, 19 nt, Homo sapiens
ggugaaauguccaaaugaa

SEQ ID NO: 515819 - RNA, 19 nt, Homo sapiens
gggauaugauguagaguuu

SEQ ID NO: 515820 - RNA, 19 nt, Homo sapiens
aaccagagcugcuugcuuu

SEQ ID NO: 515821 - RNA, 19 nt, Homo sapiens
ggucacaaauguccaguug

SEQ ID NO: 515822 - RNA, 19 nt, Homo sapiens
cagaggauuugaaccauaa

SEQ ID NO: 515823 - RNA, 19 nt, Homo sapiens
gaccagaacuguccuuugg

SEQ ID NO: 515824 - RNA, 19 nt, Homo sapiens
gauaauggaugccaaacca

SEQ ID NO: 515825 - RNA, 19 nt, Homo sapiens
ggaugcaggucacaaaugu

SEQ ID NO: 515826 - RNA, 19 nt, Homo sapiens
gaaccauaauccuuggaaa

SEQ ID NO: 515827 - RNA, 19 nt, Homo sapiens
caaaugucaucugugaaua

SEQ ID NO: 515828 - RNA, 19 nt, Homo sapiens
gcaaaugucaucugugaau

SEQ ID NO: 515829 - RNA, 19 nt, Homo sapiens
gaaccucuccagcucauuu

SEQ ID NO: 515830 - RNA, 19 nt, Homo sapiens
ucucagagguccggaauuu

SEQ ID NO: 515831 - RNA, 19 nt, Homo sapiens
ugagacaucuugaggauca

SEQ ID NO: 515832 - RNA, 19 nt, Homo sapiens
uggcaaaugucaucuguga

SEQ ID NO: 515833 - RNA, 19 nt, Homo sapiens
cuagaacgaucaugaacuu

SEQ ID NO: 515834 - RNA, 19 nt, Homo sapiens
guuagagggucgccuugua

SEQ ID NO: 515835 - RNA, 19 nt, Homo sapiens
ucagaggauuugaaccaua

SEQ ID NO: 515836 - RNA, 19 nt, Homo sapiens
ccaauuccaugcacauuca

SEQ ID NO: 515837 - RNA, 19 nt, Homo sapiens
ggccauagguucugcaaag

SEQ ID NO: 515838 - RNA, 19 nt, Homo sapiens
gaacgaucaugaacuucug

SEQ ID NO: 515839 - RNA, 19 nt, Homo sapiens
acaauacgccuuacaauuc

SEQ ID NO: 515840 - RNA, 19 nt, Homo sapiens
ugacaacugugcugcauca

SEQ ID NO: 515841 - RNA, 19 nt, Homo sapiens
gagaggucacuuacuauuu

SEQ ID NO: 515842 - RNA, 19 nt, Homo sapiens
gcgcuugcaccuucaguua

SEQ ID NO: 515843 - RNA, 19 nt, Homo sapiens
gcacuagaacgaucaugaa

SEQ ID NO: 515844 - RNA, 19 nt, Homo sapiens
gauauucagggaugaguuu

SEQ ID NO: 515845 - RNA, 19 nt, Homo sapiens
ucagagaacagaugccuaa

SEQ ID NO: 515846 - RNA, 19 nt, Homo sapiens
gaucuagacugcccuacag

SEQ ID NO: 515847 - RNA, 19 nt, Homo sapiens
gaagggacccagcuuucuu

SEQ ID NO: 515848 - RNA, 19 nt, Homo sapiens
gcaaagccugcaucauaaa

SEQ ID NO: 515849 - RNA, 19 nt, Homo sapiens
gcagcuauuuugccaguua

SEQ ID NO: 515850 - RNA, 19 nt, Homo sapiens
agaggucacuuacuauuuc

SEQ ID NO: 515851 - RNA, 19 nt, Homo sapiens
guauguaagugagcucaaa

SEQ ID NO: 515852 - RNA, 19 nt, Homo sapiens
gcaaaaccacgaagagaua

SEQ ID NO: 515853 - RNA, 19 nt, Homo sapiens
uaguauaccucuuuguugu

SEQ ID NO: 515854 - RNA, 19 nt, Homo sapiens
ccaguuaguauaccucuuu

SEQ ID NO: 515855 - RNA, 19 nt, Homo sapiens
ugugaauacugcaauacua

SEQ ID NO: 515856 - RNA, 19 nt, Homo sapiens
ggaugaguuuaaacccuaa

SEQ ID NO: 515857 - RNA, 19 nt, Homo sapiens
caauacgccuuacaauucu

SEQ ID NO: 515858 - RNA, 19 nt, Homo sapiens
gcucagcgcugugcaaacu

SEQ ID NO: 515859 - RNA, 19 nt, Homo sapiens
gaagaggagaaaccuguug

SEQ ID NO: 515860 - RNA, 19 nt, Homo sapiens
gcacgccaccuacaagaga

SEQ ID NO: 515861 - RNA, 19 nt, Homo sapiens
ccagggauaugauguagag

SEQ ID NO: 515862 - RNA, 19 nt, Homo sapiens
gaacacccagucacacaug

SEQ ID NO: 515863 - RNA, 19 nt, Homo sapiens
gaggagaaaccuguuguga

SEQ ID NO: 515864 - RNA, 19 nt, Homo sapiens
ucacaaauguccaguugac

SEQ ID NO: 515865 - RNA, 19 nt, Homo sapiens
agaaaccuguugugauuca

SEQ ID NO: 515866 - RNA, 19 nt, Homo sapiens
guaagugagcucaaacgaa

SEQ ID NO: 515867 - RNA, 19 nt, Homo sapiens
uccgggagcugacugcuaa

SEQ ID NO: 515868 - RNA, 19 nt, Homo sapiens
ugaguuugcucuuauggau

SEQ ID NO: 515869 - RNA, 19 nt, Homo sapiens
ucaacuauuuccagacaau

SEQ ID NO: 515870 - RNA, 19 nt, Homo sapiens
caaacgccaugcggccaua

SEQ ID NO: 515871 - RNA, 19 nt, Homo sapiens
ggaaagcaaguaugaaugc

SEQ ID NO: 515872 - RNA, 19 nt, Homo sapiens
gaagauuggcaacuuugga

SEQ ID NO: 515873 - RNA, 19 nt, Homo sapiens
cauugugaguuugcucuua

SEQ ID NO: 515874 - RNA, 19 nt, Homo sapiens
gcacaagauggaacugaga

SEQ ID NO: 515875 - RNA, 19 nt, Homo sapiens
uacaauacgccuuacaauu

SEQ ID NO: 515876 - RNA, 19 nt, Homo sapiens
gcaauacuauacucaucag

SEQ ID NO: 515877 - RNA, 19 nt, Homo sapiens
ggaugacacauuauuagug

SEQ ID NO: 515878 - RNA, 19 nt, Homo sapiens
guacaauacgccuuacaau

SEQ ID NO: 515879 - RNA, 19 nt, Homo sapiens
gcgcugugcaaacuauaua

SEQ ID NO: 515880 - RNA, 19 nt, Homo sapiens
gagcucaaacgaaccauuc

SEQ ID NO: 515881 - RNA, 19 nt, Homo sapiens
aaucaacuauuuccagaca

SEQ ID NO: 515882 - RNA, 19 nt, Homo sapiens
gcucauuuauggaggagau

SEQ ID NO: 515883 - RNA, 19 nt, Homo sapiens
ccuuaaaacuucagucuuu

SEQ ID NO: 515884 - RNA, 19 nt, Homo sapiens
guuaguauaccucuuuguu

SEQ ID NO: 515885 - RNA, 19 nt, Homo sapiens
gaaaacagcuguggaucca

SEQ ID NO: 515886 - RNA, 19 nt, Homo sapiens
cccaggcuguucauaguuu

SEQ ID NO: 515887 - RNA, 19 nt, Homo sapiens
auacuauacucaucagaga

SEQ ID NO: 515888 - RNA, 19 nt, Homo sapiens
gagagaaucagagcaagug

SEQ ID NO: 515889 - RNA, 19 nt, Homo sapiens
ucauagcccuggauucuac

SEQ ID NO: 515890 - RNA, 19 nt, Homo sapiens
ggagcugacugcuaaaaug

SEQ ID NO: 515891 - RNA, 19 nt, Homo sapiens
gagaacacccagucacaca

SEQ ID NO: 515892 - RNA, 19 nt, Homo sapiens
ugagucugcuaaacuguga

SEQ ID NO: 515893 - RNA, 19 nt, Homo sapiens
ccaugcacauucaguacuu

SEQ ID NO: 515894 - RNA, 19 nt, Homo sapiens
aaacaacuaccuggagaaa

SEQ ID NO: 515895 - RNA, 19 nt, Homo sapiens
caggguacaauacgccuua

SEQ ID NO: 515896 - RNA, 19 nt, Homo sapiens
cagaguauguauguaagug

SEQ ID NO: 515897 - RNA, 19 nt, Homo sapiens
ggauccagccagucugaaa

SEQ ID NO: 515898 - RNA, 19 nt, Homo sapiens
uuauugcucuagaaaguug

SEQ ID NO: 515899 - RNA, 19 nt, Homo sapiens
gguacaauacgccuuacaa

SEQ ID NO: 515900 - RNA, 19 nt, Homo sapiens
agacagguuucuugugaca

SEQ ID NO: 515901 - RNA, 19 nt, Homo sapiens
gcaaacuauauaucccuuu

SEQ ID NO: 515902 - RNA, 19 nt, Homo sapiens
guaagacaagaccaucaaa

SEQ ID NO: 515903 - RNA, 19 nt, Homo sapiens
ggcccaggcuguucauagu

SEQ ID NO: 515904 - RNA, 19 nt, Homo sapiens
caaaggagcugggaagaag

SEQ ID NO: 515905 - RNA, 19 nt, Homo sapiens
gcaggauucuccaugugua

SEQ ID NO: 515906 - RNA, 19 nt, Homo sapiens
ggaauugugguuuguauau

SEQ ID NO: 515907 - RNA, 19 nt, Homo sapiens
aaacaucgccuaggaauug

SEQ ID NO: 515908 - RNA, 19 nt, Homo sapiens
ggaagagggaguugaagaa

SEQ ID NO: 515909 - RNA, 19 nt, Homo sapiens
auaaaugugugugggaaua

SEQ ID NO: 515910 - RNA, 19 nt, Homo sapiens
ggaggaagagggaguugaa

SEQ ID NO: 515911 - RNA, 19 nt, Homo sapiens
gggcauacccugugguguu

SEQ ID NO: 515912 - RNA, 19 nt, Homo sapiens
gccuugcccucuuccuuua

SEQ ID NO: 515913 - RNA, 19 nt, Homo sapiens
gaagaccugaugccugaaa

SEQ ID NO: 515914 - RNA, 19 nt, Homo sapiens
gaaacaucgccuaggaauu

SEQ ID NO: 515915 - RNA, 19 nt, Homo sapiens
aaaucagccuagcaguuua

SEQ ID NO: 515916 - RNA, 19 nt, Homo sapiens
ccucuguauucucuaguua

SEQ ID NO: 515917 - RNA, 19 nt, Homo sapiens
gagaggaggaggaggaaga

SEQ ID NO: 515918 - RNA, 19 nt, Homo sapiens
ugaagaagaggaagaggaa

SEQ ID NO: 515919 - RNA, 19 nt, Homo sapiens
gugggaauauugaaacauc

SEQ ID NO: 515920 - RNA, 19 nt, Homo sapiens
ggaggaagagagagaggaa

SEQ ID NO: 515921 - RNA, 19 nt, Homo sapiens
aaaccugcauccagauaau

SEQ ID NO: 515922 - RNA, 19 nt, Homo sapiens
ggcauacccugugguguug

SEQ ID NO: 515923 - RNA, 19 nt, Homo sapiens
gcuaagaugguccuucugu

SEQ ID NO: 515924 - RNA, 19 nt, Homo sapiens
gaaaaucagccuagcaguu

SEQ ID NO: 515925 - RNA, 19 nt, Homo sapiens
uuagaucccugaccauaag

SEQ ID NO: 515926 - RNA, 19 nt, Homo sapiens
ccagggagccuauggucaa

SEQ ID NO: 515927 - RNA, 19 nt, Homo sapiens
ggaggaggaggaagagaga

SEQ ID NO: 515928 - RNA, 19 nt, Homo sapiens
uaggaauugugguuuguau

SEQ ID NO: 515929 - RNA, 19 nt, Homo sapiens
guuagaucccugaccauaa

SEQ ID NO: 515930 - RNA, 19 nt, Homo sapiens
gagagaggaagaccugaug

SEQ ID NO: 515931 - RNA, 19 nt, Homo sapiens
uaagaugguccuucugugu

SEQ ID NO: 515932 - RNA, 19 nt, Homo sapiens
caggccugcuccuuccuua

SEQ ID NO: 515933 - RNA, 19 nt, Homo sapiens
caugaccucuguauucucu

SEQ ID NO: 515934 - RNA, 19 nt, Homo sapiens
aagagggaguugaagaaga

SEQ ID NO: 515935 - RNA, 19 nt, Homo sapiens
gaagagggaguugaagaag

SEQ ID NO: 515936 - RNA, 19 nt, Homo sapiens
ggccuugcccucuuccuuu

SEQ ID NO: 515937 - RNA, 19 nt, Homo sapiens
gcuccuggaugaccugagu

SEQ ID NO: 515938 - RNA, 19 nt, Homo sapiens
ggaggagugaacccaguuu

SEQ ID NO: 515939 - RNA, 19 nt, Homo sapiens
agagggaguugaagaagag

SEQ ID NO: 515940 - RNA, 19 nt, Homo sapiens
cccuaucccuugucgauga

SEQ ID NO: 515941 - RNA, 19 nt, Homo sapiens
ugaaacaucgccuaggaau

SEQ ID NO: 515942 - RNA, 19 nt, Homo sapiens
gaagcguugugugcaaauc

SEQ ID NO: 515943 - RNA, 19 nt, Homo sapiens
gcagaucccaaggcucaaa

SEQ ID NO: 515944 - RNA, 19 nt, Homo sapiens
gccuaggaauugugguuug

SEQ ID NO: 515945 - RNA, 19 nt, Homo sapiens
aaaugugugugggaauauu

SEQ ID NO: 515946 - RNA, 19 nt, Homo sapiens
gaacccaguuuucccugaa

SEQ ID NO: 515947 - RNA, 19 nt, Homo sapiens
gcugcucgcucuggcuuug

SEQ ID NO: 515948 - RNA, 19 nt, Homo sapiens
gugucuggcugugggauaa

SEQ ID NO: 515949 - RNA, 19 nt, Homo sapiens
uggcuaagaugguccuucu

SEQ ID NO: 515950 - RNA, 19 nt, Homo sapiens
ucaaaggagcugggaagaa

SEQ ID NO: 515951 - RNA, 19 nt, Homo sapiens
guuuguauauaacccucua

SEQ ID NO: 515952 - RNA, 19 nt, Homo sapiens
cgucccagaucuuucaauc

SEQ ID NO: 515953 - RNA, 19 nt, Homo sapiens
ugaccucuguauucucuag

SEQ ID NO: 515954 - RNA, 19 nt, Homo sapiens
caccauucaugaccucugu

SEQ ID NO: 515955 - RNA, 19 nt, Homo sapiens
auugaaacaucgccuagga

SEQ ID NO: 515956 - RNA, 19 nt, Homo sapiens
ccacuuuccuccacuuagc

SEQ ID NO: 515957 - RNA, 19 nt, Homo sapiens
aaaaucagccuagcaguuu

SEQ ID NO: 515958 - RNA, 19 nt, Homo sapiens
ucccugaagucgaguuugu

SEQ ID NO: 515959 - RNA, 19 nt, Homo sapiens
gauaaaugugugugggaau

SEQ ID NO: 515960 - RNA, 19 nt, Homo sapiens
guccuucugugucuugcaa

SEQ ID NO: 515961 - RNA, 19 nt, Homo sapiens
aagaagaggaagaggaaga

SEQ ID NO: 515962 - RNA, 19 nt, Homo sapiens
auucaugaccucuguauuc

SEQ ID NO: 515963 - RNA, 19 nt, Homo sapiens
gugcaaauccagcuuccau

SEQ ID NO: 515964 - RNA, 19 nt, Homo sapiens
ccuaggaauugugguuugu

SEQ ID NO: 515965 - RNA, 19 nt, Homo sapiens
ggaggaggaagagggaguu

SEQ ID NO: 515966 - RNA, 19 nt, Homo sapiens
ccagggagcugaggaaaag

SEQ ID NO: 515967 - RNA, 19 nt, Homo sapiens
gagccagggagcugaggaa

SEQ ID NO: 515968 - RNA, 19 nt, Homo sapiens
caggauucuccauguguaa

SEQ ID NO: 515969 - RNA, 19 nt, Homo sapiens
gggaguugaagaagaggaa

SEQ ID NO: 515970 - RNA, 19 nt, Homo sapiens
aaucagccuagcaguuuaa

SEQ ID NO: 515971 - RNA, 19 nt, Homo sapiens
uaaaugugugugggaauau

SEQ ID NO: 515972 - RNA, 19 nt, Homo sapiens
cugaagcguugugugcaaa

SEQ ID NO: 515973 - RNA, 19 nt, Homo sapiens
gaucccaaggcucaaagga

SEQ ID NO: 515974 - RNA, 19 nt, Homo sapiens
ccuuuaggcaugugagaaa

SEQ ID NO: 515975 - RNA, 19 nt, Homo sapiens
aagaggaggaggaggaaga

SEQ ID NO: 515976 - RNA, 19 nt, Homo sapiens
agaagaggaagaggaagaa

SEQ ID NO: 515977 - RNA, 19 nt, Homo sapiens
gcacagagcuugaugauau

SEQ ID NO: 515978 - RNA, 19 nt, Homo sapiens
gaacacaaaucugaaugua

SEQ ID NO: 515979 - RNA, 19 nt, Homo sapiens
caaagaugcuauugugaua

SEQ ID NO: 515980 - RNA, 19 nt, Homo sapiens
gaaaauggaugacaaagaa

SEQ ID NO: 515981 - RNA, 19 nt, Homo sapiens
ucacaucucuuuacuguau

SEQ ID NO: 515982 - RNA, 19 nt, Homo sapiens
ggaagcaggucaccaagau

SEQ ID NO: 515983 - RNA, 19 nt, Homo sapiens
uacaagaucuccaggaauu

SEQ ID NO: 515984 - RNA, 19 nt, Homo sapiens
ggcaguagcugaucucaug

SEQ ID NO: 515985 - RNA, 19 nt, Homo sapiens
uaacagccuuuaccauuga

SEQ ID NO: 515986 - RNA, 19 nt, Homo sapiens
caacagagaaaccugcuaa

SEQ ID NO: 515987 - RNA, 19 nt, Homo sapiens
cuacaggacucuagugguu

SEQ ID NO: 515988 - RNA, 19 nt, Homo sapiens
gggagaacauggccaauag

SEQ ID NO: 515989 - RNA, 19 nt, Homo sapiens
gcuacaagaucuccaggaa

SEQ ID NO: 515990 - RNA, 19 nt, Homo sapiens
gagaaucugugcagucauc

SEQ ID NO: 515991 - RNA, 19 nt, Homo sapiens
caucuuacuuguacucauu

SEQ ID NO: 515992 - RNA, 19 nt, Homo sapiens
gcagaucagucuuugucaa

SEQ ID NO: 515993 - RNA, 19 nt, Homo sapiens
cagagaaaccugcuaacua

SEQ ID NO: 515994 - RNA, 19 nt, Homo sapiens
gagcagugguggccuuaga

SEQ ID NO: 515995 - RNA, 19 nt, Homo sapiens
guaauucuguuugcccuuu

SEQ ID NO: 515996 - RNA, 19 nt, Homo sapiens
gaacauggccaauagucau

SEQ ID NO: 515997 - RNA, 19 nt, Homo sapiens
agagaaaccugcuaacuac

SEQ ID NO: 515998 - RNA, 19 nt, Homo sapiens
caacauaacagacaguauc

SEQ ID NO: 515999 - RNA, 19 nt, Homo sapiens
gagguauccuuuagccaaa

SEQ ID NO: 516000 - RNA, 19 nt, Homo sapiens
cuacucaccuauuuaccua

SEQ ID NO: 516001 - RNA, 19 nt, Homo sapiens
cugcuuggcuucugaggua

SEQ ID NO: 516002 - RNA, 19 nt, Homo sapiens
gaauuaaugcauccucuug

SEQ ID NO: 516003 - RNA, 19 nt, Homo sapiens
uaaaucccauuccuucaga

SEQ ID NO: 516004 - RNA, 19 nt, Homo sapiens
gcagaagccaacagagaaa

SEQ ID NO: 516005 - RNA, 19 nt, Homo sapiens
aauaacagccuuuaccauu

SEQ ID NO: 516006 - RNA, 19 nt, Homo sapiens
agucauaugugaagacaga

SEQ ID NO: 516007 - RNA, 19 nt, Homo sapiens
ggccaauagucauauguga

SEQ ID NO: 516008 - RNA, 19 nt, Homo sapiens
gaaaccugcuaacuacagu

SEQ ID NO: 516009 - RNA, 19 nt, Homo sapiens
gcaagcagaagccaacaga

SEQ ID NO: 516010 - RNA, 19 nt, Homo sapiens
caacagcacaguaucuuca

SEQ ID NO: 516011 - RNA, 19 nt, Homo sapiens
gaauuacuacucaccuauu

SEQ ID NO: 516012 - RNA, 19 nt, Homo sapiens
caaggaagcaggucaccaa

SEQ ID NO: 516013 - RNA, 19 nt, Homo sapiens
uagcugaucucauggucuu

SEQ ID NO: 516014 - RNA, 19 nt, Homo sapiens
gagcagaucagucuuuguc

SEQ ID NO: 516015 - RNA, 19 nt, Homo sapiens
agccaaaguugauucauga

SEQ ID NO: 516016 - RNA, 19 nt, Homo sapiens
caacccaucagaacacaaa

SEQ ID NO: 516017 - RNA, 19 nt, Homo sapiens
ggaauuacuacucaccuau

SEQ ID NO: 516018 - RNA, 19 nt, Homo sapiens
caaagaaauugagaaucug

SEQ ID NO: 516019 - RNA, 19 nt, Homo sapiens
ucaaggagucagaccauuu

SEQ ID NO: 516020 - RNA, 19 nt, Homo sapiens
acaguguggcccuaaauua

SEQ ID NO: 516021 - RNA, 19 nt, Homo sapiens
ggacuuuggugucuuuuau

SEQ ID NO: 516022 - RNA, 19 nt, Homo sapiens
auaacagccuuuaccauug

SEQ ID NO: 516023 - RNA, 19 nt, Homo sapiens
uagccaaaguugauucaug

SEQ ID NO: 516024 - RNA, 19 nt, Homo sapiens
uuucacaucucuuuacugu

SEQ ID NO: 516025 - RNA, 19 nt, Homo sapiens
ugcauccucuuguucaaua

SEQ ID NO: 516026 - RNA, 19 nt, Homo sapiens
ucaagccacugaagaugga

SEQ ID NO: 516027 - RNA, 19 nt, Homo sapiens
gcacaguaucuucaaggaa

SEQ ID NO: 516028 - RNA, 19 nt, Homo sapiens
uaaauuacagcgucaucaa

SEQ ID NO: 516029 - RNA, 19 nt, Homo sapiens
gaucagucuuugucaaugc

SEQ ID NO: 516030 - RNA, 19 nt, Homo sapiens
cagagcagaucagucuuug

SEQ ID NO: 516031 - RNA, 19 nt, Homo sapiens
ucaacccggugauuuacaa

SEQ ID NO: 516032 - RNA, 19 nt, Homo sapiens
gauauccuguggcuacaag

SEQ ID NO: 516033 - RNA, 19 nt, Homo sapiens
cuauuuaccuaauggacuu

SEQ ID NO: 516034 - RNA, 19 nt, Homo sapiens
gaagaaaauggaugacaaa

SEQ ID NO: 516035 - RNA, 19 nt, Homo sapiens
ugucugggcuuucacaucu

SEQ ID NO: 516036 - RNA, 19 nt, Homo sapiens
caaggagucagaccauuuc

SEQ ID NO: 516037 - RNA, 19 nt, Homo sapiens
ucauuucucuccaguccuu

SEQ ID NO: 516038 - RNA, 19 nt, Homo sapiens
gcauccucuuguucaauaa

SEQ ID NO: 516039 - RNA, 19 nt, Homo sapiens
gaagacagagcagaucagu

SEQ ID NO: 516040 - RNA, 19 nt, Homo sapiens
ggaauuaaugcauccucuu

SEQ ID NO: 516041 - RNA, 19 nt, Homo sapiens
ugucaaugcucuaacaaac

SEQ ID NO: 516042 - RNA, 19 nt, Homo sapiens
ggucaccaucuuacuugua

SEQ ID NO: 516043 - RNA, 19 nt, Homo sapiens
ggacucuagugguugucaa

SEQ ID NO: 516044 - RNA, 19 nt, Homo sapiens
ccaauagucauaugugaag

SEQ ID NO: 516045 - RNA, 19 nt, Homo sapiens
gagaacauggccaauaguc

SEQ ID NO: 516046 - RNA, 19 nt, Homo sapiens
cuucugagguauccuuuag

SEQ ID NO: 516047 - RNA, 19 nt, Homo sapiens
aaucucaugucccagaaau

SEQ ID NO: 516048 - RNA, 19 nt, Homo sapiens
aauggacuuuggugucuuu

SEQ ID NO: 516049 - RNA, 19 nt, Homo sapiens
gaugacaaagaaauugaga

SEQ ID NO: 516050 - RNA, 19 nt, Homo sapiens
cuaccguccucuauggauu

SEQ ID NO: 516051 - RNA, 19 nt, Homo sapiens
aagaugcuauugugauauc

SEQ ID NO: 516052 - RNA, 19 nt, Homo sapiens
aauauuagcaccuacaaag

SEQ ID NO: 516053 - RNA, 19 nt, Homo sapiens
aagcagaagccaacagaga

SEQ ID NO: 516054 - RNA, 19 nt, Homo sapiens
cuaauggacuuuggugucu

SEQ ID NO: 516055 - RNA, 19 nt, Homo sapiens
ucaccuauuuaccuaaugg

SEQ ID NO: 516056 - RNA, 19 nt, Homo sapiens
gcaccuacaaagaugcuau

SEQ ID NO: 516057 - RNA, 19 nt, Homo sapiens
gccaauagucauaugugaa

SEQ ID NO: 516058 - RNA, 19 nt, Homo sapiens
aggaauuacuacucaccua

SEQ ID NO: 516059 - RNA, 19 nt, Homo sapiens
gggcuuucacaucucuuua

SEQ ID NO: 516060 - RNA, 19 nt, Homo sapiens
acagagcagaucagucuuu

SEQ ID NO: 516061 - RNA, 19 nt, Homo sapiens
cuccaguccuuuccaagaa

SEQ ID NO: 516062 - RNA, 19 nt, Homo sapiens
aaacgagacagucagugaa

SEQ ID NO: 516063 - RNA, 19 nt, Homo sapiens
uugcuggaucucaauauua

SEQ ID NO: 516064 - RNA, 19 nt, Homo sapiens
gcuggcagugguuguaauu

SEQ ID NO: 516065 - RNA, 19 nt, Homo sapiens
cauaacagacaguaucuac

SEQ ID NO: 516066 - RNA, 19 nt, Homo sapiens
caucaaagcccaguuucuc

SEQ ID NO: 516067 - RNA, 19 nt, Homo sapiens
auuaaugcauccucuuguu

SEQ ID NO: 516068 - RNA, 19 nt, Homo sapiens
uccaguauuugggaauuaa

SEQ ID NO: 516069 - RNA, 19 nt, Homo sapiens
cagaucagucuuugucaau

SEQ ID NO: 516070 - RNA, 19 nt, Homo sapiens
uugagaaucugugcaguca

SEQ ID NO: 516071 - RNA, 19 nt, Homo sapiens
acaccugcuuggcuucuga

SEQ ID NO: 516072 - RNA, 19 nt, Homo sapiens
ggcagugguuguaauucug

SEQ ID NO: 516073 - RNA, 19 nt, Homo sapiens
gaagcaggucaccaagaug

SEQ ID NO: 516074 - RNA, 19 nt, Homo sapiens
gcagugguggccuuagaau

SEQ ID NO: 516075 - RNA, 19 nt, Homo sapiens
caauauuagcaccuacaaa

SEQ ID NO: 516076 - RNA, 19 nt, Homo sapiens
cuugcuggaucucaauauu

SEQ ID NO: 516077 - RNA, 19 nt, Homo sapiens
ggaaagagauugacauaaa

SEQ ID NO: 516078 - RNA, 19 nt, Homo sapiens
gagagaagaugauguugga

SEQ ID NO: 516079 - RNA, 19 nt, Homo sapiens
gagcaggccuguuggaaau

SEQ ID NO: 516080 - RNA, 19 nt, Homo sapiens
gaucagcacccuaaagaaa

SEQ ID NO: 516081 - RNA, 19 nt, Homo sapiens
gcaagugugucgcaauguu

SEQ ID NO: 516082 - RNA, 19 nt, Homo sapiens
ggagaugaauacuuuacuu

SEQ ID NO: 516083 - RNA, 19 nt, Homo sapiens
gcaaggcauuggaugauau

SEQ ID NO: 516084 - RNA, 19 nt, Homo sapiens
gcccaugccuugacagaaa

SEQ ID NO: 516085 - RNA, 19 nt, Homo sapiens
caagaacccucgcauugug

SEQ ID NO: 516086 - RNA, 19 nt, Homo sapiens
gauaugaucagcacccuaa

SEQ ID NO: 516087 - RNA, 19 nt, Homo sapiens
ccaagacuauugcagauau

SEQ ID NO: 516088 - RNA, 19 nt, Homo sapiens
cugugaagcugcagacuua

SEQ ID NO: 516089 - RNA, 19 nt, Homo sapiens
gggaccacaucaguaauua

SEQ ID NO: 516090 - RNA, 19 nt, Homo sapiens
guacuuugguggacaugaa

SEQ ID NO: 516091 - RNA, 19 nt, Homo sapiens
gaagccagacugacauuga

SEQ ID NO: 516092 - RNA, 19 nt, Homo sapiens
gcauugugcugcuggauuc

SEQ ID NO: 516093 - RNA, 19 nt, Homo sapiens
gauaucauccgaacauguu

SEQ ID NO: 516094 - RNA, 19 nt, Homo sapiens
ggccaugacugguguggaa

SEQ ID NO: 516095 - RNA, 19 nt, Homo sapiens
gaccacaucaguaauuauu

SEQ ID NO: 516096 - RNA, 19 nt, Homo sapiens
gacccaggaugaagaaguu

SEQ ID NO: 516097 - RNA, 19 nt, Homo sapiens
gcagauaucauccgaacau

SEQ ID NO: 516098 - RNA, 19 nt, Homo sapiens
aaaagacacugacauguaa

SEQ ID NO: 516099 - RNA, 19 nt, Homo sapiens
ugaaggaacugggcauaug

SEQ ID NO: 516100 - RNA, 19 nt, Homo sapiens
ccaaguccaugaucgaaau

SEQ ID NO: 516101 - RNA, 19 nt, Homo sapiens
ccaaguccaugaugaagau

SEQ ID NO: 516102 - RNA, 19 nt, Homo sapiens
acacugacauguaauucuu

SEQ ID NO: 516103 - RNA, 19 nt, Homo sapiens
cagaggaacugagagaaga

SEQ ID NO: 516104 - RNA, 19 nt, Homo sapiens
ggacgucuuuguucagaag

SEQ ID NO: 516105 - RNA, 19 nt, Homo sapiens
gaacacuguggacgucuuu

SEQ ID NO: 516106 - RNA, 19 nt, Homo sapiens
gagaauggucggaaagaga

SEQ ID NO: 516107 - RNA, 19 nt, Homo sapiens
aucaacagcucuauuacua

SEQ ID NO: 516108 - RNA, 19 nt, Homo sapiens
gaacugagagaagaugaug

SEQ ID NO: 516109 - RNA, 19 nt, Homo sapiens
ggaggaagccagacugaca

SEQ ID NO: 516110 - RNA, 19 nt, Homo sapiens
ccacaucaguaauuauucu

SEQ ID NO: 516111 - RNA, 19 nt, Homo sapiens
caaaagacacugacaugua

SEQ ID NO: 516112 - RNA, 19 nt, Homo sapiens
ugacugguguggaacaaug

SEQ ID NO: 516113 - RNA, 19 nt, Homo sapiens
ggagcaggccuguuggaaa

SEQ ID NO: 516114 - RNA, 19 nt, Homo sapiens
gcucagcacuaccuuaugc

SEQ ID NO: 516115 - RNA, 19 nt, Homo sapiens
agacugacauugagauuac

SEQ ID NO: 516116 - RNA, 19 nt, Homo sapiens
ggcauuggaugauaugauc

SEQ ID NO: 516117 - RNA, 19 nt, Homo sapiens
gacagacaauaaucgcauu

SEQ ID NO: 516118 - RNA, 19 nt, Homo sapiens
uuucaucacugacugcaaa

SEQ ID NO: 516119 - RNA, 19 nt, Homo sapiens
ggucaucuuuggcuugcaa

SEQ ID NO: 516120 - RNA, 19 nt, Homo sapiens
gacauguaauucuucucua

SEQ ID NO: 516121 - RNA, 19 nt, Homo sapiens
ugaagcugcagacuuauaa

SEQ ID NO: 516122 - RNA, 19 nt, Homo sapiens
gcuggauucuucucuggaa

SEQ ID NO: 516123 - RNA, 19 nt, Homo sapiens
acagugauaugaugcugaa

SEQ ID NO: 516124 - RNA, 19 nt, Homo sapiens
ggaacacuguggacgucuu

SEQ ID NO: 516125 - RNA, 19 nt, Homo sapiens
caagaaaauuggagaugaa

SEQ ID NO: 516126 - RNA, 19 nt, Homo sapiens
gaugaccaaugauggcaau

SEQ ID NO: 516127 - RNA, 19 nt, Homo sapiens
caucaaugcugccaagacu

SEQ ID NO: 516128 - RNA, 19 nt, Homo sapiens
gcagcucugugaggacauu

SEQ ID NO: 516129 - RNA, 19 nt, Homo sapiens
ugaggagaauggucggaaa

SEQ ID NO: 516130 - RNA, 19 nt, Homo sapiens
gcugcagacuuauaagaca

SEQ ID NO: 516131 - RNA, 19 nt, Homo sapiens
gcaggccuguuggaaauca

SEQ ID NO: 516132 - RNA, 19 nt, Homo sapiens
ggagaauggucggaaagag

SEQ ID NO: 516133 - RNA, 19 nt, Homo sapiens
gaacacaaagcgugaaucc

SEQ ID NO: 516134 - RNA, 19 nt, Homo sapiens
gugaagcugcagacuuaua

SEQ ID NO: 516135 - RNA, 19 nt, Homo sapiens
gaaggaacugggcauaugg

SEQ ID NO: 516136 - RNA, 19 nt, Homo sapiens
ggacuucacccgaauucuc

SEQ ID NO: 516137 - RNA, 19 nt, Homo sapiens
cgcaaggcauuggaugaua

SEQ ID NO: 516138 - RNA, 19 nt, Homo sapiens
cccaaggccugcaccauuc

SEQ ID NO: 516139 - RNA, 19 nt, Homo sapiens
gaccagaggaacugagaga

SEQ ID NO: 516140 - RNA, 19 nt, Homo sapiens
gcagaguccggaagacaga

SEQ ID NO: 516141 - RNA, 19 nt, Homo sapiens
gaaaggaggaagccagacu

SEQ ID NO: 516142 - RNA, 19 nt, Homo sapiens
gagucaugauuaacaagga

SEQ ID NO: 516143 - RNA, 19 nt, Homo sapiens
ggaugaagaaguuggagau

SEQ ID NO: 516144 - RNA, 19 nt, Homo sapiens
ucaaugcugccaagacuau

SEQ ID NO: 516145 - RNA, 19 nt, Homo sapiens
guucugcuacugcgaauug

SEQ ID NO: 516146 - RNA, 19 nt, Homo sapiens
gugaggacauuauccaacu

SEQ ID NO: 516147 - RNA, 19 nt, Homo sapiens
guggagucaugauuaacaa

SEQ ID NO: 516148 - RNA, 19 nt, Homo sapiens
ucggaaagagauugacaua

SEQ ID NO: 516149 - RNA, 19 nt, Homo sapiens
aaaguucaaucuggaaaca

SEQ ID NO: 516150 - RNA, 19 nt, Homo sapiens
gaggacauuauccaacuga

SEQ ID NO: 516151 - RNA, 19 nt, Homo sapiens
cagacugacauugagauua

SEQ ID NO: 516152 - RNA, 19 nt, Homo sapiens
ccuggaugcugucaagaug

SEQ ID NO: 516153 - RNA, 19 nt, Homo sapiens
ggaagacagacaauaaucg

SEQ ID NO: 516154 - RNA, 19 nt, Homo sapiens
agauuuagcucagcacuac

SEQ ID NO: 516155 - RNA, 19 nt, Homo sapiens
gugauaugaugcugaacau

SEQ ID NO: 516156 - RNA, 19 nt, Homo sapiens
uuaguuugcuuccgaugau

SEQ ID NO: 516157 - RNA, 19 nt, Homo sapiens
guucagaagggaucagguu

SEQ ID NO: 516158 - RNA, 19 nt, Homo sapiens
guggaacaauggccauaca

SEQ ID NO: 516159 - RNA, 19 nt, Homo sapiens
ucaagaacccucgcauugu

SEQ ID NO: 516160 - RNA, 19 nt, Homo sapiens
gugcuuaccgcaaggcauu

SEQ ID NO: 516161 - RNA, 19 nt, Homo sapiens
ccaagcacacccaggagaa

SEQ ID NO: 516162 - RNA, 19 nt, Homo sapiens
ucaagaaaauuggagauga

SEQ ID NO: 516163 - RNA, 19 nt, Homo sapiens
gacccaaguccaugaugaa

SEQ ID NO: 516164 - RNA, 19 nt, Homo sapiens
ggacauuauccaacugaag

SEQ ID NO: 516165 - RNA, 19 nt, Homo sapiens
gaaaauuggagaugaauac

SEQ ID NO: 516166 - RNA, 19 nt, Homo sapiens
caagacuauugcagauauc

SEQ ID NO: 516167 - RNA, 19 nt, Homo sapiens
uaucaagaacccucgcauu

SEQ ID NO: 516168 - RNA, 19 nt, Homo sapiens
cagugacagugauaugaug

SEQ ID NO: 516169 - RNA, 19 nt, Homo sapiens
ggaccacaucaguaauuau

SEQ ID NO: 516170 - RNA, 19 nt, Homo sapiens
guggacgucuuuguucaga

SEQ ID NO: 516171 - RNA, 19 nt, Homo sapiens
uagcucagcacuaccuuau

SEQ ID NO: 516172 - RNA, 19 nt, Homo sapiens
caucaucaacagcucuauu

SEQ ID NO: 516173 - RNA, 19 nt, Homo sapiens
gccaagacuauugcagaua

SEQ ID NO: 516174 - RNA, 19 nt, Homo sapiens
ugcguggagucaugauuaa

SEQ ID NO: 516175 - RNA, 19 nt, Homo sapiens
uugcguggagucaugauua

SEQ ID NO: 516176 - RNA, 19 nt, Homo sapiens
caguggugaucagugcuua

SEQ ID NO: 516177 - RNA, 19 nt, Homo sapiens
guacauagcuuauugucaa

SEQ ID NO: 516178 - RNA, 19 nt, Homo sapiens
gaaauugcauuccaaguga

SEQ ID NO: 516179 - RNA, 19 nt, Homo sapiens
gauaagagguacagagauu

SEQ ID NO: 516180 - RNA, 19 nt, Homo sapiens
gaagagaccugccugaaca

SEQ ID NO: 516181 - RNA, 19 nt, Homo sapiens
guaaagaagugaaagauuc

SEQ ID NO: 516182 - RNA, 19 nt, Homo sapiens
gaacaacgauggucacuac

SEQ ID NO: 516183 - RNA, 19 nt, Homo sapiens
gcacacagcacuccguuua

SEQ ID NO: 516184 - RNA, 19 nt, Homo sapiens
ggcaagaucuucugcagua

SEQ ID NO: 516185 - RNA, 19 nt, Homo sapiens
ggaagucgcuccuugacaa

SEQ ID NO: 516186 - RNA, 19 nt, Homo sapiens
caacggagaguccauguua

SEQ ID NO: 516187 - RNA, 19 nt, Homo sapiens
gcagaaacgucaugaagau

SEQ ID NO: 516188 - RNA, 19 nt, Homo sapiens
gaacauaucacucuugcuu

SEQ ID NO: 516189 - RNA, 19 nt, Homo sapiens
gaaaggaaauccagcucuu

SEQ ID NO: 516190 - RNA, 19 nt, Homo sapiens
gacaaagccuugaccauga

SEQ ID NO: 516191 - RNA, 19 nt, Homo sapiens
gagagaagguugcacaugu

SEQ ID NO: 516192 - RNA, 19 nt, Homo sapiens
gcaagcaccuggagcagaa

SEQ ID NO: 516193 - RNA, 19 nt, Homo sapiens
gcaaauuguuuaccucaga

SEQ ID NO: 516194 - RNA, 19 nt, Homo sapiens
ccagauaacugcaaagcaa

SEQ ID NO: 516195 - RNA, 19 nt, Homo sapiens
cgaccuauccguagcauua

SEQ ID NO: 516196 - RNA, 19 nt, Homo sapiens
caaggccucuucucgguua

SEQ ID NO: 516197 - RNA, 19 nt, Homo sapiens
gaagcaaguaccuuuauaa

SEQ ID NO: 516198 - RNA, 19 nt, Homo sapiens
gaacaagcaggacuggaua

SEQ ID NO: 516199 - RNA, 19 nt, Homo sapiens
gcagacaaguuucagaugu

SEQ ID NO: 516200 - RNA, 19 nt, Homo sapiens
ugaagaagcuggcgcacaa

SEQ ID NO: 516201 - RNA, 19 nt, Homo sapiens
ggagcugccucaggauuua

SEQ ID NO: 516202 - RNA, 19 nt, Homo sapiens
caaauauggucucuuuaga

SEQ ID NO: 516203 - RNA, 19 nt, Homo sapiens
gaaaugugaucagaaagga

SEQ ID NO: 516204 - RNA, 19 nt, Homo sapiens
gaaagaagaugguguuccu

SEQ ID NO: 516205 - RNA, 19 nt, Homo sapiens
gaaguagcauggaaaugga

SEQ ID NO: 516206 - RNA, 19 nt, Homo sapiens
cgacauggauuagccaauu

SEQ ID NO: 516207 - RNA, 19 nt, Homo sapiens
gcagacgucuuccugaaau

SEQ ID NO: 516208 - RNA, 19 nt, Homo sapiens
acaaaggccuguuucuaaa

SEQ ID NO: 516209 - RNA, 19 nt, Homo sapiens
gcaacaagguaucugugaa

SEQ ID NO: 516210 - RNA, 19 nt, Homo sapiens
gaaggaaagggagagauua

SEQ ID NO: 516211 - RNA, 19 nt, Homo sapiens
gcacgaggaguuccagaua

SEQ ID NO: 516212 - RNA, 19 nt, Homo sapiens
caucaaagcuccugaacag

SEQ ID NO: 516213 - RNA, 19 nt, Homo sapiens
cuaaacagcuacacagaga

SEQ ID NO: 516214 - RNA, 19 nt, Homo sapiens
ggacgggacucucaagaag

SEQ ID NO: 516215 - RNA, 19 nt, Homo sapiens
cagaauacauugauaccuu

SEQ ID NO: 516216 - RNA, 19 nt, Homo sapiens
ccaauuccauuucuuccua

SEQ ID NO: 516217 - RNA, 19 nt, Homo sapiens
ccaaucagcuguuaaucug

SEQ ID NO: 516218 - RNA, 19 nt, Homo sapiens
gaacacaacaccuugaaca

SEQ ID NO: 516219 - RNA, 19 nt, Homo sapiens
aaacuuggauccaugaaau

SEQ ID NO: 516220 - RNA, 19 nt, Homo sapiens
cagcaaucaugacagaaua

SEQ ID NO: 516221 - RNA, 19 nt, Homo sapiens
caacuacauuuaugacguu

SEQ ID NO: 516222 - RNA, 19 nt, Homo sapiens
gagcagaucgucauauuca

SEQ ID NO: 516223 - RNA, 19 nt, Homo sapiens
gaagucaugugcauaguac

SEQ ID NO: 516224 - RNA, 19 nt, Homo sapiens
ggaaauccagcucuuuaaa

SEQ ID NO: 516225 - RNA, 19 nt, Homo sapiens
gaaagggagagauuaaaga

SEQ ID NO: 516226 - RNA, 19 nt, Homo sapiens
gacuuuagcuucccagaug

SEQ ID NO: 516227 - RNA, 19 nt, Homo sapiens
ggagaagcaaguaccuuua

SEQ ID NO: 516228 - RNA, 19 nt, Homo sapiens
gaaccacggagaagcauuu

SEQ ID NO: 516229 - RNA, 19 nt, Homo sapiens
ggaauaugaucgaggaaca

SEQ ID NO: 516230 - RNA, 19 nt, Homo sapiens
gcaaacaccagaaugaugu

SEQ ID NO: 516231 - RNA, 19 nt, Homo sapiens
gaggacgggugacguggua

SEQ ID NO: 516232 - RNA, 19 nt, Homo sapiens
caugaaguaucagcuguua

SEQ ID NO: 516233 - RNA, 19 nt, Homo sapiens
ugacaguggugauccauga

SEQ ID NO: 516234 - RNA, 19 nt, Homo sapiens
cuacucagcugauauugga

SEQ ID NO: 516235 - RNA, 19 nt, Homo sapiens
cagacaaguuucagaugua

SEQ ID NO: 516236 - RNA, 19 nt, Homo sapiens
agaacaggguauugcauua

SEQ ID NO: 516237 - RNA, 19 nt, Homo sapiens
ugaagaagaaggugauuaa

SEQ ID NO: 516238 - RNA, 19 nt, Homo sapiens
ggaauacaaccacgaagaa

SEQ ID NO: 516239 - RNA, 19 nt, Homo sapiens
ggagaccguuguucuuaga

SEQ ID NO: 516240 - RNA, 19 nt, Homo sapiens
ggagaggucguucaaauuc

SEQ ID NO: 516241 - RNA, 19 nt, Homo sapiens
gcaacauccaucagauuua

SEQ ID NO: 516242 - RNA, 19 nt, Homo sapiens
uaagagaccuccgggaaug

SEQ ID NO: 516243 - RNA, 19 nt, Homo sapiens
guacaggaccucuuuggaa

SEQ ID NO: 516244 - RNA, 19 nt, Homo sapiens
caccaaugcggauaaauua

SEQ ID NO: 516245 - RNA, 19 nt, Homo sapiens
guaugaacguguauguaaa

SEQ ID NO: 516246 - RNA, 19 nt, Homo sapiens
caaaguaguugauccuucu

SEQ ID NO: 516247 - RNA, 19 nt, Homo sapiens
agaaacagaggacuaauuu

SEQ ID NO: 516248 - RNA, 19 nt, Homo sapiens
gaaagcagcagcaguagca

SEQ ID NO: 516249 - RNA, 19 nt, Homo sapiens
ggaaggaaagggagagauu

SEQ ID NO: 516250 - RNA, 19 nt, Homo sapiens
gagugaagcuauugauaca

SEQ ID NO: 516251 - RNA, 19 nt, Homo sapiens
ccagaugacuacuuuaaag

SEQ ID NO: 516252 - RNA, 19 nt, Homo sapiens
gaagggcccugaacacaac

SEQ ID NO: 516253 - RNA, 19 nt, Homo sapiens
caagguaucugugaagcuu

SEQ ID NO: 516254 - RNA, 19 nt, Homo sapiens
ugacaucgccaaucgagua

SEQ ID NO: 516255 - RNA, 19 nt, Homo sapiens
aaugaucccuguaaauuug

SEQ ID NO: 516256 - RNA, 19 nt, Homo sapiens
ccuuaaggcuuccagcaua

SEQ ID NO: 516257 - RNA, 19 nt, Homo sapiens
gaacaugcaggguccuauu

SEQ ID NO: 516258 - RNA, 19 nt, Homo sapiens
ugaaagagcacgaggaguu

SEQ ID NO: 516259 - RNA, 19 nt, Homo sapiens
gauggaagaucgccucaag

SEQ ID NO: 516260 - RNA, 19 nt, Homo sapiens
gaagaccggauucaagauu

SEQ ID NO: 516261 - RNA, 19 nt, Homo sapiens
caccagauguggcauguga

SEQ ID NO: 516262 - RNA, 19 nt, Homo sapiens
uagcacaccuggaccuaaa

SEQ ID NO: 516263 - RNA, 19 nt, Homo sapiens
cuacauggcacuuaugaaa

SEQ ID NO: 516264 - RNA, 19 nt, Homo sapiens
ggaaauggagggcaucuuc

SEQ ID NO: 516265 - RNA, 19 nt, Homo sapiens
ggagacccuugcaaauuug

SEQ ID NO: 516266 - RNA, 19 nt, Homo sapiens
aggagacccuugcaaauuu

SEQ ID NO: 516267 - RNA, 19 nt, Homo sapiens
agaagcaaguaccuuuaua

SEQ ID NO: 516268 - RNA, 19 nt, Homo sapiens
gaacggcaucucuuccuuu

SEQ ID NO: 516269 - RNA, 19 nt, Homo sapiens
cagaagaucucacgauugc

SEQ ID NO: 516270 - RNA, 19 nt, Homo sapiens
cacagaagaucucacgauu

SEQ ID NO: 516271 - RNA, 19 nt, Homo sapiens
agacagagcgugacuaugu

SEQ ID NO: 516272 - RNA, 19 nt, Homo sapiens
gagagugaagcuauugaua

SEQ ID NO: 516273 - RNA, 19 nt, Homo sapiens
uagaaggccuuaccaaagu

SEQ ID NO: 516274 - RNA, 19 nt, Homo sapiens
cagacugacuuccuucauu

SEQ ID NO: 516275 - RNA, 19 nt, Homo sapiens
ccaaggaguucgugugcuu

SEQ ID NO: 516276 - RNA, 19 nt, Homo sapiens
guuaagaaaugugaucaga

SEQ ID NO: 516277 - RNA, 19 nt, Homo sapiens
caaaugcugucuucucuuu

SEQ ID NO: 516278 - RNA, 19 nt, Homo sapiens
ggaggagacugugagaauu

SEQ ID NO: 516279 - RNA, 19 nt, Homo sapiens
gaagcugguucacgacaug

SEQ ID NO: 516280 - RNA, 19 nt, Homo sapiens
uggauaggcugacgaagaa

SEQ ID NO: 516281 - RNA, 19 nt, Homo sapiens
auaauaaucccucgaguuu

SEQ ID NO: 516282 - RNA, 19 nt, Homo sapiens
gaucgaaguuuucacauug

SEQ ID NO: 516283 - RNA, 19 nt, Homo sapiens
gagaauuguugcucuggau

SEQ ID NO: 516284 - RNA, 19 nt, Homo sapiens
ggccuuugaucgcgucuuu

SEQ ID NO: 516285 - RNA, 19 nt, Homo sapiens
cacauuggcuguuacaagu

SEQ ID NO: 516286 - RNA, 19 nt, Homo sapiens
gaggagacugugagaauug

SEQ ID NO: 516287 - RNA, 19 nt, Homo sapiens
ggaguacuuuggccagugu

SEQ ID NO: 516288 - RNA, 19 nt, Homo sapiens
gaccagaccgacaggcaua

SEQ ID NO: 516289 - RNA, 19 nt, Homo sapiens
aauaaucccucgaguuuac

SEQ ID NO: 516290 - RNA, 19 nt, Homo sapiens
ccacugcauugaggacuuu

SEQ ID NO: 516291 - RNA, 19 nt, Homo sapiens
uaauaaucccucgaguuua

SEQ ID NO: 516292 - RNA, 19 nt, Homo sapiens
ugucuucucuuucuccaau

SEQ ID NO: 516293 - RNA, 19 nt, Homo sapiens
cagccaccgucaccacuga

SEQ ID NO: 516294 - RNA, 19 nt, Homo sapiens
ggaucgaaguuuucacauu

SEQ ID NO: 516295 - RNA, 19 nt, Homo sapiens
guucccauccuuugauuga

SEQ ID NO: 516296 - RNA, 19 nt, Homo sapiens
ggacgccgagauagacuug

SEQ ID NO: 516297 - RNA, 19 nt, Homo sapiens
gagacugugagaauuguug

SEQ ID NO: 516298 - RNA, 19 nt, Homo sapiens
gcuauaggagccagagaga

SEQ ID NO: 516299 - RNA, 19 nt, Homo sapiens
aauaauaaucccucgaguu

SEQ ID NO: 516300 - RNA, 19 nt, Homo sapiens
ccaccuguaugacuuuguc

SEQ ID NO: 516301 - RNA, 19 nt, Homo sapiens
ucccugacauccaccugua

SEQ ID NO: 516302 - RNA, 19 nt, Homo sapiens
uggccacccuggagaaaug

SEQ ID NO: 516303 - RNA, 19 nt, Homo sapiens
ugacgaagaagcugguuca

SEQ ID NO: 516304 - RNA, 19 nt, Homo sapiens
acuccagccucuuacacua

SEQ ID NO: 516305 - RNA, 19 nt, Homo sapiens
ucacauuggcuguuacaag

SEQ ID NO: 516306 - RNA, 19 nt, Homo sapiens
caguucccauccuuugauu

SEQ ID NO: 516307 - RNA, 19 nt, Homo sapiens
ggucaggaggagacuguga

SEQ ID NO: 516308 - RNA, 19 nt, Homo sapiens
cugcugagucuuccuagaa

SEQ ID NO: 516309 - RNA, 19 nt, Homo sapiens
uugaggacuuucacaggaa

SEQ ID NO: 516310 - RNA, 19 nt, Homo sapiens
cuggauaggcugacgaaga

SEQ ID NO: 516311 - RNA, 19 nt, Homo sapiens
gcucccagcgucucccuau

SEQ ID NO: 516312 - RNA, 19 nt, Homo sapiens
aagccuggacgccgagaua

SEQ ID NO: 516313 - RNA, 19 nt, Homo sapiens
cgagccagauccacugcau

SEQ ID NO: 516314 - RNA, 19 nt, Homo sapiens
ccugcuggguucucaguuc

SEQ ID NO: 516315 - RNA, 19 nt, Homo sapiens
uggagaggagggcauauug

SEQ ID NO: 516316 - RNA, 19 nt, Homo sapiens
accaaaugcugucuucucu

SEQ ID NO: 516317 - RNA, 19 nt, Homo sapiens
gucaccaaaugcugucuuc

SEQ ID NO: 516318 - RNA, 19 nt, Homo sapiens
acauccaccuguaugacuu

SEQ ID NO: 516319 - RNA, 19 nt, Homo sapiens
ggcugcugcucuccucuga

SEQ ID NO: 516320 - RNA, 19 nt, Homo sapiens
cagaggaugagcuggauag

SEQ ID NO: 516321 - RNA, 19 nt, Homo sapiens
aggaggagacugugagaau

SEQ ID NO: 516322 - RNA, 19 nt, Homo sapiens
ggagaggagggcauauugc

SEQ ID NO: 516323 - RNA, 19 nt, Homo sapiens
guggagaggagggcauauu

SEQ ID NO: 516324 - RNA, 19 nt, Homo sapiens
ccaguucccauccuuugau

SEQ ID NO: 516325 - RNA, 19 nt, Homo sapiens
gagccagauccacugcauu

SEQ ID NO: 516326 - RNA, 19 nt, Homo sapiens
cagaccgacaggcauauga

SEQ ID NO: 516327 - RNA, 19 nt, Homo sapiens
caaaguagcuuguauauuc

SEQ ID NO: 516328 - RNA, 19 nt, Homo sapiens
ugaaauaccuguugguuaa

SEQ ID NO: 516329 - RNA, 19 nt, Homo sapiens
gagaagauguuucgaguca

SEQ ID NO: 516330 - RNA, 19 nt, Homo sapiens
ggaauccucugcaggcaua

SEQ ID NO: 516331 - RNA, 19 nt, Homo sapiens
ccagucaucucacagaaua

SEQ ID NO: 516332 - RNA, 19 nt, Homo sapiens
guacauccuuggaaucuuu

SEQ ID NO: 516333 - RNA, 19 nt, Homo sapiens
agaaagggcuaauaaguug

SEQ ID NO: 516334 - RNA, 19 nt, Homo sapiens
gaagauguuucgagucaau

SEQ ID NO: 516335 - RNA, 19 nt, Homo sapiens
uaagaaggcugcaaauaag

SEQ ID NO: 516336 - RNA, 19 nt, Homo sapiens
gaugaaaguccucaaguuu

SEQ ID NO: 516337 - RNA, 19 nt, Homo sapiens
cuaagaaggcugcaaauaa

SEQ ID NO: 516338 - RNA, 19 nt, Homo sapiens
caaaguacauccuuggaau

SEQ ID NO: 516339 - RNA, 19 nt, Homo sapiens
gcaaauaaggccauagcua

SEQ ID NO: 516340 - RNA, 19 nt, Homo sapiens
gcagaccaccugaauauga

SEQ ID NO: 516341 - RNA, 19 nt, Homo sapiens
ggagaaaugacuacggaua

SEQ ID NO: 516342 - RNA, 19 nt, Homo sapiens
uuacagauaccgcuaauaa

SEQ ID NO: 516343 - RNA, 19 nt, Homo sapiens
gacaauugcuaaggucaua

SEQ ID NO: 516344 - RNA, 19 nt, Homo sapiens
ccacucagauagucacaaa

SEQ ID NO: 516345 - RNA, 19 nt, Homo sapiens
ggaagacaauugcuaaggu

SEQ ID NO: 516346 - RNA, 19 nt, Homo sapiens
uaagaaagccaacaagaug

SEQ ID NO: 516347 - RNA, 19 nt, Homo sapiens
gcuaauaaauugcaguagu

SEQ ID NO: 516348 - RNA, 19 nt, Homo sapiens
agaaaugacuacggauaua

SEQ ID NO: 516349 - RNA, 19 nt, Homo sapiens
gcuaauaaguuggugaaau

SEQ ID NO: 516350 - RNA, 19 nt, Homo sapiens
uaaccucuaucaagccuaa

SEQ ID NO: 516351 - RNA, 19 nt, Homo sapiens
ccacugagguaaccaauac

SEQ ID NO: 516352 - RNA, 19 nt, Homo sapiens
uaacuuggcaggcuuuaaa

SEQ ID NO: 516353 - RNA, 19 nt, Homo sapiens
gagucaaucugaaagaaau

SEQ ID NO: 516354 - RNA, 19 nt, Homo sapiens
gagagaaguggcaguaauu

SEQ ID NO: 516355 - RNA, 19 nt, Homo sapiens
caagaaagggcuaauaagu

SEQ ID NO: 516356 - RNA, 19 nt, Homo sapiens
ccaacaagaugaagagagu

SEQ ID NO: 516357 - RNA, 19 nt, Homo sapiens
gguaucagaguuacauuaa

SEQ ID NO: 516358 - RNA, 19 nt, Homo sapiens
gcucaucacagacgaguuu

SEQ ID NO: 516359 - RNA, 19 nt, Homo sapiens
gagaaaugacuacggauau

SEQ ID NO: 516360 - RNA, 19 nt, Homo sapiens
ucugugugcugucauauuu

SEQ ID NO: 516361 - RNA, 19 nt, Homo sapiens
cagcagaccaccugaauau

SEQ ID NO: 516362 - RNA, 19 nt, Homo sapiens
gcuaagaaggcugcaaaua

SEQ ID NO: 516363 - RNA, 19 nt, Homo sapiens
agauaccgcuaauaaauug

SEQ ID NO: 516364 - RNA, 19 nt, Homo sapiens
ccacgagacuagcaagaug

SEQ ID NO: 516365 - RNA, 19 nt, Homo sapiens
gugaaauaccuguugguua

SEQ ID NO: 516366 - RNA, 19 nt, Homo sapiens
caacguaagugcccuugag

SEQ ID NO: 516367 - RNA, 19 nt, Homo sapiens
ccaugaggguggcacuaua

SEQ ID NO: 516368 - RNA, 19 nt, Homo sapiens
ugaugaauauuucccagaa

SEQ ID NO: 516369 - RNA, 19 nt, Homo sapiens
ugagagaaguggcaguaau

SEQ ID NO: 516370 - RNA, 19 nt, Homo sapiens
gcuacacucuggagaagau

SEQ ID NO: 516371 - RNA, 19 nt, Homo sapiens
gaauauucacgcuccaauu

SEQ ID NO: 516372 - RNA, 19 nt, Homo sapiens
caagcugggucuccucaug

SEQ ID NO: 516373 - RNA, 19 nt, Homo sapiens
uacaagaaagggcuaauaa

SEQ ID NO: 516374 - RNA, 19 nt, Homo sapiens
gaugagagaaguggcagua

SEQ ID NO: 516375 - RNA, 19 nt, Homo sapiens
ccaggaagacaauugcuaa

SEQ ID NO: 516376 - RNA, 19 nt, Homo sapiens
ccaaugagacagccaguau

SEQ ID NO: 516377 - RNA, 19 nt, Homo sapiens
cuaauaaauugcaguaguc

SEQ ID NO: 516378 - RNA, 19 nt, Homo sapiens
cagauaccgcuaauaaauu

SEQ ID NO: 516379 - RNA, 19 nt, Homo sapiens
acagauaccgcuaauaaau

SEQ ID NO: 516380 - RNA, 19 nt, Homo sapiens
gcaaaguagcuuguauauu

SEQ ID NO: 516381 - RNA, 19 nt, Homo sapiens
gaaaguccaagcaucugaa

SEQ ID NO: 516382 - RNA, 19 nt, Homo sapiens
ucccuucccuccagauaua

SEQ ID NO: 516383 - RNA, 19 nt, Homo sapiens
gaaaugacuacggauauag

SEQ ID NO: 516384 - RNA, 19 nt, Homo sapiens
gcagggugcagaagaaaga

SEQ ID NO: 516385 - RNA, 19 nt, Homo sapiens
agaugaaaguccucaaguu

SEQ ID NO: 516386 - RNA, 19 nt, Homo sapiens
gaaagauggauaggagaaa

SEQ ID NO: 516387 - RNA, 19 nt, Homo sapiens
gaaagccagacuccaaaug

SEQ ID NO: 516388 - RNA, 19 nt, Homo sapiens
gcugaugcauacccuguug

SEQ ID NO: 516389 - RNA, 19 nt, Homo sapiens
gcagcuaccaggcagauug

SEQ ID NO: 516390 - RNA, 19 nt, Homo sapiens
ucauaaauacugacacuga

SEQ ID NO: 516391 - RNA, 19 nt, Homo sapiens
aagaaagggcuaauaaguu

SEQ ID NO: 516392 - RNA, 19 nt, Homo sapiens
caucaaacgcucagacaug

SEQ ID NO: 516393 - RNA, 19 nt, Homo sapiens
agacugagaccacagaaga

SEQ ID NO: 516394 - RNA, 19 nt, Homo sapiens
gggaggugcugcgcaaguu

SEQ ID NO: 516395 - RNA, 19 nt, Homo sapiens
uugcuaaggucauaaauac

SEQ ID NO: 516396 - RNA, 19 nt, Homo sapiens
gaaccaagaaagccuccaa

SEQ ID NO: 516397 - RNA, 19 nt, Homo sapiens
gcuaaggucauaaauacug

SEQ ID NO: 516398 - RNA, 19 nt, Homo sapiens
ugaaaguccucaaguuugc

SEQ ID NO: 516399 - RNA, 19 nt, Homo sapiens
guuaaggaccagacaaaga

SEQ ID NO: 516400 - RNA, 19 nt, Homo sapiens
aaagauggauaggagaaau

SEQ ID NO: 516401 - RNA, 19 nt, Homo sapiens
ccagauauacagacugaga

SEQ ID NO: 516402 - RNA, 19 nt, Homo sapiens
gcccaaauucugucucuga

SEQ ID NO: 516403 - RNA, 19 nt, Homo sapiens
ccacagaagaggacagugu

SEQ ID NO: 516404 - RNA, 19 nt, Homo sapiens
cuaaggucauaaauacuga

SEQ ID NO: 516405 - RNA, 19 nt, Homo sapiens
ucacugcucagccuaagaa

SEQ ID NO: 516406 - RNA, 19 nt, Homo sapiens
ccaauacucaggcuucuuc

SEQ ID NO: 516407 - RNA, 19 nt, Homo sapiens
gcgaggcaguggagaugga

SEQ ID NO: 516408 - RNA, 19 nt, Homo sapiens
cagacgaguuugugaagca

SEQ ID NO: 516409 - RNA, 19 nt, Homo sapiens
caagcuacacucuggagaa

SEQ ID NO: 516410 - RNA, 19 nt, Homo sapiens
agagaaguggcaguaauua

SEQ ID NO: 516411 - RNA, 19 nt, Homo sapiens
cuaagaaagccaacaagau

SEQ ID NO: 516412 - RNA, 19 nt, Homo sapiens
gagacuagcaagaugaaag

SEQ ID NO: 516413 - RNA, 19 nt, Homo sapiens
cuccagauauacagacuga

SEQ ID NO: 516414 - RNA, 19 nt, Homo sapiens
agacaaagauccccaucaa

SEQ ID NO: 516415 - RNA, 19 nt, Homo sapiens
uuacaagaaagggcuaaua

SEQ ID NO: 516416 - RNA, 19 nt, Homo sapiens
aauauucacgcuccaauug

SEQ ID NO: 516417 - RNA, 19 nt, Homo sapiens
aacaagaugaagagaguua

SEQ ID NO: 516418 - RNA, 19 nt, Homo sapiens
gcuuuaaaccugccaguca

SEQ ID NO: 516419 - RNA, 19 nt, Homo sapiens
aaagaaaccgaaaguccaa

SEQ ID NO: 516420 - RNA, 19 nt, Homo sapiens
aaggccaaauuaccaauga

SEQ ID NO: 516421 - RNA, 19 nt, Homo sapiens
gcacuauacagcugaaguc

SEQ ID NO: 516422 - RNA, 19 nt, Homo sapiens
agaaagcuuccaaggcuaa

SEQ ID NO: 516423 - RNA, 19 nt, Homo sapiens
ccaaugagucagccaguuc

SEQ ID NO: 516424 - RNA, 19 nt, Homo sapiens
gccaaugagucagccaguu

SEQ ID NO: 516425 - RNA, 19 nt, Homo sapiens
uuacucggccucccagaaa

SEQ ID NO: 516426 - RNA, 19 nt, Homo sapiens
cgagucaaucugaaagaaa

SEQ ID NO: 516427 - RNA, 19 nt, Homo sapiens
gaacauaaauugcguagau

SEQ ID NO: 516428 - RNA, 19 nt, Homo sapiens
ggacagauguuacaagauu

SEQ ID NO: 516429 - RNA, 19 nt, Homo sapiens
gagaaaugcuguuaccaua

SEQ ID NO: 516430 - RNA, 19 nt, Homo sapiens
gagcuuaucucccaaggua

SEQ ID NO: 516431 - RNA, 19 nt, Homo sapiens
ugacacaacuguaugauaa

SEQ ID NO: 516432 - RNA, 19 nt, Homo sapiens
ggacuacgguugucagaaa

SEQ ID NO: 516433 - RNA, 19 nt, Homo sapiens
gagaagaacugcaguccuu

SEQ ID NO: 516434 - RNA, 19 nt, Homo sapiens
ggaagucucuuuaaugcaa

SEQ ID NO: 516435 - RNA, 19 nt, Homo sapiens
gaacagcaaagcaaugaua

SEQ ID NO: 516436 - RNA, 19 nt, Homo sapiens
gaagagagaugaaaacuau

SEQ ID NO: 516437 - RNA, 19 nt, Homo sapiens
caagguacuuuccauaauu

SEQ ID NO: 516438 - RNA, 19 nt, Homo sapiens
cgacaagggugacuauuau

SEQ ID NO: 516439 - RNA, 19 nt, Homo sapiens
guaagaagauaaugacugu

SEQ ID NO: 516440 - RNA, 19 nt, Homo sapiens
ucaggugacuugaacauaa

SEQ ID NO: 516441 - RNA, 19 nt, Homo sapiens
gaacuuagugcugauuuaa

SEQ ID NO: 516442 - RNA, 19 nt, Homo sapiens
agaauacgcugaaugagaa

SEQ ID NO: 516443 - RNA, 19 nt, Homo sapiens
caaagacuaucugcuauau

SEQ ID NO: 516444 - RNA, 19 nt, Homo sapiens
gacagcauauuguaagaaa

SEQ ID NO: 516445 - RNA, 19 nt, Homo sapiens
aagacuaucugcuauauga

SEQ ID NO: 516446 - RNA, 19 nt, Homo sapiens
ugacgagccucuugacaaa

SEQ ID NO: 516447 - RNA, 19 nt, Homo sapiens
agaagaaucucguaaucaa

SEQ ID NO: 516448 - RNA, 19 nt, Homo sapiens
ggauguagcuaaaauguuu

SEQ ID NO: 516449 - RNA, 19 nt, Homo sapiens
guaguuaguccacauuuaa

SEQ ID NO: 516450 - RNA, 19 nt, Homo sapiens
gcgacaagggugacuauua

SEQ ID NO: 516451 - RNA, 19 nt, Homo sapiens
ggauacacuugaaauauag

SEQ ID NO: 516452 - RNA, 19 nt, Homo sapiens
cauaaaagcuuucaguuga

SEQ ID NO: 516453 - RNA, 19 nt, Homo sapiens
gagaauacgcugaaugaga

SEQ ID NO: 516454 - RNA, 19 nt, Homo sapiens
ggaucauucuugcugcuua

SEQ ID NO: 516455 - RNA, 19 nt, Homo sapiens
gacagaagaugcaaaguac

SEQ ID NO: 516456 - RNA, 19 nt, Homo sapiens
aaacauaggaagucucuuu

SEQ ID NO: 516457 - RNA, 19 nt, Homo sapiens
gcuuuguucugguauauuu

SEQ ID NO: 516458 - RNA, 19 nt, Homo sapiens
guuaagaggauauuaggua

SEQ ID NO: 516459 - RNA, 19 nt, Homo sapiens
gaucauucuugcugcuuaa

SEQ ID NO: 516460 - RNA, 19 nt, Homo sapiens
gguuucgucuugauauaua

SEQ ID NO: 516461 - RNA, 19 nt, Homo sapiens
cauaggaagucucuuuaau

SEQ ID NO: 516462 - RNA, 19 nt, Homo sapiens
gccaagaucugucaaaauu

SEQ ID NO: 516463 - RNA, 19 nt, Homo sapiens
gauuugcucucauacauca

SEQ ID NO: 516464 - RNA, 19 nt, Homo sapiens
cacaacaaguuucaugauu

SEQ ID NO: 516465 - RNA, 19 nt, Homo sapiens
ugaacuuagugcugauuua

SEQ ID NO: 516466 - RNA, 19 nt, Homo sapiens
auaaagggauguagcuaaa

SEQ ID NO: 516467 - RNA, 19 nt, Homo sapiens
gaaacuaauggaacgaauu

SEQ ID NO: 516468 - RNA, 19 nt, Homo sapiens
caaguuggagugaauguuu

SEQ ID NO: 516469 - RNA, 19 nt, Homo sapiens
guaaguggauuugcucuca

SEQ ID NO: 516470 - RNA, 19 nt, Homo sapiens
gguaacccuuggucuguaa

SEQ ID NO: 516471 - RNA, 19 nt, Homo sapiens
ccaagguacuuuccauaau

SEQ ID NO: 516472 - RNA, 19 nt, Homo sapiens
agacagaagaugcaaagua

SEQ ID NO: 516473 - RNA, 19 nt, Homo sapiens
uuacuugacuuccaugaga

SEQ ID NO: 516474 - RNA, 19 nt, Homo sapiens
gaaugacagcauauuguaa

SEQ ID NO: 516475 - RNA, 19 nt, Homo sapiens
uaaacgaacugcgccaaga

SEQ ID NO: 516476 - RNA, 19 nt, Homo sapiens
ggccagcccuugaaagaau

SEQ ID NO: 516477 - RNA, 19 nt, Homo sapiens
uuacuuggcuuucggacuu

SEQ ID NO: 516478 - RNA, 19 nt, Homo sapiens
uggcuuagcuacuuugaug

SEQ ID NO: 516479 - RNA, 19 nt, Homo sapiens
ucacacaccuuuuaugaaa

SEQ ID NO: 516480 - RNA, 19 nt, Homo sapiens
gaaugauuaugaggaacua

SEQ ID NO: 516481 - RNA, 19 nt, Homo sapiens
ccaaagacuaucugcuaua

SEQ ID NO: 516482 - RNA, 19 nt, Homo sapiens
ugaguugaguugcuucuga

SEQ ID NO: 516483 - RNA, 19 nt, Homo sapiens
cagcauuuauuguuuagga

SEQ ID NO: 516484 - RNA, 19 nt, Homo sapiens
ugugggagcugucauuguu

SEQ ID NO: 516485 - RNA, 19 nt, Homo sapiens
gcaaauguucuaaguuauc

SEQ ID NO: 516486 - RNA, 19 nt, Homo sapiens
gacgcaagcccaccuguaa

SEQ ID NO: 516487 - RNA, 19 nt, Homo sapiens
ugaaugacagcauauugua

SEQ ID NO: 516488 - RNA, 19 nt, Homo sapiens
uguaguuaguccacauuua

SEQ ID NO: 516489 - RNA, 19 nt, Homo sapiens
caccaaagacuaucugcua

SEQ ID NO: 516490 - RNA, 19 nt, Homo sapiens
gcaccugcuuugcuuuguu

SEQ ID NO: 516491 - RNA, 19 nt, Homo sapiens
caggugacuugaacauaaa

SEQ ID NO: 516492 - RNA, 19 nt, Homo sapiens
gacagauguuacaagauuu

SEQ ID NO: 516493 - RNA, 19 nt, Homo sapiens
uaaguuaucuucgucucuu

SEQ ID NO: 516494 - RNA, 19 nt, Homo sapiens
ucaaagugguugcucacaa

SEQ ID NO: 516495 - RNA, 19 nt, Homo sapiens
gauaaugacuguuuugaca

SEQ ID NO: 516496 - RNA, 19 nt, Homo sapiens
gaguuugucucccagucua

SEQ ID NO: 516497 - RNA, 19 nt, Homo sapiens
gcaguuggcugugaaugca

SEQ ID NO: 516498 - RNA, 19 nt, Homo sapiens
gauauacugcagcuucuuu

SEQ ID NO: 516499 - RNA, 19 nt, Homo sapiens
gaacugcgccaagaucugu

SEQ ID NO: 516500 - RNA, 19 nt, Homo sapiens
agacaaagaauggaaguuu

SEQ ID NO: 516501 - RNA, 19 nt, Homo sapiens
gauagcaaaucaugaagac

SEQ ID NO: 516502 - RNA, 19 nt, Homo sapiens
gaagaacugcaguccuuug

SEQ ID NO: 516503 - RNA, 19 nt, Homo sapiens
caggaaugauuaugaggaa

SEQ ID NO: 516504 - RNA, 19 nt, Homo sapiens
cauaaagggauguagcuaa

SEQ ID NO: 516505 - RNA, 19 nt, Homo sapiens
ucacauauaguucagcauu

SEQ ID NO: 516506 - RNA, 19 nt, Homo sapiens
uaaaucauggagcgaauaa

SEQ ID NO: 516507 - RNA, 19 nt, Homo sapiens
ccaaacugcugguggcaau

SEQ ID NO: 516508 - RNA, 19 nt, Homo sapiens
cuuauucuguggauuauug

SEQ ID NO: 516509 - RNA, 19 nt, Homo sapiens
uaacagaggaggauccaau

SEQ ID NO: 516510 - RNA, 19 nt, Homo sapiens
agggaucauugucuaaaua

SEQ ID NO: 516511 - RNA, 19 nt, Homo sapiens
cagguuucgucuugauaua

SEQ ID NO: 516512 - RNA, 19 nt, Homo sapiens
ggagaaaugcuguuaccau

SEQ ID NO: 516513 - RNA, 19 nt, Homo sapiens
cguaacaacuaugaaauuc

SEQ ID NO: 516514 - RNA, 19 nt, Homo sapiens
uauauauucucgcagcauu

SEQ ID NO: 516515 - RNA, 19 nt, Homo sapiens
gagcaucauauuucacauu

SEQ ID NO: 516516 - RNA, 19 nt, Homo sapiens
ucucgugaauuggaaguua

SEQ ID NO: 516517 - RNA, 19 nt, Homo sapiens
gagagcauuugaacuuagu

SEQ ID NO: 516518 - RNA, 19 nt, Homo sapiens
caguccagcucuaauaaug

SEQ ID NO: 516519 - RNA, 19 nt, Homo sapiens
uaggaagucucuuuaaugc

SEQ ID NO: 516520 - RNA, 19 nt, Homo sapiens
cacauauaguucagcauuu

SEQ ID NO: 516521 - RNA, 19 nt, Homo sapiens
guaggcaucuucugugaac

SEQ ID NO: 516522 - RNA, 19 nt, Homo sapiens
uuagaagaaucucguaauc

SEQ ID NO: 516523 - RNA, 19 nt, Homo sapiens
gggaugauuuggucagaca

SEQ ID NO: 516524 - RNA, 19 nt, Homo sapiens
ugacaaacggggauuauua

SEQ ID NO: 516525 - RNA, 19 nt, Homo sapiens
guccagcucuaauaauguu

SEQ ID NO: 516526 - RNA, 19 nt, Homo sapiens
cgaaaugaaauaagggauu

SEQ ID NO: 516527 - RNA, 19 nt, Homo sapiens
gcacaaagcuucauuaagu

SEQ ID NO: 516528 - RNA, 19 nt, Homo sapiens
gaaggaaugugcccuaaua

SEQ ID NO: 516529 - RNA, 19 nt, Homo sapiens
caacugaacugccaacaaa

SEQ ID NO: 516530 - RNA, 19 nt, Homo sapiens
ggacugaaaugcuaauuau

SEQ ID NO: 516531 - RNA, 19 nt, Homo sapiens
uauaguaggugcucaauaa

SEQ ID NO: 516532 - RNA, 19 nt, Homo sapiens
gcucaaauaugaucacaaa

SEQ ID NO: 516533 - RNA, 19 nt, Homo sapiens
ccaagcaacugaggaauua

SEQ ID NO: 516534 - RNA, 19 nt, Homo sapiens
ggaaugauguggucugaau

SEQ ID NO: 516535 - RNA, 19 nt, Homo sapiens
gaccauagcuaucaagugu

SEQ ID NO: 516536 - RNA, 19 nt, Homo sapiens
ggauuuggcuuugacuaua

SEQ ID NO: 516537 - RNA, 19 nt, Homo sapiens
gaauggagaucuggaauca

SEQ ID NO: 516538 - RNA, 19 nt, Homo sapiens
agaaggaguucaagaauga

SEQ ID NO: 516539 - RNA, 19 nt, Homo sapiens
gagaaggaguucaagaaug

SEQ ID NO: 516540 - RNA, 19 nt, Homo sapiens
auaaauggcucccuucuga

SEQ ID NO: 516541 - RNA, 19 nt, Homo sapiens
gaucacaggugucacuuuc

SEQ ID NO: 516542 - RNA, 19 nt, Homo sapiens
gauguggucugaauguaaa

SEQ ID NO: 516543 - RNA, 19 nt, Homo sapiens
ggaaugugcuugacuuugg

SEQ ID NO: 516544 - RNA, 19 nt, Homo sapiens
aaaguuagcucuuaauggu

SEQ ID NO: 516545 - RNA, 19 nt, Homo sapiens
caacgaaggcacaacagua

SEQ ID NO: 516546 - RNA, 19 nt, Homo sapiens
ucaccacgcugcccaauau

SEQ ID NO: 516547 - RNA, 19 nt, Homo sapiens
gaccaugucuuauucaucu

SEQ ID NO: 516548 - RNA, 19 nt, Homo sapiens
gaaagcacaaguagacaaa

SEQ ID NO: 516549 - RNA, 19 nt, Homo sapiens
ucagaaggauauagaaaug

SEQ ID NO: 516550 - RNA, 19 nt, Homo sapiens
ggaugacagugauguagaa

SEQ ID NO: 516551 - RNA, 19 nt, Homo sapiens
aacaguauguggacaguua

SEQ ID NO: 516552 - RNA, 19 nt, Homo sapiens
guacagugccugguauaua

SEQ ID NO: 516553 - RNA, 19 nt, Homo sapiens
ucaaucagccaacacguua

SEQ ID NO: 516554 - RNA, 19 nt, Homo sapiens
ggaaggaccuagggaauac

SEQ ID NO: 516555 - RNA, 19 nt, Homo sapiens
gaauggaaguuugcucguu

SEQ ID NO: 516556 - RNA, 19 nt, Homo sapiens
caaccuaaguacuugaaug

SEQ ID NO: 516557 - RNA, 19 nt, Homo sapiens
gauguagaauggaaguuug

SEQ ID NO: 516558 - RNA, 19 nt, Homo sapiens
ggaccuagggaauacauuu

SEQ ID NO: 516559 - RNA, 19 nt, Homo sapiens
gcccuaauauucuacaguu

SEQ ID NO: 516560 - RNA, 19 nt, Homo sapiens
aaagggcccugacauguga

SEQ ID NO: 516561 - RNA, 19 nt, Homo sapiens
gaaagggcccugacaugug

SEQ ID NO: 516562 - RNA, 19 nt, Homo sapiens
cugcagaucucucuuggaa

SEQ ID NO: 516563 - RNA, 19 nt, Homo sapiens
ugaguuccauccuuuacua

SEQ ID NO: 516564 - RNA, 19 nt, Homo sapiens
acaaaugugggcaauaaua

SEQ ID NO: 516565 - RNA, 19 nt, Homo sapiens
guauuucacuuaugcuaga

SEQ ID NO: 516566 - RNA, 19 nt, Homo sapiens
gcacaaguagacaaagaaa

SEQ ID NO: 516567 - RNA, 19 nt, Homo sapiens
ugacagugauguagaaugg

SEQ ID NO: 516568 - RNA, 19 nt, Homo sapiens
gugucaaacuugccauuaa

SEQ ID NO: 516569 - RNA, 19 nt, Homo sapiens
gagcagaccauagcuauca

SEQ ID NO: 516570 - RNA, 19 nt, Homo sapiens
caaaugugggcaauaauau

SEQ ID NO: 516571 - RNA, 19 nt, Homo sapiens
aaacauuaccuccaccuuu

SEQ ID NO: 516572 - RNA, 19 nt, Homo sapiens
gcaacgguaucgcuagcaa

SEQ ID NO: 516573 - RNA, 19 nt, Homo sapiens
caugcgaauuguuaacuuu

SEQ ID NO: 516574 - RNA, 19 nt, Homo sapiens
gaggaucaaugccuacaag

SEQ ID NO: 516575 - RNA, 19 nt, Homo sapiens
uaacuaccuuuaucaugug

SEQ ID NO: 516576 - RNA, 19 nt, Homo sapiens
gggaauggguaacucaaag

SEQ ID NO: 516577 - RNA, 19 nt, Homo sapiens
guaaaggacauauucaagu

SEQ ID NO: 516578 - RNA, 19 nt, Homo sapiens
ccuaaguacuugaauguca

SEQ ID NO: 516579 - RNA, 19 nt, Homo sapiens
ggucuggguucuuggaaug

SEQ ID NO: 516580 - RNA, 19 nt, Homo sapiens
uacauggacugaaaugcua

SEQ ID NO: 516581 - RNA, 19 nt, Homo sapiens
gcacaugcagcuucuuuca

SEQ ID NO: 516582 - RNA, 19 nt, Homo sapiens
cagcagcucuugacgaucu

SEQ ID NO: 516583 - RNA, 19 nt, Homo sapiens
gaaaagcccaauauuacua

SEQ ID NO: 516584 - RNA, 19 nt, Homo sapiens
caaccuggauuuggcuuug

SEQ ID NO: 516585 - RNA, 19 nt, Homo sapiens
gauacguucuuuauggaau

SEQ ID NO: 516586 - RNA, 19 nt, Homo sapiens
gaucuagcagccaggguua

SEQ ID NO: 516587 - RNA, 19 nt, Homo sapiens
ggaagguaccgaugaguuc

SEQ ID NO: 516588 - RNA, 19 nt, Homo sapiens
uuacuagggucaccaagga

SEQ ID NO: 516589 - RNA, 19 nt, Homo sapiens
gaaggacuguaaaggacau

SEQ ID NO: 516590 - RNA, 19 nt, Homo sapiens
gggaauacauuuugcaguu

SEQ ID NO: 516591 - RNA, 19 nt, Homo sapiens
gcauggguauauggaaauu

SEQ ID NO: 516592 - RNA, 19 nt, Homo sapiens
gguaguguguauuccagaa

SEQ ID NO: 516593 - RNA, 19 nt, Homo sapiens
uacagugccugguauauag

SEQ ID NO: 516594 - RNA, 19 nt, Homo sapiens
ggcauaccauuguguugaa

SEQ ID NO: 516595 - RNA, 19 nt, Homo sapiens
gcauguucauacuuuauuc

SEQ ID NO: 516596 - RNA, 19 nt, Homo sapiens
gagcggaagguaccgauga

SEQ ID NO: 516597 - RNA, 19 nt, Homo sapiens
aguaggugcucaauaaaug

SEQ ID NO: 516598 - RNA, 19 nt, Homo sapiens
gaagacaagagccaagcaa

SEQ ID NO: 516599 - RNA, 19 nt, Homo sapiens
ccguugugcucaaauauga

SEQ ID NO: 516600 - RNA, 19 nt, Homo sapiens
cagggaccaugucuuauuc

SEQ ID NO: 516601 - RNA, 19 nt, Homo sapiens
aagcacaaguagacaaaga

SEQ ID NO: 516602 - RNA, 19 nt, Homo sapiens
caugcuaauugcuaugauu

SEQ ID NO: 516603 - RNA, 19 nt, Homo sapiens
cggaagcucuccaugcaau

SEQ ID NO: 516604 - RNA, 19 nt, Homo sapiens
gauuuggcuuugacuauag

SEQ ID NO: 516605 - RNA, 19 nt, Homo sapiens
guuaugaacuuuuggaaga

SEQ ID NO: 516606 - RNA, 19 nt, Homo sapiens
uuaaaccucuucacucagu

SEQ ID NO: 516607 - RNA, 19 nt, Homo sapiens
ucaacaugcuaauugcuau

SEQ ID NO: 516608 - RNA, 19 nt, Homo sapiens
uuacucaacaugcuaauug

SEQ ID NO: 516609 - RNA, 19 nt, Homo sapiens
ggacauauucaaguucaug

SEQ ID NO: 516610 - RNA, 19 nt, Homo sapiens
ccaagagagugaccucagu

SEQ ID NO: 516611 - RNA, 19 nt, Homo sapiens
uaucaagugucucguugug

SEQ ID NO: 516612 - RNA, 19 nt, Homo sapiens
uagagaaggaguucaagaa

SEQ ID NO: 516613 - RNA, 19 nt, Homo sapiens
caacauagagaaggaguuc

SEQ ID NO: 516614 - RNA, 19 nt, Homo sapiens
cgguaucgcuagcaacuga

SEQ ID NO: 516615 - RNA, 19 nt, Homo sapiens
guugaaaagcccaauauua

SEQ ID NO: 516616 - RNA, 19 nt, Homo sapiens
aguuagcucuuaaugguuu

SEQ ID NO: 516617 - RNA, 19 nt, Homo sapiens
uuaacagcauucucaauca

SEQ ID NO: 516618 - RNA, 19 nt, Homo sapiens
acagugauguagaauggaa

SEQ ID NO: 516619 - RNA, 19 nt, Homo sapiens
guucaugguccucuuuauu

SEQ ID NO: 516620 - RNA, 19 nt, Homo sapiens
ggacuguaaaggacauauu

SEQ ID NO: 516621 - RNA, 19 nt, Homo sapiens
cggcuuaccucucauuguc

SEQ ID NO: 516622 - RNA, 19 nt, Homo sapiens
caaggaaggcauggguaua

SEQ ID NO: 516623 - RNA, 19 nt, Homo sapiens
gcauaccauuguguugaaa

SEQ ID NO: 516624 - RNA, 19 nt, Homo sapiens
aaacuuagugagaaacuga

SEQ ID NO: 516625 - RNA, 19 nt, Homo sapiens
gagccaagcaacugaggaa

SEQ ID NO: 516626 - RNA, 19 nt, Homo sapiens
ucaugguccucuuuauuau

SEQ ID NO: 516627 - RNA, 19 nt, Homo sapiens
gaacuacucuuaagcuuua

SEQ ID NO: 516628 - RNA, 19 nt, Homo sapiens
gaagaaagccagaaaguuu

SEQ ID NO: 516629 - RNA, 19 nt, Homo sapiens
ggacacgguuccuauaaua

SEQ ID NO: 516630 - RNA, 19 nt, Homo sapiens
gcaaauaucucugggaaga

SEQ ID NO: 516631 - RNA, 19 nt, Homo sapiens
ggugacauguuucauaaua

SEQ ID NO: 516632 - RNA, 19 nt, Homo sapiens
gaagcaaacuuuccacaau

SEQ ID NO: 516633 - RNA, 19 nt, Homo sapiens
gaacuggaaaucauucuua

SEQ ID NO: 516634 - RNA, 19 nt, Homo sapiens
uaucagcuguggcauauua

SEQ ID NO: 516635 - RNA, 19 nt, Homo sapiens
gcaaauggccuaaaucaau

SEQ ID NO: 516636 - RNA, 19 nt, Homo sapiens
caaauggccuaaaucaauu

SEQ ID NO: 516637 - RNA, 19 nt, Homo sapiens
cgucugaucucacuguuua

SEQ ID NO: 516638 - RNA, 19 nt, Homo sapiens
gagaagacaucaccaauac

SEQ ID NO: 516639 - RNA, 19 nt, Homo sapiens
ggaggaagcguuuaccaua

SEQ ID NO: 516640 - RNA, 19 nt, Homo sapiens
agaggaagcugaaauuuau

SEQ ID NO: 516641 - RNA, 19 nt, Homo sapiens
gcccgaagauugcaacuuu

SEQ ID NO: 516642 - RNA, 19 nt, Homo sapiens
aaccaaaucuucucuguuu

SEQ ID NO: 516643 - RNA, 19 nt, Homo sapiens
gcaaacaucuucaguucuc

SEQ ID NO: 516644 - RNA, 19 nt, Homo sapiens
ugaauucacuccagacauu

SEQ ID NO: 516645 - RNA, 19 nt, Homo sapiens
gauaagcaguucucugaau

SEQ ID NO: 516646 - RNA, 19 nt, Homo sapiens
gaagaaugcuccuggacau

SEQ ID NO: 516647 - RNA, 19 nt, Homo sapiens
gaacugcucuccucauugc

SEQ ID NO: 516648 - RNA, 19 nt, Homo sapiens
caagaaaucccuagaggaa

SEQ ID NO: 516649 - RNA, 19 nt, Homo sapiens
uauuugggcucaucaauuu

SEQ ID NO: 516650 - RNA, 19 nt, Homo sapiens
gcagaggcuuuauuugcua

SEQ ID NO: 516651 - RNA, 19 nt, Homo sapiens
gaacaaaguggaaaugauc

SEQ ID NO: 516652 - RNA, 19 nt, Homo sapiens
gcucaucgaacuacucuua

SEQ ID NO: 516653 - RNA, 19 nt, Homo sapiens
gaaagagaguguguccauu

SEQ ID NO: 516654 - RNA, 19 nt, Homo sapiens
aagcaaacuuuccacaaua

SEQ ID NO: 516655 - RNA, 19 nt, Homo sapiens
gaacuaaagcaagacauuu

SEQ ID NO: 516656 - RNA, 19 nt, Homo sapiens
ccacacagccuccuauuug

SEQ ID NO: 516657 - RNA, 19 nt, Homo sapiens
uguuggagaugcucuauua

SEQ ID NO: 516658 - RNA, 19 nt, Homo sapiens
ucucacagccuuucaguua

SEQ ID NO: 516659 - RNA, 19 nt, Homo sapiens
gcaugaauuuacugaguuu

SEQ ID NO: 516660 - RNA, 19 nt, Homo sapiens
gcaaaggcauaagauguga

SEQ ID NO: 516661 - RNA, 19 nt, Homo sapiens
gaaauauggcucaguucua

SEQ ID NO: 516662 - RNA, 19 nt, Homo sapiens
gcaacaaucuccuugaaaa

SEQ ID NO: 516663 - RNA, 19 nt, Homo sapiens
cuaauggacuuuguaauga

SEQ ID NO: 516664 - RNA, 19 nt, Homo sapiens
ugaagauggugacauguuu

SEQ ID NO: 516665 - RNA, 19 nt, Homo sapiens
ggagaaacaugcaaaagaa

SEQ ID NO: 516666 - RNA, 19 nt, Homo sapiens
gaccauagagaaaggaaua

SEQ ID NO: 516667 - RNA, 19 nt, Homo sapiens
gaauggaaauuugcacgaa

SEQ ID NO: 516668 - RNA, 19 nt, Homo sapiens
gaagccauuuaucaaguuu

SEQ ID NO: 516669 - RNA, 19 nt, Homo sapiens
ggaagccauuuaucaaguu

SEQ ID NO: 516670 - RNA, 19 nt, Homo sapiens
acaauagucucauagaaga

SEQ ID NO: 516671 - RNA, 19 nt, Homo sapiens
gacauuacaccaaucauuu

SEQ ID NO: 516672 - RNA, 19 nt, Homo sapiens
gcucaucaauuuauaugug

SEQ ID NO: 516673 - RNA, 19 nt, Homo sapiens
caaagcacagcaugaauuu

SEQ ID NO: 516674 - RNA, 19 nt, Homo sapiens
gacgagaaguuccagagaa

SEQ ID NO: 516675 - RNA, 19 nt, Homo sapiens
caugaaauauggcucaguu

SEQ ID NO: 516676 - RNA, 19 nt, Homo sapiens
gaacuuggagcucaucgaa

SEQ ID NO: 516677 - RNA, 19 nt, Homo sapiens
uagaggaagcugaaauuua

SEQ ID NO: 516678 - RNA, 19 nt, Homo sapiens
gcaagacauuucuaguuuc

SEQ ID NO: 516679 - RNA, 19 nt, Homo sapiens
ugacaauagucucauagaa

SEQ ID NO: 516680 - RNA, 19 nt, Homo sapiens
gcugauaacuugagaagac

SEQ ID NO: 516681 - RNA, 19 nt, Homo sapiens
cagcagcaauugccucuga

SEQ ID NO: 516682 - RNA, 19 nt, Homo sapiens
aaauauggcucaguucuau

SEQ ID NO: 516683 - RNA, 19 nt, Homo sapiens
uuaaggaacuaaagcaaga

SEQ ID NO: 516684 - RNA, 19 nt, Homo sapiens
gauggugacauguuucaua

SEQ ID NO: 516685 - RNA, 19 nt, Homo sapiens
gagaaauauucaacuggaa

SEQ ID NO: 516686 - RNA, 19 nt, Homo sapiens
gaacugagcaagguggaaa

SEQ ID NO: 516687 - RNA, 19 nt, Homo sapiens
gcaguucucugaauucacu

SEQ ID NO: 516688 - RNA, 19 nt, Homo sapiens
caaaccaaaucuucucugu

SEQ ID NO: 516689 - RNA, 19 nt, Homo sapiens
ugaagaaacgaaaggguua

SEQ ID NO: 516690 - RNA, 19 nt, Homo sapiens
ccugggaccucugcaaaua

SEQ ID NO: 516691 - RNA, 19 nt, Homo sapiens
uugcagagacgaagaaaua

SEQ ID NO: 516692 - RNA, 19 nt, Homo sapiens
gcuccagacucaacaucua

SEQ ID NO: 516693 - RNA, 19 nt, Homo sapiens
ggaacuaaagcaagacauu

SEQ ID NO: 516694 - RNA, 19 nt, Homo sapiens
ggaaccuggugaagcgaua

SEQ ID NO: 516695 - RNA, 19 nt, Homo sapiens
gaucuaaaccucccagaca

SEQ ID NO: 516696 - RNA, 19 nt, Homo sapiens
agcaagacauuucuaguuu

SEQ ID NO: 516697 - RNA, 19 nt, Homo sapiens
ugagaagacaucaccaaua

SEQ ID NO: 516698 - RNA, 19 nt, Homo sapiens
gcgagcugcugauaacuug

SEQ ID NO: 516699 - RNA, 19 nt, Homo sapiens
cuaaggaccuacuggauca

SEQ ID NO: 516700 - RNA, 19 nt, Homo sapiens
gccagucccucucucauug

SEQ ID NO: 516701 - RNA, 19 nt, Homo sapiens
ggaaagagaguguguccau

SEQ ID NO: 516702 - RNA, 19 nt, Homo sapiens
caacuggaaucucgaggau

SEQ ID NO: 516703 - RNA, 19 nt, Homo sapiens
caggaccacuugagagaaa

SEQ ID NO: 516704 - RNA, 19 nt, Homo sapiens
gauaguaagagcagaauca

SEQ ID NO: 516705 - RNA, 19 nt, Homo sapiens
agacauaacauaagcaaug

SEQ ID NO: 516706 - RNA, 19 nt, Homo sapiens
ucugguaccugaucaaaug

SEQ ID NO: 516707 - RNA, 19 nt, Homo sapiens
uaaaguacagugcccuuaa

SEQ ID NO: 516708 - RNA, 19 nt, Homo sapiens
uagcaacaaucuccuugaa

SEQ ID NO: 516709 - RNA, 19 nt, Homo sapiens
gccauuaaguaccgucaaa

SEQ ID NO: 516710 - RNA, 19 nt, Homo sapiens
gaugcucuauuacaugcua

SEQ ID NO: 516711 - RNA, 19 nt, Homo sapiens
caaaggagaaacaugcaaa

SEQ ID NO: 516712 - RNA, 19 nt, Homo sapiens
ucaaagcacagcaugaauu

SEQ ID NO: 516713 - RNA, 19 nt, Homo sapiens
gguggaaucuaauggacuu

SEQ ID NO: 516714 - RNA, 19 nt, Homo sapiens
gaggaagcguuuaccauac

SEQ ID NO: 516715 - RNA, 19 nt, Homo sapiens
gagaguguguccauucaag

SEQ ID NO: 516716 - RNA, 19 nt, Homo sapiens
ugagagaaauauucaacug

SEQ ID NO: 516717 - RNA, 19 nt, Homo sapiens
gcaauugccucugaaagac

SEQ ID NO: 516718 - RNA, 19 nt, Homo sapiens
gaaguccugggauuacuaa

SEQ ID NO: 516719 - RNA, 19 nt, Homo sapiens
gagaagaaagccagaaagu

SEQ ID NO: 516720 - RNA, 19 nt, Homo sapiens
ggaaucuaauggacuuugu

SEQ ID NO: 516721 - RNA, 19 nt, Homo sapiens
ucuauuacaugcuaucaga

SEQ ID NO: 516722 - RNA, 19 nt, Homo sapiens
aagaaggccugaccgaaga

SEQ ID NO: 516723 - RNA, 19 nt, Homo sapiens
gaagacaucaccaauacca

SEQ ID NO: 516724 - RNA, 19 nt, Homo sapiens
cagcaugaauuuacugagu

SEQ ID NO: 516725 - RNA, 19 nt, Homo sapiens
gaagaaacgaaaggguuaa

SEQ ID NO: 516726 - RNA, 19 nt, Homo sapiens
gggagaaauuaaacagaug

SEQ ID NO: 516727 - RNA, 19 nt, Homo sapiens
gaucauaucugaagugguu

SEQ ID NO: 516728 - RNA, 19 nt, Homo sapiens
gcacaaagguuuccucagu

SEQ ID NO: 516729 - RNA, 19 nt, Homo sapiens
ggacaucacucccaucaug

SEQ ID NO: 516730 - RNA, 19 nt, Homo sapiens
gcagaggccuguucucaaa

SEQ ID NO: 516731 - RNA, 19 nt, Homo sapiens
ggacagaccuucauguaca

SEQ ID NO: 516732 - RNA, 19 nt, Homo sapiens
gaaacugggucuccuauuc

SEQ ID NO: 516733 - RNA, 19 nt, Homo sapiens
gagcgugccuccuugauuu

SEQ ID NO: 516734 - RNA, 19 nt, Homo sapiens
gaggagggccgaucuguua

SEQ ID NO: 516735 - RNA, 19 nt, Homo sapiens
gguggaaccugauggauuu

SEQ ID NO: 516736 - RNA, 19 nt, Homo sapiens
gagccaauguacacaauuu

SEQ ID NO: 516737 - RNA, 19 nt, Homo sapiens
gcugagaucuacuauaaug

SEQ ID NO: 516738 - RNA, 19 nt, Homo sapiens
gaacaacuccuaucagcuu

SEQ ID NO: 516739 - RNA, 19 nt, Homo sapiens
acagaaaccucuaguguga

SEQ ID NO: 516740 - RNA, 19 nt, Homo sapiens
gggagaggcuugugacuug

SEQ ID NO: 516741 - RNA, 19 nt, Homo sapiens
gcauauugcugaaguguca

SEQ ID NO: 516742 - RNA, 19 nt, Homo sapiens
aggcugagaucuacuauaa

SEQ ID NO: 516743 - RNA, 19 nt, Homo sapiens
caaauaugccuccaaacua

SEQ ID NO: 516744 - RNA, 19 nt, Homo sapiens
uaacaacccuaguggauuc

SEQ ID NO: 516745 - RNA, 19 nt, Homo sapiens
ggguauaaguggcuuguuu

SEQ ID NO: 516746 - RNA, 19 nt, Homo sapiens
ggacaggaagaacaaguua

SEQ ID NO: 516747 - RNA, 19 nt, Homo sapiens
gaaguuaucaggaauuuag

SEQ ID NO: 516748 - RNA, 19 nt, Homo sapiens
gcaguucucugaauucaca

SEQ ID NO: 516749 - RNA, 19 nt, Homo sapiens
ggcaagagguuguccgaaa

SEQ ID NO: 516750 - RNA, 19 nt, Homo sapiens
caagacaucuccagcuuuc

SEQ ID NO: 516751 - RNA, 19 nt, Homo sapiens
uauuugaccuuccucuuua

SEQ ID NO: 516752 - RNA, 19 nt, Homo sapiens
ggacagaaaccucuagugu

SEQ ID NO: 516753 - RNA, 19 nt, Homo sapiens
gacauuuaaucacagguua

SEQ ID NO: 516754 - RNA, 19 nt, Homo sapiens
gauaaaagccugaauuuga

SEQ ID NO: 516755 - RNA, 19 nt, Homo sapiens
ggacgcaugcugcuugaua

SEQ ID NO: 516756 - RNA, 19 nt, Homo sapiens
gcaacuauuucccugaaga

SEQ ID NO: 516757 - RNA, 19 nt, Homo sapiens
gaauaaagccucauaucca

SEQ ID NO: 516758 - RNA, 19 nt, Homo sapiens
aaagauauguggcugcuau

SEQ ID NO: 516759 - RNA, 19 nt, Homo sapiens
ggacgaagcucuggaugag

SEQ ID NO: 516760 - RNA, 19 nt, Homo sapiens
gaugguggauuuacugaau

SEQ ID NO: 516761 - RNA, 19 nt, Homo sapiens
gauauugccuuggguucua

SEQ ID NO: 516762 - RNA, 19 nt, Homo sapiens
ucagcaagguggagaauga

SEQ ID NO: 516763 - RNA, 19 nt, Homo sapiens
caauaggaauccauuuaga

SEQ ID NO: 516764 - RNA, 19 nt, Homo sapiens
ccacuuugcuggucuuguu

SEQ ID NO: 516765 - RNA, 19 nt, Homo sapiens
cuaaucaucuguucuggaa

SEQ ID NO: 516766 - RNA, 19 nt, Homo sapiens
ucaaauaccaccagaaaga

SEQ ID NO: 516767 - RNA, 19 nt, Homo sapiens
ccacacagcauccuauuug

SEQ ID NO: 516768 - RNA, 19 nt, Homo sapiens
caagaaacccuuuaucaag

SEQ ID NO: 516769 - RNA, 19 nt, Homo sapiens
uaagagaaaugaggaacuu

SEQ ID NO: 516770 - RNA, 19 nt, Homo sapiens
acaaagguuuccucaguuu

SEQ ID NO: 516771 - RNA, 19 nt, Homo sapiens
gcaaauaugccuccaaacu

SEQ ID NO: 516772 - RNA, 19 nt, Homo sapiens
gcaguggaauugcaugugu

SEQ ID NO: 516773 - RNA, 19 nt, Homo sapiens
ccaaggagcuuuuccacua

SEQ ID NO: 516774 - RNA, 19 nt, Homo sapiens
ucucagaggugacacagaa

SEQ ID NO: 516775 - RNA, 19 nt, Homo sapiens
guacacaauuucugaugga

SEQ ID NO: 516776 - RNA, 19 nt, Homo sapiens
gcucaggauuucugcauug

SEQ ID NO: 516777 - RNA, 19 nt, Homo sapiens
ccaagaaagcuacauuuau

SEQ ID NO: 516778 - RNA, 19 nt, Homo sapiens
auaaguggcuuguuucguu

SEQ ID NO: 516779 - RNA, 19 nt, Homo sapiens
gagagacgauaauaaugau

SEQ ID NO: 516780 - RNA, 19 nt, Homo sapiens
guaugugggugaugcauug

SEQ ID NO: 516781 - RNA, 19 nt, Homo sapiens
ccacuuggcucaggauuuc

SEQ ID NO: 516782 - RNA, 19 nt, Homo sapiens
gacaucagauauucucaga

SEQ ID NO: 516783 - RNA, 19 nt, Homo sapiens
auauguggcugcuaugaua

SEQ ID NO: 516784 - RNA, 19 nt, Homo sapiens
uggccuaugucaaguauaa

SEQ ID NO: 516785 - RNA, 19 nt, Homo sapiens
aagaguaccucaucagaau

SEQ ID NO: 516786 - RNA, 19 nt, Homo sapiens
ccaaagggaggaauaaaga

SEQ ID NO: 516787 - RNA, 19 nt, Homo sapiens
ggacauugguagagcaaag

SEQ ID NO: 516788 - RNA, 19 nt, Homo sapiens
aaauaugccuccaaacuag

SEQ ID NO: 516789 - RNA, 19 nt, Homo sapiens
ucuaacauaugaccugaaa

SEQ ID NO: 516790 - RNA, 19 nt, Homo sapiens
aauggcaacuuuagguaua

SEQ ID NO: 516791 - RNA, 19 nt, Homo sapiens
gaggauguauuugaaacuu

SEQ ID NO: 516792 - RNA, 19 nt, Homo sapiens
uaauuuaggcugcaagaaa

SEQ ID NO: 516793 - RNA, 19 nt, Homo sapiens
gcaacuguguggagugugu

SEQ ID NO: 516794 - RNA, 19 nt, Homo sapiens
agaaaccucuagugugaaa

SEQ ID NO: 516795 - RNA, 19 nt, Homo sapiens
cuacauuccuaacucauau

SEQ ID NO: 516796 - RNA, 19 nt, Homo sapiens
cauaugaccugaaacaacu

SEQ ID NO: 516797 - RNA, 19 nt, Homo sapiens
uaacauaugaccugaaaca

SEQ ID NO: 516798 - RNA, 19 nt, Homo sapiens
gaauacagugguucaaguu

SEQ ID NO: 516799 - RNA, 19 nt, Homo sapiens
aaacuacccugcccaucuu

SEQ ID NO: 516800 - RNA, 19 nt, Homo sapiens
gauaucgaguggaaguuug

SEQ ID NO: 516801 - RNA, 19 nt, Homo sapiens
gaaugcggcucucucucuu

SEQ ID NO: 516802 - RNA, 19 nt, Homo sapiens
auacagugguucaaguuaa

SEQ ID NO: 516803 - RNA, 19 nt, Homo sapiens
ucagagagacgauaauaau

SEQ ID NO: 516804 - RNA, 19 nt, Homo sapiens
ggaauuaaagcaagacauc

SEQ ID NO: 516805 - RNA, 19 nt, Homo sapiens
cagcuuuacuucuauuaug

SEQ ID NO: 516806 - RNA, 19 nt, Homo sapiens
ucaagaaacccuuuaucaa

SEQ ID NO: 516807 - RNA, 19 nt, Homo sapiens
cuacuacacucuaaccaau

SEQ ID NO: 516808 - RNA, 19 nt, Homo sapiens
caacucgccucuaagucaa

SEQ ID NO: 516809 - RNA, 19 nt, Homo sapiens
gaagguggcaaucaaauac

SEQ ID NO: 516810 - RNA, 19 nt, Homo sapiens
ucaaggagcucagcaaggu

SEQ ID NO: 516811 - RNA, 19 nt, Homo sapiens
caacaacuacgaaaucauc

SEQ ID NO: 516812 - RNA, 19 nt, Homo sapiens
acacgcaguucucugaauu

SEQ ID NO: 516813 - RNA, 19 nt, Homo sapiens
caggauuucugcauugcua

SEQ ID NO: 516814 - RNA, 19 nt, Homo sapiens
gaagaauaaagccucauau

SEQ ID NO: 516815 - RNA, 19 nt, Homo sapiens
uaagugugguuucuguuau

SEQ ID NO: 516816 - RNA, 19 nt, Homo sapiens
aagggaggcugaagagauu

SEQ ID NO: 516817 - RNA, 19 nt, Homo sapiens
gaggugacacagaauauga

SEQ ID NO: 516818 - RNA, 19 nt, Homo sapiens
caacuccuaucagcuuauu

SEQ ID NO: 516819 - RNA, 19 nt, Homo sapiens
aagaaacccuuuaucaagu

SEQ ID NO: 516820 - RNA, 19 nt, Homo sapiens
ucaaauugcuuguccaaaa

SEQ ID NO: 516821 - RNA, 19 nt, Homo sapiens
caacuacgaaaucaucaaa

SEQ ID NO: 516822 - RNA, 19 nt, Homo sapiens
ggucugaguccuagagauu

SEQ ID NO: 516823 - RNA, 19 nt, Homo sapiens
cacuacaucucauacauug

SEQ ID NO: 516824 - RNA, 19 nt, Homo sapiens
ccgcagagcugagggaugu

SEQ ID NO: 516825 - RNA, 19 nt, Homo sapiens
gcaagacaucuccagcuuu

SEQ ID NO: 516826 - RNA, 19 nt, Homo sapiens
ugaacaugcugauugcuau

SEQ ID NO: 516827 - RNA, 19 nt, Homo sapiens
gaaugcagcugacagauuu

SEQ ID NO: 516828 - RNA, 19 nt, Homo sapiens
gauaugggcugaauguaaa

SEQ ID NO: 516829 - RNA, 19 nt, Homo sapiens
uaaaguacuugcccuauuu

SEQ ID NO: 516830 - RNA, 19 nt, Homo sapiens
agaaagaguucaagaauga

SEQ ID NO: 516831 - RNA, 19 nt, Homo sapiens
gguaaaggcuguagauaau

SEQ ID NO: 516832 - RNA, 19 nt, Homo sapiens
gcacaaaacuccuuccuaa

SEQ ID NO: 516833 - RNA, 19 nt, Homo sapiens
gagacaaugugaaauacua

SEQ ID NO: 516834 - RNA, 19 nt, Homo sapiens
uagcagaacuuauuagaga

SEQ ID NO: 516835 - RNA, 19 nt, Homo sapiens
gcuaugaacuccuugaaga

SEQ ID NO: 516836 - RNA, 19 nt, Homo sapiens
cagcauacauguuuaguga

SEQ ID NO: 516837 - RNA, 19 nt, Homo sapiens
gaaguggugucuuaaacaa

SEQ ID NO: 516838 - RNA, 19 nt, Homo sapiens
ggauggagaugcucauuau

SEQ ID NO: 516839 - RNA, 19 nt, Homo sapiens
caugugaaguggugucuua

SEQ ID NO: 516840 - RNA, 19 nt, Homo sapiens
gagaaagaguucaagaaug

SEQ ID NO: 516841 - RNA, 19 nt, Homo sapiens
ggauauaacuaacucuugu

SEQ ID NO: 516842 - RNA, 19 nt, Homo sapiens
ggacacgguucucccauga

SEQ ID NO: 516843 - RNA, 19 nt, Homo sapiens
ggaccagcauacauguuua

SEQ ID NO: 516844 - RNA, 19 nt, Homo sapiens
uaaaggcuguagauaauga

SEQ ID NO: 516845 - RNA, 19 nt, Homo sapiens
gaacugcuacuuccaauuc

SEQ ID NO: 516846 - RNA, 19 nt, Homo sapiens
guaaagaaaucuggacuca

SEQ ID NO: 516847 - RNA, 19 nt, Homo sapiens
gaagaacagucaaagacau

SEQ ID NO: 516848 - RNA, 19 nt, Homo sapiens
gcagauaucacuuggaaga

SEQ ID NO: 516849 - RNA, 19 nt, Homo sapiens
guucaagaaugacuacaaa

SEQ ID NO: 516850 - RNA, 19 nt, Homo sapiens
ggaaccaaaucaagaggaa

SEQ ID NO: 516851 - RNA, 19 nt, Homo sapiens
gaaaaccucucucgaguug

SEQ ID NO: 516852 - RNA, 19 nt, Homo sapiens
guacuugcccuauuuaguu

SEQ ID NO: 516853 - RNA, 19 nt, Homo sapiens
ccaggaagaugcagagaug

SEQ ID NO: 516854 - RNA, 19 nt, Homo sapiens
gcagagaugaacaagauaa

SEQ ID NO: 516855 - RNA, 19 nt, Homo sapiens
ccaaaucucagccguuuaa

SEQ ID NO: 516856 - RNA, 19 nt, Homo sapiens
gcaaaucuuuaacuucauc

SEQ ID NO: 516857 - RNA, 19 nt, Homo sapiens
gaacuuggagagaaauuau

SEQ ID NO: 516858 - RNA, 19 nt, Homo sapiens
gauguggaguggaaauuug

SEQ ID NO: 516859 - RNA, 19 nt, Homo sapiens
gcccaaaucucagccguuu

SEQ ID NO: 516860 - RNA, 19 nt, Homo sapiens
ugauuaaacuccauuguuc

SEQ ID NO: 516861 - RNA, 19 nt, Homo sapiens
caacuucucuccauuuggu

SEQ ID NO: 516862 - RNA, 19 nt, Homo sapiens
cagaaacacugaagaaguc

SEQ ID NO: 516863 - RNA, 19 nt, Homo sapiens
ggguaaaggcuguagauaa

SEQ ID NO: 516864 - RNA, 19 nt, Homo sapiens
auaaggagcucagaagauu

SEQ ID NO: 516865 - RNA, 19 nt, Homo sapiens
caucaacuauaaccacaaa

SEQ ID NO: 516866 - RNA, 19 nt, Homo sapiens
gcauacauguuuagugauc

SEQ ID NO: 516867 - RNA, 19 nt, Homo sapiens
agaggaugcuggacauuaa

SEQ ID NO: 516868 - RNA, 19 nt, Homo sapiens
acacagacauaaaguacuu

SEQ ID NO: 516869 - RNA, 19 nt, Homo sapiens
gagaugaacaagauaaaug

SEQ ID NO: 516870 - RNA, 19 nt, Homo sapiens
gagcaucauugacgcaaau

SEQ ID NO: 516871 - RNA, 19 nt, Homo sapiens
ccaagagguuguuguuguu

SEQ ID NO: 516872 - RNA, 19 nt, Homo sapiens
uaaacugcuuucuuggaua

SEQ ID NO: 516873 - RNA, 19 nt, Homo sapiens
caugacggcuuuagaacuu

SEQ ID NO: 516874 - RNA, 19 nt, Homo sapiens
aaacauugguuacguucuu

SEQ ID NO: 516875 - RNA, 19 nt, Homo sapiens
gaaggucuuuaugcaauug

SEQ ID NO: 516876 - RNA, 19 nt, Homo sapiens
ccaggaauaugaaauugug

SEQ ID NO: 516877 - RNA, 19 nt, Homo sapiens
ccaaugagcaucuggaaau

SEQ ID NO: 516878 - RNA, 19 nt, Homo sapiens
gaagaaugccacucacuca

SEQ ID NO: 516879 - RNA, 19 nt, Homo sapiens
gggagaagguuagcuaauc

SEQ ID NO: 516880 - RNA, 19 nt, Homo sapiens
guuguuugguuccauuaua

SEQ ID NO: 516881 - RNA, 19 nt, Homo sapiens
ugaaaucaguggucaucaa

SEQ ID NO: 516882 - RNA, 19 nt, Homo sapiens
gaaaccagcacagauaaug

SEQ ID NO: 516883 - RNA, 19 nt, Homo sapiens
gcggaagggugcuaggauu

SEQ ID NO: 516884 - RNA, 19 nt, Homo sapiens
ggaugcagcugaauauggu

SEQ ID NO: 516885 - RNA, 19 nt, Homo sapiens
ggaaaccaauagauaaugc

SEQ ID NO: 516886 - RNA, 19 nt, Homo sapiens
gaagaccuagcagaacuua

SEQ ID NO: 516887 - RNA, 19 nt, Homo sapiens
gggcagaacacuuccugua

SEQ ID NO: 516888 - RNA, 19 nt, Homo sapiens
gcagaaacacugaagaagu

SEQ ID NO: 516889 - RNA, 19 nt, Homo sapiens
ugaacggccucaugauuau

SEQ ID NO: 516890 - RNA, 19 nt, Homo sapiens
gaagggugcuaggauugaa

SEQ ID NO: 516891 - RNA, 19 nt, Homo sapiens
ggaagauguuagaagaaug

SEQ ID NO: 516892 - RNA, 19 nt, Homo sapiens
aaacugcuuucuuggauau

SEQ ID NO: 516893 - RNA, 19 nt, Homo sapiens
gaacuuauuagagaacuug

SEQ ID NO: 516894 - RNA, 19 nt, Homo sapiens
aaucaguggucaucaacua

SEQ ID NO: 516895 - RNA, 19 nt, Homo sapiens
caucauucauugcgagauu

SEQ ID NO: 516896 - RNA, 19 nt, Homo sapiens
uaaagguuauguucggauu

SEQ ID NO: 516897 - RNA, 19 nt, Homo sapiens
gcuucuagcuauuaguaaa

SEQ ID NO: 516898 - RNA, 19 nt, Homo sapiens
uagagaacuuggagagaaa

SEQ ID NO: 516899 - RNA, 19 nt, Homo sapiens
caauaauccuccaagacaa

SEQ ID NO: 516900 - RNA, 19 nt, Homo sapiens
acagaagcaugacucguuu

SEQ ID NO: 516901 - RNA, 19 nt, Homo sapiens
auaacuaacucuugugaug

SEQ ID NO: 516902 - RNA, 19 nt, Homo sapiens
gagagaaauuauccaugga

SEQ ID NO: 516903 - RNA, 19 nt, Homo sapiens
uuagagaacuuggagagaa

SEQ ID NO: 516904 - RNA, 19 nt, Homo sapiens
uaaggagagugaugaagug

SEQ ID NO: 516905 - RNA, 19 nt, Homo sapiens
ugaaaaggcucauuaaaag

SEQ ID NO: 516906 - RNA, 19 nt, Homo sapiens
uguggaacaugcuugauuu

SEQ ID NO: 516907 - RNA, 19 nt, Homo sapiens
gcugagggcuggagagucu

SEQ ID NO: 516908 - RNA, 19 nt, Homo sapiens
gcagccuccuucaccauuu

SEQ ID NO: 516909 - RNA, 19 nt, Homo sapiens
ggauugaacggccucauga

SEQ ID NO: 516910 - RNA, 19 nt, Homo sapiens
caaagaccauuggcauuca

SEQ ID NO: 516911 - RNA, 19 nt, Homo sapiens
ggagagugaugaagugaac

SEQ ID NO: 516912 - RNA, 19 nt, Homo sapiens
cacaauaaacaaccaagua

SEQ ID NO: 516913 - RNA, 19 nt, Homo sapiens
ucaaguucauggucauauu

SEQ ID NO: 516914 - RNA, 19 nt, Homo sapiens
gaaaacauccugcuucuca

SEQ ID NO: 516915 - RNA, 19 nt, Homo sapiens
caaaacuccuuccuaauga

SEQ ID NO: 516916 - RNA, 19 nt, Homo sapiens
gcaacgagagccaggacua

SEQ ID NO: 516917 - RNA, 19 nt, Homo sapiens
gccacucacucaacguuaa

SEQ ID NO: 516918 - RNA, 19 nt, Homo sapiens
agaggaaaccaauagauaa

SEQ ID NO: 516919 - RNA, 19 nt, Homo sapiens
aagaggaaaccaauagaua

SEQ ID NO: 516920 - RNA, 19 nt, Homo sapiens
gaccuagcagaacuuauua

SEQ ID NO: 516921 - RNA, 19 nt, Homo sapiens
ucucaagucuccgcuauga

SEQ ID NO: 516922 - RNA, 19 nt, Homo sapiens
gauaucacuuggaagaaca

SEQ ID NO: 516923 - RNA, 19 nt, Homo sapiens
gaaucuuucugguuuacga

SEQ ID NO: 516924 - RNA, 19 nt, Homo sapiens
caaugagcaucuggaaauu

SEQ ID NO: 516925 - RNA, 19 nt, Homo sapiens
ucaauaauccuccaagaca

SEQ ID NO: 516926 - RNA, 19 nt, Homo sapiens
guucugggcuauauuugga

SEQ ID NO: 516927 - RNA, 19 nt, Homo sapiens
gccaagaacuucaacauga

SEQ ID NO: 516928 - RNA, 19 nt, Homo sapiens
gaagaaagaaugcguguau

SEQ ID NO: 516929 - RNA, 19 nt, Homo sapiens
ugaacaggcugaacucuaa

SEQ ID NO: 516930 - RNA, 19 nt, Homo sapiens
gcagugagaucuucaugga

SEQ ID NO: 516931 - RNA, 19 nt, Homo sapiens
agaacaagcuggagaagaa

SEQ ID NO: 516932 - RNA, 19 nt, Homo sapiens
uaaagaagaugcuggaagu

SEQ ID NO: 516933 - RNA, 19 nt, Homo sapiens
ugaaggaacuguccaagga

SEQ ID NO: 516934 - RNA, 19 nt, Homo sapiens
gaacaucagccucaucuuc

SEQ ID NO: 516935 - RNA, 19 nt, Homo sapiens
acaagcagcucaagaacaa

SEQ ID NO: 516936 - RNA, 19 nt, Homo sapiens
gcaggaagagcauaaagaa

SEQ ID NO: 516937 - RNA, 19 nt, Homo sapiens
ccaaggacaugaaguuugu

SEQ ID NO: 516938 - RNA, 19 nt, Homo sapiens
ggacgaggcugcagaagcu

SEQ ID NO: 516939 - RNA, 19 nt, Homo sapiens
ggaagagcauaaagaagau

SEQ ID NO: 516940 - RNA, 19 nt, Homo sapiens
gcagaggccuggucaaggu

SEQ ID NO: 516941 - RNA, 19 nt, Homo sapiens
cauuaaaucugccaucuca

SEQ ID NO: 516942 - RNA, 19 nt, Homo sapiens
guacaaaggcuacauggau

SEQ ID NO: 516943 - RNA, 19 nt, Homo sapiens
gaugagggcuucacaugag

SEQ ID NO: 516944 - RNA, 19 nt, Homo sapiens
gcauggagguguacaaagg

SEQ ID NO: 516945 - RNA, 19 nt, Homo sapiens
ggagccaucugcaggaaga

SEQ ID NO: 516946 - RNA, 19 nt, Homo sapiens
ggacgucggcgcaaucuug

SEQ ID NO: 516947 - RNA, 19 nt, Homo sapiens
gaacauccucuccuacuuc

SEQ ID NO: 516948 - RNA, 19 nt, Homo sapiens
caaccacucucacuucauc

SEQ ID NO: 516949 - RNA, 19 nt, Homo sapiens
agaagaggcugcaggaugu

SEQ ID NO: 516950 - RNA, 19 nt, Homo sapiens
agacggaguuccugaucua

SEQ ID NO: 516951 - RNA, 19 nt, Homo sapiens
gcccaggccugucaagaga

SEQ ID NO: 516952 - RNA, 19 nt, Homo sapiens
ucagugacuucuggaauaa

SEQ ID NO: 516953 - RNA, 19 nt, Homo sapiens
guacaggagcccagacaaa

SEQ ID NO: 516954 - RNA, 19 nt, Homo sapiens
ggacaucagcaauaagguu

SEQ ID NO: 516955 - RNA, 19 nt, Homo sapiens
agaaagaaugcguguauuu

SEQ ID NO: 516956 - RNA, 19 nt, Homo sapiens
acaagacccuccuccagaa

SEQ ID NO: 516957 - RNA, 19 nt, Homo sapiens
cggaguuccugaucuauga

SEQ ID NO: 516958 - RNA, 19 nt, Homo sapiens
gaagagagagcccagaaac

SEQ ID NO: 516959 - RNA, 19 nt, Homo sapiens
caagaaagccucaguucgu

SEQ ID NO: 516960 - RNA, 19 nt, Homo sapiens
ucgaggacaucagcaauaa

SEQ ID NO: 516961 - RNA, 19 nt, Homo sapiens
ugucugaacuccugacugu

SEQ ID NO: 516962 - RNA, 19 nt, Homo sapiens
ucacgcagcugggaacaug

SEQ ID NO: 516963 - RNA, 19 nt, Homo sapiens
ucaagagggugguccugaa

SEQ ID NO: 516964 - RNA, 19 nt, Homo sapiens
ugaagcggaugaugaagga

SEQ ID NO: 516965 - RNA, 19 nt, Homo sapiens
gggugcagcugaaggaguu

SEQ ID NO: 516966 - RNA, 19 nt, Homo sapiens
ucagcucccugucuucauu

SEQ ID NO: 516967 - RNA, 19 nt, Homo sapiens
ggcccaagaucaucauugu

SEQ ID NO: 516968 - RNA, 19 nt, Homo sapiens
cagcugcacucaucuccaa

SEQ ID NO: 516969 - RNA, 19 nt, Homo sapiens
gaggagguguggccaucaa

SEQ ID NO: 516970 - RNA, 19 nt, Homo sapiens
gagcagcagcuacaaggaa

SEQ ID NO: 516971 - RNA, 19 nt, Homo sapiens
ggaugagggcuucacauga

SEQ ID NO: 516972 - RNA, 19 nt, Homo sapiens
agaaugacguggagcugaa

SEQ ID NO: 516973 - RNA, 19 nt, Homo sapiens
ggaggaguaugagcacaga

SEQ ID NO: 516974 - RNA, 19 nt, Homo sapiens
gaaagaaugcguguauuuu

SEQ ID NO: 516975 - RNA, 19 nt, Homo sapiens
gcaacaaugacaagcaaga

SEQ ID NO: 516976 - RNA, 19 nt, Homo sapiens
gaucuaugacccacccuuu

SEQ ID NO: 516977 - RNA, 19 nt, Homo sapiens
acaccuugcucuaccugua

SEQ ID NO: 516978 - RNA, 19 nt, Homo sapiens
uuugagaccuucacggaaa

SEQ ID NO: 516979 - RNA, 19 nt, Homo sapiens
ccaagaucaucauugugaa

SEQ ID NO: 516980 - RNA, 19 nt, Homo sapiens
uucagugacuucuggaaua

SEQ ID NO: 516981 - RNA, 19 nt, Homo sapiens
ugcggcagcucuucuauga

SEQ ID NO: 516982 - RNA, 19 nt, Homo sapiens
agaaacauguccaggagau

SEQ ID NO: 516983 - RNA, 19 nt, Homo sapiens
aggaagagcauaaagaaga

SEQ ID NO: 516984 - RNA, 19 nt, Homo sapiens
gagcacacggaccagauuu

SEQ ID NO: 516985 - RNA, 19 nt, Homo sapiens
gacauuaaaucugccaucu

SEQ ID NO: 516986 - RNA, 19 nt, Homo sapiens
gaacaugugcaggcugaug

SEQ ID NO: 516987 - RNA, 19 nt, Homo sapiens
acaggagcgugaaccauga

SEQ ID NO: 516988 - RNA, 19 nt, Homo sapiens
agaucuaccugaaggagaa

SEQ ID NO: 516989 - RNA, 19 nt, Homo sapiens
ccugggagaucuaccugaa

SEQ ID NO: 516990 - RNA, 19 nt, Homo sapiens
cccaagaucaucauuguga

SEQ ID NO: 516991 - RNA, 19 nt, Homo sapiens
ugaacauccucuccuacuu

SEQ ID NO: 516992 - RNA, 19 nt, Homo sapiens
acaugaaguuugugucuca

SEQ ID NO: 516993 - RNA, 19 nt, Homo sapiens
ggacagcucggaggagaug

SEQ ID NO: 516994 - RNA, 19 nt, Homo sapiens
uccgugaccuucucauuug

SEQ ID NO: 516995 - RNA, 19 nt, Homo sapiens
cggcaacaaugacaagcaa

SEQ ID NO: 516996 - RNA, 19 nt, Homo sapiens
caacagcagccucuucaag

SEQ ID NO: 516997 - RNA, 19 nt, Homo sapiens
gguaaaacccaagacauua

SEQ ID NO: 516998 - RNA, 19 nt, Homo sapiens
ggcacaagcagcucaagaa

SEQ ID NO: 516999 - RNA, 19 nt, Homo sapiens
uaucggagcagaccaagga

SEQ ID NO: 517000 - RNA, 19 nt, Homo sapiens
gaauuguacaguugcgaaa

SEQ ID NO: 517001 - RNA, 19 nt, Homo sapiens
gaugccaaccgaugccuuu

SEQ ID NO: 517002 - RNA, 19 nt, Homo sapiens
caacaaugacaagcaagaa

SEQ ID NO: 517003 - RNA, 19 nt, Homo sapiens
uccugucucugaucuauuu

SEQ ID NO: 517004 - RNA, 19 nt, Homo sapiens
uggaagugcugguggugaa

SEQ ID NO: 517005 - RNA, 19 nt, Homo sapiens
cgacagcuaccacgugaau

SEQ ID NO: 517006 - RNA, 19 nt, Homo sapiens
gaccuggacccacugaaga

SEQ ID NO: 517007 - RNA, 19 nt, Homo sapiens
ggaccagauuuggaaguuc

SEQ ID NO: 517008 - RNA, 19 nt, Homo sapiens
caucgacggugugaacuuc

SEQ ID NO: 517009 - RNA, 19 nt, Homo sapiens
gacauugcccgcagugaga

SEQ ID NO: 517010 - RNA, 19 nt, Homo sapiens
ggaaucgcguggacauugc

SEQ ID NO: 517011 - RNA, 19 nt, Homo sapiens
gaaccugaccugccuagac

SEQ ID NO: 517012 - RNA, 19 nt, Homo sapiens
ucacgggccugagccagaa

SEQ ID NO: 517013 - RNA, 19 nt, Homo sapiens
gaagguggugugucagugu

SEQ ID NO: 517014 - RNA, 19 nt, Homo sapiens
acacggaccagauuuggaa

SEQ ID NO: 517015 - RNA, 19 nt, Homo sapiens
ggagcacacggaccagauu

SEQ ID NO: 517016 - RNA, 19 nt, Homo sapiens
ucaccggccucaucuccuu

SEQ ID NO: 517017 - RNA, 19 nt, Homo sapiens
gaaaccagggcuucucucu

SEQ ID NO: 517018 - RNA, 19 nt, Homo sapiens
gagacggaguuccugaucu

SEQ ID NO: 517019 - RNA, 19 nt, Homo sapiens
gagguuguuaccauuauga

SEQ ID NO: 517020 - RNA, 19 nt, Homo sapiens
gaaacugagcguguucuuc

SEQ ID NO: 517021 - RNA, 19 nt, Homo sapiens
acaaauaaaguuccugaca

SEQ ID NO: 517022 - RNA, 19 nt, Homo sapiens
ucaagaacaagcuggagaa

SEQ ID NO: 517023 - RNA, 19 nt, Homo sapiens
gucgggagcuggcaggaau

SEQ ID NO: 517024 - RNA, 19 nt, Homo sapiens
guacauacuggaugaggau

SEQ ID NO: 517025 - RNA, 19 nt, Homo sapiens
aagaaagaaugcguguauu

SEQ ID NO: 517026 - RNA, 19 nt, Homo sapiens
guucggggcucacuacuga

SEQ ID NO: 517027 - RNA, 19 nt, Homo sapiens
ggacagagcucuaauugau

SEQ ID NO: 517028 - RNA, 19 nt, Homo sapiens
gcacacagcugcuacaaau

SEQ ID NO: 517029 - RNA, 19 nt, Homo sapiens
gauauuccaucaugcauua

SEQ ID NO: 517030 - RNA, 19 nt, Homo sapiens
gaaaggaaguucugagaga

SEQ ID NO: 517031 - RNA, 19 nt, Homo sapiens
ggaaauaguucauccguau

SEQ ID NO: 517032 - RNA, 19 nt, Homo sapiens
gagagaagcuggaagagaa

SEQ ID NO: 517033 - RNA, 19 nt, Homo sapiens
gcacauccuugcucuauuu

SEQ ID NO: 517034 - RNA, 19 nt, Homo sapiens
caacaaagauauuccauca

SEQ ID NO: 517035 - RNA, 19 nt, Homo sapiens
guacagaggccaccaguua

SEQ ID NO: 517036 - RNA, 19 nt, Homo sapiens
ggacuucccuuuguacaua

SEQ ID NO: 517037 - RNA, 19 nt, Homo sapiens
uaaacgagcuauuauggua

SEQ ID NO: 517038 - RNA, 19 nt, Homo sapiens
cgauagaucuuauuccaua

SEQ ID NO: 517039 - RNA, 19 nt, Homo sapiens
ggacaaauaugacuucaca

SEQ ID NO: 517040 - RNA, 19 nt, Homo sapiens
gcgauaacauuucugauaa

SEQ ID NO: 517041 - RNA, 19 nt, Homo sapiens
ggaaagcuccucagcauaa

SEQ ID NO: 517042 - RNA, 19 nt, Homo sapiens
gcagaggcauggauucuuu

SEQ ID NO: 517043 - RNA, 19 nt, Homo sapiens
ggaauucaauagcuuguaa

SEQ ID NO: 517044 - RNA, 19 nt, Homo sapiens
gcacuuagcacaauuaaau

SEQ ID NO: 517045 - RNA, 19 nt, Homo sapiens
ugagauaaauggucaauga

SEQ ID NO: 517046 - RNA, 19 nt, Homo sapiens
gaaguugggagaacaaaua

SEQ ID NO: 517047 - RNA, 19 nt, Homo sapiens
gcagaaguaugucaaguau

SEQ ID NO: 517048 - RNA, 19 nt, Homo sapiens
cuacaugacuccaaguaua

SEQ ID NO: 517049 - RNA, 19 nt, Homo sapiens
ccacagaucugauuaagca

SEQ ID NO: 517050 - RNA, 19 nt, Homo sapiens
gcagaugacccucaagaua

SEQ ID NO: 517051 - RNA, 19 nt, Homo sapiens
gcucuuaacucacauuguu

SEQ ID NO: 517052 - RNA, 19 nt, Homo sapiens
gaaauuacuuauccguuug

SEQ ID NO: 517053 - RNA, 19 nt, Homo sapiens
caacucauccaccgaauua

SEQ ID NO: 517054 - RNA, 19 nt, Homo sapiens
gcaaauggcggauauguau

SEQ ID NO: 517055 - RNA, 19 nt, Homo sapiens
guacaaggacugacuuuaa

SEQ ID NO: 517056 - RNA, 19 nt, Homo sapiens
gagaggaggucaacuuuag

SEQ ID NO: 517057 - RNA, 19 nt, Homo sapiens
aagcauagauggauacaaa

SEQ ID NO: 517058 - RNA, 19 nt, Homo sapiens
gauaaauggucaaugagaa

SEQ ID NO: 517059 - RNA, 19 nt, Homo sapiens
gaagacgguucauggcuuu

SEQ ID NO: 517060 - RNA, 19 nt, Homo sapiens
gaaagcaucccaguuaauu

SEQ ID NO: 517061 - RNA, 19 nt, Homo sapiens
ggacacaaauagguucuuu

SEQ ID NO: 517062 - RNA, 19 nt, Homo sapiens
ccaauugccugaccacaaa

SEQ ID NO: 517063 - RNA, 19 nt, Homo sapiens
ggucaaccguucuguguuu

SEQ ID NO: 517064 - RNA, 19 nt, Homo sapiens
gaaaguucuugcuauaaug

SEQ ID NO: 517065 - RNA, 19 nt, Homo sapiens
uauguuggcuuucucauuu

SEQ ID NO: 517066 - RNA, 19 nt, Homo sapiens
gcuguaagcuucacucugu

SEQ ID NO: 517067 - RNA, 19 nt, Homo sapiens
ggauagcguugacacgaua

SEQ ID NO: 517068 - RNA, 19 nt, Homo sapiens
ggagugccaaguauuauua

SEQ ID NO: 517069 - RNA, 19 nt, Homo sapiens
ccacggagauguagaagau

SEQ ID NO: 517070 - RNA, 19 nt, Homo sapiens
ggaaauaauccauaagaga

SEQ ID NO: 517071 - RNA, 19 nt, Homo sapiens
gaacaaugcacaaguggaa

SEQ ID NO: 517072 - RNA, 19 nt, Homo sapiens
gaaagucaccagagagaaa

SEQ ID NO: 517073 - RNA, 19 nt, Homo sapiens
guacagaucagcucucaaa

SEQ ID NO: 517074 - RNA, 19 nt, Homo sapiens
uuagaaagcaucccaguua

SEQ ID NO: 517075 - RNA, 19 nt, Homo sapiens
ucgcguagcucuaauauuc

SEQ ID NO: 517076 - RNA, 19 nt, Homo sapiens
acaaagauauuccaucaug

SEQ ID NO: 517077 - RNA, 19 nt, Homo sapiens
gccaaucccuucauuaaau

SEQ ID NO: 517078 - RNA, 19 nt, Homo sapiens
ugagaaacguugcaaguga

SEQ ID NO: 517079 - RNA, 19 nt, Homo sapiens
uggaugcacugucagauua

SEQ ID NO: 517080 - RNA, 19 nt, Homo sapiens
ggaagaugguaaacaauca

SEQ ID NO: 517081 - RNA, 19 nt, Homo sapiens
acagaaauauguuggcuuu

SEQ ID NO: 517082 - RNA, 19 nt, Homo sapiens
cugcagaacuaaaucauaa

SEQ ID NO: 517083 - RNA, 19 nt, Homo sapiens
gaaauucccuucuuuuguu

SEQ ID NO: 517084 - RNA, 19 nt, Homo sapiens
ugacauuccucuagauuug

SEQ ID NO: 517085 - RNA, 19 nt, Homo sapiens
gagaggcaguccuauagaa

SEQ ID NO: 517086 - RNA, 19 nt, Homo sapiens
ccacaugccuuaugaaguc

SEQ ID NO: 517087 - RNA, 19 nt, Homo sapiens
acagagcucuaauugauaa

SEQ ID NO: 517088 - RNA, 19 nt, Homo sapiens
agacagaaaucaggacuaa

SEQ ID NO: 517089 - RNA, 19 nt, Homo sapiens
gaaugcaaauggcggauau

SEQ ID NO: 517090 - RNA, 19 nt, Homo sapiens
gaacacucauguaccaaau

SEQ ID NO: 517091 - RNA, 19 nt, Homo sapiens
gaucagaugucagaaaaua

SEQ ID NO: 517092 - RNA, 19 nt, Homo sapiens
gcaguugcuuuguaucauu

SEQ ID NO: 517093 - RNA, 19 nt, Homo sapiens
gagaaacguugcaagugaa

SEQ ID NO: 517094 - RNA, 19 nt, Homo sapiens
gaucaacucugcaaacaac

SEQ ID NO: 517095 - RNA, 19 nt, Homo sapiens
agaaguaugucaaguaugu

SEQ ID NO: 517096 - RNA, 19 nt, Homo sapiens
cuugagaggugacaauuaa

SEQ ID NO: 517097 - RNA, 19 nt, Homo sapiens
gaaauagggcuaaauaacu

SEQ ID NO: 517098 - RNA, 19 nt, Homo sapiens
gaaaugcgagcugugguua

SEQ ID NO: 517099 - RNA, 19 nt, Homo sapiens
gcaaagaacacucauguac

SEQ ID NO: 517100 - RNA, 19 nt, Homo sapiens
gcuggaagcucgcgaguca

SEQ ID NO: 517101 - RNA, 19 nt, Homo sapiens
caaaugagaagaagauaga

SEQ ID NO: 517102 - RNA, 19 nt, Homo sapiens
uaaaaugccugaggaaaua

SEQ ID NO: 517103 - RNA, 19 nt, Homo sapiens
gaaggcaccaccaaaugua

SEQ ID NO: 517104 - RNA, 19 nt, Homo sapiens
gcgaaacacccaaauuauu

SEQ ID NO: 517105 - RNA, 19 nt, Homo sapiens
gaacacauggcauuucuuc

SEQ ID NO: 517106 - RNA, 19 nt, Homo sapiens
gccaaacucuggauauuca

SEQ ID NO: 517107 - RNA, 19 nt, Homo sapiens
aaacaacggugagcagauu

SEQ ID NO: 517108 - RNA, 19 nt, Homo sapiens
caagguaucuggaaagaac

SEQ ID NO: 517109 - RNA, 19 nt, Homo sapiens
gcagcaaagaugucuguua

SEQ ID NO: 517110 - RNA, 19 nt, Homo sapiens
gugagaaacuagacaaugu

SEQ ID NO: 517111 - RNA, 19 nt, Homo sapiens
gguaaugaagcaacuauuu

SEQ ID NO: 517112 - RNA, 19 nt, Homo sapiens
guaaccugcuguauuuauu

SEQ ID NO: 517113 - RNA, 19 nt, Homo sapiens
ccaaaacugucuagaauuu

SEQ ID NO: 517114 - RNA, 19 nt, Homo sapiens
gcagcagucugucaaggaa

SEQ ID NO: 517115 - RNA, 19 nt, Homo sapiens
ucacaaguguaccauuaaa

SEQ ID NO: 517116 - RNA, 19 nt, Homo sapiens
guaacgagcuauaauuguc

SEQ ID NO: 517117 - RNA, 19 nt, Homo sapiens
gggcaaaacuacucauuaa

SEQ ID NO: 517118 - RNA, 19 nt, Homo sapiens
caaacaagguaaugaagca

SEQ ID NO: 517119 - RNA, 19 nt, Homo sapiens
gaagagauuucccgacacu

SEQ ID NO: 517120 - RNA, 19 nt, Homo sapiens
gcaaaucaccugcaaggau

SEQ ID NO: 517121 - RNA, 19 nt, Homo sapiens
ccauggcccugauguaauu

SEQ ID NO: 517122 - RNA, 19 nt, Homo sapiens
gagugaugcugcagaacua

SEQ ID NO: 517123 - RNA, 19 nt, Homo sapiens
uagaaagcaucccaguuaa

SEQ ID NO: 517124 - RNA, 19 nt, Homo sapiens
ucaaagguagguacuguua

SEQ ID NO: 517125 - RNA, 19 nt, Homo sapiens
caaccugaguaucaaacua

SEQ ID NO: 517126 - RNA, 19 nt, Homo sapiens
gaaauaaagaaguggaaug

SEQ ID NO: 517127 - RNA, 19 nt, Homo sapiens
gaacuuaaguggcuaaaga

SEQ ID NO: 517128 - RNA, 19 nt, Homo sapiens
gaagagaaccagccauaua

SEQ ID NO: 517129 - RNA, 19 nt, Homo sapiens
guuaaaggcugacuacauu

SEQ ID NO: 517130 - RNA, 19 nt, Homo sapiens
guagucagcuagaucauuu

SEQ ID NO: 517131 - RNA, 19 nt, Homo sapiens
acaaacagcucgagagauu

SEQ ID NO: 517132 - RNA, 19 nt, Homo sapiens
guacagaguuuagaacaaa

SEQ ID NO: 517133 - RNA, 19 nt, Homo sapiens
gcaggucgcuacuggcaua

SEQ ID NO: 517134 - RNA, 19 nt, Homo sapiens
gaaguucauugucucguuu

SEQ ID NO: 517135 - RNA, 19 nt, Homo sapiens
guaaagcgcagauaacauu

SEQ ID NO: 517136 - RNA, 19 nt, Homo sapiens
gaggaaagcaguugaaaug

SEQ ID NO: 517137 - RNA, 19 nt, Homo sapiens
uggcauaguuucauaauug

SEQ ID NO: 517138 - RNA, 19 nt, Homo sapiens
ccaggaaacucuugcuauu

SEQ ID NO: 517139 - RNA, 19 nt, Homo sapiens
aaacaccucugcuuucuga

SEQ ID NO: 517140 - RNA, 19 nt, Homo sapiens
gagaagcaguuacagaaau

SEQ ID NO: 517141 - RNA, 19 nt, Homo sapiens
gaacaaacagcucgagaga

SEQ ID NO: 517142 - RNA, 19 nt, Homo sapiens
cagcauuuguuguguauuu

SEQ ID NO: 517143 - RNA, 19 nt, Homo sapiens
uaagggaguuuaauagaga

SEQ ID NO: 517144 - RNA, 19 nt, Homo sapiens
aaaguuugcuuguuucuug

SEQ ID NO: 517145 - RNA, 19 nt, Homo sapiens
gcagauaacauuugugugu

SEQ ID NO: 517146 - RNA, 19 nt, Homo sapiens
gaacuaacacgugauguga

SEQ ID NO: 517147 - RNA, 19 nt, Homo sapiens
ggaguagggcuuaguguuu

SEQ ID NO: 517148 - RNA, 19 nt, Homo sapiens
gaaguuagguucuuaaaag

SEQ ID NO: 517149 - RNA, 19 nt, Homo sapiens
ggaaagcaguugaaaugag

SEQ ID NO: 517150 - RNA, 19 nt, Homo sapiens
gaauuccauuugaggauuu

SEQ ID NO: 517151 - RNA, 19 nt, Homo sapiens
ccacguaaguuaauaagca

SEQ ID NO: 517152 - RNA, 19 nt, Homo sapiens
gaacaguauuacagauuuc

SEQ ID NO: 517153 - RNA, 19 nt, Homo sapiens
ggaaagcuuuggcaguguu

SEQ ID NO: 517154 - RNA, 19 nt, Homo sapiens
ggaauuccauuugaggauu

SEQ ID NO: 517155 - RNA, 19 nt, Homo sapiens
gaagcacacucuggucuug

SEQ ID NO: 517156 - RNA, 19 nt, Homo sapiens
guauaaagccacccacgua

SEQ ID NO: 517157 - RNA, 19 nt, Homo sapiens
ccuaaacuaugaaaccuuu

SEQ ID NO: 517158 - RNA, 19 nt, Homo sapiens
ucagaguucuauacuguaa

SEQ ID NO: 517159 - RNA, 19 nt, Homo sapiens
ugaaaugaggcaugaguua

SEQ ID NO: 517160 - RNA, 19 nt, Homo sapiens
guaagaaauuucagguugu

SEQ ID NO: 517161 - RNA, 19 nt, Homo sapiens
gauguugccuuaauauucu

SEQ ID NO: 517162 - RNA, 19 nt, Homo sapiens
ggcagcagcuuguguugaa

SEQ ID NO: 517163 - RNA, 19 nt, Homo sapiens
gggauuugguaauguguuu

SEQ ID NO: 517164 - RNA, 19 nt, Homo sapiens
gcaaaauccugacuauuau

SEQ ID NO: 517165 - RNA, 19 nt, Homo sapiens
gaaauaugacgugaagaaa

SEQ ID NO: 517166 - RNA, 19 nt, Homo sapiens
cuacuggcauaguuucaua

SEQ ID NO: 517167 - RNA, 19 nt, Homo sapiens
gaucaucccacagacaaua

SEQ ID NO: 517168 - RNA, 19 nt, Homo sapiens
gaugugaugcuugauauuu

SEQ ID NO: 517169 - RNA, 19 nt, Homo sapiens
aggaaacucuugcuauuga

SEQ ID NO: 517170 - RNA, 19 nt, Homo sapiens
gaccaaauuuccugcugaa

SEQ ID NO: 517171 - RNA, 19 nt, Homo sapiens
gaaaaguuguacagaguuu

SEQ ID NO: 517172 - RNA, 19 nt, Homo sapiens
ugagugugcugcuguaaga

SEQ ID NO: 517173 - RNA, 19 nt, Homo sapiens
ccacagacaauacguuuga

SEQ ID NO: 517174 - RNA, 19 nt, Homo sapiens
ucagcuagaucauuuguuc

SEQ ID NO: 517175 - RNA, 19 nt, Homo sapiens
acuaacacgugaugugaua

SEQ ID NO: 517176 - RNA, 19 nt, Homo sapiens
ucacugccaucaaacugua

SEQ ID NO: 517177 - RNA, 19 nt, Homo sapiens
uaccuugacuguugaugua

SEQ ID NO: 517178 - RNA, 19 nt, Homo sapiens
ugccagaaguuguggauuu

SEQ ID NO: 517179 - RNA, 19 nt, Homo sapiens
ugaaauaugacgugaagaa

SEQ ID NO: 517180 - RNA, 19 nt, Homo sapiens
gaaacagaaacacuaguga

SEQ ID NO: 517181 - RNA, 19 nt, Homo sapiens
uuaaguggcuaaagagaug

SEQ ID NO: 517182 - RNA, 19 nt, Homo sapiens
ggaaacucuugcuauugaa

SEQ ID NO: 517183 - RNA, 19 nt, Homo sapiens
agaagcaguuacagaaauu

SEQ ID NO: 517184 - RNA, 19 nt, Homo sapiens
caugagcacuggagguuug

SEQ ID NO: 517185 - RNA, 19 nt, Homo sapiens
gaguaaaucagauguugaa

SEQ ID NO: 517186 - RNA, 19 nt, Homo sapiens
ggaaacagaaacacuagug

SEQ ID NO: 517187 - RNA, 19 nt, Homo sapiens
uguaagaaaucucccaugu

SEQ ID NO: 517188 - RNA, 19 nt, Homo sapiens
gcauaccuuucacagcuuu

SEQ ID NO: 517189 - RNA, 19 nt, Homo sapiens
caauuugggcuuccuguuu

SEQ ID NO: 517190 - RNA, 19 nt, Homo sapiens
caagucauguaaauacugu

SEQ ID NO: 517191 - RNA, 19 nt, Homo sapiens
uaacacgugaugugauaua

SEQ ID NO: 517192 - RNA, 19 nt, Homo sapiens
cagaugugaugcuugauau

SEQ ID NO: 517193 - RNA, 19 nt, Homo sapiens
gcuugagaauauugaagua

SEQ ID NO: 517194 - RNA, 19 nt, Homo sapiens
gcuauugaauugagaugau

SEQ ID NO: 517195 - RNA, 19 nt, Homo sapiens
gguaauguguuuuagagua

SEQ ID NO: 517196 - RNA, 19 nt, Homo sapiens
gugaguaaaucagauguug

SEQ ID NO: 517197 - RNA, 19 nt, Homo sapiens
uugcuuaccuugacuguug

SEQ ID NO: 517198 - RNA, 19 nt, Homo sapiens
gugaguaucagaauugaaa

SEQ ID NO: 517199 - RNA, 19 nt, Homo sapiens
gauuaucucucaggaguuc

SEQ ID NO: 517200 - RNA, 19 nt, Homo sapiens
gaagugucauguuuauaac

SEQ ID NO: 517201 - RNA, 19 nt, Homo sapiens
cagacaauacguuugauaa

SEQ ID NO: 517202 - RNA, 19 nt, Homo sapiens
cacgugaugugauauauuc

SEQ ID NO: 517203 - RNA, 19 nt, Homo sapiens
gucagaaaguguaaauguu

SEQ ID NO: 517204 - RNA, 19 nt, Homo sapiens
gaagaaaguagaggaagug

SEQ ID NO: 517205 - RNA, 19 nt, Homo sapiens
ugaaagcucgagaacauuu

SEQ ID NO: 517206 - RNA, 19 nt, Homo sapiens
uaacugaagauguugagaa

SEQ ID NO: 517207 - RNA, 19 nt, Homo sapiens
gacuuaauccguaguuauu

SEQ ID NO: 517208 - RNA, 19 nt, Homo sapiens
gaaagcacacacaaaauaa

SEQ ID NO: 517209 - RNA, 19 nt, Homo sapiens
gacuccaucucuauauaaa

SEQ ID NO: 517210 - RNA, 19 nt, Homo sapiens
gaaguggucuaugaucucu

SEQ ID NO: 517211 - RNA, 19 nt, Homo sapiens
caaauuuccugcugaacag

SEQ ID NO: 517212 - RNA, 19 nt, Homo sapiens
ggaguuuaauagagaagga

SEQ ID NO: 517213 - RNA, 19 nt, Homo sapiens
gaaccagccauauacacuu

SEQ ID NO: 517214 - RNA, 19 nt, Homo sapiens
ccacccacguaaguuaaua

SEQ ID NO: 517215 - RNA, 19 nt, Homo sapiens
ccagaugugaugcuugaua

SEQ ID NO: 517216 - RNA, 19 nt, Homo sapiens
aauaugacgugaagaaagu

SEQ ID NO: 517217 - RNA, 19 nt, Homo sapiens
gcacuggagguuuguguug

SEQ ID NO: 517218 - RNA, 19 nt, Homo sapiens
cuaaagagaugagacaaac

SEQ ID NO: 517219 - RNA, 19 nt, Homo sapiens
ugccacaucuuaaacuuga

SEQ ID NO: 517220 - RNA, 19 nt, Homo sapiens
guugcuggcuuguuguaaa

SEQ ID NO: 517221 - RNA, 19 nt, Homo sapiens
aagaguaugugccaggaaa

SEQ ID NO: 517222 - RNA, 19 nt, Homo sapiens
ggaacuaacacgugaugug

SEQ ID NO: 517223 - RNA, 19 nt, Homo sapiens
aagucaagcucaacagauu

SEQ ID NO: 517224 - RNA, 19 nt, Homo sapiens
aauauagccuuuacaugga

SEQ ID NO: 517225 - RNA, 19 nt, Homo sapiens
ccucagcgguugccaggaa

SEQ ID NO: 517226 - RNA, 19 nt, Homo sapiens
gcgcuacgacggauugaaa

SEQ ID NO: 517227 - RNA, 19 nt, Homo sapiens
gaacaacgguuuauucaua

SEQ ID NO: 517228 - RNA, 19 nt, Homo sapiens
gaacuuggcuuuccuguuu

SEQ ID NO: 517229 - RNA, 19 nt, Homo sapiens
gcaaggagcugaacaaguu

SEQ ID NO: 517230 - RNA, 19 nt, Homo sapiens
gaacacagcuaaggaauga

SEQ ID NO: 517231 - RNA, 19 nt, Homo sapiens
ggaaagcucuugucucuuc

SEQ ID NO: 517232 - RNA, 19 nt, Homo sapiens
gaagauggcuauucugugu

SEQ ID NO: 517233 - RNA, 19 nt, Homo sapiens
gagaagcacuugagcauga

SEQ ID NO: 517234 - RNA, 19 nt, Homo sapiens
gaagaaauaucuagaggau

SEQ ID NO: 517235 - RNA, 19 nt, Homo sapiens
uaugaaggcucgagaguua

SEQ ID NO: 517236 - RNA, 19 nt, Homo sapiens
ugucagauguggaguauua

SEQ ID NO: 517237 - RNA, 19 nt, Homo sapiens
gaacugaagugugcuguga

SEQ ID NO: 517238 - RNA, 19 nt, Homo sapiens
gcaaagaucccaaggcauu

SEQ ID NO: 517239 - RNA, 19 nt, Homo sapiens
gaggugagcuacuuuguga

SEQ ID NO: 517240 - RNA, 19 nt, Homo sapiens
acacauaguuucugguaua

SEQ ID NO: 517241 - RNA, 19 nt, Homo sapiens
uuucaaagcuuuccuguuu

SEQ ID NO: 517242 - RNA, 19 nt, Homo sapiens
cgacacggcugauaacuga

SEQ ID NO: 517243 - RNA, 19 nt, Homo sapiens
ggacuaagcugcggaaucu

SEQ ID NO: 517244 - RNA, 19 nt, Homo sapiens
aauaugaacugcaggauaa

SEQ ID NO: 517245 - RNA, 19 nt, Homo sapiens
cggcugauguuguuaaaua

SEQ ID NO: 517246 - RNA, 19 nt, Homo sapiens
aaagucagcucuugucaaa

SEQ ID NO: 517247 - RNA, 19 nt, Homo sapiens
gcuaagacauaaucuaguu

SEQ ID NO: 517248 - RNA, 19 nt, Homo sapiens
ugacagcacuggaaacuga

SEQ ID NO: 517249 - RNA, 19 nt, Homo sapiens
ggaaagaaccgaagagcaa

SEQ ID NO: 517250 - RNA, 19 nt, Homo sapiens
ggaaacagcaucuucuuga

SEQ ID NO: 517251 - RNA, 19 nt, Homo sapiens
ggacaggauuaacgaauau

SEQ ID NO: 517252 - RNA, 19 nt, Homo sapiens
ucagacagcugcagcauga

SEQ ID NO: 517253 - RNA, 19 nt, Homo sapiens
uaaagaagaagcugcaaua

SEQ ID NO: 517254 - RNA, 19 nt, Homo sapiens
cugagaaggugaacuguua

SEQ ID NO: 517255 - RNA, 19 nt, Homo sapiens
agaagaagcugcaauaucu

SEQ ID NO: 517256 - RNA, 19 nt, Homo sapiens
gagcauaccacuugaagaa

SEQ ID NO: 517257 - RNA, 19 nt, Homo sapiens
gcagagcagucuaaacaga

SEQ ID NO: 517258 - RNA, 19 nt, Homo sapiens
caugucagcuuauauguga

SEQ ID NO: 517259 - RNA, 19 nt, Homo sapiens
gaagaacaacgguuuauuc

SEQ ID NO: 517260 - RNA, 19 nt, Homo sapiens
gauagaacuuugauggauu

SEQ ID NO: 517261 - RNA, 19 nt, Homo sapiens
ggaaggaaaucccaucagu

SEQ ID NO: 517262 - RNA, 19 nt, Homo sapiens
aagaaaggcuugacuguug

SEQ ID NO: 517263 - RNA, 19 nt, Homo sapiens
gcaaagguauuaguacaau

SEQ ID NO: 517264 - RNA, 19 nt, Homo sapiens
cugauaagcuuccuagaaa

SEQ ID NO: 517265 - RNA, 19 nt, Homo sapiens
gaacaaaacuccagacucu

SEQ ID NO: 517266 - RNA, 19 nt, Homo sapiens
ggcaaaggcuggcugugua

SEQ ID NO: 517267 - RNA, 19 nt, Homo sapiens
ccacagaagccucauauga

SEQ ID NO: 517268 - RNA, 19 nt, Homo sapiens
caagagaucugugccauag

SEQ ID NO: 517269 - RNA, 19 nt, Homo sapiens
ggaaggagccagugaacuu

SEQ ID NO: 517270 - RNA, 19 nt, Homo sapiens
ggacauagccugcaaagcu

SEQ ID NO: 517271 - RNA, 19 nt, Homo sapiens
ggacaguguuggacagcua

SEQ ID NO: 517272 - RNA, 19 nt, Homo sapiens
uaacccagguguuugaauu

SEQ ID NO: 517273 - RNA, 19 nt, Homo sapiens
agaaauaucuagaggaugu

SEQ ID NO: 517274 - RNA, 19 nt, Homo sapiens
gaaagccgccuaucggaaa

SEQ ID NO: 517275 - RNA, 19 nt, Homo sapiens
ggcaguugcuuguguuuaa

SEQ ID NO: 517276 - RNA, 19 nt, Homo sapiens
caaguacuuuggcuuauga

SEQ ID NO: 517277 - RNA, 19 nt, Homo sapiens
caagauaccaggcacuuaa

SEQ ID NO: 517278 - RNA, 19 nt, Homo sapiens
auagaaggauucagucaua

SEQ ID NO: 517279 - RNA, 19 nt, Homo sapiens
ccaaagaguuucugcaaag

SEQ ID NO: 517280 - RNA, 19 nt, Homo sapiens
gcucgagaguuauuucgua

SEQ ID NO: 517281 - RNA, 19 nt, Homo sapiens
cugaggagcuguuaaagaa

SEQ ID NO: 517282 - RNA, 19 nt, Homo sapiens
gcacuaggaagaaucagua

SEQ ID NO: 517283 - RNA, 19 nt, Homo sapiens
gcacacauaguuucuggua

SEQ ID NO: 517284 - RNA, 19 nt, Homo sapiens
gcaauaugaggccaaauuu

SEQ ID NO: 517285 - RNA, 19 nt, Homo sapiens
ucaacgagcucuauuugga

SEQ ID NO: 517286 - RNA, 19 nt, Homo sapiens
gaggccaaauuuaaucuuu

SEQ ID NO: 517287 - RNA, 19 nt, Homo sapiens
agacagaacugggcaaaga

SEQ ID NO: 517288 - RNA, 19 nt, Homo sapiens
gaacagaagaaauaucuag

SEQ ID NO: 517289 - RNA, 19 nt, Homo sapiens
ugaaagaucaguugaaguu

SEQ ID NO: 517290 - RNA, 19 nt, Homo sapiens
gaaacggacagcuuauaaa

SEQ ID NO: 517291 - RNA, 19 nt, Homo sapiens
ugaaagcguuuacaugaga

SEQ ID NO: 517292 - RNA, 19 nt, Homo sapiens
ugaaaugccucuugaccuu

SEQ ID NO: 517293 - RNA, 19 nt, Homo sapiens
gaaagauggccuccugaaa

SEQ ID NO: 517294 - RNA, 19 nt, Homo sapiens
gaaacagcaucuucuugau

SEQ ID NO: 517295 - RNA, 19 nt, Homo sapiens
caaagguucugucacucua

SEQ ID NO: 517296 - RNA, 19 nt, Homo sapiens
acacaccacuuucugcuuu

SEQ ID NO: 517297 - RNA, 19 nt, Homo sapiens
gugcucagauuccauggua

SEQ ID NO: 517298 - RNA, 19 nt, Homo sapiens
caaaggaaguagaaaugau

SEQ ID NO: 517299 - RNA, 19 nt, Homo sapiens
gaaccgaagagcaaacaaa

SEQ ID NO: 517300 - RNA, 19 nt, Homo sapiens
ggaaaucccaucagugaau

SEQ ID NO: 517301 - RNA, 19 nt, Homo sapiens
ccagguaguuuguugcauu

SEQ ID NO: 517302 - RNA, 19 nt, Homo sapiens
gaagaaaggcuugacuguu

SEQ ID NO: 517303 - RNA, 19 nt, Homo sapiens
caaagacagcccaucauuu

SEQ ID NO: 517304 - RNA, 19 nt, Homo sapiens
ggaaaugucccaccugauc

SEQ ID NO: 517305 - RNA, 19 nt, Homo sapiens
gauggacacugacgucguu

SEQ ID NO: 517306 - RNA, 19 nt, Homo sapiens
guuacugggucaugucaua

SEQ ID NO: 517307 - RNA, 19 nt, Homo sapiens
gcaaagccgccacucguuu

SEQ ID NO: 517308 - RNA, 19 nt, Homo sapiens
gcaaguacuuuggcuuaug

SEQ ID NO: 517309 - RNA, 19 nt, Homo sapiens
gagaaguugugaaagaugu

SEQ ID NO: 517310 - RNA, 19 nt, Homo sapiens
aguguuaacuugcauauug

SEQ ID NO: 517311 - RNA, 19 nt, Homo sapiens
gcacucagauaccacaaag

SEQ ID NO: 517312 - RNA, 19 nt, Homo sapiens
gaagaaggccaacaacaag

SEQ ID NO: 517313 - RNA, 19 nt, Homo sapiens
agaaagaacaagcuagaua

SEQ ID NO: 517314 - RNA, 19 nt, Homo sapiens
uaacgaauaugugggcaaa

SEQ ID NO: 517315 - RNA, 19 nt, Homo sapiens
gagaauggcccaacaagca

SEQ ID NO: 517316 - RNA, 19 nt, Homo sapiens
ugacaaggcucugcuauac

SEQ ID NO: 517317 - RNA, 19 nt, Homo sapiens
uaaagcagcaggucuagaa

SEQ ID NO: 517318 - RNA, 19 nt, Homo sapiens
caauaugaggccaaauuua

SEQ ID NO: 517319 - RNA, 19 nt, Homo sapiens
gcagaaagaacaagcuaga

SEQ ID NO: 517320 - RNA, 19 nt, Homo sapiens
gaaagaucaguugaaguua

SEQ ID NO: 517321 - RNA, 19 nt, Homo sapiens
caaagccgccacucguuua

SEQ ID NO: 517322 - RNA, 19 nt, Homo sapiens
gggcaaagguauuaguaca

SEQ ID NO: 517323 - RNA, 19 nt, Homo sapiens
aauguaggcuuucauguug

SEQ ID NO: 517324 - RNA, 19 nt, Homo sapiens
caagugcuccugaaagaaa

SEQ ID NO: 517325 - RNA, 19 nt, Homo sapiens
agaacaagcuagauacaau

SEQ ID NO: 517326 - RNA, 19 nt, Homo sapiens
gaacauaaugcugccauga

SEQ ID NO: 517327 - RNA, 19 nt, Homo sapiens
gcauuaaucucuuaccaua

SEQ ID NO: 517328 - RNA, 19 nt, Homo sapiens
ccaauguccucuugucuuu

SEQ ID NO: 517329 - RNA, 19 nt, Homo sapiens
ugacagcauuaaucucuua

SEQ ID NO: 517330 - RNA, 19 nt, Homo sapiens
ggagacacaucaccuacuu

SEQ ID NO: 517331 - RNA, 19 nt, Homo sapiens
ucaccaggcucaucaagaa

SEQ ID NO: 517332 - RNA, 19 nt, Homo sapiens
caagaucgccguccuguau

SEQ ID NO: 517333 - RNA, 19 nt, Homo sapiens
ggauuacccuuccaacgaa

SEQ ID NO: 517334 - RNA, 19 nt, Homo sapiens
cgaacgaggugguguccua

SEQ ID NO: 517335 - RNA, 19 nt, Homo sapiens
gcaaggaugguucagauga

SEQ ID NO: 517336 - RNA, 19 nt, Homo sapiens
gcuauaaagugcucaucuu

SEQ ID NO: 517337 - RNA, 19 nt, Homo sapiens
aaagggauguggccgcaua

SEQ ID NO: 517338 - RNA, 19 nt, Homo sapiens
gaacugagcauggaaugug

SEQ ID NO: 517339 - RNA, 19 nt, Homo sapiens
uuaaggucaucaaggauua

SEQ ID NO: 517340 - RNA, 19 nt, Homo sapiens
gaaggagaaguuuaagauu

SEQ ID NO: 517341 - RNA, 19 nt, Homo sapiens
gguauugccugucagugaa

SEQ ID NO: 517342 - RNA, 19 nt, Homo sapiens
ggagagauacuuugaacug

SEQ ID NO: 517343 - RNA, 19 nt, Homo sapiens
ccaacacaguggccucuuu

SEQ ID NO: 517344 - RNA, 19 nt, Homo sapiens
ccuccaaguuuaaucagua

SEQ ID NO: 517345 - RNA, 19 nt, Homo sapiens
gcucucugcuccaugcuuu

SEQ ID NO: 517346 - RNA, 19 nt, Homo sapiens
gaacuuggucaaauucaau

SEQ ID NO: 517347 - RNA, 19 nt, Homo sapiens
gaauguggccucaacaauc

SEQ ID NO: 517348 - RNA, 19 nt, Homo sapiens
ggaacucgccgacaucugu

SEQ ID NO: 517349 - RNA, 19 nt, Homo sapiens
aggaagagcuggcugacuu

SEQ ID NO: 517350 - RNA, 19 nt, Homo sapiens
agacauagaggcacagauu

SEQ ID NO: 517351 - RNA, 19 nt, Homo sapiens
ccaaggacguggacaagca

SEQ ID NO: 517352 - RNA, 19 nt, Homo sapiens
aaggagaaguuuaagauuc

SEQ ID NO: 517353 - RNA, 19 nt, Homo sapiens
gaggugguguccuaugaga

SEQ ID NO: 517354 - RNA, 19 nt, Homo sapiens
gcugagaggagccguguuu

SEQ ID NO: 517355 - RNA, 19 nt, Homo sapiens
ucaaggcccucacagacaa

SEQ ID NO: 517356 - RNA, 19 nt, Homo sapiens
gaaauacugagagaacuga

SEQ ID NO: 517357 - RNA, 19 nt, Homo sapiens
uaucaucaccgcggaaaua

SEQ ID NO: 517358 - RNA, 19 nt, Homo sapiens
caucguccaugaccuguug

SEQ ID NO: 517359 - RNA, 19 nt, Homo sapiens
ugagagaacugagcaugga

SEQ ID NO: 517360 - RNA, 19 nt, Homo sapiens
ccucacaggugcaucauag

SEQ ID NO: 517361 - RNA, 19 nt, Homo sapiens
gagagggacgccuuaaaga

SEQ ID NO: 517362 - RNA, 19 nt, Homo sapiens
ggagaaggccagagcaaca

SEQ ID NO: 517363 - RNA, 19 nt, Homo sapiens
acauucagcuccacuacaa

SEQ ID NO: 517364 - RNA, 19 nt, Homo sapiens
ucaacaggcaguucuauga

SEQ ID NO: 517365 - RNA, 19 nt, Homo sapiens
ucgaccagaucccaucaua

SEQ ID NO: 517366 - RNA, 19 nt, Homo sapiens
caaauucaauagcuguuac

SEQ ID NO: 517367 - RNA, 19 nt, Homo sapiens
uggccaagaucgugucuga

SEQ ID NO: 517368 - RNA, 19 nt, Homo sapiens
gcaacgacuuuguguccau

SEQ ID NO: 517369 - RNA, 19 nt, Homo sapiens
ugaaggagaaguuuaagau

SEQ ID NO: 517370 - RNA, 19 nt, Homo sapiens
caauccugcugcccaauga

SEQ ID NO: 517371 - RNA, 19 nt, Homo sapiens
gcuugaaggagaaguuuaa

SEQ ID NO: 517372 - RNA, 19 nt, Homo sapiens
caaggaugguucagaugau

SEQ ID NO: 517373 - RNA, 19 nt, Homo sapiens
ggaagagcuggcugacuuu

SEQ ID NO: 517374 - RNA, 19 nt, Homo sapiens
ggaauguggccucaacaau

SEQ ID NO: 517375 - RNA, 19 nt, Homo sapiens
caacgacuuuguguccauu

SEQ ID NO: 517376 - RNA, 19 nt, Homo sapiens
gaucggguccguuccaugu

SEQ ID NO: 517377 - RNA, 19 nt, Homo sapiens
gaaccugaucuccuauaga

SEQ ID NO: 517378 - RNA, 19 nt, Homo sapiens
ccaggcucaucaagaagua

SEQ ID NO: 517379 - RNA, 19 nt, Homo sapiens
ugauagggcagauuuguga

SEQ ID NO: 517380 - RNA, 19 nt, Homo sapiens
gaagcucacgcacaucuca

SEQ ID NO: 517381 - RNA, 19 nt, Homo sapiens
cugagucccugcgcuauaa

SEQ ID NO: 517382 - RNA, 19 nt, Homo sapiens
aggaggagcugauuaacuc

SEQ ID NO: 517383 - RNA, 19 nt, Homo sapiens
aaggacggcuggauucaga

SEQ ID NO: 517384 - RNA, 19 nt, Homo sapiens
caggagagauacuuugaac

SEQ ID NO: 517385 - RNA, 19 nt, Homo sapiens
ucaccuacuuggaggaaga

SEQ ID NO: 517386 - RNA, 19 nt, Homo sapiens
ggacuucaccgaguuugug

SEQ ID NO: 517387 - RNA, 19 nt, Homo sapiens
gcaguaugccaguguguuc

SEQ ID NO: 517388 - RNA, 19 nt, Homo sapiens
ggaaauacugagagaacug

SEQ ID NO: 517389 - RNA, 19 nt, Homo sapiens
gagaucguccuguccauca

SEQ ID NO: 517390 - RNA, 19 nt, Homo sapiens
gacaaugggagacacauca

SEQ ID NO: 517391 - RNA, 19 nt, Homo sapiens
ucuuuaaggucaucaagga

SEQ ID NO: 517392 - RNA, 19 nt, Homo sapiens
cagacggaguuuaucauca

SEQ ID NO: 517393 - RNA, 19 nt, Homo sapiens
gaaguuuaagauucuguug

SEQ ID NO: 517394 - RNA, 19 nt, Homo sapiens
ucgcaaggaugguucagau

SEQ ID NO: 517395 - RNA, 19 nt, Homo sapiens
aaaccaacaagcaaagauu

SEQ ID NO: 517396 - RNA, 19 nt, Homo sapiens
gaugauagggcagauuugu

SEQ ID NO: 517397 - RNA, 19 nt, Homo sapiens
ccucggacaucaacaacau

SEQ ID NO: 517398 - RNA, 19 nt, Homo sapiens
aaccugaucuccuauagag

SEQ ID NO: 517399 - RNA, 19 nt, Homo sapiens
guucaucguuacccucugu

SEQ ID NO: 517400 - RNA, 19 nt, Homo sapiens
gcccacaccuggcuaugag

SEQ ID NO: 517401 - RNA, 19 nt, Homo sapiens
gguccaauguccucuuguc

SEQ ID NO: 517402 - RNA, 19 nt, Homo sapiens
gcgguccaauguccucuug

SEQ ID NO: 517403 - RNA, 19 nt, Homo sapiens
ccgcggaaauacugagaga

SEQ ID NO: 517404 - RNA, 19 nt, Homo sapiens
ggaggacuucaccgaguuu

SEQ ID NO: 517405 - RNA, 19 nt, Homo sapiens
acgcaaauauggccucaca

SEQ ID NO: 517406 - RNA, 19 nt, Homo sapiens
caacacaguggccucuuuc

SEQ ID NO: 517407 - RNA, 19 nt, Homo sapiens
ggccaaaccaacaagcaaa

SEQ ID NO: 517408 - RNA, 19 nt, Homo sapiens
gaagagcuggcugacuuug

SEQ ID NO: 517409 - RNA, 19 nt, Homo sapiens
gggccauggucuucgaguu

SEQ ID NO: 517410 - RNA, 19 nt, Homo sapiens
ccaaacagcgcgagauggu

SEQ ID NO: 517411 - RNA, 19 nt, Homo sapiens
gaacaccgaggccaaaucc

SEQ ID NO: 517412 - RNA, 19 nt, Homo sapiens
gacauucugcugaacauca

SEQ ID NO: 517413 - RNA, 19 nt, Homo sapiens
cggaugauagggcagauuu

SEQ ID NO: 517414 - RNA, 19 nt, Homo sapiens
gccugucagugaaauaaau

SEQ ID NO: 517415 - RNA, 19 nt, Homo sapiens
ccaccugggcaacgacuuu

SEQ ID NO: 517416 - RNA, 19 nt, Homo sapiens
gcugagcccugagguuaag

SEQ ID NO: 517417 - RNA, 19 nt, Homo sapiens
cggcugagcgcuucaagga

SEQ ID NO: 517418 - RNA, 19 nt, Homo sapiens
ggccauggucuucgaguug

SEQ ID NO: 517419 - RNA, 19 nt, Homo sapiens
cagcauuaaucucuuacca

SEQ ID NO: 517420 - RNA, 19 nt, Homo sapiens
cuacauggagccagagaga

SEQ ID NO: 517421 - RNA, 19 nt, Homo sapiens
ccacgcguguguaugagau

SEQ ID NO: 517422 - RNA, 19 nt, Homo sapiens
acgaggugguguccuauga

SEQ ID NO: 517423 - RNA, 19 nt, Homo sapiens
caccggcucuauucucuca

SEQ ID NO: 517424 - RNA, 19 nt, Homo sapiens
aagcaccgcugcgacaaga

SEQ ID NO: 517425 - RNA, 19 nt, Homo sapiens
gaccagaucccaucauacg

SEQ ID NO: 517426 - RNA, 19 nt, Homo sapiens
guagagagggacgccuuaa

SEQ ID NO: 517427 - RNA, 19 nt, Homo sapiens
gcauuaaucucuuaccaua

SEQ ID NO: 517428 - RNA, 19 nt, Homo sapiens
ccaauguccucuugucuuu

SEQ ID NO: 517429 - RNA, 19 nt, Homo sapiens
ugacagcauuaaucucuua

SEQ ID NO: 517430 - RNA, 19 nt, Homo sapiens
ggagacacaucaccuacuu

SEQ ID NO: 517431 - RNA, 19 nt, Homo sapiens
ucaccaggcucaucaagaa

SEQ ID NO: 517432 - RNA, 19 nt, Homo sapiens
caagaucgccguccuguau

SEQ ID NO: 517433 - RNA, 19 nt, Homo sapiens
ggauuacccuuccaacgaa

SEQ ID NO: 517434 - RNA, 19 nt, Homo sapiens
cgaacgaggugguguccua

SEQ ID NO: 517435 - RNA, 19 nt, Homo sapiens
gcaaggaugguucagauga

SEQ ID NO: 517436 - RNA, 19 nt, Homo sapiens
gcuauaaagugcucaucuu

SEQ ID NO: 517437 - RNA, 19 nt, Homo sapiens
aaagggauguggccgcaua

SEQ ID NO: 517438 - RNA, 19 nt, Homo sapiens
gaacugagcauggaaugug

SEQ ID NO: 517439 - RNA, 19 nt, Homo sapiens
uuaaggucaucaaggauua

SEQ ID NO: 517440 - RNA, 19 nt, Homo sapiens
gaaggagaaguuuaagauu

SEQ ID NO: 517441 - RNA, 19 nt, Homo sapiens
gguauugccugucagugaa

SEQ ID NO: 517442 - RNA, 19 nt, Homo sapiens
ggagagauacuuugaacug

SEQ ID NO: 517443 - RNA, 19 nt, Homo sapiens
ccaacacaguggccucuuu

SEQ ID NO: 517444 - RNA, 19 nt, Homo sapiens
ccuccaaguuuaaucagua

SEQ ID NO: 517445 - RNA, 19 nt, Homo sapiens
gcucucugcuccaugcuuu

SEQ ID NO: 517446 - RNA, 19 nt, Homo sapiens
gaacuuggucaaauucaau

SEQ ID NO: 517447 - RNA, 19 nt, Homo sapiens
gaauguggccucaacaauc

SEQ ID NO: 517448 - RNA, 19 nt, Homo sapiens
ggaacucgccgacaucugu

SEQ ID NO: 517449 - RNA, 19 nt, Homo sapiens
aggaagagcuggcugacuu

SEQ ID NO: 517450 - RNA, 19 nt, Homo sapiens
agacauagaggcacagauu

SEQ ID NO: 517451 - RNA, 19 nt, Homo sapiens
ccaaggacguggacaagca

SEQ ID NO: 517452 - RNA, 19 nt, Homo sapiens
aaggagaaguuuaagauuc

SEQ ID NO: 517453 - RNA, 19 nt, Homo sapiens
gaggugguguccuaugaga

SEQ ID NO: 517454 - RNA, 19 nt, Homo sapiens
gcugagaggagccguguuu

SEQ ID NO: 517455 - RNA, 19 nt, Homo sapiens
ucaaggcccucacagacaa

SEQ ID NO: 517456 - RNA, 19 nt, Homo sapiens
gaaauacugagagaacuga

SEQ ID NO: 517457 - RNA, 19 nt, Homo sapiens
uaucaucaccgcggaaaua

SEQ ID NO: 517458 - RNA, 19 nt, Homo sapiens
caucguccaugaccuguug

SEQ ID NO: 517459 - RNA, 19 nt, Homo sapiens
ugagagaacugagcaugga

SEQ ID NO: 517460 - RNA, 19 nt, Homo sapiens
ccucacaggugcaucauag

SEQ ID NO: 517461 - RNA, 19 nt, Homo sapiens
gagagggacgccuuaaaga

SEQ ID NO: 517462 - RNA, 19 nt, Homo sapiens
ggagaaggccagagcaaca

SEQ ID NO: 517463 - RNA, 19 nt, Homo sapiens
acauucagcuccacuacaa

SEQ ID NO: 517464 - RNA, 19 nt, Homo sapiens
ucaacaggcaguucuauga

SEQ ID NO: 517465 - RNA, 19 nt, Homo sapiens
ucgaccagaucccaucaua

SEQ ID NO: 517466 - RNA, 19 nt, Homo sapiens
caaauucaauagcuguuac

SEQ ID NO: 517467 - RNA, 19 nt, Homo sapiens
uggccaagaucgugucuga

SEQ ID NO: 517468 - RNA, 19 nt, Homo sapiens
gcaacgacuuuguguccau

SEQ ID NO: 517469 - RNA, 19 nt, Homo sapiens
ugaaggagaaguuuaagau

SEQ ID NO: 517470 - RNA, 19 nt, Homo sapiens
caauccugcugcccaauga

SEQ ID NO: 517471 - RNA, 19 nt, Homo sapiens
gcuugaaggagaaguuuaa

SEQ ID NO: 517472 - RNA, 19 nt, Homo sapiens
caaggaugguucagaugau

SEQ ID NO: 517473 - RNA, 19 nt, Homo sapiens
ggaagagcuggcugacuuu

SEQ ID NO: 517474 - RNA, 19 nt, Homo sapiens
ggaauguggccucaacaau

SEQ ID NO: 517475 - RNA, 19 nt, Homo sapiens
caacgacuuuguguccauu

SEQ ID NO: 517476 - RNA, 19 nt, Homo sapiens
gaucggguccguuccaugu

SEQ ID NO: 517477 - RNA, 19 nt, Homo sapiens
gaaccugaucuccuauaga

SEQ ID NO: 517478 - RNA, 19 nt, Homo sapiens
ccaggcucaucaagaagua

SEQ ID NO: 517479 - RNA, 19 nt, Homo sapiens
ugauagggcagauuuguga

SEQ ID NO: 517480 - RNA, 19 nt, Homo sapiens
gaagcucacgcacaucuca

SEQ ID NO: 517481 - RNA, 19 nt, Homo sapiens
cugagucccugcgcuauaa

SEQ ID NO: 517482 - RNA, 19 nt, Homo sapiens
aggaggagcugauuaacuc

SEQ ID NO: 517483 - RNA, 19 nt, Homo sapiens
aaggacggcuggauucaga

SEQ ID NO: 517484 - RNA, 19 nt, Homo sapiens
caggagagauacuuugaac

SEQ ID NO: 517485 - RNA, 19 nt, Homo sapiens
ucaccuacuuggaggaaga

SEQ ID NO: 517486 - RNA, 19 nt, Homo sapiens
ggacuucaccgaguuugug

SEQ ID NO: 517487 - RNA, 19 nt, Homo sapiens
gcaguaugccaguguguuc

SEQ ID NO: 517488 - RNA, 19 nt, Homo sapiens
ggaaauacugagagaacug

SEQ ID NO: 517489 - RNA, 19 nt, Homo sapiens
gagaucguccuguccauca

SEQ ID NO: 517490 - RNA, 19 nt, Homo sapiens
gacaaugggagacacauca

SEQ ID NO: 517491 - RNA, 19 nt, Homo sapiens
ucuuuaaggucaucaagga

SEQ ID NO: 517492 - RNA, 19 nt, Homo sapiens
cagacggaguuuaucauca

SEQ ID NO: 517493 - RNA, 19 nt, Homo sapiens
gaaguuuaagauucuguug

SEQ ID NO: 517494 - RNA, 19 nt, Homo sapiens
ucgcaaggaugguucagau

SEQ ID NO: 517495 - RNA, 19 nt, Homo sapiens
aaaccaacaagcaaagauu

SEQ ID NO: 517496 - RNA, 19 nt, Homo sapiens
gaugauagggcagauuugu

SEQ ID NO: 517497 - RNA, 19 nt, Homo sapiens
ccucggacaucaacaacau

SEQ ID NO: 517498 - RNA, 19 nt, Homo sapiens
aaccugaucuccuauagag

SEQ ID NO: 517499 - RNA, 19 nt, Homo sapiens
guucaucguuacccucugu

SEQ ID NO: 517500 - RNA, 19 nt, Homo sapiens
gcccacaccuggcuaugag

SEQ ID NO: 517501 - RNA, 19 nt, Homo sapiens
cccaagagcaggauacaga

SEQ ID NO: 517502 - RNA, 19 nt, Homo sapiens
gguccaauguccucuuguc

SEQ ID NO: 517503 - RNA, 19 nt, Homo sapiens
gcgguccaauguccucuug

SEQ ID NO: 517504 - RNA, 19 nt, Homo sapiens
ccgcggaaauacugagaga

SEQ ID NO: 517505 - RNA, 19 nt, Homo sapiens
ggaggacuucaccgaguuu

SEQ ID NO: 517506 - RNA, 19 nt, Homo sapiens
acgcaaauauggccucaca

SEQ ID NO: 517507 - RNA, 19 nt, Homo sapiens
caacacaguggccucuuuc

SEQ ID NO: 517508 - RNA, 19 nt, Homo sapiens
ggccaaaccaacaagcaaa

SEQ ID NO: 517509 - RNA, 19 nt, Homo sapiens
gaagagcuggcugacuuug

SEQ ID NO: 517510 - RNA, 19 nt, Homo sapiens
gggccauggucuucgaguu

SEQ ID NO: 517511 - RNA, 19 nt, Homo sapiens
ccaaacagcgcgagauggu

SEQ ID NO: 517512 - RNA, 19 nt, Homo sapiens
gaacaccgaggccaaaucc

SEQ ID NO: 517513 - RNA, 19 nt, Homo sapiens
gacauucugcugaacauca

SEQ ID NO: 517514 - RNA, 19 nt, Homo sapiens
cggaugauagggcagauuu

SEQ ID NO: 517515 - RNA, 19 nt, Homo sapiens
gccugucagugaaauaaau

SEQ ID NO: 517516 - RNA, 19 nt, Homo sapiens
ccaccugggcaacgacuuu

SEQ ID NO: 517517 - RNA, 19 nt, Homo sapiens
gcugagcccugagguuaag

SEQ ID NO: 517518 - RNA, 19 nt, Homo sapiens
cggcugagcgcuucaagga

SEQ ID NO: 517519 - RNA, 19 nt, Homo sapiens
ggccauggucuucgaguug

SEQ ID NO: 517520 - RNA, 19 nt, Homo sapiens
cagcauuaaucucuuacca

SEQ ID NO: 517521 - RNA, 19 nt, Homo sapiens
cuacauggagccagagaga

SEQ ID NO: 517522 - RNA, 19 nt, Homo sapiens
ccacgcguguguaugagau

SEQ ID NO: 517523 - RNA, 19 nt, Homo sapiens
acgaggugguguccuauga

SEQ ID NO: 517524 - RNA, 19 nt, Homo sapiens
caccggcucuauucucuca

SEQ ID NO: 517525 - RNA, 19 nt, Homo sapiens
aagcaccgcugcgacaaga

SEQ ID NO: 517526 - RNA, 19 nt, Homo sapiens
gaccagaucccaucauacg

SEQ ID NO: 517527 - RNA, 19 nt, Homo sapiens
gcauuaaucucuuaccaua

SEQ ID NO: 517528 - RNA, 19 nt, Homo sapiens
ccaauguccucuugucuuu

SEQ ID NO: 517529 - RNA, 19 nt, Homo sapiens
ugacagcauuaaucucuua

SEQ ID NO: 517530 - RNA, 19 nt, Homo sapiens
ggagacacaucaccuacuu

SEQ ID NO: 517531 - RNA, 19 nt, Homo sapiens
ucaccaggcucaucaagaa

SEQ ID NO: 517532 - RNA, 19 nt, Homo sapiens
caagaucgccguccuguau

SEQ ID NO: 517533 - RNA, 19 nt, Homo sapiens
ggauuacccuuccaacgaa

SEQ ID NO: 517534 - RNA, 19 nt, Homo sapiens
cgaacgaggugguguccua

SEQ ID NO: 517535 - RNA, 19 nt, Homo sapiens
gcaaggaugguucagauga

SEQ ID NO: 517536 - RNA, 19 nt, Homo sapiens
gcuauaaagugcucaucuu

SEQ ID NO: 517537 - RNA, 19 nt, Homo sapiens
aaagggauguggccgcaua

SEQ ID NO: 517538 - RNA, 19 nt, Homo sapiens
gaacugagcauggaaugug

SEQ ID NO: 517539 - RNA, 19 nt, Homo sapiens
uuaaggucaucaaggauua

SEQ ID NO: 517540 - RNA, 19 nt, Homo sapiens
gaaggagaaguuuaagauu

SEQ ID NO: 517541 - RNA, 19 nt, Homo sapiens
gguauugccugucagugaa

SEQ ID NO: 517542 - RNA, 19 nt, Homo sapiens
ggagagauacuuugaacug

SEQ ID NO: 517543 - RNA, 19 nt, Homo sapiens
ccaacacaguggccucuuu

SEQ ID NO: 517544 - RNA, 19 nt, Homo sapiens
ccuccaaguuuaaucagua

SEQ ID NO: 517545 - RNA, 19 nt, Homo sapiens
gcucucugcuccaugcuuu

SEQ ID NO: 517546 - RNA, 19 nt, Homo sapiens
gaacuuggucaaauucaau

SEQ ID NO: 517547 - RNA, 19 nt, Homo sapiens
gaauguggccucaacaauc

SEQ ID NO: 517548 - RNA, 19 nt, Homo sapiens
ggaacucgccgacaucugu

SEQ ID NO: 517549 - RNA, 19 nt, Homo sapiens
aggaagagcuggcugacuu

SEQ ID NO: 517550 - RNA, 19 nt, Homo sapiens
agacauagaggcacagauu

SEQ ID NO: 517551 - RNA, 19 nt, Homo sapiens
ccaaggacguggacaagca

SEQ ID NO: 517552 - RNA, 19 nt, Homo sapiens
aaggagaaguuuaagauuc

SEQ ID NO: 517553 - RNA, 19 nt, Homo sapiens
gaggugguguccuaugaga

SEQ ID NO: 517554 - RNA, 19 nt, Homo sapiens
gcugagaggagccguguuu

SEQ ID NO: 517555 - RNA, 19 nt, Homo sapiens
ucaaggcccucacagacaa

SEQ ID NO: 517556 - RNA, 19 nt, Homo sapiens
gaaauacugagagaacuga

SEQ ID NO: 517557 - RNA, 19 nt, Homo sapiens
uaucaucaccgcggaaaua

SEQ ID NO: 517558 - RNA, 19 nt, Homo sapiens
caucguccaugaccuguug

SEQ ID NO: 517559 - RNA, 19 nt, Homo sapiens
ugagagaacugagcaugga

SEQ ID NO: 517560 - RNA, 19 nt, Homo sapiens
ccucacaggugcaucauag

SEQ ID NO: 517561 - RNA, 19 nt, Homo sapiens
gagagggacgccuuaaaga

SEQ ID NO: 517562 - RNA, 19 nt, Homo sapiens
ggagaaggccagagcaaca

SEQ ID NO: 517563 - RNA, 19 nt, Homo sapiens
acauucagcuccacuacaa

SEQ ID NO: 517564 - RNA, 19 nt, Homo sapiens
ucaacaggcaguucuauga

SEQ ID NO: 517565 - RNA, 19 nt, Homo sapiens
ucgaccagaucccaucaua

SEQ ID NO: 517566 - RNA, 19 nt, Homo sapiens
caaauucaauagcuguuac

SEQ ID NO: 517567 - RNA, 19 nt, Homo sapiens
uggccaagaucgugucuga

SEQ ID NO: 517568 - RNA, 19 nt, Homo sapiens
gcaacgacuuuguguccau

SEQ ID NO: 517569 - RNA, 19 nt, Homo sapiens
ugaaggagaaguuuaagau

SEQ ID NO: 517570 - RNA, 19 nt, Homo sapiens
caauccugcugcccaauga

SEQ ID NO: 517571 - RNA, 19 nt, Homo sapiens
gcuugaaggagaaguuuaa

SEQ ID NO: 517572 - RNA, 19 nt, Homo sapiens
caaggaugguucagaugau

SEQ ID NO: 517573 - RNA, 19 nt, Homo sapiens
ggaagagcuggcugacuuu

SEQ ID NO: 517574 - RNA, 19 nt, Homo sapiens
ggaauguggccucaacaau

SEQ ID NO: 517575 - RNA, 19 nt, Homo sapiens
caacgacuuuguguccauu

SEQ ID NO: 517576 - RNA, 19 nt, Homo sapiens
gaucggguccguuccaugu

SEQ ID NO: 517577 - RNA, 19 nt, Homo sapiens
gaaccugaucuccuauaga

SEQ ID NO: 517578 - RNA, 19 nt, Homo sapiens
ccaggcucaucaagaagua

SEQ ID NO: 517579 - RNA, 19 nt, Homo sapiens
cgagagacccaagaggaua

SEQ ID NO: 517580 - RNA, 19 nt, Homo sapiens
ugauagggcagauuuguga

SEQ ID NO: 517581 - RNA, 19 nt, Homo sapiens
gaagcucacgcacaucuca

SEQ ID NO: 517582 - RNA, 19 nt, Homo sapiens
cugagucccugcgcuauaa

SEQ ID NO: 517583 - RNA, 19 nt, Homo sapiens
aggaggagcugauuaacuc

SEQ ID NO: 517584 - RNA, 19 nt, Homo sapiens
aaggacggcuggauucaga

SEQ ID NO: 517585 - RNA, 19 nt, Homo sapiens
caggagagauacuuugaac

SEQ ID NO: 517586 - RNA, 19 nt, Homo sapiens
ucaccuacuuggaggaaga

SEQ ID NO: 517587 - RNA, 19 nt, Homo sapiens
ggacuucaccgaguuugug

SEQ ID NO: 517588 - RNA, 19 nt, Homo sapiens
gcaguaugccaguguguuc

SEQ ID NO: 517589 - RNA, 19 nt, Homo sapiens
ggaaauacugagagaacug

SEQ ID NO: 517590 - RNA, 19 nt, Homo sapiens
gagaucguccuguccauca

SEQ ID NO: 517591 - RNA, 19 nt, Homo sapiens
gacaaugggagacacauca

SEQ ID NO: 517592 - RNA, 19 nt, Homo sapiens
ucuuuaaggucaucaagga

SEQ ID NO: 517593 - RNA, 19 nt, Homo sapiens
cagacggaguuuaucauca

SEQ ID NO: 517594 - RNA, 19 nt, Homo sapiens
gaaguuuaagauucuguug

SEQ ID NO: 517595 - RNA, 19 nt, Homo sapiens
ucgcaaggaugguucagau

SEQ ID NO: 517596 - RNA, 19 nt, Homo sapiens
aaaccaacaagcaaagauu

SEQ ID NO: 517597 - RNA, 19 nt, Homo sapiens
gaugauagggcagauuugu

SEQ ID NO: 517598 - RNA, 19 nt, Homo sapiens
ccucggacaucaacaacau

SEQ ID NO: 517599 - RNA, 19 nt, Homo sapiens
aaccugaucuccuauagag

SEQ ID NO: 517600 - RNA, 19 nt, Homo sapiens
guucaucguuacccucugu

SEQ ID NO: 517601 - RNA, 19 nt, Homo sapiens
gcccacaccuggcuaugag

SEQ ID NO: 517602 - RNA, 19 nt, Homo sapiens
gguccaauguccucuuguc

SEQ ID NO: 517603 - RNA, 19 nt, Homo sapiens
gcgguccaauguccucuug

SEQ ID NO: 517604 - RNA, 19 nt, Homo sapiens
ccgcggaaauacugagaga

SEQ ID NO: 517605 - RNA, 19 nt, Homo sapiens
ggaggacuucaccgaguuu

SEQ ID NO: 517606 - RNA, 19 nt, Homo sapiens
acgcaaauauggccucaca

SEQ ID NO: 517607 - RNA, 19 nt, Homo sapiens
caacacaguggccucuuuc

SEQ ID NO: 517608 - RNA, 19 nt, Homo sapiens
ggccaaaccaacaagcaaa

SEQ ID NO: 517609 - RNA, 19 nt, Homo sapiens
gaagagcuggcugacuuug

SEQ ID NO: 517610 - RNA, 19 nt, Homo sapiens
gggccauggucuucgaguu

SEQ ID NO: 517611 - RNA, 19 nt, Homo sapiens
ccaaacagcgcgagauggu

SEQ ID NO: 517612 - RNA, 19 nt, Homo sapiens
cggaugauagggcagauuu

SEQ ID NO: 517613 - RNA, 19 nt, Homo sapiens
gaacaccgaggccaaaucc

SEQ ID NO: 517614 - RNA, 19 nt, Homo sapiens
gacauucugcugaacauca

SEQ ID NO: 517615 - RNA, 19 nt, Homo sapiens
gccugucagugaaauaaau

SEQ ID NO: 517616 - RNA, 19 nt, Homo sapiens
ccaccugggcaacgacuuu

SEQ ID NO: 517617 - RNA, 19 nt, Homo sapiens
gcugagcccugagguuaag

SEQ ID NO: 517618 - RNA, 19 nt, Homo sapiens
cggcugagcgcuucaagga

SEQ ID NO: 517619 - RNA, 19 nt, Homo sapiens
ggccauggucuucgaguug

SEQ ID NO: 517620 - RNA, 19 nt, Homo sapiens
cagcauuaaucucuuacca

SEQ ID NO: 517621 - RNA, 19 nt, Homo sapiens
cuacauggagccagagaga

SEQ ID NO: 517622 - RNA, 19 nt, Homo sapiens
ccacgcguguguaugagau

SEQ ID NO: 517623 - RNA, 19 nt, Homo sapiens
acgaggugguguccuauga

SEQ ID NO: 517624 - RNA, 19 nt, Homo sapiens
caccggcucuauucucuca

SEQ ID NO: 517625 - RNA, 19 nt, Homo sapiens
aagcaccgcugcgacaaga

SEQ ID NO: 517626 - RNA, 19 nt, Homo sapiens
gaccagaucccaucauacg

SEQ ID NO: 517627 - RNA, 19 nt, Homo sapiens
gaacaaucccugugccuua

SEQ ID NO: 517628 - RNA, 19 nt, Homo sapiens
aaacugagauggcggauga

SEQ ID NO: 517629 - RNA, 19 nt, Homo sapiens
gaaccucacuggaacaauc

SEQ ID NO: 517630 - RNA, 19 nt, Homo sapiens
gauaccagcuggagguuga

SEQ ID NO: 517631 - RNA, 19 nt, Homo sapiens
ggucaugauugugguauuu

SEQ ID NO: 517632 - RNA, 19 nt, Homo sapiens
ccguuuagaucaagaagua

SEQ ID NO: 517633 - RNA, 19 nt, Homo sapiens
ggacacauacccauauaau

SEQ ID NO: 517634 - RNA, 19 nt, Homo sapiens
guacaaauacagagaccua

SEQ ID NO: 517635 - RNA, 19 nt, Homo sapiens
gagcucuucuuaaaguauu

SEQ ID NO: 517636 - RNA, 19 nt, Homo sapiens
ggagguugagcucuucuua

SEQ ID NO: 517637 - RNA, 19 nt, Homo sapiens
ccacagcucccuuauacaa

SEQ ID NO: 517638 - RNA, 19 nt, Homo sapiens
gaacagaagaagaccugaa

SEQ ID NO: 517639 - RNA, 19 nt, Homo sapiens
guugagcucuucuuaaagu

SEQ ID NO: 517640 - RNA, 19 nt, Homo sapiens
ucuacugacuucucugaua

SEQ ID NO: 517641 - RNA, 19 nt, Homo sapiens
gugaaacugucaauguuau

SEQ ID NO: 517642 - RNA, 19 nt, Homo sapiens
ucuauccucuguaaacuuu

SEQ ID NO: 517643 - RNA, 19 nt, Homo sapiens
agagaugguuacccguuua

SEQ ID NO: 517644 - RNA, 19 nt, Homo sapiens
acaaugauaucgaugaagu

SEQ ID NO: 517645 - RNA, 19 nt, Homo sapiens
aaagaaggaugaagaacuc

SEQ ID NO: 517646 - RNA, 19 nt, Homo sapiens
ccacaacaaguucucagua

SEQ ID NO: 517647 - RNA, 19 nt, Homo sapiens
cuaaugaaccucacuggaa

SEQ ID NO: 517648 - RNA, 19 nt, Homo sapiens
agaccuaacuguacgugaa

SEQ ID NO: 517649 - RNA, 19 nt, Homo sapiens
uguugggacugcuaaauaa

SEQ ID NO: 517650 - RNA, 19 nt, Homo sapiens
agguugagcucuucuuaaa

SEQ ID NO: 517651 - RNA, 19 nt, Homo sapiens
gagaugaaccuccagucuu

SEQ ID NO: 517652 - RNA, 19 nt, Homo sapiens
gaaguagccgagguugaua

SEQ ID NO: 517653 - RNA, 19 nt, Homo sapiens
gaaacgaacagaagaagac

SEQ ID NO: 517654 - RNA, 19 nt, Homo sapiens
gcaaaugggaagauauauc

SEQ ID NO: 517655 - RNA, 19 nt, Homo sapiens
agaugaaccuccagucuuc

SEQ ID NO: 517656 - RNA, 19 nt, Homo sapiens
gagguugagcucuucuuaa

SEQ ID NO: 517657 - RNA, 19 nt, Homo sapiens
ucccacagcucccuuauac

SEQ ID NO: 517658 - RNA, 19 nt, Homo sapiens
auacaaagaucucaaaccu

SEQ ID NO: 517659 - RNA, 19 nt, Homo sapiens
cgugaaacugucaauguua

SEQ ID NO: 517660 - RNA, 19 nt, Homo sapiens
agaaaaugguguccaagua

SEQ ID NO: 517661 - RNA, 19 nt, Homo sapiens
aagagaugguuacccguuu

SEQ ID NO: 517662 - RNA, 19 nt, Homo sapiens
ugagauggcggaugaagga

SEQ ID NO: 517663 - RNA, 19 nt, Homo sapiens
ugaugcaaaugggaagaua

SEQ ID NO: 517664 - RNA, 19 nt, Homo sapiens
cuacugacuucucugauac

SEQ ID NO: 517665 - RNA, 19 nt, Homo sapiens
gaagaaaacgcuauugaag

SEQ ID NO: 517666 - RNA, 19 nt, Homo sapiens
gaaacuggaagagaugguu

SEQ ID NO: 517667 - RNA, 19 nt, Homo sapiens
cacuuucuauccucuguaa

SEQ ID NO: 517668 - RNA, 19 nt, Homo sapiens
aaacuggaagagaugguua

SEQ ID NO: 517669 - RNA, 19 nt, Homo sapiens
ggaugaaggaggaaaugga

SEQ ID NO: 517670 - RNA, 19 nt, Homo sapiens
agucuucucucguccuauu

SEQ ID NO: 517671 - RNA, 19 nt, Homo sapiens
ccagucuucucucguccua

SEQ ID NO: 517672 - RNA, 19 nt, Homo sapiens
caguaggugcccagaauaa

SEQ ID NO: 517673 - RNA, 19 nt, Homo sapiens
cacaacaaguucucaguac

SEQ ID NO: 517674 - RNA, 19 nt, Homo sapiens
gaugaaggaggaaauggau

SEQ ID NO: 517675 - RNA, 19 nt, Homo sapiens
cuggacacauacccauaua

SEQ ID NO: 517676 - RNA, 19 nt, Homo sapiens
ccaaguacaaauacagaga

SEQ ID NO: 517677 - RNA, 19 nt, Homo sapiens
caguagggauggcacaauc

SEQ ID NO: 517678 - RNA, 19 nt, Homo sapiens
gaccuaacuguacgugaaa

SEQ ID NO: 517679 - RNA, 19 nt, Homo sapiens
cauccgagccucucucauc

SEQ ID NO: 517680 - RNA, 19 nt, Homo sapiens
uuauucaggucaugauugu

SEQ ID NO: 517681 - RNA, 19 nt, Homo sapiens
ccgacuuccuguuguuuga

SEQ ID NO: 517682 - RNA, 19 nt, Homo sapiens
acucaguucugcucuggaa

SEQ ID NO: 517683 - RNA, 19 nt, Homo sapiens
gaaggaugaagaacucagu

SEQ ID NO: 517684 - RNA, 19 nt, Homo sapiens
acgugaaacugucaauguu

SEQ ID NO: 517685 - RNA, 19 nt, Homo sapiens
ccagggaacuaaugaaccu

SEQ ID NO: 517686 - RNA, 19 nt, Homo sapiens
gaugguuacccguuuagau

SEQ ID NO: 517687 - RNA, 19 nt, Homo sapiens
uaacuguacgugaaacugu

SEQ ID NO: 517688 - RNA, 19 nt, Homo sapiens
ucaguaggugcccagaaua

SEQ ID NO: 517689 - RNA, 19 nt, Homo sapiens
ucaagaaguagccgagguu

SEQ ID NO: 517690 - RNA, 19 nt, Homo sapiens
guaggugcccagaauaagu

SEQ ID NO: 517691 - RNA, 19 nt, Homo sapiens
caccaaauacuuccuacau

SEQ ID NO: 517692 - RNA, 19 nt, Homo sapiens
ugugguauuuggagaugaa

SEQ ID NO: 517693 - RNA, 19 nt, Homo sapiens
uuccuuaucuacaugaaug

SEQ ID NO: 517694 - RNA, 19 nt, Homo sapiens
augcaaaugggaagauaua

SEQ ID NO: 517695 - RNA, 19 nt, Homo sapiens
acacauacccauauaaucc

SEQ ID NO: 517696 - RNA, 19 nt, Homo sapiens
gcacuuucuauccucugua

SEQ ID NO: 517697 - RNA, 19 nt, Homo sapiens
caaucccugugccuuauag

SEQ ID NO: 517698 - RNA, 19 nt, Homo sapiens
gugccgacuuccuguuguu

SEQ ID NO: 517699 - RNA, 19 nt, Homo sapiens
ucaagaaaaugguguccaa

SEQ ID NO: 517700 - RNA, 19 nt, Homo sapiens
agaaguagccgagguugau

SEQ ID NO: 517701 - RNA, 19 nt, Homo sapiens
gguuacccguuuagaucaa

SEQ ID NO: 517702 - RNA, 19 nt, Homo sapiens
uaucuuccuuaucuacaug

SEQ ID NO: 517703 - RNA, 19 nt, Homo sapiens
caaauacagagaccuaacu

SEQ ID NO: 517704 - RNA, 19 nt, Homo sapiens
gaccucuacugacuucucu

SEQ ID NO: 517705 - RNA, 19 nt, Homo sapiens
accaaauacuuccuacaug

SEQ ID NO: 517706 - RNA, 19 nt, Homo sapiens
caguuuaucauucaagugu

SEQ ID NO: 517707 - RNA, 19 nt, Homo sapiens
aacagaagaagaccugaaa

SEQ ID NO: 517708 - RNA, 19 nt, Homo sapiens
aacaaucccugugccuuau

SEQ ID NO: 517709 - RNA, 19 nt, Homo sapiens
gaugcaaaugggaagauau

SEQ ID NO: 517710 - RNA, 19 nt, Homo sapiens
gacacauacccauauaauc

SEQ ID NO: 517711 - RNA, 19 nt, Homo sapiens
uuaaugcacuuucuauccu

SEQ ID NO: 517712 - RNA, 19 nt, Homo sapiens
gcuggagguugagcucuuc

SEQ ID NO: 517713 - RNA, 19 nt, Homo sapiens
gauccugaaucuguaugca

SEQ ID NO: 517714 - RNA, 19 nt, Homo sapiens
uauacaaacagauccugaa

SEQ ID NO: 517715 - RNA, 19 nt, Homo sapiens
ugaaacgaacagaagaaga

SEQ ID NO: 517716 - RNA, 19 nt, Homo sapiens
cuccauacccauccggaua

SEQ ID NO: 517717 - RNA, 19 nt, Homo sapiens
gaauguugggacugcuaaa

SEQ ID NO: 517718 - RNA, 19 nt, Homo sapiens
cgucuucugucccguaaac

SEQ ID NO: 517719 - RNA, 19 nt, Homo sapiens
ccugaagcauguacgucuu

SEQ ID NO: 517720 - RNA, 19 nt, Homo sapiens
uaagccuacuaguucaaug

SEQ ID NO: 517721 - RNA, 19 nt, Homo sapiens
uaggugcccagaauaaguu

SEQ ID NO: 517722 - RNA, 19 nt, Homo sapiens
gaaaaugguguccaaguac

SEQ ID NO: 517723 - RNA, 19 nt, Homo sapiens
ucucaucucugcggucagu

SEQ ID NO: 517724 - RNA, 19 nt, Homo sapiens
aagcauguacgucuucugu

SEQ ID NO: 517725 - RNA, 19 nt, Homo sapiens
acagcucccuuauacaaac

SEQ ID NO: 517726 - RNA, 19 nt, Homo sapiens
ccugugccuuauagaggua

SEQ ID NO: 517727 - RNA, 19 nt, Homo sapiens
ggagagagugugcuuauug

SEQ ID NO: 517728 - RNA, 19 nt, Homo sapiens
ccaaaccucagaagucuua

SEQ ID NO: 517729 - RNA, 19 nt, Homo sapiens
gcaauacugacuauaguga

SEQ ID NO: 517730 - RNA, 19 nt, Homo sapiens
ggauaucaauggcaaacug

SEQ ID NO: 517731 - RNA, 19 nt, Homo sapiens
uauagugacugcauacaug

SEQ ID NO: 517732 - RNA, 19 nt, Homo sapiens
caagugcaauacugacuau

SEQ ID NO: 517733 - RNA, 19 nt, Homo sapiens
ugacuauagugacugcaua

SEQ ID NO: 517734 - RNA, 19 nt, Homo sapiens
gaaaggagagagugugcuu

SEQ ID NO: 517735 - RNA, 19 nt, Homo sapiens
caucugugcuggauauugu

SEQ ID NO: 517736 - RNA, 19 nt, Homo sapiens
agucuuaucugguaggauu

SEQ ID NO: 517737 - RNA, 19 nt, Homo sapiens
gcaagugcaauacugacua

SEQ ID NO: 517738 - RNA, 19 nt, Homo sapiens
gacaaacuacuguaccaaa

SEQ ID NO: 517739 - RNA, 19 nt, Homo sapiens
caccaucugugcuggauau

SEQ ID NO: 517740 - RNA, 19 nt, Homo sapiens
guaccaaaccucagaaguc

SEQ ID NO: 517741 - RNA, 19 nt, Homo sapiens
gguaggauuuucugucuaa

SEQ ID NO: 517742 - RNA, 19 nt, Homo sapiens
gugcaauacugacuauagu

SEQ ID NO: 517743 - RNA, 19 nt, Homo sapiens
gagagagugugcuuauugc

SEQ ID NO: 517744 - RNA, 19 nt, Homo sapiens
uuucugauguccaugcuuu

SEQ ID NO: 517745 - RNA, 19 nt, Homo sapiens
gcacauauagagacuucau

SEQ ID NO: 517746 - RNA, 19 nt, Homo sapiens
gaagucuuaucugguagga

SEQ ID NO: 517747 - RNA, 19 nt, Homo sapiens
caacugaguauacaaugca

SEQ ID NO: 517748 - RNA, 19 nt, Homo sapiens
aacuguuucuucccaaaua

SEQ ID NO: 517749 - RNA, 19 nt, Homo sapiens
uaccaaaccucagaagucu

SEQ ID NO: 517750 - RNA, 19 nt, Homo sapiens
augaagccaucaagacaaa

SEQ ID NO: 517751 - RNA, 19 nt, Homo sapiens
gagugugcuuauugccuaa

SEQ ID NO: 517752 - RNA, 19 nt, Homo sapiens
gcuuauugccuaaccauca

SEQ ID NO: 517753 - RNA, 19 nt, Homo sapiens
caucaacaccaccaucugu

SEQ ID NO: 517754 - RNA, 19 nt, Homo sapiens
uuccuauccuguugcuuua

SEQ ID NO: 517755 - RNA, 19 nt, Homo sapiens
ugugcuggauauuguauga

SEQ ID NO: 517756 - RNA, 19 nt, Homo sapiens
ccauguugcucccuauuuu

SEQ ID NO: 517757 - RNA, 19 nt, Homo sapiens
caucaagacaaacuacugu

SEQ ID NO: 517758 - RNA, 19 nt, Homo sapiens
ccaacugaguauacaaugc

SEQ ID NO: 517759 - RNA, 19 nt, Homo sapiens
acaaacuacuguaccaaac

SEQ ID NO: 517760 - RNA, 19 nt, Homo sapiens
gauaucaauggcaaacugu

SEQ ID NO: 517761 - RNA, 19 nt, Homo sapiens
guaaguguggcaagugcaa

SEQ ID NO: 517762 - RNA, 19 nt, Homo sapiens
cuuauugccuaaccaucaa

SEQ ID NO: 517763 - RNA, 19 nt, Homo sapiens
caugaagccaucaagacaa

SEQ ID NO: 517764 - RNA, 19 nt, Homo sapiens
aagacaaacuacuguacca

SEQ ID NO: 517765 - RNA, 19 nt, Homo sapiens
uuuccuauccuguugcuuu

SEQ ID NO: 517766 - RNA, 19 nt, Homo sapiens
ggaugcccacuccauguug

SEQ ID NO: 517767 - RNA, 19 nt, Homo sapiens
ugacacgggauaucaaugg

SEQ ID NO: 517768 - RNA, 19 nt, Homo sapiens
gugggcaagcgaugucuuu

SEQ ID NO: 517769 - RNA, 19 nt, Homo sapiens
aaggagagagugugcuuau

SEQ ID NO: 517770 - RNA, 19 nt, Homo sapiens
gaagccaucaagacaaacu

SEQ ID NO: 517771 - RNA, 19 nt, Homo sapiens
uugcacauauagagacuuc

SEQ ID NO: 517772 - RNA, 19 nt, Homo sapiens
aaaggagagagugugcuua

SEQ ID NO: 517773 - RNA, 19 nt, Homo sapiens
guaugacacgggauaucaa

SEQ ID NO: 517774 - RNA, 19 nt, Homo sapiens
aaacuacuguaccaaaccu

SEQ ID NO: 517775 - RNA, 19 nt, Homo sapiens
acaugaagccaucaagaca

SEQ ID NO: 517776 - RNA, 19 nt, Homo sapiens
guauacaaugcacaucgaa

SEQ ID NO: 517777 - RNA, 19 nt, Homo sapiens
auacaugaagccaucaaga

SEQ ID NO: 517778 - RNA, 19 nt, Homo sapiens
ccuauccuguugcuuuaag

SEQ ID NO: 517779 - RNA, 19 nt, Homo sapiens
uauuguaugacacgggaua

SEQ ID NO: 517780 - RNA, 19 nt, Homo sapiens
uauacaaugcacaucgaaa

SEQ ID NO: 517781 - RNA, 19 nt, Homo sapiens
gaacuuaacuuacauagac

SEQ ID NO: 517782 - RNA, 19 nt, Homo sapiens
agaaacaccuggacucuua

SEQ ID NO: 517783 - RNA, 19 nt, Homo sapiens
uaacaacgcucauuauuac

SEQ ID NO: 517784 - RNA, 19 nt, Homo sapiens
gaagaugucuaugaacuga

SEQ ID NO: 517785 - RNA, 19 nt, Homo sapiens
gaacaagccucucaucacu

SEQ ID NO: 517786 - RNA, 19 nt, Homo sapiens
ggacaaagauaccaaaauu

SEQ ID NO: 517787 - RNA, 19 nt, Homo sapiens
caacacggcugguuucuuc

SEQ ID NO: 517788 - RNA, 19 nt, Homo sapiens
ccaaagaacagcacugaua

SEQ ID NO: 517789 - RNA, 19 nt, Homo sapiens
gaucuucaccgacuucaua

SEQ ID NO: 517790 - RNA, 19 nt, Homo sapiens
guacucuucuauccacuua

SEQ ID NO: 517791 - RNA, 19 nt, Homo sapiens
ccaaggauaugcuuucaau

SEQ ID NO: 517792 - RNA, 19 nt, Homo sapiens
aaugaaaccuugacacuga

SEQ ID NO: 517793 - RNA, 19 nt, Homo sapiens
gaacugauagcaagaaaca

SEQ ID NO: 517794 - RNA, 19 nt, Homo sapiens
cauggaagaugucuaugaa

SEQ ID NO: 517795 - RNA, 19 nt, Homo sapiens
gcucuggcauauauuguuu

SEQ ID NO: 517796 - RNA, 19 nt, Homo sapiens
caacccgugugaagacaua

SEQ ID NO: 517797 - RNA, 19 nt, Homo sapiens
ugacaguuauugacaaaga

SEQ ID NO: 517798 - RNA, 19 nt, Homo sapiens
gaagcaaggccaaaucuca

SEQ ID NO: 517799 - RNA, 19 nt, Homo sapiens
gaaucugggugacagcauu

SEQ ID NO: 517800 - RNA, 19 nt, Homo sapiens
ccaggaauaugaagagaau

SEQ ID NO: 517801 - RNA, 19 nt, Homo sapiens
uuucuaaucugcccaauau

SEQ ID NO: 517802 - RNA, 19 nt, Homo sapiens
ucacacuccuucuacaauu

SEQ ID NO: 517803 - RNA, 19 nt, Homo sapiens
gaggauggcuguguugauc

SEQ ID NO: 517804 - RNA, 19 nt, Homo sapiens
caccuggacucuuaagaaa

SEQ ID NO: 517805 - RNA, 19 nt, Homo sapiens
gcuggaugcuguuuaccua

SEQ ID NO: 517806 - RNA, 19 nt, Homo sapiens
agagucaccugcaaggaua

SEQ ID NO: 517807 - RNA, 19 nt, Homo sapiens
ccaaaucucagaagaguau

SEQ ID NO: 517808 - RNA, 19 nt, Homo sapiens
caaagaacagcacugauau

SEQ ID NO: 517809 - RNA, 19 nt, Homo sapiens
ccaagaggauggcuguguu

SEQ ID NO: 517810 - RNA, 19 nt, Homo sapiens
gaauaaauaccugacaguu

SEQ ID NO: 517811 - RNA, 19 nt, Homo sapiens
uuacuucaguccaaggaua

SEQ ID NO: 517812 - RNA, 19 nt, Homo sapiens
uaggggaacuuacaaaaua

SEQ ID NO: 517813 - RNA, 19 nt, Homo sapiens
guacaacaauggcuuuacu

SEQ ID NO: 517814 - RNA, 19 nt, Homo sapiens
uuucaacacuggacuuaaa

SEQ ID NO: 517815 - RNA, 19 nt, Homo sapiens
cagaaucuacguaucuaua

SEQ ID NO: 517816 - RNA, 19 nt, Homo sapiens
ugagaacuauuccaaguca

SEQ ID NO: 517817 - RNA, 19 nt, Homo sapiens
gcuacaaguuccugagaau

SEQ ID NO: 517818 - RNA, 19 nt, Homo sapiens
gcaccugaaggaacugaua

SEQ ID NO: 517819 - RNA, 19 nt, Homo sapiens
ucacugcccuuccauccaa

SEQ ID NO: 517820 - RNA, 19 nt, Homo sapiens
cacugaagcuguacaacaa

SEQ ID NO: 517821 - RNA, 19 nt, Homo sapiens
caagcgaguuaucggugua

SEQ ID NO: 517822 - RNA, 19 nt, Homo sapiens
gugaagacaugguguguac

SEQ ID NO: 517823 - RNA, 19 nt, Homo sapiens
ugacagccauuaugacuac

SEQ ID NO: 517824 - RNA, 19 nt, Homo sapiens
gaaucacacuccuucuaca

SEQ ID NO: 517825 - RNA, 19 nt, Homo sapiens
ucagaagaguauaugcaaa

SEQ ID NO: 517826 - RNA, 19 nt, Homo sapiens
gcaaguuuggcaucuguaa

SEQ ID NO: 517827 - RNA, 19 nt, Homo sapiens
cggaauaccaggaacuuaa

SEQ ID NO: 517828 - RNA, 19 nt, Homo sapiens
ggccaaaucucagaagagu

SEQ ID NO: 517829 - RNA, 19 nt, Homo sapiens
cuuaagaaacuuccacuuu

SEQ ID NO: 517830 - RNA, 19 nt, Homo sapiens
caacaauggcuuuacuuca

SEQ ID NO: 517831 - RNA, 19 nt, Homo sapiens
cagggacuaugcaaugaaa

SEQ ID NO: 517832 - RNA, 19 nt, Homo sapiens
ucuaaucugcccaauauuu

SEQ ID NO: 517833 - RNA, 19 nt, Homo sapiens
ggauguaccugcuccucau

SEQ ID NO: 517834 - RNA, 19 nt, Homo sapiens
cauaaugggcuacaaguuc

SEQ ID NO: 517835 - RNA, 19 nt, Homo sapiens
acacuacacuacucacaau

SEQ ID NO: 517836 - RNA, 19 nt, Homo sapiens
gugcagagcugagaaugag

SEQ ID NO: 517837 - RNA, 19 nt, Homo sapiens
gcaaugaaaccuugacacu

SEQ ID NO: 517838 - RNA, 19 nt, Homo sapiens
acagacaacccuuacauga

SEQ ID NO: 517839 - RNA, 19 nt, Homo sapiens
ggauggcuguguugaucuu

SEQ ID NO: 517840 - RNA, 19 nt, Homo sapiens
gccaauccauuccucuaug

SEQ ID NO: 517841 - RNA, 19 nt, Homo sapiens
caaaguuuauuccacugau

SEQ ID NO: 517842 - RNA, 19 nt, Homo sapiens
gaaacaccuggacucuuaa

SEQ ID NO: 517843 - RNA, 19 nt, Homo sapiens
caaagcuggaugcuguuua

SEQ ID NO: 517844 - RNA, 19 nt, Homo sapiens
ugacgucaaucccugugaa

SEQ ID NO: 517845 - RNA, 19 nt, Homo sapiens
cagcaaguuuggcaucugu

SEQ ID NO: 517846 - RNA, 19 nt, Homo sapiens
ccugagaacuauuccaagu

SEQ ID NO: 517847 - RNA, 19 nt, Homo sapiens
cacacuccuucuacaauuu

SEQ ID NO: 517848 - RNA, 19 nt, Homo sapiens
ggaaucacacuccuucuac

SEQ ID NO: 517849 - RNA, 19 nt, Homo sapiens
uaaguuaacacuacacuac

SEQ ID NO: 517850 - RNA, 19 nt, Homo sapiens
caaagaagcaaggccaaau

SEQ ID NO: 517851 - RNA, 19 nt, Homo sapiens
acaagccucucaucacugu

SEQ ID NO: 517852 - RNA, 19 nt, Homo sapiens
ccugacaguuauugacaaa

SEQ ID NO: 517853 - RNA, 19 nt, Homo sapiens
agaugucuaugaacugauu

SEQ ID NO: 517854 - RNA, 19 nt, Homo sapiens
ccauuccucuaugcuauuu

SEQ ID NO: 517855 - RNA, 19 nt, Homo sapiens
ugagaauuguggugugguu

SEQ ID NO: 517856 - RNA, 19 nt, Homo sapiens
gaagagaaucugggugaca

SEQ ID NO: 517857 - RNA, 19 nt, Homo sapiens
aaacuuccacuuuccuuga

SEQ ID NO: 517858 - RNA, 19 nt, Homo sapiens
gaaggaacugauagcaaga

SEQ ID NO: 517859 - RNA, 19 nt, Homo sapiens
ggaacuuaacuuacauaga

SEQ ID NO: 517860 - RNA, 19 nt, Homo sapiens
gaacaagaggaugagauca

SEQ ID NO: 517861 - RNA, 19 nt, Homo sapiens
cuaaaguuccuuggcauuu

SEQ ID NO: 517862 - RNA, 19 nt, Homo sapiens
ggcagggucuccacaacau

SEQ ID NO: 517863 - RNA, 19 nt, Homo sapiens
uucggaggauggagaaaua

SEQ ID NO: 517864 - RNA, 19 nt, Homo sapiens
cccaauauuuccagaaucu

SEQ ID NO: 517865 - RNA, 19 nt, Homo sapiens
ggaagaugucuaugaacug

SEQ ID NO: 517866 - RNA, 19 nt, Homo sapiens
uggaagaugucuaugaacu

SEQ ID NO: 517867 - RNA, 19 nt, Homo sapiens
aaagaacagcacugauauu

SEQ ID NO: 517868 - RNA, 19 nt, Homo sapiens
uacaaguuccugagaauug

SEQ ID NO: 517869 - RNA, 19 nt, Homo sapiens
caaucccugugaaugcuuu

SEQ ID NO: 517870 - RNA, 19 nt, Homo sapiens
auaccaggaacuuaacuua

SEQ ID NO: 517871 - RNA, 19 nt, Homo sapiens
cuacaucacaguccgaaau

SEQ ID NO: 517872 - RNA, 19 nt, Homo sapiens
gacaguuauugacaaagau

SEQ ID NO: 517873 - RNA, 19 nt, Homo sapiens
ccuugacacugaagcugua

SEQ ID NO: 517874 - RNA, 19 nt, Homo sapiens
ucccugaccugaccaaagu

SEQ ID NO: 517875 - RNA, 19 nt, Homo sapiens
gcaaggccaaaucucagaa

SEQ ID NO: 517876 - RNA, 19 nt, Homo sapiens
auaaguagcuaugccaaag

SEQ ID NO: 517877 - RNA, 19 nt, Homo sapiens
ggcuacaaguuccugagaa

SEQ ID NO: 517878 - RNA, 19 nt, Homo sapiens
aaagcuggaugcuguuuac

SEQ ID NO: 517879 - RNA, 19 nt, Homo sapiens
ccaggaacuuaacuuacau

SEQ ID NO: 517880 - RNA, 19 nt, Homo sapiens
aagccucucaucacuguua

SEQ ID NO: 517881 - RNA, 19 nt, Homo sapiens
ugacuuaacuggagaauug

SEQ ID NO: 517882 - RNA, 19 nt, Homo sapiens
gcauacagauguuugcaua

SEQ ID NO: 517883 - RNA, 19 nt, Homo sapiens
ggauauaacuguugaaagu

SEQ ID NO: 517884 - RNA, 19 nt, Homo sapiens
gaaacugaauugagcauga

SEQ ID NO: 517885 - RNA, 19 nt, Homo sapiens
gaacaauucagcaauaaga

SEQ ID NO: 517886 - RNA, 19 nt, Homo sapiens
cuaagaagcuguauaccuu

SEQ ID NO: 517887 - RNA, 19 nt, Homo sapiens
cuacaggacuacaggaaua

SEQ ID NO: 517888 - RNA, 19 nt, Homo sapiens
gggaagauaugcaucaguu

SEQ ID NO: 517889 - RNA, 19 nt, Homo sapiens
gaaucuagauacuggguuu

SEQ ID NO: 517890 - RNA, 19 nt, Homo sapiens
uaaauuggauggugucaga

SEQ ID NO: 517891 - RNA, 19 nt, Homo sapiens
aaaggaagcaugacaauuu

SEQ ID NO: 517892 - RNA, 19 nt, Homo sapiens
gacaugagcguccuguuua

SEQ ID NO: 517893 - RNA, 19 nt, Homo sapiens
gaacaugcuucagagugua

SEQ ID NO: 517894 - RNA, 19 nt, Homo sapiens
gcagauguguuuucaguua

SEQ ID NO: 517895 - RNA, 19 nt, Homo sapiens
aagauuagcucuguuugua

SEQ ID NO: 517896 - RNA, 19 nt, Homo sapiens
gagcaagacuccaucucaa

SEQ ID NO: 517897 - RNA, 19 nt, Homo sapiens
gaaacuuagucgggauaua

SEQ ID NO: 517898 - RNA, 19 nt, Homo sapiens
gauguuggccuuuaaauca

SEQ ID NO: 517899 - RNA, 19 nt, Homo sapiens
gaagcuguauaccuugaaa

SEQ ID NO: 517900 - RNA, 19 nt, Homo sapiens
gauguugcuuucuccauuu

SEQ ID NO: 517901 - RNA, 19 nt, Homo sapiens
ccuaagagaccaauuugua

SEQ ID NO: 517902 - RNA, 19 nt, Homo sapiens
gauagagaauuggagcuaa

SEQ ID NO: 517903 - RNA, 19 nt, Homo sapiens
gauaagcaguuugguacuu

SEQ ID NO: 517904 - RNA, 19 nt, Homo sapiens
gagaagggaaggauguuaa

SEQ ID NO: 517905 - RNA, 19 nt, Homo sapiens
caugacaauuucccacaua

SEQ ID NO: 517906 - RNA, 19 nt, Homo sapiens
gaugauuacuugugaugug

SEQ ID NO: 517907 - RNA, 19 nt, Homo sapiens
ugccaaagaagauguauua

SEQ ID NO: 517908 - RNA, 19 nt, Homo sapiens
gaauugaugcggaugugua

SEQ ID NO: 517909 - RNA, 19 nt, Homo sapiens
gaagagaagggaaggaugu

SEQ ID NO: 517910 - RNA, 19 nt, Homo sapiens
caaugguaaucguuaguaa

SEQ ID NO: 517911 - RNA, 19 nt, Homo sapiens
gggaguggcugacuuaacu

SEQ ID NO: 517912 - RNA, 19 nt, Homo sapiens
aaacuuagucgggauauaa

SEQ ID NO: 517913 - RNA, 19 nt, Homo sapiens
ggauguguauuaacagugu

SEQ ID NO: 517914 - RNA, 19 nt, Homo sapiens
gaagacaaugggaaagaaa

SEQ ID NO: 517915 - RNA, 19 nt, Homo sapiens
uggaagauauauugacuga

SEQ ID NO: 517916 - RNA, 19 nt, Homo sapiens
gagagacuugugaaacuua

SEQ ID NO: 517917 - RNA, 19 nt, Homo sapiens
ugacaaauaugagagacuu

SEQ ID NO: 517918 - RNA, 19 nt, Homo sapiens
gaauaacaaugguaaucgu

SEQ ID NO: 517919 - RNA, 19 nt, Homo sapiens
ccaaagaagauguauuaug

SEQ ID NO: 517920 - RNA, 19 nt, Homo sapiens
cuguauaccuugaaacaaa

SEQ ID NO: 517921 - RNA, 19 nt, Homo sapiens
ugaaagauuagcucuguuu

SEQ ID NO: 517922 - RNA, 19 nt, Homo sapiens
aaucuaacguuacucaguu

SEQ ID NO: 517923 - RNA, 19 nt, Homo sapiens
gauuagcucuguuuguaag

SEQ ID NO: 517924 - RNA, 19 nt, Homo sapiens
aaccagacauuuccaguug

SEQ ID NO: 517925 - RNA, 19 nt, Homo sapiens
gaauugagcaugacaacca

SEQ ID NO: 517926 - RNA, 19 nt, Homo sapiens
caguaggucugauagagaa

SEQ ID NO: 517927 - RNA, 19 nt, Homo sapiens
gcaggagacucgcuugaac

SEQ ID NO: 517928 - RNA, 19 nt, Homo sapiens
gagcguccuguuuaaauuu

SEQ ID NO: 517929 - RNA, 19 nt, Homo sapiens
cuaagagaccaauuuguaa

SEQ ID NO: 517930 - RNA, 19 nt, Homo sapiens
caucaaaacacgaucauua

SEQ ID NO: 517931 - RNA, 19 nt, Homo sapiens
gagucacaccugucgauua

SEQ ID NO: 517932 - RNA, 19 nt, Homo sapiens
ccacauaaccaaagaagag

SEQ ID NO: 517933 - RNA, 19 nt, Homo sapiens
cgaaaccucgucucuacua

SEQ ID NO: 517934 - RNA, 19 nt, Homo sapiens
ggcgaaaccucgucucuac

SEQ ID NO: 517935 - RNA, 19 nt, Homo sapiens
ugagcguccuguuuaaauu

SEQ ID NO: 517936 - RNA, 19 nt, Homo sapiens
gaguguaccuuuugccaua

SEQ ID NO: 517937 - RNA, 19 nt, Homo sapiens
uuugagaacuccuaagaga

SEQ ID NO: 517938 - RNA, 19 nt, Homo sapiens
ugaagacaaugggaaagaa

SEQ ID NO: 517939 - RNA, 19 nt, Homo sapiens
caaggcaugacaaauauga

SEQ ID NO: 517940 - RNA, 19 nt, Homo sapiens
gaagggaaggauguuaauu

SEQ ID NO: 517941 - RNA, 19 nt, Homo sapiens
gaaguuuggagugauaauu

SEQ ID NO: 517942 - RNA, 19 nt, Homo sapiens
guuacucaguuacuaauuc

SEQ ID NO: 517943 - RNA, 19 nt, Homo sapiens
uacaagugcuccugauaug

SEQ ID NO: 517944 - RNA, 19 nt, Homo sapiens
gaaagauuagcucuguuug

SEQ ID NO: 517945 - RNA, 19 nt, Homo sapiens
gagaauaacaaugguaauc

SEQ ID NO: 517946 - RNA, 19 nt, Homo sapiens
ggaaaugcuuuuaguagug

SEQ ID NO: 517947 - RNA, 19 nt, Homo sapiens
gauuacuugugaugugaaa

SEQ ID NO: 517948 - RNA, 19 nt, Homo sapiens
ucugaaguuuggagugaua

SEQ ID NO: 517949 - RNA, 19 nt, Homo sapiens
caugaaaguuugcauacag

SEQ ID NO: 517950 - RNA, 19 nt, Homo sapiens
cauauucaguuguacuugu

SEQ ID NO: 517951 - RNA, 19 nt, Homo sapiens
ggucagaaauuccaaaaca

SEQ ID NO: 517952 - RNA, 19 nt, Homo sapiens
gagaauugaugcggaugug

SEQ ID NO: 517953 - RNA, 19 nt, Homo sapiens
cgacaugagcaacaaagaa

SEQ ID NO: 517954 - RNA, 19 nt, Homo sapiens
ggugguaugugccuguaau

SEQ ID NO: 517955 - RNA, 19 nt, Homo sapiens
gaaaccucgucucuacuag

SEQ ID NO: 517956 - RNA, 19 nt, Homo sapiens
gaaaguuugcauacagaug

SEQ ID NO: 517957 - RNA, 19 nt, Homo sapiens
ugcaaggcaugacaaauau

SEQ ID NO: 517958 - RNA, 19 nt, Homo sapiens
gaaaugcuuuuaguaguga

SEQ ID NO: 517959 - RNA, 19 nt, Homo sapiens
uaacagagcaagacuccau

SEQ ID NO: 517960 - RNA, 19 nt, Homo sapiens
aaaauuagcuggauauggu

SEQ ID NO: 517961 - RNA, 19 nt, Homo sapiens
gagcaacaaagaaggauca

SEQ ID NO: 517962 - RNA, 19 nt, Homo sapiens
auagagaauuggagcuaaa

SEQ ID NO: 517963 - RNA, 19 nt, Homo sapiens
acagauguuugcauauaug

SEQ ID NO: 517964 - RNA, 19 nt, Homo sapiens
uauguuggcagauguguuu

SEQ ID NO: 517965 - RNA, 19 nt, Homo sapiens
ucagguuuaugauggguuu

SEQ ID NO: 517966 - RNA, 19 nt, Homo sapiens
caagugcuccugauaugga

SEQ ID NO: 517967 - RNA, 19 nt, Homo sapiens
uaaaguugccaaagaagau

SEQ ID NO: 517968 - RNA, 19 nt, Homo sapiens
uuuggaggcuuuccuauuc

SEQ ID NO: 517969 - RNA, 19 nt, Homo sapiens
acaugagcguccuguuuaa

SEQ ID NO: 517970 - RNA, 19 nt, Homo sapiens
gaaucuaacguuacucagu

SEQ ID NO: 517971 - RNA, 19 nt, Homo sapiens
caggauaagcaguuuggua

SEQ ID NO: 517972 - RNA, 19 nt, Homo sapiens
ucaguuccaucgagccauu

SEQ ID NO: 517973 - RNA, 19 nt, Homo sapiens
ugagagacuugugaaacuu

SEQ ID NO: 517974 - RNA, 19 nt, Homo sapiens
caaccagacauuuccaguu

SEQ ID NO: 517975 - RNA, 19 nt, Homo sapiens
gaucaggaggguucaggaa

SEQ ID NO: 517976 - RNA, 19 nt, Homo sapiens
agucagagggucagaaauu

SEQ ID NO: 517977 - RNA, 19 nt, Homo sapiens
agauguugcuuucuccauu

SEQ ID NO: 517978 - RNA, 19 nt, Homo sapiens
gcaugacaauuucccacau

SEQ ID NO: 517979 - RNA, 19 nt, Homo sapiens
agggaaggauguuaauuca

SEQ ID NO: 517980 - RNA, 19 nt, Homo sapiens
aaggaagcaugacaauuuc

SEQ ID NO: 517981 - RNA, 19 nt, Homo sapiens
ugacgaagaugaagacaug

SEQ ID NO: 517982 - RNA, 19 nt, Homo sapiens
caagauugcugagauccua

SEQ ID NO: 517983 - RNA, 19 nt, Homo sapiens
gcacaggaacuaaaggaaa

SEQ ID NO: 517984 - RNA, 19 nt, Homo sapiens
gcuguuggaugacauaaug

SEQ ID NO: 517985 - RNA, 19 nt, Homo sapiens
ggguaaauguggauuguau

SEQ ID NO: 517986 - RNA, 19 nt, Homo sapiens
gaauacagggcuucucauu

SEQ ID NO: 517987 - RNA, 19 nt, Homo sapiens
gaagagaagcauccuguuc

SEQ ID NO: 517988 - RNA, 19 nt, Homo sapiens
uugcugagauccuauguaa

SEQ ID NO: 517989 - RNA, 19 nt, Homo sapiens
guuguugaguugaauauga

SEQ ID NO: 517990 - RNA, 19 nt, Homo sapiens
uaacaagauugcugagauc

SEQ ID NO: 517991 - RNA, 19 nt, Homo sapiens
caacagcagccuuaacuuc

SEQ ID NO: 517992 - RNA, 19 nt, Homo sapiens
aaauguggauuguauggaa

SEQ ID NO: 517993 - RNA, 19 nt, Homo sapiens
ggaugaagccaccugaaga

SEQ ID NO: 517994 - RNA, 19 nt, Homo sapiens
gcaauccccugcaauacua

SEQ ID NO: 517995 - RNA, 19 nt, Homo sapiens
cuaacaagauugcugagau

SEQ ID NO: 517996 - RNA, 19 nt, Homo sapiens
uaauacagcagaacuccua

SEQ ID NO: 517997 - RNA, 19 nt, Homo sapiens
aggaauaucuggugaacau

SEQ ID NO: 517998 - RNA, 19 nt, Homo sapiens
aaagagaucgagucacaaa

SEQ ID NO: 517999 - RNA, 19 nt, Homo sapiens
uaaagugauuaccaaggaa

SEQ ID NO: 518000 - RNA, 19 nt, Homo sapiens
uggauuguauggaaugaaa

SEQ ID NO: 518001 - RNA, 19 nt, Homo sapiens
gaauaucuggugaacauca

SEQ ID NO: 518002 - RNA, 19 nt, Homo sapiens
auaaagugauuaccaagga

SEQ ID NO: 518003 - RNA, 19 nt, Homo sapiens
gcugagauccuauguaagg

SEQ ID NO: 518004 - RNA, 19 nt, Homo sapiens
gaagacaugcugagcuaca

SEQ ID NO: 518005 - RNA, 19 nt, Homo sapiens
ccugaucacugacgaagau

SEQ ID NO: 518006 - RNA, 19 nt, Homo sapiens
gaccacaacuucgcaggau

SEQ ID NO: 518007 - RNA, 19 nt, Homo sapiens
caccacaacagcagccuua

SEQ ID NO: 518008 - RNA, 19 nt, Homo sapiens
gaucacugacgaagaugaa

SEQ ID NO: 518009 - RNA, 19 nt, Homo sapiens
gaagcauccuguucaucuc

SEQ ID NO: 518010 - RNA, 19 nt, Homo sapiens
gccuggagguggaagaaga

SEQ ID NO: 518011 - RNA, 19 nt, Homo sapiens
augaagacaugcugagcua

SEQ ID NO: 518012 - RNA, 19 nt, Homo sapiens
ggacggcaguacucagcau

SEQ ID NO: 518013 - RNA, 19 nt, Homo sapiens
agagugagcaggcggcuuu

SEQ ID NO: 518014 - RNA, 19 nt, Homo sapiens
caaggaauaucuggugaac

SEQ ID NO: 518015 - RNA, 19 nt, Homo sapiens
guacucagcauggucuuau

SEQ ID NO: 518016 - RNA, 19 nt, Homo sapiens
ucugcaagaucauguuguu

SEQ ID NO: 518017 - RNA, 19 nt, Homo sapiens
agugguauccggauuauga

SEQ ID NO: 518018 - RNA, 19 nt, Homo sapiens
cagcagccuuaacuucuuc

SEQ ID NO: 518019 - RNA, 19 nt, Homo sapiens
guaaauguggauuguaugg

SEQ ID NO: 518020 - RNA, 19 nt, Homo sapiens
guauccggauuaugaagug

SEQ ID NO: 518021 - RNA, 19 nt, Homo sapiens
auacagggcuucucauucc

SEQ ID NO: 518022 - RNA, 19 nt, Homo sapiens
caacuucgcaggaucuaac

SEQ ID NO: 518023 - RNA, 19 nt, Homo sapiens
ugagugguauccggauuau

SEQ ID NO: 518024 - RNA, 19 nt, Homo sapiens
gaugaagccaccugaagag

SEQ ID NO: 518025 - RNA, 19 nt, Homo sapiens
acagcagccuuaacuucuu

SEQ ID NO: 518026 - RNA, 19 nt, Homo sapiens
cagaauaaagugauuacca

SEQ ID NO: 518027 - RNA, 19 nt, Homo sapiens
ggagguggaagaagagaag

SEQ ID NO: 518028 - RNA, 19 nt, Homo sapiens
cacaggaacuaaaggaaaa

SEQ ID NO: 518029 - RNA, 19 nt, Homo sapiens
aagagaagcauccuguuca

SEQ ID NO: 518030 - RNA, 19 nt, Homo sapiens
gagcuggagccgguuaaug

SEQ ID NO: 518031 - RNA, 19 nt, Homo sapiens
agagaagcauccuguucau

SEQ ID NO: 518032 - RNA, 19 nt, Homo sapiens
cuucugggccaauguuauu

SEQ ID NO: 518033 - RNA, 19 nt, Homo sapiens
ucucauuccacuccaauug

SEQ ID NO: 518034 - RNA, 19 nt, Homo sapiens
ccaaggaauaucuggugaa

SEQ ID NO: 518035 - RNA, 19 nt, Homo sapiens
agaagcauccuguucaucu

SEQ ID NO: 518036 - RNA, 19 nt, Homo sapiens
ccaguuguugaguugaaua

SEQ ID NO: 518037 - RNA, 19 nt, Homo sapiens
gaggaugaagccaccugaa

SEQ ID NO: 518038 - RNA, 19 nt, Homo sapiens
ucacugacgaagaugaaga

SEQ ID NO: 518039 - RNA, 19 nt, Homo sapiens
gcaccgccuucaggaugga

SEQ ID NO: 518040 - RNA, 19 nt, Homo sapiens
agccuuaacuucuucaacu

SEQ ID NO: 518041 - RNA, 19 nt, Homo sapiens
cacaacagcagccuuaacu

SEQ ID NO: 518042 - RNA, 19 nt, Homo sapiens
gccuuaacuucuucaacug

SEQ ID NO: 518043 - RNA, 19 nt, Homo sapiens
cuuccagaauaaagugauu

SEQ ID NO: 518044 - RNA, 19 nt, Homo sapiens
gguaaauguggauuguaug

SEQ ID NO: 518045 - RNA, 19 nt, Homo sapiens
gagcaucagauuuuaccua

SEQ ID NO: 518046 - RNA, 19 nt, Homo sapiens
ccacaacuucgcaggaucu

SEQ ID NO: 518047 - RNA, 19 nt, Homo sapiens
cggugcugcuguuggauga

SEQ ID NO: 518048 - RNA, 19 nt, Homo sapiens
ucccaguuguugaguugaa

SEQ ID NO: 518049 - RNA, 19 nt, Homo sapiens
gagaagcauccuguucauc

SEQ ID NO: 518050 - RNA, 19 nt, Homo sapiens
ggugaaaucuggcauauua

SEQ ID NO: 518051 - RNA, 19 nt, Homo sapiens
ggacgcagucucuuaaaua

SEQ ID NO: 518052 - RNA, 19 nt, Homo sapiens
gaagggaagggacaacuga

SEQ ID NO: 518053 - RNA, 19 nt, Homo sapiens
cgcagucucuuaaauauga

SEQ ID NO: 518054 - RNA, 19 nt, Homo sapiens
gacgcagucucuuaaauau

SEQ ID NO: 518055 - RNA, 19 nt, Homo sapiens
uaacucuucuuucucuuga

SEQ ID NO: 518056 - RNA, 19 nt, Homo sapiens
ggaggaugccgaaggaauu

SEQ ID NO: 518057 - RNA, 19 nt, Homo sapiens
gcaguaguaacucuucuuu

SEQ ID NO: 518058 - RNA, 19 nt, Homo sapiens
gcagagucauccuuuccaa

SEQ ID NO: 518059 - RNA, 19 nt, Homo sapiens
gcacgaggacagcgucuau

SEQ ID NO: 518060 - RNA, 19 nt, Homo sapiens
ugcgggaccuugacuuuaa

SEQ ID NO: 518061 - RNA, 19 nt, Homo sapiens
ggaggugacucguguucca

SEQ ID NO: 518062 - RNA, 19 nt, Homo sapiens
gaaguaccacauccugcua

SEQ ID NO: 518063 - RNA, 19 nt, Homo sapiens
ggaccaccguucugaagag

SEQ ID NO: 518064 - RNA, 19 nt, Homo sapiens
gggacgcagucucuuaaau

SEQ ID NO: 518065 - RNA, 19 nt, Homo sapiens
gcuacaaccacucucauga

SEQ ID NO: 518066 - RNA, 19 nt, Homo sapiens
ucagauccauaucauagau

SEQ ID NO: 518067 - RNA, 19 nt, Homo sapiens
aguaguaacucuucuuucu

SEQ ID NO: 518068 - RNA, 19 nt, Homo sapiens
ucauuuccuuggcugauaa

SEQ ID NO: 518069 - RNA, 19 nt, Homo sapiens
gacagcagagucauccuuu

SEQ ID NO: 518070 - RNA, 19 nt, Homo sapiens
aaugggagaugggaagaaa

SEQ ID NO: 518071 - RNA, 19 nt, Homo sapiens
aaucagauccauaucauag

SEQ ID NO: 518072 - RNA, 19 nt, Homo sapiens
ggacgaugcaccagugauc

SEQ ID NO: 518073 - RNA, 19 nt, Homo sapiens
uaguaacucuucuuucucu

SEQ ID NO: 518074 - RNA, 19 nt, Homo sapiens
caaacagucgcagcucuuu

SEQ ID NO: 518075 - RNA, 19 nt, Homo sapiens
guugggacgcagucucuua

SEQ ID NO: 518076 - RNA, 19 nt, Homo sapiens
guaacucuucuuucucuug

SEQ ID NO: 518077 - RNA, 19 nt, Homo sapiens
gcccuucggccacuuggua

SEQ ID NO: 518078 - RNA, 19 nt, Homo sapiens
ugacuuuaaucccaauaag

SEQ ID NO: 518079 - RNA, 19 nt, Homo sapiens
acagcaaaguccugacaug

SEQ ID NO: 518080 - RNA, 19 nt, Homo sapiens
agacagagccccacauuau

SEQ ID NO: 518081 - RNA, 19 nt, Homo sapiens
gcugacccguggcuguuug

SEQ ID NO: 518082 - RNA, 19 nt, Homo sapiens
gugcgggaccuugacuuua

SEQ ID NO: 518083 - RNA, 19 nt, Homo sapiens
gagccagaucuacugcaua

SEQ ID NO: 518084 - RNA, 19 nt, Homo sapiens
gaccaccguucugaagaga

SEQ ID NO: 518085 - RNA, 19 nt, Homo sapiens
guagcagcagcauuuauga

SEQ ID NO: 518086 - RNA, 19 nt, Homo sapiens
ggaggaccaccguucugaa

SEQ ID NO: 518087 - RNA, 19 nt, Homo sapiens
ggugcgggaccuugacuuu

SEQ ID NO: 518088 - RNA, 19 nt, Homo sapiens
ggccguagcgagguccuua

SEQ ID NO: 518089 - RNA, 19 nt, Homo sapiens
acaacgugaucgccaccua

SEQ ID NO: 518090 - RNA, 19 nt, Homo sapiens
gcgggaccuugacuuuaau

SEQ ID NO: 518091 - RNA, 19 nt, Homo sapiens
agccagaucuacugcauag

SEQ ID NO: 518092 - RNA, 19 nt, Homo sapiens
ggaagggaagggacaacug

SEQ ID NO: 518093 - RNA, 19 nt, Homo sapiens
cagcucagcgucccuggaa

SEQ ID NO: 518094 - RNA, 19 nt, Homo sapiens
gaggaugccgaaggaauug

SEQ ID NO: 518095 - RNA, 19 nt, Homo sapiens
cgagguccuuagcguguga

SEQ ID NO: 518096 - RNA, 19 nt, Homo sapiens
gucuguuccugcaguagua

SEQ ID NO: 518097 - RNA, 19 nt, Homo sapiens
gcagaaacagaugccauuc

SEQ ID NO: 518098 - RNA, 19 nt, Homo sapiens
cuuggcagauucucaaaca

SEQ ID NO: 518099 - RNA, 19 nt, Homo sapiens
cgggugaaaucuggcauau

SEQ ID NO: 518100 - RNA, 19 nt, Homo sapiens
acagagccccacauuauua

SEQ ID NO: 518101 - RNA, 19 nt, Homo sapiens
gggaagggacaacugaagu

SEQ ID NO: 518102 - RNA, 19 nt, Homo sapiens
cagcaaaguccugacaugu

SEQ ID NO: 518103 - RNA, 19 nt, Homo sapiens
gaggaccaccguucugaag

SEQ ID NO: 518104 - RNA, 19 nt, Homo sapiens
agucauccuuuccaacaug

SEQ ID NO: 518105 - RNA, 19 nt, Homo sapiens
uguggaggaugccgaagga

SEQ ID NO: 518106 - RNA, 19 nt, Homo sapiens
cugacgaccugcuacaaca

SEQ ID NO: 518107 - RNA, 19 nt, Homo sapiens
ccaucaagcgggugaaauc

SEQ ID NO: 518108 - RNA, 19 nt, Homo sapiens
gcaugagccagaucuacug

SEQ ID NO: 518109 - RNA, 19 nt, Homo sapiens
uguagcagcagcauuuaug

SEQ ID NO: 518110 - RNA, 19 nt, Homo sapiens
caggucccauugagugguu

SEQ ID NO: 518111 - RNA, 19 nt, Homo sapiens
acuguaaggugaaguucug

SEQ ID NO: 518112 - RNA, 19 nt, Homo sapiens
gcgggugaaaucuggcaua

SEQ ID NO: 518113 - RNA, 19 nt, Homo sapiens
uagcagcagcauuuaugaa

SEQ ID NO: 518114 - RNA, 19 nt, Homo sapiens
ucaaacagucgcagcucuu

SEQ ID NO: 518115 - RNA, 19 nt, Homo sapiens
acgggaggcucgugaucaa

SEQ ID NO: 518116 - RNA, 19 nt, Homo sapiens
gagucauccuuuccaacau

SEQ ID NO: 518117 - RNA, 19 nt, Homo sapiens
gagacagagccccacauua

SEQ ID NO: 518118 - RNA, 19 nt, Homo sapiens
gaucuacgggcuggaguuc

SEQ ID NO: 518119 - RNA, 19 nt, Homo sapiens
gggaggcucgugaucaaca

SEQ ID NO: 518120 - RNA, 19 nt, Homo sapiens
ucaaacugcagaaacagau

SEQ ID NO: 518121 - RNA, 19 nt, Homo sapiens
ugagccagaucuacugcau

SEQ ID NO: 518122 - RNA, 19 nt, Homo sapiens
gagcaugagccagaucuac

SEQ ID NO: 518123 - RNA, 19 nt, Homo sapiens
ggagcaugagccagaucua

SEQ ID NO: 518124 - RNA, 19 nt, Homo sapiens
guaccacauccugcuauga

SEQ ID NO: 518125 - RNA, 19 nt, Homo sapiens
aaaauguccuccuccauca

SEQ ID NO: 518126 - RNA, 19 nt, Homo sapiens
agagucauccuuuccaaca

SEQ ID NO: 518127 - RNA, 19 nt, Homo sapiens
ugggacacccggagcauga

SEQ ID NO: 518128 - RNA, 19 nt, Homo sapiens
gguuauccaggucccauug

SEQ ID NO: 518129 - RNA, 19 nt, Homo sapiens
gcagucucuuaaauaugau

SEQ ID NO: 518130 - RNA, 19 nt, Homo sapiens
uuaaucccaauaagcagua

SEQ ID NO: 518131 - RNA, 19 nt, Homo sapiens
caaacugcagaaacagaug

SEQ ID NO: 518132 - RNA, 19 nt, Homo sapiens
ggagaugggaagaaaauca

SEQ ID NO: 518133 - RNA, 19 nt, Homo sapiens
gcuacaacagaacuucaga

SEQ ID NO: 518134 - RNA, 19 nt, Homo sapiens
gacgaccugcuacaacaga

SEQ ID NO: 518135 - RNA, 19 nt, Homo sapiens
uaaaucacuuggccaguuu

SEQ ID NO: 518136 - RNA, 19 nt, Homo sapiens
gaaccggcuuugaaugaau

SEQ ID NO: 518137 - RNA, 19 nt, Homo sapiens
ggaaccggcuuugaaugaa

SEQ ID NO: 518138 - RNA, 19 nt, Homo sapiens
gcucaucgauuuccagaac

SEQ ID NO: 518139 - RNA, 19 nt, Homo sapiens
gggaaccggcuuugaauga

SEQ ID NO: 518140 - RNA, 19 nt, Homo sapiens
uuauuucgcugguucuuug

SEQ ID NO: 518141 - RNA, 19 nt, Homo sapiens
gacagccucuuccagcuau

SEQ ID NO: 518142 - RNA, 19 nt, Homo sapiens
auaaaucacuuggccaguu

SEQ ID NO: 518143 - RNA, 19 nt, Homo sapiens
gcugggaaccggcuuugaa

SEQ ID NO: 518144 - RNA, 19 nt, Homo sapiens
ccaaggagcugcgcuucca

SEQ ID NO: 518145 - RNA, 19 nt, Homo sapiens
ggcuuugaaugaauaaaug

SEQ ID NO: 518146 - RNA, 19 nt, Homo sapiens
ucacugugcccauugcaaa

SEQ ID NO: 518147 - RNA, 19 nt, Homo sapiens
aaccggcuuugaaugaaua

SEQ ID NO: 518148 - RNA, 19 nt, Homo sapiens
cgcuggcgcucaucgauuu

SEQ ID NO: 518149 - RNA, 19 nt, Homo sapiens
gccuuaaguuauuggacua

SEQ ID NO: 518150 - RNA, 19 nt, Homo sapiens
cgacagccucuuccagcua

SEQ ID NO: 518151 - RNA, 19 nt, Homo sapiens
ucacuuggccaguuugcuu

SEQ ID NO: 518152 - RNA, 19 nt, Homo sapiens
ccacaaggagaucgacuuc

SEQ ID NO: 518153 - RNA, 19 nt, Homo sapiens
gcccauugcaaauaaauca

SEQ ID NO: 518154 - RNA, 19 nt, Homo sapiens
gcgcucggcacgacaugaa

SEQ ID NO: 518155 - RNA, 19 nt, Homo sapiens
gguucuuuguagucacaua

SEQ ID NO: 518156 - RNA, 19 nt, Homo sapiens
uugcaucacugugcccauu

SEQ ID NO: 518157 - RNA, 19 nt, Homo sapiens
ccaccgaccacaaggagau

SEQ ID NO: 518158 - RNA, 19 nt, Homo sapiens
cugugcccauugcaaauaa

SEQ ID NO: 518159 - RNA, 19 nt, Homo sapiens
gcucggcacgacaugaaau

SEQ ID NO: 518160 - RNA, 19 nt, Homo sapiens
gcaucacugugcccauugc

SEQ ID NO: 518161 - RNA, 19 nt, Homo sapiens
ugaaggagaugacauguuu

SEQ ID NO: 518162 - RNA, 19 nt, Homo sapiens
uggagaaccuugaaucuaa

SEQ ID NO: 518163 - RNA, 19 nt, Homo sapiens
ggacuggacucgggccaua

SEQ ID NO: 518164 - RNA, 19 nt, Homo sapiens
ggaauaaacuuugccuuuu

SEQ ID NO: 518165 - RNA, 19 nt, Homo sapiens
gaauaaacuuugccuuuuc

SEQ ID NO: 518166 - RNA, 19 nt, Homo sapiens
ggagaaccuugaaucuaag

SEQ ID NO: 518167 - RNA, 19 nt, Homo sapiens
ccucuuaggugaaggagau

SEQ ID NO: 518168 - RNA, 19 nt, Homo sapiens
uggaauaaacuuugccuuu

SEQ ID NO: 518169 - RNA, 19 nt, Homo sapiens
ugucaacacuggaauaaac

SEQ ID NO: 518170 - RNA, 19 nt, Homo sapiens
ggagccggaugcaguagga

SEQ ID NO: 518171 - RNA, 19 nt, Homo sapiens
caacacuggaauaaacuuu

SEQ ID NO: 518172 - RNA, 19 nt, Homo sapiens
ucauggacuuccugacuga

SEQ ID NO: 518173 - RNA, 19 nt, Homo sapiens
gcucccugcucaagaccua

SEQ ID NO: 518174 - RNA, 19 nt, Homo sapiens
ggugguguaugauggugaa

SEQ ID NO: 518175 - RNA, 19 nt, Homo sapiens
agccgguucuuaccucuua

SEQ ID NO: 518176 - RNA, 19 nt, Homo sapiens
gaccucuucugcuuacugu

SEQ ID NO: 518177 - RNA, 19 nt, Homo sapiens
guaccucgagcgccacgua

SEQ ID NO: 518178 - RNA, 19 nt, Homo sapiens
gugaacaccugggcagcuu

SEQ ID NO: 518179 - RNA, 19 nt, Homo sapiens
uuagugaccccaugacuua

SEQ ID NO: 518180 - RNA, 19 nt, Homo sapiens
guggauguuccguguguuu

SEQ ID NO: 518181 - RNA, 19 nt, Homo sapiens
gagaaccuugaaucuaaga

SEQ ID NO: 518182 - RNA, 19 nt, Homo sapiens
gaacaccugggcagcuucu

SEQ ID NO: 518183 - RNA, 19 nt, Homo sapiens
gugaaggagaugacauguu

SEQ ID NO: 518184 - RNA, 19 nt, Homo sapiens
gacuuacagccgguucuua

SEQ ID NO: 518185 - RNA, 19 nt, Homo sapiens
ccucuuucuuugacauaga

SEQ ID NO: 518186 - RNA, 19 nt, Homo sapiens
agccugauguggccgugua

SEQ ID NO: 518187 - RNA, 19 nt, Homo sapiens
aaugguggcuuccggaacu

SEQ ID NO: 518188 - RNA, 19 nt, Homo sapiens
cgcacguggugguguauga

SEQ ID NO: 518189 - RNA, 19 nt, Homo sapiens
acacuggaauaaacuuugc

SEQ ID NO: 518190 - RNA, 19 nt, Homo sapiens
ccguaucagugcucaaugg

SEQ ID NO: 518191 - RNA, 19 nt, Homo sapiens
cuggagaaccuugaaucua

SEQ ID NO: 518192 - RNA, 19 nt, Homo sapiens
gcuggagaaccuugaaucu

SEQ ID NO: 518193 - RNA, 19 nt, Homo sapiens
gaagucaccuuugauacaa

SEQ ID NO: 518194 - RNA, 19 nt, Homo sapiens
ggaccuaccugcccgacuu

SEQ ID NO: 518195 - RNA, 19 nt, Homo sapiens
gcaaagccauccagaaggu

SEQ ID NO: 518196 - RNA, 19 nt, Homo sapiens
ggagaggacuggguguuug

SEQ ID NO: 518197 - RNA, 19 nt, Homo sapiens
gaugggcaguuuaagaaga

SEQ ID NO: 518198 - RNA, 19 nt, Homo sapiens
ggaagucaccuuugauaca

SEQ ID NO: 518199 - RNA, 19 nt, Homo sapiens
caagacgaccuacccgaua

SEQ ID NO: 518200 - RNA, 19 nt, Homo sapiens
cgaccuacccgauagauga

SEQ ID NO: 518201 - RNA, 19 nt, Homo sapiens
caagucggaugggcaguuu

SEQ ID NO: 518202 - RNA, 19 nt, Homo sapiens
ggaggcaguucauauacuc

SEQ ID NO: 518203 - RNA, 19 nt, Homo sapiens
ccacacacgucauccaucu

SEQ ID NO: 518204 - RNA, 19 nt, Homo sapiens
uuaagaagacagccaguaa

SEQ ID NO: 518205 - RNA, 19 nt, Homo sapiens
ccaauaaagugcauuuuca

SEQ ID NO: 518206 - RNA, 19 nt, Homo sapiens
gagccaauaaagugcauuu

SEQ ID NO: 518207 - RNA, 19 nt, Homo sapiens
gaagugaagcuggaagaca

SEQ ID NO: 518208 - RNA, 19 nt, Homo sapiens
gcagaacagggccuacuuc

SEQ ID NO: 518209 - RNA, 19 nt, Homo sapiens
uaaagugcauuuucacaga

SEQ ID NO: 518210 - RNA, 19 nt, Homo sapiens
cggaugggcaguuuaagaa

SEQ ID NO: 518211 - RNA, 19 nt, Homo sapiens
ggguguuugucuccucuaa

SEQ ID NO: 518212 - RNA, 19 nt, Homo sapiens
gugcuugguucacugacaa

SEQ ID NO: 518213 - RNA, 19 nt, Homo sapiens
ucaagcaggcggugaagga

SEQ ID NO: 518214 - RNA, 19 nt, Homo sapiens
guguuugucuccucuaaag

SEQ ID NO: 518215 - RNA, 19 nt, Homo sapiens
gaaggugguagcagaugga

SEQ ID NO: 518216 - RNA, 19 nt, Homo sapiens
gcagauggagcuggacuuc

SEQ ID NO: 518217 - RNA, 19 nt, Homo sapiens
caguacggcugcaccuuca

SEQ ID NO: 518218 - RNA, 19 nt, Homo sapiens
uccggaauaucaaauacaa

SEQ ID NO: 518219 - RNA, 19 nt, Homo sapiens
ggaauccgcggaggcaguu

SEQ ID NO: 518220 - RNA, 19 nt, Homo sapiens
acacacgucauccaucuug

SEQ ID NO: 518221 - RNA, 19 nt, Homo sapiens
ccacgacaacuucaacauc

SEQ ID NO: 518222 - RNA, 19 nt, Homo sapiens
ccugggagccaauaaagug

SEQ ID NO: 518223 - RNA, 19 nt, Homo sapiens
caacuucaacaucgaggau

SEQ ID NO: 518224 - RNA, 19 nt, Homo sapiens
aagacgaccuacccgauag

SEQ ID NO: 518225 - RNA, 19 nt, Homo sapiens
gagaggacuggguguuugu

SEQ ID NO: 518226 - RNA, 19 nt, Homo sapiens
aagaagacagccaguaaca

SEQ ID NO: 518227 - RNA, 19 nt, Homo sapiens
cgcggaggcaguucauaua

SEQ ID NO: 518228 - RNA, 19 nt, Homo sapiens
ccgcggaggcaguucauau

SEQ ID NO: 518229 - RNA, 19 nt, Homo sapiens
ggccuguuccggaauauca

SEQ ID NO: 518230 - RNA, 19 nt, Homo sapiens
uggcccagcucuuuaucug

SEQ ID NO: 518231 - RNA, 19 nt, Homo sapiens
guuccggaauaucaaauac

SEQ ID NO: 518232 - RNA, 19 nt, Homo sapiens
gaccugugcuugguucacu

SEQ ID NO: 518233 - RNA, 19 nt, Homo sapiens
ggggaagucaccuuugaua

SEQ ID NO: 518234 - RNA, 19 nt, Homo sapiens
gagaccaugauccacaaug

SEQ ID NO: 518235 - RNA, 19 nt, Homo sapiens
aggcaaagccauccagaag

SEQ ID NO: 518236 - RNA, 19 nt, Homo sapiens
agucggaugggcaguuuaa

SEQ ID NO: 518237 - RNA, 19 nt, Homo sapiens
ugaaguggagcccaucauc

SEQ ID NO: 518238 - RNA, 19 nt, Homo sapiens
aaggagaccugugcuuggu

SEQ ID NO: 518239 - RNA, 19 nt, Homo sapiens
gggaagucaccuuugauac

SEQ ID NO: 518240 - RNA, 19 nt, Homo sapiens
acgccgaucucacggauac

SEQ ID NO: 518241 - RNA, 19 nt, Homo sapiens
ugccuggccucauccacaa

SEQ ID NO: 518242 - RNA, 19 nt, Homo sapiens
uagaugagaccaugaucca

SEQ ID NO: 518243 - RNA, 19 nt, Homo sapiens
cgauagaugagaccaugau

SEQ ID NO: 518244 - RNA, 19 nt, Homo sapiens
gaagagagcacuagacuaa

SEQ ID NO: 518245 - RNA, 19 nt, Homo sapiens
ggaagaagcccauuuguug

SEQ ID NO: 518246 - RNA, 19 nt, Homo sapiens
ggagggaaaugaacaguuu

SEQ ID NO: 518247 - RNA, 19 nt, Homo sapiens
gaaaggcccugccaauguu

SEQ ID NO: 518248 - RNA, 19 nt, Homo sapiens
gaagagauguuagguaaau

SEQ ID NO: 518249 - RNA, 19 nt, Homo sapiens
gagcagaguuguaugagaa

SEQ ID NO: 518250 - RNA, 19 nt, Homo sapiens
gaaauguacuuccugaugu

SEQ ID NO: 518251 - RNA, 19 nt, Homo sapiens
gagauuaccuaagcaaauu

SEQ ID NO: 518252 - RNA, 19 nt, Homo sapiens
aagaagagauguuagguaa

SEQ ID NO: 518253 - RNA, 19 nt, Homo sapiens
ggacaagguugagaacaaa

SEQ ID NO: 518254 - RNA, 19 nt, Homo sapiens
aagagaagcuuguaugaga

SEQ ID NO: 518255 - RNA, 19 nt, Homo sapiens
gcccagacaugauugauga

SEQ ID NO: 518256 - RNA, 19 nt, Homo sapiens
gaaaggcuauccaguagag

SEQ ID NO: 518257 - RNA, 19 nt, Homo sapiens
aaagaaaggcuauccagua

SEQ ID NO: 518258 - RNA, 19 nt, Homo sapiens
ggaaaggcccugccaaugu

SEQ ID NO: 518259 - RNA, 19 nt, Homo sapiens
gagaacaaaucuaaugaag

SEQ ID NO: 518260 - RNA, 19 nt, Homo sapiens
gaggaucuguuaaaugguu

SEQ ID NO: 518261 - RNA, 19 nt, Homo sapiens
ggagaggucgauucuauuu

SEQ ID NO: 518262 - RNA, 19 nt, Homo sapiens
gaacguaaugaaagacuaa

SEQ ID NO: 518263 - RNA, 19 nt, Homo sapiens
ggaaaugaacaguuuaaga

SEQ ID NO: 518264 - RNA, 19 nt, Homo sapiens
gaagaagcccauuuguuga

SEQ ID NO: 518265 - RNA, 19 nt, Homo sapiens
ugaagaacguaaugaaaga

SEQ ID NO: 518266 - RNA, 19 nt, Homo sapiens
gaauuccucugaacuagau

SEQ ID NO: 518267 - RNA, 19 nt, Homo sapiens
gaugaagaauaccuaauag

SEQ ID NO: 518268 - RNA, 19 nt, Homo sapiens
ugaacuagaugaagaauac

SEQ ID NO: 518269 - RNA, 19 nt, Homo sapiens
gcugaaaguucuuauaguc

SEQ ID NO: 518270 - RNA, 19 nt, Homo sapiens
ugacugcagugccucauuu

SEQ ID NO: 518271 - RNA, 19 nt, Homo sapiens
agaaagaaauggccaucaa

SEQ ID NO: 518272 - RNA, 19 nt, Homo sapiens
gauuuccucugugguaaua

SEQ ID NO: 518273 - RNA, 19 nt, Homo sapiens
aaggagaggucgauucuau

SEQ ID NO: 518274 - RNA, 19 nt, Homo sapiens
gaagcugaaaguucuuaua

SEQ ID NO: 518275 - RNA, 19 nt, Homo sapiens
gaaccuaauuugauuucca

SEQ ID NO: 518276 - RNA, 19 nt, Homo sapiens
gcucguacuccaucaauuu

SEQ ID NO: 518277 - RNA, 19 nt, Homo sapiens
ggagagcagaguuguauga

SEQ ID NO: 518278 - RNA, 19 nt, Homo sapiens
gaugaaacaggacaagaaa

SEQ ID NO: 518279 - RNA, 19 nt, Homo sapiens
gauucuggcuguccuaugu

SEQ ID NO: 518280 - RNA, 19 nt, Homo sapiens
ggaugaaacaggacaagaa

SEQ ID NO: 518281 - RNA, 19 nt, Homo sapiens
gaaagaaauggccaucaau

SEQ ID NO: 518282 - RNA, 19 nt, Homo sapiens
gaagcugugagguucuuua

SEQ ID NO: 518283 - RNA, 19 nt, Homo sapiens
aaauguacuuccugaugua

SEQ ID NO: 518284 - RNA, 19 nt, Homo sapiens
aaagauccaucaauacauc

SEQ ID NO: 518285 - RNA, 19 nt, Homo sapiens
ccucugaacuagaugaaga

SEQ ID NO: 518286 - RNA, 19 nt, Homo sapiens
gaggagagcagaguuguau

SEQ ID NO: 518287 - RNA, 19 nt, Homo sapiens
gaagaggaguguuuucaug

SEQ ID NO: 518288 - RNA, 19 nt, Homo sapiens
aagaaaggcuauccaguag

SEQ ID NO: 518289 - RNA, 19 nt, Homo sapiens
ugaaacaggacaagaaaga

SEQ ID NO: 518290 - RNA, 19 nt, Homo sapiens
uaaaggaggagggaaauga

SEQ ID NO: 518291 - RNA, 19 nt, Homo sapiens
gaagaauaccuaauagaac

SEQ ID NO: 518292 - RNA, 19 nt, Homo sapiens
uaaaagaucuugggaacuu

SEQ ID NO: 518293 - RNA, 19 nt, Homo sapiens
guaagcugcucagggauga

SEQ ID NO: 518294 - RNA, 19 nt, Homo sapiens
aaacaggacaagaaagaaa

SEQ ID NO: 518295 - RNA, 19 nt, Homo sapiens
gaaacaggacaagaaagaa

SEQ ID NO: 518296 - RNA, 19 nt, Homo sapiens
ggaugaagagaaacagaaa

SEQ ID NO: 518297 - RNA, 19 nt, Homo sapiens
caugucggaugaagagaaa

SEQ ID NO: 518298 - RNA, 19 nt, Homo sapiens
cggacaagguugagaacaa

SEQ ID NO: 518299 - RNA, 19 nt, Homo sapiens
aaucagcauucccagagua

SEQ ID NO: 518300 - RNA, 19 nt, Homo sapiens
gcaaauugaagaacguaau

SEQ ID NO: 518301 - RNA, 19 nt, Homo sapiens
gaaauggccaucaaugacu

SEQ ID NO: 518302 - RNA, 19 nt, Homo sapiens
gguuacagauacucaggaa

SEQ ID NO: 518303 - RNA, 19 nt, Homo sapiens
gaagagaaacagaaaagaa

SEQ ID NO: 518304 - RNA, 19 nt, Homo sapiens
gagaagcuuguaugagauu

SEQ ID NO: 518305 - RNA, 19 nt, Homo sapiens
ugaaauguacuuccugaug

SEQ ID NO: 518306 - RNA, 19 nt, Homo sapiens
gaagagaagagagcacuag

SEQ ID NO: 518307 - RNA, 19 nt, Homo sapiens
aaagaagagauguuaggua

SEQ ID NO: 518308 - RNA, 19 nt, Homo sapiens
agagagcacuagacuaaag

SEQ ID NO: 518309 - RNA, 19 nt, Homo sapiens
aggcugaccuuccugauca

SEQ ID NO: 518310 - RNA, 19 nt, Homo sapiens
ccaggaagaagcccauuug

SEQ ID NO: 518311 - RNA, 19 nt, Homo sapiens
guuaaaugguuugaagguu

SEQ ID NO: 518312 - RNA, 19 nt, Homo sapiens
caaauugaagaacguaaug

SEQ ID NO: 518313 - RNA, 19 nt, Homo sapiens
gagaagagagcacuagacu

SEQ ID NO: 518314 - RNA, 19 nt, Homo sapiens
cuaaugaagaugugaauuc

SEQ ID NO: 518315 - RNA, 19 nt, Homo sapiens
gagcggacaagguugagaa

SEQ ID NO: 518316 - RNA, 19 nt, Homo sapiens
gguuugaagguuacagaua

SEQ ID NO: 518317 - RNA, 19 nt, Homo sapiens
cuggaagacuauaaaucua

SEQ ID NO: 518318 - RNA, 19 nt, Homo sapiens
aaagaaauggccaucaaug

SEQ ID NO: 518319 - RNA, 19 nt, Homo sapiens
uaaaugguuugaagguuac

SEQ ID NO: 518320 - RNA, 19 nt, Homo sapiens
gagggaaaugaacaguuua

SEQ ID NO: 518321 - RNA, 19 nt, Homo sapiens
gaugugaauuccucugaac

SEQ ID NO: 518322 - RNA, 19 nt, Homo sapiens
guugagaacaaaucuaaug

SEQ ID NO: 518323 - RNA, 19 nt, Homo sapiens
gggaaaggcccugccaaug

SEQ ID NO: 518324 - RNA, 19 nt, Homo sapiens
uguaugagauuaccuaagc

SEQ ID NO: 518325 - RNA, 19 nt, Homo sapiens
gcagaguuguaugagaaga

SEQ ID NO: 518326 - RNA, 19 nt, Homo sapiens
aagaaauggccaucaauga

SEQ ID NO: 518327 - RNA, 19 nt, Homo sapiens
guuugaagguuacagauac

SEQ ID NO: 518328 - RNA, 19 nt, Homo sapiens
ggagacugcccagacauga

SEQ ID NO: 518329 - RNA, 19 nt, Homo sapiens
ggagaagucagagaacugu

SEQ ID NO: 518330 - RNA, 19 nt, Homo sapiens
augaagcccuggaagacua

SEQ ID NO: 518331 - RNA, 19 nt, Homo sapiens
ugagaagacggacaagcua

SEQ ID NO: 518332 - RNA, 19 nt, Homo sapiens
gccaggagcggacaagguu

SEQ ID NO: 518333 - RNA, 19 nt, Homo sapiens
caucaaugacugcagcaaa

SEQ ID NO: 518334 - RNA, 19 nt, Homo sapiens
aaacaugucggaugaagag

SEQ ID NO: 518335 - RNA, 19 nt, Homo sapiens
gugaauuccucugaacuag

SEQ ID NO: 518336 - RNA, 19 nt, Homo sapiens
ccuccagcauuuccugauu

SEQ ID NO: 518337 - RNA, 19 nt, Homo sapiens
agaacguaaugaaagacua

SEQ ID NO: 518338 - RNA, 19 nt, Homo sapiens
ugagauuaccuaagcaaau

SEQ ID NO: 518339 - RNA, 19 nt, Homo sapiens
caauacaucaagcaagaga

SEQ ID NO: 518340 - RNA, 19 nt, Homo sapiens
caauuaaaccccagcuaua

SEQ ID NO: 518341 - RNA, 19 nt, Homo sapiens
agacggacaagcuagauga

SEQ ID NO: 518342 - RNA, 19 nt, Homo sapiens
gacuaaaggaggagggaaa

SEQ ID NO: 518343 - RNA, 19 nt, Homo sapiens
cuccagcauuuccugauuu

SEQ ID NO: 518344 - RNA, 19 nt, Homo sapiens
gaaacuagaugaugcaaua

SEQ ID NO: 518345 - RNA, 19 nt, Homo sapiens
ggaggcagcuugugaauuu

SEQ ID NO: 518346 - RNA, 19 nt, Homo sapiens
caagaaagcuuaucggaaa

SEQ ID NO: 518347 - RNA, 19 nt, Homo sapiens
ggaaggaaauuacaaacua

SEQ ID NO: 518348 - RNA, 19 nt, Homo sapiens
gaaagaagaugggaauaaa

SEQ ID NO: 518349 - RNA, 19 nt, Homo sapiens
ccaaagcacucaaagcaaa

SEQ ID NO: 518350 - RNA, 19 nt, Homo sapiens
caacaagaguucaagaaug

SEQ ID NO: 518351 - RNA, 19 nt, Homo sapiens
gaggaaagauuacuacaag

SEQ ID NO: 518352 - RNA, 19 nt, Homo sapiens
gaacacaaacagcuccuaa

SEQ ID NO: 518353 - RNA, 19 nt, Homo sapiens
gcaugaauaugggugauuu

SEQ ID NO: 518354 - RNA, 19 nt, Homo sapiens
gagaagagcucaguguuac

SEQ ID NO: 518355 - RNA, 19 nt, Homo sapiens
caaaugcagugaagcuuga

SEQ ID NO: 518356 - RNA, 19 nt, Homo sapiens
gaaggaaauuacaaacuag

SEQ ID NO: 518357 - RNA, 19 nt, Homo sapiens
cuaaugcagucauggaaua

SEQ ID NO: 518358 - RNA, 19 nt, Homo sapiens
gcuaaacucuacuguaauc

SEQ ID NO: 518359 - RNA, 19 nt, Homo sapiens
ggaccgugcccuagaauuu

SEQ ID NO: 518360 - RNA, 19 nt, Homo sapiens
acaaggaaaugcauacuau

SEQ ID NO: 518361 - RNA, 19 nt, Homo sapiens
gaacugaagaagaguaaga

SEQ ID NO: 518362 - RNA, 19 nt, Homo sapiens
gaagaagaguaagaggaaa

SEQ ID NO: 518363 - RNA, 19 nt, Homo sapiens
ggagugcgaugugguaaug

SEQ ID NO: 518364 - RNA, 19 nt, Homo sapiens
ccaagaaagauuacaauga

SEQ ID NO: 518365 - RNA, 19 nt, Homo sapiens
ggagaggccuuuacuaucc

SEQ ID NO: 518366 - RNA, 19 nt, Homo sapiens
agaguaagaggaaagauua

SEQ ID NO: 518367 - RNA, 19 nt, Homo sapiens
ucacucaguuuaaucuuga

SEQ ID NO: 518368 - RNA, 19 nt, Homo sapiens
gcagauucacucaguuuaa

SEQ ID NO: 518369 - RNA, 19 nt, Homo sapiens
augcuaaacucuacuguaa

SEQ ID NO: 518370 - RNA, 19 nt, Homo sapiens
ccucaaggcagaauguuua

SEQ ID NO: 518371 - RNA, 19 nt, Homo sapiens
gaaaauagcagaaacagau

SEQ ID NO: 518372 - RNA, 19 nt, Homo sapiens
ggaaagauuacuacaagau

SEQ ID NO: 518373 - RNA, 19 nt, Homo sapiens
ugagaaggcaguucaguuu

SEQ ID NO: 518374 - RNA, 19 nt, Homo sapiens
ggcagaauguuuagcaaug

SEQ ID NO: 518375 - RNA, 19 nt, Homo sapiens
cccuagaacuggaucauaa

SEQ ID NO: 518376 - RNA, 19 nt, Homo sapiens
gcuuagagcaguuucguuu

SEQ ID NO: 518377 - RNA, 19 nt, Homo sapiens
auagaagacugcacaaaug

SEQ ID NO: 518378 - RNA, 19 nt, Homo sapiens
caaacuagcauaugaacug

SEQ ID NO: 518379 - RNA, 19 nt, Homo sapiens
aaugcuagcuauuauggua

SEQ ID NO: 518380 - RNA, 19 nt, Homo sapiens
ccagagagcccuagaacug

SEQ ID NO: 518381 - RNA, 19 nt, Homo sapiens
gaugaggagggcaugaaua

SEQ ID NO: 518382 - RNA, 19 nt, Homo sapiens
acacagaacaguaugaaga

SEQ ID NO: 518383 - RNA, 19 nt, Homo sapiens
agaagaaguucaaggaagu

SEQ ID NO: 518384 - RNA, 19 nt, Homo sapiens
ggacacagaacaguaugaa

SEQ ID NO: 518385 - RNA, 19 nt, Homo sapiens
uuacgaagauuguauugag

SEQ ID NO: 518386 - RNA, 19 nt, Homo sapiens
ggagaagaaguucaaggaa

SEQ ID NO: 518387 - RNA, 19 nt, Homo sapiens
ugaagaagaguaagaggaa

SEQ ID NO: 518388 - RNA, 19 nt, Homo sapiens
agaaagaagaugggaauaa

SEQ ID NO: 518389 - RNA, 19 nt, Homo sapiens
guacgaggucuuugccuuu

SEQ ID NO: 518390 - RNA, 19 nt, Homo sapiens
cagauucacucaguuuaau

SEQ ID NO: 518391 - RNA, 19 nt, Homo sapiens
gaagggcaaccacccagaa

SEQ ID NO: 518392 - RNA, 19 nt, Homo sapiens
gaggagggcaugaauaugg

SEQ ID NO: 518393 - RNA, 19 nt, Homo sapiens
cgaggucuuugccuuuauu

SEQ ID NO: 518394 - RNA, 19 nt, Homo sapiens
gaauaugggugauuuugau

SEQ ID NO: 518395 - RNA, 19 nt, Homo sapiens
gaaguuggagaggccuuua

SEQ ID NO: 518396 - RNA, 19 nt, Homo sapiens
uacgaggucuuugccuuua

SEQ ID NO: 518397 - RNA, 19 nt, Homo sapiens
gcacaacaagaguucaaga

SEQ ID NO: 518398 - RNA, 19 nt, Homo sapiens
aagcagagacuuucaagga

SEQ ID NO: 518399 - RNA, 19 nt, Homo sapiens
gcaguacgagacuaugaaa

SEQ ID NO: 518400 - RNA, 19 nt, Homo sapiens
ggauagaccccaacaauau

SEQ ID NO: 518401 - RNA, 19 nt, Homo sapiens
ucaguuggaugcccugugu

SEQ ID NO: 518402 - RNA, 19 nt, Homo sapiens
gaagcuugaugacacuuac

SEQ ID NO: 518403 - RNA, 19 nt, Homo sapiens
ccgggaagcucuuggagau

SEQ ID NO: 518404 - RNA, 19 nt, Homo sapiens
ggacagggaggcagcuugu

SEQ ID NO: 518405 - RNA, 19 nt, Homo sapiens
cauaaaagccuacuugaga

SEQ ID NO: 518406 - RNA, 19 nt, Homo sapiens
acgguuaauuccaagcuua

SEQ ID NO: 518407 - RNA, 19 nt, Homo sapiens
gaaugcuaaugcagucaug

SEQ ID NO: 518408 - RNA, 19 nt, Homo sapiens
gaaguucaaggaaguugga

SEQ ID NO: 518409 - RNA, 19 nt, Homo sapiens
agaaggaggaggagaagaa

SEQ ID NO: 518410 - RNA, 19 nt, Homo sapiens
gcacaaaugcagugaagcu

SEQ ID NO: 518411 - RNA, 19 nt, Homo sapiens
aaagaaagaagaugggaau

SEQ ID NO: 518412 - RNA, 19 nt, Homo sapiens
guucaagaaugcuaaugca

SEQ ID NO: 518413 - RNA, 19 nt, Homo sapiens
gagguuggaugacaguuuu

SEQ ID NO: 518414 - RNA, 19 nt, Homo sapiens
gaagagcucaguguuacau

SEQ ID NO: 518415 - RNA, 19 nt, Homo sapiens
gcuagugacauucuacgaa

SEQ ID NO: 518416 - RNA, 19 nt, Homo sapiens
gaagaaguucaaggaaguu

SEQ ID NO: 518417 - RNA, 19 nt, Homo sapiens
gaagaugggaauaaagcau

SEQ ID NO: 518418 - RNA, 19 nt, Homo sapiens
ucaaagcaaagaaagaaga

SEQ ID NO: 518419 - RNA, 19 nt, Homo sapiens
cauggaccgugcccuagaa

SEQ ID NO: 518420 - RNA, 19 nt, Homo sapiens
gagcaaagggaaccaaugc

SEQ ID NO: 518421 - RNA, 19 nt, Homo sapiens
ucagugagguuggaugaca

SEQ ID NO: 518422 - RNA, 19 nt, Homo sapiens
aaaugcagauucacucagu

SEQ ID NO: 518423 - RNA, 19 nt, Homo sapiens
ggaaacgggccuugaugca

SEQ ID NO: 518424 - RNA, 19 nt, Homo sapiens
gaagagggaagcagagacu

SEQ ID NO: 518425 - RNA, 19 nt, Homo sapiens
aauagaagacugcacaaau

SEQ ID NO: 518426 - RNA, 19 nt, Homo sapiens
acuagaugaugcaauagaa

SEQ ID NO: 518427 - RNA, 19 nt, Homo sapiens
gcagaauguuuagcaaugc

SEQ ID NO: 518428 - RNA, 19 nt, Homo sapiens
agaugggaauaaagcauuu

SEQ ID NO: 518429 - RNA, 19 nt, Homo sapiens
gcacucaaagcaaagaaag

SEQ ID NO: 518430 - RNA, 19 nt, Homo sapiens
cugcagaaaugccaaagca

SEQ ID NO: 518431 - RNA, 19 nt, Homo sapiens
aacaagaguucaagaaugc

SEQ ID NO: 518432 - RNA, 19 nt, Homo sapiens
gcaagugccaccucucucu

SEQ ID NO: 518433 - RNA, 19 nt, Homo sapiens
gagcagccaccuugaugau

SEQ ID NO: 518434 - RNA, 19 nt, Homo sapiens
gauccaaacaauaucuuca

SEQ ID NO: 518435 - RNA, 19 nt, Homo sapiens
caauagaagacugcacaaa

SEQ ID NO: 518436 - RNA, 19 nt, Homo sapiens
gauagaccccaacaauaua

SEQ ID NO: 518437 - RNA, 19 nt, Homo sapiens
ggaacaaggaaaugcauac

SEQ ID NO: 518438 - RNA, 19 nt, Homo sapiens
caagaguucaagaaugcua

SEQ ID NO: 518439 - RNA, 19 nt, Homo sapiens
uaucuucaaggcauucuuu

SEQ ID NO: 518440 - RNA, 19 nt, Homo sapiens
ggagcaaagggaaccaaug

SEQ ID NO: 518441 - RNA, 19 nt, Homo sapiens
ggaagcagagacuuucaag

SEQ ID NO: 518442 - RNA, 19 nt, Homo sapiens
gaagaagcaguacgagacu

SEQ ID NO: 518443 - RNA, 19 nt, Homo sapiens
cuugaugacacuuacauaa

SEQ ID NO: 518444 - RNA, 19 nt, Homo sapiens
gaaaggaaaugaagaguuu

SEQ ID NO: 518445 - RNA, 19 nt, Homo sapiens
gcacugagcuugcugguuu

SEQ ID NO: 518446 - RNA, 19 nt, Homo sapiens
gaaagaaacuguagacaau

SEQ ID NO: 518447 - RNA, 19 nt, Homo sapiens
gaaggaagcccguuguuua

SEQ ID NO: 518448 - RNA, 19 nt, Homo sapiens
caaagaaaguugcuaauga

SEQ ID NO: 518449 - RNA, 19 nt, Homo sapiens
gaaauauggucacaaacua

SEQ ID NO: 518450 - RNA, 19 nt, Homo sapiens
gcaacacacuuacaaauga

SEQ ID NO: 518451 - RNA, 19 nt, Homo sapiens
gaaaucagcaacacacuua

SEQ ID NO: 518452 - RNA, 19 nt, Homo sapiens
gcaaauaaggauccaauua

SEQ ID NO: 518453 - RNA, 19 nt, Homo sapiens
uaaauuaucuggagagaga

SEQ ID NO: 518454 - RNA, 19 nt, Homo sapiens
gggaauaucuguaaaguca

SEQ ID NO: 518455 - RNA, 19 nt, Homo sapiens
agaagaaacucgacagaua

SEQ ID NO: 518456 - RNA, 19 nt, Homo sapiens
ggaagcccguuguuuaaua

SEQ ID NO: 518457 - RNA, 19 nt, Homo sapiens
ucacaaagcuaaauacaug

SEQ ID NO: 518458 - RNA, 19 nt, Homo sapiens
guaaacagguuaacuuaga

SEQ ID NO: 518459 - RNA, 19 nt, Homo sapiens
gaguagagauggugaauau

SEQ ID NO: 518460 - RNA, 19 nt, Homo sapiens
ccucaaagauucugcauuu

SEQ ID NO: 518461 - RNA, 19 nt, Homo sapiens
gaaagaggauuaugaagag

SEQ ID NO: 518462 - RNA, 19 nt, Homo sapiens
gaaaguugcuaaugauuca

SEQ ID NO: 518463 - RNA, 19 nt, Homo sapiens
gggcauagguuccaaguau

SEQ ID NO: 518464 - RNA, 19 nt, Homo sapiens
gaggaggacuuaagagaaa

SEQ ID NO: 518465 - RNA, 19 nt, Homo sapiens
gaauacaaguaccacauaa

SEQ ID NO: 518466 - RNA, 19 nt, Homo sapiens
gaacauccguugaaugagu

SEQ ID NO: 518467 - RNA, 19 nt, Homo sapiens
gcaguaugcugacaagauu

SEQ ID NO: 518468 - RNA, 19 nt, Homo sapiens
ugacucagcuuuacuguga

SEQ ID NO: 518469 - RNA, 19 nt, Homo sapiens
gcaccuauauuuacuacuu

SEQ ID NO: 518470 - RNA, 19 nt, Homo sapiens
guacauaacuucagauacu

SEQ ID NO: 518471 - RNA, 19 nt, Homo sapiens
gaaggagagugaaguguau

SEQ ID NO: 518472 - RNA, 19 nt, Homo sapiens
ggaaagaggauuaugaaga

SEQ ID NO: 518473 - RNA, 19 nt, Homo sapiens
gcucugaggaugcaaauua

SEQ ID NO: 518474 - RNA, 19 nt, Homo sapiens
gcacaggccuuuacagagu

SEQ ID NO: 518475 - RNA, 19 nt, Homo sapiens
ggaaagagagccacuauuc

SEQ ID NO: 518476 - RNA, 19 nt, Homo sapiens
ggaagaagcucugaauugg

SEQ ID NO: 518477 - RNA, 19 nt, Homo sapiens
gaagugauagguacaagua

SEQ ID NO: 518478 - RNA, 19 nt, Homo sapiens
gaacauaauacaccaagaa

SEQ ID NO: 518479 - RNA, 19 nt, Homo sapiens
gcuauucucugauaacuau

SEQ ID NO: 518480 - RNA, 19 nt, Homo sapiens
cuuagaagcucacgccuua

SEQ ID NO: 518481 - RNA, 19 nt, Homo sapiens
gaaauuguccaaagaguga

SEQ ID NO: 518482 - RNA, 19 nt, Homo sapiens
gcauagugcuuuagaugaa

SEQ ID NO: 518483 - RNA, 19 nt, Homo sapiens
ugagaaauauggucacaaa

SEQ ID NO: 518484 - RNA, 19 nt, Homo sapiens
uaaagaugcuguuagagaa

SEQ ID NO: 518485 - RNA, 19 nt, Homo sapiens
ggaaggagaacuaaugaaa

SEQ ID NO: 518486 - RNA, 19 nt, Homo sapiens
gaaaggacaagaggacuua

SEQ ID NO: 518487 - RNA, 19 nt, Homo sapiens
uaauauggcugcuagaaga

SEQ ID NO: 518488 - RNA, 19 nt, Homo sapiens
uaaauaagaugcccuugau

SEQ ID NO: 518489 - RNA, 19 nt, Homo sapiens
gccaggagauugagaauau

SEQ ID NO: 518490 - RNA, 19 nt, Homo sapiens
caacaacugucagaauaaa

SEQ ID NO: 518491 - RNA, 19 nt, Homo sapiens
gaugagcacuguggaaauu

SEQ ID NO: 518492 - RNA, 19 nt, Homo sapiens
gagaagcugugucuuuaga

SEQ ID NO: 518493 - RNA, 19 nt, Homo sapiens
gggaauuguuucuuucuaa

SEQ ID NO: 518494 - RNA, 19 nt, Homo sapiens
uaacuuggcccacgaguaa

SEQ ID NO: 518495 - RNA, 19 nt, Homo sapiens
gcaaguuccugugaaauau

SEQ ID NO: 518496 - RNA, 19 nt, Homo sapiens
uaacugauccagacuuuaa

SEQ ID NO: 518497 - RNA, 19 nt, Homo sapiens
caaagggucauuaucguua

SEQ ID NO: 518498 - RNA, 19 nt, Homo sapiens
uggaagauauuguggauuu

SEQ ID NO: 518499 - RNA, 19 nt, Homo sapiens
gugaaggugucauuucuaa

SEQ ID NO: 518500 - RNA, 19 nt, Homo sapiens
ggaaaaggaacaugaauua

SEQ ID NO: 518501 - RNA, 19 nt, Homo sapiens
ggugucauuucuaagauua

SEQ ID NO: 518502 - RNA, 19 nt, Homo sapiens
gagagaugauacugacuuu

SEQ ID NO: 518503 - RNA, 19 nt, Homo sapiens
gugaauacuuugaugauug

SEQ ID NO: 518504 - RNA, 19 nt, Homo sapiens
ugaagacccuugugcauug

SEQ ID NO: 518505 - RNA, 19 nt, Homo sapiens
ggaaggagagugaagugua

SEQ ID NO: 518506 - RNA, 19 nt, Homo sapiens
ugagugagcuuaaagaagu

SEQ ID NO: 518507 - RNA, 19 nt, Homo sapiens
gaaggugucauuucuaaga

SEQ ID NO: 518508 - RNA, 19 nt, Homo sapiens
cuacaaggaauaugucuua

SEQ ID NO: 518509 - RNA, 19 nt, Homo sapiens
gaagcccguuguuuaauau

SEQ ID NO: 518510 - RNA, 19 nt, Homo sapiens
gaaauuuguugaagaaugc

SEQ ID NO: 518511 - RNA, 19 nt, Homo sapiens
gaagaacacuuggccaaag

SEQ ID NO: 518512 - RNA, 19 nt, Homo sapiens
acagguaucuuggaacaua

SEQ ID NO: 518513 - RNA, 19 nt, Homo sapiens
ggagucaggauuuagguua

SEQ ID NO: 518514 - RNA, 19 nt, Homo sapiens
gaaggaaagcaacuugauu

SEQ ID NO: 518515 - RNA, 19 nt, Homo sapiens
ugucuuugcugcugaauuu

SEQ ID NO: 518516 - RNA, 19 nt, Homo sapiens
ggagacauguaaacagguu

SEQ ID NO: 518517 - RNA, 19 nt, Homo sapiens
uccaacaacugucagaaua

SEQ ID NO: 518518 - RNA, 19 nt, Homo sapiens
ugaaauguauacccagaaa

SEQ ID NO: 518519 - RNA, 19 nt, Homo sapiens
cgacaauucuucuagacaa

SEQ ID NO: 518520 - RNA, 19 nt, Homo sapiens
gcaagagcuagaaguaaua

SEQ ID NO: 518521 - RNA, 19 nt, Homo sapiens
ggcaagagcuagaaguaau

SEQ ID NO: 518522 - RNA, 19 nt, Homo sapiens
gaauugcugugaagauuag

SEQ ID NO: 518523 - RNA, 19 nt, Homo sapiens
guacguaucuuccuuucca

SEQ ID NO: 518524 - RNA, 19 nt, Homo sapiens
ccagagccauugaauauag

SEQ ID NO: 518525 - RNA, 19 nt, Homo sapiens
ugacauggagucugauaua

SEQ ID NO: 518526 - RNA, 19 nt, Homo sapiens
gcagagguauccguacuug

SEQ ID NO: 518527 - RNA, 19 nt, Homo sapiens
gagacaaguucccagcauu

SEQ ID NO: 518528 - RNA, 19 nt, Homo sapiens
ugacagaauucuacagugu

SEQ ID NO: 518529 - RNA, 19 nt, Homo sapiens
aaaguuagcacaagaaaga

SEQ ID NO: 518530 - RNA, 19 nt, Homo sapiens
gaagugccauggauauucu

SEQ ID NO: 518531 - RNA, 19 nt, Homo sapiens
cagaguugcugaacgguuu

SEQ ID NO: 518532 - RNA, 19 nt, Homo sapiens
cuacuucacuuaacuuugu

SEQ ID NO: 518533 - RNA, 19 nt, Homo sapiens
ucagcagcauguaaaguua

SEQ ID NO: 518534 - RNA, 19 nt, Homo sapiens
gaauuugacaucugcagua

SEQ ID NO: 518535 - RNA, 19 nt, Homo sapiens
cuauguagcuauucucuga

SEQ ID NO: 518536 - RNA, 19 nt, Homo sapiens
ugugaguucugaugucuua

SEQ ID NO: 518537 - RNA, 19 nt, Homo sapiens
ccauuucucuccaacauga

SEQ ID NO: 518538 - RNA, 19 nt, Homo sapiens
ugagguggguggcuucuuu

SEQ ID NO: 518539 - RNA, 19 nt, Homo sapiens
aaaggagcaccaaguauua

SEQ ID NO: 518540 - RNA, 19 nt, Homo sapiens
gaauaucuguaaagucaca

SEQ ID NO: 518541 - RNA, 19 nt, Homo sapiens
ggaaagcaacuugauuauu

SEQ ID NO: 518542 - RNA, 19 nt, Homo sapiens
cauaacugauccagacuuu

SEQ ID NO: 518543 - RNA, 19 nt, Homo sapiens
cuacacaccuaggaguuua

SEQ ID NO: 518544 - RNA, 19 nt, Homo sapiens
gcaaauagaugccaaagag

SEQ ID NO: 518545 - RNA, 19 nt, Homo sapiens
gaagaugccuugaggugaa

SEQ ID NO: 518546 - RNA, 19 nt, Homo sapiens
ggagaaagguguaccagau

SEQ ID NO: 518547 - RNA, 19 nt, Homo sapiens
caugaggacuccagguuua

SEQ ID NO: 518548 - RNA, 19 nt, Homo sapiens
gggcaaugauuacuuuaaa

SEQ ID NO: 518549 - RNA, 19 nt, Homo sapiens
gaggaaagccaacuugaaa

SEQ ID NO: 518550 - RNA, 19 nt, Homo sapiens
caccagagguacuuuguaa

SEQ ID NO: 518551 - RNA, 19 nt, Homo sapiens
gaacaggccaagaccuaua

SEQ ID NO: 518552 - RNA, 19 nt, Homo sapiens
gaaccuagcacaccugaau

SEQ ID NO: 518553 - RNA, 19 nt, Homo sapiens
ggaguccagugcuuucuuu

SEQ ID NO: 518554 - RNA, 19 nt, Homo sapiens
gccaagaccuauaaagaug

SEQ ID NO: 518555 - RNA, 19 nt, Homo sapiens
ggacagggcagaacuauac

SEQ ID NO: 518556 - RNA, 19 nt, Homo sapiens
gagaaagguguaccagaua

SEQ ID NO: 518557 - RNA, 19 nt, Homo sapiens
ggaaucagaaugaggcuuu

SEQ ID NO: 518558 - RNA, 19 nt, Homo sapiens
ggaaagccaacuugaaaga

SEQ ID NO: 518559 - RNA, 19 nt, Homo sapiens
gaaucagaaugaggcuuua

SEQ ID NO: 518560 - RNA, 19 nt, Homo sapiens
aaagccaacuugaaagaaa

SEQ ID NO: 518561 - RNA, 19 nt, Homo sapiens
ugagggcaaugauuacuuu

SEQ ID NO: 518562 - RNA, 19 nt, Homo sapiens
gaagaaaugugcagauccu

SEQ ID NO: 518563 - RNA, 19 nt, Homo sapiens
gcaggaaagccacaucuug

SEQ ID NO: 518564 - RNA, 19 nt, Homo sapiens
ucacuuuccucaguugaua

SEQ ID NO: 518565 - RNA, 19 nt, Homo sapiens
ugacaugauucugaacuuu

SEQ ID NO: 518566 - RNA, 19 nt, Homo sapiens
cagacaagcugaagcgaau

SEQ ID NO: 518567 - RNA, 19 nt, Homo sapiens
ccagugacaugauucugaa

SEQ ID NO: 518568 - RNA, 19 nt, Homo sapiens
gugcagauccugauuugaa

SEQ ID NO: 518569 - RNA, 19 nt, Homo sapiens
aagaugagggcaaugauua

SEQ ID NO: 518570 - RNA, 19 nt, Homo sapiens
ggucuucacuuuccucagu

SEQ ID NO: 518571 - RNA, 19 nt, Homo sapiens
gaugagggacugcaaauag

SEQ ID NO: 518572 - RNA, 19 nt, Homo sapiens
ccucaaagcaauaauaaga

SEQ ID NO: 518573 - RNA, 19 nt, Homo sapiens
gagagacccuggccucaag

SEQ ID NO: 518574 - RNA, 19 nt, Homo sapiens
gccaugauguccuuggauu

SEQ ID NO: 518575 - RNA, 19 nt, Homo sapiens
guucugcucucaaugaugu

SEQ ID NO: 518576 - RNA, 19 nt, Homo sapiens
uaaagaccguacaaacuca

SEQ ID NO: 518577 - RNA, 19 nt, Homo sapiens
ugaaucagcuggacauacu

SEQ ID NO: 518578 - RNA, 19 nt, Homo sapiens
acugaaggcuuaaagaaga

SEQ ID NO: 518579 - RNA, 19 nt, Homo sapiens
cauguuggguuguuacaga

SEQ ID NO: 518580 - RNA, 19 nt, Homo sapiens
aaacaaacaaugcauagga

SEQ ID NO: 518581 - RNA, 19 nt, Homo sapiens
gcacaucuacacacaaaca

SEQ ID NO: 518582 - RNA, 19 nt, Homo sapiens
gaaggcagggcaucagcua

SEQ ID NO: 518583 - RNA, 19 nt, Homo sapiens
ugaaugcuguccuuuauac

SEQ ID NO: 518584 - RNA, 19 nt, Homo sapiens
gccgugaacuggugugaug

SEQ ID NO: 518585 - RNA, 19 nt, Homo sapiens
gcuugucuccagucaauua

SEQ ID NO: 518586 - RNA, 19 nt, Homo sapiens
gacaguggccucuugaguu

SEQ ID NO: 518587 - RNA, 19 nt, Homo sapiens
gaaagccaacuugaaagaa

SEQ ID NO: 518588 - RNA, 19 nt, Homo sapiens
ugucuccagucaauuauuu

SEQ ID NO: 518589 - RNA, 19 nt, Homo sapiens
gaguuuauccauccugaaa

SEQ ID NO: 518590 - RNA, 19 nt, Homo sapiens
uaccagauacgaugacuaa

SEQ ID NO: 518591 - RNA, 19 nt, Homo sapiens
ccaccucaaagcaauaaua

SEQ ID NO: 518592 - RNA, 19 nt, Homo sapiens
aguacuaucugggcaauuu

SEQ ID NO: 518593 - RNA, 19 nt, Homo sapiens
gagagcgccaucagaaauu

SEQ ID NO: 518594 - RNA, 19 nt, Homo sapiens
ggccucaaguuauuucaug

SEQ ID NO: 518595 - RNA, 19 nt, Homo sapiens
cugcacaucuacacacaaa

SEQ ID NO: 518596 - RNA, 19 nt, Homo sapiens
gaauaucaggcucucagaa

SEQ ID NO: 518597 - RNA, 19 nt, Homo sapiens
caucaaggcuaggaauauc

SEQ ID NO: 518598 - RNA, 19 nt, Homo sapiens
gaaaugugcagauccugau

SEQ ID NO: 518599 - RNA, 19 nt, Homo sapiens
gcaccagagguacuuugua

SEQ ID NO: 518600 - RNA, 19 nt, Homo sapiens
ggaaaugagggcuaaagca

SEQ ID NO: 518601 - RNA, 19 nt, Homo sapiens
acaguggccucuugaguuc

SEQ ID NO: 518602 - RNA, 19 nt, Homo sapiens
cccuggaucuccucccuua

SEQ ID NO: 518603 - RNA, 19 nt, Homo sapiens
uaauuuggaggucuacuuu

SEQ ID NO: 518604 - RNA, 19 nt, Homo sapiens
aaauagaugccaaagagaa

SEQ ID NO: 518605 - RNA, 19 nt, Homo sapiens
ggccaagaccuauaaagau

SEQ ID NO: 518606 - RNA, 19 nt, Homo sapiens
ggacaguggccucuugagu

SEQ ID NO: 518607 - RNA, 19 nt, Homo sapiens
caaacaaugcauaggauuc

SEQ ID NO: 518608 - RNA, 19 nt, Homo sapiens
caaacucagauccuuggua

SEQ ID NO: 518609 - RNA, 19 nt, Homo sapiens
cgagagcgccaucagaaau

SEQ ID NO: 518610 - RNA, 19 nt, Homo sapiens
ggagaggaaucagaaugag

SEQ ID NO: 518611 - RNA, 19 nt, Homo sapiens
gaauugaacagagggaugu

SEQ ID NO: 518612 - RNA, 19 nt, Homo sapiens
ggcaucagcuauggaacaa

SEQ ID NO: 518613 - RNA, 19 nt, Homo sapiens
agaaggagaggaaucagaa

SEQ ID NO: 518614 - RNA, 19 nt, Homo sapiens
acagagggaugugaggaaa

SEQ ID NO: 518615 - RNA, 19 nt, Homo sapiens
uuugaaugcuguccuuuau

SEQ ID NO: 518616 - RNA, 19 nt, Homo sapiens
acacugaaggcuuaaagaa

SEQ ID NO: 518617 - RNA, 19 nt, Homo sapiens
acaucuugcucugcauuua

SEQ ID NO: 518618 - RNA, 19 nt, Homo sapiens
gcacagagggaagccaugu

SEQ ID NO: 518619 - RNA, 19 nt, Homo sapiens
cauaggauuccaaggcuuu

SEQ ID NO: 518620 - RNA, 19 nt, Homo sapiens
uggcuugucuccagucaau

SEQ ID NO: 518621 - RNA, 19 nt, Homo sapiens
caccucaaagcaauaauaa

SEQ ID NO: 518622 - RNA, 19 nt, Homo sapiens
ugugacagcugccagaaag

SEQ ID NO: 518623 - RNA, 19 nt, Homo sapiens
ggcaggaucccaccucaga

SEQ ID NO: 518624 - RNA, 19 nt, Homo sapiens
gaaggucuaggugagcuuu

SEQ ID NO: 518625 - RNA, 19 nt, Homo sapiens
ggcaaugauuacuuuaaag

SEQ ID NO: 518626 - RNA, 19 nt, Homo sapiens
guuggguuguuacagagua

SEQ ID NO: 518627 - RNA, 19 nt, Homo sapiens
cuauaaagaugagggcaau

SEQ ID NO: 518628 - RNA, 19 nt, Homo sapiens
cacaaacaaacaaugcaua

SEQ ID NO: 518629 - RNA, 19 nt, Homo sapiens
aaagaugagggcaaugauu

SEQ ID NO: 518630 - RNA, 19 nt, Homo sapiens
gggcagcagcacaguacua

SEQ ID NO: 518631 - RNA, 19 nt, Homo sapiens
aagaagaaaugugcagauc

SEQ ID NO: 518632 - RNA, 19 nt, Homo sapiens
aagaacaggccaagaccua

SEQ ID NO: 518633 - RNA, 19 nt, Homo sapiens
uauaaagaccguacaaacu

SEQ ID NO: 518634 - RNA, 19 nt, Homo sapiens
gacccuggccucaaguuau

SEQ ID NO: 518635 - RNA, 19 nt, Homo sapiens
uguggaguuugacaccuua

SEQ ID NO: 518636 - RNA, 19 nt, Homo sapiens
gaggacuccagguuuauug

SEQ ID NO: 518637 - RNA, 19 nt, Homo sapiens
ucucagaagcugccuguga

SEQ ID NO: 518638 - RNA, 19 nt, Homo sapiens
ugaggaaagccaacuugaa

SEQ ID NO: 518639 - RNA, 19 nt, Homo sapiens
caaauagaugccaaagaga

SEQ ID NO: 518640 - RNA, 19 nt, Homo sapiens
ccaauuuucuucaucuuug

SEQ ID NO: 518641 - RNA, 19 nt, Homo sapiens
gugacaugauucugaacuu

SEQ ID NO: 518642 - RNA, 19 nt, Homo sapiens
agaaagguguaccagauac

SEQ ID NO: 518643 - RNA, 19 nt, Homo sapiens
ggaggucuacuuugaggau

SEQ ID NO: 518644 - RNA, 19 nt, Homo sapiens
gaacagaaguuaccaagaa

SEQ ID NO: 518645 - RNA, 19 nt, Homo sapiens
gaaauuggaugcaguguaa

SEQ ID NO: 518646 - RNA, 19 nt, Homo sapiens
gaaaguugccuaucaauug

SEQ ID NO: 518647 - RNA, 19 nt, Homo sapiens
caaagaagauguucgaugu

SEQ ID NO: 518648 - RNA, 19 nt, Homo sapiens
gcugaaagcugucuauguu

SEQ ID NO: 518649 - RNA, 19 nt, Homo sapiens
gaaaggauguugauguugu

SEQ ID NO: 518650 - RNA, 19 nt, Homo sapiens
guacaaagaagaagucuaa

SEQ ID NO: 518651 - RNA, 19 nt, Homo sapiens
ggaagcagguguuacaguu

SEQ ID NO: 518652 - RNA, 19 nt, Homo sapiens
caucuuacguucaaacuaa

SEQ ID NO: 518653 - RNA, 19 nt, Homo sapiens
gagauacucguuuagauua

SEQ ID NO: 518654 - RNA, 19 nt, Homo sapiens
ggaaagaccucagaaacau

SEQ ID NO: 518655 - RNA, 19 nt, Homo sapiens
gcaagaggcgccaagguua

SEQ ID NO: 518656 - RNA, 19 nt, Homo sapiens
cagaagcccugcacaguaa

SEQ ID NO: 518657 - RNA, 19 nt, Homo sapiens
gagcauagaacagaaguua

SEQ ID NO: 518658 - RNA, 19 nt, Homo sapiens
gaaugaacagucucaaaua

SEQ ID NO: 518659 - RNA, 19 nt, Homo sapiens
gggcauaucuuggguagaa

SEQ ID NO: 518660 - RNA, 19 nt, Homo sapiens
gagaagauauagugcuuug

SEQ ID NO: 518661 - RNA, 19 nt, Homo sapiens
ggacugauaugcaggaauc

SEQ ID NO: 518662 - RNA, 19 nt, Homo sapiens
ggaagaaggugugaaaucu

SEQ ID NO: 518663 - RNA, 19 nt, Homo sapiens
aaaggaagcuuacgucugu

SEQ ID NO: 518664 - RNA, 19 nt, Homo sapiens
gaaauagacugggaagauc

SEQ ID NO: 518665 - RNA, 19 nt, Homo sapiens
aaucaaggcugucgaagaa

SEQ ID NO: 518666 - RNA, 19 nt, Homo sapiens
gaucagcagucaaagaaau

SEQ ID NO: 518667 - RNA, 19 nt, Homo sapiens
caaagaagaagucuaagaa

SEQ ID NO: 518668 - RNA, 19 nt, Homo sapiens
ccuggaaacuuauauacua

SEQ ID NO: 518669 - RNA, 19 nt, Homo sapiens
guuagaaccugcaaaugaa

SEQ ID NO: 518670 - RNA, 19 nt, Homo sapiens
gaaauccacacuccaguuu

SEQ ID NO: 518671 - RNA, 19 nt, Homo sapiens
gcacaaggugucgcuauua

SEQ ID NO: 518672 - RNA, 19 nt, Homo sapiens
ugaugaaacuccacaacua

SEQ ID NO: 518673 - RNA, 19 nt, Homo sapiens
gaucaucgacuaccuuuau

SEQ ID NO: 518674 - RNA, 19 nt, Homo sapiens
gaaacauucccacgaaauu

SEQ ID NO: 518675 - RNA, 19 nt, Homo sapiens
ggagauacucguuuagauu

SEQ ID NO: 518676 - RNA, 19 nt, Homo sapiens
gaaggagaaucaagcagau

SEQ ID NO: 518677 - RNA, 19 nt, Homo sapiens
uaagucacaugcacauaaa

SEQ ID NO: 518678 - RNA, 19 nt, Homo sapiens
uagaaaggauguugauguu

SEQ ID NO: 518679 - RNA, 19 nt, Homo sapiens
ucaaauaacuaggaggaaa

SEQ ID NO: 518680 - RNA, 19 nt, Homo sapiens
ucagaaacauucccacgaa

SEQ ID NO: 518681 - RNA, 19 nt, Homo sapiens
agacaagcccagaauaaua

SEQ ID NO: 518682 - RNA, 19 nt, Homo sapiens
ccaagaggaugacuaaugg

SEQ ID NO: 518683 - RNA, 19 nt, Homo sapiens
gaagauauagugcuuugga

SEQ ID NO: 518684 - RNA, 19 nt, Homo sapiens
gaagaaggugugaaaucua

SEQ ID NO: 518685 - RNA, 19 nt, Homo sapiens
cguaaagccuagaaucaaa

SEQ ID NO: 518686 - RNA, 19 nt, Homo sapiens
gaaggaggaggacauagaa

SEQ ID NO: 518687 - RNA, 19 nt, Homo sapiens
ucacagaucagcagucaaa

SEQ ID NO: 518688 - RNA, 19 nt, Homo sapiens
gaagacgauuggugagaug

SEQ ID NO: 518689 - RNA, 19 nt, Homo sapiens
cacaaggugucgcuauuaa

SEQ ID NO: 518690 - RNA, 19 nt, Homo sapiens
uaaccaagaggaugacuaa

SEQ ID NO: 518691 - RNA, 19 nt, Homo sapiens
gacaagcccagaauaauau

SEQ ID NO: 518692 - RNA, 19 nt, Homo sapiens
ggaagacgauuggugagau

SEQ ID NO: 518693 - RNA, 19 nt, Homo sapiens
aaaaggagauacucguuua

SEQ ID NO: 518694 - RNA, 19 nt, Homo sapiens
gcugaagauuccgaaauaa

SEQ ID NO: 518695 - RNA, 19 nt, Homo sapiens
ccaguaaccgggaauauga

SEQ ID NO: 518696 - RNA, 19 nt, Homo sapiens
gauguuguuuguguugaua

SEQ ID NO: 518697 - RNA, 19 nt, Homo sapiens
gaacagucucaaauaacua

SEQ ID NO: 518698 - RNA, 19 nt, Homo sapiens
cgaaggagauacugagaag

SEQ ID NO: 518699 - RNA, 19 nt, Homo sapiens
ggccaugccugaaggauca

SEQ ID NO: 518700 - RNA, 19 nt, Homo sapiens
ggguagaaguagaagcuaa

SEQ ID NO: 518701 - RNA, 19 nt, Homo sapiens
gauggaagaaggugugaaa

SEQ ID NO: 518702 - RNA, 19 nt, Homo sapiens
uggugaaacugcaggaaua

SEQ ID NO: 518703 - RNA, 19 nt, Homo sapiens
ggaacgguuuaaggaauuu

SEQ ID NO: 518704 - RNA, 19 nt, Homo sapiens
gaaagaccucagaaacauu

SEQ ID NO: 518705 - RNA, 19 nt, Homo sapiens
gaaggcaguacagcucuua

SEQ ID NO: 518706 - RNA, 19 nt, Homo sapiens
gggcugauaugcaggaauc

SEQ ID NO: 518707 - RNA, 19 nt, Homo sapiens
ugaagacgauagugaagga

SEQ ID NO: 518708 - RNA, 19 nt, Homo sapiens
caagaaagccuaaaacaga

SEQ ID NO: 518709 - RNA, 19 nt, Homo sapiens
ggauguugauguuguuugu

SEQ ID NO: 518710 - RNA, 19 nt, Homo sapiens
ugagacgacucuaccuuug

SEQ ID NO: 518711 - RNA, 19 nt, Homo sapiens
ucugaaacccggaaacuaa

SEQ ID NO: 518712 - RNA, 19 nt, Homo sapiens
gagcaaagaagauguucga

SEQ ID NO: 518713 - RNA, 19 nt, Homo sapiens
ggaguucauuccuaacauc

SEQ ID NO: 518714 - RNA, 19 nt, Homo sapiens
gcccugcacaguaaaguua

SEQ ID NO: 518715 - RNA, 19 nt, Homo sapiens
aaaguugccuaucaauugu

SEQ ID NO: 518716 - RNA, 19 nt, Homo sapiens
cagaaacauucccacgaaa

SEQ ID NO: 518717 - RNA, 19 nt, Homo sapiens
gauguaccauucucuccuu

SEQ ID NO: 518718 - RNA, 19 nt, Homo sapiens
ccaaucaccaggaauuuga

SEQ ID NO: 518719 - RNA, 19 nt, Homo sapiens
ccaaucaccaggaauuuga

SEQ ID NO: 518720 - RNA, 19 nt, Homo sapiens
gggcuuggaugaugaaacu

SEQ ID NO: 518721 - RNA, 19 nt, Homo sapiens
ucagaagcccugcacagua

SEQ ID NO: 518722 - RNA, 19 nt, Homo sapiens
cagaucagcagucaaagaa

SEQ ID NO: 518723 - RNA, 19 nt, Homo sapiens
gagauacugagaaguuaaa

SEQ ID NO: 518724 - RNA, 19 nt, Homo sapiens
ggagauacugagaaguuaa

SEQ ID NO: 518725 - RNA, 19 nt, Homo sapiens
ucguuuagauuacacauug

SEQ ID NO: 518726 - RNA, 19 nt, Homo sapiens
gaaaauaagcaguuagaga

SEQ ID NO: 518727 - RNA, 19 nt, Homo sapiens
gcuauuaaauuuggcaagu

SEQ ID NO: 518728 - RNA, 19 nt, Homo sapiens
caaggugucgcuauuaaau

SEQ ID NO: 518729 - RNA, 19 nt, Homo sapiens
caaaugaagaacacaaugu

SEQ ID NO: 518730 - RNA, 19 nt, Homo sapiens
gcaaaugaagaacacaaug

SEQ ID NO: 518731 - RNA, 19 nt, Homo sapiens
cuaagucacaugcacauaa

SEQ ID NO: 518732 - RNA, 19 nt, Homo sapiens
acagacaagcccagaauaa

SEQ ID NO: 518733 - RNA, 19 nt, Homo sapiens
aaaaguaaguggacagaaa

SEQ ID NO: 518734 - RNA, 19 nt, Homo sapiens
gaauccaacaguacaaaga

SEQ ID NO: 518735 - RNA, 19 nt, Homo sapiens
ugaaugaacagucucaaau

SEQ ID NO: 518736 - RNA, 19 nt, Homo sapiens
cugagaaguuaaagaugua

SEQ ID NO: 518737 - RNA, 19 nt, Homo sapiens
gaaacagcuucaggaguuc

SEQ ID NO: 518738 - RNA, 19 nt, Homo sapiens
gaagauuccgaaauaagau

SEQ ID NO: 518739 - RNA, 19 nt, Homo sapiens
caagcaagcacgugcaaga

SEQ ID NO: 518740 - RNA, 19 nt, Homo sapiens
agacaaauuucagguacuu

SEQ ID NO: 518741 - RNA, 19 nt, Homo sapiens
ugaacagucucaaauaacu

SEQ ID NO: 518742 - RNA, 19 nt, Homo sapiens
cgagacaucuuuuauuaug

SEQ ID NO: 518743 - RNA, 19 nt, Homo sapiens
caagcaaguuuucccauuu

SEQ ID NO: 518744 - RNA, 19 nt, Homo sapiens
caauaacccugaagaauaa

SEQ ID NO: 518745 - RNA, 19 nt, Homo sapiens
gaagacagaugauucaguu

SEQ ID NO: 518746 - RNA, 19 nt, Homo sapiens
gcaauaccuuggaugauua

SEQ ID NO: 518747 - RNA, 19 nt, Homo sapiens
gguauuaacugcccaagaa

SEQ ID NO: 518748 - RNA, 19 nt, Homo sapiens
ccaguuaaccuucuaaaua

SEQ ID NO: 518749 - RNA, 19 nt, Homo sapiens
gcacgugacuacuuucaaa

SEQ ID NO: 518750 - RNA, 19 nt, Homo sapiens
gauaagaucauccgacuuu

SEQ ID NO: 518751 - RNA, 19 nt, Homo sapiens
gaaauagguuaccggaauu

SEQ ID NO: 518752 - RNA, 19 nt, Homo sapiens
ucaauaacccugaagaaua

SEQ ID NO: 518753 - RNA, 19 nt, Homo sapiens
guaauggaguguggaaaua

SEQ ID NO: 518754 - RNA, 19 nt, Homo sapiens
gaagacaacaucacucuga

SEQ ID NO: 518755 - RNA, 19 nt, Homo sapiens
gcagauaaccaaacucuug

SEQ ID NO: 518756 - RNA, 19 nt, Homo sapiens
caagguauuucagguguua

SEQ ID NO: 518757 - RNA, 19 nt, Homo sapiens
gaacaaagugagagacauu

SEQ ID NO: 518758 - RNA, 19 nt, Homo sapiens
gacaauugauuccauaaug

SEQ ID NO: 518759 - RNA, 19 nt, Homo sapiens
aaucaagucuucuagcuaa

SEQ ID NO: 518760 - RNA, 19 nt, Homo sapiens
gggaaccacugaagaaaug

SEQ ID NO: 518761 - RNA, 19 nt, Homo sapiens
gauaguugauggaaugcua

SEQ ID NO: 518762 - RNA, 19 nt, Homo sapiens
gaguuuggguuccaucuuu

SEQ ID NO: 518763 - RNA, 19 nt, Homo sapiens
ggauuuaaguggcagagaa

SEQ ID NO: 518764 - RNA, 19 nt, Homo sapiens
caagauguguuaaaguguu

SEQ ID NO: 518765 - RNA, 19 nt, Homo sapiens
cagaagcaaucaaagauau

SEQ ID NO: 518766 - RNA, 19 nt, Homo sapiens
uaaccaaacucuugauagu

SEQ ID NO: 518767 - RNA, 19 nt, Homo sapiens
gaacuuagaagaagcagau

SEQ ID NO: 518768 - RNA, 19 nt, Homo sapiens
gcaacagcaucaaauacuu

SEQ ID NO: 518769 - RNA, 19 nt, Homo sapiens
agaaauagguuaccggaau

SEQ ID NO: 518770 - RNA, 19 nt, Homo sapiens
gaacaugccaccacaagau

SEQ ID NO: 518771 - RNA, 19 nt, Homo sapiens
agugagauuugcugaauua

SEQ ID NO: 518772 - RNA, 19 nt, Homo sapiens
gagagaaugggaaaucuaa

SEQ ID NO: 518773 - RNA, 19 nt, Homo sapiens
gacagaugauucaguugua

SEQ ID NO: 518774 - RNA, 19 nt, Homo sapiens
gauaggaaguggagguuca

SEQ ID NO: 518775 - RNA, 19 nt, Homo sapiens
caagugagauuugcugaau

SEQ ID NO: 518776 - RNA, 19 nt, Homo sapiens
gcagcaacagcaucaaaua

SEQ ID NO: 518777 - RNA, 19 nt, Homo sapiens
gaucuuaauaguuggcuua

SEQ ID NO: 518778 - RNA, 19 nt, Homo sapiens
caguuaaccuucuaaauag

SEQ ID NO: 518779 - RNA, 19 nt, Homo sapiens
gagcaaacugcaagaaauu

SEQ ID NO: 518780 - RNA, 19 nt, Homo sapiens
gauuugcaguuauucguaa

SEQ ID NO: 518781 - RNA, 19 nt, Homo sapiens
ccacugaagaaaugaaaua

SEQ ID NO: 518782 - RNA, 19 nt, Homo sapiens
cagaaacaguggcaaucua

SEQ ID NO: 518783 - RNA, 19 nt, Homo sapiens
ugucaaauaccaccuauaa

SEQ ID NO: 518784 - RNA, 19 nt, Homo sapiens
ccagcuaacuuucugauag

SEQ ID NO: 518785 - RNA, 19 nt, Homo sapiens
gaaagucagaguguauuaa

SEQ ID NO: 518786 - RNA, 19 nt, Homo sapiens
caaggaaccucugguguca

SEQ ID NO: 518787 - RNA, 19 nt, Homo sapiens
gaugaacuaagcuugaaua

SEQ ID NO: 518788 - RNA, 19 nt, Homo sapiens
gauggaaugcuaaagcuaa

SEQ ID NO: 518789 - RNA, 19 nt, Homo sapiens
gauaaccaaacucuugaua

SEQ ID NO: 518790 - RNA, 19 nt, Homo sapiens
cagcgcagcuuucuguaga

SEQ ID NO: 518791 - RNA, 19 nt, Homo sapiens
gcuaagugaugcucuuuua

SEQ ID NO: 518792 - RNA, 19 nt, Homo sapiens
augaagaccuuacugauga

SEQ ID NO: 518793 - RNA, 19 nt, Homo sapiens
aaacagaggauauccauuc

SEQ ID NO: 518794 - RNA, 19 nt, Homo sapiens
caugggaacgcaagaguua

SEQ ID NO: 518795 - RNA, 19 nt, Homo sapiens
caagucuucuagcuaaauu

SEQ ID NO: 518796 - RNA, 19 nt, Homo sapiens
aaacagucaugcccauuug

SEQ ID NO: 518797 - RNA, 19 nt, Homo sapiens
ccacuuaugguacuguaua

SEQ ID NO: 518798 - RNA, 19 nt, Homo sapiens
ggacuguuauacucuugaa

SEQ ID NO: 518799 - RNA, 19 nt, Homo sapiens
caagggaaccacugaagaa

SEQ ID NO: 518800 - RNA, 19 nt, Homo sapiens
ggaaucaagucuucuagcu

SEQ ID NO: 518801 - RNA, 19 nt, Homo sapiens
caacaacacagugauaaga

SEQ ID NO: 518802 - RNA, 19 nt, Homo sapiens
caaccugucuuuucaguuu

SEQ ID NO: 518803 - RNA, 19 nt, Homo sapiens
cuauaugacuuacgggaaa

SEQ ID NO: 518804 - RNA, 19 nt, Homo sapiens
caaguguuguuaaagauuc

SEQ ID NO: 518805 - RNA, 19 nt, Homo sapiens
gcaaccagauacaacaagu

SEQ ID NO: 518806 - RNA, 19 nt, Homo sapiens
gaaaggaguuuggguucca

SEQ ID NO: 518807 - RNA, 19 nt, Homo sapiens
gcagaaacauaccacuuuu

SEQ ID NO: 518808 - RNA, 19 nt, Homo sapiens
cagaguguauuaaccagaa

SEQ ID NO: 518809 - RNA, 19 nt, Homo sapiens
uaaauagcccagauuguga

SEQ ID NO: 518810 - RNA, 19 nt, Homo sapiens
accacaagaugcagaaaua

SEQ ID NO: 518811 - RNA, 19 nt, Homo sapiens
ccagaggacagacuacuaa

SEQ ID NO: 518812 - RNA, 19 nt, Homo sapiens
ggaacuguuaaccaaauua

SEQ ID NO: 518813 - RNA, 19 nt, Homo sapiens
ggaaugcuaaagcuaauug

SEQ ID NO: 518814 - RNA, 19 nt, Homo sapiens
ccacuccacuucaaaauuu

SEQ ID NO: 518815 - RNA, 19 nt, Homo sapiens
gcagcaauaccuuggauga

SEQ ID NO: 518816 - RNA, 19 nt, Homo sapiens
gaaucaagucuucuagcua

SEQ ID NO: 518817 - RNA, 19 nt, Homo sapiens
uguagaacguggagcagua

SEQ ID NO: 518818 - RNA, 19 nt, Homo sapiens
ccagaagcaaucaaagaua

SEQ ID NO: 518819 - RNA, 19 nt, Homo sapiens
caguacaucuacaugguaa

SEQ ID NO: 518820 - RNA, 19 nt, Homo sapiens
uaaagaguaucaagaacca

SEQ ID NO: 518821 - RNA, 19 nt, Homo sapiens
caaagugagagacauuaaa

SEQ ID NO: 518822 - RNA, 19 nt, Homo sapiens
agacaaaccucuagaucag

SEQ ID NO: 518823 - RNA, 19 nt, Homo sapiens
gcaguuauucguaauguca

SEQ ID NO: 518824 - RNA, 19 nt, Homo sapiens
uguuaaagauucucagguu

SEQ ID NO: 518825 - RNA, 19 nt, Homo sapiens
uaaaccagcuaacuuucug

SEQ ID NO: 518826 - RNA, 19 nt, Homo sapiens
gaagaagcagauaaccaaa

SEQ ID NO: 518827 - RNA, 19 nt, Homo sapiens
acaaaccucuagaucagaa

SEQ ID NO: 518828 - RNA, 19 nt, Homo sapiens
uaaacagucaugcccauuu

SEQ ID NO: 518829 - RNA, 19 nt, Homo sapiens
ccagauaaauauggccaaa

SEQ ID NO: 518830 - RNA, 19 nt, Homo sapiens
gcucuuguguaaucuacuu

SEQ ID NO: 518831 - RNA, 19 nt, Homo sapiens
ccauuucagcagauaauua

SEQ ID NO: 518832 - RNA, 19 nt, Homo sapiens
agaccuuacugaugaacua

SEQ ID NO: 518833 - RNA, 19 nt, Homo sapiens
cauccgacuuuaugauuau

SEQ ID NO: 518834 - RNA, 19 nt, Homo sapiens
agagcaaacugcaagaaau

SEQ ID NO: 518835 - RNA, 19 nt, Homo sapiens
gaaucccuguggaaaucua

SEQ ID NO: 518836 - RNA, 19 nt, Homo sapiens
ucugauaguugauggaaug

SEQ ID NO: 518837 - RNA, 19 nt, Homo sapiens
cuacaacaacacagugaua

SEQ ID NO: 518838 - RNA, 19 nt, Homo sapiens
gggaacuguuaaccaaauu

SEQ ID NO: 518839 - RNA, 19 nt, Homo sapiens
caacagcaucaaauacuug

SEQ ID NO: 518840 - RNA, 19 nt, Homo sapiens
cggaauucauugagacaaa

SEQ ID NO: 518841 - RNA, 19 nt, Homo sapiens
ugaugcacgugacuacuuu

SEQ ID NO: 518842 - RNA, 19 nt, Homo sapiens
ggauagcaaguauauucua

SEQ ID NO: 518843 - RNA, 19 nt, Homo sapiens
guggauagcaaguauauuc

SEQ ID NO: 518844 - RNA, 19 nt, Homo sapiens
gaaacgaggugaugaaaua

SEQ ID NO: 518845 - RNA, 19 nt, Homo sapiens
gaauauaaguuccguguua

SEQ ID NO: 518846 - RNA, 19 nt, Homo sapiens
gaagaaaucugucacauuc

SEQ ID NO: 518847 - RNA, 19 nt, Homo sapiens
gaaggaaagugcuguauuu

SEQ ID NO: 518848 - RNA, 19 nt, Homo sapiens
caaaggaccugauauaauu

SEQ ID NO: 518849 - RNA, 19 nt, Homo sapiens
gaugacaccucccaaauua

SEQ ID NO: 518850 - RNA, 19 nt, Homo sapiens
gaacaagccuuaauuagga

SEQ ID NO: 518851 - RNA, 19 nt, Homo sapiens
caauguagauggcuuauua

SEQ ID NO: 518852 - RNA, 19 nt, Homo sapiens
gaacagagguccaguuuca

SEQ ID NO: 518853 - RNA, 19 nt, Homo sapiens
gaaacaagaugcugacaaa

SEQ ID NO: 518854 - RNA, 19 nt, Homo sapiens
ugaaaggucucacuaauaa

SEQ ID NO: 518855 - RNA, 19 nt, Homo sapiens
gaucaggaauuccauauuu

SEQ ID NO: 518856 - RNA, 19 nt, Homo sapiens
gcaauaagaugccaguaaa

SEQ ID NO: 518857 - RNA, 19 nt, Homo sapiens
ggaagaaggugaucucuau

SEQ ID NO: 518858 - RNA, 19 nt, Homo sapiens
ggagaaaccuggccgaauu

SEQ ID NO: 518859 - RNA, 19 nt, Homo sapiens
ggucagaacuuauguagaa

SEQ ID NO: 518860 - RNA, 19 nt, Homo sapiens
gaaaucacccauuauguua

SEQ ID NO: 518861 - RNA, 19 nt, Homo sapiens
gaacugacuuacaagguua

SEQ ID NO: 518862 - RNA, 19 nt, Homo sapiens
gcaggcagaucuucaauuu

SEQ ID NO: 518863 - RNA, 19 nt, Homo sapiens
gcauaaagauggcaaagaa

SEQ ID NO: 518864 - RNA, 19 nt, Homo sapiens
gcagugaaaucauaaacua

SEQ ID NO: 518865 - RNA, 19 nt, Homo sapiens
gcagaaggauucaucaauu

SEQ ID NO: 518866 - RNA, 19 nt, Homo sapiens
gaaaucaagugccuagaaa

SEQ ID NO: 518867 - RNA, 19 nt, Homo sapiens
gaagaaagguggaagagau

SEQ ID NO: 518868 - RNA, 19 nt, Homo sapiens
gacaaaggcugauaugauu

SEQ ID NO: 518869 - RNA, 19 nt, Homo sapiens
guggagacauuacauauua

SEQ ID NO: 518870 - RNA, 19 nt, Homo sapiens
gaauuugucugcucuauau

SEQ ID NO: 518871 - RNA, 19 nt, Homo sapiens
gaagugacauuggaugaua

SEQ ID NO: 518872 - RNA, 19 nt, Homo sapiens
uaaagaccguguuguaaua

SEQ ID NO: 518873 - RNA, 19 nt, Homo sapiens
gaaccaaucuuaauaaagg

SEQ ID NO: 518874 - RNA, 19 nt, Homo sapiens
gaacaguacucaucucuuc

SEQ ID NO: 518875 - RNA, 19 nt, Homo sapiens
cuaaagaggugaauuggua

SEQ ID NO: 518876 - RNA, 19 nt, Homo sapiens
gaaagaacuucaggacaua

SEQ ID NO: 518877 - RNA, 19 nt, Homo sapiens
gaaaagggcugaaagaauu

SEQ ID NO: 518878 - RNA, 19 nt, Homo sapiens
gaauacuucuuccguguua

SEQ ID NO: 518879 - RNA, 19 nt, Homo sapiens
gaagugaacgucuuagaua

SEQ ID NO: 518880 - RNA, 19 nt, Homo sapiens
gaacagaagagggcuauua

SEQ ID NO: 518881 - RNA, 19 nt, Homo sapiens
gcagagaguugugaguuua

SEQ ID NO: 518882 - RNA, 19 nt, Homo sapiens
gaugaaagaugaugaagga

SEQ ID NO: 518883 - RNA, 19 nt, Homo sapiens
gaacuuauguagaagauca

SEQ ID NO: 518884 - RNA, 19 nt, Homo sapiens
gaaguaaccaucauuauug

SEQ ID NO: 518885 - RNA, 19 nt, Homo sapiens
caaauuagaugacauugga

SEQ ID NO: 518886 - RNA, 19 nt, Homo sapiens
ccaaagaaguugugaaguu

SEQ ID NO: 518887 - RNA, 19 nt, Homo sapiens
caggaaagcuucaguuuga

SEQ ID NO: 518888 - RNA, 19 nt, Homo sapiens
gggagaagcugcccuuaaa

SEQ ID NO: 518889 - RNA, 19 nt, Homo sapiens
gaacaagccuagaagugaa

SEQ ID NO: 518890 - RNA, 19 nt, Homo sapiens
gggcaagacucacaaauug

SEQ ID NO: 518891 - RNA, 19 nt, Homo sapiens
gacacaagcucuacaacua

SEQ ID NO: 518892 - RNA, 19 nt, Homo sapiens
caaaguugcugauccaauu

SEQ ID NO: 518893 - RNA, 19 nt, Homo sapiens
uagcagaacucaauaaaga

SEQ ID NO: 518894 - RNA, 19 nt, Homo sapiens
ggagauaaauaugacguua

SEQ ID NO: 518895 - RNA, 19 nt, Homo sapiens
gaagaaguaaccaucauua

SEQ ID NO: 518896 - RNA, 19 nt, Homo sapiens
gaugaaagaugaccaggaa

SEQ ID NO: 518897 - RNA, 19 nt, Homo sapiens
gaaggcaucucuuacaaau

SEQ ID NO: 518898 - RNA, 19 nt, Homo sapiens
gaagagggaugauaagaca

SEQ ID NO: 518899 - RNA, 19 nt, Homo sapiens
gauuugagcuuauaaagga

SEQ ID NO: 518900 - RNA, 19 nt, Homo sapiens
gaaaucaucuguaccucaa

SEQ ID NO: 518901 - RNA, 19 nt, Homo sapiens
ugaaggaacuuacacguuu

SEQ ID NO: 518902 - RNA, 19 nt, Homo sapiens
uaugggaucuggaaacuua

SEQ ID NO: 518903 - RNA, 19 nt, Homo sapiens
gaaauaggaccaauucuug

SEQ ID NO: 518904 - RNA, 19 nt, Homo sapiens
gauaaugggcuacaucaua

SEQ ID NO: 518905 - RNA, 19 nt, Homo sapiens
gaagaccaauacagagaua

SEQ ID NO: 518906 - RNA, 19 nt, Homo sapiens
gcgcagaagugauuuggua

SEQ ID NO: 518907 - RNA, 19 nt, Homo sapiens
caaaggauaugaugaaauc

SEQ ID NO: 518908 - RNA, 19 nt, Homo sapiens
caaagacacugaaacagaa

SEQ ID NO: 518909 - RNA, 19 nt, Homo sapiens
ggaaggcacuggcccaauu

SEQ ID NO: 518910 - RNA, 19 nt, Homo sapiens
gaccuuaccuguacagaaa

SEQ ID NO: 518911 - RNA, 19 nt, Homo sapiens
gaagagggcuauuaugaag

SEQ ID NO: 518912 - RNA, 19 nt, Homo sapiens
gguacucaaucacuaauua

SEQ ID NO: 518913 - RNA, 19 nt, Homo sapiens
caaagaauauguccugaga

SEQ ID NO: 518914 - RNA, 19 nt, Homo sapiens
guucaggccucuccaauaa

SEQ ID NO: 518915 - RNA, 19 nt, Homo sapiens
ggaagaaccuuuaacugau

SEQ ID NO: 518916 - RNA, 19 nt, Homo sapiens
ugaacuggcugcugaauuu

SEQ ID NO: 518917 - RNA, 19 nt, Homo sapiens
cagaagauauugcugagua

SEQ ID NO: 518918 - RNA, 19 nt, Homo sapiens
ugaagaagauggagaagaa

SEQ ID NO: 518919 - RNA, 19 nt, Homo sapiens
caacacugcuguagagaaa

SEQ ID NO: 518920 - RNA, 19 nt, Homo sapiens
gaaguuaaagcaagugaua

SEQ ID NO: 518921 - RNA, 19 nt, Homo sapiens
gaugacagauuugagcuua

SEQ ID NO: 518922 - RNA, 19 nt, Homo sapiens
ggacagccauuguacuuga

SEQ ID NO: 518923 - RNA, 19 nt, Homo sapiens
ucaaauggcuaaccugaaa

SEQ ID NO: 518924 - RNA, 19 nt, Homo sapiens
gaaaucaaaucaacugaca

SEQ ID NO: 518925 - RNA, 19 nt, Homo sapiens
gaagaaugguguggaaauu

SEQ ID NO: 518926 - RNA, 19 nt, Homo sapiens
ggagaaagauaccaaaugg

SEQ ID NO: 518927 - RNA, 19 nt, Homo sapiens
caaagugaguuacaacaaa

SEQ ID NO: 518928 - RNA, 19 nt, Homo sapiens
gaagagaaacgcuuuguug

SEQ ID NO: 518929 - RNA, 19 nt, Homo sapiens
gaaguuaacaguacacauu

SEQ ID NO: 518930 - RNA, 19 nt, Homo sapiens
caaacuacgucauugaauu

SEQ ID NO: 518931 - RNA, 19 nt, Homo sapiens
gagaauggcucaugaaggu

SEQ ID NO: 518932 - RNA, 19 nt, Homo sapiens
gaaacaauacugagaacua

SEQ ID NO: 518933 - RNA, 19 nt, Homo sapiens
gcaaauaacucaggagaag

SEQ ID NO: 518934 - RNA, 19 nt, Homo sapiens
cuaaagaggugaaacaaga

SEQ ID NO: 518935 - RNA, 19 nt, Homo sapiens
aaugguggcucuccaauua

SEQ ID NO: 518936 - RNA, 19 nt, Homo sapiens
caaaggcacuuacacaguu

SEQ ID NO: 518937 - RNA, 19 nt, Homo sapiens
aaauaaagcugguguuuca

SEQ ID NO: 518938 - RNA, 19 nt, Homo sapiens
gauaugaaauacugacuga

SEQ ID NO: 518939 - RNA, 19 nt, Homo sapiens
caacaaaugucuacuggau

SEQ ID NO: 518940 - RNA, 19 nt, Homo sapiens
uagaggacguuaccauuua

SEQ ID NO: 518941 - RNA, 19 nt, Homo sapiens
guauaaagauggcauugaa

SEQ ID NO: 518942 - RNA, 19 nt, Homo sapiens
gcagagccacuaacaaaua

SEQ ID NO: 518943 - RNA, 19 nt, Homo sapiens
ugaaggaucucauaccaaa

SEQ ID NO: 518944 - RNA, 19 nt, Homo sapiens
caaaggagauaccaaauua

SEQ ID NO: 518945 - RNA, 19 nt, Homo sapiens
gguggaagcugcuauauua

SEQ ID NO: 518946 - RNA, 19 nt, Homo sapiens
gaaaguaccagauuaguua

SEQ ID NO: 518947 - RNA, 19 nt, Homo sapiens
gaaauuagcugguucaaag

SEQ ID NO: 518948 - RNA, 19 nt, Homo sapiens
gaacaagccuuaauuagga

SEQ ID NO: 518949 - RNA, 19 nt, Homo sapiens
gaaacaagaugcugacaaa

SEQ ID NO: 518950 - RNA, 19 nt, Homo sapiens
ugaagaggcugaaugauua

SEQ ID NO: 518951 - RNA, 19 nt, Homo sapiens
gaaccaccaucauucauua

SEQ ID NO: 518952 - RNA, 19 nt, Homo sapiens
caacacaucucuacauaaa

SEQ ID NO: 518953 - RNA, 19 nt, Homo sapiens
gaucaggaauuccauauuu

SEQ ID NO: 518954 - RNA, 19 nt, Homo sapiens
caaaguagcuggaucauca

SEQ ID NO: 518955 - RNA, 19 nt, Homo sapiens
ggaagaaggugaucucuau

SEQ ID NO: 518956 - RNA, 19 nt, Homo sapiens
ucacuuggcugaagaauaa

SEQ ID NO: 518957 - RNA, 19 nt, Homo sapiens
ggucagaacuuauguagaa

SEQ ID NO: 518958 - RNA, 19 nt, Homo sapiens
acaaagauguucugcauua

SEQ ID NO: 518959 - RNA, 19 nt, Homo sapiens
gcaggcagaucuucaauuu

SEQ ID NO: 518960 - RNA, 19 nt, Homo sapiens
gaaaucaagugccuagaaa

SEQ ID NO: 518961 - RNA, 19 nt, Homo sapiens
gaaaagagcuaacaaguga

SEQ ID NO: 518962 - RNA, 19 nt, Homo sapiens
gaaagaugaugcuaauuug

SEQ ID NO: 518963 - RNA, 19 nt, Homo sapiens
gaaagaaccaccaagauuu

SEQ ID NO: 518964 - RNA, 19 nt, Homo sapiens
gaagagcacuuuccaagga

SEQ ID NO: 518965 - RNA, 19 nt, Homo sapiens
guggagacauuacauauua

SEQ ID NO: 518966 - RNA, 19 nt, Homo sapiens
gaauaucacugcaaagcua

SEQ ID NO: 518967 - RNA, 19 nt, Homo sapiens
uaaaguggcuucccuuaaa

SEQ ID NO: 518968 - RNA, 19 nt, Homo sapiens
cuaaagaggugaauuggua

SEQ ID NO: 518969 - RNA, 19 nt, Homo sapiens
gaaagaacuucaggacaua

SEQ ID NO: 518970 - RNA, 19 nt, Homo sapiens
gaaaagggcugaaagaauu

SEQ ID NO: 518971 - RNA, 19 nt, Homo sapiens
uaacguugcuuccuuagua

SEQ ID NO: 518972 - RNA, 19 nt, Homo sapiens
gaaagaaccagcugcauuu

SEQ ID NO: 518973 - RNA, 19 nt, Homo sapiens
uaacaugguuugcaaauga

SEQ ID NO: 518974 - RNA, 19 nt, Homo sapiens
gaacagaagagggcuauua

SEQ ID NO: 518975 - RNA, 19 nt, Homo sapiens
ucucagagguguaauauaa

SEQ ID NO: 518976 - RNA, 19 nt, Homo sapiens
caucacagcuguuaaagaa

SEQ ID NO: 518977 - RNA, 19 nt, Homo sapiens
gaugaaagaugaugaagga

SEQ ID NO: 518978 - RNA, 19 nt, Homo sapiens
gaacuuauguagaagauca

SEQ ID NO: 518979 - RNA, 19 nt, Homo sapiens
gcuagaaccuucaagaauu

SEQ ID NO: 518980 - RNA, 19 nt, Homo sapiens
ucugagagaugcaguauua

SEQ ID NO: 518981 - RNA, 19 nt, Homo sapiens
gaaguaaccaucauuauug

SEQ ID NO: 518982 - RNA, 19 nt, Homo sapiens
caaauuagaugacauugga

SEQ ID NO: 518983 - RNA, 19 nt, Homo sapiens
ccaaagaaguugugaaguu

SEQ ID NO: 518984 - RNA, 19 nt, Homo sapiens
caggaaagcuucaguuuga

SEQ ID NO: 518985 - RNA, 19 nt, Homo sapiens
gggagaagcugcccuuaaa

SEQ ID NO: 518986 - RNA, 19 nt, Homo sapiens
caaagaaccuccacgauuc

SEQ ID NO: 518987 - RNA, 19 nt, Homo sapiens
ggaggaaacuauacaauca

SEQ ID NO: 518988 - RNA, 19 nt, Homo sapiens
gaaagauaguggagaauau

SEQ ID NO: 518989 - RNA, 19 nt, Homo sapiens
gaucagcuccugcauauaa

SEQ ID NO: 518990 - RNA, 19 nt, Homo sapiens
gaagaaguaaccaucauua

SEQ ID NO: 518991 - RNA, 19 nt, Homo sapiens
gaugaaagaugaccaggaa

SEQ ID NO: 518992 - RNA, 19 nt, Homo sapiens
gaaggcaucucuuacaaau

SEQ ID NO: 518993 - RNA, 19 nt, Homo sapiens
ugaaggaacuuacacguuu

SEQ ID NO: 518994 - RNA, 19 nt, Homo sapiens
gcuaaaggaugaucagauu

SEQ ID NO: 518995 - RNA, 19 nt, Homo sapiens
guucaaagaugaccaagaa

SEQ ID NO: 518996 - RNA, 19 nt, Homo sapiens
caaagacacugaaacagaa

SEQ ID NO: 518997 - RNA, 19 nt, Homo sapiens
ggaaggcacuggcccaauu

SEQ ID NO: 518998 - RNA, 19 nt, Homo sapiens
gaccuuaccuguacagaaa

SEQ ID NO: 518999 - RNA, 19 nt, Homo sapiens
gaagagggcuauuaugaag

SEQ ID NO: 519000 - RNA, 19 nt, Homo sapiens
gguacucaaucacuaauua

SEQ ID NO: 519001 - RNA, 19 nt, Homo sapiens
caucaagccuguaucuaua

SEQ ID NO: 519002 - RNA, 19 nt, Homo sapiens
ccaccaagcuuccuaguga

SEQ ID NO: 519003 - RNA, 19 nt, Homo sapiens
ugaagaagauggagaagaa

SEQ ID NO: 519004 - RNA, 19 nt, Homo sapiens
caaaggagauucuggacaa

SEQ ID NO: 519005 - RNA, 19 nt, Homo sapiens
gcagaacccuguuggcaaa

SEQ ID NO: 519006 - RNA, 19 nt, Homo sapiens
gaaaguauaucugccaaau

SEQ ID NO: 519007 - RNA, 19 nt, Homo sapiens
gaaagcaggugacucuuca

SEQ ID NO: 519008 - RNA, 19 nt, Homo sapiens
gaacuugucucagguccua

SEQ ID NO: 519009 - RNA, 19 nt, Homo sapiens
ucaaauggcuaaccugaaa

SEQ ID NO: 519010 - RNA, 19 nt, Homo sapiens
gaaaucaaaucaacugaca

SEQ ID NO: 519011 - RNA, 19 nt, Homo sapiens
gaagaaugguguggaaauu

SEQ ID NO: 519012 - RNA, 19 nt, Homo sapiens
ggagaaagauaccaaaugg

SEQ ID NO: 519013 - RNA, 19 nt, Homo sapiens
caaagugaguuacaacaaa

SEQ ID NO: 519014 - RNA, 19 nt, Homo sapiens
gaagagaaacgcuuuguug

SEQ ID NO: 519015 - RNA, 19 nt, Homo sapiens
uaacauaacuaccucugaa

SEQ ID NO: 519016 - RNA, 19 nt, Homo sapiens
ggaguacgaugucauguug

SEQ ID NO: 519017 - RNA, 19 nt, Homo sapiens
ccaaguagaugaagacaga

SEQ ID NO: 519018 - RNA, 19 nt, Homo sapiens
gagaauggcucaugaaggu

SEQ ID NO: 519019 - RNA, 19 nt, Homo sapiens
gaaacaauacugagaacua

SEQ ID NO: 519020 - RNA, 19 nt, Homo sapiens
gcaaauaacucaggagaag

SEQ ID NO: 519021 - RNA, 19 nt, Homo sapiens
cuaaagaggugaaacaaga

SEQ ID NO: 519022 - RNA, 19 nt, Homo sapiens
ggagaaaucguuagagaaa

SEQ ID NO: 519023 - RNA, 19 nt, Homo sapiens
gaaaggagcugauguucac

SEQ ID NO: 519024 - RNA, 19 nt, Homo sapiens
gggaaacacuccucauuug

SEQ ID NO: 519025 - RNA, 19 nt, Homo sapiens
guaccaagguuauaguaaa

SEQ ID NO: 519026 - RNA, 19 nt, Homo sapiens
guauaaagauggcauugaa

SEQ ID NO: 519027 - RNA, 19 nt, Homo sapiens
gcagagccacuaacaaaua

SEQ ID NO: 519028 - RNA, 19 nt, Homo sapiens
gcaaacaucacauuacauu

SEQ ID NO: 519029 - RNA, 19 nt, Homo sapiens
gaaauuagaagccuccaaa

SEQ ID NO: 519030 - RNA, 19 nt, Homo sapiens
gcauguaccuuguuacuuc

SEQ ID NO: 519031 - RNA, 19 nt, Homo sapiens
gaaggaaaaugguaucaua

SEQ ID NO: 519032 - RNA, 19 nt, Homo sapiens
caucaaacauggagaaaga

SEQ ID NO: 519033 - RNA, 19 nt, Homo sapiens
guagauacaucacaaagug

SEQ ID NO: 519034 - RNA, 19 nt, Homo sapiens
gaaacaggaugaauucaca

SEQ ID NO: 519035 - RNA, 19 nt, Homo sapiens
ugaagugccuccuuucuuu

SEQ ID NO: 519036 - RNA, 19 nt, Homo sapiens
guucaaagauggaagagaa

SEQ ID NO: 519037 - RNA, 19 nt, Homo sapiens
ggaaauacaacaugucauu

SEQ ID NO: 519038 - RNA, 19 nt, Homo sapiens
cggagagccugcugaauua

SEQ ID NO: 519039 - RNA, 19 nt, Homo sapiens
gaacaaaugcucuacuuca

SEQ ID NO: 519040 - RNA, 19 nt, Homo sapiens
gaagguggaucccucuuau

SEQ ID NO: 519041 - RNA, 19 nt, Homo sapiens
uuagaacucucaaaccuua

SEQ ID NO: 519042 - RNA, 19 nt, Homo sapiens
ugaggaaggugauauugua

SEQ ID NO: 519043 - RNA, 19 nt, Homo sapiens
caacauagcuggagaaacc

SEQ ID NO: 519044 - RNA, 19 nt, Homo sapiens
gaacaugaaucaccuauua

SEQ ID NO: 519045 - RNA, 19 nt, Homo sapiens
gaaauaagcucaagaacuu

SEQ ID NO: 519046 - RNA, 19 nt, Homo sapiens
gaacaagccuuaauuagga

SEQ ID NO: 519047 - RNA, 19 nt, Homo sapiens
gaaacaagaugcugacaaa

SEQ ID NO: 519048 - RNA, 19 nt, Homo sapiens
ggaagaagguucacuguug

SEQ ID NO: 519049 - RNA, 19 nt, Homo sapiens
gaucaggaauuccauauuu

SEQ ID NO: 519050 - RNA, 19 nt, Homo sapiens
ggaagaaggugaucucuau

SEQ ID NO: 519051 - RNA, 19 nt, Homo sapiens
ggucagaacuuauguagaa

SEQ ID NO: 519052 - RNA, 19 nt, Homo sapiens
gcaggcagaucuucaauuu

SEQ ID NO: 519053 - RNA, 19 nt, Homo sapiens
gaaaucaagugccuagaaa

SEQ ID NO: 519054 - RNA, 19 nt, Homo sapiens
guggagacauuacauauua

SEQ ID NO: 519055 - RNA, 19 nt, Homo sapiens
gaaguuccaucucacauuu

SEQ ID NO: 519056 - RNA, 19 nt, Homo sapiens
gaauccaggugaacaaaua

SEQ ID NO: 519057 - RNA, 19 nt, Homo sapiens
gaaagaacuucaggacaua

SEQ ID NO: 519058 - RNA, 19 nt, Homo sapiens
gaaaagggcugaaagaauu

SEQ ID NO: 519059 - RNA, 19 nt, Homo sapiens
ggaaguugcugaaagauau

SEQ ID NO: 519060 - RNA, 19 nt, Homo sapiens
gaacagaagagggcuauua

SEQ ID NO: 519061 - RNA, 19 nt, Homo sapiens
agaaauagcuagugaaaga

SEQ ID NO: 519062 - RNA, 19 nt, Homo sapiens
gaugaaagaugaugaagga

SEQ ID NO: 519063 - RNA, 19 nt, Homo sapiens
gaacuuauguagaagauca

SEQ ID NO: 519064 - RNA, 19 nt, Homo sapiens
guagaaaucucaucuuugu

SEQ ID NO: 519065 - RNA, 19 nt, Homo sapiens
caugggagauucugaaaua

SEQ ID NO: 519066 - RNA, 19 nt, Homo sapiens
gaaguuaagugguauaaag

SEQ ID NO: 519067 - RNA, 19 nt, Homo sapiens
caaauuagaugacauugga

SEQ ID NO: 519068 - RNA, 19 nt, Homo sapiens
ccaaagaaguugugaaguu

SEQ ID NO: 519069 - RNA, 19 nt, Homo sapiens
caggaaagcuucaguuuga

SEQ ID NO: 519070 - RNA, 19 nt, Homo sapiens
gggagaagcugcccuuaaa

SEQ ID NO: 519071 - RNA, 19 nt, Homo sapiens
gaugaaagaugaccaggaa

SEQ ID NO: 519072 - RNA, 19 nt, Homo sapiens
gaaggcaucucuuacaaau

SEQ ID NO: 519073 - RNA, 19 nt, Homo sapiens
gaagaagguucacuguuga

SEQ ID NO: 519074 - RNA, 19 nt, Homo sapiens
ugaaggaacuuacacguuu

SEQ ID NO: 519075 - RNA, 19 nt, Homo sapiens
gaccuuaccuguacagaaa

SEQ ID NO: 519076 - RNA, 19 nt, Homo sapiens
gaagagggcuauuaugaag

SEQ ID NO: 519077 - RNA, 19 nt, Homo sapiens
gguacucaaucacuaauua

SEQ ID NO: 519078 - RNA, 19 nt, Homo sapiens
gaaauuauggccaauacua

SEQ ID NO: 519079 - RNA, 19 nt, Homo sapiens
ugaagaagauggagaagaa

SEQ ID NO: 519080 - RNA, 19 nt, Homo sapiens
ggaagggccucccagguuu

SEQ ID NO: 519081 - RNA, 19 nt, Homo sapiens
gggagauucugaaauauuu

SEQ ID NO: 519082 - RNA, 19 nt, Homo sapiens
gaaaucaaaucaacugaca

SEQ ID NO: 519083 - RNA, 19 nt, Homo sapiens
gaagaaugguguggaaauu

SEQ ID NO: 519084 - RNA, 19 nt, Homo sapiens
ggagaaagauaccaaaugg

SEQ ID NO: 519085 - RNA, 19 nt, Homo sapiens
caaagugaguuacaacaaa

SEQ ID NO: 519086 - RNA, 19 nt, Homo sapiens
gaagagaaacgcuuuguug

SEQ ID NO: 519087 - RNA, 19 nt, Homo sapiens
gaagaagaaugcacucuag

SEQ ID NO: 519088 - RNA, 19 nt, Homo sapiens
gucaagagcuuucaaauag

SEQ ID NO: 519089 - RNA, 19 nt, Homo sapiens
gagaauggcucaugaaggu

SEQ ID NO: 519090 - RNA, 19 nt, Homo sapiens
gaaacaauacugagaacua

SEQ ID NO: 519091 - RNA, 19 nt, Homo sapiens
gcaaauaacucaggagaag

SEQ ID NO: 519092 - RNA, 19 nt, Homo sapiens
cuaaagaggugaaacaaga

SEQ ID NO: 519093 - RNA, 19 nt, Homo sapiens
gaagaaauagcuagugaaa

SEQ ID NO: 519094 - RNA, 19 nt, Homo sapiens
ggagagucauccacauaua

SEQ ID NO: 519095 - RNA, 19 nt, Homo sapiens
guauaaagauggcauugaa

SEQ ID NO: 519096 - RNA, 19 nt, Homo sapiens
gcagagccacuaacaaaua

SEQ ID NO: 519097 - RNA, 19 nt, Homo sapiens
uaaccaauauggaacagua

SEQ ID NO: 519098 - RNA, 19 nt, Homo sapiens
gaggacagcuggaagaaau

SEQ ID NO: 519099 - RNA, 19 nt, Homo sapiens
gaaggaaaaugguaucaua

SEQ ID NO: 519100 - RNA, 19 nt, Homo sapiens
caucaaacauggagaaaga

SEQ ID NO: 519101 - RNA, 19 nt, Homo sapiens
ccaaacagguccaccauau

SEQ ID NO: 519102 - RNA, 19 nt, Homo sapiens
caacauagcuggagaaacc

SEQ ID NO: 519103 - RNA, 19 nt, Homo sapiens
gaacaagaaacaauacuga

SEQ ID NO: 519104 - RNA, 19 nt, Homo sapiens
ugaaaugccuccucgcuuu

SEQ ID NO: 519105 - RNA, 19 nt, Homo sapiens
gcaaagagaaucaagauca

SEQ ID NO: 519106 - RNA, 19 nt, Homo sapiens
gaauugauguccuguggaa

SEQ ID NO: 519107 - RNA, 19 nt, Homo sapiens
gaaagaauccagagccaaa

SEQ ID NO: 519108 - RNA, 19 nt, Homo sapiens
gaagagcgcuuugaaguac

SEQ ID NO: 519109 - RNA, 19 nt, Homo sapiens
gaagaaauaucugaguuag

SEQ ID NO: 519110 - RNA, 19 nt, Homo sapiens
uaaaagagcugaacaugaa

SEQ ID NO: 519111 - RNA, 19 nt, Homo sapiens
gcagaucacagacagaaua

SEQ ID NO: 519112 - RNA, 19 nt, Homo sapiens
gaaaccaacuguaaucucu

SEQ ID NO: 519113 - RNA, 19 nt, Homo sapiens
ggacauagaaguuccagaa

SEQ ID NO: 519114 - RNA, 19 nt, Homo sapiens
ggauauccauuaccaaaga

SEQ ID NO: 519115 - RNA, 19 nt, Homo sapiens
ggauacagauacaaaguga

SEQ ID NO: 519116 - RNA, 19 nt, Homo sapiens
acacuaggcuucauuguug

SEQ ID NO: 519117 - RNA, 19 nt, Homo sapiens
cagauuacauguaugauga

SEQ ID NO: 519118 - RNA, 19 nt, Homo sapiens
caucaggaauguucacuuu

SEQ ID NO: 519119 - RNA, 19 nt, Homo sapiens
gaauuagagugcauuguau

SEQ ID NO: 519120 - RNA, 19 nt, Homo sapiens
caaagaaguugugaaguug

SEQ ID NO: 519121 - RNA, 19 nt, Homo sapiens
gaaggugacaguuguaauu

SEQ ID NO: 519122 - RNA, 19 nt, Homo sapiens
uguggaagcucgucauaua

SEQ ID NO: 519123 - RNA, 19 nt, Homo sapiens
gaaaugaaagucagagcua

SEQ ID NO: 519124 - RNA, 19 nt, Homo sapiens
uaaagaagaugguacucaa

SEQ ID NO: 519125 - RNA, 19 nt, Homo sapiens
gggagacacuagagagaua

SEQ ID NO: 519126 - RNA, 19 nt, Homo sapiens
caagagcuuucaaauagaa

SEQ ID NO: 519127 - RNA, 19 nt, Homo sapiens
cccagaaacuuacauuuaa

SEQ ID NO: 519128 - RNA, 19 nt, Homo sapiens
ggaaaugccuguuuaucca

SEQ ID NO: 519129 - RNA, 19 nt, Homo sapiens
acacaaauauguaguggaa

SEQ ID NO: 519130 - RNA, 19 nt, Homo sapiens
ggaagaugcuggaaauuac

SEQ ID NO: 519131 - RNA, 19 nt, Homo sapiens
ccaaagaguuaacugaaga

SEQ ID NO: 519132 - RNA, 19 nt, Homo sapiens
caaauggacuuucuacaag

SEQ ID NO: 519133 - RNA, 19 nt, Homo sapiens
gcauugaucugagugcuuu

SEQ ID NO: 519134 - RNA, 19 nt, Homo sapiens
ggaagaagagcuagcauug

SEQ ID NO: 519135 - RNA, 19 nt, Homo sapiens
uaaggaagaugcuggaaau

SEQ ID NO: 519136 - RNA, 19 nt, Homo sapiens
cggaagagcugcgcaguaa

SEQ ID NO: 519137 - RNA, 19 nt, Homo sapiens
gugaaaugguaucgaaaua

SEQ ID NO: 519138 - RNA, 19 nt, Homo sapiens
gaaucaagaucaagcaauc

SEQ ID NO: 519139 - RNA, 19 nt, Homo sapiens
ggauaaagagucuaaagaa

SEQ ID NO: 519140 - RNA, 19 nt, Homo sapiens
gaaugaagguucuauuacu

SEQ ID NO: 519141 - RNA, 19 nt, Homo sapiens
ggaagcuccugaaucaauu

SEQ ID NO: 519142 - RNA, 19 nt, Homo sapiens
cuagaaagaugacaacuca

SEQ ID NO: 519143 - RNA, 19 nt, Homo sapiens
gcacggaugucaccugcaa

SEQ ID NO: 519144 - RNA, 19 nt, Homo sapiens
gaaacgaggugaugaaaua

SEQ ID NO: 519145 - RNA, 19 nt, Homo sapiens
gaauauaaguuccguguua

SEQ ID NO: 519146 - RNA, 19 nt, Homo sapiens
gaagaaaucugucacauuc

SEQ ID NO: 519147 - RNA, 19 nt, Homo sapiens
gaaggaaagugcuguauuu

SEQ ID NO: 519148 - RNA, 19 nt, Homo sapiens
caaaggaccugauauaauu

SEQ ID NO: 519149 - RNA, 19 nt, Homo sapiens
gaugacaccucccaaauua

SEQ ID NO: 519150 - RNA, 19 nt, Homo sapiens
gaacaagccuuaauuagga

SEQ ID NO: 519151 - RNA, 19 nt, Homo sapiens
caauguagauggcuuauua

SEQ ID NO: 519152 - RNA, 19 nt, Homo sapiens
gaacagagguccaguuuca

SEQ ID NO: 519153 - RNA, 19 nt, Homo sapiens
gaaacaagaugcugacaaa

SEQ ID NO: 519154 - RNA, 19 nt, Homo sapiens
ugaaaggucucacuaauaa

SEQ ID NO: 519155 - RNA, 19 nt, Homo sapiens
gaucaggaauuccauauuu

SEQ ID NO: 519156 - RNA, 19 nt, Homo sapiens
gcaauaagaugccaguaaa

SEQ ID NO: 519157 - RNA, 19 nt, Homo sapiens
ggaagaaggugaucucuau

SEQ ID NO: 519158 - RNA, 19 nt, Homo sapiens
ggagaaaccuggccgaauu

SEQ ID NO: 519159 - RNA, 19 nt, Homo sapiens
ggucagaacuuauguagaa

SEQ ID NO: 519160 - RNA, 19 nt, Homo sapiens
gaacugacuuacaagguua

SEQ ID NO: 519161 - RNA, 19 nt, Homo sapiens
gcaggcagaucuucaauuu

SEQ ID NO: 519162 - RNA, 19 nt, Homo sapiens
gcauaaagauggcaaagaa

SEQ ID NO: 519163 - RNA, 19 nt, Homo sapiens
gcagugaaaucauaaacua

SEQ ID NO: 519164 - RNA, 19 nt, Homo sapiens
gcagaaggauucaucaauu

SEQ ID NO: 519165 - RNA, 19 nt, Homo sapiens
gaaaucaagugccuagaaa

SEQ ID NO: 519166 - RNA, 19 nt, Homo sapiens
gaagaaagguggaagagau

SEQ ID NO: 519167 - RNA, 19 nt, Homo sapiens
gacaaaggcugauaugauu

SEQ ID NO: 519168 - RNA, 19 nt, Homo sapiens
guggagacauuacauauua

SEQ ID NO: 519169 - RNA, 19 nt, Homo sapiens
gaauuugucugcucuauau

SEQ ID NO: 519170 - RNA, 19 nt, Homo sapiens
gaagugacauuggaugaua

SEQ ID NO: 519171 - RNA, 19 nt, Homo sapiens
uaaagaccguguuguaaua

SEQ ID NO: 519172 - RNA, 19 nt, Homo sapiens
gaaccaaucuuaauaaagg

SEQ ID NO: 519173 - RNA, 19 nt, Homo sapiens
gaacaguacucaucucuuc

SEQ ID NO: 519174 - RNA, 19 nt, Homo sapiens
cuaaagaggugaauuggua

SEQ ID NO: 519175 - RNA, 19 nt, Homo sapiens
gaaagaacuucaggacaua

SEQ ID NO: 519176 - RNA, 19 nt, Homo sapiens
gaaaagggcugaaagaauu

SEQ ID NO: 519177 - RNA, 19 nt, Homo sapiens
gaauacuucuuccguguua

SEQ ID NO: 519178 - RNA, 19 nt, Homo sapiens
gaagugaacgucuuagaua

SEQ ID NO: 519179 - RNA, 19 nt, Homo sapiens
gaacagaagagggcuauua

SEQ ID NO: 519180 - RNA, 19 nt, Homo sapiens
gcagagaguugugaguuua

SEQ ID NO: 519181 - RNA, 19 nt, Homo sapiens
gaugaaagaugaugaagga

SEQ ID NO: 519182 - RNA, 19 nt, Homo sapiens
gaacuuauguagaagauca

SEQ ID NO: 519183 - RNA, 19 nt, Homo sapiens
gaaguaaccaucauuauug

SEQ ID NO: 519184 - RNA, 19 nt, Homo sapiens
caaauuagaugacauugga

SEQ ID NO: 519185 - RNA, 19 nt, Homo sapiens
ccaaagaaguugugaaguu

SEQ ID NO: 519186 - RNA, 19 nt, Homo sapiens
caggaaagcuucaguuuga

SEQ ID NO: 519187 - RNA, 19 nt, Homo sapiens
gggagaagcugcccuuaaa

SEQ ID NO: 519188 - RNA, 19 nt, Homo sapiens
gaacaagccuagaagugaa

SEQ ID NO: 519189 - RNA, 19 nt, Homo sapiens
gggcaagacucacaaauug

SEQ ID NO: 519190 - RNA, 19 nt, Homo sapiens
gacacaagcucuacaacua

SEQ ID NO: 519191 - RNA, 19 nt, Homo sapiens
caaaguugcugauccaauu

SEQ ID NO: 519192 - RNA, 19 nt, Homo sapiens
uagcagaacucaauaaaga

SEQ ID NO: 519193 - RNA, 19 nt, Homo sapiens
ggagauaaauaugacguua

SEQ ID NO: 519194 - RNA, 19 nt, Homo sapiens
gaagaaguaaccaucauua

SEQ ID NO: 519195 - RNA, 19 nt, Homo sapiens
gaugaaagaugaccaggaa

SEQ ID NO: 519196 - RNA, 19 nt, Homo sapiens
gaaggcaucucuuacaaau

SEQ ID NO: 519197 - RNA, 19 nt, Homo sapiens
gaagagggaugauaagaca

SEQ ID NO: 519198 - RNA, 19 nt, Homo sapiens
gauuugagcuuauaaagga

SEQ ID NO: 519199 - RNA, 19 nt, Homo sapiens
gaaaucaucuguaccucaa

SEQ ID NO: 519200 - RNA, 19 nt, Homo sapiens
ugaaggaacuuacacguuu

SEQ ID NO: 519201 - RNA, 19 nt, Homo sapiens
gaaauaggaccaauucuug

SEQ ID NO: 519202 - RNA, 19 nt, Homo sapiens
gauaaugggcuacaucaua

SEQ ID NO: 519203 - RNA, 19 nt, Homo sapiens
gaagaccaauacagagaua

SEQ ID NO: 519204 - RNA, 19 nt, Homo sapiens
gcgcagaagugauuuggua

SEQ ID NO: 519205 - RNA, 19 nt, Homo sapiens
caaaggauaugaugaaauc

SEQ ID NO: 519206 - RNA, 19 nt, Homo sapiens
caaagacacugaaacagaa

SEQ ID NO: 519207 - RNA, 19 nt, Homo sapiens
ggaaggcacuggcccaauu

SEQ ID NO: 519208 - RNA, 19 nt, Homo sapiens
gaccuuaccuguacagaaa

SEQ ID NO: 519209 - RNA, 19 nt, Homo sapiens
gaagagggcuauuaugaag

SEQ ID NO: 519210 - RNA, 19 nt, Homo sapiens
gguacucaaucacuaauua

SEQ ID NO: 519211 - RNA, 19 nt, Homo sapiens
caaagaauauguccugaga

SEQ ID NO: 519212 - RNA, 19 nt, Homo sapiens
guucaggccucuccaauaa

SEQ ID NO: 519213 - RNA, 19 nt, Homo sapiens
ggaagaaccuuuaacugau

SEQ ID NO: 519214 - RNA, 19 nt, Homo sapiens
ugaacuggcugcugaauuu

SEQ ID NO: 519215 - RNA, 19 nt, Homo sapiens
cagaagauauugcugagua

SEQ ID NO: 519216 - RNA, 19 nt, Homo sapiens
ugaagaagauggagaagaa

SEQ ID NO: 519217 - RNA, 19 nt, Homo sapiens
gaaguuaaagcaagugaua

SEQ ID NO: 519218 - RNA, 19 nt, Homo sapiens
gaugacagauuugagcuua

SEQ ID NO: 519219 - RNA, 19 nt, Homo sapiens
ggacagccauuguacuuga

SEQ ID NO: 519220 - RNA, 19 nt, Homo sapiens
ucaaauggcuaaccugaaa

SEQ ID NO: 519221 - RNA, 19 nt, Homo sapiens
gaaaucaaaucaacugaca

SEQ ID NO: 519222 - RNA, 19 nt, Homo sapiens
gaagaaugguguggaaauu

SEQ ID NO: 519223 - RNA, 19 nt, Homo sapiens
ggagaaagauaccaaaugg

SEQ ID NO: 519224 - RNA, 19 nt, Homo sapiens
caaagugaguuacaacaaa

SEQ ID NO: 519225 - RNA, 19 nt, Homo sapiens
gaagagaaacgcuuuguug

SEQ ID NO: 519226 - RNA, 19 nt, Homo sapiens
gaaguuaacaguacacauu

SEQ ID NO: 519227 - RNA, 19 nt, Homo sapiens
caaacuacgucauugaauu

SEQ ID NO: 519228 - RNA, 19 nt, Homo sapiens
gagaauggcucaugaaggu

SEQ ID NO: 519229 - RNA, 19 nt, Homo sapiens
gaaacaauacugagaacua

SEQ ID NO: 519230 - RNA, 19 nt, Homo sapiens
gcaaauaacucaggagaag

SEQ ID NO: 519231 - RNA, 19 nt, Homo sapiens
cuaaagaggugaaacaaga

SEQ ID NO: 519232 - RNA, 19 nt, Homo sapiens
caaaggcacuuacacaguu

SEQ ID NO: 519233 - RNA, 19 nt, Homo sapiens
aaauaaagcugguguuuca

SEQ ID NO: 519234 - RNA, 19 nt, Homo sapiens
gauaugaaauacugacuga

SEQ ID NO: 519235 - RNA, 19 nt, Homo sapiens
caacaaaugucuacuggau

SEQ ID NO: 519236 - RNA, 19 nt, Homo sapiens
uagaggacguuaccauuua

SEQ ID NO: 519237 - RNA, 19 nt, Homo sapiens
guauaaagauggcauugaa

SEQ ID NO: 519238 - RNA, 19 nt, Homo sapiens
gcagagccacuaacaaaua

SEQ ID NO: 519239 - RNA, 19 nt, Homo sapiens
ugaaggaucucauaccaaa

SEQ ID NO: 519240 - RNA, 19 nt, Homo sapiens
ucacagauguaaccaauga

SEQ ID NO: 519241 - RNA, 19 nt, Homo sapiens
gaagugauuugguauaaag

SEQ ID NO: 519242 - RNA, 19 nt, Homo sapiens
gaauauuccugugaaguaa

SEQ ID NO: 519243 - RNA, 19 nt, Homo sapiens
gcauguaccuuguuacuuc

SEQ ID NO: 519244 - RNA, 19 nt, Homo sapiens
gaaacgaggugaugaaaua

SEQ ID NO: 519245 - RNA, 19 nt, Homo sapiens
gaauauaaguuccguguua

SEQ ID NO: 519246 - RNA, 19 nt, Homo sapiens
gaagaaaucugucacauuc

SEQ ID NO: 519247 - RNA, 19 nt, Homo sapiens
gaaggaaagugcuguauuu

SEQ ID NO: 519248 - RNA, 19 nt, Homo sapiens
caaaggaccugauauaauu

SEQ ID NO: 519249 - RNA, 19 nt, Homo sapiens
gaugacaccucccaaauua

SEQ ID NO: 519250 - RNA, 19 nt, Homo sapiens
gaacaagccuuaauuagga

SEQ ID NO: 519251 - RNA, 19 nt, Homo sapiens
caauguagauggcuuauua

SEQ ID NO: 519252 - RNA, 19 nt, Homo sapiens
gaacagagguccaguuuca

SEQ ID NO: 519253 - RNA, 19 nt, Homo sapiens
gaaacaagaugcugacaaa

SEQ ID NO: 519254 - RNA, 19 nt, Homo sapiens
ugaaaggucucacuaauaa

SEQ ID NO: 519255 - RNA, 19 nt, Homo sapiens
gaucaggaauuccauauuu

SEQ ID NO: 519256 - RNA, 19 nt, Homo sapiens
gcaauaagaugccaguaaa

SEQ ID NO: 519257 - RNA, 19 nt, Homo sapiens
ggaagaaggugaucucuau

SEQ ID NO: 519258 - RNA, 19 nt, Homo sapiens
ggagaaaccuggccgaauu

SEQ ID NO: 519259 - RNA, 19 nt, Homo sapiens
ggucagaacuuauguagaa

SEQ ID NO: 519260 - RNA, 19 nt, Homo sapiens
gaacugacuuacaagguua

SEQ ID NO: 519261 - RNA, 19 nt, Homo sapiens
gaaaguguaucucaaaguu

SEQ ID NO: 519262 - RNA, 19 nt, Homo sapiens
gcaggcagaucuucaauuu

SEQ ID NO: 519263 - RNA, 19 nt, Homo sapiens
gcauaaagauggcaaagaa

SEQ ID NO: 519264 - RNA, 19 nt, Homo sapiens
gcagugaaaucauaaacua

SEQ ID NO: 519265 - RNA, 19 nt, Homo sapiens
gcagaaggauucaucaauu

SEQ ID NO: 519266 - RNA, 19 nt, Homo sapiens
gcacugagcuaucuaagga

SEQ ID NO: 519267 - RNA, 19 nt, Homo sapiens
gaaaucaagugccuagaaa

SEQ ID NO: 519268 - RNA, 19 nt, Homo sapiens
gaagaaagguggaagagau

SEQ ID NO: 519269 - RNA, 19 nt, Homo sapiens
gacaaaggcugauaugauu

SEQ ID NO: 519270 - RNA, 19 nt, Homo sapiens
guggagacauuacauauua

SEQ ID NO: 519271 - RNA, 19 nt, Homo sapiens
gaauuugucugcucuauau

SEQ ID NO: 519272 - RNA, 19 nt, Homo sapiens
gaagugacauuggaugaua

SEQ ID NO: 519273 - RNA, 19 nt, Homo sapiens
uaaagaccguguuguaaua

SEQ ID NO: 519274 - RNA, 19 nt, Homo sapiens
gaaccaaucuuaauaaagg

SEQ ID NO: 519275 - RNA, 19 nt, Homo sapiens
gaacaguacucaucucuuc

SEQ ID NO: 519276 - RNA, 19 nt, Homo sapiens
cuaaagaggugaauuggua

SEQ ID NO: 519277 - RNA, 19 nt, Homo sapiens
gaaagaacuucaggacaua

SEQ ID NO: 519278 - RNA, 19 nt, Homo sapiens
gaaaagggcugaaagaauu

SEQ ID NO: 519279 - RNA, 19 nt, Homo sapiens
gaauacuucuuccguguua

SEQ ID NO: 519280 - RNA, 19 nt, Homo sapiens
gaagugaacgucuuagaua

SEQ ID NO: 519281 - RNA, 19 nt, Homo sapiens
ucacgaaggugcaaagaua

SEQ ID NO: 519282 - RNA, 19 nt, Homo sapiens
gaacagaagagggcuauua

SEQ ID NO: 519283 - RNA, 19 nt, Homo sapiens
gcagagaguugugaguuua

SEQ ID NO: 519284 - RNA, 19 nt, Homo sapiens
gaugaaagaugaugaagga

SEQ ID NO: 519285 - RNA, 19 nt, Homo sapiens
gaacuuauguagaagauca

SEQ ID NO: 519286 - RNA, 19 nt, Homo sapiens
gaaguaaccaucauuauug

SEQ ID NO: 519287 - RNA, 19 nt, Homo sapiens
caaauuagaugacauugga

SEQ ID NO: 519288 - RNA, 19 nt, Homo sapiens
ccaaagaaguugugaaguu

SEQ ID NO: 519289 - RNA, 19 nt, Homo sapiens
caggaaagcuucaguuuga

SEQ ID NO: 519290 - RNA, 19 nt, Homo sapiens
gggagaagcugcccuuaaa

SEQ ID NO: 519291 - RNA, 19 nt, Homo sapiens
gaacaagccuagaagugaa

SEQ ID NO: 519292 - RNA, 19 nt, Homo sapiens
gggcaagacucacaaauug

SEQ ID NO: 519293 - RNA, 19 nt, Homo sapiens
gacacaagcucuacaacua

SEQ ID NO: 519294 - RNA, 19 nt, Homo sapiens
caaaguugcugauccaauu

SEQ ID NO: 519295 - RNA, 19 nt, Homo sapiens
uagcagaacucaauaaaga

SEQ ID NO: 519296 - RNA, 19 nt, Homo sapiens
ggagauaaauaugacguua

SEQ ID NO: 519297 - RNA, 19 nt, Homo sapiens
gaagaaguaaccaucauua

SEQ ID NO: 519298 - RNA, 19 nt, Homo sapiens
gaugaaagaugaccaggaa

SEQ ID NO: 519299 - RNA, 19 nt, Homo sapiens
gaaggcaucucuuacaaau

SEQ ID NO: 519300 - RNA, 19 nt, Homo sapiens
gaagagggaugauaagaca

SEQ ID NO: 519301 - RNA, 19 nt, Homo sapiens
gauuugagcuuauaaagga

SEQ ID NO: 519302 - RNA, 19 nt, Homo sapiens
gaaaucaucuguaccucaa

SEQ ID NO: 519303 - RNA, 19 nt, Homo sapiens
ugaaggaacuuacacguuu

SEQ ID NO: 519304 - RNA, 19 nt, Homo sapiens
gaaauaggaccaauucuug

SEQ ID NO: 519305 - RNA, 19 nt, Homo sapiens
gauaaugggcuacaucaua

SEQ ID NO: 519306 - RNA, 19 nt, Homo sapiens
gaagaccaauacagagaua

SEQ ID NO: 519307 - RNA, 19 nt, Homo sapiens
gcgcagaagugauuuggua

SEQ ID NO: 519308 - RNA, 19 nt, Homo sapiens
caaaggauaugaugaaauc

SEQ ID NO: 519309 - RNA, 19 nt, Homo sapiens
caaagacacugaaacagaa

SEQ ID NO: 519310 - RNA, 19 nt, Homo sapiens
ggaaggcacuggcccaauu

SEQ ID NO: 519311 - RNA, 19 nt, Homo sapiens
gaccuuaccuguacagaaa

SEQ ID NO: 519312 - RNA, 19 nt, Homo sapiens
gaagagggcuauuaugaag

SEQ ID NO: 519313 - RNA, 19 nt, Homo sapiens
gguacucaaucacuaauua

SEQ ID NO: 519314 - RNA, 19 nt, Homo sapiens
caaagaauauguccugaga

SEQ ID NO: 519315 - RNA, 19 nt, Homo sapiens
guucaggccucuccaauaa

SEQ ID NO: 519316 - RNA, 19 nt, Homo sapiens
ggaagaaccuuuaacugau

SEQ ID NO: 519317 - RNA, 19 nt, Homo sapiens
ugaacuggcugcugaauuu

SEQ ID NO: 519318 - RNA, 19 nt, Homo sapiens
cagaagauauugcugagua

SEQ ID NO: 519319 - RNA, 19 nt, Homo sapiens
ugaagaagauggagaagaa

SEQ ID NO: 519320 - RNA, 19 nt, Homo sapiens
gaaguuaaagcaagugaua

SEQ ID NO: 519321 - RNA, 19 nt, Homo sapiens
gaugacagauuugagcuua

SEQ ID NO: 519322 - RNA, 19 nt, Homo sapiens
ggacagccauuguacuuga

SEQ ID NO: 519323 - RNA, 19 nt, Homo sapiens
ucaaauggcuaaccugaaa

SEQ ID NO: 519324 - RNA, 19 nt, Homo sapiens
gaaaucaaaucaacugaca

SEQ ID NO: 519325 - RNA, 19 nt, Homo sapiens
gaagaaugguguggaaauu

SEQ ID NO: 519326 - RNA, 19 nt, Homo sapiens
ggagaaagauaccaaaugg

SEQ ID NO: 519327 - RNA, 19 nt, Homo sapiens
caaagugaguuacaacaaa

SEQ ID NO: 519328 - RNA, 19 nt, Homo sapiens
gaagagaaacgcuuuguug

SEQ ID NO: 519329 - RNA, 19 nt, Homo sapiens
gaaguuaacaguacacauu

SEQ ID NO: 519330 - RNA, 19 nt, Homo sapiens
caaacuacgucauugaauu

SEQ ID NO: 519331 - RNA, 19 nt, Homo sapiens
gagaauggcucaugaaggu

SEQ ID NO: 519332 - RNA, 19 nt, Homo sapiens
gaaacaauacugagaacua

SEQ ID NO: 519333 - RNA, 19 nt, Homo sapiens
gcaaauaacucaggagaag

SEQ ID NO: 519334 - RNA, 19 nt, Homo sapiens
cuaaagaggugaaacaaga

SEQ ID NO: 519335 - RNA, 19 nt, Homo sapiens
aaauaaagcugguguuuca

SEQ ID NO: 519336 - RNA, 19 nt, Homo sapiens
gauaugaaauacugacuga

SEQ ID NO: 519337 - RNA, 19 nt, Homo sapiens
caacaaaugucuacuggau

SEQ ID NO: 519338 - RNA, 19 nt, Homo sapiens
uagaggacguuaccauuua

SEQ ID NO: 519339 - RNA, 19 nt, Homo sapiens
guauaaagauggcauugaa

SEQ ID NO: 519340 - RNA, 19 nt, Homo sapiens
gcagagccacuaacaaaua

SEQ ID NO: 519341 - RNA, 19 nt, Homo sapiens
ugaaggaucucauaccaaa

SEQ ID NO: 519342 - RNA, 19 nt, Homo sapiens
ucacagauguaaccaauga

SEQ ID NO: 519343 - RNA, 19 nt, Homo sapiens
gaagugauuugguauaaag

SEQ ID NO: 519344 - RNA, 19 nt, Homo sapiens
gaagagaacaugaaaguua

SEQ ID NO: 519345 - RNA, 19 nt, Homo sapiens
gcagcaaaguucuuauuua

SEQ ID NO: 519346 - RNA, 19 nt, Homo sapiens
gaagauugcugcuguacuu

SEQ ID NO: 519347 - RNA, 19 nt, Homo sapiens
gaaguuaugucaugugaau

SEQ ID NO: 519348 - RNA, 19 nt, Homo sapiens
uaaaguagcugcucaugug

SEQ ID NO: 519349 - RNA, 19 nt, Homo sapiens
gugaauggcuuccuaacua

SEQ ID NO: 519350 - RNA, 19 nt, Homo sapiens
ggaauaugguggugaagaa

SEQ ID NO: 519351 - RNA, 19 nt, Homo sapiens
gggaacaacuacaaacaaa

SEQ ID NO: 519352 - RNA, 19 nt, Homo sapiens
agaaauaagugcagaucua

SEQ ID NO: 519353 - RNA, 19 nt, Homo sapiens
gagaaguuaugucauguga

SEQ ID NO: 519354 - RNA, 19 nt, Homo sapiens
ggaauggaaucaaggcuau

SEQ ID NO: 519355 - RNA, 19 nt, Homo sapiens
gcaaaguucuuauuuacag

SEQ ID NO: 519356 - RNA, 19 nt, Homo sapiens
caagaagauugcugcugua

SEQ ID NO: 519357 - RNA, 19 nt, Homo sapiens
cagcaaaguucuuauuuac

SEQ ID NO: 519358 - RNA, 19 nt, Homo sapiens
ugaauggcuuccuaacuaa

SEQ ID NO: 519359 - RNA, 19 nt, Homo sapiens
cauccgagcuuauuguaca

SEQ ID NO: 519360 - RNA, 19 nt, Homo sapiens
agcagaauguccagaaaua

SEQ ID NO: 519361 - RNA, 19 nt, Homo sapiens
gauuaucucagcagcauuu

SEQ ID NO: 519362 - RNA, 19 nt, Homo sapiens
gcagaauguccagaaauaa

SEQ ID NO: 519363 - RNA, 19 nt, Homo sapiens
cuaaucacauccgagcuua

SEQ ID NO: 519364 - RNA, 19 nt, Homo sapiens
ugacguauuucgaguaagu

SEQ ID NO: 519365 - RNA, 19 nt, Homo sapiens
uaugacguauuucgaguaa

SEQ ID NO: 519366 - RNA, 19 nt, Homo sapiens
gaaacucagcggaauggaa

SEQ ID NO: 519367 - RNA, 19 nt, Homo sapiens
gaguaagucuaaucacauc

SEQ ID NO: 519368 - RNA, 19 nt, Homo sapiens
gaaaguucguggcauccau

SEQ ID NO: 519369 - RNA, 19 nt, Homo sapiens
gguagaaacucagcggaau

SEQ ID NO: 519370 - RNA, 19 nt, Homo sapiens
ucaaaccauuccugacuga

SEQ ID NO: 519371 - RNA, 19 nt, Homo sapiens
ucaaugagaaguuauguca

SEQ ID NO: 519372 - RNA, 19 nt, Homo sapiens
gugaagaauucuccaugga

SEQ ID NO: 519373 - RNA, 19 nt, Homo sapiens
gaacaacuacaaacaaagc

SEQ ID NO: 519374 - RNA, 19 nt, Homo sapiens
ggaaucaaggcuaucuuug

SEQ ID NO: 519375 - RNA, 19 nt, Homo sapiens
guauuucgaguaagucuaa

SEQ ID NO: 519376 - RNA, 19 nt, Homo sapiens
gaucaaaccauuccugacu

SEQ ID NO: 519377 - RNA, 19 nt, Homo sapiens
ccuaaaggcuggcuaccau

SEQ ID NO: 519378 - RNA, 19 nt, Homo sapiens
gcucaugugcaucuuugua

SEQ ID NO: 519379 - RNA, 19 nt, Homo sapiens
augcuugccugaacuuuaa

SEQ ID NO: 519380 - RNA, 19 nt, Homo sapiens
gcaguuuucucaugcuuuu

SEQ ID NO: 519381 - RNA, 19 nt, Homo sapiens
gaaauaagugcagaucuac

SEQ ID NO: 519382 - RNA, 19 nt, Homo sapiens
auacaugagugauauccaa

SEQ ID NO: 519383 - RNA, 19 nt, Homo sapiens
gagagcagaauguccagaa

SEQ ID NO: 519384 - RNA, 19 nt, Homo sapiens
gaacaugaaaguuauugcu

SEQ ID NO: 519385 - RNA, 19 nt, Homo sapiens
cagcauuucugagagcauu

SEQ ID NO: 519386 - RNA, 19 nt, Homo sapiens
cuacacccuagaaguauua

SEQ ID NO: 519387 - RNA, 19 nt, Homo sapiens
gagcagaauguccagaaau

SEQ ID NO: 519388 - RNA, 19 nt, Homo sapiens
guucguggcauccauuuga

SEQ ID NO: 519389 - RNA, 19 nt, Homo sapiens
ucuggaagguuggcaguuu

SEQ ID NO: 519390 - RNA, 19 nt, Homo sapiens
ggcagcaaaguucuuauuu

SEQ ID NO: 519391 - RNA, 19 nt, Homo sapiens
gugcaucuuuguauguuuc

SEQ ID NO: 519392 - RNA, 19 nt, Homo sapiens
uacaggagguagaaacuca

SEQ ID NO: 519393 - RNA, 19 nt, Homo sapiens
gagaacaugaaaguuauug

SEQ ID NO: 519394 - RNA, 19 nt, Homo sapiens
gaauggcuuccuaacuaaa

SEQ ID NO: 519395 - RNA, 19 nt, Homo sapiens
ggaucccacuggcagcaaa

SEQ ID NO: 519396 - RNA, 19 nt, Homo sapiens
ucgaguaagucuaaucaca

SEQ ID NO: 519397 - RNA, 19 nt, Homo sapiens
acagguguuuggaaagauu

SEQ ID NO: 519398 - RNA, 19 nt, Homo sapiens
ucaugugaauggcuuccua

SEQ ID NO: 519399 - RNA, 19 nt, Homo sapiens
guacuuacggauucauuuc

SEQ ID NO: 519400 - RNA, 19 nt, Homo sapiens
guacuugaagagaacauga

SEQ ID NO: 519401 - RNA, 19 nt, Homo sapiens
aaacucagcggaauggaau

SEQ ID NO: 519402 - RNA, 19 nt, Homo sapiens
cacccuagaaguauuauug

SEQ ID NO: 519403 - RNA, 19 nt, Homo sapiens
agagcagaauguccagaaa

SEQ ID NO: 519404 - RNA, 19 nt, Homo sapiens
ggaacggauucacaugcau

SEQ ID NO: 519405 - RNA, 19 nt, Homo sapiens
uacagcuuaugacguauuu

SEQ ID NO: 519406 - RNA, 19 nt, Homo sapiens
gcaugggaacaacuacaaa

SEQ ID NO: 519407 - RNA, 19 nt, Homo sapiens
aaaccauuccugacugaaa

SEQ ID NO: 519408 - RNA, 19 nt, Homo sapiens
guagaaacucagcggaaug

SEQ ID NO: 519409 - RNA, 19 nt, Homo sapiens
cagaauguccagaaauaag

SEQ ID NO: 519410 - RNA, 19 nt, Homo sapiens
gucaggaauggacaaauuu

SEQ ID NO: 519411 - RNA, 19 nt, Homo sapiens
gcauuucccagacauucuu

SEQ ID NO: 519412 - RNA, 19 nt, Homo sapiens
uggaaucaaggcuaucuuu

SEQ ID NO: 519413 - RNA, 19 nt, Homo sapiens
ucaugugcaucuuuguaug

SEQ ID NO: 519414 - RNA, 19 nt, Homo sapiens
gaauaugguggugaagaau

SEQ ID NO: 519415 - RNA, 19 nt, Homo sapiens
gaauguccagaaauaagug

SEQ ID NO: 519416 - RNA, 19 nt, Homo sapiens
ucuggaauaugguggugaa

SEQ ID NO: 519417 - RNA, 19 nt, Homo sapiens
ggaacaacuacaaacaaag

SEQ ID NO: 519418 - RNA, 19 nt, Homo sapiens
aaucacauccgagcuuauu

SEQ ID NO: 519419 - RNA, 19 nt, Homo sapiens
cguggcauccauuugauaa

SEQ ID NO: 519420 - RNA, 19 nt, Homo sapiens
aaacuaaugcuugccugaa

SEQ ID NO: 519421 - RNA, 19 nt, Homo sapiens
cugguuaaaugaaugaaag

SEQ ID NO: 519422 - RNA, 19 nt, Homo sapiens
ggcuaucuuugaucuggaa

SEQ ID NO: 519423 - RNA, 19 nt, Homo sapiens
ucacauccgagcuuauugu

SEQ ID NO: 519424 - RNA, 19 nt, Homo sapiens
cgaguaagucuaaucacau

SEQ ID NO: 519425 - RNA, 19 nt, Homo sapiens
cugcucaugugcaucuuug

SEQ ID NO: 519426 - RNA, 19 nt, Homo sapiens
aaugcuugccugaacuuua

SEQ ID NO: 519427 - RNA, 19 nt, Homo sapiens
uaaguggagagcagaaugu

SEQ ID NO: 519428 - RNA, 19 nt, Homo sapiens
ucacaugcaugggaacaac

SEQ ID NO: 519429 - RNA, 19 nt, Homo sapiens
acggauucauuuccauuga

SEQ ID NO: 519430 - RNA, 19 nt, Homo sapiens
cugcuguacuuacggauuc

SEQ ID NO: 519431 - RNA, 19 nt, Homo sapiens
uaaggaacggauucacaug

SEQ ID NO: 519432 - RNA, 19 nt, Homo sapiens
uugaagagaacaugaaagu

SEQ ID NO: 519433 - RNA, 19 nt, Homo sapiens
gaaagaaaaggagcaaauc

SEQ ID NO: 519434 - RNA, 19 nt, Homo sapiens
caugugaauggcuuccuaa

SEQ ID NO: 519435 - RNA, 19 nt, Homo sapiens
auaugguggugaagaauuc

SEQ ID NO: 519436 - RNA, 19 nt, Homo sapiens
cuaaaguagcugcucaugu

SEQ ID NO: 519437 - RNA, 19 nt, Homo sapiens
uggcagcaaaguucuuauu

SEQ ID NO: 519438 - RNA, 19 nt, Homo sapiens
ugaagagaacaugaaaguu

SEQ ID NO: 519439 - RNA, 19 nt, Homo sapiens
aauaugguggugaagaauu

SEQ ID NO: 519440 - RNA, 19 nt, Homo sapiens
cacauccgagcuuauugua

SEQ ID NO: 519441 - RNA, 19 nt, Homo sapiens
uuaaggaacggauucacau

SEQ ID NO: 519442 - RNA, 19 nt, Homo sapiens
ucagcggaauggaaucaag

SEQ ID NO: 519443 - RNA, 19 nt, Homo sapiens
uaucucagcagcauuucug

SEQ ID NO: 519444 - RNA, 19 nt, Homo sapiens
ggagaucgcucgugucuua

SEQ ID NO: 519445 - RNA, 19 nt, Homo sapiens
caacugagguuucuuaauu

SEQ ID NO: 519446 - RNA, 19 nt, Homo sapiens
gaaguaauaugcucucauu

SEQ ID NO: 519447 - RNA, 19 nt, Homo sapiens
gcaccaaguucacuguuua

SEQ ID NO: 519448 - RNA, 19 nt, Homo sapiens
gcacaaauuucaucuccua

SEQ ID NO: 519449 - RNA, 19 nt, Homo sapiens
gcaaguuggucuuauagaa

SEQ ID NO: 519450 - RNA, 19 nt, Homo sapiens
gggcagaacagauagauua

SEQ ID NO: 519451 - RNA, 19 nt, Homo sapiens
gcaggacauuuaccucuua

SEQ ID NO: 519452 - RNA, 19 nt, Homo sapiens
gcagaaagcccuucaacuu

SEQ ID NO: 519453 - RNA, 19 nt, Homo sapiens
ccaaguggcccucagauua

SEQ ID NO: 519454 - RNA, 19 nt, Homo sapiens
gggcuaggcucuuguuuga

SEQ ID NO: 519455 - RNA, 19 nt, Homo sapiens
ccaauuaccucaucucugu

SEQ ID NO: 519456 - RNA, 19 nt, Homo sapiens
ggucguaccuugcuuuaga

SEQ ID NO: 519457 - RNA, 19 nt, Homo sapiens
ggacaccuuugccuucuuu

SEQ ID NO: 519458 - RNA, 19 nt, Homo sapiens
gcaguucccuguugaaagu

SEQ ID NO: 519459 - RNA, 19 nt, Homo sapiens
ggacagcuauaucgggaaa

SEQ ID NO: 519460 - RNA, 19 nt, Homo sapiens
caagaauguuguuagcuuu

SEQ ID NO: 519461 - RNA, 19 nt, Homo sapiens
uagaguagauguuuggaaa

SEQ ID NO: 519462 - RNA, 19 nt, Homo sapiens
ugacaggguugguuucaaa

SEQ ID NO: 519463 - RNA, 19 nt, Homo sapiens
uuaggcagcuucucuguaa

SEQ ID NO: 519464 - RNA, 19 nt, Homo sapiens
ggccuucccuucucuaauu

SEQ ID NO: 519465 - RNA, 19 nt, Homo sapiens
ucaccuagcugguuaaugg

SEQ ID NO: 519466 - RNA, 19 nt, Homo sapiens
ucucaucacuaccuuuaua

SEQ ID NO: 519467 - RNA, 19 nt, Homo sapiens
gaaaggcaaguuggucuua

SEQ ID NO: 519468 - RNA, 19 nt, Homo sapiens
gauuacacuucuccagaua

SEQ ID NO: 519469 - RNA, 19 nt, Homo sapiens
ccaagaauguuguuagcuu

SEQ ID NO: 519470 - RNA, 19 nt, Homo sapiens
gcacuuaguagcuauguga

SEQ ID NO: 519471 - RNA, 19 nt, Homo sapiens
guaauaugcucucauuucu

SEQ ID NO: 519472 - RNA, 19 nt, Homo sapiens
gaaggccacaucaacuuua

SEQ ID NO: 519473 - RNA, 19 nt, Homo sapiens
ggaagagaaagaagaguaa

SEQ ID NO: 519474 - RNA, 19 nt, Homo sapiens
ggaaggagaagaagggaaa

SEQ ID NO: 519475 - RNA, 19 nt, Homo sapiens
gaacaaccaggaggaagua

SEQ ID NO: 519476 - RNA, 19 nt, Homo sapiens
gagaaugaaugaguaggaa

SEQ ID NO: 519477 - RNA, 19 nt, Homo sapiens
gugauuauauuccugagaa

SEQ ID NO: 519478 - RNA, 19 nt, Homo sapiens
gauccagaguuuccuagaa

SEQ ID NO: 519479 - RNA, 19 nt, Homo sapiens
gcucuggucuguagguuug

SEQ ID NO: 519480 - RNA, 19 nt, Homo sapiens
gaacauacucuagugaaug

SEQ ID NO: 519481 - RNA, 19 nt, Homo sapiens
ccaagaaacuaguaucucu

SEQ ID NO: 519482 - RNA, 19 nt, Homo sapiens
ugaagaaucucuccucucu

SEQ ID NO: 519483 - RNA, 19 nt, Homo sapiens
cuagcacgcuggcagaaua

SEQ ID NO: 519484 - RNA, 19 nt, Homo sapiens
aaacugcgguccaacuuga

SEQ ID NO: 519485 - RNA, 19 nt, Homo sapiens
uagauggacuuccugguuu

SEQ ID NO: 519486 - RNA, 19 nt, Homo sapiens
ggaaaggaauaaggauguu

SEQ ID NO: 519487 - RNA, 19 nt, Homo sapiens
cagcagcacuggcagaaga

SEQ ID NO: 519488 - RNA, 19 nt, Homo sapiens
ggaguuggcuggaucuuuu

SEQ ID NO: 519489 - RNA, 19 nt, Homo sapiens
gcaaugacccggacuacau

SEQ ID NO: 519490 - RNA, 19 nt, Homo sapiens
gcaaucaacugagguuucu

SEQ ID NO: 519491 - RNA, 19 nt, Homo sapiens
ggaauuaaugacagaauga

SEQ ID NO: 519492 - RNA, 19 nt, Homo sapiens
gcagggaauuaaugacaga

SEQ ID NO: 519493 - RNA, 19 nt, Homo sapiens
gaagggagacauccaagug

SEQ ID NO: 519494 - RNA, 19 nt, Homo sapiens
guaccuugcuuuagaguag

SEQ ID NO: 519495 - RNA, 19 nt, Homo sapiens
aggcugagauccagaguuu

SEQ ID NO: 519496 - RNA, 19 nt, Homo sapiens
ugagguuucuuaauuguga

SEQ ID NO: 519497 - RNA, 19 nt, Homo sapiens
agaaagcccuucaacuuca

SEQ ID NO: 519498 - RNA, 19 nt, Homo sapiens
ggaaggaagagaaagaaga

SEQ ID NO: 519499 - RNA, 19 nt, Homo sapiens
gcucucaucacuaccuuua

SEQ ID NO: 519500 - RNA, 19 nt, Homo sapiens
gaaugagucugcuuucacu

SEQ ID NO: 519501 - RNA, 19 nt, Homo sapiens
gaaauugaacauacucuag

SEQ ID NO: 519502 - RNA, 19 nt, Homo sapiens
uaugaucgccuguggauuu

SEQ ID NO: 519503 - RNA, 19 nt, Homo sapiens
cuuaguagcuaugugauuu

SEQ ID NO: 519504 - RNA, 19 nt, Homo sapiens
gaaagcacuacugcacuua

SEQ ID NO: 519505 - RNA, 19 nt, Homo sapiens
gggaauuaaugacagaaug

SEQ ID NO: 519506 - RNA, 19 nt, Homo sapiens
ccucccagcuaaauaguaa

SEQ ID NO: 519507 - RNA, 19 nt, Homo sapiens
gcuaggcucuuguuugagu

SEQ ID NO: 519508 - RNA, 19 nt, Homo sapiens
guaguguguuguagucgua

SEQ ID NO: 519509 - RNA, 19 nt, Homo sapiens
caaguuggucuuauagaaa

SEQ ID NO: 519510 - RNA, 19 nt, Homo sapiens
cagaacagauagauuacga

SEQ ID NO: 519511 - RNA, 19 nt, Homo sapiens
cagaagauguuuccauguc

SEQ ID NO: 519512 - RNA, 19 nt, Homo sapiens
gcuccaaggugcucugugu

SEQ ID NO: 519513 - RNA, 19 nt, Homo sapiens
caacucuucuccaagucua

SEQ ID NO: 519514 - RNA, 19 nt, Homo sapiens
gcugagcuuucuagccuaa

SEQ ID NO: 519515 - RNA, 19 nt, Homo sapiens
ggaaagacaggcugagcuu

SEQ ID NO: 519516 - RNA, 19 nt, Homo sapiens
aauguuaggucaagcuauu

SEQ ID NO: 519517 - RNA, 19 nt, Homo sapiens
gauugaaaccauuccagua

SEQ ID NO: 519518 - RNA, 19 nt, Homo sapiens
gaagcuauaagagaacuuu

SEQ ID NO: 519519 - RNA, 19 nt, Homo sapiens
caacaggcuccaggucuua

SEQ ID NO: 519520 - RNA, 19 nt, Homo sapiens
gcaggacccuuaggaaucu

SEQ ID NO: 519521 - RNA, 19 nt, Homo sapiens
gagcagaagcagaagaaga

SEQ ID NO: 519522 - RNA, 19 nt, Homo sapiens
cuuuauagcucaucacugu

SEQ ID NO: 519523 - RNA, 19 nt, Homo sapiens
gcucgugucuuagaugaug

SEQ ID NO: 519524 - RNA, 19 nt, Homo sapiens
gugaauguguguauguaug

SEQ ID NO: 519525 - RNA, 19 nt, Homo sapiens
caaguucacuguuuaugac

SEQ ID NO: 519526 - RNA, 19 nt, Homo sapiens
agaaagcacuacugcacuu

SEQ ID NO: 519527 - RNA, 19 nt, Homo sapiens
gcacaaaauucuagaagca

SEQ ID NO: 519528 - RNA, 19 nt, Homo sapiens
guucagaggaagcacauaa

SEQ ID NO: 519529 - RNA, 19 nt, Homo sapiens
ugaaugacaagcaucagua

SEQ ID NO: 519530 - RNA, 19 nt, Homo sapiens
guaguaguguguuguaguc

SEQ ID NO: 519531 - RNA, 19 nt, Homo sapiens
gaucucagcauucaaagca

SEQ ID NO: 519532 - RNA, 19 nt, Homo sapiens
aaggcaaguuggucuuaua

SEQ ID NO: 519533 - RNA, 19 nt, Homo sapiens
gaggggagaugcugggaua

SEQ ID NO: 519534 - RNA, 19 nt, Homo sapiens
gcaguugggagugaguuua

SEQ ID NO: 519535 - RNA, 19 nt, Homo sapiens
gaaugggacagggugaaua

SEQ ID NO: 519536 - RNA, 19 nt, Homo sapiens
gaauccugcugccagagaa

SEQ ID NO: 519537 - RNA, 19 nt, Homo sapiens
gaagagaaagaagaguaaa

SEQ ID NO: 519538 - RNA, 19 nt, Homo sapiens
ucccuucucuaauuccuua

SEQ ID NO: 519539 - RNA, 19 nt, Homo sapiens
caagugacaggguugguuu

SEQ ID NO: 519540 - RNA, 19 nt, Homo sapiens
aaucaacugagguuucuua

SEQ ID NO: 519541 - RNA, 19 nt, Homo sapiens
gagcagucccuaaugguau

SEQ ID NO: 519542 - RNA, 19 nt, Homo sapiens
cagaaagcccuucaacuuc

SEQ ID NO: 519543 - RNA, 19 nt, Homo sapiens
uuaaacaacugcagaaagc

SEQ ID NO: 519544 - RNA, 19 nt, Homo sapiens
gggaugggauuucauguaa

SEQ ID NO: 519545 - RNA, 19 nt, Homo sapiens
ggaaauagacaccaaaucu

SEQ ID NO: 519546 - RNA, 19 nt, Homo sapiens
gaaauagacaccaaaucuu

SEQ ID NO: 519547 - RNA, 19 nt, Homo sapiens
gaauccaaguguccucuga

SEQ ID NO: 519548 - RNA, 19 nt, Homo sapiens
caacugaggaggaauuugu

SEQ ID NO: 519549 - RNA, 19 nt, Homo sapiens
uagaagggauauacaaagu

SEQ ID NO: 519550 - RNA, 19 nt, Homo sapiens
uaaccaagaguauuccauu

SEQ ID NO: 519551 - RNA, 19 nt, Homo sapiens
ggaauuuguagaagggaua

SEQ ID NO: 519552 - RNA, 19 nt, Homo sapiens
ggucaaaguucuagaugcu

SEQ ID NO: 519553 - RNA, 19 nt, Homo sapiens
cagaaaggcugcugaugac

SEQ ID NO: 519554 - RNA, 19 nt, Homo sapiens
aaccaagaguauuccauuu

SEQ ID NO: 519555 - RNA, 19 nt, Homo sapiens
gacgagggaugggauuuca

SEQ ID NO: 519556 - RNA, 19 nt, Homo sapiens
ucaccaaucccaaggaaug

SEQ ID NO: 519557 - RNA, 19 nt, Homo sapiens
gaggaggaauuuguagaag

SEQ ID NO: 519558 - RNA, 19 nt, Homo sapiens
gugcauguguucagaaagg

SEQ ID NO: 519559 - RNA, 19 nt, Homo sapiens
gcagagacaauaaaacauu

SEQ ID NO: 519560 - RNA, 19 nt, Homo sapiens
ggauauacaaaguggaaau

SEQ ID NO: 519561 - RNA, 19 nt, Homo sapiens
ucacaacugaggaggaauu

SEQ ID NO: 519562 - RNA, 19 nt, Homo sapiens
guagaagggauauacaaag

SEQ ID NO: 519563 - RNA, 19 nt, Homo sapiens
ugaggaggaauuuguagaa

SEQ ID NO: 519564 - RNA, 19 nt, Homo sapiens
caauaaaacauuccuguga

SEQ ID NO: 519565 - RNA, 19 nt, Homo sapiens
cgucaccaaucccaaggaa

SEQ ID NO: 519566 - RNA, 19 nt, Homo sapiens
cauguaaccaagaguauuc

SEQ ID NO: 519567 - RNA, 19 nt, Homo sapiens
gaugggauuucauguaacc

SEQ ID NO: 519568 - RNA, 19 nt, Homo sapiens
ggacgagggaugggauuuc

SEQ ID NO: 519569 - RNA, 19 nt, Homo sapiens
cugccuugcuggacuggua

SEQ ID NO: 519570 - RNA, 19 nt, Homo sapiens
uugcuggacugguauuugu

SEQ ID NO: 519571 - RNA, 19 nt, Homo sapiens
gauuucauguaaccaagag

SEQ ID NO: 519572 - RNA, 19 nt, Homo sapiens
ccaaguguccucugauggu

SEQ ID NO: 519573 - RNA, 19 nt, Homo sapiens
cgagggaugggauuucaug

SEQ ID NO: 519574 - RNA, 19 nt, Homo sapiens
ccgugcauguguucagaaa

SEQ ID NO: 519575 - RNA, 19 nt, Homo sapiens
gauggucaaaguucuagau

SEQ ID NO: 519576 - RNA, 19 nt, Homo sapiens
ggauuucauguaaccaaga

SEQ ID NO: 519577 - RNA, 19 nt, Homo sapiens
gcaugcagaggugguauuc

SEQ ID NO: 519578 - RNA, 19 nt, Homo sapiens
ggccgugcauguguucaga

SEQ ID NO: 519579 - RNA, 19 nt, Homo sapiens
gacugguauuugugucuga

SEQ ID NO: 519580 - RNA, 19 nt, Homo sapiens
guccaggcagagacaauaa

SEQ ID NO: 519581 - RNA, 19 nt, Homo sapiens
ggaugggauuucauguaac

SEQ ID NO: 519582 - RNA, 19 nt, Homo sapiens
gaauuuguagaagggauau

SEQ ID NO: 519583 - RNA, 19 nt, Homo sapiens
ccucugauggucaaaguuc

SEQ ID NO: 519584 - RNA, 19 nt, Homo sapiens
ucaauguggccgugcaugu

SEQ ID NO: 519585 - RNA, 19 nt, Homo sapiens
uuucauguaaccaagagua

SEQ ID NO: 519586 - RNA, 19 nt, Homo sapiens
caauguggccgugcaugug

SEQ ID NO: 519587 - RNA, 19 nt, Homo sapiens
gcaaaauccuuucgaaaua

SEQ ID NO: 519588 - RNA, 19 nt, Homo sapiens
caaauugucuccuccauca

SEQ ID NO: 519589 - RNA, 19 nt, Homo sapiens
gaucaccaaugccugcuuu

SEQ ID NO: 519590 - RNA, 19 nt, Homo sapiens
ggacaacgaagcaaucuau

SEQ ID NO: 519591 - RNA, 19 nt, Homo sapiens
gcugggagcucuauugcuu

SEQ ID NO: 519592 - RNA, 19 nt, Homo sapiens
gcaggcagguguccagaug

SEQ ID NO: 519593 - RNA, 19 nt, Homo sapiens
ugacagaguuccagaccaa

SEQ ID NO: 519594 - RNA, 19 nt, Homo sapiens
caaccucaaucgccucauu

SEQ ID NO: 519595 - RNA, 19 nt, Homo sapiens
ggagcucuauugcuuggaa

SEQ ID NO: 519596 - RNA, 19 nt, Homo sapiens
gagauguggugcccaagga

SEQ ID NO: 519597 - RNA, 19 nt, Homo sapiens
gcagcugccuggagccuau

SEQ ID NO: 519598 - RNA, 19 nt, Homo sapiens
ccagucaucucugcagaaa

SEQ ID NO: 519599 - RNA, 19 nt, Homo sapiens
gaagcaaucuaugacaucu

SEQ ID NO: 519600 - RNA, 19 nt, Homo sapiens
gggcguuugugcacuggua

SEQ ID NO: 519601 - RNA, 19 nt, Homo sapiens
gcggcucucuguugacuau

SEQ ID NO: 519602 - RNA, 19 nt, Homo sapiens
uggcagagaucaccaaugc

SEQ ID NO: 519603 - RNA, 19 nt, Homo sapiens
gcucaucacugggaaagag

SEQ ID NO: 519604 - RNA, 19 nt, Homo sapiens
gagccuauucacuauguuu

SEQ ID NO: 519605 - RNA, 19 nt, Homo sapiens
ucaccucacuccugaugga

SEQ ID NO: 519606 - RNA, 19 nt, Homo sapiens
gaccugauguaugccaaga

SEQ ID NO: 519607 - RNA, 19 nt, Homo sapiens
caaguucgaccugauguau

SEQ ID NO: 519608 - RNA, 19 nt, Homo sapiens
gccuggagccuauucacua

SEQ ID NO: 519609 - RNA, 19 nt, Homo sapiens
gcagaugcccagugacaag

SEQ ID NO: 519610 - RNA, 19 nt, Homo sapiens
caacgaagcaaucuaugac

SEQ ID NO: 519611 - RNA, 19 nt, Homo sapiens
ccuggagccuauucacuau

SEQ ID NO: 519612 - RNA, 19 nt, Homo sapiens
acaacgaagcaaucuauga

SEQ ID NO: 519613 - RNA, 19 nt, Homo sapiens
ccacaaguucgaccugaug

SEQ ID NO: 519614 - RNA, 19 nt, Homo sapiens
gcuguaccguggagaugug

SEQ ID NO: 519615 - RNA, 19 nt, Homo sapiens
caaccuacaccaaccucaa

SEQ ID NO: 519616 - RNA, 19 nt, Homo sapiens
gaugagggagaagaauaaa

SEQ ID NO: 519617 - RNA, 19 nt, Homo sapiens
ggaugucaacgcugccauu

SEQ ID NO: 519618 - RNA, 19 nt, Homo sapiens
gagccuacggucauugaug

SEQ ID NO: 519619 - RNA, 19 nt, Homo sapiens
caagcgcagcauucaguuu

SEQ ID NO: 519620 - RNA, 19 nt, Homo sapiens
gggcaucgacuccuaugag

SEQ ID NO: 519621 - RNA, 19 nt, Homo sapiens
gcgcagcauucaguuugug

SEQ ID NO: 519622 - RNA, 19 nt, Homo sapiens
uggagccuauucacuaugu

SEQ ID NO: 519623 - RNA, 19 nt, Homo sapiens
gaugucaacgcugccauug

SEQ ID NO: 519624 - RNA, 19 nt, Homo sapiens
gucgagcccuacaacucua

SEQ ID NO: 519625 - RNA, 19 nt, Homo sapiens
ggucgagcccuacaacucu

SEQ ID NO: 519626 - RNA, 19 nt, Homo sapiens
gcuucaagguugguaucaa

SEQ ID NO: 519627 - RNA, 19 nt, Homo sapiens
uguugacuauggcaagaaa

SEQ ID NO: 519628 - RNA, 19 nt, Homo sapiens
aagcgcagcauucaguuug

SEQ ID NO: 519629 - RNA, 19 nt, Homo sapiens
gcuuugagccugccaacca

SEQ ID NO: 519630 - RNA, 19 nt, Homo sapiens
ggaugcugccaacaacuau

SEQ ID NO: 519631 - RNA, 19 nt, Homo sapiens
uugaugagauccgaaaugg

SEQ ID NO: 519632 - RNA, 19 nt, Homo sapiens
ggagccuauucacuauguu

SEQ ID NO: 519633 - RNA, 19 nt, Homo sapiens
gcauggaggagggugaguu

SEQ ID NO: 519634 - RNA, 19 nt, Homo sapiens
caagaccaagcgcagcauu

SEQ ID NO: 519635 - RNA, 19 nt, Homo sapiens
gugaaacuggugcuggaaa

SEQ ID NO: 519636 - RNA, 19 nt, Homo sapiens
ugaaacuggugcuggaaaa

SEQ ID NO: 519637 - RNA, 19 nt, Homo sapiens
cgaagcaaucuaugacauc

SEQ ID NO: 519638 - RNA, 19 nt, Homo sapiens
aagaggaugcugccaacaa

SEQ ID NO: 519639 - RNA, 19 nt, Homo sapiens
ucaccaaugccugcuuuga

SEQ ID NO: 519640 - RNA, 19 nt, Homo sapiens
agaggaugcugccaacaac

SEQ ID NO: 519641 - RNA, 19 nt, Homo sapiens
gccauugccgccaucaaga

SEQ ID NO: 519642 - RNA, 19 nt, Homo sapiens
gccaaauugucuccuccau

SEQ ID NO: 519643 - RNA, 19 nt, Homo sapiens
aaccucaaucgccucauua

SEQ ID NO: 519644 - RNA, 19 nt, Homo sapiens
acgaagcaaucuaugacau

SEQ ID NO: 519645 - RNA, 19 nt, Homo sapiens
ggcacuggcucuggcuuca

SEQ ID NO: 519646 - RNA, 19 nt, Homo sapiens
uaaguucgaucucauguau

SEQ ID NO: 519647 - RNA, 19 nt, Homo sapiens
ggucagaugccaagugaua

SEQ ID NO: 519648 - RNA, 19 nt, Homo sapiens
gaagaugcggccaauaauu

SEQ ID NO: 519649 - RNA, 19 nt, Homo sapiens
gcaauuaaagguucuguau

SEQ ID NO: 519650 - RNA, 19 nt, Homo sapiens
ccaaucagauggucaagug

SEQ ID NO: 519651 - RNA, 19 nt, Homo sapiens
gaaggaagaugcggccaau

SEQ ID NO: 519652 - RNA, 19 nt, Homo sapiens
aagaugcggccaauaauua

SEQ ID NO: 519653 - RNA, 19 nt, Homo sapiens
gaccauaaguucgaucuca

SEQ ID NO: 519654 - RNA, 19 nt, Homo sapiens
gcaagaaguccaagcuaga

SEQ ID NO: 519655 - RNA, 19 nt, Homo sapiens
acaaugaagccaucuauga

SEQ ID NO: 519656 - RNA, 19 nt, Homo sapiens
ucaacacguucuucaguga

SEQ ID NO: 519657 - RNA, 19 nt, Homo sapiens
ggauuuaaggugggcauua

SEQ ID NO: 519658 - RNA, 19 nt, Homo sapiens
ggaagaugcggccaauaau

SEQ ID NO: 519659 - RNA, 19 nt, Homo sapiens
caacaugcgugaguguauc

SEQ ID NO: 519660 - RNA, 19 nt, Homo sapiens
ugacggaauuccagaccaa

SEQ ID NO: 519661 - RNA, 19 nt, Homo sapiens
aggaagaugcggccaauaa

SEQ ID NO: 519662 - RNA, 19 nt, Homo sapiens
ucgcaucucugcucaugga

SEQ ID NO: 519663 - RNA, 19 nt, Homo sapiens
gaugaagugcgcacaggaa

SEQ ID NO: 519664 - RNA, 19 nt, Homo sapiens
ggaacuguacugccuggaa

SEQ ID NO: 519665 - RNA, 19 nt, Homo sapiens
cgacaaugaagccaucuau

SEQ ID NO: 519666 - RNA, 19 nt, Homo sapiens
ggaauuccagaccaaccua

SEQ ID NO: 519667 - RNA, 19 nt, Homo sapiens
gaaccuauaggcagcucuu

SEQ ID NO: 519668 - RNA, 19 nt, Homo sapiens
cugcagggcuuccucaucu

SEQ ID NO: 519669 - RNA, 19 nt, Homo sapiens
gggccuuugugcacuggua

SEQ ID NO: 519670 - RNA, 19 nt, Homo sapiens
guucgcaucucugcucaug

SEQ ID NO: 519671 - RNA, 19 nt, Homo sapiens
gcucuggguucgcaucucu

SEQ ID NO: 519672 - RNA, 19 nt, Homo sapiens
ucagaugccaagugauaaa

SEQ ID NO: 519673 - RNA, 19 nt, Homo sapiens
gaagaggugggcguggauu

SEQ ID NO: 519674 - RNA, 19 nt, Homo sapiens
cagaucguguccuccauca

SEQ ID NO: 519675 - RNA, 19 nt, Homo sapiens
ccacguacaccaaccucaa

SEQ ID NO: 519676 - RNA, 19 nt, Homo sapiens
aauguggacuugacggaau

SEQ ID NO: 519677 - RNA, 19 nt, Homo sapiens
gcagggcuuccucaucuuc

SEQ ID NO: 519678 - RNA, 19 nt, Homo sapiens
gcaggcaggaguccagauc

SEQ ID NO: 519679 - RNA, 19 nt, Homo sapiens
gacaaugaagccaucuaug

SEQ ID NO: 519680 - RNA, 19 nt, Homo sapiens
ucaacaugcgugaguguau

SEQ ID NO: 519681 - RNA, 19 nt, Homo sapiens
caaugaagccaucuaugac

SEQ ID NO: 519682 - RNA, 19 nt, Homo sapiens
gcugaucaccgggaaggaa

SEQ ID NO: 519683 - RNA, 19 nt, Homo sapiens
gcccagagcaguguuugug

SEQ ID NO: 519684 - RNA, 19 nt, Homo sapiens
gcuucgagccagccaauca

SEQ ID NO: 519685 - RNA, 19 nt, Homo sapiens
ggcgcaaccuggacaucga

SEQ ID NO: 519686 - RNA, 19 nt, Homo sapiens
ucagcccgauggucagaug

SEQ ID NO: 519687 - RNA, 19 nt, Homo sapiens
uuccucaucuuccacaguu

SEQ ID NO: 519688 - RNA, 19 nt, Homo sapiens
cgagccagccaaucagaug

SEQ ID NO: 519689 - RNA, 19 nt, Homo sapiens
auggucagaugccaaguga

SEQ ID NO: 519690 - RNA, 19 nt, Homo sapiens
cggccucccugcgauuuga

SEQ ID NO: 519691 - RNA, 19 nt, Homo sapiens
acaucgagcgucccacgua

SEQ ID NO: 519692 - RNA, 19 nt, Homo sapiens
gugaguguaucucuaucca

SEQ ID NO: 519693 - RNA, 19 nt, Homo sapiens
uaaggugggcauuaacuac

SEQ ID NO: 519694 - RNA, 19 nt, Homo sapiens
gauggucagaugccaagug

SEQ ID NO: 519695 - RNA, 19 nt, Homo sapiens
gugcgcacaggaaccuaua

SEQ ID NO: 519696 - RNA, 19 nt, Homo sapiens
ccauaaguucgaucucaug

SEQ ID NO: 519697 - RNA, 19 nt, Homo sapiens
ggcccugaauguggacuug

SEQ ID NO: 519698 - RNA, 19 nt, Homo sapiens
cagcggaggagcucaacau

SEQ ID NO: 519699 - RNA, 19 nt, Homo sapiens
cggcaagaaguccaagcua

SEQ ID NO: 519700 - RNA, 19 nt, Homo sapiens
ggagaaggauuaugaagag

SEQ ID NO: 519701 - RNA, 19 nt, Homo sapiens
ggucagaugccaagugaua

SEQ ID NO: 519702 - RNA, 19 nt, Homo sapiens
gaagaugcggccaauaauu

SEQ ID NO: 519703 - RNA, 19 nt, Homo sapiens
gcaauuaaagguucuguau

SEQ ID NO: 519704 - RNA, 19 nt, Homo sapiens
ccaaucagauggucaagug

SEQ ID NO: 519705 - RNA, 19 nt, Homo sapiens
gaaggaagaugcggccaau

SEQ ID NO: 519706 - RNA, 19 nt, Homo sapiens
aagaugcggccaauaauua

SEQ ID NO: 519707 - RNA, 19 nt, Homo sapiens
gcaagaaguccaagcuaga

SEQ ID NO: 519708 - RNA, 19 nt, Homo sapiens
acaaugaagccaucuauga

SEQ ID NO: 519709 - RNA, 19 nt, Homo sapiens
ucaacacguucuucaguga

SEQ ID NO: 519710 - RNA, 19 nt, Homo sapiens
ggauuuaaggugggcauua

SEQ ID NO: 519711 - RNA, 19 nt, Homo sapiens
ggaagaugcggccaauaau

SEQ ID NO: 519712 - RNA, 19 nt, Homo sapiens
uggcagcucuggagaagga

SEQ ID NO: 519713 - RNA, 19 nt, Homo sapiens
caacaugcgugaguguauc

SEQ ID NO: 519714 - RNA, 19 nt, Homo sapiens
ugacggaauuccagaccaa

SEQ ID NO: 519715 - RNA, 19 nt, Homo sapiens
aggaagaugcggccaauaa

SEQ ID NO: 519716 - RNA, 19 nt, Homo sapiens
ucgcaucucugcucaugga

SEQ ID NO: 519717 - RNA, 19 nt, Homo sapiens
gaugaagugcgcacaggaa

SEQ ID NO: 519718 - RNA, 19 nt, Homo sapiens
ggaacuguacugccuggaa

SEQ ID NO: 519719 - RNA, 19 nt, Homo sapiens
cgacaaugaagccaucuau

SEQ ID NO: 519720 - RNA, 19 nt, Homo sapiens
ggaauuccagaccaaccua

SEQ ID NO: 519721 - RNA, 19 nt, Homo sapiens
gaaccuauaggcagcucuu

SEQ ID NO: 519722 - RNA, 19 nt, Homo sapiens
cugcagggcuuccucaucu

SEQ ID NO: 519723 - RNA, 19 nt, Homo sapiens
guucgcaucucugcucaug

SEQ ID NO: 519724 - RNA, 19 nt, Homo sapiens
gcucuggguucgcaucucu

SEQ ID NO: 519725 - RNA, 19 nt, Homo sapiens
ucagaugccaagugauaaa

SEQ ID NO: 519726 - RNA, 19 nt, Homo sapiens
gaagaggugggcguggauu

SEQ ID NO: 519727 - RNA, 19 nt, Homo sapiens
cagaucguguccuccauca

SEQ ID NO: 519728 - RNA, 19 nt, Homo sapiens
ccacguacaccaaccucaa

SEQ ID NO: 519729 - RNA, 19 nt, Homo sapiens
uggagaaggauuaugaaga

SEQ ID NO: 519730 - RNA, 19 nt, Homo sapiens
cagcucuggagaaggauua

SEQ ID NO: 519731 - RNA, 19 nt, Homo sapiens
aauguggacuugacggaau

SEQ ID NO: 519732 - RNA, 19 nt, Homo sapiens
gcagggcuuccucaucuuc

SEQ ID NO: 519733 - RNA, 19 nt, Homo sapiens
gcaggcaggaguccagauc

SEQ ID NO: 519734 - RNA, 19 nt, Homo sapiens
gacaaugaagccaucuaug

SEQ ID NO: 519735 - RNA, 19 nt, Homo sapiens
ucaacaugcgugaguguau

SEQ ID NO: 519736 - RNA, 19 nt, Homo sapiens
caaugaagccaucuaugac

SEQ ID NO: 519737 - RNA, 19 nt, Homo sapiens
gcugaucaccgggaaggaa

SEQ ID NO: 519738 - RNA, 19 nt, Homo sapiens
gcccagagcaguguuugug

SEQ ID NO: 519739 - RNA, 19 nt, Homo sapiens
gcuucgagccagccaauca

SEQ ID NO: 519740 - RNA, 19 nt, Homo sapiens
ucagcccgauggucagaug

SEQ ID NO: 519741 - RNA, 19 nt, Homo sapiens
ggcgcaaccuggacaucga

SEQ ID NO: 519742 - RNA, 19 nt, Homo sapiens
uuccucaucuuccacaguu

SEQ ID NO: 519743 - RNA, 19 nt, Homo sapiens
gugaguguaucucuaucca

SEQ ID NO: 519744 - RNA, 19 nt, Homo sapiens
cgagccagccaaucagaug

SEQ ID NO: 519745 - RNA, 19 nt, Homo sapiens
cggccucccugcgauuuga

SEQ ID NO: 519746 - RNA, 19 nt, Homo sapiens
acaucgagcgucccacgua

SEQ ID NO: 519747 - RNA, 19 nt, Homo sapiens
auggucagaugccaaguga

SEQ ID NO: 519748 - RNA, 19 nt, Homo sapiens
uaaggugggcauuaacuac

SEQ ID NO: 519749 - RNA, 19 nt, Homo sapiens
gauggucagaugccaagug

SEQ ID NO: 519750 - RNA, 19 nt, Homo sapiens
gugcgcacaggaaccuaua

SEQ ID NO: 519751 - RNA, 19 nt, Homo sapiens
cagcggaggagcucaacau

SEQ ID NO: 519752 - RNA, 19 nt, Homo sapiens
ggcccugaauguggacuug

SEQ ID NO: 519753 - RNA, 19 nt, Homo sapiens
cggcaagaaguccaagcua

SEQ ID NO: 519754 - RNA, 19 nt, Homo sapiens
gaugaaaccuacuccauug

SEQ ID NO: 519755 - RNA, 19 nt, Homo sapiens
gaaaccuacuccauugaua

SEQ ID NO: 519756 - RNA, 19 nt, Homo sapiens
gaucaaucgugcauccuua

SEQ ID NO: 519757 - RNA, 19 nt, Homo sapiens
gaacuucuguuguccucaa

SEQ ID NO: 519758 - RNA, 19 nt, Homo sapiens
gcaagauccgggaagagua

SEQ ID NO: 519759 - RNA, 19 nt, Homo sapiens
aaaccuacuccauugauaa

SEQ ID NO: 519760 - RNA, 19 nt, Homo sapiens
cauggucuuucuacuugua

SEQ ID NO: 519761 - RNA, 19 nt, Homo sapiens
aaucgugcauccuuaguga

SEQ ID NO: 519762 - RNA, 19 nt, Homo sapiens
uuagugaacuucuguuguc

SEQ ID NO: 519763 - RNA, 19 nt, Homo sapiens
gcaguucacggccauguuc

SEQ ID NO: 519764 - RNA, 19 nt, Homo sapiens
aguauugucugugaaggua

SEQ ID NO: 519765 - RNA, 19 nt, Homo sapiens
uggagagaaucaacgugua

SEQ ID NO: 519766 - RNA, 19 nt, Homo sapiens
gauguggaacuccucuaaa

SEQ ID NO: 519767 - RNA, 19 nt, Homo sapiens
agcauggucuuucuacuug

SEQ ID NO: 519768 - RNA, 19 nt, Homo sapiens
auaacgaggcccuguauga

SEQ ID NO: 519769 - RNA, 19 nt, Homo sapiens
gaacaccuucagcgucaug

SEQ ID NO: 519770 - RNA, 19 nt, Homo sapiens
caagaacagcagcuacuuc

SEQ ID NO: 519771 - RNA, 19 nt, Homo sapiens
gcgagggcauggacgagau

SEQ ID NO: 519772 - RNA, 19 nt, Homo sapiens
gagcucacccagcagaugu

SEQ ID NO: 519773 - RNA, 19 nt, Homo sapiens
guacccagaccgcaucaug

SEQ ID NO: 519774 - RNA, 19 nt, Homo sapiens
ucagcaagauccgggaaga

SEQ ID NO: 519775 - RNA, 19 nt, Homo sapiens
ccaagggccacuacacaga

SEQ ID NO: 519776 - RNA, 19 nt, Homo sapiens
ccucaagcauggucuuucu

SEQ ID NO: 519777 - RNA, 19 nt, Homo sapiens
gugcauccuuagugaacuu

SEQ ID NO: 519778 - RNA, 19 nt, Homo sapiens
ggagagaaucaacguguac

SEQ ID NO: 519779 - RNA, 19 nt, Homo sapiens
agaugaaaccuacuccauu

SEQ ID NO: 519780 - RNA, 19 nt, Homo sapiens
gcauggacgagauggaguu

SEQ ID NO: 519781 - RNA, 19 nt, Homo sapiens
gcgcaucuccgagcaguuc

SEQ ID NO: 519782 - RNA, 19 nt, Homo sapiens
ggagguggacgagcagaug

SEQ ID NO: 519783 - RNA, 19 nt, Homo sapiens
ugauguggaacuccucuaa

SEQ ID NO: 519784 - RNA, 19 nt, Homo sapiens
ucaacgugcagaacaagaa

SEQ ID NO: 519785 - RNA, 19 nt, Homo sapiens
gagaaucaacguguacuac

SEQ ID NO: 519786 - RNA, 19 nt, Homo sapiens
aaacuucucagaucaaucg

SEQ ID NO: 519787 - RNA, 19 nt, Homo sapiens
aagcauggucuuucuacuu

SEQ ID NO: 519788 - RNA, 19 nt, Homo sapiens
gggcgaggacgaggcuuaa

SEQ ID NO: 519789 - RNA, 19 nt, Homo sapiens
ccagaccgcaucaugaaca

SEQ ID NO: 519790 - RNA, 19 nt, Homo sapiens
gcauggucuuucuacuugu

SEQ ID NO: 519791 - RNA, 19 nt, Homo sapiens
cagaguggagccgggaaua

SEQ ID NO: 519792 - RNA, 19 nt, Homo sapiens
ccuacuccauugauaacga

SEQ ID NO: 519793 - RNA, 19 nt, Homo sapiens
ucaccgaggccgagagcaa

SEQ ID NO: 519794 - RNA, 19 nt, Homo sapiens
ugauaacgaggcccuguau

SEQ ID NO: 519795 - RNA, 19 nt, Homo sapiens
caagauccgggaagaguac

SEQ ID NO: 519796 - RNA, 19 nt, Homo sapiens
ugaaaccuacuccauugau

SEQ ID NO: 519797 - RNA, 19 nt, Homo sapiens
cagaugaaaccuacuccau

SEQ ID NO: 519798 - RNA, 19 nt, Homo sapiens
gauguaaugauguggaacu

SEQ ID NO: 519799 - RNA, 19 nt, Homo sapiens
gcaagcuggcggugaacau

SEQ ID NO: 519800 - RNA, 19 nt, Homo sapiens
gauaacgaggcccuguaug

SEQ ID NO: 519801 - RNA, 19 nt, Homo sapiens
ucgacucgguccuggaugu

SEQ ID NO: 519802 - RNA, 19 nt, Homo sapiens
caagcauggucuuucuacu

SEQ ID NO: 519803 - RNA, 19 nt, Homo sapiens
ggacaacuuugaugagaug

SEQ ID NO: 519804 - RNA, 19 nt, Homo sapiens
gcagacauacucaguguuu

SEQ ID NO: 519805 - RNA, 19 nt, Homo sapiens
ucaagaggcugacgcagaa

SEQ ID NO: 519806 - RNA, 19 nt, Homo sapiens
gcaaacacauuuacuucuc

SEQ ID NO: 519807 - RNA, 19 nt, Homo sapiens
gaaccugucgccaguauga

SEQ ID NO: 519808 - RNA, 19 nt, Homo sapiens
acauuuacuucuccucuua

SEQ ID NO: 519809 - RNA, 19 nt, Homo sapiens
gagaaccugucgccaguau

SEQ ID NO: 519810 - RNA, 19 nt, Homo sapiens
ggaccucacgcaucucuuu

SEQ ID NO: 519811 - RNA, 19 nt, Homo sapiens
gcgcuacccuggcuacaug

SEQ ID NO: 519812 - RNA, 19 nt, Homo sapiens
acgcaucucuuucucauau

SEQ ID NO: 519813 - RNA, 19 nt, Homo sapiens
ccucuuaugagacuauuua

SEQ ID NO: 519814 - RNA, 19 nt, Homo sapiens
gguccagccuuacaauuca

SEQ ID NO: 519815 - RNA, 19 nt, Homo sapiens
ggacacauccagggagauu

SEQ ID NO: 519816 - RNA, 19 nt, Homo sapiens
ugacagguauccuaagaag

SEQ ID NO: 519817 - RNA, 19 nt, Homo sapiens
aaagauccaugaggacauu

SEQ ID NO: 519818 - RNA, 19 nt, Homo sapiens
gcucuggacuggguuccua

SEQ ID NO: 519819 - RNA, 19 nt, Homo sapiens
gugcagacauacucagugu

SEQ ID NO: 519820 - RNA, 19 nt, Homo sapiens
agaagcuggugcagacaua

SEQ ID NO: 519821 - RNA, 19 nt, Homo sapiens
ugaaugacagguauccuaa

SEQ ID NO: 519822 - RNA, 19 nt, Homo sapiens
aaugacagguauccuaaga

SEQ ID NO: 519823 - RNA, 19 nt, Homo sapiens
ucagggaccucacgcaucu

SEQ ID NO: 519824 - RNA, 19 nt, Homo sapiens
cggcuccacuuccucauga

SEQ ID NO: 519825 - RNA, 19 nt, Homo sapiens
ucacgcaucucuuucucau

SEQ ID NO: 519826 - RNA, 19 nt, Homo sapiens
ggacaacacagcccugaac

SEQ ID NO: 519827 - RNA, 19 nt, Homo sapiens
acaauucacuccucacacu

SEQ ID NO: 519828 - RNA, 19 nt, Homo sapiens
aaggacaacuuugaugaga

SEQ ID NO: 519829 - RNA, 19 nt, Homo sapiens
gcaucucuuucucauauac

SEQ ID NO: 519830 - RNA, 19 nt, Homo sapiens
ggagcgaugccgagggaaa

SEQ ID NO: 519831 - RNA, 19 nt, Homo sapiens
ccacccagguccacaagag

SEQ ID NO: 519832 - RNA, 19 nt, Homo sapiens
cuggcuacaugaacaauga

SEQ ID NO: 519833 - RNA, 19 nt, Homo sapiens
ugaaccggauugccacaga

SEQ ID NO: 519834 - RNA, 19 nt, Homo sapiens
ggucagcgggcucaugaug

SEQ ID NO: 519835 - RNA, 19 nt, Homo sapiens
ccucaucgccucgcucauu

SEQ ID NO: 519836 - RNA, 19 nt, Homo sapiens
ccacagaccgccugcacau

SEQ ID NO: 519837 - RNA, 19 nt, Homo sapiens
ucuuagaacggcugaauga

SEQ ID NO: 519838 - RNA, 19 nt, Homo sapiens
aggaggagcuggcaacaac

SEQ ID NO: 519839 - RNA, 19 nt, Homo sapiens
gaccaaccacugcuacauc

SEQ ID NO: 519840 - RNA, 19 nt, Homo sapiens
gggacccucaucugccuua

SEQ ID NO: 519841 - RNA, 19 nt, Homo sapiens
ccacacggccagacuacau

SEQ ID NO: 519842 - RNA, 19 nt, Homo sapiens
acaucuaccugucggaaca

SEQ ID NO: 519843 - RNA, 19 nt, Homo sapiens
cacauuuacuucuccucuu

SEQ ID NO: 519844 - RNA, 19 nt, Homo sapiens
gacgcagaaugcagacugu

SEQ ID NO: 519845 - RNA, 19 nt, Homo sapiens
cagcaucuccucgcucuuc

SEQ ID NO: 519846 - RNA, 19 nt, Homo sapiens
gagcgaugccgagggaaau

SEQ ID NO: 519847 - RNA, 19 nt, Homo sapiens
ccacgguccuggaugucau

SEQ ID NO: 519848 - RNA, 19 nt, Homo sapiens
cugaaugacagguauccua

SEQ ID NO: 519849 - RNA, 19 nt, Homo sapiens
cuacaucgccauccucaac

SEQ ID NO: 519850 - RNA, 19 nt, Homo sapiens
gcacccaggagcagugagu

SEQ ID NO: 519851 - RNA, 19 nt, Homo sapiens
caaggacaacuuugaugag

SEQ ID NO: 519852 - RNA, 19 nt, Homo sapiens
ucacuccucacacucaaga

SEQ ID NO: 519853 - RNA, 19 nt, Homo sapiens
uuagaacggcugaaugaca

SEQ ID NO: 519854 - RNA, 19 nt, Homo sapiens
gaugguagugacagucuag

SEQ ID NO: 519855 - RNA, 19 nt, Homo sapiens
cugcaaacacauuuacuuc

SEQ ID NO: 519856 - RNA, 19 nt, Homo sapiens
gaggaggagcuggcaacaa

SEQ ID NO: 519857 - RNA, 19 nt, Homo sapiens
ggcagacgaugagcacuac

SEQ ID NO: 519858 - RNA, 19 nt, Homo sapiens
cagauuggguucgaguucu

SEQ ID NO: 519859 - RNA, 19 nt, Homo sapiens
gaggagcuggcaacaacug

SEQ ID NO: 519860 - RNA, 19 nt, Homo sapiens
uacccuggcuacaugaaca

SEQ ID NO: 519861 - RNA, 19 nt, Homo sapiens
acagguauccuaagaagcu

SEQ ID NO: 519862 - RNA, 19 nt, Homo sapiens
acuggguuccuaccucuua

SEQ ID NO: 519863 - RNA, 19 nt, Homo sapiens
acacauccagggagauugu

SEQ ID NO: 519864 - RNA, 19 nt, Homo sapiens
gaaugacagguauccuaag

SEQ ID NO: 519865 - RNA, 19 nt, Homo sapiens
gggcuaaguucaagaagua

SEQ ID NO: 519866 - RNA, 19 nt, Homo sapiens
gcagcuagauggacauuuc

SEQ ID NO: 519867 - RNA, 19 nt, Homo sapiens
gcauugagauguuccacaa

SEQ ID NO: 519868 - RNA, 19 nt, Homo sapiens
gaaguucaaccuaaucuug

SEQ ID NO: 519869 - RNA, 19 nt, Homo sapiens
ggagaagaauaucaaaugg

SEQ ID NO: 519870 - RNA, 19 nt, Homo sapiens
ggaggucaguaaacuuuga

SEQ ID NO: 519871 - RNA, 19 nt, Homo sapiens
gacccgagagcacuuauua

SEQ ID NO: 519872 - RNA, 19 nt, Homo sapiens
gcaagaacauccgcacugu

SEQ ID NO: 519873 - RNA, 19 nt, Homo sapiens
ccaaugaucuuagagaaag

SEQ ID NO: 519874 - RNA, 19 nt, Homo sapiens
ugacaggcauugagauguu

SEQ ID NO: 519875 - RNA, 19 nt, Homo sapiens
ucaccgaguuuggcuauaa

SEQ ID NO: 519876 - RNA, 19 nt, Homo sapiens
gauggcaaccggacuauug

SEQ ID NO: 519877 - RNA, 19 nt, Homo sapiens
uggaugcuguggacacuua

SEQ ID NO: 519878 - RNA, 19 nt, Homo sapiens
ggucaugcagauuauguua

SEQ ID NO: 519879 - RNA, 19 nt, Homo sapiens
gcaccggucuagucaccaa

SEQ ID NO: 519880 - RNA, 19 nt, Homo sapiens
ggucaguaaacuuugaaua

SEQ ID NO: 519881 - RNA, 19 nt, Homo sapiens
ugacugaggaggagaagaa

SEQ ID NO: 519882 - RNA, 19 nt, Homo sapiens
gcgcgaguaugaccacaau

SEQ ID NO: 519883 - RNA, 19 nt, Homo sapiens
gaagguggaggcccagguu

SEQ ID NO: 519884 - RNA, 19 nt, Homo sapiens
cgacaagccacaugugaau

SEQ ID NO: 519885 - RNA, 19 nt, Homo sapiens
caagccagguuccaucaag

SEQ ID NO: 519886 - RNA, 19 nt, Homo sapiens
cguaggcucugcucucugu

SEQ ID NO: 519887 - RNA, 19 nt, Homo sapiens
caagaaguacgaggagauu

SEQ ID NO: 519888 - RNA, 19 nt, Homo sapiens
ggaggagaagaauaucaaa

SEQ ID NO: 519889 - RNA, 19 nt, Homo sapiens
ggugacagguacacuagag

SEQ ID NO: 519890 - RNA, 19 nt, Homo sapiens
gaggagaagaauaucaaau

SEQ ID NO: 519891 - RNA, 19 nt, Homo sapiens
ucaugcagauuauguuaag

SEQ ID NO: 519892 - RNA, 19 nt, Homo sapiens
cggcucauguggaguauag

SEQ ID NO: 519893 - RNA, 19 nt, Homo sapiens
cgagauggcaaccggacua

SEQ ID NO: 519894 - RNA, 19 nt, Homo sapiens
gccaaugaucuuagagaaa

SEQ ID NO: 519895 - RNA, 19 nt, Homo sapiens
caccgaguuuggcuauaaa

SEQ ID NO: 519896 - RNA, 19 nt, Homo sapiens
gucaguaaacuuugaauag

SEQ ID NO: 519897 - RNA, 19 nt, Homo sapiens
gcgacaagccacaugugaa

SEQ ID NO: 519898 - RNA, 19 nt, Homo sapiens
agaaguacgaggagauuga

SEQ ID NO: 519899 - RNA, 19 nt, Homo sapiens
ccaacacgcuggccaugac

SEQ ID NO: 519900 - RNA, 19 nt, Homo sapiens
ggcagccaaugaucuuaga

SEQ ID NO: 519901 - RNA, 19 nt, Homo sapiens
gcagccaucacgaagauuc

SEQ ID NO: 519902 - RNA, 19 nt, Homo sapiens
gagcguggcauuuuaaaga

SEQ ID NO: 519903 - RNA, 19 nt, Homo sapiens
uggagcaugugguggugua

SEQ ID NO: 519904 - RNA, 19 nt, Homo sapiens
aggagaagaauaucaaaug

SEQ ID NO: 519905 - RNA, 19 nt, Homo sapiens
gaggaggagaagaauauca

SEQ ID NO: 519906 - RNA, 19 nt, Homo sapiens
auugagauguuccacaaga

SEQ ID NO: 519907 - RNA, 19 nt, Homo sapiens
cugaggaggagaagaauau

SEQ ID NO: 519908 - RNA, 19 nt, Homo sapiens
agacuuacgugcgcgacaa

SEQ ID NO: 519909 - RNA, 19 nt, Homo sapiens
ggugacaggcauugagaug

SEQ ID NO: 519910 - RNA, 19 nt, Homo sapiens
agacgagugugagcuccua

SEQ ID NO: 519911 - RNA, 19 nt, Homo sapiens
uagagaaaggccagcguuu

SEQ ID NO: 519912 - RNA, 19 nt, Homo sapiens
gcgaguaugaccacaaugg

SEQ ID NO: 519913 - RNA, 19 nt, Homo sapiens
aaagaagggagacgagugu

SEQ ID NO: 519914 - RNA, 19 nt, Homo sapiens
ugacugcagccaucacgaa

SEQ ID NO: 519915 - RNA, 19 nt, Homo sapiens
gacaggcauugagauguuc

SEQ ID NO: 519916 - RNA, 19 nt, Homo sapiens
uuacuggccagacagauug

SEQ ID NO: 519917 - RNA, 19 nt, Homo sapiens
cugcagccaucacgaagau

SEQ ID NO: 519918 - RNA, 19 nt, Homo sapiens
aguacccucucauggcaua

SEQ ID NO: 519919 - RNA, 19 nt, Homo sapiens
agccaaugaucuuagagaa

SEQ ID NO: 519920 - RNA, 19 nt, Homo sapiens
uggaggccaagaagacuua

SEQ ID NO: 519921 - RNA, 19 nt, Homo sapiens
gcucaccgaguuuggcuau

SEQ ID NO: 519922 - RNA, 19 nt, Homo sapiens
ugugagcuccuaggacaua

SEQ ID NO: 519923 - RNA, 19 nt, Homo sapiens
acucugagaugguggaacu

SEQ ID NO: 519924 - RNA, 19 nt, Homo sapiens
caucaaugcggcucaugug

SEQ ID NO: 519925 - RNA, 19 nt, Homo sapiens
ucaagaaguacgaggagau

SEQ ID NO: 519926 - RNA, 19 nt, Homo sapiens
acacuagagcguggcauuu

SEQ ID NO: 519927 - RNA, 19 nt, Homo sapiens
aguuaggccugaagucugu

SEQ ID NO: 519928 - RNA, 19 nt, Homo sapiens
cagcagagggcagcuagau

SEQ ID NO: 519929 - RNA, 19 nt, Homo sapiens
cagccaaugaucuuagaga

SEQ ID NO: 519930 - RNA, 19 nt, Homo sapiens
ccagacccgagagcacuua

SEQ ID NO: 519931 - RNA, 19 nt, Homo sapiens
gaggucaguaaacuuugaa

SEQ ID NO: 519932 - RNA, 19 nt, Homo sapiens
ccuaggacauagcaagaac

SEQ ID NO: 519933 - RNA, 19 nt, Homo sapiens
acuagagcguggcauuuua

SEQ ID NO: 519934 - RNA, 19 nt, Homo sapiens
ggugguguaugugaacaag

SEQ ID NO: 519935 - RNA, 19 nt, Homo sapiens
agaagggagacgaguguga

SEQ ID NO: 519936 - RNA, 19 nt, Homo sapiens
gucaugcagauuauguuaa

SEQ ID NO: 519937 - RNA, 19 nt, Homo sapiens
aaacacagcucaguucuua

SEQ ID NO: 519938 - RNA, 19 nt, Homo sapiens
ggaguucccucauuuguaa

SEQ ID NO: 519939 - RNA, 19 nt, Homo sapiens
ccaaauggcuuuagucaga

SEQ ID NO: 519940 - RNA, 19 nt, Homo sapiens
uaacaaugcucugggauuu

SEQ ID NO: 519941 - RNA, 19 nt, Homo sapiens
guugagagcuugaggaaga

SEQ ID NO: 519942 - RNA, 19 nt, Homo sapiens
guagcaagcuugacaggaa

SEQ ID NO: 519943 - RNA, 19 nt, Homo sapiens
gacaggagaugaacuugaa

SEQ ID NO: 519944 - RNA, 19 nt, Homo sapiens
gaaaguccggcaaaugaua

SEQ ID NO: 519945 - RNA, 19 nt, Homo sapiens
gagaugaacuugaacacau

SEQ ID NO: 519946 - RNA, 19 nt, Homo sapiens
ccaaagugcuaggauuaua

SEQ ID NO: 519947 - RNA, 19 nt, Homo sapiens
acacagauguccagaguga

SEQ ID NO: 519948 - RNA, 19 nt, Homo sapiens
gagccucccuucuguugua

SEQ ID NO: 519949 - RNA, 19 nt, Homo sapiens
gcuuacaucucaugauuga

SEQ ID NO: 519950 - RNA, 19 nt, Homo sapiens
ggaagacggugcaggacuu

SEQ ID NO: 519951 - RNA, 19 nt, Homo sapiens
guagauaggcaucagagua

SEQ ID NO: 519952 - RNA, 19 nt, Homo sapiens
ccagaugaguucuucacua

SEQ ID NO: 519953 - RNA, 19 nt, Homo sapiens
gggagaagauccaccacuu

SEQ ID NO: 519954 - RNA, 19 nt, Homo sapiens
guggacaccuguauaaaug

SEQ ID NO: 519955 - RNA, 19 nt, Homo sapiens
gaacuucggagcaacaaug

SEQ ID NO: 519956 - RNA, 19 nt, Homo sapiens
ggauauaaguagcaagcuu

SEQ ID NO: 519957 - RNA, 19 nt, Homo sapiens
ccacucagcuggucauucu

SEQ ID NO: 519958 - RNA, 19 nt, Homo sapiens
gccaggaacugccuacaga

SEQ ID NO: 519959 - RNA, 19 nt, Homo sapiens
uuaaccagcugaagaguga

SEQ ID NO: 519960 - RNA, 19 nt, Homo sapiens
ucauuaagguguacuugaa

SEQ ID NO: 519961 - RNA, 19 nt, Homo sapiens
gggcucacauucuggcuuu

SEQ ID NO: 519962 - RNA, 19 nt, Homo sapiens
ccuacagccuugagaagua

SEQ ID NO: 519963 - RNA, 19 nt, Homo sapiens
cagaugaguucuucacuag

SEQ ID NO: 519964 - RNA, 19 nt, Homo sapiens
gcacaccucagucuucuug

SEQ ID NO: 519965 - RNA, 19 nt, Homo sapiens
ugggagaggugacaagauu

SEQ ID NO: 519966 - RNA, 19 nt, Homo sapiens
ggagguggcccuagaggaa

SEQ ID NO: 519967 - RNA, 19 nt, Homo sapiens
ugacuucucucugcuguga

SEQ ID NO: 519968 - RNA, 19 nt, Homo sapiens
ggacccagaugaguucuuc

SEQ ID NO: 519969 - RNA, 19 nt, Homo sapiens
gcagaaagaggcagaaguc

SEQ ID NO: 519970 - RNA, 19 nt, Homo sapiens
ggucagagcaggugauauc

SEQ ID NO: 519971 - RNA, 19 nt, Homo sapiens
caccacgccuggcugauuu

SEQ ID NO: 519972 - RNA, 19 nt, Homo sapiens
cagaguauauguuguuugg

SEQ ID NO: 519973 - RNA, 19 nt, Homo sapiens
caaacuugcucugcagcua

SEQ ID NO: 519974 - RNA, 19 nt, Homo sapiens
ggacagaguggagcagaaa

SEQ ID NO: 519975 - RNA, 19 nt, Homo sapiens
agaugaacuugaacacaua

SEQ ID NO: 519976 - RNA, 19 nt, Homo sapiens
guagagagccucccuucug

SEQ ID NO: 519977 - RNA, 19 nt, Homo sapiens
gagggaagcagaacaaagu

SEQ ID NO: 519978 - RNA, 19 nt, Homo sapiens
ccagugaaccuaagcuuug

SEQ ID NO: 519979 - RNA, 19 nt, Homo sapiens
gcucaguucuuagcaacaa

SEQ ID NO: 519980 - RNA, 19 nt, Homo sapiens
ggagaggugacaagauuug

SEQ ID NO: 519981 - RNA, 19 nt, Homo sapiens
uccaggagcucaaggagaa

SEQ ID NO: 519982 - RNA, 19 nt, Homo sapiens
ggucagaguauauguuguu

SEQ ID NO: 519983 - RNA, 19 nt, Homo sapiens
gcuaaguuauuggugguuu

SEQ ID NO: 519984 - RNA, 19 nt, Homo sapiens
aaaguaauguggcccuuca

SEQ ID NO: 519985 - RNA, 19 nt, Homo sapiens
caagaugauucacgagaag

SEQ ID NO: 519986 - RNA, 19 nt, Homo sapiens
gcacugcagcccuuuggaa

SEQ ID NO: 519987 - RNA, 19 nt, Homo sapiens
uaacacugccuuugacuuc

SEQ ID NO: 519988 - RNA, 19 nt, Homo sapiens
ggagaagauccaccacuug

SEQ ID NO: 519989 - RNA, 19 nt, Homo sapiens
ggaagcagaacaaaguaau

SEQ ID NO: 519990 - RNA, 19 nt, Homo sapiens
acaagaugauucacgagaa

SEQ ID NO: 519991 - RNA, 19 nt, Homo sapiens
agacugggcucacauucug

SEQ ID NO: 519992 - RNA, 19 nt, Homo sapiens
uggcuaggcuggucucgaa

SEQ ID NO: 519993 - RNA, 19 nt, Homo sapiens
gaaucuuucucucccuuuc

SEQ ID NO: 519994 - RNA, 19 nt, Homo sapiens
guauuuggauuugcuugaa

SEQ ID NO: 519995 - RNA, 19 nt, Homo sapiens
ggauggaacaccugauaga

SEQ ID NO: 519996 - RNA, 19 nt, Homo sapiens
ggcagagaauuuagagaug

SEQ ID NO: 519997 - RNA, 19 nt, Homo sapiens
gaaggugagucuacuuucc

SEQ ID NO: 519998 - RNA, 19 nt, Homo sapiens
uugcuuacaucucaugauu

SEQ ID NO: 519999 - RNA, 19 nt, Homo sapiens
ccacaaacacagcucaguu

SEQ ID NO: 520000 - RNA, 19 nt, Homo sapiens
ggacaccuguauaaaugag

SEQ ID NO: 520001 - RNA, 19 nt, Homo sapiens
gacaggaaccuaggagauu

SEQ ID NO: 520002 - RNA, 19 nt, Homo sapiens
caggugauauccauguuuc

SEQ ID NO: 520003 - RNA, 19 nt, Homo sapiens
gagagccucccuucuguug

SEQ ID NO: 520004 - RNA, 19 nt, Homo sapiens
uagagagccucccuucugu

SEQ ID NO: 520005 - RNA, 19 nt, Homo sapiens
gaagcagaacaaaguaaug

SEQ ID NO: 520006 - RNA, 19 nt, Homo sapiens
uuucuucccuuucugauau

SEQ ID NO: 520007 - RNA, 19 nt, Homo sapiens
cagagugauuggagaaugu

SEQ ID NO: 520008 - RNA, 19 nt, Homo sapiens
agagugagguccaguacau

SEQ ID NO: 520009 - RNA, 19 nt, Homo sapiens
gcaggugauauccauguuu

SEQ ID NO: 520010 - RNA, 19 nt, Homo sapiens
guauaaaugaggauguuga

SEQ ID NO: 520011 - RNA, 19 nt, Homo sapiens
acaaugcucugggauuuca

SEQ ID NO: 520012 - RNA, 19 nt, Homo sapiens
ggacuucgggcuccugugu

SEQ ID NO: 520013 - RNA, 19 nt, Homo sapiens
gacggagcaucaggccuua

SEQ ID NO: 520014 - RNA, 19 nt, Homo sapiens
uaauguggcccuucagaga

SEQ ID NO: 520015 - RNA, 19 nt, Homo sapiens
ggagauacagguggugcua

SEQ ID NO: 520016 - RNA, 19 nt, Homo sapiens
uagauaggcaucagaguau

SEQ ID NO: 520017 - RNA, 19 nt, Homo sapiens
gccuguuucuucucucuuu

SEQ ID NO: 520018 - RNA, 19 nt, Homo sapiens
uacagacagucauguguga

SEQ ID NO: 520019 - RNA, 19 nt, Homo sapiens
gcuccugugucucaccauu

SEQ ID NO: 520020 - RNA, 19 nt, Homo sapiens
gauggaacaccugauagaa

SEQ ID NO: 520021 - RNA, 19 nt, Homo sapiens
aagcugugauccagucaaa

SEQ ID NO: 520022 - RNA, 19 nt, Homo sapiens
ggaaaguccggcaaaugau

SEQ ID NO: 520023 - RNA, 19 nt, Homo sapiens
uagaggaacuucggagcaa

SEQ ID NO: 520024 - RNA, 19 nt, Homo sapiens
gggaagcagaacaaaguaa

SEQ ID NO: 520025 - RNA, 19 nt, Homo sapiens
ggaacugccuacagaagcu

SEQ ID NO: 520026 - RNA, 19 nt, Homo sapiens
ucccaaagugcuaggauua

SEQ ID NO: 520027 - RNA, 19 nt, Homo sapiens
ccagagugauuggagaaug

SEQ ID NO: 520028 - RNA, 19 nt, Homo sapiens
gcacgagcaccuauucaag

SEQ ID NO: 520029 - RNA, 19 nt, Homo sapiens
gagcaggugauauccaugu

SEQ ID NO: 520030 - RNA, 19 nt, Homo sapiens
cagagcaggugauauccau

SEQ ID NO: 520031 - RNA, 19 nt, Homo sapiens
cauucuggcuuuguccaua

SEQ ID NO: 520032 - RNA, 19 nt, Homo sapiens
gaaguagauaggcaucaga

SEQ ID NO: 520033 - RNA, 19 nt, Homo sapiens
uauguuguuuggagaaaga

SEQ ID NO: 520034 - RNA, 19 nt, Homo sapiens
ccuaaaagcuggagacaca

SEQ ID NO: 520035 - RNA, 19 nt, Homo sapiens
guucuuagcaacaaacugu

SEQ ID NO: 520036 - RNA, 19 nt, Homo sapiens
gccaggccuucaucagauu

SEQ ID NO: 520037 - RNA, 19 nt, Homo sapiens
ggacggagaugaagaacau

SEQ ID NO: 520038 - RNA, 19 nt, Homo sapiens
gcacagaggcuaaggaaga

SEQ ID NO: 520039 - RNA, 19 nt, Homo sapiens
ggagcaagacagccaauua

SEQ ID NO: 520040 - RNA, 19 nt, Homo sapiens
agaaagcccugaagaagaa

SEQ ID NO: 520041 - RNA, 19 nt, Homo sapiens
gucaagaacuuccagauug

SEQ ID NO: 520042 - RNA, 19 nt, Homo sapiens
ggaggcagcuacggugaua

SEQ ID NO: 520043 - RNA, 19 nt, Homo sapiens
gaagaaaggcacucccaaa

SEQ ID NO: 520044 - RNA, 19 nt, Homo sapiens
ucauagaacugcacaacaa

SEQ ID NO: 520045 - RNA, 19 nt, Homo sapiens
cagcuacggugauaaagaa

SEQ ID NO: 520046 - RNA, 19 nt, Homo sapiens
ccaauuaccucaucuccau

SEQ ID NO: 520047 - RNA, 19 nt, Homo sapiens
ugagaaagaccaagaagaa

SEQ ID NO: 520048 - RNA, 19 nt, Homo sapiens
ugaagaacaucuggaguug

SEQ ID NO: 520049 - RNA, 19 nt, Homo sapiens
ggaaggcaguccugacaag

SEQ ID NO: 520050 - RNA, 19 nt, Homo sapiens
gcauguaucccuccuacuu

SEQ ID NO: 520051 - RNA, 19 nt, Homo sapiens
uggcagcugugaucuauga

SEQ ID NO: 520052 - RNA, 19 nt, Homo sapiens
ccucuuggcuggcaggaaa

SEQ ID NO: 520053 - RNA, 19 nt, Homo sapiens
ucaagaacuuccagauugu

SEQ ID NO: 520054 - RNA, 19 nt, Homo sapiens
gcaguagucauuguuguuu

SEQ ID NO: 520055 - RNA, 19 nt, Homo sapiens
caagaaagcccugaagaag

SEQ ID NO: 520056 - RNA, 19 nt, Homo sapiens
gagcaguagucauuguugu

SEQ ID NO: 520057 - RNA, 19 nt, Homo sapiens
gagcccagcagccauguuu

SEQ ID NO: 520058 - RNA, 19 nt, Homo sapiens
gagaaagaccaagaagaaa

SEQ ID NO: 520059 - RNA, 19 nt, Homo sapiens
aagaacaucuggaguugga

SEQ ID NO: 520060 - RNA, 19 nt, Homo sapiens
ggaccaagaugagaaagac

SEQ ID NO: 520061 - RNA, 19 nt, Homo sapiens
gcacccacauccccaauaa

SEQ ID NO: 520062 - RNA, 19 nt, Homo sapiens
ggaagaggaggcagaggaa

SEQ ID NO: 520063 - RNA, 19 nt, Homo sapiens
ccaucgcccucuccaguuu

SEQ ID NO: 520064 - RNA, 19 nt, Homo sapiens
ggacgaggaggacgaggaa

SEQ ID NO: 520065 - RNA, 19 nt, Homo sapiens
acaagaaagcccugaagaa

SEQ ID NO: 520066 - RNA, 19 nt, Homo sapiens
gaaagaccaagaagaaagg

SEQ ID NO: 520067 - RNA, 19 nt, Homo sapiens
cagcguggguacagcacua

SEQ ID NO: 520068 - RNA, 19 nt, Homo sapiens
gcagcuacggugauaaaga

SEQ ID NO: 520069 - RNA, 19 nt, Homo sapiens
gacaagaaagcccugaaga

SEQ ID NO: 520070 - RNA, 19 nt, Homo sapiens
gauaaagaacagcaaucaa

SEQ ID NO: 520071 - RNA, 19 nt, Homo sapiens
gagcaagacagccaauuac

SEQ ID NO: 520072 - RNA, 19 nt, Homo sapiens
guaggacggagaugaagaa

SEQ ID NO: 520073 - RNA, 19 nt, Homo sapiens
gggcaaagccaaaggaaaa

SEQ ID NO: 520074 - RNA, 19 nt, Homo sapiens
aggcaguccugacaagaaa

SEQ ID NO: 520075 - RNA, 19 nt, Homo sapiens
cacagaggcuaaggaagaa

SEQ ID NO: 520076 - RNA, 19 nt, Homo sapiens
ccgaaaccucugcguguua

SEQ ID NO: 520077 - RNA, 19 nt, Homo sapiens
cgaaaccucugcguguuag

SEQ ID NO: 520078 - RNA, 19 nt, Homo sapiens
ccaauaaagccgcguccuu

SEQ ID NO: 520079 - RNA, 19 nt, Homo sapiens
cgaggaaggaggaagaaga

SEQ ID NO: 520080 - RNA, 19 nt, Homo sapiens
aagaaagcccugaagaaga

SEQ ID NO: 520081 - RNA, 19 nt, Homo sapiens
gaagaggaggcagaggaaa

SEQ ID NO: 520082 - RNA, 19 nt, Homo sapiens
gaaggcaguccugacaaga

SEQ ID NO: 520083 - RNA, 19 nt, Homo sapiens
gcagcugugaucuaugaaa

SEQ ID NO: 520084 - RNA, 19 nt, Homo sapiens
cagugggcaugaagaagaa

SEQ ID NO: 520085 - RNA, 19 nt, Homo sapiens
gacagccaauuaccucauc

SEQ ID NO: 520086 - RNA, 19 nt, Homo sapiens
ugacagugggcaugaagaa

SEQ ID NO: 520087 - RNA, 19 nt, Homo sapiens
ggagcaguagucauuguug

SEQ ID NO: 520088 - RNA, 19 nt, Homo sapiens
ccaagaagccccugagaga

SEQ ID NO: 520089 - RNA, 19 nt, Homo sapiens
ggacgaggaggaggaggaa

SEQ ID NO: 520090 - RNA, 19 nt, Homo sapiens
gcuccuacacccucaacuu

SEQ ID NO: 520091 - RNA, 19 nt, Homo sapiens
gcuggagagccucauagaa

SEQ ID NO: 520092 - RNA, 19 nt, Homo sapiens
gcugugaucuaugaaacca

SEQ ID NO: 520093 - RNA, 19 nt, Homo sapiens
caucgacccuaccaaucug

SEQ ID NO: 520094 - RNA, 19 nt, Homo sapiens
gaggaaggaggaagaagag

SEQ ID NO: 520095 - RNA, 19 nt, Homo sapiens
agaaagaccaagaagaaag

SEQ ID NO: 520096 - RNA, 19 nt, Homo sapiens
cagcugugaucuaugaaac

SEQ ID NO: 520097 - RNA, 19 nt, Homo sapiens
gcuucacggucuuugacaa

SEQ ID NO: 520098 - RNA, 19 nt, Homo sapiens
acagugggcaugaagaaga

SEQ ID NO: 520099 - RNA, 19 nt, Homo sapiens
ccucugcguguuaggaaua

SEQ ID NO: 520100 - RNA, 19 nt, Homo sapiens
ucgggaagcugagguccaa

SEQ ID NO: 520101 - RNA, 19 nt, Homo sapiens
ggugugggccucugacagu

SEQ ID NO: 520102 - RNA, 19 nt, Homo sapiens
gaugagaaagaccaagaag

SEQ ID NO: 520103 - RNA, 19 nt, Homo sapiens
agucaagaacuuccagauu

SEQ ID NO: 520104 - RNA, 19 nt, Homo sapiens
gcaagacagccaauuaccu

SEQ ID NO: 520105 - RNA, 19 nt, Homo sapiens
gcgcgaggaaggaggaaga

SEQ ID NO: 520106 - RNA, 19 nt, Homo sapiens
gggagcaguagucauuguu

SEQ ID NO: 520107 - RNA, 19 nt, Homo sapiens
ccaugccucugcgggauga

SEQ ID NO: 520108 - RNA, 19 nt, Homo sapiens
gguaggacggagaugaaga

SEQ ID NO: 520109 - RNA, 19 nt, Homo sapiens
gagcuccgcagaccugaag

SEQ ID NO: 520110 - RNA, 19 nt, Homo sapiens
acaagccaccugucuggaa

SEQ ID NO: 520111 - RNA, 19 nt, Homo sapiens
ggagagccucauagaacug

SEQ ID NO: 520112 - RNA, 19 nt, Homo sapiens
uggagagccucauagaacu

SEQ ID NO: 520113 - RNA, 19 nt, Homo sapiens
ccaaaggcgcgaggaagga

SEQ ID NO: 520114 - RNA, 19 nt, Homo sapiens
aagaaaggcacucccaaag

SEQ ID NO: 520115 - RNA, 19 nt, Homo sapiens
cggcacagaggcuaaggaa

SEQ ID NO: 520116 - RNA, 19 nt, Homo sapiens
cuggugcgcuggcagaaca

SEQ ID NO: 520117 - RNA, 19 nt, Homo sapiens
gcaugagugcggagaacga

SEQ ID NO: 520118 - RNA, 19 nt, Homo sapiens
gggaccaagaugagaaaga

SEQ ID NO: 520119 - RNA, 19 nt, Homo sapiens
ggugauaaagaacagcaau

SEQ ID NO: 520120 - RNA, 19 nt, Homo sapiens
ggaggcagaggaaaagaaa

SEQ ID NO: 520121 - RNA, 19 nt, Homo sapiens
gggaaggcaguccugacaa

SEQ ID NO: 520122 - RNA, 19 nt, Homo sapiens
cgggagcaguagucauugu

SEQ ID NO: 520123 - RNA, 19 nt, Homo sapiens
gagccgcacaucugguuuc

SEQ ID NO: 520124 - RNA, 19 nt, Homo sapiens
augaagaacaucuggaguu

SEQ ID NO: 520125 - RNA, 19 nt, Homo sapiens
gcggguaggacggagauga

SEQ ID NO: 520126 - RNA, 19 nt, Homo sapiens
ccaucgacccuaccaaucu

SEQ ID NO: 520127 - RNA, 19 nt, Homo sapiens
aagaugagaaagaccaaga

SEQ ID NO: 520128 - RNA, 19 nt, Homo sapiens
gaaaagaaagagaaaaucc

SEQ ID NO: 520129 - RNA, 19 nt, Homo sapiens
guggguacagcacuaaugu

SEQ ID NO: 520130 - RNA, 19 nt, Homo sapiens
aggcagcuacggugauaaa

SEQ ID NO: 520131 - RNA, 19 nt, Homo sapiens
gaagcuggcuguugaauaa

SEQ ID NO: 520132 - RNA, 19 nt, Homo sapiens
gcacacaagucacccaaua

SEQ ID NO: 520133 - RNA, 19 nt, Homo sapiens
gaacaggagucgcuacuga

SEQ ID NO: 520134 - RNA, 19 nt, Homo sapiens
gcagauaucccgagauuag

SEQ ID NO: 520135 - RNA, 19 nt, Homo sapiens
ggacuucugcuuuccauuu

SEQ ID NO: 520136 - RNA, 19 nt, Homo sapiens
ggcaugagcucgcugcuau

SEQ ID NO: 520137 - RNA, 19 nt, Homo sapiens
gaaugucucaggauaauga

SEQ ID NO: 520138 - RNA, 19 nt, Homo sapiens
gcaccaaguucaccaucuu

SEQ ID NO: 520139 - RNA, 19 nt, Homo sapiens
gacuucugcuuuccauuua

SEQ ID NO: 520140 - RNA, 19 nt, Homo sapiens
gaagaagacuuggaaaaga

SEQ ID NO: 520141 - RNA, 19 nt, Homo sapiens
gagcaaaacuucuaauuac

SEQ ID NO: 520142 - RNA, 19 nt, Homo sapiens
cagaagcaguguucaggaa

SEQ ID NO: 520143 - RNA, 19 nt, Homo sapiens
ccaaagagaggaucagaau

SEQ ID NO: 520144 - RNA, 19 nt, Homo sapiens
ucgcagauaucccgagauu

SEQ ID NO: 520145 - RNA, 19 nt, Homo sapiens
gaagcaguguucaggaauc

SEQ ID NO: 520146 - RNA, 19 nt, Homo sapiens
ggagcaaaacuucuaauua

SEQ ID NO: 520147 - RNA, 19 nt, Homo sapiens
gagcauuuaaccaggaaua

SEQ ID NO: 520148 - RNA, 19 nt, Homo sapiens
gauggugacuguguauaug

SEQ ID NO: 520149 - RNA, 19 nt, Homo sapiens
cagaaugucucaggauaau

SEQ ID NO: 520150 - RNA, 19 nt, Homo sapiens
gcacggacagcgaccauau

SEQ ID NO: 520151 - RNA, 19 nt, Homo sapiens
aaagagaggaucagaaugu

SEQ ID NO: 520152 - RNA, 19 nt, Homo sapiens
auuagaagcuggcuguuga

SEQ ID NO: 520153 - RNA, 19 nt, Homo sapiens
gcaucugcuuguccaguuu

SEQ ID NO: 520154 - RNA, 19 nt, Homo sapiens
aaagucagauccaaugucu

SEQ ID NO: 520155 - RNA, 19 nt, Homo sapiens
uggaauggauggugacugu

SEQ ID NO: 520156 - RNA, 19 nt, Homo sapiens
gcuuguccaguuucaauua

SEQ ID NO: 520157 - RNA, 19 nt, Homo sapiens
gugcagagggugagaguga

SEQ ID NO: 520158 - RNA, 19 nt, Homo sapiens
ggauggugacuguguauau

SEQ ID NO: 520159 - RNA, 19 nt, Homo sapiens
gacaaacaaggguugcuuu

SEQ ID NO: 520160 - RNA, 19 nt, Homo sapiens
caccauggacuucugcuuu

SEQ ID NO: 520161 - RNA, 19 nt, Homo sapiens
aaaggaagaagacuuggaa

SEQ ID NO: 520162 - RNA, 19 nt, Homo sapiens
gaauggauggugacugugu

SEQ ID NO: 520163 - RNA, 19 nt, Homo sapiens
ggacaaacaaggguugcuu

SEQ ID NO: 520164 - RNA, 19 nt, Homo sapiens
gagauuagguccccagcuu

SEQ ID NO: 520165 - RNA, 19 nt, Homo sapiens
ggaccaaacccuggaaugg

SEQ ID NO: 520166 - RNA, 19 nt, Homo sapiens
uaugggagaugcacacaag

SEQ ID NO: 520167 - RNA, 19 nt, Homo sapiens
gaaaaugacugugauucuc

SEQ ID NO: 520168 - RNA, 19 nt, Homo sapiens
guuaugagcccaacgucuu

SEQ ID NO: 520169 - RNA, 19 nt, Homo sapiens
gaaaagaagcagcgacaga

SEQ ID NO: 520170 - RNA, 19 nt, Homo sapiens
ccucugagccgucuuucuu

SEQ ID NO: 520171 - RNA, 19 nt, Homo sapiens
ccaaaucguggaucccaaa

SEQ ID NO: 520172 - RNA, 19 nt, Homo sapiens
gaccaaacccuggaaugga

SEQ ID NO: 520173 - RNA, 19 nt, Homo sapiens
ucagaaugucucaggauaa

SEQ ID NO: 520174 - RNA, 19 nt, Homo sapiens
gcuacugagucguuaccaa

SEQ ID NO: 520175 - RNA, 19 nt, Homo sapiens
uuucuucuccucccuauuu

SEQ ID NO: 520176 - RNA, 19 nt, Homo sapiens
gaucagaaugucucaggau

SEQ ID NO: 520177 - RNA, 19 nt, Homo sapiens
gcaaagucagauccaaugu

SEQ ID NO: 520178 - RNA, 19 nt, Homo sapiens
acacaagucacccaauaug

SEQ ID NO: 520179 - RNA, 19 nt, Homo sapiens
gggagcauuuaaccaggaa

SEQ ID NO: 520180 - RNA, 19 nt, Homo sapiens
ccaaguucaccaucuuuga

SEQ ID NO: 520181 - RNA, 19 nt, Homo sapiens
cagcagcacacaacgaaga

SEQ ID NO: 520182 - RNA, 19 nt, Homo sapiens
agacaauuccgaugcagaa

SEQ ID NO: 520183 - RNA, 19 nt, Homo sapiens
gaaccaacagccagaacca

SEQ ID NO: 520184 - RNA, 19 nt, Homo sapiens
ggcaaagucagauccaaug

SEQ ID NO: 520185 - RNA, 19 nt, Homo sapiens
gggcgaaagagaagaagga

SEQ ID NO: 520186 - RNA, 19 nt, Homo sapiens
ggacagaagcaguguucag

SEQ ID NO: 520187 - RNA, 19 nt, Homo sapiens
gaauacugcccggaucaga

SEQ ID NO: 520188 - RNA, 19 nt, Homo sapiens
gggcaaagucagauccaau

SEQ ID NO: 520189 - RNA, 19 nt, Homo sapiens
agaagcuggcuguugaaua

SEQ ID NO: 520190 - RNA, 19 nt, Homo sapiens
aucagaaugucucaggaua

SEQ ID NO: 520191 - RNA, 19 nt, Homo sapiens
gaaagugucagaggcacau

SEQ ID NO: 520192 - RNA, 19 nt, Homo sapiens
caaagagaggaucagaaug

SEQ ID NO: 520193 - RNA, 19 nt, Homo sapiens
uuaugagcccaacgucuua

SEQ ID NO: 520194 - RNA, 19 nt, Homo sapiens
aauggauggugacugugua

SEQ ID NO: 520195 - RNA, 19 nt, Homo sapiens
gggagaugcacacaaguca

SEQ ID NO: 520196 - RNA, 19 nt, Homo sapiens
uguccaguuucaauuagaa

SEQ ID NO: 520197 - RNA, 19 nt, Homo sapiens
ccaaacaccaagaacaucu

SEQ ID NO: 520198 - RNA, 19 nt, Homo sapiens
agucagauccaaugucuuc

SEQ ID NO: 520199 - RNA, 19 nt, Homo sapiens
aagaagacuuggaaaagaa

SEQ ID NO: 520200 - RNA, 19 nt, Homo sapiens
gcggacagaagcaguguuc

SEQ ID NO: 520201 - RNA, 19 nt, Homo sapiens
caugagcucgcugcuauga

SEQ ID NO: 520202 - RNA, 19 nt, Homo sapiens
agcccaacgucuuaggaua

SEQ ID NO: 520203 - RNA, 19 nt, Homo sapiens
ggacaauuucgugggcaaa

SEQ ID NO: 520204 - RNA, 19 nt, Homo sapiens
cagcacacaacgaagaguu

SEQ ID NO: 520205 - RNA, 19 nt, Homo sapiens
ggaagaagacuuggaaaag

SEQ ID NO: 520206 - RNA, 19 nt, Homo sapiens
gagugggcccagacacauu

SEQ ID NO: 520207 - RNA, 19 nt, Homo sapiens
cagaaccagcgaaucaaug

SEQ ID NO: 520208 - RNA, 19 nt, Homo sapiens
ccagaaccagcgaaucaau

SEQ ID NO: 520209 - RNA, 19 nt, Homo sapiens
caaagucagauccaauguc

SEQ ID NO: 520210 - RNA, 19 nt, Homo sapiens
gaaagagaagaaggagcaa

SEQ ID NO: 520211 - RNA, 19 nt, Homo sapiens
ccaaaaggaagaagacuug

SEQ ID NO: 520212 - RNA, 19 nt, Homo sapiens
cuaugaggcugcagaagcu

SEQ ID NO: 520213 - RNA, 19 nt, Homo sapiens
caaggagaacggugucuac

SEQ ID NO: 520214 - RNA, 19 nt, Homo sapiens
caauguccagccacuaaau

SEQ ID NO: 520215 - RNA, 19 nt, Homo sapiens
accaaacccuggaauggau

SEQ ID NO: 520216 - RNA, 19 nt, Homo sapiens
ucaauguccagccacuaaa

SEQ ID NO: 520217 - RNA, 19 nt, Homo sapiens
gggcaugagcucgcugcua

SEQ ID NO: 520218 - RNA, 19 nt, Homo sapiens
acacauugaugagagacau

SEQ ID NO: 520219 - RNA, 19 nt, Homo sapiens
ucuacacgcucaauuucca

SEQ ID NO: 520220 - RNA, 19 nt, Homo sapiens
agaaccagcgaaucaaugu

SEQ ID NO: 520221 - RNA, 19 nt, Homo sapiens
gagcccaacgucuuaggau

SEQ ID NO: 520222 - RNA, 19 nt, Homo sapiens
caccaaguucaccaucuuu

SEQ ID NO: 520223 - RNA, 19 nt, Homo sapiens
gcuggaggaggacauggaa

SEQ ID NO: 520224 - RNA, 19 nt, Homo sapiens
cagacacauucaccaugga

SEQ ID NO: 520225 - RNA, 19 nt, Homo sapiens
ggaaaaugacugugauucu

SEQ ID NO: 520226 - RNA, 19 nt, Homo sapiens
cauuuaaccaggaauacug

SEQ ID NO: 520227 - RNA, 19 nt, Homo sapiens
gcugggcgaaagagaagaa

SEQ ID NO: 520228 - RNA, 19 nt, Homo sapiens
gaacguacuuggauuuaaa

SEQ ID NO: 520229 - RNA, 19 nt, Homo sapiens
ggaccaaguuuacaguuua

SEQ ID NO: 520230 - RNA, 19 nt, Homo sapiens
ccacagcaaugucaucuua

SEQ ID NO: 520231 - RNA, 19 nt, Homo sapiens
ucaguaagcuccucuguug

SEQ ID NO: 520232 - RNA, 19 nt, Homo sapiens
acaguaagaugucggauaa

SEQ ID NO: 520233 - RNA, 19 nt, Homo sapiens
ugaggagacugauggaaua

SEQ ID NO: 520234 - RNA, 19 nt, Homo sapiens
gauuacaacuacccacuuu

SEQ ID NO: 520235 - RNA, 19 nt, Homo sapiens
acaguaagcuggcguguga

SEQ ID NO: 520236 - RNA, 19 nt, Homo sapiens
gaacagaacuauggaaaau

SEQ ID NO: 520237 - RNA, 19 nt, Homo sapiens
aggcuaagcuggauuauca

SEQ ID NO: 520238 - RNA, 19 nt, Homo sapiens
gggaccaaguuuacaguuu

SEQ ID NO: 520239 - RNA, 19 nt, Homo sapiens
ugauuuaucucgugaagga

SEQ ID NO: 520240 - RNA, 19 nt, Homo sapiens
caugauaucucugaaagug

SEQ ID NO: 520241 - RNA, 19 nt, Homo sapiens
aaacgaacguacuuggauu

SEQ ID NO: 520242 - RNA, 19 nt, Homo sapiens
uaucagaggcuacuacuug

SEQ ID NO: 520243 - RNA, 19 nt, Homo sapiens
gaaacgaacguacuuggau

SEQ ID NO: 520244 - RNA, 19 nt, Homo sapiens
gaacuucgaugaggagacu

SEQ ID NO: 520245 - RNA, 19 nt, Homo sapiens
caucuuacaugguauugau

SEQ ID NO: 520246 - RNA, 19 nt, Homo sapiens
gcugccaucuccuaugaaa

SEQ ID NO: 520247 - RNA, 19 nt, Homo sapiens
ccaacuaccuuaucuccau

SEQ ID NO: 520248 - RNA, 19 nt, Homo sapiens
ggaagaagaugcugaaaac

SEQ ID NO: 520249 - RNA, 19 nt, Homo sapiens
gaccaaguuuacaguuuau

SEQ ID NO: 520250 - RNA, 19 nt, Homo sapiens
caacuaccuuaucuccauu

SEQ ID NO: 520251 - RNA, 19 nt, Homo sapiens
cgaacguacuuggauuuaa

SEQ ID NO: 520252 - RNA, 19 nt, Homo sapiens
ccagucagcauguuuagaa

SEQ ID NO: 520253 - RNA, 19 nt, Homo sapiens
ccauugauccaguugauuu

SEQ ID NO: 520254 - RNA, 19 nt, Homo sapiens
uaccuuaucuccauugauc

SEQ ID NO: 520255 - RNA, 19 nt, Homo sapiens
gcaucggucuuucuagcuu

SEQ ID NO: 520256 - RNA, 19 nt, Homo sapiens
gacaggcuaagcuggauua

SEQ ID NO: 520257 - RNA, 19 nt, Homo sapiens
uaagcuggcgugugaauga

SEQ ID NO: 520258 - RNA, 19 nt, Homo sapiens
gucagcauguuuagaaaga

SEQ ID NO: 520259 - RNA, 19 nt, Homo sapiens
gaaaccagacgaaguucau

SEQ ID NO: 520260 - RNA, 19 nt, Homo sapiens
cgaaguucaugcuccauca

SEQ ID NO: 520261 - RNA, 19 nt, Homo sapiens
cagaacagaacuauggaaa

SEQ ID NO: 520262 - RNA, 19 nt, Homo sapiens
gcuccucuguuguggaaga

SEQ ID NO: 520263 - RNA, 19 nt, Homo sapiens
ggauuuaaagguccuagga

SEQ ID NO: 520264 - RNA, 19 nt, Homo sapiens
uagacgaccuggaggacuu

SEQ ID NO: 520265 - RNA, 19 nt, Homo sapiens
gcaucaagccagaauucaa

SEQ ID NO: 520266 - RNA, 19 nt, Homo sapiens
ggagacugauggaauaucc

SEQ ID NO: 520267 - RNA, 19 nt, Homo sapiens
guucaugcuccaucaguaa

SEQ ID NO: 520268 - RNA, 19 nt, Homo sapiens
gagaagaggcaaaggaaaa

SEQ ID NO: 520269 - RNA, 19 nt, Homo sapiens
ccaaguuuacaguuuauga

SEQ ID NO: 520270 - RNA, 19 nt, Homo sapiens
ccuacuauauguacuugga

SEQ ID NO: 520271 - RNA, 19 nt, Homo sapiens
uggaggacuuuguguauag

SEQ ID NO: 520272 - RNA, 19 nt, Homo sapiens
agccagaauucaaccgaua

SEQ ID NO: 520273 - RNA, 19 nt, Homo sapiens
gaaagacccaauucugcau

SEQ ID NO: 520274 - RNA, 19 nt, Homo sapiens
cuacccacuuugugcagua

SEQ ID NO: 520275 - RNA, 19 nt, Homo sapiens
gcagaacagaacuauggaa

SEQ ID NO: 520276 - RNA, 19 nt, Homo sapiens
cuggaggacuuuguguaua

SEQ ID NO: 520277 - RNA, 19 nt, Homo sapiens
ccugaaaccagacgaaguu

SEQ ID NO: 520278 - RNA, 19 nt, Homo sapiens
caugacaguuugcucucaa

SEQ ID NO: 520279 - RNA, 19 nt, Homo sapiens
caucggucuuucuagcuuu

SEQ ID NO: 520280 - RNA, 19 nt, Homo sapiens
gcuuagauccaaccucaug

SEQ ID NO: 520281 - RNA, 19 nt, Homo sapiens
aagcuccucuguuguggaa

SEQ ID NO: 520282 - RNA, 19 nt, Homo sapiens
uuucuagcuuugacaguaa

SEQ ID NO: 520283 - RNA, 19 nt, Homo sapiens
aguaagaugucggauaauc

SEQ ID NO: 520284 - RNA, 19 nt, Homo sapiens
auuuaaagguccuaggaaa

SEQ ID NO: 520285 - RNA, 19 nt, Homo sapiens
gauuuaaagguccuaggaa

SEQ ID NO: 520286 - RNA, 19 nt, Homo sapiens
aaacagccaacuaccuuau

SEQ ID NO: 520287 - RNA, 19 nt, Homo sapiens
ccucaaggugucacaguaa

SEQ ID NO: 520288 - RNA, 19 nt, Homo sapiens
cuuucuagcuuugacagua

SEQ ID NO: 520289 - RNA, 19 nt, Homo sapiens
ucacacuggauuacaacua

SEQ ID NO: 520290 - RNA, 19 nt, Homo sapiens
cacaguaagaugucggaua

SEQ ID NO: 520291 - RNA, 19 nt, Homo sapiens
ggaggacuuuguguauagu

SEQ ID NO: 520292 - RNA, 19 nt, Homo sapiens
acagcaaugucaucuuaca

SEQ ID NO: 520293 - RNA, 19 nt, Homo sapiens
uauauagucaugcaguuug

SEQ ID NO: 520294 - RNA, 19 nt, Homo sapiens
cauugauccaguugauuua

SEQ ID NO: 520295 - RNA, 19 nt, Homo sapiens
cagucagcauguuuagaaa

SEQ ID NO: 520296 - RNA, 19 nt, Homo sapiens
ggauuacaacuacccacuu

SEQ ID NO: 520297 - RNA, 19 nt, Homo sapiens
caaagccaagggccaguga

SEQ ID NO: 520298 - RNA, 19 nt, Homo sapiens
uguggcagaugacguguuc

SEQ ID NO: 520299 - RNA, 19 nt, Homo sapiens
uggcagaacagaacuaugg

SEQ ID NO: 520300 - RNA, 19 nt, Homo sapiens
caaaacagccaacuaccuu

SEQ ID NO: 520301 - RNA, 19 nt, Homo sapiens
caugaagaaaugaugaaga

SEQ ID NO: 520302 - RNA, 19 nt, Homo sapiens
cacacuggauuacaacuac

SEQ ID NO: 520303 - RNA, 19 nt, Homo sapiens
ugaagaugcgacaggcuaa

SEQ ID NO: 520304 - RNA, 19 nt, Homo sapiens
caagguggcagaacagaac

SEQ ID NO: 520305 - RNA, 19 nt, Homo sapiens
cagaggcuacuacuugaga

SEQ ID NO: 520306 - RNA, 19 nt, Homo sapiens
gcuaagcuggauuaucaga

SEQ ID NO: 520307 - RNA, 19 nt, Homo sapiens
ccaaaagcaugauaucucu

SEQ ID NO: 520308 - RNA, 19 nt, Homo sapiens
gacccugauuauauaguca

SEQ ID NO: 520309 - RNA, 19 nt, Homo sapiens
aguccuauguccucaacuu

SEQ ID NO: 520310 - RNA, 19 nt, Homo sapiens
cccucaaggugucacagua

SEQ ID NO: 520311 - RNA, 19 nt, Homo sapiens
ccucuguuguggaagaaga

SEQ ID NO: 520312 - RNA, 19 nt, Homo sapiens
guugauuuaucucgugaag

SEQ ID NO: 520313 - RNA, 19 nt, Homo sapiens
uaucuccauugauccaguu

SEQ ID NO: 520314 - RNA, 19 nt, Homo sapiens
ugagaagaggcaaaggaaa

SEQ ID NO: 520315 - RNA, 19 nt, Homo sapiens
ugacccugauuauauaguc

SEQ ID NO: 520316 - RNA, 19 nt, Homo sapiens
ugaaacgaacguacuugga

SEQ ID NO: 520317 - RNA, 19 nt, Homo sapiens
caccuacuauauguacuug

SEQ ID NO: 520318 - RNA, 19 nt, Homo sapiens
gugaaugagagaacaguca

SEQ ID NO: 520319 - RNA, 19 nt, Homo sapiens
aggcgucugugaagaacuu

SEQ ID NO: 520320 - RNA, 19 nt, Homo sapiens
ugauccaguugauuuaucu

SEQ ID NO: 520321 - RNA, 19 nt, Homo sapiens
ccaccuacuauauguacuu

SEQ ID NO: 520322 - RNA, 19 nt, Homo sapiens
caaggugucacaguaagau

SEQ ID NO: 520323 - RNA, 19 nt, Homo sapiens
ggaauaucccagucagcau

SEQ ID NO: 520324 - RNA, 19 nt, Homo sapiens
ccaugacaguuugcucuca

SEQ ID NO: 520325 - RNA, 19 nt, Homo sapiens
aaagcgccuugagccauuu

SEQ ID NO: 520326 - RNA, 19 nt, Homo sapiens
ucggcaagcuuagauccaa

SEQ ID NO: 520327 - RNA, 19 nt, Homo sapiens
aaaguuaugucggcaagcu

SEQ ID NO: 520328 - RNA, 19 nt, Homo sapiens
gaaggacucucgucucaug

SEQ ID NO: 520329 - RNA, 19 nt, Homo sapiens
guaaauacauagcuucuca

SEQ ID NO: 520330 - RNA, 19 nt, Homo sapiens
ggagaugacaaacugauua

SEQ ID NO: 520331 - RNA, 19 nt, Homo sapiens
ggacauuggucacuuguag

SEQ ID NO: 520332 - RNA, 19 nt, Homo sapiens
gcagauggccggagaagaa

SEQ ID NO: 520333 - RNA, 19 nt, Homo sapiens
gaagauaucaggaagaauc

SEQ ID NO: 520334 - RNA, 19 nt, Homo sapiens
gauauuuccuggacucuga

SEQ ID NO: 520335 - RNA, 19 nt, Homo sapiens
gugguaagcuugccaaugu

SEQ ID NO: 520336 - RNA, 19 nt, Homo sapiens
gcgauucugucaauaaaga

SEQ ID NO: 520337 - RNA, 19 nt, Homo sapiens
gaaauucuagcuacucuga

SEQ ID NO: 520338 - RNA, 19 nt, Homo sapiens
guacugaaauuaacuuguc

SEQ ID NO: 520339 - RNA, 19 nt, Homo sapiens
gggaaggcguacugcuuua

SEQ ID NO: 520340 - RNA, 19 nt, Homo sapiens
gcacugaagcugccaauuc

SEQ ID NO: 520341 - RNA, 19 nt, Homo sapiens
gcaccaugcucucuucuca

SEQ ID NO: 520342 - RNA, 19 nt, Homo sapiens
gcuguaaaguucccagaaa

SEQ ID NO: 520343 - RNA, 19 nt, Homo sapiens
ggauaacacugucgucauc

SEQ ID NO: 520344 - RNA, 19 nt, Homo sapiens
guugugaucuggaauaugu

SEQ ID NO: 520345 - RNA, 19 nt, Homo sapiens
ccagauggacaaucacuua

SEQ ID NO: 520346 - RNA, 19 nt, Homo sapiens
uaugacagcuacacugaaa

SEQ ID NO: 520347 - RNA, 19 nt, Homo sapiens
ccacagccgucauugagaa

SEQ ID NO: 520348 - RNA, 19 nt, Homo sapiens
cgacagcuguggaaagguu

SEQ ID NO: 520349 - RNA, 19 nt, Homo sapiens
agagggagcugcugaagga

SEQ ID NO: 520350 - RNA, 19 nt, Homo sapiens
ggaagguugugaucuggaa

SEQ ID NO: 520351 - RNA, 19 nt, Homo sapiens
gaauaccgacuucgagaaa

SEQ ID NO: 520352 - RNA, 19 nt, Homo sapiens
ggacggcucuguggcauuc

SEQ ID NO: 520353 - RNA, 19 nt, Homo sapiens
gaccuaagaccuauguaaa

SEQ ID NO: 520354 - RNA, 19 nt, Homo sapiens
caagaucgaacccaugaaa

SEQ ID NO: 520355 - RNA, 19 nt, Homo sapiens
caagaugcuuugccagaug

SEQ ID NO: 520356 - RNA, 19 nt, Homo sapiens
ccggaagcguuagguauua

SEQ ID NO: 520357 - RNA, 19 nt, Homo sapiens
gaacaaugaagcuccugaa

SEQ ID NO: 520358 - RNA, 19 nt, Homo sapiens
gaauuuccuuuggccgaua

SEQ ID NO: 520359 - RNA, 19 nt, Homo sapiens
auaccgacuucgagaaaua

SEQ ID NO: 520360 - RNA, 19 nt, Homo sapiens
gcuccgauccuuccaugua

SEQ ID NO: 520361 - RNA, 19 nt, Homo sapiens
caaacagugggauguauuu

SEQ ID NO: 520362 - RNA, 19 nt, Homo sapiens
gacaaucacuuagcaugug

SEQ ID NO: 520363 - RNA, 19 nt, Homo sapiens
gcaaaggggugggcgauuu

SEQ ID NO: 520364 - RNA, 19 nt, Homo sapiens
agaaauaugcaaggacuua

SEQ ID NO: 520365 - RNA, 19 nt, Homo sapiens
gcaagagccuagccaucau

SEQ ID NO: 520366 - RNA, 19 nt, Homo sapiens
cggaaggacucucgucuca

SEQ ID NO: 520367 - RNA, 19 nt, Homo sapiens
cagcauggaaucccaguaa

SEQ ID NO: 520368 - RNA, 19 nt, Homo sapiens
gcaaggaccgcucgcuuuc

SEQ ID NO: 520369 - RNA, 19 nt, Homo sapiens
cgagaaggaugaaaauauu

SEQ ID NO: 520370 - RNA, 19 nt, Homo sapiens
gaagaaacaaguugagacu

SEQ ID NO: 520371 - RNA, 19 nt, Homo sapiens
ggacaaucacuuagcaugu

SEQ ID NO: 520372 - RNA, 19 nt, Homo sapiens
gauggacaaucacuuagca

SEQ ID NO: 520373 - RNA, 19 nt, Homo sapiens
aaaggaugcugucaguguu

SEQ ID NO: 520374 - RNA, 19 nt, Homo sapiens
gagcagaaccuugugaaag

SEQ ID NO: 520375 - RNA, 19 nt, Homo sapiens
auugucaccuucuguguua

SEQ ID NO: 520376 - RNA, 19 nt, Homo sapiens
gcaggcgauucugucaaua

SEQ ID NO: 520377 - RNA, 19 nt, Homo sapiens
gauggaagaccaacaugga

SEQ ID NO: 520378 - RNA, 19 nt, Homo sapiens
gaacgggagggauggaaga

SEQ ID NO: 520379 - RNA, 19 nt, Homo sapiens
uagcaugugugaacugugu

SEQ ID NO: 520380 - RNA, 19 nt, Homo sapiens
gcugugacguggugugugu

SEQ ID NO: 520381 - RNA, 19 nt, Homo sapiens
caccagcacuugcacugaa

SEQ ID NO: 520382 - RNA, 19 nt, Homo sapiens
gcuaaggcuuccucacugu

SEQ ID NO: 520383 - RNA, 19 nt, Homo sapiens
agcagaaccuugugaaaga

SEQ ID NO: 520384 - RNA, 19 nt, Homo sapiens
accaugcucucuucucaua

SEQ ID NO: 520385 - RNA, 19 nt, Homo sapiens
guaaaguucccagaaauuc

SEQ ID NO: 520386 - RNA, 19 nt, Homo sapiens
ugacagcgaugagaaaguc

SEQ ID NO: 520387 - RNA, 19 nt, Homo sapiens
gcaggauucugggaagguu

SEQ ID NO: 520388 - RNA, 19 nt, Homo sapiens
caugggacccuguugguaa

SEQ ID NO: 520389 - RNA, 19 nt, Homo sapiens
caucuggaaugcuguaaag

SEQ ID NO: 520390 - RNA, 19 nt, Homo sapiens
gaugacaaacugauuaugg

SEQ ID NO: 520391 - RNA, 19 nt, Homo sapiens
guucgcaacuggaggacaa

SEQ ID NO: 520392 - RNA, 19 nt, Homo sapiens
gcagugacagcgaugagaa

SEQ ID NO: 520393 - RNA, 19 nt, Homo sapiens
ugaaugggcugggcaucuu

SEQ ID NO: 520394 - RNA, 19 nt, Homo sapiens
gaagcgggcuacguacauc

SEQ ID NO: 520395 - RNA, 19 nt, Homo sapiens
gagaugacaaacugauuau

SEQ ID NO: 520396 - RNA, 19 nt, Homo sapiens
acagcagacugaccuaaga

SEQ ID NO: 520397 - RNA, 19 nt, Homo sapiens
cauggaaucccaguaauga

SEQ ID NO: 520398 - RNA, 19 nt, Homo sapiens
acuagaauuugcuaacuug

SEQ ID NO: 520399 - RNA, 19 nt, Homo sapiens
guacuagaauuugcuaacu

SEQ ID NO: 520400 - RNA, 19 nt, Homo sapiens
cuucagcagugacgauuga

SEQ ID NO: 520401 - RNA, 19 nt, Homo sapiens
ggaaggcguacugcuuuaa

SEQ ID NO: 520402 - RNA, 19 nt, Homo sapiens
uagagacaguagagaagaa

SEQ ID NO: 520403 - RNA, 19 nt, Homo sapiens
uccaugaacuguuugacaa

SEQ ID NO: 520404 - RNA, 19 nt, Homo sapiens
agaccaacauggacuuugu

SEQ ID NO: 520405 - RNA, 19 nt, Homo sapiens
gaagaccaacauggacuuu

SEQ ID NO: 520406 - RNA, 19 nt, Homo sapiens
gggacccuguugguaaaua

SEQ ID NO: 520407 - RNA, 19 nt, Homo sapiens
ugaccuaagaccuauguaa

SEQ ID NO: 520408 - RNA, 19 nt, Homo sapiens
ccaggaggaugacgagaag

SEQ ID NO: 520409 - RNA, 19 nt, Homo sapiens
ucaggaccguuagccauaa

SEQ ID NO: 520410 - RNA, 19 nt, Homo sapiens
gcauggaaucccaguaaug

SEQ ID NO: 520411 - RNA, 19 nt, Homo sapiens
ggcaagagccuagccauca

SEQ ID NO: 520412 - RNA, 19 nt, Homo sapiens
gaggaacgacccauguguu

SEQ ID NO: 520413 - RNA, 19 nt, Homo sapiens
ggucacuuguaggaaauuu

SEQ ID NO: 520414 - RNA, 19 nt, Homo sapiens
ggucaaacagugggaugua

SEQ ID NO: 520415 - RNA, 19 nt, Homo sapiens
agacugaccuaagaccuau

SEQ ID NO: 520416 - RNA, 19 nt, Homo sapiens
ggaagagggagcugcugaa

SEQ ID NO: 520417 - RNA, 19 nt, Homo sapiens
gcugugcucaggaccguua

SEQ ID NO: 520418 - RNA, 19 nt, Homo sapiens
gaaggcguacugcuuuaau

SEQ ID NO: 520419 - RNA, 19 nt, Homo sapiens
caguagagaagaagaagaa

SEQ ID NO: 520420 - RNA, 19 nt, Homo sapiens
ccaagaugcuuugccagau

SEQ ID NO: 520421 - RNA, 19 nt, Homo sapiens
uugaagauaucaggaagaa

SEQ ID NO: 520422 - RNA, 19 nt, Homo sapiens
gacaggugguuguggugaa

SEQ ID NO: 520423 - RNA, 19 nt, Homo sapiens
cacaauggcaagccgauuu

SEQ ID NO: 520424 - RNA, 19 nt, Homo sapiens
guguucggcuccaguggua

SEQ ID NO: 520425 - RNA, 19 nt, Homo sapiens
ccagugggagucaacagua

SEQ ID NO: 520426 - RNA, 19 nt, Homo sapiens
gcagaaccuugugaaagag

SEQ ID NO: 520427 - RNA, 19 nt, Homo sapiens
cuggaaugcuguaaaguuc

SEQ ID NO: 520428 - RNA, 19 nt, Homo sapiens
ggaaaggcaucacuaugga

SEQ ID NO: 520429 - RNA, 19 nt, Homo sapiens
gcaaauagauccggugucu

SEQ ID NO: 520430 - RNA, 19 nt, Homo sapiens
gcaaaaccauagucaguua

SEQ ID NO: 520431 - RNA, 19 nt, Homo sapiens
gaaaggaaaggcaucacua

SEQ ID NO: 520432 - RNA, 19 nt, Homo sapiens
ucacaccucugcauucuga

SEQ ID NO: 520433 - RNA, 19 nt, Homo sapiens
gauagaagucugaacaguu

SEQ ID NO: 520434 - RNA, 19 nt, Homo sapiens
agaccuagaugucauuguu

SEQ ID NO: 520435 - RNA, 19 nt, Homo sapiens
cuauggacuuucucuauuu

SEQ ID NO: 520436 - RNA, 19 nt, Homo sapiens
auagaagucugaacaguug

SEQ ID NO: 520437 - RNA, 19 nt, Homo sapiens
ggaucaaacuggccugcaa

SEQ ID NO: 520438 - RNA, 19 nt, Homo sapiens
cagaggaacuauaagaaca

SEQ ID NO: 520439 - RNA, 19 nt, Homo sapiens
acaaucagaggaacuauaa

SEQ ID NO: 520440 - RNA, 19 nt, Homo sapiens
gugucuaaaugcauucaua

SEQ ID NO: 520441 - RNA, 19 nt, Homo sapiens
caagaggucgugccaauca

SEQ ID NO: 520442 - RNA, 19 nt, Homo sapiens
guacaucgacuuccucuac

SEQ ID NO: 520443 - RNA, 19 nt, Homo sapiens
gaacuauaagaacaccuuu

SEQ ID NO: 520444 - RNA, 19 nt, Homo sapiens
guaacaaucagaggaacua

SEQ ID NO: 520445 - RNA, 19 nt, Homo sapiens
gaucaaacuggccugcaaa

SEQ ID NO: 520446 - RNA, 19 nt, Homo sapiens
acuauggacuuucucuauu

SEQ ID NO: 520447 - RNA, 19 nt, Homo sapiens
ggaacuauaagaacaccuu

SEQ ID NO: 520448 - RNA, 19 nt, Homo sapiens
cucuggagcuggauaacua

SEQ ID NO: 520449 - RNA, 19 nt, Homo sapiens
ggacaagcugagcaagauu

SEQ ID NO: 520450 - RNA, 19 nt, Homo sapiens
aaucagaggaacuauaaga

SEQ ID NO: 520451 - RNA, 19 nt, Homo sapiens
gacgacagccugagcaaca

SEQ ID NO: 520452 - RNA, 19 nt, Homo sapiens
cggacaagcugagcaagau

SEQ ID NO: 520453 - RNA, 19 nt, Homo sapiens
gauccggugucuaaaugca

SEQ ID NO: 520454 - RNA, 19 nt, Homo sapiens
aggcaucacuauggacuuu

SEQ ID NO: 520455 - RNA, 19 nt, Homo sapiens
aaaggaaaggcaucacuau

SEQ ID NO: 520456 - RNA, 19 nt, Homo sapiens
ugucauuguuuccagagaa

SEQ ID NO: 520457 - RNA, 19 nt, Homo sapiens
gaccuagaugucauuguuu

SEQ ID NO: 520458 - RNA, 19 nt, Homo sapiens
gcaucacuauggacuuucu

SEQ ID NO: 520459 - RNA, 19 nt, Homo sapiens
ggaguccgcagucuuacga

SEQ ID NO: 520460 - RNA, 19 nt, Homo sapiens
gaagagcaaaauccaaauu

SEQ ID NO: 520461 - RNA, 19 nt, Homo sapiens
gacaagcugagcaagauuc

SEQ ID NO: 520462 - RNA, 19 nt, Homo sapiens
cucaagaggucgugccaau

SEQ ID NO: 520463 - RNA, 19 nt, Homo sapiens
ugauagaagucugaacagu

SEQ ID NO: 520464 - RNA, 19 nt, Homo sapiens
gaaaauggacagucuagag

SEQ ID NO: 520465 - RNA, 19 nt, Homo sapiens
gcaagauucagacccucaa

SEQ ID NO: 520466 - RNA, 19 nt, Homo sapiens
gaggacccaugguaaaaug

SEQ ID NO: 520467 - RNA, 19 nt, Homo sapiens
aaccauagucaguuaauuc

SEQ ID NO: 520468 - RNA, 19 nt, Homo sapiens
gcacccagucgcugaacga

SEQ ID NO: 520469 - RNA, 19 nt, Homo sapiens
ccucacaccucugcauucu

SEQ ID NO: 520470 - RNA, 19 nt, Homo sapiens
uuauugaggacccauggua

SEQ ID NO: 520471 - RNA, 19 nt, Homo sapiens
cacuauggacuuucucuau

SEQ ID NO: 520472 - RNA, 19 nt, Homo sapiens
acaccucugcauucugaua

SEQ ID NO: 520473 - RNA, 19 nt, Homo sapiens
acaggcccguggacaguga

SEQ ID NO: 520474 - RNA, 19 nt, Homo sapiens
gagcaaaauccaaauucaa

SEQ ID NO: 520475 - RNA, 19 nt, Homo sapiens
uauugaggacccaugguaa

SEQ ID NO: 520476 - RNA, 19 nt, Homo sapiens
aacaaucagaggaacuaua

SEQ ID NO: 520477 - RNA, 19 nt, Homo sapiens
ccagguacaucgacuuccu

SEQ ID NO: 520478 - RNA, 19 nt, Homo sapiens
ccggagaccuagaugucau

SEQ ID NO: 520479 - RNA, 19 nt, Homo sapiens
aggaaaggcaucacuaugg

SEQ ID NO: 520480 - RNA, 19 nt, Homo sapiens
gagacucuggagcuggaua

SEQ ID NO: 520481 - RNA, 19 nt, Homo sapiens
acuauaagaacaccuuuag

SEQ ID NO: 520482 - RNA, 19 nt, Homo sapiens
ucacuauggacuuucucua

SEQ ID NO: 520483 - RNA, 19 nt, Homo sapiens
gagcaacagcgaggaagag

SEQ ID NO: 520484 - RNA, 19 nt, Homo sapiens
ucugauagaagucugaaca

SEQ ID NO: 520485 - RNA, 19 nt, Homo sapiens
ggccggagaccuagauguc

SEQ ID NO: 520486 - RNA, 19 nt, Homo sapiens
gcacugggcuaaauacuua

SEQ ID NO: 520487 - RNA, 19 nt, Homo sapiens
gaaaugaggugauccuauu

SEQ ID NO: 520488 - RNA, 19 nt, Homo sapiens
gaagagagccgucuaagaa

SEQ ID NO: 520489 - RNA, 19 nt, Homo sapiens
gagcaguuaucaauuguua

SEQ ID NO: 520490 - RNA, 19 nt, Homo sapiens
gaauuaacccuucgauaua

SEQ ID NO: 520491 - RNA, 19 nt, Homo sapiens
caagagcaguuaucaauug

SEQ ID NO: 520492 - RNA, 19 nt, Homo sapiens
gaaauaccauagaccauau

SEQ ID NO: 520493 - RNA, 19 nt, Homo sapiens
gggcauggauucuucauug

SEQ ID NO: 520494 - RNA, 19 nt, Homo sapiens
caagaugcauuguuucuau

SEQ ID NO: 520495 - RNA, 19 nt, Homo sapiens
gaaauuucccuucaaagaa

SEQ ID NO: 520496 - RNA, 19 nt, Homo sapiens
gcacucagcuccaugucuu

SEQ ID NO: 520497 - RNA, 19 nt, Homo sapiens
gggcuucaauggaauagua

SEQ ID NO: 520498 - RNA, 19 nt, Homo sapiens
ugagacagauauucaauga

SEQ ID NO: 520499 - RNA, 19 nt, Homo sapiens
ugacauguguguggcauua

SEQ ID NO: 520500 - RNA, 19 nt, Homo sapiens
gaaauuguagguaagguaa

SEQ ID NO: 520501 - RNA, 19 nt, Homo sapiens
gcacaugcaggccuaagua

SEQ ID NO: 520502 - RNA, 19 nt, Homo sapiens
gaacaacucagucaucauc

SEQ ID NO: 520503 - RNA, 19 nt, Homo sapiens
ucaggcaauugucauaaua

SEQ ID NO: 520504 - RNA, 19 nt, Homo sapiens
ugaauucuguguccuuuga

SEQ ID NO: 520505 - RNA, 19 nt, Homo sapiens
aguguaaccuucuccuuua

SEQ ID NO: 520506 - RNA, 19 nt, Homo sapiens
cuaaguauauguugugugu

SEQ ID NO: 520507 - RNA, 19 nt, Homo sapiens
gcacuaagaaguuauugug

SEQ ID NO: 520508 - RNA, 19 nt, Homo sapiens
gauacaacaucacagaauc

SEQ ID NO: 520509 - RNA, 19 nt, Homo sapiens
aaugaucucugucuagaaa

SEQ ID NO: 520510 - RNA, 19 nt, Homo sapiens
caaauagcacuaagaaguu

SEQ ID NO: 520511 - RNA, 19 nt, Homo sapiens
gggaugugaugcuuugaaa

SEQ ID NO: 520512 - RNA, 19 nt, Homo sapiens
cgauauacauggcagaguu

SEQ ID NO: 520513 - RNA, 19 nt, Homo sapiens
gaagauuguguguguguuu

SEQ ID NO: 520514 - RNA, 19 nt, Homo sapiens
ucaaauagcacuaagaagu

SEQ ID NO: 520515 - RNA, 19 nt, Homo sapiens
caaauucaaucugauguca

SEQ ID NO: 520516 - RNA, 19 nt, Homo sapiens
gagagccgucuaagaaaua

SEQ ID NO: 520517 - RNA, 19 nt, Homo sapiens
agagaaugcuuaagggauu

SEQ ID NO: 520518 - RNA, 19 nt, Homo sapiens
agaauuaacccuucgauau

SEQ ID NO: 520519 - RNA, 19 nt, Homo sapiens
ccaaggcacucacagaauc

SEQ ID NO: 520520 - RNA, 19 nt, Homo sapiens
gaccauauauagucucaca

SEQ ID NO: 520521 - RNA, 19 nt, Homo sapiens
gcagggaacuggacaucuc

SEQ ID NO: 520522 - RNA, 19 nt, Homo sapiens
ucacaucgguauccucgaa

SEQ ID NO: 520523 - RNA, 19 nt, Homo sapiens
gaaucauaaucauggcuaa

SEQ ID NO: 520524 - RNA, 19 nt, Homo sapiens
guacugugcuacaauuauc

SEQ ID NO: 520525 - RNA, 19 nt, Homo sapiens
aagaaguuauugugccuua

SEQ ID NO: 520526 - RNA, 19 nt, Homo sapiens
ggaagagaaugugggaaau

SEQ ID NO: 520527 - RNA, 19 nt, Homo sapiens
gaguguaaccuucuccuuu

SEQ ID NO: 520528 - RNA, 19 nt, Homo sapiens
gagaauuaacccuucgaua

SEQ ID NO: 520529 - RNA, 19 nt, Homo sapiens
ucuaaucagugacuuaaga

SEQ ID NO: 520530 - RNA, 19 nt, Homo sapiens
gcacuucucugcucuucag

SEQ ID NO: 520531 - RNA, 19 nt, Homo sapiens
gcugguggccucuguaauu

SEQ ID NO: 520532 - RNA, 19 nt, Homo sapiens
uggacaagcuuacaucuuc

SEQ ID NO: 520533 - RNA, 19 nt, Homo sapiens
gccacuaacuagccaugua

SEQ ID NO: 520534 - RNA, 19 nt, Homo sapiens
caacaucacagaaucuuuc

SEQ ID NO: 520535 - RNA, 19 nt, Homo sapiens
aaguacaccuucaacuaua

SEQ ID NO: 520536 - RNA, 19 nt, Homo sapiens
uaaguacaccuucaacuau

SEQ ID NO: 520537 - RNA, 19 nt, Homo sapiens
ccagaugauuuguaacuuc

SEQ ID NO: 520538 - RNA, 19 nt, Homo sapiens
ugaucucugucuagaaaua

SEQ ID NO: 520539 - RNA, 19 nt, Homo sapiens
gaagaaucagcuugugaaa

SEQ ID NO: 520540 - RNA, 19 nt, Homo sapiens
cagaacaacucagucauca

SEQ ID NO: 520541 - RNA, 19 nt, Homo sapiens
ucaugaaggugcagaacaa

SEQ ID NO: 520542 - RNA, 19 nt, Homo sapiens
ccaccuuccuuccaucaaa

SEQ ID NO: 520543 - RNA, 19 nt, Homo sapiens
caugucaacuuuccagaug

SEQ ID NO: 520544 - RNA, 19 nt, Homo sapiens
gggagagugagauaacuua

SEQ ID NO: 520545 - RNA, 19 nt, Homo sapiens
gcaccagcaugaacaccaa

SEQ ID NO: 520546 - RNA, 19 nt, Homo sapiens
gaucucagaauucacuaaa

SEQ ID NO: 520547 - RNA, 19 nt, Homo sapiens
ugaagaaggucaggucugu

SEQ ID NO: 520548 - RNA, 19 nt, Homo sapiens
uaaauggucucaguuggau

SEQ ID NO: 520549 - RNA, 19 nt, Homo sapiens
ucuggaugauucuguguua

SEQ ID NO: 520550 - RNA, 19 nt, Homo sapiens
cauauauagucucacauug

SEQ ID NO: 520551 - RNA, 19 nt, Homo sapiens
agaaauaccauagaccaua

SEQ ID NO: 520552 - RNA, 19 nt, Homo sapiens
gaaguuauugugccuuaug

SEQ ID NO: 520553 - RNA, 19 nt, Homo sapiens
uaagaggaaucaaguucug

SEQ ID NO: 520554 - RNA, 19 nt, Homo sapiens
uaccauagaccauauauag

SEQ ID NO: 520555 - RNA, 19 nt, Homo sapiens
acagggauauuucugcuau

SEQ ID NO: 520556 - RNA, 19 nt, Homo sapiens
uuaaguacaccuucaacua

SEQ ID NO: 520557 - RNA, 19 nt, Homo sapiens
ucaaucugaugucaaauag

SEQ ID NO: 520558 - RNA, 19 nt, Homo sapiens
gacagggcauggauucuuc

SEQ ID NO: 520559 - RNA, 19 nt, Homo sapiens
ggugaauucuguguccuuu

SEQ ID NO: 520560 - RNA, 19 nt, Homo sapiens
gaauggcggagaacugauu

SEQ ID NO: 520561 - RNA, 19 nt, Homo sapiens
gaagagaaugugggaaaug

SEQ ID NO: 520562 - RNA, 19 nt, Homo sapiens
ggccugcucuucccauguu

SEQ ID NO: 520563 - RNA, 19 nt, Homo sapiens
gcuguucgcccuuacacua

SEQ ID NO: 520564 - RNA, 19 nt, Homo sapiens
gaggauacaacaucacaga

SEQ ID NO: 520565 - RNA, 19 nt, Homo sapiens
caacuuuccagaugauuug

SEQ ID NO: 520566 - RNA, 19 nt, Homo sapiens
ugccagggcuucaauggaa

SEQ ID NO: 520567 - RNA, 19 nt, Homo sapiens
agucucacauugauaauug

SEQ ID NO: 520568 - RNA, 19 nt, Homo sapiens
agaaauuucccuucaaaga

SEQ ID NO: 520569 - RNA, 19 nt, Homo sapiens
uaagaaauaccacgugcuu

SEQ ID NO: 520570 - RNA, 19 nt, Homo sapiens
ccacuaacuagccauguaa

SEQ ID NO: 520571 - RNA, 19 nt, Homo sapiens
ggauacaacaucacagaau

SEQ ID NO: 520572 - RNA, 19 nt, Homo sapiens
ggacagggcauggauucuu

SEQ ID NO: 520573 - RNA, 19 nt, Homo sapiens
caaccacacagggauauuu

SEQ ID NO: 520574 - RNA, 19 nt, Homo sapiens
gguaagaggaaucaaguuc

SEQ ID NO: 520575 - RNA, 19 nt, Homo sapiens
ucuagaaucuccagaaagg

SEQ ID NO: 520576 - RNA, 19 nt, Homo sapiens
gugcuacaauuaucucuag

SEQ ID NO: 520577 - RNA, 19 nt, Homo sapiens
ggucuaauaucagccuaug

SEQ ID NO: 520578 - RNA, 19 nt, Homo sapiens
cuacuaggcaccuuuguga

SEQ ID NO: 520579 - RNA, 19 nt, Homo sapiens
gcagaacaacucagucauc

SEQ ID NO: 520580 - RNA, 19 nt, Homo sapiens
gcaguuaucaauuguuagu

SEQ ID NO: 520581 - RNA, 19 nt, Homo sapiens
cauguaaccuugggaaagu

SEQ ID NO: 520582 - RNA, 19 nt, Homo sapiens
gauauacauggcagaguuu

SEQ ID NO: 520583 - RNA, 19 nt, Homo sapiens
ucucuagaaucuccagaaa

SEQ ID NO: 520584 - RNA, 19 nt, Homo sapiens
caauagaggauacaacauc

SEQ ID NO: 520585 - RNA, 19 nt, Homo sapiens
ccauauauagucucacauu

SEQ ID NO: 520586 - RNA, 19 nt, Homo sapiens
gcucucugcuuacguaugc

SEQ ID NO: 520587 - RNA, 19 nt, Homo sapiens
gcuacaagccuggaguuga

SEQ ID NO: 520588 - RNA, 19 nt, Homo sapiens
cuacaagccuggaguugac

SEQ ID NO: 520589 - RNA, 19 nt, Homo sapiens
ccggcucucugcuuacgua

SEQ ID NO: 520590 - RNA, 19 nt, Homo sapiens
gcucggacgcaaucuguga

SEQ ID NO: 520591 - RNA, 19 nt, Homo sapiens
gccuccggcucucugcuua

SEQ ID NO: 520592 - RNA, 19 nt, Homo sapiens
gcaauagcucggacgcaau

SEQ ID NO: 520593 - RNA, 19 nt, Homo sapiens
caauagcucggacgcaauc

SEQ ID NO: 520594 - RNA, 19 nt, Homo sapiens
ugacggggcuccacugugu

SEQ ID NO: 520595 - RNA, 19 nt, Homo sapiens
ucacuguccagcccacuga

SEQ ID NO: 520596 - RNA, 19 nt, Homo sapiens
ccauccugcuggcccugua

SEQ ID NO: 520597 - RNA, 19 nt, Homo sapiens
gcgacaaccaggccugcaa

SEQ ID NO: 520598 - RNA, 19 nt, Homo sapiens
gaaaauggcugccugcuua

SEQ ID NO: 520599 - RNA, 19 nt, Homo sapiens
gaacaucuauugagacaag

SEQ ID NO: 520600 - RNA, 19 nt, Homo sapiens
ccaaagugaugaugaaauu

SEQ ID NO: 520601 - RNA, 19 nt, Homo sapiens
ucaaggcacuuuaugauuu

SEQ ID NO: 520602 - RNA, 19 nt, Homo sapiens
ggagaggaauggcuauauu

SEQ ID NO: 520603 - RNA, 19 nt, Homo sapiens
gagaauaaaggaaagcuua

SEQ ID NO: 520604 - RNA, 19 nt, Homo sapiens
caaaugagaacacagauaa

SEQ ID NO: 520605 - RNA, 19 nt, Homo sapiens
guauagcucuuuacagaaa

SEQ ID NO: 520606 - RNA, 19 nt, Homo sapiens
ggauauaugugaaggaaug

SEQ ID NO: 520607 - RNA, 19 nt, Homo sapiens
cagagaacccuguaauuua

SEQ ID NO: 520608 - RNA, 19 nt, Homo sapiens
gaaggugcauuuauuguca

SEQ ID NO: 520609 - RNA, 19 nt, Homo sapiens
cagaagaacugaagacugu

SEQ ID NO: 520610 - RNA, 19 nt, Homo sapiens
cuaagugucuccuguaauu

SEQ ID NO: 520611 - RNA, 19 nt, Homo sapiens
ggacucccuugaagaauuu

SEQ ID NO: 520612 - RNA, 19 nt, Homo sapiens
gcaccaauguccauauaug

SEQ ID NO: 520613 - RNA, 19 nt, Homo sapiens
cuacacaauuuccguauuu

SEQ ID NO: 520614 - RNA, 19 nt, Homo sapiens
gcaaaacugucauuuauug

SEQ ID NO: 520615 - RNA, 19 nt, Homo sapiens
gagcacagaugaagagcuu

SEQ ID NO: 520616 - RNA, 19 nt, Homo sapiens
gaaaugcuacugaguguau

SEQ ID NO: 520617 - RNA, 19 nt, Homo sapiens
ucaggaagaugauuuguuc

SEQ ID NO: 520618 - RNA, 19 nt, Homo sapiens
ccagagaacccuguaauuu

SEQ ID NO: 520619 - RNA, 19 nt, Homo sapiens
ggaauuguuuggucaguuc

SEQ ID NO: 520620 - RNA, 19 nt, Homo sapiens
acaucaagcuccauuguuu

SEQ ID NO: 520621 - RNA, 19 nt, Homo sapiens
ugagagugcuuccuucuug

SEQ ID NO: 520622 - RNA, 19 nt, Homo sapiens
uggaauaucuggagaggaa

SEQ ID NO: 520623 - RNA, 19 nt, Homo sapiens
ggaaugacaagguacguuu

SEQ ID NO: 520624 - RNA, 19 nt, Homo sapiens
guacggaggcugccauaaa

SEQ ID NO: 520625 - RNA, 19 nt, Homo sapiens
gaagagaagauccaaguca

SEQ ID NO: 520626 - RNA, 19 nt, Homo sapiens
gaauaucuuucuucagagu

SEQ ID NO: 520627 - RNA, 19 nt, Homo sapiens
ucacagagauugcggaaac

SEQ ID NO: 520628 - RNA, 19 nt, Homo sapiens
caaauaagaagcaauccaa

SEQ ID NO: 520629 - RNA, 19 nt, Homo sapiens
ggcagaacaucuauugaga

SEQ ID NO: 520630 - RNA, 19 nt, Homo sapiens
guagagcaccgcagaagaa

SEQ ID NO: 520631 - RNA, 19 nt, Homo sapiens
agagaacccuguaauuuag

SEQ ID NO: 520632 - RNA, 19 nt, Homo sapiens
gaacagaucccggugacau

SEQ ID NO: 520633 - RNA, 19 nt, Homo sapiens
ggagccaaguucccaauca

SEQ ID NO: 520634 - RNA, 19 nt, Homo sapiens
gugcagaagcgacaaauga

SEQ ID NO: 520635 - RNA, 19 nt, Homo sapiens
aaagcaagauagccaaaug

SEQ ID NO: 520636 - RNA, 19 nt, Homo sapiens
gaagacgagugucauucau

SEQ ID NO: 520637 - RNA, 19 nt, Homo sapiens
gauuugcacacucuuauuu

SEQ ID NO: 520638 - RNA, 19 nt, Homo sapiens
gaaaccuggugaccggaaa

SEQ ID NO: 520639 - RNA, 19 nt, Homo sapiens
gagccaaguucccaaucaa

SEQ ID NO: 520640 - RNA, 19 nt, Homo sapiens
gcaacuaugugacugaaaa

SEQ ID NO: 520641 - RNA, 19 nt, Homo sapiens
gcagaagaauaccugauac

SEQ ID NO: 520642 - RNA, 19 nt, Homo sapiens
gagagugcuuccuucuuga

SEQ ID NO: 520643 - RNA, 19 nt, Homo sapiens
aaggaaagcuuaggaagga

SEQ ID NO: 520644 - RNA, 19 nt, Homo sapiens
cagaacaucuauugagaca

SEQ ID NO: 520645 - RNA, 19 nt, Homo sapiens
gcaagauagccaaauguga

SEQ ID NO: 520646 - RNA, 19 nt, Homo sapiens
gugcaaagaucacaguuuu

SEQ ID NO: 520647 - RNA, 19 nt, Homo sapiens
ucugaugucuggucauuug

SEQ ID NO: 520648 - RNA, 19 nt, Homo sapiens
ucaaucaaucccugaguua

SEQ ID NO: 520649 - RNA, 19 nt, Homo sapiens
ucagccaauugucaaauaa

SEQ ID NO: 520650 - RNA, 19 nt, Homo sapiens
gaagaacugaagacuguug

SEQ ID NO: 520651 - RNA, 19 nt, Homo sapiens
gugaaggaauggaauaucu

SEQ ID NO: 520652 - RNA, 19 nt, Homo sapiens
ugacagaguucauggaaaa

SEQ ID NO: 520653 - RNA, 19 nt, Homo sapiens
gcugaugggcaguuguuua

SEQ ID NO: 520654 - RNA, 19 nt, Homo sapiens
gaaaucaggcagaacaucu

SEQ ID NO: 520655 - RNA, 19 nt, Homo sapiens
cgacaaaugagaacacaga

SEQ ID NO: 520656 - RNA, 19 nt, Homo sapiens
caaaugugaagaagugaaa

SEQ ID NO: 520657 - RNA, 19 nt, Homo sapiens
caggauauaugugaaggaa

SEQ ID NO: 520658 - RNA, 19 nt, Homo sapiens
gcaacuuuauggagucugu

SEQ ID NO: 520659 - RNA, 19 nt, Homo sapiens
cauagaaacauuaccagaa

SEQ ID NO: 520660 - RNA, 19 nt, Homo sapiens
uggcaccaauguccauaua

SEQ ID NO: 520661 - RNA, 19 nt, Homo sapiens
gaauggcggucacauaucc

SEQ ID NO: 520662 - RNA, 19 nt, Homo sapiens
agacacgccuuucaaucaa

SEQ ID NO: 520663 - RNA, 19 nt, Homo sapiens
cguggaagcuauuucugaa

SEQ ID NO: 520664 - RNA, 19 nt, Homo sapiens
guacagcaguaaaucugau

SEQ ID NO: 520665 - RNA, 19 nt, Homo sapiens
caagguacguuuuggauga

SEQ ID NO: 520666 - RNA, 19 nt, Homo sapiens
gauuggaagcggucaguuu

SEQ ID NO: 520667 - RNA, 19 nt, Homo sapiens
gaacugaagacuguugugu

SEQ ID NO: 520668 - RNA, 19 nt, Homo sapiens
caugugagauuggacaguu

SEQ ID NO: 520669 - RNA, 19 nt, Homo sapiens
cuucagugauccaugcaua

SEQ ID NO: 520670 - RNA, 19 nt, Homo sapiens
ggaaagcuuaggaaggaaa

SEQ ID NO: 520671 - RNA, 19 nt, Homo sapiens
gaagaggccaaagugauga

SEQ ID NO: 520672 - RNA, 19 nt, Homo sapiens
aaagaaggugcauuuauug

SEQ ID NO: 520673 - RNA, 19 nt, Homo sapiens
gagauuggacaguuucaga

SEQ ID NO: 520674 - RNA, 19 nt, Homo sapiens
agacgagugucauucauca

SEQ ID NO: 520675 - RNA, 19 nt, Homo sapiens
gugcauuuauugucagaga

SEQ ID NO: 520676 - RNA, 19 nt, Homo sapiens
aagagaagauccaagucaa

SEQ ID NO: 520677 - RNA, 19 nt, Homo sapiens
guggugcucuucaugauca

SEQ ID NO: 520678 - RNA, 19 nt, Homo sapiens
gcagaagcgacaaaugaga

SEQ ID NO: 520679 - RNA, 19 nt, Homo sapiens
uaucaaggccaucaaugaa

SEQ ID NO: 520680 - RNA, 19 nt, Homo sapiens
uaugggagcuagaagaagu

SEQ ID NO: 520681 - RNA, 19 nt, Homo sapiens
gcaagucguggaagcuauu

SEQ ID NO: 520682 - RNA, 19 nt, Homo sapiens
gaugaugaguaugucaguu

SEQ ID NO: 520683 - RNA, 19 nt, Homo sapiens
gcggucacauauccaggua

SEQ ID NO: 520684 - RNA, 19 nt, Homo sapiens
uaaggagagcagaagaaua

SEQ ID NO: 520685 - RNA, 19 nt, Homo sapiens
gggcuaccaugauccuuuc

SEQ ID NO: 520686 - RNA, 19 nt, Homo sapiens
ucccaaaugugaagaagug

SEQ ID NO: 520687 - RNA, 19 nt, Homo sapiens
ucacauauccagguagcua

SEQ ID NO: 520688 - RNA, 19 nt, Homo sapiens
gcauuuauugucagagauu

SEQ ID NO: 520689 - RNA, 19 nt, Homo sapiens
aaucugaugucuggucauu

SEQ ID NO: 520690 - RNA, 19 nt, Homo sapiens
caaugcagccggucucaug

SEQ ID NO: 520691 - RNA, 19 nt, Homo sapiens
ccagaaaucaggcagaaca

SEQ ID NO: 520692 - RNA, 19 nt, Homo sapiens
ccaugauccuuuccuccua

SEQ ID NO: 520693 - RNA, 19 nt, Homo sapiens
cuggaaaugucuuuuguua

SEQ ID NO: 520694 - RNA, 19 nt, Homo sapiens
ucaauaaguacagcaguaa

SEQ ID NO: 520695 - RNA, 19 nt, Homo sapiens
ugaagaggccaaagugaug

SEQ ID NO: 520696 - RNA, 19 nt, Homo sapiens
acaagagucuaaagaaggu

SEQ ID NO: 520697 - RNA, 19 nt, Homo sapiens
gaaggcaagagaccguuug

SEQ ID NO: 520698 - RNA, 19 nt, Homo sapiens
gaucaacccuuucuuucau

SEQ ID NO: 520699 - RNA, 19 nt, Homo sapiens
gcaaaaugaucaacccuuu

SEQ ID NO: 520700 - RNA, 19 nt, Homo sapiens
ggauguugcuucagagugu

SEQ ID NO: 520701 - RNA, 19 nt, Homo sapiens
gauauuccuugaaguagau

SEQ ID NO: 520702 - RNA, 19 nt, Homo sapiens
gugauaaacuuguaguagu

SEQ ID NO: 520703 - RNA, 19 nt, Homo sapiens
ugaagcagaucgagagcaa

SEQ ID NO: 520704 - RNA, 19 nt, Homo sapiens
gaagccaccauuaaugaau

SEQ ID NO: 520705 - RNA, 19 nt, Homo sapiens
uguaguaguugacuucuca

SEQ ID NO: 520706 - RNA, 19 nt, Homo sapiens
cauuggcuauuuaaacuug

SEQ ID NO: 520707 - RNA, 19 nt, Homo sapiens
aaacauaaccagccauugg

SEQ ID NO: 520708 - RNA, 19 nt, Homo sapiens
ggacgcugcaggugauaaa

SEQ ID NO: 520709 - RNA, 19 nt, Homo sapiens
cagccaagauggugaagca

SEQ ID NO: 520710 - RNA, 19 nt, Homo sapiens
gacaaaaggugggugaauu

SEQ ID NO: 520711 - RNA, 19 nt, Homo sapiens
gucaggauguugcuucaga

SEQ ID NO: 520712 - RNA, 19 nt, Homo sapiens
cgugauauuccuugaagua

SEQ ID NO: 520713 - RNA, 19 nt, Homo sapiens
ccaagauggugaagcagau

SEQ ID NO: 520714 - RNA, 19 nt, Homo sapiens
ccauuuccaucgguccuua

SEQ ID NO: 520715 - RNA, 19 nt, Homo sapiens
ugauauuccuugaaguaga

SEQ ID NO: 520716 - RNA, 19 nt, Homo sapiens
aaaguauuccaacgugaua

SEQ ID NO: 520717 - RNA, 19 nt, Homo sapiens
aagccaccauuaaugaauu

SEQ ID NO: 520718 - RNA, 19 nt, Homo sapiens
ccaucugcgugacaauaaa

SEQ ID NO: 520719 - RNA, 19 nt, Homo sapiens
ccaacgugauauuccuuga

SEQ ID NO: 520720 - RNA, 19 nt, Homo sapiens
aaugaucaacccuuucuuu

SEQ ID NO: 520721 - RNA, 19 nt, Homo sapiens
caagacugcuuuucaggaa

SEQ ID NO: 520722 - RNA, 19 nt, Homo sapiens
augaagacauaaccaguug

SEQ ID NO: 520723 - RNA, 19 nt, Homo sapiens
gaaaacauaaccagccauu

SEQ ID NO: 520724 - RNA, 19 nt, Homo sapiens
gccaucugcgugacaauaa

SEQ ID NO: 520725 - RNA, 19 nt, Homo sapiens
ugaaguagauguggaugac

SEQ ID NO: 520726 - RNA, 19 nt, Homo sapiens
caacgugauauuccuugaa

SEQ ID NO: 520727 - RNA, 19 nt, Homo sapiens
ggugauaaacuuguaguag

SEQ ID NO: 520728 - RNA, 19 nt, Homo sapiens
cauaaccaguugccaucug

SEQ ID NO: 520729 - RNA, 19 nt, Homo sapiens
uugaagccaccauuaauga

SEQ ID NO: 520730 - RNA, 19 nt, Homo sapiens
gcacgccaacauuccaguu

SEQ ID NO: 520731 - RNA, 19 nt, Homo sapiens
ugcgugacaauaaacauua

SEQ ID NO: 520732 - RNA, 19 nt, Homo sapiens
ugaagccaccauuaaugaa

SEQ ID NO: 520733 - RNA, 19 nt, Homo sapiens
ugaucaacccuuucuuuca

SEQ ID NO: 520734 - RNA, 19 nt, Homo sapiens
aagcagaucgagagcaaga

SEQ ID NO: 520735 - RNA, 19 nt, Homo sapiens
ucaacccuuucuuucauuc

SEQ ID NO: 520736 - RNA, 19 nt, Homo sapiens
ugcaggugauaaacuugua

SEQ ID NO: 520737 - RNA, 19 nt, Homo sapiens
gcagaucgagagcaagacu

SEQ ID NO: 520738 - RNA, 19 nt, Homo sapiens
aacgugauauuccuugaag

SEQ ID NO: 520739 - RNA, 19 nt, Homo sapiens
gaacauggcaucaaguuua

SEQ ID NO: 520740 - RNA, 19 nt, Homo sapiens
gauagaagcuguacagaau

SEQ ID NO: 520741 - RNA, 19 nt, Homo sapiens
gcaagacucucgaaauuau

SEQ ID NO: 520742 - RNA, 19 nt, Homo sapiens
gaagggaaauggcuacuug

SEQ ID NO: 520743 - RNA, 19 nt, Homo sapiens
gaucaacucuagccaaauu

SEQ ID NO: 520744 - RNA, 19 nt, Homo sapiens
gaaauggacuguucuuuac

SEQ ID NO: 520745 - RNA, 19 nt, Homo sapiens
gcagaaguguuuaugcuuu

SEQ ID NO: 520746 - RNA, 19 nt, Homo sapiens
guacauaucuuucugucuu

SEQ ID NO: 520747 - RNA, 19 nt, Homo sapiens
acacaaagcuucagcaugu

SEQ ID NO: 520748 - RNA, 19 nt, Homo sapiens
gaacggcccugaagaucuu

SEQ ID NO: 520749 - RNA, 19 nt, Homo sapiens
gauaggaguuggugaauag

SEQ ID NO: 520750 - RNA, 19 nt, Homo sapiens
ggaaaucauugaaggagaa

SEQ ID NO: 520751 - RNA, 19 nt, Homo sapiens
ccaccagucucugaaauua

SEQ ID NO: 520752 - RNA, 19 nt, Homo sapiens
ggagaaagcuguggagaag

SEQ ID NO: 520753 - RNA, 19 nt, Homo sapiens
ugaaauggacuguucuuua

SEQ ID NO: 520754 - RNA, 19 nt, Homo sapiens
gggcaucccuggugacaaa

SEQ ID NO: 520755 - RNA, 19 nt, Homo sapiens
ggagugcgcuggauuucuu

SEQ ID NO: 520756 - RNA, 19 nt, Homo sapiens
ggauuaaggcaacaaauaa

SEQ ID NO: 520757 - RNA, 19 nt, Homo sapiens
ggaagaacauggcaucaag

SEQ ID NO: 520758 - RNA, 19 nt, Homo sapiens
gcuacaugauggaugauua

SEQ ID NO: 520759 - RNA, 19 nt, Homo sapiens
gaacuguccugcagcugaa

SEQ ID NO: 520760 - RNA, 19 nt, Homo sapiens
cacauuggcucuuugaauu

SEQ ID NO: 520761 - RNA, 19 nt, Homo sapiens
uaagcaagcugagaucauu

SEQ ID NO: 520762 - RNA, 19 nt, Homo sapiens
ggauaggaguuggugaaua

SEQ ID NO: 520763 - RNA, 19 nt, Homo sapiens
gaccuuuccuuguggauuu

SEQ ID NO: 520764 - RNA, 19 nt, Homo sapiens
gcgaucaacucuagccaaa

SEQ ID NO: 520765 - RNA, 19 nt, Homo sapiens
gucaagagauaacaacaaa

SEQ ID NO: 520766 - RNA, 19 nt, Homo sapiens
gcagagguauucacaacau

SEQ ID NO: 520767 - RNA, 19 nt, Homo sapiens
uggaacaacugucaaauca

SEQ ID NO: 520768 - RNA, 19 nt, Homo sapiens
caagagauaacaacaaaug

SEQ ID NO: 520769 - RNA, 19 nt, Homo sapiens
cugcaagacucucgaaauu

SEQ ID NO: 520770 - RNA, 19 nt, Homo sapiens
gagaaacaguacauaucuu

SEQ ID NO: 520771 - RNA, 19 nt, Homo sapiens
agaaagcuguggagaaguu

SEQ ID NO: 520772 - RNA, 19 nt, Homo sapiens
ugaaagaccacguuacuug

SEQ ID NO: 520773 - RNA, 19 nt, Homo sapiens
uaaagacaaugaacguguu

SEQ ID NO: 520774 - RNA, 19 nt, Homo sapiens
guagcucaguccaccaaua

SEQ ID NO: 520775 - RNA, 19 nt, Homo sapiens
agacaguucguaccaauua

SEQ ID NO: 520776 - RNA, 19 nt, Homo sapiens
ggaggaacaugugugaaug

SEQ ID NO: 520777 - RNA, 19 nt, Homo sapiens
aaggaacgcucucggaauu

SEQ ID NO: 520778 - RNA, 19 nt, Homo sapiens
gguauuaaugccucaguua

SEQ ID NO: 520779 - RNA, 19 nt, Homo sapiens
agacauacauuaguaggaa

SEQ ID NO: 520780 - RNA, 19 nt, Homo sapiens
gagauaaucaggccuaauc

SEQ ID NO: 520781 - RNA, 19 nt, Homo sapiens
cagcugaaauggacuguuc

SEQ ID NO: 520782 - RNA, 19 nt, Homo sapiens
ggguaucuauuucuuucua

SEQ ID NO: 520783 - RNA, 19 nt, Homo sapiens
gacauuggguaucuauuuc

SEQ ID NO: 520784 - RNA, 19 nt, Homo sapiens
ugacauuggguaucuauuu

SEQ ID NO: 520785 - RNA, 19 nt, Homo sapiens
ggacauggccaacaaaauu

SEQ ID NO: 520786 - RNA, 19 nt, Homo sapiens
ggagaaacaguacauaucu

SEQ ID NO: 520787 - RNA, 19 nt, Homo sapiens
gcaucaaguuuauaagaca

SEQ ID NO: 520788 - RNA, 19 nt, Homo sapiens
gacaaagaauacugcauca

SEQ ID NO: 520789 - RNA, 19 nt, Homo sapiens
ggcauuugguaguauagua

SEQ ID NO: 520790 - RNA, 19 nt, Homo sapiens
ggcgauauauuggaggaua

SEQ ID NO: 520791 - RNA, 19 nt, Homo sapiens
uaagacaguucguaccaau

SEQ ID NO: 520792 - RNA, 19 nt, Homo sapiens
gguaagacccugguuguug

SEQ ID NO: 520793 - RNA, 19 nt, Homo sapiens
aagcugagaucauuugcaa

SEQ ID NO: 520794 - RNA, 19 nt, Homo sapiens
guaugauucucaccauuau

SEQ ID NO: 520795 - RNA, 19 nt, Homo sapiens
caucugcgaucaacucuag

SEQ ID NO: 520796 - RNA, 19 nt, Homo sapiens
gcgauauauuggaggauaa

SEQ ID NO: 520797 - RNA, 19 nt, Homo sapiens
gcaguuucuucucucauau

SEQ ID NO: 520798 - RNA, 19 nt, Homo sapiens
caaaucaguuuuagcauga

SEQ ID NO: 520799 - RNA, 19 nt, Homo sapiens
ucauuuggcuguguaaaga

SEQ ID NO: 520800 - RNA, 19 nt, Homo sapiens
ggaagaaaauauugagguu

SEQ ID NO: 520801 - RNA, 19 nt, Homo sapiens
gaaugcuuaugggcaauuu

SEQ ID NO: 520802 - RNA, 19 nt, Homo sapiens
uaaggaggcagcccaauau

SEQ ID NO: 520803 - RNA, 19 nt, Homo sapiens
ugaggcaguugaccauauu

SEQ ID NO: 520804 - RNA, 19 nt, Homo sapiens
uuuaaggucuguuuaggaa

SEQ ID NO: 520805 - RNA, 19 nt, Homo sapiens
gcucagcaguuucuucucu

SEQ ID NO: 520806 - RNA, 19 nt, Homo sapiens
aaaccgaucugcccguugu

SEQ ID NO: 520807 - RNA, 19 nt, Homo sapiens
cuaaggaggcagcccaaua

SEQ ID NO: 520808 - RNA, 19 nt, Homo sapiens
cagaaguguuuaugcuuug

SEQ ID NO: 520809 - RNA, 19 nt, Homo sapiens
gguaggcggugauggaaca

SEQ ID NO: 520810 - RNA, 19 nt, Homo sapiens
ccacuguauuuacuccuuu

SEQ ID NO: 520811 - RNA, 19 nt, Homo sapiens
gacaguucguaccaauuaa

SEQ ID NO: 520812 - RNA, 19 nt, Homo sapiens
agaaucacauuggcucuuu

SEQ ID NO: 520813 - RNA, 19 nt, Homo sapiens
uagaagcuguacagaauca

SEQ ID NO: 520814 - RNA, 19 nt, Homo sapiens
aaucaggccuaaucauguu

SEQ ID NO: 520815 - RNA, 19 nt, Homo sapiens
ucaguuauguguuugucaa

SEQ ID NO: 520816 - RNA, 19 nt, Homo sapiens
gguuuaccauaguuacuuu

SEQ ID NO: 520817 - RNA, 19 nt, Homo sapiens
gaaagucgaggagacaguu

SEQ ID NO: 520818 - RNA, 19 nt, Homo sapiens
gcaagucauggcuagagua

SEQ ID NO: 520819 - RNA, 19 nt, Homo sapiens
ggacaagcccugcaagacu

SEQ ID NO: 520820 - RNA, 19 nt, Homo sapiens
ggacagcacaauuggaauc

SEQ ID NO: 520821 - RNA, 19 nt, Homo sapiens
acgauuccgucaagagaua

SEQ ID NO: 520822 - RNA, 19 nt, Homo sapiens
gugaacacauggaagaaca

SEQ ID NO: 520823 - RNA, 19 nt, Homo sapiens
caaaauuggugaacacaug

SEQ ID NO: 520824 - RNA, 19 nt, Homo sapiens
gaaucacauuggcucuuug

SEQ ID NO: 520825 - RNA, 19 nt, Homo sapiens
ggaguggaauguucuaucc

SEQ ID NO: 520826 - RNA, 19 nt, Homo sapiens
caucucauuuggcugugua

SEQ ID NO: 520827 - RNA, 19 nt, Homo sapiens
gcgcucaaauguggacuga

SEQ ID NO: 520828 - RNA, 19 nt, Homo sapiens
gaauguggguugcauaccu

SEQ ID NO: 520829 - RNA, 19 nt, Homo sapiens
gagaauauaauacggugau

SEQ ID NO: 520830 - RNA, 19 nt, Homo sapiens
guuagguccauucuucuua

SEQ ID NO: 520831 - RNA, 19 nt, Homo sapiens
gaguagcucugcgggagaa

SEQ ID NO: 520832 - RNA, 19 nt, Homo sapiens
gaaauuauggauggaaagu

SEQ ID NO: 520833 - RNA, 19 nt, Homo sapiens
gauucuguauuuacccauu

SEQ ID NO: 520834 - RNA, 19 nt, Homo sapiens
guuauguguuugucaaugu

SEQ ID NO: 520835 - RNA, 19 nt, Homo sapiens
gcuuaugauuuagcuguuu

SEQ ID NO: 520836 - RNA, 19 nt, Homo sapiens
gacauacauuaguaggaaa

SEQ ID NO: 520837 - RNA, 19 nt, Homo sapiens
ggaacgcucucggaauugg

SEQ ID NO: 520838 - RNA, 19 nt, Homo sapiens
ccaaauccaaggcgaaguu

SEQ ID NO: 520839 - RNA, 19 nt, Homo sapiens
gaaauuccuugagcucaua

SEQ ID NO: 520840 - RNA, 19 nt, Homo sapiens
gcacuaauccagcccuuaa

SEQ ID NO: 520841 - RNA, 19 nt, Homo sapiens
gcacaaggaccaacgugua

SEQ ID NO: 520842 - RNA, 19 nt, Homo sapiens
gaggagauccaccacuuua

SEQ ID NO: 520843 - RNA, 19 nt, Homo sapiens
cagagugccugaaggagua

SEQ ID NO: 520844 - RNA, 19 nt, Homo sapiens
gccagugucugaccuauga

SEQ ID NO: 520845 - RNA, 19 nt, Homo sapiens
ggucugugcugaaugugua

SEQ ID NO: 520846 - RNA, 19 nt, Homo sapiens
aaacugaggcccagaauug

SEQ ID NO: 520847 - RNA, 19 nt, Homo sapiens
gcauccacauugcacauaa

SEQ ID NO: 520848 - RNA, 19 nt, Homo sapiens
gcugacgucuugacuguga

SEQ ID NO: 520849 - RNA, 19 nt, Homo sapiens
gcacauaaaguugguauca

SEQ ID NO: 520850 - RNA, 19 nt, Homo sapiens
caagccugaugcuauauuu

SEQ ID NO: 520851 - RNA, 19 nt, Homo sapiens
gcaacgugcugcuggacaa

SEQ ID NO: 520852 - RNA, 19 nt, Homo sapiens
ccacauugcacauaaaguu

SEQ ID NO: 520853 - RNA, 19 nt, Homo sapiens
ccacaagcgcuauuugaaa

SEQ ID NO: 520854 - RNA, 19 nt, Homo sapiens
cuaaguggcuugcuugagu

SEQ ID NO: 520855 - RNA, 19 nt, Homo sapiens
ccaccucugugaacuuauu

SEQ ID NO: 520856 - RNA, 19 nt, Homo sapiens
ugaagacaguccaugagaa

SEQ ID NO: 520857 - RNA, 19 nt, Homo sapiens
gcaccgccauggacaagug

SEQ ID NO: 520858 - RNA, 19 nt, Homo sapiens
ucagcuaccuggagaacaa

SEQ ID NO: 520859 - RNA, 19 nt, Homo sapiens
ucaaauaccuagccacacu

SEQ ID NO: 520860 - RNA, 19 nt, Homo sapiens
gcuggaagcaggagauuga

SEQ ID NO: 520861 - RNA, 19 nt, Homo sapiens
caaucuugcugacgucuug

SEQ ID NO: 520862 - RNA, 19 nt, Homo sapiens
gcccauggcuuggaagaug

SEQ ID NO: 520863 - RNA, 19 nt, Homo sapiens
uggaggagguggccaagaa

SEQ ID NO: 520864 - RNA, 19 nt, Homo sapiens
gaugcaagccugaugcuau

SEQ ID NO: 520865 - RNA, 19 nt, Homo sapiens
gaagacaguccaugagaag

SEQ ID NO: 520866 - RNA, 19 nt, Homo sapiens
uguaauaugcggaacuaua

SEQ ID NO: 520867 - RNA, 19 nt, Homo sapiens
gccgugagccuaaccauga

SEQ ID NO: 520868 - RNA, 19 nt, Homo sapiens
gaagucugcauccacauug

SEQ ID NO: 520869 - RNA, 19 nt, Homo sapiens
ggaagucugcauccacauu

SEQ ID NO: 520870 - RNA, 19 nt, Homo sapiens
gaaacugaggcccagaauu

SEQ ID NO: 520871 - RNA, 19 nt, Homo sapiens
gcggaacuauauugaaaca

SEQ ID NO: 520872 - RNA, 19 nt, Homo sapiens
caaaccacauccuagagau

SEQ ID NO: 520873 - RNA, 19 nt, Homo sapiens
ucacccagcugucccacuu

SEQ ID NO: 520874 - RNA, 19 nt, Homo sapiens
gcagggcaagcaugaguuu

SEQ ID NO: 520875 - RNA, 19 nt, Homo sapiens
augcaagccugaugcuaua

SEQ ID NO: 520876 - RNA, 19 nt, Homo sapiens
acgagcacaucaucaagua

SEQ ID NO: 520877 - RNA, 19 nt, Homo sapiens
ggaggagauccaccacuuu

SEQ ID NO: 520878 - RNA, 19 nt, Homo sapiens
agcaugaguuugugaauga

SEQ ID NO: 520879 - RNA, 19 nt, Homo sapiens
gaaggaguauaaguucuac

SEQ ID NO: 520880 - RNA, 19 nt, Homo sapiens
ugaaggaguauaaguucua

SEQ ID NO: 520881 - RNA, 19 nt, Homo sapiens
gagauccaccacuuuaaga

SEQ ID NO: 520882 - RNA, 19 nt, Homo sapiens
uaaguggcuugcuugaguu

SEQ ID NO: 520883 - RNA, 19 nt, Homo sapiens
agacaguccaugagaagua

SEQ ID NO: 520884 - RNA, 19 nt, Homo sapiens
gagaaccucauacccauuc

SEQ ID NO: 520885 - RNA, 19 nt, Homo sapiens
cgaaauuccuugagcucau

SEQ ID NO: 520886 - RNA, 19 nt, Homo sapiens
gaagcaggagauugacauu

SEQ ID NO: 520887 - RNA, 19 nt, Homo sapiens
caaggaccaacguguauga

SEQ ID NO: 520888 - RNA, 19 nt, Homo sapiens
aggaggaggugaacaagga

SEQ ID NO: 520889 - RNA, 19 nt, Homo sapiens
agauggucauggucaaaua

SEQ ID NO: 520890 - RNA, 19 nt, Homo sapiens
augcggaacuauauugaaa

SEQ ID NO: 520891 - RNA, 19 nt, Homo sapiens
ggagauccaccacuuuaag

SEQ ID NO: 520892 - RNA, 19 nt, Homo sapiens
gcaagccugaugcuauauu

SEQ ID NO: 520893 - RNA, 19 nt, Homo sapiens
ggagacagaggcguccuuu

SEQ ID NO: 520894 - RNA, 19 nt, Homo sapiens
gagcacaucaucaaguaca

SEQ ID NO: 520895 - RNA, 19 nt, Homo sapiens
gcaggagauugacauucug

SEQ ID NO: 520896 - RNA, 19 nt, Homo sapiens
ugaaugacguggcaucacu

SEQ ID NO: 520897 - RNA, 19 nt, Homo sapiens
gcaagcaugaguuugugaa

SEQ ID NO: 520898 - RNA, 19 nt, Homo sapiens
cgucggaccuacuacuuuc

SEQ ID NO: 520899 - RNA, 19 nt, Homo sapiens
caacccagaggccaucauu

SEQ ID NO: 520900 - RNA, 19 nt, Homo sapiens
ggucauggucaaauaccua

SEQ ID NO: 520901 - RNA, 19 nt, Homo sapiens
cauccacauugcacauaaa

SEQ ID NO: 520902 - RNA, 19 nt, Homo sapiens
gcgagggcauggccuaucu

SEQ ID NO: 520903 - RNA, 19 nt, Homo sapiens
cgagacagccagccucaug

SEQ ID NO: 520904 - RNA, 19 nt, Homo sapiens
ccaaaccacauccuagaga

SEQ ID NO: 520905 - RNA, 19 nt, Homo sapiens
ccugugaggucuaucaucu

SEQ ID NO: 520906 - RNA, 19 nt, Homo sapiens
cacaagcgcuauuugaaaa

SEQ ID NO: 520907 - RNA, 19 nt, Homo sapiens
gggcaagcaugaguuugug

SEQ ID NO: 520908 - RNA, 19 nt, Homo sapiens
gagggacccaacauuugua

SEQ ID NO: 520909 - RNA, 19 nt, Homo sapiens
gagccuaaccaugaucuug

SEQ ID NO: 520910 - RNA, 19 nt, Homo sapiens
gagacagccagccucauga

SEQ ID NO: 520911 - RNA, 19 nt, Homo sapiens
ccaaggcucacaaggcauu

SEQ ID NO: 520912 - RNA, 19 nt, Homo sapiens
uguguaauaugcggaacua

SEQ ID NO: 520913 - RNA, 19 nt, Homo sapiens
gaagaacugcugggagaca

SEQ ID NO: 520914 - RNA, 19 nt, Homo sapiens
cuacauccaccgagaccua

SEQ ID NO: 520915 - RNA, 19 nt, Homo sapiens
ggaagcaggagauugacau

SEQ ID NO: 520916 - RNA, 19 nt, Homo sapiens
gcgagaugguggcggugaa

SEQ ID NO: 520917 - RNA, 19 nt, Homo sapiens
ggacggccuguaccucauu

SEQ ID NO: 520918 - RNA, 19 nt, Homo sapiens
gcagauggucauggucaaa

SEQ ID NO: 520919 - RNA, 19 nt, Homo sapiens
gagcagggcaagcaugagu

SEQ ID NO: 520920 - RNA, 19 nt, Homo sapiens
ccuccaaucucaucaucau

SEQ ID NO: 520921 - RNA, 19 nt, Homo sapiens
gauccaccacuuuaagaau

SEQ ID NO: 520922 - RNA, 19 nt, Homo sapiens
aggaggagauccaccacuu

SEQ ID NO: 520923 - RNA, 19 nt, Homo sapiens
ccgaaggccacgaguacua

SEQ ID NO: 520924 - RNA, 19 nt, Homo sapiens
gcuacgauccgaccaacga

SEQ ID NO: 520925 - RNA, 19 nt, Homo sapiens
aagcaugaguuugugaaug

SEQ ID NO: 520926 - RNA, 19 nt, Homo sapiens
acauaaaguugguaucacu

SEQ ID NO: 520927 - RNA, 19 nt, Homo sapiens
ggaaacugaggcccagaau

SEQ ID NO: 520928 - RNA, 19 nt, Homo sapiens
gcuugcggcuccgaaaguu

SEQ ID NO: 520929 - RNA, 19 nt, Homo sapiens
cuugagggacccaacauuu

SEQ ID NO: 520930 - RNA, 19 nt, Homo sapiens
ggcccagaauugcuaagug

SEQ ID NO: 520931 - RNA, 19 nt, Homo sapiens
uagaggaggaggugaacaa

SEQ ID NO: 520932 - RNA, 19 nt, Homo sapiens
ugagggacccaacauuugu

SEQ ID NO: 520933 - RNA, 19 nt, Homo sapiens
gaaacauuacaaccaucuu

SEQ ID NO: 520934 - RNA, 19 nt, Homo sapiens
gaccuacuacuuuccacaa

SEQ ID NO: 520935 - RNA, 19 nt, Homo sapiens
cacaaggaccaacguguau

SEQ ID NO: 520936 - RNA, 19 nt, Homo sapiens
ggaccucccuuuuccagau

SEQ ID NO: 520937 - RNA, 19 nt, Homo sapiens
gaggagguggccaagaaga

SEQ ID NO: 520938 - RNA, 19 nt, Homo sapiens
ccucauacccauucugaag

SEQ ID NO: 520939 - RNA, 19 nt, Homo sapiens
gaagccaggugacuuuaua

SEQ ID NO: 520940 - RNA, 19 nt, Homo sapiens
aaagaagguuggugaauuu

SEQ ID NO: 520941 - RNA, 19 nt, Homo sapiens
uaaagaagguuggugaauu

SEQ ID NO: 520942 - RNA, 19 nt, Homo sapiens
ugaaauguaugugcucuua

SEQ ID NO: 520943 - RNA, 19 nt, Homo sapiens
gcuauucccucaaaucuga

SEQ ID NO: 520944 - RNA, 19 nt, Homo sapiens
aaauggaaauggcuguuua

SEQ ID NO: 520945 - RNA, 19 nt, Homo sapiens
gcacauauuuaccugaauc

SEQ ID NO: 520946 - RNA, 19 nt, Homo sapiens
ccaguucuuuccauaauaa

SEQ ID NO: 520947 - RNA, 19 nt, Homo sapiens
guaacaccaucgaucauga

SEQ ID NO: 520948 - RNA, 19 nt, Homo sapiens
caauggaucccgagacuuu

SEQ ID NO: 520949 - RNA, 19 nt, Homo sapiens
acagagauauggaaucaga

SEQ ID NO: 520950 - RNA, 19 nt, Homo sapiens
ggacuugggcccaguuuau

SEQ ID NO: 520951 - RNA, 19 nt, Homo sapiens
ccaaacguguguucuggaa

SEQ ID NO: 520952 - RNA, 19 nt, Homo sapiens
cacaagcuauucccucaaa

SEQ ID NO: 520953 - RNA, 19 nt, Homo sapiens
ccaggugacuuuauacaca

SEQ ID NO: 520954 - RNA, 19 nt, Homo sapiens
ugaggagaaugaaauguau

SEQ ID NO: 520955 - RNA, 19 nt, Homo sapiens
ugacaaugcugagguuaug

SEQ ID NO: 520956 - RNA, 19 nt, Homo sapiens
gccaguucuuuccauaaua

SEQ ID NO: 520957 - RNA, 19 nt, Homo sapiens
cgugaccuaucaguuauua

SEQ ID NO: 520958 - RNA, 19 nt, Homo sapiens
gugaggagaaugaaaugua

SEQ ID NO: 520959 - RNA, 19 nt, Homo sapiens
gaacaaagugaggagaaug

SEQ ID NO: 520960 - RNA, 19 nt, Homo sapiens
auacagagauauggaauca

SEQ ID NO: 520961 - RNA, 19 nt, Homo sapiens
gaggguaucugacaaugcu

SEQ ID NO: 520962 - RNA, 19 nt, Homo sapiens
guccgugaccuaucaguua

SEQ ID NO: 520963 - RNA, 19 nt, Homo sapiens
ccaaagcucaggauucuuc

SEQ ID NO: 520964 - RNA, 19 nt, Homo sapiens
ucacaucgagccacugaaa

SEQ ID NO: 520965 - RNA, 19 nt, Homo sapiens
gcuacagccugagagauga

SEQ ID NO: 520966 - RNA, 19 nt, Homo sapiens
gacagaagaaucaucaugu

SEQ ID NO: 520967 - RNA, 19 nt, Homo sapiens
gcacaucacgggccugaag

SEQ ID NO: 520968 - RNA, 19 nt, Homo sapiens
ccagagaucgggagacaug

SEQ ID NO: 520969 - RNA, 19 nt, Homo sapiens
ccacguacuuauaaagaag

SEQ ID NO: 520970 - RNA, 19 nt, Homo sapiens
ucaaucccacguacuuaua

SEQ ID NO: 520971 - RNA, 19 nt, Homo sapiens
gaaggauauugucagucuu

SEQ ID NO: 520972 - RNA, 19 nt, Homo sapiens
uuugggagaugcacauauu

SEQ ID NO: 520973 - RNA, 19 nt, Homo sapiens
acagaagaaucaucaugug

SEQ ID NO: 520974 - RNA, 19 nt, Homo sapiens
gauguagagugugguuaug

SEQ ID NO: 520975 - RNA, 19 nt, Homo sapiens
ugggagaugcacauauuua

SEQ ID NO: 520976 - RNA, 19 nt, Homo sapiens
caaagugaggagaaugaaa

SEQ ID NO: 520977 - RNA, 19 nt, Homo sapiens
aaccaacccugacgacaga

SEQ ID NO: 520978 - RNA, 19 nt, Homo sapiens
gaauacagagauauggaau

SEQ ID NO: 520979 - RNA, 19 nt, Homo sapiens
aaagugaggagaaugaaau

SEQ ID NO: 520980 - RNA, 19 nt, Homo sapiens
gagguuaugaacaaaguga

SEQ ID NO: 520981 - RNA, 19 nt, Homo sapiens
augcugagguuaugaacaa

SEQ ID NO: 520982 - RNA, 19 nt, Homo sapiens
ucuauguggugaacaguga

SEQ ID NO: 520983 - RNA, 19 nt, Homo sapiens
cgacagaagaaucaucaug

SEQ ID NO: 520984 - RNA, 19 nt, Homo sapiens
gagugugguuaugaacuuu

SEQ ID NO: 520985 - RNA, 19 nt, Homo sapiens
ugaauucccucugcugaca

SEQ ID NO: 520986 - RNA, 19 nt, Homo sapiens
guacaugauugcgcacauc

SEQ ID NO: 520987 - RNA, 19 nt, Homo sapiens
gaccaacugcaaagaguga

SEQ ID NO: 520988 - RNA, 19 nt, Homo sapiens
agagugugguuaugaacuu

SEQ ID NO: 520989 - RNA, 19 nt, Homo sapiens
uguagagugugguuaugaa

SEQ ID NO: 520990 - RNA, 19 nt, Homo sapiens
ugaacaaagugaggagaau

SEQ ID NO: 520991 - RNA, 19 nt, Homo sapiens
aaagagugauugacaccau

SEQ ID NO: 520992 - RNA, 19 nt, Homo sapiens
caaucccacguacuuauaa

SEQ ID NO: 520993 - RNA, 19 nt, Homo sapiens
aaucugggaugccaaugga

SEQ ID NO: 520994 - RNA, 19 nt, Homo sapiens
gauccacaaaugcuaaaga

SEQ ID NO: 520995 - RNA, 19 nt, Homo sapiens
uguuuagggugcuuucaaa

SEQ ID NO: 520996 - RNA, 19 nt, Homo sapiens
gccaauggaucccgagacu

SEQ ID NO: 520997 - RNA, 19 nt, Homo sapiens
ugaguaacaccaucgauca

SEQ ID NO: 520998 - RNA, 19 nt, Homo sapiens
caaccaaacguguguucug

SEQ ID NO: 520999 - RNA, 19 nt, Homo sapiens
gacgacagaagaaucauca

SEQ ID NO: 521000 - RNA, 19 nt, Homo sapiens
ucacugaggguaucugaca

SEQ ID NO: 521001 - RNA, 19 nt, Homo sapiens
gauauugucagucuuuagg

SEQ ID NO: 521002 - RNA, 19 nt, Homo sapiens
gcucaggauucuucgaaaa

SEQ ID NO: 521003 - RNA, 19 nt, Homo sapiens
ucccaaagcucaggauucu

SEQ ID NO: 521004 - RNA, 19 nt, Homo sapiens
gcgagaacccagaccuuuc

SEQ ID NO: 521005 - RNA, 19 nt, Homo sapiens
gugacuuuauacacacuuu

SEQ ID NO: 521006 - RNA, 19 nt, Homo sapiens
caacugcaaagagugauug

SEQ ID NO: 521007 - RNA, 19 nt, Homo sapiens
aauccgcauccaacuauua

SEQ ID NO: 521008 - RNA, 19 nt, Homo sapiens
acaauccgcauccaacuau

SEQ ID NO: 521009 - RNA, 19 nt, Homo sapiens
uaccagagaucgggagaca

SEQ ID NO: 521010 - RNA, 19 nt, Homo sapiens
gccaugcccucugccaguu

SEQ ID NO: 521011 - RNA, 19 nt, Homo sapiens
ugagggagcugaguaacac

SEQ ID NO: 521012 - RNA, 19 nt, Homo sapiens
caagcuauucccucaaauc

SEQ ID NO: 521013 - RNA, 19 nt, Homo sapiens
cccacguacuuauaaagaa

SEQ ID NO: 521014 - RNA, 19 nt, Homo sapiens
uaucaagggauccacaaau

SEQ ID NO: 521015 - RNA, 19 nt, Homo sapiens
aucaagggauccacaaaug

SEQ ID NO: 521016 - RNA, 19 nt, Homo sapiens
ugccaguucuuuccauaau

SEQ ID NO: 521017 - RNA, 19 nt, Homo sapiens
aaggauauugucagucuuu

SEQ ID NO: 521018 - RNA, 19 nt, Homo sapiens
gcauccaacuauuaaaaug

SEQ ID NO: 521019 - RNA, 19 nt, Homo sapiens
ugagaaaauugaugacuuc

SEQ ID NO: 521020 - RNA, 19 nt, Homo sapiens
aaucccacguacuuauaaa

SEQ ID NO: 521021 - RNA, 19 nt, Homo sapiens
caauccgcauccaacuauu

SEQ ID NO: 521022 - RNA, 19 nt, Homo sapiens
gcccugcucacguacauga

SEQ ID NO: 521023 - RNA, 19 nt, Homo sapiens
gcagaauacagagauaugg

SEQ ID NO: 521024 - RNA, 19 nt, Homo sapiens
gaaauguaugugcucuuag

SEQ ID NO: 521025 - RNA, 19 nt, Homo sapiens
ugugccaguucuuuccaua

SEQ ID NO: 521026 - RNA, 19 nt, Homo sapiens
cauauuuaccugaaucaca

SEQ ID NO: 521027 - RNA, 19 nt, Homo sapiens
cagaauacagagauaugga

SEQ ID NO: 521028 - RNA, 19 nt, Homo sapiens
aaucugagggagcugagua

SEQ ID NO: 521029 - RNA, 19 nt, Homo sapiens
ggcagaauacagagauaug

SEQ ID NO: 521030 - RNA, 19 nt, Homo sapiens
gggcagaauacagagauau

SEQ ID NO: 521031 - RNA, 19 nt, Homo sapiens
ugauguagagugugguuau

SEQ ID NO: 521032 - RNA, 19 nt, Homo sapiens
cgaucaugauguagagugu

SEQ ID NO: 521033 - RNA, 19 nt, Homo sapiens
aaauguaugugcucuuagc

SEQ ID NO: 521034 - RNA, 19 nt, Homo sapiens
aggauauugucagucuuua

SEQ ID NO: 521035 - RNA, 19 nt, Homo sapiens
augcacauauuuaccugaa

SEQ ID NO: 521036 - RNA, 19 nt, Homo sapiens
gggagaugcacauauuuac

SEQ ID NO: 521037 - RNA, 19 nt, Homo sapiens
caucaugugcgcuuggaau

SEQ ID NO: 521038 - RNA, 19 nt, Homo sapiens
agaauacagagauauggaa

SEQ ID NO: 521039 - RNA, 19 nt, Homo sapiens
gauaaucacuguaguagua

SEQ ID NO: 521040 - RNA, 19 nt, Homo sapiens
gaaauacacuggaaggauu

SEQ ID NO: 521041 - RNA, 19 nt, Homo sapiens
ggauaaagcugccaauuuc

SEQ ID NO: 521042 - RNA, 19 nt, Homo sapiens
gaaaggaugcuauuuggua

SEQ ID NO: 521043 - RNA, 19 nt, Homo sapiens
ccaaagaucugggcuauga

SEQ ID NO: 521044 - RNA, 19 nt, Homo sapiens
gaacacaccugucuuuguc

SEQ ID NO: 521045 - RNA, 19 nt, Homo sapiens
ggaccaaacugcacagaga

SEQ ID NO: 521046 - RNA, 19 nt, Homo sapiens
caacagccaucagucuuua

SEQ ID NO: 521047 - RNA, 19 nt, Homo sapiens
gauccuaucuuccuucuuc

SEQ ID NO: 521048 - RNA, 19 nt, Homo sapiens
gaggaacuguuauuuguau

SEQ ID NO: 521049 - RNA, 19 nt, Homo sapiens
gaucugggcuaugacuaua

SEQ ID NO: 521050 - RNA, 19 nt, Homo sapiens
cuaagaaccugauggagaa

SEQ ID NO: 521051 - RNA, 19 nt, Homo sapiens
ucaagaaguuuauccagaa

SEQ ID NO: 521052 - RNA, 19 nt, Homo sapiens
ggucaaaucaucauuaguu

SEQ ID NO: 521053 - RNA, 19 nt, Homo sapiens
ggaugaaagcuuaagauaa

SEQ ID NO: 521054 - RNA, 19 nt, Homo sapiens
gcccauaugucuaaggaaa

SEQ ID NO: 521055 - RNA, 19 nt, Homo sapiens
gaaucugguuccauggaua

SEQ ID NO: 521056 - RNA, 19 nt, Homo sapiens
agaaacaucuucgauuuga

SEQ ID NO: 521057 - RNA, 19 nt, Homo sapiens
gagccugugucuccucuaa

SEQ ID NO: 521058 - RNA, 19 nt, Homo sapiens
uaccacagcuuguaucaga

SEQ ID NO: 521059 - RNA, 19 nt, Homo sapiens
caaggucaaaucaucauua

SEQ ID NO: 521060 - RNA, 19 nt, Homo sapiens
guagaacacaccugucuuu

SEQ ID NO: 521061 - RNA, 19 nt, Homo sapiens
aguaguagcuggaaagaga

SEQ ID NO: 521062 - RNA, 19 nt, Homo sapiens
ggagugguauuauauaggu

SEQ ID NO: 521063 - RNA, 19 nt, Homo sapiens
aaaggaugcuauuugguaa

SEQ ID NO: 521064 - RNA, 19 nt, Homo sapiens
uaacuaccuuaaacccaua

SEQ ID NO: 521065 - RNA, 19 nt, Homo sapiens
gacuauagcuaucuacaag

SEQ ID NO: 521066 - RNA, 19 nt, Homo sapiens
ggaggugggagugguauua

SEQ ID NO: 521067 - RNA, 19 nt, Homo sapiens
caaagcagcaugcacaaug

SEQ ID NO: 521068 - RNA, 19 nt, Homo sapiens
gcagaaaagugugacauuu

SEQ ID NO: 521069 - RNA, 19 nt, Homo sapiens
ggcauagacucuucuuguu

SEQ ID NO: 521070 - RNA, 19 nt, Homo sapiens
ggucaggcauuauuauuac

SEQ ID NO: 521071 - RNA, 19 nt, Homo sapiens
gaacuguuauuuguaugug

SEQ ID NO: 521072 - RNA, 19 nt, Homo sapiens
guaaugaggaacuguuauu

SEQ ID NO: 521073 - RNA, 19 nt, Homo sapiens
gcacaucuauaugaaugga

SEQ ID NO: 521074 - RNA, 19 nt, Homo sapiens
agagguuccugucagaaua

SEQ ID NO: 521075 - RNA, 19 nt, Homo sapiens
gcauagacucuucuuguug

SEQ ID NO: 521076 - RNA, 19 nt, Homo sapiens
ccacaaauccuaacuuacu

SEQ ID NO: 521077 - RNA, 19 nt, Homo sapiens
uugcuuaggucaggcauua

SEQ ID NO: 521078 - RNA, 19 nt, Homo sapiens
ucaaaguaauguccagguu

SEQ ID NO: 521079 - RNA, 19 nt, Homo sapiens
caaacauuguagccucuuu

SEQ ID NO: 521080 - RNA, 19 nt, Homo sapiens
gaccuccgcuggccauuuc

SEQ ID NO: 521081 - RNA, 19 nt, Homo sapiens
uaacuggguuugcuuaggu

SEQ ID NO: 521082 - RNA, 19 nt, Homo sapiens
gacauaaccgggaauccua

SEQ ID NO: 521083 - RNA, 19 nt, Homo sapiens
caacgauccuaucuuccuu

SEQ ID NO: 521084 - RNA, 19 nt, Homo sapiens
gccaagacaugugauaauc

SEQ ID NO: 521085 - RNA, 19 nt, Homo sapiens
gcaauagaguagggccaaa

SEQ ID NO: 521086 - RNA, 19 nt, Homo sapiens
cuacaugguuccuuuuaua

SEQ ID NO: 521087 - RNA, 19 nt, Homo sapiens
gcuauuugguaaugaggaa

SEQ ID NO: 521088 - RNA, 19 nt, Homo sapiens
guaaagaccauuugcaaaa

SEQ ID NO: 521089 - RNA, 19 nt, Homo sapiens
uggauaaagcugccaauuu

SEQ ID NO: 521090 - RNA, 19 nt, Homo sapiens
agaaaucugugacuccaau

SEQ ID NO: 521091 - RNA, 19 nt, Homo sapiens
ccuaagcccauaugucuaa

SEQ ID NO: 521092 - RNA, 19 nt, Homo sapiens
uggcagggcuugugagcuu

SEQ ID NO: 521093 - RNA, 19 nt, Homo sapiens
aauccuacaugguuccuuu

SEQ ID NO: 521094 - RNA, 19 nt, Homo sapiens
gacacuaccucucauuugc

SEQ ID NO: 521095 - RNA, 19 nt, Homo sapiens
aaacauuguagccucuuua

SEQ ID NO: 521096 - RNA, 19 nt, Homo sapiens
uuauaccacuguacagaaa

SEQ ID NO: 521097 - RNA, 19 nt, Homo sapiens
cuauaugaauggaacaaug

SEQ ID NO: 521098 - RNA, 19 nt, Homo sapiens
gcacaaugccuugcacauc

SEQ ID NO: 521099 - RNA, 19 nt, Homo sapiens
gaagcugacaggagaugaa

SEQ ID NO: 521100 - RNA, 19 nt, Homo sapiens
ggaccuauggccaaaugaa

SEQ ID NO: 521101 - RNA, 19 nt, Homo sapiens
acagggaucugccaacgau

SEQ ID NO: 521102 - RNA, 19 nt, Homo sapiens
cacaaugccuugcacaucu

SEQ ID NO: 521103 - RNA, 19 nt, Homo sapiens
ggauuugcuaguccacuua

SEQ ID NO: 521104 - RNA, 19 nt, Homo sapiens
caucauucuucuccucuug

SEQ ID NO: 521105 - RNA, 19 nt, Homo sapiens
gacaggagaugaaaacuuc

SEQ ID NO: 521106 - RNA, 19 nt, Homo sapiens
auaaaaggcuuaggcaaua

SEQ ID NO: 521107 - RNA, 19 nt, Homo sapiens
guaucagagccauuuauaa

SEQ ID NO: 521108 - RNA, 19 nt, Homo sapiens
ucauggagaaagaggauua

SEQ ID NO: 521109 - RNA, 19 nt, Homo sapiens
gucaauggaugcacugcuu

SEQ ID NO: 521110 - RNA, 19 nt, Homo sapiens
gucguggccuuccgucuuu

SEQ ID NO: 521111 - RNA, 19 nt, Homo sapiens
ccacuugggccucaauuuc

SEQ ID NO: 521112 - RNA, 19 nt, Homo sapiens
gaauauccuucuguccaau

SEQ ID NO: 521113 - RNA, 19 nt, Homo sapiens
ccuuaaacccauaaucuuu

SEQ ID NO: 521114 - RNA, 19 nt, Homo sapiens
caagaaguuuauccagaag

SEQ ID NO: 521115 - RNA, 19 nt, Homo sapiens
gaacaaugucccagguaca

SEQ ID NO: 521116 - RNA, 19 nt, Homo sapiens
gaguuugacccaauaugaa

SEQ ID NO: 521117 - RNA, 19 nt, Homo sapiens
agacgacucuuggugagaa

SEQ ID NO: 521118 - RNA, 19 nt, Homo sapiens
augaggaacuguuauuugu

SEQ ID NO: 521119 - RNA, 19 nt, Homo sapiens
ugaccucacucuaacucaa

SEQ ID NO: 521120 - RNA, 19 nt, Homo sapiens
acaaugccuugcacaucua

SEQ ID NO: 521121 - RNA, 19 nt, Homo sapiens
gauugucuguagccgauug

SEQ ID NO: 521122 - RNA, 19 nt, Homo sapiens
uugucuggaugcauuauua

SEQ ID NO: 521123 - RNA, 19 nt, Homo sapiens
ggauucaacuguggaaacu

SEQ ID NO: 521124 - RNA, 19 nt, Homo sapiens
gccugugucuccucuaaga

SEQ ID NO: 521125 - RNA, 19 nt, Homo sapiens
ggugggagugguauuauau

SEQ ID NO: 521126 - RNA, 19 nt, Homo sapiens
cauuguagccucuuuaugg

SEQ ID NO: 521127 - RNA, 19 nt, Homo sapiens
ugaguuugacccaauauga

SEQ ID NO: 521128 - RNA, 19 nt, Homo sapiens
caucagucuuuaugcaaug

SEQ ID NO: 521129 - RNA, 19 nt, Homo sapiens
gaugcauuauuauguguca

SEQ ID NO: 521130 - RNA, 19 nt, Homo sapiens
cgacaucaauauuuaugac

SEQ ID NO: 521131 - RNA, 19 nt, Homo sapiens
gaccuauggccaaaugaaa

SEQ ID NO: 521132 - RNA, 19 nt, Homo sapiens
uguaucagagccauuuaua

SEQ ID NO: 521133 - RNA, 19 nt, Homo sapiens
cauuaaguccuauuuggaa

SEQ ID NO: 521134 - RNA, 19 nt, Homo sapiens
uacauuaaguccuauuugg

SEQ ID NO: 521135 - RNA, 19 nt, Homo sapiens
ugccaacgauccuaucuuc

SEQ ID NO: 521136 - RNA, 19 nt, Homo sapiens
uugcacaucuauaugaaug

SEQ ID NO: 521137 - RNA, 19 nt, Homo sapiens
gaaagaaaagucagucaug

SEQ ID NO: 521138 - RNA, 19 nt, Homo sapiens
ggcagagguuccugucaga

SEQ ID NO: 521139 - RNA, 19 nt, Homo sapiens
gcugaaagcugacaucauu

SEQ ID NO: 521140 - RNA, 19 nt, Homo sapiens
gaaaguggcugugaagaug

SEQ ID NO: 521141 - RNA, 19 nt, Homo sapiens
ccacugagcuggcugacua

SEQ ID NO: 521142 - RNA, 19 nt, Homo sapiens
gagauguccuuguaauauu

SEQ ID NO: 521143 - RNA, 19 nt, Homo sapiens
gaauggaacuggagaacau

SEQ ID NO: 521144 - RNA, 19 nt, Homo sapiens
gguagaaggugugccauuu

SEQ ID NO: 521145 - RNA, 19 nt, Homo sapiens
cgaaagagacggaaagaga

SEQ ID NO: 521146 - RNA, 19 nt, Homo sapiens
acaaaggcaugcuggagua

SEQ ID NO: 521147 - RNA, 19 nt, Homo sapiens
acgcugagauuuacaacua

SEQ ID NO: 521148 - RNA, 19 nt, Homo sapiens
aaagagauguccuuguaau

SEQ ID NO: 521149 - RNA, 19 nt, Homo sapiens
caagcgacauugaagaguu

SEQ ID NO: 521150 - RNA, 19 nt, Homo sapiens
gguuauguuuccaugguua

SEQ ID NO: 521151 - RNA, 19 nt, Homo sapiens
gaaacagccuccggagugu

SEQ ID NO: 521152 - RNA, 19 nt, Homo sapiens
ucaggaacccuucuccaua

SEQ ID NO: 521153 - RNA, 19 nt, Homo sapiens
ggauggcuccuuugugaaa

SEQ ID NO: 521154 - RNA, 19 nt, Homo sapiens
gagaggaacuacgaagauc

SEQ ID NO: 521155 - RNA, 19 nt, Homo sapiens
caaaggcagcugugucuga

SEQ ID NO: 521156 - RNA, 19 nt, Homo sapiens
ggaaagagacgcgguuugg

SEQ ID NO: 521157 - RNA, 19 nt, Homo sapiens
gcagaggacaugacagugu

SEQ ID NO: 521158 - RNA, 19 nt, Homo sapiens
ggagaggaacuacgaagau

SEQ ID NO: 521159 - RNA, 19 nt, Homo sapiens
guauggaggacguguauga

SEQ ID NO: 521160 - RNA, 19 nt, Homo sapiens
gcgaugaacuaaaggaaaa

SEQ ID NO: 521161 - RNA, 19 nt, Homo sapiens
ccgacaaccuguauacugu

SEQ ID NO: 521162 - RNA, 19 nt, Homo sapiens
cagcuugcaugaaggaguu

SEQ ID NO: 521163 - RNA, 19 nt, Homo sapiens
gcuaccaaaucucaaaaua

SEQ ID NO: 521164 - RNA, 19 nt, Homo sapiens
gcagagcaccagccagaga

SEQ ID NO: 521165 - RNA, 19 nt, Homo sapiens
caggaacccuucuccauac

SEQ ID NO: 521166 - RNA, 19 nt, Homo sapiens
gggaaguccuggcuguugu

SEQ ID NO: 521167 - RNA, 19 nt, Homo sapiens
gggcugugguccagaacuu

SEQ ID NO: 521168 - RNA, 19 nt, Homo sapiens
uguauacugugcagaguga

SEQ ID NO: 521169 - RNA, 19 nt, Homo sapiens
gcgcaucgaggccacauug

SEQ ID NO: 521170 - RNA, 19 nt, Homo sapiens
cugcuuaagugcaugcauu

SEQ ID NO: 521171 - RNA, 19 nt, Homo sapiens
ggaacuggagaacaucuug

SEQ ID NO: 521172 - RNA, 19 nt, Homo sapiens
ccaaacugccugucaagug

SEQ ID NO: 521173 - RNA, 19 nt, Homo sapiens
gaaggaguuugaccaucca

SEQ ID NO: 521174 - RNA, 19 nt, Homo sapiens
gaccuuuagugccaacuuc

SEQ ID NO: 521175 - RNA, 19 nt, Homo sapiens
agagauguccuuguaauau

SEQ ID NO: 521176 - RNA, 19 nt, Homo sapiens
gauuuacaacuaccucauu

SEQ ID NO: 521177 - RNA, 19 nt, Homo sapiens
gaccugaucguacgugugu

SEQ ID NO: 521178 - RNA, 19 nt, Homo sapiens
gaccagggccaauuugaca

SEQ ID NO: 521179 - RNA, 19 nt, Homo sapiens
ggaguggggugguuauguu

SEQ ID NO: 521180 - RNA, 19 nt, Homo sapiens
agaccuggcugcucggaau

SEQ ID NO: 521181 - RNA, 19 nt, Homo sapiens
uaccugagcucucggaacu

SEQ ID NO: 521182 - RNA, 19 nt, Homo sapiens
ggagaaccccuuuaaccua

SEQ ID NO: 521183 - RNA, 19 nt, Homo sapiens
gcagcccgguccuucaauc

SEQ ID NO: 521184 - RNA, 19 nt, Homo sapiens
ggcaagccuuugacagugu

SEQ ID NO: 521185 - RNA, 19 nt, Homo sapiens
caguguggcucacgguaga

SEQ ID NO: 521186 - RNA, 19 nt, Homo sapiens
ugagcacgcuaccaaaucu

SEQ ID NO: 521187 - RNA, 19 nt, Homo sapiens
aagagauguccuuguaaua

SEQ ID NO: 521188 - RNA, 19 nt, Homo sapiens
ugaaaguggcugugaagau

SEQ ID NO: 521189 - RNA, 19 nt, Homo sapiens
ggagugggaagaagugauc

SEQ ID NO: 521190 - RNA, 19 nt, Homo sapiens
ccuccaaacugccugucaa

SEQ ID NO: 521191 - RNA, 19 nt, Homo sapiens
acacguggccaaacuuguu

SEQ ID NO: 521192 - RNA, 19 nt, Homo sapiens
gagcugccccugcugcuua

SEQ ID NO: 521193 - RNA, 19 nt, Homo sapiens
uuacuugucugcgaaugga

SEQ ID NO: 521194 - RNA, 19 nt, Homo sapiens
cgaaaacgcugagauuuac

SEQ ID NO: 521195 - RNA, 19 nt, Homo sapiens
acaauggaacccaggauga

SEQ ID NO: 521196 - RNA, 19 nt, Homo sapiens
gggagccucuggaaugcau

SEQ ID NO: 521197 - RNA, 19 nt, Homo sapiens
agauguccuuguaauauuc

SEQ ID NO: 521198 - RNA, 19 nt, Homo sapiens
cccugaaccuguuaccauu

SEQ ID NO: 521199 - RNA, 19 nt, Homo sapiens
gacugucgguacauacuca

SEQ ID NO: 521200 - RNA, 19 nt, Homo sapiens
ccuuauacaucaacaucga

SEQ ID NO: 521201 - RNA, 19 nt, Homo sapiens
gcaucgaggccacauugga

SEQ ID NO: 521202 - RNA, 19 nt, Homo sapiens
guacaguucaggugacaca

SEQ ID NO: 521203 - RNA, 19 nt, Homo sapiens
gugguuauguuuccauggu

SEQ ID NO: 521204 - RNA, 19 nt, Homo sapiens
aggcccagcugaagcaaga

SEQ ID NO: 521205 - RNA, 19 nt, Homo sapiens
gcccucauccugcuucgaa

SEQ ID NO: 521206 - RNA, 19 nt, Homo sapiens
gagcccaacccuucuaaac

SEQ ID NO: 521207 - RNA, 19 nt, Homo sapiens
aaucugagcacgcuaccaa

SEQ ID NO: 521208 - RNA, 19 nt, Homo sapiens
guaagggguugguaucuca

SEQ ID NO: 521209 - RNA, 19 nt, Homo sapiens
gcccagcuauuaccacacu

SEQ ID NO: 521210 - RNA, 19 nt, Homo sapiens
uggaggacguguaugaucu

SEQ ID NO: 521211 - RNA, 19 nt, Homo sapiens
ucgaaaacgcugagauuua

SEQ ID NO: 521212 - RNA, 19 nt, Homo sapiens
ccugagcucucggaacuuc

SEQ ID NO: 521213 - RNA, 19 nt, Homo sapiens
gguggucucuucucaugac

SEQ ID NO: 521214 - RNA, 19 nt, Homo sapiens
ggccagcugucugugcuau

SEQ ID NO: 521215 - RNA, 19 nt, Homo sapiens
cgcccgagcuuuacuuguc

SEQ ID NO: 521216 - RNA, 19 nt, Homo sapiens
cauccugcuucgaaagaga

SEQ ID NO: 521217 - RNA, 19 nt, Homo sapiens
guccuggguucaagacaau

SEQ ID NO: 521218 - RNA, 19 nt, Homo sapiens
uggagagccuggccgacaa

SEQ ID NO: 521219 - RNA, 19 nt, Homo sapiens
aagcgacauugaagaguuc

SEQ ID NO: 521220 - RNA, 19 nt, Homo sapiens
ccgcaggucugaagcucau

SEQ ID NO: 521221 - RNA, 19 nt, Homo sapiens
cugguggucucuucucaug

SEQ ID NO: 521222 - RNA, 19 nt, Homo sapiens
auucaggccucaucuugga

SEQ ID NO: 521223 - RNA, 19 nt, Homo sapiens
gcaccauguuuuccuguga

SEQ ID NO: 521224 - RNA, 19 nt, Homo sapiens
ccagcugucugugcuaucu

SEQ ID NO: 521225 - RNA, 19 nt, Homo sapiens
gaggacguguaugaucuca

SEQ ID NO: 521226 - RNA, 19 nt, Homo sapiens
gggaccagggccaauuuga

SEQ ID NO: 521227 - RNA, 19 nt, Homo sapiens
aaacuguccuggguucaag

SEQ ID NO: 521228 - RNA, 19 nt, Homo sapiens
cuccauacccacaaucuga

SEQ ID NO: 521229 - RNA, 19 nt, Homo sapiens
uggaguacccagccuauca

SEQ ID NO: 521230 - RNA, 19 nt, Homo sapiens
gccgacaaccuguauacug

SEQ ID NO: 521231 - RNA, 19 nt, Homo sapiens
caaacuguccuggguucaa

SEQ ID NO: 521232 - RNA, 19 nt, Homo sapiens
cagccacuguucaccuuca

SEQ ID NO: 521233 - RNA, 19 nt, Homo sapiens
uuagggacauuuccaagcu

SEQ ID NO: 521234 - RNA, 19 nt, Homo sapiens
ccggagaggaguucaggaa

SEQ ID NO: 521235 - RNA, 19 nt, Homo sapiens
aaugagacacagaggcuuu

SEQ ID NO: 521236 - RNA, 19 nt, Homo sapiens
cugaaccuguuaccauugu

SEQ ID NO: 521237 - RNA, 19 nt, Homo sapiens
ccucuucugucccaagucu

SEQ ID NO: 521238 - RNA, 19 nt, Homo sapiens
caagggcuacugccacaca

SEQ ID NO: 521239 - RNA, 19 nt, Homo sapiens
ggaaacagcguaucacuga

SEQ ID NO: 521240 - RNA, 19 nt, Homo sapiens
ccaauacucuccuaaaaua

SEQ ID NO: 521241 - RNA, 19 nt, Homo sapiens
ggucagaggucggaugucu

SEQ ID NO: 521242 - RNA, 19 nt, Homo sapiens
ucauugcccuggccgugua

SEQ ID NO: 521243 - RNA, 19 nt, Homo sapiens
gcccagagcgauugcaguu

SEQ ID NO: 521244 - RNA, 19 nt, Homo sapiens
acagcgaccucaacacaca

SEQ ID NO: 521245 - RNA, 19 nt, Homo sapiens
aaacagcguaucacugaga

SEQ ID NO: 521246 - RNA, 19 nt, Homo sapiens
cuacagcgaccucaacaca

SEQ ID NO: 521247 - RNA, 19 nt, Homo sapiens
gugcugacagugcucauug

SEQ ID NO: 521248 - RNA, 19 nt, Homo sapiens
gagcccgaaucaugacagu

SEQ ID NO: 521249 - RNA, 19 nt, Homo sapiens
gagaccgagucgccuuauc

SEQ ID NO: 521250 - RNA, 19 nt, Homo sapiens
agaccgagucgccuuauca

SEQ ID NO: 521251 - RNA, 19 nt, Homo sapiens
ggauccagccauuccugaa

SEQ ID NO: 521252 - RNA, 19 nt, Homo sapiens
cagagugccaucccugaga

SEQ ID NO: 521253 - RNA, 19 nt, Homo sapiens
uuacaaaugagcccgaauc

SEQ ID NO: 521254 - RNA, 19 nt, Homo sapiens
ccagaccgcuccccaauac

SEQ ID NO: 521255 - RNA, 19 nt, Homo sapiens
cgauacagacccacagagu

SEQ ID NO: 521256 - RNA, 19 nt, Homo sapiens
gagaccuggugcugacagu

SEQ ID NO: 521257 - RNA, 19 nt, Homo sapiens
ccccaauacucuccuaaaa

SEQ ID NO: 521258 - RNA, 19 nt, Homo sapiens
gauccagccauuccugaag

SEQ ID NO: 521259 - RNA, 19 nt, Homo sapiens
ucagaggucggaugucuac

SEQ ID NO: 521260 - RNA, 19 nt, Homo sapiens
gauaguaaauguccacuua

SEQ ID NO: 521261 - RNA, 19 nt, Homo sapiens
gaacuaccaugcuuuguuu

SEQ ID NO: 521262 - RNA, 19 nt, Homo sapiens
caaaugcccuacucucuua

SEQ ID NO: 521263 - RNA, 19 nt, Homo sapiens
gaaacacaguggaagguua

SEQ ID NO: 521264 - RNA, 19 nt, Homo sapiens
ggacuuaaguaaagaagaa

SEQ ID NO: 521265 - RNA, 19 nt, Homo sapiens
gagauacaaugcugauaua

SEQ ID NO: 521266 - RNA, 19 nt, Homo sapiens
gcgcacaacucacccuuua

SEQ ID NO: 521267 - RNA, 19 nt, Homo sapiens
gggauacacuuaugaaauu

SEQ ID NO: 521268 - RNA, 19 nt, Homo sapiens
gaagaucuuuggcaugauu

SEQ ID NO: 521269 - RNA, 19 nt, Homo sapiens
ccaaagaacuguauaaggu

SEQ ID NO: 521270 - RNA, 19 nt, Homo sapiens
cuacuaaugucucuucuaa

SEQ ID NO: 521271 - RNA, 19 nt, Homo sapiens
caauuuggcucaucuauuc

SEQ ID NO: 521272 - RNA, 19 nt, Homo sapiens
acacuaaacuccaugauau

SEQ ID NO: 521273 - RNA, 19 nt, Homo sapiens
ggaagacccuuucagaauc

SEQ ID NO: 521274 - RNA, 19 nt, Homo sapiens
gaaauucaauggccaaguc

SEQ ID NO: 521275 - RNA, 19 nt, Homo sapiens
gaaguugguuuauuugaca

SEQ ID NO: 521276 - RNA, 19 nt, Homo sapiens
gcacaacucacccuuuauu

SEQ ID NO: 521277 - RNA, 19 nt, Homo sapiens
ccuacucucuuaugcauua

SEQ ID NO: 521278 - RNA, 19 nt, Homo sapiens
gugaagaucuuuggcauga

SEQ ID NO: 521279 - RNA, 19 nt, Homo sapiens
gcugauauauccacauuuc

SEQ ID NO: 521280 - RNA, 19 nt, Homo sapiens
caggagaucagaagaaaua

SEQ ID NO: 521281 - RNA, 19 nt, Homo sapiens
ggaacuaccuauccuuaca

SEQ ID NO: 521282 - RNA, 19 nt, Homo sapiens
gauaauugccauagcagua

SEQ ID NO: 521283 - RNA, 19 nt, Homo sapiens
gaaguggauuucucucaug

SEQ ID NO: 521284 - RNA, 19 nt, Homo sapiens
caaucacugugcuuaauuu

SEQ ID NO: 521285 - RNA, 19 nt, Homo sapiens
ggagaaggcauauggagaa

SEQ ID NO: 521286 - RNA, 19 nt, Homo sapiens
ggauauuugucaacagauu

SEQ ID NO: 521287 - RNA, 19 nt, Homo sapiens
caacuuugauuccacucua

SEQ ID NO: 521288 - RNA, 19 nt, Homo sapiens
gaaggcauauggagaacau

SEQ ID NO: 521289 - RNA, 19 nt, Homo sapiens
agaaagacaugcaggaaau

SEQ ID NO: 521290 - RNA, 19 nt, Homo sapiens
gaaaucuucuggacuuaag

SEQ ID NO: 521291 - RNA, 19 nt, Homo sapiens
ucaaugcuaugcugaagaa

SEQ ID NO: 521292 - RNA, 19 nt, Homo sapiens
ggagauacaaugcugauau

SEQ ID NO: 521293 - RNA, 19 nt, Homo sapiens
cuucacagaugcagucuuu

SEQ ID NO: 521294 - RNA, 19 nt, Homo sapiens
uaagugaacuaccaugcuu

SEQ ID NO: 521295 - RNA, 19 nt, Homo sapiens
gggaagacccuuucagaau

SEQ ID NO: 521296 - RNA, 19 nt, Homo sapiens
gcucagugcuuggaaguug

SEQ ID NO: 521297 - RNA, 19 nt, Homo sapiens
gcaacacgccacaauuuga

SEQ ID NO: 521298 - RNA, 19 nt, Homo sapiens
caacucacccuuuauuugu

SEQ ID NO: 521299 - RNA, 19 nt, Homo sapiens
gaagacccuuucagaaucu

SEQ ID NO: 521300 - RNA, 19 nt, Homo sapiens
cuuggaaguugguuuauuu

SEQ ID NO: 521301 - RNA, 19 nt, Homo sapiens
cagaaugagugcuccuaaa

SEQ ID NO: 521302 - RNA, 19 nt, Homo sapiens
gagaaagacaugcaggaaa

SEQ ID NO: 521303 - RNA, 19 nt, Homo sapiens
gacacuaaacuccaugaua

SEQ ID NO: 521304 - RNA, 19 nt, Homo sapiens
acacagaaauguuuguuac

SEQ ID NO: 521305 - RNA, 19 nt, Homo sapiens
gcauauggagaacauguuu

SEQ ID NO: 521306 - RNA, 19 nt, Homo sapiens
gagggaaaaucuucacuuu

SEQ ID NO: 521307 - RNA, 19 nt, Homo sapiens
ggacauaauagacaauaca

SEQ ID NO: 521308 - RNA, 19 nt, Homo sapiens
acuaaugucucuucuaaca

SEQ ID NO: 521309 - RNA, 19 nt, Homo sapiens
gaaugacacuaaacuccau

SEQ ID NO: 521310 - RNA, 19 nt, Homo sapiens
ggagaggagcugccuguga

SEQ ID NO: 521311 - RNA, 19 nt, Homo sapiens
ggaaguugguuuauuugac

SEQ ID NO: 521312 - RNA, 19 nt, Homo sapiens
gugacuccuuggaagauua

SEQ ID NO: 521313 - RNA, 19 nt, Homo sapiens
uaguguaccugagauaauu

SEQ ID NO: 521314 - RNA, 19 nt, Homo sapiens
gaggaugggccaauuagga

SEQ ID NO: 521315 - RNA, 19 nt, Homo sapiens
gcagaaugagugcuccuaa

SEQ ID NO: 521316 - RNA, 19 nt, Homo sapiens
ugagauaauugccauagca

SEQ ID NO: 521317 - RNA, 19 nt, Homo sapiens
ucacagaugcagucuuuga

SEQ ID NO: 521318 - RNA, 19 nt, Homo sapiens
ggagaaagacaugcaggaa

SEQ ID NO: 521319 - RNA, 19 nt, Homo sapiens
ccaccugguugaauauaau

SEQ ID NO: 521320 - RNA, 19 nt, Homo sapiens
cccuugcgcuucuucaaua

SEQ ID NO: 521321 - RNA, 19 nt, Homo sapiens
gaucuugugcuaugaaaca

SEQ ID NO: 521322 - RNA, 19 nt, Homo sapiens
gaagauauaagugaacuac

SEQ ID NO: 521323 - RNA, 19 nt, Homo sapiens
uaaucagucuguggucuaa

SEQ ID NO: 521324 - RNA, 19 nt, Homo sapiens
ccagaggguucucauaguc

SEQ ID NO: 521325 - RNA, 19 nt, Homo sapiens
uguauaagguggucauaag

SEQ ID NO: 521326 - RNA, 19 nt, Homo sapiens
gaccagaggguucucauag

SEQ ID NO: 521327 - RNA, 19 nt, Homo sapiens
gguugaguaugugaagaua

SEQ ID NO: 521328 - RNA, 19 nt, Homo sapiens
auaagguggucauaaguga

SEQ ID NO: 521329 - RNA, 19 nt, Homo sapiens
ugucucuucuaacaucuua

SEQ ID NO: 521330 - RNA, 19 nt, Homo sapiens
guucaaggcuacaacaaaa

SEQ ID NO: 521331 - RNA, 19 nt, Homo sapiens
gcaguauggaugaagcuaa

SEQ ID NO: 521332 - RNA, 19 nt, Homo sapiens
ggauacacuuaugaaauuc

SEQ ID NO: 521333 - RNA, 19 nt, Homo sapiens
cugcacaccuucacagaug

SEQ ID NO: 521334 - RNA, 19 nt, Homo sapiens
gugcuuggaaguugguuua

SEQ ID NO: 521335 - RNA, 19 nt, Homo sapiens
ggaaauguggccagaccaa

SEQ ID NO: 521336 - RNA, 19 nt, Homo sapiens
ucagucuucucuacacaaa

SEQ ID NO: 521337 - RNA, 19 nt, Homo sapiens
gguaggacaggaaagcuuu

SEQ ID NO: 521338 - RNA, 19 nt, Homo sapiens
cuaccuauccuuacauuuc

SEQ ID NO: 521339 - RNA, 19 nt, Homo sapiens
gggacugcuucuuaucuga

SEQ ID NO: 521340 - RNA, 19 nt, Homo sapiens
gcuuggaaguugguuuauu

SEQ ID NO: 521341 - RNA, 19 nt, Homo sapiens
gguucuauaugaaugcuau

SEQ ID NO: 521342 - RNA, 19 nt, Homo sapiens
gagaacauguuuuauacug

SEQ ID NO: 521343 - RNA, 19 nt, Homo sapiens
ggcaugauuuaaagguuga

SEQ ID NO: 521344 - RNA, 19 nt, Homo sapiens
guuacugguugcacucauu

SEQ ID NO: 521345 - RNA, 19 nt, Homo sapiens
acagaaauguuuguuacug

SEQ ID NO: 521346 - RNA, 19 nt, Homo sapiens
gagaucagaagaaauacug

SEQ ID NO: 521347 - RNA, 19 nt, Homo sapiens
augcuaugcugaagaauau

SEQ ID NO: 521348 - RNA, 19 nt, Homo sapiens
cuucuggacuuaaguaaag

SEQ ID NO: 521349 - RNA, 19 nt, Homo sapiens
ccaaucacugugcuuaauu

SEQ ID NO: 521350 - RNA, 19 nt, Homo sapiens
auacaaugcugauauaucc

SEQ ID NO: 521351 - RNA, 19 nt, Homo sapiens
gaaagacaugcaggaaaug

SEQ ID NO: 521352 - RNA, 19 nt, Homo sapiens
uggcaaagcgcacaacuca

SEQ ID NO: 521353 - RNA, 19 nt, Homo sapiens
gaacuaccuauccuuacau

SEQ ID NO: 521354 - RNA, 19 nt, Homo sapiens
ugaacuaccaugcuuuguu

SEQ ID NO: 521355 - RNA, 19 nt, Homo sapiens
agauauaagugaacuacca

SEQ ID NO: 521356 - RNA, 19 nt, Homo sapiens
gaucuuuggcaugauuuaa

SEQ ID NO: 521357 - RNA, 19 nt, Homo sapiens
gcccuacucucuuaugcau

SEQ ID NO: 521358 - RNA, 19 nt, Homo sapiens
guaugacccugcuguucga

SEQ ID NO: 521359 - RNA, 19 nt, Homo sapiens
acaacucacccuuuauuug

SEQ ID NO: 521360 - RNA, 19 nt, Homo sapiens
aaagauggguuucugaaua

SEQ ID NO: 521361 - RNA, 19 nt, Homo sapiens
ggaacacuaugaugaguuu

SEQ ID NO: 521362 - RNA, 19 nt, Homo sapiens
gcuagaaaguguuguaguu

SEQ ID NO: 521363 - RNA, 19 nt, Homo sapiens
caaagucaacuguucauuu

SEQ ID NO: 521364 - RNA, 19 nt, Homo sapiens
ugaaagaucugggcgauuc

SEQ ID NO: 521365 - RNA, 19 nt, Homo sapiens
uuacagaaauggaggagaa

SEQ ID NO: 521366 - RNA, 19 nt, Homo sapiens
gcucucgguugcacaauaa

SEQ ID NO: 521367 - RNA, 19 nt, Homo sapiens
aagauggguuucugaauaa

SEQ ID NO: 521368 - RNA, 19 nt, Homo sapiens
caagaagcauagaucaaga

SEQ ID NO: 521369 - RNA, 19 nt, Homo sapiens
ggugggaaauggcggagua

SEQ ID NO: 521370 - RNA, 19 nt, Homo sapiens
gucgagagaucgugaaaga

SEQ ID NO: 521371 - RNA, 19 nt, Homo sapiens
uagaaaguguuguaguuga

SEQ ID NO: 521372 - RNA, 19 nt, Homo sapiens
gaaagacaaagucaacugu

SEQ ID NO: 521373 - RNA, 19 nt, Homo sapiens
gagcgucguucucggucua

SEQ ID NO: 521374 - RNA, 19 nt, Homo sapiens
gcaagaagcauagaucaag

SEQ ID NO: 521375 - RNA, 19 nt, Homo sapiens
ugaccaaaccaguucauaa

SEQ ID NO: 521376 - RNA, 19 nt, Homo sapiens
gagaugaacgucugugaca

SEQ ID NO: 521377 - RNA, 19 nt, Homo sapiens
ggagaugcaggaacacuau

SEQ ID NO: 521378 - RNA, 19 nt, Homo sapiens
gaccaaaccaguucauaag

SEQ ID NO: 521379 - RNA, 19 nt, Homo sapiens
gaaaguguuguaguugauu

SEQ ID NO: 521380 - RNA, 19 nt, Homo sapiens
ggagaaguauggggaagua

SEQ ID NO: 521381 - RNA, 19 nt, Homo sapiens
cagaaauggaggagaagua

SEQ ID NO: 521382 - RNA, 19 nt, Homo sapiens
ggaaauggcggaguaucug

SEQ ID NO: 521383 - RNA, 19 nt, Homo sapiens
ugaagcccauuuccagaga

SEQ ID NO: 521384 - RNA, 19 nt, Homo sapiens
gaagccugcugccgucagu

SEQ ID NO: 521385 - RNA, 19 nt, Homo sapiens
aagacaaagucaacuguuc

SEQ ID NO: 521386 - RNA, 19 nt, Homo sapiens
uaccuuaugucugcuagaa

SEQ ID NO: 521387 - RNA, 19 nt, Homo sapiens
gcaccgagaaagacaaagu

SEQ ID NO: 521388 - RNA, 19 nt, Homo sapiens
gaaauggaggagaaguaug

SEQ ID NO: 521389 - RNA, 19 nt, Homo sapiens
auacaaagauggguuucug

SEQ ID NO: 521390 - RNA, 19 nt, Homo sapiens
aaaguguuguaguugauug

SEQ ID NO: 521391 - RNA, 19 nt, Homo sapiens
agaaaguguuguaguugau

SEQ ID NO: 521392 - RNA, 19 nt, Homo sapiens
gcaggaacacuaugaugag

SEQ ID NO: 521393 - RNA, 19 nt, Homo sapiens
caaagauggguuucugaau

SEQ ID NO: 521394 - RNA, 19 nt, Homo sapiens
acaaagauggguuucugaa

SEQ ID NO: 521395 - RNA, 19 nt, Homo sapiens
aguaugagaugggagaaug

SEQ ID NO: 521396 - RNA, 19 nt, Homo sapiens
gugauugacuugaauaacc

SEQ ID NO: 521397 - RNA, 19 nt, Homo sapiens
ccuuaugucugcuagaaag

SEQ ID NO: 521398 - RNA, 19 nt, Homo sapiens
cgagaaagacaaagucaac

SEQ ID NO: 521399 - RNA, 19 nt, Homo sapiens
gcugugauugacuugaaua

SEQ ID NO: 521400 - RNA, 19 nt, Homo sapiens
ggaaguagaggagaugaac

SEQ ID NO: 521401 - RNA, 19 nt, Homo sapiens
ggaaaaggcugugauugac

SEQ ID NO: 521402 - RNA, 19 nt, Homo sapiens
guaucuggccuccaucuuc

SEQ ID NO: 521403 - RNA, 19 nt, Homo sapiens
gggaaauggcggaguaucu

SEQ ID NO: 521404 - RNA, 19 nt, Homo sapiens
cgaggcggcuucugcaacu

SEQ ID NO: 521405 - RNA, 19 nt, Homo sapiens
agacaaagucaacuguuca

SEQ ID NO: 521406 - RNA, 19 nt, Homo sapiens
gauccacgccgagcuguca

SEQ ID NO: 521407 - RNA, 19 nt, Homo sapiens
agaaauggaggagaaguau

SEQ ID NO: 521408 - RNA, 19 nt, Homo sapiens
cuagaaaguguuguaguug

SEQ ID NO: 521409 - RNA, 19 nt, Homo sapiens
cgugagcgauguggagaug

SEQ ID NO: 521410 - RNA, 19 nt, Homo sapiens
aaagacaaagucaacuguu

SEQ ID NO: 521411 - RNA, 19 nt, Homo sapiens
caggaacacuaugaugagu

SEQ ID NO: 521412 - RNA, 19 nt, Homo sapiens
ugcaggaacacuaugauga

SEQ ID NO: 521413 - RNA, 19 nt, Homo sapiens
aggcugugauugacuugaa

SEQ ID NO: 521414 - RNA, 19 nt, Homo sapiens
gaugaacgucugugacaac

SEQ ID NO: 521415 - RNA, 19 nt, Homo sapiens
aaauggaggagaaguaugg

SEQ ID NO: 521416 - RNA, 19 nt, Homo sapiens
ugagcgauguggagaugca

SEQ ID NO: 521417 - RNA, 19 nt, Homo sapiens
cggaaaaggcugugauuga

SEQ ID NO: 521418 - RNA, 19 nt, Homo sapiens
caaguuucgccgugaggaa

SEQ ID NO: 521419 - RNA, 19 nt, Homo sapiens
uaugucugcuagaaagugu

SEQ ID NO: 521420 - RNA, 19 nt, Homo sapiens
agaaagacaaagucaacug

SEQ ID NO: 521421 - RNA, 19 nt, Homo sapiens
gggaaguagaggagaugaa

SEQ ID NO: 521422 - RNA, 19 nt, Homo sapiens
guaguugauugaccaaacc

SEQ ID NO: 521423 - RNA, 19 nt, Homo sapiens
gacaaagucaacuguucau

SEQ ID NO: 521424 - RNA, 19 nt, Homo sapiens
acaggaggcggucgagaga

SEQ ID NO: 521425 - RNA, 19 nt, Homo sapiens
aaaaggcugugauugacuu

SEQ ID NO: 521426 - RNA, 19 nt, Homo sapiens
caaauaaggugguucuuuc

SEQ ID NO: 521427 - RNA, 19 nt, Homo sapiens
ccaagaagaaggucaaaua

SEQ ID NO: 521428 - RNA, 19 nt, Homo sapiens
caagaagaaggucaaauaa

SEQ ID NO: 521429 - RNA, 19 nt, Homo sapiens
agaagaaggucaaauaagg

SEQ ID NO: 521430 - RNA, 19 nt, Homo sapiens
gaaauacaacugcgacaag

SEQ ID NO: 521431 - RNA, 19 nt, Homo sapiens
gcugucaacugccgcaaga

SEQ ID NO: 521432 - RNA, 19 nt, Homo sapiens
gcaaaaccaucacccuuga

SEQ ID NO: 521433 - RNA, 19 nt, Homo sapiens
ucaaauaaggugguucuuu

SEQ ID NO: 521434 - RNA, 19 nt, Homo sapiens
gaagaaggucaaauaaggu

SEQ ID NO: 521435 - RNA, 19 nt, Homo sapiens
aaauacaacugcgacaaga

SEQ ID NO: 521436 - RNA, 19 nt, Homo sapiens
ccugcgagguggcauuauu

SEQ ID NO: 521437 - RNA, 19 nt, Homo sapiens
gaggauggccgcacucucu

SEQ ID NO: 521438 - RNA, 19 nt, Homo sapiens
cagcagcgucugauauuug

SEQ ID NO: 521439 - RNA, 19 nt, Homo sapiens
ccagugacaccauugagaa

SEQ ID NO: 521440 - RNA, 19 nt, Homo sapiens
acgcaaacaugcagaucuu

SEQ ID NO: 521441 - RNA, 19 nt, Homo sapiens
caaccugcgucccaagaag

SEQ ID NO: 521442 - RNA, 19 nt, Homo sapiens
acuacaacauccagaaaga

SEQ ID NO: 521443 - RNA, 19 nt, Homo sapiens
ccuggagccucaauaaagu

SEQ ID NO: 521444 - RNA, 19 nt, Homo sapiens
acaugcagaucuuugugaa

SEQ ID NO: 521445 - RNA, 19 nt, Homo sapiens
gccgcacucucucagacua

SEQ ID NO: 521446 - RNA, 19 nt, Homo sapiens
ucaacugccgcaagaagaa

SEQ ID NO: 521447 - RNA, 19 nt, Homo sapiens
ggcccuggagccucaauaa

SEQ ID NO: 521448 - RNA, 19 nt, Homo sapiens
gaagacccucacuggcaaa

SEQ ID NO: 521449 - RNA, 19 nt, Homo sapiens
gcccuggagccucaauaaa

SEQ ID NO: 521450 - RNA, 19 nt, Homo sapiens
ggucaaauaaggugguucu

SEQ ID NO: 521451 - RNA, 19 nt, Homo sapiens
agacuacaacauccagaaa

SEQ ID NO: 521452 - RNA, 19 nt, Homo sapiens
auacaacugcgacaagaug

SEQ ID NO: 521453 - RNA, 19 nt, Homo sapiens
gaaugucaaagccaaaauu

SEQ ID NO: 521454 - RNA, 19 nt, Homo sapiens
caacugcgacaagaugauc

SEQ ID NO: 521455 - RNA, 19 nt, Homo sapiens
aagaagaaggucaaauaag

SEQ ID NO: 521456 - RNA, 19 nt, Homo sapiens
cgagcccagugacaccauu

SEQ ID NO: 521457 - RNA, 19 nt, Homo sapiens
cagacuacaacauccagaa

SEQ ID NO: 521458 - RNA, 19 nt, Homo sapiens
aaacaugcagaucuuugug

SEQ ID NO: 521459 - RNA, 19 nt, Homo sapiens
gaaaugauccucacagauu

SEQ ID NO: 521460 - RNA, 19 nt, Homo sapiens
gcucagaccugcaagagaa

SEQ ID NO: 521461 - RNA, 19 nt, Homo sapiens
uaagacagagcacaaauua

SEQ ID NO: 521462 - RNA, 19 nt, Homo sapiens
caaaguaccuaagaagauu

SEQ ID NO: 521463 - RNA, 19 nt, Homo sapiens
gaaaucagcccauggagau

SEQ ID NO: 521464 - RNA, 19 nt, Homo sapiens
gcuaugguuucuaugguua

SEQ ID NO: 521465 - RNA, 19 nt, Homo sapiens
caagaacuuugccaugauu

SEQ ID NO: 521466 - RNA, 19 nt, Homo sapiens
ucaaacaguuccucgacua

SEQ ID NO: 521467 - RNA, 19 nt, Homo sapiens
gagaaaucaucguuacaga

SEQ ID NO: 521468 - RNA, 19 nt, Homo sapiens
cagacaagcucccuggauu

SEQ ID NO: 521469 - RNA, 19 nt, Homo sapiens
ucacgaaguuaaagucuga

SEQ ID NO: 521470 - RNA, 19 nt, Homo sapiens
gacagcaacuuucauaugg

SEQ ID NO: 521471 - RNA, 19 nt, Homo sapiens
ccaaaugaauccacauauc

SEQ ID NO: 521472 - RNA, 19 nt, Homo sapiens
gcucgccgcuguccaagaa

SEQ ID NO: 521473 - RNA, 19 nt, Homo sapiens
gaaaucaucguuacagaca

SEQ ID NO: 521474 - RNA, 19 nt, Homo sapiens
gagcacaaauuagagauca

SEQ ID NO: 521475 - RNA, 19 nt, Homo sapiens
ucaaaguccuggguccuua

SEQ ID NO: 521476 - RNA, 19 nt, Homo sapiens
ggagaucgcuaagaacauc

SEQ ID NO: 521477 - RNA, 19 nt, Homo sapiens
agacagagcacaaauuaga

SEQ ID NO: 521478 - RNA, 19 nt, Homo sapiens
uuugaaaccugaauccuaa

SEQ ID NO: 521479 - RNA, 19 nt, Homo sapiens
gcguggagaucgcuaagaa

SEQ ID NO: 521480 - RNA, 19 nt, Homo sapiens
gaaaccugaauccuaauaa

SEQ ID NO: 521481 - RNA, 19 nt, Homo sapiens
acacggagcgcaucuauga

SEQ ID NO: 521482 - RNA, 19 nt, Homo sapiens
gcaacuuucauauggauuu

SEQ ID NO: 521483 - RNA, 19 nt, Homo sapiens
ggcagaaccugacuuugug

SEQ ID NO: 521484 - RNA, 19 nt, Homo sapiens
gagaugacccucaaacagu

SEQ ID NO: 521485 - RNA, 19 nt, Homo sapiens
ggaugcagcagaacuggua

SEQ ID NO: 521486 - RNA, 19 nt, Homo sapiens
gaagaucaucccagccauu

SEQ ID NO: 521487 - RNA, 19 nt, Homo sapiens
cagaaaaugucaaccagua

SEQ ID NO: 521488 - RNA, 19 nt, Homo sapiens
ccaacggaauggccaagaa

SEQ ID NO: 521489 - RNA, 19 nt, Homo sapiens
gaagucaaaucugaaucga

SEQ ID NO: 521490 - RNA, 19 nt, Homo sapiens
ucagugcuaugguuucuau

SEQ ID NO: 521491 - RNA, 19 nt, Homo sapiens
caacuucuccgacuacauc

SEQ ID NO: 521492 - RNA, 19 nt, Homo sapiens
ccacgucaccaguacuaua

SEQ ID NO: 521493 - RNA, 19 nt, Homo sapiens
ugacagagucguacaguuc

SEQ ID NO: 521494 - RNA, 19 nt, Homo sapiens
ugaggaggaugcagcagaa

SEQ ID NO: 521495 - RNA, 19 nt, Homo sapiens
aacaguuccucgacuauuu

SEQ ID NO: 521496 - RNA, 19 nt, Homo sapiens
caagaaugguuuccucaac

SEQ ID NO: 521497 - RNA, 19 nt, Homo sapiens
gcucuucugugacuuugga

SEQ ID NO: 521498 - RNA, 19 nt, Homo sapiens
gggcagcucuucugugacu

SEQ ID NO: 521499 - RNA, 19 nt, Homo sapiens
gggaggaggacaucgguaa

SEQ ID NO: 521500 - RNA, 19 nt, Homo sapiens
ugaagcggcuccagacauc

SEQ ID NO: 521501 - RNA, 19 nt, Homo sapiens
gccaaugccucuguugaug

SEQ ID NO: 521502 - RNA, 19 nt, Homo sapiens
aaaucugaaucgacaguuu

SEQ ID NO: 521503 - RNA, 19 nt, Homo sapiens
ggacaccauugagaaguca

SEQ ID NO: 521504 - RNA, 19 nt, Homo sapiens
ucaagaacuuugccaugau

SEQ ID NO: 521505 - RNA, 19 nt, Homo sapiens
ggacuuccuuagugguuuc

SEQ ID NO: 521506 - RNA, 19 nt, Homo sapiens
ccuucuaccuuguuugaaa

SEQ ID NO: 521507 - RNA, 19 nt, Homo sapiens
gcagugaagcagacauaga

SEQ ID NO: 521508 - RNA, 19 nt, Homo sapiens
gcagaaaacuaugacauuc

SEQ ID NO: 521509 - RNA, 19 nt, Homo sapiens
caagcucccuggauucaag

SEQ ID NO: 521510 - RNA, 19 nt, Homo sapiens
ccaaugcccuggacaacgu

SEQ ID NO: 521511 - RNA, 19 nt, Homo sapiens
ggaaaugauccucacagau

SEQ ID NO: 521512 - RNA, 19 nt, Homo sapiens
ucacaaccguggcaucaag

SEQ ID NO: 521513 - RNA, 19 nt, Homo sapiens
ccugaauccuaauaaagaa

SEQ ID NO: 521514 - RNA, 19 nt, Homo sapiens
ggagaugacccucaaacag

SEQ ID NO: 521515 - RNA, 19 nt, Homo sapiens
cacaagagcaagcugauug

SEQ ID NO: 521516 - RNA, 19 nt, Homo sapiens
ugacagcaacuuucauaug

SEQ ID NO: 521517 - RNA, 19 nt, Homo sapiens
ccauugacuuugagaagga

SEQ ID NO: 521518 - RNA, 19 nt, Homo sapiens
ccacagaccugggcugacu

SEQ ID NO: 521519 - RNA, 19 nt, Homo sapiens
ccacauauccgggugacaa

SEQ ID NO: 521520 - RNA, 19 nt, Homo sapiens
ccugggaugucacgaaguu

SEQ ID NO: 521521 - RNA, 19 nt, Homo sapiens
cucaagaacuuugccauga

SEQ ID NO: 521522 - RNA, 19 nt, Homo sapiens
uccggaagcuggcauaugu

SEQ ID NO: 521523 - RNA, 19 nt, Homo sapiens
ccuuauaccuuuagcaucu

SEQ ID NO: 521524 - RNA, 19 nt, Homo sapiens
ucaaggaacgguuggauca

SEQ ID NO: 521525 - RNA, 19 nt, Homo sapiens
gcacaagagcaagcugauu

SEQ ID NO: 521526 - RNA, 19 nt, Homo sapiens
gcagcugugcgccaaauga

SEQ ID NO: 521527 - RNA, 19 nt, Homo sapiens
ucaaaguaccuaagaagau

SEQ ID NO: 521528 - RNA, 19 nt, Homo sapiens
ugaaaccugaauccuaaua

SEQ ID NO: 521529 - RNA, 19 nt, Homo sapiens
cagcaacuuucauauggau

SEQ ID NO: 521530 - RNA, 19 nt, Homo sapiens
ugcaguggcuauacuuuga

SEQ ID NO: 521531 - RNA, 19 nt, Homo sapiens
ggaaguucaugcccaucau

SEQ ID NO: 521532 - RNA, 19 nt, Homo sapiens
gaucuuuccucccaguucu

SEQ ID NO: 521533 - RNA, 19 nt, Homo sapiens
gaugaugacagcaacuuuc

SEQ ID NO: 521534 - RNA, 19 nt, Homo sapiens
ggaggaggacaucgguaaa

SEQ ID NO: 521535 - RNA, 19 nt, Homo sapiens
gaucagccgaugacagaga

SEQ ID NO: 521536 - RNA, 19 nt, Homo sapiens
agaugacccucaaacaguu

SEQ ID NO: 521537 - RNA, 19 nt, Homo sapiens
agaaugguuuccucaacuu

SEQ ID NO: 521538 - RNA, 19 nt, Homo sapiens
caucgucagucaggucaaa

SEQ ID NO: 521539 - RNA, 19 nt, Homo sapiens
gcgagugggugaguucugu

SEQ ID NO: 521540 - RNA, 19 nt, Homo sapiens
cggcgaggaugucgagguu

SEQ ID NO: 521541 - RNA, 19 nt, Homo sapiens
gcguguccaugcucuauuc

SEQ ID NO: 521542 - RNA, 19 nt, Homo sapiens
caacuuggcccugccuuuc

SEQ ID NO: 521543 - RNA, 19 nt, Homo sapiens
gagcgccaaugccucuguu

SEQ ID NO: 521544 - RNA, 19 nt, Homo sapiens
guggagaaaucaucguuac

SEQ ID NO: 521545 - RNA, 19 nt, Homo sapiens
gguggagaaaucaucguua

SEQ ID NO: 521546 - RNA, 19 nt, Homo sapiens
aagagaagcugggcaagca

SEQ ID NO: 521547 - RNA, 19 nt, Homo sapiens
aaaugauccucacagauuc

SEQ ID NO: 521548 - RNA, 19 nt, Homo sapiens
gcagcucuucugugacuuu

SEQ ID NO: 521549 - RNA, 19 nt, Homo sapiens
ggaugaugacagcaacuuu

SEQ ID NO: 521550 - RNA, 19 nt, Homo sapiens
gcgucaagauccauguuuc

SEQ ID NO: 521551 - RNA, 19 nt, Homo sapiens
cacacccgcucaccuuuga

SEQ ID NO: 521552 - RNA, 19 nt, Homo sapiens
aaucaucguuacagacaug

SEQ ID NO: 521553 - RNA, 19 nt, Homo sapiens
ugggcaagcagaaguauuu

SEQ ID NO: 521554 - RNA, 19 nt, Homo sapiens
uggcagaaccugacuuugu

SEQ ID NO: 521555 - RNA, 19 nt, Homo sapiens
uugggcagcucuucuguga

SEQ ID NO: 521556 - RNA, 19 nt, Homo sapiens
gcucuauuccuucuucaug

SEQ ID NO: 521557 - RNA, 19 nt, Homo sapiens
accgacagcuugacuccua

SEQ ID NO: 521558 - RNA, 19 nt, Homo sapiens
caacuuucauauggauuuc

SEQ ID NO: 521559 - RNA, 19 nt, Homo sapiens
gaaaugauccucacagauu

SEQ ID NO: 521560 - RNA, 19 nt, Homo sapiens
gcucagaccugcaagagaa

SEQ ID NO: 521561 - RNA, 19 nt, Homo sapiens
uaagacagagcacaaauua

SEQ ID NO: 521562 - RNA, 19 nt, Homo sapiens
caaaguaccuaagaagauu

SEQ ID NO: 521563 - RNA, 19 nt, Homo sapiens
gaaaucagcccauggagau

SEQ ID NO: 521564 - RNA, 19 nt, Homo sapiens
gcuaugguuucuaugguua

SEQ ID NO: 521565 - RNA, 19 nt, Homo sapiens
caagaacuuugccaugauu

SEQ ID NO: 521566 - RNA, 19 nt, Homo sapiens
ucaaacaguuccucgacua

SEQ ID NO: 521567 - RNA, 19 nt, Homo sapiens
gagaaaucaucguuacaga

SEQ ID NO: 521568 - RNA, 19 nt, Homo sapiens
cagacaagcucccuggauu

SEQ ID NO: 521569 - RNA, 19 nt, Homo sapiens
ucacgaaguuaaagucuga

SEQ ID NO: 521570 - RNA, 19 nt, Homo sapiens
gacagcaacuuucauaugg

SEQ ID NO: 521571 - RNA, 19 nt, Homo sapiens
ccaaaugaauccacauauc

SEQ ID NO: 521572 - RNA, 19 nt, Homo sapiens
gaaaucaucguuacagaca

SEQ ID NO: 521573 - RNA, 19 nt, Homo sapiens
gcucgccgcuguccaagaa

SEQ ID NO: 521574 - RNA, 19 nt, Homo sapiens
gagcacaaauuagagauca

SEQ ID NO: 521575 - RNA, 19 nt, Homo sapiens
ucaaaguccuggguccuua

SEQ ID NO: 521576 - RNA, 19 nt, Homo sapiens
ggagaucgcuaagaacauc

SEQ ID NO: 521577 - RNA, 19 nt, Homo sapiens
agacagagcacaaauuaga

SEQ ID NO: 521578 - RNA, 19 nt, Homo sapiens
uuugaaaccugaauccuaa

SEQ ID NO: 521579 - RNA, 19 nt, Homo sapiens
gcguggagaucgcuaagaa

SEQ ID NO: 521580 - RNA, 19 nt, Homo sapiens
gaaaccugaauccuaauaa

SEQ ID NO: 521581 - RNA, 19 nt, Homo sapiens
acacggagcgcaucuauga

SEQ ID NO: 521582 - RNA, 19 nt, Homo sapiens
gcaacuuucauauggauuu

SEQ ID NO: 521583 - RNA, 19 nt, Homo sapiens
ggcagaaccugacuuugug

SEQ ID NO: 521584 - RNA, 19 nt, Homo sapiens
gagaugacccucaaacagu

SEQ ID NO: 521585 - RNA, 19 nt, Homo sapiens
ggaugcagcagaacuggua

SEQ ID NO: 521586 - RNA, 19 nt, Homo sapiens
gaagaucaucccagccauu

SEQ ID NO: 521587 - RNA, 19 nt, Homo sapiens
cagaaaaugucaaccagua

SEQ ID NO: 521588 - RNA, 19 nt, Homo sapiens
gaagucaaaucugaaucga

SEQ ID NO: 521589 - RNA, 19 nt, Homo sapiens
ucagugcuaugguuucuau

SEQ ID NO: 521590 - RNA, 19 nt, Homo sapiens
ccaacggaauggccaagaa

SEQ ID NO: 521591 - RNA, 19 nt, Homo sapiens
caacuucuccgacuacauc

SEQ ID NO: 521592 - RNA, 19 nt, Homo sapiens
ccacgucaccaguacuaua

SEQ ID NO: 521593 - RNA, 19 nt, Homo sapiens
ugacagagucguacaguuc

SEQ ID NO: 521594 - RNA, 19 nt, Homo sapiens
ugaggaggaugcagcagaa

SEQ ID NO: 521595 - RNA, 19 nt, Homo sapiens
aacaguuccucgacuauuu

SEQ ID NO: 521596 - RNA, 19 nt, Homo sapiens
caagaaugguuuccucaac

SEQ ID NO: 521597 - RNA, 19 nt, Homo sapiens
gcucuucugugacuuugga

SEQ ID NO: 521598 - RNA, 19 nt, Homo sapiens
gggcagcucuucugugacu

SEQ ID NO: 521599 - RNA, 19 nt, Homo sapiens
gggaggaggacaucgguaa

SEQ ID NO: 521600 - RNA, 19 nt, Homo sapiens
ugaagcggcuccagacauc

SEQ ID NO: 521601 - RNA, 19 nt, Homo sapiens
gccaaugccucuguugaug

SEQ ID NO: 521602 - RNA, 19 nt, Homo sapiens
aaaucugaaucgacaguuu

SEQ ID NO: 521603 - RNA, 19 nt, Homo sapiens
ggacaccauugagaaguca

SEQ ID NO: 521604 - RNA, 19 nt, Homo sapiens
ucaagaacuuugccaugau

SEQ ID NO: 521605 - RNA, 19 nt, Homo sapiens
ggacuuccuuagugguuuc

SEQ ID NO: 521606 - RNA, 19 nt, Homo sapiens
ccuucuaccuuguuugaaa

SEQ ID NO: 521607 - RNA, 19 nt, Homo sapiens
gcagaaaacuaugacauuc

SEQ ID NO: 521608 - RNA, 19 nt, Homo sapiens
caagcucccuggauucaag

SEQ ID NO: 521609 - RNA, 19 nt, Homo sapiens
ccaaugcccuggacaacgu

SEQ ID NO: 521610 - RNA, 19 nt, Homo sapiens
gcagugaagcagacauaga

SEQ ID NO: 521611 - RNA, 19 nt, Homo sapiens
ggaaaugauccucacagau

SEQ ID NO: 521612 - RNA, 19 nt, Homo sapiens
ucacaaccguggcaucaag

SEQ ID NO: 521613 - RNA, 19 nt, Homo sapiens
ccugaauccuaauaaagaa

SEQ ID NO: 521614 - RNA, 19 nt, Homo sapiens
ggagaugacccucaaacag

SEQ ID NO: 521615 - RNA, 19 nt, Homo sapiens
cacaagagcaagcugauug

SEQ ID NO: 521616 - RNA, 19 nt, Homo sapiens
ugacagcaacuuucauaug

SEQ ID NO: 521617 - RNA, 19 nt, Homo sapiens
ccauugacuuugagaagga

SEQ ID NO: 521618 - RNA, 19 nt, Homo sapiens
ccacagaccugggcugacu

SEQ ID NO: 521619 - RNA, 19 nt, Homo sapiens
ccacauauccgggugacaa

SEQ ID NO: 521620 - RNA, 19 nt, Homo sapiens
ccugggaugucacgaaguu

SEQ ID NO: 521621 - RNA, 19 nt, Homo sapiens
cucaagaacuuugccauga

SEQ ID NO: 521622 - RNA, 19 nt, Homo sapiens
uccggaagcuggcauaugu

SEQ ID NO: 521623 - RNA, 19 nt, Homo sapiens
ccuuauaccuuuagcaucu

SEQ ID NO: 521624 - RNA, 19 nt, Homo sapiens
ucaaggaacgguuggauca

SEQ ID NO: 521625 - RNA, 19 nt, Homo sapiens
gcacaagagcaagcugauu

SEQ ID NO: 521626 - RNA, 19 nt, Homo sapiens
gcagcugugcgccaaauga

SEQ ID NO: 521627 - RNA, 19 nt, Homo sapiens
ucaaaguaccuaagaagau

SEQ ID NO: 521628 - RNA, 19 nt, Homo sapiens
ugaaaccugaauccuaaua

SEQ ID NO: 521629 - RNA, 19 nt, Homo sapiens
cagcaacuuucauauggau

SEQ ID NO: 521630 - RNA, 19 nt, Homo sapiens
ugcaguggcuauacuuuga

SEQ ID NO: 521631 - RNA, 19 nt, Homo sapiens
ggaaguucaugcccaucau

SEQ ID NO: 521632 - RNA, 19 nt, Homo sapiens
gaucuuuccucccaguucu

SEQ ID NO: 521633 - RNA, 19 nt, Homo sapiens
gaugaugacagcaacuuuc

SEQ ID NO: 521634 - RNA, 19 nt, Homo sapiens
ggaggaggacaucgguaaa

SEQ ID NO: 521635 - RNA, 19 nt, Homo sapiens
gaucagccgaugacagaga

SEQ ID NO: 521636 - RNA, 19 nt, Homo sapiens
agaugacccucaaacaguu

SEQ ID NO: 521637 - RNA, 19 nt, Homo sapiens
agaaugguuuccucaacuu

SEQ ID NO: 521638 - RNA, 19 nt, Homo sapiens
caucgucagucaggucaaa

SEQ ID NO: 521639 - RNA, 19 nt, Homo sapiens
gcgagugggugaguucugu

SEQ ID NO: 521640 - RNA, 19 nt, Homo sapiens
cggcgaggaugucgagguu

SEQ ID NO: 521641 - RNA, 19 nt, Homo sapiens
gcguguccaugcucuauuc

SEQ ID NO: 521642 - RNA, 19 nt, Homo sapiens
caacuuggcccugccuuuc

SEQ ID NO: 521643 - RNA, 19 nt, Homo sapiens
gagcgccaaugccucuguu

SEQ ID NO: 521644 - RNA, 19 nt, Homo sapiens
guggagaaaucaucguuac

SEQ ID NO: 521645 - RNA, 19 nt, Homo sapiens
gguggagaaaucaucguua

SEQ ID NO: 521646 - RNA, 19 nt, Homo sapiens
aagagaagcugggcaagca

SEQ ID NO: 521647 - RNA, 19 nt, Homo sapiens
aaaugauccucacagauuc

SEQ ID NO: 521648 - RNA, 19 nt, Homo sapiens
gcagcucuucugugacuuu

SEQ ID NO: 521649 - RNA, 19 nt, Homo sapiens
ggaugaugacagcaacuuu

SEQ ID NO: 521650 - RNA, 19 nt, Homo sapiens
gcgucaagauccauguuuc

SEQ ID NO: 521651 - RNA, 19 nt, Homo sapiens
cacacccgcucaccuuuga

SEQ ID NO: 521652 - RNA, 19 nt, Homo sapiens
aaucaucguuacagacaug

SEQ ID NO: 521653 - RNA, 19 nt, Homo sapiens
ugggcaagcagaaguauuu

SEQ ID NO: 521654 - RNA, 19 nt, Homo sapiens
uggcagaaccugacuuugu

SEQ ID NO: 521655 - RNA, 19 nt, Homo sapiens
uugggcagcucuucuguga

SEQ ID NO: 521656 - RNA, 19 nt, Homo sapiens
gcucuauuccuucuucaug

SEQ ID NO: 521657 - RNA, 19 nt, Homo sapiens
accgacagcuugacuccua

SEQ ID NO: 521658 - RNA, 19 nt, Homo sapiens
caacuuucauauggauuuc

SEQ ID NO: 521659 - RNA, 19 nt, Homo sapiens
gaacaaagcccuggaaguc

SEQ ID NO: 521660 - RNA, 19 nt, Homo sapiens
gagcaggacuuggaaagga

SEQ ID NO: 521661 - RNA, 19 nt, Homo sapiens
acaaagacccuaucucuga

SEQ ID NO: 521662 - RNA, 19 nt, Homo sapiens
gcacuucccaccuaauaaa

SEQ ID NO: 521663 - RNA, 19 nt, Homo sapiens
ccacagaacuggcaagacu

SEQ ID NO: 521664 - RNA, 19 nt, Homo sapiens
gggcagugcuacaguauuc

SEQ ID NO: 521665 - RNA, 19 nt, Homo sapiens
ugaagccucugauguuuga

SEQ ID NO: 521666 - RNA, 19 nt, Homo sapiens
ccacagagcacaucuaugg

SEQ ID NO: 521667 - RNA, 19 nt, Homo sapiens
ccaagacugugagacauaa

SEQ ID NO: 521668 - RNA, 19 nt, Homo sapiens
gugggcaccuugugucaua

SEQ ID NO: 521669 - RNA, 19 nt, Homo sapiens
cccaagcccugcauuguaa

SEQ ID NO: 521670 - RNA, 19 nt, Homo sapiens
aaacucugcuuucauuaug

SEQ ID NO: 521671 - RNA, 19 nt, Homo sapiens
gucaguagcugcccaggaa

SEQ ID NO: 521672 - RNA, 19 nt, Homo sapiens
caucuuugcuaguaaucua

SEQ ID NO: 521673 - RNA, 19 nt, Homo sapiens
cuucgaagcuacuggauga

SEQ ID NO: 521674 - RNA, 19 nt, Homo sapiens
gcucagcccugcucuaugc

SEQ ID NO: 521675 - RNA, 19 nt, Homo sapiens
cgaauugugggccagauua

SEQ ID NO: 521676 - RNA, 19 nt, Homo sapiens
caaccuguaugcccagaug

SEQ ID NO: 521677 - RNA, 19 nt, Homo sapiens
auagagcgcuccaaucuca

SEQ ID NO: 521678 - RNA, 19 nt, Homo sapiens
gcaguuguucugugacuuu

SEQ ID NO: 521679 - RNA, 19 nt, Homo sapiens
gcccagagcaagcgaauug

SEQ ID NO: 521680 - RNA, 19 nt, Homo sapiens
agaaggaacugaacaaagc

SEQ ID NO: 521681 - RNA, 19 nt, Homo sapiens
cacaguaggcacucaauaa

SEQ ID NO: 521682 - RNA, 19 nt, Homo sapiens
gcauggaguuugcuuucug

SEQ ID NO: 521683 - RNA, 19 nt, Homo sapiens
ccugaagccucugauguuu

SEQ ID NO: 521684 - RNA, 19 nt, Homo sapiens
gcagaaggaacugaacaaa

SEQ ID NO: 521685 - RNA, 19 nt, Homo sapiens
ggaccaguggcuuuacuuu

SEQ ID NO: 521686 - RNA, 19 nt, Homo sapiens
gaauugagggaaugguuga

SEQ ID NO: 521687 - RNA, 19 nt, Homo sapiens
cugcugcccuggacaguuu

SEQ ID NO: 521688 - RNA, 19 nt, Homo sapiens
accaguggcuuuacuuuga

SEQ ID NO: 521689 - RNA, 19 nt, Homo sapiens
aaggcaaucuccagaaguu

SEQ ID NO: 521690 - RNA, 19 nt, Homo sapiens
uggaagagccacuggauga

SEQ ID NO: 521691 - RNA, 19 nt, Homo sapiens
gcagcuagccugagauguc

SEQ ID NO: 521692 - RNA, 19 nt, Homo sapiens
gaagucaagagacccaaga

SEQ ID NO: 521693 - RNA, 19 nt, Homo sapiens
ccacauagagcgcuccaau

SEQ ID NO: 521694 - RNA, 19 nt, Homo sapiens
gauggagacuuggugacuu

SEQ ID NO: 521695 - RNA, 19 nt, Homo sapiens
gagccgaggccucucaaga

SEQ ID NO: 521696 - RNA, 19 nt, Homo sapiens
ccacaguaggcacucaaua

SEQ ID NO: 521697 - RNA, 19 nt, Homo sapiens
gccuggagcuguauaaggu

SEQ ID NO: 521698 - RNA, 19 nt, Homo sapiens
acacacaccuccucuacgu

SEQ ID NO: 521699 - RNA, 19 nt, Homo sapiens
gggccugaacccagacuua

SEQ ID NO: 521700 - RNA, 19 nt, Homo sapiens
acacaaagacccuaucucu

SEQ ID NO: 521701 - RNA, 19 nt, Homo sapiens
cagauuaucccagccauug

SEQ ID NO: 521702 - RNA, 19 nt, Homo sapiens
gcagccacccugucaccua

SEQ ID NO: 521703 - RNA, 19 nt, Homo sapiens
cagcuagccugagauguca

SEQ ID NO: 521704 - RNA, 19 nt, Homo sapiens
ugaaggcaaucuccagaag

SEQ ID NO: 521705 - RNA, 19 nt, Homo sapiens
ccagcagcgucccuuauuc

SEQ ID NO: 521706 - RNA, 19 nt, Homo sapiens
gagagugcguccacagaac

SEQ ID NO: 521707 - RNA, 19 nt, Homo sapiens
ucaagagacccaagacugu

SEQ ID NO: 521708 - RNA, 19 nt, Homo sapiens
gaugaggagcuguauucaa

SEQ ID NO: 521709 - RNA, 19 nt, Homo sapiens
caaggcagccacccuguca

SEQ ID NO: 521710 - RNA, 19 nt, Homo sapiens
gcccugagcagcagaagga

SEQ ID NO: 521711 - RNA, 19 nt, Homo sapiens
ugaggcacuucccaccuaa

SEQ ID NO: 521712 - RNA, 19 nt, Homo sapiens
gagcacaucuauggggaua

SEQ ID NO: 521713 - RNA, 19 nt, Homo sapiens
ugacauggaccacauagag

SEQ ID NO: 521714 - RNA, 19 nt, Homo sapiens
gggcuugacuguuguugac

SEQ ID NO: 521715 - RNA, 19 nt, Homo sapiens
gaccaguggcuuuacuuug

SEQ ID NO: 521716 - RNA, 19 nt, Homo sapiens
augaggagcuguauucaag

SEQ ID NO: 521717 - RNA, 19 nt, Homo sapiens
gaauugugggccagauuau

SEQ ID NO: 521718 - RNA, 19 nt, Homo sapiens
ugucagaacuacgggauuc

SEQ ID NO: 521719 - RNA, 19 nt, Homo sapiens
cugaggcacuucccaccua

SEQ ID NO: 521720 - RNA, 19 nt, Homo sapiens
ugaggacugugcccugaga

SEQ ID NO: 521721 - RNA, 19 nt, Homo sapiens
gagauuggagacacaacaa

SEQ ID NO: 521722 - RNA, 19 nt, Homo sapiens
cugaggaccugcuguugga

SEQ ID NO: 521723 - RNA, 19 nt, Homo sapiens
gcucuuggcucagcucaac

SEQ ID NO: 521724 - RNA, 19 nt, Homo sapiens
caguaggcacucaauaauu

SEQ ID NO: 521725 - RNA, 19 nt, Homo sapiens
ccacuggaaacucugcuuu

SEQ ID NO: 521726 - RNA, 19 nt, Homo sapiens
ccacagacacucaccuuac

SEQ ID NO: 521727 - RNA, 19 nt, Homo sapiens
gcccugggauccuguugau

SEQ ID NO: 521728 - RNA, 19 nt, Homo sapiens
gaggagcuguauucaagac

SEQ ID NO: 521729 - RNA, 19 nt, Homo sapiens
ugacuguuguugacaugga

SEQ ID NO: 521730 - RNA, 19 nt, Homo sapiens
ccagagcucccaggaaguu

SEQ ID NO: 521731 - RNA, 19 nt, Homo sapiens
ggcuaucacugaagucaag

SEQ ID NO: 521732 - RNA, 19 nt, Homo sapiens
gaucccaagcccugcauug

SEQ ID NO: 521733 - RNA, 19 nt, Homo sapiens
gccggauggucaccugaaa

SEQ ID NO: 521734 - RNA, 19 nt, Homo sapiens
cgccacagcuaccuacauc

SEQ ID NO: 521735 - RNA, 19 nt, Homo sapiens
gaaggcaaucuccagaagu

SEQ ID NO: 521736 - RNA, 19 nt, Homo sapiens
ggagacacaacaacuuucu

SEQ ID NO: 521737 - RNA, 19 nt, Homo sapiens
ucucagagcaggacuugga

SEQ ID NO: 521738 - RNA, 19 nt, Homo sapiens
aggaagagccacuggaaga

SEQ ID NO: 521739 - RNA, 19 nt, Homo sapiens
ggagauuggagacacaaca

SEQ ID NO: 521740 - RNA, 19 nt, Homo sapiens
ugacuuuggugaggacuuc

SEQ ID NO: 521741 - RNA, 19 nt, Homo sapiens
uaaagugcuugaggaugga

SEQ ID NO: 521742 - RNA, 19 nt, Homo sapiens
gccacagacacucaccuua

SEQ ID NO: 521743 - RNA, 19 nt, Homo sapiens
gaccaucaaccaccaccaa

SEQ ID NO: 521744 - RNA, 19 nt, Homo sapiens
ccaguggcuuuacuuugau

SEQ ID NO: 521745 - RNA, 19 nt, Homo sapiens
aggaagugcugaaggcaau

SEQ ID NO: 521746 - RNA, 19 nt, Homo sapiens
ggaugggucccuggagauu

SEQ ID NO: 521747 - RNA, 19 nt, Homo sapiens
gggaauugagggaaugguu

SEQ ID NO: 521748 - RNA, 19 nt, Homo sapiens
auggagacuuggugacuuu

SEQ ID NO: 521749 - RNA, 19 nt, Homo sapiens
gacguuccaucaccugaag

SEQ ID NO: 521750 - RNA, 19 nt, Homo sapiens
acauagagcgcuccaaucu

SEQ ID NO: 521751 - RNA, 19 nt, Homo sapiens
ucacugaggaccugcuguu

SEQ ID NO: 521752 - RNA, 19 nt, Homo sapiens
gaccagcagcgucccuuau

SEQ ID NO: 521753 - RNA, 19 nt, Homo sapiens
ggugcugacugcugcaaag

SEQ ID NO: 521754 - RNA, 19 nt, Homo sapiens
gacccaagacugugagaca

SEQ ID NO: 521755 - RNA, 19 nt, Homo sapiens
gugacuuucucgggaauug

SEQ ID NO: 521756 - RNA, 19 nt, Homo sapiens
gggccaauacccacuacuu

SEQ ID NO: 521757 - RNA, 19 nt, Homo sapiens
caccugaaguggaccucuu

SEQ ID NO: 521758 - RNA, 19 nt, Homo sapiens
uaauaaagugcuugaggau

SEQ ID NO: 521759 - RNA, 19 nt, Homo sapiens
gaacaaacgggaauaugaa

SEQ ID NO: 521760 - RNA, 19 nt, Homo sapiens
gcauaucuguggcaaacua

SEQ ID NO: 521761 - RNA, 19 nt, Homo sapiens
gaauauggccuacagagaa

SEQ ID NO: 521762 - RNA, 19 nt, Homo sapiens
gaucagugcugcccuaagu

SEQ ID NO: 521763 - RNA, 19 nt, Homo sapiens
gcagaggaauggaaacaau

SEQ ID NO: 521764 - RNA, 19 nt, Homo sapiens
gcacacucaugccaaguuu

SEQ ID NO: 521765 - RNA, 19 nt, Homo sapiens
gcacaaguaacccauguaa

SEQ ID NO: 521766 - RNA, 19 nt, Homo sapiens
gcaagaaggagaaaguuga

SEQ ID NO: 521767 - RNA, 19 nt, Homo sapiens
caagaggugcuuaugcuua

SEQ ID NO: 521768 - RNA, 19 nt, Homo sapiens
aaugauugcugaaguguuu

SEQ ID NO: 521769 - RNA, 19 nt, Homo sapiens
gaaaacacccucuaugaaa

SEQ ID NO: 521770 - RNA, 19 nt, Homo sapiens
gccaaugucugcgaucuuu

SEQ ID NO: 521771 - RNA, 19 nt, Homo sapiens
cuaaaggaguacagcaauu

SEQ ID NO: 521772 - RNA, 19 nt, Homo sapiens
gaaggacucagcuaaagga

SEQ ID NO: 521773 - RNA, 19 nt, Homo sapiens
gaauguguuuggaauaugg

SEQ ID NO: 521774 - RNA, 19 nt, Homo sapiens
aauaaaccaccuacaguua

SEQ ID NO: 521775 - RNA, 19 nt, Homo sapiens
gugaauguguuuggaauau

SEQ ID NO: 521776 - RNA, 19 nt, Homo sapiens
gcguguuucugcaauagua

SEQ ID NO: 521777 - RNA, 19 nt, Homo sapiens
gaugaacccaaucccaaua

SEQ ID NO: 521778 - RNA, 19 nt, Homo sapiens
ccaaaugucuaugcagaug

SEQ ID NO: 521779 - RNA, 19 nt, Homo sapiens
uaaaccaccuacaguuaga

SEQ ID NO: 521780 - RNA, 19 nt, Homo sapiens
ggauggaacauuuaaacuu

SEQ ID NO: 521781 - RNA, 19 nt, Homo sapiens
augccaaguuucagaauua

SEQ ID NO: 521782 - RNA, 19 nt, Homo sapiens
guaccuggguuacuugcaa

SEQ ID NO: 521783 - RNA, 19 nt, Homo sapiens
gcuuuaauuucuucccuuu

SEQ ID NO: 521784 - RNA, 19 nt, Homo sapiens
acuaagaucucagucauau

SEQ ID NO: 521785 - RNA, 19 nt, Homo sapiens
gaagugaauguguuuggaa

SEQ ID NO: 521786 - RNA, 19 nt, Homo sapiens
gaugugucuuccauucuaa

SEQ ID NO: 521787 - RNA, 19 nt, Homo sapiens
cuaugcagaugguaguaua

SEQ ID NO: 521788 - RNA, 19 nt, Homo sapiens
caaauaaaccaccuacagu

SEQ ID NO: 521789 - RNA, 19 nt, Homo sapiens
gaagggagcauagcauauc

SEQ ID NO: 521790 - RNA, 19 nt, Homo sapiens
ugaugugucuuccauucua

SEQ ID NO: 521791 - RNA, 19 nt, Homo sapiens
ggaauauggccuacagaga

SEQ ID NO: 521792 - RNA, 19 nt, Homo sapiens
ccaaguuucagaauuauug

SEQ ID NO: 521793 - RNA, 19 nt, Homo sapiens
gaaacaaauccauguaaac

SEQ ID NO: 521794 - RNA, 19 nt, Homo sapiens
uaacauccauacagucucu

SEQ ID NO: 521795 - RNA, 19 nt, Homo sapiens
acucaauuguccaucuuua

SEQ ID NO: 521796 - RNA, 19 nt, Homo sapiens
gaaggagaaaguugaagga

SEQ ID NO: 521797 - RNA, 19 nt, Homo sapiens
gaaggaggcaugggagcua

SEQ ID NO: 521798 - RNA, 19 nt, Homo sapiens
cuucuacccucuccuuaaa

SEQ ID NO: 521799 - RNA, 19 nt, Homo sapiens
cuacuccugucauuacauu

SEQ ID NO: 521800 - RNA, 19 nt, Homo sapiens
agaacaaacgggaauauga

SEQ ID NO: 521801 - RNA, 19 nt, Homo sapiens
gugcugcccuaagugaaua

SEQ ID NO: 521802 - RNA, 19 nt, Homo sapiens
cagcaauuguaguaacuga

SEQ ID NO: 521803 - RNA, 19 nt, Homo sapiens
ggaagggagcauagcauau

SEQ ID NO: 521804 - RNA, 19 nt, Homo sapiens
uaugaugugucuuccauuc

SEQ ID NO: 521805 - RNA, 19 nt, Homo sapiens
uaaacucaauuguccaucu

SEQ ID NO: 521806 - RNA, 19 nt, Homo sapiens
uuauuggucuucuggguuu

SEQ ID NO: 521807 - RNA, 19 nt, Homo sapiens
uaaaggaguacagcaauug

SEQ ID NO: 521808 - RNA, 19 nt, Homo sapiens
aaagcguguuucugcaaua

SEQ ID NO: 521809 - RNA, 19 nt, Homo sapiens
aaacucaauuguccaucuu

SEQ ID NO: 521810 - RNA, 19 nt, Homo sapiens
aaauaacuguugugcuguu

SEQ ID NO: 521811 - RNA, 19 nt, Homo sapiens
aaauaaaccaccuacaguu

SEQ ID NO: 521812 - RNA, 19 nt, Homo sapiens
gcaauuguaguaacugaca

SEQ ID NO: 521813 - RNA, 19 nt, Homo sapiens
caagaaggagaaaguugaa

SEQ ID NO: 521814 - RNA, 19 nt, Homo sapiens
cauccuggcugguccuuca

SEQ ID NO: 521815 - RNA, 19 nt, Homo sapiens
agauuugucucuaagaugu

SEQ ID NO: 521816 - RNA, 19 nt, Homo sapiens
acugacacauccucucuuu

SEQ ID NO: 521817 - RNA, 19 nt, Homo sapiens
ccaaauaaaccaccuacag

SEQ ID NO: 521818 - RNA, 19 nt, Homo sapiens
ggagaacaaacgggaauau

SEQ ID NO: 521819 - RNA, 19 nt, Homo sapiens
uagcauaucuguggcaaac

SEQ ID NO: 521820 - RNA, 19 nt, Homo sapiens
caugccaaguuucagaauu

SEQ ID NO: 521821 - RNA, 19 nt, Homo sapiens
uggagcuccuuuaaucuuu

SEQ ID NO: 521822 - RNA, 19 nt, Homo sapiens
aguuggagcuccuuuaauc

SEQ ID NO: 521823 - RNA, 19 nt, Homo sapiens
cuacagagaauagaaacaa

SEQ ID NO: 521824 - RNA, 19 nt, Homo sapiens
caaaaugauugcugaagug

SEQ ID NO: 521825 - RNA, 19 nt, Homo sapiens
cacccucuaugaaaucaaa

SEQ ID NO: 521826 - RNA, 19 nt, Homo sapiens
caaccuaugaugugucuuc

SEQ ID NO: 521827 - RNA, 19 nt, Homo sapiens
gauacuaagaucucaguca

SEQ ID NO: 521828 - RNA, 19 nt, Homo sapiens
ccaccuacaguuagauuug

SEQ ID NO: 521829 - RNA, 19 nt, Homo sapiens
uguguuggauuuagaagug

SEQ ID NO: 521830 - RNA, 19 nt, Homo sapiens
gagaacaaacgggaauaug

SEQ ID NO: 521831 - RNA, 19 nt, Homo sapiens
acaaguaacccauguaaaa

SEQ ID NO: 521832 - RNA, 19 nt, Homo sapiens
gagaauagaaacaaaucca

SEQ ID NO: 521833 - RNA, 19 nt, Homo sapiens
ucacuuguguuggauuuag

SEQ ID NO: 521834 - RNA, 19 nt, Homo sapiens
guccuucacuuguguugga

SEQ ID NO: 521835 - RNA, 19 nt, Homo sapiens
gugcuuaugcuuagcuuga

SEQ ID NO: 521836 - RNA, 19 nt, Homo sapiens
cagcaucugagaaccuuaa

SEQ ID NO: 521837 - RNA, 19 nt, Homo sapiens
gcugcaugcuuuaauuucu

SEQ ID NO: 521838 - RNA, 19 nt, Homo sapiens
aguuauugcugcaugcuuu

SEQ ID NO: 521839 - RNA, 19 nt, Homo sapiens
gugaauaaacucaauuguc

SEQ ID NO: 521840 - RNA, 19 nt, Homo sapiens
gcuaaaggaguacagcaau

SEQ ID NO: 521841 - RNA, 19 nt, Homo sapiens
auacuaagaucucagucau

SEQ ID NO: 521842 - RNA, 19 nt, Homo sapiens
aauauggccuacagagaau

SEQ ID NO: 521843 - RNA, 19 nt, Homo sapiens
uaucuguggcaaacuauuu

SEQ ID NO: 521844 - RNA, 19 nt, Homo sapiens
guugaaggacucagcuaaa

SEQ ID NO: 521845 - RNA, 19 nt, Homo sapiens
gagcagaggaauggaaaca

SEQ ID NO: 521846 - RNA, 19 nt, Homo sapiens
aagaggugcuuaugcuuag

SEQ ID NO: 521847 - RNA, 19 nt, Homo sapiens
gaacccaaucccaauaguc

SEQ ID NO: 521848 - RNA, 19 nt, Homo sapiens
ccuaugaugugucuuccau

SEQ ID NO: 521849 - RNA, 19 nt, Homo sapiens
gggagcagaggaauggaaa

SEQ ID NO: 521850 - RNA, 19 nt, Homo sapiens
uacaagaggugcuuaugcu

SEQ ID NO: 521851 - RNA, 19 nt, Homo sapiens
ugacacauccucucuuugc

SEQ ID NO: 521852 - RNA, 19 nt, Homo sapiens
cuucacuuguguuggauuu

SEQ ID NO: 521853 - RNA, 19 nt, Homo sapiens
gcagaugguaguauauguc

SEQ ID NO: 521854 - RNA, 19 nt, Homo sapiens
cagaaaacacccucuauga

SEQ ID NO: 521855 - RNA, 19 nt, Homo sapiens
ggcaagaaggagaaaguug

SEQ ID NO: 521856 - RNA, 19 nt, Homo sapiens
ugaauguguuuggaauaug

SEQ ID NO: 521857 - RNA, 19 nt, Homo sapiens
ggaguccaaccuaugaugu

SEQ ID NO: 521858 - RNA, 19 nt, Homo sapiens
ucacugaagaauauccaaa

SEQ ID NO: 521859 - RNA, 19 nt, Homo sapiens
gaacaaagcuggaaugauu

SEQ ID NO: 521860 - RNA, 19 nt, Homo sapiens
gaauguaccucuauuaguu

SEQ ID NO: 521861 - RNA, 19 nt, Homo sapiens
caagagacuuugucacuua

SEQ ID NO: 521862 - RNA, 19 nt, Homo sapiens
gcaauacccugucuuuaaa

SEQ ID NO: 521863 - RNA, 19 nt, Homo sapiens
gaacugaugcgacuuguuu

SEQ ID NO: 521864 - RNA, 19 nt, Homo sapiens
gcaguggaaugcaguuaua

SEQ ID NO: 521865 - RNA, 19 nt, Homo sapiens
gguagcauauguuuagaua

SEQ ID NO: 521866 - RNA, 19 nt, Homo sapiens
gcagugagcugugauuaug

SEQ ID NO: 521867 - RNA, 19 nt, Homo sapiens
gcacuugccuguagucuca

SEQ ID NO: 521868 - RNA, 19 nt, Homo sapiens
ggagggaaaucuuggugua

SEQ ID NO: 521869 - RNA, 19 nt, Homo sapiens
caucuuaguuuacuggaua

SEQ ID NO: 521870 - RNA, 19 nt, Homo sapiens
guauuuaggccauuuguua

SEQ ID NO: 521871 - RNA, 19 nt, Homo sapiens
caacuggucuguuaaucuu

SEQ ID NO: 521872 - RNA, 19 nt, Homo sapiens
acacagagaacacaaauuu

SEQ ID NO: 521873 - RNA, 19 nt, Homo sapiens
gagacuuugucacuuauuu

SEQ ID NO: 521874 - RNA, 19 nt, Homo sapiens
ggaaugcaguuauauuugg

SEQ ID NO: 521875 - RNA, 19 nt, Homo sapiens
gcaagagacuuugucacuu

SEQ ID NO: 521876 - RNA, 19 nt, Homo sapiens
auacauaacuucagugcaa

SEQ ID NO: 521877 - RNA, 19 nt, Homo sapiens
gcacagcuuuaucaggaaa

SEQ ID NO: 521878 - RNA, 19 nt, Homo sapiens
gaaaucuugguguaacuua

SEQ ID NO: 521879 - RNA, 19 nt, Homo sapiens
uaacaucaauucagucucu

SEQ ID NO: 521880 - RNA, 19 nt, Homo sapiens
gagcugugauuaugccauu

SEQ ID NO: 521881 - RNA, 19 nt, Homo sapiens
caaacgagaauaugagaaa

SEQ ID NO: 521882 - RNA, 19 nt, Homo sapiens
gaacacagagaacacaaau

SEQ ID NO: 521883 - RNA, 19 nt, Homo sapiens
agacauaacugguuugacu

SEQ ID NO: 521884 - RNA, 19 nt, Homo sapiens
caaauaaaccaccaacugu

SEQ ID NO: 521885 - RNA, 19 nt, Homo sapiens
aggcugagguggcagaaua

SEQ ID NO: 521886 - RNA, 19 nt, Homo sapiens
cuacagcuucuauucauua

SEQ ID NO: 521887 - RNA, 19 nt, Homo sapiens
gagaaaggcacauauugga

SEQ ID NO: 521888 - RNA, 19 nt, Homo sapiens
aaaguuguacugcaucuua

SEQ ID NO: 521889 - RNA, 19 nt, Homo sapiens
gcuuguguaucuugauuaa

SEQ ID NO: 521890 - RNA, 19 nt, Homo sapiens
gaugguagcauauguuuag

SEQ ID NO: 521891 - RNA, 19 nt, Homo sapiens
gagcaauacccugucuuua

SEQ ID NO: 521892 - RNA, 19 nt, Homo sapiens
aauaaaccaccaacuguua

SEQ ID NO: 521893 - RNA, 19 nt, Homo sapiens
uguagucucucuaguaguu

SEQ ID NO: 521894 - RNA, 19 nt, Homo sapiens
gaaugcaguuauauuugga

SEQ ID NO: 521895 - RNA, 19 nt, Homo sapiens
uauccuaugccuucaaaua

SEQ ID NO: 521896 - RNA, 19 nt, Homo sapiens
ucacuuauuuccuuaugug

SEQ ID NO: 521897 - RNA, 19 nt, Homo sapiens
guuuagauauccuucagaa

SEQ ID NO: 521898 - RNA, 19 nt, Homo sapiens
ccaaauaaaccaccaacug

SEQ ID NO: 521899 - RNA, 19 nt, Homo sapiens
guggaaugcaguuauauuu

SEQ ID NO: 521900 - RNA, 19 nt, Homo sapiens
gggauaguguuucuguuuc

SEQ ID NO: 521901 - RNA, 19 nt, Homo sapiens
uaugcaacguuuaacauug

SEQ ID NO: 521902 - RNA, 19 nt, Homo sapiens
uguacugcaucuuaguuua

SEQ ID NO: 521903 - RNA, 19 nt, Homo sapiens
acaguuucuucaugcauua

SEQ ID NO: 521904 - RNA, 19 nt, Homo sapiens
ggcaauaucuacagcuucu

SEQ ID NO: 521905 - RNA, 19 nt, Homo sapiens
ggcaacauaauaagacuuu

SEQ ID NO: 521906 - RNA, 19 nt, Homo sapiens
gcaaugcauaucuguuuau

SEQ ID NO: 521907 - RNA, 19 nt, Homo sapiens
ugaauugguuugagaaagg

SEQ ID NO: 521908 - RNA, 19 nt, Homo sapiens
agcaauacccugucuuuaa

SEQ ID NO: 521909 - RNA, 19 nt, Homo sapiens
gaccagccagggcaacaua

SEQ ID NO: 521910 - RNA, 19 nt, Homo sapiens
ccaaauguguaugcugaug

SEQ ID NO: 521911 - RNA, 19 nt, Homo sapiens
ggagggagacgucauugca

SEQ ID NO: 521912 - RNA, 19 nt, Homo sapiens
cagcuucuauucauuaugc

SEQ ID NO: 521913 - RNA, 19 nt, Homo sapiens
caaauuugucgauuacuuc

SEQ ID NO: 521914 - RNA, 19 nt, Homo sapiens
uuagauauccuucagaauc

SEQ ID NO: 521915 - RNA, 19 nt, Homo sapiens
uaauguugguguggaguuu

SEQ ID NO: 521916 - RNA, 19 nt, Homo sapiens
acuaaguuauugcugcaua

SEQ ID NO: 521917 - RNA, 19 nt, Homo sapiens
guguauaauuuaccucuca

SEQ ID NO: 521918 - RNA, 19 nt, Homo sapiens
uccacaaccucuagucuga

SEQ ID NO: 521919 - RNA, 19 nt, Homo sapiens
caacguuuaacauugauug

SEQ ID NO: 521920 - RNA, 19 nt, Homo sapiens
ggagggagacgggauagug

SEQ ID NO: 521921 - RNA, 19 nt, Homo sapiens
cagccagggcaacauaaua

SEQ ID NO: 521922 - RNA, 19 nt, Homo sapiens
uuuaaucuccugaguugua

SEQ ID NO: 521923 - RNA, 19 nt, Homo sapiens
ggaaaacaaacgagaauau

SEQ ID NO: 521924 - RNA, 19 nt, Homo sapiens
augcaacguuuaacauuga

SEQ ID NO: 521925 - RNA, 19 nt, Homo sapiens
gagggaaaucuugguguaa

SEQ ID NO: 521926 - RNA, 19 nt, Homo sapiens
gcacauauuggagggaaau

SEQ ID NO: 521927 - RNA, 19 nt, Homo sapiens
guaccucuauuaguuucaa

SEQ ID NO: 521928 - RNA, 19 nt, Homo sapiens
aagcuuguguaucuugauu

SEQ ID NO: 521929 - RNA, 19 nt, Homo sapiens
cgggauaguguuucuguuu

SEQ ID NO: 521930 - RNA, 19 nt, Homo sapiens
caauaucuacagcuucuau

SEQ ID NO: 521931 - RNA, 19 nt, Homo sapiens
gagacgggauaguguuucu

SEQ ID NO: 521932 - RNA, 19 nt, Homo sapiens
uacaguuucuucaugcauu

SEQ ID NO: 521933 - RNA, 19 nt, Homo sapiens
guccaacucuguauuuagg

SEQ ID NO: 521934 - RNA, 19 nt, Homo sapiens
gucucuagcucuccaucua

SEQ ID NO: 521935 - RNA, 19 nt, Homo sapiens
gaauagcuuaugccuagga

SEQ ID NO: 521936 - RNA, 19 nt, Homo sapiens
gccaugagcagagaacuga

SEQ ID NO: 521937 - RNA, 19 nt, Homo sapiens
aaauaaaccaccaacuguu

SEQ ID NO: 521938 - RNA, 19 nt, Homo sapiens
gggagacgggauaguguuu

SEQ ID NO: 521939 - RNA, 19 nt, Homo sapiens
caaguaaauucuguugaac

SEQ ID NO: 521940 - RNA, 19 nt, Homo sapiens
ggccauuuguuacaguuuc

SEQ ID NO: 521941 - RNA, 19 nt, Homo sapiens
gagguggcagaauagcuua

SEQ ID NO: 521942 - RNA, 19 nt, Homo sapiens
ggcaaaggcgggaggauca

SEQ ID NO: 521943 - RNA, 19 nt, Homo sapiens
uguguagucucucuaguag

SEQ ID NO: 521944 - RNA, 19 nt, Homo sapiens
ggaaaucuugguguaacuu

SEQ ID NO: 521945 - RNA, 19 nt, Homo sapiens
cuucaugcauuacuuacug

SEQ ID NO: 521946 - RNA, 19 nt, Homo sapiens
gacaacuggucuguuaauc

SEQ ID NO: 521947 - RNA, 19 nt, Homo sapiens
gaguuucggccauuguuga

SEQ ID NO: 521948 - RNA, 19 nt, Homo sapiens
ggaggcucaugcgggauuu

SEQ ID NO: 521949 - RNA, 19 nt, Homo sapiens
aaacaaacgagaauaugag

SEQ ID NO: 521950 - RNA, 19 nt, Homo sapiens
agagcaauacccugucuuu

SEQ ID NO: 521951 - RNA, 19 nt, Homo sapiens
ugagaaaggcacauauugg

SEQ ID NO: 521952 - RNA, 19 nt, Homo sapiens
uaguugaauugguuugaga

SEQ ID NO: 521953 - RNA, 19 nt, Homo sapiens
gagaacugaugcgacuugu

SEQ ID NO: 521954 - RNA, 19 nt, Homo sapiens
cuuauuuccuuaugugugu

SEQ ID NO: 521955 - RNA, 19 nt, Homo sapiens
gaaaacaaacgagaauaug

SEQ ID NO: 521956 - RNA, 19 nt, Homo sapiens
uagauauccuucagaaucg

SEQ ID NO: 521957 - RNA, 19 nt, Homo sapiens
gccuucaaauaguauagaa

SEQ ID NO: 521958 - RNA, 19 nt, Homo sapiens
gaguaauucuagacauaac

SEQ ID NO: 521959 - RNA, 19 nt, Homo sapiens
gaaaugaucuuuacacugu

SEQ ID NO: 521960 - RNA, 19 nt, Homo sapiens
ggaaguauuugucucgaua

SEQ ID NO: 521961 - RNA, 19 nt, Homo sapiens
gagaauggacucagaaaua

SEQ ID NO: 521962 - RNA, 19 nt, Homo sapiens
caacagacaugcaagagaa

SEQ ID NO: 521963 - RNA, 19 nt, Homo sapiens
guagauugauugcagauuu

SEQ ID NO: 521964 - RNA, 19 nt, Homo sapiens
gcacaaaucuauaaaucag

SEQ ID NO: 521965 - RNA, 19 nt, Homo sapiens
gcaagagaauggacucaga

SEQ ID NO: 521966 - RNA, 19 nt, Homo sapiens
gaagaggauucagaaagaa

SEQ ID NO: 521967 - RNA, 19 nt, Homo sapiens
gcauugagaaagacauuua

SEQ ID NO: 521968 - RNA, 19 nt, Homo sapiens
ugaauuaauugcacugcua

SEQ ID NO: 521969 - RNA, 19 nt, Homo sapiens
guaggaagauguguaacuu

SEQ ID NO: 521970 - RNA, 19 nt, Homo sapiens
cccaacggcugauaauuaa

SEQ ID NO: 521971 - RNA, 19 nt, Homo sapiens
gaucuacaaugcagcugaa

SEQ ID NO: 521972 - RNA, 19 nt, Homo sapiens
agaauggacucagaaauau

SEQ ID NO: 521973 - RNA, 19 nt, Homo sapiens
gaaagaauugagugaucua

SEQ ID NO: 521974 - RNA, 19 nt, Homo sapiens
guccauauguucucuacuu

SEQ ID NO: 521975 - RNA, 19 nt, Homo sapiens
gguggagucuucuuucuca

SEQ ID NO: 521976 - RNA, 19 nt, Homo sapiens
cagaaagaauugagugauc

SEQ ID NO: 521977 - RNA, 19 nt, Homo sapiens
uaaguaggaagauguguaa

SEQ ID NO: 521978 - RNA, 19 nt, Homo sapiens
uaauugcacugcuaaguag

SEQ ID NO: 521979 - RNA, 19 nt, Homo sapiens
caacauuagcaguaaauug

SEQ ID NO: 521980 - RNA, 19 nt, Homo sapiens
gaauuaauugcacugcuaa

SEQ ID NO: 521981 - RNA, 19 nt, Homo sapiens
ccaugaaaccauuugauuu

SEQ ID NO: 521982 - RNA, 19 nt, Homo sapiens
uaccagauauugcacaaau

SEQ ID NO: 521983 - RNA, 19 nt, Homo sapiens
ugagcacuguuuacuguuu

SEQ ID NO: 521984 - RNA, 19 nt, Homo sapiens
cauauguucucuacuuugu

SEQ ID NO: 521985 - RNA, 19 nt, Homo sapiens
uauguucucuacuuuguga

SEQ ID NO: 521986 - RNA, 19 nt, Homo sapiens
guauuugucucgauauucu

SEQ ID NO: 521987 - RNA, 19 nt, Homo sapiens
cauccaaacauaaacagua

SEQ ID NO: 521988 - RNA, 19 nt, Homo sapiens
uaaauguguuucugaagca

SEQ ID NO: 521989 - RNA, 19 nt, Homo sapiens
uuaauugcacugcuaagua

SEQ ID NO: 521990 - RNA, 19 nt, Homo sapiens
gcacugcuaaguaggaaga

SEQ ID NO: 521991 - RNA, 19 nt, Homo sapiens
uacuguauguguugucuaa

SEQ ID NO: 521992 - RNA, 19 nt, Homo sapiens
gagcacuguuuacuguuuc

SEQ ID NO: 521993 - RNA, 19 nt, Homo sapiens
cauaaacaguaauggaagu

SEQ ID NO: 521994 - RNA, 19 nt, Homo sapiens
ugugggagaugacuuguuc

SEQ ID NO: 521995 - RNA, 19 nt, Homo sapiens
ccauggcgcugaagaggau

SEQ ID NO: 521996 - RNA, 19 nt, Homo sapiens
cuuaggauauucuguagau

SEQ ID NO: 521997 - RNA, 19 nt, Homo sapiens
caagagaauggacucagaa

SEQ ID NO: 521998 - RNA, 19 nt, Homo sapiens
ccaaacauaaacaguaaug

SEQ ID NO: 521999 - RNA, 19 nt, Homo sapiens
aggauauucuguagauuga

SEQ ID NO: 522000 - RNA, 19 nt, Homo sapiens
caucugcaucuucagcuua

SEQ ID NO: 522001 - RNA, 19 nt, Homo sapiens
uagauugauugcagauuuc

SEQ ID NO: 522002 - RNA, 19 nt, Homo sapiens
caacggcugauaauuaagu

SEQ ID NO: 522003 - RNA, 19 nt, Homo sapiens
aaaauacccuuaagacugu

SEQ ID NO: 522004 - RNA, 19 nt, Homo sapiens
ggacucagaaauaugcaau

SEQ ID NO: 522005 - RNA, 19 nt, Homo sapiens
gaauggacucagaaauaug

SEQ ID NO: 522006 - RNA, 19 nt, Homo sapiens
caccagcucugacuguauc

SEQ ID NO: 522007 - RNA, 19 nt, Homo sapiens
uaggauauucuguagauug

SEQ ID NO: 522008 - RNA, 19 nt, Homo sapiens
cuaaguaggaagaugugua

SEQ ID NO: 522009 - RNA, 19 nt, Homo sapiens
gauuauggagaaacacuug

SEQ ID NO: 522010 - RNA, 19 nt, Homo sapiens
cacuguaauucucagcaua

SEQ ID NO: 522011 - RNA, 19 nt, Homo sapiens
cugaaaagcaaccaaauua

SEQ ID NO: 522012 - RNA, 19 nt, Homo sapiens
ugucuuaggauauucugua

SEQ ID NO: 522013 - RNA, 19 nt, Homo sapiens
agaaagaauugagugaucu

SEQ ID NO: 522014 - RNA, 19 nt, Homo sapiens
ugucuaagaugucaguuuu

SEQ ID NO: 522015 - RNA, 19 nt, Homo sapiens
gauauucugaggucacaau

SEQ ID NO: 522016 - RNA, 19 nt, Homo sapiens
gaaguauuugucucgauau

SEQ ID NO: 522017 - RNA, 19 nt, Homo sapiens
ggaagauguguaacuuuua

SEQ ID NO: 522018 - RNA, 19 nt, Homo sapiens
cagcuuacaagaucuacaa

SEQ ID NO: 522019 - RNA, 19 nt, Homo sapiens
ucaagguggagucuucuuu

SEQ ID NO: 522020 - RNA, 19 nt, Homo sapiens
caaugcagcugaaaagcaa

SEQ ID NO: 522021 - RNA, 19 nt, Homo sapiens
aagauugcuuucacaacaa

SEQ ID NO: 522022 - RNA, 19 nt, Homo sapiens
cuuacaagaucuacaaugc

SEQ ID NO: 522023 - RNA, 19 nt, Homo sapiens
acuguuuacuguuucauug

SEQ ID NO: 522024 - RNA, 19 nt, Homo sapiens
agaauugagugaucuacag

SEQ ID NO: 522025 - RNA, 19 nt, Homo sapiens
agauugcuuucacaacaaa

SEQ ID NO: 522026 - RNA, 19 nt, Homo sapiens
guaugucaacucauuacuu

SEQ ID NO: 522027 - RNA, 19 nt, Homo sapiens
acucagaaauaugcaaugu

SEQ ID NO: 522028 - RNA, 19 nt, Homo sapiens
caagguggagucuucuuuc

SEQ ID NO: 522029 - RNA, 19 nt, Homo sapiens
uccauauguucucuacuuu

SEQ ID NO: 522030 - RNA, 19 nt, Homo sapiens
cgauccaccugcucacugu

SEQ ID NO: 522031 - RNA, 19 nt, Homo sapiens
cauguaugucaacucauua

SEQ ID NO: 522032 - RNA, 19 nt, Homo sapiens
cuguauguguugucuaaga

SEQ ID NO: 522033 - RNA, 19 nt, Homo sapiens
guaauggaaguauuugucu

SEQ ID NO: 522034 - RNA, 19 nt, Homo sapiens
cgacagauuauccuuuuaa

SEQ ID NO: 522035 - RNA, 19 nt, Homo sapiens
ucccuugucuuaggauauu

SEQ ID NO: 522036 - RNA, 19 nt, Homo sapiens
agacugugaugagagcauu

SEQ ID NO: 522037 - RNA, 19 nt, Homo sapiens
ccuuaagacugugaugaga

SEQ ID NO: 522038 - RNA, 19 nt, Homo sapiens
uaauccagaugaccccuua

SEQ ID NO: 522039 - RNA, 19 nt, Homo sapiens
aggaagauguguaacuuuu

SEQ ID NO: 522040 - RNA, 19 nt, Homo sapiens
auugagcacuguuuacugu

SEQ ID NO: 522041 - RNA, 19 nt, Homo sapiens
gagagcauuuaucauuuug

SEQ ID NO: 522042 - RNA, 19 nt, Homo sapiens
aaauacaacagacaugcaa

SEQ ID NO: 522043 - RNA, 19 nt, Homo sapiens
agucuucuuucucacugua

SEQ ID NO: 522044 - RNA, 19 nt, Homo sapiens
ccccaacggcugauaauua

SEQ ID NO: 522045 - RNA, 19 nt, Homo sapiens
auaucaagguggagucuuc

SEQ ID NO: 522046 - RNA, 19 nt, Homo sapiens
uuggacaucugcaucuuca

SEQ ID NO: 522047 - RNA, 19 nt, Homo sapiens
uuguaugcauugagaaaga

SEQ ID NO: 522048 - RNA, 19 nt, Homo sapiens
uccuguauaggcaauauua

SEQ ID NO: 522049 - RNA, 19 nt, Homo sapiens
uaggaagauguguaacuuu

SEQ ID NO: 522050 - RNA, 19 nt, Homo sapiens
uuuaaaccaccaaagauug

SEQ ID NO: 522051 - RNA, 19 nt, Homo sapiens
cugugucucccuugucuua

SEQ ID NO: 522052 - RNA, 19 nt, Homo sapiens
uauguguugucuaagaugu

SEQ ID NO: 522053 - RNA, 19 nt, Homo sapiens
ccagaguacuguaaaaucu

SEQ ID NO: 522054 - RNA, 19 nt, Homo sapiens
uguauguguugucuaagau

SEQ ID NO: 522055 - RNA, 19 nt, Homo sapiens
ccauauguucucuacuuug

SEQ ID NO: 522056 - RNA, 19 nt, Homo sapiens
cagcucugacuguaucaaa

SEQ ID NO: 522057 - RNA, 19 nt, Homo sapiens
cugaaaugaucuuuacacu

SEQ ID NO: 522058 - RNA, 19 nt, Homo sapiens
gcugaaaagcaaccaaauu

SEQ ID NO: 522059 - RNA, 19 nt, Homo sapiens
uggauaaccucuacaaaua

SEQ ID NO: 522060 - RNA, 19 nt, Homo sapiens
gagaugauauguuccauug

SEQ ID NO: 522061 - RNA, 19 nt, Homo sapiens
ggaauggacucagaaguau

SEQ ID NO: 522062 - RNA, 19 nt, Homo sapiens
gggaauggacucagaagua

SEQ ID NO: 522063 - RNA, 19 nt, Homo sapiens
caauccagaugauccuuua

SEQ ID NO: 522064 - RNA, 19 nt, Homo sapiens
gaaguaugcgauguaauua

SEQ ID NO: 522065 - RNA, 19 nt, Homo sapiens
gaagagaauccacaaggaa

SEQ ID NO: 522066 - RNA, 19 nt, Homo sapiens
cagaauagcucgggaaugg

SEQ ID NO: 522067 - RNA, 19 nt, Homo sapiens
ggauaaccucuacaaauaa

SEQ ID NO: 522068 - RNA, 19 nt, Homo sapiens
gcauuugucuugauauucu

SEQ ID NO: 522069 - RNA, 19 nt, Homo sapiens
cagcauuugucuugauauu

SEQ ID NO: 522070 - RNA, 19 nt, Homo sapiens
agaaguaugcgauguaauu

SEQ ID NO: 522071 - RNA, 19 nt, Homo sapiens
ucagaaguaugcgauguaa

SEQ ID NO: 522072 - RNA, 19 nt, Homo sapiens
caaaugacagucccuauca

SEQ ID NO: 522073 - RNA, 19 nt, Homo sapiens
ggcagcauuugucuugaua

SEQ ID NO: 522074 - RNA, 19 nt, Homo sapiens
ugaagagaauccacaagga

SEQ ID NO: 522075 - RNA, 19 nt, Homo sapiens
gcucgggaauggacucaga

SEQ ID NO: 522076 - RNA, 19 nt, Homo sapiens
aaaguacucuuguccaucu

SEQ ID NO: 522077 - RNA, 19 nt, Homo sapiens
cuaucaggguggaguauuu

SEQ ID NO: 522078 - RNA, 19 nt, Homo sapiens
guccaucuguucucuguug

SEQ ID NO: 522079 - RNA, 19 nt, Homo sapiens
caaaacagauagagaaaag

SEQ ID NO: 522080 - RNA, 19 nt, Homo sapiens
ucuguucucuguuguguga

SEQ ID NO: 522081 - RNA, 19 nt, Homo sapiens
gacaauucauuucccaaca

SEQ ID NO: 522082 - RNA, 19 nt, Homo sapiens
caauucauuucccaacaga

SEQ ID NO: 522083 - RNA, 19 nt, Homo sapiens
cacaaggaauugaaugauc

SEQ ID NO: 522084 - RNA, 19 nt, Homo sapiens
gagaauccacaaggaauug

SEQ ID NO: 522085 - RNA, 19 nt, Homo sapiens
acaaggaauugaaugaucu

SEQ ID NO: 522086 - RNA, 19 nt, Homo sapiens
ggagaugauauguuccauu

SEQ ID NO: 522087 - RNA, 19 nt, Homo sapiens
gauauucuacgaucacagu

SEQ ID NO: 522088 - RNA, 19 nt, Homo sapiens
uguuggagaugauauguuc

SEQ ID NO: 522089 - RNA, 19 nt, Homo sapiens
guacucuuguccaucuguu

SEQ ID NO: 522090 - RNA, 19 nt, Homo sapiens
uuggcaagcuacaauaaug

SEQ ID NO: 522091 - RNA, 19 nt, Homo sapiens
ccaaaugacagucccuauc

SEQ ID NO: 522092 - RNA, 19 nt, Homo sapiens
caucuguucucuguugugu

SEQ ID NO: 522093 - RNA, 19 nt, Homo sapiens
gaaaaguacaacagaauag

SEQ ID NO: 522094 - RNA, 19 nt, Homo sapiens
caaaaguacucuuguccau

SEQ ID NO: 522095 - RNA, 19 nt, Homo sapiens
gaauccacaaggaauugaa

SEQ ID NO: 522096 - RNA, 19 nt, Homo sapiens
gaauggacucagaaguaug

SEQ ID NO: 522097 - RNA, 19 nt, Homo sapiens
cagcacuaacuauuucaaa

SEQ ID NO: 522098 - RNA, 19 nt, Homo sapiens
ccaauccagaugauccuuu

SEQ ID NO: 522099 - RNA, 19 nt, Homo sapiens
caucacaccauggcucuga

SEQ ID NO: 522100 - RNA, 19 nt, Homo sapiens
cuccagcacuaacuauuuc

SEQ ID NO: 522101 - RNA, 19 nt, Homo sapiens
uuggauaaccucuacaaau

SEQ ID NO: 522102 - RNA, 19 nt, Homo sapiens
ucuccagcacuaacuauuu

SEQ ID NO: 522103 - RNA, 19 nt, Homo sapiens
ccacaaggaauugaaugau

SEQ ID NO: 522104 - RNA, 19 nt, Homo sapiens
gagaaaaguacaacagaau

SEQ ID NO: 522105 - RNA, 19 nt, Homo sapiens
cuacaaaacagauagagaa

SEQ ID NO: 522106 - RNA, 19 nt, Homo sapiens
agagaauccacaaggaauu

SEQ ID NO: 522107 - RNA, 19 nt, Homo sapiens
agagaaaaguacaacagaa

SEQ ID NO: 522108 - RNA, 19 nt, Homo sapiens
acaauucauuucccaacag

SEQ ID NO: 522109 - RNA, 19 nt, Homo sapiens
uggcagcauuugucuugau

SEQ ID NO: 522110 - RNA, 19 nt, Homo sapiens
aagagaauccacaaggaau

SEQ ID NO: 522111 - RNA, 19 nt, Homo sapiens
uccagaugauccuuuagug

SEQ ID NO: 522112 - RNA, 19 nt, Homo sapiens
ggucaccgcaucacaccau

SEQ ID NO: 522113 - RNA, 19 nt, Homo sapiens
ggaaugaccuguucuuguu

SEQ ID NO: 522114 - RNA, 19 nt, Homo sapiens
gaugagugaucaacuaaua

SEQ ID NO: 522115 - RNA, 19 nt, Homo sapiens
gauuugagguuacaugaua

SEQ ID NO: 522116 - RNA, 19 nt, Homo sapiens
ggagauggaugcucaguug

SEQ ID NO: 522117 - RNA, 19 nt, Homo sapiens
gccaaugucuucacucuaa

SEQ ID NO: 522118 - RNA, 19 nt, Homo sapiens
cagcauccauucuuguuua

SEQ ID NO: 522119 - RNA, 19 nt, Homo sapiens
aaauggagcauguguauua

SEQ ID NO: 522120 - RNA, 19 nt, Homo sapiens
ggaauggacucagaaguau

SEQ ID NO: 522121 - RNA, 19 nt, Homo sapiens
gcucuaacaugcugaagaa

SEQ ID NO: 522122 - RNA, 19 nt, Homo sapiens
gcgcugaaacggauuaaua

SEQ ID NO: 522123 - RNA, 19 nt, Homo sapiens
gcuuggagcuauuaguuaa

SEQ ID NO: 522124 - RNA, 19 nt, Homo sapiens
gggaauggacucagaagua

SEQ ID NO: 522125 - RNA, 19 nt, Homo sapiens
gaauaaaugaugcaaguug

SEQ ID NO: 522126 - RNA, 19 nt, Homo sapiens
aauagggucucaaacauuu

SEQ ID NO: 522127 - RNA, 19 nt, Homo sapiens
ugaaacggauuaauaagga

SEQ ID NO: 522128 - RNA, 19 nt, Homo sapiens
ugauguggcuggagaauug

SEQ ID NO: 522129 - RNA, 19 nt, Homo sapiens
uggcagagcuggugugaga

SEQ ID NO: 522130 - RNA, 19 nt, Homo sapiens
gaauggaaauuggaaguca

SEQ ID NO: 522131 - RNA, 19 nt, Homo sapiens
gagguuacaugauaugcuu

SEQ ID NO: 522132 - RNA, 19 nt, Homo sapiens
ucagaaguaugccauguga

SEQ ID NO: 522133 - RNA, 19 nt, Homo sapiens
gaaacggauuaauaaggaa

SEQ ID NO: 522134 - RNA, 19 nt, Homo sapiens
caaaggauacagcauuauu

SEQ ID NO: 522135 - RNA, 19 nt, Homo sapiens
gcucaguugucacaucaaa

SEQ ID NO: 522136 - RNA, 19 nt, Homo sapiens
gacaauaacugcuuuuaga

SEQ ID NO: 522137 - RNA, 19 nt, Homo sapiens
gaacagaaaaugugaugua

SEQ ID NO: 522138 - RNA, 19 nt, Homo sapiens
gccaugugaugcuaccuua

SEQ ID NO: 522139 - RNA, 19 nt, Homo sapiens
cagaauaucucgggaaugg

SEQ ID NO: 522140 - RNA, 19 nt, Homo sapiens
aaacagacagagauaagua

SEQ ID NO: 522141 - RNA, 19 nt, Homo sapiens
gcauuugucucgauauucu

SEQ ID NO: 522142 - RNA, 19 nt, Homo sapiens
ggauacagcauuauucuag

SEQ ID NO: 522143 - RNA, 19 nt, Homo sapiens
ggccggaccuuugagcaua

SEQ ID NO: 522144 - RNA, 19 nt, Homo sapiens
uguuagagauuugagguua

SEQ ID NO: 522145 - RNA, 19 nt, Homo sapiens
agagauaaguacaacagaa

SEQ ID NO: 522146 - RNA, 19 nt, Homo sapiens
cagcauuugucucgauauu

SEQ ID NO: 522147 - RNA, 19 nt, Homo sapiens
caucaaaggauacagcauu

SEQ ID NO: 522148 - RNA, 19 nt, Homo sapiens
guugucacaucaaaggaua

SEQ ID NO: 522149 - RNA, 19 nt, Homo sapiens
gaugcaaguugucaaugga

SEQ ID NO: 522150 - RNA, 19 nt, Homo sapiens
uguauuauguggccaaugu

SEQ ID NO: 522151 - RNA, 19 nt, Homo sapiens
cuacagagaauggaaauug

SEQ ID NO: 522152 - RNA, 19 nt, Homo sapiens
gcaugucaauaaaggaaug

SEQ ID NO: 522153 - RNA, 19 nt, Homo sapiens
uuuaagccuuccacuguua

SEQ ID NO: 522154 - RNA, 19 nt, Homo sapiens
gagaacaguugcccaagac

SEQ ID NO: 522155 - RNA, 19 nt, Homo sapiens
ccacaauuaugggaccuaa

SEQ ID NO: 522156 - RNA, 19 nt, Homo sapiens
cuaacaugcugaagaaauc

SEQ ID NO: 522157 - RNA, 19 nt, Homo sapiens
uuaccucccuccauucauu

SEQ ID NO: 522158 - RNA, 19 nt, Homo sapiens
gagauaaguacaacagaau

SEQ ID NO: 522159 - RNA, 19 nt, Homo sapiens
caauaaaguugcauaaacc

SEQ ID NO: 522160 - RNA, 19 nt, Homo sapiens
gagcauacaccgagagagu

SEQ ID NO: 522161 - RNA, 19 nt, Homo sapiens
cuuaaguucuuccagcuuu

SEQ ID NO: 522162 - RNA, 19 nt, Homo sapiens
auaaaggaaugaccuguuc

SEQ ID NO: 522163 - RNA, 19 nt, Homo sapiens
gauggaugcucaguuguca

SEQ ID NO: 522164 - RNA, 19 nt, Homo sapiens
gagauuugagguuacauga

SEQ ID NO: 522165 - RNA, 19 nt, Homo sapiens
ggcagcauuugucucgaua

SEQ ID NO: 522166 - RNA, 19 nt, Homo sapiens
cugaauaaaugaugcaagu

SEQ ID NO: 522167 - RNA, 19 nt, Homo sapiens
aucaaaggauacagcauua

SEQ ID NO: 522168 - RNA, 19 nt, Homo sapiens
agagaacaguugcccaaga

SEQ ID NO: 522169 - RNA, 19 nt, Homo sapiens
ccuaucagaccucaucuuu

SEQ ID NO: 522170 - RNA, 19 nt, Homo sapiens
gucagaauaaccugcauua

SEQ ID NO: 522171 - RNA, 19 nt, Homo sapiens
gaaauuggaagucaaacac

SEQ ID NO: 522172 - RNA, 19 nt, Homo sapiens
ggaaauuggaagucaaaca

SEQ ID NO: 522173 - RNA, 19 nt, Homo sapiens
gcaaguugucaauggauga

SEQ ID NO: 522174 - RNA, 19 nt, Homo sapiens
gcuggagaauugguauuga

SEQ ID NO: 522175 - RNA, 19 nt, Homo sapiens
gguuacaugauaugcuuua

SEQ ID NO: 522176 - RNA, 19 nt, Homo sapiens
caugugaugcuaccuuaaa

SEQ ID NO: 522177 - RNA, 19 nt, Homo sapiens
ucacaguggucgccugcuu

SEQ ID NO: 522178 - RNA, 19 nt, Homo sapiens
gcauacaccgagagaguga

SEQ ID NO: 522179 - RNA, 19 nt, Homo sapiens
gcagcauccauucuuguuu

SEQ ID NO: 522180 - RNA, 19 nt, Homo sapiens
uggagcauguguauuaugu

SEQ ID NO: 522181 - RNA, 19 nt, Homo sapiens
guuuaagccuuccacuguu

SEQ ID NO: 522182 - RNA, 19 nt, Homo sapiens
caucugagaagacuuaagu

SEQ ID NO: 522183 - RNA, 19 nt, Homo sapiens
gcucugcuaguaauugauu

SEQ ID NO: 522184 - RNA, 19 nt, Homo sapiens
caaaauagggucucaaaca

SEQ ID NO: 522185 - RNA, 19 nt, Homo sapiens
gaccuguucuuguucuaca

SEQ ID NO: 522186 - RNA, 19 nt, Homo sapiens
uacaugauaugcuuuaugc

SEQ ID NO: 522187 - RNA, 19 nt, Homo sapiens
gucaauggaugagugauca

SEQ ID NO: 522188 - RNA, 19 nt, Homo sapiens
aaauagggucucaaacauu

SEQ ID NO: 522189 - RNA, 19 nt, Homo sapiens
agaaguaugccaugugaug

SEQ ID NO: 522190 - RNA, 19 nt, Homo sapiens
ucgccugcuuuaacaauuu

SEQ ID NO: 522191 - RNA, 19 nt, Homo sapiens
gagaauggaaauuggaagu

SEQ ID NO: 522192 - RNA, 19 nt, Homo sapiens
cuaaugacagcccauauca

SEQ ID NO: 522193 - RNA, 19 nt, Homo sapiens
agacagagauaaguacaac

SEQ ID NO: 522194 - RNA, 19 nt, Homo sapiens
cuggagaauugguauugaa

SEQ ID NO: 522195 - RNA, 19 nt, Homo sapiens
cuagcagcauccauucuug

SEQ ID NO: 522196 - RNA, 19 nt, Homo sapiens
ccgggauaaucaagaguuu

SEQ ID NO: 522197 - RNA, 19 nt, Homo sapiens
ggcuuggagcuauuaguua

SEQ ID NO: 522198 - RNA, 19 nt, Homo sapiens
uuaggaggcuuggagcuau

SEQ ID NO: 522199 - RNA, 19 nt, Homo sapiens
gcccaagacucagaauuuu

SEQ ID NO: 522200 - RNA, 19 nt, Homo sapiens
ugcccaagacucagaauuu

SEQ ID NO: 522201 - RNA, 19 nt, Homo sapiens
acaguggucgccugcuuua

SEQ ID NO: 522202 - RNA, 19 nt, Homo sapiens
uaaaugaugcaaguuguca

SEQ ID NO: 522203 - RNA, 19 nt, Homo sapiens
gauauucuaagaucacagu

SEQ ID NO: 522204 - RNA, 19 nt, Homo sapiens
ugaugcaaguugucaaugg

SEQ ID NO: 522205 - RNA, 19 nt, Homo sapiens
gugaggagccagacgacaa

SEQ ID NO: 522206 - RNA, 19 nt, Homo sapiens
auggaugagugaucaacua

SEQ ID NO: 522207 - RNA, 19 nt, Homo sapiens
cgcugaaacggauuaauaa

SEQ ID NO: 522208 - RNA, 19 nt, Homo sapiens
gaccuaaugacagcccaua

SEQ ID NO: 522209 - RNA, 19 nt, Homo sapiens
guggucgccugcuuuaaca

SEQ ID NO: 522210 - RNA, 19 nt, Homo sapiens
uaggaggcuuggagcuauu

SEQ ID NO: 522211 - RNA, 19 nt, Homo sapiens
guuaggaggcuuggagcua

SEQ ID NO: 522212 - RNA, 19 nt, Homo sapiens
cgacaagcacacacuaugg

SEQ ID NO: 522213 - RNA, 19 nt, Homo sapiens
gaagagagcugcuuaugau

SEQ ID NO: 522214 - RNA, 19 nt, Homo sapiens
gagauacgcuacauaaauu

SEQ ID NO: 522215 - RNA, 19 nt, Homo sapiens
ggacaagaaucuaucauug

SEQ ID NO: 522216 - RNA, 19 nt, Homo sapiens
ugaaauaccuuaagcuguu

SEQ ID NO: 522217 - RNA, 19 nt, Homo sapiens
gaaauaccuuaagcuguua

SEQ ID NO: 522218 - RNA, 19 nt, Homo sapiens
gaagggaacauugauauuu

SEQ ID NO: 522219 - RNA, 19 nt, Homo sapiens
uuacacauauggccauuua

SEQ ID NO: 522220 - RNA, 19 nt, Homo sapiens
caagagauacgcuacauaa

SEQ ID NO: 522221 - RNA, 19 nt, Homo sapiens
caaaggcgauaacaucuau

SEQ ID NO: 522222 - RNA, 19 nt, Homo sapiens
gaaaaccuguagugaaaua

SEQ ID NO: 522223 - RNA, 19 nt, Homo sapiens
gcgauaacaucuaugaaug

SEQ ID NO: 522224 - RNA, 19 nt, Homo sapiens
uaagguaucuugcuacagu

SEQ ID NO: 522225 - RNA, 19 nt, Homo sapiens
gcacuaaccauuucuaaag

SEQ ID NO: 522226 - RNA, 19 nt, Homo sapiens
ccaagaagaaggagaguaa

SEQ ID NO: 522227 - RNA, 19 nt, Homo sapiens
gguaaagaguaggguauuu

SEQ ID NO: 522228 - RNA, 19 nt, Homo sapiens
gagcagaacaugacagaau

SEQ ID NO: 522229 - RNA, 19 nt, Homo sapiens
gguguauucuuucucgaua

SEQ ID NO: 522230 - RNA, 19 nt, Homo sapiens
ccaagagaauucagaagga

SEQ ID NO: 522231 - RNA, 19 nt, Homo sapiens
guagacagaauugguaaua

SEQ ID NO: 522232 - RNA, 19 nt, Homo sapiens
ucuaucugcucacuucuua

SEQ ID NO: 522233 - RNA, 19 nt, Homo sapiens
gauaacaucuaugaaugga

SEQ ID NO: 522234 - RNA, 19 nt, Homo sapiens
gacaguggaccaagagaua

SEQ ID NO: 522235 - RNA, 19 nt, Homo sapiens
guaugagggugguguauuc

SEQ ID NO: 522236 - RNA, 19 nt, Homo sapiens
gagaguaaagucagcauga

SEQ ID NO: 522237 - RNA, 19 nt, Homo sapiens
gugaaaaccuguagugaaa

SEQ ID NO: 522238 - RNA, 19 nt, Homo sapiens
gccaaucuacuuuguuuaa

SEQ ID NO: 522239 - RNA, 19 nt, Homo sapiens
gcuuguagucuguaaauuu

SEQ ID NO: 522240 - RNA, 19 nt, Homo sapiens
gaaguauugccacucagua

SEQ ID NO: 522241 - RNA, 19 nt, Homo sapiens
ugagggugguguauucuuu

SEQ ID NO: 522242 - RNA, 19 nt, Homo sapiens
cuacuuaagucugcauuug

SEQ ID NO: 522243 - RNA, 19 nt, Homo sapiens
ggaagggaacauugauauu

SEQ ID NO: 522244 - RNA, 19 nt, Homo sapiens
ugucauuaguucugcaaua

SEQ ID NO: 522245 - RNA, 19 nt, Homo sapiens
agaguaggguauuucuaua

SEQ ID NO: 522246 - RNA, 19 nt, Homo sapiens
gaguaggguauuucuauaa

SEQ ID NO: 522247 - RNA, 19 nt, Homo sapiens
caacagagcagaacaugac

SEQ ID NO: 522248 - RNA, 19 nt, Homo sapiens
agaaggagcuggcggacau

SEQ ID NO: 522249 - RNA, 19 nt, Homo sapiens
guggauugguucuauguug

SEQ ID NO: 522250 - RNA, 19 nt, Homo sapiens
gcuuggacauauugaaaga

SEQ ID NO: 522251 - RNA, 19 nt, Homo sapiens
guuauuugcuuggacauau

SEQ ID NO: 522252 - RNA, 19 nt, Homo sapiens
cagcaaaccgagaaagaaa

SEQ ID NO: 522253 - RNA, 19 nt, Homo sapiens
gagagcugcuuaugauuuu

SEQ ID NO: 522254 - RNA, 19 nt, Homo sapiens
gaagaaggagaguaaaguc

SEQ ID NO: 522255 - RNA, 19 nt, Homo sapiens
gucauuaguucugcaauau

SEQ ID NO: 522256 - RNA, 19 nt, Homo sapiens
cuucaagccuccaaagguu

SEQ ID NO: 522257 - RNA, 19 nt, Homo sapiens
agagauacgcuacauaaau

SEQ ID NO: 522258 - RNA, 19 nt, Homo sapiens
ugaaucaggacuugugaaa

SEQ ID NO: 522259 - RNA, 19 nt, Homo sapiens
agagaugaguagugcguuu

SEQ ID NO: 522260 - RNA, 19 nt, Homo sapiens
ccucuaagacuacauacuu

SEQ ID NO: 522261 - RNA, 19 nt, Homo sapiens
agagagcugcuuaugauuu

SEQ ID NO: 522262 - RNA, 19 nt, Homo sapiens
gguucuauguuguggacua

SEQ ID NO: 522263 - RNA, 19 nt, Homo sapiens
ggugggaguugguaaagag

SEQ ID NO: 522264 - RNA, 19 nt, Homo sapiens
gcaaaccgagaaagaaaca

SEQ ID NO: 522265 - RNA, 19 nt, Homo sapiens
ccaaaggcgauaacaucua

SEQ ID NO: 522266 - RNA, 19 nt, Homo sapiens
guagugaaauaccuuaagc

SEQ ID NO: 522267 - RNA, 19 nt, Homo sapiens
guaaagaguaggguauuuc

SEQ ID NO: 522268 - RNA, 19 nt, Homo sapiens
agaagagagcugcuuauga

SEQ ID NO: 522269 - RNA, 19 nt, Homo sapiens
uggcggacaucacuuuaga

SEQ ID NO: 522270 - RNA, 19 nt, Homo sapiens
uguaaggcguggaauagga

SEQ ID NO: 522271 - RNA, 19 nt, Homo sapiens
cggaggagccagacacaaa

SEQ ID NO: 522272 - RNA, 19 nt, Homo sapiens
guccagcacuaaccauuuc

SEQ ID NO: 522273 - RNA, 19 nt, Homo sapiens
ugguacagguuacacauau

SEQ ID NO: 522274 - RNA, 19 nt, Homo sapiens
ccaagagauacgcuacaua

SEQ ID NO: 522275 - RNA, 19 nt, Homo sapiens
gucaagguguuauuugcuu

SEQ ID NO: 522276 - RNA, 19 nt, Homo sapiens
aaaccgagaaagaaacaaa

SEQ ID NO: 522277 - RNA, 19 nt, Homo sapiens
guaggguauuucuauaaca

SEQ ID NO: 522278 - RNA, 19 nt, Homo sapiens
gccagacaguggaccaaga

SEQ ID NO: 522279 - RNA, 19 nt, Homo sapiens
guauugccacucaguauau

SEQ ID NO: 522280 - RNA, 19 nt, Homo sapiens
ggcgauaacaucuaugaau

SEQ ID NO: 522281 - RNA, 19 nt, Homo sapiens
augccaaucuacuuuguuu

SEQ ID NO: 522282 - RNA, 19 nt, Homo sapiens
aagaguaggguauuucuau

SEQ ID NO: 522283 - RNA, 19 nt, Homo sapiens
gggaguugguaaagaguag

SEQ ID NO: 522284 - RNA, 19 nt, Homo sapiens
cacagaagagagcugcuua

SEQ ID NO: 522285 - RNA, 19 nt, Homo sapiens
gguacagguuacacauaug

SEQ ID NO: 522286 - RNA, 19 nt, Homo sapiens
acaguagacagaauuggua

SEQ ID NO: 522287 - RNA, 19 nt, Homo sapiens
ggaaguauugccacucagu

SEQ ID NO: 522288 - RNA, 19 nt, Homo sapiens
aagguuacauuucggacaa

SEQ ID NO: 522289 - RNA, 19 nt, Homo sapiens
acuuaagucugcauuuguu

SEQ ID NO: 522290 - RNA, 19 nt, Homo sapiens
agacagaauugguaauagc

SEQ ID NO: 522291 - RNA, 19 nt, Homo sapiens
uugcagugcuggucccaaa

SEQ ID NO: 522292 - RNA, 19 nt, Homo sapiens
ccagcaaaccgagaaagaa

SEQ ID NO: 522293 - RNA, 19 nt, Homo sapiens
cagcacuaaccauuucuaa

SEQ ID NO: 522294 - RNA, 19 nt, Homo sapiens
ucaguugcuuguagucugu

SEQ ID NO: 522295 - RNA, 19 nt, Homo sapiens
ccauauaagagaugaguag

SEQ ID NO: 522296 - RNA, 19 nt, Homo sapiens
guacagguuacacauaugg

SEQ ID NO: 522297 - RNA, 19 nt, Homo sapiens
ggguauuucuauaacagau

SEQ ID NO: 522298 - RNA, 19 nt, Homo sapiens
gagggugggaguugguaaa

SEQ ID NO: 522299 - RNA, 19 nt, Homo sapiens
cagaagagagcugcuuaug

SEQ ID NO: 522300 - RNA, 19 nt, Homo sapiens
cacuaaccauuucuaaagu

SEQ ID NO: 522301 - RNA, 19 nt, Homo sapiens
cggacaagaaucuaucauu

SEQ ID NO: 522302 - RNA, 19 nt, Homo sapiens
ggagccagacacaaagaga

SEQ ID NO: 522303 - RNA, 19 nt, Homo sapiens
cucuaagacuacauacuuu

SEQ ID NO: 522304 - RNA, 19 nt, Homo sapiens
uauguaaagucccucuaag

SEQ ID NO: 522305 - RNA, 19 nt, Homo sapiens
gcaauauuagcugaaaugu

SEQ ID NO: 522306 - RNA, 19 nt, Homo sapiens
gguucgcuaugucggauga

SEQ ID NO: 522307 - RNA, 19 nt, Homo sapiens
ggaggagccagacacaaag

SEQ ID NO: 522308 - RNA, 19 nt, Homo sapiens
ugggaaguauugccacuca

SEQ ID NO: 522309 - RNA, 19 nt, Homo sapiens
ggaguugcucaguggauug

SEQ ID NO: 522310 - RNA, 19 nt, Homo sapiens
ggaauaggaguugcucagu

SEQ ID NO: 522311 - RNA, 19 nt, Homo sapiens
uggaagggaacauugauau

SEQ ID NO: 522312 - RNA, 19 nt, Homo sapiens
gcuggcggacaucacuuua

SEQ ID NO: 522313 - RNA, 19 nt, Homo sapiens
gcuacaggcuuucuacuua

SEQ ID NO: 522314 - RNA, 19 nt, Homo sapiens
gcuaguaacuucacuuauu

SEQ ID NO: 522315 - RNA, 19 nt, Homo sapiens
gaacugggcugcaauaaaa

SEQ ID NO: 522316 - RNA, 19 nt, Homo sapiens
ggaaguagucuuuggcuua

SEQ ID NO: 522317 - RNA, 19 nt, Homo sapiens
acaaagaaauugcgaugua

SEQ ID NO: 522318 - RNA, 19 nt, Homo sapiens
cuacuuaacuucuggguuu

SEQ ID NO: 522319 - RNA, 19 nt, Homo sapiens
gaagacagcuggcagaacu

SEQ ID NO: 522320 - RNA, 19 nt, Homo sapiens
ggauagaacuugagacagu

SEQ ID NO: 522321 - RNA, 19 nt, Homo sapiens
gaaaugcuuuggcagaaga

SEQ ID NO: 522322 - RNA, 19 nt, Homo sapiens
ggaauucugucaccuuaug

SEQ ID NO: 522323 - RNA, 19 nt, Homo sapiens
gcacccaccucuuggauug

SEQ ID NO: 522324 - RNA, 19 nt, Homo sapiens
ucauguacauccacaaaua

SEQ ID NO: 522325 - RNA, 19 nt, Homo sapiens
gcacccaaauguugauaaa

SEQ ID NO: 522326 - RNA, 19 nt, Homo sapiens
gaugggaaguccuuauuau

SEQ ID NO: 522327 - RNA, 19 nt, Homo sapiens
gaugggacaugguguuuga

SEQ ID NO: 522328 - RNA, 19 nt, Homo sapiens
gaaguagucuuuggcuuau

SEQ ID NO: 522329 - RNA, 19 nt, Homo sapiens
gacaagagccuaacaagug

SEQ ID NO: 522330 - RNA, 19 nt, Homo sapiens
gcauuucuauucuucauga

SEQ ID NO: 522331 - RNA, 19 nt, Homo sapiens
guauagaucccgucacuaa

SEQ ID NO: 522332 - RNA, 19 nt, Homo sapiens
guaaagaccuguacauagc

SEQ ID NO: 522333 - RNA, 19 nt, Homo sapiens
gagaaaugcuuuggcagaa

SEQ ID NO: 522334 - RNA, 19 nt, Homo sapiens
ccagagaagugguuuagga

SEQ ID NO: 522335 - RNA, 19 nt, Homo sapiens
gggaagauaaguaugguua

SEQ ID NO: 522336 - RNA, 19 nt, Homo sapiens
gauagaacuugagacagua

SEQ ID NO: 522337 - RNA, 19 nt, Homo sapiens
guacauagcacaacaugau

SEQ ID NO: 522338 - RNA, 19 nt, Homo sapiens
guggaaaccaucaugauua

SEQ ID NO: 522339 - RNA, 19 nt, Homo sapiens
caaagaaauugcgauguau

SEQ ID NO: 522340 - RNA, 19 nt, Homo sapiens
ucucauacccuucuccuua

SEQ ID NO: 522341 - RNA, 19 nt, Homo sapiens
caacaugauccggauaaua

SEQ ID NO: 522342 - RNA, 19 nt, Homo sapiens
gagggaagauagaaaugga

SEQ ID NO: 522343 - RNA, 19 nt, Homo sapiens
ggugaugugugcauuucua

SEQ ID NO: 522344 - RNA, 19 nt, Homo sapiens
gaaaccaucaugauuagug

SEQ ID NO: 522345 - RNA, 19 nt, Homo sapiens
cuacaggcuuucuacuuaa

SEQ ID NO: 522346 - RNA, 19 nt, Homo sapiens
ggaacugggcugcaauaaa

SEQ ID NO: 522347 - RNA, 19 nt, Homo sapiens
uauaagggauagaacuuga

SEQ ID NO: 522348 - RNA, 19 nt, Homo sapiens
agacucaccugcuaauguu

SEQ ID NO: 522349 - RNA, 19 nt, Homo sapiens
gcagaagagugaaagaacu

SEQ ID NO: 522350 - RNA, 19 nt, Homo sapiens
caaacaauagcaaaucuga

SEQ ID NO: 522351 - RNA, 19 nt, Homo sapiens
ggccauggcaguauaugua

SEQ ID NO: 522352 - RNA, 19 nt, Homo sapiens
gggaaguccuuauuauugg

SEQ ID NO: 522353 - RNA, 19 nt, Homo sapiens
ucucuuaccugccagaaug

SEQ ID NO: 522354 - RNA, 19 nt, Homo sapiens
ggacaugguguuugauugu

SEQ ID NO: 522355 - RNA, 19 nt, Homo sapiens
gcacucuacccaccuauug

SEQ ID NO: 522356 - RNA, 19 nt, Homo sapiens
gaagauagaaauggagaau

SEQ ID NO: 522357 - RNA, 19 nt, Homo sapiens
ggaugugauuaauguuuga

SEQ ID NO: 522358 - RNA, 19 nt, Homo sapiens
gaaugaaggcuauaauacu

SEQ ID NO: 522359 - RNA, 19 nt, Homo sapiens
caauaaaacaugccaguua

SEQ ID NO: 522360 - RNA, 19 nt, Homo sapiens
caacuucagcaaaugguaa

SEQ ID NO: 522361 - RNA, 19 nt, Homo sapiens
gagaagugguuuaggaaaa

SEQ ID NO: 522362 - RNA, 19 nt, Homo sapiens
aaaguugcccgcuguguaa

SEQ ID NO: 522363 - RNA, 19 nt, Homo sapiens
gaaagaacuccugccaaga

SEQ ID NO: 522364 - RNA, 19 nt, Homo sapiens
caauagcaaaucugacuuu

SEQ ID NO: 522365 - RNA, 19 nt, Homo sapiens
uacagaugauuacgcauuu

SEQ ID NO: 522366 - RNA, 19 nt, Homo sapiens
cagcuaguaacuucacuua

SEQ ID NO: 522367 - RNA, 19 nt, Homo sapiens
ccagaccucuacaaacguu

SEQ ID NO: 522368 - RNA, 19 nt, Homo sapiens
gcccagaccucuacaaacg

SEQ ID NO: 522369 - RNA, 19 nt, Homo sapiens
gggacaugguguuugauug

SEQ ID NO: 522370 - RNA, 19 nt, Homo sapiens
uaucuagauucuucuguga

SEQ ID NO: 522371 - RNA, 19 nt, Homo sapiens
aaacaugccaguuaucaau

SEQ ID NO: 522372 - RNA, 19 nt, Homo sapiens
uaacaauaguacacuugga

SEQ ID NO: 522373 - RNA, 19 nt, Homo sapiens
guugauuccuuaugcaaau

SEQ ID NO: 522374 - RNA, 19 nt, Homo sapiens
ccucuucaguugccuggua

SEQ ID NO: 522375 - RNA, 19 nt, Homo sapiens
gagacucaccugcuaaugu

SEQ ID NO: 522376 - RNA, 19 nt, Homo sapiens
gagcccagaccucuacaaa

SEQ ID NO: 522377 - RNA, 19 nt, Homo sapiens
aguagucuuuggcuuauaa

SEQ ID NO: 522378 - RNA, 19 nt, Homo sapiens
aaugaaggcuauaauacug

SEQ ID NO: 522379 - RNA, 19 nt, Homo sapiens
guagugaguucuuccaaaa

SEQ ID NO: 522380 - RNA, 19 nt, Homo sapiens
gaugugugcauuucuauuc

SEQ ID NO: 522381 - RNA, 19 nt, Homo sapiens
cgaugggaaguccuuauua

SEQ ID NO: 522382 - RNA, 19 nt, Homo sapiens
gguguuugauugugagaau

SEQ ID NO: 522383 - RNA, 19 nt, Homo sapiens
gaucccgucacuaacaaua

SEQ ID NO: 522384 - RNA, 19 nt, Homo sapiens
ucaguugccugguauuaag

SEQ ID NO: 522385 - RNA, 19 nt, Homo sapiens
gaaggagucaucacuaggu

SEQ ID NO: 522386 - RNA, 19 nt, Homo sapiens
gcacaacaugauccggaua

SEQ ID NO: 522387 - RNA, 19 nt, Homo sapiens
uugcuggacuucuguugua

SEQ ID NO: 522388 - RNA, 19 nt, Homo sapiens
ccagauacacuuuaugaag

SEQ ID NO: 522389 - RNA, 19 nt, Homo sapiens
gaaaucuggcacccaaaug

SEQ ID NO: 522390 - RNA, 19 nt, Homo sapiens
guuguuggcuuuuauugua

SEQ ID NO: 522391 - RNA, 19 nt, Homo sapiens
uuggaauucugucaccuua

SEQ ID NO: 522392 - RNA, 19 nt, Homo sapiens
aacaugauccggauaauau

SEQ ID NO: 522393 - RNA, 19 nt, Homo sapiens
uaauguugaugcugcgaaa

SEQ ID NO: 522394 - RNA, 19 nt, Homo sapiens
gcagaugggacaugguguu

SEQ ID NO: 522395 - RNA, 19 nt, Homo sapiens
acacuuggaugugauuaau

SEQ ID NO: 522396 - RNA, 19 nt, Homo sapiens
ggcaguauauguauuuggu

SEQ ID NO: 522397 - RNA, 19 nt, Homo sapiens
ugggaaguccuuauuauug

SEQ ID NO: 522398 - RNA, 19 nt, Homo sapiens
uggaaaccaucaugauuag

SEQ ID NO: 522399 - RNA, 19 nt, Homo sapiens
gauuaauguuugagcuuca

SEQ ID NO: 522400 - RNA, 19 nt, Homo sapiens
aaugaagcaugcacagcua

SEQ ID NO: 522401 - RNA, 19 nt, Homo sapiens
uuaagcaugucagaugaaa

SEQ ID NO: 522402 - RNA, 19 nt, Homo sapiens
aauggagacucaccugcua

SEQ ID NO: 522403 - RNA, 19 nt, Homo sapiens
ggguaaaugcuuugcuauu

SEQ ID NO: 522404 - RNA, 19 nt, Homo sapiens
caccuuauguagugaguuc

SEQ ID NO: 522405 - RNA, 19 nt, Homo sapiens
augcacagcuacaggcuuu

SEQ ID NO: 522406 - RNA, 19 nt, Homo sapiens
ccucuuggauuggauauag

SEQ ID NO: 522407 - RNA, 19 nt, Homo sapiens
gaauggagggaagauagaa

SEQ ID NO: 522408 - RNA, 19 nt, Homo sapiens
cauggcaguauauguauuu

SEQ ID NO: 522409 - RNA, 19 nt, Homo sapiens
uguagugaguucuuccaaa

SEQ ID NO: 522410 - RNA, 19 nt, Homo sapiens
uggaugugauuaauguuug

SEQ ID NO: 522411 - RNA, 19 nt, Homo sapiens
ugaaugaaggcuauaauac

SEQ ID NO: 522412 - RNA, 19 nt, Homo sapiens
uguauugaaugaaggcuau

SEQ ID NO: 522413 - RNA, 19 nt, Homo sapiens
gaagacaccugcuuugagu

SEQ ID NO: 522414 - RNA, 19 nt, Homo sapiens
uuacaaaccaucacacuua

SEQ ID NO: 522415 - RNA, 19 nt, Homo sapiens
gagcaguucuauaagauug

SEQ ID NO: 522416 - RNA, 19 nt, Homo sapiens
acaaagggcuucagguaga

SEQ ID NO: 522417 - RNA, 19 nt, Homo sapiens
gacuuaaugucgaauauug

SEQ ID NO: 522418 - RNA, 19 nt, Homo sapiens
gaaaugggguaaauagaaa

SEQ ID NO: 522419 - RNA, 19 nt, Homo sapiens
ccaagcagaucguccagaa

SEQ ID NO: 522420 - RNA, 19 nt, Homo sapiens
gcagaugcuuuucuuauaa

SEQ ID NO: 522421 - RNA, 19 nt, Homo sapiens
aaacaggcuucucuucuga

SEQ ID NO: 522422 - RNA, 19 nt, Homo sapiens
ucacaaagggcuucaggua

SEQ ID NO: 522423 - RNA, 19 nt, Homo sapiens
caaacaggcuucucuucug

SEQ ID NO: 522424 - RNA, 19 nt, Homo sapiens
gcucugugcugguaccaaa

SEQ ID NO: 522425 - RNA, 19 nt, Homo sapiens
gaugggagagucugcauuu

SEQ ID NO: 522426 - RNA, 19 nt, Homo sapiens
gaaauuuauugcugauugg

SEQ ID NO: 522427 - RNA, 19 nt, Homo sapiens
uuucaaaccuuuccuacuu

SEQ ID NO: 522428 - RNA, 19 nt, Homo sapiens
caacagagcgagacucagu

SEQ ID NO: 522429 - RNA, 19 nt, Homo sapiens
gagaccauccuggcuaaua

SEQ ID NO: 522430 - RNA, 19 nt, Homo sapiens
gggagcaguucuauaagau

SEQ ID NO: 522431 - RNA, 19 nt, Homo sapiens
caaaccaucacacuuagaa

SEQ ID NO: 522432 - RNA, 19 nt, Homo sapiens
caaggcagguagaucacaa

SEQ ID NO: 522433 - RNA, 19 nt, Homo sapiens
caugaggaguccauuacuu

SEQ ID NO: 522434 - RNA, 19 nt, Homo sapiens
ucuauaagauugccaagca

SEQ ID NO: 522435 - RNA, 19 nt, Homo sapiens
gugaugcucugugcuggua

SEQ ID NO: 522436 - RNA, 19 nt, Homo sapiens
ggccgaguacaaacaauua

SEQ ID NO: 522437 - RNA, 19 nt, Homo sapiens
ccacuugauuacccguuaa

SEQ ID NO: 522438 - RNA, 19 nt, Homo sapiens
gguuguaccugccagacuu

SEQ ID NO: 522439 - RNA, 19 nt, Homo sapiens
ccaagcagcucagcauucu

SEQ ID NO: 522440 - RNA, 19 nt, Homo sapiens
cgggagcaguucuauaaga

SEQ ID NO: 522441 - RNA, 19 nt, Homo sapiens
gugcacgccuguagucuca

SEQ ID NO: 522442 - RNA, 19 nt, Homo sapiens
ggaguccauuacuuccuuu

SEQ ID NO: 522443 - RNA, 19 nt, Homo sapiens
gcugauggccgaguacaaa

SEQ ID NO: 522444 - RNA, 19 nt, Homo sapiens
ggaguccugugcagagugu

SEQ ID NO: 522445 - RNA, 19 nt, Homo sapiens
gagauuuaccugugagaug

SEQ ID NO: 522446 - RNA, 19 nt, Homo sapiens
gcaggagaaucgcuugaac

SEQ ID NO: 522447 - RNA, 19 nt, Homo sapiens
ggcagaugcuuuucuuaua

SEQ ID NO: 522448 - RNA, 19 nt, Homo sapiens
gaucacaaggucaggaaau

SEQ ID NO: 522449 - RNA, 19 nt, Homo sapiens
uuacaguauuccucacaaa

SEQ ID NO: 522450 - RNA, 19 nt, Homo sapiens
ugaguuucccacuugauua

SEQ ID NO: 522451 - RNA, 19 nt, Homo sapiens
cuuccuuucuuccuucaua

SEQ ID NO: 522452 - RNA, 19 nt, Homo sapiens
gggagagucugcauuucca

SEQ ID NO: 522453 - RNA, 19 nt, Homo sapiens
gcgaugaccgggagcaguu

SEQ ID NO: 522454 - RNA, 19 nt, Homo sapiens
agacaccugcuuugaguuu

SEQ ID NO: 522455 - RNA, 19 nt, Homo sapiens
cagaagacaccugcuuuga

SEQ ID NO: 522456 - RNA, 19 nt, Homo sapiens
gaaaccccaugucugcuaa

SEQ ID NO: 522457 - RNA, 19 nt, Homo sapiens
cacaaggucaggaaauuga

SEQ ID NO: 522458 - RNA, 19 nt, Homo sapiens
guccauuacuuccuuucuu

SEQ ID NO: 522459 - RNA, 19 nt, Homo sapiens
caaagggcuucagguagau

SEQ ID NO: 522460 - RNA, 19 nt, Homo sapiens
gaugacuuaaugucgaaua

SEQ ID NO: 522461 - RNA, 19 nt, Homo sapiens
aaaccuuuccuacuucaaa

SEQ ID NO: 522462 - RNA, 19 nt, Homo sapiens
ggagcaguucuauaagauu

SEQ ID NO: 522463 - RNA, 19 nt, Homo sapiens
ccagaagacaccugcuuug

SEQ ID NO: 522464 - RNA, 19 nt, Homo sapiens
ggccaaggcagguagauca

SEQ ID NO: 522465 - RNA, 19 nt, Homo sapiens
gaauauugacagcuuacug

SEQ ID NO: 522466 - RNA, 19 nt, Homo sapiens
ucaaaccuuuccuacuuca

SEQ ID NO: 522467 - RNA, 19 nt, Homo sapiens
gaucaugggcccagaagac

SEQ ID NO: 522468 - RNA, 19 nt, Homo sapiens
gucgaauauugacagcuua

SEQ ID NO: 522469 - RNA, 19 nt, Homo sapiens
ugacgaaaguggagcuaac

SEQ ID NO: 522470 - RNA, 19 nt, Homo sapiens
agauuuaccugugagaugu

SEQ ID NO: 522471 - RNA, 19 nt, Homo sapiens
acaggcuucucuucugaaa

SEQ ID NO: 522472 - RNA, 19 nt, Homo sapiens
uacaaaccaucacacuuag

SEQ ID NO: 522473 - RNA, 19 nt, Homo sapiens
gacgauggaauacccagaa

SEQ ID NO: 522474 - RNA, 19 nt, Homo sapiens
cccacuugauuacccguua

SEQ ID NO: 522475 - RNA, 19 nt, Homo sapiens
ccccaugucugcuaaaauu

SEQ ID NO: 522476 - RNA, 19 nt, Homo sapiens
ggcuucagguagauuauca

SEQ ID NO: 522477 - RNA, 19 nt, Homo sapiens
ccuguaaucccagcucuuu

SEQ ID NO: 522478 - RNA, 19 nt, Homo sapiens
ucaaacaggcuucucuucu

SEQ ID NO: 522479 - RNA, 19 nt, Homo sapiens
ucacaaggucaggaaauug

SEQ ID NO: 522480 - RNA, 19 nt, Homo sapiens
agaugagauuuaccuguga

SEQ ID NO: 522481 - RNA, 19 nt, Homo sapiens
accgggagcaguucuauaa

SEQ ID NO: 522482 - RNA, 19 nt, Homo sapiens
gaccgggagcaguucuaua

SEQ ID NO: 522483 - RNA, 19 nt, Homo sapiens
cauccugaguuucccacuu

SEQ ID NO: 522484 - RNA, 19 nt, Homo sapiens
agaccauccuggcuaauac

SEQ ID NO: 522485 - RNA, 19 nt, Homo sapiens
uugagaccauccuggcuaa

SEQ ID NO: 522486 - RNA, 19 nt, Homo sapiens
gucaggaaauugagaccau

SEQ ID NO: 522487 - RNA, 19 nt, Homo sapiens
accaucacacuuagaaaua

SEQ ID NO: 522488 - RNA, 19 nt, Homo sapiens
uccauuacuuccuuucuuc

SEQ ID NO: 522489 - RNA, 19 nt, Homo sapiens
gcagagcccaaugacgaaa

SEQ ID NO: 522490 - RNA, 19 nt, Homo sapiens
cgaguacaaacaauuaaca

SEQ ID NO: 522491 - RNA, 19 nt, Homo sapiens
ccaucacacuuagaaauac

SEQ ID NO: 522492 - RNA, 19 nt, Homo sapiens
agaggcugauggccgagua

SEQ ID NO: 522493 - RNA, 19 nt, Homo sapiens
ggcaacagagcgagacuca

SEQ ID NO: 522494 - RNA, 19 nt, Homo sapiens
ccaaagaugagauuuaccu

SEQ ID NO: 522495 - RNA, 19 nt, Homo sapiens
gccaagcagcucagcauuc

SEQ ID NO: 522496 - RNA, 19 nt, Homo sapiens
gacaccugcuuugaguuug

SEQ ID NO: 522497 - RNA, 19 nt, Homo sapiens
gauggccgaguacaaacaa

SEQ ID NO: 522498 - RNA, 19 nt, Homo sapiens
aagcagaucguccagaagu

SEQ ID NO: 522499 - RNA, 19 nt, Homo sapiens
aaguggagcuaacguggau

SEQ ID NO: 522500 - RNA, 19 nt, Homo sapiens
caucacacuuagaaauacu

SEQ ID NO: 522501 - RNA, 19 nt, Homo sapiens
caaggucaggaaauugaga

SEQ ID NO: 522502 - RNA, 19 nt, Homo sapiens
caugaaugaagagaacuuu

SEQ ID NO: 522503 - RNA, 19 nt, Homo sapiens
gccgaguacaaacaauuaa

SEQ ID NO: 522504 - RNA, 19 nt, Homo sapiens
uagauuaucagagcuguca

SEQ ID NO: 522505 - RNA, 19 nt, Homo sapiens
acagcuuacugcaguuuua

SEQ ID NO: 522506 - RNA, 19 nt, Homo sapiens
uuccugccauccugaguuu

SEQ ID NO: 522507 - RNA, 19 nt, Homo sapiens
gcagaucguccagaagucu

SEQ ID NO: 522508 - RNA, 19 nt, Homo sapiens
cccagaagacaccugcuuu

SEQ ID NO: 522509 - RNA, 19 nt, Homo sapiens
uaagaaaugggguaaauag

SEQ ID NO: 522510 - RNA, 19 nt, Homo sapiens
ugacagcuuacugcaguuu

SEQ ID NO: 522511 - RNA, 19 nt, Homo sapiens
auccugaguuucccacuug

SEQ ID NO: 522512 - RNA, 19 nt, Homo sapiens
gcccagaagacaccugcuu

SEQ ID NO: 522513 - RNA, 19 nt, Homo sapiens
ggaaauagccgcucugaua

SEQ ID NO: 522514 - RNA, 19 nt, Homo sapiens
ggaccuaccugauaaauac

SEQ ID NO: 522515 - RNA, 19 nt, Homo sapiens
uuagaaagguugcagauuu

SEQ ID NO: 522516 - RNA, 19 nt, Homo sapiens
ggacagcucucuaugaucu

SEQ ID NO: 522517 - RNA, 19 nt, Homo sapiens
gaagcagacuauaauauuc

SEQ ID NO: 522518 - RNA, 19 nt, Homo sapiens
aagaguacauccagaaaua

SEQ ID NO: 522519 - RNA, 19 nt, Homo sapiens
gcagggagcuaauuaagag

SEQ ID NO: 522520 - RNA, 19 nt, Homo sapiens
gggaggacuuaaugaauuu

SEQ ID NO: 522521 - RNA, 19 nt, Homo sapiens
gaguggaccuaccugauaa

SEQ ID NO: 522522 - RNA, 19 nt, Homo sapiens
cuacugaacugucgaagga

SEQ ID NO: 522523 - RNA, 19 nt, Homo sapiens
uaaagcagggagcuaauua

SEQ ID NO: 522524 - RNA, 19 nt, Homo sapiens
gauauggaguuguaguaga

SEQ ID NO: 522525 - RNA, 19 nt, Homo sapiens
ggaacugugugucuagaug

SEQ ID NO: 522526 - RNA, 19 nt, Homo sapiens
gaaauagccgcucugauag

SEQ ID NO: 522527 - RNA, 19 nt, Homo sapiens
gaagaugaggcccaggaua

SEQ ID NO: 522528 - RNA, 19 nt, Homo sapiens
gagaagcagacuauaauau

SEQ ID NO: 522529 - RNA, 19 nt, Homo sapiens
ggcggaguauggaaaguua

SEQ ID NO: 522530 - RNA, 19 nt, Homo sapiens
caagucagccugugugcua

SEQ ID NO: 522531 - RNA, 19 nt, Homo sapiens
cauagcauauucccacauu

SEQ ID NO: 522532 - RNA, 19 nt, Homo sapiens
ggacagcacaggaggagaa

SEQ ID NO: 522533 - RNA, 19 nt, Homo sapiens
ugggaggacuuaaugaauu

SEQ ID NO: 522534 - RNA, 19 nt, Homo sapiens
caugagaagcagacuauaa

SEQ ID NO: 522535 - RNA, 19 nt, Homo sapiens
ggacgaugcuuccucucau

SEQ ID NO: 522536 - RNA, 19 nt, Homo sapiens
gcaauaugcggucugaaug

SEQ ID NO: 522537 - RNA, 19 nt, Homo sapiens
gagaguaaacaugagguua

SEQ ID NO: 522538 - RNA, 19 nt, Homo sapiens
caucggagccagccaugua

SEQ ID NO: 522539 - RNA, 19 nt, Homo sapiens
guauaaagcagggagcuaa

SEQ ID NO: 522540 - RNA, 19 nt, Homo sapiens
cccaggauauggaguugua

SEQ ID NO: 522541 - RNA, 19 nt, Homo sapiens
guagcaauaugcggucuga

SEQ ID NO: 522542 - RNA, 19 nt, Homo sapiens
caaaacacaugcagaguca

SEQ ID NO: 522543 - RNA, 19 nt, Homo sapiens
ucaagcucaucgagaguaa

SEQ ID NO: 522544 - RNA, 19 nt, Homo sapiens
ggaguuacaguauaaagca

SEQ ID NO: 522545 - RNA, 19 nt, Homo sapiens
ugagaagcagacuauaaua

SEQ ID NO: 522546 - RNA, 19 nt, Homo sapiens
uaaagaguacauccagaaa

SEQ ID NO: 522547 - RNA, 19 nt, Homo sapiens
agaguggaccuaccugaua

SEQ ID NO: 522548 - RNA, 19 nt, Homo sapiens
ccacaaggaacaccauaug

SEQ ID NO: 522549 - RNA, 19 nt, Homo sapiens
ggaggaggcgcugaaagaa

SEQ ID NO: 522550 - RNA, 19 nt, Homo sapiens
acagcucucuaugaucuua

SEQ ID NO: 522551 - RNA, 19 nt, Homo sapiens
acaaggaacaccauaugaa

SEQ ID NO: 522552 - RNA, 19 nt, Homo sapiens
ccugauaaauacccuuuca

SEQ ID NO: 522553 - RNA, 19 nt, Homo sapiens
gauagguagaugugaguaa

SEQ ID NO: 522554 - RNA, 19 nt, Homo sapiens
ggacuuaaugaauuuguag

SEQ ID NO: 522555 - RNA, 19 nt, Homo sapiens
gggagcuaauuaagaguau

SEQ ID NO: 522556 - RNA, 19 nt, Homo sapiens
ugaggugcauagcauauuc

SEQ ID NO: 522557 - RNA, 19 nt, Homo sapiens
auauggaguuguaguagaa

SEQ ID NO: 522558 - RNA, 19 nt, Homo sapiens
caaggaacaccauaugaag

SEQ ID NO: 522559 - RNA, 19 nt, Homo sapiens
gaacugugugucuagaugu

SEQ ID NO: 522560 - RNA, 19 nt, Homo sapiens
ggagcuaauuaagaguauu

SEQ ID NO: 522561 - RNA, 19 nt, Homo sapiens
auagguagaugugaguaaa

SEQ ID NO: 522562 - RNA, 19 nt, Homo sapiens
uuaaagaguacauccagaa

SEQ ID NO: 522563 - RNA, 19 nt, Homo sapiens
gugaaauccagaccuguuu

SEQ ID NO: 522564 - RNA, 19 nt, Homo sapiens
ccaauauauuugaguccuu

SEQ ID NO: 522565 - RNA, 19 nt, Homo sapiens
gaugaagcgucaggaacug

SEQ ID NO: 522566 - RNA, 19 nt, Homo sapiens
aaauaugaggguuguguuu

SEQ ID NO: 522567 - RNA, 19 nt, Homo sapiens
uaugucuucuguggaguua

SEQ ID NO: 522568 - RNA, 19 nt, Homo sapiens
aaccagcucuuggauguga

SEQ ID NO: 522569 - RNA, 19 nt, Homo sapiens
aagaugaggcccaggauau

SEQ ID NO: 522570 - RNA, 19 nt, Homo sapiens
cggaggaggcgcugaaaga

SEQ ID NO: 522571 - RNA, 19 nt, Homo sapiens
gucaggaacugugugucua

SEQ ID NO: 522572 - RNA, 19 nt, Homo sapiens
ccgcuacccugaacuuaag

SEQ ID NO: 522573 - RNA, 19 nt, Homo sapiens
cauauucccacauuccauu

SEQ ID NO: 522574 - RNA, 19 nt, Homo sapiens
ggagccagccauguaagaa

SEQ ID NO: 522575 - RNA, 19 nt, Homo sapiens
ccaaagaaacaaaccaaac

SEQ ID NO: 522576 - RNA, 19 nt, Homo sapiens
cuugauuucuuggucauuu

SEQ ID NO: 522577 - RNA, 19 nt, Homo sapiens
cccuuuagaucuugauuuc

SEQ ID NO: 522578 - RNA, 19 nt, Homo sapiens
aggaggcgcugaaagaaca

SEQ ID NO: 522579 - RNA, 19 nt, Homo sapiens
cagaagaauacaagcagaa

SEQ ID NO: 522580 - RNA, 19 nt, Homo sapiens
aaagcagggagcuaauuaa

SEQ ID NO: 522581 - RNA, 19 nt, Homo sapiens
aaacaaaccaaaccaacca

SEQ ID NO: 522582 - RNA, 19 nt, Homo sapiens
gaccacaaggaacaccaua

SEQ ID NO: 522583 - RNA, 19 nt, Homo sapiens
guauugugcuuagaaaggu

SEQ ID NO: 522584 - RNA, 19 nt, Homo sapiens
gaaaguuagaguggaccua

SEQ ID NO: 522585 - RNA, 19 nt, Homo sapiens
acccugaacuuaagagcuu

SEQ ID NO: 522586 - RNA, 19 nt, Homo sapiens
cacaaggaacaccauauga

SEQ ID NO: 522587 - RNA, 19 nt, Homo sapiens
ccaccgaccagaagaauac

SEQ ID NO: 522588 - RNA, 19 nt, Homo sapiens
caaaucuccaucuauagga

SEQ ID NO: 522589 - RNA, 19 nt, Homo sapiens
uuggacagcucucuaugau

SEQ ID NO: 522590 - RNA, 19 nt, Homo sapiens
ugaaggcggaguauggaaa

SEQ ID NO: 522591 - RNA, 19 nt, Homo sapiens
gcagaaaauuaaagaguac

SEQ ID NO: 522592 - RNA, 19 nt, Homo sapiens
cauagauccucucaauggu

SEQ ID NO: 522593 - RNA, 19 nt, Homo sapiens
aaacuuggacagcucucua

SEQ ID NO: 522594 - RNA, 19 nt, Homo sapiens
gagccagccauguaagaau

SEQ ID NO: 522595 - RNA, 19 nt, Homo sapiens
gaaggcggaguauggaaag

SEQ ID NO: 522596 - RNA, 19 nt, Homo sapiens
ccuuucaaaucuccaucua

SEQ ID NO: 522597 - RNA, 19 nt, Homo sapiens
uaaauaugaggguuguguu

SEQ ID NO: 522598 - RNA, 19 nt, Homo sapiens
ccuaguguuuggcaguuug

SEQ ID NO: 522599 - RNA, 19 nt, Homo sapiens
gaaguuuuauggaccacaa

SEQ ID NO: 522600 - RNA, 19 nt, Homo sapiens
gcucugauagguagaugug

SEQ ID NO: 522601 - RNA, 19 nt, Homo sapiens
acugaacugucgaaggaaa

SEQ ID NO: 522602 - RNA, 19 nt, Homo sapiens
ggauauggaguuguaguag

SEQ ID NO: 522603 - RNA, 19 nt, Homo sapiens
gaccgcuacccugaacuua

SEQ ID NO: 522604 - RNA, 19 nt, Homo sapiens
ugaacugucgaaggaaaua

SEQ ID NO: 522605 - RNA, 19 nt, Homo sapiens
uauaucacccuuuagaucu

SEQ ID NO: 522606 - RNA, 19 nt, Homo sapiens
ucaaaucuccaucuauagg

SEQ ID NO: 522607 - RNA, 19 nt, Homo sapiens
uguguauugugcuuagaaa

SEQ ID NO: 522608 - RNA, 19 nt, Homo sapiens
gggacgaugcuuccucuca

SEQ ID NO: 522609 - RNA, 19 nt, Homo sapiens
caaagaaacaaaccaaacc

SEQ ID NO: 522610 - RNA, 19 nt, Homo sapiens
cagccugugugcuacugaa

SEQ ID NO: 522611 - RNA, 19 nt, Homo sapiens
uaucacccuuuagaucuug

SEQ ID NO: 522612 - RNA, 19 nt, Homo sapiens
aaagaguacauccagaaau

SEQ ID NO: 522613 - RNA, 19 nt, Homo sapiens
gaaggaggcuuguuuaaac

SEQ ID NO: 522614 - RNA, 19 nt, Homo sapiens
gcagaggccuacacgauuu

SEQ ID NO: 522615 - RNA, 19 nt, Homo sapiens
gaggaaagaccacccauuu

SEQ ID NO: 522616 - RNA, 19 nt, Homo sapiens
uacaggaacuucuaaauga

SEQ ID NO: 522617 - RNA, 19 nt, Homo sapiens
uaaauucgaaccaccauua

SEQ ID NO: 522618 - RNA, 19 nt, Homo sapiens
uaaaguugcuccauacaau

SEQ ID NO: 522619 - RNA, 19 nt, Homo sapiens
ggaggaacguguggaguuu

SEQ ID NO: 522620 - RNA, 19 nt, Homo sapiens
gaaguuugcgcccucauaa

SEQ ID NO: 522621 - RNA, 19 nt, Homo sapiens
ggaaggaggcuuguuuaaa

SEQ ID NO: 522622 - RNA, 19 nt, Homo sapiens
aaucuaaaguugcuccaua

SEQ ID NO: 522623 - RNA, 19 nt, Homo sapiens
ggaaagaccacccauuugg

SEQ ID NO: 522624 - RNA, 19 nt, Homo sapiens
gagcacaagccaagaaguu

SEQ ID NO: 522625 - RNA, 19 nt, Homo sapiens
ccacuuccuuuguguuuau

SEQ ID NO: 522626 - RNA, 19 nt, Homo sapiens
ugaauugcccguuuccaua

SEQ ID NO: 522627 - RNA, 19 nt, Homo sapiens
gaacugggagugcgccauu

SEQ ID NO: 522628 - RNA, 19 nt, Homo sapiens
ggaauacaggaacuucuaa

SEQ ID NO: 522629 - RNA, 19 nt, Homo sapiens
gaaggaagggauugguuug

SEQ ID NO: 522630 - RNA, 19 nt, Homo sapiens
gcacaagccaagaaguuug

SEQ ID NO: 522631 - RNA, 19 nt, Homo sapiens
gaccugccuuggcuucuuu

SEQ ID NO: 522632 - RNA, 19 nt, Homo sapiens
gaggaaagcauggaggaaa

SEQ ID NO: 522633 - RNA, 19 nt, Homo sapiens
gaauacaggaacuucuaaa

SEQ ID NO: 522634 - RNA, 19 nt, Homo sapiens
gggaaggaggcuuguuuaa

SEQ ID NO: 522635 - RNA, 19 nt, Homo sapiens
gcgagggacuuugaacaug

SEQ ID NO: 522636 - RNA, 19 nt, Homo sapiens
gggauugguuuggcaagaa

SEQ ID NO: 522637 - RNA, 19 nt, Homo sapiens
cgagggacuuugaacaugu

SEQ ID NO: 522638 - RNA, 19 nt, Homo sapiens
acaggaacuucuaaaugaa

SEQ ID NO: 522639 - RNA, 19 nt, Homo sapiens
gggcuccucugcaucaugu

SEQ ID NO: 522640 - RNA, 19 nt, Homo sapiens
ggaccugccuuggcuucuu

SEQ ID NO: 522641 - RNA, 19 nt, Homo sapiens
gcccugaggaucuguguuu

SEQ ID NO: 522642 - RNA, 19 nt, Homo sapiens
ggaggaaagaccacccauu

SEQ ID NO: 522643 - RNA, 19 nt, Homo sapiens
ggccagccaucacaaucaa

SEQ ID NO: 522644 - RNA, 19 nt, Homo sapiens
ggaucuguguuuggugaaa

SEQ ID NO: 522645 - RNA, 19 nt, Homo sapiens
gccacuuccuuuguguuua

SEQ ID NO: 522646 - RNA, 19 nt, Homo sapiens
cauacagggucucuuccuu

SEQ ID NO: 522647 - RNA, 19 nt, Homo sapiens
guucugcgccacuuccuuu

SEQ ID NO: 522648 - RNA, 19 nt, Homo sapiens
caaucaaacagauccuauu

SEQ ID NO: 522649 - RNA, 19 nt, Homo sapiens
agaaggaagggauugguuu

SEQ ID NO: 522650 - RNA, 19 nt, Homo sapiens
auacaggaacuucuaaaug

SEQ ID NO: 522651 - RNA, 19 nt, Homo sapiens
ggaaagcauggaggaaaga

SEQ ID NO: 522652 - RNA, 19 nt, Homo sapiens
gaauugcccguuuccauac

SEQ ID NO: 522653 - RNA, 19 nt, Homo sapiens
cagaguggaguacgagaaa

SEQ ID NO: 522654 - RNA, 19 nt, Homo sapiens
auucgaaccaccauuauuu

SEQ ID NO: 522655 - RNA, 19 nt, Homo sapiens
gugggaaggaggcuuguuu

SEQ ID NO: 522656 - RNA, 19 nt, Homo sapiens
ggaggcuuguuuaaacuac

SEQ ID NO: 522657 - RNA, 19 nt, Homo sapiens
ugccuuggcuucuuugauc

SEQ ID NO: 522658 - RNA, 19 nt, Homo sapiens
guauuucaacugcuguaaa

SEQ ID NO: 522659 - RNA, 19 nt, Homo sapiens
cagaggccuacacgauuua

SEQ ID NO: 522660 - RNA, 19 nt, Homo sapiens
cuguguugcuguuuaggua

SEQ ID NO: 522661 - RNA, 19 nt, Homo sapiens
gggccugugucuuggacuu

SEQ ID NO: 522662 - RNA, 19 nt, Homo sapiens
gaacuucuaaaugaaccaa

SEQ ID NO: 522663 - RNA, 19 nt, Homo sapiens
ugggaaggaggcuuguuua

SEQ ID NO: 522664 - RNA, 19 nt, Homo sapiens
gagggacuuugaacauguc

SEQ ID NO: 522665 - RNA, 19 nt, Homo sapiens
agaaguuugcgcccucaua

SEQ ID NO: 522666 - RNA, 19 nt, Homo sapiens
gaaaaggguccgagcacaa

SEQ ID NO: 522667 - RNA, 19 nt, Homo sapiens
uuucguggcugucccaaca

SEQ ID NO: 522668 - RNA, 19 nt, Homo sapiens
gugcgagacagccuugaaa

SEQ ID NO: 522669 - RNA, 19 nt, Homo sapiens
cuaaaguugcuccauacaa

SEQ ID NO: 522670 - RNA, 19 nt, Homo sapiens
aagcagaggccuacacgau

SEQ ID NO: 522671 - RNA, 19 nt, Homo sapiens
cagugugccuguccaucuu

SEQ ID NO: 522672 - RNA, 19 nt, Homo sapiens
ggauugguuuggcaagaac

SEQ ID NO: 522673 - RNA, 19 nt, Homo sapiens
cagaaggaagggauugguu

SEQ ID NO: 522674 - RNA, 19 nt, Homo sapiens
cuccugcgcuccucucuag

SEQ ID NO: 522675 - RNA, 19 nt, Homo sapiens
cauaagcagcgaccuugug

SEQ ID NO: 522676 - RNA, 19 nt, Homo sapiens
ccaagacccagcucaagca

SEQ ID NO: 522677 - RNA, 19 nt, Homo sapiens
aggaauacaggaacuucua

SEQ ID NO: 522678 - RNA, 19 nt, Homo sapiens
uuuaaacuacggaugcuuu

SEQ ID NO: 522679 - RNA, 19 nt, Homo sapiens
cuaaaugaaccaaauaucc

SEQ ID NO: 522680 - RNA, 19 nt, Homo sapiens
ccaucacaaucaaacagau

SEQ ID NO: 522681 - RNA, 19 nt, Homo sapiens
ggaggccagccaucacaau

SEQ ID NO: 522682 - RNA, 19 nt, Homo sapiens
guaaauucgaaccaccauu

SEQ ID NO: 522683 - RNA, 19 nt, Homo sapiens
uauuucacccgaaugugua

SEQ ID NO: 522684 - RNA, 19 nt, Homo sapiens
aggaaagcauggaggaaag

SEQ ID NO: 522685 - RNA, 19 nt, Homo sapiens
gcgcuccucucuagaaccu

SEQ ID NO: 522686 - RNA, 19 nt, Homo sapiens
uggaggaacguguggaguu

SEQ ID NO: 522687 - RNA, 19 nt, Homo sapiens
aaaguugcuccauacaaug

SEQ ID NO: 522688 - RNA, 19 nt, Homo sapiens
gaggccagccaucacaauc

SEQ ID NO: 522689 - RNA, 19 nt, Homo sapiens
aggaaagaccacccauuug

SEQ ID NO: 522690 - RNA, 19 nt, Homo sapiens
gugaaaaggagccaaauuc

SEQ ID NO: 522691 - RNA, 19 nt, Homo sapiens
acaaucaaacagauccuau

SEQ ID NO: 522692 - RNA, 19 nt, Homo sapiens
gaagaugacuuaaacuuug

SEQ ID NO: 522693 - RNA, 19 nt, Homo sapiens
gcacagagaagcccuauaa

SEQ ID NO: 522694 - RNA, 19 nt, Homo sapiens
uaagaaugcugaagaguuu

SEQ ID NO: 522695 - RNA, 19 nt, Homo sapiens
ugaaggagcuugaagaaau

SEQ ID NO: 522696 - RNA, 19 nt, Homo sapiens
gcaggaggcugaugaagga

SEQ ID NO: 522697 - RNA, 19 nt, Homo sapiens
gaagaaauccgcaaaugug

SEQ ID NO: 522698 - RNA, 19 nt, Homo sapiens
gaaaagugaugauggauuu

SEQ ID NO: 522699 - RNA, 19 nt, Homo sapiens
caccgaagaucacauuuaa

SEQ ID NO: 522700 - RNA, 19 nt, Homo sapiens
gaagcucacucaguaauau

SEQ ID NO: 522701 - RNA, 19 nt, Homo sapiens
gcaggacucuguggaaauu

SEQ ID NO: 522702 - RNA, 19 nt, Homo sapiens
ugaccuagcugaagaauac

SEQ ID NO: 522703 - RNA, 19 nt, Homo sapiens
gcugaagaguuuacaaaga

SEQ ID NO: 522704 - RNA, 19 nt, Homo sapiens
gagaagcccuauaaucaca

SEQ ID NO: 522705 - RNA, 19 nt, Homo sapiens
cagagaagcccuauaauca

SEQ ID NO: 522706 - RNA, 19 nt, Homo sapiens
gaaggagcuugaagaaauc

SEQ ID NO: 522707 - RNA, 19 nt, Homo sapiens
ccacaucugucuucauuag

SEQ ID NO: 522708 - RNA, 19 nt, Homo sapiens
ugaugaaucucgccagaaa

SEQ ID NO: 522709 - RNA, 19 nt, Homo sapiens
guaauauccuuucaaugug

SEQ ID NO: 522710 - RNA, 19 nt, Homo sapiens
cugaagaguuuacaaagaa

SEQ ID NO: 522711 - RNA, 19 nt, Homo sapiens
gcaggacucggcuauuuaa

SEQ ID NO: 522712 - RNA, 19 nt, Homo sapiens
ugacaacccuccauaugau

SEQ ID NO: 522713 - RNA, 19 nt, Homo sapiens
gagaagaugacuuaaacuu

SEQ ID NO: 522714 - RNA, 19 nt, Homo sapiens
gggcugaccuagcugaaga

SEQ ID NO: 522715 - RNA, 19 nt, Homo sapiens
guaagaaugcugaagaguu

SEQ ID NO: 522716 - RNA, 19 nt, Homo sapiens
gaaacuccagcugauguua

SEQ ID NO: 522717 - RNA, 19 nt, Homo sapiens
ccucaguucuugugugaaa

SEQ ID NO: 522718 - RNA, 19 nt, Homo sapiens
ggacucggcuauuuaaagc

SEQ ID NO: 522719 - RNA, 19 nt, Homo sapiens
aaagcgaccuguggacuaa

SEQ ID NO: 522720 - RNA, 19 nt, Homo sapiens
ccaccgaagaucacauuua

SEQ ID NO: 522721 - RNA, 19 nt, Homo sapiens
gaugaaggagcuugaagaa

SEQ ID NO: 522722 - RNA, 19 nt, Homo sapiens
acuugaagcucacucagua

SEQ ID NO: 522723 - RNA, 19 nt, Homo sapiens
gccaaauucugucagcuau

SEQ ID NO: 522724 - RNA, 19 nt, Homo sapiens
caagcucacucaggaauuc

SEQ ID NO: 522725 - RNA, 19 nt, Homo sapiens
ccgcaaaugugggaugaaa

SEQ ID NO: 522726 - RNA, 19 nt, Homo sapiens
acacuccaguuuguaauaa

SEQ ID NO: 522727 - RNA, 19 nt, Homo sapiens
gcagaaaagugaugaugga

SEQ ID NO: 522728 - RNA, 19 nt, Homo sapiens
ggaguugguuuaaauucuc

SEQ ID NO: 522729 - RNA, 19 nt, Homo sapiens
cuuggaaacugucccauug

SEQ ID NO: 522730 - RNA, 19 nt, Homo sapiens
guaauccagucccucauag

SEQ ID NO: 522731 - RNA, 19 nt, Homo sapiens
cagaaucgaaaucaacuuu

SEQ ID NO: 522732 - RNA, 19 nt, Homo sapiens
gcaaagcuacagccagaau

SEQ ID NO: 522733 - RNA, 19 nt, Homo sapiens
cagcugauguuaccacagu

SEQ ID NO: 522734 - RNA, 19 nt, Homo sapiens
gaacucggcuucuuuuguc

SEQ ID NO: 522735 - RNA, 19 nt, Homo sapiens
uggagaagaugacuuaaac

SEQ ID NO: 522736 - RNA, 19 nt, Homo sapiens
gacuagauccuguggagaa

SEQ ID NO: 522737 - RNA, 19 nt, Homo sapiens
ggaagccgacgauccaaau

SEQ ID NO: 522738 - RNA, 19 nt, Homo sapiens
acuccuagcucaucuguca

SEQ ID NO: 522739 - RNA, 19 nt, Homo sapiens
gcagaggcuuggcuuucga

SEQ ID NO: 522740 - RNA, 19 nt, Homo sapiens
gggaguugguuuaaauucu

SEQ ID NO: 522741 - RNA, 19 nt, Homo sapiens
uuccacaucugucuucauu

SEQ ID NO: 522742 - RNA, 19 nt, Homo sapiens
cggcacacuuugacccuuu

SEQ ID NO: 522743 - RNA, 19 nt, Homo sapiens
ugugggaguugguuuaaau

SEQ ID NO: 522744 - RNA, 19 nt, Homo sapiens
gacaacccuccauaugaua

SEQ ID NO: 522745 - RNA, 19 nt, Homo sapiens
uagcauguguggcacuguu

SEQ ID NO: 522746 - RNA, 19 nt, Homo sapiens
ugaagaaauccgcaaaugu

SEQ ID NO: 522747 - RNA, 19 nt, Homo sapiens
aaagaucuaucacccaaac

SEQ ID NO: 522748 - RNA, 19 nt, Homo sapiens
caaggaagccgacgaucca

SEQ ID NO: 522749 - RNA, 19 nt, Homo sapiens
gccagaauguccguuugaa

SEQ ID NO: 522750 - RNA, 19 nt, Homo sapiens
aagcaggacucuguggaaa

SEQ ID NO: 522751 - RNA, 19 nt, Homo sapiens
ccgcaaagcaggacucugu

SEQ ID NO: 522752 - RNA, 19 nt, Homo sapiens
ugagcaagcuggcgaacag

SEQ ID NO: 522753 - RNA, 19 nt, Homo sapiens
acacgaacucggcuucuuu

SEQ ID NO: 522754 - RNA, 19 nt, Homo sapiens
cagcaagugugagcagaga

SEQ ID NO: 522755 - RNA, 19 nt, Homo sapiens
ugaagcucacucaguaaua

SEQ ID NO: 522756 - RNA, 19 nt, Homo sapiens
ccagguugaugaagcuaau

SEQ ID NO: 522757 - RNA, 19 nt, Homo sapiens
ugacuccaguuuauaacau

SEQ ID NO: 522758 - RNA, 19 nt, Homo sapiens
ucuccugacuccaguuuau

SEQ ID NO: 522759 - RNA, 19 nt, Homo sapiens
ucacugcacucugcucauc

SEQ ID NO: 522760 - RNA, 19 nt, Homo sapiens
guggagaagaugacuuaaa

SEQ ID NO: 522761 - RNA, 19 nt, Homo sapiens
cugcagccauuguagaaga

SEQ ID NO: 522762 - RNA, 19 nt, Homo sapiens
uugaagaaauccgcaaaug

SEQ ID NO: 522763 - RNA, 19 nt, Homo sapiens
acagagaagcccuauaauc

SEQ ID NO: 522764 - RNA, 19 nt, Homo sapiens
gcugaagaauacucuaagg

SEQ ID NO: 522765 - RNA, 19 nt, Homo sapiens
gguugaugaagcuaauuua

SEQ ID NO: 522766 - RNA, 19 nt, Homo sapiens
acacccgccugguuucuug

SEQ ID NO: 522767 - RNA, 19 nt, Homo sapiens
ccagaauguccguuugaaa

SEQ ID NO: 522768 - RNA, 19 nt, Homo sapiens
aaucacugcuucaaucuac

SEQ ID NO: 522769 - RNA, 19 nt, Homo sapiens
guucugcucucuuuguuuu

SEQ ID NO: 522770 - RNA, 19 nt, Homo sapiens
ucguauuucugccaacgua

SEQ ID NO: 522771 - RNA, 19 nt, Homo sapiens
ucugucagcuauccaaaca

SEQ ID NO: 522772 - RNA, 19 nt, Homo sapiens
caaauucugucagcuaucc

SEQ ID NO: 522773 - RNA, 19 nt, Homo sapiens
gguaaccuguaaagaaagg

SEQ ID NO: 522774 - RNA, 19 nt, Homo sapiens
gcagaguacccauucaaac

SEQ ID NO: 522775 - RNA, 19 nt, Homo sapiens
uagcugaagaauacucuaa

SEQ ID NO: 522776 - RNA, 19 nt, Homo sapiens
cugacaacccuccauauga

SEQ ID NO: 522777 - RNA, 19 nt, Homo sapiens
cagccagaauguccguuug

SEQ ID NO: 522778 - RNA, 19 nt, Homo sapiens
cagugggugucucuccuuu

SEQ ID NO: 522779 - RNA, 19 nt, Homo sapiens
ugucagcuauccaaacaag

SEQ ID NO: 522780 - RNA, 19 nt, Homo sapiens
ggaggaugcugugcacacu

SEQ ID NO: 522781 - RNA, 19 nt, Homo sapiens
ggaaacugucccauugcuu

SEQ ID NO: 522782 - RNA, 19 nt, Homo sapiens
ccgaagaucacauuuaaaa

SEQ ID NO: 522783 - RNA, 19 nt, Homo sapiens
ucacucacacuccaguuug

SEQ ID NO: 522784 - RNA, 19 nt, Homo sapiens
ccucauagcacuggugaau

SEQ ID NO: 522785 - RNA, 19 nt, Homo sapiens
guucugcugcccguaauaa

SEQ ID NO: 522786 - RNA, 19 nt, Homo sapiens
cagcagaguacccauucaa

SEQ ID NO: 522787 - RNA, 19 nt, Homo sapiens
gugggugucucuccuuugg

SEQ ID NO: 522788 - RNA, 19 nt, Homo sapiens
gcucaucacgggaggauac

SEQ ID NO: 522789 - RNA, 19 nt, Homo sapiens
uggcaagggcuuauuguuc

SEQ ID NO: 522790 - RNA, 19 nt, Homo sapiens
ggucccagguuggcacuuc

SEQ ID NO: 522791 - RNA, 19 nt, Homo sapiens
gugaaacuccagcugaugu

SEQ ID NO: 522792 - RNA, 19 nt, Homo sapiens
gaagguaguugucagguua

SEQ ID NO: 522793 - RNA, 19 nt, Homo sapiens
ucacagcccucacuaauaa

SEQ ID NO: 522794 - RNA, 19 nt, Homo sapiens
caacgaagcccaagccaua

SEQ ID NO: 522795 - RNA, 19 nt, Homo sapiens
uaacauugcugucaagugu

SEQ ID NO: 522796 - RNA, 19 nt, Homo sapiens
caauccagaugauccauua

SEQ ID NO: 522797 - RNA, 19 nt, Homo sapiens
ggaaacuucuguaaaucuu

SEQ ID NO: 522798 - RNA, 19 nt, Homo sapiens
gcacaguucugcuaucgau

SEQ ID NO: 522799 - RNA, 19 nt, Homo sapiens
cauccugguuuaaguauaa

SEQ ID NO: 522800 - RNA, 19 nt, Homo sapiens
gaucuaauugcauugguua

SEQ ID NO: 522801 - RNA, 19 nt, Homo sapiens
ggacacagucuuagaaaca

SEQ ID NO: 522802 - RNA, 19 nt, Homo sapiens
aaccaggucuuuagaauau

SEQ ID NO: 522803 - RNA, 19 nt, Homo sapiens
ccagacaucuucaguccuu

SEQ ID NO: 522804 - RNA, 19 nt, Homo sapiens
gagcagaggcuagaaguau

SEQ ID NO: 522805 - RNA, 19 nt, Homo sapiens
guagacaaguugggaagaa

SEQ ID NO: 522806 - RNA, 19 nt, Homo sapiens
ucuggaaacuucuguaaau

SEQ ID NO: 522807 - RNA, 19 nt, Homo sapiens
gagcauggacuaggcuaua

SEQ ID NO: 522808 - RNA, 19 nt, Homo sapiens
caucaaagccgaaccagau

SEQ ID NO: 522809 - RNA, 19 nt, Homo sapiens
uaaccaggucuuuagaaua

SEQ ID NO: 522810 - RNA, 19 nt, Homo sapiens
ggauuguugugaaacguuu

SEQ ID NO: 522811 - RNA, 19 nt, Homo sapiens
gugcaucacuucuccuguu

SEQ ID NO: 522812 - RNA, 19 nt, Homo sapiens
cuaauaacauugcugucaa

SEQ ID NO: 522813 - RNA, 19 nt, Homo sapiens
uauaaagcacugugaauga

SEQ ID NO: 522814 - RNA, 19 nt, Homo sapiens
caucuggauuguugugaaa

SEQ ID NO: 522815 - RNA, 19 nt, Homo sapiens
ggcuauaugccaugaauaa

SEQ ID NO: 522816 - RNA, 19 nt, Homo sapiens
aguaucaucuggauuguug

SEQ ID NO: 522817 - RNA, 19 nt, Homo sapiens
agaaguaucaucuggauug

SEQ ID NO: 522818 - RNA, 19 nt, Homo sapiens
gcagcuaaccaggucuuua

SEQ ID NO: 522819 - RNA, 19 nt, Homo sapiens
ccucuuuguuugcauuuaa

SEQ ID NO: 522820 - RNA, 19 nt, Homo sapiens
gaaguaucaucuggauugu

SEQ ID NO: 522821 - RNA, 19 nt, Homo sapiens
auaaagcacugugaaugaa

SEQ ID NO: 522822 - RNA, 19 nt, Homo sapiens
cagaugauccauuagcaaa

SEQ ID NO: 522823 - RNA, 19 nt, Homo sapiens
caucacagcccucacuaau

SEQ ID NO: 522824 - RNA, 19 nt, Homo sapiens
guauaaagcacugugaaug

SEQ ID NO: 522825 - RNA, 19 nt, Homo sapiens
gaucaucaagugugcauca

SEQ ID NO: 522826 - RNA, 19 nt, Homo sapiens
ggagggacuuuuaaacuug

SEQ ID NO: 522827 - RNA, 19 nt, Homo sapiens
gggagguaguuuaauuuua

SEQ ID NO: 522828 - RNA, 19 nt, Homo sapiens
uagcaaaucuaugucuugu

SEQ ID NO: 522829 - RNA, 19 nt, Homo sapiens
ccagaagaauacccaaugg

SEQ ID NO: 522830 - RNA, 19 nt, Homo sapiens
uggcuugucuggaaacuuc

SEQ ID NO: 522831 - RNA, 19 nt, Homo sapiens
cuagaaguaucaucuggau

SEQ ID NO: 522832 - RNA, 19 nt, Homo sapiens
guccuuuggugauuaaaug

SEQ ID NO: 522833 - RNA, 19 nt, Homo sapiens
ucaguccuuuggugauuaa

SEQ ID NO: 522834 - RNA, 19 nt, Homo sapiens
uuuaauggacacagucuua

SEQ ID NO: 522835 - RNA, 19 nt, Homo sapiens
ccuaaaguacguuucauga

SEQ ID NO: 522836 - RNA, 19 nt, Homo sapiens
ugaagguaguugucagguu

SEQ ID NO: 522837 - RNA, 19 nt, Homo sapiens
cugauucacugucauaaag

SEQ ID NO: 522838 - RNA, 19 nt, Homo sapiens
gcagaggcuagaaguauca

SEQ ID NO: 522839 - RNA, 19 nt, Homo sapiens
gggaagaauauguuuagau

SEQ ID NO: 522840 - RNA, 19 nt, Homo sapiens
agacaaguugggaagaaua

SEQ ID NO: 522841 - RNA, 19 nt, Homo sapiens
uaauaacauugcugucaag

SEQ ID NO: 522842 - RNA, 19 nt, Homo sapiens
uuuagacgcuguagaugga

SEQ ID NO: 522843 - RNA, 19 nt, Homo sapiens
gcacauuagcaaaucuaug

SEQ ID NO: 522844 - RNA, 19 nt, Homo sapiens
gggagggacuuuuaaacuu

SEQ ID NO: 522845 - RNA, 19 nt, Homo sapiens
guuaagugcucccaaucca

SEQ ID NO: 522846 - RNA, 19 nt, Homo sapiens
caaguugggaagaauaugu

SEQ ID NO: 522847 - RNA, 19 nt, Homo sapiens
acacagucuuagaaacauu

SEQ ID NO: 522848 - RNA, 19 nt, Homo sapiens
gauccgcacaguucugcua

SEQ ID NO: 522849 - RNA, 19 nt, Homo sapiens
gacaaguugggaagaauau

SEQ ID NO: 522850 - RNA, 19 nt, Homo sapiens
uuguauggcuugucuggaa

SEQ ID NO: 522851 - RNA, 19 nt, Homo sapiens
gcaggaucaucaaggaaac

SEQ ID NO: 522852 - RNA, 19 nt, Homo sapiens
gauccaggccuuguuaagu

SEQ ID NO: 522853 - RNA, 19 nt, Homo sapiens
gacacagucuuagaaacau

SEQ ID NO: 522854 - RNA, 19 nt, Homo sapiens
uaggcuauaugccaugaau

SEQ ID NO: 522855 - RNA, 19 nt, Homo sapiens
uuggugaucuaauugcauu

SEQ ID NO: 522856 - RNA, 19 nt, Homo sapiens
cacagucuuagaaacauua

SEQ ID NO: 522857 - RNA, 19 nt, Homo sapiens
guugggaagaauauguuua

SEQ ID NO: 522858 - RNA, 19 nt, Homo sapiens
ugaucuaauugcauugguu

SEQ ID NO: 522859 - RNA, 19 nt, Homo sapiens
ccauccugguuuaaguaua

SEQ ID NO: 522860 - RNA, 19 nt, Homo sapiens
gauucacugucauaaagca

SEQ ID NO: 522861 - RNA, 19 nt, Homo sapiens
gacuuccuccucuuuguuu

SEQ ID NO: 522862 - RNA, 19 nt, Homo sapiens
gaagcccaagccauagaaa

SEQ ID NO: 522863 - RNA, 19 nt, Homo sapiens
cugcagauccgcacaguuc

SEQ ID NO: 522864 - RNA, 19 nt, Homo sapiens
ucaucuggauuguugugaa

SEQ ID NO: 522865 - RNA, 19 nt, Homo sapiens
cuucaguccuuuggugauu

SEQ ID NO: 522866 - RNA, 19 nt, Homo sapiens
caucacuucuccuguucug

SEQ ID NO: 522867 - RNA, 19 nt, Homo sapiens
ugaacuauuccuuccagaa

SEQ ID NO: 522868 - RNA, 19 nt, Homo sapiens
uagacaaguugggaagaau

SEQ ID NO: 522869 - RNA, 19 nt, Homo sapiens
ucaaagccgaaccagauga

SEQ ID NO: 522870 - RNA, 19 nt, Homo sapiens
uguauggcuugucuggaaa

SEQ ID NO: 522871 - RNA, 19 nt, Homo sapiens
uaaguauaaagcacuguga

SEQ ID NO: 522872 - RNA, 19 nt, Homo sapiens
uaauggacacagucuuaga

SEQ ID NO: 522873 - RNA, 19 nt, Homo sapiens
acauugcugucaaguguag

SEQ ID NO: 522874 - RNA, 19 nt, Homo sapiens
uuauuuagacgcuguagau

SEQ ID NO: 522875 - RNA, 19 nt, Homo sapiens
gaggcuagaaguaucaucu

SEQ ID NO: 522876 - RNA, 19 nt, Homo sapiens
gcauggacuaggcuauaug

SEQ ID NO: 522877 - RNA, 19 nt, Homo sapiens
ccagaugauccauuagcaa

SEQ ID NO: 522878 - RNA, 19 nt, Homo sapiens
uagauggacaagcuugauu

SEQ ID NO: 522879 - RNA, 19 nt, Homo sapiens
guccugauucacugucaua

SEQ ID NO: 522880 - RNA, 19 nt, Homo sapiens
gcaguggaagaccaacgaa

SEQ ID NO: 522881 - RNA, 19 nt, Homo sapiens
ugucuggaaacuucuguaa

SEQ ID NO: 522882 - RNA, 19 nt, Homo sapiens
aaacaucacagcccucacu

SEQ ID NO: 522883 - RNA, 19 nt, Homo sapiens
ugaaugaagguaguuguca

SEQ ID NO: 522884 - RNA, 19 nt, Homo sapiens
auccaggccuuguuaagug

SEQ ID NO: 522885 - RNA, 19 nt, Homo sapiens
ccaggucuuuagaauaugc

SEQ ID NO: 522886 - RNA, 19 nt, Homo sapiens
cgcaggaucaucaaggaaa

SEQ ID NO: 522887 - RNA, 19 nt, Homo sapiens
ucuaugucuuguccugauu

SEQ ID NO: 522888 - RNA, 19 nt, Homo sapiens
ccuccucuuuguuugcauu

SEQ ID NO: 522889 - RNA, 19 nt, Homo sapiens
gcuauaugccaugaauaau

SEQ ID NO: 522890 - RNA, 19 nt, Homo sapiens
cgaagcccaagccauagaa

SEQ ID NO: 522891 - RNA, 19 nt, Homo sapiens
cuuguuaagugcucccaau

SEQ ID NO: 522892 - RNA, 19 nt, Homo sapiens
ggacagggaugauaauugg

SEQ ID NO: 522893 - RNA, 19 nt, Homo sapiens
gcugaaauguggaugcaua

SEQ ID NO: 522894 - RNA, 19 nt, Homo sapiens
aaacagggcuuucauuugg

SEQ ID NO: 522895 - RNA, 19 nt, Homo sapiens
ccucugaccucccuuguuu

SEQ ID NO: 522896 - RNA, 19 nt, Homo sapiens
aaaggaagcucccauucaa

SEQ ID NO: 522897 - RNA, 19 nt, Homo sapiens
gcaauugauguuuccauua

SEQ ID NO: 522898 - RNA, 19 nt, Homo sapiens
gaaaggaagcucccauuca

SEQ ID NO: 522899 - RNA, 19 nt, Homo sapiens
ggacaguguuacagcaauu

SEQ ID NO: 522900 - RNA, 19 nt, Homo sapiens
cagcaacuaucaagucuga

SEQ ID NO: 522901 - RNA, 19 nt, Homo sapiens
cagcagggauuaagaagga

SEQ ID NO: 522902 - RNA, 19 nt, Homo sapiens
aaacauggccuacaaguuc

SEQ ID NO: 522903 - RNA, 19 nt, Homo sapiens
gagaaagaccgcaugaaga

SEQ ID NO: 522904 - RNA, 19 nt, Homo sapiens
caucaaaguuguccugcaa

SEQ ID NO: 522905 - RNA, 19 nt, Homo sapiens
gacgaagacaugacacuua

SEQ ID NO: 522906 - RNA, 19 nt, Homo sapiens
caaaauggcagaauucaua

SEQ ID NO: 522907 - RNA, 19 nt, Homo sapiens
ugaccucccuuguuuaguu

SEQ ID NO: 522908 - RNA, 19 nt, Homo sapiens
caaaucauccugucaagug

SEQ ID NO: 522909 - RNA, 19 nt, Homo sapiens
gauuuaacauccuguaagu

SEQ ID NO: 522910 - RNA, 19 nt, Homo sapiens
guggaugcauaccgaaaua

SEQ ID NO: 522911 - RNA, 19 nt, Homo sapiens
ggagaaagaccgcaugaag

SEQ ID NO: 522912 - RNA, 19 nt, Homo sapiens
gcaacuaucaagucugaaa

SEQ ID NO: 522913 - RNA, 19 nt, Homo sapiens
gaguagaugugaagguuuc

SEQ ID NO: 522914 - RNA, 19 nt, Homo sapiens
ucauauagcaucaaaguug

SEQ ID NO: 522915 - RNA, 19 nt, Homo sapiens
gaagacaugacacuuacaa

SEQ ID NO: 522916 - RNA, 19 nt, Homo sapiens
gcacacaugaucccucuga

SEQ ID NO: 522917 - RNA, 19 nt, Homo sapiens
gaaagaccgcaugaagaua

SEQ ID NO: 522918 - RNA, 19 nt, Homo sapiens
ggucuaguuuggaaucuga

SEQ ID NO: 522919 - RNA, 19 nt, Homo sapiens
uaacaaaucauccugucaa

SEQ ID NO: 522920 - RNA, 19 nt, Homo sapiens
ggaucaagaaagucuauuu

SEQ ID NO: 522921 - RNA, 19 nt, Homo sapiens
aauagaauguggaccuaaa

SEQ ID NO: 522922 - RNA, 19 nt, Homo sapiens
ccaaccagauccacaagug

SEQ ID NO: 522923 - RNA, 19 nt, Homo sapiens
gcaugaagauacuuguaag

SEQ ID NO: 522924 - RNA, 19 nt, Homo sapiens
gcacaucuaacucaacugu

SEQ ID NO: 522925 - RNA, 19 nt, Homo sapiens
uguaaccacuguccacgua

SEQ ID NO: 522926 - RNA, 19 nt, Homo sapiens
ggaguaaauaguucuaaug

SEQ ID NO: 522927 - RNA, 19 nt, Homo sapiens
ggaccuaaauacccagaag

SEQ ID NO: 522928 - RNA, 19 nt, Homo sapiens
uuaaacagggcuuucauuu

SEQ ID NO: 522929 - RNA, 19 nt, Homo sapiens
gccgaagcauagauuguaa

SEQ ID NO: 522930 - RNA, 19 nt, Homo sapiens
uagaguagaugugaagguu

SEQ ID NO: 522931 - RNA, 19 nt, Homo sapiens
aaagacacaucacacaauc

SEQ ID NO: 522932 - RNA, 19 nt, Homo sapiens
acaucuaacucaacuguga

SEQ ID NO: 522933 - RNA, 19 nt, Homo sapiens
ccauaucagugcuagcaaa

SEQ ID NO: 522934 - RNA, 19 nt, Homo sapiens
gaagaugacgaagacauga

SEQ ID NO: 522935 - RNA, 19 nt, Homo sapiens
uaaacagggcuuucauuug

SEQ ID NO: 522936 - RNA, 19 nt, Homo sapiens
gccagaagccaucagguaa

SEQ ID NO: 522937 - RNA, 19 nt, Homo sapiens
ggaaaggaagcucccauuc

SEQ ID NO: 522938 - RNA, 19 nt, Homo sapiens
ucaaaguuguccugcaaga

SEQ ID NO: 522939 - RNA, 19 nt, Homo sapiens
gaccucccuuguuuaguuu

SEQ ID NO: 522940 - RNA, 19 nt, Homo sapiens
ugaauggaguaaauaguuc

SEQ ID NO: 522941 - RNA, 19 nt, Homo sapiens
cacaugaucccucugaauu

SEQ ID NO: 522942 - RNA, 19 nt, Homo sapiens
agaauagucaccaggguua

SEQ ID NO: 522943 - RNA, 19 nt, Homo sapiens
ggccagaagccaucaggua

SEQ ID NO: 522944 - RNA, 19 nt, Homo sapiens
caugacacuuccuugcuuu

SEQ ID NO: 522945 - RNA, 19 nt, Homo sapiens
ggaugcauaccgaaauaaa

SEQ ID NO: 522946 - RNA, 19 nt, Homo sapiens
gguugaacuuggagaaaga

SEQ ID NO: 522947 - RNA, 19 nt, Homo sapiens
uaacaguauuccauaagca

SEQ ID NO: 522948 - RNA, 19 nt, Homo sapiens
gaagcucccauucaaagga

SEQ ID NO: 522949 - RNA, 19 nt, Homo sapiens
cauauagcaucaaaguugu

SEQ ID NO: 522950 - RNA, 19 nt, Homo sapiens
agaaagaccgcaugaagau

SEQ ID NO: 522951 - RNA, 19 nt, Homo sapiens
gaagccaucagguaagguu

SEQ ID NO: 522952 - RNA, 19 nt, Homo sapiens
gacaugacacuuacaagau

SEQ ID NO: 522953 - RNA, 19 nt, Homo sapiens
aguaggagauggcacaguu

SEQ ID NO: 522954 - RNA, 19 nt, Homo sapiens
gggcacaucuaacucaacu

SEQ ID NO: 522955 - RNA, 19 nt, Homo sapiens
gccuaaugaugucuaaaga

SEQ ID NO: 522956 - RNA, 19 nt, Homo sapiens
caugaucccucugaauugu

SEQ ID NO: 522957 - RNA, 19 nt, Homo sapiens
ccaugacacuuccuugcuu

SEQ ID NO: 522958 - RNA, 19 nt, Homo sapiens
uagaauguggaccuaaaua

SEQ ID NO: 522959 - RNA, 19 nt, Homo sapiens
acaugacacuuacaagaug

SEQ ID NO: 522960 - RNA, 19 nt, Homo sapiens
ggcuugaccuccuggcaaa

SEQ ID NO: 522961 - RNA, 19 nt, Homo sapiens
ugaucccucugaauuguuu

SEQ ID NO: 522962 - RNA, 19 nt, Homo sapiens
ggccgaagcauagauugua

SEQ ID NO: 522963 - RNA, 19 nt, Homo sapiens
ucaaaguaccggaaaggaa

SEQ ID NO: 522964 - RNA, 19 nt, Homo sapiens
agacaugacacuuacaaga

SEQ ID NO: 522965 - RNA, 19 nt, Homo sapiens
uaacucaacugugaaaaga

SEQ ID NO: 522966 - RNA, 19 nt, Homo sapiens
cagaauucauauagcauca

SEQ ID NO: 522967 - RNA, 19 nt, Homo sapiens
gaguaaauaguucuaaugg

SEQ ID NO: 522968 - RNA, 19 nt, Homo sapiens
guaggagauggcacaguua

SEQ ID NO: 522969 - RNA, 19 nt, Homo sapiens
cgaagaaggccagaaagga

SEQ ID NO: 522970 - RNA, 19 nt, Homo sapiens
ccgaauauacagccuuaaa

SEQ ID NO: 522971 - RNA, 19 nt, Homo sapiens
gagaccuacuucugcauca

SEQ ID NO: 522972 - RNA, 19 nt, Homo sapiens
cugcaggacuggcauguca

SEQ ID NO: 522973 - RNA, 19 nt, Homo sapiens
guaaaagucccucgcaauu

SEQ ID NO: 522974 - RNA, 19 nt, Homo sapiens
gaaaagacacaucacacaa

SEQ ID NO: 522975 - RNA, 19 nt, Homo sapiens
caugucauccugccacgua

SEQ ID NO: 522976 - RNA, 19 nt, Homo sapiens
uggcagaauucauauagca

SEQ ID NO: 522977 - RNA, 19 nt, Homo sapiens
gaccauugccugauuuuaa

SEQ ID NO: 522978 - RNA, 19 nt, Homo sapiens
uuuaacauccuguaaguga

SEQ ID NO: 522979 - RNA, 19 nt, Homo sapiens
uaaacauggccuacaaguu

SEQ ID NO: 522980 - RNA, 19 nt, Homo sapiens
ccagaaaggaguaggagau

SEQ ID NO: 522981 - RNA, 19 nt, Homo sapiens
cccaacaccuuccaugaca

SEQ ID NO: 522982 - RNA, 19 nt, Homo sapiens
gugaggaauucagggcuuu

SEQ ID NO: 522983 - RNA, 19 nt, Homo sapiens
ucaccuugcugcugauuac

SEQ ID NO: 522984 - RNA, 19 nt, Homo sapiens
ucuuguagaccucaaagua

SEQ ID NO: 522985 - RNA, 19 nt, Homo sapiens
gacaguguuacagcaauua

SEQ ID NO: 522986 - RNA, 19 nt, Homo sapiens
ucuagaagaugacgaagac

SEQ ID NO: 522987 - RNA, 19 nt, Homo sapiens
uccuguaagugaaguuuaa

SEQ ID NO: 522988 - RNA, 19 nt, Homo sapiens
guucuaaggauuuaacauc

SEQ ID NO: 522989 - RNA, 19 nt, Homo sapiens
ggucauccuugcaauccau

SEQ ID NO: 522990 - RNA, 19 nt, Homo sapiens
ggacccaagagccauauca

SEQ ID NO: 522991 - RNA, 19 nt, Homo sapiens
guuggaagaacucgaagaa

SEQ ID NO: 522992 - RNA, 19 nt, Homo sapiens
ggacagggaugauaauugg

SEQ ID NO: 522993 - RNA, 19 nt, Homo sapiens
gcugaaauguggaugcaua

SEQ ID NO: 522994 - RNA, 19 nt, Homo sapiens
aaacagggcuuucauuugg

SEQ ID NO: 522995 - RNA, 19 nt, Homo sapiens
ccucugaccucccuuguuu

SEQ ID NO: 522996 - RNA, 19 nt, Homo sapiens
aaaggaagcucccauucaa

SEQ ID NO: 522997 - RNA, 19 nt, Homo sapiens
gcaauugauguuuccauua

SEQ ID NO: 522998 - RNA, 19 nt, Homo sapiens
gaaaggaagcucccauuca

SEQ ID NO: 522999 - RNA, 19 nt, Homo sapiens
ggacaguguuacagcaauu

SEQ ID NO: 523000 - RNA, 19 nt, Homo sapiens
cagcaacuaucaagucuga

SEQ ID NO: 523001 - RNA, 19 nt, Homo sapiens
cagcagggauuaagaagga

SEQ ID NO: 523002 - RNA, 19 nt, Homo sapiens
gaaggaagacuugaaccua

SEQ ID NO: 523003 - RNA, 19 nt, Homo sapiens
gagaaagaccgcaugaaga

SEQ ID NO: 523004 - RNA, 19 nt, Homo sapiens
caucaaaguuguccugcaa

SEQ ID NO: 523005 - RNA, 19 nt, Homo sapiens
gacgaagacaugacacuua

SEQ ID NO: 523006 - RNA, 19 nt, Homo sapiens
caaaauggcagaauucaua

SEQ ID NO: 523007 - RNA, 19 nt, Homo sapiens
ugaccucccuuguuuaguu

SEQ ID NO: 523008 - RNA, 19 nt, Homo sapiens
caaaucauccugucaagug

SEQ ID NO: 523009 - RNA, 19 nt, Homo sapiens
gauuuaacauccuguaagu

SEQ ID NO: 523010 - RNA, 19 nt, Homo sapiens
guggaugcauaccgaaaua

SEQ ID NO: 523011 - RNA, 19 nt, Homo sapiens
ggagaaagaccgcaugaag

SEQ ID NO: 523012 - RNA, 19 nt, Homo sapiens
caaacugagugaugaagga

SEQ ID NO: 523013 - RNA, 19 nt, Homo sapiens
gcaacuaucaagucugaaa

SEQ ID NO: 523014 - RNA, 19 nt, Homo sapiens
gaguagaugugaagguuuc

SEQ ID NO: 523015 - RNA, 19 nt, Homo sapiens
ucauauagcaucaaaguug

SEQ ID NO: 523016 - RNA, 19 nt, Homo sapiens
gaagacaugacacuuacaa

SEQ ID NO: 523017 - RNA, 19 nt, Homo sapiens
gcacacaugaucccucuga

SEQ ID NO: 523018 - RNA, 19 nt, Homo sapiens
gaaagaccgcaugaagaua

SEQ ID NO: 523019 - RNA, 19 nt, Homo sapiens
ggucuaguuuggaaucuga

SEQ ID NO: 523020 - RNA, 19 nt, Homo sapiens
uaacaaaucauccugucaa

SEQ ID NO: 523021 - RNA, 19 nt, Homo sapiens
aaagcaaacugagugauga

SEQ ID NO: 523022 - RNA, 19 nt, Homo sapiens
ggaucaagaaagucuauuu

SEQ ID NO: 523023 - RNA, 19 nt, Homo sapiens
aauagaauguggaccuaaa

SEQ ID NO: 523024 - RNA, 19 nt, Homo sapiens
gcaugaagauacuuguaag

SEQ ID NO: 523025 - RNA, 19 nt, Homo sapiens
gcacaucuaacucaacugu

SEQ ID NO: 523026 - RNA, 19 nt, Homo sapiens
uguaaccacuguccacgua

SEQ ID NO: 523027 - RNA, 19 nt, Homo sapiens
ggaguaaauaguucuaaug

SEQ ID NO: 523028 - RNA, 19 nt, Homo sapiens
ggaccuaaauacccagaag

SEQ ID NO: 523029 - RNA, 19 nt, Homo sapiens
cgucuuaccugaagucaca

SEQ ID NO: 523030 - RNA, 19 nt, Homo sapiens
ccuaugagguugauacuac

SEQ ID NO: 523031 - RNA, 19 nt, Homo sapiens
uuaaacagggcuuucauuu

SEQ ID NO: 523032 - RNA, 19 nt, Homo sapiens
gccgaagcauagauuguaa

SEQ ID NO: 523033 - RNA, 19 nt, Homo sapiens
uagaguagaugugaagguu

SEQ ID NO: 523034 - RNA, 19 nt, Homo sapiens
aaagacacaucacacaauc

SEQ ID NO: 523035 - RNA, 19 nt, Homo sapiens
acaucuaacucaacuguga

SEQ ID NO: 523036 - RNA, 19 nt, Homo sapiens
ccauaucagugcuagcaaa

SEQ ID NO: 523037 - RNA, 19 nt, Homo sapiens
gaagaugacgaagacauga

SEQ ID NO: 523038 - RNA, 19 nt, Homo sapiens
uaaacagggcuuucauuug

SEQ ID NO: 523039 - RNA, 19 nt, Homo sapiens
gccagaagccaucagguaa

SEQ ID NO: 523040 - RNA, 19 nt, Homo sapiens
ggaaaggaagcucccauuc

SEQ ID NO: 523041 - RNA, 19 nt, Homo sapiens
ucaaaguuguccugcaaga

SEQ ID NO: 523042 - RNA, 19 nt, Homo sapiens
gaccucccuuguuuaguuu

SEQ ID NO: 523043 - RNA, 19 nt, Homo sapiens
ugaauggaguaaauaguuc

SEQ ID NO: 523044 - RNA, 19 nt, Homo sapiens
caaagcaaacugagugaug

SEQ ID NO: 523045 - RNA, 19 nt, Homo sapiens
cacaugaucccucugaauu

SEQ ID NO: 523046 - RNA, 19 nt, Homo sapiens
agaauagucaccaggguua

SEQ ID NO: 523047 - RNA, 19 nt, Homo sapiens
ggccagaagccaucaggua

SEQ ID NO: 523048 - RNA, 19 nt, Homo sapiens
caugacacuuccuugcuuu

SEQ ID NO: 523049 - RNA, 19 nt, Homo sapiens
ggaugcauaccgaaauaaa

SEQ ID NO: 523050 - RNA, 19 nt, Homo sapiens
gguugaacuuggagaaaga

SEQ ID NO: 523051 - RNA, 19 nt, Homo sapiens
gagagguucaagcgucuua

SEQ ID NO: 523052 - RNA, 19 nt, Homo sapiens
uaacaguauuccauaagca

SEQ ID NO: 523053 - RNA, 19 nt, Homo sapiens
gaagcucccauucaaagga

SEQ ID NO: 523054 - RNA, 19 nt, Homo sapiens
cauauagcaucaaaguugu

SEQ ID NO: 523055 - RNA, 19 nt, Homo sapiens
agaaagaccgcaugaagau

SEQ ID NO: 523056 - RNA, 19 nt, Homo sapiens
gaagccaucagguaagguu

SEQ ID NO: 523057 - RNA, 19 nt, Homo sapiens
gacaugacacuuacaagau

SEQ ID NO: 523058 - RNA, 19 nt, Homo sapiens
aguaggagauggcacaguu

SEQ ID NO: 523059 - RNA, 19 nt, Homo sapiens
gggcacaucuaacucaacu

SEQ ID NO: 523060 - RNA, 19 nt, Homo sapiens
gccuaaugaugucuaaaga

SEQ ID NO: 523061 - RNA, 19 nt, Homo sapiens
caugaucccucugaauugu

SEQ ID NO: 523062 - RNA, 19 nt, Homo sapiens
ccaugacacuuccuugcuu

SEQ ID NO: 523063 - RNA, 19 nt, Homo sapiens
uagaauguggaccuaaaua

SEQ ID NO: 523064 - RNA, 19 nt, Homo sapiens
acaugacacuuacaagaug

SEQ ID NO: 523065 - RNA, 19 nt, Homo sapiens
ggcuugaccuccuggcaaa

SEQ ID NO: 523066 - RNA, 19 nt, Homo sapiens
ugaucccucugaauuguuu

SEQ ID NO: 523067 - RNA, 19 nt, Homo sapiens
ggccgaagcauagauugua

SEQ ID NO: 523068 - RNA, 19 nt, Homo sapiens
ucaaaguaccggaaaggaa

SEQ ID NO: 523069 - RNA, 19 nt, Homo sapiens
agacaugacacuuacaaga

SEQ ID NO: 523070 - RNA, 19 nt, Homo sapiens
uaacucaacugugaaaaga

SEQ ID NO: 523071 - RNA, 19 nt, Homo sapiens
cagaauucauauagcauca

SEQ ID NO: 523072 - RNA, 19 nt, Homo sapiens
gaguaaauaguucuaaugg

SEQ ID NO: 523073 - RNA, 19 nt, Homo sapiens
ucaagcgucuuaccugaag

SEQ ID NO: 523074 - RNA, 19 nt, Homo sapiens
guaggagauggcacaguua

SEQ ID NO: 523075 - RNA, 19 nt, Homo sapiens
cgaagaaggccagaaagga

SEQ ID NO: 523076 - RNA, 19 nt, Homo sapiens
gcaauccuaugagguugau

SEQ ID NO: 523077 - RNA, 19 nt, Homo sapiens
ccgaauauacagccuuaaa

SEQ ID NO: 523078 - RNA, 19 nt, Homo sapiens
guaaaagucccucgcaauu

SEQ ID NO: 523079 - RNA, 19 nt, Homo sapiens
gaaaagacacaucacacaa

SEQ ID NO: 523080 - RNA, 19 nt, Homo sapiens
uggcagaauucauauagca

SEQ ID NO: 523081 - RNA, 19 nt, Homo sapiens
gaccauugccugauuuuaa

SEQ ID NO: 523082 - RNA, 19 nt, Homo sapiens
uuuaacauccuguaaguga

SEQ ID NO: 523083 - RNA, 19 nt, Homo sapiens
ccagaaaggaguaggagau

SEQ ID NO: 523084 - RNA, 19 nt, Homo sapiens
cccaacaccuuccaugaca

SEQ ID NO: 523085 - RNA, 19 nt, Homo sapiens
gugaggaauucagggcuuu

SEQ ID NO: 523086 - RNA, 19 nt, Homo sapiens
ucaccuugcugcugauuac

SEQ ID NO: 523087 - RNA, 19 nt, Homo sapiens
ucuuguagaccucaaagua

SEQ ID NO: 523088 - RNA, 19 nt, Homo sapiens
gacaguguuacagcaauua

SEQ ID NO: 523089 - RNA, 19 nt, Homo sapiens
ucuagaagaugacgaagac

SEQ ID NO: 523090 - RNA, 19 nt, Homo sapiens
uccuguaagugaaguuuaa

SEQ ID NO: 523091 - RNA, 19 nt, Homo sapiens
guucuaaggauuuaacauc

SEQ ID NO: 523092 - RNA, 19 nt, Homo sapiens
gcugaaauguggaugcaua

SEQ ID NO: 523093 - RNA, 19 nt, Homo sapiens
aaacagggcuuucauuugg

SEQ ID NO: 523094 - RNA, 19 nt, Homo sapiens
ccucugaccucccuuguuu

SEQ ID NO: 523095 - RNA, 19 nt, Homo sapiens
aaaggaagcucccauucaa

SEQ ID NO: 523096 - RNA, 19 nt, Homo sapiens
gcaauugauguuuccauua

SEQ ID NO: 523097 - RNA, 19 nt, Homo sapiens
gaaaggaagcucccauuca

SEQ ID NO: 523098 - RNA, 19 nt, Homo sapiens
ggacaguguuacagcaauu

SEQ ID NO: 523099 - RNA, 19 nt, Homo sapiens
cagcaacuaucaagucuga

SEQ ID NO: 523100 - RNA, 19 nt, Homo sapiens
cagcagggauuaagaagga

SEQ ID NO: 523101 - RNA, 19 nt, Homo sapiens
gaaggaagacuugaaccua

SEQ ID NO: 523102 - RNA, 19 nt, Homo sapiens
gagaaagaccgcaugaaga

SEQ ID NO: 523103 - RNA, 19 nt, Homo sapiens
caucaaaguuguccugcaa

SEQ ID NO: 523104 - RNA, 19 nt, Homo sapiens
caaaauggcagaauucaua

SEQ ID NO: 523105 - RNA, 19 nt, Homo sapiens
ugaccucccuuguuuaguu

SEQ ID NO: 523106 - RNA, 19 nt, Homo sapiens
caaaucauccugucaagug

SEQ ID NO: 523107 - RNA, 19 nt, Homo sapiens
gauuuaacauccuguaagu

SEQ ID NO: 523108 - RNA, 19 nt, Homo sapiens
guggaugcauaccgaaaua

SEQ ID NO: 523109 - RNA, 19 nt, Homo sapiens
ggagaaagaccgcaugaag

SEQ ID NO: 523110 - RNA, 19 nt, Homo sapiens
caaacugagugaugaagga

SEQ ID NO: 523111 - RNA, 19 nt, Homo sapiens
gcaacuaucaagucugaaa

SEQ ID NO: 523112 - RNA, 19 nt, Homo sapiens
ucauauagcaucaaaguug

SEQ ID NO: 523113 - RNA, 19 nt, Homo sapiens
gcacacaugaucccucuga

SEQ ID NO: 523114 - RNA, 19 nt, Homo sapiens
gaaagaccgcaugaagaua

SEQ ID NO: 523115 - RNA, 19 nt, Homo sapiens
ggucuaguuuggaaucuga

SEQ ID NO: 523116 - RNA, 19 nt, Homo sapiens
uaacaaaucauccugucaa

SEQ ID NO: 523117 - RNA, 19 nt, Homo sapiens
aaagcaaacugagugauga

SEQ ID NO: 523118 - RNA, 19 nt, Homo sapiens
ucacugcaaagacaauuua

SEQ ID NO: 523119 - RNA, 19 nt, Homo sapiens
ggaucaagaaagucuauuu

SEQ ID NO: 523120 - RNA, 19 nt, Homo sapiens
aauagaauguggaccuaaa

SEQ ID NO: 523121 - RNA, 19 nt, Homo sapiens
cgucuuaccugaagucaca

SEQ ID NO: 523122 - RNA, 19 nt, Homo sapiens
gcaugaagauacuuguaag

SEQ ID NO: 523123 - RNA, 19 nt, Homo sapiens
gcacaucuaacucaacugu

SEQ ID NO: 523124 - RNA, 19 nt, Homo sapiens
uguaaccacuguccacgua

SEQ ID NO: 523125 - RNA, 19 nt, Homo sapiens
ggaguaaauaguucuaaug

SEQ ID NO: 523126 - RNA, 19 nt, Homo sapiens
ggaccuaaauacccagaag

SEQ ID NO: 523127 - RNA, 19 nt, Homo sapiens
uuaaacagggcuuucauuu

SEQ ID NO: 523128 - RNA, 19 nt, Homo sapiens
gccgaagcauagauuguaa

SEQ ID NO: 523129 - RNA, 19 nt, Homo sapiens
aaagacacaucacacaauc

SEQ ID NO: 523130 - RNA, 19 nt, Homo sapiens
acaucuaacucaacuguga

SEQ ID NO: 523131 - RNA, 19 nt, Homo sapiens
ccauaucagugcuagcaaa

SEQ ID NO: 523132 - RNA, 19 nt, Homo sapiens
uaaacagggcuuucauuug

SEQ ID NO: 523133 - RNA, 19 nt, Homo sapiens
gccagaagccaucagguaa

SEQ ID NO: 523134 - RNA, 19 nt, Homo sapiens
ggaaaggaagcucccauuc

SEQ ID NO: 523135 - RNA, 19 nt, Homo sapiens
ucaaaguuguccugcaaga

SEQ ID NO: 523136 - RNA, 19 nt, Homo sapiens
caaagcaaacugagugaug

SEQ ID NO: 523137 - RNA, 19 nt, Homo sapiens
gaccucccuuguuuaguuu

SEQ ID NO: 523138 - RNA, 19 nt, Homo sapiens
ugaauggaguaaauaguuc

SEQ ID NO: 523139 - RNA, 19 nt, Homo sapiens
cugcaaagacaauuuauga

SEQ ID NO: 523140 - RNA, 19 nt, Homo sapiens
cacaugaucccucugaauu

SEQ ID NO: 523141 - RNA, 19 nt, Homo sapiens
agaauagucaccaggguua

SEQ ID NO: 523142 - RNA, 19 nt, Homo sapiens
ggccagaagccaucaggua

SEQ ID NO: 523143 - RNA, 19 nt, Homo sapiens
caugacacuuccuugcuuu

SEQ ID NO: 523144 - RNA, 19 nt, Homo sapiens
aaccgaauauacagccuua

SEQ ID NO: 523145 - RNA, 19 nt, Homo sapiens
ggaugcauaccgaaauaaa

SEQ ID NO: 523146 - RNA, 19 nt, Homo sapiens
gagagguucaagcgucuua

SEQ ID NO: 523147 - RNA, 19 nt, Homo sapiens
gguugaacuuggagaaaga

SEQ ID NO: 523148 - RNA, 19 nt, Homo sapiens
uaacaguauuccauaagca

SEQ ID NO: 523149 - RNA, 19 nt, Homo sapiens
gaagcucccauucaaagga

SEQ ID NO: 523150 - RNA, 19 nt, Homo sapiens
cauauagcaucaaaguugu

SEQ ID NO: 523151 - RNA, 19 nt, Homo sapiens
aaauuucacugcaaagaca

SEQ ID NO: 523152 - RNA, 19 nt, Homo sapiens
agaaagaccgcaugaagau

SEQ ID NO: 523153 - RNA, 19 nt, Homo sapiens
gaagccaucagguaagguu

SEQ ID NO: 523154 - RNA, 19 nt, Homo sapiens
gggcacaucuaacucaacu

SEQ ID NO: 523155 - RNA, 19 nt, Homo sapiens
gccuaaugaugucuaaaga

SEQ ID NO: 523156 - RNA, 19 nt, Homo sapiens
caugaucccucugaauugu

SEQ ID NO: 523157 - RNA, 19 nt, Homo sapiens
ccaugacacuuccuugcuu

SEQ ID NO: 523158 - RNA, 19 nt, Homo sapiens
uagaauguggaccuaaaua

SEQ ID NO: 523159 - RNA, 19 nt, Homo sapiens
ggcuugaccuccuggcaaa

SEQ ID NO: 523160 - RNA, 19 nt, Homo sapiens
ugaucccucugaauuguuu

SEQ ID NO: 523161 - RNA, 19 nt, Homo sapiens
ggccgaagcauagauugua

SEQ ID NO: 523162 - RNA, 19 nt, Homo sapiens
ucaaaguaccggaaaggaa

SEQ ID NO: 523163 - RNA, 19 nt, Homo sapiens
ucaagcgucuuaccugaag

SEQ ID NO: 523164 - RNA, 19 nt, Homo sapiens
uaacucaacugugaaaaga

SEQ ID NO: 523165 - RNA, 19 nt, Homo sapiens
cagaauucauauagcauca

SEQ ID NO: 523166 - RNA, 19 nt, Homo sapiens
gaguaaauaguucuaaugg

SEQ ID NO: 523167 - RNA, 19 nt, Homo sapiens
ccgaauauacagccuuaaa

SEQ ID NO: 523168 - RNA, 19 nt, Homo sapiens
ggccuucggugaggaauuc

SEQ ID NO: 523169 - RNA, 19 nt, Homo sapiens
gaaaagacacaucacacaa

SEQ ID NO: 523170 - RNA, 19 nt, Homo sapiens
uggcagaauucauauagca

SEQ ID NO: 523171 - RNA, 19 nt, Homo sapiens
gaccauugccugauuuuaa

SEQ ID NO: 523172 - RNA, 19 nt, Homo sapiens
uuuaacauccuguaaguga

SEQ ID NO: 523173 - RNA, 19 nt, Homo sapiens
cccaacaccuuccaugaca

SEQ ID NO: 523174 - RNA, 19 nt, Homo sapiens
gugaggaauucagggcuuu

SEQ ID NO: 523175 - RNA, 19 nt, Homo sapiens
ucaccuugcugcugauuac

SEQ ID NO: 523176 - RNA, 19 nt, Homo sapiens
ucuuguagaccucaaagua

SEQ ID NO: 523177 - RNA, 19 nt, Homo sapiens
gacaguguuacagcaauua

SEQ ID NO: 523178 - RNA, 19 nt, Homo sapiens
uccuguaagugaaguuuaa

SEQ ID NO: 523179 - RNA, 19 nt, Homo sapiens
guucuaaggauuuaacauc

SEQ ID NO: 523180 - RNA, 19 nt, Homo sapiens
ggucauccuugcaauccau

SEQ ID NO: 523181 - RNA, 19 nt, Homo sapiens
ggaagacuugaaccuagaa

SEQ ID NO: 523182 - RNA, 19 nt, Homo sapiens
ggacccaagagccauauca

SEQ ID NO: 523183 - RNA, 19 nt, Homo sapiens
uaccugaagucacaaagca

SEQ ID NO: 523184 - RNA, 19 nt, Homo sapiens
ccugggaaaugaauauugg

SEQ ID NO: 523185 - RNA, 19 nt, Homo sapiens
cagguaagguuggaaagag

SEQ ID NO: 523186 - RNA, 19 nt, Homo sapiens
gaagacuugaaccuagaaa

SEQ ID NO: 523187 - RNA, 19 nt, Homo sapiens
gcccuuggccgaagcauag

SEQ ID NO: 523188 - RNA, 19 nt, Homo sapiens
ggacuacugcuaggugugu

SEQ ID NO: 523189 - RNA, 19 nt, Homo sapiens
cccauucaaaggaaauuua

SEQ ID NO: 523190 - RNA, 19 nt, Homo sapiens
ggggaaaaccuuaguucua

SEQ ID NO: 523191 - RNA, 19 nt, Homo sapiens
uaucaagucugaaaagcaa

SEQ ID NO: 523192 - RNA, 19 nt, Homo sapiens
ggaaauagguguauggaua

SEQ ID NO: 523193 - RNA, 19 nt, Homo sapiens
gaaaggcacugucauuuaa

SEQ ID NO: 523194 - RNA, 19 nt, Homo sapiens
ggacaaacauacaacaauu

SEQ ID NO: 523195 - RNA, 19 nt, Homo sapiens
gcacugucauuuaaacaua

SEQ ID NO: 523196 - RNA, 19 nt, Homo sapiens
aaagagagcugcaguugaa

SEQ ID NO: 523197 - RNA, 19 nt, Homo sapiens
gagcuaagacgucuaauga

SEQ ID NO: 523198 - RNA, 19 nt, Homo sapiens
ggaagaacuugaagaagga

SEQ ID NO: 523199 - RNA, 19 nt, Homo sapiens
gaauucagguuuacaagau

SEQ ID NO: 523200 - RNA, 19 nt, Homo sapiens
gcuaagacgucuaaugaug

SEQ ID NO: 523201 - RNA, 19 nt, Homo sapiens
cgaaauagaauucagguuu

SEQ ID NO: 523202 - RNA, 19 nt, Homo sapiens
cuaaugauguccaaagaaa

SEQ ID NO: 523203 - RNA, 19 nt, Homo sapiens
cagaauauauagccugaaa

SEQ ID NO: 523204 - RNA, 19 nt, Homo sapiens
ggacaggcaugauuauugg

SEQ ID NO: 523205 - RNA, 19 nt, Homo sapiens
aaacagaaauggcaugcuu

SEQ ID NO: 523206 - RNA, 19 nt, Homo sapiens
ugaaaggcacugucauuua

SEQ ID NO: 523207 - RNA, 19 nt, Homo sapiens
gaguuaaaguuccucguaa

SEQ ID NO: 523208 - RNA, 19 nt, Homo sapiens
gaaagcguguggagaagug

SEQ ID NO: 523209 - RNA, 19 nt, Homo sapiens
caacaaccuucuacucaug

SEQ ID NO: 523210 - RNA, 19 nt, Homo sapiens
gaugaaagcguguggagaa

SEQ ID NO: 523211 - RNA, 19 nt, Homo sapiens
gaaauagguguauggauau

SEQ ID NO: 523212 - RNA, 19 nt, Homo sapiens
ggaagcauguguguuucua

SEQ ID NO: 523213 - RNA, 19 nt, Homo sapiens
aagcuguucuuguguguua

SEQ ID NO: 523214 - RNA, 19 nt, Homo sapiens
gaaagagagcugcaguuga

SEQ ID NO: 523215 - RNA, 19 nt, Homo sapiens
guguacuucuugugaauua

SEQ ID NO: 523216 - RNA, 19 nt, Homo sapiens
gagcugcaguugaaauugu

SEQ ID NO: 523217 - RNA, 19 nt, Homo sapiens
ggaguuaaaguuccucgua

SEQ ID NO: 523218 - RNA, 19 nt, Homo sapiens
guugaugaauuccuguuaa

SEQ ID NO: 523219 - RNA, 19 nt, Homo sapiens
gaauauauagccugaaagu

SEQ ID NO: 523220 - RNA, 19 nt, Homo sapiens
aaacaugaccuggacauuu

SEQ ID NO: 523221 - RNA, 19 nt, Homo sapiens
gcauaccaguguuagcaaa

SEQ ID NO: 523222 - RNA, 19 nt, Homo sapiens
gaagcuccuccgucaguua

SEQ ID NO: 523223 - RNA, 19 nt, Homo sapiens
aacaugaccuggacauuug

SEQ ID NO: 523224 - RNA, 19 nt, Homo sapiens
caagagcuaagacgucuaa

SEQ ID NO: 523225 - RNA, 19 nt, Homo sapiens
uauauagccugaaaguaga

SEQ ID NO: 523226 - RNA, 19 nt, Homo sapiens
gacugugccauuucuauua

SEQ ID NO: 523227 - RNA, 19 nt, Homo sapiens
guaacagacaugguaaaua

SEQ ID NO: 523228 - RNA, 19 nt, Homo sapiens
ggaccuaaauacccagaag

SEQ ID NO: 523229 - RNA, 19 nt, Homo sapiens
aagcauguguguuucuaaa

SEQ ID NO: 523230 - RNA, 19 nt, Homo sapiens
guuaaaagcuguucuugug

SEQ ID NO: 523231 - RNA, 19 nt, Homo sapiens
acagaaauggcaugcuuua

SEQ ID NO: 523232 - RNA, 19 nt, Homo sapiens
ugaaacguguccucagaga

SEQ ID NO: 523233 - RNA, 19 nt, Homo sapiens
gcuuuacccaucuuacuua

SEQ ID NO: 523234 - RNA, 19 nt, Homo sapiens
guaggcgacgguacaguua

SEQ ID NO: 523235 - RNA, 19 nt, Homo sapiens
gagagcugcaguugaaauu

SEQ ID NO: 523236 - RNA, 19 nt, Homo sapiens
guucuuguguguuacaugu

SEQ ID NO: 523237 - RNA, 19 nt, Homo sapiens
uuacccaucuuacuuagug

SEQ ID NO: 523238 - RNA, 19 nt, Homo sapiens
ggaucucaaacuugucuua

SEQ ID NO: 523239 - RNA, 19 nt, Homo sapiens
cuggacauuuguaagaaua

SEQ ID NO: 523240 - RNA, 19 nt, Homo sapiens
gaccuggacauuuguaaga

SEQ ID NO: 523241 - RNA, 19 nt, Homo sapiens
gaucucaaacuugucuuaa

SEQ ID NO: 523242 - RNA, 19 nt, Homo sapiens
ccaaggacaaauuaugaaa

SEQ ID NO: 523243 - RNA, 19 nt, Homo sapiens
caccaaggacaaauuauga

SEQ ID NO: 523244 - RNA, 19 nt, Homo sapiens
ggccaccaaggacaaauua

SEQ ID NO: 523245 - RNA, 19 nt, Homo sapiens
ccucagagacugugccauu

SEQ ID NO: 523246 - RNA, 19 nt, Homo sapiens
ugaauauugucacagaugu

SEQ ID NO: 523247 - RNA, 19 nt, Homo sapiens
guuaaaguuccucguaauu

SEQ ID NO: 523248 - RNA, 19 nt, Homo sapiens
acauaaaccuggaguacuc

SEQ ID NO: 523249 - RNA, 19 nt, Homo sapiens
ugugaaacguguccucaga

SEQ ID NO: 523250 - RNA, 19 nt, Homo sapiens
caaugugggugcugacuac

SEQ ID NO: 523251 - RNA, 19 nt, Homo sapiens
gcaaugugggugcugacua

SEQ ID NO: 523252 - RNA, 19 nt, Homo sapiens
ugaaagagagcugcaguug

SEQ ID NO: 523253 - RNA, 19 nt, Homo sapiens
gaagcauguguguuucuaa

SEQ ID NO: 523254 - RNA, 19 nt, Homo sapiens
ucaacaaccuucuacucau

SEQ ID NO: 523255 - RNA, 19 nt, Homo sapiens
uagaauguggaccuaaaua

SEQ ID NO: 523256 - RNA, 19 nt, Homo sapiens
gaguuugauuucaccagaa

SEQ ID NO: 523257 - RNA, 19 nt, Homo sapiens
ggaguccuagguauuauau

SEQ ID NO: 523258 - RNA, 19 nt, Homo sapiens
gaaggacaaacauacaaca

SEQ ID NO: 523259 - RNA, 19 nt, Homo sapiens
gaacuugaagaaggacaaa

SEQ ID NO: 523260 - RNA, 19 nt, Homo sapiens
aguagaauguggaccuaaa

SEQ ID NO: 523261 - RNA, 19 nt, Homo sapiens
gguugcaaauuauccaaau

SEQ ID NO: 523262 - RNA, 19 nt, Homo sapiens
caaaccaugcauuuaaguu

SEQ ID NO: 523263 - RNA, 19 nt, Homo sapiens
cuacucauguuaaugucuu

SEQ ID NO: 523264 - RNA, 19 nt, Homo sapiens
uaagacgucuaaugauguc

SEQ ID NO: 523265 - RNA, 19 nt, Homo sapiens
gagcauaccaguguuagca

SEQ ID NO: 523266 - RNA, 19 nt, Homo sapiens
guguauggauaugugauuu

SEQ ID NO: 523267 - RNA, 19 nt, Homo sapiens
ggaguacucgaaauagaau

SEQ ID NO: 523268 - RNA, 19 nt, Homo sapiens
auauauagccugaaaguag

SEQ ID NO: 523269 - RNA, 19 nt, Homo sapiens
ccaccaaggacaaauuaug

SEQ ID NO: 523270 - RNA, 19 nt, Homo sapiens
aaaguagaauguggaccua

SEQ ID NO: 523271 - RNA, 19 nt, Homo sapiens
gagacugugccauuucuau

SEQ ID NO: 523272 - RNA, 19 nt, Homo sapiens
cagacaugguaaauauuug

SEQ ID NO: 523273 - RNA, 19 nt, Homo sapiens
guuggaagaacuugaagaa

SEQ ID NO: 523274 - RNA, 19 nt, Homo sapiens
uaguggaucucaaacuugu

SEQ ID NO: 523275 - RNA, 19 nt, Homo sapiens
guucaggauuguuuugaua

SEQ ID NO: 523276 - RNA, 19 nt, Homo sapiens
guagcagguacaaugaaua

SEQ ID NO: 523277 - RNA, 19 nt, Homo sapiens
uuuaguggaucucaaacuu

SEQ ID NO: 523278 - RNA, 19 nt, Homo sapiens
caccagaaggacaaacaua

SEQ ID NO: 523279 - RNA, 19 nt, Homo sapiens
uagcagguacaaugaauau

SEQ ID NO: 523280 - RNA, 19 nt, Homo sapiens
aaaguagcagguacaauga

SEQ ID NO: 523281 - RNA, 19 nt, Homo sapiens
aguggaagcauguguguuu

SEQ ID NO: 523282 - RNA, 19 nt, Homo sapiens
aaagaauuccagcugguaa

SEQ ID NO: 523283 - RNA, 19 nt, Homo sapiens
caaccuucuacucauguua

SEQ ID NO: 523284 - RNA, 19 nt, Homo sapiens
ugccauuucuauuauguug

SEQ ID NO: 523285 - RNA, 19 nt, Homo sapiens
cagagacugugccauuucu

SEQ ID NO: 523286 - RNA, 19 nt, Homo sapiens
guacacccauuauguuuuc

SEQ ID NO: 523287 - RNA, 19 nt, Homo sapiens
cagaaggacaaacauacaa

SEQ ID NO: 523288 - RNA, 19 nt, Homo sapiens
gcccggagcauaccagugu

SEQ ID NO: 523289 - RNA, 19 nt, Homo sapiens
aaacauaaaccuggaguac

SEQ ID NO: 523290 - RNA, 19 nt, Homo sapiens
gucuaaugauguccaaaga

SEQ ID NO: 523291 - RNA, 19 nt, Homo sapiens
uauguacacccauuauguu

SEQ ID NO: 523292 - RNA, 19 nt, Homo sapiens
gaugaucacuuuccagaua

SEQ ID NO: 523293 - RNA, 19 nt, Homo sapiens
gaacuacucucccaaggaa

SEQ ID NO: 523294 - RNA, 19 nt, Homo sapiens
ggacacaaaucacaaugaa

SEQ ID NO: 523295 - RNA, 19 nt, Homo sapiens
guacagagcuuccggaaag

SEQ ID NO: 523296 - RNA, 19 nt, Homo sapiens
ggaaguuuguuguuuguuu

SEQ ID NO: 523297 - RNA, 19 nt, Homo sapiens
ccagauugcucucuaauga

SEQ ID NO: 523298 - RNA, 19 nt, Homo sapiens
gaaaggcgcuagaauugau

SEQ ID NO: 523299 - RNA, 19 nt, Homo sapiens
caacaaaguuaggaaguuu

SEQ ID NO: 523300 - RNA, 19 nt, Homo sapiens
ccaauccucuuucuuagua

SEQ ID NO: 523301 - RNA, 19 nt, Homo sapiens
gaagaaagaagaaacaaga

SEQ ID NO: 523302 - RNA, 19 nt, Homo sapiens
agacaaagaugaagaugaa

SEQ ID NO: 523303 - RNA, 19 nt, Homo sapiens
gaagagaagguauaugaaa

SEQ ID NO: 523304 - RNA, 19 nt, Homo sapiens
uaacuaaggugagacauug

SEQ ID NO: 523305 - RNA, 19 nt, Homo sapiens
gcaguugaauccauauuug

SEQ ID NO: 523306 - RNA, 19 nt, Homo sapiens
gaauagaaaucuccacagu

SEQ ID NO: 523307 - RNA, 19 nt, Homo sapiens
gcaguuguauguggaauuu

SEQ ID NO: 523308 - RNA, 19 nt, Homo sapiens
aaacugaacuugguguuaa

SEQ ID NO: 523309 - RNA, 19 nt, Homo sapiens
gaaaucuagugaaugauga

SEQ ID NO: 523310 - RNA, 19 nt, Homo sapiens
agacaaugcuuuccauauu

SEQ ID NO: 523311 - RNA, 19 nt, Homo sapiens
gggagaaauuggaauguuu

SEQ ID NO: 523312 - RNA, 19 nt, Homo sapiens
gaaggaauuugucaaucuu

SEQ ID NO: 523313 - RNA, 19 nt, Homo sapiens
gaaugagguucuagaaaug

SEQ ID NO: 523314 - RNA, 19 nt, Homo sapiens
ugaaugagguucuagaaau

SEQ ID NO: 523315 - RNA, 19 nt, Homo sapiens
caagaaaggcgcuagaauu

SEQ ID NO: 523316 - RNA, 19 nt, Homo sapiens
ggaaggaauuugucaaucu

SEQ ID NO: 523317 - RNA, 19 nt, Homo sapiens
ccucagaacuuuaguaaca

SEQ ID NO: 523318 - RNA, 19 nt, Homo sapiens
gaaaaccacuuaucccuuu

SEQ ID NO: 523319 - RNA, 19 nt, Homo sapiens
ccacugugcuucuuaaugu

SEQ ID NO: 523320 - RNA, 19 nt, Homo sapiens
caaaugaaaugguagucaa

SEQ ID NO: 523321 - RNA, 19 nt, Homo sapiens
gcaacaaaguuaggaaguu

SEQ ID NO: 523322 - RNA, 19 nt, Homo sapiens
caaugaaucucccuuaaag

SEQ ID NO: 523323 - RNA, 19 nt, Homo sapiens
caacuguagucaucuuaaa

SEQ ID NO: 523324 - RNA, 19 nt, Homo sapiens
aaaugcagcuuucaaauca

SEQ ID NO: 523325 - RNA, 19 nt, Homo sapiens
gaggagaaauuaaauacuc

SEQ ID NO: 523326 - RNA, 19 nt, Homo sapiens
acaguaagcugaccuggaa

SEQ ID NO: 523327 - RNA, 19 nt, Homo sapiens
gaacagcagauuucagcua

SEQ ID NO: 523328 - RNA, 19 nt, Homo sapiens
gaaacugaacuugguguua

SEQ ID NO: 523329 - RNA, 19 nt, Homo sapiens
uaacagaagagaagguaua

SEQ ID NO: 523330 - RNA, 19 nt, Homo sapiens
ggugauugauugauugauu

SEQ ID NO: 523331 - RNA, 19 nt, Homo sapiens
gugaaaguguuacauauuc

SEQ ID NO: 523332 - RNA, 19 nt, Homo sapiens
ccaaugauguaugaucuaa

SEQ ID NO: 523333 - RNA, 19 nt, Homo sapiens
gacagcaguugaauccaua

SEQ ID NO: 523334 - RNA, 19 nt, Homo sapiens
gcaccaguguuauuggaaa

SEQ ID NO: 523335 - RNA, 19 nt, Homo sapiens
cagaagagaagguauauga

SEQ ID NO: 523336 - RNA, 19 nt, Homo sapiens
ccacguaaccuucaaguau

SEQ ID NO: 523337 - RNA, 19 nt, Homo sapiens
uaugacaugucccuuuaua

SEQ ID NO: 523338 - RNA, 19 nt, Homo sapiens
ugaagaagaugaugaagag

SEQ ID NO: 523339 - RNA, 19 nt, Homo sapiens
ggauauugaugccauuaga

SEQ ID NO: 523340 - RNA, 19 nt, Homo sapiens
ugacaugucccuuuauauu

SEQ ID NO: 523341 - RNA, 19 nt, Homo sapiens
gucgaaaucuagugaauga

SEQ ID NO: 523342 - RNA, 19 nt, Homo sapiens
ggaagaagacucagaagca

SEQ ID NO: 523343 - RNA, 19 nt, Homo sapiens
guagagaaagagaggauua

SEQ ID NO: 523344 - RNA, 19 nt, Homo sapiens
ggacagcaguugaauccau

SEQ ID NO: 523345 - RNA, 19 nt, Homo sapiens
gaauucgcauguacaguga

SEQ ID NO: 523346 - RNA, 19 nt, Homo sapiens
ugaaugcugucacaaagaa

SEQ ID NO: 523347 - RNA, 19 nt, Homo sapiens
gaagaagacucagaagcau

SEQ ID NO: 523348 - RNA, 19 nt, Homo sapiens
ggugagacauugauauauc

SEQ ID NO: 523349 - RNA, 19 nt, Homo sapiens
uagccaauccucuuucuua

SEQ ID NO: 523350 - RNA, 19 nt, Homo sapiens
gauuucagcuacauauaug

SEQ ID NO: 523351 - RNA, 19 nt, Homo sapiens
gggaaaucguucauucauu

SEQ ID NO: 523352 - RNA, 19 nt, Homo sapiens
ugagggagguguuuccaaa

SEQ ID NO: 523353 - RNA, 19 nt, Homo sapiens
ugacguaucacaauguaua

SEQ ID NO: 523354 - RNA, 19 nt, Homo sapiens
gaaugugacuugacguauc

SEQ ID NO: 523355 - RNA, 19 nt, Homo sapiens
gaugaugugucuguggaua

SEQ ID NO: 523356 - RNA, 19 nt, Homo sapiens
gaagacaaugcuuuccaua

SEQ ID NO: 523357 - RNA, 19 nt, Homo sapiens
acaaguagguuuacauuac

SEQ ID NO: 523358 - RNA, 19 nt, Homo sapiens
guuaggaaguuuguuguuu

SEQ ID NO: 523359 - RNA, 19 nt, Homo sapiens
guaacagcacaacaaauua

SEQ ID NO: 523360 - RNA, 19 nt, Homo sapiens
gauguaugaucuaaaggaa

SEQ ID NO: 523361 - RNA, 19 nt, Homo sapiens
guaacccaaugauguauga

SEQ ID NO: 523362 - RNA, 19 nt, Homo sapiens
ugaagaagcaguuguaugu

SEQ ID NO: 523363 - RNA, 19 nt, Homo sapiens
gagaagguauaugaaauuc

SEQ ID NO: 523364 - RNA, 19 nt, Homo sapiens
gagaugaucgcuauggaaa

SEQ ID NO: 523365 - RNA, 19 nt, Homo sapiens
gaaagaagaaacaagaaag

SEQ ID NO: 523366 - RNA, 19 nt, Homo sapiens
gaaacuauuacuccuaaga

SEQ ID NO: 523367 - RNA, 19 nt, Homo sapiens
gcacuuguccggcuagaga

SEQ ID NO: 523368 - RNA, 19 nt, Homo sapiens
aagcugaccuggaaaugaa

SEQ ID NO: 523369 - RNA, 19 nt, Homo sapiens
ggaauacucaagcaaagaa

SEQ ID NO: 523370 - RNA, 19 nt, Homo sapiens
gaaaugaagccugcacgaa

SEQ ID NO: 523371 - RNA, 19 nt, Homo sapiens
guacaaguagguuuacauu

SEQ ID NO: 523372 - RNA, 19 nt, Homo sapiens
gugccucccuucuuuauug

SEQ ID NO: 523373 - RNA, 19 nt, Homo sapiens
cugacuacauucucaauaa

SEQ ID NO: 523374 - RNA, 19 nt, Homo sapiens
uuuaugacaugucccuuua

SEQ ID NO: 523375 - RNA, 19 nt, Homo sapiens
gaagggagaaauuggaaug

SEQ ID NO: 523376 - RNA, 19 nt, Homo sapiens
ccacaguagucaccuaugu

SEQ ID NO: 523377 - RNA, 19 nt, Homo sapiens
ucucauacuugcuuuaaug

SEQ ID NO: 523378 - RNA, 19 nt, Homo sapiens
agacucuucuugcaguuua

SEQ ID NO: 523379 - RNA, 19 nt, Homo sapiens
cagggacucuguucugauu

SEQ ID NO: 523380 - RNA, 19 nt, Homo sapiens
ggaaaauccugcagacuug

SEQ ID NO: 523381 - RNA, 19 nt, Homo sapiens
gcgugaaaguguuacauau

SEQ ID NO: 523382 - RNA, 19 nt, Homo sapiens
acacaaaucacaaugaaga

SEQ ID NO: 523383 - RNA, 19 nt, Homo sapiens
gguuuacuaugcaaaugua

SEQ ID NO: 523384 - RNA, 19 nt, Homo sapiens
caccuaacguggaauguga

SEQ ID NO: 523385 - RNA, 19 nt, Homo sapiens
guaauuaaagugaggagaa

SEQ ID NO: 523386 - RNA, 19 nt, Homo sapiens
ggaaggaagggagaaauug

SEQ ID NO: 523387 - RNA, 19 nt, Homo sapiens
ggagguguuuccaaagaau

SEQ ID NO: 523388 - RNA, 19 nt, Homo sapiens
gacaauagaauucgcaugu

SEQ ID NO: 523389 - RNA, 19 nt, Homo sapiens
uuaaugaaccacugaauga

SEQ ID NO: 523390 - RNA, 19 nt, Homo sapiens
gagaaagagaggauuauuc

SEQ ID NO: 523391 - RNA, 19 nt, Homo sapiens
gaacaagaaaggcgcuaga

SEQ ID NO: 523392 - RNA, 19 nt, Homo sapiens
gaugaucacuuuccagaua

SEQ ID NO: 523393 - RNA, 19 nt, Homo sapiens
gaacuacucucccaaggaa

SEQ ID NO: 523394 - RNA, 19 nt, Homo sapiens
ggacacaaaucacaaugaa

SEQ ID NO: 523395 - RNA, 19 nt, Homo sapiens
guacagagcuuccggaaag

SEQ ID NO: 523396 - RNA, 19 nt, Homo sapiens
ggaaguuuguuguuuguuu

SEQ ID NO: 523397 - RNA, 19 nt, Homo sapiens
ccagauugcucucuaauga

SEQ ID NO: 523398 - RNA, 19 nt, Homo sapiens
gaaaggcgcuagaauugau

SEQ ID NO: 523399 - RNA, 19 nt, Homo sapiens
caacaaaguuaggaaguuu

SEQ ID NO: 523400 - RNA, 19 nt, Homo sapiens
ccaauccucuuucuuagua

SEQ ID NO: 523401 - RNA, 19 nt, Homo sapiens
gaagaaagaagaaacaaga

SEQ ID NO: 523402 - RNA, 19 nt, Homo sapiens
agacaaagaugaagaugaa

SEQ ID NO: 523403 - RNA, 19 nt, Homo sapiens
gaagagaagguauaugaaa

SEQ ID NO: 523404 - RNA, 19 nt, Homo sapiens
uaacuaaggugagacauug

SEQ ID NO: 523405 - RNA, 19 nt, Homo sapiens
gcaguugaauccauauuug

SEQ ID NO: 523406 - RNA, 19 nt, Homo sapiens
gaauagaaaucuccacagu

SEQ ID NO: 523407 - RNA, 19 nt, Homo sapiens
gcaguuguauguggaauuu

SEQ ID NO: 523408 - RNA, 19 nt, Homo sapiens
aaacugaacuugguguuaa

SEQ ID NO: 523409 - RNA, 19 nt, Homo sapiens
gaaaucuagugaaugauga

SEQ ID NO: 523410 - RNA, 19 nt, Homo sapiens
agacaaugcuuuccauauu

SEQ ID NO: 523411 - RNA, 19 nt, Homo sapiens
gggagaaauuggaauguuu

SEQ ID NO: 523412 - RNA, 19 nt, Homo sapiens
gaaggaauuugucaaucuu

SEQ ID NO: 523413 - RNA, 19 nt, Homo sapiens
gaaugagguucuagaaaug

SEQ ID NO: 523414 - RNA, 19 nt, Homo sapiens
ugaaugagguucuagaaau

SEQ ID NO: 523415 - RNA, 19 nt, Homo sapiens
caagaaaggcgcuagaauu

SEQ ID NO: 523416 - RNA, 19 nt, Homo sapiens
ggaaggaauuugucaaucu

SEQ ID NO: 523417 - RNA, 19 nt, Homo sapiens
ccucagaacuuuaguaaca

SEQ ID NO: 523418 - RNA, 19 nt, Homo sapiens
gaaaaccacuuaucccuuu

SEQ ID NO: 523419 - RNA, 19 nt, Homo sapiens
ccacugugcuucuuaaugu

SEQ ID NO: 523420 - RNA, 19 nt, Homo sapiens
caaaugaaaugguagucaa

SEQ ID NO: 523421 - RNA, 19 nt, Homo sapiens
gcaacaaaguuaggaaguu

SEQ ID NO: 523422 - RNA, 19 nt, Homo sapiens
caaugaaucucccuuaaag

SEQ ID NO: 523423 - RNA, 19 nt, Homo sapiens
caacuguagucaucuuaaa

SEQ ID NO: 523424 - RNA, 19 nt, Homo sapiens
aaaugcagcuuucaaauca

SEQ ID NO: 523425 - RNA, 19 nt, Homo sapiens
gaggagaaauuaaauacuc

SEQ ID NO: 523426 - RNA, 19 nt, Homo sapiens
acaguaagcugaccuggaa

SEQ ID NO: 523427 - RNA, 19 nt, Homo sapiens
gaacagcagauuucagcua

SEQ ID NO: 523428 - RNA, 19 nt, Homo sapiens
gaaacugaacuugguguua

SEQ ID NO: 523429 - RNA, 19 nt, Homo sapiens
uaacagaagagaagguaua

SEQ ID NO: 523430 - RNA, 19 nt, Homo sapiens
ggugauugauugauugauu

SEQ ID NO: 523431 - RNA, 19 nt, Homo sapiens
gugaaaguguuacauauuc

SEQ ID NO: 523432 - RNA, 19 nt, Homo sapiens
ccaaugauguaugaucuaa

SEQ ID NO: 523433 - RNA, 19 nt, Homo sapiens
gacagcaguugaauccaua

SEQ ID NO: 523434 - RNA, 19 nt, Homo sapiens
cagaagagaagguauauga

SEQ ID NO: 523435 - RNA, 19 nt, Homo sapiens
ccacguaaccuucaaguau

SEQ ID NO: 523436 - RNA, 19 nt, Homo sapiens
uaugacaugucccuuuaua

SEQ ID NO: 523437 - RNA, 19 nt, Homo sapiens
ugaagaagaugaugaagag

SEQ ID NO: 523438 - RNA, 19 nt, Homo sapiens
ggauauugaugccauuaga

SEQ ID NO: 523439 - RNA, 19 nt, Homo sapiens
ugacaugucccuuuauauu

SEQ ID NO: 523440 - RNA, 19 nt, Homo sapiens
gucgaaaucuagugaauga

SEQ ID NO: 523441 - RNA, 19 nt, Homo sapiens
ggaagaagacucagaagca

SEQ ID NO: 523442 - RNA, 19 nt, Homo sapiens
guagagaaagagaggauua

SEQ ID NO: 523443 - RNA, 19 nt, Homo sapiens
ggacagcaguugaauccau

SEQ ID NO: 523444 - RNA, 19 nt, Homo sapiens
gaauucgcauguacaguga

SEQ ID NO: 523445 - RNA, 19 nt, Homo sapiens
ugaaugcugucacaaagaa

SEQ ID NO: 523446 - RNA, 19 nt, Homo sapiens
gaagaagacucagaagcau

SEQ ID NO: 523447 - RNA, 19 nt, Homo sapiens
ggugagacauugauauauc

SEQ ID NO: 523448 - RNA, 19 nt, Homo sapiens
uagccaauccucuuucuua

SEQ ID NO: 523449 - RNA, 19 nt, Homo sapiens
gauuucagcuacauauaug

SEQ ID NO: 523450 - RNA, 19 nt, Homo sapiens
gggaaaucguucauucauu

SEQ ID NO: 523451 - RNA, 19 nt, Homo sapiens
ugagggagguguuuccaaa

SEQ ID NO: 523452 - RNA, 19 nt, Homo sapiens
ugacguaucacaauguaua

SEQ ID NO: 523453 - RNA, 19 nt, Homo sapiens
gaaugugacuugacguauc

SEQ ID NO: 523454 - RNA, 19 nt, Homo sapiens
gaugaugugucuguggaua

SEQ ID NO: 523455 - RNA, 19 nt, Homo sapiens
gaagacaaugcuuuccaua

SEQ ID NO: 523456 - RNA, 19 nt, Homo sapiens
acaaguagguuuacauuac

SEQ ID NO: 523457 - RNA, 19 nt, Homo sapiens
guuaggaaguuuguuguuu

SEQ ID NO: 523458 - RNA, 19 nt, Homo sapiens
guaacagcacaacaaauua

SEQ ID NO: 523459 - RNA, 19 nt, Homo sapiens
gauguaugaucuaaaggaa

SEQ ID NO: 523460 - RNA, 19 nt, Homo sapiens
guaacccaaugauguauga

SEQ ID NO: 523461 - RNA, 19 nt, Homo sapiens
ugaagaagcaguuguaugu

SEQ ID NO: 523462 - RNA, 19 nt, Homo sapiens
gagaagguauaugaaauuc

SEQ ID NO: 523463 - RNA, 19 nt, Homo sapiens
gagaugaucgcuauggaaa

SEQ ID NO: 523464 - RNA, 19 nt, Homo sapiens
gaaagaagaaacaagaaag

SEQ ID NO: 523465 - RNA, 19 nt, Homo sapiens
gaaacuauuacuccuaaga

SEQ ID NO: 523466 - RNA, 19 nt, Homo sapiens
gcacuuguccggcuagaga

SEQ ID NO: 523467 - RNA, 19 nt, Homo sapiens
aagcugaccuggaaaugaa

SEQ ID NO: 523468 - RNA, 19 nt, Homo sapiens
gaaaugaagccugcacgaa

SEQ ID NO: 523469 - RNA, 19 nt, Homo sapiens
ggaauacucaagcaaagaa

SEQ ID NO: 523470 - RNA, 19 nt, Homo sapiens
guacaaguagguuuacauu

SEQ ID NO: 523471 - RNA, 19 nt, Homo sapiens
gugccucccuucuuuauug

SEQ ID NO: 523472 - RNA, 19 nt, Homo sapiens
cugacuacauucucaauaa

SEQ ID NO: 523473 - RNA, 19 nt, Homo sapiens
uuuaugacaugucccuuua

SEQ ID NO: 523474 - RNA, 19 nt, Homo sapiens
gaagggagaaauuggaaug

SEQ ID NO: 523475 - RNA, 19 nt, Homo sapiens
ccacaguagucaccuaugu

SEQ ID NO: 523476 - RNA, 19 nt, Homo sapiens
ucucauacuugcuuuaaug

SEQ ID NO: 523477 - RNA, 19 nt, Homo sapiens
agacucuucuugcaguuua

SEQ ID NO: 523478 - RNA, 19 nt, Homo sapiens
cagggacucuguucugauu

SEQ ID NO: 523479 - RNA, 19 nt, Homo sapiens
ggaaaauccugcagacuug

SEQ ID NO: 523480 - RNA, 19 nt, Homo sapiens
gcgugaaaguguuacauau

SEQ ID NO: 523481 - RNA, 19 nt, Homo sapiens
acacaaaucacaaugaaga

SEQ ID NO: 523482 - RNA, 19 nt, Homo sapiens
gguuuacuaugcaaaugua

SEQ ID NO: 523483 - RNA, 19 nt, Homo sapiens
caccuaacguggaauguga

SEQ ID NO: 523484 - RNA, 19 nt, Homo sapiens
guaauuaaagugaggagaa

SEQ ID NO: 523485 - RNA, 19 nt, Homo sapiens
ggaaggaagggagaaauug

SEQ ID NO: 523486 - RNA, 19 nt, Homo sapiens
ggagguguuuccaaagaau

SEQ ID NO: 523487 - RNA, 19 nt, Homo sapiens
cagcuuaccuugagaacuc

SEQ ID NO: 523488 - RNA, 19 nt, Homo sapiens
gacaauagaauucgcaugu

SEQ ID NO: 523489 - RNA, 19 nt, Homo sapiens
uuaaugaaccacugaauga

SEQ ID NO: 523490 - RNA, 19 nt, Homo sapiens
gagaaagagaggauuauuc

SEQ ID NO: 523491 - RNA, 19 nt, Homo sapiens
gaacaagaaaggcgcuaga

SEQ ID NO: 523492 - RNA, 19 nt, Homo sapiens
gaugaucacuuuccagaua

SEQ ID NO: 523493 - RNA, 19 nt, Homo sapiens
gaacuacucucccaaggaa

SEQ ID NO: 523494 - RNA, 19 nt, Homo sapiens
ggacacaaaucacaaugaa

SEQ ID NO: 523495 - RNA, 19 nt, Homo sapiens
guacagagcuuccggaaag

SEQ ID NO: 523496 - RNA, 19 nt, Homo sapiens
ggaaguuuguuguuuguuu

SEQ ID NO: 523497 - RNA, 19 nt, Homo sapiens
ccagauugcucucuaauga

SEQ ID NO: 523498 - RNA, 19 nt, Homo sapiens
gaaaggcgcuagaauugau

SEQ ID NO: 523499 - RNA, 19 nt, Homo sapiens
caacaaaguuaggaaguuu

SEQ ID NO: 523500 - RNA, 19 nt, Homo sapiens
ccaauccucuuucuuagua

SEQ ID NO: 523501 - RNA, 19 nt, Homo sapiens
gaagaaagaagaaacaaga

SEQ ID NO: 523502 - RNA, 19 nt, Homo sapiens
agacaaagaugaagaugaa

SEQ ID NO: 523503 - RNA, 19 nt, Homo sapiens
gaagagaagguauaugaaa

SEQ ID NO: 523504 - RNA, 19 nt, Homo sapiens
uaacuaaggugagacauug

SEQ ID NO: 523505 - RNA, 19 nt, Homo sapiens
gcaguugaauccauauuug

SEQ ID NO: 523506 - RNA, 19 nt, Homo sapiens
gaauagaaaucuccacagu

SEQ ID NO: 523507 - RNA, 19 nt, Homo sapiens
gcaguuguauguggaauuu

SEQ ID NO: 523508 - RNA, 19 nt, Homo sapiens
aaacugaacuugguguuaa

SEQ ID NO: 523509 - RNA, 19 nt, Homo sapiens
gaaaucuagugaaugauga

SEQ ID NO: 523510 - RNA, 19 nt, Homo sapiens
agacaaugcuuuccauauu

SEQ ID NO: 523511 - RNA, 19 nt, Homo sapiens
gggagaaauuggaauguuu

SEQ ID NO: 523512 - RNA, 19 nt, Homo sapiens
gaaggaauuugucaaucuu

SEQ ID NO: 523513 - RNA, 19 nt, Homo sapiens
gaaugagguucuagaaaug

SEQ ID NO: 523514 - RNA, 19 nt, Homo sapiens
ugaaugagguucuagaaau

SEQ ID NO: 523515 - RNA, 19 nt, Homo sapiens
caagaaaggcgcuagaauu

SEQ ID NO: 523516 - RNA, 19 nt, Homo sapiens
ggaaggaauuugucaaucu

SEQ ID NO: 523517 - RNA, 19 nt, Homo sapiens
ccucagaacuuuaguaaca

SEQ ID NO: 523518 - RNA, 19 nt, Homo sapiens
gaaaaccacuuaucccuuu

SEQ ID NO: 523519 - RNA, 19 nt, Homo sapiens
ccacugugcuucuuaaugu

SEQ ID NO: 523520 - RNA, 19 nt, Homo sapiens
caaaugaaaugguagucaa

SEQ ID NO: 523521 - RNA, 19 nt, Homo sapiens
gcaacaaaguuaggaaguu

SEQ ID NO: 523522 - RNA, 19 nt, Homo sapiens
caaugaaucucccuuaaag

SEQ ID NO: 523523 - RNA, 19 nt, Homo sapiens
gaaguuuggcgaaauauga

SEQ ID NO: 523524 - RNA, 19 nt, Homo sapiens
ucagaaguuuggcgaaaua

SEQ ID NO: 523525 - RNA, 19 nt, Homo sapiens
caacuguagucaucuuaaa

SEQ ID NO: 523526 - RNA, 19 nt, Homo sapiens
aaaugcagcuuucaaauca

SEQ ID NO: 523527 - RNA, 19 nt, Homo sapiens
gaggagaaauuaaauacuc

SEQ ID NO: 523528 - RNA, 19 nt, Homo sapiens
acaguaagcugaccuggaa

SEQ ID NO: 523529 - RNA, 19 nt, Homo sapiens
gaacagcagauuucagcua

SEQ ID NO: 523530 - RNA, 19 nt, Homo sapiens
gaaacugaacuugguguua

SEQ ID NO: 523531 - RNA, 19 nt, Homo sapiens
uaacagaagagaagguaua

SEQ ID NO: 523532 - RNA, 19 nt, Homo sapiens
ggugauugauugauugauu

SEQ ID NO: 523533 - RNA, 19 nt, Homo sapiens
gugaaaguguuacauauuc

SEQ ID NO: 523534 - RNA, 19 nt, Homo sapiens
ccaaugauguaugaucuaa

SEQ ID NO: 523535 - RNA, 19 nt, Homo sapiens
gacagcaguugaauccaua

SEQ ID NO: 523536 - RNA, 19 nt, Homo sapiens
cagaagagaagguauauga

SEQ ID NO: 523537 - RNA, 19 nt, Homo sapiens
ccacguaaccuucaaguau

SEQ ID NO: 523538 - RNA, 19 nt, Homo sapiens
uaugacaugucccuuuaua

SEQ ID NO: 523539 - RNA, 19 nt, Homo sapiens
ugaagaagaugaugaagag

SEQ ID NO: 523540 - RNA, 19 nt, Homo sapiens
ggauauugaugccauuaga

SEQ ID NO: 523541 - RNA, 19 nt, Homo sapiens
ugacaugucccuuuauauu

SEQ ID NO: 523542 - RNA, 19 nt, Homo sapiens
gucgaaaucuagugaauga

SEQ ID NO: 523543 - RNA, 19 nt, Homo sapiens
ggaagaagacucagaagca

SEQ ID NO: 523544 - RNA, 19 nt, Homo sapiens
guagagaaagagaggauua

SEQ ID NO: 523545 - RNA, 19 nt, Homo sapiens
ggacagcaguugaauccau

SEQ ID NO: 523546 - RNA, 19 nt, Homo sapiens
gaauucgcauguacaguga

SEQ ID NO: 523547 - RNA, 19 nt, Homo sapiens
ugaaugcugucacaaagaa

SEQ ID NO: 523548 - RNA, 19 nt, Homo sapiens
gaagaagacucagaagcau

SEQ ID NO: 523549 - RNA, 19 nt, Homo sapiens
ggugagacauugauauauc

SEQ ID NO: 523550 - RNA, 19 nt, Homo sapiens
uagccaauccucuuucuua

SEQ ID NO: 523551 - RNA, 19 nt, Homo sapiens
gauuucagcuacauauaug

SEQ ID NO: 523552 - RNA, 19 nt, Homo sapiens
gggaaaucguucauucauu

SEQ ID NO: 523553 - RNA, 19 nt, Homo sapiens
ugagggagguguuuccaaa

SEQ ID NO: 523554 - RNA, 19 nt, Homo sapiens
ugacguaucacaauguaua

SEQ ID NO: 523555 - RNA, 19 nt, Homo sapiens
gaaugugacuugacguauc

SEQ ID NO: 523556 - RNA, 19 nt, Homo sapiens
gaugaugugucuguggaua

SEQ ID NO: 523557 - RNA, 19 nt, Homo sapiens
gaagacaaugcuuuccaua

SEQ ID NO: 523558 - RNA, 19 nt, Homo sapiens
acaaguagguuuacauuac

SEQ ID NO: 523559 - RNA, 19 nt, Homo sapiens
guuaggaaguuuguuguuu

SEQ ID NO: 523560 - RNA, 19 nt, Homo sapiens
guaacagcacaacaaauua

SEQ ID NO: 523561 - RNA, 19 nt, Homo sapiens
gauguaugaucuaaaggaa

SEQ ID NO: 523562 - RNA, 19 nt, Homo sapiens
guaacccaaugauguauga

SEQ ID NO: 523563 - RNA, 19 nt, Homo sapiens
ugaagaagcaguuguaugu

SEQ ID NO: 523564 - RNA, 19 nt, Homo sapiens
gagaagguauaugaaauuc

SEQ ID NO: 523565 - RNA, 19 nt, Homo sapiens
gagaugaucgcuauggaaa

SEQ ID NO: 523566 - RNA, 19 nt, Homo sapiens
gaaagaagaaacaagaaag

SEQ ID NO: 523567 - RNA, 19 nt, Homo sapiens
gaaacuauuacuccuaaga

SEQ ID NO: 523568 - RNA, 19 nt, Homo sapiens
gcacuuguccggcuagaga

SEQ ID NO: 523569 - RNA, 19 nt, Homo sapiens
aagcugaccuggaaaugaa

SEQ ID NO: 523570 - RNA, 19 nt, Homo sapiens
ggaauacucaagcaaagaa

SEQ ID NO: 523571 - RNA, 19 nt, Homo sapiens
gaaaugaagccugcacgaa

SEQ ID NO: 523572 - RNA, 19 nt, Homo sapiens
guacaaguagguuuacauu

SEQ ID NO: 523573 - RNA, 19 nt, Homo sapiens
gugccucccuucuuuauug

SEQ ID NO: 523574 - RNA, 19 nt, Homo sapiens
cugacuacauucucaauaa

SEQ ID NO: 523575 - RNA, 19 nt, Homo sapiens
uuuaugacaugucccuuua

SEQ ID NO: 523576 - RNA, 19 nt, Homo sapiens
gaagggagaaauuggaaug

SEQ ID NO: 523577 - RNA, 19 nt, Homo sapiens
ccacaguagucaccuaugu

SEQ ID NO: 523578 - RNA, 19 nt, Homo sapiens
ucucauacuugcuuuaaug

SEQ ID NO: 523579 - RNA, 19 nt, Homo sapiens
agacucuucuugcaguuua

SEQ ID NO: 523580 - RNA, 19 nt, Homo sapiens
cagggacucuguucugauu

SEQ ID NO: 523581 - RNA, 19 nt, Homo sapiens
ggaaaauccugcagacuug

SEQ ID NO: 523582 - RNA, 19 nt, Homo sapiens
gcgugaaaguguuacauau

SEQ ID NO: 523583 - RNA, 19 nt, Homo sapiens
acacaaaucacaaugaaga

SEQ ID NO: 523584 - RNA, 19 nt, Homo sapiens
gguuuacuaugcaaaugua

SEQ ID NO: 523585 - RNA, 19 nt, Homo sapiens
caccuaacguggaauguga

SEQ ID NO: 523586 - RNA, 19 nt, Homo sapiens
guaauuaaagugaggagaa

SEQ ID NO: 523587 - RNA, 19 nt, Homo sapiens
ggaaggaagggagaaauug

SEQ ID NO: 523588 - RNA, 19 nt, Homo sapiens
ggagguguuuccaaagaau

SEQ ID NO: 523589 - RNA, 19 nt, Homo sapiens
gacaauagaauucgcaugu

SEQ ID NO: 523590 - RNA, 19 nt, Homo sapiens
uuaaugaaccacugaauga

SEQ ID NO: 523591 - RNA, 19 nt, Homo sapiens
gagaaagagaggauuauuc

SEQ ID NO: 523592 - RNA, 19 nt, Homo sapiens
gaaggaaggugaauauauu

SEQ ID NO: 523593 - RNA, 19 nt, Homo sapiens
cauaaugacuuuccaauug

SEQ ID NO: 523594 - RNA, 19 nt, Homo sapiens
uaaauaagaucgaccaaug

SEQ ID NO: 523595 - RNA, 19 nt, Homo sapiens
ugaaacaucugguaauuug

SEQ ID NO: 523596 - RNA, 19 nt, Homo sapiens
ggaagaagaugugauugaa

SEQ ID NO: 523597 - RNA, 19 nt, Homo sapiens
caacacaucucaagaaacu

SEQ ID NO: 523598 - RNA, 19 nt, Homo sapiens
gaagggagaaggauuugua

SEQ ID NO: 523599 - RNA, 19 nt, Homo sapiens
ucaagaaacucaaagaauc

SEQ ID NO: 523600 - RNA, 19 nt, Homo sapiens
gacaacacaucucaagaaa

SEQ ID NO: 523601 - RNA, 19 nt, Homo sapiens
caacagaacacugcucuuu

SEQ ID NO: 523602 - RNA, 19 nt, Homo sapiens
gauugaaguuuaucaggaa

SEQ ID NO: 523603 - RNA, 19 nt, Homo sapiens
ggaggaagaagaugugauu

SEQ ID NO: 523604 - RNA, 19 nt, Homo sapiens
ucacucagguuucucuuug

SEQ ID NO: 523605 - RNA, 19 nt, Homo sapiens
gaagaugugauugaaguuu

SEQ ID NO: 523606 - RNA, 19 nt, Homo sapiens
gaccuuuccuuaacuugaa

SEQ ID NO: 523607 - RNA, 19 nt, Homo sapiens
uaagaaggaaggugaauau

SEQ ID NO: 523608 - RNA, 19 nt, Homo sapiens
ccaaagauggcuucacuga

SEQ ID NO: 523609 - RNA, 19 nt, Homo sapiens
ugaauucuagugcucauua

SEQ ID NO: 523610 - RNA, 19 nt, Homo sapiens
caaagaaucauacugucaa

SEQ ID NO: 523611 - RNA, 19 nt, Homo sapiens
ugacaacacaucucaagaa

SEQ ID NO: 523612 - RNA, 19 nt, Homo sapiens
gacaggguguuccaaugaa

SEQ ID NO: 523613 - RNA, 19 nt, Homo sapiens
gaugacagauaaggugaga

SEQ ID NO: 523614 - RNA, 19 nt, Homo sapiens
caaugcaaguguucauaau

SEQ ID NO: 523615 - RNA, 19 nt, Homo sapiens
gaauucuagugcucauuau

SEQ ID NO: 523616 - RNA, 19 nt, Homo sapiens
aagaagaugugauugaagu

SEQ ID NO: 523617 - RNA, 19 nt, Homo sapiens
caagaaacucaaagaauca

SEQ ID NO: 523618 - RNA, 19 nt, Homo sapiens
ccaaugcaaguguucauaa

SEQ ID NO: 523619 - RNA, 19 nt, Homo sapiens
ggagcgagguucugcuuac

SEQ ID NO: 523620 - RNA, 19 nt, Homo sapiens
ggcuuguggugauaaauaa

SEQ ID NO: 523621 - RNA, 19 nt, Homo sapiens
caaagucauuggacaggau

SEQ ID NO: 523622 - RNA, 19 nt, Homo sapiens
gauaaggugagaguaauga

SEQ ID NO: 523623 - RNA, 19 nt, Homo sapiens
cagauaaggugagaguaau

SEQ ID NO: 523624 - RNA, 19 nt, Homo sapiens
acagauaaggugagaguaa

SEQ ID NO: 523625 - RNA, 19 nt, Homo sapiens
caaaagaacugggaaugga

SEQ ID NO: 523626 - RNA, 19 nt, Homo sapiens
gaaaugaauacaacagaac

SEQ ID NO: 523627 - RNA, 19 nt, Homo sapiens
agaaggaaggugaauauau

SEQ ID NO: 523628 - RNA, 19 nt, Homo sapiens
aguaaugacuaacuccaaa

SEQ ID NO: 523629 - RNA, 19 nt, Homo sapiens
ggauauggguuuuaaaugg

SEQ ID NO: 523630 - RNA, 19 nt, Homo sapiens
ggagaaggauuuguaaacc

SEQ ID NO: 523631 - RNA, 19 nt, Homo sapiens
gaauggaggaagaagaugu

SEQ ID NO: 523632 - RNA, 19 nt, Homo sapiens
ccaauuggcccugauguuc

SEQ ID NO: 523633 - RNA, 19 nt, Homo sapiens
agaaucauacugucaaaga

SEQ ID NO: 523634 - RNA, 19 nt, Homo sapiens
gaaacucaaagaaucauac

SEQ ID NO: 523635 - RNA, 19 nt, Homo sapiens
ggacaggauagcagugaga

SEQ ID NO: 523636 - RNA, 19 nt, Homo sapiens
ccaccgucaucaugucuga

SEQ ID NO: 523637 - RNA, 19 nt, Homo sapiens
gaagaagaugugauugaag

SEQ ID NO: 523638 - RNA, 19 nt, Homo sapiens
gggaauggaggaagaagau

SEQ ID NO: 523639 - RNA, 19 nt, Homo sapiens
ugaauucacucagguuucu

SEQ ID NO: 523640 - RNA, 19 nt, Homo sapiens
gaaucauacugucaaagac

SEQ ID NO: 523641 - RNA, 19 nt, Homo sapiens
gaagccaccgucaucaugu

SEQ ID NO: 523642 - RNA, 19 nt, Homo sapiens
caaaagaagaggaauauca

SEQ ID NO: 523643 - RNA, 19 nt, Homo sapiens
agacaggguguuccaauga

SEQ ID NO: 523644 - RNA, 19 nt, Homo sapiens
agaggaauaucagguugaa

SEQ ID NO: 523645 - RNA, 19 nt, Homo sapiens
gaaacaucugguaauuuga

SEQ ID NO: 523646 - RNA, 19 nt, Homo sapiens
ucaaagaaucauacuguca

SEQ ID NO: 523647 - RNA, 19 nt, Homo sapiens
gggagaaggauuuguaaac

SEQ ID NO: 523648 - RNA, 19 nt, Homo sapiens
gaagaucccagaaaaguuc

SEQ ID NO: 523649 - RNA, 19 nt, Homo sapiens
cuagugcucauuauucauu

SEQ ID NO: 523650 - RNA, 19 nt, Homo sapiens
gucuguaccagcuucauua

SEQ ID NO: 523651 - RNA, 19 nt, Homo sapiens
gauauggguuuuaaaugga

SEQ ID NO: 523652 - RNA, 19 nt, Homo sapiens
caggauagcagugagauuc

SEQ ID NO: 523653 - RNA, 19 nt, Homo sapiens
uguaccagcuucauuaaaa

SEQ ID NO: 523654 - RNA, 19 nt, Homo sapiens
cagaaaugaauacaacaga

SEQ ID NO: 523655 - RNA, 19 nt, Homo sapiens
gaauaucagguugaaguca

SEQ ID NO: 523656 - RNA, 19 nt, Homo sapiens
aaaaugaccuuuccuuaac

SEQ ID NO: 523657 - RNA, 19 nt, Homo sapiens
gcagaaaugaauacaacag

SEQ ID NO: 523658 - RNA, 19 nt, Homo sapiens
ugacagauaaggugagagu

SEQ ID NO: 523659 - RNA, 19 nt, Homo sapiens
aauuggcccugauguucua

SEQ ID NO: 523660 - RNA, 19 nt, Homo sapiens
auaaugacuuuccaauugg

SEQ ID NO: 523661 - RNA, 19 nt, Homo sapiens
ucauauuacccucuccuuu

SEQ ID NO: 523662 - RNA, 19 nt, Homo sapiens
ugaaguuuaucaggaacaa

SEQ ID NO: 523663 - RNA, 19 nt, Homo sapiens
aagacaggguguuccaaug

SEQ ID NO: 523664 - RNA, 19 nt, Homo sapiens
gucagaagaucccagaaaa

SEQ ID NO: 523665 - RNA, 19 nt, Homo sapiens
ugucagaagaucccagaaa

SEQ ID NO: 523666 - RNA, 19 nt, Homo sapiens
augacuaacuccaaagaug

SEQ ID NO: 523667 - RNA, 19 nt, Homo sapiens
ggauaagaaggaaggugaa

SEQ ID NO: 523668 - RNA, 19 nt, Homo sapiens
gauaagaaggaaggugaau

SEQ ID NO: 523669 - RNA, 19 nt, Homo sapiens
agaagaggaauaucagguu

SEQ ID NO: 523670 - RNA, 19 nt, Homo sapiens
acucaaagaaucauacugu

SEQ ID NO: 523671 - RNA, 19 nt, Homo sapiens
gaucgaccaaugcaagugu

SEQ ID NO: 523672 - RNA, 19 nt, Homo sapiens
cauauuacccucuccuuuu

SEQ ID NO: 523673 - RNA, 19 nt, Homo sapiens
acacaucucaagaaacuca

SEQ ID NO: 523674 - RNA, 19 nt, Homo sapiens
ggaauaucagguugaaguc

SEQ ID NO: 523675 - RNA, 19 nt, Homo sapiens
ugaagccaccgucaucaug

SEQ ID NO: 523676 - RNA, 19 nt, Homo sapiens
ucaggcuuguggugauaaa

SEQ ID NO: 523677 - RNA, 19 nt, Homo sapiens
aggaagaagaugugauuga

SEQ ID NO: 523678 - RNA, 19 nt, Homo sapiens
agcuauacaugcagaaaug

SEQ ID NO: 523679 - RNA, 19 nt, Homo sapiens
ucucaagaaacucaaagaa

SEQ ID NO: 523680 - RNA, 19 nt, Homo sapiens
uaaugacuaacuccaaaga

SEQ ID NO: 523681 - RNA, 19 nt, Homo sapiens
aaggugagaguaaugacua

SEQ ID NO: 523682 - RNA, 19 nt, Homo sapiens
aggcuuguggugauaaaua

SEQ ID NO: 523683 - RNA, 19 nt, Homo sapiens
ugaccuuuccuuaacuuga

SEQ ID NO: 523684 - RNA, 19 nt, Homo sapiens
aaagacaggguguuccaau

SEQ ID NO: 523685 - RNA, 19 nt, Homo sapiens
cuccaaagauggcuucacu

SEQ ID NO: 523686 - RNA, 19 nt, Homo sapiens
auaagaaggaaggugaaua

SEQ ID NO: 523687 - RNA, 19 nt, Homo sapiens
uuucaggcuuguggugaua

SEQ ID NO: 523688 - RNA, 19 nt, Homo sapiens
aagaaggaaggugaauaua

SEQ ID NO: 523689 - RNA, 19 nt, Homo sapiens
augcagaaaugaauacaac

SEQ ID NO: 523690 - RNA, 19 nt, Homo sapiens
gaccaaaagaagaggaaua

SEQ ID NO: 523691 - RNA, 19 nt, Homo sapiens
aaaauuacgugugcacaga

SEQ ID NO: 523692 - RNA, 19 nt, Homo sapiens
gaagcaaacugcauuauca

SEQ ID NO: 523693 - RNA, 19 nt, Homo sapiens
gaagugaugucuuauauag

SEQ ID NO: 523694 - RNA, 19 nt, Homo sapiens
ggaaauaggugacccaagu

SEQ ID NO: 523695 - RNA, 19 nt, Homo sapiens
gaagugaguuuaucucguu

SEQ ID NO: 523696 - RNA, 19 nt, Homo sapiens
gaguuuaucucguuuguuu

SEQ ID NO: 523697 - RNA, 19 nt, Homo sapiens
agacagacuucuugauuua

SEQ ID NO: 523698 - RNA, 19 nt, Homo sapiens
acacaagacuguucucuaa

SEQ ID NO: 523699 - RNA, 19 nt, Homo sapiens
gagacagacuucuugauuu

SEQ ID NO: 523700 - RNA, 19 nt, Homo sapiens
caaagggaauccacuguuu

SEQ ID NO: 523701 - RNA, 19 nt, Homo sapiens
gaaccaaggucagucauau

SEQ ID NO: 523702 - RNA, 19 nt, Homo sapiens
aagaugaccuuucuaauga

SEQ ID NO: 523703 - RNA, 19 nt, Homo sapiens
ggaaaugaauguagaaacu

SEQ ID NO: 523704 - RNA, 19 nt, Homo sapiens
gaagagaacagcucaugaa

SEQ ID NO: 523705 - RNA, 19 nt, Homo sapiens
gaaauucggaugcuggaua

SEQ ID NO: 523706 - RNA, 19 nt, Homo sapiens
ggaaagaagugaguuuauc

SEQ ID NO: 523707 - RNA, 19 nt, Homo sapiens
ugaaaucucucccagaaga

SEQ ID NO: 523708 - RNA, 19 nt, Homo sapiens
guugauagcuucugacuag

SEQ ID NO: 523709 - RNA, 19 nt, Homo sapiens
caaagaagcacgaucuauu

SEQ ID NO: 523710 - RNA, 19 nt, Homo sapiens
guuaagggaucuucauuau

SEQ ID NO: 523711 - RNA, 19 nt, Homo sapiens
caagacuguucucuaauuu

SEQ ID NO: 523712 - RNA, 19 nt, Homo sapiens
gagagaagauggagaagag

SEQ ID NO: 523713 - RNA, 19 nt, Homo sapiens
ggagacagacuucuugauu

SEQ ID NO: 523714 - RNA, 19 nt, Homo sapiens
ggagaaaguauuauuguug

SEQ ID NO: 523715 - RNA, 19 nt, Homo sapiens
gguauucacauucuuguua

SEQ ID NO: 523716 - RNA, 19 nt, Homo sapiens
caaggucagucauaugaaa

SEQ ID NO: 523717 - RNA, 19 nt, Homo sapiens
caagaugaccuuucuaaug

SEQ ID NO: 523718 - RNA, 19 nt, Homo sapiens
guaaauacaguuccuagaa

SEQ ID NO: 523719 - RNA, 19 nt, Homo sapiens
uaggauaucuuuguccaua

SEQ ID NO: 523720 - RNA, 19 nt, Homo sapiens
ggagauuccuugccuuuua

SEQ ID NO: 523721 - RNA, 19 nt, Homo sapiens
gauaugaucaugccagauu

SEQ ID NO: 523722 - RNA, 19 nt, Homo sapiens
gaugaaacgcuuacuuauu

SEQ ID NO: 523723 - RNA, 19 nt, Homo sapiens
gaucagaugguucagaauu

SEQ ID NO: 523724 - RNA, 19 nt, Homo sapiens
acaagacuguucucuaauu

SEQ ID NO: 523725 - RNA, 19 nt, Homo sapiens
uggaagaaaucaugucuga

SEQ ID NO: 523726 - RNA, 19 nt, Homo sapiens
ucacagagaugaggcuuga

SEQ ID NO: 523727 - RNA, 19 nt, Homo sapiens
gaaauaggugacccaagua

SEQ ID NO: 523728 - RNA, 19 nt, Homo sapiens
ccagcaaauuuguuacuuu

SEQ ID NO: 523729 - RNA, 19 nt, Homo sapiens
uuaagccucucaaauauug

SEQ ID NO: 523730 - RNA, 19 nt, Homo sapiens
cagcaugagugaugucuug

SEQ ID NO: 523731 - RNA, 19 nt, Homo sapiens
gggagaaaguauuauuguu

SEQ ID NO: 523732 - RNA, 19 nt, Homo sapiens
aaagaagcacgaucuauuu

SEQ ID NO: 523733 - RNA, 19 nt, Homo sapiens
cauacuagcuucuuucucu

SEQ ID NO: 523734 - RNA, 19 nt, Homo sapiens
gcaaucuacuuggaagaaa

SEQ ID NO: 523735 - RNA, 19 nt, Homo sapiens
ggugagaggaucaguguaa

SEQ ID NO: 523736 - RNA, 19 nt, Homo sapiens
ggauagacauucuggugau

SEQ ID NO: 523737 - RNA, 19 nt, Homo sapiens
gaaacuuacugugggcauu

SEQ ID NO: 523738 - RNA, 19 nt, Homo sapiens
ccucagaaguugcucgaaa

SEQ ID NO: 523739 - RNA, 19 nt, Homo sapiens
gcaaagcgaggcaguuguu

SEQ ID NO: 523740 - RNA, 19 nt, Homo sapiens
uaaauacaguuccuagaag

SEQ ID NO: 523741 - RNA, 19 nt, Homo sapiens
gaaagaagugaguuuaucu

SEQ ID NO: 523742 - RNA, 19 nt, Homo sapiens
gugaucagaugguucagaa

SEQ ID NO: 523743 - RNA, 19 nt, Homo sapiens
uaauaucccucuccaccaa

SEQ ID NO: 523744 - RNA, 19 nt, Homo sapiens
guacaaucauggauagaca

SEQ ID NO: 523745 - RNA, 19 nt, Homo sapiens
ccuuaagccucucaaauau

SEQ ID NO: 523746 - RNA, 19 nt, Homo sapiens
aaaggaggauuuaguucaa

SEQ ID NO: 523747 - RNA, 19 nt, Homo sapiens
ugagugaugucuuggcauu

SEQ ID NO: 523748 - RNA, 19 nt, Homo sapiens
gcacccacccuuucaguau

SEQ ID NO: 523749 - RNA, 19 nt, Homo sapiens
guaagaggcucggcaccuu

SEQ ID NO: 523750 - RNA, 19 nt, Homo sapiens
caaaggaggauuuaguuca

SEQ ID NO: 523751 - RNA, 19 nt, Homo sapiens
gacaaaggaggauuuaguu

SEQ ID NO: 523752 - RNA, 19 nt, Homo sapiens
gaccucuggugaacaaauu

SEQ ID NO: 523753 - RNA, 19 nt, Homo sapiens
ccacaauccucacagagau

SEQ ID NO: 523754 - RNA, 19 nt, Homo sapiens
ggccagcagugaaucugua

SEQ ID NO: 523755 - RNA, 19 nt, Homo sapiens
cagauucucuuccuacaca

SEQ ID NO: 523756 - RNA, 19 nt, Homo sapiens
caaauucagccuucagcua

SEQ ID NO: 523757 - RNA, 19 nt, Homo sapiens
aaauucggaugcuggauaa

SEQ ID NO: 523758 - RNA, 19 nt, Homo sapiens
gaggguguaccguuugaua

SEQ ID NO: 523759 - RNA, 19 nt, Homo sapiens
ggagauggagcuucacaga

SEQ ID NO: 523760 - RNA, 19 nt, Homo sapiens
ggacuuugccagcagacua

SEQ ID NO: 523761 - RNA, 19 nt, Homo sapiens
cagugaaacaggcuaaaua

SEQ ID NO: 523762 - RNA, 19 nt, Homo sapiens
cacuagauguuaucaauca

SEQ ID NO: 523763 - RNA, 19 nt, Homo sapiens
ccaggaagaugggcuugaa

SEQ ID NO: 523764 - RNA, 19 nt, Homo sapiens
gggauuggauuuuaccaua

SEQ ID NO: 523765 - RNA, 19 nt, Homo sapiens
agaaaugauugccucagaa

SEQ ID NO: 523766 - RNA, 19 nt, Homo sapiens
ucagggagauggagcuuca

SEQ ID NO: 523767 - RNA, 19 nt, Homo sapiens
caucauaaggguuguauuc

SEQ ID NO: 523768 - RNA, 19 nt, Homo sapiens
uuugaaaucucucccagaa

SEQ ID NO: 523769 - RNA, 19 nt, Homo sapiens
gguguaccguuugauauga

SEQ ID NO: 523770 - RNA, 19 nt, Homo sapiens
gaauguagaaacuuacugu

SEQ ID NO: 523771 - RNA, 19 nt, Homo sapiens
uuaaucagguuuacagaca

SEQ ID NO: 523772 - RNA, 19 nt, Homo sapiens
gauggaauucggcucuaua

SEQ ID NO: 523773 - RNA, 19 nt, Homo sapiens
gaaacgcuuacuuauuuga

SEQ ID NO: 523774 - RNA, 19 nt, Homo sapiens
cccuuaagccucucaaaua

SEQ ID NO: 523775 - RNA, 19 nt, Homo sapiens
aagaugcaguugaacauga

SEQ ID NO: 523776 - RNA, 19 nt, Homo sapiens
gaucaucuacacucagcua

SEQ ID NO: 523777 - RNA, 19 nt, Homo sapiens
ccaguuaaaugcgguugaa

SEQ ID NO: 523778 - RNA, 19 nt, Homo sapiens
gcauugaacgugaguuugu

SEQ ID NO: 523779 - RNA, 19 nt, Homo sapiens
caacgucaccagcaguaaa

SEQ ID NO: 523780 - RNA, 19 nt, Homo sapiens
cacaagaugaccuuucuaa

SEQ ID NO: 523781 - RNA, 19 nt, Homo sapiens
gaaaugauugccucagaag

SEQ ID NO: 523782 - RNA, 19 nt, Homo sapiens
gagaagagaacagcucaug

SEQ ID NO: 523783 - RNA, 19 nt, Homo sapiens
gagaagauggagaagagaa

SEQ ID NO: 523784 - RNA, 19 nt, Homo sapiens
gaaugaaaauggagaauac

SEQ ID NO: 523785 - RNA, 19 nt, Homo sapiens
aaacgcaccucugcuuuca

SEQ ID NO: 523786 - RNA, 19 nt, Homo sapiens
gaugcuggauaaucggaaa

SEQ ID NO: 523787 - RNA, 19 nt, Homo sapiens
ggacgaauccaagccaguu

SEQ ID NO: 523788 - RNA, 19 nt, Homo sapiens
uccaaugucugugggaaua

SEQ ID NO: 523789 - RNA, 19 nt, Homo sapiens
ucacuuuccucccauaucu

SEQ ID NO: 523790 - RNA, 19 nt, Homo sapiens
gagcuuuaguacaaucaug

SEQ ID NO: 523791 - RNA, 19 nt, Homo sapiens
aaucaugucugagggugua

SEQ ID NO: 523792 - RNA, 19 nt, Homo sapiens
gaaaugaccuggaauaaca

SEQ ID NO: 523793 - RNA, 19 nt, Homo sapiens
ggaacgaccugucugagaa

SEQ ID NO: 523794 - RNA, 19 nt, Homo sapiens
aaacugauguggauuaaga

SEQ ID NO: 523795 - RNA, 19 nt, Homo sapiens
caagaagugugaucagaaa

SEQ ID NO: 523796 - RNA, 19 nt, Homo sapiens
gaagguguaucucaaagug

SEQ ID NO: 523797 - RNA, 19 nt, Homo sapiens
caacugaccaccuuuguuu

SEQ ID NO: 523798 - RNA, 19 nt, Homo sapiens
aagaguacaucuccaauaa

SEQ ID NO: 523799 - RNA, 19 nt, Homo sapiens
gagaaacugauguggauua

SEQ ID NO: 523800 - RNA, 19 nt, Homo sapiens
acaaggagcuuccggagaa

SEQ ID NO: 523801 - RNA, 19 nt, Homo sapiens
ggguggagauuucuaauga

SEQ ID NO: 523802 - RNA, 19 nt, Homo sapiens
gaacaaccuuccauccaau

SEQ ID NO: 523803 - RNA, 19 nt, Homo sapiens
ggacgaggaugaagaagag

SEQ ID NO: 523804 - RNA, 19 nt, Homo sapiens
ggaauaacauggaaaagaa

SEQ ID NO: 523805 - RNA, 19 nt, Homo sapiens
uaaccaagauucuguccaa

SEQ ID NO: 523806 - RNA, 19 nt, Homo sapiens
gaagaagguguaucucaaa

SEQ ID NO: 523807 - RNA, 19 nt, Homo sapiens
ccaagaagccucccaugaa

SEQ ID NO: 523808 - RNA, 19 nt, Homo sapiens
ggaagcugcugucccagaa

SEQ ID NO: 523809 - RNA, 19 nt, Homo sapiens
ggucucagcucucggacaa

SEQ ID NO: 523810 - RNA, 19 nt, Homo sapiens
gacagcaacuaucagacua

SEQ ID NO: 523811 - RNA, 19 nt, Homo sapiens
ccaagaagaugaaauucca

SEQ ID NO: 523812 - RNA, 19 nt, Homo sapiens
gaaggacgccuaucacaag

SEQ ID NO: 523813 - RNA, 19 nt, Homo sapiens
cuaaugaggugaggaaguu

SEQ ID NO: 523814 - RNA, 19 nt, Homo sapiens
aggaagacaugcugacuuu

SEQ ID NO: 523815 - RNA, 19 nt, Homo sapiens
gaguacaucuccaauaaac

SEQ ID NO: 523816 - RNA, 19 nt, Homo sapiens
agaggaagaugaugagaau

SEQ ID NO: 523817 - RNA, 19 nt, Homo sapiens
gaagagaagaugcugaaca

SEQ ID NO: 523818 - RNA, 19 nt, Homo sapiens
gagacuauauccagaagca

SEQ ID NO: 523819 - RNA, 19 nt, Homo sapiens
gaaguuccguacauugaca

SEQ ID NO: 523820 - RNA, 19 nt, Homo sapiens
caagaagccucccaugaac

SEQ ID NO: 523821 - RNA, 19 nt, Homo sapiens
agaagaagguguaucucaa

SEQ ID NO: 523822 - RNA, 19 nt, Homo sapiens
caagaaacacccagacuuc

SEQ ID NO: 523823 - RNA, 19 nt, Homo sapiens
agaagaagaaggccaagua

SEQ ID NO: 523824 - RNA, 19 nt, Homo sapiens
gaaauauauucaggacuuc

SEQ ID NO: 523825 - RNA, 19 nt, Homo sapiens
caaaagagcugaggagauc

SEQ ID NO: 523826 - RNA, 19 nt, Homo sapiens
agaacaaccuuccauccaa

SEQ ID NO: 523827 - RNA, 19 nt, Homo sapiens
ggaggaugaugaagaggau

SEQ ID NO: 523828 - RNA, 19 nt, Homo sapiens
agagagagcugagugagau

SEQ ID NO: 523829 - RNA, 19 nt, Homo sapiens
cuggacagcuggaggauga

SEQ ID NO: 523830 - RNA, 19 nt, Homo sapiens
ccauggaaaugaccuggaa

SEQ ID NO: 523831 - RNA, 19 nt, Homo sapiens
cgaugaggaugaagauaau

SEQ ID NO: 523832 - RNA, 19 nt, Homo sapiens
ggaugacgaugaggaugaa

SEQ ID NO: 523833 - RNA, 19 nt, Homo sapiens
aaagaguacaucuccaaua

SEQ ID NO: 523834 - RNA, 19 nt, Homo sapiens
ggacgccuaucacaagaag

SEQ ID NO: 523835 - RNA, 19 nt, Homo sapiens
aaugacagcuccaaguuca

SEQ ID NO: 523836 - RNA, 19 nt, Homo sapiens
ggaccgugcagcauauaaa

SEQ ID NO: 523837 - RNA, 19 nt, Homo sapiens
aagagaagaugcugaacau

SEQ ID NO: 523838 - RNA, 19 nt, Homo sapiens
gaaacuccacccugagaug

SEQ ID NO: 523839 - RNA, 19 nt, Homo sapiens
ggucggugccuucaagaaa

SEQ ID NO: 523840 - RNA, 19 nt, Homo sapiens
ggaugagaaugaagaggau

SEQ ID NO: 523841 - RNA, 19 nt, Homo sapiens
agaaacugauguggauuaa

SEQ ID NO: 523842 - RNA, 19 nt, Homo sapiens
gaagaaggccaaguacaag

SEQ ID NO: 523843 - RNA, 19 nt, Homo sapiens
agaagaaggccaaguacaa

SEQ ID NO: 523844 - RNA, 19 nt, Homo sapiens
gggaagagaagaugcugaa

SEQ ID NO: 523845 - RNA, 19 nt, Homo sapiens
gagaagaagaagaugaaau

SEQ ID NO: 523846 - RNA, 19 nt, Homo sapiens
ccaggaccgugcagcauau

SEQ ID NO: 523847 - RNA, 19 nt, Homo sapiens
ccagaaggagcacuacaaa

SEQ ID NO: 523848 - RNA, 19 nt, Homo sapiens
caugaacgguuaccagaag

SEQ ID NO: 523849 - RNA, 19 nt, Homo sapiens
ccaaugacagcuccaaguu

SEQ ID NO: 523850 - RNA, 19 nt, Homo sapiens
gaccuggaauaacauggaa

SEQ ID NO: 523851 - RNA, 19 nt, Homo sapiens
uggaaugcaugaagaacaa

SEQ ID NO: 523852 - RNA, 19 nt, Homo sapiens
acgaggagaucaugagaga

SEQ ID NO: 523853 - RNA, 19 nt, Homo sapiens
cgaggaggaugaugaagag

SEQ ID NO: 523854 - RNA, 19 nt, Homo sapiens
gaaaagaaggagaaacuga

SEQ ID NO: 523855 - RNA, 19 nt, Homo sapiens
gagagacuauauccagaag

SEQ ID NO: 523856 - RNA, 19 nt, Homo sapiens
aaucggacaucccagagaa

SEQ ID NO: 523857 - RNA, 19 nt, Homo sapiens
gagggucggugccuucaag

SEQ ID NO: 523858 - RNA, 19 nt, Homo sapiens
ugacuuugcuggaaugcau

SEQ ID NO: 523859 - RNA, 19 nt, Homo sapiens
cccaggagcugcuguccaa

SEQ ID NO: 523860 - RNA, 19 nt, Homo sapiens
gaagacaugcugacuuugc

SEQ ID NO: 523861 - RNA, 19 nt, Homo sapiens
cgacgaggaugacgaugag

SEQ ID NO: 523862 - RNA, 19 nt, Homo sapiens
ggaaaugaccuggaauaac

SEQ ID NO: 523863 - RNA, 19 nt, Homo sapiens
gaagaagaaggccaaguac

SEQ ID NO: 523864 - RNA, 19 nt, Homo sapiens
caagaagccagcccaggaa

SEQ ID NO: 523865 - RNA, 19 nt, Homo sapiens
gagaaggacgccuaucaca

SEQ ID NO: 523866 - RNA, 19 nt, Homo sapiens
ggacagcaacuaucagacu

SEQ ID NO: 523867 - RNA, 19 nt, Homo sapiens
guaagagcaugaccaagcu

SEQ ID NO: 523868 - RNA, 19 nt, Homo sapiens
gaagcggagcgacggcuaa

SEQ ID NO: 523869 - RNA, 19 nt, Homo sapiens
gagagaaacaggaguucga

SEQ ID NO: 523870 - RNA, 19 nt, Homo sapiens
ggacuuccagagagagaaa

SEQ ID NO: 523871 - RNA, 19 nt, Homo sapiens
cacccagacuucccaaaga

SEQ ID NO: 523872 - RNA, 19 nt, Homo sapiens
caccuggaccucuggguua

SEQ ID NO: 523873 - RNA, 19 nt, Homo sapiens
gagagagagcugagugaga

SEQ ID NO: 523874 - RNA, 19 nt, Homo sapiens
ggaaggaguacgaggagau

SEQ ID NO: 523875 - RNA, 19 nt, Homo sapiens
ccaauaaacguaagagcau

SEQ ID NO: 523876 - RNA, 19 nt, Homo sapiens
guacaucuccaauaaacgu

SEQ ID NO: 523877 - RNA, 19 nt, Homo sapiens
aggagaaacugauguggau

SEQ ID NO: 523878 - RNA, 19 nt, Homo sapiens
gaucaugagagacuauauc

SEQ ID NO: 523879 - RNA, 19 nt, Homo sapiens
ugaaccaccugccgcugaa

SEQ ID NO: 523880 - RNA, 19 nt, Homo sapiens
gaaggagaaggacgccuau

SEQ ID NO: 523881 - RNA, 19 nt, Homo sapiens
gcgaaacuccacccugaga

SEQ ID NO: 523882 - RNA, 19 nt, Homo sapiens
ucaagaaacacccagacuu

SEQ ID NO: 523883 - RNA, 19 nt, Homo sapiens
aaaagaggcugaaauggau

SEQ ID NO: 523884 - RNA, 19 nt, Homo sapiens
ggccagaugccacuacgaa

SEQ ID NO: 523885 - RNA, 19 nt, Homo sapiens
acgaugaggaugaagauaa

SEQ ID NO: 523886 - RNA, 19 nt, Homo sapiens
aagaagaggaagaugauga

SEQ ID NO: 523887 - RNA, 19 nt, Homo sapiens
ugaagaagaggaagaugau

SEQ ID NO: 523888 - RNA, 19 nt, Homo sapiens
ugaaagccauggaaaugac

SEQ ID NO: 523889 - RNA, 19 nt, Homo sapiens
gcucaaauggguggagauu

SEQ ID NO: 523890 - RNA, 19 nt, Homo sapiens
aauccagaaugccaagaaa

SEQ ID NO: 523891 - RNA, 19 nt, Homo sapiens
gagaucaugagagacuaua

SEQ ID NO: 523892 - RNA, 19 nt, Homo sapiens
ggagggacuuugcugauuu

SEQ ID NO: 523893 - RNA, 19 nt, Homo sapiens
ggaugugguuuaauuguuu

SEQ ID NO: 523894 - RNA, 19 nt, Homo sapiens
uuaaauggcuacuuugguu

SEQ ID NO: 523895 - RNA, 19 nt, Homo sapiens
gaccuuggaugugguuuaa

SEQ ID NO: 523896 - RNA, 19 nt, Homo sapiens
ccucuucccuucaacauga

SEQ ID NO: 523897 - RNA, 19 nt, Homo sapiens
uccgauaucuaacgcuuua

SEQ ID NO: 523898 - RNA, 19 nt, Homo sapiens
ggugugagcuucagauggu

SEQ ID NO: 523899 - RNA, 19 nt, Homo sapiens
gccaaggucugcagagaau

SEQ ID NO: 523900 - RNA, 19 nt, Homo sapiens
gggagggacuuugcugauu

SEQ ID NO: 523901 - RNA, 19 nt, Homo sapiens
ggccaauaaucaagacaaa

SEQ ID NO: 523902 - RNA, 19 nt, Homo sapiens
caugagaacuucaggaaaa

SEQ ID NO: 523903 - RNA, 19 nt, Homo sapiens
uagaugacaaggugaauuu

SEQ ID NO: 523904 - RNA, 19 nt, Homo sapiens
ccuuggaugugguuuaauu

SEQ ID NO: 523905 - RNA, 19 nt, Homo sapiens
caaggugaauuuccauuuu

SEQ ID NO: 523906 - RNA, 19 nt, Homo sapiens
gaagggacaagaaguuagu

SEQ ID NO: 523907 - RNA, 19 nt, Homo sapiens
cgucuucccuaggcuauuu

SEQ ID NO: 523908 - RNA, 19 nt, Homo sapiens
gaugugguuuaauuguuug

SEQ ID NO: 523909 - RNA, 19 nt, Homo sapiens
gagggacuuugcugauuuc

SEQ ID NO: 523910 - RNA, 19 nt, Homo sapiens
ccgagaugcugaacaaagu

SEQ ID NO: 523911 - RNA, 19 nt, Homo sapiens
guuucugucuguaaguuaa

SEQ ID NO: 523912 - RNA, 19 nt, Homo sapiens
ucaagccgauggagaucaa

SEQ ID NO: 523913 - RNA, 19 nt, Homo sapiens
gccaaugucggguagauga

SEQ ID NO: 523914 - RNA, 19 nt, Homo sapiens
gcugaagggacaagaaguu

SEQ ID NO: 523915 - RNA, 19 nt, Homo sapiens
cgcuuuaaauggcuacuuu

SEQ ID NO: 523916 - RNA, 19 nt, Homo sapiens
cuaaaaugcuucaguacuu

SEQ ID NO: 523917 - RNA, 19 nt, Homo sapiens
ugaacuugauggacgaaug

SEQ ID NO: 523918 - RNA, 19 nt, Homo sapiens
gagaaaauguccccugaag

SEQ ID NO: 523919 - RNA, 19 nt, Homo sapiens
ccgcgaagaugcagcucaa

SEQ ID NO: 523920 - RNA, 19 nt, Homo sapiens
ccaccucuaugaacuugau

SEQ ID NO: 523921 - RNA, 19 nt, Homo sapiens
gcaugagaacuucaggaaa

SEQ ID NO: 523922 - RNA, 19 nt, Homo sapiens
uggaugugguuuaauuguu

SEQ ID NO: 523923 - RNA, 19 nt, Homo sapiens
uaaauggcuacuuugguuu

SEQ ID NO: 523924 - RNA, 19 nt, Homo sapiens
uaucuaacgcuuuaaaugg

SEQ ID NO: 523925 - RNA, 19 nt, Homo sapiens
ccaauaaucaagacaaacu

SEQ ID NO: 523926 - RNA, 19 nt, Homo sapiens
cccaguguaugucuuguau

SEQ ID NO: 523927 - RNA, 19 nt, Homo sapiens
acaaggugaauuuccauuu

SEQ ID NO: 523928 - RNA, 19 nt, Homo sapiens
cgauaucuaacgcuuuaaa

SEQ ID NO: 523929 - RNA, 19 nt, Homo sapiens
caaggucugcagagaauuc

SEQ ID NO: 523930 - RNA, 19 nt, Homo sapiens
gaacuugauggacgaaugc

SEQ ID NO: 523931 - RNA, 19 nt, Homo sapiens
ggcacaaucggacuuauuc

SEQ ID NO: 523932 - RNA, 19 nt, Homo sapiens
gaagcagaccauugggaau

SEQ ID NO: 523933 - RNA, 19 nt, Homo sapiens
ggccaccucuaugaacuug

SEQ ID NO: 523934 - RNA, 19 nt, Homo sapiens
gcacaggaaggccaauguc

SEQ ID NO: 523935 - RNA, 19 nt, Homo sapiens
gaaaauguccccugaagac

SEQ ID NO: 523936 - RNA, 19 nt, Homo sapiens
cagcuguucuucuguucug

SEQ ID NO: 523937 - RNA, 19 nt, Homo sapiens
ggauggccaccucuaugaa

SEQ ID NO: 523938 - RNA, 19 nt, Homo sapiens
guagaugacaaggugaauu

SEQ ID NO: 523939 - RNA, 19 nt, Homo sapiens
gcacaaucggacuuauuca

SEQ ID NO: 523940 - RNA, 19 nt, Homo sapiens
gagcugaagggacaagaag

SEQ ID NO: 523941 - RNA, 19 nt, Homo sapiens
gcuguccacugggccauug

SEQ ID NO: 523942 - RNA, 19 nt, Homo sapiens
cccaggcacuuaagcacaa

SEQ ID NO: 523943 - RNA, 19 nt, Homo sapiens
ugaaaagaaugaggccaua

SEQ ID NO: 523944 - RNA, 19 nt, Homo sapiens
aagcagaccauugggaauu

SEQ ID NO: 523945 - RNA, 19 nt, Homo sapiens
cugaagggacaagaaguua

SEQ ID NO: 523946 - RNA, 19 nt, Homo sapiens
uaaaaugcuucaguacuug

SEQ ID NO: 523947 - RNA, 19 nt, Homo sapiens
ccauacaggcagcccauga

SEQ ID NO: 523948 - RNA, 19 nt, Homo sapiens
ucacggcccagcaugagaa

SEQ ID NO: 523949 - RNA, 19 nt, Homo sapiens
gacaaggugaauuuccauu

SEQ ID NO: 523950 - RNA, 19 nt, Homo sapiens
ucaagacaaacugggauuu

SEQ ID NO: 523951 - RNA, 19 nt, Homo sapiens
gcaguggccaauaaucaag

SEQ ID NO: 523952 - RNA, 19 nt, Homo sapiens
agucuaaaaugcuucagua

SEQ ID NO: 523953 - RNA, 19 nt, Homo sapiens
cagaggacacccugcugaa

SEQ ID NO: 523954 - RNA, 19 nt, Homo sapiens
uggauggccaccucuauga

SEQ ID NO: 523955 - RNA, 19 nt, Homo sapiens
gguuucugucuguaaguua

SEQ ID NO: 523956 - RNA, 19 nt, Homo sapiens
gaagcauucuccccagugu

SEQ ID NO: 523957 - RNA, 19 nt, Homo sapiens
ugaaggacgcugccaaggu

SEQ ID NO: 523958 - RNA, 19 nt, Homo sapiens
ucaugaagcagaccauugg

SEQ ID NO: 523959 - RNA, 19 nt, Homo sapiens
agaccuuggaugugguuua

SEQ ID NO: 523960 - RNA, 19 nt, Homo sapiens
uggcuacuuugguuucugu

SEQ ID NO: 523961 - RNA, 19 nt, Homo sapiens
caguguaugucuuguaucc

SEQ ID NO: 523962 - RNA, 19 nt, Homo sapiens
gggauuugaggauggauca

SEQ ID NO: 523963 - RNA, 19 nt, Homo sapiens
aggacacccugcugaagga

SEQ ID NO: 523964 - RNA, 19 nt, Homo sapiens
uucacgcaguggccaauaa

SEQ ID NO: 523965 - RNA, 19 nt, Homo sapiens
cagcauagcuugucaauaa

SEQ ID NO: 523966 - RNA, 19 nt, Homo sapiens
gcaauucguugauguauau

SEQ ID NO: 523967 - RNA, 19 nt, Homo sapiens
ggaggaaucugugucaaug

SEQ ID NO: 523968 - RNA, 19 nt, Homo sapiens
gcgcgacccugaugaacua

SEQ ID NO: 523969 - RNA, 19 nt, Homo sapiens
gaaguuugcaagaaguuua

SEQ ID NO: 523970 - RNA, 19 nt, Homo sapiens
ccauagaaguuugcaagaa

SEQ ID NO: 523971 - RNA, 19 nt, Homo sapiens
aagacaagaugcacuuuga

SEQ ID NO: 523972 - RNA, 19 nt, Homo sapiens
ggcaauucguugauguaua

SEQ ID NO: 523973 - RNA, 19 nt, Homo sapiens
cauagaaguuugcaagaag

SEQ ID NO: 523974 - RNA, 19 nt, Homo sapiens
gaacagaagaggaagaaaa

SEQ ID NO: 523975 - RNA, 19 nt, Homo sapiens
ccugaugaacuaagauuua

SEQ ID NO: 523976 - RNA, 19 nt, Homo sapiens
ccaauuaaccauggugaaa

SEQ ID NO: 523977 - RNA, 19 nt, Homo sapiens
gggcaucucuaugaauuag

SEQ ID NO: 523978 - RNA, 19 nt, Homo sapiens
gagaaaguagaucuucauu

SEQ ID NO: 523979 - RNA, 19 nt, Homo sapiens
uuaaugcgauugcucuuuc

SEQ ID NO: 523980 - RNA, 19 nt, Homo sapiens
gaggaugccauagaaguuu

SEQ ID NO: 523981 - RNA, 19 nt, Homo sapiens
ucaccaaccaguuucuuaa

SEQ ID NO: 523982 - RNA, 19 nt, Homo sapiens
ggacugauucaugcuauug

SEQ ID NO: 523983 - RNA, 19 nt, Homo sapiens
caaugccuguggaacaauu

SEQ ID NO: 523984 - RNA, 19 nt, Homo sapiens
gcacuuugaaucuggauca

SEQ ID NO: 523985 - RNA, 19 nt, Homo sapiens
gacaagaugcacuuugaau

SEQ ID NO: 523986 - RNA, 19 nt, Homo sapiens
gaacaauuggacugauuca

SEQ ID NO: 523987 - RNA, 19 nt, Homo sapiens
uggaacaauuggacugauu

SEQ ID NO: 523988 - RNA, 19 nt, Homo sapiens
caccaaguauagaugagaa

SEQ ID NO: 523989 - RNA, 19 nt, Homo sapiens
cgacccugaugaacuaaga

SEQ ID NO: 523990 - RNA, 19 nt, Homo sapiens
cgaggucaccaaccaguuu

SEQ ID NO: 523991 - RNA, 19 nt, Homo sapiens
gaagccauuuccaauuaac

SEQ ID NO: 523992 - RNA, 19 nt, Homo sapiens
gaagcaaacaaucagcaau

SEQ ID NO: 523993 - RNA, 19 nt, Homo sapiens
ugauguauauggaauggau

SEQ ID NO: 523994 - RNA, 19 nt, Homo sapiens
acaauuggacugauucaug

SEQ ID NO: 523995 - RNA, 19 nt, Homo sapiens
accagucugugcagucuua

SEQ ID NO: 523996 - RNA, 19 nt, Homo sapiens
cauccuaacuggcaauucg

SEQ ID NO: 523997 - RNA, 19 nt, Homo sapiens
aaugagcccugaagaacga

SEQ ID NO: 523998 - RNA, 19 nt, Homo sapiens
ggaacaauuggacugauuc

SEQ ID NO: 523999 - RNA, 19 nt, Homo sapiens
caguauauuucaugaagca

SEQ ID NO: 524000 - RNA, 19 nt, Homo sapiens
gaaguauucagaacagaag

SEQ ID NO: 524001 - RNA, 19 nt, Homo sapiens
gcauagcuugucaauaaug

SEQ ID NO: 524002 - RNA, 19 nt, Homo sapiens
auuagaggaugccauagaa

SEQ ID NO: 524003 - RNA, 19 nt, Homo sapiens
gaaacuagugaugaaacuu

SEQ ID NO: 524004 - RNA, 19 nt, Homo sapiens
ugcauuaguucauguagau

SEQ ID NO: 524005 - RNA, 19 nt, Homo sapiens
gaugagaaaguagaucuuc

SEQ ID NO: 524006 - RNA, 19 nt, Homo sapiens
agacugaggcaccaaguau

SEQ ID NO: 524007 - RNA, 19 nt, Homo sapiens
ugagaccagugcccaugaa

SEQ ID NO: 524008 - RNA, 19 nt, Homo sapiens
cugaagaacgagccagaua

SEQ ID NO: 524009 - RNA, 19 nt, Homo sapiens
acaauuaggucuacauccu

SEQ ID NO: 524010 - RNA, 19 nt, Homo sapiens
guauagaugagaaaguaga

SEQ ID NO: 524011 - RNA, 19 nt, Homo sapiens
gacugaggcaccaaguaua

SEQ ID NO: 524012 - RNA, 19 nt, Homo sapiens
ggagcgcgacccugaugaa

SEQ ID NO: 524013 - RNA, 19 nt, Homo sapiens
uggaauggauccugaacuc

SEQ ID NO: 524014 - RNA, 19 nt, Homo sapiens
ugaacuccuuagcauggua

SEQ ID NO: 524015 - RNA, 19 nt, Homo sapiens
ugccauacacuaacucaaa

SEQ ID NO: 524016 - RNA, 19 nt, Homo sapiens
uaaccauggugaaacuagu

SEQ ID NO: 524017 - RNA, 19 nt, Homo sapiens
gcaccaaguauagaugaga

SEQ ID NO: 524018 - RNA, 19 nt, Homo sapiens
uuuauuagaggaugccaua

SEQ ID NO: 524019 - RNA, 19 nt, Homo sapiens
gaccagugcccaugaaggu

SEQ ID NO: 524020 - RNA, 19 nt, Homo sapiens
cagcaaugccuguggaaca

SEQ ID NO: 524021 - RNA, 19 nt, Homo sapiens
ucucagggacaagauguua

SEQ ID NO: 524022 - RNA, 19 nt, Homo sapiens
gucaccaaccaguuucuua

SEQ ID NO: 524023 - RNA, 19 nt, Homo sapiens
ugaaacuagugaugaaacu

SEQ ID NO: 524024 - RNA, 19 nt, Homo sapiens
cagaacagaagaggaagaa

SEQ ID NO: 524025 - RNA, 19 nt, Homo sapiens
uggugaaacuagugaugaa

SEQ ID NO: 524026 - RNA, 19 nt, Homo sapiens
gaggaaucugugucaauga

SEQ ID NO: 524027 - RNA, 19 nt, Homo sapiens
ucucuuuccuauuacagaa

SEQ ID NO: 524028 - RNA, 19 nt, Homo sapiens
augggcaucucuaugaauu

SEQ ID NO: 524029 - RNA, 19 nt, Homo sapiens
ucaaugagcccugaagaac

SEQ ID NO: 524030 - RNA, 19 nt, Homo sapiens
aagcaaacaaucagcaaug

SEQ ID NO: 524031 - RNA, 19 nt, Homo sapiens
caccaaccaguuucuuaaa

SEQ ID NO: 524032 - RNA, 19 nt, Homo sapiens
gcagcauagcuugucaaua

SEQ ID NO: 524033 - RNA, 19 nt, Homo sapiens
gucaaugagcccugaagaa

SEQ ID NO: 524034 - RNA, 19 nt, Homo sapiens
gcaaacaauaaagacaaga

SEQ ID NO: 524035 - RNA, 19 nt, Homo sapiens
gccauacacuaacucaaaa

SEQ ID NO: 524036 - RNA, 19 nt, Homo sapiens
cauagcuugucaauaaugg

SEQ ID NO: 524037 - RNA, 19 nt, Homo sapiens
gauaccuggagaacuauga

SEQ ID NO: 524038 - RNA, 19 nt, Homo sapiens
uauuagaggaugccauaga

SEQ ID NO: 524039 - RNA, 19 nt, Homo sapiens
ucaauaauggaaacaccaa

SEQ ID NO: 524040 - RNA, 19 nt, Homo sapiens
ggugaaacuagugaugaaa

SEQ ID NO: 524041 - RNA, 19 nt, Homo sapiens
gaagaacgagccagauacc

SEQ ID NO: 524042 - RNA, 19 nt, Homo sapiens
gauccugaacuccuuagca

SEQ ID NO: 524043 - RNA, 19 nt, Homo sapiens
uaacuggcaauucguugau

SEQ ID NO: 524044 - RNA, 19 nt, Homo sapiens
auaaagacaagaugcacuu

SEQ ID NO: 524045 - RNA, 19 nt, Homo sapiens
caauaauggaaacaccaaa

SEQ ID NO: 524046 - RNA, 19 nt, Homo sapiens
agaggaugccauagaaguu

SEQ ID NO: 524047 - RNA, 19 nt, Homo sapiens
uagaggaugccauagaagu

SEQ ID NO: 524048 - RNA, 19 nt, Homo sapiens
cagacugaggcaccaagua

SEQ ID NO: 524049 - RNA, 19 nt, Homo sapiens
uagcuugucaauaauggaa

SEQ ID NO: 524050 - RNA, 19 nt, Homo sapiens
auagaaguuugcaagaagu

SEQ ID NO: 524051 - RNA, 19 nt, Homo sapiens
aaacaauuaggucuacauc

SEQ ID NO: 524052 - RNA, 19 nt, Homo sapiens
ugagaaaguagaucuucau

SEQ ID NO: 524053 - RNA, 19 nt, Homo sapiens
acaagaugcacuuugaauc

SEQ ID NO: 524054 - RNA, 19 nt, Homo sapiens
auucagaacagaagaggaa

SEQ ID NO: 524055 - RNA, 19 nt, Homo sapiens
ugauucaugcuauugcaaa

SEQ ID NO: 524056 - RNA, 19 nt, Homo sapiens
aauaaaaucucagggacaa

SEQ ID NO: 524057 - RNA, 19 nt, Homo sapiens
caaguauagaugagaaagu

SEQ ID NO: 524058 - RNA, 19 nt, Homo sapiens
ugaagaacgagccagauac

SEQ ID NO: 524059 - RNA, 19 nt, Homo sapiens
cuaacuggcaauucguuga

SEQ ID NO: 524060 - RNA, 19 nt, Homo sapiens
agacaagaugcacuuugaa

SEQ ID NO: 524061 - RNA, 19 nt, Homo sapiens
guugauguauauggaaugg

SEQ ID NO: 524062 - RNA, 19 nt, Homo sapiens
cuuaaacaauuaggucuac

SEQ ID NO: 524063 - RNA, 19 nt, Homo sapiens
gccauagaaguuugcaaga

SEQ ID NO: 524064 - RNA, 19 nt, Homo sapiens
aauggauccugaacuccuu

SEQ ID NO: 524065 - RNA, 19 nt, Homo sapiens
ggagcagaauugaauauua

SEQ ID NO: 524066 - RNA, 19 nt, Homo sapiens
gcagugagcugagaucgua

SEQ ID NO: 524067 - RNA, 19 nt, Homo sapiens
gaaggaaccuguguuauca

SEQ ID NO: 524068 - RNA, 19 nt, Homo sapiens
ggaaccagcucucuccuaa

SEQ ID NO: 524069 - RNA, 19 nt, Homo sapiens
uagaguagcucccauauau

SEQ ID NO: 524070 - RNA, 19 nt, Homo sapiens
caaggugccuguuauauau

SEQ ID NO: 524071 - RNA, 19 nt, Homo sapiens
gaacagagaaguugggaaa

SEQ ID NO: 524072 - RNA, 19 nt, Homo sapiens
gaacugaucucugguccaa

SEQ ID NO: 524073 - RNA, 19 nt, Homo sapiens
caacagcccuccaaacaau

SEQ ID NO: 524074 - RNA, 19 nt, Homo sapiens
gaaguggcaucuuguauca

SEQ ID NO: 524075 - RNA, 19 nt, Homo sapiens
gaauaaugaugcugacuau

SEQ ID NO: 524076 - RNA, 19 nt, Homo sapiens
gagcugagaucguaccuau

SEQ ID NO: 524077 - RNA, 19 nt, Homo sapiens
caacauuugucuggucuua

SEQ ID NO: 524078 - RNA, 19 nt, Homo sapiens
uaacagugguucaaauuuc

SEQ ID NO: 524079 - RNA, 19 nt, Homo sapiens
aaccagcucucuccuaaua

SEQ ID NO: 524080 - RNA, 19 nt, Homo sapiens
aaagacaacucaacuguuc

SEQ ID NO: 524081 - RNA, 19 nt, Homo sapiens
ugucuggucuuauaaguaa

SEQ ID NO: 524082 - RNA, 19 nt, Homo sapiens
ugaaguauguguuuaguag

SEQ ID NO: 524083 - RNA, 19 nt, Homo sapiens
cuacuuccaucccugcuua

SEQ ID NO: 524084 - RNA, 19 nt, Homo sapiens
gagugcaucuucuuuguau

SEQ ID NO: 524085 - RNA, 19 nt, Homo sapiens
gaagcaagccagccaauag

SEQ ID NO: 524086 - RNA, 19 nt, Homo sapiens
ccucgucaaugcuguguua

SEQ ID NO: 524087 - RNA, 19 nt, Homo sapiens
acauuugucuggucuuaua

SEQ ID NO: 524088 - RNA, 19 nt, Homo sapiens
gcacuauguuuccauuugu

SEQ ID NO: 524089 - RNA, 19 nt, Homo sapiens
gacaauugcuguggcguaa

SEQ ID NO: 524090 - RNA, 19 nt, Homo sapiens
gcugagaucguaccuauug

SEQ ID NO: 524091 - RNA, 19 nt, Homo sapiens
ccuggaggcuuguaaacua

SEQ ID NO: 524092 - RNA, 19 nt, Homo sapiens
ggaaaugugauuauugguu

SEQ ID NO: 524093 - RNA, 19 nt, Homo sapiens
uagccucaauucuccauua

SEQ ID NO: 524094 - RNA, 19 nt, Homo sapiens
ggauuucuguuuacuguca

SEQ ID NO: 524095 - RNA, 19 nt, Homo sapiens
ccagcucucuccuaauauu

SEQ ID NO: 524096 - RNA, 19 nt, Homo sapiens
cgucaaugcuguguuauga

SEQ ID NO: 524097 - RNA, 19 nt, Homo sapiens
gggaaaagauuacugaaau

SEQ ID NO: 524098 - RNA, 19 nt, Homo sapiens
acaaggugccuguuauaua

SEQ ID NO: 524099 - RNA, 19 nt, Homo sapiens
gaagauggccaaagacaac

SEQ ID NO: 524100 - RNA, 19 nt, Homo sapiens
aaagaaaccuuccaaugcu

SEQ ID NO: 524101 - RNA, 19 nt, Homo sapiens
uaacgugugugucuuacau

SEQ ID NO: 524102 - RNA, 19 nt, Homo sapiens
cagacaaggugccuguuau

SEQ ID NO: 524103 - RNA, 19 nt, Homo sapiens
caauugcuguggcguaaau

SEQ ID NO: 524104 - RNA, 19 nt, Homo sapiens
cgaaggaaccuguguuauc

SEQ ID NO: 524105 - RNA, 19 nt, Homo sapiens
gcaguucucaugacuccua

SEQ ID NO: 524106 - RNA, 19 nt, Homo sapiens
uauauagacuguugaaagg

SEQ ID NO: 524107 - RNA, 19 nt, Homo sapiens
gccuguaucucucacuauu

SEQ ID NO: 524108 - RNA, 19 nt, Homo sapiens
ggagugcaucuucuuugua

SEQ ID NO: 524109 - RNA, 19 nt, Homo sapiens
gcgcuugccuucagcuugu

SEQ ID NO: 524110 - RNA, 19 nt, Homo sapiens
gcauuucuuucuagaguag

SEQ ID NO: 524111 - RNA, 19 nt, Homo sapiens
ccaaagacaacucaacugu

SEQ ID NO: 524112 - RNA, 19 nt, Homo sapiens
caaauuuccuuucauaccu

SEQ ID NO: 524113 - RNA, 19 nt, Homo sapiens
cuagcauucugcaacauuu

SEQ ID NO: 524114 - RNA, 19 nt, Homo sapiens
auaaaguguugccaccaua

SEQ ID NO: 524115 - RNA, 19 nt, Homo sapiens
gccauucucugcuggacuu

SEQ ID NO: 524116 - RNA, 19 nt, Homo sapiens
aaucagggcugcuaugaac

SEQ ID NO: 524117 - RNA, 19 nt, Homo sapiens
caaagacaacucaacuguu

SEQ ID NO: 524118 - RNA, 19 nt, Homo sapiens
ucccgaagauggccaaaga

SEQ ID NO: 524119 - RNA, 19 nt, Homo sapiens
agacaaggugccuguuaua

SEQ ID NO: 524120 - RNA, 19 nt, Homo sapiens
gccuucagcuugugggaaa

SEQ ID NO: 524121 - RNA, 19 nt, Homo sapiens
gggcugcuaugaacugauc

SEQ ID NO: 524122 - RNA, 19 nt, Homo sapiens
gaugggugauucucuugau

SEQ ID NO: 524123 - RNA, 19 nt, Homo sapiens
guugaaaggagaauuugaa

SEQ ID NO: 524124 - RNA, 19 nt, Homo sapiens
guauuuggcuagcaaucug

SEQ ID NO: 524125 - RNA, 19 nt, Homo sapiens
uuucucaucugcacuaugu

SEQ ID NO: 524126 - RNA, 19 nt, Homo sapiens
cuccuaauauuccacguuu

SEQ ID NO: 524127 - RNA, 19 nt, Homo sapiens
cauaaaguguugccaccau

SEQ ID NO: 524128 - RNA, 19 nt, Homo sapiens
cuguaucucucacuauuau

SEQ ID NO: 524129 - RNA, 19 nt, Homo sapiens
gcaagccagccaauagaau

SEQ ID NO: 524130 - RNA, 19 nt, Homo sapiens
gacaaggugccuguuauau

SEQ ID NO: 524131 - RNA, 19 nt, Homo sapiens
gcaaucugccuguaucucu

SEQ ID NO: 524132 - RNA, 19 nt, Homo sapiens
gcauucugcaacauuuaua

SEQ ID NO: 524133 - RNA, 19 nt, Homo sapiens
ucaaugcuguguuaugaac

SEQ ID NO: 524134 - RNA, 19 nt, Homo sapiens
agaauaaugaugcugacua

SEQ ID NO: 524135 - RNA, 19 nt, Homo sapiens
cacccaaccucuuccugaa

SEQ ID NO: 524136 - RNA, 19 nt, Homo sapiens
caagccagccaauagaaug

SEQ ID NO: 524137 - RNA, 19 nt, Homo sapiens
ugucuuacauugccaaguc

SEQ ID NO: 524138 - RNA, 19 nt, Homo sapiens
ccuuugaaguggcaucuug

SEQ ID NO: 524139 - RNA, 19 nt, Homo sapiens
gcaucuucuuuguaucuga

SEQ ID NO: 524140 - RNA, 19 nt, Homo sapiens
gaaaccccgucucuacaaa

SEQ ID NO: 524141 - RNA, 19 nt, Homo sapiens
acugaucucugguccaaug

SEQ ID NO: 524142 - RNA, 19 nt, Homo sapiens
caaccuggaggcuuguaaa

SEQ ID NO: 524143 - RNA, 19 nt, Homo sapiens
uaucacagcagcaacacaa

SEQ ID NO: 524144 - RNA, 19 nt, Homo sapiens
ggugccuguuauauauuua

SEQ ID NO: 524145 - RNA, 19 nt, Homo sapiens
uaaaagaaaccuuccaaug

SEQ ID NO: 524146 - RNA, 19 nt, Homo sapiens
aaacaauggagucaccaaa

SEQ ID NO: 524147 - RNA, 19 nt, Homo sapiens
ccugaaggaaauucuuaua

SEQ ID NO: 524148 - RNA, 19 nt, Homo sapiens
uaacgcaggagaaucacuu

SEQ ID NO: 524149 - RNA, 19 nt, Homo sapiens
cuagcaaucugccuguauc

SEQ ID NO: 524150 - RNA, 19 nt, Homo sapiens
guaacccagagcuguauuu

SEQ ID NO: 524151 - RNA, 19 nt, Homo sapiens
cggagugcaucuucuuugu

SEQ ID NO: 524152 - RNA, 19 nt, Homo sapiens
gguacggacuuccuuuagg

SEQ ID NO: 524153 - RNA, 19 nt, Homo sapiens
cguauuucauucugauguu

SEQ ID NO: 524154 - RNA, 19 nt, Homo sapiens
ugcacuauguuuccauuug

SEQ ID NO: 524155 - RNA, 19 nt, Homo sapiens
cuagaguagcucccauaua

SEQ ID NO: 524156 - RNA, 19 nt, Homo sapiens
gaugguacggacuuccuuu

SEQ ID NO: 524157 - RNA, 19 nt, Homo sapiens
ucucaugacuccuacuuuu

SEQ ID NO: 524158 - RNA, 19 nt, Homo sapiens
ccuguaaucccagcacuuu

SEQ ID NO: 524159 - RNA, 19 nt, Homo sapiens
aagaaaccuuccaaugcuu

SEQ ID NO: 524160 - RNA, 19 nt, Homo sapiens
uagcauucugcaacauuua

SEQ ID NO: 524161 - RNA, 19 nt, Homo sapiens
gaucucugguccaaugaac

SEQ ID NO: 524162 - RNA, 19 nt, Homo sapiens
guugaucucaguauuguca

SEQ ID NO: 524163 - RNA, 19 nt, Homo sapiens
gcggagugcaucuucuuug

SEQ ID NO: 524164 - RNA, 19 nt, Homo sapiens
ccuaauauuccacguuugu

SEQ ID NO: 524165 - RNA, 19 nt, Homo sapiens
gagcagaaccgcaucauau

SEQ ID NO: 524166 - RNA, 19 nt, Homo sapiens
ccauugaccucaccuuuca

SEQ ID NO: 524167 - RNA, 19 nt, Homo sapiens
gcagaaccgcaucauauuc

SEQ ID NO: 524168 - RNA, 19 nt, Homo sapiens
gacagagacuggagcucaa

SEQ ID NO: 524169 - RNA, 19 nt, Homo sapiens
cgaaaacguugaccccuuu

SEQ ID NO: 524170 - RNA, 19 nt, Homo sapiens
uacagacgcucgccgacaa

SEQ ID NO: 524171 - RNA, 19 nt, Homo sapiens
cgagcagaaccgcaucaua

SEQ ID NO: 524172 - RNA, 19 nt, Homo sapiens
acccuucucuguccauuga

SEQ ID NO: 524173 - RNA, 19 nt, Homo sapiens
agacuggagcucaaucuug

SEQ ID NO: 524174 - RNA, 19 nt, Homo sapiens
caacccuucucuguccauu

SEQ ID NO: 524175 - RNA, 19 nt, Homo sapiens
ggcacugucugcgugacua

SEQ ID NO: 524176 - RNA, 19 nt, Homo sapiens
guccauugaccucaccuuu

SEQ ID NO: 524177 - RNA, 19 nt, Homo sapiens
gagacuggagcucaaucuu

SEQ ID NO: 524178 - RNA, 19 nt, Homo sapiens
gcacugucugcgugacuau

SEQ ID NO: 524179 - RNA, 19 nt, Homo sapiens
cgggacaacccuucucugu

SEQ ID NO: 524180 - RNA, 19 nt, Homo sapiens
guacagagcuaguaacaua

SEQ ID NO: 524181 - RNA, 19 nt, Homo sapiens
gaagugucaucaucaauug

SEQ ID NO: 524182 - RNA, 19 nt, Homo sapiens
ccacagaggucgugaaagu

SEQ ID NO: 524183 - RNA, 19 nt, Homo sapiens
cauaugaucuaaugaagga

SEQ ID NO: 524184 - RNA, 19 nt, Homo sapiens
ggacaggcgugaagagcaa

SEQ ID NO: 524185 - RNA, 19 nt, Homo sapiens
guugguaccuuccuucuug

SEQ ID NO: 524186 - RNA, 19 nt, Homo sapiens
gcccaacugugcaaugaaa

SEQ ID NO: 524187 - RNA, 19 nt, Homo sapiens
gcuaguaacauaugaucua

SEQ ID NO: 524188 - RNA, 19 nt, Homo sapiens
gaaagaaacagcaccuagu

SEQ ID NO: 524189 - RNA, 19 nt, Homo sapiens
gaagagcaagggaaaggaa

SEQ ID NO: 524190 - RNA, 19 nt, Homo sapiens
gcucuucucagcuggaaua

SEQ ID NO: 524191 - RNA, 19 nt, Homo sapiens
ggaacgucauuauguuugu

SEQ ID NO: 524192 - RNA, 19 nt, Homo sapiens
ugagaagugucaucaucaa

SEQ ID NO: 524193 - RNA, 19 nt, Homo sapiens
cgagaacugucaaagucaa

SEQ ID NO: 524194 - RNA, 19 nt, Homo sapiens
ggacuacucccaaucugau

SEQ ID NO: 524195 - RNA, 19 nt, Homo sapiens
aaagaaacagcaccuaguu

SEQ ID NO: 524196 - RNA, 19 nt, Homo sapiens
gaacgucauuauguuugug

SEQ ID NO: 524197 - RNA, 19 nt, Homo sapiens
ggaguggcaguauucauug

SEQ ID NO: 524198 - RNA, 19 nt, Homo sapiens
ccuggaacgucauuauguu

SEQ ID NO: 524199 - RNA, 19 nt, Homo sapiens
gaccaacggcuuucuucaa

SEQ ID NO: 524200 - RNA, 19 nt, Homo sapiens
caucaauuguacagagcua

SEQ ID NO: 524201 - RNA, 19 nt, Homo sapiens
cguccaguguuauuaggua

SEQ ID NO: 524202 - RNA, 19 nt, Homo sapiens
caacugaaacgagaacugu

SEQ ID NO: 524203 - RNA, 19 nt, Homo sapiens
agaagugucaucaucaauu

SEQ ID NO: 524204 - RNA, 19 nt, Homo sapiens
aacgagaacugucaaaguc

SEQ ID NO: 524205 - RNA, 19 nt, Homo sapiens
gugcccaacugugcaauga

SEQ ID NO: 524206 - RNA, 19 nt, Homo sapiens
gaaacgagaacugucaaag

SEQ ID NO: 524207 - RNA, 19 nt, Homo sapiens
ggacuuauaaugcguacag

SEQ ID NO: 524208 - RNA, 19 nt, Homo sapiens
ugcccgacguccaguguua

SEQ ID NO: 524209 - RNA, 19 nt, Homo sapiens
gauccuggaacgucauuau

SEQ ID NO: 524210 - RNA, 19 nt, Homo sapiens
ggaaucaaaccucgcuaca

SEQ ID NO: 524211 - RNA, 19 nt, Homo sapiens
gaagggcggaugaaacucu

SEQ ID NO: 524212 - RNA, 19 nt, Homo sapiens
gaacaacugaaacgagaac

SEQ ID NO: 524213 - RNA, 19 nt, Homo sapiens
aaacgagaacugucaaagu

SEQ ID NO: 524214 - RNA, 19 nt, Homo sapiens
cagagcuaguaacauauga

SEQ ID NO: 524215 - RNA, 19 nt, Homo sapiens
aacaaucaccgcuguggua

SEQ ID NO: 524216 - RNA, 19 nt, Homo sapiens
ggaccaacggcuuucuuca

SEQ ID NO: 524217 - RNA, 19 nt, Homo sapiens
gggcuucagcggcaaauca

SEQ ID NO: 524218 - RNA, 19 nt, Homo sapiens
gagcuaguaacauaugauc

SEQ ID NO: 524219 - RNA, 19 nt, Homo sapiens
guacagaauaauagcaaca

SEQ ID NO: 524220 - RNA, 19 nt, Homo sapiens
cagaagggcggaugaaacu

SEQ ID NO: 524221 - RNA, 19 nt, Homo sapiens
gagaagugucaucaucaau

SEQ ID NO: 524222 - RNA, 19 nt, Homo sapiens
cauuauguuugugugcuuu

SEQ ID NO: 524223 - RNA, 19 nt, Homo sapiens
ccaaucugaugagaagugu

SEQ ID NO: 524224 - RNA, 19 nt, Homo sapiens
gcaacaaccgaaggcuuga

SEQ ID NO: 524225 - RNA, 19 nt, Homo sapiens
uggcggacgugaucaccuu

SEQ ID NO: 524226 - RNA, 19 nt, Homo sapiens
aaacagaagggcggaugaa

SEQ ID NO: 524227 - RNA, 19 nt, Homo sapiens
ccugacagccucggacgua

SEQ ID NO: 524228 - RNA, 19 nt, Homo sapiens
caacauauuagcagaugac

SEQ ID NO: 524229 - RNA, 19 nt, Homo sapiens
cuugacgggucuuuggaaa

SEQ ID NO: 524230 - RNA, 19 nt, Homo sapiens
aacaacauauuagcagaug

SEQ ID NO: 524231 - RNA, 19 nt, Homo sapiens
caauuguacagagcuagua

SEQ ID NO: 524232 - RNA, 19 nt, Homo sapiens
acagaggucgugaaaguca

SEQ ID NO: 524233 - RNA, 19 nt, Homo sapiens
aggaguggcaguauucauu

SEQ ID NO: 524234 - RNA, 19 nt, Homo sapiens
cgacguccaguguuauuag

SEQ ID NO: 524235 - RNA, 19 nt, Homo sapiens
cacuuggugucggcucuua

SEQ ID NO: 524236 - RNA, 19 nt, Homo sapiens
gagcaagggaaaggaacuu

SEQ ID NO: 524237 - RNA, 19 nt, Homo sapiens
gcgugaagagcaagggaaa

SEQ ID NO: 524238 - RNA, 19 nt, Homo sapiens
gugcuuugaacaacugaaa

SEQ ID NO: 524239 - RNA, 19 nt, Homo sapiens
gcguacagaauaauagcaa

SEQ ID NO: 524240 - RNA, 19 nt, Homo sapiens
accaacggcuuucuucaag

SEQ ID NO: 524241 - RNA, 19 nt, Homo sapiens
caacugugcaaugaaagug

SEQ ID NO: 524242 - RNA, 19 nt, Homo sapiens
cuuauaaugcguacagaau

SEQ ID NO: 524243 - RNA, 19 nt, Homo sapiens
aaucaccgcugugguaaaa

SEQ ID NO: 524244 - RNA, 19 nt, Homo sapiens
agagccaucuccacggaau

SEQ ID NO: 524245 - RNA, 19 nt, Homo sapiens
gaguggcaguauucauugg

SEQ ID NO: 524246 - RNA, 19 nt, Homo sapiens
cuggaggaguggcaguauu

SEQ ID NO: 524247 - RNA, 19 nt, Homo sapiens
gggaaagaaacagcaccua

SEQ ID NO: 524248 - RNA, 19 nt, Homo sapiens
ugaaacgagaacugucaaa

SEQ ID NO: 524249 - RNA, 19 nt, Homo sapiens
cugcaucuccagucucuga

SEQ ID NO: 524250 - RNA, 19 nt, Homo sapiens
aaagguguccugggaacaa

SEQ ID NO: 524251 - RNA, 19 nt, Homo sapiens
aagggcggaugaaacucua

SEQ ID NO: 524252 - RNA, 19 nt, Homo sapiens
ucauuauguuugugugcuu

SEQ ID NO: 524253 - RNA, 19 nt, Homo sapiens
acaaucaccgcugugguaa

SEQ ID NO: 524254 - RNA, 19 nt, Homo sapiens
acagagcuaguaacauaug

SEQ ID NO: 524255 - RNA, 19 nt, Homo sapiens
guccaguguuauuagguau

SEQ ID NO: 524256 - RNA, 19 nt, Homo sapiens
aaucugaugagaaguguca

SEQ ID NO: 524257 - RNA, 19 nt, Homo sapiens
ccacuucacuucugccuuu

SEQ ID NO: 524258 - RNA, 19 nt, Homo sapiens
gugcugagcuggugaccua

SEQ ID NO: 524259 - RNA, 19 nt, Homo sapiens
gaagaacgggacaccuuua

SEQ ID NO: 524260 - RNA, 19 nt, Homo sapiens
ccgagaggcucccuucuga

SEQ ID NO: 524261 - RNA, 19 nt, Homo sapiens
ucaaacaguucuacaccaa

SEQ ID NO: 524262 - RNA, 19 nt, Homo sapiens
gcuaaaguccgguuacaga

SEQ ID NO: 524263 - RNA, 19 nt, Homo sapiens
gaucaccucuggcuuuguc

SEQ ID NO: 524264 - RNA, 19 nt, Homo sapiens
ucgcagaucucaucaccuu

SEQ ID NO: 524265 - RNA, 19 nt, Homo sapiens
ggaaaucagcaucaugguu

SEQ ID NO: 524266 - RNA, 19 nt, Homo sapiens
ggucggagauaccaaagca

SEQ ID NO: 524267 - RNA, 19 nt, Homo sapiens
gcaucggccuguaugauuc

SEQ ID NO: 524268 - RNA, 19 nt, Homo sapiens
ccuaccaccuucccucuuu

SEQ ID NO: 524269 - RNA, 19 nt, Homo sapiens
gaacgggacaccuuuagag

SEQ ID NO: 524270 - RNA, 19 nt, Homo sapiens
gcagaucucaucaccuuuc

SEQ ID NO: 524271 - RNA, 19 nt, Homo sapiens
guaugaccauuagguguuu

SEQ ID NO: 524272 - RNA, 19 nt, Homo sapiens
ggacguagcaggaaaucag

SEQ ID NO: 524273 - RNA, 19 nt, Homo sapiens
aagccaaccucaugacaga

SEQ ID NO: 524274 - RNA, 19 nt, Homo sapiens
ucucagugcugguggaguu

SEQ ID NO: 524275 - RNA, 19 nt, Homo sapiens
ugaccucccuugccacuuc

SEQ ID NO: 524276 - RNA, 19 nt, Homo sapiens
gaccauugcccgagaggaa

SEQ ID NO: 524277 - RNA, 19 nt, Homo sapiens
gaaagccaaccucaugaca

SEQ ID NO: 524278 - RNA, 19 nt, Homo sapiens
gcuggccacugugcccuua

SEQ ID NO: 524279 - RNA, 19 nt, Homo sapiens
ccuguaugauucugucaaa

SEQ ID NO: 524280 - RNA, 19 nt, Homo sapiens
ggaguugacauuugacagu

SEQ ID NO: 524281 - RNA, 19 nt, Homo sapiens
guuccucuaucucgucuug

SEQ ID NO: 524282 - RNA, 19 nt, Homo sapiens
ugaagaacgggacaccuuu

SEQ ID NO: 524283 - RNA, 19 nt, Homo sapiens
uuaccaugcuccagaagga

SEQ ID NO: 524284 - RNA, 19 nt, Homo sapiens
uuacagauccaaggagaaa

SEQ ID NO: 524285 - RNA, 19 nt, Homo sapiens
ugauguucgucaccuauga

SEQ ID NO: 524286 - RNA, 19 nt, Homo sapiens
ccuggaacguggugauguu

SEQ ID NO: 524287 - RNA, 19 nt, Homo sapiens
ccugaaagccaaccucaug

SEQ ID NO: 524288 - RNA, 19 nt, Homo sapiens
gguaaagguccgauuccaa

SEQ ID NO: 524289 - RNA, 19 nt, Homo sapiens
cgggacaccuuuagagaag

SEQ ID NO: 524290 - RNA, 19 nt, Homo sapiens
ggucaagacgagauacaug

SEQ ID NO: 524291 - RNA, 19 nt, Homo sapiens
gcaggaaaucagcaucaug

SEQ ID NO: 524292 - RNA, 19 nt, Homo sapiens
ccugaucaccucuggcuuu

SEQ ID NO: 524293 - RNA, 19 nt, Homo sapiens
ugguggaguugacauuuga

SEQ ID NO: 524294 - RNA, 19 nt, Homo sapiens
gucaagacgagauacauga

SEQ ID NO: 524295 - RNA, 19 nt, Homo sapiens
caccuucccucuuucuaca

SEQ ID NO: 524296 - RNA, 19 nt, Homo sapiens
cuacugccacugugaaguu

SEQ ID NO: 524297 - RNA, 19 nt, Homo sapiens
ggacaccuuuagagaagcu

SEQ ID NO: 524298 - RNA, 19 nt, Homo sapiens
agagaagcuugaucuugga

SEQ ID NO: 524299 - RNA, 19 nt, Homo sapiens
cccgaagccucuacaaugg

SEQ ID NO: 524300 - RNA, 19 nt, Homo sapiens
caucaugguuggguucaag

SEQ ID NO: 524301 - RNA, 19 nt, Homo sapiens
cuucucuccuucccucuuu

SEQ ID NO: 524302 - RNA, 19 nt, Homo sapiens
gcugaaacgagcccucaug

SEQ ID NO: 524303 - RNA, 19 nt, Homo sapiens
ggccugcagcgccaaauga

SEQ ID NO: 524304 - RNA, 19 nt, Homo sapiens
uuagagaagcuugaucuug

SEQ ID NO: 524305 - RNA, 19 nt, Homo sapiens
ucaagacgagauacaugaa

SEQ ID NO: 524306 - RNA, 19 nt, Homo sapiens
gcggcucggacacauagua

SEQ ID NO: 524307 - RNA, 19 nt, Homo sapiens
ugaccauggugcguacuga

SEQ ID NO: 524308 - RNA, 19 nt, Homo sapiens
ccacuggcagcuuugaaga

SEQ ID NO: 524309 - RNA, 19 nt, Homo sapiens
gcugguggaguugacauuu

SEQ ID NO: 524310 - RNA, 19 nt, Homo sapiens
uaaaguccgguuacagauc

SEQ ID NO: 524311 - RNA, 19 nt, Homo sapiens
cugguggaguugacauuug

SEQ ID NO: 524312 - RNA, 19 nt, Homo sapiens
uuucgucucccacccauuu

SEQ ID NO: 524313 - RNA, 19 nt, Homo sapiens
cugagcuggugaccuauga

SEQ ID NO: 524314 - RNA, 19 nt, Homo sapiens
cucccaauguugcucguaa

SEQ ID NO: 524315 - RNA, 19 nt, Homo sapiens
uaccaaagcaccgucaaug

SEQ ID NO: 524316 - RNA, 19 nt, Homo sapiens
caucaccuuuccucuggau

SEQ ID NO: 524317 - RNA, 19 nt, Homo sapiens
aaaugagcuuugccucugu

SEQ ID NO: 524318 - RNA, 19 nt, Homo sapiens
ccucuggcuuugucucuag

SEQ ID NO: 524319 - RNA, 19 nt, Homo sapiens
gaccuuacaaagccggauu

SEQ ID NO: 524320 - RNA, 19 nt, Homo sapiens
caccgucaaugccuacaag

SEQ ID NO: 524321 - RNA, 19 nt, Homo sapiens
cgcaucggccuguaugauu

SEQ ID NO: 524322 - RNA, 19 nt, Homo sapiens
ucccgucccuuggaaaguu

SEQ ID NO: 524323 - RNA, 19 nt, Homo sapiens
cugaucaccucuggcuuug

SEQ ID NO: 524324 - RNA, 19 nt, Homo sapiens
gccaaccucaugacagaug

SEQ ID NO: 524325 - RNA, 19 nt, Homo sapiens
ccucuacaaugggcugguu

SEQ ID NO: 524326 - RNA, 19 nt, Homo sapiens
uagcaggaaaucagcauca

SEQ ID NO: 524327 - RNA, 19 nt, Homo sapiens
uuggaaaguucagccagaa

SEQ ID NO: 524328 - RNA, 19 nt, Homo sapiens
ccuucccucuuucuacauu

SEQ ID NO: 524329 - RNA, 19 nt, Homo sapiens
uguaugauucugucaaaca

SEQ ID NO: 524330 - RNA, 19 nt, Homo sapiens
ccaguaccgcggugugaug

SEQ ID NO: 524331 - RNA, 19 nt, Homo sapiens
gaagaagguuugaaagaua

SEQ ID NO: 524332 - RNA, 19 nt, Homo sapiens
ggaagaagguuugaaagau

SEQ ID NO: 524333 - RNA, 19 nt, Homo sapiens
gcaagaaccuaaaguagca

SEQ ID NO: 524334 - RNA, 19 nt, Homo sapiens
gaaggccacugguagcuaa

SEQ ID NO: 524335 - RNA, 19 nt, Homo sapiens
gaacuguuguuuacuuguu

SEQ ID NO: 524336 - RNA, 19 nt, Homo sapiens
ugacgacacugaagaauca

SEQ ID NO: 524337 - RNA, 19 nt, Homo sapiens
gaugaaaguccagauguua

SEQ ID NO: 524338 - RNA, 19 nt, Homo sapiens
gugaagacccgguauauga

SEQ ID NO: 524339 - RNA, 19 nt, Homo sapiens
ggaaugcuaucgucaacug

SEQ ID NO: 524340 - RNA, 19 nt, Homo sapiens
caaaggauccagagacuug

SEQ ID NO: 524341 - RNA, 19 nt, Homo sapiens
ggacacagacccacacaug

SEQ ID NO: 524342 - RNA, 19 nt, Homo sapiens
gcaugaacgcacuuuauaa

SEQ ID NO: 524343 - RNA, 19 nt, Homo sapiens
gcagagccuuccaggacua

SEQ ID NO: 524344 - RNA, 19 nt, Homo sapiens
aaaccaagauagauccauu

SEQ ID NO: 524345 - RNA, 19 nt, Homo sapiens
ucaagaaacagaaguagaa

SEQ ID NO: 524346 - RNA, 19 nt, Homo sapiens
gggaaauuauuaugacuca

SEQ ID NO: 524347 - RNA, 19 nt, Homo sapiens
ggcaugaacgcacuuuaua

SEQ ID NO: 524348 - RNA, 19 nt, Homo sapiens
caucacacaugcaucauca

SEQ ID NO: 524349 - RNA, 19 nt, Homo sapiens
aggagaagcugcuggacua

SEQ ID NO: 524350 - RNA, 19 nt, Homo sapiens
gugagaagcugggcaugaa

SEQ ID NO: 524351 - RNA, 19 nt, Homo sapiens
gggaagaagguuugaaaga

SEQ ID NO: 524352 - RNA, 19 nt, Homo sapiens
gacaaugccuugggagaga

SEQ ID NO: 524353 - RNA, 19 nt, Homo sapiens
cgaaaccaguuaagaaugg

SEQ ID NO: 524354 - RNA, 19 nt, Homo sapiens
caugaacgcacuuuauaaa

SEQ ID NO: 524355 - RNA, 19 nt, Homo sapiens
gaggagggauucuggucuu

SEQ ID NO: 524356 - RNA, 19 nt, Homo sapiens
gaacuuugcccaacaucau

SEQ ID NO: 524357 - RNA, 19 nt, Homo sapiens
gaaagauacgguugucuag

SEQ ID NO: 524358 - RNA, 19 nt, Homo sapiens
ugaaagauacgguugucua

SEQ ID NO: 524359 - RNA, 19 nt, Homo sapiens
agacaacagugaaugacaa

SEQ ID NO: 524360 - RNA, 19 nt, Homo sapiens
caucaucagccuauuugua

SEQ ID NO: 524361 - RNA, 19 nt, Homo sapiens
cugguuagauaaugaauga

SEQ ID NO: 524362 - RNA, 19 nt, Homo sapiens
guaaaucuaacuacaagga

SEQ ID NO: 524363 - RNA, 19 nt, Homo sapiens
ccacacauguuuacagaac

SEQ ID NO: 524364 - RNA, 19 nt, Homo sapiens
gacaagaaggccacuggua

SEQ ID NO: 524365 - RNA, 19 nt, Homo sapiens
ggacuaugguuggacugaa

SEQ ID NO: 524366 - RNA, 19 nt, Homo sapiens
gacaguggaugacgugaag

SEQ ID NO: 524367 - RNA, 19 nt, Homo sapiens
caccauggcugugaaguuc

SEQ ID NO: 524368 - RNA, 19 nt, Homo sapiens
ucacugccaugccucaaga

SEQ ID NO: 524369 - RNA, 19 nt, Homo sapiens
ugaugaaaguccagauguu

SEQ ID NO: 524370 - RNA, 19 nt, Homo sapiens
caacagugaaugacaagga

SEQ ID NO: 524371 - RNA, 19 nt, Homo sapiens
aaagcucuguguaaaucua

SEQ ID NO: 524372 - RNA, 19 nt, Homo sapiens
cagaacuguuguuuacuug

SEQ ID NO: 524373 - RNA, 19 nt, Homo sapiens
gaaaccaguuaagaaugga

SEQ ID NO: 524374 - RNA, 19 nt, Homo sapiens
caaaagcucuguguaaauc

SEQ ID NO: 524375 - RNA, 19 nt, Homo sapiens
gggcaugaacgcacuuuau

SEQ ID NO: 524376 - RNA, 19 nt, Homo sapiens
gaagguuggagacguguau

SEQ ID NO: 524377 - RNA, 19 nt, Homo sapiens
ggaaacccaaggaacaaga

SEQ ID NO: 524378 - RNA, 19 nt, Homo sapiens
acacagacccacacauguu

SEQ ID NO: 524379 - RNA, 19 nt, Homo sapiens
gaggaaugcuaucgucaac

SEQ ID NO: 524380 - RNA, 19 nt, Homo sapiens
gauucaagaaacagaagua

SEQ ID NO: 524381 - RNA, 19 nt, Homo sapiens
guccagauguuacgggaau

SEQ ID NO: 524382 - RNA, 19 nt, Homo sapiens
gggcaagaaccuaaaguag

SEQ ID NO: 524383 - RNA, 19 nt, Homo sapiens
cagggaagaagguuugaaa

SEQ ID NO: 524384 - RNA, 19 nt, Homo sapiens
uagagccugugcuaaagaa

SEQ ID NO: 524385 - RNA, 19 nt, Homo sapiens
cagagaguccuuugggauu

SEQ ID NO: 524386 - RNA, 19 nt, Homo sapiens
uagaagaggaggagggauu

SEQ ID NO: 524387 - RNA, 19 nt, Homo sapiens
gaccuccucucggcccuaa

SEQ ID NO: 524388 - RNA, 19 nt, Homo sapiens
guagcuaacguguccgaaa

SEQ ID NO: 524389 - RNA, 19 nt, Homo sapiens
ggacaacuccagccucacu

SEQ ID NO: 524390 - RNA, 19 nt, Homo sapiens
ccuggaacguggugauguu

SEQ ID NO: 524391 - RNA, 19 nt, Homo sapiens
ugaagacccgguauaugaa

SEQ ID NO: 524392 - RNA, 19 nt, Homo sapiens
caacuuccccugccacuuu

SEQ ID NO: 524393 - RNA, 19 nt, Homo sapiens
aagauacgguugucuagag

SEQ ID NO: 524394 - RNA, 19 nt, Homo sapiens
cugacaagauggaaaauaa

SEQ ID NO: 524395 - RNA, 19 nt, Homo sapiens
uugcugaccucguuaccuu

SEQ ID NO: 524396 - RNA, 19 nt, Homo sapiens
guccgaaaccaguuaagaa

SEQ ID NO: 524397 - RNA, 19 nt, Homo sapiens
ccuuugggauucuaggaaa

SEQ ID NO: 524398 - RNA, 19 nt, Homo sapiens
gcacugacaagauggaaaa

SEQ ID NO: 524399 - RNA, 19 nt, Homo sapiens
guaccucaaaggauuguug

SEQ ID NO: 524400 - RNA, 19 nt, Homo sapiens
cacagacccacacauguuu

SEQ ID NO: 524401 - RNA, 19 nt, Homo sapiens
uagcuaacguguccgaaac

SEQ ID NO: 524402 - RNA, 19 nt, Homo sapiens
ccacuuugucucugccuuu

SEQ ID NO: 524403 - RNA, 19 nt, Homo sapiens
gaaaauacagcgggacuau

SEQ ID NO: 524404 - RNA, 19 nt, Homo sapiens
uagcaggacucggaauucu

SEQ ID NO: 524405 - RNA, 19 nt, Homo sapiens
guggauuccugggcaagaa

SEQ ID NO: 524406 - RNA, 19 nt, Homo sapiens
aagaagguuugaaagauac

SEQ ID NO: 524407 - RNA, 19 nt, Homo sapiens
gacuaugguuggacugaag

SEQ ID NO: 524408 - RNA, 19 nt, Homo sapiens
cuaggaaacccaaggaaca

SEQ ID NO: 524409 - RNA, 19 nt, Homo sapiens
acacauguuuacagaacug

SEQ ID NO: 524410 - RNA, 19 nt, Homo sapiens
acgcacacauggacacaga

SEQ ID NO: 524411 - RNA, 19 nt, Homo sapiens
cagccucacuacccggauu

SEQ ID NO: 524412 - RNA, 19 nt, Homo sapiens
gggauuuacacccuccuuu

SEQ ID NO: 524413 - RNA, 19 nt, Homo sapiens
aaauacagcgggacuaugg

SEQ ID NO: 524414 - RNA, 19 nt, Homo sapiens
gcaaaagcucuguguaaau

SEQ ID NO: 524415 - RNA, 19 nt, Homo sapiens
aaacuagagccugugcuaa

SEQ ID NO: 524416 - RNA, 19 nt, Homo sapiens
ugauguucguaaccuauga

SEQ ID NO: 524417 - RNA, 19 nt, Homo sapiens
ggaacuuugcccaacauca

SEQ ID NO: 524418 - RNA, 19 nt, Homo sapiens
gacuauggacgccuacaga

SEQ ID NO: 524419 - RNA, 19 nt, Homo sapiens
aauauucccugacgacacu

SEQ ID NO: 524420 - RNA, 19 nt, Homo sapiens
agagaguccuuugggauuc

SEQ ID NO: 524421 - RNA, 19 nt, Homo sapiens
aucaucagccuauuuguaa

SEQ ID NO: 524422 - RNA, 19 nt, Homo sapiens
acaauggagugggagauca

SEQ ID NO: 524423 - RNA, 19 nt, Homo sapiens
agaaacagaaguagaagag

SEQ ID NO: 524424 - RNA, 19 nt, Homo sapiens
ccugcucacugacaacuuc

SEQ ID NO: 524425 - RNA, 19 nt, Homo sapiens
acucggaauucucgggaaa

SEQ ID NO: 524426 - RNA, 19 nt, Homo sapiens
cgacacugaagaaucaaga

SEQ ID NO: 524427 - RNA, 19 nt, Homo sapiens
aacuagagccugugcuaaa

SEQ ID NO: 524428 - RNA, 19 nt, Homo sapiens
ccaccauggcugugaaguu

SEQ ID NO: 524429 - RNA, 19 nt, Homo sapiens
acccacacauguuuacaga

SEQ ID NO: 524430 - RNA, 19 nt, Homo sapiens
gacacagacccacacaugu

SEQ ID NO: 524431 - RNA, 19 nt, Homo sapiens
ccacaaagaagaaguuuaa

SEQ ID NO: 524432 - RNA, 19 nt, Homo sapiens
gugaagacccgguauauga

SEQ ID NO: 524433 - RNA, 19 nt, Homo sapiens
ggaaugcuaucgucaacug

SEQ ID NO: 524434 - RNA, 19 nt, Homo sapiens
gcagagccuuccaggacua

SEQ ID NO: 524435 - RNA, 19 nt, Homo sapiens
guaaaugccacaaagaaga

SEQ ID NO: 524436 - RNA, 19 nt, Homo sapiens
aggagaagcugcuggacua

SEQ ID NO: 524437 - RNA, 19 nt, Homo sapiens
gaacuuugcccaacaucau

SEQ ID NO: 524438 - RNA, 19 nt, Homo sapiens
agacaacagugaaugacaa

SEQ ID NO: 524439 - RNA, 19 nt, Homo sapiens
ggacuaugguuggacugaa

SEQ ID NO: 524440 - RNA, 19 nt, Homo sapiens
caccauggcugugaaguuc

SEQ ID NO: 524441 - RNA, 19 nt, Homo sapiens
caacagugaaugacaagga

SEQ ID NO: 524442 - RNA, 19 nt, Homo sapiens
uaaaugccacaaagaagaa

SEQ ID NO: 524443 - RNA, 19 nt, Homo sapiens
gaggaaugcuaucgucaac

SEQ ID NO: 524444 - RNA, 19 nt, Homo sapiens
gauguaaaugccacaaaga

SEQ ID NO: 524445 - RNA, 19 nt, Homo sapiens
gaacaggggcuucuuucuu

SEQ ID NO: 524446 - RNA, 19 nt, Homo sapiens
gauguagcggugaagagua

SEQ ID NO: 524447 - RNA, 19 nt, Homo sapiens
gaccuccucucggcccuaa

SEQ ID NO: 524448 - RNA, 19 nt, Homo sapiens
ugaagacccgguauaugaa

SEQ ID NO: 524449 - RNA, 19 nt, Homo sapiens
caacuuccccugccacuuu

SEQ ID NO: 524450 - RNA, 19 nt, Homo sapiens
ggacaacuccagccucacu

SEQ ID NO: 524451 - RNA, 19 nt, Homo sapiens
uugcugaccucguuaccuu

SEQ ID NO: 524452 - RNA, 19 nt, Homo sapiens
ccacuuugucucugccuuu

SEQ ID NO: 524453 - RNA, 19 nt, Homo sapiens
gaaaauacagcgggacuau

SEQ ID NO: 524454 - RNA, 19 nt, Homo sapiens
agauguaaaugccacaaag

SEQ ID NO: 524455 - RNA, 19 nt, Homo sapiens
gacuaugguuggacugaag

SEQ ID NO: 524456 - RNA, 19 nt, Homo sapiens
aaauacagcgggacuaugg

SEQ ID NO: 524457 - RNA, 19 nt, Homo sapiens
cagccucacuacccggauu

SEQ ID NO: 524458 - RNA, 19 nt, Homo sapiens
ggauguagcggugaagagu

SEQ ID NO: 524459 - RNA, 19 nt, Homo sapiens
aacaggggcuucuuucuuu

SEQ ID NO: 524460 - RNA, 19 nt, Homo sapiens
ggaacuuugcccaacauca

SEQ ID NO: 524461 - RNA, 19 nt, Homo sapiens
gacuauggacgccuacaga

SEQ ID NO: 524462 - RNA, 19 nt, Homo sapiens
gccacaaagaagaaguuua

SEQ ID NO: 524463 - RNA, 19 nt, Homo sapiens
ccugcucacugacaacuuc

SEQ ID NO: 524464 - RNA, 19 nt, Homo sapiens
ggugaagacccgguauaug

SEQ ID NO: 524465 - RNA, 19 nt, Homo sapiens
ccaccauggcugugaaguu

SEQ ID NO: 524466 - RNA, 19 nt, Homo sapiens
ucgacuguaugauaaagau

SEQ ID NO: 524467 - RNA, 19 nt, Homo sapiens
gaagacccgguauaugaac

SEQ ID NO: 524468 - RNA, 19 nt, Homo sapiens
gcggugaagaguacagaug

SEQ ID NO: 524469 - RNA, 19 nt, Homo sapiens
gguggugaccuacgacauc

SEQ ID NO: 524470 - RNA, 19 nt, Homo sapiens
ugaccauggugcggacuga

SEQ ID NO: 524471 - RNA, 19 nt, Homo sapiens
gggucaaccugggauguag

SEQ ID NO: 524472 - RNA, 19 nt, Homo sapiens
guggugaagacccgguaua

SEQ ID NO: 524473 - RNA, 19 nt, Homo sapiens
ugaggaaugcuaucgucaa

SEQ ID NO: 524474 - RNA, 19 nt, Homo sapiens
ugcccaacaucaugaggaa

SEQ ID NO: 524475 - RNA, 19 nt, Homo sapiens
cauccaggagcgacagaaa

SEQ ID NO: 524476 - RNA, 19 nt, Homo sapiens
gugcccagcccacagaugu

SEQ ID NO: 524477 - RNA, 19 nt, Homo sapiens
gacaacuccagccucacua

SEQ ID NO: 524478 - RNA, 19 nt, Homo sapiens
gcaauagacuggauggaaa

SEQ ID NO: 524479 - RNA, 19 nt, Homo sapiens
ggaagaaagcccuaaguga

SEQ ID NO: 524480 - RNA, 19 nt, Homo sapiens
gagaaaggagggaagauaa

SEQ ID NO: 524481 - RNA, 19 nt, Homo sapiens
gaaaggagggaagauaauu

SEQ ID NO: 524482 - RNA, 19 nt, Homo sapiens
ggagaaaggagggaagaua

SEQ ID NO: 524483 - RNA, 19 nt, Homo sapiens
aaucaagccuggagauauu

SEQ ID NO: 524484 - RNA, 19 nt, Homo sapiens
caaagaacccgaaagacaa

SEQ ID NO: 524485 - RNA, 19 nt, Homo sapiens
caacucagccgacuuaaca

SEQ ID NO: 524486 - RNA, 19 nt, Homo sapiens
gaccaacucagccgacuua

SEQ ID NO: 524487 - RNA, 19 nt, Homo sapiens
aaagacaaguccagcauga

SEQ ID NO: 524488 - RNA, 19 nt, Homo sapiens
gccaucaacuauaaugaaa

SEQ ID NO: 524489 - RNA, 19 nt, Homo sapiens
ggucagauguggagaaagg

SEQ ID NO: 524490 - RNA, 19 nt, Homo sapiens
cuacaaagaacccgaaaga

SEQ ID NO: 524491 - RNA, 19 nt, Homo sapiens
ggacagucauugcguaaaa

SEQ ID NO: 524492 - RNA, 19 nt, Homo sapiens
uguucaaacugaccaauaa

SEQ ID NO: 524493 - RNA, 19 nt, Homo sapiens
aaaggagggaagauaauua

SEQ ID NO: 524494 - RNA, 19 nt, Homo sapiens
gguaagauaacuuucauca

SEQ ID NO: 524495 - RNA, 19 nt, Homo sapiens
acaaagaacccgaaagaca

SEQ ID NO: 524496 - RNA, 19 nt, Homo sapiens
acaugaacguggacuuuga

SEQ ID NO: 524497 - RNA, 19 nt, Homo sapiens
gaggacuguuggcugauug

SEQ ID NO: 524498 - RNA, 19 nt, Homo sapiens
gaacguggacuuugaugcu

SEQ ID NO: 524499 - RNA, 19 nt, Homo sapiens
acuguuggcugauuggaaa

SEQ ID NO: 524500 - RNA, 19 nt, Homo sapiens
gggaagaaagcccuaagug

SEQ ID NO: 524501 - RNA, 19 nt, Homo sapiens
caaacugaccaauaagaau

SEQ ID NO: 524502 - RNA, 19 nt, Homo sapiens
ucaaacugaccaauaagaa

SEQ ID NO: 524503 - RNA, 19 nt, Homo sapiens
cgacuuaacauuaccuauc

SEQ ID NO: 524504 - RNA, 19 nt, Homo sapiens
ccaaucaagccuggagaua

SEQ ID NO: 524505 - RNA, 19 nt, Homo sapiens
ugacaugaacguggacuuu

SEQ ID NO: 524506 - RNA, 19 nt, Homo sapiens
caggucagauguggagaaa

SEQ ID NO: 524507 - RNA, 19 nt, Homo sapiens
caaucaagccuggagauau

SEQ ID NO: 524508 - RNA, 19 nt, Homo sapiens
gaggcagauucgucgcuuu

SEQ ID NO: 524509 - RNA, 19 nt, Homo sapiens
ggcaauagacuggauggaa

SEQ ID NO: 524510 - RNA, 19 nt, Homo sapiens
gcagaacuuacucuuggaa

SEQ ID NO: 524511 - RNA, 19 nt, Homo sapiens
ggagggaagauaauuaugc

SEQ ID NO: 524512 - RNA, 19 nt, Homo sapiens
aaacgcacuuaggaacuuu

SEQ ID NO: 524513 - RNA, 19 nt, Homo sapiens
ccaaagccguauuagaaaa

SEQ ID NO: 524514 - RNA, 19 nt, Homo sapiens
cacacuggaugaugcagaa

SEQ ID NO: 524515 - RNA, 19 nt, Homo sapiens
cccaugcuguucaaacuga

SEQ ID NO: 524516 - RNA, 19 nt, Homo sapiens
gcagauucgucgcuuucuc

SEQ ID NO: 524517 - RNA, 19 nt, Homo sapiens
caaggcaguguccaucauu

SEQ ID NO: 524518 - RNA, 19 nt, Homo sapiens
gaugcagaacuuacucuug

SEQ ID NO: 524519 - RNA, 19 nt, Homo sapiens
ugaggacuguuggcugauu

SEQ ID NO: 524520 - RNA, 19 nt, Homo sapiens
caugaggagucgacagaag

SEQ ID NO: 524521 - RNA, 19 nt, Homo sapiens
caggugguguccaucaugu

SEQ ID NO: 524522 - RNA, 19 nt, Homo sapiens
ggagaaggacagucauugc

SEQ ID NO: 524523 - RNA, 19 nt, Homo sapiens
uagacuggauggaaagaag

SEQ ID NO: 524524 - RNA, 19 nt, Homo sapiens
gacaugaacguggacuuug

SEQ ID NO: 524525 - RNA, 19 nt, Homo sapiens
cccaaagccguauuagaaa

SEQ ID NO: 524526 - RNA, 19 nt, Homo sapiens
gacuuaacauuaccuaucc

SEQ ID NO: 524527 - RNA, 19 nt, Homo sapiens
cgaaagacaaguccagcau

SEQ ID NO: 524528 - RNA, 19 nt, Homo sapiens
ggacaucaccaaccccaaa

SEQ ID NO: 524529 - RNA, 19 nt, Homo sapiens
uguccaucauguucucuuu

SEQ ID NO: 524530 - RNA, 19 nt, Homo sapiens
cauguucgaccacccuauu

SEQ ID NO: 524531 - RNA, 19 nt, Homo sapiens
ggagucgacagaaggugaa

SEQ ID NO: 524532 - RNA, 19 nt, Homo sapiens
caucauugagugugacaug

SEQ ID NO: 524533 - RNA, 19 nt, Homo sapiens
uuaccuaucccaugcuguu

SEQ ID NO: 524534 - RNA, 19 nt, Homo sapiens
uccaucauguucucuuuca

SEQ ID NO: 524535 - RNA, 19 nt, Homo sapiens
acaaggcaguguccaucau

SEQ ID NO: 524536 - RNA, 19 nt, Homo sapiens
ggccaccuacuccaaauuc

SEQ ID NO: 524537 - RNA, 19 nt, Homo sapiens
aaggagggaagauaauuau

SEQ ID NO: 524538 - RNA, 19 nt, Homo sapiens
agaaaggagggaagauaau

SEQ ID NO: 524539 - RNA, 19 nt, Homo sapiens
ggugguguccaucauguuc

SEQ ID NO: 524540 - RNA, 19 nt, Homo sapiens
gcaguguccaucauugagu

SEQ ID NO: 524541 - RNA, 19 nt, Homo sapiens
ccccaaagccguauuagaa

SEQ ID NO: 524542 - RNA, 19 nt, Homo sapiens
ucagccgacuuaacauuac

SEQ ID NO: 524543 - RNA, 19 nt, Homo sapiens
cucagccgacuuaacauua

SEQ ID NO: 524544 - RNA, 19 nt, Homo sapiens
gaaauucacguccccuugu

SEQ ID NO: 524545 - RNA, 19 nt, Homo sapiens
aaggcaguguccaucauug

SEQ ID NO: 524546 - RNA, 19 nt, Homo sapiens
uuaggaacuuugccugucu

SEQ ID NO: 524547 - RNA, 19 nt, Homo sapiens
ucaagccuggagauauuaa

SEQ ID NO: 524548 - RNA, 19 nt, Homo sapiens
caauagacuggauggaaag

SEQ ID NO: 524549 - RNA, 19 nt, Homo sapiens
uaccgcugcuucucugugu

SEQ ID NO: 524550 - RNA, 19 nt, Homo sapiens
gcccugacuuccuggacau

SEQ ID NO: 524551 - RNA, 19 nt, Homo sapiens
ccuaucccaugcuguucaa

SEQ ID NO: 524552 - RNA, 19 nt, Homo sapiens
cucuggaucuggcaauaga

SEQ ID NO: 524553 - RNA, 19 nt, Homo sapiens
uguccaucauugaguguga

SEQ ID NO: 524554 - RNA, 19 nt, Homo sapiens
ggaccaacucagccgacuu

SEQ ID NO: 524555 - RNA, 19 nt, Homo sapiens
ugacuaagcucucucauga

SEQ ID NO: 524556 - RNA, 19 nt, Homo sapiens
agaauaaccuccaguaugu

SEQ ID NO: 524557 - RNA, 19 nt, Homo sapiens
caaguacgcugacaauauc

SEQ ID NO: 524558 - RNA, 19 nt, Homo sapiens
caaacucugaucaguauua

SEQ ID NO: 524559 - RNA, 19 nt, Homo sapiens
ccacguggacccauuauuu

SEQ ID NO: 524560 - RNA, 19 nt, Homo sapiens
gcaggugucuacuuugaga

SEQ ID NO: 524561 - RNA, 19 nt, Homo sapiens
caaaguugcucaccaaggu

SEQ ID NO: 524562 - RNA, 19 nt, Homo sapiens
ggaccaaacucugaucagu

SEQ ID NO: 524563 - RNA, 19 nt, Homo sapiens
gcagugcccucucucaucu

SEQ ID NO: 524564 - RNA, 19 nt, Homo sapiens
gaccaaacucugaucagua

SEQ ID NO: 524565 - RNA, 19 nt, Homo sapiens
ucaaguacgcugacaauau

SEQ ID NO: 524566 - RNA, 19 nt, Homo sapiens
cagaauaaccuccaguaug

SEQ ID NO: 524567 - RNA, 19 nt, Homo sapiens
caacaugacuaagcucucu

SEQ ID NO: 524568 - RNA, 19 nt, Homo sapiens
cuucgcaggugucuacuuu

SEQ ID NO: 524569 - RNA, 19 nt, Homo sapiens
ugacauaccagcugaagau

SEQ ID NO: 524570 - RNA, 19 nt, Homo sapiens
ccaccucccuguccauugu

SEQ ID NO: 524571 - RNA, 19 nt, Homo sapiens
ucgcaggugucuacuuuga

SEQ ID NO: 524572 - RNA, 19 nt, Homo sapiens
gcagaauaaccuccaguau

SEQ ID NO: 524573 - RNA, 19 nt, Homo sapiens
ugaagcaccugguucucuu

SEQ ID NO: 524574 - RNA, 19 nt, Homo sapiens
gcgcuggacucgucauugg

SEQ ID NO: 524575 - RNA, 19 nt, Homo sapiens
uggcugugguugucaagua

SEQ ID NO: 524576 - RNA, 19 nt, Homo sapiens
ccacuuuccaggugacaua

SEQ ID NO: 524577 - RNA, 19 nt, Homo sapiens
accaaacucugaucaguau

SEQ ID NO: 524578 - RNA, 19 nt, Homo sapiens
ccauugugcuguccacugu

SEQ ID NO: 524579 - RNA, 19 nt, Homo sapiens
ucuacaccuugcagaauaa

SEQ ID NO: 524580 - RNA, 19 nt, Homo sapiens
ccugccagcuccacacuau

SEQ ID NO: 524581 - RNA, 19 nt, Homo sapiens
guuccuagccgcugggauu

SEQ ID NO: 524582 - RNA, 19 nt, Homo sapiens
ccuaccagcugccacuuuc

SEQ ID NO: 524583 - RNA, 19 nt, Homo sapiens
gaagagggguaacgugaag

SEQ ID NO: 524584 - RNA, 19 nt, Homo sapiens
gcuccacacuaucucuuag

SEQ ID NO: 524585 - RNA, 19 nt, Homo sapiens
gcaaauaaaauguguugug

SEQ ID NO: 524586 - RNA, 19 nt, Homo sapiens
ugccaaaguugcucaccaa

SEQ ID NO: 524587 - RNA, 19 nt, Homo sapiens
ccagaaugccucccucauc

SEQ ID NO: 524588 - RNA, 19 nt, Homo sapiens
gaauaaccuccaguauguu

SEQ ID NO: 524589 - RNA, 19 nt, Homo sapiens
gggccaacaugacuaagcu

SEQ ID NO: 524590 - RNA, 19 nt, Homo sapiens
ccagggccaacaugacuaa

SEQ ID NO: 524591 - RNA, 19 nt, Homo sapiens
cgucauuggugcugucuac

SEQ ID NO: 524592 - RNA, 19 nt, Homo sapiens
uaacgugaagcaccugguu

SEQ ID NO: 524593 - RNA, 19 nt, Homo sapiens
aaacucugaucaguauuag

SEQ ID NO: 524594 - RNA, 19 nt, Homo sapiens
gaagugcucaaaggucuca

SEQ ID NO: 524595 - RNA, 19 nt, Homo sapiens
aggcuguccuggugcagua

SEQ ID NO: 524596 - RNA, 19 nt, Homo sapiens
ccuagccgcugggauugaa

SEQ ID NO: 524597 - RNA, 19 nt, Homo sapiens
aucuacaccuugcagaaua

SEQ ID NO: 524598 - RNA, 19 nt, Homo sapiens
ccacccagggccaacauga

SEQ ID NO: 524599 - RNA, 19 nt, Homo sapiens
ccgcugggauugaagacau

SEQ ID NO: 524600 - RNA, 19 nt, Homo sapiens
cacguggacccauuauuug

SEQ ID NO: 524601 - RNA, 19 nt, Homo sapiens
aauaaccuccaguauguug

SEQ ID NO: 524602 - RNA, 19 nt, Homo sapiens
uggcggaagugcucaaagg

SEQ ID NO: 524603 - RNA, 19 nt, Homo sapiens
ggugucuacuuugagaaga

SEQ ID NO: 524604 - RNA, 19 nt, Homo sapiens
cacggccacuggaucagaa

SEQ ID NO: 524605 - RNA, 19 nt, Homo sapiens
ccaguauguugccaucucu

SEQ ID NO: 524606 - RNA, 19 nt, Homo sapiens
cauaccagcugaagauccu

SEQ ID NO: 524607 - RNA, 19 nt, Homo sapiens
caucuacaccuugcagaau

SEQ ID NO: 524608 - RNA, 19 nt, Homo sapiens
ucuccgugcucaugcugaa

SEQ ID NO: 524609 - RNA, 19 nt, Homo sapiens
gcccaaagcucacugugua

SEQ ID NO: 524610 - RNA, 19 nt, Homo sapiens
aaagcucacuguguaauua

SEQ ID NO: 524611 - RNA, 19 nt, Homo sapiens
ggacacacccuccaguuau

SEQ ID NO: 524612 - RNA, 19 nt, Homo sapiens
gccuugcucucuucaauaa

SEQ ID NO: 524613 - RNA, 19 nt, Homo sapiens
ccagagaaagcaucauuaa

SEQ ID NO: 524614 - RNA, 19 nt, Homo sapiens
gagaaagcaucauuaagcu

SEQ ID NO: 524615 - RNA, 19 nt, Homo sapiens
gacacacccuccaguuaug

SEQ ID NO: 524616 - RNA, 19 nt, Homo sapiens
ucauuaagcucauggaaaa

SEQ ID NO: 524617 - RNA, 19 nt, Homo sapiens
gcauuuagaagcugaagau

SEQ ID NO: 524618 - RNA, 19 nt, Homo sapiens
caauaaaccacaagcaucu

SEQ ID NO: 524619 - RNA, 19 nt, Homo sapiens
caaagcucacuguguaauu

SEQ ID NO: 524620 - RNA, 19 nt, Homo sapiens
uuaugaggcugccauggaa

SEQ ID NO: 524621 - RNA, 19 nt, Homo sapiens
cagccuugcucucuucaau

SEQ ID NO: 524622 - RNA, 19 nt, Homo sapiens
gcagagacggaaccagaga

SEQ ID NO: 524623 - RNA, 19 nt, Homo sapiens
gcccagagaaagcaucauu

SEQ ID NO: 524624 - RNA, 19 nt, Homo sapiens
ccaccagccuugcucucuu

SEQ ID NO: 524625 - RNA, 19 nt, Homo sapiens
agagaaagcaucauuaagc

SEQ ID NO: 524626 - RNA, 19 nt, Homo sapiens
guuaugaggcugccaugga

SEQ ID NO: 524627 - RNA, 19 nt, Homo sapiens
caccagccuugcucucuuc

SEQ ID NO: 524628 - RNA, 19 nt, Homo sapiens
aaaccacaagcaucucaaa

SEQ ID NO: 524629 - RNA, 19 nt, Homo sapiens
gagaucugcccgagcuuuc

SEQ ID NO: 524630 - RNA, 19 nt, Homo sapiens
cccagagaaagcaucauua

SEQ ID NO: 524631 - RNA, 19 nt, Homo sapiens
ccaaagcucacuguguaau

SEQ ID NO: 524632 - RNA, 19 nt, Homo sapiens
ucucuucaauaaaccacaa

SEQ ID NO: 524633 - RNA, 19 nt, Homo sapiens
caucauuaagcucauggaa

SEQ ID NO: 524634 - RNA, 19 nt, Homo sapiens
cagagaaagcaucauuaag

SEQ ID NO: 524635 - RNA, 19 nt, Homo sapiens
gaggcugccauggaacuuu

SEQ ID NO: 524636 - RNA, 19 nt, Homo sapiens
cagcccugaucaagacaug

SEQ ID NO: 524637 - RNA, 19 nt, Homo sapiens
gauaugaaguugcaaagua

SEQ ID NO: 524638 - RNA, 19 nt, Homo sapiens
gaacuucacauccaagaua

SEQ ID NO: 524639 - RNA, 19 nt, Homo sapiens
gcgaauccaugacaauaua

SEQ ID NO: 524640 - RNA, 19 nt, Homo sapiens
caauguaacugguuucaaa

SEQ ID NO: 524641 - RNA, 19 nt, Homo sapiens
ggaccaaacuacgaauuaa

SEQ ID NO: 524642 - RNA, 19 nt, Homo sapiens
gauuacaccucaacaagaa

SEQ ID NO: 524643 - RNA, 19 nt, Homo sapiens
gaugcuagauuguuuauag

SEQ ID NO: 524644 - RNA, 19 nt, Homo sapiens
ggaaugucuuguuuaauga

SEQ ID NO: 524645 - RNA, 19 nt, Homo sapiens
gggcuuugcugccaccuua

SEQ ID NO: 524646 - RNA, 19 nt, Homo sapiens
gaucuuauauggauuugug

SEQ ID NO: 524647 - RNA, 19 nt, Homo sapiens
gauccuaacuuaaucaaca

SEQ ID NO: 524648 - RNA, 19 nt, Homo sapiens
gaaaagauguguuggauca

SEQ ID NO: 524649 - RNA, 19 nt, Homo sapiens
ucaacaaccuggaaacauu

SEQ ID NO: 524650 - RNA, 19 nt, Homo sapiens
ggaaauccuagauguauaa

SEQ ID NO: 524651 - RNA, 19 nt, Homo sapiens
gaugggauauuaugguauu

SEQ ID NO: 524652 - RNA, 19 nt, Homo sapiens
gaacuggucgcuacagauu

SEQ ID NO: 524653 - RNA, 19 nt, Homo sapiens
caggaggacuuauagcuuu

SEQ ID NO: 524654 - RNA, 19 nt, Homo sapiens
acaggaaugucuuguuuaa

SEQ ID NO: 524655 - RNA, 19 nt, Homo sapiens
gcaaaacucuggcucauau

SEQ ID NO: 524656 - RNA, 19 nt, Homo sapiens
gauaguggaauaagaguaa

SEQ ID NO: 524657 - RNA, 19 nt, Homo sapiens
gaaggcaacugacaaacag

SEQ ID NO: 524658 - RNA, 19 nt, Homo sapiens
ccaggugucucucuucuga

SEQ ID NO: 524659 - RNA, 19 nt, Homo sapiens
cagaugggauauuauggua

SEQ ID NO: 524660 - RNA, 19 nt, Homo sapiens
cuauaucucugccaaugua

SEQ ID NO: 524661 - RNA, 19 nt, Homo sapiens
aggaaugucuuguuuaaug

SEQ ID NO: 524662 - RNA, 19 nt, Homo sapiens
uuacugacauggugaauca

SEQ ID NO: 524663 - RNA, 19 nt, Homo sapiens
gcauggcacuugcaucugu

SEQ ID NO: 524664 - RNA, 19 nt, Homo sapiens
caacugacaaacagccuua

SEQ ID NO: 524665 - RNA, 19 nt, Homo sapiens
gauuugugauaguggaaua

SEQ ID NO: 524666 - RNA, 19 nt, Homo sapiens
caagaaggcaacugacaaa

SEQ ID NO: 524667 - RNA, 19 nt, Homo sapiens
uggcaugguuuauauuuga

SEQ ID NO: 524668 - RNA, 19 nt, Homo sapiens
guguucagaugggauauua

SEQ ID NO: 524669 - RNA, 19 nt, Homo sapiens
ccuuagagcagguauauuu

SEQ ID NO: 524670 - RNA, 19 nt, Homo sapiens
gagaacuggucgcuacaga

SEQ ID NO: 524671 - RNA, 19 nt, Homo sapiens
uaacugguuucaaaugugu

SEQ ID NO: 524672 - RNA, 19 nt, Homo sapiens
ucaaaugugugacaggaau

SEQ ID NO: 524673 - RNA, 19 nt, Homo sapiens
gaagugcuccuuuguguac

SEQ ID NO: 524674 - RNA, 19 nt, Homo sapiens
gaucaagcaggaggacuua

SEQ ID NO: 524675 - RNA, 19 nt, Homo sapiens
cagauacgcuuacugacau

SEQ ID NO: 524676 - RNA, 19 nt, Homo sapiens
acaaacagccuuauagcaa

SEQ ID NO: 524677 - RNA, 19 nt, Homo sapiens
acuauaagcuggagaacug

SEQ ID NO: 524678 - RNA, 19 nt, Homo sapiens
gcaauguccacucaaguug

SEQ ID NO: 524679 - RNA, 19 nt, Homo sapiens
guacauugccgaagauuac

SEQ ID NO: 524680 - RNA, 19 nt, Homo sapiens
ucaagcaggaggacuuaua

SEQ ID NO: 524681 - RNA, 19 nt, Homo sapiens
guaacugguuucaaaugug

SEQ ID NO: 524682 - RNA, 19 nt, Homo sapiens
aauaugaagugcuccuuug

SEQ ID NO: 524683 - RNA, 19 nt, Homo sapiens
caguuucaauccagaauga

SEQ ID NO: 524684 - RNA, 19 nt, Homo sapiens
ugaccgagguuggagguuu

SEQ ID NO: 524685 - RNA, 19 nt, Homo sapiens
ucacauccaagauacuaua

SEQ ID NO: 524686 - RNA, 19 nt, Homo sapiens
uaucaucuacacccgauua

SEQ ID NO: 524687 - RNA, 19 nt, Homo sapiens
aaaguuggcauuaauccua

SEQ ID NO: 524688 - RNA, 19 nt, Homo sapiens
caugcuuccugcuacaaua

SEQ ID NO: 524689 - RNA, 19 nt, Homo sapiens
guaauuccagauacgcuua

SEQ ID NO: 524690 - RNA, 19 nt, Homo sapiens
gguagauccuaacuuaauc

SEQ ID NO: 524691 - RNA, 19 nt, Homo sapiens
guugccaguuuaauuauug

SEQ ID NO: 524692 - RNA, 19 nt, Homo sapiens
gcaggaggacuuauagcuu

SEQ ID NO: 524693 - RNA, 19 nt, Homo sapiens
aaauguugaugcuagauug

SEQ ID NO: 524694 - RNA, 19 nt, Homo sapiens
ggguagauccuaacuuaau

SEQ ID NO: 524695 - RNA, 19 nt, Homo sapiens
gaccgagguuggagguuug

SEQ ID NO: 524696 - RNA, 19 nt, Homo sapiens
ugccgaagauuacuuuaug

SEQ ID NO: 524697 - RNA, 19 nt, Homo sapiens
uaacaugcuuccugcuaca

SEQ ID NO: 524698 - RNA, 19 nt, Homo sapiens
uaagaguaauuccagauac

SEQ ID NO: 524699 - RNA, 19 nt, Homo sapiens
caaccuggaaacauucuuu

SEQ ID NO: 524700 - RNA, 19 nt, Homo sapiens
gguuggagguuugcaaugu

SEQ ID NO: 524701 - RNA, 19 nt, Homo sapiens
guugcaaaguaugaucuua

SEQ ID NO: 524702 - RNA, 19 nt, Homo sapiens
gcuuugugacuguauauaa

SEQ ID NO: 524703 - RNA, 19 nt, Homo sapiens
gaucagguggaccaaacua

SEQ ID NO: 524704 - RNA, 19 nt, Homo sapiens
gcucauauucaauuucuca

SEQ ID NO: 524705 - RNA, 19 nt, Homo sapiens
ucaacaagaaggcaacuga

SEQ ID NO: 524706 - RNA, 19 nt, Homo sapiens
gagaaaagauguguuggau

SEQ ID NO: 524707 - RNA, 19 nt, Homo sapiens
ccauugauguauguaagaa

SEQ ID NO: 524708 - RNA, 19 nt, Homo sapiens
ccagauacgcuuacugaca

SEQ ID NO: 524709 - RNA, 19 nt, Homo sapiens
caaauguugaugcuagauu

SEQ ID NO: 524710 - RNA, 19 nt, Homo sapiens
caacaaccuggaaacauuc

SEQ ID NO: 524711 - RNA, 19 nt, Homo sapiens
guucagaugggauauuaug

SEQ ID NO: 524712 - RNA, 19 nt, Homo sapiens
uggaccaaacuacgaauua

SEQ ID NO: 524713 - RNA, 19 nt, Homo sapiens
uguaacugguuucaaaugu

SEQ ID NO: 524714 - RNA, 19 nt, Homo sapiens
gugaaucaaaugacagaaa

SEQ ID NO: 524715 - RNA, 19 nt, Homo sapiens
gccaggauaugaaguugca

SEQ ID NO: 524716 - RNA, 19 nt, Homo sapiens
gcacuugcaucugugaaaa

SEQ ID NO: 524717 - RNA, 19 nt, Homo sapiens
ugaaagggguagauccuaa

SEQ ID NO: 524718 - RNA, 19 nt, Homo sapiens
ugcuguggcugaugcauuu

SEQ ID NO: 524719 - RNA, 19 nt, Homo sapiens
gagcagguauauuuuggaa

SEQ ID NO: 524720 - RNA, 19 nt, Homo sapiens
cauggugaaucaaaugaca

SEQ ID NO: 524721 - RNA, 19 nt, Homo sapiens
gccaauuucagaaugcuuu

SEQ ID NO: 524722 - RNA, 19 nt, Homo sapiens
gugagccaauuucagaaug

SEQ ID NO: 524723 - RNA, 19 nt, Homo sapiens
caaacuacgaauuaacaug

SEQ ID NO: 524724 - RNA, 19 nt, Homo sapiens
ggaucaagcaggaggacuu

SEQ ID NO: 524725 - RNA, 19 nt, Homo sapiens
gacaaacagccuuauagca

SEQ ID NO: 524726 - RNA, 19 nt, Homo sapiens
gguuugcaauguccacuca

SEQ ID NO: 524727 - RNA, 19 nt, Homo sapiens
cgauuacaccucaacaaga

SEQ ID NO: 524728 - RNA, 19 nt, Homo sapiens
uuucauggcuaucaucuac

SEQ ID NO: 524729 - RNA, 19 nt, Homo sapiens
gaugauccagccauugaug

SEQ ID NO: 524730 - RNA, 19 nt, Homo sapiens
ccgcgaauccaugacaaua

SEQ ID NO: 524731 - RNA, 19 nt, Homo sapiens
aaagauguguuggaucaag

SEQ ID NO: 524732 - RNA, 19 nt, Homo sapiens
agggguagauccuaacuua

SEQ ID NO: 524733 - RNA, 19 nt, Homo sapiens
gacauggugaaucaaauga

SEQ ID NO: 524734 - RNA, 19 nt, Homo sapiens
uguugaugcuagauuguuu

SEQ ID NO: 524735 - RNA, 19 nt, Homo sapiens
gugacuguauauaaaggaa

SEQ ID NO: 524736 - RNA, 19 nt, Homo sapiens
ccaacuauaagcuggagaa

SEQ ID NO: 524737 - RNA, 19 nt, Homo sapiens
gaucauagauagucuguuu

SEQ ID NO: 524738 - RNA, 19 nt, Homo sapiens
gcaaauaucuaucugcuau

SEQ ID NO: 524739 - RNA, 19 nt, Homo sapiens
cagcagaucugaaguauau

SEQ ID NO: 524740 - RNA, 19 nt, Homo sapiens
gaaaguauccgucgcauau

SEQ ID NO: 524741 - RNA, 19 nt, Homo sapiens
gcucauauguguccugaaa

SEQ ID NO: 524742 - RNA, 19 nt, Homo sapiens
gagaagagggagacaaaua

SEQ ID NO: 524743 - RNA, 19 nt, Homo sapiens
gugcacaucuacauauaua

SEQ ID NO: 524744 - RNA, 19 nt, Homo sapiens
gaagagggagacaaauaua

SEQ ID NO: 524745 - RNA, 19 nt, Homo sapiens
guaaaugaaccaaguguuu

SEQ ID NO: 524746 - RNA, 19 nt, Homo sapiens
ggagacaaauauaaagaug

SEQ ID NO: 524747 - RNA, 19 nt, Homo sapiens
ggaaaccaauauaaucuca

SEQ ID NO: 524748 - RNA, 19 nt, Homo sapiens
ggacacuggugauacaaga

SEQ ID NO: 524749 - RNA, 19 nt, Homo sapiens
gaauuugguuuaucucugu

SEQ ID NO: 524750 - RNA, 19 nt, Homo sapiens
agaaguagcucguuauugg

SEQ ID NO: 524751 - RNA, 19 nt, Homo sapiens
ggaauggaccagagaauug

SEQ ID NO: 524752 - RNA, 19 nt, Homo sapiens
gaaaagauccucaccacua

SEQ ID NO: 524753 - RNA, 19 nt, Homo sapiens
ggacauguuuaaggaauug

SEQ ID NO: 524754 - RNA, 19 nt, Homo sapiens
caaguuacauauagcauca

SEQ ID NO: 524755 - RNA, 19 nt, Homo sapiens
aacaggagcugauguagaa

SEQ ID NO: 524756 - RNA, 19 nt, Homo sapiens
aaacagccuuuacauguau

SEQ ID NO: 524757 - RNA, 19 nt, Homo sapiens
gaaggugcacaucuacaua

SEQ ID NO: 524758 - RNA, 19 nt, Homo sapiens
caacagcgauuggaaugga

SEQ ID NO: 524759 - RNA, 19 nt, Homo sapiens
caaagagaauuccauaugc

SEQ ID NO: 524760 - RNA, 19 nt, Homo sapiens
gaucugaaguauauugaag

SEQ ID NO: 524761 - RNA, 19 nt, Homo sapiens
gaaagauaaucauguuggu

SEQ ID NO: 524762 - RNA, 19 nt, Homo sapiens
ggugaaauuccgaaguuua

SEQ ID NO: 524763 - RNA, 19 nt, Homo sapiens
cagagaauaagcagcauua

SEQ ID NO: 524764 - RNA, 19 nt, Homo sapiens
agaagcugaucuuguauuu

SEQ ID NO: 524765 - RNA, 19 nt, Homo sapiens
guccauaggccacacuuua

SEQ ID NO: 524766 - RNA, 19 nt, Homo sapiens
cuccuacacuuccuauuua

SEQ ID NO: 524767 - RNA, 19 nt, Homo sapiens
ggacccacauguaguguca

SEQ ID NO: 524768 - RNA, 19 nt, Homo sapiens
ucaaagagaauuccauaug

SEQ ID NO: 524769 - RNA, 19 nt, Homo sapiens
cuucagagcuuuccaaacu

SEQ ID NO: 524770 - RNA, 19 nt, Homo sapiens
gucaaugaaucaagaauca

SEQ ID NO: 524771 - RNA, 19 nt, Homo sapiens
gagccaggauggucucaau

SEQ ID NO: 524772 - RNA, 19 nt, Homo sapiens
aaacucaaauggguacaaa

SEQ ID NO: 524773 - RNA, 19 nt, Homo sapiens
uuacauguauggucugguu

SEQ ID NO: 524774 - RNA, 19 nt, Homo sapiens
gguacaaucauguuugaaa

SEQ ID NO: 524775 - RNA, 19 nt, Homo sapiens
gcagaucugaaguauauug

SEQ ID NO: 524776 - RNA, 19 nt, Homo sapiens
uauugaagcuugugcuaga

SEQ ID NO: 524777 - RNA, 19 nt, Homo sapiens
gaagcugaucuuguauuua

SEQ ID NO: 524778 - RNA, 19 nt, Homo sapiens
guuauugguuuguuuguca

SEQ ID NO: 524779 - RNA, 19 nt, Homo sapiens
ugucauugcucauaugugu

SEQ ID NO: 524780 - RNA, 19 nt, Homo sapiens
ccagagaauuggaaacaag

SEQ ID NO: 524781 - RNA, 19 nt, Homo sapiens
aaacccaacuugaauuuac

SEQ ID NO: 524782 - RNA, 19 nt, Homo sapiens
gaaauugcuaugcuaaaca

SEQ ID NO: 524783 - RNA, 19 nt, Homo sapiens
ccaugaaauugcuaugcua

SEQ ID NO: 524784 - RNA, 19 nt, Homo sapiens
ccaaagugcugggauuaca

SEQ ID NO: 524785 - RNA, 19 nt, Homo sapiens
caagauccaccuaacaaga

SEQ ID NO: 524786 - RNA, 19 nt, Homo sapiens
guagugucauugcucauau

SEQ ID NO: 524787 - RNA, 19 nt, Homo sapiens
gaaguauauugaagcuugu

SEQ ID NO: 524788 - RNA, 19 nt, Homo sapiens
ggguaacgguuguugaugu

SEQ ID NO: 524789 - RNA, 19 nt, Homo sapiens
gggaagugguacaaucaug

SEQ ID NO: 524790 - RNA, 19 nt, Homo sapiens
caaugucccuuugauacuu

SEQ ID NO: 524791 - RNA, 19 nt, Homo sapiens
agacaggguuucaccaugu

SEQ ID NO: 524792 - RNA, 19 nt, Homo sapiens
aaaggacacuggugauaca

SEQ ID NO: 524793 - RNA, 19 nt, Homo sapiens
aaagaacccagacagagua

SEQ ID NO: 524794 - RNA, 19 nt, Homo sapiens
aaguauccgucgcauauuu

SEQ ID NO: 524795 - RNA, 19 nt, Homo sapiens
ucaaauggguacaaaauug

SEQ ID NO: 524796 - RNA, 19 nt, Homo sapiens
acagaagcaucucuacaga

SEQ ID NO: 524797 - RNA, 19 nt, Homo sapiens
gaagugguacaaucauguu

SEQ ID NO: 524798 - RNA, 19 nt, Homo sapiens
ugccagaaguagcucguua

SEQ ID NO: 524799 - RNA, 19 nt, Homo sapiens
gugguacaaucauguuuga

SEQ ID NO: 524800 - RNA, 19 nt, Homo sapiens
caacaggagcugauguaga

SEQ ID NO: 524801 - RNA, 19 nt, Homo sapiens
gggcagcagaucugaagua

SEQ ID NO: 524802 - RNA, 19 nt, Homo sapiens
uaaaagaagugguagaauc

SEQ ID NO: 524803 - RNA, 19 nt, Homo sapiens
uuucuuaugucucuuguug

SEQ ID NO: 524804 - RNA, 19 nt, Homo sapiens
cauaggccacacuuuaaua

SEQ ID NO: 524805 - RNA, 19 nt, Homo sapiens
acaaugaacuacaaaccau

SEQ ID NO: 524806 - RNA, 19 nt, Homo sapiens
gcuccacaaugaacuacaa

SEQ ID NO: 524807 - RNA, 19 nt, Homo sapiens
cuacacuuccuauuuauga

SEQ ID NO: 524808 - RNA, 19 nt, Homo sapiens
ggacagaagcaucucuaca

SEQ ID NO: 524809 - RNA, 19 nt, Homo sapiens
gcccaugaaccaaguguuu

SEQ ID NO: 524810 - RNA, 19 nt, Homo sapiens
gcugggaagugguacaauc

SEQ ID NO: 524811 - RNA, 19 nt, Homo sapiens
ucugugaggcucugaauuu

SEQ ID NO: 524812 - RNA, 19 nt, Homo sapiens
ccaaaaggauguucugaau

SEQ ID NO: 524813 - RNA, 19 nt, Homo sapiens
cauaagugcucugugugaa

SEQ ID NO: 524814 - RNA, 19 nt, Homo sapiens
ccagacagaguacugauug

SEQ ID NO: 524815 - RNA, 19 nt, Homo sapiens
uguauggucugguuaaagu

SEQ ID NO: 524816 - RNA, 19 nt, Homo sapiens
ucauauguguccugaaauc

SEQ ID NO: 524817 - RNA, 19 nt, Homo sapiens
ggaagugguacaaucaugu

SEQ ID NO: 524818 - RNA, 19 nt, Homo sapiens
uuggaugagugaaagauaa

SEQ ID NO: 524819 - RNA, 19 nt, Homo sapiens
uagcucaguuauuggauga

SEQ ID NO: 524820 - RNA, 19 nt, Homo sapiens
gggacauguuuaaggaauu

SEQ ID NO: 524821 - RNA, 19 nt, Homo sapiens
ggauccauaugaagcaugu

SEQ ID NO: 524822 - RNA, 19 nt, Homo sapiens
cacagugccugggcuaauu

SEQ ID NO: 524823 - RNA, 19 nt, Homo sapiens
accauuggcuuccagauug

SEQ ID NO: 524824 - RNA, 19 nt, Homo sapiens
agcauuaacuccauaagug

SEQ ID NO: 524825 - RNA, 19 nt, Homo sapiens
uaaagaacccagacagagu

SEQ ID NO: 524826 - RNA, 19 nt, Homo sapiens
agaauaagcagcauuaacu

SEQ ID NO: 524827 - RNA, 19 nt, Homo sapiens
ggcagcagaucugaaguau

SEQ ID NO: 524828 - RNA, 19 nt, Homo sapiens
agagggagacaaauauaaa

SEQ ID NO: 524829 - RNA, 19 nt, Homo sapiens
uuaugucucuuguugaguu

SEQ ID NO: 524830 - RNA, 19 nt, Homo sapiens
gaaauuccgaaguuuaguc

SEQ ID NO: 524831 - RNA, 19 nt, Homo sapiens
aaaagauccucaccacuaa

SEQ ID NO: 524832 - RNA, 19 nt, Homo sapiens
ggaggacccacauguagug

SEQ ID NO: 524833 - RNA, 19 nt, Homo sapiens
gaggacagaagcaucucua

SEQ ID NO: 524834 - RNA, 19 nt, Homo sapiens
agaagagggagacaaauau

SEQ ID NO: 524835 - RNA, 19 nt, Homo sapiens
ugaaauugcuaugcuaaac

SEQ ID NO: 524836 - RNA, 19 nt, Homo sapiens
aagcagcauuaacuccaua

SEQ ID NO: 524837 - RNA, 19 nt, Homo sapiens
uuacgaagguucaagauua

SEQ ID NO: 524838 - RNA, 19 nt, Homo sapiens
uaauauaucuuccguguug

SEQ ID NO: 524839 - RNA, 19 nt, Homo sapiens
gcaaagcaaugucucaaga

SEQ ID NO: 524840 - RNA, 19 nt, Homo sapiens
ucaaaccucuauagucuua

SEQ ID NO: 524841 - RNA, 19 nt, Homo sapiens
auaaugggcuaguuucuua

SEQ ID NO: 524842 - RNA, 19 nt, Homo sapiens
gagcuagaauuaucuguga

SEQ ID NO: 524843 - RNA, 19 nt, Homo sapiens
gaagagaucccaaaguuag

SEQ ID NO: 524844 - RNA, 19 nt, Homo sapiens
gcgggacacucacucaaua

SEQ ID NO: 524845 - RNA, 19 nt, Homo sapiens
ucauggaagucacaaauaa

SEQ ID NO: 524846 - RNA, 19 nt, Homo sapiens
gggccugccugauaauaua

SEQ ID NO: 524847 - RNA, 19 nt, Homo sapiens
gcaauacuuuccuucuuug

SEQ ID NO: 524848 - RNA, 19 nt, Homo sapiens
gauagugucuggaaaccuu

SEQ ID NO: 524849 - RNA, 19 nt, Homo sapiens
cuacagaaguacaaucauu

SEQ ID NO: 524850 - RNA, 19 nt, Homo sapiens
ggcaagagcuagaauuauc

SEQ ID NO: 524851 - RNA, 19 nt, Homo sapiens
acaaacaaccuauggauuu

SEQ ID NO: 524852 - RNA, 19 nt, Homo sapiens
guggaucuguauauucuua

SEQ ID NO: 524853 - RNA, 19 nt, Homo sapiens
uagcaaaggacgugucuua

SEQ ID NO: 524854 - RNA, 19 nt, Homo sapiens
ggaaaacgcugugaauuug

SEQ ID NO: 524855 - RNA, 19 nt, Homo sapiens
uaccagauaugcuugaauu

SEQ ID NO: 524856 - RNA, 19 nt, Homo sapiens
gaaggcaaagaguauauuu

SEQ ID NO: 524857 - RNA, 19 nt, Homo sapiens
gcuaguuucuuacaaugaa

SEQ ID NO: 524858 - RNA, 19 nt, Homo sapiens
gcagguacccgaggauuaa

SEQ ID NO: 524859 - RNA, 19 nt, Homo sapiens
cuacaacucuggauugcuu

SEQ ID NO: 524860 - RNA, 19 nt, Homo sapiens
caaaggacgugucuuacuc

SEQ ID NO: 524861 - RNA, 19 nt, Homo sapiens
uugaagagaucccaaaguu

SEQ ID NO: 524862 - RNA, 19 nt, Homo sapiens
acaaugaaauguucucuag

SEQ ID NO: 524863 - RNA, 19 nt, Homo sapiens
gaacaaaaccuacaauaca

SEQ ID NO: 524864 - RNA, 19 nt, Homo sapiens
ccaaaguuaguuacucuua

SEQ ID NO: 524865 - RNA, 19 nt, Homo sapiens
gacacucacucaauaugaa

SEQ ID NO: 524866 - RNA, 19 nt, Homo sapiens
uagcgugacuccucuagaa

SEQ ID NO: 524867 - RNA, 19 nt, Homo sapiens
guucaagucuguaucaaag

SEQ ID NO: 524868 - RNA, 19 nt, Homo sapiens
caaacaaccuauggauuuc

SEQ ID NO: 524869 - RNA, 19 nt, Homo sapiens
ggacacucacucaauauga

SEQ ID NO: 524870 - RNA, 19 nt, Homo sapiens
agagagaccugcccuguag

SEQ ID NO: 524871 - RNA, 19 nt, Homo sapiens
aaaauacuguggacacuua

SEQ ID NO: 524872 - RNA, 19 nt, Homo sapiens
cagauaugcuugaauugga

SEQ ID NO: 524873 - RNA, 19 nt, Homo sapiens
ugucaaaccucuauagucu

SEQ ID NO: 524874 - RNA, 19 nt, Homo sapiens
ucaagucuguaucaaaguu

SEQ ID NO: 524875 - RNA, 19 nt, Homo sapiens
aaugaaauguucucuagga

SEQ ID NO: 524876 - RNA, 19 nt, Homo sapiens
gaacgguuaucaucauugc

SEQ ID NO: 524877 - RNA, 19 nt, Homo sapiens
ugaauuggaucaccucaca

SEQ ID NO: 524878 - RNA, 19 nt, Homo sapiens
ugcaauacuuuccuucuuu

SEQ ID NO: 524879 - RNA, 19 nt, Homo sapiens
gaaaguauaccagauaugc

SEQ ID NO: 524880 - RNA, 19 nt, Homo sapiens
ggagaaggcaaagaguaua

SEQ ID NO: 524881 - RNA, 19 nt, Homo sapiens
caauacagaugucccucuu

SEQ ID NO: 524882 - RNA, 19 nt, Homo sapiens
ugaagagaucccaaaguua

SEQ ID NO: 524883 - RNA, 19 nt, Homo sapiens
uaaaacacgugcagaugua

SEQ ID NO: 524884 - RNA, 19 nt, Homo sapiens
acagaugucccucuuguuu

SEQ ID NO: 524885 - RNA, 19 nt, Homo sapiens
uguacaagaucuuagcaaa

SEQ ID NO: 524886 - RNA, 19 nt, Homo sapiens
gggaacgguuaucaucauu

SEQ ID NO: 524887 - RNA, 19 nt, Homo sapiens
ucaauuagaaacugcagua

SEQ ID NO: 524888 - RNA, 19 nt, Homo sapiens
gauggaggccugaauguca

SEQ ID NO: 524889 - RNA, 19 nt, Homo sapiens
uguggacacuuaaauaaug

SEQ ID NO: 524890 - RNA, 19 nt, Homo sapiens
aaagcaaugucucaagaug

SEQ ID NO: 524891 - RNA, 19 nt, Homo sapiens
cuacagugcccuugguuaa

SEQ ID NO: 524892 - RNA, 19 nt, Homo sapiens
agaauuaucugugaagaag

SEQ ID NO: 524893 - RNA, 19 nt, Homo sapiens
uaucccaccuggagcagua

SEQ ID NO: 524894 - RNA, 19 nt, Homo sapiens
gaucuuagcaaagcaaugu

SEQ ID NO: 524895 - RNA, 19 nt, Homo sapiens
gugcaauacuuuccuucuu

SEQ ID NO: 524896 - RNA, 19 nt, Homo sapiens
gggcuaguuucuuacaaug

SEQ ID NO: 524897 - RNA, 19 nt, Homo sapiens
gguggaaauugcucaagug

SEQ ID NO: 524898 - RNA, 19 nt, Homo sapiens
gagaaggcaaagaguauau

SEQ ID NO: 524899 - RNA, 19 nt, Homo sapiens
gcaguaugcuuuuagucua

SEQ ID NO: 524900 - RNA, 19 nt, Homo sapiens
gagcaguauuagagaacaa

SEQ ID NO: 524901 - RNA, 19 nt, Homo sapiens
cauggugacagaauugaua

SEQ ID NO: 524902 - RNA, 19 nt, Homo sapiens
aagcacauguugacgaguu

SEQ ID NO: 524903 - RNA, 19 nt, Homo sapiens
ggauggauuucggaagcua

SEQ ID NO: 524904 - RNA, 19 nt, Homo sapiens
gagaucccaaaguuaguua

SEQ ID NO: 524905 - RNA, 19 nt, Homo sapiens
gcugugaauuugucaugga

SEQ ID NO: 524906 - RNA, 19 nt, Homo sapiens
gcaaaggacgugucuuacu

SEQ ID NO: 524907 - RNA, 19 nt, Homo sapiens
auacagaugucccucuugu

SEQ ID NO: 524908 - RNA, 19 nt, Homo sapiens
uaaauaaugggcuaguuuc

SEQ ID NO: 524909 - RNA, 19 nt, Homo sapiens
caguggaucuguauauucu

SEQ ID NO: 524910 - RNA, 19 nt, Homo sapiens
aaacugagacugguggaaa

SEQ ID NO: 524911 - RNA, 19 nt, Homo sapiens
caauaugaaggcaaacuga

SEQ ID NO: 524912 - RNA, 19 nt, Homo sapiens
uacgaagguucaagauuau

SEQ ID NO: 524913 - RNA, 19 nt, Homo sapiens
caggaucucugacaaugag

SEQ ID NO: 524914 - RNA, 19 nt, Homo sapiens
caggucauggugauauuua

SEQ ID NO: 524915 - RNA, 19 nt, Homo sapiens
caaaucauggugacagaau

SEQ ID NO: 524916 - RNA, 19 nt, Homo sapiens
ucggcaagagcuagaauua

SEQ ID NO: 524917 - RNA, 19 nt, Homo sapiens
ugaaauguucucuaggauu

SEQ ID NO: 524918 - RNA, 19 nt, Homo sapiens
acaagauagugucuggaaa

SEQ ID NO: 524919 - RNA, 19 nt, Homo sapiens
acauggaaaucauugugaa

SEQ ID NO: 524920 - RNA, 19 nt, Homo sapiens
gguacccgaggauuaauaa

SEQ ID NO: 524921 - RNA, 19 nt, Homo sapiens
guacuuuacuauguuacug

SEQ ID NO: 524922 - RNA, 19 nt, Homo sapiens
uggaaaccuucgcaucuug

SEQ ID NO: 524923 - RNA, 19 nt, Homo sapiens
acagugcccuugguuaaau

SEQ ID NO: 524924 - RNA, 19 nt, Homo sapiens
gcaggaucucugacaauga

SEQ ID NO: 524925 - RNA, 19 nt, Homo sapiens
gacauggaaaucauuguga

SEQ ID NO: 524926 - RNA, 19 nt, Homo sapiens
acccgaggauuaauaaaga

SEQ ID NO: 524927 - RNA, 19 nt, Homo sapiens
uuucggaagcuauuucaua

SEQ ID NO: 524928 - RNA, 19 nt, Homo sapiens
gugaagaaggaacuagaaa

SEQ ID NO: 524929 - RNA, 19 nt, Homo sapiens
guacaagaucuuagcaaag

SEQ ID NO: 524930 - RNA, 19 nt, Homo sapiens
ccucacaguuucaggagau

SEQ ID NO: 524931 - RNA, 19 nt, Homo sapiens
uaggagaaggcaaagagua

SEQ ID NO: 524932 - RNA, 19 nt, Homo sapiens
acagauggugcaauacuuu

SEQ ID NO: 524933 - RNA, 19 nt, Homo sapiens
cacagauggugcaauacuu

SEQ ID NO: 524934 - RNA, 19 nt, Homo sapiens
caucuuggaccacugaaau

SEQ ID NO: 524935 - RNA, 19 nt, Homo sapiens
aaaucauggugacagaauu

SEQ ID NO: 524936 - RNA, 19 nt, Homo sapiens
uggaucaccucacaguuuc

SEQ ID NO: 524937 - RNA, 19 nt, Homo sapiens
gaagaaagggccaauguaa

SEQ ID NO: 524938 - RNA, 19 nt, Homo sapiens
ggaauaaaccagauacuuu

SEQ ID NO: 524939 - RNA, 19 nt, Homo sapiens
gaaauggacuucagcucuu

SEQ ID NO: 524940 - RNA, 19 nt, Homo sapiens
gaacuaagugaccaaauga

SEQ ID NO: 524941 - RNA, 19 nt, Homo sapiens
gggagcagcuguuaguuug

SEQ ID NO: 524942 - RNA, 19 nt, Homo sapiens
caaauacucagcauacuuu

SEQ ID NO: 524943 - RNA, 19 nt, Homo sapiens
cgaaggaaauggaagaguu

SEQ ID NO: 524944 - RNA, 19 nt, Homo sapiens
gaaggaaauggaagaguuu

SEQ ID NO: 524945 - RNA, 19 nt, Homo sapiens
acauauggcuuauucgaaa

SEQ ID NO: 524946 - RNA, 19 nt, Homo sapiens
gcugacauauggcuuauuc

SEQ ID NO: 524947 - RNA, 19 nt, Homo sapiens
cuacaggagucaagauuug

SEQ ID NO: 524948 - RNA, 19 nt, Homo sapiens
gggaucaguucuacaguga

SEQ ID NO: 524949 - RNA, 19 nt, Homo sapiens
ggacuucuguucccuccuu

SEQ ID NO: 524950 - RNA, 19 nt, Homo sapiens
agaaagggccaauguaauu

SEQ ID NO: 524951 - RNA, 19 nt, Homo sapiens
gaauucagccacuggauga

SEQ ID NO: 524952 - RNA, 19 nt, Homo sapiens
gagauuugaugggaauaaa

SEQ ID NO: 524953 - RNA, 19 nt, Homo sapiens
gggcagaacuuccaaaaga

SEQ ID NO: 524954 - RNA, 19 nt, Homo sapiens
ucaagcagcugguuaagag

SEQ ID NO: 524955 - RNA, 19 nt, Homo sapiens
gaauuugucaugcgccaua

SEQ ID NO: 524956 - RNA, 19 nt, Homo sapiens
ggaaacaagaacauuaaga

SEQ ID NO: 524957 - RNA, 19 nt, Homo sapiens
gcaaauacucagcauacuu

SEQ ID NO: 524958 - RNA, 19 nt, Homo sapiens
gaagugggaucaguucuac

SEQ ID NO: 524959 - RNA, 19 nt, Homo sapiens
acaagaacauuaagaaguc

SEQ ID NO: 524960 - RNA, 19 nt, Homo sapiens
agagauuccuuucuucuug

SEQ ID NO: 524961 - RNA, 19 nt, Homo sapiens
ggugggcguuccauuguuu

SEQ ID NO: 524962 - RNA, 19 nt, Homo sapiens
ggcaaucucuccuagaauc

SEQ ID NO: 524963 - RNA, 19 nt, Homo sapiens
agaacuaagugaccaaaug

SEQ ID NO: 524964 - RNA, 19 nt, Homo sapiens
ggaugaacuuguccagaga

SEQ ID NO: 524965 - RNA, 19 nt, Homo sapiens
cauggaaacaagaacauua

SEQ ID NO: 524966 - RNA, 19 nt, Homo sapiens
gccacuggaugaauauaaa

SEQ ID NO: 524967 - RNA, 19 nt, Homo sapiens
cgagcagucuucuggauug

SEQ ID NO: 524968 - RNA, 19 nt, Homo sapiens
guuguuaugucagaacuaa

SEQ ID NO: 524969 - RNA, 19 nt, Homo sapiens
guacagacuuacucaaugc

SEQ ID NO: 524970 - RNA, 19 nt, Homo sapiens
cuacugggauuuucaauuu

SEQ ID NO: 524971 - RNA, 19 nt, Homo sapiens
gaagaagugggaucaguuc

SEQ ID NO: 524972 - RNA, 19 nt, Homo sapiens
gcagucuucuggauugaau

SEQ ID NO: 524973 - RNA, 19 nt, Homo sapiens
guucuacagugaaguucua

SEQ ID NO: 524974 - RNA, 19 nt, Homo sapiens
gaucaguucuacagugaag

SEQ ID NO: 524975 - RNA, 19 nt, Homo sapiens
gcaggauuguguuguuuua

SEQ ID NO: 524976 - RNA, 19 nt, Homo sapiens
ggaagacccacuacguuau

SEQ ID NO: 524977 - RNA, 19 nt, Homo sapiens
gcccaucuacucuuaaauu

SEQ ID NO: 524978 - RNA, 19 nt, Homo sapiens
gagcagcuguuaguuugga

SEQ ID NO: 524979 - RNA, 19 nt, Homo sapiens
gagauuccuuucuucuugu

SEQ ID NO: 524980 - RNA, 19 nt, Homo sapiens
aagaagacguugugauaca

SEQ ID NO: 524981 - RNA, 19 nt, Homo sapiens
agagauuaauuacgucuga

SEQ ID NO: 524982 - RNA, 19 nt, Homo sapiens
ggcaaaagcugacauaugg

SEQ ID NO: 524983 - RNA, 19 nt, Homo sapiens
gauaacauugcacacauga

SEQ ID NO: 524984 - RNA, 19 nt, Homo sapiens
aaggcaaucucuccuagaa

SEQ ID NO: 524985 - RNA, 19 nt, Homo sapiens
cuacaggccucgcuucucu

SEQ ID NO: 524986 - RNA, 19 nt, Homo sapiens
cagcccaucuacucuuaaa

SEQ ID NO: 524987 - RNA, 19 nt, Homo sapiens
cccaauaaaugaacuccuu

SEQ ID NO: 524988 - RNA, 19 nt, Homo sapiens
gaaagaaggggaaaagaga

SEQ ID NO: 524989 - RNA, 19 nt, Homo sapiens
ccagauacuuuaggacuca

SEQ ID NO: 524990 - RNA, 19 nt, Homo sapiens
cccaucuacucuuaaauuu

SEQ ID NO: 524991 - RNA, 19 nt, Homo sapiens
aaagccauaugagguuaua

SEQ ID NO: 524992 - RNA, 19 nt, Homo sapiens
ggggaaaagagauuaauua

SEQ ID NO: 524993 - RNA, 19 nt, Homo sapiens
caagggagcagcuguuagu

SEQ ID NO: 524994 - RNA, 19 nt, Homo sapiens
auaaagccauaugagguua

SEQ ID NO: 524995 - RNA, 19 nt, Homo sapiens
gggaauaaaccagauacuu

SEQ ID NO: 524996 - RNA, 19 nt, Homo sapiens
ggagauuugaugggaauaa

SEQ ID NO: 524997 - RNA, 19 nt, Homo sapiens
cacccacucuuaccaaaug

SEQ ID NO: 524998 - RNA, 19 nt, Homo sapiens
aggaagacccacuacguua

SEQ ID NO: 524999 - RNA, 19 nt, Homo sapiens
gaaaguucuguaaggauau

SEQ ID NO: 525000 - RNA, 19 nt, Homo sapiens
ccaauucacagguuacaug

SEQ ID NO: 525001 - RNA, 19 nt, Homo sapiens
auacucggcuguacaagug

SEQ ID NO: 525002 - RNA, 19 nt, Homo sapiens
gaagacccacuacguuauc

SEQ ID NO: 525003 - RNA, 19 nt, Homo sapiens
cagugaaguucuaggaaga

SEQ ID NO: 525004 - RNA, 19 nt, Homo sapiens
gaaacuacaggagucaaga

SEQ ID NO: 525005 - RNA, 19 nt, Homo sapiens
uaagagaugggcagaacuu

SEQ ID NO: 525006 - RNA, 19 nt, Homo sapiens
gagcagucuucuggauuga

SEQ ID NO: 525007 - RNA, 19 nt, Homo sapiens
uaacauugcacacaugaag

SEQ ID NO: 525008 - RNA, 19 nt, Homo sapiens
gaaaacaagcauugcauug

SEQ ID NO: 525009 - RNA, 19 nt, Homo sapiens
caacagcccaucuacucuu

SEQ ID NO: 525010 - RNA, 19 nt, Homo sapiens
gggaaacccaauaaaugaa

SEQ ID NO: 525011 - RNA, 19 nt, Homo sapiens
guaccacucuuuggaugug

SEQ ID NO: 525012 - RNA, 19 nt, Homo sapiens
cagaagaaagggccaaugu

SEQ ID NO: 525013 - RNA, 19 nt, Homo sapiens
aacagcccaucuacucuua

SEQ ID NO: 525014 - RNA, 19 nt, Homo sapiens
uauuugacaugaagaagug

SEQ ID NO: 525015 - RNA, 19 nt, Homo sapiens
cuaugugccuguuguuaug

SEQ ID NO: 525016 - RNA, 19 nt, Homo sapiens
gaagaaacuacaggaguca

SEQ ID NO: 525017 - RNA, 19 nt, Homo sapiens
ugaaguuuauccuguaucu

SEQ ID NO: 525018 - RNA, 19 nt, Homo sapiens
caugcaggauuguguuguu

SEQ ID NO: 525019 - RNA, 19 nt, Homo sapiens
uauaaagccauaugagguu

SEQ ID NO: 525020 - RNA, 19 nt, Homo sapiens
gaaacccaauaaaugaacu

SEQ ID NO: 525021 - RNA, 19 nt, Homo sapiens
gaugggaauaaaccagaua

SEQ ID NO: 525022 - RNA, 19 nt, Homo sapiens
agaagaaagggccaaugua

SEQ ID NO: 525023 - RNA, 19 nt, Homo sapiens
guauuggcaucuucagcuu

SEQ ID NO: 525024 - RNA, 19 nt, Homo sapiens
gauacuuuaggacucaaua

SEQ ID NO: 525025 - RNA, 19 nt, Homo sapiens
guuaagagaugggcagaac

SEQ ID NO: 525026 - RNA, 19 nt, Homo sapiens
guacauggaaacaagaaca

SEQ ID NO: 525027 - RNA, 19 nt, Homo sapiens
gccaagggagcagcuguua

SEQ ID NO: 525028 - RNA, 19 nt, Homo sapiens
ccaauaaaugaacuccuuu

SEQ ID NO: 525029 - RNA, 19 nt, Homo sapiens
ugauaacauugcacacaug

SEQ ID NO: 525030 - RNA, 19 nt, Homo sapiens
cagcuuccauuucuuucga

SEQ ID NO: 525031 - RNA, 19 nt, Homo sapiens
ucaauacucggcuguacaa

SEQ ID NO: 525032 - RNA, 19 nt, Homo sapiens
guggagauuugaugggaau

SEQ ID NO: 525033 - RNA, 19 nt, Homo sapiens
ucaguaacacgucagaaga

SEQ ID NO: 525034 - RNA, 19 nt, Homo sapiens
gacauauggcuuauucgaa

SEQ ID NO: 525035 - RNA, 19 nt, Homo sapiens
uaucugagacaauggcaaa

SEQ ID NO: 525036 - RNA, 19 nt, Homo sapiens
uaaaauacccuuugucuac

SEQ ID NO: 525037 - RNA, 19 nt, Homo sapiens
gaaauggacuucaguaauu

SEQ ID NO: 525038 - RNA, 19 nt, Homo sapiens
gaauaaaccagauaccuua

SEQ ID NO: 525039 - RNA, 19 nt, Homo sapiens
caacugagcuuuugcuuua

SEQ ID NO: 525040 - RNA, 19 nt, Homo sapiens
guacaagagucaagauuug

SEQ ID NO: 525041 - RNA, 19 nt, Homo sapiens
gaagaaagggccaacguaa

SEQ ID NO: 525042 - RNA, 19 nt, Homo sapiens
ggaaauggaagacuuugua

SEQ ID NO: 525043 - RNA, 19 nt, Homo sapiens
gaaagauugugaugcaaga

SEQ ID NO: 525044 - RNA, 19 nt, Homo sapiens
caagaaagauugugaugca

SEQ ID NO: 525045 - RNA, 19 nt, Homo sapiens
gaauacagccauuggauga

SEQ ID NO: 525046 - RNA, 19 nt, Homo sapiens
uaacauugcucacaugaag

SEQ ID NO: 525047 - RNA, 19 nt, Homo sapiens
gaagaagugggaucaguuu

SEQ ID NO: 525048 - RNA, 19 nt, Homo sapiens
cuacguaccuguuguuaug

SEQ ID NO: 525049 - RNA, 19 nt, Homo sapiens
gccauuggaugaauauaaa

SEQ ID NO: 525050 - RNA, 19 nt, Homo sapiens
caacucauccgcucuuaaa

SEQ ID NO: 525051 - RNA, 19 nt, Homo sapiens
cgaaauauuugacaugaag

SEQ ID NO: 525052 - RNA, 19 nt, Homo sapiens
uaacauacccuuuguguac

SEQ ID NO: 525053 - RNA, 19 nt, Homo sapiens
ggaauaaaccagauaccuu

SEQ ID NO: 525054 - RNA, 19 nt, Homo sapiens
gcaccaggaugucugugaa

SEQ ID NO: 525055 - RNA, 19 nt, Homo sapiens
gcauugaagagaguaauua

SEQ ID NO: 525056 - RNA, 19 nt, Homo sapiens
guacagacuugcugaaugc

SEQ ID NO: 525057 - RNA, 19 nt, Homo sapiens
gagauuugaugggaauaaa

SEQ ID NO: 525058 - RNA, 19 nt, Homo sapiens
ucaguaacaugacagaaga

SEQ ID NO: 525059 - RNA, 19 nt, Homo sapiens
agaaagggccaacguaauu

SEQ ID NO: 525060 - RNA, 19 nt, Homo sapiens
gcugcuggcugagcuauuu

SEQ ID NO: 525061 - RNA, 19 nt, Homo sapiens
caggaaaucaugucaauau

SEQ ID NO: 525062 - RNA, 19 nt, Homo sapiens
cauccacucuuaccaaaug

SEQ ID NO: 525063 - RNA, 19 nt, Homo sapiens
cauaguggaggauuuauuu

SEQ ID NO: 525064 - RNA, 19 nt, Homo sapiens
ucuaugugcuuuacuuuga

SEQ ID NO: 525065 - RNA, 19 nt, Homo sapiens
cuaaggaaauggaagacuu

SEQ ID NO: 525066 - RNA, 19 nt, Homo sapiens
cgagcagucuucuggauug

SEQ ID NO: 525067 - RNA, 19 nt, Homo sapiens
guacuggcaucuucagcuu

SEQ ID NO: 525068 - RNA, 19 nt, Homo sapiens
gagacuacuucaguuuauu

SEQ ID NO: 525069 - RNA, 19 nt, Homo sapiens
gaccagagcuuuuauaacu

SEQ ID NO: 525070 - RNA, 19 nt, Homo sapiens
gcagucuucuggauugaau

SEQ ID NO: 525071 - RNA, 19 nt, Homo sapiens
gaaagggccaacguaauug

SEQ ID NO: 525072 - RNA, 19 nt, Homo sapiens
uggcaacugugauauuuau

SEQ ID NO: 525073 - RNA, 19 nt, Homo sapiens
ggaagacccacuacguuau

SEQ ID NO: 525074 - RNA, 19 nt, Homo sapiens
gaagaaaacacuacggaaa

SEQ ID NO: 525075 - RNA, 19 nt, Homo sapiens
ugagacuacuucaguuuau

SEQ ID NO: 525076 - RNA, 19 nt, Homo sapiens
gcugacguauggcuuauuc

SEQ ID NO: 525077 - RNA, 19 nt, Homo sapiens
gcugagcuauuuaacauac

SEQ ID NO: 525078 - RNA, 19 nt, Homo sapiens
uaucccacaucuuuaacua

SEQ ID NO: 525079 - RNA, 19 nt, Homo sapiens
ugacuguacuggcaucuuc

SEQ ID NO: 525080 - RNA, 19 nt, Homo sapiens
cagacuugcugaaugcauu

SEQ ID NO: 525081 - RNA, 19 nt, Homo sapiens
gauaacauugcucacauga

SEQ ID NO: 525082 - RNA, 19 nt, Homo sapiens
gugagacuacuucaguuua

SEQ ID NO: 525083 - RNA, 19 nt, Homo sapiens
ucuggaaguuugcuagaaa

SEQ ID NO: 525084 - RNA, 19 nt, Homo sapiens
ucaauggucaguaacauga

SEQ ID NO: 525085 - RNA, 19 nt, Homo sapiens
uggcugagcuauuuaacau

SEQ ID NO: 525086 - RNA, 19 nt, Homo sapiens
uguggcaacugugauauuu

SEQ ID NO: 525087 - RNA, 19 nt, Homo sapiens
caacaugaucaaccaguga

SEQ ID NO: 525088 - RNA, 19 nt, Homo sapiens
uaaggaaauggaagacuuu

SEQ ID NO: 525089 - RNA, 19 nt, Homo sapiens
agauugugaugcaagauuu

SEQ ID NO: 525090 - RNA, 19 nt, Homo sapiens
uaacaugacagaagaaagg

SEQ ID NO: 525091 - RNA, 19 nt, Homo sapiens
ggggaaagcugacguaugg

SEQ ID NO: 525092 - RNA, 19 nt, Homo sapiens
gaagugggaucaguuuuau

SEQ ID NO: 525093 - RNA, 19 nt, Homo sapiens
gaucuaugugcuuuacuuu

SEQ ID NO: 525094 - RNA, 19 nt, Homo sapiens
uacaggaaaucaugucaau

SEQ ID NO: 525095 - RNA, 19 nt, Homo sapiens
ugcaacagauuaagagaug

SEQ ID NO: 525096 - RNA, 19 nt, Homo sapiens
gaguggacuucaacacaau

SEQ ID NO: 525097 - RNA, 19 nt, Homo sapiens
agaguggacuucaacacaa

SEQ ID NO: 525098 - RNA, 19 nt, Homo sapiens
ggagauuugaugggaauaa

SEQ ID NO: 525099 - RNA, 19 nt, Homo sapiens
aggaagacccacuacguua

SEQ ID NO: 525100 - RNA, 19 nt, Homo sapiens
cuguaaagauguaguuuca

SEQ ID NO: 525101 - RNA, 19 nt, Homo sapiens
gcagcagaauacagccauu

SEQ ID NO: 525102 - RNA, 19 nt, Homo sapiens
ggugagacuacuucaguuu

SEQ ID NO: 525103 - RNA, 19 nt, Homo sapiens
gcuaauacaacugagcuuu

SEQ ID NO: 525104 - RNA, 19 nt, Homo sapiens
acguauggcuuauucgaaa

SEQ ID NO: 525105 - RNA, 19 nt, Homo sapiens
gaagacccacuacguuauc

SEQ ID NO: 525106 - RNA, 19 nt, Homo sapiens
ugaaauuuaucccacaucu

SEQ ID NO: 525107 - RNA, 19 nt, Homo sapiens
gagcagucuucuggauuga

SEQ ID NO: 525108 - RNA, 19 nt, Homo sapiens
gcauaguggaggauuuauu

SEQ ID NO: 525109 - RNA, 19 nt, Homo sapiens
caacaacucauccgcucuu

SEQ ID NO: 525110 - RNA, 19 nt, Homo sapiens
caggaugucugugaaaugg

SEQ ID NO: 525111 - RNA, 19 nt, Homo sapiens
guaccacucuuuggaugug

SEQ ID NO: 525112 - RNA, 19 nt, Homo sapiens
uauuugacaugaagaagug

SEQ ID NO: 525113 - RNA, 19 nt, Homo sapiens
aaagcauaguggaggauuu

SEQ ID NO: 525114 - RNA, 19 nt, Homo sapiens
guuggagaauuucaucaug

SEQ ID NO: 525115 - RNA, 19 nt, Homo sapiens
gaaauuuaucccacaucuu

SEQ ID NO: 525116 - RNA, 19 nt, Homo sapiens
gauccuucauauaaagaga

SEQ ID NO: 525117 - RNA, 19 nt, Homo sapiens
gaugggaauaaaccagaua

SEQ ID NO: 525118 - RNA, 19 nt, Homo sapiens
ugaucuaugugcuuuacuu

SEQ ID NO: 525119 - RNA, 19 nt, Homo sapiens
aagcauaguggaggauuua

SEQ ID NO: 525120 - RNA, 19 nt, Homo sapiens
gaaaacacuacggaaaaua

SEQ ID NO: 525121 - RNA, 19 nt, Homo sapiens
gaaauggaagacuuuguac

SEQ ID NO: 525122 - RNA, 19 nt, Homo sapiens
uagugaaguucuaggaaga

SEQ ID NO: 525123 - RNA, 19 nt, Homo sapiens
ggaugagcuuauucagaga

SEQ ID NO: 525124 - RNA, 19 nt, Homo sapiens
agaagaaagggccaacgua

SEQ ID NO: 525125 - RNA, 19 nt, Homo sapiens
gggaucaguuuuauaguga

SEQ ID NO: 525126 - RNA, 19 nt, Homo sapiens
gaaaguucuguaaagaugu

SEQ ID NO: 525127 - RNA, 19 nt, Homo sapiens
gaaaagcaaagaagggaaa

SEQ ID NO: 525128 - RNA, 19 nt, Homo sapiens
ugaaugcauugaagagagu

SEQ ID NO: 525129 - RNA, 19 nt, Homo sapiens
gcagaauacagccauugga

SEQ ID NO: 525130 - RNA, 19 nt, Homo sapiens
ugauaacauugcucacaug

SEQ ID NO: 525131 - RNA, 19 nt, Homo sapiens
guggagauuugaugggaau

SEQ ID NO: 525132 - RNA, 19 nt, Homo sapiens
ggucaauggucaguaacau

SEQ ID NO: 525133 - RNA, 19 nt, Homo sapiens
ugaagaagugggaucaguu

SEQ ID NO: 525134 - RNA, 19 nt, Homo sapiens
aagguucuguggagauuug

SEQ ID NO: 525135 - RNA, 19 nt, Homo sapiens
uacguuaucugagacaaug

SEQ ID NO: 525136 - RNA, 19 nt, Homo sapiens
caguucaugguuagaaaua

SEQ ID NO: 525137 - RNA, 19 nt, Homo sapiens
gaggaaagcugacauaugg

SEQ ID NO: 525138 - RNA, 19 nt, Homo sapiens
gaaauccugugggcaauua

SEQ ID NO: 525139 - RNA, 19 nt, Homo sapiens
gaauaaaccagaugccuua

SEQ ID NO: 525140 - RNA, 19 nt, Homo sapiens
guuaagagauugucagaaa

SEQ ID NO: 525141 - RNA, 19 nt, Homo sapiens
gaauacagccuuuggauga

SEQ ID NO: 525142 - RNA, 19 nt, Homo sapiens
gaagaaagggccaacguaa

SEQ ID NO: 525143 - RNA, 19 nt, Homo sapiens
gcacaaggauggcucugaa

SEQ ID NO: 525144 - RNA, 19 nt, Homo sapiens
guacagaccugcugaaugc

SEQ ID NO: 525145 - RNA, 19 nt, Homo sapiens
gaaauggacuacaguucug

SEQ ID NO: 525146 - RNA, 19 nt, Homo sapiens
gaagaagugggaucaguuu

SEQ ID NO: 525147 - RNA, 19 nt, Homo sapiens
cuacguaccuguuguuaug

SEQ ID NO: 525148 - RNA, 19 nt, Homo sapiens
ggaugaauaugaagacaau

SEQ ID NO: 525149 - RNA, 19 nt, Homo sapiens
uaaauuuccucauccauuc

SEQ ID NO: 525150 - RNA, 19 nt, Homo sapiens
cuacaagagucaagauuug

SEQ ID NO: 525151 - RNA, 19 nt, Homo sapiens
uaacauacccuuuguguac

SEQ ID NO: 525152 - RNA, 19 nt, Homo sapiens
ugaagacaauccugaaaga

SEQ ID NO: 525153 - RNA, 19 nt, Homo sapiens
gagaauaucaucaugcaau

SEQ ID NO: 525154 - RNA, 19 nt, Homo sapiens
caaaggagccaaacaucuu

SEQ ID NO: 525155 - RNA, 19 nt, Homo sapiens
gauaauauugcucacauga

SEQ ID NO: 525156 - RNA, 19 nt, Homo sapiens
ggaaauggaggaguuugua

SEQ ID NO: 525157 - RNA, 19 nt, Homo sapiens
gagauuugaugggaauaaa

SEQ ID NO: 525158 - RNA, 19 nt, Homo sapiens
ggaagacccacuacauuau

SEQ ID NO: 525159 - RNA, 19 nt, Homo sapiens
ucaguaacaugacagaaga

SEQ ID NO: 525160 - RNA, 19 nt, Homo sapiens
cuaaggaaauggaggaguu

SEQ ID NO: 525161 - RNA, 19 nt, Homo sapiens
agaaagggccaacguaauu

SEQ ID NO: 525162 - RNA, 19 nt, Homo sapiens
gcugcuggcugagcuauuu

SEQ ID NO: 525163 - RNA, 19 nt, Homo sapiens
gcacaguggaggauuuauu

SEQ ID NO: 525164 - RNA, 19 nt, Homo sapiens
caagggagcagcuguuaga

SEQ ID NO: 525165 - RNA, 19 nt, Homo sapiens
uaauauugcucacaugaag

SEQ ID NO: 525166 - RNA, 19 nt, Homo sapiens
cauccacucuuaaacuuga

SEQ ID NO: 525167 - RNA, 19 nt, Homo sapiens
ggacuacaguucugcugau

SEQ ID NO: 525168 - RNA, 19 nt, Homo sapiens
cgagcagucuucuggauug

SEQ ID NO: 525169 - RNA, 19 nt, Homo sapiens
guacuggcaucuucagcuu

SEQ ID NO: 525170 - RNA, 19 nt, Homo sapiens
cgaaacuccuggaauuuua

SEQ ID NO: 525171 - RNA, 19 nt, Homo sapiens
aggaagacccacuacauua

SEQ ID NO: 525172 - RNA, 19 nt, Homo sapiens
gcagucuucuggauugaau

SEQ ID NO: 525173 - RNA, 19 nt, Homo sapiens
gaaagggccaacguaauug

SEQ ID NO: 525174 - RNA, 19 nt, Homo sapiens
guggaaaggugcugguaug

SEQ ID NO: 525175 - RNA, 19 nt, Homo sapiens
gaagacaauccugaaagaa

SEQ ID NO: 525176 - RNA, 19 nt, Homo sapiens
ggugggcauuccauuguuu

SEQ ID NO: 525177 - RNA, 19 nt, Homo sapiens
ccagaugccuuaggucuca

SEQ ID NO: 525178 - RNA, 19 nt, Homo sapiens
uaaaccagaugccuuaggu

SEQ ID NO: 525179 - RNA, 19 nt, Homo sapiens
gcugagcuauuuaacauac

SEQ ID NO: 525180 - RNA, 19 nt, Homo sapiens
ugacuguacuggcaucuuc

SEQ ID NO: 525181 - RNA, 19 nt, Homo sapiens
gacuacaguucugcugaua

SEQ ID NO: 525182 - RNA, 19 nt, Homo sapiens
cgacucauccacucuuaaa

SEQ ID NO: 525183 - RNA, 19 nt, Homo sapiens
gaaguuugcuagaaaagga

SEQ ID NO: 525184 - RNA, 19 nt, Homo sapiens
ucuggaaguuugcuagaaa

SEQ ID NO: 525185 - RNA, 19 nt, Homo sapiens
cuacaguucugcugauaca

SEQ ID NO: 525186 - RNA, 19 nt, Homo sapiens
ucaauggucaguaacauga

SEQ ID NO: 525187 - RNA, 19 nt, Homo sapiens
gcucugaaauggacuacag

SEQ ID NO: 525188 - RNA, 19 nt, Homo sapiens
uggcugagcuauuuaacau

SEQ ID NO: 525189 - RNA, 19 nt, Homo sapiens
gagauugucagaaauucaa

SEQ ID NO: 525190 - RNA, 19 nt, Homo sapiens
caacaugaucaaccaguga

SEQ ID NO: 525191 - RNA, 19 nt, Homo sapiens
gaagacccacuacauuauc

SEQ ID NO: 525192 - RNA, 19 nt, Homo sapiens
uggcaaccgugcuauuuau

SEQ ID NO: 525193 - RNA, 19 nt, Homo sapiens
ccacaaaggagccaaacau

SEQ ID NO: 525194 - RNA, 19 nt, Homo sapiens
uaacaugacagaagaaagg

SEQ ID NO: 525195 - RNA, 19 nt, Homo sapiens
augcgaaacuccuggaauu

SEQ ID NO: 525196 - RNA, 19 nt, Homo sapiens
gaguggacuucaacacaau

SEQ ID NO: 525197 - RNA, 19 nt, Homo sapiens
agaguggacuucaacacaa

SEQ ID NO: 525198 - RNA, 19 nt, Homo sapiens
ggagauuugaugggaauaa

SEQ ID NO: 525199 - RNA, 19 nt, Homo sapiens
ccucauccauucuuaccaa

SEQ ID NO: 525200 - RNA, 19 nt, Homo sapiens
cacaguggaggauuuauuu

SEQ ID NO: 525201 - RNA, 19 nt, Homo sapiens
cuguaaagauguaguuuca

SEQ ID NO: 525202 - RNA, 19 nt, Homo sapiens
guggcaaccgugcuauuua

SEQ ID NO: 525203 - RNA, 19 nt, Homo sapiens
gagcagucuucuggauuga

SEQ ID NO: 525204 - RNA, 19 nt, Homo sapiens
ugcaauugguuaagagauu

SEQ ID NO: 525205 - RNA, 19 nt, Homo sapiens
gccuuuggaugaauaugaa

SEQ ID NO: 525206 - RNA, 19 nt, Homo sapiens
caaccgugcuauuuaucau

SEQ ID NO: 525207 - RNA, 19 nt, Homo sapiens
gcaaccgugcuauuuauca

SEQ ID NO: 525208 - RNA, 19 nt, Homo sapiens
guaccacucuuuggaugug

SEQ ID NO: 525209 - RNA, 19 nt, Homo sapiens
uaggaagacccacuacauu

SEQ ID NO: 525210 - RNA, 19 nt, Homo sapiens
caaggauggcucugaaaug

SEQ ID NO: 525211 - RNA, 19 nt, Homo sapiens
gauccuucauauaaagaga

SEQ ID NO: 525212 - RNA, 19 nt, Homo sapiens
gaauaucaucaugcaauug

SEQ ID NO: 525213 - RNA, 19 nt, Homo sapiens
gugggcaauuaaugacaua

SEQ ID NO: 525214 - RNA, 19 nt, Homo sapiens
gccaagggagcagcuguua

SEQ ID NO: 525215 - RNA, 19 nt, Homo sapiens
agaagaaagggccaacgua

SEQ ID NO: 525216 - RNA, 19 nt, Homo sapiens
agacaauccugaaagaacu

SEQ ID NO: 525217 - RNA, 19 nt, Homo sapiens
gaaaaggaaagaagggaaa

SEQ ID NO: 525218 - RNA, 19 nt, Homo sapiens
agccaaacaucuucgaguu

SEQ ID NO: 525219 - RNA, 19 nt, Homo sapiens
auacucgacuguacaagug

SEQ ID NO: 525220 - RNA, 19 nt, Homo sapiens
aaggauggcucugaaaugg

SEQ ID NO: 525221 - RNA, 19 nt, Homo sapiens
gcagaauacagccuuugga

SEQ ID NO: 525222 - RNA, 19 nt, Homo sapiens
ggucaauggucaguaacau

SEQ ID NO: 525223 - RNA, 19 nt, Homo sapiens
uaucugagacaaugaggaa

SEQ ID NO: 525224 - RNA, 19 nt, Homo sapiens
aauaugcucuaugugcuuu

SEQ ID NO: 525225 - RNA, 19 nt, Homo sapiens
gaaauggaggaguuuguac

SEQ ID NO: 525226 - RNA, 19 nt, Homo sapiens
ugaagaagugggaucaguu

SEQ ID NO: 525227 - RNA, 19 nt, Homo sapiens
gaaaggcacaguggaggau

SEQ ID NO: 525228 - RNA, 19 nt, Homo sapiens
ugaggaaagcugacauaug

SEQ ID NO: 525229 - RNA, 19 nt, Homo sapiens
gggaucaguuuuacaguga

SEQ ID NO: 525230 - RNA, 19 nt, Homo sapiens
ugaaauggacuacaguucu

SEQ ID NO: 525231 - RNA, 19 nt, Homo sapiens
ugaaguuuauccuacaucu

SEQ ID NO: 525232 - RNA, 19 nt, Homo sapiens
caagaauucaacaugauca

SEQ ID NO: 525233 - RNA, 19 nt, Homo sapiens
cugaagacaguaauuaaug

SEQ ID NO: 525234 - RNA, 19 nt, Homo sapiens
caacgacucauccacucuu

SEQ ID NO: 525235 - RNA, 19 nt, Homo sapiens
uaccuguuguuaugucaaa

SEQ ID NO: 525236 - RNA, 19 nt, Homo sapiens
uacagccuuuggaugaaua

SEQ ID NO: 525237 - RNA, 19 nt, Homo sapiens
ggaaacaacuucuaguauu

SEQ ID NO: 525238 - RNA, 19 nt, Homo sapiens
ggagauauaccuaauguua

SEQ ID NO: 525239 - RNA, 19 nt, Homo sapiens
gaaacaacuucuaguauug

SEQ ID NO: 525240 - RNA, 19 nt, Homo sapiens
gaagaaugguggaggauuu

SEQ ID NO: 525241 - RNA, 19 nt, Homo sapiens
uaacauugcucacaugaaa

SEQ ID NO: 525242 - RNA, 19 nt, Homo sapiens
gcuacuggcugaacuauuu

SEQ ID NO: 525243 - RNA, 19 nt, Homo sapiens
gcaagaagccaaauacauu

SEQ ID NO: 525244 - RNA, 19 nt, Homo sapiens
gaauacagccauuggauaa

SEQ ID NO: 525245 - RNA, 19 nt, Homo sapiens
gcauugaagucagucauua

SEQ ID NO: 525246 - RNA, 19 nt, Homo sapiens
guaacaagcucuguaaaga

SEQ ID NO: 525247 - RNA, 19 nt, Homo sapiens
gaaauggacgucagucuuu

SEQ ID NO: 525248 - RNA, 19 nt, Homo sapiens
gauagcauuuggagauaua

SEQ ID NO: 525249 - RNA, 19 nt, Homo sapiens
gagauuugcucaaugcauu

SEQ ID NO: 525250 - RNA, 19 nt, Homo sapiens
ugauacagcucaguuguua

SEQ ID NO: 525251 - RNA, 19 nt, Homo sapiens
gaagaaagugccaacauga

SEQ ID NO: 525252 - RNA, 19 nt, Homo sapiens
caagaagccaaauacauua

SEQ ID NO: 525253 - RNA, 19 nt, Homo sapiens
uuaaugacccugucuauaa

SEQ ID NO: 525254 - RNA, 19 nt, Homo sapiens
gaaccaauggcaucuauga

SEQ ID NO: 525255 - RNA, 19 nt, Homo sapiens
cagcucaguuguuacuuua

SEQ ID NO: 525256 - RNA, 19 nt, Homo sapiens
uaaugacccugucuauaaa

SEQ ID NO: 525257 - RNA, 19 nt, Homo sapiens
gaagaagugggaccaguuu

SEQ ID NO: 525258 - RNA, 19 nt, Homo sapiens
gaaguggaaugacugaaag

SEQ ID NO: 525259 - RNA, 19 nt, Homo sapiens
uaacauacccuuucuguac

SEQ ID NO: 525260 - RNA, 19 nt, Homo sapiens
gaaagugccaacaugauug

SEQ ID NO: 525261 - RNA, 19 nt, Homo sapiens
cuaaggaaauggaagaguu

SEQ ID NO: 525262 - RNA, 19 nt, Homo sapiens
gaagacccacuacauuauu

SEQ ID NO: 525263 - RNA, 19 nt, Homo sapiens
ggauauaugguguuucaaa

SEQ ID NO: 525264 - RNA, 19 nt, Homo sapiens
gccaguaaaucaucugcua

SEQ ID NO: 525265 - RNA, 19 nt, Homo sapiens
ggaagacccacuacauuau

SEQ ID NO: 525266 - RNA, 19 nt, Homo sapiens
ucaguaacaugucagaaga

SEQ ID NO: 525267 - RNA, 19 nt, Homo sapiens
ggaauauuaugacuacagu

SEQ ID NO: 525268 - RNA, 19 nt, Homo sapiens
agaagaaagugccaacaug

SEQ ID NO: 525269 - RNA, 19 nt, Homo sapiens
gaugaucaguaacauguca

SEQ ID NO: 525270 - RNA, 19 nt, Homo sapiens
ggacuccuccuuuauuuca

SEQ ID NO: 525271 - RNA, 19 nt, Homo sapiens
guagagauuugcucaaugc

SEQ ID NO: 525272 - RNA, 19 nt, Homo sapiens
agaugggacuccuccuuua

SEQ ID NO: 525273 - RNA, 19 nt, Homo sapiens
cgagcagucuucuggauug

SEQ ID NO: 525274 - RNA, 19 nt, Homo sapiens
uaacaugucagaagaaagu

SEQ ID NO: 525275 - RNA, 19 nt, Homo sapiens
cuauguaccuguuguuaug

SEQ ID NO: 525276 - RNA, 19 nt, Homo sapiens
ugaagacaauccuggaaga

SEQ ID NO: 525277 - RNA, 19 nt, Homo sapiens
aggaagacccacuacauua

SEQ ID NO: 525278 - RNA, 19 nt, Homo sapiens
gcugaacuauuuaacauac

SEQ ID NO: 525279 - RNA, 19 nt, Homo sapiens
gagauuugauggcaagaag

SEQ ID NO: 525280 - RNA, 19 nt, Homo sapiens
gccauuggauaaauaugaa

SEQ ID NO: 525281 - RNA, 19 nt, Homo sapiens
gaaagaagaagaaaagaga

SEQ ID NO: 525282 - RNA, 19 nt, Homo sapiens
uggcaacugugauauuuau

SEQ ID NO: 525283 - RNA, 19 nt, Homo sapiens
uuuaugaucugaagaagug

SEQ ID NO: 525284 - RNA, 19 nt, Homo sapiens
cguggcaacugugauauuu

SEQ ID NO: 525285 - RNA, 19 nt, Homo sapiens
caucagcccuugcccagau

SEQ ID NO: 525286 - RNA, 19 nt, Homo sapiens
gaauuguguugggaauauu

SEQ ID NO: 525287 - RNA, 19 nt, Homo sapiens
uuggaggacuucacuguaa

SEQ ID NO: 525288 - RNA, 19 nt, Homo sapiens
aacaagcucuguaaagaug

SEQ ID NO: 525289 - RNA, 19 nt, Homo sapiens
caagaauuguguugggaau

SEQ ID NO: 525290 - RNA, 19 nt, Homo sapiens
ggauagcauuuggagauau

SEQ ID NO: 525291 - RNA, 19 nt, Homo sapiens
gauaacauugcucacauga

SEQ ID NO: 525292 - RNA, 19 nt, Homo sapiens
gaagccaaauacauuaggu

SEQ ID NO: 525293 - RNA, 19 nt, Homo sapiens
gcuacacauuugagaagaa

SEQ ID NO: 525294 - RNA, 19 nt, Homo sapiens
agaauuguguugggaauau

SEQ ID NO: 525295 - RNA, 19 nt, Homo sapiens
gacccugucuauaaagaga

SEQ ID NO: 525296 - RNA, 19 nt, Homo sapiens
ggugggcauucccuuguuu

SEQ ID NO: 525297 - RNA, 19 nt, Homo sapiens
ggauuucuguucccuccuu

SEQ ID NO: 525298 - RNA, 19 nt, Homo sapiens
gaacauggaaacaacuucu

SEQ ID NO: 525299 - RNA, 19 nt, Homo sapiens
uaaggaaauggaagaguuu

SEQ ID NO: 525300 - RNA, 19 nt, Homo sapiens
acagcucaguuguuacuuu

SEQ ID NO: 525301 - RNA, 19 nt, Homo sapiens
ccaaauacauuagguucca

SEQ ID NO: 525302 - RNA, 19 nt, Homo sapiens
agucuucgauucucuguug

SEQ ID NO: 525303 - RNA, 19 nt, Homo sapiens
ugaaguggaaugacugaaa

SEQ ID NO: 525304 - RNA, 19 nt, Homo sapiens
ugggacuccuccuuuauuu

SEQ ID NO: 525305 - RNA, 19 nt, Homo sapiens
ucaaaagccugaaguggaa

SEQ ID NO: 525306 - RNA, 19 nt, Homo sapiens
gcagucuucuggauugagu

SEQ ID NO: 525307 - RNA, 19 nt, Homo sapiens
uacagccauuggauaaaua

SEQ ID NO: 525308 - RNA, 19 nt, Homo sapiens
agaaagugccaacaugauu

SEQ ID NO: 525309 - RNA, 19 nt, Homo sapiens
ggaaauggaagaguuugug

SEQ ID NO: 525310 - RNA, 19 nt, Homo sapiens
aagacccacuacauuauuu

SEQ ID NO: 525311 - RNA, 19 nt, Homo sapiens
ucuguuggcuacacauuug

SEQ ID NO: 525312 - RNA, 19 nt, Homo sapiens
uaacaagcucuguaaagau

SEQ ID NO: 525313 - RNA, 19 nt, Homo sapiens
gagcagucuucuggauuga

SEQ ID NO: 525314 - RNA, 19 nt, Homo sapiens
agaauacagccauuggaua

SEQ ID NO: 525315 - RNA, 19 nt, Homo sapiens
cucgauagauggauauaug

SEQ ID NO: 525316 - RNA, 19 nt, Homo sapiens
guaccacucuuuggaugug

SEQ ID NO: 525317 - RNA, 19 nt, Homo sapiens
caugucaaguagagauuug

SEQ ID NO: 525318 - RNA, 19 nt, Homo sapiens
caggaugucucugaaaugg

SEQ ID NO: 525319 - RNA, 19 nt, Homo sapiens
ugacuguguugacaucuuc

SEQ ID NO: 525320 - RNA, 19 nt, Homo sapiens
uaggaagacccacuacauu

SEQ ID NO: 525321 - RNA, 19 nt, Homo sapiens
uggcugaacuauuuaacau

SEQ ID NO: 525322 - RNA, 19 nt, Homo sapiens
ggaugcagcacgcaacaug

SEQ ID NO: 525323 - RNA, 19 nt, Homo sapiens
gggauuuaauacguacuuu

SEQ ID NO: 525324 - RNA, 19 nt, Homo sapiens
gaugaaacuacaagaguca

SEQ ID NO: 525325 - RNA, 19 nt, Homo sapiens
ucaggaccaugucaaguag

SEQ ID NO: 525326 - RNA, 19 nt, Homo sapiens
uagugaaguucuaggaaga

SEQ ID NO: 525327 - RNA, 19 nt, Homo sapiens
guacagucuucgauucucu

SEQ ID NO: 525328 - RNA, 19 nt, Homo sapiens
gaugggacuccuccuuuau

SEQ ID NO: 525329 - RNA, 19 nt, Homo sapiens
uacauuagguuccaauacu

SEQ ID NO: 525330 - RNA, 19 nt, Homo sapiens
aagguucuauggagauuug

SEQ ID NO: 525331 - RNA, 19 nt, Homo sapiens
auacagccauuggauaaau

SEQ ID NO: 525332 - RNA, 19 nt, Homo sapiens
caguaaaucaucugcuauu

SEQ ID NO: 525333 - RNA, 19 nt, Homo sapiens
ugaaauggacgucagucuu

SEQ ID NO: 525334 - RNA, 19 nt, Homo sapiens
ugauaacauugcucacaug

SEQ ID NO: 525335 - RNA, 19 nt, Homo sapiens
auacucgacuguacaagug

SEQ ID NO: 525336 - RNA, 19 nt, Homo sapiens
gcauuuggagauauaccua

SEQ ID NO: 525337 - RNA, 19 nt, Homo sapiens
gaagaaugguggaggauuu

SEQ ID NO: 525338 - RNA, 19 nt, Homo sapiens
gcaagaagccaaauacuuu

SEQ ID NO: 525339 - RNA, 19 nt, Homo sapiens
uaacauugcucacaugaaa

SEQ ID NO: 525340 - RNA, 19 nt, Homo sapiens
gaauacagccauuggauaa

SEQ ID NO: 525341 - RNA, 19 nt, Homo sapiens
gcauugaagucagucauua

SEQ ID NO: 525342 - RNA, 19 nt, Homo sapiens
uuacugagcuuccuuaugu

SEQ ID NO: 525343 - RNA, 19 nt, Homo sapiens
gagauuugcucaaugcauu

SEQ ID NO: 525344 - RNA, 19 nt, Homo sapiens
gaagaaagugccaacauga

SEQ ID NO: 525345 - RNA, 19 nt, Homo sapiens
cauaugaucugaagaagug

SEQ ID NO: 525346 - RNA, 19 nt, Homo sapiens
gggaauauucugacuauaa

SEQ ID NO: 525347 - RNA, 19 nt, Homo sapiens
gaaccaauggcaucuauga

SEQ ID NO: 525348 - RNA, 19 nt, Homo sapiens
gaacaagaaacuuaugaga

SEQ ID NO: 525349 - RNA, 19 nt, Homo sapiens
cagcucaguuguuacuuua

SEQ ID NO: 525350 - RNA, 19 nt, Homo sapiens
gcagcucaguuguuacuuu

SEQ ID NO: 525351 - RNA, 19 nt, Homo sapiens
aaagaagcauugcauaaga

SEQ ID NO: 525352 - RNA, 19 nt, Homo sapiens
gaagaaaagggauuaguua

SEQ ID NO: 525353 - RNA, 19 nt, Homo sapiens
gaagaagugggaccaguuu

SEQ ID NO: 525354 - RNA, 19 nt, Homo sapiens
ugaugcagcucaguuguua

SEQ ID NO: 525355 - RNA, 19 nt, Homo sapiens
caagaagccaaauacuuua

SEQ ID NO: 525356 - RNA, 19 nt, Homo sapiens
uaacauacccuuucuguac

SEQ ID NO: 525357 - RNA, 19 nt, Homo sapiens
gaaagugccaacaugauug

SEQ ID NO: 525358 - RNA, 19 nt, Homo sapiens
gaaauggaugucagucuuu

SEQ ID NO: 525359 - RNA, 19 nt, Homo sapiens
gaaaagaagcauugcauaa

SEQ ID NO: 525360 - RNA, 19 nt, Homo sapiens
cuaaggaaauggaagaguu

SEQ ID NO: 525361 - RNA, 19 nt, Homo sapiens
gaagacccacuacauuauu

SEQ ID NO: 525362 - RNA, 19 nt, Homo sapiens
gccaguaaaucaucugcua

SEQ ID NO: 525363 - RNA, 19 nt, Homo sapiens
auuaacaacuccacucaua

SEQ ID NO: 525364 - RNA, 19 nt, Homo sapiens
gacccuaucuauaaagaga

SEQ ID NO: 525365 - RNA, 19 nt, Homo sapiens
ggaagacccacuacauuau

SEQ ID NO: 525366 - RNA, 19 nt, Homo sapiens
ucaguaacaugucagaaga

SEQ ID NO: 525367 - RNA, 19 nt, Homo sapiens
ugaaauggaugucagucuu

SEQ ID NO: 525368 - RNA, 19 nt, Homo sapiens
ggaugucucugaaauggau

SEQ ID NO: 525369 - RNA, 19 nt, Homo sapiens
cuuaugggcuuauauugaa

SEQ ID NO: 525370 - RNA, 19 nt, Homo sapiens
agaagaaagugccaacaug

SEQ ID NO: 525371 - RNA, 19 nt, Homo sapiens
gaugaucaguaacauguca

SEQ ID NO: 525372 - RNA, 19 nt, Homo sapiens
gauagauggacauauagua

SEQ ID NO: 525373 - RNA, 19 nt, Homo sapiens
caacuccacucauaguauc

SEQ ID NO: 525374 - RNA, 19 nt, Homo sapiens
guagagauuugcucaaugc

SEQ ID NO: 525375 - RNA, 19 nt, Homo sapiens
uucgauagauggacauaua

SEQ ID NO: 525376 - RNA, 19 nt, Homo sapiens
agaugggacuccuccuuua

SEQ ID NO: 525377 - RNA, 19 nt, Homo sapiens
cgagcagucuucuggauug

SEQ ID NO: 525378 - RNA, 19 nt, Homo sapiens
uaacaugucagaagaaagu

SEQ ID NO: 525379 - RNA, 19 nt, Homo sapiens
cuauguaccuguuguuaug

SEQ ID NO: 525380 - RNA, 19 nt, Homo sapiens
gcuacacaguugagaagaa

SEQ ID NO: 525381 - RNA, 19 nt, Homo sapiens
ugaagacaauccuggaaga

SEQ ID NO: 525382 - RNA, 19 nt, Homo sapiens
aggaagacccacuacauua

SEQ ID NO: 525383 - RNA, 19 nt, Homo sapiens
gagauuugauggcaagaag

SEQ ID NO: 525384 - RNA, 19 nt, Homo sapiens
gcugcuggcugaacuacuu

SEQ ID NO: 525385 - RNA, 19 nt, Homo sapiens
gccauuggauaaauaugaa

SEQ ID NO: 525386 - RNA, 19 nt, Homo sapiens
caucagcccuugcccagau

SEQ ID NO: 525387 - RNA, 19 nt, Homo sapiens
gaauuguguugggaauauu

SEQ ID NO: 525388 - RNA, 19 nt, Homo sapiens
uuggaggacuucacuguaa

SEQ ID NO: 525389 - RNA, 19 nt, Homo sapiens
auauaaagcucugugaaga

SEQ ID NO: 525390 - RNA, 19 nt, Homo sapiens
caagaauuguguugggaau

SEQ ID NO: 525391 - RNA, 19 nt, Homo sapiens
gauaacauugcucacauga

SEQ ID NO: 525392 - RNA, 19 nt, Homo sapiens
gaagccaaauacuuuaggu

SEQ ID NO: 525393 - RNA, 19 nt, Homo sapiens
agaauuguguugggaauau

SEQ ID NO: 525394 - RNA, 19 nt, Homo sapiens
gucaugaggugauuguguu

SEQ ID NO: 525395 - RNA, 19 nt, Homo sapiens
ggugggcauucccuuguuu

SEQ ID NO: 525396 - RNA, 19 nt, Homo sapiens
ggauuucuguucccuccuu

SEQ ID NO: 525397 - RNA, 19 nt, Homo sapiens
uaaggaaauggaagaguuu

SEQ ID NO: 525398 - RNA, 19 nt, Homo sapiens
ucaagcauaugaucugaag

SEQ ID NO: 525399 - RNA, 19 nt, Homo sapiens
ggcaagaagccaaauacuu

SEQ ID NO: 525400 - RNA, 19 nt, Homo sapiens
aaagaaacaacaacuggaa

SEQ ID NO: 525401 - RNA, 19 nt, Homo sapiens
cacaaaauguugccuguuu

SEQ ID NO: 525402 - RNA, 19 nt, Homo sapiens
cagccaaacccuugccuaa

SEQ ID NO: 525403 - RNA, 19 nt, Homo sapiens
auaaagcucugugaagaug

SEQ ID NO: 525404 - RNA, 19 nt, Homo sapiens
uaacaacuccacucauagu

SEQ ID NO: 525405 - RNA, 19 nt, Homo sapiens
ucaaaagccugaaguggaa

SEQ ID NO: 525406 - RNA, 19 nt, Homo sapiens
cguggcaacuaugauauuu

SEQ ID NO: 525407 - RNA, 19 nt, Homo sapiens
uacagccauuggauaaaua

SEQ ID NO: 525408 - RNA, 19 nt, Homo sapiens
gcagucuucuggauugagu

SEQ ID NO: 525409 - RNA, 19 nt, Homo sapiens
agaaagugccaacaugauu

SEQ ID NO: 525410 - RNA, 19 nt, Homo sapiens
ggaaauggaagaguuugug

SEQ ID NO: 525411 - RNA, 19 nt, Homo sapiens
aagacccacuacauuauuu

SEQ ID NO: 525412 - RNA, 19 nt, Homo sapiens
gagcagucuucuggauuga

SEQ ID NO: 525413 - RNA, 19 nt, Homo sapiens
agaauacagccauuggaua

SEQ ID NO: 525414 - RNA, 19 nt, Homo sapiens
cuacacaguugagaagaau

SEQ ID NO: 525415 - RNA, 19 nt, Homo sapiens
caggaugucucugaaaugg

SEQ ID NO: 525416 - RNA, 19 nt, Homo sapiens
gaaguggaaugaccaaaag

SEQ ID NO: 525417 - RNA, 19 nt, Homo sapiens
guaccacucuuuggaugug

SEQ ID NO: 525418 - RNA, 19 nt, Homo sapiens
caugucaaguagagauuug

SEQ ID NO: 525419 - RNA, 19 nt, Homo sapiens
uaggaagacccacuacauu

SEQ ID NO: 525420 - RNA, 19 nt, Homo sapiens
gugauuguguugacaucuu

SEQ ID NO: 525421 - RNA, 19 nt, Homo sapiens
aagcauaugaucugaagaa

SEQ ID NO: 525422 - RNA, 19 nt, Homo sapiens
agucuccgcuucucuguug

SEQ ID NO: 525423 - RNA, 19 nt, Homo sapiens
ggaaaagaagcauugcaua

SEQ ID NO: 525424 - RNA, 19 nt, Homo sapiens
ccaggaauuuaauauguac

SEQ ID NO: 525425 - RNA, 19 nt, Homo sapiens
uuucacaacuuacccuguu

SEQ ID NO: 525426 - RNA, 19 nt, Homo sapiens
ucaggaccaugucaaguag

SEQ ID NO: 525427 - RNA, 19 nt, Homo sapiens
uagugaaguucuaggaaga

SEQ ID NO: 525428 - RNA, 19 nt, Homo sapiens
gaugggacuccuccuuuau

SEQ ID NO: 525429 - RNA, 19 nt, Homo sapiens
auacagccauuggauaaau

SEQ ID NO: 525430 - RNA, 19 nt, Homo sapiens
gaguuugucaugcgccaua

SEQ ID NO: 525431 - RNA, 19 nt, Homo sapiens
aagguucuauggagauuug

SEQ ID NO: 525432 - RNA, 19 nt, Homo sapiens
cuacuuaacauacccuuuc

SEQ ID NO: 525433 - RNA, 19 nt, Homo sapiens
uggcugaacuacuuaacau

SEQ ID NO: 525434 - RNA, 19 nt, Homo sapiens
caguaaaucaucugcuauu

SEQ ID NO: 525435 - RNA, 19 nt, Homo sapiens
ugauaacauugcucacaug

SEQ ID NO: 525436 - RNA, 19 nt, Homo sapiens
uggaaccaauggcaucuau

SEQ ID NO: 525437 - RNA, 19 nt, Homo sapiens
ccaggaaucuuuaacagua

SEQ ID NO: 525438 - RNA, 19 nt, Homo sapiens
gacgagcuaugaagucuua

SEQ ID NO: 525439 - RNA, 19 nt, Homo sapiens
uaaauugguucacucauug

SEQ ID NO: 525440 - RNA, 19 nt, Homo sapiens
acacuaaacucauagaaug

SEQ ID NO: 525441 - RNA, 19 nt, Homo sapiens
gauauugccuuugugcuuu

SEQ ID NO: 525442 - RNA, 19 nt, Homo sapiens
caaagaaucuaggaaacaa

SEQ ID NO: 525443 - RNA, 19 nt, Homo sapiens
cagaagacauugcuaacaa

SEQ ID NO: 525444 - RNA, 19 nt, Homo sapiens
gaaauggccauauuaaaca

SEQ ID NO: 525445 - RNA, 19 nt, Homo sapiens
ggaaacaacacuaaacuca

SEQ ID NO: 525446 - RNA, 19 nt, Homo sapiens
caaaagaaauggccauauu

SEQ ID NO: 525447 - RNA, 19 nt, Homo sapiens
ggauauugcuagaauggaa

SEQ ID NO: 525448 - RNA, 19 nt, Homo sapiens
agaaguccauguaugauuu

SEQ ID NO: 525449 - RNA, 19 nt, Homo sapiens
gcuuggugcugccuuguua

SEQ ID NO: 525450 - RNA, 19 nt, Homo sapiens
gguaaauggugcuaaugaa

SEQ ID NO: 525451 - RNA, 19 nt, Homo sapiens
gaaauaagcauagcacagu

SEQ ID NO: 525452 - RNA, 19 nt, Homo sapiens
ugugauagcucaucuuuua

SEQ ID NO: 525453 - RNA, 19 nt, Homo sapiens
uaagaacugugacaugaug

SEQ ID NO: 525454 - RNA, 19 nt, Homo sapiens
ucccaaauaugaaaggaua

SEQ ID NO: 525455 - RNA, 19 nt, Homo sapiens
guggagugcuguugggaua

SEQ ID NO: 525456 - RNA, 19 nt, Homo sapiens
aaaggauaaugcagaagua

SEQ ID NO: 525457 - RNA, 19 nt, Homo sapiens
gaaaggauaaugcagaagu

SEQ ID NO: 525458 - RNA, 19 nt, Homo sapiens
uagcauacgucccagaguu

SEQ ID NO: 525459 - RNA, 19 nt, Homo sapiens
gaagcacuagugaagguua

SEQ ID NO: 525460 - RNA, 19 nt, Homo sapiens
gagcuggugucaaguaucu

SEQ ID NO: 525461 - RNA, 19 nt, Homo sapiens
acuaagaacugugacauga

SEQ ID NO: 525462 - RNA, 19 nt, Homo sapiens
gaaagccauauguacauuu

SEQ ID NO: 525463 - RNA, 19 nt, Homo sapiens
gauccagggucugaagaaa

SEQ ID NO: 525464 - RNA, 19 nt, Homo sapiens
cauggugguuugaacagua

SEQ ID NO: 525465 - RNA, 19 nt, Homo sapiens
gacccacucugccuaaugu

SEQ ID NO: 525466 - RNA, 19 nt, Homo sapiens
gagaaguccauguaugauu

SEQ ID NO: 525467 - RNA, 19 nt, Homo sapiens
uuaccucauuuccagauua

SEQ ID NO: 525468 - RNA, 19 nt, Homo sapiens
agucuguggucuagaaaua

SEQ ID NO: 525469 - RNA, 19 nt, Homo sapiens
agaagacauugcuaacaaa

SEQ ID NO: 525470 - RNA, 19 nt, Homo sapiens
ucacagaccgcaugaacuu

SEQ ID NO: 525471 - RNA, 19 nt, Homo sapiens
cuaaugauauguguggauu

SEQ ID NO: 525472 - RNA, 19 nt, Homo sapiens
guuaaagcaucgcuaucaa

SEQ ID NO: 525473 - RNA, 19 nt, Homo sapiens
caccucagaugcuuuccua

SEQ ID NO: 525474 - RNA, 19 nt, Homo sapiens
agacauugcuaacaaacug

SEQ ID NO: 525475 - RNA, 19 nt, Homo sapiens
ugaaagccauauguacauu

SEQ ID NO: 525476 - RNA, 19 nt, Homo sapiens
gccaagagacgagcuauga

SEQ ID NO: 525477 - RNA, 19 nt, Homo sapiens
ggauaaugcagaaguacaa

SEQ ID NO: 525478 - RNA, 19 nt, Homo sapiens
ggauauugccuuugugcuu

SEQ ID NO: 525479 - RNA, 19 nt, Homo sapiens
cuagugaagguuaucaaua

SEQ ID NO: 525480 - RNA, 19 nt, Homo sapiens
guccauguaugauuugguu

SEQ ID NO: 525481 - RNA, 19 nt, Homo sapiens
gcauacgucccagaguuua

SEQ ID NO: 525482 - RNA, 19 nt, Homo sapiens
caaucgaacuguuugacau

SEQ ID NO: 525483 - RNA, 19 nt, Homo sapiens
gcgcuacccaggaaucuuu

SEQ ID NO: 525484 - RNA, 19 nt, Homo sapiens
ucagagggcucagaagcuu

SEQ ID NO: 525485 - RNA, 19 nt, Homo sapiens
gaaacaacacuaaacucau

SEQ ID NO: 525486 - RNA, 19 nt, Homo sapiens
gguggacccuaaugauaug

SEQ ID NO: 525487 - RNA, 19 nt, Homo sapiens
uccaagaugcggaauauuu

SEQ ID NO: 525488 - RNA, 19 nt, Homo sapiens
uauacuuucucuugucuug

SEQ ID NO: 525489 - RNA, 19 nt, Homo sapiens
ggagaccauuaugauacua

SEQ ID NO: 525490 - RNA, 19 nt, Homo sapiens
gcuugggcauucaaagauu

SEQ ID NO: 525491 - RNA, 19 nt, Homo sapiens
accagaagaucuccaaaga

SEQ ID NO: 525492 - RNA, 19 nt, Homo sapiens
gaugcuguguacugacgua

SEQ ID NO: 525493 - RNA, 19 nt, Homo sapiens
aaugauauguguggauuug

SEQ ID NO: 525494 - RNA, 19 nt, Homo sapiens
agucuuacacuccauauuu

SEQ ID NO: 525495 - RNA, 19 nt, Homo sapiens
acaauggaauccucaaugg

SEQ ID NO: 525496 - RNA, 19 nt, Homo sapiens
ggguaaauggugcuaauga

SEQ ID NO: 525497 - RNA, 19 nt, Homo sapiens
caaaccagccagcccacua

SEQ ID NO: 525498 - RNA, 19 nt, Homo sapiens
ugccuaauguuguuuaugu

SEQ ID NO: 525499 - RNA, 19 nt, Homo sapiens
uuaacucacuccucacaga

SEQ ID NO: 525500 - RNA, 19 nt, Homo sapiens
gggugcuccugcuccauua

SEQ ID NO: 525501 - RNA, 19 nt, Homo sapiens
cagcccaggugauagaaau

SEQ ID NO: 525502 - RNA, 19 nt, Homo sapiens
cgacagcccaggugauaga

SEQ ID NO: 525503 - RNA, 19 nt, Homo sapiens
gcauagcacaguuaaugga

SEQ ID NO: 525504 - RNA, 19 nt, Homo sapiens
aagcauagcacaguuaaug

SEQ ID NO: 525505 - RNA, 19 nt, Homo sapiens
uaaugaacauggcuuuguc

SEQ ID NO: 525506 - RNA, 19 nt, Homo sapiens
cuggaucacuauacuaaga

SEQ ID NO: 525507 - RNA, 19 nt, Homo sapiens
cgagagaggccaccauaca

SEQ ID NO: 525508 - RNA, 19 nt, Homo sapiens
agaaauggccauauuaaac

SEQ ID NO: 525509 - RNA, 19 nt, Homo sapiens
aaauaagcauagcacaguu

SEQ ID NO: 525510 - RNA, 19 nt, Homo sapiens
cuugggcauucaaagauua

SEQ ID NO: 525511 - RNA, 19 nt, Homo sapiens
gccuaauguuguuuaugua

SEQ ID NO: 525512 - RNA, 19 nt, Homo sapiens
caagacccacucugccuaa

SEQ ID NO: 525513 - RNA, 19 nt, Homo sapiens
cgagggaggacacgguuaa

SEQ ID NO: 525514 - RNA, 19 nt, Homo sapiens
ugacauacuggaucacuau

SEQ ID NO: 525515 - RNA, 19 nt, Homo sapiens
gguuaaagcaucgcuauca

SEQ ID NO: 525516 - RNA, 19 nt, Homo sapiens
uaaauggugcuaaugaaca

SEQ ID NO: 525517 - RNA, 19 nt, Homo sapiens
cuccaaagauggguaaaug

SEQ ID NO: 525518 - RNA, 19 nt, Homo sapiens
caacuggccuuugguaucc

SEQ ID NO: 525519 - RNA, 19 nt, Homo sapiens
ggacccuaaugauaugugu

SEQ ID NO: 525520 - RNA, 19 nt, Homo sapiens
uccagggucugaagaaaga

SEQ ID NO: 525521 - RNA, 19 nt, Homo sapiens
gccgacagcccaggugaua

SEQ ID NO: 525522 - RNA, 19 nt, Homo sapiens
caacacuaaacucauagaa

SEQ ID NO: 525523 - RNA, 19 nt, Homo sapiens
ugauauguguggauuugug

SEQ ID NO: 525524 - RNA, 19 nt, Homo sapiens
aauaagcauagcacaguua

SEQ ID NO: 525525 - RNA, 19 nt, Homo sapiens
gaaguccauguaugauuug

SEQ ID NO: 525526 - RNA, 19 nt, Homo sapiens
gcaaucgaacuguuugaca

SEQ ID NO: 525527 - RNA, 19 nt, Homo sapiens
caaaaggcauggggauauu

SEQ ID NO: 525528 - RNA, 19 nt, Homo sapiens
caagagacgagcuaugaag

SEQ ID NO: 525529 - RNA, 19 nt, Homo sapiens
ggaggacacgguuaaagca

SEQ ID NO: 525530 - RNA, 19 nt, Homo sapiens
ccaaagaaucuaggaaaca

SEQ ID NO: 525531 - RNA, 19 nt, Homo sapiens
gauauguguggauuuguga

SEQ ID NO: 525532 - RNA, 19 nt, Homo sapiens
gaacugugacaugaugguu

SEQ ID NO: 525533 - RNA, 19 nt, Homo sapiens
gugcugccuuguuauacuu

SEQ ID NO: 525534 - RNA, 19 nt, Homo sapiens
ggacccaaaccaaagaauc

SEQ ID NO: 525535 - RNA, 19 nt, Homo sapiens
aaaagucuguggucuagaa

SEQ ID NO: 525536 - RNA, 19 nt, Homo sapiens
caucagaucuccuuuuguc

SEQ ID NO: 525537 - RNA, 19 nt, Homo sapiens
aaacaggacuucaacauca

SEQ ID NO: 525538 - RNA, 19 nt, Homo sapiens
ggacaguguugacgaggaa

SEQ ID NO: 525539 - RNA, 19 nt, Homo sapiens
gcaagauggugcucugaau

SEQ ID NO: 525540 - RNA, 19 nt, Homo sapiens
ggucagugcucuaaacauc

SEQ ID NO: 525541 - RNA, 19 nt, Homo sapiens
uaaagaguguggcaaaaua

SEQ ID NO: 525542 - RNA, 19 nt, Homo sapiens
caucagagacagagagaaa

SEQ ID NO: 525543 - RNA, 19 nt, Homo sapiens
ggaaagcccugugcuccau

SEQ ID NO: 525544 - RNA, 19 nt, Homo sapiens
gaagugggagugucauaga

SEQ ID NO: 525545 - RNA, 19 nt, Homo sapiens
ucgacaaggucuucaugua

SEQ ID NO: 525546 - RNA, 19 nt, Homo sapiens
gcaaacaggacuucaacau

SEQ ID NO: 525547 - RNA, 19 nt, Homo sapiens
aauccuggcugucgagaaa

SEQ ID NO: 525548 - RNA, 19 nt, Homo sapiens
gggcagccaucucugacuu

SEQ ID NO: 525549 - RNA, 19 nt, Homo sapiens
guccagauguuccgguuug

SEQ ID NO: 525550 - RNA, 19 nt, Homo sapiens
agacucaacuauccaagug

SEQ ID NO: 525551 - RNA, 19 nt, Homo sapiens
gggaccagauuccgaagug

SEQ ID NO: 525552 - RNA, 19 nt, Homo sapiens
gacgaggacugcaaaucga

SEQ ID NO: 525553 - RNA, 19 nt, Homo sapiens
cagccugugucuuuaaaug

SEQ ID NO: 525554 - RNA, 19 nt, Homo sapiens
gccaacccgucuuuccuuu

SEQ ID NO: 525555 - RNA, 19 nt, Homo sapiens
ggacagaugcccacacacu

SEQ ID NO: 525556 - RNA, 19 nt, Homo sapiens
gacugcaaaucgaauaaug

SEQ ID NO: 525557 - RNA, 19 nt, Homo sapiens
gaaaagaaaguucaugcuu

SEQ ID NO: 525558 - RNA, 19 nt, Homo sapiens
caacccgucuuuccuuugg

SEQ ID NO: 525559 - RNA, 19 nt, Homo sapiens
gacagaugcccacacacua

SEQ ID NO: 525560 - RNA, 19 nt, Homo sapiens
caggacagaugcccacaca

SEQ ID NO: 525561 - RNA, 19 nt, Homo sapiens
gaggacugcaaaucgaaua

SEQ ID NO: 525562 - RNA, 19 nt, Homo sapiens
ugacuuggaugcugauggu

SEQ ID NO: 525563 - RNA, 19 nt, Homo sapiens
gcucaugaccaacugcuau

SEQ ID NO: 525564 - RNA, 19 nt, Homo sapiens
caaacaggacuucaacauc

SEQ ID NO: 525565 - RNA, 19 nt, Homo sapiens
ggugcuaucuagaccugaa

SEQ ID NO: 525566 - RNA, 19 nt, Homo sapiens
ccaauggucagugcucuaa

SEQ ID NO: 525567 - RNA, 19 nt, Homo sapiens
ggacaccagacaucagaga

SEQ ID NO: 525568 - RNA, 19 nt, Homo sapiens
ggacugggugucuguagug

SEQ ID NO: 525569 - RNA, 19 nt, Homo sapiens
gcaagugccagcugaagag

SEQ ID NO: 525570 - RNA, 19 nt, Homo sapiens
ggagugucauagaucaauc

SEQ ID NO: 525571 - RNA, 19 nt, Homo sapiens
caagauggugcucugaaug

SEQ ID NO: 525572 - RNA, 19 nt, Homo sapiens
cgacaaggucuucauguac

SEQ ID NO: 525573 - RNA, 19 nt, Homo sapiens
ccaccuugacccugacuuu

SEQ ID NO: 525574 - RNA, 19 nt, Homo sapiens
caucauccgugaccucaac

SEQ ID NO: 525575 - RNA, 19 nt, Homo sapiens
ugugaggagugcaguauag

SEQ ID NO: 525576 - RNA, 19 nt, Homo sapiens
gugggagugucauagauca

SEQ ID NO: 525577 - RNA, 19 nt, Homo sapiens
ucaauguggugggcagcua

SEQ ID NO: 525578 - RNA, 19 nt, Homo sapiens
ucacaacugcagccacuga

SEQ ID NO: 525579 - RNA, 19 nt, Homo sapiens
gcacugcucaugaccaacu

SEQ ID NO: 525580 - RNA, 19 nt, Homo sapiens
augaaacccaugccacuua

SEQ ID NO: 525581 - RNA, 19 nt, Homo sapiens
ucugugacaccaugaauga

SEQ ID NO: 525582 - RNA, 19 nt, Homo sapiens
ccaaggcuccuccgugaca

SEQ ID NO: 525583 - RNA, 19 nt, Homo sapiens
ugacaccucagaagcaaga

SEQ ID NO: 525584 - RNA, 19 nt, Homo sapiens
gugguggccucuugguuca

SEQ ID NO: 525585 - RNA, 19 nt, Homo sapiens
gauuugcacugcucaugac

SEQ ID NO: 525586 - RNA, 19 nt, Homo sapiens
ggcgaccugucccgauuug

SEQ ID NO: 525587 - RNA, 19 nt, Homo sapiens
ugaaacccaugccacuuac

SEQ ID NO: 525588 - RNA, 19 nt, Homo sapiens
ggacugcaaaucgaauaau

SEQ ID NO: 525589 - RNA, 19 nt, Homo sapiens
gcagcuacuugugcguaug

SEQ ID NO: 525590 - RNA, 19 nt, Homo sapiens
gggacugggugucuguagu

SEQ ID NO: 525591 - RNA, 19 nt, Homo sapiens
uguucagccugccuucuuu

SEQ ID NO: 525592 - RNA, 19 nt, Homo sapiens
ugugacaccaugaaugaaa

SEQ ID NO: 525593 - RNA, 19 nt, Homo sapiens
cgauuugcacugcucauga

SEQ ID NO: 525594 - RNA, 19 nt, Homo sapiens
uccgugaccucaacaucaa

SEQ ID NO: 525595 - RNA, 19 nt, Homo sapiens
gcuacuacgucuacaaccu

SEQ ID NO: 525596 - RNA, 19 nt, Homo sapiens
guauagacgaggacugcaa

SEQ ID NO: 525597 - RNA, 19 nt, Homo sapiens
ggcagcuacuugugcguau

SEQ ID NO: 525598 - RNA, 19 nt, Homo sapiens
ccaccugcacggaggauga

SEQ ID NO: 525599 - RNA, 19 nt, Homo sapiens
gagacucaacuauccaagu

SEQ ID NO: 525600 - RNA, 19 nt, Homo sapiens
ggugcucgggcuucaauga

SEQ ID NO: 525601 - RNA, 19 nt, Homo sapiens
uauagacgaggacugcaaa

SEQ ID NO: 525602 - RNA, 19 nt, Homo sapiens
gacaucagagacagagaga

SEQ ID NO: 525603 - RNA, 19 nt, Homo sapiens
ccuuaaagaguguggcaaa

SEQ ID NO: 525604 - RNA, 19 nt, Homo sapiens
acacuagagacucaacuau

SEQ ID NO: 525605 - RNA, 19 nt, Homo sapiens
gacugggugucuguaguga

SEQ ID NO: 525606 - RNA, 19 nt, Homo sapiens
agccaucucugacuuggau

SEQ ID NO: 525607 - RNA, 19 nt, Homo sapiens
gauggugcucugaauguca

SEQ ID NO: 525608 - RNA, 19 nt, Homo sapiens
ccacugaggcuuuucucua

SEQ ID NO: 525609 - RNA, 19 nt, Homo sapiens
cccucuaccuggcagauga

SEQ ID NO: 525610 - RNA, 19 nt, Homo sapiens
gcuaucuagaccugaagua

SEQ ID NO: 525611 - RNA, 19 nt, Homo sapiens
ccagugcuccagccacaga

SEQ ID NO: 525612 - RNA, 19 nt, Homo sapiens
ggccaacccgucuuuccuu

SEQ ID NO: 525613 - RNA, 19 nt, Homo sapiens
gggagugucauagaucaau

SEQ ID NO: 525614 - RNA, 19 nt, Homo sapiens
cacacuagagacucaacua

SEQ ID NO: 525615 - RNA, 19 nt, Homo sapiens
ccucuugguucaucacaac

SEQ ID NO: 525616 - RNA, 19 nt, Homo sapiens
gggcgaccugucccgauuu

SEQ ID NO: 525617 - RNA, 19 nt, Homo sapiens
gcucugaaugucacagcaa

SEQ ID NO: 525618 - RNA, 19 nt, Homo sapiens
ucagugcucuaaacaucag

SEQ ID NO: 525619 - RNA, 19 nt, Homo sapiens
ccgaagugggagugucaua

SEQ ID NO: 525620 - RNA, 19 nt, Homo sapiens
acuagagacucaacuaucc

SEQ ID NO: 525621 - RNA, 19 nt, Homo sapiens
aagauggugcucugaaugu

SEQ ID NO: 525622 - RNA, 19 nt, Homo sapiens
cagaugcccacacacuaga

SEQ ID NO: 525623 - RNA, 19 nt, Homo sapiens
uugcacugcucaugaccaa

SEQ ID NO: 525624 - RNA, 19 nt, Homo sapiens
gaaguaugcugaugugauc

SEQ ID NO: 525625 - RNA, 19 nt, Homo sapiens
agaaaucacugaagggaaa

SEQ ID NO: 525626 - RNA, 19 nt, Homo sapiens
gagaugaaaugccuuugau

SEQ ID NO: 525627 - RNA, 19 nt, Homo sapiens
gaauucugcuugccaacaa

SEQ ID NO: 525628 - RNA, 19 nt, Homo sapiens
ggugaugccuaauuaugaa

SEQ ID NO: 525629 - RNA, 19 nt, Homo sapiens
ccuaugacauuacuguauu

SEQ ID NO: 525630 - RNA, 19 nt, Homo sapiens
ggagaugaaaugccuuuga

SEQ ID NO: 525631 - RNA, 19 nt, Homo sapiens
ggcgagcccuuccuuauag

SEQ ID NO: 525632 - RNA, 19 nt, Homo sapiens
gcucaucuguacauacugu

SEQ ID NO: 525633 - RNA, 19 nt, Homo sapiens
cgagaccuguuccagauga

SEQ ID NO: 525634 - RNA, 19 nt, Homo sapiens
aaagaaguaugcugaugug

SEQ ID NO: 525635 - RNA, 19 nt, Homo sapiens
agaaugagguggacuaucg

SEQ ID NO: 525636 - RNA, 19 nt, Homo sapiens
caaagaaguaugcugaugu

SEQ ID NO: 525637 - RNA, 19 nt, Homo sapiens
cggcaagucuuccgugugu

SEQ ID NO: 525638 - RNA, 19 nt, Homo sapiens
uacuggugaugccuaauua

SEQ ID NO: 525639 - RNA, 19 nt, Homo sapiens
gcacugcucaucuguacau

SEQ ID NO: 525640 - RNA, 19 nt, Homo sapiens
acaaagaaguaugcugaug

SEQ ID NO: 525641 - RNA, 19 nt, Homo sapiens
cggaugccuuugacaauga

SEQ ID NO: 525642 - RNA, 19 nt, Homo sapiens
ggaaggaggagacaguuac

SEQ ID NO: 525643 - RNA, 19 nt, Homo sapiens
gagagaggcagggaucuug

SEQ ID NO: 525644 - RNA, 19 nt, Homo sapiens
uacgagaccuguuccagau

SEQ ID NO: 525645 - RNA, 19 nt, Homo sapiens
cggcgagcccuuccuuaua

SEQ ID NO: 525646 - RNA, 19 nt, Homo sapiens
gaaaacaccauggagauga

SEQ ID NO: 525647 - RNA, 19 nt, Homo sapiens
ccaaacggcagaccaaugg

SEQ ID NO: 525648 - RNA, 19 nt, Homo sapiens
cagacguggugcucuuuga

SEQ ID NO: 525649 - RNA, 19 nt, Homo sapiens
ggaugccuuugacaaugaa

SEQ ID NO: 525650 - RNA, 19 nt, Homo sapiens
gagccaggauagcuucuac

SEQ ID NO: 525651 - RNA, 19 nt, Homo sapiens
uuaugaauccaacguguaa

SEQ ID NO: 525652 - RNA, 19 nt, Homo sapiens
gaacagcuagcggcaaguc

SEQ ID NO: 525653 - RNA, 19 nt, Homo sapiens
gcggcgagcccuuccuuau

SEQ ID NO: 525654 - RNA, 19 nt, Homo sapiens
guacauuacguucgucaag

SEQ ID NO: 525655 - RNA, 19 nt, Homo sapiens
ccgcagacguggugcucuu

SEQ ID NO: 525656 - RNA, 19 nt, Homo sapiens
cuacuggugaugccuaauu

SEQ ID NO: 525657 - RNA, 19 nt, Homo sapiens
cccuagaggugcagauaau

SEQ ID NO: 525658 - RNA, 19 nt, Homo sapiens
ccggaugccuuugacaaug

SEQ ID NO: 525659 - RNA, 19 nt, Homo sapiens
gcagaaugagguggacuau

SEQ ID NO: 525660 - RNA, 19 nt, Homo sapiens
ggaauucugcuugccaaca

SEQ ID NO: 525661 - RNA, 19 nt, Homo sapiens
cggaaggaggagacaguua

SEQ ID NO: 525662 - RNA, 19 nt, Homo sapiens
uaacaaaacugugccaacu

SEQ ID NO: 525663 - RNA, 19 nt, Homo sapiens
gguggacuaucgccagaag

SEQ ID NO: 525664 - RNA, 19 nt, Homo sapiens
gagaccuguuccagaugaa

SEQ ID NO: 525665 - RNA, 19 nt, Homo sapiens
gcagacguggugcucuuug

SEQ ID NO: 525666 - RNA, 19 nt, Homo sapiens
gauaaucugguggccauca

SEQ ID NO: 525667 - RNA, 19 nt, Homo sapiens
uguacauacuguuuccuau

SEQ ID NO: 525668 - RNA, 19 nt, Homo sapiens
ggcagaaugagguggacua

SEQ ID NO: 525669 - RNA, 19 nt, Homo sapiens
acuguuuccuaugacauua

SEQ ID NO: 525670 - RNA, 19 nt, Homo sapiens
gaggcacugcucaucugua

SEQ ID NO: 525671 - RNA, 19 nt, Homo sapiens
ugaccacccggaugccuuu

SEQ ID NO: 525672 - RNA, 19 nt, Homo sapiens
aaacugugccaacuacuac

SEQ ID NO: 525673 - RNA, 19 nt, Homo sapiens
agaaguaugcugaugugau

SEQ ID NO: 525674 - RNA, 19 nt, Homo sapiens
caagccugccuuugaggaa

SEQ ID NO: 525675 - RNA, 19 nt, Homo sapiens
gaaggaggagacaguuacu

SEQ ID NO: 525676 - RNA, 19 nt, Homo sapiens
uggugaugccuaauuauga

SEQ ID NO: 525677 - RNA, 19 nt, Homo sapiens
cugcucaucuguacauacu

SEQ ID NO: 525678 - RNA, 19 nt, Homo sapiens
uaucucaguacauuacguu

SEQ ID NO: 525679 - RNA, 19 nt, Homo sapiens
ggacuagacugcuuuguua

SEQ ID NO: 525680 - RNA, 19 nt, Homo sapiens
gaaggucacugaugccaua

SEQ ID NO: 525681 - RNA, 19 nt, Homo sapiens
ggaaagaaacaaaggauua

SEQ ID NO: 525682 - RNA, 19 nt, Homo sapiens
gaaagucacuggcuggaaa

SEQ ID NO: 525683 - RNA, 19 nt, Homo sapiens
cagcagagauguacagaaa

SEQ ID NO: 525684 - RNA, 19 nt, Homo sapiens
caccucagcuuccagauua

SEQ ID NO: 525685 - RNA, 19 nt, Homo sapiens
gaacuaagcgucuuguaga

SEQ ID NO: 525686 - RNA, 19 nt, Homo sapiens
ugaaggagguaucuuuaaa

SEQ ID NO: 525687 - RNA, 19 nt, Homo sapiens
gugaagacauugaagauau

SEQ ID NO: 525688 - RNA, 19 nt, Homo sapiens
gaugaggucuugccauguu

SEQ ID NO: 525689 - RNA, 19 nt, Homo sapiens
gaagacucauguagauauu

SEQ ID NO: 525690 - RNA, 19 nt, Homo sapiens
guuagggucuuccacauuu

SEQ ID NO: 525691 - RNA, 19 nt, Homo sapiens
ggagcacucugaauuuguu

SEQ ID NO: 525692 - RNA, 19 nt, Homo sapiens
ggagguaucuuuaaaauag

SEQ ID NO: 525693 - RNA, 19 nt, Homo sapiens
ccgcauugauacuauaaua

SEQ ID NO: 525694 - RNA, 19 nt, Homo sapiens
gaggagcacucugaauuug

SEQ ID NO: 525695 - RNA, 19 nt, Homo sapiens
gaccggaaguuugcagaua

SEQ ID NO: 525696 - RNA, 19 nt, Homo sapiens
gccaugaguucuugauauu

SEQ ID NO: 525697 - RNA, 19 nt, Homo sapiens
gcugaagacucauguagau

SEQ ID NO: 525698 - RNA, 19 nt, Homo sapiens
gaguagacuugguguuuga

SEQ ID NO: 525699 - RNA, 19 nt, Homo sapiens
gggcagaucuaguaaaugc

SEQ ID NO: 525700 - RNA, 19 nt, Homo sapiens
caugaguucuugauauuug

SEQ ID NO: 525701 - RNA, 19 nt, Homo sapiens
ccacguccaucuaaauuuc

SEQ ID NO: 525702 - RNA, 19 nt, Homo sapiens
cauuguaggucguggcaua

SEQ ID NO: 525703 - RNA, 19 nt, Homo sapiens
ugaaaggccugcaagaagu

SEQ ID NO: 525704 - RNA, 19 nt, Homo sapiens
gaaguuugcagauauagga

SEQ ID NO: 525705 - RNA, 19 nt, Homo sapiens
ugagucagguugcagauau

SEQ ID NO: 525706 - RNA, 19 nt, Homo sapiens
aaaggaagcacccaaagaa

SEQ ID NO: 525707 - RNA, 19 nt, Homo sapiens
acaagaaguuauuggcaaa

SEQ ID NO: 525708 - RNA, 19 nt, Homo sapiens
cgugcaggcuuucaaguuu

SEQ ID NO: 525709 - RNA, 19 nt, Homo sapiens
ggaguucucauggucuuua

SEQ ID NO: 525710 - RNA, 19 nt, Homo sapiens
guaugaaggagguaucuuu

SEQ ID NO: 525711 - RNA, 19 nt, Homo sapiens
gaaacaaaggauuauggaa

SEQ ID NO: 525712 - RNA, 19 nt, Homo sapiens
ggagugcaguggugagauc

SEQ ID NO: 525713 - RNA, 19 nt, Homo sapiens
gaaggagaccaaucugugu

SEQ ID NO: 525714 - RNA, 19 nt, Homo sapiens
gaaggaaagaaacaaagga

SEQ ID NO: 525715 - RNA, 19 nt, Homo sapiens
guagaaggaacuauuaauc

SEQ ID NO: 525716 - RNA, 19 nt, Homo sapiens
ggaacuaagcgucuuguag

SEQ ID NO: 525717 - RNA, 19 nt, Homo sapiens
ugaagacauugaagauaug

SEQ ID NO: 525718 - RNA, 19 nt, Homo sapiens
ccggaaguuugcagauaua

SEQ ID NO: 525719 - RNA, 19 nt, Homo sapiens
uaaaggaagcacccaaaga

SEQ ID NO: 525720 - RNA, 19 nt, Homo sapiens
cagccuaauugcaguaaga

SEQ ID NO: 525721 - RNA, 19 nt, Homo sapiens
guacaauagcccacaagaa

SEQ ID NO: 525722 - RNA, 19 nt, Homo sapiens
ggaagcaggaggagauaau

SEQ ID NO: 525723 - RNA, 19 nt, Homo sapiens
uaugaaggagguaucuuua

SEQ ID NO: 525724 - RNA, 19 nt, Homo sapiens
uuauacagcuuugccauug

SEQ ID NO: 525725 - RNA, 19 nt, Homo sapiens
agacugcuuuguuauucua

SEQ ID NO: 525726 - RNA, 19 nt, Homo sapiens
ucaccgcauugauacuaua

SEQ ID NO: 525727 - RNA, 19 nt, Homo sapiens
caauagcccacaagaaguu

SEQ ID NO: 525728 - RNA, 19 nt, Homo sapiens
gaagugggccugccuuugc

SEQ ID NO: 525729 - RNA, 19 nt, Homo sapiens
gauauaggaaacacaguga

SEQ ID NO: 525730 - RNA, 19 nt, Homo sapiens
caaaggauuauggaacuaa

SEQ ID NO: 525731 - RNA, 19 nt, Homo sapiens
ucaaagugcugggauuaca

SEQ ID NO: 525732 - RNA, 19 nt, Homo sapiens
gaccgcgucuucugaguca

SEQ ID NO: 525733 - RNA, 19 nt, Homo sapiens
ggaagcguauuugaguaga

SEQ ID NO: 525734 - RNA, 19 nt, Homo sapiens
ugaggagcacucugaauuu

SEQ ID NO: 525735 - RNA, 19 nt, Homo sapiens
ugaagacucauguagauau

SEQ ID NO: 525736 - RNA, 19 nt, Homo sapiens
gcaccaagaggcuaaaguc

SEQ ID NO: 525737 - RNA, 19 nt, Homo sapiens
gggacuagacugcuuuguu

SEQ ID NO: 525738 - RNA, 19 nt, Homo sapiens
cuagacugcuuuguuauuc

SEQ ID NO: 525739 - RNA, 19 nt, Homo sapiens
gugcaggcuuucaaguuug

SEQ ID NO: 525740 - RNA, 19 nt, Homo sapiens
ugaguagacuugguguuug

SEQ ID NO: 525741 - RNA, 19 nt, Homo sapiens
uacaauagcccacaagaag

SEQ ID NO: 525742 - RNA, 19 nt, Homo sapiens
aagcaugaaaccagaauuu

SEQ ID NO: 525743 - RNA, 19 nt, Homo sapiens
agaaggaacuauuaaucca

SEQ ID NO: 525744 - RNA, 19 nt, Homo sapiens
gagucagguugcagauauu

SEQ ID NO: 525745 - RNA, 19 nt, Homo sapiens
gucacuggcuggaaauaau

SEQ ID NO: 525746 - RNA, 19 nt, Homo sapiens
gcagagauguacagaaaag

SEQ ID NO: 525747 - RNA, 19 nt, Homo sapiens
gaaaggccugcaagaagug

SEQ ID NO: 525748 - RNA, 19 nt, Homo sapiens
accaguggaucuaguguuu

SEQ ID NO: 525749 - RNA, 19 nt, Homo sapiens
gcaccaccacguccaucua

SEQ ID NO: 525750 - RNA, 19 nt, Homo sapiens
cugaauuuguuguugguuu

SEQ ID NO: 525751 - RNA, 19 nt, Homo sapiens
uuuggaaacuguugagguu

SEQ ID NO: 525752 - RNA, 19 nt, Homo sapiens
caaucaaauuccaaugcuu

SEQ ID NO: 525753 - RNA, 19 nt, Homo sapiens
gugaaaggccugcaagaag

SEQ ID NO: 525754 - RNA, 19 nt, Homo sapiens
ugccaugaguucuugauau

SEQ ID NO: 525755 - RNA, 19 nt, Homo sapiens
ggaaacuguugagguucuu

SEQ ID NO: 525756 - RNA, 19 nt, Homo sapiens
gcuaaagucagcacagcuu

SEQ ID NO: 525757 - RNA, 19 nt, Homo sapiens
ggagugccuuauacagcuu

SEQ ID NO: 525758 - RNA, 19 nt, Homo sapiens
gugucuaucugcugauguu

SEQ ID NO: 525759 - RNA, 19 nt, Homo sapiens
ucaggagaaugucuuugug

SEQ ID NO: 525760 - RNA, 19 nt, Homo sapiens
acaaaggauuauggaacua

SEQ ID NO: 525761 - RNA, 19 nt, Homo sapiens
caaccaaucaaauuccaau

SEQ ID NO: 525762 - RNA, 19 nt, Homo sapiens
ggaagcagcagagauguac

SEQ ID NO: 525763 - RNA, 19 nt, Homo sapiens
uauaggaaacacagugaaa

SEQ ID NO: 525764 - RNA, 19 nt, Homo sapiens
ggaagcacccaaagaacuc

SEQ ID NO: 525765 - RNA, 19 nt, Homo sapiens
ccaaucaaauuccaaugcu

SEQ ID NO: 525766 - RNA, 19 nt, Homo sapiens
ucucaaagugcugggauua

SEQ ID NO: 525767 - RNA, 19 nt, Homo sapiens
uguacgacgugcaggcuuu

SEQ ID NO: 525768 - RNA, 19 nt, Homo sapiens
ugggaagcguauuugagua

SEQ ID NO: 525769 - RNA, 19 nt, Homo sapiens
gcacucugaauuuguuguu

SEQ ID NO: 525770 - RNA, 19 nt, Homo sapiens
cugaggagcacucugaauu

SEQ ID NO: 525771 - RNA, 19 nt, Homo sapiens
gaaggagguaucuuuaaaa

SEQ ID NO: 525772 - RNA, 19 nt, Homo sapiens
gugaugaaggaguugauaa

SEQ ID NO: 525773 - RNA, 19 nt, Homo sapiens
uauaaaggaagcacccaaa

SEQ ID NO: 525774 - RNA, 19 nt, Homo sapiens
cuaauugcaguaagacaaa

SEQ ID NO: 525775 - RNA, 19 nt, Homo sapiens
cugggcagaucuaguaaau

SEQ ID NO: 525776 - RNA, 19 nt, Homo sapiens
ucuaucugcugauguuuca

SEQ ID NO: 525777 - RNA, 19 nt, Homo sapiens
uagagcagcgguuagaaug

SEQ ID NO: 525778 - RNA, 19 nt, Homo sapiens
ugauaacucuggcaaaaug

SEQ ID NO: 525779 - RNA, 19 nt, Homo sapiens
ggaauaagcaguggaauuu

SEQ ID NO: 525780 - RNA, 19 nt, Homo sapiens
gaagacagaugaggucaaa

SEQ ID NO: 525781 - RNA, 19 nt, Homo sapiens
gaaccaggcuguccaggaa

SEQ ID NO: 525782 - RNA, 19 nt, Homo sapiens
caacauggcuucggccuaa

SEQ ID NO: 525783 - RNA, 19 nt, Homo sapiens
gaaguaagcugggucuugu

SEQ ID NO: 525784 - RNA, 19 nt, Homo sapiens
ggaaggagcugugaucauc

SEQ ID NO: 525785 - RNA, 19 nt, Homo sapiens
cuacagacauagaggauuu

SEQ ID NO: 525786 - RNA, 19 nt, Homo sapiens
gaaaucacuuugggauauu

SEQ ID NO: 525787 - RNA, 19 nt, Homo sapiens
gcugugagcuuuaucagau

SEQ ID NO: 525788 - RNA, 19 nt, Homo sapiens
gaacucgaauggccuuguu

SEQ ID NO: 525789 - RNA, 19 nt, Homo sapiens
gcaguuguguccuggcuaa

SEQ ID NO: 525790 - RNA, 19 nt, Homo sapiens
gaaagcauuacacuguuua

SEQ ID NO: 525791 - RNA, 19 nt, Homo sapiens
ugaaaucacuuugggauau

SEQ ID NO: 525792 - RNA, 19 nt, Homo sapiens
gaacaaggaagaggagaaa

SEQ ID NO: 525793 - RNA, 19 nt, Homo sapiens
uaagauugcugugagcuuu

SEQ ID NO: 525794 - RNA, 19 nt, Homo sapiens
gcagugccauugauaggaa

SEQ ID NO: 525795 - RNA, 19 nt, Homo sapiens
gaaguacucaugcagauau

SEQ ID NO: 525796 - RNA, 19 nt, Homo sapiens
cugcaacacuggaaaguuu

SEQ ID NO: 525797 - RNA, 19 nt, Homo sapiens
agacagaugaggucaaaua

SEQ ID NO: 525798 - RNA, 19 nt, Homo sapiens
uaagagaccgagagaagua

SEQ ID NO: 525799 - RNA, 19 nt, Homo sapiens
uuacgaaguuccacugaaa

SEQ ID NO: 525800 - RNA, 19 nt, Homo sapiens
ggagaacauuuauaaagag

SEQ ID NO: 525801 - RNA, 19 nt, Homo sapiens
auaaagaguugucuacaga

SEQ ID NO: 525802 - RNA, 19 nt, Homo sapiens
gaagaaagaaagcauuaca

SEQ ID NO: 525803 - RNA, 19 nt, Homo sapiens
cagaagaaagaaagcauua

SEQ ID NO: 525804 - RNA, 19 nt, Homo sapiens
uaagcugggucuuguuauu

SEQ ID NO: 525805 - RNA, 19 nt, Homo sapiens
gauaagagaccgagagaag

SEQ ID NO: 525806 - RNA, 19 nt, Homo sapiens
aaagaaagcauuacacugu

SEQ ID NO: 525807 - RNA, 19 nt, Homo sapiens
cagcacagacugccaagua

SEQ ID NO: 525808 - RNA, 19 nt, Homo sapiens
aauaagcaguggaauuuga

SEQ ID NO: 525809 - RNA, 19 nt, Homo sapiens
guacucaugcagauauaua

SEQ ID NO: 525810 - RNA, 19 nt, Homo sapiens
ucaguuggcucucuuuauc

SEQ ID NO: 525811 - RNA, 19 nt, Homo sapiens
agaagcugcuguuaacgua

SEQ ID NO: 525812 - RNA, 19 nt, Homo sapiens
gcugggaccuguuccacaa

SEQ ID NO: 525813 - RNA, 19 nt, Homo sapiens
cagaugaggucaaauacuc

SEQ ID NO: 525814 - RNA, 19 nt, Homo sapiens
agaaagcauuacacuguuu

SEQ ID NO: 525815 - RNA, 19 nt, Homo sapiens
gaggucaaauacucaguug

SEQ ID NO: 525816 - RNA, 19 nt, Homo sapiens
gcucacgggcucugcuuua

SEQ ID NO: 525817 - RNA, 19 nt, Homo sapiens
acgcgagguuuguuaauaa

SEQ ID NO: 525818 - RNA, 19 nt, Homo sapiens
ggacaggauccauaucaug

SEQ ID NO: 525819 - RNA, 19 nt, Homo sapiens
gggauuuguugcagaagaa

SEQ ID NO: 525820 - RNA, 19 nt, Homo sapiens
gaaguuccacugaaaauuu

SEQ ID NO: 525821 - RNA, 19 nt, Homo sapiens
gaagcggcaccauguacua

SEQ ID NO: 525822 - RNA, 19 nt, Homo sapiens
gcagaagaaagaaagcauu

SEQ ID NO: 525823 - RNA, 19 nt, Homo sapiens
gggcucugcuuuaguguuc

SEQ ID NO: 525824 - RNA, 19 nt, Homo sapiens
gcauuacacuguuuaucca

SEQ ID NO: 525825 - RNA, 19 nt, Homo sapiens
ggaauuugaacaaggaaga

SEQ ID NO: 525826 - RNA, 19 nt, Homo sapiens
caagccaacucucauaagg

SEQ ID NO: 525827 - RNA, 19 nt, Homo sapiens
caucaagccaacucucaua

SEQ ID NO: 525828 - RNA, 19 nt, Homo sapiens
gcaccuccauccuugaucu

SEQ ID NO: 525829 - RNA, 19 nt, Homo sapiens
ccaguuuggagaacauuua

SEQ ID NO: 525830 - RNA, 19 nt, Homo sapiens
uacgcgagguuuguuaaua

SEQ ID NO: 525831 - RNA, 19 nt, Homo sapiens
uauagaggguucuuuggau

SEQ ID NO: 525832 - RNA, 19 nt, Homo sapiens
uaaaagaugugaagguugu

SEQ ID NO: 525833 - RNA, 19 nt, Homo sapiens
caaaugucuuucucugcaa

SEQ ID NO: 525834 - RNA, 19 nt, Homo sapiens
aagaaagcauuacacuguu

SEQ ID NO: 525835 - RNA, 19 nt, Homo sapiens
gcaguggaauuugaacaag

SEQ ID NO: 525836 - RNA, 19 nt, Homo sapiens
uaaaucagaacucgaaugg

SEQ ID NO: 525837 - RNA, 19 nt, Homo sapiens
gaauaagcaguggaauuug

SEQ ID NO: 525838 - RNA, 19 nt, Homo sapiens
gcauaaggauguuuugcaa

SEQ ID NO: 525839 - RNA, 19 nt, Homo sapiens
gguuagacuuucagugaca

SEQ ID NO: 525840 - RNA, 19 nt, Homo sapiens
guuacgaaguuccacugaa

SEQ ID NO: 525841 - RNA, 19 nt, Homo sapiens
guauagaggguucuuugga

SEQ ID NO: 525842 - RNA, 19 nt, Homo sapiens
uuaucaagcuaaugggauu

SEQ ID NO: 525843 - RNA, 19 nt, Homo sapiens
uauaaagaguugucuacag

SEQ ID NO: 525844 - RNA, 19 nt, Homo sapiens
guaguagagguuaagauug

SEQ ID NO: 525845 - RNA, 19 nt, Homo sapiens
uguaguagagguuaagauu

SEQ ID NO: 525846 - RNA, 19 nt, Homo sapiens
ccagaaagcagccaugaac

SEQ ID NO: 525847 - RNA, 19 nt, Homo sapiens
aagcugcuguuaacguauu

SEQ ID NO: 525848 - RNA, 19 nt, Homo sapiens
cauaaaagaugugaagguu

SEQ ID NO: 525849 - RNA, 19 nt, Homo sapiens
uaguagagguuaagauugc

SEQ ID NO: 525850 - RNA, 19 nt, Homo sapiens
aagaaguacucaugcagau

SEQ ID NO: 525851 - RNA, 19 nt, Homo sapiens
gaauggcagcuguauccaa

SEQ ID NO: 525852 - RNA, 19 nt, Homo sapiens
uugagaagcugcuguuaac

SEQ ID NO: 525853 - RNA, 19 nt, Homo sapiens
uguccuggcuaaaucagaa

SEQ ID NO: 525854 - RNA, 19 nt, Homo sapiens
agaagcccauugacuggaa

SEQ ID NO: 525855 - RNA, 19 nt, Homo sapiens
gggacaggauccauaucau

SEQ ID NO: 525856 - RNA, 19 nt, Homo sapiens
aguaagcugggucuuguua

SEQ ID NO: 525857 - RNA, 19 nt, Homo sapiens
gacuuucagugacagaugu

SEQ ID NO: 525858 - RNA, 19 nt, Homo sapiens
gagaagcugcuguuaacgu

SEQ ID NO: 525859 - RNA, 19 nt, Homo sapiens
agaggguucuuuggaugua

SEQ ID NO: 525860 - RNA, 19 nt, Homo sapiens
aaugggauuuguugcagaa

SEQ ID NO: 525861 - RNA, 19 nt, Homo sapiens
cacgggcucugcuuuagug

SEQ ID NO: 525862 - RNA, 19 nt, Homo sapiens
uaucauggaccuaaucaag

SEQ ID NO: 525863 - RNA, 19 nt, Homo sapiens
gggaaaccguauuuuauca

SEQ ID NO: 525864 - RNA, 19 nt, Homo sapiens
ggucugcaccuccauccuu

SEQ ID NO: 525865 - RNA, 19 nt, Homo sapiens
cuaggguuauguccaguug

SEQ ID NO: 525866 - RNA, 19 nt, Homo sapiens
uggaauaagcaguggaauu

SEQ ID NO: 525867 - RNA, 19 nt, Homo sapiens
gagguuaagauugcuguga

SEQ ID NO: 525868 - RNA, 19 nt, Homo sapiens
guuaacguauuugccaguu

SEQ ID NO: 525869 - RNA, 19 nt, Homo sapiens
gcucaucccuccccuuugu

SEQ ID NO: 525870 - RNA, 19 nt, Homo sapiens
gaauggccuuguuuucuug

SEQ ID NO: 525871 - RNA, 19 nt, Homo sapiens
cgaauggccuuguuuucuu

SEQ ID NO: 525872 - RNA, 19 nt, Homo sapiens
guuguguccuggcuaaauc

SEQ ID NO: 525873 - RNA, 19 nt, Homo sapiens
cgcgagguuuguuaauaaa

SEQ ID NO: 525874 - RNA, 19 nt, Homo sapiens
guuagucggguuagaguug

SEQ ID NO: 525875 - RNA, 19 nt, Homo sapiens
agacugccaaguacuguuu

SEQ ID NO: 525876 - RNA, 19 nt, Homo sapiens
cugguuagacuuucaguga

SEQ ID NO: 525877 - RNA, 19 nt, Homo sapiens
gcugagggguggccuuuga

SEQ ID NO: 525878 - RNA, 19 nt, Homo sapiens
gcuaaugggauuuguugca

SEQ ID NO: 525879 - RNA, 19 nt, Homo sapiens
ggaauaagcaguggaauuu

SEQ ID NO: 525880 - RNA, 19 nt, Homo sapiens
gaagacagaugaggucaaa

SEQ ID NO: 525881 - RNA, 19 nt, Homo sapiens
gaaccaggcuguccaggaa

SEQ ID NO: 525882 - RNA, 19 nt, Homo sapiens
caacauggcuucggccuaa

SEQ ID NO: 525883 - RNA, 19 nt, Homo sapiens
gaaguaagcugggucuugu

SEQ ID NO: 525884 - RNA, 19 nt, Homo sapiens
ggaaggagcugugaucauc

SEQ ID NO: 525885 - RNA, 19 nt, Homo sapiens
cuacagacauagaggauuu

SEQ ID NO: 525886 - RNA, 19 nt, Homo sapiens
gaaaucacuuugggauauu

SEQ ID NO: 525887 - RNA, 19 nt, Homo sapiens
gcugugagcuuuaucagau

SEQ ID NO: 525888 - RNA, 19 nt, Homo sapiens
gaacucgaauggccuuguu

SEQ ID NO: 525889 - RNA, 19 nt, Homo sapiens
gcaguuguguccuggcuaa

SEQ ID NO: 525890 - RNA, 19 nt, Homo sapiens
gaaagcauuacacuguuua

SEQ ID NO: 525891 - RNA, 19 nt, Homo sapiens
ugaaaucacuuugggauau

SEQ ID NO: 525892 - RNA, 19 nt, Homo sapiens
gaacaaggaagaggagaaa

SEQ ID NO: 525893 - RNA, 19 nt, Homo sapiens
uaagauugcugugagcuuu

SEQ ID NO: 525894 - RNA, 19 nt, Homo sapiens
gcagugccauugauaggaa

SEQ ID NO: 525895 - RNA, 19 nt, Homo sapiens
gaaguacucaugcagauau

SEQ ID NO: 525896 - RNA, 19 nt, Homo sapiens
cugcaacacuggaaaguuu

SEQ ID NO: 525897 - RNA, 19 nt, Homo sapiens
agacagaugaggucaaaua

SEQ ID NO: 525898 - RNA, 19 nt, Homo sapiens
uaagagaccgagagaagua

SEQ ID NO: 525899 - RNA, 19 nt, Homo sapiens
uuacgaaguuccacugaaa

SEQ ID NO: 525900 - RNA, 19 nt, Homo sapiens
ggagaacauuuauaaagag

SEQ ID NO: 525901 - RNA, 19 nt, Homo sapiens
auaaagaguugucuacaga

SEQ ID NO: 525902 - RNA, 19 nt, Homo sapiens
gaagaaagaaagcauuaca

SEQ ID NO: 525903 - RNA, 19 nt, Homo sapiens
cagaagaaagaaagcauua

SEQ ID NO: 525904 - RNA, 19 nt, Homo sapiens
uaagcugggucuuguuauu

SEQ ID NO: 525905 - RNA, 19 nt, Homo sapiens
gauaagagaccgagagaag

SEQ ID NO: 525906 - RNA, 19 nt, Homo sapiens
aaagaaagcauuacacugu

SEQ ID NO: 525907 - RNA, 19 nt, Homo sapiens
cagcacagacugccaagua

SEQ ID NO: 525908 - RNA, 19 nt, Homo sapiens
aauaagcaguggaauuuga

SEQ ID NO: 525909 - RNA, 19 nt, Homo sapiens
guacucaugcagauauaua

SEQ ID NO: 525910 - RNA, 19 nt, Homo sapiens
ucaguuggcucucuuuauc

SEQ ID NO: 525911 - RNA, 19 nt, Homo sapiens
agaagacgcucuacuccuu

SEQ ID NO: 525912 - RNA, 19 nt, Homo sapiens
agaagcugcuguuaacgua

SEQ ID NO: 525913 - RNA, 19 nt, Homo sapiens
cagaugaggucaaauacuc

SEQ ID NO: 525914 - RNA, 19 nt, Homo sapiens
agaaagcauuacacuguuu

SEQ ID NO: 525915 - RNA, 19 nt, Homo sapiens
gaggucaaauacucaguug

SEQ ID NO: 525916 - RNA, 19 nt, Homo sapiens
gcucacgggcucugcuuua

SEQ ID NO: 525917 - RNA, 19 nt, Homo sapiens
acgcgagguuuguuaauaa

SEQ ID NO: 525918 - RNA, 19 nt, Homo sapiens
ggacaggauccauaucaug

SEQ ID NO: 525919 - RNA, 19 nt, Homo sapiens
gggauuuguugcagaagaa

SEQ ID NO: 525920 - RNA, 19 nt, Homo sapiens
gaaguuccacugaaaauuu

SEQ ID NO: 525921 - RNA, 19 nt, Homo sapiens
gaagcggcaccauguacua

SEQ ID NO: 525922 - RNA, 19 nt, Homo sapiens
gcagaagaaagaaagcauu

SEQ ID NO: 525923 - RNA, 19 nt, Homo sapiens
gaagacgcucuacuccuuu

SEQ ID NO: 525924 - RNA, 19 nt, Homo sapiens
gggcucugcuuuaguguuc

SEQ ID NO: 525925 - RNA, 19 nt, Homo sapiens
gcauuacacuguuuaucca

SEQ ID NO: 525926 - RNA, 19 nt, Homo sapiens
ggaauuugaacaaggaaga

SEQ ID NO: 525927 - RNA, 19 nt, Homo sapiens
caagccaacucucauaagg

SEQ ID NO: 525928 - RNA, 19 nt, Homo sapiens
caucaagccaacucucaua

SEQ ID NO: 525929 - RNA, 19 nt, Homo sapiens
gcaccuccauccuugaucu

SEQ ID NO: 525930 - RNA, 19 nt, Homo sapiens
ccaguuuggagaacauuua

SEQ ID NO: 525931 - RNA, 19 nt, Homo sapiens
uacgcgagguuuguuaaua

SEQ ID NO: 525932 - RNA, 19 nt, Homo sapiens
uauagaggguucuuuggau

SEQ ID NO: 525933 - RNA, 19 nt, Homo sapiens
uaaaagaugugaagguugu

SEQ ID NO: 525934 - RNA, 19 nt, Homo sapiens
caaaugucuuucucugcaa

SEQ ID NO: 525935 - RNA, 19 nt, Homo sapiens
aagaaagcauuacacuguu

SEQ ID NO: 525936 - RNA, 19 nt, Homo sapiens
gcaguggaauuugaacaag

SEQ ID NO: 525937 - RNA, 19 nt, Homo sapiens
uaaaucagaacucgaaugg

SEQ ID NO: 525938 - RNA, 19 nt, Homo sapiens
gaauaagcaguggaauuug

SEQ ID NO: 525939 - RNA, 19 nt, Homo sapiens
gcauaaggauguuuugcaa

SEQ ID NO: 525940 - RNA, 19 nt, Homo sapiens
uuaucaagcuaaugggauu

SEQ ID NO: 525941 - RNA, 19 nt, Homo sapiens
gguuagacuuucagugaca

SEQ ID NO: 525942 - RNA, 19 nt, Homo sapiens
guuacgaaguuccacugaa

SEQ ID NO: 525943 - RNA, 19 nt, Homo sapiens
guauagaggguucuuugga

SEQ ID NO: 525944 - RNA, 19 nt, Homo sapiens
uauaaagaguugucuacag

SEQ ID NO: 525945 - RNA, 19 nt, Homo sapiens
guaguagagguuaagauug

SEQ ID NO: 525946 - RNA, 19 nt, Homo sapiens
uguaguagagguuaagauu

SEQ ID NO: 525947 - RNA, 19 nt, Homo sapiens
ccagaaagcagccaugaac

SEQ ID NO: 525948 - RNA, 19 nt, Homo sapiens
aagcugcuguuaacguauu

SEQ ID NO: 525949 - RNA, 19 nt, Homo sapiens
cauaaaagaugugaagguu

SEQ ID NO: 525950 - RNA, 19 nt, Homo sapiens
uaguagagguuaagauugc

SEQ ID NO: 525951 - RNA, 19 nt, Homo sapiens
aagaaguacucaugcagau

SEQ ID NO: 525952 - RNA, 19 nt, Homo sapiens
gaauggcagcuguauccaa

SEQ ID NO: 525953 - RNA, 19 nt, Homo sapiens
uugagaagcugcuguuaac

SEQ ID NO: 525954 - RNA, 19 nt, Homo sapiens
uguccuggcuaaaucagaa

SEQ ID NO: 525955 - RNA, 19 nt, Homo sapiens
agaagcccauugacuggaa

SEQ ID NO: 525956 - RNA, 19 nt, Homo sapiens
gggacaggauccauaucau

SEQ ID NO: 525957 - RNA, 19 nt, Homo sapiens
aguaagcugggucuuguua

SEQ ID NO: 525958 - RNA, 19 nt, Homo sapiens
gacuuucagugacagaugu

SEQ ID NO: 525959 - RNA, 19 nt, Homo sapiens
gagaagcugcuguuaacgu

SEQ ID NO: 525960 - RNA, 19 nt, Homo sapiens
agaggguucuuuggaugua

SEQ ID NO: 525961 - RNA, 19 nt, Homo sapiens
cacgggcucugcuuuagug

SEQ ID NO: 525962 - RNA, 19 nt, Homo sapiens
uaucauggaccuaaucaag

SEQ ID NO: 525963 - RNA, 19 nt, Homo sapiens
aaugggauuuguugcagaa

SEQ ID NO: 525964 - RNA, 19 nt, Homo sapiens
ggucugcaccuccauccuu

SEQ ID NO: 525965 - RNA, 19 nt, Homo sapiens
cuaggguuauguccaguug

SEQ ID NO: 525966 - RNA, 19 nt, Homo sapiens
uggaauaagcaguggaauu

SEQ ID NO: 525967 - RNA, 19 nt, Homo sapiens
gagguuaagauugcuguga

SEQ ID NO: 525968 - RNA, 19 nt, Homo sapiens
gggaaaccguauuuuauca

SEQ ID NO: 525969 - RNA, 19 nt, Homo sapiens
guuaacguauuugccaguu

SEQ ID NO: 525970 - RNA, 19 nt, Homo sapiens
gcucaucccuccccuuugu

SEQ ID NO: 525971 - RNA, 19 nt, Homo sapiens
gaauggccuuguuuucuug

SEQ ID NO: 525972 - RNA, 19 nt, Homo sapiens
cgaauggccuuguuuucuu

SEQ ID NO: 525973 - RNA, 19 nt, Homo sapiens
guuguguccuggcuaaauc

SEQ ID NO: 525974 - RNA, 19 nt, Homo sapiens
cgcgagguuuguuaauaaa

SEQ ID NO: 525975 - RNA, 19 nt, Homo sapiens
guuagucggguuagaguug

SEQ ID NO: 525976 - RNA, 19 nt, Homo sapiens
agacugccaaguacuguuu

SEQ ID NO: 525977 - RNA, 19 nt, Homo sapiens
cugguuagacuuucaguga

SEQ ID NO: 525978 - RNA, 19 nt, Homo sapiens
gcugagggguggccuuuga

SEQ ID NO: 525979 - RNA, 19 nt, Homo sapiens
gaagaaagaucgaguuaug

SEQ ID NO: 525980 - RNA, 19 nt, Homo sapiens
ggaaacaccugcuucauga

SEQ ID NO: 525981 - RNA, 19 nt, Homo sapiens
ccaaauggaugaagguuua

SEQ ID NO: 525982 - RNA, 19 nt, Homo sapiens
gaacagcugugaaggagaa

SEQ ID NO: 525983 - RNA, 19 nt, Homo sapiens
ggaauaaacuacuaaacug

SEQ ID NO: 525984 - RNA, 19 nt, Homo sapiens
gaagaccguuuaccuagaa

SEQ ID NO: 525985 - RNA, 19 nt, Homo sapiens
gaagaaguaugugggcuuu

SEQ ID NO: 525986 - RNA, 19 nt, Homo sapiens
agaacaaacugaaugguaa

SEQ ID NO: 525987 - RNA, 19 nt, Homo sapiens
aaacucaacucucgaucua

SEQ ID NO: 525988 - RNA, 19 nt, Homo sapiens
gaacagcugacauaaauuc

SEQ ID NO: 525989 - RNA, 19 nt, Homo sapiens
gaacugaagcucugugaga

SEQ ID NO: 525990 - RNA, 19 nt, Homo sapiens
gggauaagcucgacacagu

SEQ ID NO: 525991 - RNA, 19 nt, Homo sapiens
agacaacucugggcuauuu

SEQ ID NO: 525992 - RNA, 19 nt, Homo sapiens
gaacuccgcuuugcagugu

SEQ ID NO: 525993 - RNA, 19 nt, Homo sapiens
gaaauacccuucuuuuaug

SEQ ID NO: 525994 - RNA, 19 nt, Homo sapiens
uggaacagcugacauaaau

SEQ ID NO: 525995 - RNA, 19 nt, Homo sapiens
gaaacagccuuuaccugau

SEQ ID NO: 525996 - RNA, 19 nt, Homo sapiens
gagcauggccuguuuguca

SEQ ID NO: 525997 - RNA, 19 nt, Homo sapiens
gagcuuggacccuuaauga

SEQ ID NO: 525998 - RNA, 19 nt, Homo sapiens
gagccaccauccucucaua

SEQ ID NO: 525999 - RNA, 19 nt, Homo sapiens
gaucuacacuggccaugga

SEQ ID NO: 526000 - RNA, 19 nt, Homo sapiens
ggaaauacccuucuuuuau

SEQ ID NO: 526001 - RNA, 19 nt, Homo sapiens
gccuuuaccugaugaguuu

SEQ ID NO: 526002 - RNA, 19 nt, Homo sapiens
ugacauaaauucacuugca

SEQ ID NO: 526003 - RNA, 19 nt, Homo sapiens
gcgcagugguaucuuauug

SEQ ID NO: 526004 - RNA, 19 nt, Homo sapiens
gcaaagucgagguguauuu

SEQ ID NO: 526005 - RNA, 19 nt, Homo sapiens
ugaauuggacuauguauug

SEQ ID NO: 526006 - RNA, 19 nt, Homo sapiens
gguauuacuuugaugauag

SEQ ID NO: 526007 - RNA, 19 nt, Homo sapiens
gaacaaacugaaugguaaa

SEQ ID NO: 526008 - RNA, 19 nt, Homo sapiens
ucgcagauguguauaauca

SEQ ID NO: 526009 - RNA, 19 nt, Homo sapiens
ccaccaaugugcugaguug

SEQ ID NO: 526010 - RNA, 19 nt, Homo sapiens
gggugaacauaaccuauuu

SEQ ID NO: 526011 - RNA, 19 nt, Homo sapiens
cagcaaggccuuaugugua

SEQ ID NO: 526012 - RNA, 19 nt, Homo sapiens
ggaaauugcagaagccuau

SEQ ID NO: 526013 - RNA, 19 nt, Homo sapiens
cagcuuaugugcuauuuua

SEQ ID NO: 526014 - RNA, 19 nt, Homo sapiens
caaacugaaugguaaaugg

SEQ ID NO: 526015 - RNA, 19 nt, Homo sapiens
gaucugaaccggguaaaga

SEQ ID NO: 526016 - RNA, 19 nt, Homo sapiens
aaacacggcucuggaacaa

SEQ ID NO: 526017 - RNA, 19 nt, Homo sapiens
ucacuuagcaguucugguu

SEQ ID NO: 526018 - RNA, 19 nt, Homo sapiens
ccacugcccuugaagaaag

SEQ ID NO: 526019 - RNA, 19 nt, Homo sapiens
aaagaagaccguuuaccua

SEQ ID NO: 526020 - RNA, 19 nt, Homo sapiens
gagaagaugaggaagaaau

SEQ ID NO: 526021 - RNA, 19 nt, Homo sapiens
aaacagccuuuaccugaug

SEQ ID NO: 526022 - RNA, 19 nt, Homo sapiens
guaccaggcuguuugugau

SEQ ID NO: 526023 - RNA, 19 nt, Homo sapiens
aaucacagguugaggaaug

SEQ ID NO: 526024 - RNA, 19 nt, Homo sapiens
gaccuugaaagaacacuua

SEQ ID NO: 526025 - RNA, 19 nt, Homo sapiens
gaagaugagccaggaaaug

SEQ ID NO: 526026 - RNA, 19 nt, Homo sapiens
gaacauguccgaguuuguc

SEQ ID NO: 526027 - RNA, 19 nt, Homo sapiens
gcauggacaccaacuaaug

SEQ ID NO: 526028 - RNA, 19 nt, Homo sapiens
gacccucacugcagaccua

SEQ ID NO: 526029 - RNA, 19 nt, Homo sapiens
cagaugcggugguggcaaa

SEQ ID NO: 526030 - RNA, 19 nt, Homo sapiens
gggaaacaccugcuucaug

SEQ ID NO: 526031 - RNA, 19 nt, Homo sapiens
acacggcucuggaacaaau

SEQ ID NO: 526032 - RNA, 19 nt, Homo sapiens
gugcugaguugccauuuca

SEQ ID NO: 526033 - RNA, 19 nt, Homo sapiens
agaaguaugugggcuuuga

SEQ ID NO: 526034 - RNA, 19 nt, Homo sapiens
gguacugucccaacuguaa

SEQ ID NO: 526035 - RNA, 19 nt, Homo sapiens
gaagaucugaaccggguaa

SEQ ID NO: 526036 - RNA, 19 nt, Homo sapiens
gcaaauggugauagcacua

SEQ ID NO: 526037 - RNA, 19 nt, Homo sapiens
cagcauggacaccaacuaa

SEQ ID NO: 526038 - RNA, 19 nt, Homo sapiens
uguccgaguuugucuguaa

SEQ ID NO: 526039 - RNA, 19 nt, Homo sapiens
aaacguuucuccuacaaca

SEQ ID NO: 526040 - RNA, 19 nt, Homo sapiens
guucaaaacucaaguagga

SEQ ID NO: 526041 - RNA, 19 nt, Homo sapiens
gaaacacggcucuggaaca

SEQ ID NO: 526042 - RNA, 19 nt, Homo sapiens
gcgaagaacaaacugaaug

SEQ ID NO: 526043 - RNA, 19 nt, Homo sapiens
cuagauggauugcaugaag

SEQ ID NO: 526044 - RNA, 19 nt, Homo sapiens
gggcagccacuauugcuuu

SEQ ID NO: 526045 - RNA, 19 nt, Homo sapiens
ggucgcagauguguauaau

SEQ ID NO: 526046 - RNA, 19 nt, Homo sapiens
aggaagaaauggagcauca

SEQ ID NO: 526047 - RNA, 19 nt, Homo sapiens
aguuaacccuugagucuuu

SEQ ID NO: 526048 - RNA, 19 nt, Homo sapiens
cauggccucuucaaaucua

SEQ ID NO: 526049 - RNA, 19 nt, Homo sapiens
cugcuaguguucugucuaa

SEQ ID NO: 526050 - RNA, 19 nt, Homo sapiens
ucaaacguuucuccuacaa

SEQ ID NO: 526051 - RNA, 19 nt, Homo sapiens
cuugugaacuccuauggaa

SEQ ID NO: 526052 - RNA, 19 nt, Homo sapiens
ugaaggagaagaugaggaa

SEQ ID NO: 526053 - RNA, 19 nt, Homo sapiens
cguaucagccgcuauguga

SEQ ID NO: 526054 - RNA, 19 nt, Homo sapiens
gaucguaucagccgcuaug

SEQ ID NO: 526055 - RNA, 19 nt, Homo sapiens
gaauuggacuauguauugg

SEQ ID NO: 526056 - RNA, 19 nt, Homo sapiens
cagcaaggcagacaccauu

SEQ ID NO: 526057 - RNA, 19 nt, Homo sapiens
ucaagcaguggaagaagua

SEQ ID NO: 526058 - RNA, 19 nt, Homo sapiens
aagaacaaacugaauggua

SEQ ID NO: 526059 - RNA, 19 nt, Homo sapiens
aaagagaugcggaagcuau

SEQ ID NO: 526060 - RNA, 19 nt, Homo sapiens
gcagugguaucuuauugac

SEQ ID NO: 526061 - RNA, 19 nt, Homo sapiens
gcaguucugguuccucuga

SEQ ID NO: 526062 - RNA, 19 nt, Homo sapiens
acgucgagaugaugaauuu

SEQ ID NO: 526063 - RNA, 19 nt, Homo sapiens
gggaagaugagccaggaaa

SEQ ID NO: 526064 - RNA, 19 nt, Homo sapiens
ccaccauccucucauauac

SEQ ID NO: 526065 - RNA, 19 nt, Homo sapiens
gccaccauccucucauaua

SEQ ID NO: 526066 - RNA, 19 nt, Homo sapiens
gcgccuagcagaaauuuua

SEQ ID NO: 526067 - RNA, 19 nt, Homo sapiens
ggucaggugcuaguaauug

SEQ ID NO: 526068 - RNA, 19 nt, Homo sapiens
agaagaccguuuaccuaga

SEQ ID NO: 526069 - RNA, 19 nt, Homo sapiens
agucagaccuugaaagaac

SEQ ID NO: 526070 - RNA, 19 nt, Homo sapiens
aggagaagaugaggaagaa

SEQ ID NO: 526071 - RNA, 19 nt, Homo sapiens
gggaugacauuuucgugua

SEQ ID NO: 526072 - RNA, 19 nt, Homo sapiens
gucaggugcuaguaauuga

SEQ ID NO: 526073 - RNA, 19 nt, Homo sapiens
ggaaaugaccccagugaga

SEQ ID NO: 526074 - RNA, 19 nt, Homo sapiens
aaauggagcaucaggaaga

SEQ ID NO: 526075 - RNA, 19 nt, Homo sapiens
caaaggaagccugggagaa

SEQ ID NO: 526076 - RNA, 19 nt, Homo sapiens
guaugaagccgaaaucaac

SEQ ID NO: 526077 - RNA, 19 nt, Homo sapiens
uguauuugcuggaacugaa

SEQ ID NO: 526078 - RNA, 19 nt, Homo sapiens
ggaaaacuacuuaaacuca

SEQ ID NO: 526079 - RNA, 19 nt, Homo sapiens
gaacagauccggaagaaga

SEQ ID NO: 526080 - RNA, 19 nt, Homo sapiens
gggcgagccuguagaccua

SEQ ID NO: 526081 - RNA, 19 nt, Homo sapiens
gcuaacagcggcucaagaa

SEQ ID NO: 526082 - RNA, 19 nt, Homo sapiens
ucacggagcuggccaucau

SEQ ID NO: 526083 - RNA, 19 nt, Homo sapiens
cuaagcaagugccugguuu

SEQ ID NO: 526084 - RNA, 19 nt, Homo sapiens
agaagaagauucggaaaca

SEQ ID NO: 526085 - RNA, 19 nt, Homo sapiens
gaagaacagauccggaaga

SEQ ID NO: 526086 - RNA, 19 nt, Homo sapiens
gaagaagaagauucggaaa

SEQ ID NO: 526087 - RNA, 19 nt, Homo sapiens
uaaagaggaggacgaagaa

SEQ ID NO: 526088 - RNA, 19 nt, Homo sapiens
uggaggcgcugcuguccua

SEQ ID NO: 526089 - RNA, 19 nt, Homo sapiens
aagaacagauccggaagaa

SEQ ID NO: 526090 - RNA, 19 nt, Homo sapiens
cuaaagaggaggacgaaga

SEQ ID NO: 526091 - RNA, 19 nt, Homo sapiens
gagaucaugcugcuagaga

SEQ ID NO: 526092 - RNA, 19 nt, Homo sapiens
aacagcggcucaagaacua

SEQ ID NO: 526093 - RNA, 19 nt, Homo sapiens
ccagauggacgcuuucaug

SEQ ID NO: 526094 - RNA, 19 nt, Homo sapiens
gcucaucgccaucaacauc

SEQ ID NO: 526095 - RNA, 19 nt, Homo sapiens
cagaguguaucaccuucuu

SEQ ID NO: 526096 - RNA, 19 nt, Homo sapiens
guggcgaaguuaccuuuga

SEQ ID NO: 526097 - RNA, 19 nt, Homo sapiens
gaguguaucaccuucuuga

SEQ ID NO: 526098 - RNA, 19 nt, Homo sapiens
ccagaucgcccuccugaag

SEQ ID NO: 526099 - RNA, 19 nt, Homo sapiens
ggagcuggccaucaucuca

SEQ ID NO: 526100 - RNA, 19 nt, Homo sapiens
uaacagcggcucaagaacu

SEQ ID NO: 526101 - RNA, 19 nt, Homo sapiens
gcagugcguccuuucugaa

SEQ ID NO: 526102 - RNA, 19 nt, Homo sapiens
ugaccacccuccagcagau

SEQ ID NO: 526103 - RNA, 19 nt, Homo sapiens
gcuacaaccacgagacaga

SEQ ID NO: 526104 - RNA, 19 nt, Homo sapiens
guagaccuaucggcucuca

SEQ ID NO: 526105 - RNA, 19 nt, Homo sapiens
gcuaagcaagugccugguu

SEQ ID NO: 526106 - RNA, 19 nt, Homo sapiens
gaucguggacuucgcuaag

SEQ ID NO: 526107 - RNA, 19 nt, Homo sapiens
gcaacaaacgcuccuucuc

SEQ ID NO: 526108 - RNA, 19 nt, Homo sapiens
agacagaguguaucaccuu

SEQ ID NO: 526109 - RNA, 19 nt, Homo sapiens
gagcagugcguccuuucug

SEQ ID NO: 526110 - RNA, 19 nt, Homo sapiens
ccugccagauggacgcuuu

SEQ ID NO: 526111 - RNA, 19 nt, Homo sapiens
aggcgaggguguccagcua

SEQ ID NO: 526112 - RNA, 19 nt, Homo sapiens
caucccagaucccgaagag

SEQ ID NO: 526113 - RNA, 19 nt, Homo sapiens
gaaguggcgaaguuaccuu

SEQ ID NO: 526114 - RNA, 19 nt, Homo sapiens
gcagguggaguucaucaac

SEQ ID NO: 526115 - RNA, 19 nt, Homo sapiens
gaucaugcugcuagagaca

SEQ ID NO: 526116 - RNA, 19 nt, Homo sapiens
cuuugaggguauuugagua

SEQ ID NO: 526117 - RNA, 19 nt, Homo sapiens
cagggcaacaggaguaguu

SEQ ID NO: 526118 - RNA, 19 nt, Homo sapiens
ggcauccacuaucgagauc

SEQ ID NO: 526119 - RNA, 19 nt, Homo sapiens
cuacagcaaggacgacuuc

SEQ ID NO: 526120 - RNA, 19 nt, Homo sapiens
accacgaguucccuggaua

SEQ ID NO: 526121 - RNA, 19 nt, Homo sapiens
cuucuucacccacuguaaa

SEQ ID NO: 526122 - RNA, 19 nt, Homo sapiens
cauccacuaucgagaucau

SEQ ID NO: 526123 - RNA, 19 nt, Homo sapiens
gcaaggaggcagggaugag

SEQ ID NO: 526124 - RNA, 19 nt, Homo sapiens
gcacucggagcaggucuuc

SEQ ID NO: 526125 - RNA, 19 nt, Homo sapiens
caaccacgagacagagugu

SEQ ID NO: 526126 - RNA, 19 nt, Homo sapiens
gcgcuacaaccacgagaca

SEQ ID NO: 526127 - RNA, 19 nt, Homo sapiens
cugaaggcauccacuaucg

SEQ ID NO: 526128 - RNA, 19 nt, Homo sapiens
cucaagaacuaaugaucca

SEQ ID NO: 526129 - RNA, 19 nt, Homo sapiens
gcgaggguguccagcuaac

SEQ ID NO: 526130 - RNA, 19 nt, Homo sapiens
agcagugcguccuuucuga

SEQ ID NO: 526131 - RNA, 19 nt, Homo sapiens
aaacggaccuuaacaagaa

SEQ ID NO: 526132 - RNA, 19 nt, Homo sapiens
ucauaaagcugcuguacua

SEQ ID NO: 526133 - RNA, 19 nt, Homo sapiens
ugugaugacuugccauuaa

SEQ ID NO: 526134 - RNA, 19 nt, Homo sapiens
gggcauuccuucuaucuca

SEQ ID NO: 526135 - RNA, 19 nt, Homo sapiens
gugcagagcugggccuuga

SEQ ID NO: 526136 - RNA, 19 nt, Homo sapiens
ggccuugacugcccaggua

SEQ ID NO: 526137 - RNA, 19 nt, Homo sapiens
gugaugacuugccauuaaa

SEQ ID NO: 526138 - RNA, 19 nt, Homo sapiens
gaccugcugugaugacuug

SEQ ID NO: 526139 - RNA, 19 nt, Homo sapiens
gcuaugccauguauaaagu

SEQ ID NO: 526140 - RNA, 19 nt, Homo sapiens
uaaagcugcuguacuaugc

SEQ ID NO: 526141 - RNA, 19 nt, Homo sapiens
guaugggcauuccuucuau

SEQ ID NO: 526142 - RNA, 19 nt, Homo sapiens
gguaugggcauuccuucua

SEQ ID NO: 526143 - RNA, 19 nt, Homo sapiens
guuuggagaugugaaguuu

SEQ ID NO: 526144 - RNA, 19 nt, Homo sapiens
gggagccaaugcagagaaa

SEQ ID NO: 526145 - RNA, 19 nt, Homo sapiens
gguagagacuaucccaaca

SEQ ID NO: 526146 - RNA, 19 nt, Homo sapiens
gcugaaagucacaaugauu

SEQ ID NO: 526147 - RNA, 19 nt, Homo sapiens
ugagcuacuucaucaagaa

SEQ ID NO: 526148 - RNA, 19 nt, Homo sapiens
cugcagagcugagcgaguu

SEQ ID NO: 526149 - RNA, 19 nt, Homo sapiens
caauuucccagccuuguuu

SEQ ID NO: 526150 - RNA, 19 nt, Homo sapiens
gcaccuuggacuucuauga

SEQ ID NO: 526151 - RNA, 19 nt, Homo sapiens
ugaccgcuaugccauguau

SEQ ID NO: 526152 - RNA, 19 nt, Homo sapiens
gauggaguccucgguguuu

SEQ ID NO: 526153 - RNA, 19 nt, Homo sapiens
ccacuagcagacacaauuu

SEQ ID NO: 526154 - RNA, 19 nt, Homo sapiens
gagacuaucccaacaucug

SEQ ID NO: 526155 - RNA, 19 nt, Homo sapiens
cagagaaagcugaaaguca

SEQ ID NO: 526156 - RNA, 19 nt, Homo sapiens
cuggugagcuacuucauca

SEQ ID NO: 526157 - RNA, 19 nt, Homo sapiens
ggaacaccaugugcaccuu

SEQ ID NO: 526158 - RNA, 19 nt, Homo sapiens
caggagcuguugcuguguu

SEQ ID NO: 526159 - RNA, 19 nt, Homo sapiens
uggcacuucuggugggaua

SEQ ID NO: 526160 - RNA, 19 nt, Homo sapiens
caacaucugugcgggaacu

SEQ ID NO: 526161 - RNA, 19 nt, Homo sapiens
aagcugaaagucacaauga

SEQ ID NO: 526162 - RNA, 19 nt, Homo sapiens
gugagcuacuucaucaaga

SEQ ID NO: 526163 - RNA, 19 nt, Homo sapiens
gcuccaacgucacuaucau

SEQ ID NO: 526164 - RNA, 19 nt, Homo sapiens
uagagacuaucccaacauc

SEQ ID NO: 526165 - RNA, 19 nt, Homo sapiens
ccuucuaucucaaucaugu

SEQ ID NO: 526166 - RNA, 19 nt, Homo sapiens
gacggguccugccucaguu

SEQ ID NO: 526167 - RNA, 19 nt, Homo sapiens
ggaaaacggaccuuaacaa

SEQ ID NO: 526168 - RNA, 19 nt, Homo sapiens
aggcagaguuugagcagau

SEQ ID NO: 526169 - RNA, 19 nt, Homo sapiens
gcagagaaagcugaaaguc

SEQ ID NO: 526170 - RNA, 19 nt, Homo sapiens
ggagaugugaaguuugugu

SEQ ID NO: 526171 - RNA, 19 nt, Homo sapiens
ggaccggugcugucuguca

SEQ ID NO: 526172 - RNA, 19 nt, Homo sapiens
uuggagaugugaaguuugu

SEQ ID NO: 526173 - RNA, 19 nt, Homo sapiens
ucaagaagaaacugagcaa

SEQ ID NO: 526174 - RNA, 19 nt, Homo sapiens
gaaaacggaccuuaacaag

SEQ ID NO: 526175 - RNA, 19 nt, Homo sapiens
gaaagcugaaagucacaau

SEQ ID NO: 526176 - RNA, 19 nt, Homo sapiens
uccagccgcucuccucuga

SEQ ID NO: 526177 - RNA, 19 nt, Homo sapiens
caccuuggacuucuaugaa

SEQ ID NO: 526178 - RNA, 19 nt, Homo sapiens
uaggaccggugcugucugu

SEQ ID NO: 526179 - RNA, 19 nt, Homo sapiens
gcugugaugacuugccauu

SEQ ID NO: 526180 - RNA, 19 nt, Homo sapiens
gaagcgggucauccggaaa

SEQ ID NO: 526181 - RNA, 19 nt, Homo sapiens
ggcagaguuugagcagauu

SEQ ID NO: 526182 - RNA, 19 nt, Homo sapiens
ugccauguauaaaguagga

SEQ ID NO: 526183 - RNA, 19 nt, Homo sapiens
guagagacuaucccaacau

SEQ ID NO: 526184 - RNA, 19 nt, Homo sapiens
ggugagcuacuucaucaag

SEQ ID NO: 526185 - RNA, 19 nt, Homo sapiens
gaaggacaagcaggcguau

SEQ ID NO: 526186 - RNA, 19 nt, Homo sapiens
ggcauuccuucuaucucaa

SEQ ID NO: 526187 - RNA, 19 nt, Homo sapiens
acacggagaaggacaagca

SEQ ID NO: 526188 - RNA, 19 nt, Homo sapiens
cgucuccugucccaauuca

SEQ ID NO: 526189 - RNA, 19 nt, Homo sapiens
ccuggagcauugcguuugu

SEQ ID NO: 526190 - RNA, 19 nt, Homo sapiens
ugacggguccugccucagu

SEQ ID NO: 526191 - RNA, 19 nt, Homo sapiens
gucacuaucauccgcauug

SEQ ID NO: 526192 - RNA, 19 nt, Homo sapiens
gcagaguuugagcagauug

SEQ ID NO: 526193 - RNA, 19 nt, Homo sapiens
auaaagcugcuguacuaug

SEQ ID NO: 526194 - RNA, 19 nt, Homo sapiens
gcucauaaagcugcuguac

SEQ ID NO: 526195 - RNA, 19 nt, Homo sapiens
gaacuaagucccuauaaua

SEQ ID NO: 526196 - RNA, 19 nt, Homo sapiens
gcagggaacuggugagugu

SEQ ID NO: 526197 - RNA, 19 nt, Homo sapiens
gcagagagaucccaauguc

SEQ ID NO: 526198 - RNA, 19 nt, Homo sapiens
gugcugggcuucaucauug

SEQ ID NO: 526199 - RNA, 19 nt, Homo sapiens
ugaacuaagucccuauaau

SEQ ID NO: 526200 - RNA, 19 nt, Homo sapiens
gagagccaaugacagcaaa

SEQ ID NO: 526201 - RNA, 19 nt, Homo sapiens
cuaagucccuauaauaaag

SEQ ID NO: 526202 - RNA, 19 nt, Homo sapiens
gugcauaccaggugacaaa

SEQ ID NO: 526203 - RNA, 19 nt, Homo sapiens
ucacggugcugcucucugu

SEQ ID NO: 526204 - RNA, 19 nt, Homo sapiens
ggugcuggcuucacaguca

SEQ ID NO: 526205 - RNA, 19 nt, Homo sapiens
ugacuuuccucccauuuua

SEQ ID NO: 526206 - RNA, 19 nt, Homo sapiens
uuccaacacuccauuauuc

SEQ ID NO: 526207 - RNA, 19 nt, Homo sapiens
gcagcagcuucuccaggaa

SEQ ID NO: 526208 - RNA, 19 nt, Homo sapiens
guggugacguccagcuuug

SEQ ID NO: 526209 - RNA, 19 nt, Homo sapiens
cuacauuuccuaccuagug

SEQ ID NO: 526210 - RNA, 19 nt, Homo sapiens
uuuccuaccuagugaagaa

SEQ ID NO: 526211 - RNA, 19 nt, Homo sapiens
ggagagccaaugacagcaa

SEQ ID NO: 526212 - RNA, 19 nt, Homo sapiens
gcugcagacuucaacaucu

SEQ ID NO: 526213 - RNA, 19 nt, Homo sapiens
cagcagagagaucccaaug

SEQ ID NO: 526214 - RNA, 19 nt, Homo sapiens
caacaucucaagccucucu

SEQ ID NO: 526215 - RNA, 19 nt, Homo sapiens
uacauuuccuaccuaguga

SEQ ID NO: 526216 - RNA, 19 nt, Homo sapiens
ggugcugggcuucaucauu

SEQ ID NO: 526217 - RNA, 19 nt, Homo sapiens
ccacugaguccagcagaga

SEQ ID NO: 526218 - RNA, 19 nt, Homo sapiens
gugaacuaagucccuauaa

SEQ ID NO: 526219 - RNA, 19 nt, Homo sapiens
gccaggaaccaaauucuac

SEQ ID NO: 526220 - RNA, 19 nt, Homo sapiens
acaaaccucgugccaggaa

SEQ ID NO: 526221 - RNA, 19 nt, Homo sapiens
caguggugcuggcuucaca

SEQ ID NO: 526222 - RNA, 19 nt, Homo sapiens
gcaaugccacacugauggu

SEQ ID NO: 526223 - RNA, 19 nt, Homo sapiens
auccggaccuugcccuuga

SEQ ID NO: 526224 - RNA, 19 nt, Homo sapiens
ggacagggcugagguguau

SEQ ID NO: 526225 - RNA, 19 nt, Homo sapiens
caacguuccuacaaacaga

SEQ ID NO: 526226 - RNA, 19 nt, Homo sapiens
gaguacagguucaaguaug

SEQ ID NO: 526227 - RNA, 19 nt, Homo sapiens
gcaggaaaacccuuaauaa

SEQ ID NO: 526228 - RNA, 19 nt, Homo sapiens
ucaaguauguccuggucaa

SEQ ID NO: 526229 - RNA, 19 nt, Homo sapiens
gcucaacguuccuacaaac

SEQ ID NO: 526230 - RNA, 19 nt, Homo sapiens
ggaguacagguucaaguau

SEQ ID NO: 526231 - RNA, 19 nt, Homo sapiens
ccucacagauccugaaugc

SEQ ID NO: 526232 - RNA, 19 nt, Homo sapiens
ccaaccagcucaccccaua

SEQ ID NO: 526233 - RNA, 19 nt, Homo sapiens
acucacgacucccaaauca

SEQ ID NO: 526234 - RNA, 19 nt, Homo sapiens
aguauguccuggucaauau

SEQ ID NO: 526235 - RNA, 19 nt, Homo sapiens
cggaguacagguucaagua

SEQ ID NO: 526236 - RNA, 19 nt, Homo sapiens
gggcucaacguuccuacaa

SEQ ID NO: 526237 - RNA, 19 nt, Homo sapiens
aagccucucugcauguuug

SEQ ID NO: 526238 - RNA, 19 nt, Homo sapiens
caggaaaacccuuaauaaa

SEQ ID NO: 526239 - RNA, 19 nt, Homo sapiens
ggcucaacguuccuacaaa

SEQ ID NO: 526240 - RNA, 19 nt, Homo sapiens
ggaaugccucagugcaaga

SEQ ID NO: 526241 - RNA, 19 nt, Homo sapiens
gggcuugucccuccaacug

SEQ ID NO: 526242 - RNA, 19 nt, Homo sapiens
caacuuccagggccucugu

SEQ ID NO: 526243 - RNA, 19 nt, Homo sapiens
guccaaggccucacagauc

SEQ ID NO: 526244 - RNA, 19 nt, Homo sapiens
gcccuucuuucuacuugug

SEQ ID NO: 526245 - RNA, 19 nt, Homo sapiens
gaaaagccucucugcaugu

SEQ ID NO: 526246 - RNA, 19 nt, Homo sapiens
caggaaugccucagugcaa

SEQ ID NO: 526247 - RNA, 19 nt, Homo sapiens
aaguauguccuggucaaua

SEQ ID NO: 526248 - RNA, 19 nt, Homo sapiens
aguacagguucaaguaugu

SEQ ID NO: 526249 - RNA, 19 nt, Homo sapiens
ucacgacucccaaaucacu

SEQ ID NO: 526250 - RNA, 19 nt, Homo sapiens
cgacucacgacucccaaau

SEQ ID NO: 526251 - RNA, 19 nt, Homo sapiens
gcaaagaaguaaucaugua

SEQ ID NO: 526252 - RNA, 19 nt, Homo sapiens
gacaggauguuucgcauua

SEQ ID NO: 526253 - RNA, 19 nt, Homo sapiens
gcaaguggcuggaugguau

SEQ ID NO: 526254 - RNA, 19 nt, Homo sapiens
uauggaagcuacugaauaa

SEQ ID NO: 526255 - RNA, 19 nt, Homo sapiens
gaagaugguuaaacuugaa

SEQ ID NO: 526256 - RNA, 19 nt, Homo sapiens
cugaaucccuuuacuguua

SEQ ID NO: 526257 - RNA, 19 nt, Homo sapiens
gaaguaaucauguaguuga

SEQ ID NO: 526258 - RNA, 19 nt, Homo sapiens
caucagaucuugccuaaag

SEQ ID NO: 526259 - RNA, 19 nt, Homo sapiens
gaagccacuuuaucaguuu

SEQ ID NO: 526260 - RNA, 19 nt, Homo sapiens
cugagaaccuuuauaauga

SEQ ID NO: 526261 - RNA, 19 nt, Homo sapiens
gcuaacauguauacuagaa

SEQ ID NO: 526262 - RNA, 19 nt, Homo sapiens
uugccaagauugagaaaua

SEQ ID NO: 526263 - RNA, 19 nt, Homo sapiens
aaugcgagaugauacaaua

SEQ ID NO: 526264 - RNA, 19 nt, Homo sapiens
gagcucagaagccacuuua

SEQ ID NO: 526265 - RNA, 19 nt, Homo sapiens
ggaugaagauguaaaagaa

SEQ ID NO: 526266 - RNA, 19 nt, Homo sapiens
caacauaggcauacuuaag

SEQ ID NO: 526267 - RNA, 19 nt, Homo sapiens
auacgaggaugaagaugua

SEQ ID NO: 526268 - RNA, 19 nt, Homo sapiens
uuacaaugcugcaggauuc

SEQ ID NO: 526269 - RNA, 19 nt, Homo sapiens
ugaagaugguuaaacuuga

SEQ ID NO: 526270 - RNA, 19 nt, Homo sapiens
gugcuaacauguauacuag

SEQ ID NO: 526271 - RNA, 19 nt, Homo sapiens
gggcaaagaaguaaucaug

SEQ ID NO: 526272 - RNA, 19 nt, Homo sapiens
ucacugguaugcaaacaga

SEQ ID NO: 526273 - RNA, 19 nt, Homo sapiens
gagaagaaugggcaaagaa

SEQ ID NO: 526274 - RNA, 19 nt, Homo sapiens
ccugagaaccuuuauaaug

SEQ ID NO: 526275 - RNA, 19 nt, Homo sapiens
agaagccacuuuaucaguu

SEQ ID NO: 526276 - RNA, 19 nt, Homo sapiens
aaagagcaguggaccaaau

SEQ ID NO: 526277 - RNA, 19 nt, Homo sapiens
guaaucauguaguugaagu

SEQ ID NO: 526278 - RNA, 19 nt, Homo sapiens
aauagccucuucacuggua

SEQ ID NO: 526279 - RNA, 19 nt, Homo sapiens
gcaguggaccaaauaugaa

SEQ ID NO: 526280 - RNA, 19 nt, Homo sapiens
gaacuugaagcaucagauc

SEQ ID NO: 526281 - RNA, 19 nt, Homo sapiens
gcaggccguuucagcauca

SEQ ID NO: 526282 - RNA, 19 nt, Homo sapiens
ugaaucccuuuacuguuaa

SEQ ID NO: 526283 - RNA, 19 nt, Homo sapiens
uaacuacugaaucccuuua

SEQ ID NO: 526284 - RNA, 19 nt, Homo sapiens
gagaugauacaauauacga

SEQ ID NO: 526285 - RNA, 19 nt, Homo sapiens
gcucagaagccacuuuauc

SEQ ID NO: 526286 - RNA, 19 nt, Homo sapiens
ucauguaguugaagucugu

SEQ ID NO: 526287 - RNA, 19 nt, Homo sapiens
aagaaugggcaaagaagua

SEQ ID NO: 526288 - RNA, 19 nt, Homo sapiens
ccucuucacugguaugcaa

SEQ ID NO: 526289 - RNA, 19 nt, Homo sapiens
ccaaaccuuauacugaaua

SEQ ID NO: 526290 - RNA, 19 nt, Homo sapiens
agaauuauuuggucugaag

SEQ ID NO: 526291 - RNA, 19 nt, Homo sapiens
caauauacgaggaugaaga

SEQ ID NO: 526292 - RNA, 19 nt, Homo sapiens
uuccaaaccuuauacugaa

SEQ ID NO: 526293 - RNA, 19 nt, Homo sapiens
caaagaaguaaucauguag

SEQ ID NO: 526294 - RNA, 19 nt, Homo sapiens
gaagaaugggcaaagaagu

SEQ ID NO: 526295 - RNA, 19 nt, Homo sapiens
gcgagaugauacaauauac

SEQ ID NO: 526296 - RNA, 19 nt, Homo sapiens
gagaaccuuuauaaugaca

SEQ ID NO: 526297 - RNA, 19 nt, Homo sapiens
uauuuggucugaagauguu

SEQ ID NO: 526298 - RNA, 19 nt, Homo sapiens
aggcaacgcuucucuuucu

SEQ ID NO: 526299 - RNA, 19 nt, Homo sapiens
agagaagaaugggcaaaga

SEQ ID NO: 526300 - RNA, 19 nt, Homo sapiens
uauacauacuccugugcua

SEQ ID NO: 526301 - RNA, 19 nt, Homo sapiens
uuauggaagcuacugaaua

SEQ ID NO: 526302 - RNA, 19 nt, Homo sapiens
gagcaguggaccaaauaug

SEQ ID NO: 526303 - RNA, 19 nt, Homo sapiens
cccaacauaggcauacuua

SEQ ID NO: 526304 - RNA, 19 nt, Homo sapiens
gguuaaacuugaaacaaac

SEQ ID NO: 526305 - RNA, 19 nt, Homo sapiens
gcugcaggauucaauaaac

SEQ ID NO: 526306 - RNA, 19 nt, Homo sapiens
uuuccucacugguuggaua

SEQ ID NO: 526307 - RNA, 19 nt, Homo sapiens
cuaaagagcaguggaccaa

SEQ ID NO: 526308 - RNA, 19 nt, Homo sapiens
agcaucagaucuugccuaa

SEQ ID NO: 526309 - RNA, 19 nt, Homo sapiens
gcuuguccucuaugacuua

SEQ ID NO: 526310 - RNA, 19 nt, Homo sapiens
cugaauaacuacugaaucc

SEQ ID NO: 526311 - RNA, 19 nt, Homo sapiens
ggaagcuacugaauaaaag

SEQ ID NO: 526312 - RNA, 19 nt, Homo sapiens
aaggauauaacuuccguaa

SEQ ID NO: 526313 - RNA, 19 nt, Homo sapiens
aagagcaguggaccaaaua

SEQ ID NO: 526314 - RNA, 19 nt, Homo sapiens
uauaaugacaggauguuuc

SEQ ID NO: 526315 - RNA, 19 nt, Homo sapiens
aaaagaagccauaagaaga

SEQ ID NO: 526316 - RNA, 19 nt, Homo sapiens
agaaugggcaaagaaguaa

SEQ ID NO: 526317 - RNA, 19 nt, Homo sapiens
cgaaaaugguauuacaaug

SEQ ID NO: 526318 - RNA, 19 nt, Homo sapiens
uuccugagaaccuuuauaa

SEQ ID NO: 526319 - RNA, 19 nt, Homo sapiens
caggauguuucgcauuaag

SEQ ID NO: 526320 - RNA, 19 nt, Homo sapiens
gauuuugcauccuaucauu

SEQ ID NO: 526321 - RNA, 19 nt, Homo sapiens
cagaagccacuuuaucagu

SEQ ID NO: 526322 - RNA, 19 nt, Homo sapiens
gaaaaugguauuacaaugc

SEQ ID NO: 526323 - RNA, 19 nt, Homo sapiens
ugcgagaugauacaauaua

SEQ ID NO: 526324 - RNA, 19 nt, Homo sapiens
acaggauguuucgcauuaa

SEQ ID NO: 526325 - RNA, 19 nt, Homo sapiens
gauuugauuuugcauccua

SEQ ID NO: 526326 - RNA, 19 nt, Homo sapiens
ggcaaagaaguaaucaugu

SEQ ID NO: 526327 - RNA, 19 nt, Homo sapiens
guaaaagaagccauaagaa

SEQ ID NO: 526328 - RNA, 19 nt, Homo sapiens
cucagaagccacuuuauca

SEQ ID NO: 526329 - RNA, 19 nt, Homo sapiens
ugugcuaacauguauacua

SEQ ID NO: 526330 - RNA, 19 nt, Homo sapiens
auacuccugugcuaacaug

SEQ ID NO: 526331 - RNA, 19 nt, Homo sapiens
ggagcucagaagccacuuu

SEQ ID NO: 526332 - RNA, 19 nt, Homo sapiens
ugagaaccuuuauaaugac

SEQ ID NO: 526333 - RNA, 19 nt, Homo sapiens
uaaaagaagccauaagaag

SEQ ID NO: 526334 - RNA, 19 nt, Homo sapiens
guugaagucuguggaugca

SEQ ID NO: 526335 - RNA, 19 nt, Homo sapiens
ccuugaaccguaucugaaa

SEQ ID NO: 526336 - RNA, 19 nt, Homo sapiens
ugacaggauguuucgcauu

SEQ ID NO: 526337 - RNA, 19 nt, Homo sapiens
cuacugaaucccuuuacug

SEQ ID NO: 526338 - RNA, 19 nt, Homo sapiens
auuccaaaccuuauacuga

SEQ ID NO: 526339 - RNA, 19 nt, Homo sapiens
gaauuauuuggucugaaga

SEQ ID NO: 526340 - RNA, 19 nt, Homo sapiens
cuugaagcaucagaucuug

SEQ ID NO: 526341 - RNA, 19 nt, Homo sapiens
aaagaagccauaagaagac

SEQ ID NO: 526342 - RNA, 19 nt, Homo sapiens
uacaauauacgaggaugaa

SEQ ID NO: 526343 - RNA, 19 nt, Homo sapiens
uauacgaggaugaagaugu

SEQ ID NO: 526344 - RNA, 19 nt, Homo sapiens
auacauacuccugugcuaa

SEQ ID NO: 526345 - RNA, 19 nt, Homo sapiens
gagaaauagccucuucacu

SEQ ID NO: 526346 - RNA, 19 nt, Homo sapiens
cucuaugacuuacccagaa

SEQ ID NO: 526347 - RNA, 19 nt, Homo sapiens
uagccuaucaguuuaugga

SEQ ID NO: 526348 - RNA, 19 nt, Homo sapiens
agcaguggaccaaauauga

SEQ ID NO: 526349 - RNA, 19 nt, Homo sapiens
cuccugugcuaacauguau

SEQ ID NO: 526350 - RNA, 19 nt, Homo sapiens
augaagaugguuaaacuug

SEQ ID NO: 526351 - RNA, 19 nt, Homo sapiens
gcacacagcuuacuacauc

SEQ ID NO: 526352 - RNA, 19 nt, Homo sapiens
gaaaugcccugguaucuca

SEQ ID NO: 526353 - RNA, 19 nt, Homo sapiens
gagauguggucuuuaacua

SEQ ID NO: 526354 - RNA, 19 nt, Homo sapiens
gaaggaacgugaugugauc

SEQ ID NO: 526355 - RNA, 19 nt, Homo sapiens
gaaaaucgaugacaugaug

SEQ ID NO: 526356 - RNA, 19 nt, Homo sapiens
gaaacauaaugcacucuga

SEQ ID NO: 526357 - RNA, 19 nt, Homo sapiens
gcacuacuccuguguguga

SEQ ID NO: 526358 - RNA, 19 nt, Homo sapiens
gcagugcccuggagaagga

SEQ ID NO: 526359 - RNA, 19 nt, Homo sapiens
ccucagaaaugcccuggua

SEQ ID NO: 526360 - RNA, 19 nt, Homo sapiens
ggagaaugaugcaucuaug

SEQ ID NO: 526361 - RNA, 19 nt, Homo sapiens
ucaaggcgcuguccaagga

SEQ ID NO: 526362 - RNA, 19 nt, Homo sapiens
gugcagacuugaccgagua

SEQ ID NO: 526363 - RNA, 19 nt, Homo sapiens
ccaaggaucugccgaaagc

SEQ ID NO: 526364 - RNA, 19 nt, Homo sapiens
ccacguggccauugcagua

SEQ ID NO: 526365 - RNA, 19 nt, Homo sapiens
gcaggagaaugaugcaucu

SEQ ID NO: 526366 - RNA, 19 nt, Homo sapiens
uuuccacgcugguacuuua

SEQ ID NO: 526367 - RNA, 19 nt, Homo sapiens
ggagcaccagcaacuguua

SEQ ID NO: 526368 - RNA, 19 nt, Homo sapiens
ugcgagauguggucuuuaa

SEQ ID NO: 526369 - RNA, 19 nt, Homo sapiens
caacuuguggucccaggua

SEQ ID NO: 526370 - RNA, 19 nt, Homo sapiens
cuggaagacucacagauug

SEQ ID NO: 526371 - RNA, 19 nt, Homo sapiens
gggagaugcaggagaauga

SEQ ID NO: 526372 - RNA, 19 nt, Homo sapiens
gagaaggaacgugauguga

SEQ ID NO: 526373 - RNA, 19 nt, Homo sapiens
gugaugaugcucuaccuuu

SEQ ID NO: 526374 - RNA, 19 nt, Homo sapiens
gacggcagguggacugaug

SEQ ID NO: 526375 - RNA, 19 nt, Homo sapiens
gcuccaaguacaucuauga

SEQ ID NO: 526376 - RNA, 19 nt, Homo sapiens
uaugcgagauguggucuuu

SEQ ID NO: 526377 - RNA, 19 nt, Homo sapiens
agaaggagguggagagcau

SEQ ID NO: 526378 - RNA, 19 nt, Homo sapiens
uguuagaccucgcccagaa

SEQ ID NO: 526379 - RNA, 19 nt, Homo sapiens
ccagugagaaugucaggaa

SEQ ID NO: 526380 - RNA, 19 nt, Homo sapiens
gacgcagccuccugaccua

SEQ ID NO: 526381 - RNA, 19 nt, Homo sapiens
cacuaugacugcacuuaug

SEQ ID NO: 526382 - RNA, 19 nt, Homo sapiens
gcuccugggugacauugug

SEQ ID NO: 526383 - RNA, 19 nt, Homo sapiens
cauaaugcacucugacuuc

SEQ ID NO: 526384 - RNA, 19 nt, Homo sapiens
gaaugggaaagccggauug

SEQ ID NO: 526385 - RNA, 19 nt, Homo sapiens
gcccugguaucucaucuag

SEQ ID NO: 526386 - RNA, 19 nt, Homo sapiens
ccaccgugaugaugcucua

SEQ ID NO: 526387 - RNA, 19 nt, Homo sapiens
agacugagaagaauaaugg

SEQ ID NO: 526388 - RNA, 19 nt, Homo sapiens
uggagcaucuggcuuucaa

SEQ ID NO: 526389 - RNA, 19 nt, Homo sapiens
aacaagcuaugccagaguu

SEQ ID NO: 526390 - RNA, 19 nt, Homo sapiens
ugggugacauugugcagaa

SEQ ID NO: 526391 - RNA, 19 nt, Homo sapiens
gaaugaaaaucgaugacau

SEQ ID NO: 526392 - RNA, 19 nt, Homo sapiens
ccacuaugacugcacuuau

SEQ ID NO: 526393 - RNA, 19 nt, Homo sapiens
gagauccgccaccgugaug

SEQ ID NO: 526394 - RNA, 19 nt, Homo sapiens
guccaaggaucugccgaaa

SEQ ID NO: 526395 - RNA, 19 nt, Homo sapiens
caggugcuguggccaacaa

SEQ ID NO: 526396 - RNA, 19 nt, Homo sapiens
gacgcugugcccacucuua

SEQ ID NO: 526397 - RNA, 19 nt, Homo sapiens
ccgaguaccucagcacaca

SEQ ID NO: 526398 - RNA, 19 nt, Homo sapiens
gggagcacacagcuuacua

SEQ ID NO: 526399 - RNA, 19 nt, Homo sapiens
cccgggagcacacagcuua

SEQ ID NO: 526400 - RNA, 19 nt, Homo sapiens
gugggaguguggauugaug

SEQ ID NO: 526401 - RNA, 19 nt, Homo sapiens
gcagccuccugaccuaugg

SEQ ID NO: 526402 - RNA, 19 nt, Homo sapiens
gaguaccucagcacacauu

SEQ ID NO: 526403 - RNA, 19 nt, Homo sapiens
gguggaugccaguguggua

SEQ ID NO: 526404 - RNA, 19 nt, Homo sapiens
ggcaucccauggacauaug

SEQ ID NO: 526405 - RNA, 19 nt, Homo sapiens
gacauugugcagaacugua

SEQ ID NO: 526406 - RNA, 19 nt, Homo sapiens
aagccaggccagcacaaua

SEQ ID NO: 526407 - RNA, 19 nt, Homo sapiens
ccagugccacggagaguga

SEQ ID NO: 526408 - RNA, 19 nt, Homo sapiens
cuugcugggugcacacuuu

SEQ ID NO: 526409 - RNA, 19 nt, Homo sapiens
ggacaguguggccuugcaa

SEQ ID NO: 526410 - RNA, 19 nt, Homo sapiens
acgccagccuugcggagua

SEQ ID NO: 526411 - RNA, 19 nt, Homo sapiens
uuccagaccuucagcaucu

SEQ ID NO: 526412 - RNA, 19 nt, Homo sapiens
guaaguuuccacgcuggua

SEQ ID NO: 526413 - RNA, 19 nt, Homo sapiens
ugcgggagaugcaggagaa

SEQ ID NO: 526414 - RNA, 19 nt, Homo sapiens
gagcacacagcuuacuaca

SEQ ID NO: 526415 - RNA, 19 nt, Homo sapiens
ucagaaaugcccugguauc

SEQ ID NO: 526416 - RNA, 19 nt, Homo sapiens
cggccgagcaccaacugua

SEQ ID NO: 526417 - RNA, 19 nt, Homo sapiens
caacaagcuaugccagagu

SEQ ID NO: 526418 - RNA, 19 nt, Homo sapiens
gccacuaugacugcacuua

SEQ ID NO: 526419 - RNA, 19 nt, Homo sapiens
gagacugagaagaauaaug

SEQ ID NO: 526420 - RNA, 19 nt, Homo sapiens
ggaguguggauugauguug

SEQ ID NO: 526421 - RNA, 19 nt, Homo sapiens
gccagaguuuccagaccuu

SEQ ID NO: 526422 - RNA, 19 nt, Homo sapiens
cggcuggugagaaacauaa

SEQ ID NO: 526423 - RNA, 19 nt, Homo sapiens
gagaugcaggagaaugaug

SEQ ID NO: 526424 - RNA, 19 nt, Homo sapiens
cagaaaugcccugguaucu

SEQ ID NO: 526425 - RNA, 19 nt, Homo sapiens
agaaggaacgugaugugau

SEQ ID NO: 526426 - RNA, 19 nt, Homo sapiens
ugagaaggaacgugaugug

SEQ ID NO: 526427 - RNA, 19 nt, Homo sapiens
ggagcacacagcuuacuac

SEQ ID NO: 526428 - RNA, 19 nt, Homo sapiens
uggcacuacuccugugugu

SEQ ID NO: 526429 - RNA, 19 nt, Homo sapiens
ugaugaugcucuaccuuuu

SEQ ID NO: 526430 - RNA, 19 nt, Homo sapiens
uggaagacucacagauuga

SEQ ID NO: 526431 - RNA, 19 nt, Homo sapiens
uugagacugagaagaauaa

SEQ ID NO: 526432 - RNA, 19 nt, Homo sapiens
ugaaugggaaagccggauu

SEQ ID NO: 526433 - RNA, 19 nt, Homo sapiens
ucagagccagucagccaaa

SEQ ID NO: 526434 - RNA, 19 nt, Homo sapiens
ccuccgagcaguccucuca

SEQ ID NO: 526435 - RNA, 19 nt, Homo sapiens
gaguggagcaccagcaacu

SEQ ID NO: 526436 - RNA, 19 nt, Homo sapiens
gaacaaucuugaaucauga

SEQ ID NO: 526437 - RNA, 19 nt, Homo sapiens
ggagagagcugaacguucu

SEQ ID NO: 526438 - RNA, 19 nt, Homo sapiens
ggaguuacauuacuucguu

SEQ ID NO: 526439 - RNA, 19 nt, Homo sapiens
caucagaggaguuacauua

SEQ ID NO: 526440 - RNA, 19 nt, Homo sapiens
caagauaacccguggaauu

SEQ ID NO: 526441 - RNA, 19 nt, Homo sapiens
ggcuaaugcugauaucaua

SEQ ID NO: 526442 - RNA, 19 nt, Homo sapiens
gcaagaauggcuuugauug

SEQ ID NO: 526443 - RNA, 19 nt, Homo sapiens
aaacuauucuccuguauca

SEQ ID NO: 526444 - RNA, 19 nt, Homo sapiens
caacucagcagccauuuga

SEQ ID NO: 526445 - RNA, 19 nt, Homo sapiens
agaacaaucuugaaucaug

SEQ ID NO: 526446 - RNA, 19 nt, Homo sapiens
ucagaacaaucuugaauca

SEQ ID NO: 526447 - RNA, 19 nt, Homo sapiens
caacacagauguccaagcu

SEQ ID NO: 526448 - RNA, 19 nt, Homo sapiens
gauaacccguggaauugaa

SEQ ID NO: 526449 - RNA, 19 nt, Homo sapiens
uaugaggacuucagcaauu

SEQ ID NO: 526450 - RNA, 19 nt, Homo sapiens
agucagaagucucuaauau

SEQ ID NO: 526451 - RNA, 19 nt, Homo sapiens
gaaagucagaagucucuaa

SEQ ID NO: 526452 - RNA, 19 nt, Homo sapiens
gaacaguuucucaacauga

SEQ ID NO: 526453 - RNA, 19 nt, Homo sapiens
gcuaaucccuuguauuguc

SEQ ID NO: 526454 - RNA, 19 nt, Homo sapiens
cagcagccauuugauguuu

SEQ ID NO: 526455 - RNA, 19 nt, Homo sapiens
gguggcaaauuaaguguga

SEQ ID NO: 526456 - RNA, 19 nt, Homo sapiens
cgucuuacauccagucuga

SEQ ID NO: 526457 - RNA, 19 nt, Homo sapiens
caacuaccguggaggugaa

SEQ ID NO: 526458 - RNA, 19 nt, Homo sapiens
caccacagcaccagaauuu

SEQ ID NO: 526459 - RNA, 19 nt, Homo sapiens
cauccagucugacgacaaa

SEQ ID NO: 526460 - RNA, 19 nt, Homo sapiens
gcagacucaugucauugaa

SEQ ID NO: 526461 - RNA, 19 nt, Homo sapiens
gcaguugguggcaaauuaa

SEQ ID NO: 526462 - RNA, 19 nt, Homo sapiens
gagcagcaaacacaugaaa

SEQ ID NO: 526463 - RNA, 19 nt, Homo sapiens
cagaggaguuacauuacuu

SEQ ID NO: 526464 - RNA, 19 nt, Homo sapiens
ccacaguccuucagcagau

SEQ ID NO: 526465 - RNA, 19 nt, Homo sapiens
ugaagcaguugguggcaaa

SEQ ID NO: 526466 - RNA, 19 nt, Homo sapiens
uaauacugaugcacacauu

SEQ ID NO: 526467 - RNA, 19 nt, Homo sapiens
ggcagcaaguggaaauuug

SEQ ID NO: 526468 - RNA, 19 nt, Homo sapiens
uggcuaaucccuuguauug

SEQ ID NO: 526469 - RNA, 19 nt, Homo sapiens
gauaugaggacuucagcaa

SEQ ID NO: 526470 - RNA, 19 nt, Homo sapiens
gucagaagucucuaauaua

SEQ ID NO: 526471 - RNA, 19 nt, Homo sapiens
gcugaacaguuucucaaca

SEQ ID NO: 526472 - RNA, 19 nt, Homo sapiens
cauuugauguuucugcauu

SEQ ID NO: 526473 - RNA, 19 nt, Homo sapiens
aagaauggcuuugauugga

SEQ ID NO: 526474 - RNA, 19 nt, Homo sapiens
gcuguggccuuucagaauc

SEQ ID NO: 526475 - RNA, 19 nt, Homo sapiens
ggacuucagcaauuuagga

SEQ ID NO: 526476 - RNA, 19 nt, Homo sapiens
uaaagcaggcaguagauau

SEQ ID NO: 526477 - RNA, 19 nt, Homo sapiens
gcagcaaacacaugaaagu

SEQ ID NO: 526478 - RNA, 19 nt, Homo sapiens
ucagaaccauuucacaagu

SEQ ID NO: 526479 - RNA, 19 nt, Homo sapiens
agcaguugguggcaaauua

SEQ ID NO: 526480 - RNA, 19 nt, Homo sapiens
gaaauccgagaacagaaug

SEQ ID NO: 526481 - RNA, 19 nt, Homo sapiens
uaaugucaguggagucuuc

SEQ ID NO: 526482 - RNA, 19 nt, Homo sapiens
ggugaaauccgagaacaga

SEQ ID NO: 526483 - RNA, 19 nt, Homo sapiens
gugcaagaauggcuuugau

SEQ ID NO: 526484 - RNA, 19 nt, Homo sapiens
gaggugaaauccgagaaca

SEQ ID NO: 526485 - RNA, 19 nt, Homo sapiens
uuacauuacuucguucaga

SEQ ID NO: 526486 - RNA, 19 nt, Homo sapiens
uacauuacuucguucagaa

SEQ ID NO: 526487 - RNA, 19 nt, Homo sapiens
gggaaaacauggcuuauac

SEQ ID NO: 526488 - RNA, 19 nt, Homo sapiens
ucuccuguaucaagaauug

SEQ ID NO: 526489 - RNA, 19 nt, Homo sapiens
ugagucauccuguucuaaa

SEQ ID NO: 526490 - RNA, 19 nt, Homo sapiens
gcuaaagauugacaaagcu

SEQ ID NO: 526491 - RNA, 19 nt, Homo sapiens
uaauggaguuccugcucaa

SEQ ID NO: 526492 - RNA, 19 nt, Homo sapiens
gcuaaugcugauaucauaa

SEQ ID NO: 526493 - RNA, 19 nt, Homo sapiens
cagaaccauuucacaagug

SEQ ID NO: 526494 - RNA, 19 nt, Homo sapiens
gaccuucagccucagcuaa

SEQ ID NO: 526495 - RNA, 19 nt, Homo sapiens
aagauaacccguggaauug

SEQ ID NO: 526496 - RNA, 19 nt, Homo sapiens
cagagcagcaaacacauga

SEQ ID NO: 526497 - RNA, 19 nt, Homo sapiens
ucuggacucuuugggauuu

SEQ ID NO: 526498 - RNA, 19 nt, Homo sapiens
ugaacaguuucucaacaug

SEQ ID NO: 526499 - RNA, 19 nt, Homo sapiens
ggacucuuugggauuuaua

SEQ ID NO: 526500 - RNA, 19 nt, Homo sapiens
gcaacucagcagccauuug

SEQ ID NO: 526501 - RNA, 19 nt, Homo sapiens
caagaauggcuuugauugg

SEQ ID NO: 526502 - RNA, 19 nt, Homo sapiens
ucagaggaguuacauuacu

SEQ ID NO: 526503 - RNA, 19 nt, Homo sapiens
agccucagcuaaagauuga

SEQ ID NO: 526504 - RNA, 19 nt, Homo sapiens
gagauuuuauucccucaaa

SEQ ID NO: 526505 - RNA, 19 nt, Homo sapiens
caguagauaugaggacuuc

SEQ ID NO: 526506 - RNA, 19 nt, Homo sapiens
cauuaaagcaggcaguaga

SEQ ID NO: 526507 - RNA, 19 nt, Homo sapiens
gcagccauuugauguuucu

SEQ ID NO: 526508 - RNA, 19 nt, Homo sapiens
gauuggacuuggugugagu

SEQ ID NO: 526509 - RNA, 19 nt, Homo sapiens
uuucacaagugcaagaaug

SEQ ID NO: 526510 - RNA, 19 nt, Homo sapiens
ugaaucaugaagcuacuaa

SEQ ID NO: 526511 - RNA, 19 nt, Homo sapiens
gaccgugugucagaacaau

SEQ ID NO: 526512 - RNA, 19 nt, Homo sapiens
uggaguuccugcucaaugu

SEQ ID NO: 526513 - RNA, 19 nt, Homo sapiens
gagguaaaauaaggcauaa

SEQ ID NO: 526514 - RNA, 19 nt, Homo sapiens
uugaugaguuguaauacug

SEQ ID NO: 526515 - RNA, 19 nt, Homo sapiens
uuaguguucuucagcaugu

SEQ ID NO: 526516 - RNA, 19 nt, Homo sapiens
uguauuguccugacuauag

SEQ ID NO: 526517 - RNA, 19 nt, Homo sapiens
gggugauguugauauucua

SEQ ID NO: 526518 - RNA, 19 nt, Homo sapiens
ugaggacuucagcaauuua

SEQ ID NO: 526519 - RNA, 19 nt, Homo sapiens
gaugaguuguaauacugau

SEQ ID NO: 526520 - RNA, 19 nt, Homo sapiens
guugaugaguuguaauacu

SEQ ID NO: 526521 - RNA, 19 nt, Homo sapiens
ggagucuucugaguguuuc

SEQ ID NO: 526522 - RNA, 19 nt, Homo sapiens
uguccaagcugccaagaac

SEQ ID NO: 526523 - RNA, 19 nt, Homo sapiens
ugaaauccgagaacagaau

SEQ ID NO: 526524 - RNA, 19 nt, Homo sapiens
gagucauccuguucuaaag

SEQ ID NO: 526525 - RNA, 19 nt, Homo sapiens
uuaccaaguuaccaaaugg

SEQ ID NO: 526526 - RNA, 19 nt, Homo sapiens
gaagugcagaggcaaaugc

SEQ ID NO: 526527 - RNA, 19 nt, Homo sapiens
cugaacaguuucucaacau

SEQ ID NO: 526528 - RNA, 19 nt, Homo sapiens
ggugauguugauauucuaa

SEQ ID NO: 526529 - RNA, 19 nt, Homo sapiens
gaccuaaagucaauaaaac

SEQ ID NO: 526530 - RNA, 19 nt, Homo sapiens
gcacacauuacaggagaga

SEQ ID NO: 526531 - RNA, 19 nt, Homo sapiens
caagugcaagaauggcuuu

SEQ ID NO: 526532 - RNA, 19 nt, Homo sapiens
agacucaugucauugaaaa

SEQ ID NO: 526533 - RNA, 19 nt, Homo sapiens
gaaaacauggcuuauacug

SEQ ID NO: 526534 - RNA, 19 nt, Homo sapiens
caagggaaaacauggcuua

SEQ ID NO: 526535 - RNA, 19 nt, Homo sapiens
uuaaagcaggcaguagaua

SEQ ID NO: 526536 - RNA, 19 nt, Homo sapiens
gaacauggcuuucaaaugg

SEQ ID NO: 526537 - RNA, 19 nt, Homo sapiens
gcaagaacauggcuuucaa

SEQ ID NO: 526538 - RNA, 19 nt, Homo sapiens
ggaagcugcaguugaauua

SEQ ID NO: 526539 - RNA, 19 nt, Homo sapiens
ggcauucacuuaauaaaga

SEQ ID NO: 526540 - RNA, 19 nt, Homo sapiens
gaaggaaauugagcaggaa

SEQ ID NO: 526541 - RNA, 19 nt, Homo sapiens
gaacccagaaggaaauuga

SEQ ID NO: 526542 - RNA, 19 nt, Homo sapiens
ucaggagacuuauuugaga

SEQ ID NO: 526543 - RNA, 19 nt, Homo sapiens
gcaguugaauuaucacagu

SEQ ID NO: 526544 - RNA, 19 nt, Homo sapiens
gaugauguauuugcaaaca

SEQ ID NO: 526545 - RNA, 19 nt, Homo sapiens
caaggugccugacuucucu

SEQ ID NO: 526546 - RNA, 19 nt, Homo sapiens
gagcggcugucgccauguu

SEQ ID NO: 526547 - RNA, 19 nt, Homo sapiens
caaugucccugcuucuguu

SEQ ID NO: 526548 - RNA, 19 nt, Homo sapiens
gacgauauggugauuguug

SEQ ID NO: 526549 - RNA, 19 nt, Homo sapiens
cauagaacccagaaggaaa

SEQ ID NO: 526550 - RNA, 19 nt, Homo sapiens
ugccugacuucucugaaua

SEQ ID NO: 526551 - RNA, 19 nt, Homo sapiens
gugacgauauggugauugu

SEQ ID NO: 526552 - RNA, 19 nt, Homo sapiens
caagaacauggcuuucaaa

SEQ ID NO: 526553 - RNA, 19 nt, Homo sapiens
guugaauuaucacaguuga

SEQ ID NO: 526554 - RNA, 19 nt, Homo sapiens
agaaugccgucacccaguu

SEQ ID NO: 526555 - RNA, 19 nt, Homo sapiens
caccucaggagacuuauuu

SEQ ID NO: 526556 - RNA, 19 nt, Homo sapiens
gugccugacuucucugaau

SEQ ID NO: 526557 - RNA, 19 nt, Homo sapiens
uauggugauuguugguuaa

SEQ ID NO: 526558 - RNA, 19 nt, Homo sapiens
auauggugauuguugguua

SEQ ID NO: 526559 - RNA, 19 nt, Homo sapiens
gaguaaagaaaccugaaug

SEQ ID NO: 526560 - RNA, 19 nt, Homo sapiens
aaagguuucuccuauuugg

SEQ ID NO: 526561 - RNA, 19 nt, Homo sapiens
gagacuuauuugagaggaa

SEQ ID NO: 526562 - RNA, 19 nt, Homo sapiens
caugagugcuucugcugau

SEQ ID NO: 526563 - RNA, 19 nt, Homo sapiens
ucgcauaugcugccaagaa

SEQ ID NO: 526564 - RNA, 19 nt, Homo sapiens
ugucaccucaggagacuua

SEQ ID NO: 526565 - RNA, 19 nt, Homo sapiens
gaauugaugauguauuugc

SEQ ID NO: 526566 - RNA, 19 nt, Homo sapiens
ugagggacccacagcauga

SEQ ID NO: 526567 - RNA, 19 nt, Homo sapiens
ggugauuguugguuaagag

SEQ ID NO: 526568 - RNA, 19 nt, Homo sapiens
ggacccacagcaugaucua

SEQ ID NO: 526569 - RNA, 19 nt, Homo sapiens
acacuguuaagcacuguua

SEQ ID NO: 526570 - RNA, 19 nt, Homo sapiens
uucaggcauucacuuaaua

SEQ ID NO: 526571 - RNA, 19 nt, Homo sapiens
auaaagacacuguuaagca

SEQ ID NO: 526572 - RNA, 19 nt, Homo sapiens
ucaggcauucacuuaauaa

SEQ ID NO: 526573 - RNA, 19 nt, Homo sapiens
uuucaggcauucacuuaau

SEQ ID NO: 526574 - RNA, 19 nt, Homo sapiens
cgcauaugcugccaagaau

SEQ ID NO: 526575 - RNA, 19 nt, Homo sapiens
aagcugcaguugaauuauc

SEQ ID NO: 526576 - RNA, 19 nt, Homo sapiens
ucauagaacccagaaggaa

SEQ ID NO: 526577 - RNA, 19 nt, Homo sapiens
cugaauggguuauccugau

SEQ ID NO: 526578 - RNA, 19 nt, Homo sapiens
cagacugguguacaagaua

SEQ ID NO: 526579 - RNA, 19 nt, Homo sapiens
acagacugguguacaagau

SEQ ID NO: 526580 - RNA, 19 nt, Homo sapiens
ccucaggagacuuauuuga

SEQ ID NO: 526581 - RNA, 19 nt, Homo sapiens
ugccaugggucacacuaug

SEQ ID NO: 526582 - RNA, 19 nt, Homo sapiens
caguugaauuaucacaguu

SEQ ID NO: 526583 - RNA, 19 nt, Homo sapiens
gaagcugcaguugaauuau

SEQ ID NO: 526584 - RNA, 19 nt, Homo sapiens
ggaaggucguccccuguga

SEQ ID NO: 526585 - RNA, 19 nt, Homo sapiens
ggcaagaacauggcuuuca

SEQ ID NO: 526586 - RNA, 19 nt, Homo sapiens
gguuucuccuauuugguaa

SEQ ID NO: 526587 - RNA, 19 nt, Homo sapiens
gucauacacgcgaaaggua

SEQ ID NO: 526588 - RNA, 19 nt, Homo sapiens
acaucaaggugccugacuu

SEQ ID NO: 526589 - RNA, 19 nt, Homo sapiens
gauuguugguuaagagacu

SEQ ID NO: 526590 - RNA, 19 nt, Homo sapiens
agacugguguacaagauac

SEQ ID NO: 526591 - RNA, 19 nt, Homo sapiens
gcauucacuuaauaaagac

SEQ ID NO: 526592 - RNA, 19 nt, Homo sapiens
gcuguguacccauugcaaa

SEQ ID NO: 526593 - RNA, 19 nt, Homo sapiens
ucaaugucccugcuucugu

SEQ ID NO: 526594 - RNA, 19 nt, Homo sapiens
uuugguaacuggaguaacu

SEQ ID NO: 526595 - RNA, 19 nt, Homo sapiens
cgcgaaagguacaaugucu

SEQ ID NO: 526596 - RNA, 19 nt, Homo sapiens
cugcuucuguuuguuauuc

SEQ ID NO: 526597 - RNA, 19 nt, Homo sapiens
gauauggugauuguugguu

SEQ ID NO: 526598 - RNA, 19 nt, Homo sapiens
gccaugggucacacuauga

SEQ ID NO: 526599 - RNA, 19 nt, Homo sapiens
gcauaugcugccaagaaug

SEQ ID NO: 526600 - RNA, 19 nt, Homo sapiens
cggagcagccuguguugga

SEQ ID NO: 526601 - RNA, 19 nt, Homo sapiens
caggagauuuuggugguua

SEQ ID NO: 526602 - RNA, 19 nt, Homo sapiens
caucaaggugccugacuuc

SEQ ID NO: 526603 - RNA, 19 nt, Homo sapiens
agaacauggcuuucaaaug

SEQ ID NO: 526604 - RNA, 19 nt, Homo sapiens
uacugugggugucgcauau

SEQ ID NO: 526605 - RNA, 19 nt, Homo sapiens
cuacugugggugucgcaua

SEQ ID NO: 526606 - RNA, 19 nt, Homo sapiens
gcgaaagguacaaugucuu

SEQ ID NO: 526607 - RNA, 19 nt, Homo sapiens
cagugacgauauggugauu

SEQ ID NO: 526608 - RNA, 19 nt, Homo sapiens
cgaguaaagaaaccugaau

SEQ ID NO: 526609 - RNA, 19 nt, Homo sapiens
gagugcuucugcugaugug

SEQ ID NO: 526610 - RNA, 19 nt, Homo sapiens
guacaaugucuuuuagcua

SEQ ID NO: 526611 - RNA, 19 nt, Homo sapiens
ucccugcuucuguuuguua

SEQ ID NO: 526612 - RNA, 19 nt, Homo sapiens
gcugguagcuucuauguaa

SEQ ID NO: 526613 - RNA, 19 nt, Homo sapiens
gcaaugauuccaucuaaau

SEQ ID NO: 526614 - RNA, 19 nt, Homo sapiens
gcacggaggagcucuuuga

SEQ ID NO: 526615 - RNA, 19 nt, Homo sapiens
gcaucagaauauuuccuua

SEQ ID NO: 526616 - RNA, 19 nt, Homo sapiens
cggaggagcucuuugacuu

SEQ ID NO: 526617 - RNA, 19 nt, Homo sapiens
ucgcaaugauuccaucuaa

SEQ ID NO: 526618 - RNA, 19 nt, Homo sapiens
gcgagcaguuggagaaaug

SEQ ID NO: 526619 - RNA, 19 nt, Homo sapiens
gaaauaaauguguggacuu

SEQ ID NO: 526620 - RNA, 19 nt, Homo sapiens
ggcuagagcucugugauga

SEQ ID NO: 526621 - RNA, 19 nt, Homo sapiens
ggagcucuuugacuucuug

SEQ ID NO: 526622 - RNA, 19 nt, Homo sapiens
cagaauauuuccuuauggu

SEQ ID NO: 526623 - RNA, 19 nt, Homo sapiens
aaaguucuaugaucugcaa

SEQ ID NO: 526624 - RNA, 19 nt, Homo sapiens
gcaguuggagaaaugugua

SEQ ID NO: 526625 - RNA, 19 nt, Homo sapiens
gauguaccauuuguuucuu

SEQ ID NO: 526626 - RNA, 19 nt, Homo sapiens
ccucauggguuuggcuuga

SEQ ID NO: 526627 - RNA, 19 nt, Homo sapiens
ggauguaccauuuguuucu

SEQ ID NO: 526628 - RNA, 19 nt, Homo sapiens
gaggagcucuuugacuucu

SEQ ID NO: 526629 - RNA, 19 nt, Homo sapiens
gagcgugauuccucucgau

SEQ ID NO: 526630 - RNA, 19 nt, Homo sapiens
auaaauguguggacuuaag

SEQ ID NO: 526631 - RNA, 19 nt, Homo sapiens
gggcucguguugaaucuag

SEQ ID NO: 526632 - RNA, 19 nt, Homo sapiens
ucagaauauuuccuuaugg

SEQ ID NO: 526633 - RNA, 19 nt, Homo sapiens
cgcaaugauuccaucuaaa

SEQ ID NO: 526634 - RNA, 19 nt, Homo sapiens
gguuuuggauguaccauuu

SEQ ID NO: 526635 - RNA, 19 nt, Homo sapiens
ggaggagcucuuugacuuc

SEQ ID NO: 526636 - RNA, 19 nt, Homo sapiens
caacagugagagagcaaug

SEQ ID NO: 526637 - RNA, 19 nt, Homo sapiens
gguagcuucuauguaauuc

SEQ ID NO: 526638 - RNA, 19 nt, Homo sapiens
caaaagaugcuuaccgaau

SEQ ID NO: 526639 - RNA, 19 nt, Homo sapiens
ucuauguaauucgcaauga

SEQ ID NO: 526640 - RNA, 19 nt, Homo sapiens
aaaagaugcuuaccgaauc

SEQ ID NO: 526641 - RNA, 19 nt, Homo sapiens
cuauguaauucgcaaugau

SEQ ID NO: 526642 - RNA, 19 nt, Homo sapiens
uuggauguaccauuuguuu

SEQ ID NO: 526643 - RNA, 19 nt, Homo sapiens
ggcaucagaauauuuccuu

SEQ ID NO: 526644 - RNA, 19 nt, Homo sapiens
uaaauguguggacuuaagu

SEQ ID NO: 526645 - RNA, 19 nt, Homo sapiens
gagagcaaugcgagcaguu

SEQ ID NO: 526646 - RNA, 19 nt, Homo sapiens
uguguggacuuaaguugca

SEQ ID NO: 526647 - RNA, 19 nt, Homo sapiens
ucacauacagaagaggauu

SEQ ID NO: 526648 - RNA, 19 nt, Homo sapiens
ugaggcugguagcuucuau

SEQ ID NO: 526649 - RNA, 19 nt, Homo sapiens
gcccacagcucuucaacaa

SEQ ID NO: 526650 - RNA, 19 nt, Homo sapiens
ugugaaagauugucccaua

SEQ ID NO: 526651 - RNA, 19 nt, Homo sapiens
cauggacccugaugacaua

SEQ ID NO: 526652 - RNA, 19 nt, Homo sapiens
ccacagcucuucaacaagu

SEQ ID NO: 526653 - RNA, 19 nt, Homo sapiens
ggaagacggugacauugca

SEQ ID NO: 526654 - RNA, 19 nt, Homo sapiens
gagaagagcaggaccuaga

SEQ ID NO: 526655 - RNA, 19 nt, Homo sapiens
ccucucauauccucuuaua

SEQ ID NO: 526656 - RNA, 19 nt, Homo sapiens
gaucaucuuugcuaaggau

SEQ ID NO: 526657 - RNA, 19 nt, Homo sapiens
ccaggcaggccguuacuua

SEQ ID NO: 526658 - RNA, 19 nt, Homo sapiens
gaguugaaccuauugugua

SEQ ID NO: 526659 - RNA, 19 nt, Homo sapiens
acagacagcugaccaugga

SEQ ID NO: 526660 - RNA, 19 nt, Homo sapiens
uuccggagcugaagaauga

SEQ ID NO: 526661 - RNA, 19 nt, Homo sapiens
gaaagauugucccauaucc

SEQ ID NO: 526662 - RNA, 19 nt, Homo sapiens
gugaaagauugucccauau

SEQ ID NO: 526663 - RNA, 19 nt, Homo sapiens
ggacgugugccgcugauug

SEQ ID NO: 526664 - RNA, 19 nt, Homo sapiens
gcagaugcuggaugacuuu

SEQ ID NO: 526665 - RNA, 19 nt, Homo sapiens
ccacuaacacagaugauug

SEQ ID NO: 526666 - RNA, 19 nt, Homo sapiens
gaugcuggaugacuuugga

SEQ ID NO: 526667 - RNA, 19 nt, Homo sapiens
ccagagccauuaagagaag

SEQ ID NO: 526668 - RNA, 19 nt, Homo sapiens
ggaguugaaccuauugugu

SEQ ID NO: 526669 - RNA, 19 nt, Homo sapiens
ccucugagcuaggcuaugu

SEQ ID NO: 526670 - RNA, 19 nt, Homo sapiens
caauaaaaguuucggaguu

SEQ ID NO: 526671 - RNA, 19 nt, Homo sapiens
caaguaccacuaacacaga

SEQ ID NO: 526672 - RNA, 19 nt, Homo sapiens
agacuacacucccguuugg

SEQ ID NO: 526673 - RNA, 19 nt, Homo sapiens
ccaugaucaucuuugcuaa

SEQ ID NO: 526674 - RNA, 19 nt, Homo sapiens
ggaccacaucgcuacauug

SEQ ID NO: 526675 - RNA, 19 nt, Homo sapiens
ggcccaagcuggcuaugag

SEQ ID NO: 526676 - RNA, 19 nt, Homo sapiens
ggacccugaugacauacau

SEQ ID NO: 526677 - RNA, 19 nt, Homo sapiens
ugacauggacccagaacau

SEQ ID NO: 526678 - RNA, 19 nt, Homo sapiens
ucagagaccucaggcuagu

SEQ ID NO: 526679 - RNA, 19 nt, Homo sapiens
cagcuucccagagccauua

SEQ ID NO: 526680 - RNA, 19 nt, Homo sapiens
uuucggaguugaaccuauu

SEQ ID NO: 526681 - RNA, 19 nt, Homo sapiens
uuaccagaguuuagggaaa

SEQ ID NO: 526682 - RNA, 19 nt, Homo sapiens
uugaaccuauuguguaguu

SEQ ID NO: 526683 - RNA, 19 nt, Homo sapiens
guaccacuaacacagauga

SEQ ID NO: 526684 - RNA, 19 nt, Homo sapiens
gcuaggcuauguguuccaa

SEQ ID NO: 526685 - RNA, 19 nt, Homo sapiens
gauguggccaagcaaguga

SEQ ID NO: 526686 - RNA, 19 nt, Homo sapiens
ugagcuaggcuauguguuc

SEQ ID NO: 526687 - RNA, 19 nt, Homo sapiens
ccuacgggauccagaagug

SEQ ID NO: 526688 - RNA, 19 nt, Homo sapiens
ucccagagccauuaagaga

SEQ ID NO: 526689 - RNA, 19 nt, Homo sapiens
ugaaagauugucccauauc

SEQ ID NO: 526690 - RNA, 19 nt, Homo sapiens
ggccguuacuuaccagagu

SEQ ID NO: 526691 - RNA, 19 nt, Homo sapiens
gaggccugcugugaacuga

SEQ ID NO: 526692 - RNA, 19 nt, Homo sapiens
gaaccuauuguguaguuuu

SEQ ID NO: 526693 - RNA, 19 nt, Homo sapiens
gguugggaccucaggguuu

SEQ ID NO: 526694 - RNA, 19 nt, Homo sapiens
cccaugaucaucuuugcua

SEQ ID NO: 526695 - RNA, 19 nt, Homo sapiens
uggaccacaucgcuacauu

SEQ ID NO: 526696 - RNA, 19 nt, Homo sapiens
ggaugacuuuggaccacau

SEQ ID NO: 526697 - RNA, 19 nt, Homo sapiens
ggcaguuggugaagcagau

SEQ ID NO: 526698 - RNA, 19 nt, Homo sapiens
ucccauauccucaguucuu

SEQ ID NO: 526699 - RNA, 19 nt, Homo sapiens
uaaacacucacgucugcuu

SEQ ID NO: 526700 - RNA, 19 nt, Homo sapiens
gccguuacuuaccagaguu

SEQ ID NO: 526701 - RNA, 19 nt, Homo sapiens
uauccucaguucuucuuag

SEQ ID NO: 526702 - RNA, 19 nt, Homo sapiens
aggaggagaucgggcaguu

SEQ ID NO: 526703 - RNA, 19 nt, Homo sapiens
cagacuacacucccguuug

SEQ ID NO: 526704 - RNA, 19 nt, Homo sapiens
gcauugcagcuguuugagu

SEQ ID NO: 526705 - RNA, 19 nt, Homo sapiens
ccugaugacauacaugguu

SEQ ID NO: 526706 - RNA, 19 nt, Homo sapiens
aauaaaaguuucggaguug

SEQ ID NO: 526707 - RNA, 19 nt, Homo sapiens
gaccacaucgcuacauugc

SEQ ID NO: 526708 - RNA, 19 nt, Homo sapiens
ccugaggccugcugugaac

SEQ ID NO: 526709 - RNA, 19 nt, Homo sapiens
acaaguuugcacugccuua

SEQ ID NO: 526710 - RNA, 19 nt, Homo sapiens
agaagagcaggaccuagaa

SEQ ID NO: 526711 - RNA, 19 nt, Homo sapiens
cacuaacacagaugauuga

SEQ ID NO: 526712 - RNA, 19 nt, Homo sapiens
ggcaggccguuacuuacca

SEQ ID NO: 526713 - RNA, 19 nt, Homo sapiens
gaagagcaggaccuagaac

SEQ ID NO: 526714 - RNA, 19 nt, Homo sapiens
ugucccauauccucaguuc

SEQ ID NO: 526715 - RNA, 19 nt, Homo sapiens
aguugaaccuauuguguag

SEQ ID NO: 526716 - RNA, 19 nt, Homo sapiens
ggcuuuauccugacaugga

SEQ ID NO: 526717 - RNA, 19 nt, Homo sapiens
ucuccgacauccuuguugu

SEQ ID NO: 526718 - RNA, 19 nt, Homo sapiens
gggaagacggugacauugc

SEQ ID NO: 526719 - RNA, 19 nt, Homo sapiens
aggcauugcagcuguuuga

SEQ ID NO: 526720 - RNA, 19 nt, Homo sapiens
ccauggacccugaugacau

SEQ ID NO: 526721 - RNA, 19 nt, Homo sapiens
ggaaaggucucugaaagaa

SEQ ID NO: 526722 - RNA, 19 nt, Homo sapiens
ggagaaaccuguggaaaug

SEQ ID NO: 526723 - RNA, 19 nt, Homo sapiens
ggaguuaucuggugacaau

SEQ ID NO: 526724 - RNA, 19 nt, Homo sapiens
cagaaaagcuugcagaaua

SEQ ID NO: 526725 - RNA, 19 nt, Homo sapiens
ggaaggaagucaaauaaac

SEQ ID NO: 526726 - RNA, 19 nt, Homo sapiens
gcaggaaggaagucaaaua

SEQ ID NO: 526727 - RNA, 19 nt, Homo sapiens
gcacgugacugcccucugu

SEQ ID NO: 526728 - RNA, 19 nt, Homo sapiens
aaagagaaauccugccaaa

SEQ ID NO: 526729 - RNA, 19 nt, Homo sapiens
ggaauuaggauuauaugga

SEQ ID NO: 526730 - RNA, 19 nt, Homo sapiens
uaucagggaauuaggauua

SEQ ID NO: 526731 - RNA, 19 nt, Homo sapiens
gaagcuuucucauccugaa

SEQ ID NO: 526732 - RNA, 19 nt, Homo sapiens
caaagggauugccauggaa

SEQ ID NO: 526733 - RNA, 19 nt, Homo sapiens
caaaagcgcucaaggacaa

SEQ ID NO: 526734 - RNA, 19 nt, Homo sapiens
acaaagggauugccaugga

SEQ ID NO: 526735 - RNA, 19 nt, Homo sapiens
caggaaggaagucaaauaa

SEQ ID NO: 526736 - RNA, 19 nt, Homo sapiens
ucaagcacauucaggaguu

SEQ ID NO: 526737 - RNA, 19 nt, Homo sapiens
gaaaggucucugaaagaaa

SEQ ID NO: 526738 - RNA, 19 nt, Homo sapiens
ggaagcagcagaguuaugu

SEQ ID NO: 526739 - RNA, 19 nt, Homo sapiens
gcaauaaugaagguucuuu

SEQ ID NO: 526740 - RNA, 19 nt, Homo sapiens
gaaaugcuacugcuucucu

SEQ ID NO: 526741 - RNA, 19 nt, Homo sapiens
ggacuugaagccacuuuga

SEQ ID NO: 526742 - RNA, 19 nt, Homo sapiens
caagcacauucaggaguua

SEQ ID NO: 526743 - RNA, 19 nt, Homo sapiens
aagggaaccugaacagcua

SEQ ID NO: 526744 - RNA, 19 nt, Homo sapiens
gggaaaggucucugaaaga

SEQ ID NO: 526745 - RNA, 19 nt, Homo sapiens
aaauuggccuggauacaga

SEQ ID NO: 526746 - RNA, 19 nt, Homo sapiens
aaauaaaccacacugacua

SEQ ID NO: 526747 - RNA, 19 nt, Homo sapiens
gugacaauaucgaucaaau

SEQ ID NO: 526748 - RNA, 19 nt, Homo sapiens
ggaaugccaagucagugua

SEQ ID NO: 526749 - RNA, 19 nt, Homo sapiens
gaaccugaacagcuacuau

SEQ ID NO: 526750 - RNA, 19 nt, Homo sapiens
cugcuucucuagugaguaa

SEQ ID NO: 526751 - RNA, 19 nt, Homo sapiens
uuucucauccugaagauua

SEQ ID NO: 526752 - RNA, 19 nt, Homo sapiens
gaaggagaaaccuguggaa

SEQ ID NO: 526753 - RNA, 19 nt, Homo sapiens
aggauuauauggacuugaa

SEQ ID NO: 526754 - RNA, 19 nt, Homo sapiens
caaauaaaccacacugacu

SEQ ID NO: 526755 - RNA, 19 nt, Homo sapiens
gcagcagaguuauguuugg

SEQ ID NO: 526756 - RNA, 19 nt, Homo sapiens
aguggaagcagcagaguua

SEQ ID NO: 526757 - RNA, 19 nt, Homo sapiens
ucagggaauuaggauuaua

SEQ ID NO: 526758 - RNA, 19 nt, Homo sapiens
gcacugccucuucuauuuc

SEQ ID NO: 526759 - RNA, 19 nt, Homo sapiens
gcuacugcuucucuaguga

SEQ ID NO: 526760 - RNA, 19 nt, Homo sapiens
caguguaugugguuggaaa

SEQ ID NO: 526761 - RNA, 19 nt, Homo sapiens
ggaaagcauaacuguguau

SEQ ID NO: 526762 - RNA, 19 nt, Homo sapiens
gcucaaggacaaagggauu

SEQ ID NO: 526763 - RNA, 19 nt, Homo sapiens
ugaaggaugcgaaggaaga

SEQ ID NO: 526764 - RNA, 19 nt, Homo sapiens
aaaggucucugaaagaaaa

SEQ ID NO: 526765 - RNA, 19 nt, Homo sapiens
ugggaaaggucucugaaag

SEQ ID NO: 526766 - RNA, 19 nt, Homo sapiens
aaacugaagucugggaaag

SEQ ID NO: 526767 - RNA, 19 nt, Homo sapiens
uggaaagcauaacugugua

SEQ ID NO: 526768 - RNA, 19 nt, Homo sapiens
agcacugccucuucuauuu

SEQ ID NO: 526769 - RNA, 19 nt, Homo sapiens
guggaaaccucaaaagaga

SEQ ID NO: 526770 - RNA, 19 nt, Homo sapiens
cagcagaguuauguuugga

SEQ ID NO: 526771 - RNA, 19 nt, Homo sapiens
ggauugccauggaaagcau

SEQ ID NO: 526772 - RNA, 19 nt, Homo sapiens
ucacauacagucucaagca

SEQ ID NO: 526773 - RNA, 19 nt, Homo sapiens
cagcaggaaggaagucaaa

SEQ ID NO: 526774 - RNA, 19 nt, Homo sapiens
cauacagucucaagcacau

SEQ ID NO: 526775 - RNA, 19 nt, Homo sapiens
gaaggaagucaaauaaacc

SEQ ID NO: 526776 - RNA, 19 nt, Homo sapiens
cagcacugccucuucuauu

SEQ ID NO: 526777 - RNA, 19 nt, Homo sapiens
ccucagcacugccucuucu

SEQ ID NO: 526778 - RNA, 19 nt, Homo sapiens
gaaaagcuugcagaauaua

SEQ ID NO: 526779 - RNA, 19 nt, Homo sapiens
caagucaguguaugugguu

SEQ ID NO: 526780 - RNA, 19 nt, Homo sapiens
aagcagcagaguuauguuu

SEQ ID NO: 526781 - RNA, 19 nt, Homo sapiens
ccacuuugaucccuguuuu

SEQ ID NO: 526782 - RNA, 19 nt, Homo sapiens
agaguuauguuuggagcaa

SEQ ID NO: 526783 - RNA, 19 nt, Homo sapiens
aagcauaacuguguaucag

SEQ ID NO: 526784 - RNA, 19 nt, Homo sapiens
agaaaagcuugcagaauau

SEQ ID NO: 526785 - RNA, 19 nt, Homo sapiens
gaaugccaagucaguguau

SEQ ID NO: 526786 - RNA, 19 nt, Homo sapiens
guauaucagggaauuagga

SEQ ID NO: 526787 - RNA, 19 nt, Homo sapiens
cauggcugcugcugaguca

SEQ ID NO: 526788 - RNA, 19 nt, Homo sapiens
ggccucacauacagucuca

SEQ ID NO: 526789 - RNA, 19 nt, Homo sapiens
gaaagcauaacuguguauc

SEQ ID NO: 526790 - RNA, 19 nt, Homo sapiens
cagggaauuaggauuauau

SEQ ID NO: 526791 - RNA, 19 nt, Homo sapiens
agaaaccuguggaaaugca

SEQ ID NO: 526792 - RNA, 19 nt, Homo sapiens
guuaucuggugacaauauc

SEQ ID NO: 526793 - RNA, 19 nt, Homo sapiens
ccucuggccucacauacag

SEQ ID NO: 526794 - RNA, 19 nt, Homo sapiens
aggagaaaccuguggaaau

SEQ ID NO: 526795 - RNA, 19 nt, Homo sapiens
aaaauggaaugccaaguca

SEQ ID NO: 526796 - RNA, 19 nt, Homo sapiens
gaagcagcagaguuauguu

SEQ ID NO: 526797 - RNA, 19 nt, Homo sapiens
ucccgcgagugcccuauaa

SEQ ID NO: 526798 - RNA, 19 nt, Homo sapiens
ggaaaccucaaaagagaaa

SEQ ID NO: 526799 - RNA, 19 nt, Homo sapiens
aaaugcuacugcuucucua

SEQ ID NO: 526800 - RNA, 19 nt, Homo sapiens
ggccaggauccguauauca

SEQ ID NO: 526801 - RNA, 19 nt, Homo sapiens
gaaggaugcgaaggaagau

SEQ ID NO: 526802 - RNA, 19 nt, Homo sapiens
gagcaaaacaauaaaacug

SEQ ID NO: 526803 - RNA, 19 nt, Homo sapiens
gcacauucaggaguuaucu

SEQ ID NO: 526804 - RNA, 19 nt, Homo sapiens
gccaggcaauaaugaaggu

SEQ ID NO: 526805 - RNA, 19 nt, Homo sapiens
aggaaggaagucaaauaaa

SEQ ID NO: 526806 - RNA, 19 nt, Homo sapiens
aaccugaacagcuacuauu

SEQ ID NO: 526807 - RNA, 19 nt, Homo sapiens
acugaaggaugcgaaggaa

SEQ ID NO: 526808 - RNA, 19 nt, Homo sapiens
ccauggaaagcauaacugu

SEQ ID NO: 526809 - RNA, 19 nt, Homo sapiens
aaagggauugccauggaaa

SEQ ID NO: 526810 - RNA, 19 nt, Homo sapiens
gagaaauccugccaaaagc

SEQ ID NO: 526811 - RNA, 19 nt, Homo sapiens
gcuugcagaauauauuugu

SEQ ID NO: 526812 - RNA, 19 nt, Homo sapiens
cauugcuccugcagccuuu

SEQ ID NO: 526813 - RNA, 19 nt, Homo sapiens
uggaaaugcuacugcuucu

SEQ ID NO: 526814 - RNA, 19 nt, Homo sapiens
ugaagguucuuuuacugaa

SEQ ID NO: 526815 - RNA, 19 nt, Homo sapiens
gaacugaggcccugugaua

SEQ ID NO: 526816 - RNA, 19 nt, Homo sapiens
ggagcaagcuuacacaaga

SEQ ID NO: 526817 - RNA, 19 nt, Homo sapiens
gugcagcucuccaagauaa

SEQ ID NO: 526818 - RNA, 19 nt, Homo sapiens
ggaaaggacuuagcacuca

SEQ ID NO: 526819 - RNA, 19 nt, Homo sapiens
gagcugagguuuagaugug

SEQ ID NO: 526820 - RNA, 19 nt, Homo sapiens
gauuagaggucgucaucaa

SEQ ID NO: 526821 - RNA, 19 nt, Homo sapiens
gagacaagaucaacaacug

SEQ ID NO: 526822 - RNA, 19 nt, Homo sapiens
gaguaaaggugggauucua

SEQ ID NO: 526823 - RNA, 19 nt, Homo sapiens
gagcaagcuuacacaagaa

SEQ ID NO: 526824 - RNA, 19 nt, Homo sapiens
ggucaauucuuugugauga

SEQ ID NO: 526825 - RNA, 19 nt, Homo sapiens
gcacuuccauugguucuuc

SEQ ID NO: 526826 - RNA, 19 nt, Homo sapiens
gcagggcucagcauaauga

SEQ ID NO: 526827 - RNA, 19 nt, Homo sapiens
gcagauagcccaggagcaa

SEQ ID NO: 526828 - RNA, 19 nt, Homo sapiens
gacaacagguggaagaucu

SEQ ID NO: 526829 - RNA, 19 nt, Homo sapiens
gaugucaccacaagaagua

SEQ ID NO: 526830 - RNA, 19 nt, Homo sapiens
gaugaugucaccacaagaa

SEQ ID NO: 526831 - RNA, 19 nt, Homo sapiens
auccaaagcuugugauuau

SEQ ID NO: 526832 - RNA, 19 nt, Homo sapiens
gugagaagcugaggccuau

SEQ ID NO: 526833 - RNA, 19 nt, Homo sapiens
caagaaugacagcaacuaa

SEQ ID NO: 526834 - RNA, 19 nt, Homo sapiens
gcagggacuugaccaacug

SEQ ID NO: 526835 - RNA, 19 nt, Homo sapiens
ggacgacucgggaugagaa

SEQ ID NO: 526836 - RNA, 19 nt, Homo sapiens
ggaagccagcgcucaauug

SEQ ID NO: 526837 - RNA, 19 nt, Homo sapiens
gaaugacagcaacuaacua

SEQ ID NO: 526838 - RNA, 19 nt, Homo sapiens
caacagguggaagaucuua

SEQ ID NO: 526839 - RNA, 19 nt, Homo sapiens
ccaaagcuugugauuauau

SEQ ID NO: 526840 - RNA, 19 nt, Homo sapiens
cugagacgcacuauacuua

SEQ ID NO: 526841 - RNA, 19 nt, Homo sapiens
aaacaagaaucugcugcuu

SEQ ID NO: 526842 - RNA, 19 nt, Homo sapiens
gggaagacccaaccagugu

SEQ ID NO: 526843 - RNA, 19 nt, Homo sapiens
caaagcuugugauuauauc

SEQ ID NO: 526844 - RNA, 19 nt, Homo sapiens
gcacuggucaauucuuugu

SEQ ID NO: 526845 - RNA, 19 nt, Homo sapiens
gcagcuggauggccaaacu

SEQ ID NO: 526846 - RNA, 19 nt, Homo sapiens
ggaggaagccagcgcucaa

SEQ ID NO: 526847 - RNA, 19 nt, Homo sapiens
uggcacuggucaauucuuu

SEQ ID NO: 526848 - RNA, 19 nt, Homo sapiens
aaacgcagggcucagcaua

SEQ ID NO: 526849 - RNA, 19 nt, Homo sapiens
caccagugaugaugcaguu

SEQ ID NO: 526850 - RNA, 19 nt, Homo sapiens
gaagaacugcagggacuug

SEQ ID NO: 526851 - RNA, 19 nt, Homo sapiens
gagauuggccagugagaag

SEQ ID NO: 526852 - RNA, 19 nt, Homo sapiens
gauaggaaaggacuuagca

SEQ ID NO: 526853 - RNA, 19 nt, Homo sapiens
aacugcagcuggacaauga

SEQ ID NO: 526854 - RNA, 19 nt, Homo sapiens
ccgcuugucugaagaacug

SEQ ID NO: 526855 - RNA, 19 nt, Homo sapiens
guaaccaccgcuugucuga

SEQ ID NO: 526856 - RNA, 19 nt, Homo sapiens
uauccaaagcuugugauua

SEQ ID NO: 526857 - RNA, 19 nt, Homo sapiens
gaagugagggaaggauguu

SEQ ID NO: 526858 - RNA, 19 nt, Homo sapiens
ugacagcaacuaacuaugg

SEQ ID NO: 526859 - RNA, 19 nt, Homo sapiens
uagaggucgucaucaagaa

SEQ ID NO: 526860 - RNA, 19 nt, Homo sapiens
gagggaaggauguuuagca

SEQ ID NO: 526861 - RNA, 19 nt, Homo sapiens
gcuggacaaugacgugcuu

SEQ ID NO: 526862 - RNA, 19 nt, Homo sapiens
gggcucagcauaaugaagu

SEQ ID NO: 526863 - RNA, 19 nt, Homo sapiens
ucaauucuuugugaugaug

SEQ ID NO: 526864 - RNA, 19 nt, Homo sapiens
gagacgcacuauacuuacu

SEQ ID NO: 526865 - RNA, 19 nt, Homo sapiens
gcacucaggccugugaauc

SEQ ID NO: 526866 - RNA, 19 nt, Homo sapiens
caaccaguguggcuauugc

SEQ ID NO: 526867 - RNA, 19 nt, Homo sapiens
ggagauuggccagugagaa

SEQ ID NO: 526868 - RNA, 19 nt, Homo sapiens
acucaggccugugaaucua

SEQ ID NO: 526869 - RNA, 19 nt, Homo sapiens
ucaagaaugacagcaacua

SEQ ID NO: 526870 - RNA, 19 nt, Homo sapiens
gcugagacgcacuauacuu

SEQ ID NO: 526871 - RNA, 19 nt, Homo sapiens
agaggagauuggccaguga

SEQ ID NO: 526872 - RNA, 19 nt, Homo sapiens
gcaacuaacuauggggauu

SEQ ID NO: 526873 - RNA, 19 nt, Homo sapiens
uccaaagcuugugauuaua

SEQ ID NO: 526874 - RNA, 19 nt, Homo sapiens
acgcagggcucagcauaau

SEQ ID NO: 526875 - RNA, 19 nt, Homo sapiens
gaagccagcgcucaauugc

SEQ ID NO: 526876 - RNA, 19 nt, Homo sapiens
acuggucaauucuuuguga

SEQ ID NO: 526877 - RNA, 19 nt, Homo sapiens
ccagugaugaugcaguuga

SEQ ID NO: 526878 - RNA, 19 nt, Homo sapiens
cccaagaacugcagauagc

SEQ ID NO: 526879 - RNA, 19 nt, Homo sapiens
guaaaggugggauucuauc

SEQ ID NO: 526880 - RNA, 19 nt, Homo sapiens
gagauacaaagaccuccaa

SEQ ID NO: 526881 - RNA, 19 nt, Homo sapiens
uuccauugguucuuccuuu

SEQ ID NO: 526882 - RNA, 19 nt, Homo sapiens
acagguggaagaucuuaaa

SEQ ID NO: 526883 - RNA, 19 nt, Homo sapiens
caacugcagcuggacaaug

SEQ ID NO: 526884 - RNA, 19 nt, Homo sapiens
aaccaccgcuugucugaag

SEQ ID NO: 526885 - RNA, 19 nt, Homo sapiens
guccugugcuugcuuagag

SEQ ID NO: 526886 - RNA, 19 nt, Homo sapiens
cuuguccugugcuugcuua

SEQ ID NO: 526887 - RNA, 19 nt, Homo sapiens
aaugacagcaacuaacuau

SEQ ID NO: 526888 - RNA, 19 nt, Homo sapiens
ggacaaugacgugcuucga

SEQ ID NO: 526889 - RNA, 19 nt, Homo sapiens
gcugaggccuaugcagaca

SEQ ID NO: 526890 - RNA, 19 nt, Homo sapiens
agugagggaaggauguuua

SEQ ID NO: 526891 - RNA, 19 nt, Homo sapiens
ggacucuggcacuuccauu

SEQ ID NO: 526892 - RNA, 19 nt, Homo sapiens
gcccaagaacugcagauag

SEQ ID NO: 526893 - RNA, 19 nt, Homo sapiens
gaggucgucaucaagaaug

SEQ ID NO: 526894 - RNA, 19 nt, Homo sapiens
uuagaggucgucaucaaga

SEQ ID NO: 526895 - RNA, 19 nt, Homo sapiens
ucgugcagcucuccaagau

SEQ ID NO: 526896 - RNA, 19 nt, Homo sapiens
cuaggacucacccuuauuc

SEQ ID NO: 526897 - RNA, 19 nt, Homo sapiens
gaaguacugcagggaggaa

SEQ ID NO: 526898 - RNA, 19 nt, Homo sapiens
gacgcacuauacuuacuuc

SEQ ID NO: 526899 - RNA, 19 nt, Homo sapiens
gagaagcugaggccuaugc

SEQ ID NO: 526900 - RNA, 19 nt, Homo sapiens
aaacagcugaaacggaaga

SEQ ID NO: 526901 - RNA, 19 nt, Homo sapiens
cagaguaaccaccgcuugu

SEQ ID NO: 526902 - RNA, 19 nt, Homo sapiens
gccgagacaagaucaacaa

SEQ ID NO: 526903 - RNA, 19 nt, Homo sapiens
ggccugcaguggugugaag

SEQ ID NO: 526904 - RNA, 19 nt, Homo sapiens
ggcccaagaacugcagaua

SEQ ID NO: 526905 - RNA, 19 nt, Homo sapiens
ggaccaguuccucggaugu

SEQ ID NO: 526906 - RNA, 19 nt, Homo sapiens
ggagcugagguuuagaugu

SEQ ID NO: 526907 - RNA, 19 nt, Homo sapiens
gauacuggacacacuaaac

SEQ ID NO: 526908 - RNA, 19 nt, Homo sapiens
ggauacuggacacacuaaa

SEQ ID NO: 526909 - RNA, 19 nt, Homo sapiens
guugcggcaccacggauua

SEQ ID NO: 526910 - RNA, 19 nt, Homo sapiens
caggagcuucggcagagua

SEQ ID NO: 526911 - RNA, 19 nt, Homo sapiens
gcuggauacuggacacacu

SEQ ID NO: 526912 - RNA, 19 nt, Homo sapiens
cccaggagcaacagccuaa

SEQ ID NO: 526913 - RNA, 19 nt, Homo sapiens
cccuaggacucacccuuau

SEQ ID NO: 526914 - RNA, 19 nt, Homo sapiens
ugaggccuaugcagacauc

SEQ ID NO: 526915 - RNA, 19 nt, Homo sapiens
ucgaggagcugaagaauga

SEQ ID NO: 526916 - RNA, 19 nt, Homo sapiens
gcacagagagggacacaug

SEQ ID NO: 526917 - RNA, 19 nt, Homo sapiens
caaaaucccuucagcaaug

SEQ ID NO: 526918 - RNA, 19 nt, Homo sapiens
gggacaagaucaacaacug

SEQ ID NO: 526919 - RNA, 19 nt, Homo sapiens
agagagagguauuuaacug

SEQ ID NO: 526920 - RNA, 19 nt, Homo sapiens
gcaagacgggagcgaguaa

SEQ ID NO: 526921 - RNA, 19 nt, Homo sapiens
gaaaaucauuccagacugu

SEQ ID NO: 526922 - RNA, 19 nt, Homo sapiens
gaagagcccagcacaacga

SEQ ID NO: 526923 - RNA, 19 nt, Homo sapiens
gcgauuacauccgggaguu

SEQ ID NO: 526924 - RNA, 19 nt, Homo sapiens
ggagggacaagaucaacaa

SEQ ID NO: 526925 - RNA, 19 nt, Homo sapiens
caacauccaguaccaguuc

SEQ ID NO: 526926 - RNA, 19 nt, Homo sapiens
gagaagagcccagcacaac

SEQ ID NO: 526927 - RNA, 19 nt, Homo sapiens
gcaggagaccuucaaagag

SEQ ID NO: 526928 - RNA, 19 nt, Homo sapiens
ggagaagagcccagcacaa

SEQ ID NO: 526929 - RNA, 19 nt, Homo sapiens
uaaugcauuucuguggaua

SEQ ID NO: 526930 - RNA, 19 nt, Homo sapiens
gaucguccagcuuucgaaa

SEQ ID NO: 526931 - RNA, 19 nt, Homo sapiens
uagagagagagguauuuaa

SEQ ID NO: 526932 - RNA, 19 nt, Homo sapiens
auagagagagagguauuua

SEQ ID NO: 526933 - RNA, 19 nt, Homo sapiens
gaaugagaacgcccugcuu

SEQ ID NO: 526934 - RNA, 19 nt, Homo sapiens
gacgggagcgaguaaagga

SEQ ID NO: 526935 - RNA, 19 nt, Homo sapiens
ggccaguucuacgucauga

SEQ ID NO: 526936 - RNA, 19 nt, Homo sapiens
ccaguucuacgucaugaug

SEQ ID NO: 526937 - RNA, 19 nt, Homo sapiens
ugcaggagaccuucaaaga

SEQ ID NO: 526938 - RNA, 19 nt, Homo sapiens
uguccaaggccugcgauua

SEQ ID NO: 526939 - RNA, 19 nt, Homo sapiens
gagagagagguauuuaacu

SEQ ID NO: 526940 - RNA, 19 nt, Homo sapiens
gagcccagcacaacgaagu

SEQ ID NO: 526941 - RNA, 19 nt, Homo sapiens
gaucgaggagcugaagaau

SEQ ID NO: 526942 - RNA, 19 nt, Homo sapiens
gaggagcugaagaaugaga

SEQ ID NO: 526943 - RNA, 19 nt, Homo sapiens
gcaugcaggagaccuucaa

SEQ ID NO: 526944 - RNA, 19 nt, Homo sapiens
guccaaggccugcgauuac

SEQ ID NO: 526945 - RNA, 19 nt, Homo sapiens
ggagauacuacggcugugu

SEQ ID NO: 526946 - RNA, 19 nt, Homo sapiens
agagagagagguauuuaac

SEQ ID NO: 526947 - RNA, 19 nt, Homo sapiens
gcagaucgaggagcugaag

SEQ ID NO: 526948 - RNA, 19 nt, Homo sapiens
gcgaccacaacauccagua

SEQ ID NO: 526949 - RNA, 19 nt, Homo sapiens
auaaugcauuucuguggau

SEQ ID NO: 526950 - RNA, 19 nt, Homo sapiens
ggcugcagauggacaacga

SEQ ID NO: 526951 - RNA, 19 nt, Homo sapiens
ggaggcggagggacaagau

SEQ ID NO: 526952 - RNA, 19 nt, Homo sapiens
ccacagaccagagcuugca

SEQ ID NO: 526953 - RNA, 19 nt, Homo sapiens
ggugacauaccgcguaguc

SEQ ID NO: 526954 - RNA, 19 nt, Homo sapiens
agacagcgguggccaucac

SEQ ID NO: 526955 - RNA, 19 nt, Homo sapiens
gaaagaagcucuaaaggau

SEQ ID NO: 526956 - RNA, 19 nt, Homo sapiens
gaucaacacuccuuuauug

SEQ ID NO: 526957 - RNA, 19 nt, Homo sapiens
cgacagcuauggauuauuu

SEQ ID NO: 526958 - RNA, 19 nt, Homo sapiens
aaacaaaggugaagaacaa

SEQ ID NO: 526959 - RNA, 19 nt, Homo sapiens
gcauagagauggacaguau

SEQ ID NO: 526960 - RNA, 19 nt, Homo sapiens
caaagcagauuaugagcua

SEQ ID NO: 526961 - RNA, 19 nt, Homo sapiens
gaaauacacagccaaguaa

SEQ ID NO: 526962 - RNA, 19 nt, Homo sapiens
gaggagaguucugaaauuu

SEQ ID NO: 526963 - RNA, 19 nt, Homo sapiens
gaagagaaccagagacaaa

SEQ ID NO: 526964 - RNA, 19 nt, Homo sapiens
gcacagucuucaccuauaa

SEQ ID NO: 526965 - RNA, 19 nt, Homo sapiens
ggaaauacacagccaagua

SEQ ID NO: 526966 - RNA, 19 nt, Homo sapiens
agaaauaccucauccgaaa

SEQ ID NO: 526967 - RNA, 19 nt, Homo sapiens
caagggaaauugcaaagaa

SEQ ID NO: 526968 - RNA, 19 nt, Homo sapiens
caaaaugccugaaguuaua

SEQ ID NO: 526969 - RNA, 19 nt, Homo sapiens
uaagagagcuuuggauuuc

SEQ ID NO: 526970 - RNA, 19 nt, Homo sapiens
cauaguggcauuacaauua

SEQ ID NO: 526971 - RNA, 19 nt, Homo sapiens
gaauauagagcaucugaaa

SEQ ID NO: 526972 - RNA, 19 nt, Homo sapiens
gaagaagugucaauuagag

SEQ ID NO: 526973 - RNA, 19 nt, Homo sapiens
ggacuaauuuguaucuguu

SEQ ID NO: 526974 - RNA, 19 nt, Homo sapiens
gcacaaagccaacuaacga

SEQ ID NO: 526975 - RNA, 19 nt, Homo sapiens
gauuacaacuuuccucuau

SEQ ID NO: 526976 - RNA, 19 nt, Homo sapiens
gaugaagaagugucaauua

SEQ ID NO: 526977 - RNA, 19 nt, Homo sapiens
ggacuugaaucuccaggaa

SEQ ID NO: 526978 - RNA, 19 nt, Homo sapiens
gaagaaagaagcucuaaag

SEQ ID NO: 526979 - RNA, 19 nt, Homo sapiens
gaccaaacaggcauuaaua

SEQ ID NO: 526980 - RNA, 19 nt, Homo sapiens
aaacuuguaucgguucuua

SEQ ID NO: 526981 - RNA, 19 nt, Homo sapiens
ggaaaugaaugguauuaac

SEQ ID NO: 526982 - RNA, 19 nt, Homo sapiens
gaaguuaaacccauaaaca

SEQ ID NO: 526983 - RNA, 19 nt, Homo sapiens
gaauugauaugcaguuuac

SEQ ID NO: 526984 - RNA, 19 nt, Homo sapiens
uaacgacagcuauggauua

SEQ ID NO: 526985 - RNA, 19 nt, Homo sapiens
guuuggaguuugauuguua

SEQ ID NO: 526986 - RNA, 19 nt, Homo sapiens
acaauuugcuucaguagaa

SEQ ID NO: 526987 - RNA, 19 nt, Homo sapiens
gaacucaacccuauguaug

SEQ ID NO: 526988 - RNA, 19 nt, Homo sapiens
gaaauucugagacuaguga

SEQ ID NO: 526989 - RNA, 19 nt, Homo sapiens
ggcaaguuaugaauugaua

SEQ ID NO: 526990 - RNA, 19 nt, Homo sapiens
gggcauggacuaauuugua

SEQ ID NO: 526991 - RNA, 19 nt, Homo sapiens
ggagaguucugaaauuucu

SEQ ID NO: 526992 - RNA, 19 nt, Homo sapiens
gaagagagaaaacuuguua

SEQ ID NO: 526993 - RNA, 19 nt, Homo sapiens
caaaggacaaucuaaagaa

SEQ ID NO: 526994 - RNA, 19 nt, Homo sapiens
ccagagaaauauacugaug

SEQ ID NO: 526995 - RNA, 19 nt, Homo sapiens
gaaacaaggaauccaguga

SEQ ID NO: 526996 - RNA, 19 nt, Homo sapiens
gcauuacacugcuucuguu

SEQ ID NO: 526997 - RNA, 19 nt, Homo sapiens
caaaguuacugaagagaag

SEQ ID NO: 526998 - RNA, 19 nt, Homo sapiens
ggaauccagugaccaaaca

SEQ ID NO: 526999 - RNA, 19 nt, Homo sapiens
uuacacugcuucuguuaaa

SEQ ID NO: 527000 - RNA, 19 nt, Homo sapiens
caacacuccuuuauugaca

SEQ ID NO: 527001 - RNA, 19 nt, Homo sapiens
gaaacaugccaacuccuaa

SEQ ID NO: 527002 - RNA, 19 nt, Homo sapiens
gaaauuauagagugagugu

SEQ ID NO: 527003 - RNA, 19 nt, Homo sapiens
ccaaacaggcauuaauauu

SEQ ID NO: 527004 - RNA, 19 nt, Homo sapiens
caagaucaacacuccuuua

SEQ ID NO: 527005 - RNA, 19 nt, Homo sapiens
gaagcugaacgaagucuuu

SEQ ID NO: 527006 - RNA, 19 nt, Homo sapiens
ccagcauucuuucuaaauu

SEQ ID NO: 527007 - RNA, 19 nt, Homo sapiens
gaggcauucugaagacuuu

SEQ ID NO: 527008 - RNA, 19 nt, Homo sapiens
gaggaaaugaaugguauua

SEQ ID NO: 527009 - RNA, 19 nt, Homo sapiens
aaggauaucuacagcauga

SEQ ID NO: 527010 - RNA, 19 nt, Homo sapiens
gaacagcuccaggcuaguu

SEQ ID NO: 527011 - RNA, 19 nt, Homo sapiens
ugaauaaucucggcaauac

SEQ ID NO: 527012 - RNA, 19 nt, Homo sapiens
gaacucauuuuccucagua

SEQ ID NO: 527013 - RNA, 19 nt, Homo sapiens
gagcaaagcagauuaugag

SEQ ID NO: 527014 - RNA, 19 nt, Homo sapiens
gggaaacauucaagaaaca

SEQ ID NO: 527015 - RNA, 19 nt, Homo sapiens
aagaagcucuaaaggauga

SEQ ID NO: 527016 - RNA, 19 nt, Homo sapiens
gaccaaaugugugaaaugg

SEQ ID NO: 527017 - RNA, 19 nt, Homo sapiens
cuuggaaugugaaaguuua

SEQ ID NO: 527018 - RNA, 19 nt, Homo sapiens
ccaaggaacaccagucauu

SEQ ID NO: 527019 - RNA, 19 nt, Homo sapiens
caucugaaauugaucaagu

SEQ ID NO: 527020 - RNA, 19 nt, Homo sapiens
uaagagucaugaagcuaaa

SEQ ID NO: 527021 - RNA, 19 nt, Homo sapiens
ggaggcauuuaaacacuug

SEQ ID NO: 527022 - RNA, 19 nt, Homo sapiens
gccaugaccagauauaauu

SEQ ID NO: 527023 - RNA, 19 nt, Homo sapiens
gaaaugaagacccugagau

SEQ ID NO: 527024 - RNA, 19 nt, Homo sapiens
caaaggugaagaacaaauu

SEQ ID NO: 527025 - RNA, 19 nt, Homo sapiens
gguuaaagucugcaacuaa

SEQ ID NO: 527026 - RNA, 19 nt, Homo sapiens
gcacaggaaguauuacaau

SEQ ID NO: 527027 - RNA, 19 nt, Homo sapiens
gcagcacagucuucaccua

SEQ ID NO: 527028 - RNA, 19 nt, Homo sapiens
ggcauggacuaauuuguau

SEQ ID NO: 527029 - RNA, 19 nt, Homo sapiens
ggaguaauuaucuacauga

SEQ ID NO: 527030 - RNA, 19 nt, Homo sapiens
auaaagugcucguauuugu

SEQ ID NO: 527031 - RNA, 19 nt, Homo sapiens
agagguagcccuucaaaga

SEQ ID NO: 527032 - RNA, 19 nt, Homo sapiens
caacaaagccucuaauccu

SEQ ID NO: 527033 - RNA, 19 nt, Homo sapiens
agaggagaguucugaaauu

SEQ ID NO: 527034 - RNA, 19 nt, Homo sapiens
gguauuaacagcauagaga

SEQ ID NO: 527035 - RNA, 19 nt, Homo sapiens
acaguucgcuucuacacaa

SEQ ID NO: 527036 - RNA, 19 nt, Homo sapiens
gagguagcccuucaaagaa

SEQ ID NO: 527037 - RNA, 19 nt, Homo sapiens
caacccagcauucuuucua

SEQ ID NO: 527038 - RNA, 19 nt, Homo sapiens
ucugaagacuuuaaagaga

SEQ ID NO: 527039 - RNA, 19 nt, Homo sapiens
ugucauaccuagugaaagu

SEQ ID NO: 527040 - RNA, 19 nt, Homo sapiens
ccuauaaacugugagaaga

SEQ ID NO: 527041 - RNA, 19 nt, Homo sapiens
agagacuagugaugcauua

SEQ ID NO: 527042 - RNA, 19 nt, Homo sapiens
ccucuuaaauugucacuag

SEQ ID NO: 527043 - RNA, 19 nt, Homo sapiens
gaaaacugccaucauuaua

SEQ ID NO: 527044 - RNA, 19 nt, Homo sapiens
gaaagugauaacacaacua

SEQ ID NO: 527045 - RNA, 19 nt, Homo sapiens
uguagaagcuauuggacuu

SEQ ID NO: 527046 - RNA, 19 nt, Homo sapiens
gauaacacaacuaaugguu

SEQ ID NO: 527047 - RNA, 19 nt, Homo sapiens
guuaaagucugcaacuaag

SEQ ID NO: 527048 - RNA, 19 nt, Homo sapiens
gaaugguauuaacagcaua

SEQ ID NO: 527049 - RNA, 19 nt, Homo sapiens
uggcagaauuaccuacuaa

SEQ ID NO: 527050 - RNA, 19 nt, Homo sapiens
gaaauugcaaagaagauuc

SEQ ID NO: 527051 - RNA, 19 nt, Homo sapiens
ggaaauugcaaagaagauu

SEQ ID NO: 527052 - RNA, 19 nt, Homo sapiens
gaaaacuuguuaccauuug

SEQ ID NO: 527053 - RNA, 19 nt, Homo sapiens
ggcacaaagucuagaaugu

SEQ ID NO: 527054 - RNA, 19 nt, Homo sapiens
gaagcuacuggauauuauu

SEQ ID NO: 527055 - RNA, 19 nt, Homo sapiens
gcaaauagcuagucuuuaa

SEQ ID NO: 527056 - RNA, 19 nt, Homo sapiens
ggacaacacucucaaauca

SEQ ID NO: 527057 - RNA, 19 nt, Homo sapiens
ggacagaguuuaaaugguu

SEQ ID NO: 527058 - RNA, 19 nt, Homo sapiens
uuacacagcuugcccauua

SEQ ID NO: 527059 - RNA, 19 nt, Homo sapiens
gagggaaacuugacuuuaa

SEQ ID NO: 527060 - RNA, 19 nt, Homo sapiens
gcacaacaauccaucuuaa

SEQ ID NO: 527061 - RNA, 19 nt, Homo sapiens
ggaaauggguauuguaaau

SEQ ID NO: 527062 - RNA, 19 nt, Homo sapiens
gauauuaccugucaccaaa

SEQ ID NO: 527063 - RNA, 19 nt, Homo sapiens
ggaagaagguguaaucagu

SEQ ID NO: 527064 - RNA, 19 nt, Homo sapiens
ccaaaggacuucaguguga

SEQ ID NO: 527065 - RNA, 19 nt, Homo sapiens
acaauguccuugcaaauua

SEQ ID NO: 527066 - RNA, 19 nt, Homo sapiens
gaaauaaggauucaaagga

SEQ ID NO: 527067 - RNA, 19 nt, Homo sapiens
gcaacaagguguaaugugu

SEQ ID NO: 527068 - RNA, 19 nt, Homo sapiens
gaagaugucagccuuguaa

SEQ ID NO: 527069 - RNA, 19 nt, Homo sapiens
gcaaauaggacagaguuua

SEQ ID NO: 527070 - RNA, 19 nt, Homo sapiens
cagauuguguucaaacuua

SEQ ID NO: 527071 - RNA, 19 nt, Homo sapiens
gaagggagacagugcaaua

SEQ ID NO: 527072 - RNA, 19 nt, Homo sapiens
agaaugaucugcauccuaa

SEQ ID NO: 527073 - RNA, 19 nt, Homo sapiens
agacacagcugauaauaga

SEQ ID NO: 527074 - RNA, 19 nt, Homo sapiens
gcucaguccucauucauuu

SEQ ID NO: 527075 - RNA, 19 nt, Homo sapiens
ggaggacaguguaauugua

SEQ ID NO: 527076 - RNA, 19 nt, Homo sapiens
ggccauagauguuugcaaa

SEQ ID NO: 527077 - RNA, 19 nt, Homo sapiens
caacugagacugcuguuaa

SEQ ID NO: 527078 - RNA, 19 nt, Homo sapiens
gaauggacccucuccuaua

SEQ ID NO: 527079 - RNA, 19 nt, Homo sapiens
gaaugaaaccugucacuug

SEQ ID NO: 527080 - RNA, 19 nt, Homo sapiens
gcacagcgguacugcauuc

SEQ ID NO: 527081 - RNA, 19 nt, Homo sapiens
uaaaguacccugcuucaaa

SEQ ID NO: 527082 - RNA, 19 nt, Homo sapiens
gagcaaauagcuagucuuu

SEQ ID NO: 527083 - RNA, 19 nt, Homo sapiens
guucaaaguucuucugcua

SEQ ID NO: 527084 - RNA, 19 nt, Homo sapiens
gauaagacugggacaauaa

SEQ ID NO: 527085 - RNA, 19 nt, Homo sapiens
gguuagaugucaccaauug

SEQ ID NO: 527086 - RNA, 19 nt, Homo sapiens
gaucgcugcuugccucuuu

SEQ ID NO: 527087 - RNA, 19 nt, Homo sapiens
gcgugggccugauuauuua

SEQ ID NO: 527088 - RNA, 19 nt, Homo sapiens
gaaauggaauucgagcuau

SEQ ID NO: 527089 - RNA, 19 nt, Homo sapiens
gacaguggauggagauauu

SEQ ID NO: 527090 - RNA, 19 nt, Homo sapiens
gaaauggauucaucuuagu

SEQ ID NO: 527091 - RNA, 19 nt, Homo sapiens
ugaagaagcagccuuauug

SEQ ID NO: 527092 - RNA, 19 nt, Homo sapiens
acugaaaccuuauaggaua

SEQ ID NO: 527093 - RNA, 19 nt, Homo sapiens
ggacugaaaccuuauagga

SEQ ID NO: 527094 - RNA, 19 nt, Homo sapiens
gaucaauacccauacagua

SEQ ID NO: 527095 - RNA, 19 nt, Homo sapiens
gagcauaacacuacaggaa

SEQ ID NO: 527096 - RNA, 19 nt, Homo sapiens
caaauaggacagaguuuaa

SEQ ID NO: 527097 - RNA, 19 nt, Homo sapiens
gaucauacaccuuucaaug

SEQ ID NO: 527098 - RNA, 19 nt, Homo sapiens
ggaauccguuucauaggaa

SEQ ID NO: 527099 - RNA, 19 nt, Homo sapiens
gggagaagccagcagauaa

SEQ ID NO: 527100 - RNA, 19 nt, Homo sapiens
aaacaugaauugcccaguu

SEQ ID NO: 527101 - RNA, 19 nt, Homo sapiens
ugacuuacagcuucuaaua

SEQ ID NO: 527102 - RNA, 19 nt, Homo sapiens
aaagauaacuucucuaagc

SEQ ID NO: 527103 - RNA, 19 nt, Homo sapiens
agacugagaucuacuaaag

SEQ ID NO: 527104 - RNA, 19 nt, Homo sapiens
gauaugaacuauacaugag

SEQ ID NO: 527105 - RNA, 19 nt, Homo sapiens
gaggacaaguucaaaguuc

SEQ ID NO: 527106 - RNA, 19 nt, Homo sapiens
ccacuuggaugucaacaau

SEQ ID NO: 527107 - RNA, 19 nt, Homo sapiens
gggcuuaggugugaucauu

SEQ ID NO: 527108 - RNA, 19 nt, Homo sapiens
gaaaguauucaguucugua

SEQ ID NO: 527109 - RNA, 19 nt, Homo sapiens
caacuuugcuuagcuaauc

SEQ ID NO: 527110 - RNA, 19 nt, Homo sapiens
gaaaugauaccagcagcua

SEQ ID NO: 527111 - RNA, 19 nt, Homo sapiens
ggucuucgcuguaaucagu

SEQ ID NO: 527112 - RNA, 19 nt, Homo sapiens
ucaggagccuugaaugaaa

SEQ ID NO: 527113 - RNA, 19 nt, Homo sapiens
gacaguagaugggcagauu

SEQ ID NO: 527114 - RNA, 19 nt, Homo sapiens
aaaucaaucuggucccaua

SEQ ID NO: 527115 - RNA, 19 nt, Homo sapiens
ccaaaugcccacuggcuua

SEQ ID NO: 527116 - RNA, 19 nt, Homo sapiens
gaacgugucugcaguuucc

SEQ ID NO: 527117 - RNA, 19 nt, Homo sapiens
caacuucugcuuuauauuc

SEQ ID NO: 527118 - RNA, 19 nt, Homo sapiens
gcugaaaccugagcaacaa

SEQ ID NO: 527119 - RNA, 19 nt, Homo sapiens
ugaagacaaugaaauggaa

SEQ ID NO: 527120 - RNA, 19 nt, Homo sapiens
guaaguguguuugacauug

SEQ ID NO: 527121 - RNA, 19 nt, Homo sapiens
gaaaccacaucugaggaaa

SEQ ID NO: 527122 - RNA, 19 nt, Homo sapiens
ugauaagacugggacaaua

SEQ ID NO: 527123 - RNA, 19 nt, Homo sapiens
gucuucagcuuuccaauuu

SEQ ID NO: 527124 - RNA, 19 nt, Homo sapiens
agaaauggauucaucuuag

SEQ ID NO: 527125 - RNA, 19 nt, Homo sapiens
ucaauaugcuuucugaaca

SEQ ID NO: 527126 - RNA, 19 nt, Homo sapiens
cuaaagaaaccacaucuga

SEQ ID NO: 527127 - RNA, 19 nt, Homo sapiens
gacauuaccugggaccauu

SEQ ID NO: 527128 - RNA, 19 nt, Homo sapiens
ggagggaaacuucuaccua

SEQ ID NO: 527129 - RNA, 19 nt, Homo sapiens
gggagacagugcaauaaau

SEQ ID NO: 527130 - RNA, 19 nt, Homo sapiens
gggacugucuguaaugcua

SEQ ID NO: 527131 - RNA, 19 nt, Homo sapiens
caacaagccagccauauag

SEQ ID NO: 527132 - RNA, 19 nt, Homo sapiens
gagaacgugucugcaguuu

SEQ ID NO: 527133 - RNA, 19 nt, Homo sapiens
caagguguaauguguguua

SEQ ID NO: 527134 - RNA, 19 nt, Homo sapiens
ugacauugcuuuauuuagg

SEQ ID NO: 527135 - RNA, 19 nt, Homo sapiens
ggaaucaacagcacaacaa

SEQ ID NO: 527136 - RNA, 19 nt, Homo sapiens
gcaauucaguugguugugu

SEQ ID NO: 527137 - RNA, 19 nt, Homo sapiens
gcagaguauuagaaauuga

SEQ ID NO: 527138 - RNA, 19 nt, Homo sapiens
gaugucagccuuguaauug

SEQ ID NO: 527139 - RNA, 19 nt, Homo sapiens
gaccauuacuuuggauuug

SEQ ID NO: 527140 - RNA, 19 nt, Homo sapiens
caaaucaacaggacaaugu

SEQ ID NO: 527141 - RNA, 19 nt, Homo sapiens
gcuugccucuuuauaauga

SEQ ID NO: 527142 - RNA, 19 nt, Homo sapiens
ggagacacagcugauaaua

SEQ ID NO: 527143 - RNA, 19 nt, Homo sapiens
gugguucaauuacagauuu

SEQ ID NO: 527144 - RNA, 19 nt, Homo sapiens
gcaagaacucuaagugguu

SEQ ID NO: 527145 - RNA, 19 nt, Homo sapiens
gggccugauuauuuauuua

SEQ ID NO: 527146 - RNA, 19 nt, Homo sapiens
gcucaacuucugcuuuaua

SEQ ID NO: 527147 - RNA, 19 nt, Homo sapiens
gaagucccaugaccucugu

SEQ ID NO: 527148 - RNA, 19 nt, Homo sapiens
auacagacuucacugguaa

SEQ ID NO: 527149 - RNA, 19 nt, Homo sapiens
gaagccagcagauaauguu

SEQ ID NO: 527150 - RNA, 19 nt, Homo sapiens
ccucacagguacaauuuga

SEQ ID NO: 527151 - RNA, 19 nt, Homo sapiens
gaggaggaguuugugauga

SEQ ID NO: 527152 - RNA, 19 nt, Homo sapiens
gugaucaaguuuacgcuuu

SEQ ID NO: 527153 - RNA, 19 nt, Homo sapiens
aaucaugccuaacagauau

SEQ ID NO: 527154 - RNA, 19 nt, Homo sapiens
gccaggacauguuucuuga

SEQ ID NO: 527155 - RNA, 19 nt, Homo sapiens
gaaacuaucuuguuguuga

SEQ ID NO: 527156 - RNA, 19 nt, Homo sapiens
cagcagcccucauauaaua

SEQ ID NO: 527157 - RNA, 19 nt, Homo sapiens
ggacagccuucuucaugua

SEQ ID NO: 527158 - RNA, 19 nt, Homo sapiens
aaacaagucuccaaucguu

SEQ ID NO: 527159 - RNA, 19 nt, Homo sapiens
gaaauacaccuggacaauu

SEQ ID NO: 527160 - RNA, 19 nt, Homo sapiens
guacucagcagcccucaua

SEQ ID NO: 527161 - RNA, 19 nt, Homo sapiens
ggagggagcacacgaguga

SEQ ID NO: 527162 - RNA, 19 nt, Homo sapiens
ggaaaugagugggcuagga

SEQ ID NO: 527163 - RNA, 19 nt, Homo sapiens
uagcugaaaugguccagua

SEQ ID NO: 527164 - RNA, 19 nt, Homo sapiens
gaacugacccuuccuucau

SEQ ID NO: 527165 - RNA, 19 nt, Homo sapiens
gacaauuucuagaagacua

SEQ ID NO: 527166 - RNA, 19 nt, Homo sapiens
ccguauaccugagaaauaa

SEQ ID NO: 527167 - RNA, 19 nt, Homo sapiens
ccacugcacuggcucauuc

SEQ ID NO: 527168 - RNA, 19 nt, Homo sapiens
ccagaaagcaccaaggaaa

SEQ ID NO: 527169 - RNA, 19 nt, Homo sapiens
gaaaauccaucaccucuca

SEQ ID NO: 527170 - RNA, 19 nt, Homo sapiens
gcucauuccugccucaguu

SEQ ID NO: 527171 - RNA, 19 nt, Homo sapiens
gagaaugacagcaaacaga

SEQ ID NO: 527172 - RNA, 19 nt, Homo sapiens
ggaaauacaccuggacaau

SEQ ID NO: 527173 - RNA, 19 nt, Homo sapiens
gaccacaggugcugaguac

SEQ ID NO: 527174 - RNA, 19 nt, Homo sapiens
gauauuguuugccucugaa

SEQ ID NO: 527175 - RNA, 19 nt, Homo sapiens
caucauauguaucacuauc

SEQ ID NO: 527176 - RNA, 19 nt, Homo sapiens
gaaaacaagucuccaaucg

SEQ ID NO: 527177 - RNA, 19 nt, Homo sapiens
gggacagccuucuucaugu

SEQ ID NO: 527178 - RNA, 19 nt, Homo sapiens
caucagaacacaccgaguu

SEQ ID NO: 527179 - RNA, 19 nt, Homo sapiens
gaacuauuuacaaggauga

SEQ ID NO: 527180 - RNA, 19 nt, Homo sapiens
agaagggacuuaugucuac

SEQ ID NO: 527181 - RNA, 19 nt, Homo sapiens
guaagucuuuagcugaaau

SEQ ID NO: 527182 - RNA, 19 nt, Homo sapiens
gcccucauauaauagguuu

SEQ ID NO: 527183 - RNA, 19 nt, Homo sapiens
ggacuuaugucuacaaaac

SEQ ID NO: 527184 - RNA, 19 nt, Homo sapiens
cagcugagccuggaacuga

SEQ ID NO: 527185 - RNA, 19 nt, Homo sapiens
gaaaugguccaguacaaaa

SEQ ID NO: 527186 - RNA, 19 nt, Homo sapiens
gcuagagcccgguucugua

SEQ ID NO: 527187 - RNA, 19 nt, Homo sapiens
cugaaacuaucuuguuguu

SEQ ID NO: 527188 - RNA, 19 nt, Homo sapiens
ggugucagcucguuucacu

SEQ ID NO: 527189 - RNA, 19 nt, Homo sapiens
cagcagacaucagaacaca

SEQ ID NO: 527190 - RNA, 19 nt, Homo sapiens
gguuugaaaguacuccuua

SEQ ID NO: 527191 - RNA, 19 nt, Homo sapiens
ugauauuguuugccucuga

SEQ ID NO: 527192 - RNA, 19 nt, Homo sapiens
cuagagcccgguucuguaa

SEQ ID NO: 527193 - RNA, 19 nt, Homo sapiens
guuugaaaguacuccuuaa

SEQ ID NO: 527194 - RNA, 19 nt, Homo sapiens
ugccauccuuauuguguua

SEQ ID NO: 527195 - RNA, 19 nt, Homo sapiens
caaaagcacuggaaaugag

SEQ ID NO: 527196 - RNA, 19 nt, Homo sapiens
ugucagcucguuucacuuu

SEQ ID NO: 527197 - RNA, 19 nt, Homo sapiens
ucuagaagacuacaauuca

SEQ ID NO: 527198 - RNA, 19 nt, Homo sapiens
cucagcagcccucauauaa

SEQ ID NO: 527199 - RNA, 19 nt, Homo sapiens
ugaaaugguccaguacaaa

SEQ ID NO: 527200 - RNA, 19 nt, Homo sapiens
ugauuuccuucucaacauu

SEQ ID NO: 527201 - RNA, 19 nt, Homo sapiens
guaucacuaucugaaacua

SEQ ID NO: 527202 - RNA, 19 nt, Homo sapiens
gugauuuccuucucaacau

SEQ ID NO: 527203 - RNA, 19 nt, Homo sapiens
gaagggacuuaugucuaca

SEQ ID NO: 527204 - RNA, 19 nt, Homo sapiens
cugaaaugguccaguacaa

SEQ ID NO: 527205 - RNA, 19 nt, Homo sapiens
ggaugaaacaaccguauac

SEQ ID NO: 527206 - RNA, 19 nt, Homo sapiens
guuugccucugaagugaaa

SEQ ID NO: 527207 - RNA, 19 nt, Homo sapiens
ucucuucucugccauccuu

SEQ ID NO: 527208 - RNA, 19 nt, Homo sapiens
acucagagaucacucaaaa

SEQ ID NO: 527209 - RNA, 19 nt, Homo sapiens
ccugcacucuuauuggauu

SEQ ID NO: 527210 - RNA, 19 nt, Homo sapiens
gaccaugcccauccacuca

SEQ ID NO: 527211 - RNA, 19 nt, Homo sapiens
aagaagggacuuaugucua

SEQ ID NO: 527212 - RNA, 19 nt, Homo sapiens
gcugucuugucaugauauu

SEQ ID NO: 527213 - RNA, 19 nt, Homo sapiens
ucauauguaucacuaucug

SEQ ID NO: 527214 - RNA, 19 nt, Homo sapiens
uccaucauauguaucacua

SEQ ID NO: 527215 - RNA, 19 nt, Homo sapiens
gagcauccacgucaauguc

SEQ ID NO: 527216 - RNA, 19 nt, Homo sapiens
uuagugcugugaggaguaa

SEQ ID NO: 527217 - RNA, 19 nt, Homo sapiens
gaugcaggcuauuuucuug

SEQ ID NO: 527218 - RNA, 19 nt, Homo sapiens
uaaagaagggacuuauguc

SEQ ID NO: 527219 - RNA, 19 nt, Homo sapiens
uuggaacuauuuacaagga

SEQ ID NO: 527220 - RNA, 19 nt, Homo sapiens
ccucauauaauagguuuga

SEQ ID NO: 527221 - RNA, 19 nt, Homo sapiens
acucagcagcccucauaua

SEQ ID NO: 527222 - RNA, 19 nt, Homo sapiens
aaauauaccaccucauucu

SEQ ID NO: 527223 - RNA, 19 nt, Homo sapiens
uggcugucuugucaugaua

SEQ ID NO: 527224 - RNA, 19 nt, Homo sapiens
ucucugccauccuuauugu

SEQ ID NO: 527225 - RNA, 19 nt, Homo sapiens
gaucuuuaaagggugauuu

SEQ ID NO: 527226 - RNA, 19 nt, Homo sapiens
gacagcaaacagaucacua

SEQ ID NO: 527227 - RNA, 19 nt, Homo sapiens
aagcagagaaugacagcaa

SEQ ID NO: 527228 - RNA, 19 nt, Homo sapiens
cuguaagucuuuagcugaa

SEQ ID NO: 527229 - RNA, 19 nt, Homo sapiens
cuagaagacuacaauucag

SEQ ID NO: 527230 - RNA, 19 nt, Homo sapiens
gaaugacagcaaacagauc

SEQ ID NO: 527231 - RNA, 19 nt, Homo sapiens
ggugauuuccuucucaaca

SEQ ID NO: 527232 - RNA, 19 nt, Homo sapiens
cauucuggcugacuaaagg

SEQ ID NO: 527233 - RNA, 19 nt, Homo sapiens
caaaaucccauuacccuau

SEQ ID NO: 527234 - RNA, 19 nt, Homo sapiens
ccgguucuguaagucuuua

SEQ ID NO: 527235 - RNA, 19 nt, Homo sapiens
aaagaagggacuuaugucu

SEQ ID NO: 527236 - RNA, 19 nt, Homo sapiens
auuccucucugucuucuug

SEQ ID NO: 527237 - RNA, 19 nt, Homo sapiens
gcccgguucuguaagucuu

SEQ ID NO: 527238 - RNA, 19 nt, Homo sapiens
cuggacaauuucuagaaga

SEQ ID NO: 527239 - RNA, 19 nt, Homo sapiens
ccacaggugcugaguacuc

SEQ ID NO: 527240 - RNA, 19 nt, Homo sapiens
gcuauucgccagcagacau

SEQ ID NO: 527241 - RNA, 19 nt, Homo sapiens
guggcugucuugucaugau

SEQ ID NO: 527242 - RNA, 19 nt, Homo sapiens
ccuggacaauuucuagaag

SEQ ID NO: 527243 - RNA, 19 nt, Homo sapiens
ccccuuaaaucaggaaaua

SEQ ID NO: 527244 - RNA, 19 nt, Homo sapiens
ccaugcccauccacucaga

SEQ ID NO: 527245 - RNA, 19 nt, Homo sapiens
aggaugaaacaaccguaua

SEQ ID NO: 527246 - RNA, 19 nt, Homo sapiens
agaaugacagcaaacagau

SEQ ID NO: 527247 - RNA, 19 nt, Homo sapiens
ucucuguuccguagaaaga

SEQ ID NO: 527248 - RNA, 19 nt, Homo sapiens
ggauuccucucugucuucu

SEQ ID NO: 527249 - RNA, 19 nt, Homo sapiens
guacaaaagcacuggaaau

SEQ ID NO: 527250 - RNA, 19 nt, Homo sapiens
gcugaaaugguccaguaca

SEQ ID NO: 527251 - RNA, 19 nt, Homo sapiens
ccuuaaaucaggaaauaca

SEQ ID NO: 527252 - RNA, 19 nt, Homo sapiens
ucagcagcccucauauaau

SEQ ID NO: 527253 - RNA, 19 nt, Homo sapiens
aaccugcuguccuccagaa

SEQ ID NO: 527254 - RNA, 19 nt, Homo sapiens
uguaagucuuuagcugaaa

SEQ ID NO: 527255 - RNA, 19 nt, Homo sapiens
cagcagcccucauauaaua

SEQ ID NO: 527256 - RNA, 19 nt, Homo sapiens
gauacaggcuggaaaguaa

SEQ ID NO: 527257 - RNA, 19 nt, Homo sapiens
ggacagccuucuucaugua

SEQ ID NO: 527258 - RNA, 19 nt, Homo sapiens
uaauguagcugcagaucua

SEQ ID NO: 527259 - RNA, 19 nt, Homo sapiens
caaaggcaguugacuagaa

SEQ ID NO: 527260 - RNA, 19 nt, Homo sapiens
ggcaggagcuggacaaguu

SEQ ID NO: 527261 - RNA, 19 nt, Homo sapiens
ugacuagaaucgacaaauu

SEQ ID NO: 527262 - RNA, 19 nt, Homo sapiens
guacucagcagcccucaua

SEQ ID NO: 527263 - RNA, 19 nt, Homo sapiens
gaaaguaagggaagcagaa

SEQ ID NO: 527264 - RNA, 19 nt, Homo sapiens
gaacugacccuuccuucau

SEQ ID NO: 527265 - RNA, 19 nt, Homo sapiens
caaauuacguacuaaggau

SEQ ID NO: 527266 - RNA, 19 nt, Homo sapiens
ggcaaaccuuucuauaauu

SEQ ID NO: 527267 - RNA, 19 nt, Homo sapiens
aaaccaagcuuaggguauu

SEQ ID NO: 527268 - RNA, 19 nt, Homo sapiens
gaaaugcaguacgggcuuu

SEQ ID NO: 527269 - RNA, 19 nt, Homo sapiens
ccguauaccugagaaauaa

SEQ ID NO: 527270 - RNA, 19 nt, Homo sapiens
aaaggcacauggaauauau

SEQ ID NO: 527271 - RNA, 19 nt, Homo sapiens
ccagaaagcaccaaggaaa

SEQ ID NO: 527272 - RNA, 19 nt, Homo sapiens
gaaaauccaucaccucuca

SEQ ID NO: 527273 - RNA, 19 nt, Homo sapiens
aggcaaaccuuucuauaau

SEQ ID NO: 527274 - RNA, 19 nt, Homo sapiens
gaucucugcuuaguacauu

SEQ ID NO: 527275 - RNA, 19 nt, Homo sapiens
gggaagaucauuugaguuc

SEQ ID NO: 527276 - RNA, 19 nt, Homo sapiens
ggaguagacuugcuuuggu

SEQ ID NO: 527277 - RNA, 19 nt, Homo sapiens
gaucuaauguacugaaagg

SEQ ID NO: 527278 - RNA, 19 nt, Homo sapiens
gagaaugacagcaaacaga

SEQ ID NO: 527279 - RNA, 19 nt, Homo sapiens
gcagaaacaacuaauguag

SEQ ID NO: 527280 - RNA, 19 nt, Homo sapiens
caaaggcacauggaauaua

SEQ ID NO: 527281 - RNA, 19 nt, Homo sapiens
ggauacaggcuggaaagua

SEQ ID NO: 527282 - RNA, 19 nt, Homo sapiens
uaauacgacuugcuggauu

SEQ ID NO: 527283 - RNA, 19 nt, Homo sapiens
gaccacaggugcugaguac

SEQ ID NO: 527284 - RNA, 19 nt, Homo sapiens
gaagaucauuugaguucag

SEQ ID NO: 527285 - RNA, 19 nt, Homo sapiens
gcagaaggaaggcuuugaa

SEQ ID NO: 527286 - RNA, 19 nt, Homo sapiens
gauauuguuugccucugaa

SEQ ID NO: 527287 - RNA, 19 nt, Homo sapiens
acacauuuguugccagauu

SEQ ID NO: 527288 - RNA, 19 nt, Homo sapiens
guuacagccugggcaauaa

SEQ ID NO: 527289 - RNA, 19 nt, Homo sapiens
gggacagccuucuucaugu

SEQ ID NO: 527290 - RNA, 19 nt, Homo sapiens
caucagaacacaccgaguu

SEQ ID NO: 527291 - RNA, 19 nt, Homo sapiens
gaacuauuuacaaggauga

SEQ ID NO: 527292 - RNA, 19 nt, Homo sapiens
ccacugaggaaucaugaaa

SEQ ID NO: 527293 - RNA, 19 nt, Homo sapiens
agaagggacuuaugucuac

SEQ ID NO: 527294 - RNA, 19 nt, Homo sapiens
gcccucauauaauagguuu

SEQ ID NO: 527295 - RNA, 19 nt, Homo sapiens
gugggaagaucauuugagu

SEQ ID NO: 527296 - RNA, 19 nt, Homo sapiens
ggacuuaugucuacaaaac

SEQ ID NO: 527297 - RNA, 19 nt, Homo sapiens
cagcugagccuggaacuga

SEQ ID NO: 527298 - RNA, 19 nt, Homo sapiens
aaaggcaguugacuagaau

SEQ ID NO: 527299 - RNA, 19 nt, Homo sapiens
ggacaccguuguggaucaa

SEQ ID NO: 527300 - RNA, 19 nt, Homo sapiens
gcuauagugucucgaguac

SEQ ID NO: 527301 - RNA, 19 nt, Homo sapiens
ggaagaucauuugaguuca

SEQ ID NO: 527302 - RNA, 19 nt, Homo sapiens
caaggugggaagaucauuu

SEQ ID NO: 527303 - RNA, 19 nt, Homo sapiens
cacauuuguugccagauuu

SEQ ID NO: 527304 - RNA, 19 nt, Homo sapiens
ggacaaguuuaugggugaa

SEQ ID NO: 527305 - RNA, 19 nt, Homo sapiens
gcagaucuaauguacugaa

SEQ ID NO: 527306 - RNA, 19 nt, Homo sapiens
aauacgacuugcuggauuu

SEQ ID NO: 527307 - RNA, 19 nt, Homo sapiens
ugaaugggcuccuaauacg

SEQ ID NO: 527308 - RNA, 19 nt, Homo sapiens
cagcagacaucagaacaca

SEQ ID NO: 527309 - RNA, 19 nt, Homo sapiens
gguuugaaaguacuccuua

SEQ ID NO: 527310 - RNA, 19 nt, Homo sapiens
gacuagaaucgacaaauug

SEQ ID NO: 527311 - RNA, 19 nt, Homo sapiens
cugcagaucuaauguacug

SEQ ID NO: 527312 - RNA, 19 nt, Homo sapiens
agaaacaacuaauguagcu

SEQ ID NO: 527313 - RNA, 19 nt, Homo sapiens
gaagccguuucucaucaug

SEQ ID NO: 527314 - RNA, 19 nt, Homo sapiens
ucacgacaguacuuucaau

SEQ ID NO: 527315 - RNA, 19 nt, Homo sapiens
gagacccugucacuaacaa

SEQ ID NO: 527316 - RNA, 19 nt, Homo sapiens
ugauauuguuugccucuga

SEQ ID NO: 527317 - RNA, 19 nt, Homo sapiens
guuugaaaguacuccuuaa

SEQ ID NO: 527318 - RNA, 19 nt, Homo sapiens
aaugaucucugcuuaguac

SEQ ID NO: 527319 - RNA, 19 nt, Homo sapiens
gacuugcuuuggucacuuu

SEQ ID NO: 527320 - RNA, 19 nt, Homo sapiens
cagaucuaauguacugaaa

SEQ ID NO: 527321 - RNA, 19 nt, Homo sapiens
ugccauccuuauuguguua

SEQ ID NO: 527322 - RNA, 19 nt, Homo sapiens
cucagcagcccucauauaa

SEQ ID NO: 527323 - RNA, 19 nt, Homo sapiens
gaucugcagcugacuaaag

SEQ ID NO: 527324 - RNA, 19 nt, Homo sapiens
ugcaaucgcuuuccuaaaa

SEQ ID NO: 527325 - RNA, 19 nt, Homo sapiens
gcaggagcuggacaaguuu

SEQ ID NO: 527326 - RNA, 19 nt, Homo sapiens
ucauuugaguucaggaguu

SEQ ID NO: 527327 - RNA, 19 nt, Homo sapiens
gcugcaaucgcuuuccuaa

SEQ ID NO: 527328 - RNA, 19 nt, Homo sapiens
cagaaggaaggcuuugaaa

SEQ ID NO: 527329 - RNA, 19 nt, Homo sapiens
caaaaucugcaaacucuaa

SEQ ID NO: 527330 - RNA, 19 nt, Homo sapiens
gggacaccguuguggauca

SEQ ID NO: 527331 - RNA, 19 nt, Homo sapiens
uaaagacgcagaaacaacu

SEQ ID NO: 527332 - RNA, 19 nt, Homo sapiens
gaagggacuuaugucuaca

SEQ ID NO: 527333 - RNA, 19 nt, Homo sapiens
ggaugaaacaaccguauac

SEQ ID NO: 527334 - RNA, 19 nt, Homo sapiens
guaucacuguaucaucuug

SEQ ID NO: 527335 - RNA, 19 nt, Homo sapiens
cgaguacuaauaugcaauu

SEQ ID NO: 527336 - RNA, 19 nt, Homo sapiens
ucucuucucugccauccuu

SEQ ID NO: 527337 - RNA, 19 nt, Homo sapiens
guuugccucugaagugaaa

SEQ ID NO: 527338 - RNA, 19 nt, Homo sapiens
aagaagggacuuaugucua

SEQ ID NO: 527339 - RNA, 19 nt, Homo sapiens
gcugucuugucaugauauu

SEQ ID NO: 527340 - RNA, 19 nt, Homo sapiens
caauuacauucacgacagu

SEQ ID NO: 527341 - RNA, 19 nt, Homo sapiens
gagcauccacgucaauguc

SEQ ID NO: 527342 - RNA, 19 nt, Homo sapiens
uaucaaaggcacauggaau

SEQ ID NO: 527343 - RNA, 19 nt, Homo sapiens
acaaauuacguacuaagga

SEQ ID NO: 527344 - RNA, 19 nt, Homo sapiens
ucucuaauauauccacaca

SEQ ID NO: 527345 - RNA, 19 nt, Homo sapiens
ggauuucaguucccuuuug

SEQ ID NO: 527346 - RNA, 19 nt, Homo sapiens
uggccggaguguucaguuu

SEQ ID NO: 527347 - RNA, 19 nt, Homo sapiens
uaggaccacugaggaauca

SEQ ID NO: 527348 - RNA, 19 nt, Homo sapiens
gauaucaaaggcacaugga

SEQ ID NO: 527349 - RNA, 19 nt, Homo sapiens
gagcuggacaaguuuaugg

SEQ ID NO: 527350 - RNA, 19 nt, Homo sapiens
uaaagaagggacuuauguc

SEQ ID NO: 527351 - RNA, 19 nt, Homo sapiens
uuggaacuauuuacaagga

SEQ ID NO: 527352 - RNA, 19 nt, Homo sapiens
ccucauauaauagguuuga

SEQ ID NO: 527353 - RNA, 19 nt, Homo sapiens
acucagcagcccucauaua

SEQ ID NO: 527354 - RNA, 19 nt, Homo sapiens
cgguaucacuguaucaucu

SEQ ID NO: 527355 - RNA, 19 nt, Homo sapiens
guccaaagauuuccaauua

SEQ ID NO: 527356 - RNA, 19 nt, Homo sapiens
gauacaggcuggaaaguaa

SEQ ID NO: 527357 - RNA, 19 nt, Homo sapiens
ggacagccuucuucaugua

SEQ ID NO: 527358 - RNA, 19 nt, Homo sapiens
uaauguagcugcagaucua

SEQ ID NO: 527359 - RNA, 19 nt, Homo sapiens
caaaggcaguugacuagaa

SEQ ID NO: 527360 - RNA, 19 nt, Homo sapiens
ggcaggagcuggacaaguu

SEQ ID NO: 527361 - RNA, 19 nt, Homo sapiens
cguaauaaaugcagucaaa

SEQ ID NO: 527362 - RNA, 19 nt, Homo sapiens
ugacuagaaucgacaaauu

SEQ ID NO: 527363 - RNA, 19 nt, Homo sapiens
gaaaguaagggaagcagaa

SEQ ID NO: 527364 - RNA, 19 nt, Homo sapiens
gaaccucgcccucacagaa

SEQ ID NO: 527365 - RNA, 19 nt, Homo sapiens
caaauuacguacuaaggau

SEQ ID NO: 527366 - RNA, 19 nt, Homo sapiens
ggcaaaccuuucuauaauu

SEQ ID NO: 527367 - RNA, 19 nt, Homo sapiens
ccguucagcuuccguaaua

SEQ ID NO: 527368 - RNA, 19 nt, Homo sapiens
gaaaugcaguacgggcuuu

SEQ ID NO: 527369 - RNA, 19 nt, Homo sapiens
aaaggcacauggaauauau

SEQ ID NO: 527370 - RNA, 19 nt, Homo sapiens
gaaaauccaucaccucuca

SEQ ID NO: 527371 - RNA, 19 nt, Homo sapiens
aggcaaaccuuucuauaau

SEQ ID NO: 527372 - RNA, 19 nt, Homo sapiens
gcugggagcuguccguuca

SEQ ID NO: 527373 - RNA, 19 nt, Homo sapiens
gggaagaucauuugaguuc

SEQ ID NO: 527374 - RNA, 19 nt, Homo sapiens
ggaguagacuugcuuuggu

SEQ ID NO: 527375 - RNA, 19 nt, Homo sapiens
gaucuaauguacugaaagg

SEQ ID NO: 527376 - RNA, 19 nt, Homo sapiens
gcagaaacaacuaauguag

SEQ ID NO: 527377 - RNA, 19 nt, Homo sapiens
caaaggcacauggaauaua

SEQ ID NO: 527378 - RNA, 19 nt, Homo sapiens
gaaggcaguuugaaagacu

SEQ ID NO: 527379 - RNA, 19 nt, Homo sapiens
ggauacaggcuggaaagua

SEQ ID NO: 527380 - RNA, 19 nt, Homo sapiens
uaauacgacuugcuggauu

SEQ ID NO: 527381 - RNA, 19 nt, Homo sapiens
ccaaagauuuccaauuagg

SEQ ID NO: 527382 - RNA, 19 nt, Homo sapiens
gaagaucauuugaguucag

SEQ ID NO: 527383 - RNA, 19 nt, Homo sapiens
gcagaaggaaggcuuugaa

SEQ ID NO: 527384 - RNA, 19 nt, Homo sapiens
gauauuguuugccucugaa

SEQ ID NO: 527385 - RNA, 19 nt, Homo sapiens
acacauuuguugccagauu

SEQ ID NO: 527386 - RNA, 19 nt, Homo sapiens
guuacagccugggcaauaa

SEQ ID NO: 527387 - RNA, 19 nt, Homo sapiens
ggagaaaagccaaguauga

SEQ ID NO: 527388 - RNA, 19 nt, Homo sapiens
gggacagccuucuucaugu

SEQ ID NO: 527389 - RNA, 19 nt, Homo sapiens
cuucaucuacugacauuua

SEQ ID NO: 527390 - RNA, 19 nt, Homo sapiens
agaagggacuuaugucuac

SEQ ID NO: 527391 - RNA, 19 nt, Homo sapiens
gugggaagaucauuugagu

SEQ ID NO: 527392 - RNA, 19 nt, Homo sapiens
ggacuuaugucuacaaaac

SEQ ID NO: 527393 - RNA, 19 nt, Homo sapiens
aaaggcaguugacuagaau

SEQ ID NO: 527394 - RNA, 19 nt, Homo sapiens
ggacaccguuguggaucaa

SEQ ID NO: 527395 - RNA, 19 nt, Homo sapiens
ggaagaucauuugaguuca

SEQ ID NO: 527396 - RNA, 19 nt, Homo sapiens
caaggugggaagaucauuu

SEQ ID NO: 527397 - RNA, 19 nt, Homo sapiens
cacauuuguugccagauuu

SEQ ID NO: 527398 - RNA, 19 nt, Homo sapiens
gcagaucuaauguacugaa

SEQ ID NO: 527399 - RNA, 19 nt, Homo sapiens
aauacgacuugcuggauuu

SEQ ID NO: 527400 - RNA, 19 nt, Homo sapiens
ugaaugggcuccuaauacg

SEQ ID NO: 527401 - RNA, 19 nt, Homo sapiens
ggacaaguuuaugggugaa

SEQ ID NO: 527402 - RNA, 19 nt, Homo sapiens
gggagaagaagcagcagaa

SEQ ID NO: 527403 - RNA, 19 nt, Homo sapiens
gacuagaaucgacaaauug

SEQ ID NO: 527404 - RNA, 19 nt, Homo sapiens
cugcagaucuaauguacug

SEQ ID NO: 527405 - RNA, 19 nt, Homo sapiens
agaaacaacuaauguagcu

SEQ ID NO: 527406 - RNA, 19 nt, Homo sapiens
gaagccguuucucaucaug

SEQ ID NO: 527407 - RNA, 19 nt, Homo sapiens
ugauauuguuugccucuga

SEQ ID NO: 527408 - RNA, 19 nt, Homo sapiens
gacuugcuuuggucacuuu

SEQ ID NO: 527409 - RNA, 19 nt, Homo sapiens
cagaucuaauguacugaaa

SEQ ID NO: 527410 - RNA, 19 nt, Homo sapiens
ugccauccuuauuguguua

SEQ ID NO: 527411 - RNA, 19 nt, Homo sapiens
caaguaugagugaugauga

SEQ ID NO: 527412 - RNA, 19 nt, Homo sapiens
ugcaaucgcuuuccuaaaa

SEQ ID NO: 527413 - RNA, 19 nt, Homo sapiens
aaccgucgauggugaaguu

SEQ ID NO: 527414 - RNA, 19 nt, Homo sapiens
ucauuugaguucaggaguu

SEQ ID NO: 527415 - RNA, 19 nt, Homo sapiens
gcugcaaucgcuuuccuaa

SEQ ID NO: 527416 - RNA, 19 nt, Homo sapiens
cagaaggaaggcuuugaaa

SEQ ID NO: 527417 - RNA, 19 nt, Homo sapiens
ggagaagaagcagcagaaa

SEQ ID NO: 527418 - RNA, 19 nt, Homo sapiens
gcaggagcuggacaaguuu

SEQ ID NO: 527419 - RNA, 19 nt, Homo sapiens
uaaagacgcagaaacaacu

SEQ ID NO: 527420 - RNA, 19 nt, Homo sapiens
gaagggacuuaugucuaca

SEQ ID NO: 527421 - RNA, 19 nt, Homo sapiens
gggacaccguuguggauca

SEQ ID NO: 527422 - RNA, 19 nt, Homo sapiens
guuugccucugaagugaaa

SEQ ID NO: 527423 - RNA, 19 nt, Homo sapiens
ucucuucucugccauccuu

SEQ ID NO: 527424 - RNA, 19 nt, Homo sapiens
gccuucaucuacugacauu

SEQ ID NO: 527425 - RNA, 19 nt, Homo sapiens
aagaagggacuuaugucua

SEQ ID NO: 527426 - RNA, 19 nt, Homo sapiens
gcugucuugucaugauauu

SEQ ID NO: 527427 - RNA, 19 nt, Homo sapiens
guucagcuuccguaauaaa

SEQ ID NO: 527428 - RNA, 19 nt, Homo sapiens
uaucaaaggcacauggaau

SEQ ID NO: 527429 - RNA, 19 nt, Homo sapiens
acaaauuacguacuaagga

SEQ ID NO: 527430 - RNA, 19 nt, Homo sapiens
gagcauccacgucaauguc

SEQ ID NO: 527431 - RNA, 19 nt, Homo sapiens
ucucuaauauauccacaca

SEQ ID NO: 527432 - RNA, 19 nt, Homo sapiens
cauuuaaccuggcgagaac

SEQ ID NO: 527433 - RNA, 19 nt, Homo sapiens
ggauuucaguucccuuuug

SEQ ID NO: 527434 - RNA, 19 nt, Homo sapiens
gagaaccgucgauggugaa

SEQ ID NO: 527435 - RNA, 19 nt, Homo sapiens
gauaucaaaggcacaugga

SEQ ID NO: 527436 - RNA, 19 nt, Homo sapiens
uuacagauucuuaguccaa

SEQ ID NO: 527437 - RNA, 19 nt, Homo sapiens
uaaagaagggacuuauguc

SEQ ID NO: 527438 - RNA, 19 nt, Homo sapiens
gagcuggacaaguuuaugg

SEQ ID NO: 527439 - RNA, 19 nt, Homo sapiens
uggccggaguguucaguuu

SEQ ID NO: 527440 - RNA, 19 nt, Homo sapiens
gagaagaagcagcagaaaa

SEQ ID NO: 527441 - RNA, 19 nt, Homo sapiens
aaauauaccaccucauucu

SEQ ID NO: 527442 - RNA, 19 nt, Homo sapiens
uggcugucuugucaugaua

SEQ ID NO: 527443 - RNA, 19 nt, Homo sapiens
ucucugccauccuuauugu

SEQ ID NO: 527444 - RNA, 19 nt, Homo sapiens
ucaaaggcacauggaauau

SEQ ID NO: 527445 - RNA, 19 nt, Homo sapiens
ucgugacaauguuuacaaa

SEQ ID NO: 527446 - RNA, 19 nt, Homo sapiens
ucaggacccuucgugacaa

SEQ ID NO: 527447 - RNA, 19 nt, Homo sapiens
cagcuuccguaauaaaugc

SEQ ID NO: 527448 - RNA, 19 nt, Homo sapiens
uauauccacacauuuguug

SEQ ID NO: 527449 - RNA, 19 nt, Homo sapiens
gacccuucgugacaauguu

SEQ ID NO: 527450 - RNA, 19 nt, Homo sapiens
ggcagucccuucccauugc

SEQ ID NO: 527451 - RNA, 19 nt, Homo sapiens
cauuugaguucaggaguuc

SEQ ID NO: 527452 - RNA, 19 nt, Homo sapiens
ccaaguaugagugaugaug

SEQ ID NO: 527453 - RNA, 19 nt, Homo sapiens
aucaaaggcacauggaaua

SEQ ID NO: 527454 - RNA, 19 nt, Homo sapiens
uagcugcagaucuaaugua

SEQ ID NO: 527455 - RNA, 19 nt, Homo sapiens
gaaacuaucuuguuguuga

SEQ ID NO: 527456 - RNA, 19 nt, Homo sapiens
ggacagccuucuucaugua

SEQ ID NO: 527457 - RNA, 19 nt, Homo sapiens
ggagggagcacacgaguga

SEQ ID NO: 527458 - RNA, 19 nt, Homo sapiens
ccacugcacuggcucauuc

SEQ ID NO: 527459 - RNA, 19 nt, Homo sapiens
caacaggaaucuuguccau

SEQ ID NO: 527460 - RNA, 19 nt, Homo sapiens
gcucauuccugccucaguu

SEQ ID NO: 527461 - RNA, 19 nt, Homo sapiens
caucauauguaucacuauc

SEQ ID NO: 527462 - RNA, 19 nt, Homo sapiens
gggacagccuucuucaugu

SEQ ID NO: 527463 - RNA, 19 nt, Homo sapiens
acaggaaucuuguccaucu

SEQ ID NO: 527464 - RNA, 19 nt, Homo sapiens
uauaagcucugugagacaa

SEQ ID NO: 527465 - RNA, 19 nt, Homo sapiens
cugaaacuaucuuguuguu

SEQ ID NO: 527466 - RNA, 19 nt, Homo sapiens
ggugucagcucguuucacu

SEQ ID NO: 527467 - RNA, 19 nt, Homo sapiens
uccaacaccuagaauaaug

SEQ ID NO: 527468 - RNA, 19 nt, Homo sapiens
ggaaucuuguccaucuugu

SEQ ID NO: 527469 - RNA, 19 nt, Homo sapiens
ugagacaacaggaaucuug

SEQ ID NO: 527470 - RNA, 19 nt, Homo sapiens
ugccauccuuauuguguua

SEQ ID NO: 527471 - RNA, 19 nt, Homo sapiens
ugucagcucguuucacuuu

SEQ ID NO: 527472 - RNA, 19 nt, Homo sapiens
gguuauaagcucugugaga

SEQ ID NO: 527473 - RNA, 19 nt, Homo sapiens
aaucuuguccaucuuguuu

SEQ ID NO: 527474 - RNA, 19 nt, Homo sapiens
guaucacuaucugaaacua

SEQ ID NO: 527475 - RNA, 19 nt, Homo sapiens
ugauuuccuucucaacauu

SEQ ID NO: 527476 - RNA, 19 nt, Homo sapiens
gugauuuccuucucaacau

SEQ ID NO: 527477 - RNA, 19 nt, Homo sapiens
ucucuucucugccauccuu

SEQ ID NO: 527478 - RNA, 19 nt, Homo sapiens
acucagagaucacucaaaa

SEQ ID NO: 527479 - RNA, 19 nt, Homo sapiens
cuuccaacaccuagaauaa

SEQ ID NO: 527480 - RNA, 19 nt, Homo sapiens
ucauauguaucacuaucug

SEQ ID NO: 527481 - RNA, 19 nt, Homo sapiens
uccaucauauguaucacua

SEQ ID NO: 527482 - RNA, 19 nt, Homo sapiens
gaccaugcccauccacuca

SEQ ID NO: 527483 - RNA, 19 nt, Homo sapiens
gagcauccacgucaauguc

SEQ ID NO: 527484 - RNA, 19 nt, Homo sapiens
uuagugcugugaggaguaa

SEQ ID NO: 527485 - RNA, 19 nt, Homo sapiens
gaugcaggcuauuuucuug

SEQ ID NO: 527486 - RNA, 19 nt, Homo sapiens
cagguuauaagcucuguga

SEQ ID NO: 527487 - RNA, 19 nt, Homo sapiens
ucucugccauccuuauugu

SEQ ID NO: 527488 - RNA, 19 nt, Homo sapiens
gcucuacuuccaacaccua

SEQ ID NO: 527489 - RNA, 19 nt, Homo sapiens
gaucuuuaaagggugauuu

SEQ ID NO: 527490 - RNA, 19 nt, Homo sapiens
ggugauuuccuucucaaca

SEQ ID NO: 527491 - RNA, 19 nt, Homo sapiens
caaaaucccauuacccuau

SEQ ID NO: 527492 - RNA, 19 nt, Homo sapiens
cuacuuccaacaccuagaa

SEQ ID NO: 527493 - RNA, 19 nt, Homo sapiens
gaaucuuguccaucuuguu

SEQ ID NO: 527494 - RNA, 19 nt, Homo sapiens
ccaugcccauccacucaga

SEQ ID NO: 527495 - RNA, 19 nt, Homo sapiens
caggaaucuuguccaucuu

SEQ ID NO: 527496 - RNA, 19 nt, Homo sapiens
uaagcucugugagacaaca

SEQ ID NO: 527497 - RNA, 19 nt, Homo sapiens
gaagaaaccuacaaucaaa

SEQ ID NO: 527498 - RNA, 19 nt, Homo sapiens
gaacaucacugccaaagga

SEQ ID NO: 527499 - RNA, 19 nt, Homo sapiens
ggaauuagaucaucacuuc

SEQ ID NO: 527500 - RNA, 19 nt, Homo sapiens
gaacguggcucacauaagu

SEQ ID NO: 527501 - RNA, 19 nt, Homo sapiens
gaaacuaccugguuaaaca

SEQ ID NO: 527502 - RNA, 19 nt, Homo sapiens
acaaacagcucaccacaua

SEQ ID NO: 527503 - RNA, 19 nt, Homo sapiens
ugaaagaugugcuaaauga

SEQ ID NO: 527504 - RNA, 19 nt, Homo sapiens
guaagcaggugaugaagua

SEQ ID NO: 527505 - RNA, 19 nt, Homo sapiens
gaagaacgcuggaauaggu

SEQ ID NO: 527506 - RNA, 19 nt, Homo sapiens
ggaaagagcaucacaguug

SEQ ID NO: 527507 - RNA, 19 nt, Homo sapiens
gcaagacacuuccgaaaug

SEQ ID NO: 527508 - RNA, 19 nt, Homo sapiens
ucaaauggcugaauaugaa

SEQ ID NO: 527509 - RNA, 19 nt, Homo sapiens
gcaaggagaucgcuacuca

SEQ ID NO: 527510 - RNA, 19 nt, Homo sapiens
gaagaagaggcaauuaaua

SEQ ID NO: 527511 - RNA, 19 nt, Homo sapiens
uagaagaacugaucaaaug

SEQ ID NO: 527512 - RNA, 19 nt, Homo sapiens
ggaauaagauuugcagaga

SEQ ID NO: 527513 - RNA, 19 nt, Homo sapiens
ucacaaagguacuuaagaa

SEQ ID NO: 527514 - RNA, 19 nt, Homo sapiens
gaaggaagcuauuggaucu

SEQ ID NO: 527515 - RNA, 19 nt, Homo sapiens
gauagaugcuuuccaaguu

SEQ ID NO: 527516 - RNA, 19 nt, Homo sapiens
gcagaugaauuaaaccaaa

SEQ ID NO: 527517 - RNA, 19 nt, Homo sapiens
gauguugaauuaucgcuua

SEQ ID NO: 527518 - RNA, 19 nt, Homo sapiens
gaaaaggugucucaacaua

SEQ ID NO: 527519 - RNA, 19 nt, Homo sapiens
agacuuaacucaagaaaug

SEQ ID NO: 527520 - RNA, 19 nt, Homo sapiens
aacagaggcugaagaauua

SEQ ID NO: 527521 - RNA, 19 nt, Homo sapiens
ggagacaguuccauuguga

SEQ ID NO: 527522 - RNA, 19 nt, Homo sapiens
ggacagaauuaauagaaug

SEQ ID NO: 527523 - RNA, 19 nt, Homo sapiens
ggucaccacugaaacauuu

SEQ ID NO: 527524 - RNA, 19 nt, Homo sapiens
cuaagaagaucaacaguga

SEQ ID NO: 527525 - RNA, 19 nt, Homo sapiens
gauaugagaacagcaauua

SEQ ID NO: 527526 - RNA, 19 nt, Homo sapiens
aaacucaaauggcugaaua

SEQ ID NO: 527527 - RNA, 19 nt, Homo sapiens
uaacagaggcugaagaauu

SEQ ID NO: 527528 - RNA, 19 nt, Homo sapiens
caacuugcuucuggaauua

SEQ ID NO: 527529 - RNA, 19 nt, Homo sapiens
gcaagcagauuucuuugga

SEQ ID NO: 527530 - RNA, 19 nt, Homo sapiens
gauggaagcuucuugaaag

SEQ ID NO: 527531 - RNA, 19 nt, Homo sapiens
aaagauccguuugcaauua

SEQ ID NO: 527532 - RNA, 19 nt, Homo sapiens
gcagagagcaagcagauuu

SEQ ID NO: 527533 - RNA, 19 nt, Homo sapiens
ggagaagguuucaucagaa

SEQ ID NO: 527534 - RNA, 19 nt, Homo sapiens
gcuauuggaucuucuagaa

SEQ ID NO: 527535 - RNA, 19 nt, Homo sapiens
ggaaaccacccaucaauga

SEQ ID NO: 527536 - RNA, 19 nt, Homo sapiens
acagauaucucuuuaagga

SEQ ID NO: 527537 - RNA, 19 nt, Homo sapiens
ggagaugcuuucagauaaa

SEQ ID NO: 527538 - RNA, 19 nt, Homo sapiens
cauggaugauguugaauua

SEQ ID NO: 527539 - RNA, 19 nt, Homo sapiens
gaaaagaaaccaacaagua

SEQ ID NO: 527540 - RNA, 19 nt, Homo sapiens
uggaauagguuacaagaaa

SEQ ID NO: 527541 - RNA, 19 nt, Homo sapiens
ugaaagaugucaugaagga

SEQ ID NO: 527542 - RNA, 19 nt, Homo sapiens
ucagaacaauguggaauua

SEQ ID NO: 527543 - RNA, 19 nt, Homo sapiens
gaacagcaauuacagaaaa

SEQ ID NO: 527544 - RNA, 19 nt, Homo sapiens
ggacaugcauaucuggaaa

SEQ ID NO: 527545 - RNA, 19 nt, Homo sapiens
cagcaaggcucaaacuuau

SEQ ID NO: 527546 - RNA, 19 nt, Homo sapiens
caaagguacuuaagaacaa

SEQ ID NO: 527547 - RNA, 19 nt, Homo sapiens
aaauaaagcuuccaguuca

SEQ ID NO: 527548 - RNA, 19 nt, Homo sapiens
gagaaaaccugcaagaauu

SEQ ID NO: 527549 - RNA, 19 nt, Homo sapiens
ugaaggaaauagagacuaa

SEQ ID NO: 527550 - RNA, 19 nt, Homo sapiens
ggaagaacguggagaacug

SEQ ID NO: 527551 - RNA, 19 nt, Homo sapiens
ugaagguucuuuacaauga

SEQ ID NO: 527552 - RNA, 19 nt, Homo sapiens
gcaagaauuugaugaugug

SEQ ID NO: 527553 - RNA, 19 nt, Homo sapiens
cgaauucagugauaucauu

SEQ ID NO: 527554 - RNA, 19 nt, Homo sapiens
gacaacaacuuaugaugga

SEQ ID NO: 527555 - RNA, 19 nt, Homo sapiens
uacaaaggcugacuuagaa

SEQ ID NO: 527556 - RNA, 19 nt, Homo sapiens
gugagaaacuggaggcuuu

SEQ ID NO: 527557 - RNA, 19 nt, Homo sapiens
ggaacaagcuaaaggucuu

SEQ ID NO: 527558 - RNA, 19 nt, Homo sapiens
gugcagagcuguugaacug

SEQ ID NO: 527559 - RNA, 19 nt, Homo sapiens
cagauggacucgccuuuaa

SEQ ID NO: 527560 - RNA, 19 nt, Homo sapiens
ggagaaugcucuucaggau

SEQ ID NO: 527561 - RNA, 19 nt, Homo sapiens
cugaagaacugaugagaaa

SEQ ID NO: 527562 - RNA, 19 nt, Homo sapiens
ugacuuggauacagaaauu

SEQ ID NO: 527563 - RNA, 19 nt, Homo sapiens
ggaagaauguaucucaaca

SEQ ID NO: 527564 - RNA, 19 nt, Homo sapiens
gcaaggcucaaacuuauuu

SEQ ID NO: 527565 - RNA, 19 nt, Homo sapiens
ucaaugauauguucacaga

SEQ ID NO: 527566 - RNA, 19 nt, Homo sapiens
gaggaggucuggucuuguu

SEQ ID NO: 527567 - RNA, 19 nt, Homo sapiens
ccaaagauggaaugacuua

SEQ ID NO: 527568 - RNA, 19 nt, Homo sapiens
cagaacgaauucagugaua

SEQ ID NO: 527569 - RNA, 19 nt, Homo sapiens
ggaagacucucugaagaau

SEQ ID NO: 527570 - RNA, 19 nt, Homo sapiens
caacacugcuauuuacgaa

SEQ ID NO: 527571 - RNA, 19 nt, Homo sapiens
aaaccaaacuggacaaauc

SEQ ID NO: 527572 - RNA, 19 nt, Homo sapiens
ggaacuaagugucaguguu

SEQ ID NO: 527573 - RNA, 19 nt, Homo sapiens
gcaaccaacugauaacaca

SEQ ID NO: 527574 - RNA, 19 nt, Homo sapiens
gugcugaccugguugcuuu

SEQ ID NO: 527575 - RNA, 19 nt, Homo sapiens
aaagaugucucgccagcua

SEQ ID NO: 527576 - RNA, 19 nt, Homo sapiens
ucaaauggcugaauagaac

SEQ ID NO: 527577 - RNA, 19 nt, Homo sapiens
ggacaacaucaaguuauua

SEQ ID NO: 527578 - RNA, 19 nt, Homo sapiens
gagugaagauucucaagga

SEQ ID NO: 527579 - RNA, 19 nt, Homo sapiens
gaaaguggaacaagcuaaa

SEQ ID NO: 527580 - RNA, 19 nt, Homo sapiens
uggaagaucuagaaagaaa

SEQ ID NO: 527581 - RNA, 19 nt, Homo sapiens
uaaauaaaguccagacaag

SEQ ID NO: 527582 - RNA, 19 nt, Homo sapiens
ggaauagguuacaagaaau

SEQ ID NO: 527583 - RNA, 19 nt, Homo sapiens
uaaauaacgucaacagagu

SEQ ID NO: 527584 - RNA, 19 nt, Homo sapiens
guacaugccuuaaauaacg

SEQ ID NO: 527585 - RNA, 19 nt, Homo sapiens
auagaagccuuaagcauuu

SEQ ID NO: 527586 - RNA, 19 nt, Homo sapiens
ugaaagaaaccacagagua

SEQ ID NO: 527587 - RNA, 19 nt, Homo sapiens
uuacucagcugaaugcaaa

SEQ ID NO: 527588 - RNA, 19 nt, Homo sapiens
ucagaaaccugcauuacau

SEQ ID NO: 527589 - RNA, 19 nt, Homo sapiens
gagaaggcccugcaagaaa

SEQ ID NO: 527590 - RNA, 19 nt, Homo sapiens
gaaaugaagcgucaaacau

SEQ ID NO: 527591 - RNA, 19 nt, Homo sapiens
ggugaaagaugucaugaag

SEQ ID NO: 527592 - RNA, 19 nt, Homo sapiens
aauaugcgauggaaacuuu

SEQ ID NO: 527593 - RNA, 19 nt, Homo sapiens
ggacaaggcauuggagaaa

SEQ ID NO: 527594 - RNA, 19 nt, Homo sapiens
ggacauccaggcagaaauu

SEQ ID NO: 527595 - RNA, 19 nt, Homo sapiens
gaaagaaaccacagaguac

SEQ ID NO: 527596 - RNA, 19 nt, Homo sapiens
ggaggagacugaagaacug

SEQ ID NO: 527597 - RNA, 19 nt, Homo sapiens
ggaauaaacuucagauuug

SEQ ID NO: 527598 - RNA, 19 nt, Homo sapiens
gcacauagacuaaggaaua

SEQ ID NO: 527599 - RNA, 19 nt, Homo sapiens
gcaagucuaugaccaauuu

SEQ ID NO: 527600 - RNA, 19 nt, Homo sapiens
uacauuagcuccuccauua

SEQ ID NO: 527601 - RNA, 19 nt, Homo sapiens
ggaaggugcuauucaagua

SEQ ID NO: 527602 - RNA, 19 nt, Homo sapiens
gaacagcuccgcgcaaaua

SEQ ID NO: 527603 - RNA, 19 nt, Homo sapiens
ugacuaaacuuccugcuuu

SEQ ID NO: 527604 - RNA, 19 nt, Homo sapiens
ggaaauaucauucugcaaa

SEQ ID NO: 527605 - RNA, 19 nt, Homo sapiens
gaaagucaguuugucuuaa

SEQ ID NO: 527606 - RNA, 19 nt, Homo sapiens
ccacagaaauuacagcauu

SEQ ID NO: 527607 - RNA, 19 nt, Homo sapiens
ucacaaagguaauggauug

SEQ ID NO: 527608 - RNA, 19 nt, Homo sapiens
gcucauuacuguagcauuu

SEQ ID NO: 527609 - RNA, 19 nt, Homo sapiens
gcagauacaugguguucaa

SEQ ID NO: 527610 - RNA, 19 nt, Homo sapiens
gagaguaauucacgaaaga

SEQ ID NO: 527611 - RNA, 19 nt, Homo sapiens
uaagaacucugaagcaaug

SEQ ID NO: 527612 - RNA, 19 nt, Homo sapiens
gcacuugcagcacgaauua

SEQ ID NO: 527613 - RNA, 19 nt, Homo sapiens
gggcuuauguucaaaguga

SEQ ID NO: 527614 - RNA, 19 nt, Homo sapiens
ugaccuaucugaugacaaa

SEQ ID NO: 527615 - RNA, 19 nt, Homo sapiens
gaaucuuucugcacaagua

SEQ ID NO: 527616 - RNA, 19 nt, Homo sapiens
cagcacgaauuaaguauuu

SEQ ID NO: 527617 - RNA, 19 nt, Homo sapiens
gcauuucagugggcaauua

SEQ ID NO: 527618 - RNA, 19 nt, Homo sapiens
gagaagggauggaagaauc

SEQ ID NO: 527619 - RNA, 19 nt, Homo sapiens
gguaauggauugcacauag

SEQ ID NO: 527620 - RNA, 19 nt, Homo sapiens
gaacauaugguagaaguga

SEQ ID NO: 527621 - RNA, 19 nt, Homo sapiens
ggaaagucaguuugucuua

SEQ ID NO: 527622 - RNA, 19 nt, Homo sapiens
ggaagcagauccuaauucu

SEQ ID NO: 527623 - RNA, 19 nt, Homo sapiens
ucagacugguuuauuguua

SEQ ID NO: 527624 - RNA, 19 nt, Homo sapiens
ggaguucuguaauuucaaa

SEQ ID NO: 527625 - RNA, 19 nt, Homo sapiens
ggcaacaucuuacagacua

SEQ ID NO: 527626 - RNA, 19 nt, Homo sapiens
ggaaguacagacacuauuu

SEQ ID NO: 527627 - RNA, 19 nt, Homo sapiens
cgaaagaccuacauaguac

SEQ ID NO: 527628 - RNA, 19 nt, Homo sapiens
gguggaagcuaacaaugaa

SEQ ID NO: 527629 - RNA, 19 nt, Homo sapiens
caaugucuguguccauaua

SEQ ID NO: 527630 - RNA, 19 nt, Homo sapiens
ggaaauggaaguaauggaa

SEQ ID NO: 527631 - RNA, 19 nt, Homo sapiens
gccaacagcugacucauca

SEQ ID NO: 527632 - RNA, 19 nt, Homo sapiens
uaaacgugaugcuuucuuu

SEQ ID NO: 527633 - RNA, 19 nt, Homo sapiens
uuucugggcugaugaauuu

SEQ ID NO: 527634 - RNA, 19 nt, Homo sapiens
ggaacaaauugcaaagugu

SEQ ID NO: 527635 - RNA, 19 nt, Homo sapiens
ugaauggaaugcuguuauu

SEQ ID NO: 527636 - RNA, 19 nt, Homo sapiens
aagaagaaccagcucauua

SEQ ID NO: 527637 - RNA, 19 nt, Homo sapiens
gguacgaucuacuggaauu

SEQ ID NO: 527638 - RNA, 19 nt, Homo sapiens
guaagguaguuagcaauuu

SEQ ID NO: 527639 - RNA, 19 nt, Homo sapiens
gcuauuggcuggugcaaca

SEQ ID NO: 527640 - RNA, 19 nt, Homo sapiens
aaacuuugguggaagcuaa

SEQ ID NO: 527641 - RNA, 19 nt, Homo sapiens
gaaauggaaguaauggaaa

SEQ ID NO: 527642 - RNA, 19 nt, Homo sapiens
aagcaaauguuccagugua

SEQ ID NO: 527643 - RNA, 19 nt, Homo sapiens
gaacacagcacagcagaau

SEQ ID NO: 527644 - RNA, 19 nt, Homo sapiens
gcuguucgcugcuaugaau

SEQ ID NO: 527645 - RNA, 19 nt, Homo sapiens
ucacauugcccacuuauau

SEQ ID NO: 527646 - RNA, 19 nt, Homo sapiens
ggaccaauauugaccuauc

SEQ ID NO: 527647 - RNA, 19 nt, Homo sapiens
ugcuggagcucuuaaguua

SEQ ID NO: 527648 - RNA, 19 nt, Homo sapiens
gagcaagccuucaggaaac

SEQ ID NO: 527649 - RNA, 19 nt, Homo sapiens
gcacucacucuaccucaua

SEQ ID NO: 527650 - RNA, 19 nt, Homo sapiens
ucaaacacuacuccuauua

SEQ ID NO: 527651 - RNA, 19 nt, Homo sapiens
caacaacauugcuuggaau

SEQ ID NO: 527652 - RNA, 19 nt, Homo sapiens
ggaaguugcagcuacauga

SEQ ID NO: 527653 - RNA, 19 nt, Homo sapiens
cauaaagaccacucagaua

SEQ ID NO: 527654 - RNA, 19 nt, Homo sapiens
ccaccuacaccuaguauuu

SEQ ID NO: 527655 - RNA, 19 nt, Homo sapiens
ccauggagauucuaaguca

SEQ ID NO: 527656 - RNA, 19 nt, Homo sapiens
ucaaucaccucuccucuca

SEQ ID NO: 527657 - RNA, 19 nt, Homo sapiens
gcagcuggcucugguauuc

SEQ ID NO: 527658 - RNA, 19 nt, Homo sapiens
gcucauucaugguguuuga

SEQ ID NO: 527659 - RNA, 19 nt, Homo sapiens
gaguugggcuuauguucaa

SEQ ID NO: 527660 - RNA, 19 nt, Homo sapiens
uagccuagcuggucauuuc

SEQ ID NO: 527661 - RNA, 19 nt, Homo sapiens
cauaguacauugccaagau

SEQ ID NO: 527662 - RNA, 19 nt, Homo sapiens
cuacuuaaaugcaacuaga

SEQ ID NO: 527663 - RNA, 19 nt, Homo sapiens
ggaaagcuaugcuauucag

SEQ ID NO: 527664 - RNA, 19 nt, Homo sapiens
guaauggauugcacauaga

SEQ ID NO: 527665 - RNA, 19 nt, Homo sapiens
ggcauuaccuuaaccaaag

SEQ ID NO: 527666 - RNA, 19 nt, Homo sapiens
ucacaaaggucagaguuca

SEQ ID NO: 527667 - RNA, 19 nt, Homo sapiens
gauacaugguguucaauag

SEQ ID NO: 527668 - RNA, 19 nt, Homo sapiens
ccagagguacuacaguuua

SEQ ID NO: 527669 - RNA, 19 nt, Homo sapiens
ucaauuaggucacuucaac

SEQ ID NO: 527670 - RNA, 19 nt, Homo sapiens
gcaaugacagaccaauaaa

SEQ ID NO: 527671 - RNA, 19 nt, Homo sapiens
gcuggucauuucuuuguaa

SEQ ID NO: 527672 - RNA, 19 nt, Homo sapiens
gagauuuggucuggauaaa

SEQ ID NO: 527673 - RNA, 19 nt, Homo sapiens
gaagcuaacaaugaacaua

SEQ ID NO: 527674 - RNA, 19 nt, Homo sapiens
gaucauaccaucaaugucu

SEQ ID NO: 527675 - RNA, 19 nt, Homo sapiens
gcaacaacaccaaaugaga

SEQ ID NO: 527676 - RNA, 19 nt, Homo sapiens
gauaaagccaccaaggaaa

SEQ ID NO: 527677 - RNA, 19 nt, Homo sapiens
uagcuuugguugacuguaa

SEQ ID NO: 527678 - RNA, 19 nt, Homo sapiens
gcaaggcuguucgcugcua

SEQ ID NO: 527679 - RNA, 19 nt, Homo sapiens
gaugagcuguacuucagaa

SEQ ID NO: 527680 - RNA, 19 nt, Homo sapiens
ggucucagauccaaagcuu

SEQ ID NO: 527681 - RNA, 19 nt, Homo sapiens
ucagcgaccuggagauuug

SEQ ID NO: 527682 - RNA, 19 nt, Homo sapiens
uugaaugacuucugugaaa

SEQ ID NO: 527683 - RNA, 19 nt, Homo sapiens
caggaugccuuuauaucuu

SEQ ID NO: 527684 - RNA, 19 nt, Homo sapiens
gagggaagcucucauugcu

SEQ ID NO: 527685 - RNA, 19 nt, Homo sapiens
gaauggaacaaauugcaaa

SEQ ID NO: 527686 - RNA, 19 nt, Homo sapiens
ccacccagcuguucauaca

SEQ ID NO: 527687 - RNA, 19 nt, Homo sapiens
acucaucacugccuacaaa

SEQ ID NO: 527688 - RNA, 19 nt, Homo sapiens
gaauacuucugacaauugg

SEQ ID NO: 527689 - RNA, 19 nt, Homo sapiens
guacuacaguuuacagucu

SEQ ID NO: 527690 - RNA, 19 nt, Homo sapiens
agaaccagcucauuacugu

SEQ ID NO: 527691 - RNA, 19 nt, Homo sapiens
gcaaauguuccaguguaua

SEQ ID NO: 527692 - RNA, 19 nt, Homo sapiens
aaauaaacgugaugcuuuc

SEQ ID NO: 527693 - RNA, 19 nt, Homo sapiens
ccacagaucauaccaucaa

SEQ ID NO: 527694 - RNA, 19 nt, Homo sapiens
guaauggaaacgugccuua

SEQ ID NO: 527695 - RNA, 19 nt, Homo sapiens
gcuaugcuauucaguaucu

SEQ ID NO: 527696 - RNA, 19 nt, Homo sapiens
gagauaaagccaccaagga

SEQ ID NO: 527697 - RNA, 19 nt, Homo sapiens
gcacauagacaaagaaaua

SEQ ID NO: 527698 - RNA, 19 nt, Homo sapiens
caacaaagaucacgugaga

SEQ ID NO: 527699 - RNA, 19 nt, Homo sapiens
cgacugaggucauaagaua

SEQ ID NO: 527700 - RNA, 19 nt, Homo sapiens
acagaaaccucgauauaua

SEQ ID NO: 527701 - RNA, 19 nt, Homo sapiens
caaagaaguugcucaggua

SEQ ID NO: 527702 - RNA, 19 nt, Homo sapiens
ugacuaaacuuccugcuuu

SEQ ID NO: 527703 - RNA, 19 nt, Homo sapiens
uacacuagcucuuucauua

SEQ ID NO: 527704 - RNA, 19 nt, Homo sapiens
gcaacuagcacugguauua

SEQ ID NO: 527705 - RNA, 19 nt, Homo sapiens
gauaauggauugcacauag

SEQ ID NO: 527706 - RNA, 19 nt, Homo sapiens
gaaagucaguuugucuuaa

SEQ ID NO: 527707 - RNA, 19 nt, Homo sapiens
gaacaacugcgagcaaaua

SEQ ID NO: 527708 - RNA, 19 nt, Homo sapiens
gcucauuacuguagcauuu

SEQ ID NO: 527709 - RNA, 19 nt, Homo sapiens
gguagaagcuaacaaugaa

SEQ ID NO: 527710 - RNA, 19 nt, Homo sapiens
gcagauacaugguguucaa

SEQ ID NO: 527711 - RNA, 19 nt, Homo sapiens
agacguaacugccauuaaa

SEQ ID NO: 527712 - RNA, 19 nt, Homo sapiens
uuucugggcugaugaauua

SEQ ID NO: 527713 - RNA, 19 nt, Homo sapiens
gaacacaacacaaagauca

SEQ ID NO: 527714 - RNA, 19 nt, Homo sapiens
gauauuaugccuucucuuu

SEQ ID NO: 527715 - RNA, 19 nt, Homo sapiens
ggaccuagguacucucuau

SEQ ID NO: 527716 - RNA, 19 nt, Homo sapiens
ggaagguguuauucaagua

SEQ ID NO: 527717 - RNA, 19 nt, Homo sapiens
gcgacaaagugaauaauau

SEQ ID NO: 527718 - RNA, 19 nt, Homo sapiens
ucaagggacuuucuaauca

SEQ ID NO: 527719 - RNA, 19 nt, Homo sapiens
ggaaguaucauucugcaaa

SEQ ID NO: 527720 - RNA, 19 nt, Homo sapiens
gcaaaugucccuguguaua

SEQ ID NO: 527721 - RNA, 19 nt, Homo sapiens
gaacauaugguagaaguga

SEQ ID NO: 527722 - RNA, 19 nt, Homo sapiens
acacaaagaucauucagau

SEQ ID NO: 527723 - RNA, 19 nt, Homo sapiens
caauagaucucauacuaca

SEQ ID NO: 527724 - RNA, 19 nt, Homo sapiens
ugcuggagcucuuaaauua

SEQ ID NO: 527725 - RNA, 19 nt, Homo sapiens
gaaauuacagcacuuggaa

SEQ ID NO: 527726 - RNA, 19 nt, Homo sapiens
caagauguccuuuauguug

SEQ ID NO: 527727 - RNA, 19 nt, Homo sapiens
gaaagcaauagaucucaua

SEQ ID NO: 527728 - RNA, 19 nt, Homo sapiens
cuauaucgcuaguaaauug

SEQ ID NO: 527729 - RNA, 19 nt, Homo sapiens
acauugaccucucugauaa

SEQ ID NO: 527730 - RNA, 19 nt, Homo sapiens
gaaaagaacacaacacaaa

SEQ ID NO: 527731 - RNA, 19 nt, Homo sapiens
uaaacgugaugcuuucuuu

SEQ ID NO: 527732 - RNA, 19 nt, Homo sapiens
uaauauggaucuaguagga

SEQ ID NO: 527733 - RNA, 19 nt, Homo sapiens
agugauagcccauaaauaa

SEQ ID NO: 527734 - RNA, 19 nt, Homo sapiens
gcucuuaaauuagaucuug

SEQ ID NO: 527735 - RNA, 19 nt, Homo sapiens
gaacuacuggaauucauaa

SEQ ID NO: 527736 - RNA, 19 nt, Homo sapiens
caauagguguguuguauca

SEQ ID NO: 527737 - RNA, 19 nt, Homo sapiens
ggaggcauaugaacaacuu

SEQ ID NO: 527738 - RNA, 19 nt, Homo sapiens
gcaaagaaccagccuaugg

SEQ ID NO: 527739 - RNA, 19 nt, Homo sapiens
gaaaacauauagucaguga

SEQ ID NO: 527740 - RNA, 19 nt, Homo sapiens
gaaacaagcaggcauacug

SEQ ID NO: 527741 - RNA, 19 nt, Homo sapiens
gaagugaaaguaauggaaa

SEQ ID NO: 527742 - RNA, 19 nt, Homo sapiens
gcaaaugagacacaaagaa

SEQ ID NO: 527743 - RNA, 19 nt, Homo sapiens
gagaggaaaugggcaaaga

SEQ ID NO: 527744 - RNA, 19 nt, Homo sapiens
gauagcccauaaauaauug

SEQ ID NO: 527745 - RNA, 19 nt, Homo sapiens
ugaccucucugauaacaaa

SEQ ID NO: 527746 - RNA, 19 nt, Homo sapiens
gguacgaacuacuggaauu

SEQ ID NO: 527747 - RNA, 19 nt, Homo sapiens
uuaaaucucuccucgauca

SEQ ID NO: 527748 - RNA, 19 nt, Homo sapiens
ggaaguugcaguuacauga

SEQ ID NO: 527749 - RNA, 19 nt, Homo sapiens
cuucugcucuguuaacaua

SEQ ID NO: 527750 - RNA, 19 nt, Homo sapiens
gaaaucuucuaacccaugu

SEQ ID NO: 527751 - RNA, 19 nt, Homo sapiens
agcaauagaucucauacua

SEQ ID NO: 527752 - RNA, 19 nt, Homo sapiens
gagcagagaagcauaaaca

SEQ ID NO: 527753 - RNA, 19 nt, Homo sapiens
gaagcaaacguuguaguaa

SEQ ID NO: 527754 - RNA, 19 nt, Homo sapiens
gggcucauguucaaaguga

SEQ ID NO: 527755 - RNA, 19 nt, Homo sapiens
ccaauuaggucacuucaac

SEQ ID NO: 527756 - RNA, 19 nt, Homo sapiens
uaaaugcaguugccacguu

SEQ ID NO: 527757 - RNA, 19 nt, Homo sapiens
cuaaggaguucuguaguuu

SEQ ID NO: 527758 - RNA, 19 nt, Homo sapiens
ugacacagaauacugauuu

SEQ ID NO: 527759 - RNA, 19 nt, Homo sapiens
uagguuggaugcaucauaa

SEQ ID NO: 527760 - RNA, 19 nt, Homo sapiens
aaaccuuccugcacaagua

SEQ ID NO: 527761 - RNA, 19 nt, Homo sapiens
gaagauggcgccagaacga

SEQ ID NO: 527762 - RNA, 19 nt, Homo sapiens
gaaaauggcggaaggaaaa

SEQ ID NO: 527763 - RNA, 19 nt, Homo sapiens
ggaguacaguggagcaaug

SEQ ID NO: 527764 - RNA, 19 nt, Homo sapiens
ugaaccagcucauuacugu

SEQ ID NO: 527765 - RNA, 19 nt, Homo sapiens
cugaaugacuucugugaaa

SEQ ID NO: 527766 - RNA, 19 nt, Homo sapiens
gaucuuaccaucaauguca

SEQ ID NO: 527767 - RNA, 19 nt, Homo sapiens
ucucagaucuuaccaucaa

SEQ ID NO: 527768 - RNA, 19 nt, Homo sapiens
gaaaacagcuaucuaacuc

SEQ ID NO: 527769 - RNA, 19 nt, Homo sapiens
gcuaggcaguaauuguaua

SEQ ID NO: 527770 - RNA, 19 nt, Homo sapiens
ggaggcagauccuaauucu

SEQ ID NO: 527771 - RNA, 19 nt, Homo sapiens
cuacaagucuaguuuaaag

SEQ ID NO: 527772 - RNA, 19 nt, Homo sapiens
ucagaaugauaaccucuuu

SEQ ID NO: 527773 - RNA, 19 nt, Homo sapiens
aagcaaaugucccugugua

SEQ ID NO: 527774 - RNA, 19 nt, Homo sapiens
ggacaacaaggcauuaugu

SEQ ID NO: 527775 - RNA, 19 nt, Homo sapiens
gcuagaagcaaacguugua

SEQ ID NO: 527776 - RNA, 19 nt, Homo sapiens
ggaaagcuaugcuauucag

SEQ ID NO: 527777 - RNA, 19 nt, Homo sapiens
aaaccuacauaguacauug

SEQ ID NO: 527778 - RNA, 19 nt, Homo sapiens
gauaacgaauccacaucuu

SEQ ID NO: 527779 - RNA, 19 nt, Homo sapiens
gcaacaccuucuccuaaau

SEQ ID NO: 527780 - RNA, 19 nt, Homo sapiens
gcauuauguuuaccaaaga

SEQ ID NO: 527781 - RNA, 19 nt, Homo sapiens
gauacaugguguucaauag

SEQ ID NO: 527782 - RNA, 19 nt, Homo sapiens
auacagaaaccucgauaua

SEQ ID NO: 527783 - RNA, 19 nt, Homo sapiens
gcuggucauuucuucauaa

SEQ ID NO: 527784 - RNA, 19 nt, Homo sapiens
gagauuuggucuggauaaa

SEQ ID NO: 527785 - RNA, 19 nt, Homo sapiens
gauugugaaugguuuguug

SEQ ID NO: 527786 - RNA, 19 nt, Homo sapiens
gaagcuaacaaugaacaua

SEQ ID NO: 527787 - RNA, 19 nt, Homo sapiens
ucacagagcucuacaaaag

SEQ ID NO: 527788 - RNA, 19 nt, Homo sapiens
ccauggagauucaccaaau

SEQ ID NO: 527789 - RNA, 19 nt, Homo sapiens
guaauggaaaugugccuua

SEQ ID NO: 527790 - RNA, 19 nt, Homo sapiens
agacaaagccacaaaggaa

SEQ ID NO: 527791 - RNA, 19 nt, Homo sapiens
cagaaaccucgauauauaa

SEQ ID NO: 527792 - RNA, 19 nt, Homo sapiens
uuaaaggguuucccaaugu

SEQ ID NO: 527793 - RNA, 19 nt, Homo sapiens
ucagcgaccuggagauuug

SEQ ID NO: 527794 - RNA, 19 nt, Homo sapiens
gaauccacaucuucagaga

SEQ ID NO: 527795 - RNA, 19 nt, Homo sapiens
aaacuuugguagaagcuaa

SEQ ID NO: 527796 - RNA, 19 nt, Homo sapiens
cuacaaacucugucucuaa

SEQ ID NO: 527797 - RNA, 19 nt, Homo sapiens
gagggaagaugauaauaua

SEQ ID NO: 527798 - RNA, 19 nt, Homo sapiens
gaagugaagugauuaagaa

SEQ ID NO: 527799 - RNA, 19 nt, Homo sapiens
ggacucaggaucauuguua

SEQ ID NO: 527800 - RNA, 19 nt, Homo sapiens
ccucagauauccuauaauu

SEQ ID NO: 527801 - RNA, 19 nt, Homo sapiens
uaaaugagcugaggaagga

SEQ ID NO: 527802 - RNA, 19 nt, Homo sapiens
gaagaguucucccgaagga

SEQ ID NO: 527803 - RNA, 19 nt, Homo sapiens
ugagauaguuggauuaaga

SEQ ID NO: 527804 - RNA, 19 nt, Homo sapiens
ucagguaacuguucagaaa

SEQ ID NO: 527805 - RNA, 19 nt, Homo sapiens
gaauguauguagagaguug

SEQ ID NO: 527806 - RNA, 19 nt, Homo sapiens
ugauguaaaucccauguua

SEQ ID NO: 527807 - RNA, 19 nt, Homo sapiens
caucuggucuccaugauuu

SEQ ID NO: 527808 - RNA, 19 nt, Homo sapiens
gaucaacaaucaaagacaa

SEQ ID NO: 527809 - RNA, 19 nt, Homo sapiens
gcaaugcacucaccagaca

SEQ ID NO: 527810 - RNA, 19 nt, Homo sapiens
ggaucuaguuggcagcuua

SEQ ID NO: 527811 - RNA, 19 nt, Homo sapiens
gcuaagauaucaacaugga

SEQ ID NO: 527812 - RNA, 19 nt, Homo sapiens
gggagaaguugcaguuuga

SEQ ID NO: 527813 - RNA, 19 nt, Homo sapiens
gugaaugccugcaguuaaa

SEQ ID NO: 527814 - RNA, 19 nt, Homo sapiens
gaacacacccuuaguuucu

SEQ ID NO: 527815 - RNA, 19 nt, Homo sapiens
gaacauaaggauuacuuug

SEQ ID NO: 527816 - RNA, 19 nt, Homo sapiens
gacgagacauagaauacua

SEQ ID NO: 527817 - RNA, 19 nt, Homo sapiens
guaccacaguccaccuuua

SEQ ID NO: 527818 - RNA, 19 nt, Homo sapiens
gagacaaagcuccauauuu

SEQ ID NO: 527819 - RNA, 19 nt, Homo sapiens
gaagacuaaugcucaguug

SEQ ID NO: 527820 - RNA, 19 nt, Homo sapiens
aaacagacuuugggaauga

SEQ ID NO: 527821 - RNA, 19 nt, Homo sapiens
caaauugcauuacaagaca

SEQ ID NO: 527822 - RNA, 19 nt, Homo sapiens
gagguggcauuacugcaua

SEQ ID NO: 527823 - RNA, 19 nt, Homo sapiens
gucagaaggucagcauuua

SEQ ID NO: 527824 - RNA, 19 nt, Homo sapiens
gacaucagauucacugguu

SEQ ID NO: 527825 - RNA, 19 nt, Homo sapiens
cagaaggaaucccuaaaug

SEQ ID NO: 527826 - RNA, 19 nt, Homo sapiens
aaacuaagacucacaucua

SEQ ID NO: 527827 - RNA, 19 nt, Homo sapiens
auacaucugugucuuguuu

SEQ ID NO: 527828 - RNA, 19 nt, Homo sapiens
gugaagugauuaagaauuc

SEQ ID NO: 527829 - RNA, 19 nt, Homo sapiens
cgaaggaucuaugcacuga

SEQ ID NO: 527830 - RNA, 19 nt, Homo sapiens
cagcuaagauaucaacaug

SEQ ID NO: 527831 - RNA, 19 nt, Homo sapiens
gcuguugcuuuauacguua

SEQ ID NO: 527832 - RNA, 19 nt, Homo sapiens
gcaaggcaguugagauagu

SEQ ID NO: 527833 - RNA, 19 nt, Homo sapiens
gacguuccaucucuucuaa

SEQ ID NO: 527834 - RNA, 19 nt, Homo sapiens
agagagaguuuccacugua

SEQ ID NO: 527835 - RNA, 19 nt, Homo sapiens
ggugucaaguugccuaauu

SEQ ID NO: 527836 - RNA, 19 nt, Homo sapiens
gcacuuaacccuuugugau

SEQ ID NO: 527837 - RNA, 19 nt, Homo sapiens
ggagagaccgagagaaaga

SEQ ID NO: 527838 - RNA, 19 nt, Homo sapiens
gaaggaaucccuaaaugag

SEQ ID NO: 527839 - RNA, 19 nt, Homo sapiens
gcugaaugauggauacuau

SEQ ID NO: 527840 - RNA, 19 nt, Homo sapiens
gcaaacucuuuaaaggaaa

SEQ ID NO: 527841 - RNA, 19 nt, Homo sapiens
gagagaguuuccacuguau

SEQ ID NO: 527842 - RNA, 19 nt, Homo sapiens
gagagagaguuuccacugu

SEQ ID NO: 527843 - RNA, 19 nt, Homo sapiens
gcaggcaguuacucucuga

SEQ ID NO: 527844 - RNA, 19 nt, Homo sapiens
gaacuggaacggcagaaga

SEQ ID NO: 527845 - RNA, 19 nt, Homo sapiens
gaaaggagaacaucuacca

SEQ ID NO: 527846 - RNA, 19 nt, Homo sapiens
gaacuaggcaugcuuucug

SEQ ID NO: 527847 - RNA, 19 nt, Homo sapiens
gggagaauuugaagaguuc

SEQ ID NO: 527848 - RNA, 19 nt, Homo sapiens
gcacaucuggucuccauga

SEQ ID NO: 527849 - RNA, 19 nt, Homo sapiens
caucacaccuccagugcaa

SEQ ID NO: 527850 - RNA, 19 nt, Homo sapiens
agaaguugcaguuugauua

SEQ ID NO: 527851 - RNA, 19 nt, Homo sapiens
caauaucaaugacaaacug

SEQ ID NO: 527852 - RNA, 19 nt, Homo sapiens
caaaugcucagaagacuau

SEQ ID NO: 527853 - RNA, 19 nt, Homo sapiens
cagcauaguggucuccuua

SEQ ID NO: 527854 - RNA, 19 nt, Homo sapiens
ugagguagaugaagaagca

SEQ ID NO: 527855 - RNA, 19 nt, Homo sapiens
gugaucagcuagaagcauu

SEQ ID NO: 527856 - RNA, 19 nt, Homo sapiens
gaaguugcaguuugauuau

SEQ ID NO: 527857 - RNA, 19 nt, Homo sapiens
aagcugcacuuaacccuuu

SEQ ID NO: 527858 - RNA, 19 nt, Homo sapiens
ggagcaagcagaagaaauc

SEQ ID NO: 527859 - RNA, 19 nt, Homo sapiens
cauuugcuguugcuuuaua

SEQ ID NO: 527860 - RNA, 19 nt, Homo sapiens
gaagugagcaggucaacag

SEQ ID NO: 527861 - RNA, 19 nt, Homo sapiens
ucucugagcuuuccuacau

SEQ ID NO: 527862 - RNA, 19 nt, Homo sapiens
uacaagcaaugaacugaaa

SEQ ID NO: 527863 - RNA, 19 nt, Homo sapiens
ggaaaggaaauugaagaaa

SEQ ID NO: 527864 - RNA, 19 nt, Homo sapiens
uggaugggcugaaauacuu

SEQ ID NO: 527865 - RNA, 19 nt, Homo sapiens
gggucuagaucaacaauca

SEQ ID NO: 527866 - RNA, 19 nt, Homo sapiens
ucaaguugccuaauucuga

SEQ ID NO: 527867 - RNA, 19 nt, Homo sapiens
gcagguggaucagaacugu

SEQ ID NO: 527868 - RNA, 19 nt, Homo sapiens
gcauucagauuucauuugc

SEQ ID NO: 527869 - RNA, 19 nt, Homo sapiens
caaggcaguugagauaguu

SEQ ID NO: 527870 - RNA, 19 nt, Homo sapiens
gauguaaaucccauguuaa

SEQ ID NO: 527871 - RNA, 19 nt, Homo sapiens
gcugagcucugcuguacug

SEQ ID NO: 527872 - RNA, 19 nt, Homo sapiens
agacaaaggaagugcauuu

SEQ ID NO: 527873 - RNA, 19 nt, Homo sapiens
ucuaccagcuguugauuga

SEQ ID NO: 527874 - RNA, 19 nt, Homo sapiens
ugcaaacucuuuaaaggaa

SEQ ID NO: 527875 - RNA, 19 nt, Homo sapiens
cagaauguauguagagagu

SEQ ID NO: 527876 - RNA, 19 nt, Homo sapiens
gaaaacaggacaucagauu

SEQ ID NO: 527877 - RNA, 19 nt, Homo sapiens
gcauaguggucuccuuaca

SEQ ID NO: 527878 - RNA, 19 nt, Homo sapiens
ugagagacuucaguacaaa

SEQ ID NO: 527879 - RNA, 19 nt, Homo sapiens
gcccucagauuagaugaaa

SEQ ID NO: 527880 - RNA, 19 nt, Homo sapiens
gcaagcagaagaaaucauc

SEQ ID NO: 527881 - RNA, 19 nt, Homo sapiens
caaaggaagugcauuuuca

SEQ ID NO: 527882 - RNA, 19 nt, Homo sapiens
cauuugaacauaaggguua

SEQ ID NO: 527883 - RNA, 19 nt, Homo sapiens
gaucagcuagaagcauuua

SEQ ID NO: 527884 - RNA, 19 nt, Homo sapiens
uguaugcggugucaaguug

SEQ ID NO: 527885 - RNA, 19 nt, Homo sapiens
aaacaggacaucagauuca

SEQ ID NO: 527886 - RNA, 19 nt, Homo sapiens
gcuccuugauaccuacuuu

SEQ ID NO: 527887 - RNA, 19 nt, Homo sapiens
uaagagacaaagcuccaua

SEQ ID NO: 527888 - RNA, 19 nt, Homo sapiens
uauggugucuaucuucuga

SEQ ID NO: 527889 - RNA, 19 nt, Homo sapiens
gauaccuacuuuacacuuc

SEQ ID NO: 527890 - RNA, 19 nt, Homo sapiens
cuuacgaugucuucucuuu

SEQ ID NO: 527891 - RNA, 19 nt, Homo sapiens
gaaggucagcauuuacaug

SEQ ID NO: 527892 - RNA, 19 nt, Homo sapiens
cgagguuacugcagucaga

SEQ ID NO: 527893 - RNA, 19 nt, Homo sapiens
uauaaugaacacacccuua

SEQ ID NO: 527894 - RNA, 19 nt, Homo sapiens
gugagcaggucaacaguag

SEQ ID NO: 527895 - RNA, 19 nt, Homo sapiens
gaaugaacauaaggauuac

SEQ ID NO: 527896 - RNA, 19 nt, Homo sapiens
agaaggaaucccuaaauga

SEQ ID NO: 527897 - RNA, 19 nt, Homo sapiens
gggagaagcuagagaaauu

SEQ ID NO: 527898 - RNA, 19 nt, Homo sapiens
ggagaaaggugaccggauu

SEQ ID NO: 527899 - RNA, 19 nt, Homo sapiens
gagcaagucucuaggcaau

SEQ ID NO: 527900 - RNA, 19 nt, Homo sapiens
caagaaagaggcaaagaaa

SEQ ID NO: 527901 - RNA, 19 nt, Homo sapiens
gcaacaagcucuggaaugc

SEQ ID NO: 527902 - RNA, 19 nt, Homo sapiens
cuagagaaauuccaacaga

SEQ ID NO: 527903 - RNA, 19 nt, Homo sapiens
gcaagucucuaggcaaugu

SEQ ID NO: 527904 - RNA, 19 nt, Homo sapiens
gaccaucucccuccaguuu

SEQ ID NO: 527905 - RNA, 19 nt, Homo sapiens
uaaugugacucgcugguuu

SEQ ID NO: 527906 - RNA, 19 nt, Homo sapiens
ccugaaaccuguacugaau

SEQ ID NO: 527907 - RNA, 19 nt, Homo sapiens
caagaucagucuccagcaa

SEQ ID NO: 527908 - RNA, 19 nt, Homo sapiens
gcucugugaugucuacuug

SEQ ID NO: 527909 - RNA, 19 nt, Homo sapiens
ggagaccggucaugacauc

SEQ ID NO: 527910 - RNA, 19 nt, Homo sapiens
gcaagaugaggauguauug

SEQ ID NO: 527911 - RNA, 19 nt, Homo sapiens
acauugagguggauaagaa

SEQ ID NO: 527912 - RNA, 19 nt, Homo sapiens
cgaggugucuucaugaugu

SEQ ID NO: 527913 - RNA, 19 nt, Homo sapiens
gccagacccuguacacuug

SEQ ID NO: 527914 - RNA, 19 nt, Homo sapiens
ggcaucaucuaucgcagua

SEQ ID NO: 527915 - RNA, 19 nt, Homo sapiens
cagaagaccugaguguguu

SEQ ID NO: 527916 - RNA, 19 nt, Homo sapiens
cugcucagcucaagaaaga

SEQ ID NO: 527917 - RNA, 19 nt, Homo sapiens
ccagcaagaugaggaugua

SEQ ID NO: 527918 - RNA, 19 nt, Homo sapiens
cgccggaucuggaauaaug

SEQ ID NO: 527919 - RNA, 19 nt, Homo sapiens
gcaguacccgccuuguuaa

SEQ ID NO: 527920 - RNA, 19 nt, Homo sapiens
ggaaguggaaggaggagaa

SEQ ID NO: 527921 - RNA, 19 nt, Homo sapiens
uagagaaauuccaacagaa

SEQ ID NO: 527922 - RNA, 19 nt, Homo sapiens
gauccggccugacuguuuc

SEQ ID NO: 527923 - RNA, 19 nt, Homo sapiens
ggauuuaccaccaguugaa

SEQ ID NO: 527924 - RNA, 19 nt, Homo sapiens
gaacgugauccacccauuc

SEQ ID NO: 527925 - RNA, 19 nt, Homo sapiens
gcugggagauguggcugua

SEQ ID NO: 527926 - RNA, 19 nt, Homo sapiens
cgcaguacccgccuuguua

SEQ ID NO: 527927 - RNA, 19 nt, Homo sapiens
ucuaugagcucugugaugu

SEQ ID NO: 527928 - RNA, 19 nt, Homo sapiens
caaaaugacuaugaaguug

SEQ ID NO: 527929 - RNA, 19 nt, Homo sapiens
gagaaaggugaccggauuu

SEQ ID NO: 527930 - RNA, 19 nt, Homo sapiens
guucggaccuucucauaac

SEQ ID NO: 527931 - RNA, 19 nt, Homo sapiens
aagcagagcucaggaaggu

SEQ ID NO: 527932 - RNA, 19 nt, Homo sapiens
gaguaugggcguccuaaug

SEQ ID NO: 527933 - RNA, 19 nt, Homo sapiens
ucaagaaagaggcaaagaa

SEQ ID NO: 527934 - RNA, 19 nt, Homo sapiens
ucucggagccuucccauug

SEQ ID NO: 527935 - RNA, 19 nt, Homo sapiens
gaagcuagagaaauuccaa

SEQ ID NO: 527936 - RNA, 19 nt, Homo sapiens
gaugaggauguauuggaua

SEQ ID NO: 527937 - RNA, 19 nt, Homo sapiens
gaaggcagccaaggaguuc

SEQ ID NO: 527938 - RNA, 19 nt, Homo sapiens
agacaaugcugggagaugu

SEQ ID NO: 527939 - RNA, 19 nt, Homo sapiens
ccaggccucucucucauca

SEQ ID NO: 527940 - RNA, 19 nt, Homo sapiens
gagccaggccucucucuca

SEQ ID NO: 527941 - RNA, 19 nt, Homo sapiens
ggauccggccugacuguuu

SEQ ID NO: 527942 - RNA, 19 nt, Homo sapiens
guacccgccuuguuaacug

SEQ ID NO: 527943 - RNA, 19 nt, Homo sapiens
cgaggaaggcaucaucuau

SEQ ID NO: 527944 - RNA, 19 nt, Homo sapiens
gaagccaagcuccaacaga

SEQ ID NO: 527945 - RNA, 19 nt, Homo sapiens
gcucuccgguuuggauuau

SEQ ID NO: 527946 - RNA, 19 nt, Homo sapiens
ccagauaccagcaccugaa

SEQ ID NO: 527947 - RNA, 19 nt, Homo sapiens
ugucuucgaugaauuugug

SEQ ID NO: 527948 - RNA, 19 nt, Homo sapiens
gaggaaggcaucaucuauc

SEQ ID NO: 527949 - RNA, 19 nt, Homo sapiens
caaagaaacgggagaagcu

SEQ ID NO: 527950 - RNA, 19 nt, Homo sapiens
ggacuguuccguggcauug

SEQ ID NO: 527951 - RNA, 19 nt, Homo sapiens
cauggacccuaaacucuca

SEQ ID NO: 527952 - RNA, 19 nt, Homo sapiens
gaucuggaauaaugugacu

SEQ ID NO: 527953 - RNA, 19 nt, Homo sapiens
ugaaaccuguacugaaugg

SEQ ID NO: 527954 - RNA, 19 nt, Homo sapiens
gucaugacauccucuucuu

SEQ ID NO: 527955 - RNA, 19 nt, Homo sapiens
guucuccucuggccucuuc

SEQ ID NO: 527956 - RNA, 19 nt, Homo sapiens
gaaguggaaggaggagaaa

SEQ ID NO: 527957 - RNA, 19 nt, Homo sapiens
cuacagcccucgguaugug

SEQ ID NO: 527958 - RNA, 19 nt, Homo sapiens
gaagaugagcaagucucua

SEQ ID NO: 527959 - RNA, 19 nt, Homo sapiens
gagcuggcgcuaagcauca

SEQ ID NO: 527960 - RNA, 19 nt, Homo sapiens
gggagaaggcagccaagga

SEQ ID NO: 527961 - RNA, 19 nt, Homo sapiens
agaaaggugaccggauuua

SEQ ID NO: 527962 - RNA, 19 nt, Homo sapiens
cuacuuggagugccugaaa

SEQ ID NO: 527963 - RNA, 19 nt, Homo sapiens
cagccuacuuugucacugu

SEQ ID NO: 527964 - RNA, 19 nt, Homo sapiens
acaaggagaagguggaguu

SEQ ID NO: 527965 - RNA, 19 nt, Homo sapiens
uccagaagaugcugugauc

SEQ ID NO: 527966 - RNA, 19 nt, Homo sapiens
gagccuguuucaccaugga

SEQ ID NO: 527967 - RNA, 19 nt, Homo sapiens
gcuccugcccucccaaaga

SEQ ID NO: 527968 - RNA, 19 nt, Homo sapiens
cggcugcucucacccuuca

SEQ ID NO: 527969 - RNA, 19 nt, Homo sapiens
ggaaugccaccaaguuugc

SEQ ID NO: 527970 - RNA, 19 nt, Homo sapiens
ggccaaagaagggcagaaa

SEQ ID NO: 527971 - RNA, 19 nt, Homo sapiens
ucgcaucccagccuacuuu

SEQ ID NO: 527972 - RNA, 19 nt, Homo sapiens
ggucgaaggacgugguaga

SEQ ID NO: 527973 - RNA, 19 nt, Homo sapiens
gaaaggugaccggauuuac

SEQ ID NO: 527974 - RNA, 19 nt, Homo sapiens
gcugugaccaugcagguau

SEQ ID NO: 527975 - RNA, 19 nt, Homo sapiens
guaugggcguccuaaugug

SEQ ID NO: 527976 - RNA, 19 nt, Homo sapiens
ucugugaugucuacuugga

SEQ ID NO: 527977 - RNA, 19 nt, Homo sapiens
agaugaggauguauuggau

SEQ ID NO: 527978 - RNA, 19 nt, Homo sapiens
gcugcugccuuuccgauac

SEQ ID NO: 527979 - RNA, 19 nt, Homo sapiens
agaacgugauccacccauu

SEQ ID NO: 527980 - RNA, 19 nt, Homo sapiens
ggcuucggcugcacaccua

SEQ ID NO: 527981 - RNA, 19 nt, Homo sapiens
guacagcuucuggcucuau

SEQ ID NO: 527982 - RNA, 19 nt, Homo sapiens
ggaagaugagcaagucucu

SEQ ID NO: 527983 - RNA, 19 nt, Homo sapiens
ccauugucuucgaugaauu

SEQ ID NO: 527984 - RNA, 19 nt, Homo sapiens
ccaaagauaccagauacca

SEQ ID NO: 527985 - RNA, 19 nt, Homo sapiens
ggagaagcuagagaaauuc

SEQ ID NO: 527986 - RNA, 19 nt, Homo sapiens
ggggauggcagcaauaaaa

SEQ ID NO: 527987 - RNA, 19 nt, Homo sapiens
ccagguggcagcugagugu

SEQ ID NO: 527988 - RNA, 19 nt, Homo sapiens
gccaaggaguucggagugu

SEQ ID NO: 527989 - RNA, 19 nt, Homo sapiens
ugaccaaaaugacuaugaa

SEQ ID NO: 527990 - RNA, 19 nt, Homo sapiens
cgaugaauuuguggacaug

SEQ ID NO: 527991 - RNA, 19 nt, Homo sapiens
cauugucuucgaugaauuu

SEQ ID NO: 527992 - RNA, 19 nt, Homo sapiens
gagcagcagggcuucuuca

SEQ ID NO: 527993 - RNA, 19 nt, Homo sapiens
ccaucgcccuauuccagaa

SEQ ID NO: 527994 - RNA, 19 nt, Homo sapiens
uaugagcucugugaugucu

SEQ ID NO: 527995 - RNA, 19 nt, Homo sapiens
ccaaagaagggcagaaagc

SEQ ID NO: 527996 - RNA, 19 nt, Homo sapiens
gccggaagaugagcaaguc

SEQ ID NO: 527997 - RNA, 19 nt, Homo sapiens
gaaauaagaugcuguaacu

SEQ ID NO: 527998 - RNA, 19 nt, Homo sapiens
gaaauaagaugagggagaa

SEQ ID NO: 527999 - RNA, 19 nt, Homo sapiens
ggaauuggcugaagacaca

SEQ ID NO: 528000 - RNA, 19 nt, Homo sapiens
gcaggaaccucucaucaga

SEQ ID NO: 528001 - RNA, 19 nt, Homo sapiens
gaauaaaucugccaguuuu

SEQ ID NO: 528002 - RNA, 19 nt, Homo sapiens
ccacugugaugcuuuauga

SEQ ID NO: 528003 - RNA, 19 nt, Homo sapiens
cuuaaugccuucaaaguuu

SEQ ID NO: 528004 - RNA, 19 nt, Homo sapiens
gaaagaggaaaucauugaa

SEQ ID NO: 528005 - RNA, 19 nt, Homo sapiens
gaagaaggaauugcagaaa

SEQ ID NO: 528006 - RNA, 19 nt, Homo sapiens
uggaagaggugaagaagga

SEQ ID NO: 528007 - RNA, 19 nt, Homo sapiens
gggccacugugaugcuuua

SEQ ID NO: 528008 - RNA, 19 nt, Homo sapiens
ccaggaagccggacucuau

SEQ ID NO: 528009 - RNA, 19 nt, Homo sapiens
gcgagacggucaucuguuc

SEQ ID NO: 528010 - RNA, 19 nt, Homo sapiens
ugaaagaggaaaucauuga

SEQ ID NO: 528011 - RNA, 19 nt, Homo sapiens
gagccaaacucaggaaagu

SEQ ID NO: 528012 - RNA, 19 nt, Homo sapiens
gaggaaauaagaugcugua

SEQ ID NO: 528013 - RNA, 19 nt, Homo sapiens
gaaacaggagcuucuggaa

SEQ ID NO: 528014 - RNA, 19 nt, Homo sapiens
ggaugaaucugccaaucag

SEQ ID NO: 528015 - RNA, 19 nt, Homo sapiens
ggaaggaaggagggaauuu

SEQ ID NO: 528016 - RNA, 19 nt, Homo sapiens
gaaggaaagccacgcaagu

SEQ ID NO: 528017 - RNA, 19 nt, Homo sapiens
gcagaaagugaaagaggaa

SEQ ID NO: 528018 - RNA, 19 nt, Homo sapiens
agaauaaaucugccaguuu

SEQ ID NO: 528019 - RNA, 19 nt, Homo sapiens
gaaggaaggagggaauuuc

SEQ ID NO: 528020 - RNA, 19 nt, Homo sapiens
ggaauugcagaaagugaaa

SEQ ID NO: 528021 - RNA, 19 nt, Homo sapiens
agaaggaauugcagaaagu

SEQ ID NO: 528022 - RNA, 19 nt, Homo sapiens
ggaaggagggaauuucaca

SEQ ID NO: 528023 - RNA, 19 nt, Homo sapiens
gcuuaaugccuucaaaguu

SEQ ID NO: 528024 - RNA, 19 nt, Homo sapiens
cacauucccuuguucuaga

SEQ ID NO: 528025 - RNA, 19 nt, Homo sapiens
ggaaauaagaugcuguaac

SEQ ID NO: 528026 - RNA, 19 nt, Homo sapiens
agauucacuuuaacgcuua

SEQ ID NO: 528027 - RNA, 19 nt, Homo sapiens
gaaagugaaagaggaaauc

SEQ ID NO: 528028 - RNA, 19 nt, Homo sapiens
aagaaggaauugcagaaag

SEQ ID NO: 528029 - RNA, 19 nt, Homo sapiens
ugaagaaggaauugcagaa

SEQ ID NO: 528030 - RNA, 19 nt, Homo sapiens
gagaagaacagcacaaccu

SEQ ID NO: 528031 - RNA, 19 nt, Homo sapiens
gagcgagacggucaucugu

SEQ ID NO: 528032 - RNA, 19 nt, Homo sapiens
cuacuugacuuggaauugg

SEQ ID NO: 528033 - RNA, 19 nt, Homo sapiens
acgcccagcuccagugauu

SEQ ID NO: 528034 - RNA, 19 nt, Homo sapiens
gaaggaauugcagaaagug

SEQ ID NO: 528035 - RNA, 19 nt, Homo sapiens
gaagaggugaagaaggaau

SEQ ID NO: 528036 - RNA, 19 nt, Homo sapiens
ccacacuggcugcugauug

SEQ ID NO: 528037 - RNA, 19 nt, Homo sapiens
cuucuucggugaccacuuc

SEQ ID NO: 528038 - RNA, 19 nt, Homo sapiens
gccaaacucaggaaaguca

SEQ ID NO: 528039 - RNA, 19 nt, Homo sapiens
agugaaagaggaaaucauu

SEQ ID NO: 528040 - RNA, 19 nt, Homo sapiens
ggagguggagcagcagaaa

SEQ ID NO: 528041 - RNA, 19 nt, Homo sapiens
cugugaugcuuuaugauga

SEQ ID NO: 528042 - RNA, 19 nt, Homo sapiens
cacacuggcugcugauugg

SEQ ID NO: 528043 - RNA, 19 nt, Homo sapiens
ucaggaaagucagcaagca

SEQ ID NO: 528044 - RNA, 19 nt, Homo sapiens
gaaggagggaauuucacau

SEQ ID NO: 528045 - RNA, 19 nt, Homo sapiens
ccacagggacccagaagac

SEQ ID NO: 528046 - RNA, 19 nt, Homo sapiens
gcagguggucaucaacugu

SEQ ID NO: 528047 - RNA, 19 nt, Homo sapiens
cggagacccugggagaaga

SEQ ID NO: 528048 - RNA, 19 nt, Homo sapiens
aaggagggaauuucacauu

SEQ ID NO: 528049 - RNA, 19 nt, Homo sapiens
ccaaugaaccccacaggaa

SEQ ID NO: 528050 - RNA, 19 nt, Homo sapiens
gugaaagaggaaaucauug

SEQ ID NO: 528051 - RNA, 19 nt, Homo sapiens
ggagacccugggagaagaa

SEQ ID NO: 528052 - RNA, 19 nt, Homo sapiens
aaggaaagccacgcaaguu

SEQ ID NO: 528053 - RNA, 19 nt, Homo sapiens
gcguccagaucuaccacaa

SEQ ID NO: 528054 - RNA, 19 nt, Homo sapiens
guucuagauucacuuuaac

SEQ ID NO: 528055 - RNA, 19 nt, Homo sapiens
ggaccuacagagggugaaa

SEQ ID NO: 528056 - RNA, 19 nt, Homo sapiens
ucacauucccuuguucuag

SEQ ID NO: 528057 - RNA, 19 nt, Homo sapiens
aauuucacauucccuuguu

SEQ ID NO: 528058 - RNA, 19 nt, Homo sapiens
gggaaggaaggagggaauu

SEQ ID NO: 528059 - RNA, 19 nt, Homo sapiens
aagacccgcuucuccuuuc

SEQ ID NO: 528060 - RNA, 19 nt, Homo sapiens
gacacaggaaugcaucguu

SEQ ID NO: 528061 - RNA, 19 nt, Homo sapiens
aaagaggaaaucauugaag

SEQ ID NO: 528062 - RNA, 19 nt, Homo sapiens
agaagaacagcacaaccuu

SEQ ID NO: 528063 - RNA, 19 nt, Homo sapiens
ucuaugaggaaauaagaug

SEQ ID NO: 528064 - RNA, 19 nt, Homo sapiens
ggaagaggugaagaaggaa

SEQ ID NO: 528065 - RNA, 19 nt, Homo sapiens
ggagccaaacucaggaaag

SEQ ID NO: 528066 - RNA, 19 nt, Homo sapiens
uaagaugagggagaaagga

SEQ ID NO: 528067 - RNA, 19 nt, Homo sapiens
ugugaugcuuuaugaugau

SEQ ID NO: 528068 - RNA, 19 nt, Homo sapiens
aggaaagccacgcaaguug

SEQ ID NO: 528069 - RNA, 19 nt, Homo sapiens
cgacaaagcucuacucauc

SEQ ID NO: 528070 - RNA, 19 nt, Homo sapiens
ggaggaagauuauucugaa

SEQ ID NO: 528071 - RNA, 19 nt, Homo sapiens
caagagaauugaagaagaa

SEQ ID NO: 528072 - RNA, 19 nt, Homo sapiens
gcuaugagcuguucuucaa

SEQ ID NO: 528073 - RNA, 19 nt, Homo sapiens
gcccugacaugguuaauuu

SEQ ID NO: 528074 - RNA, 19 nt, Homo sapiens
gcagaacucucuaaaggau

SEQ ID NO: 528075 - RNA, 19 nt, Homo sapiens
gcagaaauacaucuacuaa

SEQ ID NO: 528076 - RNA, 19 nt, Homo sapiens
gcucaacccuggagacauu

SEQ ID NO: 528077 - RNA, 19 nt, Homo sapiens
gcagcgaguucucaaauau

SEQ ID NO: 528078 - RNA, 19 nt, Homo sapiens
gaauuugccaucagcauua

SEQ ID NO: 528079 - RNA, 19 nt, Homo sapiens
gaaggaugcagcagaauuu

SEQ ID NO: 528080 - RNA, 19 nt, Homo sapiens
ccugaaaccucaagacauu

SEQ ID NO: 528081 - RNA, 19 nt, Homo sapiens
gggcaugacuuccagaugu

SEQ ID NO: 528082 - RNA, 19 nt, Homo sapiens
cagcagaacucucuaaagg

SEQ ID NO: 528083 - RNA, 19 nt, Homo sapiens
uuacggagcugguggaguu

SEQ ID NO: 528084 - RNA, 19 nt, Homo sapiens
ucaagauccuuaacaagaa

SEQ ID NO: 528085 - RNA, 19 nt, Homo sapiens
gccaucagcauuaaauaua

SEQ ID NO: 528086 - RNA, 19 nt, Homo sapiens
ggugaaggaugcagcagaa

SEQ ID NO: 528087 - RNA, 19 nt, Homo sapiens
gaaggacuguaccggauca

SEQ ID NO: 528088 - RNA, 19 nt, Homo sapiens
caacaucuauccggagaau

SEQ ID NO: 528089 - RNA, 19 nt, Homo sapiens
gggaggacgugcagaugaa

SEQ ID NO: 528090 - RNA, 19 nt, Homo sapiens
uaaugaaauuggcugguuu

SEQ ID NO: 528091 - RNA, 19 nt, Homo sapiens
caaggagggugacaucauc

SEQ ID NO: 528092 - RNA, 19 nt, Homo sapiens
agaugaagcuggaggaaug

SEQ ID NO: 528093 - RNA, 19 nt, Homo sapiens
ccaacuacguggaggaaga

SEQ ID NO: 528094 - RNA, 19 nt, Homo sapiens
gaagaaggacaaacuacau

SEQ ID NO: 528095 - RNA, 19 nt, Homo sapiens
acaagagaauugaagaaga

SEQ ID NO: 528096 - RNA, 19 nt, Homo sapiens
gaggagaaguacacugaca

SEQ ID NO: 528097 - RNA, 19 nt, Homo sapiens
agaaguggauggagcaguu

SEQ ID NO: 528098 - RNA, 19 nt, Homo sapiens
ccuaugaccucaaggacuu

SEQ ID NO: 528099 - RNA, 19 nt, Homo sapiens
ugcgacagaucaccaauuu

SEQ ID NO: 528100 - RNA, 19 nt, Homo sapiens
caggaacuaugaagaagga

SEQ ID NO: 528101 - RNA, 19 nt, Homo sapiens
uaccaggucuucaucaaau

SEQ ID NO: 528102 - RNA, 19 nt, Homo sapiens
ucaucaagauccuuaacaa

SEQ ID NO: 528103 - RNA, 19 nt, Homo sapiens
gacaucaucaagauccuua

SEQ ID NO: 528104 - RNA, 19 nt, Homo sapiens
ggaccugucuguucaucuc

SEQ ID NO: 528105 - RNA, 19 nt, Homo sapiens
gaacuaugaagaaggacaa

SEQ ID NO: 528106 - RNA, 19 nt, Homo sapiens
ucucaaauaucaccuccuu

SEQ ID NO: 528107 - RNA, 19 nt, Homo sapiens
agaacucucuaaaggauug

SEQ ID NO: 528108 - RNA, 19 nt, Homo sapiens
cuaaugaaauuggcugguu

SEQ ID NO: 528109 - RNA, 19 nt, Homo sapiens
ggaaggcgacgagaucuau

SEQ ID NO: 528110 - RNA, 19 nt, Homo sapiens
ucgcagggcucaggacaaa

SEQ ID NO: 528111 - RNA, 19 nt, Homo sapiens
ugugucagcugcuuaacaa

SEQ ID NO: 528112 - RNA, 19 nt, Homo sapiens
ggauggagcaguuugagau

SEQ ID NO: 528113 - RNA, 19 nt, Homo sapiens
ucaaauacaaggagagguu

SEQ ID NO: 528114 - RNA, 19 nt, Homo sapiens
cgcccaagaugacagagua

SEQ ID NO: 528115 - RNA, 19 nt, Homo sapiens
gaguguaggugaugaagac

SEQ ID NO: 528116 - RNA, 19 nt, Homo sapiens
ucuaaaggauugcuucaag

SEQ ID NO: 528117 - RNA, 19 nt, Homo sapiens
gagaauugaagaagaagug

SEQ ID NO: 528118 - RNA, 19 nt, Homo sapiens
ggcaugacuuccagauguu

SEQ ID NO: 528119 - RNA, 19 nt, Homo sapiens
ggaggagaguguaggugau

SEQ ID NO: 528120 - RNA, 19 nt, Homo sapiens
gagaaacuccaggcucuga

SEQ ID NO: 528121 - RNA, 19 nt, Homo sapiens
aagcucuacucaucuguaa

SEQ ID NO: 528122 - RNA, 19 nt, Homo sapiens
caagauccuuaacaagaag

SEQ ID NO: 528123 - RNA, 19 nt, Homo sapiens
ggacaccaccuugcaguuc

SEQ ID NO: 528124 - RNA, 19 nt, Homo sapiens
acaaagcucuacucaucug

SEQ ID NO: 528125 - RNA, 19 nt, Homo sapiens
ccaagaugacagaguauga

SEQ ID NO: 528126 - RNA, 19 nt, Homo sapiens
gcagagagacgagaaacuc

SEQ ID NO: 528127 - RNA, 19 nt, Homo sapiens
cuaaaggauugcuucaagu

SEQ ID NO: 528128 - RNA, 19 nt, Homo sapiens
cauacucacuuccuaaagg

SEQ ID NO: 528129 - RNA, 19 nt, Homo sapiens
ugaaggaugcagcagaauu

SEQ ID NO: 528130 - RNA, 19 nt, Homo sapiens
uggagguguuucaggaaua

SEQ ID NO: 528131 - RNA, 19 nt, Homo sapiens
ccaaagcccgcuaugacuu

SEQ ID NO: 528132 - RNA, 19 nt, Homo sapiens
gugggaagcacaaaguauu

SEQ ID NO: 528133 - RNA, 19 nt, Homo sapiens
caaggagccugaaaagaga

SEQ ID NO: 528134 - RNA, 19 nt, Homo sapiens
gcagcagaauuugccauca

SEQ ID NO: 528135 - RNA, 19 nt, Homo sapiens
gggcagaaauacaucuacu

SEQ ID NO: 528136 - RNA, 19 nt, Homo sapiens
ccuuugaccucuucgaugu

SEQ ID NO: 528137 - RNA, 19 nt, Homo sapiens
cagaugcugcuuagaggua

SEQ ID NO: 528138 - RNA, 19 nt, Homo sapiens
gagggugacaucaucaaga

SEQ ID NO: 528139 - RNA, 19 nt, Homo sapiens
gcagugggaagcacaaagu

SEQ ID NO: 528140 - RNA, 19 nt, Homo sapiens
ucaaauaucaccuccuucu

SEQ ID NO: 528141 - RNA, 19 nt, Homo sapiens
ugcagcgaguucucaaaua

SEQ ID NO: 528142 - RNA, 19 nt, Homo sapiens
aauauaacgucgaggucaa

SEQ ID NO: 528143 - RNA, 19 nt, Homo sapiens
ggagguguuucaggaauac

SEQ ID NO: 528144 - RNA, 19 nt, Homo sapiens
ggccaucuccaacaucuau

SEQ ID NO: 528145 - RNA, 19 nt, Homo sapiens
guucauacucacuuccuaa

SEQ ID NO: 528146 - RNA, 19 nt, Homo sapiens
gaugacagaguaugacaag

SEQ ID NO: 528147 - RNA, 19 nt, Homo sapiens
uaacaagaagggacagcaa

SEQ ID NO: 528148 - RNA, 19 nt, Homo sapiens
caacauugaggaccugcuu

SEQ ID NO: 528149 - RNA, 19 nt, Homo sapiens
gaaguggauggagcaguuu

SEQ ID NO: 528150 - RNA, 19 nt, Homo sapiens
cggaggagaaguacacuga

SEQ ID NO: 528151 - RNA, 19 nt, Homo sapiens
gaugaggaccuguaugacu

SEQ ID NO: 528152 - RNA, 19 nt, Homo sapiens
ggaacggcgcuccaagaug

SEQ ID NO: 528153 - RNA, 19 nt, Homo sapiens
ggaggaugaggaccuguau

SEQ ID NO: 528154 - RNA, 19 nt, Homo sapiens
cuacguggaggaagauuau

SEQ ID NO: 528155 - RNA, 19 nt, Homo sapiens
caaagcccgcuaugacuuc

SEQ ID NO: 528156 - RNA, 19 nt, Homo sapiens
ggcagaaauacaucuacua

SEQ ID NO: 528157 - RNA, 19 nt, Homo sapiens
gacaagagaauugaagaag

SEQ ID NO: 528158 - RNA, 19 nt, Homo sapiens
caagacaagagaauugaag

SEQ ID NO: 528159 - RNA, 19 nt, Homo sapiens
cagcagaauuugccaucag

SEQ ID NO: 528160 - RNA, 19 nt, Homo sapiens
ggagaguguaggugaugaa

SEQ ID NO: 528161 - RNA, 19 nt, Homo sapiens
ugaagaaggacaaacuaca

SEQ ID NO: 528162 - RNA, 19 nt, Homo sapiens
uaugaagaaggacaaacua

SEQ ID NO: 528163 - RNA, 19 nt, Homo sapiens
uuccagauguucuccuuug

SEQ ID NO: 528164 - RNA, 19 nt, Homo sapiens
ggagaccgagacaacaaga

SEQ ID NO: 528165 - RNA, 19 nt, Homo sapiens
gaccucaaggacuuuguaa

SEQ ID NO: 528166 - RNA, 19 nt, Homo sapiens
cgacagaucaccaauuucc

SEQ ID NO: 528167 - RNA, 19 nt, Homo sapiens
ggaccugcuucguguucau

SEQ ID NO: 528168 - RNA, 19 nt, Homo sapiens
gcucaaggagggugacauc

SEQ ID NO: 528169 - RNA, 19 nt, Homo sapiens
ggacaagacucgcagauuu

SEQ ID NO: 528170 - RNA, 19 nt, Homo sapiens
gcugagcgcuuugcaauaa

SEQ ID NO: 528171 - RNA, 19 nt, Homo sapiens
ggaaguggauggagcaguu

SEQ ID NO: 528172 - RNA, 19 nt, Homo sapiens
caagaagucucacgggaaa

SEQ ID NO: 528173 - RNA, 19 nt, Homo sapiens
ucacagaggccaagaaauu

SEQ ID NO: 528174 - RNA, 19 nt, Homo sapiens
gcaauaagcaucaaguuca

SEQ ID NO: 528175 - RNA, 19 nt, Homo sapiens
cagaagauaugaagaggaa

SEQ ID NO: 528176 - RNA, 19 nt, Homo sapiens
gaaagucugccacgauaaa

SEQ ID NO: 528177 - RNA, 19 nt, Homo sapiens
cauggcagcugucuucauu

SEQ ID NO: 528178 - RNA, 19 nt, Homo sapiens
ccacagagaaugacgauga

SEQ ID NO: 528179 - RNA, 19 nt, Homo sapiens
gcuacgagcucaaggagau

SEQ ID NO: 528180 - RNA, 19 nt, Homo sapiens
gagcugcuguuccacaaga

SEQ ID NO: 528181 - RNA, 19 nt, Homo sapiens
gccaaggucuuccucgauu

SEQ ID NO: 528182 - RNA, 19 nt, Homo sapiens
cugaaagucugccacgaua

SEQ ID NO: 528183 - RNA, 19 nt, Homo sapiens
caauaagcaucaaguucaa

SEQ ID NO: 528184 - RNA, 19 nt, Homo sapiens
uggcagcugucuucauuaa

SEQ ID NO: 528185 - RNA, 19 nt, Homo sapiens
gcucaaagaagcacuggaa

SEQ ID NO: 528186 - RNA, 19 nt, Homo sapiens
ugcagagggugcucaaaua

SEQ ID NO: 528187 - RNA, 19 nt, Homo sapiens
caacaaggacgucaagaag

SEQ ID NO: 528188 - RNA, 19 nt, Homo sapiens
gugcagcagcccaugauua

SEQ ID NO: 528189 - RNA, 19 nt, Homo sapiens
uggaggacauugagaagaa

SEQ ID NO: 528190 - RNA, 19 nt, Homo sapiens
gcaggaacguggacaagac

SEQ ID NO: 528191 - RNA, 19 nt, Homo sapiens
gaacaacaaggacgucaag

SEQ ID NO: 528192 - RNA, 19 nt, Homo sapiens
ccacgauaaauuuggauua

SEQ ID NO: 528193 - RNA, 19 nt, Homo sapiens
cggauuggcugguuuccuu

SEQ ID NO: 528194 - RNA, 19 nt, Homo sapiens
ggaagccugugcugaccuu

SEQ ID NO: 528195 - RNA, 19 nt, Homo sapiens
gaaacuggaggaauuugga

SEQ ID NO: 528196 - RNA, 19 nt, Homo sapiens
aagugaaacuggaggaauu

SEQ ID NO: 528197 - RNA, 19 nt, Homo sapiens
ccaaggucuuccucgauuu

SEQ ID NO: 528198 - RNA, 19 nt, Homo sapiens
gaagauaugaagaggaagu

SEQ ID NO: 528199 - RNA, 19 nt, Homo sapiens
acaaggacgucaagaaguc

SEQ ID NO: 528200 - RNA, 19 nt, Homo sapiens
cgauaaauuuggauuaagg

SEQ ID NO: 528201 - RNA, 19 nt, Homo sapiens
gugggagggucgucuggua

SEQ ID NO: 528202 - RNA, 19 nt, Homo sapiens
aaacaucaagccagacaaa

SEQ ID NO: 528203 - RNA, 19 nt, Homo sapiens
ggauggagcaguuugagau

SEQ ID NO: 528204 - RNA, 19 nt, Homo sapiens
gaauuucagaguucuauag

SEQ ID NO: 528205 - RNA, 19 nt, Homo sapiens
gggcaugacugaagaugac

SEQ ID NO: 528206 - RNA, 19 nt, Homo sapiens
ucaaggugguggagaagga

SEQ ID NO: 528207 - RNA, 19 nt, Homo sapiens
cagaggagaccacagagaa

SEQ ID NO: 528208 - RNA, 19 nt, Homo sapiens
caucacagaggccaagaaa

SEQ ID NO: 528209 - RNA, 19 nt, Homo sapiens
ccaccacaguuuccagaug

SEQ ID NO: 528210 - RNA, 19 nt, Homo sapiens
gccgcuggcucaucgauug

SEQ ID NO: 528211 - RNA, 19 nt, Homo sapiens
ggccgcagaugucccaguu

SEQ ID NO: 528212 - RNA, 19 nt, Homo sapiens
acaccaagcaggacaggua

SEQ ID NO: 528213 - RNA, 19 nt, Homo sapiens
ccgcagaugucccaguuuc

SEQ ID NO: 528214 - RNA, 19 nt, Homo sapiens
gagauggccaugucaaaca

SEQ ID NO: 528215 - RNA, 19 nt, Homo sapiens
gaaaguccgguccauaguc

SEQ ID NO: 528216 - RNA, 19 nt, Homo sapiens
ggagugccuggaagugaua

SEQ ID NO: 528217 - RNA, 19 nt, Homo sapiens
caccacaguuuccagaugu

SEQ ID NO: 528218 - RNA, 19 nt, Homo sapiens
gguacuuguuccuguuuga

SEQ ID NO: 528219 - RNA, 19 nt, Homo sapiens
aaaguccgguccauaguca

SEQ ID NO: 528220 - RNA, 19 nt, Homo sapiens
ugguggccgugcagaauua

SEQ ID NO: 528221 - RNA, 19 nt, Homo sapiens
aaacagaagauaugaagag

SEQ ID NO: 528222 - RNA, 19 nt, Homo sapiens
agaccgaggccaaguacua

SEQ ID NO: 528223 - RNA, 19 nt, Homo sapiens
gucucuagcuccucuguga

SEQ ID NO: 528224 - RNA, 19 nt, Homo sapiens
ggacaccacacucaaguac

SEQ ID NO: 528225 - RNA, 19 nt, Homo sapiens
ucaaauaccaccugcucuu

SEQ ID NO: 528226 - RNA, 19 nt, Homo sapiens
ccucagggccucagcuuug

SEQ ID NO: 528227 - RNA, 19 nt, Homo sapiens
uggaguugguggaguacua

SEQ ID NO: 528228 - RNA, 19 nt, Homo sapiens
caaauaccaccugcucuug

SEQ ID NO: 528229 - RNA, 19 nt, Homo sapiens
gcagcugucuucauuaacc

SEQ ID NO: 528230 - RNA, 19 nt, Homo sapiens
ccuuugaccucuucgaugu

SEQ ID NO: 528231 - RNA, 19 nt, Homo sapiens
ugucccaguuucuguguuu

SEQ ID NO: 528232 - RNA, 19 nt, Homo sapiens
caagaccaccaacugcaaa

SEQ ID NO: 528233 - RNA, 19 nt, Homo sapiens
aauaccaccugcucuugaa

SEQ ID NO: 528234 - RNA, 19 nt, Homo sapiens
gcagagggugcucaaauac

SEQ ID NO: 528235 - RNA, 19 nt, Homo sapiens
aaaugggcaugacugaaga

SEQ ID NO: 528236 - RNA, 19 nt, Homo sapiens
gaggagaccacagagaaug

SEQ ID NO: 528237 - RNA, 19 nt, Homo sapiens
cagcaucgcgcagaacaaa

SEQ ID NO: 528238 - RNA, 19 nt, Homo sapiens
gcugguuuccuucaacgua

SEQ ID NO: 528239 - RNA, 19 nt, Homo sapiens
gagaccaacggacggauug

SEQ ID NO: 528240 - RNA, 19 nt, Homo sapiens
cggacaaccugcucaaguc

SEQ ID NO: 528241 - RNA, 19 nt, Homo sapiens
gaagaugacaagaggaacu

SEQ ID NO: 528242 - RNA, 19 nt, Homo sapiens
acaucaaggugguggagaa

SEQ ID NO: 528243 - RNA, 19 nt, Homo sapiens
gagaucgacuacacugcau

SEQ ID NO: 528244 - RNA, 19 nt, Homo sapiens
cauacgcaccuuccugaaa

SEQ ID NO: 528245 - RNA, 19 nt, Homo sapiens
caguuucuguguuugaaga

SEQ ID NO: 528246 - RNA, 19 nt, Homo sapiens
cuaccuaauucaccuucaa

SEQ ID NO: 528247 - RNA, 19 nt, Homo sapiens
ucagcgaauuucagaguuc

SEQ ID NO: 528248 - RNA, 19 nt, Homo sapiens
gggaggacuucaggcagaa

SEQ ID NO: 528249 - RNA, 19 nt, Homo sapiens
ccaggaagucaggguauuu

SEQ ID NO: 528250 - RNA, 19 nt, Homo sapiens
gaaguggauggagcaguuu

SEQ ID NO: 528251 - RNA, 19 nt, Homo sapiens
acaacaaggacgucaagaa

SEQ ID NO: 528252 - RNA, 19 nt, Homo sapiens
gaucaucgagcugcuguuc

SEQ ID NO: 528253 - RNA, 19 nt, Homo sapiens
gauuagauacaugcagaaa

SEQ ID NO: 528254 - RNA, 19 nt, Homo sapiens
gcccugaagucugucucua

SEQ ID NO: 528255 - RNA, 19 nt, Homo sapiens
auacgcaccuuccugaaag

SEQ ID NO: 528256 - RNA, 19 nt, Homo sapiens
gcaggacagguacuuguuc

SEQ ID NO: 528257 - RNA, 19 nt, Homo sapiens
cagcagcccaugauuagau

SEQ ID NO: 528258 - RNA, 19 nt, Homo sapiens
ggacggauuggcugguuuc

SEQ ID NO: 528259 - RNA, 19 nt, Homo sapiens
caacuuuucuuuucucagu

SEQ ID NO: 528260 - RNA, 19 nt, Homo sapiens
ggacaacuggauccacauc

SEQ ID NO: 528261 - RNA, 19 nt, Homo sapiens
cuacggcuucuaccuaauu

SEQ ID NO: 528262 - RNA, 19 nt, Homo sapiens
cgagauaugagggagcuuu

SEQ ID NO: 528263 - RNA, 19 nt, Homo sapiens
ggagggucgucugguacaa

SEQ ID NO: 528264 - RNA, 19 nt, Homo sapiens
acacaaggagugccuggaa

SEQ ID NO: 528265 - RNA, 19 nt, Homo sapiens
ugaagaacauacgcaccuu

SEQ ID NO: 528266 - RNA, 19 nt, Homo sapiens
agaggcagcagcucaaaga

SEQ ID NO: 528267 - RNA, 19 nt, Homo sapiens
agucugccacgauaaauuu

SEQ ID NO: 528268 - RNA, 19 nt, Homo sapiens
gaugguggccgugcagaau

SEQ ID NO: 528269 - RNA, 19 nt, Homo sapiens
uaaagaagcuggaugaaca

SEQ ID NO: 528270 - RNA, 19 nt, Homo sapiens
cagcaaagcuaaugguauu

SEQ ID NO: 528271 - RNA, 19 nt, Homo sapiens
ggaggaagaccuugacuuu

SEQ ID NO: 528272 - RNA, 19 nt, Homo sapiens
gaacaguaccagaaguaua

SEQ ID NO: 528273 - RNA, 19 nt, Homo sapiens
gaaagcuacuaguacauug

SEQ ID NO: 528274 - RNA, 19 nt, Homo sapiens
gcuauugucuucuauaagu

SEQ ID NO: 528275 - RNA, 19 nt, Homo sapiens
gaacucaaccuugcucaaa

SEQ ID NO: 528276 - RNA, 19 nt, Homo sapiens
uuucaugacuuacugcuua

SEQ ID NO: 528277 - RNA, 19 nt, Homo sapiens
gaaugagacugcagauaca

SEQ ID NO: 528278 - RNA, 19 nt, Homo sapiens
ggacaguuguggcaaagga

SEQ ID NO: 528279 - RNA, 19 nt, Homo sapiens
gcucaggcauuguuggaaa

SEQ ID NO: 528280 - RNA, 19 nt, Homo sapiens
gaagacagacaguuugaau

SEQ ID NO: 528281 - RNA, 19 nt, Homo sapiens
aaacagacuuuggaaauuc

SEQ ID NO: 528282 - RNA, 19 nt, Homo sapiens
ggaaugagacugcagauac

SEQ ID NO: 528283 - RNA, 19 nt, Homo sapiens
gaagcuggaugaacaguac

SEQ ID NO: 528284 - RNA, 19 nt, Homo sapiens
gaucuuggccaacgugaaa

SEQ ID NO: 528285 - RNA, 19 nt, Homo sapiens
gaaauuaaacagacuuugg

SEQ ID NO: 528286 - RNA, 19 nt, Homo sapiens
ggaaagcuacuaguacauu

SEQ ID NO: 528287 - RNA, 19 nt, Homo sapiens
gauucuugcuggcagauaa

SEQ ID NO: 528288 - RNA, 19 nt, Homo sapiens
ugaaacagccugggaauga

SEQ ID NO: 528289 - RNA, 19 nt, Homo sapiens
gauguagauuccuucauga

SEQ ID NO: 528290 - RNA, 19 nt, Homo sapiens
gggcuaauguaaugcuuga

SEQ ID NO: 528291 - RNA, 19 nt, Homo sapiens
gaaugugcauggagaugga

SEQ ID NO: 528292 - RNA, 19 nt, Homo sapiens
uaagagggcuauuaagacu

SEQ ID NO: 528293 - RNA, 19 nt, Homo sapiens
ugaugaagcucaggcauug

SEQ ID NO: 528294 - RNA, 19 nt, Homo sapiens
gaaacaaggaugacucuac

SEQ ID NO: 528295 - RNA, 19 nt, Homo sapiens
uaaggacaguuguggcaaa

SEQ ID NO: 528296 - RNA, 19 nt, Homo sapiens
agacagacaguuugaauau

SEQ ID NO: 528297 - RNA, 19 nt, Homo sapiens
gagaagacagacaguuuga

SEQ ID NO: 528298 - RNA, 19 nt, Homo sapiens
caacauaagggagaucuug

SEQ ID NO: 528299 - RNA, 19 nt, Homo sapiens
gacagacaguuugaauauu

SEQ ID NO: 528300 - RNA, 19 nt, Homo sapiens
guggaaagcuacuaguaca

SEQ ID NO: 528301 - RNA, 19 nt, Homo sapiens
uaacaguucuccagagcau

SEQ ID NO: 528302 - RNA, 19 nt, Homo sapiens
ucagauaagugcagugucu

SEQ ID NO: 528303 - RNA, 19 nt, Homo sapiens
agauguagauuccuucaug

SEQ ID NO: 528304 - RNA, 19 nt, Homo sapiens
uaauuugccuugcuacaca

SEQ ID NO: 528305 - RNA, 19 nt, Homo sapiens
uagagaagacagacaguuu

SEQ ID NO: 528306 - RNA, 19 nt, Homo sapiens
aaggaugacucuaccaaga

SEQ ID NO: 528307 - RNA, 19 nt, Homo sapiens
ucaauuuacuaccacagaa

SEQ ID NO: 528308 - RNA, 19 nt, Homo sapiens
guagauuccuucaugaaac

SEQ ID NO: 528309 - RNA, 19 nt, Homo sapiens
ggaguuucaugacuuacug

SEQ ID NO: 528310 - RNA, 19 nt, Homo sapiens
cgagaucaauuuacuacca

SEQ ID NO: 528311 - RNA, 19 nt, Homo sapiens
uggccaggguuuauaauug

SEQ ID NO: 528312 - RNA, 19 nt, Homo sapiens
gaaacagccugggaaugag

SEQ ID NO: 528313 - RNA, 19 nt, Homo sapiens
ugugagacaugcuauggaa

SEQ ID NO: 528314 - RNA, 19 nt, Homo sapiens
caaccuugcucaaaagaaa

SEQ ID NO: 528315 - RNA, 19 nt, Homo sapiens
guaccagaaguauaaguuu

SEQ ID NO: 528316 - RNA, 19 nt, Homo sapiens
aacaguaccagaaguauaa

SEQ ID NO: 528317 - RNA, 19 nt, Homo sapiens
gaaauggccacagggaaug

SEQ ID NO: 528318 - RNA, 19 nt, Homo sapiens
aggaagaccuugacuuucu

SEQ ID NO: 528319 - RNA, 19 nt, Homo sapiens
gaugaacaguaccagaagu

SEQ ID NO: 528320 - RNA, 19 nt, Homo sapiens
cuaccaagaacaaagcaua

SEQ ID NO: 528321 - RNA, 19 nt, Homo sapiens
cagacaguuugaauauuug

SEQ ID NO: 528322 - RNA, 19 nt, Homo sapiens
ggccaggguuuauaauugg

SEQ ID NO: 528323 - RNA, 19 nt, Homo sapiens
caaaagaaaagaaggcuaa

SEQ ID NO: 528324 - RNA, 19 nt, Homo sapiens
cacauuaagagggcuauua

SEQ ID NO: 528325 - RNA, 19 nt, Homo sapiens
ccaagaacaaagcauaaug

SEQ ID NO: 528326 - RNA, 19 nt, Homo sapiens
aaagaagaaacaaggauga

SEQ ID NO: 528327 - RNA, 19 nt, Homo sapiens
acuuacugcuuaacgaaua

SEQ ID NO: 528328 - RNA, 19 nt, Homo sapiens
gguccucuguugcuauugu

SEQ ID NO: 528329 - RNA, 19 nt, Homo sapiens
aaauaccccuuuauccuua

SEQ ID NO: 528330 - RNA, 19 nt, Homo sapiens
guucaucuccauguaguaa

SEQ ID NO: 528331 - RNA, 19 nt, Homo sapiens
gauaagugcagugucuuug

SEQ ID NO: 528332 - RNA, 19 nt, Homo sapiens
aguggaguuucaugacuua

SEQ ID NO: 528333 - RNA, 19 nt, Homo sapiens
cuaaucggcugauguuacu

SEQ ID NO: 528334 - RNA, 19 nt, Homo sapiens
gcuaauguaaugcuugaau

SEQ ID NO: 528335 - RNA, 19 nt, Homo sapiens
ugauguuacucucacuuga

SEQ ID NO: 528336 - RNA, 19 nt, Homo sapiens
ggaugacucuaccaagaac

SEQ ID NO: 528337 - RNA, 19 nt, Homo sapiens
uauuaaagaagcuggauga

SEQ ID NO: 528338 - RNA, 19 nt, Homo sapiens
uagauuccuucaugaaaca

SEQ ID NO: 528339 - RNA, 19 nt, Homo sapiens
ucuuugcaaugccaacaua

SEQ ID NO: 528340 - RNA, 19 nt, Homo sapiens
uaaguggaguuucaugacu

SEQ ID NO: 528341 - RNA, 19 nt, Homo sapiens
gccggacgcuagcacaguu

SEQ ID NO: 528342 - RNA, 19 nt, Homo sapiens
caauauggccaggguuuau

SEQ ID NO: 528343 - RNA, 19 nt, Homo sapiens
gaaaagaaggcuaaaaggu

SEQ ID NO: 528344 - RNA, 19 nt, Homo sapiens
gggaaugagacugcagaua

SEQ ID NO: 528345 - RNA, 19 nt, Homo sapiens
uaaaugugaaucugcaaug

SEQ ID NO: 528346 - RNA, 19 nt, Homo sapiens
cugcuuaacgaauaacuaa

SEQ ID NO: 528347 - RNA, 19 nt, Homo sapiens
gugguccucuguugcuauu

SEQ ID NO: 528348 - RNA, 19 nt, Homo sapiens
agaaaacucuuagcugaaa

SEQ ID NO: 528349 - RNA, 19 nt, Homo sapiens
cagguugacauaacuuuga

SEQ ID NO: 528350 - RNA, 19 nt, Homo sapiens
uguauuaguucaucuccau

SEQ ID NO: 528351 - RNA, 19 nt, Homo sapiens
uauaaguggaguuucauga

SEQ ID NO: 528352 - RNA, 19 nt, Homo sapiens
ucaauauggccaggguuua

SEQ ID NO: 528353 - RNA, 19 nt, Homo sapiens
uuucuaaccucagauaagu

SEQ ID NO: 528354 - RNA, 19 nt, Homo sapiens
aagacagacaguuugaaua

SEQ ID NO: 528355 - RNA, 19 nt, Homo sapiens
ccacauuucucagcaaagc

SEQ ID NO: 528356 - RNA, 19 nt, Homo sapiens
agaaauggccacagggaau

SEQ ID NO: 528357 - RNA, 19 nt, Homo sapiens
gaggaagaccuugacuuuc

SEQ ID NO: 528358 - RNA, 19 nt, Homo sapiens
ucaaaacucugccuaaggu

SEQ ID NO: 528359 - RNA, 19 nt, Homo sapiens
guagagaagacagacaguu

SEQ ID NO: 528360 - RNA, 19 nt, Homo sapiens
uaccaagaacaaagcauaa

SEQ ID NO: 528361 - RNA, 19 nt, Homo sapiens
ugacuuacugcuuaacgaa

SEQ ID NO: 528362 - RNA, 19 nt, Homo sapiens
gauguuacucucacuugau

SEQ ID NO: 528363 - RNA, 19 nt, Homo sapiens
gucaauauggccaggguuu

SEQ ID NO: 528364 - RNA, 19 nt, Homo sapiens
uaucgacugccacaaagaa

SEQ ID NO: 528365 - RNA, 19 nt, Homo sapiens
agagaagacagacaguuug

SEQ ID NO: 528366 - RNA, 19 nt, Homo sapiens
uagcugaaauggccgaaaa

SEQ ID NO: 528367 - RNA, 19 nt, Homo sapiens
ggaacucaaccuugcucaa

SEQ ID NO: 528368 - RNA, 19 nt, Homo sapiens
agagggcuauuaagacuac

SEQ ID NO: 528369 - RNA, 19 nt, Homo sapiens
ggaaagaaaugcccaucua

SEQ ID NO: 528370 - RNA, 19 nt, Homo sapiens
gaaaggaaguggaauuaau

SEQ ID NO: 528371 - RNA, 19 nt, Homo sapiens
gaaugcaacucucaccuua

SEQ ID NO: 528372 - RNA, 19 nt, Homo sapiens
aaaguuggcucacaauuaa

SEQ ID NO: 528373 - RNA, 19 nt, Homo sapiens
ggagauagacuuacugaaa

SEQ ID NO: 528374 - RNA, 19 nt, Homo sapiens
gagaaaccauuuacuguug

SEQ ID NO: 528375 - RNA, 19 nt, Homo sapiens
gaaaagagguggaauuaau

SEQ ID NO: 528376 - RNA, 19 nt, Homo sapiens
caaaguuggcucacaauua

SEQ ID NO: 528377 - RNA, 19 nt, Homo sapiens
gaaggcaguucugugaaua

SEQ ID NO: 528378 - RNA, 19 nt, Homo sapiens
gcaaacacuuuaugucaau

SEQ ID NO: 528379 - RNA, 19 nt, Homo sapiens
cuaaauaccucaaccuaug

SEQ ID NO: 528380 - RNA, 19 nt, Homo sapiens
gaaaagcucuuguuuguca

SEQ ID NO: 528381 - RNA, 19 nt, Homo sapiens
ggaagucccuggaaaccaa

SEQ ID NO: 528382 - RNA, 19 nt, Homo sapiens
ggaauuaauuguucaagag

SEQ ID NO: 528383 - RNA, 19 nt, Homo sapiens
caaugaauccuguuaguuu

SEQ ID NO: 528384 - RNA, 19 nt, Homo sapiens
aaacaaaguuggcucacaa

SEQ ID NO: 528385 - RNA, 19 nt, Homo sapiens
gcaacucucaccuuaauuu

SEQ ID NO: 528386 - RNA, 19 nt, Homo sapiens
caucuacgcugacaaugaa

SEQ ID NO: 528387 - RNA, 19 nt, Homo sapiens
caucaucucuuguacaugu

SEQ ID NO: 528388 - RNA, 19 nt, Homo sapiens
aaaugcaacucucaccuua

SEQ ID NO: 528389 - RNA, 19 nt, Homo sapiens
gagcuaaauuacacauuga

SEQ ID NO: 528390 - RNA, 19 nt, Homo sapiens
gagauagacuuacugaaag

SEQ ID NO: 528391 - RNA, 19 nt, Homo sapiens
ggaaggcaguucugugaau

SEQ ID NO: 528392 - RNA, 19 nt, Homo sapiens
guauugaacuuggaaagaa

SEQ ID NO: 528393 - RNA, 19 nt, Homo sapiens
caacuggagacacuauuua

SEQ ID NO: 528394 - RNA, 19 nt, Homo sapiens
ucacgaaguuuguucauca

SEQ ID NO: 528395 - RNA, 19 nt, Homo sapiens
guauaguacuggcauggua

SEQ ID NO: 528396 - RNA, 19 nt, Homo sapiens
gggaguauaugaaugugaa

SEQ ID NO: 528397 - RNA, 19 nt, Homo sapiens
gagcaagaagucaaaguaa

SEQ ID NO: 528398 - RNA, 19 nt, Homo sapiens
gaaagaaaugcccaucuau

SEQ ID NO: 528399 - RNA, 19 nt, Homo sapiens
aauaauaccugccauugga

SEQ ID NO: 528400 - RNA, 19 nt, Homo sapiens
gaaggaugcgggaguauau

SEQ ID NO: 528401 - RNA, 19 nt, Homo sapiens
gaaguggaauuaauuaucc

SEQ ID NO: 528402 - RNA, 19 nt, Homo sapiens
gcagaaaggaaguggaauu

SEQ ID NO: 528403 - RNA, 19 nt, Homo sapiens
cgagcuaaauuacacauug

SEQ ID NO: 528404 - RNA, 19 nt, Homo sapiens
ggaguuccuugaucuguau

SEQ ID NO: 528405 - RNA, 19 nt, Homo sapiens
gaaaggcccaguugaagga

SEQ ID NO: 528406 - RNA, 19 nt, Homo sapiens
ggagacaggagacacagua

SEQ ID NO: 528407 - RNA, 19 nt, Homo sapiens
gagauugaauuacuuaagg

SEQ ID NO: 528408 - RNA, 19 nt, Homo sapiens
gcaacucucaccuuaauug

SEQ ID NO: 528409 - RNA, 19 nt, Homo sapiens
agacuucccugaauguauu

SEQ ID NO: 528410 - RNA, 19 nt, Homo sapiens
gaacgaacacucuuaucug

SEQ ID NO: 528411 - RNA, 19 nt, Homo sapiens
gagguggaauuaauuguuc

SEQ ID NO: 528412 - RNA, 19 nt, Homo sapiens
gcuaaugcuugauauguuc

SEQ ID NO: 528413 - RNA, 19 nt, Homo sapiens
gaggaaggcaguucuguga

SEQ ID NO: 528414 - RNA, 19 nt, Homo sapiens
ggacauaagaaacuggaaa

SEQ ID NO: 528415 - RNA, 19 nt, Homo sapiens
cagaaaggaaguggaauua

SEQ ID NO: 528416 - RNA, 19 nt, Homo sapiens
caggcuaaguuacauauug

SEQ ID NO: 528417 - RNA, 19 nt, Homo sapiens
caugaagagucaggaauuu

SEQ ID NO: 528418 - RNA, 19 nt, Homo sapiens
gaaaugcaacucucaccuu

SEQ ID NO: 528419 - RNA, 19 nt, Homo sapiens
ugacuggguuucucuguau

SEQ ID NO: 528420 - RNA, 19 nt, Homo sapiens
ggaauucgaacccaaacaa

SEQ ID NO: 528421 - RNA, 19 nt, Homo sapiens
caagagaaaccauuuacug

SEQ ID NO: 528422 - RNA, 19 nt, Homo sapiens
ggaagccgaucacagucaa

SEQ ID NO: 528423 - RNA, 19 nt, Homo sapiens
gacaaugaauccuguuagu

SEQ ID NO: 528424 - RNA, 19 nt, Homo sapiens
ggaaguggaauuaauuauc

SEQ ID NO: 528425 - RNA, 19 nt, Homo sapiens
gcugauguauacccauuug

SEQ ID NO: 528426 - RNA, 19 nt, Homo sapiens
gacaggagacacaguacua

SEQ ID NO: 528427 - RNA, 19 nt, Homo sapiens
gauagauaguccacugaau

SEQ ID NO: 528428 - RNA, 19 nt, Homo sapiens
ggagaacccagauagauag

SEQ ID NO: 528429 - RNA, 19 nt, Homo sapiens
gcucacaauuaagaaguuu

SEQ ID NO: 528430 - RNA, 19 nt, Homo sapiens
ccuuggagccucaaauaua

SEQ ID NO: 528431 - RNA, 19 nt, Homo sapiens
gcgggaaggugaggaguga

SEQ ID NO: 528432 - RNA, 19 nt, Homo sapiens
ccggauugcugcucagauu

SEQ ID NO: 528433 - RNA, 19 nt, Homo sapiens
acucucaccuuaauuucua

SEQ ID NO: 528434 - RNA, 19 nt, Homo sapiens
gugaaggaguuaauuugau

SEQ ID NO: 528435 - RNA, 19 nt, Homo sapiens
cuacauaucacccaagaau

SEQ ID NO: 528436 - RNA, 19 nt, Homo sapiens
gaggcagacuucccugaau

SEQ ID NO: 528437 - RNA, 19 nt, Homo sapiens
gagcugagaggcagacuuc

SEQ ID NO: 528438 - RNA, 19 nt, Homo sapiens
gaagagaaaacaacaaaga

SEQ ID NO: 528439 - RNA, 19 nt, Homo sapiens
gauaauguuugcagcuucu

SEQ ID NO: 528440 - RNA, 19 nt, Homo sapiens
ucuaccagcuccagagauu

SEQ ID NO: 528441 - RNA, 19 nt, Homo sapiens
gaaguuuguucaucagacu

SEQ ID NO: 528442 - RNA, 19 nt, Homo sapiens
acucucaccuuaauugcua

SEQ ID NO: 528443 - RNA, 19 nt, Homo sapiens
cuacagcaccuuucuggaa

SEQ ID NO: 528444 - RNA, 19 nt, Homo sapiens
gaauugcaagucuacauau

SEQ ID NO: 528445 - RNA, 19 nt, Homo sapiens
ugagcaagaagucaaagua

SEQ ID NO: 528446 - RNA, 19 nt, Homo sapiens
guugaaggaugcgggagua

SEQ ID NO: 528447 - RNA, 19 nt, Homo sapiens
gaauucgaacccaaacaaa

SEQ ID NO: 528448 - RNA, 19 nt, Homo sapiens
ggaggauacggauaugaaa

SEQ ID NO: 528449 - RNA, 19 nt, Homo sapiens
acagucaaguguucaguug

SEQ ID NO: 528450 - RNA, 19 nt, Homo sapiens
gcacuggguugacuuucag

SEQ ID NO: 528451 - RNA, 19 nt, Homo sapiens
aguguugcuuggacuauua

SEQ ID NO: 528452 - RNA, 19 nt, Homo sapiens
gcaagaagucaaaguaaaa

SEQ ID NO: 528453 - RNA, 19 nt, Homo sapiens
ggucauauagucuuguaga

SEQ ID NO: 528454 - RNA, 19 nt, Homo sapiens
guucaagagaaaccauuua

SEQ ID NO: 528455 - RNA, 19 nt, Homo sapiens
cagaguacgcaaacacuuu

SEQ ID NO: 528456 - RNA, 19 nt, Homo sapiens
ugggagcucugucacugua

SEQ ID NO: 528457 - RNA, 19 nt, Homo sapiens
agguggagcucuacucauu

SEQ ID NO: 528458 - RNA, 19 nt, Homo sapiens
gagauuuucuggaguaaga

SEQ ID NO: 528459 - RNA, 19 nt, Homo sapiens
uggagaacccagauagaua

SEQ ID NO: 528460 - RNA, 19 nt, Homo sapiens
agcaagaagucaaaguaaa

SEQ ID NO: 528461 - RNA, 19 nt, Homo sapiens
aaguguagcuaaugcuuga

SEQ ID NO: 528462 - RNA, 19 nt, Homo sapiens
gcaguucugugaauaugac

SEQ ID NO: 528463 - RNA, 19 nt, Homo sapiens
acagugacuuguggacaua

SEQ ID NO: 528464 - RNA, 19 nt, Homo sapiens
agaaaccauuuacuguuga

SEQ ID NO: 528465 - RNA, 19 nt, Homo sapiens
caagaagguggcucuguga

SEQ ID NO: 528466 - RNA, 19 nt, Homo sapiens
agguggagaucuacucuuu

SEQ ID NO: 528467 - RNA, 19 nt, Homo sapiens
gaaucuaggaaauuggaaa

SEQ ID NO: 528468 - RNA, 19 nt, Homo sapiens
aaagaaaugcccaucuaug

SEQ ID NO: 528469 - RNA, 19 nt, Homo sapiens
ggaaagaaaugcccaucua

SEQ ID NO: 528470 - RNA, 19 nt, Homo sapiens
gaaaggaaguggaauuaau

SEQ ID NO: 528471 - RNA, 19 nt, Homo sapiens
gaaugcaacucucaccuua

SEQ ID NO: 528472 - RNA, 19 nt, Homo sapiens
aaaguuggcucacaauuaa

SEQ ID NO: 528473 - RNA, 19 nt, Homo sapiens
ggagauagacuuacugaaa

SEQ ID NO: 528474 - RNA, 19 nt, Homo sapiens
gaaaagagguggaauuaau

SEQ ID NO: 528475 - RNA, 19 nt, Homo sapiens
caaaguuggcucacaauua

SEQ ID NO: 528476 - RNA, 19 nt, Homo sapiens
gaaggcaguucugugaaua

SEQ ID NO: 528477 - RNA, 19 nt, Homo sapiens
gcaaacacuuuaugucaau

SEQ ID NO: 528478 - RNA, 19 nt, Homo sapiens
cuaaauaccucaaccuaug

SEQ ID NO: 528479 - RNA, 19 nt, Homo sapiens
gaaaagcucuuguuuguca

SEQ ID NO: 528480 - RNA, 19 nt, Homo sapiens
ggaauuaauuguucaagca

SEQ ID NO: 528481 - RNA, 19 nt, Homo sapiens
ggaagucccuggaaaccaa

SEQ ID NO: 528482 - RNA, 19 nt, Homo sapiens
caaugaauccuguuaguuu

SEQ ID NO: 528483 - RNA, 19 nt, Homo sapiens
aaacaaaguuggcucacaa

SEQ ID NO: 528484 - RNA, 19 nt, Homo sapiens
gcaacucucaccuuaauuu

SEQ ID NO: 528485 - RNA, 19 nt, Homo sapiens
caucuacgcugacaaugaa

SEQ ID NO: 528486 - RNA, 19 nt, Homo sapiens
caucaucucuuguacaugu

SEQ ID NO: 528487 - RNA, 19 nt, Homo sapiens
aaaugcaacucucaccuua

SEQ ID NO: 528488 - RNA, 19 nt, Homo sapiens
gagcuaaauuacacauuga

SEQ ID NO: 528489 - RNA, 19 nt, Homo sapiens
gagauagacuuacugaaag

SEQ ID NO: 528490 - RNA, 19 nt, Homo sapiens
ggaaggcaguucugugaau

SEQ ID NO: 528491 - RNA, 19 nt, Homo sapiens
guauugaacuuggaaagaa

SEQ ID NO: 528492 - RNA, 19 nt, Homo sapiens
caacuggagacacuauuua

SEQ ID NO: 528493 - RNA, 19 nt, Homo sapiens
ucacgaaguuuguucauca

SEQ ID NO: 528494 - RNA, 19 nt, Homo sapiens
guauaguacuggcauggua

SEQ ID NO: 528495 - RNA, 19 nt, Homo sapiens
gggaguauaugaaugugaa

SEQ ID NO: 528496 - RNA, 19 nt, Homo sapiens
gagcaagaagucaaaguaa

SEQ ID NO: 528497 - RNA, 19 nt, Homo sapiens
gaaagaaaugcccaucuau

SEQ ID NO: 528498 - RNA, 19 nt, Homo sapiens
aauaauaccugccauugga

SEQ ID NO: 528499 - RNA, 19 nt, Homo sapiens
gaaggaugcgggaguauau

SEQ ID NO: 528500 - RNA, 19 nt, Homo sapiens
gaaguggaauuaauuaucc

SEQ ID NO: 528501 - RNA, 19 nt, Homo sapiens
gcagaaaggaaguggaauu

SEQ ID NO: 528502 - RNA, 19 nt, Homo sapiens
cgagcuaaauuacacauug

SEQ ID NO: 528503 - RNA, 19 nt, Homo sapiens
ggaguuccuugaucuguau

SEQ ID NO: 528504 - RNA, 19 nt, Homo sapiens
gaaaggcccaguugaagga

SEQ ID NO: 528505 - RNA, 19 nt, Homo sapiens
ggagacaggagacacagua

SEQ ID NO: 528506 - RNA, 19 nt, Homo sapiens
gagauugaauuacuuaagg

SEQ ID NO: 528507 - RNA, 19 nt, Homo sapiens
gcaacucucaccuuaauug

SEQ ID NO: 528508 - RNA, 19 nt, Homo sapiens
agacuucccugaauguauu

SEQ ID NO: 528509 - RNA, 19 nt, Homo sapiens
gagguggaauuaauuguuc

SEQ ID NO: 528510 - RNA, 19 nt, Homo sapiens
gcuaaugcuugauauguuc

SEQ ID NO: 528511 - RNA, 19 nt, Homo sapiens
gaggaaggcaguucuguga

SEQ ID NO: 528512 - RNA, 19 nt, Homo sapiens
cagaaaggaaguggaauua

SEQ ID NO: 528513 - RNA, 19 nt, Homo sapiens
caggcuaaguuacauauug

SEQ ID NO: 528514 - RNA, 19 nt, Homo sapiens
caugaagagucaggaauuu

SEQ ID NO: 528515 - RNA, 19 nt, Homo sapiens
gaaaugcaacucucaccuu

SEQ ID NO: 528516 - RNA, 19 nt, Homo sapiens
ugacuggguuucucuguau

SEQ ID NO: 528517 - RNA, 19 nt, Homo sapiens
ggaauucgaacccaaacaa

SEQ ID NO: 528518 - RNA, 19 nt, Homo sapiens
ggaagccgaucacagucaa

SEQ ID NO: 528519 - RNA, 19 nt, Homo sapiens
gacaaugaauccuguuagu

SEQ ID NO: 528520 - RNA, 19 nt, Homo sapiens
ggaaguggaauuaauuauc

SEQ ID NO: 528521 - RNA, 19 nt, Homo sapiens
gcugauguauacccauuug

SEQ ID NO: 528522 - RNA, 19 nt, Homo sapiens
gacaggagacacaguacua

SEQ ID NO: 528523 - RNA, 19 nt, Homo sapiens
gauagauaguccacugaau

SEQ ID NO: 528524 - RNA, 19 nt, Homo sapiens
ggagaacccagauagauag

SEQ ID NO: 528525 - RNA, 19 nt, Homo sapiens
ccuuggagccucaaauaua

SEQ ID NO: 528526 - RNA, 19 nt, Homo sapiens
gcucacaauuaagaaguuu

SEQ ID NO: 528527 - RNA, 19 nt, Homo sapiens
acucucaccuuaauuucua

SEQ ID NO: 528528 - RNA, 19 nt, Homo sapiens
gugaaggaguuaauuugau

SEQ ID NO: 528529 - RNA, 19 nt, Homo sapiens
cuacauaucacccaagaau

SEQ ID NO: 528530 - RNA, 19 nt, Homo sapiens
gaggcagacuucccugaau

SEQ ID NO: 528531 - RNA, 19 nt, Homo sapiens
gagcugagaggcagacuuc

SEQ ID NO: 528532 - RNA, 19 nt, Homo sapiens
gaagagaaaacaacaaaga

SEQ ID NO: 528533 - RNA, 19 nt, Homo sapiens
ucuaccagcuccagagauu

SEQ ID NO: 528534 - RNA, 19 nt, Homo sapiens
gauaauguuugcagcuucu

SEQ ID NO: 528535 - RNA, 19 nt, Homo sapiens
gaaguuuguucaucagacu

SEQ ID NO: 528536 - RNA, 19 nt, Homo sapiens
acucucaccuuaauugcua

SEQ ID NO: 528537 - RNA, 19 nt, Homo sapiens
cuacagcaccuuucuggaa

SEQ ID NO: 528538 - RNA, 19 nt, Homo sapiens
gaauugcaagucuacauau

SEQ ID NO: 528539 - RNA, 19 nt, Homo sapiens
ugagcaagaagucaaagua

SEQ ID NO: 528540 - RNA, 19 nt, Homo sapiens
guugaaggaugcgggagua

SEQ ID NO: 528541 - RNA, 19 nt, Homo sapiens
gaauucgaacccaaacaaa

SEQ ID NO: 528542 - RNA, 19 nt, Homo sapiens
ggaggauacggauaugaaa

SEQ ID NO: 528543 - RNA, 19 nt, Homo sapiens
acagucaaguguucaguug

SEQ ID NO: 528544 - RNA, 19 nt, Homo sapiens
gcacuggguugacuuucag

SEQ ID NO: 528545 - RNA, 19 nt, Homo sapiens
aguguugcuuggacuauua

SEQ ID NO: 528546 - RNA, 19 nt, Homo sapiens
gcaagaagucaaaguaaaa

SEQ ID NO: 528547 - RNA, 19 nt, Homo sapiens
ggucauauagucuuguaga

SEQ ID NO: 528548 - RNA, 19 nt, Homo sapiens
cagaguacgcaaacacuuu

SEQ ID NO: 528549 - RNA, 19 nt, Homo sapiens
ugggagcucugucacugua

SEQ ID NO: 528550 - RNA, 19 nt, Homo sapiens
gagauuuucuggaguaaga

SEQ ID NO: 528551 - RNA, 19 nt, Homo sapiens
uggagaacccagauagaua

SEQ ID NO: 528552 - RNA, 19 nt, Homo sapiens
agcaagaagucaaaguaaa

SEQ ID NO: 528553 - RNA, 19 nt, Homo sapiens
aaguguagcuaaugcuuga

SEQ ID NO: 528554 - RNA, 19 nt, Homo sapiens
gcaguucugugaauaugac

SEQ ID NO: 528555 - RNA, 19 nt, Homo sapiens
caagaagguggcucuguga

SEQ ID NO: 528556 - RNA, 19 nt, Homo sapiens
agguggagaucuacucuuu

SEQ ID NO: 528557 - RNA, 19 nt, Homo sapiens
gaaucuaggaaauuggaaa

SEQ ID NO: 528558 - RNA, 19 nt, Homo sapiens
aaagaaaugcccaucuaug

SEQ ID NO: 528559 - RNA, 19 nt, Homo sapiens
acacugucaucaucucuug

SEQ ID NO: 528560 - RNA, 19 nt, Homo sapiens
aggcuaaguuacauauuga

SEQ ID NO: 528561 - RNA, 19 nt, Homo sapiens
uggaaaagcucuuguuugu

SEQ ID NO: 528562 - RNA, 19 nt, Homo sapiens
gcuggagauugaauuacuu

SEQ ID NO: 528563 - RNA, 19 nt, Homo sapiens
agaauugcaagucuacaua

SEQ ID NO: 528564 - RNA, 19 nt, Homo sapiens
ccacaucuacgcugacaau

SEQ ID NO: 528565 - RNA, 19 nt, Homo sapiens
guuccuugaucuguauaua

SEQ ID NO: 528566 - RNA, 19 nt, Homo sapiens
cgcaaacacuuuaugucaa

SEQ ID NO: 528567 - RNA, 19 nt, Homo sapiens
guacgcaaacacuuuaugu

SEQ ID NO: 528568 - RNA, 19 nt, Homo sapiens
agaguacgcaaacacuuua

SEQ ID NO: 528569 - RNA, 19 nt, Homo sapiens
gcaaaucaguuacuaagaa

SEQ ID NO: 528570 - RNA, 19 nt, Homo sapiens
gcagaaagcucagcaggua

SEQ ID NO: 528571 - RNA, 19 nt, Homo sapiens
gaagugagcuuugcugcua

SEQ ID NO: 528572 - RNA, 19 nt, Homo sapiens
gcacagaaaccucuacuaa

SEQ ID NO: 528573 - RNA, 19 nt, Homo sapiens
ggaaauaucugcucugacu

SEQ ID NO: 528574 - RNA, 19 nt, Homo sapiens
ugagauaauucguguguua

SEQ ID NO: 528575 - RNA, 19 nt, Homo sapiens
gcagaugacugaucaagug

SEQ ID NO: 528576 - RNA, 19 nt, Homo sapiens
ccagacagcuccaugauga

SEQ ID NO: 528577 - RNA, 19 nt, Homo sapiens
gggaagagguauuugauga

SEQ ID NO: 528578 - RNA, 19 nt, Homo sapiens
gcucguaucuuacuuagga

SEQ ID NO: 528579 - RNA, 19 nt, Homo sapiens
gagcgaaucccaaccauaa

SEQ ID NO: 528580 - RNA, 19 nt, Homo sapiens
caaagcagcuguacaccuu

SEQ ID NO: 528581 - RNA, 19 nt, Homo sapiens
gauuagaaccaaccucuua

SEQ ID NO: 528582 - RNA, 19 nt, Homo sapiens
ggaaauacuacuccuguaa

SEQ ID NO: 528583 - RNA, 19 nt, Homo sapiens
ccacagagaugcugguuca

SEQ ID NO: 528584 - RNA, 19 nt, Homo sapiens
gaagagguauuugaugaga

SEQ ID NO: 528585 - RNA, 19 nt, Homo sapiens
cagcauauuuguauaguug

SEQ ID NO: 528586 - RNA, 19 nt, Homo sapiens
uauaguugcuugccugaua

SEQ ID NO: 528587 - RNA, 19 nt, Homo sapiens
uaucugcucugacuucuaa

SEQ ID NO: 528588 - RNA, 19 nt, Homo sapiens
uggaagauuuggucacuua

SEQ ID NO: 528589 - RNA, 19 nt, Homo sapiens
guaauggguuucauauuuc

SEQ ID NO: 528590 - RNA, 19 nt, Homo sapiens
ugacuaagauggccaagau

SEQ ID NO: 528591 - RNA, 19 nt, Homo sapiens
uauaaagccuguauucuca

SEQ ID NO: 528592 - RNA, 19 nt, Homo sapiens
gccaagcagugcacagaua

SEQ ID NO: 528593 - RNA, 19 nt, Homo sapiens
gacacugguuuacacuuua

SEQ ID NO: 528594 - RNA, 19 nt, Homo sapiens
guaagaaccuugccugaac

SEQ ID NO: 528595 - RNA, 19 nt, Homo sapiens
ucgaacagaugcuggauuu

SEQ ID NO: 528596 - RNA, 19 nt, Homo sapiens
gagggcagcuaacuuugaa

SEQ ID NO: 528597 - RNA, 19 nt, Homo sapiens
ccaaagaucacuuguuguu

SEQ ID NO: 528598 - RNA, 19 nt, Homo sapiens
gcugaggccuuaucauuca

SEQ ID NO: 528599 - RNA, 19 nt, Homo sapiens
caagguagccaucccauga

SEQ ID NO: 528600 - RNA, 19 nt, Homo sapiens
gaacaacuccgacuaacag

SEQ ID NO: 528601 - RNA, 19 nt, Homo sapiens
uaaauuagcagaucuacga

SEQ ID NO: 528602 - RNA, 19 nt, Homo sapiens
caucgaauguguacaacuu

SEQ ID NO: 528603 - RNA, 19 nt, Homo sapiens
ccacauccuuucuaaacaa

SEQ ID NO: 528604 - RNA, 19 nt, Homo sapiens
ccaaggagguugccaagca

SEQ ID NO: 528605 - RNA, 19 nt, Homo sapiens
ggaaaaggaugaagaguuc

SEQ ID NO: 528606 - RNA, 19 nt, Homo sapiens
ccagaugaguaaaggagua

SEQ ID NO: 528607 - RNA, 19 nt, Homo sapiens
ggucugugcugaggccuua

SEQ ID NO: 528608 - RNA, 19 nt, Homo sapiens
caagaugauugacgagaga

SEQ ID NO: 528609 - RNA, 19 nt, Homo sapiens
gaaagauuacuuagaggaa

SEQ ID NO: 528610 - RNA, 19 nt, Homo sapiens
ugccaaagaucacuuguug

SEQ ID NO: 528611 - RNA, 19 nt, Homo sapiens
gagaguaauggguuucaua

SEQ ID NO: 528612 - RNA, 19 nt, Homo sapiens
gaaauacuacuccuguaau

SEQ ID NO: 528613 - RNA, 19 nt, Homo sapiens
gcgcauggcucugcugaug

SEQ ID NO: 528614 - RNA, 19 nt, Homo sapiens
ugaugaagcucgcaaaugg

SEQ ID NO: 528615 - RNA, 19 nt, Homo sapiens
gaaagcugccucugaugaa

SEQ ID NO: 528616 - RNA, 19 nt, Homo sapiens
agacacugguuuacacuuu

SEQ ID NO: 528617 - RNA, 19 nt, Homo sapiens
gggaaauacuacuccugua

SEQ ID NO: 528618 - RNA, 19 nt, Homo sapiens
agagggagguggagaauuc

SEQ ID NO: 528619 - RNA, 19 nt, Homo sapiens
uaacagggaagagguauuu

SEQ ID NO: 528620 - RNA, 19 nt, Homo sapiens
acagaaaccucuacuaaaa

SEQ ID NO: 528621 - RNA, 19 nt, Homo sapiens
gaacagaugcuggauuuac

SEQ ID NO: 528622 - RNA, 19 nt, Homo sapiens
aaacuguacuucacuguca

SEQ ID NO: 528623 - RNA, 19 nt, Homo sapiens
gcccauggacuucacauaa

SEQ ID NO: 528624 - RNA, 19 nt, Homo sapiens
caucagaccugcuccuuac

SEQ ID NO: 528625 - RNA, 19 nt, Homo sapiens
ggaagaaaucacagaauca

SEQ ID NO: 528626 - RNA, 19 nt, Homo sapiens
ugagagggcagcuaacuuu

SEQ ID NO: 528627 - RNA, 19 nt, Homo sapiens
ggaaggagaagagcagauu

SEQ ID NO: 528628 - RNA, 19 nt, Homo sapiens
gcauagaggaagcuuuaaa

SEQ ID NO: 528629 - RNA, 19 nt, Homo sapiens
gaaucaaugggaaauacua

SEQ ID NO: 528630 - RNA, 19 nt, Homo sapiens
gguguuuguucaucuguaa

SEQ ID NO: 528631 - RNA, 19 nt, Homo sapiens
caaaucaguuacuaagaag

SEQ ID NO: 528632 - RNA, 19 nt, Homo sapiens
uaaagccuguauucucaaa

SEQ ID NO: 528633 - RNA, 19 nt, Homo sapiens
acacugcgcuggguuagaa

SEQ ID NO: 528634 - RNA, 19 nt, Homo sapiens
ucaagagaguaauggguuu

SEQ ID NO: 528635 - RNA, 19 nt, Homo sapiens
uuagaaagacucccuggua

SEQ ID NO: 528636 - RNA, 19 nt, Homo sapiens
gugcacagauaaacggauu

SEQ ID NO: 528637 - RNA, 19 nt, Homo sapiens
gcagagcauugcaaagaag

SEQ ID NO: 528638 - RNA, 19 nt, Homo sapiens
gauaauucguguguuacaa

SEQ ID NO: 528639 - RNA, 19 nt, Homo sapiens
cagcauuuauuaagguuga

SEQ ID NO: 528640 - RNA, 19 nt, Homo sapiens
ucaaggcccucagcauauu

SEQ ID NO: 528641 - RNA, 19 nt, Homo sapiens
gcaaggcagcccugucuga

SEQ ID NO: 528642 - RNA, 19 nt, Homo sapiens
gugauuaaccagccaauga

SEQ ID NO: 528643 - RNA, 19 nt, Homo sapiens
gugcugaaauuaaugagau

SEQ ID NO: 528644 - RNA, 19 nt, Homo sapiens
gccagaaccagaugaguaa

SEQ ID NO: 528645 - RNA, 19 nt, Homo sapiens
gaaaucacagaaucauaug

SEQ ID NO: 528646 - RNA, 19 nt, Homo sapiens
caaacacaguuacacuugu

SEQ ID NO: 528647 - RNA, 19 nt, Homo sapiens
acagauaaacggauuagaa

SEQ ID NO: 528648 - RNA, 19 nt, Homo sapiens
caaagcagagcauugcaaa

SEQ ID NO: 528649 - RNA, 19 nt, Homo sapiens
uggagacuauggaagauuu

SEQ ID NO: 528650 - RNA, 19 nt, Homo sapiens
acucaggcuuucacuauuu

SEQ ID NO: 528651 - RNA, 19 nt, Homo sapiens
guucaucuguaacucuaaa

SEQ ID NO: 528652 - RNA, 19 nt, Homo sapiens
gaagaaaucacagaaucau

SEQ ID NO: 528653 - RNA, 19 nt, Homo sapiens
gaucgaugcugcucagaac

SEQ ID NO: 528654 - RNA, 19 nt, Homo sapiens
uauuagaguuugcaaagga

SEQ ID NO: 528655 - RNA, 19 nt, Homo sapiens
gugcugaggccuuaucauu

SEQ ID NO: 528656 - RNA, 19 nt, Homo sapiens
cagagaugcugguucacaa

SEQ ID NO: 528657 - RNA, 19 nt, Homo sapiens
caggaagugucagauguuu

SEQ ID NO: 528658 - RNA, 19 nt, Homo sapiens
gcugagguccguaaaauua

SEQ ID NO: 528659 - RNA, 19 nt, Homo sapiens
ccaggcaaaucaguuacua

SEQ ID NO: 528660 - RNA, 19 nt, Homo sapiens
gaaggaaaaugaucugagu

SEQ ID NO: 528661 - RNA, 19 nt, Homo sapiens
guggaucgauaauguugaa

SEQ ID NO: 528662 - RNA, 19 nt, Homo sapiens
caacucccaucaagcuguu

SEQ ID NO: 528663 - RNA, 19 nt, Homo sapiens
gagcaggccaucagacaga

SEQ ID NO: 528664 - RNA, 19 nt, Homo sapiens
gaacaccgugaaagaguug

SEQ ID NO: 528665 - RNA, 19 nt, Homo sapiens
ggccaggaaugacuaagau

SEQ ID NO: 528666 - RNA, 19 nt, Homo sapiens
cccagcacaugaaaccuua

SEQ ID NO: 528667 - RNA, 19 nt, Homo sapiens
gccuuaucauucauucuua

SEQ ID NO: 528668 - RNA, 19 nt, Homo sapiens
cauccucucuggaacauca

SEQ ID NO: 528669 - RNA, 19 nt, Homo sapiens
gcaaaucaguuacuaagaa

SEQ ID NO: 528670 - RNA, 19 nt, Homo sapiens
gcagaaagcucagcaggua

SEQ ID NO: 528671 - RNA, 19 nt, Homo sapiens
gaagugagcuuugcugcua

SEQ ID NO: 528672 - RNA, 19 nt, Homo sapiens
gcacagaaaccucuacuaa

SEQ ID NO: 528673 - RNA, 19 nt, Homo sapiens
ggaaauaucugcucugacu

SEQ ID NO: 528674 - RNA, 19 nt, Homo sapiens
ugagauaauucguguguua

SEQ ID NO: 528675 - RNA, 19 nt, Homo sapiens
gcagaugacugaucaagug

SEQ ID NO: 528676 - RNA, 19 nt, Homo sapiens
ccagacagcuccaugauga

SEQ ID NO: 528677 - RNA, 19 nt, Homo sapiens
gggaagagguauuugauga

SEQ ID NO: 528678 - RNA, 19 nt, Homo sapiens
gcucguaucuuacuuagga

SEQ ID NO: 528679 - RNA, 19 nt, Homo sapiens
gagcgaaucccaaccauaa

SEQ ID NO: 528680 - RNA, 19 nt, Homo sapiens
caaagcagcuguacaccuu

SEQ ID NO: 528681 - RNA, 19 nt, Homo sapiens
gauuagaaccaaccucuua

SEQ ID NO: 528682 - RNA, 19 nt, Homo sapiens
ggaaauacuacuccuguaa

SEQ ID NO: 528683 - RNA, 19 nt, Homo sapiens
ccacagagaugcugguuca

SEQ ID NO: 528684 - RNA, 19 nt, Homo sapiens
gaagagguauuugaugaga

SEQ ID NO: 528685 - RNA, 19 nt, Homo sapiens
cagcauauuuguauaguug

SEQ ID NO: 528686 - RNA, 19 nt, Homo sapiens
uauaguugcuugccugaua

SEQ ID NO: 528687 - RNA, 19 nt, Homo sapiens
uaucugcucugacuucuaa

SEQ ID NO: 528688 - RNA, 19 nt, Homo sapiens
uggaagauuuggucacuua

SEQ ID NO: 528689 - RNA, 19 nt, Homo sapiens
guaauggguuucauauuuc

SEQ ID NO: 528690 - RNA, 19 nt, Homo sapiens
ugacuaagauggccaagau

SEQ ID NO: 528691 - RNA, 19 nt, Homo sapiens
uauaaagccuguauucuca

SEQ ID NO: 528692 - RNA, 19 nt, Homo sapiens
gccaagcagugcacagaua

SEQ ID NO: 528693 - RNA, 19 nt, Homo sapiens
gacacugguuuacacuuua

SEQ ID NO: 528694 - RNA, 19 nt, Homo sapiens
guaagaaccuugccugaac

SEQ ID NO: 528695 - RNA, 19 nt, Homo sapiens
ucgaacagaugcuggauuu

SEQ ID NO: 528696 - RNA, 19 nt, Homo sapiens
gagggcagcuaacuuugaa

SEQ ID NO: 528697 - RNA, 19 nt, Homo sapiens
ccaaagaucacuuguuguu

SEQ ID NO: 528698 - RNA, 19 nt, Homo sapiens
gcugaggccuuaucauuca

SEQ ID NO: 528699 - RNA, 19 nt, Homo sapiens
caagguagccaucccauga

SEQ ID NO: 528700 - RNA, 19 nt, Homo sapiens
gaacaacuccgacuaacag

SEQ ID NO: 528701 - RNA, 19 nt, Homo sapiens
uaaauuagcagaucuacga

SEQ ID NO: 528702 - RNA, 19 nt, Homo sapiens
caucgaauguguacaacuu

SEQ ID NO: 528703 - RNA, 19 nt, Homo sapiens
ccacauccuuucuaaacaa

SEQ ID NO: 528704 - RNA, 19 nt, Homo sapiens
ccaaggagguugccaagca

SEQ ID NO: 528705 - RNA, 19 nt, Homo sapiens
ggaaaaggaugaagaguuc

SEQ ID NO: 528706 - RNA, 19 nt, Homo sapiens
ccagaugaguaaaggagua

SEQ ID NO: 528707 - RNA, 19 nt, Homo sapiens
ggucugugcugaggccuua

SEQ ID NO: 528708 - RNA, 19 nt, Homo sapiens
caagaugauugacgagaga

SEQ ID NO: 528709 - RNA, 19 nt, Homo sapiens
gaaagauuacuuagaggaa

SEQ ID NO: 528710 - RNA, 19 nt, Homo sapiens
ugccaaagaucacuuguug

SEQ ID NO: 528711 - RNA, 19 nt, Homo sapiens
gagaguaauggguuucaua

SEQ ID NO: 528712 - RNA, 19 nt, Homo sapiens
gaaauacuacuccuguaau

SEQ ID NO: 528713 - RNA, 19 nt, Homo sapiens
gcgcauggcucugcugaug

SEQ ID NO: 528714 - RNA, 19 nt, Homo sapiens
ugaugaagcucgcaaaugg

SEQ ID NO: 528715 - RNA, 19 nt, Homo sapiens
gaaagcugccucugaugaa

SEQ ID NO: 528716 - RNA, 19 nt, Homo sapiens
agacacugguuuacacuuu

SEQ ID NO: 528717 - RNA, 19 nt, Homo sapiens
gggaaauacuacuccugua

SEQ ID NO: 528718 - RNA, 19 nt, Homo sapiens
gaaccugagcugcuguuaa

SEQ ID NO: 528719 - RNA, 19 nt, Homo sapiens
agagggagguggagaauuc

SEQ ID NO: 528720 - RNA, 19 nt, Homo sapiens
uaacagggaagagguauuu

SEQ ID NO: 528721 - RNA, 19 nt, Homo sapiens
acagaaaccucuacuaaaa

SEQ ID NO: 528722 - RNA, 19 nt, Homo sapiens
gaacagaugcuggauuuac

SEQ ID NO: 528723 - RNA, 19 nt, Homo sapiens
aaacuguacuucacuguca

SEQ ID NO: 528724 - RNA, 19 nt, Homo sapiens
gcccauggacuucacauaa

SEQ ID NO: 528725 - RNA, 19 nt, Homo sapiens
caucagaccugcuccuuac

SEQ ID NO: 528726 - RNA, 19 nt, Homo sapiens
ggaagaaaucacagaauca

SEQ ID NO: 528727 - RNA, 19 nt, Homo sapiens
ggaagacgauuacgaaccu

SEQ ID NO: 528728 - RNA, 19 nt, Homo sapiens
ugagagggcagcuaacuuu

SEQ ID NO: 528729 - RNA, 19 nt, Homo sapiens
ggaaggagaagagcagauu

SEQ ID NO: 528730 - RNA, 19 nt, Homo sapiens
gcauagaggaagcuuuaaa

SEQ ID NO: 528731 - RNA, 19 nt, Homo sapiens
gaaucaaugggaaauacua

SEQ ID NO: 528732 - RNA, 19 nt, Homo sapiens
gguguuuguucaucuguaa

SEQ ID NO: 528733 - RNA, 19 nt, Homo sapiens
caaaucaguuacuaagaag

SEQ ID NO: 528734 - RNA, 19 nt, Homo sapiens
uaaagccuguauucucaaa

SEQ ID NO: 528735 - RNA, 19 nt, Homo sapiens
acacugcgcuggguuagaa

SEQ ID NO: 528736 - RNA, 19 nt, Homo sapiens
ucaagagaguaauggguuu

SEQ ID NO: 528737 - RNA, 19 nt, Homo sapiens
cagcauuuauuaagguuga

SEQ ID NO: 528738 - RNA, 19 nt, Homo sapiens
uuagaaagacucccuggua

SEQ ID NO: 528739 - RNA, 19 nt, Homo sapiens
gugcacagauaaacggauu

SEQ ID NO: 528740 - RNA, 19 nt, Homo sapiens
gcagagcauugcaaagaag

SEQ ID NO: 528741 - RNA, 19 nt, Homo sapiens
gauaauucguguguuacaa

SEQ ID NO: 528742 - RNA, 19 nt, Homo sapiens
ucaaggcccucagcauauu

SEQ ID NO: 528743 - RNA, 19 nt, Homo sapiens
gcaaggcagcccugucuga

SEQ ID NO: 528744 - RNA, 19 nt, Homo sapiens
aaccugagcugcuguuaau

SEQ ID NO: 528745 - RNA, 19 nt, Homo sapiens
gugauuaaccagccaauga

SEQ ID NO: 528746 - RNA, 19 nt, Homo sapiens
gugcugaaauuaaugagau

SEQ ID NO: 528747 - RNA, 19 nt, Homo sapiens
gccagaaccagaugaguaa

SEQ ID NO: 528748 - RNA, 19 nt, Homo sapiens
gaaaucacagaaucauaug

SEQ ID NO: 528749 - RNA, 19 nt, Homo sapiens
caaacacaguuacacuugu

SEQ ID NO: 528750 - RNA, 19 nt, Homo sapiens
acagauaaacggauuagaa

SEQ ID NO: 528751 - RNA, 19 nt, Homo sapiens
caaagcagagcauugcaaa

SEQ ID NO: 528752 - RNA, 19 nt, Homo sapiens
uggagacuauggaagauuu

SEQ ID NO: 528753 - RNA, 19 nt, Homo sapiens
acucaggcuuucacuauuu

SEQ ID NO: 528754 - RNA, 19 nt, Homo sapiens
guucaucuguaacucuaaa

SEQ ID NO: 528755 - RNA, 19 nt, Homo sapiens
gaagaaaucacagaaucau

SEQ ID NO: 528756 - RNA, 19 nt, Homo sapiens
gaucgaugcugcucagaac

SEQ ID NO: 528757 - RNA, 19 nt, Homo sapiens
uauuagaguuugcaaagga

SEQ ID NO: 528758 - RNA, 19 nt, Homo sapiens
gugcugaggccuuaucauu

SEQ ID NO: 528759 - RNA, 19 nt, Homo sapiens
cagagaugcugguucacaa

SEQ ID NO: 528760 - RNA, 19 nt, Homo sapiens
caggaagugucagauguuu

SEQ ID NO: 528761 - RNA, 19 nt, Homo sapiens
gcugagguccguaaaauua

SEQ ID NO: 528762 - RNA, 19 nt, Homo sapiens
ccaggcaaaucaguuacua

SEQ ID NO: 528763 - RNA, 19 nt, Homo sapiens
gaaggaaaaugaucugagu

SEQ ID NO: 528764 - RNA, 19 nt, Homo sapiens
guggaucgauaauguugaa

SEQ ID NO: 528765 - RNA, 19 nt, Homo sapiens
caacucccaucaagcuguu

SEQ ID NO: 528766 - RNA, 19 nt, Homo sapiens
gagcaggccaucagacaga

SEQ ID NO: 528767 - RNA, 19 nt, Homo sapiens
gaacaccgugaaagaguug

SEQ ID NO: 528768 - RNA, 19 nt, Homo sapiens
ggccaggaaugacuaagau

SEQ ID NO: 528769 - RNA, 19 nt, Homo sapiens
ggagguagauauuggaauu

SEQ ID NO: 528770 - RNA, 19 nt, Homo sapiens
gcaugugggugcugacuua

SEQ ID NO: 528771 - RNA, 19 nt, Homo sapiens
gcagcuagcucagaucaaa

SEQ ID NO: 528772 - RNA, 19 nt, Homo sapiens
gaugagaagucccguguug

SEQ ID NO: 528773 - RNA, 19 nt, Homo sapiens
gaauagaguuguucggaau

SEQ ID NO: 528774 - RNA, 19 nt, Homo sapiens
caacagccauucucaaaca

SEQ ID NO: 528775 - RNA, 19 nt, Homo sapiens
caaauuggcuggugagucu

SEQ ID NO: 528776 - RNA, 19 nt, Homo sapiens
gaagaguccuugaaugaag

SEQ ID NO: 528777 - RNA, 19 nt, Homo sapiens
gagcugaccugacagagau

SEQ ID NO: 528778 - RNA, 19 nt, Homo sapiens
caaccggccugacaucauu

SEQ ID NO: 528779 - RNA, 19 nt, Homo sapiens
ggaagcagcuagcucagau

SEQ ID NO: 528780 - RNA, 19 nt, Homo sapiens
aaacagauccuagcccuua

SEQ ID NO: 528781 - RNA, 19 nt, Homo sapiens
gaugauacuuguucugaug

SEQ ID NO: 528782 - RNA, 19 nt, Homo sapiens
gcagagggcacaugugauu

SEQ ID NO: 528783 - RNA, 19 nt, Homo sapiens
caacagacccaacagcauu

SEQ ID NO: 528784 - RNA, 19 nt, Homo sapiens
caauaaacguugggucaaa

SEQ ID NO: 528785 - RNA, 19 nt, Homo sapiens
acaugaagcuggcagauga

SEQ ID NO: 528786 - RNA, 19 nt, Homo sapiens
ucagagaaaucuuugacaa

SEQ ID NO: 528787 - RNA, 19 nt, Homo sapiens
gaacagguagccaaugaga

SEQ ID NO: 528788 - RNA, 19 nt, Homo sapiens
gggcacaugugauuguuau

SEQ ID NO: 528789 - RNA, 19 nt, Homo sapiens
gagacauccugcccucuuu

SEQ ID NO: 528790 - RNA, 19 nt, Homo sapiens
ucaaagagaugguggaacu

SEQ ID NO: 528791 - RNA, 19 nt, Homo sapiens
ccaagggaguucuguucua

SEQ ID NO: 528792 - RNA, 19 nt, Homo sapiens
guugcuggauguuuauaua

SEQ ID NO: 528793 - RNA, 19 nt, Homo sapiens
gugaauccaucgagaguga

SEQ ID NO: 528794 - RNA, 19 nt, Homo sapiens
caagggaguucuguucuau

SEQ ID NO: 528795 - RNA, 19 nt, Homo sapiens
gcuuagagauucuucagau

SEQ ID NO: 528796 - RNA, 19 nt, Homo sapiens
ucaaagugguggaaacaga

SEQ ID NO: 528797 - RNA, 19 nt, Homo sapiens
gguaaucucuucgagguau

SEQ ID NO: 528798 - RNA, 19 nt, Homo sapiens
ugaaugaaguaggguauga

SEQ ID NO: 528799 - RNA, 19 nt, Homo sapiens
gaugagaagauucggauga

SEQ ID NO: 528800 - RNA, 19 nt, Homo sapiens
gaagagacgagaagcuguu

SEQ ID NO: 528801 - RNA, 19 nt, Homo sapiens
caaugaugaugaccuguau

SEQ ID NO: 528802 - RNA, 19 nt, Homo sapiens
uggaacagguagccaauga

SEQ ID NO: 528803 - RNA, 19 nt, Homo sapiens
ggaagaguccuugaaugaa

SEQ ID NO: 528804 - RNA, 19 nt, Homo sapiens
gaaguaggguaugaugaca

SEQ ID NO: 528805 - RNA, 19 nt, Homo sapiens
ggaaagaagagacgagaag

SEQ ID NO: 528806 - RNA, 19 nt, Homo sapiens
cagaagacaaugaugauga

SEQ ID NO: 528807 - RNA, 19 nt, Homo sapiens
cggcacagguggcagugua

SEQ ID NO: 528808 - RNA, 19 nt, Homo sapiens
ucaaccagauccugacaga

SEQ ID NO: 528809 - RNA, 19 nt, Homo sapiens
cagacaaauuccugaaguu

SEQ ID NO: 528810 - RNA, 19 nt, Homo sapiens
ccagacaaauuccugaagu

SEQ ID NO: 528811 - RNA, 19 nt, Homo sapiens
gagagcaaccuucguaaag

SEQ ID NO: 528812 - RNA, 19 nt, Homo sapiens
gauauuggaauuccugaug

SEQ ID NO: 528813 - RNA, 19 nt, Homo sapiens
ccucauggauggccuaaag

SEQ ID NO: 528814 - RNA, 19 nt, Homo sapiens
uuacggaccuccuggaaca

SEQ ID NO: 528815 - RNA, 19 nt, Homo sapiens
gagagugaauuaccaacag

SEQ ID NO: 528816 - RNA, 19 nt, Homo sapiens
acacagaagacaaugauga

SEQ ID NO: 528817 - RNA, 19 nt, Homo sapiens
ugacagggagguagauauu

SEQ ID NO: 528818 - RNA, 19 nt, Homo sapiens
ccugauugcucgagcugua

SEQ ID NO: 528819 - RNA, 19 nt, Homo sapiens
caaacgagaggaugaggaa

SEQ ID NO: 528820 - RNA, 19 nt, Homo sapiens
gauccuagcccuuauugca

SEQ ID NO: 528821 - RNA, 19 nt, Homo sapiens
cgagaucacuuugaagaag

SEQ ID NO: 528822 - RNA, 19 nt, Homo sapiens
guagaggugccacagguaa

SEQ ID NO: 528823 - RNA, 19 nt, Homo sapiens
cagaagaaccgucccaauc

SEQ ID NO: 528824 - RNA, 19 nt, Homo sapiens
gcacagguggcaguguaua

SEQ ID NO: 528825 - RNA, 19 nt, Homo sapiens
caucagccauggagguaga

SEQ ID NO: 528826 - RNA, 19 nt, Homo sapiens
guccugagaucaugagcaa

SEQ ID NO: 528827 - RNA, 19 nt, Homo sapiens
guaaucucuucgagguaua

SEQ ID NO: 528828 - RNA, 19 nt, Homo sapiens
guggaaggcauuacuggua

SEQ ID NO: 528829 - RNA, 19 nt, Homo sapiens
ccauuucuguuguaguuug

SEQ ID NO: 528830 - RNA, 19 nt, Homo sapiens
guaggcggagagugaauua

SEQ ID NO: 528831 - RNA, 19 nt, Homo sapiens
uagcucagaucaaagagau

SEQ ID NO: 528832 - RNA, 19 nt, Homo sapiens
gcccacagccugcuccauu

SEQ ID NO: 528833 - RNA, 19 nt, Homo sapiens
aaccagauccugacagaaa

SEQ ID NO: 528834 - RNA, 19 nt, Homo sapiens
uugaugagcuggauucgau

SEQ ID NO: 528835 - RNA, 19 nt, Homo sapiens
gaagcuggcagaugaugug

SEQ ID NO: 528836 - RNA, 19 nt, Homo sapiens
ugaggaggcugagaagaau

SEQ ID NO: 528837 - RNA, 19 nt, Homo sapiens
ggagccuucuucuucuuga

SEQ ID NO: 528838 - RNA, 19 nt, Homo sapiens
gaacgagagaggcagacaa

SEQ ID NO: 528839 - RNA, 19 nt, Homo sapiens
ggagguaacauuggagaug

SEQ ID NO: 528840 - RNA, 19 nt, Homo sapiens
ggccaaagccauugcuaau

SEQ ID NO: 528841 - RNA, 19 nt, Homo sapiens
agacaaauuccugaaguuu

SEQ ID NO: 528842 - RNA, 19 nt, Homo sapiens
acaggacgcuuagagauuc

SEQ ID NO: 528843 - RNA, 19 nt, Homo sapiens
gacuggagccuucuucuuc

SEQ ID NO: 528844 - RNA, 19 nt, Homo sapiens
gaucaaagagaugguggaa

SEQ ID NO: 528845 - RNA, 19 nt, Homo sapiens
ugccauuucuguuguaguu

SEQ ID NO: 528846 - RNA, 19 nt, Homo sapiens
ggagcugaccugacagaga

SEQ ID NO: 528847 - RNA, 19 nt, Homo sapiens
caguguugcugaaaggaaa

SEQ ID NO: 528848 - RNA, 19 nt, Homo sapiens
caaugucagagaaaucuuu

SEQ ID NO: 528849 - RNA, 19 nt, Homo sapiens
gagauucuucagauccaua

SEQ ID NO: 528850 - RNA, 19 nt, Homo sapiens
gaaugcuccugccaucauc

SEQ ID NO: 528851 - RNA, 19 nt, Homo sapiens
ucaaugaggacaacagugu

SEQ ID NO: 528852 - RNA, 19 nt, Homo sapiens
ugaccuguauggcuaagug

SEQ ID NO: 528853 - RNA, 19 nt, Homo sapiens
ggaaguaugagauguuugc

SEQ ID NO: 528854 - RNA, 19 nt, Homo sapiens
gcucguggagguaacauug

SEQ ID NO: 528855 - RNA, 19 nt, Homo sapiens
ggagcacccagacaaauuc

SEQ ID NO: 528856 - RNA, 19 nt, Homo sapiens
gggccuagaggaugucaaa

SEQ ID NO: 528857 - RNA, 19 nt, Homo sapiens
ccugugugcuauucuuuga

SEQ ID NO: 528858 - RNA, 19 nt, Homo sapiens
gagggcacaugugauuguu

SEQ ID NO: 528859 - RNA, 19 nt, Homo sapiens
aagcagagggcacauguga

SEQ ID NO: 528860 - RNA, 19 nt, Homo sapiens
gccaugcccugaugugaag

SEQ ID NO: 528861 - RNA, 19 nt, Homo sapiens
cggaauaaccuucguguac

SEQ ID NO: 528862 - RNA, 19 nt, Homo sapiens
gagccagaguaacccauca

SEQ ID NO: 528863 - RNA, 19 nt, Homo sapiens
gcacaugugauuguuaugg

SEQ ID NO: 528864 - RNA, 19 nt, Homo sapiens
aguaggguaugaugacauu

SEQ ID NO: 528865 - RNA, 19 nt, Homo sapiens
uggaugaauugcaguuguu

SEQ ID NO: 528866 - RNA, 19 nt, Homo sapiens
ucggaaguaugagauguuu

SEQ ID NO: 528867 - RNA, 19 nt, Homo sapiens
caagccauccgcaagaaga

SEQ ID NO: 528868 - RNA, 19 nt, Homo sapiens
gaacaugaagcuggcagau

SEQ ID NO: 528869 - RNA, 19 nt, Homo sapiens
gagaauggauuggaauuua

SEQ ID NO: 528870 - RNA, 19 nt, Homo sapiens
gaacaacuccagccugaua

SEQ ID NO: 528871 - RNA, 19 nt, Homo sapiens
cgacauggauuucgacauu

SEQ ID NO: 528872 - RNA, 19 nt, Homo sapiens
gauaauauguaggcacuuu

SEQ ID NO: 528873 - RNA, 19 nt, Homo sapiens
cuacaagacugaugaauuc

SEQ ID NO: 528874 - RNA, 19 nt, Homo sapiens
ggaagugucugugugauug

SEQ ID NO: 528875 - RNA, 19 nt, Homo sapiens
cagcauagcuaccuucaga

SEQ ID NO: 528876 - RNA, 19 nt, Homo sapiens
gaaauggaauaccgacaau

SEQ ID NO: 528877 - RNA, 19 nt, Homo sapiens
ggagaccgcugucaaucuu

SEQ ID NO: 528878 - RNA, 19 nt, Homo sapiens
gcuauaagcuuggaagugu

SEQ ID NO: 528879 - RNA, 19 nt, Homo sapiens
gccaauaauucaggacuua

SEQ ID NO: 528880 - RNA, 19 nt, Homo sapiens
guacagaagaaaccuauuu

SEQ ID NO: 528881 - RNA, 19 nt, Homo sapiens
aaauuggacuucuguugua

SEQ ID NO: 528882 - RNA, 19 nt, Homo sapiens
auagcuaccuucagaauuu

SEQ ID NO: 528883 - RNA, 19 nt, Homo sapiens
ggaagcggauaauauguag

SEQ ID NO: 528884 - RNA, 19 nt, Homo sapiens
cuauggauuuggcuuaaua

SEQ ID NO: 528885 - RNA, 19 nt, Homo sapiens
gaauagcagccaaguauca

SEQ ID NO: 528886 - RNA, 19 nt, Homo sapiens
ugauucagcuuuaagaugu

SEQ ID NO: 528887 - RNA, 19 nt, Homo sapiens
ggacuggaauuucaagcau

SEQ ID NO: 528888 - RNA, 19 nt, Homo sapiens
gaagguggaugugaugaag

SEQ ID NO: 528889 - RNA, 19 nt, Homo sapiens
ggacagcaggaaacaguaa

SEQ ID NO: 528890 - RNA, 19 nt, Homo sapiens
gaguacggccugacguuua

SEQ ID NO: 528891 - RNA, 19 nt, Homo sapiens
gaaaccaaguacagaugga

SEQ ID NO: 528892 - RNA, 19 nt, Homo sapiens
guaggcacuuuguaaauuc

SEQ ID NO: 528893 - RNA, 19 nt, Homo sapiens
gcuacaagacugaugaauu

SEQ ID NO: 528894 - RNA, 19 nt, Homo sapiens
ggacuucuguuguauucuc

SEQ ID NO: 528895 - RNA, 19 nt, Homo sapiens
ccacaagcuuggucuagga

SEQ ID NO: 528896 - RNA, 19 nt, Homo sapiens
uaacacgcgcuucggaaua

SEQ ID NO: 528897 - RNA, 19 nt, Homo sapiens
gaugugaugaagccaauaa

SEQ ID NO: 528898 - RNA, 19 nt, Homo sapiens
gacuggaauuucaagcaua

SEQ ID NO: 528899 - RNA, 19 nt, Homo sapiens
cggaauagcagccaaguau

SEQ ID NO: 528900 - RNA, 19 nt, Homo sapiens
ggccugacguuuacagaga

SEQ ID NO: 528901 - RNA, 19 nt, Homo sapiens
ccugauagguuuaggauac

SEQ ID NO: 528902 - RNA, 19 nt, Homo sapiens
gcagccaaguaucagauug

SEQ ID NO: 528903 - RNA, 19 nt, Homo sapiens
ggacuuauuccuucuugug

SEQ ID NO: 528904 - RNA, 19 nt, Homo sapiens
ccagggaugucuucaccaa

SEQ ID NO: 528905 - RNA, 19 nt, Homo sapiens
uguaggcacuuuguaaauu

SEQ ID NO: 528906 - RNA, 19 nt, Homo sapiens
gaaagugaacaagaaguug

SEQ ID NO: 528907 - RNA, 19 nt, Homo sapiens
gaauaccgacaauacacua

SEQ ID NO: 528908 - RNA, 19 nt, Homo sapiens
ugagaugccagguuucuuu

SEQ ID NO: 528909 - RNA, 19 nt, Homo sapiens
uagcuaccuucagaauuua

SEQ ID NO: 528910 - RNA, 19 nt, Homo sapiens
caccaagggcuauggauuu

SEQ ID NO: 528911 - RNA, 19 nt, Homo sapiens
gguauuaaacugacacugu

SEQ ID NO: 528912 - RNA, 19 nt, Homo sapiens
uaaauuggacuucuguugu

SEQ ID NO: 528913 - RNA, 19 nt, Homo sapiens
ccuuugagaugccagguuu

SEQ ID NO: 528914 - RNA, 19 nt, Homo sapiens
gaguuuggcggcuccauuu

SEQ ID NO: 528915 - RNA, 19 nt, Homo sapiens
gaaugacgggacagaguuu

SEQ ID NO: 528916 - RNA, 19 nt, Homo sapiens
ucucaccacucaauuuguu

SEQ ID NO: 528917 - RNA, 19 nt, Homo sapiens
gugaugaagccaauaauuc

SEQ ID NO: 528918 - RNA, 19 nt, Homo sapiens
gaugguguguacaaacuca

SEQ ID NO: 528919 - RNA, 19 nt, Homo sapiens
aauuccagcuucacacuaa

SEQ ID NO: 528920 - RNA, 19 nt, Homo sapiens
acacuaggcaccgagauua

SEQ ID NO: 528921 - RNA, 19 nt, Homo sapiens
uguacaaacucaccugaau

SEQ ID NO: 528922 - RNA, 19 nt, Homo sapiens
gaaauggcugcaaguggaa

SEQ ID NO: 528923 - RNA, 19 nt, Homo sapiens
gugcucuggugcuagguua

SEQ ID NO: 528924 - RNA, 19 nt, Homo sapiens
gcaccagaguaugaaauag

SEQ ID NO: 528925 - RNA, 19 nt, Homo sapiens
guacaaacucaccugaaug

SEQ ID NO: 528926 - RNA, 19 nt, Homo sapiens
uauguuagcccuccagguu

SEQ ID NO: 528927 - RNA, 19 nt, Homo sapiens
ugucugggaugcaaguauu

SEQ ID NO: 528928 - RNA, 19 nt, Homo sapiens
ggagaagguggaugugaug

SEQ ID NO: 528929 - RNA, 19 nt, Homo sapiens
caaguggaagcggauaaua

SEQ ID NO: 528930 - RNA, 19 nt, Homo sapiens
gcauagcuaccuucagaau

SEQ ID NO: 528931 - RNA, 19 nt, Homo sapiens
acuggaauuucaagcauaa

SEQ ID NO: 528932 - RNA, 19 nt, Homo sapiens
gcaaaucugccagggaugu

SEQ ID NO: 528933 - RNA, 19 nt, Homo sapiens
gggcuauggauuuggcuua

SEQ ID NO: 528934 - RNA, 19 nt, Homo sapiens
ggauuggaauuuacaagcu

SEQ ID NO: 528935 - RNA, 19 nt, Homo sapiens
gauacacucagacucuaaa

SEQ ID NO: 528936 - RNA, 19 nt, Homo sapiens
ggauacacucagacucuaa

SEQ ID NO: 528937 - RNA, 19 nt, Homo sapiens
cgagauuacuguggaagau

SEQ ID NO: 528938 - RNA, 19 nt, Homo sapiens
acacugagaccaccaaagu

SEQ ID NO: 528939 - RNA, 19 nt, Homo sapiens
uguuagcccuccagguuaa

SEQ ID NO: 528940 - RNA, 19 nt, Homo sapiens
gaauuccagcuucacacua

SEQ ID NO: 528941 - RNA, 19 nt, Homo sapiens
gauucauccuucucaccua

SEQ ID NO: 528942 - RNA, 19 nt, Homo sapiens
ggcuauggauuuggcuuaa

SEQ ID NO: 528943 - RNA, 19 nt, Homo sapiens
acucuaaagccagguauua

SEQ ID NO: 528944 - RNA, 19 nt, Homo sapiens
gguuuaggauacacucaga

SEQ ID NO: 528945 - RNA, 19 nt, Homo sapiens
accagaaagugaacaagaa

SEQ ID NO: 528946 - RNA, 19 nt, Homo sapiens
gacauggauuucgacauug

SEQ ID NO: 528947 - RNA, 19 nt, Homo sapiens
ggcacuuuguaaauucaua

SEQ ID NO: 528948 - RNA, 19 nt, Homo sapiens
uuccagagguacagaagaa

SEQ ID NO: 528949 - RNA, 19 nt, Homo sapiens
ucuaaagccagguauuaaa

SEQ ID NO: 528950 - RNA, 19 nt, Homo sapiens
uggaagcggauaauaugua

SEQ ID NO: 528951 - RNA, 19 nt, Homo sapiens
guuguauucucaccacuca

SEQ ID NO: 528952 - RNA, 19 nt, Homo sapiens
gaauggauuggaauuuaca

SEQ ID NO: 528953 - RNA, 19 nt, Homo sapiens
agaaagugaacaagaaguu

SEQ ID NO: 528954 - RNA, 19 nt, Homo sapiens
gcuaccagaugaauuuuga

SEQ ID NO: 528955 - RNA, 19 nt, Homo sapiens
gaugagaggcucgcugcuu

SEQ ID NO: 528956 - RNA, 19 nt, Homo sapiens
gucuaggacuggaauuuca

SEQ ID NO: 528957 - RNA, 19 nt, Homo sapiens
cggcuaaagugaacaacuc

SEQ ID NO: 528958 - RNA, 19 nt, Homo sapiens
uggagaagguggaugugau

SEQ ID NO: 528959 - RNA, 19 nt, Homo sapiens
gcaaguggaagcggauaau

SEQ ID NO: 528960 - RNA, 19 nt, Homo sapiens
acuccagccugauagguuu

SEQ ID NO: 528961 - RNA, 19 nt, Homo sapiens
gcggcuccauuuaccagaa

SEQ ID NO: 528962 - RNA, 19 nt, Homo sapiens
uacaagcgggagcacauua

SEQ ID NO: 528963 - RNA, 19 nt, Homo sapiens
agaaauggaauaccgacaa

SEQ ID NO: 528964 - RNA, 19 nt, Homo sapiens
uauguaggcacuuuguaaa

SEQ ID NO: 528965 - RNA, 19 nt, Homo sapiens
ugagaauggauuggaauuu

SEQ ID NO: 528966 - RNA, 19 nt, Homo sapiens
gauucagcuuuaagauguu

SEQ ID NO: 528967 - RNA, 19 nt, Homo sapiens
gcauaaaugaauacuguac

SEQ ID NO: 528968 - RNA, 19 nt, Homo sapiens
agaauggauuggaauuuac

SEQ ID NO: 528969 - RNA, 19 nt, Homo sapiens
gaacagaaaucgcaauuga

SEQ ID NO: 528970 - RNA, 19 nt, Homo sapiens
caacaacucuagcuuaauu

SEQ ID NO: 528971 - RNA, 19 nt, Homo sapiens
aaucaaagcugacaaggaa

SEQ ID NO: 528972 - RNA, 19 nt, Homo sapiens
cccagaacaugacaaauua

SEQ ID NO: 528973 - RNA, 19 nt, Homo sapiens
gcaauugugugcauguuug

SEQ ID NO: 528974 - RNA, 19 nt, Homo sapiens
guucagccauuauuacuuu

SEQ ID NO: 528975 - RNA, 19 nt, Homo sapiens
gaggaucaauuuaucagaa

SEQ ID NO: 528976 - RNA, 19 nt, Homo sapiens
guucagcugucuuugguua

SEQ ID NO: 528977 - RNA, 19 nt, Homo sapiens
gauacuaccuucucaccaa

SEQ ID NO: 528978 - RNA, 19 nt, Homo sapiens
gaaaguuugugaagaucuu

SEQ ID NO: 528979 - RNA, 19 nt, Homo sapiens
gucaacaacucuagcuuaa

SEQ ID NO: 528980 - RNA, 19 nt, Homo sapiens
gaucuugacacuucaguaa

SEQ ID NO: 528981 - RNA, 19 nt, Homo sapiens
ucagaaaguuugugaagau

SEQ ID NO: 528982 - RNA, 19 nt, Homo sapiens
gaccagauuugucaagguu

SEQ ID NO: 528983 - RNA, 19 nt, Homo sapiens
uaaaugcgcuacccaccaa

SEQ ID NO: 528984 - RNA, 19 nt, Homo sapiens
gcuaccagaugaccuuuga

SEQ ID NO: 528985 - RNA, 19 nt, Homo sapiens
guagaugggaagagcauua

SEQ ID NO: 528986 - RNA, 19 nt, Homo sapiens
guugugauguugacuuuga

SEQ ID NO: 528987 - RNA, 19 nt, Homo sapiens
gcugguuucuaguugguua

SEQ ID NO: 528988 - RNA, 19 nt, Homo sapiens
caacaagagcuguauuuua

SEQ ID NO: 528989 - RNA, 19 nt, Homo sapiens
gacagaauuuggaggauca

SEQ ID NO: 528990 - RNA, 19 nt, Homo sapiens
caaaguugccagagauauu

SEQ ID NO: 528991 - RNA, 19 nt, Homo sapiens
gcaauugaagaccagauuu

SEQ ID NO: 528992 - RNA, 19 nt, Homo sapiens
ucaaagcugacaaggaaua

SEQ ID NO: 528993 - RNA, 19 nt, Homo sapiens
uacagacacugguaaaguu

SEQ ID NO: 528994 - RNA, 19 nt, Homo sapiens
gguaccaacugcacucguu

SEQ ID NO: 528995 - RNA, 19 nt, Homo sapiens
aaucaagucuucuuacaag

SEQ ID NO: 528996 - RNA, 19 nt, Homo sapiens
caacguccgguucaucuaa

SEQ ID NO: 528997 - RNA, 19 nt, Homo sapiens
ccagauuugucaagguuug

SEQ ID NO: 528998 - RNA, 19 nt, Homo sapiens
gcuacacacuaaugucaau

SEQ ID NO: 528999 - RNA, 19 nt, Homo sapiens
uuuguuagcugguuucuag

SEQ ID NO: 529000 - RNA, 19 nt, Homo sapiens
gcauugcagcuaaauauca

SEQ ID NO: 529001 - RNA, 19 nt, Homo sapiens
ccagagauauuuucaacaa

SEQ ID NO: 529002 - RNA, 19 nt, Homo sapiens
gaugggaagagcauuaaug

SEQ ID NO: 529003 - RNA, 19 nt, Homo sapiens
ucaaugaugggacagaauu

SEQ ID NO: 529004 - RNA, 19 nt, Homo sapiens
gaucaguggauauuaagau

SEQ ID NO: 529005 - RNA, 19 nt, Homo sapiens
gaaaagugguaaaaucaag

SEQ ID NO: 529006 - RNA, 19 nt, Homo sapiens
ccaaauacaagugguguga

SEQ ID NO: 529007 - RNA, 19 nt, Homo sapiens
ggacaucagguaccaacug

SEQ ID NO: 529008 - RNA, 19 nt, Homo sapiens
cauugacuguuaccauuga

SEQ ID NO: 529009 - RNA, 19 nt, Homo sapiens
guauuuagacaguucuuug

SEQ ID NO: 529010 - RNA, 19 nt, Homo sapiens
uacacucucugcucuggua

SEQ ID NO: 529011 - RNA, 19 nt, Homo sapiens
ggaucccacugcuuccauu

SEQ ID NO: 529012 - RNA, 19 nt, Homo sapiens
gaaacugacauuugauacu

SEQ ID NO: 529013 - RNA, 19 nt, Homo sapiens
gggaacagaaaucgcaauu

SEQ ID NO: 529014 - RNA, 19 nt, Homo sapiens
gugaguauggucugacuuu

SEQ ID NO: 529015 - RNA, 19 nt, Homo sapiens
ucccagaacaugacaaauu

SEQ ID NO: 529016 - RNA, 19 nt, Homo sapiens
ccaagaagaugaucaaaac

SEQ ID NO: 529017 - RNA, 19 nt, Homo sapiens
gacaaggaauaacuuugca

SEQ ID NO: 529018 - RNA, 19 nt, Homo sapiens
guguauuccuccaucauau

SEQ ID NO: 529019 - RNA, 19 nt, Homo sapiens
aaaguugccagagauauuu

SEQ ID NO: 529020 - RNA, 19 nt, Homo sapiens
caauugaagaccagauuug

SEQ ID NO: 529021 - RNA, 19 nt, Homo sapiens
gcgcuacccaccaauaaug

SEQ ID NO: 529022 - RNA, 19 nt, Homo sapiens
guuagcugguuucuaguug

SEQ ID NO: 529023 - RNA, 19 nt, Homo sapiens
gagggaguguauaaaccuu

SEQ ID NO: 529024 - RNA, 19 nt, Homo sapiens
ggaaagaaaagugguaaaa

SEQ ID NO: 529025 - RNA, 19 nt, Homo sapiens
uaugaaaacugugcaauug

SEQ ID NO: 529026 - RNA, 19 nt, Homo sapiens
uaauccagcugaaagaaac

SEQ ID NO: 529027 - RNA, 19 nt, Homo sapiens
agucaacaacucuagcuua

SEQ ID NO: 529028 - RNA, 19 nt, Homo sapiens
ccagaugaccuuugacagu

SEQ ID NO: 529029 - RNA, 19 nt, Homo sapiens
gaaacuggaugugaaaaca

SEQ ID NO: 529030 - RNA, 19 nt, Homo sapiens
caagagggaguguauaaac

SEQ ID NO: 529031 - RNA, 19 nt, Homo sapiens
ggugaaacuggaugugaaa

SEQ ID NO: 529032 - RNA, 19 nt, Homo sapiens
ccaccaauaaugaaauaga

SEQ ID NO: 529033 - RNA, 19 nt, Homo sapiens
uuagacaguucuuuguuag

SEQ ID NO: 529034 - RNA, 19 nt, Homo sapiens
aaaccuugcuuggacauca

SEQ ID NO: 529035 - RNA, 19 nt, Homo sapiens
guggaacacugauaacacu

SEQ ID NO: 529036 - RNA, 19 nt, Homo sapiens
aaauacaaguggugugagu

SEQ ID NO: 529037 - RNA, 19 nt, Homo sapiens
acagacacugguaaaguua

SEQ ID NO: 529038 - RNA, 19 nt, Homo sapiens
guuucuaguugguuaucua

SEQ ID NO: 529039 - RNA, 19 nt, Homo sapiens
uaauacagacacugguaaa

SEQ ID NO: 529040 - RNA, 19 nt, Homo sapiens
guuaaguucagccauuauu

SEQ ID NO: 529041 - RNA, 19 nt, Homo sapiens
gauauuaagaugagguuac

SEQ ID NO: 529042 - RNA, 19 nt, Homo sapiens
acccaccaauaaugaaaua

SEQ ID NO: 529043 - RNA, 19 nt, Homo sapiens
gcugacaaggaauaacuuu

SEQ ID NO: 529044 - RNA, 19 nt, Homo sapiens
gauguugacuuugauuuug

SEQ ID NO: 529045 - RNA, 19 nt, Homo sapiens
ggaacagaaaucgcaauug

SEQ ID NO: 529046 - RNA, 19 nt, Homo sapiens
cagaacaugacaaauuaug

SEQ ID NO: 529047 - RNA, 19 nt, Homo sapiens
uggcauugcagcuaaauau

SEQ ID NO: 529048 - RNA, 19 nt, Homo sapiens
caaagcugacaaggaauaa

SEQ ID NO: 529049 - RNA, 19 nt, Homo sapiens
gaagaccagauuugucaag

SEQ ID NO: 529050 - RNA, 19 nt, Homo sapiens
guucuuuguuagcugguuu

SEQ ID NO: 529051 - RNA, 19 nt, Homo sapiens
ggaucaauuuaucagaaag

SEQ ID NO: 529052 - RNA, 19 nt, Homo sapiens
acagaaaucgcaauugaag

SEQ ID NO: 529053 - RNA, 19 nt, Homo sapiens
gaguauggucugacuuuca

SEQ ID NO: 529054 - RNA, 19 nt, Homo sapiens
cccuggaguuggaggcuua

SEQ ID NO: 529055 - RNA, 19 nt, Homo sapiens
uuguuaaguucagccauua

SEQ ID NO: 529056 - RNA, 19 nt, Homo sapiens
uuuguuaaguucagccauu

SEQ ID NO: 529057 - RNA, 19 nt, Homo sapiens
cugcuuccauuucugcaaa

SEQ ID NO: 529058 - RNA, 19 nt, Homo sapiens
guaccaacugcacucguuu

SEQ ID NO: 529059 - RNA, 19 nt, Homo sapiens
caaugaugggacagaauuu

SEQ ID NO: 529060 - RNA, 19 nt, Homo sapiens
cagcuacacacuaauguca

SEQ ID NO: 529061 - RNA, 19 nt, Homo sapiens
ugauaacacucugggaaca

SEQ ID NO: 529062 - RNA, 19 nt, Homo sapiens
cuaauacagacacugguaa

SEQ ID NO: 529063 - RNA, 19 nt, Homo sapiens
uggugaaacuggaugugaa

SEQ ID NO: 529064 - RNA, 19 nt, Homo sapiens
cagaaaguuugugaagauc

SEQ ID NO: 529065 - RNA, 19 nt, Homo sapiens
ggaggaucaauuuaucaga

SEQ ID NO: 529066 - RNA, 19 nt, Homo sapiens
ucagcugucuuugguuaug

SEQ ID NO: 529067 - RNA, 19 nt, Homo sapiens
ggaccugcaauccaugguu

SEQ ID NO: 529068 - RNA, 19 nt, Homo sapiens
auacuaccuucucaccaaa

SEQ ID NO: 529069 - RNA, 19 nt, Homo sapiens
gaacuucucucucugcuaa

SEQ ID NO: 529070 - RNA, 19 nt, Homo sapiens
gauuugaacuggaagcuua

SEQ ID NO: 529071 - RNA, 19 nt, Homo sapiens
gaaaugaacccacuauguu

SEQ ID NO: 529072 - RNA, 19 nt, Homo sapiens
gcaguaauguugauauaga

SEQ ID NO: 529073 - RNA, 19 nt, Homo sapiens
gaaagaagagugggaaauu

SEQ ID NO: 529074 - RNA, 19 nt, Homo sapiens
ggaggucuuugguuucaua

SEQ ID NO: 529075 - RNA, 19 nt, Homo sapiens
gaggaaagcaucagauuug

SEQ ID NO: 529076 - RNA, 19 nt, Homo sapiens
gcugaaggguugaaacuga

SEQ ID NO: 529077 - RNA, 19 nt, Homo sapiens
gaacacagacaauacucua

SEQ ID NO: 529078 - RNA, 19 nt, Homo sapiens
gaaggugaaugagaagauu

SEQ ID NO: 529079 - RNA, 19 nt, Homo sapiens
gaacgauggcacugaauuu

SEQ ID NO: 529080 - RNA, 19 nt, Homo sapiens
ccaaauauaaggucuguaa

SEQ ID NO: 529081 - RNA, 19 nt, Homo sapiens
gaaagcaucaggcaaccua

SEQ ID NO: 529082 - RNA, 19 nt, Homo sapiens
cauaagagccugagagaga

SEQ ID NO: 529083 - RNA, 19 nt, Homo sapiens
cuaaguacaugcuggauug

SEQ ID NO: 529084 - RNA, 19 nt, Homo sapiens
guaauauacuggucucugu

SEQ ID NO: 529085 - RNA, 19 nt, Homo sapiens
ggacuggguuauacucaga

SEQ ID NO: 529086 - RNA, 19 nt, Homo sapiens
ggucaugcuuacacugaua

SEQ ID NO: 529087 - RNA, 19 nt, Homo sapiens
cuaaggaugucuucaacaa

SEQ ID NO: 529088 - RNA, 19 nt, Homo sapiens
gguugaaacugacucuuga

SEQ ID NO: 529089 - RNA, 19 nt, Homo sapiens
uauaaggucuguaacuaug

SEQ ID NO: 529090 - RNA, 19 nt, Homo sapiens
gaagauugaaacauccaua

SEQ ID NO: 529091 - RNA, 19 nt, Homo sapiens
ggguggaggucuuugguuu

SEQ ID NO: 529092 - RNA, 19 nt, Homo sapiens
gagaauaaguuggcugaag

SEQ ID NO: 529093 - RNA, 19 nt, Homo sapiens
gaaaggcugcuaaggaugu

SEQ ID NO: 529094 - RNA, 19 nt, Homo sapiens
ccuggaaguugucauguuu

SEQ ID NO: 529095 - RNA, 19 nt, Homo sapiens
aaagaagagugggaaauug

SEQ ID NO: 529096 - RNA, 19 nt, Homo sapiens
caaccuagaaaccaaauau

SEQ ID NO: 529097 - RNA, 19 nt, Homo sapiens
ggaguaacaacacccguuu

SEQ ID NO: 529098 - RNA, 19 nt, Homo sapiens
ugacacagccaaauccaaa

SEQ ID NO: 529099 - RNA, 19 nt, Homo sapiens
uggcaguaauguugauaua

SEQ ID NO: 529100 - RNA, 19 nt, Homo sapiens
gaaauugaaggccuccuau

SEQ ID NO: 529101 - RNA, 19 nt, Homo sapiens
ggaaauugaaggccuccua

SEQ ID NO: 529102 - RNA, 19 nt, Homo sapiens
gaaauggaacacagacaau

SEQ ID NO: 529103 - RNA, 19 nt, Homo sapiens
gaucugacccaccaguuug

SEQ ID NO: 529104 - RNA, 19 nt, Homo sapiens
gaaacugacucuugauacc

SEQ ID NO: 529105 - RNA, 19 nt, Homo sapiens
gugcuauaguggaaucuuu

SEQ ID NO: 529106 - RNA, 19 nt, Homo sapiens
uuacaaggcugcggacuuc

SEQ ID NO: 529107 - RNA, 19 nt, Homo sapiens
gaagcuuaaugugguuuga

SEQ ID NO: 529108 - RNA, 19 nt, Homo sapiens
gaacuggaagcuuaaugug

SEQ ID NO: 529109 - RNA, 19 nt, Homo sapiens
aaaugaacccacuauguuu

SEQ ID NO: 529110 - RNA, 19 nt, Homo sapiens
ggaaagaagagugggaaau

SEQ ID NO: 529111 - RNA, 19 nt, Homo sapiens
gaauuuggagguucuaucu

SEQ ID NO: 529112 - RNA, 19 nt, Homo sapiens
cgauggcacugaauuugga

SEQ ID NO: 529113 - RNA, 19 nt, Homo sapiens
aggaaaggcugcuaaggau

SEQ ID NO: 529114 - RNA, 19 nt, Homo sapiens
gaagugaagagaaaugaac

SEQ ID NO: 529115 - RNA, 19 nt, Homo sapiens
agaaaugaacccacuaugu

SEQ ID NO: 529116 - RNA, 19 nt, Homo sapiens
ugaggaaagcaucagauuu

SEQ ID NO: 529117 - RNA, 19 nt, Homo sapiens
ugaaacauccauaaaccuu

SEQ ID NO: 529118 - RNA, 19 nt, Homo sapiens
aauugaaggccuccuauaa

SEQ ID NO: 529119 - RNA, 19 nt, Homo sapiens
gucuguaacuauggacuua

SEQ ID NO: 529120 - RNA, 19 nt, Homo sapiens
auaguggaaucuuugguuu

SEQ ID NO: 529121 - RNA, 19 nt, Homo sapiens
aaggaugucuucaacaaag

SEQ ID NO: 529122 - RNA, 19 nt, Homo sapiens
ggaagugaagagaaaugaa

SEQ ID NO: 529123 - RNA, 19 nt, Homo sapiens
uaggaaaggcugcuaagga

SEQ ID NO: 529124 - RNA, 19 nt, Homo sapiens
aauaaacccaucacauuug

SEQ ID NO: 529125 - RNA, 19 nt, Homo sapiens
uaaggucuguaacuaugga

SEQ ID NO: 529126 - RNA, 19 nt, Homo sapiens
cuacuucuggucaugcuua

SEQ ID NO: 529127 - RNA, 19 nt, Homo sapiens
accagaaggugaaugagaa

SEQ ID NO: 529128 - RNA, 19 nt, Homo sapiens
gacucuugauaccauauuu

SEQ ID NO: 529129 - RNA, 19 nt, Homo sapiens
aaauggaacacagacaaua

SEQ ID NO: 529130 - RNA, 19 nt, Homo sapiens
ggaguggaauuuucuacuu

SEQ ID NO: 529131 - RNA, 19 nt, Homo sapiens
aagguuggcuugggauuug

SEQ ID NO: 529132 - RNA, 19 nt, Homo sapiens
ugcaggaggucacaagguu

SEQ ID NO: 529133 - RNA, 19 nt, Homo sapiens
uggcauugcugcuaaguac

SEQ ID NO: 529134 - RNA, 19 nt, Homo sapiens
aagaagagugggaaauuga

SEQ ID NO: 529135 - RNA, 19 nt, Homo sapiens
gaacacaggaaagaagagu

SEQ ID NO: 529136 - RNA, 19 nt, Homo sapiens
guggaggucuuugguuuca

SEQ ID NO: 529137 - RNA, 19 nt, Homo sapiens
guaccgaacacaggaaaga

SEQ ID NO: 529138 - RNA, 19 nt, Homo sapiens
uaaugugguuugaggaaag

SEQ ID NO: 529139 - RNA, 19 nt, Homo sapiens
gcuaaguacaugcuggauu

SEQ ID NO: 529140 - RNA, 19 nt, Homo sapiens
ggacagcugggaguaacaa

SEQ ID NO: 529141 - RNA, 19 nt, Homo sapiens
augagaagauugaaacauc

SEQ ID NO: 529142 - RNA, 19 nt, Homo sapiens
gccuggaaguugucauguu

SEQ ID NO: 529143 - RNA, 19 nt, Homo sapiens
gagaaaugaacccacuaug

SEQ ID NO: 529144 - RNA, 19 nt, Homo sapiens
gacuuuaucagcuuuaauc

SEQ ID NO: 529145 - RNA, 19 nt, Homo sapiens
aauaaugccagccugauug

SEQ ID NO: 529146 - RNA, 19 nt, Homo sapiens
gauugaaacauccauaaac

SEQ ID NO: 529147 - RNA, 19 nt, Homo sapiens
ugugaacgauggcacugaa

SEQ ID NO: 529148 - RNA, 19 nt, Homo sapiens
acaauacucuagggacaga

SEQ ID NO: 529149 - RNA, 19 nt, Homo sapiens
uaaggaugucuucaacaaa

SEQ ID NO: 529150 - RNA, 19 nt, Homo sapiens
ucucugugcuauaguggaa

SEQ ID NO: 529151 - RNA, 19 nt, Homo sapiens
ggguugaaacugacucuug

SEQ ID NO: 529152 - RNA, 19 nt, Homo sapiens
caggcaaccuagaaaccaa

SEQ ID NO: 529153 - RNA, 19 nt, Homo sapiens
aaauaaugccagccugauu

SEQ ID NO: 529154 - RNA, 19 nt, Homo sapiens
caacacccguuuuggcauu

SEQ ID NO: 529155 - RNA, 19 nt, Homo sapiens
ugaaugagaagauugaaac

SEQ ID NO: 529156 - RNA, 19 nt, Homo sapiens
aaauugaaggccuccuaua

SEQ ID NO: 529157 - RNA, 19 nt, Homo sapiens
gaagagugggaaauugaag

SEQ ID NO: 529158 - RNA, 19 nt, Homo sapiens
agaaauggaacacagacaa

SEQ ID NO: 529159 - RNA, 19 nt, Homo sapiens
gcaucaggcaaccuagaaa

SEQ ID NO: 529160 - RNA, 19 nt, Homo sapiens
aaacccaucacauuuggaa

SEQ ID NO: 529161 - RNA, 19 nt, Homo sapiens
acaguguagcgucauguua

SEQ ID NO: 529162 - RNA, 19 nt, Homo sapiens
uuaaugugguuugaggaaa

SEQ ID NO: 529163 - RNA, 19 nt, Homo sapiens
gaaugagaagauugaaaca

SEQ ID NO: 529164 - RNA, 19 nt, Homo sapiens
ugaacgauggcacugaauu

SEQ ID NO: 529165 - RNA, 19 nt, Homo sapiens
gcuaucagaugaguuuuga

SEQ ID NO: 529166 - RNA, 19 nt, Homo sapiens
uugaaggccuccuauaaac

SEQ ID NO: 529167 - RNA, 19 nt, Homo sapiens
gcuuuggcauggucaagau

SEQ ID NO: 529168 - RNA, 19 nt, Homo sapiens
cgaucugacccaccaguuu

SEQ ID NO: 529169 - RNA, 19 nt, Homo sapiens
caucaucgauucuacuuua

SEQ ID NO: 529170 - RNA, 19 nt, Homo sapiens
ggaagcgucuguccguuua

SEQ ID NO: 529171 - RNA, 19 nt, Homo sapiens
gaacuuacauugugaaacu

SEQ ID NO: 529172 - RNA, 19 nt, Homo sapiens
gagagacccuuguuugauu

SEQ ID NO: 529173 - RNA, 19 nt, Homo sapiens
gcuguugccucaucuauaa

SEQ ID NO: 529174 - RNA, 19 nt, Homo sapiens
gcauauauaucgcuuaauc

SEQ ID NO: 529175 - RNA, 19 nt, Homo sapiens
gaaacccugucucuauuaa

SEQ ID NO: 529176 - RNA, 19 nt, Homo sapiens
gaacccaccugcugagaga

SEQ ID NO: 529177 - RNA, 19 nt, Homo sapiens
gcacuuacuuuguuugcaa

SEQ ID NO: 529178 - RNA, 19 nt, Homo sapiens
gcaaugagaucuccugacu

SEQ ID NO: 529179 - RNA, 19 nt, Homo sapiens
cuaaguggcugcugacuga

SEQ ID NO: 529180 - RNA, 19 nt, Homo sapiens
ccacugauuuggagauauu

SEQ ID NO: 529181 - RNA, 19 nt, Homo sapiens
cauuauaacugaaggagaa

SEQ ID NO: 529182 - RNA, 19 nt, Homo sapiens
agaaugagagugugaaaua

SEQ ID NO: 529183 - RNA, 19 nt, Homo sapiens
ugaagaagcugaacuugca

SEQ ID NO: 529184 - RNA, 19 nt, Homo sapiens
caaguacugcuguaaauaa

SEQ ID NO: 529185 - RNA, 19 nt, Homo sapiens
ggauggaggagaagaauuu

SEQ ID NO: 529186 - RNA, 19 nt, Homo sapiens
guacugcuguaaauaaaug

SEQ ID NO: 529187 - RNA, 19 nt, Homo sapiens
ccaacacacugcagacgua

SEQ ID NO: 529188 - RNA, 19 nt, Homo sapiens
gcugaaugauuuccaaaga

SEQ ID NO: 529189 - RNA, 19 nt, Homo sapiens
gcgaaaggauguaaacagu

SEQ ID NO: 529190 - RNA, 19 nt, Homo sapiens
caagcgaggucaacagaga

SEQ ID NO: 529191 - RNA, 19 nt, Homo sapiens
gaaacuccgucuuagaagu

SEQ ID NO: 529192 - RNA, 19 nt, Homo sapiens
gcaaguacugcuguaaaua

SEQ ID NO: 529193 - RNA, 19 nt, Homo sapiens
ugaaugauuuccaaagaga

SEQ ID NO: 529194 - RNA, 19 nt, Homo sapiens
uaacaugcauuugucuuug

SEQ ID NO: 529195 - RNA, 19 nt, Homo sapiens
gcgaaacuccgucuuagaa

SEQ ID NO: 529196 - RNA, 19 nt, Homo sapiens
ucaaugcuaugaccuguga

SEQ ID NO: 529197 - RNA, 19 nt, Homo sapiens
ccauugaggucaucauguu

SEQ ID NO: 529198 - RNA, 19 nt, Homo sapiens
ggaauguguggcagauuua

SEQ ID NO: 529199 - RNA, 19 nt, Homo sapiens
gggaacuccugaaauauca

SEQ ID NO: 529200 - RNA, 19 nt, Homo sapiens
ucacagaggcuucuucaga

SEQ ID NO: 529201 - RNA, 19 nt, Homo sapiens
gagagggucuggagaagca

SEQ ID NO: 529202 - RNA, 19 nt, Homo sapiens
gaugauaccaggauucaga

SEQ ID NO: 529203 - RNA, 19 nt, Homo sapiens
ccauugcccugguuauauu

SEQ ID NO: 529204 - RNA, 19 nt, Homo sapiens
gaaugagagugugaaauag

SEQ ID NO: 529205 - RNA, 19 nt, Homo sapiens
gagcgaaacuccgucuuag

SEQ ID NO: 529206 - RNA, 19 nt, Homo sapiens
gugaaacuucuguacauua

SEQ ID NO: 529207 - RNA, 19 nt, Homo sapiens
gggagaacuuacauuguga

SEQ ID NO: 529208 - RNA, 19 nt, Homo sapiens
aaugagaucuccugacuag

SEQ ID NO: 529209 - RNA, 19 nt, Homo sapiens
caaccaauguagaaagcuu

SEQ ID NO: 529210 - RNA, 19 nt, Homo sapiens
caacagagaaggcaggaau

SEQ ID NO: 529211 - RNA, 19 nt, Homo sapiens
cagaauagcauauauaucg

SEQ ID NO: 529212 - RNA, 19 nt, Homo sapiens
gcaaccaagacuacaagua

SEQ ID NO: 529213 - RNA, 19 nt, Homo sapiens
caagucaaccaauguagaa

SEQ ID NO: 529214 - RNA, 19 nt, Homo sapiens
gauaugaguuguuuucaga

SEQ ID NO: 529215 - RNA, 19 nt, Homo sapiens
ugagucaccaggaauguua

SEQ ID NO: 529216 - RNA, 19 nt, Homo sapiens
uaucaccucuucagacaug

SEQ ID NO: 529217 - RNA, 19 nt, Homo sapiens
gagcagcagcgcaucauug

SEQ ID NO: 529218 - RNA, 19 nt, Homo sapiens
agugaaagcuagagauaug

SEQ ID NO: 529219 - RNA, 19 nt, Homo sapiens
ggaacagacaggagaaaug

SEQ ID NO: 529220 - RNA, 19 nt, Homo sapiens
ccagaaguuugucaaguca

SEQ ID NO: 529221 - RNA, 19 nt, Homo sapiens
aggaauguguggcagauuu

SEQ ID NO: 529222 - RNA, 19 nt, Homo sapiens
gggagagacccuuguuuga

SEQ ID NO: 529223 - RNA, 19 nt, Homo sapiens
ucagacuccauuuguauua

SEQ ID NO: 529224 - RNA, 19 nt, Homo sapiens
gcagugagccgcaucuucu

SEQ ID NO: 529225 - RNA, 19 nt, Homo sapiens
aacagugccugcugaauga

SEQ ID NO: 529226 - RNA, 19 nt, Homo sapiens
aaacagugccugcugaaug

SEQ ID NO: 529227 - RNA, 19 nt, Homo sapiens
ggagaaggaaggagacuca

SEQ ID NO: 529228 - RNA, 19 nt, Homo sapiens
ggagagacccuuguuugau

SEQ ID NO: 529229 - RNA, 19 nt, Homo sapiens
gucauuggcuuugcuaaga

SEQ ID NO: 529230 - RNA, 19 nt, Homo sapiens
gacucagacuccauuugua

SEQ ID NO: 529231 - RNA, 19 nt, Homo sapiens
caaccaagacuacaaguac

SEQ ID NO: 529232 - RNA, 19 nt, Homo sapiens
gccagaaguuugucaaguc

SEQ ID NO: 529233 - RNA, 19 nt, Homo sapiens
gcaggaauguguggcagau

SEQ ID NO: 529234 - RNA, 19 nt, Homo sapiens
ccucaggccuuggauaaug

SEQ ID NO: 529235 - RNA, 19 nt, Homo sapiens
ucacccaagccauauauaa

SEQ ID NO: 529236 - RNA, 19 nt, Homo sapiens
cacagaggcuucuucagau

SEQ ID NO: 529237 - RNA, 19 nt, Homo sapiens
gaacagacaggagaaaugc

SEQ ID NO: 529238 - RNA, 19 nt, Homo sapiens
gaggaguugcuguuuguuu

SEQ ID NO: 529239 - RNA, 19 nt, Homo sapiens
caugaggaguugcuguuug

SEQ ID NO: 529240 - RNA, 19 nt, Homo sapiens
uguggcagauuuagugaaa

SEQ ID NO: 529241 - RNA, 19 nt, Homo sapiens
ucuaggagcugggaggaaa

SEQ ID NO: 529242 - RNA, 19 nt, Homo sapiens
uagcagguaccacugauuu

SEQ ID NO: 529243 - RNA, 19 nt, Homo sapiens
gccugacccuggagacuuu

SEQ ID NO: 529244 - RNA, 19 nt, Homo sapiens
agaccaaccugaccaacau

SEQ ID NO: 529245 - RNA, 19 nt, Homo sapiens
agagacccuuguuugauuu

SEQ ID NO: 529246 - RNA, 19 nt, Homo sapiens
gaucacagaggcuucuuca

SEQ ID NO: 529247 - RNA, 19 nt, Homo sapiens
gggaagcgucuguccguuu

SEQ ID NO: 529248 - RNA, 19 nt, Homo sapiens
ggcuuucacuucaaugcua

SEQ ID NO: 529249 - RNA, 19 nt, Homo sapiens
gagugcagcaugaagcuaa

SEQ ID NO: 529250 - RNA, 19 nt, Homo sapiens
gcagauuuagugaaagcua

SEQ ID NO: 529251 - RNA, 19 nt, Homo sapiens
gaaagagccaagucuggau

SEQ ID NO: 529252 - RNA, 19 nt, Homo sapiens
gggaagcccuggauuucag

SEQ ID NO: 529253 - RNA, 19 nt, Homo sapiens
cccaagccauauauaacua

SEQ ID NO: 529254 - RNA, 19 nt, Homo sapiens
gcgcaucauugccauacug

SEQ ID NO: 529255 - RNA, 19 nt, Homo sapiens
acaaguaccgcgucaguga

SEQ ID NO: 529256 - RNA, 19 nt, Homo sapiens
ccaccaagcccaucagaag

SEQ ID NO: 529257 - RNA, 19 nt, Homo sapiens
gaucugggacccuuuccuu

SEQ ID NO: 529258 - RNA, 19 nt, Homo sapiens
agaaacccugucucuauua

SEQ ID NO: 529259 - RNA, 19 nt, Homo sapiens
gcaccugcauccguaguuc

SEQ ID NO: 529260 - RNA, 19 nt, Homo sapiens
ugacaaagaaacccaagug

SEQ ID NO: 529261 - RNA, 19 nt, Homo sapiens
ggaagcauguaggagaauc

SEQ ID NO: 529262 - RNA, 19 nt, Homo sapiens
ccacuggcuuucacuucaa

SEQ ID NO: 529263 - RNA, 19 nt, Homo sapiens
agagcgaaacuccgucuua

SEQ ID NO: 529264 - RNA, 19 nt, Homo sapiens
caccaggaauguuaaaguc

SEQ ID NO: 529265 - RNA, 19 nt, Homo sapiens
uuagugaaagcuagagaua

SEQ ID NO: 529266 - RNA, 19 nt, Homo sapiens
gauuuuagcugcagaacug

SEQ ID NO: 529267 - RNA, 19 nt, Homo sapiens
cagccugagugcagcauga

SEQ ID NO: 529268 - RNA, 19 nt, Homo sapiens
cuaagaugauaccaggauu

SEQ ID NO: 529269 - RNA, 19 nt, Homo sapiens
ggagaaagcauuuguuugu

SEQ ID NO: 529270 - RNA, 19 nt, Homo sapiens
cgaggcagcuugaguuaaa

SEQ ID NO: 529271 - RNA, 19 nt, Homo sapiens
gagaaagcauuuguuugua

SEQ ID NO: 529272 - RNA, 19 nt, Homo sapiens
gaacguacuugcagaugug

SEQ ID NO: 529273 - RNA, 19 nt, Homo sapiens
aaagaaagauagagcaaga

SEQ ID NO: 529274 - RNA, 19 nt, Homo sapiens
gcucggugcuggaauuuga

SEQ ID NO: 529275 - RNA, 19 nt, Homo sapiens
gaaagcauuuguuuguaca

SEQ ID NO: 529276 - RNA, 19 nt, Homo sapiens
ggaguacccugaugagauc

SEQ ID NO: 529277 - RNA, 19 nt, Homo sapiens
gcaagaaaucccgguauaa

SEQ ID NO: 529278 - RNA, 19 nt, Homo sapiens
gcagaaucaucacgaagug

SEQ ID NO: 529279 - RNA, 19 nt, Homo sapiens
caaagugagugaccugcuu

SEQ ID NO: 529280 - RNA, 19 nt, Homo sapiens
cgcaagaaaucccgguaua

SEQ ID NO: 529281 - RNA, 19 nt, Homo sapiens
ccgcagacguguaaauguu

SEQ ID NO: 529282 - RNA, 19 nt, Homo sapiens
agagagaagucgaggaaga

SEQ ID NO: 529283 - RNA, 19 nt, Homo sapiens
gaggaaagagguagcaaga

SEQ ID NO: 529284 - RNA, 19 nt, Homo sapiens
gcggagaaagcauuuguuu

SEQ ID NO: 529285 - RNA, 19 nt, Homo sapiens
agcaagagcuccagagaga

SEQ ID NO: 529286 - RNA, 19 nt, Homo sapiens
guguaaauguuccugcaaa

SEQ ID NO: 529287 - RNA, 19 nt, Homo sapiens
caacaucaccaugcagauu

SEQ ID NO: 529288 - RNA, 19 nt, Homo sapiens
gaggagggcagaaucauca

SEQ ID NO: 529289 - RNA, 19 nt, Homo sapiens
ugaacuuucugcugucuug

SEQ ID NO: 529290 - RNA, 19 nt, Homo sapiens
gauagagcaagacaagaaa

SEQ ID NO: 529291 - RNA, 19 nt, Homo sapiens
ccagagagaagucgaggaa

SEQ ID NO: 529292 - RNA, 19 nt, Homo sapiens
caagaaaucccgguauaag

SEQ ID NO: 529293 - RNA, 19 nt, Homo sapiens
aaacgaaagcgcaagaaau

SEQ ID NO: 529294 - RNA, 19 nt, Homo sapiens
gaaugcagaccaaagaaag

SEQ ID NO: 529295 - RNA, 19 nt, Homo sapiens
gaaguucauggaugucuau

SEQ ID NO: 529296 - RNA, 19 nt, Homo sapiens
cgaacguacuugcagaugu

SEQ ID NO: 529297 - RNA, 19 nt, Homo sapiens
agaaagcauuuguuuguac

SEQ ID NO: 529298 - RNA, 19 nt, Homo sapiens
ggaggaagaagagaaggaa

SEQ ID NO: 529299 - RNA, 19 nt, Homo sapiens
gaaggaggagggcagaauc

SEQ ID NO: 529300 - RNA, 19 nt, Homo sapiens
aaagauagagcaagacaag

SEQ ID NO: 529301 - RNA, 19 nt, Homo sapiens
gaaagauagagcaagacaa

SEQ ID NO: 529302 - RNA, 19 nt, Homo sapiens
ucaccaaggccagcacaua

SEQ ID NO: 529303 - RNA, 19 nt, Homo sapiens
gagcggagaaagcauuugu

SEQ ID NO: 529304 - RNA, 19 nt, Homo sapiens
agauagagcaagacaagaa

SEQ ID NO: 529305 - RNA, 19 nt, Homo sapiens
cugaugagaucgaguacau

SEQ ID NO: 529306 - RNA, 19 nt, Homo sapiens
guucauggaugucuaucag

SEQ ID NO: 529307 - RNA, 19 nt, Homo sapiens
ccaaagaaagauagagcaa

SEQ ID NO: 529308 - RNA, 19 nt, Homo sapiens
caagauccgcagacgugua

SEQ ID NO: 529309 - RNA, 19 nt, Homo sapiens
aacaucaccaugcagauua

SEQ ID NO: 529310 - RNA, 19 nt, Homo sapiens
ggcgaggcagcuugaguua

SEQ ID NO: 529311 - RNA, 19 nt, Homo sapiens
ugaaugcagaccaaagaaa

SEQ ID NO: 529312 - RNA, 19 nt, Homo sapiens
gcagaccaaagaaagauag

SEQ ID NO: 529313 - RNA, 19 nt, Homo sapiens
aaaugugaaugcagaccaa

SEQ ID NO: 529314 - RNA, 19 nt, Homo sapiens
ccacugaggaguccaacau

SEQ ID NO: 529315 - RNA, 19 nt, Homo sapiens
caagagcuccagagagaag

SEQ ID NO: 529316 - RNA, 19 nt, Homo sapiens
gaguuaaacgaacguacuu

SEQ ID NO: 529317 - RNA, 19 nt, Homo sapiens
gggaggaggaagaagagaa

SEQ ID NO: 529318 - RNA, 19 nt, Homo sapiens
guagcaagagcuccagaga

SEQ ID NO: 529319 - RNA, 19 nt, Homo sapiens
ggcgcucggugcuggaauu

SEQ ID NO: 529320 - RNA, 19 nt, Homo sapiens
agaaaucccgguauaaguc

SEQ ID NO: 529321 - RNA, 19 nt, Homo sapiens
ggaggaggaagaagagaag

SEQ ID NO: 529322 - RNA, 19 nt, Homo sapiens
cagaaagaggaaagaggua

SEQ ID NO: 529323 - RNA, 19 nt, Homo sapiens
ucagagcggagaaagcauu

SEQ ID NO: 529324 - RNA, 19 nt, Homo sapiens
ggaggagggcagaaucauc

SEQ ID NO: 529325 - RNA, 19 nt, Homo sapiens
aagauccgcagacguguaa

SEQ ID NO: 529326 - RNA, 19 nt, Homo sapiens
ggaagaagagaaggaagag

SEQ ID NO: 529327 - RNA, 19 nt, Homo sapiens
aacgaaagcgcaagaaauc

SEQ ID NO: 529328 - RNA, 19 nt, Homo sapiens
gcagcuugaguuaaacgaa

SEQ ID NO: 529329 - RNA, 19 nt, Homo sapiens
ggugcuggaauuugauauu

SEQ ID NO: 529330 - RNA, 19 nt, Homo sapiens
gcgcaagaaaucccgguau

SEQ ID NO: 529331 - RNA, 19 nt, Homo sapiens
gcaagagcuccagagagaa

SEQ ID NO: 529332 - RNA, 19 nt, Homo sapiens
caccaaggccagcacauag

SEQ ID NO: 529333 - RNA, 19 nt, Homo sapiens
ggcagaaucaucacgaagu

SEQ ID NO: 529334 - RNA, 19 nt, Homo sapiens
gguuuuaucccucuucuuu

SEQ ID NO: 529335 - RNA, 19 nt, Homo sapiens
agaagucgaggaagagaga

SEQ ID NO: 529336 - RNA, 19 nt, Homo sapiens
gauccgcagacguguaaau

SEQ ID NO: 529337 - RNA, 19 nt, Homo sapiens
gaucgaguacaucuucaag

SEQ ID NO: 529338 - RNA, 19 nt, Homo sapiens
gagagaagucgaggaagag

SEQ ID NO: 529339 - RNA, 19 nt, Homo sapiens
gcgaggcagcuugaguuaa

SEQ ID NO: 529340 - RNA, 19 nt, Homo sapiens
ccaaggccagcacauagga

SEQ ID NO: 529341 - RNA, 19 nt, Homo sapiens
acugaggaguccaacauca

SEQ ID NO: 529342 - RNA, 19 nt, Homo sapiens
acgagggccuggagugugu

SEQ ID NO: 529343 - RNA, 19 nt, Homo sapiens
ggacaucuuccaggaguac

SEQ ID NO: 529344 - RNA, 19 nt, Homo sapiens
aagaaaucccgguauaagu

SEQ ID NO: 529345 - RNA, 19 nt, Homo sapiens
uuggaaaccagcagaaaga

SEQ ID NO: 529346 - RNA, 19 nt, Homo sapiens
gugaaugcagaccaaagaa

SEQ ID NO: 529347 - RNA, 19 nt, Homo sapiens
cagauuaugcggaucaaac

SEQ ID NO: 529348 - RNA, 19 nt, Homo sapiens
acaucaccaugcagauuau

SEQ ID NO: 529349 - RNA, 19 nt, Homo sapiens
cggagaaagcauuuguuug

SEQ ID NO: 529350 - RNA, 19 nt, Homo sapiens
agaaagauagagcaagaca

SEQ ID NO: 529351 - RNA, 19 nt, Homo sapiens
cagagcggagaaagcauuu

SEQ ID NO: 529352 - RNA, 19 nt, Homo sapiens
ugugaaugcagaccaaaga

SEQ ID NO: 529353 - RNA, 19 nt, Homo sapiens
cagcacauaggagagauga

SEQ ID NO: 529354 - RNA, 19 nt, Homo sapiens
acuguauuguuucucguuu

SEQ ID NO: 529355 - RNA, 19 nt, Homo sapiens
ugacggacagacagacaga

SEQ ID NO: 529356 - RNA, 19 nt, Homo sapiens
gaaaguggugucauggaua

SEQ ID NO: 529357 - RNA, 19 nt, Homo sapiens
ggaaaguggugucauggau

SEQ ID NO: 529358 - RNA, 19 nt, Homo sapiens
uaaaagagauggaaggaaa

SEQ ID NO: 529359 - RNA, 19 nt, Homo sapiens
uaaccacucugugcaagua

SEQ ID NO: 529360 - RNA, 19 nt, Homo sapiens
ccaaaccucugcauaaugg

SEQ ID NO: 529361 - RNA, 19 nt, Homo sapiens
gaaggugacacauggcuuu

SEQ ID NO: 529362 - RNA, 19 nt, Homo sapiens
gacccaaaccucugcauaa

SEQ ID NO: 529363 - RNA, 19 nt, Homo sapiens
ggagaugucccuggaagaa

SEQ ID NO: 529364 - RNA, 19 nt, Homo sapiens
gauuugggcuuugguacaa

SEQ ID NO: 529365 - RNA, 19 nt, Homo sapiens
acaaagaggagccugguaa

SEQ ID NO: 529366 - RNA, 19 nt, Homo sapiens
ugucauggauagaugugua

SEQ ID NO: 529367 - RNA, 19 nt, Homo sapiens
caaagaggagccugguaaa

SEQ ID NO: 529368 - RNA, 19 nt, Homo sapiens
agaggaaaguggugucaug

SEQ ID NO: 529369 - RNA, 19 nt, Homo sapiens
cagggugacuugccucaga

SEQ ID NO: 529370 - RNA, 19 nt, Homo sapiens
aaaguggugucauggauag

SEQ ID NO: 529371 - RNA, 19 nt, Homo sapiens
auaaugggauuugggcuuu

SEQ ID NO: 529372 - RNA, 19 nt, Homo sapiens
caucaaacaggacagaguu

SEQ ID NO: 529373 - RNA, 19 nt, Homo sapiens
agaauggaguacugucuca

SEQ ID NO: 529374 - RNA, 19 nt, Homo sapiens
aaacaggacagaguuggaa

SEQ ID NO: 529375 - RNA, 19 nt, Homo sapiens
cagugugaaugcagaccua

SEQ ID NO: 529376 - RNA, 19 nt, Homo sapiens
gaccucagcccaggcagaa

SEQ ID NO: 529377 - RNA, 19 nt, Homo sapiens
ccacugggcagcaccaagu

SEQ ID NO: 529378 - RNA, 19 nt, Homo sapiens
ggauuugggcuuugguaca

SEQ ID NO: 529379 - RNA, 19 nt, Homo sapiens
acccaaaccucugcauaau

SEQ ID NO: 529380 - RNA, 19 nt, Homo sapiens
ggagaauggaguacugucu

SEQ ID NO: 529381 - RNA, 19 nt, Homo sapiens
caaacaggacagaguugga

SEQ ID NO: 529382 - RNA, 19 nt, Homo sapiens
agaugucccuggaagaaca

SEQ ID NO: 529383 - RNA, 19 nt, Homo sapiens
acgauggccuggagugugu

SEQ ID NO: 529384 - RNA, 19 nt, Homo sapiens
ucacuaagaagacccaaac

SEQ ID NO: 529385 - RNA, 19 nt, Homo sapiens
agacccaaaccucugcaua

SEQ ID NO: 529386 - RNA, 19 nt, Homo sapiens
caagaggggucacauacca

SEQ ID NO: 529387 - RNA, 19 nt, Homo sapiens
cugaggccaucaucaaaca

SEQ ID NO: 529388 - RNA, 19 nt, Homo sapiens
acacauggcuuuucagacu

SEQ ID NO: 529389 - RNA, 19 nt, Homo sapiens
ccccaacccugauaaaaga

SEQ ID NO: 529390 - RNA, 19 nt, Homo sapiens
guggugucauggauagaug

SEQ ID NO: 529391 - RNA, 19 nt, Homo sapiens
gggcuuugguacaagaacu

SEQ ID NO: 529392 - RNA, 19 nt, Homo sapiens
ggugacacauggcuuuuca

SEQ ID NO: 529393 - RNA, 19 nt, Homo sapiens
agacugggaggcagcaaga

SEQ ID NO: 529394 - RNA, 19 nt, Homo sapiens
caaaugagcuaagauugua

SEQ ID NO: 529395 - RNA, 19 nt, Homo sapiens
ccacagaaaugcuuguuaa

SEQ ID NO: 529396 - RNA, 19 nt, Homo sapiens
ggagaugacucaacagaug

SEQ ID NO: 529397 - RNA, 19 nt, Homo sapiens
gauaaugaguggagaaaga

SEQ ID NO: 529398 - RNA, 19 nt, Homo sapiens
ccaauuacauguggaauaa

SEQ ID NO: 529399 - RNA, 19 nt, Homo sapiens
aaaggaggcuggcaacaua

SEQ ID NO: 529400 - RNA, 19 nt, Homo sapiens
guggauaacuuuacagaaa

SEQ ID NO: 529401 - RNA, 19 nt, Homo sapiens
gagcuaagauuguacuguu

SEQ ID NO: 529402 - RNA, 19 nt, Homo sapiens
acaaagaacuagacagaaa

SEQ ID NO: 529403 - RNA, 19 nt, Homo sapiens
acaaggagcuggaugaaga

SEQ ID NO: 529404 - RNA, 19 nt, Homo sapiens
cgacaaacaccuucuuuaa

SEQ ID NO: 529405 - RNA, 19 nt, Homo sapiens
ggacagaagagacuauaaa

SEQ ID NO: 529406 - RNA, 19 nt, Homo sapiens
gaagaagugugucguugug

SEQ ID NO: 529407 - RNA, 19 nt, Homo sapiens
gaaauggacuggagcucau

SEQ ID NO: 529408 - RNA, 19 nt, Homo sapiens
gacaaacaccuucuuuaaa

SEQ ID NO: 529409 - RNA, 19 nt, Homo sapiens
acaaacaccuucuuuaaac

SEQ ID NO: 529410 - RNA, 19 nt, Homo sapiens
acagagaucuugaaaagua

SEQ ID NO: 529411 - RNA, 19 nt, Homo sapiens
gaacagagagacccuugug

SEQ ID NO: 529412 - RNA, 19 nt, Homo sapiens
ccacaaagaacuagacaga

SEQ ID NO: 529413 - RNA, 19 nt, Homo sapiens
gaccaaacagccaagauuu

SEQ ID NO: 529414 - RNA, 19 nt, Homo sapiens
ccacaaaugagcuaagauu

SEQ ID NO: 529415 - RNA, 19 nt, Homo sapiens
ggauaacuuuacagaaaug

SEQ ID NO: 529416 - RNA, 19 nt, Homo sapiens
gauguccgguuuccuguga

SEQ ID NO: 529417 - RNA, 19 nt, Homo sapiens
ggagaaagacucaaugcau

SEQ ID NO: 529418 - RNA, 19 nt, Homo sapiens
gcgacaaacaccuucuuua

SEQ ID NO: 529419 - RNA, 19 nt, Homo sapiens
gaccacaaaugagcuaaga

SEQ ID NO: 529420 - RNA, 19 nt, Homo sapiens
guacagaaaguccacagaa

SEQ ID NO: 529421 - RNA, 19 nt, Homo sapiens
gacuggagcucaucugcaa

SEQ ID NO: 529422 - RNA, 19 nt, Homo sapiens
gcaaaaggccucuuguaaa

SEQ ID NO: 529423 - RNA, 19 nt, Homo sapiens
caaacaaggagcuggauga

SEQ ID NO: 529424 - RNA, 19 nt, Homo sapiens
gaaauuacagugccucucu

SEQ ID NO: 529425 - RNA, 19 nt, Homo sapiens
caaaaggccucuuguaaag

SEQ ID NO: 529426 - RNA, 19 nt, Homo sapiens
gagccaggauuuucauaua

SEQ ID NO: 529427 - RNA, 19 nt, Homo sapiens
uacagaaaguccacagaaa

SEQ ID NO: 529428 - RNA, 19 nt, Homo sapiens
cagacaaguucauuccauu

SEQ ID NO: 529429 - RNA, 19 nt, Homo sapiens
caaccgagaauuugaugaa

SEQ ID NO: 529430 - RNA, 19 nt, Homo sapiens
gaaaggaggcuggcaacau

SEQ ID NO: 529431 - RNA, 19 nt, Homo sapiens
gaaguuccaccaccaaaca

SEQ ID NO: 529432 - RNA, 19 nt, Homo sapiens
gaaccauguggauaacuuu

SEQ ID NO: 529433 - RNA, 19 nt, Homo sapiens
agcaagacguuauuugaaa

SEQ ID NO: 529434 - RNA, 19 nt, Homo sapiens
aaaugugccugugaaugua

SEQ ID NO: 529435 - RNA, 19 nt, Homo sapiens
agacaaguucauuccauua

SEQ ID NO: 529436 - RNA, 19 nt, Homo sapiens
ggagguguguauagaugug

SEQ ID NO: 529437 - RNA, 19 nt, Homo sapiens
cagaaaguccacagaaaug

SEQ ID NO: 529438 - RNA, 19 nt, Homo sapiens
ugaaccauguggauaacuu

SEQ ID NO: 529439 - RNA, 19 nt, Homo sapiens
gaacuagacagaaacucau

SEQ ID NO: 529440 - RNA, 19 nt, Homo sapiens
cagcaagacguuauuugaa

SEQ ID NO: 529441 - RNA, 19 nt, Homo sapiens
ucagcaagacguuauuuga

SEQ ID NO: 529442 - RNA, 19 nt, Homo sapiens
guacaagugucagcuaagg

SEQ ID NO: 529443 - RNA, 19 nt, Homo sapiens
aaaagaaccugccccagaa

SEQ ID NO: 529444 - RNA, 19 nt, Homo sapiens
gagaacaggccaaccucaa

SEQ ID NO: 529445 - RNA, 19 nt, Homo sapiens
ugaccaaacagccaagauu

SEQ ID NO: 529446 - RNA, 19 nt, Homo sapiens
guggguccaugcuaacaaa

SEQ ID NO: 529447 - RNA, 19 nt, Homo sapiens
guagaacugucugugaaca

SEQ ID NO: 529448 - RNA, 19 nt, Homo sapiens
gucguugugucccuucaua

SEQ ID NO: 529449 - RNA, 19 nt, Homo sapiens
gacaaguucauuccauuau

SEQ ID NO: 529450 - RNA, 19 nt, Homo sapiens
ugacaucuguggaccaaac

SEQ ID NO: 529451 - RNA, 19 nt, Homo sapiens
ugaagagaccugucagugu

SEQ ID NO: 529452 - RNA, 19 nt, Homo sapiens
gaacaggccaaccucaacu

SEQ ID NO: 529453 - RNA, 19 nt, Homo sapiens
cagaaaugcuuguuaaaag

SEQ ID NO: 529454 - RNA, 19 nt, Homo sapiens
caugacaucuguggaccaa

SEQ ID NO: 529455 - RNA, 19 nt, Homo sapiens
acucaugacuguacucuac

SEQ ID NO: 529456 - RNA, 19 nt, Homo sapiens
acagaaaguccacagaaau

SEQ ID NO: 529457 - RNA, 19 nt, Homo sapiens
uagcaacaacaauugguaa

SEQ ID NO: 529458 - RNA, 19 nt, Homo sapiens
ugacucaacagauggauuc

SEQ ID NO: 529459 - RNA, 19 nt, Homo sapiens
cgggagguguguauagaug

SEQ ID NO: 529460 - RNA, 19 nt, Homo sapiens
gcugcagcacauuauaaua

SEQ ID NO: 529461 - RNA, 19 nt, Homo sapiens
ccauguggauaacuuuaca

SEQ ID NO: 529462 - RNA, 19 nt, Homo sapiens
ccuuguggguccaugcuaa

SEQ ID NO: 529463 - RNA, 19 nt, Homo sapiens
cagaaacucaugccagugu

SEQ ID NO: 529464 - RNA, 19 nt, Homo sapiens
uuacagugccucucucuca

SEQ ID NO: 529465 - RNA, 19 nt, Homo sapiens
auacagagaucuugaaaag

SEQ ID NO: 529466 - RNA, 19 nt, Homo sapiens
ccucuugugauuucuuuaa

SEQ ID NO: 529467 - RNA, 19 nt, Homo sapiens
acagacaaguucauuccau

SEQ ID NO: 529468 - RNA, 19 nt, Homo sapiens
gagcaguuacggucugugu

SEQ ID NO: 529469 - RNA, 19 nt, Homo sapiens
gggccaaccgagaauuuga

SEQ ID NO: 529470 - RNA, 19 nt, Homo sapiens
ugucuuuccugaaccaugu

SEQ ID NO: 529471 - RNA, 19 nt, Homo sapiens
guugugucccuucauauug

SEQ ID NO: 529472 - RNA, 19 nt, Homo sapiens
gaaacucaugccagugugu

SEQ ID NO: 529473 - RNA, 19 nt, Homo sapiens
acaagugucagcuaaggaa

SEQ ID NO: 529474 - RNA, 19 nt, Homo sapiens
aaacaaggagcuggaugaa

SEQ ID NO: 529475 - RNA, 19 nt, Homo sapiens
gauguuuacagacaaguuc

SEQ ID NO: 529476 - RNA, 19 nt, Homo sapiens
gccgaugcaugucuaaacu

SEQ ID NO: 529477 - RNA, 19 nt, Homo sapiens
cacgggagguguguauaga

SEQ ID NO: 529478 - RNA, 19 nt, Homo sapiens
gcacauuauaauacagaga

SEQ ID NO: 529479 - RNA, 19 nt, Homo sapiens
gcacuugcugggcuucuuc

SEQ ID NO: 529480 - RNA, 19 nt, Homo sapiens
uggaaaagaccacaaauga

SEQ ID NO: 529481 - RNA, 19 nt, Homo sapiens
gcuggcaacauaacagaga

SEQ ID NO: 529482 - RNA, 19 nt, Homo sapiens
gaacucaugacuguacucu

SEQ ID NO: 529483 - RNA, 19 nt, Homo sapiens
agaacuagacagaaacuca

SEQ ID NO: 529484 - RNA, 19 nt, Homo sapiens
cacaaaugagcuaagauug

SEQ ID NO: 529485 - RNA, 19 nt, Homo sapiens
gaaaguccacagaaaugcu

SEQ ID NO: 529486 - RNA, 19 nt, Homo sapiens
gaaaaugugccugugaaug

SEQ ID NO: 529487 - RNA, 19 nt, Homo sapiens
guacucuacccagaauauu

SEQ ID NO: 529488 - RNA, 19 nt, Homo sapiens
uacagugccucucucucaa

SEQ ID NO: 529489 - RNA, 19 nt, Homo sapiens
cagcacauuauaauacaga

SEQ ID NO: 529490 - RNA, 19 nt, Homo sapiens
caacaacaauugguaaaac

SEQ ID NO: 529491 - RNA, 19 nt, Homo sapiens
caaagaacuagacagaaac

SEQ ID NO: 529492 - RNA, 19 nt, Homo sapiens
ccacgggagguguguauag

SEQ ID NO: 529493 - RNA, 19 nt, Homo sapiens
ugaagaagugugucguugu

SEQ ID NO: 529494 - RNA, 19 nt, Homo sapiens
aggaggagcuggagaauua

SEQ ID NO: 529495 - RNA, 19 nt, Homo sapiens
ccaagucgcugugaauuga

SEQ ID NO: 529496 - RNA, 19 nt, Homo sapiens
caugaaagcccucagauug

SEQ ID NO: 529497 - RNA, 19 nt, Homo sapiens
ggaaauaguuuugcuaaga

SEQ ID NO: 529498 - RNA, 19 nt, Homo sapiens
ucauugagcuguccaccaa

SEQ ID NO: 529499 - RNA, 19 nt, Homo sapiens
cgagauuucaguccaagua

SEQ ID NO: 529500 - RNA, 19 nt, Homo sapiens
ucgaggagguggaggagaa

SEQ ID NO: 529501 - RNA, 19 nt, Homo sapiens
ggaggaagaagcagcugaa

SEQ ID NO: 529502 - RNA, 19 nt, Homo sapiens
uuaauugugugaagugugu

SEQ ID NO: 529503 - RNA, 19 nt, Homo sapiens
uccaggaacugcgagauuu

SEQ ID NO: 529504 - RNA, 19 nt, Homo sapiens
ugaaagcccucagauuguc

SEQ ID NO: 529505 - RNA, 19 nt, Homo sapiens
gggaggaggacgaggugua

SEQ ID NO: 529506 - RNA, 19 nt, Homo sapiens
gacgaucgacagccucauu

SEQ ID NO: 529507 - RNA, 19 nt, Homo sapiens
gcaguuccaguuaauugug

SEQ ID NO: 529508 - RNA, 19 nt, Homo sapiens
ggcagccucuuggucauga

SEQ ID NO: 529509 - RNA, 19 nt, Homo sapiens
gaggaaauaguuuugcuaa

SEQ ID NO: 529510 - RNA, 19 nt, Homo sapiens
ggucaugaaagcccucaga

SEQ ID NO: 529511 - RNA, 19 nt, Homo sapiens
ccaguuaauugugugaagu

SEQ ID NO: 529512 - RNA, 19 nt, Homo sapiens
ucaugaaagcccucagauu

SEQ ID NO: 529513 - RNA, 19 nt, Homo sapiens
aagcaguuccaguuaauug

SEQ ID NO: 529514 - RNA, 19 nt, Homo sapiens
ggaggacgacgaggagaug

SEQ ID NO: 529515 - RNA, 19 nt, Homo sapiens
gcaggacgagggagagcuu

SEQ ID NO: 529516 - RNA, 19 nt, Homo sapiens
gaccugcugcuccaguauu

SEQ ID NO: 529517 - RNA, 19 nt, Homo sapiens
cggaccugcugcuccagua

SEQ ID NO: 529518 - RNA, 19 nt, Homo sapiens
uccuuucucuguuguaaau

SEQ ID NO: 529519 - RNA, 19 nt, Homo sapiens
cuucuuuccuuucucuguu

SEQ ID NO: 529520 - RNA, 19 nt, Homo sapiens
aaaagcaguuccaguuaau

SEQ ID NO: 529521 - RNA, 19 nt, Homo sapiens
gcccucagacuccggagaa

SEQ ID NO: 529522 - RNA, 19 nt, Homo sapiens
ccuccagccucuccaaguc

SEQ ID NO: 529523 - RNA, 19 nt, Homo sapiens
ggacgacgaggagauggau

SEQ ID NO: 529524 - RNA, 19 nt, Homo sapiens
ggaccugcugcuccaguau

SEQ ID NO: 529525 - RNA, 19 nt, Homo sapiens
gagauuucaguccaaguag

SEQ ID NO: 529526 - RNA, 19 nt, Homo sapiens
caguuccaguuaauugugu

SEQ ID NO: 529527 - RNA, 19 nt, Homo sapiens
gcaggaggagcuggagaau

SEQ ID NO: 529528 - RNA, 19 nt, Homo sapiens
gaggagcgagagagugcaa

SEQ ID NO: 529529 - RNA, 19 nt, Homo sapiens
ggaggaggacgagguguac

SEQ ID NO: 529530 - RNA, 19 nt, Homo sapiens
acaccuaggcgaggcauug

SEQ ID NO: 529531 - RNA, 19 nt, Homo sapiens
ucccgaaacccacaaguuc

SEQ ID NO: 529532 - RNA, 19 nt, Homo sapiens
ggaaggagauccaaacaua

SEQ ID NO: 529533 - RNA, 19 nt, Homo sapiens
gcacacaucuguaauccua

SEQ ID NO: 529534 - RNA, 19 nt, Homo sapiens
gaugggagauugaagauuu

SEQ ID NO: 529535 - RNA, 19 nt, Homo sapiens
gcaauacucuugucccaaa

SEQ ID NO: 529536 - RNA, 19 nt, Homo sapiens
ggaguagccuggacuguuu

SEQ ID NO: 529537 - RNA, 19 nt, Homo sapiens
ccagccagcuuuauuauuu

SEQ ID NO: 529538 - RNA, 19 nt, Homo sapiens
caggacagcuuguauguaa

SEQ ID NO: 529539 - RNA, 19 nt, Homo sapiens
gcccagaacuucaagauga

SEQ ID NO: 529540 - RNA, 19 nt, Homo sapiens
gaaacccuaucucuacuaa

SEQ ID NO: 529541 - RNA, 19 nt, Homo sapiens
ccaccacgcuggccaauuu

SEQ ID NO: 529542 - RNA, 19 nt, Homo sapiens
ugacauuccugauugauuu

SEQ ID NO: 529543 - RNA, 19 nt, Homo sapiens
guaaggagguuuauauaag

SEQ ID NO: 529544 - RNA, 19 nt, Homo sapiens
gaaaccucaucuccacuua

SEQ ID NO: 529545 - RNA, 19 nt, Homo sapiens
caccaugccuggcuaauuu

SEQ ID NO: 529546 - RNA, 19 nt, Homo sapiens
gcgcaugccuguaauccua

SEQ ID NO: 529547 - RNA, 19 nt, Homo sapiens
gaagaucauuggaguuuag

SEQ ID NO: 529548 - RNA, 19 nt, Homo sapiens
gagcugauaucgcaccauu

SEQ ID NO: 529549 - RNA, 19 nt, Homo sapiens
gagccaagaucacaccauu

SEQ ID NO: 529550 - RNA, 19 nt, Homo sapiens
ggauggagcucacucuugu

SEQ ID NO: 529551 - RNA, 19 nt, Homo sapiens
gagaacccgucuauacaaa

SEQ ID NO: 529552 - RNA, 19 nt, Homo sapiens
ggauugacauucuacaguu

SEQ ID NO: 529553 - RNA, 19 nt, Homo sapiens
gagaagaucauuggaguuu

SEQ ID NO: 529554 - RNA, 19 nt, Homo sapiens
gagaaaaucugcauguuug

SEQ ID NO: 529555 - RNA, 19 nt, Homo sapiens
gaaggagauccaaacauaa

SEQ ID NO: 529556 - RNA, 19 nt, Homo sapiens
ccaauggauucauggagua

SEQ ID NO: 529557 - RNA, 19 nt, Homo sapiens
gaaugagacacuccaguuu

SEQ ID NO: 529558 - RNA, 19 nt, Homo sapiens
caaauucaaugcuucuauc

SEQ ID NO: 529559 - RNA, 19 nt, Homo sapiens
gcucacgccuguaaucuca

SEQ ID NO: 529560 - RNA, 19 nt, Homo sapiens
uagucaagccugagaauua

SEQ ID NO: 529561 - RNA, 19 nt, Homo sapiens
guaagugguuaguauuuca

SEQ ID NO: 529562 - RNA, 19 nt, Homo sapiens
gcaagacccugccucaaaa

SEQ ID NO: 529563 - RNA, 19 nt, Homo sapiens
aaacuaggauugacauucu

SEQ ID NO: 529564 - RNA, 19 nt, Homo sapiens
ggaaaagacagaaaacuaa

SEQ ID NO: 529565 - RNA, 19 nt, Homo sapiens
gugaacaaaugucuuaaag

SEQ ID NO: 529566 - RNA, 19 nt, Homo sapiens
ccuguaaucucagcacuuu

SEQ ID NO: 529567 - RNA, 19 nt, Homo sapiens
uuucgaaucuugugaaugu

SEQ ID NO: 529568 - RNA, 19 nt, Homo sapiens
acaagucuuucuccucuuu

SEQ ID NO: 529569 - RNA, 19 nt, Homo sapiens
uggcaugcaucuuuaauuc

SEQ ID NO: 529570 - RNA, 19 nt, Homo sapiens
aaagaucccuauuagauac

SEQ ID NO: 529571 - RNA, 19 nt, Homo sapiens
guagagaaacauuuggaaa

SEQ ID NO: 529572 - RNA, 19 nt, Homo sapiens
acagugaacaaaugucuua

SEQ ID NO: 529573 - RNA, 19 nt, Homo sapiens
gaaauaggcaggguguguu

SEQ ID NO: 529574 - RNA, 19 nt, Homo sapiens
agagugaaauuccaucuca

SEQ ID NO: 529575 - RNA, 19 nt, Homo sapiens
gggcaaacaucacaaaaug

SEQ ID NO: 529576 - RNA, 19 nt, Homo sapiens
gguaagugguuaguauuuc

SEQ ID NO: 529577 - RNA, 19 nt, Homo sapiens
ggaaauaggcagggugugu

SEQ ID NO: 529578 - RNA, 19 nt, Homo sapiens
gaaguuccuauuucaaguu

SEQ ID NO: 529579 - RNA, 19 nt, Homo sapiens
ggaaacaagagugaaauuc

SEQ ID NO: 529580 - RNA, 19 nt, Homo sapiens
guucaugcuccucuuguua

SEQ ID NO: 529581 - RNA, 19 nt, Homo sapiens
gaucucugcucacuacaag

SEQ ID NO: 529582 - RNA, 19 nt, Homo sapiens
gcuagacuuagauucauua

SEQ ID NO: 529583 - RNA, 19 nt, Homo sapiens
uuccaagucucuucucuuu

SEQ ID NO: 529584 - RNA, 19 nt, Homo sapiens
guacggcccugaagaagac

SEQ ID NO: 529585 - RNA, 19 nt, Homo sapiens
ccuauuagauacacuucuu

SEQ ID NO: 529586 - RNA, 19 nt, Homo sapiens
cagcaauuauguugagaau

SEQ ID NO: 529587 - RNA, 19 nt, Homo sapiens
gauugacauucuacaguug

SEQ ID NO: 529588 - RNA, 19 nt, Homo sapiens
ggaauugcagcauaucguu

SEQ ID NO: 529589 - RNA, 19 nt, Homo sapiens
aaacaagagugaaauucca

SEQ ID NO: 529590 - RNA, 19 nt, Homo sapiens
aaccucaucuccacuuaaa

SEQ ID NO: 529591 - RNA, 19 nt, Homo sapiens
caaaucagagugaagugaa

SEQ ID NO: 529592 - RNA, 19 nt, Homo sapiens
ggcagugagucaugaguau

SEQ ID NO: 529593 - RNA, 19 nt, Homo sapiens
ucauuggaguuuaggaauu

SEQ ID NO: 529594 - RNA, 19 nt, Homo sapiens
aaauaggcaccauugcuua

SEQ ID NO: 529595 - RNA, 19 nt, Homo sapiens
ggugaaacccuaucucuac

SEQ ID NO: 529596 - RNA, 19 nt, Homo sapiens
gaaaccccgucucuauuaa

SEQ ID NO: 529597 - RNA, 19 nt, Homo sapiens
gaccaaggcggauggauca

SEQ ID NO: 529598 - RNA, 19 nt, Homo sapiens
gaucauuggaguuuaggaa

SEQ ID NO: 529599 - RNA, 19 nt, Homo sapiens
gaauugcagcauaucguuu

SEQ ID NO: 529600 - RNA, 19 nt, Homo sapiens
aaggguaagugguuaguau

SEQ ID NO: 529601 - RNA, 19 nt, Homo sapiens
cuuaagagacggugaaguu

SEQ ID NO: 529602 - RNA, 19 nt, Homo sapiens
gcacagaaaauacgagaaa

SEQ ID NO: 529603 - RNA, 19 nt, Homo sapiens
gguccacucuuguugaagu

SEQ ID NO: 529604 - RNA, 19 nt, Homo sapiens
gaaagugcuuagagguucu

SEQ ID NO: 529605 - RNA, 19 nt, Homo sapiens
guuaguauuucaccagcaa

SEQ ID NO: 529606 - RNA, 19 nt, Homo sapiens
aaaccuguagcaugaauaa

SEQ ID NO: 529607 - RNA, 19 nt, Homo sapiens
gcaggagaauggcaugaac

SEQ ID NO: 529608 - RNA, 19 nt, Homo sapiens
gcugauaucgcaccauugu

SEQ ID NO: 529609 - RNA, 19 nt, Homo sapiens
cauuggaguuuaggaauug

SEQ ID NO: 529610 - RNA, 19 nt, Homo sapiens
agaagaucauuggaguuua

SEQ ID NO: 529611 - RNA, 19 nt, Homo sapiens
cuuauaggcuagacuuaga

SEQ ID NO: 529612 - RNA, 19 nt, Homo sapiens
gccaguguauacucugaaa

SEQ ID NO: 529613 - RNA, 19 nt, Homo sapiens
auuaaauggugcugaguaa

SEQ ID NO: 529614 - RNA, 19 nt, Homo sapiens
cgaaucuugugaauguauu

SEQ ID NO: 529615 - RNA, 19 nt, Homo sapiens
gggaaacaagagugaaauu

SEQ ID NO: 529616 - RNA, 19 nt, Homo sapiens
ugaaugagacacuccaguu

SEQ ID NO: 529617 - RNA, 19 nt, Homo sapiens
ugaugagucuugaucuaga

SEQ ID NO: 529618 - RNA, 19 nt, Homo sapiens
gaugagucuugaucuagau

SEQ ID NO: 529619 - RNA, 19 nt, Homo sapiens
uaguugagauuguacuguu

SEQ ID NO: 529620 - RNA, 19 nt, Homo sapiens
ugcagcauaucguuuaauu

SEQ ID NO: 529621 - RNA, 19 nt, Homo sapiens
ggguaagugguuaguauuu

SEQ ID NO: 529622 - RNA, 19 nt, Homo sapiens
ccaagucucuucucuuucc

SEQ ID NO: 529623 - RNA, 19 nt, Homo sapiens
acuaggcgcuucucucuca

SEQ ID NO: 529624 - RNA, 19 nt, Homo sapiens
ccgcuugaguacuguguuu

SEQ ID NO: 529625 - RNA, 19 nt, Homo sapiens
gaaacaagagugaaauucc

SEQ ID NO: 529626 - RNA, 19 nt, Homo sapiens
cguccagccagcuuuauua

SEQ ID NO: 529627 - RNA, 19 nt, Homo sapiens
gacaguguuucgccauguu

SEQ ID NO: 529628 - RNA, 19 nt, Homo sapiens
cacguaauccuccugagua

SEQ ID NO: 529629 - RNA, 19 nt, Homo sapiens
gcagcauaucguuuaauuu

SEQ ID NO: 529630 - RNA, 19 nt, Homo sapiens
aggagaaggugguggcauu

SEQ ID NO: 529631 - RNA, 19 nt, Homo sapiens
ccaaaaggguaagugguua

SEQ ID NO: 529632 - RNA, 19 nt, Homo sapiens
ggaagaggaugauguguuc

SEQ ID NO: 529633 - RNA, 19 nt, Homo sapiens
ccacagagaucccugacuu

SEQ ID NO: 529634 - RNA, 19 nt, Homo sapiens
guagagauguccuggaaga

SEQ ID NO: 529635 - RNA, 19 nt, Homo sapiens
gcacaggaauaccucaaga

SEQ ID NO: 529636 - RNA, 19 nt, Homo sapiens
caaaggcucucucaacauc

SEQ ID NO: 529637 - RNA, 19 nt, Homo sapiens
gcaguacccuacccugauu

SEQ ID NO: 529638 - RNA, 19 nt, Homo sapiens
gaacaccuguccauugaag

SEQ ID NO: 529639 - RNA, 19 nt, Homo sapiens
ggacggagagaaugaauug

SEQ ID NO: 529640 - RNA, 19 nt, Homo sapiens
ccacacagauggaugacuu

SEQ ID NO: 529641 - RNA, 19 nt, Homo sapiens
ccaaugagcaggagaagaa

SEQ ID NO: 529642 - RNA, 19 nt, Homo sapiens
cgugguagcuggagaggua

SEQ ID NO: 529643 - RNA, 19 nt, Homo sapiens
aagaguagcugugguugua

SEQ ID NO: 529644 - RNA, 19 nt, Homo sapiens
ggaguaacaccaaauccua

SEQ ID NO: 529645 - RNA, 19 nt, Homo sapiens
gaugauguguuccuacuag

SEQ ID NO: 529646 - RNA, 19 nt, Homo sapiens
gaaauuacagcaucagcuu

SEQ ID NO: 529647 - RNA, 19 nt, Homo sapiens
ggagccaccucaucuuaug

SEQ ID NO: 529648 - RNA, 19 nt, Homo sapiens
acucaaggcugcacucaaa

SEQ ID NO: 529649 - RNA, 19 nt, Homo sapiens
gagauguccuggaagaguu

SEQ ID NO: 529650 - RNA, 19 nt, Homo sapiens
gcaugacucuggccaagga

SEQ ID NO: 529651 - RNA, 19 nt, Homo sapiens
ccaagagacuacaggaaga

SEQ ID NO: 529652 - RNA, 19 nt, Homo sapiens
caauuccaaugaugucuuu

SEQ ID NO: 529653 - RNA, 19 nt, Homo sapiens
gaggaacaccuguccauug

SEQ ID NO: 529654 - RNA, 19 nt, Homo sapiens
ccagcagccuguccuauga

SEQ ID NO: 529655 - RNA, 19 nt, Homo sapiens
gcugagcgcccaagucaaa

SEQ ID NO: 529656 - RNA, 19 nt, Homo sapiens
gaguagcugugguuguaaa

SEQ ID NO: 529657 - RNA, 19 nt, Homo sapiens
caucuuauguccaucuuca

SEQ ID NO: 529658 - RNA, 19 nt, Homo sapiens
gcaaggagccaccucaucu

SEQ ID NO: 529659 - RNA, 19 nt, Homo sapiens
agagaucccugacuucaau

SEQ ID NO: 529660 - RNA, 19 nt, Homo sapiens
gauauuaguccuacaccaa

SEQ ID NO: 529661 - RNA, 19 nt, Homo sapiens
cagccaagaugaaauuaca

SEQ ID NO: 529662 - RNA, 19 nt, Homo sapiens
gucaaaggcucucucaaca

SEQ ID NO: 529663 - RNA, 19 nt, Homo sapiens
uaauguaccuauuccuuca

SEQ ID NO: 529664 - RNA, 19 nt, Homo sapiens
gagaagaguagcugugguu

SEQ ID NO: 529665 - RNA, 19 nt, Homo sapiens
aggaacaccuguccauuga

SEQ ID NO: 529666 - RNA, 19 nt, Homo sapiens
gaagugaaauuuugcagau

SEQ ID NO: 529667 - RNA, 19 nt, Homo sapiens
caaguggaguaacaccaaa

SEQ ID NO: 529668 - RNA, 19 nt, Homo sapiens
gaagaucuacguguggaaa

SEQ ID NO: 529669 - RNA, 19 nt, Homo sapiens
gaaagaugauaccccaaaa

SEQ ID NO: 529670 - RNA, 19 nt, Homo sapiens
caaucaggaugacuuggaa

SEQ ID NO: 529671 - RNA, 19 nt, Homo sapiens
gugcagguguggcgcauug

SEQ ID NO: 529672 - RNA, 19 nt, Homo sapiens
caacaacaccaaggccuuu

SEQ ID NO: 529673 - RNA, 19 nt, Homo sapiens
gacccagucuugcugcuau

SEQ ID NO: 529674 - RNA, 19 nt, Homo sapiens
guaccuauuccuucagaaa

SEQ ID NO: 529675 - RNA, 19 nt, Homo sapiens
ggagauggccaagaugguu

SEQ ID NO: 529676 - RNA, 19 nt, Homo sapiens
agcagaagaugguagauga

SEQ ID NO: 529677 - RNA, 19 nt, Homo sapiens
aaacuucuguggcaaaugc

SEQ ID NO: 529678 - RNA, 19 nt, Homo sapiens
cuacaccaauugaagugaa

SEQ ID NO: 529679 - RNA, 19 nt, Homo sapiens
gcuaacagcaaccucaguu

SEQ ID NO: 529680 - RNA, 19 nt, Homo sapiens
gagaagaagggagccauga

SEQ ID NO: 529681 - RNA, 19 nt, Homo sapiens
ggagggcgcaccuauguag

SEQ ID NO: 529682 - RNA, 19 nt, Homo sapiens
gaucacugcugaggucaca

SEQ ID NO: 529683 - RNA, 19 nt, Homo sapiens
caaccacugcacaggaaua

SEQ ID NO: 529684 - RNA, 19 nt, Homo sapiens
uggagcagcuagugaacaa

SEQ ID NO: 529685 - RNA, 19 nt, Homo sapiens
ccaacgaggaggagaagaa

SEQ ID NO: 529686 - RNA, 19 nt, Homo sapiens
ccuaugacauccacuacug

SEQ ID NO: 529687 - RNA, 19 nt, Homo sapiens
caacaaaaccucaagaaag

SEQ ID NO: 529688 - RNA, 19 nt, Homo sapiens
ggaacuggcgccaacaaca

SEQ ID NO: 529689 - RNA, 19 nt, Homo sapiens
aggcugcacucaaacugua

SEQ ID NO: 529690 - RNA, 19 nt, Homo sapiens
ugaagcacguggagaccaa

SEQ ID NO: 529691 - RNA, 19 nt, Homo sapiens
caaaguggacguguucaau

SEQ ID NO: 529692 - RNA, 19 nt, Homo sapiens
gaagaaaaccuggucauca

SEQ ID NO: 529693 - RNA, 19 nt, Homo sapiens
gaagaguagcugugguugu

SEQ ID NO: 529694 - RNA, 19 nt, Homo sapiens
aacaaaaccucaagaaaga

SEQ ID NO: 529695 - RNA, 19 nt, Homo sapiens
aaggagccaccucaucuua

SEQ ID NO: 529696 - RNA, 19 nt, Homo sapiens
ggaggaacaccuguccauu

SEQ ID NO: 529697 - RNA, 19 nt, Homo sapiens
gcaggagccagccaacuuc

SEQ ID NO: 529698 - RNA, 19 nt, Homo sapiens
agguggaggugcagaauga

SEQ ID NO: 529699 - RNA, 19 nt, Homo sapiens
guggacguguucaaugcua

SEQ ID NO: 529700 - RNA, 19 nt, Homo sapiens
gaguaacaccaaauccuau

SEQ ID NO: 529701 - RNA, 19 nt, Homo sapiens
gauguguuccuacuagaug

SEQ ID NO: 529702 - RNA, 19 nt, Homo sapiens
gaccucaggccuaggcaaa

SEQ ID NO: 529703 - RNA, 19 nt, Homo sapiens
gcaacaaaaccucaagaaa

SEQ ID NO: 529704 - RNA, 19 nt, Homo sapiens
acucaggccuuugggauga

SEQ ID NO: 529705 - RNA, 19 nt, Homo sapiens
ggccagccaagaugaaauu

SEQ ID NO: 529706 - RNA, 19 nt, Homo sapiens
gcucuacaccuaccucauc

SEQ ID NO: 529707 - RNA, 19 nt, Homo sapiens
gaaagggaagaaagccaau

SEQ ID NO: 529708 - RNA, 19 nt, Homo sapiens
ugauggaggugaugaacca

SEQ ID NO: 529709 - RNA, 19 nt, Homo sapiens
agguagagauguccuggaa

SEQ ID NO: 529710 - RNA, 19 nt, Homo sapiens
caggucuucuucuggauug

SEQ ID NO: 529711 - RNA, 19 nt, Homo sapiens
ggcaggagccagccaacuu

SEQ ID NO: 529712 - RNA, 19 nt, Homo sapiens
uauuaguccuacaccaauu

SEQ ID NO: 529713 - RNA, 19 nt, Homo sapiens
cauccuggcuauccacaag

SEQ ID NO: 529714 - RNA, 19 nt, Homo sapiens
caagagacuacaggaagaa

SEQ ID NO: 529715 - RNA, 19 nt, Homo sapiens
caccucaucuuauguccau

SEQ ID NO: 529716 - RNA, 19 nt, Homo sapiens
agauuucacucaggccuuu

SEQ ID NO: 529717 - RNA, 19 nt, Homo sapiens
guaacaccaaauccuauga

SEQ ID NO: 529718 - RNA, 19 nt, Homo sapiens
cagucuugcugcuaucuau

SEQ ID NO: 529719 - RNA, 19 nt, Homo sapiens
gcaccucccgaacuaacaa

SEQ ID NO: 529720 - RNA, 19 nt, Homo sapiens
uccagaggcugcugcaugu

SEQ ID NO: 529721 - RNA, 19 nt, Homo sapiens
gaucgaggccaugcagaug

SEQ ID NO: 529722 - RNA, 19 nt, Homo sapiens
ucacgaggacuguuacauc

SEQ ID NO: 529723 - RNA, 19 nt, Homo sapiens
uagcugugguuguaaagca

SEQ ID NO: 529724 - RNA, 19 nt, Homo sapiens
aaauuacagcaucagcuua

SEQ ID NO: 529725 - RNA, 19 nt, Homo sapiens
uucagcagcucuuccagaa

SEQ ID NO: 529726 - RNA, 19 nt, Homo sapiens
caucaaagccaagcaguac

SEQ ID NO: 529727 - RNA, 19 nt, Homo sapiens
uaacagcaaccucaguucu

SEQ ID NO: 529728 - RNA, 19 nt, Homo sapiens
aaaguggacguguucaaug

SEQ ID NO: 529729 - RNA, 19 nt, Homo sapiens
ggcggagucuggcaaccuu

SEQ ID NO: 529730 - RNA, 19 nt, Homo sapiens
gaacuggcgccaacaacac

SEQ ID NO: 529731 - RNA, 19 nt, Homo sapiens
gggcaagaggaacguggua

SEQ ID NO: 529732 - RNA, 19 nt, Homo sapiens
gagcaggacugauugaauu

SEQ ID NO: 529733 - RNA, 19 nt, Homo sapiens
gcgcggagcugucuaguga

SEQ ID NO: 529734 - RNA, 19 nt, Homo sapiens
gaacaucucuuucaaugac

SEQ ID NO: 529735 - RNA, 19 nt, Homo sapiens
gaaggcaccugacuuugug

SEQ ID NO: 529736 - RNA, 19 nt, Homo sapiens
cgaaucaccuccuguguug

SEQ ID NO: 529737 - RNA, 19 nt, Homo sapiens
ggcaacagcuggaaacaga

SEQ ID NO: 529738 - RNA, 19 nt, Homo sapiens
caagaaggcaccugacuuu

SEQ ID NO: 529739 - RNA, 19 nt, Homo sapiens
gcucaaagauaaugcuaug

SEQ ID NO: 529740 - RNA, 19 nt, Homo sapiens
caaggaggaugaaguugaa

SEQ ID NO: 529741 - RNA, 19 nt, Homo sapiens
ggaaauguauggaaucaac

SEQ ID NO: 529742 - RNA, 19 nt, Homo sapiens
caaagauaaugcuauguug

SEQ ID NO: 529743 - RNA, 19 nt, Homo sapiens
gcaaggaggaugaaguuga

SEQ ID NO: 529744 - RNA, 19 nt, Homo sapiens
cguguaaacaggauuauua

SEQ ID NO: 529745 - RNA, 19 nt, Homo sapiens
gaaaaugccuguaaagucu

SEQ ID NO: 529746 - RNA, 19 nt, Homo sapiens
ggcugaagcuggauaagaa

SEQ ID NO: 529747 - RNA, 19 nt, Homo sapiens
gaucccaguuccuuuagaa

SEQ ID NO: 529748 - RNA, 19 nt, Homo sapiens
ccaaagaagcccaggauga

SEQ ID NO: 529749 - RNA, 19 nt, Homo sapiens
gugggaugcucaaagauaa

SEQ ID NO: 529750 - RNA, 19 nt, Homo sapiens
gaggaggacacuuggauuu

SEQ ID NO: 529751 - RNA, 19 nt, Homo sapiens
ugaaggauccaucuuugua

SEQ ID NO: 529752 - RNA, 19 nt, Homo sapiens
acaaagaagugcacaaguc

SEQ ID NO: 529753 - RNA, 19 nt, Homo sapiens
acaagagucagcaucauua

SEQ ID NO: 529754 - RNA, 19 nt, Homo sapiens
ggacaucacccagaaacuu

SEQ ID NO: 529755 - RNA, 19 nt, Homo sapiens
gcagagagcacagugauca

SEQ ID NO: 529756 - RNA, 19 nt, Homo sapiens
caaagaaggcagagagaga

SEQ ID NO: 529757 - RNA, 19 nt, Homo sapiens
gcccuuggacugaauauuu

SEQ ID NO: 529758 - RNA, 19 nt, Homo sapiens
ggauccaucuuuguauauu

SEQ ID NO: 529759 - RNA, 19 nt, Homo sapiens
uaugaaggauccaucuuug

SEQ ID NO: 529760 - RNA, 19 nt, Homo sapiens
cgaggauacucaccagaaa

SEQ ID NO: 529761 - RNA, 19 nt, Homo sapiens
ggacugaauauuuaugaga

SEQ ID NO: 529762 - RNA, 19 nt, Homo sapiens
aaggauccaucuuuguaua

SEQ ID NO: 529763 - RNA, 19 nt, Homo sapiens
uguaaagucugaguaagaa

SEQ ID NO: 529764 - RNA, 19 nt, Homo sapiens
ucagaucccaguuccuuua

SEQ ID NO: 529765 - RNA, 19 nt, Homo sapiens
gaaggauccaucuuuguau

SEQ ID NO: 529766 - RNA, 19 nt, Homo sapiens
caagauugcccuccuggaa

SEQ ID NO: 529767 - RNA, 19 nt, Homo sapiens
ggagugaaaucaggaacau

SEQ ID NO: 529768 - RNA, 19 nt, Homo sapiens
aggaacaucucuuucaaug

SEQ ID NO: 529769 - RNA, 19 nt, Homo sapiens
ucaggaacaucucuuucaa

SEQ ID NO: 529770 - RNA, 19 nt, Homo sapiens
aagauuggcuuuccuugga

SEQ ID NO: 529771 - RNA, 19 nt, Homo sapiens
cccuuggacugaauauuua

SEQ ID NO: 529772 - RNA, 19 nt, Homo sapiens
uuaaacccaucgacaagaa

SEQ ID NO: 529773 - RNA, 19 nt, Homo sapiens
gacaucacccagaaacuuu

SEQ ID NO: 529774 - RNA, 19 nt, Homo sapiens
gaucaggugguaaagacua

SEQ ID NO: 529775 - RNA, 19 nt, Homo sapiens
gcugggagcaggacugauu

SEQ ID NO: 529776 - RNA, 19 nt, Homo sapiens
ccaaucaauguccgaguua

SEQ ID NO: 529777 - RNA, 19 nt, Homo sapiens
ucacugaggcagagaagaa

SEQ ID NO: 529778 - RNA, 19 nt, Homo sapiens
gcgcaaggaggaugaaguu

SEQ ID NO: 529779 - RNA, 19 nt, Homo sapiens
uggaauaccugaagauugc

SEQ ID NO: 529780 - RNA, 19 nt, Homo sapiens
guucuacccugaagaugug

SEQ ID NO: 529781 - RNA, 19 nt, Homo sapiens
ccgcagacaugaaauaaaa

SEQ ID NO: 529782 - RNA, 19 nt, Homo sapiens
gauacaagagucagcauca

SEQ ID NO: 529783 - RNA, 19 nt, Homo sapiens
ccuagaggcugaccguaug

SEQ ID NO: 529784 - RNA, 19 nt, Homo sapiens
ggacuacaacaaagaagug

SEQ ID NO: 529785 - RNA, 19 nt, Homo sapiens
gcaauccagccaaauacaa

SEQ ID NO: 529786 - RNA, 19 nt, Homo sapiens
aauggacuaugcacacuuu

SEQ ID NO: 529787 - RNA, 19 nt, Homo sapiens
ggaaauugagucugaagca

SEQ ID NO: 529788 - RNA, 19 nt, Homo sapiens
uggcaggacuuccaucugu

SEQ ID NO: 529789 - RNA, 19 nt, Homo sapiens
caagagucagcaucauuaa

SEQ ID NO: 529790 - RNA, 19 nt, Homo sapiens
gacaggcgguggaucagau

SEQ ID NO: 529791 - RNA, 19 nt, Homo sapiens
ucuaaaccauggcacuuga

SEQ ID NO: 529792 - RNA, 19 nt, Homo sapiens
caugcuggccugugugaua

SEQ ID NO: 529793 - RNA, 19 nt, Homo sapiens
ucuaggaacucccucagau

SEQ ID NO: 529794 - RNA, 19 nt, Homo sapiens
gggaggagaagcaucagaa

SEQ ID NO: 529795 - RNA, 19 nt, Homo sapiens
gaaaucaggaacaucucuu

SEQ ID NO: 529796 - RNA, 19 nt, Homo sapiens
caacaaagaagugcacaag

SEQ ID NO: 529797 - RNA, 19 nt, Homo sapiens
ucacguguaaacaggauua

SEQ ID NO: 529798 - RNA, 19 nt, Homo sapiens
aggaggagcuggagagaca

SEQ ID NO: 529799 - RNA, 19 nt, Homo sapiens
ggaacaucucuuucaauga

SEQ ID NO: 529800 - RNA, 19 nt, Homo sapiens
guacuuuggccuccacuau

SEQ ID NO: 529801 - RNA, 19 nt, Homo sapiens
ggacuaugcacacuuuuaa

SEQ ID NO: 529802 - RNA, 19 nt, Homo sapiens
ggaaaguuuuguucuguau

SEQ ID NO: 529803 - RNA, 19 nt, Homo sapiens
ggaggaggacacuuggauu

SEQ ID NO: 529804 - RNA, 19 nt, Homo sapiens
ggagcaggacugauugaau

SEQ ID NO: 529805 - RNA, 19 nt, Homo sapiens
auaagaggacccacaauga

SEQ ID NO: 529806 - RNA, 19 nt, Homo sapiens
gugccauacuuguucugua

SEQ ID NO: 529807 - RNA, 19 nt, Homo sapiens
cgaguucgaggcccuguaa

SEQ ID NO: 529808 - RNA, 19 nt, Homo sapiens
cgugggaugcucaaagaua

SEQ ID NO: 529809 - RNA, 19 nt, Homo sapiens
caaagaagugcacaagucu

SEQ ID NO: 529810 - RNA, 19 nt, Homo sapiens
cuaugaaggauccaucuuu

SEQ ID NO: 529811 - RNA, 19 nt, Homo sapiens
gcaccugacuuuguguuuu

SEQ ID NO: 529812 - RNA, 19 nt, Homo sapiens
gcaggacuaugaggagaag

SEQ ID NO: 529813 - RNA, 19 nt, Homo sapiens
caacagcuggaaacagaga

SEQ ID NO: 529814 - RNA, 19 nt, Homo sapiens
caccugacuuuguguuuua

SEQ ID NO: 529815 - RNA, 19 nt, Homo sapiens
uaaguuaaccccaaagauu

SEQ ID NO: 529816 - RNA, 19 nt, Homo sapiens
caaguucuacccugaagau

SEQ ID NO: 529817 - RNA, 19 nt, Homo sapiens
cuauguggauaauaaagga

SEQ ID NO: 529818 - RNA, 19 nt, Homo sapiens
aauaagaggacccacaaug

SEQ ID NO: 529819 - RNA, 19 nt, Homo sapiens
gaaagaugauaaguuaacc

SEQ ID NO: 529820 - RNA, 19 nt, Homo sapiens
ggaaaaugccuguaaaguc

SEQ ID NO: 529821 - RNA, 19 nt, Homo sapiens
gugccaagcaggccugauu

SEQ ID NO: 529822 - RNA, 19 nt, Homo sapiens
caaagaagcccaggaugac

SEQ ID NO: 529823 - RNA, 19 nt, Homo sapiens
agauugcccuccuggaaga

SEQ ID NO: 529824 - RNA, 19 nt, Homo sapiens
gagaagaaaaggagagaaa

SEQ ID NO: 529825 - RNA, 19 nt, Homo sapiens
gcuggaaacagagaagaaa

SEQ ID NO: 529826 - RNA, 19 nt, Homo sapiens
gagcggcugaucccucaaa

SEQ ID NO: 529827 - RNA, 19 nt, Homo sapiens
ucuguuugcuuguguuugu

SEQ ID NO: 529828 - RNA, 19 nt, Homo sapiens
aggagaagcgcaucacuga

SEQ ID NO: 529829 - RNA, 19 nt, Homo sapiens
ucuaaggguucugcucuga

SEQ ID NO: 529830 - RNA, 19 nt, Homo sapiens
gacaaagaaggcagagaga

SEQ ID NO: 529831 - RNA, 19 nt, Homo sapiens
ucauuaaacccaucgacaa

SEQ ID NO: 529832 - RNA, 19 nt, Homo sapiens
ggaaauggcucgucaccuu

SEQ ID NO: 529833 - RNA, 19 nt, Homo sapiens
caagauagauuuggaauag

SEQ ID NO: 529834 - RNA, 19 nt, Homo sapiens
ugaagaaacuccacgaaga

SEQ ID NO: 529835 - RNA, 19 nt, Homo sapiens
gcagaagaaugguacaaau

SEQ ID NO: 529836 - RNA, 19 nt, Homo sapiens
caacgaaacuucucagcau

SEQ ID NO: 529837 - RNA, 19 nt, Homo sapiens
uaagauggcccuugacauu

SEQ ID NO: 529838 - RNA, 19 nt, Homo sapiens
ugaaguggaugcccuuaaa

SEQ ID NO: 529839 - RNA, 19 nt, Homo sapiens
gaaaucccauaucuuaaag

SEQ ID NO: 529840 - RNA, 19 nt, Homo sapiens
ggacauuccugauuaagac

SEQ ID NO: 529841 - RNA, 19 nt, Homo sapiens
caagaccugcucaauguua

SEQ ID NO: 529842 - RNA, 19 nt, Homo sapiens
ccaaaucgauguggauguu

SEQ ID NO: 529843 - RNA, 19 nt, Homo sapiens
ggaacagcauguccaaauc

SEQ ID NO: 529844 - RNA, 19 nt, Homo sapiens
gcaagauagauuuggaaua

SEQ ID NO: 529845 - RNA, 19 nt, Homo sapiens
gagggaaacuaaucuggau

SEQ ID NO: 529846 - RNA, 19 nt, Homo sapiens
ccagaugcgugaaauggaa

SEQ ID NO: 529847 - RNA, 19 nt, Homo sapiens
ucacgaugaccuugaauaa

SEQ ID NO: 529848 - RNA, 19 nt, Homo sapiens
caaguuugcugaccucucu

SEQ ID NO: 529849 - RNA, 19 nt, Homo sapiens
acauugagauugccaccua

SEQ ID NO: 529850 - RNA, 19 nt, Homo sapiens
gaaacuccacgaagaggaa

SEQ ID NO: 529851 - RNA, 19 nt, Homo sapiens
gaagaaacuccacgaagag

SEQ ID NO: 529852 - RNA, 19 nt, Homo sapiens
gacaggauguugacaaugc

SEQ ID NO: 529853 - RNA, 19 nt, Homo sapiens
uuaagacgguugaaacuag

SEQ ID NO: 529854 - RNA, 19 nt, Homo sapiens
caaagcaggaguccacuga

SEQ ID NO: 529855 - RNA, 19 nt, Homo sapiens
gaagaaugguacaaaucca

SEQ ID NO: 529856 - RNA, 19 nt, Homo sapiens
gaacuuugccguugaagcu

SEQ ID NO: 529857 - RNA, 19 nt, Homo sapiens
gaaauggaagagaacuuug

SEQ ID NO: 529858 - RNA, 19 nt, Homo sapiens
caagugccuuucugcaguu

SEQ ID NO: 529859 - RNA, 19 nt, Homo sapiens
uaagacgguugaaacuaga

SEQ ID NO: 529860 - RNA, 19 nt, Homo sapiens
accaagaccugcucaaugu

SEQ ID NO: 529861 - RNA, 19 nt, Homo sapiens
ggacagguuaucaacgaaa

SEQ ID NO: 529862 - RNA, 19 nt, Homo sapiens
ugaaauggaagagaacuuu

SEQ ID NO: 529863 - RNA, 19 nt, Homo sapiens
gcaggaggcagaagaaugg

SEQ ID NO: 529864 - RNA, 19 nt, Homo sapiens
ccaacuacaucgacaaggu

SEQ ID NO: 529865 - RNA, 19 nt, Homo sapiens
agauagauuuggaauagga

SEQ ID NO: 529866 - RNA, 19 nt, Homo sapiens
guacgucagcaauaugaaa

SEQ ID NO: 529867 - RNA, 19 nt, Homo sapiens
cagacaggauguugacaau

SEQ ID NO: 529868 - RNA, 19 nt, Homo sapiens
gaaaacacccugcaaucuu

SEQ ID NO: 529869 - RNA, 19 nt, Homo sapiens
gguugaaacuagagaugga

SEQ ID NO: 529870 - RNA, 19 nt, Homo sapiens
agauggcccuugacauuga

SEQ ID NO: 529871 - RNA, 19 nt, Homo sapiens
aaaacacccugcaaucuuu

SEQ ID NO: 529872 - RNA, 19 nt, Homo sapiens
aguggcaggcgauauauua

SEQ ID NO: 529873 - RNA, 19 nt, Homo sapiens
gagauggacagguuaucaa

SEQ ID NO: 529874 - RNA, 19 nt, Homo sapiens
gaauaugaaggaggaaaug

SEQ ID NO: 529875 - RNA, 19 nt, Homo sapiens
cguugaagcugcuaacuac

SEQ ID NO: 529876 - RNA, 19 nt, Homo sapiens
gaacagcauguccaaaucg

SEQ ID NO: 529877 - RNA, 19 nt, Homo sapiens
acgaugaccuugaauaaaa

SEQ ID NO: 529878 - RNA, 19 nt, Homo sapiens
gcugcuaacuaccaagaca

SEQ ID NO: 529879 - RNA, 19 nt, Homo sapiens
aagagaacuuugccguuga

SEQ ID NO: 529880 - RNA, 19 nt, Homo sapiens
uggcacgucuugaccuuga

SEQ ID NO: 529881 - RNA, 19 nt, Homo sapiens
gaaauugcaggaggagaug

SEQ ID NO: 529882 - RNA, 19 nt, Homo sapiens
uaacuaccaagacacuauu

SEQ ID NO: 529883 - RNA, 19 nt, Homo sapiens
agagaacuuugccguugaa

SEQ ID NO: 529884 - RNA, 19 nt, Homo sapiens
ccagcuaaccaacgacaaa

SEQ ID NO: 529885 - RNA, 19 nt, Homo sapiens
aacuagagauggacagguu

SEQ ID NO: 529886 - RNA, 19 nt, Homo sapiens
caggagcgcaagauagauu

SEQ ID NO: 529887 - RNA, 19 nt, Homo sapiens
gaaccugagggaaacuaau

SEQ ID NO: 529888 - RNA, 19 nt, Homo sapiens
aagaccugcucaauguuaa

SEQ ID NO: 529889 - RNA, 19 nt, Homo sapiens
ugaagcugcuaacuaccaa

SEQ ID NO: 529890 - RNA, 19 nt, Homo sapiens
aggagaugcuucagagaga

SEQ ID NO: 529891 - RNA, 19 nt, Homo sapiens
cagaagaaugguacaaauc

SEQ ID NO: 529892 - RNA, 19 nt, Homo sapiens
gaacgcaaaguggaaucuu

SEQ ID NO: 529893 - RNA, 19 nt, Homo sapiens
aaaucgauguggauguuuc

SEQ ID NO: 529894 - RNA, 19 nt, Homo sapiens
gaaguggaugcccuuaaag

SEQ ID NO: 529895 - RNA, 19 nt, Homo sapiens
uauauuacccaggcaagaa

SEQ ID NO: 529896 - RNA, 19 nt, Homo sapiens
ggcagaagaaugguacaaa

SEQ ID NO: 529897 - RNA, 19 nt, Homo sapiens
uaccaagaccugcucaaug

SEQ ID NO: 529898 - RNA, 19 nt, Homo sapiens
gcaggaguccacugaguac

SEQ ID NO: 529899 - RNA, 19 nt, Homo sapiens
gcgcaagauagauuuggaa

SEQ ID NO: 529900 - RNA, 19 nt, Homo sapiens
gauuaagacgguugaaacu

SEQ ID NO: 529901 - RNA, 19 nt, Homo sapiens
aagcaggaguccacugagu

SEQ ID NO: 529902 - RNA, 19 nt, Homo sapiens
cuaacuaccaagacacuau

SEQ ID NO: 529903 - RNA, 19 nt, Homo sapiens
ugcgugaaauggaagagaa

SEQ ID NO: 529904 - RNA, 19 nt, Homo sapiens
ucagacaggauguugacaa

SEQ ID NO: 529905 - RNA, 19 nt, Homo sapiens
cacgaugaccuugaauaaa

SEQ ID NO: 529906 - RNA, 19 nt, Homo sapiens
gugaaguggaugcccuuaa

SEQ ID NO: 529907 - RNA, 19 nt, Homo sapiens
aggcucagauucaggaaca

SEQ ID NO: 529908 - RNA, 19 nt, Homo sapiens
gacagguuaucaacgaaac

SEQ ID NO: 529909 - RNA, 19 nt, Homo sapiens
guuaagauggcccuugaca

SEQ ID NO: 529910 - RNA, 19 nt, Homo sapiens
ggaggagaugcuucagaga

SEQ ID NO: 529911 - RNA, 19 nt, Homo sapiens
caaccuggccgaggacauc

SEQ ID NO: 529912 - RNA, 19 nt, Homo sapiens
cgucagcaauaugaaagug

SEQ ID NO: 529913 - RNA, 19 nt, Homo sapiens
uccuggagcagcagaauaa

SEQ ID NO: 529914 - RNA, 19 nt, Homo sapiens
agaaauugcaggaggagau

SEQ ID NO: 529915 - RNA, 19 nt, Homo sapiens
gcgaggagagcaggauuuc

SEQ ID NO: 529916 - RNA, 19 nt, Homo sapiens
gcaggacucgguggacuuc

SEQ ID NO: 529917 - RNA, 19 nt, Homo sapiens
aggaacagcauguccaaau

SEQ ID NO: 529918 - RNA, 19 nt, Homo sapiens
ccugcucaauguuaagaug

SEQ ID NO: 529919 - RNA, 19 nt, Homo sapiens
caaaucgauguggauguuu

SEQ ID NO: 529920 - RNA, 19 nt, Homo sapiens
ggagcgcaagauagauuug

SEQ ID NO: 529921 - RNA, 19 nt, Homo sapiens
uggaccagcuaaccaacga

SEQ ID NO: 529922 - RNA, 19 nt, Homo sapiens
cucaguggcaggcgauaua

SEQ ID NO: 529923 - RNA, 19 nt, Homo sapiens
ggauucacucccucugguu

SEQ ID NO: 529924 - RNA, 19 nt, Homo sapiens
ggcgaggagagcaggauuu

SEQ ID NO: 529925 - RNA, 19 nt, Homo sapiens
uggagcagcagaauaagau

SEQ ID NO: 529926 - RNA, 19 nt, Homo sapiens
cugccaaccggaacaauga

SEQ ID NO: 529927 - RNA, 19 nt, Homo sapiens
caucaacaccgaguucaag

SEQ ID NO: 529928 - RNA, 19 nt, Homo sapiens
gcuuucaagugccuuucug

SEQ ID NO: 529929 - RNA, 19 nt, Homo sapiens
ccguugaagcugcuaacua

SEQ ID NO: 529930 - RNA, 19 nt, Homo sapiens
gcugccaaccggaacaaug

SEQ ID NO: 529931 - RNA, 19 nt, Homo sapiens
ucaacaccgaguucaagaa

SEQ ID NO: 529932 - RNA, 19 nt, Homo sapiens
ggaaugcuguguuaaauaa

SEQ ID NO: 529933 - RNA, 19 nt, Homo sapiens
caaaggcucucuccugaua

SEQ ID NO: 529934 - RNA, 19 nt, Homo sapiens
gaaauggacaccagaaaua

SEQ ID NO: 529935 - RNA, 19 nt, Homo sapiens
gaauauugcuuuggucaua

SEQ ID NO: 529936 - RNA, 19 nt, Homo sapiens
acaaauggcuguaaagaaa

SEQ ID NO: 529937 - RNA, 19 nt, Homo sapiens
gauaaguaaugcuagguua

SEQ ID NO: 529938 - RNA, 19 nt, Homo sapiens
gagcaaagcugaugacaac

SEQ ID NO: 529939 - RNA, 19 nt, Homo sapiens
gaugacaacuucccaguga

SEQ ID NO: 529940 - RNA, 19 nt, Homo sapiens
gcaguaacaucucagaaga

SEQ ID NO: 529941 - RNA, 19 nt, Homo sapiens
cauaugagcuuccuucugu

SEQ ID NO: 529942 - RNA, 19 nt, Homo sapiens
cagauggaaugcuguguua

SEQ ID NO: 529943 - RNA, 19 nt, Homo sapiens
acacucaguuguucaauaa

SEQ ID NO: 529944 - RNA, 19 nt, Homo sapiens
gaacagauaaucagugugu

SEQ ID NO: 529945 - RNA, 19 nt, Homo sapiens
aaaugaaccugaucaaguu

SEQ ID NO: 529946 - RNA, 19 nt, Homo sapiens
ccaauuauaugagacguuu

SEQ ID NO: 529947 - RNA, 19 nt, Homo sapiens
gaaaacaaauggcuguaaa

SEQ ID NO: 529948 - RNA, 19 nt, Homo sapiens
gauaaucagugugucuaaa

SEQ ID NO: 529949 - RNA, 19 nt, Homo sapiens
cagguugggugacagaaua

SEQ ID NO: 529950 - RNA, 19 nt, Homo sapiens
gagcaaaauugauguguuu

SEQ ID NO: 529951 - RNA, 19 nt, Homo sapiens
caaaugaaccugaucaagu

SEQ ID NO: 529952 - RNA, 19 nt, Homo sapiens
gaaaacaacuucaauaucc

SEQ ID NO: 529953 - RNA, 19 nt, Homo sapiens
ucacucagaugcagucuuc

SEQ ID NO: 529954 - RNA, 19 nt, Homo sapiens
gauggaaugcuguguuaaa

SEQ ID NO: 529955 - RNA, 19 nt, Homo sapiens
gauguauucuagcuaaugu

SEQ ID NO: 529956 - RNA, 19 nt, Homo sapiens
caaagcugaugacaacuuc

SEQ ID NO: 529957 - RNA, 19 nt, Homo sapiens
cgacuuuccagaagaguua

SEQ ID NO: 529958 - RNA, 19 nt, Homo sapiens
uaugauguauccagaaaug

SEQ ID NO: 529959 - RNA, 19 nt, Homo sapiens
ucucaaauuuggauugcua

SEQ ID NO: 529960 - RNA, 19 nt, Homo sapiens
ccagugaauucuugaagga

SEQ ID NO: 529961 - RNA, 19 nt, Homo sapiens
gcaaagcugaugacaacuu

SEQ ID NO: 529962 - RNA, 19 nt, Homo sapiens
gaaaacguguuagcaguaa

SEQ ID NO: 529963 - RNA, 19 nt, Homo sapiens
uagaacagauaaucagugu

SEQ ID NO: 529964 - RNA, 19 nt, Homo sapiens
ugacuucaguaaacucuug

SEQ ID NO: 529965 - RNA, 19 nt, Homo sapiens
gaaugaaacacucaguugu

SEQ ID NO: 529966 - RNA, 19 nt, Homo sapiens
gcuaauguaauaacuguga

SEQ ID NO: 529967 - RNA, 19 nt, Homo sapiens
agaguguacuuaacuauuc

SEQ ID NO: 529968 - RNA, 19 nt, Homo sapiens
gccauaaugacucagaaua

SEQ ID NO: 529969 - RNA, 19 nt, Homo sapiens
caggagaguagaacagaua

SEQ ID NO: 529970 - RNA, 19 nt, Homo sapiens
ugugauguauucuagcuaa

SEQ ID NO: 529971 - RNA, 19 nt, Homo sapiens
gcaauuucauaugcuguau

SEQ ID NO: 529972 - RNA, 19 nt, Homo sapiens
uaaagaccuugcuuaugau

SEQ ID NO: 529973 - RNA, 19 nt, Homo sapiens
ugacucagaauauugcuuu

SEQ ID NO: 529974 - RNA, 19 nt, Homo sapiens
gaaaaugauacgcaacaua

SEQ ID NO: 529975 - RNA, 19 nt, Homo sapiens
gcagauggaaugcuguguu

SEQ ID NO: 529976 - RNA, 19 nt, Homo sapiens
agucuucacugacaacuau

SEQ ID NO: 529977 - RNA, 19 nt, Homo sapiens
gacacacccuauuaugaug

SEQ ID NO: 529978 - RNA, 19 nt, Homo sapiens
gaaaaugacacacccuauu

SEQ ID NO: 529979 - RNA, 19 nt, Homo sapiens
aaacaaauggcuguaaaga

SEQ ID NO: 529980 - RNA, 19 nt, Homo sapiens
caacuauacccgccuuaga

SEQ ID NO: 529981 - RNA, 19 nt, Homo sapiens
ugacacacccuauuaugau

SEQ ID NO: 529982 - RNA, 19 nt, Homo sapiens
caaaaugcauuagcugaaa

SEQ ID NO: 529983 - RNA, 19 nt, Homo sapiens
ugaaugaaacacucaguug

SEQ ID NO: 529984 - RNA, 19 nt, Homo sapiens
gagcaaaugaaccugauca

SEQ ID NO: 529985 - RNA, 19 nt, Homo sapiens
gaacgaccccugcuucuga

SEQ ID NO: 529986 - RNA, 19 nt, Homo sapiens
gagaguagaacagauaauc

SEQ ID NO: 529987 - RNA, 19 nt, Homo sapiens
ccauaaugacucagaauau

SEQ ID NO: 529988 - RNA, 19 nt, Homo sapiens
gaggagcagugagggagaa

SEQ ID NO: 529989 - RNA, 19 nt, Homo sapiens
gaguguacuuaacuauuca

SEQ ID NO: 529990 - RNA, 19 nt, Homo sapiens
aaaaugacacacccuauua

SEQ ID NO: 529991 - RNA, 19 nt, Homo sapiens
ugagcuuccuucugugaaa

SEQ ID NO: 529992 - RNA, 19 nt, Homo sapiens
aaauggacaccagaaauaa

SEQ ID NO: 529993 - RNA, 19 nt, Homo sapiens
gcaaaugaaccugaucaag

SEQ ID NO: 529994 - RNA, 19 nt, Homo sapiens
cagugugucuaaauuugaa

SEQ ID NO: 529995 - RNA, 19 nt, Homo sapiens
ggagcaaagcugaugacaa

SEQ ID NO: 529996 - RNA, 19 nt, Homo sapiens
uugagucucuuaugggaaa

SEQ ID NO: 529997 - RNA, 19 nt, Homo sapiens
gagcuuccuucugugaaau

SEQ ID NO: 529998 - RNA, 19 nt, Homo sapiens
cugcuuguguuaaguaugu

SEQ ID NO: 529999 - RNA, 19 nt, Homo sapiens
ugcuguauauccuuucuaa

SEQ ID NO: 530000 - RNA, 19 nt, Homo sapiens
agucaaacgucacucagau

SEQ ID NO: 530001 - RNA, 19 nt, Homo sapiens
ggaaaacguguuagcagua

SEQ ID NO: 530002 - RNA, 19 nt, Homo sapiens
aaaaguaccuugagucucu

SEQ ID NO: 530003 - RNA, 19 nt, Homo sapiens
gggagcaaaugaaccugau

SEQ ID NO: 530004 - RNA, 19 nt, Homo sapiens
uggaaugcuguguuaaaua

SEQ ID NO: 530005 - RNA, 19 nt, Homo sapiens
gauagucuuucaguuaagg

SEQ ID NO: 530006 - RNA, 19 nt, Homo sapiens
gcucucagguugggugaca

SEQ ID NO: 530007 - RNA, 19 nt, Homo sapiens
caacuucaauauccaaacc

SEQ ID NO: 530008 - RNA, 19 nt, Homo sapiens
agugaauucuugaaggaaa

SEQ ID NO: 530009 - RNA, 19 nt, Homo sapiens
ggugacagaauacccuuug

SEQ ID NO: 530010 - RNA, 19 nt, Homo sapiens
gagagaaaauaaagaccuu

SEQ ID NO: 530011 - RNA, 19 nt, Homo sapiens
agaaauggacaccagaaau

SEQ ID NO: 530012 - RNA, 19 nt, Homo sapiens
ccugaucaaguuucauuaa

SEQ ID NO: 530013 - RNA, 19 nt, Homo sapiens
aaugcuagguuaauccaau

SEQ ID NO: 530014 - RNA, 19 nt, Homo sapiens
caaauggcuguaaagaaau

SEQ ID NO: 530015 - RNA, 19 nt, Homo sapiens
ggcgagaggcacagaaaug

SEQ ID NO: 530016 - RNA, 19 nt, Homo sapiens
cagaaauggacaccagaaa

SEQ ID NO: 530017 - RNA, 19 nt, Homo sapiens
caggcaugcugauggaguu

SEQ ID NO: 530018 - RNA, 19 nt, Homo sapiens
gaaaauaaagaccuugcuu

SEQ ID NO: 530019 - RNA, 19 nt, Homo sapiens
cacacccuauuaugaugua

SEQ ID NO: 530020 - RNA, 19 nt, Homo sapiens
acugugaaguuuacauugu

SEQ ID NO: 530021 - RNA, 19 nt, Homo sapiens
gugacagaauacccuuuga

SEQ ID NO: 530022 - RNA, 19 nt, Homo sapiens
uaacuauucaggagaguag

SEQ ID NO: 530023 - RNA, 19 nt, Homo sapiens
uugugaauguugugaugua

SEQ ID NO: 530024 - RNA, 19 nt, Homo sapiens
caucucagaagacccugua

SEQ ID NO: 530025 - RNA, 19 nt, Homo sapiens
gagcagugagggagaaucu

SEQ ID NO: 530026 - RNA, 19 nt, Homo sapiens
gcaaaaugcauuagcugaa

SEQ ID NO: 530027 - RNA, 19 nt, Homo sapiens
gaagacccuguaccaguca

SEQ ID NO: 530028 - RNA, 19 nt, Homo sapiens
uaccuugagucucuuaugg

SEQ ID NO: 530029 - RNA, 19 nt, Homo sapiens
gugaaugaaacacucaguu

SEQ ID NO: 530030 - RNA, 19 nt, Homo sapiens
gcucucuccugauagucuu

SEQ ID NO: 530031 - RNA, 19 nt, Homo sapiens
cagauaaucagugugucua

SEQ ID NO: 530032 - RNA, 19 nt, Homo sapiens
ggagagcacaccuaucuua

SEQ ID NO: 530033 - RNA, 19 nt, Homo sapiens
gcaacaggcuugugcaaca

SEQ ID NO: 530034 - RNA, 19 nt, Homo sapiens
gagcacaccuaucuuagug

SEQ ID NO: 530035 - RNA, 19 nt, Homo sapiens
acaauaggcugcagcaaga

SEQ ID NO: 530036 - RNA, 19 nt, Homo sapiens
uaacuaggcucagagaugu

SEQ ID NO: 530037 - RNA, 19 nt, Homo sapiens
ucacugugguggaucauaa

SEQ ID NO: 530038 - RNA, 19 nt, Homo sapiens
ccacaugcaccucuucaua

SEQ ID NO: 530039 - RNA, 19 nt, Homo sapiens
gagccugccuggagcguuu

SEQ ID NO: 530040 - RNA, 19 nt, Homo sapiens
cagauccucuugguuauuu

SEQ ID NO: 530041 - RNA, 19 nt, Homo sapiens
gagcguuucuagcaaguga

SEQ ID NO: 530042 - RNA, 19 nt, Homo sapiens
ugacagcaguccauacuca

SEQ ID NO: 530043 - RNA, 19 nt, Homo sapiens
ggaacuacauccacaugca

SEQ ID NO: 530044 - RNA, 19 nt, Homo sapiens
gugaaagcacggacucuua

SEQ ID NO: 530045 - RNA, 19 nt, Homo sapiens
ccucuugguuauuuguuua

SEQ ID NO: 530046 - RNA, 19 nt, Homo sapiens
gcacggacucuuacugcua

SEQ ID NO: 530047 - RNA, 19 nt, Homo sapiens
gauuugaacucagaucugu

SEQ ID NO: 530048 - RNA, 19 nt, Homo sapiens
ggaggagugugacuaugug

SEQ ID NO: 530049 - RNA, 19 nt, Homo sapiens
caccauugcugucaaguuc

SEQ ID NO: 530050 - RNA, 19 nt, Homo sapiens
ugucauggcuaacuucuuc

SEQ ID NO: 530051 - RNA, 19 nt, Homo sapiens
gcuggagaaugagacaaua

SEQ ID NO: 530052 - RNA, 19 nt, Homo sapiens
caauaaauguuggcuugga

SEQ ID NO: 530053 - RNA, 19 nt, Homo sapiens
guaacuaggcucagagaug

SEQ ID NO: 530054 - RNA, 19 nt, Homo sapiens
ccaccuaugugccaacugu

SEQ ID NO: 530055 - RNA, 19 nt, Homo sapiens
ugaagccucugggaaauga

SEQ ID NO: 530056 - RNA, 19 nt, Homo sapiens
aauauugugucauggcuaa

SEQ ID NO: 530057 - RNA, 19 nt, Homo sapiens
gcagcaagaugugggacaa

SEQ ID NO: 530058 - RNA, 19 nt, Homo sapiens
gaagcaacaggaaucaaga

SEQ ID NO: 530059 - RNA, 19 nt, Homo sapiens
gcacgcagguuuccaugcu

SEQ ID NO: 530060 - RNA, 19 nt, Homo sapiens
cacggacucuuacugcuaa

SEQ ID NO: 530061 - RNA, 19 nt, Homo sapiens
ucaaguuccuuuggguuaa

SEQ ID NO: 530062 - RNA, 19 nt, Homo sapiens
guuauuuguuuaccacuug

SEQ ID NO: 530063 - RNA, 19 nt, Homo sapiens
gcaggaggagugugacuau

SEQ ID NO: 530064 - RNA, 19 nt, Homo sapiens
gguuaagcauuaccacuca

SEQ ID NO: 530065 - RNA, 19 nt, Homo sapiens
ggaagcaacaggaaucaag

SEQ ID NO: 530066 - RNA, 19 nt, Homo sapiens
agccagauccucuugguua

SEQ ID NO: 530067 - RNA, 19 nt, Homo sapiens
aggcccagcuggagaauga

SEQ ID NO: 530068 - RNA, 19 nt, Homo sapiens
uccuuuggguuaagcauua

SEQ ID NO: 530069 - RNA, 19 nt, Homo sapiens
caucauguucgccuucuuu

SEQ ID NO: 530070 - RNA, 19 nt, Homo sapiens
ucaccuccaucuugguaaa

SEQ ID NO: 530071 - RNA, 19 nt, Homo sapiens
gacucuuacugcuaacuuu

SEQ ID NO: 530072 - RNA, 19 nt, Homo sapiens
gucaaguuccuuuggguua

SEQ ID NO: 530073 - RNA, 19 nt, Homo sapiens
agguggaacucagucauua

SEQ ID NO: 530074 - RNA, 19 nt, Homo sapiens
guucuacgguucugugaag

SEQ ID NO: 530075 - RNA, 19 nt, Homo sapiens
auucaaggccgcaauguaa

SEQ ID NO: 530076 - RNA, 19 nt, Homo sapiens
cauuaccacucaggcauuu

SEQ ID NO: 530077 - RNA, 19 nt, Homo sapiens
gaauccugcuucagaaacu

SEQ ID NO: 530078 - RNA, 19 nt, Homo sapiens
uaaggcagccauggucuuu

SEQ ID NO: 530079 - RNA, 19 nt, Homo sapiens
gccagauccucuugguuau

SEQ ID NO: 530080 - RNA, 19 nt, Homo sapiens
aaugcuaggucucggacua

SEQ ID NO: 530081 - RNA, 19 nt, Homo sapiens
gcucuucuccuccauucaa

SEQ ID NO: 530082 - RNA, 19 nt, Homo sapiens
uacaggauuugaacucaga

SEQ ID NO: 530083 - RNA, 19 nt, Homo sapiens
ggacugagggacucugaag

SEQ ID NO: 530084 - RNA, 19 nt, Homo sapiens
ccacgguagugccugaaau

SEQ ID NO: 530085 - RNA, 19 nt, Homo sapiens
cauacaggauuugaacuca

SEQ ID NO: 530086 - RNA, 19 nt, Homo sapiens
gguggauccucaaacaaca

SEQ ID NO: 530087 - RNA, 19 nt, Homo sapiens
cgaagucucccuggucuga

SEQ ID NO: 530088 - RNA, 19 nt, Homo sapiens
ucucauguaucaucuggau

SEQ ID NO: 530089 - RNA, 19 nt, Homo sapiens
aagccuaccugcucuccaa

SEQ ID NO: 530090 - RNA, 19 nt, Homo sapiens
gcauuaccacucaggcauu

SEQ ID NO: 530091 - RNA, 19 nt, Homo sapiens
cacaugcaccucuucauau

SEQ ID NO: 530092 - RNA, 19 nt, Homo sapiens
gugacuaugugcagaugau

SEQ ID NO: 530093 - RNA, 19 nt, Homo sapiens
gguuauuuguuuaccacuu

SEQ ID NO: 530094 - RNA, 19 nt, Homo sapiens
ggacggugcaacccaagga

SEQ ID NO: 530095 - RNA, 19 nt, Homo sapiens
ucucugagcggaaguacuu

SEQ ID NO: 530096 - RNA, 19 nt, Homo sapiens
ggacucuuacugcuaacuu

SEQ ID NO: 530097 - RNA, 19 nt, Homo sapiens
aucaagagcugcccuccuu

SEQ ID NO: 530098 - RNA, 19 nt, Homo sapiens
gagagcacaccuaucuuag

SEQ ID NO: 530099 - RNA, 19 nt, Homo sapiens
cauccucaccuccaucuug

SEQ ID NO: 530100 - RNA, 19 nt, Homo sapiens
ugacaaggcagcgaguuug

SEQ ID NO: 530101 - RNA, 19 nt, Homo sapiens
gccuccaucucauguauca

SEQ ID NO: 530102 - RNA, 19 nt, Homo sapiens
ucaguggcuucaucuguca

SEQ ID NO: 530103 - RNA, 19 nt, Homo sapiens
gguccacacuccugcugau

SEQ ID NO: 530104 - RNA, 19 nt, Homo sapiens
acaugcaccucuucauauc

SEQ ID NO: 530105 - RNA, 19 nt, Homo sapiens
uggcucuucugcccaauug

SEQ ID NO: 530106 - RNA, 19 nt, Homo sapiens
gcaccaacaccacgguagu

SEQ ID NO: 530107 - RNA, 19 nt, Homo sapiens
uuuccaauauugugucaug

SEQ ID NO: 530108 - RNA, 19 nt, Homo sapiens
guggaacucagucauuaga

SEQ ID NO: 530109 - RNA, 19 nt, Homo sapiens
ucacaccagccauacuuau

SEQ ID NO: 530110 - RNA, 19 nt, Homo sapiens
gauaucaggaagagugaca

SEQ ID NO: 530111 - RNA, 19 nt, Homo sapiens
cagccauacuuaucucucu

SEQ ID NO: 530112 - RNA, 19 nt, Homo sapiens
caaggcagcgaguuuggau

SEQ ID NO: 530113 - RNA, 19 nt, Homo sapiens
gaugagcagcagaccaugu

SEQ ID NO: 530114 - RNA, 19 nt, Homo sapiens
ccucaccuccaucuuggua

SEQ ID NO: 530115 - RNA, 19 nt, Homo sapiens
gugcacccaugggcucuga

SEQ ID NO: 530116 - RNA, 19 nt, Homo sapiens
caaguuccuuuggguuaag

SEQ ID NO: 530117 - RNA, 19 nt, Homo sapiens
gcucuucugcccaauugga

SEQ ID NO: 530118 - RNA, 19 nt, Homo sapiens
cagguggaacucagucauu

SEQ ID NO: 530119 - RNA, 19 nt, Homo sapiens
uggaguacacuacaucaug

SEQ ID NO: 530120 - RNA, 19 nt, Homo sapiens
ccagccagauccucuuggu

SEQ ID NO: 530121 - RNA, 19 nt, Homo sapiens
uaucguaaccagccagauc

SEQ ID NO: 530122 - RNA, 19 nt, Homo sapiens
ugaaagcacggacucuuac

SEQ ID NO: 530123 - RNA, 19 nt, Homo sapiens
ucugaagccucugggaaau

SEQ ID NO: 530124 - RNA, 19 nt, Homo sapiens
guaaggcagccauggucuu

SEQ ID NO: 530125 - RNA, 19 nt, Homo sapiens
ugauaggaaugugaaagca

SEQ ID NO: 530126 - RNA, 19 nt, Homo sapiens
ggauuugaacucagaucug

SEQ ID NO: 530127 - RNA, 19 nt, Homo sapiens
acacauacaggauuugaac

SEQ ID NO: 530128 - RNA, 19 nt, Homo sapiens
cuacacauacaggauuuga

SEQ ID NO: 530129 - RNA, 19 nt, Homo sapiens
cacgguagugccugaaauu

SEQ ID NO: 530130 - RNA, 19 nt, Homo sapiens
uggcuauccucuacugcuu

SEQ ID NO: 530131 - RNA, 19 nt, Homo sapiens
accaucaacuccucacugu

SEQ ID NO: 530132 - RNA, 19 nt, Homo sapiens
ggaaugagcuguguaaaua

SEQ ID NO: 530133 - RNA, 19 nt, Homo sapiens
gauuuaaacuccagcauuu

SEQ ID NO: 530134 - RNA, 19 nt, Homo sapiens
gaacagcauucacccagaa

SEQ ID NO: 530135 - RNA, 19 nt, Homo sapiens
ggaauuacauccaccugaa

SEQ ID NO: 530136 - RNA, 19 nt, Homo sapiens
cagcaaagcaggaaacaua

SEQ ID NO: 530137 - RNA, 19 nt, Homo sapiens
caacaggugucuuuaacug

SEQ ID NO: 530138 - RNA, 19 nt, Homo sapiens
ccggaaaccuauucucuuu

SEQ ID NO: 530139 - RNA, 19 nt, Homo sapiens
ucagagacguucccagauu

SEQ ID NO: 530140 - RNA, 19 nt, Homo sapiens
gcaacgaccagucucagua

SEQ ID NO: 530141 - RNA, 19 nt, Homo sapiens
ggagucguguugucauuga

SEQ ID NO: 530142 - RNA, 19 nt, Homo sapiens
caagcugguuguccacuaa

SEQ ID NO: 530143 - RNA, 19 nt, Homo sapiens
cagagacguucccagauuu

SEQ ID NO: 530144 - RNA, 19 nt, Homo sapiens
ggaaauacaggaggaagaa

SEQ ID NO: 530145 - RNA, 19 nt, Homo sapiens
ccaaaagucuucagcaauu

SEQ ID NO: 530146 - RNA, 19 nt, Homo sapiens
aaagauuugugguaacuga

SEQ ID NO: 530147 - RNA, 19 nt, Homo sapiens
gaacaacccaccauuucug

SEQ ID NO: 530148 - RNA, 19 nt, Homo sapiens
ccaaauaccagauacuguu

SEQ ID NO: 530149 - RNA, 19 nt, Homo sapiens
gcacauuugacuccacuuu

SEQ ID NO: 530150 - RNA, 19 nt, Homo sapiens
ugacauccgucccacauca

SEQ ID NO: 530151 - RNA, 19 nt, Homo sapiens
gcucaucccuggacuucug

SEQ ID NO: 530152 - RNA, 19 nt, Homo sapiens
ugacugguuucuccuggua

SEQ ID NO: 530153 - RNA, 19 nt, Homo sapiens
gaagggugguuugcagaug

SEQ ID NO: 530154 - RNA, 19 nt, Homo sapiens
gaauuuugcugcagaaguu

SEQ ID NO: 530155 - RNA, 19 nt, Homo sapiens
gcaacaggaagcauaauuc

SEQ ID NO: 530156 - RNA, 19 nt, Homo sapiens
aauaaagccugaucucaca

SEQ ID NO: 530157 - RNA, 19 nt, Homo sapiens
ggucaacaggugucuuuaa

SEQ ID NO: 530158 - RNA, 19 nt, Homo sapiens
acaagaggcuggccaaguc

SEQ ID NO: 530159 - RNA, 19 nt, Homo sapiens
caaauaccagauacuguuu

SEQ ID NO: 530160 - RNA, 19 nt, Homo sapiens
gcucacacauccugucagu

SEQ ID NO: 530161 - RNA, 19 nt, Homo sapiens
gggaaugagcuguguaaau

SEQ ID NO: 530162 - RNA, 19 nt, Homo sapiens
ccaaagugcugggauuaag

SEQ ID NO: 530163 - RNA, 19 nt, Homo sapiens
gaauuggagucguguuguc

SEQ ID NO: 530164 - RNA, 19 nt, Homo sapiens
cagaacaacccaccauuuc

SEQ ID NO: 530165 - RNA, 19 nt, Homo sapiens
agagcaaggucaugaagga

SEQ ID NO: 530166 - RNA, 19 nt, Homo sapiens
gcccaguccuuccugcaaa

SEQ ID NO: 530167 - RNA, 19 nt, Homo sapiens
caucauggccaacuucuuc

SEQ ID NO: 530168 - RNA, 19 nt, Homo sapiens
ucucagugcuggucaagga

SEQ ID NO: 530169 - RNA, 19 nt, Homo sapiens
ugacuccacuuuuccuuua

SEQ ID NO: 530170 - RNA, 19 nt, Homo sapiens
agagcaagaucacguuuua

SEQ ID NO: 530171 - RNA, 19 nt, Homo sapiens
ggacaugucaggugguuac

SEQ ID NO: 530172 - RNA, 19 nt, Homo sapiens
cagcaucuccuccaaauac

SEQ ID NO: 530173 - RNA, 19 nt, Homo sapiens
caugguguuugccguguuu

SEQ ID NO: 530174 - RNA, 19 nt, Homo sapiens
gcagaggauccaucacaga

SEQ ID NO: 530175 - RNA, 19 nt, Homo sapiens
gaaauacaggaggaagaaa

SEQ ID NO: 530176 - RNA, 19 nt, Homo sapiens
gaaauguggaaacgcaguu

SEQ ID NO: 530177 - RNA, 19 nt, Homo sapiens
ugugguaacugaagguguu

SEQ ID NO: 530178 - RNA, 19 nt, Homo sapiens
ggaaaggacggcugagcau

SEQ ID NO: 530179 - RNA, 19 nt, Homo sapiens
acagaacaacccaccauuu

SEQ ID NO: 530180 - RNA, 19 nt, Homo sapiens
ucaagcugguuguccacua

SEQ ID NO: 530181 - RNA, 19 nt, Homo sapiens
uacagugucucucugaugu

SEQ ID NO: 530182 - RNA, 19 nt, Homo sapiens
aagcagcaguguccagaga

SEQ ID NO: 530183 - RNA, 19 nt, Homo sapiens
gcaggaaacauaagcaaaa

SEQ ID NO: 530184 - RNA, 19 nt, Homo sapiens
gcgggaaugagcuguguaa

SEQ ID NO: 530185 - RNA, 19 nt, Homo sapiens
ccagaaugccgauuucauc

SEQ ID NO: 530186 - RNA, 19 nt, Homo sapiens
ccaaggaggaaauguggaa

SEQ ID NO: 530187 - RNA, 19 nt, Homo sapiens
aaacuccagcauuuagaua

SEQ ID NO: 530188 - RNA, 19 nt, Homo sapiens
aauaccagauacuguuuga

SEQ ID NO: 530189 - RNA, 19 nt, Homo sapiens
caacaggaagcauaauucu

SEQ ID NO: 530190 - RNA, 19 nt, Homo sapiens
ucucugaugucucuugcaa

SEQ ID NO: 530191 - RNA, 19 nt, Homo sapiens
ucugaugucucuugcaaca

SEQ ID NO: 530192 - RNA, 19 nt, Homo sapiens
gugcauugguggcaucaca

SEQ ID NO: 530193 - RNA, 19 nt, Homo sapiens
ggucauacgaauaccgauu

SEQ ID NO: 530194 - RNA, 19 nt, Homo sapiens
gacaccgguugcugggaua

SEQ ID NO: 530195 - RNA, 19 nt, Homo sapiens
caaaagucuucagcaauuu

SEQ ID NO: 530196 - RNA, 19 nt, Homo sapiens
cgauuuaaacuccagcauu

SEQ ID NO: 530197 - RNA, 19 nt, Homo sapiens
agugcgagcugaagcgaaa

SEQ ID NO: 530198 - RNA, 19 nt, Homo sapiens
uaauuuccaucaucgucaa

SEQ ID NO: 530199 - RNA, 19 nt, Homo sapiens
gcauaauucugugccucuu

SEQ ID NO: 530200 - RNA, 19 nt, Homo sapiens
gucuuuaacugucauugug

SEQ ID NO: 530201 - RNA, 19 nt, Homo sapiens
gucaacaggugucuuuaac

SEQ ID NO: 530202 - RNA, 19 nt, Homo sapiens
guuaggaccaggagaaauc

SEQ ID NO: 530203 - RNA, 19 nt, Homo sapiens
gcaaagcaggaaacauaag

SEQ ID NO: 530204 - RNA, 19 nt, Homo sapiens
gcaguggcgucugggacaa

SEQ ID NO: 530205 - RNA, 19 nt, Homo sapiens
ucacccagaaugccgauuu

SEQ ID NO: 530206 - RNA, 19 nt, Homo sapiens
caaggacgacguucucuac

SEQ ID NO: 530207 - RNA, 19 nt, Homo sapiens
gacguuaggaccaggagaa

SEQ ID NO: 530208 - RNA, 19 nt, Homo sapiens
gagccaaggaggaaaugug

SEQ ID NO: 530209 - RNA, 19 nt, Homo sapiens
gucauacgaauaccgauuu

SEQ ID NO: 530210 - RNA, 19 nt, Homo sapiens
ggauacaaacgaccacagu

SEQ ID NO: 530211 - RNA, 19 nt, Homo sapiens
gaggaugagagcaagauca

SEQ ID NO: 530212 - RNA, 19 nt, Homo sapiens
ucaauaaagccugaucuca

SEQ ID NO: 530213 - RNA, 19 nt, Homo sapiens
gggcagucaucagucauca

SEQ ID NO: 530214 - RNA, 19 nt, Homo sapiens
ccacagggaagcucacaca

SEQ ID NO: 530215 - RNA, 19 nt, Homo sapiens
ccuagcggcugcuccuuca

SEQ ID NO: 530216 - RNA, 19 nt, Homo sapiens
ggagagcaaggucaugaag

SEQ ID NO: 530217 - RNA, 19 nt, Homo sapiens
guucccagauuucgucgau

SEQ ID NO: 530218 - RNA, 19 nt, Homo sapiens
guggucaacaggugucuuu

SEQ ID NO: 530219 - RNA, 19 nt, Homo sapiens
gggcgugaguggacauguc

SEQ ID NO: 530220 - RNA, 19 nt, Homo sapiens
uggccguccucuacuguuu

SEQ ID NO: 530221 - RNA, 19 nt, Homo sapiens
cgaccagucucaguacaag

SEQ ID NO: 530222 - RNA, 19 nt, Homo sapiens
auaauucugugccucuuca

SEQ ID NO: 530223 - RNA, 19 nt, Homo sapiens
caggagagcaaggucauga

SEQ ID NO: 530224 - RNA, 19 nt, Homo sapiens
ggaauuggagucguguugu

SEQ ID NO: 530225 - RNA, 19 nt, Homo sapiens
gcaagaucacguuuuauau

SEQ ID NO: 530226 - RNA, 19 nt, Homo sapiens
guucugagcacauuugacu

SEQ ID NO: 530227 - RNA, 19 nt, Homo sapiens
aguccacgcuccugcuuau

SEQ ID NO: 530228 - RNA, 19 nt, Homo sapiens
ucaaggacgacguucucua

SEQ ID NO: 530229 - RNA, 19 nt, Homo sapiens
ugagcuguguaaauacuuc

SEQ ID NO: 530230 - RNA, 19 nt, Homo sapiens
gaaugagcuguguaaauac

SEQ ID NO: 530231 - RNA, 19 nt, Homo sapiens
aaaggacggcugagcaugu

SEQ ID NO: 530232 - RNA, 19 nt, Homo sapiens
gaaaagaacuguguaaaga

SEQ ID NO: 530233 - RNA, 19 nt, Homo sapiens
gaagaaaacuguggcaaua

SEQ ID NO: 530234 - RNA, 19 nt, Homo sapiens
gaacacaacagaaauuuca

SEQ ID NO: 530235 - RNA, 19 nt, Homo sapiens
gaauuacacuugaccuuau

SEQ ID NO: 530236 - RNA, 19 nt, Homo sapiens
gaaagagugucauauaaac

SEQ ID NO: 530237 - RNA, 19 nt, Homo sapiens
ccaggaaucugcagucaaa

SEQ ID NO: 530238 - RNA, 19 nt, Homo sapiens
ggaucaagcuuguguacuu

SEQ ID NO: 530239 - RNA, 19 nt, Homo sapiens
ucuauuggcuugauucuaa

SEQ ID NO: 530240 - RNA, 19 nt, Homo sapiens
gaagagacaucaggaagau

SEQ ID NO: 530241 - RNA, 19 nt, Homo sapiens
ggacugaugcggcuucuaa

SEQ ID NO: 530242 - RNA, 19 nt, Homo sapiens
ggaauuacacuugaccuua

SEQ ID NO: 530243 - RNA, 19 nt, Homo sapiens
ugacauugcugcccagaaa

SEQ ID NO: 530244 - RNA, 19 nt, Homo sapiens
gaacagugccauaugagaa

SEQ ID NO: 530245 - RNA, 19 nt, Homo sapiens
ccagaacagugccauauga

SEQ ID NO: 530246 - RNA, 19 nt, Homo sapiens
ggccgagacugucaaagua

SEQ ID NO: 530247 - RNA, 19 nt, Homo sapiens
acaaauggucgcuguauua

SEQ ID NO: 530248 - RNA, 19 nt, Homo sapiens
cggaagggcugguaacuug

SEQ ID NO: 530249 - RNA, 19 nt, Homo sapiens
gcgagagccugccuccaua

SEQ ID NO: 530250 - RNA, 19 nt, Homo sapiens
ggaaucugcagucaaauuu

SEQ ID NO: 530251 - RNA, 19 nt, Homo sapiens
guauuacgcuguuguggaa

SEQ ID NO: 530252 - RNA, 19 nt, Homo sapiens
cagugaaacuugugcuaua

SEQ ID NO: 530253 - RNA, 19 nt, Homo sapiens
cugaaagagugucauauaa

SEQ ID NO: 530254 - RNA, 19 nt, Homo sapiens
ggaauuggcaacacaagaa

SEQ ID NO: 530255 - RNA, 19 nt, Homo sapiens
caagucugaucuucacuaa

SEQ ID NO: 530256 - RNA, 19 nt, Homo sapiens
gaagacgugugcugaaucu

SEQ ID NO: 530257 - RNA, 19 nt, Homo sapiens
caauggagguuugcaaaga

SEQ ID NO: 530258 - RNA, 19 nt, Homo sapiens
ggacaaaacggguuacuaa

SEQ ID NO: 530259 - RNA, 19 nt, Homo sapiens
gcgagugcauccauaagaa

SEQ ID NO: 530260 - RNA, 19 nt, Homo sapiens
gaucgugucuacuggauag

SEQ ID NO: 530261 - RNA, 19 nt, Homo sapiens
gguuugaacugauagauag

SEQ ID NO: 530262 - RNA, 19 nt, Homo sapiens
gcauagauaucagcaaagu

SEQ ID NO: 530263 - RNA, 19 nt, Homo sapiens
ugacuucugugacaaaugu

SEQ ID NO: 530264 - RNA, 19 nt, Homo sapiens
gaucguaggauaguacuaa

SEQ ID NO: 530265 - RNA, 19 nt, Homo sapiens
gcuuagagaggaaagaaua

SEQ ID NO: 530266 - RNA, 19 nt, Homo sapiens
guggagauauugaugaaug

SEQ ID NO: 530267 - RNA, 19 nt, Homo sapiens
gaaaaccuguggagauauu

SEQ ID NO: 530268 - RNA, 19 nt, Homo sapiens
uauaggccaucuguaaaua

SEQ ID NO: 530269 - RNA, 19 nt, Homo sapiens
ggacacacguacccagcaa

SEQ ID NO: 530270 - RNA, 19 nt, Homo sapiens
gauacgaacacaacagaaa

SEQ ID NO: 530271 - RNA, 19 nt, Homo sapiens
gccaauaaauucacuggau

SEQ ID NO: 530272 - RNA, 19 nt, Homo sapiens
cugcaaagaccuaguuaua

SEQ ID NO: 530273 - RNA, 19 nt, Homo sapiens
aaugguggauguucucaua

SEQ ID NO: 530274 - RNA, 19 nt, Homo sapiens
cauaagaaguggcgaugug

SEQ ID NO: 530275 - RNA, 19 nt, Homo sapiens
gaacaucaagauaccuuug

SEQ ID NO: 530276 - RNA, 19 nt, Homo sapiens
gaggaaagaauauauccaa

SEQ ID NO: 530277 - RNA, 19 nt, Homo sapiens
guaaauaucccagagaaca

SEQ ID NO: 530278 - RNA, 19 nt, Homo sapiens
ccagcaauaucaguuguaa

SEQ ID NO: 530279 - RNA, 19 nt, Homo sapiens
gcagcuggguuugaacuga

SEQ ID NO: 530280 - RNA, 19 nt, Homo sapiens
acgaaugcuugguaaauaa

SEQ ID NO: 530281 - RNA, 19 nt, Homo sapiens
aaauuaaaccagcagcuua

SEQ ID NO: 530282 - RNA, 19 nt, Homo sapiens
gaucuagcuugacuucugu

SEQ ID NO: 530283 - RNA, 19 nt, Homo sapiens
ugacaauccuguguacuug

SEQ ID NO: 530284 - RNA, 19 nt, Homo sapiens
caccacaaauuaaugauca

SEQ ID NO: 530285 - RNA, 19 nt, Homo sapiens
ccaguggccuaacggaauu

SEQ ID NO: 530286 - RNA, 19 nt, Homo sapiens
gguaaauaaugguggaugu

SEQ ID NO: 530287 - RNA, 19 nt, Homo sapiens
ccugaaagagugucauaua

SEQ ID NO: 530288 - RNA, 19 nt, Homo sapiens
gcgaagaugguucagauga

SEQ ID NO: 530289 - RNA, 19 nt, Homo sapiens
ggaagaacaucaagauacc

SEQ ID NO: 530290 - RNA, 19 nt, Homo sapiens
gaauggaggaugugaauac

SEQ ID NO: 530291 - RNA, 19 nt, Homo sapiens
aagaagacauggagaaugg

SEQ ID NO: 530292 - RNA, 19 nt, Homo sapiens
gaagaagacauggagaaug

SEQ ID NO: 530293 - RNA, 19 nt, Homo sapiens
gcacaaauggucgcuguau

SEQ ID NO: 530294 - RNA, 19 nt, Homo sapiens
uggccaagaucguaggaua

SEQ ID NO: 530295 - RNA, 19 nt, Homo sapiens
uaucuucagugccucaauu

SEQ ID NO: 530296 - RNA, 19 nt, Homo sapiens
agucugaucuucacuaauc

SEQ ID NO: 530297 - RNA, 19 nt, Homo sapiens
gcaaggcaguaggcaaaga

SEQ ID NO: 530298 - RNA, 19 nt, Homo sapiens
gcagucaaauuuguaucaa

SEQ ID NO: 530299 - RNA, 19 nt, Homo sapiens
ucacuauucuuaagcacuu

SEQ ID NO: 530300 - RNA, 19 nt, Homo sapiens
gagaauggaggaugugaau

SEQ ID NO: 530301 - RNA, 19 nt, Homo sapiens
aaagaacuguguaaagaag

SEQ ID NO: 530302 - RNA, 19 nt, Homo sapiens
uugccgaccugaccaauuu

SEQ ID NO: 530303 - RNA, 19 nt, Homo sapiens
ggaccucuccauagacauu

SEQ ID NO: 530304 - RNA, 19 nt, Homo sapiens
acagaaauuucagcaacua

SEQ ID NO: 530305 - RNA, 19 nt, Homo sapiens
ucaggaagauuggcuuaga

SEQ ID NO: 530306 - RNA, 19 nt, Homo sapiens
gcaaagagccaagucugau

SEQ ID NO: 530307 - RNA, 19 nt, Homo sapiens
aacgaaugcuugguaaaua

SEQ ID NO: 530308 - RNA, 19 nt, Homo sapiens
uggaggaugugaauaccua

SEQ ID NO: 530309 - RNA, 19 nt, Homo sapiens
guuccuagcucauccucuu

SEQ ID NO: 530310 - RNA, 19 nt, Homo sapiens
uauaaacgaaugcuuggua

SEQ ID NO: 530311 - RNA, 19 nt, Homo sapiens
gauaucagcaaaguaugua

SEQ ID NO: 530312 - RNA, 19 nt, Homo sapiens
ggagaaugcauagauauca

SEQ ID NO: 530313 - RNA, 19 nt, Homo sapiens
gaugaaagcccagaacagu

SEQ ID NO: 530314 - RNA, 19 nt, Homo sapiens
aagcaggaaugaauggauu

SEQ ID NO: 530315 - RNA, 19 nt, Homo sapiens
auaaacgaaugcuugguaa

SEQ ID NO: 530316 - RNA, 19 nt, Homo sapiens
gugcagaaguggagaaugc

SEQ ID NO: 530317 - RNA, 19 nt, Homo sapiens
gaauuucuagacaguauug

SEQ ID NO: 530318 - RNA, 19 nt, Homo sapiens
ggaugugguuaccgaguau

SEQ ID NO: 530319 - RNA, 19 nt, Homo sapiens
gaaauuucagcaacuagug

SEQ ID NO: 530320 - RNA, 19 nt, Homo sapiens
gauucuaaguugcacaugu

SEQ ID NO: 530321 - RNA, 19 nt, Homo sapiens
ucaaauggaucuugcuacu

SEQ ID NO: 530322 - RNA, 19 nt, Homo sapiens
ccaggaacuuuguuugcaa

SEQ ID NO: 530323 - RNA, 19 nt, Homo sapiens
agaaaacuguggcaauaua

SEQ ID NO: 530324 - RNA, 19 nt, Homo sapiens
aaacuugugcuauagugua

SEQ ID NO: 530325 - RNA, 19 nt, Homo sapiens
gaguaucuguaacccuuga

SEQ ID NO: 530326 - RNA, 19 nt, Homo sapiens
uagcuugacuucugugaca

SEQ ID NO: 530327 - RNA, 19 nt, Homo sapiens
ugacuuacagugagacaaa

SEQ ID NO: 530328 - RNA, 19 nt, Homo sapiens
caagguugguagacauguu

SEQ ID NO: 530329 - RNA, 19 nt, Homo sapiens
caauuccagugcacaaaug

SEQ ID NO: 530330 - RNA, 19 nt, Homo sapiens
gauccugacugcgaagaug

SEQ ID NO: 530331 - RNA, 19 nt, Homo sapiens
gcaaggauggcagugauga

SEQ ID NO: 530332 - RNA, 19 nt, Homo sapiens
cgucaaagcuucacagugu

SEQ ID NO: 530333 - RNA, 19 nt, Homo sapiens
ggauggagccggacaugua

SEQ ID NO: 530334 - RNA, 19 nt, Homo sapiens
ccagaaguaucucaaguga

SEQ ID NO: 530335 - RNA, 19 nt, Homo sapiens
ggaugaagcacauuccuaa

SEQ ID NO: 530336 - RNA, 19 nt, Homo sapiens
gcacauuccuaaccugcuu

SEQ ID NO: 530337 - RNA, 19 nt, Homo sapiens
aacaaggccuggaagcuua

SEQ ID NO: 530338 - RNA, 19 nt, Homo sapiens
ucacauggauccuuauugg

SEQ ID NO: 530339 - RNA, 19 nt, Homo sapiens
acacuacacucaaagauca

SEQ ID NO: 530340 - RNA, 19 nt, Homo sapiens
gaguuuaaccugacggaua

SEQ ID NO: 530341 - RNA, 19 nt, Homo sapiens
aaacagggaugaagcacau

SEQ ID NO: 530342 - RNA, 19 nt, Homo sapiens
ugaacgagaugaacaccuu

SEQ ID NO: 530343 - RNA, 19 nt, Homo sapiens
aaacugagccuaccacaca

SEQ ID NO: 530344 - RNA, 19 nt, Homo sapiens
ccaagacagccacaccuua

SEQ ID NO: 530345 - RNA, 19 nt, Homo sapiens
ccagacuacuucagccuuu

SEQ ID NO: 530346 - RNA, 19 nt, Homo sapiens
aaacuacuguggcccaaga

SEQ ID NO: 530347 - RNA, 19 nt, Homo sapiens
uacaacagccugaaucaaa

SEQ ID NO: 530348 - RNA, 19 nt, Homo sapiens
gaacaaucaccaaccaaca

SEQ ID NO: 530349 - RNA, 19 nt, Homo sapiens
gccuacgacuggauuagua

SEQ ID NO: 530350 - RNA, 19 nt, Homo sapiens
ucuacaagcugcuauaugg

SEQ ID NO: 530351 - RNA, 19 nt, Homo sapiens
cauacacacuacacucaaa

SEQ ID NO: 530352 - RNA, 19 nt, Homo sapiens
gaagaacaacagcugaugu

SEQ ID NO: 530353 - RNA, 19 nt, Homo sapiens
ugacggauaugccagagau

SEQ ID NO: 530354 - RNA, 19 nt, Homo sapiens
gcauagacaccaaagacaa

SEQ ID NO: 530355 - RNA, 19 nt, Homo sapiens
caacaaggccuggaagcuu

SEQ ID NO: 530356 - RNA, 19 nt, Homo sapiens
uacaucauccgcuuuauuu

SEQ ID NO: 530357 - RNA, 19 nt, Homo sapiens
auacagcuguccacacuga

SEQ ID NO: 530358 - RNA, 19 nt, Homo sapiens
acucaaagaucacauggau

SEQ ID NO: 530359 - RNA, 19 nt, Homo sapiens
gauggagcacccagaagua

SEQ ID NO: 530360 - RNA, 19 nt, Homo sapiens
caaccaacauacacacuac

SEQ ID NO: 530361 - RNA, 19 nt, Homo sapiens
acaacagccugaaucaaau

SEQ ID NO: 530362 - RNA, 19 nt, Homo sapiens
gcuuaaagacugugaguuc

SEQ ID NO: 530363 - RNA, 19 nt, Homo sapiens
caucauccgcuuuauuuau

SEQ ID NO: 530364 - RNA, 19 nt, Homo sapiens
acaaagaggagauggaguu

SEQ ID NO: 530365 - RNA, 19 nt, Homo sapiens
ccggacauguacuggaaua

SEQ ID NO: 530366 - RNA, 19 nt, Homo sapiens
ccauacagcuguccacacu

SEQ ID NO: 530367 - RNA, 19 nt, Homo sapiens
gcuauauggcgaguucuua

SEQ ID NO: 530368 - RNA, 19 nt, Homo sapiens
cagacuacuucagccuuua

SEQ ID NO: 530369 - RNA, 19 nt, Homo sapiens
caagacagccacaccuuag

SEQ ID NO: 530370 - RNA, 19 nt, Homo sapiens
gcugcuauauggcgaguuc

SEQ ID NO: 530371 - RNA, 19 nt, Homo sapiens
uuccuaaccugcuuccuaa

SEQ ID NO: 530372 - RNA, 19 nt, Homo sapiens
gcagccaaacagaacguua

SEQ ID NO: 530373 - RNA, 19 nt, Homo sapiens
cauagacaccaaagacaaa

SEQ ID NO: 530374 - RNA, 19 nt, Homo sapiens
ucacaggcauagacaccaa

SEQ ID NO: 530375 - RNA, 19 nt, Homo sapiens
gagccuaccacacaacaug

SEQ ID NO: 530376 - RNA, 19 nt, Homo sapiens
uggaaacauuuaacucaga

SEQ ID NO: 530377 - RNA, 19 nt, Homo sapiens
cgucgagccuccuuuaugg

SEQ ID NO: 530378 - RNA, 19 nt, Homo sapiens
gcaguucuucuucuauguu

SEQ ID NO: 530379 - RNA, 19 nt, Homo sapiens
ucacguuccugcaguucuu

SEQ ID NO: 530380 - RNA, 19 nt, Homo sapiens
agacagccacaccuuagua

SEQ ID NO: 530381 - RNA, 19 nt, Homo sapiens
acaaucaccaaccaacaua

SEQ ID NO: 530382 - RNA, 19 nt, Homo sapiens
ggaagaacaacagcugaug

SEQ ID NO: 530383 - RNA, 19 nt, Homo sapiens
gggaugaagcacauuccua

SEQ ID NO: 530384 - RNA, 19 nt, Homo sapiens
gaaaaucaccucaaagaac

SEQ ID NO: 530385 - RNA, 19 nt, Homo sapiens
ggacauguacuggaauaag

SEQ ID NO: 530386 - RNA, 19 nt, Homo sapiens
gcaucuacaagcugcuaua

SEQ ID NO: 530387 - RNA, 19 nt, Homo sapiens
ugugaaagcuagacugaac

SEQ ID NO: 530388 - RNA, 19 nt, Homo sapiens
aguuuaaccugacggauau

SEQ ID NO: 530389 - RNA, 19 nt, Homo sapiens
cuuccugacuugucuaguu

SEQ ID NO: 530390 - RNA, 19 nt, Homo sapiens
ccaaccaacauacacacua

SEQ ID NO: 530391 - RNA, 19 nt, Homo sapiens
cuacaucauccgcuuuauu

SEQ ID NO: 530392 - RNA, 19 nt, Homo sapiens
gacauguacuggaauaagc

SEQ ID NO: 530393 - RNA, 19 nt, Homo sapiens
cggcagaacacaagcaguu

SEQ ID NO: 530394 - RNA, 19 nt, Homo sapiens
gguggaaccaguacgagaa

SEQ ID NO: 530395 - RNA, 19 nt, Homo sapiens
uaaucuuccugcucugcua

SEQ ID NO: 530396 - RNA, 19 nt, Homo sapiens
caacagccugaaucaaaug

SEQ ID NO: 530397 - RNA, 19 nt, Homo sapiens
uugccaaccugucaaugaa

SEQ ID NO: 530398 - RNA, 19 nt, Homo sapiens
ccacaaggcagccaaacag

SEQ ID NO: 530399 - RNA, 19 nt, Homo sapiens
gcagucccaugaucaccau

SEQ ID NO: 530400 - RNA, 19 nt, Homo sapiens
caucauuggccgcuuccua

SEQ ID NO: 530401 - RNA, 19 nt, Homo sapiens
ucaaggaccaaacuacugu

SEQ ID NO: 530402 - RNA, 19 nt, Homo sapiens
uuuaugggcuccaccuuca

SEQ ID NO: 530403 - RNA, 19 nt, Homo sapiens
cuauauggcgaguucuuaa

SEQ ID NO: 530404 - RNA, 19 nt, Homo sapiens
cuaaccugcuuccuaaugg

SEQ ID NO: 530405 - RNA, 19 nt, Homo sapiens
caucagcgccgucaaagcu

SEQ ID NO: 530406 - RNA, 19 nt, Homo sapiens
aaacucaaggaccaaacua

SEQ ID NO: 530407 - RNA, 19 nt, Homo sapiens
caguucuucuucuauguug

SEQ ID NO: 530408 - RNA, 19 nt, Homo sapiens
cugcaguucuucuucuaug

SEQ ID NO: 530409 - RNA, 19 nt, Homo sapiens
gcacccagaaguaucucaa

SEQ ID NO: 530410 - RNA, 19 nt, Homo sapiens
caccaaagacaaaagcuua

SEQ ID NO: 530411 - RNA, 19 nt, Homo sapiens
gacagccacaccuuaguau

SEQ ID NO: 530412 - RNA, 19 nt, Homo sapiens
ggagcacccagaaguaucu

SEQ ID NO: 530413 - RNA, 19 nt, Homo sapiens
ucacagugucacaggcaua

SEQ ID NO: 530414 - RNA, 19 nt, Homo sapiens
caaggcagccaaacagaac

SEQ ID NO: 530415 - RNA, 19 nt, Homo sapiens
ggccugcagucccaugauc

SEQ ID NO: 530416 - RNA, 19 nt, Homo sapiens
gcucugcuacuacaucauc

SEQ ID NO: 530417 - RNA, 19 nt, Homo sapiens
gaccuucugugggaucauc

SEQ ID NO: 530418 - RNA, 19 nt, Homo sapiens
gccaugaccaucacuuaca

SEQ ID NO: 530419 - RNA, 19 nt, Homo sapiens
aguauacugcccaaacuaa

SEQ ID NO: 530420 - RNA, 19 nt, Homo sapiens
ugaagcacauuccuaaccu

SEQ ID NO: 530421 - RNA, 19 nt, Homo sapiens
auacugcccaaacuaauga

SEQ ID NO: 530422 - RNA, 19 nt, Homo sapiens
acccuuaguucuaucugaa

SEQ ID NO: 530423 - RNA, 19 nt, Homo sapiens
ucagagucgggaacccuua

SEQ ID NO: 530424 - RNA, 19 nt, Homo sapiens
acaaggcagccaaacagaa

SEQ ID NO: 530425 - RNA, 19 nt, Homo sapiens
uacuacaucauccgcuuua

SEQ ID NO: 530426 - RNA, 19 nt, Homo sapiens
guauacugcccaaacuaau

SEQ ID NO: 530427 - RNA, 19 nt, Homo sapiens
cagccacaccuuaguauac

SEQ ID NO: 530428 - RNA, 19 nt, Homo sapiens
agacuacuucagccuuuaa

SEQ ID NO: 530429 - RNA, 19 nt, Homo sapiens
uauacugcccaaacuaaug

SEQ ID NO: 530430 - RNA, 19 nt, Homo sapiens
ccuaaccugcuuccuaaug

SEQ ID NO: 530431 - RNA, 19 nt, Homo sapiens
uggccaugaccaucacuua

SEQ ID NO: 530432 - RNA, 19 nt, Homo sapiens
ccaaagauguggccaggaa

SEQ ID NO: 530433 - RNA, 19 nt, Homo sapiens
gagagacugucauggaaga

SEQ ID NO: 530434 - RNA, 19 nt, Homo sapiens
ggacgaggcuauguauuac

SEQ ID NO: 530435 - RNA, 19 nt, Homo sapiens
aggacgaggcuauguauua

SEQ ID NO: 530436 - RNA, 19 nt, Homo sapiens
agacugcauuagggaauua

SEQ ID NO: 530437 - RNA, 19 nt, Homo sapiens
gagacugcauuagggaauu

SEQ ID NO: 530438 - RNA, 19 nt, Homo sapiens
uggagagacugucauggaa

SEQ ID NO: 530439 - RNA, 19 nt, Homo sapiens
ucgcuucucuggauccaaa

SEQ ID NO: 530440 - RNA, 19 nt, Homo sapiens
gaggaacgaccaugacauc

SEQ ID NO: 530441 - RNA, 19 nt, Homo sapiens
gguauuugagcaucucuga

SEQ ID NO: 530442 - RNA, 19 nt, Homo sapiens
guccugcaguguugcugua

SEQ ID NO: 530443 - RNA, 19 nt, Homo sapiens
gcuauguauuacugugcua

SEQ ID NO: 530444 - RNA, 19 nt, Homo sapiens
uguacagcgucuacuggua

SEQ ID NO: 530445 - RNA, 19 nt, Homo sapiens
ggagacugcauuagggaau

SEQ ID NO: 530446 - RNA, 19 nt, Homo sapiens
gguuccugcugagauauuu

SEQ ID NO: 530447 - RNA, 19 nt, Homo sapiens
cugcaguguugcuguaaau

SEQ ID NO: 530448 - RNA, 19 nt, Homo sapiens
ugaggacgaggcuauguau

SEQ ID NO: 530449 - RNA, 19 nt, Homo sapiens
acacgugucccuugaacug

SEQ ID NO: 530450 - RNA, 19 nt, Homo sapiens
cccauuggagacugcauua

SEQ ID NO: 530451 - RNA, 19 nt, Homo sapiens
gaggacgaggcuauguauu

SEQ ID NO: 530452 - RNA, 19 nt, Homo sapiens
gaccaugacaucggugugu

SEQ ID NO: 530453 - RNA, 19 nt, Homo sapiens
acgaggcuauguauuacug

SEQ ID NO: 530454 - RNA, 19 nt, Homo sapiens
ccugcaguguugcuguaaa

SEQ ID NO: 530455 - RNA, 19 nt, Homo sapiens
ggaccaacaugcucuacua

SEQ ID NO: 530456 - RNA, 19 nt, Homo sapiens
caccaugucuggcuaauuu

SEQ ID NO: 530457 - RNA, 19 nt, Homo sapiens
ggaaugcaguggcacaauu

SEQ ID NO: 530458 - RNA, 19 nt, Homo sapiens
gaacaccagugcucuguca

SEQ ID NO: 530459 - RNA, 19 nt, Homo sapiens
guauguggcuuccauggua

SEQ ID NO: 530460 - RNA, 19 nt, Homo sapiens
cagcaaggaugaagaaaug

SEQ ID NO: 530461 - RNA, 19 nt, Homo sapiens
gcaagaagcaccucacaga

SEQ ID NO: 530462 - RNA, 19 nt, Homo sapiens
ggagagauccugucugugu

SEQ ID NO: 530463 - RNA, 19 nt, Homo sapiens
ggagacuauuuccgaguua

SEQ ID NO: 530464 - RNA, 19 nt, Homo sapiens
ugacgagcauguacaauga

SEQ ID NO: 530465 - RNA, 19 nt, Homo sapiens
gcacaucgccaucgagaga

SEQ ID NO: 530466 - RNA, 19 nt, Homo sapiens
cagaagaucagcucaauug

SEQ ID NO: 530467 - RNA, 19 nt, Homo sapiens
ccaaguagcugggauuaca

SEQ ID NO: 530468 - RNA, 19 nt, Homo sapiens
auacuggcauccucaaaua

SEQ ID NO: 530469 - RNA, 19 nt, Homo sapiens
ugagagaccugugccguuu

SEQ ID NO: 530470 - RNA, 19 nt, Homo sapiens
cuaacagacuuucagguuu

SEQ ID NO: 530471 - RNA, 19 nt, Homo sapiens
agacagaauuucacucuuc

SEQ ID NO: 530472 - RNA, 19 nt, Homo sapiens
ccaaaucugugcuggacaa

SEQ ID NO: 530473 - RNA, 19 nt, Homo sapiens
gccuggagcuguucaaguu

SEQ ID NO: 530474 - RNA, 19 nt, Homo sapiens
uggaggagcucaccaacaa

SEQ ID NO: 530475 - RNA, 19 nt, Homo sapiens
gcucggccuucuuugauuu

SEQ ID NO: 530476 - RNA, 19 nt, Homo sapiens
ccaagugaaucuccuaaca

SEQ ID NO: 530477 - RNA, 19 nt, Homo sapiens
caauugcugugcagguuaa

SEQ ID NO: 530478 - RNA, 19 nt, Homo sapiens
gaaugcaguggcacaauuu

SEQ ID NO: 530479 - RNA, 19 nt, Homo sapiens
caucuaugccgucaugaua

SEQ ID NO: 530480 - RNA, 19 nt, Homo sapiens
gagagauccugucuguguu

SEQ ID NO: 530481 - RNA, 19 nt, Homo sapiens
gaaccacaucccaaaggua

SEQ ID NO: 530482 - RNA, 19 nt, Homo sapiens
uccgagggauucaguauuu

SEQ ID NO: 530483 - RNA, 19 nt, Homo sapiens
gagcauguacaaugagauu

SEQ ID NO: 530484 - RNA, 19 nt, Homo sapiens
gguaagaauguuugaaaga

SEQ ID NO: 530485 - RNA, 19 nt, Homo sapiens
uaacagacuuucagguuuu

SEQ ID NO: 530486 - RNA, 19 nt, Homo sapiens
gcacaugcuuccacuccau

SEQ ID NO: 530487 - RNA, 19 nt, Homo sapiens
ggagugcaguggugugauc

SEQ ID NO: 530488 - RNA, 19 nt, Homo sapiens
ucagccaccucaaggagua

SEQ ID NO: 530489 - RNA, 19 nt, Homo sapiens
guggacagcuacagugaga

SEQ ID NO: 530490 - RNA, 19 nt, Homo sapiens
gaaaacaccuuugggaaca

SEQ ID NO: 530491 - RNA, 19 nt, Homo sapiens
ccaaagugcugggauuaca

SEQ ID NO: 530492 - RNA, 19 nt, Homo sapiens
ccaaagugcugggauuaca

SEQ ID NO: 530493 - RNA, 19 nt, Homo sapiens
gaccuggaguucacugaga

SEQ ID NO: 530494 - RNA, 19 nt, Homo sapiens
ggacaagugggacagauuc

SEQ ID NO: 530495 - RNA, 19 nt, Homo sapiens
gcaagaacaucuggaagcu

SEQ ID NO: 530496 - RNA, 19 nt, Homo sapiens
gcugcuggccuauguaauu

SEQ ID NO: 530497 - RNA, 19 nt, Homo sapiens
cuucaaggcugucuucauc

SEQ ID NO: 530498 - RNA, 19 nt, Homo sapiens
caccauggcugccuacuac

SEQ ID NO: 530499 - RNA, 19 nt, Homo sapiens
agaagcaccucacagacaa

SEQ ID NO: 530500 - RNA, 19 nt, Homo sapiens
cccgauagcuccuacaaca

SEQ ID NO: 530501 - RNA, 19 nt, Homo sapiens
ggacagcuacagugagaug

SEQ ID NO: 530502 - RNA, 19 nt, Homo sapiens
guaaaugaagcccaggaaa

SEQ ID NO: 530503 - RNA, 19 nt, Homo sapiens
ugagaacuaugacuucaag

SEQ ID NO: 530504 - RNA, 19 nt, Homo sapiens
agaagaugauccugagaga

SEQ ID NO: 530505 - RNA, 19 nt, Homo sapiens
gagacagaauuucacucuu

SEQ ID NO: 530506 - RNA, 19 nt, Homo sapiens
aagugaaucuccuaacaga

SEQ ID NO: 530507 - RNA, 19 nt, Homo sapiens
ccugugccguuucauguuu

SEQ ID NO: 530508 - RNA, 19 nt, Homo sapiens
ggaggagucuacuucuuuu

SEQ ID NO: 530509 - RNA, 19 nt, Homo sapiens
ugccucggcuucccaagua

SEQ ID NO: 530510 - RNA, 19 nt, Homo sapiens
gaggagcucaccaacaaga

SEQ ID NO: 530511 - RNA, 19 nt, Homo sapiens
guucaaagacccugagaca

SEQ ID NO: 530512 - RNA, 19 nt, Homo sapiens
gaucgcaggaguaucuuug

SEQ ID NO: 530513 - RNA, 19 nt, Homo sapiens
gugagacugucaacaagau

SEQ ID NO: 530514 - RNA, 19 nt, Homo sapiens
ccaccugccuggagcuguu

SEQ ID NO: 530515 - RNA, 19 nt, Homo sapiens
ucaagcgcaucuucuacuu

SEQ ID NO: 530516 - RNA, 19 nt, Homo sapiens
gaggcaagugcucgagaua

SEQ ID NO: 530517 - RNA, 19 nt, Homo sapiens
gcacaggagagcaagaaca

SEQ ID NO: 530518 - RNA, 19 nt, Homo sapiens
cuggagagauccugucugu

SEQ ID NO: 530519 - RNA, 19 nt, Homo sapiens
gcaaggaugaagaaaugga

SEQ ID NO: 530520 - RNA, 19 nt, Homo sapiens
acaccuggcuguuuucuuu

SEQ ID NO: 530521 - RNA, 19 nt, Homo sapiens
ccuaacagacuuucagguu

SEQ ID NO: 530522 - RNA, 19 nt, Homo sapiens
ucacugagaacuaugacuu

SEQ ID NO: 530523 - RNA, 19 nt, Homo sapiens
aagcgcaucuucuacuuca

SEQ ID NO: 530524 - RNA, 19 nt, Homo sapiens
gaagaucagcucaauugcu

SEQ ID NO: 530525 - RNA, 19 nt, Homo sapiens
gugcaguggugugaucuug

SEQ ID NO: 530526 - RNA, 19 nt, Homo sapiens
cuacaucgucuucuuguuc

SEQ ID NO: 530527 - RNA, 19 nt, Homo sapiens
gauuacaggugagcacuac

SEQ ID NO: 530528 - RNA, 19 nt, Homo sapiens
ggcaagugcucgagauagg

SEQ ID NO: 530529 - RNA, 19 nt, Homo sapiens
ccuauguaauucucaccua

SEQ ID NO: 530530 - RNA, 19 nt, Homo sapiens
ccagcucucccuucgagua

SEQ ID NO: 530531 - RNA, 19 nt, Homo sapiens
gugggaagcguucuuggaa

SEQ ID NO: 530532 - RNA, 19 nt, Homo sapiens
agaggacgcugaggucuuc

SEQ ID NO: 530533 - RNA, 19 nt, Homo sapiens
acaaugagauucugauccu

SEQ ID NO: 530534 - RNA, 19 nt, Homo sapiens
ucacagacaacgaguucaa

SEQ ID NO: 530535 - RNA, 19 nt, Homo sapiens
ugaagccguugcucagaau

SEQ ID NO: 530536 - RNA, 19 nt, Homo sapiens
ucaauugcugugcagguua

SEQ ID NO: 530537 - RNA, 19 nt, Homo sapiens
agaagacccucaggcucua

SEQ ID NO: 530538 - RNA, 19 nt, Homo sapiens
gcagacacuggaagaacuu

SEQ ID NO: 530539 - RNA, 19 nt, Homo sapiens
ucaaggcugucuucaucau

SEQ ID NO: 530540 - RNA, 19 nt, Homo sapiens
uggugacgcugauugaaga

SEQ ID NO: 530541 - RNA, 19 nt, Homo sapiens
gaccugugccguuucaugu

SEQ ID NO: 530542 - RNA, 19 nt, Homo sapiens
cgaugaagacccuguuugu

SEQ ID NO: 530543 - RNA, 19 nt, Homo sapiens
uaggaggagucuacuucuu

SEQ ID NO: 530544 - RNA, 19 nt, Homo sapiens
agagauccugucuguguua

SEQ ID NO: 530545 - RNA, 19 nt, Homo sapiens
uggagacuauuuccgaguu

SEQ ID NO: 530546 - RNA, 19 nt, Homo sapiens
gugacgagcauguacaaug

SEQ ID NO: 530547 - RNA, 19 nt, Homo sapiens
cagcagugccuucuucauc

SEQ ID NO: 530548 - RNA, 19 nt, Homo sapiens
gggugagacugucaacaag

SEQ ID NO: 530549 - RNA, 19 nt, Homo sapiens
guuaggaggagucuacuuc

SEQ ID NO: 530550 - RNA, 19 nt, Homo sapiens
caucuucuacuucaacuuc

SEQ ID NO: 530551 - RNA, 19 nt, Homo sapiens
ggucuuggccuauauucuc

SEQ ID NO: 530552 - RNA, 19 nt, Homo sapiens
gcaaacggacagccugaag

SEQ ID NO: 530553 - RNA, 19 nt, Homo sapiens
gaagccguugcucagaaua

SEQ ID NO: 530554 - RNA, 19 nt, Homo sapiens
ucgcaggaguaucuuugaa

SEQ ID NO: 530555 - RNA, 19 nt, Homo sapiens
ggaccaacaugcucuacua

SEQ ID NO: 530556 - RNA, 19 nt, Homo sapiens
caccaugucuggcuaauuu

SEQ ID NO: 530557 - RNA, 19 nt, Homo sapiens
ggaaugcaguggcacaauu

SEQ ID NO: 530558 - RNA, 19 nt, Homo sapiens
gaacaccagugcucuguca

SEQ ID NO: 530559 - RNA, 19 nt, Homo sapiens
guauguggcuuccauggua

SEQ ID NO: 530560 - RNA, 19 nt, Homo sapiens
cagcaaggaugaagaaaug

SEQ ID NO: 530561 - RNA, 19 nt, Homo sapiens
gcaagaagcaccucacaga

SEQ ID NO: 530562 - RNA, 19 nt, Homo sapiens
ggagagauccugucugugu

SEQ ID NO: 530563 - RNA, 19 nt, Homo sapiens
ggagacuauuuccgaguua

SEQ ID NO: 530564 - RNA, 19 nt, Homo sapiens
ugacgagcauguacaauga

SEQ ID NO: 530565 - RNA, 19 nt, Homo sapiens
gcacaucgccaucgagaga

SEQ ID NO: 530566 - RNA, 19 nt, Homo sapiens
cagaagaucagcucaauug

SEQ ID NO: 530567 - RNA, 19 nt, Homo sapiens
ccaaguagcugggauuaca

SEQ ID NO: 530568 - RNA, 19 nt, Homo sapiens
auacuggcauccucaaaua

SEQ ID NO: 530569 - RNA, 19 nt, Homo sapiens
ugagagaccugugccguuu

SEQ ID NO: 530570 - RNA, 19 nt, Homo sapiens
cuaacagacuuucagguuu

SEQ ID NO: 530571 - RNA, 19 nt, Homo sapiens
agacagaauuucacucuuc

SEQ ID NO: 530572 - RNA, 19 nt, Homo sapiens
ccaaaucugugcuggacaa

SEQ ID NO: 530573 - RNA, 19 nt, Homo sapiens
gccuggagcuguucaaguu

SEQ ID NO: 530574 - RNA, 19 nt, Homo sapiens
uggaggagcucaccaacaa

SEQ ID NO: 530575 - RNA, 19 nt, Homo sapiens
gcucggccuucuuugauuu

SEQ ID NO: 530576 - RNA, 19 nt, Homo sapiens
ccaagugaaucuccuaaca

SEQ ID NO: 530577 - RNA, 19 nt, Homo sapiens
caauugcugugcagguuaa

SEQ ID NO: 530578 - RNA, 19 nt, Homo sapiens
gaaugcaguggcacaauuu

SEQ ID NO: 530579 - RNA, 19 nt, Homo sapiens
caucuaugccgucaugaua

SEQ ID NO: 530580 - RNA, 19 nt, Homo sapiens
gagagauccugucuguguu

SEQ ID NO: 530581 - RNA, 19 nt, Homo sapiens
gaaccacaucccaaaggua

SEQ ID NO: 530582 - RNA, 19 nt, Homo sapiens
uccgagggauucaguauuu

SEQ ID NO: 530583 - RNA, 19 nt, Homo sapiens
gagcauguacaaugagauu

SEQ ID NO: 530584 - RNA, 19 nt, Homo sapiens
gguaagaauguuugaaaga

SEQ ID NO: 530585 - RNA, 19 nt, Homo sapiens
uaacagacuuucagguuuu

SEQ ID NO: 530586 - RNA, 19 nt, Homo sapiens
gcacaugcuuccacuccau

SEQ ID NO: 530587 - RNA, 19 nt, Homo sapiens
ggagugcaguggugugauc

SEQ ID NO: 530588 - RNA, 19 nt, Homo sapiens
ucagccaccucaaggagua

SEQ ID NO: 530589 - RNA, 19 nt, Homo sapiens
guggacagcuacagugaga

SEQ ID NO: 530590 - RNA, 19 nt, Homo sapiens
gaaaacaccuuugggaaca

SEQ ID NO: 530591 - RNA, 19 nt, Homo sapiens
ccaaagugcugggauuaca

SEQ ID NO: 530592 - RNA, 19 nt, Homo sapiens
ccaaagugcugggauuaca

SEQ ID NO: 530593 - RNA, 19 nt, Homo sapiens
gaccuggaguucacugaga

SEQ ID NO: 530594 - RNA, 19 nt, Homo sapiens
ggacaagugggacagauuc

SEQ ID NO: 530595 - RNA, 19 nt, Homo sapiens
gcaagaacaucuggaagcu

SEQ ID NO: 530596 - RNA, 19 nt, Homo sapiens
gcugcuggccuauguaauu

SEQ ID NO: 530597 - RNA, 19 nt, Homo sapiens
cuucaaggcugucuucauc

SEQ ID NO: 530598 - RNA, 19 nt, Homo sapiens
caccauggcugccuacuac

SEQ ID NO: 530599 - RNA, 19 nt, Homo sapiens
agaagcaccucacagacaa

SEQ ID NO: 530600 - RNA, 19 nt, Homo sapiens
cccgauagcuccuacaaca

SEQ ID NO: 530601 - RNA, 19 nt, Homo sapiens
ggacagcuacagugagaug

SEQ ID NO: 530602 - RNA, 19 nt, Homo sapiens
guaaaugaagcccaggaaa

SEQ ID NO: 530603 - RNA, 19 nt, Homo sapiens
ugagaacuaugacuucaag

SEQ ID NO: 530604 - RNA, 19 nt, Homo sapiens
agaagaugauccugagaga

SEQ ID NO: 530605 - RNA, 19 nt, Homo sapiens
gcaaaccgucccuguguuc

SEQ ID NO: 530606 - RNA, 19 nt, Homo sapiens
gagacagaauuucacucuu

SEQ ID NO: 530607 - RNA, 19 nt, Homo sapiens
aagugaaucuccuaacaga

SEQ ID NO: 530608 - RNA, 19 nt, Homo sapiens
ccugugccguuucauguuu

SEQ ID NO: 530609 - RNA, 19 nt, Homo sapiens
ggaggagucuacuucuuuu

SEQ ID NO: 530610 - RNA, 19 nt, Homo sapiens
ugccucggcuucccaagua

SEQ ID NO: 530611 - RNA, 19 nt, Homo sapiens
gaggagcucaccaacaaga

SEQ ID NO: 530612 - RNA, 19 nt, Homo sapiens
guucaaagacccugagaca

SEQ ID NO: 530613 - RNA, 19 nt, Homo sapiens
gaucgcaggaguaucuuug

SEQ ID NO: 530614 - RNA, 19 nt, Homo sapiens
gugagacugucaacaagau

SEQ ID NO: 530615 - RNA, 19 nt, Homo sapiens
ccaccugccuggagcuguu

SEQ ID NO: 530616 - RNA, 19 nt, Homo sapiens
gcagucguauucucucucu

SEQ ID NO: 530617 - RNA, 19 nt, Homo sapiens
ucaagcgcaucuucuacuu

SEQ ID NO: 530618 - RNA, 19 nt, Homo sapiens
ggaagcagucguauucucu

SEQ ID NO: 530619 - RNA, 19 nt, Homo sapiens
gaggcaagugcucgagaua

SEQ ID NO: 530620 - RNA, 19 nt, Homo sapiens
gcacaggagagcaagaaca

SEQ ID NO: 530621 - RNA, 19 nt, Homo sapiens
cuggagagauccugucugu

SEQ ID NO: 530622 - RNA, 19 nt, Homo sapiens
gcaaggaugaagaaaugga

SEQ ID NO: 530623 - RNA, 19 nt, Homo sapiens
acaccuggcuguuuucuuu

SEQ ID NO: 530624 - RNA, 19 nt, Homo sapiens
ccuaacagacuuucagguu

SEQ ID NO: 530625 - RNA, 19 nt, Homo sapiens
ucacugagaacuaugacuu

SEQ ID NO: 530626 - RNA, 19 nt, Homo sapiens
aagcgcaucuucuacuuca

SEQ ID NO: 530627 - RNA, 19 nt, Homo sapiens
gaagaucagcucaauugcu

SEQ ID NO: 530628 - RNA, 19 nt, Homo sapiens
gggaagcagucguauucuc

SEQ ID NO: 530629 - RNA, 19 nt, Homo sapiens
gugcaguggugugaucuug

SEQ ID NO: 530630 - RNA, 19 nt, Homo sapiens
cuacaucgucuucuuguuc

SEQ ID NO: 530631 - RNA, 19 nt, Homo sapiens
gauuacaggugagcacuac

SEQ ID NO: 530632 - RNA, 19 nt, Homo sapiens
ggcaagugcucgagauagg

SEQ ID NO: 530633 - RNA, 19 nt, Homo sapiens
ccuauguaauucucaccua

SEQ ID NO: 530634 - RNA, 19 nt, Homo sapiens
gugggaagcguucuuggaa

SEQ ID NO: 530635 - RNA, 19 nt, Homo sapiens
agaggacgcugaggucuuc

SEQ ID NO: 530636 - RNA, 19 nt, Homo sapiens
acaaugagauucugauccu

SEQ ID NO: 530637 - RNA, 19 nt, Homo sapiens
ucacagacaacgaguucaa

SEQ ID NO: 530638 - RNA, 19 nt, Homo sapiens
ugaagccguugcucagaau

SEQ ID NO: 530639 - RNA, 19 nt, Homo sapiens
ucaauugcugugcagguua

SEQ ID NO: 530640 - RNA, 19 nt, Homo sapiens
gcagacacuggaagaacuu

SEQ ID NO: 530641 - RNA, 19 nt, Homo sapiens
ucaaggcugucuucaucau

SEQ ID NO: 530642 - RNA, 19 nt, Homo sapiens
uggugacgcugauugaaga

SEQ ID NO: 530643 - RNA, 19 nt, Homo sapiens
gaccugugccguuucaugu

SEQ ID NO: 530644 - RNA, 19 nt, Homo sapiens
cgaugaagacccuguuugu

SEQ ID NO: 530645 - RNA, 19 nt, Homo sapiens
uaggaggagucuacuucuu

SEQ ID NO: 530646 - RNA, 19 nt, Homo sapiens
agagauccugucuguguua

SEQ ID NO: 530647 - RNA, 19 nt, Homo sapiens
uggagacuauuuccgaguu

SEQ ID NO: 530648 - RNA, 19 nt, Homo sapiens
gugacgagcauguacaaug

SEQ ID NO: 530649 - RNA, 19 nt, Homo sapiens
agaagacccucaggcucua

SEQ ID NO: 530650 - RNA, 19 nt, Homo sapiens
cagcagugccuucuucauc

SEQ ID NO: 530651 - RNA, 19 nt, Homo sapiens
gggugagacugucaacaag

SEQ ID NO: 530652 - RNA, 19 nt, Homo sapiens
guuaggaggagucuacuuc

SEQ ID NO: 530653 - RNA, 19 nt, Homo sapiens
caucuucuacuucaacuuc

SEQ ID NO: 530654 - RNA, 19 nt, Homo sapiens
ggucuuggccuauauucuc

SEQ ID NO: 530655 - RNA, 19 nt, Homo sapiens
ggaccaacaugcucuacua

SEQ ID NO: 530656 - RNA, 19 nt, Homo sapiens
caacgccgcugacaaagaa

SEQ ID NO: 530657 - RNA, 19 nt, Homo sapiens
caccaugucuggcuaauuu

SEQ ID NO: 530658 - RNA, 19 nt, Homo sapiens
ggaaugcaguggcacaauu

SEQ ID NO: 530659 - RNA, 19 nt, Homo sapiens
gaacaccagugcucuguca

SEQ ID NO: 530660 - RNA, 19 nt, Homo sapiens
guauguggcuuccauggua

SEQ ID NO: 530661 - RNA, 19 nt, Homo sapiens
cagcaaggaugaagaaaug

SEQ ID NO: 530662 - RNA, 19 nt, Homo sapiens
gcaagaagcaccucacaga

SEQ ID NO: 530663 - RNA, 19 nt, Homo sapiens
caguauagauucagcguuu

SEQ ID NO: 530664 - RNA, 19 nt, Homo sapiens
ggagagauccugucugugu

SEQ ID NO: 530665 - RNA, 19 nt, Homo sapiens
ggagacuauuuccgaguua

SEQ ID NO: 530666 - RNA, 19 nt, Homo sapiens
caaagaacauugccgaaag

SEQ ID NO: 530667 - RNA, 19 nt, Homo sapiens
ugacgagcauguacaauga

SEQ ID NO: 530668 - RNA, 19 nt, Homo sapiens
gcacaucgccaucgagaga

SEQ ID NO: 530669 - RNA, 19 nt, Homo sapiens
cagaagaucagcucaauug

SEQ ID NO: 530670 - RNA, 19 nt, Homo sapiens
ccaaguagcugggauuaca

SEQ ID NO: 530671 - RNA, 19 nt, Homo sapiens
auacuggcauccucaaaua

SEQ ID NO: 530672 - RNA, 19 nt, Homo sapiens
ugagagaccugugccguuu

SEQ ID NO: 530673 - RNA, 19 nt, Homo sapiens
cuaacagacuuucagguuu

SEQ ID NO: 530674 - RNA, 19 nt, Homo sapiens
agacagaauuucacucuuc

SEQ ID NO: 530675 - RNA, 19 nt, Homo sapiens
ccaaaucugugcuggacaa

SEQ ID NO: 530676 - RNA, 19 nt, Homo sapiens
gccuggagcuguucaaguu

SEQ ID NO: 530677 - RNA, 19 nt, Homo sapiens
uggaggagcucaccaacaa

SEQ ID NO: 530678 - RNA, 19 nt, Homo sapiens
gcucggccuucuuugauuu

SEQ ID NO: 530679 - RNA, 19 nt, Homo sapiens
ccaagugaaucuccuaaca

SEQ ID NO: 530680 - RNA, 19 nt, Homo sapiens
caauugcugugcagguuaa

SEQ ID NO: 530681 - RNA, 19 nt, Homo sapiens
gaaugcaguggcacaauuu

SEQ ID NO: 530682 - RNA, 19 nt, Homo sapiens
caucuaugccgucaugaua

SEQ ID NO: 530683 - RNA, 19 nt, Homo sapiens
gagagauccugucuguguu

SEQ ID NO: 530684 - RNA, 19 nt, Homo sapiens
gaaccacaucccaaaggua

SEQ ID NO: 530685 - RNA, 19 nt, Homo sapiens
uccgagggauucaguauuu

SEQ ID NO: 530686 - RNA, 19 nt, Homo sapiens
gagcauguacaaugagauu

SEQ ID NO: 530687 - RNA, 19 nt, Homo sapiens
gguaagaauguuugaaaga

SEQ ID NO: 530688 - RNA, 19 nt, Homo sapiens
uaacagacuuucagguuuu

SEQ ID NO: 530689 - RNA, 19 nt, Homo sapiens
gcacaugcuuccacuccau

SEQ ID NO: 530690 - RNA, 19 nt, Homo sapiens
ggagugcaguggugugauc

SEQ ID NO: 530691 - RNA, 19 nt, Homo sapiens
ucagccaccucaaggagua

SEQ ID NO: 530692 - RNA, 19 nt, Homo sapiens
guggacagcuacagugaga

SEQ ID NO: 530693 - RNA, 19 nt, Homo sapiens
gaaaacaccuuugggaaca

SEQ ID NO: 530694 - RNA, 19 nt, Homo sapiens
ccaaagugcugggauuaca

SEQ ID NO: 530695 - RNA, 19 nt, Homo sapiens
ccaaagugcugggauuaca

SEQ ID NO: 530696 - RNA, 19 nt, Homo sapiens
gaccuggaguucacugaga

SEQ ID NO: 530697 - RNA, 19 nt, Homo sapiens
ggacaagugggacagauuc

SEQ ID NO: 530698 - RNA, 19 nt, Homo sapiens
gcaagaacaucuggaagcu

SEQ ID NO: 530699 - RNA, 19 nt, Homo sapiens
gcugcuggccuauguaauu

SEQ ID NO: 530700 - RNA, 19 nt, Homo sapiens
cuucaaggcugucuucauc

SEQ ID NO: 530701 - RNA, 19 nt, Homo sapiens
caccauggcugccuacuac

SEQ ID NO: 530702 - RNA, 19 nt, Homo sapiens
agaagcaccucacagacaa

SEQ ID NO: 530703 - RNA, 19 nt, Homo sapiens
cccgauagcuccuacaaca

SEQ ID NO: 530704 - RNA, 19 nt, Homo sapiens
ggacagcuacagugagaug

SEQ ID NO: 530705 - RNA, 19 nt, Homo sapiens
guaaaugaagcccaggaaa

SEQ ID NO: 530706 - RNA, 19 nt, Homo sapiens
ugagaacuaugacuucaag

SEQ ID NO: 530707 - RNA, 19 nt, Homo sapiens
agaagaugauccugagaga

SEQ ID NO: 530708 - RNA, 19 nt, Homo sapiens
gagacagaauuucacucuu

SEQ ID NO: 530709 - RNA, 19 nt, Homo sapiens
aagugaaucuccuaacaga

SEQ ID NO: 530710 - RNA, 19 nt, Homo sapiens
gcaacgccgcugacaaaga

SEQ ID NO: 530711 - RNA, 19 nt, Homo sapiens
ccugugccguuucauguuu

SEQ ID NO: 530712 - RNA, 19 nt, Homo sapiens
ggaggagucuacuucuuuu

SEQ ID NO: 530713 - RNA, 19 nt, Homo sapiens
ugccucggcuucccaagua

SEQ ID NO: 530714 - RNA, 19 nt, Homo sapiens
gaggagcucaccaacaaga

SEQ ID NO: 530715 - RNA, 19 nt, Homo sapiens
guucaaagacccugagaca

SEQ ID NO: 530716 - RNA, 19 nt, Homo sapiens
gaucgcaggaguaucuuug

SEQ ID NO: 530717 - RNA, 19 nt, Homo sapiens
gugagacugucaacaagau

SEQ ID NO: 530718 - RNA, 19 nt, Homo sapiens
ccaccugccuggagcuguu

SEQ ID NO: 530719 - RNA, 19 nt, Homo sapiens
ucaagcgcaucuucuacuu

SEQ ID NO: 530720 - RNA, 19 nt, Homo sapiens
gaggcaagugcucgagaua

SEQ ID NO: 530721 - RNA, 19 nt, Homo sapiens
gcacaggagagcaagaaca

SEQ ID NO: 530722 - RNA, 19 nt, Homo sapiens
cuggagagauccugucugu

SEQ ID NO: 530723 - RNA, 19 nt, Homo sapiens
gcaaggaugaagaaaugga

SEQ ID NO: 530724 - RNA, 19 nt, Homo sapiens
acaccuggcuguuuucuuu

SEQ ID NO: 530725 - RNA, 19 nt, Homo sapiens
ccuaacagacuuucagguu

SEQ ID NO: 530726 - RNA, 19 nt, Homo sapiens
ucacugagaacuaugacuu

SEQ ID NO: 530727 - RNA, 19 nt, Homo sapiens
aagcgcaucuucuacuuca

SEQ ID NO: 530728 - RNA, 19 nt, Homo sapiens
gaagaucagcucaauugcu

SEQ ID NO: 530729 - RNA, 19 nt, Homo sapiens
gugcaguggugugaucuug

SEQ ID NO: 530730 - RNA, 19 nt, Homo sapiens
cuacaucgucuucuuguuc

SEQ ID NO: 530731 - RNA, 19 nt, Homo sapiens
acaaagaacauugccgaaa

SEQ ID NO: 530732 - RNA, 19 nt, Homo sapiens
gauuacaggugagcacuac

SEQ ID NO: 530733 - RNA, 19 nt, Homo sapiens
ggcaagugcucgagauagg

SEQ ID NO: 530734 - RNA, 19 nt, Homo sapiens
ccuauguaauucucaccua

SEQ ID NO: 530735 - RNA, 19 nt, Homo sapiens
aggcaacgccgcugacaaa

SEQ ID NO: 530736 - RNA, 19 nt, Homo sapiens
gugggaagcguucuuggaa

SEQ ID NO: 530737 - RNA, 19 nt, Homo sapiens
agaggacgcugaggucuuc

SEQ ID NO: 530738 - RNA, 19 nt, Homo sapiens
aaagaacauugccgaaagg

SEQ ID NO: 530739 - RNA, 19 nt, Homo sapiens
acaaugagauucugauccu

SEQ ID NO: 530740 - RNA, 19 nt, Homo sapiens
ucacagacaacgaguucaa

SEQ ID NO: 530741 - RNA, 19 nt, Homo sapiens
ugaagccguugcucagaau

SEQ ID NO: 530742 - RNA, 19 nt, Homo sapiens
ucaauugcugugcagguua

SEQ ID NO: 530743 - RNA, 19 nt, Homo sapiens
gcagacacuggaagaacuu

SEQ ID NO: 530744 - RNA, 19 nt, Homo sapiens
ucaaggcugucuucaucau

SEQ ID NO: 530745 - RNA, 19 nt, Homo sapiens
uggugacgcugauugaaga

SEQ ID NO: 530746 - RNA, 19 nt, Homo sapiens
gaccugugccguuucaugu

SEQ ID NO: 530747 - RNA, 19 nt, Homo sapiens
cgaugaagacccuguuugu

SEQ ID NO: 530748 - RNA, 19 nt, Homo sapiens
uaggaggagucuacuucuu

SEQ ID NO: 530749 - RNA, 19 nt, Homo sapiens
agagauccugucuguguua

SEQ ID NO: 530750 - RNA, 19 nt, Homo sapiens
uggagacuauuuccgaguu

SEQ ID NO: 530751 - RNA, 19 nt, Homo sapiens
gugacgagcauguacaaug

SEQ ID NO: 530752 - RNA, 19 nt, Homo sapiens
agaagacccucaggcucua

SEQ ID NO: 530753 - RNA, 19 nt, Homo sapiens
cagcagugccuucuucauc

SEQ ID NO: 530754 - RNA, 19 nt, Homo sapiens
gggugagacugucaacaag

SEQ ID NO: 530755 - RNA, 19 nt, Homo sapiens
ggaccaacaugcucuacua

SEQ ID NO: 530756 - RNA, 19 nt, Homo sapiens
caccaugucuggcuaauuu

SEQ ID NO: 530757 - RNA, 19 nt, Homo sapiens
ggaaugcaguggcacaauu

SEQ ID NO: 530758 - RNA, 19 nt, Homo sapiens
gacaagcaguccuuacuuu

SEQ ID NO: 530759 - RNA, 19 nt, Homo sapiens
gaacaccagugcucuguca

SEQ ID NO: 530760 - RNA, 19 nt, Homo sapiens
guauguggcuuccauggua

SEQ ID NO: 530761 - RNA, 19 nt, Homo sapiens
cagcaaggaugaagaaaug

SEQ ID NO: 530762 - RNA, 19 nt, Homo sapiens
gcaagaagcaccucacaga

SEQ ID NO: 530763 - RNA, 19 nt, Homo sapiens
ggagagauccugucugugu

SEQ ID NO: 530764 - RNA, 19 nt, Homo sapiens
ggagacuauuuccgaguua

SEQ ID NO: 530765 - RNA, 19 nt, Homo sapiens
ugacgagcauguacaauga

SEQ ID NO: 530766 - RNA, 19 nt, Homo sapiens
gcacaucgccaucgagaga

SEQ ID NO: 530767 - RNA, 19 nt, Homo sapiens
cagaagaucagcucaauug

SEQ ID NO: 530768 - RNA, 19 nt, Homo sapiens
ccaaguagcugggauuaca

SEQ ID NO: 530769 - RNA, 19 nt, Homo sapiens
auacuggcauccucaaaua

SEQ ID NO: 530770 - RNA, 19 nt, Homo sapiens
ugagagaccugugccguuu

SEQ ID NO: 530771 - RNA, 19 nt, Homo sapiens
cuaacagacuuucagguuu

SEQ ID NO: 530772 - RNA, 19 nt, Homo sapiens
uggaaacacuucaguucua

SEQ ID NO: 530773 - RNA, 19 nt, Homo sapiens
agacagaauuucacucuuc

SEQ ID NO: 530774 - RNA, 19 nt, Homo sapiens
ccaaaucugugcuggacaa

SEQ ID NO: 530775 - RNA, 19 nt, Homo sapiens
gccuggagcuguucaaguu

SEQ ID NO: 530776 - RNA, 19 nt, Homo sapiens
uggaggagcucaccaacaa

SEQ ID NO: 530777 - RNA, 19 nt, Homo sapiens
gcucggccuucuuugauuu

SEQ ID NO: 530778 - RNA, 19 nt, Homo sapiens
ccaagugaaucuccuaaca

SEQ ID NO: 530779 - RNA, 19 nt, Homo sapiens
caauugcugugcagguuaa

SEQ ID NO: 530780 - RNA, 19 nt, Homo sapiens
gaaugcaguggcacaauuu

SEQ ID NO: 530781 - RNA, 19 nt, Homo sapiens
ggaaacacuucaguucuag

SEQ ID NO: 530782 - RNA, 19 nt, Homo sapiens
caucuaugccgucaugaua

SEQ ID NO: 530783 - RNA, 19 nt, Homo sapiens
gagagauccugucuguguu

SEQ ID NO: 530784 - RNA, 19 nt, Homo sapiens
gaaccacaucccaaaggua

SEQ ID NO: 530785 - RNA, 19 nt, Homo sapiens
uccgagggauucaguauuu

SEQ ID NO: 530786 - RNA, 19 nt, Homo sapiens
gagcauguacaaugagauu

SEQ ID NO: 530787 - RNA, 19 nt, Homo sapiens
gguaagaauguuugaaaga

SEQ ID NO: 530788 - RNA, 19 nt, Homo sapiens
uaacagacuuucagguuuu

SEQ ID NO: 530789 - RNA, 19 nt, Homo sapiens
gcacaugcuuccacuccau

SEQ ID NO: 530790 - RNA, 19 nt, Homo sapiens
ggagugcaguggugugauc

SEQ ID NO: 530791 - RNA, 19 nt, Homo sapiens
ucagccaccucaaggagua

SEQ ID NO: 530792 - RNA, 19 nt, Homo sapiens
guggacagcuacagugaga

SEQ ID NO: 530793 - RNA, 19 nt, Homo sapiens
gaaaacaccuuugggaaca

SEQ ID NO: 530794 - RNA, 19 nt, Homo sapiens
ccaaagugcugggauuaca

SEQ ID NO: 530795 - RNA, 19 nt, Homo sapiens
ccaaagugcugggauuaca

SEQ ID NO: 530796 - RNA, 19 nt, Homo sapiens
gcagcgcggugguuaucaa

SEQ ID NO: 530797 - RNA, 19 nt, Homo sapiens
gaccuggaguucacugaga

SEQ ID NO: 530798 - RNA, 19 nt, Homo sapiens
ggacaagugggacagauuc

SEQ ID NO: 530799 - RNA, 19 nt, Homo sapiens
gcaagaacaucuggaagcu

SEQ ID NO: 530800 - RNA, 19 nt, Homo sapiens
gcugcuggccuauguaauu

SEQ ID NO: 530801 - RNA, 19 nt, Homo sapiens
cuucaaggcugucuucauc

SEQ ID NO: 530802 - RNA, 19 nt, Homo sapiens
caccauggcugccuacuac

SEQ ID NO: 530803 - RNA, 19 nt, Homo sapiens
agaagcaccucacagacaa

SEQ ID NO: 530804 - RNA, 19 nt, Homo sapiens
cccgauagcuccuacaaca

SEQ ID NO: 530805 - RNA, 19 nt, Homo sapiens
ggacagcuacagugagaug

SEQ ID NO: 530806 - RNA, 19 nt, Homo sapiens
guaaaugaagcccaggaaa

SEQ ID NO: 530807 - RNA, 19 nt, Homo sapiens
ugagaacuaugacuucaag

SEQ ID NO: 530808 - RNA, 19 nt, Homo sapiens
agaagaugauccugagaga

SEQ ID NO: 530809 - RNA, 19 nt, Homo sapiens
gagacagaauuucacucuu

SEQ ID NO: 530810 - RNA, 19 nt, Homo sapiens
aagugaaucuccuaacaga

SEQ ID NO: 530811 - RNA, 19 nt, Homo sapiens
ccugugccguuucauguuu

SEQ ID NO: 530812 - RNA, 19 nt, Homo sapiens
ggaggagucuacuucuuuu

SEQ ID NO: 530813 - RNA, 19 nt, Homo sapiens
ugccucggcuucccaagua

SEQ ID NO: 530814 - RNA, 19 nt, Homo sapiens
gaggagcucaccaacaaga

SEQ ID NO: 530815 - RNA, 19 nt, Homo sapiens
guucaaagacccugagaca

SEQ ID NO: 530816 - RNA, 19 nt, Homo sapiens
gaucgcaggaguaucuuug

SEQ ID NO: 530817 - RNA, 19 nt, Homo sapiens
gugagacugucaacaagau

SEQ ID NO: 530818 - RNA, 19 nt, Homo sapiens
ccaccugccuggagcuguu

SEQ ID NO: 530819 - RNA, 19 nt, Homo sapiens
ucaagcgcaucuucuacuu

SEQ ID NO: 530820 - RNA, 19 nt, Homo sapiens
gaggcaagugcucgagaua

SEQ ID NO: 530821 - RNA, 19 nt, Homo sapiens
gcacaggagagcaagaaca

SEQ ID NO: 530822 - RNA, 19 nt, Homo sapiens
cuggagagauccugucugu

SEQ ID NO: 530823 - RNA, 19 nt, Homo sapiens
gcaaggaugaagaaaugga

SEQ ID NO: 530824 - RNA, 19 nt, Homo sapiens
acaccuggcuguuuucuuu

SEQ ID NO: 530825 - RNA, 19 nt, Homo sapiens
ccuaacagacuuucagguu

SEQ ID NO: 530826 - RNA, 19 nt, Homo sapiens
gcagcaaguuggaguuuug

SEQ ID NO: 530827 - RNA, 19 nt, Homo sapiens
ucacugagaacuaugacuu

SEQ ID NO: 530828 - RNA, 19 nt, Homo sapiens
aagcgcaucuucuacuuca

SEQ ID NO: 530829 - RNA, 19 nt, Homo sapiens
gaagaucagcucaauugcu

SEQ ID NO: 530830 - RNA, 19 nt, Homo sapiens
gugcaguggugugaucuug

SEQ ID NO: 530831 - RNA, 19 nt, Homo sapiens
cuacaucgucuucuuguuc

SEQ ID NO: 530832 - RNA, 19 nt, Homo sapiens
gauuacaggugagcacuac

SEQ ID NO: 530833 - RNA, 19 nt, Homo sapiens
ggcaagugcucgagauagg

SEQ ID NO: 530834 - RNA, 19 nt, Homo sapiens
ccuauguaauucucaccua

SEQ ID NO: 530835 - RNA, 19 nt, Homo sapiens
gugggaagcguucuuggaa

SEQ ID NO: 530836 - RNA, 19 nt, Homo sapiens
agaggacgcugaggucuuc

SEQ ID NO: 530837 - RNA, 19 nt, Homo sapiens
acaaugagauucugauccu

SEQ ID NO: 530838 - RNA, 19 nt, Homo sapiens
ucacagacaacgaguucaa

SEQ ID NO: 530839 - RNA, 19 nt, Homo sapiens
ugaagccguugcucagaau

SEQ ID NO: 530840 - RNA, 19 nt, Homo sapiens
ucaauugcugugcagguua

SEQ ID NO: 530841 - RNA, 19 nt, Homo sapiens
gcagacacuggaagaacuu

SEQ ID NO: 530842 - RNA, 19 nt, Homo sapiens
ucaaggcugucuucaucau

SEQ ID NO: 530843 - RNA, 19 nt, Homo sapiens
uggugacgcugauugaaga

SEQ ID NO: 530844 - RNA, 19 nt, Homo sapiens
gaccugugccguuucaugu

SEQ ID NO: 530845 - RNA, 19 nt, Homo sapiens
cgaugaagacccuguuugu

SEQ ID NO: 530846 - RNA, 19 nt, Homo sapiens
uaggaggagucuacuucuu

SEQ ID NO: 530847 - RNA, 19 nt, Homo sapiens
agagauccugucuguguua

SEQ ID NO: 530848 - RNA, 19 nt, Homo sapiens
uggagacuauuuccgaguu

SEQ ID NO: 530849 - RNA, 19 nt, Homo sapiens
gugacgagcauguacaaug

SEQ ID NO: 530850 - RNA, 19 nt, Homo sapiens
agaagacccucaggcucua

SEQ ID NO: 530851 - RNA, 19 nt, Homo sapiens
gagguucaguccuggaaac

SEQ ID NO: 530852 - RNA, 19 nt, Homo sapiens
cagcagugccuucuucauc

SEQ ID NO: 530853 - RNA, 19 nt, Homo sapiens
gggugagacugucaacaag

SEQ ID NO: 530854 - RNA, 19 nt, Homo sapiens
guuaggaggagucuacuuc

SEQ ID NO: 530855 - RNA, 19 nt, Homo sapiens
gaaagagaguccagaagua

SEQ ID NO: 530856 - RNA, 19 nt, Homo sapiens
gaaaaugccucguguaaaa

SEQ ID NO: 530857 - RNA, 19 nt, Homo sapiens
caaggaaccugguguugaa

SEQ ID NO: 530858 - RNA, 19 nt, Homo sapiens
caggugaaauugccaaaua

SEQ ID NO: 530859 - RNA, 19 nt, Homo sapiens
gaaaguaggauuacccauu

SEQ ID NO: 530860 - RNA, 19 nt, Homo sapiens
aaacaaaccaggugaaauu

SEQ ID NO: 530861 - RNA, 19 nt, Homo sapiens
ggaauggaaaguaggauua

SEQ ID NO: 530862 - RNA, 19 nt, Homo sapiens
gaaagaaauugaagaaagc

SEQ ID NO: 530863 - RNA, 19 nt, Homo sapiens
caaaucuucuucugaacua

SEQ ID NO: 530864 - RNA, 19 nt, Homo sapiens
caaagaagcgaaagaaaga

SEQ ID NO: 530865 - RNA, 19 nt, Homo sapiens
ccaaauacauggaaacagu

SEQ ID NO: 530866 - RNA, 19 nt, Homo sapiens
agaaggaguucauaaagaa

SEQ ID NO: 530867 - RNA, 19 nt, Homo sapiens
cagaaggaguucauaaaga

SEQ ID NO: 530868 - RNA, 19 nt, Homo sapiens
ccucaaaucuucuucugaa

SEQ ID NO: 530869 - RNA, 19 nt, Homo sapiens
gcagaacaauuugcaguug

SEQ ID NO: 530870 - RNA, 19 nt, Homo sapiens
uaaggaugauggcaaauug

SEQ ID NO: 530871 - RNA, 19 nt, Homo sapiens
aaaguaggauuacccauug

SEQ ID NO: 530872 - RNA, 19 nt, Homo sapiens
gaggauaauuugaaagauc

SEQ ID NO: 530873 - RNA, 19 nt, Homo sapiens
caaggaggcuuuggcugua

SEQ ID NO: 530874 - RNA, 19 nt, Homo sapiens
gaauggagguuugaaagca

SEQ ID NO: 530875 - RNA, 19 nt, Homo sapiens
ggaaacagugaaauuacua

SEQ ID NO: 530876 - RNA, 19 nt, Homo sapiens
gcaguuggagagauaauaa

SEQ ID NO: 530877 - RNA, 19 nt, Homo sapiens
ggagugaccuucagaaaau

SEQ ID NO: 530878 - RNA, 19 nt, Homo sapiens
gguuauacuccuuaaguua

SEQ ID NO: 530879 - RNA, 19 nt, Homo sapiens
uaacaaagaagcgaaagaa

SEQ ID NO: 530880 - RNA, 19 nt, Homo sapiens
cagagcaaauucagaaaug

SEQ ID NO: 530881 - RNA, 19 nt, Homo sapiens
gcaaggaaccugguguuga

SEQ ID NO: 530882 - RNA, 19 nt, Homo sapiens
cauggaaacagugaaauua

SEQ ID NO: 530883 - RNA, 19 nt, Homo sapiens
gaagcgaaagaaagaaauu

SEQ ID NO: 530884 - RNA, 19 nt, Homo sapiens
uuacuagacuacacugaaa

SEQ ID NO: 530885 - RNA, 19 nt, Homo sapiens
gcuuaagaauucuggauau

SEQ ID NO: 530886 - RNA, 19 nt, Homo sapiens
ugaugcaccuuguguugua

SEQ ID NO: 530887 - RNA, 19 nt, Homo sapiens
auacagacccguucaagaa

SEQ ID NO: 530888 - RNA, 19 nt, Homo sapiens
gauacggaauggucaaaca

SEQ ID NO: 530889 - RNA, 19 nt, Homo sapiens
auucagaaauggauucgua

SEQ ID NO: 530890 - RNA, 19 nt, Homo sapiens
ggagagauaauaacugaca

SEQ ID NO: 530891 - RNA, 19 nt, Homo sapiens
uuaaggaaaugcaaagcuu

SEQ ID NO: 530892 - RNA, 19 nt, Homo sapiens
ggagaauggagguuugaaa

SEQ ID NO: 530893 - RNA, 19 nt, Homo sapiens
caaauuggaccucaguguu

SEQ ID NO: 530894 - RNA, 19 nt, Homo sapiens
agagacaucuugcagaaca

SEQ ID NO: 530895 - RNA, 19 nt, Homo sapiens
auacucauguguucagaaa

SEQ ID NO: 530896 - RNA, 19 nt, Homo sapiens
aaagagaguccagaaguaa

SEQ ID NO: 530897 - RNA, 19 nt, Homo sapiens
gaaccugguguugaagaua

SEQ ID NO: 530898 - RNA, 19 nt, Homo sapiens
gggaggauaauuugaaaga

SEQ ID NO: 530899 - RNA, 19 nt, Homo sapiens
cgauggcacuauugaauuc

SEQ ID NO: 530900 - RNA, 19 nt, Homo sapiens
ggucuggucuacaugacaa

SEQ ID NO: 530901 - RNA, 19 nt, Homo sapiens
uuggagagauaauaacuga

SEQ ID NO: 530902 - RNA, 19 nt, Homo sapiens
guaaggaugauggcaaauu

SEQ ID NO: 530903 - RNA, 19 nt, Homo sapiens
uagauuauggccuugcuua

SEQ ID NO: 530904 - RNA, 19 nt, Homo sapiens
uaucaaggccucaaaucuu

SEQ ID NO: 530905 - RNA, 19 nt, Homo sapiens
gcaaauuggaccucagugu

SEQ ID NO: 530906 - RNA, 19 nt, Homo sapiens
ugaaauugccaaauacaug

SEQ ID NO: 530907 - RNA, 19 nt, Homo sapiens
ggaaccugguguugaagau

SEQ ID NO: 530908 - RNA, 19 nt, Homo sapiens
gagaauggagguuugaaag

SEQ ID NO: 530909 - RNA, 19 nt, Homo sapiens
caaagaagaccccaaaaga

SEQ ID NO: 530910 - RNA, 19 nt, Homo sapiens
ggucaaacacacagacaga

SEQ ID NO: 530911 - RNA, 19 nt, Homo sapiens
gaagauacggaauggucaa

SEQ ID NO: 530912 - RNA, 19 nt, Homo sapiens
gcgaaagaaagaaauugaa

SEQ ID NO: 530913 - RNA, 19 nt, Homo sapiens
gaaauuacuagacuacacu

SEQ ID NO: 530914 - RNA, 19 nt, Homo sapiens
ggaggauaauuugaaagau

SEQ ID NO: 530915 - RNA, 19 nt, Homo sapiens
ggaacccagugacaaugga

SEQ ID NO: 530916 - RNA, 19 nt, Homo sapiens
cgagguggaauuaaugauu

SEQ ID NO: 530917 - RNA, 19 nt, Homo sapiens
gagcaaauucagaaaugga

SEQ ID NO: 530918 - RNA, 19 nt, Homo sapiens
guacugcccagaaggaguu

SEQ ID NO: 530919 - RNA, 19 nt, Homo sapiens
ggcuuuggcuguauauauc

SEQ ID NO: 530920 - RNA, 19 nt, Homo sapiens
ccagaaagagaguccagaa

SEQ ID NO: 530921 - RNA, 19 nt, Homo sapiens
aaguaaggaugauggcaaa

SEQ ID NO: 530922 - RNA, 19 nt, Homo sapiens
auacuugguuauugcauga

SEQ ID NO: 530923 - RNA, 19 nt, Homo sapiens
guaccuggguguuccuaag

SEQ ID NO: 530924 - RNA, 19 nt, Homo sapiens
gcaaauucagaaauggauu

SEQ ID NO: 530925 - RNA, 19 nt, Homo sapiens
uugcugauaugaauucuuc

SEQ ID NO: 530926 - RNA, 19 nt, Homo sapiens
acaaagaagcgaaagaaag

SEQ ID NO: 530927 - RNA, 19 nt, Homo sapiens
gaaggaguucauaaagaau

SEQ ID NO: 530928 - RNA, 19 nt, Homo sapiens
gcccagaaggaguucauaa

SEQ ID NO: 530929 - RNA, 19 nt, Homo sapiens
agguguacuugguagauua

SEQ ID NO: 530930 - RNA, 19 nt, Homo sapiens
gcagugaugcaccuugugu

SEQ ID NO: 530931 - RNA, 19 nt, Homo sapiens
gaaacagugaaauuacuag

SEQ ID NO: 530932 - RNA, 19 nt, Homo sapiens
ccagaaggaguucauaaag

SEQ ID NO: 530933 - RNA, 19 nt, Homo sapiens
guaugugcauggagauauc

SEQ ID NO: 530934 - RNA, 19 nt, Homo sapiens
gaugcaccuuguguuguaa

SEQ ID NO: 530935 - RNA, 19 nt, Homo sapiens
cagagucaguuggcaguga

SEQ ID NO: 530936 - RNA, 19 nt, Homo sapiens
cagaugcugugaaccagau

SEQ ID NO: 530937 - RNA, 19 nt, Homo sapiens
guccagaaguaauucagau

SEQ ID NO: 530938 - RNA, 19 nt, Homo sapiens
agaaagagaguccagaagu

SEQ ID NO: 530939 - RNA, 19 nt, Homo sapiens
cgaaagaaagaaauugaag

SEQ ID NO: 530940 - RNA, 19 nt, Homo sapiens
caauaacaaagaagcgaaa

SEQ ID NO: 530941 - RNA, 19 nt, Homo sapiens
gauaucaaggccucaaauc

SEQ ID NO: 530942 - RNA, 19 nt, Homo sapiens
aaaacugucuugcagcuaa

SEQ ID NO: 530943 - RNA, 19 nt, Homo sapiens
gcacuuuucuaaucauugu

SEQ ID NO: 530944 - RNA, 19 nt, Homo sapiens
aaauuggaccucaguguug

SEQ ID NO: 530945 - RNA, 19 nt, Homo sapiens
acagugaaauuacuagacu

SEQ ID NO: 530946 - RNA, 19 nt, Homo sapiens
caaauucagaaauggauuc

SEQ ID NO: 530947 - RNA, 19 nt, Homo sapiens
cuccuuaaguuaucccaaa

SEQ ID NO: 530948 - RNA, 19 nt, Homo sapiens
agaacaauuugcaguugga

SEQ ID NO: 530949 - RNA, 19 nt, Homo sapiens
ugcaugauccaauggcuua

SEQ ID NO: 530950 - RNA, 19 nt, Homo sapiens
ggaaaugcaaagcuuaaaa

SEQ ID NO: 530951 - RNA, 19 nt, Homo sapiens
gauuauggccuugcuuauc

SEQ ID NO: 530952 - RNA, 19 nt, Homo sapiens
gagacaucuugcagaacaa

SEQ ID NO: 530953 - RNA, 19 nt, Homo sapiens
agagaguccagaaguaauu

SEQ ID NO: 530954 - RNA, 19 nt, Homo sapiens
cagugaaauuacuagacua

SEQ ID NO: 530955 - RNA, 19 nt, Homo sapiens
ggaagaaguuacagauuua

SEQ ID NO: 530956 - RNA, 19 nt, Homo sapiens
gggaagaaguuacagauuu

SEQ ID NO: 530957 - RNA, 19 nt, Homo sapiens
gcaauuagguauccgaaug

SEQ ID NO: 530958 - RNA, 19 nt, Homo sapiens
gaucuggucugacugaauu

SEQ ID NO: 530959 - RNA, 19 nt, Homo sapiens
gcaagguucuggaugauau

SEQ ID NO: 530960 - RNA, 19 nt, Homo sapiens
cacaauagguuaaucgaaa

SEQ ID NO: 530961 - RNA, 19 nt, Homo sapiens
ggaauagauuuacagaaga

SEQ ID NO: 530962 - RNA, 19 nt, Homo sapiens
caaauaaaccagagaaaga

SEQ ID NO: 530963 - RNA, 19 nt, Homo sapiens
ggacuuuggccuacaauuu

SEQ ID NO: 530964 - RNA, 19 nt, Homo sapiens
ggacuuuccuacagauauu

SEQ ID NO: 530965 - RNA, 19 nt, Homo sapiens
caacaaagcaagucaacaa

SEQ ID NO: 530966 - RNA, 19 nt, Homo sapiens
ccgaaauguuguauucuua

SEQ ID NO: 530967 - RNA, 19 nt, Homo sapiens
gaaagacuaggaauagauu

SEQ ID NO: 530968 - RNA, 19 nt, Homo sapiens
gauuggcucuggaggauuu

SEQ ID NO: 530969 - RNA, 19 nt, Homo sapiens
gaaacugauuggauugaug

SEQ ID NO: 530970 - RNA, 19 nt, Homo sapiens
ccagauauauucaagaagu

SEQ ID NO: 530971 - RNA, 19 nt, Homo sapiens
ggagaagacagaaauauca

SEQ ID NO: 530972 - RNA, 19 nt, Homo sapiens
gaaagaugcaagacaugua

SEQ ID NO: 530973 - RNA, 19 nt, Homo sapiens
caaacuuccuauuccauuu

SEQ ID NO: 530974 - RNA, 19 nt, Homo sapiens
gaaagaggagaaacugauu

SEQ ID NO: 530975 - RNA, 19 nt, Homo sapiens
gaacgcaaacaacuugauu

SEQ ID NO: 530976 - RNA, 19 nt, Homo sapiens
ucaccgaaauguuguauuc

SEQ ID NO: 530977 - RNA, 19 nt, Homo sapiens
gaagacagaaauaucaaga

SEQ ID NO: 530978 - RNA, 19 nt, Homo sapiens
guacuggaauauauacaug

SEQ ID NO: 530979 - RNA, 19 nt, Homo sapiens
cauggaaagugcagaaaga

SEQ ID NO: 530980 - RNA, 19 nt, Homo sapiens
gaagaucucaggccagaau

SEQ ID NO: 530981 - RNA, 19 nt, Homo sapiens
cgacgcagcuggagagaag

SEQ ID NO: 530982 - RNA, 19 nt, Homo sapiens
guccagauauauucaagaa

SEQ ID NO: 530983 - RNA, 19 nt, Homo sapiens
ccagaaugguaccuuuaaa

SEQ ID NO: 530984 - RNA, 19 nt, Homo sapiens
uggaggauuuggauugaua

SEQ ID NO: 530985 - RNA, 19 nt, Homo sapiens
caucauaccuguccuuuug

SEQ ID NO: 530986 - RNA, 19 nt, Homo sapiens
uuugaacccucauggaaua

SEQ ID NO: 530987 - RNA, 19 nt, Homo sapiens
gcugugaaauagcccaauu

SEQ ID NO: 530988 - RNA, 19 nt, Homo sapiens
ggaaagacuaggaauagau

SEQ ID NO: 530989 - RNA, 19 nt, Homo sapiens
gcucuucaccgaaauguug

SEQ ID NO: 530990 - RNA, 19 nt, Homo sapiens
ccuacaauuucccaguuua

SEQ ID NO: 530991 - RNA, 19 nt, Homo sapiens
aggagaaacugauuggauu

SEQ ID NO: 530992 - RNA, 19 nt, Homo sapiens
ggauguacuggaauauaua

SEQ ID NO: 530993 - RNA, 19 nt, Homo sapiens
cagaagugaugccaccaaa

SEQ ID NO: 530994 - RNA, 19 nt, Homo sapiens
caagaaccuuugaaugaag

SEQ ID NO: 530995 - RNA, 19 nt, Homo sapiens
ccacaaacaguaucaggaa

SEQ ID NO: 530996 - RNA, 19 nt, Homo sapiens
aaagucaacuguccugcaa

SEQ ID NO: 530997 - RNA, 19 nt, Homo sapiens
aggaauagauuuacagaag

SEQ ID NO: 530998 - RNA, 19 nt, Homo sapiens
agagaaagaugcaagacau

SEQ ID NO: 530999 - RNA, 19 nt, Homo sapiens
acagaaauaucaagagucu

SEQ ID NO: 531000 - RNA, 19 nt, Homo sapiens
agacagaaauaucaagagu

SEQ ID NO: 531001 - RNA, 19 nt, Homo sapiens
ucaagaaaauggcccguua

SEQ ID NO: 531002 - RNA, 19 nt, Homo sapiens
caggaaagcacaaggagaa

SEQ ID NO: 531003 - RNA, 19 nt, Homo sapiens
caaugaagcagcucaggaa

SEQ ID NO: 531004 - RNA, 19 nt, Homo sapiens
guacugggcaagaagauug

SEQ ID NO: 531005 - RNA, 19 nt, Homo sapiens
caaggagaagacagaaaua

SEQ ID NO: 531006 - RNA, 19 nt, Homo sapiens
caaggcacacaauagguua

SEQ ID NO: 531007 - RNA, 19 nt, Homo sapiens
gaagugacguugagauccu

SEQ ID NO: 531008 - RNA, 19 nt, Homo sapiens
uggauguacuggaauauau

SEQ ID NO: 531009 - RNA, 19 nt, Homo sapiens
ccaguuuacucuuagugaa

SEQ ID NO: 531010 - RNA, 19 nt, Homo sapiens
caacauggaaagugcagaa

SEQ ID NO: 531011 - RNA, 19 nt, Homo sapiens
caacaaggcacacaauagg

SEQ ID NO: 531012 - RNA, 19 nt, Homo sapiens
gauagaacgcaaacaacuu

SEQ ID NO: 531013 - RNA, 19 nt, Homo sapiens
aaucagcuauacacaauuc

SEQ ID NO: 531014 - RNA, 19 nt, Homo sapiens
caacuguccugcaauuagg

SEQ ID NO: 531015 - RNA, 19 nt, Homo sapiens
gaauucaagggaagaaguu

SEQ ID NO: 531016 - RNA, 19 nt, Homo sapiens
ggagaaacugauuggauug

SEQ ID NO: 531017 - RNA, 19 nt, Homo sapiens
gaggagaaacugauuggau

SEQ ID NO: 531018 - RNA, 19 nt, Homo sapiens
gagaagacagaaauaucaa

SEQ ID NO: 531019 - RNA, 19 nt, Homo sapiens
ggccuacaauuucccaguu

SEQ ID NO: 531020 - RNA, 19 nt, Homo sapiens
ccacaaauaaaccagagaa

SEQ ID NO: 531021 - RNA, 19 nt, Homo sapiens
agaaauaucaagagucuca

SEQ ID NO: 531022 - RNA, 19 nt, Homo sapiens
aaacugauuggauugauga

SEQ ID NO: 531023 - RNA, 19 nt, Homo sapiens
gcagaaagaggagaaacug

SEQ ID NO: 531024 - RNA, 19 nt, Homo sapiens
agucaacuguccugcaauu

SEQ ID NO: 531025 - RNA, 19 nt, Homo sapiens
gccagaaugguaccuuuaa

SEQ ID NO: 531026 - RNA, 19 nt, Homo sapiens
ggccagaaugguaccuuua

SEQ ID NO: 531027 - RNA, 19 nt, Homo sapiens
aaggcaagguucuggauga

SEQ ID NO: 531028 - RNA, 19 nt, Homo sapiens
cacaaacaguaucaggaaa

SEQ ID NO: 531029 - RNA, 19 nt, Homo sapiens
aauguuggauguacuggaa

SEQ ID NO: 531030 - RNA, 19 nt, Homo sapiens
gccuacaauuucccaguuu

SEQ ID NO: 531031 - RNA, 19 nt, Homo sapiens
gagaaacugauuggauuga

SEQ ID NO: 531032 - RNA, 19 nt, Homo sapiens
gggaacagaaccugaagga

SEQ ID NO: 531033 - RNA, 19 nt, Homo sapiens
ggaaagcacaaggagaaga

SEQ ID NO: 531034 - RNA, 19 nt, Homo sapiens
guaauggaaagacuaggaa

SEQ ID NO: 531035 - RNA, 19 nt, Homo sapiens
ggauagaacgcaaacaacu

SEQ ID NO: 531036 - RNA, 19 nt, Homo sapiens
gaugcaagacauguaguaa

SEQ ID NO: 531037 - RNA, 19 nt, Homo sapiens
acaauucccaaacucauuu

SEQ ID NO: 531038 - RNA, 19 nt, Homo sapiens
gcacaaggagaagacagaa

SEQ ID NO: 531039 - RNA, 19 nt, Homo sapiens
uaaauguccauacuccaaa

SEQ ID NO: 531040 - RNA, 19 nt, Homo sapiens
cuaucaagcccucaagaaa

SEQ ID NO: 531041 - RNA, 19 nt, Homo sapiens
gguucuggaugauauggaa

SEQ ID NO: 531042 - RNA, 19 nt, Homo sapiens
gaagagacaaacgcagaug

SEQ ID NO: 531043 - RNA, 19 nt, Homo sapiens
gcacggggaucacagacuu

SEQ ID NO: 531044 - RNA, 19 nt, Homo sapiens
aaauacacuuccacaguca

SEQ ID NO: 531045 - RNA, 19 nt, Homo sapiens
ucaagagucucaagaaccu

SEQ ID NO: 531046 - RNA, 19 nt, Homo sapiens
gaggauuuggauugauaua

SEQ ID NO: 531047 - RNA, 19 nt, Homo sapiens
gacuuuggccuacaauuuc

SEQ ID NO: 531048 - RNA, 19 nt, Homo sapiens
uaucaagagucucaagaac

SEQ ID NO: 531049 - RNA, 19 nt, Homo sapiens
acaaggagaagacagaaau

SEQ ID NO: 531050 - RNA, 19 nt, Homo sapiens
uguuggauguacuggaaua

SEQ ID NO: 531051 - RNA, 19 nt, Homo sapiens
gagaaagaugcaagacaug

SEQ ID NO: 531052 - RNA, 19 nt, Homo sapiens
gguaauggaaagacuagga

SEQ ID NO: 531053 - RNA, 19 nt, Homo sapiens
gaaguuacagauuuauggu

SEQ ID NO: 531054 - RNA, 19 nt, Homo sapiens
guggauagaacgcaaacaa

SEQ ID NO: 531055 - RNA, 19 nt, Homo sapiens
gaacaaagaugaccagauu

SEQ ID NO: 531056 - RNA, 19 nt, Homo sapiens
gaaaugagcugaugucaau

SEQ ID NO: 531057 - RNA, 19 nt, Homo sapiens
gcucguaucuccuugauua

SEQ ID NO: 531058 - RNA, 19 nt, Homo sapiens
gcaaagaguuauaugacuu

SEQ ID NO: 531059 - RNA, 19 nt, Homo sapiens
uaaauggacuugcuucuug

SEQ ID NO: 531060 - RNA, 19 nt, Homo sapiens
gaaaugugcugcaaagagu

SEQ ID NO: 531061 - RNA, 19 nt, Homo sapiens
gagcgacccuuccauugua

SEQ ID NO: 531062 - RNA, 19 nt, Homo sapiens
gaacugggccuucaauaug

SEQ ID NO: 531063 - RNA, 19 nt, Homo sapiens
ggacuugcuucuuguguuu

SEQ ID NO: 531064 - RNA, 19 nt, Homo sapiens
gcaauaaaugucccaaaua

SEQ ID NO: 531065 - RNA, 19 nt, Homo sapiens
ggguuugccuuaauucuua

SEQ ID NO: 531066 - RNA, 19 nt, Homo sapiens
caaacaaccugccacaaug

SEQ ID NO: 531067 - RNA, 19 nt, Homo sapiens
ggaaagagcuguuuuggau

SEQ ID NO: 531068 - RNA, 19 nt, Homo sapiens
gagcugaugucaaugcuau

SEQ ID NO: 531069 - RNA, 19 nt, Homo sapiens
caucgaggcuaucuacaaa

SEQ ID NO: 531070 - RNA, 19 nt, Homo sapiens
caagauggauaagaacaaa

SEQ ID NO: 531071 - RNA, 19 nt, Homo sapiens
cacagaagcuuguauuauc

SEQ ID NO: 531072 - RNA, 19 nt, Homo sapiens
gcacaaaagucucaauguu

SEQ ID NO: 531073 - RNA, 19 nt, Homo sapiens
ggcaauaaaugucccaaau

SEQ ID NO: 531074 - RNA, 19 nt, Homo sapiens
ucagcaagauggauaagaa

SEQ ID NO: 531075 - RNA, 19 nt, Homo sapiens
ggcuaaaucucgaggaauu

SEQ ID NO: 531076 - RNA, 19 nt, Homo sapiens
ccaaugugguggcaauaaa

SEQ ID NO: 531077 - RNA, 19 nt, Homo sapiens
gaaguucuuuccuuaugga

SEQ ID NO: 531078 - RNA, 19 nt, Homo sapiens
agaguuauaugacuucuug

SEQ ID NO: 531079 - RNA, 19 nt, Homo sapiens
agagacggcuuaagcguuu

SEQ ID NO: 531080 - RNA, 19 nt, Homo sapiens
gugaagagcacagaguuua

SEQ ID NO: 531081 - RNA, 19 nt, Homo sapiens
gcaacaacuuacuaaaucu

SEQ ID NO: 531082 - RNA, 19 nt, Homo sapiens
gugaaguucuuuccuuaug

SEQ ID NO: 531083 - RNA, 19 nt, Homo sapiens
gaggcuaaaucucgaggaa

SEQ ID NO: 531084 - RNA, 19 nt, Homo sapiens
gaaguguauugguuucugu

SEQ ID NO: 531085 - RNA, 19 nt, Homo sapiens
agauuacacuggaugaauu

SEQ ID NO: 531086 - RNA, 19 nt, Homo sapiens
aagcuuguauuaucaguga

SEQ ID NO: 531087 - RNA, 19 nt, Homo sapiens
caauauguaugaccuggau

SEQ ID NO: 531088 - RNA, 19 nt, Homo sapiens
gcagugguacaaaggauuu

SEQ ID NO: 531089 - RNA, 19 nt, Homo sapiens
gauggaaguguauugguuu

SEQ ID NO: 531090 - RNA, 19 nt, Homo sapiens
ccugcuaaaugacuuauug

SEQ ID NO: 531091 - RNA, 19 nt, Homo sapiens
uuggaugaaugcaguauaa

SEQ ID NO: 531092 - RNA, 19 nt, Homo sapiens
ccacagaagcuuguauuau

SEQ ID NO: 531093 - RNA, 19 nt, Homo sapiens
guaucuccuugauuacaua

SEQ ID NO: 531094 - RNA, 19 nt, Homo sapiens
gaguggagaugcuggagau

SEQ ID NO: 531095 - RNA, 19 nt, Homo sapiens
gaagagcacagaguuuaau

SEQ ID NO: 531096 - RNA, 19 nt, Homo sapiens
acagaagcuuguauuauca

SEQ ID NO: 531097 - RNA, 19 nt, Homo sapiens
uguauugguuucuguuuga

SEQ ID NO: 531098 - RNA, 19 nt, Homo sapiens
gcagugcgacauccagaaa

SEQ ID NO: 531099 - RNA, 19 nt, Homo sapiens
gguaggcacugugaucaug

SEQ ID NO: 531100 - RNA, 19 nt, Homo sapiens
gaagcagaauagcaaacug

SEQ ID NO: 531101 - RNA, 19 nt, Homo sapiens
ggacggcaccauugacuuc

SEQ ID NO: 531102 - RNA, 19 nt, Homo sapiens
gcuagcaacaacuuacuaa

SEQ ID NO: 531103 - RNA, 19 nt, Homo sapiens
ggaaguguauugguuucug

SEQ ID NO: 531104 - RNA, 19 nt, Homo sapiens
ucacuacccuccuguaaaa

SEQ ID NO: 531105 - RNA, 19 nt, Homo sapiens
gcaagauggauaagaacaa

SEQ ID NO: 531106 - RNA, 19 nt, Homo sapiens
gcaaagagcgacccuucca

SEQ ID NO: 531107 - RNA, 19 nt, Homo sapiens
uaugugaaguucuuuccuu

SEQ ID NO: 531108 - RNA, 19 nt, Homo sapiens
agcaacaacuuacuaaauc

SEQ ID NO: 531109 - RNA, 19 nt, Homo sapiens
ccuuaauucuuaccucauu

SEQ ID NO: 531110 - RNA, 19 nt, Homo sapiens
ccaugguaauguaacuuaa

SEQ ID NO: 531111 - RNA, 19 nt, Homo sapiens
acaaacaaccugccacaau

SEQ ID NO: 531112 - RNA, 19 nt, Homo sapiens
agauggaaguguauugguu

SEQ ID NO: 531113 - RNA, 19 nt, Homo sapiens
aaagagcgacccuuccauu

SEQ ID NO: 531114 - RNA, 19 nt, Homo sapiens
gcagcgaguagacaagauu

SEQ ID NO: 531115 - RNA, 19 nt, Homo sapiens
gaucaucgaggcuaucuac

SEQ ID NO: 531116 - RNA, 19 nt, Homo sapiens
ggauggugauggcaagauc

SEQ ID NO: 531117 - RNA, 19 nt, Homo sapiens
ugaagagcacagaguuuaa

SEQ ID NO: 531118 - RNA, 19 nt, Homo sapiens
cgacccuuccauuguauua

SEQ ID NO: 531119 - RNA, 19 nt, Homo sapiens
uggauaagaacaaagauga

SEQ ID NO: 531120 - RNA, 19 nt, Homo sapiens
gcagcucuaugugaaguuc

SEQ ID NO: 531121 - RNA, 19 nt, Homo sapiens
uuucaaaggcuuccaaugu

SEQ ID NO: 531122 - RNA, 19 nt, Homo sapiens
ggugaagagcacagaguuu

SEQ ID NO: 531123 - RNA, 19 nt, Homo sapiens
gcugcaaagaguuauauga

SEQ ID NO: 531124 - RNA, 19 nt, Homo sapiens
gacaagauuuucagcaaga

SEQ ID NO: 531125 - RNA, 19 nt, Homo sapiens
gagcacagaguuuaaugag

SEQ ID NO: 531126 - RNA, 19 nt, Homo sapiens
cgagagagaaccacacaca

SEQ ID NO: 531127 - RNA, 19 nt, Homo sapiens
caaagaguuauaugacuuc

SEQ ID NO: 531128 - RNA, 19 nt, Homo sapiens
uugcuuggacuaccuauaa

SEQ ID NO: 531129 - RNA, 19 nt, Homo sapiens
agagagaaccacacacaga

SEQ ID NO: 531130 - RNA, 19 nt, Homo sapiens
uggaggaccuggugaagag

SEQ ID NO: 531131 - RNA, 19 nt, Homo sapiens
guguauugguuucuguuug

SEQ ID NO: 531132 - RNA, 19 nt, Homo sapiens
aaagagcuguuuuggauga

SEQ ID NO: 531133 - RNA, 19 nt, Homo sapiens
gaucuggaaagagcuguuu

SEQ ID NO: 531134 - RNA, 19 nt, Homo sapiens
ugacuucuuguucauguuu

SEQ ID NO: 531135 - RNA, 19 nt, Homo sapiens
gaacucaagcagugguaca

SEQ ID NO: 531136 - RNA, 19 nt, Homo sapiens
gcaaggcgcgauccaagag

SEQ ID NO: 531137 - RNA, 19 nt, Homo sapiens
gagcagcgaguagacaaga

SEQ ID NO: 531138 - RNA, 19 nt, Homo sapiens
gagacggcuuaagcguuua

SEQ ID NO: 531139 - RNA, 19 nt, Homo sapiens
uucaaaggcuuccaaugug

SEQ ID NO: 531140 - RNA, 19 nt, Homo sapiens
gaguucaucugcgcucugu

SEQ ID NO: 531141 - RNA, 19 nt, Homo sapiens
caacuuuggaauuugaaga

SEQ ID NO: 531142 - RNA, 19 nt, Homo sapiens
ccaagugggaggcuaaauc

SEQ ID NO: 531143 - RNA, 19 nt, Homo sapiens
cagcaugccuuccgaaccu

SEQ ID NO: 531144 - RNA, 19 nt, Homo sapiens
augugaaguucuuuccuua

SEQ ID NO: 531145 - RNA, 19 nt, Homo sapiens
uggacuaccuauaaaugga

SEQ ID NO: 531146 - RNA, 19 nt, Homo sapiens
caagugggaggcuaaaucu

SEQ ID NO: 531147 - RNA, 19 nt, Homo sapiens
acacagagacggcuuaagc

SEQ ID NO: 531148 - RNA, 19 nt, Homo sapiens
cauucagucugcagcuauu

SEQ ID NO: 531149 - RNA, 19 nt, Homo sapiens
ugaaguucuuuccuuaugg

SEQ ID NO: 531150 - RNA, 19 nt, Homo sapiens
cagcagcucuaugugaagu

SEQ ID NO: 531151 - RNA, 19 nt, Homo sapiens
cauccaggcucccaaaaga

SEQ ID NO: 531152 - RNA, 19 nt, Homo sapiens
cccaugguaauguaacuua

SEQ ID NO: 531153 - RNA, 19 nt, Homo sapiens
caaagccugggcagaaaug

SEQ ID NO: 531154 - RNA, 19 nt, Homo sapiens
uccaaagccugggcagaaa

SEQ ID NO: 531155 - RNA, 19 nt, Homo sapiens
caacaacuaugaugacuac

SEQ ID NO: 531156 - RNA, 19 nt, Homo sapiens
gggaugggcuggagguuga

SEQ ID NO: 531157 - RNA, 19 nt, Homo sapiens
ccauguggcuguccuuguu

SEQ ID NO: 531158 - RNA, 19 nt, Homo sapiens
gcuaugaacuggacgaaaa

SEQ ID NO: 531159 - RNA, 19 nt, Homo sapiens
gcaaacagagcagcagaaa

SEQ ID NO: 531160 - RNA, 19 nt, Homo sapiens
gagcuuggcaaaggucuua

SEQ ID NO: 531161 - RNA, 19 nt, Homo sapiens
ccaaugagccuucuuucug

SEQ ID NO: 531162 - RNA, 19 nt, Homo sapiens
uaaagcuguugcccaauga

SEQ ID NO: 531163 - RNA, 19 nt, Homo sapiens
gagcgggucuacuucuuca

SEQ ID NO: 531164 - RNA, 19 nt, Homo sapiens
gacaaguacuaccgaguca

SEQ ID NO: 531165 - RNA, 19 nt, Homo sapiens
caaugccacuguccaugaa

SEQ ID NO: 531166 - RNA, 19 nt, Homo sapiens
ggacaagaagugccagugu

SEQ ID NO: 531167 - RNA, 19 nt, Homo sapiens
gaaaaugaacuaagacuca

SEQ ID NO: 531168 - RNA, 19 nt, Homo sapiens
gagccaacaacuaugauga

SEQ ID NO: 531169 - RNA, 19 nt, Homo sapiens
ucacuaugccggaggauga

SEQ ID NO: 531170 - RNA, 19 nt, Homo sapiens
auaaagcuguugcccaaug

SEQ ID NO: 531171 - RNA, 19 nt, Homo sapiens
gcuucaacguggacaagaa

SEQ ID NO: 531172 - RNA, 19 nt, Homo sapiens
gccaggcacugagcuagaa

SEQ ID NO: 531173 - RNA, 19 nt, Homo sapiens
gcacugagggcuucaacgu

SEQ ID NO: 531174 - RNA, 19 nt, Homo sapiens
caaaggcuaccguucacaa

SEQ ID NO: 531175 - RNA, 19 nt, Homo sapiens
ccgaugaccuaaugauucu

SEQ ID NO: 531176 - RNA, 19 nt, Homo sapiens
gggagcgggucuacuucuu

SEQ ID NO: 531177 - RNA, 19 nt, Homo sapiens
ccaggaaugugaccuuugc

SEQ ID NO: 531178 - RNA, 19 nt, Homo sapiens
gaugaccuaaugauucuga

SEQ ID NO: 531179 - RNA, 19 nt, Homo sapiens
caaguacuaccgagucaau

SEQ ID NO: 531180 - RNA, 19 nt, Homo sapiens
gaacccauccagagugucu

SEQ ID NO: 531181 - RNA, 19 nt, Homo sapiens
gugaacccauccagagugu

SEQ ID NO: 531182 - RNA, 19 nt, Homo sapiens
acaagaagugccaguguga

SEQ ID NO: 531183 - RNA, 19 nt, Homo sapiens
gaucaauagcuauguuugg

SEQ ID NO: 531184 - RNA, 19 nt, Homo sapiens
ugaacacuuugccaugaug

SEQ ID NO: 531185 - RNA, 19 nt, Homo sapiens
ccgcaaaggcuaccguuca

SEQ ID NO: 531186 - RNA, 19 nt, Homo sapiens
acaaugccacuguccauga

SEQ ID NO: 531187 - RNA, 19 nt, Homo sapiens
gagcugcugcacagacuau

SEQ ID NO: 531188 - RNA, 19 nt, Homo sapiens
gcaaggcuuuguuaauccu

SEQ ID NO: 531189 - RNA, 19 nt, Homo sapiens
caucagagcggagacuuca

SEQ ID NO: 531190 - RNA, 19 nt, Homo sapiens
ggaucaauagcuauguuug

SEQ ID NO: 531191 - RNA, 19 nt, Homo sapiens
uuugaacacuuugccauga

SEQ ID NO: 531192 - RNA, 19 nt, Homo sapiens
ccagucaggaggaguguga

SEQ ID NO: 531193 - RNA, 19 nt, Homo sapiens
gaaaaggcaguuccucuuc

SEQ ID NO: 531194 - RNA, 19 nt, Homo sapiens
aaacagagcagcagaaaag

SEQ ID NO: 531195 - RNA, 19 nt, Homo sapiens
ccaacaacuaugaugacua

SEQ ID NO: 531196 - RNA, 19 nt, Homo sapiens
agucaguacuggcgcuuug

SEQ ID NO: 531197 - RNA, 19 nt, Homo sapiens
guacacggucuaugacgau

SEQ ID NO: 531198 - RNA, 19 nt, Homo sapiens
caucuucgagcuucucuuc

SEQ ID NO: 531199 - RNA, 19 nt, Homo sapiens
ggagcgggucuacuucuuc

SEQ ID NO: 531200 - RNA, 19 nt, Homo sapiens
guacuggcgcuuugaggau

SEQ ID NO: 531201 - RNA, 19 nt, Homo sapiens
ucugaaaccugaggaagag

SEQ ID NO: 531202 - RNA, 19 nt, Homo sapiens
guacuaccgagucaaucuu

SEQ ID NO: 531203 - RNA, 19 nt, Homo sapiens
agacagccccaguucauua

SEQ ID NO: 531204 - RNA, 19 nt, Homo sapiens
ggagccaacaacuaugaug

SEQ ID NO: 531205 - RNA, 19 nt, Homo sapiens
gcuggagguugagcaaaca

SEQ ID NO: 531206 - RNA, 19 nt, Homo sapiens
ggaggacaucuucgagcuu

SEQ ID NO: 531207 - RNA, 19 nt, Homo sapiens
ucacccgcaucaacuguca

SEQ ID NO: 531208 - RNA, 19 nt, Homo sapiens
gcggggauguguucacuau

SEQ ID NO: 531209 - RNA, 19 nt, Homo sapiens
cuucaaggguagucaguac

SEQ ID NO: 531210 - RNA, 19 nt, Homo sapiens
aaacaaugccacuguccau

SEQ ID NO: 531211 - RNA, 19 nt, Homo sapiens
cacgcuccaucgcucagua

SEQ ID NO: 531212 - RNA, 19 nt, Homo sapiens
ccugucggcuguguuugaa

SEQ ID NO: 531213 - RNA, 19 nt, Homo sapiens
gccaacaacuaugaugacu

SEQ ID NO: 531214 - RNA, 19 nt, Homo sapiens
cagcugggaggacaucuuc

SEQ ID NO: 531215 - RNA, 19 nt, Homo sapiens
ggacagcugggaggacauc

SEQ ID NO: 531216 - RNA, 19 nt, Homo sapiens
augaguacacggucuauga

SEQ ID NO: 531217 - RNA, 19 nt, Homo sapiens
aaaggcaguuccucuucuc

SEQ ID NO: 531218 - RNA, 19 nt, Homo sapiens
ccagugaggagagcaacuu

SEQ ID NO: 531219 - RNA, 19 nt, Homo sapiens
aucaauagcuauguuugga

SEQ ID NO: 531220 - RNA, 19 nt, Homo sapiens
ggcuggagguugagcaaac

SEQ ID NO: 531221 - RNA, 19 nt, Homo sapiens
auucugagcuuggcaaagg

SEQ ID NO: 531222 - RNA, 19 nt, Homo sapiens
gaaagaaagucaccuugaa

SEQ ID NO: 531223 - RNA, 19 nt, Homo sapiens
ggacagaucaugacacuga

SEQ ID NO: 531224 - RNA, 19 nt, Homo sapiens
ccagcgaggucuugaaaua

SEQ ID NO: 531225 - RNA, 19 nt, Homo sapiens
ggaagacccuguggacuuu

SEQ ID NO: 531226 - RNA, 19 nt, Homo sapiens
ccaaagggcuguaucuaga

SEQ ID NO: 531227 - RNA, 19 nt, Homo sapiens
aauaaaggcugagcucuua

SEQ ID NO: 531228 - RNA, 19 nt, Homo sapiens
gaacggagccaaugacuuc

SEQ ID NO: 531229 - RNA, 19 nt, Homo sapiens
gaagaggccugcacucagu

SEQ ID NO: 531230 - RNA, 19 nt, Homo sapiens
ggucacaucuucacauuca

SEQ ID NO: 531231 - RNA, 19 nt, Homo sapiens
gaaaguguguggccugugu

SEQ ID NO: 531232 - RNA, 19 nt, Homo sapiens
gaggagagauugagcuguu

SEQ ID NO: 531233 - RNA, 19 nt, Homo sapiens
gaaggaggaggucuuuaua

SEQ ID NO: 531234 - RNA, 19 nt, Homo sapiens
gaacauggaagucaacguu

SEQ ID NO: 531235 - RNA, 19 nt, Homo sapiens
ucacuuacguucugcauga

SEQ ID NO: 531236 - RNA, 19 nt, Homo sapiens
guagaauccuuaccaguga

SEQ ID NO: 531237 - RNA, 19 nt, Homo sapiens
gaggacaccugauuucugu

SEQ ID NO: 531238 - RNA, 19 nt, Homo sapiens
ggccagaccuugcugaaga

SEQ ID NO: 531239 - RNA, 19 nt, Homo sapiens
aaacgcuccuucucgauua

SEQ ID NO: 531240 - RNA, 19 nt, Homo sapiens
ggaaagaaagucaccuuga

SEQ ID NO: 531241 - RNA, 19 nt, Homo sapiens
gagcugaacugcccgaaag

SEQ ID NO: 531242 - RNA, 19 nt, Homo sapiens
gcaccugccugucaaguca

SEQ ID NO: 531243 - RNA, 19 nt, Homo sapiens
ggagaaacagugaagauug

SEQ ID NO: 531244 - RNA, 19 nt, Homo sapiens
ggacgucucuguggauuca

SEQ ID NO: 531245 - RNA, 19 nt, Homo sapiens
gagaagacuuugugugagu

SEQ ID NO: 531246 - RNA, 19 nt, Homo sapiens
aggcugagcucuuaucuug

SEQ ID NO: 531247 - RNA, 19 nt, Homo sapiens
gcaaagccauguacuccau

SEQ ID NO: 531248 - RNA, 19 nt, Homo sapiens
ggucaucucuggauucaag

SEQ ID NO: 531249 - RNA, 19 nt, Homo sapiens
ugucacagcuugggcuuua

SEQ ID NO: 531250 - RNA, 19 nt, Homo sapiens
gagaaacagugaagauugg

SEQ ID NO: 531251 - RNA, 19 nt, Homo sapiens
gaaacgcuccuucucgauu

SEQ ID NO: 531252 - RNA, 19 nt, Homo sapiens
ccaaggcuuucauuucaaa

SEQ ID NO: 531253 - RNA, 19 nt, Homo sapiens
guucuuauguccuauuuca

SEQ ID NO: 531254 - RNA, 19 nt, Homo sapiens
ccugagcacugccagauuu

SEQ ID NO: 531255 - RNA, 19 nt, Homo sapiens
gggaggaccugcagaugga

SEQ ID NO: 531256 - RNA, 19 nt, Homo sapiens
caagagcuuugacaacaga

SEQ ID NO: 531257 - RNA, 19 nt, Homo sapiens
ggaagacugugaugaucga

SEQ ID NO: 531258 - RNA, 19 nt, Homo sapiens
gaggaggucuuuauacaac

SEQ ID NO: 531259 - RNA, 19 nt, Homo sapiens
acauggaagucaacguuua

SEQ ID NO: 531260 - RNA, 19 nt, Homo sapiens
auacuugacuucagaaaug

SEQ ID NO: 531261 - RNA, 19 nt, Homo sapiens
ggaagcaucaccaccauug

SEQ ID NO: 531262 - RNA, 19 nt, Homo sapiens
gaaauccugccucugauga

SEQ ID NO: 531263 - RNA, 19 nt, Homo sapiens
gacagauacuucaacaaga

SEQ ID NO: 531264 - RNA, 19 nt, Homo sapiens
uaugauuccugccagauuu

SEQ ID NO: 531265 - RNA, 19 nt, Homo sapiens
gaaggcgagugcuguggaa

SEQ ID NO: 531266 - RNA, 19 nt, Homo sapiens
cagauaaagucauguugga

SEQ ID NO: 531267 - RNA, 19 nt, Homo sapiens
gcaauuccuuccuccacaa

SEQ ID NO: 531268 - RNA, 19 nt, Homo sapiens
gaggagggcugcgaugugu

SEQ ID NO: 531269 - RNA, 19 nt, Homo sapiens
gggaacuccuggaaaguga

SEQ ID NO: 531270 - RNA, 19 nt, Homo sapiens
ugaaauccaucgaggugaa

SEQ ID NO: 531271 - RNA, 19 nt, Homo sapiens
aaacugugcucuggauuug

SEQ ID NO: 531272 - RNA, 19 nt, Homo sapiens
cgccaaggcuuucauuuca

SEQ ID NO: 531273 - RNA, 19 nt, Homo sapiens
gugagaagacuuuguguga

SEQ ID NO: 531274 - RNA, 19 nt, Homo sapiens
cagcuguucuuauguccua

SEQ ID NO: 531275 - RNA, 19 nt, Homo sapiens
gaccacuccuucuccauug

SEQ ID NO: 531276 - RNA, 19 nt, Homo sapiens
gagugagccucuccgugua

SEQ ID NO: 531277 - RNA, 19 nt, Homo sapiens
gaggacagaucaugacacu

SEQ ID NO: 531278 - RNA, 19 nt, Homo sapiens
ccagugcugugaugaguau

SEQ ID NO: 531279 - RNA, 19 nt, Homo sapiens
caaacugugcucuggauuu

SEQ ID NO: 531280 - RNA, 19 nt, Homo sapiens
agaagaaggucauugugau

SEQ ID NO: 531281 - RNA, 19 nt, Homo sapiens
aaacgugccagaacuauga

SEQ ID NO: 531282 - RNA, 19 nt, Homo sapiens
ggagaacaguggugugaac

SEQ ID NO: 531283 - RNA, 19 nt, Homo sapiens
ggaggucuuuauacaacaa

SEQ ID NO: 531284 - RNA, 19 nt, Homo sapiens
ggaacguggucccggagaa

SEQ ID NO: 531285 - RNA, 19 nt, Homo sapiens
ggaaggaucggacaaaauu

SEQ ID NO: 531286 - RNA, 19 nt, Homo sapiens
gagugugaguggcgcuaua

SEQ ID NO: 531287 - RNA, 19 nt, Homo sapiens
ggaccacuccuucuccauu

SEQ ID NO: 531288 - RNA, 19 nt, Homo sapiens
gagcagugccagcuucuga

SEQ ID NO: 531289 - RNA, 19 nt, Homo sapiens
caacggaugucccggaacu

SEQ ID NO: 531290 - RNA, 19 nt, Homo sapiens
aagauuggcugcaacacuu

SEQ ID NO: 531291 - RNA, 19 nt, Homo sapiens
gcagcugugucccugaaga

SEQ ID NO: 531292 - RNA, 19 nt, Homo sapiens
gaagaagaaggucauugug

SEQ ID NO: 531293 - RNA, 19 nt, Homo sapiens
gaaauacacacuguuccaa

SEQ ID NO: 531294 - RNA, 19 nt, Homo sapiens
guggauuccuccuguagaa

SEQ ID NO: 531295 - RNA, 19 nt, Homo sapiens
ugaagaggcccaugaagga

SEQ ID NO: 531296 - RNA, 19 nt, Homo sapiens
cuucugagcccacaauaaa

SEQ ID NO: 531297 - RNA, 19 nt, Homo sapiens
ggaggaggucuuuauacaa

SEQ ID NO: 531298 - RNA, 19 nt, Homo sapiens
gggcuucacuuacguucug

SEQ ID NO: 531299 - RNA, 19 nt, Homo sapiens
gcaagugugugaggugauc

SEQ ID NO: 531300 - RNA, 19 nt, Homo sapiens
gaacguggucccggagaaa

SEQ ID NO: 531301 - RNA, 19 nt, Homo sapiens
ggagaacggguaugagugu

SEQ ID NO: 531302 - RNA, 19 nt, Homo sapiens
agggacagcuccuggauga

SEQ ID NO: 531303 - RNA, 19 nt, Homo sapiens
aaacugaggcuggguacua

SEQ ID NO: 531304 - RNA, 19 nt, Homo sapiens
ggcuguaucuagaaacuga

SEQ ID NO: 531305 - RNA, 19 nt, Homo sapiens
gaagaaggucauugugauc

SEQ ID NO: 531306 - RNA, 19 nt, Homo sapiens
ccagggaccuuggagauag

SEQ ID NO: 531307 - RNA, 19 nt, Homo sapiens
ccagggaccuuggagauag

SEQ ID NO: 531308 - RNA, 19 nt, Homo sapiens
caguggaucugcagcaaug

SEQ ID NO: 531309 - RNA, 19 nt, Homo sapiens
ucagacagauacuucaaca

SEQ ID NO: 531310 - RNA, 19 nt, Homo sapiens
aaagggcuguaucuagaaa

SEQ ID NO: 531311 - RNA, 19 nt, Homo sapiens
ugaaggaggaggucuuuau

SEQ ID NO: 531312 - RNA, 19 nt, Homo sapiens
gugacaguguucccuauug

SEQ ID NO: 531313 - RNA, 19 nt, Homo sapiens
caagaggaacuccaugguu

SEQ ID NO: 531314 - RNA, 19 nt, Homo sapiens
gcagacauaccaggagaaa

SEQ ID NO: 531315 - RNA, 19 nt, Homo sapiens
gcaagaaacgggucaccau

SEQ ID NO: 531316 - RNA, 19 nt, Homo sapiens
gagggugguugguggaugu

SEQ ID NO: 531317 - RNA, 19 nt, Homo sapiens
gaggugauucuccauaaug

SEQ ID NO: 531318 - RNA, 19 nt, Homo sapiens
ucagugggaucugccagua

SEQ ID NO: 531319 - RNA, 19 nt, Homo sapiens
cagaauggcaagagaguga

SEQ ID NO: 531320 - RNA, 19 nt, Homo sapiens
caauaaaggcugagcucuu

SEQ ID NO: 531321 - RNA, 19 nt, Homo sapiens
ucaaugccauggagugcaa

SEQ ID NO: 531322 - RNA, 19 nt, Homo sapiens
caacaagacuuucauauuc

SEQ ID NO: 531323 - RNA, 19 nt, Homo sapiens
gcaaggaggucacggauga

SEQ ID NO: 531324 - RNA, 19 nt, Homo sapiens
ggacuuagcuagggagaaa

SEQ ID NO: 531325 - RNA, 19 nt, Homo sapiens
gagcucagguuucuacaaa

SEQ ID NO: 531326 - RNA, 19 nt, Homo sapiens
gaaauugauucugcaguaa

SEQ ID NO: 531327 - RNA, 19 nt, Homo sapiens
caaaguggcuccaggaugu

SEQ ID NO: 531328 - RNA, 19 nt, Homo sapiens
ccacagaucuuccgagaca

SEQ ID NO: 531329 - RNA, 19 nt, Homo sapiens
ugaaauugauucugcagua

SEQ ID NO: 531330 - RNA, 19 nt, Homo sapiens
gaaaucacccagcuuuaaa

SEQ ID NO: 531331 - RNA, 19 nt, Homo sapiens
gauccuuacuuuagaauga

SEQ ID NO: 531332 - RNA, 19 nt, Homo sapiens
ggacgugucuuucauguac

SEQ ID NO: 531333 - RNA, 19 nt, Homo sapiens
gguaauuggugcuggcuaa

SEQ ID NO: 531334 - RNA, 19 nt, Homo sapiens
ccugugaguuccauuauuu

SEQ ID NO: 531335 - RNA, 19 nt, Homo sapiens
ugaccaggauccuuacuuu

SEQ ID NO: 531336 - RNA, 19 nt, Homo sapiens
uaagaaaucacccagcuuu

SEQ ID NO: 531337 - RNA, 19 nt, Homo sapiens
gagcagaucaggaaggauu

SEQ ID NO: 531338 - RNA, 19 nt, Homo sapiens
ggaggucacggaugagaua

SEQ ID NO: 531339 - RNA, 19 nt, Homo sapiens
gaaaugcgucaaaggauga

SEQ ID NO: 531340 - RNA, 19 nt, Homo sapiens
ggucaccucauuccauuua

SEQ ID NO: 531341 - RNA, 19 nt, Homo sapiens
uaaagauguuggugucauu

SEQ ID NO: 531342 - RNA, 19 nt, Homo sapiens
ggcaaagcauuguggguaa

SEQ ID NO: 531343 - RNA, 19 nt, Homo sapiens
caucaucgccuguggcuuu

SEQ ID NO: 531344 - RNA, 19 nt, Homo sapiens
aaaccaaggucaauaagca

SEQ ID NO: 531345 - RNA, 19 nt, Homo sapiens
cggaugagauagugaaaga

SEQ ID NO: 531346 - RNA, 19 nt, Homo sapiens
cuaauaaaccgaauagaga

SEQ ID NO: 531347 - RNA, 19 nt, Homo sapiens
cacagaagcugaagaggau

SEQ ID NO: 531348 - RNA, 19 nt, Homo sapiens
agaaguaucuguggaagga

SEQ ID NO: 531349 - RNA, 19 nt, Homo sapiens
ccaaagaccacaccacuuc

SEQ ID NO: 531350 - RNA, 19 nt, Homo sapiens
gcaccuaccaguaaucaug

SEQ ID NO: 531351 - RNA, 19 nt, Homo sapiens
aaacuuccuuggcuccuaa

SEQ ID NO: 531352 - RNA, 19 nt, Homo sapiens
gggaugagcucagguuucu

SEQ ID NO: 531353 - RNA, 19 nt, Homo sapiens
guaguccacuccagaaauc

SEQ ID NO: 531354 - RNA, 19 nt, Homo sapiens
guaagccuguguauguuau

SEQ ID NO: 531355 - RNA, 19 nt, Homo sapiens
gcucaagaaggcacucaua

SEQ ID NO: 531356 - RNA, 19 nt, Homo sapiens
gaccaggauccuuacuuua

SEQ ID NO: 531357 - RNA, 19 nt, Homo sapiens
caaacaugcccaacaguga

SEQ ID NO: 531358 - RNA, 19 nt, Homo sapiens
ccaggauccuuacuuuaga

SEQ ID NO: 531359 - RNA, 19 nt, Homo sapiens
gcauugggaagaucaguuu

SEQ ID NO: 531360 - RNA, 19 nt, Homo sapiens
ugacucgucugcugaacaa

SEQ ID NO: 531361 - RNA, 19 nt, Homo sapiens
ccauugaccaggauccuua

SEQ ID NO: 531362 - RNA, 19 nt, Homo sapiens
agaaaucacccagcuuuaa

SEQ ID NO: 531363 - RNA, 19 nt, Homo sapiens
ggagguuuauugagcacaa

SEQ ID NO: 531364 - RNA, 19 nt, Homo sapiens
gcaaagcauuguggguaau

SEQ ID NO: 531365 - RNA, 19 nt, Homo sapiens
ugacggaugacgagaagua

SEQ ID NO: 531366 - RNA, 19 nt, Homo sapiens
gcuaauaaaccgaauagag

SEQ ID NO: 531367 - RNA, 19 nt, Homo sapiens
uaagacccacucuguuuaa

SEQ ID NO: 531368 - RNA, 19 nt, Homo sapiens
ucauguaccugaccuucuu

SEQ ID NO: 531369 - RNA, 19 nt, Homo sapiens
gacccaaacuccuccaucu

SEQ ID NO: 531370 - RNA, 19 nt, Homo sapiens
gaugacggaugacgagaag

SEQ ID NO: 531371 - RNA, 19 nt, Homo sapiens
gcagaggcaucuucuucuc

SEQ ID NO: 531372 - RNA, 19 nt, Homo sapiens
ugacaaagagcuaauaaac

SEQ ID NO: 531373 - RNA, 19 nt, Homo sapiens
ccuguaggcuucugucuca

SEQ ID NO: 531374 - RNA, 19 nt, Homo sapiens
caaagcaccgccaccugua

SEQ ID NO: 531375 - RNA, 19 nt, Homo sapiens
caagaaggcacucauagag

SEQ ID NO: 531376 - RNA, 19 nt, Homo sapiens
gaucggcuauccuaaacca

SEQ ID NO: 531377 - RNA, 19 nt, Homo sapiens
guaaagauguuggugucau

SEQ ID NO: 531378 - RNA, 19 nt, Homo sapiens
ccaguguucuccugccaaa

SEQ ID NO: 531379 - RNA, 19 nt, Homo sapiens
uuacugaacuccagaccau

SEQ ID NO: 531380 - RNA, 19 nt, Homo sapiens
gagcacaagauguauuuca

SEQ ID NO: 531381 - RNA, 19 nt, Homo sapiens
gguuccaaguauacucuua

SEQ ID NO: 531382 - RNA, 19 nt, Homo sapiens
gcgcagaggcaucuucuuc

SEQ ID NO: 531383 - RNA, 19 nt, Homo sapiens
caaaggaugaaauugauuc

SEQ ID NO: 531384 - RNA, 19 nt, Homo sapiens
uuaagacccacucuguuua

SEQ ID NO: 531385 - RNA, 19 nt, Homo sapiens
ucaccucauuccauuuauu

SEQ ID NO: 531386 - RNA, 19 nt, Homo sapiens
guacagacaagcagugcaa

SEQ ID NO: 531387 - RNA, 19 nt, Homo sapiens
cuuaagacccacucuguuu

SEQ ID NO: 531388 - RNA, 19 nt, Homo sapiens
ggucacggaugagauagug

SEQ ID NO: 531389 - RNA, 19 nt, Homo sapiens
caucaacaagacuuucaua

SEQ ID NO: 531390 - RNA, 19 nt, Homo sapiens
uaagcucauuguucgguuu

SEQ ID NO: 531391 - RNA, 19 nt, Homo sapiens
ucaagaaggcacucauaga

SEQ ID NO: 531392 - RNA, 19 nt, Homo sapiens
gcaacucauucccacagau

SEQ ID NO: 531393 - RNA, 19 nt, Homo sapiens
gagcuaauaaaccgaauag

SEQ ID NO: 531394 - RNA, 19 nt, Homo sapiens
uuauugagcacaagaugua

SEQ ID NO: 531395 - RNA, 19 nt, Homo sapiens
ucucugaccuggacuacau

SEQ ID NO: 531396 - RNA, 19 nt, Homo sapiens
gagagccaccggccaaaga

SEQ ID NO: 531397 - RNA, 19 nt, Homo sapiens
gcacucugcccuccuguca

SEQ ID NO: 531398 - RNA, 19 nt, Homo sapiens
ucuguaagccuguguaugu

SEQ ID NO: 531399 - RNA, 19 nt, Homo sapiens
gaugagauagugaaagagu

SEQ ID NO: 531400 - RNA, 19 nt, Homo sapiens
caggauccuuacuuuagaa

SEQ ID NO: 531401 - RNA, 19 nt, Homo sapiens
gcucguaaggucccucaaa

SEQ ID NO: 531402 - RNA, 19 nt, Homo sapiens
gcgaugcuguugagaaugc

SEQ ID NO: 531403 - RNA, 19 nt, Homo sapiens
uagcaaacaugcccaacag

SEQ ID NO: 531404 - RNA, 19 nt, Homo sapiens
agacuacgauaagcucauu

SEQ ID NO: 531405 - RNA, 19 nt, Homo sapiens
gaagaguauuaaagaccau

SEQ ID NO: 531406 - RNA, 19 nt, Homo sapiens
uaaacuuccuuggcuccua

SEQ ID NO: 531407 - RNA, 19 nt, Homo sapiens
cuccgcagaugcuucauuu

SEQ ID NO: 531408 - RNA, 19 nt, Homo sapiens
ccugagagauagcaaacau

SEQ ID NO: 531409 - RNA, 19 nt, Homo sapiens
aagcuucguuauacauuug

SEQ ID NO: 531410 - RNA, 19 nt, Homo sapiens
gaggagcacaggcaguuug

SEQ ID NO: 531411 - RNA, 19 nt, Homo sapiens
agacuuucauauucucuga

SEQ ID NO: 531412 - RNA, 19 nt, Homo sapiens
gcuuugaaauauugaugug

SEQ ID NO: 531413 - RNA, 19 nt, Homo sapiens
aacauugcauggucggaua

SEQ ID NO: 531414 - RNA, 19 nt, Homo sapiens
gcuccaggauguauuuaac

SEQ ID NO: 531415 - RNA, 19 nt, Homo sapiens
agauguuggugucauuaaa

SEQ ID NO: 531416 - RNA, 19 nt, Homo sapiens
ccaaguauacucuuaagac

SEQ ID NO: 531417 - RNA, 19 nt, Homo sapiens
aggcuucugucucauggua

SEQ ID NO: 531418 - RNA, 19 nt, Homo sapiens
caccucauuccauuuauuu

SEQ ID NO: 531419 - RNA, 19 nt, Homo sapiens
gcccuccugucacccagua

SEQ ID NO: 531420 - RNA, 19 nt, Homo sapiens
caacagcaucgccacacaa

SEQ ID NO: 531421 - RNA, 19 nt, Homo sapiens
gauguggacgugucuuuca

SEQ ID NO: 531422 - RNA, 19 nt, Homo sapiens
gccgagaccucuaaacuua

SEQ ID NO: 531423 - RNA, 19 nt, Homo sapiens
ggaccuagcccagcugaua

SEQ ID NO: 531424 - RNA, 19 nt, Homo sapiens
ucucuucacucaaggauuu

SEQ ID NO: 531425 - RNA, 19 nt, Homo sapiens
ccucuaaacuuaucuacga

SEQ ID NO: 531426 - RNA, 19 nt, Homo sapiens
ggaagaagaagaucagcaa

SEQ ID NO: 531427 - RNA, 19 nt, Homo sapiens
uagcccagcugauaagaaa

SEQ ID NO: 531428 - RNA, 19 nt, Homo sapiens
ugacugaguggcugaguua

SEQ ID NO: 531429 - RNA, 19 nt, Homo sapiens
cgaugaagaugaagaugau

SEQ ID NO: 531430 - RNA, 19 nt, Homo sapiens
gaggcaaaguggagacaga

SEQ ID NO: 531431 - RNA, 19 nt, Homo sapiens
aaacuuaucuacgacuuca

SEQ ID NO: 531432 - RNA, 19 nt, Homo sapiens
gaagaagaagaucagcaaa

SEQ ID NO: 531433 - RNA, 19 nt, Homo sapiens
gaauggauuugacgugaac

SEQ ID NO: 531434 - RNA, 19 nt, Homo sapiens
aagaaacgcucagggaaga

SEQ ID NO: 531435 - RNA, 19 nt, Homo sapiens
caccagcgguucagcagaa

SEQ ID NO: 531436 - RNA, 19 nt, Homo sapiens
agaugaagaugaugaaugg

SEQ ID NO: 531437 - RNA, 19 nt, Homo sapiens
gcgaugaagaugaagauga

SEQ ID NO: 531438 - RNA, 19 nt, Homo sapiens
gaacaaccucgacccagau

SEQ ID NO: 531439 - RNA, 19 nt, Homo sapiens
ucaguucucuucacucaag

SEQ ID NO: 531440 - RNA, 19 nt, Homo sapiens
gagaagacaagggcagaaa

SEQ ID NO: 531441 - RNA, 19 nt, Homo sapiens
gaccuagcccagcugauaa

SEQ ID NO: 531442 - RNA, 19 nt, Homo sapiens
caacaccagccaaugaaga

SEQ ID NO: 531443 - RNA, 19 nt, Homo sapiens
cgagaccucuaaacuuauc

SEQ ID NO: 531444 - RNA, 19 nt, Homo sapiens
ucucaguucucuucacuca

SEQ ID NO: 531445 - RNA, 19 nt, Homo sapiens
cgagaaccagcgacucuuu

SEQ ID NO: 531446 - RNA, 19 nt, Homo sapiens
acucacagcuugucuacuc

SEQ ID NO: 531447 - RNA, 19 nt, Homo sapiens
gcuggccacugcaguuguu

SEQ ID NO: 531448 - RNA, 19 nt, Homo sapiens
gcucagggaagaagaagau

SEQ ID NO: 531449 - RNA, 19 nt, Homo sapiens
gagaaccagcgacucuuug

SEQ ID NO: 531450 - RNA, 19 nt, Homo sapiens
caccaacaccagccaauga

SEQ ID NO: 531451 - RNA, 19 nt, Homo sapiens
gagcugagcacuggaccaa

SEQ ID NO: 531452 - RNA, 19 nt, Homo sapiens
ggggagcgcuuuuggauca

SEQ ID NO: 531453 - RNA, 19 nt, Homo sapiens
ccaguggauucaagcaugu

SEQ ID NO: 531454 - RNA, 19 nt, Homo sapiens
gaauugucuuucugucucu

SEQ ID NO: 531455 - RNA, 19 nt, Homo sapiens
agaauggauuugacgugaa

SEQ ID NO: 531456 - RNA, 19 nt, Homo sapiens
agaagaagaucagcaaagc

SEQ ID NO: 531457 - RNA, 19 nt, Homo sapiens
caucacgaguucacgauac

SEQ ID NO: 531458 - RNA, 19 nt, Homo sapiens
gaagaugaagaugaugaau

SEQ ID NO: 531459 - RNA, 19 nt, Homo sapiens
cuaaacuuaucuacgacuu

SEQ ID NO: 531460 - RNA, 19 nt, Homo sapiens
cugaguggcugaguuacuu

SEQ ID NO: 531461 - RNA, 19 nt, Homo sapiens
gaagacaagggcagaaagc

SEQ ID NO: 531462 - RNA, 19 nt, Homo sapiens
gaugaugaaugggaugacu

SEQ ID NO: 531463 - RNA, 19 nt, Homo sapiens
ggcuggcgaugaagaugaa

SEQ ID NO: 531464 - RNA, 19 nt, Homo sapiens
gauuugacgugaacaaccu

SEQ ID NO: 531465 - RNA, 19 nt, Homo sapiens
ugaagaugaagaugaugaa

SEQ ID NO: 531466 - RNA, 19 nt, Homo sapiens
cugcaguuguucagcugua

SEQ ID NO: 531467 - RNA, 19 nt, Homo sapiens
gaggagcaccagcgguuca

SEQ ID NO: 531468 - RNA, 19 nt, Homo sapiens
caccuucgcuggagaugac

SEQ ID NO: 531469 - RNA, 19 nt, Homo sapiens
ugaugaaugggaugacuga

SEQ ID NO: 531470 - RNA, 19 nt, Homo sapiens
gaagaagaucagcaaagcu

SEQ ID NO: 531471 - RNA, 19 nt, Homo sapiens
gaaacgcucagggaagaag

SEQ ID NO: 531472 - RNA, 19 nt, Homo sapiens
aagaugaagaugaugaaug

SEQ ID NO: 531473 - RNA, 19 nt, Homo sapiens
caaccucgacccagaucug

SEQ ID NO: 531474 - RNA, 19 nt, Homo sapiens
cauccacuccuccgacgaa

SEQ ID NO: 531475 - RNA, 19 nt, Homo sapiens
caaauccggcagggaauuc

SEQ ID NO: 531476 - RNA, 19 nt, Homo sapiens
agaaccagcgacucuuuga

SEQ ID NO: 531477 - RNA, 19 nt, Homo sapiens
guacucacagcuugucuac

SEQ ID NO: 531478 - RNA, 19 nt, Homo sapiens
ucaaauccggcagggaauu

SEQ ID NO: 531479 - RNA, 19 nt, Homo sapiens
aaccagcgacucuuugaga

SEQ ID NO: 531480 - RNA, 19 nt, Homo sapiens
acccugacaucacgaguuc

SEQ ID NO: 531481 - RNA, 19 nt, Homo sapiens
gugcaggagaagauacaaa

SEQ ID NO: 531482 - RNA, 19 nt, Homo sapiens
gaaccagcgacucuuugag

SEQ ID NO: 531483 - RNA, 19 nt, Homo sapiens
gggcagaaagcaccaugag

SEQ ID NO: 531484 - RNA, 19 nt, Homo sapiens
ugagaugcuuggacgaaaa

SEQ ID NO: 531485 - RNA, 19 nt, Homo sapiens
gaucugcggagucuguucu

SEQ ID NO: 531486 - RNA, 19 nt, Homo sapiens
gaacuucaaugaugaggaa

SEQ ID NO: 531487 - RNA, 19 nt, Homo sapiens
gaaacacacucucuucuca

SEQ ID NO: 531488 - RNA, 19 nt, Homo sapiens
gugcagcccuccacauuua

SEQ ID NO: 531489 - RNA, 19 nt, Homo sapiens
gaacugugcgaucuuaaua

SEQ ID NO: 531490 - RNA, 19 nt, Homo sapiens
gaucaagacuguggacgua

SEQ ID NO: 531491 - RNA, 19 nt, Homo sapiens
gaacaaugcucagucuaug

SEQ ID NO: 531492 - RNA, 19 nt, Homo sapiens
ugacgggaaucaucucuua

SEQ ID NO: 531493 - RNA, 19 nt, Homo sapiens
caacagcaauugugucuca

SEQ ID NO: 531494 - RNA, 19 nt, Homo sapiens
ggaaagauaaggacauuga

SEQ ID NO: 531495 - RNA, 19 nt, Homo sapiens
gugaacaguuggaaagaua

SEQ ID NO: 531496 - RNA, 19 nt, Homo sapiens
ccagaaagccagcaucuaa

SEQ ID NO: 531497 - RNA, 19 nt, Homo sapiens
gaagaggacgaacuaauga

SEQ ID NO: 531498 - RNA, 19 nt, Homo sapiens
caacagcccaugcagcuua

SEQ ID NO: 531499 - RNA, 19 nt, Homo sapiens
gcaauugcuucuacaacaa

SEQ ID NO: 531500 - RNA, 19 nt, Homo sapiens
ggaagaggacgaacuaaug

SEQ ID NO: 531501 - RNA, 19 nt, Homo sapiens
ggaaaggucugcggcaugu

SEQ ID NO: 531502 - RNA, 19 nt, Homo sapiens
gcagacgccuggaacaaga

SEQ ID NO: 531503 - RNA, 19 nt, Homo sapiens
ggacugugccuguuaaguu

SEQ ID NO: 531504 - RNA, 19 nt, Homo sapiens
gaaagcaacaacagaauuc

SEQ ID NO: 531505 - RNA, 19 nt, Homo sapiens
caaguggacucagaagaaa

SEQ ID NO: 531506 - RNA, 19 nt, Homo sapiens
gacaagaaccgcaagaaug

SEQ ID NO: 531507 - RNA, 19 nt, Homo sapiens
ccaacaggaugguaucuau

SEQ ID NO: 531508 - RNA, 19 nt, Homo sapiens
gcagguaccauauaucaga

SEQ ID NO: 531509 - RNA, 19 nt, Homo sapiens
gaacgaggaggaagagaga

SEQ ID NO: 531510 - RNA, 19 nt, Homo sapiens
gcgaugaaguagcaaauag

SEQ ID NO: 531511 - RNA, 19 nt, Homo sapiens
gcacacacauguccaccau

SEQ ID NO: 531512 - RNA, 19 nt, Homo sapiens
gcaaacacccucugugagu

SEQ ID NO: 531513 - RNA, 19 nt, Homo sapiens
gcuguaaggucaugcugaa

SEQ ID NO: 531514 - RNA, 19 nt, Homo sapiens
caagacagcuauuuuguug

SEQ ID NO: 531515 - RNA, 19 nt, Homo sapiens
gcuauggguuucaucuuga

SEQ ID NO: 531516 - RNA, 19 nt, Homo sapiens
caacacggccucugugguu

SEQ ID NO: 531517 - RNA, 19 nt, Homo sapiens
ccacccggcugauguuuga

SEQ ID NO: 531518 - RNA, 19 nt, Homo sapiens
gcaauggcaucuacuacca

SEQ ID NO: 531519 - RNA, 19 nt, Homo sapiens
ucagaaaggccacaucuug

SEQ ID NO: 531520 - RNA, 19 nt, Homo sapiens
gaaaccaccaccucuguug

SEQ ID NO: 531521 - RNA, 19 nt, Homo sapiens
acaagaaccgcaagaauga

SEQ ID NO: 531522 - RNA, 19 nt, Homo sapiens
gcaaauagugacagugaau

SEQ ID NO: 531523 - RNA, 19 nt, Homo sapiens
aagaaagggucaucaggaa

SEQ ID NO: 531524 - RNA, 19 nt, Homo sapiens
gcacuuugcccaccacaug

SEQ ID NO: 531525 - RNA, 19 nt, Homo sapiens
gcugagggcugcauuuguc

SEQ ID NO: 531526 - RNA, 19 nt, Homo sapiens
gauacaguuugccguggua

SEQ ID NO: 531527 - RNA, 19 nt, Homo sapiens
ccaaguggacucagaagaa

SEQ ID NO: 531528 - RNA, 19 nt, Homo sapiens
gcugagagcugugaauguc

SEQ ID NO: 531529 - RNA, 19 nt, Homo sapiens
ggaguucgcauaccacaug

SEQ ID NO: 531530 - RNA, 19 nt, Homo sapiens
gaaagggucaucaggaaag

SEQ ID NO: 531531 - RNA, 19 nt, Homo sapiens
gacugugccuguuaaguug

SEQ ID NO: 531532 - RNA, 19 nt, Homo sapiens
caaacacccucugugaguu

SEQ ID NO: 531533 - RNA, 19 nt, Homo sapiens
gugaauuugugaacaguug

SEQ ID NO: 531534 - RNA, 19 nt, Homo sapiens
uacgugagcuuugauggua

SEQ ID NO: 531535 - RNA, 19 nt, Homo sapiens
gacaacagcaacagcaauu

SEQ ID NO: 531536 - RNA, 19 nt, Homo sapiens
ccuacaaucuccaccaaga

SEQ ID NO: 531537 - RNA, 19 nt, Homo sapiens
gcagcagcuuucugacuga

SEQ ID NO: 531538 - RNA, 19 nt, Homo sapiens
ggaaggacgcaacaagaug

SEQ ID NO: 531539 - RNA, 19 nt, Homo sapiens
gcuuaagaauggccaguau

SEQ ID NO: 531540 - RNA, 19 nt, Homo sapiens
acuaucaucuccacagaaa

SEQ ID NO: 531541 - RNA, 19 nt, Homo sapiens
cauuuaugcuucagucuug

SEQ ID NO: 531542 - RNA, 19 nt, Homo sapiens
uguaaucgcgucuguauga

SEQ ID NO: 531543 - RNA, 19 nt, Homo sapiens
ugaccuauguucugaucaa

SEQ ID NO: 531544 - RNA, 19 nt, Homo sapiens
cccguuaccucacauuuga

SEQ ID NO: 531545 - RNA, 19 nt, Homo sapiens
gcuaugugcugagugaaga

SEQ ID NO: 531546 - RNA, 19 nt, Homo sapiens
caacaacgacuacuaugag

SEQ ID NO: 531547 - RNA, 19 nt, Homo sapiens
acagagcgcugcccuccaa

SEQ ID NO: 531548 - RNA, 19 nt, Homo sapiens
guugauuucugauccuuga

SEQ ID NO: 531549 - RNA, 19 nt, Homo sapiens
gagagugcauuuacagaac

SEQ ID NO: 531550 - RNA, 19 nt, Homo sapiens
ggacauugacccaaguugu

SEQ ID NO: 531551 - RNA, 19 nt, Homo sapiens
ugugggaacuucaaugaug

SEQ ID NO: 531552 - RNA, 19 nt, Homo sapiens
gaagggccaccgugugcua

SEQ ID NO: 531553 - RNA, 19 nt, Homo sapiens
caagaucagugccaagcau

SEQ ID NO: 531554 - RNA, 19 nt, Homo sapiens
gaacuaugacggcaacagu

SEQ ID NO: 531555 - RNA, 19 nt, Homo sapiens
caacucaacagacccauuc

SEQ ID NO: 531556 - RNA, 19 nt, Homo sapiens
cuacggagacccucauuau

SEQ ID NO: 531557 - RNA, 19 nt, Homo sapiens
agacuaccaucucuacaga

SEQ ID NO: 531558 - RNA, 19 nt, Homo sapiens
ugaaaccacuggccucaca

SEQ ID NO: 531559 - RNA, 19 nt, Homo sapiens
ccgcaagaaugacaugaug

SEQ ID NO: 531560 - RNA, 19 nt, Homo sapiens
gugcaaacacccucuguga

SEQ ID NO: 531561 - RNA, 19 nt, Homo sapiens
gcccagcgaugaaguagca

SEQ ID NO: 531562 - RNA, 19 nt, Homo sapiens
gugggaacuucaaugauga

SEQ ID NO: 531563 - RNA, 19 nt, Homo sapiens
cagaaaggccacaucuuga

SEQ ID NO: 531564 - RNA, 19 nt, Homo sapiens
gaccaggagugucagaagu

SEQ ID NO: 531565 - RNA, 19 nt, Homo sapiens
guaaggucaugcugaaugg

SEQ ID NO: 531566 - RNA, 19 nt, Homo sapiens
acaaugaccaccugaaguu

SEQ ID NO: 531567 - RNA, 19 nt, Homo sapiens
gguuucaucuugaucaauc

SEQ ID NO: 531568 - RNA, 19 nt, Homo sapiens
caacgcccaucccuucugu

SEQ ID NO: 531569 - RNA, 19 nt, Homo sapiens
gaugugcucuggaaacacu

SEQ ID NO: 531570 - RNA, 19 nt, Homo sapiens
cagcuuugguggaaggaaa

SEQ ID NO: 531571 - RNA, 19 nt, Homo sapiens
uagcaaauagugacaguga

SEQ ID NO: 531572 - RNA, 19 nt, Homo sapiens
cugcaaacccaaccagaua

SEQ ID NO: 531573 - RNA, 19 nt, Homo sapiens
gcgaagccaugcccugaca

SEQ ID NO: 531574 - RNA, 19 nt, Homo sapiens
agacuaccaucuccacaga

SEQ ID NO: 531575 - RNA, 19 nt, Homo sapiens
agacuaccaucuccacaga

SEQ ID NO: 531576 - RNA, 19 nt, Homo sapiens
gaucaauccugggacuugu

SEQ ID NO: 531577 - RNA, 19 nt, Homo sapiens
gggaguauccggaaacaca

SEQ ID NO: 531578 - RNA, 19 nt, Homo sapiens
ccuguuaaguugcucaguu

SEQ ID NO: 531579 - RNA, 19 nt, Homo sapiens
gugcuucucuguucauucu

SEQ ID NO: 531580 - RNA, 19 nt, Homo sapiens
cagcagguaccauauauca

SEQ ID NO: 531581 - RNA, 19 nt, Homo sapiens
caggagaacccgaguggaa

SEQ ID NO: 531582 - RNA, 19 nt, Homo sapiens
ugaggaagaggacgaacua

SEQ ID NO: 531583 - RNA, 19 nt, Homo sapiens
cuacagcauuguuaacauc

SEQ ID NO: 531584 - RNA, 19 nt, Homo sapiens
ccauaaggcucagcagcaa

SEQ ID NO: 531585 - RNA, 19 nt, Homo sapiens
ugaaagcaacaacagaauu

SEQ ID NO: 531586 - RNA, 19 nt, Homo sapiens
gaacuucaaugaugaggaa

SEQ ID NO: 531587 - RNA, 19 nt, Homo sapiens
gaaacacacucucuucuca

SEQ ID NO: 531588 - RNA, 19 nt, Homo sapiens
gugcagcccuccacauuua

SEQ ID NO: 531589 - RNA, 19 nt, Homo sapiens
gaacugugcgaucuuaaua

SEQ ID NO: 531590 - RNA, 19 nt, Homo sapiens
gaucaagacuguggacgua

SEQ ID NO: 531591 - RNA, 19 nt, Homo sapiens
gaacaaugcucagucuaug

SEQ ID NO: 531592 - RNA, 19 nt, Homo sapiens
ugacgggaaucaucucuua

SEQ ID NO: 531593 - RNA, 19 nt, Homo sapiens
caacagcaauugugucuca

SEQ ID NO: 531594 - RNA, 19 nt, Homo sapiens
ggaaagauaaggacauuga

SEQ ID NO: 531595 - RNA, 19 nt, Homo sapiens
gugaacaguuggaaagaua

SEQ ID NO: 531596 - RNA, 19 nt, Homo sapiens
ccagaaagccagcaucuaa

SEQ ID NO: 531597 - RNA, 19 nt, Homo sapiens
gaagaggacgaacuaauga

SEQ ID NO: 531598 - RNA, 19 nt, Homo sapiens
caacagcccaugcagcuua

SEQ ID NO: 531599 - RNA, 19 nt, Homo sapiens
gcaauugcuucuacaacaa

SEQ ID NO: 531600 - RNA, 19 nt, Homo sapiens
ggaagaggacgaacuaaug

SEQ ID NO: 531601 - RNA, 19 nt, Homo sapiens
ggaaaggucugcggcaugu

SEQ ID NO: 531602 - RNA, 19 nt, Homo sapiens
gcagacgccuggaacaaga

SEQ ID NO: 531603 - RNA, 19 nt, Homo sapiens
ggacugugccuguuaaguu

SEQ ID NO: 531604 - RNA, 19 nt, Homo sapiens
gaaagcaacaacagaauuc

SEQ ID NO: 531605 - RNA, 19 nt, Homo sapiens
caaguggacucagaagaaa

SEQ ID NO: 531606 - RNA, 19 nt, Homo sapiens
gacaagaaccgcaagaaug

SEQ ID NO: 531607 - RNA, 19 nt, Homo sapiens
ccaacaggaugguaucuau

SEQ ID NO: 531608 - RNA, 19 nt, Homo sapiens
gcagguaccauauaucaga

SEQ ID NO: 531609 - RNA, 19 nt, Homo sapiens
gaacgaggaggaagagaga

SEQ ID NO: 531610 - RNA, 19 nt, Homo sapiens
gcgaugaaguagcaaauag

SEQ ID NO: 531611 - RNA, 19 nt, Homo sapiens
gcacacacauguccaccau

SEQ ID NO: 531612 - RNA, 19 nt, Homo sapiens
gcaaacacccucugugagu

SEQ ID NO: 531613 - RNA, 19 nt, Homo sapiens
gcuguaaggucaugcugaa

SEQ ID NO: 531614 - RNA, 19 nt, Homo sapiens
caagacagcuauuuuguug

SEQ ID NO: 531615 - RNA, 19 nt, Homo sapiens
gcuauggguuucaucuuga

SEQ ID NO: 531616 - RNA, 19 nt, Homo sapiens
caacacggccucugugguu

SEQ ID NO: 531617 - RNA, 19 nt, Homo sapiens
ccacccggcugauguuuga

SEQ ID NO: 531618 - RNA, 19 nt, Homo sapiens
gcaauggcaucuacuacca

SEQ ID NO: 531619 - RNA, 19 nt, Homo sapiens
ucagaaaggccacaucuug

SEQ ID NO: 531620 - RNA, 19 nt, Homo sapiens
gaaaccaccaccucuguug

SEQ ID NO: 531621 - RNA, 19 nt, Homo sapiens
acaagaaccgcaagaauga

SEQ ID NO: 531622 - RNA, 19 nt, Homo sapiens
gcaaauagugacagugaau

SEQ ID NO: 531623 - RNA, 19 nt, Homo sapiens
aagaaagggucaucaggaa

SEQ ID NO: 531624 - RNA, 19 nt, Homo sapiens
gcacuuugcccaccacaug

SEQ ID NO: 531625 - RNA, 19 nt, Homo sapiens
gcugagggcugcauuuguc

SEQ ID NO: 531626 - RNA, 19 nt, Homo sapiens
gauacaguuugccguggua

SEQ ID NO: 531627 - RNA, 19 nt, Homo sapiens
ccaaguggacucagaagaa

SEQ ID NO: 531628 - RNA, 19 nt, Homo sapiens
gcugagagcugugaauguc

SEQ ID NO: 531629 - RNA, 19 nt, Homo sapiens
ggaguucgcauaccacaug

SEQ ID NO: 531630 - RNA, 19 nt, Homo sapiens
gaaagggucaucaggaaag

SEQ ID NO: 531631 - RNA, 19 nt, Homo sapiens
gacugugccuguuaaguug

SEQ ID NO: 531632 - RNA, 19 nt, Homo sapiens
caaacacccucugugaguu

SEQ ID NO: 531633 - RNA, 19 nt, Homo sapiens
gugaauuugugaacaguug

SEQ ID NO: 531634 - RNA, 19 nt, Homo sapiens
uacgugagcuuugauggua

SEQ ID NO: 531635 - RNA, 19 nt, Homo sapiens
gacaacagcaacagcaauu

SEQ ID NO: 531636 - RNA, 19 nt, Homo sapiens
ccuacaaucuccaccaaga

SEQ ID NO: 531637 - RNA, 19 nt, Homo sapiens
gcagcagcuuucugacuga

SEQ ID NO: 531638 - RNA, 19 nt, Homo sapiens
ggaaggacgcaacaagaug

SEQ ID NO: 531639 - RNA, 19 nt, Homo sapiens
gcuuaagaauggccaguau

SEQ ID NO: 531640 - RNA, 19 nt, Homo sapiens
acuaucaucuccacagaaa

SEQ ID NO: 531641 - RNA, 19 nt, Homo sapiens
cauuuaugcuucagucuug

SEQ ID NO: 531642 - RNA, 19 nt, Homo sapiens
uguaaucgcgucuguauga

SEQ ID NO: 531643 - RNA, 19 nt, Homo sapiens
ugaccuauguucugaucaa

SEQ ID NO: 531644 - RNA, 19 nt, Homo sapiens
cccguuaccucacauuuga

SEQ ID NO: 531645 - RNA, 19 nt, Homo sapiens
gcuaugugcugagugaaga

SEQ ID NO: 531646 - RNA, 19 nt, Homo sapiens
caacaacgacuacuaugag

SEQ ID NO: 531647 - RNA, 19 nt, Homo sapiens
acagagcgcugcccuccaa

SEQ ID NO: 531648 - RNA, 19 nt, Homo sapiens
guugauuucugauccuuga

SEQ ID NO: 531649 - RNA, 19 nt, Homo sapiens
gagagugcauuuacagaac

SEQ ID NO: 531650 - RNA, 19 nt, Homo sapiens
ggacauugacccaaguugu

SEQ ID NO: 531651 - RNA, 19 nt, Homo sapiens
ugugggaacuucaaugaug

SEQ ID NO: 531652 - RNA, 19 nt, Homo sapiens
gaagggccaccgugugcua

SEQ ID NO: 531653 - RNA, 19 nt, Homo sapiens
caagaucagugccaagcau

SEQ ID NO: 531654 - RNA, 19 nt, Homo sapiens
gaacuaugacggcaacagu

SEQ ID NO: 531655 - RNA, 19 nt, Homo sapiens
caacucaacagacccauuc

SEQ ID NO: 531656 - RNA, 19 nt, Homo sapiens
cuacggagacccucauuau

SEQ ID NO: 531657 - RNA, 19 nt, Homo sapiens
agacuaccaucucuacaga

SEQ ID NO: 531658 - RNA, 19 nt, Homo sapiens
ugaaaccacuggccucaca

SEQ ID NO: 531659 - RNA, 19 nt, Homo sapiens
ccgcaagaaugacaugaug

SEQ ID NO: 531660 - RNA, 19 nt, Homo sapiens
gugcaaacacccucuguga

SEQ ID NO: 531661 - RNA, 19 nt, Homo sapiens
gcccagcgaugaaguagca

SEQ ID NO: 531662 - RNA, 19 nt, Homo sapiens
gugggaacuucaaugauga

SEQ ID NO: 531663 - RNA, 19 nt, Homo sapiens
cagaaaggccacaucuuga

SEQ ID NO: 531664 - RNA, 19 nt, Homo sapiens
gaccaggagugucagaagu

SEQ ID NO: 531665 - RNA, 19 nt, Homo sapiens
guaaggucaugcugaaugg

SEQ ID NO: 531666 - RNA, 19 nt, Homo sapiens
acaaugaccaccugaaguu

SEQ ID NO: 531667 - RNA, 19 nt, Homo sapiens
gguuucaucuugaucaauc

SEQ ID NO: 531668 - RNA, 19 nt, Homo sapiens
caacgcccaucccuucugu

SEQ ID NO: 531669 - RNA, 19 nt, Homo sapiens
gaugugcucuggaaacacu

SEQ ID NO: 531670 - RNA, 19 nt, Homo sapiens
cagcuuugguggaaggaaa

SEQ ID NO: 531671 - RNA, 19 nt, Homo sapiens
uagcaaauagugacaguga

SEQ ID NO: 531672 - RNA, 19 nt, Homo sapiens
cugcaaacccaaccagaua

SEQ ID NO: 531673 - RNA, 19 nt, Homo sapiens
gcgaagccaugcccugaca

SEQ ID NO: 531674 - RNA, 19 nt, Homo sapiens
agacuaccaucuccacaga

SEQ ID NO: 531675 - RNA, 19 nt, Homo sapiens
agacuaccaucuccacaga

SEQ ID NO: 531676 - RNA, 19 nt, Homo sapiens
gaucaauccugggacuugu

SEQ ID NO: 531677 - RNA, 19 nt, Homo sapiens
gggaguauccggaaacaca

SEQ ID NO: 531678 - RNA, 19 nt, Homo sapiens
ccuguuaaguugcucaguu

SEQ ID NO: 531679 - RNA, 19 nt, Homo sapiens
gugcuucucuguucauucu

SEQ ID NO: 531680 - RNA, 19 nt, Homo sapiens
cagcagguaccauauauca

SEQ ID NO: 531681 - RNA, 19 nt, Homo sapiens
caggagaacccgaguggaa

SEQ ID NO: 531682 - RNA, 19 nt, Homo sapiens
ugaggaagaggacgaacua

SEQ ID NO: 531683 - RNA, 19 nt, Homo sapiens
cuacagcauuguuaacauc

SEQ ID NO: 531684 - RNA, 19 nt, Homo sapiens
ccauaaggcucagcagcaa

SEQ ID NO: 531685 - RNA, 19 nt, Homo sapiens
ugaaagcaacaacagaauu

SEQ ID NO: 531686 - RNA, 19 nt, Homo sapiens
gaacuucaaugaugaggaa

SEQ ID NO: 531687 - RNA, 19 nt, Homo sapiens
gaaacacacucucuucuca

SEQ ID NO: 531688 - RNA, 19 nt, Homo sapiens
gugcagcccuccacauuua

SEQ ID NO: 531689 - RNA, 19 nt, Homo sapiens
gaacugugcgaucuuaaua

SEQ ID NO: 531690 - RNA, 19 nt, Homo sapiens
gaucaagacuguggacgua

SEQ ID NO: 531691 - RNA, 19 nt, Homo sapiens
gaacaaugcucagucuaug

SEQ ID NO: 531692 - RNA, 19 nt, Homo sapiens
ugacgggaaucaucucuua

SEQ ID NO: 531693 - RNA, 19 nt, Homo sapiens
caacagcaauugugucuca

SEQ ID NO: 531694 - RNA, 19 nt, Homo sapiens
ggaaagauaaggacauuga

SEQ ID NO: 531695 - RNA, 19 nt, Homo sapiens
gugaacaguuggaaagaua

SEQ ID NO: 531696 - RNA, 19 nt, Homo sapiens
ccagaaagccagcaucuaa

SEQ ID NO: 531697 - RNA, 19 nt, Homo sapiens
gaagaggacgaacuaauga

SEQ ID NO: 531698 - RNA, 19 nt, Homo sapiens
caacagcccaugcagcuua

SEQ ID NO: 531699 - RNA, 19 nt, Homo sapiens
gcaauugcuucuacaacaa

SEQ ID NO: 531700 - RNA, 19 nt, Homo sapiens
ggaagaggacgaacuaaug

SEQ ID NO: 531701 - RNA, 19 nt, Homo sapiens
ggaaaggucugcggcaugu

SEQ ID NO: 531702 - RNA, 19 nt, Homo sapiens
gcagacgccuggaacaaga

SEQ ID NO: 531703 - RNA, 19 nt, Homo sapiens
ggacugugccuguuaaguu

SEQ ID NO: 531704 - RNA, 19 nt, Homo sapiens
gaaagcaacaacagaauuc

SEQ ID NO: 531705 - RNA, 19 nt, Homo sapiens
caaguggacucagaagaaa

SEQ ID NO: 531706 - RNA, 19 nt, Homo sapiens
gacaagaaccgcaagaaug

SEQ ID NO: 531707 - RNA, 19 nt, Homo sapiens
ccaacaggaugguaucuau

SEQ ID NO: 531708 - RNA, 19 nt, Homo sapiens
gcagguaccauauaucaga

SEQ ID NO: 531709 - RNA, 19 nt, Homo sapiens
gaacgaggaggaagagaga

SEQ ID NO: 531710 - RNA, 19 nt, Homo sapiens
gcgaugaaguagcaaauag

SEQ ID NO: 531711 - RNA, 19 nt, Homo sapiens
gcacacacauguccaccau

SEQ ID NO: 531712 - RNA, 19 nt, Homo sapiens
gcaaacacccucugugagu

SEQ ID NO: 531713 - RNA, 19 nt, Homo sapiens
gcuguaaggucaugcugaa

SEQ ID NO: 531714 - RNA, 19 nt, Homo sapiens
caagacagcuauuuuguug

SEQ ID NO: 531715 - RNA, 19 nt, Homo sapiens
gcuauggguuucaucuuga

SEQ ID NO: 531716 - RNA, 19 nt, Homo sapiens
caacacggccucugugguu

SEQ ID NO: 531717 - RNA, 19 nt, Homo sapiens
ccacccggcugauguuuga

SEQ ID NO: 531718 - RNA, 19 nt, Homo sapiens
gcaauggcaucuacuacca

SEQ ID NO: 531719 - RNA, 19 nt, Homo sapiens
ucagaaaggccacaucuug

SEQ ID NO: 531720 - RNA, 19 nt, Homo sapiens
gaaaccaccaccucuguug

SEQ ID NO: 531721 - RNA, 19 nt, Homo sapiens
acaagaaccgcaagaauga

SEQ ID NO: 531722 - RNA, 19 nt, Homo sapiens
gcaaauagugacagugaau

SEQ ID NO: 531723 - RNA, 19 nt, Homo sapiens
aagaaagggucaucaggaa

SEQ ID NO: 531724 - RNA, 19 nt, Homo sapiens
gcacuuugcccaccacaug

SEQ ID NO: 531725 - RNA, 19 nt, Homo sapiens
gcugagggcugcauuuguc

SEQ ID NO: 531726 - RNA, 19 nt, Homo sapiens
gauacaguuugccguggua

SEQ ID NO: 531727 - RNA, 19 nt, Homo sapiens
ccaaguggacucagaagaa

SEQ ID NO: 531728 - RNA, 19 nt, Homo sapiens
gcugagagcugugaauguc

SEQ ID NO: 531729 - RNA, 19 nt, Homo sapiens
ggaguucgcauaccacaug

SEQ ID NO: 531730 - RNA, 19 nt, Homo sapiens
gaaagggucaucaggaaag

SEQ ID NO: 531731 - RNA, 19 nt, Homo sapiens
gacugugccuguuaaguug

SEQ ID NO: 531732 - RNA, 19 nt, Homo sapiens
caaacacccucugugaguu

SEQ ID NO: 531733 - RNA, 19 nt, Homo sapiens
gugaauuugugaacaguug

SEQ ID NO: 531734 - RNA, 19 nt, Homo sapiens
uacgugagcuuugauggua

SEQ ID NO: 531735 - RNA, 19 nt, Homo sapiens
gacaacagcaacagcaauu

SEQ ID NO: 531736 - RNA, 19 nt, Homo sapiens
ccuacaaucuccaccaaga

SEQ ID NO: 531737 - RNA, 19 nt, Homo sapiens
gcagcagcuuucugacuga

SEQ ID NO: 531738 - RNA, 19 nt, Homo sapiens
ggaaggacgcaacaagaug

SEQ ID NO: 531739 - RNA, 19 nt, Homo sapiens
gcuuaagaauggccaguau

SEQ ID NO: 531740 - RNA, 19 nt, Homo sapiens
acuaucaucuccacagaaa

SEQ ID NO: 531741 - RNA, 19 nt, Homo sapiens
cauuuaugcuucagucuug

SEQ ID NO: 531742 - RNA, 19 nt, Homo sapiens
uguaaucgcgucuguauga

SEQ ID NO: 531743 - RNA, 19 nt, Homo sapiens
ugaccuauguucugaucaa

SEQ ID NO: 531744 - RNA, 19 nt, Homo sapiens
cccguuaccucacauuuga

SEQ ID NO: 531745 - RNA, 19 nt, Homo sapiens
gcuaugugcugagugaaga

SEQ ID NO: 531746 - RNA, 19 nt, Homo sapiens
caacaacgacuacuaugag

SEQ ID NO: 531747 - RNA, 19 nt, Homo sapiens
acagagcgcugcccuccaa

SEQ ID NO: 531748 - RNA, 19 nt, Homo sapiens
guugauuucugauccuuga

SEQ ID NO: 531749 - RNA, 19 nt, Homo sapiens
gagagugcauuuacagaac

SEQ ID NO: 531750 - RNA, 19 nt, Homo sapiens
ggacauugacccaaguugu

SEQ ID NO: 531751 - RNA, 19 nt, Homo sapiens
ugugggaacuucaaugaug

SEQ ID NO: 531752 - RNA, 19 nt, Homo sapiens
gaagggccaccgugugcua

SEQ ID NO: 531753 - RNA, 19 nt, Homo sapiens
caagaucagugccaagcau

SEQ ID NO: 531754 - RNA, 19 nt, Homo sapiens
gaacuaugacggcaacagu

SEQ ID NO: 531755 - RNA, 19 nt, Homo sapiens
caacucaacagacccauuc

SEQ ID NO: 531756 - RNA, 19 nt, Homo sapiens
cuacggagacccucauuau

SEQ ID NO: 531757 - RNA, 19 nt, Homo sapiens
agacuaccaucucuacaga

SEQ ID NO: 531758 - RNA, 19 nt, Homo sapiens
ugaaaccacuggccucaca

SEQ ID NO: 531759 - RNA, 19 nt, Homo sapiens
ccgcaagaaugacaugaug

SEQ ID NO: 531760 - RNA, 19 nt, Homo sapiens
gugcaaacacccucuguga

SEQ ID NO: 531761 - RNA, 19 nt, Homo sapiens
gcccagcgaugaaguagca

SEQ ID NO: 531762 - RNA, 19 nt, Homo sapiens
gugggaacuucaaugauga

SEQ ID NO: 531763 - RNA, 19 nt, Homo sapiens
cagaaaggccacaucuuga

SEQ ID NO: 531764 - RNA, 19 nt, Homo sapiens
gaccaggagugucagaagu

SEQ ID NO: 531765 - RNA, 19 nt, Homo sapiens
guaaggucaugcugaaugg

SEQ ID NO: 531766 - RNA, 19 nt, Homo sapiens
acaaugaccaccugaaguu

SEQ ID NO: 531767 - RNA, 19 nt, Homo sapiens
gguuucaucuugaucaauc

SEQ ID NO: 531768 - RNA, 19 nt, Homo sapiens
caacgcccaucccuucugu

SEQ ID NO: 531769 - RNA, 19 nt, Homo sapiens
gaugugcucuggaaacacu

SEQ ID NO: 531770 - RNA, 19 nt, Homo sapiens
cagcuuugguggaaggaaa

SEQ ID NO: 531771 - RNA, 19 nt, Homo sapiens
uagcaaauagugacaguga

SEQ ID NO: 531772 - RNA, 19 nt, Homo sapiens
cugcaaacccaaccagaua

SEQ ID NO: 531773 - RNA, 19 nt, Homo sapiens
gcgaagccaugcccugaca

SEQ ID NO: 531774 - RNA, 19 nt, Homo sapiens
agacuaccaucuccacaga

SEQ ID NO: 531775 - RNA, 19 nt, Homo sapiens
agacuaccaucuccacaga

SEQ ID NO: 531776 - RNA, 19 nt, Homo sapiens
gaucaauccugggacuugu

SEQ ID NO: 531777 - RNA, 19 nt, Homo sapiens
gggaguauccggaaacaca

SEQ ID NO: 531778 - RNA, 19 nt, Homo sapiens
ccuguuaaguugcucaguu

SEQ ID NO: 531779 - RNA, 19 nt, Homo sapiens
gugcuucucuguucauucu

SEQ ID NO: 531780 - RNA, 19 nt, Homo sapiens
cagcagguaccauauauca

SEQ ID NO: 531781 - RNA, 19 nt, Homo sapiens
caggagaacccgaguggaa

SEQ ID NO: 531782 - RNA, 19 nt, Homo sapiens
ugaggaagaggacgaacua

SEQ ID NO: 531783 - RNA, 19 nt, Homo sapiens
cuacagcauuguuaacauc

SEQ ID NO: 531784 - RNA, 19 nt, Homo sapiens
ccauaaggcucagcagcaa

SEQ ID NO: 531785 - RNA, 19 nt, Homo sapiens
ugaaagcaacaacagaauu

SEQ ID NO: 531786 - RNA, 19 nt, Homo sapiens
gaacuucaaugaugaggaa

SEQ ID NO: 531787 - RNA, 19 nt, Homo sapiens
gaaacacacucucuucuca

SEQ ID NO: 531788 - RNA, 19 nt, Homo sapiens
gugcagcccuccacauuua

SEQ ID NO: 531789 - RNA, 19 nt, Homo sapiens
gaacugugcgaucuuaaua

SEQ ID NO: 531790 - RNA, 19 nt, Homo sapiens
gaucaagacuguggacgua

SEQ ID NO: 531791 - RNA, 19 nt, Homo sapiens
gaacaaugcucagucuaug

SEQ ID NO: 531792 - RNA, 19 nt, Homo sapiens
ugacgggaaucaucucuua

SEQ ID NO: 531793 - RNA, 19 nt, Homo sapiens
caacagcaauugugucuca

SEQ ID NO: 531794 - RNA, 19 nt, Homo sapiens
ggaaagauaaggacauuga

SEQ ID NO: 531795 - RNA, 19 nt, Homo sapiens
gugaacaguuggaaagaua

SEQ ID NO: 531796 - RNA, 19 nt, Homo sapiens
ccagaaagccagcaucuaa

SEQ ID NO: 531797 - RNA, 19 nt, Homo sapiens
gaagaggacgaacuaauga

SEQ ID NO: 531798 - RNA, 19 nt, Homo sapiens
caacagcccaugcagcuua

SEQ ID NO: 531799 - RNA, 19 nt, Homo sapiens
gcaauugcuucuacaacaa

SEQ ID NO: 531800 - RNA, 19 nt, Homo sapiens
ggaagaggacgaacuaaug

SEQ ID NO: 531801 - RNA, 19 nt, Homo sapiens
ggaaaggucugcggcaugu

SEQ ID NO: 531802 - RNA, 19 nt, Homo sapiens
gcagacgccuggaacaaga

SEQ ID NO: 531803 - RNA, 19 nt, Homo sapiens
ggacugugccuguuaaguu

SEQ ID NO: 531804 - RNA, 19 nt, Homo sapiens
gaaagcaacaacagaauuc

SEQ ID NO: 531805 - RNA, 19 nt, Homo sapiens
caaguggacucagaagaaa

SEQ ID NO: 531806 - RNA, 19 nt, Homo sapiens
gacaagaaccgcaagaaug

SEQ ID NO: 531807 - RNA, 19 nt, Homo sapiens
ccaacaggaugguaucuau

SEQ ID NO: 531808 - RNA, 19 nt, Homo sapiens
gaacgaggaggaagagaga

SEQ ID NO: 531809 - RNA, 19 nt, Homo sapiens
gcgaugaaguagcaaauag

SEQ ID NO: 531810 - RNA, 19 nt, Homo sapiens
gcacacacauguccaccau

SEQ ID NO: 531811 - RNA, 19 nt, Homo sapiens
gcaaacacccucugugagu

SEQ ID NO: 531812 - RNA, 19 nt, Homo sapiens
gcuguaaggucaugcugaa

SEQ ID NO: 531813 - RNA, 19 nt, Homo sapiens
caagacagcuauuuuguug

SEQ ID NO: 531814 - RNA, 19 nt, Homo sapiens
gcuauggguuucaucuuga

SEQ ID NO: 531815 - RNA, 19 nt, Homo sapiens
caacacggccucugugguu

SEQ ID NO: 531816 - RNA, 19 nt, Homo sapiens
ccacccggcugauguuuga

SEQ ID NO: 531817 - RNA, 19 nt, Homo sapiens
ucagaaaggccacaucuug

SEQ ID NO: 531818 - RNA, 19 nt, Homo sapiens
gaaaccaccaccucuguug

SEQ ID NO: 531819 - RNA, 19 nt, Homo sapiens
acaagaaccgcaagaauga

SEQ ID NO: 531820 - RNA, 19 nt, Homo sapiens
gcaaauagugacagugaau

SEQ ID NO: 531821 - RNA, 19 nt, Homo sapiens
aagaaagggucaucaggaa

SEQ ID NO: 531822 - RNA, 19 nt, Homo sapiens
gcacuuugcccaccacaug

SEQ ID NO: 531823 - RNA, 19 nt, Homo sapiens
gcugagggcugcauuuguc

SEQ ID NO: 531824 - RNA, 19 nt, Homo sapiens
gauacaguuugccguggua

SEQ ID NO: 531825 - RNA, 19 nt, Homo sapiens
ccaaguggacucagaagaa

SEQ ID NO: 531826 - RNA, 19 nt, Homo sapiens
gcugagagcugugaauguc

SEQ ID NO: 531827 - RNA, 19 nt, Homo sapiens
ggaguucgcauaccacaug

SEQ ID NO: 531828 - RNA, 19 nt, Homo sapiens
gaaagggucaucaggaaag

SEQ ID NO: 531829 - RNA, 19 nt, Homo sapiens
gacugugccuguuaaguug

SEQ ID NO: 531830 - RNA, 19 nt, Homo sapiens
caaacacccucugugaguu

SEQ ID NO: 531831 - RNA, 19 nt, Homo sapiens
gugaauuugugaacaguug

SEQ ID NO: 531832 - RNA, 19 nt, Homo sapiens
uacgugagcuuugauggua

SEQ ID NO: 531833 - RNA, 19 nt, Homo sapiens
gacaacagcaacagcaauu

SEQ ID NO: 531834 - RNA, 19 nt, Homo sapiens
ccuacaaucuccaccaaga

SEQ ID NO: 531835 - RNA, 19 nt, Homo sapiens
gcagcagcuuucugacuga

SEQ ID NO: 531836 - RNA, 19 nt, Homo sapiens
ggaaggacgcaacaagaug

SEQ ID NO: 531837 - RNA, 19 nt, Homo sapiens
gcuuaagaauggccaguau

SEQ ID NO: 531838 - RNA, 19 nt, Homo sapiens
acuaucaucuccacagaaa

SEQ ID NO: 531839 - RNA, 19 nt, Homo sapiens
cauuuaugcuucagucuug

SEQ ID NO: 531840 - RNA, 19 nt, Homo sapiens
uguaaucgcgucuguauga

SEQ ID NO: 531841 - RNA, 19 nt, Homo sapiens
ugaccuauguucugaucaa

SEQ ID NO: 531842 - RNA, 19 nt, Homo sapiens
cccguuaccucacauuuga

SEQ ID NO: 531843 - RNA, 19 nt, Homo sapiens
gcuaugugcugagugaaga

SEQ ID NO: 531844 - RNA, 19 nt, Homo sapiens
caacaacgacuacuaugag

SEQ ID NO: 531845 - RNA, 19 nt, Homo sapiens
acagagcgcugcccuccaa

SEQ ID NO: 531846 - RNA, 19 nt, Homo sapiens
guugauuucugauccuuga

SEQ ID NO: 531847 - RNA, 19 nt, Homo sapiens
gagagugcauuuacagaac

SEQ ID NO: 531848 - RNA, 19 nt, Homo sapiens
ggacauugacccaaguugu

SEQ ID NO: 531849 - RNA, 19 nt, Homo sapiens
ugugggaacuucaaugaug

SEQ ID NO: 531850 - RNA, 19 nt, Homo sapiens
gaagggccaccgugugcua

SEQ ID NO: 531851 - RNA, 19 nt, Homo sapiens
caagaucagugccaagcau

SEQ ID NO: 531852 - RNA, 19 nt, Homo sapiens
gaacuaugacggcaacagu

SEQ ID NO: 531853 - RNA, 19 nt, Homo sapiens
caacucaacagacccauuc

SEQ ID NO: 531854 - RNA, 19 nt, Homo sapiens
cuacggagacccucauuau

SEQ ID NO: 531855 - RNA, 19 nt, Homo sapiens
agacuaccaucucuacaga

SEQ ID NO: 531856 - RNA, 19 nt, Homo sapiens
ugaaaccacuggccucaca

SEQ ID NO: 531857 - RNA, 19 nt, Homo sapiens
ccgcaagaaugacaugaug

SEQ ID NO: 531858 - RNA, 19 nt, Homo sapiens
gugcaaacacccucuguga

SEQ ID NO: 531859 - RNA, 19 nt, Homo sapiens
gcccagcgaugaaguagca

SEQ ID NO: 531860 - RNA, 19 nt, Homo sapiens
gugggaacuucaaugauga

SEQ ID NO: 531861 - RNA, 19 nt, Homo sapiens
cagaaaggccacaucuuga

SEQ ID NO: 531862 - RNA, 19 nt, Homo sapiens
gaccaggagugucagaagu

SEQ ID NO: 531863 - RNA, 19 nt, Homo sapiens
guaaggucaugcugaaugg

SEQ ID NO: 531864 - RNA, 19 nt, Homo sapiens
acaaugaccaccugaaguu

SEQ ID NO: 531865 - RNA, 19 nt, Homo sapiens
gguuucaucuugaucaauc

SEQ ID NO: 531866 - RNA, 19 nt, Homo sapiens
caacgcccaucccuucugu

SEQ ID NO: 531867 - RNA, 19 nt, Homo sapiens
gaugugcucuggaaacacu

SEQ ID NO: 531868 - RNA, 19 nt, Homo sapiens
cagcuuugguggaaggaaa

SEQ ID NO: 531869 - RNA, 19 nt, Homo sapiens
uagcaaauagugacaguga

SEQ ID NO: 531870 - RNA, 19 nt, Homo sapiens
cugcaaacccaaccagaua

SEQ ID NO: 531871 - RNA, 19 nt, Homo sapiens
gcgaagccaugcccugaca

SEQ ID NO: 531872 - RNA, 19 nt, Homo sapiens
agacuaccaucuccacaga

SEQ ID NO: 531873 - RNA, 19 nt, Homo sapiens
agacuaccaucuccacaga

SEQ ID NO: 531874 - RNA, 19 nt, Homo sapiens
gaucaauccugggacuugu

SEQ ID NO: 531875 - RNA, 19 nt, Homo sapiens
gggaguauccggaaacaca

SEQ ID NO: 531876 - RNA, 19 nt, Homo sapiens
ccuguuaaguugcucaguu

SEQ ID NO: 531877 - RNA, 19 nt, Homo sapiens
gugcuucucuguucauucu

SEQ ID NO: 531878 - RNA, 19 nt, Homo sapiens
caggagaacccgaguggaa

SEQ ID NO: 531879 - RNA, 19 nt, Homo sapiens
uaacggagagggcagcuau

SEQ ID NO: 531880 - RNA, 19 nt, Homo sapiens
ugaggaagaggacgaacua

SEQ ID NO: 531881 - RNA, 19 nt, Homo sapiens
cuacagcauuguuaacauc

SEQ ID NO: 531882 - RNA, 19 nt, Homo sapiens
ccauaaggcucagcagcaa

SEQ ID NO: 531883 - RNA, 19 nt, Homo sapiens
ugaaagcaacaacagaauu

SEQ ID NO: 531884 - RNA, 19 nt, Homo sapiens
cuacaacaacgacuacuau

SEQ ID NO: 531885 - RNA, 19 nt, Homo sapiens
ccaaaugcccgcuacgaau

SEQ ID NO: 531886 - RNA, 19 nt, Homo sapiens
gaacuucaaugaugaggaa

SEQ ID NO: 531887 - RNA, 19 nt, Homo sapiens
gaaacacacucucuucuca

SEQ ID NO: 531888 - RNA, 19 nt, Homo sapiens
gugcagcccuccacauuua

SEQ ID NO: 531889 - RNA, 19 nt, Homo sapiens
gaacugugcgaucuuaaua

SEQ ID NO: 531890 - RNA, 19 nt, Homo sapiens
gaucaagacuguggacgua

SEQ ID NO: 531891 - RNA, 19 nt, Homo sapiens
gaacaaugcucagucuaug

SEQ ID NO: 531892 - RNA, 19 nt, Homo sapiens
ugacgggaaucaucucuua

SEQ ID NO: 531893 - RNA, 19 nt, Homo sapiens
caacagcaauugugucuca

SEQ ID NO: 531894 - RNA, 19 nt, Homo sapiens
ggaaagauaaggacauuga

SEQ ID NO: 531895 - RNA, 19 nt, Homo sapiens
gugaacaguuggaaagaua

SEQ ID NO: 531896 - RNA, 19 nt, Homo sapiens
ccagaaagccagcaucuaa

SEQ ID NO: 531897 - RNA, 19 nt, Homo sapiens
gaagaggacgaacuaauga

SEQ ID NO: 531898 - RNA, 19 nt, Homo sapiens
caacagcccaugcagcuua

SEQ ID NO: 531899 - RNA, 19 nt, Homo sapiens
gcaauugcuucuacaacaa

SEQ ID NO: 531900 - RNA, 19 nt, Homo sapiens
ggaagaggacgaacuaaug

SEQ ID NO: 531901 - RNA, 19 nt, Homo sapiens
ggaaaggucugcggcaugu

SEQ ID NO: 531902 - RNA, 19 nt, Homo sapiens
gcagacgccuggaacaaga

SEQ ID NO: 531903 - RNA, 19 nt, Homo sapiens
ggacugugccuguuaaguu

SEQ ID NO: 531904 - RNA, 19 nt, Homo sapiens
gaaagcaacaacagaauuc

SEQ ID NO: 531905 - RNA, 19 nt, Homo sapiens
caaguggacucagaagaaa

SEQ ID NO: 531906 - RNA, 19 nt, Homo sapiens
gacaagaaccgcaagaaug

SEQ ID NO: 531907 - RNA, 19 nt, Homo sapiens
ccaacaggaugguaucuau

SEQ ID NO: 531908 - RNA, 19 nt, Homo sapiens
gaacgaggaggaagagaga

SEQ ID NO: 531909 - RNA, 19 nt, Homo sapiens
gcgaugaaguagcaaauag

SEQ ID NO: 531910 - RNA, 19 nt, Homo sapiens
gcacacacauguccaccau

SEQ ID NO: 531911 - RNA, 19 nt, Homo sapiens
gcaaacacccucugugagu

SEQ ID NO: 531912 - RNA, 19 nt, Homo sapiens
gcuguaaggucaugcugaa

SEQ ID NO: 531913 - RNA, 19 nt, Homo sapiens
caagacagcuauuuuguug

SEQ ID NO: 531914 - RNA, 19 nt, Homo sapiens
gcuauggguuucaucuuga

SEQ ID NO: 531915 - RNA, 19 nt, Homo sapiens
caacacggccucugugguu

SEQ ID NO: 531916 - RNA, 19 nt, Homo sapiens
ccacccggcugauguuuga

SEQ ID NO: 531917 - RNA, 19 nt, Homo sapiens
ucagaaaggccacaucuug

SEQ ID NO: 531918 - RNA, 19 nt, Homo sapiens
gaaaccaccaccucuguug

SEQ ID NO: 531919 - RNA, 19 nt, Homo sapiens
acaagaaccgcaagaauga

SEQ ID NO: 531920 - RNA, 19 nt, Homo sapiens
gcaaauagugacagugaau

SEQ ID NO: 531921 - RNA, 19 nt, Homo sapiens
aagaaagggucaucaggaa

SEQ ID NO: 531922 - RNA, 19 nt, Homo sapiens
gcacuuugcccaccacaug

SEQ ID NO: 531923 - RNA, 19 nt, Homo sapiens
gcugagggcugcauuuguc

SEQ ID NO: 531924 - RNA, 19 nt, Homo sapiens
gauacaguuugccguggua

SEQ ID NO: 531925 - RNA, 19 nt, Homo sapiens
ccaaguggacucagaagaa

SEQ ID NO: 531926 - RNA, 19 nt, Homo sapiens
gcugagagcugugaauguc

SEQ ID NO: 531927 - RNA, 19 nt, Homo sapiens
ggaguucgcauaccacaug

SEQ ID NO: 531928 - RNA, 19 nt, Homo sapiens
gaaagggucaucaggaaag

SEQ ID NO: 531929 - RNA, 19 nt, Homo sapiens
gacugugccuguuaaguug

SEQ ID NO: 531930 - RNA, 19 nt, Homo sapiens
caaacacccucugugaguu

SEQ ID NO: 531931 - RNA, 19 nt, Homo sapiens
gugaauuugugaacaguug

SEQ ID NO: 531932 - RNA, 19 nt, Homo sapiens
uacgugagcuuugauggua

SEQ ID NO: 531933 - RNA, 19 nt, Homo sapiens
gacaacagcaacagcaauu

SEQ ID NO: 531934 - RNA, 19 nt, Homo sapiens
ccuacaaucuccaccaaga

SEQ ID NO: 531935 - RNA, 19 nt, Homo sapiens
gcagcagcuuucugacuga

SEQ ID NO: 531936 - RNA, 19 nt, Homo sapiens
ggaaggacgcaacaagaug

SEQ ID NO: 531937 - RNA, 19 nt, Homo sapiens
gcuuaagaauggccaguau

SEQ ID NO: 531938 - RNA, 19 nt, Homo sapiens
acuaucaucuccacagaaa

SEQ ID NO: 531939 - RNA, 19 nt, Homo sapiens
cauuuaugcuucagucuug

SEQ ID NO: 531940 - RNA, 19 nt, Homo sapiens
uguaaucgcgucuguauga

SEQ ID NO: 531941 - RNA, 19 nt, Homo sapiens
ugaccuauguucugaucaa

SEQ ID NO: 531942 - RNA, 19 nt, Homo sapiens
cccguuaccucacauuuga

SEQ ID NO: 531943 - RNA, 19 nt, Homo sapiens
gcuaugugcugagugaaga

SEQ ID NO: 531944 - RNA, 19 nt, Homo sapiens
caacaacgacuacuaugag

SEQ ID NO: 531945 - RNA, 19 nt, Homo sapiens
acagagcgcugcccuccaa

SEQ ID NO: 531946 - RNA, 19 nt, Homo sapiens
guugauuucugauccuuga

SEQ ID NO: 531947 - RNA, 19 nt, Homo sapiens
gagagugcauuuacagaac

SEQ ID NO: 531948 - RNA, 19 nt, Homo sapiens
ggacauugacccaaguugu

SEQ ID NO: 531949 - RNA, 19 nt, Homo sapiens
ugugggaacuucaaugaug

SEQ ID NO: 531950 - RNA, 19 nt, Homo sapiens
gaagggccaccgugugcua

SEQ ID NO: 531951 - RNA, 19 nt, Homo sapiens
caagaucagugccaagcau

SEQ ID NO: 531952 - RNA, 19 nt, Homo sapiens
gaacuaugacggcaacagu

SEQ ID NO: 531953 - RNA, 19 nt, Homo sapiens
caacucaacagacccauuc

SEQ ID NO: 531954 - RNA, 19 nt, Homo sapiens
cuacggagacccucauuau

SEQ ID NO: 531955 - RNA, 19 nt, Homo sapiens
agacuaccaucucuacaga

SEQ ID NO: 531956 - RNA, 19 nt, Homo sapiens
ugaaaccacuggccucaca

SEQ ID NO: 531957 - RNA, 19 nt, Homo sapiens
ccgcaagaaugacaugaug

SEQ ID NO: 531958 - RNA, 19 nt, Homo sapiens
gugcaaacacccucuguga

SEQ ID NO: 531959 - RNA, 19 nt, Homo sapiens
gcccagcgaugaaguagca

SEQ ID NO: 531960 - RNA, 19 nt, Homo sapiens
gugggaacuucaaugauga

SEQ ID NO: 531961 - RNA, 19 nt, Homo sapiens
cagaaaggccacaucuuga

SEQ ID NO: 531962 - RNA, 19 nt, Homo sapiens
gaccaggagugucagaagu

SEQ ID NO: 531963 - RNA, 19 nt, Homo sapiens
guaaggucaugcugaaugg

SEQ ID NO: 531964 - RNA, 19 nt, Homo sapiens
acaaugaccaccugaaguu

SEQ ID NO: 531965 - RNA, 19 nt, Homo sapiens
gguuucaucuugaucaauc

SEQ ID NO: 531966 - RNA, 19 nt, Homo sapiens
caacgcccaucccuucugu

SEQ ID NO: 531967 - RNA, 19 nt, Homo sapiens
gaugugcucuggaaacacu

SEQ ID NO: 531968 - RNA, 19 nt, Homo sapiens
cagcuuugguggaaggaaa

SEQ ID NO: 531969 - RNA, 19 nt, Homo sapiens
uagcaaauagugacaguga

SEQ ID NO: 531970 - RNA, 19 nt, Homo sapiens
cugcaaacccaaccagaua

SEQ ID NO: 531971 - RNA, 19 nt, Homo sapiens
gcgaagccaugcccugaca

SEQ ID NO: 531972 - RNA, 19 nt, Homo sapiens
agacuaccaucuccacaga

SEQ ID NO: 531973 - RNA, 19 nt, Homo sapiens
agacuaccaucuccacaga

SEQ ID NO: 531974 - RNA, 19 nt, Homo sapiens
gaucaauccugggacuugu

SEQ ID NO: 531975 - RNA, 19 nt, Homo sapiens
gggaguauccggaaacaca

SEQ ID NO: 531976 - RNA, 19 nt, Homo sapiens
ccuguuaaguugcucaguu

SEQ ID NO: 531977 - RNA, 19 nt, Homo sapiens
gugcuucucuguucauucu

SEQ ID NO: 531978 - RNA, 19 nt, Homo sapiens
caggagaacccgaguggaa

SEQ ID NO: 531979 - RNA, 19 nt, Homo sapiens
uaacggagagggcagcuau

SEQ ID NO: 531980 - RNA, 19 nt, Homo sapiens
ugaggaagaggacgaacua

SEQ ID NO: 531981 - RNA, 19 nt, Homo sapiens
cuacagcauuguuaacauc

SEQ ID NO: 531982 - RNA, 19 nt, Homo sapiens
ccauaaggcucagcagcaa

SEQ ID NO: 531983 - RNA, 19 nt, Homo sapiens
ugaaagcaacaacagaauu

SEQ ID NO: 531984 - RNA, 19 nt, Homo sapiens
cuacaacaacgacuacuau

SEQ ID NO: 531985 - RNA, 19 nt, Homo sapiens
ccaaaugcccgcuacgaau

SEQ ID NO: 531986 - RNA, 19 nt, Homo sapiens
gaacuucaaugaugaggaa

SEQ ID NO: 531987 - RNA, 19 nt, Homo sapiens
gaaacacacucucuucuca

SEQ ID NO: 531988 - RNA, 19 nt, Homo sapiens
gugcagcccuccacauuua

SEQ ID NO: 531989 - RNA, 19 nt, Homo sapiens
gaacugugcgaucuuaaua

SEQ ID NO: 531990 - RNA, 19 nt, Homo sapiens
gaucaagacuguggacgua

SEQ ID NO: 531991 - RNA, 19 nt, Homo sapiens
gaacaaugcucagucuaug

SEQ ID NO: 531992 - RNA, 19 nt, Homo sapiens
ugacgggaaucaucucuua

SEQ ID NO: 531993 - RNA, 19 nt, Homo sapiens
caacagcaauugugucuca

SEQ ID NO: 531994 - RNA, 19 nt, Homo sapiens
ggaaagauaaggacauuga

SEQ ID NO: 531995 - RNA, 19 nt, Homo sapiens
gugaacaguuggaaagaua

SEQ ID NO: 531996 - RNA, 19 nt, Homo sapiens
ccagaaagccagcaucuaa

SEQ ID NO: 531997 - RNA, 19 nt, Homo sapiens
gaagaggacgaacuaauga

SEQ ID NO: 531998 - RNA, 19 nt, Homo sapiens
caacagcccaugcagcuua

SEQ ID NO: 531999 - RNA, 19 nt, Homo sapiens
gcaauugcuucuacaacaa

SEQ ID NO: 532000 - RNA, 19 nt, Homo sapiens
ggaagaggacgaacuaaug

SEQ ID NO: 532001 - RNA, 19 nt, Homo sapiens
ggaaaggucugcggcaugu

SEQ ID NO: 532002 - RNA, 19 nt, Homo sapiens
gcagacgccuggaacaaga

SEQ ID NO: 532003 - RNA, 19 nt, Homo sapiens
ggacugugccuguuaaguu

SEQ ID NO: 532004 - RNA, 19 nt, Homo sapiens
gaaagcaacaacagaauuc

SEQ ID NO: 532005 - RNA, 19 nt, Homo sapiens
caaguggacucagaagaaa

SEQ ID NO: 532006 - RNA, 19 nt, Homo sapiens
gacaagaaccgcaagaaug

SEQ ID NO: 532007 - RNA, 19 nt, Homo sapiens
ccaacaggaugguaucuau

SEQ ID NO: 532008 - RNA, 19 nt, Homo sapiens
gaacgaggaggaagagaga

SEQ ID NO: 532009 - RNA, 19 nt, Homo sapiens
gcgaugaaguagcaaauag

SEQ ID NO: 532010 - RNA, 19 nt, Homo sapiens
gcacacacauguccaccau

SEQ ID NO: 532011 - RNA, 19 nt, Homo sapiens
gcaaacacccucugugagu

SEQ ID NO: 532012 - RNA, 19 nt, Homo sapiens
gcuguaaggucaugcugaa

SEQ ID NO: 532013 - RNA, 19 nt, Homo sapiens
caagacagcuauuuuguug

SEQ ID NO: 532014 - RNA, 19 nt, Homo sapiens
gcuauggguuucaucuuga

SEQ ID NO: 532015 - RNA, 19 nt, Homo sapiens
caacacggccucugugguu

SEQ ID NO: 532016 - RNA, 19 nt, Homo sapiens
ccacccggcugauguuuga

SEQ ID NO: 532017 - RNA, 19 nt, Homo sapiens
ucagaaaggccacaucuug

SEQ ID NO: 532018 - RNA, 19 nt, Homo sapiens
gaaaccaccaccucuguug

SEQ ID NO: 532019 - RNA, 19 nt, Homo sapiens
acaagaaccgcaagaauga

SEQ ID NO: 532020 - RNA, 19 nt, Homo sapiens
gcaaauagugacagugaau

SEQ ID NO: 532021 - RNA, 19 nt, Homo sapiens
aagaaagggucaucaggaa

SEQ ID NO: 532022 - RNA, 19 nt, Homo sapiens
gcacuuugcccaccacaug

SEQ ID NO: 532023 - RNA, 19 nt, Homo sapiens
gcugagggcugcauuuguc

SEQ ID NO: 532024 - RNA, 19 nt, Homo sapiens
gauacaguuugccguggua

SEQ ID NO: 532025 - RNA, 19 nt, Homo sapiens
ccaaguggacucagaagaa

SEQ ID NO: 532026 - RNA, 19 nt, Homo sapiens
gcugagagcugugaauguc

SEQ ID NO: 532027 - RNA, 19 nt, Homo sapiens
ggaguucgcauaccacaug

SEQ ID NO: 532028 - RNA, 19 nt, Homo sapiens
gaaagggucaucaggaaag

SEQ ID NO: 532029 - RNA, 19 nt, Homo sapiens
gacugugccuguuaaguug

SEQ ID NO: 532030 - RNA, 19 nt, Homo sapiens
caaacacccucugugaguu

SEQ ID NO: 532031 - RNA, 19 nt, Homo sapiens
gugaauuugugaacaguug

SEQ ID NO: 532032 - RNA, 19 nt, Homo sapiens
uacgugagcuuugauggua

SEQ ID NO: 532033 - RNA, 19 nt, Homo sapiens
gacaacagcaacagcaauu

SEQ ID NO: 532034 - RNA, 19 nt, Homo sapiens
ccuacaaucuccaccaaga

SEQ ID NO: 532035 - RNA, 19 nt, Homo sapiens
ggaaggacgcaacaagaug

SEQ ID NO: 532036 - RNA, 19 nt, Homo sapiens
gcuuaagaauggccaguau

SEQ ID NO: 532037 - RNA, 19 nt, Homo sapiens
acuaucaucuccacagaaa

SEQ ID NO: 532038 - RNA, 19 nt, Homo sapiens
cauuuaugcuucagucuug

SEQ ID NO: 532039 - RNA, 19 nt, Homo sapiens
uguaaucgcgucuguauga

SEQ ID NO: 532040 - RNA, 19 nt, Homo sapiens
ugaccuauguucugaucaa

SEQ ID NO: 532041 - RNA, 19 nt, Homo sapiens
cccguuaccucacauuuga

SEQ ID NO: 532042 - RNA, 19 nt, Homo sapiens
gcuaugugcugagugaaga

SEQ ID NO: 532043 - RNA, 19 nt, Homo sapiens
caacaacgacuacuaugag

SEQ ID NO: 532044 - RNA, 19 nt, Homo sapiens
acagagcgcugcccuccaa

SEQ ID NO: 532045 - RNA, 19 nt, Homo sapiens
guugauuucugauccuuga

SEQ ID NO: 532046 - RNA, 19 nt, Homo sapiens
gagagugcauuuacagaac

SEQ ID NO: 532047 - RNA, 19 nt, Homo sapiens
ggacauugacccaaguugu

SEQ ID NO: 532048 - RNA, 19 nt, Homo sapiens
ugugggaacuucaaugaug

SEQ ID NO: 532049 - RNA, 19 nt, Homo sapiens
gaagggccaccgugugcua

SEQ ID NO: 532050 - RNA, 19 nt, Homo sapiens
caagaucagugccaagcau

SEQ ID NO: 532051 - RNA, 19 nt, Homo sapiens
gaacuaugacggcaacagu

SEQ ID NO: 532052 - RNA, 19 nt, Homo sapiens
caacucaacagacccauuc

SEQ ID NO: 532053 - RNA, 19 nt, Homo sapiens
cuacggagacccucauuau

SEQ ID NO: 532054 - RNA, 19 nt, Homo sapiens
agacuaccaucucuacaga

SEQ ID NO: 532055 - RNA, 19 nt, Homo sapiens
ugaaaccacuggccucaca

SEQ ID NO: 532056 - RNA, 19 nt, Homo sapiens
ccgcaagaaugacaugaug

SEQ ID NO: 532057 - RNA, 19 nt, Homo sapiens
gugcaaacacccucuguga

SEQ ID NO: 532058 - RNA, 19 nt, Homo sapiens
gcccagcgaugaaguagca

SEQ ID NO: 532059 - RNA, 19 nt, Homo sapiens
gugggaacuucaaugauga

SEQ ID NO: 532060 - RNA, 19 nt, Homo sapiens
cagaaaggccacaucuuga

SEQ ID NO: 532061 - RNA, 19 nt, Homo sapiens
gaccaggagugucagaagu

SEQ ID NO: 532062 - RNA, 19 nt, Homo sapiens
guaaggucaugcugaaugg

SEQ ID NO: 532063 - RNA, 19 nt, Homo sapiens
acaaugaccaccugaaguu

SEQ ID NO: 532064 - RNA, 19 nt, Homo sapiens
gguuucaucuugaucaauc

SEQ ID NO: 532065 - RNA, 19 nt, Homo sapiens
caacgcccaucccuucugu

SEQ ID NO: 532066 - RNA, 19 nt, Homo sapiens
gaugugcucuggaaacacu

SEQ ID NO: 532067 - RNA, 19 nt, Homo sapiens
cagcuuugguggaaggaaa

SEQ ID NO: 532068 - RNA, 19 nt, Homo sapiens
uagcaaauagugacaguga

SEQ ID NO: 532069 - RNA, 19 nt, Homo sapiens
cugcaaacccaaccagaua

SEQ ID NO: 532070 - RNA, 19 nt, Homo sapiens
gcgaagccaugcccugaca

SEQ ID NO: 532071 - RNA, 19 nt, Homo sapiens
agacuaccaucuccacaga

SEQ ID NO: 532072 - RNA, 19 nt, Homo sapiens
agacuaccaucuccacaga

SEQ ID NO: 532073 - RNA, 19 nt, Homo sapiens
gaucaauccugggacuugu

SEQ ID NO: 532074 - RNA, 19 nt, Homo sapiens
gggaguauccggaaacaca

SEQ ID NO: 532075 - RNA, 19 nt, Homo sapiens
ccuguuaaguugcucaguu

SEQ ID NO: 532076 - RNA, 19 nt, Homo sapiens
gugcuucucuguucauucu

SEQ ID NO: 532077 - RNA, 19 nt, Homo sapiens
caggagaacccgaguggaa

SEQ ID NO: 532078 - RNA, 19 nt, Homo sapiens
ugaggaagaggacgaacua

SEQ ID NO: 532079 - RNA, 19 nt, Homo sapiens
cuacagcauuguuaacauc

SEQ ID NO: 532080 - RNA, 19 nt, Homo sapiens
uaacggagagggcagcuau

SEQ ID NO: 532081 - RNA, 19 nt, Homo sapiens
ccauaaggcucagcagcaa

SEQ ID NO: 532082 - RNA, 19 nt, Homo sapiens
ugaaagcaacaacagaauu

SEQ ID NO: 532083 - RNA, 19 nt, Homo sapiens
cuacaacaacgacuacuau

SEQ ID NO: 532084 - RNA, 19 nt, Homo sapiens
ccaaaugcccgcuacgaau

SEQ ID NO: 532085 - RNA, 19 nt, Homo sapiens
gaagcaacacggccucugu

SEQ ID NO: 532086 - RNA, 19 nt, Homo sapiens
ugacagaagugcaccaaua

SEQ ID NO: 532087 - RNA, 19 nt, Homo sapiens
gcaccuagcuuuucauauu

SEQ ID NO: 532088 - RNA, 19 nt, Homo sapiens
ggaagaaacuaaagaagac

SEQ ID NO: 532089 - RNA, 19 nt, Homo sapiens
agaagacggucaccaauga

SEQ ID NO: 532090 - RNA, 19 nt, Homo sapiens
gcaaagggaagaaacuaaa

SEQ ID NO: 532091 - RNA, 19 nt, Homo sapiens
caaccaaauucaaacauuc

SEQ ID NO: 532092 - RNA, 19 nt, Homo sapiens
caacagggauaaugauucu

SEQ ID NO: 532093 - RNA, 19 nt, Homo sapiens
ccaaccaaauucaaacauu

SEQ ID NO: 532094 - RNA, 19 nt, Homo sapiens
ccaagacucuccaugugaa

SEQ ID NO: 532095 - RNA, 19 nt, Homo sapiens
gggaagaaacuaaagaaga

SEQ ID NO: 532096 - RNA, 19 nt, Homo sapiens
gaagaugagugggaaagca

SEQ ID NO: 532097 - RNA, 19 nt, Homo sapiens
uagcauuccuccuccagua

SEQ ID NO: 532098 - RNA, 19 nt, Homo sapiens
aagccuaccuugaauaaga

SEQ ID NO: 532099 - RNA, 19 nt, Homo sapiens
cagagaagccuaccuugaa

SEQ ID NO: 532100 - RNA, 19 nt, Homo sapiens
ugacuugcaucccagcuuu

SEQ ID NO: 532101 - RNA, 19 nt, Homo sapiens
caagacuguucaacgcaua

SEQ ID NO: 532102 - RNA, 19 nt, Homo sapiens
agaaauggcuuccaagacu

SEQ ID NO: 532103 - RNA, 19 nt, Homo sapiens
gcucaaagccugauagcau

SEQ ID NO: 532104 - RNA, 19 nt, Homo sapiens
ggaaagcagauucuacuuc

SEQ ID NO: 532105 - RNA, 19 nt, Homo sapiens
uaaagaagacggucaccaa

SEQ ID NO: 532106 - RNA, 19 nt, Homo sapiens
gauaaugauucuggaggaa

SEQ ID NO: 532107 - RNA, 19 nt, Homo sapiens
gagaagccuaccuugaaua

SEQ ID NO: 532108 - RNA, 19 nt, Homo sapiens
acgcauaacugcccaagau

SEQ ID NO: 532109 - RNA, 19 nt, Homo sapiens
aacauucacugcuuauuug

SEQ ID NO: 532110 - RNA, 19 nt, Homo sapiens
cucaagagcugcuucuguu

SEQ ID NO: 532111 - RNA, 19 nt, Homo sapiens
ggaggaagccgaccaccau

SEQ ID NO: 532112 - RNA, 19 nt, Homo sapiens
caucccagcuuuccaccaa

SEQ ID NO: 532113 - RNA, 19 nt, Homo sapiens
caagacccauucaaucaag

SEQ ID NO: 532114 - RNA, 19 nt, Homo sapiens
cggaaucugucccucaguu

SEQ ID NO: 532115 - RNA, 19 nt, Homo sapiens
agagaagccuaccuugaau

SEQ ID NO: 532116 - RNA, 19 nt, Homo sapiens
ggauccaaccgaagagaaa

SEQ ID NO: 532117 - RNA, 19 nt, Homo sapiens
ccagagccauauguacaaa

SEQ ID NO: 532118 - RNA, 19 nt, Homo sapiens
uauuagaaauggcuuccaa

SEQ ID NO: 532119 - RNA, 19 nt, Homo sapiens
ccaccaucaacaucuauua

SEQ ID NO: 532120 - RNA, 19 nt, Homo sapiens
gcagggccuuggaugacaa

SEQ ID NO: 532121 - RNA, 19 nt, Homo sapiens
gcacuggccaauacagaga

SEQ ID NO: 532122 - RNA, 19 nt, Homo sapiens
ggaagccgaccaccauugu

SEQ ID NO: 532123 - RNA, 19 nt, Homo sapiens
caaacuggcaagaaacgaa

SEQ ID NO: 532124 - RNA, 19 nt, Homo sapiens
agaagccuaccuugaauaa

SEQ ID NO: 532125 - RNA, 19 nt, Homo sapiens
cucaaagccugauagcauu

SEQ ID NO: 532126 - RNA, 19 nt, Homo sapiens
uaagaaaugcaccuagcuu

SEQ ID NO: 532127 - RNA, 19 nt, Homo sapiens
caaaaguuaucccagcaaa

SEQ ID NO: 532128 - RNA, 19 nt, Homo sapiens
uucaaacauucacugcuua

SEQ ID NO: 532129 - RNA, 19 nt, Homo sapiens
gggaaucgguaagaaaugc

SEQ ID NO: 532130 - RNA, 19 nt, Homo sapiens
uccauccgauuuccgauuu

SEQ ID NO: 532131 - RNA, 19 nt, Homo sapiens
aggcagagaugacuugcau

SEQ ID NO: 532132 - RNA, 19 nt, Homo sapiens
acagagaagccuaccuuga

SEQ ID NO: 532133 - RNA, 19 nt, Homo sapiens
ucgauaggcuuuugucgua

SEQ ID NO: 532134 - RNA, 19 nt, Homo sapiens
ccaagacccauucaaucaa

SEQ ID NO: 532135 - RNA, 19 nt, Homo sapiens
cagcaaagggaagaaacua

SEQ ID NO: 532136 - RNA, 19 nt, Homo sapiens
auucaaacauucacugcuu

SEQ ID NO: 532137 - RNA, 19 nt, Homo sapiens
aagaaaugcaccuagcuuu

SEQ ID NO: 532138 - RNA, 19 nt, Homo sapiens
ggugggaaucgguaagaaa

SEQ ID NO: 532139 - RNA, 19 nt, Homo sapiens
cugcuucuguugcuaucua

SEQ ID NO: 532140 - RNA, 19 nt, Homo sapiens
gaguggauccaaccgaaga

SEQ ID NO: 532141 - RNA, 19 nt, Homo sapiens
gauaucagcaaagggaaga

SEQ ID NO: 532142 - RNA, 19 nt, Homo sapiens
gagcaggcugggagaaaug

SEQ ID NO: 532143 - RNA, 19 nt, Homo sapiens
guacaaacgaccaaaaguu

SEQ ID NO: 532144 - RNA, 19 nt, Homo sapiens
gccaacagggauaaugauu

SEQ ID NO: 532145 - RNA, 19 nt, Homo sapiens
ccuccaccaucaacaucua

SEQ ID NO: 532146 - RNA, 19 nt, Homo sapiens
cccaccaccuccuccagua

SEQ ID NO: 532147 - RNA, 19 nt, Homo sapiens
gcaacaggcccuccaucca

SEQ ID NO: 532148 - RNA, 19 nt, Homo sapiens
aaagggaagaaacuaaaga

SEQ ID NO: 532149 - RNA, 19 nt, Homo sapiens
gagcugcuucuguugcuau

SEQ ID NO: 532150 - RNA, 19 nt, Homo sapiens
aaacuggcaagaaacgaaa

SEQ ID NO: 532151 - RNA, 19 nt, Homo sapiens
uacaaacgaccaaaaguua

SEQ ID NO: 532152 - RNA, 19 nt, Homo sapiens
gggaggaggcucaauacgu

SEQ ID NO: 532153 - RNA, 19 nt, Homo sapiens
ccaacagggauaaugauuc

SEQ ID NO: 532154 - RNA, 19 nt, Homo sapiens
gacagaagugcaccaauac

SEQ ID NO: 532155 - RNA, 19 nt, Homo sapiens
aaugcucuccuuucugaua

SEQ ID NO: 532156 - RNA, 19 nt, Homo sapiens
gcucgucucuacccaagcu

SEQ ID NO: 532157 - RNA, 19 nt, Homo sapiens
uccaagacccauucaauca

SEQ ID NO: 532158 - RNA, 19 nt, Homo sapiens
gaagccgaccaccauuguu

SEQ ID NO: 532159 - RNA, 19 nt, Homo sapiens
gaggaagccgaccaccauu

SEQ ID NO: 532160 - RNA, 19 nt, Homo sapiens
cucgagaaguugguuguuu

SEQ ID NO: 532161 - RNA, 19 nt, Homo sapiens
caaagggaagaaacuaaag

SEQ ID NO: 532162 - RNA, 19 nt, Homo sapiens
gcucuccuuucugauauca

SEQ ID NO: 532163 - RNA, 19 nt, Homo sapiens
uuagaaauggcuuccaaga

SEQ ID NO: 532164 - RNA, 19 nt, Homo sapiens
aaagaagacggucaccaau

SEQ ID NO: 532165 - RNA, 19 nt, Homo sapiens
gugggaaucgguaagaaau

SEQ ID NO: 532166 - RNA, 19 nt, Homo sapiens
auacagagaagccuaccuu

SEQ ID NO: 532167 - RNA, 19 nt, Homo sapiens
gcagaaacggcagcacauc

SEQ ID NO: 532168 - RNA, 19 nt, Homo sapiens
ggaaucugucccucaguuc

SEQ ID NO: 532169 - RNA, 19 nt, Homo sapiens
ccagcagggccuuggauga

SEQ ID NO: 532170 - RNA, 19 nt, Homo sapiens
caauacuggacaaaccuaa

SEQ ID NO: 532171 - RNA, 19 nt, Homo sapiens
cagaagugcaccaauacug

SEQ ID NO: 532172 - RNA, 19 nt, Homo sapiens
gggaaagcagauucuacuu

SEQ ID NO: 532173 - RNA, 19 nt, Homo sapiens
ccaccaccuccuccaguaa

SEQ ID NO: 532174 - RNA, 19 nt, Homo sapiens
caaguuccagcggcaauga

SEQ ID NO: 532175 - RNA, 19 nt, Homo sapiens
ccaauacuggacaaaccua

SEQ ID NO: 532176 - RNA, 19 nt, Homo sapiens
caaacauucacugcuuauu

SEQ ID NO: 532177 - RNA, 19 nt, Homo sapiens
gggugggaaucgguaagaa

SEQ ID NO: 532178 - RNA, 19 nt, Homo sapiens
ccuugugccucauguaugg

SEQ ID NO: 532179 - RNA, 19 nt, Homo sapiens
gugcaccaauacuggacaa

SEQ ID NO: 532180 - RNA, 19 nt, Homo sapiens
ucaaacauucacugcuuau

SEQ ID NO: 532181 - RNA, 19 nt, Homo sapiens
agagcaggcugggagaaau

SEQ ID NO: 532182 - RNA, 19 nt, Homo sapiens
aagaagacggucaccaaug

SEQ ID NO: 532183 - RNA, 19 nt, Homo sapiens
cguuugcacuggccaauac

SEQ ID NO: 532184 - RNA, 19 nt, Homo sapiens
ucgagaaguugguuguuuu

SEQ ID NO: 532185 - RNA, 19 nt, Homo sapiens
cagagcaggcugggagaaa

SEQ ID NO: 532186 - RNA, 19 nt, Homo sapiens
gcagagaccuuguugguau

SEQ ID NO: 532187 - RNA, 19 nt, Homo sapiens
caacauggauuucagagaa

SEQ ID NO: 532188 - RNA, 19 nt, Homo sapiens
acacuuaacuucagaaaga

SEQ ID NO: 532189 - RNA, 19 nt, Homo sapiens
ggaaugugcuuaguauuug

SEQ ID NO: 532190 - RNA, 19 nt, Homo sapiens
ucuagaaucuggcacuuua

SEQ ID NO: 532191 - RNA, 19 nt, Homo sapiens
gauaagaaccauuugugua

SEQ ID NO: 532192 - RNA, 19 nt, Homo sapiens
cuucagggaugacuucuua

SEQ ID NO: 532193 - RNA, 19 nt, Homo sapiens
gcacuuuacucauuuccuu

SEQ ID NO: 532194 - RNA, 19 nt, Homo sapiens
gaccacgacuccagcuuaa

SEQ ID NO: 532195 - RNA, 19 nt, Homo sapiens
guaaaucuauggauauggu

SEQ ID NO: 532196 - RNA, 19 nt, Homo sapiens
gcaauccaguugacuuuua

SEQ ID NO: 532197 - RNA, 19 nt, Homo sapiens
uaaaggauucugcuaugua

SEQ ID NO: 532198 - RNA, 19 nt, Homo sapiens
gugcaggguucagcaguua

SEQ ID NO: 532199 - RNA, 19 nt, Homo sapiens
cauguugaguucuguauug

SEQ ID NO: 532200 - RNA, 19 nt, Homo sapiens
agacaaagacacagauaaa

SEQ ID NO: 532201 - RNA, 19 nt, Homo sapiens
uccaaacacuuaacacauu

SEQ ID NO: 532202 - RNA, 19 nt, Homo sapiens
ccagcuaguucacuccuuu

SEQ ID NO: 532203 - RNA, 19 nt, Homo sapiens
caaacccgaugcuuucaga

SEQ ID NO: 532204 - RNA, 19 nt, Homo sapiens
gacagaaaguaaaucuaug

SEQ ID NO: 532205 - RNA, 19 nt, Homo sapiens
cggagaagaugcagugaau

SEQ ID NO: 532206 - RNA, 19 nt, Homo sapiens
gagugcaugucagcuguua

SEQ ID NO: 532207 - RNA, 19 nt, Homo sapiens
gagacaaagacacagauaa

SEQ ID NO: 532208 - RNA, 19 nt, Homo sapiens
cggaaugugcuuaguauuu

SEQ ID NO: 532209 - RNA, 19 nt, Homo sapiens
ucagagaacccacagaaga

SEQ ID NO: 532210 - RNA, 19 nt, Homo sapiens
gaaguggauucccuuaagg

SEQ ID NO: 532211 - RNA, 19 nt, Homo sapiens
ccaaacacuuaacacauuc

SEQ ID NO: 532212 - RNA, 19 nt, Homo sapiens
caaaacacaugcaucuaaa

SEQ ID NO: 532213 - RNA, 19 nt, Homo sapiens
gagauaagaaccauuugug

SEQ ID NO: 532214 - RNA, 19 nt, Homo sapiens
caaaaugggucuagaaucu

SEQ ID NO: 532215 - RNA, 19 nt, Homo sapiens
gauaggcucacacgagaaa

SEQ ID NO: 532216 - RNA, 19 nt, Homo sapiens
caugucagcuguuaacaag

SEQ ID NO: 532217 - RNA, 19 nt, Homo sapiens
gagaggaagucguucaaaa

SEQ ID NO: 532218 - RNA, 19 nt, Homo sapiens
agaaggaguugcccacaga

SEQ ID NO: 532219 - RNA, 19 nt, Homo sapiens
ugaaguggauucccuuaag

SEQ ID NO: 532220 - RNA, 19 nt, Homo sapiens
gagaaacagugaggcugaa

SEQ ID NO: 532221 - RNA, 19 nt, Homo sapiens
cuucugaccugcauguuga

SEQ ID NO: 532222 - RNA, 19 nt, Homo sapiens
gggacacacuggacuguuc

SEQ ID NO: 532223 - RNA, 19 nt, Homo sapiens
guggaucuguuccuaguau

SEQ ID NO: 532224 - RNA, 19 nt, Homo sapiens
gaagaugcagugaaugcuu

SEQ ID NO: 532225 - RNA, 19 nt, Homo sapiens
agaauucgaugaaguggau

SEQ ID NO: 532226 - RNA, 19 nt, Homo sapiens
uaggcaacauaaugagaua

SEQ ID NO: 532227 - RNA, 19 nt, Homo sapiens
aaucagaggcaccuuguuu

SEQ ID NO: 532228 - RNA, 19 nt, Homo sapiens
gggcuuugcuguaucuauc

SEQ ID NO: 532229 - RNA, 19 nt, Homo sapiens
gcuuucagaugaccuacuu

SEQ ID NO: 532230 - RNA, 19 nt, Homo sapiens
cagcugugauggauauaga

SEQ ID NO: 532231 - RNA, 19 nt, Homo sapiens
gggcaauccaguugacuuu

SEQ ID NO: 532232 - RNA, 19 nt, Homo sapiens
gaaucuggcacuuuacuca

SEQ ID NO: 532233 - RNA, 19 nt, Homo sapiens
ggguagcucucgagaaucu

SEQ ID NO: 532234 - RNA, 19 nt, Homo sapiens
gaugaaguggauucccuua

SEQ ID NO: 532235 - RNA, 19 nt, Homo sapiens
aaaggauucugcuauguag

SEQ ID NO: 532236 - RNA, 19 nt, Homo sapiens
gaacaaaacacaugcaucu

SEQ ID NO: 532237 - RNA, 19 nt, Homo sapiens
uaaucaaacccgaugcuuu

SEQ ID NO: 532238 - RNA, 19 nt, Homo sapiens
uuccuuugcuuucucuuua

SEQ ID NO: 532239 - RNA, 19 nt, Homo sapiens
ggcagccgcuucagagaug

SEQ ID NO: 532240 - RNA, 19 nt, Homo sapiens
auaaugagauacugugcuu

SEQ ID NO: 532241 - RNA, 19 nt, Homo sapiens
cuuuaaggaucucagcaua

SEQ ID NO: 532242 - RNA, 19 nt, Homo sapiens
cagaaagacaugcauuaug

SEQ ID NO: 532243 - RNA, 19 nt, Homo sapiens
caacauaaugagauacugu

SEQ ID NO: 532244 - RNA, 19 nt, Homo sapiens
gugaauggccagcggguuu

SEQ ID NO: 532245 - RNA, 19 nt, Homo sapiens
ugucagcuguuaacaagug

SEQ ID NO: 532246 - RNA, 19 nt, Homo sapiens
ccaguugacuuuuaaaugu

SEQ ID NO: 532247 - RNA, 19 nt, Homo sapiens
ggucugcggccacaucuug

SEQ ID NO: 532248 - RNA, 19 nt, Homo sapiens
guauucagcugugauggau

SEQ ID NO: 532249 - RNA, 19 nt, Homo sapiens
uuaaggaucucagcauaag

SEQ ID NO: 532250 - RNA, 19 nt, Homo sapiens
ccugucagcuucucugcuu

SEQ ID NO: 532251 - RNA, 19 nt, Homo sapiens
uuacaaggccucagcaauc

SEQ ID NO: 532252 - RNA, 19 nt, Homo sapiens
uuccuacugugucuuguua

SEQ ID NO: 532253 - RNA, 19 nt, Homo sapiens
ugucaggaaccuucagaua

SEQ ID NO: 532254 - RNA, 19 nt, Homo sapiens
gagaagaugcagugaaugc

SEQ ID NO: 532255 - RNA, 19 nt, Homo sapiens
ucccaacucugcuaucuuc

SEQ ID NO: 532256 - RNA, 19 nt, Homo sapiens
aaucaaacccgaugcuuuc

SEQ ID NO: 532257 - RNA, 19 nt, Homo sapiens
gacaaagacacagauaaau

SEQ ID NO: 532258 - RNA, 19 nt, Homo sapiens
cagagaccuuguugguauu

SEQ ID NO: 532259 - RNA, 19 nt, Homo sapiens
ugaccugcauguugaguuc

SEQ ID NO: 532260 - RNA, 19 nt, Homo sapiens
uuuaaaggauucugcuaug

SEQ ID NO: 532261 - RNA, 19 nt, Homo sapiens
caacacuuaacuucagaaa

SEQ ID NO: 532262 - RNA, 19 nt, Homo sapiens
gaaugugcuuaguauuugg

SEQ ID NO: 532263 - RNA, 19 nt, Homo sapiens
ucaggaaccuucagauagc

SEQ ID NO: 532264 - RNA, 19 nt, Homo sapiens
guagggaguccacggagaa

SEQ ID NO: 532265 - RNA, 19 nt, Homo sapiens
agaccacgacuccagcuua

SEQ ID NO: 532266 - RNA, 19 nt, Homo sapiens
gaagaggaaagagcacaga

SEQ ID NO: 532267 - RNA, 19 nt, Homo sapiens
cagcggaaugugcuuagua

SEQ ID NO: 532268 - RNA, 19 nt, Homo sapiens
ccucagugcuucucuucug

SEQ ID NO: 532269 - RNA, 19 nt, Homo sapiens
gcaugucagcuguuaacaa

SEQ ID NO: 532270 - RNA, 19 nt, Homo sapiens
caauguggauaagauaaag

SEQ ID NO: 532271 - RNA, 19 nt, Homo sapiens
ucagaugaccuacuuacau

SEQ ID NO: 532272 - RNA, 19 nt, Homo sapiens
ucagaaagacaugcauuau

SEQ ID NO: 532273 - RNA, 19 nt, Homo sapiens
ggacugcagcugucuaggu

SEQ ID NO: 532274 - RNA, 19 nt, Homo sapiens
auacgauggugcacuguug

SEQ ID NO: 532275 - RNA, 19 nt, Homo sapiens
uuaaaggauucugcuaugu

SEQ ID NO: 532276 - RNA, 19 nt, Homo sapiens
ucugagauaagaaccauuu

SEQ ID NO: 532277 - RNA, 19 nt, Homo sapiens
uccuuuccauuccuauuua

SEQ ID NO: 532278 - RNA, 19 nt, Homo sapiens
ugugauggauauagagaau

SEQ ID NO: 532279 - RNA, 19 nt, Homo sapiens
ccaggcguuuccuuucauu

SEQ ID NO: 532280 - RNA, 19 nt, Homo sapiens
cgggaugacuucaauucug

SEQ ID NO: 532281 - RNA, 19 nt, Homo sapiens
gaaggcagaaaacaagaua

SEQ ID NO: 532282 - RNA, 19 nt, Homo sapiens
caccaacacuuaacuucag

SEQ ID NO: 532283 - RNA, 19 nt, Homo sapiens
uaacaccaacacuuaacuu

SEQ ID NO: 532284 - RNA, 19 nt, Homo sapiens
gaaccuucagauagcagua

SEQ ID NO: 532285 - RNA, 19 nt, Homo sapiens
gcaacauaaugagauacug

SEQ ID NO: 532286 - RNA, 19 nt, Homo sapiens
gcagagaccuuguugguau

SEQ ID NO: 532287 - RNA, 19 nt, Homo sapiens
caacauggauuucagagaa

SEQ ID NO: 532288 - RNA, 19 nt, Homo sapiens
acacuuaacuucagaaaga

SEQ ID NO: 532289 - RNA, 19 nt, Homo sapiens
ggaaugugcuuaguauuug

SEQ ID NO: 532290 - RNA, 19 nt, Homo sapiens
ucuagaaucuggcacuuua

SEQ ID NO: 532291 - RNA, 19 nt, Homo sapiens
gauaagaaccauuugugua

SEQ ID NO: 532292 - RNA, 19 nt, Homo sapiens
cuucagggaugacuucuua

SEQ ID NO: 532293 - RNA, 19 nt, Homo sapiens
gcacuuuacucauuuccuu

SEQ ID NO: 532294 - RNA, 19 nt, Homo sapiens
gaccacgacuccagcuuaa

SEQ ID NO: 532295 - RNA, 19 nt, Homo sapiens
guaaaucuauggauauggu

SEQ ID NO: 532296 - RNA, 19 nt, Homo sapiens
gcaauccaguugacuuuua

SEQ ID NO: 532297 - RNA, 19 nt, Homo sapiens
uaaaggauucugcuaugua

SEQ ID NO: 532298 - RNA, 19 nt, Homo sapiens
gugcaggguucagcaguua

SEQ ID NO: 532299 - RNA, 19 nt, Homo sapiens
cauguugaguucuguauug

SEQ ID NO: 532300 - RNA, 19 nt, Homo sapiens
agacaaagacacagauaaa

SEQ ID NO: 532301 - RNA, 19 nt, Homo sapiens
uccaaacacuuaacacauu

SEQ ID NO: 532302 - RNA, 19 nt, Homo sapiens
ccagcuaguucacuccuuu

SEQ ID NO: 532303 - RNA, 19 nt, Homo sapiens
caaacccgaugcuuucaga

SEQ ID NO: 532304 - RNA, 19 nt, Homo sapiens
gacagaaaguaaaucuaug

SEQ ID NO: 532305 - RNA, 19 nt, Homo sapiens
cggagaagaugcagugaau

SEQ ID NO: 532306 - RNA, 19 nt, Homo sapiens
gagugcaugucagcuguua

SEQ ID NO: 532307 - RNA, 19 nt, Homo sapiens
gagacaaagacacagauaa

SEQ ID NO: 532308 - RNA, 19 nt, Homo sapiens
cggaaugugcuuaguauuu

SEQ ID NO: 532309 - RNA, 19 nt, Homo sapiens
ucagagaacccacagaaga

SEQ ID NO: 532310 - RNA, 19 nt, Homo sapiens
gaaguggauucccuuaagg

SEQ ID NO: 532311 - RNA, 19 nt, Homo sapiens
ccaaacacuuaacacauuc

SEQ ID NO: 532312 - RNA, 19 nt, Homo sapiens
caaaacacaugcaucuaaa

SEQ ID NO: 532313 - RNA, 19 nt, Homo sapiens
gagauaagaaccauuugug

SEQ ID NO: 532314 - RNA, 19 nt, Homo sapiens
caaaaugggucuagaaucu

SEQ ID NO: 532315 - RNA, 19 nt, Homo sapiens
gauaggcucacacgagaaa

SEQ ID NO: 532316 - RNA, 19 nt, Homo sapiens
caugucagcuguuaacaag

SEQ ID NO: 532317 - RNA, 19 nt, Homo sapiens
gagaggaagucguucaaaa

SEQ ID NO: 532318 - RNA, 19 nt, Homo sapiens
agaaggaguugcccacaga

SEQ ID NO: 532319 - RNA, 19 nt, Homo sapiens
ugaaguggauucccuuaag

SEQ ID NO: 532320 - RNA, 19 nt, Homo sapiens
gagaaacagugaggcugaa

SEQ ID NO: 532321 - RNA, 19 nt, Homo sapiens
cuucugaccugcauguuga

SEQ ID NO: 532322 - RNA, 19 nt, Homo sapiens
gggacacacuggacuguuc

SEQ ID NO: 532323 - RNA, 19 nt, Homo sapiens
guggaucuguuccuaguau

SEQ ID NO: 532324 - RNA, 19 nt, Homo sapiens
gaagaugcagugaaugcuu

SEQ ID NO: 532325 - RNA, 19 nt, Homo sapiens
agaauucgaugaaguggau

SEQ ID NO: 532326 - RNA, 19 nt, Homo sapiens
uaggcaacauaaugagaua

SEQ ID NO: 532327 - RNA, 19 nt, Homo sapiens
aaucagaggcaccuuguuu

SEQ ID NO: 532328 - RNA, 19 nt, Homo sapiens
gggcuuugcuguaucuauc

SEQ ID NO: 532329 - RNA, 19 nt, Homo sapiens
gcuuucagaugaccuacuu

SEQ ID NO: 532330 - RNA, 19 nt, Homo sapiens
cagcugugauggauauaga

SEQ ID NO: 532331 - RNA, 19 nt, Homo sapiens
gggcaauccaguugacuuu

SEQ ID NO: 532332 - RNA, 19 nt, Homo sapiens
gaaucuggcacuuuacuca

SEQ ID NO: 532333 - RNA, 19 nt, Homo sapiens
gaugaaguggauucccuua

SEQ ID NO: 532334 - RNA, 19 nt, Homo sapiens
aaaggauucugcuauguag

SEQ ID NO: 532335 - RNA, 19 nt, Homo sapiens
gaacaaaacacaugcaucu

SEQ ID NO: 532336 - RNA, 19 nt, Homo sapiens
uaaucaaacccgaugcuuu

SEQ ID NO: 532337 - RNA, 19 nt, Homo sapiens
uuccuuugcuuucucuuua

SEQ ID NO: 532338 - RNA, 19 nt, Homo sapiens
ggcagccgcuucagagaug

SEQ ID NO: 532339 - RNA, 19 nt, Homo sapiens
auaaugagauacugugcuu

SEQ ID NO: 532340 - RNA, 19 nt, Homo sapiens
cuuuaaggaucucagcaua

SEQ ID NO: 532341 - RNA, 19 nt, Homo sapiens
cagaaagacaugcauuaug

SEQ ID NO: 532342 - RNA, 19 nt, Homo sapiens
caacauaaugagauacugu

SEQ ID NO: 532343 - RNA, 19 nt, Homo sapiens
gugaauggccagcggguuu

SEQ ID NO: 532344 - RNA, 19 nt, Homo sapiens
ugucagcuguuaacaagug

SEQ ID NO: 532345 - RNA, 19 nt, Homo sapiens
ccaguugacuuuuaaaugu

SEQ ID NO: 532346 - RNA, 19 nt, Homo sapiens
ggucugcggccacaucuug

SEQ ID NO: 532347 - RNA, 19 nt, Homo sapiens
guauucagcugugauggau

SEQ ID NO: 532348 - RNA, 19 nt, Homo sapiens
uuaaggaucucagcauaag

SEQ ID NO: 532349 - RNA, 19 nt, Homo sapiens
ccugucagcuucucugcuu

SEQ ID NO: 532350 - RNA, 19 nt, Homo sapiens
uuacaaggccucagcaauc

SEQ ID NO: 532351 - RNA, 19 nt, Homo sapiens
uuccuacugugucuuguua

SEQ ID NO: 532352 - RNA, 19 nt, Homo sapiens
ugucaggaaccuucagaua

SEQ ID NO: 532353 - RNA, 19 nt, Homo sapiens
gagaagaugcagugaaugc

SEQ ID NO: 532354 - RNA, 19 nt, Homo sapiens
ucccaacucugcuaucuuc

SEQ ID NO: 532355 - RNA, 19 nt, Homo sapiens
aaucaaacccgaugcuuuc

SEQ ID NO: 532356 - RNA, 19 nt, Homo sapiens
uuuaaaggauucugcuaug

SEQ ID NO: 532357 - RNA, 19 nt, Homo sapiens
gacaaagacacagauaaau

SEQ ID NO: 532358 - RNA, 19 nt, Homo sapiens
cagagaccuuguugguauu

SEQ ID NO: 532359 - RNA, 19 nt, Homo sapiens
ugaccugcauguugaguuc

SEQ ID NO: 532360 - RNA, 19 nt, Homo sapiens
caacacuuaacuucagaaa

SEQ ID NO: 532361 - RNA, 19 nt, Homo sapiens
gaaugugcuuaguauuugg

SEQ ID NO: 532362 - RNA, 19 nt, Homo sapiens
ucaggaaccuucagauagc

SEQ ID NO: 532363 - RNA, 19 nt, Homo sapiens
guagggaguccacggagaa

SEQ ID NO: 532364 - RNA, 19 nt, Homo sapiens
agaccacgacuccagcuua

SEQ ID NO: 532365 - RNA, 19 nt, Homo sapiens
gaagaggaaagagcacaga

SEQ ID NO: 532366 - RNA, 19 nt, Homo sapiens
cagcggaaugugcuuagua

SEQ ID NO: 532367 - RNA, 19 nt, Homo sapiens
ccucagugcuucucuucug

SEQ ID NO: 532368 - RNA, 19 nt, Homo sapiens
gcaugucagcuguuaacaa

SEQ ID NO: 532369 - RNA, 19 nt, Homo sapiens
caauguggauaagauaaag

SEQ ID NO: 532370 - RNA, 19 nt, Homo sapiens
ucagaugaccuacuuacau

SEQ ID NO: 532371 - RNA, 19 nt, Homo sapiens
ucagaaagacaugcauuau

SEQ ID NO: 532372 - RNA, 19 nt, Homo sapiens
ggacugcagcugucuaggu

SEQ ID NO: 532373 - RNA, 19 nt, Homo sapiens
auacgauggugcacuguug

SEQ ID NO: 532374 - RNA, 19 nt, Homo sapiens
uuaaaggauucugcuaugu

SEQ ID NO: 532375 - RNA, 19 nt, Homo sapiens
ucugagauaagaaccauuu

SEQ ID NO: 532376 - RNA, 19 nt, Homo sapiens
uccuuuccauuccuauuua

SEQ ID NO: 532377 - RNA, 19 nt, Homo sapiens
ugugauggauauagagaau

SEQ ID NO: 532378 - RNA, 19 nt, Homo sapiens
ccaggcguuuccuuucauu

SEQ ID NO: 532379 - RNA, 19 nt, Homo sapiens
gaaggcagaaaacaagaua

SEQ ID NO: 532380 - RNA, 19 nt, Homo sapiens
caccaacacuuaacuucag

SEQ ID NO: 532381 - RNA, 19 nt, Homo sapiens
uaacaccaacacuuaacuu

SEQ ID NO: 532382 - RNA, 19 nt, Homo sapiens
gaaccuucagauagcagua

SEQ ID NO: 532383 - RNA, 19 nt, Homo sapiens
gcaacauaaugagauacug

SEQ ID NO: 532384 - RNA, 19 nt, Homo sapiens
uaguauaggcaacauaaug

SEQ ID NO: 532385 - RNA, 19 nt, Homo sapiens
cagcagagaccuuguuggu

SEQ ID NO: 532386 - RNA, 19 nt, Homo sapiens
ggacaaagcucagaaacaa

SEQ ID NO: 532387 - RNA, 19 nt, Homo sapiens
ccucaagccugcuaaguua

SEQ ID NO: 532388 - RNA, 19 nt, Homo sapiens
ggccaaagacacaguauua

SEQ ID NO: 532389 - RNA, 19 nt, Homo sapiens
ggacgaaggugagugaaga

SEQ ID NO: 532390 - RNA, 19 nt, Homo sapiens
agaagaagauguuggacua

SEQ ID NO: 532391 - RNA, 19 nt, Homo sapiens
caaagacacaguauuauga

SEQ ID NO: 532392 - RNA, 19 nt, Homo sapiens
gaccagauguuccaaaaua

SEQ ID NO: 532393 - RNA, 19 nt, Homo sapiens
gaaccuucuucaaacagua

SEQ ID NO: 532394 - RNA, 19 nt, Homo sapiens
ggaggaagguggaggaucu

SEQ ID NO: 532395 - RNA, 19 nt, Homo sapiens
ugaccgggcuggacaaaga

SEQ ID NO: 532396 - RNA, 19 nt, Homo sapiens
uaagugcgcuggagagcaa

SEQ ID NO: 532397 - RNA, 19 nt, Homo sapiens
gcaugcaguucuauuaaca

SEQ ID NO: 532398 - RNA, 19 nt, Homo sapiens
gaaggacgaaggugaguga

SEQ ID NO: 532399 - RNA, 19 nt, Homo sapiens
gcaggaccgugccuacaga

SEQ ID NO: 532400 - RNA, 19 nt, Homo sapiens
aacaggaggucgagaguuu

SEQ ID NO: 532401 - RNA, 19 nt, Homo sapiens
gaccagcacucacccuugu

SEQ ID NO: 532402 - RNA, 19 nt, Homo sapiens
ggugacggguguccaagaa

SEQ ID NO: 532403 - RNA, 19 nt, Homo sapiens
acagguugcuuacagcuuu

SEQ ID NO: 532404 - RNA, 19 nt, Homo sapiens
ccaagaagaccaagcguau

SEQ ID NO: 532405 - RNA, 19 nt, Homo sapiens
ucaaauacagcucuuucua

SEQ ID NO: 532406 - RNA, 19 nt, Homo sapiens
gcucagggcccaaguaagu

SEQ ID NO: 532407 - RNA, 19 nt, Homo sapiens
auacagcucuuucuagcaa

SEQ ID NO: 532408 - RNA, 19 nt, Homo sapiens
ucacguuccugcccaaaug

SEQ ID NO: 532409 - RNA, 19 nt, Homo sapiens
ggacacgugugcaauucau

SEQ ID NO: 532410 - RNA, 19 nt, Homo sapiens
acacagagacacauacuug

SEQ ID NO: 532411 - RNA, 19 nt, Homo sapiens
ccaaagacacaguauuaug

SEQ ID NO: 532412 - RNA, 19 nt, Homo sapiens
gaacaagagggacaaagag

SEQ ID NO: 532413 - RNA, 19 nt, Homo sapiens
caaauacagcucuuucuag

SEQ ID NO: 532414 - RNA, 19 nt, Homo sapiens
caucccggcuuucccguaa

SEQ ID NO: 532415 - RNA, 19 nt, Homo sapiens
gggagcauccagucuuuaa

SEQ ID NO: 532416 - RNA, 19 nt, Homo sapiens
gagccgggacugucacuuu

SEQ ID NO: 532417 - RNA, 19 nt, Homo sapiens
cguaucggcuucccaucua

SEQ ID NO: 532418 - RNA, 19 nt, Homo sapiens
agcagaaacucaaggauga

SEQ ID NO: 532419 - RNA, 19 nt, Homo sapiens
cagaaccugucauugcauu

SEQ ID NO: 532420 - RNA, 19 nt, Homo sapiens
agagacacauacuugguuu

SEQ ID NO: 532421 - RNA, 19 nt, Homo sapiens
gcaauuccgguucugcaaa

SEQ ID NO: 532422 - RNA, 19 nt, Homo sapiens
ggaaggagcggagccugaa

SEQ ID NO: 532423 - RNA, 19 nt, Homo sapiens
gcuaauggacaacuggaaa

SEQ ID NO: 532424 - RNA, 19 nt, Homo sapiens
gcccagaucgcccucauga

SEQ ID NO: 532425 - RNA, 19 nt, Homo sapiens
gagaagcagcagcacauug

SEQ ID NO: 532426 - RNA, 19 nt, Homo sapiens
gcucucgcaugcaguucua

SEQ ID NO: 532427 - RNA, 19 nt, Homo sapiens
ggagagcaaguguaaguca

SEQ ID NO: 532428 - RNA, 19 nt, Homo sapiens
gcaggacaaagcucagaaa

SEQ ID NO: 532429 - RNA, 19 nt, Homo sapiens
agaagcagcagcacauuga

SEQ ID NO: 532430 - RNA, 19 nt, Homo sapiens
ccagaucgcccucaugagu

SEQ ID NO: 532431 - RNA, 19 nt, Homo sapiens
gguaagagaaaucuaacug

SEQ ID NO: 532432 - RNA, 19 nt, Homo sapiens
gcguauacacacccaagua

SEQ ID NO: 532433 - RNA, 19 nt, Homo sapiens
acaaagcucagaaacaaga

SEQ ID NO: 532434 - RNA, 19 nt, Homo sapiens
ucaaggagcagaaacucaa

SEQ ID NO: 532435 - RNA, 19 nt, Homo sapiens
ugaacaagagggacaaaga

SEQ ID NO: 532436 - RNA, 19 nt, Homo sapiens
cccagucccuguuggcuuu

SEQ ID NO: 532437 - RNA, 19 nt, Homo sapiens
caacacacacacaccucua

SEQ ID NO: 532438 - RNA, 19 nt, Homo sapiens
gaacgaacugcggguguug

SEQ ID NO: 532439 - RNA, 19 nt, Homo sapiens
guaagucaggcgagaagaa

SEQ ID NO: 532440 - RNA, 19 nt, Homo sapiens
cagcacacccacaugauug

SEQ ID NO: 532441 - RNA, 19 nt, Homo sapiens
acaacaggcugaccacagu

SEQ ID NO: 532442 - RNA, 19 nt, Homo sapiens
ggucaaauacagcucuuuc

SEQ ID NO: 532443 - RNA, 19 nt, Homo sapiens
cuaagcugcuggccgaaga

SEQ ID NO: 532444 - RNA, 19 nt, Homo sapiens
ccagugcccacccaaguuu

SEQ ID NO: 532445 - RNA, 19 nt, Homo sapiens
gacacaguauuaugaaggu

SEQ ID NO: 532446 - RNA, 19 nt, Homo sapiens
gcccagccuucuacagaga

SEQ ID NO: 532447 - RNA, 19 nt, Homo sapiens
ugaacgaacugcggguguu

SEQ ID NO: 532448 - RNA, 19 nt, Homo sapiens
ccaugcacgugaaggagaa

SEQ ID NO: 532449 - RNA, 19 nt, Homo sapiens
caggacacgugugcaauuc

SEQ ID NO: 532450 - RNA, 19 nt, Homo sapiens
aggacaagcugaacaagag

SEQ ID NO: 532451 - RNA, 19 nt, Homo sapiens
ugagcaguauguugcagaa

SEQ ID NO: 532452 - RNA, 19 nt, Homo sapiens
cgugugcaauucauaggaa

SEQ ID NO: 532453 - RNA, 19 nt, Homo sapiens
uacagauacugcaaacguu

SEQ ID NO: 532454 - RNA, 19 nt, Homo sapiens
ggaccgugccuacagauac

SEQ ID NO: 532455 - RNA, 19 nt, Homo sapiens
gcucuaggcagguuugaca

SEQ ID NO: 532456 - RNA, 19 nt, Homo sapiens
ccacaugauugagucgaau

SEQ ID NO: 532457 - RNA, 19 nt, Homo sapiens
gguggaggaucugcaguuc

SEQ ID NO: 532458 - RNA, 19 nt, Homo sapiens
aggaggcacugaaggagaa

SEQ ID NO: 532459 - RNA, 19 nt, Homo sapiens
gagaccgugucccggaaga

SEQ ID NO: 532460 - RNA, 19 nt, Homo sapiens
ccagcacacccacaugauu

SEQ ID NO: 532461 - RNA, 19 nt, Homo sapiens
aggcacagcaugagcagua

SEQ ID NO: 532462 - RNA, 19 nt, Homo sapiens
ggagaagcagcagcacauu

SEQ ID NO: 532463 - RNA, 19 nt, Homo sapiens
caguggaauuguugaagug

SEQ ID NO: 532464 - RNA, 19 nt, Homo sapiens
cagagacacauacuugguu

SEQ ID NO: 532465 - RNA, 19 nt, Homo sapiens
acaguauuaugaagguuug

SEQ ID NO: 532466 - RNA, 19 nt, Homo sapiens
gagcugcccugaggaccau

SEQ ID NO: 532467 - RNA, 19 nt, Homo sapiens
cagcaugagcaguauguug

SEQ ID NO: 532468 - RNA, 19 nt, Homo sapiens
acaguggaauuguugaagu

SEQ ID NO: 532469 - RNA, 19 nt, Homo sapiens
ucgcaugcaguucuauuaa

SEQ ID NO: 532470 - RNA, 19 nt, Homo sapiens
cccggcagcuucuggaguu

SEQ ID NO: 532471 - RNA, 19 nt, Homo sapiens
cccagaaccugucauugca

SEQ ID NO: 532472 - RNA, 19 nt, Homo sapiens
ccugguggcugagaacaga

SEQ ID NO: 532473 - RNA, 19 nt, Homo sapiens
gcggcugcuccgagaauua

SEQ ID NO: 532474 - RNA, 19 nt, Homo sapiens
cuacagauacugcaaacgu

SEQ ID NO: 532475 - RNA, 19 nt, Homo sapiens
gcccagaccaucggcaauu

SEQ ID NO: 532476 - RNA, 19 nt, Homo sapiens
augaggagcugcccugaca

SEQ ID NO: 532477 - RNA, 19 nt, Homo sapiens
gcccagaaccugucauugc

SEQ ID NO: 532478 - RNA, 19 nt, Homo sapiens
ggagauugcccugcucaag

SEQ ID NO: 532479 - RNA, 19 nt, Homo sapiens
cucaacagcuccgugaaga

SEQ ID NO: 532480 - RNA, 19 nt, Homo sapiens
gaccgugccuacagauacu

SEQ ID NO: 532481 - RNA, 19 nt, Homo sapiens
caaggccaaagacacagua

SEQ ID NO: 532482 - RNA, 19 nt, Homo sapiens
ggccacacagagacacaua

SEQ ID NO: 532483 - RNA, 19 nt, Homo sapiens
gccaaagacacaguauuau

SEQ ID NO: 532484 - RNA, 19 nt, Homo sapiens
caauuccgguucugcaaac

SEQ ID NO: 532485 - RNA, 19 nt, Homo sapiens
caggacaagcugaacaaga

SEQ ID NO: 532486 - RNA, 19 nt, Homo sapiens
ggacaaagcucagaaacaa

SEQ ID NO: 532487 - RNA, 19 nt, Homo sapiens
ccucaagccugcuaaguua

SEQ ID NO: 532488 - RNA, 19 nt, Homo sapiens
ggccaaagacacaguauua

SEQ ID NO: 532489 - RNA, 19 nt, Homo sapiens
ggacgaaggugagugaaga

SEQ ID NO: 532490 - RNA, 19 nt, Homo sapiens
agaagaagauguuggacua

SEQ ID NO: 532491 - RNA, 19 nt, Homo sapiens
caaagacacaguauuauga

SEQ ID NO: 532492 - RNA, 19 nt, Homo sapiens
gaccagauguuccaaaaua

SEQ ID NO: 532493 - RNA, 19 nt, Homo sapiens
gaaccuucuucaaacagua

SEQ ID NO: 532494 - RNA, 19 nt, Homo sapiens
ggaggaagguggaggaucu

SEQ ID NO: 532495 - RNA, 19 nt, Homo sapiens
ugaccgggcuggacaaaga

SEQ ID NO: 532496 - RNA, 19 nt, Homo sapiens
uaagugcgcuggagagcaa

SEQ ID NO: 532497 - RNA, 19 nt, Homo sapiens
gcaugcaguucuauuaaca

SEQ ID NO: 532498 - RNA, 19 nt, Homo sapiens
gaaggacgaaggugaguga

SEQ ID NO: 532499 - RNA, 19 nt, Homo sapiens
gcaggaccgugccuacaga

SEQ ID NO: 532500 - RNA, 19 nt, Homo sapiens
aacaggaggucgagaguuu

SEQ ID NO: 532501 - RNA, 19 nt, Homo sapiens
gaccagcacucacccuugu

SEQ ID NO: 532502 - RNA, 19 nt, Homo sapiens
ggugacggguguccaagaa

SEQ ID NO: 532503 - RNA, 19 nt, Homo sapiens
acagguugcuuacagcuuu

SEQ ID NO: 532504 - RNA, 19 nt, Homo sapiens
ccaagaagaccaagcguau

SEQ ID NO: 532505 - RNA, 19 nt, Homo sapiens
ucaaauacagcucuuucua

SEQ ID NO: 532506 - RNA, 19 nt, Homo sapiens
gcucagggcccaaguaagu

SEQ ID NO: 532507 - RNA, 19 nt, Homo sapiens
auacagcucuuucuagcaa

SEQ ID NO: 532508 - RNA, 19 nt, Homo sapiens
ucacguuccugcccaaaug

SEQ ID NO: 532509 - RNA, 19 nt, Homo sapiens
ggacacgugugcaauucau

SEQ ID NO: 532510 - RNA, 19 nt, Homo sapiens
acacagagacacauacuug

SEQ ID NO: 532511 - RNA, 19 nt, Homo sapiens
ccaaagacacaguauuaug

SEQ ID NO: 532512 - RNA, 19 nt, Homo sapiens
gaacaagagggacaaagag

SEQ ID NO: 532513 - RNA, 19 nt, Homo sapiens
caaauacagcucuuucuag

SEQ ID NO: 532514 - RNA, 19 nt, Homo sapiens
caucccggcuuucccguaa

SEQ ID NO: 532515 - RNA, 19 nt, Homo sapiens
gggagcauccagucuuuaa

SEQ ID NO: 532516 - RNA, 19 nt, Homo sapiens
gagccgggacugucacuuu

SEQ ID NO: 532517 - RNA, 19 nt, Homo sapiens
cguaucggcuucccaucua

SEQ ID NO: 532518 - RNA, 19 nt, Homo sapiens
agcagaaacucaaggauga

SEQ ID NO: 532519 - RNA, 19 nt, Homo sapiens
cagaaccugucauugcauu

SEQ ID NO: 532520 - RNA, 19 nt, Homo sapiens
agagacacauacuugguuu

SEQ ID NO: 532521 - RNA, 19 nt, Homo sapiens
gcaauuccgguucugcaaa

SEQ ID NO: 532522 - RNA, 19 nt, Homo sapiens
ggaaggagcggagccugaa

SEQ ID NO: 532523 - RNA, 19 nt, Homo sapiens
gcuaauggacaacuggaaa

SEQ ID NO: 532524 - RNA, 19 nt, Homo sapiens
gcccagaucgcccucauga

SEQ ID NO: 532525 - RNA, 19 nt, Homo sapiens
gagaagcagcagcacauug

SEQ ID NO: 532526 - RNA, 19 nt, Homo sapiens
gcucucgcaugcaguucua

SEQ ID NO: 532527 - RNA, 19 nt, Homo sapiens
ggagagcaaguguaaguca

SEQ ID NO: 532528 - RNA, 19 nt, Homo sapiens
gcaggacaaagcucagaaa

SEQ ID NO: 532529 - RNA, 19 nt, Homo sapiens
agaagcagcagcacauuga

SEQ ID NO: 532530 - RNA, 19 nt, Homo sapiens
ccagaucgcccucaugagu

SEQ ID NO: 532531 - RNA, 19 nt, Homo sapiens
gguaagagaaaucuaacug

SEQ ID NO: 532532 - RNA, 19 nt, Homo sapiens
gcguauacacacccaagua

SEQ ID NO: 532533 - RNA, 19 nt, Homo sapiens
acaaagcucagaaacaaga

SEQ ID NO: 532534 - RNA, 19 nt, Homo sapiens
ucaaggagcagaaacucaa

SEQ ID NO: 532535 - RNA, 19 nt, Homo sapiens
ugaacaagagggacaaaga

SEQ ID NO: 532536 - RNA, 19 nt, Homo sapiens
cccagucccuguuggcuuu

SEQ ID NO: 532537 - RNA, 19 nt, Homo sapiens
caacacacacacaccucua

SEQ ID NO: 532538 - RNA, 19 nt, Homo sapiens
gaacgaacugcggguguug

SEQ ID NO: 532539 - RNA, 19 nt, Homo sapiens
guaagucaggcgagaagaa

SEQ ID NO: 532540 - RNA, 19 nt, Homo sapiens
cagcacacccacaugauug

SEQ ID NO: 532541 - RNA, 19 nt, Homo sapiens
ggucaaauacagcucuuuc

SEQ ID NO: 532542 - RNA, 19 nt, Homo sapiens
cuaagcugcuggccgaaga

SEQ ID NO: 532543 - RNA, 19 nt, Homo sapiens
ccagugcccacccaaguuu

SEQ ID NO: 532544 - RNA, 19 nt, Homo sapiens
gacacaguauuaugaaggu

SEQ ID NO: 532545 - RNA, 19 nt, Homo sapiens
gcccagccuucuacagaga

SEQ ID NO: 532546 - RNA, 19 nt, Homo sapiens
ugaacgaacugcggguguu

SEQ ID NO: 532547 - RNA, 19 nt, Homo sapiens
ccaugcacgugaaggagaa

SEQ ID NO: 532548 - RNA, 19 nt, Homo sapiens
caggacacgugugcaauuc

SEQ ID NO: 532549 - RNA, 19 nt, Homo sapiens
aggacaagcugaacaagag

SEQ ID NO: 532550 - RNA, 19 nt, Homo sapiens
ugagcaguauguugcagaa

SEQ ID NO: 532551 - RNA, 19 nt, Homo sapiens
cgugugcaauucauaggaa

SEQ ID NO: 532552 - RNA, 19 nt, Homo sapiens
uacagauacugcaaacguu

SEQ ID NO: 532553 - RNA, 19 nt, Homo sapiens
ggaccgugccuacagauac

SEQ ID NO: 532554 - RNA, 19 nt, Homo sapiens
gcucuaggcagguuugaca

SEQ ID NO: 532555 - RNA, 19 nt, Homo sapiens
ccacaugauugagucgaau

SEQ ID NO: 532556 - RNA, 19 nt, Homo sapiens
gguggaggaucugcaguuc

SEQ ID NO: 532557 - RNA, 19 nt, Homo sapiens
aggaggcacugaaggagaa

SEQ ID NO: 532558 - RNA, 19 nt, Homo sapiens
gagaccgugucccggaaga

SEQ ID NO: 532559 - RNA, 19 nt, Homo sapiens
ccagcacacccacaugauu

SEQ ID NO: 532560 - RNA, 19 nt, Homo sapiens
aggcacagcaugagcagua

SEQ ID NO: 532561 - RNA, 19 nt, Homo sapiens
ggagaagcagcagcacauu

SEQ ID NO: 532562 - RNA, 19 nt, Homo sapiens
caguggaauuguugaagug

SEQ ID NO: 532563 - RNA, 19 nt, Homo sapiens
cagagacacauacuugguu

SEQ ID NO: 532564 - RNA, 19 nt, Homo sapiens
acaguauuaugaagguuug

SEQ ID NO: 532565 - RNA, 19 nt, Homo sapiens
gagcugcccugaggaccau

SEQ ID NO: 532566 - RNA, 19 nt, Homo sapiens
cagcaugagcaguauguug

SEQ ID NO: 532567 - RNA, 19 nt, Homo sapiens
acaguggaauuguugaagu

SEQ ID NO: 532568 - RNA, 19 nt, Homo sapiens
ucgcaugcaguucuauuaa

SEQ ID NO: 532569 - RNA, 19 nt, Homo sapiens
cccggcagcuucuggaguu

SEQ ID NO: 532570 - RNA, 19 nt, Homo sapiens
cccagaaccugucauugca

SEQ ID NO: 532571 - RNA, 19 nt, Homo sapiens
ccugguggcugagaacaga

SEQ ID NO: 532572 - RNA, 19 nt, Homo sapiens
cuacagauacugcaaacgu

SEQ ID NO: 532573 - RNA, 19 nt, Homo sapiens
gcccagaccaucggcaauu

SEQ ID NO: 532574 - RNA, 19 nt, Homo sapiens
augaggagcugcccugaca

SEQ ID NO: 532575 - RNA, 19 nt, Homo sapiens
gcccagaaccugucauugc

SEQ ID NO: 532576 - RNA, 19 nt, Homo sapiens
ggagauugcccugcucaag

SEQ ID NO: 532577 - RNA, 19 nt, Homo sapiens
gaccgugccuacagauacu

SEQ ID NO: 532578 - RNA, 19 nt, Homo sapiens
caaggccaaagacacagua

SEQ ID NO: 532579 - RNA, 19 nt, Homo sapiens
cucaacagcuccgugaaga

SEQ ID NO: 532580 - RNA, 19 nt, Homo sapiens
ggccacacagagacacaua

SEQ ID NO: 532581 - RNA, 19 nt, Homo sapiens
gccaaagacacaguauuau

SEQ ID NO: 532582 - RNA, 19 nt, Homo sapiens
caauuccgguucugcaaac

SEQ ID NO: 532583 - RNA, 19 nt, Homo sapiens
caggacaagcugaacaaga

SEQ ID NO: 532584 - RNA, 19 nt, Homo sapiens
agaagauguuggacuacga

SEQ ID NO: 532585 - RNA, 19 nt, Homo sapiens
ggagaucggcgagcugaag

SEQ ID NO: 532586 - RNA, 19 nt, Homo sapiens
ucagaaauguugccagaaa

SEQ ID NO: 532587 - RNA, 19 nt, Homo sapiens
gaguagagauuucuguguu

SEQ ID NO: 532588 - RNA, 19 nt, Homo sapiens
ggacggaugcgcaggauuu

SEQ ID NO: 532589 - RNA, 19 nt, Homo sapiens
cugcagagcugauuaaaca

SEQ ID NO: 532590 - RNA, 19 nt, Homo sapiens
cuagaaagcauuacaugua

SEQ ID NO: 532591 - RNA, 19 nt, Homo sapiens
gaggaacccuggacucuca

SEQ ID NO: 532592 - RNA, 19 nt, Homo sapiens
gcaaagaggucagagaaaa

SEQ ID NO: 532593 - RNA, 19 nt, Homo sapiens
ugauaagcuuguacaguua

SEQ ID NO: 532594 - RNA, 19 nt, Homo sapiens
guggaaaugucacuugcua

SEQ ID NO: 532595 - RNA, 19 nt, Homo sapiens
ggagccauauuuaacauuc

SEQ ID NO: 532596 - RNA, 19 nt, Homo sapiens
uugauaagcuuguacaguu

SEQ ID NO: 532597 - RNA, 19 nt, Homo sapiens
gaaagcauuacauguaguu

SEQ ID NO: 532598 - RNA, 19 nt, Homo sapiens
ggaaccggauuacgugaau

SEQ ID NO: 532599 - RNA, 19 nt, Homo sapiens
agagggaccuugagucaga

SEQ ID NO: 532600 - RNA, 19 nt, Homo sapiens
gaacucagcauccauccau

SEQ ID NO: 532601 - RNA, 19 nt, Homo sapiens
ggaggaagccuacauagac

SEQ ID NO: 532602 - RNA, 19 nt, Homo sapiens
aggacaagcuguugcaauu

SEQ ID NO: 532603 - RNA, 19 nt, Homo sapiens
uagaaagcauuacauguag

SEQ ID NO: 532604 - RNA, 19 nt, Homo sapiens
gaaaggagccaaggcaaag

SEQ ID NO: 532605 - RNA, 19 nt, Homo sapiens
aaaugucacuugcuacaga

SEQ ID NO: 532606 - RNA, 19 nt, Homo sapiens
uaccagaacuucagcaaag

SEQ ID NO: 532607 - RNA, 19 nt, Homo sapiens
ggaaaugucacuugcuaca

SEQ ID NO: 532608 - RNA, 19 nt, Homo sapiens
gauaagcuuguacaguuaa

SEQ ID NO: 532609 - RNA, 19 nt, Homo sapiens
ggaccacugugcucaugga

SEQ ID NO: 532610 - RNA, 19 nt, Homo sapiens
gacaagcuguugcaauucu

SEQ ID NO: 532611 - RNA, 19 nt, Homo sapiens
ucaguucacucaggaagaa

SEQ ID NO: 532612 - RNA, 19 nt, Homo sapiens
guccaacacugguaucugu

SEQ ID NO: 532613 - RNA, 19 nt, Homo sapiens
ucccagagcuacucaacuu

SEQ ID NO: 532614 - RNA, 19 nt, Homo sapiens
uaacccggcuccugguaug

SEQ ID NO: 532615 - RNA, 19 nt, Homo sapiens
gaccuugagucagaaaugu

SEQ ID NO: 532616 - RNA, 19 nt, Homo sapiens
gcaugagagucuagagaag

SEQ ID NO: 532617 - RNA, 19 nt, Homo sapiens
guagagauuucuguguugu

SEQ ID NO: 532618 - RNA, 19 nt, Homo sapiens
acugguaucuguguucuuu

SEQ ID NO: 532619 - RNA, 19 nt, Homo sapiens
gugcaaagaggucagagaa

SEQ ID NO: 532620 - RNA, 19 nt, Homo sapiens
gaggcugucgccaucuuua

SEQ ID NO: 532621 - RNA, 19 nt, Homo sapiens
gagaaguagugaccagaac

SEQ ID NO: 532622 - RNA, 19 nt, Homo sapiens
caaggaaggacaagcuguu

SEQ ID NO: 532623 - RNA, 19 nt, Homo sapiens
ccagagggaccuugaguca

SEQ ID NO: 532624 - RNA, 19 nt, Homo sapiens
gaggaccaacagagcuuua

SEQ ID NO: 532625 - RNA, 19 nt, Homo sapiens
augagagucuagagaagua

SEQ ID NO: 532626 - RNA, 19 nt, Homo sapiens
ggaccuugagucagaaaug

SEQ ID NO: 532627 - RNA, 19 nt, Homo sapiens
ggauuucagaguagagauu

SEQ ID NO: 532628 - RNA, 19 nt, Homo sapiens
gcagagcugauuaaacagu

SEQ ID NO: 532629 - RNA, 19 nt, Homo sapiens
gaaccggauuacgugaaug

SEQ ID NO: 532630 - RNA, 19 nt, Homo sapiens
agaagaugaugaugccaau

SEQ ID NO: 532631 - RNA, 19 nt, Homo sapiens
gacaauagugcaugagagu

SEQ ID NO: 532632 - RNA, 19 nt, Homo sapiens
uaucagaacucagcaucca

SEQ ID NO: 532633 - RNA, 19 nt, Homo sapiens
guaccagaacuucagcaaa

SEQ ID NO: 532634 - RNA, 19 nt, Homo sapiens
ggacaagcuguugcaauuc

SEQ ID NO: 532635 - RNA, 19 nt, Homo sapiens
ggaaggacaagcuguugca

SEQ ID NO: 532636 - RNA, 19 nt, Homo sapiens
cagagcuacucaacuuuua

SEQ ID NO: 532637 - RNA, 19 nt, Homo sapiens
uacagacaauagugcauga

SEQ ID NO: 532638 - RNA, 19 nt, Homo sapiens
gauuucagaguagagauuu

SEQ ID NO: 532639 - RNA, 19 nt, Homo sapiens
ccuaauugcuauuguuggu

SEQ ID NO: 532640 - RNA, 19 nt, Homo sapiens
gauuuaggauaagcuguca

SEQ ID NO: 532641 - RNA, 19 nt, Homo sapiens
agaaaggagccaaggcaaa

SEQ ID NO: 532642 - RNA, 19 nt, Homo sapiens
caaccaaaacaucucaaua

SEQ ID NO: 532643 - RNA, 19 nt, Homo sapiens
gcggauguacggaugauuc

SEQ ID NO: 532644 - RNA, 19 nt, Homo sapiens
acccaucgcugccuuccaa

SEQ ID NO: 532645 - RNA, 19 nt, Homo sapiens
gggcagaccaagaagaaag

SEQ ID NO: 532646 - RNA, 19 nt, Homo sapiens
gaagaugaugaugccaauu

SEQ ID NO: 532647 - RNA, 19 nt, Homo sapiens
gacggaugcgcaggauuua

SEQ ID NO: 532648 - RNA, 19 nt, Homo sapiens
acaagcuguugcaauucua

SEQ ID NO: 532649 - RNA, 19 nt, Homo sapiens
aguagagauuucuguguug

SEQ ID NO: 532650 - RNA, 19 nt, Homo sapiens
ugcgcaggauuuaggauaa

SEQ ID NO: 532651 - RNA, 19 nt, Homo sapiens
gagggaccuugagucagaa

SEQ ID NO: 532652 - RNA, 19 nt, Homo sapiens
gaaaaucuaccagcagaga

SEQ ID NO: 532653 - RNA, 19 nt, Homo sapiens
uagggcagaccaagaagaa

SEQ ID NO: 532654 - RNA, 19 nt, Homo sapiens
uguguugucuccuagaaag

SEQ ID NO: 532655 - RNA, 19 nt, Homo sapiens
guacaguuaacuuauagag

SEQ ID NO: 532656 - RNA, 19 nt, Homo sapiens
gacauggcacccacaagga

SEQ ID NO: 532657 - RNA, 19 nt, Homo sapiens
uaacaaaaccacuguccaa

SEQ ID NO: 532658 - RNA, 19 nt, Homo sapiens
gcgcaggauuuaggauaag

SEQ ID NO: 532659 - RNA, 19 nt, Homo sapiens
gggcaacuccagagagaag

SEQ ID NO: 532660 - RNA, 19 nt, Homo sapiens
gauguacggaugauucagu

SEQ ID NO: 532661 - RNA, 19 nt, Homo sapiens
aagaugaugaugccaauuc

SEQ ID NO: 532662 - RNA, 19 nt, Homo sapiens
gaaguagugaccagaacag

SEQ ID NO: 532663 - RNA, 19 nt, Homo sapiens
uauuucagcauccuuguug

SEQ ID NO: 532664 - RNA, 19 nt, Homo sapiens
gagccauauuuaacauucu

SEQ ID NO: 532665 - RNA, 19 nt, Homo sapiens
gguaacccggcuccuggua

SEQ ID NO: 532666 - RNA, 19 nt, Homo sapiens
gccuagggcagaccaagaa

SEQ ID NO: 532667 - RNA, 19 nt, Homo sapiens
cggaggaagccuacauaga

SEQ ID NO: 532668 - RNA, 19 nt, Homo sapiens
cagaaauguugccagaaaa

SEQ ID NO: 532669 - RNA, 19 nt, Homo sapiens
caauagugcaugagagucu

SEQ ID NO: 532670 - RNA, 19 nt, Homo sapiens
ccacuguccaacacuggua

SEQ ID NO: 532671 - RNA, 19 nt, Homo sapiens
gcagaaaaccacagagaca

SEQ ID NO: 532672 - RNA, 19 nt, Homo sapiens
agaaagcauuacauguagu

SEQ ID NO: 532673 - RNA, 19 nt, Homo sapiens
gaaggacaagcuguugcaa

SEQ ID NO: 532674 - RNA, 19 nt, Homo sapiens
gugcaugagagucuagaga

SEQ ID NO: 532675 - RNA, 19 nt, Homo sapiens
cagacaauagugcaugaga

SEQ ID NO: 532676 - RNA, 19 nt, Homo sapiens
gcuuguacaguuaacuuau

SEQ ID NO: 532677 - RNA, 19 nt, Homo sapiens
gggaaaagacaguuacuca

SEQ ID NO: 532678 - RNA, 19 nt, Homo sapiens
gggaaccggauuacgugaa

SEQ ID NO: 532679 - RNA, 19 nt, Homo sapiens
ccacaaggaaggacaagcu

SEQ ID NO: 532680 - RNA, 19 nt, Homo sapiens
gaccagaacagggcagagu

SEQ ID NO: 532681 - RNA, 19 nt, Homo sapiens
aauagugcaugagagucua

SEQ ID NO: 532682 - RNA, 19 nt, Homo sapiens
ccuagaaagcauuacaugu

SEQ ID NO: 532683 - RNA, 19 nt, Homo sapiens
agagauuucuguguugucu

SEQ ID NO: 532684 - RNA, 19 nt, Homo sapiens
ggaccauuucccagagcua

SEQ ID NO: 532685 - RNA, 19 nt, Homo sapiens
ucacuugcuacagacaaua

SEQ ID NO: 532686 - RNA, 19 nt, Homo sapiens
ucagaaauguugccagaaa

SEQ ID NO: 532687 - RNA, 19 nt, Homo sapiens
gaguagagauuucuguguu

SEQ ID NO: 532688 - RNA, 19 nt, Homo sapiens
ggacggaugcgcaggauuu

SEQ ID NO: 532689 - RNA, 19 nt, Homo sapiens
cugcagagcugauuaaaca

SEQ ID NO: 532690 - RNA, 19 nt, Homo sapiens
cuagaaagcauuacaugua

SEQ ID NO: 532691 - RNA, 19 nt, Homo sapiens
gaggaacccuggacucuca

SEQ ID NO: 532692 - RNA, 19 nt, Homo sapiens
gcaaagaggucagagaaaa

SEQ ID NO: 532693 - RNA, 19 nt, Homo sapiens
ugauaagcuuguacaguua

SEQ ID NO: 532694 - RNA, 19 nt, Homo sapiens
guggaaaugucacuugcua

SEQ ID NO: 532695 - RNA, 19 nt, Homo sapiens
ggagccauauuuaacauuc

SEQ ID NO: 532696 - RNA, 19 nt, Homo sapiens
uugauaagcuuguacaguu

SEQ ID NO: 532697 - RNA, 19 nt, Homo sapiens
gaaagcauuacauguaguu

SEQ ID NO: 532698 - RNA, 19 nt, Homo sapiens
ggaaccggauuacgugaau

SEQ ID NO: 532699 - RNA, 19 nt, Homo sapiens
ccaacgugcugggauuaua

SEQ ID NO: 532700 - RNA, 19 nt, Homo sapiens
agagggaccuugagucaga

SEQ ID NO: 532701 - RNA, 19 nt, Homo sapiens
gaacucagcauccauccau

SEQ ID NO: 532702 - RNA, 19 nt, Homo sapiens
ggaggaagccuacauagac

SEQ ID NO: 532703 - RNA, 19 nt, Homo sapiens
aggacaagcuguugcaauu

SEQ ID NO: 532704 - RNA, 19 nt, Homo sapiens
uagaaagcauuacauguag

SEQ ID NO: 532705 - RNA, 19 nt, Homo sapiens
gaaaggagccaaggcaaag

SEQ ID NO: 532706 - RNA, 19 nt, Homo sapiens
aaaugucacuugcuacaga

SEQ ID NO: 532707 - RNA, 19 nt, Homo sapiens
uaccagaacuucagcaaag

SEQ ID NO: 532708 - RNA, 19 nt, Homo sapiens
ggaaaugucacuugcuaca

SEQ ID NO: 532709 - RNA, 19 nt, Homo sapiens
gauggaauuucaccguguu

SEQ ID NO: 532710 - RNA, 19 nt, Homo sapiens
gauaagcuuguacaguuaa

SEQ ID NO: 532711 - RNA, 19 nt, Homo sapiens
ggaccacugugcucaugga

SEQ ID NO: 532712 - RNA, 19 nt, Homo sapiens
gacaagcuguugcaauucu

SEQ ID NO: 532713 - RNA, 19 nt, Homo sapiens
ucaguucacucaggaagaa

SEQ ID NO: 532714 - RNA, 19 nt, Homo sapiens
guccaacacugguaucugu

SEQ ID NO: 532715 - RNA, 19 nt, Homo sapiens
ucccagagcuacucaacuu

SEQ ID NO: 532716 - RNA, 19 nt, Homo sapiens
guuccuaguugcaacaguu

SEQ ID NO: 532717 - RNA, 19 nt, Homo sapiens
uaacccggcuccugguaug

SEQ ID NO: 532718 - RNA, 19 nt, Homo sapiens
gaccuugagucagaaaugu

SEQ ID NO: 532719 - RNA, 19 nt, Homo sapiens
gcaugagagucuagagaag

SEQ ID NO: 532720 - RNA, 19 nt, Homo sapiens
guagagauuucuguguugu

SEQ ID NO: 532721 - RNA, 19 nt, Homo sapiens
acugguaucuguguucuuu

SEQ ID NO: 532722 - RNA, 19 nt, Homo sapiens
gugcaaagaggucagagaa

SEQ ID NO: 532723 - RNA, 19 nt, Homo sapiens
cagggucuguuccuaguug

SEQ ID NO: 532724 - RNA, 19 nt, Homo sapiens
gaggcugucgccaucuuua

SEQ ID NO: 532725 - RNA, 19 nt, Homo sapiens
gagaaguagugaccagaac

SEQ ID NO: 532726 - RNA, 19 nt, Homo sapiens
caaggaaggacaagcuguu

SEQ ID NO: 532727 - RNA, 19 nt, Homo sapiens
ccagagggaccuugaguca

SEQ ID NO: 532728 - RNA, 19 nt, Homo sapiens
gaggaccaacagagcuuua

SEQ ID NO: 532729 - RNA, 19 nt, Homo sapiens
augagagucuagagaagua

SEQ ID NO: 532730 - RNA, 19 nt, Homo sapiens
ggaccuugagucagaaaug

SEQ ID NO: 532731 - RNA, 19 nt, Homo sapiens
ggauuucagaguagagauu

SEQ ID NO: 532732 - RNA, 19 nt, Homo sapiens
gcagagcugauuaaacagu

SEQ ID NO: 532733 - RNA, 19 nt, Homo sapiens
gaaccggauuacgugaaug

SEQ ID NO: 532734 - RNA, 19 nt, Homo sapiens
agaagaugaugaugccaau

SEQ ID NO: 532735 - RNA, 19 nt, Homo sapiens
uugcaacaguucuuggaaa

SEQ ID NO: 532736 - RNA, 19 nt, Homo sapiens
gacaauagugcaugagagu

SEQ ID NO: 532737 - RNA, 19 nt, Homo sapiens
uaucagaacucagcaucca

SEQ ID NO: 532738 - RNA, 19 nt, Homo sapiens
guaccagaacuucagcaaa

SEQ ID NO: 532739 - RNA, 19 nt, Homo sapiens
ggacaagcuguugcaauuc

SEQ ID NO: 532740 - RNA, 19 nt, Homo sapiens
ggaaggacaagcuguugca

SEQ ID NO: 532741 - RNA, 19 nt, Homo sapiens
cagagcuacucaacuuuua

SEQ ID NO: 532742 - RNA, 19 nt, Homo sapiens
uacagacaauagugcauga

SEQ ID NO: 532743 - RNA, 19 nt, Homo sapiens
gauuucagaguagagauuu

SEQ ID NO: 532744 - RNA, 19 nt, Homo sapiens
ccuaauugcuauuguuggu

SEQ ID NO: 532745 - RNA, 19 nt, Homo sapiens
gauuuaggauaagcuguca

SEQ ID NO: 532746 - RNA, 19 nt, Homo sapiens
agaaaggagccaaggcaaa

SEQ ID NO: 532747 - RNA, 19 nt, Homo sapiens
caaccaaaacaucucaaua

SEQ ID NO: 532748 - RNA, 19 nt, Homo sapiens
gccagggucuguuccuagu

SEQ ID NO: 532749 - RNA, 19 nt, Homo sapiens
caacgugcugggauuauag

SEQ ID NO: 532750 - RNA, 19 nt, Homo sapiens
gcggauguacggaugauuc

SEQ ID NO: 532751 - RNA, 19 nt, Homo sapiens
acccaucgcugccuuccaa

SEQ ID NO: 532752 - RNA, 19 nt, Homo sapiens
gggcagaccaagaagaaag

SEQ ID NO: 532753 - RNA, 19 nt, Homo sapiens
gaagaugaugaugccaauu

SEQ ID NO: 532754 - RNA, 19 nt, Homo sapiens
gacggaugcgcaggauuua

SEQ ID NO: 532755 - RNA, 19 nt, Homo sapiens
acaagcuguugcaauucua

SEQ ID NO: 532756 - RNA, 19 nt, Homo sapiens
aguagagauuucuguguug

SEQ ID NO: 532757 - RNA, 19 nt, Homo sapiens
ugcgcaggauuuaggauaa

SEQ ID NO: 532758 - RNA, 19 nt, Homo sapiens
gagggaccuugagucagaa

SEQ ID NO: 532759 - RNA, 19 nt, Homo sapiens
uagggcagaccaagaagaa

SEQ ID NO: 532760 - RNA, 19 nt, Homo sapiens
gaaaaucuaccagcagaga

SEQ ID NO: 532761 - RNA, 19 nt, Homo sapiens
gauguacggaugauucagu

SEQ ID NO: 532762 - RNA, 19 nt, Homo sapiens
uguguugucuccuagaaag

SEQ ID NO: 532763 - RNA, 19 nt, Homo sapiens
guacaguuaacuuauagag

SEQ ID NO: 532764 - RNA, 19 nt, Homo sapiens
uaacaaaaccacuguccaa

SEQ ID NO: 532765 - RNA, 19 nt, Homo sapiens
gcgcaggauuuaggauaag

SEQ ID NO: 532766 - RNA, 19 nt, Homo sapiens
gggcaacuccagagagaag

SEQ ID NO: 532767 - RNA, 19 nt, Homo sapiens
aagaugaugaugccaauuc

SEQ ID NO: 532768 - RNA, 19 nt, Homo sapiens
gacauggcacccacaagga

SEQ ID NO: 532769 - RNA, 19 nt, Homo sapiens
gaaguagugaccagaacag

SEQ ID NO: 532770 - RNA, 19 nt, Homo sapiens
uauuucagcauccuuguug

SEQ ID NO: 532771 - RNA, 19 nt, Homo sapiens
gagccauauuuaacauucu

SEQ ID NO: 532772 - RNA, 19 nt, Homo sapiens
gguaacccggcuccuggua

SEQ ID NO: 532773 - RNA, 19 nt, Homo sapiens
gccuagggcagaccaagaa

SEQ ID NO: 532774 - RNA, 19 nt, Homo sapiens
cggaggaagccuacauaga

SEQ ID NO: 532775 - RNA, 19 nt, Homo sapiens
cagaaauguugccagaaaa

SEQ ID NO: 532776 - RNA, 19 nt, Homo sapiens
caauagugcaugagagucu

SEQ ID NO: 532777 - RNA, 19 nt, Homo sapiens
ccacuguccaacacuggua

SEQ ID NO: 532778 - RNA, 19 nt, Homo sapiens
gcagaaaaccacagagaca

SEQ ID NO: 532779 - RNA, 19 nt, Homo sapiens
agaaagcauuacauguagu

SEQ ID NO: 532780 - RNA, 19 nt, Homo sapiens
gaaggacaagcuguugcaa

SEQ ID NO: 532781 - RNA, 19 nt, Homo sapiens
gugcaugagagucuagaga

SEQ ID NO: 532782 - RNA, 19 nt, Homo sapiens
cagacaauagugcaugaga

SEQ ID NO: 532783 - RNA, 19 nt, Homo sapiens
gcuuguacaguuaacuuau

SEQ ID NO: 532784 - RNA, 19 nt, Homo sapiens
gggaaaagacaguuacuca

SEQ ID NO: 532785 - RNA, 19 nt, Homo sapiens
gggaaccggauuacgugaa

SEQ ID NO: 532786 - RNA, 19 nt, Homo sapiens
ucagaaauguugccagaaa

SEQ ID NO: 532787 - RNA, 19 nt, Homo sapiens
gaguagagauuucuguguu

SEQ ID NO: 532788 - RNA, 19 nt, Homo sapiens
ggacggaugcgcaggauuu

SEQ ID NO: 532789 - RNA, 19 nt, Homo sapiens
cugcagagcugauuaaaca

SEQ ID NO: 532790 - RNA, 19 nt, Homo sapiens
cuagaaagcauuacaugua

SEQ ID NO: 532791 - RNA, 19 nt, Homo sapiens
gaggaacccuggacucuca

SEQ ID NO: 532792 - RNA, 19 nt, Homo sapiens
gcaaagaggucagagaaaa

SEQ ID NO: 532793 - RNA, 19 nt, Homo sapiens
ugauaagcuuguacaguua

SEQ ID NO: 532794 - RNA, 19 nt, Homo sapiens
guggaaaugucacuugcua

SEQ ID NO: 532795 - RNA, 19 nt, Homo sapiens
ggagccauauuuaacauuc

SEQ ID NO: 532796 - RNA, 19 nt, Homo sapiens
uugauaagcuuguacaguu

SEQ ID NO: 532797 - RNA, 19 nt, Homo sapiens
gaaagcauuacauguaguu

SEQ ID NO: 532798 - RNA, 19 nt, Homo sapiens
ggaaccggauuacgugaau

SEQ ID NO: 532799 - RNA, 19 nt, Homo sapiens
ccaacgugcugggauuaua

SEQ ID NO: 532800 - RNA, 19 nt, Homo sapiens
agagggaccuugagucaga

SEQ ID NO: 532801 - RNA, 19 nt, Homo sapiens
gaacucagcauccauccau

SEQ ID NO: 532802 - RNA, 19 nt, Homo sapiens
ggaggaagccuacauagac

SEQ ID NO: 532803 - RNA, 19 nt, Homo sapiens
aggacaagcuguugcaauu

SEQ ID NO: 532804 - RNA, 19 nt, Homo sapiens
uagaaagcauuacauguag

SEQ ID NO: 532805 - RNA, 19 nt, Homo sapiens
gaaaggagccaaggcaaag

SEQ ID NO: 532806 - RNA, 19 nt, Homo sapiens
aaaugucacuugcuacaga

SEQ ID NO: 532807 - RNA, 19 nt, Homo sapiens
uaccagaacuucagcaaag

SEQ ID NO: 532808 - RNA, 19 nt, Homo sapiens
ggaaaugucacuugcuaca

SEQ ID NO: 532809 - RNA, 19 nt, Homo sapiens
gauggaauuucaccguguu

SEQ ID NO: 532810 - RNA, 19 nt, Homo sapiens
gauaagcuuguacaguuaa

SEQ ID NO: 532811 - RNA, 19 nt, Homo sapiens
ggaccacugugcucaugga

SEQ ID NO: 532812 - RNA, 19 nt, Homo sapiens
gacaagcuguugcaauucu

SEQ ID NO: 532813 - RNA, 19 nt, Homo sapiens
ucaguucacucaggaagaa

SEQ ID NO: 532814 - RNA, 19 nt, Homo sapiens
guccaacacugguaucugu

SEQ ID NO: 532815 - RNA, 19 nt, Homo sapiens
ucccagagcuacucaacuu

SEQ ID NO: 532816 - RNA, 19 nt, Homo sapiens
uaacccggcuccugguaug

SEQ ID NO: 532817 - RNA, 19 nt, Homo sapiens
gaccuugagucagaaaugu

SEQ ID NO: 532818 - RNA, 19 nt, Homo sapiens
gcaugagagucuagagaag

SEQ ID NO: 532819 - RNA, 19 nt, Homo sapiens
guagagauuucuguguugu

SEQ ID NO: 532820 - RNA, 19 nt, Homo sapiens
acugguaucuguguucuuu

SEQ ID NO: 532821 - RNA, 19 nt, Homo sapiens
gugcaaagaggucagagaa

SEQ ID NO: 532822 - RNA, 19 nt, Homo sapiens
gaggcugucgccaucuuua

SEQ ID NO: 532823 - RNA, 19 nt, Homo sapiens
gagaaguagugaccagaac

SEQ ID NO: 532824 - RNA, 19 nt, Homo sapiens
caaggaaggacaagcuguu

SEQ ID NO: 532825 - RNA, 19 nt, Homo sapiens
ccagagggaccuugaguca

SEQ ID NO: 532826 - RNA, 19 nt, Homo sapiens
gaggaccaacagagcuuua

SEQ ID NO: 532827 - RNA, 19 nt, Homo sapiens
augagagucuagagaagua

SEQ ID NO: 532828 - RNA, 19 nt, Homo sapiens
ggaccuugagucagaaaug

SEQ ID NO: 532829 - RNA, 19 nt, Homo sapiens
ggauuucagaguagagauu

SEQ ID NO: 532830 - RNA, 19 nt, Homo sapiens
gcagagcugauuaaacagu

SEQ ID NO: 532831 - RNA, 19 nt, Homo sapiens
gaaccggauuacgugaaug

SEQ ID NO: 532832 - RNA, 19 nt, Homo sapiens
agaagaugaugaugccaau

SEQ ID NO: 532833 - RNA, 19 nt, Homo sapiens
gacaauagugcaugagagu

SEQ ID NO: 532834 - RNA, 19 nt, Homo sapiens
uaucagaacucagcaucca

SEQ ID NO: 532835 - RNA, 19 nt, Homo sapiens
guaccagaacuucagcaaa

SEQ ID NO: 532836 - RNA, 19 nt, Homo sapiens
ggacaagcuguugcaauuc

SEQ ID NO: 532837 - RNA, 19 nt, Homo sapiens
ggaaggacaagcuguugca

SEQ ID NO: 532838 - RNA, 19 nt, Homo sapiens
cagagcuacucaacuuuua

SEQ ID NO: 532839 - RNA, 19 nt, Homo sapiens
uacagacaauagugcauga

SEQ ID NO: 532840 - RNA, 19 nt, Homo sapiens
gauuucagaguagagauuu

SEQ ID NO: 532841 - RNA, 19 nt, Homo sapiens
ccuaauugcuauuguuggu

SEQ ID NO: 532842 - RNA, 19 nt, Homo sapiens
gauuuaggauaagcuguca

SEQ ID NO: 532843 - RNA, 19 nt, Homo sapiens
agaaaggagccaaggcaaa

SEQ ID NO: 532844 - RNA, 19 nt, Homo sapiens
caaccaaaacaucucaaua

SEQ ID NO: 532845 - RNA, 19 nt, Homo sapiens
caacgugcugggauuauag

SEQ ID NO: 532846 - RNA, 19 nt, Homo sapiens
gcggauguacggaugauuc

SEQ ID NO: 532847 - RNA, 19 nt, Homo sapiens
acccaucgcugccuuccaa

SEQ ID NO: 532848 - RNA, 19 nt, Homo sapiens
gggcagaccaagaagaaag

SEQ ID NO: 532849 - RNA, 19 nt, Homo sapiens
gaagaugaugaugccaauu

SEQ ID NO: 532850 - RNA, 19 nt, Homo sapiens
gacggaugcgcaggauuua

SEQ ID NO: 532851 - RNA, 19 nt, Homo sapiens
acaagcuguugcaauucua

SEQ ID NO: 532852 - RNA, 19 nt, Homo sapiens
aguagagauuucuguguug

SEQ ID NO: 532853 - RNA, 19 nt, Homo sapiens
ugcgcaggauuuaggauaa

SEQ ID NO: 532854 - RNA, 19 nt, Homo sapiens
gagggaccuugagucagaa

SEQ ID NO: 532855 - RNA, 19 nt, Homo sapiens
gaaaaucuaccagcagaga

SEQ ID NO: 532856 - RNA, 19 nt, Homo sapiens
uagggcagaccaagaagaa

SEQ ID NO: 532857 - RNA, 19 nt, Homo sapiens
gauguacggaugauucagu

SEQ ID NO: 532858 - RNA, 19 nt, Homo sapiens
uguguugucuccuagaaag

SEQ ID NO: 532859 - RNA, 19 nt, Homo sapiens
guacaguuaacuuauagag

SEQ ID NO: 532860 - RNA, 19 nt, Homo sapiens
uaacaaaaccacuguccaa

SEQ ID NO: 532861 - RNA, 19 nt, Homo sapiens
gcgcaggauuuaggauaag

SEQ ID NO: 532862 - RNA, 19 nt, Homo sapiens
gggcaacuccagagagaag

SEQ ID NO: 532863 - RNA, 19 nt, Homo sapiens
aagaugaugaugccaauuc

SEQ ID NO: 532864 - RNA, 19 nt, Homo sapiens
gacauggcacccacaagga

SEQ ID NO: 532865 - RNA, 19 nt, Homo sapiens
gaaguagugaccagaacag

SEQ ID NO: 532866 - RNA, 19 nt, Homo sapiens
uauuucagcauccuuguug

SEQ ID NO: 532867 - RNA, 19 nt, Homo sapiens
gagccauauuuaacauucu

SEQ ID NO: 532868 - RNA, 19 nt, Homo sapiens
gguaacccggcuccuggua

SEQ ID NO: 532869 - RNA, 19 nt, Homo sapiens
gccuagggcagaccaagaa

SEQ ID NO: 532870 - RNA, 19 nt, Homo sapiens
cggaggaagccuacauaga

SEQ ID NO: 532871 - RNA, 19 nt, Homo sapiens
cagaaauguugccagaaaa

SEQ ID NO: 532872 - RNA, 19 nt, Homo sapiens
caauagugcaugagagucu

SEQ ID NO: 532873 - RNA, 19 nt, Homo sapiens
ccacuguccaacacuggua

SEQ ID NO: 532874 - RNA, 19 nt, Homo sapiens
gcagaaaaccacagagaca

SEQ ID NO: 532875 - RNA, 19 nt, Homo sapiens
agaaagcauuacauguagu

SEQ ID NO: 532876 - RNA, 19 nt, Homo sapiens
gaaggacaagcuguugcaa

SEQ ID NO: 532877 - RNA, 19 nt, Homo sapiens
gugcaugagagucuagaga

SEQ ID NO: 532878 - RNA, 19 nt, Homo sapiens
cagacaauagugcaugaga

SEQ ID NO: 532879 - RNA, 19 nt, Homo sapiens
gcuuguacaguuaacuuau

SEQ ID NO: 532880 - RNA, 19 nt, Homo sapiens
gggaaaagacaguuacuca

SEQ ID NO: 532881 - RNA, 19 nt, Homo sapiens
gggaaccggauuacgugaa

SEQ ID NO: 532882 - RNA, 19 nt, Homo sapiens
ccacaaggaaggacaagcu

SEQ ID NO: 532883 - RNA, 19 nt, Homo sapiens
gaccagaacagggcagagu

SEQ ID NO: 532884 - RNA, 19 nt, Homo sapiens
aauagugcaugagagucua

SEQ ID NO: 532885 - RNA, 19 nt, Homo sapiens
ccuagaaagcauuacaugu

SEQ ID NO: 532886 - RNA, 19 nt, Homo sapiens
ggaggaagccuacauauga

SEQ ID NO: 532887 - RNA, 19 nt, Homo sapiens
ucagaaauguugccagaaa

SEQ ID NO: 532888 - RNA, 19 nt, Homo sapiens
gaguagagauuucuguguu

SEQ ID NO: 532889 - RNA, 19 nt, Homo sapiens
ggacggaugcgcaggauuu

SEQ ID NO: 532890 - RNA, 19 nt, Homo sapiens
cugcagagcugauuaaaca

SEQ ID NO: 532891 - RNA, 19 nt, Homo sapiens
cuagaaagcauuacaugua

SEQ ID NO: 532892 - RNA, 19 nt, Homo sapiens
gaggaacccuggacucuca

SEQ ID NO: 532893 - RNA, 19 nt, Homo sapiens
gcaaagaggucagagaaaa

SEQ ID NO: 532894 - RNA, 19 nt, Homo sapiens
ugauaagcuuguacaguua

SEQ ID NO: 532895 - RNA, 19 nt, Homo sapiens
guggaaaugucacuugcua

SEQ ID NO: 532896 - RNA, 19 nt, Homo sapiens
ggagccauauuuaacauuc

SEQ ID NO: 532897 - RNA, 19 nt, Homo sapiens
uugauaagcuuguacaguu

SEQ ID NO: 532898 - RNA, 19 nt, Homo sapiens
gaaagcauuacauguaguu

SEQ ID NO: 532899 - RNA, 19 nt, Homo sapiens
ggaaccggauuacgugaau

SEQ ID NO: 532900 - RNA, 19 nt, Homo sapiens
agagggaccuugagucaga

SEQ ID NO: 532901 - RNA, 19 nt, Homo sapiens
gaacucagcauccauccau

SEQ ID NO: 532902 - RNA, 19 nt, Homo sapiens
gaggaagccuacauaugau

SEQ ID NO: 532903 - RNA, 19 nt, Homo sapiens
aggacaagcuguugcaauu

SEQ ID NO: 532904 - RNA, 19 nt, Homo sapiens
uagaaagcauuacauguag

SEQ ID NO: 532905 - RNA, 19 nt, Homo sapiens
gaaaggagccaaggcaaag

SEQ ID NO: 532906 - RNA, 19 nt, Homo sapiens
aaaugucacuugcuacaga

SEQ ID NO: 532907 - RNA, 19 nt, Homo sapiens
uaccagaacuucagcaaag

SEQ ID NO: 532908 - RNA, 19 nt, Homo sapiens
ggaaaugucacuugcuaca

SEQ ID NO: 532909 - RNA, 19 nt, Homo sapiens
gauaagcuuguacaguuaa

SEQ ID NO: 532910 - RNA, 19 nt, Homo sapiens
ggaccacugugcucaugga

SEQ ID NO: 532911 - RNA, 19 nt, Homo sapiens
gacaagcuguugcaauucu

SEQ ID NO: 532912 - RNA, 19 nt, Homo sapiens
ucaguucacucaggaagaa

SEQ ID NO: 532913 - RNA, 19 nt, Homo sapiens
guccaacacugguaucugu

SEQ ID NO: 532914 - RNA, 19 nt, Homo sapiens
ucccagagcuacucaacuu

SEQ ID NO: 532915 - RNA, 19 nt, Homo sapiens
uaacccggcuccugguaug

SEQ ID NO: 532916 - RNA, 19 nt, Homo sapiens
gaccuugagucagaaaugu

SEQ ID NO: 532917 - RNA, 19 nt, Homo sapiens
gcaugagagucuagagaag

SEQ ID NO: 532918 - RNA, 19 nt, Homo sapiens
guagagauuucuguguugu

SEQ ID NO: 532919 - RNA, 19 nt, Homo sapiens
acugguaucuguguucuuu

SEQ ID NO: 532920 - RNA, 19 nt, Homo sapiens
ggaagccuacauaugauga

SEQ ID NO: 532921 - RNA, 19 nt, Homo sapiens
gugcaaagaggucagagaa

SEQ ID NO: 532922 - RNA, 19 nt, Homo sapiens
gaggcugucgccaucuuua

SEQ ID NO: 532923 - RNA, 19 nt, Homo sapiens
gagaaguagugaccagaac

SEQ ID NO: 532924 - RNA, 19 nt, Homo sapiens
cauaugaugaugccaauuc

SEQ ID NO: 532925 - RNA, 19 nt, Homo sapiens
caaggaaggacaagcuguu

SEQ ID NO: 532926 - RNA, 19 nt, Homo sapiens
ccagagggaccuugaguca

SEQ ID NO: 532927 - RNA, 19 nt, Homo sapiens
gaggaccaacagagcuuua

SEQ ID NO: 532928 - RNA, 19 nt, Homo sapiens
augagagucuagagaagua

SEQ ID NO: 532929 - RNA, 19 nt, Homo sapiens
ggaccuugagucagaaaug

SEQ ID NO: 532930 - RNA, 19 nt, Homo sapiens
ggauuucagaguagagauu

SEQ ID NO: 532931 - RNA, 19 nt, Homo sapiens
gcagagcugauuaaacagu

SEQ ID NO: 532932 - RNA, 19 nt, Homo sapiens
gaaccggauuacgugaaug

SEQ ID NO: 532933 - RNA, 19 nt, Homo sapiens
gacaauagugcaugagagu

SEQ ID NO: 532934 - RNA, 19 nt, Homo sapiens
uaucagaacucagcaucca

SEQ ID NO: 532935 - RNA, 19 nt, Homo sapiens
guaccagaacuucagcaaa

SEQ ID NO: 532936 - RNA, 19 nt, Homo sapiens
ggacaagcuguugcaauuc

SEQ ID NO: 532937 - RNA, 19 nt, Homo sapiens
ggaaggacaagcuguugca

SEQ ID NO: 532938 - RNA, 19 nt, Homo sapiens
cagagcuacucaacuuuua

SEQ ID NO: 532939 - RNA, 19 nt, Homo sapiens
uacagacaauagugcauga

SEQ ID NO: 532940 - RNA, 19 nt, Homo sapiens
gauuucagaguagagauuu

SEQ ID NO: 532941 - RNA, 19 nt, Homo sapiens
ccuaauugcuauuguuggu

SEQ ID NO: 532942 - RNA, 19 nt, Homo sapiens
gauuuaggauaagcuguca

SEQ ID NO: 532943 - RNA, 19 nt, Homo sapiens
agaaaggagccaaggcaaa

SEQ ID NO: 532944 - RNA, 19 nt, Homo sapiens
caaccaaaacaucucaaua

SEQ ID NO: 532945 - RNA, 19 nt, Homo sapiens
gcggauguacggaugauuc

SEQ ID NO: 532946 - RNA, 19 nt, Homo sapiens
acccaucgcugccuuccaa

SEQ ID NO: 532947 - RNA, 19 nt, Homo sapiens
gggcagaccaagaagaaag

SEQ ID NO: 532948 - RNA, 19 nt, Homo sapiens
gacggaugcgcaggauuua

SEQ ID NO: 532949 - RNA, 19 nt, Homo sapiens
acaagcuguugcaauucua

SEQ ID NO: 532950 - RNA, 19 nt, Homo sapiens
aguagagauuucuguguug

SEQ ID NO: 532951 - RNA, 19 nt, Homo sapiens
ugcgcaggauuuaggauaa

SEQ ID NO: 532952 - RNA, 19 nt, Homo sapiens
gagggaccuugagucagaa

SEQ ID NO: 532953 - RNA, 19 nt, Homo sapiens
uagggcagaccaagaagaa

SEQ ID NO: 532954 - RNA, 19 nt, Homo sapiens
gaaaaucuaccagcagaga

SEQ ID NO: 532955 - RNA, 19 nt, Homo sapiens
gauguacggaugauucagu

SEQ ID NO: 532956 - RNA, 19 nt, Homo sapiens
gacauggcacccacaagga

SEQ ID NO: 532957 - RNA, 19 nt, Homo sapiens
uguguugucuccuagaaag

SEQ ID NO: 532958 - RNA, 19 nt, Homo sapiens
guacaguuaacuuauagag

SEQ ID NO: 532959 - RNA, 19 nt, Homo sapiens
uaacaaaaccacuguccaa

SEQ ID NO: 532960 - RNA, 19 nt, Homo sapiens
gcgcaggauuuaggauaag

SEQ ID NO: 532961 - RNA, 19 nt, Homo sapiens
gggcaacuccagagagaag

SEQ ID NO: 532962 - RNA, 19 nt, Homo sapiens
gaaguagugaccagaacag

SEQ ID NO: 532963 - RNA, 19 nt, Homo sapiens
uauuucagcauccuuguug

SEQ ID NO: 532964 - RNA, 19 nt, Homo sapiens
gagccauauuuaacauucu

SEQ ID NO: 532965 - RNA, 19 nt, Homo sapiens
gguaacccggcuccuggua

SEQ ID NO: 532966 - RNA, 19 nt, Homo sapiens
gccuagggcagaccaagaa

SEQ ID NO: 532967 - RNA, 19 nt, Homo sapiens
cagaaauguugccagaaaa

SEQ ID NO: 532968 - RNA, 19 nt, Homo sapiens
caauagugcaugagagucu

SEQ ID NO: 532969 - RNA, 19 nt, Homo sapiens
ccacuguccaacacuggua

SEQ ID NO: 532970 - RNA, 19 nt, Homo sapiens
gcagaaaaccacagagaca

SEQ ID NO: 532971 - RNA, 19 nt, Homo sapiens
uacauaugaugaugccaau

SEQ ID NO: 532972 - RNA, 19 nt, Homo sapiens
cggaggaagccuacauaug

SEQ ID NO: 532973 - RNA, 19 nt, Homo sapiens
agaaagcauuacauguagu

SEQ ID NO: 532974 - RNA, 19 nt, Homo sapiens
gaaggacaagcuguugcaa

SEQ ID NO: 532975 - RNA, 19 nt, Homo sapiens
gugcaugagagucuagaga

SEQ ID NO: 532976 - RNA, 19 nt, Homo sapiens
cagacaauagugcaugaga

SEQ ID NO: 532977 - RNA, 19 nt, Homo sapiens
gcuuguacaguuaacuuau

SEQ ID NO: 532978 - RNA, 19 nt, Homo sapiens
ccacaaggaaggacaagcu

SEQ ID NO: 532979 - RNA, 19 nt, Homo sapiens
gggaaaagacaguuacuca

SEQ ID NO: 532980 - RNA, 19 nt, Homo sapiens
gggaaccggauuacgugaa

SEQ ID NO: 532981 - RNA, 19 nt, Homo sapiens
gaccagaacagggcagagu

SEQ ID NO: 532982 - RNA, 19 nt, Homo sapiens
aauagugcaugagagucua

SEQ ID NO: 532983 - RNA, 19 nt, Homo sapiens
ccuagaaagcauuacaugu

SEQ ID NO: 532984 - RNA, 19 nt, Homo sapiens
agagauuucuguguugucu

SEQ ID NO: 532985 - RNA, 19 nt, Homo sapiens
ggaccauuucccagagcua

SEQ ID NO: 532986 - RNA, 19 nt, Homo sapiens
gcauuuaucuccauguuaa

SEQ ID NO: 532987 - RNA, 19 nt, Homo sapiens
caacaacaguuucugaauu

SEQ ID NO: 532988 - RNA, 19 nt, Homo sapiens
gaugaugccuucuguugaa

SEQ ID NO: 532989 - RNA, 19 nt, Homo sapiens
gaagaugccacaauuaaga

SEQ ID NO: 532990 - RNA, 19 nt, Homo sapiens
caaguuccgucaugucuuu

SEQ ID NO: 532991 - RNA, 19 nt, Homo sapiens
ggaaagaacacaguagaaa

SEQ ID NO: 532992 - RNA, 19 nt, Homo sapiens
caucuuugcuggacucuuu

SEQ ID NO: 532993 - RNA, 19 nt, Homo sapiens
gacaaccacuauuucuaua

SEQ ID NO: 532994 - RNA, 19 nt, Homo sapiens
ggacaaccacuauuucuau

SEQ ID NO: 532995 - RNA, 19 nt, Homo sapiens
gagcccaucuccaugauug

SEQ ID NO: 532996 - RNA, 19 nt, Homo sapiens
gcagagagaccuaucuuca

SEQ ID NO: 532997 - RNA, 19 nt, Homo sapiens
ugagcuaccugacugagua

SEQ ID NO: 532998 - RNA, 19 nt, Homo sapiens
ggacauauacccuccaaca

SEQ ID NO: 532999 - RNA, 19 nt, Homo sapiens
aaaccuggcugacaaaugg

SEQ ID NO: 533000 - RNA, 19 nt, Homo sapiens
ucaaggacaaccacuauuu

SEQ ID NO: 533001 - RNA, 19 nt, Homo sapiens
agagagaccuaucuucaau

SEQ ID NO: 533002 - RNA, 19 nt, Homo sapiens
ucuggaaccuggauacaaa

SEQ ID NO: 533003 - RNA, 19 nt, Homo sapiens
aacaacaguuucugaauug

SEQ ID NO: 533004 - RNA, 19 nt, Homo sapiens
gcaagauucggguuauuga

SEQ ID NO: 533005 - RNA, 19 nt, Homo sapiens
gaugugauccucuccaugu

SEQ ID NO: 533006 - RNA, 19 nt, Homo sapiens
caccaaagacagagaauga

SEQ ID NO: 533007 - RNA, 19 nt, Homo sapiens
gcaaagaccgcaagauucg

SEQ ID NO: 533008 - RNA, 19 nt, Homo sapiens
gauuagcugucaccaagau

SEQ ID NO: 533009 - RNA, 19 nt, Homo sapiens
gaggaaagaacacaguaga

SEQ ID NO: 533010 - RNA, 19 nt, Homo sapiens
aaagcuggcugcagaagau

SEQ ID NO: 533011 - RNA, 19 nt, Homo sapiens
aaaggagucugucaucaca

SEQ ID NO: 533012 - RNA, 19 nt, Homo sapiens
aaacugugguccagagaau

SEQ ID NO: 533013 - RNA, 19 nt, Homo sapiens
gaaaccccaucucuacuaa

SEQ ID NO: 533014 - RNA, 19 nt, Homo sapiens
gaaagaacacaguagaaaa

SEQ ID NO: 533015 - RNA, 19 nt, Homo sapiens
gcaacaacaguuucugaau

SEQ ID NO: 533016 - RNA, 19 nt, Homo sapiens
agaaugaguugcugcagau

SEQ ID NO: 533017 - RNA, 19 nt, Homo sapiens
gcuggcacuugaaauuuga

SEQ ID NO: 533018 - RNA, 19 nt, Homo sapiens
agagaccuaucuucaauuc

SEQ ID NO: 533019 - RNA, 19 nt, Homo sapiens
ggaccaggauaaccucucu

SEQ ID NO: 533020 - RNA, 19 nt, Homo sapiens
cugaagaugccacaauuaa

SEQ ID NO: 533021 - RNA, 19 nt, Homo sapiens
acaaggugaugaucuggaa

SEQ ID NO: 533022 - RNA, 19 nt, Homo sapiens
gggcacagaggcaacguuu

SEQ ID NO: 533023 - RNA, 19 nt, Homo sapiens
gcucuugaaucagacagaa

SEQ ID NO: 533024 - RNA, 19 nt, Homo sapiens
caaagacagagaaugaguu

SEQ ID NO: 533025 - RNA, 19 nt, Homo sapiens
gagaucgccuccuguucug

SEQ ID NO: 533026 - RNA, 19 nt, Homo sapiens
gcacagaggcaacguuuug

SEQ ID NO: 533027 - RNA, 19 nt, Homo sapiens
gaugccuucuguugaauuc

SEQ ID NO: 533028 - RNA, 19 nt, Homo sapiens
ggaucggugucaugccaaa

SEQ ID NO: 533029 - RNA, 19 nt, Homo sapiens
cugaguaccgcuccuauaa

SEQ ID NO: 533030 - RNA, 19 nt, Homo sapiens
cugcaaagaccgcaagauu

SEQ ID NO: 533031 - RNA, 19 nt, Homo sapiens
ggacaccacucggcuccau

SEQ ID NO: 533032 - RNA, 19 nt, Homo sapiens
ccaggaggccagcuacaaa

SEQ ID NO: 533033 - RNA, 19 nt, Homo sapiens
caauuaagaucuggagcau

SEQ ID NO: 533034 - RNA, 19 nt, Homo sapiens
ccacuucauugcaguugug

SEQ ID NO: 533035 - RNA, 19 nt, Homo sapiens
gcacuugaaauuugagaag

SEQ ID NO: 533036 - RNA, 19 nt, Homo sapiens
caaggacaaccacuauuuc

SEQ ID NO: 533037 - RNA, 19 nt, Homo sapiens
gcugcuggcacuugaaauu

SEQ ID NO: 533038 - RNA, 19 nt, Homo sapiens
acaaaggagucugucauca

SEQ ID NO: 533039 - RNA, 19 nt, Homo sapiens
gcaaggagaacugcuacga

SEQ ID NO: 533040 - RNA, 19 nt, Homo sapiens
gagaccagccugaccaaca

SEQ ID NO: 533041 - RNA, 19 nt, Homo sapiens
cagccuggacaaacaauuu

SEQ ID NO: 533042 - RNA, 19 nt, Homo sapiens
agaccuaucuucaauucca

SEQ ID NO: 533043 - RNA, 19 nt, Homo sapiens
gcagucagaauccuaccaa

SEQ ID NO: 533044 - RNA, 19 nt, Homo sapiens
gaccgcaagauucggguua

SEQ ID NO: 533045 - RNA, 19 nt, Homo sapiens
ugaguacgauuagcuguca

SEQ ID NO: 533046 - RNA, 19 nt, Homo sapiens
gagcagaggcauuuaucuc

SEQ ID NO: 533047 - RNA, 19 nt, Homo sapiens
gcucacgccuguaauucca

SEQ ID NO: 533048 - RNA, 19 nt, Homo sapiens
cuggaaggaucuagguuga

SEQ ID NO: 533049 - RNA, 19 nt, Homo sapiens
ucuacaagcugaucacaac

SEQ ID NO: 533050 - RNA, 19 nt, Homo sapiens
agucuggccuccugccuuu

SEQ ID NO: 533051 - RNA, 19 nt, Homo sapiens
aaagacagagaaugaguug

SEQ ID NO: 533052 - RNA, 19 nt, Homo sapiens
gagagaccuaucuucaauu

SEQ ID NO: 533053 - RNA, 19 nt, Homo sapiens
uuaacaagcagaugucaug

SEQ ID NO: 533054 - RNA, 19 nt, Homo sapiens
uguaacuucucaagaggaa

SEQ ID NO: 533055 - RNA, 19 nt, Homo sapiens
cuccaucgcugaaagagau

SEQ ID NO: 533056 - RNA, 19 nt, Homo sapiens
gguccaggccaaacaguug

SEQ ID NO: 533057 - RNA, 19 nt, Homo sapiens
guugaccugucugugauuu

SEQ ID NO: 533058 - RNA, 19 nt, Homo sapiens
gagcuguaacuucucaaga

SEQ ID NO: 533059 - RNA, 19 nt, Homo sapiens
cagagagaccuaucuucaa

SEQ ID NO: 533060 - RNA, 19 nt, Homo sapiens
ccaauccuggugucccuua

SEQ ID NO: 533061 - RNA, 19 nt, Homo sapiens
gaucgccuccuguucugaa

SEQ ID NO: 533062 - RNA, 19 nt, Homo sapiens
ggcauuuaucuccauguua

SEQ ID NO: 533063 - RNA, 19 nt, Homo sapiens
ccacuucugugccgugaac

SEQ ID NO: 533064 - RNA, 19 nt, Homo sapiens
gcuccaaguuccgucaugu

SEQ ID NO: 533065 - RNA, 19 nt, Homo sapiens
gaacacaguagaaaacuag

SEQ ID NO: 533066 - RNA, 19 nt, Homo sapiens
gaucuuccgcuucuacaag

SEQ ID NO: 533067 - RNA, 19 nt, Homo sapiens
gaguaccgcuccuauaacc

SEQ ID NO: 533068 - RNA, 19 nt, Homo sapiens
ccucuucagugcuggcuau

SEQ ID NO: 533069 - RNA, 19 nt, Homo sapiens
augaugagcuguaacuucu

SEQ ID NO: 533070 - RNA, 19 nt, Homo sapiens
aacacaggcuggaggagaa

SEQ ID NO: 533071 - RNA, 19 nt, Homo sapiens
ucugaagaugccacaauua

SEQ ID NO: 533072 - RNA, 19 nt, Homo sapiens
ggaacccuuuugaugauuu

SEQ ID NO: 533073 - RNA, 19 nt, Homo sapiens
gcaccagacagggaaguug

SEQ ID NO: 533074 - RNA, 19 nt, Homo sapiens
gcaaaccagccagcaagga

SEQ ID NO: 533075 - RNA, 19 nt, Homo sapiens
agaccagccugaccaacau

SEQ ID NO: 533076 - RNA, 19 nt, Homo sapiens
caugaugagcuguaacuuc

SEQ ID NO: 533077 - RNA, 19 nt, Homo sapiens
uauuaagggcccaugauga

SEQ ID NO: 533078 - RNA, 19 nt, Homo sapiens
ccaaagacagagaaugagu

SEQ ID NO: 533079 - RNA, 19 nt, Homo sapiens
gaggagaagaugccaaggu

SEQ ID NO: 533080 - RNA, 19 nt, Homo sapiens
gaucacgaggucagcaguu

SEQ ID NO: 533081 - RNA, 19 nt, Homo sapiens
caagaggaaagaacacagu

SEQ ID NO: 533082 - RNA, 19 nt, Homo sapiens
caggggcacugacaucuuu

SEQ ID NO: 533083 - RNA, 19 nt, Homo sapiens
ccucaaggacaaccacuau

SEQ ID NO: 533084 - RNA, 19 nt, Homo sapiens
aagaaaaccuggcugacaa

SEQ ID NO: 533085 - RNA, 19 nt, Homo sapiens
gaagaaaaccuggcugaca

SEQ ID NO: 533086 - RNA, 19 nt, Homo sapiens
caacaacaguuucugaauu

SEQ ID NO: 533087 - RNA, 19 nt, Homo sapiens
gaugaugccuucuguugaa

SEQ ID NO: 533088 - RNA, 19 nt, Homo sapiens
gaagaugccacaauuaaga

SEQ ID NO: 533089 - RNA, 19 nt, Homo sapiens
caaguuccgucaugucuuu

SEQ ID NO: 533090 - RNA, 19 nt, Homo sapiens
ggaaagaacacaguagaaa

SEQ ID NO: 533091 - RNA, 19 nt, Homo sapiens
gacaaccacuauuucuaua

SEQ ID NO: 533092 - RNA, 19 nt, Homo sapiens
ggacaaccacuauuucuau

SEQ ID NO: 533093 - RNA, 19 nt, Homo sapiens
gagcccaucuccaugauug

SEQ ID NO: 533094 - RNA, 19 nt, Homo sapiens
gcagagagaccuaucuuca

SEQ ID NO: 533095 - RNA, 19 nt, Homo sapiens
ugagcuaccugacugagua

SEQ ID NO: 533096 - RNA, 19 nt, Homo sapiens
ggacauauacccuccaaca

SEQ ID NO: 533097 - RNA, 19 nt, Homo sapiens
aaaccuggcugacaaaugg

SEQ ID NO: 533098 - RNA, 19 nt, Homo sapiens
ucaaggacaaccacuauuu

SEQ ID NO: 533099 - RNA, 19 nt, Homo sapiens
agagagaccuaucuucaau

SEQ ID NO: 533100 - RNA, 19 nt, Homo sapiens
ucuggaaccuggauacaaa

SEQ ID NO: 533101 - RNA, 19 nt, Homo sapiens
aacaacaguuucugaauug

SEQ ID NO: 533102 - RNA, 19 nt, Homo sapiens
gcaagauucggguuauuga

SEQ ID NO: 533103 - RNA, 19 nt, Homo sapiens
gaugugauccucuccaugu

SEQ ID NO: 533104 - RNA, 19 nt, Homo sapiens
caccaaagacagagaauga

SEQ ID NO: 533105 - RNA, 19 nt, Homo sapiens
gcaaagaccgcaagauucg

SEQ ID NO: 533106 - RNA, 19 nt, Homo sapiens
gauuagcugucaccaagau

SEQ ID NO: 533107 - RNA, 19 nt, Homo sapiens
gaggaaagaacacaguaga

SEQ ID NO: 533108 - RNA, 19 nt, Homo sapiens
aaagcuggcugcagaagau

SEQ ID NO: 533109 - RNA, 19 nt, Homo sapiens
aaaggagucugucaucaca

SEQ ID NO: 533110 - RNA, 19 nt, Homo sapiens
aaacugugguccagagaau

SEQ ID NO: 533111 - RNA, 19 nt, Homo sapiens
gaaaccccaucucuacuaa

SEQ ID NO: 533112 - RNA, 19 nt, Homo sapiens
gaaagaacacaguagaaaa

SEQ ID NO: 533113 - RNA, 19 nt, Homo sapiens
gcaacaacaguuucugaau

SEQ ID NO: 533114 - RNA, 19 nt, Homo sapiens
agaaugaguugcugcagau

SEQ ID NO: 533115 - RNA, 19 nt, Homo sapiens
agagaccuaucuucaauuc

SEQ ID NO: 533116 - RNA, 19 nt, Homo sapiens
ggaccaggauaaccucucu

SEQ ID NO: 533117 - RNA, 19 nt, Homo sapiens
cugaagaugccacaauuaa

SEQ ID NO: 533118 - RNA, 19 nt, Homo sapiens
ggucagaauccuaccaaga

SEQ ID NO: 533119 - RNA, 19 nt, Homo sapiens
acaaggugaugaucuggaa

SEQ ID NO: 533120 - RNA, 19 nt, Homo sapiens
gggcacagaggcaacguuu

SEQ ID NO: 533121 - RNA, 19 nt, Homo sapiens
gcucuugaaucagacagaa

SEQ ID NO: 533122 - RNA, 19 nt, Homo sapiens
caaagacagagaaugaguu

SEQ ID NO: 533123 - RNA, 19 nt, Homo sapiens
gagaucgccuccuguucug

SEQ ID NO: 533124 - RNA, 19 nt, Homo sapiens
gcacagaggcaacguuuug

SEQ ID NO: 533125 - RNA, 19 nt, Homo sapiens
gaugccuucuguugaauuc

SEQ ID NO: 533126 - RNA, 19 nt, Homo sapiens
ggaucggugucaugccaaa

SEQ ID NO: 533127 - RNA, 19 nt, Homo sapiens
cugaguaccgcuccuauaa

SEQ ID NO: 533128 - RNA, 19 nt, Homo sapiens
cugcaaagaccgcaagauu

SEQ ID NO: 533129 - RNA, 19 nt, Homo sapiens
ggacaccacucggcuccau

SEQ ID NO: 533130 - RNA, 19 nt, Homo sapiens
ccaggaggccagcuacaaa

SEQ ID NO: 533131 - RNA, 19 nt, Homo sapiens
caauuaagaucuggagcau

SEQ ID NO: 533132 - RNA, 19 nt, Homo sapiens
ccacuucauugcaguugug

SEQ ID NO: 533133 - RNA, 19 nt, Homo sapiens
caaggacaaccacuauuuc

SEQ ID NO: 533134 - RNA, 19 nt, Homo sapiens
gcaaggagaacugcuacga

SEQ ID NO: 533135 - RNA, 19 nt, Homo sapiens
acaaaggagucugucauca

SEQ ID NO: 533136 - RNA, 19 nt, Homo sapiens
gagaccagccugaccaaca

SEQ ID NO: 533137 - RNA, 19 nt, Homo sapiens
agaccuaucuucaauucca

SEQ ID NO: 533138 - RNA, 19 nt, Homo sapiens
gaccgcaagauucggguua

SEQ ID NO: 533139 - RNA, 19 nt, Homo sapiens
ugaguacgauuagcuguca

SEQ ID NO: 533140 - RNA, 19 nt, Homo sapiens
gcucacgccuguaauucca

SEQ ID NO: 533141 - RNA, 19 nt, Homo sapiens
cuggaaggaucuagguuga

SEQ ID NO: 533142 - RNA, 19 nt, Homo sapiens
ucuacaagcugaucacaac

SEQ ID NO: 533143 - RNA, 19 nt, Homo sapiens
aaagacagagaaugaguug

SEQ ID NO: 533144 - RNA, 19 nt, Homo sapiens
gagagaccuaucuucaauu

SEQ ID NO: 533145 - RNA, 19 nt, Homo sapiens
uguaacuucucaagaggaa

SEQ ID NO: 533146 - RNA, 19 nt, Homo sapiens
cuccaucgcugaaagagau

SEQ ID NO: 533147 - RNA, 19 nt, Homo sapiens
gguccaggccaaacaguug

SEQ ID NO: 533148 - RNA, 19 nt, Homo sapiens
guugaccugucugugauuu

SEQ ID NO: 533149 - RNA, 19 nt, Homo sapiens
gagcuguaacuucucaaga

SEQ ID NO: 533150 - RNA, 19 nt, Homo sapiens
cagagagaccuaucuucaa

SEQ ID NO: 533151 - RNA, 19 nt, Homo sapiens
ccaauccuggugucccuua

SEQ ID NO: 533152 - RNA, 19 nt, Homo sapiens
gaucgccuccuguucugaa

SEQ ID NO: 533153 - RNA, 19 nt, Homo sapiens
gcuccaaguuccgucaugu

SEQ ID NO: 533154 - RNA, 19 nt, Homo sapiens
ccacuucugugccgugaac

SEQ ID NO: 533155 - RNA, 19 nt, Homo sapiens
gaacacaguagaaaacuag

SEQ ID NO: 533156 - RNA, 19 nt, Homo sapiens
gaucuuccgcuucuacaag

SEQ ID NO: 533157 - RNA, 19 nt, Homo sapiens
gaguaccgcuccuauaacc

SEQ ID NO: 533158 - RNA, 19 nt, Homo sapiens
ccucuucagugcuggcuau

SEQ ID NO: 533159 - RNA, 19 nt, Homo sapiens
ggaacccuuuugaugauuu

SEQ ID NO: 533160 - RNA, 19 nt, Homo sapiens
augaugagcuguaacuucu

SEQ ID NO: 533161 - RNA, 19 nt, Homo sapiens
gcaccagacagggaaguug

SEQ ID NO: 533162 - RNA, 19 nt, Homo sapiens
aacacaggcuggaggagaa

SEQ ID NO: 533163 - RNA, 19 nt, Homo sapiens
gcaaaccagccagcaagga

SEQ ID NO: 533164 - RNA, 19 nt, Homo sapiens
ucugaagaugccacaauua

SEQ ID NO: 533165 - RNA, 19 nt, Homo sapiens
agaccagccugaccaacau

SEQ ID NO: 533166 - RNA, 19 nt, Homo sapiens
caugaugagcuguaacuuc

SEQ ID NO: 533167 - RNA, 19 nt, Homo sapiens
uauuaagggcccaugauga

SEQ ID NO: 533168 - RNA, 19 nt, Homo sapiens
ccaaagacagagaaugagu

SEQ ID NO: 533169 - RNA, 19 nt, Homo sapiens
gaggagaagaugccaaggu

SEQ ID NO: 533170 - RNA, 19 nt, Homo sapiens
gaucacgaggucagcaguu

SEQ ID NO: 533171 - RNA, 19 nt, Homo sapiens
caagaggaaagaacacagu

SEQ ID NO: 533172 - RNA, 19 nt, Homo sapiens
ccucaaggacaaccacuau

SEQ ID NO: 533173 - RNA, 19 nt, Homo sapiens
aagaaaaccuggcugacaa

SEQ ID NO: 533174 - RNA, 19 nt, Homo sapiens
gaagaaaaccuggcugaca

SEQ ID NO: 533175 - RNA, 19 nt, Homo sapiens
gaacccuuuugaugauuuu

SEQ ID NO: 533176 - RNA, 19 nt, Homo sapiens
caaacugugguccagagaa

SEQ ID NO: 533177 - RNA, 19 nt, Homo sapiens
ugagaucgccuccuguucu

SEQ ID NO: 533178 - RNA, 19 nt, Homo sapiens
ccgcaagauucggguuauu

SEQ ID NO: 533179 - RNA, 19 nt, Homo sapiens
ggcccaugaugagcuguaa

SEQ ID NO: 533180 - RNA, 19 nt, Homo sapiens
ggaugaaucgagacccaau

SEQ ID NO: 533181 - RNA, 19 nt, Homo sapiens
ucacgacaaccacuucugu

SEQ ID NO: 533182 - RNA, 19 nt, Homo sapiens
acaagcugaucacaaccaa

SEQ ID NO: 533183 - RNA, 19 nt, Homo sapiens
uaacuucucaagaggaaag

SEQ ID NO: 533184 - RNA, 19 nt, Homo sapiens
acaacaguuucugaauuga

SEQ ID NO: 533185 - RNA, 19 nt, Homo sapiens
cuaccaagaggacauauac

SEQ ID NO: 533186 - RNA, 19 nt, Homo sapiens
guacauagcuguuugaaau

SEQ ID NO: 533187 - RNA, 19 nt, Homo sapiens
gguauugccuugugaauuu

SEQ ID NO: 533188 - RNA, 19 nt, Homo sapiens
ggagaucaauggcaugaaa

SEQ ID NO: 533189 - RNA, 19 nt, Homo sapiens
ggaaugcuguauuaaugua

SEQ ID NO: 533190 - RNA, 19 nt, Homo sapiens
gcagaacaauuacgaauag

SEQ ID NO: 533191 - RNA, 19 nt, Homo sapiens
gguaaagcauucaguauug

SEQ ID NO: 533192 - RNA, 19 nt, Homo sapiens
gcagaacgcuuugagagaa

SEQ ID NO: 533193 - RNA, 19 nt, Homo sapiens
aauagaacaucucgacuua

SEQ ID NO: 533194 - RNA, 19 nt, Homo sapiens
gcuguaaacuuguagcauu

SEQ ID NO: 533195 - RNA, 19 nt, Homo sapiens
uagaacaucucgacuuauu

SEQ ID NO: 533196 - RNA, 19 nt, Homo sapiens
aaagagugcagaacaauua

SEQ ID NO: 533197 - RNA, 19 nt, Homo sapiens
gaucauaugcuuauacaga

SEQ ID NO: 533198 - RNA, 19 nt, Homo sapiens
guacucaagggcuuuauua

SEQ ID NO: 533199 - RNA, 19 nt, Homo sapiens
gaagaugaucauaugcuua

SEQ ID NO: 533200 - RNA, 19 nt, Homo sapiens
ggccgaggcuugagguaua

SEQ ID NO: 533201 - RNA, 19 nt, Homo sapiens
ggacagcauucucauguag

SEQ ID NO: 533202 - RNA, 19 nt, Homo sapiens
gaaagagaacguauuggaa

SEQ ID NO: 533203 - RNA, 19 nt, Homo sapiens
aaucggcucuggagaauuu

SEQ ID NO: 533204 - RNA, 19 nt, Homo sapiens
gaaacaagaccugcuaaga

SEQ ID NO: 533205 - RNA, 19 nt, Homo sapiens
ggcagaagaugaucauaug

SEQ ID NO: 533206 - RNA, 19 nt, Homo sapiens
ugaaauguauagcugcuuu

SEQ ID NO: 533207 - RNA, 19 nt, Homo sapiens
gaauuagacuuguauaucc

SEQ ID NO: 533208 - RNA, 19 nt, Homo sapiens
gacauacccucccuuugaa

SEQ ID NO: 533209 - RNA, 19 nt, Homo sapiens
gaaagagugcagaacaauu

SEQ ID NO: 533210 - RNA, 19 nt, Homo sapiens
gcacuugucuuugacuugu

SEQ ID NO: 533211 - RNA, 19 nt, Homo sapiens
caucuaaucuuaccagucu

SEQ ID NO: 533212 - RNA, 19 nt, Homo sapiens
auuaugagcuugaagauga

SEQ ID NO: 533213 - RNA, 19 nt, Homo sapiens
guagaaagagaacguauug

SEQ ID NO: 533214 - RNA, 19 nt, Homo sapiens
agacauacccucccuuuga

SEQ ID NO: 533215 - RNA, 19 nt, Homo sapiens
gcuguugcauuguaauaaa

SEQ ID NO: 533216 - RNA, 19 nt, Homo sapiens
ccaagaauuuacagaguug

SEQ ID NO: 533217 - RNA, 19 nt, Homo sapiens
guaguucucucuucaugga

SEQ ID NO: 533218 - RNA, 19 nt, Homo sapiens
caacugugcugcuguuucu

SEQ ID NO: 533219 - RNA, 19 nt, Homo sapiens
cuacucagccuucaaugua

SEQ ID NO: 533220 - RNA, 19 nt, Homo sapiens
gaagagggcgauagucguu

SEQ ID NO: 533221 - RNA, 19 nt, Homo sapiens
gaaccucaaucccaaaugc

SEQ ID NO: 533222 - RNA, 19 nt, Homo sapiens
aauaugaagucccgguaua

SEQ ID NO: 533223 - RNA, 19 nt, Homo sapiens
guugaaagcuguauuuuga

SEQ ID NO: 533224 - RNA, 19 nt, Homo sapiens
agaauccaguuugcaauua

SEQ ID NO: 533225 - RNA, 19 nt, Homo sapiens
ggagaauuauacccaucua

SEQ ID NO: 533226 - RNA, 19 nt, Homo sapiens
gaucuccaguccacaaguu

SEQ ID NO: 533227 - RNA, 19 nt, Homo sapiens
cuucugacauuccaaguuu

SEQ ID NO: 533228 - RNA, 19 nt, Homo sapiens
ccuuuggaaugcuguauua

SEQ ID NO: 533229 - RNA, 19 nt, Homo sapiens
ucaauggcaugaaaucaga

SEQ ID NO: 533230 - RNA, 19 nt, Homo sapiens
aacaagaccugcuaagaga

SEQ ID NO: 533231 - RNA, 19 nt, Homo sapiens
caucucgacuuauuggaaa

SEQ ID NO: 533232 - RNA, 19 nt, Homo sapiens
gaacaucucgacuuauugg

SEQ ID NO: 533233 - RNA, 19 nt, Homo sapiens
gugauuagccauuugacua

SEQ ID NO: 533234 - RNA, 19 nt, Homo sapiens
gauagaauccaguuugcaa

SEQ ID NO: 533235 - RNA, 19 nt, Homo sapiens
uagaaagagugcagaacaa

SEQ ID NO: 533236 - RNA, 19 nt, Homo sapiens
cacaagugcuuucccaaga

SEQ ID NO: 533237 - RNA, 19 nt, Homo sapiens
ugucuuugcuguaaacuug

SEQ ID NO: 533238 - RNA, 19 nt, Homo sapiens
guguguccaucuuauauuu

SEQ ID NO: 533239 - RNA, 19 nt, Homo sapiens
gaagcuagguugaaaucac

SEQ ID NO: 533240 - RNA, 19 nt, Homo sapiens
cuguaaacuuguagcauua

SEQ ID NO: 533241 - RNA, 19 nt, Homo sapiens
agaggaagcuagguugaaa

SEQ ID NO: 533242 - RNA, 19 nt, Homo sapiens
gaauuuacagaguugcuaa

SEQ ID NO: 533243 - RNA, 19 nt, Homo sapiens
cgacagacuccucaaguga

SEQ ID NO: 533244 - RNA, 19 nt, Homo sapiens
gcuaaaagacucauuacua

SEQ ID NO: 533245 - RNA, 19 nt, Homo sapiens
gaugaaacaagaccugcua

SEQ ID NO: 533246 - RNA, 19 nt, Homo sapiens
caauggcacugguaaagca

SEQ ID NO: 533247 - RNA, 19 nt, Homo sapiens
gggcagaagaugaucauau

SEQ ID NO: 533248 - RNA, 19 nt, Homo sapiens
ucauguaguucgauauuuc

SEQ ID NO: 533249 - RNA, 19 nt, Homo sapiens
gaggcuggauggaugcauu

SEQ ID NO: 533250 - RNA, 19 nt, Homo sapiens
gaagcuagugcauuggaaa

SEQ ID NO: 533251 - RNA, 19 nt, Homo sapiens
auacugagcuacuccuuuc

SEQ ID NO: 533252 - RNA, 19 nt, Homo sapiens
acuacagaaucaugaguua

SEQ ID NO: 533253 - RNA, 19 nt, Homo sapiens
guauuuaagugugugaaga

SEQ ID NO: 533254 - RNA, 19 nt, Homo sapiens
gggcaacugugcugcuguu

SEQ ID NO: 533255 - RNA, 19 nt, Homo sapiens
gaaaaucggcucuggagaa

SEQ ID NO: 533256 - RNA, 19 nt, Homo sapiens
gcgacagacuccucaagug

SEQ ID NO: 533257 - RNA, 19 nt, Homo sapiens
ucaagggcuuuauuacaga

SEQ ID NO: 533258 - RNA, 19 nt, Homo sapiens
gaaccucuuccgagaaaug

SEQ ID NO: 533259 - RNA, 19 nt, Homo sapiens
aggcuuucaucuaaucuua

SEQ ID NO: 533260 - RNA, 19 nt, Homo sapiens
gaauccaguuugcaauuac

SEQ ID NO: 533261 - RNA, 19 nt, Homo sapiens
caagugcuuucccaagaau

SEQ ID NO: 533262 - RNA, 19 nt, Homo sapiens
caaaugcugccucugaaga

SEQ ID NO: 533263 - RNA, 19 nt, Homo sapiens
ggcuugagguauauucauu

SEQ ID NO: 533264 - RNA, 19 nt, Homo sapiens
ggacucggccuuucaagag

SEQ ID NO: 533265 - RNA, 19 nt, Homo sapiens
gaaaugccagaaugacuuc

SEQ ID NO: 533266 - RNA, 19 nt, Homo sapiens
ccacugggagcacuuugua

SEQ ID NO: 533267 - RNA, 19 nt, Homo sapiens
gggcuuuauuacagacaua

SEQ ID NO: 533268 - RNA, 19 nt, Homo sapiens
auaguuugcuguugcauug

SEQ ID NO: 533269 - RNA, 19 nt, Homo sapiens
uaucugugauuagccauuu

SEQ ID NO: 533270 - RNA, 19 nt, Homo sapiens
ggagcacuuuguaggcauu

SEQ ID NO: 533271 - RNA, 19 nt, Homo sapiens
acaagugcuuucccaagaa

SEQ ID NO: 533272 - RNA, 19 nt, Homo sapiens
gaaaucagacaggguagau

SEQ ID NO: 533273 - RNA, 19 nt, Homo sapiens
agaaguauaugcucaugca

SEQ ID NO: 533274 - RNA, 19 nt, Homo sapiens
aaacaagaccugcuaagag

SEQ ID NO: 533275 - RNA, 19 nt, Homo sapiens
ggaagccagugauuaugag

SEQ ID NO: 533276 - RNA, 19 nt, Homo sapiens
cauggaagccagugauuau

SEQ ID NO: 533277 - RNA, 19 nt, Homo sapiens
aaagagaacguauuggaau

SEQ ID NO: 533278 - RNA, 19 nt, Homo sapiens
uuggaaugcuguauuaaug

SEQ ID NO: 533279 - RNA, 19 nt, Homo sapiens
cccaagaauuuacagaguu

SEQ ID NO: 533280 - RNA, 19 nt, Homo sapiens
cugaaccucuuccgagaaa

SEQ ID NO: 533281 - RNA, 19 nt, Homo sapiens
guaccuguguguccaucuu

SEQ ID NO: 533282 - RNA, 19 nt, Homo sapiens
gaaaagggacaugcuaaaa

SEQ ID NO: 533283 - RNA, 19 nt, Homo sapiens
ggugugcugcuuauaguuu

SEQ ID NO: 533284 - RNA, 19 nt, Homo sapiens
uaauagaacaucucgacuu

SEQ ID NO: 533285 - RNA, 19 nt, Homo sapiens
gcuguccgcuucuagaaag

SEQ ID NO: 533286 - RNA, 19 nt, Homo sapiens
caaauaagcaucuguguaa

SEQ ID NO: 533287 - RNA, 19 nt, Homo sapiens
gaggagcucugucgccuua

SEQ ID NO: 533288 - RNA, 19 nt, Homo sapiens
gcagagaccuugcgaccau

SEQ ID NO: 533289 - RNA, 19 nt, Homo sapiens
uggcacagcugaggaauuu

SEQ ID NO: 533290 - RNA, 19 nt, Homo sapiens
ucauggagaucaaggagua

SEQ ID NO: 533291 - RNA, 19 nt, Homo sapiens
ggaggucccugccaguguu

SEQ ID NO: 533292 - RNA, 19 nt, Homo sapiens
gcaugaaggucuacaacuc

SEQ ID NO: 533293 - RNA, 19 nt, Homo sapiens
gugaaggucuugccugaau

SEQ ID NO: 533294 - RNA, 19 nt, Homo sapiens
gcgcucaucuucuucuuca

SEQ ID NO: 533295 - RNA, 19 nt, Homo sapiens
uagaagagccugacugugu

SEQ ID NO: 533296 - RNA, 19 nt, Homo sapiens
ccaaauaagcaucugugua

SEQ ID NO: 533297 - RNA, 19 nt, Homo sapiens
gcacuuuacagaugagauu

SEQ ID NO: 533298 - RNA, 19 nt, Homo sapiens
gcaaguggccugucuucga

SEQ ID NO: 533299 - RNA, 19 nt, Homo sapiens
ccaagucccugcagaagca

SEQ ID NO: 533300 - RNA, 19 nt, Homo sapiens
uggcggagcugcuggagaa

SEQ ID NO: 533301 - RNA, 19 nt, Homo sapiens
cacaguagcauuucuuauu

SEQ ID NO: 533302 - RNA, 19 nt, Homo sapiens
ucaacgcgcucaucuucuu

SEQ ID NO: 533303 - RNA, 19 nt, Homo sapiens
ggagaucacuaagaaguac

SEQ ID NO: 533304 - RNA, 19 nt, Homo sapiens
gcagcgaguccaagaacua

SEQ ID NO: 533305 - RNA, 19 nt, Homo sapiens
ggaaauccccuuugaagaa

SEQ ID NO: 533306 - RNA, 19 nt, Homo sapiens
ggccgcagaucucccguuu

SEQ ID NO: 533307 - RNA, 19 nt, Homo sapiens
gucugaagguggucaagua

SEQ ID NO: 533308 - RNA, 19 nt, Homo sapiens
caucaggacuugggaaaca

SEQ ID NO: 533309 - RNA, 19 nt, Homo sapiens
gcacagcugaggaauuuca

SEQ ID NO: 533310 - RNA, 19 nt, Homo sapiens
aggcagcccuggucaugua

SEQ ID NO: 533311 - RNA, 19 nt, Homo sapiens
agaagagccugacuguguu

SEQ ID NO: 533312 - RNA, 19 nt, Homo sapiens
guagcucuguccacucuga

SEQ ID NO: 533313 - RNA, 19 nt, Homo sapiens
gcagguagugggugaaugu

SEQ ID NO: 533314 - RNA, 19 nt, Homo sapiens
cgacacggaugaagaacuc

SEQ ID NO: 533315 - RNA, 19 nt, Homo sapiens
ugaauuggcccuaccugaa

SEQ ID NO: 533316 - RNA, 19 nt, Homo sapiens
ugucaucaccggcuucuuu

SEQ ID NO: 533317 - RNA, 19 nt, Homo sapiens
caucaacgcgcucaucuuc

SEQ ID NO: 533318 - RNA, 19 nt, Homo sapiens
ggacuugggaaacagagaa

SEQ ID NO: 533319 - RNA, 19 nt, Homo sapiens
caguagcauuucuuauuug

SEQ ID NO: 533320 - RNA, 19 nt, Homo sapiens
ugacugacaucgacaacag

SEQ ID NO: 533321 - RNA, 19 nt, Homo sapiens
ccgcagaucucccguuugc

SEQ ID NO: 533322 - RNA, 19 nt, Homo sapiens
gcucuguccacucugaaua

SEQ ID NO: 533323 - RNA, 19 nt, Homo sapiens
gucuacaacuccacacuga

SEQ ID NO: 533324 - RNA, 19 nt, Homo sapiens
cagagggcaugaaggucua

SEQ ID NO: 533325 - RNA, 19 nt, Homo sapiens
gaauuggcccuaccugaag

SEQ ID NO: 533326 - RNA, 19 nt, Homo sapiens
gugaaugugugaaggucuu

SEQ ID NO: 533327 - RNA, 19 nt, Homo sapiens
ucaacaugcucccguucuu

SEQ ID NO: 533328 - RNA, 19 nt, Homo sapiens
gcaggacgacgaagaugau

SEQ ID NO: 533329 - RNA, 19 nt, Homo sapiens
guccugaguggcugaaaua

SEQ ID NO: 533330 - RNA, 19 nt, Homo sapiens
gagcuuccagugcauguug

SEQ ID NO: 533331 - RNA, 19 nt, Homo sapiens
gccaucagcugccucaacu

SEQ ID NO: 533332 - RNA, 19 nt, Homo sapiens
cagcagcgagugcagauug

SEQ ID NO: 533333 - RNA, 19 nt, Homo sapiens
gcucagagggcaugaaggu

SEQ ID NO: 533334 - RNA, 19 nt, Homo sapiens
cugaguggcugaaauaaaa

SEQ ID NO: 533335 - RNA, 19 nt, Homo sapiens
gguccugaguggcugaaau

SEQ ID NO: 533336 - RNA, 19 nt, Homo sapiens
ggucacugcuacaccuuag

SEQ ID NO: 533337 - RNA, 19 nt, Homo sapiens
agggaaggcugcuguguag

SEQ ID NO: 533338 - RNA, 19 nt, Homo sapiens
ggagcucugucgccuuaag

SEQ ID NO: 533339 - RNA, 19 nt, Homo sapiens
gagcaggagaggagcgaaa

SEQ ID NO: 533340 - RNA, 19 nt, Homo sapiens
ggagcccuaugcccauuuc

SEQ ID NO: 533341 - RNA, 19 nt, Homo sapiens
ucagcaaccucaccaucga

SEQ ID NO: 533342 - RNA, 19 nt, Homo sapiens
caaagggagacauggaaau

SEQ ID NO: 533343 - RNA, 19 nt, Homo sapiens
ccuguucccucuuucuuuc

SEQ ID NO: 533344 - RNA, 19 nt, Homo sapiens
uuguggagaucacuaagaa

SEQ ID NO: 533345 - RNA, 19 nt, Homo sapiens
caaggcagcccuggucaug

SEQ ID NO: 533346 - RNA, 19 nt, Homo sapiens
cuacuuccucuuccucuuu

SEQ ID NO: 533347 - RNA, 19 nt, Homo sapiens
gucaucaccggcuucuuua

SEQ ID NO: 533348 - RNA, 19 nt, Homo sapiens
caaccucaccaucgacuuc

SEQ ID NO: 533349 - RNA, 19 nt, Homo sapiens
cggagcugcuggagaaugu

SEQ ID NO: 533350 - RNA, 19 nt, Homo sapiens
gaugugcacggcagcuuga

SEQ ID NO: 533351 - RNA, 19 nt, Homo sapiens
gaccaaggccagcuucucu

SEQ ID NO: 533352 - RNA, 19 nt, Homo sapiens
gaagcacuaccugcaguug

SEQ ID NO: 533353 - RNA, 19 nt, Homo sapiens
aggaguaccugauugacau

SEQ ID NO: 533354 - RNA, 19 nt, Homo sapiens
ggaagcacuaccugcaguu

SEQ ID NO: 533355 - RNA, 19 nt, Homo sapiens
ucaagggcaccuacugcua

SEQ ID NO: 533356 - RNA, 19 nt, Homo sapiens
gcauggcacagcugaggaa

SEQ ID NO: 533357 - RNA, 19 nt, Homo sapiens
gaccugccacugcgucuga

SEQ ID NO: 533358 - RNA, 19 nt, Homo sapiens
ggucaacgagcacgaugga

SEQ ID NO: 533359 - RNA, 19 nt, Homo sapiens
ucagugccuuggagcagaa

SEQ ID NO: 533360 - RNA, 19 nt, Homo sapiens
gaagagccugacuguguuc

SEQ ID NO: 533361 - RNA, 19 nt, Homo sapiens
gugcuuggcggacagaaga

SEQ ID NO: 533362 - RNA, 19 nt, Homo sapiens
uguccacucugaauaccaa

SEQ ID NO: 533363 - RNA, 19 nt, Homo sapiens
gcccacgugugcagacugu

SEQ ID NO: 533364 - RNA, 19 nt, Homo sapiens
gaaauccccuuugaagaag

SEQ ID NO: 533365 - RNA, 19 nt, Homo sapiens
ucccgugccugcucuaugu

SEQ ID NO: 533366 - RNA, 19 nt, Homo sapiens
cuacaaagggagacaugga

SEQ ID NO: 533367 - RNA, 19 nt, Homo sapiens
gcucaucuucuucuucauc

SEQ ID NO: 533368 - RNA, 19 nt, Homo sapiens
cugaauaccaaguguguug

SEQ ID NO: 533369 - RNA, 19 nt, Homo sapiens
guguagcucuguccacucu

SEQ ID NO: 533370 - RNA, 19 nt, Homo sapiens
gcuacuuccucuuccucuu

SEQ ID NO: 533371 - RNA, 19 nt, Homo sapiens
ccugcucucugucuucuuc

SEQ ID NO: 533372 - RNA, 19 nt, Homo sapiens
gcaaggccugggagaacuu

SEQ ID NO: 533373 - RNA, 19 nt, Homo sapiens
guggagaucacuaagaagu

SEQ ID NO: 533374 - RNA, 19 nt, Homo sapiens
ggaaggcugcuguguagcu

SEQ ID NO: 533375 - RNA, 19 nt, Homo sapiens
caacaugcucccguucuuc

SEQ ID NO: 533376 - RNA, 19 nt, Homo sapiens
acaaagggagacauggaaa

SEQ ID NO: 533377 - RNA, 19 nt, Homo sapiens
ccuccaugcccuugaauug

SEQ ID NO: 533378 - RNA, 19 nt, Homo sapiens
gcacccuguucccucuuuc

SEQ ID NO: 533379 - RNA, 19 nt, Homo sapiens
aagggaaggcugcugugua

SEQ ID NO: 533380 - RNA, 19 nt, Homo sapiens
ccugccacaucaagaaguu

SEQ ID NO: 533381 - RNA, 19 nt, Homo sapiens
uaccuggugugcuucaugu

SEQ ID NO: 533382 - RNA, 19 nt, Homo sapiens
ccugaguggcugaaauaaa

SEQ ID NO: 533383 - RNA, 19 nt, Homo sapiens
ccacaguagcauuucuuau

SEQ ID NO: 533384 - RNA, 19 nt, Homo sapiens
cgacuucuucgccuucuuc

SEQ ID NO: 533385 - RNA, 19 nt, Homo sapiens
ggacgacgaagaugaugac

SEQ ID NO: 533386 - RNA, 19 nt, Homo sapiens
agaaagagcuuggauauuu

SEQ ID NO: 533387 - RNA, 19 nt, Homo sapiens
agacauagaugaagcauuu

SEQ ID NO: 533388 - RNA, 19 nt, Homo sapiens
gaacuaccauuguaauaug

SEQ ID NO: 533389 - RNA, 19 nt, Homo sapiens
gaagaagacucugguaaug

SEQ ID NO: 533390 - RNA, 19 nt, Homo sapiens
gaaagagcuuggauauuug

SEQ ID NO: 533391 - RNA, 19 nt, Homo sapiens
gaggcaaaguguaguguua

SEQ ID NO: 533392 - RNA, 19 nt, Homo sapiens
gauccuaagucauguauau

SEQ ID NO: 533393 - RNA, 19 nt, Homo sapiens
gaacuacaguaaauguuug

SEQ ID NO: 533394 - RNA, 19 nt, Homo sapiens
ucauagagcuuuggaguuu

SEQ ID NO: 533395 - RNA, 19 nt, Homo sapiens
gaacccagcugcucuguac

SEQ ID NO: 533396 - RNA, 19 nt, Homo sapiens
uaauacaccuuccuacauu

SEQ ID NO: 533397 - RNA, 19 nt, Homo sapiens
ucacuugaguuguugcuua

SEQ ID NO: 533398 - RNA, 19 nt, Homo sapiens
gaaaggucauuuacaguuc

SEQ ID NO: 533399 - RNA, 19 nt, Homo sapiens
ggagcuuacugaaauauga

SEQ ID NO: 533400 - RNA, 19 nt, Homo sapiens
uaucgaaggcuuugauuua

SEQ ID NO: 533401 - RNA, 19 nt, Homo sapiens
agaagacucugguaaugua

SEQ ID NO: 533402 - RNA, 19 nt, Homo sapiens
gaaaaggcaguaagaauua

SEQ ID NO: 533403 - RNA, 19 nt, Homo sapiens
aagcagcucuugugucuaa

SEQ ID NO: 533404 - RNA, 19 nt, Homo sapiens
ugaaacaucuaggagcuua

SEQ ID NO: 533405 - RNA, 19 nt, Homo sapiens
gguccaaagugucggguua

SEQ ID NO: 533406 - RNA, 19 nt, Homo sapiens
gaagagugcauucccauga

SEQ ID NO: 533407 - RNA, 19 nt, Homo sapiens
gagcuuggauauuugagaa

SEQ ID NO: 533408 - RNA, 19 nt, Homo sapiens
guaaugcucagacuucaua

SEQ ID NO: 533409 - RNA, 19 nt, Homo sapiens
gacaaacagugcacuaugu

SEQ ID NO: 533410 - RNA, 19 nt, Homo sapiens
ggaagccucucuuugaauc

SEQ ID NO: 533411 - RNA, 19 nt, Homo sapiens
guaaagugcauaaagauga

SEQ ID NO: 533412 - RNA, 19 nt, Homo sapiens
uaauaugacuccuguguuc

SEQ ID NO: 533413 - RNA, 19 nt, Homo sapiens
ggcacgagcugucugcuuu

SEQ ID NO: 533414 - RNA, 19 nt, Homo sapiens
ggcaaaguguaguguuaua

SEQ ID NO: 533415 - RNA, 19 nt, Homo sapiens
ucuaggagcuuacugaaau

SEQ ID NO: 533416 - RNA, 19 nt, Homo sapiens
cagaguacaugauagcaaa

SEQ ID NO: 533417 - RNA, 19 nt, Homo sapiens
ggaggaagccaaagauuuc

SEQ ID NO: 533418 - RNA, 19 nt, Homo sapiens
aagaccaccuguugaaaua

SEQ ID NO: 533419 - RNA, 19 nt, Homo sapiens
gaugugugauaaucuguuu

SEQ ID NO: 533420 - RNA, 19 nt, Homo sapiens
gacaagauuucgccauguu

SEQ ID NO: 533421 - RNA, 19 nt, Homo sapiens
aaauggcucuccagaaauu

SEQ ID NO: 533422 - RNA, 19 nt, Homo sapiens
guuauucacuugaguuguu

SEQ ID NO: 533423 - RNA, 19 nt, Homo sapiens
ggagaaggacaguuugaaa

SEQ ID NO: 533424 - RNA, 19 nt, Homo sapiens
agaagagccucguagcuuu

SEQ ID NO: 533425 - RNA, 19 nt, Homo sapiens
cgaagcagcucuugugucu

SEQ ID NO: 533426 - RNA, 19 nt, Homo sapiens
gcacuuagaaugauguaau

SEQ ID NO: 533427 - RNA, 19 nt, Homo sapiens
caugagaauugcuguuuga

SEQ ID NO: 533428 - RNA, 19 nt, Homo sapiens
agucagaacuaccauugua

SEQ ID NO: 533429 - RNA, 19 nt, Homo sapiens
guuguaaagugcauaaaga

SEQ ID NO: 533430 - RNA, 19 nt, Homo sapiens
uauggaagaugugugauaa

SEQ ID NO: 533431 - RNA, 19 nt, Homo sapiens
ucuaagaucucaaguccuu

SEQ ID NO: 533432 - RNA, 19 nt, Homo sapiens
gacaaaggccugugaagga

SEQ ID NO: 533433 - RNA, 19 nt, Homo sapiens
cagauauacuucagucuug

SEQ ID NO: 533434 - RNA, 19 nt, Homo sapiens
agacaaagaccaccuguug

SEQ ID NO: 533435 - RNA, 19 nt, Homo sapiens
gcccuugccucauguuuga

SEQ ID NO: 533436 - RNA, 19 nt, Homo sapiens
uaggucauguuguaguuua

SEQ ID NO: 533437 - RNA, 19 nt, Homo sapiens
gauaaaucuuccauuagug

SEQ ID NO: 533438 - RNA, 19 nt, Homo sapiens
caguugagcugacauauac

SEQ ID NO: 533439 - RNA, 19 nt, Homo sapiens
gcaguuucauaguucuuaa

SEQ ID NO: 533440 - RNA, 19 nt, Homo sapiens
uaacugagaaugagguaaa

SEQ ID NO: 533441 - RNA, 19 nt, Homo sapiens
caaguucaccuuucucuau

SEQ ID NO: 533442 - RNA, 19 nt, Homo sapiens
uguaagaguucacauggaa

SEQ ID NO: 533443 - RNA, 19 nt, Homo sapiens
ugaaggagaaggacaguuu

SEQ ID NO: 533444 - RNA, 19 nt, Homo sapiens
gagaagagccucguagcuu

SEQ ID NO: 533445 - RNA, 19 nt, Homo sapiens
ugucagaaguugauagguu

SEQ ID NO: 533446 - RNA, 19 nt, Homo sapiens
ggacaaacagugcacuaug

SEQ ID NO: 533447 - RNA, 19 nt, Homo sapiens
ugacagugcugcugaugug

SEQ ID NO: 533448 - RNA, 19 nt, Homo sapiens
gcaaaguguaguguuauaa

SEQ ID NO: 533449 - RNA, 19 nt, Homo sapiens
cauuguaacaugacacuua

SEQ ID NO: 533450 - RNA, 19 nt, Homo sapiens
acacagggaugagguggua

SEQ ID NO: 533451 - RNA, 19 nt, Homo sapiens
ccagaaagagcuuggauau

SEQ ID NO: 533452 - RNA, 19 nt, Homo sapiens
cacuuuaggucauguugua

SEQ ID NO: 533453 - RNA, 19 nt, Homo sapiens
gcaguuguccugaccuuga

SEQ ID NO: 533454 - RNA, 19 nt, Homo sapiens
gaagagagacacaaucacu

SEQ ID NO: 533455 - RNA, 19 nt, Homo sapiens
guacugcacuuagaaugau

SEQ ID NO: 533456 - RNA, 19 nt, Homo sapiens
gcucuguacugcacuuaga

SEQ ID NO: 533457 - RNA, 19 nt, Homo sapiens
acugguaacucuuaacuga

SEQ ID NO: 533458 - RNA, 19 nt, Homo sapiens
ucacagcuauaccaaacuu

SEQ ID NO: 533459 - RNA, 19 nt, Homo sapiens
auacaacguuggugauuug

SEQ ID NO: 533460 - RNA, 19 nt, Homo sapiens
ggaagaggagcauaaaaua

SEQ ID NO: 533461 - RNA, 19 nt, Homo sapiens
ggaagcaucugggcuggau

SEQ ID NO: 533462 - RNA, 19 nt, Homo sapiens
ucucaaguccuucagauaa

SEQ ID NO: 533463 - RNA, 19 nt, Homo sapiens
gaaguugauagguuguuaa

SEQ ID NO: 533464 - RNA, 19 nt, Homo sapiens
gauuuagaguaaugcauga

SEQ ID NO: 533465 - RNA, 19 nt, Homo sapiens
uaacaugacacuuagacuu

SEQ ID NO: 533466 - RNA, 19 nt, Homo sapiens
gcagagagcacgcuacaac

SEQ ID NO: 533467 - RNA, 19 nt, Homo sapiens
gggaagaguacuccucaaa

SEQ ID NO: 533468 - RNA, 19 nt, Homo sapiens
cagagacccuggagaguca

SEQ ID NO: 533469 - RNA, 19 nt, Homo sapiens
gggcauuguucaagcagaa

SEQ ID NO: 533470 - RNA, 19 nt, Homo sapiens
acaaaggccugugaaggaa

SEQ ID NO: 533471 - RNA, 19 nt, Homo sapiens
ccaaagugcugggauuaca

SEQ ID NO: 533472 - RNA, 19 nt, Homo sapiens
agaaguugauagguuguua

SEQ ID NO: 533473 - RNA, 19 nt, Homo sapiens
ugaaaggucauuuacaguu

SEQ ID NO: 533474 - RNA, 19 nt, Homo sapiens
gaaauacaacguuggugau

SEQ ID NO: 533475 - RNA, 19 nt, Homo sapiens
gaagcaggcaccagaaauc

SEQ ID NO: 533476 - RNA, 19 nt, Homo sapiens
ugacauuucuaucacaauc

SEQ ID NO: 533477 - RNA, 19 nt, Homo sapiens
caccgugccuguccuagaa

SEQ ID NO: 533478 - RNA, 19 nt, Homo sapiens
acaugacacuuagacuuua

SEQ ID NO: 533479 - RNA, 19 nt, Homo sapiens
gcauguaaaccacugaaga

SEQ ID NO: 533480 - RNA, 19 nt, Homo sapiens
gagacacaaucacugacaa

SEQ ID NO: 533481 - RNA, 19 nt, Homo sapiens
cuaggagcuuacugaaaua

SEQ ID NO: 533482 - RNA, 19 nt, Homo sapiens
caaauagccacagaacgua

SEQ ID NO: 533483 - RNA, 19 nt, Homo sapiens
gaagaguacuccucaaaag

SEQ ID NO: 533484 - RNA, 19 nt, Homo sapiens
gggaccagcuucaucucaa

SEQ ID NO: 533485 - RNA, 19 nt, Homo sapiens
acaaagaccaccuguugaa

SEQ ID NO: 533486 - RNA, 19 nt, Homo sapiens
gcucagaacugcaauuuaa

SEQ ID NO: 533487 - RNA, 19 nt, Homo sapiens
ggaaacuacucucgauuua

SEQ ID NO: 533488 - RNA, 19 nt, Homo sapiens
agaaagagcuuggauauuu

SEQ ID NO: 533489 - RNA, 19 nt, Homo sapiens
ggagggauauacugaaaua

SEQ ID NO: 533490 - RNA, 19 nt, Homo sapiens
gaagaggaguugcuugauu

SEQ ID NO: 533491 - RNA, 19 nt, Homo sapiens
guaagauucuccuguauuu

SEQ ID NO: 533492 - RNA, 19 nt, Homo sapiens
gaagaagacucugguaaug

SEQ ID NO: 533493 - RNA, 19 nt, Homo sapiens
ggacggagcugacuuuuaa

SEQ ID NO: 533494 - RNA, 19 nt, Homo sapiens
ggaaagcuguguuuggaaa

SEQ ID NO: 533495 - RNA, 19 nt, Homo sapiens
gggagcagauauuaacuua

SEQ ID NO: 533496 - RNA, 19 nt, Homo sapiens
gaaagagcuuggauauuug

SEQ ID NO: 533497 - RNA, 19 nt, Homo sapiens
guacuaaugugaauuguuc

SEQ ID NO: 533498 - RNA, 19 nt, Homo sapiens
gcacgugggucuaaagaga

SEQ ID NO: 533499 - RNA, 19 nt, Homo sapiens
ggacaguagugaaaucuug

SEQ ID NO: 533500 - RNA, 19 nt, Homo sapiens
gagaauuuguuaacgagua

SEQ ID NO: 533501 - RNA, 19 nt, Homo sapiens
gaucauuacucugcucuuu

SEQ ID NO: 533502 - RNA, 19 nt, Homo sapiens
cgacugaaguguguguuua

SEQ ID NO: 533503 - RNA, 19 nt, Homo sapiens
aaacuacucucgauuuaug

SEQ ID NO: 533504 - RNA, 19 nt, Homo sapiens
agacaaggaccguauaaua

SEQ ID NO: 533505 - RNA, 19 nt, Homo sapiens
agaagacucugguaaugua

SEQ ID NO: 533506 - RNA, 19 nt, Homo sapiens
ucaccagguuugauaguua

SEQ ID NO: 533507 - RNA, 19 nt, Homo sapiens
aagcagcucuugugucuaa

SEQ ID NO: 533508 - RNA, 19 nt, Homo sapiens
gcacgagauuggagaauuc

SEQ ID NO: 533509 - RNA, 19 nt, Homo sapiens
gguccaaagugucggguua

SEQ ID NO: 533510 - RNA, 19 nt, Homo sapiens
gcagagaaguuuacagaac

SEQ ID NO: 533511 - RNA, 19 nt, Homo sapiens
gaagagugcauucccauga

SEQ ID NO: 533512 - RNA, 19 nt, Homo sapiens
gagcuuggauauuugagaa

SEQ ID NO: 533513 - RNA, 19 nt, Homo sapiens
cuaguaagauucuccugua

SEQ ID NO: 533514 - RNA, 19 nt, Homo sapiens
cgacgacccuuucaucaga

SEQ ID NO: 533515 - RNA, 19 nt, Homo sapiens
ccaugaggcuugugugaaa

SEQ ID NO: 533516 - RNA, 19 nt, Homo sapiens
ggaagccucucuuugaauc

SEQ ID NO: 533517 - RNA, 19 nt, Homo sapiens
guaaagugcauaaagauga

SEQ ID NO: 533518 - RNA, 19 nt, Homo sapiens
cuucaauccuccaucauua

SEQ ID NO: 533519 - RNA, 19 nt, Homo sapiens
guuaagcgcugugugguaa

SEQ ID NO: 533520 - RNA, 19 nt, Homo sapiens
guaaagagagcaagacaga

SEQ ID NO: 533521 - RNA, 19 nt, Homo sapiens
ggcacgagcugucugcuuu

SEQ ID NO: 533522 - RNA, 19 nt, Homo sapiens
ugaaguguguguuuacuga

SEQ ID NO: 533523 - RNA, 19 nt, Homo sapiens
ccaauaacacguccacuuu

SEQ ID NO: 533524 - RNA, 19 nt, Homo sapiens
aagaccaccuguugaaaua

SEQ ID NO: 533525 - RNA, 19 nt, Homo sapiens
cagaguggcuuccaucuca

SEQ ID NO: 533526 - RNA, 19 nt, Homo sapiens
caucagaaagggagaauuu

SEQ ID NO: 533527 - RNA, 19 nt, Homo sapiens
aagaggaguugcuugauuu

SEQ ID NO: 533528 - RNA, 19 nt, Homo sapiens
gacaagauuucgccauguu

SEQ ID NO: 533529 - RNA, 19 nt, Homo sapiens
aaauggcucuccagaaauu

SEQ ID NO: 533530 - RNA, 19 nt, Homo sapiens
agaccuaucuaucugagua

SEQ ID NO: 533531 - RNA, 19 nt, Homo sapiens
ggagaaggacaguuugaaa

SEQ ID NO: 533532 - RNA, 19 nt, Homo sapiens
agaagagccucguagcuuu

SEQ ID NO: 533533 - RNA, 19 nt, Homo sapiens
cgaagcagcucuugugucu

SEQ ID NO: 533534 - RNA, 19 nt, Homo sapiens
gauggaagaugcagucucu

SEQ ID NO: 533535 - RNA, 19 nt, Homo sapiens
gagaaugcuuggacuagug

SEQ ID NO: 533536 - RNA, 19 nt, Homo sapiens
guuguaaagugcauaaaga

SEQ ID NO: 533537 - RNA, 19 nt, Homo sapiens
gaguagugcuuuccaguuc

SEQ ID NO: 533538 - RNA, 19 nt, Homo sapiens
ucuaagaucucaaguccuu

SEQ ID NO: 533539 - RNA, 19 nt, Homo sapiens
uaccaaugcuuacgucaaa

SEQ ID NO: 533540 - RNA, 19 nt, Homo sapiens
ugagaauccuuguggcuuu

SEQ ID NO: 533541 - RNA, 19 nt, Homo sapiens
agacaaagaccaccuguug

SEQ ID NO: 533542 - RNA, 19 nt, Homo sapiens
gcccuugccucauguuuga

SEQ ID NO: 533543 - RNA, 19 nt, Homo sapiens
ggaaaauuguguaugagua

SEQ ID NO: 533544 - RNA, 19 nt, Homo sapiens
uggaucggcucauagauuu

SEQ ID NO: 533545 - RNA, 19 nt, Homo sapiens
gacaaggaccguauaauag

SEQ ID NO: 533546 - RNA, 19 nt, Homo sapiens
gaaagggagaauuuguuaa

SEQ ID NO: 533547 - RNA, 19 nt, Homo sapiens
caaguucaccuuucucuau

SEQ ID NO: 533548 - RNA, 19 nt, Homo sapiens
agaaagggagaauuuguua

SEQ ID NO: 533549 - RNA, 19 nt, Homo sapiens
gagggaagcccgagaaaca

SEQ ID NO: 533550 - RNA, 19 nt, Homo sapiens
ugaaggagaaggacaguuu

SEQ ID NO: 533551 - RNA, 19 nt, Homo sapiens
gagaagagccucguagcuu

SEQ ID NO: 533552 - RNA, 19 nt, Homo sapiens
ugaggcuccuguuaaauuu

SEQ ID NO: 533553 - RNA, 19 nt, Homo sapiens
aagcugcacuuccaggaua

SEQ ID NO: 533554 - RNA, 19 nt, Homo sapiens
ugacagugcugcugaugug

SEQ ID NO: 533555 - RNA, 19 nt, Homo sapiens
acacagggaugagguggua

SEQ ID NO: 533556 - RNA, 19 nt, Homo sapiens
ccagaaagagcuuggauau

SEQ ID NO: 533557 - RNA, 19 nt, Homo sapiens
gaguguaguugaugacugu

SEQ ID NO: 533558 - RNA, 19 nt, Homo sapiens
cuacaauacccguugauaa

SEQ ID NO: 533559 - RNA, 19 nt, Homo sapiens
acaggaugcugauguuuga

SEQ ID NO: 533560 - RNA, 19 nt, Homo sapiens
gcacuuccaggauaucauu

SEQ ID NO: 533561 - RNA, 19 nt, Homo sapiens
gaagagagacacaaucacu

SEQ ID NO: 533562 - RNA, 19 nt, Homo sapiens
cagcaaaguuaacuacaca

SEQ ID NO: 533563 - RNA, 19 nt, Homo sapiens
gggugaaacuugggaacua

SEQ ID NO: 533564 - RNA, 19 nt, Homo sapiens
ucacagcuauaccaaacuu

SEQ ID NO: 533565 - RNA, 19 nt, Homo sapiens
auacaacguuggugauuug

SEQ ID NO: 533566 - RNA, 19 nt, Homo sapiens
acugguaacucuuaacuga

SEQ ID NO: 533567 - RNA, 19 nt, Homo sapiens
ggaagaggagcauaaaaua

SEQ ID NO: 533568 - RNA, 19 nt, Homo sapiens
ggaagcaucugggcuggau

SEQ ID NO: 533569 - RNA, 19 nt, Homo sapiens
gguuugauaguuagacuua

SEQ ID NO: 533570 - RNA, 19 nt, Homo sapiens
gugaauuguuccucagaaa

SEQ ID NO: 533571 - RNA, 19 nt, Homo sapiens
ggauaucauuugggugaaa

SEQ ID NO: 533572 - RNA, 19 nt, Homo sapiens
caucugcacugcccacuuc

SEQ ID NO: 533573 - RNA, 19 nt, Homo sapiens
ucucaaguccuucagauaa

SEQ ID NO: 533574 - RNA, 19 nt, Homo sapiens
ugaaugaaaugccaauaac

SEQ ID NO: 533575 - RNA, 19 nt, Homo sapiens
aaaguuaauuggcauaugg

SEQ ID NO: 533576 - RNA, 19 nt, Homo sapiens
gcaaaccuucgacuucauu

SEQ ID NO: 533577 - RNA, 19 nt, Homo sapiens
aaaggaaacuacucucgau

SEQ ID NO: 533578 - RNA, 19 nt, Homo sapiens
gcagagagcacgcuacaac

SEQ ID NO: 533579 - RNA, 19 nt, Homo sapiens
gggaagaguacuccucaaa

SEQ ID NO: 533580 - RNA, 19 nt, Homo sapiens
cagagacccuggagaguca

SEQ ID NO: 533581 - RNA, 19 nt, Homo sapiens
gggcauuguucaagcagaa

SEQ ID NO: 533582 - RNA, 19 nt, Homo sapiens
guugaugacuguuuguuag

SEQ ID NO: 533583 - RNA, 19 nt, Homo sapiens
gauuuaugcuccuuaugau

SEQ ID NO: 533584 - RNA, 19 nt, Homo sapiens
ccucgaaacugccauugug

SEQ ID NO: 533585 - RNA, 19 nt, Homo sapiens
gcucagcguuccuggacaa

SEQ ID NO: 533586 - RNA, 19 nt, Homo sapiens
ggaaacuacucucgauuua

SEQ ID NO: 533587 - RNA, 19 nt, Homo sapiens
agaaagagcuuggauauuu

SEQ ID NO: 533588 - RNA, 19 nt, Homo sapiens
ggagggauauacugaaaua

SEQ ID NO: 533589 - RNA, 19 nt, Homo sapiens
gaagaagacucugguaaug

SEQ ID NO: 533590 - RNA, 19 nt, Homo sapiens
ggacggagcugacuuuuaa

SEQ ID NO: 533591 - RNA, 19 nt, Homo sapiens
ggaaagcuguguuuggaaa

SEQ ID NO: 533592 - RNA, 19 nt, Homo sapiens
gggagcagauauuaacuua

SEQ ID NO: 533593 - RNA, 19 nt, Homo sapiens
gaaagagcuuggauauuug

SEQ ID NO: 533594 - RNA, 19 nt, Homo sapiens
guacuaaugugaauuguuc

SEQ ID NO: 533595 - RNA, 19 nt, Homo sapiens
gcacgugggucuaaagaga

SEQ ID NO: 533596 - RNA, 19 nt, Homo sapiens
ggacaguagugaaaucuug

SEQ ID NO: 533597 - RNA, 19 nt, Homo sapiens
gagaauuuguuaacgagua

SEQ ID NO: 533598 - RNA, 19 nt, Homo sapiens
gaucauuacucugcucuuu

SEQ ID NO: 533599 - RNA, 19 nt, Homo sapiens
cgacugaaguguguguuua

SEQ ID NO: 533600 - RNA, 19 nt, Homo sapiens
aaacuacucucgauuuaug

SEQ ID NO: 533601 - RNA, 19 nt, Homo sapiens
agacaaggaccguauaaua

SEQ ID NO: 533602 - RNA, 19 nt, Homo sapiens
agaagacucugguaaugua

SEQ ID NO: 533603 - RNA, 19 nt, Homo sapiens
ucaccagguuugauaguua

SEQ ID NO: 533604 - RNA, 19 nt, Homo sapiens
aagcagcucuugugucuaa

SEQ ID NO: 533605 - RNA, 19 nt, Homo sapiens
gcacgagauuggagaauuc

SEQ ID NO: 533606 - RNA, 19 nt, Homo sapiens
gguccaaagugucggguua

SEQ ID NO: 533607 - RNA, 19 nt, Homo sapiens
gcagagaaguuuacagaac

SEQ ID NO: 533608 - RNA, 19 nt, Homo sapiens
gaagagugcauucccauga

SEQ ID NO: 533609 - RNA, 19 nt, Homo sapiens
gagcuuggauauuugagaa

SEQ ID NO: 533610 - RNA, 19 nt, Homo sapiens
cgacgacccuuucaucaga

SEQ ID NO: 533611 - RNA, 19 nt, Homo sapiens
ccaugaggcuugugugaaa

SEQ ID NO: 533612 - RNA, 19 nt, Homo sapiens
ggaagccucucuuugaauc

SEQ ID NO: 533613 - RNA, 19 nt, Homo sapiens
guaaagugcauaaagauga

SEQ ID NO: 533614 - RNA, 19 nt, Homo sapiens
cuucaauccuccaucauua

SEQ ID NO: 533615 - RNA, 19 nt, Homo sapiens
guuaagcgcugugugguaa

SEQ ID NO: 533616 - RNA, 19 nt, Homo sapiens
guaaagagagcaagacaga

SEQ ID NO: 533617 - RNA, 19 nt, Homo sapiens
ggcacgagcugucugcuuu

SEQ ID NO: 533618 - RNA, 19 nt, Homo sapiens
ugaaguguguguuuacuga

SEQ ID NO: 533619 - RNA, 19 nt, Homo sapiens
ccaauaacacguccacuuu

SEQ ID NO: 533620 - RNA, 19 nt, Homo sapiens
aagaccaccuguugaaaua

SEQ ID NO: 533621 - RNA, 19 nt, Homo sapiens
cagaguggcuuccaucuca

SEQ ID NO: 533622 - RNA, 19 nt, Homo sapiens
caucagaaagggagaauuu

SEQ ID NO: 533623 - RNA, 19 nt, Homo sapiens
gacaagauuucgccauguu

SEQ ID NO: 533624 - RNA, 19 nt, Homo sapiens
aaauggcucuccagaaauu

SEQ ID NO: 533625 - RNA, 19 nt, Homo sapiens
agaccuaucuaucugagua

SEQ ID NO: 533626 - RNA, 19 nt, Homo sapiens
ggagaaggacaguuugaaa

SEQ ID NO: 533627 - RNA, 19 nt, Homo sapiens
agaagagccucguagcuuu

SEQ ID NO: 533628 - RNA, 19 nt, Homo sapiens
cgaagcagcucuugugucu

SEQ ID NO: 533629 - RNA, 19 nt, Homo sapiens
gauggaagaugcagucucu

SEQ ID NO: 533630 - RNA, 19 nt, Homo sapiens
guuguaaagugcauaaaga

SEQ ID NO: 533631 - RNA, 19 nt, Homo sapiens
gaguagugcuuuccaguuc

SEQ ID NO: 533632 - RNA, 19 nt, Homo sapiens
ucuaagaucucaaguccuu

SEQ ID NO: 533633 - RNA, 19 nt, Homo sapiens
uaccaaugcuuacgucaaa

SEQ ID NO: 533634 - RNA, 19 nt, Homo sapiens
ugagaauccuuguggcuuu

SEQ ID NO: 533635 - RNA, 19 nt, Homo sapiens
agacaaagaccaccuguug

SEQ ID NO: 533636 - RNA, 19 nt, Homo sapiens
gcccuugccucauguuuga

SEQ ID NO: 533637 - RNA, 19 nt, Homo sapiens
ggaaaauuguguaugagua

SEQ ID NO: 533638 - RNA, 19 nt, Homo sapiens
uggaucggcucauagauuu

SEQ ID NO: 533639 - RNA, 19 nt, Homo sapiens
gacaaggaccguauaauag

SEQ ID NO: 533640 - RNA, 19 nt, Homo sapiens
gaaagggagaauuuguuaa

SEQ ID NO: 533641 - RNA, 19 nt, Homo sapiens
caaguucaccuuucucuau

SEQ ID NO: 533642 - RNA, 19 nt, Homo sapiens
agaaagggagaauuuguua

SEQ ID NO: 533643 - RNA, 19 nt, Homo sapiens
gagggaagcccgagaaaca

SEQ ID NO: 533644 - RNA, 19 nt, Homo sapiens
ugaaggagaaggacaguuu

SEQ ID NO: 533645 - RNA, 19 nt, Homo sapiens
gagaagagccucguagcuu

SEQ ID NO: 533646 - RNA, 19 nt, Homo sapiens
ugaggcuccuguuaaauuu

SEQ ID NO: 533647 - RNA, 19 nt, Homo sapiens
aagcugcacuuccaggaua

SEQ ID NO: 533648 - RNA, 19 nt, Homo sapiens
ugacagugcugcugaugug

SEQ ID NO: 533649 - RNA, 19 nt, Homo sapiens
acacagggaugagguggua

SEQ ID NO: 533650 - RNA, 19 nt, Homo sapiens
ccagaaagagcuuggauau

SEQ ID NO: 533651 - RNA, 19 nt, Homo sapiens
gaguguaguugaugacugu

SEQ ID NO: 533652 - RNA, 19 nt, Homo sapiens
cuacaauacccguugauaa

SEQ ID NO: 533653 - RNA, 19 nt, Homo sapiens
acaggaugcugauguuuga

SEQ ID NO: 533654 - RNA, 19 nt, Homo sapiens
gcacuuccaggauaucauu

SEQ ID NO: 533655 - RNA, 19 nt, Homo sapiens
gaagagagacacaaucacu

SEQ ID NO: 533656 - RNA, 19 nt, Homo sapiens
cagcaaaguuaacuacaca

SEQ ID NO: 533657 - RNA, 19 nt, Homo sapiens
acugguaacucuuaacuga

SEQ ID NO: 533658 - RNA, 19 nt, Homo sapiens
gggugaaacuugggaacua

SEQ ID NO: 533659 - RNA, 19 nt, Homo sapiens
ccucagggauucacucaug

SEQ ID NO: 533660 - RNA, 19 nt, Homo sapiens
ucacagcuauaccaaacuu

SEQ ID NO: 533661 - RNA, 19 nt, Homo sapiens
auacaacguuggugauuug

SEQ ID NO: 533662 - RNA, 19 nt, Homo sapiens
ggaagaggagcauaaaaua

SEQ ID NO: 533663 - RNA, 19 nt, Homo sapiens
ggaagcaucugggcuggau

SEQ ID NO: 533664 - RNA, 19 nt, Homo sapiens
gguuugauaguuagacuua

SEQ ID NO: 533665 - RNA, 19 nt, Homo sapiens
gugaauuguuccucagaaa

SEQ ID NO: 533666 - RNA, 19 nt, Homo sapiens
ggauaucauuugggugaaa

SEQ ID NO: 533667 - RNA, 19 nt, Homo sapiens
caucugcacugcccacuuc

SEQ ID NO: 533668 - RNA, 19 nt, Homo sapiens
ucucaaguccuucagauaa

SEQ ID NO: 533669 - RNA, 19 nt, Homo sapiens
ugaaugaaaugccaauaac

SEQ ID NO: 533670 - RNA, 19 nt, Homo sapiens
aaaguuaauuggcauaugg

SEQ ID NO: 533671 - RNA, 19 nt, Homo sapiens
gcaaaccuucgacuucauu

SEQ ID NO: 533672 - RNA, 19 nt, Homo sapiens
aaaggaaacuacucucgau

SEQ ID NO: 533673 - RNA, 19 nt, Homo sapiens
gcagagagcacgcuacaac

SEQ ID NO: 533674 - RNA, 19 nt, Homo sapiens
gggaagaguacuccucaaa

SEQ ID NO: 533675 - RNA, 19 nt, Homo sapiens
cagagacccuggagaguca

SEQ ID NO: 533676 - RNA, 19 nt, Homo sapiens
gggcauuguucaagcagaa

SEQ ID NO: 533677 - RNA, 19 nt, Homo sapiens
guugaugacuguuuguuag

SEQ ID NO: 533678 - RNA, 19 nt, Homo sapiens
ccaaagugcugggauuaca

SEQ ID NO: 533679 - RNA, 19 nt, Homo sapiens
gauuuaugcuccuuaugau

SEQ ID NO: 533680 - RNA, 19 nt, Homo sapiens
ccucgaaacugccauugug

SEQ ID NO: 533681 - RNA, 19 nt, Homo sapiens
gcucagcguuccuggacaa

SEQ ID NO: 533682 - RNA, 19 nt, Homo sapiens
ucacucauguuucgugugu

SEQ ID NO: 533683 - RNA, 19 nt, Homo sapiens
cgaaacacaaacugaagua

SEQ ID NO: 533684 - RNA, 19 nt, Homo sapiens
gaaauacaacguuggugau

SEQ ID NO: 533685 - RNA, 19 nt, Homo sapiens
gaagcaggcaccagaaauc

SEQ ID NO: 533686 - RNA, 19 nt, Homo sapiens
ggaaacuacucucgauuua

SEQ ID NO: 533687 - RNA, 19 nt, Homo sapiens
agaaagagcuuggauauuu

SEQ ID NO: 533688 - RNA, 19 nt, Homo sapiens
ggagggauauacugaaaua

SEQ ID NO: 533689 - RNA, 19 nt, Homo sapiens
gaagaagacucugguaaug

SEQ ID NO: 533690 - RNA, 19 nt, Homo sapiens
ggacggagcugacuuuuaa

SEQ ID NO: 533691 - RNA, 19 nt, Homo sapiens
ggaaagcuguguuuggaaa

SEQ ID NO: 533692 - RNA, 19 nt, Homo sapiens
gggagcagauauuaacuua

SEQ ID NO: 533693 - RNA, 19 nt, Homo sapiens
gaaagagcuuggauauuug

SEQ ID NO: 533694 - RNA, 19 nt, Homo sapiens
guacuaaugugaauuguuc

SEQ ID NO: 533695 - RNA, 19 nt, Homo sapiens
gcacgugggucuaaagaga

SEQ ID NO: 533696 - RNA, 19 nt, Homo sapiens
ggacaguagugaaaucuug

SEQ ID NO: 533697 - RNA, 19 nt, Homo sapiens
gagaauuuguuaacgagua

SEQ ID NO: 533698 - RNA, 19 nt, Homo sapiens
gaucauuacucugcucuuu

SEQ ID NO: 533699 - RNA, 19 nt, Homo sapiens
cgacugaaguguguguuua

SEQ ID NO: 533700 - RNA, 19 nt, Homo sapiens
aaacuacucucgauuuaug

SEQ ID NO: 533701 - RNA, 19 nt, Homo sapiens
agacaaggaccguauaaua

SEQ ID NO: 533702 - RNA, 19 nt, Homo sapiens
agaagacucugguaaugua

SEQ ID NO: 533703 - RNA, 19 nt, Homo sapiens
ucaccagguuugauaguua

SEQ ID NO: 533704 - RNA, 19 nt, Homo sapiens
aagcagcucuugugucuaa

SEQ ID NO: 533705 - RNA, 19 nt, Homo sapiens
gcacgagauuggagaauuc

SEQ ID NO: 533706 - RNA, 19 nt, Homo sapiens
gguccaaagugucggguua

SEQ ID NO: 533707 - RNA, 19 nt, Homo sapiens
gcagagaaguuuacagaac

SEQ ID NO: 533708 - RNA, 19 nt, Homo sapiens
gaagagugcauucccauga

SEQ ID NO: 533709 - RNA, 19 nt, Homo sapiens
gagcuuggauauuugagaa

SEQ ID NO: 533710 - RNA, 19 nt, Homo sapiens
cgacgacccuuucaucaga

SEQ ID NO: 533711 - RNA, 19 nt, Homo sapiens
ccaugaggcuugugugaaa

SEQ ID NO: 533712 - RNA, 19 nt, Homo sapiens
ggaagccucucuuugaauc

SEQ ID NO: 533713 - RNA, 19 nt, Homo sapiens
guaaagugcauaaagauga

SEQ ID NO: 533714 - RNA, 19 nt, Homo sapiens
cuucaauccuccaucauua

SEQ ID NO: 533715 - RNA, 19 nt, Homo sapiens
guuaagcgcugugugguaa

SEQ ID NO: 533716 - RNA, 19 nt, Homo sapiens
guaaagagagcaagacaga

SEQ ID NO: 533717 - RNA, 19 nt, Homo sapiens
ugaaguguguguuuacuga

SEQ ID NO: 533718 - RNA, 19 nt, Homo sapiens
ccaauaacacguccacuuu

SEQ ID NO: 533719 - RNA, 19 nt, Homo sapiens
aagaccaccuguugaaaua

SEQ ID NO: 533720 - RNA, 19 nt, Homo sapiens
cagaguggcuuccaucuca

SEQ ID NO: 533721 - RNA, 19 nt, Homo sapiens
caucagaaagggagaauuu

SEQ ID NO: 533722 - RNA, 19 nt, Homo sapiens
aaauggcucuccagaaauu

SEQ ID NO: 533723 - RNA, 19 nt, Homo sapiens
agaccuaucuaucugagua

SEQ ID NO: 533724 - RNA, 19 nt, Homo sapiens
ggagaaggacaguuugaaa

SEQ ID NO: 533725 - RNA, 19 nt, Homo sapiens
agaagagccucguagcuuu

SEQ ID NO: 533726 - RNA, 19 nt, Homo sapiens
cgaagcagcucuugugucu

SEQ ID NO: 533727 - RNA, 19 nt, Homo sapiens
gauggaagaugcagucucu

SEQ ID NO: 533728 - RNA, 19 nt, Homo sapiens
guuguaaagugcauaaaga

SEQ ID NO: 533729 - RNA, 19 nt, Homo sapiens
gaguagugcuuuccaguuc

SEQ ID NO: 533730 - RNA, 19 nt, Homo sapiens
ucuaagaucucaaguccuu

SEQ ID NO: 533731 - RNA, 19 nt, Homo sapiens
uaccaaugcuuacgucaaa

SEQ ID NO: 533732 - RNA, 19 nt, Homo sapiens
ugagaauccuuguggcuuu

SEQ ID NO: 533733 - RNA, 19 nt, Homo sapiens
agacaaagaccaccuguug

SEQ ID NO: 533734 - RNA, 19 nt, Homo sapiens
ggaaaauuguguaugagua

SEQ ID NO: 533735 - RNA, 19 nt, Homo sapiens
uggaucggcucauagauuu

SEQ ID NO: 533736 - RNA, 19 nt, Homo sapiens
gacaaggaccguauaauag

SEQ ID NO: 533737 - RNA, 19 nt, Homo sapiens
gaaagggagaauuuguuaa

SEQ ID NO: 533738 - RNA, 19 nt, Homo sapiens
caaguucaccuuucucuau

SEQ ID NO: 533739 - RNA, 19 nt, Homo sapiens
agaaagggagaauuuguua

SEQ ID NO: 533740 - RNA, 19 nt, Homo sapiens
gagggaagcccgagaaaca

SEQ ID NO: 533741 - RNA, 19 nt, Homo sapiens
ugaaggagaaggacaguuu

SEQ ID NO: 533742 - RNA, 19 nt, Homo sapiens
gagaagagccucguagcuu

SEQ ID NO: 533743 - RNA, 19 nt, Homo sapiens
ugaggcuccuguuaaauuu

SEQ ID NO: 533744 - RNA, 19 nt, Homo sapiens
aagcugcacuuccaggaua

SEQ ID NO: 533745 - RNA, 19 nt, Homo sapiens
ugacagugcugcugaugug

SEQ ID NO: 533746 - RNA, 19 nt, Homo sapiens
acacagggaugagguggua

SEQ ID NO: 533747 - RNA, 19 nt, Homo sapiens
ccagaaagagcuuggauau

SEQ ID NO: 533748 - RNA, 19 nt, Homo sapiens
gaguguaguugaugacugu

SEQ ID NO: 533749 - RNA, 19 nt, Homo sapiens
cuacaauacccguugauaa

SEQ ID NO: 533750 - RNA, 19 nt, Homo sapiens
acaggaugcugauguuuga

SEQ ID NO: 533751 - RNA, 19 nt, Homo sapiens
gcacuuccaggauaucauu

SEQ ID NO: 533752 - RNA, 19 nt, Homo sapiens
gaagagagacacaaucacu

SEQ ID NO: 533753 - RNA, 19 nt, Homo sapiens
cagcaaaguuaacuacaca

SEQ ID NO: 533754 - RNA, 19 nt, Homo sapiens
gggugaaacuugggaacua

SEQ ID NO: 533755 - RNA, 19 nt, Homo sapiens
ccucagggauucacucaug

SEQ ID NO: 533756 - RNA, 19 nt, Homo sapiens
ggaagcaucugggcuggau

SEQ ID NO: 533757 - RNA, 19 nt, Homo sapiens
ucacagcuauaccaaacuu

SEQ ID NO: 533758 - RNA, 19 nt, Homo sapiens
auacaacguuggugauuug

SEQ ID NO: 533759 - RNA, 19 nt, Homo sapiens
ggaagaggagcauaaaaua

SEQ ID NO: 533760 - RNA, 19 nt, Homo sapiens
gguuugauaguuagacuua

SEQ ID NO: 533761 - RNA, 19 nt, Homo sapiens
gugaauuguuccucagaaa

SEQ ID NO: 533762 - RNA, 19 nt, Homo sapiens
ggauaucauuugggugaaa

SEQ ID NO: 533763 - RNA, 19 nt, Homo sapiens
caucugcacugcccacuuc

SEQ ID NO: 533764 - RNA, 19 nt, Homo sapiens
ucucaaguccuucagauaa

SEQ ID NO: 533765 - RNA, 19 nt, Homo sapiens
ugaaugaaaugccaauaac

SEQ ID NO: 533766 - RNA, 19 nt, Homo sapiens
aaaguuaauuggcauaugg

SEQ ID NO: 533767 - RNA, 19 nt, Homo sapiens
gcaaaccuucgacuucauu

SEQ ID NO: 533768 - RNA, 19 nt, Homo sapiens
aaaggaaacuacucucgau

SEQ ID NO: 533769 - RNA, 19 nt, Homo sapiens
gcagagagcacgcuacaac

SEQ ID NO: 533770 - RNA, 19 nt, Homo sapiens
gggaagaguacuccucaaa

SEQ ID NO: 533771 - RNA, 19 nt, Homo sapiens
cagagacccuggagaguca

SEQ ID NO: 533772 - RNA, 19 nt, Homo sapiens
gggcauuguucaagcagaa

SEQ ID NO: 533773 - RNA, 19 nt, Homo sapiens
guugaugacuguuuguuag

SEQ ID NO: 533774 - RNA, 19 nt, Homo sapiens
gaagcaggcaccagaaauc

SEQ ID NO: 533775 - RNA, 19 nt, Homo sapiens
ccaaagugcugggauuaca

SEQ ID NO: 533776 - RNA, 19 nt, Homo sapiens
gauuuaugcuccuuaugau

SEQ ID NO: 533777 - RNA, 19 nt, Homo sapiens
ccucgaaacugccauugug

SEQ ID NO: 533778 - RNA, 19 nt, Homo sapiens
gcucagcguuccuggacaa

SEQ ID NO: 533779 - RNA, 19 nt, Homo sapiens
ucacucauguuucgugugu

SEQ ID NO: 533780 - RNA, 19 nt, Homo sapiens
cgaaacacaaacugaagua

SEQ ID NO: 533781 - RNA, 19 nt, Homo sapiens
gaaauacaacguuggugau

SEQ ID NO: 533782 - RNA, 19 nt, Homo sapiens
auacugaaauagagaguug

SEQ ID NO: 533783 - RNA, 19 nt, Homo sapiens
gggauauacugaaauagag

SEQ ID NO: 533784 - RNA, 19 nt, Homo sapiens
gacucuaacuucucccaaa

SEQ ID NO: 533785 - RNA, 19 nt, Homo sapiens
aaacugcagugucuuugga

SEQ ID NO: 533786 - RNA, 19 nt, Homo sapiens
ggaaacuacucucgauuua

SEQ ID NO: 533787 - RNA, 19 nt, Homo sapiens
agaaagagcuuggauauuu

SEQ ID NO: 533788 - RNA, 19 nt, Homo sapiens
ggagggauauacugaaaua

SEQ ID NO: 533789 - RNA, 19 nt, Homo sapiens
gaagaagacucugguaaug

SEQ ID NO: 533790 - RNA, 19 nt, Homo sapiens
ggacggagcugacuuuuaa

SEQ ID NO: 533791 - RNA, 19 nt, Homo sapiens
ggaaagcuguguuuggaaa

SEQ ID NO: 533792 - RNA, 19 nt, Homo sapiens
gggagcagauauuaacuua

SEQ ID NO: 533793 - RNA, 19 nt, Homo sapiens
gaaagagcuuggauauuug

SEQ ID NO: 533794 - RNA, 19 nt, Homo sapiens
guacuaaugugaauuguuc

SEQ ID NO: 533795 - RNA, 19 nt, Homo sapiens
gcacgugggucuaaagaga

SEQ ID NO: 533796 - RNA, 19 nt, Homo sapiens
ggacaguagugaaaucuug

SEQ ID NO: 533797 - RNA, 19 nt, Homo sapiens
gagaauuuguuaacgagua

SEQ ID NO: 533798 - RNA, 19 nt, Homo sapiens
gaucauuacucugcucuuu

SEQ ID NO: 533799 - RNA, 19 nt, Homo sapiens
gaacccagcugcucuguac

SEQ ID NO: 533800 - RNA, 19 nt, Homo sapiens
cgacugaaguguguguuua

SEQ ID NO: 533801 - RNA, 19 nt, Homo sapiens
aaacuacucucgauuuaug

SEQ ID NO: 533802 - RNA, 19 nt, Homo sapiens
agacaaggaccguauaaua

SEQ ID NO: 533803 - RNA, 19 nt, Homo sapiens
agaagacucugguaaugua

SEQ ID NO: 533804 - RNA, 19 nt, Homo sapiens
ucaccagguuugauaguua

SEQ ID NO: 533805 - RNA, 19 nt, Homo sapiens
aagcagcucuugugucuaa

SEQ ID NO: 533806 - RNA, 19 nt, Homo sapiens
gcacgagauuggagaauuc

SEQ ID NO: 533807 - RNA, 19 nt, Homo sapiens
gguccaaagugucggguua

SEQ ID NO: 533808 - RNA, 19 nt, Homo sapiens
gcagagaaguuuacagaac

SEQ ID NO: 533809 - RNA, 19 nt, Homo sapiens
gaagagugcauucccauga

SEQ ID NO: 533810 - RNA, 19 nt, Homo sapiens
gagcuuggauauuugagaa

SEQ ID NO: 533811 - RNA, 19 nt, Homo sapiens
cgacgacccuuucaucaga

SEQ ID NO: 533812 - RNA, 19 nt, Homo sapiens
ccaugaggcuugugugaaa

SEQ ID NO: 533813 - RNA, 19 nt, Homo sapiens
ggaagccucucuuugaauc

SEQ ID NO: 533814 - RNA, 19 nt, Homo sapiens
guaaagugcauaaagauga

SEQ ID NO: 533815 - RNA, 19 nt, Homo sapiens
cuucaauccuccaucauua

SEQ ID NO: 533816 - RNA, 19 nt, Homo sapiens
guuaagcgcugugugguaa

SEQ ID NO: 533817 - RNA, 19 nt, Homo sapiens
guaaagagagcaagacaga

SEQ ID NO: 533818 - RNA, 19 nt, Homo sapiens
ggcacgagcugucugcuuu

SEQ ID NO: 533819 - RNA, 19 nt, Homo sapiens
ugaaguguguguuuacuga

SEQ ID NO: 533820 - RNA, 19 nt, Homo sapiens
ccaauaacacguccacuuu

SEQ ID NO: 533821 - RNA, 19 nt, Homo sapiens
aagaccaccuguugaaaua

SEQ ID NO: 533822 - RNA, 19 nt, Homo sapiens
cagaguggcuuccaucuca

SEQ ID NO: 533823 - RNA, 19 nt, Homo sapiens
caucagaaagggagaauuu

SEQ ID NO: 533824 - RNA, 19 nt, Homo sapiens
gacaagauuucgccauguu

SEQ ID NO: 533825 - RNA, 19 nt, Homo sapiens
gaugugugauaaucuguuu

SEQ ID NO: 533826 - RNA, 19 nt, Homo sapiens
aaauggcucuccagaaauu

SEQ ID NO: 533827 - RNA, 19 nt, Homo sapiens
agaccuaucuaucugagua

SEQ ID NO: 533828 - RNA, 19 nt, Homo sapiens
ggagaaggacaguuugaaa

SEQ ID NO: 533829 - RNA, 19 nt, Homo sapiens
agaagagccucguagcuuu

SEQ ID NO: 533830 - RNA, 19 nt, Homo sapiens
cgaagcagcucuugugucu

SEQ ID NO: 533831 - RNA, 19 nt, Homo sapiens
gauggaagaugcagucucu

SEQ ID NO: 533832 - RNA, 19 nt, Homo sapiens
gcacuuagaaugauguaau

SEQ ID NO: 533833 - RNA, 19 nt, Homo sapiens
guuguaaagugcauaaaga

SEQ ID NO: 533834 - RNA, 19 nt, Homo sapiens
gaguagugcuuuccaguuc

SEQ ID NO: 533835 - RNA, 19 nt, Homo sapiens
uauggaagaugugugauaa

SEQ ID NO: 533836 - RNA, 19 nt, Homo sapiens
ucuaagaucucaaguccuu

SEQ ID NO: 533837 - RNA, 19 nt, Homo sapiens
uaccaaugcuuacgucaaa

SEQ ID NO: 533838 - RNA, 19 nt, Homo sapiens
ugagaauccuuguggcuuu

SEQ ID NO: 533839 - RNA, 19 nt, Homo sapiens
gcccuugccucauguuuga

SEQ ID NO: 533840 - RNA, 19 nt, Homo sapiens
agacaaagaccaccuguug

SEQ ID NO: 533841 - RNA, 19 nt, Homo sapiens
ggaaaauuguguaugagua

SEQ ID NO: 533842 - RNA, 19 nt, Homo sapiens
uggaucggcucauagauuu

SEQ ID NO: 533843 - RNA, 19 nt, Homo sapiens
gacaaggaccguauaauag

SEQ ID NO: 533844 - RNA, 19 nt, Homo sapiens
gaaagggagaauuuguuaa

SEQ ID NO: 533845 - RNA, 19 nt, Homo sapiens
caaguucaccuuucucuau

SEQ ID NO: 533846 - RNA, 19 nt, Homo sapiens
agaaagggagaauuuguua

SEQ ID NO: 533847 - RNA, 19 nt, Homo sapiens
gagggaagcccgagaaaca

SEQ ID NO: 533848 - RNA, 19 nt, Homo sapiens
ugaaggagaaggacaguuu

SEQ ID NO: 533849 - RNA, 19 nt, Homo sapiens
gagaagagccucguagcuu

SEQ ID NO: 533850 - RNA, 19 nt, Homo sapiens
ugaggcuccuguuaaauuu

SEQ ID NO: 533851 - RNA, 19 nt, Homo sapiens
aagcugcacuuccaggaua

SEQ ID NO: 533852 - RNA, 19 nt, Homo sapiens
ugacagugcugcugaugug

SEQ ID NO: 533853 - RNA, 19 nt, Homo sapiens
acacagggaugagguggua

SEQ ID NO: 533854 - RNA, 19 nt, Homo sapiens
ccagaaagagcuuggauau

SEQ ID NO: 533855 - RNA, 19 nt, Homo sapiens
gaguguaguugaugacugu

SEQ ID NO: 533856 - RNA, 19 nt, Homo sapiens
cuacaauacccguugauaa

SEQ ID NO: 533857 - RNA, 19 nt, Homo sapiens
acaggaugcugauguuuga

SEQ ID NO: 533858 - RNA, 19 nt, Homo sapiens
gcacuuccaggauaucauu

SEQ ID NO: 533859 - RNA, 19 nt, Homo sapiens
gaagagagacacaaucacu

SEQ ID NO: 533860 - RNA, 19 nt, Homo sapiens
cagcaaaguuaacuacaca

SEQ ID NO: 533861 - RNA, 19 nt, Homo sapiens
gggugaaacuugggaacua

SEQ ID NO: 533862 - RNA, 19 nt, Homo sapiens
ccucagggauucacucaug

SEQ ID NO: 533863 - RNA, 19 nt, Homo sapiens
guacugcacuuagaaugau

SEQ ID NO: 533864 - RNA, 19 nt, Homo sapiens
gcucuguacugcacuuaga

SEQ ID NO: 533865 - RNA, 19 nt, Homo sapiens
ucacagcuauaccaaacuu

SEQ ID NO: 533866 - RNA, 19 nt, Homo sapiens
acugguaacucuuaacuga

SEQ ID NO: 533867 - RNA, 19 nt, Homo sapiens
auacaacguuggugauuug

SEQ ID NO: 533868 - RNA, 19 nt, Homo sapiens
ggaagaggagcauaaaaua

SEQ ID NO: 533869 - RNA, 19 nt, Homo sapiens
ggaagcaucugggcuggau

SEQ ID NO: 533870 - RNA, 19 nt, Homo sapiens
gguuugauaguuagacuua

SEQ ID NO: 533871 - RNA, 19 nt, Homo sapiens
gugaauuguuccucagaaa

SEQ ID NO: 533872 - RNA, 19 nt, Homo sapiens
ggauaucauuugggugaaa

SEQ ID NO: 533873 - RNA, 19 nt, Homo sapiens
caucugcacugcccacuuc

SEQ ID NO: 533874 - RNA, 19 nt, Homo sapiens
ucucaaguccuucagauaa

SEQ ID NO: 533875 - RNA, 19 nt, Homo sapiens
ugaaugaaaugccaauaac

SEQ ID NO: 533876 - RNA, 19 nt, Homo sapiens
aaaguuaauuggcauaugg

SEQ ID NO: 533877 - RNA, 19 nt, Homo sapiens
gcaaaccuucgacuucauu

SEQ ID NO: 533878 - RNA, 19 nt, Homo sapiens
aaaggaaacuacucucgau

SEQ ID NO: 533879 - RNA, 19 nt, Homo sapiens
gcagagagcacgcuacaac

SEQ ID NO: 533880 - RNA, 19 nt, Homo sapiens
gggaagaguacuccucaaa

SEQ ID NO: 533881 - RNA, 19 nt, Homo sapiens
cagagacccuggagaguca

SEQ ID NO: 533882 - RNA, 19 nt, Homo sapiens
gggcauuguucaagcagaa

SEQ ID NO: 533883 - RNA, 19 nt, Homo sapiens
guugaugacuguuuguuag

SEQ ID NO: 533884 - RNA, 19 nt, Homo sapiens
ccaaagugcugggauuaca

SEQ ID NO: 533885 - RNA, 19 nt, Homo sapiens
gauuuaugcuccuuaugau

SEQ ID NO: 533886 - RNA, 19 nt, Homo sapiens
ggaaacuacucucgauuua

SEQ ID NO: 533887 - RNA, 19 nt, Homo sapiens
agaaagagcuuggauauuu

SEQ ID NO: 533888 - RNA, 19 nt, Homo sapiens
ggagggauauacugaaaua

SEQ ID NO: 533889 - RNA, 19 nt, Homo sapiens
gaagaagacucugguaaug

SEQ ID NO: 533890 - RNA, 19 nt, Homo sapiens
ggacggagcugacuuuuaa

SEQ ID NO: 533891 - RNA, 19 nt, Homo sapiens
ggaaagcuguguuuggaaa

SEQ ID NO: 533892 - RNA, 19 nt, Homo sapiens
gggagcagauauuaacuua

SEQ ID NO: 533893 - RNA, 19 nt, Homo sapiens
gaaagagcuuggauauuug

SEQ ID NO: 533894 - RNA, 19 nt, Homo sapiens
guacuaaugugaauuguuc

SEQ ID NO: 533895 - RNA, 19 nt, Homo sapiens
gcacgugggucuaaagaga

SEQ ID NO: 533896 - RNA, 19 nt, Homo sapiens
ggacaguagugaaaucuug

SEQ ID NO: 533897 - RNA, 19 nt, Homo sapiens
gagaauuuguuaacgagua

SEQ ID NO: 533898 - RNA, 19 nt, Homo sapiens
gaucauuacucugcucuuu

SEQ ID NO: 533899 - RNA, 19 nt, Homo sapiens
gaacccagcugcucuguac

SEQ ID NO: 533900 - RNA, 19 nt, Homo sapiens
cgacugaaguguguguuua

SEQ ID NO: 533901 - RNA, 19 nt, Homo sapiens
aaacuacucucgauuuaug

SEQ ID NO: 533902 - RNA, 19 nt, Homo sapiens
agacaaggaccguauaaua

SEQ ID NO: 533903 - RNA, 19 nt, Homo sapiens
agaagacucugguaaugua

SEQ ID NO: 533904 - RNA, 19 nt, Homo sapiens
ucaccagguuugauaguua

SEQ ID NO: 533905 - RNA, 19 nt, Homo sapiens
aagcagcucuugugucuaa

SEQ ID NO: 533906 - RNA, 19 nt, Homo sapiens
gcacgagauuggagaauuc

SEQ ID NO: 533907 - RNA, 19 nt, Homo sapiens
gguccaaagugucggguua

SEQ ID NO: 533908 - RNA, 19 nt, Homo sapiens
gcagagaaguuuacagaac

SEQ ID NO: 533909 - RNA, 19 nt, Homo sapiens
gaagagugcauucccauga

SEQ ID NO: 533910 - RNA, 19 nt, Homo sapiens
gagcuuggauauuugagaa

SEQ ID NO: 533911 - RNA, 19 nt, Homo sapiens
cgacgacccuuucaucaga

SEQ ID NO: 533912 - RNA, 19 nt, Homo sapiens
ccaugaggcuugugugaaa

SEQ ID NO: 533913 - RNA, 19 nt, Homo sapiens
ggaagccucucuuugaauc

SEQ ID NO: 533914 - RNA, 19 nt, Homo sapiens
guaaagugcauaaagauga

SEQ ID NO: 533915 - RNA, 19 nt, Homo sapiens
cuucaauccuccaucauua

SEQ ID NO: 533916 - RNA, 19 nt, Homo sapiens
guuaagcgcugugugguaa

SEQ ID NO: 533917 - RNA, 19 nt, Homo sapiens
guaaagagagcaagacaga

SEQ ID NO: 533918 - RNA, 19 nt, Homo sapiens
ggcacgagcugucugcuuu

SEQ ID NO: 533919 - RNA, 19 nt, Homo sapiens
ugaaguguguguuuacuga

SEQ ID NO: 533920 - RNA, 19 nt, Homo sapiens
ccaauaacacguccacuuu

SEQ ID NO: 533921 - RNA, 19 nt, Homo sapiens
aagaccaccuguugaaaua

SEQ ID NO: 533922 - RNA, 19 nt, Homo sapiens
cagaguggcuuccaucuca

SEQ ID NO: 533923 - RNA, 19 nt, Homo sapiens
caucagaaagggagaauuu

SEQ ID NO: 533924 - RNA, 19 nt, Homo sapiens
gacaagauuucgccauguu

SEQ ID NO: 533925 - RNA, 19 nt, Homo sapiens
aaauggcucuccagaaauu

SEQ ID NO: 533926 - RNA, 19 nt, Homo sapiens
agaccuaucuaucugagua

SEQ ID NO: 533927 - RNA, 19 nt, Homo sapiens
ggagaaggacaguuugaaa

SEQ ID NO: 533928 - RNA, 19 nt, Homo sapiens
agaagagccucguagcuuu

SEQ ID NO: 533929 - RNA, 19 nt, Homo sapiens
cgaagcagcucuugugucu

SEQ ID NO: 533930 - RNA, 19 nt, Homo sapiens
gauggaagaugcagucucu

SEQ ID NO: 533931 - RNA, 19 nt, Homo sapiens
gcacuuagaaugauguaau

SEQ ID NO: 533932 - RNA, 19 nt, Homo sapiens
guuguaaagugcauaaaga

SEQ ID NO: 533933 - RNA, 19 nt, Homo sapiens
gaguagugcuuuccaguuc

SEQ ID NO: 533934 - RNA, 19 nt, Homo sapiens
ucuaagaucucaaguccuu

SEQ ID NO: 533935 - RNA, 19 nt, Homo sapiens
uaccaaugcuuacgucaaa

SEQ ID NO: 533936 - RNA, 19 nt, Homo sapiens
ugagaauccuuguggcuuu

SEQ ID NO: 533937 - RNA, 19 nt, Homo sapiens
agacaaagaccaccuguug

SEQ ID NO: 533938 - RNA, 19 nt, Homo sapiens
gcccuugccucauguuuga

SEQ ID NO: 533939 - RNA, 19 nt, Homo sapiens
ggaaaauuguguaugagua

SEQ ID NO: 533940 - RNA, 19 nt, Homo sapiens
uggaucggcucauagauuu

SEQ ID NO: 533941 - RNA, 19 nt, Homo sapiens
gacaaggaccguauaauag

SEQ ID NO: 533942 - RNA, 19 nt, Homo sapiens
gaaagggagaauuuguuaa

SEQ ID NO: 533943 - RNA, 19 nt, Homo sapiens
caaguucaccuuucucuau

SEQ ID NO: 533944 - RNA, 19 nt, Homo sapiens
agaaagggagaauuuguua

SEQ ID NO: 533945 - RNA, 19 nt, Homo sapiens
gagggaagcccgagaaaca

SEQ ID NO: 533946 - RNA, 19 nt, Homo sapiens
ugaaggagaaggacaguuu

SEQ ID NO: 533947 - RNA, 19 nt, Homo sapiens
gagaagagccucguagcuu

SEQ ID NO: 533948 - RNA, 19 nt, Homo sapiens
ugaggcuccuguuaaauuu

SEQ ID NO: 533949 - RNA, 19 nt, Homo sapiens
aagcugcacuuccaggaua

SEQ ID NO: 533950 - RNA, 19 nt, Homo sapiens
ugacagugcugcugaugug

SEQ ID NO: 533951 - RNA, 19 nt, Homo sapiens
acacagggaugagguggua

SEQ ID NO: 533952 - RNA, 19 nt, Homo sapiens
ccagaaagagcuuggauau

SEQ ID NO: 533953 - RNA, 19 nt, Homo sapiens
gaguguaguugaugacugu

SEQ ID NO: 533954 - RNA, 19 nt, Homo sapiens
cuacaauacccguugauaa

SEQ ID NO: 533955 - RNA, 19 nt, Homo sapiens
acaggaugcugauguuuga

SEQ ID NO: 533956 - RNA, 19 nt, Homo sapiens
gcacuuccaggauaucauu

SEQ ID NO: 533957 - RNA, 19 nt, Homo sapiens
gaagagagacacaaucacu

SEQ ID NO: 533958 - RNA, 19 nt, Homo sapiens
cagcaaaguuaacuacaca

SEQ ID NO: 533959 - RNA, 19 nt, Homo sapiens
gggugaaacuugggaacua

SEQ ID NO: 533960 - RNA, 19 nt, Homo sapiens
ccucagggauucacucaug

SEQ ID NO: 533961 - RNA, 19 nt, Homo sapiens
guacugcacuuagaaugau

SEQ ID NO: 533962 - RNA, 19 nt, Homo sapiens
gcucuguacugcacuuaga

SEQ ID NO: 533963 - RNA, 19 nt, Homo sapiens
ucacagcuauaccaaacuu

SEQ ID NO: 533964 - RNA, 19 nt, Homo sapiens
acugguaacucuuaacuga

SEQ ID NO: 533965 - RNA, 19 nt, Homo sapiens
auacaacguuggugauuug

SEQ ID NO: 533966 - RNA, 19 nt, Homo sapiens
ggaagaggagcauaaaaua

SEQ ID NO: 533967 - RNA, 19 nt, Homo sapiens
ggaagcaucugggcuggau

SEQ ID NO: 533968 - RNA, 19 nt, Homo sapiens
gguuugauaguuagacuua

SEQ ID NO: 533969 - RNA, 19 nt, Homo sapiens
gugaauuguuccucagaaa

SEQ ID NO: 533970 - RNA, 19 nt, Homo sapiens
ggauaucauuugggugaaa

SEQ ID NO: 533971 - RNA, 19 nt, Homo sapiens
caucugcacugcccacuuc

SEQ ID NO: 533972 - RNA, 19 nt, Homo sapiens
ucucaaguccuucagauaa

SEQ ID NO: 533973 - RNA, 19 nt, Homo sapiens
ugaaugaaaugccaauaac

SEQ ID NO: 533974 - RNA, 19 nt, Homo sapiens
aaaguuaauuggcauaugg

SEQ ID NO: 533975 - RNA, 19 nt, Homo sapiens
gcaaaccuucgacuucauu

SEQ ID NO: 533976 - RNA, 19 nt, Homo sapiens
aaaggaaacuacucucgau

SEQ ID NO: 533977 - RNA, 19 nt, Homo sapiens
gcagagagcacgcuacaac

SEQ ID NO: 533978 - RNA, 19 nt, Homo sapiens
gggaagaguacuccucaaa

SEQ ID NO: 533979 - RNA, 19 nt, Homo sapiens
cagagacccuggagaguca

SEQ ID NO: 533980 - RNA, 19 nt, Homo sapiens
gggcauuguucaagcagaa

SEQ ID NO: 533981 - RNA, 19 nt, Homo sapiens
guugaugacuguuuguuag

SEQ ID NO: 533982 - RNA, 19 nt, Homo sapiens
ccaaagugcugggauuaca

SEQ ID NO: 533983 - RNA, 19 nt, Homo sapiens
gauuuaugcuccuuaugau

SEQ ID NO: 533984 - RNA, 19 nt, Homo sapiens
ccucgaaacugccauugug

SEQ ID NO: 533985 - RNA, 19 nt, Homo sapiens
gcucagcguuccuggacaa

SEQ ID NO: 533986 - RNA, 19 nt, Homo sapiens
gaacguuucugacuaauau

SEQ ID NO: 533987 - RNA, 19 nt, Homo sapiens
ggacaaaguuggguugaua

SEQ ID NO: 533988 - RNA, 19 nt, Homo sapiens
agaaagagcuuggauauuu

SEQ ID NO: 533989 - RNA, 19 nt, Homo sapiens
gaagaccuguuugaaauua

SEQ ID NO: 533990 - RNA, 19 nt, Homo sapiens
gcauauaacucucggguaa

SEQ ID NO: 533991 - RNA, 19 nt, Homo sapiens
gaugaugagugacuuauuu

SEQ ID NO: 533992 - RNA, 19 nt, Homo sapiens
ggaauuccuucauuucaua

SEQ ID NO: 533993 - RNA, 19 nt, Homo sapiens
gcucaaauguugcaggaua

SEQ ID NO: 533994 - RNA, 19 nt, Homo sapiens
gaagaagacucugguaaug

SEQ ID NO: 533995 - RNA, 19 nt, Homo sapiens
gcaaauaggcaacuuggua

SEQ ID NO: 533996 - RNA, 19 nt, Homo sapiens
gaaagagcuuggauauuug

SEQ ID NO: 533997 - RNA, 19 nt, Homo sapiens
caauguagauuucaaguug

SEQ ID NO: 533998 - RNA, 19 nt, Homo sapiens
gcaacuugguacuaucuua

SEQ ID NO: 533999 - RNA, 19 nt, Homo sapiens
gcaguuggcuggaaugugu

SEQ ID NO: 534000 - RNA, 19 nt, Homo sapiens
caacuugcuucauuucuuu

SEQ ID NO: 534001 - RNA, 19 nt, Homo sapiens
guacagaaauucauuaugc

SEQ ID NO: 534002 - RNA, 19 nt, Homo sapiens
gccaucagcuuccuucuuu

SEQ ID NO: 534003 - RNA, 19 nt, Homo sapiens
gcagaacacuggauuugug

SEQ ID NO: 534004 - RNA, 19 nt, Homo sapiens
gaacccagcugcucuguac

SEQ ID NO: 534005 - RNA, 19 nt, Homo sapiens
ggaaaguucuugacagagu

SEQ ID NO: 534006 - RNA, 19 nt, Homo sapiens
ggagugggcucauccuaga

SEQ ID NO: 534007 - RNA, 19 nt, Homo sapiens
gaaauuacagcaugaugaa

SEQ ID NO: 534008 - RNA, 19 nt, Homo sapiens
agaagacucugguaaugua

SEQ ID NO: 534009 - RNA, 19 nt, Homo sapiens
gccaggaaguuucuaguuu

SEQ ID NO: 534010 - RNA, 19 nt, Homo sapiens
guaauaggguggcaucuuc

SEQ ID NO: 534011 - RNA, 19 nt, Homo sapiens
aagcagcucuugugucuaa

SEQ ID NO: 534012 - RNA, 19 nt, Homo sapiens
guggaaacgugcuaacuuu

SEQ ID NO: 534013 - RNA, 19 nt, Homo sapiens
gagacaggguuucgccaua

SEQ ID NO: 534014 - RNA, 19 nt, Homo sapiens
ugagguaacugucauuaga

SEQ ID NO: 534015 - RNA, 19 nt, Homo sapiens
gcgaguagcccacaguuaa

SEQ ID NO: 534016 - RNA, 19 nt, Homo sapiens
gguccaaagugucggguua

SEQ ID NO: 534017 - RNA, 19 nt, Homo sapiens
gagaggcuccugucugaua

SEQ ID NO: 534018 - RNA, 19 nt, Homo sapiens
aaauggcucugguucaaua

SEQ ID NO: 534019 - RNA, 19 nt, Homo sapiens
gaagagugcauucccauga

SEQ ID NO: 534020 - RNA, 19 nt, Homo sapiens
gagcuuggauauuugagaa

SEQ ID NO: 534021 - RNA, 19 nt, Homo sapiens
gaucguagauguuguagac

SEQ ID NO: 534022 - RNA, 19 nt, Homo sapiens
caucaagccuuuauauauc

SEQ ID NO: 534023 - RNA, 19 nt, Homo sapiens
guaaagugcauaaagauga

SEQ ID NO: 534024 - RNA, 19 nt, Homo sapiens
cguaaguacuccauuguaa

SEQ ID NO: 534025 - RNA, 19 nt, Homo sapiens
gauuguagcuguucuaaaa

SEQ ID NO: 534026 - RNA, 19 nt, Homo sapiens
ggaagccucucuuugaauc

SEQ ID NO: 534027 - RNA, 19 nt, Homo sapiens
gagggaggaugcuguguga

SEQ ID NO: 534028 - RNA, 19 nt, Homo sapiens
aaacguaaguacuccauug

SEQ ID NO: 534029 - RNA, 19 nt, Homo sapiens
uaggaaaucucuccaagug

SEQ ID NO: 534030 - RNA, 19 nt, Homo sapiens
ggaaacaacgggaaaguuc

SEQ ID NO: 534031 - RNA, 19 nt, Homo sapiens
gaaggaauguauuucuaag

SEQ ID NO: 534032 - RNA, 19 nt, Homo sapiens
ggaaguuucuaguuugugu

SEQ ID NO: 534033 - RNA, 19 nt, Homo sapiens
gaacguggaugggaaugau

SEQ ID NO: 534034 - RNA, 19 nt, Homo sapiens
caucagcccucauguuuca

SEQ ID NO: 534035 - RNA, 19 nt, Homo sapiens
aagaccaccuguugaaaua

SEQ ID NO: 534036 - RNA, 19 nt, Homo sapiens
gaauagaucguagauguug

SEQ ID NO: 534037 - RNA, 19 nt, Homo sapiens
ggaauguguucacuagguu

SEQ ID NO: 534038 - RNA, 19 nt, Homo sapiens
uggaagaccuguuugaaau

SEQ ID NO: 534039 - RNA, 19 nt, Homo sapiens
ccuuugaacuccaugguua

SEQ ID NO: 534040 - RNA, 19 nt, Homo sapiens
uaaugaacguuucugacua

SEQ ID NO: 534041 - RNA, 19 nt, Homo sapiens
gaugugugauaaucuguuu

SEQ ID NO: 534042 - RNA, 19 nt, Homo sapiens
aaauggcucuccagaaauu

SEQ ID NO: 534043 - RNA, 19 nt, Homo sapiens
uggaauagaucguagaugu

SEQ ID NO: 534044 - RNA, 19 nt, Homo sapiens
aaaugcaucucguuggaua

SEQ ID NO: 534045 - RNA, 19 nt, Homo sapiens
ccaggaaguuucuaguuug

SEQ ID NO: 534046 - RNA, 19 nt, Homo sapiens
ucauguagcuggagacguu

SEQ ID NO: 534047 - RNA, 19 nt, Homo sapiens
gacacuagauacaguaaau

SEQ ID NO: 534048 - RNA, 19 nt, Homo sapiens
ggagaaggacaguuugaaa

SEQ ID NO: 534049 - RNA, 19 nt, Homo sapiens
agaagagccucguagcuuu

SEQ ID NO: 534050 - RNA, 19 nt, Homo sapiens
cgaagcagcucuugugucu

SEQ ID NO: 534051 - RNA, 19 nt, Homo sapiens
guuguaaagugcauaaaga

SEQ ID NO: 534052 - RNA, 19 nt, Homo sapiens
ggaugggaaugauagugua

SEQ ID NO: 534053 - RNA, 19 nt, Homo sapiens
acugauagaugcauuagaa

SEQ ID NO: 534054 - RNA, 19 nt, Homo sapiens
gcacuuagaaugauguaau

SEQ ID NO: 534055 - RNA, 19 nt, Homo sapiens
gucauggacuguacuauug

SEQ ID NO: 534056 - RNA, 19 nt, Homo sapiens
uuacugugcuguuaacuug

SEQ ID NO: 534057 - RNA, 19 nt, Homo sapiens
gaaauucauuaugcugcua

SEQ ID NO: 534058 - RNA, 19 nt, Homo sapiens
uauggaagaugugugauaa

SEQ ID NO: 534059 - RNA, 19 nt, Homo sapiens
ucuaagaucucaaguccuu

SEQ ID NO: 534060 - RNA, 19 nt, Homo sapiens
gagaguggagaaaguauuu

SEQ ID NO: 534061 - RNA, 19 nt, Homo sapiens
gggcuguugucauuuguaa

SEQ ID NO: 534062 - RNA, 19 nt, Homo sapiens
caacacacuucucuaacau

SEQ ID NO: 534063 - RNA, 19 nt, Homo sapiens
agacaaagaccaccuguug

SEQ ID NO: 534064 - RNA, 19 nt, Homo sapiens
uaacuuggaagaccuguuu

SEQ ID NO: 534065 - RNA, 19 nt, Homo sapiens
ccaucaagccuuuauauau

SEQ ID NO: 534066 - RNA, 19 nt, Homo sapiens
uagagguccugaauuguuu

SEQ ID NO: 534067 - RNA, 19 nt, Homo sapiens
gugauacauucuagccuua

SEQ ID NO: 534068 - RNA, 19 nt, Homo sapiens
ugaaauaaaccuagaagug

SEQ ID NO: 534069 - RNA, 19 nt, Homo sapiens
caaguucaccuuucucuau

SEQ ID NO: 534070 - RNA, 19 nt, Homo sapiens
ccagccagcuagcccauaa

SEQ ID NO: 534071 - RNA, 19 nt, Homo sapiens
aaugaacguuucugacuaa

SEQ ID NO: 534072 - RNA, 19 nt, Homo sapiens
ugaaggagaaggacaguuu

SEQ ID NO: 534073 - RNA, 19 nt, Homo sapiens
gagaagagccucguagcuu

SEQ ID NO: 534074 - RNA, 19 nt, Homo sapiens
agacugagauuugggacua

SEQ ID NO: 534075 - RNA, 19 nt, Homo sapiens
agaagggucacuuuaauaa

SEQ ID NO: 534076 - RNA, 19 nt, Homo sapiens
cuagaagggucacuuuaau

SEQ ID NO: 534077 - RNA, 19 nt, Homo sapiens
cguguuagguccacauuug

SEQ ID NO: 534078 - RNA, 19 nt, Homo sapiens
uaaguaauguaacgcaugu

SEQ ID NO: 534079 - RNA, 19 nt, Homo sapiens
ugacagugcugcugaugug

SEQ ID NO: 534080 - RNA, 19 nt, Homo sapiens
cggaaucucugcaaucugu

SEQ ID NO: 534081 - RNA, 19 nt, Homo sapiens
caaggucuguaauuguauu

SEQ ID NO: 534082 - RNA, 19 nt, Homo sapiens
gcccugacccuagaauuua

SEQ ID NO: 534083 - RNA, 19 nt, Homo sapiens
ggugugcgguuuaucuuug

SEQ ID NO: 534084 - RNA, 19 nt, Homo sapiens
ggaagccaguauaagcauu

SEQ ID NO: 534085 - RNA, 19 nt, Homo sapiens
ccagaagccugaugugagu

SEQ ID NO: 534086 - RNA, 19 nt, Homo sapiens
ggaaacuacucucgauuua

SEQ ID NO: 534087 - RNA, 19 nt, Homo sapiens
agaaagagcuuggauauuu

SEQ ID NO: 534088 - RNA, 19 nt, Homo sapiens
ggagggauauacugaaaua

SEQ ID NO: 534089 - RNA, 19 nt, Homo sapiens
gaagaagacucugguaaug

SEQ ID NO: 534090 - RNA, 19 nt, Homo sapiens
ggacggagcugacuuuuaa

SEQ ID NO: 534091 - RNA, 19 nt, Homo sapiens
ggaaagcuguguuuggaaa

SEQ ID NO: 534092 - RNA, 19 nt, Homo sapiens
gggagcagauauuaacuua

SEQ ID NO: 534093 - RNA, 19 nt, Homo sapiens
gaaagagcuuggauauuug

SEQ ID NO: 534094 - RNA, 19 nt, Homo sapiens
guacuaaugugaauuguuc

SEQ ID NO: 534095 - RNA, 19 nt, Homo sapiens
gcacgugggucuaaagaga

SEQ ID NO: 534096 - RNA, 19 nt, Homo sapiens
ggacaguagugaaaucuug

SEQ ID NO: 534097 - RNA, 19 nt, Homo sapiens
gagaauuuguuaacgagua

SEQ ID NO: 534098 - RNA, 19 nt, Homo sapiens
gaucauuacucugcucuuu

SEQ ID NO: 534099 - RNA, 19 nt, Homo sapiens
cgacugaaguguguguuua

SEQ ID NO: 534100 - RNA, 19 nt, Homo sapiens
aaacuacucucgauuuaug

SEQ ID NO: 534101 - RNA, 19 nt, Homo sapiens
agacaaggaccguauaaua

SEQ ID NO: 534102 - RNA, 19 nt, Homo sapiens
agaagacucugguaaugua

SEQ ID NO: 534103 - RNA, 19 nt, Homo sapiens
ucaccagguuugauaguua

SEQ ID NO: 534104 - RNA, 19 nt, Homo sapiens
aagcagcucuugugucuaa

SEQ ID NO: 534105 - RNA, 19 nt, Homo sapiens
gcacgagauuggagaauuc

SEQ ID NO: 534106 - RNA, 19 nt, Homo sapiens
gguccaaagugucggguua

SEQ ID NO: 534107 - RNA, 19 nt, Homo sapiens
gcagagaaguuuacagaac

SEQ ID NO: 534108 - RNA, 19 nt, Homo sapiens
gaagagugcauucccauga

SEQ ID NO: 534109 - RNA, 19 nt, Homo sapiens
gagcuuggauauuugagaa

SEQ ID NO: 534110 - RNA, 19 nt, Homo sapiens
cgacgacccuuucaucaga

SEQ ID NO: 534111 - RNA, 19 nt, Homo sapiens
ccaugaggcuugugugaaa

SEQ ID NO: 534112 - RNA, 19 nt, Homo sapiens
ggaagccucucuuugaauc

SEQ ID NO: 534113 - RNA, 19 nt, Homo sapiens
guaaagugcauaaagauga

SEQ ID NO: 534114 - RNA, 19 nt, Homo sapiens
cuucaauccuccaucauua

SEQ ID NO: 534115 - RNA, 19 nt, Homo sapiens
guuaagcgcugugugguaa

SEQ ID NO: 534116 - RNA, 19 nt, Homo sapiens
guaaagagagcaagacaga

SEQ ID NO: 534117 - RNA, 19 nt, Homo sapiens
ugaaguguguguuuacuga

SEQ ID NO: 534118 - RNA, 19 nt, Homo sapiens
ccaauaacacguccacuuu

SEQ ID NO: 534119 - RNA, 19 nt, Homo sapiens
aagaccaccuguugaaaua

SEQ ID NO: 534120 - RNA, 19 nt, Homo sapiens
cagaguggcuuccaucuca

SEQ ID NO: 534121 - RNA, 19 nt, Homo sapiens
caucagaaagggagaauuu

SEQ ID NO: 534122 - RNA, 19 nt, Homo sapiens
aaauggcucuccagaaauu

SEQ ID NO: 534123 - RNA, 19 nt, Homo sapiens
agaccuaucuaucugagua

SEQ ID NO: 534124 - RNA, 19 nt, Homo sapiens
ggagaaggacaguuugaaa

SEQ ID NO: 534125 - RNA, 19 nt, Homo sapiens
agaagagccucguagcuuu

SEQ ID NO: 534126 - RNA, 19 nt, Homo sapiens
cgaagcagcucuugugucu

SEQ ID NO: 534127 - RNA, 19 nt, Homo sapiens
gauggaagaugcagucucu

SEQ ID NO: 534128 - RNA, 19 nt, Homo sapiens
guuguaaagugcauaaaga

SEQ ID NO: 534129 - RNA, 19 nt, Homo sapiens
gaguagugcuuuccaguuc

SEQ ID NO: 534130 - RNA, 19 nt, Homo sapiens
ucuaagaucucaaguccuu

SEQ ID NO: 534131 - RNA, 19 nt, Homo sapiens
uaccaaugcuuacgucaaa

SEQ ID NO: 534132 - RNA, 19 nt, Homo sapiens
ugagaauccuuguggcuuu

SEQ ID NO: 534133 - RNA, 19 nt, Homo sapiens
agacaaagaccaccuguug

SEQ ID NO: 534134 - RNA, 19 nt, Homo sapiens
ggaaaauuguguaugagua

SEQ ID NO: 534135 - RNA, 19 nt, Homo sapiens
uggaucggcucauagauuu

SEQ ID NO: 534136 - RNA, 19 nt, Homo sapiens
gacaaggaccguauaauag

SEQ ID NO: 534137 - RNA, 19 nt, Homo sapiens
gaaagggagaauuuguuaa

SEQ ID NO: 534138 - RNA, 19 nt, Homo sapiens
caaguucaccuuucucuau

SEQ ID NO: 534139 - RNA, 19 nt, Homo sapiens
agaaagggagaauuuguua

SEQ ID NO: 534140 - RNA, 19 nt, Homo sapiens
gagggaagcccgagaaaca

SEQ ID NO: 534141 - RNA, 19 nt, Homo sapiens
ugaaggagaaggacaguuu

SEQ ID NO: 534142 - RNA, 19 nt, Homo sapiens
gagaagagccucguagcuu

SEQ ID NO: 534143 - RNA, 19 nt, Homo sapiens
ugaggcuccuguuaaauuu

SEQ ID NO: 534144 - RNA, 19 nt, Homo sapiens
aagcugcacuuccaggaua

SEQ ID NO: 534145 - RNA, 19 nt, Homo sapiens
ugacagugcugcugaugug

SEQ ID NO: 534146 - RNA, 19 nt, Homo sapiens
acacagggaugagguggua

SEQ ID NO: 534147 - RNA, 19 nt, Homo sapiens
ccagaaagagcuuggauau

SEQ ID NO: 534148 - RNA, 19 nt, Homo sapiens
gaguguaguugaugacugu

SEQ ID NO: 534149 - RNA, 19 nt, Homo sapiens
cuacaauacccguugauaa

SEQ ID NO: 534150 - RNA, 19 nt, Homo sapiens
acaggaugcugauguuuga

SEQ ID NO: 534151 - RNA, 19 nt, Homo sapiens
gcacuuccaggauaucauu

SEQ ID NO: 534152 - RNA, 19 nt, Homo sapiens
gaagagagacacaaucacu

SEQ ID NO: 534153 - RNA, 19 nt, Homo sapiens
cagcaaaguuaacuacaca

SEQ ID NO: 534154 - RNA, 19 nt, Homo sapiens
ggaagcaucugggcuggau

SEQ ID NO: 534155 - RNA, 19 nt, Homo sapiens
gggugaaacuugggaacua

SEQ ID NO: 534156 - RNA, 19 nt, Homo sapiens
ccucagggauucacucaug

SEQ ID NO: 534157 - RNA, 19 nt, Homo sapiens
ucacagcuauaccaaacuu

SEQ ID NO: 534158 - RNA, 19 nt, Homo sapiens
auacaacguuggugauuug

SEQ ID NO: 534159 - RNA, 19 nt, Homo sapiens
ggaagaggagcauaaaaua

SEQ ID NO: 534160 - RNA, 19 nt, Homo sapiens
gguuugauaguuagacuua

SEQ ID NO: 534161 - RNA, 19 nt, Homo sapiens
gugaauuguuccucagaaa

SEQ ID NO: 534162 - RNA, 19 nt, Homo sapiens
ggauaucauuugggugaaa

SEQ ID NO: 534163 - RNA, 19 nt, Homo sapiens
caucugcacugcccacuuc

SEQ ID NO: 534164 - RNA, 19 nt, Homo sapiens
ucucaaguccuucagauaa

SEQ ID NO: 534165 - RNA, 19 nt, Homo sapiens
ugaaugaaaugccaauaac

SEQ ID NO: 534166 - RNA, 19 nt, Homo sapiens
aaaguuaauuggcauaugg

SEQ ID NO: 534167 - RNA, 19 nt, Homo sapiens
gcaaaccuucgacuucauu

SEQ ID NO: 534168 - RNA, 19 nt, Homo sapiens
aaaggaaacuacucucgau

SEQ ID NO: 534169 - RNA, 19 nt, Homo sapiens
gcagagagcacgcuacaac

SEQ ID NO: 534170 - RNA, 19 nt, Homo sapiens
gggaagaguacuccucaaa

SEQ ID NO: 534171 - RNA, 19 nt, Homo sapiens
cagagacccuggagaguca

SEQ ID NO: 534172 - RNA, 19 nt, Homo sapiens
gggcauuguucaagcagaa

SEQ ID NO: 534173 - RNA, 19 nt, Homo sapiens
guugaugacuguuuguuag

SEQ ID NO: 534174 - RNA, 19 nt, Homo sapiens
ccaaagugcugggauuaca

SEQ ID NO: 534175 - RNA, 19 nt, Homo sapiens
gauuuaugcuccuuaugau

SEQ ID NO: 534176 - RNA, 19 nt, Homo sapiens
ccucgaaacugccauugug

SEQ ID NO: 534177 - RNA, 19 nt, Homo sapiens
gcucagcguuccuggacaa

SEQ ID NO: 534178 - RNA, 19 nt, Homo sapiens
ucacucauguuucgugugu

SEQ ID NO: 534179 - RNA, 19 nt, Homo sapiens
cgaaacacaaacugaagua

SEQ ID NO: 534180 - RNA, 19 nt, Homo sapiens
gaaauacaacguuggugau

SEQ ID NO: 534181 - RNA, 19 nt, Homo sapiens
gaagcaggcaccagaaauc

SEQ ID NO: 534182 - RNA, 19 nt, Homo sapiens
auacugaaauagagaguug

SEQ ID NO: 534183 - RNA, 19 nt, Homo sapiens
gggauauacugaaauagag

SEQ ID NO: 534184 - RNA, 19 nt, Homo sapiens
gacucuaacuucucccaaa

SEQ ID NO: 534185 - RNA, 19 nt, Homo sapiens
aaacugcagugucuuugga

SEQ ID NO: 534186 - RNA, 19 nt, Homo sapiens
ggaaacuacucucgauuua

SEQ ID NO: 534187 - RNA, 19 nt, Homo sapiens
gggauuugcuucagaauaa

SEQ ID NO: 534188 - RNA, 19 nt, Homo sapiens
ggacggagcugacuuuuaa

SEQ ID NO: 534189 - RNA, 19 nt, Homo sapiens
guacuaaugugaauuguuc

SEQ ID NO: 534190 - RNA, 19 nt, Homo sapiens
gagaauuuguuaacgagua

SEQ ID NO: 534191 - RNA, 19 nt, Homo sapiens
gcauugugguuauauguaa

SEQ ID NO: 534192 - RNA, 19 nt, Homo sapiens
gaucauuacucugcucuuu

SEQ ID NO: 534193 - RNA, 19 nt, Homo sapiens
aaacuacucucgauuuaug

SEQ ID NO: 534194 - RNA, 19 nt, Homo sapiens
agacaaggaccguauaaua

SEQ ID NO: 534195 - RNA, 19 nt, Homo sapiens
gcacgagauuggagaauuc

SEQ ID NO: 534196 - RNA, 19 nt, Homo sapiens
caaaggaauucagaagauu

SEQ ID NO: 534197 - RNA, 19 nt, Homo sapiens
cgacgacccuuucaucaga

SEQ ID NO: 534198 - RNA, 19 nt, Homo sapiens
ccaugaggcuugugugaaa

SEQ ID NO: 534199 - RNA, 19 nt, Homo sapiens
guuaagcgcugugugguaa

SEQ ID NO: 534200 - RNA, 19 nt, Homo sapiens
guaaagagagcaagacaga

SEQ ID NO: 534201 - RNA, 19 nt, Homo sapiens
ccaauaacacguccacuuu

SEQ ID NO: 534202 - RNA, 19 nt, Homo sapiens
gugcuaaacuucuuaugga

SEQ ID NO: 534203 - RNA, 19 nt, Homo sapiens
caucagaaagggagaauuu

SEQ ID NO: 534204 - RNA, 19 nt, Homo sapiens
cuaaacuucuuauggauga

SEQ ID NO: 534205 - RNA, 19 nt, Homo sapiens
ugagaauccuuguggcuuu

SEQ ID NO: 534206 - RNA, 19 nt, Homo sapiens
gacaaggaccguauaauag

SEQ ID NO: 534207 - RNA, 19 nt, Homo sapiens
gaaagggagaauuuguuaa

SEQ ID NO: 534208 - RNA, 19 nt, Homo sapiens
agaaagggagaauuuguua

SEQ ID NO: 534209 - RNA, 19 nt, Homo sapiens
gagggaagcccgagaaaca

SEQ ID NO: 534210 - RNA, 19 nt, Homo sapiens
acaaaggaauucagaagau

SEQ ID NO: 534211 - RNA, 19 nt, Homo sapiens
acaggaugcugauguuuga

SEQ ID NO: 534212 - RNA, 19 nt, Homo sapiens
gcacuuccaggauaucauu

SEQ ID NO: 534213 - RNA, 19 nt, Homo sapiens
ggacaaaggaauucagaag

SEQ ID NO: 534214 - RNA, 19 nt, Homo sapiens
gggugaaacuugggaacua

SEQ ID NO: 534215 - RNA, 19 nt, Homo sapiens
ccucagggauucacucaug

SEQ ID NO: 534216 - RNA, 19 nt, Homo sapiens
gugaauuguuccucagaaa

SEQ ID NO: 534217 - RNA, 19 nt, Homo sapiens
ggauaucauuugggugaaa

SEQ ID NO: 534218 - RNA, 19 nt, Homo sapiens
caucugcacugcccacuuc

SEQ ID NO: 534219 - RNA, 19 nt, Homo sapiens
aaugauaugucugggauuu

SEQ ID NO: 534220 - RNA, 19 nt, Homo sapiens
ugaaugaaaugccaauaac

SEQ ID NO: 534221 - RNA, 19 nt, Homo sapiens
aaaguuaauuggcauaugg

SEQ ID NO: 534222 - RNA, 19 nt, Homo sapiens
gcaaaccuucgacuucauu

SEQ ID NO: 534223 - RNA, 19 nt, Homo sapiens
aaaggaaacuacucucgau

SEQ ID NO: 534224 - RNA, 19 nt, Homo sapiens
ccucgaaacugccauugug

SEQ ID NO: 534225 - RNA, 19 nt, Homo sapiens
gcucagcguuccuggacaa

SEQ ID NO: 534226 - RNA, 19 nt, Homo sapiens
ucacucauguuucgugugu

SEQ ID NO: 534227 - RNA, 19 nt, Homo sapiens
cgaaacacaaacugaagua

SEQ ID NO: 534228 - RNA, 19 nt, Homo sapiens
cuucugaacucgcuagguu

SEQ ID NO: 534229 - RNA, 19 nt, Homo sapiens
gacccuggauuccucgaaa

SEQ ID NO: 534230 - RNA, 19 nt, Homo sapiens
gaaacuacucucgauuuau

SEQ ID NO: 534231 - RNA, 19 nt, Homo sapiens
ccaagaucaucaagacaga

SEQ ID NO: 534232 - RNA, 19 nt, Homo sapiens
gcauguaaaccacugaaga

SEQ ID NO: 534233 - RNA, 19 nt, Homo sapiens
gcuagguucuuaucaacau

SEQ ID NO: 534234 - RNA, 19 nt, Homo sapiens
gggccuaucuucugaacuc

SEQ ID NO: 534235 - RNA, 19 nt, Homo sapiens
cuacacagcggauauuuca

SEQ ID NO: 534236 - RNA, 19 nt, Homo sapiens
aaagaucaaggguuuauga

SEQ ID NO: 534237 - RNA, 19 nt, Homo sapiens
gacaaaggaauucagaaga

SEQ ID NO: 534238 - RNA, 19 nt, Homo sapiens
ggaaccagguauggauaga

SEQ ID NO: 534239 - RNA, 19 nt, Homo sapiens
gaauuucuccgaaugucaa

SEQ ID NO: 534240 - RNA, 19 nt, Homo sapiens
ccaauucguucuguaagga

SEQ ID NO: 534241 - RNA, 19 nt, Homo sapiens
gugguuauauguaagacuu

SEQ ID NO: 534242 - RNA, 19 nt, Homo sapiens
gagaauccuuguggcuuug

SEQ ID NO: 534243 - RNA, 19 nt, Homo sapiens
gcucagugaucgccuccaa

SEQ ID NO: 534244 - RNA, 19 nt, Homo sapiens
gagagcaagacagauguua

SEQ ID NO: 534245 - RNA, 19 nt, Homo sapiens
aaagagagcaagacagaug

SEQ ID NO: 534246 - RNA, 19 nt, Homo sapiens
auacgaaagugcagacgaa

SEQ ID NO: 534247 - RNA, 19 nt, Homo sapiens
aauaacacguccacuuuca

SEQ ID NO: 534248 - RNA, 19 nt, Homo sapiens
gggauucacucauguuucg

SEQ ID NO: 534249 - RNA, 19 nt, Homo sapiens
ccagaaggacaaaggaauu

SEQ ID NO: 534250 - RNA, 19 nt, Homo sapiens
ggggauaacuuuguauauu

SEQ ID NO: 534251 - RNA, 19 nt, Homo sapiens
ccaagagggacaucagaaa

SEQ ID NO: 534252 - RNA, 19 nt, Homo sapiens
gagcaagacagauguuaag

SEQ ID NO: 534253 - RNA, 19 nt, Homo sapiens
acucauguuucguguguaa

SEQ ID NO: 534254 - RNA, 19 nt, Homo sapiens
gaaaguuaagccagaagga

SEQ ID NO: 534255 - RNA, 19 nt, Homo sapiens
uuacucugcucuuuggaaa

SEQ ID NO: 534256 - RNA, 19 nt, Homo sapiens
acaaggaccguauaauaga

SEQ ID NO: 534257 - RNA, 19 nt, Homo sapiens
cgacaucacccacuucuac

SEQ ID NO: 534258 - RNA, 19 nt, Homo sapiens
ugugugagcugccaugcuu

SEQ ID NO: 534259 - RNA, 19 nt, Homo sapiens
cauguaaaccacugaagaa

SEQ ID NO: 534260 - RNA, 19 nt, Homo sapiens
gaaugaaaugccaauaaca

SEQ ID NO: 534261 - RNA, 19 nt, Homo sapiens
ucccaagggucgcuagaaa

SEQ ID NO: 534262 - RNA, 19 nt, Homo sapiens
gaaaaugaagcacgagauu

SEQ ID NO: 534263 - RNA, 19 nt, Homo sapiens
gauuugugcuaaacuucuu

SEQ ID NO: 534264 - RNA, 19 nt, Homo sapiens
cgaaagugcagacgaaaca

SEQ ID NO: 534265 - RNA, 19 nt, Homo sapiens
gcucuuggguuuagcaaaa

SEQ ID NO: 534266 - RNA, 19 nt, Homo sapiens
aagauuuccucccguaguu

SEQ ID NO: 534267 - RNA, 19 nt, Homo sapiens
ggacaugggguucauugua

SEQ ID NO: 534268 - RNA, 19 nt, Homo sapiens
gaaacugccauugugauca

SEQ ID NO: 534269 - RNA, 19 nt, Homo sapiens
cagcguuccuggacaaaca

SEQ ID NO: 534270 - RNA, 19 nt, Homo sapiens
cagaaagggagaauuuguu

SEQ ID NO: 534271 - RNA, 19 nt, Homo sapiens
acaagcacaucaaggugaa

SEQ ID NO: 534272 - RNA, 19 nt, Homo sapiens
aaacugccauugugaucau

SEQ ID NO: 534273 - RNA, 19 nt, Homo sapiens
uuaauuggcauauggaaug

SEQ ID NO: 534274 - RNA, 19 nt, Homo sapiens
ggacguggaaccagguaug

SEQ ID NO: 534275 - RNA, 19 nt, Homo sapiens
gaaacacaaacugaaguau

SEQ ID NO: 534276 - RNA, 19 nt, Homo sapiens
agagauuugugcuaaacuu

SEQ ID NO: 534277 - RNA, 19 nt, Homo sapiens
uggcaaaccuucgacuuca

SEQ ID NO: 534278 - RNA, 19 nt, Homo sapiens
ggaauguccuuggcaucau

SEQ ID NO: 534279 - RNA, 19 nt, Homo sapiens
gaacgacaucacccacuuc

SEQ ID NO: 534280 - RNA, 19 nt, Homo sapiens
uggaugaaaugauaugucu

SEQ ID NO: 534281 - RNA, 19 nt, Homo sapiens
agaccaagaucaucaagac

SEQ ID NO: 534282 - RNA, 19 nt, Homo sapiens
ccagagaccaagaucauca

SEQ ID NO: 534283 - RNA, 19 nt, Homo sapiens
gaucuacacagcggauauu

SEQ ID NO: 534284 - RNA, 19 nt, Homo sapiens
ggucagagggaucggaaga

SEQ ID NO: 534285 - RNA, 19 nt, Homo sapiens
gccaauaacacguccacuu

SEQ ID NO: 534286 - RNA, 19 nt, Homo sapiens
guauaguuguggacauuua

SEQ ID NO: 534287 - RNA, 19 nt, Homo sapiens
ggacaucucugagcuggau

SEQ ID NO: 534288 - RNA, 19 nt, Homo sapiens
acgcguaggugucuucaua

SEQ ID NO: 534289 - RNA, 19 nt, Homo sapiens
ugaccaauguguccuagaa

SEQ ID NO: 534290 - RNA, 19 nt, Homo sapiens
aaacuugggucccugaaca

SEQ ID NO: 534291 - RNA, 19 nt, Homo sapiens
ggagcagaaucccaacguu

SEQ ID NO: 534292 - RNA, 19 nt, Homo sapiens
cagcucugccuguuuguua

SEQ ID NO: 534293 - RNA, 19 nt, Homo sapiens
ucaaaggcaucccgaagca

SEQ ID NO: 534294 - RNA, 19 nt, Homo sapiens
ucucugagcuggauauggu

SEQ ID NO: 534295 - RNA, 19 nt, Homo sapiens
ggacucaacguuacauuuu

SEQ ID NO: 534296 - RNA, 19 nt, Homo sapiens
gcauuucucugggguauuu

SEQ ID NO: 534297 - RNA, 19 nt, Homo sapiens
guucaagacggccaacaaa

SEQ ID NO: 534298 - RNA, 19 nt, Homo sapiens
aggaaacggugguggagaa

SEQ ID NO: 534299 - RNA, 19 nt, Homo sapiens
gaaggaacgaggugugaag

SEQ ID NO: 534300 - RNA, 19 nt, Homo sapiens
ccuguuuguuagacucuua

SEQ ID NO: 534301 - RNA, 19 nt, Homo sapiens
uugggucccugaacaauga

SEQ ID NO: 534302 - RNA, 19 nt, Homo sapiens
gcgaagcggagaaggaaga

SEQ ID NO: 534303 - RNA, 19 nt, Homo sapiens
uuuaaguucuggaugcauu

SEQ ID NO: 534304 - RNA, 19 nt, Homo sapiens
acaagcccaugaccaaugu

SEQ ID NO: 534305 - RNA, 19 nt, Homo sapiens
caagacggccaacaaaguc

SEQ ID NO: 534306 - RNA, 19 nt, Homo sapiens
ucaagacggccaacaaagu

SEQ ID NO: 534307 - RNA, 19 nt, Homo sapiens
gugugaagcugcuggacau

SEQ ID NO: 534308 - RNA, 19 nt, Homo sapiens
gcacgguggacgagaugaa

SEQ ID NO: 534309 - RNA, 19 nt, Homo sapiens
uaucugaaccauuaaaguc

SEQ ID NO: 534310 - RNA, 19 nt, Homo sapiens
cagcagcagccuaagaaga

SEQ ID NO: 534311 - RNA, 19 nt, Homo sapiens
gcucagcagcagccuaaga

SEQ ID NO: 534312 - RNA, 19 nt, Homo sapiens
gacagucuuuggguaccua

SEQ ID NO: 534313 - RNA, 19 nt, Homo sapiens
ggaaggaacgaggugugaa

SEQ ID NO: 534314 - RNA, 19 nt, Homo sapiens
cagugaagcucaaguugcu

SEQ ID NO: 534315 - RNA, 19 nt, Homo sapiens
gcguaggugucuucauaag

SEQ ID NO: 534316 - RNA, 19 nt, Homo sapiens
aaaggugggugagugugaa

SEQ ID NO: 534317 - RNA, 19 nt, Homo sapiens
ggacacaggcucgcuuaac

SEQ ID NO: 534318 - RNA, 19 nt, Homo sapiens
gacacaggcucgcuuaacc

SEQ ID NO: 534319 - RNA, 19 nt, Homo sapiens
uguuugagaugaacuaugc

SEQ ID NO: 534320 - RNA, 19 nt, Homo sapiens
augcggaggugguggagaa

SEQ ID NO: 534321 - RNA, 19 nt, Homo sapiens
cccaggagauguucaagac

SEQ ID NO: 534322 - RNA, 19 nt, Homo sapiens
guacaagcccaugaccaau

SEQ ID NO: 534323 - RNA, 19 nt, Homo sapiens
gaggcgaagcggagaagga

SEQ ID NO: 534324 - RNA, 19 nt, Homo sapiens
agcagcagccuaagaagaa

SEQ ID NO: 534325 - RNA, 19 nt, Homo sapiens
ugaagcugcuggacaucuc

SEQ ID NO: 534326 - RNA, 19 nt, Homo sapiens
ucccaacguucaggauauu

SEQ ID NO: 534327 - RNA, 19 nt, Homo sapiens
uuguauaguuguggacauu

SEQ ID NO: 534328 - RNA, 19 nt, Homo sapiens
uggacucaacguuacauuu

SEQ ID NO: 534329 - RNA, 19 nt, Homo sapiens
gcccaggagauguucaaga

SEQ ID NO: 534330 - RNA, 19 nt, Homo sapiens
ucgccgacaucuugaaguc

SEQ ID NO: 534331 - RNA, 19 nt, Homo sapiens
uuaaagcggaaacccaaga

SEQ ID NO: 534332 - RNA, 19 nt, Homo sapiens
ugggagaacuuagagaaaa

SEQ ID NO: 534333 - RNA, 19 nt, Homo sapiens
agucuuuggguaccuauuu

SEQ ID NO: 534334 - RNA, 19 nt, Homo sapiens
uacaagcccaugaccaaug

SEQ ID NO: 534335 - RNA, 19 nt, Homo sapiens
ccggacacaggcucgcuua

SEQ ID NO: 534336 - RNA, 19 nt, Homo sapiens
aguacaagcccaugaccaa

SEQ ID NO: 534337 - RNA, 19 nt, Homo sapiens
ucacgagagagcagauguu

SEQ ID NO: 534338 - RNA, 19 nt, Homo sapiens
ggcagugaagcucaaguug

SEQ ID NO: 534339 - RNA, 19 nt, Homo sapiens
ccacgaaccugcuuacaga

SEQ ID NO: 534340 - RNA, 19 nt, Homo sapiens
gaccugcgcuuccucauga

SEQ ID NO: 534341 - RNA, 19 nt, Homo sapiens
gaguuuggauguuguaaau

SEQ ID NO: 534342 - RNA, 19 nt, Homo sapiens
ccucuucucuccucaguuu

SEQ ID NO: 534343 - RNA, 19 nt, Homo sapiens
ccucaucaguguguaaaua

SEQ ID NO: 534344 - RNA, 19 nt, Homo sapiens
gcguuuaucuucgcuauca

SEQ ID NO: 534345 - RNA, 19 nt, Homo sapiens
caaccgaggcugucgagaa

SEQ ID NO: 534346 - RNA, 19 nt, Homo sapiens
gggcagcugugaugaugug

SEQ ID NO: 534347 - RNA, 19 nt, Homo sapiens
cgagaaaucgcccaacuuc

SEQ ID NO: 534348 - RNA, 19 nt, Homo sapiens
aaccgaggcugucgagaaa

SEQ ID NO: 534349 - RNA, 19 nt, Homo sapiens
cuaagucccuuccuauucu

SEQ ID NO: 534350 - RNA, 19 nt, Homo sapiens
gauacagagccacgaguuu

SEQ ID NO: 534351 - RNA, 19 nt, Homo sapiens
ccgaguaccuccagucaca

SEQ ID NO: 534352 - RNA, 19 nt, Homo sapiens
cagcugugaugauguggaa

SEQ ID NO: 534353 - RNA, 19 nt, Homo sapiens
ucagaagguuccaucgaau

SEQ ID NO: 534354 - RNA, 19 nt, Homo sapiens
caaacagcggcgucugaua

SEQ ID NO: 534355 - RNA, 19 nt, Homo sapiens
ggauacagagccacgaguu

SEQ ID NO: 534356 - RNA, 19 nt, Homo sapiens
ucgaugacuugguggcuuu

SEQ ID NO: 534357 - RNA, 19 nt, Homo sapiens
acugaaacguggauacaga

SEQ ID NO: 534358 - RNA, 19 nt, Homo sapiens
gcacugaaacguggauaca

SEQ ID NO: 534359 - RNA, 19 nt, Homo sapiens
ccuccuaagucccuuccua

SEQ ID NO: 534360 - RNA, 19 nt, Homo sapiens
caucuuccucugcagaaua

SEQ ID NO: 534361 - RNA, 19 nt, Homo sapiens
gugaugauguggaaaugag

SEQ ID NO: 534362 - RNA, 19 nt, Homo sapiens
ggacuccucaaaccacuug

SEQ ID NO: 534363 - RNA, 19 nt, Homo sapiens
ccacgaguuuggauguugu

SEQ ID NO: 534364 - RNA, 19 nt, Homo sapiens
cgaccucucugccucucuu

SEQ ID NO: 534365 - RNA, 19 nt, Homo sapiens
caucccaucucucccacuu

SEQ ID NO: 534366 - RNA, 19 nt, Homo sapiens
cucagaagguuccaucgaa

SEQ ID NO: 534367 - RNA, 19 nt, Homo sapiens
gcacucaagacccgguuau

SEQ ID NO: 534368 - RNA, 19 nt, Homo sapiens
aaacagcggcgucugauac

SEQ ID NO: 534369 - RNA, 19 nt, Homo sapiens
gaaucaguauuuccuucca

SEQ ID NO: 534370 - RNA, 19 nt, Homo sapiens
gcaaacagcggcgucugau

SEQ ID NO: 534371 - RNA, 19 nt, Homo sapiens
aguauuuccuuccacugua

SEQ ID NO: 534372 - RNA, 19 nt, Homo sapiens
caaucccucuccacucuuc

SEQ ID NO: 534373 - RNA, 19 nt, Homo sapiens
gggcugcagcgacaacauu

SEQ ID NO: 534374 - RNA, 19 nt, Homo sapiens
ccaccaguguagcaucuuc

SEQ ID NO: 534375 - RNA, 19 nt, Homo sapiens
guauuuccuuccacuguag

SEQ ID NO: 534376 - RNA, 19 nt, Homo sapiens
gcguuugccuccuggaauc

SEQ ID NO: 534377 - RNA, 19 nt, Homo sapiens
gccacgaguuuggauguug

SEQ ID NO: 534378 - RNA, 19 nt, Homo sapiens
ggaccugcgcuuccucaug

SEQ ID NO: 534379 - RNA, 19 nt, Homo sapiens
ccacucuucucuccuuucu

SEQ ID NO: 534380 - RNA, 19 nt, Homo sapiens
ccuaagucccuuccuauuc

SEQ ID NO: 534381 - RNA, 19 nt, Homo sapiens
ccuccuggaaucaguauuu

SEQ ID NO: 534382 - RNA, 19 nt, Homo sapiens
caaaagggcagcugugaug

SEQ ID NO: 534383 - RNA, 19 nt, Homo sapiens
cagacucgcuagcacucaa

SEQ ID NO: 534384 - RNA, 19 nt, Homo sapiens
cccaaucccucuccacucu

SEQ ID NO: 534385 - RNA, 19 nt, Homo sapiens
ccaaacagacucgcuagca

SEQ ID NO: 534386 - RNA, 19 nt, Homo sapiens
gaauccagaacacaaccuu

SEQ ID NO: 534387 - RNA, 19 nt, Homo sapiens
aagggcagcugugaugaug

SEQ ID NO: 534388 - RNA, 19 nt, Homo sapiens
guacugcacgagugucugu

SEQ ID NO: 534389 - RNA, 19 nt, Homo sapiens
gcagcgacaacauugacuu

SEQ ID NO: 534390 - RNA, 19 nt, Homo sapiens
gcucagaagguuccaucga

SEQ ID NO: 534391 - RNA, 19 nt, Homo sapiens
cuccucaguuucucaaaga

SEQ ID NO: 534392 - RNA, 19 nt, Homo sapiens
caagagucugcaacuggua

SEQ ID NO: 534393 - RNA, 19 nt, Homo sapiens
gagccacgaguuuggaugu

SEQ ID NO: 534394 - RNA, 19 nt, Homo sapiens
auacagagccacgaguuug

SEQ ID NO: 534395 - RNA, 19 nt, Homo sapiens
gcugugaugauguggaaau

SEQ ID NO: 534396 - RNA, 19 nt, Homo sapiens
ucuccacucuucucuccuu

SEQ ID NO: 534397 - RNA, 19 nt, Homo sapiens
gcaucuuccucugcagaau

SEQ ID NO: 534398 - RNA, 19 nt, Homo sapiens
uagcugaagcaggagguua

SEQ ID NO: 534399 - RNA, 19 nt, Homo sapiens
cgaguuuggauguuguaaa

SEQ ID NO: 534400 - RNA, 19 nt, Homo sapiens
cggcguuuaucuucgcuau

SEQ ID NO: 534401 - RNA, 19 nt, Homo sapiens
uugcaaagaccaccuccaa

SEQ ID NO: 534402 - RNA, 19 nt, Homo sapiens
cacgucagcugccgcaacu

SEQ ID NO: 534403 - RNA, 19 nt, Homo sapiens
guaauuaccuggagaagaa

SEQ ID NO: 534404 - RNA, 19 nt, Homo sapiens
ccacaaauggucccaauua

SEQ ID NO: 534405 - RNA, 19 nt, Homo sapiens
ggacagcugugaagucaug

SEQ ID NO: 534406 - RNA, 19 nt, Homo sapiens
caagaacacuggaccuuug

SEQ ID NO: 534407 - RNA, 19 nt, Homo sapiens
cgaguucucuuuggaaaua

SEQ ID NO: 534408 - RNA, 19 nt, Homo sapiens
ugaauggucuggcaauauu

SEQ ID NO: 534409 - RNA, 19 nt, Homo sapiens
caaauggucccaauuaaga

SEQ ID NO: 534410 - RNA, 19 nt, Homo sapiens
ggagaagaauggcuuucaa

SEQ ID NO: 534411 - RNA, 19 nt, Homo sapiens
gaugaauggucuggcaaua

SEQ ID NO: 534412 - RNA, 19 nt, Homo sapiens
guaaagcgguucuugaaac

SEQ ID NO: 534413 - RNA, 19 nt, Homo sapiens
gggaaucugccuuuguuua

SEQ ID NO: 534414 - RNA, 19 nt, Homo sapiens
gauggaauaucagaaguau

SEQ ID NO: 534415 - RNA, 19 nt, Homo sapiens
gcgauuaucucuggaggaa

SEQ ID NO: 534416 - RNA, 19 nt, Homo sapiens
cacaaauggucccaauuaa

SEQ ID NO: 534417 - RNA, 19 nt, Homo sapiens
gaagaauggcuuucaauac

SEQ ID NO: 534418 - RNA, 19 nt, Homo sapiens
ccagagcccugaugaaucu

SEQ ID NO: 534419 - RNA, 19 nt, Homo sapiens
ggaaucugccuuuguuuau

SEQ ID NO: 534420 - RNA, 19 nt, Homo sapiens
gguccgggcuggccuuuau

SEQ ID NO: 534421 - RNA, 19 nt, Homo sapiens
gcaagaacacuggaccuuu

SEQ ID NO: 534422 - RNA, 19 nt, Homo sapiens
gauuaucucuggaggaagu

SEQ ID NO: 534423 - RNA, 19 nt, Homo sapiens
gcaaaggaaaggaaaggaa

SEQ ID NO: 534424 - RNA, 19 nt, Homo sapiens
gugauaacauugacuaugg

SEQ ID NO: 534425 - RNA, 19 nt, Homo sapiens
gcagugauaacauugacua

SEQ ID NO: 534426 - RNA, 19 nt, Homo sapiens
ucucucagauggaacagua

SEQ ID NO: 534427 - RNA, 19 nt, Homo sapiens
caaaggaaaggaaaggaaa

SEQ ID NO: 534428 - RNA, 19 nt, Homo sapiens
gaugugaugcgugccauua

SEQ ID NO: 534429 - RNA, 19 nt, Homo sapiens
uaugguguguuguaucuuu

SEQ ID NO: 534430 - RNA, 19 nt, Homo sapiens
ccuaaagccuacccuauuc

SEQ ID NO: 534431 - RNA, 19 nt, Homo sapiens
gcauguggccuuuaucuca

SEQ ID NO: 534432 - RNA, 19 nt, Homo sapiens
gaaucugccuuuguuuaug

SEQ ID NO: 534433 - RNA, 19 nt, Homo sapiens
guacuaugguguguuguau

SEQ ID NO: 534434 - RNA, 19 nt, Homo sapiens
agaagaauggcuuucaaua

SEQ ID NO: 534435 - RNA, 19 nt, Homo sapiens
ugacguuucuucuuucuag

SEQ ID NO: 534436 - RNA, 19 nt, Homo sapiens
uaaagcgguucuugaaaca

SEQ ID NO: 534437 - RNA, 19 nt, Homo sapiens
ggaguuguauuugccauca

SEQ ID NO: 534438 - RNA, 19 nt, Homo sapiens
ggauggaauaucagaagua

SEQ ID NO: 534439 - RNA, 19 nt, Homo sapiens
gaggucaacucuucauggu

SEQ ID NO: 534440 - RNA, 19 nt, Homo sapiens
gccacacgcugcaccuaaa

SEQ ID NO: 534441 - RNA, 19 nt, Homo sapiens
cucaaugucuucccacaaa

SEQ ID NO: 534442 - RNA, 19 nt, Homo sapiens
ggcaauauucuguaacuau

SEQ ID NO: 534443 - RNA, 19 nt, Homo sapiens
gagaagaauggcuuucaau

SEQ ID NO: 534444 - RNA, 19 nt, Homo sapiens
cuuagaaucugaagggaau

SEQ ID NO: 534445 - RNA, 19 nt, Homo sapiens
gcaguuggccaagcagaaa

SEQ ID NO: 534446 - RNA, 19 nt, Homo sapiens
ccacccaccuugacguuuc

SEQ ID NO: 534447 - RNA, 19 nt, Homo sapiens
cauuggaucugcaagaaca

SEQ ID NO: 534448 - RNA, 19 nt, Homo sapiens
ggaaaggaaaggaaaggau

SEQ ID NO: 534449 - RNA, 19 nt, Homo sapiens
uuuaguggauggaauauca

SEQ ID NO: 534450 - RNA, 19 nt, Homo sapiens
aaagaaagcagaaucaacu

SEQ ID NO: 534451 - RNA, 19 nt, Homo sapiens
ggcgaguucucuuuggaaa

SEQ ID NO: 534452 - RNA, 19 nt, Homo sapiens
ucgggaaucugccuuuguu

SEQ ID NO: 534453 - RNA, 19 nt, Homo sapiens
ccagggugaugugcgauaa

SEQ ID NO: 534454 - RNA, 19 nt, Homo sapiens
ggagcuuucucaaugucuu

SEQ ID NO: 534455 - RNA, 19 nt, Homo sapiens
ggauugcuuugcauuacug

SEQ ID NO: 534456 - RNA, 19 nt, Homo sapiens
cuaacgagagguuuaagaa

SEQ ID NO: 534457 - RNA, 19 nt, Homo sapiens
uggcugcagugauaacauu

SEQ ID NO: 534458 - RNA, 19 nt, Homo sapiens
gaaucugaagggaauuaaa

SEQ ID NO: 534459 - RNA, 19 nt, Homo sapiens
gguguguuguaucuuugua

SEQ ID NO: 534460 - RNA, 19 nt, Homo sapiens
gguacuaugguguguugua

SEQ ID NO: 534461 - RNA, 19 nt, Homo sapiens
guaaagaaagcagaaucaa

SEQ ID NO: 534462 - RNA, 19 nt, Homo sapiens
cauguggccuuuaucucaa

SEQ ID NO: 534463 - RNA, 19 nt, Homo sapiens
gauauuuccuaaggcaugu

SEQ ID NO: 534464 - RNA, 19 nt, Homo sapiens
ccauccaccuucccuucua

SEQ ID NO: 534465 - RNA, 19 nt, Homo sapiens
uaaagccuacccuauucua

SEQ ID NO: 534466 - RNA, 19 nt, Homo sapiens
gcuguaaagcgguucuuga

SEQ ID NO: 534467 - RNA, 19 nt, Homo sapiens
ugacuaugggaucaaauuu

SEQ ID NO: 534468 - RNA, 19 nt, Homo sapiens
auacuucucucagauggaa

SEQ ID NO: 534469 - RNA, 19 nt, Homo sapiens
uagaaucugaagggaauua

SEQ ID NO: 534470 - RNA, 19 nt, Homo sapiens
aagaauggcuuucaauacc

SEQ ID NO: 534471 - RNA, 19 nt, Homo sapiens
agauggaacaguaaagaaa

SEQ ID NO: 534472 - RNA, 19 nt, Homo sapiens
cagaaugccagcaccaguu

SEQ ID NO: 534473 - RNA, 19 nt, Homo sapiens
ccauccagguggucaugaa

SEQ ID NO: 534474 - RNA, 19 nt, Homo sapiens
gacuaugggaucaaauuug

SEQ ID NO: 534475 - RNA, 19 nt, Homo sapiens
ccuggaagcucuggaugug

SEQ ID NO: 534476 - RNA, 19 nt, Homo sapiens
gcuaacgagagguuuaaga

SEQ ID NO: 534477 - RNA, 19 nt, Homo sapiens
cacggagucugaccugaug

SEQ ID NO: 534478 - RNA, 19 nt, Homo sapiens
ggucuggcaauauucugua

SEQ ID NO: 534479 - RNA, 19 nt, Homo sapiens
gauggaacaguaaagaaag

SEQ ID NO: 534480 - RNA, 19 nt, Homo sapiens
ucacccggaugaccaagug

SEQ ID NO: 534481 - RNA, 19 nt, Homo sapiens
ggccacacgcugcaccuaa

SEQ ID NO: 534482 - RNA, 19 nt, Homo sapiens
uaaagaaagcagaaucaac

SEQ ID NO: 534483 - RNA, 19 nt, Homo sapiens
cagauggaacaguaaagaa

SEQ ID NO: 534484 - RNA, 19 nt, Homo sapiens
ucaaugucuucccacaaau

SEQ ID NO: 534485 - RNA, 19 nt, Homo sapiens
ucuccagacuacuguauca

SEQ ID NO: 534486 - RNA, 19 nt, Homo sapiens
gguuuaagaagccaacgaa

SEQ ID NO: 534487 - RNA, 19 nt, Homo sapiens
ggaugcaaaggaaaggaaa

SEQ ID NO: 534488 - RNA, 19 nt, Homo sapiens
ucagauggaacaguaaaga

SEQ ID NO: 534489 - RNA, 19 nt, Homo sapiens
gggcauggacagcugugaa

SEQ ID NO: 534490 - RNA, 19 nt, Homo sapiens
cagcuggaguuguauuugc

SEQ ID NO: 534491 - RNA, 19 nt, Homo sapiens
uagagcaguuggccaagca

SEQ ID NO: 534492 - RNA, 19 nt, Homo sapiens
ggugaugugcgauaaugug

SEQ ID NO: 534493 - RNA, 19 nt, Homo sapiens
gggauugcuuugcauuacu

SEQ ID NO: 534494 - RNA, 19 nt, Homo sapiens
acaaauggucccaauuaag

SEQ ID NO: 534495 - RNA, 19 nt, Homo sapiens
caaugucuucccacaaaug

SEQ ID NO: 534496 - RNA, 19 nt, Homo sapiens
gaugccagagcccugauga

SEQ ID NO: 534497 - RNA, 19 nt, Homo sapiens
caaggacagcaaaggcauu

SEQ ID NO: 534498 - RNA, 19 nt, Homo sapiens
accuugacguuucuucuuu

SEQ ID NO: 534499 - RNA, 19 nt, Homo sapiens
caaguguggguguaaguuc

SEQ ID NO: 534500 - RNA, 19 nt, Homo sapiens
uaacgagagguuuaagaag

SEQ ID NO: 534501 - RNA, 19 nt, Homo sapiens
gggugaauaugguggaaaa

SEQ ID NO: 534502 - RNA, 19 nt, Homo sapiens
acuaugguguguuguaucu

SEQ ID NO: 534503 - RNA, 19 nt, Homo sapiens
gaacagaccugaggcuuau

SEQ ID NO: 534504 - RNA, 19 nt, Homo sapiens
gcaauuacaucgagaucau

SEQ ID NO: 534505 - RNA, 19 nt, Homo sapiens
ggaacagaccugaggcuua

SEQ ID NO: 534506 - RNA, 19 nt, Homo sapiens
ggacuuuguuccaacuauu

SEQ ID NO: 534507 - RNA, 19 nt, Homo sapiens
gaacugcaccaccauagau

SEQ ID NO: 534508 - RNA, 19 nt, Homo sapiens
ggaccggacuugcaauguc

SEQ ID NO: 534509 - RNA, 19 nt, Homo sapiens
gaccugaggcuuaucuuug

SEQ ID NO: 534510 - RNA, 19 nt, Homo sapiens
ggcugugacucgcaucaua

SEQ ID NO: 534511 - RNA, 19 nt, Homo sapiens
gaccggacuugcaauguca

SEQ ID NO: 534512 - RNA, 19 nt, Homo sapiens
ccucggagaugguaguaga

SEQ ID NO: 534513 - RNA, 19 nt, Homo sapiens
ccgcacgcgugguaaauga

SEQ ID NO: 534514 - RNA, 19 nt, Homo sapiens
aaagucauuuccaaucuca

SEQ ID NO: 534515 - RNA, 19 nt, Homo sapiens
gcugugacucgcaucauaa

SEQ ID NO: 534516 - RNA, 19 nt, Homo sapiens
ggacggagaagcggaagga

SEQ ID NO: 534517 - RNA, 19 nt, Homo sapiens
gcuuaucuuugcacauguu

SEQ ID NO: 534518 - RNA, 19 nt, Homo sapiens
gacaagcccgaaagucauu

SEQ ID NO: 534519 - RNA, 19 nt, Homo sapiens
gccaaguacucgcucuuca

SEQ ID NO: 534520 - RNA, 19 nt, Homo sapiens
gcucggccaugaacaagca

SEQ ID NO: 534521 - RNA, 19 nt, Homo sapiens
ggaacugcaccaccauaga

SEQ ID NO: 534522 - RNA, 19 nt, Homo sapiens
ucucucaucuuacauuucu

SEQ ID NO: 534523 - RNA, 19 nt, Homo sapiens
ugaacaagcacaacaacga

SEQ ID NO: 534524 - RNA, 19 nt, Homo sapiens
acacaucucugggcucaca

SEQ ID NO: 534525 - RNA, 19 nt, Homo sapiens
aggcuuaucuuugcacaug

SEQ ID NO: 534526 - RNA, 19 nt, Homo sapiens
ugacagcgccucggagaug

SEQ ID NO: 534527 - RNA, 19 nt, Homo sapiens
cgacuauccuggaccacau

SEQ ID NO: 534528 - RNA, 19 nt, Homo sapiens
ccagagacggguuccuuug

SEQ ID NO: 534529 - RNA, 19 nt, Homo sapiens
ggagaugguaguagagaag

SEQ ID NO: 534530 - RNA, 19 nt, Homo sapiens
ggaguguauucgcaucuac

SEQ ID NO: 534531 - RNA, 19 nt, Homo sapiens
ccacaugcaccucaaaugc

SEQ ID NO: 534532 - RNA, 19 nt, Homo sapiens
ucucucucaucuuacauuu

SEQ ID NO: 534533 - RNA, 19 nt, Homo sapiens
gggaaggggugaagugugu

SEQ ID NO: 534534 - RNA, 19 nt, Homo sapiens
ccaaguacucgcucuucaa

SEQ ID NO: 534535 - RNA, 19 nt, Homo sapiens
ugacagccuggccaucuuu

SEQ ID NO: 534536 - RNA, 19 nt, Homo sapiens
caaguacucgcucuucaag

SEQ ID NO: 534537 - RNA, 19 nt, Homo sapiens
ggaccacaugcaccucaaa

SEQ ID NO: 534538 - RNA, 19 nt, Homo sapiens
uuaguucucuagggucuga

SEQ ID NO: 534539 - RNA, 19 nt, Homo sapiens
guagagaagcaccgugagu

SEQ ID NO: 534540 - RNA, 19 nt, Homo sapiens
gggcagcugugaggugaag

SEQ ID NO: 534541 - RNA, 19 nt, Homo sapiens
ucucuagggucugauagga

SEQ ID NO: 534542 - RNA, 19 nt, Homo sapiens
cggagaugguaguagagaa

SEQ ID NO: 534543 - RNA, 19 nt, Homo sapiens
gaccacaugcaccucaaau

SEQ ID NO: 534544 - RNA, 19 nt, Homo sapiens
gcgagucggccuucguuca

SEQ ID NO: 534545 - RNA, 19 nt, Homo sapiens
cucgcuggcuacccaauuu

SEQ ID NO: 534546 - RNA, 19 nt, Homo sapiens
uuacauuucucacccuacu

SEQ ID NO: 534547 - RNA, 19 nt, Homo sapiens
gacuuuguuccaacuauug

SEQ ID NO: 534548 - RNA, 19 nt, Homo sapiens
ccaugaacaagcacaacaa

SEQ ID NO: 534549 - RNA, 19 nt, Homo sapiens
agaccugaggcuuaucuuu

SEQ ID NO: 534550 - RNA, 19 nt, Homo sapiens
ugacuucggcguguuagug

SEQ ID NO: 534551 - RNA, 19 nt, Homo sapiens
guguguggcugggcggauu

SEQ ID NO: 534552 - RNA, 19 nt, Homo sapiens
gcgugaagcugggcaucca

SEQ ID NO: 534553 - RNA, 19 nt, Homo sapiens
gaacuuggcuaauggaauu

SEQ ID NO: 534554 - RNA, 19 nt, Homo sapiens
gaagcaaccucguuucuga

SEQ ID NO: 534555 - RNA, 19 nt, Homo sapiens
gaaaacaguucacuacuua

SEQ ID NO: 534556 - RNA, 19 nt, Homo sapiens
gagguuggcuugaacauaa

SEQ ID NO: 534557 - RNA, 19 nt, Homo sapiens
gaaagagggugguagaaau

SEQ ID NO: 534558 - RNA, 19 nt, Homo sapiens
gaauaacccuguucagaug

SEQ ID NO: 534559 - RNA, 19 nt, Homo sapiens
gggcauuacuuguucguua

SEQ ID NO: 534560 - RNA, 19 nt, Homo sapiens
ccaaacaggccaucaaaua

SEQ ID NO: 534561 - RNA, 19 nt, Homo sapiens
uaacacauacccuaacuua

SEQ ID NO: 534562 - RNA, 19 nt, Homo sapiens
ggacaccucuuuccaaaca

SEQ ID NO: 534563 - RNA, 19 nt, Homo sapiens
gaaauaacacauacccuaa

SEQ ID NO: 534564 - RNA, 19 nt, Homo sapiens
uaaauucucuggugcaaga

SEQ ID NO: 534565 - RNA, 19 nt, Homo sapiens
ugacagaacuuggcuaaug

SEQ ID NO: 534566 - RNA, 19 nt, Homo sapiens
agaacucugugguuuauua

SEQ ID NO: 534567 - RNA, 19 nt, Homo sapiens
ccaaauggaagauagaaua

SEQ ID NO: 534568 - RNA, 19 nt, Homo sapiens
ugaagagaguugaguuuaa

SEQ ID NO: 534569 - RNA, 19 nt, Homo sapiens
gaagacaggcaucaaagaa

SEQ ID NO: 534570 - RNA, 19 nt, Homo sapiens
caacuguggcucuuaauuu

SEQ ID NO: 534571 - RNA, 19 nt, Homo sapiens
ucgaaaggcuuauuccaaa

SEQ ID NO: 534572 - RNA, 19 nt, Homo sapiens
caaaagaucuugaaagcaa

SEQ ID NO: 534573 - RNA, 19 nt, Homo sapiens
gcagacagaccgucauauu

SEQ ID NO: 534574 - RNA, 19 nt, Homo sapiens
ggaaacccaugccuauuag

SEQ ID NO: 534575 - RNA, 19 nt, Homo sapiens
gauaaaaggucuugggaaa

SEQ ID NO: 534576 - RNA, 19 nt, Homo sapiens
uaagaacucugugguuuau

SEQ ID NO: 534577 - RNA, 19 nt, Homo sapiens
gcucguaaacugauuauga

SEQ ID NO: 534578 - RNA, 19 nt, Homo sapiens
gaagagaguugaguuuaac

SEQ ID NO: 534579 - RNA, 19 nt, Homo sapiens
ggagagggcauuacuuguu

SEQ ID NO: 534580 - RNA, 19 nt, Homo sapiens
gauccuguguuuagauuau

SEQ ID NO: 534581 - RNA, 19 nt, Homo sapiens
uccagaagguaaagaaaua

SEQ ID NO: 534582 - RNA, 19 nt, Homo sapiens
gagagggcauuacuuguuc

SEQ ID NO: 534583 - RNA, 19 nt, Homo sapiens
gaaauccaccuuccucuuc

SEQ ID NO: 534584 - RNA, 19 nt, Homo sapiens
gagcagacaaccuauuuga

SEQ ID NO: 534585 - RNA, 19 nt, Homo sapiens
guacacauccagaagguaa

SEQ ID NO: 534586 - RNA, 19 nt, Homo sapiens
caacuguggcucuuuaauu

SEQ ID NO: 534587 - RNA, 19 nt, Homo sapiens
caaacaggccaucaaauau

SEQ ID NO: 534588 - RNA, 19 nt, Homo sapiens
gaagaaacugugccacuug

SEQ ID NO: 534589 - RNA, 19 nt, Homo sapiens
ucuaagaacucugugguuu

SEQ ID NO: 534590 - RNA, 19 nt, Homo sapiens
gcacagcaccaacuagaga

SEQ ID NO: 534591 - RNA, 19 nt, Homo sapiens
acauggacguuaagagaua

SEQ ID NO: 534592 - RNA, 19 nt, Homo sapiens
aacuguggcucuuaauuua

SEQ ID NO: 534593 - RNA, 19 nt, Homo sapiens
gacagaccgucauauucua

SEQ ID NO: 534594 - RNA, 19 nt, Homo sapiens
gaaacugugccacuuguau

SEQ ID NO: 534595 - RNA, 19 nt, Homo sapiens
uggaaacccaugccuauua

SEQ ID NO: 534596 - RNA, 19 nt, Homo sapiens
ucaugaaccugcacaacaa

SEQ ID NO: 534597 - RNA, 19 nt, Homo sapiens
guucagaugucagaaguau

SEQ ID NO: 534598 - RNA, 19 nt, Homo sapiens
gaaaggcuuauuccaaaug

SEQ ID NO: 534599 - RNA, 19 nt, Homo sapiens
gcagugaauugugagcaaa

SEQ ID NO: 534600 - RNA, 19 nt, Homo sapiens
uuauagacauggacguuaa

SEQ ID NO: 534601 - RNA, 19 nt, Homo sapiens
ggaaaacaguucacuacuu

SEQ ID NO: 534602 - RNA, 19 nt, Homo sapiens
ggagaucguggaccaguuu

SEQ ID NO: 534603 - RNA, 19 nt, Homo sapiens
gcgagacggccuucacaua

SEQ ID NO: 534604 - RNA, 19 nt, Homo sapiens
caucaaagaaugccaguau

SEQ ID NO: 534605 - RNA, 19 nt, Homo sapiens
agacaggcaucaaagaaug

SEQ ID NO: 534606 - RNA, 19 nt, Homo sapiens
gagaagcgcagucaaucaa

SEQ ID NO: 534607 - RNA, 19 nt, Homo sapiens
aacuguggcucuuuaauuu

SEQ ID NO: 534608 - RNA, 19 nt, Homo sapiens
gaagcgcagucaaucaaca

SEQ ID NO: 534609 - RNA, 19 nt, Homo sapiens
gaauugagacacguuugua

SEQ ID NO: 534610 - RNA, 19 nt, Homo sapiens
gccaucaaauauguucuua

SEQ ID NO: 534611 - RNA, 19 nt, Homo sapiens
agccagugauuuagauuua

SEQ ID NO: 534612 - RNA, 19 nt, Homo sapiens
gcagcggguuccugaguga

SEQ ID NO: 534613 - RNA, 19 nt, Homo sapiens
gagcacagcaccaacuaga

SEQ ID NO: 534614 - RNA, 19 nt, Homo sapiens
uuaauaaggacaccucuuu

SEQ ID NO: 534615 - RNA, 19 nt, Homo sapiens
ccugauaucucaaagucuu

SEQ ID NO: 534616 - RNA, 19 nt, Homo sapiens
uaggagcucugcuuggaaa

SEQ ID NO: 534617 - RNA, 19 nt, Homo sapiens
gugaugcccugaaggagaa

SEQ ID NO: 534618 - RNA, 19 nt, Homo sapiens
gcauaaugauauucacauc

SEQ ID NO: 534619 - RNA, 19 nt, Homo sapiens
ccaguguacuugaacaguu

SEQ ID NO: 534620 - RNA, 19 nt, Homo sapiens
gaaaguccccagaaauuaa

SEQ ID NO: 534621 - RNA, 19 nt, Homo sapiens
aaagguauaucacaugucu

SEQ ID NO: 534622 - RNA, 19 nt, Homo sapiens
cuaagaacucugugguuua

SEQ ID NO: 534623 - RNA, 19 nt, Homo sapiens
cccaggacccgcuuauuua

SEQ ID NO: 534624 - RNA, 19 nt, Homo sapiens
ucagaugucagaaguauau

SEQ ID NO: 534625 - RNA, 19 nt, Homo sapiens
gccuauaucuugccaucaa

SEQ ID NO: 534626 - RNA, 19 nt, Homo sapiens
acaaacaucgaaaggcuua

SEQ ID NO: 534627 - RNA, 19 nt, Homo sapiens
caaccuccauuucuguuca

SEQ ID NO: 534628 - RNA, 19 nt, Homo sapiens
gacagaacuuggcuaaugg

SEQ ID NO: 534629 - RNA, 19 nt, Homo sapiens
uagcuugcuuucugcauuu

SEQ ID NO: 534630 - RNA, 19 nt, Homo sapiens
gagagggaauaaacaucuu

SEQ ID NO: 534631 - RNA, 19 nt, Homo sapiens
cuacaugucauucagauau

SEQ ID NO: 534632 - RNA, 19 nt, Homo sapiens
guuuaacaauccuagcuuu

SEQ ID NO: 534633 - RNA, 19 nt, Homo sapiens
aaggacaccucuuuccaaa

SEQ ID NO: 534634 - RNA, 19 nt, Homo sapiens
cagagcagacaaccuauuu

SEQ ID NO: 534635 - RNA, 19 nt, Homo sapiens
ggaaaguccccagaaauua

SEQ ID NO: 534636 - RNA, 19 nt, Homo sapiens
uauaucacaugucucauuc

SEQ ID NO: 534637 - RNA, 19 nt, Homo sapiens
guauaucacaugucucauu

SEQ ID NO: 534638 - RNA, 19 nt, Homo sapiens
gcugcuagcuugcuuucug

SEQ ID NO: 534639 - RNA, 19 nt, Homo sapiens
gacuauggcuaccgcuuug

SEQ ID NO: 534640 - RNA, 19 nt, Homo sapiens
cgaaaggcuuauuccaaau

SEQ ID NO: 534641 - RNA, 19 nt, Homo sapiens
gcauaaugauauccacauc

SEQ ID NO: 534642 - RNA, 19 nt, Homo sapiens
aaacaggccaucaaauaug

SEQ ID NO: 534643 - RNA, 19 nt, Homo sapiens
ggaauucacagagguguug

SEQ ID NO: 534644 - RNA, 19 nt, Homo sapiens
caccagagcagacaaccua

SEQ ID NO: 534645 - RNA, 19 nt, Homo sapiens
ggaggaaaguccccagaaa

SEQ ID NO: 534646 - RNA, 19 nt, Homo sapiens
guacagugauucugguuuu

SEQ ID NO: 534647 - RNA, 19 nt, Homo sapiens
ggacugagcacagcaccaa

SEQ ID NO: 534648 - RNA, 19 nt, Homo sapiens
gcgacaacaucgacuaugg

SEQ ID NO: 534649 - RNA, 19 nt, Homo sapiens
ggcauuacuuguucguuau

SEQ ID NO: 534650 - RNA, 19 nt, Homo sapiens
guuaugauccuguguuuag

SEQ ID NO: 534651 - RNA, 19 nt, Homo sapiens
gcaguaguuuucuauguuu

SEQ ID NO: 534652 - RNA, 19 nt, Homo sapiens
gaagcuguuauaagaauug

SEQ ID NO: 534653 - RNA, 19 nt, Homo sapiens
ggagacggccuucguguuc

SEQ ID NO: 534654 - RNA, 19 nt, Homo sapiens
gcgugcagcucgaagagaa

SEQ ID NO: 534655 - RNA, 19 nt, Homo sapiens
ccacuggugcugcguagua

SEQ ID NO: 534656 - RNA, 19 nt, Homo sapiens
gagaagucgaggcucuuua

SEQ ID NO: 534657 - RNA, 19 nt, Homo sapiens
ggaagugguggcagagcua

SEQ ID NO: 534658 - RNA, 19 nt, Homo sapiens
gagagugccaguuccaguu

SEQ ID NO: 534659 - RNA, 19 nt, Homo sapiens
gagguuaguaucaauaaag

SEQ ID NO: 534660 - RNA, 19 nt, Homo sapiens
ggugagguuaguaucaaua

SEQ ID NO: 534661 - RNA, 19 nt, Homo sapiens
agucgaggcucuuuaugga

SEQ ID NO: 534662 - RNA, 19 nt, Homo sapiens
ggucgcgccugcaauagca

SEQ ID NO: 534663 - RNA, 19 nt, Homo sapiens
gaacugcuggccacaggau

SEQ ID NO: 534664 - RNA, 19 nt, Homo sapiens
gcgaggggcuugagaggaa

SEQ ID NO: 534665 - RNA, 19 nt, Homo sapiens
acgcaggccuguucuaugg

SEQ ID NO: 534666 - RNA, 19 nt, Homo sapiens
gauggugggugagguuagu

SEQ ID NO: 534667 - RNA, 19 nt, Homo sapiens
gucuaaaggccucuggaua

SEQ ID NO: 534668 - RNA, 19 nt, Homo sapiens
gaagucgaggcucuuuaug

SEQ ID NO: 534669 - RNA, 19 nt, Homo sapiens
gugagguuaguaucaauaa

SEQ ID NO: 534670 - RNA, 19 nt, Homo sapiens
cagaagcugccuccauuuc

SEQ ID NO: 534671 - RNA, 19 nt, Homo sapiens
cuaaaggccucuggauacu

SEQ ID NO: 534672 - RNA, 19 nt, Homo sapiens
ucuaaaggccucuggauac

SEQ ID NO: 534673 - RNA, 19 nt, Homo sapiens
agaagucgaggcucuuuau

SEQ ID NO: 534674 - RNA, 19 nt, Homo sapiens
gggagacggccuucguguu

SEQ ID NO: 534675 - RNA, 19 nt, Homo sapiens
guagggcggucacgaugcu

SEQ ID NO: 534676 - RNA, 19 nt, Homo sapiens
cgagaagucgaggcucuuu

SEQ ID NO: 534677 - RNA, 19 nt, Homo sapiens
ccacagcaaggccuuugga

SEQ ID NO: 534678 - RNA, 19 nt, Homo sapiens
gcguuuaaaggacacugua

SEQ ID NO: 534679 - RNA, 19 nt, Homo sapiens
ucacgcaggccuguucuau

SEQ ID NO: 534680 - RNA, 19 nt, Homo sapiens
gggugagguuaguaucaau

SEQ ID NO: 534681 - RNA, 19 nt, Homo sapiens
ugggugagguuaguaucaa

SEQ ID NO: 534682 - RNA, 19 nt, Homo sapiens
ggagaaggcucacaaaugg

SEQ ID NO: 534683 - RNA, 19 nt, Homo sapiens
gcgcaagcaucaucuguaa

SEQ ID NO: 534684 - RNA, 19 nt, Homo sapiens
ucagagcccucaacuauuc

SEQ ID NO: 534685 - RNA, 19 nt, Homo sapiens
ucaagaagccacugucgua

SEQ ID NO: 534686 - RNA, 19 nt, Homo sapiens
gcaagcaucaucuguaaca

SEQ ID NO: 534687 - RNA, 19 nt, Homo sapiens
ccucaucacagcaauauuu

SEQ ID NO: 534688 - RNA, 19 nt, Homo sapiens
ucucagagcccucaacuau

SEQ ID NO: 534689 - RNA, 19 nt, Homo sapiens
gauguacacgugcaaguga

SEQ ID NO: 534690 - RNA, 19 nt, Homo sapiens
gcccucaacuauucuguuc

SEQ ID NO: 534691 - RNA, 19 nt, Homo sapiens
ugggaggacuggaccguuu

SEQ ID NO: 534692 - RNA, 19 nt, Homo sapiens
gcuacaacacccaccagua

SEQ ID NO: 534693 - RNA, 19 nt, Homo sapiens
gcuacgugcucaaggacaa

SEQ ID NO: 534694 - RNA, 19 nt, Homo sapiens
gcugcuaugucaagugcaa

SEQ ID NO: 534695 - RNA, 19 nt, Homo sapiens
cagaaugcccggacucuca

SEQ ID NO: 534696 - RNA, 19 nt, Homo sapiens
ucaugaacuugcacaacaa

SEQ ID NO: 534697 - RNA, 19 nt, Homo sapiens
gcaggaugcugagcuuguc

SEQ ID NO: 534698 - RNA, 19 nt, Homo sapiens
caacgaggcaggccgaaag

SEQ ID NO: 534699 - RNA, 19 nt, Homo sapiens
gcucugggcgcaagcauca

SEQ ID NO: 534700 - RNA, 19 nt, Homo sapiens
cgacuguggcugcgacaaa

SEQ ID NO: 534701 - RNA, 19 nt, Homo sapiens
agaagucgcccaacuacug

SEQ ID NO: 534702 - RNA, 19 nt, Homo sapiens
ggacucucaugaacuugca

SEQ ID NO: 534703 - RNA, 19 nt, Homo sapiens
cccgggagaucaagcagaa

SEQ ID NO: 534704 - RNA, 19 nt, Homo sapiens
cucaugaacuugcacaaca

SEQ ID NO: 534705 - RNA, 19 nt, Homo sapiens
agcaucaucuguaacaaga

SEQ ID NO: 534706 - RNA, 19 nt, Homo sapiens
cuacaacacccaccaguac

SEQ ID NO: 534707 - RNA, 19 nt, Homo sapiens
uggcuucuccucaguggua

SEQ ID NO: 534708 - RNA, 19 nt, Homo sapiens
aggagaaggcucacaaaug

SEQ ID NO: 534709 - RNA, 19 nt, Homo sapiens
cauaggagaaggcucacaa

SEQ ID NO: 534710 - RNA, 19 nt, Homo sapiens
cggccaaucgggacuauga

SEQ ID NO: 534711 - RNA, 19 nt, Homo sapiens
ggacgagugucaguuucag

SEQ ID NO: 534712 - RNA, 19 nt, Homo sapiens
ucgagaagucgcccaacua

SEQ ID NO: 534713 - RNA, 19 nt, Homo sapiens
gggaggcugcguucaccua

SEQ ID NO: 534714 - RNA, 19 nt, Homo sapiens
caucaucgucauaggagaa

SEQ ID NO: 534715 - RNA, 19 nt, Homo sapiens
ggcgcaagcaucaucugua

SEQ ID NO: 534716 - RNA, 19 nt, Homo sapiens
ucaaggacaaguacaacga

SEQ ID NO: 534717 - RNA, 19 nt, Homo sapiens
caguuucaguuccgcaaug

SEQ ID NO: 534718 - RNA, 19 nt, Homo sapiens
caucacagcaauauuuaac

SEQ ID NO: 534719 - RNA, 19 nt, Homo sapiens
ccucaacuauucuguucca

SEQ ID NO: 534720 - RNA, 19 nt, Homo sapiens
cccggacucucaugaacuu

SEQ ID NO: 534721 - RNA, 19 nt, Homo sapiens
guucaccuacgccaucauu

SEQ ID NO: 534722 - RNA, 19 nt, Homo sapiens
ggaugcugagcuugucuuu

SEQ ID NO: 534723 - RNA, 19 nt, Homo sapiens
caagcaucaucuguaacaa

SEQ ID NO: 534724 - RNA, 19 nt, Homo sapiens
gcgagcgcacggagaugua

SEQ ID NO: 534725 - RNA, 19 nt, Homo sapiens
gcaauggccgcuggaacug

SEQ ID NO: 534726 - RNA, 19 nt, Homo sapiens
cgagaagucgcccaacuac

SEQ ID NO: 534727 - RNA, 19 nt, Homo sapiens
gagaacaugaagcuggaau

SEQ ID NO: 534728 - RNA, 19 nt, Homo sapiens
gacuguggcugcgacaaag

SEQ ID NO: 534729 - RNA, 19 nt, Homo sapiens
cucaucacagcaauauuua

SEQ ID NO: 534730 - RNA, 19 nt, Homo sapiens
gagauguacacgugcaagu

SEQ ID NO: 534731 - RNA, 19 nt, Homo sapiens
cacuggugcugcuauguca

SEQ ID NO: 534732 - RNA, 19 nt, Homo sapiens
cgaggcaggccgaaagauc

SEQ ID NO: 534733 - RNA, 19 nt, Homo sapiens
cggcuucgccaaggucuuu

SEQ ID NO: 534734 - RNA, 19 nt, Homo sapiens
ccuggacgagugucaguuu

SEQ ID NO: 534735 - RNA, 19 nt, Homo sapiens
aagagaagcaaggccagua

SEQ ID NO: 534736 - RNA, 19 nt, Homo sapiens
ggccucaucacagcaauau

SEQ ID NO: 534737 - RNA, 19 nt, Homo sapiens
uaggagaaggcucacaaau

SEQ ID NO: 534738 - RNA, 19 nt, Homo sapiens
ggacagauguugacacaaa

SEQ ID NO: 534739 - RNA, 19 nt, Homo sapiens
ggaccacgcugcccaaguu

SEQ ID NO: 534740 - RNA, 19 nt, Homo sapiens
gaaacccugucucuacuaa

SEQ ID NO: 534741 - RNA, 19 nt, Homo sapiens
caaguucucuuucuucucu

SEQ ID NO: 534742 - RNA, 19 nt, Homo sapiens
agacagaccugguguacau

SEQ ID NO: 534743 - RNA, 19 nt, Homo sapiens
gcacgacucugucucaaaa

SEQ ID NO: 534744 - RNA, 19 nt, Homo sapiens
gaucaugcacagaaacuuu

SEQ ID NO: 534745 - RNA, 19 nt, Homo sapiens
ucaugaaccugcauaacaa

SEQ ID NO: 534746 - RNA, 19 nt, Homo sapiens
gagccaacaucaucugcaa

SEQ ID NO: 534747 - RNA, 19 nt, Homo sapiens
gcuccuccaugccgucuuu

SEQ ID NO: 534748 - RNA, 19 nt, Homo sapiens
gacacccucuguuuccuuu

SEQ ID NO: 534749 - RNA, 19 nt, Homo sapiens
ccaagauugugccacugua

SEQ ID NO: 534750 - RNA, 19 nt, Homo sapiens
cuacguguuucucugcuuu

SEQ ID NO: 534751 - RNA, 19 nt, Homo sapiens
uaacacauagccaguccua

SEQ ID NO: 534752 - RNA, 19 nt, Homo sapiens
cagauguugacacaaauua

SEQ ID NO: 534753 - RNA, 19 nt, Homo sapiens
gaaccugcauaacaaugag

SEQ ID NO: 534754 - RNA, 19 nt, Homo sapiens
gcgagaagcagggcuacua

SEQ ID NO: 534755 - RNA, 19 nt, Homo sapiens
gcaaagugaugaggagacu

SEQ ID NO: 534756 - RNA, 19 nt, Homo sapiens
ggugaaacccugucucuac

SEQ ID NO: 534757 - RNA, 19 nt, Homo sapiens
ccagagagcaaagugauga

SEQ ID NO: 534758 - RNA, 19 nt, Homo sapiens
gcuacaacacccaccagua

SEQ ID NO: 534759 - RNA, 19 nt, Homo sapiens
gaccugguguacauugaga

SEQ ID NO: 534760 - RNA, 19 nt, Homo sapiens
gacagauguugacacaaau

SEQ ID NO: 534761 - RNA, 19 nt, Homo sapiens
aacaucaucugcaacaaga

SEQ ID NO: 534762 - RNA, 19 nt, Homo sapiens
gagcacgacucugucucaa

SEQ ID NO: 534763 - RNA, 19 nt, Homo sapiens
gccacuguauuccaacuug

SEQ ID NO: 534764 - RNA, 19 nt, Homo sapiens
ggagguggagguugcaaug

SEQ ID NO: 534765 - RNA, 19 nt, Homo sapiens
caacaucaucugcaacaag

SEQ ID NO: 534766 - RNA, 19 nt, Homo sapiens
aaagugaugaggagacuga

SEQ ID NO: 534767 - RNA, 19 nt, Homo sapiens
gcaaguggauuuucuacgu

SEQ ID NO: 534768 - RNA, 19 nt, Homo sapiens
caagggaaccugagcaacu

SEQ ID NO: 534769 - RNA, 19 nt, Homo sapiens
agacaggacacuugcuuga

SEQ ID NO: 534770 - RNA, 19 nt, Homo sapiens
gugaaacccugucucuacu

SEQ ID NO: 534771 - RNA, 19 nt, Homo sapiens
cucgggagaucaagaagaa

SEQ ID NO: 534772 - RNA, 19 nt, Homo sapiens
gcagggcuacuacaaccaa

SEQ ID NO: 534773 - RNA, 19 nt, Homo sapiens
gcaccuguaaucccagcua

SEQ ID NO: 534774 - RNA, 19 nt, Homo sapiens
agaggauucucggcacuaa

SEQ ID NO: 534775 - RNA, 19 nt, Homo sapiens
ggcaaguucucuuucuucu

SEQ ID NO: 534776 - RNA, 19 nt, Homo sapiens
agaagucgcccaacuacug

SEQ ID NO: 534777 - RNA, 19 nt, Homo sapiens
gaccgaggcagguggauca

SEQ ID NO: 534778 - RNA, 19 nt, Homo sapiens
gacauagacgggugcagaa

SEQ ID NO: 534779 - RNA, 19 nt, Homo sapiens
cuacaacacccaccaguac

SEQ ID NO: 534780 - RNA, 19 nt, Homo sapiens
caagauugugccacuguau

SEQ ID NO: 534781 - RNA, 19 nt, Homo sapiens
ccuguaaucccagcacuuu

SEQ ID NO: 534782 - RNA, 19 nt, Homo sapiens
ggagacagaccugguguac

SEQ ID NO: 534783 - RNA, 19 nt, Homo sapiens
agaagcccauggagacaga

SEQ ID NO: 534784 - RNA, 19 nt, Homo sapiens
gaagcagggcuacuacaac

SEQ ID NO: 534785 - RNA, 19 nt, Homo sapiens
cagaccugguguacauuga

SEQ ID NO: 534786 - RNA, 19 nt, Homo sapiens
gggcaagagcuccgaguag

SEQ ID NO: 534787 - RNA, 19 nt, Homo sapiens
acaggacacuugcuugaac

SEQ ID NO: 534788 - RNA, 19 nt, Homo sapiens
ucucggcacuaacacauag

SEQ ID NO: 534789 - RNA, 19 nt, Homo sapiens
ugaaccugcauaacaauga

SEQ ID NO: 534790 - RNA, 19 nt, Homo sapiens
gacaggacacuugcuugaa

SEQ ID NO: 534791 - RNA, 19 nt, Homo sapiens
acacauagccaguccuaac

SEQ ID NO: 534792 - RNA, 19 nt, Homo sapiens
cacauccacuccucaccuu

SEQ ID NO: 534793 - RNA, 19 nt, Homo sapiens
gccaacaucaucugcaaca

SEQ ID NO: 534794 - RNA, 19 nt, Homo sapiens
gccaccugcugaaggagaa

SEQ ID NO: 534795 - RNA, 19 nt, Homo sapiens
ccuggaucaugcacagaaa

SEQ ID NO: 534796 - RNA, 19 nt, Homo sapiens
gcuaucagaagcccaugga

SEQ ID NO: 534797 - RNA, 19 nt, Homo sapiens
agaagcagggcuacuacaa

SEQ ID NO: 534798 - RNA, 19 nt, Homo sapiens
ugaaacccugucucuacua

SEQ ID NO: 534799 - RNA, 19 nt, Homo sapiens
gagaagcagggcuacuaca

SEQ ID NO: 534800 - RNA, 19 nt, Homo sapiens
gagguggagguugcaauga

SEQ ID NO: 534801 - RNA, 19 nt, Homo sapiens
ugagacaggacacuugcuu

SEQ ID NO: 534802 - RNA, 19 nt, Homo sapiens
ccaacaucaucugcaacaa

SEQ ID NO: 534803 - RNA, 19 nt, Homo sapiens
caucaacgagugccaguac

SEQ ID NO: 534804 - RNA, 19 nt, Homo sapiens
gcucgggagaucaagaaga

SEQ ID NO: 534805 - RNA, 19 nt, Homo sapiens
cuaacuccguacucugugu

SEQ ID NO: 534806 - RNA, 19 nt, Homo sapiens
aagggaaccugagcaacug

SEQ ID NO: 534807 - RNA, 19 nt, Homo sapiens
ccggcaaguucucuuucuu

SEQ ID NO: 534808 - RNA, 19 nt, Homo sapiens
caugccgucuuuccuucuu

SEQ ID NO: 534809 - RNA, 19 nt, Homo sapiens
ggggacagauguugacaca

SEQ ID NO: 534810 - RNA, 19 nt, Homo sapiens
uugagaagucgcccaacua

SEQ ID NO: 534811 - RNA, 19 nt, Homo sapiens
ccuagacacccucuguuuc

SEQ ID NO: 534812 - RNA, 19 nt, Homo sapiens
ggugcugcuucgucaagug

SEQ ID NO: 534813 - RNA, 19 nt, Homo sapiens
ugagaagucgcccaacuac

SEQ ID NO: 534814 - RNA, 19 nt, Homo sapiens
gccaagggaaccugagcaa

SEQ ID NO: 534815 - RNA, 19 nt, Homo sapiens
cucaugaaccugcauaaca

SEQ ID NO: 534816 - RNA, 19 nt, Homo sapiens
gaaaggaucuccaaacucu

SEQ ID NO: 534817 - RNA, 19 nt, Homo sapiens
cagagagacuuccuucaua

SEQ ID NO: 534818 - RNA, 19 nt, Homo sapiens
cuacaaaucuaugcugaua

SEQ ID NO: 534819 - RNA, 19 nt, Homo sapiens
uaaaugagauugagaacuc

SEQ ID NO: 534820 - RNA, 19 nt, Homo sapiens
ucacauaaauacugaggaa

SEQ ID NO: 534821 - RNA, 19 nt, Homo sapiens
gugaacaauuuccugauaa

SEQ ID NO: 534822 - RNA, 19 nt, Homo sapiens
agagggaccuucaaaguau

SEQ ID NO: 534823 - RNA, 19 nt, Homo sapiens
gcugaggccuuccuuccua

SEQ ID NO: 534824 - RNA, 19 nt, Homo sapiens
gcuguacggucaaguguga

SEQ ID NO: 534825 - RNA, 19 nt, Homo sapiens
auacagacucccagaauua

SEQ ID NO: 534826 - RNA, 19 nt, Homo sapiens
gaggaaaacugaggucaua

SEQ ID NO: 534827 - RNA, 19 nt, Homo sapiens
ccagagcccugaugaaucu

SEQ ID NO: 534828 - RNA, 19 nt, Homo sapiens
gauaaaggagaaacuagaa

SEQ ID NO: 534829 - RNA, 19 nt, Homo sapiens
gcagugagagccaccauga

SEQ ID NO: 534830 - RNA, 19 nt, Homo sapiens
gggaaaggaucuccaaacu

SEQ ID NO: 534831 - RNA, 19 nt, Homo sapiens
uagcaugggugacuucgaa

SEQ ID NO: 534832 - RNA, 19 nt, Homo sapiens
uaucugaccuacacgacua

SEQ ID NO: 534833 - RNA, 19 nt, Homo sapiens
ggagucauguacaucauca

SEQ ID NO: 534834 - RNA, 19 nt, Homo sapiens
cagcgacaauguggaauuu

SEQ ID NO: 534835 - RNA, 19 nt, Homo sapiens
ggagaugggagacuaccua

SEQ ID NO: 534836 - RNA, 19 nt, Homo sapiens
gagacuuccuucauacaug

SEQ ID NO: 534837 - RNA, 19 nt, Homo sapiens
ggauaaaggagaaacuaga

SEQ ID NO: 534838 - RNA, 19 nt, Homo sapiens
ccuggucagugaacaauuu

SEQ ID NO: 534839 - RNA, 19 nt, Homo sapiens
uagagggaccuucaaagua

SEQ ID NO: 534840 - RNA, 19 nt, Homo sapiens
agugaacaauuuccugaua

SEQ ID NO: 534841 - RNA, 19 nt, Homo sapiens
ccagcugggacuucuauua

SEQ ID NO: 534842 - RNA, 19 nt, Homo sapiens
gaacucaacuguauuuugc

SEQ ID NO: 534843 - RNA, 19 nt, Homo sapiens
gaugggagacuaccuaaag

SEQ ID NO: 534844 - RNA, 19 nt, Homo sapiens
ggagugcaaguuccaguuu

SEQ ID NO: 534845 - RNA, 19 nt, Homo sapiens
gcaacucccuugauuucag

SEQ ID NO: 534846 - RNA, 19 nt, Homo sapiens
ggucgugagugccuacaga

SEQ ID NO: 534847 - RNA, 19 nt, Homo sapiens
gggcagcucugggcauaug

SEQ ID NO: 534848 - RNA, 19 nt, Homo sapiens
aauacagacucccagaauu

SEQ ID NO: 534849 - RNA, 19 nt, Homo sapiens
ccaccaggauaaaggagaa

SEQ ID NO: 534850 - RNA, 19 nt, Homo sapiens
gagggaccuucaaaguauu

SEQ ID NO: 534851 - RNA, 19 nt, Homo sapiens
ggaaucaggagaauagaag

SEQ ID NO: 534852 - RNA, 19 nt, Homo sapiens
aggagaaacuagaaauaug

SEQ ID NO: 534853 - RNA, 19 nt, Homo sapiens
caauacagacucccagaau

SEQ ID NO: 534854 - RNA, 19 nt, Homo sapiens
uuggaaaccuuaagaucaa

SEQ ID NO: 534855 - RNA, 19 nt, Homo sapiens
guaggcauguggugagcaa

SEQ ID NO: 534856 - RNA, 19 nt, Homo sapiens
caaaugucauggcaucucu

SEQ ID NO: 534857 - RNA, 19 nt, Homo sapiens
gcgacaauguggaauuugg

SEQ ID NO: 534858 - RNA, 19 nt, Homo sapiens
ugugaugggucaaacaaug

SEQ ID NO: 534859 - RNA, 19 nt, Homo sapiens
gagugcaaguuccaguuug

SEQ ID NO: 534860 - RNA, 19 nt, Homo sapiens
ccauaaaugcuucuaagau

SEQ ID NO: 534861 - RNA, 19 nt, Homo sapiens
gagaugggagacuaccuaa

SEQ ID NO: 534862 - RNA, 19 nt, Homo sapiens
gcagcgacaauguggaauu

SEQ ID NO: 534863 - RNA, 19 nt, Homo sapiens
ucauguacaucaucaccaa

SEQ ID NO: 534864 - RNA, 19 nt, Homo sapiens
ccagaauuagaaaguguua

SEQ ID NO: 534865 - RNA, 19 nt, Homo sapiens
ggagaaacuagaaauaugc

SEQ ID NO: 534866 - RNA, 19 nt, Homo sapiens
cuucuucuguaucccaaua

SEQ ID NO: 534867 - RNA, 19 nt, Homo sapiens
gaacaauuuccugauaaca

SEQ ID NO: 534868 - RNA, 19 nt, Homo sapiens
ggcauguggugagcaagua

SEQ ID NO: 534869 - RNA, 19 nt, Homo sapiens
agacacuggucaacaggaa

SEQ ID NO: 534870 - RNA, 19 nt, Homo sapiens
aaacgaaagaguucuguuc

SEQ ID NO: 534871 - RNA, 19 nt, Homo sapiens
caacucccuugauuucagu

SEQ ID NO: 534872 - RNA, 19 nt, Homo sapiens
gcugauaaaugagauugag

SEQ ID NO: 534873 - RNA, 19 nt, Homo sapiens
gccuguggcuacaaaucua

SEQ ID NO: 534874 - RNA, 19 nt, Homo sapiens
ucaggagaauagaagcaaa

SEQ ID NO: 534875 - RNA, 19 nt, Homo sapiens
cuacagaacagccacaaca

SEQ ID NO: 534876 - RNA, 19 nt, Homo sapiens
ccagagagacuuccuucau

SEQ ID NO: 534877 - RNA, 19 nt, Homo sapiens
auaugcaacucccuugauu

SEQ ID NO: 534878 - RNA, 19 nt, Homo sapiens
ucugggagcugcagcauac

SEQ ID NO: 534879 - RNA, 19 nt, Homo sapiens
ggaaaggaucuccaaacuc

SEQ ID NO: 534880 - RNA, 19 nt, Homo sapiens
agagagacuuccuucauac

SEQ ID NO: 534881 - RNA, 19 nt, Homo sapiens
gcgcagaggcggaacugau

SEQ ID NO: 534882 - RNA, 19 nt, Homo sapiens
gggaaucaggagaauagaa

SEQ ID NO: 534883 - RNA, 19 nt, Homo sapiens
gaacugcccugaaaaugcu

SEQ ID NO: 534884 - RNA, 19 nt, Homo sapiens
aaggaucuccaaacucuuu

SEQ ID NO: 534885 - RNA, 19 nt, Homo sapiens
acauaaauacugaggaaga

SEQ ID NO: 534886 - RNA, 19 nt, Homo sapiens
agugagagccaccaugaaa

SEQ ID NO: 534887 - RNA, 19 nt, Homo sapiens
gcugggacuucuauuacuc

SEQ ID NO: 534888 - RNA, 19 nt, Homo sapiens
cgcuggaacugcccugaaa

SEQ ID NO: 534889 - RNA, 19 nt, Homo sapiens
ucccuugauuucaguguuu

SEQ ID NO: 534890 - RNA, 19 nt, Homo sapiens
caggauaaaggagaaacua

SEQ ID NO: 534891 - RNA, 19 nt, Homo sapiens
ugaacaauuuccugauaac

SEQ ID NO: 534892 - RNA, 19 nt, Homo sapiens
cuagagggaccuucaaagu

SEQ ID NO: 534893 - RNA, 19 nt, Homo sapiens
cacaacaggcugagaagug

SEQ ID NO: 534894 - RNA, 19 nt, Homo sapiens
ugagaagugcuaccagaga

SEQ ID NO: 534895 - RNA, 19 nt, Homo sapiens
gccauaaaugcuucuaaga

SEQ ID NO: 534896 - RNA, 19 nt, Homo sapiens
aaauuccaguggugcugua

SEQ ID NO: 534897 - RNA, 19 nt, Homo sapiens
cagacucccagaauuagaa

SEQ ID NO: 534898 - RNA, 19 nt, Homo sapiens
ucaacuguauuuugccaua

SEQ ID NO: 534899 - RNA, 19 nt, Homo sapiens
gaggucauaagcagcugua

SEQ ID NO: 534900 - RNA, 19 nt, Homo sapiens
ugccauaaaugcuucuaag

SEQ ID NO: 534901 - RNA, 19 nt, Homo sapiens
cauaaauacugaggaagac

SEQ ID NO: 534902 - RNA, 19 nt, Homo sapiens
gcagguggaagagaggaaa

SEQ ID NO: 534903 - RNA, 19 nt, Homo sapiens
cagaacagccacaacacau

SEQ ID NO: 534904 - RNA, 19 nt, Homo sapiens
gcugugaugggucaaacaa

SEQ ID NO: 534905 - RNA, 19 nt, Homo sapiens
gcaaaugucauggcaucuc

SEQ ID NO: 534906 - RNA, 19 nt, Homo sapiens
cugggcagcucugggcaua

SEQ ID NO: 534907 - RNA, 19 nt, Homo sapiens
gagagacuuccuucauaca

SEQ ID NO: 534908 - RNA, 19 nt, Homo sapiens
gaugccagagcccugauga

SEQ ID NO: 534909 - RNA, 19 nt, Homo sapiens
gcuggagucauguacauca

SEQ ID NO: 534910 - RNA, 19 nt, Homo sapiens
gagaaacuagaaauaugca

SEQ ID NO: 534911 - RNA, 19 nt, Homo sapiens
cuauuacucccuuuggaaa

SEQ ID NO: 534912 - RNA, 19 nt, Homo sapiens
cagcugggacuucuauuac

SEQ ID NO: 534913 - RNA, 19 nt, Homo sapiens
caucgaggagugcaaguuc

SEQ ID NO: 534914 - RNA, 19 nt, Homo sapiens
gccucugccuggucaguga

SEQ ID NO: 534915 - RNA, 19 nt, Homo sapiens
cagcuguaacugcaaauuc

SEQ ID NO: 534916 - RNA, 19 nt, Homo sapiens
ggacauagcuucucucuua

SEQ ID NO: 534917 - RNA, 19 nt, Homo sapiens
gaaaggaucuccaaacucu

SEQ ID NO: 534918 - RNA, 19 nt, Homo sapiens
cagagagacuuccuucaua

SEQ ID NO: 534919 - RNA, 19 nt, Homo sapiens
cuacaaaucuaugcugaua

SEQ ID NO: 534920 - RNA, 19 nt, Homo sapiens
uaaaugagauugagaacuc

SEQ ID NO: 534921 - RNA, 19 nt, Homo sapiens
ucacauaaauacugaggaa

SEQ ID NO: 534922 - RNA, 19 nt, Homo sapiens
aaacuacuuucccaucuuu

SEQ ID NO: 534923 - RNA, 19 nt, Homo sapiens
gugaacaauuuccugauaa

SEQ ID NO: 534924 - RNA, 19 nt, Homo sapiens
agagggaccuucaaaguau

SEQ ID NO: 534925 - RNA, 19 nt, Homo sapiens
gcugaggccuuccuuccua

SEQ ID NO: 534926 - RNA, 19 nt, Homo sapiens
gcaaacuacuuucccaucu

SEQ ID NO: 534927 - RNA, 19 nt, Homo sapiens
gagaacagauuggaaagca

SEQ ID NO: 534928 - RNA, 19 nt, Homo sapiens
gcuguacggucaaguguga

SEQ ID NO: 534929 - RNA, 19 nt, Homo sapiens
auacagacucccagaauua

SEQ ID NO: 534930 - RNA, 19 nt, Homo sapiens
gaggaaaacugaggucaua

SEQ ID NO: 534931 - RNA, 19 nt, Homo sapiens
ccagagcccugaugaaucu

SEQ ID NO: 534932 - RNA, 19 nt, Homo sapiens
gauaaaggagaaacuagaa

SEQ ID NO: 534933 - RNA, 19 nt, Homo sapiens
gcagugagagccaccauga

SEQ ID NO: 534934 - RNA, 19 nt, Homo sapiens
gggaaaggaucuccaaacu

SEQ ID NO: 534935 - RNA, 19 nt, Homo sapiens
uagcaugggugacuucgaa

SEQ ID NO: 534936 - RNA, 19 nt, Homo sapiens
uaucugaccuacacgacua

SEQ ID NO: 534937 - RNA, 19 nt, Homo sapiens
ggagucauguacaucauca

SEQ ID NO: 534938 - RNA, 19 nt, Homo sapiens
ccaagauucuacagcauau

SEQ ID NO: 534939 - RNA, 19 nt, Homo sapiens
cagcgacaauguggaauuu

SEQ ID NO: 534940 - RNA, 19 nt, Homo sapiens
caaacuacuuucccaucuu

SEQ ID NO: 534941 - RNA, 19 nt, Homo sapiens
ggaaagcaaucggaaaauu

SEQ ID NO: 534942 - RNA, 19 nt, Homo sapiens
ggagaugggagacuaccua

SEQ ID NO: 534943 - RNA, 19 nt, Homo sapiens
gagacuuccuucauacaug

SEQ ID NO: 534944 - RNA, 19 nt, Homo sapiens
ggauaaaggagaaacuaga

SEQ ID NO: 534945 - RNA, 19 nt, Homo sapiens
ccuggucagugaacaauuu

SEQ ID NO: 534946 - RNA, 19 nt, Homo sapiens
uagagggaccuucaaagua

SEQ ID NO: 534947 - RNA, 19 nt, Homo sapiens
agugaacaauuuccugaua

SEQ ID NO: 534948 - RNA, 19 nt, Homo sapiens
guacuuaugcagcuuucua

SEQ ID NO: 534949 - RNA, 19 nt, Homo sapiens
ccagcugggacuucuauua

SEQ ID NO: 534950 - RNA, 19 nt, Homo sapiens
gaacucaacuguauuuugc

SEQ ID NO: 534951 - RNA, 19 nt, Homo sapiens
gaugggagacuaccuaaag

SEQ ID NO: 534952 - RNA, 19 nt, Homo sapiens
ggagugcaaguuccaguuu

SEQ ID NO: 534953 - RNA, 19 nt, Homo sapiens
gcaacucccuugauuucag

SEQ ID NO: 534954 - RNA, 19 nt, Homo sapiens
ggucgugagugccuacaga

SEQ ID NO: 534955 - RNA, 19 nt, Homo sapiens
gggcagcucugggcauaug

SEQ ID NO: 534956 - RNA, 19 nt, Homo sapiens
aauacagacucccagaauu

SEQ ID NO: 534957 - RNA, 19 nt, Homo sapiens
ccaccaggauaaaggagaa

SEQ ID NO: 534958 - RNA, 19 nt, Homo sapiens
gagggaccuucaaaguauu

SEQ ID NO: 534959 - RNA, 19 nt, Homo sapiens
ggaaucaggagaauagaag

SEQ ID NO: 534960 - RNA, 19 nt, Homo sapiens
aggagaaacuagaaauaug

SEQ ID NO: 534961 - RNA, 19 nt, Homo sapiens
caauacagacucccagaau

SEQ ID NO: 534962 - RNA, 19 nt, Homo sapiens
uuggaaaccuuaagaucaa

SEQ ID NO: 534963 - RNA, 19 nt, Homo sapiens
agagagaacagauuggaaa

SEQ ID NO: 534964 - RNA, 19 nt, Homo sapiens
guaggcauguggugagcaa

SEQ ID NO: 534965 - RNA, 19 nt, Homo sapiens
caaaugucauggcaucucu

SEQ ID NO: 534966 - RNA, 19 nt, Homo sapiens
gcgacaauguggaauuugg

SEQ ID NO: 534967 - RNA, 19 nt, Homo sapiens
ugugaugggucaaacaaug

SEQ ID NO: 534968 - RNA, 19 nt, Homo sapiens
gagugcaaguuccaguuug

SEQ ID NO: 534969 - RNA, 19 nt, Homo sapiens
ccauaaaugcuucuaagau

SEQ ID NO: 534970 - RNA, 19 nt, Homo sapiens
gagaugggagacuaccuaa

SEQ ID NO: 534971 - RNA, 19 nt, Homo sapiens
gcagcgacaauguggaauu

SEQ ID NO: 534972 - RNA, 19 nt, Homo sapiens
ucauguacaucaucaccaa

SEQ ID NO: 534973 - RNA, 19 nt, Homo sapiens
ccagaauuagaaaguguua

SEQ ID NO: 534974 - RNA, 19 nt, Homo sapiens
ggagaaacuagaaauaugc

SEQ ID NO: 534975 - RNA, 19 nt, Homo sapiens
cuucuucuguaucccaaua

SEQ ID NO: 534976 - RNA, 19 nt, Homo sapiens
gaacaauuuccugauaaca

SEQ ID NO: 534977 - RNA, 19 nt, Homo sapiens
ggcauguggugagcaagua

SEQ ID NO: 534978 - RNA, 19 nt, Homo sapiens
agacacuggucaacaggaa

SEQ ID NO: 534979 - RNA, 19 nt, Homo sapiens
aaacgaaagaguucuguuc

SEQ ID NO: 534980 - RNA, 19 nt, Homo sapiens
cauuucaucuuuccugcaa

SEQ ID NO: 534981 - RNA, 19 nt, Homo sapiens
caacucccuugauuucagu

SEQ ID NO: 534982 - RNA, 19 nt, Homo sapiens
gcugauaaaugagauugag

SEQ ID NO: 534983 - RNA, 19 nt, Homo sapiens
gccuguggcuacaaaucua

SEQ ID NO: 534984 - RNA, 19 nt, Homo sapiens
ucaggagaauagaagcaaa

SEQ ID NO: 534985 - RNA, 19 nt, Homo sapiens
caucuuuccugcaaacuac

SEQ ID NO: 534986 - RNA, 19 nt, Homo sapiens
cuacagaacagccacaaca

SEQ ID NO: 534987 - RNA, 19 nt, Homo sapiens
ccagagagacuuccuucau

SEQ ID NO: 534988 - RNA, 19 nt, Homo sapiens
auaugcaacucccuugauu

SEQ ID NO: 534989 - RNA, 19 nt, Homo sapiens
ucugggagcugcagcauac

SEQ ID NO: 534990 - RNA, 19 nt, Homo sapiens
ggaaaggaucuccaaacuc

SEQ ID NO: 534991 - RNA, 19 nt, Homo sapiens
agagagacuuccuucauac

SEQ ID NO: 534992 - RNA, 19 nt, Homo sapiens
gaaaauggaggcccaagau

SEQ ID NO: 534993 - RNA, 19 nt, Homo sapiens
gacauagcuucucucuuag

SEQ ID NO: 534994 - RNA, 19 nt, Homo sapiens
gcgcagaggcggaacugau

SEQ ID NO: 534995 - RNA, 19 nt, Homo sapiens
gaacugcccugaaaaugcu

SEQ ID NO: 534996 - RNA, 19 nt, Homo sapiens
gggaaucaggagaauagaa

SEQ ID NO: 534997 - RNA, 19 nt, Homo sapiens
gauaauaccccacacaagu

SEQ ID NO: 534998 - RNA, 19 nt, Homo sapiens
aaggaucuccaaacucuuu

SEQ ID NO: 534999 - RNA, 19 nt, Homo sapiens
acauaaauacugaggaaga

SEQ ID NO: 535000 - RNA, 19 nt, Homo sapiens
aaauggaggcccaagauuc

SEQ ID NO: 535001 - RNA, 19 nt, Homo sapiens
agugagagccaccaugaaa

SEQ ID NO: 535002 - RNA, 19 nt, Homo sapiens
gcugggacuucuauuacuc

SEQ ID NO: 535003 - RNA, 19 nt, Homo sapiens
cgcuggaacugcccugaaa

SEQ ID NO: 535004 - RNA, 19 nt, Homo sapiens
cccaagauucuacagcaua

SEQ ID NO: 535005 - RNA, 19 nt, Homo sapiens
ucccuugauuucaguguuu

SEQ ID NO: 535006 - RNA, 19 nt, Homo sapiens
ugagaagugcuaccagaga

SEQ ID NO: 535007 - RNA, 19 nt, Homo sapiens
caggauaaaggagaaacua

SEQ ID NO: 535008 - RNA, 19 nt, Homo sapiens
ugaacaauuuccugauaac

SEQ ID NO: 535009 - RNA, 19 nt, Homo sapiens
cuagagggaccuucaaagu

SEQ ID NO: 535010 - RNA, 19 nt, Homo sapiens
gaaccugggccuccugacu

SEQ ID NO: 535011 - RNA, 19 nt, Homo sapiens
cacaacaggcugagaagug

SEQ ID NO: 535012 - RNA, 19 nt, Homo sapiens
gccauaaaugcuucuaaga

SEQ ID NO: 535013 - RNA, 19 nt, Homo sapiens
ggucuguaguccucaugau

SEQ ID NO: 535014 - RNA, 19 nt, Homo sapiens
aaauuccaguggugcugua

SEQ ID NO: 535015 - RNA, 19 nt, Homo sapiens
cagacucccagaauuagaa

SEQ ID NO: 535016 - RNA, 19 nt, Homo sapiens
ggacccagguuaacucaaa

SEQ ID NO: 535017 - RNA, 19 nt, Homo sapiens
gcuggucggugaacaauuu

SEQ ID NO: 535018 - RNA, 19 nt, Homo sapiens
cagguuaacucaaagcuuu

SEQ ID NO: 535019 - RNA, 19 nt, Homo sapiens
ugacuuuccuagacaauaa

SEQ ID NO: 535020 - RNA, 19 nt, Homo sapiens
gcaaugacuuuccuagaca

SEQ ID NO: 535021 - RNA, 19 nt, Homo sapiens
ugaauggacuuuacuagug

SEQ ID NO: 535022 - RNA, 19 nt, Homo sapiens
ccaggaaucuugaaugcuu

SEQ ID NO: 535023 - RNA, 19 nt, Homo sapiens
guucuuggcuuccuuuaga

SEQ ID NO: 535024 - RNA, 19 nt, Homo sapiens
gcaaccaacuuuaccucuu

SEQ ID NO: 535025 - RNA, 19 nt, Homo sapiens
aaacugcaauuucuccaaa

SEQ ID NO: 535026 - RNA, 19 nt, Homo sapiens
ccaaaggcuuaccugauuu

SEQ ID NO: 535027 - RNA, 19 nt, Homo sapiens
cuaaagcucugucugaauc

SEQ ID NO: 535028 - RNA, 19 nt, Homo sapiens
ccaugaaccugcacaacaa

SEQ ID NO: 535029 - RNA, 19 nt, Homo sapiens
gagaggcgauuuccaagca

SEQ ID NO: 535030 - RNA, 19 nt, Homo sapiens
caaccaacuuuaccucuuc

SEQ ID NO: 535031 - RNA, 19 nt, Homo sapiens
uccaaaggcuuaccugauu

SEQ ID NO: 535032 - RNA, 19 nt, Homo sapiens
gcucuggagugcuaacuug

SEQ ID NO: 535033 - RNA, 19 nt, Homo sapiens
gaaugcaaguaucaguuug

SEQ ID NO: 535034 - RNA, 19 nt, Homo sapiens
gcgcgcaccugaaggagaa

SEQ ID NO: 535035 - RNA, 19 nt, Homo sapiens
caaaggcuuaccugauuua

SEQ ID NO: 535036 - RNA, 19 nt, Homo sapiens
ggugaacaauuuccugaug

SEQ ID NO: 535037 - RNA, 19 nt, Homo sapiens
uuacugaucuuccuuggau

SEQ ID NO: 535038 - RNA, 19 nt, Homo sapiens
gugaacaauuuccugauga

SEQ ID NO: 535039 - RNA, 19 nt, Homo sapiens
ccaagacugagguaaauaa

SEQ ID NO: 535040 - RNA, 19 nt, Homo sapiens
ccagagugguauugaagaa

SEQ ID NO: 535041 - RNA, 19 nt, Homo sapiens
gagggacuccagauacaua

SEQ ID NO: 535042 - RNA, 19 nt, Homo sapiens
gccggagggucaccaagua

SEQ ID NO: 535043 - RNA, 19 nt, Homo sapiens
gagccaagacugagguaaa

SEQ ID NO: 535044 - RNA, 19 nt, Homo sapiens
gcaccacgcagaccuguug

SEQ ID NO: 535045 - RNA, 19 nt, Homo sapiens
ugacugguccaaaggcuua

SEQ ID NO: 535046 - RNA, 19 nt, Homo sapiens
uuucaaagccuucugugua

SEQ ID NO: 535047 - RNA, 19 nt, Homo sapiens
ccacuuuccucuucagauc

SEQ ID NO: 535048 - RNA, 19 nt, Homo sapiens
ucucugaccuagccuauca

SEQ ID NO: 535049 - RNA, 19 nt, Homo sapiens
ccuagccuaucaacccuua

SEQ ID NO: 535050 - RNA, 19 nt, Homo sapiens
ccaugaaacgcacguguaa

SEQ ID NO: 535051 - RNA, 19 nt, Homo sapiens
ggagacagcauuugugcau

SEQ ID NO: 535052 - RNA, 19 nt, Homo sapiens
ggcaaugacuuuccuagac

SEQ ID NO: 535053 - RNA, 19 nt, Homo sapiens
uaucaugaauggacuuuac

SEQ ID NO: 535054 - RNA, 19 nt, Homo sapiens
gaagaaugcaaguaucagu

SEQ ID NO: 535055 - RNA, 19 nt, Homo sapiens
uguacacccugacuagaaa

SEQ ID NO: 535056 - RNA, 19 nt, Homo sapiens
agacugagguaaauaaagc

SEQ ID NO: 535057 - RNA, 19 nt, Homo sapiens
gcacaaacccgggagaaaa

SEQ ID NO: 535058 - RNA, 19 nt, Homo sapiens
agagugguauugaagaaug

SEQ ID NO: 535059 - RNA, 19 nt, Homo sapiens
cagaggauuauguuucuuu

SEQ ID NO: 535060 - RNA, 19 nt, Homo sapiens
gucauuuccuacccuuuaa

SEQ ID NO: 535061 - RNA, 19 nt, Homo sapiens
gugcuaacuugaacaccaa

SEQ ID NO: 535062 - RNA, 19 nt, Homo sapiens
ggaauuuucucuagcuguu

SEQ ID NO: 535063 - RNA, 19 nt, Homo sapiens
caagacugagguaaauaaa

SEQ ID NO: 535064 - RNA, 19 nt, Homo sapiens
ucucuccucuucucccuuu

SEQ ID NO: 535065 - RNA, 19 nt, Homo sapiens
ccucugugcucuccuaaag

SEQ ID NO: 535066 - RNA, 19 nt, Homo sapiens
agauuacagucauuuccua

SEQ ID NO: 535067 - RNA, 19 nt, Homo sapiens
caggaaucuugaaugcuuu

SEQ ID NO: 535068 - RNA, 19 nt, Homo sapiens
agaaugcaaguaucaguuu

SEQ ID NO: 535069 - RNA, 19 nt, Homo sapiens
ggucuaggaaauacguuaa

SEQ ID NO: 535070 - RNA, 19 nt, Homo sapiens
caaugacuuuccuagacaa

SEQ ID NO: 535071 - RNA, 19 nt, Homo sapiens
cuacucaucccuaugguau

SEQ ID NO: 535072 - RNA, 19 nt, Homo sapiens
ccucuucucccuuuccuuu

SEQ ID NO: 535073 - RNA, 19 nt, Homo sapiens
agucauuuccuacccuuua

SEQ ID NO: 535074 - RNA, 19 nt, Homo sapiens
gggcagauuacagucauuu

SEQ ID NO: 535075 - RNA, 19 nt, Homo sapiens
acacgcaggacccagguua

SEQ ID NO: 535076 - RNA, 19 nt, Homo sapiens
ccugaugacugguccaaag

SEQ ID NO: 535077 - RNA, 19 nt, Homo sapiens
guuaagggcagauuacagu

SEQ ID NO: 535078 - RNA, 19 nt, Homo sapiens
cgccaucgccgacaccuuu

SEQ ID NO: 535079 - RNA, 19 nt, Homo sapiens
aggcuuaccugauuuacuc

SEQ ID NO: 535080 - RNA, 19 nt, Homo sapiens
ccgagggacuccagauaca

SEQ ID NO: 535081 - RNA, 19 nt, Homo sapiens
agggagcucuggagugcua

SEQ ID NO: 535082 - RNA, 19 nt, Homo sapiens
ggcagagguugaagaugga

SEQ ID NO: 535083 - RNA, 19 nt, Homo sapiens
guugggcuuugaagaauuc

SEQ ID NO: 535084 - RNA, 19 nt, Homo sapiens
uaagugccauggcgugucu

SEQ ID NO: 535085 - RNA, 19 nt, Homo sapiens
cauggccacuggaggaaga

SEQ ID NO: 535086 - RNA, 19 nt, Homo sapiens
gccaugaaccugcacaaca

SEQ ID NO: 535087 - RNA, 19 nt, Homo sapiens
ccuccuagcaaccaacuuu

SEQ ID NO: 535088 - RNA, 19 nt, Homo sapiens
gggcaaugacuuuccuaga

SEQ ID NO: 535089 - RNA, 19 nt, Homo sapiens
gcuuugaguuacugaucuu

SEQ ID NO: 535090 - RNA, 19 nt, Homo sapiens
caacuuuaccucuucuucu

SEQ ID NO: 535091 - RNA, 19 nt, Homo sapiens
guuugucgaugcccuggaa

SEQ ID NO: 535092 - RNA, 19 nt, Homo sapiens
gcuuacccaucucccaguu

SEQ ID NO: 535093 - RNA, 19 nt, Homo sapiens
gaaggucuaggaaauacgu

SEQ ID NO: 535094 - RNA, 19 nt, Homo sapiens
aaucuugaaugcuuucucu

SEQ ID NO: 535095 - RNA, 19 nt, Homo sapiens
ccgaaggucuaggaaauac

SEQ ID NO: 535096 - RNA, 19 nt, Homo sapiens
acucaucccuaugguauca

SEQ ID NO: 535097 - RNA, 19 nt, Homo sapiens
ggagggucaccaaguacuu

SEQ ID NO: 535098 - RNA, 19 nt, Homo sapiens
ggaaacaggacaggaugca

SEQ ID NO: 535099 - RNA, 19 nt, Homo sapiens
gccaagacugagguaaaua

SEQ ID NO: 535100 - RNA, 19 nt, Homo sapiens
ccuaucagcccuaaucucu

SEQ ID NO: 535101 - RNA, 19 nt, Homo sapiens
acugaucuuccuuggauua

SEQ ID NO: 535102 - RNA, 19 nt, Homo sapiens
ugcaauuucuccaaagcuu

SEQ ID NO: 535103 - RNA, 19 nt, Homo sapiens
gcuacucaucccuauggua

SEQ ID NO: 535104 - RNA, 19 nt, Homo sapiens
gcaggacccagguuaacuc

SEQ ID NO: 535105 - RNA, 19 nt, Homo sapiens
acuacugccuggagaacaa

SEQ ID NO: 535106 - RNA, 19 nt, Homo sapiens
guaccacgcagcacucaag

SEQ ID NO: 535107 - RNA, 19 nt, Homo sapiens
guauugaagaaugcaagua

SEQ ID NO: 535108 - RNA, 19 nt, Homo sapiens
agccaagacugagguaaau

SEQ ID NO: 535109 - RNA, 19 nt, Homo sapiens
agaggauuauguuucuuuc

SEQ ID NO: 535110 - RNA, 19 nt, Homo sapiens
ugauaacuguggcugugau

SEQ ID NO: 535111 - RNA, 19 nt, Homo sapiens
gccacuggaggaagaauau

SEQ ID NO: 535112 - RNA, 19 nt, Homo sapiens
ugcuacugcugaccaaauu

SEQ ID NO: 535113 - RNA, 19 nt, Homo sapiens
uccuaaagcucugucugaa

SEQ ID NO: 535114 - RNA, 19 nt, Homo sapiens
cacuggaggaagaauauuu

SEQ ID NO: 535115 - RNA, 19 nt, Homo sapiens
ggccacuggaggaagaaua

SEQ ID NO: 535116 - RNA, 19 nt, Homo sapiens
uaaaguaucuaccuggaaa

SEQ ID NO: 535117 - RNA, 19 nt, Homo sapiens
caggagagcuggucuacuu

SEQ ID NO: 535118 - RNA, 19 nt, Homo sapiens
gaaguucucucgggauuuc

SEQ ID NO: 535119 - RNA, 19 nt, Homo sapiens
gagcuggucuacuuugaga

SEQ ID NO: 535120 - RNA, 19 nt, Homo sapiens
gaugaaaugcacuguauug

SEQ ID NO: 535121 - RNA, 19 nt, Homo sapiens
ggaagaggacugugugaga

SEQ ID NO: 535122 - RNA, 19 nt, Homo sapiens
aagaugaaaugcacuguau

SEQ ID NO: 535123 - RNA, 19 nt, Homo sapiens
gcuaugugcugugugauga

SEQ ID NO: 535124 - RNA, 19 nt, Homo sapiens
gagagcuggucuacuuuga

SEQ ID NO: 535125 - RNA, 19 nt, Homo sapiens
ggugggaagggauaauuua

SEQ ID NO: 535126 - RNA, 19 nt, Homo sapiens
gaaugcgaauccacaacaa

SEQ ID NO: 535127 - RNA, 19 nt, Homo sapiens
guucuugguuccuguuuga

SEQ ID NO: 535128 - RNA, 19 nt, Homo sapiens
ugaauggacuaagaugaaa

SEQ ID NO: 535129 - RNA, 19 nt, Homo sapiens
ugugaugagugcaagguua

SEQ ID NO: 535130 - RNA, 19 nt, Homo sapiens
gaucacccacuccuaugua

SEQ ID NO: 535131 - RNA, 19 nt, Homo sapiens
gcugcuaugugcuguguga

SEQ ID NO: 535132 - RNA, 19 nt, Homo sapiens
caagcgcgguuuccgagaa

SEQ ID NO: 535133 - RNA, 19 nt, Homo sapiens
gaagaaugcggcucugaca

SEQ ID NO: 535134 - RNA, 19 nt, Homo sapiens
ggaagggugggaagggaua

SEQ ID NO: 535135 - RNA, 19 nt, Homo sapiens
ccuggaagcuuaaaguauc

SEQ ID NO: 535136 - RNA, 19 nt, Homo sapiens
gacauggacuuuggagaga

SEQ ID NO: 535137 - RNA, 19 nt, Homo sapiens
cgggccaucuucauugaua

SEQ ID NO: 535138 - RNA, 19 nt, Homo sapiens
ggacauccaggcacgaaug

SEQ ID NO: 535139 - RNA, 19 nt, Homo sapiens
ccuuuaacccugauucaua

SEQ ID NO: 535140 - RNA, 19 nt, Homo sapiens
cuuggucccuggaagcuua

SEQ ID NO: 535141 - RNA, 19 nt, Homo sapiens
acaccugaauggacuaaga

SEQ ID NO: 535142 - RNA, 19 nt, Homo sapiens
caagugucauggcacauca

SEQ ID NO: 535143 - RNA, 19 nt, Homo sapiens
uaagaugaaaugcacugua

SEQ ID NO: 535144 - RNA, 19 nt, Homo sapiens
ggagagcuggucuacuuug

SEQ ID NO: 535145 - RNA, 19 nt, Homo sapiens
agacagugguagagagguu

SEQ ID NO: 535146 - RNA, 19 nt, Homo sapiens
gguuuaagcagcacuagug

SEQ ID NO: 535147 - RNA, 19 nt, Homo sapiens
uuagggaaguugucuccuu

SEQ ID NO: 535148 - RNA, 19 nt, Homo sapiens
ccacagcgccauccucaag

SEQ ID NO: 535149 - RNA, 19 nt, Homo sapiens
uuacagagugggugaaugu

SEQ ID NO: 535150 - RNA, 19 nt, Homo sapiens
gcucuaagcaaugagauuc

SEQ ID NO: 535151 - RNA, 19 nt, Homo sapiens
gagaucacccacuccuaug

SEQ ID NO: 535152 - RNA, 19 nt, Homo sapiens
gguggacucugggaugugu

SEQ ID NO: 535153 - RNA, 19 nt, Homo sapiens
gaguugagcgcugccauug

SEQ ID NO: 535154 - RNA, 19 nt, Homo sapiens
caagaccagccgccuguug

SEQ ID NO: 535155 - RNA, 19 nt, Homo sapiens
ggcgccaggugguaacuga

SEQ ID NO: 535156 - RNA, 19 nt, Homo sapiens
agagaucacccacuccuau

SEQ ID NO: 535157 - RNA, 19 nt, Homo sapiens
ggcacuguuuggagccaua

SEQ ID NO: 535158 - RNA, 19 nt, Homo sapiens
gcugccaguucaagacaug

SEQ ID NO: 535159 - RNA, 19 nt, Homo sapiens
auacugagacuuguucuug

SEQ ID NO: 535160 - RNA, 19 nt, Homo sapiens
ggagccauaagaucuguau

SEQ ID NO: 535161 - RNA, 19 nt, Homo sapiens
guauugcuccucccacuuc

SEQ ID NO: 535162 - RNA, 19 nt, Homo sapiens
cugaauggacuaagaugaa

SEQ ID NO: 535163 - RNA, 19 nt, Homo sapiens
gggugaauguguguaagug

SEQ ID NO: 535164 - RNA, 19 nt, Homo sapiens
gcagucgggcucuaagcaa

SEQ ID NO: 535165 - RNA, 19 nt, Homo sapiens
gaacugcuccgcgcuugag

SEQ ID NO: 535166 - RNA, 19 nt, Homo sapiens
gcaagugucauggcacauc

SEQ ID NO: 535167 - RNA, 19 nt, Homo sapiens
gaagcggaaaugcaagugu

SEQ ID NO: 535168 - RNA, 19 nt, Homo sapiens
gaauggacuaagaugaaau

SEQ ID NO: 535169 - RNA, 19 nt, Homo sapiens
cgaaugcgaauccacaaca

SEQ ID NO: 535170 - RNA, 19 nt, Homo sapiens
gcacugucccgaggcaaga

SEQ ID NO: 535171 - RNA, 19 nt, Homo sapiens
gaagggugggaagggauaa

SEQ ID NO: 535172 - RNA, 19 nt, Homo sapiens
cacccacuccuauguacua

SEQ ID NO: 535173 - RNA, 19 nt, Homo sapiens
caccacuccucucccuuga

SEQ ID NO: 535174 - RNA, 19 nt, Homo sapiens
gggugggaagggauaauuu

SEQ ID NO: 535175 - RNA, 19 nt, Homo sapiens
ccacuccuauguacuaucc

SEQ ID NO: 535176 - RNA, 19 nt, Homo sapiens
ccuuugcucugauuuccuu

SEQ ID NO: 535177 - RNA, 19 nt, Homo sapiens
cagguggacucugggaugu

SEQ ID NO: 535178 - RNA, 19 nt, Homo sapiens
cuaccuggaaacagcuuua

SEQ ID NO: 535179 - RNA, 19 nt, Homo sapiens
cagucgggcucuaagcaau

SEQ ID NO: 535180 - RNA, 19 nt, Homo sapiens
ggaacugcuccgcgcuuga

SEQ ID NO: 535181 - RNA, 19 nt, Homo sapiens
ggugaauguguguaaguga

SEQ ID NO: 535182 - RNA, 19 nt, Homo sapiens
ucucgggauuucuuggauu

SEQ ID NO: 535183 - RNA, 19 nt, Homo sapiens
gggcaguggugagcaggau

SEQ ID NO: 535184 - RNA, 19 nt, Homo sapiens
cuuuaacccugauucauac

SEQ ID NO: 535185 - RNA, 19 nt, Homo sapiens
ccacuggugcugcuaugug

SEQ ID NO: 535186 - RNA, 19 nt, Homo sapiens
gcacuguuuggagccauaa

SEQ ID NO: 535187 - RNA, 19 nt, Homo sapiens
uuaagcagcacuagugaag

SEQ ID NO: 535188 - RNA, 19 nt, Homo sapiens
cgaguugagcgcugccauu

SEQ ID NO: 535189 - RNA, 19 nt, Homo sapiens
gucgggcucuaagcaauga

SEQ ID NO: 535190 - RNA, 19 nt, Homo sapiens
gugcugcuaugugcugugu

SEQ ID NO: 535191 - RNA, 19 nt, Homo sapiens
gagauucugggccugaagu

SEQ ID NO: 535192 - RNA, 19 nt, Homo sapiens
agaaugcggcucugacaag

SEQ ID NO: 535193 - RNA, 19 nt, Homo sapiens
gauacccacaaccgcaauu

SEQ ID NO: 535194 - RNA, 19 nt, Homo sapiens
ggaaugggguggcuguaac

SEQ ID NO: 535195 - RNA, 19 nt, Homo sapiens
ugaaauaaaugcugaguga

SEQ ID NO: 535196 - RNA, 19 nt, Homo sapiens
uguggaagcuacagaaaua

SEQ ID NO: 535197 - RNA, 19 nt, Homo sapiens
gagcucugcuugugaauuc

SEQ ID NO: 535198 - RNA, 19 nt, Homo sapiens
gcagcuguaugaaauaaau

SEQ ID NO: 535199 - RNA, 19 nt, Homo sapiens
ggaggcggcuugugcuuug

SEQ ID NO: 535200 - RNA, 19 nt, Homo sapiens
uuaagcagcuguaugaaau

SEQ ID NO: 535201 - RNA, 19 nt, Homo sapiens
ggaagcuacagaaauauuu

SEQ ID NO: 535202 - RNA, 19 nt, Homo sapiens
gauacagacuugaccuuuc

SEQ ID NO: 535203 - RNA, 19 nt, Homo sapiens
ucaccugacuucugcauga

SEQ ID NO: 535204 - RNA, 19 nt, Homo sapiens
uagcuuggguuguaaaugu

SEQ ID NO: 535205 - RNA, 19 nt, Homo sapiens
aaaggaaaccgacaagauu

SEQ ID NO: 535206 - RNA, 19 nt, Homo sapiens
caaaggaaaccgacaagau

SEQ ID NO: 535207 - RNA, 19 nt, Homo sapiens
ggcaggacaucaaaggaaa

SEQ ID NO: 535208 - RNA, 19 nt, Homo sapiens
cgaggacucugcucaagga

SEQ ID NO: 535209 - RNA, 19 nt, Homo sapiens
gcgccucucuggaaaugaa

SEQ ID NO: 535210 - RNA, 19 nt, Homo sapiens
ggagucggccuucguguau

SEQ ID NO: 535211 - RNA, 19 nt, Homo sapiens
gaacugcuccuccauugag

SEQ ID NO: 535212 - RNA, 19 nt, Homo sapiens
ggguggcacuucucaauuc

SEQ ID NO: 535213 - RNA, 19 nt, Homo sapiens
gacaggcagugcaacaaga

SEQ ID NO: 535214 - RNA, 19 nt, Homo sapiens
gcagagcucaccugacuuc

SEQ ID NO: 535215 - RNA, 19 nt, Homo sapiens
ggaaaccgacaagauuaaa

SEQ ID NO: 535216 - RNA, 19 nt, Homo sapiens
aaggaaaccgacaagauua

SEQ ID NO: 535217 - RNA, 19 nt, Homo sapiens
aagcagcuguaugaaauaa

SEQ ID NO: 535218 - RNA, 19 nt, Homo sapiens
auacagacuugaccuuuca

SEQ ID NO: 535219 - RNA, 19 nt, Homo sapiens
gcagcaaccuggagcucau

SEQ ID NO: 535220 - RNA, 19 nt, Homo sapiens
ucacuagcuuggguuguaa

SEQ ID NO: 535221 - RNA, 19 nt, Homo sapiens
caucggcccuggcacugaa

SEQ ID NO: 535222 - RNA, 19 nt, Homo sapiens
gggcaggacaucaaaggaa

SEQ ID NO: 535223 - RNA, 19 nt, Homo sapiens
gaagccaccaggaacagaa

SEQ ID NO: 535224 - RNA, 19 nt, Homo sapiens
ccauggagcucugcuugug

SEQ ID NO: 535225 - RNA, 19 nt, Homo sapiens
caaggacccucagcaacug

SEQ ID NO: 535226 - RNA, 19 nt, Homo sapiens
gcucaaggacccucagcaa

SEQ ID NO: 535227 - RNA, 19 nt, Homo sapiens
ccaagccaauaaacugaug

SEQ ID NO: 535228 - RNA, 19 nt, Homo sapiens
caggaucccaagccaauaa

SEQ ID NO: 535229 - RNA, 19 nt, Homo sapiens
gggagucggccuucgugua

SEQ ID NO: 535230 - RNA, 19 nt, Homo sapiens
cgacagcugcgaccuuaug

SEQ ID NO: 535231 - RNA, 19 nt, Homo sapiens
ggaacugcuccuccauuga

SEQ ID NO: 535232 - RNA, 19 nt, Homo sapiens
gcaugaagaaugagaaggu

SEQ ID NO: 535233 - RNA, 19 nt, Homo sapiens
aaacugaugcgucuacaca

SEQ ID NO: 535234 - RNA, 19 nt, Homo sapiens
gauguggaagcuacagaaa

SEQ ID NO: 535235 - RNA, 19 nt, Homo sapiens
ugagacugauacagacuug

SEQ ID NO: 535236 - RNA, 19 nt, Homo sapiens
gucgagcggugccacugua

SEQ ID NO: 535237 - RNA, 19 nt, Homo sapiens
uaagcagcuguaugaaaua

SEQ ID NO: 535238 - RNA, 19 nt, Homo sapiens
ggauguggaagcuacagaa

SEQ ID NO: 535239 - RNA, 19 nt, Homo sapiens
gcacuucucaauuccucuu

SEQ ID NO: 535240 - RNA, 19 nt, Homo sapiens
ggaaggagggcaggacauc

SEQ ID NO: 535241 - RNA, 19 nt, Homo sapiens
agcgacagcugcgaccuua

SEQ ID NO: 535242 - RNA, 19 nt, Homo sapiens
caagacaggcagugcaaca

SEQ ID NO: 535243 - RNA, 19 nt, Homo sapiens
cacauggaaucacuagcuu

SEQ ID NO: 535244 - RNA, 19 nt, Homo sapiens
caucaaaggaaaccgacaa

SEQ ID NO: 535245 - RNA, 19 nt, Homo sapiens
cuggauauccggccuguga

SEQ ID NO: 535246 - RNA, 19 nt, Homo sapiens
gaaggagggcaggacauca

SEQ ID NO: 535247 - RNA, 19 nt, Homo sapiens
gagcggugccacuguaagu

SEQ ID NO: 535248 - RNA, 19 nt, Homo sapiens
cuucucaauuccucuuuau

SEQ ID NO: 535249 - RNA, 19 nt, Homo sapiens
ucaaggacccucagcaacu

SEQ ID NO: 535250 - RNA, 19 nt, Homo sapiens
cucuggaaaugaaguguaa

SEQ ID NO: 535251 - RNA, 19 nt, Homo sapiens
ugauacagacuugaccuuu

SEQ ID NO: 535252 - RNA, 19 nt, Homo sapiens
gcuuugccuucacuuggaa

SEQ ID NO: 535253 - RNA, 19 nt, Homo sapiens
gggaggcggcuugugcuuu

SEQ ID NO: 535254 - RNA, 19 nt, Homo sapiens
gcgcuaugucugcaaguga

SEQ ID NO: 535255 - RNA, 19 nt, Homo sapiens
ccacauggaaucacuagcu

SEQ ID NO: 535256 - RNA, 19 nt, Homo sapiens
ggagcucugcuugugaauu

SEQ ID NO: 535257 - RNA, 19 nt, Homo sapiens
uuuaagcagcuguaugaaa

SEQ ID NO: 535258 - RNA, 19 nt, Homo sapiens
uggaagcuacagaaauauu

SEQ ID NO: 535259 - RNA, 19 nt, Homo sapiens
ucggugagacugauacaga

SEQ ID NO: 535260 - RNA, 19 nt, Homo sapiens
gaaaccgacaagauuaaaa

SEQ ID NO: 535261 - RNA, 19 nt, Homo sapiens
aggaaaccgacaagauuaa

SEQ ID NO: 535262 - RNA, 19 nt, Homo sapiens
ggaagccaccaggaacaga

SEQ ID NO: 535263 - RNA, 19 nt, Homo sapiens
acuucucaauuccucuuua

SEQ ID NO: 535264 - RNA, 19 nt, Homo sapiens
aucacuagcuuggguugua

SEQ ID NO: 535265 - RNA, 19 nt, Homo sapiens
caccugacuucugcaugaa

SEQ ID NO: 535266 - RNA, 19 nt, Homo sapiens
gaucccaagccaauaaacu

SEQ ID NO: 535267 - RNA, 19 nt, Homo sapiens
gugcggacaaccucagcua

SEQ ID NO: 535268 - RNA, 19 nt, Homo sapiens
gggaucggugagacugaua

SEQ ID NO: 535269 - RNA, 19 nt, Homo sapiens
ggacugaucuugucuacuu

SEQ ID NO: 535270 - RNA, 19 nt, Homo sapiens
gaaaugaguugcacuaaag

SEQ ID NO: 535271 - RNA, 19 nt, Homo sapiens
cgagugaucugugacaaua

SEQ ID NO: 535272 - RNA, 19 nt, Homo sapiens
uaacacugcugucuccuuu

SEQ ID NO: 535273 - RNA, 19 nt, Homo sapiens
ggacaagguuccauucaca

SEQ ID NO: 535274 - RNA, 19 nt, Homo sapiens
ugaaaugaguugcacuaaa

SEQ ID NO: 535275 - RNA, 19 nt, Homo sapiens
ggacagcacugccucuuuu

SEQ ID NO: 535276 - RNA, 19 nt, Homo sapiens
gaaguccguuugagcagaa

SEQ ID NO: 535277 - RNA, 19 nt, Homo sapiens
caagcaaugugguuguaaa

SEQ ID NO: 535278 - RNA, 19 nt, Homo sapiens
acacauucauucucucuuu

SEQ ID NO: 535279 - RNA, 19 nt, Homo sapiens
uuaaggauguagagaguaa

SEQ ID NO: 535280 - RNA, 19 nt, Homo sapiens
ucaagccucucaacucaaa

SEQ ID NO: 535281 - RNA, 19 nt, Homo sapiens
ugacaacucuccagauuac

SEQ ID NO: 535282 - RNA, 19 nt, Homo sapiens
aaucuuaacugcaaucugu

SEQ ID NO: 535283 - RNA, 19 nt, Homo sapiens
gcaaugugguuguaaaauu

SEQ ID NO: 535284 - RNA, 19 nt, Homo sapiens
gcuaccacauucuauuauu

SEQ ID NO: 535285 - RNA, 19 nt, Homo sapiens
aaacacacauucauucucu

SEQ ID NO: 535286 - RNA, 19 nt, Homo sapiens
ugugcaagcucccugauuu

SEQ ID NO: 535287 - RNA, 19 nt, Homo sapiens
uguccuggcugguuccuua

SEQ ID NO: 535288 - RNA, 19 nt, Homo sapiens
ggcgugcacucucagauuu

SEQ ID NO: 535289 - RNA, 19 nt, Homo sapiens
gaacagacgguugugaaau

SEQ ID NO: 535290 - RNA, 19 nt, Homo sapiens
gggcacgagugaucuguga

SEQ ID NO: 535291 - RNA, 19 nt, Homo sapiens
ggaacagacgguugugaaa

SEQ ID NO: 535292 - RNA, 19 nt, Homo sapiens
caccaccgcuggaacugua

SEQ ID NO: 535293 - RNA, 19 nt, Homo sapiens
gugacaauaucccugguuu

SEQ ID NO: 535294 - RNA, 19 nt, Homo sapiens
gaacacuccuaggauagau

SEQ ID NO: 535295 - RNA, 19 nt, Homo sapiens
gaggaaggguaccuguaga

SEQ ID NO: 535296 - RNA, 19 nt, Homo sapiens
acaaguguuugcaaaggua

SEQ ID NO: 535297 - RNA, 19 nt, Homo sapiens
gcagugguucccaugcuua

SEQ ID NO: 535298 - RNA, 19 nt, Homo sapiens
gagguggaaugcagugguu

SEQ ID NO: 535299 - RNA, 19 nt, Homo sapiens
gaagggagaguagaagaga

SEQ ID NO: 535300 - RNA, 19 nt, Homo sapiens
ccaagauggugccaacuuc

SEQ ID NO: 535301 - RNA, 19 nt, Homo sapiens
gagagugucagcaccaauu

SEQ ID NO: 535302 - RNA, 19 nt, Homo sapiens
uggcauaccuacacaguca

SEQ ID NO: 535303 - RNA, 19 nt, Homo sapiens
ggauggccuuggaguggua

SEQ ID NO: 535304 - RNA, 19 nt, Homo sapiens
cuaccacauucuauuauug

SEQ ID NO: 535305 - RNA, 19 nt, Homo sapiens
gcugcuaccgcuucuauuu

SEQ ID NO: 535306 - RNA, 19 nt, Homo sapiens
ucacucaucccuccaauuc

SEQ ID NO: 535307 - RNA, 19 nt, Homo sapiens
ggccgugucugcagcaaga

SEQ ID NO: 535308 - RNA, 19 nt, Homo sapiens
aaucuuaggcuaccacauu

SEQ ID NO: 535309 - RNA, 19 nt, Homo sapiens
gauauaagaaacugugcaa

SEQ ID NO: 535310 - RNA, 19 nt, Homo sapiens
uugagagccugagauguua

SEQ ID NO: 535311 - RNA, 19 nt, Homo sapiens
aaaguuagaugggacaaag

SEQ ID NO: 535312 - RNA, 19 nt, Homo sapiens
uuugacaacucuccagauu

SEQ ID NO: 535313 - RNA, 19 nt, Homo sapiens
cugaagagcccaagcaaug

SEQ ID NO: 535314 - RNA, 19 nt, Homo sapiens
gaagagcccaagcaaugug

SEQ ID NO: 535315 - RNA, 19 nt, Homo sapiens
acacugcugucuccuuuca

SEQ ID NO: 535316 - RNA, 19 nt, Homo sapiens
gcuguacggugcaaggaau

SEQ ID NO: 535317 - RNA, 19 nt, Homo sapiens
uaucacacuuucccacaug

SEQ ID NO: 535318 - RNA, 19 nt, Homo sapiens
ccauucacaugcucauaug

SEQ ID NO: 535319 - RNA, 19 nt, Homo sapiens
ugcuaccgcuucuauuuaa

SEQ ID NO: 535320 - RNA, 19 nt, Homo sapiens
acucaucccuccaauucaa

SEQ ID NO: 535321 - RNA, 19 nt, Homo sapiens
ccaaggagaagaggcuuaa

SEQ ID NO: 535322 - RNA, 19 nt, Homo sapiens
agaggcagcuuuuguauau

SEQ ID NO: 535323 - RNA, 19 nt, Homo sapiens
uucugaagcuggaguguaa

SEQ ID NO: 535324 - RNA, 19 nt, Homo sapiens
cauguuggauggccuugga

SEQ ID NO: 535325 - RNA, 19 nt, Homo sapiens
gacaauaucccugguuugg

SEQ ID NO: 535326 - RNA, 19 nt, Homo sapiens
acacuccuaggauagauua

SEQ ID NO: 535327 - RNA, 19 nt, Homo sapiens
uggcaugucccuucucuga

SEQ ID NO: 535328 - RNA, 19 nt, Homo sapiens
ggaaggguaccuguagaga

SEQ ID NO: 535329 - RNA, 19 nt, Homo sapiens
uaagugccauggcgugagu

SEQ ID NO: 535330 - RNA, 19 nt, Homo sapiens
auucaagccucucaacuca

SEQ ID NO: 535331 - RNA, 19 nt, Homo sapiens
ccacuggugcugugcugua

SEQ ID NO: 535332 - RNA, 19 nt, Homo sapiens
cugcuaccgcuucuauuua

SEQ ID NO: 535333 - RNA, 19 nt, Homo sapiens
agacgguugugaaaucaug

SEQ ID NO: 535334 - RNA, 19 nt, Homo sapiens
aacagacgguugugaaauc

SEQ ID NO: 535335 - RNA, 19 nt, Homo sapiens
ggagaagaggcuuaaggau

SEQ ID NO: 535336 - RNA, 19 nt, Homo sapiens
uuagaugggacaaagauga

SEQ ID NO: 535337 - RNA, 19 nt, Homo sapiens
gugguagccauaagcauuu

SEQ ID NO: 535338 - RNA, 19 nt, Homo sapiens
agucagcguucaacaagug

SEQ ID NO: 535339 - RNA, 19 nt, Homo sapiens
caauacaaacacacauuca

SEQ ID NO: 535340 - RNA, 19 nt, Homo sapiens
ggcaguaccuggcauaccu

SEQ ID NO: 535341 - RNA, 19 nt, Homo sapiens
aggcuaccacauucuauua

SEQ ID NO: 535342 - RNA, 19 nt, Homo sapiens
cccaagcaaugugguugua

SEQ ID NO: 535343 - RNA, 19 nt, Homo sapiens
gcacgagugaucugugaca

SEQ ID NO: 535344 - RNA, 19 nt, Homo sapiens
gcacugccucuuuugcuua

SEQ ID NO: 535345 - RNA, 19 nt, Homo sapiens
ccugagauguuagccauag

SEQ ID NO: 535346 - RNA, 19 nt, Homo sapiens
guuucuaccuggccaaagu

SEQ ID NO: 535347 - RNA, 19 nt, Homo sapiens
gggcugcuaccgcuucuau

SEQ ID NO: 535348 - RNA, 19 nt, Homo sapiens
gacugaucuugucuacuuu

SEQ ID NO: 535349 - RNA, 19 nt, Homo sapiens
ccucaugaacuuacauaau

SEQ ID NO: 535350 - RNA, 19 nt, Homo sapiens
ugaauggcaugucccuucu

SEQ ID NO: 535351 - RNA, 19 nt, Homo sapiens
ucuccuauaucacacuuuc

SEQ ID NO: 535352 - RNA, 19 nt, Homo sapiens
gaguugcacuaaaguacgu

SEQ ID NO: 535353 - RNA, 19 nt, Homo sapiens
gagauuugaagggagagua

SEQ ID NO: 535354 - RNA, 19 nt, Homo sapiens
gcaaggaaugcagaaauac

SEQ ID NO: 535355 - RNA, 19 nt, Homo sapiens
uacaaacacacauucauuc

SEQ ID NO: 535356 - RNA, 19 nt, Homo sapiens
acucgagucacccguguua

SEQ ID NO: 535357 - RNA, 19 nt, Homo sapiens
caagauggugccaacuuca

SEQ ID NO: 535358 - RNA, 19 nt, Homo sapiens
cuccuaggauagauuaaug

SEQ ID NO: 535359 - RNA, 19 nt, Homo sapiens
gcaguaccuggcauaccua

SEQ ID NO: 535360 - RNA, 19 nt, Homo sapiens
gaugggacaaagaugaaug

SEQ ID NO: 535361 - RNA, 19 nt, Homo sapiens
gccaaggagaagaggcuua

SEQ ID NO: 535362 - RNA, 19 nt, Homo sapiens
cgugucaugcucagaagua

SEQ ID NO: 535363 - RNA, 19 nt, Homo sapiens
auugagagccugagauguu

SEQ ID NO: 535364 - RNA, 19 nt, Homo sapiens
agggagaguagaagagaua

SEQ ID NO: 535365 - RNA, 19 nt, Homo sapiens
acagacgguugugaaauca

SEQ ID NO: 535366 - RNA, 19 nt, Homo sapiens
cuaccuggccaaaguuaga

SEQ ID NO: 535367 - RNA, 19 nt, Homo sapiens
gugaaaugaguugcacuaa

SEQ ID NO: 535368 - RNA, 19 nt, Homo sapiens
auaagaaacugugcaagcu

SEQ ID NO: 535369 - RNA, 19 nt, Homo sapiens
ggacugaucuugucuacuu

SEQ ID NO: 535370 - RNA, 19 nt, Homo sapiens
gaaaugaguugcacuaaag

SEQ ID NO: 535371 - RNA, 19 nt, Homo sapiens
cgagugaucugugacaaua

SEQ ID NO: 535372 - RNA, 19 nt, Homo sapiens
ggacaagguuccauucaca

SEQ ID NO: 535373 - RNA, 19 nt, Homo sapiens
ugaaaugaguugcacuaaa

SEQ ID NO: 535374 - RNA, 19 nt, Homo sapiens
ggacagcacugccucuuuu

SEQ ID NO: 535375 - RNA, 19 nt, Homo sapiens
gaaguccguuugagcagaa

SEQ ID NO: 535376 - RNA, 19 nt, Homo sapiens
acacauucauucucucuuu

SEQ ID NO: 535377 - RNA, 19 nt, Homo sapiens
uuaaggauguagagaguaa

SEQ ID NO: 535378 - RNA, 19 nt, Homo sapiens
ucaagccucucaacucaaa

SEQ ID NO: 535379 - RNA, 19 nt, Homo sapiens
ugacaacucuccagauuac

SEQ ID NO: 535380 - RNA, 19 nt, Homo sapiens
gcuaccacauucuauuauu

SEQ ID NO: 535381 - RNA, 19 nt, Homo sapiens
aaacacacauucauucucu

SEQ ID NO: 535382 - RNA, 19 nt, Homo sapiens
ugugcaagcucccugauuu

SEQ ID NO: 535383 - RNA, 19 nt, Homo sapiens
uguccuggcugguuccuua

SEQ ID NO: 535384 - RNA, 19 nt, Homo sapiens
ggcgugcacucucagauuu

SEQ ID NO: 535385 - RNA, 19 nt, Homo sapiens
gaacagacgguugugaaau

SEQ ID NO: 535386 - RNA, 19 nt, Homo sapiens
gggcacgagugaucuguga

SEQ ID NO: 535387 - RNA, 19 nt, Homo sapiens
ggaacagacgguugugaaa

SEQ ID NO: 535388 - RNA, 19 nt, Homo sapiens
caccaccgcuggaacugua

SEQ ID NO: 535389 - RNA, 19 nt, Homo sapiens
gugacaauaucccugguuu

SEQ ID NO: 535390 - RNA, 19 nt, Homo sapiens
gaacacuccuaggauagau

SEQ ID NO: 535391 - RNA, 19 nt, Homo sapiens
gaggaaggguaccuguaga

SEQ ID NO: 535392 - RNA, 19 nt, Homo sapiens
gcagugguucccaugcuua

SEQ ID NO: 535393 - RNA, 19 nt, Homo sapiens
gagguggaaugcagugguu

SEQ ID NO: 535394 - RNA, 19 nt, Homo sapiens
gaagggagaguagaagaga

SEQ ID NO: 535395 - RNA, 19 nt, Homo sapiens
ccaagauggugccaacuuc

SEQ ID NO: 535396 - RNA, 19 nt, Homo sapiens
gagagugucagcaccaauu

SEQ ID NO: 535397 - RNA, 19 nt, Homo sapiens
cuaccacauucuauuauug

SEQ ID NO: 535398 - RNA, 19 nt, Homo sapiens
gcugcuaccgcuucuauuu

SEQ ID NO: 535399 - RNA, 19 nt, Homo sapiens
ucacucaucccuccaauuc

SEQ ID NO: 535400 - RNA, 19 nt, Homo sapiens
ggccgugucugcagcaaga

SEQ ID NO: 535401 - RNA, 19 nt, Homo sapiens
aaucuuaggcuaccacauu

SEQ ID NO: 535402 - RNA, 19 nt, Homo sapiens
gauauaagaaacugugcaa

SEQ ID NO: 535403 - RNA, 19 nt, Homo sapiens
uugagagccugagauguua

SEQ ID NO: 535404 - RNA, 19 nt, Homo sapiens
aaaguuagaugggacaaag

SEQ ID NO: 535405 - RNA, 19 nt, Homo sapiens
uuugacaacucuccagauu

SEQ ID NO: 535406 - RNA, 19 nt, Homo sapiens
gcuguacggugcaaggaau

SEQ ID NO: 535407 - RNA, 19 nt, Homo sapiens
ccauucacaugcucauaug

SEQ ID NO: 535408 - RNA, 19 nt, Homo sapiens
ugcuaccgcuucuauuuaa

SEQ ID NO: 535409 - RNA, 19 nt, Homo sapiens
acucaucccuccaauucaa

SEQ ID NO: 535410 - RNA, 19 nt, Homo sapiens
ccaaggagaagaggcuuaa

SEQ ID NO: 535411 - RNA, 19 nt, Homo sapiens
agaggcagcuuuuguauau

SEQ ID NO: 535412 - RNA, 19 nt, Homo sapiens
uucugaagcuggaguguaa

SEQ ID NO: 535413 - RNA, 19 nt, Homo sapiens
gacaauaucccugguuugg

SEQ ID NO: 535414 - RNA, 19 nt, Homo sapiens
acacuccuaggauagauua

SEQ ID NO: 535415 - RNA, 19 nt, Homo sapiens
uggcaugucccuucucuga

SEQ ID NO: 535416 - RNA, 19 nt, Homo sapiens
ggaaggguaccuguagaga

SEQ ID NO: 535417 - RNA, 19 nt, Homo sapiens
uaagugccauggcgugagu

SEQ ID NO: 535418 - RNA, 19 nt, Homo sapiens
auucaagccucucaacuca

SEQ ID NO: 535419 - RNA, 19 nt, Homo sapiens
ccacuggugcugugcugua

SEQ ID NO: 535420 - RNA, 19 nt, Homo sapiens
cugcuaccgcuucuauuua

SEQ ID NO: 535421 - RNA, 19 nt, Homo sapiens
agacgguugugaaaucaug

SEQ ID NO: 535422 - RNA, 19 nt, Homo sapiens
aacagacgguugugaaauc

SEQ ID NO: 535423 - RNA, 19 nt, Homo sapiens
ggagaagaggcuuaaggau

SEQ ID NO: 535424 - RNA, 19 nt, Homo sapiens
uuagaugggacaaagauga

SEQ ID NO: 535425 - RNA, 19 nt, Homo sapiens
caauacaaacacacauuca

SEQ ID NO: 535426 - RNA, 19 nt, Homo sapiens
aggcuaccacauucuauua

SEQ ID NO: 535427 - RNA, 19 nt, Homo sapiens
gcacgagugaucugugaca

SEQ ID NO: 535428 - RNA, 19 nt, Homo sapiens
gcacugccucuuuugcuua

SEQ ID NO: 535429 - RNA, 19 nt, Homo sapiens
ccugagauguuagccauag

SEQ ID NO: 535430 - RNA, 19 nt, Homo sapiens
guuucuaccuggccaaagu

SEQ ID NO: 535431 - RNA, 19 nt, Homo sapiens
gggcugcuaccgcuucuau

SEQ ID NO: 535432 - RNA, 19 nt, Homo sapiens
gacugaucuugucuacuuu

SEQ ID NO: 535433 - RNA, 19 nt, Homo sapiens
ccucaugaacuuacauaau

SEQ ID NO: 535434 - RNA, 19 nt, Homo sapiens
ugaauggcaugucccuucu

SEQ ID NO: 535435 - RNA, 19 nt, Homo sapiens
gaguugcacuaaaguacgu

SEQ ID NO: 535436 - RNA, 19 nt, Homo sapiens
gagauuugaagggagagua

SEQ ID NO: 535437 - RNA, 19 nt, Homo sapiens
gcaaggaaugcagaaauac

SEQ ID NO: 535438 - RNA, 19 nt, Homo sapiens
uacaaacacacauucauuc

SEQ ID NO: 535439 - RNA, 19 nt, Homo sapiens
acucgagucacccguguua

SEQ ID NO: 535440 - RNA, 19 nt, Homo sapiens
caagauggugccaacuuca

SEQ ID NO: 535441 - RNA, 19 nt, Homo sapiens
cuccuaggauagauuaaug

SEQ ID NO: 535442 - RNA, 19 nt, Homo sapiens
gaugggacaaagaugaaug

SEQ ID NO: 535443 - RNA, 19 nt, Homo sapiens
cgugucaugcucagaagua

SEQ ID NO: 535444 - RNA, 19 nt, Homo sapiens
gccaaggagaagaggcuua

SEQ ID NO: 535445 - RNA, 19 nt, Homo sapiens
auugagagccugagauguu

SEQ ID NO: 535446 - RNA, 19 nt, Homo sapiens
agggagaguagaagagaua

SEQ ID NO: 535447 - RNA, 19 nt, Homo sapiens
acagacgguugugaaauca

SEQ ID NO: 535448 - RNA, 19 nt, Homo sapiens
cuaccuggccaaaguuaga

SEQ ID NO: 535449 - RNA, 19 nt, Homo sapiens
gugaaaugaguugcacuaa

SEQ ID NO: 535450 - RNA, 19 nt, Homo sapiens
auaagaaacugugcaagcu

SEQ ID NO: 535451 - RNA, 19 nt, Homo sapiens
ccacauucuauuauugaga

SEQ ID NO: 535452 - RNA, 19 nt, Homo sapiens
uagaugggacaaagaugaa

SEQ ID NO: 535453 - RNA, 19 nt, Homo sapiens
gagaggcagcuuuuguaua

SEQ ID NO: 535454 - RNA, 19 nt, Homo sapiens
caacucuccagauuacugu

SEQ ID NO: 535455 - RNA, 19 nt, Homo sapiens
gcccucaugaacuuacaua

SEQ ID NO: 535456 - RNA, 19 nt, Homo sapiens
uagccagggugaacugagu

SEQ ID NO: 535457 - RNA, 19 nt, Homo sapiens
acaauacaaacacacauuc

SEQ ID NO: 535458 - RNA, 19 nt, Homo sapiens
gcaccagcuucccgacacu

SEQ ID NO: 535459 - RNA, 19 nt, Homo sapiens
uguagagaguaauccauag

SEQ ID NO: 535460 - RNA, 19 nt, Homo sapiens
ccagugugagugcaaauuc

SEQ ID NO: 535461 - RNA, 19 nt, Homo sapiens
agugaucugugacaauauc

SEQ ID NO: 535462 - RNA, 19 nt, Homo sapiens
caaaguuagaugggacaaa

SEQ ID NO: 535463 - RNA, 19 nt, Homo sapiens
caaggaaugcagaaauacu

SEQ ID NO: 535464 - RNA, 19 nt, Homo sapiens
caaacacacauucauucuc

SEQ ID NO: 535465 - RNA, 19 nt, Homo sapiens
gcuauuacucgcgccugua

SEQ ID NO: 535466 - RNA, 19 nt, Homo sapiens
uugacaacucuccagauua

SEQ ID NO: 535467 - RNA, 19 nt, Homo sapiens
agaggaaggguaccuguag

SEQ ID NO: 535468 - RNA, 19 nt, Homo sapiens
ggccgugucaugcucagaa

SEQ ID NO: 535469 - RNA, 19 nt, Homo sapiens
gcaagcaucugaagcacaa

SEQ ID NO: 535470 - RNA, 19 nt, Homo sapiens
gcaaguucgucaaggaauu

SEQ ID NO: 535471 - RNA, 19 nt, Homo sapiens
gcagcaaguucgucaagga

SEQ ID NO: 535472 - RNA, 19 nt, Homo sapiens
gcacauggcacaggcauug

SEQ ID NO: 535473 - RNA, 19 nt, Homo sapiens
gagacaaccuuaaguacag

SEQ ID NO: 535474 - RNA, 19 nt, Homo sapiens
gcggagacaaccuuaagua

SEQ ID NO: 535475 - RNA, 19 nt, Homo sapiens
gagacugccuuccucuaug

SEQ ID NO: 535476 - RNA, 19 nt, Homo sapiens
ggagacaaccuuaaguaca

SEQ ID NO: 535477 - RNA, 19 nt, Homo sapiens
ggagacugccuuccucuau

SEQ ID NO: 535478 - RNA, 19 nt, Homo sapiens
ggccaugcaugcuaguaug

SEQ ID NO: 535479 - RNA, 19 nt, Homo sapiens
gcaaggacugagaggcuuu

SEQ ID NO: 535480 - RNA, 19 nt, Homo sapiens
gagcaugaaugggccuaca

SEQ ID NO: 535481 - RNA, 19 nt, Homo sapiens
gggcagcaccaccaaugaa

SEQ ID NO: 535482 - RNA, 19 nt, Homo sapiens
gaggugggcaagcaucuga

SEQ ID NO: 535483 - RNA, 19 nt, Homo sapiens
gcaguuggcgccuuuccau

SEQ ID NO: 535484 - RNA, 19 nt, Homo sapiens
gcucagagugcaggcauug

SEQ ID NO: 535485 - RNA, 19 nt, Homo sapiens
gguagucccugggcucagu

SEQ ID NO: 535486 - RNA, 19 nt, Homo sapiens
cagcaaguucgucaaggaa

SEQ ID NO: 535487 - RNA, 19 nt, Homo sapiens
gugcguuggugcugcuaug

SEQ ID NO: 535488 - RNA, 19 nt, Homo sapiens
ccaguuccaguuccgcuuu

SEQ ID NO: 535489 - RNA, 19 nt, Homo sapiens
guggaggccgugagcauga

SEQ ID NO: 535490 - RNA, 19 nt, Homo sapiens
gggccaugcaugcuaguau

SEQ ID NO: 535491 - RNA, 19 nt, Homo sapiens
gugagggccaugcaugcua

SEQ ID NO: 535492 - RNA, 19 nt, Homo sapiens
caucugaagcacaaguaug

SEQ ID NO: 535493 - RNA, 19 nt, Homo sapiens
uaaguacagcagcaaguuc

SEQ ID NO: 535494 - RNA, 19 nt, Homo sapiens
gcauugcacagagcaugaa

SEQ ID NO: 535495 - RNA, 19 nt, Homo sapiens
gcaucugaagcacaaguau

SEQ ID NO: 535496 - RNA, 19 nt, Homo sapiens
caaguucgucaaggaauuc

SEQ ID NO: 535497 - RNA, 19 nt, Homo sapiens
gccaugcaugcuaguauga

SEQ ID NO: 535498 - RNA, 19 nt, Homo sapiens
agacugccuuccucuaugc

SEQ ID NO: 535499 - RNA, 19 nt, Homo sapiens
caugagcgcuggaacugua

SEQ ID NO: 535500 - RNA, 19 nt, Homo sapiens
gagcacagcaggacugaaa

SEQ ID NO: 535501 - RNA, 19 nt, Homo sapiens
gaaauaagggagaccaaga

SEQ ID NO: 535502 - RNA, 19 nt, Homo sapiens
agaaagacauggagggaaa

SEQ ID NO: 535503 - RNA, 19 nt, Homo sapiens
gcaccaaguuucugagcaa

SEQ ID NO: 535504 - RNA, 19 nt, Homo sapiens
aagagaggcuucaaagaga

SEQ ID NO: 535505 - RNA, 19 nt, Homo sapiens
gcaaagccuccucccuuaa

SEQ ID NO: 535506 - RNA, 19 nt, Homo sapiens
gcacagcaggacugaaauu

SEQ ID NO: 535507 - RNA, 19 nt, Homo sapiens
uaagugccauggcguauca

SEQ ID NO: 535508 - RNA, 19 nt, Homo sapiens
caagagaggcuucaaagag

SEQ ID NO: 535509 - RNA, 19 nt, Homo sapiens
caucaaggcugugaagagu

SEQ ID NO: 535510 - RNA, 19 nt, Homo sapiens
agcaaagccuccucccuua

SEQ ID NO: 535511 - RNA, 19 nt, Homo sapiens
ccucgauacucaacaaaga

SEQ ID NO: 535512 - RNA, 19 nt, Homo sapiens
ggaugggccugcucaagag

SEQ ID NO: 535513 - RNA, 19 nt, Homo sapiens
cagcaggacugaaauuuug

SEQ ID NO: 535514 - RNA, 19 nt, Homo sapiens
ggagaggagggcagaguga

SEQ ID NO: 535515 - RNA, 19 nt, Homo sapiens
caaguacagcaccaaguuu

SEQ ID NO: 535516 - RNA, 19 nt, Homo sapiens
ucaaguacagcaccaaguu

SEQ ID NO: 535517 - RNA, 19 nt, Homo sapiens
gcggugacaaccucaagua

SEQ ID NO: 535518 - RNA, 19 nt, Homo sapiens
ggcagacugucaucacaug

SEQ ID NO: 535519 - RNA, 19 nt, Homo sapiens
gcucaagagaggcuucaaa

SEQ ID NO: 535520 - RNA, 19 nt, Homo sapiens
gagggcagagugagaaaga

SEQ ID NO: 535521 - RNA, 19 nt, Homo sapiens
gcagggcagccucaccaaa

SEQ ID NO: 535522 - RNA, 19 nt, Homo sapiens
gugacaaccucaaguacag

SEQ ID NO: 535523 - RNA, 19 nt, Homo sapiens
gaggagggcagagugagaa

SEQ ID NO: 535524 - RNA, 19 nt, Homo sapiens
ucaagagaggcuucaaaga

SEQ ID NO: 535525 - RNA, 19 nt, Homo sapiens
gcagagugagaaagacaug

SEQ ID NO: 535526 - RNA, 19 nt, Homo sapiens
gcaucaaggcugugaagag

SEQ ID NO: 535527 - RNA, 19 nt, Homo sapiens
ggugacaaccucaaguaca

SEQ ID NO: 535528 - RNA, 19 nt, Homo sapiens
aaagacauggagggaaaua

SEQ ID NO: 535529 - RNA, 19 nt, Homo sapiens
ccacucaccaccauuccuu

SEQ ID NO: 535530 - RNA, 19 nt, Homo sapiens
gcaggaggagcuuguguac

SEQ ID NO: 535531 - RNA, 19 nt, Homo sapiens
gaaagacauggagggaaau

SEQ ID NO: 535532 - RNA, 19 nt, Homo sapiens
aggaggagcuuguguacac

SEQ ID NO: 535533 - RNA, 19 nt, Homo sapiens
gaggggcuauuccaucuug

SEQ ID NO: 535534 - RNA, 19 nt, Homo sapiens
gagaggggcuauuccaucu

SEQ ID NO: 535535 - RNA, 19 nt, Homo sapiens
caacaaagagaagcaaagc

SEQ ID NO: 535536 - RNA, 19 nt, Homo sapiens
cacagcaggacugaaauuu

SEQ ID NO: 535537 - RNA, 19 nt, Homo sapiens
agacauggagggaaauaag

SEQ ID NO: 535538 - RNA, 19 nt, Homo sapiens
caaagccuccucccuuaac

SEQ ID NO: 535539 - RNA, 19 nt, Homo sapiens
ugacgcccuucccaggauu

SEQ ID NO: 535540 - RNA, 19 nt, Homo sapiens
ugcugaaacugcgcuauga

SEQ ID NO: 535541 - RNA, 19 nt, Homo sapiens
gggcagagugagaaagaca

SEQ ID NO: 535542 - RNA, 19 nt, Homo sapiens
gugcugaaacugcgcuaug

SEQ ID NO: 535543 - RNA, 19 nt, Homo sapiens
gagcgcugcaccugugaug

SEQ ID NO: 535544 - RNA, 19 nt, Homo sapiens
guacagcaccaaguuucug

SEQ ID NO: 535545 - RNA, 19 nt, Homo sapiens
aggaugggccugcucaaga

SEQ ID NO: 535546 - RNA, 19 nt, Homo sapiens
gcaagcacuaggccuacug

SEQ ID NO: 535547 - RNA, 19 nt, Homo sapiens
ugcauaaaccggcaugugu

SEQ ID NO: 535548 - RNA, 19 nt, Homo sapiens
cagggcagccucaccaaag

SEQ ID NO: 535549 - RNA, 19 nt, Homo sapiens
ccaagagaggaaacaagga

SEQ ID NO: 535550 - RNA, 19 nt, Homo sapiens
ggaauuaccuguuggauuu

SEQ ID NO: 535551 - RNA, 19 nt, Homo sapiens
gagcaagaguuguauagua

SEQ ID NO: 535552 - RNA, 19 nt, Homo sapiens
gaacaacacuaauugacau

SEQ ID NO: 535553 - RNA, 19 nt, Homo sapiens
ucaacaagaugacggauaa

SEQ ID NO: 535554 - RNA, 19 nt, Homo sapiens
ccaagaaaguccaguuuau

SEQ ID NO: 535555 - RNA, 19 nt, Homo sapiens
gagcaggagucacagauga

SEQ ID NO: 535556 - RNA, 19 nt, Homo sapiens
gaaagaaagaucaacaaga

SEQ ID NO: 535557 - RNA, 19 nt, Homo sapiens
ggacgaguuugccagauau

SEQ ID NO: 535558 - RNA, 19 nt, Homo sapiens
gauuugcccucuuauguau

SEQ ID NO: 535559 - RNA, 19 nt, Homo sapiens
gaauauguuuguucuugga

SEQ ID NO: 535560 - RNA, 19 nt, Homo sapiens
ccuuauaaguccugauuaa

SEQ ID NO: 535561 - RNA, 19 nt, Homo sapiens
gagcggagauccaggacau

SEQ ID NO: 535562 - RNA, 19 nt, Homo sapiens
ggugauaagugucgcuuuc

SEQ ID NO: 535563 - RNA, 19 nt, Homo sapiens
gccaagaaaguccaguuua

SEQ ID NO: 535564 - RNA, 19 nt, Homo sapiens
gcaggugguguuggaauua

SEQ ID NO: 535565 - RNA, 19 nt, Homo sapiens
caacaugauggacgaguuu

SEQ ID NO: 535566 - RNA, 19 nt, Homo sapiens
agaaagaucaacaagauga

SEQ ID NO: 535567 - RNA, 19 nt, Homo sapiens
ugacacguauguacuagug

SEQ ID NO: 535568 - RNA, 19 nt, Homo sapiens
gaaaguccaguuuaugaca

SEQ ID NO: 535569 - RNA, 19 nt, Homo sapiens
uaaaaugggugauaagugu

SEQ ID NO: 535570 - RNA, 19 nt, Homo sapiens
agaccaugaugcauuguuu

SEQ ID NO: 535571 - RNA, 19 nt, Homo sapiens
aagugucgcuuucuacgua

SEQ ID NO: 535572 - RNA, 19 nt, Homo sapiens
gaugcaauguucuuaggau

SEQ ID NO: 535573 - RNA, 19 nt, Homo sapiens
ucacucauuuggaaguauu

SEQ ID NO: 535574 - RNA, 19 nt, Homo sapiens
ccagggugcugcagaagga

SEQ ID NO: 535575 - RNA, 19 nt, Homo sapiens
ugauaagugucgcuuucua

SEQ ID NO: 535576 - RNA, 19 nt, Homo sapiens
ggaaagaaagaucaacaag

SEQ ID NO: 535577 - RNA, 19 nt, Homo sapiens
uggacgaguuugccagaua

SEQ ID NO: 535578 - RNA, 19 nt, Homo sapiens
cuugugauuugcccucuua

SEQ ID NO: 535579 - RNA, 19 nt, Homo sapiens
aagaaaguccaguuuauga

SEQ ID NO: 535580 - RNA, 19 nt, Homo sapiens
caagaaaguccaguuuaug

SEQ ID NO: 535581 - RNA, 19 nt, Homo sapiens
gaugacggauaagcucaaa

SEQ ID NO: 535582 - RNA, 19 nt, Homo sapiens
agcaagaguuguauaguau

SEQ ID NO: 535583 - RNA, 19 nt, Homo sapiens
gugcucagcuucguguuug

SEQ ID NO: 535584 - RNA, 19 nt, Homo sapiens
gcaagaguuguauaguauu

SEQ ID NO: 535585 - RNA, 19 nt, Homo sapiens
acacguauguacuagugaa

SEQ ID NO: 535586 - RNA, 19 nt, Homo sapiens
gcucaaaacccaugugaaa

SEQ ID NO: 535587 - RNA, 19 nt, Homo sapiens
guacgaaaugugaaauguu

SEQ ID NO: 535588 - RNA, 19 nt, Homo sapiens
gcucaauuagccaagauaa

SEQ ID NO: 535589 - RNA, 19 nt, Homo sapiens
gauuuccucuuccuagcuu

SEQ ID NO: 535590 - RNA, 19 nt, Homo sapiens
uacuugaggcuguuaauuu

SEQ ID NO: 535591 - RNA, 19 nt, Homo sapiens
caacacuaauugacauugc

SEQ ID NO: 535592 - RNA, 19 nt, Homo sapiens
ugauuugcccucuuaugua

SEQ ID NO: 535593 - RNA, 19 nt, Homo sapiens
guucuuggacuuuaugaga

SEQ ID NO: 535594 - RNA, 19 nt, Homo sapiens
ugaucucacucauuuggaa

SEQ ID NO: 535595 - RNA, 19 nt, Homo sapiens
ucaacaugauggacgaguu

SEQ ID NO: 535596 - RNA, 19 nt, Homo sapiens
gaacaccguccucgaucug

SEQ ID NO: 535597 - RNA, 19 nt, Homo sapiens
uuuaugcucuuuagaaugg

SEQ ID NO: 535598 - RNA, 19 nt, Homo sapiens
gugauuugcccucuuaugu

SEQ ID NO: 535599 - RNA, 19 nt, Homo sapiens
gaaacaaaagugcauaguu

SEQ ID NO: 535600 - RNA, 19 nt, Homo sapiens
guguuuggaugcaauguuc

SEQ ID NO: 535601 - RNA, 19 nt, Homo sapiens
ugucauuuguugagcaaga

SEQ ID NO: 535602 - RNA, 19 nt, Homo sapiens
guguuggaauuaccuguug

SEQ ID NO: 535603 - RNA, 19 nt, Homo sapiens
uagaguagcaggugguguu

SEQ ID NO: 535604 - RNA, 19 nt, Homo sapiens
acaccguccucgaucugua

SEQ ID NO: 535605 - RNA, 19 nt, Homo sapiens
gcggagauccaggacauga

SEQ ID NO: 535606 - RNA, 19 nt, Homo sapiens
gugcucaacuuguguuuug

SEQ ID NO: 535607 - RNA, 19 nt, Homo sapiens
acgagaccaugaugcauug

SEQ ID NO: 535608 - RNA, 19 nt, Homo sapiens
gagccaagaaaguccaguu

SEQ ID NO: 535609 - RNA, 19 nt, Homo sapiens
uuugcccucuuauguauuu

SEQ ID NO: 535610 - RNA, 19 nt, Homo sapiens
cgaaaugugaaauguuuag

SEQ ID NO: 535611 - RNA, 19 nt, Homo sapiens
gauaagugucgcuuucuac

SEQ ID NO: 535612 - RNA, 19 nt, Homo sapiens
ggagauccaggacaugaag

SEQ ID NO: 535613 - RNA, 19 nt, Homo sapiens
acacagaaaacaaaccuua

SEQ ID NO: 535614 - RNA, 19 nt, Homo sapiens
gcaggagucacagaugaga

SEQ ID NO: 535615 - RNA, 19 nt, Homo sapiens
cacgagaccaugaugcauu

SEQ ID NO: 535616 - RNA, 19 nt, Homo sapiens
uguacgaaaugugaaaugu

SEQ ID NO: 535617 - RNA, 19 nt, Homo sapiens
caaaguugucgcuauugug

SEQ ID NO: 535618 - RNA, 19 nt, Homo sapiens
ggagcaggagucacagaug

SEQ ID NO: 535619 - RNA, 19 nt, Homo sapiens
gcucggacagcucaauuag

SEQ ID NO: 535620 - RNA, 19 nt, Homo sapiens
cuacuuacuugaggcuguu

SEQ ID NO: 535621 - RNA, 19 nt, Homo sapiens
caagauaaaaugggugaua

SEQ ID NO: 535622 - RNA, 19 nt, Homo sapiens
caacuggaaagucaaaauu

SEQ ID NO: 535623 - RNA, 19 nt, Homo sapiens
gaacaggaggauggauaca

SEQ ID NO: 535624 - RNA, 19 nt, Homo sapiens
cugaacaggaggauggaua

SEQ ID NO: 535625 - RNA, 19 nt, Homo sapiens
uggcugucgugccgaguaa

SEQ ID NO: 535626 - RNA, 19 nt, Homo sapiens
gcaauguucuuaggauccu

SEQ ID NO: 535627 - RNA, 19 nt, Homo sapiens
ggugcucagcuucguguuu

SEQ ID NO: 535628 - RNA, 19 nt, Homo sapiens
ucucacucauuuggaagua

SEQ ID NO: 535629 - RNA, 19 nt, Homo sapiens
cagcucaauuagccaagau

SEQ ID NO: 535630 - RNA, 19 nt, Homo sapiens
gagaccaugaugcauuguu

SEQ ID NO: 535631 - RNA, 19 nt, Homo sapiens
agaacaacacuaauugaca

SEQ ID NO: 535632 - RNA, 19 nt, Homo sapiens
ucauauugccaacuggaaa

SEQ ID NO: 535633 - RNA, 19 nt, Homo sapiens
uuucuacaccugucauuga

SEQ ID NO: 535634 - RNA, 19 nt, Homo sapiens
uggaauuaccuguuggauu

SEQ ID NO: 535635 - RNA, 19 nt, Homo sapiens
aguagcaggugguguugga

SEQ ID NO: 535636 - RNA, 19 nt, Homo sapiens
uguccagggugcugcagaa

SEQ ID NO: 535637 - RNA, 19 nt, Homo sapiens
ugaacaccguccucgaucu

SEQ ID NO: 535638 - RNA, 19 nt, Homo sapiens
uguuuguucuuggacuuua

SEQ ID NO: 535639 - RNA, 19 nt, Homo sapiens
gcucuccacagucaacaug

SEQ ID NO: 535640 - RNA, 19 nt, Homo sapiens
gaucuguacgaaaugugaa

SEQ ID NO: 535641 - RNA, 19 nt, Homo sapiens
uuaugacacguauguacua

SEQ ID NO: 535642 - RNA, 19 nt, Homo sapiens
aaacggauuuccucuuccu

SEQ ID NO: 535643 - RNA, 19 nt, Homo sapiens
gguguuggaauuaccuguu

SEQ ID NO: 535644 - RNA, 19 nt, Homo sapiens
guugagcaagaguuguaua

SEQ ID NO: 535645 - RNA, 19 nt, Homo sapiens
gaaagaucaacaagaugac

SEQ ID NO: 535646 - RNA, 19 nt, Homo sapiens
cguccucgaucuguacgaa

SEQ ID NO: 535647 - RNA, 19 nt, Homo sapiens
ggaugcaauguucuuagga

SEQ ID NO: 535648 - RNA, 19 nt, Homo sapiens
uauguuuguucuuggacuu

SEQ ID NO: 535649 - RNA, 19 nt, Homo sapiens
gugccgaguaaauggauaa

SEQ ID NO: 535650 - RNA, 19 nt, Homo sapiens
gaagagaucuguucaaguu

SEQ ID NO: 535651 - RNA, 19 nt, Homo sapiens
ggaaagagcuuguuugaug

SEQ ID NO: 535652 - RNA, 19 nt, Homo sapiens
gaaauaaaguggaacgaaa

SEQ ID NO: 535653 - RNA, 19 nt, Homo sapiens
guaaacagcuccugaaaga

SEQ ID NO: 535654 - RNA, 19 nt, Homo sapiens
gaacaugaacuccaaauuu

SEQ ID NO: 535655 - RNA, 19 nt, Homo sapiens
gcagaaacaugccaauaaa

SEQ ID NO: 535656 - RNA, 19 nt, Homo sapiens
gaacugaggcccagcaaua

SEQ ID NO: 535657 - RNA, 19 nt, Homo sapiens
ugacagauguugccaauaa

SEQ ID NO: 535658 - RNA, 19 nt, Homo sapiens
ggaaagacauucaucauag

SEQ ID NO: 535659 - RNA, 19 nt, Homo sapiens
gaacuggcaucuuaaauca

SEQ ID NO: 535660 - RNA, 19 nt, Homo sapiens
caaaucaucuugucucauu

SEQ ID NO: 535661 - RNA, 19 nt, Homo sapiens
gaaagugauucauucagua

SEQ ID NO: 535662 - RNA, 19 nt, Homo sapiens
ggaugaaugugcagaauaa

SEQ ID NO: 535663 - RNA, 19 nt, Homo sapiens
gaccaaaccuguauuuaga

SEQ ID NO: 535664 - RNA, 19 nt, Homo sapiens
ggaagaagaugaugauaag

SEQ ID NO: 535665 - RNA, 19 nt, Homo sapiens
gagcaaauguuacuuguuc

SEQ ID NO: 535666 - RNA, 19 nt, Homo sapiens
guacguugcuuaaaucuga

SEQ ID NO: 535667 - RNA, 19 nt, Homo sapiens
ggaauaaaguuugcugauu

SEQ ID NO: 535668 - RNA, 19 nt, Homo sapiens
ccaaagagcauuguuauaa

SEQ ID NO: 535669 - RNA, 19 nt, Homo sapiens
gaagaauuguguccaaaga

SEQ ID NO: 535670 - RNA, 19 nt, Homo sapiens
gaagauggauuugaagaug

SEQ ID NO: 535671 - RNA, 19 nt, Homo sapiens
guacagagaagaagucuaa

SEQ ID NO: 535672 - RNA, 19 nt, Homo sapiens
acagagaccuggagccuua

SEQ ID NO: 535673 - RNA, 19 nt, Homo sapiens
cuaaggacauggaaucaua

SEQ ID NO: 535674 - RNA, 19 nt, Homo sapiens
ugagagugaugaagauuua

SEQ ID NO: 535675 - RNA, 19 nt, Homo sapiens
ugagagugaugaagauuua

SEQ ID NO: 535676 - RNA, 19 nt, Homo sapiens
gaagauguacuuggaaaua

SEQ ID NO: 535677 - RNA, 19 nt, Homo sapiens
agacucagauuguguuaua

SEQ ID NO: 535678 - RNA, 19 nt, Homo sapiens
gguagaaauuggcuucaua

SEQ ID NO: 535679 - RNA, 19 nt, Homo sapiens
gaaagaagagauaauguug

SEQ ID NO: 535680 - RNA, 19 nt, Homo sapiens
gagaagauguacuuggaaa

SEQ ID NO: 535681 - RNA, 19 nt, Homo sapiens
gaagaaguaggcaucaaua

SEQ ID NO: 535682 - RNA, 19 nt, Homo sapiens
gauauuagcaugagucuau

SEQ ID NO: 535683 - RNA, 19 nt, Homo sapiens
gaaagagcuuguuugaugu

SEQ ID NO: 535684 - RNA, 19 nt, Homo sapiens
caauugagauccuuaaaca

SEQ ID NO: 535685 - RNA, 19 nt, Homo sapiens
ggaaagugauucauucagu

SEQ ID NO: 535686 - RNA, 19 nt, Homo sapiens
gauccauuguguauaguua

SEQ ID NO: 535687 - RNA, 19 nt, Homo sapiens
caaauaguguucagacaga

SEQ ID NO: 535688 - RNA, 19 nt, Homo sapiens
ggacauggaaucauauuau

SEQ ID NO: 535689 - RNA, 19 nt, Homo sapiens
gaagaaagaagagauaaug

SEQ ID NO: 535690 - RNA, 19 nt, Homo sapiens
ggagaucaguggaaacuuc

SEQ ID NO: 535691 - RNA, 19 nt, Homo sapiens
gcaccaaagagcauuguua

SEQ ID NO: 535692 - RNA, 19 nt, Homo sapiens
uuaaauaggcaccuucuua

SEQ ID NO: 535693 - RNA, 19 nt, Homo sapiens
ccagaauacuguucaggua

SEQ ID NO: 535694 - RNA, 19 nt, Homo sapiens
cuacuaacauugagacuga

SEQ ID NO: 535695 - RNA, 19 nt, Homo sapiens
uaugugcucugauuugaua

SEQ ID NO: 535696 - RNA, 19 nt, Homo sapiens
gagcugauguguacugugu

SEQ ID NO: 535697 - RNA, 19 nt, Homo sapiens
gaaauucagugugucauag

SEQ ID NO: 535698 - RNA, 19 nt, Homo sapiens
gaacuuaggaaacuuaauc

SEQ ID NO: 535699 - RNA, 19 nt, Homo sapiens
aaacauuucugccaaacaa

SEQ ID NO: 535700 - RNA, 19 nt, Homo sapiens
ggaauuaugggaacugaaa

SEQ ID NO: 535701 - RNA, 19 nt, Homo sapiens
cuaauucaguuguguguuu

SEQ ID NO: 535702 - RNA, 19 nt, Homo sapiens
gaagauuauugcugauguu

SEQ ID NO: 535703 - RNA, 19 nt, Homo sapiens
gguagaagcuaggcagaaa

SEQ ID NO: 535704 - RNA, 19 nt, Homo sapiens
gcaagaaauuaauggacaa

SEQ ID NO: 535705 - RNA, 19 nt, Homo sapiens
gaaagaaaggcauguguuc

SEQ ID NO: 535706 - RNA, 19 nt, Homo sapiens
gggaagaagaugaugauaa

SEQ ID NO: 535707 - RNA, 19 nt, Homo sapiens
guacaucaccuaacagaau

SEQ ID NO: 535708 - RNA, 19 nt, Homo sapiens
gagaagcaaggaagaagua

SEQ ID NO: 535709 - RNA, 19 nt, Homo sapiens
guaaauuuccucucacuga

SEQ ID NO: 535710 - RNA, 19 nt, Homo sapiens
ggagaugcuuaagucuuua

SEQ ID NO: 535711 - RNA, 19 nt, Homo sapiens
aaaggcagguguaggaauu

SEQ ID NO: 535712 - RNA, 19 nt, Homo sapiens
uaaaagaugugcuguagaa

SEQ ID NO: 535713 - RNA, 19 nt, Homo sapiens
gauuauugcugauguuauc

SEQ ID NO: 535714 - RNA, 19 nt, Homo sapiens
guaaugagaaguuucgauu

SEQ ID NO: 535715 - RNA, 19 nt, Homo sapiens
agaauucacuggauccauu

SEQ ID NO: 535716 - RNA, 19 nt, Homo sapiens
gauuaguaguuacauggua

SEQ ID NO: 535717 - RNA, 19 nt, Homo sapiens
gcucugauuugauauagau

SEQ ID NO: 535718 - RNA, 19 nt, Homo sapiens
uaaagaugauggcaaagau

SEQ ID NO: 535719 - RNA, 19 nt, Homo sapiens
gaaagacauucaucauagg

SEQ ID NO: 535720 - RNA, 19 nt, Homo sapiens
guauccaccuguuuaugua

SEQ ID NO: 535721 - RNA, 19 nt, Homo sapiens
gaagugauaccagcaagaa

SEQ ID NO: 535722 - RNA, 19 nt, Homo sapiens
cagauuggaucauugcuau

SEQ ID NO: 535723 - RNA, 19 nt, Homo sapiens
gaccaagugcuacagcuua

SEQ ID NO: 535724 - RNA, 19 nt, Homo sapiens
uggagaugcuuaagucuuu

SEQ ID NO: 535725 - RNA, 19 nt, Homo sapiens
gaggguuucuaucuuacua

SEQ ID NO: 535726 - RNA, 19 nt, Homo sapiens
ugaaggagaucaguggaaa

SEQ ID NO: 535727 - RNA, 19 nt, Homo sapiens
ggaguaguauuuuggcuua

SEQ ID NO: 535728 - RNA, 19 nt, Homo sapiens
guagaaauuggcuucauaa

SEQ ID NO: 535729 - RNA, 19 nt, Homo sapiens
cagaucaccuguacugguu

SEQ ID NO: 535730 - RNA, 19 nt, Homo sapiens
gauggaagaccaagugcua

SEQ ID NO: 535731 - RNA, 19 nt, Homo sapiens
ucacugaggaggaugauaa

SEQ ID NO: 535732 - RNA, 19 nt, Homo sapiens
gagagcaaauguuacuugu

SEQ ID NO: 535733 - RNA, 19 nt, Homo sapiens
uacaucaccuaacagaaua

SEQ ID NO: 535734 - RNA, 19 nt, Homo sapiens
gcaacuggauauggaaaga

SEQ ID NO: 535735 - RNA, 19 nt, Homo sapiens
ccaguucaguggaaaguga

SEQ ID NO: 535736 - RNA, 19 nt, Homo sapiens
cccaacacuugaucauuua

SEQ ID NO: 535737 - RNA, 19 nt, Homo sapiens
caaaguucacuguuuauug

SEQ ID NO: 535738 - RNA, 19 nt, Homo sapiens
gauaccagcaagaaauuaa

SEQ ID NO: 535739 - RNA, 19 nt, Homo sapiens
cagcuauucuggcaacaaa

SEQ ID NO: 535740 - RNA, 19 nt, Homo sapiens
uguguuauauggcaaauug

SEQ ID NO: 535741 - RNA, 19 nt, Homo sapiens
caucauagguuuguaagag

SEQ ID NO: 535742 - RNA, 19 nt, Homo sapiens
agacauucaucauagguuu

SEQ ID NO: 535743 - RNA, 19 nt, Homo sapiens
auacguaacuccagaauac

SEQ ID NO: 535744 - RNA, 19 nt, Homo sapiens
gagcuuguuugaugucguu

SEQ ID NO: 535745 - RNA, 19 nt, Homo sapiens
ggaaauaaaguggaacgaa

SEQ ID NO: 535746 - RNA, 19 nt, Homo sapiens
agaguaaggaguaguauuu

SEQ ID NO: 535747 - RNA, 19 nt, Homo sapiens
ggccaucacauacucuuua

SEQ ID NO: 535748 - RNA, 19 nt, Homo sapiens
gcagccauuucuugucaaa

SEQ ID NO: 535749 - RNA, 19 nt, Homo sapiens
gaaguugggcucccuaaag

SEQ ID NO: 535750 - RNA, 19 nt, Homo sapiens
gaacuuaggagccaccuua

SEQ ID NO: 535751 - RNA, 19 nt, Homo sapiens
gcacacugcucuuaagaaa

SEQ ID NO: 535752 - RNA, 19 nt, Homo sapiens
ggaaauccauuguuuaaag

SEQ ID NO: 535753 - RNA, 19 nt, Homo sapiens
cuacagcagugacaauuua

SEQ ID NO: 535754 - RNA, 19 nt, Homo sapiens
gggagggaauuuauuauuu

SEQ ID NO: 535755 - RNA, 19 nt, Homo sapiens
gaacugcuuucaagucuga

SEQ ID NO: 535756 - RNA, 19 nt, Homo sapiens
ucacuuugcucucaauuaa

SEQ ID NO: 535757 - RNA, 19 nt, Homo sapiens
gaagcacacuggugagaaa

SEQ ID NO: 535758 - RNA, 19 nt, Homo sapiens
gaggaaauccauuguuuaa

SEQ ID NO: 535759 - RNA, 19 nt, Homo sapiens
aacaaugucugguuaguua

SEQ ID NO: 535760 - RNA, 19 nt, Homo sapiens
gugaggaaauccauuguuu

SEQ ID NO: 535761 - RNA, 19 nt, Homo sapiens
uaagggagggaauuuauua

SEQ ID NO: 535762 - RNA, 19 nt, Homo sapiens
guaugugucugcuaaugua

SEQ ID NO: 535763 - RNA, 19 nt, Homo sapiens
gaagagccauagcugauca

SEQ ID NO: 535764 - RNA, 19 nt, Homo sapiens
ggaaucagaugaacuuagg

SEQ ID NO: 535765 - RNA, 19 nt, Homo sapiens
uccaggaucuccacugaua

SEQ ID NO: 535766 - RNA, 19 nt, Homo sapiens
caacuuccaagacaagaua

SEQ ID NO: 535767 - RNA, 19 nt, Homo sapiens
ugaaaccauuccaguguaa

SEQ ID NO: 535768 - RNA, 19 nt, Homo sapiens
gggugaaucuugucuaaca

SEQ ID NO: 535769 - RNA, 19 nt, Homo sapiens
gugaaaccauuccagugua

SEQ ID NO: 535770 - RNA, 19 nt, Homo sapiens
gaaauaaaucagagagcaa

SEQ ID NO: 535771 - RNA, 19 nt, Homo sapiens
ucucugcccugccuacuuu

SEQ ID NO: 535772 - RNA, 19 nt, Homo sapiens
caguaccucuguauagaaa

SEQ ID NO: 535773 - RNA, 19 nt, Homo sapiens
ugaggaaauccauuguuua

SEQ ID NO: 535774 - RNA, 19 nt, Homo sapiens
uaacagcaacagcaagaaa

SEQ ID NO: 535775 - RNA, 19 nt, Homo sapiens
cgccuucacuguccacuuu

SEQ ID NO: 535776 - RNA, 19 nt, Homo sapiens
aaucagaacuaaccaguac

SEQ ID NO: 535777 - RNA, 19 nt, Homo sapiens
acacugcucuuaagaaacu

SEQ ID NO: 535778 - RNA, 19 nt, Homo sapiens
ggacugugaacgaagguuu

SEQ ID NO: 535779 - RNA, 19 nt, Homo sapiens
gcucucaauuaaagucuau

SEQ ID NO: 535780 - RNA, 19 nt, Homo sapiens
gaucuccacugauaagacu

SEQ ID NO: 535781 - RNA, 19 nt, Homo sapiens
gguaaucauaugugucuuu

SEQ ID NO: 535782 - RNA, 19 nt, Homo sapiens
agagaaacaugaccaaacu

SEQ ID NO: 535783 - RNA, 19 nt, Homo sapiens
auacaggugugaaaccauu

SEQ ID NO: 535784 - RNA, 19 nt, Homo sapiens
uacccaggcugcaauaaga

SEQ ID NO: 535785 - RNA, 19 nt, Homo sapiens
ucagaggcauucaggaugu

SEQ ID NO: 535786 - RNA, 19 nt, Homo sapiens
gauccuggacuuccucuug

SEQ ID NO: 535787 - RNA, 19 nt, Homo sapiens
gcugguauauggcuucaag

SEQ ID NO: 535788 - RNA, 19 nt, Homo sapiens
guaccucuguauagaaauc

SEQ ID NO: 535789 - RNA, 19 nt, Homo sapiens
gaauuaguccgccaucaca

SEQ ID NO: 535790 - RNA, 19 nt, Homo sapiens
uaaccaguaccucuguaua

SEQ ID NO: 535791 - RNA, 19 nt, Homo sapiens
gaaagcaggauguaguucu

SEQ ID NO: 535792 - RNA, 19 nt, Homo sapiens
gcaagaaauaaaucagaga

SEQ ID NO: 535793 - RNA, 19 nt, Homo sapiens
gcaacagcaagaaauaaau

SEQ ID NO: 535794 - RNA, 19 nt, Homo sapiens
caacaugcaucagagaaac

SEQ ID NO: 535795 - RNA, 19 nt, Homo sapiens
cgagagcgauaaccacaca

SEQ ID NO: 535796 - RNA, 19 nt, Homo sapiens
caacagcaagaaauaaauc

SEQ ID NO: 535797 - RNA, 19 nt, Homo sapiens
ugcaugaccuggaaucaga

SEQ ID NO: 535798 - RNA, 19 nt, Homo sapiens
ugagaaaccauaccagugu

SEQ ID NO: 535799 - RNA, 19 nt, Homo sapiens
caucacaacaugcaucaga

SEQ ID NO: 535800 - RNA, 19 nt, Homo sapiens
ggucuacaaguauauguga

SEQ ID NO: 535801 - RNA, 19 nt, Homo sapiens
ggccagggcauguguaugu

SEQ ID NO: 535802 - RNA, 19 nt, Homo sapiens
ugacaucccagcuugaaug

SEQ ID NO: 535803 - RNA, 19 nt, Homo sapiens
ccaaaugacaucccagcuu

SEQ ID NO: 535804 - RNA, 19 nt, Homo sapiens
uguaaacuuugucaugguu

SEQ ID NO: 535805 - RNA, 19 nt, Homo sapiens
agccauagcugaucauguc

SEQ ID NO: 535806 - RNA, 19 nt, Homo sapiens
caucccagcuugaaugcau

SEQ ID NO: 535807 - RNA, 19 nt, Homo sapiens
cagcaacagcaagaaauaa

SEQ ID NO: 535808 - RNA, 19 nt, Homo sapiens
acagcaacagcaagaaaua

SEQ ID NO: 535809 - RNA, 19 nt, Homo sapiens
cggcaucugggccaaguua

SEQ ID NO: 535810 - RNA, 19 nt, Homo sapiens
aagaaacuaugaagaucug

SEQ ID NO: 535811 - RNA, 19 nt, Homo sapiens
cagcaagaaauaaaucaga

SEQ ID NO: 535812 - RNA, 19 nt, Homo sapiens
guaaagcuugucagcgaaa

SEQ ID NO: 535813 - RNA, 19 nt, Homo sapiens
ggaagcacacuggugagaa

SEQ ID NO: 535814 - RNA, 19 nt, Homo sapiens
gcagugacaauuuauacca

SEQ ID NO: 535815 - RNA, 19 nt, Homo sapiens
ucacuggguguugaucuua

SEQ ID NO: 535816 - RNA, 19 nt, Homo sapiens
ggauggaauuauuguacca

SEQ ID NO: 535817 - RNA, 19 nt, Homo sapiens
ggaggggaauucauuuuca

SEQ ID NO: 535818 - RNA, 19 nt, Homo sapiens
gagugguaaucauaugugu

SEQ ID NO: 535819 - RNA, 19 nt, Homo sapiens
gcucuuaagaaacuaugaa

SEQ ID NO: 535820 - RNA, 19 nt, Homo sapiens
caaugucugguuaguuaaa

SEQ ID NO: 535821 - RNA, 19 nt, Homo sapiens
cauccaacuuccaagacaa

SEQ ID NO: 535822 - RNA, 19 nt, Homo sapiens
gagaaacgccccuucaugu

SEQ ID NO: 535823 - RNA, 19 nt, Homo sapiens
gaaaccauuccaguguaaa

SEQ ID NO: 535824 - RNA, 19 nt, Homo sapiens
agacaccaaaggagacaua

SEQ ID NO: 535825 - RNA, 19 nt, Homo sapiens
caucugagaccagugagaa

SEQ ID NO: 535826 - RNA, 19 nt, Homo sapiens
cugcggagcccaauacaga

SEQ ID NO: 535827 - RNA, 19 nt, Homo sapiens
cugcuaauguaaacuuugu

SEQ ID NO: 535828 - RNA, 19 nt, Homo sapiens
ccggucagaugaauuaguc

SEQ ID NO: 535829 - RNA, 19 nt, Homo sapiens
ccgccucacuccuucauca

SEQ ID NO: 535830 - RNA, 19 nt, Homo sapiens
gagacauacaggugugaaa

SEQ ID NO: 535831 - RNA, 19 nt, Homo sapiens
uugaaugcaugaccuggaa

SEQ ID NO: 535832 - RNA, 19 nt, Homo sapiens
guguguguguguuguguug

SEQ ID NO: 535833 - RNA, 19 nt, Homo sapiens
aaagcaggauguaguucug

SEQ ID NO: 535834 - RNA, 19 nt, Homo sapiens
gcuaauguaaacuuuguca

SEQ ID NO: 535835 - RNA, 19 nt, Homo sapiens
guggccaaguugucagaaa

SEQ ID NO: 535836 - RNA, 19 nt, Homo sapiens
cagugacaauuuauaccaa

SEQ ID NO: 535837 - RNA, 19 nt, Homo sapiens
aaacuaugaagaucugaga

SEQ ID NO: 535838 - RNA, 19 nt, Homo sapiens
ccaguaccucuguauagaa

SEQ ID NO: 535839 - RNA, 19 nt, Homo sapiens
gugaaucuugucuaacauu

SEQ ID NO: 535840 - RNA, 19 nt, Homo sapiens
ccugacccuucccuucuuu

SEQ ID NO: 535841 - RNA, 19 nt, Homo sapiens
ggagcccaauacagaauac

SEQ ID NO: 535842 - RNA, 19 nt, Homo sapiens
ggaaagcaggauguaguuc

SEQ ID NO: 535843 - RNA, 19 nt, Homo sapiens
aagaagagccauagcugau

SEQ ID NO: 535844 - RNA, 19 nt, Homo sapiens
gaucuucuucauccaacuu

SEQ ID NO: 535845 - RNA, 19 nt, Homo sapiens
gauuugcucuuugacaacu

SEQ ID NO: 535846 - RNA, 19 nt, Homo sapiens
ggugaggaaauccauuguu

SEQ ID NO: 535847 - RNA, 19 nt, Homo sapiens
ggugaaucuugucuaacau

SEQ ID NO: 535848 - RNA, 19 nt, Homo sapiens
guguaugugucugcuaaug

SEQ ID NO: 535849 - RNA, 19 nt, Homo sapiens
caagauaccggugcuucug

SEQ ID NO: 535850 - RNA, 19 nt, Homo sapiens
gaacuuaggagccaccuua

SEQ ID NO: 535851 - RNA, 19 nt, Homo sapiens
gcacacugcucuuaagaaa

SEQ ID NO: 535852 - RNA, 19 nt, Homo sapiens
ggaaauccauuguuuaaag

SEQ ID NO: 535853 - RNA, 19 nt, Homo sapiens
cuacagcagugacaauuua

SEQ ID NO: 535854 - RNA, 19 nt, Homo sapiens
gggagggaauuuauuauuu

SEQ ID NO: 535855 - RNA, 19 nt, Homo sapiens
gaacugcuuucaagucuga

SEQ ID NO: 535856 - RNA, 19 nt, Homo sapiens
ucacuuugcucucaauuaa

SEQ ID NO: 535857 - RNA, 19 nt, Homo sapiens
gaagcacacuggugagaaa

SEQ ID NO: 535858 - RNA, 19 nt, Homo sapiens
gaggaaauccauuguuuaa

SEQ ID NO: 535859 - RNA, 19 nt, Homo sapiens
aacaaugucugguuaguua

SEQ ID NO: 535860 - RNA, 19 nt, Homo sapiens
gugaggaaauccauuguuu

SEQ ID NO: 535861 - RNA, 19 nt, Homo sapiens
uaagggagggaauuuauua

SEQ ID NO: 535862 - RNA, 19 nt, Homo sapiens
guaugugucugcuaaugua

SEQ ID NO: 535863 - RNA, 19 nt, Homo sapiens
gaagagccauagcugauca

SEQ ID NO: 535864 - RNA, 19 nt, Homo sapiens
ggaaucagaugaacuuagg

SEQ ID NO: 535865 - RNA, 19 nt, Homo sapiens
uccaggaucuccacugaua

SEQ ID NO: 535866 - RNA, 19 nt, Homo sapiens
caacuuccaagacaagaua

SEQ ID NO: 535867 - RNA, 19 nt, Homo sapiens
ugaaaccauuccaguguaa

SEQ ID NO: 535868 - RNA, 19 nt, Homo sapiens
gggugaaucuugucuaaca

SEQ ID NO: 535869 - RNA, 19 nt, Homo sapiens
gugaaaccauuccagugua

SEQ ID NO: 535870 - RNA, 19 nt, Homo sapiens
gaaauaaaucagagagcaa

SEQ ID NO: 535871 - RNA, 19 nt, Homo sapiens
ucucugcccugccuacuuu

SEQ ID NO: 535872 - RNA, 19 nt, Homo sapiens
caguaccucuguauagaaa

SEQ ID NO: 535873 - RNA, 19 nt, Homo sapiens
ggacagaagggcagagcaa

SEQ ID NO: 535874 - RNA, 19 nt, Homo sapiens
ugaggaaauccauuguuua

SEQ ID NO: 535875 - RNA, 19 nt, Homo sapiens
uaacagcaacagcaagaaa

SEQ ID NO: 535876 - RNA, 19 nt, Homo sapiens
cgccuucacuguccacuuu

SEQ ID NO: 535877 - RNA, 19 nt, Homo sapiens
aaucagaacuaaccaguac

SEQ ID NO: 535878 - RNA, 19 nt, Homo sapiens
acacugcucuuaagaaacu

SEQ ID NO: 535879 - RNA, 19 nt, Homo sapiens
ggacugugaacgaagguuu

SEQ ID NO: 535880 - RNA, 19 nt, Homo sapiens
gcucucaauuaaagucuau

SEQ ID NO: 535881 - RNA, 19 nt, Homo sapiens
gaucuccacugauaagacu

SEQ ID NO: 535882 - RNA, 19 nt, Homo sapiens
gguaaucauaugugucuuu

SEQ ID NO: 535883 - RNA, 19 nt, Homo sapiens
agagaaacaugaccaaacu

SEQ ID NO: 535884 - RNA, 19 nt, Homo sapiens
auacaggugugaaaccauu

SEQ ID NO: 535885 - RNA, 19 nt, Homo sapiens
uacccaggcugcaauaaga

SEQ ID NO: 535886 - RNA, 19 nt, Homo sapiens
ucagaggcauucaggaugu

SEQ ID NO: 535887 - RNA, 19 nt, Homo sapiens
gauccuggacuuccucuug

SEQ ID NO: 535888 - RNA, 19 nt, Homo sapiens
gcugguauauggcuucaag

SEQ ID NO: 535889 - RNA, 19 nt, Homo sapiens
guaccucuguauagaaauc

SEQ ID NO: 535890 - RNA, 19 nt, Homo sapiens
gaauuaguccgccaucaca

SEQ ID NO: 535891 - RNA, 19 nt, Homo sapiens
uaaccaguaccucuguaua

SEQ ID NO: 535892 - RNA, 19 nt, Homo sapiens
gaaagcaggauguaguucu

SEQ ID NO: 535893 - RNA, 19 nt, Homo sapiens
gcaagaaauaaaucagaga

SEQ ID NO: 535894 - RNA, 19 nt, Homo sapiens
gcaacagcaagaaauaaau

SEQ ID NO: 535895 - RNA, 19 nt, Homo sapiens
caacaugcaucagagaaac

SEQ ID NO: 535896 - RNA, 19 nt, Homo sapiens
cgagagcgauaaccacaca

SEQ ID NO: 535897 - RNA, 19 nt, Homo sapiens
ucagugaaauggacagaag

SEQ ID NO: 535898 - RNA, 19 nt, Homo sapiens
caacagcaagaaauaaauc

SEQ ID NO: 535899 - RNA, 19 nt, Homo sapiens
ugcaugaccuggaaucaga

SEQ ID NO: 535900 - RNA, 19 nt, Homo sapiens
ugagaaaccauaccagugu

SEQ ID NO: 535901 - RNA, 19 nt, Homo sapiens
caucacaacaugcaucaga

SEQ ID NO: 535902 - RNA, 19 nt, Homo sapiens
ggucuacaaguauauguga

SEQ ID NO: 535903 - RNA, 19 nt, Homo sapiens
ggccagggcauguguaugu

SEQ ID NO: 535904 - RNA, 19 nt, Homo sapiens
ugacaucccagcuugaaug

SEQ ID NO: 535905 - RNA, 19 nt, Homo sapiens
ccaaaugacaucccagcuu

SEQ ID NO: 535906 - RNA, 19 nt, Homo sapiens
uguaaacuuugucaugguu

SEQ ID NO: 535907 - RNA, 19 nt, Homo sapiens
agccauagcugaucauguc

SEQ ID NO: 535908 - RNA, 19 nt, Homo sapiens
caucccagcuugaaugcau

SEQ ID NO: 535909 - RNA, 19 nt, Homo sapiens
cagcaacagcaagaaauaa

SEQ ID NO: 535910 - RNA, 19 nt, Homo sapiens
acagcaacagcaagaaaua

SEQ ID NO: 535911 - RNA, 19 nt, Homo sapiens
cggcaucugggccaaguua

SEQ ID NO: 535912 - RNA, 19 nt, Homo sapiens
aagaaacuaugaagaucug

SEQ ID NO: 535913 - RNA, 19 nt, Homo sapiens
cagcaagaaauaaaucaga

SEQ ID NO: 535914 - RNA, 19 nt, Homo sapiens
guaaagcuugucagcgaaa

SEQ ID NO: 535915 - RNA, 19 nt, Homo sapiens
ggaagcacacuggugagaa

SEQ ID NO: 535916 - RNA, 19 nt, Homo sapiens
gcagugacaauuuauacca

SEQ ID NO: 535917 - RNA, 19 nt, Homo sapiens
ucacuggguguugaucuua

SEQ ID NO: 535918 - RNA, 19 nt, Homo sapiens
ggauggaauuauuguacca

SEQ ID NO: 535919 - RNA, 19 nt, Homo sapiens
ggaggggaauucauuuuca

SEQ ID NO: 535920 - RNA, 19 nt, Homo sapiens
gagugguaaucauaugugu

SEQ ID NO: 535921 - RNA, 19 nt, Homo sapiens
gcucuuaagaaacuaugaa

SEQ ID NO: 535922 - RNA, 19 nt, Homo sapiens
caaugucugguuaguuaaa

SEQ ID NO: 535923 - RNA, 19 nt, Homo sapiens
cauccaacuuccaagacaa

SEQ ID NO: 535924 - RNA, 19 nt, Homo sapiens
gagaaacgccccuucaugu

SEQ ID NO: 535925 - RNA, 19 nt, Homo sapiens
gaaaccauuccaguguaaa

SEQ ID NO: 535926 - RNA, 19 nt, Homo sapiens
agacaccaaaggagacaua

SEQ ID NO: 535927 - RNA, 19 nt, Homo sapiens
caucugagaccagugagaa

SEQ ID NO: 535928 - RNA, 19 nt, Homo sapiens
cugcggagcccaauacaga

SEQ ID NO: 535929 - RNA, 19 nt, Homo sapiens
cugcuaauguaaacuuugu

SEQ ID NO: 535930 - RNA, 19 nt, Homo sapiens
ccggucagaugaauuaguc

SEQ ID NO: 535931 - RNA, 19 nt, Homo sapiens
ccgccucacuccuucauca

SEQ ID NO: 535932 - RNA, 19 nt, Homo sapiens
gagacauacaggugugaaa

SEQ ID NO: 535933 - RNA, 19 nt, Homo sapiens
uugaaugcaugaccuggaa

SEQ ID NO: 535934 - RNA, 19 nt, Homo sapiens
guguguguguguuguguug

SEQ ID NO: 535935 - RNA, 19 nt, Homo sapiens
aaagcaggauguaguucug

SEQ ID NO: 535936 - RNA, 19 nt, Homo sapiens
gcuaauguaaacuuuguca

SEQ ID NO: 535937 - RNA, 19 nt, Homo sapiens
cagugacaauuuauaccaa

SEQ ID NO: 535938 - RNA, 19 nt, Homo sapiens
guggccaaguugucagaaa

SEQ ID NO: 535939 - RNA, 19 nt, Homo sapiens
aaacuaugaagaucugaga

SEQ ID NO: 535940 - RNA, 19 nt, Homo sapiens
ccaguaccucuguauagaa

SEQ ID NO: 535941 - RNA, 19 nt, Homo sapiens
gugaaucuugucuaacauu

SEQ ID NO: 535942 - RNA, 19 nt, Homo sapiens
ccugacccuucccuucuuu

SEQ ID NO: 535943 - RNA, 19 nt, Homo sapiens
ggagcccaauacagaauac

SEQ ID NO: 535944 - RNA, 19 nt, Homo sapiens
ggaaagcaggauguaguuc

SEQ ID NO: 535945 - RNA, 19 nt, Homo sapiens
aagaagagccauagcugau

SEQ ID NO: 535946 - RNA, 19 nt, Homo sapiens
gaucuucuucauccaacuu

SEQ ID NO: 535947 - RNA, 19 nt, Homo sapiens
gauuugcucuuugacaacu

SEQ ID NO: 535948 - RNA, 19 nt, Homo sapiens
ggugaggaaauccauuguu

SEQ ID NO: 535949 - RNA, 19 nt, Homo sapiens
ggugaaucuugucuaacau

SEQ ID NO: 535950 - RNA, 19 nt, Homo sapiens
gaacuuaggagccaccuua

SEQ ID NO: 535951 - RNA, 19 nt, Homo sapiens
gcacacugcucuuaagaaa

SEQ ID NO: 535952 - RNA, 19 nt, Homo sapiens
ggaaauccauuguuuaaag

SEQ ID NO: 535953 - RNA, 19 nt, Homo sapiens
cuacagcagugacaauuua

SEQ ID NO: 535954 - RNA, 19 nt, Homo sapiens
gggagggaauuuauuauuu

SEQ ID NO: 535955 - RNA, 19 nt, Homo sapiens
gaacugcuuucaagucuga

SEQ ID NO: 535956 - RNA, 19 nt, Homo sapiens
ucacuuugcucucaauuaa

SEQ ID NO: 535957 - RNA, 19 nt, Homo sapiens
gaagcacacuggugagaaa

SEQ ID NO: 535958 - RNA, 19 nt, Homo sapiens
gaggaaauccauuguuuaa

SEQ ID NO: 535959 - RNA, 19 nt, Homo sapiens
aacaaugucugguuaguua

SEQ ID NO: 535960 - RNA, 19 nt, Homo sapiens
gugaggaaauccauuguuu

SEQ ID NO: 535961 - RNA, 19 nt, Homo sapiens
uaagggagggaauuuauua

SEQ ID NO: 535962 - RNA, 19 nt, Homo sapiens
guaugugucugcuaaugua

SEQ ID NO: 535963 - RNA, 19 nt, Homo sapiens
gaagagccauagcugauca

SEQ ID NO: 535964 - RNA, 19 nt, Homo sapiens
ggaaucagaugaacuuagg

SEQ ID NO: 535965 - RNA, 19 nt, Homo sapiens
uccaggaucuccacugaua

SEQ ID NO: 535966 - RNA, 19 nt, Homo sapiens
caacuuccaagacaagaua

SEQ ID NO: 535967 - RNA, 19 nt, Homo sapiens
ugaaaccauuccaguguaa

SEQ ID NO: 535968 - RNA, 19 nt, Homo sapiens
gggugaaucuugucuaaca

SEQ ID NO: 535969 - RNA, 19 nt, Homo sapiens
gugaaaccauuccagugua

SEQ ID NO: 535970 - RNA, 19 nt, Homo sapiens
gaaauaaaucagagagcaa

SEQ ID NO: 535971 - RNA, 19 nt, Homo sapiens
ucucugcccugccuacuuu

SEQ ID NO: 535972 - RNA, 19 nt, Homo sapiens
caguaccucuguauagaaa

SEQ ID NO: 535973 - RNA, 19 nt, Homo sapiens
ugaggaaauccauuguuua

SEQ ID NO: 535974 - RNA, 19 nt, Homo sapiens
uaacagcaacagcaagaaa

SEQ ID NO: 535975 - RNA, 19 nt, Homo sapiens
cgccuucacuguccacuuu

SEQ ID NO: 535976 - RNA, 19 nt, Homo sapiens
aaucagaacuaaccaguac

SEQ ID NO: 535977 - RNA, 19 nt, Homo sapiens
acacugcucuuaagaaacu

SEQ ID NO: 535978 - RNA, 19 nt, Homo sapiens
ggacugugaacgaagguuu

SEQ ID NO: 535979 - RNA, 19 nt, Homo sapiens
gcucucaauuaaagucuau

SEQ ID NO: 535980 - RNA, 19 nt, Homo sapiens
gaucuccacugauaagacu

SEQ ID NO: 535981 - RNA, 19 nt, Homo sapiens
gguaaucauaugugucuuu

SEQ ID NO: 535982 - RNA, 19 nt, Homo sapiens
agagaaacaugaccaaacu

SEQ ID NO: 535983 - RNA, 19 nt, Homo sapiens
auacaggugugaaaccauu

SEQ ID NO: 535984 - RNA, 19 nt, Homo sapiens
uacccaggcugcaauaaga

SEQ ID NO: 535985 - RNA, 19 nt, Homo sapiens
ucagaggcauucaggaugu

SEQ ID NO: 535986 - RNA, 19 nt, Homo sapiens
gauccuggacuuccucuug

SEQ ID NO: 535987 - RNA, 19 nt, Homo sapiens
gcugguauauggcuucaag

SEQ ID NO: 535988 - RNA, 19 nt, Homo sapiens
guaccucuguauagaaauc

SEQ ID NO: 535989 - RNA, 19 nt, Homo sapiens
gaauuaguccgccaucaca

SEQ ID NO: 535990 - RNA, 19 nt, Homo sapiens
uaaccaguaccucuguaua

SEQ ID NO: 535991 - RNA, 19 nt, Homo sapiens
gaaagcaggauguaguucu

SEQ ID NO: 535992 - RNA, 19 nt, Homo sapiens
gcaagaaauaaaucagaga

SEQ ID NO: 535993 - RNA, 19 nt, Homo sapiens
gcaacagcaagaaauaaau

SEQ ID NO: 535994 - RNA, 19 nt, Homo sapiens
caacaugcaucagagaaac

SEQ ID NO: 535995 - RNA, 19 nt, Homo sapiens
cgagagcgauaaccacaca

SEQ ID NO: 535996 - RNA, 19 nt, Homo sapiens
caacagcaagaaauaaauc

SEQ ID NO: 535997 - RNA, 19 nt, Homo sapiens
ugcaugaccuggaaucaga

SEQ ID NO: 535998 - RNA, 19 nt, Homo sapiens
ugagaaaccauaccagugu

SEQ ID NO: 535999 - RNA, 19 nt, Homo sapiens
caucacaacaugcaucaga

SEQ ID NO: 536000 - RNA, 19 nt, Homo sapiens
ggucuacaaguauauguga

SEQ ID NO: 536001 - RNA, 19 nt, Homo sapiens
ggccagggcauguguaugu

SEQ ID NO: 536002 - RNA, 19 nt, Homo sapiens
ugacaucccagcuugaaug

SEQ ID NO: 536003 - RNA, 19 nt, Homo sapiens
ccaaaugacaucccagcuu

SEQ ID NO: 536004 - RNA, 19 nt, Homo sapiens
uguaaacuuugucaugguu

SEQ ID NO: 536005 - RNA, 19 nt, Homo sapiens
agccauagcugaucauguc

SEQ ID NO: 536006 - RNA, 19 nt, Homo sapiens
ccaggacucauacagguaa

SEQ ID NO: 536007 - RNA, 19 nt, Homo sapiens
caucccagcuugaaugcau

SEQ ID NO: 536008 - RNA, 19 nt, Homo sapiens
cagcaacagcaagaaauaa

SEQ ID NO: 536009 - RNA, 19 nt, Homo sapiens
acagcaacagcaagaaaua

SEQ ID NO: 536010 - RNA, 19 nt, Homo sapiens
cggcaucugggccaaguua

SEQ ID NO: 536011 - RNA, 19 nt, Homo sapiens
aagaaacuaugaagaucug

SEQ ID NO: 536012 - RNA, 19 nt, Homo sapiens
cagcaagaaauaaaucaga

SEQ ID NO: 536013 - RNA, 19 nt, Homo sapiens
guaaagcuugucagcgaaa

SEQ ID NO: 536014 - RNA, 19 nt, Homo sapiens
ggaagcacacuggugagaa

SEQ ID NO: 536015 - RNA, 19 nt, Homo sapiens
gcagugacaauuuauacca

SEQ ID NO: 536016 - RNA, 19 nt, Homo sapiens
ucacuggguguugaucuua

SEQ ID NO: 536017 - RNA, 19 nt, Homo sapiens
ggauggaauuauuguacca

SEQ ID NO: 536018 - RNA, 19 nt, Homo sapiens
ggaggggaauucauuuuca

SEQ ID NO: 536019 - RNA, 19 nt, Homo sapiens
gagugguaaucauaugugu

SEQ ID NO: 536020 - RNA, 19 nt, Homo sapiens
gcucuuaagaaacuaugaa

SEQ ID NO: 536021 - RNA, 19 nt, Homo sapiens
caaugucugguuaguuaaa

SEQ ID NO: 536022 - RNA, 19 nt, Homo sapiens
cauccaacuuccaagacaa

SEQ ID NO: 536023 - RNA, 19 nt, Homo sapiens
gagaaacgccccuucaugu

SEQ ID NO: 536024 - RNA, 19 nt, Homo sapiens
gaaaccauuccaguguaaa

SEQ ID NO: 536025 - RNA, 19 nt, Homo sapiens
agacaccaaaggagacaua

SEQ ID NO: 536026 - RNA, 19 nt, Homo sapiens
caucugagaccagugagaa

SEQ ID NO: 536027 - RNA, 19 nt, Homo sapiens
cugcggagcccaauacaga

SEQ ID NO: 536028 - RNA, 19 nt, Homo sapiens
cugcuaauguaaacuuugu

SEQ ID NO: 536029 - RNA, 19 nt, Homo sapiens
ccggucagaugaauuaguc

SEQ ID NO: 536030 - RNA, 19 nt, Homo sapiens
ccgccucacuccuucauca

SEQ ID NO: 536031 - RNA, 19 nt, Homo sapiens
gagacauacaggugugaaa

SEQ ID NO: 536032 - RNA, 19 nt, Homo sapiens
uugaaugcaugaccuggaa

SEQ ID NO: 536033 - RNA, 19 nt, Homo sapiens
guguguguguguuguguug

SEQ ID NO: 536034 - RNA, 19 nt, Homo sapiens
aaagcaggauguaguucug

SEQ ID NO: 536035 - RNA, 19 nt, Homo sapiens
gcuaauguaaacuuuguca

SEQ ID NO: 536036 - RNA, 19 nt, Homo sapiens
cagugacaauuuauaccaa

SEQ ID NO: 536037 - RNA, 19 nt, Homo sapiens
guggccaaguugucagaaa

SEQ ID NO: 536038 - RNA, 19 nt, Homo sapiens
aaacuaugaagaucugaga

SEQ ID NO: 536039 - RNA, 19 nt, Homo sapiens
ccaguaccucuguauagaa

SEQ ID NO: 536040 - RNA, 19 nt, Homo sapiens
gugaaucuugucuaacauu

SEQ ID NO: 536041 - RNA, 19 nt, Homo sapiens
ccugacccuucccuucuuu

SEQ ID NO: 536042 - RNA, 19 nt, Homo sapiens
ggagcccaauacagaauac

SEQ ID NO: 536043 - RNA, 19 nt, Homo sapiens
ggaaagcaggauguaguuc

SEQ ID NO: 536044 - RNA, 19 nt, Homo sapiens
aagaagagccauagcugau

SEQ ID NO: 536045 - RNA, 19 nt, Homo sapiens
gaucuucuucauccaacuu

SEQ ID NO: 536046 - RNA, 19 nt, Homo sapiens
gauuugcucuuugacaacu

SEQ ID NO: 536047 - RNA, 19 nt, Homo sapiens
ggugaggaaauccauuguu

SEQ ID NO: 536048 - RNA, 19 nt, Homo sapiens
ggugaaucuugucuaacau

SEQ ID NO: 536049 - RNA, 19 nt, Homo sapiens
guguaugugucugcuaaug

SEQ ID NO: 536050 - RNA, 19 nt, Homo sapiens
gaacuuaggagccaccuua

SEQ ID NO: 536051 - RNA, 19 nt, Homo sapiens
gcacacugcucuuaagaaa

SEQ ID NO: 536052 - RNA, 19 nt, Homo sapiens
ggaaauccauuguuuaaag

SEQ ID NO: 536053 - RNA, 19 nt, Homo sapiens
cuacagcagugacaauuua

SEQ ID NO: 536054 - RNA, 19 nt, Homo sapiens
gggagggaauuuauuauuu

SEQ ID NO: 536055 - RNA, 19 nt, Homo sapiens
gaacugcuuucaagucuga

SEQ ID NO: 536056 - RNA, 19 nt, Homo sapiens
ucacuuugcucucaauuaa

SEQ ID NO: 536057 - RNA, 19 nt, Homo sapiens
gaagcacacuggugagaaa

SEQ ID NO: 536058 - RNA, 19 nt, Homo sapiens
gaggaaauccauuguuuaa

SEQ ID NO: 536059 - RNA, 19 nt, Homo sapiens
aacaaugucugguuaguua

SEQ ID NO: 536060 - RNA, 19 nt, Homo sapiens
gugaggaaauccauuguuu

SEQ ID NO: 536061 - RNA, 19 nt, Homo sapiens
uaagggagggaauuuauua

SEQ ID NO: 536062 - RNA, 19 nt, Homo sapiens
guaugugucugcuaaugua

SEQ ID NO: 536063 - RNA, 19 nt, Homo sapiens
gaagagccauagcugauca

SEQ ID NO: 536064 - RNA, 19 nt, Homo sapiens
ggaaucagaugaacuuagg

SEQ ID NO: 536065 - RNA, 19 nt, Homo sapiens
uccaggaucuccacugaua

SEQ ID NO: 536066 - RNA, 19 nt, Homo sapiens
caacuuccaagacaagaua

SEQ ID NO: 536067 - RNA, 19 nt, Homo sapiens
ugaaaccauuccaguguaa

SEQ ID NO: 536068 - RNA, 19 nt, Homo sapiens
gggugaaucuugucuaaca

SEQ ID NO: 536069 - RNA, 19 nt, Homo sapiens
gugaaaccauuccagugua

SEQ ID NO: 536070 - RNA, 19 nt, Homo sapiens
gaaauaaaucagagagcaa

SEQ ID NO: 536071 - RNA, 19 nt, Homo sapiens
ucucugcccugccuacuuu

SEQ ID NO: 536072 - RNA, 19 nt, Homo sapiens
caguaccucuguauagaaa

SEQ ID NO: 536073 - RNA, 19 nt, Homo sapiens
ggacagaagggcagagcaa

SEQ ID NO: 536074 - RNA, 19 nt, Homo sapiens
ugaggaaauccauuguuua

SEQ ID NO: 536075 - RNA, 19 nt, Homo sapiens
uaacagcaacagcaagaaa

SEQ ID NO: 536076 - RNA, 19 nt, Homo sapiens
cgccuucacuguccacuuu

SEQ ID NO: 536077 - RNA, 19 nt, Homo sapiens
aaucagaacuaaccaguac

SEQ ID NO: 536078 - RNA, 19 nt, Homo sapiens
acacugcucuuaagaaacu

SEQ ID NO: 536079 - RNA, 19 nt, Homo sapiens
ggacugugaacgaagguuu

SEQ ID NO: 536080 - RNA, 19 nt, Homo sapiens
gcucucaauuaaagucuau

SEQ ID NO: 536081 - RNA, 19 nt, Homo sapiens
gaucuccacugauaagacu

SEQ ID NO: 536082 - RNA, 19 nt, Homo sapiens
gguaaucauaugugucuuu

SEQ ID NO: 536083 - RNA, 19 nt, Homo sapiens
agagaaacaugaccaaacu

SEQ ID NO: 536084 - RNA, 19 nt, Homo sapiens
auacaggugugaaaccauu

SEQ ID NO: 536085 - RNA, 19 nt, Homo sapiens
uacccaggcugcaauaaga

SEQ ID NO: 536086 - RNA, 19 nt, Homo sapiens
ucagaggcauucaggaugu

SEQ ID NO: 536087 - RNA, 19 nt, Homo sapiens
gauccuggacuuccucuug

SEQ ID NO: 536088 - RNA, 19 nt, Homo sapiens
gcugguauauggcuucaag

SEQ ID NO: 536089 - RNA, 19 nt, Homo sapiens
guaccucuguauagaaauc

SEQ ID NO: 536090 - RNA, 19 nt, Homo sapiens
gaauuaguccgccaucaca

SEQ ID NO: 536091 - RNA, 19 nt, Homo sapiens
uaaccaguaccucuguaua

SEQ ID NO: 536092 - RNA, 19 nt, Homo sapiens
gaaagcaggauguaguucu

SEQ ID NO: 536093 - RNA, 19 nt, Homo sapiens
gcaagaaauaaaucagaga

SEQ ID NO: 536094 - RNA, 19 nt, Homo sapiens
gcaacagcaagaaauaaau

SEQ ID NO: 536095 - RNA, 19 nt, Homo sapiens
caacaugcaucagagaaac

SEQ ID NO: 536096 - RNA, 19 nt, Homo sapiens
cgagagcgauaaccacaca

SEQ ID NO: 536097 - RNA, 19 nt, Homo sapiens
ucagugaaauggacagaag

SEQ ID NO: 536098 - RNA, 19 nt, Homo sapiens
caacagcaagaaauaaauc

SEQ ID NO: 536099 - RNA, 19 nt, Homo sapiens
ugcaugaccuggaaucaga

SEQ ID NO: 536100 - RNA, 19 nt, Homo sapiens
ugagaaaccauaccagugu

SEQ ID NO: 536101 - RNA, 19 nt, Homo sapiens
caucacaacaugcaucaga

SEQ ID NO: 536102 - RNA, 19 nt, Homo sapiens
ggucuacaaguauauguga

SEQ ID NO: 536103 - RNA, 19 nt, Homo sapiens
ggccagggcauguguaugu

SEQ ID NO: 536104 - RNA, 19 nt, Homo sapiens
ugacaucccagcuugaaug

SEQ ID NO: 536105 - RNA, 19 nt, Homo sapiens
ccaaaugacaucccagcuu

SEQ ID NO: 536106 - RNA, 19 nt, Homo sapiens
uguaaacuuugucaugguu

SEQ ID NO: 536107 - RNA, 19 nt, Homo sapiens
agccauagcugaucauguc

SEQ ID NO: 536108 - RNA, 19 nt, Homo sapiens
ccaggacucauacagguaa

SEQ ID NO: 536109 - RNA, 19 nt, Homo sapiens
caucccagcuugaaugcau

SEQ ID NO: 536110 - RNA, 19 nt, Homo sapiens
cagcaacagcaagaaauaa

SEQ ID NO: 536111 - RNA, 19 nt, Homo sapiens
acagcaacagcaagaaaua

SEQ ID NO: 536112 - RNA, 19 nt, Homo sapiens
cggcaucugggccaaguua

SEQ ID NO: 536113 - RNA, 19 nt, Homo sapiens
aagaaacuaugaagaucug

SEQ ID NO: 536114 - RNA, 19 nt, Homo sapiens
cagcaagaaauaaaucaga

SEQ ID NO: 536115 - RNA, 19 nt, Homo sapiens
ggaagcacacuggugagaa

SEQ ID NO: 536116 - RNA, 19 nt, Homo sapiens
gcagugacaauuuauacca

SEQ ID NO: 536117 - RNA, 19 nt, Homo sapiens
ucacuggguguugaucuua

SEQ ID NO: 536118 - RNA, 19 nt, Homo sapiens
ggauggaauuauuguacca

SEQ ID NO: 536119 - RNA, 19 nt, Homo sapiens
ggaggggaauucauuuuca

SEQ ID NO: 536120 - RNA, 19 nt, Homo sapiens
gagugguaaucauaugugu

SEQ ID NO: 536121 - RNA, 19 nt, Homo sapiens
gcucuuaagaaacuaugaa

SEQ ID NO: 536122 - RNA, 19 nt, Homo sapiens
caaugucugguuaguuaaa

SEQ ID NO: 536123 - RNA, 19 nt, Homo sapiens
cauccaacuuccaagacaa

SEQ ID NO: 536124 - RNA, 19 nt, Homo sapiens
gagaaacgccccuucaugu

SEQ ID NO: 536125 - RNA, 19 nt, Homo sapiens
gaaaccauuccaguguaaa

SEQ ID NO: 536126 - RNA, 19 nt, Homo sapiens
agacaccaaaggagacaua

SEQ ID NO: 536127 - RNA, 19 nt, Homo sapiens
caucugagaccagugagaa

SEQ ID NO: 536128 - RNA, 19 nt, Homo sapiens
cugcggagcccaauacaga

SEQ ID NO: 536129 - RNA, 19 nt, Homo sapiens
cugcuaauguaaacuuugu

SEQ ID NO: 536130 - RNA, 19 nt, Homo sapiens
ccggucagaugaauuaguc

SEQ ID NO: 536131 - RNA, 19 nt, Homo sapiens
ccgccucacuccuucauca

SEQ ID NO: 536132 - RNA, 19 nt, Homo sapiens
gagacauacaggugugaaa

SEQ ID NO: 536133 - RNA, 19 nt, Homo sapiens
uugaaugcaugaccuggaa

SEQ ID NO: 536134 - RNA, 19 nt, Homo sapiens
guguguguguguuguguug

SEQ ID NO: 536135 - RNA, 19 nt, Homo sapiens
aaagcaggauguaguucug

SEQ ID NO: 536136 - RNA, 19 nt, Homo sapiens
gcuaauguaaacuuuguca

SEQ ID NO: 536137 - RNA, 19 nt, Homo sapiens
cagugacaauuuauaccaa

SEQ ID NO: 536138 - RNA, 19 nt, Homo sapiens
guggccaaguugucagaaa

SEQ ID NO: 536139 - RNA, 19 nt, Homo sapiens
aaacuaugaagaucugaga

SEQ ID NO: 536140 - RNA, 19 nt, Homo sapiens
ccaguaccucuguauagaa

SEQ ID NO: 536141 - RNA, 19 nt, Homo sapiens
gugaaucuugucuaacauu

SEQ ID NO: 536142 - RNA, 19 nt, Homo sapiens
ccugacccuucccuucuuu

SEQ ID NO: 536143 - RNA, 19 nt, Homo sapiens
ggagcccaauacagaauac

SEQ ID NO: 536144 - RNA, 19 nt, Homo sapiens
ggaaagcaggauguaguuc

SEQ ID NO: 536145 - RNA, 19 nt, Homo sapiens
aagaagagccauagcugau

SEQ ID NO: 536146 - RNA, 19 nt, Homo sapiens
gaucuucuucauccaacuu

SEQ ID NO: 536147 - RNA, 19 nt, Homo sapiens
gauuugcucuuugacaacu

SEQ ID NO: 536148 - RNA, 19 nt, Homo sapiens
ggugaggaaauccauuguu

SEQ ID NO: 536149 - RNA, 19 nt, Homo sapiens
ggugaaucuugucuaacau

SEQ ID NO: 536150 - RNA, 19 nt, Homo sapiens
ggaagaaccuguagaagau

SEQ ID NO: 536151 - RNA, 19 nt, Homo sapiens
gagccaagcuaauguggua

SEQ ID NO: 536152 - RNA, 19 nt, Homo sapiens
gagaauuccucuauuuguu

SEQ ID NO: 536153 - RNA, 19 nt, Homo sapiens
gguauugacucuucagauu

SEQ ID NO: 536154 - RNA, 19 nt, Homo sapiens
gaaguagacauggaauuua

SEQ ID NO: 536155 - RNA, 19 nt, Homo sapiens
gaaggaagaaccuguagaa

SEQ ID NO: 536156 - RNA, 19 nt, Homo sapiens
acaaaugucuugaaguaga

SEQ ID NO: 536157 - RNA, 19 nt, Homo sapiens
ucuaaggaaugauccaaua

SEQ ID NO: 536158 - RNA, 19 nt, Homo sapiens
aaagaaggcucgaaugagu

SEQ ID NO: 536159 - RNA, 19 nt, Homo sapiens
ggaaugauccaauacuguu

SEQ ID NO: 536160 - RNA, 19 nt, Homo sapiens
cgaaagaaggcucgaauga

SEQ ID NO: 536161 - RNA, 19 nt, Homo sapiens
gacauggaauuuaugaaug

SEQ ID NO: 536162 - RNA, 19 nt, Homo sapiens
ggaagccauuaaugaacua

SEQ ID NO: 536163 - RNA, 19 nt, Homo sapiens
aaacuacccaugcaauuaa

SEQ ID NO: 536164 - RNA, 19 nt, Homo sapiens
guaagggucauuagacaaa

SEQ ID NO: 536165 - RNA, 19 nt, Homo sapiens
gcaagugguagauuuagaa

SEQ ID NO: 536166 - RNA, 19 nt, Homo sapiens
gaacagcaagugguagauu

SEQ ID NO: 536167 - RNA, 19 nt, Homo sapiens
ugaaguagacauggaauuu

SEQ ID NO: 536168 - RNA, 19 nt, Homo sapiens
gaauuccucuauuuguuca

SEQ ID NO: 536169 - RNA, 19 nt, Homo sapiens
uguagaagaugaccucguu

SEQ ID NO: 536170 - RNA, 19 nt, Homo sapiens
uccaagguauugagacaua

SEQ ID NO: 536171 - RNA, 19 nt, Homo sapiens
agugguagauuuagaagaa

SEQ ID NO: 536172 - RNA, 19 nt, Homo sapiens
agacagagagccaagcuaa

SEQ ID NO: 536173 - RNA, 19 nt, Homo sapiens
caacuuggacccagucaug

SEQ ID NO: 536174 - RNA, 19 nt, Homo sapiens
ccagucauguucuucaaau

SEQ ID NO: 536175 - RNA, 19 nt, Homo sapiens
gcuggaagccauuaaugaa

SEQ ID NO: 536176 - RNA, 19 nt, Homo sapiens
gaacaucuccccauggauu

SEQ ID NO: 536177 - RNA, 19 nt, Homo sapiens
ggagcuggguaucucaaau

SEQ ID NO: 536178 - RNA, 19 nt, Homo sapiens
agaaugaucacccugaauu

SEQ ID NO: 536179 - RNA, 19 nt, Homo sapiens
gaaaacucauggccuugua

SEQ ID NO: 536180 - RNA, 19 nt, Homo sapiens
gaaagaaggcucgaaugag

SEQ ID NO: 536181 - RNA, 19 nt, Homo sapiens
gcucuuucccucauguaua

SEQ ID NO: 536182 - RNA, 19 nt, Homo sapiens
guagacauggaauuuauga

SEQ ID NO: 536183 - RNA, 19 nt, Homo sapiens
gcgcugaggaggaaacuga

SEQ ID NO: 536184 - RNA, 19 nt, Homo sapiens
ugucuguacuucauucaaa

SEQ ID NO: 536185 - RNA, 19 nt, Homo sapiens
ggugcuuucuccauuuauu

SEQ ID NO: 536186 - RNA, 19 nt, Homo sapiens
aaggugcuuucuccauuua

SEQ ID NO: 536187 - RNA, 19 nt, Homo sapiens
uaguguagcuucugaaagg

SEQ ID NO: 536188 - RNA, 19 nt, Homo sapiens
ugaucacccugaauucauu

SEQ ID NO: 536189 - RNA, 19 nt, Homo sapiens
agaaggcgcugaggaggaa

SEQ ID NO: 536190 - RNA, 19 nt, Homo sapiens
aagcuaaugugguagugaa

SEQ ID NO: 536191 - RNA, 19 nt, Homo sapiens
ugacauguccucucugcuu

SEQ ID NO: 536192 - RNA, 19 nt, Homo sapiens
aacagcaagugguagauuu

SEQ ID NO: 536193 - RNA, 19 nt, Homo sapiens
auacaguccuagagaauuc

SEQ ID NO: 536194 - RNA, 19 nt, Homo sapiens
ccagaggucuacccagaag

SEQ ID NO: 536195 - RNA, 19 nt, Homo sapiens
gagaguauacaguccuaga

SEQ ID NO: 536196 - RNA, 19 nt, Homo sapiens
uagagaguauacaguccua

SEQ ID NO: 536197 - RNA, 19 nt, Homo sapiens
ucagugacauguccucucu

SEQ ID NO: 536198 - RNA, 19 nt, Homo sapiens
aggaagaaccuguagaaga

SEQ ID NO: 536199 - RNA, 19 nt, Homo sapiens
gaauucauugucucaguga

SEQ ID NO: 536200 - RNA, 19 nt, Homo sapiens
uauugacucuucagauuca

SEQ ID NO: 536201 - RNA, 19 nt, Homo sapiens
ugccagagaucgaaagaag

SEQ ID NO: 536202 - RNA, 19 nt, Homo sapiens
gaguauacaguccuagaga

SEQ ID NO: 536203 - RNA, 19 nt, Homo sapiens
acagcaagugguagauuua

SEQ ID NO: 536204 - RNA, 19 nt, Homo sapiens
agagaaugaucacccugaa

SEQ ID NO: 536205 - RNA, 19 nt, Homo sapiens
gauauccuguugggcauuc

SEQ ID NO: 536206 - RNA, 19 nt, Homo sapiens
acagagagccaagcuaaug

SEQ ID NO: 536207 - RNA, 19 nt, Homo sapiens
cauggauucuggcgguauu

SEQ ID NO: 536208 - RNA, 19 nt, Homo sapiens
uggcuugccuccaguuuua

SEQ ID NO: 536209 - RNA, 19 nt, Homo sapiens
gaacuacagcuuuuaagau

SEQ ID NO: 536210 - RNA, 19 nt, Homo sapiens
ccaauacuguugcccuuuu

SEQ ID NO: 536211 - RNA, 19 nt, Homo sapiens
gaaugauccaauacuguug

SEQ ID NO: 536212 - RNA, 19 nt, Homo sapiens
aagaaccuguagaagauga

SEQ ID NO: 536213 - RNA, 19 nt, Homo sapiens
guauugagacauauuacug

SEQ ID NO: 536214 - RNA, 19 nt, Homo sapiens
caagguauugagacauauu

SEQ ID NO: 536215 - RNA, 19 nt, Homo sapiens
ggaggacacuuuugccaau

SEQ ID NO: 536216 - RNA, 19 nt, Homo sapiens
ucaaguaagaucaagaauc

SEQ ID NO: 536217 - RNA, 19 nt, Homo sapiens
guauacaguccuagagaau

SEQ ID NO: 536218 - RNA, 19 nt, Homo sapiens
gcaauuaaaagguacaaug

SEQ ID NO: 536219 - RNA, 19 nt, Homo sapiens
acauggaauuuaugaaugg

SEQ ID NO: 536220 - RNA, 19 nt, Homo sapiens
uaauugagaacuacagcuu

SEQ ID NO: 536221 - RNA, 19 nt, Homo sapiens
aguauacaguccuagagaa

SEQ ID NO: 536222 - RNA, 19 nt, Homo sapiens
gagaagccugucuguacuu

SEQ ID NO: 536223 - RNA, 19 nt, Homo sapiens
gagcuggguaucucaaauc

SEQ ID NO: 536224 - RNA, 19 nt, Homo sapiens
gaagaaccuguagaagaug

SEQ ID NO: 536225 - RNA, 19 nt, Homo sapiens
cagcucagacugccagaga

SEQ ID NO: 536226 - RNA, 19 nt, Homo sapiens
gugcuuucuccauuuauuu

SEQ ID NO: 536227 - RNA, 19 nt, Homo sapiens
ccaagguauugagacauau

SEQ ID NO: 536228 - RNA, 19 nt, Homo sapiens
gagaaugaucacccugaau

SEQ ID NO: 536229 - RNA, 19 nt, Homo sapiens
guauugacucuucagauuc

SEQ ID NO: 536230 - RNA, 19 nt, Homo sapiens
guugagaaccaggaguuaa

SEQ ID NO: 536231 - RNA, 19 nt, Homo sapiens
aaggaaugauccaauacug

SEQ ID NO: 536232 - RNA, 19 nt, Homo sapiens
cucauggccuuguaguuga

SEQ ID NO: 536233 - RNA, 19 nt, Homo sapiens
aaaacuacccaugcaauua

SEQ ID NO: 536234 - RNA, 19 nt, Homo sapiens
uaagggucauuagacaaau

SEQ ID NO: 536235 - RNA, 19 nt, Homo sapiens
ggugguaguuuucccuaaa

SEQ ID NO: 536236 - RNA, 19 nt, Homo sapiens
agagaagccugucuguacu

SEQ ID NO: 536237 - RNA, 19 nt, Homo sapiens
gcaguccaagguauugaga

SEQ ID NO: 536238 - RNA, 19 nt, Homo sapiens
ccuggaggauagcagagaa

SEQ ID NO: 536239 - RNA, 19 nt, Homo sapiens
acucauggccuuguaguug

SEQ ID NO: 536240 - RNA, 19 nt, Homo sapiens
ucgaaugagugagcuggaa

SEQ ID NO: 536241 - RNA, 19 nt, Homo sapiens
uggaagccauuaaugaacu

SEQ ID NO: 536242 - RNA, 19 nt, Homo sapiens
cagaguagcagcucagacu

SEQ ID NO: 536243 - RNA, 19 nt, Homo sapiens
cagaacaucuccccaugga

SEQ ID NO: 536244 - RNA, 19 nt, Homo sapiens
gaaugagugagcuggaaca

SEQ ID NO: 536245 - RNA, 19 nt, Homo sapiens
caagcuggaagccauuaau

SEQ ID NO: 536246 - RNA, 19 nt, Homo sapiens
agaaggcucgaaugaguga

SEQ ID NO: 536247 - RNA, 19 nt, Homo sapiens
agaauuccucuauuuguuc

SEQ ID NO: 536248 - RNA, 19 nt, Homo sapiens
uacacugccuggaggauag

SEQ ID NO: 536249 - RNA, 19 nt, Homo sapiens
ccugccuacuggaugcuua

SEQ ID NO: 536250 - RNA, 19 nt, Homo sapiens
ggaauaagcuucacaguuc

SEQ ID NO: 536251 - RNA, 19 nt, Homo sapiens
gaacauggaucuauuaaag

SEQ ID NO: 536252 - RNA, 19 nt, Homo sapiens
gcagaaaggugguggagaa

SEQ ID NO: 536253 - RNA, 19 nt, Homo sapiens
gauguuggcuccagucuaa

SEQ ID NO: 536254 - RNA, 19 nt, Homo sapiens
gcacagauauugucaugga

SEQ ID NO: 536255 - RNA, 19 nt, Homo sapiens
ggaagcagcugcgauuuga

SEQ ID NO: 536256 - RNA, 19 nt, Homo sapiens
gaagacaagugaaugcaau

SEQ ID NO: 536257 - RNA, 19 nt, Homo sapiens
ggucacagcugccuacaug

SEQ ID NO: 536258 - RNA, 19 nt, Homo sapiens
gaacaagaucguccacuuu

SEQ ID NO: 536259 - RNA, 19 nt, Homo sapiens
gaagaacuaccagccauua

SEQ ID NO: 536260 - RNA, 19 nt, Homo sapiens
caacuuuacuguuucagaa

SEQ ID NO: 536261 - RNA, 19 nt, Homo sapiens
ugaaugcaauggaagauuu

SEQ ID NO: 536262 - RNA, 19 nt, Homo sapiens
gaacauaccacagaacaug

SEQ ID NO: 536263 - RNA, 19 nt, Homo sapiens
uagaggagcuacacuauuc

SEQ ID NO: 536264 - RNA, 19 nt, Homo sapiens
ggaagcaagucaagucugu

SEQ ID NO: 536265 - RNA, 19 nt, Homo sapiens
uaagaagguuccaggguuu

SEQ ID NO: 536266 - RNA, 19 nt, Homo sapiens
gcacagugaugcucuccaa

SEQ ID NO: 536267 - RNA, 19 nt, Homo sapiens
gagacucacugcaccauug

SEQ ID NO: 536268 - RNA, 19 nt, Homo sapiens
ggacaguuguggcucuuga

SEQ ID NO: 536269 - RNA, 19 nt, Homo sapiens
gaccugagcugaagaucga

SEQ ID NO: 536270 - RNA, 19 nt, Homo sapiens
gaaaaucaccuaugaagaa

SEQ ID NO: 536271 - RNA, 19 nt, Homo sapiens
ggaggaacauaccacagaa

SEQ ID NO: 536272 - RNA, 19 nt, Homo sapiens
caggagaacuguccagaug

SEQ ID NO: 536273 - RNA, 19 nt, Homo sapiens
gaaaucgacugccuaacag

SEQ ID NO: 536274 - RNA, 19 nt, Homo sapiens
caaggagaauuguuggaaa

SEQ ID NO: 536275 - RNA, 19 nt, Homo sapiens
agagugagguugacaaguu

SEQ ID NO: 536276 - RNA, 19 nt, Homo sapiens
aagagaggauugugcauaa

SEQ ID NO: 536277 - RNA, 19 nt, Homo sapiens
gaugaggacaugcugauaa

SEQ ID NO: 536278 - RNA, 19 nt, Homo sapiens
gggaaggguuugugcuauu

SEQ ID NO: 536279 - RNA, 19 nt, Homo sapiens
gaacuaccagccauuauca

SEQ ID NO: 536280 - RNA, 19 nt, Homo sapiens
ggaguaacauaacuggaau

SEQ ID NO: 536281 - RNA, 19 nt, Homo sapiens
aagaucaaguccauagaua

SEQ ID NO: 536282 - RNA, 19 nt, Homo sapiens
gagcucagcacacagguaa

SEQ ID NO: 536283 - RNA, 19 nt, Homo sapiens
guaauaacgugaaggaacu

SEQ ID NO: 536284 - RNA, 19 nt, Homo sapiens
gaagacaagugugguaaac

SEQ ID NO: 536285 - RNA, 19 nt, Homo sapiens
gggaguauuucucagcauu

SEQ ID NO: 536286 - RNA, 19 nt, Homo sapiens
agaauaugcuguuuccuau

SEQ ID NO: 536287 - RNA, 19 nt, Homo sapiens
aaaccaaccuucccuccaa

SEQ ID NO: 536288 - RNA, 19 nt, Homo sapiens
guccauagauacaucagaa

SEQ ID NO: 536289 - RNA, 19 nt, Homo sapiens
aauaugcuguuuccuauga

SEQ ID NO: 536290 - RNA, 19 nt, Homo sapiens
gcaugaaccagaagaaaga

SEQ ID NO: 536291 - RNA, 19 nt, Homo sapiens
guagaaaucgacugccuaa

SEQ ID NO: 536292 - RNA, 19 nt, Homo sapiens
acacggagauuggcauuga

SEQ ID NO: 536293 - RNA, 19 nt, Homo sapiens
ggaaggguuugugcuauuc

SEQ ID NO: 536294 - RNA, 19 nt, Homo sapiens
aaacuguuaugccuaaaug

SEQ ID NO: 536295 - RNA, 19 nt, Homo sapiens
gagaaugggaggaggcuuu

SEQ ID NO: 536296 - RNA, 19 nt, Homo sapiens
gcucagcacacagguaaua

SEQ ID NO: 536297 - RNA, 19 nt, Homo sapiens
uaacaggagaucauaagaa

SEQ ID NO: 536298 - RNA, 19 nt, Homo sapiens
gccaaggccuucauaccaa

SEQ ID NO: 536299 - RNA, 19 nt, Homo sapiens
gagaggauugugcauaauu

SEQ ID NO: 536300 - RNA, 19 nt, Homo sapiens
uacaggagcuggcccuuug

SEQ ID NO: 536301 - RNA, 19 nt, Homo sapiens
ggaauaggaagcaccaaga

SEQ ID NO: 536302 - RNA, 19 nt, Homo sapiens
cagugaugcucuccaagua

SEQ ID NO: 536303 - RNA, 19 nt, Homo sapiens
gacaaugacagcagacaaa

SEQ ID NO: 536304 - RNA, 19 nt, Homo sapiens
accagaagcuugaggguuu

SEQ ID NO: 536305 - RNA, 19 nt, Homo sapiens
ugacacacuucaaccagaa

SEQ ID NO: 536306 - RNA, 19 nt, Homo sapiens
cagaggaggugcggagaaa

SEQ ID NO: 536307 - RNA, 19 nt, Homo sapiens
caauugaggaugcuauaaa

SEQ ID NO: 536308 - RNA, 19 nt, Homo sapiens
gaugggauuuggaagacaa

SEQ ID NO: 536309 - RNA, 19 nt, Homo sapiens
cacagaacauggaucuauu

SEQ ID NO: 536310 - RNA, 19 nt, Homo sapiens
caacaagaaggccaucuau

SEQ ID NO: 536311 - RNA, 19 nt, Homo sapiens
gcuacagcuuugagacuaa

SEQ ID NO: 536312 - RNA, 19 nt, Homo sapiens
cgaagcagauaauguugug

SEQ ID NO: 536313 - RNA, 19 nt, Homo sapiens
aagagaaccuggaagacaa

SEQ ID NO: 536314 - RNA, 19 nt, Homo sapiens
acaagugaaugcaauggaa

SEQ ID NO: 536315 - RNA, 19 nt, Homo sapiens
gcauaauucccaccaaguu

SEQ ID NO: 536316 - RNA, 19 nt, Homo sapiens
aaucaccuaugaagaacua

SEQ ID NO: 536317 - RNA, 19 nt, Homo sapiens
ggauaagguuacuuguguu

SEQ ID NO: 536318 - RNA, 19 nt, Homo sapiens
gggaguaacauaacuggaa

SEQ ID NO: 536319 - RNA, 19 nt, Homo sapiens
gagauuggcauugagauga

SEQ ID NO: 536320 - RNA, 19 nt, Homo sapiens
ugacaacuguggaaggaau

SEQ ID NO: 536321 - RNA, 19 nt, Homo sapiens
gaauaugcaauuaggauca

SEQ ID NO: 536322 - RNA, 19 nt, Homo sapiens
caagaugggauuuggaaga

SEQ ID NO: 536323 - RNA, 19 nt, Homo sapiens
ccacagaacauggaucuau

SEQ ID NO: 536324 - RNA, 19 nt, Homo sapiens
gcaggagcccuacuucaug

SEQ ID NO: 536325 - RNA, 19 nt, Homo sapiens
gaacaacuccuuuuaugga

SEQ ID NO: 536326 - RNA, 19 nt, Homo sapiens
gguaaccaguggcaugaga

SEQ ID NO: 536327 - RNA, 19 nt, Homo sapiens
gaacacggagauuggcauu

SEQ ID NO: 536328 - RNA, 19 nt, Homo sapiens
gagaugggaauaauccaaa

SEQ ID NO: 536329 - RNA, 19 nt, Homo sapiens
ccaaggccuucauaccaaa

SEQ ID NO: 536330 - RNA, 19 nt, Homo sapiens
acacagaacaccaugaaga

SEQ ID NO: 536331 - RNA, 19 nt, Homo sapiens
cgaaggauaagguuacuug

SEQ ID NO: 536332 - RNA, 19 nt, Homo sapiens
ggguuuguuuguuucauuu

SEQ ID NO: 536333 - RNA, 19 nt, Homo sapiens
gaucaaguccauagauaca

SEQ ID NO: 536334 - RNA, 19 nt, Homo sapiens
guucaagaauaugcuguuu

SEQ ID NO: 536335 - RNA, 19 nt, Homo sapiens
agaacaagaucguccacuu

SEQ ID NO: 536336 - RNA, 19 nt, Homo sapiens
uaucauuggugcugugguu

SEQ ID NO: 536337 - RNA, 19 nt, Homo sapiens
aggauaagguuacuugugu

SEQ ID NO: 536338 - RNA, 19 nt, Homo sapiens
agacaagugugguaaacug

SEQ ID NO: 536339 - RNA, 19 nt, Homo sapiens
ggaagacaagugugguaaa

SEQ ID NO: 536340 - RNA, 19 nt, Homo sapiens
gaaccuggaagacaagugu

SEQ ID NO: 536341 - RNA, 19 nt, Homo sapiens
cuauuaaagucacagaaug

SEQ ID NO: 536342 - RNA, 19 nt, Homo sapiens
acagaacauggaucuauua

SEQ ID NO: 536343 - RNA, 19 nt, Homo sapiens
gugaugcucuccaaguaug

SEQ ID NO: 536344 - RNA, 19 nt, Homo sapiens
ggauuuggaagacaaguga

SEQ ID NO: 536345 - RNA, 19 nt, Homo sapiens
ugcaaacccuggucuguga

SEQ ID NO: 536346 - RNA, 19 nt, Homo sapiens
ccgcacagauauugucaug

SEQ ID NO: 536347 - RNA, 19 nt, Homo sapiens
gaaccuccgcacagauauu

SEQ ID NO: 536348 - RNA, 19 nt, Homo sapiens
aaagagaggauugugcaua

SEQ ID NO: 536349 - RNA, 19 nt, Homo sapiens
gauaagguuacuuguguug

SEQ ID NO: 536350 - RNA, 19 nt, Homo sapiens
gcuaaauucuucagugaua

SEQ ID NO: 536351 - RNA, 19 nt, Homo sapiens
ugagauaucugcacauaaa

SEQ ID NO: 536352 - RNA, 19 nt, Homo sapiens
gaugucugaugcucaauua

SEQ ID NO: 536353 - RNA, 19 nt, Homo sapiens
gaaaaugucugaagauguu

SEQ ID NO: 536354 - RNA, 19 nt, Homo sapiens
uauaagaguuucagcauga

SEQ ID NO: 536355 - RNA, 19 nt, Homo sapiens
caagaaguauacuagcuuu

SEQ ID NO: 536356 - RNA, 19 nt, Homo sapiens
gaagaauauuguugagguu

SEQ ID NO: 536357 - RNA, 19 nt, Homo sapiens
aaccaaagaucaagacauu

SEQ ID NO: 536358 - RNA, 19 nt, Homo sapiens
ggagguuacuucaaugaug

SEQ ID NO: 536359 - RNA, 19 nt, Homo sapiens
gcauauugguauaguuuga

SEQ ID NO: 536360 - RNA, 19 nt, Homo sapiens
gaucauccuuucagcuuug

SEQ ID NO: 536361 - RNA, 19 nt, Homo sapiens
cgacagcgguggaaauauc

SEQ ID NO: 536362 - RNA, 19 nt, Homo sapiens
gcaguagggagguagaaua

SEQ ID NO: 536363 - RNA, 19 nt, Homo sapiens
guugugagaucuucagcua

SEQ ID NO: 536364 - RNA, 19 nt, Homo sapiens
gcuuggagcccauuuguuu

SEQ ID NO: 536365 - RNA, 19 nt, Homo sapiens
caucauuugugcaauuuga

SEQ ID NO: 536366 - RNA, 19 nt, Homo sapiens
guagggagguagaauaucu

SEQ ID NO: 536367 - RNA, 19 nt, Homo sapiens
gagaucaccauucaacgua

SEQ ID NO: 536368 - RNA, 19 nt, Homo sapiens
ccaagaagccaaacucaga

SEQ ID NO: 536369 - RNA, 19 nt, Homo sapiens
gugcuaaauucuucaguga

SEQ ID NO: 536370 - RNA, 19 nt, Homo sapiens
ucugggagaugaagaauau

SEQ ID NO: 536371 - RNA, 19 nt, Homo sapiens
ugaaugugaugugguuaua

SEQ ID NO: 536372 - RNA, 19 nt, Homo sapiens
gaaccguguuuaucacugu

SEQ ID NO: 536373 - RNA, 19 nt, Homo sapiens
gagguuacuucaaugaugu

SEQ ID NO: 536374 - RNA, 19 nt, Homo sapiens
gagcagcagccaguuauuu

SEQ ID NO: 536375 - RNA, 19 nt, Homo sapiens
aaucgugucucccaucgua

SEQ ID NO: 536376 - RNA, 19 nt, Homo sapiens
gggcauauugguauaguuu

SEQ ID NO: 536377 - RNA, 19 nt, Homo sapiens
ggagacagaaauagugauu

SEQ ID NO: 536378 - RNA, 19 nt, Homo sapiens
ggaaaucuugggaugcuuu

SEQ ID NO: 536379 - RNA, 19 nt, Homo sapiens
ucucagauguggauucaug

SEQ ID NO: 536380 - RNA, 19 nt, Homo sapiens
gaccugugcuaaauucuuc

SEQ ID NO: 536381 - RNA, 19 nt, Homo sapiens
gacacaauuugaugaccua

SEQ ID NO: 536382 - RNA, 19 nt, Homo sapiens
gaccagaagucaacaacag

SEQ ID NO: 536383 - RNA, 19 nt, Homo sapiens
ggugaugucugaugcucaa

SEQ ID NO: 536384 - RNA, 19 nt, Homo sapiens
ccaaagaucaagacauuca

SEQ ID NO: 536385 - RNA, 19 nt, Homo sapiens
cagcaugagcuuaauuaaa

SEQ ID NO: 536386 - RNA, 19 nt, Homo sapiens
gaagauaguccauauuucc

SEQ ID NO: 536387 - RNA, 19 nt, Homo sapiens
cauugagcauucauuauug

SEQ ID NO: 536388 - RNA, 19 nt, Homo sapiens
acucagauaucuacccaaa

SEQ ID NO: 536389 - RNA, 19 nt, Homo sapiens
guggauucaugcaucauuu

SEQ ID NO: 536390 - RNA, 19 nt, Homo sapiens
gagaugaagaauauuguug

SEQ ID NO: 536391 - RNA, 19 nt, Homo sapiens
caggaguggugaugucuga

SEQ ID NO: 536392 - RNA, 19 nt, Homo sapiens
guccauauuuccuauuuca

SEQ ID NO: 536393 - RNA, 19 nt, Homo sapiens
ugaaagggcuccccgguuu

SEQ ID NO: 536394 - RNA, 19 nt, Homo sapiens
cauuuagacuuugccauaa

SEQ ID NO: 536395 - RNA, 19 nt, Homo sapiens
gcgcauaggagacagaaau

SEQ ID NO: 536396 - RNA, 19 nt, Homo sapiens
acaagaaccguguuuauca

SEQ ID NO: 536397 - RNA, 19 nt, Homo sapiens
ggucucagauguggauuca

SEQ ID NO: 536398 - RNA, 19 nt, Homo sapiens
gaucaccauucaacguaug

SEQ ID NO: 536399 - RNA, 19 nt, Homo sapiens
caguggagguuacuucaau

SEQ ID NO: 536400 - RNA, 19 nt, Homo sapiens
ucagauaucuacccaaagc

SEQ ID NO: 536401 - RNA, 19 nt, Homo sapiens
ugaagauaguccauauuuc

SEQ ID NO: 536402 - RNA, 19 nt, Homo sapiens
ccauaaauaucagaaccaa

SEQ ID NO: 536403 - RNA, 19 nt, Homo sapiens
acauuuagacuuugccaua

SEQ ID NO: 536404 - RNA, 19 nt, Homo sapiens
acaauuugaugaccuaaag

SEQ ID NO: 536405 - RNA, 19 nt, Homo sapiens
gugaugugguuauaaagau

SEQ ID NO: 536406 - RNA, 19 nt, Homo sapiens
gcaaaaugacugauguuaa

SEQ ID NO: 536407 - RNA, 19 nt, Homo sapiens
gaugaagaauauuguugag

SEQ ID NO: 536408 - RNA, 19 nt, Homo sapiens
cacacacgcuuaaccaugu

SEQ ID NO: 536409 - RNA, 19 nt, Homo sapiens
gagacagaaauagugauua

SEQ ID NO: 536410 - RNA, 19 nt, Homo sapiens
uuugagauaucugcacaua

SEQ ID NO: 536411 - RNA, 19 nt, Homo sapiens
ggagaugaagaauauuguu

SEQ ID NO: 536412 - RNA, 19 nt, Homo sapiens
gaucuucagcuaccucaug

SEQ ID NO: 536413 - RNA, 19 nt, Homo sapiens
uaucagaaccaaagaucaa

SEQ ID NO: 536414 - RNA, 19 nt, Homo sapiens
caacaguggagguuacuuc

SEQ ID NO: 536415 - RNA, 19 nt, Homo sapiens
gaaccaaagaucaagacau

SEQ ID NO: 536416 - RNA, 19 nt, Homo sapiens
aaaggaugguuugggcaua

SEQ ID NO: 536417 - RNA, 19 nt, Homo sapiens
ggagguagaauaucuuggu

SEQ ID NO: 536418 - RNA, 19 nt, Homo sapiens
acaaagcggugagcaguag

SEQ ID NO: 536419 - RNA, 19 nt, Homo sapiens
gacuguggcucucuguugu

SEQ ID NO: 536420 - RNA, 19 nt, Homo sapiens
gaaugugaugugguuauaa

SEQ ID NO: 536421 - RNA, 19 nt, Homo sapiens
aguauuagguccugcaaca

SEQ ID NO: 536422 - RNA, 19 nt, Homo sapiens
gacaucgccucccuuccuu

SEQ ID NO: 536423 - RNA, 19 nt, Homo sapiens
gcucauauuuuccacuuga

SEQ ID NO: 536424 - RNA, 19 nt, Homo sapiens
ucacuguuguggagauuuc

SEQ ID NO: 536425 - RNA, 19 nt, Homo sapiens
ggaguccacugagguucuu

SEQ ID NO: 536426 - RNA, 19 nt, Homo sapiens
gucugaugcucaauuacua

SEQ ID NO: 536427 - RNA, 19 nt, Homo sapiens
aaagagagaagguugaaag

SEQ ID NO: 536428 - RNA, 19 nt, Homo sapiens
uugcauuccuugguuuaua

SEQ ID NO: 536429 - RNA, 19 nt, Homo sapiens
caacauugcauuccuuggu

SEQ ID NO: 536430 - RNA, 19 nt, Homo sapiens
gcaccaacauugcauuccu

SEQ ID NO: 536431 - RNA, 19 nt, Homo sapiens
gcuaccucauggugcaaua

SEQ ID NO: 536432 - RNA, 19 nt, Homo sapiens
ccaagaaguauacuagcuu

SEQ ID NO: 536433 - RNA, 19 nt, Homo sapiens
ggaccugugcuaaauucuu

SEQ ID NO: 536434 - RNA, 19 nt, Homo sapiens
gaagccaaacucagauauc

SEQ ID NO: 536435 - RNA, 19 nt, Homo sapiens
aauaacacacacacgcuua

SEQ ID NO: 536436 - RNA, 19 nt, Homo sapiens
caagaaccguguuuaucac

SEQ ID NO: 536437 - RNA, 19 nt, Homo sapiens
ggagaucaccauucaacgu

SEQ ID NO: 536438 - RNA, 19 nt, Homo sapiens
ggcgguggcuacuccaguu

SEQ ID NO: 536439 - RNA, 19 nt, Homo sapiens
gagcuuggagcccauuugu

SEQ ID NO: 536440 - RNA, 19 nt, Homo sapiens
agucuuugauacucuguaa

SEQ ID NO: 536441 - RNA, 19 nt, Homo sapiens
ccuuucagcuuugagauau

SEQ ID NO: 536442 - RNA, 19 nt, Homo sapiens
ugguuuggcuauucauuug

SEQ ID NO: 536443 - RNA, 19 nt, Homo sapiens
ucacuaagcauucccaacu

SEQ ID NO: 536444 - RNA, 19 nt, Homo sapiens
gggagcagcagccaguuau

SEQ ID NO: 536445 - RNA, 19 nt, Homo sapiens
ccuuuaauccauuccauuu

SEQ ID NO: 536446 - RNA, 19 nt, Homo sapiens
guggaaagcacuugaaagg

SEQ ID NO: 536447 - RNA, 19 nt, Homo sapiens
guucuugcauccugaagca

SEQ ID NO: 536448 - RNA, 19 nt, Homo sapiens
caagcaggguuugaucauc

SEQ ID NO: 536449 - RNA, 19 nt, Homo sapiens
ggggaugcauuauuucuga

SEQ ID NO: 536450 - RNA, 19 nt, Homo sapiens
gaauaacacucaagacuau

SEQ ID NO: 536451 - RNA, 19 nt, Homo sapiens
gguagcauauccucaauua

SEQ ID NO: 536452 - RNA, 19 nt, Homo sapiens
gaaguaaguucaucaaaca

SEQ ID NO: 536453 - RNA, 19 nt, Homo sapiens
gaaaagaggugaccauaaa

SEQ ID NO: 536454 - RNA, 19 nt, Homo sapiens
gaagauaggugagcaacuu

SEQ ID NO: 536455 - RNA, 19 nt, Homo sapiens
gaagaucucugcucugcuu

SEQ ID NO: 536456 - RNA, 19 nt, Homo sapiens
caaaagggcucuauaauga

SEQ ID NO: 536457 - RNA, 19 nt, Homo sapiens
caacugaauugcuaucauu

SEQ ID NO: 536458 - RNA, 19 nt, Homo sapiens
auaaagaucuccaguugua

SEQ ID NO: 536459 - RNA, 19 nt, Homo sapiens
ggacgucacuguuggaaga

SEQ ID NO: 536460 - RNA, 19 nt, Homo sapiens
gggauccacuucucuguua

SEQ ID NO: 536461 - RNA, 19 nt, Homo sapiens
gccauuauuucuaccauua

SEQ ID NO: 536462 - RNA, 19 nt, Homo sapiens
guacuaugcuuucuaacuu

SEQ ID NO: 536463 - RNA, 19 nt, Homo sapiens
ggaugugaguuuaaucuuu

SEQ ID NO: 536464 - RNA, 19 nt, Homo sapiens
gacccuauuuguuucauua

SEQ ID NO: 536465 - RNA, 19 nt, Homo sapiens
ggacagagauuugguaacu

SEQ ID NO: 536466 - RNA, 19 nt, Homo sapiens
ccacuucucuguuaaccua

SEQ ID NO: 536467 - RNA, 19 nt, Homo sapiens
gagcacaggcauauuauuu

SEQ ID NO: 536468 - RNA, 19 nt, Homo sapiens
ggagugaggugugggagua

SEQ ID NO: 536469 - RNA, 19 nt, Homo sapiens
gcaggaaguuagcuguuaa

SEQ ID NO: 536470 - RNA, 19 nt, Homo sapiens
acacaucacuuaccacuug

SEQ ID NO: 536471 - RNA, 19 nt, Homo sapiens
ugauaaagaucuccaguug

SEQ ID NO: 536472 - RNA, 19 nt, Homo sapiens
gauaugagcuuucguugac

SEQ ID NO: 536473 - RNA, 19 nt, Homo sapiens
gagauuugguaacucauuu

SEQ ID NO: 536474 - RNA, 19 nt, Homo sapiens
ucacaccaauuuagaauga

SEQ ID NO: 536475 - RNA, 19 nt, Homo sapiens
ggaagaagucuccucauga

SEQ ID NO: 536476 - RNA, 19 nt, Homo sapiens
gauaaaggauauagcaaca

SEQ ID NO: 536477 - RNA, 19 nt, Homo sapiens
ccacuucacacauuuauaa

SEQ ID NO: 536478 - RNA, 19 nt, Homo sapiens
caacuugagugaucccaaa

SEQ ID NO: 536479 - RNA, 19 nt, Homo sapiens
gggcuuaccuguucucuag

SEQ ID NO: 536480 - RNA, 19 nt, Homo sapiens
gcaagucccauaauuggua

SEQ ID NO: 536481 - RNA, 19 nt, Homo sapiens
ugaaagcccuggaauuuua

SEQ ID NO: 536482 - RNA, 19 nt, Homo sapiens
caacaucauuccugucaga

SEQ ID NO: 536483 - RNA, 19 nt, Homo sapiens
aaaggaagaucuacaguca

SEQ ID NO: 536484 - RNA, 19 nt, Homo sapiens
gaagaagucuccucaugac

SEQ ID NO: 536485 - RNA, 19 nt, Homo sapiens
cagaggagauugagaagga

SEQ ID NO: 536486 - RNA, 19 nt, Homo sapiens
gaaaccaccuuaaaacauu

SEQ ID NO: 536487 - RNA, 19 nt, Homo sapiens
gcuguaaggccauucuuua

SEQ ID NO: 536488 - RNA, 19 nt, Homo sapiens
gauaaucaguuuccacuac

SEQ ID NO: 536489 - RNA, 19 nt, Homo sapiens
gagauugacuucagaaacu

SEQ ID NO: 536490 - RNA, 19 nt, Homo sapiens
agaaaucucucacccaguu

SEQ ID NO: 536491 - RNA, 19 nt, Homo sapiens
caugaaagcccuggaauuu

SEQ ID NO: 536492 - RNA, 19 nt, Homo sapiens
caucacaguucacagguaa

SEQ ID NO: 536493 - RNA, 19 nt, Homo sapiens
ucagagcacaggcauauua

SEQ ID NO: 536494 - RNA, 19 nt, Homo sapiens
ggcaggaaguuagcuguua

SEQ ID NO: 536495 - RNA, 19 nt, Homo sapiens
caacuuaauugcucuaugc

SEQ ID NO: 536496 - RNA, 19 nt, Homo sapiens
ccauaaagaucacaccaau

SEQ ID NO: 536497 - RNA, 19 nt, Homo sapiens
gaagaguuaccuugguuaa

SEQ ID NO: 536498 - RNA, 19 nt, Homo sapiens
uuauagagcucuuggguau

SEQ ID NO: 536499 - RNA, 19 nt, Homo sapiens
cuacagucauccagagaua

SEQ ID NO: 536500 - RNA, 19 nt, Homo sapiens
gcacagccauucucuucau

SEQ ID NO: 536501 - RNA, 19 nt, Homo sapiens
gcagaaggcaaacuaauca

SEQ ID NO: 536502 - RNA, 19 nt, Homo sapiens
guagaauucuuaccaucuu

SEQ ID NO: 536503 - RNA, 19 nt, Homo sapiens
ggagggcuguucaaguuug

SEQ ID NO: 536504 - RNA, 19 nt, Homo sapiens
gaagagccuuaugucagua

SEQ ID NO: 536505 - RNA, 19 nt, Homo sapiens
uaaaggauauagcaacauc

SEQ ID NO: 536506 - RNA, 19 nt, Homo sapiens
cuaggcauguuaggaauua

SEQ ID NO: 536507 - RNA, 19 nt, Homo sapiens
aaagggcucuauaaugauu

SEQ ID NO: 536508 - RNA, 19 nt, Homo sapiens
gcauagauacacaaucgua

SEQ ID NO: 536509 - RNA, 19 nt, Homo sapiens
gcucaggccuugggaguga

SEQ ID NO: 536510 - RNA, 19 nt, Homo sapiens
gaauagggauccacuucuc

SEQ ID NO: 536511 - RNA, 19 nt, Homo sapiens
gaaagcgaaauacuugaaa

SEQ ID NO: 536512 - RNA, 19 nt, Homo sapiens
caaguacgaugaguaugaa

SEQ ID NO: 536513 - RNA, 19 nt, Homo sapiens
aaacauuagugcuaugguu

SEQ ID NO: 536514 - RNA, 19 nt, Homo sapiens
gaaauaaguagugucauuc

SEQ ID NO: 536515 - RNA, 19 nt, Homo sapiens
guaaggccauucuuuaguc

SEQ ID NO: 536516 - RNA, 19 nt, Homo sapiens
gcauccauacuguuuaaua

SEQ ID NO: 536517 - RNA, 19 nt, Homo sapiens
ggcaugcugucucuaauug

SEQ ID NO: 536518 - RNA, 19 nt, Homo sapiens
guacugguuagauucauua

SEQ ID NO: 536519 - RNA, 19 nt, Homo sapiens
ucucauguguuuggaguua

SEQ ID NO: 536520 - RNA, 19 nt, Homo sapiens
caacuuuucucauguguuu

SEQ ID NO: 536521 - RNA, 19 nt, Homo sapiens
guaacucauuuggguauuu

SEQ ID NO: 536522 - RNA, 19 nt, Homo sapiens
ugacuuggcauaauuguga

SEQ ID NO: 536523 - RNA, 19 nt, Homo sapiens
gcaauuugacuuggcauaa

SEQ ID NO: 536524 - RNA, 19 nt, Homo sapiens
ggaaugaccagaaaauuuu

SEQ ID NO: 536525 - RNA, 19 nt, Homo sapiens
ucacuaccacuuguaauua

SEQ ID NO: 536526 - RNA, 19 nt, Homo sapiens
ugacagcccugaccucauc

SEQ ID NO: 536527 - RNA, 19 nt, Homo sapiens
guaaguucaucaaacaugu

SEQ ID NO: 536528 - RNA, 19 nt, Homo sapiens
caacauauacuuccaugca

SEQ ID NO: 536529 - RNA, 19 nt, Homo sapiens
caaggcauccauacuguuu

SEQ ID NO: 536530 - RNA, 19 nt, Homo sapiens
gcguagaucuagugccauu

SEQ ID NO: 536531 - RNA, 19 nt, Homo sapiens
gaguuguacugguuagauu

SEQ ID NO: 536532 - RNA, 19 nt, Homo sapiens
gcaucacaguucacaggua

SEQ ID NO: 536533 - RNA, 19 nt, Homo sapiens
gcaacaaugaagagccuua

SEQ ID NO: 536534 - RNA, 19 nt, Homo sapiens
gcaccaccauuguacuaug

SEQ ID NO: 536535 - RNA, 19 nt, Homo sapiens
gauugccacucgaguugua

SEQ ID NO: 536536 - RNA, 19 nt, Homo sapiens
uggaggagcuuugagauug

SEQ ID NO: 536537 - RNA, 19 nt, Homo sapiens
ccacugacuaggcauguua

SEQ ID NO: 536538 - RNA, 19 nt, Homo sapiens
uagaagaguuaccuugguu

SEQ ID NO: 536539 - RNA, 19 nt, Homo sapiens
gagacaccuucuagcagua

SEQ ID NO: 536540 - RNA, 19 nt, Homo sapiens
ugaagagccuuaugucagu

SEQ ID NO: 536541 - RNA, 19 nt, Homo sapiens
gauaggaaaggaagaucua

SEQ ID NO: 536542 - RNA, 19 nt, Homo sapiens
acaggugcccuuucucuua

SEQ ID NO: 536543 - RNA, 19 nt, Homo sapiens
guccagcacuacaacuuaa

SEQ ID NO: 536544 - RNA, 19 nt, Homo sapiens
guaauuagagauugacuuc

SEQ ID NO: 536545 - RNA, 19 nt, Homo sapiens
guucacagguaaccauguu

SEQ ID NO: 536546 - RNA, 19 nt, Homo sapiens
agagguggcucagguguuu

SEQ ID NO: 536547 - RNA, 19 nt, Homo sapiens
uuucaagacugacaucuau

SEQ ID NO: 536548 - RNA, 19 nt, Homo sapiens
cgaugaguaugaagucaaa

SEQ ID NO: 536549 - RNA, 19 nt, Homo sapiens
ucaaguacgaugaguauga

SEQ ID NO: 536550 - RNA, 19 nt, Homo sapiens
gaaagacugugauuuagaa

SEQ ID NO: 536551 - RNA, 19 nt, Homo sapiens
gaaugaaacccuuguauaa

SEQ ID NO: 536552 - RNA, 19 nt, Homo sapiens
gccaugaacugacauauga

SEQ ID NO: 536553 - RNA, 19 nt, Homo sapiens
gcagagaugcugaugauaa

SEQ ID NO: 536554 - RNA, 19 nt, Homo sapiens
aggcugaacuggauucuua

SEQ ID NO: 536555 - RNA, 19 nt, Homo sapiens
gaacuggauucuuaaccaa

SEQ ID NO: 536556 - RNA, 19 nt, Homo sapiens
gggaaagaauuuauggauu

SEQ ID NO: 536557 - RNA, 19 nt, Homo sapiens
gaugauaaacacaagcuua

SEQ ID NO: 536558 - RNA, 19 nt, Homo sapiens
ucaagaagcauuagaagaa

SEQ ID NO: 536559 - RNA, 19 nt, Homo sapiens
gaagaagaauccacaucau

SEQ ID NO: 536560 - RNA, 19 nt, Homo sapiens
cagagaugcugaugauaaa

SEQ ID NO: 536561 - RNA, 19 nt, Homo sapiens
ugaaacccuuguauaagua

SEQ ID NO: 536562 - RNA, 19 nt, Homo sapiens
ucugaaagacugugauuua

SEQ ID NO: 536563 - RNA, 19 nt, Homo sapiens
cgaagaaugugggaaagaa

SEQ ID NO: 536564 - RNA, 19 nt, Homo sapiens
ggagcugagugcuagagua

SEQ ID NO: 536565 - RNA, 19 nt, Homo sapiens
gaugacauguaccguaaga

SEQ ID NO: 536566 - RNA, 19 nt, Homo sapiens
gggagacgauuguucauca

SEQ ID NO: 536567 - RNA, 19 nt, Homo sapiens
caaauuugaggacaagaua

SEQ ID NO: 536568 - RNA, 19 nt, Homo sapiens
ugaaugaaacccuuguaua

SEQ ID NO: 536569 - RNA, 19 nt, Homo sapiens
uagaguaggugcagaagug

SEQ ID NO: 536570 - RNA, 19 nt, Homo sapiens
aagaugacauguaccguaa

SEQ ID NO: 536571 - RNA, 19 nt, Homo sapiens
cguaagacuuguacuaugu

SEQ ID NO: 536572 - RNA, 19 nt, Homo sapiens
ugugauaacugcagagaug

SEQ ID NO: 536573 - RNA, 19 nt, Homo sapiens
gacaagauaccaaggcaaa

SEQ ID NO: 536574 - RNA, 19 nt, Homo sapiens
aaagcaacaucuucauaga

SEQ ID NO: 536575 - RNA, 19 nt, Homo sapiens
gagccaccucuuaaauuua

SEQ ID NO: 536576 - RNA, 19 nt, Homo sapiens
gaccuguuauggaauuuga

SEQ ID NO: 536577 - RNA, 19 nt, Homo sapiens
ggaaaaggguucaacaaag

SEQ ID NO: 536578 - RNA, 19 nt, Homo sapiens
gaaaaggguucaacaaagg

SEQ ID NO: 536579 - RNA, 19 nt, Homo sapiens
ccuagaagaugacauguac

SEQ ID NO: 536580 - RNA, 19 nt, Homo sapiens
ggaggcauggcuaauguaa

SEQ ID NO: 536581 - RNA, 19 nt, Homo sapiens
gaaugugggaaagaauuua

SEQ ID NO: 536582 - RNA, 19 nt, Homo sapiens
agaagaagaagaacagaaa

SEQ ID NO: 536583 - RNA, 19 nt, Homo sapiens
uuaguucagugaccuguuu

SEQ ID NO: 536584 - RNA, 19 nt, Homo sapiens
ggaggaggcuucauuuuag

SEQ ID NO: 536585 - RNA, 19 nt, Homo sapiens
ggagacgauuguucaucaa

SEQ ID NO: 536586 - RNA, 19 nt, Homo sapiens
ggaagaagaagaagaacag

SEQ ID NO: 536587 - RNA, 19 nt, Homo sapiens
ccuaauagcagaaauaaac

SEQ ID NO: 536588 - RNA, 19 nt, Homo sapiens
gaaacccuuguauaaguaa

SEQ ID NO: 536589 - RNA, 19 nt, Homo sapiens
caagaagcauuagaagaag

SEQ ID NO: 536590 - RNA, 19 nt, Homo sapiens
aacacaagcuuauaaccaa

SEQ ID NO: 536591 - RNA, 19 nt, Homo sapiens
ugaagaagaauccacauca

SEQ ID NO: 536592 - RNA, 19 nt, Homo sapiens
aacaaaggcugaacuggau

SEQ ID NO: 536593 - RNA, 19 nt, Homo sapiens
caaggcaaacccuagauug

SEQ ID NO: 536594 - RNA, 19 nt, Homo sapiens
gcuacaaauuugaggacaa

SEQ ID NO: 536595 - RNA, 19 nt, Homo sapiens
gaagaaaaccuagaagaug

SEQ ID NO: 536596 - RNA, 19 nt, Homo sapiens
cugcagagaugcugaugau

SEQ ID NO: 536597 - RNA, 19 nt, Homo sapiens
gcagaaauaaacauugagu

SEQ ID NO: 536598 - RNA, 19 nt, Homo sapiens
aaaagcagccccaaagaua

SEQ ID NO: 536599 - RNA, 19 nt, Homo sapiens
acacaagcuuauaaccaaa

SEQ ID NO: 536600 - RNA, 19 nt, Homo sapiens
gaagaaugugggaaagaau

SEQ ID NO: 536601 - RNA, 19 nt, Homo sapiens
uguaauaugcgaagaaugu

SEQ ID NO: 536602 - RNA, 19 nt, Homo sapiens
gaagaagaacagaaaauug

SEQ ID NO: 536603 - RNA, 19 nt, Homo sapiens
ucagugaccuguuuuauag

SEQ ID NO: 536604 - RNA, 19 nt, Homo sapiens
ugaaagacugugauuuaga

SEQ ID NO: 536605 - RNA, 19 nt, Homo sapiens
ugaacuggauucuuaacca

SEQ ID NO: 536606 - RNA, 19 nt, Homo sapiens
aagaaaaccuagaagauga

SEQ ID NO: 536607 - RNA, 19 nt, Homo sapiens
agaggaagaagaagaagaa

SEQ ID NO: 536608 - RNA, 19 nt, Homo sapiens
gcccuaauagcagaaauaa

SEQ ID NO: 536609 - RNA, 19 nt, Homo sapiens
gcugagugcuagaguaggu

SEQ ID NO: 536610 - RNA, 19 nt, Homo sapiens
gagcugagugcuagaguag

SEQ ID NO: 536611 - RNA, 19 nt, Homo sapiens
augaaacccuuguauaagu

SEQ ID NO: 536612 - RNA, 19 nt, Homo sapiens
aaaccuagaagaugacaug

SEQ ID NO: 536613 - RNA, 19 nt, Homo sapiens
aaagggagacgauuguuca

SEQ ID NO: 536614 - RNA, 19 nt, Homo sapiens
aagaagaauccacaucauu

SEQ ID NO: 536615 - RNA, 19 nt, Homo sapiens
gauuugccaacuugugaua

SEQ ID NO: 536616 - RNA, 19 nt, Homo sapiens
agaagaggaagaagaagaa

SEQ ID NO: 536617 - RNA, 19 nt, Homo sapiens
gaguauggaccagaagaaa

SEQ ID NO: 536618 - RNA, 19 nt, Homo sapiens
gagaugcugaugauaaaca

SEQ ID NO: 536619 - RNA, 19 nt, Homo sapiens
cuacaaauuugaggacaag

SEQ ID NO: 536620 - RNA, 19 nt, Homo sapiens
gaugaaugaaacccuugua

SEQ ID NO: 536621 - RNA, 19 nt, Homo sapiens
ccguaagacuuguacuaug

SEQ ID NO: 536622 - RNA, 19 nt, Homo sapiens
aaaggaaguccgacaggaa

SEQ ID NO: 536623 - RNA, 19 nt, Homo sapiens
acaauggggugauaugaaa

SEQ ID NO: 536624 - RNA, 19 nt, Homo sapiens
uagaagaggaagaagaaga

SEQ ID NO: 536625 - RNA, 19 nt, Homo sapiens
agccaccucuuaaauuuau

SEQ ID NO: 536626 - RNA, 19 nt, Homo sapiens
gaagaagaagaagaacaga

SEQ ID NO: 536627 - RNA, 19 nt, Homo sapiens
uaugaaccacuuugauuug

SEQ ID NO: 536628 - RNA, 19 nt, Homo sapiens
ccaaggcaaacccuagauu

SEQ ID NO: 536629 - RNA, 19 nt, Homo sapiens
caugaacugacauaugaaa

SEQ ID NO: 536630 - RNA, 19 nt, Homo sapiens
cugaaagacugugauuuag

SEQ ID NO: 536631 - RNA, 19 nt, Homo sapiens
aaacacaagcuuauaacca

SEQ ID NO: 536632 - RNA, 19 nt, Homo sapiens
cuuaugaaccacuuugauu

SEQ ID NO: 536633 - RNA, 19 nt, Homo sapiens
gggaaaaggguucaacaaa

SEQ ID NO: 536634 - RNA, 19 nt, Homo sapiens
gucugugauugccuucuua

SEQ ID NO: 536635 - RNA, 19 nt, Homo sapiens
aggcauggcuaauguaaaa

SEQ ID NO: 536636 - RNA, 19 nt, Homo sapiens
ggccaugaacugacauaug

SEQ ID NO: 536637 - RNA, 19 nt, Homo sapiens
uaagacuuguacuaugugu

SEQ ID NO: 536638 - RNA, 19 nt, Homo sapiens
uaagaagcagcguguggaa

SEQ ID NO: 536639 - RNA, 19 nt, Homo sapiens
agaaugugggaaagaauuu

SEQ ID NO: 536640 - RNA, 19 nt, Homo sapiens
cacaggaggaggcuucauu

SEQ ID NO: 536641 - RNA, 19 nt, Homo sapiens
acaggaggaggcuucauuu

SEQ ID NO: 536642 - RNA, 19 nt, Homo sapiens
gaacagaaaauuggaaaag

SEQ ID NO: 536643 - RNA, 19 nt, Homo sapiens
ggguagucaagaagcauua

SEQ ID NO: 536644 - RNA, 19 nt, Homo sapiens
caaaacagaggcaaaacaa

SEQ ID NO: 536645 - RNA, 19 nt, Homo sapiens
acauguaccguaagacuug

SEQ ID NO: 536646 - RNA, 19 nt, Homo sapiens
acaugaguauggaccagaa

SEQ ID NO: 536647 - RNA, 19 nt, Homo sapiens
aagaaugugggaaagaauu

SEQ ID NO: 536648 - RNA, 19 nt, Homo sapiens
cgauuucugucuccacgau

SEQ ID NO: 536649 - RNA, 19 nt, Homo sapiens
gaagaagaagaacagaaaa

SEQ ID NO: 536650 - RNA, 19 nt, Homo sapiens
gaaaggagauuugcuauuu

SEQ ID NO: 536651 - RNA, 19 nt, Homo sapiens
gcaaauggcuucuaucgaa

SEQ ID NO: 536652 - RNA, 19 nt, Homo sapiens
gaaagaagacuuggaguuu

SEQ ID NO: 536653 - RNA, 19 nt, Homo sapiens
ggagggcgaugaaacguuu

SEQ ID NO: 536654 - RNA, 19 nt, Homo sapiens
caagauaaccugcagacua

SEQ ID NO: 536655 - RNA, 19 nt, Homo sapiens
ggaagagguugaagaacuu

SEQ ID NO: 536656 - RNA, 19 nt, Homo sapiens
gagguggacucucuucuga

SEQ ID NO: 536657 - RNA, 19 nt, Homo sapiens
ggaggaggaugccuuugaa

SEQ ID NO: 536658 - RNA, 19 nt, Homo sapiens
gaccagcucucaagcagaa

SEQ ID NO: 536659 - RNA, 19 nt, Homo sapiens
guccauauauucuuacuga

SEQ ID NO: 536660 - RNA, 19 nt, Homo sapiens
caaggugacuguuaaaucu

SEQ ID NO: 536661 - RNA, 19 nt, Homo sapiens
gaagcggcaucuccugaaa

SEQ ID NO: 536662 - RNA, 19 nt, Homo sapiens
gcaaaggaaccaaacaaga

SEQ ID NO: 536663 - RNA, 19 nt, Homo sapiens
gaacugcgcagccagaaau

SEQ ID NO: 536664 - RNA, 19 nt, Homo sapiens
ggaaguugcuggccaaagg

SEQ ID NO: 536665 - RNA, 19 nt, Homo sapiens
cgagacagcugccauccuu

SEQ ID NO: 536666 - RNA, 19 nt, Homo sapiens
gccagccucugaccuguua

SEQ ID NO: 536667 - RNA, 19 nt, Homo sapiens
caaauggcuucuaucgaaa

SEQ ID NO: 536668 - RNA, 19 nt, Homo sapiens
gaugaggaauugguccaua

SEQ ID NO: 536669 - RNA, 19 nt, Homo sapiens
gggaagagguugaagaacu

SEQ ID NO: 536670 - RNA, 19 nt, Homo sapiens
auaaagcucucuguacuaa

SEQ ID NO: 536671 - RNA, 19 nt, Homo sapiens
guauaaagcucucuguacu

SEQ ID NO: 536672 - RNA, 19 nt, Homo sapiens
ggaacgaguuugggaaugu

SEQ ID NO: 536673 - RNA, 19 nt, Homo sapiens
ucucaaaccuggugaagug

SEQ ID NO: 536674 - RNA, 19 nt, Homo sapiens
caaacaagaggaaaccuuu

SEQ ID NO: 536675 - RNA, 19 nt, Homo sapiens
gcuagcaaauggcuucuau

SEQ ID NO: 536676 - RNA, 19 nt, Homo sapiens
gaggaugccuuugaagaug

SEQ ID NO: 536677 - RNA, 19 nt, Homo sapiens
ggugaggcuuggagaagua

SEQ ID NO: 536678 - RNA, 19 nt, Homo sapiens
gaaauaugaggccaucuau

SEQ ID NO: 536679 - RNA, 19 nt, Homo sapiens
ccaaagaccagcaaaggaa

SEQ ID NO: 536680 - RNA, 19 nt, Homo sapiens
ggcuagagguguucuguga

SEQ ID NO: 536681 - RNA, 19 nt, Homo sapiens
aagcauagcugguauagac

SEQ ID NO: 536682 - RNA, 19 nt, Homo sapiens
ccuccagggugucuuauaa

SEQ ID NO: 536683 - RNA, 19 nt, Homo sapiens
gaaugaagacagcaaugaa

SEQ ID NO: 536684 - RNA, 19 nt, Homo sapiens
gagauuugcuauuuacucu

SEQ ID NO: 536685 - RNA, 19 nt, Homo sapiens
ggaaaggagauuugcuauu

SEQ ID NO: 536686 - RNA, 19 nt, Homo sapiens
ccaccaagcccaugaccua

SEQ ID NO: 536687 - RNA, 19 nt, Homo sapiens
gaacaagggaggcagaaag

SEQ ID NO: 536688 - RNA, 19 nt, Homo sapiens
gaagaggaagaaagugaaa

SEQ ID NO: 536689 - RNA, 19 nt, Homo sapiens
gggcuaccaugaaugaaga

SEQ ID NO: 536690 - RNA, 19 nt, Homo sapiens
gguggacucucuucugaug

SEQ ID NO: 536691 - RNA, 19 nt, Homo sapiens
ggagaaguacccuacaaga

SEQ ID NO: 536692 - RNA, 19 nt, Homo sapiens
ggagaagaaagaagacuug

SEQ ID NO: 536693 - RNA, 19 nt, Homo sapiens
caagggaggcagaaagaaa

SEQ ID NO: 536694 - RNA, 19 nt, Homo sapiens
gaucaguguuaaacuagau

SEQ ID NO: 536695 - RNA, 19 nt, Homo sapiens
gcuauuggccuguccauca

SEQ ID NO: 536696 - RNA, 19 nt, Homo sapiens
gagcugagcgcccacuaga

SEQ ID NO: 536697 - RNA, 19 nt, Homo sapiens
gagcaggcagucauugaaa

SEQ ID NO: 536698 - RNA, 19 nt, Homo sapiens
gaacgaguuugggaaugug

SEQ ID NO: 536699 - RNA, 19 nt, Homo sapiens
ggcaucuccugaaauauga

SEQ ID NO: 536700 - RNA, 19 nt, Homo sapiens
ccucugaccuguuacaagu

SEQ ID NO: 536701 - RNA, 19 nt, Homo sapiens
caaaggaaccaaacaagag

SEQ ID NO: 536702 - RNA, 19 nt, Homo sapiens
gaagagguugaagaacuua

SEQ ID NO: 536703 - RNA, 19 nt, Homo sapiens
ggaagaaagugaaaaugau

SEQ ID NO: 536704 - RNA, 19 nt, Homo sapiens
ggaggaugccuuugaagau

SEQ ID NO: 536705 - RNA, 19 nt, Homo sapiens
gcuaggagauacucuucug

SEQ ID NO: 536706 - RNA, 19 nt, Homo sapiens
ccaaaggucugcucaucag

SEQ ID NO: 536707 - RNA, 19 nt, Homo sapiens
agaaguacccuacaagaug

SEQ ID NO: 536708 - RNA, 19 nt, Homo sapiens
gagaaguacccuacaagau

SEQ ID NO: 536709 - RNA, 19 nt, Homo sapiens
ugaaauaugaggccaucua

SEQ ID NO: 536710 - RNA, 19 nt, Homo sapiens
uggccaaggugacuguuaa

SEQ ID NO: 536711 - RNA, 19 nt, Homo sapiens
gcagagaaguacaggucau

SEQ ID NO: 536712 - RNA, 19 nt, Homo sapiens
aaagaagacuuggaguuuc

SEQ ID NO: 536713 - RNA, 19 nt, Homo sapiens
aagauaaccugcagacuac

SEQ ID NO: 536714 - RNA, 19 nt, Homo sapiens
gaagacaagagaaagaagu

SEQ ID NO: 536715 - RNA, 19 nt, Homo sapiens
caguggagauagagauuga

SEQ ID NO: 536716 - RNA, 19 nt, Homo sapiens
gcaaugaagaagaggaaga

SEQ ID NO: 536717 - RNA, 19 nt, Homo sapiens
ggaucuaguuuuccaagua

SEQ ID NO: 536718 - RNA, 19 nt, Homo sapiens
ggagagagcagagaaguac

SEQ ID NO: 536719 - RNA, 19 nt, Homo sapiens
ggaagccaccgggagauuu

SEQ ID NO: 536720 - RNA, 19 nt, Homo sapiens
ggaggaggaggaugccuuu

SEQ ID NO: 536721 - RNA, 19 nt, Homo sapiens
aagaagacuuggaguuuca

SEQ ID NO: 536722 - RNA, 19 nt, Homo sapiens
ccaagcccaugaccuaugu

SEQ ID NO: 536723 - RNA, 19 nt, Homo sapiens
ggacaccuacuaccucuca

SEQ ID NO: 536724 - RNA, 19 nt, Homo sapiens
gaucuaguuuuccaaguaa

SEQ ID NO: 536725 - RNA, 19 nt, Homo sapiens
gaccuguucuuuccaucuu

SEQ ID NO: 536726 - RNA, 19 nt, Homo sapiens
aaaccgagaagaugaagaa

SEQ ID NO: 536727 - RNA, 19 nt, Homo sapiens
ccuguucuuuccaucuuua

SEQ ID NO: 536728 - RNA, 19 nt, Homo sapiens
acagaacacuuugcuagga

SEQ ID NO: 536729 - RNA, 19 nt, Homo sapiens
ucaagguuauaaaggauga

SEQ ID NO: 536730 - RNA, 19 nt, Homo sapiens
uaagaaccacccucuguau

SEQ ID NO: 536731 - RNA, 19 nt, Homo sapiens
ggacagggagaagaaagaa

SEQ ID NO: 536732 - RNA, 19 nt, Homo sapiens
aaagaagcauagcugguau

SEQ ID NO: 536733 - RNA, 19 nt, Homo sapiens
gaaccuggcccuccaaagc

SEQ ID NO: 536734 - RNA, 19 nt, Homo sapiens
aggaauugguccauauauu

SEQ ID NO: 536735 - RNA, 19 nt, Homo sapiens
gaucucuucugccugugaa

SEQ ID NO: 536736 - RNA, 19 nt, Homo sapiens
agacagcaaugaagaagag

SEQ ID NO: 536737 - RNA, 19 nt, Homo sapiens
gagucaggcuuacuaaugc

SEQ ID NO: 536738 - RNA, 19 nt, Homo sapiens
ggccaaaggucugcucauc

SEQ ID NO: 536739 - RNA, 19 nt, Homo sapiens
acacguggcugaagaaagc

SEQ ID NO: 536740 - RNA, 19 nt, Homo sapiens
caagaggaaaccuuugcua

SEQ ID NO: 536741 - RNA, 19 nt, Homo sapiens
gaagucagcaacagcaaag

SEQ ID NO: 536742 - RNA, 19 nt, Homo sapiens
ugaagaagaggaagaaagu

SEQ ID NO: 536743 - RNA, 19 nt, Homo sapiens
agcggcaucuccugaaaua

SEQ ID NO: 536744 - RNA, 19 nt, Homo sapiens
gccgagaccuugagaccau

SEQ ID NO: 536745 - RNA, 19 nt, Homo sapiens
guggguauguguagacugu

SEQ ID NO: 536746 - RNA, 19 nt, Homo sapiens
agccagaucugcaugcuau

SEQ ID NO: 536747 - RNA, 19 nt, Homo sapiens
gcuaaaaucaggaaagaaa

SEQ ID NO: 536748 - RNA, 19 nt, Homo sapiens
ugagucaggcuuacuaaug

SEQ ID NO: 536749 - RNA, 19 nt, Homo sapiens
caacagcaaagggaaagaa

SEQ ID NO: 536750 - RNA, 19 nt, Homo sapiens
gcgacuggcucaacaauua

SEQ ID NO: 536751 - RNA, 19 nt, Homo sapiens
ugacaaagcugaggaguuu

SEQ ID NO: 536752 - RNA, 19 nt, Homo sapiens
gagauugcguggcuauuua

SEQ ID NO: 536753 - RNA, 19 nt, Homo sapiens
gacagcaacuggacacuua

SEQ ID NO: 536754 - RNA, 19 nt, Homo sapiens
gaccugagcuucccaacaa

SEQ ID NO: 536755 - RNA, 19 nt, Homo sapiens
gcacagccaucaucacaga

SEQ ID NO: 536756 - RNA, 19 nt, Homo sapiens
ggagcacaauccaguauuu

SEQ ID NO: 536757 - RNA, 19 nt, Homo sapiens
ggaaggaauugcagaaaca

SEQ ID NO: 536758 - RNA, 19 nt, Homo sapiens
ccaaagcugugaagaauuc

SEQ ID NO: 536759 - RNA, 19 nt, Homo sapiens
gaaagagguucccaaaggu

SEQ ID NO: 536760 - RNA, 19 nt, Homo sapiens
gaucauuccuacagauuau

SEQ ID NO: 536761 - RNA, 19 nt, Homo sapiens
ggagaaagagguucccaaa

SEQ ID NO: 536762 - RNA, 19 nt, Homo sapiens
agaaagagguucccaaagg

SEQ ID NO: 536763 - RNA, 19 nt, Homo sapiens
uuaacuggcuggagaaaga

SEQ ID NO: 536764 - RNA, 19 nt, Homo sapiens
gcacgggacuggacauggu

SEQ ID NO: 536765 - RNA, 19 nt, Homo sapiens
gcaccugcuucuugacuug

SEQ ID NO: 536766 - RNA, 19 nt, Homo sapiens
gugaagaccaaguauaauu

SEQ ID NO: 536767 - RNA, 19 nt, Homo sapiens
gcaugauugucacugauga

SEQ ID NO: 536768 - RNA, 19 nt, Homo sapiens
gaagaauucagcugaguca

SEQ ID NO: 536769 - RNA, 19 nt, Homo sapiens
gacaugguguugggucuuu

SEQ ID NO: 536770 - RNA, 19 nt, Homo sapiens
gggauucaggccuagauua

SEQ ID NO: 536771 - RNA, 19 nt, Homo sapiens
gaccaccgcugcuguaugc

SEQ ID NO: 536772 - RNA, 19 nt, Homo sapiens
ggagaaccucguugacaaa

SEQ ID NO: 536773 - RNA, 19 nt, Homo sapiens
ggaagaaaauggccaaagu

SEQ ID NO: 536774 - RNA, 19 nt, Homo sapiens
ggacacaccaacucaggaa

SEQ ID NO: 536775 - RNA, 19 nt, Homo sapiens
ccaagcaaauggacagcaa

SEQ ID NO: 536776 - RNA, 19 nt, Homo sapiens
ucgaguggcucaucagaga

SEQ ID NO: 536777 - RNA, 19 nt, Homo sapiens
cgccaaagcugugaagaau

SEQ ID NO: 536778 - RNA, 19 nt, Homo sapiens
gcaaucauaggacuagaga

SEQ ID NO: 536779 - RNA, 19 nt, Homo sapiens
gcaagccucuccucacacu

SEQ ID NO: 536780 - RNA, 19 nt, Homo sapiens
aaggaaugcuucacauaug

SEQ ID NO: 536781 - RNA, 19 nt, Homo sapiens
cgaucaugcucuucauuga

SEQ ID NO: 536782 - RNA, 19 nt, Homo sapiens
caucagagugaguauauug

SEQ ID NO: 536783 - RNA, 19 nt, Homo sapiens
cuccaaaggugacuucaga

SEQ ID NO: 536784 - RNA, 19 nt, Homo sapiens
agaggaacgucaugugguu

SEQ ID NO: 536785 - RNA, 19 nt, Homo sapiens
gggaaggaauugcagaaac

SEQ ID NO: 536786 - RNA, 19 nt, Homo sapiens
gcaacuggacacuuaugaa

SEQ ID NO: 536787 - RNA, 19 nt, Homo sapiens
ugauagauguggauucucu

SEQ ID NO: 536788 - RNA, 19 nt, Homo sapiens
cuuugaaccucuaacauug

SEQ ID NO: 536789 - RNA, 19 nt, Homo sapiens
gcaacaggcagacuuugug

SEQ ID NO: 536790 - RNA, 19 nt, Homo sapiens
ucugugaacucuuuaacug

SEQ ID NO: 536791 - RNA, 19 nt, Homo sapiens
uggauucucuuacagacaa

SEQ ID NO: 536792 - RNA, 19 nt, Homo sapiens
gauccaggccuacaucauc

SEQ ID NO: 536793 - RNA, 19 nt, Homo sapiens
ugacucgggugcucaauac

SEQ ID NO: 536794 - RNA, 19 nt, Homo sapiens
gaaccucguugacaaaauc

SEQ ID NO: 536795 - RNA, 19 nt, Homo sapiens
aggagaaccucguugacaa

SEQ ID NO: 536796 - RNA, 19 nt, Homo sapiens
caacuggacacuuaugaag

SEQ ID NO: 536797 - RNA, 19 nt, Homo sapiens
gggcacagccaucaucaca

SEQ ID NO: 536798 - RNA, 19 nt, Homo sapiens
ugagauugcguggcuauuu

SEQ ID NO: 536799 - RNA, 19 nt, Homo sapiens
ucacacugggccuggauua

SEQ ID NO: 536800 - RNA, 19 nt, Homo sapiens
ucccaaagguggugugaca

SEQ ID NO: 536801 - RNA, 19 nt, Homo sapiens
gaaaauggccaaaguucug

SEQ ID NO: 536802 - RNA, 19 nt, Homo sapiens
aagacuggcuggugagugu

SEQ ID NO: 536803 - RNA, 19 nt, Homo sapiens
gcucucgaguggcucauca

SEQ ID NO: 536804 - RNA, 19 nt, Homo sapiens
cauugauggugaccgcaua

SEQ ID NO: 536805 - RNA, 19 nt, Homo sapiens
gagacgaucaugcucuuca

SEQ ID NO: 536806 - RNA, 19 nt, Homo sapiens
ggacagcaacuggacacuu

SEQ ID NO: 536807 - RNA, 19 nt, Homo sapiens
ggggaagccugaccuuuga

SEQ ID NO: 536808 - RNA, 19 nt, Homo sapiens
cugugaagaccaaguauaa

SEQ ID NO: 536809 - RNA, 19 nt, Homo sapiens
ccaaagguggugugacaga

SEQ ID NO: 536810 - RNA, 19 nt, Homo sapiens
cauuaaagaugcuguugcu

SEQ ID NO: 536811 - RNA, 19 nt, Homo sapiens
uugcagaccuucgguugaa

SEQ ID NO: 536812 - RNA, 19 nt, Homo sapiens
gaagaaaauggccaaaguu

SEQ ID NO: 536813 - RNA, 19 nt, Homo sapiens
gggaugugauugggaagga

SEQ ID NO: 536814 - RNA, 19 nt, Homo sapiens
aaugauagauguggauucu

SEQ ID NO: 536815 - RNA, 19 nt, Homo sapiens
ccuuugaaccucuaacauu

SEQ ID NO: 536816 - RNA, 19 nt, Homo sapiens
ugaucauuccuacagauua

SEQ ID NO: 536817 - RNA, 19 nt, Homo sapiens
gaauguuguccuugugguu

SEQ ID NO: 536818 - RNA, 19 nt, Homo sapiens
ugagaauguuguccuugug

SEQ ID NO: 536819 - RNA, 19 nt, Homo sapiens
caggcaugauugucacuga

SEQ ID NO: 536820 - RNA, 19 nt, Homo sapiens
aggaaugcuucacauaugu

SEQ ID NO: 536821 - RNA, 19 nt, Homo sapiens
gcaggcaacaggcagacuu

SEQ ID NO: 536822 - RNA, 19 nt, Homo sapiens
ucauaggacuagagacgau

SEQ ID NO: 536823 - RNA, 19 nt, Homo sapiens
gaagauggggcuuuuggaa

SEQ ID NO: 536824 - RNA, 19 nt, Homo sapiens
ggauucaggccuagauuac

SEQ ID NO: 536825 - RNA, 19 nt, Homo sapiens
ugacgcggacaaugcauuu

SEQ ID NO: 536826 - RNA, 19 nt, Homo sapiens
gagaaagagguucccaaag

SEQ ID NO: 536827 - RNA, 19 nt, Homo sapiens
ccaggugcaucccuacaag

SEQ ID NO: 536828 - RNA, 19 nt, Homo sapiens
gaugagauugcguggcuau

SEQ ID NO: 536829 - RNA, 19 nt, Homo sapiens
ggaugugauugggaaggaa

SEQ ID NO: 536830 - RNA, 19 nt, Homo sapiens
agauguggauucucuuaca

SEQ ID NO: 536831 - RNA, 19 nt, Homo sapiens
gaggcaggcaugauuguca

SEQ ID NO: 536832 - RNA, 19 nt, Homo sapiens
ugagacaagccaugaggaa

SEQ ID NO: 536833 - RNA, 19 nt, Homo sapiens
ggaacgucaugugguuugu

SEQ ID NO: 536834 - RNA, 19 nt, Homo sapiens
gagugcgacuggcucaaca

SEQ ID NO: 536835 - RNA, 19 nt, Homo sapiens
gauguggauucucuuacag

SEQ ID NO: 536836 - RNA, 19 nt, Homo sapiens
acuggacacuuaugaagau

SEQ ID NO: 536837 - RNA, 19 nt, Homo sapiens
uugcguggcuauuuaaucu

SEQ ID NO: 536838 - RNA, 19 nt, Homo sapiens
ucacugccuuggaugagau

SEQ ID NO: 536839 - RNA, 19 nt, Homo sapiens
ugaaggacacaccaacuca

SEQ ID NO: 536840 - RNA, 19 nt, Homo sapiens
acaaaacauucucugauga

SEQ ID NO: 536841 - RNA, 19 nt, Homo sapiens
ucuccaggcugccaagcaa

SEQ ID NO: 536842 - RNA, 19 nt, Homo sapiens
auagauguggauucucuua

SEQ ID NO: 536843 - RNA, 19 nt, Homo sapiens
auucaggccuagauuacuu

SEQ ID NO: 536844 - RNA, 19 nt, Homo sapiens
ucaccuucuugacuccuuu

SEQ ID NO: 536845 - RNA, 19 nt, Homo sapiens
cuucacauauguccucaag

SEQ ID NO: 536846 - RNA, 19 nt, Homo sapiens
gaugugacgcggacaaugc

SEQ ID NO: 536847 - RNA, 19 nt, Homo sapiens
ggaccugagcuucccaaca

SEQ ID NO: 536848 - RNA, 19 nt, Homo sapiens
gacaagccaugaggaacuc

SEQ ID NO: 536849 - RNA, 19 nt, Homo sapiens
uugcaagccucuccucaca

SEQ ID NO: 536850 - RNA, 19 nt, Homo sapiens
gcgacuggcucaacaauua

SEQ ID NO: 536851 - RNA, 19 nt, Homo sapiens
ugacaaagcugaggaguuu

SEQ ID NO: 536852 - RNA, 19 nt, Homo sapiens
gagauugcguggcuauuua

SEQ ID NO: 536853 - RNA, 19 nt, Homo sapiens
gacagcaacuggacacuua

SEQ ID NO: 536854 - RNA, 19 nt, Homo sapiens
gaccugagcuucccaacaa

SEQ ID NO: 536855 - RNA, 19 nt, Homo sapiens
gcacagccaucaucacaga

SEQ ID NO: 536856 - RNA, 19 nt, Homo sapiens
gagaacaagccaagaauaa

SEQ ID NO: 536857 - RNA, 19 nt, Homo sapiens
ggagcacaauccaguauuu

SEQ ID NO: 536858 - RNA, 19 nt, Homo sapiens
ggaaggaauugcagaaaca

SEQ ID NO: 536859 - RNA, 19 nt, Homo sapiens
ccaaagcugugaagaauuc

SEQ ID NO: 536860 - RNA, 19 nt, Homo sapiens
gaaagagguucccaaaggu

SEQ ID NO: 536861 - RNA, 19 nt, Homo sapiens
gaucauuccuacagauuau

SEQ ID NO: 536862 - RNA, 19 nt, Homo sapiens
ggaaacagacggcagaaug

SEQ ID NO: 536863 - RNA, 19 nt, Homo sapiens
gcucaugagacuauauuua

SEQ ID NO: 536864 - RNA, 19 nt, Homo sapiens
ggagaaagagguucccaaa

SEQ ID NO: 536865 - RNA, 19 nt, Homo sapiens
agaaagagguucccaaagg

SEQ ID NO: 536866 - RNA, 19 nt, Homo sapiens
uuaacuggcuggagaaaga

SEQ ID NO: 536867 - RNA, 19 nt, Homo sapiens
gcacgggacuggacauggu

SEQ ID NO: 536868 - RNA, 19 nt, Homo sapiens
gcaccugcuucuugacuug

SEQ ID NO: 536869 - RNA, 19 nt, Homo sapiens
gugaagaccaaguauaauu

SEQ ID NO: 536870 - RNA, 19 nt, Homo sapiens
cgacuucuuuggccaguga

SEQ ID NO: 536871 - RNA, 19 nt, Homo sapiens
gaacaagccaagaauaaaa

SEQ ID NO: 536872 - RNA, 19 nt, Homo sapiens
gcaugauugucacugauga

SEQ ID NO: 536873 - RNA, 19 nt, Homo sapiens
gaagaauucagcugaguca

SEQ ID NO: 536874 - RNA, 19 nt, Homo sapiens
uaaaauugcugcaccagaa

SEQ ID NO: 536875 - RNA, 19 nt, Homo sapiens
gacaugguguugggucuuu

SEQ ID NO: 536876 - RNA, 19 nt, Homo sapiens
gggauucaggccuagauua

SEQ ID NO: 536877 - RNA, 19 nt, Homo sapiens
gaccaccgcugcuguaugc

SEQ ID NO: 536878 - RNA, 19 nt, Homo sapiens
ggagaaccucguugacaaa

SEQ ID NO: 536879 - RNA, 19 nt, Homo sapiens
ggaagaaaauggccaaagu

SEQ ID NO: 536880 - RNA, 19 nt, Homo sapiens
ggacacaccaacucaggaa

SEQ ID NO: 536881 - RNA, 19 nt, Homo sapiens
ccaagcaaauggacagcaa

SEQ ID NO: 536882 - RNA, 19 nt, Homo sapiens
ucgaguggcucaucagaga

SEQ ID NO: 536883 - RNA, 19 nt, Homo sapiens
cgccaaagcugugaagaau

SEQ ID NO: 536884 - RNA, 19 nt, Homo sapiens
gcaaucauaggacuagaga

SEQ ID NO: 536885 - RNA, 19 nt, Homo sapiens
gcagaaugccuccaaaggu

SEQ ID NO: 536886 - RNA, 19 nt, Homo sapiens
gcaagccucuccucacacu

SEQ ID NO: 536887 - RNA, 19 nt, Homo sapiens
ucuccaaacagcauuaaua

SEQ ID NO: 536888 - RNA, 19 nt, Homo sapiens
aaggaaugcuucacauaug

SEQ ID NO: 536889 - RNA, 19 nt, Homo sapiens
gaauggcagccuccagaaa

SEQ ID NO: 536890 - RNA, 19 nt, Homo sapiens
cgaucaugcucuucauuga

SEQ ID NO: 536891 - RNA, 19 nt, Homo sapiens
caucagagugaguauauug

SEQ ID NO: 536892 - RNA, 19 nt, Homo sapiens
ugagaacaagccaagaaua

SEQ ID NO: 536893 - RNA, 19 nt, Homo sapiens
cuccaaaggugacuucaga

SEQ ID NO: 536894 - RNA, 19 nt, Homo sapiens
agaggaacgucaugugguu

SEQ ID NO: 536895 - RNA, 19 nt, Homo sapiens
gggaaggaauugcagaaac

SEQ ID NO: 536896 - RNA, 19 nt, Homo sapiens
gcaacuggacacuuaugaa

SEQ ID NO: 536897 - RNA, 19 nt, Homo sapiens
ugauagauguggauucucu

SEQ ID NO: 536898 - RNA, 19 nt, Homo sapiens
cuuugaaccucuaacauug

SEQ ID NO: 536899 - RNA, 19 nt, Homo sapiens
gcaacaggcagacuuugug

SEQ ID NO: 536900 - RNA, 19 nt, Homo sapiens
ucugugaacucuuuaacug

SEQ ID NO: 536901 - RNA, 19 nt, Homo sapiens
agaaagccaccgcgaguaa

SEQ ID NO: 536902 - RNA, 19 nt, Homo sapiens
gaacacuuggugaaaggaa

SEQ ID NO: 536903 - RNA, 19 nt, Homo sapiens
uggauucucuuacagacaa

SEQ ID NO: 536904 - RNA, 19 nt, Homo sapiens
gauccaggccuacaucauc

SEQ ID NO: 536905 - RNA, 19 nt, Homo sapiens
ggaagaaacguggcagauc

SEQ ID NO: 536906 - RNA, 19 nt, Homo sapiens
auaaauaccuccccgguuu

SEQ ID NO: 536907 - RNA, 19 nt, Homo sapiens
ugacucgggugcucaauac

SEQ ID NO: 536908 - RNA, 19 nt, Homo sapiens
gaaccucguugacaaaauc

SEQ ID NO: 536909 - RNA, 19 nt, Homo sapiens
gaaacagacggcagaaugc

SEQ ID NO: 536910 - RNA, 19 nt, Homo sapiens
aggagaaccucguugacaa

SEQ ID NO: 536911 - RNA, 19 nt, Homo sapiens
caacuggacacuuaugaag

SEQ ID NO: 536912 - RNA, 19 nt, Homo sapiens
ugagauugcguggcuauuu

SEQ ID NO: 536913 - RNA, 19 nt, Homo sapiens
ucacacugggccuggauua

SEQ ID NO: 536914 - RNA, 19 nt, Homo sapiens
gggcacagccaucaucaca

SEQ ID NO: 536915 - RNA, 19 nt, Homo sapiens
cuccaaacagcauuaauaa

SEQ ID NO: 536916 - RNA, 19 nt, Homo sapiens
ucccaaagguggugugaca

SEQ ID NO: 536917 - RNA, 19 nt, Homo sapiens
gaaaauggccaaaguucug

SEQ ID NO: 536918 - RNA, 19 nt, Homo sapiens
aagacuggcuggugagugu

SEQ ID NO: 536919 - RNA, 19 nt, Homo sapiens
guaaaaugcucuggaggaa

SEQ ID NO: 536920 - RNA, 19 nt, Homo sapiens
gcucucgaguggcucauca

SEQ ID NO: 536921 - RNA, 19 nt, Homo sapiens
cauugauggugaccgcaua

SEQ ID NO: 536922 - RNA, 19 nt, Homo sapiens
gagacgaucaugcucuuca

SEQ ID NO: 536923 - RNA, 19 nt, Homo sapiens
ggacagcaacuggacacuu

SEQ ID NO: 536924 - RNA, 19 nt, Homo sapiens
agaacaagccaagaauaaa

SEQ ID NO: 536925 - RNA, 19 nt, Homo sapiens
guugagaacaagccaagaa

SEQ ID NO: 536926 - RNA, 19 nt, Homo sapiens
ggggaagccugaccuuuga

SEQ ID NO: 536927 - RNA, 19 nt, Homo sapiens
cugugaagaccaaguauaa

SEQ ID NO: 536928 - RNA, 19 nt, Homo sapiens
ccaaagguggugugacaga

SEQ ID NO: 536929 - RNA, 19 nt, Homo sapiens
cauuaaagaugcuguugcu

SEQ ID NO: 536930 - RNA, 19 nt, Homo sapiens
uugcagaccuucgguugaa

SEQ ID NO: 536931 - RNA, 19 nt, Homo sapiens
gaagaaaauggccaaaguu

SEQ ID NO: 536932 - RNA, 19 nt, Homo sapiens
gggaugugauugggaagga

SEQ ID NO: 536933 - RNA, 19 nt, Homo sapiens
aaugauagauguggauucu

SEQ ID NO: 536934 - RNA, 19 nt, Homo sapiens
ccuuugaaccucuaacauu

SEQ ID NO: 536935 - RNA, 19 nt, Homo sapiens
ugaucauuccuacagauua

SEQ ID NO: 536936 - RNA, 19 nt, Homo sapiens
uuaaugcucaugagacuau

SEQ ID NO: 536937 - RNA, 19 nt, Homo sapiens
gaauguuguccuugugguu

SEQ ID NO: 536938 - RNA, 19 nt, Homo sapiens
ugagaauguuguccuugug

SEQ ID NO: 536939 - RNA, 19 nt, Homo sapiens
caggcaugauugucacuga

SEQ ID NO: 536940 - RNA, 19 nt, Homo sapiens
aggaaugcuucacauaugu

SEQ ID NO: 536941 - RNA, 19 nt, Homo sapiens
gcaggcaacaggcagacuu

SEQ ID NO: 536942 - RNA, 19 nt, Homo sapiens
ucauaggacuagagacgau

SEQ ID NO: 536943 - RNA, 19 nt, Homo sapiens
guugaacacuuggugaaag

SEQ ID NO: 536944 - RNA, 19 nt, Homo sapiens
gaagauggggcuuuuggaa

SEQ ID NO: 536945 - RNA, 19 nt, Homo sapiens
ggauucaggccuagauuac

SEQ ID NO: 536946 - RNA, 19 nt, Homo sapiens
ugacgcggacaaugcauuu

SEQ ID NO: 536947 - RNA, 19 nt, Homo sapiens
gagaaagagguucccaaag

SEQ ID NO: 536948 - RNA, 19 nt, Homo sapiens
ccaggugcaucccuacaag

SEQ ID NO: 536949 - RNA, 19 nt, Homo sapiens
gaugagauugcguggcuau

SEQ ID NO: 536950 - RNA, 19 nt, Homo sapiens
gaauuuggcuguggaguaa

SEQ ID NO: 536951 - RNA, 19 nt, Homo sapiens
gaacugcaguggugacuau

SEQ ID NO: 536952 - RNA, 19 nt, Homo sapiens
ggaaaggccugaaggaaca

SEQ ID NO: 536953 - RNA, 19 nt, Homo sapiens
ggagcuaccugaccuuuga

SEQ ID NO: 536954 - RNA, 19 nt, Homo sapiens
gcuccagacucuccuguua

SEQ ID NO: 536955 - RNA, 19 nt, Homo sapiens
cuauaaggauggagaauuu

SEQ ID NO: 536956 - RNA, 19 nt, Homo sapiens
gggagaaacucgugacaga

SEQ ID NO: 536957 - RNA, 19 nt, Homo sapiens
gaggagcccuuugaacuuu

SEQ ID NO: 536958 - RNA, 19 nt, Homo sapiens
gcaaacaagagucgcuuua

SEQ ID NO: 536959 - RNA, 19 nt, Homo sapiens
gcacagaugcucacaugaa

SEQ ID NO: 536960 - RNA, 19 nt, Homo sapiens
gggcagagaucguggacaa

SEQ ID NO: 536961 - RNA, 19 nt, Homo sapiens
gaaaccaucucugcuagug

SEQ ID NO: 536962 - RNA, 19 nt, Homo sapiens
ggccuaaccuauaaccuaa

SEQ ID NO: 536963 - RNA, 19 nt, Homo sapiens
gaaguuggcaccacuccua

SEQ ID NO: 536964 - RNA, 19 nt, Homo sapiens
ccaaacgccuccuucuuga

SEQ ID NO: 536965 - RNA, 19 nt, Homo sapiens
gcaaauggacuguaauugg

SEQ ID NO: 536966 - RNA, 19 nt, Homo sapiens
ggaauuuggcuguggagua

SEQ ID NO: 536967 - RNA, 19 nt, Homo sapiens
gaagccagaugcagaagca

SEQ ID NO: 536968 - RNA, 19 nt, Homo sapiens
guaauugggagcuccauaa

SEQ ID NO: 536969 - RNA, 19 nt, Homo sapiens
caaauuugguugggaguug

SEQ ID NO: 536970 - RNA, 19 nt, Homo sapiens
gaggcaguguggaauauga

SEQ ID NO: 536971 - RNA, 19 nt, Homo sapiens
cagagggaguuaagccaua

SEQ ID NO: 536972 - RNA, 19 nt, Homo sapiens
cagcuagucucuucucuuc

SEQ ID NO: 536973 - RNA, 19 nt, Homo sapiens
gaaauaggaaagccagcua

SEQ ID NO: 536974 - RNA, 19 nt, Homo sapiens
ugggaucuaugaaaugaua

SEQ ID NO: 536975 - RNA, 19 nt, Homo sapiens
gaguuaagccauaggaauu

SEQ ID NO: 536976 - RNA, 19 nt, Homo sapiens
ggaaacacagggcuucuug

SEQ ID NO: 536977 - RNA, 19 nt, Homo sapiens
cuagaaaccuuugcauuca

SEQ ID NO: 536978 - RNA, 19 nt, Homo sapiens
gggaugcuggucucaauua

SEQ ID NO: 536979 - RNA, 19 nt, Homo sapiens
ccuaaggacacacaaauuu

SEQ ID NO: 536980 - RNA, 19 nt, Homo sapiens
ccacagacaucaccagaac

SEQ ID NO: 536981 - RNA, 19 nt, Homo sapiens
cucacagacucuucuauua

SEQ ID NO: 536982 - RNA, 19 nt, Homo sapiens
aaacaaagccccaagaaaa

SEQ ID NO: 536983 - RNA, 19 nt, Homo sapiens
agauguggcucucguggua

SEQ ID NO: 536984 - RNA, 19 nt, Homo sapiens
ccaagggcauguucacuuc

SEQ ID NO: 536985 - RNA, 19 nt, Homo sapiens
gccaaacgccuccuucuug

SEQ ID NO: 536986 - RNA, 19 nt, Homo sapiens
ucuauuagguuguuugcaa

SEQ ID NO: 536987 - RNA, 19 nt, Homo sapiens
gcucacagacucuucuauu

SEQ ID NO: 536988 - RNA, 19 nt, Homo sapiens
uaaaacagccuaacaaaga

SEQ ID NO: 536989 - RNA, 19 nt, Homo sapiens
gagaggcgugcguggauua

SEQ ID NO: 536990 - RNA, 19 nt, Homo sapiens
ggcaggaugugagaaauug

SEQ ID NO: 536991 - RNA, 19 nt, Homo sapiens
uaugggaucuaugaaauga

SEQ ID NO: 536992 - RNA, 19 nt, Homo sapiens
gaugugaggaucuggauug

SEQ ID NO: 536993 - RNA, 19 nt, Homo sapiens
gcuagucucuucucuucug

SEQ ID NO: 536994 - RNA, 19 nt, Homo sapiens
gagaagaacgugcccaaag

SEQ ID NO: 536995 - RNA, 19 nt, Homo sapiens
gggcauagccagagcuguu

SEQ ID NO: 536996 - RNA, 19 nt, Homo sapiens
ggacaaguuccgaggagaa

SEQ ID NO: 536997 - RNA, 19 nt, Homo sapiens
ggccaccgguuccaaauca

SEQ ID NO: 536998 - RNA, 19 nt, Homo sapiens
cuacaaugcuguuaaaucc

SEQ ID NO: 536999 - RNA, 19 nt, Homo sapiens
uagguuccaugccaaguaa

SEQ ID NO: 537000 - RNA, 19 nt, Homo sapiens
ccaaaacccuccaaaacaa

SEQ ID NO: 537001 - RNA, 19 nt, Homo sapiens
ccagugacauccccuauaa

SEQ ID NO: 537002 - RNA, 19 nt, Homo sapiens
ggaguuaagccauaggaau

SEQ ID NO: 537003 - RNA, 19 nt, Homo sapiens
gggaccagcuauaccaugu

SEQ ID NO: 537004 - RNA, 19 nt, Homo sapiens
ggaugcuggucucaauuau

SEQ ID NO: 537005 - RNA, 19 nt, Homo sapiens
gagaaacucgugacagaca

SEQ ID NO: 537006 - RNA, 19 nt, Homo sapiens
uguaugggaucuaugaaau

SEQ ID NO: 537007 - RNA, 19 nt, Homo sapiens
gagacggccuggcucuuca

SEQ ID NO: 537008 - RNA, 19 nt, Homo sapiens
gugcugauaggaaauauug

SEQ ID NO: 537009 - RNA, 19 nt, Homo sapiens
aaagccagcuagucucuuc

SEQ ID NO: 537010 - RNA, 19 nt, Homo sapiens
ccuagaaaccuuugcauuc

SEQ ID NO: 537011 - RNA, 19 nt, Homo sapiens
ccuacacgcugcucacaga

SEQ ID NO: 537012 - RNA, 19 nt, Homo sapiens
ccuuugaagugguaucauu

SEQ ID NO: 537013 - RNA, 19 nt, Homo sapiens
uagaagcaaagaccaagua

SEQ ID NO: 537014 - RNA, 19 nt, Homo sapiens
ccacggcauuggcaacuuc

SEQ ID NO: 537015 - RNA, 19 nt, Homo sapiens
cauccaggccuacucauug

SEQ ID NO: 537016 - RNA, 19 nt, Homo sapiens
ucacagacucuucuauuag

SEQ ID NO: 537017 - RNA, 19 nt, Homo sapiens
ucccagcccucuccucauu

SEQ ID NO: 537018 - RNA, 19 nt, Homo sapiens
ggugaggcaguguggaaua

SEQ ID NO: 537019 - RNA, 19 nt, Homo sapiens
guagguuccaugccaagua

SEQ ID NO: 537020 - RNA, 19 nt, Homo sapiens
gaacccagccagggaugaa

SEQ ID NO: 537021 - RNA, 19 nt, Homo sapiens
guaccugaaucgcuacuac

SEQ ID NO: 537022 - RNA, 19 nt, Homo sapiens
cagagaucguggacaaguu

SEQ ID NO: 537023 - RNA, 19 nt, Homo sapiens
ccaaaggcacaguggauga

SEQ ID NO: 537024 - RNA, 19 nt, Homo sapiens
agaagaacgugcccaaagg

SEQ ID NO: 537025 - RNA, 19 nt, Homo sapiens
gcuacaaugcuguuaaauc

SEQ ID NO: 537026 - RNA, 19 nt, Homo sapiens
gcagaggcgccagcuacua

SEQ ID NO: 537027 - RNA, 19 nt, Homo sapiens
aggcacagaugcucacaug

SEQ ID NO: 537028 - RNA, 19 nt, Homo sapiens
cuaaggacacacaaauuug

SEQ ID NO: 537029 - RNA, 19 nt, Homo sapiens
caaagugcagccacagcua

SEQ ID NO: 537030 - RNA, 19 nt, Homo sapiens
ccggaacccgucacuauuu

SEQ ID NO: 537031 - RNA, 19 nt, Homo sapiens
guuaagccauaggaauuug

SEQ ID NO: 537032 - RNA, 19 nt, Homo sapiens
ucucuucucuucugugauc

SEQ ID NO: 537033 - RNA, 19 nt, Homo sapiens
gagggcaggaugugagaaa

SEQ ID NO: 537034 - RNA, 19 nt, Homo sapiens
ggauccgucucgaagaugu

SEQ ID NO: 537035 - RNA, 19 nt, Homo sapiens
gcagagaucguggacaagu

SEQ ID NO: 537036 - RNA, 19 nt, Homo sapiens
aaacaagagucgcuuuagc

SEQ ID NO: 537037 - RNA, 19 nt, Homo sapiens
gugaggcaguguggaauau

SEQ ID NO: 537038 - RNA, 19 nt, Homo sapiens
ggaaagccagcuagucucu

SEQ ID NO: 537039 - RNA, 19 nt, Homo sapiens
gggcaggaugugagaaauu

SEQ ID NO: 537040 - RNA, 19 nt, Homo sapiens
ggacgggaccacagacauc

SEQ ID NO: 537041 - RNA, 19 nt, Homo sapiens
cuauuagguuguuugcaaa

SEQ ID NO: 537042 - RNA, 19 nt, Homo sapiens
cagcugguguccaucacaa

SEQ ID NO: 537043 - RNA, 19 nt, Homo sapiens
auugggagcuccauaagga

SEQ ID NO: 537044 - RNA, 19 nt, Homo sapiens
cgaggagcccuuugaacuu

SEQ ID NO: 537045 - RNA, 19 nt, Homo sapiens
cagaaucucucagccuaca

SEQ ID NO: 537046 - RNA, 19 nt, Homo sapiens
gcuggcccauugccuagaa

SEQ ID NO: 537047 - RNA, 19 nt, Homo sapiens
cuccugggccucuguguua

SEQ ID NO: 537048 - RNA, 19 nt, Homo sapiens
ggagaagaacgugcccaaa

SEQ ID NO: 537049 - RNA, 19 nt, Homo sapiens
ccaaggcagugaagaacag

SEQ ID NO: 537050 - RNA, 19 nt, Homo sapiens
gaacagaacuucauucaaa

SEQ ID NO: 537051 - RNA, 19 nt, Homo sapiens
gaaagucucugucaaaaua

SEQ ID NO: 537052 - RNA, 19 nt, Homo sapiens
gcaauaggcuccauuagug

SEQ ID NO: 537053 - RNA, 19 nt, Homo sapiens
gaaauacuauggacuacaa

SEQ ID NO: 537054 - RNA, 19 nt, Homo sapiens
gaaauauccuuccauuguu

SEQ ID NO: 537055 - RNA, 19 nt, Homo sapiens
cagagaagcuucacaauca

SEQ ID NO: 537056 - RNA, 19 nt, Homo sapiens
aagaauggcucaagaagua

SEQ ID NO: 537057 - RNA, 19 nt, Homo sapiens
cagaagaaaugugugauua

SEQ ID NO: 537058 - RNA, 19 nt, Homo sapiens
ggaacaugaucaacuuaua

SEQ ID NO: 537059 - RNA, 19 nt, Homo sapiens
gaagugaugccauuuauug

SEQ ID NO: 537060 - RNA, 19 nt, Homo sapiens
ggaaauuucugaagacugu

SEQ ID NO: 537061 - RNA, 19 nt, Homo sapiens
ggauacagauuccauaaau

SEQ ID NO: 537062 - RNA, 19 nt, Homo sapiens
acaaacagaucaaacagua

SEQ ID NO: 537063 - RNA, 19 nt, Homo sapiens
ggaacacaguuaguuauuu

SEQ ID NO: 537064 - RNA, 19 nt, Homo sapiens
ggacaagagucgacacaau

SEQ ID NO: 537065 - RNA, 19 nt, Homo sapiens
gagaagugaugccauuuau

SEQ ID NO: 537066 - RNA, 19 nt, Homo sapiens
gaaagaauaaugacagaga

SEQ ID NO: 537067 - RNA, 19 nt, Homo sapiens
uagauaauguggugaauug

SEQ ID NO: 537068 - RNA, 19 nt, Homo sapiens
gcagaugcuuccuuuaaau

SEQ ID NO: 537069 - RNA, 19 nt, Homo sapiens
uaacccaagucaaaucuaa

SEQ ID NO: 537070 - RNA, 19 nt, Homo sapiens
caaauugcguuguuuaaag

SEQ ID NO: 537071 - RNA, 19 nt, Homo sapiens
ggagaagugaugccauuua

SEQ ID NO: 537072 - RNA, 19 nt, Homo sapiens
caagguccguuuauuaaug

SEQ ID NO: 537073 - RNA, 19 nt, Homo sapiens
guugguaucugaaguagaa

SEQ ID NO: 537074 - RNA, 19 nt, Homo sapiens
cgaaaugucucucugaagu

SEQ ID NO: 537075 - RNA, 19 nt, Homo sapiens
gcaaugaauucucacagau

SEQ ID NO: 537076 - RNA, 19 nt, Homo sapiens
ccuacaagaugcucaagua

SEQ ID NO: 537077 - RNA, 19 nt, Homo sapiens
uaaggaacaugaucaacuu

SEQ ID NO: 537078 - RNA, 19 nt, Homo sapiens
caacuuguguagagaaaga

SEQ ID NO: 537079 - RNA, 19 nt, Homo sapiens
gaaccagugcgaaggaaua

SEQ ID NO: 537080 - RNA, 19 nt, Homo sapiens
uagaauaggcugcaucuuu

SEQ ID NO: 537081 - RNA, 19 nt, Homo sapiens
caaggaacauuuaagagau

SEQ ID NO: 537082 - RNA, 19 nt, Homo sapiens
acaaagcaaccauugauua

SEQ ID NO: 537083 - RNA, 19 nt, Homo sapiens
caagucaaaucuaagcauu

SEQ ID NO: 537084 - RNA, 19 nt, Homo sapiens
gaaguacugacacauuuaa

SEQ ID NO: 537085 - RNA, 19 nt, Homo sapiens
ugaaauauccuuccauugu

SEQ ID NO: 537086 - RNA, 19 nt, Homo sapiens
ggauauggcuugugauacu

SEQ ID NO: 537087 - RNA, 19 nt, Homo sapiens
gaacauagaacgaacuuuu

SEQ ID NO: 537088 - RNA, 19 nt, Homo sapiens
ugacaaugaugcaacuaaa

SEQ ID NO: 537089 - RNA, 19 nt, Homo sapiens
gcaaagaauggcucaagaa

SEQ ID NO: 537090 - RNA, 19 nt, Homo sapiens
gaguguugcucauuuguga

SEQ ID NO: 537091 - RNA, 19 nt, Homo sapiens
agacacuucugauuuguuu

SEQ ID NO: 537092 - RNA, 19 nt, Homo sapiens
ccaaaucuuucuucaggaa

SEQ ID NO: 537093 - RNA, 19 nt, Homo sapiens
gcugaaauaccucaaauau

SEQ ID NO: 537094 - RNA, 19 nt, Homo sapiens
gaaccagaagugcuuagua

SEQ ID NO: 537095 - RNA, 19 nt, Homo sapiens
ggaaggagcaguugguuca

SEQ ID NO: 537096 - RNA, 19 nt, Homo sapiens
ggaaacauugcucagauuu

SEQ ID NO: 537097 - RNA, 19 nt, Homo sapiens
aagaaguacugacacauuu

SEQ ID NO: 537098 - RNA, 19 nt, Homo sapiens
gauacgggcuuacagauac

SEQ ID NO: 537099 - RNA, 19 nt, Homo sapiens
gauggucgcugaaaauuuu

SEQ ID NO: 537100 - RNA, 19 nt, Homo sapiens
uuacucaucuggauuaugu

SEQ ID NO: 537101 - RNA, 19 nt, Homo sapiens
gaacaugaucaacuuauag

SEQ ID NO: 537102 - RNA, 19 nt, Homo sapiens
gaaauccaguuaacaacca

SEQ ID NO: 537103 - RNA, 19 nt, Homo sapiens
ggacauauaacagcugaaa

SEQ ID NO: 537104 - RNA, 19 nt, Homo sapiens
ggacagauaacccaaguca

SEQ ID NO: 537105 - RNA, 19 nt, Homo sapiens
gcaaguaggaccagcgaaa

SEQ ID NO: 537106 - RNA, 19 nt, Homo sapiens
cacaugagauuccagaaga

SEQ ID NO: 537107 - RNA, 19 nt, Homo sapiens
uaagagauuuccuaguuca

SEQ ID NO: 537108 - RNA, 19 nt, Homo sapiens
gaaggauacagauuccaua

SEQ ID NO: 537109 - RNA, 19 nt, Homo sapiens
gacaagagucgacacaauu

SEQ ID NO: 537110 - RNA, 19 nt, Homo sapiens
cagcauaucuuuucuguug

SEQ ID NO: 537111 - RNA, 19 nt, Homo sapiens
acagauaacccaagucaaa

SEQ ID NO: 537112 - RNA, 19 nt, Homo sapiens
gcaggcugaugaagagaaa

SEQ ID NO: 537113 - RNA, 19 nt, Homo sapiens
ugaagaauauccugaacau

SEQ ID NO: 537114 - RNA, 19 nt, Homo sapiens
cagaagugcuuaguacuau

SEQ ID NO: 537115 - RNA, 19 nt, Homo sapiens
aagcaaccauugauuagaa

SEQ ID NO: 537116 - RNA, 19 nt, Homo sapiens
ugagagaauucaugaagga

SEQ ID NO: 537117 - RNA, 19 nt, Homo sapiens
gaaggagcccagcaaagaa

SEQ ID NO: 537118 - RNA, 19 nt, Homo sapiens
caagaaguacugacacauu

SEQ ID NO: 537119 - RNA, 19 nt, Homo sapiens
guacaugauuggugcacaa

SEQ ID NO: 537120 - RNA, 19 nt, Homo sapiens
uaugauccuuguucagaua

SEQ ID NO: 537121 - RNA, 19 nt, Homo sapiens
gaggaguguugcucauuug

SEQ ID NO: 537122 - RNA, 19 nt, Homo sapiens
gcagcaagaucaugugcau

SEQ ID NO: 537123 - RNA, 19 nt, Homo sapiens
ugaaagauccugaaacagu

SEQ ID NO: 537124 - RNA, 19 nt, Homo sapiens
gaauaugagggaaacauug

SEQ ID NO: 537125 - RNA, 19 nt, Homo sapiens
gagaaguugugagagaauu

SEQ ID NO: 537126 - RNA, 19 nt, Homo sapiens
augcaguucucauugauua

SEQ ID NO: 537127 - RNA, 19 nt, Homo sapiens
agaaguaugcgaacuguaa

SEQ ID NO: 537128 - RNA, 19 nt, Homo sapiens
cagaaagaauaaugacaga

SEQ ID NO: 537129 - RNA, 19 nt, Homo sapiens
uggaggcccuucauuauau

SEQ ID NO: 537130 - RNA, 19 nt, Homo sapiens
guuccaauguuucgaaaug

SEQ ID NO: 537131 - RNA, 19 nt, Homo sapiens
caaugaauucucacagaua

SEQ ID NO: 537132 - RNA, 19 nt, Homo sapiens
gguaaucuaugccagcaau

SEQ ID NO: 537133 - RNA, 19 nt, Homo sapiens
aaacaacucuggcuuuuga

SEQ ID NO: 537134 - RNA, 19 nt, Homo sapiens
gcauaucaucccauuguaa

SEQ ID NO: 537135 - RNA, 19 nt, Homo sapiens
ggacugaaucguuugucua

SEQ ID NO: 537136 - RNA, 19 nt, Homo sapiens
acaagaugcucaaguaaag

SEQ ID NO: 537137 - RNA, 19 nt, Homo sapiens
gagaauucaugaaggauac

SEQ ID NO: 537138 - RNA, 19 nt, Homo sapiens
ccaggagacagcuauauuu

SEQ ID NO: 537139 - RNA, 19 nt, Homo sapiens
ccaaauuaaucagcacauu

SEQ ID NO: 537140 - RNA, 19 nt, Homo sapiens
gcaauuaugacaauguuag

SEQ ID NO: 537141 - RNA, 19 nt, Homo sapiens
ucaaggaacauuuaagaga

SEQ ID NO: 537142 - RNA, 19 nt, Homo sapiens
gcagauacgggcuuacaga

SEQ ID NO: 537143 - RNA, 19 nt, Homo sapiens
ucaacagguucauacguuu

SEQ ID NO: 537144 - RNA, 19 nt, Homo sapiens
guacauaguaggucaauac

SEQ ID NO: 537145 - RNA, 19 nt, Homo sapiens
guacagaguggucauggaa

SEQ ID NO: 537146 - RNA, 19 nt, Homo sapiens
cgacuugcguacucaaaug

SEQ ID NO: 537147 - RNA, 19 nt, Homo sapiens
caaauuaaucagcacauug

SEQ ID NO: 537148 - RNA, 19 nt, Homo sapiens
ggauuauagugcugcauug

SEQ ID NO: 537149 - RNA, 19 nt, Homo sapiens
agaauauccugaacauaga

SEQ ID NO: 537150 - RNA, 19 nt, Homo sapiens
gcaagcacuucuuucuuua

SEQ ID NO: 537151 - RNA, 19 nt, Homo sapiens
ggcaagcacuucuuucuuu

SEQ ID NO: 537152 - RNA, 19 nt, Homo sapiens
gcaaugagaagcagaaguu

SEQ ID NO: 537153 - RNA, 19 nt, Homo sapiens
ccaggaagauauagacauu

SEQ ID NO: 537154 - RNA, 19 nt, Homo sapiens
ggaagaggaaguuggauuu

SEQ ID NO: 537155 - RNA, 19 nt, Homo sapiens
ucccugagcucccagauuu

SEQ ID NO: 537156 - RNA, 19 nt, Homo sapiens
ggaaugauggcucagcuuu

SEQ ID NO: 537157 - RNA, 19 nt, Homo sapiens
ccgcaagccugaaguaugu

SEQ ID NO: 537158 - RNA, 19 nt, Homo sapiens
gaacacggacagugaggaa

SEQ ID NO: 537159 - RNA, 19 nt, Homo sapiens
ggagaaggaggagcagaua

SEQ ID NO: 537160 - RNA, 19 nt, Homo sapiens
agaggaaguuggauuugaa

SEQ ID NO: 537161 - RNA, 19 nt, Homo sapiens
gcaagacuaugagguccuu

SEQ ID NO: 537162 - RNA, 19 nt, Homo sapiens
aggaagauauagacauuga

SEQ ID NO: 537163 - RNA, 19 nt, Homo sapiens
acacacacacgaugcauuu

SEQ ID NO: 537164 - RNA, 19 nt, Homo sapiens
gaucuacaguugcaaugag

SEQ ID NO: 537165 - RNA, 19 nt, Homo sapiens
caccagugcuccaggaaga

SEQ ID NO: 537166 - RNA, 19 nt, Homo sapiens
ggacagcacgcaccucauc

SEQ ID NO: 537167 - RNA, 19 nt, Homo sapiens
ggauuugaaccaagaagaa

SEQ ID NO: 537168 - RNA, 19 nt, Homo sapiens
gaagaggaaguuggauuug

SEQ ID NO: 537169 - RNA, 19 nt, Homo sapiens
acacacacgaugcauuuaa

SEQ ID NO: 537170 - RNA, 19 nt, Homo sapiens
aagaggaaguuggauuuga

SEQ ID NO: 537171 - RNA, 19 nt, Homo sapiens
gggaagaggaaguuggauu

SEQ ID NO: 537172 - RNA, 19 nt, Homo sapiens
cccgauggaucuacaguug

SEQ ID NO: 537173 - RNA, 19 nt, Homo sapiens
gaucacagcacaggaaugg

SEQ ID NO: 537174 - RNA, 19 nt, Homo sapiens
gcagccagcccuacagcaa

SEQ ID NO: 537175 - RNA, 19 nt, Homo sapiens
acacacgaugcauuuaaua

SEQ ID NO: 537176 - RNA, 19 nt, Homo sapiens
gauuugaaccaagaagaaa

SEQ ID NO: 537177 - RNA, 19 nt, Homo sapiens
ccaaagggaagaggaaguu

SEQ ID NO: 537178 - RNA, 19 nt, Homo sapiens
cacacgaugcauuuaauaa

SEQ ID NO: 537179 - RNA, 19 nt, Homo sapiens
cacacacgaugcauuuaau

SEQ ID NO: 537180 - RNA, 19 nt, Homo sapiens
gcgaagcccacgacguuga

SEQ ID NO: 537181 - RNA, 19 nt, Homo sapiens
caaugagaagcagaaguua

SEQ ID NO: 537182 - RNA, 19 nt, Homo sapiens
cgauggaucuacaguugca

SEQ ID NO: 537183 - RNA, 19 nt, Homo sapiens
gggcaagcacuucuuucuu

SEQ ID NO: 537184 - RNA, 19 nt, Homo sapiens
ggucaccucaucuuucaug

SEQ ID NO: 537185 - RNA, 19 nt, Homo sapiens
gcucgaggacuauaugagu

SEQ ID NO: 537186 - RNA, 19 nt, Homo sapiens
ugagugaccggguucaguu

SEQ ID NO: 537187 - RNA, 19 nt, Homo sapiens
gaaugauggcucagcuuuc

SEQ ID NO: 537188 - RNA, 19 nt, Homo sapiens
ggcagacacuuaccgaaaa

SEQ ID NO: 537189 - RNA, 19 nt, Homo sapiens
ggagcucgaggacuauaug

SEQ ID NO: 537190 - RNA, 19 nt, Homo sapiens
ccagggcaagcacuucuuu

SEQ ID NO: 537191 - RNA, 19 nt, Homo sapiens
cagaaggacaggacaaugg

SEQ ID NO: 537192 - RNA, 19 nt, Homo sapiens
uggcagagcagaaggaaca

SEQ ID NO: 537193 - RNA, 19 nt, Homo sapiens
ccagugcuccaggaagaua

SEQ ID NO: 537194 - RNA, 19 nt, Homo sapiens
caccucaucugugccuuug

SEQ ID NO: 537195 - RNA, 19 nt, Homo sapiens
ggaucuacaguugcaauga

SEQ ID NO: 537196 - RNA, 19 nt, Homo sapiens
gagcucgaggacuauauga

SEQ ID NO: 537197 - RNA, 19 nt, Homo sapiens
ggaaguuggauuugaacca

SEQ ID NO: 537198 - RNA, 19 nt, Homo sapiens
cuggucaccucaucuuuca

SEQ ID NO: 537199 - RNA, 19 nt, Homo sapiens
agauaaggcccuagagcuu

SEQ ID NO: 537200 - RNA, 19 nt, Homo sapiens
aggcgaagcccacgacguu

SEQ ID NO: 537201 - RNA, 19 nt, Homo sapiens
gcagacacuuaccgaaaau

SEQ ID NO: 537202 - RNA, 19 nt, Homo sapiens
gagugaccggguucaguuu

SEQ ID NO: 537203 - RNA, 19 nt, Homo sapiens
ggaaacucauccgauacgu

SEQ ID NO: 537204 - RNA, 19 nt, Homo sapiens
gaaccaagaagaaaagaag

SEQ ID NO: 537205 - RNA, 19 nt, Homo sapiens
ucgacucacugugcagaaa

SEQ ID NO: 537206 - RNA, 19 nt, Homo sapiens
agaaggaggagcagauaca

SEQ ID NO: 537207 - RNA, 19 nt, Homo sapiens
aggcagacacuuaccgaaa

SEQ ID NO: 537208 - RNA, 19 nt, Homo sapiens
aggaggcccugauggacaa

SEQ ID NO: 537209 - RNA, 19 nt, Homo sapiens
gugaccggguucaguuugu

SEQ ID NO: 537210 - RNA, 19 nt, Homo sapiens
caaguacagccagguccua

SEQ ID NO: 537211 - RNA, 19 nt, Homo sapiens
uaaauugccagcuccaacu

SEQ ID NO: 537212 - RNA, 19 nt, Homo sapiens
gcagccaggacucgacuca

SEQ ID NO: 537213 - RNA, 19 nt, Homo sapiens
gccgcaagccugaaguaug

SEQ ID NO: 537214 - RNA, 19 nt, Homo sapiens
ggaggguggcagagcagaa

SEQ ID NO: 537215 - RNA, 19 nt, Homo sapiens
cagaggagcuggggaagau

SEQ ID NO: 537216 - RNA, 19 nt, Homo sapiens
aaugauggcucagcuuucg

SEQ ID NO: 537217 - RNA, 19 nt, Homo sapiens
gauccuucaggguguggua

SEQ ID NO: 537218 - RNA, 19 nt, Homo sapiens
cgccaucuguucccaagag

SEQ ID NO: 537219 - RNA, 19 nt, Homo sapiens
caaagggaagaggaaguug

SEQ ID NO: 537220 - RNA, 19 nt, Homo sapiens
gugugaaggaggaggauga

SEQ ID NO: 537221 - RNA, 19 nt, Homo sapiens
ccaaagcucugaagaaaua

SEQ ID NO: 537222 - RNA, 19 nt, Homo sapiens
uagagaagcuuguaaauga

SEQ ID NO: 537223 - RNA, 19 nt, Homo sapiens
ggaaguagaagucuuauuu

SEQ ID NO: 537224 - RNA, 19 nt, Homo sapiens
gaaauguucucagugcuua

SEQ ID NO: 537225 - RNA, 19 nt, Homo sapiens
gcaaagauuucaugacgaa

SEQ ID NO: 537226 - RNA, 19 nt, Homo sapiens
ggaacagaauagagaauuu

SEQ ID NO: 537227 - RNA, 19 nt, Homo sapiens
ggaauacuauacagccaua

SEQ ID NO: 537228 - RNA, 19 nt, Homo sapiens
gauaugcuccggcuaguua

SEQ ID NO: 537229 - RNA, 19 nt, Homo sapiens
gaaaugcuuuaucaccuaa

SEQ ID NO: 537230 - RNA, 19 nt, Homo sapiens
gaaacuaucaagagaguaa

SEQ ID NO: 537231 - RNA, 19 nt, Homo sapiens
caagauggauuaaagacuu

SEQ ID NO: 537232 - RNA, 19 nt, Homo sapiens
gagcugagaucgcgccauu

SEQ ID NO: 537233 - RNA, 19 nt, Homo sapiens
ugauacagauuaccacuuu

SEQ ID NO: 537234 - RNA, 19 nt, Homo sapiens
uaaauuaguucagccauug

SEQ ID NO: 537235 - RNA, 19 nt, Homo sapiens
caaaggacaugaacagaca

SEQ ID NO: 537236 - RNA, 19 nt, Homo sapiens
ggcaauggauucucuauuc

SEQ ID NO: 537237 - RNA, 19 nt, Homo sapiens
caaacaagaugauucucaa

SEQ ID NO: 537238 - RNA, 19 nt, Homo sapiens
guauauacccaaaggaaua

SEQ ID NO: 537239 - RNA, 19 nt, Homo sapiens
gcaacgacacaaacuauaa

SEQ ID NO: 537240 - RNA, 19 nt, Homo sapiens
ggacauaggcacaggcaaa

SEQ ID NO: 537241 - RNA, 19 nt, Homo sapiens
gaaguuccuugaaagaaau

SEQ ID NO: 537242 - RNA, 19 nt, Homo sapiens
ggacaugaacagacacuuu

SEQ ID NO: 537243 - RNA, 19 nt, Homo sapiens
acagacagcuuacagaaug

SEQ ID NO: 537244 - RNA, 19 nt, Homo sapiens
gcaauggauucucuauuca

SEQ ID NO: 537245 - RNA, 19 nt, Homo sapiens
gaaauagaaccaaaucugu

SEQ ID NO: 537246 - RNA, 19 nt, Homo sapiens
gaagacaacccaggcagua

SEQ ID NO: 537247 - RNA, 19 nt, Homo sapiens
gaccacacaccuauaauuu

SEQ ID NO: 537248 - RNA, 19 nt, Homo sapiens
caacccagcaaucucauua

SEQ ID NO: 537249 - RNA, 19 nt, Homo sapiens
ucacaaaugggaucuaauu

SEQ ID NO: 537250 - RNA, 19 nt, Homo sapiens
cuacccagcuucaaacuau

SEQ ID NO: 537251 - RNA, 19 nt, Homo sapiens
caccacgccuggcuaauuu

SEQ ID NO: 537252 - RNA, 19 nt, Homo sapiens
gaaaguauguuuuguaguc

SEQ ID NO: 537253 - RNA, 19 nt, Homo sapiens
gagcacagacuaucccaaa

SEQ ID NO: 537254 - RNA, 19 nt, Homo sapiens
gcucaugccugugauccua

SEQ ID NO: 537255 - RNA, 19 nt, Homo sapiens
agacagagauaccauucaa

SEQ ID NO: 537256 - RNA, 19 nt, Homo sapiens
gagguaagaaguaauaaug

SEQ ID NO: 537257 - RNA, 19 nt, Homo sapiens
ucacugaucauuagagaaa

SEQ ID NO: 537258 - RNA, 19 nt, Homo sapiens
cagcaucuauacguaauuu

SEQ ID NO: 537259 - RNA, 19 nt, Homo sapiens
gauaguaaggcaauccuaa

SEQ ID NO: 537260 - RNA, 19 nt, Homo sapiens
acacuuuacucacuagaaa

SEQ ID NO: 537261 - RNA, 19 nt, Homo sapiens
agaaguuccuugaaagaaa

SEQ ID NO: 537262 - RNA, 19 nt, Homo sapiens
guaaggcaauccuaagcaa

SEQ ID NO: 537263 - RNA, 19 nt, Homo sapiens
gauguauacuucccaaauc

SEQ ID NO: 537264 - RNA, 19 nt, Homo sapiens
gguagaaguuccuugaaag

SEQ ID NO: 537265 - RNA, 19 nt, Homo sapiens
ccacuuacuucuuacacuu

SEQ ID NO: 537266 - RNA, 19 nt, Homo sapiens
ucccaaagcucugaagaaa

SEQ ID NO: 537267 - RNA, 19 nt, Homo sapiens
agaaaugcuuuaucaccua

SEQ ID NO: 537268 - RNA, 19 nt, Homo sapiens
ccaccaauauuucuucaca

SEQ ID NO: 537269 - RNA, 19 nt, Homo sapiens
gguaagaaguaauaaugag

SEQ ID NO: 537270 - RNA, 19 nt, Homo sapiens
ugagagguaagaaguaaua

SEQ ID NO: 537271 - RNA, 19 nt, Homo sapiens
ucaaagcagcaaccaauuu

SEQ ID NO: 537272 - RNA, 19 nt, Homo sapiens
caagaugauucucaaagca

SEQ ID NO: 537273 - RNA, 19 nt, Homo sapiens
guccaaauggcuauuauaa

SEQ ID NO: 537274 - RNA, 19 nt, Homo sapiens
ggccaacaauccuauggaa

SEQ ID NO: 537275 - RNA, 19 nt, Homo sapiens
agaguaaacagacagcuua

SEQ ID NO: 537276 - RNA, 19 nt, Homo sapiens
aaacacacguagacugaug

SEQ ID NO: 537277 - RNA, 19 nt, Homo sapiens
caauauuucuucacaaagg

SEQ ID NO: 537278 - RNA, 19 nt, Homo sapiens
guucagccauuguggaaga

SEQ ID NO: 537279 - RNA, 19 nt, Homo sapiens
agacaucuguggccaacaa

SEQ ID NO: 537280 - RNA, 19 nt, Homo sapiens
ggucugaaauccagcaucu

SEQ ID NO: 537281 - RNA, 19 nt, Homo sapiens
guagacugauggaacagaa

SEQ ID NO: 537282 - RNA, 19 nt, Homo sapiens
uuucuaggcuguugaauca

SEQ ID NO: 537283 - RNA, 19 nt, Homo sapiens
cagauuaccacuuugauau

SEQ ID NO: 537284 - RNA, 19 nt, Homo sapiens
ccuaacagcacgauguaua

SEQ ID NO: 537285 - RNA, 19 nt, Homo sapiens
ucucauuacuggguauaua

SEQ ID NO: 537286 - RNA, 19 nt, Homo sapiens
aaacagacagcuuacagaa

SEQ ID NO: 537287 - RNA, 19 nt, Homo sapiens
uggauagccugucagcuuu

SEQ ID NO: 537288 - RNA, 19 nt, Homo sapiens
gaagguggccuggaaguag

SEQ ID NO: 537289 - RNA, 19 nt, Homo sapiens
gaaaccccaucucuauuaa

SEQ ID NO: 537290 - RNA, 19 nt, Homo sapiens
caagggauccuccuaugug

SEQ ID NO: 537291 - RNA, 19 nt, Homo sapiens
aaacuaugcaucugagaaa

SEQ ID NO: 537292 - RNA, 19 nt, Homo sapiens
aaguaaaucugagagguaa

SEQ ID NO: 537293 - RNA, 19 nt, Homo sapiens
cagaauggauuuguuaaac

SEQ ID NO: 537294 - RNA, 19 nt, Homo sapiens
ggaaauguucucagugcuu

SEQ ID NO: 537295 - RNA, 19 nt, Homo sapiens
gaaaugcaaaucgaaacaa

SEQ ID NO: 537296 - RNA, 19 nt, Homo sapiens
gcaguaccauucaggacau

SEQ ID NO: 537297 - RNA, 19 nt, Homo sapiens
aauaaaucgugcugggaua

SEQ ID NO: 537298 - RNA, 19 nt, Homo sapiens
gcauggugauauucuugaa

SEQ ID NO: 537299 - RNA, 19 nt, Homo sapiens
ucugagagguaagaaguaa

SEQ ID NO: 537300 - RNA, 19 nt, Homo sapiens
ggauagaccgcgucaaugg

SEQ ID NO: 537301 - RNA, 19 nt, Homo sapiens
ccaaaggaauagaaaucau

SEQ ID NO: 537302 - RNA, 19 nt, Homo sapiens
guagaaguuccuugaaaga

SEQ ID NO: 537303 - RNA, 19 nt, Homo sapiens
ugagaccacacaccuauaa

SEQ ID NO: 537304 - RNA, 19 nt, Homo sapiens
aaaguaaaucugagaggua

SEQ ID NO: 537305 - RNA, 19 nt, Homo sapiens
uuagagaaaugcaaaucga

SEQ ID NO: 537306 - RNA, 19 nt, Homo sapiens
cacaaacuauaaugcagaa

SEQ ID NO: 537307 - RNA, 19 nt, Homo sapiens
cacaaaugggaucuaauua

SEQ ID NO: 537308 - RNA, 19 nt, Homo sapiens
ggaaaagauugaaaaugga

SEQ ID NO: 537309 - RNA, 19 nt, Homo sapiens
guaaagacuauucuguuuc

SEQ ID NO: 537310 - RNA, 19 nt, Homo sapiens
gugcccagcccuaaaguuu

SEQ ID NO: 537311 - RNA, 19 nt, Homo sapiens
caaacuaugcaucugagaa

SEQ ID NO: 537312 - RNA, 19 nt, Homo sapiens
ccaaagugcuaggauuaca

SEQ ID NO: 537313 - RNA, 19 nt, Homo sapiens
ccaaacaagaugauucuca

SEQ ID NO: 537314 - RNA, 19 nt, Homo sapiens
caacgacacaaacuauaau

SEQ ID NO: 537315 - RNA, 19 nt, Homo sapiens
aauccagcaucuauacgua

SEQ ID NO: 537316 - RNA, 19 nt, Homo sapiens
gggagaaaauuguugcaaa

SEQ ID NO: 537317 - RNA, 19 nt, Homo sapiens
aagaaacuaucaagagagu

SEQ ID NO: 537318 - RNA, 19 nt, Homo sapiens
gaaaauggacgccuuccuu

SEQ ID NO: 537319 - RNA, 19 nt, Homo sapiens
gcauaguacuggcacaaaa

SEQ ID NO: 537320 - RNA, 19 nt, Homo sapiens
gcaucacgcuacccagcuu

SEQ ID NO: 537321 - RNA, 19 nt, Homo sapiens
caacagcccugccugagaa

SEQ ID NO: 537322 - RNA, 19 nt, Homo sapiens
caggagagcugcuucagaa

SEQ ID NO: 537323 - RNA, 19 nt, Homo sapiens
uaagaaagccaaacugaaa

SEQ ID NO: 537324 - RNA, 19 nt, Homo sapiens
gcacagaccaggccuuuga

SEQ ID NO: 537325 - RNA, 19 nt, Homo sapiens
ggaccugaaucccagaauu

SEQ ID NO: 537326 - RNA, 19 nt, Homo sapiens
gaauuugcauccauuguuc

SEQ ID NO: 537327 - RNA, 19 nt, Homo sapiens
gaccugaaucccagaauua

SEQ ID NO: 537328 - RNA, 19 nt, Homo sapiens
gggagacacuuaagggaaa

SEQ ID NO: 537329 - RNA, 19 nt, Homo sapiens
gcugagaacggccuccuua

SEQ ID NO: 537330 - RNA, 19 nt, Homo sapiens
ccacaggcuuugaauugaa

SEQ ID NO: 537331 - RNA, 19 nt, Homo sapiens
gcgagugccucagaauuug

SEQ ID NO: 537332 - RNA, 19 nt, Homo sapiens
cgaagaugguggccacaga

SEQ ID NO: 537333 - RNA, 19 nt, Homo sapiens
ggcgagugccucagaauuu

SEQ ID NO: 537334 - RNA, 19 nt, Homo sapiens
gaugguggccacagacuga

SEQ ID NO: 537335 - RNA, 19 nt, Homo sapiens
gcagccagaucuucaucga

SEQ ID NO: 537336 - RNA, 19 nt, Homo sapiens
gggacugccuugucucuag

SEQ ID NO: 537337 - RNA, 19 nt, Homo sapiens
uggagugugugaauaagaa

SEQ ID NO: 537338 - RNA, 19 nt, Homo sapiens
acacaguucugggcaaaga

SEQ ID NO: 537339 - RNA, 19 nt, Homo sapiens
ggaagcagcauccuuacag

SEQ ID NO: 537340 - RNA, 19 nt, Homo sapiens
aaacugaaaucgguaaagg

SEQ ID NO: 537341 - RNA, 19 nt, Homo sapiens
cauccauuguucugucuuu

SEQ ID NO: 537342 - RNA, 19 nt, Homo sapiens
ggacugccuugucucuagu

SEQ ID NO: 537343 - RNA, 19 nt, Homo sapiens
caagagaugccucagucaa

SEQ ID NO: 537344 - RNA, 19 nt, Homo sapiens
gaacggccuccuuacacuu

SEQ ID NO: 537345 - RNA, 19 nt, Homo sapiens
gaccagacuugaagagacu

SEQ ID NO: 537346 - RNA, 19 nt, Homo sapiens
ccuuacaucuggcuggaaa

SEQ ID NO: 537347 - RNA, 19 nt, Homo sapiens
cugaaucccagaauuauug

SEQ ID NO: 537348 - RNA, 19 nt, Homo sapiens
ggagacacuuaagggaaau

SEQ ID NO: 537349 - RNA, 19 nt, Homo sapiens
aauguucaauggaugcaaa

SEQ ID NO: 537350 - RNA, 19 nt, Homo sapiens
caagguggagaaagcauau

SEQ ID NO: 537351 - RNA, 19 nt, Homo sapiens
gcugggagccugguucaga

SEQ ID NO: 537352 - RNA, 19 nt, Homo sapiens
gcaucaaccaggugacaga

SEQ ID NO: 537353 - RNA, 19 nt, Homo sapiens
ugaagagacugaccaaccu

SEQ ID NO: 537354 - RNA, 19 nt, Homo sapiens
ccucagaauuugcauccau

SEQ ID NO: 537355 - RNA, 19 nt, Homo sapiens
ugccuugucucuaguagug

SEQ ID NO: 537356 - RNA, 19 nt, Homo sapiens
gcgggaggaugugcacaga

SEQ ID NO: 537357 - RNA, 19 nt, Homo sapiens
ucccacaggcuuugaauug

SEQ ID NO: 537358 - RNA, 19 nt, Homo sapiens
uuaagaaagccaaacugaa

SEQ ID NO: 537359 - RNA, 19 nt, Homo sapiens
ggcagcggcuccacuuucu

SEQ ID NO: 537360 - RNA, 19 nt, Homo sapiens
cccacaggcuuugaauuga

SEQ ID NO: 537361 - RNA, 19 nt, Homo sapiens
agaauuugcauccauuguu

SEQ ID NO: 537362 - RNA, 19 nt, Homo sapiens
gcaagagaugccucaguca

SEQ ID NO: 537363 - RNA, 19 nt, Homo sapiens
agagaugccucagucaagu

SEQ ID NO: 537364 - RNA, 19 nt, Homo sapiens
gagaacggccuccuuacac

SEQ ID NO: 537365 - RNA, 19 nt, Homo sapiens
ugagaacggccuccuuaca

SEQ ID NO: 537366 - RNA, 19 nt, Homo sapiens
acaagguggagaaagcaua

SEQ ID NO: 537367 - RNA, 19 nt, Homo sapiens
ggagccgccugcuucuucu

SEQ ID NO: 537368 - RNA, 19 nt, Homo sapiens
ggagccugguucagacaca

SEQ ID NO: 537369 - RNA, 19 nt, Homo sapiens
agacacuuaagggaaauua

SEQ ID NO: 537370 - RNA, 19 nt, Homo sapiens
cucagaauuugcauccauu

SEQ ID NO: 537371 - RNA, 19 nt, Homo sapiens
gcccugugcugugcaucaa

SEQ ID NO: 537372 - RNA, 19 nt, Homo sapiens
ccaggagagcugcuucaga

SEQ ID NO: 537373 - RNA, 19 nt, Homo sapiens
gccaaacugaaaucgguaa

SEQ ID NO: 537374 - RNA, 19 nt, Homo sapiens
gucuggcacuugcugagaa

SEQ ID NO: 537375 - RNA, 19 nt, Homo sapiens
caauuaagaaagccaaacu

SEQ ID NO: 537376 - RNA, 19 nt, Homo sapiens
uguuggagugugugaauaa

SEQ ID NO: 537377 - RNA, 19 nt, Homo sapiens
cgauguggacaccuuguug

SEQ ID NO: 537378 - RNA, 19 nt, Homo sapiens
agaacggccuccuuacacu

SEQ ID NO: 537379 - RNA, 19 nt, Homo sapiens
auuaagaaagccaaacuga

SEQ ID NO: 537380 - RNA, 19 nt, Homo sapiens
ggaaauuaaacugcagagu

SEQ ID NO: 537381 - RNA, 19 nt, Homo sapiens
cagcggcuccacuuucuca

SEQ ID NO: 537382 - RNA, 19 nt, Homo sapiens
cacaggcuuugaauugaag

SEQ ID NO: 537383 - RNA, 19 nt, Homo sapiens
acaacagcccugccugaga

SEQ ID NO: 537384 - RNA, 19 nt, Homo sapiens
gggaagcagcauccuuaca

SEQ ID NO: 537385 - RNA, 19 nt, Homo sapiens
gaaaucgguaaaggagguu

SEQ ID NO: 537386 - RNA, 19 nt, Homo sapiens
ccaagaagcugaugacaug

SEQ ID NO: 537387 - RNA, 19 nt, Homo sapiens
ggagagguauuaagaaaug

SEQ ID NO: 537388 - RNA, 19 nt, Homo sapiens
ggacacauuuaucauauuc

SEQ ID NO: 537389 - RNA, 19 nt, Homo sapiens
gcaaaggacacauuuauca

SEQ ID NO: 537390 - RNA, 19 nt, Homo sapiens
gagcacaucucagcugaaa

SEQ ID NO: 537391 - RNA, 19 nt, Homo sapiens
gaauccaccuuguuucuga

SEQ ID NO: 537392 - RNA, 19 nt, Homo sapiens
aaacccagcugaagucauu

SEQ ID NO: 537393 - RNA, 19 nt, Homo sapiens
gcugauguauacacguuua

SEQ ID NO: 537394 - RNA, 19 nt, Homo sapiens
gaaauauguuggugaacug

SEQ ID NO: 537395 - RNA, 19 nt, Homo sapiens
gauguucacuagacuaugu

SEQ ID NO: 537396 - RNA, 19 nt, Homo sapiens
gagaaucagcuucaagaaa

SEQ ID NO: 537397 - RNA, 19 nt, Homo sapiens
gaagauaccggaaguagag

SEQ ID NO: 537398 - RNA, 19 nt, Homo sapiens
gagauccagucuaugauga

SEQ ID NO: 537399 - RNA, 19 nt, Homo sapiens
ggaaauauguuggugaacu

SEQ ID NO: 537400 - RNA, 19 nt, Homo sapiens
ugaccgagauccagucuau

SEQ ID NO: 537401 - RNA, 19 nt, Homo sapiens
gaaaggcuucugagagauu

SEQ ID NO: 537402 - RNA, 19 nt, Homo sapiens
cagcugaagucauuagaga

SEQ ID NO: 537403 - RNA, 19 nt, Homo sapiens
ccugaaagaugucucauuc

SEQ ID NO: 537404 - RNA, 19 nt, Homo sapiens
gcaugccuauaauuacaua

SEQ ID NO: 537405 - RNA, 19 nt, Homo sapiens
caaaauggauuacacaugu

SEQ ID NO: 537406 - RNA, 19 nt, Homo sapiens
aaaccaaacugaucucucu

SEQ ID NO: 537407 - RNA, 19 nt, Homo sapiens
ggaaaagccugauucuuca

SEQ ID NO: 537408 - RNA, 19 nt, Homo sapiens
gauauugcaccaaguagaa

SEQ ID NO: 537409 - RNA, 19 nt, Homo sapiens
gcaaucuguucugaaauga

SEQ ID NO: 537410 - RNA, 19 nt, Homo sapiens
gaaagaugucucauucaga

SEQ ID NO: 537411 - RNA, 19 nt, Homo sapiens
gaaaacaggacaaagaaaa

SEQ ID NO: 537412 - RNA, 19 nt, Homo sapiens
ugugauagcuguccaacau

SEQ ID NO: 537413 - RNA, 19 nt, Homo sapiens
guacugaugaggaaaguga

SEQ ID NO: 537414 - RNA, 19 nt, Homo sapiens
ggagacugaucuuuauaag

SEQ ID NO: 537415 - RNA, 19 nt, Homo sapiens
gaacccaguauaacucauu

SEQ ID NO: 537416 - RNA, 19 nt, Homo sapiens
cagcaugccuauaauuaca

SEQ ID NO: 537417 - RNA, 19 nt, Homo sapiens
cauacacagugaauugaaa

SEQ ID NO: 537418 - RNA, 19 nt, Homo sapiens
ugagaguacugaugaggaa

SEQ ID NO: 537419 - RNA, 19 nt, Homo sapiens
aaaggagaauuucaaguca

SEQ ID NO: 537420 - RNA, 19 nt, Homo sapiens
gacagcgaaugcaaagaaa

SEQ ID NO: 537421 - RNA, 19 nt, Homo sapiens
ucacggagagguauuaaga

SEQ ID NO: 537422 - RNA, 19 nt, Homo sapiens
gcaaaaccuugaucuguga

SEQ ID NO: 537423 - RNA, 19 nt, Homo sapiens
aaacugcaaucuguucuga

SEQ ID NO: 537424 - RNA, 19 nt, Homo sapiens
aaaugcagcucaagaacga

SEQ ID NO: 537425 - RNA, 19 nt, Homo sapiens
ucauucagcaugccuauaa

SEQ ID NO: 537426 - RNA, 19 nt, Homo sapiens
ugaugacacuggcacauug

SEQ ID NO: 537427 - RNA, 19 nt, Homo sapiens
uuacauacacagugaauug

SEQ ID NO: 537428 - RNA, 19 nt, Homo sapiens
agaaucagcuucaagaaaa

SEQ ID NO: 537429 - RNA, 19 nt, Homo sapiens
uaaggaagcuuuggagacu

SEQ ID NO: 537430 - RNA, 19 nt, Homo sapiens
cagcugauguauacacguu

SEQ ID NO: 537431 - RNA, 19 nt, Homo sapiens
acggagagguauuaagaaa

SEQ ID NO: 537432 - RNA, 19 nt, Homo sapiens
augaaaggcuucugagaga

SEQ ID NO: 537433 - RNA, 19 nt, Homo sapiens
ggacaaagaaaacaucauu

SEQ ID NO: 537434 - RNA, 19 nt, Homo sapiens
acagugaauugaaaccauu

SEQ ID NO: 537435 - RNA, 19 nt, Homo sapiens
ggaagauaccggaaguaga

SEQ ID NO: 537436 - RNA, 19 nt, Homo sapiens
gcuauuaccguaucuuaca

SEQ ID NO: 537437 - RNA, 19 nt, Homo sapiens
caagucagcagccgcuauu

SEQ ID NO: 537438 - RNA, 19 nt, Homo sapiens
gguguugaaugagaagaaa

SEQ ID NO: 537439 - RNA, 19 nt, Homo sapiens
ccucuuugaugagauuuaa

SEQ ID NO: 537440 - RNA, 19 nt, Homo sapiens
gaaaaugaaaggcuucuga

SEQ ID NO: 537441 - RNA, 19 nt, Homo sapiens
ucagagauuucccaagaag

SEQ ID NO: 537442 - RNA, 19 nt, Homo sapiens
ggagaaucagcuucaagaa

SEQ ID NO: 537443 - RNA, 19 nt, Homo sapiens
agacagcgaaugcaaagaa

SEQ ID NO: 537444 - RNA, 19 nt, Homo sapiens
gauccagucuaugaugaga

SEQ ID NO: 537445 - RNA, 19 nt, Homo sapiens
gagcaggaccagcugaugu

SEQ ID NO: 537446 - RNA, 19 nt, Homo sapiens
guuauuacacuuacugaug

SEQ ID NO: 537447 - RNA, 19 nt, Homo sapiens
ggaaucugguuuuguuauu

SEQ ID NO: 537448 - RNA, 19 nt, Homo sapiens
ggagacagcgaaugcaaag

SEQ ID NO: 537449 - RNA, 19 nt, Homo sapiens
ugcaaucuguucugaaaug

SEQ ID NO: 537450 - RNA, 19 nt, Homo sapiens
acugcaaucuguucugaaa

SEQ ID NO: 537451 - RNA, 19 nt, Homo sapiens
aaaaggacaucaaacaaga

SEQ ID NO: 537452 - RNA, 19 nt, Homo sapiens
gaaacagcagcccagaaga

SEQ ID NO: 537453 - RNA, 19 nt, Homo sapiens
gguuuauucugguguugaa

SEQ ID NO: 537454 - RNA, 19 nt, Homo sapiens
gagauuggaaugauguuca

SEQ ID NO: 537455 - RNA, 19 nt, Homo sapiens
cauccugucugggaagauu

SEQ ID NO: 537456 - RNA, 19 nt, Homo sapiens
caucucagcugaaaacaug

SEQ ID NO: 537457 - RNA, 19 nt, Homo sapiens
ugggacaguuucugaauca

SEQ ID NO: 537458 - RNA, 19 nt, Homo sapiens
gagaaacagcagcccagaa

SEQ ID NO: 537459 - RNA, 19 nt, Homo sapiens
gcugauacucucauugguu

SEQ ID NO: 537460 - RNA, 19 nt, Homo sapiens
gaugacauggcaauggaaa

SEQ ID NO: 537461 - RNA, 19 nt, Homo sapiens
guagagucacggagaggua

SEQ ID NO: 537462 - RNA, 19 nt, Homo sapiens
aagauacgauuugaugaug

SEQ ID NO: 537463 - RNA, 19 nt, Homo sapiens
gagcaccugcagaaagaaa

SEQ ID NO: 537464 - RNA, 19 nt, Homo sapiens
caaaggacacauuuaucau

SEQ ID NO: 537465 - RNA, 19 nt, Homo sapiens
agaccucuuugaugagauu

SEQ ID NO: 537466 - RNA, 19 nt, Homo sapiens
gaaaaggacaucaaacaag

SEQ ID NO: 537467 - RNA, 19 nt, Homo sapiens
auacuuugauguucacuag

SEQ ID NO: 537468 - RNA, 19 nt, Homo sapiens
gauguucaaggacgauuug

SEQ ID NO: 537469 - RNA, 19 nt, Homo sapiens
ggacaccauugcagaaaau

SEQ ID NO: 537470 - RNA, 19 nt, Homo sapiens
gcagaauccaccuuguuuc

SEQ ID NO: 537471 - RNA, 19 nt, Homo sapiens
agggaaauauguuggugaa

SEQ ID NO: 537472 - RNA, 19 nt, Homo sapiens
gauacgauuugaugaugac

SEQ ID NO: 537473 - RNA, 19 nt, Homo sapiens
ccgcuauuaccguaucuua

SEQ ID NO: 537474 - RNA, 19 nt, Homo sapiens
gagaaaaggacaucaaaca

SEQ ID NO: 537475 - RNA, 19 nt, Homo sapiens
uuuggagacugaucuuuau

SEQ ID NO: 537476 - RNA, 19 nt, Homo sapiens
gacacuggcacauugaguu

SEQ ID NO: 537477 - RNA, 19 nt, Homo sapiens
uagaaacucugagaaacag

SEQ ID NO: 537478 - RNA, 19 nt, Homo sapiens
ugaugucacugauauugca

SEQ ID NO: 537479 - RNA, 19 nt, Homo sapiens
gucuugaugucacugauau

SEQ ID NO: 537480 - RNA, 19 nt, Homo sapiens
gaugacacuggcacauuga

SEQ ID NO: 537481 - RNA, 19 nt, Homo sapiens
uaagcagaauccaccuugu

SEQ ID NO: 537482 - RNA, 19 nt, Homo sapiens
gggaaacugcaaucuguuc

SEQ ID NO: 537483 - RNA, 19 nt, Homo sapiens
uggagacugaucuuuauaa

SEQ ID NO: 537484 - RNA, 19 nt, Homo sapiens
cuuuggagacugaucuuua

SEQ ID NO: 537485 - RNA, 19 nt, Homo sapiens
aggaagcuuuggagacuga

SEQ ID NO: 537486 - RNA, 19 nt, Homo sapiens
ccaagaagcugaugacaug

SEQ ID NO: 537487 - RNA, 19 nt, Homo sapiens
ggacacauuuaucauauuc

SEQ ID NO: 537488 - RNA, 19 nt, Homo sapiens
gcaaaggacacauuuauca

SEQ ID NO: 537489 - RNA, 19 nt, Homo sapiens
gagcacaucucagcugaaa

SEQ ID NO: 537490 - RNA, 19 nt, Homo sapiens
gaauccaccuuguuucuga

SEQ ID NO: 537491 - RNA, 19 nt, Homo sapiens
aaacccagcugaagucauu

SEQ ID NO: 537492 - RNA, 19 nt, Homo sapiens
gcugauguauacacguuua

SEQ ID NO: 537493 - RNA, 19 nt, Homo sapiens
gaaauauguuggugaacug

SEQ ID NO: 537494 - RNA, 19 nt, Homo sapiens
gauguucacuagacuaugu

SEQ ID NO: 537495 - RNA, 19 nt, Homo sapiens
gagaaucagcuucaagaaa

SEQ ID NO: 537496 - RNA, 19 nt, Homo sapiens
gaagauaccggaaguagag

SEQ ID NO: 537497 - RNA, 19 nt, Homo sapiens
gagauccagucuaugauga

SEQ ID NO: 537498 - RNA, 19 nt, Homo sapiens
ggaaauauguuggugaacu

SEQ ID NO: 537499 - RNA, 19 nt, Homo sapiens
ugaccgagauccagucuau

SEQ ID NO: 537500 - RNA, 19 nt, Homo sapiens
gaaaggcuucugagagauu

SEQ ID NO: 537501 - RNA, 19 nt, Homo sapiens
cagcugaagucauuagaga

SEQ ID NO: 537502 - RNA, 19 nt, Homo sapiens
ccugaaagaugucucauuc

SEQ ID NO: 537503 - RNA, 19 nt, Homo sapiens
gcaugccuauaauuacaua

SEQ ID NO: 537504 - RNA, 19 nt, Homo sapiens
caaaauggauuacacaugu

SEQ ID NO: 537505 - RNA, 19 nt, Homo sapiens
aaaccaaacugaucucucu

SEQ ID NO: 537506 - RNA, 19 nt, Homo sapiens
gauauugcaccaaguagaa

SEQ ID NO: 537507 - RNA, 19 nt, Homo sapiens
gcaaucuguucugaaauga

SEQ ID NO: 537508 - RNA, 19 nt, Homo sapiens
gaaagaugucucauucaga

SEQ ID NO: 537509 - RNA, 19 nt, Homo sapiens
gaaaacaggacaaagaaaa

SEQ ID NO: 537510 - RNA, 19 nt, Homo sapiens
ucacggagaguauuaagaa

SEQ ID NO: 537511 - RNA, 19 nt, Homo sapiens
ugugauagcuguccaacau

SEQ ID NO: 537512 - RNA, 19 nt, Homo sapiens
guacugaugaggaaaguga

SEQ ID NO: 537513 - RNA, 19 nt, Homo sapiens
ggagacugaucuuuauaag

SEQ ID NO: 537514 - RNA, 19 nt, Homo sapiens
gaacccaguauaacucauu

SEQ ID NO: 537515 - RNA, 19 nt, Homo sapiens
cagcaugccuauaauuaca

SEQ ID NO: 537516 - RNA, 19 nt, Homo sapiens
cauacacagugaauugaaa

SEQ ID NO: 537517 - RNA, 19 nt, Homo sapiens
ugagaguacugaugaggaa

SEQ ID NO: 537518 - RNA, 19 nt, Homo sapiens
aaaggagaauuucaaguca

SEQ ID NO: 537519 - RNA, 19 nt, Homo sapiens
gacagcgaaugcaaagaaa

SEQ ID NO: 537520 - RNA, 19 nt, Homo sapiens
aaacugcaaucuguucuga

SEQ ID NO: 537521 - RNA, 19 nt, Homo sapiens
gcaaaaccuugaucuguga

SEQ ID NO: 537522 - RNA, 19 nt, Homo sapiens
aaaugcagcucaagaacga

SEQ ID NO: 537523 - RNA, 19 nt, Homo sapiens
cggagaguauuaagaaaug

SEQ ID NO: 537524 - RNA, 19 nt, Homo sapiens
ucauucagcaugccuauaa

SEQ ID NO: 537525 - RNA, 19 nt, Homo sapiens
ugaugacacuggcacauug

SEQ ID NO: 537526 - RNA, 19 nt, Homo sapiens
uuacauacacagugaauug

SEQ ID NO: 537527 - RNA, 19 nt, Homo sapiens
agaaucagcuucaagaaaa

SEQ ID NO: 537528 - RNA, 19 nt, Homo sapiens
uaaggaagcuuuggagacu

SEQ ID NO: 537529 - RNA, 19 nt, Homo sapiens
cagcugauguauacacguu

SEQ ID NO: 537530 - RNA, 19 nt, Homo sapiens
augaaaggcuucugagaga

SEQ ID NO: 537531 - RNA, 19 nt, Homo sapiens
ggacaaagaaaacaucauu

SEQ ID NO: 537532 - RNA, 19 nt, Homo sapiens
acagugaauugaaaccauu

SEQ ID NO: 537533 - RNA, 19 nt, Homo sapiens
ggaagauaccggaaguaga

SEQ ID NO: 537534 - RNA, 19 nt, Homo sapiens
gcuauuaccguaucuuaca

SEQ ID NO: 537535 - RNA, 19 nt, Homo sapiens
caagucagcagccgcuauu

SEQ ID NO: 537536 - RNA, 19 nt, Homo sapiens
gguguugaaugagaagaaa

SEQ ID NO: 537537 - RNA, 19 nt, Homo sapiens
ccucuuugaugagauuuaa

SEQ ID NO: 537538 - RNA, 19 nt, Homo sapiens
gaaaaugaaaggcuucuga

SEQ ID NO: 537539 - RNA, 19 nt, Homo sapiens
ucagagauuucccaagaag

SEQ ID NO: 537540 - RNA, 19 nt, Homo sapiens
ggagaaucagcuucaagaa

SEQ ID NO: 537541 - RNA, 19 nt, Homo sapiens
agacagcgaaugcaaagaa

SEQ ID NO: 537542 - RNA, 19 nt, Homo sapiens
gauccagucuaugaugaga

SEQ ID NO: 537543 - RNA, 19 nt, Homo sapiens
gagcaggaccagcugaugu

SEQ ID NO: 537544 - RNA, 19 nt, Homo sapiens
guuauuacacuuacugaug

SEQ ID NO: 537545 - RNA, 19 nt, Homo sapiens
ggaaucugguuuuguuauu

SEQ ID NO: 537546 - RNA, 19 nt, Homo sapiens
ggagacagcgaaugcaaag

SEQ ID NO: 537547 - RNA, 19 nt, Homo sapiens
ugcaaucuguucugaaaug

SEQ ID NO: 537548 - RNA, 19 nt, Homo sapiens
acugcaaucuguucugaaa

SEQ ID NO: 537549 - RNA, 19 nt, Homo sapiens
aaaaggacaucaaacaaga

SEQ ID NO: 537550 - RNA, 19 nt, Homo sapiens
gaaacagcagcccagaaga

SEQ ID NO: 537551 - RNA, 19 nt, Homo sapiens
gguuuauucugguguugaa

SEQ ID NO: 537552 - RNA, 19 nt, Homo sapiens
gagauuggaaugauguuca

SEQ ID NO: 537553 - RNA, 19 nt, Homo sapiens
cauccugucugggaagauu

SEQ ID NO: 537554 - RNA, 19 nt, Homo sapiens
caucucagcugaaaacaug

SEQ ID NO: 537555 - RNA, 19 nt, Homo sapiens
ugggacaguuucugaauca

SEQ ID NO: 537556 - RNA, 19 nt, Homo sapiens
gcugauacucucauugguu

SEQ ID NO: 537557 - RNA, 19 nt, Homo sapiens
gagaaacagcagcccagaa

SEQ ID NO: 537558 - RNA, 19 nt, Homo sapiens
gaugacauggcaauggaaa

SEQ ID NO: 537559 - RNA, 19 nt, Homo sapiens
aagauacgauuugaugaug

SEQ ID NO: 537560 - RNA, 19 nt, Homo sapiens
gagcaccugcagaaagaaa

SEQ ID NO: 537561 - RNA, 19 nt, Homo sapiens
caaaggacacauuuaucau

SEQ ID NO: 537562 - RNA, 19 nt, Homo sapiens
agaccucuuugaugagauu

SEQ ID NO: 537563 - RNA, 19 nt, Homo sapiens
gaaaaggacaucaaacaag

SEQ ID NO: 537564 - RNA, 19 nt, Homo sapiens
gcagaauccaccuuguuuc

SEQ ID NO: 537565 - RNA, 19 nt, Homo sapiens
auacuuugauguucacuag

SEQ ID NO: 537566 - RNA, 19 nt, Homo sapiens
gauguucaaggacgauuug

SEQ ID NO: 537567 - RNA, 19 nt, Homo sapiens
ggacaccauugcagaaaau

SEQ ID NO: 537568 - RNA, 19 nt, Homo sapiens
agggaaauauguuggugaa

SEQ ID NO: 537569 - RNA, 19 nt, Homo sapiens
gauacgauuugaugaugac

SEQ ID NO: 537570 - RNA, 19 nt, Homo sapiens
ccgcuauuaccguaucuua

SEQ ID NO: 537571 - RNA, 19 nt, Homo sapiens
gagaaaaggacaucaaaca

SEQ ID NO: 537572 - RNA, 19 nt, Homo sapiens
uuuggagacugaucuuuau

SEQ ID NO: 537573 - RNA, 19 nt, Homo sapiens
gacacuggcacauugaguu

SEQ ID NO: 537574 - RNA, 19 nt, Homo sapiens
uagaaacucugagaaacag

SEQ ID NO: 537575 - RNA, 19 nt, Homo sapiens
ugaugucacugauauugca

SEQ ID NO: 537576 - RNA, 19 nt, Homo sapiens
gucuugaugucacugauau

SEQ ID NO: 537577 - RNA, 19 nt, Homo sapiens
gaugacacuggcacauuga

SEQ ID NO: 537578 - RNA, 19 nt, Homo sapiens
guagagucacggagaguau

SEQ ID NO: 537579 - RNA, 19 nt, Homo sapiens
gggaaacugcaaucuguuc

SEQ ID NO: 537580 - RNA, 19 nt, Homo sapiens
uggagacugaucuuuauaa

SEQ ID NO: 537581 - RNA, 19 nt, Homo sapiens
cuuuggagacugaucuuua

SEQ ID NO: 537582 - RNA, 19 nt, Homo sapiens
aggaagcuuuggagacuga

SEQ ID NO: 537583 - RNA, 19 nt, Homo sapiens
uaagcagaauccaccuugu

SEQ ID NO: 537584 - RNA, 19 nt, Homo sapiens
augagcaccugcagaaaga

SEQ ID NO: 537585 - RNA, 19 nt, Homo sapiens
gagaaaagcauuguuguca

SEQ ID NO: 537586 - RNA, 19 nt, Homo sapiens
ccaagaagcugaugacaug

SEQ ID NO: 537587 - RNA, 19 nt, Homo sapiens
ggacacauuuaucauauuc

SEQ ID NO: 537588 - RNA, 19 nt, Homo sapiens
gcaaaggacacauuuauca

SEQ ID NO: 537589 - RNA, 19 nt, Homo sapiens
gagcacaucucagcugaaa

SEQ ID NO: 537590 - RNA, 19 nt, Homo sapiens
gaauccaccuuguuucuga

SEQ ID NO: 537591 - RNA, 19 nt, Homo sapiens
aaacccagcugaagucauu

SEQ ID NO: 537592 - RNA, 19 nt, Homo sapiens
gcugauguauacacguuua

SEQ ID NO: 537593 - RNA, 19 nt, Homo sapiens
gaaauauguuggugaacug

SEQ ID NO: 537594 - RNA, 19 nt, Homo sapiens
gauguucacuagacuaugu

SEQ ID NO: 537595 - RNA, 19 nt, Homo sapiens
gagaaucagcuucaagaaa

SEQ ID NO: 537596 - RNA, 19 nt, Homo sapiens
gaagauaccggaaguagag

SEQ ID NO: 537597 - RNA, 19 nt, Homo sapiens
gagauccagucuaugauga

SEQ ID NO: 537598 - RNA, 19 nt, Homo sapiens
ggaaauauguuggugaacu

SEQ ID NO: 537599 - RNA, 19 nt, Homo sapiens
ugaccgagauccagucuau

SEQ ID NO: 537600 - RNA, 19 nt, Homo sapiens
gaaaggcuucugagagauu

SEQ ID NO: 537601 - RNA, 19 nt, Homo sapiens
cagcugaagucauuagaga

SEQ ID NO: 537602 - RNA, 19 nt, Homo sapiens
ccugaaagaugucucauuc

SEQ ID NO: 537603 - RNA, 19 nt, Homo sapiens
gcaugccuauaauuacaua

SEQ ID NO: 537604 - RNA, 19 nt, Homo sapiens
caaaauggauuacacaugu

SEQ ID NO: 537605 - RNA, 19 nt, Homo sapiens
aaaccaaacugaucucucu

SEQ ID NO: 537606 - RNA, 19 nt, Homo sapiens
ggaaaagccugauucuuca

SEQ ID NO: 537607 - RNA, 19 nt, Homo sapiens
gauauugcaccaaguagaa

SEQ ID NO: 537608 - RNA, 19 nt, Homo sapiens
gcaaucuguucugaaauga

SEQ ID NO: 537609 - RNA, 19 nt, Homo sapiens
gaaagaugucucauucaga

SEQ ID NO: 537610 - RNA, 19 nt, Homo sapiens
gaaaacaggacaaagaaaa

SEQ ID NO: 537611 - RNA, 19 nt, Homo sapiens
ugugauagcuguccaacau

SEQ ID NO: 537612 - RNA, 19 nt, Homo sapiens
guacugaugaggaaaguga

SEQ ID NO: 537613 - RNA, 19 nt, Homo sapiens
ggagacugaucuuuauaag

SEQ ID NO: 537614 - RNA, 19 nt, Homo sapiens
gaacccaguauaacucauu

SEQ ID NO: 537615 - RNA, 19 nt, Homo sapiens
cagcaugccuauaauuaca

SEQ ID NO: 537616 - RNA, 19 nt, Homo sapiens
cauacacagugaauugaaa

SEQ ID NO: 537617 - RNA, 19 nt, Homo sapiens
ugagaguacugaugaggaa

SEQ ID NO: 537618 - RNA, 19 nt, Homo sapiens
aaaggagaauuucaaguca

SEQ ID NO: 537619 - RNA, 19 nt, Homo sapiens
gacagcgaaugcaaagaaa

SEQ ID NO: 537620 - RNA, 19 nt, Homo sapiens
aaacugcaaucuguucuga

SEQ ID NO: 537621 - RNA, 19 nt, Homo sapiens
gcaaaaccuugaucuguga

SEQ ID NO: 537622 - RNA, 19 nt, Homo sapiens
aaaugcagcucaagaacga

SEQ ID NO: 537623 - RNA, 19 nt, Homo sapiens
ucauucagcaugccuauaa

SEQ ID NO: 537624 - RNA, 19 nt, Homo sapiens
ugaugacacuggcacauug

SEQ ID NO: 537625 - RNA, 19 nt, Homo sapiens
uuacauacacagugaauug

SEQ ID NO: 537626 - RNA, 19 nt, Homo sapiens
agaaucagcuucaagaaaa

SEQ ID NO: 537627 - RNA, 19 nt, Homo sapiens
uaaggaagcuuuggagacu

SEQ ID NO: 537628 - RNA, 19 nt, Homo sapiens
cagcugauguauacacguu

SEQ ID NO: 537629 - RNA, 19 nt, Homo sapiens
gggcugccucuuuaaauaa

SEQ ID NO: 537630 - RNA, 19 nt, Homo sapiens
augaaaggcuucugagaga

SEQ ID NO: 537631 - RNA, 19 nt, Homo sapiens
ucugagguauuaagaaaug

SEQ ID NO: 537632 - RNA, 19 nt, Homo sapiens
ggacaaagaaaacaucauu

SEQ ID NO: 537633 - RNA, 19 nt, Homo sapiens
acagugaauugaaaccauu

SEQ ID NO: 537634 - RNA, 19 nt, Homo sapiens
ggaagauaccggaaguaga

SEQ ID NO: 537635 - RNA, 19 nt, Homo sapiens
gcuauuaccguaucuuaca

SEQ ID NO: 537636 - RNA, 19 nt, Homo sapiens
caagucagcagccgcuauu

SEQ ID NO: 537637 - RNA, 19 nt, Homo sapiens
gguguugaaugagaagaaa

SEQ ID NO: 537638 - RNA, 19 nt, Homo sapiens
ccucuuugaugagauuuaa

SEQ ID NO: 537639 - RNA, 19 nt, Homo sapiens
gaaaaugaaaggcuucuga

SEQ ID NO: 537640 - RNA, 19 nt, Homo sapiens
ucagagauuucccaagaag

SEQ ID NO: 537641 - RNA, 19 nt, Homo sapiens
gagguaggauccggaagug

SEQ ID NO: 537642 - RNA, 19 nt, Homo sapiens
ggagaaucagcuucaagaa

SEQ ID NO: 537643 - RNA, 19 nt, Homo sapiens
agacagcgaaugcaaagaa

SEQ ID NO: 537644 - RNA, 19 nt, Homo sapiens
gauccagucuaugaugaga

SEQ ID NO: 537645 - RNA, 19 nt, Homo sapiens
gagcaggaccagcugaugu

SEQ ID NO: 537646 - RNA, 19 nt, Homo sapiens
guuauuacacuuacugaug

SEQ ID NO: 537647 - RNA, 19 nt, Homo sapiens
ggaaucugguuuuguuauu

SEQ ID NO: 537648 - RNA, 19 nt, Homo sapiens
ggagacagcgaaugcaaag

SEQ ID NO: 537649 - RNA, 19 nt, Homo sapiens
ugcaaucuguucugaaaug

SEQ ID NO: 537650 - RNA, 19 nt, Homo sapiens
acugcaaucuguucugaaa

SEQ ID NO: 537651 - RNA, 19 nt, Homo sapiens
aaaaggacaucaaacaaga

SEQ ID NO: 537652 - RNA, 19 nt, Homo sapiens
gaaacagcagcccagaaga

SEQ ID NO: 537653 - RNA, 19 nt, Homo sapiens
gguuuauucugguguugaa

SEQ ID NO: 537654 - RNA, 19 nt, Homo sapiens
gagauuggaaugauguuca

SEQ ID NO: 537655 - RNA, 19 nt, Homo sapiens
cauccugucugggaagauu

SEQ ID NO: 537656 - RNA, 19 nt, Homo sapiens
ggggcugccucuuuaaaua

SEQ ID NO: 537657 - RNA, 19 nt, Homo sapiens
caucucagcugaaaacaug

SEQ ID NO: 537658 - RNA, 19 nt, Homo sapiens
ugggacaguuucugaauca

SEQ ID NO: 537659 - RNA, 19 nt, Homo sapiens
gaaguggggcugccucuuu

SEQ ID NO: 537660 - RNA, 19 nt, Homo sapiens
gagaaacagcagcccagaa

SEQ ID NO: 537661 - RNA, 19 nt, Homo sapiens
gcugauacucucauugguu

SEQ ID NO: 537662 - RNA, 19 nt, Homo sapiens
gaugacauggcaauggaaa

SEQ ID NO: 537663 - RNA, 19 nt, Homo sapiens
aagauacgauuugaugaug

SEQ ID NO: 537664 - RNA, 19 nt, Homo sapiens
guagagucacggagaggua

SEQ ID NO: 537665 - RNA, 19 nt, Homo sapiens
gagcaccugcagaaagaaa

SEQ ID NO: 537666 - RNA, 19 nt, Homo sapiens
caaaggacacauuuaucau

SEQ ID NO: 537667 - RNA, 19 nt, Homo sapiens
agaccucuuugaugagauu

SEQ ID NO: 537668 - RNA, 19 nt, Homo sapiens
gaaaaggacaucaaacaag

SEQ ID NO: 537669 - RNA, 19 nt, Homo sapiens
gcagaauccaccuuguuuc

SEQ ID NO: 537670 - RNA, 19 nt, Homo sapiens
auacuuugauguucacuag

SEQ ID NO: 537671 - RNA, 19 nt, Homo sapiens
gauguucaaggacgauuug

SEQ ID NO: 537672 - RNA, 19 nt, Homo sapiens
ggacaccauugcagaaaau

SEQ ID NO: 537673 - RNA, 19 nt, Homo sapiens
agggaaauauguuggugaa

SEQ ID NO: 537674 - RNA, 19 nt, Homo sapiens
gauacgauuugaugaugac

SEQ ID NO: 537675 - RNA, 19 nt, Homo sapiens
ccgcuauuaccguaucuua

SEQ ID NO: 537676 - RNA, 19 nt, Homo sapiens
gagaaaaggacaucaaaca

SEQ ID NO: 537677 - RNA, 19 nt, Homo sapiens
uuuggagacugaucuuuau

SEQ ID NO: 537678 - RNA, 19 nt, Homo sapiens
gacacuggcacauugaguu

SEQ ID NO: 537679 - RNA, 19 nt, Homo sapiens
uagaaacucugagaaacag

SEQ ID NO: 537680 - RNA, 19 nt, Homo sapiens
ugaugucacugauauugca

SEQ ID NO: 537681 - RNA, 19 nt, Homo sapiens
gucuugaugucacugauau

SEQ ID NO: 537682 - RNA, 19 nt, Homo sapiens
gaugacacuggcacauuga

SEQ ID NO: 537683 - RNA, 19 nt, Homo sapiens
uaagcagaauccaccuugu

SEQ ID NO: 537684 - RNA, 19 nt, Homo sapiens
gggaaacugcaaucuguuc

SEQ ID NO: 537685 - RNA, 19 nt, Homo sapiens
uggagacugaucuuuauaa

SEQ ID NO: 537686 - RNA, 19 nt, Homo sapiens
uaagucagcuuucaucuuu

SEQ ID NO: 537687 - RNA, 19 nt, Homo sapiens
ggaagaagccauuaaguuu

SEQ ID NO: 537688 - RNA, 19 nt, Homo sapiens
gaagugauauaguuccuuu

SEQ ID NO: 537689 - RNA, 19 nt, Homo sapiens
gaaagaaguuugagaagag

SEQ ID NO: 537690 - RNA, 19 nt, Homo sapiens
gaagauggguuggaugaaa

SEQ ID NO: 537691 - RNA, 19 nt, Homo sapiens
ggaaagaaguuugagaaga

SEQ ID NO: 537692 - RNA, 19 nt, Homo sapiens
guaaccagcucauaaauca

SEQ ID NO: 537693 - RNA, 19 nt, Homo sapiens
gaugauaucuuuagaaggu

SEQ ID NO: 537694 - RNA, 19 nt, Homo sapiens
gcucauaaaucacaucgaa

SEQ ID NO: 537695 - RNA, 19 nt, Homo sapiens
gaaaucaaguucuaaaggu

SEQ ID NO: 537696 - RNA, 19 nt, Homo sapiens
gauggugucuccuuuacua

SEQ ID NO: 537697 - RNA, 19 nt, Homo sapiens
aaagucagcuggauauuau

SEQ ID NO: 537698 - RNA, 19 nt, Homo sapiens
gaagauggaccuacagcua

SEQ ID NO: 537699 - RNA, 19 nt, Homo sapiens
gaauuacucugaucaccaa

SEQ ID NO: 537700 - RNA, 19 nt, Homo sapiens
caagagaaaguggaaauua

SEQ ID NO: 537701 - RNA, 19 nt, Homo sapiens
gagaagaggcauauugaaa

SEQ ID NO: 537702 - RNA, 19 nt, Homo sapiens
caaagaaggugauaaccau

SEQ ID NO: 537703 - RNA, 19 nt, Homo sapiens
gaaagcccuucaagagaaa

SEQ ID NO: 537704 - RNA, 19 nt, Homo sapiens
gagcagcgcuuuaacaacu

SEQ ID NO: 537705 - RNA, 19 nt, Homo sapiens
ccauaucagugaaccuuua

SEQ ID NO: 537706 - RNA, 19 nt, Homo sapiens
ggacaguuguggaugcaaa

SEQ ID NO: 537707 - RNA, 19 nt, Homo sapiens
gacgugggcuuuaccauga

SEQ ID NO: 537708 - RNA, 19 nt, Homo sapiens
gcacuuuccucccugauuc

SEQ ID NO: 537709 - RNA, 19 nt, Homo sapiens
uaaaucacaucgaacaguu

SEQ ID NO: 537710 - RNA, 19 nt, Homo sapiens
ccaacaagcagcuggguua

SEQ ID NO: 537711 - RNA, 19 nt, Homo sapiens
gccaaaaucucaagaaauu

SEQ ID NO: 537712 - RNA, 19 nt, Homo sapiens
ugaaugcuguugaugcuuu

SEQ ID NO: 537713 - RNA, 19 nt, Homo sapiens
gcagcugccuuucauggaa

SEQ ID NO: 537714 - RNA, 19 nt, Homo sapiens
ugaagaagguggugaugug

SEQ ID NO: 537715 - RNA, 19 nt, Homo sapiens
gggaagaagccauuaaguu

SEQ ID NO: 537716 - RNA, 19 nt, Homo sapiens
ucaagugacugcucaggaa

SEQ ID NO: 537717 - RNA, 19 nt, Homo sapiens
ccgcugaggugacaacaaa

SEQ ID NO: 537718 - RNA, 19 nt, Homo sapiens
ggaaauuguuguccaggau

SEQ ID NO: 537719 - RNA, 19 nt, Homo sapiens
gagcauggaugugauucaa

SEQ ID NO: 537720 - RNA, 19 nt, Homo sapiens
gcgaguaaccagcucauaa

SEQ ID NO: 537721 - RNA, 19 nt, Homo sapiens
gaagacagacacccuugaa

SEQ ID NO: 537722 - RNA, 19 nt, Homo sapiens
ggaauuaccgaacagcaaa

SEQ ID NO: 537723 - RNA, 19 nt, Homo sapiens
gaacaaggaugagauugcu

SEQ ID NO: 537724 - RNA, 19 nt, Homo sapiens
ugauauaggucguggaugu

SEQ ID NO: 537725 - RNA, 19 nt, Homo sapiens
gaagagcagcgcuuuaaca

SEQ ID NO: 537726 - RNA, 19 nt, Homo sapiens
uaaaguggaugaggaacaa

SEQ ID NO: 537727 - RNA, 19 nt, Homo sapiens
gcauggaugugauucaaca

SEQ ID NO: 537728 - RNA, 19 nt, Homo sapiens
ggaggacauugaaagcaaa

SEQ ID NO: 537729 - RNA, 19 nt, Homo sapiens
guggugauguggacgauuu

SEQ ID NO: 537730 - RNA, 19 nt, Homo sapiens
aaagaaagaugagaagaca

SEQ ID NO: 537731 - RNA, 19 nt, Homo sapiens
caugggaaaucaaguucua

SEQ ID NO: 537732 - RNA, 19 nt, Homo sapiens
gaacaucacagugcacaga

SEQ ID NO: 537733 - RNA, 19 nt, Homo sapiens
ggaaugaauacacacauau

SEQ ID NO: 537734 - RNA, 19 nt, Homo sapiens
uuacauacaugcuuugaag

SEQ ID NO: 537735 - RNA, 19 nt, Homo sapiens
uggaaugaauacacacaua

SEQ ID NO: 537736 - RNA, 19 nt, Homo sapiens
cagaagagcagcgcuuuaa

SEQ ID NO: 537737 - RNA, 19 nt, Homo sapiens
caaaagagcuaauccucaa

SEQ ID NO: 537738 - RNA, 19 nt, Homo sapiens
ucgauaugcuuaugacaaa

SEQ ID NO: 537739 - RNA, 19 nt, Homo sapiens
cuaaugaaacaccguauuu

SEQ ID NO: 537740 - RNA, 19 nt, Homo sapiens
aaacuuccguguucuagug

SEQ ID NO: 537741 - RNA, 19 nt, Homo sapiens
ucagauuccucucucuaaa

SEQ ID NO: 537742 - RNA, 19 nt, Homo sapiens
uaacuccauuccugguaua

SEQ ID NO: 537743 - RNA, 19 nt, Homo sapiens
gaauaaggcagcuguugug

SEQ ID NO: 537744 - RNA, 19 nt, Homo sapiens
caacaugaaacaauaggaa

SEQ ID NO: 537745 - RNA, 19 nt, Homo sapiens
gaaaauaacaaagcccuua

SEQ ID NO: 537746 - RNA, 19 nt, Homo sapiens
ucacuucacuguucucuac

SEQ ID NO: 537747 - RNA, 19 nt, Homo sapiens
gggccuuccuuuccacuaa

SEQ ID NO: 537748 - RNA, 19 nt, Homo sapiens
cccaaucucugccauauca

SEQ ID NO: 537749 - RNA, 19 nt, Homo sapiens
gugguggucucaugaagaa

SEQ ID NO: 537750 - RNA, 19 nt, Homo sapiens
cauacaugcuuugaaguuu

SEQ ID NO: 537751 - RNA, 19 nt, Homo sapiens
gaaacaccguauuuuauga

SEQ ID NO: 537752 - RNA, 19 nt, Homo sapiens
ggaauaaggcagcuguugu

SEQ ID NO: 537753 - RNA, 19 nt, Homo sapiens
gugaugauaucuuuagaag

SEQ ID NO: 537754 - RNA, 19 nt, Homo sapiens
gaaacaauaggaaagaagu

SEQ ID NO: 537755 - RNA, 19 nt, Homo sapiens
gcaaagaaggugauaacca

SEQ ID NO: 537756 - RNA, 19 nt, Homo sapiens
ggaagccucuggaaguucu

SEQ ID NO: 537757 - RNA, 19 nt, Homo sapiens
cgaguaaccagcucauaaa

SEQ ID NO: 537758 - RNA, 19 nt, Homo sapiens
gaagaaggccagcuuugag

SEQ ID NO: 537759 - RNA, 19 nt, Homo sapiens
guaacuccauuccugguau

SEQ ID NO: 537760 - RNA, 19 nt, Homo sapiens
ugagcaagcaguagcauuu

SEQ ID NO: 537761 - RNA, 19 nt, Homo sapiens
uuauaucacuucacuguuc

SEQ ID NO: 537762 - RNA, 19 nt, Homo sapiens
cgacagguguuugcugaga

SEQ ID NO: 537763 - RNA, 19 nt, Homo sapiens
ucugguugguguauuauuu

SEQ ID NO: 537764 - RNA, 19 nt, Homo sapiens
caaguuggaugcggccauu

SEQ ID NO: 537765 - RNA, 19 nt, Homo sapiens
ggaaaucaaguucuaaagg

SEQ ID NO: 537766 - RNA, 19 nt, Homo sapiens
ccucaaagagagaaaguuu

SEQ ID NO: 537767 - RNA, 19 nt, Homo sapiens
acaagcagcuggguuagga

SEQ ID NO: 537768 - RNA, 19 nt, Homo sapiens
gcaugguuauugaugaguu

SEQ ID NO: 537769 - RNA, 19 nt, Homo sapiens
gaagaagccauuaaguuuu

SEQ ID NO: 537770 - RNA, 19 nt, Homo sapiens
ggugauaaccauguuugua

SEQ ID NO: 537771 - RNA, 19 nt, Homo sapiens
ggaugaggaacaaaugaaa

SEQ ID NO: 537772 - RNA, 19 nt, Homo sapiens
caaaccaaguggagacaca

SEQ ID NO: 537773 - RNA, 19 nt, Homo sapiens
ugauauaguuccuuucucu

SEQ ID NO: 537774 - RNA, 19 nt, Homo sapiens
gagcacaauuucccuucau

SEQ ID NO: 537775 - RNA, 19 nt, Homo sapiens
ggagcacaauuucccuuca

SEQ ID NO: 537776 - RNA, 19 nt, Homo sapiens
gaaauucccagcagguuac

SEQ ID NO: 537777 - RNA, 19 nt, Homo sapiens
gaagacuuguuuccaacca

SEQ ID NO: 537778 - RNA, 19 nt, Homo sapiens
guacagauggcacugacaa

SEQ ID NO: 537779 - RNA, 19 nt, Homo sapiens
gcaaagaaagaugagaaga

SEQ ID NO: 537780 - RNA, 19 nt, Homo sapiens
gagccaaaaucucaagaaa

SEQ ID NO: 537781 - RNA, 19 nt, Homo sapiens
gcugaaaacuuccguguuc

SEQ ID NO: 537782 - RNA, 19 nt, Homo sapiens
acauuacucugccucugua

SEQ ID NO: 537783 - RNA, 19 nt, Homo sapiens
agacagacacccuugaaga

SEQ ID NO: 537784 - RNA, 19 nt, Homo sapiens
gaaggugauaaccauguuu

SEQ ID NO: 537785 - RNA, 19 nt, Homo sapiens
uggguuggaugaaauuuau

SEQ ID NO: 537786 - RNA, 19 nt, Homo sapiens
gcacaaaucugccaaaaua

SEQ ID NO: 537787 - RNA, 19 nt, Homo sapiens
gaagagugcugucauuauu

SEQ ID NO: 537788 - RNA, 19 nt, Homo sapiens
gaauauagaugaacagaga

SEQ ID NO: 537789 - RNA, 19 nt, Homo sapiens
cagaagaccuuucauuuaa

SEQ ID NO: 537790 - RNA, 19 nt, Homo sapiens
gaagguaacuagaaaguga

SEQ ID NO: 537791 - RNA, 19 nt, Homo sapiens
ggaaggagauggaaaguau

SEQ ID NO: 537792 - RNA, 19 nt, Homo sapiens
gaaggacccugaugaaaga

SEQ ID NO: 537793 - RNA, 19 nt, Homo sapiens
uaagaagggugaaagauuu

SEQ ID NO: 537794 - RNA, 19 nt, Homo sapiens
acucagagcuccucacuua

SEQ ID NO: 537795 - RNA, 19 nt, Homo sapiens
ucacuuagcuauauucuga

SEQ ID NO: 537796 - RNA, 19 nt, Homo sapiens
gauggaagguaauguuuaa

SEQ ID NO: 537797 - RNA, 19 nt, Homo sapiens
ggaaaucccucgagaaucu

SEQ ID NO: 537798 - RNA, 19 nt, Homo sapiens
gaaguggaauuugaaagua

SEQ ID NO: 537799 - RNA, 19 nt, Homo sapiens
guacaagugugagccauua

SEQ ID NO: 537800 - RNA, 19 nt, Homo sapiens
gaaguuaacccuuaccaaa

SEQ ID NO: 537801 - RNA, 19 nt, Homo sapiens
gaaagugaguuaaucuugu

SEQ ID NO: 537802 - RNA, 19 nt, Homo sapiens
ucauggaacugaaagaaua

SEQ ID NO: 537803 - RNA, 19 nt, Homo sapiens
ucaagaagcucagauaaug

SEQ ID NO: 537804 - RNA, 19 nt, Homo sapiens
gaagaccuuucauuuaaga

SEQ ID NO: 537805 - RNA, 19 nt, Homo sapiens
cagaaucccuccaugaauu

SEQ ID NO: 537806 - RNA, 19 nt, Homo sapiens
gaugaaagaccaacauuug

SEQ ID NO: 537807 - RNA, 19 nt, Homo sapiens
ggaagguaauguuuaaugu

SEQ ID NO: 537808 - RNA, 19 nt, Homo sapiens
gagaaaagaugcugaaaga

SEQ ID NO: 537809 - RNA, 19 nt, Homo sapiens
gcaaagggaacagcaguua

SEQ ID NO: 537810 - RNA, 19 nt, Homo sapiens
uaagaagagugcugucauu

SEQ ID NO: 537811 - RNA, 19 nt, Homo sapiens
gaagaaggacccugaugaa

SEQ ID NO: 537812 - RNA, 19 nt, Homo sapiens
uauggucgguuuacaauaa

SEQ ID NO: 537813 - RNA, 19 nt, Homo sapiens
gaacagcaguuaauuucag

SEQ ID NO: 537814 - RNA, 19 nt, Homo sapiens
ugauauggcugcucagauu

SEQ ID NO: 537815 - RNA, 19 nt, Homo sapiens
aaacuacuguccaaucaaa

SEQ ID NO: 537816 - RNA, 19 nt, Homo sapiens
ggaagaaggacccugauga

SEQ ID NO: 537817 - RNA, 19 nt, Homo sapiens
acagaagaccuuucauuua

SEQ ID NO: 537818 - RNA, 19 nt, Homo sapiens
uuagauagcaugcaaagua

SEQ ID NO: 537819 - RNA, 19 nt, Homo sapiens
gaacagagaggaaaaugua

SEQ ID NO: 537820 - RNA, 19 nt, Homo sapiens
uaaacaggaucucaaacuu

SEQ ID NO: 537821 - RNA, 19 nt, Homo sapiens
gcaaacagaacuaguaaca

SEQ ID NO: 537822 - RNA, 19 nt, Homo sapiens
agaacaugcugaugguuua

SEQ ID NO: 537823 - RNA, 19 nt, Homo sapiens
uuacguaaccugcuuagua

SEQ ID NO: 537824 - RNA, 19 nt, Homo sapiens
ggugaaccgugaaguacua

SEQ ID NO: 537825 - RNA, 19 nt, Homo sapiens
ugacaaugguggauacuau

SEQ ID NO: 537826 - RNA, 19 nt, Homo sapiens
gaaaagaugcugaaagauu

SEQ ID NO: 537827 - RNA, 19 nt, Homo sapiens
gaauggagcaguuccuuau

SEQ ID NO: 537828 - RNA, 19 nt, Homo sapiens
aaaguaagacccagcauuu

SEQ ID NO: 537829 - RNA, 19 nt, Homo sapiens
uagauagcaugcaaaguaa

SEQ ID NO: 537830 - RNA, 19 nt, Homo sapiens
ggccuuauaugauuaugaa

SEQ ID NO: 537831 - RNA, 19 nt, Homo sapiens
guucauauccugcugguuu

SEQ ID NO: 537832 - RNA, 19 nt, Homo sapiens
agaaauuggugaaacacua

SEQ ID NO: 537833 - RNA, 19 nt, Homo sapiens
gagaaaaucuugugugcaa

SEQ ID NO: 537834 - RNA, 19 nt, Homo sapiens
ggauggaagguaauguuua

SEQ ID NO: 537835 - RNA, 19 nt, Homo sapiens
gaauggaaccacgaaagua

SEQ ID NO: 537836 - RNA, 19 nt, Homo sapiens
caacuaaaggugcuuauuc

SEQ ID NO: 537837 - RNA, 19 nt, Homo sapiens
uuagagggauggaagguaa

SEQ ID NO: 537838 - RNA, 19 nt, Homo sapiens
gagcagaacccacuacagu

SEQ ID NO: 537839 - RNA, 19 nt, Homo sapiens
ucaaaagggugacaaaauu

SEQ ID NO: 537840 - RNA, 19 nt, Homo sapiens
ugaaacuacuguccaauca

SEQ ID NO: 537841 - RNA, 19 nt, Homo sapiens
ugaagaguuugacuuagaa

SEQ ID NO: 537842 - RNA, 19 nt, Homo sapiens
ugaggcuccugcuuauuua

SEQ ID NO: 537843 - RNA, 19 nt, Homo sapiens
gaaagaccaacauuugaau

SEQ ID NO: 537844 - RNA, 19 nt, Homo sapiens
ccucagggcuguccagaau

SEQ ID NO: 537845 - RNA, 19 nt, Homo sapiens
uauaugcuguuguuucuga

SEQ ID NO: 537846 - RNA, 19 nt, Homo sapiens
ggcuuuaugugaacuauga

SEQ ID NO: 537847 - RNA, 19 nt, Homo sapiens
gggaacagcaguuaauuuc

SEQ ID NO: 537848 - RNA, 19 nt, Homo sapiens
gaggaaaacuuauucugaa

SEQ ID NO: 537849 - RNA, 19 nt, Homo sapiens
gaaaguauaaugcaguaca

SEQ ID NO: 537850 - RNA, 19 nt, Homo sapiens
ggagauggaaaguauuuga

SEQ ID NO: 537851 - RNA, 19 nt, Homo sapiens
guaugagguugcauugauu

SEQ ID NO: 537852 - RNA, 19 nt, Homo sapiens
gaacuauauucaccgagau

SEQ ID NO: 537853 - RNA, 19 nt, Homo sapiens
gagcacaauuugauacucu

SEQ ID NO: 537854 - RNA, 19 nt, Homo sapiens
uuaggaaacuugacaaugg

SEQ ID NO: 537855 - RNA, 19 nt, Homo sapiens
gguuauaucccgagcaauu

SEQ ID NO: 537856 - RNA, 19 nt, Homo sapiens
gagcaguuccuuauauaau

SEQ ID NO: 537857 - RNA, 19 nt, Homo sapiens
uggagcaguuccuuauaua

SEQ ID NO: 537858 - RNA, 19 nt, Homo sapiens
gugaguuaaucuuguauga

SEQ ID NO: 537859 - RNA, 19 nt, Homo sapiens
gugaggcuccugcuuauuu

SEQ ID NO: 537860 - RNA, 19 nt, Homo sapiens
ugauaaacuuguuccacua

SEQ ID NO: 537861 - RNA, 19 nt, Homo sapiens
gcagaagaaugguauuuug

SEQ ID NO: 537862 - RNA, 19 nt, Homo sapiens
aaugguagccuaaacuuaa

SEQ ID NO: 537863 - RNA, 19 nt, Homo sapiens
cagccuacauucacuucua

SEQ ID NO: 537864 - RNA, 19 nt, Homo sapiens
caccacgccuggcuaguuu

SEQ ID NO: 537865 - RNA, 19 nt, Homo sapiens
gcuccucacuuagcuauau

SEQ ID NO: 537866 - RNA, 19 nt, Homo sapiens
gaucuucgggcugcuaaua

SEQ ID NO: 537867 - RNA, 19 nt, Homo sapiens
ccacgaaaguagcaaucaa

SEQ ID NO: 537868 - RNA, 19 nt, Homo sapiens
uugauacucugcagaaauu

SEQ ID NO: 537869 - RNA, 19 nt, Homo sapiens
gugacaaugugaaacacua

SEQ ID NO: 537870 - RNA, 19 nt, Homo sapiens
gaauaaugguagccuaaac

SEQ ID NO: 537871 - RNA, 19 nt, Homo sapiens
ggagcaguuccuuauauaa

SEQ ID NO: 537872 - RNA, 19 nt, Homo sapiens
uuuaagggcuuuaugugaa

SEQ ID NO: 537873 - RNA, 19 nt, Homo sapiens
uacguaaccugcuuaguau

SEQ ID NO: 537874 - RNA, 19 nt, Homo sapiens
aaacuagacuucguacugu

SEQ ID NO: 537875 - RNA, 19 nt, Homo sapiens
cugaagaguuugacuuaga

SEQ ID NO: 537876 - RNA, 19 nt, Homo sapiens
ucugaugucuggucauuug

SEQ ID NO: 537877 - RNA, 19 nt, Homo sapiens
ucaacgagguauuuucuua

SEQ ID NO: 537878 - RNA, 19 nt, Homo sapiens
uacagaagaccuuucauuu

SEQ ID NO: 537879 - RNA, 19 nt, Homo sapiens
gaaggucugguguauaugu

SEQ ID NO: 537880 - RNA, 19 nt, Homo sapiens
ggacuugaaugcacuuuug

SEQ ID NO: 537881 - RNA, 19 nt, Homo sapiens
acagugaggcuccugcuua

SEQ ID NO: 537882 - RNA, 19 nt, Homo sapiens
ugaagacaaugaauacaca

SEQ ID NO: 537883 - RNA, 19 nt, Homo sapiens
gauuugaauagcagcauua

SEQ ID NO: 537884 - RNA, 19 nt, Homo sapiens
ccaaagugcugggauuaca

SEQ ID NO: 537885 - RNA, 19 nt, Homo sapiens
caaaguaagacccagcauu

SEQ ID NO: 537886 - RNA, 19 nt, Homo sapiens
gaacucaccuccugauuau

SEQ ID NO: 537887 - RNA, 19 nt, Homo sapiens
caacuaaccugaaaucuca

SEQ ID NO: 537888 - RNA, 19 nt, Homo sapiens
ccugaaaucucacaucuua

SEQ ID NO: 537889 - RNA, 19 nt, Homo sapiens
cauaaaggcugcacaaaga

SEQ ID NO: 537890 - RNA, 19 nt, Homo sapiens
ccaaacaacuggcagaauu

SEQ ID NO: 537891 - RNA, 19 nt, Homo sapiens
gaagugugauugggaauaa

SEQ ID NO: 537892 - RNA, 19 nt, Homo sapiens
acaaagauguucagggaua

SEQ ID NO: 537893 - RNA, 19 nt, Homo sapiens
gcaguuacaugcauacuuc

SEQ ID NO: 537894 - RNA, 19 nt, Homo sapiens
cagaauauaugacaggaaa

SEQ ID NO: 537895 - RNA, 19 nt, Homo sapiens
gaacagaucauuggagaga

SEQ ID NO: 537896 - RNA, 19 nt, Homo sapiens
uaacuuugcuugcaguaga

SEQ ID NO: 537897 - RNA, 19 nt, Homo sapiens
acagaaagggcaacaauaa

SEQ ID NO: 537898 - RNA, 19 nt, Homo sapiens
ucuguaaucucguuucaaa

SEQ ID NO: 537899 - RNA, 19 nt, Homo sapiens
caaagauguucagggauaa

SEQ ID NO: 537900 - RNA, 19 nt, Homo sapiens
gaggacaauucaugaacuu

SEQ ID NO: 537901 - RNA, 19 nt, Homo sapiens
ucguauagcuguauugaau

SEQ ID NO: 537902 - RNA, 19 nt, Homo sapiens
ucucacaucuuaacacaug

SEQ ID NO: 537903 - RNA, 19 nt, Homo sapiens
agaaaguggugcucaguug

SEQ ID NO: 537904 - RNA, 19 nt, Homo sapiens
uaagggacauguuuugaua

SEQ ID NO: 537905 - RNA, 19 nt, Homo sapiens
guauagcuguauugaauca

SEQ ID NO: 537906 - RNA, 19 nt, Homo sapiens
auaugaagcucaccuguug

SEQ ID NO: 537907 - RNA, 19 nt, Homo sapiens
aaauaugccucuccuuugu

SEQ ID NO: 537908 - RNA, 19 nt, Homo sapiens
acaauagcuugcccucaua

SEQ ID NO: 537909 - RNA, 19 nt, Homo sapiens
uaagaaguuugcucaguca

SEQ ID NO: 537910 - RNA, 19 nt, Homo sapiens
gaagaugaugcuccaagaa

SEQ ID NO: 537911 - RNA, 19 nt, Homo sapiens
caaacaacuggcagaauuu

SEQ ID NO: 537912 - RNA, 19 nt, Homo sapiens
gaauauaugacaggaaaga

SEQ ID NO: 537913 - RNA, 19 nt, Homo sapiens
gcaagaagagcggcaagaa

SEQ ID NO: 537914 - RNA, 19 nt, Homo sapiens
uaaauaugccucuccuuug

SEQ ID NO: 537915 - RNA, 19 nt, Homo sapiens
ggagacaggcccuaugugu

SEQ ID NO: 537916 - RNA, 19 nt, Homo sapiens
agaacucaccuccugauua

SEQ ID NO: 537917 - RNA, 19 nt, Homo sapiens
gcucaccuguugcuuacaa

SEQ ID NO: 537918 - RNA, 19 nt, Homo sapiens
uaacagaaagggcaacaau

SEQ ID NO: 537919 - RNA, 19 nt, Homo sapiens
gauguucaguguaauuucu

SEQ ID NO: 537920 - RNA, 19 nt, Homo sapiens
gcucuaucuugcucuguaa

SEQ ID NO: 537921 - RNA, 19 nt, Homo sapiens
ggagagaagcccuuucagu

SEQ ID NO: 537922 - RNA, 19 nt, Homo sapiens
gcucaguuguagaauguau

SEQ ID NO: 537923 - RNA, 19 nt, Homo sapiens
gugcucaguuguagaaugu

SEQ ID NO: 537924 - RNA, 19 nt, Homo sapiens
aagaugacauugcuaagau

SEQ ID NO: 537925 - RNA, 19 nt, Homo sapiens
ggaggacaauucaugaacu

SEQ ID NO: 537926 - RNA, 19 nt, Homo sapiens
auaaauaugccucuccuuu

SEQ ID NO: 537927 - RNA, 19 nt, Homo sapiens
ggcagaauuugcuagaaug

SEQ ID NO: 537928 - RNA, 19 nt, Homo sapiens
ccucucagaucccaaacaa

SEQ ID NO: 537929 - RNA, 19 nt, Homo sapiens
cagaaagggcaacaauaaa

SEQ ID NO: 537930 - RNA, 19 nt, Homo sapiens
guaaugcuacgugugauuu

SEQ ID NO: 537931 - RNA, 19 nt, Homo sapiens
cgacgacgacuacauugaa

SEQ ID NO: 537932 - RNA, 19 nt, Homo sapiens
acacaugugcgaauccaua

SEQ ID NO: 537933 - RNA, 19 nt, Homo sapiens
ucacuggacuucaauuugc

SEQ ID NO: 537934 - RNA, 19 nt, Homo sapiens
guaauuucuuugccuguuc

SEQ ID NO: 537935 - RNA, 19 nt, Homo sapiens
ucaugaacuucgcaucaaa

SEQ ID NO: 537936 - RNA, 19 nt, Homo sapiens
ggacauguuuugauaaagu

SEQ ID NO: 537937 - RNA, 19 nt, Homo sapiens
agaagcaggugcagaucaa

SEQ ID NO: 537938 - RNA, 19 nt, Homo sapiens
aagaagagcggcaagaaga

SEQ ID NO: 537939 - RNA, 19 nt, Homo sapiens
agaagaugaugcuccaaga

SEQ ID NO: 537940 - RNA, 19 nt, Homo sapiens
ggaggaauaccuggcauug

SEQ ID NO: 537941 - RNA, 19 nt, Homo sapiens
gggcucggguugaggaguu

SEQ ID NO: 537942 - RNA, 19 nt, Homo sapiens
ggauaacucggccaugaga

SEQ ID NO: 537943 - RNA, 19 nt, Homo sapiens
gcagaauuugcuagaauga

SEQ ID NO: 537944 - RNA, 19 nt, Homo sapiens
agacagugguugaagaaca

SEQ ID NO: 537945 - RNA, 19 nt, Homo sapiens
gaaaguggugcucaguugu

SEQ ID NO: 537946 - RNA, 19 nt, Homo sapiens
ucuggagguugauaacuuu

SEQ ID NO: 537947 - RNA, 19 nt, Homo sapiens
gcucuguaaucucguuuca

SEQ ID NO: 537948 - RNA, 19 nt, Homo sapiens
uaagaugacauugcuaaga

SEQ ID NO: 537949 - RNA, 19 nt, Homo sapiens
gccucuccuuuguauauua

SEQ ID NO: 537950 - RNA, 19 nt, Homo sapiens
uggcagaauuugcuagaau

SEQ ID NO: 537951 - RNA, 19 nt, Homo sapiens
gaucugggcucggguugag

SEQ ID NO: 537952 - RNA, 19 nt, Homo sapiens
guugauaacuuugcuugca

SEQ ID NO: 537953 - RNA, 19 nt, Homo sapiens
gggauaugcuuaguaaugc

SEQ ID NO: 537954 - RNA, 19 nt, Homo sapiens
uuacuaagaugacauugcu

SEQ ID NO: 537955 - RNA, 19 nt, Homo sapiens
guucgaaggcugugggaaa

SEQ ID NO: 537956 - RNA, 19 nt, Homo sapiens
aacaauagcuugcccucau

SEQ ID NO: 537957 - RNA, 19 nt, Homo sapiens
agaauuugcuagaaugaag

SEQ ID NO: 537958 - RNA, 19 nt, Homo sapiens
aaaguggugcucaguugua

SEQ ID NO: 537959 - RNA, 19 nt, Homo sapiens
gauaugcuuaguaaugcua

SEQ ID NO: 537960 - RNA, 19 nt, Homo sapiens
cagaauguggcaaagcuuu

SEQ ID NO: 537961 - RNA, 19 nt, Homo sapiens
agggauaacucggccauga

SEQ ID NO: 537962 - RNA, 19 nt, Homo sapiens
guugaggaguugguauuug

SEQ ID NO: 537963 - RNA, 19 nt, Homo sapiens
aauaagaaguuugcucagu

SEQ ID NO: 537964 - RNA, 19 nt, Homo sapiens
gaugaugcuccaagaacaa

SEQ ID NO: 537965 - RNA, 19 nt, Homo sapiens
ggugcucaguuguagaaug

SEQ ID NO: 537966 - RNA, 19 nt, Homo sapiens
uuaaaagaaugggcaguua

SEQ ID NO: 537967 - RNA, 19 nt, Homo sapiens
uuaguaaugcuacguguga

SEQ ID NO: 537968 - RNA, 19 nt, Homo sapiens
gaaaucucacaucuuaaca

SEQ ID NO: 537969 - RNA, 19 nt, Homo sapiens
caauagcuugcccucauaa

SEQ ID NO: 537970 - RNA, 19 nt, Homo sapiens
gcuagaaugaagccaagaa

SEQ ID NO: 537971 - RNA, 19 nt, Homo sapiens
gacagugguugaagaacag

SEQ ID NO: 537972 - RNA, 19 nt, Homo sapiens
aaucucacaucuuaacaca

SEQ ID NO: 537973 - RNA, 19 nt, Homo sapiens
caacuggcagaauuugcua

SEQ ID NO: 537974 - RNA, 19 nt, Homo sapiens
gaggaauaccuggcauuga

SEQ ID NO: 537975 - RNA, 19 nt, Homo sapiens
gagaacucaccuccugauu

SEQ ID NO: 537976 - RNA, 19 nt, Homo sapiens
guuguagaauguauuguac

SEQ ID NO: 537977 - RNA, 19 nt, Homo sapiens
uucuuugccuguucaguua

SEQ ID NO: 537978 - RNA, 19 nt, Homo sapiens
gaaagggcaacaauaaaau

SEQ ID NO: 537979 - RNA, 19 nt, Homo sapiens
uugaggaguugguauuugu

SEQ ID NO: 537980 - RNA, 19 nt, Homo sapiens
acuaagaugacauugcuaa

SEQ ID NO: 537981 - RNA, 19 nt, Homo sapiens
acaccuaagggacauguuu

SEQ ID NO: 537982 - RNA, 19 nt, Homo sapiens
aaugaauccuacacaccua

SEQ ID NO: 537983 - RNA, 19 nt, Homo sapiens
ugagacagugguugaagaa

SEQ ID NO: 537984 - RNA, 19 nt, Homo sapiens
gaagagcggcaagaagagu

SEQ ID NO: 537985 - RNA, 19 nt, Homo sapiens
ucauaaaggcugcacaaag

SEQ ID NO: 537986 - RNA, 19 nt, Homo sapiens
gaagagcacuggacuugga

SEQ ID NO: 537987 - RNA, 19 nt, Homo sapiens
aaagugagcugguacagaa

SEQ ID NO: 537988 - RNA, 19 nt, Homo sapiens
gcacuaaauuucucagucu

SEQ ID NO: 537989 - RNA, 19 nt, Homo sapiens
gaagauagaggcagaacug

SEQ ID NO: 537990 - RNA, 19 nt, Homo sapiens
gaaaggagauuauuuuagg

SEQ ID NO: 537991 - RNA, 19 nt, Homo sapiens
gcacucugaucaugcaguu

SEQ ID NO: 537992 - RNA, 19 nt, Homo sapiens
aaacagagaggaaugagaa

SEQ ID NO: 537993 - RNA, 19 nt, Homo sapiens
gcugagcgauaugaugaua

SEQ ID NO: 537994 - RNA, 19 nt, Homo sapiens
ucuguacccucaacauaua

SEQ ID NO: 537995 - RNA, 19 nt, Homo sapiens
guagugggcuuaggaagga

SEQ ID NO: 537996 - RNA, 19 nt, Homo sapiens
uggauacgcugaaugaaga

SEQ ID NO: 537997 - RNA, 19 nt, Homo sapiens
cuacacaaccagaaaguaa

SEQ ID NO: 537998 - RNA, 19 nt, Homo sapiens
ggcaugaacucuccaacga

SEQ ID NO: 537999 - RNA, 19 nt, Homo sapiens
guaagguguucuacuugaa

SEQ ID NO: 538000 - RNA, 19 nt, Homo sapiens
ccagcaggcuuaccaggaa

SEQ ID NO: 538001 - RNA, 19 nt, Homo sapiens
ggauagagaagcaggaaga

SEQ ID NO: 538002 - RNA, 19 nt, Homo sapiens
ggcauuugaugaagcaauu

SEQ ID NO: 538003 - RNA, 19 nt, Homo sapiens
auucuaaacucuccugaaa

SEQ ID NO: 538004 - RNA, 19 nt, Homo sapiens
uuagguaucuuucugaagu

SEQ ID NO: 538005 - RNA, 19 nt, Homo sapiens
ggagggagagaacuaaugu

SEQ ID NO: 538006 - RNA, 19 nt, Homo sapiens
agacagcacucugaucaug

SEQ ID NO: 538007 - RNA, 19 nt, Homo sapiens
gcaaagaguaccgugagaa

SEQ ID NO: 538008 - RNA, 19 nt, Homo sapiens
gaaguggcaucuggagaca

SEQ ID NO: 538009 - RNA, 19 nt, Homo sapiens
aaagacagcacucugauca

SEQ ID NO: 538010 - RNA, 19 nt, Homo sapiens
cgugucaucuccagcauug

SEQ ID NO: 538011 - RNA, 19 nt, Homo sapiens
uaauguuucucgugcuuug

SEQ ID NO: 538012 - RNA, 19 nt, Homo sapiens
uauaaagacagcacucuga

SEQ ID NO: 538013 - RNA, 19 nt, Homo sapiens
agaaaucugcucucuguug

SEQ ID NO: 538014 - RNA, 19 nt, Homo sapiens
cgaacucccagcaggcuua

SEQ ID NO: 538015 - RNA, 19 nt, Homo sapiens
agaguaccgugagaagaua

SEQ ID NO: 538016 - RNA, 19 nt, Homo sapiens
ugaaggcagucacagaaca

SEQ ID NO: 538017 - RNA, 19 nt, Homo sapiens
ggauaaaagugagcuggua

SEQ ID NO: 538018 - RNA, 19 nt, Homo sapiens
gcaguuacuuagggacaau

SEQ ID NO: 538019 - RNA, 19 nt, Homo sapiens
acuaugagauucuaaacuc

SEQ ID NO: 538020 - RNA, 19 nt, Homo sapiens
ggcaaagaguaccgugaga

SEQ ID NO: 538021 - RNA, 19 nt, Homo sapiens
caugaaggcagucacagaa

SEQ ID NO: 538022 - RNA, 19 nt, Homo sapiens
gcagaugggcaaagaguac

SEQ ID NO: 538023 - RNA, 19 nt, Homo sapiens
uaagguguucuacuugaaa

SEQ ID NO: 538024 - RNA, 19 nt, Homo sapiens
cagagaggaaugagaagaa

SEQ ID NO: 538025 - RNA, 19 nt, Homo sapiens
ugagcaggcugagcgauau

SEQ ID NO: 538026 - RNA, 19 nt, Homo sapiens
ugaauuggauacgcugaau

SEQ ID NO: 538027 - RNA, 19 nt, Homo sapiens
gcaugaacucuccaacgaa

SEQ ID NO: 538028 - RNA, 19 nt, Homo sapiens
gaaugacaauggauaaaag

SEQ ID NO: 538029 - RNA, 19 nt, Homo sapiens
agggagagaacuaauguuu

SEQ ID NO: 538030 - RNA, 19 nt, Homo sapiens
uggagcuguuggacaaaua

SEQ ID NO: 538031 - RNA, 19 nt, Homo sapiens
caaagaguaccgugagaag

SEQ ID NO: 538032 - RNA, 19 nt, Homo sapiens
caacgaagagagaaaucug

SEQ ID NO: 538033 - RNA, 19 nt, Homo sapiens
uaucuuauucccaaugcua

SEQ ID NO: 538034 - RNA, 19 nt, Homo sapiens
cagggaaugacaauggaua

SEQ ID NO: 538035 - RNA, 19 nt, Homo sapiens
gggaaugacaauggauaaa

SEQ ID NO: 538036 - RNA, 19 nt, Homo sapiens
gcucggaagggucuuuguu

SEQ ID NO: 538037 - RNA, 19 nt, Homo sapiens
ggagacaacaaacaaacca

SEQ ID NO: 538038 - RNA, 19 nt, Homo sapiens
ccauucggcuguggauaga

SEQ ID NO: 538039 - RNA, 19 nt, Homo sapiens
ggaaugacaauggauaaaa

SEQ ID NO: 538040 - RNA, 19 nt, Homo sapiens
gggagagaacuaauguuuc

SEQ ID NO: 538041 - RNA, 19 nt, Homo sapiens
gcuacacaaccagaaagua

SEQ ID NO: 538042 - RNA, 19 nt, Homo sapiens
ggagcuguuggacaaauau

SEQ ID NO: 538043 - RNA, 19 nt, Homo sapiens
gcauugagcagaaaacaga

SEQ ID NO: 538044 - RNA, 19 nt, Homo sapiens
ggaaggaagaggucaucuc

SEQ ID NO: 538045 - RNA, 19 nt, Homo sapiens
gggagggagagaacuaaug

SEQ ID NO: 538046 - RNA, 19 nt, Homo sapiens
gaucaugcaguuacuuagg

SEQ ID NO: 538047 - RNA, 19 nt, Homo sapiens
cugaucaugcaguuacuua

SEQ ID NO: 538048 - RNA, 19 nt, Homo sapiens
gaauuggauacgcugaaug

SEQ ID NO: 538049 - RNA, 19 nt, Homo sapiens
gaaagaaaugcagccuaca

SEQ ID NO: 538050 - RNA, 19 nt, Homo sapiens
aaaccacugugucgaacuc

SEQ ID NO: 538051 - RNA, 19 nt, Homo sapiens
ucuguugccuacaagaaug

SEQ ID NO: 538052 - RNA, 19 nt, Homo sapiens
aauuggauacgcugaauga

SEQ ID NO: 538053 - RNA, 19 nt, Homo sapiens
aggcugagcgauaugauga

SEQ ID NO: 538054 - RNA, 19 nt, Homo sapiens
aagaguaccgugagaagau

SEQ ID NO: 538055 - RNA, 19 nt, Homo sapiens
ccaugaaggcagucacaga

SEQ ID NO: 538056 - RNA, 19 nt, Homo sapiens
acucuguacccucaacaua

SEQ ID NO: 538057 - RNA, 19 nt, Homo sapiens
uuacuuagggacaaucuca

SEQ ID NO: 538058 - RNA, 19 nt, Homo sapiens
gucuuggucuggcacuaaa

SEQ ID NO: 538059 - RNA, 19 nt, Homo sapiens
aggaagagcacuggacuug

SEQ ID NO: 538060 - RNA, 19 nt, Homo sapiens
uaaagacagcacucugauc

SEQ ID NO: 538061 - RNA, 19 nt, Homo sapiens
gauucuaaacucuccugaa

SEQ ID NO: 538062 - RNA, 19 nt, Homo sapiens
ggucuggcacuaaauuucu

SEQ ID NO: 538063 - RNA, 19 nt, Homo sapiens
cagcagaugggcaaagagu

SEQ ID NO: 538064 - RNA, 19 nt, Homo sapiens
acuaauguuucucgugcuu

SEQ ID NO: 538065 - RNA, 19 nt, Homo sapiens
uaccaggaagcauuugaaa

SEQ ID NO: 538066 - RNA, 19 nt, Homo sapiens
gcuguuggacaaauaucuu

SEQ ID NO: 538067 - RNA, 19 nt, Homo sapiens
ucuaaacucuccugaaaag

SEQ ID NO: 538068 - RNA, 19 nt, Homo sapiens
cacuaaauuucucagucuu

SEQ ID NO: 538069 - RNA, 19 nt, Homo sapiens
gaaggcagucacagaacag

SEQ ID NO: 538070 - RNA, 19 nt, Homo sapiens
agagaggaaugagaagaag

SEQ ID NO: 538071 - RNA, 19 nt, Homo sapiens
cugagcaggcugagcgaua

SEQ ID NO: 538072 - RNA, 19 nt, Homo sapiens
ucuccagcauugagcagaa

SEQ ID NO: 538073 - RNA, 19 nt, Homo sapiens
acagcacucugaucaugca

SEQ ID NO: 538074 - RNA, 19 nt, Homo sapiens
aaagaguaccgugagaaga

SEQ ID NO: 538075 - RNA, 19 nt, Homo sapiens
aaaccagggagacgaagga

SEQ ID NO: 538076 - RNA, 19 nt, Homo sapiens
ggaaaaccagggagacgaa

SEQ ID NO: 538077 - RNA, 19 nt, Homo sapiens
acacacccaauucgucuug

SEQ ID NO: 538078 - RNA, 19 nt, Homo sapiens
cagccuacacacccaauuc

SEQ ID NO: 538079 - RNA, 19 nt, Homo sapiens
aaagugagcugguacagaa

SEQ ID NO: 538080 - RNA, 19 nt, Homo sapiens
gcacuaaauuucucagucu

SEQ ID NO: 538081 - RNA, 19 nt, Homo sapiens
gaagauagaggcagaacug

SEQ ID NO: 538082 - RNA, 19 nt, Homo sapiens
gaaaggagauuauuuuagg

SEQ ID NO: 538083 - RNA, 19 nt, Homo sapiens
gcacucugaucaugcaguu

SEQ ID NO: 538084 - RNA, 19 nt, Homo sapiens
aaacagagaggaaugagaa

SEQ ID NO: 538085 - RNA, 19 nt, Homo sapiens
gcugagcgauaugaugaua

SEQ ID NO: 538086 - RNA, 19 nt, Homo sapiens
ucuguacccucaacauaua

SEQ ID NO: 538087 - RNA, 19 nt, Homo sapiens
guagugggcuuaggaagga

SEQ ID NO: 538088 - RNA, 19 nt, Homo sapiens
uggauacgcugaaugaaga

SEQ ID NO: 538089 - RNA, 19 nt, Homo sapiens
cuacacaaccagaaaguaa

SEQ ID NO: 538090 - RNA, 19 nt, Homo sapiens
ggcaugaacucuccaacga

SEQ ID NO: 538091 - RNA, 19 nt, Homo sapiens
guaagguguucuacuugaa

SEQ ID NO: 538092 - RNA, 19 nt, Homo sapiens
ccagcaggcuuaccaggaa

SEQ ID NO: 538093 - RNA, 19 nt, Homo sapiens
ggcauuugaugaagcaauu

SEQ ID NO: 538094 - RNA, 19 nt, Homo sapiens
auucuaaacucuccugaaa

SEQ ID NO: 538095 - RNA, 19 nt, Homo sapiens
uuagguaucuuucugaagu

SEQ ID NO: 538096 - RNA, 19 nt, Homo sapiens
ggagggagagaacuaaugu

SEQ ID NO: 538097 - RNA, 19 nt, Homo sapiens
agacagcacucugaucaug

SEQ ID NO: 538098 - RNA, 19 nt, Homo sapiens
gcaaagaguaccgugagaa

SEQ ID NO: 538099 - RNA, 19 nt, Homo sapiens
ccacgggaaugacaaugga

SEQ ID NO: 538100 - RNA, 19 nt, Homo sapiens
gaaguggcaucuggagaca

SEQ ID NO: 538101 - RNA, 19 nt, Homo sapiens
aaagacagcacucugauca

SEQ ID NO: 538102 - RNA, 19 nt, Homo sapiens
cgugucaucuccagcauug

SEQ ID NO: 538103 - RNA, 19 nt, Homo sapiens
uaauguuucucgugcuuug

SEQ ID NO: 538104 - RNA, 19 nt, Homo sapiens
uauaaagacagcacucuga

SEQ ID NO: 538105 - RNA, 19 nt, Homo sapiens
agaaaucugcucucuguug

SEQ ID NO: 538106 - RNA, 19 nt, Homo sapiens
cgaacucccagcaggcuua

SEQ ID NO: 538107 - RNA, 19 nt, Homo sapiens
agaguaccgugagaagaua

SEQ ID NO: 538108 - RNA, 19 nt, Homo sapiens
ggauaaaagugagcuggua

SEQ ID NO: 538109 - RNA, 19 nt, Homo sapiens
ugaaggcagucacagaaca

SEQ ID NO: 538110 - RNA, 19 nt, Homo sapiens
gcaguuacuuagggacaau

SEQ ID NO: 538111 - RNA, 19 nt, Homo sapiens
acuaugagauucuaaacuc

SEQ ID NO: 538112 - RNA, 19 nt, Homo sapiens
ggcaaagaguaccgugaga

SEQ ID NO: 538113 - RNA, 19 nt, Homo sapiens
caugaaggcagucacagaa

SEQ ID NO: 538114 - RNA, 19 nt, Homo sapiens
gcagaugggcaaagaguac

SEQ ID NO: 538115 - RNA, 19 nt, Homo sapiens
uaagguguucuacuugaaa

SEQ ID NO: 538116 - RNA, 19 nt, Homo sapiens
cagagaggaaugagaagaa

SEQ ID NO: 538117 - RNA, 19 nt, Homo sapiens
ugagcaggcugagcgauau

SEQ ID NO: 538118 - RNA, 19 nt, Homo sapiens
gaaugacaauggauaaaag

SEQ ID NO: 538119 - RNA, 19 nt, Homo sapiens
ugaauuggauacgcugaau

SEQ ID NO: 538120 - RNA, 19 nt, Homo sapiens
gcaugaacucuccaacgaa

SEQ ID NO: 538121 - RNA, 19 nt, Homo sapiens
agggagagaacuaauguuu

SEQ ID NO: 538122 - RNA, 19 nt, Homo sapiens
uggagcuguuggacaaaua

SEQ ID NO: 538123 - RNA, 19 nt, Homo sapiens
caaagaguaccgugagaag

SEQ ID NO: 538124 - RNA, 19 nt, Homo sapiens
caacgaagagagaaaucug

SEQ ID NO: 538125 - RNA, 19 nt, Homo sapiens
uaucuuauucccaaugcua

SEQ ID NO: 538126 - RNA, 19 nt, Homo sapiens
ggagacaacaaacaaacca

SEQ ID NO: 538127 - RNA, 19 nt, Homo sapiens
gcucggaagggucuuuguu

SEQ ID NO: 538128 - RNA, 19 nt, Homo sapiens
gggaaugacaauggauaaa

SEQ ID NO: 538129 - RNA, 19 nt, Homo sapiens
ggaaugacaauggauaaaa

SEQ ID NO: 538130 - RNA, 19 nt, Homo sapiens
gggagagaacuaauguuuc

SEQ ID NO: 538131 - RNA, 19 nt, Homo sapiens
gcuacacaaccagaaagua

SEQ ID NO: 538132 - RNA, 19 nt, Homo sapiens
ggaaggaagaggucaucuc

SEQ ID NO: 538133 - RNA, 19 nt, Homo sapiens
ggagcuguuggacaaauau

SEQ ID NO: 538134 - RNA, 19 nt, Homo sapiens
gcauugagcagaaaacaga

SEQ ID NO: 538135 - RNA, 19 nt, Homo sapiens
gggagggagagaacuaaug

SEQ ID NO: 538136 - RNA, 19 nt, Homo sapiens
gaucaugcaguuacuuagg

SEQ ID NO: 538137 - RNA, 19 nt, Homo sapiens
cugaucaugcaguuacuua

SEQ ID NO: 538138 - RNA, 19 nt, Homo sapiens
gaauuggauacgcugaaug

SEQ ID NO: 538139 - RNA, 19 nt, Homo sapiens
gaaagaaaugcagccuaca

SEQ ID NO: 538140 - RNA, 19 nt, Homo sapiens
aaaccacugugucgaacuc

SEQ ID NO: 538141 - RNA, 19 nt, Homo sapiens
ucuguugccuacaagaaug

SEQ ID NO: 538142 - RNA, 19 nt, Homo sapiens
ccaugaaggcagucacaga

SEQ ID NO: 538143 - RNA, 19 nt, Homo sapiens
aauuggauacgcugaauga

SEQ ID NO: 538144 - RNA, 19 nt, Homo sapiens
aggcugagcgauaugauga

SEQ ID NO: 538145 - RNA, 19 nt, Homo sapiens
aagaguaccgugagaagau

SEQ ID NO: 538146 - RNA, 19 nt, Homo sapiens
acucuguacccucaacaua

SEQ ID NO: 538147 - RNA, 19 nt, Homo sapiens
uuacuuagggacaaucuca

SEQ ID NO: 538148 - RNA, 19 nt, Homo sapiens
gucuuggucuggcacuaaa

SEQ ID NO: 538149 - RNA, 19 nt, Homo sapiens
uaaagacagcacucugauc

SEQ ID NO: 538150 - RNA, 19 nt, Homo sapiens
gauucuaaacucuccugaa

SEQ ID NO: 538151 - RNA, 19 nt, Homo sapiens
ggucuggcacuaaauuucu

SEQ ID NO: 538152 - RNA, 19 nt, Homo sapiens
cagcagaugggcaaagagu

SEQ ID NO: 538153 - RNA, 19 nt, Homo sapiens
acuaauguuucucgugcuu

SEQ ID NO: 538154 - RNA, 19 nt, Homo sapiens
cgggaaugacaauggauaa

SEQ ID NO: 538155 - RNA, 19 nt, Homo sapiens
uaccaggaagcauuugaaa

SEQ ID NO: 538156 - RNA, 19 nt, Homo sapiens
gcuguuggacaaauaucuu

SEQ ID NO: 538157 - RNA, 19 nt, Homo sapiens
cugagcaggcugagcgaua

SEQ ID NO: 538158 - RNA, 19 nt, Homo sapiens
ucuaaacucuccugaaaag

SEQ ID NO: 538159 - RNA, 19 nt, Homo sapiens
cacuaaauuucucagucuu

SEQ ID NO: 538160 - RNA, 19 nt, Homo sapiens
agagaggaaugagaagaag

SEQ ID NO: 538161 - RNA, 19 nt, Homo sapiens
gaaggcagucacagaacag

SEQ ID NO: 538162 - RNA, 19 nt, Homo sapiens
ucuccagcauugagcagaa

SEQ ID NO: 538163 - RNA, 19 nt, Homo sapiens
acagcacucugaucaugca

SEQ ID NO: 538164 - RNA, 19 nt, Homo sapiens
aaagaguaccgugagaaga

SEQ ID NO: 538165 - RNA, 19 nt, Homo sapiens
aaaccagggagacgaagga

SEQ ID NO: 538166 - RNA, 19 nt, Homo sapiens
ggaaaaccagggagacgaa

SEQ ID NO: 538167 - RNA, 19 nt, Homo sapiens
acacacccaauucgucuug

SEQ ID NO: 538168 - RNA, 19 nt, Homo sapiens
cagccuacacacccaauuc

SEQ ID NO: 538169 - RNA, 19 nt, Homo sapiens
aaagaaaccuccuaucugu

SEQ ID NO: 538170 - RNA, 19 nt, Homo sapiens
ggacuucguuguaaugguu

SEQ ID NO: 538171 - RNA, 19 nt, Homo sapiens
gagcuaaaguuaaucuguu

SEQ ID NO: 538172 - RNA, 19 nt, Homo sapiens
gaaagaaaccuccuaucug

SEQ ID NO: 538173 - RNA, 19 nt, Homo sapiens
cagcauggaauuaacauua

SEQ ID NO: 538174 - RNA, 19 nt, Homo sapiens
agacugagcuaaaguuaau

SEQ ID NO: 538175 - RNA, 19 nt, Homo sapiens
gaaaaucagugagacauaa

SEQ ID NO: 538176 - RNA, 19 nt, Homo sapiens
gugaagagcagaauaaaga

SEQ ID NO: 538177 - RNA, 19 nt, Homo sapiens
guuaaucuguugugacauu

SEQ ID NO: 538178 - RNA, 19 nt, Homo sapiens
ggaaggaggcugcggagaa

SEQ ID NO: 538179 - RNA, 19 nt, Homo sapiens
gaagaaagaaaccuccuau

SEQ ID NO: 538180 - RNA, 19 nt, Homo sapiens
gcugacaguugaagaaaga

SEQ ID NO: 538181 - RNA, 19 nt, Homo sapiens
gaaacacagcauggaauua

SEQ ID NO: 538182 - RNA, 19 nt, Homo sapiens
gugauaaucugacacuaug

SEQ ID NO: 538183 - RNA, 19 nt, Homo sapiens
gggagggacuucguuguaa

SEQ ID NO: 538184 - RNA, 19 nt, Homo sapiens
aaacacagcauggaauuaa

SEQ ID NO: 538185 - RNA, 19 nt, Homo sapiens
uaaagcugcuagugauauu

SEQ ID NO: 538186 - RNA, 19 nt, Homo sapiens
gaaaugguggagucaauga

SEQ ID NO: 538187 - RNA, 19 nt, Homo sapiens
cauuuggucucagaauuua

SEQ ID NO: 538188 - RNA, 19 nt, Homo sapiens
gaaaguagcagggauggau

SEQ ID NO: 538189 - RNA, 19 nt, Homo sapiens
gcucauucuugccuacuuu

SEQ ID NO: 538190 - RNA, 19 nt, Homo sapiens
gacauaagccaacaagaga

SEQ ID NO: 538191 - RNA, 19 nt, Homo sapiens
ggcaaaugguugagacuga

SEQ ID NO: 538192 - RNA, 19 nt, Homo sapiens
cagcagcauugaacagaaa

SEQ ID NO: 538193 - RNA, 19 nt, Homo sapiens
ccuccuaucuguugcauau

SEQ ID NO: 538194 - RNA, 19 nt, Homo sapiens
ggagggacuucguuguaau

SEQ ID NO: 538195 - RNA, 19 nt, Homo sapiens
gcauaagugguaucaguuu

SEQ ID NO: 538196 - RNA, 19 nt, Homo sapiens
caagaucaccauuagcaaa

SEQ ID NO: 538197 - RNA, 19 nt, Homo sapiens
gcauugaacagaaagaaga

SEQ ID NO: 538198 - RNA, 19 nt, Homo sapiens
cugcaugccuguucaauuc

SEQ ID NO: 538199 - RNA, 19 nt, Homo sapiens
gaagcagguuagcguugaa

SEQ ID NO: 538200 - RNA, 19 nt, Homo sapiens
gaaggaggcugcggagaac

SEQ ID NO: 538201 - RNA, 19 nt, Homo sapiens
uuauaaagcugcuagugau

SEQ ID NO: 538202 - RNA, 19 nt, Homo sapiens
acacuaacaggacuacaua

SEQ ID NO: 538203 - RNA, 19 nt, Homo sapiens
agaauaaucagcagcauug

SEQ ID NO: 538204 - RNA, 19 nt, Homo sapiens
gcauggugcugguaacagu

SEQ ID NO: 538205 - RNA, 19 nt, Homo sapiens
uauagaggcauaaguggua

SEQ ID NO: 538206 - RNA, 19 nt, Homo sapiens
gcaauugcagaacuggaua

SEQ ID NO: 538207 - RNA, 19 nt, Homo sapiens
ggacaaacaccucauucca

SEQ ID NO: 538208 - RNA, 19 nt, Homo sapiens
gagaauaaucagcagcauu

SEQ ID NO: 538209 - RNA, 19 nt, Homo sapiens
gaggagaagacaagcuaaa

SEQ ID NO: 538210 - RNA, 19 nt, Homo sapiens
ugaagcagguuagcguuga

SEQ ID NO: 538211 - RNA, 19 nt, Homo sapiens
gguaacaguucaacaaucc

SEQ ID NO: 538212 - RNA, 19 nt, Homo sapiens
uaccaguguuugcaaguaa

SEQ ID NO: 538213 - RNA, 19 nt, Homo sapiens
gagacugagcuaaaguuaa

SEQ ID NO: 538214 - RNA, 19 nt, Homo sapiens
gggaggagaagacaagcua

SEQ ID NO: 538215 - RNA, 19 nt, Homo sapiens
uugaaagccauuagacuua

SEQ ID NO: 538216 - RNA, 19 nt, Homo sapiens
gaaucuguauuguucuuac

SEQ ID NO: 538217 - RNA, 19 nt, Homo sapiens
aguccaagguuuucuauua

SEQ ID NO: 538218 - RNA, 19 nt, Homo sapiens
agaaaccuccuaucuguug

SEQ ID NO: 538219 - RNA, 19 nt, Homo sapiens
ggagcugacaguugaagaa

SEQ ID NO: 538220 - RNA, 19 nt, Homo sapiens
ugaaacacagcauggaauu

SEQ ID NO: 538221 - RNA, 19 nt, Homo sapiens
agagguuaaucacacuaua

SEQ ID NO: 538222 - RNA, 19 nt, Homo sapiens
agaaagaaaccuccuaucu

SEQ ID NO: 538223 - RNA, 19 nt, Homo sapiens
gcugguaacaguucaacaa

SEQ ID NO: 538224 - RNA, 19 nt, Homo sapiens
caucuaagagagagguuaa

SEQ ID NO: 538225 - RNA, 19 nt, Homo sapiens
uacauuuggucucagaauu

SEQ ID NO: 538226 - RNA, 19 nt, Homo sapiens
ugagaaccaccaaaucuga

SEQ ID NO: 538227 - RNA, 19 nt, Homo sapiens
gauaaucugacacuaugga

SEQ ID NO: 538228 - RNA, 19 nt, Homo sapiens
gcuuaggucuugcucucaa

SEQ ID NO: 538229 - RNA, 19 nt, Homo sapiens
cguugaaggugguauggaa

SEQ ID NO: 538230 - RNA, 19 nt, Homo sapiens
gagcugacaguugaagaaa

SEQ ID NO: 538231 - RNA, 19 nt, Homo sapiens
gugaagaaagcuauaagga

SEQ ID NO: 538232 - RNA, 19 nt, Homo sapiens
uccuaucuguugcauauaa

SEQ ID NO: 538233 - RNA, 19 nt, Homo sapiens
guggcaagaucaccauuag

SEQ ID NO: 538234 - RNA, 19 nt, Homo sapiens
ucacugagaaccaccaaau

SEQ ID NO: 538235 - RNA, 19 nt, Homo sapiens
cauaagccaacaagagaaa

SEQ ID NO: 538236 - RNA, 19 nt, Homo sapiens
acuauggacuucagacaug

SEQ ID NO: 538237 - RNA, 19 nt, Homo sapiens
ugagacugagcuaaaguua

SEQ ID NO: 538238 - RNA, 19 nt, Homo sapiens
gcaugccuguucaauucuu

SEQ ID NO: 538239 - RNA, 19 nt, Homo sapiens
gauguggagcugacaguug

SEQ ID NO: 538240 - RNA, 19 nt, Homo sapiens
uggauacgcugagugaaga

SEQ ID NO: 538241 - RNA, 19 nt, Homo sapiens
gggaauaucggcaaauggu

SEQ ID NO: 538242 - RNA, 19 nt, Homo sapiens
ggagcgagaggcugagaga

SEQ ID NO: 538243 - RNA, 19 nt, Homo sapiens
gcaagaucaccauuagcaa

SEQ ID NO: 538244 - RNA, 19 nt, Homo sapiens
gaagagcagaauaaagaag

SEQ ID NO: 538245 - RNA, 19 nt, Homo sapiens
cuacacuuaucaugcaguu

SEQ ID NO: 538246 - RNA, 19 nt, Homo sapiens
uauaaagcugcuagugaua

SEQ ID NO: 538247 - RNA, 19 nt, Homo sapiens
aaguuaaucuguugugaca

SEQ ID NO: 538248 - RNA, 19 nt, Homo sapiens
aggcauaagugguaucagu

SEQ ID NO: 538249 - RNA, 19 nt, Homo sapiens
ggcaagaucaccauuagca

SEQ ID NO: 538250 - RNA, 19 nt, Homo sapiens
guuguuacgugauaaucug

SEQ ID NO: 538251 - RNA, 19 nt, Homo sapiens
gcugagcgauacgacgaaa

SEQ ID NO: 538252 - RNA, 19 nt, Homo sapiens
gagagagguuaaucacacu

SEQ ID NO: 538253 - RNA, 19 nt, Homo sapiens
agacauaagccaacaagag

SEQ ID NO: 538254 - RNA, 19 nt, Homo sapiens
ggacucuacacuuaucaug

SEQ ID NO: 538255 - RNA, 19 nt, Homo sapiens
ggaauaucggcaaaugguu

SEQ ID NO: 538256 - RNA, 19 nt, Homo sapiens
ucagcagcauugaacagaa

SEQ ID NO: 538257 - RNA, 19 nt, Homo sapiens
gagguuaaucacacuauag

SEQ ID NO: 538258 - RNA, 19 nt, Homo sapiens
acauuuggucucagaauuu

SEQ ID NO: 538259 - RNA, 19 nt, Homo sapiens
ccacaggaaacgacaggaa

SEQ ID NO: 538260 - RNA, 19 nt, Homo sapiens
ggaggagaagacaagcuaa

SEQ ID NO: 538261 - RNA, 19 nt, Homo sapiens
caagggaggagaagacaag

SEQ ID NO: 538262 - RNA, 19 nt, Homo sapiens
guauuguucuuacugaaac

SEQ ID NO: 538263 - RNA, 19 nt, Homo sapiens
uggagucaaugaagaaagu

SEQ ID NO: 538264 - RNA, 19 nt, Homo sapiens
uuagguuccugcccuguug

SEQ ID NO: 538265 - RNA, 19 nt, Homo sapiens
augcaguuguuacgugaua

SEQ ID NO: 538266 - RNA, 19 nt, Homo sapiens
gagagagucggagacacua

SEQ ID NO: 538267 - RNA, 19 nt, Homo sapiens
caaccucuuuuguucagua

SEQ ID NO: 538268 - RNA, 19 nt, Homo sapiens
gcaucuaagagagagguua

SEQ ID NO: 538269 - RNA, 19 nt, Homo sapiens
gaaaugcacuugccuauga

SEQ ID NO: 538270 - RNA, 19 nt, Homo sapiens
gaagaggugugaguaauug

SEQ ID NO: 538271 - RNA, 19 nt, Homo sapiens
cgaagucucugauuaguug

SEQ ID NO: 538272 - RNA, 19 nt, Homo sapiens
gaaccacgaugaccacaga

SEQ ID NO: 538273 - RNA, 19 nt, Homo sapiens
gcagguggcugugggauuu

SEQ ID NO: 538274 - RNA, 19 nt, Homo sapiens
gauggaauaucaugaaugu

SEQ ID NO: 538275 - RNA, 19 nt, Homo sapiens
uacaguagcuugaaauuga

SEQ ID NO: 538276 - RNA, 19 nt, Homo sapiens
ggaaacaacguugcuauuu

SEQ ID NO: 538277 - RNA, 19 nt, Homo sapiens
uaaccauucuguccaauuu

SEQ ID NO: 538278 - RNA, 19 nt, Homo sapiens
gcaaauaaacuuacagauc

SEQ ID NO: 538279 - RNA, 19 nt, Homo sapiens
cagaagaacuaguagaaga

SEQ ID NO: 538280 - RNA, 19 nt, Homo sapiens
ggacuguucuguagauuca

SEQ ID NO: 538281 - RNA, 19 nt, Homo sapiens
guuaugcagugaacuauuu

SEQ ID NO: 538282 - RNA, 19 nt, Homo sapiens
gauuaggccuggcucuuaa

SEQ ID NO: 538283 - RNA, 19 nt, Homo sapiens
gaaugagccuuugugcuuu

SEQ ID NO: 538284 - RNA, 19 nt, Homo sapiens
gaacugaguauguguaaca

SEQ ID NO: 538285 - RNA, 19 nt, Homo sapiens
ggauacaggugacagugaa

SEQ ID NO: 538286 - RNA, 19 nt, Homo sapiens
ccaaguaauuguaggaaga

SEQ ID NO: 538287 - RNA, 19 nt, Homo sapiens
gaucgccucuuugacauuu

SEQ ID NO: 538288 - RNA, 19 nt, Homo sapiens
gcaaaguguucuaccugaa

SEQ ID NO: 538289 - RNA, 19 nt, Homo sapiens
gauagaagaaccacgauga

SEQ ID NO: 538290 - RNA, 19 nt, Homo sapiens
gggagaagauagagaagga

SEQ ID NO: 538291 - RNA, 19 nt, Homo sapiens
caaauauguucucugaaug

SEQ ID NO: 538292 - RNA, 19 nt, Homo sapiens
gcaagaagaggugugagua

SEQ ID NO: 538293 - RNA, 19 nt, Homo sapiens
auagugacaugcaguuaua

SEQ ID NO: 538294 - RNA, 19 nt, Homo sapiens
gggaaugggagacuugaua

SEQ ID NO: 538295 - RNA, 19 nt, Homo sapiens
gcgagcaacuggugcagaa

SEQ ID NO: 538296 - RNA, 19 nt, Homo sapiens
gaaagcgacuucagguuuu

SEQ ID NO: 538297 - RNA, 19 nt, Homo sapiens
auaacuaccugaucaagaa

SEQ ID NO: 538298 - RNA, 19 nt, Homo sapiens
gaguauguguaacaggaua

SEQ ID NO: 538299 - RNA, 19 nt, Homo sapiens
gcuauauccuuaaccauuc

SEQ ID NO: 538300 - RNA, 19 nt, Homo sapiens
gugcugagccugcuggaua

SEQ ID NO: 538301 - RNA, 19 nt, Homo sapiens
gcauaggaauuggagauug

SEQ ID NO: 538302 - RNA, 19 nt, Homo sapiens
gaagagcuauauccuuaac

SEQ ID NO: 538303 - RNA, 19 nt, Homo sapiens
gaagauagagaaggaguug

SEQ ID NO: 538304 - RNA, 19 nt, Homo sapiens
ugaaugagccuuugugcuu

SEQ ID NO: 538305 - RNA, 19 nt, Homo sapiens
gcaugcuaguguuguauuu

SEQ ID NO: 538306 - RNA, 19 nt, Homo sapiens
guuuaggccuugccaguuu

SEQ ID NO: 538307 - RNA, 19 nt, Homo sapiens
ugggagacuugauauuuaa

SEQ ID NO: 538308 - RNA, 19 nt, Homo sapiens
caagaagaggugugaguaa

SEQ ID NO: 538309 - RNA, 19 nt, Homo sapiens
gcccgcaugugcauucuuu

SEQ ID NO: 538310 - RNA, 19 nt, Homo sapiens
ggagcugucugucucuaau

SEQ ID NO: 538311 - RNA, 19 nt, Homo sapiens
gaacucccgagacguguaa

SEQ ID NO: 538312 - RNA, 19 nt, Homo sapiens
gaaucugucuaucugugaa

SEQ ID NO: 538313 - RNA, 19 nt, Homo sapiens
gcuuuaacauccuuauuca

SEQ ID NO: 538314 - RNA, 19 nt, Homo sapiens
gaggucucauucauccuua

SEQ ID NO: 538315 - RNA, 19 nt, Homo sapiens
gagcaaauaaacuuacaga

SEQ ID NO: 538316 - RNA, 19 nt, Homo sapiens
gcacuugccuaugauacug

SEQ ID NO: 538317 - RNA, 19 nt, Homo sapiens
ugaaugagccacugucgaa

SEQ ID NO: 538318 - RNA, 19 nt, Homo sapiens
agaagaagauugagauggu

SEQ ID NO: 538319 - RNA, 19 nt, Homo sapiens
guguuucucuaaggaauua

SEQ ID NO: 538320 - RNA, 19 nt, Homo sapiens
cuccauuacucuauugaua

SEQ ID NO: 538321 - RNA, 19 nt, Homo sapiens
gacucaaugugcucuguaa

SEQ ID NO: 538322 - RNA, 19 nt, Homo sapiens
uuuccgaagucucugauua

SEQ ID NO: 538323 - RNA, 19 nt, Homo sapiens
uggaauaucaugaauguga

SEQ ID NO: 538324 - RNA, 19 nt, Homo sapiens
augggagacuugauauuua

SEQ ID NO: 538325 - RNA, 19 nt, Homo sapiens
ggaaugggagacuugauau

SEQ ID NO: 538326 - RNA, 19 nt, Homo sapiens
caggcuagcugugcuggua

SEQ ID NO: 538327 - RNA, 19 nt, Homo sapiens
cuuaaugucugguguuugu

SEQ ID NO: 538328 - RNA, 19 nt, Homo sapiens
cagcaugacuuuccuuagg

SEQ ID NO: 538329 - RNA, 19 nt, Homo sapiens
gcauugagcagaagacauc

SEQ ID NO: 538330 - RNA, 19 nt, Homo sapiens
ggaagagcuauauccuuaa

SEQ ID NO: 538331 - RNA, 19 nt, Homo sapiens
gcuaguuguuugggcuuua

SEQ ID NO: 538332 - RNA, 19 nt, Homo sapiens
uuuaaggucuaaucaguga

SEQ ID NO: 538333 - RNA, 19 nt, Homo sapiens
ggauguugcuauagugaca

SEQ ID NO: 538334 - RNA, 19 nt, Homo sapiens
uguaacaucgcacaguuua

SEQ ID NO: 538335 - RNA, 19 nt, Homo sapiens
gcaguuuacaguauuucua

SEQ ID NO: 538336 - RNA, 19 nt, Homo sapiens
cgauuaggccuggcucuua

SEQ ID NO: 538337 - RNA, 19 nt, Homo sapiens
gauaacuaccugaucaaga

SEQ ID NO: 538338 - RNA, 19 nt, Homo sapiens
ucaguagcauugagcagaa

SEQ ID NO: 538339 - RNA, 19 nt, Homo sapiens
cugauuaguugacaguauu

SEQ ID NO: 538340 - RNA, 19 nt, Homo sapiens
gcggcgaaggcaacaauua

SEQ ID NO: 538341 - RNA, 19 nt, Homo sapiens
ccaaauagugauuguaaca

SEQ ID NO: 538342 - RNA, 19 nt, Homo sapiens
gguguuauguauuccuaug

SEQ ID NO: 538343 - RNA, 19 nt, Homo sapiens
aacgaaaccuucugucugu

SEQ ID NO: 538344 - RNA, 19 nt, Homo sapiens
gaaugggagacuugauauu

SEQ ID NO: 538345 - RNA, 19 nt, Homo sapiens
uaagugaagccuaccagaa

SEQ ID NO: 538346 - RNA, 19 nt, Homo sapiens
gaguaaaagucccaguuaa

SEQ ID NO: 538347 - RNA, 19 nt, Homo sapiens
gaacgugacagagcugaau

SEQ ID NO: 538348 - RNA, 19 nt, Homo sapiens
guaaugacaccacacuugu

SEQ ID NO: 538349 - RNA, 19 nt, Homo sapiens
uaacaucaagccaucgauu

SEQ ID NO: 538350 - RNA, 19 nt, Homo sapiens
ugucuuugaucgccucuuu

SEQ ID NO: 538351 - RNA, 19 nt, Homo sapiens
ugucguacauugagcaaau

SEQ ID NO: 538352 - RNA, 19 nt, Homo sapiens
cuucuuuccucuuaacgua

SEQ ID NO: 538353 - RNA, 19 nt, Homo sapiens
cauucauccuuaugguuua

SEQ ID NO: 538354 - RNA, 19 nt, Homo sapiens
cgucuggacuguucuguag

SEQ ID NO: 538355 - RNA, 19 nt, Homo sapiens
ggaccaucuuuagcaguuu

SEQ ID NO: 538356 - RNA, 19 nt, Homo sapiens
uacuguagguguuauguau

SEQ ID NO: 538357 - RNA, 19 nt, Homo sapiens
gggugaaucugucuaucug

SEQ ID NO: 538358 - RNA, 19 nt, Homo sapiens
cgaccuguccugucuuuga

SEQ ID NO: 538359 - RNA, 19 nt, Homo sapiens
uaacuacuccgucuucuac

SEQ ID NO: 538360 - RNA, 19 nt, Homo sapiens
gaaaugauuacuccuccau

SEQ ID NO: 538361 - RNA, 19 nt, Homo sapiens
aagaagaggugugaguaau

SEQ ID NO: 538362 - RNA, 19 nt, Homo sapiens
ggucuguggugcagugugu

SEQ ID NO: 538363 - RNA, 19 nt, Homo sapiens
ggagaggcguuuggagaag

SEQ ID NO: 538364 - RNA, 19 nt, Homo sapiens
uagcugugcugguauugga

SEQ ID NO: 538365 - RNA, 19 nt, Homo sapiens
cggcgaaggcaacaauuaa

SEQ ID NO: 538366 - RNA, 19 nt, Homo sapiens
cagcgaagcccacgagauc

SEQ ID NO: 538367 - RNA, 19 nt, Homo sapiens
ccagugcacauuuggaauu

SEQ ID NO: 538368 - RNA, 19 nt, Homo sapiens
cauaggaauuggagauugg

SEQ ID NO: 538369 - RNA, 19 nt, Homo sapiens
gcaaugauuuccaguauga

SEQ ID NO: 538370 - RNA, 19 nt, Homo sapiens
ggaauucaauggguaaaua

SEQ ID NO: 538371 - RNA, 19 nt, Homo sapiens
guaaauaaaugcugcuuug

SEQ ID NO: 538372 - RNA, 19 nt, Homo sapiens
ggaagcaguuucagauaaa

SEQ ID NO: 538373 - RNA, 19 nt, Homo sapiens
caagaugggugauuaugaa

SEQ ID NO: 538374 - RNA, 19 nt, Homo sapiens
gggaagcaguuucagauaa

SEQ ID NO: 538375 - RNA, 19 nt, Homo sapiens
gaaugaaccucucuccaau

SEQ ID NO: 538376 - RNA, 19 nt, Homo sapiens
ccaccucuuucuucaauua

SEQ ID NO: 538377 - RNA, 19 nt, Homo sapiens
gggagaagauugagaagga

SEQ ID NO: 538378 - RNA, 19 nt, Homo sapiens
gaaccucucuccaaugaag

SEQ ID NO: 538379 - RNA, 19 nt, Homo sapiens
gcacaaaccuucuuuucaa

SEQ ID NO: 538380 - RNA, 19 nt, Homo sapiens
gcaaugauguccugucucu

SEQ ID NO: 538381 - RNA, 19 nt, Homo sapiens
uggagaaaguuaaagcuua

SEQ ID NO: 538382 - RNA, 19 nt, Homo sapiens
agagacaacuugcuccuuu

SEQ ID NO: 538383 - RNA, 19 nt, Homo sapiens
gagcaagccugccucuuag

SEQ ID NO: 538384 - RNA, 19 nt, Homo sapiens
gggcauugcuggacugaug

SEQ ID NO: 538385 - RNA, 19 nt, Homo sapiens
ugagcaagccugccucuua

SEQ ID NO: 538386 - RNA, 19 nt, Homo sapiens
ggagacaguuugcaaugau

SEQ ID NO: 538387 - RNA, 19 nt, Homo sapiens
gaugggugauuaugaaaug

SEQ ID NO: 538388 - RNA, 19 nt, Homo sapiens
gcaaugcaucugaaaguuu

SEQ ID NO: 538389 - RNA, 19 nt, Homo sapiens
agaaggagcuggagacagu

SEQ ID NO: 538390 - RNA, 19 nt, Homo sapiens
ggagaaaguuaaagcuuac

SEQ ID NO: 538391 - RNA, 19 nt, Homo sapiens
aaacaagccuucgaugaug

SEQ ID NO: 538392 - RNA, 19 nt, Homo sapiens
ggaaaucuaggcgaaagua

SEQ ID NO: 538393 - RNA, 19 nt, Homo sapiens
aggcuacaguugauauuua

SEQ ID NO: 538394 - RNA, 19 nt, Homo sapiens
gaucugcacuccugucucu

SEQ ID NO: 538395 - RNA, 19 nt, Homo sapiens
caaacaagccuucgaugau

SEQ ID NO: 538396 - RNA, 19 nt, Homo sapiens
gacauggccuccgcuauga

SEQ ID NO: 538397 - RNA, 19 nt, Homo sapiens
ggcuacaguugauauuuaa

SEQ ID NO: 538398 - RNA, 19 nt, Homo sapiens
acaaguuccugaucaagaa

SEQ ID NO: 538399 - RNA, 19 nt, Homo sapiens
cagcacagcuacucagauc

SEQ ID NO: 538400 - RNA, 19 nt, Homo sapiens
gugcuaaaccuaucuguau

SEQ ID NO: 538401 - RNA, 19 nt, Homo sapiens
ccaaacaagccuucgauga

SEQ ID NO: 538402 - RNA, 19 nt, Homo sapiens
ugaauuguguggagaagug

SEQ ID NO: 538403 - RNA, 19 nt, Homo sapiens
gaaaagaaauuggagaaag

SEQ ID NO: 538404 - RNA, 19 nt, Homo sapiens
uucaguagcuccuugguuu

SEQ ID NO: 538405 - RNA, 19 nt, Homo sapiens
gauaguguuucguuaagca

SEQ ID NO: 538406 - RNA, 19 nt, Homo sapiens
gaaaucuaggcgaaaguaa

SEQ ID NO: 538407 - RNA, 19 nt, Homo sapiens
cgacauggccuccgcuaug

SEQ ID NO: 538408 - RNA, 19 nt, Homo sapiens
ggaagcugauacagagaga

SEQ ID NO: 538409 - RNA, 19 nt, Homo sapiens
gcugauaguguuucguuaa

SEQ ID NO: 538410 - RNA, 19 nt, Homo sapiens
gggaagauuagaaagaauu

SEQ ID NO: 538411 - RNA, 19 nt, Homo sapiens
gaagcaguuucagauaaau

SEQ ID NO: 538412 - RNA, 19 nt, Homo sapiens
gaaggcaacugaagauccu

SEQ ID NO: 538413 - RNA, 19 nt, Homo sapiens
ggagaaggcaacugaagau

SEQ ID NO: 538414 - RNA, 19 nt, Homo sapiens
ugaaugaaccucucuccaa

SEQ ID NO: 538415 - RNA, 19 nt, Homo sapiens
ggacugaugguugcuuuga

SEQ ID NO: 538416 - RNA, 19 nt, Homo sapiens
gagacaacuugcuccuuuc

SEQ ID NO: 538417 - RNA, 19 nt, Homo sapiens
ggaugaagaagcaggagaa

SEQ ID NO: 538418 - RNA, 19 nt, Homo sapiens
ucaagaacugcaaugauuu

SEQ ID NO: 538419 - RNA, 19 nt, Homo sapiens
gagacaguuugcaaugaug

SEQ ID NO: 538420 - RNA, 19 nt, Homo sapiens
uaagggaagcugauacaga

SEQ ID NO: 538421 - RNA, 19 nt, Homo sapiens
aaaugaagggugauuacua

SEQ ID NO: 538422 - RNA, 19 nt, Homo sapiens
guaacucuuuggcuauugu

SEQ ID NO: 538423 - RNA, 19 nt, Homo sapiens
gcacagcuacucagaucug

SEQ ID NO: 538424 - RNA, 19 nt, Homo sapiens
gcuaaaccuaucuguauug

SEQ ID NO: 538425 - RNA, 19 nt, Homo sapiens
gacaaguuccugaucaaga

SEQ ID NO: 538426 - RNA, 19 nt, Homo sapiens
caaugcaucugaaaguuuu

SEQ ID NO: 538427 - RNA, 19 nt, Homo sapiens
uaaauuaugacgugcacaa

SEQ ID NO: 538428 - RNA, 19 nt, Homo sapiens
uugccacaaucacuaaaua

SEQ ID NO: 538429 - RNA, 19 nt, Homo sapiens
ugauuacuaccgcuacuua

SEQ ID NO: 538430 - RNA, 19 nt, Homo sapiens
cugcaaugauuuccaguau

SEQ ID NO: 538431 - RNA, 19 nt, Homo sapiens
ccacgcugaucaugcaguu

SEQ ID NO: 538432 - RNA, 19 nt, Homo sapiens
caagaacugcaaugauuuc

SEQ ID NO: 538433 - RNA, 19 nt, Homo sapiens
augaaccucucuccaauga

SEQ ID NO: 538434 - RNA, 19 nt, Homo sapiens
ucaagaugggugauuauga

SEQ ID NO: 538435 - RNA, 19 nt, Homo sapiens
uacuaugccuguugaucua

SEQ ID NO: 538436 - RNA, 19 nt, Homo sapiens
aaugaagggugauuacuac

SEQ ID NO: 538437 - RNA, 19 nt, Homo sapiens
gguaaauaaaugcugcuuu

SEQ ID NO: 538438 - RNA, 19 nt, Homo sapiens
cagcccaugucaaucaaga

SEQ ID NO: 538439 - RNA, 19 nt, Homo sapiens
gguuuugccucuuuaaauu

SEQ ID NO: 538440 - RNA, 19 nt, Homo sapiens
acuaugagauccagaaugc

SEQ ID NO: 538441 - RNA, 19 nt, Homo sapiens
guuaagcaguacaucuugu

SEQ ID NO: 538442 - RNA, 19 nt, Homo sapiens
ccacaaucacuaaauaucu

SEQ ID NO: 538443 - RNA, 19 nt, Homo sapiens
ccagcaggaugaagaagca

SEQ ID NO: 538444 - RNA, 19 nt, Homo sapiens
agccuucgaugaugccaua

SEQ ID NO: 538445 - RNA, 19 nt, Homo sapiens
gagggucauuagcagcauu

SEQ ID NO: 538446 - RNA, 19 nt, Homo sapiens
uagcagcauugagcagaaa

SEQ ID NO: 538447 - RNA, 19 nt, Homo sapiens
uggagacaguuugcaauga

SEQ ID NO: 538448 - RNA, 19 nt, Homo sapiens
gauacagagagacaacuug

SEQ ID NO: 538449 - RNA, 19 nt, Homo sapiens
agaaagaauuagccaacca

SEQ ID NO: 538450 - RNA, 19 nt, Homo sapiens
ccucuuucuucaauuaaug

SEQ ID NO: 538451 - RNA, 19 nt, Homo sapiens
caacuucuccguguucuac

SEQ ID NO: 538452 - RNA, 19 nt, Homo sapiens
gauucuuccuugccacaau

SEQ ID NO: 538453 - RNA, 19 nt, Homo sapiens
uaacgugagguuucaguag

SEQ ID NO: 538454 - RNA, 19 nt, Homo sapiens
gaugaggcauuuuacuaug

SEQ ID NO: 538455 - RNA, 19 nt, Homo sapiens
gcccacaggagcucccuuu

SEQ ID NO: 538456 - RNA, 19 nt, Homo sapiens
ugcuaaaccuaucuguauu

SEQ ID NO: 538457 - RNA, 19 nt, Homo sapiens
gcgaccagcaggaugaaga

SEQ ID NO: 538458 - RNA, 19 nt, Homo sapiens
cgagcgaccagcaggauga

SEQ ID NO: 538459 - RNA, 19 nt, Homo sapiens
ucccaccucuuucuucaau

SEQ ID NO: 538460 - RNA, 19 nt, Homo sapiens
guacaucuugugcaugcaa

SEQ ID NO: 538461 - RNA, 19 nt, Homo sapiens
gauaaaucaugggcauugc

SEQ ID NO: 538462 - RNA, 19 nt, Homo sapiens
ugaagcugccuacaaggaa

SEQ ID NO: 538463 - RNA, 19 nt, Homo sapiens
ccucccaccucuuucuuca

SEQ ID NO: 538464 - RNA, 19 nt, Homo sapiens
aaucuaggcgaaaguaaug

SEQ ID NO: 538465 - RNA, 19 nt, Homo sapiens
guugaucuaugggaaaucu

SEQ ID NO: 538466 - RNA, 19 nt, Homo sapiens
ugucagcccaugucaauca

SEQ ID NO: 538467 - RNA, 19 nt, Homo sapiens
acaacuugcuccuuuccau

SEQ ID NO: 538468 - RNA, 19 nt, Homo sapiens
uguauuggcagcacagcua

SEQ ID NO: 538469 - RNA, 19 nt, Homo sapiens
gcaaaucucuccuuaguug

SEQ ID NO: 538470 - RNA, 19 nt, Homo sapiens
ggaaauaacuugagaugau

SEQ ID NO: 538471 - RNA, 19 nt, Homo sapiens
gcuguuagcuuucauuauu

SEQ ID NO: 538472 - RNA, 19 nt, Homo sapiens
gcagauggcucgagaauac

SEQ ID NO: 538473 - RNA, 19 nt, Homo sapiens
gaacacguguauuaaauuc

SEQ ID NO: 538474 - RNA, 19 nt, Homo sapiens
guuaagaacacguguauua

SEQ ID NO: 538475 - RNA, 19 nt, Homo sapiens
gcaaggagcugaauuaucc

SEQ ID NO: 538476 - RNA, 19 nt, Homo sapiens
uaagagauaucugcaauga

SEQ ID NO: 538477 - RNA, 19 nt, Homo sapiens
gaaauaacuugagaugaug

SEQ ID NO: 538478 - RNA, 19 nt, Homo sapiens
gcagaaguguuccuuuaga

SEQ ID NO: 538479 - RNA, 19 nt, Homo sapiens
gaugauggcuagcuuuguu

SEQ ID NO: 538480 - RNA, 19 nt, Homo sapiens
gagcugaauuauccaauga

SEQ ID NO: 538481 - RNA, 19 nt, Homo sapiens
uaaccggccuuccaacuuu

SEQ ID NO: 538482 - RNA, 19 nt, Homo sapiens
agagauaucugcaaugaug

SEQ ID NO: 538483 - RNA, 19 nt, Homo sapiens
gaacaauccaagcauaauu

SEQ ID NO: 538484 - RNA, 19 nt, Homo sapiens
aaagacagcacgcuaauaa

SEQ ID NO: 538485 - RNA, 19 nt, Homo sapiens
aaagaaaacugccuacaua

SEQ ID NO: 538486 - RNA, 19 nt, Homo sapiens
cagcaaaucucuccuuagu

SEQ ID NO: 538487 - RNA, 19 nt, Homo sapiens
uaacuucucuguguucuau

SEQ ID NO: 538488 - RNA, 19 nt, Homo sapiens
gcuaagagauaucugcaau

SEQ ID NO: 538489 - RNA, 19 nt, Homo sapiens
gacggaaggugcugagaaa

SEQ ID NO: 538490 - RNA, 19 nt, Homo sapiens
cugcagaaguguuccuuua

SEQ ID NO: 538491 - RNA, 19 nt, Homo sapiens
ccauggauaccacauauua

SEQ ID NO: 538492 - RNA, 19 nt, Homo sapiens
ccucaaaccuugcuucuag

SEQ ID NO: 538493 - RNA, 19 nt, Homo sapiens
caagauuaccuuccuguuu

SEQ ID NO: 538494 - RNA, 19 nt, Homo sapiens
caugaacaauccaagcaua

SEQ ID NO: 538495 - RNA, 19 nt, Homo sapiens
agagcaaagucuucuauuu

SEQ ID NO: 538496 - RNA, 19 nt, Homo sapiens
uuacaaggcugugguagaa

SEQ ID NO: 538497 - RNA, 19 nt, Homo sapiens
agaaagggauugucgauca

SEQ ID NO: 538498 - RNA, 19 nt, Homo sapiens
gcaaugauguacugucucu

SEQ ID NO: 538499 - RNA, 19 nt, Homo sapiens
uagagccaguuaacauuua

SEQ ID NO: 538500 - RNA, 19 nt, Homo sapiens
gcccuuaacuucucugugu

SEQ ID NO: 538501 - RNA, 19 nt, Homo sapiens
ccaagaagcuuuugaaauc

SEQ ID NO: 538502 - RNA, 19 nt, Homo sapiens
gcagugagucuugaugaua

SEQ ID NO: 538503 - RNA, 19 nt, Homo sapiens
agucacagguguaguaauu

SEQ ID NO: 538504 - RNA, 19 nt, Homo sapiens
cagugagucuugaugauaa

SEQ ID NO: 538505 - RNA, 19 nt, Homo sapiens
gacuacagcugcagaagug

SEQ ID NO: 538506 - RNA, 19 nt, Homo sapiens
aaaaugagcugguucagaa

SEQ ID NO: 538507 - RNA, 19 nt, Homo sapiens
gaauguaagcuccucaaga

SEQ ID NO: 538508 - RNA, 19 nt, Homo sapiens
ugaaacuucucuaaaggaa

SEQ ID NO: 538509 - RNA, 19 nt, Homo sapiens
uugcugaacuugauacauu

SEQ ID NO: 538510 - RNA, 19 nt, Homo sapiens
gaaaugcaaccaacacauc

SEQ ID NO: 538511 - RNA, 19 nt, Homo sapiens
ggagcugaauuauccaaug

SEQ ID NO: 538512 - RNA, 19 nt, Homo sapiens
gucauugucugccuuuaaa

SEQ ID NO: 538513 - RNA, 19 nt, Homo sapiens
gcaugaagucuguaacuga

SEQ ID NO: 538514 - RNA, 19 nt, Homo sapiens
guaguguguuccauuuaaa

SEQ ID NO: 538515 - RNA, 19 nt, Homo sapiens
guaauuguggguacuuuaa

SEQ ID NO: 538516 - RNA, 19 nt, Homo sapiens
gaagagucauacaaagaca

SEQ ID NO: 538517 - RNA, 19 nt, Homo sapiens
caacaagcauaccaagaag

SEQ ID NO: 538518 - RNA, 19 nt, Homo sapiens
agacggagcuaagagauau

SEQ ID NO: 538519 - RNA, 19 nt, Homo sapiens
ugagcaaggagcugaauua

SEQ ID NO: 538520 - RNA, 19 nt, Homo sapiens
caccaaccauucuuacuug

SEQ ID NO: 538521 - RNA, 19 nt, Homo sapiens
gcagaaacgguucacauuc

SEQ ID NO: 538522 - RNA, 19 nt, Homo sapiens
uguaguguguuccauuuaa

SEQ ID NO: 538523 - RNA, 19 nt, Homo sapiens
ggaguuaucuguuuucauc

SEQ ID NO: 538524 - RNA, 19 nt, Homo sapiens
gcacagcaguaaaacaaaa

SEQ ID NO: 538525 - RNA, 19 nt, Homo sapiens
guagagccaguuaacauuu

SEQ ID NO: 538526 - RNA, 19 nt, Homo sapiens
gaaguguuccuuuagacaa

SEQ ID NO: 538527 - RNA, 19 nt, Homo sapiens
guggaauacucaaugugua

SEQ ID NO: 538528 - RNA, 19 nt, Homo sapiens
gcacgcuaauaaugcaauu

SEQ ID NO: 538529 - RNA, 19 nt, Homo sapiens
ggagggucgucucaaguau

SEQ ID NO: 538530 - RNA, 19 nt, Homo sapiens
gcccguaggucaucuugga

SEQ ID NO: 538531 - RNA, 19 nt, Homo sapiens
uaacuacuguuuccauguc

SEQ ID NO: 538532 - RNA, 19 nt, Homo sapiens
ucacagguguaguaauugu

SEQ ID NO: 538533 - RNA, 19 nt, Homo sapiens
caaaagggccaguguaaaa

SEQ ID NO: 538534 - RNA, 19 nt, Homo sapiens
auaaguguuuggcauagua

SEQ ID NO: 538535 - RNA, 19 nt, Homo sapiens
gagacggagcuaagagaua

SEQ ID NO: 538536 - RNA, 19 nt, Homo sapiens
aauguaagcuccucaagag

SEQ ID NO: 538537 - RNA, 19 nt, Homo sapiens
caacacauccuaucagacu

SEQ ID NO: 538538 - RNA, 19 nt, Homo sapiens
acaacaagcauaccaagaa

SEQ ID NO: 538539 - RNA, 19 nt, Homo sapiens
aaauuagucuugguucuga

SEQ ID NO: 538540 - RNA, 19 nt, Homo sapiens
ccaaggagacgaagcugaa

SEQ ID NO: 538541 - RNA, 19 nt, Homo sapiens
caaagacagcacgcuaaua

SEQ ID NO: 538542 - RNA, 19 nt, Homo sapiens
uacauuaagugaagaguca

SEQ ID NO: 538543 - RNA, 19 nt, Homo sapiens
guaaauuagucuugguucu

SEQ ID NO: 538544 - RNA, 19 nt, Homo sapiens
ucucucaguugcuuauaaa

SEQ ID NO: 538545 - RNA, 19 nt, Homo sapiens
uaacagggaaauaacuuga

SEQ ID NO: 538546 - RNA, 19 nt, Homo sapiens
gaaagggauugucgaucag

SEQ ID NO: 538547 - RNA, 19 nt, Homo sapiens
aaugggcucuuaccaaguu

SEQ ID NO: 538548 - RNA, 19 nt, Homo sapiens
gcuaaugggcucuuaccaa

SEQ ID NO: 538549 - RNA, 19 nt, Homo sapiens
caaccuaagaacaaaugua

SEQ ID NO: 538550 - RNA, 19 nt, Homo sapiens
guuauaaguguuuggcaua

SEQ ID NO: 538551 - RNA, 19 nt, Homo sapiens
gagaaggaggggaaaauua

SEQ ID NO: 538552 - RNA, 19 nt, Homo sapiens
gacugggucuggcccuuaa

SEQ ID NO: 538553 - RNA, 19 nt, Homo sapiens
gagaugauggcuagcuuug

SEQ ID NO: 538554 - RNA, 19 nt, Homo sapiens
gguucacauuccauuauuu

SEQ ID NO: 538555 - RNA, 19 nt, Homo sapiens
ugagcgauaugaugacaug

SEQ ID NO: 538556 - RNA, 19 nt, Homo sapiens
gaguagagccaguuaacau

SEQ ID NO: 538557 - RNA, 19 nt, Homo sapiens
agacagcacgcuaauaaug

SEQ ID NO: 538558 - RNA, 19 nt, Homo sapiens
gugaagagucauacaaaga

SEQ ID NO: 538559 - RNA, 19 nt, Homo sapiens
gcucgagaauacagagaga

SEQ ID NO: 538560 - RNA, 19 nt, Homo sapiens
gauaagggugagaaacuga

SEQ ID NO: 538561 - RNA, 19 nt, Homo sapiens
cuauuucccucauccuauu

SEQ ID NO: 538562 - RNA, 19 nt, Homo sapiens
uggguagcauuaacuguaa

SEQ ID NO: 538563 - RNA, 19 nt, Homo sapiens
aaaguuaccugcuguuagc

SEQ ID NO: 538564 - RNA, 19 nt, Homo sapiens
ggcagaaacgguucacauu

SEQ ID NO: 538565 - RNA, 19 nt, Homo sapiens
aaacugcuuccaugucuaa

SEQ ID NO: 538566 - RNA, 19 nt, Homo sapiens
ugagagacaacuugacauu

SEQ ID NO: 538567 - RNA, 19 nt, Homo sapiens
caaccaacacauccuauca

SEQ ID NO: 538568 - RNA, 19 nt, Homo sapiens
ggagauuacuaccguuacu

SEQ ID NO: 538569 - RNA, 19 nt, Homo sapiens
gcaaaucucuccuuaguug

SEQ ID NO: 538570 - RNA, 19 nt, Homo sapiens
ggaaauaacuugagaugau

SEQ ID NO: 538571 - RNA, 19 nt, Homo sapiens
gcuguuagcuuucauuauu

SEQ ID NO: 538572 - RNA, 19 nt, Homo sapiens
gcagauggcucgagaauac

SEQ ID NO: 538573 - RNA, 19 nt, Homo sapiens
gaacacguguauuaaauuc

SEQ ID NO: 538574 - RNA, 19 nt, Homo sapiens
guuaagaacacguguauua

SEQ ID NO: 538575 - RNA, 19 nt, Homo sapiens
gcaaggagcugaauuaucc

SEQ ID NO: 538576 - RNA, 19 nt, Homo sapiens
uaagagauaucugcaauga

SEQ ID NO: 538577 - RNA, 19 nt, Homo sapiens
gaaauaacuugagaugaug

SEQ ID NO: 538578 - RNA, 19 nt, Homo sapiens
gcagaaguguuccuuuaga

SEQ ID NO: 538579 - RNA, 19 nt, Homo sapiens
gaugauggcuagcuuuguu

SEQ ID NO: 538580 - RNA, 19 nt, Homo sapiens
gagcugaauuauccaauga

SEQ ID NO: 538581 - RNA, 19 nt, Homo sapiens
uaaccggccuuccaacuuu

SEQ ID NO: 538582 - RNA, 19 nt, Homo sapiens
agagauaucugcaaugaug

SEQ ID NO: 538583 - RNA, 19 nt, Homo sapiens
gaacaauccaagcauaauu

SEQ ID NO: 538584 - RNA, 19 nt, Homo sapiens
aaagacagcacgcuaauaa

SEQ ID NO: 538585 - RNA, 19 nt, Homo sapiens
aaagaaaacugccuacaua

SEQ ID NO: 538586 - RNA, 19 nt, Homo sapiens
cagcaaaucucuccuuagu

SEQ ID NO: 538587 - RNA, 19 nt, Homo sapiens
uaacuucucuguguucuau

SEQ ID NO: 538588 - RNA, 19 nt, Homo sapiens
gcuaagagauaucugcaau

SEQ ID NO: 538589 - RNA, 19 nt, Homo sapiens
gacggaaggugcugagaaa

SEQ ID NO: 538590 - RNA, 19 nt, Homo sapiens
cugcagaaguguuccuuua

SEQ ID NO: 538591 - RNA, 19 nt, Homo sapiens
ccauggauaccacauauua

SEQ ID NO: 538592 - RNA, 19 nt, Homo sapiens
caagauuaccuuccuguuu

SEQ ID NO: 538593 - RNA, 19 nt, Homo sapiens
caugaacaauccaagcaua

SEQ ID NO: 538594 - RNA, 19 nt, Homo sapiens
agagcaaagucuucuauuu

SEQ ID NO: 538595 - RNA, 19 nt, Homo sapiens
uuacaaggcugugguagaa

SEQ ID NO: 538596 - RNA, 19 nt, Homo sapiens
agaaagggauugucgauca

SEQ ID NO: 538597 - RNA, 19 nt, Homo sapiens
gcaaugauguacugucucu

SEQ ID NO: 538598 - RNA, 19 nt, Homo sapiens
uagagccaguuaacauuua

SEQ ID NO: 538599 - RNA, 19 nt, Homo sapiens
gcccuuaacuucucugugu

SEQ ID NO: 538600 - RNA, 19 nt, Homo sapiens
ccaagaagcuuuugaaauc

SEQ ID NO: 538601 - RNA, 19 nt, Homo sapiens
gcagugagucuugaugaua

SEQ ID NO: 538602 - RNA, 19 nt, Homo sapiens
agucacagguguaguaauu

SEQ ID NO: 538603 - RNA, 19 nt, Homo sapiens
cagugagucuugaugauaa

SEQ ID NO: 538604 - RNA, 19 nt, Homo sapiens
gacuacagcugcagaagug

SEQ ID NO: 538605 - RNA, 19 nt, Homo sapiens
aaaaugagcugguucagaa

SEQ ID NO: 538606 - RNA, 19 nt, Homo sapiens
gaauguaagcuccucaaga

SEQ ID NO: 538607 - RNA, 19 nt, Homo sapiens
ugaaacuucucuaaaggaa

SEQ ID NO: 538608 - RNA, 19 nt, Homo sapiens
uugcugaacuugauacauu

SEQ ID NO: 538609 - RNA, 19 nt, Homo sapiens
gaaaugcaaccaacacauc

SEQ ID NO: 538610 - RNA, 19 nt, Homo sapiens
ggagcugaauuauccaaug

SEQ ID NO: 538611 - RNA, 19 nt, Homo sapiens
gucauugucugccuuuaaa

SEQ ID NO: 538612 - RNA, 19 nt, Homo sapiens
guaguguguuccauuuaaa

SEQ ID NO: 538613 - RNA, 19 nt, Homo sapiens
guaauuguggguacuuuaa

SEQ ID NO: 538614 - RNA, 19 nt, Homo sapiens
gaagagucauacaaagaca

SEQ ID NO: 538615 - RNA, 19 nt, Homo sapiens
ugagcaaggagcugaauua

SEQ ID NO: 538616 - RNA, 19 nt, Homo sapiens
gcaugaagucuguaacuga

SEQ ID NO: 538617 - RNA, 19 nt, Homo sapiens
caacaagcauaccaagaag

SEQ ID NO: 538618 - RNA, 19 nt, Homo sapiens
agacggagcuaagagauau

SEQ ID NO: 538619 - RNA, 19 nt, Homo sapiens
caccaaccauucuuacuug

SEQ ID NO: 538620 - RNA, 19 nt, Homo sapiens
gcagaaacgguucacauuc

SEQ ID NO: 538621 - RNA, 19 nt, Homo sapiens
uguaguguguuccauuuaa

SEQ ID NO: 538622 - RNA, 19 nt, Homo sapiens
ggaguuaucuguuuucauc

SEQ ID NO: 538623 - RNA, 19 nt, Homo sapiens
gcacagcaguaaaacaaaa

SEQ ID NO: 538624 - RNA, 19 nt, Homo sapiens
guagagccaguuaacauuu

SEQ ID NO: 538625 - RNA, 19 nt, Homo sapiens
gaaguguuccuuuagacaa

SEQ ID NO: 538626 - RNA, 19 nt, Homo sapiens
guggaauacucaaugugua

SEQ ID NO: 538627 - RNA, 19 nt, Homo sapiens
gcacgcuaauaaugcaauu

SEQ ID NO: 538628 - RNA, 19 nt, Homo sapiens
ggagggucgucucaaguau

SEQ ID NO: 538629 - RNA, 19 nt, Homo sapiens
gcccguaggucaucuugga

SEQ ID NO: 538630 - RNA, 19 nt, Homo sapiens
uaacuacuguuuccauguc

SEQ ID NO: 538631 - RNA, 19 nt, Homo sapiens
ucacagguguaguaauugu

SEQ ID NO: 538632 - RNA, 19 nt, Homo sapiens
caaaagggccaguguaaaa

SEQ ID NO: 538633 - RNA, 19 nt, Homo sapiens
auaaguguuuggcauagua

SEQ ID NO: 538634 - RNA, 19 nt, Homo sapiens
gagacggagcuaagagaua

SEQ ID NO: 538635 - RNA, 19 nt, Homo sapiens
aauguaagcuccucaagag

SEQ ID NO: 538636 - RNA, 19 nt, Homo sapiens
caacacauccuaucagacu

SEQ ID NO: 538637 - RNA, 19 nt, Homo sapiens
acaacaagcauaccaagaa

SEQ ID NO: 538638 - RNA, 19 nt, Homo sapiens
aaauuagucuugguucuga

SEQ ID NO: 538639 - RNA, 19 nt, Homo sapiens
ccaaggagacgaagcugaa

SEQ ID NO: 538640 - RNA, 19 nt, Homo sapiens
caaagacagcacgcuaaua

SEQ ID NO: 538641 - RNA, 19 nt, Homo sapiens
uacauuaagugaagaguca

SEQ ID NO: 538642 - RNA, 19 nt, Homo sapiens
guaaauuagucuugguucu

SEQ ID NO: 538643 - RNA, 19 nt, Homo sapiens
uaacagggaaauaacuuga

SEQ ID NO: 538644 - RNA, 19 nt, Homo sapiens
ucucucaguugcuuauaaa

SEQ ID NO: 538645 - RNA, 19 nt, Homo sapiens
cacagaacauccagucaug

SEQ ID NO: 538646 - RNA, 19 nt, Homo sapiens
gaaagggauugucgaucag

SEQ ID NO: 538647 - RNA, 19 nt, Homo sapiens
aaugggcucuuaccaaguu

SEQ ID NO: 538648 - RNA, 19 nt, Homo sapiens
gcuaaugggcucuuaccaa

SEQ ID NO: 538649 - RNA, 19 nt, Homo sapiens
caaccuaagaacaaaugua

SEQ ID NO: 538650 - RNA, 19 nt, Homo sapiens
guuauaaguguuuggcaua

SEQ ID NO: 538651 - RNA, 19 nt, Homo sapiens
gagaaggaggggaaaauua

SEQ ID NO: 538652 - RNA, 19 nt, Homo sapiens
gacugggucuggcccuuaa

SEQ ID NO: 538653 - RNA, 19 nt, Homo sapiens
ugagcgauaugaugacaug

SEQ ID NO: 538654 - RNA, 19 nt, Homo sapiens
gagaugauggcuagcuuug

SEQ ID NO: 538655 - RNA, 19 nt, Homo sapiens
gguucacauuccauuauuu

SEQ ID NO: 538656 - RNA, 19 nt, Homo sapiens
gaguagagccaguuaacau

SEQ ID NO: 538657 - RNA, 19 nt, Homo sapiens
agacagcacgcuaauaaug

SEQ ID NO: 538658 - RNA, 19 nt, Homo sapiens
gugaagagucauacaaaga

SEQ ID NO: 538659 - RNA, 19 nt, Homo sapiens
gcucgagaauacagagaga

SEQ ID NO: 538660 - RNA, 19 nt, Homo sapiens
gauaagggugagaaacuga

SEQ ID NO: 538661 - RNA, 19 nt, Homo sapiens
cuauuucccucauccuauu

SEQ ID NO: 538662 - RNA, 19 nt, Homo sapiens
uggguagcauuaacuguaa

SEQ ID NO: 538663 - RNA, 19 nt, Homo sapiens
aaaguuaccugcuguuagc

SEQ ID NO: 538664 - RNA, 19 nt, Homo sapiens
ggcagaaacgguucacauu

SEQ ID NO: 538665 - RNA, 19 nt, Homo sapiens
gaggaaucuucucucaguu

SEQ ID NO: 538666 - RNA, 19 nt, Homo sapiens
aaacugcuuccaugucuaa

SEQ ID NO: 538667 - RNA, 19 nt, Homo sapiens
ugagagacaacuugacauu

SEQ ID NO: 538668 - RNA, 19 nt, Homo sapiens
caaccaacacauccuauca

SEQ ID NO: 538669 - RNA, 19 nt, Homo sapiens
agaaagagcuuauauagug

SEQ ID NO: 538670 - RNA, 19 nt, Homo sapiens
ggaacacgcuggcuccaua

SEQ ID NO: 538671 - RNA, 19 nt, Homo sapiens
gaaagggucugugaaagaa

SEQ ID NO: 538672 - RNA, 19 nt, Homo sapiens
ggaguuggcucgcuuaaau

SEQ ID NO: 538673 - RNA, 19 nt, Homo sapiens
uagaagaccugacucguaa

SEQ ID NO: 538674 - RNA, 19 nt, Homo sapiens
gcgcaaagauggccagaug

SEQ ID NO: 538675 - RNA, 19 nt, Homo sapiens
caaagcagccugaguuauu

SEQ ID NO: 538676 - RNA, 19 nt, Homo sapiens
gugauucuguugacaauaa

SEQ ID NO: 538677 - RNA, 19 nt, Homo sapiens
gaacaagaaagagcuuaua

SEQ ID NO: 538678 - RNA, 19 nt, Homo sapiens
ccacauugcuucagacugu

SEQ ID NO: 538679 - RNA, 19 nt, Homo sapiens
ggagugcaaugccaagauu

SEQ ID NO: 538680 - RNA, 19 nt, Homo sapiens
caagaaagagcuuauauag

SEQ ID NO: 538681 - RNA, 19 nt, Homo sapiens
ggaaagggucugugaaaga

SEQ ID NO: 538682 - RNA, 19 nt, Homo sapiens
uaagaaacauccugaagca

SEQ ID NO: 538683 - RNA, 19 nt, Homo sapiens
caacacgugugagugauaa

SEQ ID NO: 538684 - RNA, 19 nt, Homo sapiens
gauaaagcacggauggaua

SEQ ID NO: 538685 - RNA, 19 nt, Homo sapiens
caagaugaguacccagaaa

SEQ ID NO: 538686 - RNA, 19 nt, Homo sapiens
ccaggaaugccuacaguua

SEQ ID NO: 538687 - RNA, 19 nt, Homo sapiens
gaaccaagacacaauggaa

SEQ ID NO: 538688 - RNA, 19 nt, Homo sapiens
uuacaaaccuccagcaaca

SEQ ID NO: 538689 - RNA, 19 nt, Homo sapiens
ucagggacccgcagcauua

SEQ ID NO: 538690 - RNA, 19 nt, Homo sapiens
gcaaagauggccagauguu

SEQ ID NO: 538691 - RNA, 19 nt, Homo sapiens
ggaacacccugaagaacau

SEQ ID NO: 538692 - RNA, 19 nt, Homo sapiens
ccaaaugucugaauguuuu

SEQ ID NO: 538693 - RNA, 19 nt, Homo sapiens
ggucuucugcugcaauuua

SEQ ID NO: 538694 - RNA, 19 nt, Homo sapiens
gaacagaagacagugauuc

SEQ ID NO: 538695 - RNA, 19 nt, Homo sapiens
gacgauaacaggaucuuaa

SEQ ID NO: 538696 - RNA, 19 nt, Homo sapiens
ucagucagcucaggauaaa

SEQ ID NO: 538697 - RNA, 19 nt, Homo sapiens
ugaagaacauagagaagga

SEQ ID NO: 538698 - RNA, 19 nt, Homo sapiens
ugguuuaucugcagaaauu

SEQ ID NO: 538699 - RNA, 19 nt, Homo sapiens
aaagcagccugaguuauuu

SEQ ID NO: 538700 - RNA, 19 nt, Homo sapiens
ucaagccaccugcagauua

SEQ ID NO: 538701 - RNA, 19 nt, Homo sapiens
gaagugauucuguugacaa

SEQ ID NO: 538702 - RNA, 19 nt, Homo sapiens
gaucaguaccugggaagua

SEQ ID NO: 538703 - RNA, 19 nt, Homo sapiens
ggacugaggcuccgccaau

SEQ ID NO: 538704 - RNA, 19 nt, Homo sapiens
ggcacaaccucaucacaga

SEQ ID NO: 538705 - RNA, 19 nt, Homo sapiens
ggcaagggcuuuggccauu

SEQ ID NO: 538706 - RNA, 19 nt, Homo sapiens
gcaacacgugugagugaua

SEQ ID NO: 538707 - RNA, 19 nt, Homo sapiens
cagcuucccacacccauua

SEQ ID NO: 538708 - RNA, 19 nt, Homo sapiens
aagcacggauggauaaaga

SEQ ID NO: 538709 - RNA, 19 nt, Homo sapiens
gggauguuccauugaauaa

SEQ ID NO: 538710 - RNA, 19 nt, Homo sapiens
aagggagucuuguaaaguu

SEQ ID NO: 538711 - RNA, 19 nt, Homo sapiens
gagcuuauauagugcaacu

SEQ ID NO: 538712 - RNA, 19 nt, Homo sapiens
gauaagaaacauccugaag

SEQ ID NO: 538713 - RNA, 19 nt, Homo sapiens
ggcaaagcagccugaguua

SEQ ID NO: 538714 - RNA, 19 nt, Homo sapiens
caucgagugucuucuuugu

SEQ ID NO: 538715 - RNA, 19 nt, Homo sapiens
aggaaugccuacaguuauu

SEQ ID NO: 538716 - RNA, 19 nt, Homo sapiens
ugucuucuuugucuucuuu

SEQ ID NO: 538717 - RNA, 19 nt, Homo sapiens
auaaagcacggauggauaa

SEQ ID NO: 538718 - RNA, 19 nt, Homo sapiens
gcaguggaacagauaagaa

SEQ ID NO: 538719 - RNA, 19 nt, Homo sapiens
ccgcuucccucuccaugaa

SEQ ID NO: 538720 - RNA, 19 nt, Homo sapiens
ucaagcugguuguggguuu

SEQ ID NO: 538721 - RNA, 19 nt, Homo sapiens
gcacggauggauaaagaau

SEQ ID NO: 538722 - RNA, 19 nt, Homo sapiens
gggaaagggucugugaaag

SEQ ID NO: 538723 - RNA, 19 nt, Homo sapiens
cagcaacacgugugaguga

SEQ ID NO: 538724 - RNA, 19 nt, Homo sapiens
caagccaccugcagauuac

SEQ ID NO: 538725 - RNA, 19 nt, Homo sapiens
gcagauagaagaccugacu

SEQ ID NO: 538726 - RNA, 19 nt, Homo sapiens
ucucuucacugguuuaucu

SEQ ID NO: 538727 - RNA, 19 nt, Homo sapiens
caagggcuuuggccauuca

SEQ ID NO: 538728 - RNA, 19 nt, Homo sapiens
gcaagggcuuuggccauuc

SEQ ID NO: 538729 - RNA, 19 nt, Homo sapiens
gcaaagcagccugaguuau

SEQ ID NO: 538730 - RNA, 19 nt, Homo sapiens
cggcaaagcagccugaguu

SEQ ID NO: 538731 - RNA, 19 nt, Homo sapiens
acggauggauaaagaauau

SEQ ID NO: 538732 - RNA, 19 nt, Homo sapiens
ccaauacaauggagaacgu

SEQ ID NO: 538733 - RNA, 19 nt, Homo sapiens
gggaacacccugaagaaca

SEQ ID NO: 538734 - RNA, 19 nt, Homo sapiens
agagaugguugcacucaau

SEQ ID NO: 538735 - RNA, 19 nt, Homo sapiens
gaacacgcuggcuccauau

SEQ ID NO: 538736 - RNA, 19 nt, Homo sapiens
gagaacaagaaagagcuua

SEQ ID NO: 538737 - RNA, 19 nt, Homo sapiens
guagguucaucuccagguu

SEQ ID NO: 538738 - RNA, 19 nt, Homo sapiens
ccauggcccuccuccaaug

SEQ ID NO: 538739 - RNA, 19 nt, Homo sapiens
guacccagaaaucaacuuu

SEQ ID NO: 538740 - RNA, 19 nt, Homo sapiens
ggauaaagcacggauggau

SEQ ID NO: 538741 - RNA, 19 nt, Homo sapiens
gauaacaggaucuuaagac

SEQ ID NO: 538742 - RNA, 19 nt, Homo sapiens
gaagcaggguaucgagacu

SEQ ID NO: 538743 - RNA, 19 nt, Homo sapiens
gcaaugccaagauuaugau

SEQ ID NO: 538744 - RNA, 19 nt, Homo sapiens
ccugagcccaucuacaaua

SEQ ID NO: 538745 - RNA, 19 nt, Homo sapiens
auagaagaccugacucgua

SEQ ID NO: 538746 - RNA, 19 nt, Homo sapiens
ccaugagagugaggacuuu

SEQ ID NO: 538747 - RNA, 19 nt, Homo sapiens
gaacacccugaagaacaua

SEQ ID NO: 538748 - RNA, 19 nt, Homo sapiens
agaccugacucguaaacug

SEQ ID NO: 538749 - RNA, 19 nt, Homo sapiens
uaaaagagcagugugguuu

SEQ ID NO: 538750 - RNA, 19 nt, Homo sapiens
ccaaaggccuggugauccu

SEQ ID NO: 538751 - RNA, 19 nt, Homo sapiens
aaaggcaguggaacagaua

SEQ ID NO: 538752 - RNA, 19 nt, Homo sapiens
ccacuucaugcccugguua

SEQ ID NO: 538753 - RNA, 19 nt, Homo sapiens
caaagauggccagauguug

SEQ ID NO: 538754 - RNA, 19 nt, Homo sapiens
acccagaaaucaacuuugu

SEQ ID NO: 538755 - RNA, 19 nt, Homo sapiens
gaugaguacccagaaauca

SEQ ID NO: 538756 - RNA, 19 nt, Homo sapiens
caggaaugccuacaguuau

SEQ ID NO: 538757 - RNA, 19 nt, Homo sapiens
caccgucucucaugucuac

SEQ ID NO: 538758 - RNA, 19 nt, Homo sapiens
caguggaacagauaagaaa

SEQ ID NO: 538759 - RNA, 19 nt, Homo sapiens
gaagguugggcgcaaagau

SEQ ID NO: 538760 - RNA, 19 nt, Homo sapiens
gagugcaaugccaagauua

SEQ ID NO: 538761 - RNA, 19 nt, Homo sapiens
ucgagugucuucuuugucu

SEQ ID NO: 538762 - RNA, 19 nt, Homo sapiens
ggaacagaagacagugauu

SEQ ID NO: 538763 - RNA, 19 nt, Homo sapiens
gggaagacgauaacaggau

SEQ ID NO: 538764 - RNA, 19 nt, Homo sapiens
gacaggaugguucggcaaa

SEQ ID NO: 538765 - RNA, 19 nt, Homo sapiens
gacaucccaugcagcacaa

SEQ ID NO: 538766 - RNA, 19 nt, Homo sapiens
caauggaacagaagacagu

SEQ ID NO: 538767 - RNA, 19 nt, Homo sapiens
gauguugccaggagaagau

SEQ ID NO: 538768 - RNA, 19 nt, Homo sapiens
gugauaaagucaugauucc

SEQ ID NO: 538769 - RNA, 19 nt, Homo sapiens
ucaaugggcccuuuauuua

SEQ ID NO: 538770 - RNA, 19 nt, Homo sapiens
ccaaaucugucuccuagaa

SEQ ID NO: 538771 - RNA, 19 nt, Homo sapiens
ggacaguaaucaaguaauc

SEQ ID NO: 538772 - RNA, 19 nt, Homo sapiens
gauccgacccugaugaaua

SEQ ID NO: 538773 - RNA, 19 nt, Homo sapiens
gaauccuggugcucaaauu

SEQ ID NO: 538774 - RNA, 19 nt, Homo sapiens
aaucuuaugugcugugaau

SEQ ID NO: 538775 - RNA, 19 nt, Homo sapiens
caaugggcccuuuauuuau

SEQ ID NO: 538776 - RNA, 19 nt, Homo sapiens
uauauugggucgucugcuu

SEQ ID NO: 538777 - RNA, 19 nt, Homo sapiens
agacggaacucugucacaa

SEQ ID NO: 538778 - RNA, 19 nt, Homo sapiens
uaugugcugugaauaauag

SEQ ID NO: 538779 - RNA, 19 nt, Homo sapiens
ccucuucccugcccaaauc

SEQ ID NO: 538780 - RNA, 19 nt, Homo sapiens
ccacaacccuagcgaagac

SEQ ID NO: 538781 - RNA, 19 nt, Homo sapiens
aaugggcccuuuauuuaug

SEQ ID NO: 538782 - RNA, 19 nt, Homo sapiens
ggaucugacugccaucuac

SEQ ID NO: 538783 - RNA, 19 nt, Homo sapiens
auaaaucaaugggcccuuu

SEQ ID NO: 538784 - RNA, 19 nt, Homo sapiens
uggagugucuuccgagguu

SEQ ID NO: 538785 - RNA, 19 nt, Homo sapiens
gcucaaauuacccuccaaa

SEQ ID NO: 538786 - RNA, 19 nt, Homo sapiens
cgaagggccacuccuauca

SEQ ID NO: 538787 - RNA, 19 nt, Homo sapiens
caagugugcaagcucagua

SEQ ID NO: 538788 - RNA, 19 nt, Homo sapiens
caucuucaaucgcaucucu

SEQ ID NO: 538789 - RNA, 19 nt, Homo sapiens
guaauccccuuuuccagaa

SEQ ID NO: 538790 - RNA, 19 nt, Homo sapiens
caucucuguuucugaguga

SEQ ID NO: 538791 - RNA, 19 nt, Homo sapiens
ucaaucgcaucucuguuuc

SEQ ID NO: 538792 - RNA, 19 nt, Homo sapiens
aaaucugucuccuagaauc

SEQ ID NO: 538793 - RNA, 19 nt, Homo sapiens
gcaagcucaguauucauga

SEQ ID NO: 538794 - RNA, 19 nt, Homo sapiens
ccaaagccguugccaaacc

SEQ ID NO: 538795 - RNA, 19 nt, Homo sapiens
agccaaagccguugccaaa

SEQ ID NO: 538796 - RNA, 19 nt, Homo sapiens
aauccuggugcucaaauua

SEQ ID NO: 538797 - RNA, 19 nt, Homo sapiens
ucugucuccuagaaucuua

SEQ ID NO: 538798 - RNA, 19 nt, Homo sapiens
caagcucaguauucaugau

SEQ ID NO: 538799 - RNA, 19 nt, Homo sapiens
ggaauccuggugcucaaau

SEQ ID NO: 538800 - RNA, 19 nt, Homo sapiens
ugugcaagcucaguauuca

SEQ ID NO: 538801 - RNA, 19 nt, Homo sapiens
ccaaauacaagacggaacu

SEQ ID NO: 538802 - RNA, 19 nt, Homo sapiens
gucgucugcuucccuugua

SEQ ID NO: 538803 - RNA, 19 nt, Homo sapiens
uucaaucgcaucucuguuu

SEQ ID NO: 538804 - RNA, 19 nt, Homo sapiens
aucaaugggcccuuuauuu

SEQ ID NO: 538805 - RNA, 19 nt, Homo sapiens
auccgacccugaugaauau

SEQ ID NO: 538806 - RNA, 19 nt, Homo sapiens
gggauccgacccugaugaa

SEQ ID NO: 538807 - RNA, 19 nt, Homo sapiens
gcucaguauucaugauggu

SEQ ID NO: 538808 - RNA, 19 nt, Homo sapiens
acggaacucugucacaagu

SEQ ID NO: 538809 - RNA, 19 nt, Homo sapiens
gaccauggagggacugagu

SEQ ID NO: 538810 - RNA, 19 nt, Homo sapiens
caaaucugucuccuagaau

SEQ ID NO: 538811 - RNA, 19 nt, Homo sapiens
auacaagacggaacucugu

SEQ ID NO: 538812 - RNA, 19 nt, Homo sapiens
aaucaaugggcccuuuauu

SEQ ID NO: 538813 - RNA, 19 nt, Homo sapiens
caaauuacccuccaaaagc

SEQ ID NO: 538814 - RNA, 19 nt, Homo sapiens
gaagggccacuccuaucag

SEQ ID NO: 538815 - RNA, 19 nt, Homo sapiens
agaaucuuaugugcuguga

SEQ ID NO: 538816 - RNA, 19 nt, Homo sapiens
gccgaagggccacuccuau

SEQ ID NO: 538817 - RNA, 19 nt, Homo sapiens
ggacauagcucaucucuua

SEQ ID NO: 538818 - RNA, 19 nt, Homo sapiens
ggagaaaccuuauaaaugu

SEQ ID NO: 538819 - RNA, 19 nt, Homo sapiens
ggagaaaccuuaugaaugu

SEQ ID NO: 538820 - RNA, 19 nt, Homo sapiens
agacacagcucaaaccuua

SEQ ID NO: 538821 - RNA, 19 nt, Homo sapiens
caagauauauugugaagug

SEQ ID NO: 538822 - RNA, 19 nt, Homo sapiens
gagaaacccuuugaaugua

SEQ ID NO: 538823 - RNA, 19 nt, Homo sapiens
gaaagguucucagccauaa

SEQ ID NO: 538824 - RNA, 19 nt, Homo sapiens
gcucaaaccuuauucaaca

SEQ ID NO: 538825 - RNA, 19 nt, Homo sapiens
aaguauagcucaucccuua

SEQ ID NO: 538826 - RNA, 19 nt, Homo sapiens
gaagucacaccucauuaua

SEQ ID NO: 538827 - RNA, 19 nt, Homo sapiens
gagaaauuauccagccaua

SEQ ID NO: 538828 - RNA, 19 nt, Homo sapiens
gcucaucccuuacuaaaca

SEQ ID NO: 538829 - RNA, 19 nt, Homo sapiens
ggagaaaccauaugaaugu

SEQ ID NO: 538830 - RNA, 19 nt, Homo sapiens
cauaguucaucccauauua

SEQ ID NO: 538831 - RNA, 19 nt, Homo sapiens
agccauagcucaucugaua

SEQ ID NO: 538832 - RNA, 19 nt, Homo sapiens
gaaaucugaugcagcuaaa

SEQ ID NO: 538833 - RNA, 19 nt, Homo sapiens
gaaagaugaugaccagcuu

SEQ ID NO: 538834 - RNA, 19 nt, Homo sapiens
ucaaagaacucauacuaag

SEQ ID NO: 538835 - RNA, 19 nt, Homo sapiens
aaagcaaacuggaaagaaa

SEQ ID NO: 538836 - RNA, 19 nt, Homo sapiens
ucacccagcucuuucuuaa

SEQ ID NO: 538837 - RNA, 19 nt, Homo sapiens
agguauaacucaucucuua

SEQ ID NO: 538838 - RNA, 19 nt, Homo sapiens
gaacucauacuaaggagaa

SEQ ID NO: 538839 - RNA, 19 nt, Homo sapiens
gauauauugugaaguguga

SEQ ID NO: 538840 - RNA, 19 nt, Homo sapiens
agagcaaccuguauaauga

SEQ ID NO: 538841 - RNA, 19 nt, Homo sapiens
ugucauaguucaucccaua

SEQ ID NO: 538842 - RNA, 19 nt, Homo sapiens
gggauagccuuuagccaaa

SEQ ID NO: 538843 - RNA, 19 nt, Homo sapiens
caucaaagaacucauacua

SEQ ID NO: 538844 - RNA, 19 nt, Homo sapiens
gagaaaccauaugaaugua

SEQ ID NO: 538845 - RNA, 19 nt, Homo sapiens
gcaauggagaaacaaguua

SEQ ID NO: 538846 - RNA, 19 nt, Homo sapiens
guacaucagagaacucaua

SEQ ID NO: 538847 - RNA, 19 nt, Homo sapiens
caaagcccauggucauaaa

SEQ ID NO: 538848 - RNA, 19 nt, Homo sapiens
ccagaaaucucaaaacaaa

SEQ ID NO: 538849 - RNA, 19 nt, Homo sapiens
gcaaagcccauggucauaa

SEQ ID NO: 538850 - RNA, 19 nt, Homo sapiens
ggaaagguucucagccaua

SEQ ID NO: 538851 - RNA, 19 nt, Homo sapiens
ggaaaucugaugcagcuaa

SEQ ID NO: 538852 - RNA, 19 nt, Homo sapiens
ggauacaaaugugcuggua

SEQ ID NO: 538853 - RNA, 19 nt, Homo sapiens
ucaaagcaauggagaaaca

SEQ ID NO: 538854 - RNA, 19 nt, Homo sapiens
aaucacagcuuguuauaca

SEQ ID NO: 538855 - RNA, 19 nt, Homo sapiens
gaauguaacgaaugugaaa

SEQ ID NO: 538856 - RNA, 19 nt, Homo sapiens
gagaagccauaugaaugua

SEQ ID NO: 538857 - RNA, 19 nt, Homo sapiens
gcucaucucuuacuuacca

SEQ ID NO: 538858 - RNA, 19 nt, Homo sapiens
ugagaaacccuuugaaugu

SEQ ID NO: 538859 - RNA, 19 nt, Homo sapiens
guacuuaagcaccauauau

SEQ ID NO: 538860 - RNA, 19 nt, Homo sapiens
gagagaaacaugagaaauc

SEQ ID NO: 538861 - RNA, 19 nt, Homo sapiens
gaagaaaacucaagcuaag

SEQ ID NO: 538862 - RNA, 19 nt, Homo sapiens
gggagaaaccuuaugaaug

SEQ ID NO: 538863 - RNA, 19 nt, Homo sapiens
caggugaaauaccauauga

SEQ ID NO: 538864 - RNA, 19 nt, Homo sapiens
agccuuagcucaucuacua

SEQ ID NO: 538865 - RNA, 19 nt, Homo sapiens
uaaagcagcugaggauaca

SEQ ID NO: 538866 - RNA, 19 nt, Homo sapiens
gaccaucuaagaauucaua

SEQ ID NO: 538867 - RNA, 19 nt, Homo sapiens
gaaacccuaugaauguaau

SEQ ID NO: 538868 - RNA, 19 nt, Homo sapiens
caagaagucacaccucauu

SEQ ID NO: 538869 - RNA, 19 nt, Homo sapiens
gagaacacauacaggugaa

SEQ ID NO: 538870 - RNA, 19 nt, Homo sapiens
gagaaaucacccagccuua

SEQ ID NO: 538871 - RNA, 19 nt, Homo sapiens
gagaaaccuuaugaaugua

SEQ ID NO: 538872 - RNA, 19 nt, Homo sapiens
agaaacccuuugaauguaa

SEQ ID NO: 538873 - RNA, 19 nt, Homo sapiens
uagaaucaguggauggaaa

SEQ ID NO: 538874 - RNA, 19 nt, Homo sapiens
gugggaaauuuguuaacua

SEQ ID NO: 538875 - RNA, 19 nt, Homo sapiens
ccaaaagucucaccucauu

SEQ ID NO: 538876 - RNA, 19 nt, Homo sapiens
caacaucagagaguucaua

SEQ ID NO: 538877 - RNA, 19 nt, Homo sapiens
gagaaaagcccuaugaaug

SEQ ID NO: 538878 - RNA, 19 nt, Homo sapiens
gugaaacccuaugaaugua

SEQ ID NO: 538879 - RNA, 19 nt, Homo sapiens
agagaaacaugagaaauca

SEQ ID NO: 538880 - RNA, 19 nt, Homo sapiens
gcucaucugauaaguguaa

SEQ ID NO: 538881 - RNA, 19 nt, Homo sapiens
uagcucaucugauaagugu

SEQ ID NO: 538882 - RNA, 19 nt, Homo sapiens
gaacacaagaagucauuca

SEQ ID NO: 538883 - RNA, 19 nt, Homo sapiens
gaugaugaccagcuugaaa

SEQ ID NO: 538884 - RNA, 19 nt, Homo sapiens
agucaagguuguccaagua

SEQ ID NO: 538885 - RNA, 19 nt, Homo sapiens
gaaguuaaugugggaaauu

SEQ ID NO: 538886 - RNA, 19 nt, Homo sapiens
gagaaaccguaugagugua

SEQ ID NO: 538887 - RNA, 19 nt, Homo sapiens
ggagagaaaccguaugagu

SEQ ID NO: 538888 - RNA, 19 nt, Homo sapiens
guauguguauguaucuuug

SEQ ID NO: 538889 - RNA, 19 nt, Homo sapiens
ccauaugaaugcaaugaau

SEQ ID NO: 538890 - RNA, 19 nt, Homo sapiens
ggaaagaaacaugagaaau

SEQ ID NO: 538891 - RNA, 19 nt, Homo sapiens
agauuuaccugaucacuca

SEQ ID NO: 538892 - RNA, 19 nt, Homo sapiens
guauaagccucuuugacau

SEQ ID NO: 538893 - RNA, 19 nt, Homo sapiens
caccauauauuagaguuga

SEQ ID NO: 538894 - RNA, 19 nt, Homo sapiens
gaagccauaugaauguaag

SEQ ID NO: 538895 - RNA, 19 nt, Homo sapiens
gaaauuauccagccauagc

SEQ ID NO: 538896 - RNA, 19 nt, Homo sapiens
gaaauaccauaugaaugca

SEQ ID NO: 538897 - RNA, 19 nt, Homo sapiens
ugaaauaccauaugaaugc

SEQ ID NO: 538898 - RNA, 19 nt, Homo sapiens
ggugaaauaccauaugaau

SEQ ID NO: 538899 - RNA, 19 nt, Homo sapiens
aagaagucauucaaccaua

SEQ ID NO: 538900 - RNA, 19 nt, Homo sapiens
guaugugaauagacuuuga

SEQ ID NO: 538901 - RNA, 19 nt, Homo sapiens
gcugaaccauguauauagu

SEQ ID NO: 538902 - RNA, 19 nt, Homo sapiens
gaaacccuuugaauguaau

SEQ ID NO: 538903 - RNA, 19 nt, Homo sapiens
gaaugugggauagccuuua

SEQ ID NO: 538904 - RNA, 19 nt, Homo sapiens
gggagaaaccauaugaaug

SEQ ID NO: 538905 - RNA, 19 nt, Homo sapiens
uaaucaauguggaaagguu

SEQ ID NO: 538906 - RNA, 19 nt, Homo sapiens
aaacucaagcuaagaagaa

SEQ ID NO: 538907 - RNA, 19 nt, Homo sapiens
gaaguugcagucaagaaga

SEQ ID NO: 538908 - RNA, 19 nt, Homo sapiens
uaaccucugucucuuaucu

SEQ ID NO: 538909 - RNA, 19 nt, Homo sapiens
ccauguauauaguauguuc

SEQ ID NO: 538910 - RNA, 19 nt, Homo sapiens
gaguugaauuugcauaucu

SEQ ID NO: 538911 - RNA, 19 nt, Homo sapiens
gaugucacaccuuguugua

SEQ ID NO: 538912 - RNA, 19 nt, Homo sapiens
gugagaaacccuuugaaug

SEQ ID NO: 538913 - RNA, 19 nt, Homo sapiens
cagagcaaccuguauaaug

SEQ ID NO: 538914 - RNA, 19 nt, Homo sapiens
ggaagucuuuuagguauaa

SEQ ID NO: 538915 - RNA, 19 nt, Homo sapiens
aaacauguuccuucaaaga

SEQ ID NO: 538916 - RNA, 19 nt, Homo sapiens
cuaaacacaugagaauuca

SEQ ID NO: 538917 - RNA, 19 nt, Homo sapiens
caagaacacugcacaaaua

SEQ ID NO: 538918 - RNA, 19 nt, Homo sapiens
gaacacugcacaaauauaa

SEQ ID NO: 538919 - RNA, 19 nt, Homo sapiens
ccucaagccuuaacauuua

SEQ ID NO: 538920 - RNA, 19 nt, Homo sapiens
gauaauagccugaguuguu

SEQ ID NO: 538921 - RNA, 19 nt, Homo sapiens
gaaaugguguuccucaguu

SEQ ID NO: 538922 - RNA, 19 nt, Homo sapiens
caaggcaucugaucugaaa

SEQ ID NO: 538923 - RNA, 19 nt, Homo sapiens
gauaaacuguguucucaga

SEQ ID NO: 538924 - RNA, 19 nt, Homo sapiens
guauuaauguugccaguaa

SEQ ID NO: 538925 - RNA, 19 nt, Homo sapiens
gaaaugccaacaauaguuu

SEQ ID NO: 538926 - RNA, 19 nt, Homo sapiens
cagauaacuucuucagaua

SEQ ID NO: 538927 - RNA, 19 nt, Homo sapiens
gcucuuagguuccucuuau

SEQ ID NO: 538928 - RNA, 19 nt, Homo sapiens
ggaaacguaugaacauugu

SEQ ID NO: 538929 - RNA, 19 nt, Homo sapiens
cagcaaagauuuccgugaa

SEQ ID NO: 538930 - RNA, 19 nt, Homo sapiens
uaaaggagaugcaguaugc

SEQ ID NO: 538931 - RNA, 19 nt, Homo sapiens
ggcguuagauuuauauuug

SEQ ID NO: 538932 - RNA, 19 nt, Homo sapiens
ccagugacaugaaguuuga

SEQ ID NO: 538933 - RNA, 19 nt, Homo sapiens
cccaagauuuccuagauua

SEQ ID NO: 538934 - RNA, 19 nt, Homo sapiens
ugucuggugucuaguauua

SEQ ID NO: 538935 - RNA, 19 nt, Homo sapiens
gaaggagaauuuugugaua

SEQ ID NO: 538936 - RNA, 19 nt, Homo sapiens
gaaugccaguuacaauauu

SEQ ID NO: 538937 - RNA, 19 nt, Homo sapiens
ccucaaggaucaugaaaga

SEQ ID NO: 538938 - RNA, 19 nt, Homo sapiens
gacaaagccuucaaacaca

SEQ ID NO: 538939 - RNA, 19 nt, Homo sapiens
ugagugaagugaaagauga

SEQ ID NO: 538940 - RNA, 19 nt, Homo sapiens
guucaaggcauuaagauaa

SEQ ID NO: 538941 - RNA, 19 nt, Homo sapiens
acagauaacuucuucagau

SEQ ID NO: 538942 - RNA, 19 nt, Homo sapiens
gacaaauaaugguugcuuu

SEQ ID NO: 538943 - RNA, 19 nt, Homo sapiens
gcacagaguaauaaguaaa

SEQ ID NO: 538944 - RNA, 19 nt, Homo sapiens
uugaagagguccugaacua

SEQ ID NO: 538945 - RNA, 19 nt, Homo sapiens
uuaaggcagugcuugguua

SEQ ID NO: 538946 - RNA, 19 nt, Homo sapiens
ggacaacagccgccaguga

SEQ ID NO: 538947 - RNA, 19 nt, Homo sapiens
gauaacuucuucagauaca

SEQ ID NO: 538948 - RNA, 19 nt, Homo sapiens
gacaagaacagauaacuuc

SEQ ID NO: 538949 - RNA, 19 nt, Homo sapiens
ggacaggccauuuguuugu

SEQ ID NO: 538950 - RNA, 19 nt, Homo sapiens
agaacaauaugcacaguga

SEQ ID NO: 538951 - RNA, 19 nt, Homo sapiens
gugaaugccaguuacaaua

SEQ ID NO: 538952 - RNA, 19 nt, Homo sapiens
ccacaacgcucaggguuca

SEQ ID NO: 538953 - RNA, 19 nt, Homo sapiens
gaagagguccugaacuaca

SEQ ID NO: 538954 - RNA, 19 nt, Homo sapiens
ggacaagaacagauaacuu

SEQ ID NO: 538955 - RNA, 19 nt, Homo sapiens
uaaagaagcaugagagagu

SEQ ID NO: 538956 - RNA, 19 nt, Homo sapiens
gacaugaaguuugaguauu

SEQ ID NO: 538957 - RNA, 19 nt, Homo sapiens
gaaauucagagcacacaga

SEQ ID NO: 538958 - RNA, 19 nt, Homo sapiens
gcaacaaacaucagacugu

SEQ ID NO: 538959 - RNA, 19 nt, Homo sapiens
gaguggaccugugguaaga

SEQ ID NO: 538960 - RNA, 19 nt, Homo sapiens
ugagagaguucacaguaau

SEQ ID NO: 538961 - RNA, 19 nt, Homo sapiens
ggaugaugauguagaggaa

SEQ ID NO: 538962 - RNA, 19 nt, Homo sapiens
uaaaauaaaucgccccauu

SEQ ID NO: 538963 - RNA, 19 nt, Homo sapiens
caguaugucugaaaccauu

SEQ ID NO: 538964 - RNA, 19 nt, Homo sapiens
gcggacaggccauuuguuu

SEQ ID NO: 538965 - RNA, 19 nt, Homo sapiens
agacugagaugacguggau

SEQ ID NO: 538966 - RNA, 19 nt, Homo sapiens
acacaagucucaccucaag

SEQ ID NO: 538967 - RNA, 19 nt, Homo sapiens
caugagagaguucacagua

SEQ ID NO: 538968 - RNA, 19 nt, Homo sapiens
ggaagacguuuucugauga

SEQ ID NO: 538969 - RNA, 19 nt, Homo sapiens
ccauaaaggagaugcagua

SEQ ID NO: 538970 - RNA, 19 nt, Homo sapiens
gaacagauaacuucuucag

SEQ ID NO: 538971 - RNA, 19 nt, Homo sapiens
gaaaguggagacugagaug

SEQ ID NO: 538972 - RNA, 19 nt, Homo sapiens
caaggaucaugaaagaaga

SEQ ID NO: 538973 - RNA, 19 nt, Homo sapiens
cagaaugucaucaagcuuu

SEQ ID NO: 538974 - RNA, 19 nt, Homo sapiens
uaacuuccaucagcaacaa

SEQ ID NO: 538975 - RNA, 19 nt, Homo sapiens
gcagauugaggaagcauga

SEQ ID NO: 538976 - RNA, 19 nt, Homo sapiens
aaacaauggucaguccaaa

SEQ ID NO: 538977 - RNA, 19 nt, Homo sapiens
gagcgagacagaacaguug

SEQ ID NO: 538978 - RNA, 19 nt, Homo sapiens
gcugugagguguguggaaa

SEQ ID NO: 538979 - RNA, 19 nt, Homo sapiens
ugaaagagcuggggaguga

SEQ ID NO: 538980 - RNA, 19 nt, Homo sapiens
ggcacaugauuuauccaua

SEQ ID NO: 538981 - RNA, 19 nt, Homo sapiens
ugacaaagccuucaaacac

SEQ ID NO: 538982 - RNA, 19 nt, Homo sapiens
ugauaguucuucggucaua

SEQ ID NO: 538983 - RNA, 19 nt, Homo sapiens
ggucuuacguauuccaagu

SEQ ID NO: 538984 - RNA, 19 nt, Homo sapiens
ggacaaauaaugguugcuu

SEQ ID NO: 538985 - RNA, 19 nt, Homo sapiens
ccaagaacacugcacaaau

SEQ ID NO: 538986 - RNA, 19 nt, Homo sapiens
ugauauugcuauugugguu

SEQ ID NO: 538987 - RNA, 19 nt, Homo sapiens
gcaagucgcccaccacaac

SEQ ID NO: 538988 - RNA, 19 nt, Homo sapiens
ugaaaugccaacaauaguu

SEQ ID NO: 538989 - RNA, 19 nt, Homo sapiens
ccuggaaaguggagacuga

SEQ ID NO: 538990 - RNA, 19 nt, Homo sapiens
cacccaggaugaugaugua

SEQ ID NO: 538991 - RNA, 19 nt, Homo sapiens
cagaccaaauguuuauguu

SEQ ID NO: 538992 - RNA, 19 nt, Homo sapiens
guguuggucuuacguauuc

SEQ ID NO: 538993 - RNA, 19 nt, Homo sapiens
aaagaagcaugagagaguu

SEQ ID NO: 538994 - RNA, 19 nt, Homo sapiens
gaaguuugaguauuugcuu

SEQ ID NO: 538995 - RNA, 19 nt, Homo sapiens
uggauaaacuguguucuca

SEQ ID NO: 538996 - RNA, 19 nt, Homo sapiens
gccaaggcaucugaucuga

SEQ ID NO: 538997 - RNA, 19 nt, Homo sapiens
acaaagccuucaaacacaa

SEQ ID NO: 538998 - RNA, 19 nt, Homo sapiens
ugacaugaaguuugaguau

SEQ ID NO: 538999 - RNA, 19 nt, Homo sapiens
agugaaagaugaacagaca

SEQ ID NO: 539000 - RNA, 19 nt, Homo sapiens
gaugacaguccuucugaug

SEQ ID NO: 539001 - RNA, 19 nt, Homo sapiens
uaaagauugucagaccaaa

SEQ ID NO: 539002 - RNA, 19 nt, Homo sapiens
gugguaagaagaauagaaa

SEQ ID NO: 539003 - RNA, 19 nt, Homo sapiens
ggaccugugguaagaagaa

SEQ ID NO: 539004 - RNA, 19 nt, Homo sapiens
gggaagacguuuucugaug

SEQ ID NO: 539005 - RNA, 19 nt, Homo sapiens
ugggaugagugaagugaaa

SEQ ID NO: 539006 - RNA, 19 nt, Homo sapiens
cugcacagaguaauaagua

SEQ ID NO: 539007 - RNA, 19 nt, Homo sapiens
guggaaacguaugaacauu

SEQ ID NO: 539008 - RNA, 19 nt, Homo sapiens
ugaaugccaguuacaauau

SEQ ID NO: 539009 - RNA, 19 nt, Homo sapiens
uaagauaauagccugaguu

SEQ ID NO: 539010 - RNA, 19 nt, Homo sapiens
ugucuugucuggugucuag

SEQ ID NO: 539011 - RNA, 19 nt, Homo sapiens
gaacaauaugcacagugaa

SEQ ID NO: 539012 - RNA, 19 nt, Homo sapiens
gaucaugaaagaagacaca

SEQ ID NO: 539013 - RNA, 19 nt, Homo sapiens
gguugaggaugugaaauuc

SEQ ID NO: 539014 - RNA, 19 nt, Homo sapiens
ccagaccccucaagccuua

SEQ ID NO: 539015 - RNA, 19 nt, Homo sapiens
gauucuugguauccgauuu

SEQ ID NO: 539016 - RNA, 19 nt, Homo sapiens
ccaagauuuccuagauuaa

SEQ ID NO: 539017 - RNA, 19 nt, Homo sapiens
gagagaagcuggccacagu

SEQ ID NO: 539018 - RNA, 19 nt, Homo sapiens
caacacgucugacuucucu

SEQ ID NO: 539019 - RNA, 19 nt, Homo sapiens
ugaccaaccuguucugcuu

SEQ ID NO: 539020 - RNA, 19 nt, Homo sapiens
ugucugcuaugaucucuuu

SEQ ID NO: 539021 - RNA, 19 nt, Homo sapiens
ugcaauggcuccaagauag

SEQ ID NO: 539022 - RNA, 19 nt, Homo sapiens
aagcauuugucuugacuug

SEQ ID NO: 539023 - RNA, 19 nt, Homo sapiens
cgacccgccuugucugcua

SEQ ID NO: 539024 - RNA, 19 nt, Homo sapiens
gcauuugucuugacuugcu

SEQ ID NO: 539025 - RNA, 19 nt, Homo sapiens
ccuaggaagguguaugaua

SEQ ID NO: 539026 - RNA, 19 nt, Homo sapiens
ucacugggccugccucaau

SEQ ID NO: 539027 - RNA, 19 nt, Homo sapiens
gcacacagugauccacaug

SEQ ID NO: 539028 - RNA, 19 nt, Homo sapiens
gcuccaagauagcgacuac

SEQ ID NO: 539029 - RNA, 19 nt, Homo sapiens
caaccuggacccacucaug

SEQ ID NO: 539030 - RNA, 19 nt, Homo sapiens
ccucaagccuaagacacua

SEQ ID NO: 539031 - RNA, 19 nt, Homo sapiens
acuggcagguggaaauaaa

SEQ ID NO: 539032 - RNA, 19 nt, Homo sapiens
gagaagcuggccacaguca

SEQ ID NO: 539033 - RNA, 19 nt, Homo sapiens
gccgaucaguaaacacaga

SEQ ID NO: 539034 - RNA, 19 nt, Homo sapiens
ugacuuggucuuaguuuua

SEQ ID NO: 539035 - RNA, 19 nt, Homo sapiens
cgucugacuucucugacuu

SEQ ID NO: 539036 - RNA, 19 nt, Homo sapiens
cugcaauggcuccaagaua

SEQ ID NO: 539037 - RNA, 19 nt, Homo sapiens
gaagcuggccacagucaac

SEQ ID NO: 539038 - RNA, 19 nt, Homo sapiens
cgccuugucugcuaugauc

SEQ ID NO: 539039 - RNA, 19 nt, Homo sapiens
guaagugccccaagagaaa

SEQ ID NO: 539040 - RNA, 19 nt, Homo sapiens
ccuaggauguggguucugu

SEQ ID NO: 539041 - RNA, 19 nt, Homo sapiens
ccucaacacgucugacuuc

SEQ ID NO: 539042 - RNA, 19 nt, Homo sapiens
caaccuguucugcuucgaa

SEQ ID NO: 539043 - RNA, 19 nt, Homo sapiens
gcaccugccggcuaucagu

SEQ ID NO: 539044 - RNA, 19 nt, Homo sapiens
agacuggcagguggaaaua

SEQ ID NO: 539045 - RNA, 19 nt, Homo sapiens
ccauggagacugugacgau

SEQ ID NO: 539046 - RNA, 19 nt, Homo sapiens
ucucugacuuggucuuagu

SEQ ID NO: 539047 - RNA, 19 nt, Homo sapiens
acacgucugacuucucuga

SEQ ID NO: 539048 - RNA, 19 nt, Homo sapiens
gacccgccuugucugcuau

SEQ ID NO: 539049 - RNA, 19 nt, Homo sapiens
gacuuggucuuaguuuuaa

SEQ ID NO: 539050 - RNA, 19 nt, Homo sapiens
ccaagagaaaggugaccaa

SEQ ID NO: 539051 - RNA, 19 nt, Homo sapiens
gaagacuggcagguggaaa

SEQ ID NO: 539052 - RNA, 19 nt, Homo sapiens
gggccucccucugaucgau

SEQ ID NO: 539053 - RNA, 19 nt, Homo sapiens
gcagguggaaauaaacaac

SEQ ID NO: 539054 - RNA, 19 nt, Homo sapiens
aaccuggacccacucauga

SEQ ID NO: 539055 - RNA, 19 nt, Homo sapiens
cacugggccugccucaaug

SEQ ID NO: 539056 - RNA, 19 nt, Homo sapiens
gaacaaggguuauugaauc

SEQ ID NO: 539057 - RNA, 19 nt, Homo sapiens
gcaaauggaugacaaugaa

SEQ ID NO: 539058 - RNA, 19 nt, Homo sapiens
gccagaagaugaagauuua

SEQ ID NO: 539059 - RNA, 19 nt, Homo sapiens
caaaggaucuuccauuuag

SEQ ID NO: 539060 - RNA, 19 nt, Homo sapiens
guaaagagaugccauucaa

SEQ ID NO: 539061 - RNA, 19 nt, Homo sapiens
ugaaaucgcugacgaaguu

SEQ ID NO: 539062 - RNA, 19 nt, Homo sapiens
ggaaauugauccuuguaaa

SEQ ID NO: 539063 - RNA, 19 nt, Homo sapiens
gaacuuuccucauauuugu

SEQ ID NO: 539064 - RNA, 19 nt, Homo sapiens
gcaagaacuuuccucauau

SEQ ID NO: 539065 - RNA, 19 nt, Homo sapiens
gaagauaaguuuacacaac

SEQ ID NO: 539066 - RNA, 19 nt, Homo sapiens
gaagaugacuuagguggaa

SEQ ID NO: 539067 - RNA, 19 nt, Homo sapiens
gcaacaugcuaguuacuuu

SEQ ID NO: 539068 - RNA, 19 nt, Homo sapiens
gcagauccauuuguucuaa

SEQ ID NO: 539069 - RNA, 19 nt, Homo sapiens
cgacguaguuucagaagaa

SEQ ID NO: 539070 - RNA, 19 nt, Homo sapiens
ugacuuagguggaacugua

SEQ ID NO: 539071 - RNA, 19 nt, Homo sapiens
cacaaaggaucuuccauuu

SEQ ID NO: 539072 - RNA, 19 nt, Homo sapiens
ccaaagaggugcagcaaca

SEQ ID NO: 539073 - RNA, 19 nt, Homo sapiens
gcacaaguguaaauucugu

SEQ ID NO: 539074 - RNA, 19 nt, Homo sapiens
gaacguuuguagagauauu

SEQ ID NO: 539075 - RNA, 19 nt, Homo sapiens
gaucagaacagcaguauuc

SEQ ID NO: 539076 - RNA, 19 nt, Homo sapiens
gauguucagugcccagaua

SEQ ID NO: 539077 - RNA, 19 nt, Homo sapiens
gaaaagaaccagcacauaa

SEQ ID NO: 539078 - RNA, 19 nt, Homo sapiens
caagaacuuuccucauauu

SEQ ID NO: 539079 - RNA, 19 nt, Homo sapiens
ggaugacaaugaaaucaaa

SEQ ID NO: 539080 - RNA, 19 nt, Homo sapiens
ugacgaaguuuauauggaa

SEQ ID NO: 539081 - RNA, 19 nt, Homo sapiens
gggaaaagaugguuuauau

SEQ ID NO: 539082 - RNA, 19 nt, Homo sapiens
caguggauguucaagauua

SEQ ID NO: 539083 - RNA, 19 nt, Homo sapiens
agcaagaacuuuccucaua

SEQ ID NO: 539084 - RNA, 19 nt, Homo sapiens
ggaaagacauagaagaacu

SEQ ID NO: 539085 - RNA, 19 nt, Homo sapiens
aagcagaaauugucacuga

SEQ ID NO: 539086 - RNA, 19 nt, Homo sapiens
guaccaaacagcaauaauu

SEQ ID NO: 539087 - RNA, 19 nt, Homo sapiens
gaaugaccauggacacaga

SEQ ID NO: 539088 - RNA, 19 nt, Homo sapiens
gcccagauaucauggaaga

SEQ ID NO: 539089 - RNA, 19 nt, Homo sapiens
guguagacauugugacuuu

SEQ ID NO: 539090 - RNA, 19 nt, Homo sapiens
ggaagaagcagaugugucu

SEQ ID NO: 539091 - RNA, 19 nt, Homo sapiens
ugacccagauucaguugua

SEQ ID NO: 539092 - RNA, 19 nt, Homo sapiens
uaaaggccauggaugaaga

SEQ ID NO: 539093 - RNA, 19 nt, Homo sapiens
gaaagacauagaagaacua

SEQ ID NO: 539094 - RNA, 19 nt, Homo sapiens
guagagauauuggccuuga

SEQ ID NO: 539095 - RNA, 19 nt, Homo sapiens
cuucagaacucaagaaaca

SEQ ID NO: 539096 - RNA, 19 nt, Homo sapiens
agagugagccugagaauga

SEQ ID NO: 539097 - RNA, 19 nt, Homo sapiens
uaagauugcagauccauuu

SEQ ID NO: 539098 - RNA, 19 nt, Homo sapiens
ccaacaagaagauaaguuu

SEQ ID NO: 539099 - RNA, 19 nt, Homo sapiens
ggacacagagucggaaauu

SEQ ID NO: 539100 - RNA, 19 nt, Homo sapiens
gagucaaguugugugauua

SEQ ID NO: 539101 - RNA, 19 nt, Homo sapiens
cagaacguuuguagagaua

SEQ ID NO: 539102 - RNA, 19 nt, Homo sapiens
acauuugucuucugacuuu

SEQ ID NO: 539103 - RNA, 19 nt, Homo sapiens
gggagaagccguaccaaug

SEQ ID NO: 539104 - RNA, 19 nt, Homo sapiens
gguaauaauucugauggaa

SEQ ID NO: 539105 - RNA, 19 nt, Homo sapiens
ggaugaagaugggcuugaa

SEQ ID NO: 539106 - RNA, 19 nt, Homo sapiens
gauugcagauccauuuguu

SEQ ID NO: 539107 - RNA, 19 nt, Homo sapiens
gauuugaaacgacacauaa

SEQ ID NO: 539108 - RNA, 19 nt, Homo sapiens
ucaaauuguuguggaagua

SEQ ID NO: 539109 - RNA, 19 nt, Homo sapiens
gaguauagcacuacagaug

SEQ ID NO: 539110 - RNA, 19 nt, Homo sapiens
gcaacagagugagcuuaaa

SEQ ID NO: 539111 - RNA, 19 nt, Homo sapiens
gaaauugauccuuguaaag

SEQ ID NO: 539112 - RNA, 19 nt, Homo sapiens
acacauggauggugaucaa

SEQ ID NO: 539113 - RNA, 19 nt, Homo sapiens
acaaaggaucuuccauuua

SEQ ID NO: 539114 - RNA, 19 nt, Homo sapiens
cauugugacuuuaagauug

SEQ ID NO: 539115 - RNA, 19 nt, Homo sapiens
gaaugaucauggaguugaa

SEQ ID NO: 539116 - RNA, 19 nt, Homo sapiens
ggauggugaucaaauuguu

SEQ ID NO: 539117 - RNA, 19 nt, Homo sapiens
ugaagaugggcuugaauua

SEQ ID NO: 539118 - RNA, 19 nt, Homo sapiens
ccagcaggaugaugacaaa

SEQ ID NO: 539119 - RNA, 19 nt, Homo sapiens
ugaggacguuguuauagaa

SEQ ID NO: 539120 - RNA, 19 nt, Homo sapiens
gauuuaugcuguguacaaa

SEQ ID NO: 539121 - RNA, 19 nt, Homo sapiens
gugcuggacucagauguaa

SEQ ID NO: 539122 - RNA, 19 nt, Homo sapiens
cauggauggugaucaaauu

SEQ ID NO: 539123 - RNA, 19 nt, Homo sapiens
gggaagcauuucucucaug

SEQ ID NO: 539124 - RNA, 19 nt, Homo sapiens
ggcagcagcuuaugguaau

SEQ ID NO: 539125 - RNA, 19 nt, Homo sapiens
ugagaaugaucauggaguu

SEQ ID NO: 539126 - RNA, 19 nt, Homo sapiens
acacagagucggaaauuga

SEQ ID NO: 539127 - RNA, 19 nt, Homo sapiens
ggaaguacaagaaacuguu

SEQ ID NO: 539128 - RNA, 19 nt, Homo sapiens
gaaagggauuuaggcaaca

SEQ ID NO: 539129 - RNA, 19 nt, Homo sapiens
ucacaggccuucagaacuc

SEQ ID NO: 539130 - RNA, 19 nt, Homo sapiens
aagaagaaauaccgcugua

SEQ ID NO: 539131 - RNA, 19 nt, Homo sapiens
gaaguuucuuuagcacauu

SEQ ID NO: 539132 - RNA, 19 nt, Homo sapiens
ggacguuguuauagaagau

SEQ ID NO: 539133 - RNA, 19 nt, Homo sapiens
caggagcugugacugauga

SEQ ID NO: 539134 - RNA, 19 nt, Homo sapiens
cacauaaugcgacaucaua

SEQ ID NO: 539135 - RNA, 19 nt, Homo sapiens
ggaaaguguaucaguguga

SEQ ID NO: 539136 - RNA, 19 nt, Homo sapiens
ccauuuaggugcaagagau

SEQ ID NO: 539137 - RNA, 19 nt, Homo sapiens
gcagagaaggccauugaau

SEQ ID NO: 539138 - RNA, 19 nt, Homo sapiens
aagaugggcuugaauuaca

SEQ ID NO: 539139 - RNA, 19 nt, Homo sapiens
gaggacuaccuuaugauuu

SEQ ID NO: 539140 - RNA, 19 nt, Homo sapiens
uaauuucaguucacacgaa

SEQ ID NO: 539141 - RNA, 19 nt, Homo sapiens
ugugaggacuaccuuauga

SEQ ID NO: 539142 - RNA, 19 nt, Homo sapiens
acacaaaggaucuuccauu

SEQ ID NO: 539143 - RNA, 19 nt, Homo sapiens
gaagaugggcuugaauuac

SEQ ID NO: 539144 - RNA, 19 nt, Homo sapiens
gcaccaguguagacauugu

SEQ ID NO: 539145 - RNA, 19 nt, Homo sapiens
gaagaaauaccgcuguacu

SEQ ID NO: 539146 - RNA, 19 nt, Homo sapiens
gggcagcagcuuaugguaa

SEQ ID NO: 539147 - RNA, 19 nt, Homo sapiens
agagucaaguugugugauu

SEQ ID NO: 539148 - RNA, 19 nt, Homo sapiens
guagacauugugacuuuaa

SEQ ID NO: 539149 - RNA, 19 nt, Homo sapiens
ccauaagugugacaugugu

SEQ ID NO: 539150 - RNA, 19 nt, Homo sapiens
gcagcagcuuaugguaaua

SEQ ID NO: 539151 - RNA, 19 nt, Homo sapiens
gcccugaggucaucaaggu

SEQ ID NO: 539152 - RNA, 19 nt, Homo sapiens
ggucaucauuccugagcaa

SEQ ID NO: 539153 - RNA, 19 nt, Homo sapiens
agacauaacugugcauaac

SEQ ID NO: 539154 - RNA, 19 nt, Homo sapiens
caaguugugugauuaagac

SEQ ID NO: 539155 - RNA, 19 nt, Homo sapiens
gcaguaccaaacagcaaua

SEQ ID NO: 539156 - RNA, 19 nt, Homo sapiens
gaacauauggugcaugaua

SEQ ID NO: 539157 - RNA, 19 nt, Homo sapiens
caaaggaucuuccauuuag

SEQ ID NO: 539158 - RNA, 19 nt, Homo sapiens
guaaagagaugccauucaa

SEQ ID NO: 539159 - RNA, 19 nt, Homo sapiens
gaacuuuccucauauuugu

SEQ ID NO: 539160 - RNA, 19 nt, Homo sapiens
ugacauaguuucagaagaa

SEQ ID NO: 539161 - RNA, 19 nt, Homo sapiens
gcaagaacuuuccucauau

SEQ ID NO: 539162 - RNA, 19 nt, Homo sapiens
ggaugaagaugaauuugaa

SEQ ID NO: 539163 - RNA, 19 nt, Homo sapiens
ugaaauugcugaugaaguu

SEQ ID NO: 539164 - RNA, 19 nt, Homo sapiens
gaagaugacuuagguggaa

SEQ ID NO: 539165 - RNA, 19 nt, Homo sapiens
ugacuuagguggaacugua

SEQ ID NO: 539166 - RNA, 19 nt, Homo sapiens
gaaagacuauccucauaag

SEQ ID NO: 539167 - RNA, 19 nt, Homo sapiens
gaccaucgaugcagaauca

SEQ ID NO: 539168 - RNA, 19 nt, Homo sapiens
gauguucagugcucagaua

SEQ ID NO: 539169 - RNA, 19 nt, Homo sapiens
cacaaaggaucuuccauuu

SEQ ID NO: 539170 - RNA, 19 nt, Homo sapiens
gcacaaguguaaauucugu

SEQ ID NO: 539171 - RNA, 19 nt, Homo sapiens
gaucuuccauuuaggugua

SEQ ID NO: 539172 - RNA, 19 nt, Homo sapiens
gaucagaacagcaguauuc

SEQ ID NO: 539173 - RNA, 19 nt, Homo sapiens
caaugacucucaacaagaa

SEQ ID NO: 539174 - RNA, 19 nt, Homo sapiens
gaaaagaaccagcacauaa

SEQ ID NO: 539175 - RNA, 19 nt, Homo sapiens
caagaacuuuccucauauu

SEQ ID NO: 539176 - RNA, 19 nt, Homo sapiens
agaaauggauccuuguaaa

SEQ ID NO: 539177 - RNA, 19 nt, Homo sapiens
ucaauacgcuguccugaau

SEQ ID NO: 539178 - RNA, 19 nt, Homo sapiens
guaaagauguuggccuuga

SEQ ID NO: 539179 - RNA, 19 nt, Homo sapiens
gcaaauugaugaggaugaa

SEQ ID NO: 539180 - RNA, 19 nt, Homo sapiens
gggaaaagaugguuuauau

SEQ ID NO: 539181 - RNA, 19 nt, Homo sapiens
aagcagaaaucauuacuga

SEQ ID NO: 539182 - RNA, 19 nt, Homo sapiens
ucacaggccuucagaacuu

SEQ ID NO: 539183 - RNA, 19 nt, Homo sapiens
agcaagaacuuuccucaua

SEQ ID NO: 539184 - RNA, 19 nt, Homo sapiens
ggaaauacaagaagcaguu

SEQ ID NO: 539185 - RNA, 19 nt, Homo sapiens
ccaaagaagugcagcaaca

SEQ ID NO: 539186 - RNA, 19 nt, Homo sapiens
ggauagcacuuguccugaa

SEQ ID NO: 539187 - RNA, 19 nt, Homo sapiens
gcagacccauuuguucuaa

SEQ ID NO: 539188 - RNA, 19 nt, Homo sapiens
guaccaaacagcaauaauu

SEQ ID NO: 539189 - RNA, 19 nt, Homo sapiens
cuucagaacuuaagaaaca

SEQ ID NO: 539190 - RNA, 19 nt, Homo sapiens
gaacagggguuauugaauc

SEQ ID NO: 539191 - RNA, 19 nt, Homo sapiens
gugauuacacuaccaauaa

SEQ ID NO: 539192 - RNA, 19 nt, Homo sapiens
ccagcaagauaaugacaaa

SEQ ID NO: 539193 - RNA, 19 nt, Homo sapiens
acauuugucuucugacuuu

SEQ ID NO: 539194 - RNA, 19 nt, Homo sapiens
gguaauaauucugauggaa

SEQ ID NO: 539195 - RNA, 19 nt, Homo sapiens
uguugaagauguugucaua

SEQ ID NO: 539196 - RNA, 19 nt, Homo sapiens
ucacauccauuacuauaca

SEQ ID NO: 539197 - RNA, 19 nt, Homo sapiens
cgaaagacuauccucauaa

SEQ ID NO: 539198 - RNA, 19 nt, Homo sapiens
acgaaagacuauccucaua

SEQ ID NO: 539199 - RNA, 19 nt, Homo sapiens
gauuugaaacgacauguaa

SEQ ID NO: 539200 - RNA, 19 nt, Homo sapiens
ggaugaugcuggcaaaaua

SEQ ID NO: 539201 - RNA, 19 nt, Homo sapiens
gaguauagcacuacagaug

SEQ ID NO: 539202 - RNA, 19 nt, Homo sapiens
uaagauugcagacccauuu

SEQ ID NO: 539203 - RNA, 19 nt, Homo sapiens
cagacuggcuaaacagaaa

SEQ ID NO: 539204 - RNA, 19 nt, Homo sapiens
ugaugaggaugaaaugaaa

SEQ ID NO: 539205 - RNA, 19 nt, Homo sapiens
uauuguggauucugacaua

SEQ ID NO: 539206 - RNA, 19 nt, Homo sapiens
cacguuauuuccauucaua

SEQ ID NO: 539207 - RNA, 19 nt, Homo sapiens
acaaaggaucuuccauuua

SEQ ID NO: 539208 - RNA, 19 nt, Homo sapiens
cauugugacuuuaagauug

SEQ ID NO: 539209 - RNA, 19 nt, Homo sapiens
ucagauuguuguggaaaua

SEQ ID NO: 539210 - RNA, 19 nt, Homo sapiens
uguaagagauguagaaagg

SEQ ID NO: 539211 - RNA, 19 nt, Homo sapiens
cacaagagccaaacucauu

SEQ ID NO: 539212 - RNA, 19 nt, Homo sapiens
gugcucagauaucuuagaa

SEQ ID NO: 539213 - RNA, 19 nt, Homo sapiens
ucagugcucagauaucuua

SEQ ID NO: 539214 - RNA, 19 nt, Homo sapiens
gagacaccauaaagaaguu

SEQ ID NO: 539215 - RNA, 19 nt, Homo sapiens
ccauuuagguguaagagau

SEQ ID NO: 539216 - RNA, 19 nt, Homo sapiens
gaaauggauccuuguaaag

SEQ ID NO: 539217 - RNA, 19 nt, Homo sapiens
gugcuggacucagauguaa

SEQ ID NO: 539218 - RNA, 19 nt, Homo sapiens
ggcagcagcuuaugguaau

SEQ ID NO: 539219 - RNA, 19 nt, Homo sapiens
ugacauaacugugcauaac

SEQ ID NO: 539220 - RNA, 19 nt, Homo sapiens
cgagugacauaguuucaga

SEQ ID NO: 539221 - RNA, 19 nt, Homo sapiens
gacccagacucaguuguaa

SEQ ID NO: 539222 - RNA, 19 nt, Homo sapiens
guucacauccauuacuaua

SEQ ID NO: 539223 - RNA, 19 nt, Homo sapiens
uaaagauguuggccuugaa

SEQ ID NO: 539224 - RNA, 19 nt, Homo sapiens
aauaggagcugaugcuaca

SEQ ID NO: 539225 - RNA, 19 nt, Homo sapiens
gaaagggauuuaggcaaca

SEQ ID NO: 539226 - RNA, 19 nt, Homo sapiens
gcgagaagccauaccaaug

SEQ ID NO: 539227 - RNA, 19 nt, Homo sapiens
aagaagaaguaccacugua

SEQ ID NO: 539228 - RNA, 19 nt, Homo sapiens
aauccaagauguuguugaa

SEQ ID NO: 539229 - RNA, 19 nt, Homo sapiens
cuaauauuguggauucuga

SEQ ID NO: 539230 - RNA, 19 nt, Homo sapiens
gcagagaaggccauugaau

SEQ ID NO: 539231 - RNA, 19 nt, Homo sapiens
gaaauacaagaagcaguuu

SEQ ID NO: 539232 - RNA, 19 nt, Homo sapiens
ggaggaugcugcuguugca

SEQ ID NO: 539233 - RNA, 19 nt, Homo sapiens
gaggacuaccuaaugauuu

SEQ ID NO: 539234 - RNA, 19 nt, Homo sapiens
ugugaggacuaccuaauga

SEQ ID NO: 539235 - RNA, 19 nt, Homo sapiens
acacaaaggaucuuccauu

SEQ ID NO: 539236 - RNA, 19 nt, Homo sapiens
gggcagcagcuuaugguaa

SEQ ID NO: 539237 - RNA, 19 nt, Homo sapiens
gcagcaaauugaugaggau

SEQ ID NO: 539238 - RNA, 19 nt, Homo sapiens
uugaagauguugucauaga

SEQ ID NO: 539239 - RNA, 19 nt, Homo sapiens
guagacauugugacuuuaa

SEQ ID NO: 539240 - RNA, 19 nt, Homo sapiens
gcagcagcuuaugguaaua

SEQ ID NO: 539241 - RNA, 19 nt, Homo sapiens
ccaagauguuguugaagau

SEQ ID NO: 539242 - RNA, 19 nt, Homo sapiens
uccaagauguuguugaaga

SEQ ID NO: 539243 - RNA, 19 nt, Homo sapiens
agacuauccucauaagugu

SEQ ID NO: 539244 - RNA, 19 nt, Homo sapiens
aaagaagugcagcaacaua

SEQ ID NO: 539245 - RNA, 19 nt, Homo sapiens
gcaguaccaaacagcaaua

SEQ ID NO: 539246 - RNA, 19 nt, Homo sapiens
gcaugauaguguaguggaa

SEQ ID NO: 539247 - RNA, 19 nt, Homo sapiens
gacauuacuucaaccucaa

SEQ ID NO: 539248 - RNA, 19 nt, Homo sapiens
gaaccagcacauaaugaga

SEQ ID NO: 539249 - RNA, 19 nt, Homo sapiens
ggaaaguauaucaguguga

SEQ ID NO: 539250 - RNA, 19 nt, Homo sapiens
cauggauggugaucagauu

SEQ ID NO: 539251 - RNA, 19 nt, Homo sapiens
gcagacucuucuaacuuga

SEQ ID NO: 539252 - RNA, 19 nt, Homo sapiens
ugagaaagcacaugcgaau

SEQ ID NO: 539253 - RNA, 19 nt, Homo sapiens
uugcugaaauugcugauga

SEQ ID NO: 539254 - RNA, 19 nt, Homo sapiens
ccauucaagugugacauuu

SEQ ID NO: 539255 - RNA, 19 nt, Homo sapiens
gaaagcacaugcgaaucca

SEQ ID NO: 539256 - RNA, 19 nt, Homo sapiens
gaacucguauguacacuuu

SEQ ID NO: 539257 - RNA, 19 nt, Homo sapiens
gaaagaacccugcgaauca

SEQ ID NO: 539258 - RNA, 19 nt, Homo sapiens
gcaaacauuucgucccaaa

SEQ ID NO: 539259 - RNA, 19 nt, Homo sapiens
gaaaggagagagagagaaa

SEQ ID NO: 539260 - RNA, 19 nt, Homo sapiens
gucaagaauucguauagua

SEQ ID NO: 539261 - RNA, 19 nt, Homo sapiens
aaacuguacuguugaauuc

SEQ ID NO: 539262 - RNA, 19 nt, Homo sapiens
uagaagaacucguauguac

SEQ ID NO: 539263 - RNA, 19 nt, Homo sapiens
uguuacagcucuucaauau

SEQ ID NO: 539264 - RNA, 19 nt, Homo sapiens
acacguauacacaacauua

SEQ ID NO: 539265 - RNA, 19 nt, Homo sapiens
gaacaaaacccuauuuaag

SEQ ID NO: 539266 - RNA, 19 nt, Homo sapiens
cgaccuaacccaauauuau

SEQ ID NO: 539267 - RNA, 19 nt, Homo sapiens
gcacagcacagccucuuug

SEQ ID NO: 539268 - RNA, 19 nt, Homo sapiens
gugucaaacuguuccauuu

SEQ ID NO: 539269 - RNA, 19 nt, Homo sapiens
gaggccaccugaccaaaug

SEQ ID NO: 539270 - RNA, 19 nt, Homo sapiens
uuccagaacuguuugguaa

SEQ ID NO: 539271 - RNA, 19 nt, Homo sapiens
gaagauaaaccgcaaaaga

SEQ ID NO: 539272 - RNA, 19 nt, Homo sapiens
ccaaauacaaacugguuaa

SEQ ID NO: 539273 - RNA, 19 nt, Homo sapiens
cuucaaagccaaauacaaa

SEQ ID NO: 539274 - RNA, 19 nt, Homo sapiens
gccaguuucuugucgaauu

SEQ ID NO: 539275 - RNA, 19 nt, Homo sapiens
gcgacaagcccuaucuuug

SEQ ID NO: 539276 - RNA, 19 nt, Homo sapiens
gcuagaagaacucguaugu

SEQ ID NO: 539277 - RNA, 19 nt, Homo sapiens
gcaguaaaauguuguuuca

SEQ ID NO: 539278 - RNA, 19 nt, Homo sapiens
caaaagauacaaccacaua

SEQ ID NO: 539279 - RNA, 19 nt, Homo sapiens
acacaacauuacugaaaga

SEQ ID NO: 539280 - RNA, 19 nt, Homo sapiens
gugcaugauuugcgccuuu

SEQ ID NO: 539281 - RNA, 19 nt, Homo sapiens
gcuuaaaacuguacuguug

SEQ ID NO: 539282 - RNA, 19 nt, Homo sapiens
uuaagagacugaucacaca

SEQ ID NO: 539283 - RNA, 19 nt, Homo sapiens
agcaagagcucaucugcaa

SEQ ID NO: 539284 - RNA, 19 nt, Homo sapiens
gaggcgagcgugagagaaa

SEQ ID NO: 539285 - RNA, 19 nt, Homo sapiens
acagugcgcucucuuccaa

SEQ ID NO: 539286 - RNA, 19 nt, Homo sapiens
ccaguucgcugcgcaaaca

SEQ ID NO: 539287 - RNA, 19 nt, Homo sapiens
gaucacacacguauacaca

SEQ ID NO: 539288 - RNA, 19 nt, Homo sapiens
gacaagcccuaucuuugca

SEQ ID NO: 539289 - RNA, 19 nt, Homo sapiens
gaacuguuugguaaccuuu

SEQ ID NO: 539290 - RNA, 19 nt, Homo sapiens
ggccgaaagccaacuguuu

SEQ ID NO: 539291 - RNA, 19 nt, Homo sapiens
aaagaacccugcgaaucaa

SEQ ID NO: 539292 - RNA, 19 nt, Homo sapiens
guaaauguguaccaaaaug

SEQ ID NO: 539293 - RNA, 19 nt, Homo sapiens
gaaagccaacuguuuguac

SEQ ID NO: 539294 - RNA, 19 nt, Homo sapiens
ccaguuucuugucgaauug

SEQ ID NO: 539295 - RNA, 19 nt, Homo sapiens
gcgcucacauuccucuaug

SEQ ID NO: 539296 - RNA, 19 nt, Homo sapiens
gaagaacucguauguacac

SEQ ID NO: 539297 - RNA, 19 nt, Homo sapiens
gagaaaggagagagagaga

SEQ ID NO: 539298 - RNA, 19 nt, Homo sapiens
caauauuuauggcuagaag

SEQ ID NO: 539299 - RNA, 19 nt, Homo sapiens
gccgaaagccaacuguuug

SEQ ID NO: 539300 - RNA, 19 nt, Homo sapiens
aaccuuucguaccuuauua

SEQ ID NO: 539301 - RNA, 19 nt, Homo sapiens
gcugaggaggugaaaguuu

SEQ ID NO: 539302 - RNA, 19 nt, Homo sapiens
ccaacuguuuguacugaau

SEQ ID NO: 539303 - RNA, 19 nt, Homo sapiens
guauacacaacauuacuga

SEQ ID NO: 539304 - RNA, 19 nt, Homo sapiens
gccaacccaucaagcaaga

SEQ ID NO: 539305 - RNA, 19 nt, Homo sapiens
ugaaagaacccugcgaauc

SEQ ID NO: 539306 - RNA, 19 nt, Homo sapiens
cauguccugucaagaauuc

SEQ ID NO: 539307 - RNA, 19 nt, Homo sapiens
guacugaauggcaagaaug

SEQ ID NO: 539308 - RNA, 19 nt, Homo sapiens
uccuuucgcuuucauuauu

SEQ ID NO: 539309 - RNA, 19 nt, Homo sapiens
acaugaagguccacgaauc

SEQ ID NO: 539310 - RNA, 19 nt, Homo sapiens
caagagcucaucugcaagu

SEQ ID NO: 539311 - RNA, 19 nt, Homo sapiens
ccauauuuauccgcaugua

SEQ ID NO: 539312 - RNA, 19 nt, Homo sapiens
agacugaucacacacguau

SEQ ID NO: 539313 - RNA, 19 nt, Homo sapiens
cgacaagcccuaucuuugc

SEQ ID NO: 539314 - RNA, 19 nt, Homo sapiens
gcuccgagaauuuaaagau

SEQ ID NO: 539315 - RNA, 19 nt, Homo sapiens
gccaaauacaaacugguua

SEQ ID NO: 539316 - RNA, 19 nt, Homo sapiens
ggagcagaguaaucacauc

SEQ ID NO: 539317 - RNA, 19 nt, Homo sapiens
gagagaaaggagagagaga

SEQ ID NO: 539318 - RNA, 19 nt, Homo sapiens
guauguacacuuuaguuuc

SEQ ID NO: 539319 - RNA, 19 nt, Homo sapiens
cgaaagccaacuguuugua

SEQ ID NO: 539320 - RNA, 19 nt, Homo sapiens
ggaggccaccugaccaaau

SEQ ID NO: 539321 - RNA, 19 nt, Homo sapiens
guaaucacaucugcuucug

SEQ ID NO: 539322 - RNA, 19 nt, Homo sapiens
gugaauuacuuuguacgau

SEQ ID NO: 539323 - RNA, 19 nt, Homo sapiens
uaaccuuucguaccuuauu

SEQ ID NO: 539324 - RNA, 19 nt, Homo sapiens
ggaucugcgugucaaacug

SEQ ID NO: 539325 - RNA, 19 nt, Homo sapiens
uuucauguccugucaagaa

SEQ ID NO: 539326 - RNA, 19 nt, Homo sapiens
aaacauuucgucccaaagu

SEQ ID NO: 539327 - RNA, 19 nt, Homo sapiens
ggagagagagagaaaagaa

SEQ ID NO: 539328 - RNA, 19 nt, Homo sapiens
guacuguugaauucuguaa

SEQ ID NO: 539329 - RNA, 19 nt, Homo sapiens
ucacacacguauacacaac

SEQ ID NO: 539330 - RNA, 19 nt, Homo sapiens
gagacugagcggcgagaaa

SEQ ID NO: 539331 - RNA, 19 nt, Homo sapiens
gcguuguggucuuugcauu

SEQ ID NO: 539332 - RNA, 19 nt, Homo sapiens
gggccaguuucuugucgaa

SEQ ID NO: 539333 - RNA, 19 nt, Homo sapiens
gagcagaguaaucacaucu

SEQ ID NO: 539334 - RNA, 19 nt, Homo sapiens
cguauguacacuuuaguuu

SEQ ID NO: 539335 - RNA, 19 nt, Homo sapiens
gaucugcgugucaaacugu

SEQ ID NO: 539336 - RNA, 19 nt, Homo sapiens
caacuccacgcgggacuuu

SEQ ID NO: 539337 - RNA, 19 nt, Homo sapiens
ucaagaauucguauaguac

SEQ ID NO: 539338 - RNA, 19 nt, Homo sapiens
ucuaguaaauguguaccaa

SEQ ID NO: 539339 - RNA, 19 nt, Homo sapiens
caauauugugcaugauuug

SEQ ID NO: 539340 - RNA, 19 nt, Homo sapiens
gcagcgaccgcaagaagca

SEQ ID NO: 539341 - RNA, 19 nt, Homo sapiens
gcccggagcagaguaauca

SEQ ID NO: 539342 - RNA, 19 nt, Homo sapiens
cauauuuauccgcauguaa

SEQ ID NO: 539343 - RNA, 19 nt, Homo sapiens
aagauacaaccacauaaug

SEQ ID NO: 539344 - RNA, 19 nt, Homo sapiens
gaggaggccaccugaccaa

SEQ ID NO: 539345 - RNA, 19 nt, Homo sapiens
ccuuucgcuuucauuauuu

SEQ ID NO: 539346 - RNA, 19 nt, Homo sapiens
cgaacaaaacccuauuuaa

SEQ ID NO: 539347 - RNA, 19 nt, Homo sapiens
gaaacaaaacaucgaacaa

SEQ ID NO: 539348 - RNA, 19 nt, Homo sapiens
cuagaagaacucguaugua

SEQ ID NO: 539349 - RNA, 19 nt, Homo sapiens
ugagaugcuccaugccuuu

SEQ ID NO: 539350 - RNA, 19 nt, Homo sapiens
uacacaacauuacugaaag

SEQ ID NO: 539351 - RNA, 19 nt, Homo sapiens
acucguauguacacuuuag

SEQ ID NO: 539352 - RNA, 19 nt, Homo sapiens
aauagacccaggacgagua

SEQ ID NO: 539353 - RNA, 19 nt, Homo sapiens
agaguaaucacaucugcuu

SEQ ID NO: 539354 - RNA, 19 nt, Homo sapiens
gccaacuguuuguacugaa

SEQ ID NO: 539355 - RNA, 19 nt, Homo sapiens
acacacguauacacaacau

SEQ ID NO: 539356 - RNA, 19 nt, Homo sapiens
gguauuaacuugcuacaga

SEQ ID NO: 539357 - RNA, 19 nt, Homo sapiens
caaagucucccuucuguuu

SEQ ID NO: 539358 - RNA, 19 nt, Homo sapiens
gaaccaaaccucccugcua

SEQ ID NO: 539359 - RNA, 19 nt, Homo sapiens
gaggcaaccugauuguaaa

SEQ ID NO: 539360 - RNA, 19 nt, Homo sapiens
gaaguuuguccauuuguaa

SEQ ID NO: 539361 - RNA, 19 nt, Homo sapiens
aaccaaaccucccugcuaa

SEQ ID NO: 539362 - RNA, 19 nt, Homo sapiens
caacugagcaaucccaaga

SEQ ID NO: 539363 - RNA, 19 nt, Homo sapiens
gccaaagucucccuucugu

SEQ ID NO: 539364 - RNA, 19 nt, Homo sapiens
guauagaaguuuguccauu

SEQ ID NO: 539365 - RNA, 19 nt, Homo sapiens
caagaagagcugcaacaaa

SEQ ID NO: 539366 - RNA, 19 nt, Homo sapiens
guacaauugugggcauaaa

SEQ ID NO: 539367 - RNA, 19 nt, Homo sapiens
aagaagagcugcaacaaaa

SEQ ID NO: 539368 - RNA, 19 nt, Homo sapiens
uaaauacccguuaccauau

SEQ ID NO: 539369 - RNA, 19 nt, Homo sapiens
uaacacccuuccuucugua

SEQ ID NO: 539370 - RNA, 19 nt, Homo sapiens
gcaaccugauuguaaacuu

SEQ ID NO: 539371 - RNA, 19 nt, Homo sapiens
caaccugauuguaaacuuc

SEQ ID NO: 539372 - RNA, 19 nt, Homo sapiens
uagcuggguuuacauguga

SEQ ID NO: 539373 - RNA, 19 nt, Homo sapiens
ugaggcaaccugauuguaa

SEQ ID NO: 539374 - RNA, 19 nt, Homo sapiens
agaaguuuguccauuugua

SEQ ID NO: 539375 - RNA, 19 nt, Homo sapiens
uaagugguuugaucauuuc

SEQ ID NO: 539376 - RNA, 19 nt, Homo sapiens
cuacagaggaaacaauauu

SEQ ID NO: 539377 - RNA, 19 nt, Homo sapiens
caacgcuugugaauguauu

SEQ ID NO: 539378 - RNA, 19 nt, Homo sapiens
cugacaaacuguguacaua

SEQ ID NO: 539379 - RNA, 19 nt, Homo sapiens
ggagaagccguuccagugu

SEQ ID NO: 539380 - RNA, 19 nt, Homo sapiens
guuccuguaugaaagauug

SEQ ID NO: 539381 - RNA, 19 nt, Homo sapiens
uuuguuaguuccuguauga

SEQ ID NO: 539382 - RNA, 19 nt, Homo sapiens
ugagaguaaugcauacaga

SEQ ID NO: 539383 - RNA, 19 nt, Homo sapiens
gugguuugaucauuucuug

SEQ ID NO: 539384 - RNA, 19 nt, Homo sapiens
gcacaugggagccuucaag

SEQ ID NO: 539385 - RNA, 19 nt, Homo sapiens
gagggcaccuugugaucau

SEQ ID NO: 539386 - RNA, 19 nt, Homo sapiens
gagaguaaugcauacagaa

SEQ ID NO: 539387 - RNA, 19 nt, Homo sapiens
uaguuuacccgguuucuuu

SEQ ID NO: 539388 - RNA, 19 nt, Homo sapiens
gugaugggcuuucucuuuu

SEQ ID NO: 539389 - RNA, 19 nt, Homo sapiens
caaugaaugguacguguga

SEQ ID NO: 539390 - RNA, 19 nt, Homo sapiens
cuucaaggccaaauacaaa

SEQ ID NO: 539391 - RNA, 19 nt, Homo sapiens
auagaaguuuguccauuug

SEQ ID NO: 539392 - RNA, 19 nt, Homo sapiens
gacaaacuguguacauagc

SEQ ID NO: 539393 - RNA, 19 nt, Homo sapiens
agaagccguuccaguguga

SEQ ID NO: 539394 - RNA, 19 nt, Homo sapiens
guuaguuccuguaugaaag

SEQ ID NO: 539395 - RNA, 19 nt, Homo sapiens
gaguaaugcauacagaaau

SEQ ID NO: 539396 - RNA, 19 nt, Homo sapiens
aauaugaacauggguauga

SEQ ID NO: 539397 - RNA, 19 nt, Homo sapiens
cguaauaacacccuuccuu

SEQ ID NO: 539398 - RNA, 19 nt, Homo sapiens
gcaucaagcaggagcuaau

SEQ ID NO: 539399 - RNA, 19 nt, Homo sapiens
ugacaaacuguguacauag

SEQ ID NO: 539400 - RNA, 19 nt, Homo sapiens
ccgagaaccucaagaucca

SEQ ID NO: 539401 - RNA, 19 nt, Homo sapiens
ccaagaagagcugcaacaa

SEQ ID NO: 539402 - RNA, 19 nt, Homo sapiens
uuaacuugcuacagaggaa

SEQ ID NO: 539403 - RNA, 19 nt, Homo sapiens
auaacacccuuccuucugu

SEQ ID NO: 539404 - RNA, 19 nt, Homo sapiens
ucuguuagcuggguuuaca

SEQ ID NO: 539405 - RNA, 19 nt, Homo sapiens
agaguaaugcauacagaaa

SEQ ID NO: 539406 - RNA, 19 nt, Homo sapiens
agugaugggcuuucucuuu

SEQ ID NO: 539407 - RNA, 19 nt, Homo sapiens
aaaccucccugcuaaucuc

SEQ ID NO: 539408 - RNA, 19 nt, Homo sapiens
gcacguuggcuccuacucu

SEQ ID NO: 539409 - RNA, 19 nt, Homo sapiens
cacccuuccuucuguaaau

SEQ ID NO: 539410 - RNA, 19 nt, Homo sapiens
cauagcggacuccuccuuu

SEQ ID NO: 539411 - RNA, 19 nt, Homo sapiens
guuugaucauuucuuguga

SEQ ID NO: 539412 - RNA, 19 nt, Homo sapiens
gcaaguucaauuuguuagu

SEQ ID NO: 539413 - RNA, 19 nt, Homo sapiens
uaaucuccaugcccacguu

SEQ ID NO: 539414 - RNA, 19 nt, Homo sapiens
ccaaauacaaacuggucaa

SEQ ID NO: 539415 - RNA, 19 nt, Homo sapiens
ccaaaccucccugcuaauc

SEQ ID NO: 539416 - RNA, 19 nt, Homo sapiens
cuugugaucauguuguuaa

SEQ ID NO: 539417 - RNA, 19 nt, Homo sapiens
gguuugaucauuucuugug

SEQ ID NO: 539418 - RNA, 19 nt, Homo sapiens
gcuccgagaaccucaagau

SEQ ID NO: 539419 - RNA, 19 nt, Homo sapiens
gcaaccacgucugcuucug

SEQ ID NO: 539420 - RNA, 19 nt, Homo sapiens
ugcacgagcuggugacaca

SEQ ID NO: 539421 - RNA, 19 nt, Homo sapiens
uaauaacacccuuccuucu

SEQ ID NO: 539422 - RNA, 19 nt, Homo sapiens
uuagcuggguuuacaugug

SEQ ID NO: 539423 - RNA, 19 nt, Homo sapiens
ggcuuucucuuuucucuuu

SEQ ID NO: 539424 - RNA, 19 nt, Homo sapiens
gcacggcucgcagaaugug

SEQ ID NO: 539425 - RNA, 19 nt, Homo sapiens
gaauaugaacauggguaug

SEQ ID NO: 539426 - RNA, 19 nt, Homo sapiens
cagcgagggcaccuuguga

SEQ ID NO: 539427 - RNA, 19 nt, Homo sapiens
cggcgcaacuccacaacca

SEQ ID NO: 539428 - RNA, 19 nt, Homo sapiens
uucagcacauugacccaua

SEQ ID NO: 539429 - RNA, 19 nt, Homo sapiens
ugaauaugaacauggguau

SEQ ID NO: 539430 - RNA, 19 nt, Homo sapiens
aauaaucuaggcaugaaga

SEQ ID NO: 539431 - RNA, 19 nt, Homo sapiens
caacuccacccgggacuuc

SEQ ID NO: 539432 - RNA, 19 nt, Homo sapiens
aaugagccgugccaaaguc

SEQ ID NO: 539433 - RNA, 19 nt, Homo sapiens
cggagucuuugaagcugaa

SEQ ID NO: 539434 - RNA, 19 nt, Homo sapiens
ugagcaaucccaagaagag

SEQ ID NO: 539435 - RNA, 19 nt, Homo sapiens
aauaacacccuuccuucug

SEQ ID NO: 539436 - RNA, 19 nt, Homo sapiens
caauuuguuaguuccugua

SEQ ID NO: 539437 - RNA, 19 nt, Homo sapiens
uuuaugaggcaaccugauu

SEQ ID NO: 539438 - RNA, 19 nt, Homo sapiens
ucccuucccuaaagugaug

SEQ ID NO: 539439 - RNA, 19 nt, Homo sapiens
gcaagaugugcgacaaguc

SEQ ID NO: 539440 - RNA, 19 nt, Homo sapiens
gcagcgacaggaagaagca

SEQ ID NO: 539441 - RNA, 19 nt, Homo sapiens
gcuacagaggaaacaauau

SEQ ID NO: 539442 - RNA, 19 nt, Homo sapiens
acccuuccuucuguaaaua

SEQ ID NO: 539443 - RNA, 19 nt, Homo sapiens
uucccagucuucugacaaa

SEQ ID NO: 539444 - RNA, 19 nt, Homo sapiens
uuuaccagcagaaggauuu

SEQ ID NO: 539445 - RNA, 19 nt, Homo sapiens
acagcggccucuccuccaa

SEQ ID NO: 539446 - RNA, 19 nt, Homo sapiens
gugccaaagucucccuucu

SEQ ID NO: 539447 - RNA, 19 nt, Homo sapiens
gaugcaggaccgugaacug

SEQ ID NO: 539448 - RNA, 19 nt, Homo sapiens
acacaaacccuguuaauua

SEQ ID NO: 539449 - RNA, 19 nt, Homo sapiens
gcaaagauguuaagagcau

SEQ ID NO: 539450 - RNA, 19 nt, Homo sapiens
gaaaugaugcuaugggaaa

SEQ ID NO: 539451 - RNA, 19 nt, Homo sapiens
aaacaguggugaugaguaa

SEQ ID NO: 539452 - RNA, 19 nt, Homo sapiens
gagcauuguuuccauuaaa

SEQ ID NO: 539453 - RNA, 19 nt, Homo sapiens
gaggagaugugagcaaauu

SEQ ID NO: 539454 - RNA, 19 nt, Homo sapiens
cccaaucucugcaugaaua

SEQ ID NO: 539455 - RNA, 19 nt, Homo sapiens
cacaaacccuguuaauuau

SEQ ID NO: 539456 - RNA, 19 nt, Homo sapiens
ggcagucaauuugguauua

SEQ ID NO: 539457 - RNA, 19 nt, Homo sapiens
gccgggaacugaacaauau

SEQ ID NO: 539458 - RNA, 19 nt, Homo sapiens
aaacuccgcccuccacuua

SEQ ID NO: 539459 - RNA, 19 nt, Homo sapiens
aaagaaccauaguccauuu

SEQ ID NO: 539460 - RNA, 19 nt, Homo sapiens
ggcuacaucuuguuaauug

SEQ ID NO: 539461 - RNA, 19 nt, Homo sapiens
uaucuaaucugccuaucaa

SEQ ID NO: 539462 - RNA, 19 nt, Homo sapiens
ggagaugugagcaaauuaa

SEQ ID NO: 539463 - RNA, 19 nt, Homo sapiens
uaacagccuucuucuacaa

SEQ ID NO: 539464 - RNA, 19 nt, Homo sapiens
ccaaucagauggaaaugga

SEQ ID NO: 539465 - RNA, 19 nt, Homo sapiens
ggacauaaggaauuguaaa

SEQ ID NO: 539466 - RNA, 19 nt, Homo sapiens
gaugccauauuuaucguuu

SEQ ID NO: 539467 - RNA, 19 nt, Homo sapiens
cugagaagcuggauuuaau

SEQ ID NO: 539468 - RNA, 19 nt, Homo sapiens
gugagcaaauuaaaucuug

SEQ ID NO: 539469 - RNA, 19 nt, Homo sapiens
ccucaaagcauuacacuug

SEQ ID NO: 539470 - RNA, 19 nt, Homo sapiens
uaacagaaagguggacaua

SEQ ID NO: 539471 - RNA, 19 nt, Homo sapiens
uaagagcauuguuuccauu

SEQ ID NO: 539472 - RNA, 19 nt, Homo sapiens
gauguuaagagcauuguuu

SEQ ID NO: 539473 - RNA, 19 nt, Homo sapiens
cagcaguucugaaaugaug

SEQ ID NO: 539474 - RNA, 19 nt, Homo sapiens
ggaaggcaaaggcugauuu

SEQ ID NO: 539475 - RNA, 19 nt, Homo sapiens
caaacccuguuaauuauag

SEQ ID NO: 539476 - RNA, 19 nt, Homo sapiens
ggccagagcucggcuuuca

SEQ ID NO: 539477 - RNA, 19 nt, Homo sapiens
acagaaagguggacauaag

SEQ ID NO: 539478 - RNA, 19 nt, Homo sapiens
gaaccauaguccauuuaca

SEQ ID NO: 539479 - RNA, 19 nt, Homo sapiens
gaugugauguuacucuaca

SEQ ID NO: 539480 - RNA, 19 nt, Homo sapiens
cuaauagggucgaaacugu

SEQ ID NO: 539481 - RNA, 19 nt, Homo sapiens
ccaaaguccuguuaugucu

SEQ ID NO: 539482 - RNA, 19 nt, Homo sapiens
gauguuaaacugauggaaa

SEQ ID NO: 539483 - RNA, 19 nt, Homo sapiens
ggcaagaggccauauauag

SEQ ID NO: 539484 - RNA, 19 nt, Homo sapiens
caguaaagauaccacuaaa

SEQ ID NO: 539485 - RNA, 19 nt, Homo sapiens
uuacagugguuauauggaa

SEQ ID NO: 539486 - RNA, 19 nt, Homo sapiens
ggacaggauuggcaaacuc

SEQ ID NO: 539487 - RNA, 19 nt, Homo sapiens
caaucuaucuaguagcuau

SEQ ID NO: 539488 - RNA, 19 nt, Homo sapiens
caugacaucucaaucuugu

SEQ ID NO: 539489 - RNA, 19 nt, Homo sapiens
gaugugagcaaauuaaauc

SEQ ID NO: 539490 - RNA, 19 nt, Homo sapiens
gaaagguggacauaaggaa

SEQ ID NO: 539491 - RNA, 19 nt, Homo sapiens
gggaacugaacaauauuua

SEQ ID NO: 539492 - RNA, 19 nt, Homo sapiens
gaagguucaugaaucucaa

SEQ ID NO: 539493 - RNA, 19 nt, Homo sapiens
gcagucaauuugguauuau

SEQ ID NO: 539494 - RNA, 19 nt, Homo sapiens
guuguuugcuuugugauaa

SEQ ID NO: 539495 - RNA, 19 nt, Homo sapiens
guucugaaaugaugcuaug

SEQ ID NO: 539496 - RNA, 19 nt, Homo sapiens
uaacgaaugguacgucuga

SEQ ID NO: 539497 - RNA, 19 nt, Homo sapiens
gaagaucuuugcccguucu

SEQ ID NO: 539498 - RNA, 19 nt, Homo sapiens
gagaucacccauauaccua

SEQ ID NO: 539499 - RNA, 19 nt, Homo sapiens
agacugagaagcuggauuu

SEQ ID NO: 539500 - RNA, 19 nt, Homo sapiens
ggucgaaacuguuguucag

SEQ ID NO: 539501 - RNA, 19 nt, Homo sapiens
ugaauaggcuuaaguaccu

SEQ ID NO: 539502 - RNA, 19 nt, Homo sapiens
gguagaguauugagaccuu

SEQ ID NO: 539503 - RNA, 19 nt, Homo sapiens
gucccuuaguucuuuauua

SEQ ID NO: 539504 - RNA, 19 nt, Homo sapiens
guaacagccuucuucuaca

SEQ ID NO: 539505 - RNA, 19 nt, Homo sapiens
ugacuccuuucucuuguuu

SEQ ID NO: 539506 - RNA, 19 nt, Homo sapiens
gccaugacaucucaaucuu

SEQ ID NO: 539507 - RNA, 19 nt, Homo sapiens
ucagaugguuguuuaacug

SEQ ID NO: 539508 - RNA, 19 nt, Homo sapiens
acaguugccuuuuguaaua

SEQ ID NO: 539509 - RNA, 19 nt, Homo sapiens
ccuuaguggugauuguuua

SEQ ID NO: 539510 - RNA, 19 nt, Homo sapiens
guaacgagccugccuacug

SEQ ID NO: 539511 - RNA, 19 nt, Homo sapiens
uggaaccacugacuccuuu

SEQ ID NO: 539512 - RNA, 19 nt, Homo sapiens
uaaggccaguugagcauug

SEQ ID NO: 539513 - RNA, 19 nt, Homo sapiens
uaaauuccuuacaguguca

SEQ ID NO: 539514 - RNA, 19 nt, Homo sapiens
gagaugugagcaaauuaaa

SEQ ID NO: 539515 - RNA, 19 nt, Homo sapiens
aaaguccuguuaugucuug

SEQ ID NO: 539516 - RNA, 19 nt, Homo sapiens
gacagacgcuuugccaaca

SEQ ID NO: 539517 - RNA, 19 nt, Homo sapiens
gggcaaugcucuagguuuu

SEQ ID NO: 539518 - RNA, 19 nt, Homo sapiens
gcaugucugucuguucuau

SEQ ID NO: 539519 - RNA, 19 nt, Homo sapiens
ccuguuaugucuugaacuu

SEQ ID NO: 539520 - RNA, 19 nt, Homo sapiens
acacuuguccuguuucuug

SEQ ID NO: 539521 - RNA, 19 nt, Homo sapiens
aaacuccuccaauucauuu

SEQ ID NO: 539522 - RNA, 19 nt, Homo sapiens
gcaagaggccauauauagg

SEQ ID NO: 539523 - RNA, 19 nt, Homo sapiens
cauauccauugaugccaua

SEQ ID NO: 539524 - RNA, 19 nt, Homo sapiens
ggcugaggaugugauguua

SEQ ID NO: 539525 - RNA, 19 nt, Homo sapiens
uggaguggguagaguauug

SEQ ID NO: 539526 - RNA, 19 nt, Homo sapiens
uaaucugccuaucaaucua

SEQ ID NO: 539527 - RNA, 19 nt, Homo sapiens
aagaggagaugugagcaaa

SEQ ID NO: 539528 - RNA, 19 nt, Homo sapiens
cuacaaagaggagauguga

SEQ ID NO: 539529 - RNA, 19 nt, Homo sapiens
uauauagggcuacaucuug

SEQ ID NO: 539530 - RNA, 19 nt, Homo sapiens
ggacuuccuccuaauuuua

SEQ ID NO: 539531 - RNA, 19 nt, Homo sapiens
ucagugaagcaacucauuu

SEQ ID NO: 539532 - RNA, 19 nt, Homo sapiens
ucccugcccuacauauaua

SEQ ID NO: 539533 - RNA, 19 nt, Homo sapiens
aaucaucccugcccuacau

SEQ ID NO: 539534 - RNA, 19 nt, Homo sapiens
caaagcauuacacuuguga

SEQ ID NO: 539535 - RNA, 19 nt, Homo sapiens
gugccaaaguccuguuaug

SEQ ID NO: 539536 - RNA, 19 nt, Homo sapiens
uuagggugcuguuuguuau

SEQ ID NO: 539537 - RNA, 19 nt, Homo sapiens
ccauugaugccauauuuau

SEQ ID NO: 539538 - RNA, 19 nt, Homo sapiens
uaaggcaagaggccauaua

SEQ ID NO: 539539 - RNA, 19 nt, Homo sapiens
acaguaaagauaccacuaa

SEQ ID NO: 539540 - RNA, 19 nt, Homo sapiens
ugcaugagcuggugacaca

SEQ ID NO: 539541 - RNA, 19 nt, Homo sapiens
uuaugucccuuaguucuuu

SEQ ID NO: 539542 - RNA, 19 nt, Homo sapiens
guacuucaaagacugagaa

SEQ ID NO: 539543 - RNA, 19 nt, Homo sapiens
caaauucuguacagcuuuu

SEQ ID NO: 539544 - RNA, 19 nt, Homo sapiens
gcaauuguccaggaagguu

SEQ ID NO: 539545 - RNA, 19 nt, Homo sapiens
uaaaaccccuucugcaguu

SEQ ID NO: 539546 - RNA, 19 nt, Homo sapiens
cccuauaucugcaaagugu

SEQ ID NO: 539547 - RNA, 19 nt, Homo sapiens
guagaguauugagaccuuu

SEQ ID NO: 539548 - RNA, 19 nt, Homo sapiens
ggaaaugacucuaaagaua

SEQ ID NO: 539549 - RNA, 19 nt, Homo sapiens
gcuaauaggugcucaauaa

SEQ ID NO: 539550 - RNA, 19 nt, Homo sapiens
ggaaguagauuaauugauc

SEQ ID NO: 539551 - RNA, 19 nt, Homo sapiens
gacaagaacuuccauacaa

SEQ ID NO: 539552 - RNA, 19 nt, Homo sapiens
gcacuaaucuuguucucuu

SEQ ID NO: 539553 - RNA, 19 nt, Homo sapiens
gaacuuccauacaaauuug

SEQ ID NO: 539554 - RNA, 19 nt, Homo sapiens
ccagggaaauucucacuaa

SEQ ID NO: 539555 - RNA, 19 nt, Homo sapiens
gagaauggcugcugugucu

SEQ ID NO: 539556 - RNA, 19 nt, Homo sapiens
gggaaauucucacuaaaga

SEQ ID NO: 539557 - RNA, 19 nt, Homo sapiens
gagagaagcccuuugaaug

SEQ ID NO: 539558 - RNA, 19 nt, Homo sapiens
gacaauaggauagauguua

SEQ ID NO: 539559 - RNA, 19 nt, Homo sapiens
uaucacagcaguacuauuu

SEQ ID NO: 539560 - RNA, 19 nt, Homo sapiens
gagaaaguccuuaugaaug

SEQ ID NO: 539561 - RNA, 19 nt, Homo sapiens
ucacgaugcuucagacaaa

SEQ ID NO: 539562 - RNA, 19 nt, Homo sapiens
ggagaacuauaacagcauu

SEQ ID NO: 539563 - RNA, 19 nt, Homo sapiens
gcgccagaguguuuaauaa

SEQ ID NO: 539564 - RNA, 19 nt, Homo sapiens
aaacuaagccugagauuca

SEQ ID NO: 539565 - RNA, 19 nt, Homo sapiens
ggagaaaguccuuaugaau

SEQ ID NO: 539566 - RNA, 19 nt, Homo sapiens
agaaaguccuuaugaaugu

SEQ ID NO: 539567 - RNA, 19 nt, Homo sapiens
gaaaugacucuaaagauac

SEQ ID NO: 539568 - RNA, 19 nt, Homo sapiens
acaagaacuuccauacaaa

SEQ ID NO: 539569 - RNA, 19 nt, Homo sapiens
ccucucaacuagauuguaa

SEQ ID NO: 539570 - RNA, 19 nt, Homo sapiens
gggaaaggcagaaugauau

SEQ ID NO: 539571 - RNA, 19 nt, Homo sapiens
gagagagaauggccagaga

SEQ ID NO: 539572 - RNA, 19 nt, Homo sapiens
gaucucgccugucuuaaag

SEQ ID NO: 539573 - RNA, 19 nt, Homo sapiens
ggagagaagcccuuugaau

SEQ ID NO: 539574 - RNA, 19 nt, Homo sapiens
ggagggaaaggcagaauga

SEQ ID NO: 539575 - RNA, 19 nt, Homo sapiens
ucaccaaccauaugaagua

SEQ ID NO: 539576 - RNA, 19 nt, Homo sapiens
uaacagcauugugucauug

SEQ ID NO: 539577 - RNA, 19 nt, Homo sapiens
ccauggaaaugacucuaaa

SEQ ID NO: 539578 - RNA, 19 nt, Homo sapiens
ggacaagaacuuccauaca

SEQ ID NO: 539579 - RNA, 19 nt, Homo sapiens
ccacaugaaugcagcgaau

SEQ ID NO: 539580 - RNA, 19 nt, Homo sapiens
caggaagccuuaugagugu

SEQ ID NO: 539581 - RNA, 19 nt, Homo sapiens
gagaauggccagagagugu

SEQ ID NO: 539582 - RNA, 19 nt, Homo sapiens
ggacaagccguggauggua

SEQ ID NO: 539583 - RNA, 19 nt, Homo sapiens
cgacagcgcugccauuuug

SEQ ID NO: 539584 - RNA, 19 nt, Homo sapiens
acacaccucuugucugaga

SEQ ID NO: 539585 - RNA, 19 nt, Homo sapiens
acacagugccuugcuaaua

SEQ ID NO: 539586 - RNA, 19 nt, Homo sapiens
uguauuauccucucaacua

SEQ ID NO: 539587 - RNA, 19 nt, Homo sapiens
gagacaagccacaugaaug

SEQ ID NO: 539588 - RNA, 19 nt, Homo sapiens
gacccucgcuaucagugua

SEQ ID NO: 539589 - RNA, 19 nt, Homo sapiens
gaccauaagucucccaaac

SEQ ID NO: 539590 - RNA, 19 nt, Homo sapiens
gaauagacaucagaaagcu

SEQ ID NO: 539591 - RNA, 19 nt, Homo sapiens
gaaggaucauugagggaau

SEQ ID NO: 539592 - RNA, 19 nt, Homo sapiens
gagaagcccuuugaaugca

SEQ ID NO: 539593 - RNA, 19 nt, Homo sapiens
ggaggacucugcccuuguc

SEQ ID NO: 539594 - RNA, 19 nt, Homo sapiens
cacagugccuugcuaauag

SEQ ID NO: 539595 - RNA, 19 nt, Homo sapiens
uauggugucucgucucuga

SEQ ID NO: 539596 - RNA, 19 nt, Homo sapiens
cgaagacguugccgugguu

SEQ ID NO: 539597 - RNA, 19 nt, Homo sapiens
uaugcucgaugguuuguuu

SEQ ID NO: 539598 - RNA, 19 nt, Homo sapiens
ucacugcacuuuaagaaac

SEQ ID NO: 539599 - RNA, 19 nt, Homo sapiens
gaaacuaagccugagauuc

SEQ ID NO: 539600 - RNA, 19 nt, Homo sapiens
gguaaagacucagcuaagg

SEQ ID NO: 539601 - RNA, 19 nt, Homo sapiens
ggagacaagccacaugaau

SEQ ID NO: 539602 - RNA, 19 nt, Homo sapiens
uuugaccgcucaucccuua

SEQ ID NO: 539603 - RNA, 19 nt, Homo sapiens
uggagaaaguccuuaugaa

SEQ ID NO: 539604 - RNA, 19 nt, Homo sapiens
gagguaaagacucagcuaa

SEQ ID NO: 539605 - RNA, 19 nt, Homo sapiens
gauccugucaccaaccaua

SEQ ID NO: 539606 - RNA, 19 nt, Homo sapiens
agguaucacugcacuuuaa

SEQ ID NO: 539607 - RNA, 19 nt, Homo sapiens
cagggaaauucucacuaaa

SEQ ID NO: 539608 - RNA, 19 nt, Homo sapiens
uuucggacgucauauuaaa

SEQ ID NO: 539609 - RNA, 19 nt, Homo sapiens
guauuauccucucaacuag

SEQ ID NO: 539610 - RNA, 19 nt, Homo sapiens
gaugagcacccugagguuu

SEQ ID NO: 539611 - RNA, 19 nt, Homo sapiens
ccucuuacuuccacugcua

SEQ ID NO: 539612 - RNA, 19 nt, Homo sapiens
auagaucucgccugucuua

SEQ ID NO: 539613 - RNA, 19 nt, Homo sapiens
uaugaaguaggcacuguua

SEQ ID NO: 539614 - RNA, 19 nt, Homo sapiens
ccagaguguuuaauaagca

SEQ ID NO: 539615 - RNA, 19 nt, Homo sapiens
uaauugauccugucaccaa

SEQ ID NO: 539616 - RNA, 19 nt, Homo sapiens
acaauaggauagauguuag

SEQ ID NO: 539617 - RNA, 19 nt, Homo sapiens
caagaacuuccauacaaau

SEQ ID NO: 539618 - RNA, 19 nt, Homo sapiens
gaggcaccaugaucagaga

SEQ ID NO: 539619 - RNA, 19 nt, Homo sapiens
ggaagccuuaugaguguaa

SEQ ID NO: 539620 - RNA, 19 nt, Homo sapiens
aaaguccucuguguccuaa

SEQ ID NO: 539621 - RNA, 19 nt, Homo sapiens
ucucuagacugggaaacua

SEQ ID NO: 539622 - RNA, 19 nt, Homo sapiens
gaaacuggaggcugcaaca

SEQ ID NO: 539623 - RNA, 19 nt, Homo sapiens
ccagguaucacugcacuuu

SEQ ID NO: 539624 - RNA, 19 nt, Homo sapiens
uuacacagcaucagaagau

SEQ ID NO: 539625 - RNA, 19 nt, Homo sapiens
ccauaagucucccaaacag

SEQ ID NO: 539626 - RNA, 19 nt, Homo sapiens
ggugucucgucucugaaua

SEQ ID NO: 539627 - RNA, 19 nt, Homo sapiens
caaaguccucuguguccua

SEQ ID NO: 539628 - RNA, 19 nt, Homo sapiens
gaugugauuuuccaauuga

SEQ ID NO: 539629 - RNA, 19 nt, Homo sapiens
acaggaaguagauuaauug

SEQ ID NO: 539630 - RNA, 19 nt, Homo sapiens
ccucuugucugagaaccua

SEQ ID NO: 539631 - RNA, 19 nt, Homo sapiens
ggaaacuaagccugagauu

SEQ ID NO: 539632 - RNA, 19 nt, Homo sapiens
ggagggacgcgacacuaga

SEQ ID NO: 539633 - RNA, 19 nt, Homo sapiens
ucacacagugccuugcuaa

SEQ ID NO: 539634 - RNA, 19 nt, Homo sapiens
gcucgaugguuuguuuguu

SEQ ID NO: 539635 - RNA, 19 nt, Homo sapiens
ucucuugugucccagcuuu

SEQ ID NO: 539636 - RNA, 19 nt, Homo sapiens
ugauaucacagcaguacua

SEQ ID NO: 539637 - RNA, 19 nt, Homo sapiens
gaaaggcagaaugauauca

SEQ ID NO: 539638 - RNA, 19 nt, Homo sapiens
ccauacaaauuugagauag

SEQ ID NO: 539639 - RNA, 19 nt, Homo sapiens
uaacgaguguggcaaagcu

SEQ ID NO: 539640 - RNA, 19 nt, Homo sapiens
gaaaguccuuaugaauguc

SEQ ID NO: 539641 - RNA, 19 nt, Homo sapiens
ggaaaggcagaaugauauc

SEQ ID NO: 539642 - RNA, 19 nt, Homo sapiens
ucuuaaagcugccauuugc

SEQ ID NO: 539643 - RNA, 19 nt, Homo sapiens
gaaguucauacacccaaug

SEQ ID NO: 539644 - RNA, 19 nt, Homo sapiens
ggaaggcaaaguccucugu

SEQ ID NO: 539645 - RNA, 19 nt, Homo sapiens
auaacagcauugugucauu

SEQ ID NO: 539646 - RNA, 19 nt, Homo sapiens
gaacuauaacagcauugug

SEQ ID NO: 539647 - RNA, 19 nt, Homo sapiens
cucgaugguuuguuuguuu

SEQ ID NO: 539648 - RNA, 19 nt, Homo sapiens
gagaaagacugaacaggaa

SEQ ID NO: 539649 - RNA, 19 nt, Homo sapiens
ggagaaacccuaugaaugu

SEQ ID NO: 539650 - RNA, 19 nt, Homo sapiens
ggugagauuugagcuauua

SEQ ID NO: 539651 - RNA, 19 nt, Homo sapiens
gaauguagcaagagcuuua

SEQ ID NO: 539652 - RNA, 19 nt, Homo sapiens
gagagaagcgagaaauaua

SEQ ID NO: 539653 - RNA, 19 nt, Homo sapiens
gaaauuauauccccuuuga

SEQ ID NO: 539654 - RNA, 19 nt, Homo sapiens
gaacugauucucuaccuuu

SEQ ID NO: 539655 - RNA, 19 nt, Homo sapiens
gcacauauauaacgucucu

SEQ ID NO: 539656 - RNA, 19 nt, Homo sapiens
gagaaacccuaugaaugua

SEQ ID NO: 539657 - RNA, 19 nt, Homo sapiens
ggauguagcuguguacuuc

SEQ ID NO: 539658 - RNA, 19 nt, Homo sapiens
agccagagcucacaccuua

SEQ ID NO: 539659 - RNA, 19 nt, Homo sapiens
uaaagaagccuaugaacga

SEQ ID NO: 539660 - RNA, 19 nt, Homo sapiens
ugacagugcucuucuuuca

SEQ ID NO: 539661 - RNA, 19 nt, Homo sapiens
ccaaguguguucuguaaug

SEQ ID NO: 539662 - RNA, 19 nt, Homo sapiens
gaagcgagaaauauaauga

SEQ ID NO: 539663 - RNA, 19 nt, Homo sapiens
ggucugagcucugcccaaa

SEQ ID NO: 539664 - RNA, 19 nt, Homo sapiens
caccaaguguguucuguaa

SEQ ID NO: 539665 - RNA, 19 nt, Homo sapiens
agcaggagcucaacccuua

SEQ ID NO: 539666 - RNA, 19 nt, Homo sapiens
gaaaagcccuaugaaugua

SEQ ID NO: 539667 - RNA, 19 nt, Homo sapiens
agcaagagcuuuaaucgaa

SEQ ID NO: 539668 - RNA, 19 nt, Homo sapiens
gagagagaagcgagaaaua

SEQ ID NO: 539669 - RNA, 19 nt, Homo sapiens
acagugcucuucuuucaaa

SEQ ID NO: 539670 - RNA, 19 nt, Homo sapiens
gagaugugaugcuggagaa

SEQ ID NO: 539671 - RNA, 19 nt, Homo sapiens
cacaaucuuugcacugaua

SEQ ID NO: 539672 - RNA, 19 nt, Homo sapiens
ggaaggaguggaagcguuu

SEQ ID NO: 539673 - RNA, 19 nt, Homo sapiens
uaagcuggccucagguuua

SEQ ID NO: 539674 - RNA, 19 nt, Homo sapiens
gaaacccuaugaauguaau

SEQ ID NO: 539675 - RNA, 19 nt, Homo sapiens
gggaaaaccuucagcugua

SEQ ID NO: 539676 - RNA, 19 nt, Homo sapiens
gggagaaacccuaugaaug

SEQ ID NO: 539677 - RNA, 19 nt, Homo sapiens
gaacuucagaccuuauuca

SEQ ID NO: 539678 - RNA, 19 nt, Homo sapiens
ccauaagugugaugaaugu

SEQ ID NO: 539679 - RNA, 19 nt, Homo sapiens
ugcauucucugauguuuaa

SEQ ID NO: 539680 - RNA, 19 nt, Homo sapiens
gcucuucccacauucguua

SEQ ID NO: 539681 - RNA, 19 nt, Homo sapiens
cuucagaccuuauucaaca

SEQ ID NO: 539682 - RNA, 19 nt, Homo sapiens
gaagacacaagaucacaug

SEQ ID NO: 539683 - RNA, 19 nt, Homo sapiens
aaccuuaucucacaucaga

SEQ ID NO: 539684 - RNA, 19 nt, Homo sapiens
gagauuugagcuauuacua

SEQ ID NO: 539685 - RNA, 19 nt, Homo sapiens
aguaggaacugauucucua

SEQ ID NO: 539686 - RNA, 19 nt, Homo sapiens
cacauucguuacacugaua

SEQ ID NO: 539687 - RNA, 19 nt, Homo sapiens
uaaucgaacuucagaccuu

SEQ ID NO: 539688 - RNA, 19 nt, Homo sapiens
ggucucaaguuuaaagaag

SEQ ID NO: 539689 - RNA, 19 nt, Homo sapiens
ggaacugauucucuaccuu

SEQ ID NO: 539690 - RNA, 19 nt, Homo sapiens
gccacaaucuuugcacuga

SEQ ID NO: 539691 - RNA, 19 nt, Homo sapiens
ggaaaagcccuaugaaugu

SEQ ID NO: 539692 - RNA, 19 nt, Homo sapiens
gagcuuuaaucgaacuuca

SEQ ID NO: 539693 - RNA, 19 nt, Homo sapiens
aggcugaucucguaucuca

SEQ ID NO: 539694 - RNA, 19 nt, Homo sapiens
gagaagcgagaaauauaau

SEQ ID NO: 539695 - RNA, 19 nt, Homo sapiens
aauccacacuggugagaaa

SEQ ID NO: 539696 - RNA, 19 nt, Homo sapiens
ccagagcucacaccuuauu

SEQ ID NO: 539697 - RNA, 19 nt, Homo sapiens
aaucgaacuucagaccuua

SEQ ID NO: 539698 - RNA, 19 nt, Homo sapiens
agagaagcgagaaauauaa

SEQ ID NO: 539699 - RNA, 19 nt, Homo sapiens
ggagagagaagcgagaaau

SEQ ID NO: 539700 - RNA, 19 nt, Homo sapiens
cucagggucucaaguuuaa

SEQ ID NO: 539701 - RNA, 19 nt, Homo sapiens
ccuuaugaauguagugauu

SEQ ID NO: 539702 - RNA, 19 nt, Homo sapiens
gguuugagcuguggcugaa

SEQ ID NO: 539703 - RNA, 19 nt, Homo sapiens
cugaaagccuugccacaau

SEQ ID NO: 539704 - RNA, 19 nt, Homo sapiens
gggaaaagcccuaugaaug

SEQ ID NO: 539705 - RNA, 19 nt, Homo sapiens
acugugaauuccaaccuua

SEQ ID NO: 539706 - RNA, 19 nt, Homo sapiens
gguaaccuuugaggaugua

SEQ ID NO: 539707 - RNA, 19 nt, Homo sapiens
ugaaagccuugccacaauc

SEQ ID NO: 539708 - RNA, 19 nt, Homo sapiens
gcugaaagccuugccacaa

SEQ ID NO: 539709 - RNA, 19 nt, Homo sapiens
gagaauuacgggaaugugu

SEQ ID NO: 539710 - RNA, 19 nt, Homo sapiens
ccacauucagcacauauau

SEQ ID NO: 539711 - RNA, 19 nt, Homo sapiens
augugaugcuggagaauua

SEQ ID NO: 539712 - RNA, 19 nt, Homo sapiens
ucucagggucucaaguuua

SEQ ID NO: 539713 - RNA, 19 nt, Homo sapiens
gaugugaugcuggagaauu

SEQ ID NO: 539714 - RNA, 19 nt, Homo sapiens
cuacugggaagauuucaaa

SEQ ID NO: 539715 - RNA, 19 nt, Homo sapiens
uguguguucuccuguguuu

SEQ ID NO: 539716 - RNA, 19 nt, Homo sapiens
ccacauucguuacacugau

SEQ ID NO: 539717 - RNA, 19 nt, Homo sapiens
ugugaugaauguagcaaga

SEQ ID NO: 539718 - RNA, 19 nt, Homo sapiens
gcugguaaccuuugaggau

SEQ ID NO: 539719 - RNA, 19 nt, Homo sapiens
gaauuccaaccuuaucuca

SEQ ID NO: 539720 - RNA, 19 nt, Homo sapiens
agaagccuaugaacgagaa

SEQ ID NO: 539721 - RNA, 19 nt, Homo sapiens
gauauggcgccucuucugu

SEQ ID NO: 539722 - RNA, 19 nt, Homo sapiens
gaauuacgggaauguguuc

SEQ ID NO: 539723 - RNA, 19 nt, Homo sapiens
gcuggagaauuacgggaau

SEQ ID NO: 539724 - RNA, 19 nt, Homo sapiens
cgugagaccaggacugaaa

SEQ ID NO: 539725 - RNA, 19 nt, Homo sapiens
agagagaagcgagaaauau

SEQ ID NO: 539726 - RNA, 19 nt, Homo sapiens
gauccgauagugacgaaug

SEQ ID NO: 539727 - RNA, 19 nt, Homo sapiens
caacccuuauucaccauca

SEQ ID NO: 539728 - RNA, 19 nt, Homo sapiens
gcacccaggagaccagaga

SEQ ID NO: 539729 - RNA, 19 nt, Homo sapiens
ggaguggaagcguuuggaa

SEQ ID NO: 539730 - RNA, 19 nt, Homo sapiens
ggcgauaaucacagaaauu

SEQ ID NO: 539731 - RNA, 19 nt, Homo sapiens
ccaccaaguguguucugua

SEQ ID NO: 539732 - RNA, 19 nt, Homo sapiens
gugcauucucugauguuua

SEQ ID NO: 539733 - RNA, 19 nt, Homo sapiens
cuaugaauguaaugagugu

SEQ ID NO: 539734 - RNA, 19 nt, Homo sapiens
cuaugaauguaaugagugu

SEQ ID NO: 539735 - RNA, 19 nt, Homo sapiens
aagcuggccucagguuuau

SEQ ID NO: 539736 - RNA, 19 nt, Homo sapiens
cacauucagcacauauaua

SEQ ID NO: 539737 - RNA, 19 nt, Homo sapiens
gaccaggacugaaaaugau

SEQ ID NO: 539738 - RNA, 19 nt, Homo sapiens
ggagcucaacccuuauuca

SEQ ID NO: 539739 - RNA, 19 nt, Homo sapiens
caagagcuuuaaucgaacu

SEQ ID NO: 539740 - RNA, 19 nt, Homo sapiens
guuuaaagaagccuaugaa

SEQ ID NO: 539741 - RNA, 19 nt, Homo sapiens
cacacuuggugcacacgua

SEQ ID NO: 539742 - RNA, 19 nt, Homo sapiens
uaauggagggugagguuug

SEQ ID NO: 539743 - RNA, 19 nt, Homo sapiens
cuguagcucugcccucauu

SEQ ID NO: 539744 - RNA, 19 nt, Homo sapiens
caaguguguucuguaaugg

SEQ ID NO: 539745 - RNA, 19 nt, Homo sapiens
ggacugaaaaugaucaaga

SEQ ID NO: 539746 - RNA, 19 nt, Homo sapiens
gaccuuauucaacaucaga

SEQ ID NO: 539747 - RNA, 19 nt, Homo sapiens
gguccuacugggaagauuu

SEQ ID NO: 539748 - RNA, 19 nt, Homo sapiens
gaacagaggcugcuaaauu

SEQ ID NO: 539749 - RNA, 19 nt, Homo sapiens
gaaaggaguuugcacuaaa

SEQ ID NO: 539750 - RNA, 19 nt, Homo sapiens
gagaaagacugaacaggaa

SEQ ID NO: 539751 - RNA, 19 nt, Homo sapiens
gaagauuaaugcagagaaa

SEQ ID NO: 539752 - RNA, 19 nt, Homo sapiens
ggacagaauucgauggauu

SEQ ID NO: 539753 - RNA, 19 nt, Homo sapiens
ggaaaggaguuugcacuaa

SEQ ID NO: 539754 - RNA, 19 nt, Homo sapiens
gggcaaaucuguccaaaca

SEQ ID NO: 539755 - RNA, 19 nt, Homo sapiens
ggagaaacccuaugaaugu

SEQ ID NO: 539756 - RNA, 19 nt, Homo sapiens
gaauguagcaagagcuuua

SEQ ID NO: 539757 - RNA, 19 nt, Homo sapiens
gagagaagcgagaaauaua

SEQ ID NO: 539758 - RNA, 19 nt, Homo sapiens
agagaaaccuggugauauu

SEQ ID NO: 539759 - RNA, 19 nt, Homo sapiens
gcucuugccuuacccuaua

SEQ ID NO: 539760 - RNA, 19 nt, Homo sapiens
gagaaacccuaugaaugua

SEQ ID NO: 539761 - RNA, 19 nt, Homo sapiens
gagagaagccuuugaaugg

SEQ ID NO: 539762 - RNA, 19 nt, Homo sapiens
gagagaagcccuacgaaug

SEQ ID NO: 539763 - RNA, 19 nt, Homo sapiens
ggauguagcuguguacuuc

SEQ ID NO: 539764 - RNA, 19 nt, Homo sapiens
agccagagcucacaccuua

SEQ ID NO: 539765 - RNA, 19 nt, Homo sapiens
uaaagaagccuaugaacga

SEQ ID NO: 539766 - RNA, 19 nt, Homo sapiens
gaauguggaggaaaguuua

SEQ ID NO: 539767 - RNA, 19 nt, Homo sapiens
gagaagcccuacgaaugua

SEQ ID NO: 539768 - RNA, 19 nt, Homo sapiens
gaagcgagaaauauaauga

SEQ ID NO: 539769 - RNA, 19 nt, Homo sapiens
ggagagaagccuuugaaug

SEQ ID NO: 539770 - RNA, 19 nt, Homo sapiens
gcugcuaaauucccaguaa

SEQ ID NO: 539771 - RNA, 19 nt, Homo sapiens
caagagaaaccuggugaua

SEQ ID NO: 539772 - RNA, 19 nt, Homo sapiens
ggaggaaaguuuaccuaca

SEQ ID NO: 539773 - RNA, 19 nt, Homo sapiens
agcaggagcucaacccuua

SEQ ID NO: 539774 - RNA, 19 nt, Homo sapiens
gaaaagcccuaugaaugua

SEQ ID NO: 539775 - RNA, 19 nt, Homo sapiens
agcaagagcuuuaaucgaa

SEQ ID NO: 539776 - RNA, 19 nt, Homo sapiens
gagagagaagcgagaaaua

SEQ ID NO: 539777 - RNA, 19 nt, Homo sapiens
aaagggagacuauuucaaa

SEQ ID NO: 539778 - RNA, 19 nt, Homo sapiens
gagaugugaugcuggagaa

SEQ ID NO: 539779 - RNA, 19 nt, Homo sapiens
cuauaaaucucaacagcuu

SEQ ID NO: 539780 - RNA, 19 nt, Homo sapiens
ggaaggaguggaagcguuu

SEQ ID NO: 539781 - RNA, 19 nt, Homo sapiens
gaggaaaguuuaccuacag

SEQ ID NO: 539782 - RNA, 19 nt, Homo sapiens
gaaacccuaugaauguaau

SEQ ID NO: 539783 - RNA, 19 nt, Homo sapiens
ugacagugcucuuccuuca

SEQ ID NO: 539784 - RNA, 19 nt, Homo sapiens
ggaauguggaggaaaguuu

SEQ ID NO: 539785 - RNA, 19 nt, Homo sapiens
gggaaaaccuucagcugua

SEQ ID NO: 539786 - RNA, 19 nt, Homo sapiens
acagugcucuuccuucaaa

SEQ ID NO: 539787 - RNA, 19 nt, Homo sapiens
guaaggaugcuuucaagga

SEQ ID NO: 539788 - RNA, 19 nt, Homo sapiens
agaaaucacaccagccuua

SEQ ID NO: 539789 - RNA, 19 nt, Homo sapiens
gggagaaacccuaugaaug

SEQ ID NO: 539790 - RNA, 19 nt, Homo sapiens
gaacuucagaccuuauuca

SEQ ID NO: 539791 - RNA, 19 nt, Homo sapiens
ccauaagugugaugaaugu

SEQ ID NO: 539792 - RNA, 19 nt, Homo sapiens
gaccauguuuccaagagaa

SEQ ID NO: 539793 - RNA, 19 nt, Homo sapiens
gggaaagccuucagguaca

SEQ ID NO: 539794 - RNA, 19 nt, Homo sapiens
gaaaguuuaccuacaguuc

SEQ ID NO: 539795 - RNA, 19 nt, Homo sapiens
cuucagaccuuauucaaca

SEQ ID NO: 539796 - RNA, 19 nt, Homo sapiens
gaagacacaagaucacaug

SEQ ID NO: 539797 - RNA, 19 nt, Homo sapiens
ucuagggacugacuucaaa

SEQ ID NO: 539798 - RNA, 19 nt, Homo sapiens
aacagaggcugcuaaauuc

SEQ ID NO: 539799 - RNA, 19 nt, Homo sapiens
cuaaaugccuggguaagga

SEQ ID NO: 539800 - RNA, 19 nt, Homo sapiens
aaccuuaucucacaucaga

SEQ ID NO: 539801 - RNA, 19 nt, Homo sapiens
ggagacuauuucaaagcua

SEQ ID NO: 539802 - RNA, 19 nt, Homo sapiens
ggagagaagcccuacgaau

SEQ ID NO: 539803 - RNA, 19 nt, Homo sapiens
uaaucgaacuucagaccuu

SEQ ID NO: 539804 - RNA, 19 nt, Homo sapiens
ggucucaaguuuaaagaag

SEQ ID NO: 539805 - RNA, 19 nt, Homo sapiens
guacagcucggcucuuguu

SEQ ID NO: 539806 - RNA, 19 nt, Homo sapiens
ggguaaagggagacuauuu

SEQ ID NO: 539807 - RNA, 19 nt, Homo sapiens
ucagagaguccacgugaaa

SEQ ID NO: 539808 - RNA, 19 nt, Homo sapiens
ggaaaagcccuaugaaugu

SEQ ID NO: 539809 - RNA, 19 nt, Homo sapiens
gagcuuuaaucgaacuuca

SEQ ID NO: 539810 - RNA, 19 nt, Homo sapiens
gcacagacagcaguggaaa

SEQ ID NO: 539811 - RNA, 19 nt, Homo sapiens
caacucagacuuuucauuu

SEQ ID NO: 539812 - RNA, 19 nt, Homo sapiens
gugaugaugguguccuuua

SEQ ID NO: 539813 - RNA, 19 nt, Homo sapiens
guuacgaccgaguuaaaua

SEQ ID NO: 539814 - RNA, 19 nt, Homo sapiens
gagaagcgagaaauauaau

SEQ ID NO: 539815 - RNA, 19 nt, Homo sapiens
aggcugaucucguaucuca

SEQ ID NO: 539816 - RNA, 19 nt, Homo sapiens
gcuuuaaguuucgguaaga

SEQ ID NO: 539817 - RNA, 19 nt, Homo sapiens
guaaagggagacuauuuca

SEQ ID NO: 539818 - RNA, 19 nt, Homo sapiens
gguaaagggagacuauuuc

SEQ ID NO: 539819 - RNA, 19 nt, Homo sapiens
caaagaaggaaggaaagaa

SEQ ID NO: 539820 - RNA, 19 nt, Homo sapiens
aauccacacuggugagaaa

SEQ ID NO: 539821 - RNA, 19 nt, Homo sapiens
ccagagcucacaccuuauu

SEQ ID NO: 539822 - RNA, 19 nt, Homo sapiens
aaucgaacuucagaccuua

SEQ ID NO: 539823 - RNA, 19 nt, Homo sapiens
agagaagcgagaaauauaa

SEQ ID NO: 539824 - RNA, 19 nt, Homo sapiens
ggagagagaagcgagaaau

SEQ ID NO: 539825 - RNA, 19 nt, Homo sapiens
cucagggucucaaguuuaa

SEQ ID NO: 539826 - RNA, 19 nt, Homo sapiens
gcacagucgggacagaauu

SEQ ID NO: 539827 - RNA, 19 nt, Homo sapiens
ccuuaugaauguagugauu

SEQ ID NO: 539828 - RNA, 19 nt, Homo sapiens
ggguaaggaugcuuucaag

SEQ ID NO: 539829 - RNA, 19 nt, Homo sapiens
gagcagccagaccauguuu

SEQ ID NO: 539830 - RNA, 19 nt, Homo sapiens
gaagcacagucgggacaga

SEQ ID NO: 539831 - RNA, 19 nt, Homo sapiens
gaguuacgaccgaguuaaa

SEQ ID NO: 539832 - RNA, 19 nt, Homo sapiens
gggaaaagcccuaugaaug

SEQ ID NO: 539833 - RNA, 19 nt, Homo sapiens
acugugaauuccaaccuua

SEQ ID NO: 539834 - RNA, 19 nt, Homo sapiens
gagaauuacgggaaugugu

SEQ ID NO: 539835 - RNA, 19 nt, Homo sapiens
gguaaccuuugaggaugua

SEQ ID NO: 539836 - RNA, 19 nt, Homo sapiens
cuacgaauguauggaaugu

SEQ ID NO: 539837 - RNA, 19 nt, Homo sapiens
ucucagggucucaaguuua

SEQ ID NO: 539838 - RNA, 19 nt, Homo sapiens
augugaugcuggagaauua

SEQ ID NO: 539839 - RNA, 19 nt, Homo sapiens
gagcucacuuggccugcuu

SEQ ID NO: 539840 - RNA, 19 nt, Homo sapiens
gguagaagagauuccagaa

SEQ ID NO: 539841 - RNA, 19 nt, Homo sapiens
caaagcuacuguuccuagu

SEQ ID NO: 539842 - RNA, 19 nt, Homo sapiens
gaggguaaagggagacuau

SEQ ID NO: 539843 - RNA, 19 nt, Homo sapiens
gcucuggguccuguuauuu

SEQ ID NO: 539844 - RNA, 19 nt, Homo sapiens
cuacugggaagauuucaaa

SEQ ID NO: 539845 - RNA, 19 nt, Homo sapiens
gaugugaugcuggagaauu

SEQ ID NO: 539846 - RNA, 19 nt, Homo sapiens
ugauugcuguccucucuug

SEQ ID NO: 539847 - RNA, 19 nt, Homo sapiens
agagaagcccuacgaaugu

SEQ ID NO: 539848 - RNA, 19 nt, Homo sapiens
gaacagaaauugucacaga

SEQ ID NO: 539849 - RNA, 19 nt, Homo sapiens
gaaggaagauuuaccaaug

SEQ ID NO: 539850 - RNA, 19 nt, Homo sapiens
gcacaguaccuucaaauuu

SEQ ID NO: 539851 - RNA, 19 nt, Homo sapiens
ugaaauagguggaacagaa

SEQ ID NO: 539852 - RNA, 19 nt, Homo sapiens
gccauaagcucauaaacaa

SEQ ID NO: 539853 - RNA, 19 nt, Homo sapiens
acaagaagaugcuaaagaa

SEQ ID NO: 539854 - RNA, 19 nt, Homo sapiens
gguaacaauuugccauaua

SEQ ID NO: 539855 - RNA, 19 nt, Homo sapiens
ugaaauagcagaugaaguu

SEQ ID NO: 539856 - RNA, 19 nt, Homo sapiens
caaauacugugacuaugaa

SEQ ID NO: 539857 - RNA, 19 nt, Homo sapiens
gcaaauacugugacuauga

SEQ ID NO: 539858 - RNA, 19 nt, Homo sapiens
ggacucugauguuaauaaa

SEQ ID NO: 539859 - RNA, 19 nt, Homo sapiens
caucuugacuucugaacua

SEQ ID NO: 539860 - RNA, 19 nt, Homo sapiens
aaacugggauagaacauuu

SEQ ID NO: 539861 - RNA, 19 nt, Homo sapiens
cacaguaccuucaaauuug

SEQ ID NO: 539862 - RNA, 19 nt, Homo sapiens
gaacaugugguccaagauu

SEQ ID NO: 539863 - RNA, 19 nt, Homo sapiens
gaucacaucuugacuucug

SEQ ID NO: 539864 - RNA, 19 nt, Homo sapiens
cacagagacugauguagua

SEQ ID NO: 539865 - RNA, 19 nt, Homo sapiens
gaugagagccaguggauga

SEQ ID NO: 539866 - RNA, 19 nt, Homo sapiens
uauaauagguccugaugga

SEQ ID NO: 539867 - RNA, 19 nt, Homo sapiens
uuagaaagcagaaguagua

SEQ ID NO: 539868 - RNA, 19 nt, Homo sapiens
aaagacacaugaagaauca

SEQ ID NO: 539869 - RNA, 19 nt, Homo sapiens
gaaauagguggaacagaaa

SEQ ID NO: 539870 - RNA, 19 nt, Homo sapiens
ugaagaggauuuagaggaa

SEQ ID NO: 539871 - RNA, 19 nt, Homo sapiens
gaauacagcacuacagaug

SEQ ID NO: 539872 - RNA, 19 nt, Homo sapiens
gaacucaagaaacauauga

SEQ ID NO: 539873 - RNA, 19 nt, Homo sapiens
gggagaagaugguuuacau

SEQ ID NO: 539874 - RNA, 19 nt, Homo sapiens
aaaggaagcagucauguuu

SEQ ID NO: 539875 - RNA, 19 nt, Homo sapiens
gaguuuccauaaccacuua

SEQ ID NO: 539876 - RNA, 19 nt, Homo sapiens
gguccaagauuguguuuca

SEQ ID NO: 539877 - RNA, 19 nt, Homo sapiens
ucauaucuguccauacuaa

SEQ ID NO: 539878 - RNA, 19 nt, Homo sapiens
ugucacagaugaugggaua

SEQ ID NO: 539879 - RNA, 19 nt, Homo sapiens
caucauaucuguccauacu

SEQ ID NO: 539880 - RNA, 19 nt, Homo sapiens
cgacaaaacccaugaauuu

SEQ ID NO: 539881 - RNA, 19 nt, Homo sapiens
gcgcugaaauagcagauga

SEQ ID NO: 539882 - RNA, 19 nt, Homo sapiens
agaagaagaugauaucagu

SEQ ID NO: 539883 - RNA, 19 nt, Homo sapiens
guguacagauugugacuuu

SEQ ID NO: 539884 - RNA, 19 nt, Homo sapiens
gaagauggguuugguucug

SEQ ID NO: 539885 - RNA, 19 nt, Homo sapiens
uaacauagcacagaaggaa

SEQ ID NO: 539886 - RNA, 19 nt, Homo sapiens
guuccugguucuacaguua

SEQ ID NO: 539887 - RNA, 19 nt, Homo sapiens
ucaagcagcuggagguguu

SEQ ID NO: 539888 - RNA, 19 nt, Homo sapiens
ccacugaguuccaauaaac

SEQ ID NO: 539889 - RNA, 19 nt, Homo sapiens
uaaacgacaugugauauca

SEQ ID NO: 539890 - RNA, 19 nt, Homo sapiens
cagaugaaguuuacaugga

SEQ ID NO: 539891 - RNA, 19 nt, Homo sapiens
guacaccaguggacauuca

SEQ ID NO: 539892 - RNA, 19 nt, Homo sapiens
gagacaagagaauguagua

SEQ ID NO: 539893 - RNA, 19 nt, Homo sapiens
cauaagagcaccaauucaa

SEQ ID NO: 539894 - RNA, 19 nt, Homo sapiens
cacauuaagucuaaacaug

SEQ ID NO: 539895 - RNA, 19 nt, Homo sapiens
cccaugaauuuacagaaua

SEQ ID NO: 539896 - RNA, 19 nt, Homo sapiens
ucugaagacuacuuaauga

SEQ ID NO: 539897 - RNA, 19 nt, Homo sapiens
uccgauccauuuauucuua

SEQ ID NO: 539898 - RNA, 19 nt, Homo sapiens
cuaugaaacugcagaacaa

SEQ ID NO: 539899 - RNA, 19 nt, Homo sapiens
ggccauauccuuucaguuc

SEQ ID NO: 539900 - RNA, 19 nt, Homo sapiens
ugaggacucugauguuaau

SEQ ID NO: 539901 - RNA, 19 nt, Homo sapiens
aagcugauguugccauuga

SEQ ID NO: 539902 - RNA, 19 nt, Homo sapiens
agaaagaagcuauuuagga

SEQ ID NO: 539903 - RNA, 19 nt, Homo sapiens
caagagaggauucagacaa

SEQ ID NO: 539904 - RNA, 19 nt, Homo sapiens
cuaaagaucagccauugaa

SEQ ID NO: 539905 - RNA, 19 nt, Homo sapiens
ccauggaccugauaucauc

SEQ ID NO: 539906 - RNA, 19 nt, Homo sapiens
gaugaugggauaacucuug

SEQ ID NO: 539907 - RNA, 19 nt, Homo sapiens
caucugaguccucuaauau

SEQ ID NO: 539908 - RNA, 19 nt, Homo sapiens
ccauaucagugucaguauu

SEQ ID NO: 539909 - RNA, 19 nt, Homo sapiens
ucaaauuugugacggcauu

SEQ ID NO: 539910 - RNA, 19 nt, Homo sapiens
cuugaggacucugauguua

SEQ ID NO: 539911 - RNA, 19 nt, Homo sapiens
uaaagaagauggguuuggu

SEQ ID NO: 539912 - RNA, 19 nt, Homo sapiens
uagaacaugugguccaaga

SEQ ID NO: 539913 - RNA, 19 nt, Homo sapiens
agaggugaauacaaguuua

SEQ ID NO: 539914 - RNA, 19 nt, Homo sapiens
gaagcuauuuaggagauau

SEQ ID NO: 539915 - RNA, 19 nt, Homo sapiens
aaugugaggucugugauaa

SEQ ID NO: 539916 - RNA, 19 nt, Homo sapiens
gaccauaagagcaccaauu

SEQ ID NO: 539917 - RNA, 19 nt, Homo sapiens
gugcaaauacugugacuau

SEQ ID NO: 539918 - RNA, 19 nt, Homo sapiens
agaaagccauaagcucaua

SEQ ID NO: 539919 - RNA, 19 nt, Homo sapiens
gacaagagaauguaguaga

SEQ ID NO: 539920 - RNA, 19 nt, Homo sapiens
gcagcacaguaccuucaaa

SEQ ID NO: 539921 - RNA, 19 nt, Homo sapiens
gaaauagcagaugaaguuu

SEQ ID NO: 539922 - RNA, 19 nt, Homo sapiens
uaacagaaggugugauugu

SEQ ID NO: 539923 - RNA, 19 nt, Homo sapiens
agacugauguaguaacaga

SEQ ID NO: 539924 - RNA, 19 nt, Homo sapiens
gagaccauauuguuguuuc

SEQ ID NO: 539925 - RNA, 19 nt, Homo sapiens
ggaaggaagauuuaccaau

SEQ ID NO: 539926 - RNA, 19 nt, Homo sapiens
uaaaacauccgauccauuu

SEQ ID NO: 539927 - RNA, 19 nt, Homo sapiens
ucugaguccucuaauauug

SEQ ID NO: 539928 - RNA, 19 nt, Homo sapiens
gcauuagaaagcagaagua

SEQ ID NO: 539929 - RNA, 19 nt, Homo sapiens
guuugguucugaaguuaua

SEQ ID NO: 539930 - RNA, 19 nt, Homo sapiens
ggguuugguucugaaguua

SEQ ID NO: 539931 - RNA, 19 nt, Homo sapiens
cgaagaugaugaugaugau

SEQ ID NO: 539932 - RNA, 19 nt, Homo sapiens
ccaugauuaugcaagauuu

SEQ ID NO: 539933 - RNA, 19 nt, Homo sapiens
gaaacugggauagaacauu

SEQ ID NO: 539934 - RNA, 19 nt, Homo sapiens
gaauacacacgaagauaca

SEQ ID NO: 539935 - RNA, 19 nt, Homo sapiens
gaaaccaggcaguggcaaa

SEQ ID NO: 539936 - RNA, 19 nt, Homo sapiens
gaaugcagcgggagaagau

SEQ ID NO: 539937 - RNA, 19 nt, Homo sapiens
ggcugaagaugauguugaa

SEQ ID NO: 539938 - RNA, 19 nt, Homo sapiens
gagagccaguggaugaaau

SEQ ID NO: 539939 - RNA, 19 nt, Homo sapiens
caagaagggauuccgaaga

SEQ ID NO: 539940 - RNA, 19 nt, Homo sapiens
cagugucaguauuguauuu

SEQ ID NO: 539941 - RNA, 19 nt, Homo sapiens
gaaaauaacauagcacaga

SEQ ID NO: 539942 - RNA, 19 nt, Homo sapiens
gaaagcagaaguaguacag

SEQ ID NO: 539943 - RNA, 19 nt, Homo sapiens
ggacucagcauuagaaagc

SEQ ID NO: 539944 - RNA, 19 nt, Homo sapiens
agaagaugcuaaagaagau

SEQ ID NO: 539945 - RNA, 19 nt, Homo sapiens
gcaagaauuuuccucaugu

SEQ ID NO: 539946 - RNA, 19 nt, Homo sapiens
gugacggcauuaauacaaa

SEQ ID NO: 539947 - RNA, 19 nt, Homo sapiens
agaugaaguuuacauggaa

SEQ ID NO: 539948 - RNA, 19 nt, Homo sapiens
gaauaaaccuauagccuua

SEQ ID NO: 539949 - RNA, 19 nt, Homo sapiens
gcacacagcuuacaauaca

SEQ ID NO: 539950 - RNA, 19 nt, Homo sapiens
guucagggcucacaccuua

SEQ ID NO: 539951 - RNA, 19 nt, Homo sapiens
aaucguagcucaaggcuua

SEQ ID NO: 539952 - RNA, 19 nt, Homo sapiens
gagagaagccuuauaaaug

SEQ ID NO: 539953 - RNA, 19 nt, Homo sapiens
gggaaagccuucagucaaa

SEQ ID NO: 539954 - RNA, 19 nt, Homo sapiens
caagacagauucuacgauu

SEQ ID NO: 539955 - RNA, 19 nt, Homo sapiens
ggaaaagccuucaguauga

SEQ ID NO: 539956 - RNA, 19 nt, Homo sapiens
ggagaagccuuauaaaugc

SEQ ID NO: 539957 - RNA, 19 nt, Homo sapiens
gagaggcccuauaaaugua

SEQ ID NO: 539958 - RNA, 19 nt, Homo sapiens
gagagaaacccuuuaaaug

SEQ ID NO: 539959 - RNA, 19 nt, Homo sapiens
gggagaagccuuauaaaug

SEQ ID NO: 539960 - RNA, 19 nt, Homo sapiens
ggagagaggcccuauaaau

SEQ ID NO: 539961 - RNA, 19 nt, Homo sapiens
gagaaacccuuuaaaugca

SEQ ID NO: 539962 - RNA, 19 nt, Homo sapiens
ggagagaagccuuauaaau

SEQ ID NO: 539963 - RNA, 19 nt, Homo sapiens
ggagagaaacccuuuaaau

SEQ ID NO: 539964 - RNA, 19 nt, Homo sapiens
gagagaagccguacgaaug

SEQ ID NO: 539965 - RNA, 19 nt, Homo sapiens
gagagaggcccuauaaaug

SEQ ID NO: 539966 - RNA, 19 nt, Homo sapiens
gauagaccacuuacauaua

SEQ ID NO: 539967 - RNA, 19 nt, Homo sapiens
guacgaaugugcagagugu

SEQ ID NO: 539968 - RNA, 19 nt, Homo sapiens
ggagagaggcccuaugguu

SEQ ID NO: 539969 - RNA, 19 nt, Homo sapiens
ggauagaccacuuacauau

SEQ ID NO: 539970 - RNA, 19 nt, Homo sapiens
gagaaacccuaugugugua

SEQ ID NO: 539971 - RNA, 19 nt, Homo sapiens
gguuguaguucacggcuua

SEQ ID NO: 539972 - RNA, 19 nt, Homo sapiens
gcucugcauugggaaauua

SEQ ID NO: 539973 - RNA, 19 nt, Homo sapiens
gagcacacagcuuacaaua

SEQ ID NO: 539974 - RNA, 19 nt, Homo sapiens
agucagaguuccagccuua

SEQ ID NO: 539975 - RNA, 19 nt, Homo sapiens
ggaaaagccuucagucaga

SEQ ID NO: 539976 - RNA, 19 nt, Homo sapiens
gagaagcccuacagaugug

SEQ ID NO: 539977 - RNA, 19 nt, Homo sapiens
ucauggaggugguaacauu

SEQ ID NO: 539978 - RNA, 19 nt, Homo sapiens
ggagagaaacccuaugugu

SEQ ID NO: 539979 - RNA, 19 nt, Homo sapiens
ugaagacugugagaagaua

SEQ ID NO: 539980 - RNA, 19 nt, Homo sapiens
gggagaagcccuacagaug

SEQ ID NO: 539981 - RNA, 19 nt, Homo sapiens
ucagagaauucacgcugua

SEQ ID NO: 539982 - RNA, 19 nt, Homo sapiens
ggagaagcccuacagaugu

SEQ ID NO: 539983 - RNA, 19 nt, Homo sapiens
guagagaaaccauuuaagu

SEQ ID NO: 539984 - RNA, 19 nt, Homo sapiens
gggaagugaugcuggagaa

SEQ ID NO: 539985 - RNA, 19 nt, Homo sapiens
gggauagaccacuuacaua

SEQ ID NO: 539986 - RNA, 19 nt, Homo sapiens
cuacagaugugaggaaugu

SEQ ID NO: 539987 - RNA, 19 nt, Homo sapiens
ggaagcagcggccuggauu

SEQ ID NO: 539988 - RNA, 19 nt, Homo sapiens
gcagcggccuggauuguca

SEQ ID NO: 539989 - RNA, 19 nt, Homo sapiens
cgccugagcucaaaacuua

SEQ ID NO: 539990 - RNA, 19 nt, Homo sapiens
ggaaacauacaaauaacug

SEQ ID NO: 539991 - RNA, 19 nt, Homo sapiens
guucacaccuaauuauaca

SEQ ID NO: 539992 - RNA, 19 nt, Homo sapiens
agagaagccuuauaaaugc

SEQ ID NO: 539993 - RNA, 19 nt, Homo sapiens
uagcagaugucaagaaugc

SEQ ID NO: 539994 - RNA, 19 nt, Homo sapiens
agaaaccauuuaaguguga

SEQ ID NO: 539995 - RNA, 19 nt, Homo sapiens
ggagagaagccguacgaau

SEQ ID NO: 539996 - RNA, 19 nt, Homo sapiens
aguaugagcacacagcuua

SEQ ID NO: 539997 - RNA, 19 nt, Homo sapiens
caucagagaauccauaaag

SEQ ID NO: 539998 - RNA, 19 nt, Homo sapiens
gcaccaaggaccuccaaga

SEQ ID NO: 539999 - RNA, 19 nt, Homo sapiens
uaacugccauggagagaag

SEQ ID NO: 540000 - RNA, 19 nt, Homo sapiens
aagacagauucuacgauua

SEQ ID NO: 540001 - RNA, 19 nt, Homo sapiens
gaauucacgcuguagagaa

SEQ ID NO: 540002 - RNA, 19 nt, Homo sapiens
agagaaacccuaugugugu

SEQ ID NO: 540003 - RNA, 19 nt, Homo sapiens
caucagagccacuucagau

SEQ ID NO: 540004 - RNA, 19 nt, Homo sapiens
ggcuuuaccuuccaaaaua

SEQ ID NO: 540005 - RNA, 19 nt, Homo sapiens
ggacauggacauccuaaaa

SEQ ID NO: 540006 - RNA, 19 nt, Homo sapiens
gaacaccagagaauacaca

SEQ ID NO: 540007 - RNA, 19 nt, Homo sapiens
cagcuuacaauacaucaaa

SEQ ID NO: 540008 - RNA, 19 nt, Homo sapiens
caccagagaauacacacua

SEQ ID NO: 540009 - RNA, 19 nt, Homo sapiens
agagaaaccauuuaagugu

SEQ ID NO: 540010 - RNA, 19 nt, Homo sapiens
ucagaauccuggcuuugga

SEQ ID NO: 540011 - RNA, 19 nt, Homo sapiens
gagaagccuuauaaaugca

SEQ ID NO: 540012 - RNA, 19 nt, Homo sapiens
agagaggcccuauaaaugu

SEQ ID NO: 540013 - RNA, 19 nt, Homo sapiens
gagaagccuuauaaaugca

SEQ ID NO: 540014 - RNA, 19 nt, Homo sapiens
cuggagagaagccuuauaa

SEQ ID NO: 540015 - RNA, 19 nt, Homo sapiens
agagaaacccuuuaaaugc

SEQ ID NO: 540016 - RNA, 19 nt, Homo sapiens
caacaccagauaauucaug

SEQ ID NO: 540017 - RNA, 19 nt, Homo sapiens
gaaacccuauguguguaau

SEQ ID NO: 540018 - RNA, 19 nt, Homo sapiens
uagagaaaccauuuaagug

SEQ ID NO: 540019 - RNA, 19 nt, Homo sapiens
cagaguuccagccuuauuu

SEQ ID NO: 540020 - RNA, 19 nt, Homo sapiens
cagagccacuucagauauc

SEQ ID NO: 540021 - RNA, 19 nt, Homo sapiens
gcguucacaccuaauuaua

SEQ ID NO: 540022 - RNA, 19 nt, Homo sapiens
ucagagaauccauaaagga

SEQ ID NO: 540023 - RNA, 19 nt, Homo sapiens
aauucacgcuguagagaaa

SEQ ID NO: 540024 - RNA, 19 nt, Homo sapiens
gagaggcccuacccuugca

SEQ ID NO: 540025 - RNA, 19 nt, Homo sapiens
cgauguggcugugcacuuc

SEQ ID NO: 540026 - RNA, 19 nt, Homo sapiens
ggacaguggucagaaucuc

SEQ ID NO: 540027 - RNA, 19 nt, Homo sapiens
agucaaaacucaacccuuu

SEQ ID NO: 540028 - RNA, 19 nt, Homo sapiens
agaguuccagccuuauuua

SEQ ID NO: 540029 - RNA, 19 nt, Homo sapiens
ccuuauaaaugcaacaagu

SEQ ID NO: 540030 - RNA, 19 nt, Homo sapiens
guggaucucucgccugagu

SEQ ID NO: 540031 - RNA, 19 nt, Homo sapiens
cuaauuauacaccagagaa

SEQ ID NO: 540032 - RNA, 19 nt, Homo sapiens
ggaaagccuucagucaaaa

SEQ ID NO: 540033 - RNA, 19 nt, Homo sapiens
cuggagagaggcccuauaa

SEQ ID NO: 540034 - RNA, 19 nt, Homo sapiens
gcuguagagaaaccauuua

SEQ ID NO: 540035 - RNA, 19 nt, Homo sapiens
ucagagccacuucagauau

SEQ ID NO: 540036 - RNA, 19 nt, Homo sapiens
agacagauucuacgauuag

SEQ ID NO: 540037 - RNA, 19 nt, Homo sapiens
uuaaucagcaucagagaau

SEQ ID NO: 540038 - RNA, 19 nt, Homo sapiens
gagaagccguacgaaugug

SEQ ID NO: 540039 - RNA, 19 nt, Homo sapiens
caguguggcuggacuagca

SEQ ID NO: 540040 - RNA, 19 nt, Homo sapiens
gauucacacuggagagaag

SEQ ID NO: 540041 - RNA, 19 nt, Homo sapiens
gggagagaaacccuuuaaa

SEQ ID NO: 540042 - RNA, 19 nt, Homo sapiens
gauugucagccucuugaaa

SEQ ID NO: 540043 - RNA, 19 nt, Homo sapiens
acacuggagagaagccuua

SEQ ID NO: 540044 - RNA, 19 nt, Homo sapiens
gaaugaggagacugugguu

SEQ ID NO: 540045 - RNA, 19 nt, Homo sapiens
uuggagacguuucugauuc

SEQ ID NO: 540046 - RNA, 19 nt, Homo sapiens
aaaccuauagccuuaacuu

SEQ ID NO: 540047 - RNA, 19 nt, Homo sapiens
ugugaagacugugagaaga

SEQ ID NO: 540048 - RNA, 19 nt, Homo sapiens
caagugaagucaacuguua

SEQ ID NO: 540049 - RNA, 19 nt, Homo sapiens
ggauagagguuuccaguuu

SEQ ID NO: 540050 - RNA, 19 nt, Homo sapiens
gaauagggauugaugaaug

SEQ ID NO: 540051 - RNA, 19 nt, Homo sapiens
gcacgggaaugcacaauug

SEQ ID NO: 540052 - RNA, 19 nt, Homo sapiens
gcucagaguuagcauaauu

SEQ ID NO: 540053 - RNA, 19 nt, Homo sapiens
gcaaggagcccaagagaga

SEQ ID NO: 540054 - RNA, 19 nt, Homo sapiens
ucacagaaaucaagauguu

SEQ ID NO: 540055 - RNA, 19 nt, Homo sapiens
agacaacuguguuucauuu

SEQ ID NO: 540056 - RNA, 19 nt, Homo sapiens
ggaaagagcaacugaaguc

SEQ ID NO: 540057 - RNA, 19 nt, Homo sapiens
cgagagaaaucggaauaaa

SEQ ID NO: 540058 - RNA, 19 nt, Homo sapiens
gagcuuuacuugccgugua

SEQ ID NO: 540059 - RNA, 19 nt, Homo sapiens
gauagagguuuccaguuug

SEQ ID NO: 540060 - RNA, 19 nt, Homo sapiens
aaaccgacuuucugcauuu

SEQ ID NO: 540061 - RNA, 19 nt, Homo sapiens
gaggaugccugcuauaacu

SEQ ID NO: 540062 - RNA, 19 nt, Homo sapiens
caacugaaguccuagaaaa

SEQ ID NO: 540063 - RNA, 19 nt, Homo sapiens
ucaaguaacaucuguauca

SEQ ID NO: 540064 - RNA, 19 nt, Homo sapiens
aaacaucaaugcucagagu

SEQ ID NO: 540065 - RNA, 19 nt, Homo sapiens
ggaacaacuucaucacagu

SEQ ID NO: 540066 - RNA, 19 nt, Homo sapiens
gcaaugagugcuucaagug

SEQ ID NO: 540067 - RNA, 19 nt, Homo sapiens
cuacauagaacauacaguu

SEQ ID NO: 540068 - RNA, 19 nt, Homo sapiens
gccaucaacugcagcaaga

SEQ ID NO: 540069 - RNA, 19 nt, Homo sapiens
ccucgucucuuccagauau

SEQ ID NO: 540070 - RNA, 19 nt, Homo sapiens
aagagcaacugaaguccua

SEQ ID NO: 540071 - RNA, 19 nt, Homo sapiens
caagacaagugaagucaac

SEQ ID NO: 540072 - RNA, 19 nt, Homo sapiens
gcaaagguuuagaacacau

SEQ ID NO: 540073 - RNA, 19 nt, Homo sapiens
uaucaggcccuacauagaa

SEQ ID NO: 540074 - RNA, 19 nt, Homo sapiens
uaaugauggucuuggauug

SEQ ID NO: 540075 - RNA, 19 nt, Homo sapiens
ugguagagguguuauguau

SEQ ID NO: 540076 - RNA, 19 nt, Homo sapiens
aaagugaagugcuauaggu

SEQ ID NO: 540077 - RNA, 19 nt, Homo sapiens
gcaaugcugcuacaacugu

SEQ ID NO: 540078 - RNA, 19 nt, Homo sapiens
ugaccucaguagcuauuaa

SEQ ID NO: 540079 - RNA, 19 nt, Homo sapiens
cauagauggugauggcaaa

SEQ ID NO: 540080 - RNA, 19 nt, Homo sapiens
guauaaugauggucuugga

SEQ ID NO: 540081 - RNA, 19 nt, Homo sapiens
uggugaaacuggucaugua

SEQ ID NO: 540082 - RNA, 19 nt, Homo sapiens
caagagagagcgagagcaa

SEQ ID NO: 540083 - RNA, 19 nt, Homo sapiens
cgguagagguggccacauu

SEQ ID NO: 540084 - RNA, 19 nt, Homo sapiens
gcaacugaaguccuagaaa

SEQ ID NO: 540085 - RNA, 19 nt, Homo sapiens
gcaacucccaggccaguga

SEQ ID NO: 540086 - RNA, 19 nt, Homo sapiens
ucacaguguugauguugga

SEQ ID NO: 540087 - RNA, 19 nt, Homo sapiens
gguagagguguuauguaua

SEQ ID NO: 540088 - RNA, 19 nt, Homo sapiens
caucaaugcucagaguuag

SEQ ID NO: 540089 - RNA, 19 nt, Homo sapiens
cauuugcuguaaucaguuu

SEQ ID NO: 540090 - RNA, 19 nt, Homo sapiens
agaguuagcauaauuugga

SEQ ID NO: 540091 - RNA, 19 nt, Homo sapiens
ccaugcagaugagcagaaa

SEQ ID NO: 540092 - RNA, 19 nt, Homo sapiens
ucacuuagacaacuguguu

SEQ ID NO: 540093 - RNA, 19 nt, Homo sapiens
caucaaguaacaucuguau

SEQ ID NO: 540094 - RNA, 19 nt, Homo sapiens
gugaauagggauugaugaa

SEQ ID NO: 540095 - RNA, 19 nt, Homo sapiens
cuacaacuguggcaaacca

SEQ ID NO: 540096 - RNA, 19 nt, Homo sapiens
uggcaaagguuuagaacac

SEQ ID NO: 540097 - RNA, 19 nt, Homo sapiens
acaucaaugcucagaguua

SEQ ID NO: 540098 - RNA, 19 nt, Homo sapiens
acauagaacauacaguuga

SEQ ID NO: 540099 - RNA, 19 nt, Homo sapiens
ucugauugaugguuguauu

SEQ ID NO: 540100 - RNA, 19 nt, Homo sapiens
gagagaaaucggaauaaaa

SEQ ID NO: 540101 - RNA, 19 nt, Homo sapiens
cauagaacauacaguugag

SEQ ID NO: 540102 - RNA, 19 nt, Homo sapiens
gaccucaguagcuauuaaa

SEQ ID NO: 540103 - RNA, 19 nt, Homo sapiens
gaguugagucagaccagua

SEQ ID NO: 540104 - RNA, 19 nt, Homo sapiens
gcuacagccuaauuauuuu

SEQ ID NO: 540105 - RNA, 19 nt, Homo sapiens
guaaacaucaaugcucaga

SEQ ID NO: 540106 - RNA, 19 nt, Homo sapiens
caaguaacaucuguaucag

SEQ ID NO: 540107 - RNA, 19 nt, Homo sapiens
gcaagacaagugaagucaa

SEQ ID NO: 540108 - RNA, 19 nt, Homo sapiens
guaucaggcccuacauaga

SEQ ID NO: 540109 - RNA, 19 nt, Homo sapiens
uaacaucaaguaacaucug

SEQ ID NO: 540110 - RNA, 19 nt, Homo sapiens
ccucuucacuggccaaagg

SEQ ID NO: 540111 - RNA, 19 nt, Homo sapiens
agagagagcgagagcaaug

SEQ ID NO: 540112 - RNA, 19 nt, Homo sapiens
ugccaaggauugugaucuu

SEQ ID NO: 540113 - RNA, 19 nt, Homo sapiens
gccaugagcagcaaugagu

SEQ ID NO: 540114 - RNA, 19 nt, Homo sapiens
gauggaaagagcaacugaa

SEQ ID NO: 540115 - RNA, 19 nt, Homo sapiens
caacuguguuucauuugcu

SEQ ID NO: 540116 - RNA, 19 nt, Homo sapiens
ggcaaagguuuagaacaca

SEQ ID NO: 540117 - RNA, 19 nt, Homo sapiens
ugggaagaguugagucaga

SEQ ID NO: 540118 - RNA, 19 nt, Homo sapiens
aaagacugcaccaaaguga

SEQ ID NO: 540119 - RNA, 19 nt, Homo sapiens
ggaggaugccugcuauaac

SEQ ID NO: 540120 - RNA, 19 nt, Homo sapiens
caaagguuuagaacacauu

SEQ ID NO: 540121 - RNA, 19 nt, Homo sapiens
cugauugaugguuguauua

SEQ ID NO: 540122 - RNA, 19 nt, Homo sapiens
aaacaggaacaacuucauc

SEQ ID NO: 540123 - RNA, 19 nt, Homo sapiens
uaauggcuguucgagagaa

SEQ ID NO: 540124 - RNA, 19 nt, Homo sapiens
aaccgacuuucugcauuua

SEQ ID NO: 540125 - RNA, 19 nt, Homo sapiens
gccaaggauugugaucuuc

SEQ ID NO: 540126 - RNA, 19 nt, Homo sapiens
aaacccagaguaaacauca

SEQ ID NO: 540127 - RNA, 19 nt, Homo sapiens
ggacacauagauggugaug

SEQ ID NO: 540128 - RNA, 19 nt, Homo sapiens
gacaagugaagucaacugu

SEQ ID NO: 540129 - RNA, 19 nt, Homo sapiens
gguagagguggccacauug

SEQ ID NO: 540130 - RNA, 19 nt, Homo sapiens
cacagaaaucaagauguua

SEQ ID NO: 540131 - RNA, 19 nt, Homo sapiens
aauagggauugaugaaugg

SEQ ID NO: 540132 - RNA, 19 nt, Homo sapiens
caaugagugcuucaagugu

SEQ ID NO: 540133 - RNA, 19 nt, Homo sapiens
uuagacaacuguguuucau

SEQ ID NO: 540134 - RNA, 19 nt, Homo sapiens
gaucugacugcagccauga

SEQ ID NO: 540135 - RNA, 19 nt, Homo sapiens
ugcuauagguguggugaaa

SEQ ID NO: 540136 - RNA, 19 nt, Homo sapiens
gagcaacugaaguccuaga

SEQ ID NO: 540137 - RNA, 19 nt, Homo sapiens
ccaaggauugugaucuuca

SEQ ID NO: 540138 - RNA, 19 nt, Homo sapiens
ucagaguuagcauaauuug

SEQ ID NO: 540139 - RNA, 19 nt, Homo sapiens
ggugaauagggauugauga

SEQ ID NO: 540140 - RNA, 19 nt, Homo sapiens
ggccagugagcuuuacuug

SEQ ID NO: 540141 - RNA, 19 nt, Homo sapiens
auagagguuuccaguuugu

SEQ ID NO: 540142 - RNA, 19 nt, Homo sapiens
cuauagguguggugaaacu

SEQ ID NO: 540143 - RNA, 19 nt, Homo sapiens
ccaaagugaagugcuauag

SEQ ID NO: 540144 - RNA, 19 nt, Homo sapiens
uucaggaauugcagagaaa

SEQ ID NO: 540145 - RNA, 19 nt, Homo sapiens
agcauaauuuggagcuauu

SEQ ID NO: 540146 - RNA, 19 nt, Homo sapiens
acaguugagugggaguaaa

SEQ ID NO: 540147 - RNA, 19 nt, Homo sapiens
auaaugauggucuuggauu

SEQ ID NO: 540148 - RNA, 19 nt, Homo sapiens
ggaauaagcucaaauaugu

SEQ ID NO: 540149 - RNA, 19 nt, Homo sapiens
gagauaagcuguacaaauu

SEQ ID NO: 540150 - RNA, 19 nt, Homo sapiens
gaagagaccuauaaaugua

SEQ ID NO: 540151 - RNA, 19 nt, Homo sapiens
gaagaagucuggaaaugua

SEQ ID NO: 540152 - RNA, 19 nt, Homo sapiens
ggaaugaucucugguauuu

SEQ ID NO: 540153 - RNA, 19 nt, Homo sapiens
guucauagcucuaggcuua

SEQ ID NO: 540154 - RNA, 19 nt, Homo sapiens
ggacagcgcuuguuaauac

SEQ ID NO: 540155 - RNA, 19 nt, Homo sapiens
ggaaagaaaccacagauuu

SEQ ID NO: 540156 - RNA, 19 nt, Homo sapiens
ccagaacucuccauuuaua

SEQ ID NO: 540157 - RNA, 19 nt, Homo sapiens
caacauaccuaucagaaau

SEQ ID NO: 540158 - RNA, 19 nt, Homo sapiens
aauauuagcugcucaauga

SEQ ID NO: 540159 - RNA, 19 nt, Homo sapiens
ggauugagaugauauguau

SEQ ID NO: 540160 - RNA, 19 nt, Homo sapiens
ggaguagaauagucacuua

SEQ ID NO: 540161 - RNA, 19 nt, Homo sapiens
uuaaugagcuuuccuauuc

SEQ ID NO: 540162 - RNA, 19 nt, Homo sapiens
guaagaggauaucuaguuu

SEQ ID NO: 540163 - RNA, 19 nt, Homo sapiens
gagaagagaccuauaaaug

SEQ ID NO: 540164 - RNA, 19 nt, Homo sapiens
gaaaaucacugacaaauag

SEQ ID NO: 540165 - RNA, 19 nt, Homo sapiens
gaauagugccugacauaua

SEQ ID NO: 540166 - RNA, 19 nt, Homo sapiens
ggaaacagcuuagaauagu

SEQ ID NO: 540167 - RNA, 19 nt, Homo sapiens
gaccaagucuuaaaugcua

SEQ ID NO: 540168 - RNA, 19 nt, Homo sapiens
gaaaugugaugcuggagaa

SEQ ID NO: 540169 - RNA, 19 nt, Homo sapiens
ggauauagguuucauuucu

SEQ ID NO: 540170 - RNA, 19 nt, Homo sapiens
ccucuaaccuuauuggaua

SEQ ID NO: 540171 - RNA, 19 nt, Homo sapiens
ccagagaucucaccuuguu

SEQ ID NO: 540172 - RNA, 19 nt, Homo sapiens
gagagaguauuuccauaaa

SEQ ID NO: 540173 - RNA, 19 nt, Homo sapiens
gcucauacuugucguugua

SEQ ID NO: 540174 - RNA, 19 nt, Homo sapiens
caaguguccucaugugaua

SEQ ID NO: 540175 - RNA, 19 nt, Homo sapiens
gauaagcuguacaaauuga

SEQ ID NO: 540176 - RNA, 19 nt, Homo sapiens
gagacaaacuguacacaug

SEQ ID NO: 540177 - RNA, 19 nt, Homo sapiens
gauaaugacaacucucuua

SEQ ID NO: 540178 - RNA, 19 nt, Homo sapiens
ggucaaacuuucugucaaa

SEQ ID NO: 540179 - RNA, 19 nt, Homo sapiens
gagaugauauguaugaauc

SEQ ID NO: 540180 - RNA, 19 nt, Homo sapiens
gaaaucugcuugugugcuu

SEQ ID NO: 540181 - RNA, 19 nt, Homo sapiens
gcaauccugugacauuaaa

SEQ ID NO: 540182 - RNA, 19 nt, Homo sapiens
ggaagaggaucuauuuuaa

SEQ ID NO: 540183 - RNA, 19 nt, Homo sapiens
gauacacacuggagagaaa

SEQ ID NO: 540184 - RNA, 19 nt, Homo sapiens
gagaaacccuaugaaugua

SEQ ID NO: 540185 - RNA, 19 nt, Homo sapiens
ggcaagaauugaaaguaua

SEQ ID NO: 540186 - RNA, 19 nt, Homo sapiens
gggcauacauagagagaaa

SEQ ID NO: 540187 - RNA, 19 nt, Homo sapiens
gggcaagaauugaaaguau

SEQ ID NO: 540188 - RNA, 19 nt, Homo sapiens
agccagaacucuccauuua

SEQ ID NO: 540189 - RNA, 19 nt, Homo sapiens
gcaaguaacaguaaugaau

SEQ ID NO: 540190 - RNA, 19 nt, Homo sapiens
gaaauguagagaccaguua

SEQ ID NO: 540191 - RNA, 19 nt, Homo sapiens
caacacaucuccacuacca

SEQ ID NO: 540192 - RNA, 19 nt, Homo sapiens
ggugauaaauccuacaaau

SEQ ID NO: 540193 - RNA, 19 nt, Homo sapiens
gaaguaucaucaagaacaa

SEQ ID NO: 540194 - RNA, 19 nt, Homo sapiens
guaauucucuggauguuag

SEQ ID NO: 540195 - RNA, 19 nt, Homo sapiens
uuaaauaggugaguuguug

SEQ ID NO: 540196 - RNA, 19 nt, Homo sapiens
cauaguaggugccauuaau

SEQ ID NO: 540197 - RNA, 19 nt, Homo sapiens
gaggauaucuaguuucucu

SEQ ID NO: 540198 - RNA, 19 nt, Homo sapiens
gagagaaacccuaugaaug

SEQ ID NO: 540199 - RNA, 19 nt, Homo sapiens
gagagaaacccuaugaaug

SEQ ID NO: 540200 - RNA, 19 nt, Homo sapiens
gcauauccguguaauggaa

SEQ ID NO: 540201 - RNA, 19 nt, Homo sapiens
gguccuggguuucauguuu

SEQ ID NO: 540202 - RNA, 19 nt, Homo sapiens
ucaggagacuugagaacua

SEQ ID NO: 540203 - RNA, 19 nt, Homo sapiens
ccagacaaaucauauuaga

SEQ ID NO: 540204 - RNA, 19 nt, Homo sapiens
gcucuuaacauugcuaaua

SEQ ID NO: 540205 - RNA, 19 nt, Homo sapiens
gcuagaaucugagaaggaa

SEQ ID NO: 540206 - RNA, 19 nt, Homo sapiens
guacacaaauccaucagau

SEQ ID NO: 540207 - RNA, 19 nt, Homo sapiens
ggagauaagcuguacaaau

SEQ ID NO: 540208 - RNA, 19 nt, Homo sapiens
gagagcaguucuuaacaug

SEQ ID NO: 540209 - RNA, 19 nt, Homo sapiens
gagaauucauguuggagaa

SEQ ID NO: 540210 - RNA, 19 nt, Homo sapiens
ggagagaaaccauaugaau

SEQ ID NO: 540211 - RNA, 19 nt, Homo sapiens
uaaagaauguggaaagucu

SEQ ID NO: 540212 - RNA, 19 nt, Homo sapiens
gauaagcaauccugugaca

SEQ ID NO: 540213 - RNA, 19 nt, Homo sapiens
ggagucgcguucucuguuu

SEQ ID NO: 540214 - RNA, 19 nt, Homo sapiens
guacaaagguuuuccauuc

SEQ ID NO: 540215 - RNA, 19 nt, Homo sapiens
ggagagcaguucuuaacau

SEQ ID NO: 540216 - RNA, 19 nt, Homo sapiens
acaaaugcccugauaauga

SEQ ID NO: 540217 - RNA, 19 nt, Homo sapiens
guaugaggaugaucacuga

SEQ ID NO: 540218 - RNA, 19 nt, Homo sapiens
ggaaguaucaucaagaaca

SEQ ID NO: 540219 - RNA, 19 nt, Homo sapiens
uuaagggucuaacuuguaa

SEQ ID NO: 540220 - RNA, 19 nt, Homo sapiens
aauagugccugacauauau

SEQ ID NO: 540221 - RNA, 19 nt, Homo sapiens
gugccaaacuuacugauau

SEQ ID NO: 540222 - RNA, 19 nt, Homo sapiens
gaaagaaaccacagauuuu

SEQ ID NO: 540223 - RNA, 19 nt, Homo sapiens
agucgaagcucucaccuuu

SEQ ID NO: 540224 - RNA, 19 nt, Homo sapiens
caagagacccauccugauu

SEQ ID NO: 540225 - RNA, 19 nt, Homo sapiens
gagcuuuccuauucuaaau

SEQ ID NO: 540226 - RNA, 19 nt, Homo sapiens
ggagagaaacccuaugaau

SEQ ID NO: 540227 - RNA, 19 nt, Homo sapiens
gaggaacccuaugaaugua

SEQ ID NO: 540228 - RNA, 19 nt, Homo sapiens
gagaccaguuagacaagua

SEQ ID NO: 540229 - RNA, 19 nt, Homo sapiens
gcauaauauuuguggcaua

SEQ ID NO: 540230 - RNA, 19 nt, Homo sapiens
ucaauuuccucaacuguau

SEQ ID NO: 540231 - RNA, 19 nt, Homo sapiens
ggagaguuguugcugagaa

SEQ ID NO: 540232 - RNA, 19 nt, Homo sapiens
agagagaaauucaccaaga

SEQ ID NO: 540233 - RNA, 19 nt, Homo sapiens
agaacuagguccuggguuu

SEQ ID NO: 540234 - RNA, 19 nt, Homo sapiens
gagcuagacuacccagguu

SEQ ID NO: 540235 - RNA, 19 nt, Homo sapiens
gagcaaguguccucaugug

SEQ ID NO: 540236 - RNA, 19 nt, Homo sapiens
caaaagcuccugagaauuu

SEQ ID NO: 540237 - RNA, 19 nt, Homo sapiens
gaaaugauacaguuaaugc

SEQ ID NO: 540238 - RNA, 19 nt, Homo sapiens
gagagaaaccauaugaaug

SEQ ID NO: 540239 - RNA, 19 nt, Homo sapiens
gcucucaccuuuauucaca

SEQ ID NO: 540240 - RNA, 19 nt, Homo sapiens
ucaggaagaggaucuauuu

SEQ ID NO: 540241 - RNA, 19 nt, Homo sapiens
ggauuauggugaguauuaa

SEQ ID NO: 540242 - RNA, 19 nt, Homo sapiens
gggaacaaguauuuaaaca

SEQ ID NO: 540243 - RNA, 19 nt, Homo sapiens
caaagggcauacauagaga

SEQ ID NO: 540244 - RNA, 19 nt, Homo sapiens
auaaugagguuacuacuag

SEQ ID NO: 540245 - RNA, 19 nt, Homo sapiens
ggaacccuaugaauguaaa

SEQ ID NO: 540246 - RNA, 19 nt, Homo sapiens
caaguggcauucacccaaa

SEQ ID NO: 540247 - RNA, 19 nt, Homo sapiens
gaaauauguaugaggauga

SEQ ID NO: 540248 - RNA, 19 nt, Homo sapiens
ggaacaagguaauguaaua

SEQ ID NO: 540249 - RNA, 19 nt, Homo sapiens
gcuaguagaugcagacuua

SEQ ID NO: 540250 - RNA, 19 nt, Homo sapiens
gaacacagaugcagaaauc

SEQ ID NO: 540251 - RNA, 19 nt, Homo sapiens
gagaauaacugugacuaua

SEQ ID NO: 540252 - RNA, 19 nt, Homo sapiens
ggaaagaggcccacacaua

SEQ ID NO: 540253 - RNA, 19 nt, Homo sapiens
ccacagagcuaauguuuau

SEQ ID NO: 540254 - RNA, 19 nt, Homo sapiens
gaagugauauucuguugaa

SEQ ID NO: 540255 - RNA, 19 nt, Homo sapiens
uaagucagcucuaauugua

SEQ ID NO: 540256 - RNA, 19 nt, Homo sapiens
gagaaacacuuugaaugua

SEQ ID NO: 540257 - RNA, 19 nt, Homo sapiens
gcacauaaauuuggaagga

SEQ ID NO: 540258 - RNA, 19 nt, Homo sapiens
gaagucagaccucacaaua

SEQ ID NO: 540259 - RNA, 19 nt, Homo sapiens
caggagaacuuacucaauu

SEQ ID NO: 540260 - RNA, 19 nt, Homo sapiens
ggagaaacccuaugaaugu

SEQ ID NO: 540261 - RNA, 19 nt, Homo sapiens
ggagaaacccuaugaaugu

SEQ ID NO: 540262 - RNA, 19 nt, Homo sapiens
gcagaaacccuaugaaugu

SEQ ID NO: 540263 - RNA, 19 nt, Homo sapiens
caagaugcauucucucaaa

SEQ ID NO: 540264 - RNA, 19 nt, Homo sapiens
gggaaauucuuuagccaua

SEQ ID NO: 540265 - RNA, 19 nt, Homo sapiens
gagaaacccuaucagugua

SEQ ID NO: 540266 - RNA, 19 nt, Homo sapiens
uaagucagcccucacauua

SEQ ID NO: 540267 - RNA, 19 nt, Homo sapiens
gcaauuauaugacauucug

SEQ ID NO: 540268 - RNA, 19 nt, Homo sapiens
ccaaauggauucacugaug

SEQ ID NO: 540269 - RNA, 19 nt, Homo sapiens
gaagagagagugagcugua

SEQ ID NO: 540270 - RNA, 19 nt, Homo sapiens
guugaaaccuuaugaaugu

SEQ ID NO: 540271 - RNA, 19 nt, Homo sapiens
gaacucacauaggagauaa

SEQ ID NO: 540272 - RNA, 19 nt, Homo sapiens
ucagaaaggugauaaagga

SEQ ID NO: 540273 - RNA, 19 nt, Homo sapiens
ggauaacacuucccaaauc

SEQ ID NO: 540274 - RNA, 19 nt, Homo sapiens
gauguuaccuugcuaguag

SEQ ID NO: 540275 - RNA, 19 nt, Homo sapiens
ggagagaaaucuugucagu

SEQ ID NO: 540276 - RNA, 19 nt, Homo sapiens
ucagagaacucacauagga

SEQ ID NO: 540277 - RNA, 19 nt, Homo sapiens
cagaauugguuaucaguaa

SEQ ID NO: 540278 - RNA, 19 nt, Homo sapiens
gaaaugauaccaagucugu

SEQ ID NO: 540279 - RNA, 19 nt, Homo sapiens
ggacagucacuaugaauuu

SEQ ID NO: 540280 - RNA, 19 nt, Homo sapiens
gagaaacccuaugaaugua

SEQ ID NO: 540281 - RNA, 19 nt, Homo sapiens
gauaacacuucccaaauca

SEQ ID NO: 540282 - RNA, 19 nt, Homo sapiens
caagugguaugugauauaa

SEQ ID NO: 540283 - RNA, 19 nt, Homo sapiens
ugaguuugaugccauaaua

SEQ ID NO: 540284 - RNA, 19 nt, Homo sapiens
ggagaaacccuuugcaugu

SEQ ID NO: 540285 - RNA, 19 nt, Homo sapiens
ggagaaacccuaucagugu

SEQ ID NO: 540286 - RNA, 19 nt, Homo sapiens
gacagucacuaugaauuua

SEQ ID NO: 540287 - RNA, 19 nt, Homo sapiens
aaucuaagcuuccacuuug

SEQ ID NO: 540288 - RNA, 19 nt, Homo sapiens
guaguucccuuguuguauu

SEQ ID NO: 540289 - RNA, 19 nt, Homo sapiens
ggaaaauccuucuguauga

SEQ ID NO: 540290 - RNA, 19 nt, Homo sapiens
gaagacaaauacugcuaau

SEQ ID NO: 540291 - RNA, 19 nt, Homo sapiens
gaaagaggcccacacauac

SEQ ID NO: 540292 - RNA, 19 nt, Homo sapiens
cauaaaaccucacagauuu

SEQ ID NO: 540293 - RNA, 19 nt, Homo sapiens
agagaaaucuugucagugu

SEQ ID NO: 540294 - RNA, 19 nt, Homo sapiens
ggaaauucuuuagccauaa

SEQ ID NO: 540295 - RNA, 19 nt, Homo sapiens
gauuuagccucaaguaguu

SEQ ID NO: 540296 - RNA, 19 nt, Homo sapiens
aaucagaccuugcuaaaca

SEQ ID NO: 540297 - RNA, 19 nt, Homo sapiens
caaaugaaccauaaugaug

SEQ ID NO: 540298 - RNA, 19 nt, Homo sapiens
ggaauaauuucaggaggaa

SEQ ID NO: 540299 - RNA, 19 nt, Homo sapiens
gaagagagagaaugcagaa

SEQ ID NO: 540300 - RNA, 19 nt, Homo sapiens
gaaccauaaugaugcaaga

SEQ ID NO: 540301 - RNA, 19 nt, Homo sapiens
guacaagugguaugugaua

SEQ ID NO: 540302 - RNA, 19 nt, Homo sapiens
caaaucaucacucacagua

SEQ ID NO: 540303 - RNA, 19 nt, Homo sapiens
gaaacccuaugaauguuau

SEQ ID NO: 540304 - RNA, 19 nt, Homo sapiens
caaaggacagucacuauga

SEQ ID NO: 540305 - RNA, 19 nt, Homo sapiens
caagguagaucagaaguuc

SEQ ID NO: 540306 - RNA, 19 nt, Homo sapiens
caagucagccuccauaaug

SEQ ID NO: 540307 - RNA, 19 nt, Homo sapiens
ggagaaacccuaugaaugc

SEQ ID NO: 540308 - RNA, 19 nt, Homo sapiens
ucagauaccuccaucaaag

SEQ ID NO: 540309 - RNA, 19 nt, Homo sapiens
guaaccaucaacacaauua

SEQ ID NO: 540310 - RNA, 19 nt, Homo sapiens
gggauaaacccauagacua

SEQ ID NO: 540311 - RNA, 19 nt, Homo sapiens
gagaagagccagaaucaag

SEQ ID NO: 540312 - RNA, 19 nt, Homo sapiens
agagugagcuguaucuuca

SEQ ID NO: 540313 - RNA, 19 nt, Homo sapiens
gaaaagcccuaugaaugua

SEQ ID NO: 540314 - RNA, 19 nt, Homo sapiens
gagagaaacacuuugaaug

SEQ ID NO: 540315 - RNA, 19 nt, Homo sapiens
gaaaauaaaagcagggaua

SEQ ID NO: 540316 - RNA, 19 nt, Homo sapiens
caucagagaucacauacag

SEQ ID NO: 540317 - RNA, 19 nt, Homo sapiens
gagaacccauacacaagaa

SEQ ID NO: 540318 - RNA, 19 nt, Homo sapiens
gaauucacaccuuacagua

SEQ ID NO: 540319 - RNA, 19 nt, Homo sapiens
uguaugaauucacaccuua

SEQ ID NO: 540320 - RNA, 19 nt, Homo sapiens
cagaagagaauaacuguga

SEQ ID NO: 540321 - RNA, 19 nt, Homo sapiens
gagaugugaugcuggagaa

SEQ ID NO: 540322 - RNA, 19 nt, Homo sapiens
gauaaaaccucucaacaca

SEQ ID NO: 540323 - RNA, 19 nt, Homo sapiens
caaauggauucacugaugu

SEQ ID NO: 540324 - RNA, 19 nt, Homo sapiens
ggcauccacuugacuauga

SEQ ID NO: 540325 - RNA, 19 nt, Homo sapiens
caaauaggauuauguuagc

SEQ ID NO: 540326 - RNA, 19 nt, Homo sapiens
gagaaaucuugucagugua

SEQ ID NO: 540327 - RNA, 19 nt, Homo sapiens
gaaauucuuuagccauaag

SEQ ID NO: 540328 - RNA, 19 nt, Homo sapiens
aaucugaccucacuaaaca

SEQ ID NO: 540329 - RNA, 19 nt, Homo sapiens
agucaaaccucacuaaaca

SEQ ID NO: 540330 - RNA, 19 nt, Homo sapiens
gaagucaaaccucacuaaa

SEQ ID NO: 540331 - RNA, 19 nt, Homo sapiens
gcagaagaaucacuugaac

SEQ ID NO: 540332 - RNA, 19 nt, Homo sapiens
guagaucucaguaggcaua

SEQ ID NO: 540333 - RNA, 19 nt, Homo sapiens
aaacaucagagaucacaua

SEQ ID NO: 540334 - RNA, 19 nt, Homo sapiens
gaaacccuaugaauguaau

SEQ ID NO: 540335 - RNA, 19 nt, Homo sapiens
aaagaaauauggacaacuc

SEQ ID NO: 540336 - RNA, 19 nt, Homo sapiens
uaaaucagaccuugcuaaa

SEQ ID NO: 540337 - RNA, 19 nt, Homo sapiens
gaaguccacccuuucuaaa

SEQ ID NO: 540338 - RNA, 19 nt, Homo sapiens
ugaacaagguagaucagaa

SEQ ID NO: 540339 - RNA, 19 nt, Homo sapiens
ccacaagucagccuccaua

SEQ ID NO: 540340 - RNA, 19 nt, Homo sapiens
gaaacccuaugaaugcaau

SEQ ID NO: 540341 - RNA, 19 nt, Homo sapiens
gggagaaacccuaugaaug

SEQ ID NO: 540342 - RNA, 19 nt, Homo sapiens
gggagaaacccuaugaaug

SEQ ID NO: 540343 - RNA, 19 nt, Homo sapiens
gggagaaacccuaugaaug

SEQ ID NO: 540344 - RNA, 19 nt, Homo sapiens
ggagaaaccuuuugaaugc

SEQ ID NO: 540345 - RNA, 19 nt, Homo sapiens
gaaugaguuucaacacugu

SEQ ID NO: 540346 - RNA, 19 nt, Homo sapiens
caaggaacaccacugcuuu

SEQ ID NO: 540347 - RNA, 19 nt, Homo sapiens
gcaaggaacaccacugcuu

SEQ ID NO: 540348 - RNA, 19 nt, Homo sapiens
gagagaaagucuaagaaua

SEQ ID NO: 540349 - RNA, 19 nt, Homo sapiens
gagagaaacccuauaaaua

SEQ ID NO: 540350 - RNA, 19 nt, Homo sapiens
caaauucgauugcaugaaa

SEQ ID NO: 540351 - RNA, 19 nt, Homo sapiens
gaaagaaacccuaugaaug

SEQ ID NO: 540352 - RNA, 19 nt, Homo sapiens
gagaaacccuaucgaugua

SEQ ID NO: 540353 - RNA, 19 nt, Homo sapiens
ugaaagaacucauauugga

SEQ ID NO: 540354 - RNA, 19 nt, Homo sapiens
gagaaaccguaucaaugua

SEQ ID NO: 540355 - RNA, 19 nt, Homo sapiens
gaagcugugugaauacaaa

SEQ ID NO: 540356 - RNA, 19 nt, Homo sapiens
gagaaacccuaugaaugua

SEQ ID NO: 540357 - RNA, 19 nt, Homo sapiens
gagaaacccuaugaaugua

SEQ ID NO: 540358 - RNA, 19 nt, Homo sapiens
gagaaacccuaugaaugua

SEQ ID NO: 540359 - RNA, 19 nt, Homo sapiens
gagaaacccuaugaaugua

SEQ ID NO: 540360 - RNA, 19 nt, Homo sapiens
gagaaacccuaugaaugua

SEQ ID NO: 540361 - RNA, 19 nt, Homo sapiens
gagaaacccuaugaaugua

SEQ ID NO: 540362 - RNA, 19 nt, Homo sapiens
ggaaagaaacccuaugaau

SEQ ID NO: 540363 - RNA, 19 nt, Homo sapiens
caaaugaguaucaggaaua

SEQ ID NO: 540364 - RNA, 19 nt, Homo sapiens
caucauucgucccuuaaua

SEQ ID NO: 540365 - RNA, 19 nt, Homo sapiens
ggagagaaacccuauaaau

SEQ ID NO: 540366 - RNA, 19 nt, Homo sapiens
ggaaagccuucaacucuuc

SEQ ID NO: 540367 - RNA, 19 nt, Homo sapiens
gagagaaaccuuaugaaug

SEQ ID NO: 540368 - RNA, 19 nt, Homo sapiens
ggacagaaacccuaugaau

SEQ ID NO: 540369 - RNA, 19 nt, Homo sapiens
gaagaugucauaugguuga

SEQ ID NO: 540370 - RNA, 19 nt, Homo sapiens
gaaaccguaucaauguaaa

SEQ ID NO: 540371 - RNA, 19 nt, Homo sapiens
gaaacccuaugaauguaaa

SEQ ID NO: 540372 - RNA, 19 nt, Homo sapiens
gaaacccuaugaauguaaa

SEQ ID NO: 540373 - RNA, 19 nt, Homo sapiens
gaaacccuaugaauguaaa

SEQ ID NO: 540374 - RNA, 19 nt, Homo sapiens
gaaacccuaugaauguaaa

SEQ ID NO: 540375 - RNA, 19 nt, Homo sapiens
uaaacgauguggcaaauca

SEQ ID NO: 540376 - RNA, 19 nt, Homo sapiens
gaaacccuaugaauguaaa

SEQ ID NO: 540377 - RNA, 19 nt, Homo sapiens
gaaacccuaugaauguaaa

SEQ ID NO: 540378 - RNA, 19 nt, Homo sapiens
cuaaagcccuugauuguuc

SEQ ID NO: 540379 - RNA, 19 nt, Homo sapiens
agagaaaccuuaugagugu

SEQ ID NO: 540380 - RNA, 19 nt, Homo sapiens
gagagaaaccguaucaaug

SEQ ID NO: 540381 - RNA, 19 nt, Homo sapiens
gagagaaacccuaugaaug

SEQ ID NO: 540382 - RNA, 19 nt, Homo sapiens
gagagaaacccuaugaaug

SEQ ID NO: 540383 - RNA, 19 nt, Homo sapiens
gagagaaacccuaugaaug

SEQ ID NO: 540384 - RNA, 19 nt, Homo sapiens
gagagaaacccuaugaaug

SEQ ID NO: 540385 - RNA, 19 nt, Homo sapiens
gagagaaacccuaugaaug

SEQ ID NO: 540386 - RNA, 19 nt, Homo sapiens
gaaacccuaucgauguaaa

SEQ ID NO: 540387 - RNA, 19 nt, Homo sapiens
aaagaaacccuaugaaugu

SEQ ID NO: 540388 - RNA, 19 nt, Homo sapiens
uagaagagguagcaaaugu

SEQ ID NO: 540389 - RNA, 19 nt, Homo sapiens
gaaaguaucauguaaacag

SEQ ID NO: 540390 - RNA, 19 nt, Homo sapiens
gagaaacaguaugaaugua

SEQ ID NO: 540391 - RNA, 19 nt, Homo sapiens
ggagagaaaccuuaugaau

SEQ ID NO: 540392 - RNA, 19 nt, Homo sapiens
ucgagcacauguaauaaua

SEQ ID NO: 540393 - RNA, 19 nt, Homo sapiens
ggacagaaaccaaaugagu

SEQ ID NO: 540394 - RNA, 19 nt, Homo sapiens
gggaaagccuucagguguu

SEQ ID NO: 540395 - RNA, 19 nt, Homo sapiens
caaguucccuucaaagaca

SEQ ID NO: 540396 - RNA, 19 nt, Homo sapiens
gaauguaaacaauguggua

SEQ ID NO: 540397 - RNA, 19 nt, Homo sapiens
caguugaccuaauucauuu

SEQ ID NO: 540398 - RNA, 19 nt, Homo sapiens
ggagagaaaccguaucaau

SEQ ID NO: 540399 - RNA, 19 nt, Homo sapiens
ggagagaaacccuaugaau

SEQ ID NO: 540400 - RNA, 19 nt, Homo sapiens
ggagagaaacccuaugaau

SEQ ID NO: 540401 - RNA, 19 nt, Homo sapiens
gcagagaaacccuaugaau

SEQ ID NO: 540402 - RNA, 19 nt, Homo sapiens
ggagagaaacccuaugaau

SEQ ID NO: 540403 - RNA, 19 nt, Homo sapiens
ggagagaaacccuaugaau

SEQ ID NO: 540404 - RNA, 19 nt, Homo sapiens
ggagagaaacccuaugaau

SEQ ID NO: 540405 - RNA, 19 nt, Homo sapiens
caacuguccucuagagugu

SEQ ID NO: 540406 - RNA, 19 nt, Homo sapiens
agagaaaccuuaugaaugc

SEQ ID NO: 540407 - RNA, 19 nt, Homo sapiens
gcaaccauguaaauguaaa

SEQ ID NO: 540408 - RNA, 19 nt, Homo sapiens
aagcaaccauguaaaugua

SEQ ID NO: 540409 - RNA, 19 nt, Homo sapiens
gacagaaaccaaaugagua

SEQ ID NO: 540410 - RNA, 19 nt, Homo sapiens
gaauguaagcaauguggua

SEQ ID NO: 540411 - RNA, 19 nt, Homo sapiens
gggcuuugcuggauucuuc

SEQ ID NO: 540412 - RNA, 19 nt, Homo sapiens
ggacucauaugggagagaa

SEQ ID NO: 540413 - RNA, 19 nt, Homo sapiens
ugggaaagccuucagauuu

SEQ ID NO: 540414 - RNA, 19 nt, Homo sapiens
gggaagaccaggacauuga

SEQ ID NO: 540415 - RNA, 19 nt, Homo sapiens
gggaaagccuucaacucuu

SEQ ID NO: 540416 - RNA, 19 nt, Homo sapiens
gggugaaagucuauaaaug

SEQ ID NO: 540417 - RNA, 19 nt, Homo sapiens
gaaaccuuaugaaugcaaa

SEQ ID NO: 540418 - RNA, 19 nt, Homo sapiens
gggaaagccuucagauuuu

SEQ ID NO: 540419 - RNA, 19 nt, Homo sapiens
cagaaacccuaugaaugua

SEQ ID NO: 540420 - RNA, 19 nt, Homo sapiens
gaagcccuaugaauguaaa

SEQ ID NO: 540421 - RNA, 19 nt, Homo sapiens
gaaauucuucauccuaguu

SEQ ID NO: 540422 - RNA, 19 nt, Homo sapiens
ggugaaagucuauaaaugu

SEQ ID NO: 540423 - RNA, 19 nt, Homo sapiens
ggagagaaagucuaagaau

SEQ ID NO: 540424 - RNA, 19 nt, Homo sapiens
ugaaaggacucacaaugca

SEQ ID NO: 540425 - RNA, 19 nt, Homo sapiens
gacagaaacccuaugaaug

SEQ ID NO: 540426 - RNA, 19 nt, Homo sapiens
aaucgaagaugucauaugg

SEQ ID NO: 540427 - RNA, 19 nt, Homo sapiens
ucgaagaugucauaugguu

SEQ ID NO: 540428 - RNA, 19 nt, Homo sapiens
gaacacacacuggagagaa

SEQ ID NO: 540429 - RNA, 19 nt, Homo sapiens
ggagagaaaccuuaugagu

SEQ ID NO: 540430 - RNA, 19 nt, Homo sapiens
gaaugcagcuuuuguggaa

SEQ ID NO: 540431 - RNA, 19 nt, Homo sapiens
agagaaacccuaugaaugu

SEQ ID NO: 540432 - RNA, 19 nt, Homo sapiens
agagaaacccuaugaaugu

SEQ ID NO: 540433 - RNA, 19 nt, Homo sapiens
agagaaacccuaugaaugu

SEQ ID NO: 540434 - RNA, 19 nt, Homo sapiens
agagaaacccuaugaaugu

SEQ ID NO: 540435 - RNA, 19 nt, Homo sapiens
gccuucaacucuucuaauu

SEQ ID NO: 540436 - RNA, 19 nt, Homo sapiens
agagaaacccuaugaaugu

SEQ ID NO: 540437 - RNA, 19 nt, Homo sapiens
agagaaacccuaugaaugu

SEQ ID NO: 540438 - RNA, 19 nt, Homo sapiens
acagaaacccuaugaaugu

SEQ ID NO: 540439 - RNA, 19 nt, Homo sapiens
gagugaagcccuaugaaug

SEQ ID NO: 540440 - RNA, 19 nt, Homo sapiens
ggaaagccuucagguguuc

SEQ ID NO: 540441 - RNA, 19 nt, Homo sapiens
ggagugggcuuugcuggau

SEQ ID NO: 540442 - RNA, 19 nt, Homo sapiens
ucucuucgauugcaugaaa

SEQ ID NO: 540443 - RNA, 19 nt, Homo sapiens
ccacauacuuucgaacuca

SEQ ID NO: 540444 - RNA, 19 nt, Homo sapiens
ggagagaaacccuaucgau

SEQ ID NO: 540445 - RNA, 19 nt, Homo sapiens
cagagaaacccuaugaaug

SEQ ID NO: 540446 - RNA, 19 nt, Homo sapiens
gaaaguagaagagguagca

SEQ ID NO: 540447 - RNA, 19 nt, Homo sapiens
gaacucauauuggagaaaa

SEQ ID NO: 540448 - RNA, 19 nt, Homo sapiens
agaaagaucuggacuguaa

SEQ ID NO: 540449 - RNA, 19 nt, Homo sapiens
gcucaaaccucaucaaaca

SEQ ID NO: 540450 - RNA, 19 nt, Homo sapiens
agucagagcuccagccuua

SEQ ID NO: 540451 - RNA, 19 nt, Homo sapiens
gaaaguccacucauaugua

SEQ ID NO: 540452 - RNA, 19 nt, Homo sapiens
gaucuggacuguaaugguu

SEQ ID NO: 540453 - RNA, 19 nt, Homo sapiens
gcucaaaccucauccaaca

SEQ ID NO: 540454 - RNA, 19 nt, Homo sapiens
ggagaaagaucuggacugu

SEQ ID NO: 540455 - RNA, 19 nt, Homo sapiens
gagagaagcccuaugaaug

SEQ ID NO: 540456 - RNA, 19 nt, Homo sapiens
gagagaagcccuauaagug

SEQ ID NO: 540457 - RNA, 19 nt, Homo sapiens
ggaaaucccuacagaagag

SEQ ID NO: 540458 - RNA, 19 nt, Homo sapiens
ggaaucacaggcagaaaua

SEQ ID NO: 540459 - RNA, 19 nt, Homo sapiens
gagaagcccuaugaaugua

SEQ ID NO: 540460 - RNA, 19 nt, Homo sapiens
gagagaagccguacagaug

SEQ ID NO: 540461 - RNA, 19 nt, Homo sapiens
ccacugcucuugccucuug

SEQ ID NO: 540462 - RNA, 19 nt, Homo sapiens
aaaguccacucauauguaa

SEQ ID NO: 540463 - RNA, 19 nt, Homo sapiens
gggaaagcauuuagucaga

SEQ ID NO: 540464 - RNA, 19 nt, Homo sapiens
gcagugagaggccuuauau

SEQ ID NO: 540465 - RNA, 19 nt, Homo sapiens
aaacuaugcuggugauguu

SEQ ID NO: 540466 - RNA, 19 nt, Homo sapiens
ggaagacauucaugaagau

SEQ ID NO: 540467 - RNA, 19 nt, Homo sapiens
gagauaaccauaguaguuu

SEQ ID NO: 540468 - RNA, 19 nt, Homo sapiens
gcucuugccucuugugaug

SEQ ID NO: 540469 - RNA, 19 nt, Homo sapiens
guaguuuguuugauuggua

SEQ ID NO: 540470 - RNA, 19 nt, Homo sapiens
ugagaggccuuauaugugu

SEQ ID NO: 540471 - RNA, 19 nt, Homo sapiens
guaaagugacguuugguuu

SEQ ID NO: 540472 - RNA, 19 nt, Homo sapiens
agccagaacucgagccuua

SEQ ID NO: 540473 - RNA, 19 nt, Homo sapiens
ggccuuauauguguaauga

SEQ ID NO: 540474 - RNA, 19 nt, Homo sapiens
gaagagaggccacauccau

SEQ ID NO: 540475 - RNA, 19 nt, Homo sapiens
ggagagaagcccuaugaau

SEQ ID NO: 540476 - RNA, 19 nt, Homo sapiens
ggagagaagcccuauaagu

SEQ ID NO: 540477 - RNA, 19 nt, Homo sapiens
caucagaggauucauaaug

SEQ ID NO: 540478 - RNA, 19 nt, Homo sapiens
ggagaucugugugaugaug

SEQ ID NO: 540479 - RNA, 19 nt, Homo sapiens
ugagauaaccauaguaguu

SEQ ID NO: 540480 - RNA, 19 nt, Homo sapiens
aaccgaagcucaaaucuca

SEQ ID NO: 540481 - RNA, 19 nt, Homo sapiens
agagaagccuuaugagugu

SEQ ID NO: 540482 - RNA, 19 nt, Homo sapiens
agacauucaugaagauuug

SEQ ID NO: 540483 - RNA, 19 nt, Homo sapiens
gacaaggaguuucuucaca

SEQ ID NO: 540484 - RNA, 19 nt, Homo sapiens
ccaaagcucacaccucauu

SEQ ID NO: 540485 - RNA, 19 nt, Homo sapiens
gcuccaaccucauccuuca

SEQ ID NO: 540486 - RNA, 19 nt, Homo sapiens
caacaucaaagaauccauu

SEQ ID NO: 540487 - RNA, 19 nt, Homo sapiens
gugagaagcccuaugaaug

SEQ ID NO: 540488 - RNA, 19 nt, Homo sapiens
acaaggaguuucuucacaa

SEQ ID NO: 540489 - RNA, 19 nt, Homo sapiens
ggacugaagacaaggaguu

SEQ ID NO: 540490 - RNA, 19 nt, Homo sapiens
aaagugacguuugguuuga

SEQ ID NO: 540491 - RNA, 19 nt, Homo sapiens
ggagagaagccuuaugagu

SEQ ID NO: 540492 - RNA, 19 nt, Homo sapiens
caaggaagacauucaugaa

SEQ ID NO: 540493 - RNA, 19 nt, Homo sapiens
caacuccucuuuggccauu

SEQ ID NO: 540494 - RNA, 19 nt, Homo sapiens
gcugaaaguccacucauau

SEQ ID NO: 540495 - RNA, 19 nt, Homo sapiens
ugacauggguggccagagu

SEQ ID NO: 540496 - RNA, 19 nt, Homo sapiens
aggaagacauucaugaaga

SEQ ID NO: 540497 - RNA, 19 nt, Homo sapiens
aaaguaaagugacguuugg

SEQ ID NO: 540498 - RNA, 19 nt, Homo sapiens
ggagagaagccguacagau

SEQ ID NO: 540499 - RNA, 19 nt, Homo sapiens
gagaggccuuauaugugua

SEQ ID NO: 540500 - RNA, 19 nt, Homo sapiens
ggagugaaaccgagcauag

SEQ ID NO: 540501 - RNA, 19 nt, Homo sapiens
ucacguguguaauguaugu

SEQ ID NO: 540502 - RNA, 19 nt, Homo sapiens
gaagccaucugcccucacu

SEQ ID NO: 540503 - RNA, 19 nt, Homo sapiens
uaaagugacguuugguuug

SEQ ID NO: 540504 - RNA, 19 nt, Homo sapiens
aaacaccaguugauucaca

SEQ ID NO: 540505 - RNA, 19 nt, Homo sapiens
ccacagcucagcccucauu

SEQ ID NO: 540506 - RNA, 19 nt, Homo sapiens
gacguuugguuugagauaa

SEQ ID NO: 540507 - RNA, 19 nt, Homo sapiens
ggacugcacguuuguuaca

SEQ ID NO: 540508 - RNA, 19 nt, Homo sapiens
cagcaucagaggauucaua

SEQ ID NO: 540509 - RNA, 19 nt, Homo sapiens
ggaguuucuucacaaggaa

SEQ ID NO: 540510 - RNA, 19 nt, Homo sapiens
ugagugagaagcccuauga

SEQ ID NO: 540511 - RNA, 19 nt, Homo sapiens
cauccaacaucaaagaauc

SEQ ID NO: 540512 - RNA, 19 nt, Homo sapiens
gaaauccugaccuuauuca

SEQ ID NO: 540513 - RNA, 19 nt, Homo sapiens
caagggagaagauuaugga

SEQ ID NO: 540514 - RNA, 19 nt, Homo sapiens
guuacaagggagaagauua

SEQ ID NO: 540515 - RNA, 19 nt, Homo sapiens
gaagcccuaugaaugcaau

SEQ ID NO: 540516 - RNA, 19 nt, Homo sapiens
ccuuaugaguguaaugauu

SEQ ID NO: 540517 - RNA, 19 nt, Homo sapiens
gagaagccuuaugagugua

SEQ ID NO: 540518 - RNA, 19 nt, Homo sapiens
gucaggaaaucccuacaga

SEQ ID NO: 540519 - RNA, 19 nt, Homo sapiens
gaagacauucaugaagauu

SEQ ID NO: 540520 - RNA, 19 nt, Homo sapiens
ccucacguguguaauguau

SEQ ID NO: 540521 - RNA, 19 nt, Homo sapiens
caccaggacugaagacaag

SEQ ID NO: 540522 - RNA, 19 nt, Homo sapiens
ggaaauccugaccuuauuc

SEQ ID NO: 540523 - RNA, 19 nt, Homo sapiens
ggaggcugcauauucauga

SEQ ID NO: 540524 - RNA, 19 nt, Homo sapiens
agagaagcccuaugaaugu

SEQ ID NO: 540525 - RNA, 19 nt, Homo sapiens
gagaagccguacagaugca

SEQ ID NO: 540526 - RNA, 19 nt, Homo sapiens
gagaagcccuaugaaugca

SEQ ID NO: 540527 - RNA, 19 nt, Homo sapiens
caaggaguuucuucacaag

SEQ ID NO: 540528 - RNA, 19 nt, Homo sapiens
gaaagcaccagaucaucca

SEQ ID NO: 540529 - RNA, 19 nt, Homo sapiens
caaaccugauggcauguca

SEQ ID NO: 540530 - RNA, 19 nt, Homo sapiens
acaaggaagacauucauga

SEQ ID NO: 540531 - RNA, 19 nt, Homo sapiens
cuugugaugucuuggguuu

SEQ ID NO: 540532 - RNA, 19 nt, Homo sapiens
ggugaagcccuaugacugu

SEQ ID NO: 540533 - RNA, 19 nt, Homo sapiens
cuaugaauguacugaaugu

SEQ ID NO: 540534 - RNA, 19 nt, Homo sapiens
uuacaagggagaagauuau

SEQ ID NO: 540535 - RNA, 19 nt, Homo sapiens
ccaugaauguaaccagugu

SEQ ID NO: 540536 - RNA, 19 nt, Homo sapiens
cuggagagaagcccuauaa

SEQ ID NO: 540537 - RNA, 19 nt, Homo sapiens
caggaaaucccuacagaag

SEQ ID NO: 540538 - RNA, 19 nt, Homo sapiens
uuggagaucugugugauga

SEQ ID NO: 540539 - RNA, 19 nt, Homo sapiens
gauggcaugucaggaaauc

SEQ ID NO: 540540 - RNA, 19 nt, Homo sapiens
gaagcucaaaucucauuca

SEQ ID NO: 540541 - RNA, 19 nt, Homo sapiens
ucuccaaccucauuaagca

SEQ ID NO: 540542 - RNA, 19 nt, Homo sapiens
ugaaaguccacucauaugu

SEQ ID NO: 540543 - RNA, 19 nt, Homo sapiens
gaggcugcauauucaugaa

SEQ ID NO: 540544 - RNA, 19 nt, Homo sapiens
uacauccaguggccacaua

SEQ ID NO: 540545 - RNA, 19 nt, Homo sapiens
ucagagcuccagccuuauu

SEQ ID NO: 540546 - RNA, 19 nt, Homo sapiens
gagcucaaaccucauccaa

SEQ ID NO: 540547 - RNA, 19 nt, Homo sapiens
ccagaacucgagccuuaaa

SEQ ID NO: 540548 - RNA, 19 nt, Homo sapiens
gggcaagccuuuaaugaua

SEQ ID NO: 540549 - RNA, 19 nt, Homo sapiens
gggaauaguuucacgagua

SEQ ID NO: 540550 - RNA, 19 nt, Homo sapiens
guaaagauguugagaccaa

SEQ ID NO: 540551 - RNA, 19 nt, Homo sapiens
gagcuaauaggaacaaaua

SEQ ID NO: 540552 - RNA, 19 nt, Homo sapiens
guacagaagugugauguug

SEQ ID NO: 540553 - RNA, 19 nt, Homo sapiens
gaagugugauguuggagaa

SEQ ID NO: 540554 - RNA, 19 nt, Homo sapiens
caaagaugguucaauuaga

SEQ ID NO: 540555 - RNA, 19 nt, Homo sapiens
gaaauguacugaguggauu

SEQ ID NO: 540556 - RNA, 19 nt, Homo sapiens
ggagaaacccuuugacugu

SEQ ID NO: 540557 - RNA, 19 nt, Homo sapiens
ggagaaacccuaugagugu

SEQ ID NO: 540558 - RNA, 19 nt, Homo sapiens
gacagugaguccacauuaa

SEQ ID NO: 540559 - RNA, 19 nt, Homo sapiens
gagaaacccuaugagugua

SEQ ID NO: 540560 - RNA, 19 nt, Homo sapiens
gagaaacccuaugagugua

SEQ ID NO: 540561 - RNA, 19 nt, Homo sapiens
gagaaacccuaugagugua

SEQ ID NO: 540562 - RNA, 19 nt, Homo sapiens
gaacugacuucccagaaac

SEQ ID NO: 540563 - RNA, 19 nt, Homo sapiens
ggacaagccuucaauuuuc

SEQ ID NO: 540564 - RNA, 19 nt, Homo sapiens
ggaauaguuucacgaguag

SEQ ID NO: 540565 - RNA, 19 nt, Homo sapiens
ggcaagccuuuaaugauaa

SEQ ID NO: 540566 - RNA, 19 nt, Homo sapiens
ggagaaaccuuuugagugu

SEQ ID NO: 540567 - RNA, 19 nt, Homo sapiens
gagaugggaugaugucaca

SEQ ID NO: 540568 - RNA, 19 nt, Homo sapiens
agaaagagaugggaugaug

SEQ ID NO: 540569 - RNA, 19 nt, Homo sapiens
gacugaagauaauguuuga

SEQ ID NO: 540570 - RNA, 19 nt, Homo sapiens
ggagagagacccuaucagu

SEQ ID NO: 540571 - RNA, 19 nt, Homo sapiens
ggaaauccuucagcuacuu

SEQ ID NO: 540572 - RNA, 19 nt, Homo sapiens
gaagaaagagaugggauga

SEQ ID NO: 540573 - RNA, 19 nt, Homo sapiens
uuacagaggugagaaugaa

SEQ ID NO: 540574 - RNA, 19 nt, Homo sapiens
gaaacccuuugacugugua

SEQ ID NO: 540575 - RNA, 19 nt, Homo sapiens
gaaaagccuuauucuugua

SEQ ID NO: 540576 - RNA, 19 nt, Homo sapiens
gagaaggccuuugggacuu

SEQ ID NO: 540577 - RNA, 19 nt, Homo sapiens
ggaaaagccuuauucuugu

SEQ ID NO: 540578 - RNA, 19 nt, Homo sapiens
caccaugccugaagcuaaa

SEQ ID NO: 540579 - RNA, 19 nt, Homo sapiens
agaacugacuucccagaaa

SEQ ID NO: 540580 - RNA, 19 nt, Homo sapiens
ugacagugaguccacauua

SEQ ID NO: 540581 - RNA, 19 nt, Homo sapiens
agaccaacauugacaguga

SEQ ID NO: 540582 - RNA, 19 nt, Homo sapiens
gcugugcacuucaccaaga

SEQ ID NO: 540583 - RNA, 19 nt, Homo sapiens
ggauguggcugugcacuuc

SEQ ID NO: 540584 - RNA, 19 nt, Homo sapiens
ggagagaaacccuaugagu

SEQ ID NO: 540585 - RNA, 19 nt, Homo sapiens
ggaaaagccuugacuagca

SEQ ID NO: 540586 - RNA, 19 nt, Homo sapiens
gggaaaagccuuauucuug

SEQ ID NO: 540587 - RNA, 19 nt, Homo sapiens
ggagagaaacccuaugagu

SEQ ID NO: 540588 - RNA, 19 nt, Homo sapiens
gcacugaucucacuuuugg

SEQ ID NO: 540589 - RNA, 19 nt, Homo sapiens
aaagaugguucaauuagag

SEQ ID NO: 540590 - RNA, 19 nt, Homo sapiens
gccuuauucuuguaaagua

SEQ ID NO: 540591 - RNA, 19 nt, Homo sapiens
gaaauccuucagcuacuuu

SEQ ID NO: 540592 - RNA, 19 nt, Homo sapiens
caauuagagucccaggauu

SEQ ID NO: 540593 - RNA, 19 nt, Homo sapiens
ccaaagaugguucaauuag

SEQ ID NO: 540594 - RNA, 19 nt, Homo sapiens
aaacgucuguaaagauguu

SEQ ID NO: 540595 - RNA, 19 nt, Homo sapiens
caacaucagcguauucaca

SEQ ID NO: 540596 - RNA, 19 nt, Homo sapiens
gaucaggcaucagagaauc

SEQ ID NO: 540597 - RNA, 19 nt, Homo sapiens
agaaacacguaauguggaa

SEQ ID NO: 540598 - RNA, 19 nt, Homo sapiens
gcaagccuuuaaugauaau

SEQ ID NO: 540599 - RNA, 19 nt, Homo sapiens
gaagagugucccucagaga

SEQ ID NO: 540600 - RNA, 19 nt, Homo sapiens
agagaaacccuaugagugu

SEQ ID NO: 540601 - RNA, 19 nt, Homo sapiens
gaaaucuucaucagcauca

SEQ ID NO: 540602 - RNA, 19 nt, Homo sapiens
gaaaagccuugacuagcaa

SEQ ID NO: 540603 - RNA, 19 nt, Homo sapiens
guggacaagccuucaauuu

SEQ ID NO: 540604 - RNA, 19 nt, Homo sapiens
agagaaacccuaugagugu

SEQ ID NO: 540605 - RNA, 19 nt, Homo sapiens
gauucacacuggagagaga

SEQ ID NO: 540606 - RNA, 19 nt, Homo sapiens
ccacauuaauccagggaau

SEQ ID NO: 540607 - RNA, 19 nt, Homo sapiens
caucaaagaauccauacug

SEQ ID NO: 540608 - RNA, 19 nt, Homo sapiens
aaaggcaucugagaauuca

SEQ ID NO: 540609 - RNA, 19 nt, Homo sapiens
cagcaucaaagaauccaua

SEQ ID NO: 540610 - RNA, 19 nt, Homo sapiens
gaaagagaugggaugaugu

SEQ ID NO: 540611 - RNA, 19 nt, Homo sapiens
agagagacccuaucagugu

SEQ ID NO: 540612 - RNA, 19 nt, Homo sapiens
gaacagccacauacaccau

SEQ ID NO: 540613 - RNA, 19 nt, Homo sapiens
gagaauuggagagcaguaa

SEQ ID NO: 540614 - RNA, 19 nt, Homo sapiens
agaacuagacucuuacaga

SEQ ID NO: 540615 - RNA, 19 nt, Homo sapiens
gcacuucaccaagacagaa

SEQ ID NO: 540616 - RNA, 19 nt, Homo sapiens
ugauucagaugucaguaga

SEQ ID NO: 540617 - RNA, 19 nt, Homo sapiens
acagaagugugauguugga

SEQ ID NO: 540618 - RNA, 19 nt, Homo sapiens
cuauguaugugaugagugu

SEQ ID NO: 540619 - RNA, 19 nt, Homo sapiens
gaaacccuaugaguguaau

SEQ ID NO: 540620 - RNA, 19 nt, Homo sapiens
gaaacccuaugaguguaau

SEQ ID NO: 540621 - RNA, 19 nt, Homo sapiens
uugggaaccugacugcuuu

SEQ ID NO: 540622 - RNA, 19 nt, Homo sapiens
guacagagugugggaauag

SEQ ID NO: 540623 - RNA, 19 nt, Homo sapiens
ucccaaaccugcacugauc

SEQ ID NO: 540624 - RNA, 19 nt, Homo sapiens
gaguguagcaaguaugaga

SEQ ID NO: 540625 - RNA, 19 nt, Homo sapiens
ggagucuuccuauguaugu

SEQ ID NO: 540626 - RNA, 19 nt, Homo sapiens
guuccgaguuuguuauaca

SEQ ID NO: 540627 - RNA, 19 nt, Homo sapiens
gauaaugcaaaucugauca

SEQ ID NO: 540628 - RNA, 19 nt, Homo sapiens
gagaacugacuucccagaa

SEQ ID NO: 540629 - RNA, 19 nt, Homo sapiens
gugugauguuggagaauuu

SEQ ID NO: 540630 - RNA, 19 nt, Homo sapiens
cacgaguaguuccgaguuu

SEQ ID NO: 540631 - RNA, 19 nt, Homo sapiens
guuaaugauucagauguca

SEQ ID NO: 540632 - RNA, 19 nt, Homo sapiens
uaacucggcaccagagaau

SEQ ID NO: 540633 - RNA, 19 nt, Homo sapiens
uuuaggagauggugaccuu

SEQ ID NO: 540634 - RNA, 19 nt, Homo sapiens
cagagugugggaauaguuu

SEQ ID NO: 540635 - RNA, 19 nt, Homo sapiens
uaccaggacuuucccucaa

SEQ ID NO: 540636 - RNA, 19 nt, Homo sapiens
ggacauccccacagugaaa

SEQ ID NO: 540637 - RNA, 19 nt, Homo sapiens
ccagagggcccuguacaga

SEQ ID NO: 540638 - RNA, 19 nt, Homo sapiens
agacugaagauaauguuug

SEQ ID NO: 540639 - RNA, 19 nt, Homo sapiens
ucaauuagagucccaggau

SEQ ID NO: 540640 - RNA, 19 nt, Homo sapiens
ugaaauguacugaguggau

SEQ ID NO: 540641 - RNA, 19 nt, Homo sapiens
ggagugugggcaagccuuu

SEQ ID NO: 540642 - RNA, 19 nt, Homo sapiens
gggaaauccuucagcuacu

SEQ ID NO: 540643 - RNA, 19 nt, Homo sapiens
acucaggaauggaaugugu

SEQ ID NO: 540644 - RNA, 19 nt, Homo sapiens
cugaguggauuccgucuuc

SEQ ID NO: 540645 - RNA, 19 nt, Homo sapiens
ucagugcucaggaacaauu

SEQ ID NO: 540646 - RNA, 19 nt, Homo sapiens
gaggagaaacccuuugacu

SEQ ID NO: 540647 - RNA, 19 nt, Homo sapiens
cagagggcccuguacagaa

SEQ ID NO: 540648 - RNA, 19 nt, Homo sapiens
uaacauaccugauggagaa

SEQ ID NO: 540649 - RNA, 19 nt, Homo sapiens
gggaauaguuucaccagua

SEQ ID NO: 540650 - RNA, 19 nt, Homo sapiens
gggcgagccuuuaaugaua

SEQ ID NO: 540651 - RNA, 19 nt, Homo sapiens
guaaagauguugagaccaa

SEQ ID NO: 540652 - RNA, 19 nt, Homo sapiens
gcucaaaggugccaaagug

SEQ ID NO: 540653 - RNA, 19 nt, Homo sapiens
gagcuaauaggaacaaaua

SEQ ID NO: 540654 - RNA, 19 nt, Homo sapiens
guacagaagugugauguug

SEQ ID NO: 540655 - RNA, 19 nt, Homo sapiens
gaagugugauguuggagaa

SEQ ID NO: 540656 - RNA, 19 nt, Homo sapiens
caaagaugguucaauuaga

SEQ ID NO: 540657 - RNA, 19 nt, Homo sapiens
gaaauguacugaguggauu

SEQ ID NO: 540658 - RNA, 19 nt, Homo sapiens
ggagaaacccuuugacugu

SEQ ID NO: 540659 - RNA, 19 nt, Homo sapiens
ggagaaacccuaugagugu

SEQ ID NO: 540660 - RNA, 19 nt, Homo sapiens
gacagugaguccacauuaa

SEQ ID NO: 540661 - RNA, 19 nt, Homo sapiens
gggcgucacuauacaauug

SEQ ID NO: 540662 - RNA, 19 nt, Homo sapiens
ggaacagaauuuugacuua

SEQ ID NO: 540663 - RNA, 19 nt, Homo sapiens
gagaaacccuaugagugua

SEQ ID NO: 540664 - RNA, 19 nt, Homo sapiens
gagaaacccuaugagugua

SEQ ID NO: 540665 - RNA, 19 nt, Homo sapiens
gagaaacccuaugagugua

SEQ ID NO: 540666 - RNA, 19 nt, Homo sapiens
gaacugacuucccagaaac

SEQ ID NO: 540667 - RNA, 19 nt, Homo sapiens
ggacaagccuucaauuuuc

SEQ ID NO: 540668 - RNA, 19 nt, Homo sapiens
ggaauaguuucaccaguag

SEQ ID NO: 540669 - RNA, 19 nt, Homo sapiens
ggagaaaccuuuugagugu

SEQ ID NO: 540670 - RNA, 19 nt, Homo sapiens
gagaugggaugaugucaca

SEQ ID NO: 540671 - RNA, 19 nt, Homo sapiens
gagcccagguuauaucaga

SEQ ID NO: 540672 - RNA, 19 nt, Homo sapiens
agaaagagaugggaugaug

SEQ ID NO: 540673 - RNA, 19 nt, Homo sapiens
gacugaagauaauguuuga

SEQ ID NO: 540674 - RNA, 19 nt, Homo sapiens
gagcuuggguugggaguga

SEQ ID NO: 540675 - RNA, 19 nt, Homo sapiens
ggaaauccuucagcuacuu

SEQ ID NO: 540676 - RNA, 19 nt, Homo sapiens
gaagaaagagaugggauga

SEQ ID NO: 540677 - RNA, 19 nt, Homo sapiens
uuacagaggugagaaugaa

SEQ ID NO: 540678 - RNA, 19 nt, Homo sapiens
gaaacccuuugacugugua

SEQ ID NO: 540679 - RNA, 19 nt, Homo sapiens
gaaaagccuuauucuugua

SEQ ID NO: 540680 - RNA, 19 nt, Homo sapiens
gagaaggccuuugggacuu

SEQ ID NO: 540681 - RNA, 19 nt, Homo sapiens
ggaaaagccuuauucuugu

SEQ ID NO: 540682 - RNA, 19 nt, Homo sapiens
ggugggaccugggcuguuu

SEQ ID NO: 540683 - RNA, 19 nt, Homo sapiens
caccaugccugaagcuaaa

SEQ ID NO: 540684 - RNA, 19 nt, Homo sapiens
ggagaaauguuuugugugu

SEQ ID NO: 540685 - RNA, 19 nt, Homo sapiens
agaacugacuucccagaaa

SEQ ID NO: 540686 - RNA, 19 nt, Homo sapiens
ugacagugaguccacauua

SEQ ID NO: 540687 - RNA, 19 nt, Homo sapiens
agaccaacauugacaguga

SEQ ID NO: 540688 - RNA, 19 nt, Homo sapiens
gcugugcacuucaccaaga

SEQ ID NO: 540689 - RNA, 19 nt, Homo sapiens
ggauguggcugugcacuuc

SEQ ID NO: 540690 - RNA, 19 nt, Homo sapiens
ggagagaaacccuaugagu

SEQ ID NO: 540691 - RNA, 19 nt, Homo sapiens
ggaaaagccuugacuagca

SEQ ID NO: 540692 - RNA, 19 nt, Homo sapiens
gggaaaagccuuauucuug

SEQ ID NO: 540693 - RNA, 19 nt, Homo sapiens
ggagagaaacccuaugagu

SEQ ID NO: 540694 - RNA, 19 nt, Homo sapiens
gcacugaucucacuuuugg

SEQ ID NO: 540695 - RNA, 19 nt, Homo sapiens
ggcgagccuuuaaugauaa

SEQ ID NO: 540696 - RNA, 19 nt, Homo sapiens
aaagaugguucaauuagag

SEQ ID NO: 540697 - RNA, 19 nt, Homo sapiens
gccuuauucuuguaaagua

SEQ ID NO: 540698 - RNA, 19 nt, Homo sapiens
gaaauccuucagcuacuuu

SEQ ID NO: 540699 - RNA, 19 nt, Homo sapiens
caauuagagucccaggauu

SEQ ID NO: 540700 - RNA, 19 nt, Homo sapiens
ccaaagaugguucaauuag

SEQ ID NO: 540701 - RNA, 19 nt, Homo sapiens
ggagagagacccuaucacu

SEQ ID NO: 540702 - RNA, 19 nt, Homo sapiens
aaacgucuguaaagauguu

SEQ ID NO: 540703 - RNA, 19 nt, Homo sapiens
caacaucagcguauucaca

SEQ ID NO: 540704 - RNA, 19 nt, Homo sapiens
gaucaggcaucagagaauc

SEQ ID NO: 540705 - RNA, 19 nt, Homo sapiens
agaaacacguaauguggaa

SEQ ID NO: 540706 - RNA, 19 nt, Homo sapiens
cuaaaagcuuucacucuua

SEQ ID NO: 540707 - RNA, 19 nt, Homo sapiens
caacuugagcucuguaaca

SEQ ID NO: 540708 - RNA, 19 nt, Homo sapiens
gaagagugucccucagaga

SEQ ID NO: 540709 - RNA, 19 nt, Homo sapiens
agagaaacccuaugagugu

SEQ ID NO: 540710 - RNA, 19 nt, Homo sapiens
gaaaucuucaucagcauca

SEQ ID NO: 540711 - RNA, 19 nt, Homo sapiens
gaaaagccuugacuagcaa

SEQ ID NO: 540712 - RNA, 19 nt, Homo sapiens
guggacaagccuucaauuu

SEQ ID NO: 540713 - RNA, 19 nt, Homo sapiens
agagaaacccuaugagugu

SEQ ID NO: 540714 - RNA, 19 nt, Homo sapiens
caccaguaguuccgaguuu

SEQ ID NO: 540715 - RNA, 19 nt, Homo sapiens
gauucacacuggagagaga

SEQ ID NO: 540716 - RNA, 19 nt, Homo sapiens
ccacauuaauccagggaau

SEQ ID NO: 540717 - RNA, 19 nt, Homo sapiens
caucaaagaauccauacug

SEQ ID NO: 540718 - RNA, 19 nt, Homo sapiens
aaaggcaucugagaauuca

SEQ ID NO: 540719 - RNA, 19 nt, Homo sapiens
gaaauucuaacaacuugag

SEQ ID NO: 540720 - RNA, 19 nt, Homo sapiens
ggagagcccagguuauauc

SEQ ID NO: 540721 - RNA, 19 nt, Homo sapiens
uagcaguuguuugaaguuu

SEQ ID NO: 540722 - RNA, 19 nt, Homo sapiens
cauuguagcaguuguuuga

SEQ ID NO: 540723 - RNA, 19 nt, Homo sapiens
cagcaucaaagaauccaua

SEQ ID NO: 540724 - RNA, 19 nt, Homo sapiens
gaaagagaugggaugaugu

SEQ ID NO: 540725 - RNA, 19 nt, Homo sapiens
agaaaagucuuaacuagga

SEQ ID NO: 540726 - RNA, 19 nt, Homo sapiens
agacaccacuaguagauag

SEQ ID NO: 540727 - RNA, 19 nt, Homo sapiens
aacuggagcuggagaaaga

SEQ ID NO: 540728 - RNA, 19 nt, Homo sapiens
agagagacccuaucacugu

SEQ ID NO: 540729 - RNA, 19 nt, Homo sapiens
ggagugagacagcauagca

SEQ ID NO: 540730 - RNA, 19 nt, Homo sapiens
agucuuaacuaggaaacua

SEQ ID NO: 540731 - RNA, 19 nt, Homo sapiens
gaacagccacauacaccau

SEQ ID NO: 540732 - RNA, 19 nt, Homo sapiens
gagaauuggagagcaguaa

SEQ ID NO: 540733 - RNA, 19 nt, Homo sapiens
gugcaaggacccacaguug

SEQ ID NO: 540734 - RNA, 19 nt, Homo sapiens
ccacuaguagauagaaauu

SEQ ID NO: 540735 - RNA, 19 nt, Homo sapiens
agaacuagacucuuacaga

SEQ ID NO: 540736 - RNA, 19 nt, Homo sapiens
ugauucagaugucaguaga

SEQ ID NO: 540737 - RNA, 19 nt, Homo sapiens
cuauguaugugaugagugu

SEQ ID NO: 540738 - RNA, 19 nt, Homo sapiens
gaaacccuaugaguguaau

SEQ ID NO: 540739 - RNA, 19 nt, Homo sapiens
gaaacccuaugaguguaau

SEQ ID NO: 540740 - RNA, 19 nt, Homo sapiens
guacagagugugggaauag

SEQ ID NO: 540741 - RNA, 19 nt, Homo sapiens
ucccaaaccugcacugauc

SEQ ID NO: 540742 - RNA, 19 nt, Homo sapiens
uugggaaccugacugcuuu

SEQ ID NO: 540743 - RNA, 19 nt, Homo sapiens
acagaagugugauguugga

SEQ ID NO: 540744 - RNA, 19 nt, Homo sapiens
gcacuucaccaagacagaa

SEQ ID NO: 540745 - RNA, 19 nt, Homo sapiens
gaguguagcaaguaugaga

SEQ ID NO: 540746 - RNA, 19 nt, Homo sapiens
ggagucuuccuauguaugu

SEQ ID NO: 540747 - RNA, 19 nt, Homo sapiens
guuccgaguuuguuauaca

SEQ ID NO: 540748 - RNA, 19 nt, Homo sapiens
ggagaaagcuucaaacaga

SEQ ID NO: 540749 - RNA, 19 nt, Homo sapiens
ggaaagaaaucccauaaau

SEQ ID NO: 540750 - RNA, 19 nt, Homo sapiens
aaacagagcucaaaucuca

SEQ ID NO: 540751 - RNA, 19 nt, Homo sapiens
gaagaagccuguaaacucu

SEQ ID NO: 540752 - RNA, 19 nt, Homo sapiens
gacaaacccuauaaaugua

SEQ ID NO: 540753 - RNA, 19 nt, Homo sapiens
gggcaugacuauucgauuu

SEQ ID NO: 540754 - RNA, 19 nt, Homo sapiens
gaaagaaaucccauaaaug

SEQ ID NO: 540755 - RNA, 19 nt, Homo sapiens
ugacaaacccuauaaaugu

SEQ ID NO: 540756 - RNA, 19 nt, Homo sapiens
gaagaagcuuggaugacaa

SEQ ID NO: 540757 - RNA, 19 nt, Homo sapiens
cuacaaaugugaugagugu

SEQ ID NO: 540758 - RNA, 19 nt, Homo sapiens
agccagagcucccaccuua

SEQ ID NO: 540759 - RNA, 19 nt, Homo sapiens
guacaccucuaggaaauga

SEQ ID NO: 540760 - RNA, 19 nt, Homo sapiens
ccauaaaugugcugauugu

SEQ ID NO: 540761 - RNA, 19 nt, Homo sapiens
ggaaaggccuaugagaaca

SEQ ID NO: 540762 - RNA, 19 nt, Homo sapiens
gaaagcugguacagaagga

SEQ ID NO: 540763 - RNA, 19 nt, Homo sapiens
acaugaaggugcauaaaga

SEQ ID NO: 540764 - RNA, 19 nt, Homo sapiens
ggaaaugaaacacuaguuc

SEQ ID NO: 540765 - RNA, 19 nt, Homo sapiens
gaagagaagccucguaaaa

SEQ ID NO: 540766 - RNA, 19 nt, Homo sapiens
ucacuuacccucuuggaaa

SEQ ID NO: 540767 - RNA, 19 nt, Homo sapiens
ucuaggaaaugaaacacua

SEQ ID NO: 540768 - RNA, 19 nt, Homo sapiens
uuggaaagcugguacagaa

SEQ ID NO: 540769 - RNA, 19 nt, Homo sapiens
gaaggugcauaaagaagag

SEQ ID NO: 540770 - RNA, 19 nt, Homo sapiens
gagaauucauacuggagaa

SEQ ID NO: 540771 - RNA, 19 nt, Homo sapiens
gaaaagcccuacaaaugug

SEQ ID NO: 540772 - RNA, 19 nt, Homo sapiens
agaagaagcuuggaugaca

SEQ ID NO: 540773 - RNA, 19 nt, Homo sapiens
aaacacuaguucagaagaa

SEQ ID NO: 540774 - RNA, 19 nt, Homo sapiens
ucagaguucuaaucucauu

SEQ ID NO: 540775 - RNA, 19 nt, Homo sapiens
gaugacaaacccuauaaau

SEQ ID NO: 540776 - RNA, 19 nt, Homo sapiens
cagcaucgacggauccaua

SEQ ID NO: 540777 - RNA, 19 nt, Homo sapiens
gcaugacuauucgauuuga

SEQ ID NO: 540778 - RNA, 19 nt, Homo sapiens
ccagagcucccaccuuauu

SEQ ID NO: 540779 - RNA, 19 nt, Homo sapiens
gaaacacuaguucagaaga

SEQ ID NO: 540780 - RNA, 19 nt, Homo sapiens
gggaaaagcccuacaaaug

SEQ ID NO: 540781 - RNA, 19 nt, Homo sapiens
gaauguggcaaauguuuca

SEQ ID NO: 540782 - RNA, 19 nt, Homo sapiens
ggaaaagcccuacaaaugu

SEQ ID NO: 540783 - RNA, 19 nt, Homo sapiens
gcucccaccuuauucaaca

SEQ ID NO: 540784 - RNA, 19 nt, Homo sapiens
uuucagaguucuaaucuca

SEQ ID NO: 540785 - RNA, 19 nt, Homo sapiens
gaaaggccuaugagaacaa

SEQ ID NO: 540786 - RNA, 19 nt, Homo sapiens
cagugaauguggcaaaugu

SEQ ID NO: 540787 - RNA, 19 nt, Homo sapiens
aagaagagaagccucguaa

SEQ ID NO: 540788 - RNA, 19 nt, Homo sapiens
ggcaaauguuucagucaga

SEQ ID NO: 540789 - RNA, 19 nt, Homo sapiens
agaagaagccuguaaacuc

SEQ ID NO: 540790 - RNA, 19 nt, Homo sapiens
gugaauguggcaaauguuu

SEQ ID NO: 540791 - RNA, 19 nt, Homo sapiens
caucugaggcagcacauga

SEQ ID NO: 540792 - RNA, 19 nt, Homo sapiens
gcuggucuccguuaaguau

SEQ ID NO: 540793 - RNA, 19 nt, Homo sapiens
gagcucaaaucucauucag

SEQ ID NO: 540794 - RNA, 19 nt, Homo sapiens
caaggaaaggccuaugaga

SEQ ID NO: 540795 - RNA, 19 nt, Homo sapiens
guucagaagaagccuguaa

SEQ ID NO: 540796 - RNA, 19 nt, Homo sapiens
ucaaacagagcucaaaucu

SEQ ID NO: 540797 - RNA, 19 nt, Homo sapiens
caacaccagaagauccaua

SEQ ID NO: 540798 - RNA, 19 nt, Homo sapiens
gcuguacaccucuaggaaa

SEQ ID NO: 540799 - RNA, 19 nt, Homo sapiens
ucccauaaaugugcugauu

SEQ ID NO: 540800 - RNA, 19 nt, Homo sapiens
ggaugacaaacccuauaaa

SEQ ID NO: 540801 - RNA, 19 nt, Homo sapiens
aaggaaaggccuaugagaa

SEQ ID NO: 540802 - RNA, 19 nt, Homo sapiens
ugaaggugcauaaagaaga

SEQ ID NO: 540803 - RNA, 19 nt, Homo sapiens
gaguguggccgguguuuca

SEQ ID NO: 540804 - RNA, 19 nt, Homo sapiens
cagcaccagagaauucaua

SEQ ID NO: 540805 - RNA, 19 nt, Homo sapiens
gacucaagcuucaguagac

SEQ ID NO: 540806 - RNA, 19 nt, Homo sapiens
gccaaggaaaggccuauga

SEQ ID NO: 540807 - RNA, 19 nt, Homo sapiens
guuauucaccaugagguua

SEQ ID NO: 540808 - RNA, 19 nt, Homo sapiens
cccuauaaauguacugaau

SEQ ID NO: 540809 - RNA, 19 nt, Homo sapiens
ucagaagaagcuuggauga

SEQ ID NO: 540810 - RNA, 19 nt, Homo sapiens
caugaaggugcauaaagaa

SEQ ID NO: 540811 - RNA, 19 nt, Homo sapiens
agacucacuuacccucuug

SEQ ID NO: 540812 - RNA, 19 nt, Homo sapiens
caccagagaauucauacug

SEQ ID NO: 540813 - RNA, 19 nt, Homo sapiens
ucaguagacucagaagaag

SEQ ID NO: 540814 - RNA, 19 nt, Homo sapiens
gagcuguacaccucuagga

SEQ ID NO: 540815 - RNA, 19 nt, Homo sapiens
gcagugaauguggcaaaug

SEQ ID NO: 540816 - RNA, 19 nt, Homo sapiens
gagcucaagccaaggaaag

SEQ ID NO: 540817 - RNA, 19 nt, Homo sapiens
uggaugacaaacccuauaa

SEQ ID NO: 540818 - RNA, 19 nt, Homo sapiens
acagagcucaaaucucauu

SEQ ID NO: 540819 - RNA, 19 nt, Homo sapiens
cuggaaagaaaucccauaa

SEQ ID NO: 540820 - RNA, 19 nt, Homo sapiens
aaagaagagaagccucgua

SEQ ID NO: 540821 - RNA, 19 nt, Homo sapiens
ugugaugaguguggagaaa

SEQ ID NO: 540822 - RNA, 19 nt, Homo sapiens
aagcuucaguagacucaga

SEQ ID NO: 540823 - RNA, 19 nt, Homo sapiens
ugacucaagcuucaguaga

SEQ ID NO: 540824 - RNA, 19 nt, Homo sapiens
cuguacaccucuaggaaau

SEQ ID NO: 540825 - RNA, 19 nt, Homo sapiens
guggagaaagcuucaaaca

SEQ ID NO: 540826 - RNA, 19 nt, Homo sapiens
uggaaagaaaucccauaaa

SEQ ID NO: 540827 - RNA, 19 nt, Homo sapiens
gagcucccaccuuauucaa

SEQ ID NO: 540828 - RNA, 19 nt, Homo sapiens
ggcaugacuauucgauuug

SEQ ID NO: 540829 - RNA, 19 nt, Homo sapiens
gaguuucagucagaguuca

SEQ ID NO: 540830 - RNA, 19 nt, Homo sapiens
ggagcucaagccaaggaaa

SEQ ID NO: 540831 - RNA, 19 nt, Homo sapiens
gccuaaagcggguauuucu

SEQ ID NO: 540832 - RNA, 19 nt, Homo sapiens
uucaguagacucagaagaa

SEQ ID NO: 540833 - RNA, 19 nt, Homo sapiens
uggcuggucuccguuaagu

SEQ ID NO: 540834 - RNA, 19 nt, Homo sapiens
cagaagaagccuguaaacu

SEQ ID NO: 540835 - RNA, 19 nt, Homo sapiens
ccuauaaauguacugaaug

SEQ ID NO: 540836 - RNA, 19 nt, Homo sapiens
augacaaacccuauaaaug

SEQ ID NO: 540837 - RNA, 19 nt, Homo sapiens
ugaggcagcacaugaaggu

SEQ ID NO: 540838 - RNA, 19 nt, Homo sapiens
gugcagugaauguggcaaa

SEQ ID NO: 540839 - RNA, 19 nt, Homo sapiens
ggaaaggccuucagcguua

SEQ ID NO: 540840 - RNA, 19 nt, Homo sapiens
ggaaauggcuucagcugua

SEQ ID NO: 540841 - RNA, 19 nt, Homo sapiens
ggaaaaggcuucaauaaua

SEQ ID NO: 540842 - RNA, 19 nt, Homo sapiens
gacauagggucaugaauua

SEQ ID NO: 540843 - RNA, 19 nt, Homo sapiens
ggaaagcguucaauguuaa

SEQ ID NO: 540844 - RNA, 19 nt, Homo sapiens
ggacuuguauggagaaauu

SEQ ID NO: 540845 - RNA, 19 nt, Homo sapiens
gggaaagcguucaauguua

SEQ ID NO: 540846 - RNA, 19 nt, Homo sapiens
gaucaaguaucaucagauu

SEQ ID NO: 540847 - RNA, 19 nt, Homo sapiens
gaagaaacccuauaugugu

SEQ ID NO: 540848 - RNA, 19 nt, Homo sapiens
ggagaugcuuuacuucuaa

SEQ ID NO: 540849 - RNA, 19 nt, Homo sapiens
gggaaagccuucagaugua

SEQ ID NO: 540850 - RNA, 19 nt, Homo sapiens
gggaaagcauucagguuua

SEQ ID NO: 540851 - RNA, 19 nt, Homo sapiens
caacaagcauguauuacuu

SEQ ID NO: 540852 - RNA, 19 nt, Homo sapiens
gcauucagcuguaguucua

SEQ ID NO: 540853 - RNA, 19 nt, Homo sapiens
ggagaaacccuucaaaugu

SEQ ID NO: 540854 - RNA, 19 nt, Homo sapiens
gggaaagccuucaguauca

SEQ ID NO: 540855 - RNA, 19 nt, Homo sapiens
gagaaagcauucagcugua

SEQ ID NO: 540856 - RNA, 19 nt, Homo sapiens
agagaaaccuuaugaaugu

SEQ ID NO: 540857 - RNA, 19 nt, Homo sapiens
gagaaacccuucaaaugug

SEQ ID NO: 540858 - RNA, 19 nt, Homo sapiens
gaucaucaccgaauccaua

SEQ ID NO: 540859 - RNA, 19 nt, Homo sapiens
gcaaagcuuucagcauuaa

SEQ ID NO: 540860 - RNA, 19 nt, Homo sapiens
ggaaauccaucagcuuuga

SEQ ID NO: 540861 - RNA, 19 nt, Homo sapiens
gcaggaaccuauuguuuca

SEQ ID NO: 540862 - RNA, 19 nt, Homo sapiens
ucaaauguauggaauguga

SEQ ID NO: 540863 - RNA, 19 nt, Homo sapiens
gaaaagcccuaucaaugua

SEQ ID NO: 540864 - RNA, 19 nt, Homo sapiens
gagaagcccuaucagugua

SEQ ID NO: 540865 - RNA, 19 nt, Homo sapiens
gaaaggaugaccaguuaaa

SEQ ID NO: 540866 - RNA, 19 nt, Homo sapiens
gagaaacccuucagaugug

SEQ ID NO: 540867 - RNA, 19 nt, Homo sapiens
ggaaagccuucagauguaa

SEQ ID NO: 540868 - RNA, 19 nt, Homo sapiens
uggcaaagcuuucagcauu

SEQ ID NO: 540869 - RNA, 19 nt, Homo sapiens
ggagaaaccuuuugaaugu

SEQ ID NO: 540870 - RNA, 19 nt, Homo sapiens
ggacguggcuguguacuuc

SEQ ID NO: 540871 - RNA, 19 nt, Homo sapiens
ggagaaacccuucagaugu

SEQ ID NO: 540872 - RNA, 19 nt, Homo sapiens
aaagaaaccuacuugauca

SEQ ID NO: 540873 - RNA, 19 nt, Homo sapiens
ugacaacaagcauguauua

SEQ ID NO: 540874 - RNA, 19 nt, Homo sapiens
aggaaaggaugaccaguua

SEQ ID NO: 540875 - RNA, 19 nt, Homo sapiens
ggaagaaacccuauaugug

SEQ ID NO: 540876 - RNA, 19 nt, Homo sapiens
gagagaaaccuuaugaaug

SEQ ID NO: 540877 - RNA, 19 nt, Homo sapiens
ggcaaagcuuucagcauua

SEQ ID NO: 540878 - RNA, 19 nt, Homo sapiens
gcaggaacauuaaccuaug

SEQ ID NO: 540879 - RNA, 19 nt, Homo sapiens
gagaagagcaacaccauug

SEQ ID NO: 540880 - RNA, 19 nt, Homo sapiens
gggagaugcuuuacuucua

SEQ ID NO: 540881 - RNA, 19 nt, Homo sapiens
ccacucagcaggaaauaua

SEQ ID NO: 540882 - RNA, 19 nt, Homo sapiens
gagagaagccuuguuguug

SEQ ID NO: 540883 - RNA, 19 nt, Homo sapiens
caaaauggaucaaguauca

SEQ ID NO: 540884 - RNA, 19 nt, Homo sapiens
gaaaagcccuaucagugua

SEQ ID NO: 540885 - RNA, 19 nt, Homo sapiens
ggaaauguaugaaggaaaa

SEQ ID NO: 540886 - RNA, 19 nt, Homo sapiens
ggagagaaaccuuaugaau

SEQ ID NO: 540887 - RNA, 19 nt, Homo sapiens
agagaaaccuuacgagugu

SEQ ID NO: 540888 - RNA, 19 nt, Homo sapiens
gaaaggccuucagcguuaa

SEQ ID NO: 540889 - RNA, 19 nt, Homo sapiens
gagaaacccuaugagugua

SEQ ID NO: 540890 - RNA, 19 nt, Homo sapiens
ggugauaccacaagucuuu

SEQ ID NO: 540891 - RNA, 19 nt, Homo sapiens
gaaaagccuuccauguuaa

SEQ ID NO: 540892 - RNA, 19 nt, Homo sapiens
caacaucagagaauccaua

SEQ ID NO: 540893 - RNA, 19 nt, Homo sapiens
gggagaaacccuucaaaug

SEQ ID NO: 540894 - RNA, 19 nt, Homo sapiens
gagcagcccucugggugua

SEQ ID NO: 540895 - RNA, 19 nt, Homo sapiens
ugacaaaggaaauguauga

SEQ ID NO: 540896 - RNA, 19 nt, Homo sapiens
gagaagcccuaugagugua

SEQ ID NO: 540897 - RNA, 19 nt, Homo sapiens
ggaaaagccuuaucagugu

SEQ ID NO: 540898 - RNA, 19 nt, Homo sapiens
ggaaaagccuucaguguca

SEQ ID NO: 540899 - RNA, 19 nt, Homo sapiens
cgugaagcaugaaauaauu

SEQ ID NO: 540900 - RNA, 19 nt, Homo sapiens
agaagucggugaccuuuga

SEQ ID NO: 540901 - RNA, 19 nt, Homo sapiens
ggccugagcuauggaauug

SEQ ID NO: 540902 - RNA, 19 nt, Homo sapiens
gaugaccaguuaaagagaa

SEQ ID NO: 540903 - RNA, 19 nt, Homo sapiens
ggagaagcccuaugagugu

SEQ ID NO: 540904 - RNA, 19 nt, Homo sapiens
ggagaagcccuaucagugu

SEQ ID NO: 540905 - RNA, 19 nt, Homo sapiens
caggaaauauaaagaagga

SEQ ID NO: 540906 - RNA, 19 nt, Homo sapiens
gaaguccacucagcaggaa

SEQ ID NO: 540907 - RNA, 19 nt, Homo sapiens
ggaaagcauucagguuuag

SEQ ID NO: 540908 - RNA, 19 nt, Homo sapiens
aagaaacccuauaugugua

SEQ ID NO: 540909 - RNA, 19 nt, Homo sapiens
cgagaaacccuaugagugu

SEQ ID NO: 540910 - RNA, 19 nt, Homo sapiens
gagaaaccuuaugaaugua

SEQ ID NO: 540911 - RNA, 19 nt, Homo sapiens
gauacucuaccuacauuaa

SEQ ID NO: 540912 - RNA, 19 nt, Homo sapiens
gagaagccuuguuguugga

SEQ ID NO: 540913 - RNA, 19 nt, Homo sapiens
gcagagucuucauauggaa

SEQ ID NO: 540914 - RNA, 19 nt, Homo sapiens
guuaauggaagccuaagua

SEQ ID NO: 540915 - RNA, 19 nt, Homo sapiens
gaagccuuguuguuggaua

SEQ ID NO: 540916 - RNA, 19 nt, Homo sapiens
caagagggcaugaauaugg

SEQ ID NO: 540917 - RNA, 19 nt, Homo sapiens
gagaaaagcccuaucaaug

SEQ ID NO: 540918 - RNA, 19 nt, Homo sapiens
cugcauauauuacacauca

SEQ ID NO: 540919 - RNA, 19 nt, Homo sapiens
gaaauggcuucagcuguag

SEQ ID NO: 540920 - RNA, 19 nt, Homo sapiens
gaacaacacugaggaaaag

SEQ ID NO: 540921 - RNA, 19 nt, Homo sapiens
ucucaaaccugcugugauc

SEQ ID NO: 540922 - RNA, 19 nt, Homo sapiens
gggagaaacccuucagaug

SEQ ID NO: 540923 - RNA, 19 nt, Homo sapiens
caguaucaaugccaaacua

SEQ ID NO: 540924 - RNA, 19 nt, Homo sapiens
ggaaagccuucaguaucaa

SEQ ID NO: 540925 - RNA, 19 nt, Homo sapiens
agauguaacucccaauuuc

SEQ ID NO: 540926 - RNA, 19 nt, Homo sapiens
cagcuacaguucccauuau

SEQ ID NO: 540927 - RNA, 19 nt, Homo sapiens
cagcaggaaccuauuguuu

SEQ ID NO: 540928 - RNA, 19 nt, Homo sapiens
ggacuuccauggacuacag

SEQ ID NO: 540929 - RNA, 19 nt, Homo sapiens
uaaagauacucuaccuaca

SEQ ID NO: 540930 - RNA, 19 nt, Homo sapiens
aagauacucuaccuacauu

SEQ ID NO: 540931 - RNA, 19 nt, Homo sapiens
gaauaaauggagagagaga

SEQ ID NO: 540932 - RNA, 19 nt, Homo sapiens
ggagaaauuuaagucuuca

SEQ ID NO: 540933 - RNA, 19 nt, Homo sapiens
ucaaguaucaucagauuca

SEQ ID NO: 540934 - RNA, 19 nt, Homo sapiens
ggagagaagcccuaucagu

SEQ ID NO: 540935 - RNA, 19 nt, Homo sapiens
uugaauaaauggagagaga

SEQ ID NO: 540936 - RNA, 19 nt, Homo sapiens
ggcagagucuucauaugga

SEQ ID NO: 540937 - RNA, 19 nt, Homo sapiens
uaaagaaggagaagagcaa

SEQ ID NO: 540938 - RNA, 19 nt, Homo sapiens
gggaugugaugcuggagaa

SEQ ID NO: 540939 - RNA, 19 nt, Homo sapiens
ggaagaagauucaauacuu

SEQ ID NO: 540940 - RNA, 19 nt, Homo sapiens
ugaaagaaauggugucaua

SEQ ID NO: 540941 - RNA, 19 nt, Homo sapiens
ggagaaaccuuauggaugu

SEQ ID NO: 540942 - RNA, 19 nt, Homo sapiens
ccaaagagcuacagacuug

SEQ ID NO: 540943 - RNA, 19 nt, Homo sapiens
agaagaagcucagggauua

SEQ ID NO: 540944 - RNA, 19 nt, Homo sapiens
ggagaaaccuuaugaaugc

SEQ ID NO: 540945 - RNA, 19 nt, Homo sapiens
ugacagugcuggaggauuu

SEQ ID NO: 540946 - RNA, 19 nt, Homo sapiens
ggagcuuccuucagcauua

SEQ ID NO: 540947 - RNA, 19 nt, Homo sapiens
gcucagggauuaccaaguu

SEQ ID NO: 540948 - RNA, 19 nt, Homo sapiens
agaaaucccucucgaaaga

SEQ ID NO: 540949 - RNA, 19 nt, Homo sapiens
caugguaucucaagaagaa

SEQ ID NO: 540950 - RNA, 19 nt, Homo sapiens
guacuguaaucuaccauaa

SEQ ID NO: 540951 - RNA, 19 nt, Homo sapiens
caacaggaauuacaaaguc

SEQ ID NO: 540952 - RNA, 19 nt, Homo sapiens
ugucauaccugccuagaaa

SEQ ID NO: 540953 - RNA, 19 nt, Homo sapiens
gauaagaagugauggugau

SEQ ID NO: 540954 - RNA, 19 nt, Homo sapiens
gaauggaacaccuugauug

SEQ ID NO: 540955 - RNA, 19 nt, Homo sapiens
aaccauaagucucagauaa

SEQ ID NO: 540956 - RNA, 19 nt, Homo sapiens
ggaaugaugcagaauaguu

SEQ ID NO: 540957 - RNA, 19 nt, Homo sapiens
gcucagcccuuauucuuca

SEQ ID NO: 540958 - RNA, 19 nt, Homo sapiens
cuacucauccucucuauaa

SEQ ID NO: 540959 - RNA, 19 nt, Homo sapiens
gaaugaugcagaauaguuu

SEQ ID NO: 540960 - RNA, 19 nt, Homo sapiens
ugaauguuguggaaguuua

SEQ ID NO: 540961 - RNA, 19 nt, Homo sapiens
uuaccaggguguuguauuu

SEQ ID NO: 540962 - RNA, 19 nt, Homo sapiens
uagaagacaugguaucuca

SEQ ID NO: 540963 - RNA, 19 nt, Homo sapiens
gguauugcccugaggcuua

SEQ ID NO: 540964 - RNA, 19 nt, Homo sapiens
gcuaagagccucaaaauga

SEQ ID NO: 540965 - RNA, 19 nt, Homo sapiens
ggaauuacaaagucugaaa

SEQ ID NO: 540966 - RNA, 19 nt, Homo sapiens
gaagugauggugauaaaca

SEQ ID NO: 540967 - RNA, 19 nt, Homo sapiens
ggauacauucccuuauaua

SEQ ID NO: 540968 - RNA, 19 nt, Homo sapiens
gggagaaaccuuaugaaug

SEQ ID NO: 540969 - RNA, 19 nt, Homo sapiens
ccauaagucucagauaaga

SEQ ID NO: 540970 - RNA, 19 nt, Homo sapiens
gcagaaaauucaaaagcua

SEQ ID NO: 540971 - RNA, 19 nt, Homo sapiens
ggucuuaaugccuaaauuu

SEQ ID NO: 540972 - RNA, 19 nt, Homo sapiens
aaucuucacucaccauuau

SEQ ID NO: 540973 - RNA, 19 nt, Homo sapiens
gcaguuuguugccauccua

SEQ ID NO: 540974 - RNA, 19 nt, Homo sapiens
aaucagcacucaggucuuu

SEQ ID NO: 540975 - RNA, 19 nt, Homo sapiens
gagaagacacaaugcagaa

SEQ ID NO: 540976 - RNA, 19 nt, Homo sapiens
gggaaguacuaguagaaga

SEQ ID NO: 540977 - RNA, 19 nt, Homo sapiens
aagaagugauggugauaaa

SEQ ID NO: 540978 - RNA, 19 nt, Homo sapiens
gaaccauaagucucagaua

SEQ ID NO: 540979 - RNA, 19 nt, Homo sapiens
gguauuucuuccacuguaa

SEQ ID NO: 540980 - RNA, 19 nt, Homo sapiens
aagcagccaugcauuuauu

SEQ ID NO: 540981 - RNA, 19 nt, Homo sapiens
auaaugaacuaccugauuc

SEQ ID NO: 540982 - RNA, 19 nt, Homo sapiens
gggaaaucguauagucaaa

SEQ ID NO: 540983 - RNA, 19 nt, Homo sapiens
ggccagagacgcacacaaa

SEQ ID NO: 540984 - RNA, 19 nt, Homo sapiens
gcacugugaugaugauggu

SEQ ID NO: 540985 - RNA, 19 nt, Homo sapiens
auggauacauucccuuaua

SEQ ID NO: 540986 - RNA, 19 nt, Homo sapiens
caucagagaagacacaaug

SEQ ID NO: 540987 - RNA, 19 nt, Homo sapiens
gaaaucguauagucaaagc

SEQ ID NO: 540988 - RNA, 19 nt, Homo sapiens
gagaucaucauccagagaa

SEQ ID NO: 540989 - RNA, 19 nt, Homo sapiens
cucauccucucuauaauuu

SEQ ID NO: 540990 - RNA, 19 nt, Homo sapiens
gaaaccuuauggauguguu

SEQ ID NO: 540991 - RNA, 19 nt, Homo sapiens
gcauuagaaucccaugaag

SEQ ID NO: 540992 - RNA, 19 nt, Homo sapiens
gcgaagagggaucaaguau

SEQ ID NO: 540993 - RNA, 19 nt, Homo sapiens
gcuagguacuguaaucuac

SEQ ID NO: 540994 - RNA, 19 nt, Homo sapiens
ggauaaaggaugcuaagag

SEQ ID NO: 540995 - RNA, 19 nt, Homo sapiens
caugugauguuuauagucu

SEQ ID NO: 540996 - RNA, 19 nt, Homo sapiens
gaagacaugguaucucaag

SEQ ID NO: 540997 - RNA, 19 nt, Homo sapiens
gcaacaggaauuacaaagu

SEQ ID NO: 540998 - RNA, 19 nt, Homo sapiens
ucacucaccauuaugauau

SEQ ID NO: 540999 - RNA, 19 nt, Homo sapiens
gaauguuguggaaguuuaa

SEQ ID NO: 541000 - RNA, 19 nt, Homo sapiens
gacaugguaucucaagaag

SEQ ID NO: 541001 - RNA, 19 nt, Homo sapiens
aauauggaaugaugcagaa

SEQ ID NO: 541002 - RNA, 19 nt, Homo sapiens
gaugaugguaggacugaaa

SEQ ID NO: 541003 - RNA, 19 nt, Homo sapiens
gugggcaaguaucagguua

SEQ ID NO: 541004 - RNA, 19 nt, Homo sapiens
gggcagguuugaaagaaag

SEQ ID NO: 541005 - RNA, 19 nt, Homo sapiens
cuaaggcacugugaugaug

SEQ ID NO: 541006 - RNA, 19 nt, Homo sapiens
caucagagaauccauacug

SEQ ID NO: 541007 - RNA, 19 nt, Homo sapiens
gcuuauuaaucaucagaga

SEQ ID NO: 541008 - RNA, 19 nt, Homo sapiens
guauggguguuccucaaau

SEQ ID NO: 541009 - RNA, 19 nt, Homo sapiens
cgagaacuuugccgucugu

SEQ ID NO: 541010 - RNA, 19 nt, Homo sapiens
uggauacauucccuuauau

SEQ ID NO: 541011 - RNA, 19 nt, Homo sapiens
uggaggauuuggagaguga

SEQ ID NO: 541012 - RNA, 19 nt, Homo sapiens
gaucaaguauccccuggaa

SEQ ID NO: 541013 - RNA, 19 nt, Homo sapiens
uauggaaugaugcagaaua

SEQ ID NO: 541014 - RNA, 19 nt, Homo sapiens
cggagugccugugaagaaa

SEQ ID NO: 541015 - RNA, 19 nt, Homo sapiens
gauucaggcaguuuggaua

SEQ ID NO: 541016 - RNA, 19 nt, Homo sapiens
uaagaagugauggugauaa

SEQ ID NO: 541017 - RNA, 19 nt, Homo sapiens
gaaaauaagaggauaaagg

SEQ ID NO: 541018 - RNA, 19 nt, Homo sapiens
cagccgaaguuccauucuu

SEQ ID NO: 541019 - RNA, 19 nt, Homo sapiens
gcccuuauucuucaucaaa

SEQ ID NO: 541020 - RNA, 19 nt, Homo sapiens
cacagucaguggaagaaga

SEQ ID NO: 541021 - RNA, 19 nt, Homo sapiens
cugcauugaucauugaaau

SEQ ID NO: 541022 - RNA, 19 nt, Homo sapiens
cauuauuucugcauugauc

SEQ ID NO: 541023 - RNA, 19 nt, Homo sapiens
aaaucccucucgaaagaaa

SEQ ID NO: 541024 - RNA, 19 nt, Homo sapiens
gaaaucccucucgaaagaa

SEQ ID NO: 541025 - RNA, 19 nt, Homo sapiens
uauggguguuccucaaauu

SEQ ID NO: 541026 - RNA, 19 nt, Homo sapiens
ggagcuccauucccuaagg

SEQ ID NO: 541027 - RNA, 19 nt, Homo sapiens
agacuuggguucgagauca

SEQ ID NO: 541028 - RNA, 19 nt, Homo sapiens
ccugauucauugucccuuu

SEQ ID NO: 541029 - RNA, 19 nt, Homo sapiens
caagggcagguuugaaaga

SEQ ID NO: 541030 - RNA, 19 nt, Homo sapiens
agacaugguaucucaagaa

SEQ ID NO: 541031 - RNA, 19 nt, Homo sapiens
auaaguagguagguauuuc

SEQ ID NO: 541032 - RNA, 19 nt, Homo sapiens
aauggucugucauggcuuu

SEQ ID NO: 541033 - RNA, 19 nt, Homo sapiens
guauugcccugaggcuuau

SEQ ID NO: 541034 - RNA, 19 nt, Homo sapiens
gaacuaccugauucauugu

SEQ ID NO: 541035 - RNA, 19 nt, Homo sapiens
gaaagaaauggugucauac

SEQ ID NO: 541036 - RNA, 19 nt, Homo sapiens
aagaagaagcucagggauu

SEQ ID NO: 541037 - RNA, 19 nt, Homo sapiens
gagaggaggcagugacagu

SEQ ID NO: 541038 - RNA, 19 nt, Homo sapiens
uaugugaguuagccucuuc

SEQ ID NO: 541039 - RNA, 19 nt, Homo sapiens
gaacagagucuuaaaguua

SEQ ID NO: 541040 - RNA, 19 nt, Homo sapiens
ucaaagagcucauagcaua

SEQ ID NO: 541041 - RNA, 19 nt, Homo sapiens
gaaggaauguggagcaaua

SEQ ID NO: 541042 - RNA, 19 nt, Homo sapiens
gaaagaauccugauaaguu

SEQ ID NO: 541043 - RNA, 19 nt, Homo sapiens
gggaaagccuucaauauga

SEQ ID NO: 541044 - RNA, 19 nt, Homo sapiens
gagaaacccuacucaugua

SEQ ID NO: 541045 - RNA, 19 nt, Homo sapiens
gauagguuguggaauaaua

SEQ ID NO: 541046 - RNA, 19 nt, Homo sapiens
gcagaucuggcauuuauua

SEQ ID NO: 541047 - RNA, 19 nt, Homo sapiens
gaagucaucucucagugaa

SEQ ID NO: 541048 - RNA, 19 nt, Homo sapiens
gaauguaguuugugugaga

SEQ ID NO: 541049 - RNA, 19 nt, Homo sapiens
guacaucucagaauucaua

SEQ ID NO: 541050 - RNA, 19 nt, Homo sapiens
gaaagucacauuccagauu

SEQ ID NO: 541051 - RNA, 19 nt, Homo sapiens
ggagagagaccaaccauau

SEQ ID NO: 541052 - RNA, 19 nt, Homo sapiens
ggaacagagucuuaaaguu

SEQ ID NO: 541053 - RNA, 19 nt, Homo sapiens
ggauaaugguaaucucuuu

SEQ ID NO: 541054 - RNA, 19 nt, Homo sapiens
uuacagggcugccgcuuaa

SEQ ID NO: 541055 - RNA, 19 nt, Homo sapiens
aagcagaucuggcauuuau

SEQ ID NO: 541056 - RNA, 19 nt, Homo sapiens
ggagaaacccuacucaugu

SEQ ID NO: 541057 - RNA, 19 nt, Homo sapiens
ggagagagaccuuaugaau

SEQ ID NO: 541058 - RNA, 19 nt, Homo sapiens
caacugagaagcccuauga

SEQ ID NO: 541059 - RNA, 19 nt, Homo sapiens
ggagagagacccuaugaau

SEQ ID NO: 541060 - RNA, 19 nt, Homo sapiens
gaauaacuguggauacgau

SEQ ID NO: 541061 - RNA, 19 nt, Homo sapiens
uuugauagguuguggaaua

SEQ ID NO: 541062 - RNA, 19 nt, Homo sapiens
aaagucacauuccagauuu

SEQ ID NO: 541063 - RNA, 19 nt, Homo sapiens
gguagugucuuucagguau

SEQ ID NO: 541064 - RNA, 19 nt, Homo sapiens
gcaggaggcccuaaaauua

SEQ ID NO: 541065 - RNA, 19 nt, Homo sapiens
cugauaaguuucaugguua

SEQ ID NO: 541066 - RNA, 19 nt, Homo sapiens
ggagagaaaccauggaaau

SEQ ID NO: 541067 - RNA, 19 nt, Homo sapiens
ggaaaagccuucacucaga

SEQ ID NO: 541068 - RNA, 19 nt, Homo sapiens
gagagacccuaugaaugua

SEQ ID NO: 541069 - RNA, 19 nt, Homo sapiens
gaguuaacacugaauagua

SEQ ID NO: 541070 - RNA, 19 nt, Homo sapiens
ucagaaugaugcaauguga

SEQ ID NO: 541071 - RNA, 19 nt, Homo sapiens
ggaaauccuucuguuggaa

SEQ ID NO: 541072 - RNA, 19 nt, Homo sapiens
caggagacuucggauaaua

SEQ ID NO: 541073 - RNA, 19 nt, Homo sapiens
ccaagcagaaguuauuuaa

SEQ ID NO: 541074 - RNA, 19 nt, Homo sapiens
ggaguucacacaggaaaua

SEQ ID NO: 541075 - RNA, 19 nt, Homo sapiens
aggaacaccuuauaaguug

SEQ ID NO: 541076 - RNA, 19 nt, Homo sapiens
ucagagaacucauucaacu

SEQ ID NO: 541077 - RNA, 19 nt, Homo sapiens
agagagaccuuaugaaugc

SEQ ID NO: 541078 - RNA, 19 nt, Homo sapiens
gaauucagggcuucguaua

SEQ ID NO: 541079 - RNA, 19 nt, Homo sapiens
guucacauccgaaugcaua

SEQ ID NO: 541080 - RNA, 19 nt, Homo sapiens
gagagagaccuuaugaaug

SEQ ID NO: 541081 - RNA, 19 nt, Homo sapiens
gaauguggagcaauaaaug

SEQ ID NO: 541082 - RNA, 19 nt, Homo sapiens
ggagacuucggauaauaua

SEQ ID NO: 541083 - RNA, 19 nt, Homo sapiens
gggaaauccuucuguugga

SEQ ID NO: 541084 - RNA, 19 nt, Homo sapiens
agucauaccuuguuauaca

SEQ ID NO: 541085 - RNA, 19 nt, Homo sapiens
gaaaucacagcuucuuuua

SEQ ID NO: 541086 - RNA, 19 nt, Homo sapiens
ccugauaaguuucaugguu

SEQ ID NO: 541087 - RNA, 19 nt, Homo sapiens
gagagagacccuaugaaug

SEQ ID NO: 541088 - RNA, 19 nt, Homo sapiens
gcuccaagcagaaguuauu

SEQ ID NO: 541089 - RNA, 19 nt, Homo sapiens
ggagugaaaccguaugaau

SEQ ID NO: 541090 - RNA, 19 nt, Homo sapiens
gggaaagccuacaguugga

SEQ ID NO: 541091 - RNA, 19 nt, Homo sapiens
cauuguacaucucagaauu

SEQ ID NO: 541092 - RNA, 19 nt, Homo sapiens
gaaaagccuucacucagaa

SEQ ID NO: 541093 - RNA, 19 nt, Homo sapiens
ugaaugcaaugaaugugaa

SEQ ID NO: 541094 - RNA, 19 nt, Homo sapiens
gggagaaacccuacucaug

SEQ ID NO: 541095 - RNA, 19 nt, Homo sapiens
agagagaccaaccauauuu

SEQ ID NO: 541096 - RNA, 19 nt, Homo sapiens
gagagagaccaaccauauu

SEQ ID NO: 541097 - RNA, 19 nt, Homo sapiens
agagagacccuaugaaugu

SEQ ID NO: 541098 - RNA, 19 nt, Homo sapiens
uuuccucacuucucaauaa

SEQ ID NO: 541099 - RNA, 19 nt, Homo sapiens
gcaguuccaugccuguugu

SEQ ID NO: 541100 - RNA, 19 nt, Homo sapiens
gaucuggcauuuauuacag

SEQ ID NO: 541101 - RNA, 19 nt, Homo sapiens
guacaccagagaacucaua

SEQ ID NO: 541102 - RNA, 19 nt, Homo sapiens
gggaacucauucauucuug

SEQ ID NO: 541103 - RNA, 19 nt, Homo sapiens
gcagggaacagagucuuaa

SEQ ID NO: 541104 - RNA, 19 nt, Homo sapiens
gguaugaacaguugacuuc

SEQ ID NO: 541105 - RNA, 19 nt, Homo sapiens
gaacaccuuauaaguugaa

SEQ ID NO: 541106 - RNA, 19 nt, Homo sapiens
ggaacaccuuauaaguuga

SEQ ID NO: 541107 - RNA, 19 nt, Homo sapiens
ggagagaagcccuauggau

SEQ ID NO: 541108 - RNA, 19 nt, Homo sapiens
gaaccugcuucucugaucu

SEQ ID NO: 541109 - RNA, 19 nt, Homo sapiens
ggaacucauucauucuugu

SEQ ID NO: 541110 - RNA, 19 nt, Homo sapiens
ggaauguggagcaauaaau

SEQ ID NO: 541111 - RNA, 19 nt, Homo sapiens
gagagaaaccauggaaaug

SEQ ID NO: 541112 - RNA, 19 nt, Homo sapiens
gagagaaaccuuuuaaaug

SEQ ID NO: 541113 - RNA, 19 nt, Homo sapiens
gagugaaaccguaugaaug

SEQ ID NO: 541114 - RNA, 19 nt, Homo sapiens
ugugggaacucauucauuc

SEQ ID NO: 541115 - RNA, 19 nt, Homo sapiens
ucagguauccguuccacua

SEQ ID NO: 541116 - RNA, 19 nt, Homo sapiens
ccauggaaaugcucugaau

SEQ ID NO: 541117 - RNA, 19 nt, Homo sapiens
auaagcagaucuggcauuu

SEQ ID NO: 541118 - RNA, 19 nt, Homo sapiens
uaaugugacuuuccugagu

SEQ ID NO: 541119 - RNA, 19 nt, Homo sapiens
uaggaacaccuuauaaguu

SEQ ID NO: 541120 - RNA, 19 nt, Homo sapiens
acacuaggaacaccuuaua

SEQ ID NO: 541121 - RNA, 19 nt, Homo sapiens
gagaaaccauggaaaugcu

SEQ ID NO: 541122 - RNA, 19 nt, Homo sapiens
gaacagcucacugcacauc

SEQ ID NO: 541123 - RNA, 19 nt, Homo sapiens
uugagaacauccauucauu

SEQ ID NO: 541124 - RNA, 19 nt, Homo sapiens
acucagaagucaucucuca

SEQ ID NO: 541125 - RNA, 19 nt, Homo sapiens
gaagucuccauucguugua

SEQ ID NO: 541126 - RNA, 19 nt, Homo sapiens
cagagaauuuacacuagga

SEQ ID NO: 541127 - RNA, 19 nt, Homo sapiens
caaauguuguaguaucauc

SEQ ID NO: 541128 - RNA, 19 nt, Homo sapiens
gaagcccuaugaaugcaau

SEQ ID NO: 541129 - RNA, 19 nt, Homo sapiens
caucagagaacucauucaa

SEQ ID NO: 541130 - RNA, 19 nt, Homo sapiens
ugggaaagccuucaauaug

SEQ ID NO: 541131 - RNA, 19 nt, Homo sapiens
uaaguccuaucuccauguu

SEQ ID NO: 541132 - RNA, 19 nt, Homo sapiens
ggaaaucacagcuucuuuu

SEQ ID NO: 541133 - RNA, 19 nt, Homo sapiens
gaaagccuacaguuggaaa

SEQ ID NO: 541134 - RNA, 19 nt, Homo sapiens
ggagagaaaccuuuuaaau

SEQ ID NO: 541135 - RNA, 19 nt, Homo sapiens
gagagagccuuuuguggaa

SEQ ID NO: 541136 - RNA, 19 nt, Homo sapiens
gggaacagagucuuaaagu

SEQ ID NO: 541137 - RNA, 19 nt, Homo sapiens
guaagucacagcucauugu

SEQ ID NO: 541138 - RNA, 19 nt, Homo sapiens
gagagaccaaccauauuug

SEQ ID NO: 541139 - RNA, 19 nt, Homo sapiens
gaacuggacucgcugauga

SEQ ID NO: 541140 - RNA, 19 nt, Homo sapiens
gaagaacagugacaucauu

SEQ ID NO: 541141 - RNA, 19 nt, Homo sapiens
aaccagagcuccagucuua

SEQ ID NO: 541142 - RNA, 19 nt, Homo sapiens
ggacaugcccuuucuauga

SEQ ID NO: 541143 - RNA, 19 nt, Homo sapiens
gcucaaaccuucugaaaca

SEQ ID NO: 541144 - RNA, 19 nt, Homo sapiens
gaagaacuccugauuguga

SEQ ID NO: 541145 - RNA, 19 nt, Homo sapiens
gagagaagccguauaaaug

SEQ ID NO: 541146 - RNA, 19 nt, Homo sapiens
gagagaagcccuauaaaug

SEQ ID NO: 541147 - RNA, 19 nt, Homo sapiens
gagagaagcccuacaaaug

SEQ ID NO: 541148 - RNA, 19 nt, Homo sapiens
caaugaagaugcugucaaa

SEQ ID NO: 541149 - RNA, 19 nt, Homo sapiens
ggaagugaauuacaaauac

SEQ ID NO: 541150 - RNA, 19 nt, Homo sapiens
gaagagaccaggcccuuaa

SEQ ID NO: 541151 - RNA, 19 nt, Homo sapiens
ggagaaacuuuaugagugu

SEQ ID NO: 541152 - RNA, 19 nt, Homo sapiens
uaagagcucugcccucauu

SEQ ID NO: 541153 - RNA, 19 nt, Homo sapiens
caacaacaguucccacuuc

SEQ ID NO: 541154 - RNA, 19 nt, Homo sapiens
gagagaagccguauaagug

SEQ ID NO: 541155 - RNA, 19 nt, Homo sapiens
gggaaaagcuucaguaaga

SEQ ID NO: 541156 - RNA, 19 nt, Homo sapiens
gcauugaccuggagggauu

SEQ ID NO: 541157 - RNA, 19 nt, Homo sapiens
ggagaaacccuacaagugu

SEQ ID NO: 541158 - RNA, 19 nt, Homo sapiens
uguaagagcugugucagua

SEQ ID NO: 541159 - RNA, 19 nt, Homo sapiens
agaaggagcucuguaaaga

SEQ ID NO: 541160 - RNA, 19 nt, Homo sapiens
gcuaagaacuuuguauaca

SEQ ID NO: 541161 - RNA, 19 nt, Homo sapiens
caaaggaggacucaaugua

SEQ ID NO: 541162 - RNA, 19 nt, Homo sapiens
guucuaaccucauuacuca

SEQ ID NO: 541163 - RNA, 19 nt, Homo sapiens
ggagagaagccguauaaau

SEQ ID NO: 541164 - RNA, 19 nt, Homo sapiens
ggagagaagcccuauaaau

SEQ ID NO: 541165 - RNA, 19 nt, Homo sapiens
gcaaagacuucaacaacag

SEQ ID NO: 541166 - RNA, 19 nt, Homo sapiens
gggaaguuaucuugguaua

SEQ ID NO: 541167 - RNA, 19 nt, Homo sapiens
ggagagaaaccauaugaau

SEQ ID NO: 541168 - RNA, 19 nt, Homo sapiens
agagacagcuccugaacaa

SEQ ID NO: 541169 - RNA, 19 nt, Homo sapiens
gggcugggauccugaagaa

SEQ ID NO: 541170 - RNA, 19 nt, Homo sapiens
gcccugaccuucccaauca

SEQ ID NO: 541171 - RNA, 19 nt, Homo sapiens
uaagagcugugucaguauu

SEQ ID NO: 541172 - RNA, 19 nt, Homo sapiens
caacaaaggaggacucaau

SEQ ID NO: 541173 - RNA, 19 nt, Homo sapiens
gagcuccagucuuauuauu

SEQ ID NO: 541174 - RNA, 19 nt, Homo sapiens
gcuccaagcucaucacaca

SEQ ID NO: 541175 - RNA, 19 nt, Homo sapiens
agcaauagcugguguuuau

SEQ ID NO: 541176 - RNA, 19 nt, Homo sapiens
acagugacaucauuacaaa

SEQ ID NO: 541177 - RNA, 19 nt, Homo sapiens
gcaaacaugcugagaagga

SEQ ID NO: 541178 - RNA, 19 nt, Homo sapiens
gcaggaagacauuggauga

SEQ ID NO: 541179 - RNA, 19 nt, Homo sapiens
aaggaggacucaauguaua

SEQ ID NO: 541180 - RNA, 19 nt, Homo sapiens
gcucugcccucauuaguca

SEQ ID NO: 541181 - RNA, 19 nt, Homo sapiens
gaacaaccucaaaguauca

SEQ ID NO: 541182 - RNA, 19 nt, Homo sapiens
gauuaaaggacuugggaua

SEQ ID NO: 541183 - RNA, 19 nt, Homo sapiens
uagaccacauuuccuguua

SEQ ID NO: 541184 - RNA, 19 nt, Homo sapiens
guaaagacccacacagaau

SEQ ID NO: 541185 - RNA, 19 nt, Homo sapiens
gguauaaaccagguaauuu

SEQ ID NO: 541186 - RNA, 19 nt, Homo sapiens
gagagaaaccauaugaaug

SEQ ID NO: 541187 - RNA, 19 nt, Homo sapiens
gugagaagcccuacaaaug

SEQ ID NO: 541188 - RNA, 19 nt, Homo sapiens
guauaaaccagguaauuug

SEQ ID NO: 541189 - RNA, 19 nt, Homo sapiens
gcuccagucuuauuauuca

SEQ ID NO: 541190 - RNA, 19 nt, Homo sapiens
ggagagaagccguauaagu

SEQ ID NO: 541191 - RNA, 19 nt, Homo sapiens
ggagagaagcccuacaaau

SEQ ID NO: 541192 - RNA, 19 nt, Homo sapiens
ggguuugccuggagccuua

SEQ ID NO: 541193 - RNA, 19 nt, Homo sapiens
ggcaaagacuucaacaaca

SEQ ID NO: 541194 - RNA, 19 nt, Homo sapiens
cuauaaauguggagaaugu

SEQ ID NO: 541195 - RNA, 19 nt, Homo sapiens
gaaaagcccuauaaaugug

SEQ ID NO: 541196 - RNA, 19 nt, Homo sapiens
ccuagaggcuugggaaauu

SEQ ID NO: 541197 - RNA, 19 nt, Homo sapiens
uaaaccagguaauuuggaa

SEQ ID NO: 541198 - RNA, 19 nt, Homo sapiens
cuagaggcuugggaaauua

SEQ ID NO: 541199 - RNA, 19 nt, Homo sapiens
gagaggaguuggccuagag

SEQ ID NO: 541200 - RNA, 19 nt, Homo sapiens
gagaagccguauaaaugug

SEQ ID NO: 541201 - RNA, 19 nt, Homo sapiens
gagugaaucuccuuucucu

SEQ ID NO: 541202 - RNA, 19 nt, Homo sapiens
cugaagaacuccugauugu

SEQ ID NO: 541203 - RNA, 19 nt, Homo sapiens
ggaauugcauacagaagag

SEQ ID NO: 541204 - RNA, 19 nt, Homo sapiens
ggacuggaauugcauacag

SEQ ID NO: 541205 - RNA, 19 nt, Homo sapiens
ggacuugggauauccagaa

SEQ ID NO: 541206 - RNA, 19 nt, Homo sapiens
gcucugugcuaagaacuuu

SEQ ID NO: 541207 - RNA, 19 nt, Homo sapiens
gcacagaguaggaagaaca

SEQ ID NO: 541208 - RNA, 19 nt, Homo sapiens
caccguagaugcaggaaga

SEQ ID NO: 541209 - RNA, 19 nt, Homo sapiens
cuacaaaugccuugaaugu

SEQ ID NO: 541210 - RNA, 19 nt, Homo sapiens
caggaacaguggcaagaaa

SEQ ID NO: 541211 - RNA, 19 nt, Homo sapiens
gugaaucuccuuucucuga

SEQ ID NO: 541212 - RNA, 19 nt, Homo sapiens
gcagauuacagccuggaua

SEQ ID NO: 541213 - RNA, 19 nt, Homo sapiens
gaccacauuuccuguuaug

SEQ ID NO: 541214 - RNA, 19 nt, Homo sapiens
gugcuaagaacuuuguaua

SEQ ID NO: 541215 - RNA, 19 nt, Homo sapiens
ggcaagcucugugcuaaga

SEQ ID NO: 541216 - RNA, 19 nt, Homo sapiens
gaacagugacaucauuaca

SEQ ID NO: 541217 - RNA, 19 nt, Homo sapiens
cagggaaguuaucuuggua

SEQ ID NO: 541218 - RNA, 19 nt, Homo sapiens
gggagaaacccuacaagug

SEQ ID NO: 541219 - RNA, 19 nt, Homo sapiens
ugaacaaccucaaaguauc

SEQ ID NO: 541220 - RNA, 19 nt, Homo sapiens
gagcucaaaccuucugaaa

SEQ ID NO: 541221 - RNA, 19 nt, Homo sapiens
gggagaauguugugacucu

SEQ ID NO: 541222 - RNA, 19 nt, Homo sapiens
gggaaaagcccuauaaaug

SEQ ID NO: 541223 - RNA, 19 nt, Homo sapiens
aaaggagcacugcagauua

SEQ ID NO: 541224 - RNA, 19 nt, Homo sapiens
caaguaauaccuccgagaa

SEQ ID NO: 541225 - RNA, 19 nt, Homo sapiens
ccacauuuccuguuaugaa

SEQ ID NO: 541226 - RNA, 19 nt, Homo sapiens
gaaucuccaugcacuuugu

SEQ ID NO: 541227 - RNA, 19 nt, Homo sapiens
ggaaaagcccuauaaaugu

SEQ ID NO: 541228 - RNA, 19 nt, Homo sapiens
gaacaguggcaagaaaguu

SEQ ID NO: 541229 - RNA, 19 nt, Homo sapiens
gugcuggccuggucaaugu

SEQ ID NO: 541230 - RNA, 19 nt, Homo sapiens
guauaaauguguggacugu

SEQ ID NO: 541231 - RNA, 19 nt, Homo sapiens
cugaagaaauggcagaaga

SEQ ID NO: 541232 - RNA, 19 nt, Homo sapiens
gcacuggucacacaucugu

SEQ ID NO: 541233 - RNA, 19 nt, Homo sapiens
gcagugguucuccuacuuu

SEQ ID NO: 541234 - RNA, 19 nt, Homo sapiens
agagaaaccauaugaaugu

SEQ ID NO: 541235 - RNA, 19 nt, Homo sapiens
caaaccuucugaaacauca

SEQ ID NO: 541236 - RNA, 19 nt, Homo sapiens
ggagcagugucgcuacaga

SEQ ID NO: 541237 - RNA, 19 nt, Homo sapiens
ggucacacaucuguaagug

SEQ ID NO: 541238 - RNA, 19 nt, Homo sapiens
aauccugacuguccuugua

SEQ ID NO: 541239 - RNA, 19 nt, Homo sapiens
aaaggaagcuuaauuguuc

SEQ ID NO: 541240 - RNA, 19 nt, Homo sapiens
gaaaggaagcuuaauuguu

SEQ ID NO: 541241 - RNA, 19 nt, Homo sapiens
gaagauaugcccagaaugu

SEQ ID NO: 541242 - RNA, 19 nt, Homo sapiens
gaagcaaccuauccaguuc

SEQ ID NO: 541243 - RNA, 19 nt, Homo sapiens
gagagaagcuggaacaaaa

SEQ ID NO: 541244 - RNA, 19 nt, Homo sapiens
cagagaagcuucaggaauc

SEQ ID NO: 541245 - RNA, 19 nt, Homo sapiens
gaauguagcguucuucaau

SEQ ID NO: 541246 - RNA, 19 nt, Homo sapiens
ccacaaauaugaccacucu

SEQ ID NO: 541247 - RNA, 19 nt, Homo sapiens
ggacugucauggaagauau

SEQ ID NO: 541248 - RNA, 19 nt, Homo sapiens
gagaagcccuauagaugug

SEQ ID NO: 541249 - RNA, 19 nt, Homo sapiens
gaagagagaagcuggaaca

SEQ ID NO: 541250 - RNA, 19 nt, Homo sapiens
ucacagaggcucacccuuu

SEQ ID NO: 541251 - RNA, 19 nt, Homo sapiens
ggaaaagccuucagucaga

SEQ ID NO: 541252 - RNA, 19 nt, Homo sapiens
caaaggcaaucuuguuaca

SEQ ID NO: 541253 - RNA, 19 nt, Homo sapiens
gccaaaggcaaucuuguua

SEQ ID NO: 541254 - RNA, 19 nt, Homo sapiens
ggaagaaucauaugaagag

SEQ ID NO: 541255 - RNA, 19 nt, Homo sapiens
gaauggagaaucuuucaga

SEQ ID NO: 541256 - RNA, 19 nt, Homo sapiens
cgaagacacuacaggaaga

SEQ ID NO: 541257 - RNA, 19 nt, Homo sapiens
gaaugaauggagaaucuuu

SEQ ID NO: 541258 - RNA, 19 nt, Homo sapiens
ggagagacacccuaucugu

SEQ ID NO: 541259 - RNA, 19 nt, Homo sapiens
gaguggacauguuuggauu

SEQ ID NO: 541260 - RNA, 19 nt, Homo sapiens
cagaaaggaagcuuaauug

SEQ ID NO: 541261 - RNA, 19 nt, Homo sapiens
gcaaucuuguuacacauca

SEQ ID NO: 541262 - RNA, 19 nt, Homo sapiens
gugagaagcccuauagaug

SEQ ID NO: 541263 - RNA, 19 nt, Homo sapiens
ggagagaagccuuaucagu

SEQ ID NO: 541264 - RNA, 19 nt, Homo sapiens
guagcguucuucaauguga

SEQ ID NO: 541265 - RNA, 19 nt, Homo sapiens
gaacagcccauggaagaau

SEQ ID NO: 541266 - RNA, 19 nt, Homo sapiens
ucagaaaggaagcuuaauu

SEQ ID NO: 541267 - RNA, 19 nt, Homo sapiens
agaguaaccuugcuguuca

SEQ ID NO: 541268 - RNA, 19 nt, Homo sapiens
ccaguucuauggaaugaau

SEQ ID NO: 541269 - RNA, 19 nt, Homo sapiens
cacagaggcucacccuuug

SEQ ID NO: 541270 - RNA, 19 nt, Homo sapiens
augaagagguggugacuga

SEQ ID NO: 541271 - RNA, 19 nt, Homo sapiens
cuauagaugugaucagugu

SEQ ID NO: 541272 - RNA, 19 nt, Homo sapiens
gacugaagcccaccacaaa

SEQ ID NO: 541273 - RNA, 19 nt, Homo sapiens
uggaagauaugcccagaau

SEQ ID NO: 541274 - RNA, 19 nt, Homo sapiens
acaaauaugaccacucuga

SEQ ID NO: 541275 - RNA, 19 nt, Homo sapiens
gguggugacugaggucgua

SEQ ID NO: 541276 - RNA, 19 nt, Homo sapiens
ccacuuuccugaagagaag

SEQ ID NO: 541277 - RNA, 19 nt, Homo sapiens
ugaagcaaccuauccaguu

SEQ ID NO: 541278 - RNA, 19 nt, Homo sapiens
cuacgagugugcuauuugu

SEQ ID NO: 541279 - RNA, 19 nt, Homo sapiens
gggaaaagcuucagucaac

SEQ ID NO: 541280 - RNA, 19 nt, Homo sapiens
gaaaauccuuccggcaaaa

SEQ ID NO: 541281 - RNA, 19 nt, Homo sapiens
gcuggacugucauggaaga

SEQ ID NO: 541282 - RNA, 19 nt, Homo sapiens
ucagaaagaccaucauugg

SEQ ID NO: 541283 - RNA, 19 nt, Homo sapiens
caaccuauccaguucuaug

SEQ ID NO: 541284 - RNA, 19 nt, Homo sapiens
acagaaacccuacgagugu

SEQ ID NO: 541285 - RNA, 19 nt, Homo sapiens
agucuaacguuacaugaga

SEQ ID NO: 541286 - RNA, 19 nt, Homo sapiens
gaagcuuaauuguucacau

SEQ ID NO: 541287 - RNA, 19 nt, Homo sapiens
ugagaagcccuauagaugu

SEQ ID NO: 541288 - RNA, 19 nt, Homo sapiens
cugaagcccaccacaaaua

SEQ ID NO: 541289 - RNA, 19 nt, Homo sapiens
ggugagaagcccuauagau

SEQ ID NO: 541290 - RNA, 19 nt, Homo sapiens
aagcaggaguggacauguu

SEQ ID NO: 541291 - RNA, 19 nt, Homo sapiens
ggccaaaggcaaucuuguu

SEQ ID NO: 541292 - RNA, 19 nt, Homo sapiens
uggaaugaauggagaaucu

SEQ ID NO: 541293 - RNA, 19 nt, Homo sapiens
ggguagggcaaacugauuu

SEQ ID NO: 541294 - RNA, 19 nt, Homo sapiens
gcccauggaagaaucauau

SEQ ID NO: 541295 - RNA, 19 nt, Homo sapiens
gaaaagccuucagucagaa

SEQ ID NO: 541296 - RNA, 19 nt, Homo sapiens
uguuacacaucaacggaua

SEQ ID NO: 541297 - RNA, 19 nt, Homo sapiens
cauggaagaaucauaugaa

SEQ ID NO: 541298 - RNA, 19 nt, Homo sapiens
cugcuggacugucauggaa

SEQ ID NO: 541299 - RNA, 19 nt, Homo sapiens
aagcuuaauuguucacauc

SEQ ID NO: 541300 - RNA, 19 nt, Homo sapiens
gaugugaucaguguggaaa

SEQ ID NO: 541301 - RNA, 19 nt, Homo sapiens
aaaagguagucuaacguua

SEQ ID NO: 541302 - RNA, 19 nt, Homo sapiens
ggaguggacauguuuggau

SEQ ID NO: 541303 - RNA, 19 nt, Homo sapiens
aauggagaaucuuucagaa

SEQ ID NO: 541304 - RNA, 19 nt, Homo sapiens
cagaguaaccuugcuguuc

SEQ ID NO: 541305 - RNA, 19 nt, Homo sapiens
aaggcaaucuuguuacaca

SEQ ID NO: 541306 - RNA, 19 nt, Homo sapiens
gcugggauauccaaaauuc

SEQ ID NO: 541307 - RNA, 19 nt, Homo sapiens
cuuaauuguucacaucaga

SEQ ID NO: 541308 - RNA, 19 nt, Homo sapiens
ggaacagcccauggaagaa

SEQ ID NO: 541309 - RNA, 19 nt, Homo sapiens
ucagagaagcuucaggaau

SEQ ID NO: 541310 - RNA, 19 nt, Homo sapiens
uaacguuacaugagagaau

SEQ ID NO: 541311 - RNA, 19 nt, Homo sapiens
gcucacccuuugaccacuu

SEQ ID NO: 541312 - RNA, 19 nt, Homo sapiens
gaagcccaccacaaauaug

SEQ ID NO: 541313 - RNA, 19 nt, Homo sapiens
ugaagcccaccacaaauau

SEQ ID NO: 541314 - RNA, 19 nt, Homo sapiens
aggaacagcccauggaaga

SEQ ID NO: 541315 - RNA, 19 nt, Homo sapiens
cgggagagaagccuuauca

SEQ ID NO: 541316 - RNA, 19 nt, Homo sapiens
aauguagcguucuucaaug

SEQ ID NO: 541317 - RNA, 19 nt, Homo sapiens
ugacugaagcccaccacaa

SEQ ID NO: 541318 - RNA, 19 nt, Homo sapiens
guggacauguuuggauuuc

SEQ ID NO: 541319 - RNA, 19 nt, Homo sapiens
gugcaaggagugugggaaa

SEQ ID NO: 541320 - RNA, 19 nt, Homo sapiens
acacgggagagaagccuua

SEQ ID NO: 541321 - RNA, 19 nt, Homo sapiens
ccauggaagaaucauauga

SEQ ID NO: 541322 - RNA, 19 nt, Homo sapiens
gcuacaggauccucaagcu

SEQ ID NO: 541323 - RNA, 19 nt, Homo sapiens
agagagaagcuggaacaaa

SEQ ID NO: 541324 - RNA, 19 nt, Homo sapiens
ggaaugaauggagaaucuu

SEQ ID NO: 541325 - RNA, 19 nt, Homo sapiens
agaaaggaagcuuaauugu

SEQ ID NO: 541326 - RNA, 19 nt, Homo sapiens
agucagaaaggaagcuuaa

SEQ ID NO: 541327 - RNA, 19 nt, Homo sapiens
agagaagcuucaggaauca

SEQ ID NO: 541328 - RNA, 19 nt, Homo sapiens
gguagucuaacguuacaug

SEQ ID NO: 541329 - RNA, 19 nt, Homo sapiens
caggagagacacccuaucu

SEQ ID NO: 541330 - RNA, 19 nt, Homo sapiens
gaagcccuauagaugugau

SEQ ID NO: 541331 - RNA, 19 nt, Homo sapiens
acacaucaacggauacaca

SEQ ID NO: 541332 - RNA, 19 nt, Homo sapiens
ucuucaaugugaugacuga

SEQ ID NO: 541333 - RNA, 19 nt, Homo sapiens
gagaauccacacuggucaa

SEQ ID NO: 541334 - RNA, 19 nt, Homo sapiens
gaagacacuacaggaagau

SEQ ID NO: 541335 - RNA, 19 nt, Homo sapiens
cuacccugcuggacuguca

SEQ ID NO: 541336 - RNA, 19 nt, Homo sapiens
ggauacacacgggagagaa

SEQ ID NO: 541337 - RNA, 19 nt, Homo sapiens
guggugagaagcccuauag

SEQ ID NO: 541338 - RNA, 19 nt, Homo sapiens
guagucuaacguuacauga

SEQ ID NO: 541339 - RNA, 19 nt, Homo sapiens
ggaacaaggugauguaaua

SEQ ID NO: 541340 - RNA, 19 nt, Homo sapiens
gaacacagaugcagaaauc

SEQ ID NO: 541341 - RNA, 19 nt, Homo sapiens
ccacagagcuaauguuuau

SEQ ID NO: 541342 - RNA, 19 nt, Homo sapiens
aaucuaagcuuccacuuua

SEQ ID NO: 541343 - RNA, 19 nt, Homo sapiens
uaagucagcucuaauugua

SEQ ID NO: 541344 - RNA, 19 nt, Homo sapiens
cauaacaccuuacagauuu

SEQ ID NO: 541345 - RNA, 19 nt, Homo sapiens
gagaaacccuaucaaugua

SEQ ID NO: 541346 - RNA, 19 nt, Homo sapiens
gagaaacacuuugaaugua

SEQ ID NO: 541347 - RNA, 19 nt, Homo sapiens
gagaaaaccuuaugaauga

SEQ ID NO: 541348 - RNA, 19 nt, Homo sapiens
ggagagaaaucuugucaau

SEQ ID NO: 541349 - RNA, 19 nt, Homo sapiens
gcugguagauagagacuua

SEQ ID NO: 541350 - RNA, 19 nt, Homo sapiens
gcucaaagaugaaauacga

SEQ ID NO: 541351 - RNA, 19 nt, Homo sapiens
ggagaaacccuaugaaugu

SEQ ID NO: 541352 - RNA, 19 nt, Homo sapiens
ggagaaacccuaucaaugu

SEQ ID NO: 541353 - RNA, 19 nt, Homo sapiens
gggaaauucuuuagccaua

SEQ ID NO: 541354 - RNA, 19 nt, Homo sapiens
uaagucagcccucacauua

SEQ ID NO: 541355 - RNA, 19 nt, Homo sapiens
gagaagacauauaggagaa

SEQ ID NO: 541356 - RNA, 19 nt, Homo sapiens
agagaaaucuugucaaugu

SEQ ID NO: 541357 - RNA, 19 nt, Homo sapiens
ggagaaacccuacgaaugu

SEQ ID NO: 541358 - RNA, 19 nt, Homo sapiens
ggacaaucacuaugaauuu

SEQ ID NO: 541359 - RNA, 19 nt, Homo sapiens
ucagaaaggugauaaagga

SEQ ID NO: 541360 - RNA, 19 nt, Homo sapiens
gcuauauaaugcaguguua

SEQ ID NO: 541361 - RNA, 19 nt, Homo sapiens
gggagaacuuugugugaua

SEQ ID NO: 541362 - RNA, 19 nt, Homo sapiens
cagaauugguuaucaguaa

SEQ ID NO: 541363 - RNA, 19 nt, Homo sapiens
ucucaaagcucacacaaga

SEQ ID NO: 541364 - RNA, 19 nt, Homo sapiens
gggaaauccuuuagugaaa

SEQ ID NO: 541365 - RNA, 19 nt, Homo sapiens
gagaaacccuaugaaugua

SEQ ID NO: 541366 - RNA, 19 nt, Homo sapiens
gaagucagaccucacagua

SEQ ID NO: 541367 - RNA, 19 nt, Homo sapiens
guggaaaccuuaugaaugu

SEQ ID NO: 541368 - RNA, 19 nt, Homo sapiens
ugaguuugaugccauaaua

SEQ ID NO: 541369 - RNA, 19 nt, Homo sapiens
gcagaaacccuuugcaugu

SEQ ID NO: 541370 - RNA, 19 nt, Homo sapiens
gcagugagcugagauugug

SEQ ID NO: 541371 - RNA, 19 nt, Homo sapiens
ggaaacaggaggaagaauu

SEQ ID NO: 541372 - RNA, 19 nt, Homo sapiens
caacaucagagaucacaua

SEQ ID NO: 541373 - RNA, 19 nt, Homo sapiens
gagaaaucuugucaaugua

SEQ ID NO: 541374 - RNA, 19 nt, Homo sapiens
gcacaaaucaucacucaca

SEQ ID NO: 541375 - RNA, 19 nt, Homo sapiens
ggaaauucuuuagccauaa

SEQ ID NO: 541376 - RNA, 19 nt, Homo sapiens
gauccuagauuacacaagu

SEQ ID NO: 541377 - RNA, 19 nt, Homo sapiens
gauuuagccucaaguaguu

SEQ ID NO: 541378 - RNA, 19 nt, Homo sapiens
gcauaacaccuuacagauu

SEQ ID NO: 541379 - RNA, 19 nt, Homo sapiens
ggaaaccuuaugaauguua

SEQ ID NO: 541380 - RNA, 19 nt, Homo sapiens
ggaauaauuucaggaggaa

SEQ ID NO: 541381 - RNA, 19 nt, Homo sapiens
gaaaugauaccaagucucu

SEQ ID NO: 541382 - RNA, 19 nt, Homo sapiens
caagacgcauucucucaaa

SEQ ID NO: 541383 - RNA, 19 nt, Homo sapiens
guuaggaagugauauucua

SEQ ID NO: 541384 - RNA, 19 nt, Homo sapiens
caaaucaucacucacagua

SEQ ID NO: 541385 - RNA, 19 nt, Homo sapiens
cuacgaaugucaugaaugu

SEQ ID NO: 541386 - RNA, 19 nt, Homo sapiens
gaaacccuaugaauguuau

SEQ ID NO: 541387 - RNA, 19 nt, Homo sapiens
cagcuaacauuauccuuga

SEQ ID NO: 541388 - RNA, 19 nt, Homo sapiens
ucaaagcucacacaagaua

SEQ ID NO: 541389 - RNA, 19 nt, Homo sapiens
cuagcuagcuuaagaacaa

SEQ ID NO: 541390 - RNA, 19 nt, Homo sapiens
caagucagccuccauaaug

SEQ ID NO: 541391 - RNA, 19 nt, Homo sapiens
guacaucagagaagacaua

SEQ ID NO: 541392 - RNA, 19 nt, Homo sapiens
ggagaaacccuaugaaugc

SEQ ID NO: 541393 - RNA, 19 nt, Homo sapiens
gaagaauucccaagccaaa

SEQ ID NO: 541394 - RNA, 19 nt, Homo sapiens
gauaacacuucccaacuca

SEQ ID NO: 541395 - RNA, 19 nt, Homo sapiens
gaaaaggucaguaaaauug

SEQ ID NO: 541396 - RNA, 19 nt, Homo sapiens
gggauaaacccauagacua

SEQ ID NO: 541397 - RNA, 19 nt, Homo sapiens
gaagagagagaacgcagaa

SEQ ID NO: 541398 - RNA, 19 nt, Homo sapiens
gcagaaauccucaaaauau

SEQ ID NO: 541399 - RNA, 19 nt, Homo sapiens
gcugaaacccuaugaaugu

SEQ ID NO: 541400 - RNA, 19 nt, Homo sapiens
ccaauauccauucauguua

SEQ ID NO: 541401 - RNA, 19 nt, Homo sapiens
caucacagcuaauccuaug

SEQ ID NO: 541402 - RNA, 19 nt, Homo sapiens
gcaauagcauuaagcacau

SEQ ID NO: 541403 - RNA, 19 nt, Homo sapiens
gaaaagcccuaugaaugua

SEQ ID NO: 541404 - RNA, 19 nt, Homo sapiens
gaauucacauaggagauaa

SEQ ID NO: 541405 - RNA, 19 nt, Homo sapiens
gagagaaacacuuugaaug

SEQ ID NO: 541406 - RNA, 19 nt, Homo sapiens
gaaacaggaggaagaauuc

SEQ ID NO: 541407 - RNA, 19 nt, Homo sapiens
gagaugugaugcuggagaa

SEQ ID NO: 541408 - RNA, 19 nt, Homo sapiens
gaauuuacacugaggagaa

SEQ ID NO: 541409 - RNA, 19 nt, Homo sapiens
caucagagaucacauacag

SEQ ID NO: 541410 - RNA, 19 nt, Homo sapiens
gagaacccauacacaagaa

SEQ ID NO: 541411 - RNA, 19 nt, Homo sapiens
cagaagagaauaacuguga

SEQ ID NO: 541412 - RNA, 19 nt, Homo sapiens
ccauagacuacaacaauua

SEQ ID NO: 541413 - RNA, 19 nt, Homo sapiens
gaaauucuuuagccauaag

SEQ ID NO: 541414 - RNA, 19 nt, Homo sapiens
aaucugaccucacuaaaca

SEQ ID NO: 541415 - RNA, 19 nt, Homo sapiens
agucaaaccucacuaaaca

SEQ ID NO: 541416 - RNA, 19 nt, Homo sapiens
gcagaagaaucacuugaac

SEQ ID NO: 541417 - RNA, 19 nt, Homo sapiens
ggagaaagcccugaugaca

SEQ ID NO: 541418 - RNA, 19 nt, Homo sapiens
gaaacccuaugaauguaau

SEQ ID NO: 541419 - RNA, 19 nt, Homo sapiens
ucagagaauucacauagga

SEQ ID NO: 541420 - RNA, 19 nt, Homo sapiens
gaaacccuaucaauguaau

SEQ ID NO: 541421 - RNA, 19 nt, Homo sapiens
gaagagaauaacugugauu

SEQ ID NO: 541422 - RNA, 19 nt, Homo sapiens
ggaacacacugagucauca

SEQ ID NO: 541423 - RNA, 19 nt, Homo sapiens
cuagacacuuuccuacuaa

SEQ ID NO: 541424 - RNA, 19 nt, Homo sapiens
cauaaugccucagaguauu

SEQ ID NO: 541425 - RNA, 19 nt, Homo sapiens
gaaguccacccuuucuaaa

SEQ ID NO: 541426 - RNA, 19 nt, Homo sapiens
guacuggaagugcuauaua

SEQ ID NO: 541427 - RNA, 19 nt, Homo sapiens
uagagagaauucccaugua

SEQ ID NO: 541428 - RNA, 19 nt, Homo sapiens
gaaguuuaaugaguagaga

SEQ ID NO: 541429 - RNA, 19 nt, Homo sapiens
gggcauaacaccuuacaga

SEQ ID NO: 541430 - RNA, 19 nt, Homo sapiens
ccacaagucagccuccaua

SEQ ID NO: 541431 - RNA, 19 nt, Homo sapiens
gaaacccuaugaaugcaau

SEQ ID NO: 541432 - RNA, 19 nt, Homo sapiens
gggagaaacccuaugaaug

SEQ ID NO: 541433 - RNA, 19 nt, Homo sapiens
gggagaaacccuaugaaug

SEQ ID NO: 541434 - RNA, 19 nt, Homo sapiens
gggagaaacccuaucaaug

SEQ ID NO: 541435 - RNA, 19 nt, Homo sapiens
ggagaaaccuuuugaaugc

SEQ ID NO: 541436 - RNA, 19 nt, Homo sapiens
caagggacaaucacuauga

SEQ ID NO: 541437 - RNA, 19 nt, Homo sapiens
gaaugaguuucaacacugu

SEQ ID NO: 541438 - RNA, 19 nt, Homo sapiens
gcagcucaaagaugaaaua

SEQ ID NO: 541439 - RNA, 19 nt, Homo sapiens
gaagaugacugcagaauug

SEQ ID NO: 541440 - RNA, 19 nt, Homo sapiens
ggaagaaacucaagaagaa

SEQ ID NO: 541441 - RNA, 19 nt, Homo sapiens
gaacccaucuuguugaaua

SEQ ID NO: 541442 - RNA, 19 nt, Homo sapiens
gaauaaagcuugccuagag

SEQ ID NO: 541443 - RNA, 19 nt, Homo sapiens
guacaaagcuaagugguaa

SEQ ID NO: 541444 - RNA, 19 nt, Homo sapiens
gaauguggcuuuccuagga

SEQ ID NO: 541445 - RNA, 19 nt, Homo sapiens
gcucauaccuacuuauuca

SEQ ID NO: 541446 - RNA, 19 nt, Homo sapiens
gggaaaggauuuagucaga

SEQ ID NO: 541447 - RNA, 19 nt, Homo sapiens
ccagaaagcugauccucaa

SEQ ID NO: 541448 - RNA, 19 nt, Homo sapiens
gggaaagccuucacucaga

SEQ ID NO: 541449 - RNA, 19 nt, Homo sapiens
gagaagcccuuugccugua

SEQ ID NO: 541450 - RNA, 19 nt, Homo sapiens
gccaagcacucaaggauug

SEQ ID NO: 541451 - RNA, 19 nt, Homo sapiens
ggagaagcccuaugaaugu

SEQ ID NO: 541452 - RNA, 19 nt, Homo sapiens
gagagaaacccuuugaaug

SEQ ID NO: 541453 - RNA, 19 nt, Homo sapiens
gaaaggauuuagucagagu

SEQ ID NO: 541454 - RNA, 19 nt, Homo sapiens
gacaagugauagugaauga

SEQ ID NO: 541455 - RNA, 19 nt, Homo sapiens
caacagcuccuucuccaaa

SEQ ID NO: 541456 - RNA, 19 nt, Homo sapiens
ggacagaaauaggaaaugg

SEQ ID NO: 541457 - RNA, 19 nt, Homo sapiens
gugcaaaucuuauuguaca

SEQ ID NO: 541458 - RNA, 19 nt, Homo sapiens
uuaaagaggcagagaauaa

SEQ ID NO: 541459 - RNA, 19 nt, Homo sapiens
uaagaaaucuggaggaaaa

SEQ ID NO: 541460 - RNA, 19 nt, Homo sapiens
gguagcaguucaacaauuc

SEQ ID NO: 541461 - RNA, 19 nt, Homo sapiens
guugaaccguguauucuaa

SEQ ID NO: 541462 - RNA, 19 nt, Homo sapiens
agucagcucucuugccuua

SEQ ID NO: 541463 - RNA, 19 nt, Homo sapiens
gagugcaaaucuuauugua

SEQ ID NO: 541464 - RNA, 19 nt, Homo sapiens
guucaaaucugacuguaca

SEQ ID NO: 541465 - RNA, 19 nt, Homo sapiens
gggagaagcccuaugaaug

SEQ ID NO: 541466 - RNA, 19 nt, Homo sapiens
ggagagaaacccuuugaau

SEQ ID NO: 541467 - RNA, 19 nt, Homo sapiens
caucagagaauucauaaug

SEQ ID NO: 541468 - RNA, 19 nt, Homo sapiens
guacaucagcgaagccaua

SEQ ID NO: 541469 - RNA, 19 nt, Homo sapiens
ugaaggagucaaagaauaa

SEQ ID NO: 541470 - RNA, 19 nt, Homo sapiens
gaaccuugguauuguaaag

SEQ ID NO: 541471 - RNA, 19 nt, Homo sapiens
gaaauaggaaauggacuuu

SEQ ID NO: 541472 - RNA, 19 nt, Homo sapiens
aggaagaccuccagcauug

SEQ ID NO: 541473 - RNA, 19 nt, Homo sapiens
gaaguguggugcagcuuuc

SEQ ID NO: 541474 - RNA, 19 nt, Homo sapiens
gagaauucauaauggagaa

SEQ ID NO: 541475 - RNA, 19 nt, Homo sapiens
ggaggaaaauauagccuua

SEQ ID NO: 541476 - RNA, 19 nt, Homo sapiens
ucaaggaccugaguuagga

SEQ ID NO: 541477 - RNA, 19 nt, Homo sapiens
ggaggcaccugcugcuuca

SEQ ID NO: 541478 - RNA, 19 nt, Homo sapiens
gggaagaaacucaagaaga

SEQ ID NO: 541479 - RNA, 19 nt, Homo sapiens
gagaaacccuuugaauguc

SEQ ID NO: 541480 - RNA, 19 nt, Homo sapiens
ggaugaaggagucaaagaa

SEQ ID NO: 541481 - RNA, 19 nt, Homo sapiens
agacaccucuuugcuguuu

SEQ ID NO: 541482 - RNA, 19 nt, Homo sapiens
caccagaaaguccacauua

SEQ ID NO: 541483 - RNA, 19 nt, Homo sapiens
agagaaacccuuugaaugu

SEQ ID NO: 541484 - RNA, 19 nt, Homo sapiens
gacugucacuuaccugaaa

SEQ ID NO: 541485 - RNA, 19 nt, Homo sapiens
ccacacaccagcuauauuc

SEQ ID NO: 541486 - RNA, 19 nt, Homo sapiens
cauguucucugaaguggaa

SEQ ID NO: 541487 - RNA, 19 nt, Homo sapiens
ucagagaauucauaaugga

SEQ ID NO: 541488 - RNA, 19 nt, Homo sapiens
gaagccauaugaguguaaa

SEQ ID NO: 541489 - RNA, 19 nt, Homo sapiens
ggguagcaguucaacaauu

SEQ ID NO: 541490 - RNA, 19 nt, Homo sapiens
gaauaacaaguaaggaaga

SEQ ID NO: 541491 - RNA, 19 nt, Homo sapiens
gagaagccauaugagugua

SEQ ID NO: 541492 - RNA, 19 nt, Homo sapiens
ggaggaggaagaagaagaa

SEQ ID NO: 541493 - RNA, 19 nt, Homo sapiens
ggacaccacacaccagcua

SEQ ID NO: 541494 - RNA, 19 nt, Homo sapiens
gaaguggaauguggcuuuc

SEQ ID NO: 541495 - RNA, 19 nt, Homo sapiens
gcauuucagaggcuaauuu

SEQ ID NO: 541496 - RNA, 19 nt, Homo sapiens
ccauagaacccaucuuguu

SEQ ID NO: 541497 - RNA, 19 nt, Homo sapiens
ucagcucucuugccuuauu

SEQ ID NO: 541498 - RNA, 19 nt, Homo sapiens
uaaagaggcagagaauaaa

SEQ ID NO: 541499 - RNA, 19 nt, Homo sapiens
ccaagaaccuacaguuacu

SEQ ID NO: 541500 - RNA, 19 nt, Homo sapiens
agaagaagcuuuugaaaca

SEQ ID NO: 541501 - RNA, 19 nt, Homo sapiens
gaacucaggucgggcuucu

SEQ ID NO: 541502 - RNA, 19 nt, Homo sapiens
gagaagcccuaugaaugug

SEQ ID NO: 541503 - RNA, 19 nt, Homo sapiens
ucagacaagugauagugaa

SEQ ID NO: 541504 - RNA, 19 nt, Homo sapiens
caucauaucagaaagaauc

SEQ ID NO: 541505 - RNA, 19 nt, Homo sapiens
augaaggagucaaagaaua

SEQ ID NO: 541506 - RNA, 19 nt, Homo sapiens
cacaccagcuauauucauu

SEQ ID NO: 541507 - RNA, 19 nt, Homo sapiens
cauagaacccaucuuguug

SEQ ID NO: 541508 - RNA, 19 nt, Homo sapiens
gggaaaacauuuacuagga

SEQ ID NO: 541509 - RNA, 19 nt, Homo sapiens
gcgcccagcuauaggaguu

SEQ ID NO: 541510 - RNA, 19 nt, Homo sapiens
ugagggcuguguccuuaaa

SEQ ID NO: 541511 - RNA, 19 nt, Homo sapiens
cagcauuggucauaaccuu

SEQ ID NO: 541512 - RNA, 19 nt, Homo sapiens
acacuggacagaaaccuua

SEQ ID NO: 541513 - RNA, 19 nt, Homo sapiens
cuucucagcugcgcacaua

SEQ ID NO: 541514 - RNA, 19 nt, Homo sapiens
caccagcuauauucauuug

SEQ ID NO: 541515 - RNA, 19 nt, Homo sapiens
cagcagaagacacaagaaa

SEQ ID NO: 541516 - RNA, 19 nt, Homo sapiens
agugagggcuguguccuua

SEQ ID NO: 541517 - RNA, 19 nt, Homo sapiens
guggagaucuuccuuacgu

SEQ ID NO: 541518 - RNA, 19 nt, Homo sapiens
gaauucacacugcagagaa

SEQ ID NO: 541519 - RNA, 19 nt, Homo sapiens
gaaggagucaaagaauaaa

SEQ ID NO: 541520 - RNA, 19 nt, Homo sapiens
gaugaaggagucaaagaau

SEQ ID NO: 541521 - RNA, 19 nt, Homo sapiens
gaaugcagcagaagacaca

SEQ ID NO: 541522 - RNA, 19 nt, Homo sapiens
gcacauaggcaguacucau

SEQ ID NO: 541523 - RNA, 19 nt, Homo sapiens
ccagaaauguaagaaaucu

SEQ ID NO: 541524 - RNA, 19 nt, Homo sapiens
gcuguguccuuaaaaguua

SEQ ID NO: 541525 - RNA, 19 nt, Homo sapiens
gaaaagggaaacauguuaa

SEQ ID NO: 541526 - RNA, 19 nt, Homo sapiens
uagaacccaucuuguugaa

SEQ ID NO: 541527 - RNA, 19 nt, Homo sapiens
caagugcacuccgagaaca

SEQ ID NO: 541528 - RNA, 19 nt, Homo sapiens
ccugaaccuugguauugua

SEQ ID NO: 541529 - RNA, 19 nt, Homo sapiens
ggacuuuguuuuaacugua

SEQ ID NO: 541530 - RNA, 19 nt, Homo sapiens
cauuucagaggcuaauuua

SEQ ID NO: 541531 - RNA, 19 nt, Homo sapiens
caccauagaacccaucuug

SEQ ID NO: 541532 - RNA, 19 nt, Homo sapiens
ccauaugaguguaaagagu

SEQ ID NO: 541533 - RNA, 19 nt, Homo sapiens
uguaagaaaucuggaggaa

SEQ ID NO: 541534 - RNA, 19 nt, Homo sapiens
aaccaagaaccuacaguua

SEQ ID NO: 541535 - RNA, 19 nt, Homo sapiens
aaagcuaagugguaaugau

SEQ ID NO: 541536 - RNA, 19 nt, Homo sapiens
caaguaaggaagaggaaga

SEQ ID NO: 541537 - RNA, 19 nt, Homo sapiens
ugaaguggaauguggcuuu

SEQ ID NO: 541538 - RNA, 19 nt, Homo sapiens
gcacuccgagaacaucaaa

SEQ ID NO: 541539 - RNA, 19 nt, Homo sapiens
ggaaagaccuucuguagca

SEQ ID NO: 541540 - RNA, 19 nt, Homo sapiens
gagaaucaguuccuacuaa

SEQ ID NO: 541541 - RNA, 19 nt, Homo sapiens
ggagagagacguuauauau

SEQ ID NO: 541542 - RNA, 19 nt, Homo sapiens
caagaaagguagagaauca

SEQ ID NO: 541543 - RNA, 19 nt, Homo sapiens
gcucagaccuucuuaaaca

SEQ ID NO: 541544 - RNA, 19 nt, Homo sapiens
gcucaaaucucaccaaaca

SEQ ID NO: 541545 - RNA, 19 nt, Homo sapiens
ggaagaaacauuaagauug

SEQ ID NO: 541546 - RNA, 19 nt, Homo sapiens
ggagaagccuuaucagugu

SEQ ID NO: 541547 - RNA, 19 nt, Homo sapiens
gaacacaauugaaugagau

SEQ ID NO: 541548 - RNA, 19 nt, Homo sapiens
caagaaagguccgagauug

SEQ ID NO: 541549 - RNA, 19 nt, Homo sapiens
aguaauagcucaaaucuca

SEQ ID NO: 541550 - RNA, 19 nt, Homo sapiens
gagaagccauauaagugua

SEQ ID NO: 541551 - RNA, 19 nt, Homo sapiens
gguccgagauugcagauug

SEQ ID NO: 541552 - RNA, 19 nt, Homo sapiens
ggagaagcaccguaacuuu

SEQ ID NO: 541553 - RNA, 19 nt, Homo sapiens
gagagaagccauauaagug

SEQ ID NO: 541554 - RNA, 19 nt, Homo sapiens
agagagacguuauauaugu

SEQ ID NO: 541555 - RNA, 19 nt, Homo sapiens
ggagagaagccauauaagu

SEQ ID NO: 541556 - RNA, 19 nt, Homo sapiens
gagcucagaccuucuuaaa

SEQ ID NO: 541557 - RNA, 19 nt, Homo sapiens
ccauaucagugcaaagauu

SEQ ID NO: 541558 - RNA, 19 nt, Homo sapiens
ggaguucgcucaagaucca

SEQ ID NO: 541559 - RNA, 19 nt, Homo sapiens
gagaagccuuaucagugua

SEQ ID NO: 541560 - RNA, 19 nt, Homo sapiens
ggagaccagucacaaauac

SEQ ID NO: 541561 - RNA, 19 nt, Homo sapiens
cagaagaggcgccauauca

SEQ ID NO: 541562 - RNA, 19 nt, Homo sapiens
gagaagcaccguaacuuuc

SEQ ID NO: 541563 - RNA, 19 nt, Homo sapiens
gcguaaaccuugaaaauga

SEQ ID NO: 541564 - RNA, 19 nt, Homo sapiens
caaguccaaucuuuccaaa

SEQ ID NO: 541565 - RNA, 19 nt, Homo sapiens
gaaagaccuucuguagcaa

SEQ ID NO: 541566 - RNA, 19 nt, Homo sapiens
gaguuuacaugaugaccaa

SEQ ID NO: 541567 - RNA, 19 nt, Homo sapiens
gaacuggaaacccaaagga

SEQ ID NO: 541568 - RNA, 19 nt, Homo sapiens
agaaucaguuccuacuaaa

SEQ ID NO: 541569 - RNA, 19 nt, Homo sapiens
ccacagagucccaucuuug

SEQ ID NO: 541570 - RNA, 19 nt, Homo sapiens
uguagcaaguccaaucuuu

SEQ ID NO: 541571 - RNA, 19 nt, Homo sapiens
gagagacguuauauaugug

SEQ ID NO: 541572 - RNA, 19 nt, Homo sapiens
gagagagacguuauauaug

SEQ ID NO: 541573 - RNA, 19 nt, Homo sapiens
cgagauugcagauugagua

SEQ ID NO: 541574 - RNA, 19 nt, Homo sapiens
ugaacacaauugaaugaga

SEQ ID NO: 541575 - RNA, 19 nt, Homo sapiens
acacuuagggucccaguaa

SEQ ID NO: 541576 - RNA, 19 nt, Homo sapiens
ccggagagaagccauauaa

SEQ ID NO: 541577 - RNA, 19 nt, Homo sapiens
gaauugagccacauugaac

SEQ ID NO: 541578 - RNA, 19 nt, Homo sapiens
gcuccaacuucaauaaaca

SEQ ID NO: 541579 - RNA, 19 nt, Homo sapiens
gaagcaccguaacuuucaa

SEQ ID NO: 541580 - RNA, 19 nt, Homo sapiens
ucaauaaacaccacagaau

SEQ ID NO: 541581 - RNA, 19 nt, Homo sapiens
gaagaggcgccauaucagu

SEQ ID NO: 541582 - RNA, 19 nt, Homo sapiens
gaggcaggcuccaagaaag

SEQ ID NO: 541583 - RNA, 19 nt, Homo sapiens
caguuuggguaccaugaua

SEQ ID NO: 541584 - RNA, 19 nt, Homo sapiens
ugucaucacuguggaaaga

SEQ ID NO: 541585 - RNA, 19 nt, Homo sapiens
uagcucaaaucucaccaaa

SEQ ID NO: 541586 - RNA, 19 nt, Homo sapiens
gguagagaaucaguuccua

SEQ ID NO: 541587 - RNA, 19 nt, Homo sapiens
gaaagguagagaaucaguu

SEQ ID NO: 541588 - RNA, 19 nt, Homo sapiens
ccaagaaagguccgagauu

SEQ ID NO: 541589 - RNA, 19 nt, Homo sapiens
guaaagaauugagccacau

SEQ ID NO: 541590 - RNA, 19 nt, Homo sapiens
caauaaacaccacagaauc

SEQ ID NO: 541591 - RNA, 19 nt, Homo sapiens
ggucucaacuccuccaaac

SEQ ID NO: 541592 - RNA, 19 nt, Homo sapiens
cagcaucgauuccggugau

SEQ ID NO: 541593 - RNA, 19 nt, Homo sapiens
aaccacagcuccaacuuca

SEQ ID NO: 541594 - RNA, 19 nt, Homo sapiens
gcagagcucagaccuucuu

SEQ ID NO: 541595 - RNA, 19 nt, Homo sapiens
cuacuggugucaucacugu

SEQ ID NO: 541596 - RNA, 19 nt, Homo sapiens
ccacagcuccaacuucaau

SEQ ID NO: 541597 - RNA, 19 nt, Homo sapiens
gcagaugagcagaaagguu

SEQ ID NO: 541598 - RNA, 19 nt, Homo sapiens
acacagaagaggcgccaua

SEQ ID NO: 541599 - RNA, 19 nt, Homo sapiens
gcucaaaggggauauaauu

SEQ ID NO: 541600 - RNA, 19 nt, Homo sapiens
aguccaaucuuuccaaaca

SEQ ID NO: 541601 - RNA, 19 nt, Homo sapiens
gcaaguccaaucuuuccaa

SEQ ID NO: 541602 - RNA, 19 nt, Homo sapiens
uaacuuguggcccuaaaga

SEQ ID NO: 541603 - RNA, 19 nt, Homo sapiens
guggaaagaccuucuguag

SEQ ID NO: 541604 - RNA, 19 nt, Homo sapiens
gcacgaggaaucagcagau

SEQ ID NO: 541605 - RNA, 19 nt, Homo sapiens
cucaggaacugcaaaggaa

SEQ ID NO: 541606 - RNA, 19 nt, Homo sapiens
ucaaaucucaccaaacaca

SEQ ID NO: 541607 - RNA, 19 nt, Homo sapiens
uauccagucuaguuaagga

SEQ ID NO: 541608 - RNA, 19 nt, Homo sapiens
guuccacacucgccaguuc

SEQ ID NO: 541609 - RNA, 19 nt, Homo sapiens
cagaaggugucaggagguu

SEQ ID NO: 541610 - RNA, 19 nt, Homo sapiens
cgauuccggugauagaguu

SEQ ID NO: 541611 - RNA, 19 nt, Homo sapiens
uucaagcgcuccuguuguu

SEQ ID NO: 541612 - RNA, 19 nt, Homo sapiens
gggagaagcaccguaacuu

SEQ ID NO: 541613 - RNA, 19 nt, Homo sapiens
aaacccaaaggaacgaaua

SEQ ID NO: 541614 - RNA, 19 nt, Homo sapiens
ggcccgagauccacaccaa

SEQ ID NO: 541615 - RNA, 19 nt, Homo sapiens
uaaagaauugagccacauu

SEQ ID NO: 541616 - RNA, 19 nt, Homo sapiens
ccaagugugggaaagcuuu

SEQ ID NO: 541617 - RNA, 19 nt, Homo sapiens
ccaggagagagacguuaua

SEQ ID NO: 541618 - RNA, 19 nt, Homo sapiens
uuagagaggcagugcguaa

SEQ ID NO: 541619 - RNA, 19 nt, Homo sapiens
aaacacaggagaacacaca

SEQ ID NO: 541620 - RNA, 19 nt, Homo sapiens
agaaaccggugugggagaa

SEQ ID NO: 541621 - RNA, 19 nt, Homo sapiens
gaggcuguuucuggaguuu

SEQ ID NO: 541622 - RNA, 19 nt, Homo sapiens
gggauauaauuucugugau

SEQ ID NO: 541623 - RNA, 19 nt, Homo sapiens
caaccacagcuccaacuuc

SEQ ID NO: 541624 - RNA, 19 nt, Homo sapiens
cauaucagugcaaagauug

SEQ ID NO: 541625 - RNA, 19 nt, Homo sapiens
caagaggcaggcuccaaga

SEQ ID NO: 541626 - RNA, 19 nt, Homo sapiens
agagggagaagcaccguaa

SEQ ID NO: 541627 - RNA, 19 nt, Homo sapiens
aagaagagaaaggcaagua

SEQ ID NO: 541628 - RNA, 19 nt, Homo sapiens
aaagguagagaaucaguuc

SEQ ID NO: 541629 - RNA, 19 nt, Homo sapiens
ggcagugcguaaaccuuga

SEQ ID NO: 541630 - RNA, 19 nt, Homo sapiens
ggcugucacucuccucgaa

SEQ ID NO: 541631 - RNA, 19 nt, Homo sapiens
agaauugagccacauugaa

SEQ ID NO: 541632 - RNA, 19 nt, Homo sapiens
cgaggagaaagaagagaaa

SEQ ID NO: 541633 - RNA, 19 nt, Homo sapiens
ccagucuaguuaaggaaga

SEQ ID NO: 541634 - RNA, 19 nt, Homo sapiens
ccucagcucccaccagaga

SEQ ID NO: 541635 - RNA, 19 nt, Homo sapiens
cagccucauucgucacuau

SEQ ID NO: 541636 - RNA, 19 nt, Homo sapiens
gagaaugcacacagaagag

SEQ ID NO: 541637 - RNA, 19 nt, Homo sapiens
cagaccuucuuaaacauca

SEQ ID NO: 541638 - RNA, 19 nt, Homo sapiens
guccgagauugcagauuga

SEQ ID NO: 541639 - RNA, 19 nt, Homo sapiens
gaagaacuguggcaagaua

SEQ ID NO: 541640 - RNA, 19 nt, Homo sapiens
ggaagagccuuuagagaaa

SEQ ID NO: 541641 - RNA, 19 nt, Homo sapiens
gaucaaaucucauaacaca

SEQ ID NO: 541642 - RNA, 19 nt, Homo sapiens
gaucgaaucucauuaaaca

SEQ ID NO: 541643 - RNA, 19 nt, Homo sapiens
ggacaaaccucaccacaca

SEQ ID NO: 541644 - RNA, 19 nt, Homo sapiens
gagaaacccuauauaugua

SEQ ID NO: 541645 - RNA, 19 nt, Homo sapiens
caucagaaaucucauauug

SEQ ID NO: 541646 - RNA, 19 nt, Homo sapiens
gaaagacacuaugaaugua

SEQ ID NO: 541647 - RNA, 19 nt, Homo sapiens
gaucagaccucuuuagaca

SEQ ID NO: 541648 - RNA, 19 nt, Homo sapiens
ggaaaugcuucacuaagaa

SEQ ID NO: 541649 - RNA, 19 nt, Homo sapiens
ggaaauccuucacuaagaa

SEQ ID NO: 541650 - RNA, 19 nt, Homo sapiens
ggaaaggucuucacucaca

SEQ ID NO: 541651 - RNA, 19 nt, Homo sapiens
gaacucagaccucaguaua

SEQ ID NO: 541652 - RNA, 19 nt, Homo sapiens
gaacaugaccacuaugaaa

SEQ ID NO: 541653 - RNA, 19 nt, Homo sapiens
guaaugggcuucacucaga

SEQ ID NO: 541654 - RNA, 19 nt, Homo sapiens
ggagaaacccuaugaaugu

SEQ ID NO: 541655 - RNA, 19 nt, Homo sapiens
gggaaaugcuucacuaaga

SEQ ID NO: 541656 - RNA, 19 nt, Homo sapiens
ggagagaaacccuauauau

SEQ ID NO: 541657 - RNA, 19 nt, Homo sapiens
caauauaugugcugaaugu

SEQ ID NO: 541658 - RNA, 19 nt, Homo sapiens
gagagaagccuuaugaaug

SEQ ID NO: 541659 - RNA, 19 nt, Homo sapiens
gagauuugaucaacccaua

SEQ ID NO: 541660 - RNA, 19 nt, Homo sapiens
ucagaaaucucauauugga

SEQ ID NO: 541661 - RNA, 19 nt, Homo sapiens
aaagaaaccuuaugcuugu

SEQ ID NO: 541662 - RNA, 19 nt, Homo sapiens
gaagucacgccucaauaua

SEQ ID NO: 541663 - RNA, 19 nt, Homo sapiens
ggaaagccuucauccagaa

SEQ ID NO: 541664 - RNA, 19 nt, Homo sapiens
ggagagaaaccuuauguau

SEQ ID NO: 541665 - RNA, 19 nt, Homo sapiens
gggaaauccuucacuaaga

SEQ ID NO: 541666 - RNA, 19 nt, Homo sapiens
caacacacaucagagaauu

SEQ ID NO: 541667 - RNA, 19 nt, Homo sapiens
ggagaagauucauuauguu

SEQ ID NO: 541668 - RNA, 19 nt, Homo sapiens
cauaggagaagauucauua

SEQ ID NO: 541669 - RNA, 19 nt, Homo sapiens
ggaaagaaaccuuaugcuu

SEQ ID NO: 541670 - RNA, 19 nt, Homo sapiens
gagagaaacccuauauaug

SEQ ID NO: 541671 - RNA, 19 nt, Homo sapiens
gaaacacuaugaaugcaau

SEQ ID NO: 541672 - RNA, 19 nt, Homo sapiens
gaagcauacuuuaaacuca

SEQ ID NO: 541673 - RNA, 19 nt, Homo sapiens
gcaaauuccugugaacaug

SEQ ID NO: 541674 - RNA, 19 nt, Homo sapiens
ugagugaacugaaggcaaa

SEQ ID NO: 541675 - RNA, 19 nt, Homo sapiens
gagagaaacccuauaagug

SEQ ID NO: 541676 - RNA, 19 nt, Homo sapiens
gcaagauaaugaccagcua

SEQ ID NO: 541677 - RNA, 19 nt, Homo sapiens
ggaagucacgccucaauau

SEQ ID NO: 541678 - RNA, 19 nt, Homo sapiens
ggagaaagacacuaugaau

SEQ ID NO: 541679 - RNA, 19 nt, Homo sapiens
ggaaggccuuuauccagaa

SEQ ID NO: 541680 - RNA, 19 nt, Homo sapiens
ccagucaaaucucauuaaa

SEQ ID NO: 541681 - RNA, 19 nt, Homo sapiens
gcagaaacccuacaaaugc

SEQ ID NO: 541682 - RNA, 19 nt, Homo sapiens
aaucaaaccucauuacaca

SEQ ID NO: 541683 - RNA, 19 nt, Homo sapiens
gagagaaaccuuauguaug

SEQ ID NO: 541684 - RNA, 19 nt, Homo sapiens
ggagaagcuuuaugugugu

SEQ ID NO: 541685 - RNA, 19 nt, Homo sapiens
ggacgugacuguggacuuc

SEQ ID NO: 541686 - RNA, 19 nt, Homo sapiens
gagcgaaagucauguuugg

SEQ ID NO: 541687 - RNA, 19 nt, Homo sapiens
ggagagaagccuuaugaau

SEQ ID NO: 541688 - RNA, 19 nt, Homo sapiens
ggagagaaacccuauaagu

SEQ ID NO: 541689 - RNA, 19 nt, Homo sapiens
gagaauucaugcuggagaa

SEQ ID NO: 541690 - RNA, 19 nt, Homo sapiens
caucagaagucucauacug

SEQ ID NO: 541691 - RNA, 19 nt, Homo sapiens
ggagagagacacuaugaau

SEQ ID NO: 541692 - RNA, 19 nt, Homo sapiens
guggaaaggucuucacuca

SEQ ID NO: 541693 - RNA, 19 nt, Homo sapiens
agagaaaccuuauguaugc

SEQ ID NO: 541694 - RNA, 19 nt, Homo sapiens
gagagaaacacuaugaaug

SEQ ID NO: 541695 - RNA, 19 nt, Homo sapiens
cagcauauccugggacaua

SEQ ID NO: 541696 - RNA, 19 nt, Homo sapiens
ccagaaaucgcacuucauu

SEQ ID NO: 541697 - RNA, 19 nt, Homo sapiens
gggaaggcuuucacaagaa

SEQ ID NO: 541698 - RNA, 19 nt, Homo sapiens
guacugggaugugacacua

SEQ ID NO: 541699 - RNA, 19 nt, Homo sapiens
gagaaagacacuaugaaug

SEQ ID NO: 541700 - RNA, 19 nt, Homo sapiens
uagaagaacuguggcaaga

SEQ ID NO: 541701 - RNA, 19 nt, Homo sapiens
cagaaggccuuuacugaca

SEQ ID NO: 541702 - RNA, 19 nt, Homo sapiens
cagaaagccacacuaagua

SEQ ID NO: 541703 - RNA, 19 nt, Homo sapiens
ggaaaagccuucauaugga

SEQ ID NO: 541704 - RNA, 19 nt, Homo sapiens
agagaaacccuauauaugu

SEQ ID NO: 541705 - RNA, 19 nt, Homo sapiens
ggugagaagcccaauauau

SEQ ID NO: 541706 - RNA, 19 nt, Homo sapiens
aggagaagauucauuaugu

SEQ ID NO: 541707 - RNA, 19 nt, Homo sapiens
gggagaaacccuaugaaug

SEQ ID NO: 541708 - RNA, 19 nt, Homo sapiens
gugagaagcccaauauaug

SEQ ID NO: 541709 - RNA, 19 nt, Homo sapiens
gaaaagccuucauauggaa

SEQ ID NO: 541710 - RNA, 19 nt, Homo sapiens
gaaaaugcauaguggagaa

SEQ ID NO: 541711 - RNA, 19 nt, Homo sapiens
guaaaugugggaaagcuuu

SEQ ID NO: 541712 - RNA, 19 nt, Homo sapiens
agaaagacacuaugaaugu

SEQ ID NO: 541713 - RNA, 19 nt, Homo sapiens
gagaauucauacuggagaa

SEQ ID NO: 541714 - RNA, 19 nt, Homo sapiens
ggagagaaacacuaugaau

SEQ ID NO: 541715 - RNA, 19 nt, Homo sapiens
gagaauucauacaggagaa

SEQ ID NO: 541716 - RNA, 19 nt, Homo sapiens
gagaucagaccucuuuaga

SEQ ID NO: 541717 - RNA, 19 nt, Homo sapiens
ccagaaagccacacuaagu

SEQ ID NO: 541718 - RNA, 19 nt, Homo sapiens
gagaaaagccguaugaaug

SEQ ID NO: 541719 - RNA, 19 nt, Homo sapiens
gaaacagugcaacaaagaa

SEQ ID NO: 541720 - RNA, 19 nt, Homo sapiens
guaccaaauucccaaguca

SEQ ID NO: 541721 - RNA, 19 nt, Homo sapiens
cgucaucucuuaugcuuca

SEQ ID NO: 541722 - RNA, 19 nt, Homo sapiens
caucagguaucuaauagca

SEQ ID NO: 541723 - RNA, 19 nt, Homo sapiens
ggaaaucacaacuggguau

SEQ ID NO: 541724 - RNA, 19 nt, Homo sapiens
gagaaacccuaugaaugug

SEQ ID NO: 541725 - RNA, 19 nt, Homo sapiens
gaaggccuuuauccagaaa

SEQ ID NO: 541726 - RNA, 19 nt, Homo sapiens
ugggaaggcuuucacaaga

SEQ ID NO: 541727 - RNA, 19 nt, Homo sapiens
gaggagaagcuuuaugugu

SEQ ID NO: 541728 - RNA, 19 nt, Homo sapiens
ggcagaaacccuacaaaug

SEQ ID NO: 541729 - RNA, 19 nt, Homo sapiens
guacauccaaguguuuaua

SEQ ID NO: 541730 - RNA, 19 nt, Homo sapiens
caguguauaugcaauucua

SEQ ID NO: 541731 - RNA, 19 nt, Homo sapiens
ccaugugcaucaaagaauu

SEQ ID NO: 541732 - RNA, 19 nt, Homo sapiens
gcacucaggaugcaucaga

SEQ ID NO: 541733 - RNA, 19 nt, Homo sapiens
gcgugaacauggcagcuaa

SEQ ID NO: 541734 - RNA, 19 nt, Homo sapiens
gagaagauucauuauguuc

SEQ ID NO: 541735 - RNA, 19 nt, Homo sapiens
gaaagcauuugagcgaaag

SEQ ID NO: 541736 - RNA, 19 nt, Homo sapiens
agaaagcauuugagcgaaa

SEQ ID NO: 541737 - RNA, 19 nt, Homo sapiens
cuaaguaugcaucagauaa

SEQ ID NO: 541738 - RNA, 19 nt, Homo sapiens
gagcugacacuaagcaugu

SEQ ID NO: 541739 - RNA, 19 nt, Homo sapiens
gaagaacuguggcaagaua

SEQ ID NO: 541740 - RNA, 19 nt, Homo sapiens
ggaagagccuuuagagaaa

SEQ ID NO: 541741 - RNA, 19 nt, Homo sapiens
gaucaaaucucauaacaca

SEQ ID NO: 541742 - RNA, 19 nt, Homo sapiens
gaucgaaucucauuaaaca

SEQ ID NO: 541743 - RNA, 19 nt, Homo sapiens
ggacaaaccucaccacaca

SEQ ID NO: 541744 - RNA, 19 nt, Homo sapiens
gagaaacccuauauaugua

SEQ ID NO: 541745 - RNA, 19 nt, Homo sapiens
caucagaaaucucauauug

SEQ ID NO: 541746 - RNA, 19 nt, Homo sapiens
gaaagacacuaugaaugua

SEQ ID NO: 541747 - RNA, 19 nt, Homo sapiens
gaucagaccucuuuagaca

SEQ ID NO: 541748 - RNA, 19 nt, Homo sapiens
ggaaaugcuucacuaagaa

SEQ ID NO: 541749 - RNA, 19 nt, Homo sapiens
ggaaauccuucacuaagaa

SEQ ID NO: 541750 - RNA, 19 nt, Homo sapiens
ggaaaggucuucacucaca

SEQ ID NO: 541751 - RNA, 19 nt, Homo sapiens
gaacucagaccucaguaua

SEQ ID NO: 541752 - RNA, 19 nt, Homo sapiens
gaacaugaccacuaugaaa

SEQ ID NO: 541753 - RNA, 19 nt, Homo sapiens
guaaugggcuucacucaga

SEQ ID NO: 541754 - RNA, 19 nt, Homo sapiens
ggagaaacccuaugaaugu

SEQ ID NO: 541755 - RNA, 19 nt, Homo sapiens
gggaaaugcuucacuaaga

SEQ ID NO: 541756 - RNA, 19 nt, Homo sapiens
ggagagaaacccuauauau

SEQ ID NO: 541757 - RNA, 19 nt, Homo sapiens
caauauaugugcugaaugu

SEQ ID NO: 541758 - RNA, 19 nt, Homo sapiens
gagagaagccuuaugaaug

SEQ ID NO: 541759 - RNA, 19 nt, Homo sapiens
gagauuugaucaacccaua

SEQ ID NO: 541760 - RNA, 19 nt, Homo sapiens
ucagaaaucucauauugga

SEQ ID NO: 541761 - RNA, 19 nt, Homo sapiens
aaagaaaccuuaugcuugu

SEQ ID NO: 541762 - RNA, 19 nt, Homo sapiens
gaagucacgccucaauaua

SEQ ID NO: 541763 - RNA, 19 nt, Homo sapiens
ggaaagccuucauccagaa

SEQ ID NO: 541764 - RNA, 19 nt, Homo sapiens
ggagagaaaccuuauguau

SEQ ID NO: 541765 - RNA, 19 nt, Homo sapiens
gagagucacugaaggaaau

SEQ ID NO: 541766 - RNA, 19 nt, Homo sapiens
gggaaauccuucacuaaga

SEQ ID NO: 541767 - RNA, 19 nt, Homo sapiens
caacacacaucagagaauu

SEQ ID NO: 541768 - RNA, 19 nt, Homo sapiens
ggagaagauucauuauguu

SEQ ID NO: 541769 - RNA, 19 nt, Homo sapiens
cauaggagaagauucauua

SEQ ID NO: 541770 - RNA, 19 nt, Homo sapiens
ggaaagaaaccuuaugcuu

SEQ ID NO: 541771 - RNA, 19 nt, Homo sapiens
gagagaaacccuauauaug

SEQ ID NO: 541772 - RNA, 19 nt, Homo sapiens
gaaacacuaugaaugcaau

SEQ ID NO: 541773 - RNA, 19 nt, Homo sapiens
gaagcauacuuuaaacuca

SEQ ID NO: 541774 - RNA, 19 nt, Homo sapiens
gcaaauuccugugaacaug

SEQ ID NO: 541775 - RNA, 19 nt, Homo sapiens
ugagugaacugaaggcaaa

SEQ ID NO: 541776 - RNA, 19 nt, Homo sapiens
gagagaaacccuauaagug

SEQ ID NO: 541777 - RNA, 19 nt, Homo sapiens
gcaagauaaugaccagcua

SEQ ID NO: 541778 - RNA, 19 nt, Homo sapiens
ggaagucacgccucaauau

SEQ ID NO: 541779 - RNA, 19 nt, Homo sapiens
gaaaugaccgcccuuccaa

SEQ ID NO: 541780 - RNA, 19 nt, Homo sapiens
ggagaaagacacuaugaau

SEQ ID NO: 541781 - RNA, 19 nt, Homo sapiens
ggaaggccuuuauccagaa

SEQ ID NO: 541782 - RNA, 19 nt, Homo sapiens
ccagucaaaucucauuaaa

SEQ ID NO: 541783 - RNA, 19 nt, Homo sapiens
gcagaaacccuacaaaugc

SEQ ID NO: 541784 - RNA, 19 nt, Homo sapiens
aaucaaaccucauuacaca

SEQ ID NO: 541785 - RNA, 19 nt, Homo sapiens
gagagaaaccuuauguaug

SEQ ID NO: 541786 - RNA, 19 nt, Homo sapiens
ggagaagcuuuaugugugu

SEQ ID NO: 541787 - RNA, 19 nt, Homo sapiens
ggacgugacuguggacuuc

SEQ ID NO: 541788 - RNA, 19 nt, Homo sapiens
gagcgaaagucauguuugg

SEQ ID NO: 541789 - RNA, 19 nt, Homo sapiens
ggagagaagccuuaugaau

SEQ ID NO: 541790 - RNA, 19 nt, Homo sapiens
ggagaagccuggugguaca

SEQ ID NO: 541791 - RNA, 19 nt, Homo sapiens
ggagagaaacccuauaagu

SEQ ID NO: 541792 - RNA, 19 nt, Homo sapiens
gagaauucaugcuggagaa

SEQ ID NO: 541793 - RNA, 19 nt, Homo sapiens
caucagaagucucauacug

SEQ ID NO: 541794 - RNA, 19 nt, Homo sapiens
ggagagagacacuaugaau

SEQ ID NO: 541795 - RNA, 19 nt, Homo sapiens
guggaaaggucuucacuca

SEQ ID NO: 541796 - RNA, 19 nt, Homo sapiens
agagaaaccuuauguaugc

SEQ ID NO: 541797 - RNA, 19 nt, Homo sapiens
gagagaaacacuaugaaug

SEQ ID NO: 541798 - RNA, 19 nt, Homo sapiens
cagcauauccugggacaua

SEQ ID NO: 541799 - RNA, 19 nt, Homo sapiens
ccagaaaucgcacuucauu

SEQ ID NO: 541800 - RNA, 19 nt, Homo sapiens
gggaaggcuuucacaagaa

SEQ ID NO: 541801 - RNA, 19 nt, Homo sapiens
guacugggaugugacacua

SEQ ID NO: 541802 - RNA, 19 nt, Homo sapiens
gagaaagacacuaugaaug

SEQ ID NO: 541803 - RNA, 19 nt, Homo sapiens
uagaagaacuguggcaaga

SEQ ID NO: 541804 - RNA, 19 nt, Homo sapiens
cagaaggccuuuacugaca

SEQ ID NO: 541805 - RNA, 19 nt, Homo sapiens
cagaaagccacacuaagua

SEQ ID NO: 541806 - RNA, 19 nt, Homo sapiens
ggaaaagccuucauaugga

SEQ ID NO: 541807 - RNA, 19 nt, Homo sapiens
agagaaacccuauauaugu

SEQ ID NO: 541808 - RNA, 19 nt, Homo sapiens
ggugagaagcccaauauau

SEQ ID NO: 541809 - RNA, 19 nt, Homo sapiens
aggagaagauucauuaugu

SEQ ID NO: 541810 - RNA, 19 nt, Homo sapiens
gggagaaacccuaugaaug

SEQ ID NO: 541811 - RNA, 19 nt, Homo sapiens
gugagaagcccaauauaug

SEQ ID NO: 541812 - RNA, 19 nt, Homo sapiens
gaaaagccuucauauggaa

SEQ ID NO: 541813 - RNA, 19 nt, Homo sapiens
gaaaaugcauaguggagaa

SEQ ID NO: 541814 - RNA, 19 nt, Homo sapiens
guaaaugugggaaagcuuu

SEQ ID NO: 541815 - RNA, 19 nt, Homo sapiens
agaaagacacuaugaaugu

SEQ ID NO: 541816 - RNA, 19 nt, Homo sapiens
gagaauucauacuggagaa

SEQ ID NO: 541817 - RNA, 19 nt, Homo sapiens
ggagagaaacacuaugaau

SEQ ID NO: 541818 - RNA, 19 nt, Homo sapiens
gagaauucauacaggagaa

SEQ ID NO: 541819 - RNA, 19 nt, Homo sapiens
gagaucagaccucuuuaga

SEQ ID NO: 541820 - RNA, 19 nt, Homo sapiens
ccagaaagccacacuaagu

SEQ ID NO: 541821 - RNA, 19 nt, Homo sapiens
gagaaaagccguaugaaug

SEQ ID NO: 541822 - RNA, 19 nt, Homo sapiens
gaaacagugcaacaaagaa

SEQ ID NO: 541823 - RNA, 19 nt, Homo sapiens
guaccaaauucccaaguca

SEQ ID NO: 541824 - RNA, 19 nt, Homo sapiens
cgucaucucuuaugcuuca

SEQ ID NO: 541825 - RNA, 19 nt, Homo sapiens
caucagguaucuaauagca

SEQ ID NO: 541826 - RNA, 19 nt, Homo sapiens
ggaaaucacaacuggguau

SEQ ID NO: 541827 - RNA, 19 nt, Homo sapiens
gagaaacccuaugaaugug

SEQ ID NO: 541828 - RNA, 19 nt, Homo sapiens
gaaggccuuuauccagaaa

SEQ ID NO: 541829 - RNA, 19 nt, Homo sapiens
ugggaaggcuuucacaaga

SEQ ID NO: 541830 - RNA, 19 nt, Homo sapiens
gaggagaagcuuuaugugu

SEQ ID NO: 541831 - RNA, 19 nt, Homo sapiens
ggcagaaacccuacaaaug

SEQ ID NO: 541832 - RNA, 19 nt, Homo sapiens
guacauccaaguguuuaua

SEQ ID NO: 541833 - RNA, 19 nt, Homo sapiens
caguguauaugcaauucua

SEQ ID NO: 541834 - RNA, 19 nt, Homo sapiens
gagugaacguggagugaug

SEQ ID NO: 541835 - RNA, 19 nt, Homo sapiens
ccaugugcaucaaagaauu

SEQ ID NO: 541836 - RNA, 19 nt, Homo sapiens
gcacucaggaugcaucaga

SEQ ID NO: 541837 - RNA, 19 nt, Homo sapiens
gagaagauucauuauguuc

SEQ ID NO: 541838 - RNA, 19 nt, Homo sapiens
gcgugaacauggcagcuaa

SEQ ID NO: 541839 - RNA, 19 nt, Homo sapiens
ggaaauggcagaugaguuc

SEQ ID NO: 541840 - RNA, 19 nt, Homo sapiens
gcuggguucugucucauua

SEQ ID NO: 541841 - RNA, 19 nt, Homo sapiens
ccacagacaucacaagcaa

SEQ ID NO: 541842 - RNA, 19 nt, Homo sapiens
ccacuucucuccucuguag

SEQ ID NO: 541843 - RNA, 19 nt, Homo sapiens
gacuuucucucaccacuaa

SEQ ID NO: 541844 - RNA, 19 nt, Homo sapiens
gauauaagcauuagcuaca

SEQ ID NO: 541845 - RNA, 19 nt, Homo sapiens
uacuguagguguccaauaa

SEQ ID NO: 541846 - RNA, 19 nt, Homo sapiens
gaggagauggaguguauuu

SEQ ID NO: 541847 - RNA, 19 nt, Homo sapiens
ggagauggaguguauuuua

SEQ ID NO: 541848 - RNA, 19 nt, Homo sapiens
ucucagucuucuugauuua

SEQ ID NO: 541849 - RNA, 19 nt, Homo sapiens
gagguuauugaucuucuua

SEQ ID NO: 541850 - RNA, 19 nt, Homo sapiens
cagaugaguucagcccuaa

SEQ ID NO: 541851 - RNA, 19 nt, Homo sapiens
ccaauaaacaguagaugga

SEQ ID NO: 541852 - RNA, 19 nt, Homo sapiens
gcugauuuccuuugaugua

SEQ ID NO: 541853 - RNA, 19 nt, Homo sapiens
ccagcgaucugaggaguga

SEQ ID NO: 541854 - RNA, 19 nt, Homo sapiens
gcagguccagguaguguaa

SEQ ID NO: 541855 - RNA, 19 nt, Homo sapiens
ucuaugagguuauugaucu

SEQ ID NO: 541856 - RNA, 19 nt, Homo sapiens
aggaggagauggaguguau

SEQ ID NO: 541857 - RNA, 19 nt, Homo sapiens
ccaugugucuaugagguua

SEQ ID NO: 541858 - RNA, 19 nt, Homo sapiens
cggcauggcuggccuuucu

SEQ ID NO: 541859 - RNA, 19 nt, Homo sapiens
ggcgauuacauaaguauaa

SEQ ID NO: 541860 - RNA, 19 nt, Homo sapiens
guguggaaauggcagauga

SEQ ID NO: 541861 - RNA, 19 nt, Homo sapiens
gagauggaguguauuuuau

SEQ ID NO: 541862 - RNA, 19 nt, Homo sapiens
gcucuuuacuuaggagguu

SEQ ID NO: 541863 - RNA, 19 nt, Homo sapiens
gaggcuggcgauuacauaa

SEQ ID NO: 541864 - RNA, 19 nt, Homo sapiens
caauacauaggaacacuug

SEQ ID NO: 541865 - RNA, 19 nt, Homo sapiens
gcuggugccuccuccuuca

SEQ ID NO: 541866 - RNA, 19 nt, Homo sapiens
gauuuccuuugauguauuc

SEQ ID NO: 541867 - RNA, 19 nt, Homo sapiens
ccacuucccugcauuugcu

SEQ ID NO: 541868 - RNA, 19 nt, Homo sapiens
gcagucaggguguggaaau

SEQ ID NO: 541869 - RNA, 19 nt, Homo sapiens
gcgauuacauaaguauaag

SEQ ID NO: 541870 - RNA, 19 nt, Homo sapiens
caagcaaggcacauccaaa

SEQ ID NO: 541871 - RNA, 19 nt, Homo sapiens
gcuggcgauuacauaagua

SEQ ID NO: 541872 - RNA, 19 nt, Homo sapiens
ggacuuucucucaccacua

SEQ ID NO: 541873 - RNA, 19 nt, Homo sapiens
ccuuugauguauucuaguu

SEQ ID NO: 541874 - RNA, 19 nt, Homo sapiens
gaguguauuuuaugggaua

SEQ ID NO: 541875 - RNA, 19 nt, Homo sapiens
caauaaacaguagauggaa

SEQ ID NO: 541876 - RNA, 19 nt, Homo sapiens
ccacccacuucccugcauu

SEQ ID NO: 541877 - RNA, 19 nt, Homo sapiens
gguuugccauuuguccuuu

SEQ ID NO: 541878 - RNA, 19 nt, Homo sapiens
uacauuuccuguccuguuc

SEQ ID NO: 541879 - RNA, 19 nt, Homo sapiens
ggcuggcgauuacauaagu

SEQ ID NO: 541880 - RNA, 19 nt, Homo sapiens
aaucagacuagaaagcuuu

SEQ ID NO: 541881 - RNA, 19 nt, Homo sapiens
gguuauugaucuucuuacu

SEQ ID NO: 541882 - RNA, 19 nt, Homo sapiens
cuacauuuccuguccuguu

SEQ ID NO: 541883 - RNA, 19 nt, Homo sapiens
ggugggcauucugucauga

SEQ ID NO: 541884 - RNA, 19 nt, Homo sapiens
gaccaucauuuuccaccua

SEQ ID NO: 541885 - RNA, 19 nt, Homo sapiens
uugcugauuuccuuugaug

SEQ ID NO: 541886 - RNA, 19 nt, Homo sapiens
ugaggcuggcgauuacaua

SEQ ID NO: 541887 - RNA, 19 nt, Homo sapiens
aaaucagacuagaaagcuu

SEQ ID NO: 541888 - RNA, 19 nt, Homo sapiens
gagguuaauuagccuuuug

SEQ ID NO: 541889 - RNA, 19 nt, Homo sapiens
gguguccaauaaacaguag

SEQ ID NO: 541890 - RNA, 19 nt, Homo sapiens
ccauguguaugcccuagag

SEQ ID NO: 541891 - RNA, 19 nt, Homo sapiens
gggauauaagcauuagcua

SEQ ID NO: 541892 - RNA, 19 nt, Homo sapiens
ucucucagucuucuugauu

SEQ ID NO: 541893 - RNA, 19 nt, Homo sapiens
cugauuuccuuugauguau

SEQ ID NO: 541894 - RNA, 19 nt, Homo sapiens
uaaaucagacuagaaagcu

SEQ ID NO: 541895 - RNA, 19 nt, Homo sapiens
gaaauggcagaugaguuca

SEQ ID NO: 541896 - RNA, 19 nt, Homo sapiens
cgagugcggccagagcuuu

SEQ ID NO: 541897 - RNA, 19 nt, Homo sapiens
cuucucuccucuguagaua

SEQ ID NO: 541898 - RNA, 19 nt, Homo sapiens
uaugggauauaagcauuag

SEQ ID NO: 541899 - RNA, 19 nt, Homo sapiens
cugccucuuuggucaguuu

SEQ ID NO: 541900 - RNA, 19 nt, Homo sapiens
ccugcacccucuuucuguu

SEQ ID NO: 541901 - RNA, 19 nt, Homo sapiens
gccaauacauaggaacacu

SEQ ID NO: 541902 - RNA, 19 nt, Homo sapiens
ucagucuucuugauuuaac

SEQ ID NO: 541903 - RNA, 19 nt, Homo sapiens
ugagguuauugaucuucuu

SEQ ID NO: 541904 - RNA, 19 nt, Homo sapiens
guagguguccaauaaacag

SEQ ID NO: 541905 - RNA, 19 nt, Homo sapiens
caucagggaagucuguaca

SEQ ID NO: 541906 - RNA, 19 nt, Homo sapiens
cgacuuauggacuuucucu

SEQ ID NO: 541907 - RNA, 19 nt, Homo sapiens
gcaaagcuuucaaccaaua

SEQ ID NO: 541908 - RNA, 19 nt, Homo sapiens
guacaaaugugaagaaugu

SEQ ID NO: 541909 - RNA, 19 nt, Homo sapiens
gauacaaacucuacaaaug

SEQ ID NO: 541910 - RNA, 19 nt, Homo sapiens
gcaaagcauuuaacuauuc

SEQ ID NO: 541911 - RNA, 19 nt, Homo sapiens
caaagaauguggcaaauca

SEQ ID NO: 541912 - RNA, 19 nt, Homo sapiens
gaggagacaugaaauggua

SEQ ID NO: 541913 - RNA, 19 nt, Homo sapiens
gcaccuagaugacguguga

SEQ ID NO: 541914 - RNA, 19 nt, Homo sapiens
gcucauaucuuacucaaca

SEQ ID NO: 541915 - RNA, 19 nt, Homo sapiens
ggagaaacccuacaaaugu

SEQ ID NO: 541916 - RNA, 19 nt, Homo sapiens
agagaaaccuuacaaaugu

SEQ ID NO: 541917 - RNA, 19 nt, Homo sapiens
cuacaaaugugaagaaugu

SEQ ID NO: 541918 - RNA, 19 nt, Homo sapiens
cuacaaaugugaagaaugu

SEQ ID NO: 541919 - RNA, 19 nt, Homo sapiens
cuacaaaugugaagaaugu

SEQ ID NO: 541920 - RNA, 19 nt, Homo sapiens
cuacaaaugugaagaaugu

SEQ ID NO: 541921 - RNA, 19 nt, Homo sapiens
cuacaaaugugaagaaugu

SEQ ID NO: 541922 - RNA, 19 nt, Homo sapiens
cuacaaaugugaagaaugu

SEQ ID NO: 541923 - RNA, 19 nt, Homo sapiens
cuacaaaugugaagaaugu

SEQ ID NO: 541924 - RNA, 19 nt, Homo sapiens
cuacaaaugugaaguaugu

SEQ ID NO: 541925 - RNA, 19 nt, Homo sapiens
cuacaaaugugaagaaugu

SEQ ID NO: 541926 - RNA, 19 nt, Homo sapiens
cuacaaaugugaagaaugu

SEQ ID NO: 541927 - RNA, 19 nt, Homo sapiens
gagagaaaccuuacaaaug

SEQ ID NO: 541928 - RNA, 19 nt, Homo sapiens
cuacaaaugugaagaaugu

SEQ ID NO: 541929 - RNA, 19 nt, Homo sapiens
ggaaugugauguuagagaa

SEQ ID NO: 541930 - RNA, 19 nt, Homo sapiens
cagaugggauugugacaua

SEQ ID NO: 541931 - RNA, 19 nt, Homo sapiens
gagagaaacccuacaaaug

SEQ ID NO: 541932 - RNA, 19 nt, Homo sapiens
gagagaaacccuacaaaug

SEQ ID NO: 541933 - RNA, 19 nt, Homo sapiens
gagagaaacccuacaaaug

SEQ ID NO: 541934 - RNA, 19 nt, Homo sapiens
gagagaaacccuacaaaug

SEQ ID NO: 541935 - RNA, 19 nt, Homo sapiens
ccucaaagcuuacugaaca

SEQ ID NO: 541936 - RNA, 19 nt, Homo sapiens
ccucaaaccuuacuaaaca

SEQ ID NO: 541937 - RNA, 19 nt, Homo sapiens
ccucaaagcuuacugaaca

SEQ ID NO: 541938 - RNA, 19 nt, Homo sapiens
ccucaaaccuuacuaaaca

SEQ ID NO: 541939 - RNA, 19 nt, Homo sapiens
cuacaaaccugaagaugug

SEQ ID NO: 541940 - RNA, 19 nt, Homo sapiens
ccaguuauguguucucauu

SEQ ID NO: 541941 - RNA, 19 nt, Homo sapiens
ugacaacaccucaaacuuu

SEQ ID NO: 541942 - RNA, 19 nt, Homo sapiens
gcacagaggagguuauaau

SEQ ID NO: 541943 - RNA, 19 nt, Homo sapiens
caaccaauauucaaaccuu

SEQ ID NO: 541944 - RNA, 19 nt, Homo sapiens
uggcaaagcuuucaaccaa

SEQ ID NO: 541945 - RNA, 19 nt, Homo sapiens
gagaaacccuacaaaugug

SEQ ID NO: 541946 - RNA, 19 nt, Homo sapiens
gagaaacccuacaaaugug

SEQ ID NO: 541947 - RNA, 19 nt, Homo sapiens
gagaaacccuacaaaugug

SEQ ID NO: 541948 - RNA, 19 nt, Homo sapiens
gagaaacccuacaaaugug

SEQ ID NO: 541949 - RNA, 19 nt, Homo sapiens
gagaaacccuacaaaugug

SEQ ID NO: 541950 - RNA, 19 nt, Homo sapiens
gcacagcagaauuuauaua

SEQ ID NO: 541951 - RNA, 19 nt, Homo sapiens
aaagaaacccuacaaaugu

SEQ ID NO: 541952 - RNA, 19 nt, Homo sapiens
aaagaaacccuacaaaugu

SEQ ID NO: 541953 - RNA, 19 nt, Homo sapiens
cagcagaauuuauauagga

SEQ ID NO: 541954 - RNA, 19 nt, Homo sapiens
ggagagaaaccuuacaaau

SEQ ID NO: 541955 - RNA, 19 nt, Homo sapiens
uaacugcccuucaaucauc

SEQ ID NO: 541956 - RNA, 19 nt, Homo sapiens
cagggaccauugacauuua

SEQ ID NO: 541957 - RNA, 19 nt, Homo sapiens
gagcaacccuacaaaugug

SEQ ID NO: 541958 - RNA, 19 nt, Homo sapiens
gagagaaacccuacaagug

SEQ ID NO: 541959 - RNA, 19 nt, Homo sapiens
gagaaacccuacacaugug

SEQ ID NO: 541960 - RNA, 19 nt, Homo sapiens
gagagaaacccuacacaug

SEQ ID NO: 541961 - RNA, 19 nt, Homo sapiens
gagaaacccuacacaugug

SEQ ID NO: 541962 - RNA, 19 nt, Homo sapiens
gagagaaacccuacacaug

SEQ ID NO: 541963 - RNA, 19 nt, Homo sapiens
cagagggcauugugacaua

SEQ ID NO: 541964 - RNA, 19 nt, Homo sapiens
cuacaagugugaagaaugu

SEQ ID NO: 541965 - RNA, 19 nt, Homo sapiens
guucucaacucuuacuaaa

SEQ ID NO: 541966 - RNA, 19 nt, Homo sapiens
ccucaaaccuuacuacaca

SEQ ID NO: 541967 - RNA, 19 nt, Homo sapiens
cuacaagugugaagaaugu

SEQ ID NO: 541968 - RNA, 19 nt, Homo sapiens
gcaaagcuuuuaaccauuu

SEQ ID NO: 541969 - RNA, 19 nt, Homo sapiens
ccucaaaccuuacugaaca

SEQ ID NO: 541970 - RNA, 19 nt, Homo sapiens
cagaggagguuauaaugga

SEQ ID NO: 541971 - RNA, 19 nt, Homo sapiens
ggagagaaacccuacaaau

SEQ ID NO: 541972 - RNA, 19 nt, Homo sapiens
ggagagaaacccuacaaau

SEQ ID NO: 541973 - RNA, 19 nt, Homo sapiens
ggagagaaacccuacaaau

SEQ ID NO: 541974 - RNA, 19 nt, Homo sapiens
ggagagaaacccuacaaau

SEQ ID NO: 541975 - RNA, 19 nt, Homo sapiens
ccucaacucuuacuaaaca

SEQ ID NO: 541976 - RNA, 19 nt, Homo sapiens
aaacuguccucaacccuuu

SEQ ID NO: 541977 - RNA, 19 nt, Homo sapiens
gcccuucaaucaucacuaa

SEQ ID NO: 541978 - RNA, 19 nt, Homo sapiens
acaucuagcucaacauaaa

SEQ ID NO: 541979 - RNA, 19 nt, Homo sapiens
gaaaagccauuaauaugug

SEQ ID NO: 541980 - RNA, 19 nt, Homo sapiens
ggcaaagcauuuaacuauu

SEQ ID NO: 541981 - RNA, 19 nt, Homo sapiens
gagagcaacccuacaaaug

SEQ ID NO: 541982 - RNA, 19 nt, Homo sapiens
ggccagagcagcauauaaa

SEQ ID NO: 541983 - RNA, 19 nt, Homo sapiens
ccucaacccuuacuaaaca

SEQ ID NO: 541984 - RNA, 19 nt, Homo sapiens
ucucaaaccuuacuacaca

SEQ ID NO: 541985 - RNA, 19 nt, Homo sapiens
ccucaacccuuacuaaaca

SEQ ID NO: 541986 - RNA, 19 nt, Homo sapiens
ucucaaaccuuacuacaca

SEQ ID NO: 541987 - RNA, 19 nt, Homo sapiens
ucucaacucuuacuaaaca

SEQ ID NO: 541988 - RNA, 19 nt, Homo sapiens
aaccauuucucaauccuua

SEQ ID NO: 541989 - RNA, 19 nt, Homo sapiens
gcccucaacucuuacuaaa

SEQ ID NO: 541990 - RNA, 19 nt, Homo sapiens
ccacaucuagcucaacaua

SEQ ID NO: 541991 - RNA, 19 nt, Homo sapiens
gaagaugugacagugauuu

SEQ ID NO: 541992 - RNA, 19 nt, Homo sapiens
uaacaaguccucaauccuu

SEQ ID NO: 541993 - RNA, 19 nt, Homo sapiens
ggacccagcaccuagauga

SEQ ID NO: 541994 - RNA, 19 nt, Homo sapiens
ugaagaauguggcaaaguc

SEQ ID NO: 541995 - RNA, 19 nt, Homo sapiens
uagaucaugugacccuaua

SEQ ID NO: 541996 - RNA, 19 nt, Homo sapiens
uaaagaauguggcaaagcu

SEQ ID NO: 541997 - RNA, 19 nt, Homo sapiens
ugaagaauguggcaaagca

SEQ ID NO: 541998 - RNA, 19 nt, Homo sapiens
agagaaacccuacaaaugu

SEQ ID NO: 541999 - RNA, 19 nt, Homo sapiens
cuucaaaccuuacuacaca

SEQ ID NO: 542000 - RNA, 19 nt, Homo sapiens
agagaaacccuacaaaugu

SEQ ID NO: 542001 - RNA, 19 nt, Homo sapiens
gagaauucauacugcagaa

SEQ ID NO: 542002 - RNA, 19 nt, Homo sapiens
aaccaguucucaaaccuua

SEQ ID NO: 542003 - RNA, 19 nt, Homo sapiens
agagaaacccuacaaaugu

SEQ ID NO: 542004 - RNA, 19 nt, Homo sapiens
agagaaacccuacaaaugu

SEQ ID NO: 542005 - RNA, 19 nt, Homo sapiens
aaccaguucucaaaccuua

SEQ ID NO: 542006 - RNA, 19 nt, Homo sapiens
aaccaauccucaaaccuua

SEQ ID NO: 542007 - RNA, 19 nt, Homo sapiens
gaucauaucuucaaguuca

SEQ ID NO: 542008 - RNA, 19 nt, Homo sapiens
gagaugauuugcacuauaa

SEQ ID NO: 542009 - RNA, 19 nt, Homo sapiens
caagagaguuaaucaagua

SEQ ID NO: 542010 - RNA, 19 nt, Homo sapiens
gguaagggcuucagucgua

SEQ ID NO: 542011 - RNA, 19 nt, Homo sapiens
gaugggugcugaaauauuu

SEQ ID NO: 542012 - RNA, 19 nt, Homo sapiens
gagcucagaucuuaaugua

SEQ ID NO: 542013 - RNA, 19 nt, Homo sapiens
gcucucaucuucaaauuaa

SEQ ID NO: 542014 - RNA, 19 nt, Homo sapiens
gagagaauccauacaaaua

SEQ ID NO: 542015 - RNA, 19 nt, Homo sapiens
gaaagaaaccauauaagug

SEQ ID NO: 542016 - RNA, 19 nt, Homo sapiens
gguaagcgcuucagacaga

SEQ ID NO: 542017 - RNA, 19 nt, Homo sapiens
gagagaagcccuacaaaug

SEQ ID NO: 542018 - RNA, 19 nt, Homo sapiens
uaagguaccugccucauga

SEQ ID NO: 542019 - RNA, 19 nt, Homo sapiens
ucacaagaguggagacaua

SEQ ID NO: 542020 - RNA, 19 nt, Homo sapiens
gcucaagucuuaucauuca

SEQ ID NO: 542021 - RNA, 19 nt, Homo sapiens
gcucacaccuuaauauuca

SEQ ID NO: 542022 - RNA, 19 nt, Homo sapiens
gagagaaacccuauaaaug

SEQ ID NO: 542023 - RNA, 19 nt, Homo sapiens
ggcaagagcuuuaguuaca

SEQ ID NO: 542024 - RNA, 19 nt, Homo sapiens
ggaaagaaaccauauaagu

SEQ ID NO: 542025 - RNA, 19 nt, Homo sapiens
gagagaaacccuauaaaug

SEQ ID NO: 542026 - RNA, 19 nt, Homo sapiens
gagcucaagucuuaucauu

SEQ ID NO: 542027 - RNA, 19 nt, Homo sapiens
gcucagaucuuaauguaca

SEQ ID NO: 542028 - RNA, 19 nt, Homo sapiens
gagagaaacccuacaaaug

SEQ ID NO: 542029 - RNA, 19 nt, Homo sapiens
gagagaagccauacaaaug

SEQ ID NO: 542030 - RNA, 19 nt, Homo sapiens
ggagagagaccauacaaau

SEQ ID NO: 542031 - RNA, 19 nt, Homo sapiens
ggagagaaacccuauaaau

SEQ ID NO: 542032 - RNA, 19 nt, Homo sapiens
ggagagaaacccuauaaau

SEQ ID NO: 542033 - RNA, 19 nt, Homo sapiens
gagaaacccuauaaaugug

SEQ ID NO: 542034 - RNA, 19 nt, Homo sapiens
guaucaagauucuguggua

SEQ ID NO: 542035 - RNA, 19 nt, Homo sapiens
gaaaagcuguggaugauga

SEQ ID NO: 542036 - RNA, 19 nt, Homo sapiens
ggacguggcuguggucuuc

SEQ ID NO: 542037 - RNA, 19 nt, Homo sapiens
gagaaacccuaucaaugug

SEQ ID NO: 542038 - RNA, 19 nt, Homo sapiens
gagagaaacccuaucaaug

SEQ ID NO: 542039 - RNA, 19 nt, Homo sapiens
gagaaacccuacaaaugug

SEQ ID NO: 542040 - RNA, 19 nt, Homo sapiens
gagagaaacccuauaagug

SEQ ID NO: 542041 - RNA, 19 nt, Homo sapiens
acacaaaugaugcaaguua

SEQ ID NO: 542042 - RNA, 19 nt, Homo sapiens
agucggagcucagaucuua

SEQ ID NO: 542043 - RNA, 19 nt, Homo sapiens
aguuggagcucaagucuua

SEQ ID NO: 542044 - RNA, 19 nt, Homo sapiens
ggcaacagauuacaagaga

SEQ ID NO: 542045 - RNA, 19 nt, Homo sapiens
gagaagcccuacaaaugug

SEQ ID NO: 542046 - RNA, 19 nt, Homo sapiens
cgagaugauuugcacuaua

SEQ ID NO: 542047 - RNA, 19 nt, Homo sapiens
gagaguuaaucaaguauca

SEQ ID NO: 542048 - RNA, 19 nt, Homo sapiens
cauauggacugcauucaga

SEQ ID NO: 542049 - RNA, 19 nt, Homo sapiens
ggagagaaacccuaucaau

SEQ ID NO: 542050 - RNA, 19 nt, Homo sapiens
ggagagaaacccuacaaau

SEQ ID NO: 542051 - RNA, 19 nt, Homo sapiens
caaaucugcuggaccauca

SEQ ID NO: 542052 - RNA, 19 nt, Homo sapiens
ggagagaagccauacaaau

SEQ ID NO: 542053 - RNA, 19 nt, Homo sapiens
ggagagaaacccuauaagu

SEQ ID NO: 542054 - RNA, 19 nt, Homo sapiens
gcagagaagccucacaaga

SEQ ID NO: 542055 - RNA, 19 nt, Homo sapiens
gaugugaugugugugguaa

SEQ ID NO: 542056 - RNA, 19 nt, Homo sapiens
gguaaggccuucagucagu

SEQ ID NO: 542057 - RNA, 19 nt, Homo sapiens
gaagauggcaacccagaga

SEQ ID NO: 542058 - RNA, 19 nt, Homo sapiens
gagaugugaugcuggagaa

SEQ ID NO: 542059 - RNA, 19 nt, Homo sapiens
agauagaaaugcugaauuc

SEQ ID NO: 542060 - RNA, 19 nt, Homo sapiens
ggagagaagcccuacaaau

SEQ ID NO: 542061 - RNA, 19 nt, Homo sapiens
ggacugcauucagaacauu

SEQ ID NO: 542062 - RNA, 19 nt, Homo sapiens
agagaaacccuauaaaugu

SEQ ID NO: 542063 - RNA, 19 nt, Homo sapiens
caucagagaguccacagua

SEQ ID NO: 542064 - RNA, 19 nt, Homo sapiens
gagcucucaucuucaaauu

SEQ ID NO: 542065 - RNA, 19 nt, Homo sapiens
aguuacagcucacaccuua

SEQ ID NO: 542066 - RNA, 19 nt, Homo sapiens
ggagagaaaccauaucagu

SEQ ID NO: 542067 - RNA, 19 nt, Homo sapiens
gagaagccauacaaaugug

SEQ ID NO: 542068 - RNA, 19 nt, Homo sapiens
ggagagaauccauacaaau

SEQ ID NO: 542069 - RNA, 19 nt, Homo sapiens
agucugaucuggaguaaau

SEQ ID NO: 542070 - RNA, 19 nt, Homo sapiens
ggagacauauggacugcau

SEQ ID NO: 542071 - RNA, 19 nt, Homo sapiens
agagaaacccuaucaaugu

SEQ ID NO: 542072 - RNA, 19 nt, Homo sapiens
agagaaacccuacaaaugu

SEQ ID NO: 542073 - RNA, 19 nt, Homo sapiens
gcgagaaaccauacaaaug

SEQ ID NO: 542074 - RNA, 19 nt, Homo sapiens
aaucagaguucccaucuuc

SEQ ID NO: 542075 - RNA, 19 nt, Homo sapiens
gcugauacaugcagacaag

SEQ ID NO: 542076 - RNA, 19 nt, Homo sapiens
uucagaacauugaccauua

SEQ ID NO: 542077 - RNA, 19 nt, Homo sapiens
gauuugcacuauaaagaug

SEQ ID NO: 542078 - RNA, 19 nt, Homo sapiens
guacuaagauagaaaugcu

SEQ ID NO: 542079 - RNA, 19 nt, Homo sapiens
gagagagaccauacaaaug

SEQ ID NO: 542080 - RNA, 19 nt, Homo sapiens
caaaucuucuggcccauca

SEQ ID NO: 542081 - RNA, 19 nt, Homo sapiens
gcauguggcaagagcuuua

SEQ ID NO: 542082 - RNA, 19 nt, Homo sapiens
agucagaggucacaucuuc

SEQ ID NO: 542083 - RNA, 19 nt, Homo sapiens
gaagaaaagcuguggauga

SEQ ID NO: 542084 - RNA, 19 nt, Homo sapiens
caggagagaaacccuauaa

SEQ ID NO: 542085 - RNA, 19 nt, Homo sapiens
caggagagaaacccuauaa

SEQ ID NO: 542086 - RNA, 19 nt, Homo sapiens
gagaaaccauacaaaugca

SEQ ID NO: 542087 - RNA, 19 nt, Homo sapiens
caggaaaacucgauaaaau

SEQ ID NO: 542088 - RNA, 19 nt, Homo sapiens
auacaaaugugaggaaugu

SEQ ID NO: 542089 - RNA, 19 nt, Homo sapiens
agagaaacccuauaagugu

SEQ ID NO: 542090 - RNA, 19 nt, Homo sapiens
cuggagaacuucaggaaug

SEQ ID NO: 542091 - RNA, 19 nt, Homo sapiens
gaaaccauauaagugugaa

SEQ ID NO: 542092 - RNA, 19 nt, Homo sapiens
aggagaacauugugugaaa

SEQ ID NO: 542093 - RNA, 19 nt, Homo sapiens
guaccugccucaugaagag

SEQ ID NO: 542094 - RNA, 19 nt, Homo sapiens
gagagaccauacaaaugug

SEQ ID NO: 542095 - RNA, 19 nt, Homo sapiens
gugccacacuggagagaaa

SEQ ID NO: 542096 - RNA, 19 nt, Homo sapiens
gggaaaagcucacauuguc

SEQ ID NO: 542097 - RNA, 19 nt, Homo sapiens
gaugcaaguuacaggaguu

SEQ ID NO: 542098 - RNA, 19 nt, Homo sapiens
cuauaaagaugagggauuc

SEQ ID NO: 542099 - RNA, 19 nt, Homo sapiens
cagaaguacuaagauagaa

SEQ ID NO: 542100 - RNA, 19 nt, Homo sapiens
agagagaccauacaaaugu

SEQ ID NO: 542101 - RNA, 19 nt, Homo sapiens
ucaagauucugugguaaau

SEQ ID NO: 542102 - RNA, 19 nt, Homo sapiens
agagaagccucacaagagu

SEQ ID NO: 542103 - RNA, 19 nt, Homo sapiens
cagagaagccucacaagag

SEQ ID NO: 542104 - RNA, 19 nt, Homo sapiens
cagauggccuaccacaguu

SEQ ID NO: 542105 - RNA, 19 nt, Homo sapiens
guggcaagagcuuuaguua

SEQ ID NO: 542106 - RNA, 19 nt, Homo sapiens
ucagaacauugaccauuag

SEQ ID NO: 542107 - RNA, 19 nt, Homo sapiens
gaacaugcagcgagaauuu

SEQ ID NO: 542108 - RNA, 19 nt, Homo sapiens
ccaaacaagugaaugcaua

SEQ ID NO: 542109 - RNA, 19 nt, Homo sapiens
ggagagaugugacccagaa

SEQ ID NO: 542110 - RNA, 19 nt, Homo sapiens
gaacacauguauacacaca

SEQ ID NO: 542111 - RNA, 19 nt, Homo sapiens
ggucauaaauucccucgaa

SEQ ID NO: 542112 - RNA, 19 nt, Homo sapiens
caacugaaaugaaucaagu

SEQ ID NO: 542113 - RNA, 19 nt, Homo sapiens
agacuugccuugugccuua

SEQ ID NO: 542114 - RNA, 19 nt, Homo sapiens
ugaaaugaaucaaguguuc

SEQ ID NO: 542115 - RNA, 19 nt, Homo sapiens
cauccaaccugacauauuc

SEQ ID NO: 542116 - RNA, 19 nt, Homo sapiens
agucagagcucacacaaga

SEQ ID NO: 542117 - RNA, 19 nt, Homo sapiens
ccacagagccuuugcagau

SEQ ID NO: 542118 - RNA, 19 nt, Homo sapiens
acacagagccaguagaauu

SEQ ID NO: 542119 - RNA, 19 nt, Homo sapiens
ccaguugucucuugcuauu

SEQ ID NO: 542120 - RNA, 19 nt, Homo sapiens
guaaugaccuuggugaagu

SEQ ID NO: 542121 - RNA, 19 nt, Homo sapiens
gaaaaguucucgcuuguca

SEQ ID NO: 542122 - RNA, 19 nt, Homo sapiens
ggaggaagggauucgauuu

SEQ ID NO: 542123 - RNA, 19 nt, Homo sapiens
acacauguauacacacaaa

SEQ ID NO: 542124 - RNA, 19 nt, Homo sapiens
caacaucuccauacacaug

SEQ ID NO: 542125 - RNA, 19 nt, Homo sapiens
gugcaguccucaaauuuau

SEQ ID NO: 542126 - RNA, 19 nt, Homo sapiens
ggaagggauucgauuucuu

SEQ ID NO: 542127 - RNA, 19 nt, Homo sapiens
cgacuaccuuucucacauu

SEQ ID NO: 542128 - RNA, 19 nt, Homo sapiens
caaaacagauuguggauca

SEQ ID NO: 542129 - RNA, 19 nt, Homo sapiens
caucuguggucauaaauuc

SEQ ID NO: 542130 - RNA, 19 nt, Homo sapiens
ggucugaugucucccugaa

SEQ ID NO: 542131 - RNA, 19 nt, Homo sapiens
ggcaacaucuccauacaca

SEQ ID NO: 542132 - RNA, 19 nt, Homo sapiens
ggaaaguaaugaccuuggu

SEQ ID NO: 542133 - RNA, 19 nt, Homo sapiens
cacagagccaguagaauua

SEQ ID NO: 542134 - RNA, 19 nt, Homo sapiens
gcucagcuccuucauuguu

SEQ ID NO: 542135 - RNA, 19 nt, Homo sapiens
gcuauuuguugcacauuau

SEQ ID NO: 542136 - RNA, 19 nt, Homo sapiens
caaacaagugaaugcauaa

SEQ ID NO: 542137 - RNA, 19 nt, Homo sapiens
aggcucagcuccuucauug

SEQ ID NO: 542138 - RNA, 19 nt, Homo sapiens
ugacauccaaccugacaua

SEQ ID NO: 542139 - RNA, 19 nt, Homo sapiens
ugugacagcuggucugaug

SEQ ID NO: 542140 - RNA, 19 nt, Homo sapiens
gcauucagaucucaacaac

SEQ ID NO: 542141 - RNA, 19 nt, Homo sapiens
ggagauguuuacuucaaag

SEQ ID NO: 542142 - RNA, 19 nt, Homo sapiens
cauaaauucccucgaaaga

SEQ ID NO: 542143 - RNA, 19 nt, Homo sapiens
gauuucagccauacuguga

SEQ ID NO: 542144 - RNA, 19 nt, Homo sapiens
aaaaugagcuguaccaucu

SEQ ID NO: 542145 - RNA, 19 nt, Homo sapiens
aaacagauuguggaucaua

SEQ ID NO: 542146 - RNA, 19 nt, Homo sapiens
caaagacacagagccagua

SEQ ID NO: 542147 - RNA, 19 nt, Homo sapiens
guaguaaccuaaggcaaca

SEQ ID NO: 542148 - RNA, 19 nt, Homo sapiens
gcaguccucaaauuuauau

SEQ ID NO: 542149 - RNA, 19 nt, Homo sapiens
ugacauauucagcuauuug

SEQ ID NO: 542150 - RNA, 19 nt, Homo sapiens
aauuggagauguuuacuuc

SEQ ID NO: 542151 - RNA, 19 nt, Homo sapiens
cauauucagcuauuuguug

SEQ ID NO: 542152 - RNA, 19 nt, Homo sapiens
ucagagcucacacaagaaa

SEQ ID NO: 542153 - RNA, 19 nt, Homo sapiens
agauauaaccgaugccaaa

SEQ ID NO: 542154 - RNA, 19 nt, Homo sapiens
cacacaaagguaaaucuua

SEQ ID NO: 542155 - RNA, 19 nt, Homo sapiens
gaggaagggauucgauuuc

SEQ ID NO: 542156 - RNA, 19 nt, Homo sapiens
acaaccaacugacauccaa

SEQ ID NO: 542157 - RNA, 19 nt, Homo sapiens
gucauaaauucccucgaaa

SEQ ID NO: 542158 - RNA, 19 nt, Homo sapiens
agacacagagccaguagaa

SEQ ID NO: 542159 - RNA, 19 nt, Homo sapiens
caguaacaguggaaacaga

SEQ ID NO: 542160 - RNA, 19 nt, Homo sapiens
uauaaccgaugccaaaggu

SEQ ID NO: 542161 - RNA, 19 nt, Homo sapiens
cagagccaguagaauuaaa

SEQ ID NO: 542162 - RNA, 19 nt, Homo sapiens
aaacagcgaggcccuugaa

SEQ ID NO: 542163 - RNA, 19 nt, Homo sapiens
uggaacacauguauacaca

SEQ ID NO: 542164 - RNA, 19 nt, Homo sapiens
acacuuaugccauuacugu

SEQ ID NO: 542165 - RNA, 19 nt, Homo sapiens
cacaagaacacuuagacuu

SEQ ID NO: 542166 - RNA, 19 nt, Homo sapiens
uggagauguuuacuucaaa

SEQ ID NO: 542167 - RNA, 19 nt, Homo sapiens
gaucagucaaguaucuuug

SEQ ID NO: 542168 - RNA, 19 nt, Homo sapiens
ucagcuccuucauuguuaa

SEQ ID NO: 542169 - RNA, 19 nt, Homo sapiens
gaaaacagugucaaaauac

SEQ ID NO: 542170 - RNA, 19 nt, Homo sapiens
gccauagccuuguucuucu

SEQ ID NO: 542171 - RNA, 19 nt, Homo sapiens
ugugcaguccucaaauuua

SEQ ID NO: 542172 - RNA, 19 nt, Homo sapiens
uuucucacauugcaacuga

SEQ ID NO: 542173 - RNA, 19 nt, Homo sapiens
ccagagauuucagccauac

SEQ ID NO: 542174 - RNA, 19 nt, Homo sapiens
acagagccuuugcagauca

SEQ ID NO: 542175 - RNA, 19 nt, Homo sapiens
cucagcuccuucauuguua

SEQ ID NO: 542176 - RNA, 19 nt, Homo sapiens
uaaugaccuuggugaagug

SEQ ID NO: 542177 - RNA, 19 nt, Homo sapiens
uuggagauguuuacuucaa

SEQ ID NO: 542178 - RNA, 19 nt, Homo sapiens
gacuaccuuucucacauug

SEQ ID NO: 542179 - RNA, 19 nt, Homo sapiens
ccgacuaccuuucucacau

SEQ ID NO: 542180 - RNA, 19 nt, Homo sapiens
gcauuggcccagagauuuc

SEQ ID NO: 542181 - RNA, 19 nt, Homo sapiens
uguauacacacaaagguaa

SEQ ID NO: 542182 - RNA, 19 nt, Homo sapiens
ggacuggaggucaaagaag

SEQ ID NO: 542183 - RNA, 19 nt, Homo sapiens
gaaagggccaaaacagauu

SEQ ID NO: 542184 - RNA, 19 nt, Homo sapiens
cccagagauuucagccaua

SEQ ID NO: 542185 - RNA, 19 nt, Homo sapiens
ggaaagggccaaaacagau

SEQ ID NO: 542186 - RNA, 19 nt, Homo sapiens
guauacacacaaagguaaa

SEQ ID NO: 542187 - RNA, 19 nt, Homo sapiens
ucgaaagagccaauuguug

SEQ ID NO: 542188 - RNA, 19 nt, Homo sapiens
uugcagaucagucaaguau

SEQ ID NO: 542189 - RNA, 19 nt, Homo sapiens
cuaaggcaacaucuccaua

SEQ ID NO: 542190 - RNA, 19 nt, Homo sapiens
aacaaggacuggaggucaa

SEQ ID NO: 542191 - RNA, 19 nt, Homo sapiens
gcaacugaaaugaaucaag

SEQ ID NO: 542192 - RNA, 19 nt, Homo sapiens
cagcgaggcccuugaaugc

SEQ ID NO: 542193 - RNA, 19 nt, Homo sapiens
gacauauucagcuauuugu

SEQ ID NO: 542194 - RNA, 19 nt, Homo sapiens
gaaaugaaucaaguguucu

SEQ ID NO: 542195 - RNA, 19 nt, Homo sapiens
caauuggagauguuuacuu

SEQ ID NO: 542196 - RNA, 19 nt, Homo sapiens
agcuauuuguugcacauua

SEQ ID NO: 542197 - RNA, 19 nt, Homo sapiens
aagguuugguaaugcauug

SEQ ID NO: 542198 - RNA, 19 nt, Homo sapiens
acacacaaagguaaaucuu

SEQ ID NO: 542199 - RNA, 19 nt, Homo sapiens
cggugucccugcuuccauu

SEQ ID NO: 542200 - RNA, 19 nt, Homo sapiens
uaaggcaacaucuccauac

SEQ ID NO: 542201 - RNA, 19 nt, Homo sapiens
gauauaaccgaugccaaag

SEQ ID NO: 542202 - RNA, 19 nt, Homo sapiens
ucaagcaggagagauguga

SEQ ID NO: 542203 - RNA, 19 nt, Homo sapiens
uauauggcauucagaucuc

SEQ ID NO: 542204 - RNA, 19 nt, Homo sapiens
aaugagcuguaccaucugu

SEQ ID NO: 542205 - RNA, 19 nt, Homo sapiens
cacagagccuuugcagauc

SEQ ID NO: 542206 - RNA, 19 nt, Homo sapiens
gcagcgagaauuugguuuu

SEQ ID NO: 542207 - RNA, 19 nt, Homo sapiens
gaaagccuguaauaacuua

SEQ ID NO: 542208 - RNA, 19 nt, Homo sapiens
ggacagaccuuugguaaau

SEQ ID NO: 542209 - RNA, 19 nt, Homo sapiens
caucagagaacucacauua

SEQ ID NO: 542210 - RNA, 19 nt, Homo sapiens
gaagucauaccucacaaua

SEQ ID NO: 542211 - RNA, 19 nt, Homo sapiens
gagaaagccuguaauaacu

SEQ ID NO: 542212 - RNA, 19 nt, Homo sapiens
gagaaacccuccauuagca

SEQ ID NO: 542213 - RNA, 19 nt, Homo sapiens
gggauaagcccuacaaaug

SEQ ID NO: 542214 - RNA, 19 nt, Homo sapiens
gaaaagcccuaugaauaua

SEQ ID NO: 542215 - RNA, 19 nt, Homo sapiens
uaagaagguucauauagga

SEQ ID NO: 542216 - RNA, 19 nt, Homo sapiens
caagaugccuacugaggaa

SEQ ID NO: 542217 - RNA, 19 nt, Homo sapiens
gaaaagcccuaucagugua

SEQ ID NO: 542218 - RNA, 19 nt, Homo sapiens
gggaaaagcccuaugaaua

SEQ ID NO: 542219 - RNA, 19 nt, Homo sapiens
ggauaagcccuacaaaugu

SEQ ID NO: 542220 - RNA, 19 nt, Homo sapiens
gacagaccuuugguaaaua

SEQ ID NO: 542221 - RNA, 19 nt, Homo sapiens
ucagagaacucacauuagg

SEQ ID NO: 542222 - RNA, 19 nt, Homo sapiens
ggaaaagcccuaugaauau

SEQ ID NO: 542223 - RNA, 19 nt, Homo sapiens
uaugagaaagccuguaaua

SEQ ID NO: 542224 - RNA, 19 nt, Homo sapiens
gccuguaacugcugugaaa

SEQ ID NO: 542225 - RNA, 19 nt, Homo sapiens
cauauagccacaagucaua

SEQ ID NO: 542226 - RNA, 19 nt, Homo sapiens
ccauaugcauguaacaaau

SEQ ID NO: 542227 - RNA, 19 nt, Homo sapiens
guaagucauuccucacugu

SEQ ID NO: 542228 - RNA, 19 nt, Homo sapiens
agucauaccucacaauaca

SEQ ID NO: 542229 - RNA, 19 nt, Homo sapiens
guaaaucaacuucucacuu

SEQ ID NO: 542230 - RNA, 19 nt, Homo sapiens
ugugagaaacccuccauua

SEQ ID NO: 542231 - RNA, 19 nt, Homo sapiens
caagggauaacucagguaa

SEQ ID NO: 542232 - RNA, 19 nt, Homo sapiens
cauaagaagguucauauag

SEQ ID NO: 542233 - RNA, 19 nt, Homo sapiens
gaacucacauuagggaaaa

SEQ ID NO: 542234 - RNA, 19 nt, Homo sapiens
ugagaaagccuguaauaac

SEQ ID NO: 542235 - RNA, 19 nt, Homo sapiens
uaagucaaaccucaggaua

SEQ ID NO: 542236 - RNA, 19 nt, Homo sapiens
gcauuuagccauaagucaa

SEQ ID NO: 542237 - RNA, 19 nt, Homo sapiens
caacuucucacuuuacauc

SEQ ID NO: 542238 - RNA, 19 nt, Homo sapiens
gcaugugaccauugugaaa

SEQ ID NO: 542239 - RNA, 19 nt, Homo sapiens
gaaacccuccauuagcaaa

SEQ ID NO: 542240 - RNA, 19 nt, Homo sapiens
cacaauacaucauagaacu

SEQ ID NO: 542241 - RNA, 19 nt, Homo sapiens
gcauguaacaaauguggaa

SEQ ID NO: 542242 - RNA, 19 nt, Homo sapiens
auaagaagguucauauagg

SEQ ID NO: 542243 - RNA, 19 nt, Homo sapiens
uagcaaaucagaccucaug

SEQ ID NO: 542244 - RNA, 19 nt, Homo sapiens
acagaccuuugguaaauau

SEQ ID NO: 542245 - RNA, 19 nt, Homo sapiens
agggauaacucagguaaga

SEQ ID NO: 542246 - RNA, 19 nt, Homo sapiens
aaacauauagccacaaguc

SEQ ID NO: 542247 - RNA, 19 nt, Homo sapiens
uaggacagaccuuugguaa

SEQ ID NO: 542248 - RNA, 19 nt, Homo sapiens
gugagaaacccuccauuag

SEQ ID NO: 542249 - RNA, 19 nt, Homo sapiens
ggauaacucagguaagaca

SEQ ID NO: 542250 - RNA, 19 nt, Homo sapiens
augaauguguugaauguga

SEQ ID NO: 542251 - RNA, 19 nt, Homo sapiens
gcaaaagcccuaugcaugu

SEQ ID NO: 542252 - RNA, 19 nt, Homo sapiens
ggaaaagcccuaucagugu

SEQ ID NO: 542253 - RNA, 19 nt, Homo sapiens
gcaaugaacuggggaaaac

SEQ ID NO: 542254 - RNA, 19 nt, Homo sapiens
aauaugagaaagccuguaa

SEQ ID NO: 542255 - RNA, 19 nt, Homo sapiens
guuccucacuguccaucaa

SEQ ID NO: 542256 - RNA, 19 nt, Homo sapiens
aaccuucacuguaaaucaa

SEQ ID NO: 542257 - RNA, 19 nt, Homo sapiens
agucaaaccucaggauaca

SEQ ID NO: 542258 - RNA, 19 nt, Homo sapiens
guagaaaacccuuuaucaa

SEQ ID NO: 542259 - RNA, 19 nt, Homo sapiens
ggauacaucagagaacuca

SEQ ID NO: 542260 - RNA, 19 nt, Homo sapiens
caauacaucauagaacuca

SEQ ID NO: 542261 - RNA, 19 nt, Homo sapiens
gaacucacacuggggauaa

SEQ ID NO: 542262 - RNA, 19 nt, Homo sapiens
cagaagucauaccucacaa

SEQ ID NO: 542263 - RNA, 19 nt, Homo sapiens
cauauaggacagaccuuug

SEQ ID NO: 542264 - RNA, 19 nt, Homo sapiens
agucauuccucacuuuaca

SEQ ID NO: 542265 - RNA, 19 nt, Homo sapiens
gaaaagcccuauggaugca

SEQ ID NO: 542266 - RNA, 19 nt, Homo sapiens
ucauauaggacagaccuuu

SEQ ID NO: 542267 - RNA, 19 nt, Homo sapiens
gaauaugagaaagccugua

SEQ ID NO: 542268 - RNA, 19 nt, Homo sapiens
ugagaaacccuccauuagc

SEQ ID NO: 542269 - RNA, 19 nt, Homo sapiens
cauuuagccauaagucaaa

SEQ ID NO: 542270 - RNA, 19 nt, Homo sapiens
uaccucacaauacaucaua

SEQ ID NO: 542271 - RNA, 19 nt, Homo sapiens
ucagaagucauaccucaca

SEQ ID NO: 542272 - RNA, 19 nt, Homo sapiens
cagguaagacagccaacuu

SEQ ID NO: 542273 - RNA, 19 nt, Homo sapiens
caggauacaucagagaacu

SEQ ID NO: 542274 - RNA, 19 nt, Homo sapiens
ucaaaccucaggauacauc

SEQ ID NO: 542275 - RNA, 19 nt, Homo sapiens
cuaugcaugugaccauugu

SEQ ID NO: 542276 - RNA, 19 nt, Homo sapiens
ccuuuagucagaagucaua

SEQ ID NO: 542277 - RNA, 19 nt, Homo sapiens
cccuauggaugcaaugaau

SEQ ID NO: 542278 - RNA, 19 nt, Homo sapiens
cauaugcauguaacaaaug

SEQ ID NO: 542279 - RNA, 19 nt, Homo sapiens
caaagcuuacuguccauca

SEQ ID NO: 542280 - RNA, 19 nt, Homo sapiens
uauaaguccagccucacua

SEQ ID NO: 542281 - RNA, 19 nt, Homo sapiens
aaaccuucacuguaaauca

SEQ ID NO: 542282 - RNA, 19 nt, Homo sapiens
cacuauccaucagagaauu

SEQ ID NO: 542283 - RNA, 19 nt, Homo sapiens
agaacucacauuagggaaa

SEQ ID NO: 542284 - RNA, 19 nt, Homo sapiens
gaacucacaccuggcaaaa

SEQ ID NO: 542285 - RNA, 19 nt, Homo sapiens
agaaagccuguaauaacuu

SEQ ID NO: 542286 - RNA, 19 nt, Homo sapiens
cuacgaaugcaaugaacug

SEQ ID NO: 542287 - RNA, 19 nt, Homo sapiens
gaauguguugaaugugaga

SEQ ID NO: 542288 - RNA, 19 nt, Homo sapiens
caaaagcccuaugcaugug

SEQ ID NO: 542289 - RNA, 19 nt, Homo sapiens
ucacuauccaucagagaau

SEQ ID NO: 542290 - RNA, 19 nt, Homo sapiens
aaaagucguuccucacugu

SEQ ID NO: 542291 - RNA, 19 nt, Homo sapiens
gaacacacacaggggaaaa

SEQ ID NO: 542292 - RNA, 19 nt, Homo sapiens
augagaaagccuguaauaa

SEQ ID NO: 542293 - RNA, 19 nt, Homo sapiens
cuaugaaugcaaugaaugu

SEQ ID NO: 542294 - RNA, 19 nt, Homo sapiens
cccuaugaaugcaaugaau

SEQ ID NO: 542295 - RNA, 19 nt, Homo sapiens
ucacaauacaucauagaac

SEQ ID NO: 542296 - RNA, 19 nt, Homo sapiens
ccaagggauaacucaggua

SEQ ID NO: 542297 - RNA, 19 nt, Homo sapiens
gagcaaaccucgaaacuaa

SEQ ID NO: 542298 - RNA, 19 nt, Homo sapiens
gcucacaccuguaaucuua

SEQ ID NO: 542299 - RNA, 19 nt, Homo sapiens
cagaaccacugucucauua

SEQ ID NO: 542300 - RNA, 19 nt, Homo sapiens
gaaccacugucucauuaaa

SEQ ID NO: 542301 - RNA, 19 nt, Homo sapiens
gcaagacccugugugaaau

SEQ ID NO: 542302 - RNA, 19 nt, Homo sapiens
gauuugcacuugaggauau

SEQ ID NO: 542303 - RNA, 19 nt, Homo sapiens
gcagggcauuugcaaagaa

SEQ ID NO: 542304 - RNA, 19 nt, Homo sapiens
ggaggaguguugagaguca

SEQ ID NO: 542305 - RNA, 19 nt, Homo sapiens
gccgugaccuugacucauu

SEQ ID NO: 542306 - RNA, 19 nt, Homo sapiens
agaagucguuuaaguguga

SEQ ID NO: 542307 - RNA, 19 nt, Homo sapiens
gaagccagguccaaggaau

SEQ ID NO: 542308 - RNA, 19 nt, Homo sapiens
gaucuuucuugccaauaaa

SEQ ID NO: 542309 - RNA, 19 nt, Homo sapiens
ggagaagucguuuaagugu

SEQ ID NO: 542310 - RNA, 19 nt, Homo sapiens
ccuguaaucuuaacacugu

SEQ ID NO: 542311 - RNA, 19 nt, Homo sapiens
gacccugugugaaauuaaa

SEQ ID NO: 542312 - RNA, 19 nt, Homo sapiens
ggauguggcuguggacuuc

SEQ ID NO: 542313 - RNA, 19 nt, Homo sapiens
ccucgaaacuaacaugaug

SEQ ID NO: 542314 - RNA, 19 nt, Homo sapiens
ggagcaaaccucgaaacua

SEQ ID NO: 542315 - RNA, 19 nt, Homo sapiens
gggaugugauguuggagaa

SEQ ID NO: 542316 - RNA, 19 nt, Homo sapiens
ccaaggaaucggugaguuu

SEQ ID NO: 542317 - RNA, 19 nt, Homo sapiens
gugagaagcccuacaagug

SEQ ID NO: 542318 - RNA, 19 nt, Homo sapiens
gggagaaggcuuacaagug

SEQ ID NO: 542319 - RNA, 19 nt, Homo sapiens
acucagacgugcuugauug

SEQ ID NO: 542320 - RNA, 19 nt, Homo sapiens
cagcuucacucuuguaguc

SEQ ID NO: 542321 - RNA, 19 nt, Homo sapiens
cagggugccuccucuaguu

SEQ ID NO: 542322 - RNA, 19 nt, Homo sapiens
guaccgggaugugauguug

SEQ ID NO: 542323 - RNA, 19 nt, Homo sapiens
ccaaagugcugggauuaca

SEQ ID NO: 542324 - RNA, 19 nt, Homo sapiens
agagagaucaggccaguuu

SEQ ID NO: 542325 - RNA, 19 nt, Homo sapiens
gggacaagccguucaagug

SEQ ID NO: 542326 - RNA, 19 nt, Homo sapiens
ugaaggcggugcccucuca

SEQ ID NO: 542327 - RNA, 19 nt, Homo sapiens
ugugaucucucaucuggaa

SEQ ID NO: 542328 - RNA, 19 nt, Homo sapiens
gaaccuucuugcccuagga

SEQ ID NO: 542329 - RNA, 19 nt, Homo sapiens
gagaagacagguacagcuu

SEQ ID NO: 542330 - RNA, 19 nt, Homo sapiens
gcaaaccucgaaacuaaca

SEQ ID NO: 542331 - RNA, 19 nt, Homo sapiens
ggagcucgcaccucacuga

SEQ ID NO: 542332 - RNA, 19 nt, Homo sapiens
gggagaagucguuuaagug

SEQ ID NO: 542333 - RNA, 19 nt, Homo sapiens
agaucuuucuugccaauaa

SEQ ID NO: 542334 - RNA, 19 nt, Homo sapiens
ccagaaccacugucucauu

SEQ ID NO: 542335 - RNA, 19 nt, Homo sapiens
gcagagccuucagccagaa

SEQ ID NO: 542336 - RNA, 19 nt, Homo sapiens
caacuagacuccccucaga

SEQ ID NO: 542337 - RNA, 19 nt, Homo sapiens
agguacagcuucacucuug

SEQ ID NO: 542338 - RNA, 19 nt, Homo sapiens
caguaugucuguggauuug

SEQ ID NO: 542339 - RNA, 19 nt, Homo sapiens
aaagcaagacccuguguga

SEQ ID NO: 542340 - RNA, 19 nt, Homo sapiens
cacgacaggugggcuuuaa

SEQ ID NO: 542341 - RNA, 19 nt, Homo sapiens
agaagcauccagcaucuuu

SEQ ID NO: 542342 - RNA, 19 nt, Homo sapiens
ccagaagcauccagcaucu

SEQ ID NO: 542343 - RNA, 19 nt, Homo sapiens
cgccagcucuuuccucuca

SEQ ID NO: 542344 - RNA, 19 nt, Homo sapiens
agacacaggcagauuauuc

SEQ ID NO: 542345 - RNA, 19 nt, Homo sapiens
ccucgaugcuguuucuguu

SEQ ID NO: 542346 - RNA, 19 nt, Homo sapiens
gaggugggaggaucauuug

SEQ ID NO: 542347 - RNA, 19 nt, Homo sapiens
gagagucauuugagguagu

SEQ ID NO: 542348 - RNA, 19 nt, Homo sapiens
gagcuacucaacaaggaaa

SEQ ID NO: 542349 - RNA, 19 nt, Homo sapiens
gguucugccuccucucuga

SEQ ID NO: 542350 - RNA, 19 nt, Homo sapiens
caagugagccagaaaaguu

SEQ ID NO: 542351 - RNA, 19 nt, Homo sapiens
agagggcccuguccagaau

SEQ ID NO: 542352 - RNA, 19 nt, Homo sapiens
aagacccugugugaaauua

SEQ ID NO: 542353 - RNA, 19 nt, Homo sapiens
ugaggugggaggaucauuu

SEQ ID NO: 542354 - RNA, 19 nt, Homo sapiens
ugaauuggagugucugaga

SEQ ID NO: 542355 - RNA, 19 nt, Homo sapiens
gaugugcuuuggugucagu

SEQ ID NO: 542356 - RNA, 19 nt, Homo sapiens
ggauuugcacuugaggaua

SEQ ID NO: 542357 - RNA, 19 nt, Homo sapiens
cugagacacaggcagauua

SEQ ID NO: 542358 - RNA, 19 nt, Homo sapiens
aaucauuuguucccacuca

SEQ ID NO: 542359 - RNA, 19 nt, Homo sapiens
caagacccugugugaaauu

SEQ ID NO: 542360 - RNA, 19 nt, Homo sapiens
caggaggaguguugagagu

SEQ ID NO: 542361 - RNA, 19 nt, Homo sapiens
cagcagggcauuugcaaag

SEQ ID NO: 542362 - RNA, 19 nt, Homo sapiens
gaugugauguuggagaacu

SEQ ID NO: 542363 - RNA, 19 nt, Homo sapiens
ggauauugacacucagaga

SEQ ID NO: 542364 - RNA, 19 nt, Homo sapiens
gaucuuccgcucacugcaa

SEQ ID NO: 542365 - RNA, 19 nt, Homo sapiens
agcaagacccugugugaaa

SEQ ID NO: 542366 - RNA, 19 nt, Homo sapiens
ccauggcucacaccuguaa

SEQ ID NO: 542367 - RNA, 19 nt, Homo sapiens
ccucucugauucucacuug

SEQ ID NO: 542368 - RNA, 19 nt, Homo sapiens
gucaguaugucuguggauu

SEQ ID NO: 542369 - RNA, 19 nt, Homo sapiens
cagccugggugacaaagca

SEQ ID NO: 542370 - RNA, 19 nt, Homo sapiens
ggccauccaguucaacaaa

SEQ ID NO: 542371 - RNA, 19 nt, Homo sapiens
ggugagaagcccuacaagu

SEQ ID NO: 542372 - RNA, 19 nt, Homo sapiens
ggucugggacguccuguag

SEQ ID NO: 542373 - RNA, 19 nt, Homo sapiens
ggagaacuaccagaaccuu

SEQ ID NO: 542374 - RNA, 19 nt, Homo sapiens
cgccucaaccucccaagua

SEQ ID NO: 542375 - RNA, 19 nt, Homo sapiens
ggugccuccucuaguuaaa

SEQ ID NO: 542376 - RNA, 19 nt, Homo sapiens
guuuaagugugagaaaugu

SEQ ID NO: 542377 - RNA, 19 nt, Homo sapiens
gggcauuugcaaagaagaa

SEQ ID NO: 542378 - RNA, 19 nt, Homo sapiens
cagagggcccuguccagaa

SEQ ID NO: 542379 - RNA, 19 nt, Homo sapiens
guaugucuguggauuugca

SEQ ID NO: 542380 - RNA, 19 nt, Homo sapiens
ucaggccaguuucccagaa

SEQ ID NO: 542381 - RNA, 19 nt, Homo sapiens
ugaugggccuggaaguugu

SEQ ID NO: 542382 - RNA, 19 nt, Homo sapiens
gcacuugaggauauugaca

SEQ ID NO: 542383 - RNA, 19 nt, Homo sapiens
ccauccaguucaacaaaca

SEQ ID NO: 542384 - RNA, 19 nt, Homo sapiens
ggggagaagucguuuaagu

SEQ ID NO: 542385 - RNA, 19 nt, Homo sapiens
caaggaaucggugaguuuc

SEQ ID NO: 542386 - RNA, 19 nt, Homo sapiens
ucaguaugucuguggauuu

SEQ ID NO: 542387 - RNA, 19 nt, Homo sapiens
gaggauauugacacucaga

SEQ ID NO: 542388 - RNA, 19 nt, Homo sapiens
gcuuacaagugcgaugaau

SEQ ID NO: 542389 - RNA, 19 nt, Homo sapiens
aguccggucuguccacuug

SEQ ID NO: 542390 - RNA, 19 nt, Homo sapiens
gugcaacgagugcggcaaa

SEQ ID NO: 542391 - RNA, 19 nt, Homo sapiens
caacagcagggcauuugca

SEQ ID NO: 542392 - RNA, 19 nt, Homo sapiens
ugagacacaggcagauuau

SEQ ID NO: 542393 - RNA, 19 nt, Homo sapiens
gccucaaccucccaaguag

SEQ ID NO: 542394 - RNA, 19 nt, Homo sapiens
aaggagguauaucaacugu

SEQ ID NO: 542395 - RNA, 19 nt, Homo sapiens
ucacucuuguagucaguau

SEQ ID NO: 542396 - RNA, 19 nt, Homo sapiens
ucacaccuguaaucuuaac

SEQ ID NO: 542397 - RNA, 19 nt, Homo sapiens
gcacaagaguugauacaua

SEQ ID NO: 542398 - RNA, 19 nt, Homo sapiens
gaaagaaaccugcaacuug

SEQ ID NO: 542399 - RNA, 19 nt, Homo sapiens
gggaaaagcuucagaguua

SEQ ID NO: 542400 - RNA, 19 nt, Homo sapiens
gggaaaagcuuuagucaua

SEQ ID NO: 542401 - RNA, 19 nt, Homo sapiens
gagagaagcccuuuaaaug

SEQ ID NO: 542402 - RNA, 19 nt, Homo sapiens
gcucugaucuuauuaaaca

SEQ ID NO: 542403 - RNA, 19 nt, Homo sapiens
cacaagaguugauacauaa

SEQ ID NO: 542404 - RNA, 19 nt, Homo sapiens
gagaagcccuuuaaaugug

SEQ ID NO: 542405 - RNA, 19 nt, Homo sapiens
gagagaaacccuauaaaug

SEQ ID NO: 542406 - RNA, 19 nt, Homo sapiens
agaagacucucuacaauga

SEQ ID NO: 542407 - RNA, 19 nt, Homo sapiens
gaaaugaucauccuauauc

SEQ ID NO: 542408 - RNA, 19 nt, Homo sapiens
ugucaucucucuaggguua

SEQ ID NO: 542409 - RNA, 19 nt, Homo sapiens
uagaaguggugaaagaaua

SEQ ID NO: 542410 - RNA, 19 nt, Homo sapiens
ggagagaaacccuauaaau

SEQ ID NO: 542411 - RNA, 19 nt, Homo sapiens
aaagaaaccugcaacuugu

SEQ ID NO: 542412 - RNA, 19 nt, Homo sapiens
ugaggaaaguuaccaugua

SEQ ID NO: 542413 - RNA, 19 nt, Homo sapiens
ggagagaagcccuuuaaau

SEQ ID NO: 542414 - RNA, 19 nt, Homo sapiens
uaacacaaaucuacacaca

SEQ ID NO: 542415 - RNA, 19 nt, Homo sapiens
gaggaagaguggcaauuau

SEQ ID NO: 542416 - RNA, 19 nt, Homo sapiens
gcaccuggccuaccaugua

SEQ ID NO: 542417 - RNA, 19 nt, Homo sapiens
ggagaaaccuuuuaagugu

SEQ ID NO: 542418 - RNA, 19 nt, Homo sapiens
gaucgagccuucuuagaca

SEQ ID NO: 542419 - RNA, 19 nt, Homo sapiens
auucagaacucccaccuua

SEQ ID NO: 542420 - RNA, 19 nt, Homo sapiens
ggaguucagaucuuaauaa

SEQ ID NO: 542421 - RNA, 19 nt, Homo sapiens
gacaggagguuuagaugga

SEQ ID NO: 542422 - RNA, 19 nt, Homo sapiens
gaacucccaccuuauuaaa

SEQ ID NO: 542423 - RNA, 19 nt, Homo sapiens
gagaaacccuauaaauguc

SEQ ID NO: 542424 - RNA, 19 nt, Homo sapiens
gaaucuaagcugucuguuu

SEQ ID NO: 542425 - RNA, 19 nt, Homo sapiens
gaggaaaguuaccauguag

SEQ ID NO: 542426 - RNA, 19 nt, Homo sapiens
acacaaaucuacacacaca

SEQ ID NO: 542427 - RNA, 19 nt, Homo sapiens
ggaagcaugucuagugucu

SEQ ID NO: 542428 - RNA, 19 nt, Homo sapiens
ggaaaugaucauccuauau

SEQ ID NO: 542429 - RNA, 19 nt, Homo sapiens
gaaauggcaucgagcuuuu

SEQ ID NO: 542430 - RNA, 19 nt, Homo sapiens
ccacagcugucaugaucaa

SEQ ID NO: 542431 - RNA, 19 nt, Homo sapiens
agagaaacccuauaaaugu

SEQ ID NO: 542432 - RNA, 19 nt, Homo sapiens
caacuaggcuuggcacagu

SEQ ID NO: 542433 - RNA, 19 nt, Homo sapiens
caugacccaucaaggaaua

SEQ ID NO: 542434 - RNA, 19 nt, Homo sapiens
caucagaaauacaaacauc

SEQ ID NO: 542435 - RNA, 19 nt, Homo sapiens
uggaaaugaucauccuaua

SEQ ID NO: 542436 - RNA, 19 nt, Homo sapiens
gaucauccuauaucuguuu

SEQ ID NO: 542437 - RNA, 19 nt, Homo sapiens
ucucuaggguuaaagcuaa

SEQ ID NO: 542438 - RNA, 19 nt, Homo sapiens
gaugagauuccuuuagcua

SEQ ID NO: 542439 - RNA, 19 nt, Homo sapiens
ucuagugucuccaaacuga

SEQ ID NO: 542440 - RNA, 19 nt, Homo sapiens
ccucuuugcuccuuccuuu

SEQ ID NO: 542441 - RNA, 19 nt, Homo sapiens
aaaugaaaguguagugaug

SEQ ID NO: 542442 - RNA, 19 nt, Homo sapiens
ugaggaagaguggcaauua

SEQ ID NO: 542443 - RNA, 19 nt, Homo sapiens
gcaggugcuuugaggcauu

SEQ ID NO: 542444 - RNA, 19 nt, Homo sapiens
caggagagaagcccuuuaa

SEQ ID NO: 542445 - RNA, 19 nt, Homo sapiens
gaaauacaaacaucaggau

SEQ ID NO: 542446 - RNA, 19 nt, Homo sapiens
ucagaacucccaccuuauu

SEQ ID NO: 542447 - RNA, 19 nt, Homo sapiens
ggaaaagcuuuagucauaa

SEQ ID NO: 542448 - RNA, 19 nt, Homo sapiens
caaugugacaggagguuua

SEQ ID NO: 542449 - RNA, 19 nt, Homo sapiens
ggcaaguacuaaacuauag

SEQ ID NO: 542450 - RNA, 19 nt, Homo sapiens
gaaaguguagugaugagau

SEQ ID NO: 542451 - RNA, 19 nt, Homo sapiens
aaucuaagcugucuguuuu

SEQ ID NO: 542452 - RNA, 19 nt, Homo sapiens
gaaugaaaauugcccagaa

SEQ ID NO: 542453 - RNA, 19 nt, Homo sapiens
caccuggccuaccauguaa

SEQ ID NO: 542454 - RNA, 19 nt, Homo sapiens
guagugaugagauuccuuu

SEQ ID NO: 542455 - RNA, 19 nt, Homo sapiens
cagaacucccaccuuauua

SEQ ID NO: 542456 - RNA, 19 nt, Homo sapiens
guaaacaagagcuuccaaa

SEQ ID NO: 542457 - RNA, 19 nt, Homo sapiens
aaaguguagugaugagauu

SEQ ID NO: 542458 - RNA, 19 nt, Homo sapiens
ccauguagagcuugacuuu

SEQ ID NO: 542459 - RNA, 19 nt, Homo sapiens
cagaaacuccacagaagaa

SEQ ID NO: 542460 - RNA, 19 nt, Homo sapiens
gcaagagaaacuuuaguag

SEQ ID NO: 542461 - RNA, 19 nt, Homo sapiens
gaaacccuauaaaugucaa

SEQ ID NO: 542462 - RNA, 19 nt, Homo sapiens
uugaagauguggcugugua

SEQ ID NO: 542463 - RNA, 19 nt, Homo sapiens
guuauucucuaggcaacua

SEQ ID NO: 542464 - RNA, 19 nt, Homo sapiens
agagaagcccuuuaaaugu

SEQ ID NO: 542465 - RNA, 19 nt, Homo sapiens
acacacacaccaaagaauu

SEQ ID NO: 542466 - RNA, 19 nt, Homo sapiens
cauccuauaucuguuucua

SEQ ID NO: 542467 - RNA, 19 nt, Homo sapiens
uaaugcaggauaucuauga

SEQ ID NO: 542468 - RNA, 19 nt, Homo sapiens
ggaaaauccuggugauaca

SEQ ID NO: 542469 - RNA, 19 nt, Homo sapiens
aaaugacacuggaaaugau

SEQ ID NO: 542470 - RNA, 19 nt, Homo sapiens
uagaguuuguugacauuug

SEQ ID NO: 542471 - RNA, 19 nt, Homo sapiens
ggaaaguuaccauguagag

SEQ ID NO: 542472 - RNA, 19 nt, Homo sapiens
ugagauuccuuuagcuauc

SEQ ID NO: 542473 - RNA, 19 nt, Homo sapiens
gugaugagauuccuuuagc

SEQ ID NO: 542474 - RNA, 19 nt, Homo sapiens
uaugaggcacccaaugaua

SEQ ID NO: 542475 - RNA, 19 nt, Homo sapiens
aguuagcucugaucuuauu

SEQ ID NO: 542476 - RNA, 19 nt, Homo sapiens
gaagauguggcuguguauu

SEQ ID NO: 542477 - RNA, 19 nt, Homo sapiens
ccagaaacuccacagaaga

SEQ ID NO: 542478 - RNA, 19 nt, Homo sapiens
agaaauggcaucgagcuuu

SEQ ID NO: 542479 - RNA, 19 nt, Homo sapiens
cuggugagcuguuauuucu

SEQ ID NO: 542480 - RNA, 19 nt, Homo sapiens
agaguuuguugacauuuga

SEQ ID NO: 542481 - RNA, 19 nt, Homo sapiens
uggcaaguacuaaacuaua

SEQ ID NO: 542482 - RNA, 19 nt, Homo sapiens
ggguacauguuacacuuca

SEQ ID NO: 542483 - RNA, 19 nt, Homo sapiens
gaagaagggaagcaugucu

SEQ ID NO: 542484 - RNA, 19 nt, Homo sapiens
acacaggugagcagccuua

SEQ ID NO: 542485 - RNA, 19 nt, Homo sapiens
agaagcccuuuaaauguga

SEQ ID NO: 542486 - RNA, 19 nt, Homo sapiens
cccuaaaucuuguacuguu

SEQ ID NO: 542487 - RNA, 19 nt, Homo sapiens
cuauaucuguuucuacauc

SEQ ID NO: 542488 - RNA, 19 nt, Homo sapiens
ugaaguggcaaguacuaaa

SEQ ID NO: 542489 - RNA, 19 nt, Homo sapiens
auguagagcuugacuuuag

SEQ ID NO: 542490 - RNA, 19 nt, Homo sapiens
caccagaaacuccacagaa

SEQ ID NO: 542491 - RNA, 19 nt, Homo sapiens
ugcaagagaaacuuuagua

SEQ ID NO: 542492 - RNA, 19 nt, Homo sapiens
caagagcuuccaaaacuua

SEQ ID NO: 542493 - RNA, 19 nt, Homo sapiens
gaaaauugcccagaaaaca

SEQ ID NO: 542494 - RNA, 19 nt, Homo sapiens
aagauguggcuguguauuu

SEQ ID NO: 542495 - RNA, 19 nt, Homo sapiens
uccuuuagcuaucuaucua

SEQ ID NO: 542496 - RNA, 19 nt, Homo sapiens
uaagcugucuguuuuauuc

SEQ ID NO: 542497 - RNA, 19 nt, Homo sapiens
gaagacaucucuaauggaa

SEQ ID NO: 542498 - RNA, 19 nt, Homo sapiens
caagaaagauugugcaaga

SEQ ID NO: 542499 - RNA, 19 nt, Homo sapiens
gauaagagguuuagaugga

SEQ ID NO: 542500 - RNA, 19 nt, Homo sapiens
gaacagcucagcaggaaua

SEQ ID NO: 542501 - RNA, 19 nt, Homo sapiens
guagcaggcuuaccaauuu

SEQ ID NO: 542502 - RNA, 19 nt, Homo sapiens
gaagagaaacccuauaaau

SEQ ID NO: 542503 - RNA, 19 nt, Homo sapiens
ucacuugaguuccuucuua

SEQ ID NO: 542504 - RNA, 19 nt, Homo sapiens
gggaaaaccuucagaguua

SEQ ID NO: 542505 - RNA, 19 nt, Homo sapiens
gaugaaaucuuguuaacca

SEQ ID NO: 542506 - RNA, 19 nt, Homo sapiens
gagcagccauauacuugua

SEQ ID NO: 542507 - RNA, 19 nt, Homo sapiens
agucagaacucccaccuua

SEQ ID NO: 542508 - RNA, 19 nt, Homo sapiens
gggaaaagcuucagucaaa

SEQ ID NO: 542509 - RNA, 19 nt, Homo sapiens
ggaaacggguuggaauuug

SEQ ID NO: 542510 - RNA, 19 nt, Homo sapiens
gaaacggguuggaauuugu

SEQ ID NO: 542511 - RNA, 19 nt, Homo sapiens
agaaggcccucuacaauga

SEQ ID NO: 542512 - RNA, 19 nt, Homo sapiens
agacugagccuguguauga

SEQ ID NO: 542513 - RNA, 19 nt, Homo sapiens
gcaggaauacucauaaaga

SEQ ID NO: 542514 - RNA, 19 nt, Homo sapiens
aaauggagcuuggcacuaa

SEQ ID NO: 542515 - RNA, 19 nt, Homo sapiens
guauugaucucuccaguca

SEQ ID NO: 542516 - RNA, 19 nt, Homo sapiens
gaaaguagaagacaucucu

SEQ ID NO: 542517 - RNA, 19 nt, Homo sapiens
gcagugcucuugggagaaa

SEQ ID NO: 542518 - RNA, 19 nt, Homo sapiens
ggucaagccuucuuagaca

SEQ ID NO: 542519 - RNA, 19 nt, Homo sapiens
ggaguucagaucuuaauaa

SEQ ID NO: 542520 - RNA, 19 nt, Homo sapiens
aaagugaucuccugucuag

SEQ ID NO: 542521 - RNA, 19 nt, Homo sapiens
cagcagaggccucaaguuu

SEQ ID NO: 542522 - RNA, 19 nt, Homo sapiens
ucacagaaguaaacauugu

SEQ ID NO: 542523 - RNA, 19 nt, Homo sapiens
gaacucccaccuuauuaaa

SEQ ID NO: 542524 - RNA, 19 nt, Homo sapiens
gagaaacccuauaaauguc

SEQ ID NO: 542525 - RNA, 19 nt, Homo sapiens
cagcaggcgucauaucaaa

SEQ ID NO: 542526 - RNA, 19 nt, Homo sapiens
ugucaucucucuagcauug

SEQ ID NO: 542527 - RNA, 19 nt, Homo sapiens
gccauauacuuguagcaua

SEQ ID NO: 542528 - RNA, 19 nt, Homo sapiens
gaaaacagcaggcaaagaa

SEQ ID NO: 542529 - RNA, 19 nt, Homo sapiens
ggacaucacuugaguuccu

SEQ ID NO: 542530 - RNA, 19 nt, Homo sapiens
gcagaggccucaaguuucg

SEQ ID NO: 542531 - RNA, 19 nt, Homo sapiens
agagaaacccuauaaaugu

SEQ ID NO: 542532 - RNA, 19 nt, Homo sapiens
ggaagaaugggaguuauug

SEQ ID NO: 542533 - RNA, 19 nt, Homo sapiens
cagcaggaauacucauaaa

SEQ ID NO: 542534 - RNA, 19 nt, Homo sapiens
gggcacgguuugcaaaguu

SEQ ID NO: 542535 - RNA, 19 nt, Homo sapiens
ggucacagaaguaaacauu

SEQ ID NO: 542536 - RNA, 19 nt, Homo sapiens
gaaaagcccuucacauguc

SEQ ID NO: 542537 - RNA, 19 nt, Homo sapiens
gagagaagccuuuuaaaug

SEQ ID NO: 542538 - RNA, 19 nt, Homo sapiens
gaagaaguggccauguauu

SEQ ID NO: 542539 - RNA, 19 nt, Homo sapiens
gagcacgucuugccugagu

SEQ ID NO: 542540 - RNA, 19 nt, Homo sapiens
gggauaaacauacauuuca

SEQ ID NO: 542541 - RNA, 19 nt, Homo sapiens
ggcgguggcuugcguuuga

SEQ ID NO: 542542 - RNA, 19 nt, Homo sapiens
gggcguaucccaagaugaa

SEQ ID NO: 542543 - RNA, 19 nt, Homo sapiens
gaagagccauggguucaag

SEQ ID NO: 542544 - RNA, 19 nt, Homo sapiens
gaaaggaggcagugcucuu

SEQ ID NO: 542545 - RNA, 19 nt, Homo sapiens
agacaucucuaauggaauc

SEQ ID NO: 542546 - RNA, 19 nt, Homo sapiens
cagaugaacuauuaaugca

SEQ ID NO: 542547 - RNA, 19 nt, Homo sapiens
uuacugugaugaaaucuug

SEQ ID NO: 542548 - RNA, 19 nt, Homo sapiens
gcacuuaacaacacaccaa

SEQ ID NO: 542549 - RNA, 19 nt, Homo sapiens
cuauaaaugucaacagugu

SEQ ID NO: 542550 - RNA, 19 nt, Homo sapiens
uugaagaaguggccaugua

SEQ ID NO: 542551 - RNA, 19 nt, Homo sapiens
gagaaaagcccuucacaug

SEQ ID NO: 542552 - RNA, 19 nt, Homo sapiens
aagagaaacccuauaaaug

SEQ ID NO: 542553 - RNA, 19 nt, Homo sapiens
ucagaacucccaccuuauu

SEQ ID NO: 542554 - RNA, 19 nt, Homo sapiens
ccaggaagaaugggaguua

SEQ ID NO: 542555 - RNA, 19 nt, Homo sapiens
gggaaacggguuggaauuu

SEQ ID NO: 542556 - RNA, 19 nt, Homo sapiens
gagcuuggcacuaaaauuu

SEQ ID NO: 542557 - RNA, 19 nt, Homo sapiens
aagaacagcucagcaggaa

SEQ ID NO: 542558 - RNA, 19 nt, Homo sapiens
ggacacauccaauagaaac

SEQ ID NO: 542559 - RNA, 19 nt, Homo sapiens
cagaacucccaccuuauua

SEQ ID NO: 542560 - RNA, 19 nt, Homo sapiens
cucaacagauucuagcuuu

SEQ ID NO: 542561 - RNA, 19 nt, Homo sapiens
gaucgucacaagaaagauu

SEQ ID NO: 542562 - RNA, 19 nt, Homo sapiens
ucagaaggcccucuacaau

SEQ ID NO: 542563 - RNA, 19 nt, Homo sapiens
uuaaugcacugucuuaugc

SEQ ID NO: 542564 - RNA, 19 nt, Homo sapiens
gaaacccuauaaaugucaa

SEQ ID NO: 542565 - RNA, 19 nt, Homo sapiens
gaucuccugucuagagcaa

SEQ ID NO: 542566 - RNA, 19 nt, Homo sapiens
ggugauguuuggaaaguag

SEQ ID NO: 542567 - RNA, 19 nt, Homo sapiens
uaacaacacaccaaggaau

SEQ ID NO: 542568 - RNA, 19 nt, Homo sapiens
caagagagaagccuuuuaa

SEQ ID NO: 542569 - RNA, 19 nt, Homo sapiens
aagaaguggccauguauuu

SEQ ID NO: 542570 - RNA, 19 nt, Homo sapiens
gugaugaaaucuuguuaac

SEQ ID NO: 542571 - RNA, 19 nt, Homo sapiens
ccagaaacuccaccuguga

SEQ ID NO: 542572 - RNA, 19 nt, Homo sapiens
uuacauacacaccaaagaa

SEQ ID NO: 542573 - RNA, 19 nt, Homo sapiens
caacacaccaaggaauaaa

SEQ ID NO: 542574 - RNA, 19 nt, Homo sapiens
cagaaggcccucuacaaug

SEQ ID NO: 542575 - RNA, 19 nt, Homo sapiens
caauuuccauagucucaug

SEQ ID NO: 542576 - RNA, 19 nt, Homo sapiens
cugaagagaaacccuauaa

SEQ ID NO: 542577 - RNA, 19 nt, Homo sapiens
ucccagagcuuguugacau

SEQ ID NO: 542578 - RNA, 19 nt, Homo sapiens
cuauuaaugcacugucuua

SEQ ID NO: 542579 - RNA, 19 nt, Homo sapiens
cacuugaguuccuucuuaa

SEQ ID NO: 542580 - RNA, 19 nt, Homo sapiens
aucccaagaugaagaauuu

SEQ ID NO: 542581 - RNA, 19 nt, Homo sapiens
ccaguguccucauucugaa

SEQ ID NO: 542582 - RNA, 19 nt, Homo sapiens
caggaauacucauaaagag

SEQ ID NO: 542583 - RNA, 19 nt, Homo sapiens
cuaaagugaucuccugucu

SEQ ID NO: 542584 - RNA, 19 nt, Homo sapiens
gugagcagccauauacuug

SEQ ID NO: 542585 - RNA, 19 nt, Homo sapiens
gugauaagagguuuagaug

SEQ ID NO: 542586 - RNA, 19 nt, Homo sapiens
gcucugcagccacucagua

SEQ ID NO: 542587 - RNA, 19 nt, Homo sapiens
ggauaaacauacauuucac

SEQ ID NO: 542588 - RNA, 19 nt, Homo sapiens
ggaaaagcuucagucaaaa

SEQ ID NO: 542589 - RNA, 19 nt, Homo sapiens
guugacauuugaagaagug

SEQ ID NO: 542590 - RNA, 19 nt, Homo sapiens
ugucaacagugugauaaga

SEQ ID NO: 542591 - RNA, 19 nt, Homo sapiens
ugaagaaguggccauguau

SEQ ID NO: 542592 - RNA, 19 nt, Homo sapiens
gcauaccauucucuucaca

SEQ ID NO: 542593 - RNA, 19 nt, Homo sapiens
auugaucucuccagucauu

SEQ ID NO: 542594 - RNA, 19 nt, Homo sapiens
gaaaaugggauaaacauac

SEQ ID NO: 542595 - RNA, 19 nt, Homo sapiens
gaaacuccaccugugaaga

SEQ ID NO: 542596 - RNA, 19 nt, Homo sapiens
accaaagaauucacacuga

SEQ ID NO: 542597 - RNA, 19 nt, Homo sapiens
gcacauggaugaaugagua

SEQ ID NO: 542598 - RNA, 19 nt, Homo sapiens
cauagaagguggccacaua

SEQ ID NO: 542599 - RNA, 19 nt, Homo sapiens
caccaccgcucaucacuua

SEQ ID NO: 542600 - RNA, 19 nt, Homo sapiens
ggaaacgcuucaccgagua

SEQ ID NO: 542601 - RNA, 19 nt, Homo sapiens
ccagcaagguucuucauga

SEQ ID NO: 542602 - RNA, 19 nt, Homo sapiens
ugagaugccuggcuacuug

SEQ ID NO: 542603 - RNA, 19 nt, Homo sapiens
gauggugacugaagaagau

SEQ ID NO: 542604 - RNA, 19 nt, Homo sapiens
aagaagcucucuccuuuga

SEQ ID NO: 542605 - RNA, 19 nt, Homo sapiens
gcagcaaguuggagacaga

SEQ ID NO: 542606 - RNA, 19 nt, Homo sapiens
ggacucaaguguagcaucu

SEQ ID NO: 542607 - RNA, 19 nt, Homo sapiens
ggauuggguuugauuuguu

SEQ ID NO: 542608 - RNA, 19 nt, Homo sapiens
gauuggguuugauuuguuu

SEQ ID NO: 542609 - RNA, 19 nt, Homo sapiens
acaccacagucaauuaauu

SEQ ID NO: 542610 - RNA, 19 nt, Homo sapiens
ccacucuccuccuaaagaa

SEQ ID NO: 542611 - RNA, 19 nt, Homo sapiens
gaguggcccuguacauaga

SEQ ID NO: 542612 - RNA, 19 nt, Homo sapiens
gggaguggcccuguacaua

SEQ ID NO: 542613 - RNA, 19 nt, Homo sapiens
caagaaaacugccuaacug

SEQ ID NO: 542614 - RNA, 19 nt, Homo sapiens
gggagaagccauacguuug

SEQ ID NO: 542615 - RNA, 19 nt, Homo sapiens
cagcauggcuuacauacac

SEQ ID NO: 542616 - RNA, 19 nt, Homo sapiens
gggauuggguuugauuugu

SEQ ID NO: 542617 - RNA, 19 nt, Homo sapiens
ggaggaacagcagaccuua

SEQ ID NO: 542618 - RNA, 19 nt, Homo sapiens
ggaguggcccuguacauag

SEQ ID NO: 542619 - RNA, 19 nt, Homo sapiens
uagcaucucuucgucauca

SEQ ID NO: 542620 - RNA, 19 nt, Homo sapiens
ccggauagcuuaccuuucg

SEQ ID NO: 542621 - RNA, 19 nt, Homo sapiens
agacagaggugggcuugga

SEQ ID NO: 542622 - RNA, 19 nt, Homo sapiens
gguggcacauggaugaaug

SEQ ID NO: 542623 - RNA, 19 nt, Homo sapiens
gugagaagacagcaagaaa

SEQ ID NO: 542624 - RNA, 19 nt, Homo sapiens
uagaggaggccaucaaugu

SEQ ID NO: 542625 - RNA, 19 nt, Homo sapiens
ucagauuugugacccagaa

SEQ ID NO: 542626 - RNA, 19 nt, Homo sapiens
caacggaacgcacauugca

SEQ ID NO: 542627 - RNA, 19 nt, Homo sapiens
uuucggaggugaaggaaga

SEQ ID NO: 542628 - RNA, 19 nt, Homo sapiens
ggugguggcacauggauga

SEQ ID NO: 542629 - RNA, 19 nt, Homo sapiens
gcaguaugccagcaagguu

SEQ ID NO: 542630 - RNA, 19 nt, Homo sapiens
agaaagaagcucucuccuu

SEQ ID NO: 542631 - RNA, 19 nt, Homo sapiens
gaccucagcuguggcucuu

SEQ ID NO: 542632 - RNA, 19 nt, Homo sapiens
gugagaaaccauacaagug

SEQ ID NO: 542633 - RNA, 19 nt, Homo sapiens
ggugagaaaccauacaagu

SEQ ID NO: 542634 - RNA, 19 nt, Homo sapiens
uacccacacuggugagaaa

SEQ ID NO: 542635 - RNA, 19 nt, Homo sapiens
ccagcgccaccaacuauaa

SEQ ID NO: 542636 - RNA, 19 nt, Homo sapiens
gcaccauccuggccguaca

SEQ ID NO: 542637 - RNA, 19 nt, Homo sapiens
cauggaugaaugaguauuu

SEQ ID NO: 542638 - RNA, 19 nt, Homo sapiens
ggagaguccgccacccaaa

SEQ ID NO: 542639 - RNA, 19 nt, Homo sapiens
aagccaacuucaugucuga

SEQ ID NO: 542640 - RNA, 19 nt, Homo sapiens
ccaccgcucaucacuuaaa

SEQ ID NO: 542641 - RNA, 19 nt, Homo sapiens
uggcuccacugccuacauu

SEQ ID NO: 542642 - RNA, 19 nt, Homo sapiens
cagugcagcuggaggaaca

SEQ ID NO: 542643 - RNA, 19 nt, Homo sapiens
ggaggugaaggaagagaga

SEQ ID NO: 542644 - RNA, 19 nt, Homo sapiens
ggagaagccauacguuugc

SEQ ID NO: 542645 - RNA, 19 nt, Homo sapiens
ggaccuggcagcagaggau

SEQ ID NO: 542646 - RNA, 19 nt, Homo sapiens
cagcccgucacaaucauua

SEQ ID NO: 542647 - RNA, 19 nt, Homo sapiens
gcacacauacagucaccau

SEQ ID NO: 542648 - RNA, 19 nt, Homo sapiens
ggaaaagggcagcaaguug

SEQ ID NO: 542649 - RNA, 19 nt, Homo sapiens
caccagcgccaccaacuau

SEQ ID NO: 542650 - RNA, 19 nt, Homo sapiens
caucuaacauccgcaaggu

SEQ ID NO: 542651 - RNA, 19 nt, Homo sapiens
gccacaggcuauggacuga

SEQ ID NO: 542652 - RNA, 19 nt, Homo sapiens
gaccguccauacagaugug

SEQ ID NO: 542653 - RNA, 19 nt, Homo sapiens
gagaagccauacguuugca

SEQ ID NO: 542654 - RNA, 19 nt, Homo sapiens
ccaccaacuauaagaauca

SEQ ID NO: 542655 - RNA, 19 nt, Homo sapiens
gccaccaacuauaagaauc

SEQ ID NO: 542656 - RNA, 19 nt, Homo sapiens
gcagcaaggccuucaagac

SEQ ID NO: 542657 - RNA, 19 nt, Homo sapiens
cugaagagccacguucgua

SEQ ID NO: 542658 - RNA, 19 nt, Homo sapiens
cagcaagguucuucaugac

SEQ ID NO: 542659 - RNA, 19 nt, Homo sapiens
gaaaacugccuaacugaag

SEQ ID NO: 542660 - RNA, 19 nt, Homo sapiens
ccagguggcucugaucacu

SEQ ID NO: 542661 - RNA, 19 nt, Homo sapiens
gaaggaagagagagaugac

SEQ ID NO: 542662 - RNA, 19 nt, Homo sapiens
gcaccugcggcaagaccua

SEQ ID NO: 542663 - RNA, 19 nt, Homo sapiens
cugccuaacugaagggaau

SEQ ID NO: 542664 - RNA, 19 nt, Homo sapiens
ggugagaagacagcaagaa

SEQ ID NO: 542665 - RNA, 19 nt, Homo sapiens
acaccaugcuggaggaagu

SEQ ID NO: 542666 - RNA, 19 nt, Homo sapiens
ugaaggaagagagagauga

SEQ ID NO: 542667 - RNA, 19 nt, Homo sapiens
gcauuccgcuguggcuaca

SEQ ID NO: 542668 - RNA, 19 nt, Homo sapiens
caccacagucaauuaauuc

SEQ ID NO: 542669 - RNA, 19 nt, Homo sapiens
gaagacagcaagaaaacug

SEQ ID NO: 542670 - RNA, 19 nt, Homo sapiens
ggaccaccgcauacauuca

SEQ ID NO: 542671 - RNA, 19 nt, Homo sapiens
acacggugacccuuaguga

SEQ ID NO: 542672 - RNA, 19 nt, Homo sapiens
uggcgauggugacugaaga

SEQ ID NO: 542673 - RNA, 19 nt, Homo sapiens
gcuccuucaccacaucuaa

SEQ ID NO: 542674 - RNA, 19 nt, Homo sapiens
ugguggcccuggagcagua

SEQ ID NO: 542675 - RNA, 19 nt, Homo sapiens
gcacccgccucucaaaauc

SEQ ID NO: 542676 - RNA, 19 nt, Homo sapiens
aggaacagcagaccuuaga

SEQ ID NO: 542677 - RNA, 19 nt, Homo sapiens
ucaaguguagcaucucuuc

SEQ ID NO: 542678 - RNA, 19 nt, Homo sapiens
guccugcccucccagcaau

SEQ ID NO: 542679 - RNA, 19 nt, Homo sapiens
aagauggcagcauggcuua

SEQ ID NO: 542680 - RNA, 19 nt, Homo sapiens
ccacaucuggcacacauac

SEQ ID NO: 542681 - RNA, 19 nt, Homo sapiens
ucaccagcgccaccaacua

SEQ ID NO: 542682 - RNA, 19 nt, Homo sapiens
ucacuuaaaggugcaugaa

SEQ ID NO: 542683 - RNA, 19 nt, Homo sapiens
cgcccacucuccuccuaaa

SEQ ID NO: 542684 - RNA, 19 nt, Homo sapiens
gccaacggaacgcacauug

SEQ ID NO: 542685 - RNA, 19 nt, Homo sapiens
aguacucgagcuuguauaa

SEQ ID NO: 542686 - RNA, 19 nt, Homo sapiens
cauccuggccguacagaca

SEQ ID NO: 542687 - RNA, 19 nt, Homo sapiens
cacaggcuauggacugaag

SEQ ID NO: 542688 - RNA, 19 nt, Homo sapiens
gcaagaaaacugccuaacu

SEQ ID NO: 542689 - RNA, 19 nt, Homo sapiens
gaggaagugccaucugcau

SEQ ID NO: 542690 - RNA, 19 nt, Homo sapiens
gcagcauggcuuacauaca

SEQ ID NO: 542691 - RNA, 19 nt, Homo sapiens
gcgccaccaacuauaagaa

SEQ ID NO: 542692 - RNA, 19 nt, Homo sapiens
gauuugugacccagaagga

SEQ ID NO: 542693 - RNA, 19 nt, Homo sapiens
gcugugacccuggagacaa

SEQ ID NO: 542694 - RNA, 19 nt, Homo sapiens
uguagcaucucuucgucau

SEQ ID NO: 542695 - RNA, 19 nt, Homo sapiens
gggaccaccgcauacauuc

SEQ ID NO: 542696 - RNA, 19 nt, Homo sapiens
cugcacacggugacccuua

SEQ ID NO: 542697 - RNA, 19 nt, Homo sapiens
gaaagcaucugaagacauc

SEQ ID NO: 542698 - RNA, 19 nt, Homo sapiens
aaccagagcucaucccuua

SEQ ID NO: 542699 - RNA, 19 nt, Homo sapiens
gagaagccauauaaaugua

SEQ ID NO: 542700 - RNA, 19 nt, Homo sapiens
gagagaagccuuacaagug

SEQ ID NO: 542701 - RNA, 19 nt, Homo sapiens
gagagaagcccuacgaaug

SEQ ID NO: 542702 - RNA, 19 nt, Homo sapiens
gagagaagcccuacagaug

SEQ ID NO: 542703 - RNA, 19 nt, Homo sapiens
gggagaggcuggagaggaa

SEQ ID NO: 542704 - RNA, 19 nt, Homo sapiens
gggaaauucuucagugaga

SEQ ID NO: 542705 - RNA, 19 nt, Homo sapiens
ggagaagccauauaaaugu

SEQ ID NO: 542706 - RNA, 19 nt, Homo sapiens
gggagaagccauauaaaug

SEQ ID NO: 542707 - RNA, 19 nt, Homo sapiens
gagaguaacuaggaacaug

SEQ ID NO: 542708 - RNA, 19 nt, Homo sapiens
gagaaagccuucagugacu

SEQ ID NO: 542709 - RNA, 19 nt, Homo sapiens
gagaagcccuacagaugug

SEQ ID NO: 542710 - RNA, 19 nt, Homo sapiens
gggagaagcccuacagaug

SEQ ID NO: 542711 - RNA, 19 nt, Homo sapiens
gggagaagcccuacaagug

SEQ ID NO: 542712 - RNA, 19 nt, Homo sapiens
ggagaagcccuacagaugu

SEQ ID NO: 542713 - RNA, 19 nt, Homo sapiens
gcaaaacaccuucaauaaa

SEQ ID NO: 542714 - RNA, 19 nt, Homo sapiens
gugcaaaccucacaaacca

SEQ ID NO: 542715 - RNA, 19 nt, Homo sapiens
ccagugaccuugagaagag

SEQ ID NO: 542716 - RNA, 19 nt, Homo sapiens
gugcaaaccucacgaacca

SEQ ID NO: 542717 - RNA, 19 nt, Homo sapiens
gggagaaacccuacaagug

SEQ ID NO: 542718 - RNA, 19 nt, Homo sapiens
gagaagcccuacagaugca

SEQ ID NO: 542719 - RNA, 19 nt, Homo sapiens
ggagagaagccuuacaagu

SEQ ID NO: 542720 - RNA, 19 nt, Homo sapiens
caaaacaccuucaauaaac

SEQ ID NO: 542721 - RNA, 19 nt, Homo sapiens
ccauaugcauguaaugaau

SEQ ID NO: 542722 - RNA, 19 nt, Homo sapiens
cuacuaggacuuccaguuu

SEQ ID NO: 542723 - RNA, 19 nt, Homo sapiens
gaacucggaaauccugaaa

SEQ ID NO: 542724 - RNA, 19 nt, Homo sapiens
ggagagaagcccuacgaau

SEQ ID NO: 542725 - RNA, 19 nt, Homo sapiens
cagcaucagagaauucaua

SEQ ID NO: 542726 - RNA, 19 nt, Homo sapiens
ggagagaagcccuacagau

SEQ ID NO: 542727 - RNA, 19 nt, Homo sapiens
ggagagaagcccuaugagu

SEQ ID NO: 542728 - RNA, 19 nt, Homo sapiens
gguagauuguugccaguug

SEQ ID NO: 542729 - RNA, 19 nt, Homo sapiens
gagcucaucucucauucag

SEQ ID NO: 542730 - RNA, 19 nt, Homo sapiens
gagcaagcccuuucugaag

SEQ ID NO: 542731 - RNA, 19 nt, Homo sapiens
gcccagagccacaugcaaa

SEQ ID NO: 542732 - RNA, 19 nt, Homo sapiens
ucugaagacaucuaacuua

SEQ ID NO: 542733 - RNA, 19 nt, Homo sapiens
gugggaaauucuucaguga

SEQ ID NO: 542734 - RNA, 19 nt, Homo sapiens
gagccacacuggagagaag

SEQ ID NO: 542735 - RNA, 19 nt, Homo sapiens
gcagugugacgguagcuuu

SEQ ID NO: 542736 - RNA, 19 nt, Homo sapiens
ggcaaagccuucaguuacu

SEQ ID NO: 542737 - RNA, 19 nt, Homo sapiens
guaaugaaugugggaaauu

SEQ ID NO: 542738 - RNA, 19 nt, Homo sapiens
gugagaaagccuucaguga

SEQ ID NO: 542739 - RNA, 19 nt, Homo sapiens
gcaaaaccauaugcaugua

SEQ ID NO: 542740 - RNA, 19 nt, Homo sapiens
caagacccauguguagaga

SEQ ID NO: 542741 - RNA, 19 nt, Homo sapiens
gaggaucugagaaaugcua

SEQ ID NO: 542742 - RNA, 19 nt, Homo sapiens
cuaggaacaugguagaagu

SEQ ID NO: 542743 - RNA, 19 nt, Homo sapiens
gugaggaucugagaaaugc

SEQ ID NO: 542744 - RNA, 19 nt, Homo sapiens
guggcaaagccuucaguua

SEQ ID NO: 542745 - RNA, 19 nt, Homo sapiens
aaacagccacuauuucaca

SEQ ID NO: 542746 - RNA, 19 nt, Homo sapiens
auaaacagccacuauuuca

SEQ ID NO: 542747 - RNA, 19 nt, Homo sapiens
uaacuaggaacaugguaga

SEQ ID NO: 542748 - RNA, 19 nt, Homo sapiens
ugagugugguaaagcguuu

SEQ ID NO: 542749 - RNA, 19 nt, Homo sapiens
gagaagcccuacgaaugca

SEQ ID NO: 542750 - RNA, 19 nt, Homo sapiens
gcgugaaacccuacgaaug

SEQ ID NO: 542751 - RNA, 19 nt, Homo sapiens
gauucacacuggagagaag

SEQ ID NO: 542752 - RNA, 19 nt, Homo sapiens
gaaaugcuaaaggcuugaa

SEQ ID NO: 542753 - RNA, 19 nt, Homo sapiens
gcucugccuucguuagaca

SEQ ID NO: 542754 - RNA, 19 nt, Homo sapiens
ugcuguagauagacccuua

SEQ ID NO: 542755 - RNA, 19 nt, Homo sapiens
acacuggagagaagccuua

SEQ ID NO: 542756 - RNA, 19 nt, Homo sapiens
uggcaaagccuucaguuac

SEQ ID NO: 542757 - RNA, 19 nt, Homo sapiens
agacccauguguagagaug

SEQ ID NO: 542758 - RNA, 19 nt, Homo sapiens
ggaaaacacaggagaggaa

SEQ ID NO: 542759 - RNA, 19 nt, Homo sapiens
gaauucauaccggagagaa

SEQ ID NO: 542760 - RNA, 19 nt, Homo sapiens
acaccgagagcuucaagaa

SEQ ID NO: 542761 - RNA, 19 nt, Homo sapiens
ggugaggaucugagaaaug

SEQ ID NO: 542762 - RNA, 19 nt, Homo sapiens
ugacugcucagcucuuguu

SEQ ID NO: 542763 - RNA, 19 nt, Homo sapiens
gaacccacaccggagagaa

SEQ ID NO: 542764 - RNA, 19 nt, Homo sapiens
ggaccagugaccuugagaa

SEQ ID NO: 542765 - RNA, 19 nt, Homo sapiens
gaucugagaaaugcuaaag

SEQ ID NO: 542766 - RNA, 19 nt, Homo sapiens
uguaaugaaugugggaaau

SEQ ID NO: 542767 - RNA, 19 nt, Homo sapiens
uuacuguucuucccuuucu

SEQ ID NO: 542768 - RNA, 19 nt, Homo sapiens
gcaagcccuuucugaagcu

SEQ ID NO: 542769 - RNA, 19 nt, Homo sapiens
agagcaagcccuuucugaa

SEQ ID NO: 542770 - RNA, 19 nt, Homo sapiens
gcccucauucggcaucaua

SEQ ID NO: 542771 - RNA, 19 nt, Homo sapiens
cuggagagaagcccuauga

SEQ ID NO: 542772 - RNA, 19 nt, Homo sapiens
gguugccgguagauuguug

SEQ ID NO: 542773 - RNA, 19 nt, Homo sapiens
cuacagaugcagcgagugu

SEQ ID NO: 542774 - RNA, 19 nt, Homo sapiens
ucacagagcaaaaccauau

SEQ ID NO: 542775 - RNA, 19 nt, Homo sapiens
cgugaaacccuacgaaugc

SEQ ID NO: 542776 - RNA, 19 nt, Homo sapiens
uguaaugagugugguaaag

SEQ ID NO: 542777 - RNA, 19 nt, Homo sapiens
ccuuacaagugcagugaau

SEQ ID NO: 542778 - RNA, 19 nt, Homo sapiens
aaacacaggagaggaagga

SEQ ID NO: 542779 - RNA, 19 nt, Homo sapiens
gggugaggaucugagaaau

SEQ ID NO: 542780 - RNA, 19 nt, Homo sapiens
ccucauucggcaucauaua

SEQ ID NO: 542781 - RNA, 19 nt, Homo sapiens
uuacaagugcagugaaugu

SEQ ID NO: 542782 - RNA, 19 nt, Homo sapiens
ccacauucuucagcagugu

SEQ ID NO: 542783 - RNA, 19 nt, Homo sapiens
gaaauccugaaaccucaca

SEQ ID NO: 542784 - RNA, 19 nt, Homo sapiens
accgagagcuucaagaacu

SEQ ID NO: 542785 - RNA, 19 nt, Homo sapiens
ccaagacccauguguagag

SEQ ID NO: 542786 - RNA, 19 nt, Homo sapiens
uacuaggacuuccaguuuc

SEQ ID NO: 542787 - RNA, 19 nt, Homo sapiens
cacaggagaggaaggaaug

SEQ ID NO: 542788 - RNA, 19 nt, Homo sapiens
ccagagcucaucccuuagu

SEQ ID NO: 542789 - RNA, 19 nt, Homo sapiens
ccaaagaguggcugugacu

SEQ ID NO: 542790 - RNA, 19 nt, Homo sapiens
gaaaguccaggagccuugu

SEQ ID NO: 542791 - RNA, 19 nt, Homo sapiens
uuagucagcaucagagaau

SEQ ID NO: 542792 - RNA, 19 nt, Homo sapiens
ccuuaugaguguaaugagu

SEQ ID NO: 542793 - RNA, 19 nt, Homo sapiens
gaccagugaccuugagaag

SEQ ID NO: 542794 - RNA, 19 nt, Homo sapiens
gccggagaguaacuaggaa

SEQ ID NO: 542795 - RNA, 19 nt, Homo sapiens
cauucggcaucauauaauc

SEQ ID NO: 542796 - RNA, 19 nt, Homo sapiens
cucauucggcaucauauaa

SEQ ID NO: 542797 - RNA, 19 nt, Homo sapiens
aaacacagcuuaucuaauc

SEQ ID NO: 542798 - RNA, 19 nt, Homo sapiens
ggaaagaccuucagcuauc

SEQ ID NO: 542799 - RNA, 19 nt, Homo sapiens
caauaaaucuugcuacuuc

SEQ ID NO: 542800 - RNA, 19 nt, Homo sapiens
gagauaaacucuaugagau

SEQ ID NO: 542801 - RNA, 19 nt, Homo sapiens
uaagguaucucuguaugua

SEQ ID NO: 542802 - RNA, 19 nt, Homo sapiens
ggaggaagaugagcccuaa

SEQ ID NO: 542803 - RNA, 19 nt, Homo sapiens
cagcuuaucuaaucuaaug

SEQ ID NO: 542804 - RNA, 19 nt, Homo sapiens
ggaagaaacuccgaacaca

SEQ ID NO: 542805 - RNA, 19 nt, Homo sapiens
gaaagaaaugccuaucaaa

SEQ ID NO: 542806 - RNA, 19 nt, Homo sapiens
ugaaagaaaugccuaucaa

SEQ ID NO: 542807 - RNA, 19 nt, Homo sapiens
gcaaacgucugcagcuuca

SEQ ID NO: 542808 - RNA, 19 nt, Homo sapiens
ggucugcacucacagguuu

SEQ ID NO: 542809 - RNA, 19 nt, Homo sapiens
gaaagggacgagagaauga

SEQ ID NO: 542810 - RNA, 19 nt, Homo sapiens
gagaagcacucugaauuca

SEQ ID NO: 542811 - RNA, 19 nt, Homo sapiens
acaauaagguaucucugua

SEQ ID NO: 542812 - RNA, 19 nt, Homo sapiens
gcagagaugugcgugcaaa

SEQ ID NO: 542813 - RNA, 19 nt, Homo sapiens
ggaccaggguuauaugcaa

SEQ ID NO: 542814 - RNA, 19 nt, Homo sapiens
gaaagaccuucagcuauca

SEQ ID NO: 542815 - RNA, 19 nt, Homo sapiens
ggacacaguuggaaaugca

SEQ ID NO: 542816 - RNA, 19 nt, Homo sapiens
cuaagccacuucaggauuu

SEQ ID NO: 542817 - RNA, 19 nt, Homo sapiens
guagguacacugucuauga

SEQ ID NO: 542818 - RNA, 19 nt, Homo sapiens
guaaguagguacacugucu

SEQ ID NO: 542819 - RNA, 19 nt, Homo sapiens
acaccucucuccauaguuu

SEQ ID NO: 542820 - RNA, 19 nt, Homo sapiens
ggagaccuguugguuauug

SEQ ID NO: 542821 - RNA, 19 nt, Homo sapiens
gagggagaccuguugguua

SEQ ID NO: 542822 - RNA, 19 nt, Homo sapiens
guacacugucuaugaaaua

SEQ ID NO: 542823 - RNA, 19 nt, Homo sapiens
gaacguugagacaaucuaa

SEQ ID NO: 542824 - RNA, 19 nt, Homo sapiens
cagaagggcacuugaguuu

SEQ ID NO: 542825 - RNA, 19 nt, Homo sapiens
uguggaagcuuuguucuuu

SEQ ID NO: 542826 - RNA, 19 nt, Homo sapiens
ggagaagcacucugaauuc

SEQ ID NO: 542827 - RNA, 19 nt, Homo sapiens
agaauuccuuccagagaua

SEQ ID NO: 542828 - RNA, 19 nt, Homo sapiens
gggaagaccuacaaaugca

SEQ ID NO: 542829 - RNA, 19 nt, Homo sapiens
cuagaauccucaagaaaug

SEQ ID NO: 542830 - RNA, 19 nt, Homo sapiens
guagauccuuugacauguu

SEQ ID NO: 542831 - RNA, 19 nt, Homo sapiens
aaacaagagcuaagacaaa

SEQ ID NO: 542832 - RNA, 19 nt, Homo sapiens
gaaguuaaacaagagcuaa

SEQ ID NO: 542833 - RNA, 19 nt, Homo sapiens
gaagggaacuguaaaagag

SEQ ID NO: 542834 - RNA, 19 nt, Homo sapiens
gaacacauccgaacaucag

SEQ ID NO: 542835 - RNA, 19 nt, Homo sapiens
ggugaagccuuaugaaugc

SEQ ID NO: 542836 - RNA, 19 nt, Homo sapiens
uagauccuuugacauguua

SEQ ID NO: 542837 - RNA, 19 nt, Homo sapiens
caaagaaugugggaaaggu

SEQ ID NO: 542838 - RNA, 19 nt, Homo sapiens
cgacuucguucgacacaug

SEQ ID NO: 542839 - RNA, 19 nt, Homo sapiens
gaagggcacuugaguuucc

SEQ ID NO: 542840 - RNA, 19 nt, Homo sapiens
aagagcaugucacuaguuu

SEQ ID NO: 542841 - RNA, 19 nt, Homo sapiens
gagagaagcccugcaagug

SEQ ID NO: 542842 - RNA, 19 nt, Homo sapiens
ccacaccucucuccauagu

SEQ ID NO: 542843 - RNA, 19 nt, Homo sapiens
gagucacacuggagagaaa

SEQ ID NO: 542844 - RNA, 19 nt, Homo sapiens
gagaugugcgugcaaagaa

SEQ ID NO: 542845 - RNA, 19 nt, Homo sapiens
ggagagaagcccuaugagu

SEQ ID NO: 542846 - RNA, 19 nt, Homo sapiens
gaaacaauaagguaucucu

SEQ ID NO: 542847 - RNA, 19 nt, Homo sapiens
uagguacacugucuaugaa

SEQ ID NO: 542848 - RNA, 19 nt, Homo sapiens
guaagaagggaacuguaaa

SEQ ID NO: 542849 - RNA, 19 nt, Homo sapiens
gcagaagggcacuugaguu

SEQ ID NO: 542850 - RNA, 19 nt, Homo sapiens
gaacaucagaaggaacaaa

SEQ ID NO: 542851 - RNA, 19 nt, Homo sapiens
ccacgaaggucugcagcuu

SEQ ID NO: 542852 - RNA, 19 nt, Homo sapiens
gaaauaucuuccucagcau

SEQ ID NO: 542853 - RNA, 19 nt, Homo sapiens
gaagaaacuccgaacacau

SEQ ID NO: 542854 - RNA, 19 nt, Homo sapiens
gaugugcgugcaaagaaua

SEQ ID NO: 542855 - RNA, 19 nt, Homo sapiens
ggugagccuugauuauuuc

SEQ ID NO: 542856 - RNA, 19 nt, Homo sapiens
ggagagaagcccugcaagu

SEQ ID NO: 542857 - RNA, 19 nt, Homo sapiens
uacuacaacucuuccuuaa

SEQ ID NO: 542858 - RNA, 19 nt, Homo sapiens
uuacuacaacucuuccuua

SEQ ID NO: 542859 - RNA, 19 nt, Homo sapiens
guggaaagaccuucagcua

SEQ ID NO: 542860 - RNA, 19 nt, Homo sapiens
gggugaagccuuaugaaug

SEQ ID NO: 542861 - RNA, 19 nt, Homo sapiens
gaccaagaacccaccaauu

SEQ ID NO: 542862 - RNA, 19 nt, Homo sapiens
gguacacugucuaugaaau

SEQ ID NO: 542863 - RNA, 19 nt, Homo sapiens
gugcaaagaaugugggaaa

SEQ ID NO: 542864 - RNA, 19 nt, Homo sapiens
gaaugugggagcguguuua

SEQ ID NO: 542865 - RNA, 19 nt, Homo sapiens
gggagaagcccuguaagug

SEQ ID NO: 542866 - RNA, 19 nt, Homo sapiens
aauaagguaucucuguaug

SEQ ID NO: 542867 - RNA, 19 nt, Homo sapiens
aggugagccuugauuauuu

SEQ ID NO: 542868 - RNA, 19 nt, Homo sapiens
caggugagccuugauuauu

SEQ ID NO: 542869 - RNA, 19 nt, Homo sapiens
ggagggagaccuguugguu

SEQ ID NO: 542870 - RNA, 19 nt, Homo sapiens
gaccaggguuauaugcaau

SEQ ID NO: 542871 - RNA, 19 nt, Homo sapiens
acauguagauccuuugaca

SEQ ID NO: 542872 - RNA, 19 nt, Homo sapiens
caagagcuaagacaaacaa

SEQ ID NO: 542873 - RNA, 19 nt, Homo sapiens
uaaacaagagcuaagacaa

SEQ ID NO: 542874 - RNA, 19 nt, Homo sapiens
acccacaccucucuccaua

SEQ ID NO: 542875 - RNA, 19 nt, Homo sapiens
agggagaccuguugguuau

SEQ ID NO: 542876 - RNA, 19 nt, Homo sapiens
gaacuuaaacugcgaaaag

SEQ ID NO: 542877 - RNA, 19 nt, Homo sapiens
ggauggaccaggguuauau

SEQ ID NO: 542878 - RNA, 19 nt, Homo sapiens
ggaaguaaguagguacacu

SEQ ID NO: 542879 - RNA, 19 nt, Homo sapiens
caaaacaaaacacagcuua

SEQ ID NO: 542880 - RNA, 19 nt, Homo sapiens
agaaauucaugcauagcuu

SEQ ID NO: 542881 - RNA, 19 nt, Homo sapiens
cuacaacucuuccuuaacc

SEQ ID NO: 542882 - RNA, 19 nt, Homo sapiens
ggaaugugggagcguguuu

SEQ ID NO: 542883 - RNA, 19 nt, Homo sapiens
cauccucacuuggcauuga

SEQ ID NO: 542884 - RNA, 19 nt, Homo sapiens
ccaagagcaugucacuagu

SEQ ID NO: 542885 - RNA, 19 nt, Homo sapiens
caauaagguaucucuguau

SEQ ID NO: 542886 - RNA, 19 nt, Homo sapiens
ucuagaauccucaagaaau

SEQ ID NO: 542887 - RNA, 19 nt, Homo sapiens
aaacauguagauccuuuga

SEQ ID NO: 542888 - RNA, 19 nt, Homo sapiens
caaaacacagcuuaucuaa

SEQ ID NO: 542889 - RNA, 19 nt, Homo sapiens
gaggagaagcacucugaau

SEQ ID NO: 542890 - RNA, 19 nt, Homo sapiens
cgacauacaaggagucaca

SEQ ID NO: 542891 - RNA, 19 nt, Homo sapiens
ccuuugacauguuaauuca

SEQ ID NO: 542892 - RNA, 19 nt, Homo sapiens
cacagcuuaucuaaucuaa

SEQ ID NO: 542893 - RNA, 19 nt, Homo sapiens
caagagcaugucacuaguu

SEQ ID NO: 542894 - RNA, 19 nt, Homo sapiens
gaacccgccagaaggaaga

SEQ ID NO: 542895 - RNA, 19 nt, Homo sapiens
acacuggggugaagccuua

SEQ ID NO: 542896 - RNA, 19 nt, Homo sapiens
guugagacaaucuaaaugu

SEQ ID NO: 542897 - RNA, 19 nt, Homo sapiens
gaaaguagaugguaacaug

SEQ ID NO: 542898 - RNA, 19 nt, Homo sapiens
ggaaugaaguucuaugaaa

SEQ ID NO: 542899 - RNA, 19 nt, Homo sapiens
ucagagaacucauacagua

SEQ ID NO: 542900 - RNA, 19 nt, Homo sapiens
gguaggagauggagaaauu

SEQ ID NO: 542901 - RNA, 19 nt, Homo sapiens
gaaaccaagucucauuaaa

SEQ ID NO: 542902 - RNA, 19 nt, Homo sapiens
ugacuuagauggauugauu

SEQ ID NO: 542903 - RNA, 19 nt, Homo sapiens
gaaagccgaucauaauuca

SEQ ID NO: 542904 - RNA, 19 nt, Homo sapiens
gaagucacaucucauauca

SEQ ID NO: 542905 - RNA, 19 nt, Homo sapiens
gaagucacaucucauauca

SEQ ID NO: 542906 - RNA, 19 nt, Homo sapiens
caucagagcagacauauaa

SEQ ID NO: 542907 - RNA, 19 nt, Homo sapiens
ugacagauguucacuuuga

SEQ ID NO: 542908 - RNA, 19 nt, Homo sapiens
gcacaaaggccgacgguuu

SEQ ID NO: 542909 - RNA, 19 nt, Homo sapiens
agacaagccuuauagagua

SEQ ID NO: 542910 - RNA, 19 nt, Homo sapiens
ggaauacaguuaauaguag

SEQ ID NO: 542911 - RNA, 19 nt, Homo sapiens
gggagaaacucuaugaaug

SEQ ID NO: 542912 - RNA, 19 nt, Homo sapiens
uaaaugaggugguguaugg

SEQ ID NO: 542913 - RNA, 19 nt, Homo sapiens
caaauaagccugcucaugu

SEQ ID NO: 542914 - RNA, 19 nt, Homo sapiens
uggagaaccuaacaauuua

SEQ ID NO: 542915 - RNA, 19 nt, Homo sapiens
gaagucaagucucaucaau

SEQ ID NO: 542916 - RNA, 19 nt, Homo sapiens
ggucgagucucauuaauca

SEQ ID NO: 542917 - RNA, 19 nt, Homo sapiens
gaugagaacucuaaaugag

SEQ ID NO: 542918 - RNA, 19 nt, Homo sapiens
guugacagauguucacuuu

SEQ ID NO: 542919 - RNA, 19 nt, Homo sapiens
gaaugaaguucuaugaaag

SEQ ID NO: 542920 - RNA, 19 nt, Homo sapiens
ucaagucucuuaagcuauu

SEQ ID NO: 542921 - RNA, 19 nt, Homo sapiens
gggagggccuuuagugaaa

SEQ ID NO: 542922 - RNA, 19 nt, Homo sapiens
agagaaaccuuaugagugu

SEQ ID NO: 542923 - RNA, 19 nt, Homo sapiens
gaagagacgcacaguagaa

SEQ ID NO: 542924 - RNA, 19 nt, Homo sapiens
gagagaaacccuaugaaug

SEQ ID NO: 542925 - RNA, 19 nt, Homo sapiens
gagagaaacccuaugaaug

SEQ ID NO: 542926 - RNA, 19 nt, Homo sapiens
ucagaugacuuuaaugugu

SEQ ID NO: 542927 - RNA, 19 nt, Homo sapiens
gaaauuccaaguucagauu

SEQ ID NO: 542928 - RNA, 19 nt, Homo sapiens
gcucaucaaucaucagaga

SEQ ID NO: 542929 - RNA, 19 nt, Homo sapiens
ccagaagucucaguuuauu

SEQ ID NO: 542930 - RNA, 19 nt, Homo sapiens
ggagaaacccuaugaaugc

SEQ ID NO: 542931 - RNA, 19 nt, Homo sapiens
gacaguucauuguacauaa

SEQ ID NO: 542932 - RNA, 19 nt, Homo sapiens
gcaaagaagaauccuguga

SEQ ID NO: 542933 - RNA, 19 nt, Homo sapiens
gaagucacaucucauaucg

SEQ ID NO: 542934 - RNA, 19 nt, Homo sapiens
agucacagcucaucaauca

SEQ ID NO: 542935 - RNA, 19 nt, Homo sapiens
agucacagcugguuaauca

SEQ ID NO: 542936 - RNA, 19 nt, Homo sapiens
ggagagaaacccuaugaau

SEQ ID NO: 542937 - RNA, 19 nt, Homo sapiens
ggagagaaacccuaugaau

SEQ ID NO: 542938 - RNA, 19 nt, Homo sapiens
agucagagcuuauuagaca

SEQ ID NO: 542939 - RNA, 19 nt, Homo sapiens
gaaggugacuuagauggau

SEQ ID NO: 542940 - RNA, 19 nt, Homo sapiens
ggaaagccgaucauaauuc

SEQ ID NO: 542941 - RNA, 19 nt, Homo sapiens
gaacauucacagcaaagaa

SEQ ID NO: 542942 - RNA, 19 nt, Homo sapiens
ucucggaagucacaccuua

SEQ ID NO: 542943 - RNA, 19 nt, Homo sapiens
ccagaagucacaucucaua

SEQ ID NO: 542944 - RNA, 19 nt, Homo sapiens
gaagucagagcuuauuaga

SEQ ID NO: 542945 - RNA, 19 nt, Homo sapiens
ggauacugauaccugguua

SEQ ID NO: 542946 - RNA, 19 nt, Homo sapiens
guagaacauucacagcaaa

SEQ ID NO: 542947 - RNA, 19 nt, Homo sapiens
gauccugguccuacaaaua

SEQ ID NO: 542948 - RNA, 19 nt, Homo sapiens
aaacagugaaggugacuua

SEQ ID NO: 542949 - RNA, 19 nt, Homo sapiens
gaagucaagucucuuaagc

SEQ ID NO: 542950 - RNA, 19 nt, Homo sapiens
agaccucacuccacaguuu

SEQ ID NO: 542951 - RNA, 19 nt, Homo sapiens
acacaucacagaacucaua

SEQ ID NO: 542952 - RNA, 19 nt, Homo sapiens
ccagaagucaagucucuua

SEQ ID NO: 542953 - RNA, 19 nt, Homo sapiens
aaagaagaauccugugaau

SEQ ID NO: 542954 - RNA, 19 nt, Homo sapiens
ccacaucaaaggacacaua

SEQ ID NO: 542955 - RNA, 19 nt, Homo sapiens
aaucacagcucguuagaca

SEQ ID NO: 542956 - RNA, 19 nt, Homo sapiens
gagaagucagagcuuauua

SEQ ID NO: 542957 - RNA, 19 nt, Homo sapiens
caaagaagaauccugugaa

SEQ ID NO: 542958 - RNA, 19 nt, Homo sapiens
agucaagucucaucaauca

SEQ ID NO: 542959 - RNA, 19 nt, Homo sapiens
gggagaaacccuaugaaug

SEQ ID NO: 542960 - RNA, 19 nt, Homo sapiens
ucagaagucacaucucaua

SEQ ID NO: 542961 - RNA, 19 nt, Homo sapiens
gaaaucacagcucguuaga

SEQ ID NO: 542962 - RNA, 19 nt, Homo sapiens
ggagagaaaccuuaugagu

SEQ ID NO: 542963 - RNA, 19 nt, Homo sapiens
uaagaaaccaagucucauu

SEQ ID NO: 542964 - RNA, 19 nt, Homo sapiens
gaaguucuaugaaaguacu

SEQ ID NO: 542965 - RNA, 19 nt, Homo sapiens
agucaagucucuuaagcua

SEQ ID NO: 542966 - RNA, 19 nt, Homo sapiens
agaagaauccugugaaugu

SEQ ID NO: 542967 - RNA, 19 nt, Homo sapiens
ggaugagaacucuaaauga

SEQ ID NO: 542968 - RNA, 19 nt, Homo sapiens
caucaaucaucagagaaua

SEQ ID NO: 542969 - RNA, 19 nt, Homo sapiens
ggaaagccuucagcaggaa

SEQ ID NO: 542970 - RNA, 19 nt, Homo sapiens
ggaaagccuucagcaggaa

SEQ ID NO: 542971 - RNA, 19 nt, Homo sapiens
aaacaucagagcagacaua

SEQ ID NO: 542972 - RNA, 19 nt, Homo sapiens
gaagaauccugugaauguc

SEQ ID NO: 542973 - RNA, 19 nt, Homo sapiens
gagaagucggagcuaauua

SEQ ID NO: 542974 - RNA, 19 nt, Homo sapiens
gggaaggccuuuggugaga

SEQ ID NO: 542975 - RNA, 19 nt, Homo sapiens
caucucauaucacaucaga

SEQ ID NO: 542976 - RNA, 19 nt, Homo sapiens
caucucauaucacaucaga

SEQ ID NO: 542977 - RNA, 19 nt, Homo sapiens
uauaagagacauagccuuu

SEQ ID NO: 542978 - RNA, 19 nt, Homo sapiens
ggagagaagccuuaucgau

SEQ ID NO: 542979 - RNA, 19 nt, Homo sapiens
ugaaugcaaugaauguaga

SEQ ID NO: 542980 - RNA, 19 nt, Homo sapiens
cuaaauacccaucagagaa

SEQ ID NO: 542981 - RNA, 19 nt, Homo sapiens
ggaaaucacagcucguuag

SEQ ID NO: 542982 - RNA, 19 nt, Homo sapiens
ggagagaaaccucauggau

SEQ ID NO: 542983 - RNA, 19 nt, Homo sapiens
gaaacccuauggaugcaau

SEQ ID NO: 542984 - RNA, 19 nt, Homo sapiens
ggagagaaacccuauggau

SEQ ID NO: 542985 - RNA, 19 nt, Homo sapiens
ugucagaagucacaucuca

SEQ ID NO: 542986 - RNA, 19 nt, Homo sapiens
gcagaagagacgcacagua

SEQ ID NO: 542987 - RNA, 19 nt, Homo sapiens
gaaaaguccaaucucauua

SEQ ID NO: 542988 - RNA, 19 nt, Homo sapiens
ucccagaaaucacagcuaa

SEQ ID NO: 542989 - RNA, 19 nt, Homo sapiens
gaaaccucauggaugcauu

SEQ ID NO: 542990 - RNA, 19 nt, Homo sapiens
uaagagacauagccuuugg

SEQ ID NO: 542991 - RNA, 19 nt, Homo sapiens
caaauuggaggaaggagaa

SEQ ID NO: 542992 - RNA, 19 nt, Homo sapiens
acaaggaugugauguugga

SEQ ID NO: 542993 - RNA, 19 nt, Homo sapiens
ucacaucagaggacacaua

SEQ ID NO: 542994 - RNA, 19 nt, Homo sapiens
agacaucagacaauucaua

SEQ ID NO: 542995 - RNA, 19 nt, Homo sapiens
ggaagucacaucucauauc

SEQ ID NO: 542996 - RNA, 19 nt, Homo sapiens
aaccaagucucauuaaaca

SEQ ID NO: 542997 - RNA, 19 nt, Homo sapiens
gguaagagcuuccguguua

SEQ ID NO: 542998 - RNA, 19 nt, Homo sapiens
ggaaagagauuuacucaga

SEQ ID NO: 542999 - RNA, 19 nt, Homo sapiens
gggaagagcuuuguacaua

SEQ ID NO: 543000 - RNA, 19 nt, Homo sapiens
gaagagaucuacucagaau

SEQ ID NO: 543001 - RNA, 19 nt, Homo sapiens
caaauucccugaaguagaa

SEQ ID NO: 543002 - RNA, 19 nt, Homo sapiens
ggaaaaggcuucauuugua

SEQ ID NO: 543003 - RNA, 19 nt, Homo sapiens
gaucagcacuuaauaguca

SEQ ID NO: 543004 - RNA, 19 nt, Homo sapiens
gagagaaaccuuauaauug

SEQ ID NO: 543005 - RNA, 19 nt, Homo sapiens
ggagagaaaccauauaauu

SEQ ID NO: 543006 - RNA, 19 nt, Homo sapiens
ggagagaaaccuuauaauu

SEQ ID NO: 543007 - RNA, 19 nt, Homo sapiens
gcaaauaugggaacaaauu

SEQ ID NO: 543008 - RNA, 19 nt, Homo sapiens
gggaagagaucuacucaga

SEQ ID NO: 543009 - RNA, 19 nt, Homo sapiens
cauaguagaucagcacuua

SEQ ID NO: 543010 - RNA, 19 nt, Homo sapiens
caaacagccuacaauuaua

SEQ ID NO: 543011 - RNA, 19 nt, Homo sapiens
cguguuagaucaagacuua

SEQ ID NO: 543012 - RNA, 19 nt, Homo sapiens
gagagacccuauaauugua

SEQ ID NO: 543013 - RNA, 19 nt, Homo sapiens
gagguuggaucuugaguuu

SEQ ID NO: 543014 - RNA, 19 nt, Homo sapiens
gaucagcacuuaauguuca

SEQ ID NO: 543015 - RNA, 19 nt, Homo sapiens
gaagagcuuuguacauaga

SEQ ID NO: 543016 - RNA, 19 nt, Homo sapiens
gaacaucagagaauccaua

SEQ ID NO: 543017 - RNA, 19 nt, Homo sapiens
gagcgacccuauaauugua

SEQ ID NO: 543018 - RNA, 19 nt, Homo sapiens
gagagaaaccauauaauug

SEQ ID NO: 543019 - RNA, 19 nt, Homo sapiens
cgucagagaucagcacuua

SEQ ID NO: 543020 - RNA, 19 nt, Homo sapiens
caacucaucugacccauca

SEQ ID NO: 543021 - RNA, 19 nt, Homo sapiens
gagaaaagcuauacaaaug

SEQ ID NO: 543022 - RNA, 19 nt, Homo sapiens
ggagagcgacccuauaauu

SEQ ID NO: 543023 - RNA, 19 nt, Homo sapiens
caucagagaucccacaaug

SEQ ID NO: 543024 - RNA, 19 nt, Homo sapiens
ggcaagaacuuucgucaga

SEQ ID NO: 543025 - RNA, 19 nt, Homo sapiens
gcaaagcauucaagaagug

SEQ ID NO: 543026 - RNA, 19 nt, Homo sapiens
gaagagaagccauacaaau

SEQ ID NO: 543027 - RNA, 19 nt, Homo sapiens
gggaaagccuucauucaug

SEQ ID NO: 543028 - RNA, 19 nt, Homo sapiens
gggaacaaauugcaaguga

SEQ ID NO: 543029 - RNA, 19 nt, Homo sapiens
gaggcaagauccaaauuga

SEQ ID NO: 543030 - RNA, 19 nt, Homo sapiens
gcucacaucugcaaacuca

SEQ ID NO: 543031 - RNA, 19 nt, Homo sapiens
gguaaggaauuuaaucaga

SEQ ID NO: 543032 - RNA, 19 nt, Homo sapiens
gaggcaagacuaucuauaa

SEQ ID NO: 543033 - RNA, 19 nt, Homo sapiens
ucaaacagccuacaauuau

SEQ ID NO: 543034 - RNA, 19 nt, Homo sapiens
ggugagagacccuauaauu

SEQ ID NO: 543035 - RNA, 19 nt, Homo sapiens
gaauucacagcuucauuua

SEQ ID NO: 543036 - RNA, 19 nt, Homo sapiens
ucuggaagcuugaacuuaa

SEQ ID NO: 543037 - RNA, 19 nt, Homo sapiens
cagcaaauaugggaacaaa

SEQ ID NO: 543038 - RNA, 19 nt, Homo sapiens
ggaagagcuuuguacauag

SEQ ID NO: 543039 - RNA, 19 nt, Homo sapiens
gaagacaacaagccaaaga

SEQ ID NO: 543040 - RNA, 19 nt, Homo sapiens
gagcuuccguguuagauca

SEQ ID NO: 543041 - RNA, 19 nt, Homo sapiens
guaaacaguccaucaguga

SEQ ID NO: 543042 - RNA, 19 nt, Homo sapiens
caacuucauucccaucaga

SEQ ID NO: 543043 - RNA, 19 nt, Homo sapiens
caagaacuuucgucagaga

SEQ ID NO: 543044 - RNA, 19 nt, Homo sapiens
ucaacgagcuagcgauaga

SEQ ID NO: 543045 - RNA, 19 nt, Homo sapiens
ggguacaacaguaaauuua

SEQ ID NO: 543046 - RNA, 19 nt, Homo sapiens
ccaagauacuuuccacuuc

SEQ ID NO: 543047 - RNA, 19 nt, Homo sapiens
cuacaaauucccugaagua

SEQ ID NO: 543048 - RNA, 19 nt, Homo sapiens
gaguuacccuuuauucugu

SEQ ID NO: 543049 - RNA, 19 nt, Homo sapiens
caucagacaugccauacug

SEQ ID NO: 543050 - RNA, 19 nt, Homo sapiens
gguuggaucuugaguuuca

SEQ ID NO: 543051 - RNA, 19 nt, Homo sapiens
cgagcuagcgauagauuua

SEQ ID NO: 543052 - RNA, 19 nt, Homo sapiens
gcccagcccuucauauuca

SEQ ID NO: 543053 - RNA, 19 nt, Homo sapiens
acagaaaccuuaccguugu

SEQ ID NO: 543054 - RNA, 19 nt, Homo sapiens
gagagcgacccuauaauug

SEQ ID NO: 543055 - RNA, 19 nt, Homo sapiens
ucaaagaggcagugacauu

SEQ ID NO: 543056 - RNA, 19 nt, Homo sapiens
gagaaaagccauauaaaug

SEQ ID NO: 543057 - RNA, 19 nt, Homo sapiens
cgcaggcccuucugaauuu

SEQ ID NO: 543058 - RNA, 19 nt, Homo sapiens
gagaagccauacaaaugug

SEQ ID NO: 543059 - RNA, 19 nt, Homo sapiens
gaacuuucgucagagauca

SEQ ID NO: 543060 - RNA, 19 nt, Homo sapiens
aaauugagauggagacugu

SEQ ID NO: 543061 - RNA, 19 nt, Homo sapiens
ggaguuacccuuuauucug

SEQ ID NO: 543062 - RNA, 19 nt, Homo sapiens
auucaggacucuacaaauu

SEQ ID NO: 543063 - RNA, 19 nt, Homo sapiens
ugaagaguguggaaagaga

SEQ ID NO: 543064 - RNA, 19 nt, Homo sapiens
ugagagacccuauaauugu

SEQ ID NO: 543065 - RNA, 19 nt, Homo sapiens
caggagagaaaccauauaa

SEQ ID NO: 543066 - RNA, 19 nt, Homo sapiens
uaauaggcauuccaugguu

SEQ ID NO: 543067 - RNA, 19 nt, Homo sapiens
caggagagaaaccuuauaa

SEQ ID NO: 543068 - RNA, 19 nt, Homo sapiens
uaagucacgugcaacagaa

SEQ ID NO: 543069 - RNA, 19 nt, Homo sapiens
gagaaaccuuauaauugug

SEQ ID NO: 543070 - RNA, 19 nt, Homo sapiens
caagauacuuuccacuucu

SEQ ID NO: 543071 - RNA, 19 nt, Homo sapiens
gaaaaggcuucauuuguag

SEQ ID NO: 543072 - RNA, 19 nt, Homo sapiens
uaugagaacugugggaaga

SEQ ID NO: 543073 - RNA, 19 nt, Homo sapiens
guaagucuaugugggagaa

SEQ ID NO: 543074 - RNA, 19 nt, Homo sapiens
gugagagacccuauaauug

SEQ ID NO: 543075 - RNA, 19 nt, Homo sapiens
gaaaagccauauaaaugug

SEQ ID NO: 543076 - RNA, 19 nt, Homo sapiens
gaaaagccauugaaaucug

SEQ ID NO: 543077 - RNA, 19 nt, Homo sapiens
gagaagggguacaacagua

SEQ ID NO: 543078 - RNA, 19 nt, Homo sapiens
gaaaagcuauacaaaugug

SEQ ID NO: 543079 - RNA, 19 nt, Homo sapiens
cagcaaagcauucaagaag

SEQ ID NO: 543080 - RNA, 19 nt, Homo sapiens
agaauucacagcuucauuu

SEQ ID NO: 543081 - RNA, 19 nt, Homo sapiens
ggaagggauuuuauacaaa

SEQ ID NO: 543082 - RNA, 19 nt, Homo sapiens
auacaaaugugagcaaugu

SEQ ID NO: 543083 - RNA, 19 nt, Homo sapiens
gagaucagcacuuaauagu

SEQ ID NO: 543084 - RNA, 19 nt, Homo sapiens
gaaaggcuuccauaguaga

SEQ ID NO: 543085 - RNA, 19 nt, Homo sapiens
cagaaaccuuaccguugua

SEQ ID NO: 543086 - RNA, 19 nt, Homo sapiens
ggaggcaagauccaaauug

SEQ ID NO: 543087 - RNA, 19 nt, Homo sapiens
ggaagagaucuacucagaa

SEQ ID NO: 543088 - RNA, 19 nt, Homo sapiens
aaaggagguuggaucuuga

SEQ ID NO: 543089 - RNA, 19 nt, Homo sapiens
gaauguaaacaguccauca

SEQ ID NO: 543090 - RNA, 19 nt, Homo sapiens
ggcaagauccaaauugaga

SEQ ID NO: 543091 - RNA, 19 nt, Homo sapiens
gggaagggauuuuauacaa

SEQ ID NO: 543092 - RNA, 19 nt, Homo sapiens
aagagaagccauacaaaug

SEQ ID NO: 543093 - RNA, 19 nt, Homo sapiens
caaauaugggaacaaauug

SEQ ID NO: 543094 - RNA, 19 nt, Homo sapiens
caccacacccagcuaauuu

SEQ ID NO: 543095 - RNA, 19 nt, Homo sapiens
gagaaaagccauugaaauc

SEQ ID NO: 543096 - RNA, 19 nt, Homo sapiens
ucagagaucccacaaugga

SEQ ID NO: 543097 - RNA, 19 nt, Homo sapiens
gaacauagcagaauucaua

SEQ ID NO: 543098 - RNA, 19 nt, Homo sapiens
caaaggagguuguaaugga

SEQ ID NO: 543099 - RNA, 19 nt, Homo sapiens
guaauggacuuaaccaaug

SEQ ID NO: 543100 - RNA, 19 nt, Homo sapiens
ugacaacaccucagacuua

SEQ ID NO: 543101 - RNA, 19 nt, Homo sapiens
agagaaaccuuacaaaugu

SEQ ID NO: 543102 - RNA, 19 nt, Homo sapiens
agagaaaccuuacaaaugu

SEQ ID NO: 543103 - RNA, 19 nt, Homo sapiens
agagaaaccuuacaaaugu

SEQ ID NO: 543104 - RNA, 19 nt, Homo sapiens
agagaaaccuuacaaaugu

SEQ ID NO: 543105 - RNA, 19 nt, Homo sapiens
aaagaggccuggaguauga

SEQ ID NO: 543106 - RNA, 19 nt, Homo sapiens
gaagagaaaccuuacaaau

SEQ ID NO: 543107 - RNA, 19 nt, Homo sapiens
gagagaaaccuuacaaaug

SEQ ID NO: 543108 - RNA, 19 nt, Homo sapiens
gagagaaaccuuacaaaug

SEQ ID NO: 543109 - RNA, 19 nt, Homo sapiens
cuacaaaugugaagaaugu

SEQ ID NO: 543110 - RNA, 19 nt, Homo sapiens
gagagaaaccuuacaaaug

SEQ ID NO: 543111 - RNA, 19 nt, Homo sapiens
cuacaaaugugaagaaugu

SEQ ID NO: 543112 - RNA, 19 nt, Homo sapiens
uggcaaagcuuuaaucaau

SEQ ID NO: 543113 - RNA, 19 nt, Homo sapiens
gagagaagccuuacaaauc

SEQ ID NO: 543114 - RNA, 19 nt, Homo sapiens
ccucaaaccuuauuaaaca

SEQ ID NO: 543115 - RNA, 19 nt, Homo sapiens
gagagaaacccuacaaaug

SEQ ID NO: 543116 - RNA, 19 nt, Homo sapiens
gagagaaacccuacaaaug

SEQ ID NO: 543117 - RNA, 19 nt, Homo sapiens
gagagaaacccuacaaaug

SEQ ID NO: 543118 - RNA, 19 nt, Homo sapiens
gagagaaacccuacaaaug

SEQ ID NO: 543119 - RNA, 19 nt, Homo sapiens
gcacagcggaauuuauaua

SEQ ID NO: 543120 - RNA, 19 nt, Homo sapiens
caacaccucagacuuauaa

SEQ ID NO: 543121 - RNA, 19 nt, Homo sapiens
ccucaaaccuuacuaaaca

SEQ ID NO: 543122 - RNA, 19 nt, Homo sapiens
aaacagacaugagauaaga

SEQ ID NO: 543123 - RNA, 19 nt, Homo sapiens
guuaauaucugcucacauc

SEQ ID NO: 543124 - RNA, 19 nt, Homo sapiens
cuacuaaccugaaagaugu

SEQ ID NO: 543125 - RNA, 19 nt, Homo sapiens
aaucauuucucacaccuua

SEQ ID NO: 543126 - RNA, 19 nt, Homo sapiens
ccugaaagaugugacaaua

SEQ ID NO: 543127 - RNA, 19 nt, Homo sapiens
gagagaaacccuaugaaug

SEQ ID NO: 543128 - RNA, 19 nt, Homo sapiens
gagaaacccuacaaaugug

SEQ ID NO: 543129 - RNA, 19 nt, Homo sapiens
gagaaacccuacaaaugug

SEQ ID NO: 543130 - RNA, 19 nt, Homo sapiens
gagagaaaccauacaaaug

SEQ ID NO: 543131 - RNA, 19 nt, Homo sapiens
ccucaaaucuuacuagaca

SEQ ID NO: 543132 - RNA, 19 nt, Homo sapiens
ggacuuaaccaaugucuca

SEQ ID NO: 543133 - RNA, 19 nt, Homo sapiens
ggaaagaggccuggaguau

SEQ ID NO: 543134 - RNA, 19 nt, Homo sapiens
aauaucugcucacaucuua

SEQ ID NO: 543135 - RNA, 19 nt, Homo sapiens
ggagagaaaccauacaaau

SEQ ID NO: 543136 - RNA, 19 nt, Homo sapiens
ggagagaaaccuuacaaau

SEQ ID NO: 543137 - RNA, 19 nt, Homo sapiens
ggagagaaaccuuacaaau

SEQ ID NO: 543138 - RNA, 19 nt, Homo sapiens
ggagagaaaccuuacaaau
